United States Patent 7,777,022 (BIOINFORMATICALLY DETECTABLE GROUP OF NOVEL REGULATORY VIRAL AND VIRAL ASSOCIATED OLIGONUCLEOTIDES AND USES THEREOF) - sequence listing, part 71

SEQ ID NO: 3234002 - RNA, 17 nt, Human
aagaaccuaacauuuau

SEQ ID NO: 3234003 - RNA, 14 nt, Human
aagaacuagcauaa

SEQ ID NO: 3234004 - RNA, 15 nt, Human
aagccuuucauuuug

SEQ ID NO: 3234005 - RNA, 10 nt, Human
aagccuuugu

SEQ ID NO: 3234006 - RNA, 17 nt, Human
aagccuuucauuuugcu

SEQ ID NO: 3234007 - RNA, 14 nt, Human
aagccuuuguugaa

SEQ ID NO: 3234008 - RNA, 15 nt, Human
aagcgugagccacug

SEQ ID NO: 3234009 - RNA, 13 nt, Human
aagcguauggcuu

SEQ ID NO: 3234010 - RNA, 15 nt, Human
aagcguauggcuuua

SEQ ID NO: 3234011 - RNA, 14 nt, Human
aagcggcuggcagc

SEQ ID NO: 3234012 - RNA, 14 nt, Human
aagcgggaaacaug

SEQ ID NO: 3234013 - RNA, 22 nt, Human
aagcggcucaagcccaggaggg

SEQ ID NO: 3234014 - RNA, 18 nt, Human
aagccuuuguugaacugu

SEQ ID NO: 3234015 - RNA, 14 nt, Human
aagcgaaaaacuca

SEQ ID NO: 3234016 - RNA, 20 nt, Human
aagccagggcccgggaagca

SEQ ID NO: 3234017 - RNA, 23 nt, Human
aagccagguuccacagaggacac

SEQ ID NO: 3234018 - RNA, 21 nt, Human
aagccagguuccacagaggac

SEQ ID NO: 3234019 - RNA, 21 nt, Human
aagauacacucaagcaugaag

SEQ ID NO: 3234020 - RNA, 22 nt, Human
aagauaaguuggaaacacuaaa

SEQ ID NO: 3234021 - RNA, 20 nt, Human
aagauaaguuggaaacacua

SEQ ID NO: 3234022 - RNA, 19 nt, Human
aagauaaguuggaaacacu

SEQ ID NO: 3234023 - RNA, 15 nt, Human
aagauaaucucagug

SEQ ID NO: 3234024 - RNA, 22 nt, Human
aagauaaucucagugcuuuccu

SEQ ID NO: 3234025 - RNA, 23 nt, Human
aagauaaucucagugcuuuccuc

SEQ ID NO: 3234026 - RNA, 19 nt, Human
aagauaauauuaaggaaga

SEQ ID NO: 3234027 - RNA, 21 nt, Human
aagauaauauuaaggaagaca

SEQ ID NO: 3234028 - RNA, 14 nt, Human
aagauaaaugugcu

SEQ ID NO: 3234029 - RNA, 17 nt, Human
aagauaaguuggaaaca

SEQ ID NO: 3234030 - RNA, 16 nt, Human
aagauaaguuggaaac

SEQ ID NO: 3234031 - RNA, 15 nt, Human
aagauaaguuggaaa

SEQ ID NO: 3234032 - RNA, 13 nt, Human
aagauaaguugga

SEQ ID NO: 3234033 - RNA, 13 nt, Human
aaggcaaggcugu

SEQ ID NO: 3234034 - RNA, 15 nt, Human
aaggcaaggcuguca

SEQ ID NO: 3234035 - RNA, 19 nt, Human
aaggcagggagggccuggg

SEQ ID NO: 3234036 - RNA, 22 nt, Human
aaggcagggagggccugggccc

SEQ ID NO: 3234037 - RNA, 13 nt, Human
aagcugcacccuc

SEQ ID NO: 3234038 - RNA, 19 nt, Human
aagcugcacccucaggcag

SEQ ID NO: 3234039 - RNA, 23 nt, Human
acccucaucaccaacgucugugc

SEQ ID NO: 3234040 - RNA, 23 nt, Human
acccuggcacuauaauguaagcu

SEQ ID NO: 3234041 - RNA, 18 nt, Human
acccuggcacccagggug

SEQ ID NO: 3234042 - RNA, 22 nt, Human
acccuggcaaagcagcaacaca

SEQ ID NO: 3234043 - RNA, 18 nt, Human
acccucagagccaccccu

SEQ ID NO: 3234044 - RNA, 13 nt, Human
acccucaggcagg

SEQ ID NO: 3234045 - RNA, 14 nt, Human
acccucaggcaggu

SEQ ID NO: 3234046 - RNA, 15 nt, Human
acccucaggcaggug

SEQ ID NO: 3234047 - RNA, 16 nt, Human
acccucaggcaggugg

SEQ ID NO: 3234048 - RNA, 13 nt, Human
acccucaucacca

SEQ ID NO: 3234049 - RNA, 21 nt, Human
acccugucucuacuaaaaaua

SEQ ID NO: 3234050 - RNA, 18 nt, Human
acccugucaaacauuagu

SEQ ID NO: 3234051 - RNA, 16 nt, Human
acccugugauggggcc

SEQ ID NO: 3234052 - RNA, 14 nt, Human
acccugguugugug

SEQ ID NO: 3234053 - RNA, 18 nt, Human
acccuguauaucagggua

SEQ ID NO: 3234054 - RNA, 16 nt, Human
acccugucaaacauua

SEQ ID NO: 3234055 - RNA, 15 nt, Human
acccugucaaacauu

SEQ ID NO: 3234056 - RNA, 16 nt, Human
acccuggggagaaagu

SEQ ID NO: 3234057 - RNA, 14 nt, Human
acccuauugcugcu

SEQ ID NO: 3234058 - RNA, 19 nt, Human
acccuauugcugcuugagg

SEQ ID NO: 3234059 - RNA, 11 nt, Human
acccucagagc

SEQ ID NO: 3234060 - RNA, 13 nt, Human
acccuauugcugc

SEQ ID NO: 3234061 - RNA, 15 nt, Human
acccuauaucuauaa

SEQ ID NO: 3234062 - RNA, 19 nt, Human
acccuaccaacuuuacugu

SEQ ID NO: 3234063 - RNA, 23 nt, Human
accgggcugggagcucugcagag

SEQ ID NO: 3234064 - RNA, 18 nt, Human
accgugaggccagagaca

SEQ ID NO: 3234065 - RNA, 19 nt, Human
accggcuggccuggccccu

SEQ ID NO: 3234066 - RNA, 21 nt, Human
accgggcugggagcucugcag

SEQ ID NO: 3234067 - RNA, 11 nt, Human
accucagccuc

SEQ ID NO: 3234068 - RNA, 12 nt, Human
accucagccucc

SEQ ID NO: 3234069 - RNA, 23 nt, Human
accgugaggccagagacacaagc

SEQ ID NO: 3234070 - RNA, 19 nt, Human
accgugccuggccacgccc

SEQ ID NO: 3234071 - RNA, 17 nt, Human
acccugugauggggccc

SEQ ID NO: 3234072 - RNA, 19 nt, Human
acccugugauggggcccug

SEQ ID NO: 3234073 - RNA, 20 nt, Human
acccugugauggggcccugc

SEQ ID NO: 3234074 - RNA, 21 nt, Human
acccugugauggggcccugcc

SEQ ID NO: 3234075 - RNA, 16 nt, Human
accgggcacucagaag

SEQ ID NO: 3234076 - RNA, 20 nt, Human
accgggccacagagaaagua

SEQ ID NO: 3234077 - RNA, 14 nt, Human
accgggcacucaga

SEQ ID NO: 3234078 - RNA, 12 nt, Human
accgggcacuca

SEQ ID NO: 3234079 - RNA, 21 nt, Human
accucaggugauccacccacc

SEQ ID NO: 3234080 - RNA, 20 nt, Human
accucaggugauccacccac

SEQ ID NO: 3234081 - RNA, 11 nt, Human
accucaggccu

SEQ ID NO: 3234082 - RNA, 22 nt, Human
acgcugugcugcccugcccacc

SEQ ID NO: 3234083 - RNA, 19 nt, Human
acgcugugcugcccugccc

SEQ ID NO: 3234084 - RNA, 23 nt, Human
acgcagcccugcuuugggcugcc

SEQ ID NO: 3234085 - RNA, 22 nt, Human
acgcagcccugcuuugggcugc

SEQ ID NO: 3234086 - RNA, 12 nt, Human
acgcagcccugc

SEQ ID NO: 3234087 - RNA, 15 nt, Human
acgcaccagcccaga

SEQ ID NO: 3234088 - RNA, 12 nt, Human
acgucugugcca

SEQ ID NO: 3234089 - RNA, 13 nt, Human
acgucugugccau

SEQ ID NO: 3234090 - RNA, 17 nt, Human
acgugaagauaccauaa

SEQ ID NO: 3234091 - RNA, 15 nt, Human
acggaauaguuggcu

SEQ ID NO: 3234092 - RNA, 19 nt, Human
acggaauaguuggcuagga

SEQ ID NO: 3234093 - RNA, 17 nt, Human
acggacacucaaaagcu

SEQ ID NO: 3234094 - RNA, 18 nt, Human
acuaauggggcggugaga

SEQ ID NO: 3234095 - RNA, 22 nt, Human
acguggagaaucacaggcuggg

SEQ ID NO: 3234096 - RNA, 21 nt, Human
acguggagaaucacaggcugg

SEQ ID NO: 3234097 - RNA, 19 nt, Human
acguggagaaucacaggcu

SEQ ID NO: 3234098 - RNA, 23 nt, Human
accugugagcugcaccagguaga

SEQ ID NO: 3234099 - RNA, 21 nt, Human
accugugagcugcaccaggua

SEQ ID NO: 3234100 - RNA, 23 nt, Human
accugccaggaagccagcaggcu

SEQ ID NO: 3234101 - RNA, 21 nt, Human
accugccaggaagccagcagg

SEQ ID NO: 3234102 - RNA, 22 nt, Human
accugccaggaagccagcaggc

SEQ ID NO: 3234103 - RNA, 12 nt, Human
accugccccuca

SEQ ID NO: 3234104 - RNA, 15 nt, Human
accugccccucaacu

SEQ ID NO: 3234105 - RNA, 12 nt, Human
accucugccuga

SEQ ID NO: 3234106 - RNA, 20 nt, Human
accucugccugaagucacac

SEQ ID NO: 3234107 - RNA, 19 nt, Human
accugccaggaagccagca

SEQ ID NO: 3234108 - RNA, 17 nt, Human
acuguaaaauacuucuu

SEQ ID NO: 3234109 - RNA, 15 nt, Human
acuggugauauaucu

SEQ ID NO: 3234110 - RNA, 13 nt, Human
acuggugauauau

SEQ ID NO: 3234111 - RNA, 12 nt, Human
acuguaaaaugc

SEQ ID NO: 3234112 - RNA, 15 nt, Human
acuguaaaaugcaaa

SEQ ID NO: 3234113 - RNA, 13 nt, Human
acuguaaaaugca

SEQ ID NO: 3234114 - RNA, 24 nt, Human
acuguaaaaugcaaaaaaucuuaa

SEQ ID NO: 3234115 - RNA, 21 nt, Human
acuguaaaaugcaaaaaaucu

SEQ ID NO: 3234116 - RNA, 19 nt, Human
acuguaaaaugcaaaaaau

SEQ ID NO: 3234117 - RNA, 16 nt, Human
acuguaaaaugcaaaa

SEQ ID NO: 3234118 - RNA, 16 nt, Human
acugugccaugugcca

SEQ ID NO: 3234119 - RNA, 18 nt, Human
acugugccaugugccagg

SEQ ID NO: 3234120 - RNA, 17 nt, Human
acugugccaugugccag

SEQ ID NO: 3234121 - RNA, 20 nt, Human
acugcuuuuggucuguguga

SEQ ID NO: 3234122 - RNA, 15 nt, Human
acuggaggagcuggg

SEQ ID NO: 3234123 - RNA, 12 nt, Human
acugguggcccg

SEQ ID NO: 3234124 - RNA, 14 nt, Human
acugccaugccagc

SEQ ID NO: 3234125 - RNA, 19 nt, Human
acugcccaggccugccugu

SEQ ID NO: 3234126 - RNA, 15 nt, Human
acuugaaaagagaca

SEQ ID NO: 3234127 - RNA, 17 nt, Human
acuugaaaagagacagg

SEQ ID NO: 3234128 - RNA, 20 nt, Human
acuugaaaagagacaggcag

SEQ ID NO: 3234129 - RNA, 21 nt, Human
acuugaaaagagacaggcagg

SEQ ID NO: 3234130 - RNA, 17 nt, Human
acuuggggcacagggag

SEQ ID NO: 3234131 - RNA, 11 nt, Human
acuugaaaaga

SEQ ID NO: 3234132 - RNA, 23 nt, Human
acuuggggggcugaggugggagg

SEQ ID NO: 3234133 - RNA, 22 nt, Human
acuugaaaagagacaggcaggu

SEQ ID NO: 3234134 - RNA, 18 nt, Human
acuuggggcacagggaga

SEQ ID NO: 3234135 - RNA, 16 nt, Human
acuugggggcucagca

SEQ ID NO: 3234136 - RNA, 15 nt, Human
acuugggggcucagc

SEQ ID NO: 3234137 - RNA, 22 nt, Human
acuugggggcucagcaaggcca

SEQ ID NO: 3234138 - RNA, 21 nt, Human
acuugggggcucagcaaggcc

SEQ ID NO: 3234139 - RNA, 20 nt, Human
acuugggggcucagcaaggc

SEQ ID NO: 3234140 - RNA, 17 nt, Human
acuugggggcucagcaa

SEQ ID NO: 3234141 - RNA, 18 nt, Human
acuuggucacagccaggc

SEQ ID NO: 3234142 - RNA, 21 nt, Human
acuuggguccaggccuacucc

SEQ ID NO: 3234143 - RNA, 23 nt, Human
acuugggggcucagcaaggccac

SEQ ID NO: 3234144 - RNA, 21 nt, Human
acuucagacauagaauuaaca

SEQ ID NO: 3234145 - RNA, 13 nt, Human
acuucuugaauau

SEQ ID NO: 3234146 - RNA, 21 nt, Human
acuucuugaauauaaaaaauc

SEQ ID NO: 3234147 - RNA, 23 nt, Human
acuucuugaauauaaaaaaucau

SEQ ID NO: 3234148 - RNA, 19 nt, Human
acuuguauauucuauuuua

SEQ ID NO: 3234149 - RNA, 18 nt, Human
acuuguauauucuauuuu

SEQ ID NO: 3234150 - RNA, 22 nt, Human
acuuguauauucuauuuuacaa

SEQ ID NO: 3234151 - RNA, 20 nt, Human
acuuguauauucuauuuuac

SEQ ID NO: 3234152 - RNA, 18 nt, Human
acuuguagauuugauuuu

SEQ ID NO: 3234153 - RNA, 16 nt, Human
acuuguaguuuagugu

SEQ ID NO: 3234154 - RNA, 14 nt, Human
acuuguagauuuga

SEQ ID NO: 3234155 - RNA, 15 nt, Human
acuuguagauuugau

SEQ ID NO: 3234156 - RNA, 16 nt, Human
acuuguagauuugauu

SEQ ID NO: 3234157 - RNA, 17 nt, Human
acuuguagauuugauuu

SEQ ID NO: 3234158 - RNA, 20 nt, Human
acuuggucacagccaggcgc

SEQ ID NO: 3234159 - RNA, 12 nt, Human
acuuguagauuu

SEQ ID NO: 3234160 - RNA, 13 nt, Human
acuuguagauuug

SEQ ID NO: 3234161 - RNA, 15 nt, Human
acuucaaaaguuugu

SEQ ID NO: 3234162 - RNA, 15 nt, Human
acuucaaaauauuga

SEQ ID NO: 3234163 - RNA, 16 nt, Human
acuucaaaauauugag

SEQ ID NO: 3234164 - RNA, 14 nt, Human
acuuaaaacacguu

SEQ ID NO: 3234165 - RNA, 18 nt, Human
acuuaaaacacguuuuaa

SEQ ID NO: 3234166 - RNA, 12 nt, Human
acuucagacaua

SEQ ID NO: 3234167 - RNA, 22 nt, Human
acuuaaaaaugguuuaaauggu

SEQ ID NO: 3234168 - RNA, 16 nt, Human
acuuaaaaauuuauua

SEQ ID NO: 3234169 - RNA, 12 nt, Human
acuuaaaacacg

SEQ ID NO: 3234170 - RNA, 21 nt, Human
acuuaaaaaugguuuaaaugg

SEQ ID NO: 3234171 - RNA, 16 nt, Human
acuguuucaucuaagu

SEQ ID NO: 3234172 - RNA, 17 nt, Human
acugauccagcccugag

SEQ ID NO: 3234173 - RNA, 16 nt, Human
acugauccagcccuga

SEQ ID NO: 3234174 - RNA, 23 nt, Human
acugaugggcaacccccagccug

SEQ ID NO: 3234175 - RNA, 23 nt, Human
acugaucucaggggucuuaccuu

SEQ ID NO: 3234176 - RNA, 15 nt, Human
acugauuucaguaag

SEQ ID NO: 3234177 - RNA, 19 nt, Human
acugauguguugugccuua

SEQ ID NO: 3234178 - RNA, 12 nt, Human
acugaugugaaa

SEQ ID NO: 3234179 - RNA, 13 nt, Human
acugaugugaaac

SEQ ID NO: 3234180 - RNA, 14 nt, Human
acugaugugaaacu

SEQ ID NO: 3234181 - RNA, 18 nt, Human
acugauguuugugcagua

SEQ ID NO: 3234182 - RNA, 16 nt, Human
acugauguuugugcag

SEQ ID NO: 3234183 - RNA, 16 nt, Human
acugauuuuuuuuucc

SEQ ID NO: 3234184 - RNA, 20 nt, Human
acugauuuuguacauaaaca

SEQ ID NO: 3234185 - RNA, 23 nt, Human
acugauuugggcugaauguaugu

SEQ ID NO: 3234186 - RNA, 17 nt, Human
acugauuuuuuuuuccu

SEQ ID NO: 3234187 - RNA, 18 nt, Human
acugauuuuuuuuuccuu

SEQ ID NO: 3234188 - RNA, 19 nt, Human
acugauuuuuuuuuccuuc

SEQ ID NO: 3234189 - RNA, 20 nt, Human
acugauuuuuuuuuccuuca

SEQ ID NO: 3234190 - RNA, 18 nt, Human
acugacauuguuggccaa

SEQ ID NO: 3234191 - RNA, 17 nt, Human
acugacauuguuggcca

SEQ ID NO: 3234192 - RNA, 19 nt, Human
acugaauuuuuauguguga

SEQ ID NO: 3234193 - RNA, 13 nt, Human
acugaauuuggag

SEQ ID NO: 3234194 - RNA, 16 nt, Human
acugaauuuuuaugug

SEQ ID NO: 3234195 - RNA, 15 nt, Human
acugaauuuuuaugu

SEQ ID NO: 3234196 - RNA, 21 nt, Human
acugaauuccaaacaugguuu

SEQ ID NO: 3234197 - RNA, 12 nt, Human
acugaauuccaa

SEQ ID NO: 3234198 - RNA, 20 nt, Human
acugaaugaagcaguauuuu

SEQ ID NO: 3234199 - RNA, 21 nt, Human
acugaaugaagcaguauuuug

SEQ ID NO: 3234200 - RNA, 15 nt, Human
acucuacagaggcca

SEQ ID NO: 3234201 - RNA, 16 nt, Human
acucuacaugcuuguu

SEQ ID NO: 3234202 - RNA, 14 nt, Human
acucccuuucaaca

SEQ ID NO: 3234203 - RNA, 18 nt, Human
acucccugccccccagcc

SEQ ID NO: 3234204 - RNA, 21 nt, Human
acucccaagacccgagcuggg

SEQ ID NO: 3234205 - RNA, 15 nt, Human
acucccaagcuggac

SEQ ID NO: 3234206 - RNA, 12 nt, Human
acuccauucucc

SEQ ID NO: 3234207 - RNA, 20 nt, Human
acucccagcaucgcacucug

SEQ ID NO: 3234208 - RNA, 22 nt, Human
acucccaucugugaaaggaaag

SEQ ID NO: 3234209 - RNA, 15 nt, Human
acucccaucagccca

SEQ ID NO: 3234210 - RNA, 21 nt, Human
aauuauagugucaugcagagu

SEQ ID NO: 3234211 - RNA, 18 nt, Human
aauuauaggagacuugua

SEQ ID NO: 3234212 - RNA, 23 nt, Human
aauuauauuccucuugcauuuca

SEQ ID NO: 3234213 - RNA, 11 nt, Human
aauuauauucc

SEQ ID NO: 3234214 - RNA, 19 nt, Human
aauuauacccccugcaaag

SEQ ID NO: 3234215 - RNA, 16 nt, Human
aauuauacugugugug

SEQ ID NO: 3234216 - RNA, 22 nt, Human
aauuauaauguauucauauuug

SEQ ID NO: 3234217 - RNA, 18 nt, Human
aauuauaauguauucaua

SEQ ID NO: 3234218 - RNA, 16 nt, Human
aauuauaauguauuca

SEQ ID NO: 3234219 - RNA, 14 nt, Human
aauuauaauguauu

SEQ ID NO: 3234220 - RNA, 18 nt, Human
aauuaugguaaaauuuug

SEQ ID NO: 3234221 - RNA, 17 nt, Human
aauuaugguaaaauuuu

SEQ ID NO: 3234222 - RNA, 21 nt, Human
aauuauggcccagggggcuaa

SEQ ID NO: 3234223 - RNA, 22 nt, Human
aauuaugcuaagaauuuuuuau

SEQ ID NO: 3234224 - RNA, 18 nt, Human
aauuaugcuaagaauuuu

SEQ ID NO: 3234225 - RNA, 16 nt, Human
aauuaugcuaagaauu

SEQ ID NO: 3234226 - RNA, 19 nt, Human
aauuaugaguuauuuuuau

SEQ ID NO: 3234227 - RNA, 13 nt, Human
aauuaucagcaaa

SEQ ID NO: 3234228 - RNA, 16 nt, Human
aauuaucagcaaagaa

SEQ ID NO: 3234229 - RNA, 19 nt, Human
aauuaucagcaaagaaaaa

SEQ ID NO: 3234230 - RNA, 20 nt, Human
aauuaucagcaaagaaaaaa

SEQ ID NO: 3234231 - RNA, 21 nt, Human
aauuaucagcaaagaaaaaaa

SEQ ID NO: 3234232 - RNA, 16 nt, Human
aauuguaaggaaugau

SEQ ID NO: 3234233 - RNA, 22 nt, Human
aauuguaaggaaugauuaauua

SEQ ID NO: 3234234 - RNA, 22 nt, Human
aauuggaguuggaguagaaugu

SEQ ID NO: 3234235 - RNA, 14 nt, Human
aauucuguuuuucu

SEQ ID NO: 3234236 - RNA, 18 nt, Human
aauucuguuuuucuaggc

SEQ ID NO: 3234237 - RNA, 11 nt, Human
aauucugauuu

SEQ ID NO: 3234238 - RNA, 13 nt, Human
aauucugauuucu

SEQ ID NO: 3234239 - RNA, 14 nt, Human
aauucugauuucuu

SEQ ID NO: 3234240 - RNA, 15 nt, Human
aauucugauuucuuu

SEQ ID NO: 3234241 - RNA, 16 nt, Human
aauucugauuucuuuu

SEQ ID NO: 3234242 - RNA, 22 nt, Human
aauucugauuucuuuucaccau

SEQ ID NO: 3234243 - RNA, 20 nt, Human
aauucuguuuuuaaaaauua

SEQ ID NO: 3234244 - RNA, 18 nt, Human
aauucuguuuuuaaaaau

SEQ ID NO: 3234245 - RNA, 17 nt, Human
aauucuguuuuuaaaaa

SEQ ID NO: 3234246 - RNA, 20 nt, Human
aauucuguucugauauuaau

SEQ ID NO: 3234247 - RNA, 19 nt, Human
aauucucagaaucucaaau

SEQ ID NO: 3234248 - RNA, 15 nt, Human
aauucuaugccuguc

SEQ ID NO: 3234249 - RNA, 13 nt, Human
aauucuaugccug

SEQ ID NO: 3234250 - RNA, 14 nt, Human
aauucuacuuugag

SEQ ID NO: 3234251 - RNA, 22 nt, Human
aauucuagcuuugagcuuaaga

SEQ ID NO: 3234252 - RNA, 15 nt, Human
aauucucuuauccaa

SEQ ID NO: 3234253 - RNA, 14 nt, Human
aauucugaaguuau

SEQ ID NO: 3234254 - RNA, 23 nt, Human
aauucucuuccaaccauuuaucu

SEQ ID NO: 3234255 - RNA, 21 nt, Human
aauucugaaguuauauuuccu

SEQ ID NO: 3234256 - RNA, 19 nt, Human
aauucugaaguuauauuuc

SEQ ID NO: 3234257 - RNA, 18 nt, Human
aauucugaaguuauauuu

SEQ ID NO: 3234258 - RNA, 15 nt, Human
aauucugaaguuaua

SEQ ID NO: 3234259 - RNA, 21 nt, Human
aauucucauuugucacacacu

SEQ ID NO: 3234260 - RNA, 14 nt, Human
aauucuccugccuc

SEQ ID NO: 3234261 - RNA, 19 nt, Human
aauucucccgggacucugc

SEQ ID NO: 3234262 - RNA, 15 nt, Human
aauucuccugccuca

SEQ ID NO: 3234263 - RNA, 16 nt, Human
aauucuccugccucag

SEQ ID NO: 3234264 - RNA, 11 nt, Human
aauucuccuuu

SEQ ID NO: 3234265 - RNA, 15 nt, Human
aauuucccaaagcag

SEQ ID NO: 3234266 - RNA, 17 nt, Human
aauuucccaaagcagug

SEQ ID NO: 3234267 - RNA, 17 nt, Human
aauuguaauuaauaaua

SEQ ID NO: 3234268 - RNA, 22 nt, Human
aauuucauaccuaucaucuuaa

SEQ ID NO: 3234269 - RNA, 18 nt, Human
aauuucauagcuguacuu

SEQ ID NO: 3234270 - RNA, 20 nt, Human
aauuucauagcuguacuucu

SEQ ID NO: 3234271 - RNA, 21 nt, Human
aauuucauagcuguacuucuu

SEQ ID NO: 3234272 - RNA, 18 nt, Human
aauuuccccuaaucuuuu

SEQ ID NO: 3234273 - RNA, 17 nt, Human
aauuuccccuaaucuuu

SEQ ID NO: 3234274 - RNA, 15 nt, Human
acaccaauauucaua

SEQ ID NO: 3234275 - RNA, 13 nt, Human
acaccagagccca

SEQ ID NO: 3234276 - RNA, 23 nt, Human
acaccagagcccaccuuggcuca

SEQ ID NO: 3234277 - RNA, 18 nt, Human
acaccagagcccaccuug

SEQ ID NO: 3234278 - RNA, 18 nt, Human
acacagcucuucuccagg

SEQ ID NO: 3234279 - RNA, 13 nt, Human
acacagcucuucu

SEQ ID NO: 3234280 - RNA, 14 nt, Human
acaccaaucuuacu

SEQ ID NO: 3234281 - RNA, 14 nt, Human
acacguuuuaagga

SEQ ID NO: 3234282 - RNA, 15 nt, Human
acacguuggaguaua

SEQ ID NO: 3234283 - RNA, 15 nt, Human
acacguuuuaaggac

SEQ ID NO: 3234284 - RNA, 16 nt, Human
acacguuuuaaggacu

SEQ ID NO: 3234285 - RNA, 17 nt, Human
acacguuuuaaggacug

SEQ ID NO: 3234286 - RNA, 22 nt, Human
acacguuuuaaggacugacuga

SEQ ID NO: 3234287 - RNA, 16 nt, Human
acacagcucuucucca

SEQ ID NO: 3234288 - RNA, 14 nt, Human
acacagcucuucuc

SEQ ID NO: 3234289 - RNA, 14 nt, Human
acacagcauuucaa

SEQ ID NO: 3234290 - RNA, 16 nt, Human
acaaggugcaggcagg

SEQ ID NO: 3234291 - RNA, 15 nt, Human
acaaggugcaggcag

SEQ ID NO: 3234292 - RNA, 15 nt, Human
acaaguuaaauaaau

SEQ ID NO: 3234293 - RNA, 15 nt, Human
acaaguuaagauucu

SEQ ID NO: 3234294 - RNA, 19 nt, Human
acaaguuaagauucuuggu

SEQ ID NO: 3234295 - RNA, 16 nt, Human
acaaggcaaggcuguc

SEQ ID NO: 3234296 - RNA, 17 nt, Human
acaaggcaaggcuguca

SEQ ID NO: 3234297 - RNA, 19 nt, Human
acaaggcaaggcugucaau

SEQ ID NO: 3234298 - RNA, 15 nt, Human
acaaggcaaggcugu

SEQ ID NO: 3234299 - RNA, 13 nt, Human
acaacccccagcu

SEQ ID NO: 3234300 - RNA, 14 nt, Human
acaaacaagcauau

SEQ ID NO: 3234301 - RNA, 14 nt, Human
acaaacagaugcuc

SEQ ID NO: 3234302 - RNA, 17 nt, Human
acaacauuuauauguag

SEQ ID NO: 3234303 - RNA, 13 nt, Human
acaaccauuaaag

SEQ ID NO: 3234304 - RNA, 18 nt, Human
acaaccauuaaagucaga

SEQ ID NO: 3234305 - RNA, 21 nt, Human
acaaacugcuuccuuucuuga

SEQ ID NO: 3234306 - RNA, 15 nt, Human
acaaacugcuuccuu

SEQ ID NO: 3234307 - RNA, 23 nt, Human
acaaacugcacaugauuucacaa

SEQ ID NO: 3234308 - RNA, 21 nt, Human
acaaacugcacaugauuucac

SEQ ID NO: 3234309 - RNA, 20 nt, Human
acaaacugcacaugauuuca

SEQ ID NO: 3234310 - RNA, 19 nt, Human
acaaacugcacaugauuuc

SEQ ID NO: 3234311 - RNA, 16 nt, Human
acaaacugcacaugau

SEQ ID NO: 3234312 - RNA, 14 nt, Human
acaaacugcacaug

SEQ ID NO: 3234313 - RNA, 17 nt, Human
acauguguuggcagccu

SEQ ID NO: 3234314 - RNA, 17 nt, Human
acauguuuucaaaugga

SEQ ID NO: 3234315 - RNA, 16 nt, Human
acauguuuucaaaugg

SEQ ID NO: 3234316 - RNA, 11 nt, Human
acauguuuuca

SEQ ID NO: 3234317 - RNA, 15 nt, Human
acauguuuucaaaug

SEQ ID NO: 3234318 - RNA, 14 nt, Human
acauguuuucaaau

SEQ ID NO: 3234319 - RNA, 13 nt, Human
acauguuuucaaa

SEQ ID NO: 3234320 - RNA, 12 nt, Human
acauguuuucaa

SEQ ID NO: 3234321 - RNA, 18 nt, Human
acauaacugacuuaguuc

SEQ ID NO: 3234322 - RNA, 16 nt, Human
acauacaauuccaaac

SEQ ID NO: 3234323 - RNA, 14 nt, Human
acauaauacugaac

SEQ ID NO: 3234324 - RNA, 16 nt, Human
acauaauacugaacca

SEQ ID NO: 3234325 - RNA, 17 nt, Human
acauaauacugaaccac

SEQ ID NO: 3234326 - RNA, 18 nt, Human
acauaauacugaaccacu

SEQ ID NO: 3234327 - RNA, 20 nt, Human
acauacaggaagguagaaau

SEQ ID NO: 3234328 - RNA, 22 nt, Human
acauacacccaaacacuuacac

SEQ ID NO: 3234329 - RNA, 13 nt, Human
acaucauuccuuu

SEQ ID NO: 3234330 - RNA, 16 nt, Human
acaucauuccuuuuua

SEQ ID NO: 3234331 - RNA, 17 nt, Human
acaucauuccuuuuuau

SEQ ID NO: 3234332 - RNA, 21 nt, Human
acaucauuccuuuuuauuuau

SEQ ID NO: 3234333 - RNA, 22 nt, Human
acaucauuccuuuuuauuuaua

SEQ ID NO: 3234334 - RNA, 20 nt, Human
acaugccucucucaggccaa

SEQ ID NO: 3234335 - RNA, 23 nt, Human
acaugcagccacuuaggacaaau

SEQ ID NO: 3234336 - RNA, 13 nt, Human
acaugcacgugug

SEQ ID NO: 3234337 - RNA, 23 nt, Human
acaugcacagcuaacauggaagu

SEQ ID NO: 3234338 - RNA, 16 nt, Human
acaucccucucugcug

SEQ ID NO: 3234339 - RNA, 15 nt, Human
acaucccucucugcu

SEQ ID NO: 3234340 - RNA, 12 nt, Human
acauccccugcu

SEQ ID NO: 3234341 - RNA, 17 nt, Human
accaccagaagcccaga

SEQ ID NO: 3234342 - RNA, 16 nt, Human
accaccagaagcccag

SEQ ID NO: 3234343 - RNA, 15 nt, Human
accaccagaagccca

SEQ ID NO: 3234344 - RNA, 13 nt, Human
accaccagaagcc

SEQ ID NO: 3234345 - RNA, 14 nt, Human
accacccauaucau

SEQ ID NO: 3234346 - RNA, 15 nt, Human
accacccauaucaug

SEQ ID NO: 3234347 - RNA, 17 nt, Human
accacccauaucaugca

SEQ ID NO: 3234348 - RNA, 12 nt, Human
accaagcccagu

SEQ ID NO: 3234349 - RNA, 14 nt, Human
accaagccguggcu

SEQ ID NO: 3234350 - RNA, 18 nt, Human
accaagccguggcuuccc

SEQ ID NO: 3234351 - RNA, 17 nt, Human
accaagccguggcuucc

SEQ ID NO: 3234352 - RNA, 16 nt, Human
accaagccguggcuuc

SEQ ID NO: 3234353 - RNA, 15 nt, Human
accaagccguggcuu

SEQ ID NO: 3234354 - RNA, 16 nt, Human
accacgcuggaccuug

SEQ ID NO: 3234355 - RNA, 14 nt, Human
accacgcuggaccu

SEQ ID NO: 3234356 - RNA, 18 nt, Human
accacgcuggaccuugaa

SEQ ID NO: 3234357 - RNA, 14 nt, Human
accaacgucugugc

SEQ ID NO: 3234358 - RNA, 17 nt, Human
accaacgucugugccau

SEQ ID NO: 3234359 - RNA, 14 nt, Human
accagagcugccac

SEQ ID NO: 3234360 - RNA, 16 nt, Human
accagagcugccaccu

SEQ ID NO: 3234361 - RNA, 13 nt, Human
accagagcugcca

SEQ ID NO: 3234362 - RNA, 12 nt, Human
accagagcugcc

SEQ ID NO: 3234363 - RNA, 23 nt, Human
accacgucuauuucaucagaaca

SEQ ID NO: 3234364 - RNA, 20 nt, Human
accacguugggacagggagg

SEQ ID NO: 3234365 - RNA, 17 nt, Human
acagugcuacugaaagg

SEQ ID NO: 3234366 - RNA, 15 nt, Human
acagugcuacugaaa

SEQ ID NO: 3234367 - RNA, 15 nt, Human
acaguggauugcuca

SEQ ID NO: 3234368 - RNA, 19 nt, Human
acaguggagugcaaaaggc

SEQ ID NO: 3234369 - RNA, 17 nt, Human
acaguggagugcaaaag

SEQ ID NO: 3234370 - RNA, 19 nt, Human
acagugauuaccagggacu

SEQ ID NO: 3234371 - RNA, 13 nt, Human
acagugcaucuca

SEQ ID NO: 3234372 - RNA, 18 nt, Human
acagugcaucucagccca

SEQ ID NO: 3234373 - RNA, 17 nt, Human
acagugcaucucagccc

SEQ ID NO: 3234374 - RNA, 15 nt, Human
acagugcaucucagc

SEQ ID NO: 3234375 - RNA, 23 nt, Human
acaggcacccaccaucaugucug

SEQ ID NO: 3234376 - RNA, 14 nt, Human
acaggcaaugcugg

SEQ ID NO: 3234377 - RNA, 17 nt, Human
acaggcaaugcuggcug

SEQ ID NO: 3234378 - RNA, 14 nt, Human
acaggcacccacca

SEQ ID NO: 3234379 - RNA, 16 nt, Human
acaggcaaugcuggcu

SEQ ID NO: 3234380 - RNA, 15 nt, Human
acaggcaaugcuggc

SEQ ID NO: 3234381 - RNA, 18 nt, Human
acagcucuucuccaggcu

SEQ ID NO: 3234382 - RNA, 20 nt, Human
acagcucuucuccaggcugu

SEQ ID NO: 3234383 - RNA, 19 nt, Human
acagcucuucuccaggcug

SEQ ID NO: 3234384 - RNA, 18 nt, Human
agagcccacgcccccacu

SEQ ID NO: 3234385 - RNA, 11 nt, Human
agagagcaaga

SEQ ID NO: 3234386 - RNA, 19 nt, Human
agagagcaagacgcugugc

SEQ ID NO: 3234387 - RNA, 19 nt, Human
agagagauguguaauuuuu

SEQ ID NO: 3234388 - RNA, 18 nt, Human
agagagauguguaauuuu

SEQ ID NO: 3234389 - RNA, 14 nt, Human
agagagauguguaa

SEQ ID NO: 3234390 - RNA, 17 nt, Human
agagcccacgcccccac

SEQ ID NO: 3234391 - RNA, 18 nt, Human
agagcccagagucccccc

SEQ ID NO: 3234392 - RNA, 15 nt, Human
agagcccagaguccc

SEQ ID NO: 3234393 - RNA, 22 nt, Human
agagcccagaguccccccacuc

SEQ ID NO: 3234394 - RNA, 19 nt, Human
agagccugccccagcgcug

SEQ ID NO: 3234395 - RNA, 17 nt, Human
agagccugccccagcgc

SEQ ID NO: 3234396 - RNA, 16 nt, Human
agagccugccccagcg

SEQ ID NO: 3234397 - RNA, 13 nt, Human
agagccugcccca

SEQ ID NO: 3234398 - RNA, 12 nt, Human
agagccugcccc

SEQ ID NO: 3234399 - RNA, 22 nt, Human
agagaaacacugaaaagaagga

SEQ ID NO: 3234400 - RNA, 18 nt, Human
agagaaaguacuucucca

SEQ ID NO: 3234401 - RNA, 13 nt, Human
agagaaagaaauu

SEQ ID NO: 3234402 - RNA, 22 nt, Human
agagaaguggacuggaggagcu

SEQ ID NO: 3234403 - RNA, 19 nt, Human
agagaagugacgguuccua

SEQ ID NO: 3234404 - RNA, 18 nt, Human
agagaagugacgguuccu

SEQ ID NO: 3234405 - RNA, 12 nt, Human
agagaaaugaaa

SEQ ID NO: 3234406 - RNA, 23 nt, Human
agagaaauauuuuaauuuuuaaa

SEQ ID NO: 3234407 - RNA, 18 nt, Human
agagaaauauuuuaauuu

SEQ ID NO: 3234408 - RNA, 15 nt, Human
agagaaauauuuuaa

SEQ ID NO: 3234409 - RNA, 14 nt, Human
agagaaauauuuua

SEQ ID NO: 3234410 - RNA, 16 nt, Human
agacucuuuggacacu

SEQ ID NO: 3234411 - RNA, 14 nt, Human
agacgaacauguag

SEQ ID NO: 3234412 - RNA, 23 nt, Human
agaccaucccugaaggccccgcc

SEQ ID NO: 3234413 - RNA, 21 nt, Human
agacagcccgggcucugccuc

SEQ ID NO: 3234414 - RNA, 22 nt, Human
agacagcccgggcucugccucc

SEQ ID NO: 3234415 - RNA, 23 nt, Human
agacagcccgggcucugccuccc

SEQ ID NO: 3234416 - RNA, 17 nt, Human
agaccacccauaucaug

SEQ ID NO: 3234417 - RNA, 18 nt, Human
agaccacccauaucaugc

SEQ ID NO: 3234418 - RNA, 19 nt, Human
agaccacccauaucaugca

SEQ ID NO: 3234419 - RNA, 13 nt, Human
agacagcccucca

SEQ ID NO: 3234420 - RNA, 18 nt, Human
agacgcugugcugcccug

SEQ ID NO: 3234421 - RNA, 19 nt, Human
agacgcugugcugcccugc

SEQ ID NO: 3234422 - RNA, 17 nt, Human
agacgcugugcugcccu

SEQ ID NO: 3234423 - RNA, 15 nt, Human
agacgacagccccug

SEQ ID NO: 3234424 - RNA, 12 nt, Human
agacaaaaagua

SEQ ID NO: 3234425 - RNA, 14 nt, Human
agacaaaaaguaua

SEQ ID NO: 3234426 - RNA, 19 nt, Human
agacaaaaaguauauuaaa

SEQ ID NO: 3234427 - RNA, 23 nt, Human
agacaaaaaguauauuaaacaaa

SEQ ID NO: 3234428 - RNA, 14 nt, Human
agaauuuuuuauuu

SEQ ID NO: 3234429 - RNA, 15 nt, Human
agacaaguaauuuca

SEQ ID NO: 3234430 - RNA, 18 nt, Human
agacaaguaauuucagug

SEQ ID NO: 3234431 - RNA, 22 nt, Human
agacaaguaauuucaguguaaa

SEQ ID NO: 3234432 - RNA, 22 nt, Human
agacaagcuguugaccaggcac

SEQ ID NO: 3234433 - RNA, 18 nt, Human
agacaagcuguugaccag

SEQ ID NO: 3234434 - RNA, 20 nt, Human
agacaaugugaaaagaaaaa

SEQ ID NO: 3234435 - RNA, 22 nt, Human
agaauuuugugaaacagacuug

SEQ ID NO: 3234436 - RNA, 14 nt, Human
agaauuuugugaaa

SEQ ID NO: 3234437 - RNA, 15 nt, Human
agaauuuugagcagg

SEQ ID NO: 3234438 - RNA, 20 nt, Human
agaaugaggcugcuuuccaa

SEQ ID NO: 3234439 - RNA, 14 nt, Human
agaaugaggcugcu

SEQ ID NO: 3234440 - RNA, 13 nt, Human
agaaugaggcugc

SEQ ID NO: 3234441 - RNA, 12 nt, Human
agaaugaggcug

SEQ ID NO: 3234442 - RNA, 23 nt, Human
agaaugcacaaacagaggccgcc

SEQ ID NO: 3234443 - RNA, 15 nt, Human
agaaugaguuucuua

SEQ ID NO: 3234444 - RNA, 14 nt, Human
agaaugaguuucuu

SEQ ID NO: 3234445 - RNA, 22 nt, Human
agaaugcacaaacagaggccgc

SEQ ID NO: 3234446 - RNA, 21 nt, Human
agaaugaugguuuccaauuuc

SEQ ID NO: 3234447 - RNA, 13 nt, Human
agaaugaugguuu

SEQ ID NO: 3234448 - RNA, 18 nt, Human
agaaugcaugcuuuccau

SEQ ID NO: 3234449 - RNA, 16 nt, Human
agaaugcaugcuuucc

SEQ ID NO: 3234450 - RNA, 18 nt, Human
agaaugcaccauacucau

SEQ ID NO: 3234451 - RNA, 18 nt, Human
agaaugcucuuuacuuca

SEQ ID NO: 3234452 - RNA, 23 nt, Human
agaaugcaugcuuuccauauuuu

SEQ ID NO: 3234453 - RNA, 17 nt, Human
agaaucucaaauaacua

SEQ ID NO: 3234454 - RNA, 19 nt, Human
agaaucuuguuuugaaaau

SEQ ID NO: 3234455 - RNA, 22 nt, Human
agaaucuuguuuugaaaauaac

SEQ ID NO: 3234456 - RNA, 18 nt, Human
agaaucucaacaugucuc

SEQ ID NO: 3234457 - RNA, 15 nt, Human
agaaggggacugcca

SEQ ID NO: 3234458 - RNA, 19 nt, Human
agaaggggacugccaccuc

SEQ ID NO: 3234459 - RNA, 16 nt, Human
agaaggggacugccac

SEQ ID NO: 3234460 - RNA, 20 nt, Human
agaaggggacugccaccucc

SEQ ID NO: 3234461 - RNA, 15 nt, Human
agaagaucuuugggc

SEQ ID NO: 3234462 - RNA, 13 nt, Human
agaagaucuuugg

SEQ ID NO: 3234463 - RNA, 18 nt, Human
agaagggagcuggcucca

SEQ ID NO: 3234464 - RNA, 14 nt, Human
agaagucacacagu

SEQ ID NO: 3234465 - RNA, 13 nt, Human
agaaguccagagu

SEQ ID NO: 3234466 - RNA, 15 nt, Human
agaagucaacauccu

SEQ ID NO: 3234467 - RNA, 19 nt, Human
agaagucuuagauguauau

SEQ ID NO: 3234468 - RNA, 17 nt, Human
agaagucuuagauguau

SEQ ID NO: 3234469 - RNA, 19 nt, Human
agaagucuucaugaaaugc

SEQ ID NO: 3234470 - RNA, 18 nt, Human
agaagucuucaugaaaug

SEQ ID NO: 3234471 - RNA, 16 nt, Human
agaagucuucaugaaa

SEQ ID NO: 3234472 - RNA, 13 nt, Human
agaagucuucaug

SEQ ID NO: 3234473 - RNA, 13 nt, Human
agaagauagcagg

SEQ ID NO: 3234474 - RNA, 20 nt, Human
agaagagcuguucacagcca

SEQ ID NO: 3234475 - RNA, 17 nt, Human
agaagauagucuuggaa

SEQ ID NO: 3234476 - RNA, 22 nt, Human
agaagagccccacucucagagg

SEQ ID NO: 3234477 - RNA, 20 nt, Human
agaagagccccacucucaga

SEQ ID NO: 3234478 - RNA, 17 nt, Human
agaagagccccacucuc

SEQ ID NO: 3234479 - RNA, 14 nt, Human
agaagagccccacu

SEQ ID NO: 3234480 - RNA, 13 nt, Human
agaagagcuguuc

SEQ ID NO: 3234481 - RNA, 13 nt, Human
agaagagccccac

SEQ ID NO: 3234482 - RNA, 12 nt, Human
agaagagcccca

SEQ ID NO: 3234483 - RNA, 15 nt, Human
agaagagaaugcaca

SEQ ID NO: 3234484 - RNA, 21 nt, Human
agaagagauugugguuucauu

SEQ ID NO: 3234485 - RNA, 22 nt, Human
agaaccagucuuucaacucauu

SEQ ID NO: 3234486 - RNA, 20 nt, Human
agaaccaggcaacuugggaa

SEQ ID NO: 3234487 - RNA, 19 nt, Human
agaaccagucuuucaacuc

SEQ ID NO: 3234488 - RNA, 17 nt, Human
agaaccagucuuucaac

SEQ ID NO: 3234489 - RNA, 21 nt, Human
agaaccaaaaagaggcuaugu

SEQ ID NO: 3234490 - RNA, 17 nt, Human
agaaccaggcaacuugg

SEQ ID NO: 3234491 - RNA, 13 nt, Human
agaacacugccaa

SEQ ID NO: 3234492 - RNA, 18 nt, Human
agaacaacauauacaaca

SEQ ID NO: 3234493 - RNA, 17 nt, Human
agaaccaaaaagaggcu

SEQ ID NO: 3234494 - RNA, 18 nt, Human
agaaccaaaaagaggcua

SEQ ID NO: 3234495 - RNA, 15 nt, Human
agaacagcuguugac

SEQ ID NO: 3234496 - RNA, 12 nt, Human
agaacagcuguu

SEQ ID NO: 3234497 - RNA, 16 nt, Human
agaacagauaaagauu

SEQ ID NO: 3234498 - RNA, 22 nt, Human
agaacagugauuaccagggacu

SEQ ID NO: 3234499 - RNA, 17 nt, Human
agaacagguuuuuuugu

SEQ ID NO: 3234500 - RNA, 18 nt, Human
agaacagguuuuuuuguu

SEQ ID NO: 3234501 - RNA, 21 nt, Human
agaacagguuuuuuuguuugu

SEQ ID NO: 3234502 - RNA, 18 nt, Human
agaacaguggaaacuaug

SEQ ID NO: 3234503 - RNA, 22 nt, Human
agaacaguggaaacuauguguu

SEQ ID NO: 3234504 - RNA, 13 nt, Human
agcaucucccagu

SEQ ID NO: 3234505 - RNA, 17 nt, Human
agcaucuggaagagcua

SEQ ID NO: 3234506 - RNA, 14 nt, Human
agccaagaggcugc

SEQ ID NO: 3234507 - RNA, 14 nt, Human
agccagauuucacu

SEQ ID NO: 3234508 - RNA, 17 nt, Human
agccagauuucacucuc

SEQ ID NO: 3234509 - RNA, 20 nt, Human
agccagauuucacucuccuu

SEQ ID NO: 3234510 - RNA, 22 nt, Human
agcccaaaccaccagaagccca

SEQ ID NO: 3234511 - RNA, 20 nt, Human
agcccaaaccaccagaagcc

SEQ ID NO: 3234512 - RNA, 19 nt, Human
agcccaaaccaccagaagc

SEQ ID NO: 3234513 - RNA, 17 nt, Human
agcccaaaccaccagaa

SEQ ID NO: 3234514 - RNA, 23 nt, Human
agccagcaggcucucaggccagc

SEQ ID NO: 3234515 - RNA, 22 nt, Human
agccagcaggcucucaggccag

SEQ ID NO: 3234516 - RNA, 21 nt, Human
agccagcaggcucucaggcca

SEQ ID NO: 3234517 - RNA, 17 nt, Human
agcccacgcccccacug

SEQ ID NO: 3234518 - RNA, 18 nt, Human
agcccacgcccccacugg

SEQ ID NO: 3234519 - RNA, 15 nt, Human
agcccacgcccccac

SEQ ID NO: 3234520 - RNA, 19 nt, Human
agcccacgcccccacuggu

SEQ ID NO: 3234521 - RNA, 23 nt, Human
agcccaccccucaacaccucugc

SEQ ID NO: 3234522 - RNA, 13 nt, Human
agcccaccuuggc

SEQ ID NO: 3234523 - RNA, 16 nt, Human
agcaucuaugugagac

SEQ ID NO: 3234524 - RNA, 18 nt, Human
agcaguggagcccaggag

SEQ ID NO: 3234525 - RNA, 16 nt, Human
agcaguggagcccagg

SEQ ID NO: 3234526 - RNA, 23 nt, Human
agcaguggccuacaaaucaguaa

SEQ ID NO: 3234527 - RNA, 17 nt, Human
agcagugcaugcugucc

SEQ ID NO: 3234528 - RNA, 23 nt, Human
agcagugauauucuuuguuaauu

SEQ ID NO: 3234529 - RNA, 13 nt, Human
agcagugcaugcu

SEQ ID NO: 3234530 - RNA, 16 nt, Human
agcagugcaugcuguc

SEQ ID NO: 3234531 - RNA, 20 nt, Human
agcagccuggacccugugga

SEQ ID NO: 3234532 - RNA, 13 nt, Human
agcagccuggcuc

SEQ ID NO: 3234533 - RNA, 14 nt, Human
agcagccuggcucc

SEQ ID NO: 3234534 - RNA, 15 nt, Human
agcagccuggcuccc

SEQ ID NO: 3234535 - RNA, 17 nt, Human
agcagccuggcuccccu

SEQ ID NO: 3234536 - RNA, 19 nt, Human
agcagccuggcuccccugg

SEQ ID NO: 3234537 - RNA, 21 nt, Human
agcagccuggcuccccugggg

SEQ ID NO: 3234538 - RNA, 17 nt, Human
agcacugacuucuaagu

SEQ ID NO: 3234539 - RNA, 16 nt, Human
agcacugacuucuaag

SEQ ID NO: 3234540 - RNA, 19 nt, Human
agcacugacuucuaaguaa

SEQ ID NO: 3234541 - RNA, 16 nt, Human
agcagccuggacccug

SEQ ID NO: 3234542 - RNA, 20 nt, Human
agcacuaaggugugcucuga

SEQ ID NO: 3234543 - RNA, 18 nt, Human
agcacagaggccuccugu

SEQ ID NO: 3234544 - RNA, 21 nt, Human
agcacagacccugcccugugg

SEQ ID NO: 3234545 - RNA, 11 nt, Human
agcacaaaauu

SEQ ID NO: 3234546 - RNA, 12 nt, Human
agcacaaaauuc

SEQ ID NO: 3234547 - RNA, 14 nt, Human
agcacaaaauucaa

SEQ ID NO: 3234548 - RNA, 15 nt, Human
agcacaaaauucaaa

SEQ ID NO: 3234549 - RNA, 20 nt, Human
agcacaaaauucaaagcaug

SEQ ID NO: 3234550 - RNA, 22 nt, Human
agcacaaaauucaaagcaugga

SEQ ID NO: 3234551 - RNA, 15 nt, Human
agcaauucuccugcc

SEQ ID NO: 3234552 - RNA, 17 nt, Human
agcaauucuccugccuc

SEQ ID NO: 3234553 - RNA, 18 nt, Human
agcaauucuccugccuca

SEQ ID NO: 3234554 - RNA, 19 nt, Human
agcaauucuccugccucag

SEQ ID NO: 3234555 - RNA, 20 nt, Human
agcaauucuccugccucagc

SEQ ID NO: 3234556 - RNA, 19 nt, Human
agcaaacuuguugaauuua

SEQ ID NO: 3234557 - RNA, 18 nt, Human
agcaaacugguuauuuaa

SEQ ID NO: 3234558 - RNA, 22 nt, Human
agcaaaguaguacuucuucugu

SEQ ID NO: 3234559 - RNA, 24 nt, Human
agcaaaguaguacuucuucuguaa

SEQ ID NO: 3234560 - RNA, 19 nt, Human
agcaaagcacccauuucaa

SEQ ID NO: 3234561 - RNA, 20 nt, Human
agcaaagcacccauuucaau

SEQ ID NO: 3234562 - RNA, 22 nt, Human
agcaaagcacccauuucaaugu

SEQ ID NO: 3234563 - RNA, 20 nt, Human
agcaaagcaugccaauuucu

SEQ ID NO: 3234564 - RNA, 19 nt, Human
agcaaauucuguuuuucua

SEQ ID NO: 3234565 - RNA, 20 nt, Human
agcaaaaugcauguaaucaa

SEQ ID NO: 3234566 - RNA, 15 nt, Human
agcaaaaugcaugua

SEQ ID NO: 3234567 - RNA, 16 nt, Human
agauugcaccacugca

SEQ ID NO: 3234568 - RNA, 17 nt, Human
agauugcaacaggcugg

SEQ ID NO: 3234569 - RNA, 16 nt, Human
agauugcaacaggcug

SEQ ID NO: 3234570 - RNA, 15 nt, Human
agauucuuuccugag

SEQ ID NO: 3234571 - RNA, 16 nt, Human
agauucuuuccugagg

SEQ ID NO: 3234572 - RNA, 12 nt, Human
agauugagaaau

SEQ ID NO: 3234573 - RNA, 13 nt, Human
agauugagaaaug

SEQ ID NO: 3234574 - RNA, 14 nt, Human
agauugagaaaugu

SEQ ID NO: 3234575 - RNA, 16 nt, Human
agauugagaaaugugu

SEQ ID NO: 3234576 - RNA, 17 nt, Human
agauugagaaaugugua

SEQ ID NO: 3234577 - RNA, 14 nt, Human
agauucuuuccuga

SEQ ID NO: 3234578 - RNA, 20 nt, Human
agauucuaggaccugugucc

SEQ ID NO: 3234579 - RNA, 20 nt, Human
agaugggugcuuggaggaag

SEQ ID NO: 3234580 - RNA, 22 nt, Human
agaugggugcuuggaggaagga

SEQ ID NO: 3234581 - RNA, 18 nt, Human
agaugacaucugucuagg

SEQ ID NO: 3234582 - RNA, 20 nt, Human
agauggcugugccucugccu

SEQ ID NO: 3234583 - RNA, 19 nt, Human
agauggcugugccucugcc

SEQ ID NO: 3234584 - RNA, 18 nt, Human
agauggcugugccucugc

SEQ ID NO: 3234585 - RNA, 17 nt, Human
agauggcugugccucug

SEQ ID NO: 3234586 - RNA, 21 nt, Human
agauggcugugccucugccug

SEQ ID NO: 3234587 - RNA, 18 nt, Human
agaugggggccucuuuca

SEQ ID NO: 3234588 - RNA, 15 nt, Human
agaugggggccucuu

SEQ ID NO: 3234589 - RNA, 23 nt, Human
agaucucugcuuuggaaaucaca

SEQ ID NO: 3234590 - RNA, 14 nt, Human
agaucucuuucuaa

SEQ ID NO: 3234591 - RNA, 18 nt, Human
agaucucugcuuuggaaa

SEQ ID NO: 3234592 - RNA, 19 nt, Human
agagugggguagguuggga

SEQ ID NO: 3234593 - RNA, 14 nt, Human
agaguggcuccucc

SEQ ID NO: 3234594 - RNA, 13 nt, Human
agaguggcuccuc

SEQ ID NO: 3234595 - RNA, 12 nt, Human
agaguggcuccu

SEQ ID NO: 3234596 - RNA, 20 nt, Human
agagggucugaggaauccag

SEQ ID NO: 3234597 - RNA, 21 nt, Human
agaggguaauaaccagacaca

SEQ ID NO: 3234598 - RNA, 19 nt, Human
agagggugauaauagaaga

SEQ ID NO: 3234599 - RNA, 19 nt, Human
agagggugaguccuccaga

SEQ ID NO: 3234600 - RNA, 21 nt, Human
agagggugaguccuccagaac

SEQ ID NO: 3234601 - RNA, 20 nt, Human
agagggugaguccuccagaa

SEQ ID NO: 3234602 - RNA, 23 nt, Human
agaggggguggccucccaacuca

SEQ ID NO: 3234603 - RNA, 19 nt, Human
agauagccccacaggaggu

SEQ ID NO: 3234604 - RNA, 13 nt, Human
agauagaguaaaa

SEQ ID NO: 3234605 - RNA, 20 nt, Human
agauagccaaggccaaagga

SEQ ID NO: 3234606 - RNA, 20 nt, Human
agauaggaaggucauuucca

SEQ ID NO: 3234607 - RNA, 21 nt, Human
agauaggaaggucauuuccau

SEQ ID NO: 3234608 - RNA, 13 nt, Human
agaguugaagaca

SEQ ID NO: 3234609 - RNA, 11 nt, Human
agaguguaaaa

SEQ ID NO: 3234610 - RNA, 14 nt, Human
agaguugaagacag

SEQ ID NO: 3234611 - RNA, 15 nt, Human
agaguugaagacaga

SEQ ID NO: 3234612 - RNA, 21 nt, Human
agauagagagugaguacaugc

SEQ ID NO: 3234613 - RNA, 23 nt, Human
agauauacuuguuuuuguaaaga

SEQ ID NO: 3234614 - RNA, 21 nt, Human
agauauacuuguuuuuguaaa

SEQ ID NO: 3234615 - RNA, 20 nt, Human
agauauacuuguuuuuguaa

SEQ ID NO: 3234616 - RNA, 15 nt, Human
agauauacuuguuuu

SEQ ID NO: 3234617 - RNA, 16 nt, Human
agauauaaugaacaaa

SEQ ID NO: 3234618 - RNA, 19 nt, Human
agauauaaugaacaaaauu

SEQ ID NO: 3234619 - RNA, 21 nt, Human
agauauaaugaacaaaauuau

SEQ ID NO: 3234620 - RNA, 13 nt, Human
aggcugagccuca

SEQ ID NO: 3234621 - RNA, 11 nt, Human
aggcugagccu

SEQ ID NO: 3234622 - RNA, 13 nt, Human
aggcucuucuccu

SEQ ID NO: 3234623 - RNA, 11 nt, Human
aggcugaggac

SEQ ID NO: 3234624 - RNA, 13 nt, Human
aggcugaggacuu

SEQ ID NO: 3234625 - RNA, 19 nt, Human
aggcuguugaauggaauuu

SEQ ID NO: 3234626 - RNA, 17 nt, Human
agggacaggauaagagg

SEQ ID NO: 3234627 - RNA, 16 nt, Human
agggacagucucacca

SEQ ID NO: 3234628 - RNA, 13 nt, Human
agggacagucuca

SEQ ID NO: 3234629 - RNA, 24 nt, Human
aggcuguaucccaugagccucagc

SEQ ID NO: 3234630 - RNA, 16 nt, Human
aggcuguauucagcaa

SEQ ID NO: 3234631 - RNA, 12 nt, Human
aggcugucaauu

SEQ ID NO: 3234632 - RNA, 17 nt, Human
aggcugcagugagccga

SEQ ID NO: 3234633 - RNA, 19 nt, Human
aggcugcagugagccgaga

SEQ ID NO: 3234634 - RNA, 23 nt, Human
aggcuguaucccaugagccucag

SEQ ID NO: 3234635 - RNA, 19 nt, Human
aggcccucugcccacuccc

SEQ ID NO: 3234636 - RNA, 20 nt, Human
aggcccucugcccacucccu

SEQ ID NO: 3234637 - RNA, 19 nt, Human
aggccagggagcaguggcu

SEQ ID NO: 3234638 - RNA, 22 nt, Human
agggauuuggggcucagagugg

SEQ ID NO: 3234639 - RNA, 18 nt, Human
agggccuggccugagcug

SEQ ID NO: 3234640 - RNA, 19 nt, Human
agggauugauuuuaaaaug

SEQ ID NO: 3234641 - RNA, 17 nt, Human
agggauugauuuuaaaa

SEQ ID NO: 3234642 - RNA, 14 nt, Human
agggauugauuuua

SEQ ID NO: 3234643 - RNA, 13 nt, Human
agggccuggcuca

SEQ ID NO: 3234644 - RNA, 14 nt, Human
agggccuggcucag

SEQ ID NO: 3234645 - RNA, 18 nt, Human
agggccuggcucaggugg

SEQ ID NO: 3234646 - RNA, 16 nt, Human
agggccugggccuggc

SEQ ID NO: 3234647 - RNA, 13 nt, Human
agggccugggccu

SEQ ID NO: 3234648 - RNA, 21 nt, Human
agggccugggccuggcucccu

SEQ ID NO: 3234649 - RNA, 20 nt, Human
agggccugggccuggcuccc

SEQ ID NO: 3234650 - RNA, 19 nt, Human
agggccugggccuggcucc

SEQ ID NO: 3234651 - RNA, 17 nt, Human
agggccugggccuggcu

SEQ ID NO: 3234652 - RNA, 14 nt, Human
agggcucaacacug

SEQ ID NO: 3234653 - RNA, 21 nt, Human
agggcuaggaauauagauuaa

SEQ ID NO: 3234654 - RNA, 16 nt, Human
agggcuaggaauauag

SEQ ID NO: 3234655 - RNA, 15 nt, Human
agggcuaggaauaua

SEQ ID NO: 3234656 - RNA, 15 nt, Human
agggaugcauggaga

SEQ ID NO: 3234657 - RNA, 20 nt, Human
agggauuagggagagaagau

SEQ ID NO: 3234658 - RNA, 16 nt, Human
agggauggaggaagaa

SEQ ID NO: 3234659 - RNA, 22 nt, Human
agggauuccuaaucacucagag

SEQ ID NO: 3234660 - RNA, 16 nt, Human
agggaugaauuguaaa

SEQ ID NO: 3234661 - RNA, 17 nt, Human
aggcaucgcaauguaag

SEQ ID NO: 3234662 - RNA, 11 nt, Human
aggcaugaagg

SEQ ID NO: 3234663 - RNA, 23 nt, Human
aggcaugugaugagaggaaauca

SEQ ID NO: 3234664 - RNA, 24 nt, Human
aggcaugugaugagaggaaaucac

SEQ ID NO: 3234665 - RNA, 22 nt, Human
aggcauguucucugaggacacu

SEQ ID NO: 3234666 - RNA, 20 nt, Human
aggcauguucucugaggaca

SEQ ID NO: 3234667 - RNA, 21 nt, Human
aggcauuccccaggaggccag

SEQ ID NO: 3234668 - RNA, 22 nt, Human
aggcauuccccaggaggccagc

SEQ ID NO: 3234669 - RNA, 23 nt, Human
aggcauuccccaggaggccagcc

SEQ ID NO: 3234670 - RNA, 12 nt, Human
aggccagcugcu

SEQ ID NO: 3234671 - RNA, 23 nt, Human
aggccagggggccagucccugag

SEQ ID NO: 3234672 - RNA, 19 nt, Human
aggccagggggccaguccc

SEQ ID NO: 3234673 - RNA, 17 nt, Human
aggcccucugcccacuc

SEQ ID NO: 3234674 - RNA, 15 nt, Human
aggcccucugcccac

SEQ ID NO: 3234675 - RNA, 16 nt, Human
aggccaugggccuccu

SEQ ID NO: 3234676 - RNA, 14 nt, Human
aggccaugggccuc

SEQ ID NO: 3234677 - RNA, 13 nt, Human
aggccagcugcuu

SEQ ID NO: 3234678 - RNA, 14 nt, Human
aggccagcugcuug

SEQ ID NO: 3234679 - RNA, 16 nt, Human
aggccagcugcuuggg

SEQ ID NO: 3234680 - RNA, 16 nt, Human
aggccaggcccucugc

SEQ ID NO: 3234681 - RNA, 17 nt, Human
aggccaggcccucugcc

SEQ ID NO: 3234682 - RNA, 18 nt, Human
aggccaggcccucugccc

SEQ ID NO: 3234683 - RNA, 19 nt, Human
aggccaggcccucugccca

SEQ ID NO: 3234684 - RNA, 23 nt, Human
aggccaggcccucugcccacucc

SEQ ID NO: 3234685 - RNA, 20 nt, Human
aggcagagguugcagugagc

SEQ ID NO: 3234686 - RNA, 13 nt, Human
aggcagauacagg

SEQ ID NO: 3234687 - RNA, 15 nt, Human
aggcagccaggccac

SEQ ID NO: 3234688 - RNA, 16 nt, Human
aggcagccaggccaca

SEQ ID NO: 3234689 - RNA, 14 nt, Human
aggcagccaggcca

SEQ ID NO: 3234690 - RNA, 16 nt, Human
aggcacuucugccuga

SEQ ID NO: 3234691 - RNA, 14 nt, Human
aggcagaaagcaaa

SEQ ID NO: 3234692 - RNA, 19 nt, Human
aggcagaaagcaaaauuau

SEQ ID NO: 3234693 - RNA, 16 nt, Human
aggcagaaagcaaaau

SEQ ID NO: 3234694 - RNA, 15 nt, Human
aggcacuucugccug

SEQ ID NO: 3234695 - RNA, 13 nt, Human
aggaugucugggc

SEQ ID NO: 3234696 - RNA, 17 nt, Human
aggaugggcuucugugc

SEQ ID NO: 3234697 - RNA, 16 nt, Human
aggaugggcuucugug

SEQ ID NO: 3234698 - RNA, 16 nt, Human
aggaugugcugcagug

SEQ ID NO: 3234699 - RNA, 23 nt, Human
aggaguucgaguuacagccuggg

SEQ ID NO: 3234700 - RNA, 14 nt, Human
aggagugagcacua

SEQ ID NO: 3234701 - RNA, 21 nt, Human
aggagugaaacaucauagaaa

SEQ ID NO: 3234702 - RNA, 22 nt, Human
aggagugcguggcccaccaggc

SEQ ID NO: 3234703 - RNA, 21 nt, Human
aggagugaucgucagaugugu

SEQ ID NO: 3234704 - RNA, 20 nt, Human
aggagugcguggcccaccag

SEQ ID NO: 3234705 - RNA, 13 nt, Human
aggaguaaaagag

SEQ ID NO: 3234706 - RNA, 14 nt, Human
aggaguaaaauuca

SEQ ID NO: 3234707 - RNA, 16 nt, Human
aggaguaaaauucagu

SEQ ID NO: 3234708 - RNA, 21 nt, Human
aggaguaaaauucaguuuuuu

SEQ ID NO: 3234709 - RNA, 19 nt, Human
aggagguuggagggaaagc

SEQ ID NO: 3234710 - RNA, 12 nt, Human
aggagugagcac

SEQ ID NO: 3234711 - RNA, 15 nt, Human
aggaggucucuaaga

SEQ ID NO: 3234712 - RNA, 19 nt, Human
aggaaguacuggagaaaau

SEQ ID NO: 3234713 - RNA, 17 nt, Human
aggagagauuauuuaca

SEQ ID NO: 3234714 - RNA, 16 nt, Human
aggagagcccuucauu

SEQ ID NO: 3234715 - RNA, 14 nt, Human
aggagggaggggga

SEQ ID NO: 3234716 - RNA, 15 nt, Human
aggagggucuagagg

SEQ ID NO: 3234717 - RNA, 20 nt, Human
aggagggucuagaggccuga

SEQ ID NO: 3234718 - RNA, 14 nt, Human
aggaggucucuaag

SEQ ID NO: 3234719 - RNA, 19 nt, Human
aggaaaaccaagccguggc

SEQ ID NO: 3234720 - RNA, 16 nt, Human
aggaaaaaauugcuuu

SEQ ID NO: 3234721 - RNA, 17 nt, Human
agcuuuguuuguucuug

SEQ ID NO: 3234722 - RNA, 16 nt, Human
agcuuuguuuguucuu

SEQ ID NO: 3234723 - RNA, 22 nt, Human
agcuuuuuuuuuuuaauuuugu

SEQ ID NO: 3234724 - RNA, 21 nt, Human
agcuuuguuuguugucagcug

SEQ ID NO: 3234725 - RNA, 15 nt, Human
agcuuuguuuguucu

SEQ ID NO: 3234726 - RNA, 13 nt, Human
agcuuuguuuguu

SEQ ID NO: 3234727 - RNA, 20 nt, Human
agcuuuguuuagucuuuaua

SEQ ID NO: 3234728 - RNA, 18 nt, Human
agcuuuguuuagucuuua

SEQ ID NO: 3234729 - RNA, 15 nt, Human
aggaacacuccuuca

SEQ ID NO: 3234730 - RNA, 11 nt, Human
aggaagaaauu

SEQ ID NO: 3234731 - RNA, 12 nt, Human
aggaacacuccu

SEQ ID NO: 3234732 - RNA, 23 nt, Human
aggaacaaggcaaggcugucaau

SEQ ID NO: 3234733 - RNA, 12 nt, Human
aggaaaaauuca

SEQ ID NO: 3234734 - RNA, 23 nt, Human
aggaaaaccaagccguggcuucc

SEQ ID NO: 3234735 - RNA, 22 nt, Human
aggaaaaccaagccguggcuuc

SEQ ID NO: 3234736 - RNA, 21 nt, Human
aggaaaaccaagccguggcuu

SEQ ID NO: 3234737 - RNA, 20 nt, Human
aggaaaaccaagccguggcu

SEQ ID NO: 3234738 - RNA, 14 nt, Human
aggaagguagaaau

SEQ ID NO: 3234739 - RNA, 17 nt, Human
aggaagacaguucuaca

SEQ ID NO: 3234740 - RNA, 14 nt, Human
aggaagguaaaaag

SEQ ID NO: 3234741 - RNA, 16 nt, Human
aggaagaaauuaacuu

SEQ ID NO: 3234742 - RNA, 19 nt, Human
aggaagaacugaaaggcuu

SEQ ID NO: 3234743 - RNA, 17 nt, Human
aggaagaauagggccca

SEQ ID NO: 3234744 - RNA, 18 nt, Human
aggaagaauagggcccau

SEQ ID NO: 3234745 - RNA, 11 nt, Human
aggaaguacug

SEQ ID NO: 3234746 - RNA, 15 nt, Human
aggaaguacuggaga

SEQ ID NO: 3234747 - RNA, 18 nt, Human
aggaaggucauuuccaug

SEQ ID NO: 3234748 - RNA, 16 nt, Human
aggaaggucauuucca

SEQ ID NO: 3234749 - RNA, 14 nt, Human
aggaaggucauuuc

SEQ ID NO: 3234750 - RNA, 15 nt, Human
agcugacuuuucugu

SEQ ID NO: 3234751 - RNA, 16 nt, Human
agcugcugaaacaaca

SEQ ID NO: 3234752 - RNA, 15 nt, Human
agcugcugaaacaac

SEQ ID NO: 3234753 - RNA, 14 nt, Human
agcugcugaaacaa

SEQ ID NO: 3234754 - RNA, 22 nt, Human
agcugccuguucagcuccagcu

SEQ ID NO: 3234755 - RNA, 19 nt, Human
agcugacuuucaaagugga

SEQ ID NO: 3234756 - RNA, 15 nt, Human
agcuggucccacuca

SEQ ID NO: 3234757 - RNA, 14 nt, Human
agcuggguuggaaa

SEQ ID NO: 3234758 - RNA, 16 nt, Human
agcuggguuggaaaac

SEQ ID NO: 3234759 - RNA, 20 nt, Human
agcuggguuggaaaacagua

SEQ ID NO: 3234760 - RNA, 13 nt, Human
agcugguaacauc

SEQ ID NO: 3234761 - RNA, 23 nt, Human
agcucaccagccccagugcccac

SEQ ID NO: 3234762 - RNA, 22 nt, Human
agcucaccagccccagugccca

SEQ ID NO: 3234763 - RNA, 17 nt, Human
agccugcuccuucccuu

SEQ ID NO: 3234764 - RNA, 14 nt, Human
agccuggacccugu

SEQ ID NO: 3234765 - RNA, 19 nt, Human
agccuggaaaccugucuga

SEQ ID NO: 3234766 - RNA, 18 nt, Human
agccuggaaaccugucug

SEQ ID NO: 3234767 - RNA, 18 nt, Human
agccuggcacagggcagu

SEQ ID NO: 3234768 - RNA, 17 nt, Human
agccuggcacagggcag

SEQ ID NO: 3234769 - RNA, 20 nt, Human
agccuggcacagggcagugg

SEQ ID NO: 3234770 - RNA, 18 nt, Human
agccugggcaaugugaua

SEQ ID NO: 3234771 - RNA, 20 nt, Human
agccugggaggucaaggcug

SEQ ID NO: 3234772 - RNA, 20 nt, Human
agccugggauaggggcagag

SEQ ID NO: 3234773 - RNA, 22 nt, Human
agccugggauaggggcagagga

SEQ ID NO: 3234774 - RNA, 16 nt, Human
agccuuucauuuugcu

SEQ ID NO: 3234775 - RNA, 13 nt, Human
agccuuucauuuu

SEQ ID NO: 3234776 - RNA, 16 nt, Human
agccuuuaccugugaa

SEQ ID NO: 3234777 - RNA, 18 nt, Human
agccuuuaccugugaagu

SEQ ID NO: 3234778 - RNA, 16 nt, Human
agccuuuacuguuuga

SEQ ID NO: 3234779 - RNA, 19 nt, Human
agccuuuacuguuugauau

SEQ ID NO: 3234780 - RNA, 20 nt, Human
agccuuuacuguuugauaua

SEQ ID NO: 3234781 - RNA, 15 nt, Human
agccuuucuuuucuu

SEQ ID NO: 3234782 - RNA, 23 nt, Human
agccuuucauuuugcuuuaauuu

SEQ ID NO: 3234783 - RNA, 21 nt, Human
agccuuucauuuugcuuuaau

SEQ ID NO: 3234784 - RNA, 20 nt, Human
agccuuucauuuugcuuuaa

SEQ ID NO: 3234785 - RNA, 19 nt, Human
agccuuucauuuugcuuua

SEQ ID NO: 3234786 - RNA, 18 nt, Human
agccuuucauuuugcuuu

SEQ ID NO: 3234787 - RNA, 17 nt, Human
agccuuucauuuugcuu

SEQ ID NO: 3234788 - RNA, 13 nt, Human
agcgaacugacau

SEQ ID NO: 3234789 - RNA, 14 nt, Human
agccuuuuugaaag

SEQ ID NO: 3234790 - RNA, 19 nt, Human
agccuuucuuuucuuucuu

SEQ ID NO: 3234791 - RNA, 16 nt, Human
agccuuuuucuaggcc

SEQ ID NO: 3234792 - RNA, 13 nt, Human
agcgaauuuuaaa

SEQ ID NO: 3234793 - RNA, 16 nt, Human
agcgaauuuuaaaaga

SEQ ID NO: 3234794 - RNA, 15 nt, Human
agcgaauuuuaaaag

SEQ ID NO: 3234795 - RNA, 13 nt, Human
agcgacagugaga

SEQ ID NO: 3234796 - RNA, 15 nt, Human
agcgacagugagacu

SEQ ID NO: 3234797 - RNA, 15 nt, Human
agcgauucuucugcu

SEQ ID NO: 3234798 - RNA, 13 nt, Human
agcgacagagcag

SEQ ID NO: 3234799 - RNA, 17 nt, Human
agcgacaacagauugga

SEQ ID NO: 3234800 - RNA, 19 nt, Human
agcgauucuucugcuucag

SEQ ID NO: 3234801 - RNA, 17 nt, Human
agcgauucuucugcuuc

SEQ ID NO: 3234802 - RNA, 19 nt, Human
agcuaacauggaaguacua

SEQ ID NO: 3234803 - RNA, 19 nt, Human
agcgauucucuugccucag

SEQ ID NO: 3234804 - RNA, 20 nt, Human
agcuaacauggaaguacuau

SEQ ID NO: 3234805 - RNA, 15 nt, Human
agcuaaugggacacu

SEQ ID NO: 3234806 - RNA, 14 nt, Human
agcuaaugggacac

SEQ ID NO: 3234807 - RNA, 13 nt, Human
agcuaaugggaca

SEQ ID NO: 3234808 - RNA, 19 nt, Human
agcuaagguuuagauaaau

SEQ ID NO: 3234809 - RNA, 17 nt, Human
agcuacaacuaauaaca

SEQ ID NO: 3234810 - RNA, 21 nt, Human
agcucaccagccccagugccc

SEQ ID NO: 3234811 - RNA, 20 nt, Human
agcucaccagccccagugcc

SEQ ID NO: 3234812 - RNA, 14 nt, Human
agcucaccagcccc

SEQ ID NO: 3234813 - RNA, 13 nt, Human
agcucaccagccc

SEQ ID NO: 3234814 - RNA, 14 nt, Human
agugacagaggcag

SEQ ID NO: 3234815 - RNA, 19 nt, Human
agugacagaggcagcccca

SEQ ID NO: 3234816 - RNA, 16 nt, Human
agugacagaggcagcc

SEQ ID NO: 3234817 - RNA, 13 nt, Human
agugauuaccagg

SEQ ID NO: 3234818 - RNA, 19 nt, Human
agugaugucacuagggcag

SEQ ID NO: 3234819 - RNA, 20 nt, Human
agugauggguuaguggaugg

SEQ ID NO: 3234820 - RNA, 22 nt, Human
agugauccucccaccucagccu

SEQ ID NO: 3234821 - RNA, 20 nt, Human
agugauccucccaccucagc

SEQ ID NO: 3234822 - RNA, 19 nt, Human
agugauccucccaccucag

SEQ ID NO: 3234823 - RNA, 19 nt, Human
agugccuuauggaacacuc

SEQ ID NO: 3234824 - RNA, 20 nt, Human
agugccuuauggaacacucu

SEQ ID NO: 3234825 - RNA, 21 nt, Human
agugccuuauggaacacucug

SEQ ID NO: 3234826 - RNA, 22 nt, Human
agugccuuauggaacacucuga

SEQ ID NO: 3234827 - RNA, 18 nt, Human
agugccuuauggaacacu

SEQ ID NO: 3234828 - RNA, 17 nt, Human
agugauucuccugccuc

SEQ ID NO: 3234829 - RNA, 20 nt, Human
agugauucuccugccucagc

SEQ ID NO: 3234830 - RNA, 18 nt, Human
agugauucuccugccuca

SEQ ID NO: 3234831 - RNA, 19 nt, Human
agugauucuccugccucag

SEQ ID NO: 3234832 - RNA, 14 nt, Human
agugcuacugaaag

SEQ ID NO: 3234833 - RNA, 17 nt, Human
agugcguggcccaccag

SEQ ID NO: 3234834 - RNA, 13 nt, Human
agugcguggccca

SEQ ID NO: 3234835 - RNA, 21 nt, Human
agugccuuugcagcucagaac

SEQ ID NO: 3234836 - RNA, 18 nt, Human
agugccuuugcagcucag

SEQ ID NO: 3234837 - RNA, 20 nt, Human
agugccuuugcagcucagaa

SEQ ID NO: 3234838 - RNA, 17 nt, Human
agugccuuugcagcuca

SEQ ID NO: 3234839 - RNA, 13 nt, Human
agucauuuaauaa

SEQ ID NO: 3234840 - RNA, 15 nt, Human
agucauuucugauuu

SEQ ID NO: 3234841 - RNA, 14 nt, Human
agucauuucugauu

SEQ ID NO: 3234842 - RNA, 13 nt, Human
agucauuucugau

SEQ ID NO: 3234843 - RNA, 20 nt, Human
agucauuguaauguugugaa

SEQ ID NO: 3234844 - RNA, 17 nt, Human
agucauuguaauguugu

SEQ ID NO: 3234845 - RNA, 16 nt, Human
agucauuguaauguug

SEQ ID NO: 3234846 - RNA, 15 nt, Human
agucauuguaauguu

SEQ ID NO: 3234847 - RNA, 12 nt, Human
agucauuguaau

SEQ ID NO: 3234848 - RNA, 16 nt, Human
aguccuuaccagcaga

SEQ ID NO: 3234849 - RNA, 18 nt, Human
aguccuuaccagcagagc

SEQ ID NO: 3234850 - RNA, 14 nt, Human
aguccucuuuucug

SEQ ID NO: 3234851 - RNA, 16 nt, Human
agucauuuuguguuga

SEQ ID NO: 3234852 - RNA, 15 nt, Human
agucauuuucaagac

SEQ ID NO: 3234853 - RNA, 15 nt, Human
agucauuugugaauu

SEQ ID NO: 3234854 - RNA, 13 nt, Human
agucauuuucaag

SEQ ID NO: 3234855 - RNA, 18 nt, Human
agucuggcccuuccuuuu

SEQ ID NO: 3234856 - RNA, 17 nt, Human
agucuggggaccagcuu

SEQ ID NO: 3234857 - RNA, 16 nt, Human
agucgaggacagggag

SEQ ID NO: 3234858 - RNA, 17 nt, Human
aguccuuugagcuccug

SEQ ID NO: 3234859 - RNA, 18 nt, Human
agucuggaaugcaguggu

SEQ ID NO: 3234860 - RNA, 20 nt, Human
agucugauucccaagcucug

SEQ ID NO: 3234861 - RNA, 22 nt, Human
agucugauucccaagcucugcu

SEQ ID NO: 3234862 - RNA, 21 nt, Human
agucugauucccaagcucugc

SEQ ID NO: 3234863 - RNA, 18 nt, Human
aguaucagagauguccau

SEQ ID NO: 3234864 - RNA, 23 nt, Human
aguaucagagauguccauuuuua

SEQ ID NO: 3234865 - RNA, 13 nt, Human
aguaucaugaagc

SEQ ID NO: 3234866 - RNA, 13 nt, Human
aguauauuuuauu

SEQ ID NO: 3234867 - RNA, 19 nt, Human
aguauauuuuauuucaaug

SEQ ID NO: 3234868 - RNA, 20 nt, Human
aguauauuuuauuucaaugu

SEQ ID NO: 3234869 - RNA, 14 nt, Human
aguauauuguugaa

SEQ ID NO: 3234870 - RNA, 18 nt, Human
aguauauuguugaagaga

SEQ ID NO: 3234871 - RNA, 20 nt, Human
aguauauuguugaagagaca

SEQ ID NO: 3234872 - RNA, 22 nt, Human
aguauauuguugaagagacaga

SEQ ID NO: 3234873 - RNA, 16 nt, Human
aguauauuauaauaga

SEQ ID NO: 3234874 - RNA, 21 nt, Human
aguacuucuccacccugcucu

SEQ ID NO: 3234875 - RNA, 15 nt, Human
aguauaucucaguuu

SEQ ID NO: 3234876 - RNA, 19 nt, Human
aguacuucuccacccugcu

SEQ ID NO: 3234877 - RNA, 20 nt, Human
aguacuucuccacccugcuc

SEQ ID NO: 3234878 - RNA, 13 nt, Human
aguacucauacau

SEQ ID NO: 3234879 - RNA, 19 nt, Human
aguaccuggguccccagcc

SEQ ID NO: 3234880 - RNA, 20 nt, Human
aguaccuuaucaaaguagca

SEQ ID NO: 3234881 - RNA, 22 nt, Human
aguaccuggguccccagcccuu

SEQ ID NO: 3234882 - RNA, 21 nt, Human
aguaccuggguccccagcccu

SEQ ID NO: 3234883 - RNA, 15 nt, Human
aguacuggagaaaau

SEQ ID NO: 3234884 - RNA, 23 nt, Human
aguacugagcagugauauucuuu

SEQ ID NO: 3234885 - RNA, 19 nt, Human
aguacugagcagugauauu

SEQ ID NO: 3234886 - RNA, 14 nt, Human
aguaaauguaguuc

SEQ ID NO: 3234887 - RNA, 12 nt, Human
aguaaauguagu

SEQ ID NO: 3234888 - RNA, 15 nt, Human
aguaaauguaguuca

SEQ ID NO: 3234889 - RNA, 17 nt, Human
aguaacuuacuuaggug

SEQ ID NO: 3234890 - RNA, 18 nt, Human
aguaacuugggagugugg

SEQ ID NO: 3234891 - RNA, 14 nt, Human
aguaacuugggagu

SEQ ID NO: 3234892 - RNA, 18 nt, Human
aguaacuggugauauauc

SEQ ID NO: 3234893 - RNA, 12 nt, Human
aguaaacacugu

SEQ ID NO: 3234894 - RNA, 15 nt, Human
aguaaaccugucuga

SEQ ID NO: 3234895 - RNA, 16 nt, Human
aguaaacacuguguau

SEQ ID NO: 3234896 - RNA, 13 nt, Human
aguaaacacugug

SEQ ID NO: 3234897 - RNA, 12 nt, Human
aguaaaauucag

SEQ ID NO: 3234898 - RNA, 14 nt, Human
aguaaaauucaguu

SEQ ID NO: 3234899 - RNA, 18 nt, Human
aguaaaauucaguuuuuu

SEQ ID NO: 3234900 - RNA, 19 nt, Human
aggggccagacccugccca

SEQ ID NO: 3234901 - RNA, 21 nt, Human
auacuguuuuucgucauucca

SEQ ID NO: 3234902 - RNA, 16 nt, Human
auacuuaaaaauuuau

SEQ ID NO: 3234903 - RNA, 13 nt, Human
auacuguguguga

SEQ ID NO: 3234904 - RNA, 21 nt, Human
auacugugugugagugugaau

SEQ ID NO: 3234905 - RNA, 15 nt, Human
auacuguuauucuuu

SEQ ID NO: 3234906 - RNA, 18 nt, Human
auacuguuauucuuugca

SEQ ID NO: 3234907 - RNA, 16 nt, Human
auacuguuauucuuug

SEQ ID NO: 3234908 - RNA, 22 nt, Human
auacuguuauucuuugcacuuu

SEQ ID NO: 3234909 - RNA, 20 nt, Human
auacuguuauucuuugcacu

SEQ ID NO: 3234910 - RNA, 17 nt, Human
auacuuuuuugaaauca

SEQ ID NO: 3234911 - RNA, 14 nt, Human
auacuuuuuugaaa

SEQ ID NO: 3234912 - RNA, 17 nt, Human
auagaaaaaaacauucu

SEQ ID NO: 3234913 - RNA, 14 nt, Human
auagcaaaguagua

SEQ ID NO: 3234914 - RNA, 13 nt, Human
auagaaaaacaaa

SEQ ID NO: 3234915 - RNA, 12 nt, Human
auacuugaacca

SEQ ID NO: 3234916 - RNA, 12 nt, Human
auacuuaaaugu

SEQ ID NO: 3234917 - RNA, 13 nt, Human
auacuugaaccau

SEQ ID NO: 3234918 - RNA, 16 nt, Human
auacuugaaccauaaa

SEQ ID NO: 3234919 - RNA, 17 nt, Human
auacuugaaccauaaaa

SEQ ID NO: 3234920 - RNA, 18 nt, Human
auacuugaaccauaaaau

SEQ ID NO: 3234921 - RNA, 20 nt, Human
auacuugaaccauaaaaugu

SEQ ID NO: 3234922 - RNA, 22 nt, Human
auacuugaaccauaaaaugucc

SEQ ID NO: 3234923 - RNA, 14 nt, Human
auacaccgggccug

SEQ ID NO: 3234924 - RNA, 21 nt, Human
auacaccucaacuaaauccaa

SEQ ID NO: 3234925 - RNA, 18 nt, Human
auacaccgggccuggaga

SEQ ID NO: 3234926 - RNA, 18 nt, Human
auaagcuuaugcuuaaau

SEQ ID NO: 3234927 - RNA, 22 nt, Human
auaagcuaguugaauacuugaa

SEQ ID NO: 3234928 - RNA, 23 nt, Human
auaagcuaguugaauacuugaac

SEQ ID NO: 3234929 - RNA, 17 nt, Human
auaagcuaguugaauac

SEQ ID NO: 3234930 - RNA, 18 nt, Human
auaagcuaguugaauacu

SEQ ID NO: 3234931 - RNA, 20 nt, Human
auaagcuaguugaauacuug

SEQ ID NO: 3234932 - RNA, 21 nt, Human
auaagcuaguugaauacuuga

SEQ ID NO: 3234933 - RNA, 14 nt, Human
auaagcuaguugaa

SEQ ID NO: 3234934 - RNA, 15 nt, Human
auaagcuaguugaau

SEQ ID NO: 3234935 - RNA, 21 nt, Human
auaaguggccuugacacauua

SEQ ID NO: 3234936 - RNA, 12 nt, Human
auaaugugaaau

SEQ ID NO: 3234937 - RNA, 15 nt, Human
auaaugugaaaugua

SEQ ID NO: 3234938 - RNA, 19 nt, Human
auaaguggccuugacacau

SEQ ID NO: 3234939 - RNA, 20 nt, Human
auacacacucaaaucaagaa

SEQ ID NO: 3234940 - RNA, 12 nt, Human
auaauguuguca

SEQ ID NO: 3234941 - RNA, 12 nt, Human
auaauguuaaca

SEQ ID NO: 3234942 - RNA, 22 nt, Human
auaauguucugcuaaauuucaa

SEQ ID NO: 3234943 - RNA, 14 nt, Human
auaauguucugcua

SEQ ID NO: 3234944 - RNA, 17 nt, Human
auaaagaccagaaauuc

SEQ ID NO: 3234945 - RNA, 20 nt, Human
aguuugccccguucuguuug

SEQ ID NO: 3234946 - RNA, 15 nt, Human
aguuugcuaauguuu

SEQ ID NO: 3234947 - RNA, 16 nt, Human
aguuugcuaauguuuc

SEQ ID NO: 3234948 - RNA, 18 nt, Human
auaaaaaaaagaaaaaag

SEQ ID NO: 3234949 - RNA, 17 nt, Human
auaaaaaaaagaaaaaa

SEQ ID NO: 3234950 - RNA, 13 nt, Human
auaaaaaaaagaa

SEQ ID NO: 3234951 - RNA, 13 nt, Human
auaaaaaaucaug

SEQ ID NO: 3234952 - RNA, 16 nt, Human
auaaaaaaucaugcca

SEQ ID NO: 3234953 - RNA, 14 nt, Human
auaaaaaaugacaa

SEQ ID NO: 3234954 - RNA, 16 nt, Human
auaaaaaaagaaaaaa

SEQ ID NO: 3234955 - RNA, 12 nt, Human
auaaaaaaagaa

SEQ ID NO: 3234956 - RNA, 15 nt, Human
auaaaaaaacagcuu

SEQ ID NO: 3234957 - RNA, 19 nt, Human
auaaaaagauaaucucagu

SEQ ID NO: 3234958 - RNA, 22 nt, Human
auaaaacaguuggcaugcaucc

SEQ ID NO: 3234959 - RNA, 19 nt, Human
auaaaacagaguaaucuug

SEQ ID NO: 3234960 - RNA, 21 nt, Human
auaaaacagaguaaucuuguu

SEQ ID NO: 3234961 - RNA, 16 nt, Human
auaaaacagaguaauc

SEQ ID NO: 3234962 - RNA, 18 nt, Human
auaaaaauuacuguguua

SEQ ID NO: 3234963 - RNA, 16 nt, Human
auaaaaauucuagauu

SEQ ID NO: 3234964 - RNA, 18 nt, Human
auaaaaauucuagauuac

SEQ ID NO: 3234965 - RNA, 14 nt, Human
aguuugaucuuccu

SEQ ID NO: 3234966 - RNA, 21 nt, Human
aguuugaucuuccucugcuaa

SEQ ID NO: 3234967 - RNA, 16 nt, Human
aguuugaucuuccucu

SEQ ID NO: 3234968 - RNA, 23 nt, Human
aguuugaucuuccucugcuaaau

SEQ ID NO: 3234969 - RNA, 22 nt, Human
aguuugaucuuccucugcuaaa

SEQ ID NO: 3234970 - RNA, 18 nt, Human
aguuugaggauuaguuua

SEQ ID NO: 3234971 - RNA, 16 nt, Human
aguuugauaaauagug

SEQ ID NO: 3234972 - RNA, 19 nt, Human
aguuugauaaauaguguua

SEQ ID NO: 3234973 - RNA, 18 nt, Human
aguuugauaaauaguguu

SEQ ID NO: 3234974 - RNA, 17 nt, Human
aguuugaggauuaguuu

SEQ ID NO: 3234975 - RNA, 20 nt, Human
aguuugaggaaauuugcagc

SEQ ID NO: 3234976 - RNA, 19 nt, Human
aguuugaggaaauuugcag

SEQ ID NO: 3234977 - RNA, 18 nt, Human
aguuugaggaaauuugca

SEQ ID NO: 3234978 - RNA, 14 nt, Human
aguuugaggaaauu

SEQ ID NO: 3234979 - RNA, 11 nt, Human
aguuugcaguu

SEQ ID NO: 3234980 - RNA, 15 nt, Human
aguuugcauuucaga

SEQ ID NO: 3234981 - RNA, 23 nt, Human
aguuugcauuucagaaagccuuu

SEQ ID NO: 3234982 - RNA, 17 nt, Human
aguuugcauuucagaaa

SEQ ID NO: 3234983 - RNA, 16 nt, Human
aguuugcauuucagaa

SEQ ID NO: 3234984 - RNA, 13 nt, Human
aguuucugugguu

SEQ ID NO: 3234985 - RNA, 17 nt, Human
aguuucugugguuggcu

SEQ ID NO: 3234986 - RNA, 21 nt, Human
aguuucugugguuggcuggga

SEQ ID NO: 3234987 - RNA, 23 nt, Human
aguuucugugguuggcugggaaa

SEQ ID NO: 3234988 - RNA, 20 nt, Human
aguuucugucguuaaaaaca

SEQ ID NO: 3234989 - RNA, 23 nt, Human
aguuucugucguuaaaaacagau

SEQ ID NO: 3234990 - RNA, 22 nt, Human
aguuucugucguuaaaaacaga

SEQ ID NO: 3234991 - RNA, 20 nt, Human
aguuguuagauuaagaaaua

SEQ ID NO: 3234992 - RNA, 17 nt, Human
aguuguuagugugucuu

SEQ ID NO: 3234993 - RNA, 22 nt, Human
aguuguuagugugucuuagugu

SEQ ID NO: 3234994 - RNA, 14 nt, Human
aguugaauacuuga

SEQ ID NO: 3234995 - RNA, 17 nt, Human
aguugaagucaugcucc

SEQ ID NO: 3234996 - RNA, 17 nt, Human
aguugaaguuaguggaa

SEQ ID NO: 3234997 - RNA, 19 nt, Human
aguugaaguuaguggaaau

SEQ ID NO: 3234998 - RNA, 22 nt, Human
aguugaaguuaguggaaaucug

SEQ ID NO: 3234999 - RNA, 15 nt, Human
aguugaagucaugcu

SEQ ID NO: 3235000 - RNA, 19 nt, Human
aguugaauacuugaaccau

SEQ ID NO: 3235001 - RNA, 15 nt, Human
aguuguuagauuaag

SEQ ID NO: 3235002 - RNA, 15 nt, Human
aguugaauacuugaa

SEQ ID NO: 3235003 - RNA, 16 nt, Human
aguugaauacuugaac

SEQ ID NO: 3235004 - RNA, 17 nt, Human
aguugaauacuugaacc

SEQ ID NO: 3235005 - RNA, 18 nt, Human
aguugaauacuugaacca

SEQ ID NO: 3235006 - RNA, 19 nt, Human
aguuaauguauauaaaaau

SEQ ID NO: 3235007 - RNA, 20 nt, Human
aguuaauguauauaaaaaug

SEQ ID NO: 3235008 - RNA, 19 nt, Human
aguuaacaggcaaacauuu

SEQ ID NO: 3235009 - RNA, 18 nt, Human
aguuaacaggcaaacauu

SEQ ID NO: 3235010 - RNA, 17 nt, Human
aguguuuucagaagaaa

SEQ ID NO: 3235011 - RNA, 18 nt, Human
aguguuuucagaagaaau

SEQ ID NO: 3235012 - RNA, 12 nt, Human
aguuaaaucuca

SEQ ID NO: 3235013 - RNA, 14 nt, Human
aguuaaaucucaaa

SEQ ID NO: 3235014 - RNA, 19 nt, Human
agugcuauuacgaaguuca

SEQ ID NO: 3235015 - RNA, 23 nt, Human
agugcuauuacgaaguucaagau

SEQ ID NO: 3235016 - RNA, 16 nt, Human
aguggccaucauuucu

SEQ ID NO: 3235017 - RNA, 15 nt, Human
aguggcccaacaggg

SEQ ID NO: 3235018 - RNA, 17 nt, Human
aguggccaucauuucug

SEQ ID NO: 3235019 - RNA, 13 nt, Human
aguggccccaccu

SEQ ID NO: 3235020 - RNA, 21 nt, Human
aguggcccaacaggggcucca

SEQ ID NO: 3235021 - RNA, 12 nt, Human
aguggccccacc

SEQ ID NO: 3235022 - RNA, 18 nt, Human
aguggccuacaaaucagu

SEQ ID NO: 3235023 - RNA, 21 nt, Human
aguggccuacaaaucaguaau

SEQ ID NO: 3235024 - RNA, 22 nt, Human
aguggccuacaaaucaguaauu

SEQ ID NO: 3235025 - RNA, 19 nt, Human
aguggccccaccuggcccu

SEQ ID NO: 3235026 - RNA, 18 nt, Human
aguggccccaccuggccc

SEQ ID NO: 3235027 - RNA, 16 nt, Human
aguggccccaccuggc

SEQ ID NO: 3235028 - RNA, 14 nt, Human
aguggccccaccug

SEQ ID NO: 3235029 - RNA, 12 nt, Human
aguguuugcugc

SEQ ID NO: 3235030 - RNA, 14 nt, Human
aguucauacccugu

SEQ ID NO: 3235031 - RNA, 23 nt, Human
aguuacaaauuauaauguauuca

SEQ ID NO: 3235032 - RNA, 22 nt, Human
aguuacaaauuauaauguauuc

SEQ ID NO: 3235033 - RNA, 21 nt, Human
aguuacaaauuauaauguauu

SEQ ID NO: 3235034 - RNA, 18 nt, Human
aguuccaccaucaagcca

SEQ ID NO: 3235035 - RNA, 21 nt, Human
aguuccaccaucaagccacca

SEQ ID NO: 3235036 - RNA, 15 nt, Human
aguucaucccuucuc

SEQ ID NO: 3235037 - RNA, 13 nt, Human
aguucaucccuuc

SEQ ID NO: 3235038 - RNA, 18 nt, Human
aguugaaaaacagcugag

SEQ ID NO: 3235039 - RNA, 16 nt, Human
aguugaagacagagcu

SEQ ID NO: 3235040 - RNA, 17 nt, Human
aguugaagacagagcua

SEQ ID NO: 3235041 - RNA, 17 nt, Human
aguugaaaaacagcuga

SEQ ID NO: 3235042 - RNA, 17 nt, Human
aguuccaaucaguagcu

SEQ ID NO: 3235043 - RNA, 13 nt, Human
aguuccacugaga

SEQ ID NO: 3235044 - RNA, 19 nt, Human
aguucaucccuucucuucc

SEQ ID NO: 3235045 - RNA, 16 nt, Human
aguucaucccuucucu

SEQ ID NO: 3235046 - RNA, 15 nt, Human
aguuccacugagacc

SEQ ID NO: 3235047 - RNA, 22 nt, Human
augaggcugcuuuccaaagcca

SEQ ID NO: 3235048 - RNA, 15 nt, Human
augagcuugauuaaa

SEQ ID NO: 3235049 - RNA, 21 nt, Human
augagcuuugucuacuucaaa

SEQ ID NO: 3235050 - RNA, 15 nt, Human
augaccuuucaauag

SEQ ID NO: 3235051 - RNA, 18 nt, Human
augaccuuguaauguaac

SEQ ID NO: 3235052 - RNA, 20 nt, Human
augaccuuguaauguaacug

SEQ ID NO: 3235053 - RNA, 19 nt, Human
augaccuuguaauguaacu

SEQ ID NO: 3235054 - RNA, 13 nt, Human
augaccuuucaau

SEQ ID NO: 3235055 - RNA, 11 nt, Human
augagccuggc

SEQ ID NO: 3235056 - RNA, 19 nt, Human
augagccucagcauccugg

SEQ ID NO: 3235057 - RNA, 21 nt, Human
augagccucagcauccuggca

SEQ ID NO: 3235058 - RNA, 17 nt, Human
augaauaaagacaccua

SEQ ID NO: 3235059 - RNA, 18 nt, Human
augaauaaugccuuugua

SEQ ID NO: 3235060 - RNA, 19 nt, Human
augaauaaugccuuuguaa

SEQ ID NO: 3235061 - RNA, 20 nt, Human
augaauaaugccuuuguaac

SEQ ID NO: 3235062 - RNA, 13 nt, Human
augaauaauggaa

SEQ ID NO: 3235063 - RNA, 14 nt, Human
augaauaauggaaa

SEQ ID NO: 3235064 - RNA, 20 nt, Human
augaauaauggaaaaugcca

SEQ ID NO: 3235065 - RNA, 17 nt, Human
augaauacgagcaagcu

SEQ ID NO: 3235066 - RNA, 12 nt, Human
augaauacuuug

SEQ ID NO: 3235067 - RNA, 13 nt, Human
augaaacuuggau

SEQ ID NO: 3235068 - RNA, 12 nt, Human
augaaagacugu

SEQ ID NO: 3235069 - RNA, 23 nt, Human
augaagcauuuacuuuguguuca

SEQ ID NO: 3235070 - RNA, 18 nt, Human
augaaagaaaacuuuuau

SEQ ID NO: 3235071 - RNA, 23 nt, Human
aucuaggaagacuuuggaaagag

SEQ ID NO: 3235072 - RNA, 17 nt, Human
augcaucccacugcuga

SEQ ID NO: 3235073 - RNA, 23 nt, Human
augcauaauaauccugcaaagua

SEQ ID NO: 3235074 - RNA, 21 nt, Human
augcauaauaauccugcaaag

SEQ ID NO: 3235075 - RNA, 19 nt, Human
augcauaauaauccugcaa

SEQ ID NO: 3235076 - RNA, 18 nt, Human
augccugguggcagcugc

SEQ ID NO: 3235077 - RNA, 19 nt, Human
augccugguggcagcugcg

SEQ ID NO: 3235078 - RNA, 13 nt, Human
augccugguggca

SEQ ID NO: 3235079 - RNA, 12 nt, Human
augccugguggc

SEQ ID NO: 3235080 - RNA, 11 nt, Human
augccuggugg

SEQ ID NO: 3235081 - RNA, 19 nt, Human
augcauguaaucaacaugg

SEQ ID NO: 3235082 - RNA, 13 nt, Human
augcauguaauca

SEQ ID NO: 3235083 - RNA, 21 nt, Human
augccugguggcagcugcggu

SEQ ID NO: 3235084 - RNA, 23 nt, Human
auggagauagccccacaggaggu

SEQ ID NO: 3235085 - RNA, 16 nt, Human
augcuuugaucccuuc

SEQ ID NO: 3235086 - RNA, 23 nt, Human
augcuuuccauauuuuuuuccuu

SEQ ID NO: 3235087 - RNA, 15 nt, Human
augcuuuccauauuu

SEQ ID NO: 3235088 - RNA, 22 nt, Human
augcuuuccauauuuuuuuccu

SEQ ID NO: 3235089 - RNA, 16 nt, Human
augcuuuccauauuuu

SEQ ID NO: 3235090 - RNA, 21 nt, Human
augcuuuaggauguacaguua

SEQ ID NO: 3235091 - RNA, 20 nt, Human
augcuucuucagagacuccu

SEQ ID NO: 3235092 - RNA, 14 nt, Human
augcuucuucagag

SEQ ID NO: 3235093 - RNA, 17 nt, Human
augcuucuucagagacu

SEQ ID NO: 3235094 - RNA, 19 nt, Human
augcucugcauguuacaua

SEQ ID NO: 3235095 - RNA, 18 nt, Human
augcucugcauguuacau

SEQ ID NO: 3235096 - RNA, 15 nt, Human
augcucugcauguua

SEQ ID NO: 3235097 - RNA, 15 nt, Human
augggacagggagga

SEQ ID NO: 3235098 - RNA, 20 nt, Human
augggaaagcauuguaaaug

SEQ ID NO: 3235099 - RNA, 14 nt, Human
augggaaagcauug

SEQ ID NO: 3235100 - RNA, 21 nt, Human
augggaaugaaugucagugug

SEQ ID NO: 3235101 - RNA, 22 nt, Human
augggaaaguauucucuuuuca

SEQ ID NO: 3235102 - RNA, 18 nt, Human
augggaaaguauucucuu

SEQ ID NO: 3235103 - RNA, 18 nt, Human
auggcuuuauuuuuuuga

SEQ ID NO: 3235104 - RNA, 23 nt, Human
auggcuuuauuuuuuugaacucu

SEQ ID NO: 3235105 - RNA, 20 nt, Human
auggcuucggacaaaauauc

SEQ ID NO: 3235106 - RNA, 23 nt, Human
auggaguuggaguucauucauau

SEQ ID NO: 3235107 - RNA, 18 nt, Human
auggaguuggaguucauu

SEQ ID NO: 3235108 - RNA, 20 nt, Human
auggaguuaaacuuuagugc

SEQ ID NO: 3235109 - RNA, 23 nt, Human
auccacucucucuuguucuuacu

SEQ ID NO: 3235110 - RNA, 18 nt, Human
auccacucugcaggaaau

SEQ ID NO: 3235111 - RNA, 22 nt, Human
auccacucugcaggaaauaggc

SEQ ID NO: 3235112 - RNA, 21 nt, Human
auccacugugccaugugccag

SEQ ID NO: 3235113 - RNA, 21 nt, Human
auccagcccugaguuccuagc

SEQ ID NO: 3235114 - RNA, 12 nt, Human
auccaggccacu

SEQ ID NO: 3235115 - RNA, 14 nt, Human
auccaggccccucc

SEQ ID NO: 3235116 - RNA, 19 nt, Human
auccaggccacucuuagcc

SEQ ID NO: 3235117 - RNA, 21 nt, Human
auccaggccccucccucucca

SEQ ID NO: 3235118 - RNA, 20 nt, Human
auccaggccccucccucucc

SEQ ID NO: 3235119 - RNA, 15 nt, Human
aucauccuaagcuau

SEQ ID NO: 3235120 - RNA, 23 nt, Human
aucauccacugugccaugugcca

SEQ ID NO: 3235121 - RNA, 14 nt, Human
aucaaauacauuua

SEQ ID NO: 3235122 - RNA, 13 nt, Human
aucaaauacauuu

SEQ ID NO: 3235123 - RNA, 20 nt, Human
aucaaauaauaccuuagaag

SEQ ID NO: 3235124 - RNA, 17 nt, Human
aucaaauaauaccuuag

SEQ ID NO: 3235125 - RNA, 16 nt, Human
aucaaaguagcaaaug

SEQ ID NO: 3235126 - RNA, 17 nt, Human
aucaaauaaaaauucua

SEQ ID NO: 3235127 - RNA, 19 nt, Human
aucaaauaaaaauucuaga

SEQ ID NO: 3235128 - RNA, 21 nt, Human
aucaaauaaaaauucuagauu

SEQ ID NO: 3235129 - RNA, 11 nt, Human
aucaaagugcu

SEQ ID NO: 3235130 - RNA, 18 nt, Human
aucaugcacacaauuaga

SEQ ID NO: 3235131 - RNA, 19 nt, Human
aucaugcacacaauuagau

SEQ ID NO: 3235132 - RNA, 19 nt, Human
aucaugccaguauuuuuaa

SEQ ID NO: 3235133 - RNA, 14 nt, Human
aucaugaauuuuaa

SEQ ID NO: 3235134 - RNA, 15 nt, Human
aucaugaauuuuaaa

SEQ ID NO: 3235135 - RNA, 17 nt, Human
aucaugaauuuuaaagu

SEQ ID NO: 3235136 - RNA, 18 nt, Human
aucaugaauuuuaaagua

SEQ ID NO: 3235137 - RNA, 19 nt, Human
aucaugaauuuuaaaguau

SEQ ID NO: 3235138 - RNA, 14 nt, Human
aucgaccugccucg

SEQ ID NO: 3235139 - RNA, 17 nt, Human
aucgacuuguucuugau

SEQ ID NO: 3235140 - RNA, 13 nt, Human
aucgaaaaaauaa

SEQ ID NO: 3235141 - RNA, 14 nt, Human
aucgaaaaaauaau

SEQ ID NO: 3235142 - RNA, 22 nt, Human
aucuaggaagacuuuggaaaga

SEQ ID NO: 3235143 - RNA, 12 nt, Human
aucaaaggacac

SEQ ID NO: 3235144 - RNA, 19 nt, Human
aucaaagagguuuuaaaaa

SEQ ID NO: 3235145 - RNA, 20 nt, Human
aucaaaagguuaauaaagua

SEQ ID NO: 3235146 - RNA, 14 nt, Human
aucaaaagaaagaa

SEQ ID NO: 3235147 - RNA, 23 nt, Human
aucaaaaaggcuuauaaaacaga

SEQ ID NO: 3235148 - RNA, 12 nt, Human
aucaaaaaggcu

SEQ ID NO: 3235149 - RNA, 13 nt, Human
aucaaaaaggcuu

SEQ ID NO: 3235150 - RNA, 16 nt, Human
aucaaaaaggcuuaua

SEQ ID NO: 3235151 - RNA, 17 nt, Human
aucaaaaaggcuuauaa

SEQ ID NO: 3235152 - RNA, 21 nt, Human
aucaaaaaggcuuauaaaaca

SEQ ID NO: 3235153 - RNA, 22 nt, Human
auauuuuuuuccuuacauaaac

SEQ ID NO: 3235154 - RNA, 21 nt, Human
auauuuuuuuccuuacauaaa

SEQ ID NO: 3235155 - RNA, 19 nt, Human
auauuuuuuuccuuacaua

SEQ ID NO: 3235156 - RNA, 18 nt, Human
auauuuuuuuccuuacau

SEQ ID NO: 3235157 - RNA, 17 nt, Human
auauuuuuuuccuuaca

SEQ ID NO: 3235158 - RNA, 15 nt, Human
auauuuuuuuccuua

SEQ ID NO: 3235159 - RNA, 14 nt, Human
auauuuuuuuccuu

SEQ ID NO: 3235160 - RNA, 17 nt, Human
auauuuuuuuaacuuua

SEQ ID NO: 3235161 - RNA, 14 nt, Human
auagcacagacccu

SEQ ID NO: 3235162 - RNA, 12 nt, Human
caaauguuucua

SEQ ID NO: 3235163 - RNA, 19 nt, Human
caaauguuucuaagguaac

SEQ ID NO: 3235164 - RNA, 13 nt, Human
caaauuaaaaaaa

SEQ ID NO: 3235165 - RNA, 19 nt, Human
caaauuaaaaaaaaauugu

SEQ ID NO: 3235166 - RNA, 21 nt, Human
caaauuaaaaaaaaauuguau

SEQ ID NO: 3235167 - RNA, 20 nt, Human
caaauugcuuuuuuccaaaa

SEQ ID NO: 3235168 - RNA, 22 nt, Human
caaauugcuuuuuuccaaaaca

SEQ ID NO: 3235169 - RNA, 22 nt, Human
caaaguucccuacuuccuguga

SEQ ID NO: 3235170 - RNA, 21 nt, Human
caaaguucccuacuuccugug

SEQ ID NO: 3235171 - RNA, 21 nt, Human
caaauauuuagauguaauuuu

SEQ ID NO: 3235172 - RNA, 13 nt, Human
caaauauuguuaa

SEQ ID NO: 3235173 - RNA, 23 nt, Human
caaauauuuagauguaauuuugu

SEQ ID NO: 3235174 - RNA, 22 nt, Human
caaauauuuagauguaauuuug

SEQ ID NO: 3235175 - RNA, 14 nt, Human
caaaggagauugga

SEQ ID NO: 3235176 - RNA, 17 nt, Human
caaagccccauuaacug

SEQ ID NO: 3235177 - RNA, 20 nt, Human
caaaggagauuggaaggaac

SEQ ID NO: 3235178 - RNA, 18 nt, Human
caaaggcuguauucagca

SEQ ID NO: 3235179 - RNA, 19 nt, Human
caaaggcuguauucagcaa

SEQ ID NO: 3235180 - RNA, 16 nt, Human
caaaguggugagaggc

SEQ ID NO: 3235181 - RNA, 17 nt, Human
caaaguggugagaggca

SEQ ID NO: 3235182 - RNA, 23 nt, Human
caaaggguaucaggugcugccau

SEQ ID NO: 3235183 - RNA, 21 nt, Human
caaaggguaucaggugcugcc

SEQ ID NO: 3235184 - RNA, 20 nt, Human
caaaggguaucaggugcugc

SEQ ID NO: 3235185 - RNA, 14 nt, Human
caaagaaauguaag

SEQ ID NO: 3235186 - RNA, 20 nt, Human
caaacuggaaugagcagcuu

SEQ ID NO: 3235187 - RNA, 20 nt, Human
caaacuggccgcgggggcag

SEQ ID NO: 3235188 - RNA, 22 nt, Human
caaagaaucaccuaauuaauuu

SEQ ID NO: 3235189 - RNA, 23 nt, Human
caaagacaaauaguaggcaagau

SEQ ID NO: 3235190 - RNA, 16 nt, Human
caaagacaaauaguag

SEQ ID NO: 3235191 - RNA, 15 nt, Human
caaagacaaauagua

SEQ ID NO: 3235192 - RNA, 14 nt, Human
caaagacaaauagu

SEQ ID NO: 3235193 - RNA, 23 nt, Human
caaagaaugaauuucaacgccug

SEQ ID NO: 3235194 - RNA, 13 nt, Human
caaagacaaauag

SEQ ID NO: 3235195 - RNA, 13 nt, Human
caaagcccagcuu

SEQ ID NO: 3235196 - RNA, 14 nt, Human
caaagagguuuuaa

SEQ ID NO: 3235197 - RNA, 21 nt, Human
caaagagguuuuaaaaaaauc

SEQ ID NO: 3235198 - RNA, 21 nt, Human
caaagaccaauuuuuugugug

SEQ ID NO: 3235199 - RNA, 23 nt, Human
auuuuaagcuaggaaaagaaauc

SEQ ID NO: 3235200 - RNA, 22 nt, Human
auuuuaagcuaggaaaagaaau

SEQ ID NO: 3235201 - RNA, 20 nt, Human
auuuuaagcuaggaaaagaa

SEQ ID NO: 3235202 - RNA, 19 nt, Human
auuuuaagcuaggaaaaga

SEQ ID NO: 3235203 - RNA, 14 nt, Human
caaacugcacauga

SEQ ID NO: 3235204 - RNA, 21 nt, Human
caaacugcacaugauuucaca

SEQ ID NO: 3235205 - RNA, 19 nt, Human
caaacugcacaugauuuca

SEQ ID NO: 3235206 - RNA, 18 nt, Human
caaacugcacaugauuuc

SEQ ID NO: 3235207 - RNA, 15 nt, Human
caaacugcacaugau

SEQ ID NO: 3235208 - RNA, 22 nt, Human
caaacugcacaugauuucacaa

SEQ ID NO: 3235209 - RNA, 12 nt, Human
auuuuaaaugug

SEQ ID NO: 3235210 - RNA, 18 nt, Human
auuuuaaaugugugagug

SEQ ID NO: 3235211 - RNA, 13 nt, Human
auuuuaaaugugu

SEQ ID NO: 3235212 - RNA, 18 nt, Human
auuuuaaagccauucuga

SEQ ID NO: 3235213 - RNA, 13 nt, Human
auuuuaaaguaug

SEQ ID NO: 3235214 - RNA, 17 nt, Human
auuuuaaaguaugcauu

SEQ ID NO: 3235215 - RNA, 19 nt, Human
auuuuaaaguaugcauuau

SEQ ID NO: 3235216 - RNA, 22 nt, Human
auuuuaaaguaugcauuauuaa

SEQ ID NO: 3235217 - RNA, 16 nt, Human
auuuguaccauuucag

SEQ ID NO: 3235218 - RNA, 16 nt, Human
auuuuaagccuuuguu

SEQ ID NO: 3235219 - RNA, 19 nt, Human
auuuuaagccuuuguugaa

SEQ ID NO: 3235220 - RNA, 18 nt, Human
auuuuaagccuuuguuga

SEQ ID NO: 3235221 - RNA, 17 nt, Human
auuuuaagcuaggaaaa

SEQ ID NO: 3235222 - RNA, 16 nt, Human
auuuuaagcuaggaaa

SEQ ID NO: 3235223 - RNA, 23 nt, Human
auuuuaagccuuuguugaacugu

SEQ ID NO: 3235224 - RNA, 22 nt, Human
auuuuaagccuuuguugaacug

SEQ ID NO: 3235225 - RNA, 23 nt, Human
auuuuaaaugugugagugcaugu

SEQ ID NO: 3235226 - RNA, 20 nt, Human
caacaggcugggcuucagug

SEQ ID NO: 3235227 - RNA, 23 nt, Human
caagagccugagagugaggugga

SEQ ID NO: 3235228 - RNA, 12 nt, Human
caagagccuuaa

SEQ ID NO: 3235229 - RNA, 14 nt, Human
caagagccuuaaaa

SEQ ID NO: 3235230 - RNA, 15 nt, Human
caagagccuuaaaac

SEQ ID NO: 3235231 - RNA, 16 nt, Human
caagagccuuaaaaca

SEQ ID NO: 3235232 - RNA, 17 nt, Human
caagagccuuaaaacau

SEQ ID NO: 3235233 - RNA, 20 nt, Human
caagagggcacugguggccc

SEQ ID NO: 3235234 - RNA, 19 nt, Human
caagagggcacugguggcc

SEQ ID NO: 3235235 - RNA, 18 nt, Human
caagagggcacugguggc

SEQ ID NO: 3235236 - RNA, 17 nt, Human
caagagggcacuggugg

SEQ ID NO: 3235237 - RNA, 13 nt, Human
caagagccugaga

SEQ ID NO: 3235238 - RNA, 11 nt, Human
caagagccuga

SEQ ID NO: 3235239 - RNA, 17 nt, Human
caagagcccaggccucc

SEQ ID NO: 3235240 - RNA, 17 nt, Human
caagacuuauuuucaca

SEQ ID NO: 3235241 - RNA, 17 nt, Human
caagagggucugaggaa

SEQ ID NO: 3235242 - RNA, 16 nt, Human
caagagggucugagga

SEQ ID NO: 3235243 - RNA, 12 nt, Human
caagagggucug

SEQ ID NO: 3235244 - RNA, 12 nt, Human
caagcagauucg

SEQ ID NO: 3235245 - RNA, 20 nt, Human
caagagguuuggcuccugcc

SEQ ID NO: 3235246 - RNA, 23 nt, Human
caagagguuuggcuccugcccac

SEQ ID NO: 3235247 - RNA, 22 nt, Human
caagagguuuggcuccugccca

SEQ ID NO: 3235248 - RNA, 21 nt, Human
caagacgcugugcugcccugc

SEQ ID NO: 3235249 - RNA, 22 nt, Human
caagacgcugugcugcccugcc

SEQ ID NO: 3235250 - RNA, 13 nt, Human
caagaccuucucc

SEQ ID NO: 3235251 - RNA, 19 nt, Human
caagacgcugugcugcccu

SEQ ID NO: 3235252 - RNA, 20 nt, Human
caagacgcugugcugcccug

SEQ ID NO: 3235253 - RNA, 13 nt, Human
caagaaaugaaag

SEQ ID NO: 3235254 - RNA, 23 nt, Human
caagacccuuguggucccacccc

SEQ ID NO: 3235255 - RNA, 12 nt, Human
caacuugccuuu

SEQ ID NO: 3235256 - RNA, 14 nt, Human
caacuugcaagggc

SEQ ID NO: 3235257 - RNA, 12 nt, Human
caacugugugau

SEQ ID NO: 3235258 - RNA, 22 nt, Human
caacugugugauuaaaagguau

SEQ ID NO: 3235259 - RNA, 20 nt, Human
caagcccaguucagcuuggg

SEQ ID NO: 3235260 - RNA, 14 nt, Human
caagcccaggaggg

SEQ ID NO: 3235261 - RNA, 17 nt, Human
caagcauucucuccauu

SEQ ID NO: 3235262 - RNA, 21 nt, Human
caagcauaccaacacgagcag

SEQ ID NO: 3235263 - RNA, 22 nt, Human
caagcaguuucaauaaaguuug

SEQ ID NO: 3235264 - RNA, 15 nt, Human
caagcaucacuuuuu

SEQ ID NO: 3235265 - RNA, 21 nt, Human
caagcaguuucaauaaaguuu

SEQ ID NO: 3235266 - RNA, 20 nt, Human
caagcaguuucaauaaaguu

SEQ ID NO: 3235267 - RNA, 16 nt, Human
caagcaguuucaauaa

SEQ ID NO: 3235268 - RNA, 15 nt, Human
caagcaguuucaaua

SEQ ID NO: 3235269 - RNA, 21 nt, Human
caagcaugaagauaaacacag

SEQ ID NO: 3235270 - RNA, 13 nt, Human
caagcauguggau

SEQ ID NO: 3235271 - RNA, 16 nt, Human
caagcauaccaacacg

SEQ ID NO: 3235272 - RNA, 23 nt, Human
caagcaguggauacgugucaaug

SEQ ID NO: 3235273 - RNA, 14 nt, Human
caagcaguuucaau

SEQ ID NO: 3235274 - RNA, 13 nt, Human
caagcaguuucaa

SEQ ID NO: 3235275 - RNA, 14 nt, Human
caaggauccugagc

SEQ ID NO: 3235276 - RNA, 20 nt, Human
caaggacuaggguccugggg

SEQ ID NO: 3235277 - RNA, 21 nt, Human
caaggacuaggguccugggga

SEQ ID NO: 3235278 - RNA, 16 nt, Human
caaggacuaggguccu

SEQ ID NO: 3235279 - RNA, 14 nt, Human
caaggacuaggguc

SEQ ID NO: 3235280 - RNA, 18 nt, Human
caaggacuaggguccugg

SEQ ID NO: 3235281 - RNA, 19 nt, Human
caaggacuaggguccuggg

SEQ ID NO: 3235282 - RNA, 14 nt, Human
caagcuuauuuugg

SEQ ID NO: 3235283 - RNA, 13 nt, Human
caagcuuuaaauu

SEQ ID NO: 3235284 - RNA, 14 nt, Human
caagcuuuaaauua

SEQ ID NO: 3235285 - RNA, 16 nt, Human
caagcuuuaaauuaug

SEQ ID NO: 3235286 - RNA, 19 nt, Human
caagcuguugaccaggcac

SEQ ID NO: 3235287 - RNA, 17 nt, Human
caagcuguugaccaggc

SEQ ID NO: 3235288 - RNA, 15 nt, Human
caaggauccugagcc

SEQ ID NO: 3235289 - RNA, 16 nt, Human
caaggauccugagcca

SEQ ID NO: 3235290 - RNA, 18 nt, Human
caaggcugggggaagaag

SEQ ID NO: 3235291 - RNA, 21 nt, Human
caaggcugggggaagaagcuc

SEQ ID NO: 3235292 - RNA, 13 nt, Human
caaggcugucaau

SEQ ID NO: 3235293 - RNA, 14 nt, Human
caaggcugucaauu

SEQ ID NO: 3235294 - RNA, 23 nt, Human
caagggaauuucuucaacucccu

SEQ ID NO: 3235295 - RNA, 20 nt, Human
caagguagaaugaccuugua

SEQ ID NO: 3235296 - RNA, 18 nt, Human
caagguagaaugaccuug

SEQ ID NO: 3235297 - RNA, 13 nt, Human
caagguagaauga

SEQ ID NO: 3235298 - RNA, 23 nt, Human
caagguaggguaggcagccugag

SEQ ID NO: 3235299 - RNA, 17 nt, Human
caaggugugccccgugg

SEQ ID NO: 3235300 - RNA, 14 nt, Human
caagguaaggaggg

SEQ ID NO: 3235301 - RNA, 22 nt, Human
caaggggaaucuggagguagcc

SEQ ID NO: 3235302 - RNA, 23 nt, Human
caaggggaauguuugccucugcc

SEQ ID NO: 3235303 - RNA, 13 nt, Human
caagggccuggcc

SEQ ID NO: 3235304 - RNA, 14 nt, Human
caagggccuggccu

SEQ ID NO: 3235305 - RNA, 15 nt, Human
caagggccuggccug

SEQ ID NO: 3235306 - RNA, 21 nt, Human
caaggggaauguuugccucug

SEQ ID NO: 3235307 - RNA, 16 nt, Human
caagggaggcccagcg

SEQ ID NO: 3235308 - RNA, 22 nt, Human
caagggaugaauuguaaaagca

SEQ ID NO: 3235309 - RNA, 15 nt, Human
caagggaggcccagc

SEQ ID NO: 3235310 - RNA, 14 nt, Human
caagggaggcccag

SEQ ID NO: 3235311 - RNA, 20 nt, Human
caagugauucuccugccuca

SEQ ID NO: 3235312 - RNA, 17 nt, Human
caagugacgaaaacauu

SEQ ID NO: 3235313 - RNA, 15 nt, Human
caagugagacccugu

SEQ ID NO: 3235314 - RNA, 18 nt, Human
caagugauucuccugccu

SEQ ID NO: 3235315 - RNA, 19 nt, Human
caagugauucuccugccuc

SEQ ID NO: 3235316 - RNA, 22 nt, Human
caagugaaaaaggaggaagaga

SEQ ID NO: 3235317 - RNA, 21 nt, Human
caagguucugggugcaggagc

SEQ ID NO: 3235318 - RNA, 13 nt, Human
caagguucugggu

SEQ ID NO: 3235319 - RNA, 23 nt, Human
caagugaaaaaggaggaagagaa

SEQ ID NO: 3235320 - RNA, 12 nt, Human
caagugaaaaau

SEQ ID NO: 3235321 - RNA, 14 nt, Human
caagugagacccug

SEQ ID NO: 3235322 - RNA, 20 nt, Human
caacugcaucaagaugugac

SEQ ID NO: 3235323 - RNA, 23 nt, Human
caacugcaucaagaugugacaug

SEQ ID NO: 3235324 - RNA, 17 nt, Human
caacugcaucaagaugu

SEQ ID NO: 3235325 - RNA, 14 nt, Human
caacugaucuguua

SEQ ID NO: 3235326 - RNA, 15 nt, Human
caacugaucuguuau

SEQ ID NO: 3235327 - RNA, 19 nt, Human
caaccugauugugucucuu

SEQ ID NO: 3235328 - RNA, 21 nt, Human
caaccugauugugucucuugg

SEQ ID NO: 3235329 - RNA, 17 nt, Human
caaccugauugugucuc

SEQ ID NO: 3235330 - RNA, 16 nt, Human
caaauuuacagagaca

SEQ ID NO: 3235331 - RNA, 17 nt, Human
caaauuuacagagacag

SEQ ID NO: 3235332 - RNA, 23 nt, Human
caaauuuacagagacagaaagca

SEQ ID NO: 3235333 - RNA, 14 nt, Human
caacaggcugggcu

SEQ ID NO: 3235334 - RNA, 17 nt, Human
caacaggcugggcuuca

SEQ ID NO: 3235335 - RNA, 13 nt, Human
caacaggcugggc

SEQ ID NO: 3235336 - RNA, 14 nt, Human
caacauacucccau

SEQ ID NO: 3235337 - RNA, 15 nt, Human
caacauacucccauc

SEQ ID NO: 3235338 - RNA, 20 nt, Human
caauccuuacaaaugauugc

SEQ ID NO: 3235339 - RNA, 17 nt, Human
caauccuuacaaaugau

SEQ ID NO: 3235340 - RNA, 16 nt, Human
caauccuuacaaauga

SEQ ID NO: 3235341 - RNA, 15 nt, Human
caauccuuacaaaug

SEQ ID NO: 3235342 - RNA, 14 nt, Human
caauccuuacaaau

SEQ ID NO: 3235343 - RNA, 13 nt, Human
caauccuuacaaa

SEQ ID NO: 3235344 - RNA, 12 nt, Human
caauccuuacaa

SEQ ID NO: 3235345 - RNA, 11 nt, Human
caauccuuaca

SEQ ID NO: 3235346 - RNA, 18 nt, Human
caaucucggcucacugca

SEQ ID NO: 3235347 - RNA, 21 nt, Human
caaucucguauagaagucuuc

SEQ ID NO: 3235348 - RNA, 16 nt, Human
caaucuuacuuuguaa

SEQ ID NO: 3235349 - RNA, 17 nt, Human
caaucuuacuuuguaaa

SEQ ID NO: 3235350 - RNA, 19 nt, Human
caaucuuacuuuguaaauu

SEQ ID NO: 3235351 - RNA, 22 nt, Human
caaucuuacuuuguaaauucug

SEQ ID NO: 3235352 - RNA, 23 nt, Human
caaucuuacuuuguaaauucuga

SEQ ID NO: 3235353 - RNA, 15 nt, Human
caaugaccuuucaau

SEQ ID NO: 3235354 - RNA, 16 nt, Human
caaugaccuuucaaua

SEQ ID NO: 3235355 - RNA, 13 nt, Human
caaugauggucac

SEQ ID NO: 3235356 - RNA, 14 nt, Human
caaugaccuuucaa

SEQ ID NO: 3235357 - RNA, 13 nt, Human
caaugaccuuuca

SEQ ID NO: 3235358 - RNA, 18 nt, Human
caaucuuuagaaaaggca

SEQ ID NO: 3235359 - RNA, 19 nt, Human
caaugaaaaggugauuguc

SEQ ID NO: 3235360 - RNA, 21 nt, Human
caaugcaaaccaucauugaaa

SEQ ID NO: 3235361 - RNA, 22 nt, Human
caaugcaaaccaucauugaaau

SEQ ID NO: 3235362 - RNA, 14 nt, Human
caaugauggucacc

SEQ ID NO: 3235363 - RNA, 13 nt, Human
caaugcacuuugu

SEQ ID NO: 3235364 - RNA, 14 nt, Human
caaugcacugacau

SEQ ID NO: 3235365 - RNA, 23 nt, Human
caaugcaaaccaucauugaaauc

SEQ ID NO: 3235366 - RNA, 20 nt, Human
caaugcaaaccaucauugaa

SEQ ID NO: 3235367 - RNA, 18 nt, Human
caauguaauuaaacuguu

SEQ ID NO: 3235368 - RNA, 13 nt, Human
cacacccagccca

SEQ ID NO: 3235369 - RNA, 22 nt, Human
cacaccagagcccaccuuggcu

SEQ ID NO: 3235370 - RNA, 21 nt, Human
cacaccagagcccaccuuggc

SEQ ID NO: 3235371 - RNA, 15 nt, Human
cacacagcucugucc

SEQ ID NO: 3235372 - RNA, 14 nt, Human
cacacagcucuguc

SEQ ID NO: 3235373 - RNA, 13 nt, Human
cacacagcucugu

SEQ ID NO: 3235374 - RNA, 22 nt, Human
cacacagauuugagcucagccc

SEQ ID NO: 3235375 - RNA, 20 nt, Human
cacacccagcccacuucugc

SEQ ID NO: 3235376 - RNA, 14 nt, Human
cacacccagcccac

SEQ ID NO: 3235377 - RNA, 17 nt, Human
cacaccgggcacucaga

SEQ ID NO: 3235378 - RNA, 21 nt, Human
cacaccuccucccacugccca

SEQ ID NO: 3235379 - RNA, 14 nt, Human
cacaccuccuccca

SEQ ID NO: 3235380 - RNA, 19 nt, Human
cacaccuccucccacugcc

SEQ ID NO: 3235381 - RNA, 16 nt, Human
cacaccuccucccacu

SEQ ID NO: 3235382 - RNA, 12 nt, Human
cacaccuccucc

SEQ ID NO: 3235383 - RNA, 14 nt, Human
cacacaagugcagu

SEQ ID NO: 3235384 - RNA, 16 nt, Human
cacacaauuagauuuc

SEQ ID NO: 3235385 - RNA, 20 nt, Human
cacaaucucggcucacugca

SEQ ID NO: 3235386 - RNA, 22 nt, Human
cacaaucucggcucacugcauc

SEQ ID NO: 3235387 - RNA, 23 nt, Human
cacaaucucggcucacugcaucc

SEQ ID NO: 3235388 - RNA, 24 nt, Human
cacaaucucggcucacugcauccu

SEQ ID NO: 3235389 - RNA, 20 nt, Human
cacacaccagagcccaccuu

SEQ ID NO: 3235390 - RNA, 16 nt, Human
cacacaccagagccca

SEQ ID NO: 3235391 - RNA, 15 nt, Human
cacacaccagagccc

SEQ ID NO: 3235392 - RNA, 17 nt, Human
cacacacaaaaaaagac

SEQ ID NO: 3235393 - RNA, 14 nt, Human
cacacacaaaaaaa

SEQ ID NO: 3235394 - RNA, 14 nt, Human
cacacacuuuggcu

SEQ ID NO: 3235395 - RNA, 11 nt, Human
cacacacacaa

SEQ ID NO: 3235396 - RNA, 13 nt, Human
cacacacacaaaa

SEQ ID NO: 3235397 - RNA, 21 nt, Human
cacacagaggcugccucuccc

SEQ ID NO: 3235398 - RNA, 18 nt, Human
cacacagauuugagcuca

SEQ ID NO: 3235399 - RNA, 20 nt, Human
cacacagauuugagcucagc

SEQ ID NO: 3235400 - RNA, 15 nt, Human
cacaagaaaugaaag

SEQ ID NO: 3235401 - RNA, 21 nt, Human
cacaagaaaugaaagcaggga

SEQ ID NO: 3235402 - RNA, 13 nt, Human
cacaagaaaugaa

SEQ ID NO: 3235403 - RNA, 19 nt, Human
cacaacugugugauuaaaa

SEQ ID NO: 3235404 - RNA, 22 nt, Human
cacaacugugugauuaaaaggu

SEQ ID NO: 3235405 - RNA, 17 nt, Human
cacaaagguagcuuuuc

SEQ ID NO: 3235406 - RNA, 20 nt, Human
cacaaauauuaaaaagucuu

SEQ ID NO: 3235407 - RNA, 14 nt, Human
cacaaauauuauuu

SEQ ID NO: 3235408 - RNA, 23 nt, Human
cacaaauauuauuuguguuuccu

SEQ ID NO: 3235409 - RNA, 14 nt, Human
cacaaauauuaaaa

SEQ ID NO: 3235410 - RNA, 13 nt, Human
cacaaauauuaaa

SEQ ID NO: 3235411 - RNA, 13 nt, Human
cacaaaugacuuu

SEQ ID NO: 3235412 - RNA, 17 nt, Human
cacaaauauuaaaaagu

SEQ ID NO: 3235413 - RNA, 14 nt, Human
cacaaaugacuuua

SEQ ID NO: 3235414 - RNA, 15 nt, Human
cacaaaugacuuuau

SEQ ID NO: 3235415 - RNA, 20 nt, Human
cacaaaugacuuuauuauuu

SEQ ID NO: 3235416 - RNA, 22 nt, Human
cacaaaugacuuuauuauuuau

SEQ ID NO: 3235417 - RNA, 23 nt, Human
cacaagaaaugaaagcagggacu

SEQ ID NO: 3235418 - RNA, 19 nt, Human
cacaaucucggcucacugc

SEQ ID NO: 3235419 - RNA, 22 nt, Human
cacaaucaccgaugcaaacauu

SEQ ID NO: 3235420 - RNA, 15 nt, Human
cacaaacagaggccg

SEQ ID NO: 3235421 - RNA, 13 nt, Human
caauuuuuauuuc

SEQ ID NO: 3235422 - RNA, 18 nt, Human
caauuuuuauuucuuuua

SEQ ID NO: 3235423 - RNA, 17 nt, Human
cacaaacgggcucagca

SEQ ID NO: 3235424 - RNA, 22 nt, Human
cacaaacugcuuccuuucuuga

SEQ ID NO: 3235425 - RNA, 18 nt, Human
caaugguuuucuugugug

SEQ ID NO: 3235426 - RNA, 14 nt, Human
caaugcacuuuguu

SEQ ID NO: 3235427 - RNA, 22 nt, Human
caauuauaaacucauuuugcuu

SEQ ID NO: 3235428 - RNA, 13 nt, Human
caauuauuucccc

SEQ ID NO: 3235429 - RNA, 15 nt, Human
caauuauuuccccca

SEQ ID NO: 3235430 - RNA, 20 nt, Human
caauguaaacacuuaacaga

SEQ ID NO: 3235431 - RNA, 19 nt, Human
caccacacugauccagccc

SEQ ID NO: 3235432 - RNA, 15 nt, Human
caccacacucagccc

SEQ ID NO: 3235433 - RNA, 14 nt, Human
caccacacucagcc

SEQ ID NO: 3235434 - RNA, 17 nt, Human
caccacacccagcccac

SEQ ID NO: 3235435 - RNA, 19 nt, Human
caccacacccagcccacuu

SEQ ID NO: 3235436 - RNA, 15 nt, Human
caccacgcccggcua

SEQ ID NO: 3235437 - RNA, 14 nt, Human
caccacgcccggcu

SEQ ID NO: 3235438 - RNA, 15 nt, Human
caccagagcccaccu

SEQ ID NO: 3235439 - RNA, 22 nt, Human
caccagagcccaccuuggcuca

SEQ ID NO: 3235440 - RNA, 20 nt, Human
caccagagcccaccuuggcu

SEQ ID NO: 3235441 - RNA, 18 nt, Human
caccagagcccaccuugg

SEQ ID NO: 3235442 - RNA, 17 nt, Human
caccagagcccaccuug

SEQ ID NO: 3235443 - RNA, 18 nt, Human
cacauguccaagaagccc

SEQ ID NO: 3235444 - RNA, 19 nt, Human
cacauguccaagaagccca

SEQ ID NO: 3235445 - RNA, 21 nt, Human
cacauguccaagaagcccagg

SEQ ID NO: 3235446 - RNA, 22 nt, Human
cacauguccaagaagcccagga

SEQ ID NO: 3235447 - RNA, 16 nt, Human
caccaacgucugugcc

SEQ ID NO: 3235448 - RNA, 18 nt, Human
caccaacuacuaccugua

SEQ ID NO: 3235449 - RNA, 17 nt, Human
caccaacgucugugcca

SEQ ID NO: 3235450 - RNA, 13 nt, Human
caccaagcccagu

SEQ ID NO: 3235451 - RNA, 12 nt, Human
caccaagcccag

SEQ ID NO: 3235452 - RNA, 22 nt, Human
caccaaucuuacuuuguaaauu

SEQ ID NO: 3235453 - RNA, 18 nt, Human
caccaaucuuacuuugua

SEQ ID NO: 3235454 - RNA, 19 nt, Human
caccaaucuuacuuuguaa

SEQ ID NO: 3235455 - RNA, 17 nt, Human
caccaaucuuacuuugu

SEQ ID NO: 3235456 - RNA, 14 nt, Human
caccagaugagaau

SEQ ID NO: 3235457 - RNA, 16 nt, Human
caccagggccaaaagc

SEQ ID NO: 3235458 - RNA, 22 nt, Human
caccagggccaaaagcuucccu

SEQ ID NO: 3235459 - RNA, 15 nt, Human
caccagaugugacag

SEQ ID NO: 3235460 - RNA, 15 nt, Human
caccagugaccugga

SEQ ID NO: 3235461 - RNA, 14 nt, Human
caccagugaccugg

SEQ ID NO: 3235462 - RNA, 23 nt, Human
caccaggguuuaguuugcauuua

SEQ ID NO: 3235463 - RNA, 22 nt, Human
caccaguacauucucaguuuuu

SEQ ID NO: 3235464 - RNA, 21 nt, Human
caccaguacauucucaguuuu

SEQ ID NO: 3235465 - RNA, 13 nt, Human
caccaguacauuc

SEQ ID NO: 3235466 - RNA, 20 nt, Human
caccagguagaacgccaggg

SEQ ID NO: 3235467 - RNA, 18 nt, Human
caccauaggucaccuuua

SEQ ID NO: 3235468 - RNA, 14 nt, Human
caccaucaagccac

SEQ ID NO: 3235469 - RNA, 15 nt, Human
caccaucaagccacc

SEQ ID NO: 3235470 - RNA, 13 nt, Human
caccaucaagcca

SEQ ID NO: 3235471 - RNA, 16 nt, Human
caccaucaagccacca

SEQ ID NO: 3235472 - RNA, 17 nt, Human
caccaucaagccaccaa

SEQ ID NO: 3235473 - RNA, 19 nt, Human
caccaucaagccaccaaca

SEQ ID NO: 3235474 - RNA, 24 nt, Human
caccaucaagccaccaacauacuc

SEQ ID NO: 3235475 - RNA, 17 nt, Human
caccaucaugucuggcu

SEQ ID NO: 3235476 - RNA, 15 nt, Human
caccaucaugucugg

SEQ ID NO: 3235477 - RNA, 18 nt, Human
caccaucaugucuggcua

SEQ ID NO: 3235478 - RNA, 15 nt, Human
caccaucacagcuug

SEQ ID NO: 3235479 - RNA, 16 nt, Human
caccaucacagcuugu

SEQ ID NO: 3235480 - RNA, 21 nt, Human
caccaucacagcuuguuuugg

SEQ ID NO: 3235481 - RNA, 22 nt, Human
caccaucacagcuuguuuugga

SEQ ID NO: 3235482 - RNA, 13 nt, Human
caccauccccucc

SEQ ID NO: 3235483 - RNA, 20 nt, Human
caccauguuggccaggcugc

SEQ ID NO: 3235484 - RNA, 20 nt, Human
caccauguuggccaggcugg

SEQ ID NO: 3235485 - RNA, 19 nt, Human
caccauguuggccaggcug

SEQ ID NO: 3235486 - RNA, 10 nt, Human
caccaucugc

SEQ ID NO: 3235487 - RNA, 16 nt, Human
caccaucugcugucuu

SEQ ID NO: 3235488 - RNA, 15 nt, Human
caccaucugcugucu

SEQ ID NO: 3235489 - RNA, 22 nt, Human
caccaugagggaagaauaaaga

SEQ ID NO: 3235490 - RNA, 19 nt, Human
caccaucugcugucuuuuc

SEQ ID NO: 3235491 - RNA, 12 nt, Human
caccaucuuuua

SEQ ID NO: 3235492 - RNA, 20 nt, Human
cacacguaaugaaacuugga

SEQ ID NO: 3235493 - RNA, 19 nt, Human
cacacguaaugaaacuugg

SEQ ID NO: 3235494 - RNA, 19 nt, Human
cacacgcugcucugcccca

SEQ ID NO: 3235495 - RNA, 20 nt, Human
cacagcaacgaucacaaaug

SEQ ID NO: 3235496 - RNA, 22 nt, Human
cacacggacacucaaaagcugg

SEQ ID NO: 3235497 - RNA, 13 nt, Human
cacacgcugccuu

SEQ ID NO: 3235498 - RNA, 12 nt, Human
cacacgcugccu

SEQ ID NO: 3235499 - RNA, 17 nt, Human
cacacgcugcucugccc

SEQ ID NO: 3235500 - RNA, 16 nt, Human
cacacgcugcucugcc

SEQ ID NO: 3235501 - RNA, 13 nt, Human
cacacgcugcucu

SEQ ID NO: 3235502 - RNA, 14 nt, Human
cacacgcugccuuc

SEQ ID NO: 3235503 - RNA, 18 nt, Human
cacagcucuucuccaggc

SEQ ID NO: 3235504 - RNA, 21 nt, Human
cacagcaacgaucacaaauga

SEQ ID NO: 3235505 - RNA, 22 nt, Human
cacagcaacgaucacaaaugac

SEQ ID NO: 3235506 - RNA, 19 nt, Human
cacaggcagguccaggguu

SEQ ID NO: 3235507 - RNA, 18 nt, Human
cacaggccacccugugca

SEQ ID NO: 3235508 - RNA, 16 nt, Human
cacaggccacccugug

SEQ ID NO: 3235509 - RNA, 15 nt, Human
cacaggccacccugu

SEQ ID NO: 3235510 - RNA, 23 nt, Human
cacaguccuuaccagcagagcac

SEQ ID NO: 3235511 - RNA, 14 nt, Human
cacagucuccccca

SEQ ID NO: 3235512 - RNA, 23 nt, Human
cacaggccacccugugcagaagg

SEQ ID NO: 3235513 - RNA, 22 nt, Human
cacaguccuuaccagcagagca

SEQ ID NO: 3235514 - RNA, 14 nt, Human
cacaggcccggcuc

SEQ ID NO: 3235515 - RNA, 20 nt, Human
cacagcucuucuccaggcug

SEQ ID NO: 3235516 - RNA, 19 nt, Human
cacagcucuucuccaggcu

SEQ ID NO: 3235517 - RNA, 15 nt, Human
cacaggaaguagagg

SEQ ID NO: 3235518 - RNA, 18 nt, Human
cacaggacagggguuccu

SEQ ID NO: 3235519 - RNA, 23 nt, Human
cacaggacaggaaaguggcaccu

SEQ ID NO: 3235520 - RNA, 17 nt, Human
cacaggaucagucugau

SEQ ID NO: 3235521 - RNA, 16 nt, Human
cacaggacucugccuc

SEQ ID NO: 3235522 - RNA, 15 nt, Human
cacaggacucugccu

SEQ ID NO: 3235523 - RNA, 19 nt, Human
cacaggacagggguuccuu

SEQ ID NO: 3235524 - RNA, 16 nt, Human
cacaugagauaauaug

SEQ ID NO: 3235525 - RNA, 14 nt, Human
cacaugauuucaca

SEQ ID NO: 3235526 - RNA, 17 nt, Human
cacaugauuucacaaau

SEQ ID NO: 3235527 - RNA, 16 nt, Human
cacaugauuucacaaa

SEQ ID NO: 3235528 - RNA, 12 nt, Human
cacaugauuuca

SEQ ID NO: 3235529 - RNA, 18 nt, Human
cacaugcacgugugugca

SEQ ID NO: 3235530 - RNA, 20 nt, Human
cacaugauuucacaaauauu

SEQ ID NO: 3235531 - RNA, 19 nt, Human
cacaugauuucacaaauau

SEQ ID NO: 3235532 - RNA, 18 nt, Human
cacaugauuucacaaaua

SEQ ID NO: 3235533 - RNA, 16 nt, Human
cacauguccaagaagc

SEQ ID NO: 3235534 - RNA, 17 nt, Human
cacauguccaagaagcc

SEQ ID NO: 3235535 - RNA, 20 nt, Human
cacaugccucucucaggcca

SEQ ID NO: 3235536 - RNA, 14 nt, Human
cacaugccaggggc

SEQ ID NO: 3235537 - RNA, 19 nt, Human
cacaugccaggggccuuug

SEQ ID NO: 3235538 - RNA, 22 nt, Human
cacaugcccuuggugacagcug

SEQ ID NO: 3235539 - RNA, 21 nt, Human
cacaugccucucucaggccaa

SEQ ID NO: 3235540 - RNA, 15 nt, Human
cacaugagauaauau

SEQ ID NO: 3235541 - RNA, 13 nt, Human
cacaugagcauca

SEQ ID NO: 3235542 - RNA, 17 nt, Human
cacaugagcaucaggcc

SEQ ID NO: 3235543 - RNA, 18 nt, Human
cacaugagcaucaggcca

SEQ ID NO: 3235544 - RNA, 19 nt, Human
cacaugagcaucaggccag

SEQ ID NO: 3235545 - RNA, 20 nt, Human
cacaugagcaucaggccagg

SEQ ID NO: 3235546 - RNA, 21 nt, Human
cacaugagcaucaggccaggc

SEQ ID NO: 3235547 - RNA, 22 nt, Human
cacaguuuucugagaaagacua

SEQ ID NO: 3235548 - RNA, 21 nt, Human
cacaguuuucugagaaagacu

SEQ ID NO: 3235549 - RNA, 20 nt, Human
cacaguuuucugagaaagac

SEQ ID NO: 3235550 - RNA, 13 nt, Human
cacccaagggccu

SEQ ID NO: 3235551 - RNA, 16 nt, Human
cacccaagcaggaggc

SEQ ID NO: 3235552 - RNA, 18 nt, Human
caccauguuggccaggcu

SEQ ID NO: 3235553 - RNA, 20 nt, Human
caccauucguacauaauacu

SEQ ID NO: 3235554 - RNA, 22 nt, Human
caccauucguacauaauacuga

SEQ ID NO: 3235555 - RNA, 23 nt, Human
caccauucguacauaauacugaa

SEQ ID NO: 3235556 - RNA, 19 nt, Human
caccauugcaacaaaauac

SEQ ID NO: 3235557 - RNA, 17 nt, Human
caccauuuccccagggc

SEQ ID NO: 3235558 - RNA, 15 nt, Human
caccauuuccccagg

SEQ ID NO: 3235559 - RNA, 19 nt, Human
caccauuuccccagggcac

SEQ ID NO: 3235560 - RNA, 18 nt, Human
caccauuuccccagggca

SEQ ID NO: 3235561 - RNA, 20 nt, Human
caccauuuccccagggcacg

SEQ ID NO: 3235562 - RNA, 12 nt, Human
uuuuuucuuuca

SEQ ID NO: 3235563 - RNA, 19 nt, Human
uuuuuugaacucuucucau

SEQ ID NO: 3235564 - RNA, 12 nt, Human
uuuuuugaaaug

SEQ ID NO: 3235565 - RNA, 13 nt, Human
uuuuuugaaauca

SEQ ID NO: 3235566 - RNA, 16 nt, Human
ucacgccacugcacua

SEQ ID NO: 3235567 - RNA, 14 nt, Human
ucacgccacugcac

SEQ ID NO: 3235568 - RNA, 13 nt, Human
ucacgccacugca

SEQ ID NO: 3235569 - RNA, 20 nt, Human
ucacgccuguaauccuagca

SEQ ID NO: 3235570 - RNA, 16 nt, Human
ucacgcuccuuucuga

SEQ ID NO: 3235571 - RNA, 19 nt, Human
ucacgccuguaauccuagc

SEQ ID NO: 3235572 - RNA, 14 nt, Human
ucaccuuugucccc

SEQ ID NO: 3235573 - RNA, 15 nt, Human
ucaccuuugucccca

SEQ ID NO: 3235574 - RNA, 17 nt, Human
ucaccuuuguccccacc

SEQ ID NO: 3235575 - RNA, 18 nt, Human
ucaccuuuguccccaccg

SEQ ID NO: 3235576 - RNA, 22 nt, Human
ucaccuuuguccccaccgcaga

SEQ ID NO: 3235577 - RNA, 15 nt, Human
ucaccuuuucaggaa

SEQ ID NO: 3235578 - RNA, 17 nt, Human
ucaccuuuucaggaaaa

SEQ ID NO: 3235579 - RNA, 16 nt, Human
ucacgagucauccaga

SEQ ID NO: 3235580 - RNA, 13 nt, Human
ucacgauucauuu

SEQ ID NO: 3235581 - RNA, 14 nt, Human
ucacgauucauuuu

SEQ ID NO: 3235582 - RNA, 15 nt, Human
ucacaggcaggucca

SEQ ID NO: 3235583 - RNA, 12 nt, Human
ucacaggcaggu

SEQ ID NO: 3235584 - RNA, 19 nt, Human
ucacaggcagguccagggu

SEQ ID NO: 3235585 - RNA, 20 nt, Human
ucacaggcugggcugggcac

SEQ ID NO: 3235586 - RNA, 14 nt, Human
ucacaggcugggcu

SEQ ID NO: 3235587 - RNA, 19 nt, Human
ucacaggcugggcugggca

SEQ ID NO: 3235588 - RNA, 18 nt, Human
ucacaggcugggcugggc

SEQ ID NO: 3235589 - RNA, 17 nt, Human
ucaccuaauuaauuuca

SEQ ID NO: 3235590 - RNA, 14 nt, Human
ucaccuuucccauc

SEQ ID NO: 3235591 - RNA, 12 nt, Human
ucaccuuugucc

SEQ ID NO: 3235592 - RNA, 13 nt, Human
ucaccuuuauucu

SEQ ID NO: 3235593 - RNA, 17 nt, Human
ucaccuugguuccuggg

SEQ ID NO: 3235594 - RNA, 15 nt, Human
ucaccuugguuccug

SEQ ID NO: 3235595 - RNA, 15 nt, Human
ucaccucacucagca

SEQ ID NO: 3235596 - RNA, 14 nt, Human
ucaccucacucagc

SEQ ID NO: 3235597 - RNA, 20 nt, Human
ucaccucacucagcaccacu

SEQ ID NO: 3235598 - RNA, 19 nt, Human
ucaccucacucagcaccac

SEQ ID NO: 3235599 - RNA, 18 nt, Human
ucaccucacucagcacca

SEQ ID NO: 3235600 - RNA, 16 nt, Human
ucaccucacucagcac

SEQ ID NO: 3235601 - RNA, 23 nt, Human
ucaccucacucagcaccacucaa

SEQ ID NO: 3235602 - RNA, 21 nt, Human
ucaccucacucagcaccacuc

SEQ ID NO: 3235603 - RNA, 11 nt, Human
ucacucucagg

SEQ ID NO: 3235604 - RNA, 20 nt, Human
ucacucuacuuagcaugucc

SEQ ID NO: 3235605 - RNA, 19 nt, Human
ucacucuacuuagcauguc

SEQ ID NO: 3235606 - RNA, 12 nt, Human
ucacucuccuug

SEQ ID NO: 3235607 - RNA, 14 nt, Human
ucacucuccuuggu

SEQ ID NO: 3235608 - RNA, 12 nt, Human
ucacucuggcag

SEQ ID NO: 3235609 - RNA, 13 nt, Human
ucacucuggcagc

SEQ ID NO: 3235610 - RNA, 23 nt, Human
ucacucuccuuggugucgggcau

SEQ ID NO: 3235611 - RNA, 14 nt, Human
ucacucugcuaccu

SEQ ID NO: 3235612 - RNA, 22 nt, Human
ucacucugcuaccuugccccaa

SEQ ID NO: 3235613 - RNA, 12 nt, Human
ucacucucagga

SEQ ID NO: 3235614 - RNA, 14 nt, Human
ucacucuggcagcu

SEQ ID NO: 3235615 - RNA, 15 nt, Human
ucacucuggcagcuc

SEQ ID NO: 3235616 - RNA, 16 nt, Human
ucacucuggcagcuca

SEQ ID NO: 3235617 - RNA, 17 nt, Human
ucacucuggcagcucag

SEQ ID NO: 3235618 - RNA, 18 nt, Human
ucacucuggcagcucaga

SEQ ID NO: 3235619 - RNA, 19 nt, Human
ucacucuggcagcucagag

SEQ ID NO: 3235620 - RNA, 20 nt, Human
ucacucuggcagcucagaga

SEQ ID NO: 3235621 - RNA, 22 nt, Human
ucacucuggcagcucagagagg

SEQ ID NO: 3235622 - RNA, 13 nt, Human
ucacuccuugaaa

SEQ ID NO: 3235623 - RNA, 14 nt, Human
ucacucuaagaugu

SEQ ID NO: 3235624 - RNA, 22 nt, Human
ucacucuaagauguuauauuuu

SEQ ID NO: 3235625 - RNA, 21 nt, Human
ucacucuaagauguuauauuu

SEQ ID NO: 3235626 - RNA, 15 nt, Human
ucacucuaagauguu

SEQ ID NO: 3235627 - RNA, 17 nt, Human
ucacucuaagauguuau

SEQ ID NO: 3235628 - RNA, 16 nt, Human
ucacucuaagauguua

SEQ ID NO: 3235629 - RNA, 15 nt, Human
ucacuccuaccuggu

SEQ ID NO: 3235630 - RNA, 18 nt, Human
ucacuccuaccugguaau

SEQ ID NO: 3235631 - RNA, 20 nt, Human
ucacggcucacugcagccuc

SEQ ID NO: 3235632 - RNA, 15 nt, Human
ucacggcucacugca

SEQ ID NO: 3235633 - RNA, 13 nt, Human
ucacggcucacug

SEQ ID NO: 3235634 - RNA, 16 nt, Human
ucacggaagagccuug

SEQ ID NO: 3235635 - RNA, 17 nt, Human
ucacggaagagccuugc

SEQ ID NO: 3235636 - RNA, 14 nt, Human
ucacggaagagccu

SEQ ID NO: 3235637 - RNA, 23 nt, Human
ucagaaaaaagguucuuugugua

SEQ ID NO: 3235638 - RNA, 10 nt, Human
ucagaaaaaa

SEQ ID NO: 3235639 - RNA, 22 nt, Human
ucagaaauaauaaaaaauuuca

SEQ ID NO: 3235640 - RNA, 20 nt, Human
ucagaaagggcagaaguagg

SEQ ID NO: 3235641 - RNA, 22 nt, Human
ucagaaauacagauaaaugauu

SEQ ID NO: 3235642 - RNA, 17 nt, Human
ucagaaauacagauaaa

SEQ ID NO: 3235643 - RNA, 23 nt, Human
ucagaaagccuuucauuuugcuu

SEQ ID NO: 3235644 - RNA, 17 nt, Human
ucagaaagccuuucauu

SEQ ID NO: 3235645 - RNA, 12 nt, Human
ucacuuuuauuu

SEQ ID NO: 3235646 - RNA, 22 nt, Human
ucacuuuuauuuagcaccaggg

SEQ ID NO: 3235647 - RNA, 19 nt, Human
ucacuuugacacuuuucau

SEQ ID NO: 3235648 - RNA, 12 nt, Human
ucacuuucauaa

SEQ ID NO: 3235649 - RNA, 13 nt, Human
ucacuggcauggu

SEQ ID NO: 3235650 - RNA, 21 nt, Human
ucacuggccacaguuguuuga

SEQ ID NO: 3235651 - RNA, 16 nt, Human
ucacucugucgcccag

SEQ ID NO: 3235652 - RNA, 12 nt, Human
ucacucugucgc

SEQ ID NO: 3235653 - RNA, 19 nt, Human
ucacucugucgcccagucu

SEQ ID NO: 3235654 - RNA, 20 nt, Human
ucagaguucccaagaaagga

SEQ ID NO: 3235655 - RNA, 20 nt, Human
ucagcaaacuuguugaauuu

SEQ ID NO: 3235656 - RNA, 13 nt, Human
ucagcaaagaaaa

SEQ ID NO: 3235657 - RNA, 15 nt, Human
ucagcaaagaaaaaa

SEQ ID NO: 3235658 - RNA, 22 nt, Human
ucagaggccccaauaccccaug

SEQ ID NO: 3235659 - RNA, 12 nt, Human
ucagaggcccca

SEQ ID NO: 3235660 - RNA, 24 nt, Human
ucagcaaggcgcuaacuugcuuaa

SEQ ID NO: 3235661 - RNA, 22 nt, Human
ucagcaaggcgcuaacuugcuu

SEQ ID NO: 3235662 - RNA, 20 nt, Human
ucagcaaggcgcuaacuugc

SEQ ID NO: 3235663 - RNA, 19 nt, Human
ucagcaaggcgcuaacuug

SEQ ID NO: 3235664 - RNA, 23 nt, Human
ucagcaaggccaccucuuccugg

SEQ ID NO: 3235665 - RNA, 18 nt, Human
ucagcaaggccaccucuu

SEQ ID NO: 3235666 - RNA, 13 nt, Human
ucagcaaggccac

SEQ ID NO: 3235667 - RNA, 12 nt, Human
ucagcaaggcca

SEQ ID NO: 3235668 - RNA, 17 nt, Human
ucagcaaggccaccucu

SEQ ID NO: 3235669 - RNA, 16 nt, Human
ucagcaaggccaccuc

SEQ ID NO: 3235670 - RNA, 15 nt, Human
ucagcaaggccaccu

SEQ ID NO: 3235671 - RNA, 14 nt, Human
ucagcaaggccacc

SEQ ID NO: 3235672 - RNA, 22 nt, Human
ucagacauagaauuaacacaug

SEQ ID NO: 3235673 - RNA, 19 nt, Human
ucagacauagaauuaacac

SEQ ID NO: 3235674 - RNA, 14 nt, Human
ucagacagcugccu

SEQ ID NO: 3235675 - RNA, 17 nt, Human
ucagaaaugacuuuuug

SEQ ID NO: 3235676 - RNA, 19 nt, Human
ucagacagcugccugggau

SEQ ID NO: 3235677 - RNA, 20 nt, Human
ucagacagcugccugggauc

SEQ ID NO: 3235678 - RNA, 15 nt, Human
ucagacagcugccug

SEQ ID NO: 3235679 - RNA, 16 nt, Human
ucagacagcugccugg

SEQ ID NO: 3235680 - RNA, 17 nt, Human
ucagacagcugccuggg

SEQ ID NO: 3235681 - RNA, 18 nt, Human
ucagacagcugccuggga

SEQ ID NO: 3235682 - RNA, 23 nt, Human
uauuuuauacucauggaagagau

SEQ ID NO: 3235683 - RNA, 13 nt, Human
uauuuuauauaaa

SEQ ID NO: 3235684 - RNA, 21 nt, Human
uauuuucaacgcagcccugcu

SEQ ID NO: 3235685 - RNA, 19 nt, Human
uauuuucaacgcagcccug

SEQ ID NO: 3235686 - RNA, 19 nt, Human
uauuuucagucaaaacuuu

SEQ ID NO: 3235687 - RNA, 21 nt, Human
uauuuucagucaaaacuuuaa

SEQ ID NO: 3235688 - RNA, 13 nt, Human
uauuuuuguuguu

SEQ ID NO: 3235689 - RNA, 17 nt, Human
uauuuugaaauggaaau

SEQ ID NO: 3235690 - RNA, 21 nt, Human
uauuuucuguguguuccuggc

SEQ ID NO: 3235691 - RNA, 21 nt, Human
uauuuugaagugagaaaauga

SEQ ID NO: 3235692 - RNA, 19 nt, Human
uauuuuuuuagauugagaa

SEQ ID NO: 3235693 - RNA, 19 nt, Human
uauuuuuuuccuuacauaa

SEQ ID NO: 3235694 - RNA, 18 nt, Human
uauuuuuuuccuuacaua

SEQ ID NO: 3235695 - RNA, 12 nt, Human
uauuuuuuuccu

SEQ ID NO: 3235696 - RNA, 14 nt, Human
ucaaaaagaaauca

SEQ ID NO: 3235697 - RNA, 17 nt, Human
ucaaaaagaaaucaaua

SEQ ID NO: 3235698 - RNA, 17 nt, Human
ucaaaaaggcuuauaaa

SEQ ID NO: 3235699 - RNA, 19 nt, Human
ucaaaaaggcuuauaaaac

SEQ ID NO: 3235700 - RNA, 20 nt, Human
ucaaaaaggcuuauaaaaca

SEQ ID NO: 3235701 - RNA, 21 nt, Human
ucaaaaaggcuuauaaaacag

SEQ ID NO: 3235702 - RNA, 22 nt, Human
ucaaaacgguuuuacugcagcu

SEQ ID NO: 3235703 - RNA, 23 nt, Human
ucaaacggccucacuaggcuucu

SEQ ID NO: 3235704 - RNA, 14 nt, Human
ucaaacucuuaaaa

SEQ ID NO: 3235705 - RNA, 16 nt, Human
ucaaacgugaaaaugc

SEQ ID NO: 3235706 - RNA, 15 nt, Human
ucaaacgugaaaaug

SEQ ID NO: 3235707 - RNA, 14 nt, Human
uauuucuucaaaua

SEQ ID NO: 3235708 - RNA, 18 nt, Human
uauuucuuaauuauuaua

SEQ ID NO: 3235709 - RNA, 23 nt, Human
uauuucuuaauuauuauaaaaau

SEQ ID NO: 3235710 - RNA, 15 nt, Human
uauuucuccuuuugu

SEQ ID NO: 3235711 - RNA, 12 nt, Human
uauuucuccuuu

SEQ ID NO: 3235712 - RNA, 11 nt, Human
uauuucuccuu

SEQ ID NO: 3235713 - RNA, 14 nt, Human
uauuucugaaggua

SEQ ID NO: 3235714 - RNA, 21 nt, Human
uauuucugaagguagcauucu

SEQ ID NO: 3235715 - RNA, 17 nt, Human
uauuugaggaguguuaa

SEQ ID NO: 3235716 - RNA, 18 nt, Human
uauuugcugacaaccauu

SEQ ID NO: 3235717 - RNA, 16 nt, Human
uauuuggaauuagaac

SEQ ID NO: 3235718 - RNA, 15 nt, Human
uauuuggaauuagaa

SEQ ID NO: 3235719 - RNA, 14 nt, Human
uauuuggaauuaga

SEQ ID NO: 3235720 - RNA, 14 nt, Human
uauuuggauaucug

SEQ ID NO: 3235721 - RNA, 15 nt, Human
uauuuggauaucugu

SEQ ID NO: 3235722 - RNA, 16 nt, Human
uauuuggauaucuguu

SEQ ID NO: 3235723 - RNA, 15 nt, Human
uauuuggaugcagag

SEQ ID NO: 3235724 - RNA, 19 nt, Human
uauuuggaugcagaguuca

SEQ ID NO: 3235725 - RNA, 16 nt, Human
uauuuggaugcagagu

SEQ ID NO: 3235726 - RNA, 22 nt, Human
uauuuuaguggacccugaaaug

SEQ ID NO: 3235727 - RNA, 21 nt, Human
uauuuuaguggacccugaaau

SEQ ID NO: 3235728 - RNA, 23 nt, Human
uauuuuaguggacccugaaaugu

SEQ ID NO: 3235729 - RNA, 20 nt, Human
uauuuggaugcagaguucag

SEQ ID NO: 3235730 - RNA, 21 nt, Human
uauuuauugacucuugaguug

SEQ ID NO: 3235731 - RNA, 21 nt, Human
uauuuauucugggaauguaua

SEQ ID NO: 3235732 - RNA, 12 nt, Human
uauuuauugacu

SEQ ID NO: 3235733 - RNA, 15 nt, Human
uauuuauugacucuu

SEQ ID NO: 3235734 - RNA, 17 nt, Human
uauuuauugacucuuga

SEQ ID NO: 3235735 - RNA, 24 nt, Human
uauuuauuaaauuuuuuuguauga

SEQ ID NO: 3235736 - RNA, 13 nt, Human
uauuuauuacaua

SEQ ID NO: 3235737 - RNA, 14 nt, Human
uauuuauuacauaa

SEQ ID NO: 3235738 - RNA, 16 nt, Human
uauuuauuacauaauu

SEQ ID NO: 3235739 - RNA, 20 nt, Human
uauuuauuacauaauuuagu

SEQ ID NO: 3235740 - RNA, 23 nt, Human
uauuuauuaaaugcccagccccu

SEQ ID NO: 3235741 - RNA, 15 nt, Human
uauuuauuaaauuuu

SEQ ID NO: 3235742 - RNA, 15 nt, Human
uaucugaaaauguau

SEQ ID NO: 3235743 - RNA, 14 nt, Human
uaucugaaaaugua

SEQ ID NO: 3235744 - RNA, 20 nt, Human
uaucugaaaauguaugugua

SEQ ID NO: 3235745 - RNA, 13 nt, Human
uaucugaaaguca

SEQ ID NO: 3235746 - RNA, 14 nt, Human
ucacaggaaguaga

SEQ ID NO: 3235747 - RNA, 19 nt, Human
ucacaggaaguagaggagg

SEQ ID NO: 3235748 - RNA, 11 nt, Human
ucacaggcagg

SEQ ID NO: 3235749 - RNA, 23 nt, Human
ucacacagugagucgaggacagg

SEQ ID NO: 3235750 - RNA, 22 nt, Human
ucacacagugagucgaggacag

SEQ ID NO: 3235751 - RNA, 21 nt, Human
ucacacaugagcaucaggcca

SEQ ID NO: 3235752 - RNA, 13 nt, Human
ucacacagugagu

SEQ ID NO: 3235753 - RNA, 22 nt, Human
ucacacaguauuacuucugcua

SEQ ID NO: 3235754 - RNA, 21 nt, Human
ucacacaguauuacuucugcu

SEQ ID NO: 3235755 - RNA, 19 nt, Human
ucaauuacaggaaguacug

SEQ ID NO: 3235756 - RNA, 22 nt, Human
ucacaaguuaagauucuuggua

SEQ ID NO: 3235757 - RNA, 13 nt, Human
ucaauuacaggaa

SEQ ID NO: 3235758 - RNA, 18 nt, Human
ucaauuacaggaaguacu

SEQ ID NO: 3235759 - RNA, 22 nt, Human
ucaaugcuguuuggguuuccaa

SEQ ID NO: 3235760 - RNA, 18 nt, Human
ucaaugcacugacauugu

SEQ ID NO: 3235761 - RNA, 17 nt, Human
ucaaugcuauaacuaug

SEQ ID NO: 3235762 - RNA, 15 nt, Human
ucaaugcuguuuggg

SEQ ID NO: 3235763 - RNA, 17 nt, Human
ucaaugcuggagaaaaa

SEQ ID NO: 3235764 - RNA, 14 nt, Human
ucaauaggaaaaac

SEQ ID NO: 3235765 - RNA, 23 nt, Human
ucaauagcccaggauauauuuua

SEQ ID NO: 3235766 - RNA, 16 nt, Human
ucaauagcguguguag

SEQ ID NO: 3235767 - RNA, 17 nt, Human
ucaauagcguguguaga

SEQ ID NO: 3235768 - RNA, 14 nt, Human
ucaaugcacugaca

SEQ ID NO: 3235769 - RNA, 13 nt, Human
ucaauaggaaaaa

SEQ ID NO: 3235770 - RNA, 22 nt, Human
ucaaguggcaaagcuguucuuc

SEQ ID NO: 3235771 - RNA, 19 nt, Human
ucaaguggcaaagcuguuc

SEQ ID NO: 3235772 - RNA, 14 nt, Human
ucaaguggcaaagc

SEQ ID NO: 3235773 - RNA, 21 nt, Human
ucaaacugaaaagcugagacc

SEQ ID NO: 3235774 - RNA, 12 nt, Human
ucaaacugaaaa

SEQ ID NO: 3235775 - RNA, 22 nt, Human
ucaaacucuugaccucagguga

SEQ ID NO: 3235776 - RNA, 13 nt, Human
ucaaccuccuggg

SEQ ID NO: 3235777 - RNA, 20 nt, Human
ucaacuaaaguuguacuuua

SEQ ID NO: 3235778 - RNA, 18 nt, Human
ucaacuaaaguuguacuu

SEQ ID NO: 3235779 - RNA, 15 nt, Human
ucaacuaaauccaaa

SEQ ID NO: 3235780 - RNA, 22 nt, Human
ucaacuaaaguuguacuuuaaa

SEQ ID NO: 3235781 - RNA, 21 nt, Human
ucaacuaaaguuguacuuuaa

SEQ ID NO: 3235782 - RNA, 21 nt, Human
ucaagcgauucuucugcuuca

SEQ ID NO: 3235783 - RNA, 16 nt, Human
ucaagcgauucuucug

SEQ ID NO: 3235784 - RNA, 15 nt, Human
ucaagcgauucucuu

SEQ ID NO: 3235785 - RNA, 12 nt, Human
ucaagcaugaag

SEQ ID NO: 3235786 - RNA, 14 nt, Human
ucaagcaugaagau

SEQ ID NO: 3235787 - RNA, 16 nt, Human
ucaagcaugaagauaa

SEQ ID NO: 3235788 - RNA, 22 nt, Human
ucaagccuagauguuuuauaca

SEQ ID NO: 3235789 - RNA, 15 nt, Human
ucaagcccaggaggg

SEQ ID NO: 3235790 - RNA, 20 nt, Human
ucaaggauccugagccagau

SEQ ID NO: 3235791 - RNA, 21 nt, Human
ucaagugauucuccugccuca

SEQ ID NO: 3235792 - RNA, 17 nt, Human
ucaaggauccugagcca

SEQ ID NO: 3235793 - RNA, 15 nt, Human
ucaagugauucucuu

SEQ ID NO: 3235794 - RNA, 22 nt, Human
ucaagugauucuccugccucag

SEQ ID NO: 3235795 - RNA, 18 nt, Human
ucaaggauccugagccag

SEQ ID NO: 3235796 - RNA, 19 nt, Human
ucaaggauccugagccaga

SEQ ID NO: 3235797 - RNA, 18 nt, Human
ucaagcuccaucuuauuu

SEQ ID NO: 3235798 - RNA, 16 nt, Human
ucccccuccaccugcu

SEQ ID NO: 3235799 - RNA, 17 nt, Human
ucccccaucucuucugg

SEQ ID NO: 3235800 - RNA, 13 nt, Human
ucccccugcccca

SEQ ID NO: 3235801 - RNA, 13 nt, Human
ucccccucuggcu

SEQ ID NO: 3235802 - RNA, 21 nt, Human
ucccccucccccagccacucc

SEQ ID NO: 3235803 - RNA, 14 nt, Human
ucccccucccccag

SEQ ID NO: 3235804 - RNA, 22 nt, Human
ucccccagccccauccucugua

SEQ ID NO: 3235805 - RNA, 16 nt, Human
ucccccaguccccuuc

SEQ ID NO: 3235806 - RNA, 20 nt, Human
uccccgcacugggcuugggg

SEQ ID NO: 3235807 - RNA, 21 nt, Human
ucccccuuccauggacuuugu

SEQ ID NO: 3235808 - RNA, 15 nt, Human
ucccccuuucuuccu

SEQ ID NO: 3235809 - RNA, 11 nt, Human
ucccccuuucu

SEQ ID NO: 3235810 - RNA, 21 nt, Human
ucccccuuucuuccucauucc

SEQ ID NO: 3235811 - RNA, 16 nt, Human
ucccccuuucuuccuc

SEQ ID NO: 3235812 - RNA, 13 nt, Human
uccccugcagccc

SEQ ID NO: 3235813 - RNA, 17 nt, Human
uccccugcagcccuggc

SEQ ID NO: 3235814 - RNA, 18 nt, Human
uccccugcagcccuggcc

SEQ ID NO: 3235815 - RNA, 11 nt, Human
uccccuuccuu

SEQ ID NO: 3235816 - RNA, 19 nt, Human
uccccuuccuaccacccgg

SEQ ID NO: 3235817 - RNA, 21 nt, Human
uccccuuccuaauuccacagc

SEQ ID NO: 3235818 - RNA, 18 nt, Human
uccccuuccccuuccuuc

SEQ ID NO: 3235819 - RNA, 16 nt, Human
uccccuuccccuuccu

SEQ ID NO: 3235820 - RNA, 12 nt, Human
uccccuucccag

SEQ ID NO: 3235821 - RNA, 15 nt, Human
uccccuuccauuucu

SEQ ID NO: 3235822 - RNA, 22 nt, Human
uccccuuccuaauuccacagcu

SEQ ID NO: 3235823 - RNA, 18 nt, Human
uccccuucccgugaccug

SEQ ID NO: 3235824 - RNA, 16 nt, Human
uccccuuccuaccacc

SEQ ID NO: 3235825 - RNA, 23 nt, Human
ucccuaccgagucucuucuccac

SEQ ID NO: 3235826 - RNA, 16 nt, Human
ucccucccugcuguca

SEQ ID NO: 3235827 - RNA, 12 nt, Human
ucccucccugcu

SEQ ID NO: 3235828 - RNA, 17 nt, Human
ucccucccucuuucccu

SEQ ID NO: 3235829 - RNA, 15 nt, Human
ucccucccucuuucc

SEQ ID NO: 3235830 - RNA, 16 nt, Human
ucccuacuuccuguga

SEQ ID NO: 3235831 - RNA, 15 nt, Human
ucccuacuuccugug

SEQ ID NO: 3235832 - RNA, 14 nt, Human
uccccugcugggug

SEQ ID NO: 3235833 - RNA, 15 nt, Human
uccccugcugggugu

SEQ ID NO: 3235834 - RNA, 20 nt, Human
uccccugcuggguguggcgc

SEQ ID NO: 3235835 - RNA, 21 nt, Human
uccccugcuggguguggcgca

SEQ ID NO: 3235836 - RNA, 13 nt, Human
uccccugcuccug

SEQ ID NO: 3235837 - RNA, 22 nt, Human
uccccuguagagugggagcuga

SEQ ID NO: 3235838 - RNA, 23 nt, Human
uccccuguccccgcacugggcuu

SEQ ID NO: 3235839 - RNA, 16 nt, Human
uccccuggggugcagg

SEQ ID NO: 3235840 - RNA, 18 nt, Human
uccccuggggugcaggcg

SEQ ID NO: 3235841 - RNA, 20 nt, Human
uccccuggggugcaggcgcc

SEQ ID NO: 3235842 - RNA, 17 nt, Human
uccccugugccagccca

SEQ ID NO: 3235843 - RNA, 15 nt, Human
uccccuguucacucu

SEQ ID NO: 3235844 - RNA, 20 nt, Human
uccccugugccagcccagag

SEQ ID NO: 3235845 - RNA, 19 nt, Human
uccccugugccagcccaga

SEQ ID NO: 3235846 - RNA, 24 nt, Human
uccccugcuggguguggcgcagca

SEQ ID NO: 3235847 - RNA, 13 nt, Human
uccccugcuggcc

SEQ ID NO: 3235848 - RNA, 19 nt, Human
uccccuggaagcagugccc

SEQ ID NO: 3235849 - RNA, 17 nt, Human
uccccuggaagcagugc

SEQ ID NO: 3235850 - RNA, 19 nt, Human
uccccuguagagugggagc

SEQ ID NO: 3235851 - RNA, 23 nt, Human
uccccuggaagcagugcccaggu

SEQ ID NO: 3235852 - RNA, 22 nt, Human
uccccuggaagcagugcccagg

SEQ ID NO: 3235853 - RNA, 21 nt, Human
uccccuggaagcagugcccag

SEQ ID NO: 3235854 - RNA, 20 nt, Human
uccccuggaagcagugccca

SEQ ID NO: 3235855 - RNA, 22 nt, Human
uccccagacuccaccaagccug

SEQ ID NO: 3235856 - RNA, 21 nt, Human
uccccagaacucugccugccc

SEQ ID NO: 3235857 - RNA, 19 nt, Human
uccccagaacucugccugc

SEQ ID NO: 3235858 - RNA, 17 nt, Human
uccccagaacucugccu

SEQ ID NO: 3235859 - RNA, 22 nt, Human
uccccacuugagaauuacccuu

SEQ ID NO: 3235860 - RNA, 20 nt, Human
ucccaucucacacaugagca

SEQ ID NO: 3235861 - RNA, 16 nt, Human
ucccaggcugagccuc

SEQ ID NO: 3235862 - RNA, 23 nt, Human
ucccaucucacacaugagcauca

SEQ ID NO: 3235863 - RNA, 12 nt, Human
ucccaugcccug

SEQ ID NO: 3235864 - RNA, 11 nt, Human
ucccauggugc

SEQ ID NO: 3235865 - RNA, 22 nt, Human
ucccaggcauuccccaggaggc

SEQ ID NO: 3235866 - RNA, 19 nt, Human
ucccaggcauuccccagga

SEQ ID NO: 3235867 - RNA, 15 nt, Human
ucccaggcugagccu

SEQ ID NO: 3235868 - RNA, 21 nt, Human
ucccaggcgccccuucccccu

SEQ ID NO: 3235869 - RNA, 18 nt, Human
ucccaggcgccccuuccc

SEQ ID NO: 3235870 - RNA, 20 nt, Human
ucccaggcgccccuuccccc

SEQ ID NO: 3235871 - RNA, 20 nt, Human
ucccaggcauuccccaggag

SEQ ID NO: 3235872 - RNA, 21 nt, Human
ucccaggcauuccccaggagg

SEQ ID NO: 3235873 - RNA, 13 nt, Human
ucccaggagccug

SEQ ID NO: 3235874 - RNA, 17 nt, Human
ucccaggagccugccca

SEQ ID NO: 3235875 - RNA, 18 nt, Human
ucccaggagccugcccag

SEQ ID NO: 3235876 - RNA, 15 nt, Human
ucccaccucagccuc

SEQ ID NO: 3235877 - RNA, 14 nt, Human
ucccaccucagccu

SEQ ID NO: 3235878 - RNA, 13 nt, Human
ucccaccucagcc

SEQ ID NO: 3235879 - RNA, 16 nt, Human
ucccaagguucugggu

SEQ ID NO: 3235880 - RNA, 22 nt, Human
ucccaaggcucugagcaaaugu

SEQ ID NO: 3235881 - RNA, 13 nt, Human
uccauggacuuug

SEQ ID NO: 3235882 - RNA, 14 nt, Human
uccauggacuuugu

SEQ ID NO: 3235883 - RNA, 15 nt, Human
uccauggacuuuguu

SEQ ID NO: 3235884 - RNA, 21 nt, Human
ucccaaagugcugggauuaca

SEQ ID NO: 3235885 - RNA, 19 nt, Human
uccauggggucucucacag

SEQ ID NO: 3235886 - RNA, 23 nt, Human
uccauggggucucucacagacag

SEQ ID NO: 3235887 - RNA, 22 nt, Human
uccauggggucucucacagaca

SEQ ID NO: 3235888 - RNA, 21 nt, Human
uccauggguuccaguuucaga

SEQ ID NO: 3235889 - RNA, 23 nt, Human
uccagcucaccagccccagugcc

SEQ ID NO: 3235890 - RNA, 16 nt, Human
uccauccaggccauuc

SEQ ID NO: 3235891 - RNA, 16 nt, Human
ucccaaauuucauacc

SEQ ID NO: 3235892 - RNA, 19 nt, Human
uccauguagccuuuaauau

SEQ ID NO: 3235893 - RNA, 20 nt, Human
uccauguaugcauaauaauc

SEQ ID NO: 3235894 - RNA, 15 nt, Human
uccauguaugcauaa

SEQ ID NO: 3235895 - RNA, 13 nt, Human
ucccaacucaccc

SEQ ID NO: 3235896 - RNA, 21 nt, Human
ucccaaaugugugcccagcuu

SEQ ID NO: 3235897 - RNA, 20 nt, Human
ucccaaaugugugcccagcu

SEQ ID NO: 3235898 - RNA, 14 nt, Human
ucccaacucacccc

SEQ ID NO: 3235899 - RNA, 15 nt, Human
ucccaacucacccca

SEQ ID NO: 3235900 - RNA, 16 nt, Human
ucccaacucaccccag

SEQ ID NO: 3235901 - RNA, 15 nt, Human
ucccaagcucugcuc

SEQ ID NO: 3235902 - RNA, 14 nt, Human
ucccaagcucugcu

SEQ ID NO: 3235903 - RNA, 13 nt, Human
ucccaagcucugc

SEQ ID NO: 3235904 - RNA, 12 nt, Human
ucccaagcucug

SEQ ID NO: 3235905 - RNA, 17 nt, Human
ucccaagcucugcuccu

SEQ ID NO: 3235906 - RNA, 18 nt, Human
ucccaaggcucugagcaa

SEQ ID NO: 3235907 - RNA, 17 nt, Human
uccaaagccaaugugaa

SEQ ID NO: 3235908 - RNA, 15 nt, Human
uccaaagcagagagc

SEQ ID NO: 3235909 - RNA, 12 nt, Human
uccaaagcagag

SEQ ID NO: 3235910 - RNA, 20 nt, Human
uccaagaagcccaggaaagg

SEQ ID NO: 3235911 - RNA, 22 nt, Human
uccaagaagcccaggaaaggcu

SEQ ID NO: 3235912 - RNA, 19 nt, Human
uccaagaagcccaggaaag

SEQ ID NO: 3235913 - RNA, 23 nt, Human
uccaagcauaccaacacgagcag

SEQ ID NO: 3235914 - RNA, 14 nt, Human
ucauuucuuugagu

SEQ ID NO: 3235915 - RNA, 12 nt, Human
ucauuucugauu

SEQ ID NO: 3235916 - RNA, 22 nt, Human
ucauuucugcaucagcugcuga

SEQ ID NO: 3235917 - RNA, 16 nt, Human
ucauuucugcaucagc

SEQ ID NO: 3235918 - RNA, 24 nt, Human
ucauucaccaguacauucucaguu

SEQ ID NO: 3235919 - RNA, 22 nt, Human
ucauucauauuacaauauuugu

SEQ ID NO: 3235920 - RNA, 20 nt, Human
ucauucauauuacaauauuu

SEQ ID NO: 3235921 - RNA, 14 nt, Human
ucauucagcaucug

SEQ ID NO: 3235922 - RNA, 15 nt, Human
ucauucauacuuaaa

SEQ ID NO: 3235923 - RNA, 19 nt, Human
ucauucauacuuaaaaauu

SEQ ID NO: 3235924 - RNA, 12 nt, Human
ucauucauauua

SEQ ID NO: 3235925 - RNA, 19 nt, Human
ucauucauauuacaauauu

SEQ ID NO: 3235926 - RNA, 15 nt, Human
ucauucauauuacaa

SEQ ID NO: 3235927 - RNA, 13 nt, Human
uccaaagaaaguu

SEQ ID NO: 3235928 - RNA, 17 nt, Human
uccaaacuggaaugagc

SEQ ID NO: 3235929 - RNA, 16 nt, Human
uccaaacuggaaugag

SEQ ID NO: 3235930 - RNA, 19 nt, Human
uccaaacuaccuuccaguu

SEQ ID NO: 3235931 - RNA, 14 nt, Human
uccaccuacaugag

SEQ ID NO: 3235932 - RNA, 14 nt, Human
uccaccguccccuc

SEQ ID NO: 3235933 - RNA, 15 nt, Human
uccaccguccccucc

SEQ ID NO: 3235934 - RNA, 12 nt, Human
uccaccugccag

SEQ ID NO: 3235935 - RNA, 22 nt, Human
uccaagcaggacauggacaagg

SEQ ID NO: 3235936 - RNA, 14 nt, Human
uccacaacacacag

SEQ ID NO: 3235937 - RNA, 14 nt, Human
uccacaagagccca

SEQ ID NO: 3235938 - RNA, 12 nt, Human
uccacuuggucu

SEQ ID NO: 3235939 - RNA, 13 nt, Human
uccacuuggucug

SEQ ID NO: 3235940 - RNA, 13 nt, Human
uccaccugccagg

SEQ ID NO: 3235941 - RNA, 13 nt, Human
uccaccucuggga

SEQ ID NO: 3235942 - RNA, 22 nt, Human
uccagaaaugucccuuucuucu

SEQ ID NO: 3235943 - RNA, 16 nt, Human
uccagaaaugucccuu

SEQ ID NO: 3235944 - RNA, 20 nt, Human
uccagaaaugucccuuucuu

SEQ ID NO: 3235945 - RNA, 19 nt, Human
uccagaaaugucccuuucu

SEQ ID NO: 3235946 - RNA, 18 nt, Human
uccagaacucuuccucca

SEQ ID NO: 3235947 - RNA, 16 nt, Human
uccagaacucuuccuc

SEQ ID NO: 3235948 - RNA, 12 nt, Human
uccagcaggagg

SEQ ID NO: 3235949 - RNA, 13 nt, Human
uccagcaggccca

SEQ ID NO: 3235950 - RNA, 12 nt, Human
uccagcaggccc

SEQ ID NO: 3235951 - RNA, 22 nt, Human
uccagcaggagggacagucuca

SEQ ID NO: 3235952 - RNA, 17 nt, Human
uccagcaggagggacag

SEQ ID NO: 3235953 - RNA, 22 nt, Human
uccagcaggcccaugggaggcu

SEQ ID NO: 3235954 - RNA, 15 nt, Human
uccagcaggcccaug

SEQ ID NO: 3235955 - RNA, 18 nt, Human
ucaguugcucaaaaagaa

SEQ ID NO: 3235956 - RNA, 20 nt, Human
ucaguugcucaaaaagaaau

SEQ ID NO: 3235957 - RNA, 13 nt, Human
ucauaaugacuua

SEQ ID NO: 3235958 - RNA, 12 nt, Human
ucaguuguguuu

SEQ ID NO: 3235959 - RNA, 13 nt, Human
ucaguuguguuuu

SEQ ID NO: 3235960 - RNA, 14 nt, Human
ucaguuguguuuuu

SEQ ID NO: 3235961 - RNA, 16 nt, Human
ucaguuguguuuuuua

SEQ ID NO: 3235962 - RNA, 18 nt, Human
ucaguuguguuuuuuaag

SEQ ID NO: 3235963 - RNA, 22 nt, Human
ucaguucaaagucaugauguuu

SEQ ID NO: 3235964 - RNA, 21 nt, Human
ucaguucaaagucaugauguu

SEQ ID NO: 3235965 - RNA, 20 nt, Human
ucaguucaaagucaugaugu

SEQ ID NO: 3235966 - RNA, 16 nt, Human
ucaguucaaagucaug

SEQ ID NO: 3235967 - RNA, 13 nt, Human
ucaguucaaaguc

SEQ ID NO: 3235968 - RNA, 12 nt, Human
ucaguucaaagu

SEQ ID NO: 3235969 - RNA, 15 nt, Human
ucaguuacucuucag

SEQ ID NO: 3235970 - RNA, 23 nt, Human
ucaguuauugucccuggcuuccu

SEQ ID NO: 3235971 - RNA, 19 nt, Human
ucaguuaugacauccacaa

SEQ ID NO: 3235972 - RNA, 20 nt, Human
ucaguuauacaguuauaaaa

SEQ ID NO: 3235973 - RNA, 21 nt, Human
ucaguuauacaguuauaaaau

SEQ ID NO: 3235974 - RNA, 13 nt, Human
ucauacccacccc

SEQ ID NO: 3235975 - RNA, 16 nt, Human
ucauaauuuguuucca

SEQ ID NO: 3235976 - RNA, 19 nt, Human
ucauaauuuguuuccagca

SEQ ID NO: 3235977 - RNA, 17 nt, Human
ucagugugacugaucuc

SEQ ID NO: 3235978 - RNA, 13 nt, Human
ucagugugacuga

SEQ ID NO: 3235979 - RNA, 23 nt, Human
ucagugguuggcaauuguuucaa

SEQ ID NO: 3235980 - RNA, 14 nt, Human
ucaguguaaagugu

SEQ ID NO: 3235981 - RNA, 18 nt, Human
ucaguguacacucugagu

SEQ ID NO: 3235982 - RNA, 15 nt, Human
ucagucuggcccuuc

SEQ ID NO: 3235983 - RNA, 20 nt, Human
ucaguggggcccauggaugu

SEQ ID NO: 3235984 - RNA, 24 nt, Human
ucagucugauucccaagcucugcu

SEQ ID NO: 3235985 - RNA, 13 nt, Human
ucauguaauuuua

SEQ ID NO: 3235986 - RNA, 23 nt, Human
ucauucaccaguacauucucagu

SEQ ID NO: 3235987 - RNA, 13 nt, Human
ucauguaaauuga

SEQ ID NO: 3235988 - RNA, 22 nt, Human
ucauguaaauugacuguacuag

SEQ ID NO: 3235989 - RNA, 20 nt, Human
ucauacccacccccacccaa

SEQ ID NO: 3235990 - RNA, 14 nt, Human
ucauacccaccccc

SEQ ID NO: 3235991 - RNA, 15 nt, Human
ucauacccaccccca

SEQ ID NO: 3235992 - RNA, 14 nt, Human
ucauagguuaaaaa

SEQ ID NO: 3235993 - RNA, 15 nt, Human
ucauagguuaaaaaa

SEQ ID NO: 3235994 - RNA, 20 nt, Human
ucauagguuaaaaaaaaaag

SEQ ID NO: 3235995 - RNA, 21 nt, Human
ucauagguuaaaaaaaaaagu

SEQ ID NO: 3235996 - RNA, 23 nt, Human
ucauagguuaaaaaaaaaaguca

SEQ ID NO: 3235997 - RNA, 16 nt, Human
ucaucuguaagcuguu

SEQ ID NO: 3235998 - RNA, 11 nt, Human
ucaucuguaag

SEQ ID NO: 3235999 - RNA, 21 nt, Human
ucaucucuagggaccagaacc

SEQ ID NO: 3236000 - RNA, 22 nt, Human
ucaucucuagggaccagaacca

SEQ ID NO: 3236001 - RNA, 19 nt, Human
uccuucuguccuacucugu

SEQ ID NO: 3236002 - RNA, 12 nt, Human
uccuucuguccu

SEQ ID NO: 3236003 - RNA, 13 nt, Human
uccuucugggcau

SEQ ID NO: 3236004 - RNA, 17 nt, Human
uccugucaucugagaau

SEQ ID NO: 3236005 - RNA, 20 nt, Human
uccuuacaaaugauugcuuu

SEQ ID NO: 3236006 - RNA, 18 nt, Human
uccuuacaaaugauugcu

SEQ ID NO: 3236007 - RNA, 16 nt, Human
uccuuacaaaugauug

SEQ ID NO: 3236008 - RNA, 15 nt, Human
uccuuacaaaugauu

SEQ ID NO: 3236009 - RNA, 15 nt, Human
uccugucaucugaga

SEQ ID NO: 3236010 - RNA, 19 nt, Human
uccugucaagcaaucaaga

SEQ ID NO: 3236011 - RNA, 16 nt, Human
uccuucaaagcaaaug

SEQ ID NO: 3236012 - RNA, 13 nt, Human
uccuucaaagucu

SEQ ID NO: 3236013 - RNA, 18 nt, Human
uccuucaaagucucaaug

SEQ ID NO: 3236014 - RNA, 17 nt, Human
uccuuaugcuugggccu

SEQ ID NO: 3236015 - RNA, 15 nt, Human
uccuuacauaaacau

SEQ ID NO: 3236016 - RNA, 19 nt, Human
uccuucaacaaggcuugcu

SEQ ID NO: 3236017 - RNA, 20 nt, Human
uccuucaacaaggcuugcug

SEQ ID NO: 3236018 - RNA, 21 nt, Human
uccuuauggguagggcucuga

SEQ ID NO: 3236019 - RNA, 21 nt, Human
uccuucaacaaggcuugcugc

SEQ ID NO: 3236020 - RNA, 23 nt, Human
uccugguccuaggcuggaaggag

SEQ ID NO: 3236021 - RNA, 14 nt, Human
uccuggucgaaagu

SEQ ID NO: 3236022 - RNA, 10 nt, Human
ucccucccuu

SEQ ID NO: 3236023 - RNA, 22 nt, Human
uccuggcaugggaaugaauguc

SEQ ID NO: 3236024 - RNA, 17 nt, Human
uccuggcccacugcauc

SEQ ID NO: 3236025 - RNA, 15 nt, Human
uccugguguggaaga

SEQ ID NO: 3236026 - RNA, 11 nt, Human
uccugguuccu

SEQ ID NO: 3236027 - RNA, 19 nt, Human
uccuguaggaguucuauuu

SEQ ID NO: 3236028 - RNA, 10 nt, Human
uccuguaaac

SEQ ID NO: 3236029 - RNA, 20 nt, Human
uccuguaaacacucagcugu

SEQ ID NO: 3236030 - RNA, 21 nt, Human
uccuguaaacacucagcuguu

SEQ ID NO: 3236031 - RNA, 23 nt, Human
uccuuuuggagucagacagaugu

SEQ ID NO: 3236032 - RNA, 14 nt, Human
uccuuuuggaguca

SEQ ID NO: 3236033 - RNA, 13 nt, Human
uccuuuuuauuua

SEQ ID NO: 3236034 - RNA, 14 nt, Human
uccuuuuuauuuau

SEQ ID NO: 3236035 - RNA, 15 nt, Human
uccuuuuuauuuaua

SEQ ID NO: 3236036 - RNA, 18 nt, Human
uccuuuuuauuuauaugu

SEQ ID NO: 3236037 - RNA, 12 nt, Human
uccuuuuguguu

SEQ ID NO: 3236038 - RNA, 19 nt, Human
uccuuuuguguuccaaaca

SEQ ID NO: 3236039 - RNA, 16 nt, Human
uccuuuuguguuccaa

SEQ ID NO: 3236040 - RNA, 13 nt, Human
uccuuuuguguuc

SEQ ID NO: 3236041 - RNA, 15 nt, Human
ucgaguuacagacaa

SEQ ID NO: 3236042 - RNA, 14 nt, Human
ucgagucugaggcc

SEQ ID NO: 3236043 - RNA, 20 nt, Human
ucgagugccgcaucucacag

SEQ ID NO: 3236044 - RNA, 22 nt, Human
ucgagugccgcaucucacagcu

SEQ ID NO: 3236045 - RNA, 23 nt, Human
ucgagugccgcaucucacagcua

SEQ ID NO: 3236046 - RNA, 23 nt, Human
ucgagugagacagacuagaaguu

SEQ ID NO: 3236047 - RNA, 14 nt, Human
ucgagugagacaga

SEQ ID NO: 3236048 - RNA, 17 nt, Human
ucgaguuacagacaaag

SEQ ID NO: 3236049 - RNA, 17 nt, Human
ucgaguuacagccuggg

SEQ ID NO: 3236050 - RNA, 16 nt, Human
ucgaguggcccaacag

SEQ ID NO: 3236051 - RNA, 22 nt, Human
uccuuuuuauuuauauguaugu

SEQ ID NO: 3236052 - RNA, 23 nt, Human
uccuuuuuauuuauauguaugug

SEQ ID NO: 3236053 - RNA, 12 nt, Human
ucgaaaaaauaa

SEQ ID NO: 3236054 - RNA, 13 nt, Human
ucgaaaaaauaau

SEQ ID NO: 3236055 - RNA, 17 nt, Human
ucgaaaaaauaauuauu

SEQ ID NO: 3236056 - RNA, 18 nt, Human
ucgaaaaaauaauuauuu

SEQ ID NO: 3236057 - RNA, 13 nt, Human
ucgagucugaggc

SEQ ID NO: 3236058 - RNA, 23 nt, Human
ucgcugugucagcauagaaguaa

SEQ ID NO: 3236059 - RNA, 22 nt, Human
ucgcuucuuagaacaguggaaa

SEQ ID NO: 3236060 - RNA, 20 nt, Human
ucggaaccugugagcugcac

SEQ ID NO: 3236061 - RNA, 12 nt, Human
ucgcccaggcug

SEQ ID NO: 3236062 - RNA, 14 nt, Human
ucgcccaggcugga

SEQ ID NO: 3236063 - RNA, 14 nt, Human
ucgcccagucccag

SEQ ID NO: 3236064 - RNA, 21 nt, Human
ucgcccagucccagcagccag

SEQ ID NO: 3236065 - RNA, 19 nt, Human
ucgcccagucccagcagcc

SEQ ID NO: 3236066 - RNA, 18 nt, Human
ucgcccagucccagcagc

SEQ ID NO: 3236067 - RNA, 17 nt, Human
ucgcccagucccagcag

SEQ ID NO: 3236068 - RNA, 19 nt, Human
ucgcccaggcuggagugca

SEQ ID NO: 3236069 - RNA, 17 nt, Human
ucgcaauguaagacucg

SEQ ID NO: 3236070 - RNA, 19 nt, Human
ucgcacucuggcagcaccg

SEQ ID NO: 3236071 - RNA, 21 nt, Human
ucgcacucuggcagcaccgcc

SEQ ID NO: 3236072 - RNA, 22 nt, Human
ucucaacaaggcaaaaacaaag

SEQ ID NO: 3236073 - RNA, 18 nt, Human
ucucaacaugucuccuac

SEQ ID NO: 3236074 - RNA, 14 nt, Human
ucucaacaugucuc

SEQ ID NO: 3236075 - RNA, 21 nt, Human
ucucaaacucuugaccucagg

SEQ ID NO: 3236076 - RNA, 13 nt, Human
ucucaaacucuug

SEQ ID NO: 3236077 - RNA, 22 nt, Human
ucucaaacucuugaccucaggu

SEQ ID NO: 3236078 - RNA, 13 nt, Human
ucuaguacuguga

SEQ ID NO: 3236079 - RNA, 21 nt, Human
ucuaguaauauauuuaaaggg

SEQ ID NO: 3236080 - RNA, 14 nt, Human
ucuaguaauauauu

SEQ ID NO: 3236081 - RNA, 15 nt, Human
ucuaguacugugaau

SEQ ID NO: 3236082 - RNA, 14 nt, Human
ucuaguacugugaa

SEQ ID NO: 3236083 - RNA, 15 nt, Human
ucuaguaauaaagac

SEQ ID NO: 3236084 - RNA, 19 nt, Human
ucuaguaauaaagacucua

SEQ ID NO: 3236085 - RNA, 17 nt, Human
ucuaguaauaaagacuc

SEQ ID NO: 3236086 - RNA, 22 nt, Human
ucuaguauuuauggguggauuu

SEQ ID NO: 3236087 - RNA, 17 nt, Human
ucucacucugucgccca

SEQ ID NO: 3236088 - RNA, 16 nt, Human
ucucacucugucgccc

SEQ ID NO: 3236089 - RNA, 18 nt, Human
ucucacucugucgcccag

SEQ ID NO: 3236090 - RNA, 21 nt, Human
ucucacuguugcccaggcugg

SEQ ID NO: 3236091 - RNA, 20 nt, Human
ucucacuguugcccaggcug

SEQ ID NO: 3236092 - RNA, 19 nt, Human
ucucacuguugcccaggcu

SEQ ID NO: 3236093 - RNA, 18 nt, Human
ucucacuguugcccaggc

SEQ ID NO: 3236094 - RNA, 21 nt, Human
ucucagaaucucaaauaacua

SEQ ID NO: 3236095 - RNA, 17 nt, Human
ucucagaaucucaaaua

SEQ ID NO: 3236096 - RNA, 16 nt, Human
ucucagggugucccag

SEQ ID NO: 3236097 - RNA, 17 nt, Human
ucucagggugucccaga

SEQ ID NO: 3236098 - RNA, 18 nt, Human
ucucagggugucccagac

SEQ ID NO: 3236099 - RNA, 17 nt, Human
ucucacuguugcccagg

SEQ ID NO: 3236100 - RNA, 21 nt, Human
ucuaaaucuguccaacugaga

SEQ ID NO: 3236101 - RNA, 14 nt, Human
ucuaaaucugucca

SEQ ID NO: 3236102 - RNA, 18 nt, Human
ucuagaagagucuauugu

SEQ ID NO: 3236103 - RNA, 19 nt, Human
ucuagaagagucuauuguc

SEQ ID NO: 3236104 - RNA, 20 nt, Human
ucuagaagagucuauugucu

SEQ ID NO: 3236105 - RNA, 21 nt, Human
ucuagaagagucuauugucuc

SEQ ID NO: 3236106 - RNA, 22 nt, Human
ucuacugaggugcuauguucuu

SEQ ID NO: 3236107 - RNA, 24 nt, Human
ucuacugcauuuagggaguauucu

SEQ ID NO: 3236108 - RNA, 22 nt, Human
ucuagggaaaaaccagcgugug

SEQ ID NO: 3236109 - RNA, 19 nt, Human
ucuagggaaaaaccagcgu

SEQ ID NO: 3236110 - RNA, 17 nt, Human
ucuagggaccagaacca

SEQ ID NO: 3236111 - RNA, 12 nt, Human
ucuaacuguaua

SEQ ID NO: 3236112 - RNA, 17 nt, Human
ucuaacuguauauuugu

SEQ ID NO: 3236113 - RNA, 18 nt, Human
ucuaacuguauauuugua

SEQ ID NO: 3236114 - RNA, 17 nt, Human
ucuacacuccagugaga

SEQ ID NO: 3236115 - RNA, 12 nt, Human
ucuacacugugc

SEQ ID NO: 3236116 - RNA, 14 nt, Human
ucuacacugugcug

SEQ ID NO: 3236117 - RNA, 19 nt, Human
ucuacugaggugcuauguu

SEQ ID NO: 3236118 - RNA, 18 nt, Human
ucuacugaggugcuaugu

SEQ ID NO: 3236119 - RNA, 15 nt, Human
ucuacacugugcuga

SEQ ID NO: 3236120 - RNA, 18 nt, Human
ucucuucacagucacauu

SEQ ID NO: 3236121 - RNA, 18 nt, Human
ucucuuccaggcagccgc

SEQ ID NO: 3236122 - RNA, 23 nt, Human
ucucuuccaaccauuuaucuuga

SEQ ID NO: 3236123 - RNA, 16 nt, Human
ucucuuccacauguua

SEQ ID NO: 3236124 - RNA, 16 nt, Human
ucucuuccaggcagcc

SEQ ID NO: 3236125 - RNA, 15 nt, Human
ucucuuccaggcagc

SEQ ID NO: 3236126 - RNA, 14 nt, Human
ucucuucucugcca

SEQ ID NO: 3236127 - RNA, 13 nt, Human
ucucuucuccuua

SEQ ID NO: 3236128 - RNA, 11 nt, Human
ucucuuugccc

SEQ ID NO: 3236129 - RNA, 14 nt, Human
ucucuuugaaacau

SEQ ID NO: 3236130 - RNA, 12 nt, Human
ucucuuugaaac

SEQ ID NO: 3236131 - RNA, 12 nt, Human
ucucuucuccuu

SEQ ID NO: 3236132 - RNA, 11 nt, Human
ucucuucuccu

SEQ ID NO: 3236133 - RNA, 21 nt, Human
ucucuucuccccuuccauuuc

SEQ ID NO: 3236134 - RNA, 18 nt, Human
ucucuucuccccuuccau

SEQ ID NO: 3236135 - RNA, 16 nt, Human
ucucuucuccacugga

SEQ ID NO: 3236136 - RNA, 15 nt, Human
ucucuucuccacugg

SEQ ID NO: 3236137 - RNA, 14 nt, Human
ucucuucuccacug

SEQ ID NO: 3236138 - RNA, 13 nt, Human
ucucuucuccacu

SEQ ID NO: 3236139 - RNA, 11 nt, Human
ucucuucucca

SEQ ID NO: 3236140 - RNA, 13 nt, Human
ucugaaagggacg

SEQ ID NO: 3236141 - RNA, 23 nt, Human
ucugaaaauguauguguaaguau

SEQ ID NO: 3236142 - RNA, 14 nt, Human
ucugaaaauguaug

SEQ ID NO: 3236143 - RNA, 17 nt, Human
ucugaaauauaaagucu

SEQ ID NO: 3236144 - RNA, 16 nt, Human
ucucuuuucaaaacau

SEQ ID NO: 3236145 - RNA, 14 nt, Human
ucucuuuucaagaa

SEQ ID NO: 3236146 - RNA, 15 nt, Human
ucucuuuucaaaaca

SEQ ID NO: 3236147 - RNA, 16 nt, Human
ucugaaaauguaugug

SEQ ID NO: 3236148 - RNA, 21 nt, Human
ucucuuuuugcccccucuccu

SEQ ID NO: 3236149 - RNA, 19 nt, Human
ucugagcuuacguaguucu

SEQ ID NO: 3236150 - RNA, 17 nt, Human
ucugagcuuacguaguu

SEQ ID NO: 3236151 - RNA, 22 nt, Human
ucugagcuggccucucacugcc

SEQ ID NO: 3236152 - RNA, 16 nt, Human
ucugagcuggccucuc

SEQ ID NO: 3236153 - RNA, 17 nt, Human
ucugaggacaagagaaa

SEQ ID NO: 3236154 - RNA, 14 nt, Human
ucugaggacaagag

SEQ ID NO: 3236155 - RNA, 23 nt, Human
ucugaggacacuaaccacgcugg

SEQ ID NO: 3236156 - RNA, 20 nt, Human
ucugaggacacuaaccacgc

SEQ ID NO: 3236157 - RNA, 17 nt, Human
ucugaggaauccagacc

SEQ ID NO: 3236158 - RNA, 16 nt, Human
ucugaggaauccagac

SEQ ID NO: 3236159 - RNA, 22 nt, Human
ucugagcauuagauuucucauu

SEQ ID NO: 3236160 - RNA, 23 nt, Human
ucugauucccaagcucugcuccu

SEQ ID NO: 3236161 - RNA, 15 nt, Human
ucugauucuucaaag

SEQ ID NO: 3236162 - RNA, 18 nt, Human
ucugaggacaagagaaaa

SEQ ID NO: 3236163 - RNA, 14 nt, Human
ucugcacaagcugc

SEQ ID NO: 3236164 - RNA, 19 nt, Human
ucugcacaagcugcacccu

SEQ ID NO: 3236165 - RNA, 14 nt, Human
ucugcacacaaaua

SEQ ID NO: 3236166 - RNA, 16 nt, Human
ucugcacacaaauauu

SEQ ID NO: 3236167 - RNA, 17 nt, Human
ucugcacacaaauauua

SEQ ID NO: 3236168 - RNA, 15 nt, Human
ucugacccaugcugc

SEQ ID NO: 3236169 - RNA, 16 nt, Human
ucugacccaugcugcc

SEQ ID NO: 3236170 - RNA, 17 nt, Human
ucugacccaugcugccc

SEQ ID NO: 3236171 - RNA, 18 nt, Human
ucugacccaugcugcccu

SEQ ID NO: 3236172 - RNA, 24 nt, Human
ucugagaucaaaacgguuuuacug

SEQ ID NO: 3236173 - RNA, 20 nt, Human
ucugagcauuagauuucuca

SEQ ID NO: 3236174 - RNA, 19 nt, Human
ucugagcaccgaauauuga

SEQ ID NO: 3236175 - RNA, 22 nt, Human
ucugagcaccgaauauugagca

SEQ ID NO: 3236176 - RNA, 22 nt, Human
ucugagcaagaggauuuugcgu

SEQ ID NO: 3236177 - RNA, 20 nt, Human
ucugaacuuggcgcugcccc

SEQ ID NO: 3236178 - RNA, 15 nt, Human
ucugacccacugcuu

SEQ ID NO: 3236179 - RNA, 14 nt, Human
ucugacccaugcug

SEQ ID NO: 3236180 - RNA, 16 nt, Human
ucucccgggacucugc

SEQ ID NO: 3236181 - RNA, 22 nt, Human
ucuccucuugccacugccucuu

SEQ ID NO: 3236182 - RNA, 22 nt, Human
ucuccugaaaaaagcaguucuu

SEQ ID NO: 3236183 - RNA, 19 nt, Human
ucuccugcguguucucaga

SEQ ID NO: 3236184 - RNA, 19 nt, Human
ucuccugccucagccuccc

SEQ ID NO: 3236185 - RNA, 22 nt, Human
ucuccugccucagccucccaaa

SEQ ID NO: 3236186 - RNA, 22 nt, Human
ucucagugguuaagauuccuaa

SEQ ID NO: 3236187 - RNA, 13 nt, Human
ucucagugcuuuc

SEQ ID NO: 3236188 - RNA, 15 nt, Human
ucucagugcuuuccu

SEQ ID NO: 3236189 - RNA, 21 nt, Human
ucucagugucaaugcagcccc

SEQ ID NO: 3236190 - RNA, 16 nt, Human
ucucaggucugaguug

SEQ ID NO: 3236191 - RNA, 15 nt, Human
ucucaggucccugca

SEQ ID NO: 3236192 - RNA, 20 nt, Human
ucucagguuuguuuugugaa

SEQ ID NO: 3236193 - RNA, 21 nt, Human
ucucagguuuguuuugugaau

SEQ ID NO: 3236194 - RNA, 15 nt, Human
ucucccccagcccca

SEQ ID NO: 3236195 - RNA, 17 nt, Human
ucucccccagccccauc

SEQ ID NO: 3236196 - RNA, 14 nt, Human
ucucccccagcccc

SEQ ID NO: 3236197 - RNA, 22 nt, Human
ucucccccagccccauccucug

SEQ ID NO: 3236198 - RNA, 13 nt, Human
ucucccccagccc

SEQ ID NO: 3236199 - RNA, 18 nt, Human
ucucccccagccccaucc

SEQ ID NO: 3236200 - RNA, 20 nt, Human
ucucccccagccccauccuc

SEQ ID NO: 3236201 - RNA, 21 nt, Human
ucuccccuuccauuucugccu

SEQ ID NO: 3236202 - RNA, 21 nt, Human
ucucucuauuucccccuuucu

SEQ ID NO: 3236203 - RNA, 17 nt, Human
ucucucucaauuuuugg

SEQ ID NO: 3236204 - RNA, 17 nt, Human
ucucuauuccccacccu

SEQ ID NO: 3236205 - RNA, 14 nt, Human
ucucuauuccccac

SEQ ID NO: 3236206 - RNA, 23 nt, Human
ucucuauuucccccuuucuuccu

SEQ ID NO: 3236207 - RNA, 18 nt, Human
ucucuauuugaauuauuu

SEQ ID NO: 3236208 - RNA, 22 nt, Human
ucucucuuguucuuacuuuccu

SEQ ID NO: 3236209 - RNA, 13 nt, Human
ucucugaggacac

SEQ ID NO: 3236210 - RNA, 15 nt, Human
ucucuacaaaaagca

SEQ ID NO: 3236211 - RNA, 21 nt, Human
ucuccugcguguucucagagg

SEQ ID NO: 3236212 - RNA, 20 nt, Human
ucuuuugguuaugaauacuu

SEQ ID NO: 3236213 - RNA, 20 nt, Human
ucuuuugcuugccaaaguac

SEQ ID NO: 3236214 - RNA, 20 nt, Human
ucuuuucuuugccaucucug

SEQ ID NO: 3236215 - RNA, 12 nt, Human
ucuuuucuuauu

SEQ ID NO: 3236216 - RNA, 18 nt, Human
ucuuuucugaaucuucug

SEQ ID NO: 3236217 - RNA, 15 nt, Human
ucuuuucugaaucuu

SEQ ID NO: 3236218 - RNA, 14 nt, Human
ucuuuucugaaucu

SEQ ID NO: 3236219 - RNA, 12 nt, Human
ucuuuucugaau

SEQ ID NO: 3236220 - RNA, 22 nt, Human
ucuuuucugaaucuucugaaac

SEQ ID NO: 3236221 - RNA, 20 nt, Human
ucuuuucugaaucuucugaa

SEQ ID NO: 3236222 - RNA, 19 nt, Human
ucuuuucugaaucuucuga

SEQ ID NO: 3236223 - RNA, 12 nt, Human
ucuuuucuugga

SEQ ID NO: 3236224 - RNA, 13 nt, Human
ucuuuucuuggac

SEQ ID NO: 3236225 - RNA, 18 nt, Human
ucuuuucuuugccaucuc

SEQ ID NO: 3236226 - RNA, 19 nt, Human
ugaaaacuuuaugcuaagu

SEQ ID NO: 3236227 - RNA, 16 nt, Human
ugaaaacuaaguucuc

SEQ ID NO: 3236228 - RNA, 15 nt, Human
ugaaaagaaggaaag

SEQ ID NO: 3236229 - RNA, 16 nt, Human
ugaaaagaaggaaaga

SEQ ID NO: 3236230 - RNA, 15 nt, Human
ugaaaagaaguagug

SEQ ID NO: 3236231 - RNA, 16 nt, Human
ugaaaacuuuguagua

SEQ ID NO: 3236232 - RNA, 13 nt, Human
ugaaaacuuugua

SEQ ID NO: 3236233 - RNA, 22 nt, Human
ugaaaagaaaaaugagccuggc

SEQ ID NO: 3236234 - RNA, 19 nt, Human
ugaaaagacuccaaagaaa

SEQ ID NO: 3236235 - RNA, 17 nt, Human
ugaaaagacuccaaaga

SEQ ID NO: 3236236 - RNA, 16 nt, Human
ugaaaagacuccaaag

SEQ ID NO: 3236237 - RNA, 15 nt, Human
ugaaaagacuccaaa

SEQ ID NO: 3236238 - RNA, 16 nt, Human
ucuuuuugcuuugcuu

SEQ ID NO: 3236239 - RNA, 14 nt, Human
ucuuuuugaaucuu

SEQ ID NO: 3236240 - RNA, 15 nt, Human
ucuuuuuuauuaauc

SEQ ID NO: 3236241 - RNA, 24 nt, Human
ucuuuuuuauuaaucacuguguau

SEQ ID NO: 3236242 - RNA, 16 nt, Human
ucuuuuuuauuaauca

SEQ ID NO: 3236243 - RNA, 21 nt, Human
ucuuuuuuauuaaucacugug

SEQ ID NO: 3236244 - RNA, 19 nt, Human
ucuuuuuuacaaaggcugu

SEQ ID NO: 3236245 - RNA, 18 nt, Human
ucuuuuuuacaaaggcug

SEQ ID NO: 3236246 - RNA, 13 nt, Human
ucuuuuuuacaaa

SEQ ID NO: 3236247 - RNA, 20 nt, Human
ucuuuuugcucuaaaauauu

SEQ ID NO: 3236248 - RNA, 17 nt, Human
ucuuuuugcucuaaaau

SEQ ID NO: 3236249 - RNA, 16 nt, Human
ugaaauccugguuccu

SEQ ID NO: 3236250 - RNA, 17 nt, Human
ugaaaucuuuuugcuuu

SEQ ID NO: 3236251 - RNA, 18 nt, Human
ugaaaggcaaacauuuga

SEQ ID NO: 3236252 - RNA, 17 nt, Human
ugaaagggcccagagag

SEQ ID NO: 3236253 - RNA, 16 nt, Human
ugaaagggcccagaga

SEQ ID NO: 3236254 - RNA, 15 nt, Human
ugaaagggcccagag

SEQ ID NO: 3236255 - RNA, 22 nt, Human
ugaaaugaggucagagccugca

SEQ ID NO: 3236256 - RNA, 21 nt, Human
ugaaaugaggucagagccugc

SEQ ID NO: 3236257 - RNA, 23 nt, Human
ugaaaugaggucagagccugcag

SEQ ID NO: 3236258 - RNA, 20 nt, Human
ugaaaugaggucagagccug

SEQ ID NO: 3236259 - RNA, 19 nt, Human
ugaaaugaggucagagccu

SEQ ID NO: 3236260 - RNA, 22 nt, Human
ugaaaugaacacaaauuaugcu

SEQ ID NO: 3236261 - RNA, 18 nt, Human
ugaaaugaacacaaauua

SEQ ID NO: 3236262 - RNA, 17 nt, Human
ugaaaugaacacaaauu

SEQ ID NO: 3236263 - RNA, 14 nt, Human
ugaaaugaacacaa

SEQ ID NO: 3236264 - RNA, 13 nt, Human
ugaaaugaacaca

SEQ ID NO: 3236265 - RNA, 22 nt, Human
ugaaaagaggugugcaagagag

SEQ ID NO: 3236266 - RNA, 18 nt, Human
ugaaacccugucucuacu

SEQ ID NO: 3236267 - RNA, 13 nt, Human
ugaaaagaggugu

SEQ ID NO: 3236268 - RNA, 16 nt, Human
ugaaaagagacaggca

SEQ ID NO: 3236269 - RNA, 22 nt, Human
ugaaaagacuccaaagaaaugu

SEQ ID NO: 3236270 - RNA, 19 nt, Human
ugaaagauggcugugccuc

SEQ ID NO: 3236271 - RNA, 21 nt, Human
ugaaagauggcugugccucug

SEQ ID NO: 3236272 - RNA, 23 nt, Human
ugaaagauggcugugccucugcc

SEQ ID NO: 3236273 - RNA, 22 nt, Human
ugaaagauggcugugccucugc

SEQ ID NO: 3236274 - RNA, 18 nt, Human
ugaaagcagggacuugaa

SEQ ID NO: 3236275 - RNA, 19 nt, Human
ugaaagcagggacuugaac

SEQ ID NO: 3236276 - RNA, 17 nt, Human
ugaaaggaaagaggcuc

SEQ ID NO: 3236277 - RNA, 22 nt, Human
ugaaaggaauuuugcuaaguaa

SEQ ID NO: 3236278 - RNA, 17 nt, Human
ugaaaggaauuuugcua

SEQ ID NO: 3236279 - RNA, 12 nt, Human
ugaaaggaaaga

SEQ ID NO: 3236280 - RNA, 15 nt, Human
ugaacugagcuugga

SEQ ID NO: 3236281 - RNA, 12 nt, Human
ugaacugagcuu

SEQ ID NO: 3236282 - RNA, 17 nt, Human
ugaacugaacucugaca

SEQ ID NO: 3236283 - RNA, 19 nt, Human
ugaacugaacucugacaac

SEQ ID NO: 3236284 - RNA, 11 nt, Human
ugaacugaagg

SEQ ID NO: 3236285 - RNA, 16 nt, Human
ugaacugagcuuggaa

SEQ ID NO: 3236286 - RNA, 15 nt, Human
ugaacucuucaaucu

SEQ ID NO: 3236287 - RNA, 21 nt, Human
ugaaccacaucuugcucugcu

SEQ ID NO: 3236288 - RNA, 20 nt, Human
ugaaccacaucuugcucugc

SEQ ID NO: 3236289 - RNA, 18 nt, Human
ugaacucuucaaucucuu

SEQ ID NO: 3236290 - RNA, 14 nt, Human
ugaacucuucucau

SEQ ID NO: 3236291 - RNA, 18 nt, Human
ugaacucuucucauuacu

SEQ ID NO: 3236292 - RNA, 21 nt, Human
ugaacucuucucauuacuugu

SEQ ID NO: 3236293 - RNA, 12 nt, Human
ugaacugaaagu

SEQ ID NO: 3236294 - RNA, 14 nt, Human
ugaacugaacucug

SEQ ID NO: 3236295 - RNA, 14 nt, Human
ugaacacaucagcu

SEQ ID NO: 3236296 - RNA, 14 nt, Human
ugaacacaaauuau

SEQ ID NO: 3236297 - RNA, 12 nt, Human
ugaacacaaauu

SEQ ID NO: 3236298 - RNA, 17 nt, Human
ugaacacaaauuaugcu

SEQ ID NO: 3236299 - RNA, 12 nt, Human
ugaacacauuuc

SEQ ID NO: 3236300 - RNA, 14 nt, Human
ugaacacauuucuu

SEQ ID NO: 3236301 - RNA, 19 nt, Human
ugaaaugcugaaaauugcc

SEQ ID NO: 3236302 - RNA, 17 nt, Human
ugaaaugcugaaaauug

SEQ ID NO: 3236303 - RNA, 16 nt, Human
ugaaaugcugaaaauu

SEQ ID NO: 3236304 - RNA, 15 nt, Human
ugaaaugcugaaaau

SEQ ID NO: 3236305 - RNA, 22 nt, Human
ugaaaugcuaugucauuucaug

SEQ ID NO: 3236306 - RNA, 21 nt, Human
ugaaaugcuaugucauuucau

SEQ ID NO: 3236307 - RNA, 20 nt, Human
ugaaaugcuaugucauuuca

SEQ ID NO: 3236308 - RNA, 18 nt, Human
ugaaaugcuaugucauuu

SEQ ID NO: 3236309 - RNA, 17 nt, Human
ugaaaugcuaugucauu

SEQ ID NO: 3236310 - RNA, 15 nt, Human
ugaacauacaaaugc

SEQ ID NO: 3236311 - RNA, 16 nt, Human
ugaacauaauucuuau

SEQ ID NO: 3236312 - RNA, 16 nt, Human
ugaacauacaaaugca

SEQ ID NO: 3236313 - RNA, 23 nt, Human
ugaacauacaaaugcaucuuuga

SEQ ID NO: 3236314 - RNA, 19 nt, Human
ugaaccacaucuugcucug

SEQ ID NO: 3236315 - RNA, 19 nt, Human
ugaacauucuccuguggaa

SEQ ID NO: 3236316 - RNA, 13 nt, Human
ugaacauguuuua

SEQ ID NO: 3236317 - RNA, 22 nt, Human
ugaacauuaauccacauguuuc

SEQ ID NO: 3236318 - RNA, 21 nt, Human
ugaaggcucgagcaugccugg

SEQ ID NO: 3236319 - RNA, 20 nt, Human
ugaaggcucgagcaugccug

SEQ ID NO: 3236320 - RNA, 15 nt, Human
ugaaggaugccaaga

SEQ ID NO: 3236321 - RNA, 21 nt, Human
ugaaggauuauggaaaaauaa

SEQ ID NO: 3236322 - RNA, 22 nt, Human
ugaaggauuauggaaaaauaaa

SEQ ID NO: 3236323 - RNA, 22 nt, Human
ugaaggaggcuccaggcagcac

SEQ ID NO: 3236324 - RNA, 21 nt, Human
ugaaggaggcuccaggcagca

SEQ ID NO: 3236325 - RNA, 20 nt, Human
ugaaggaggcuccaggcagc

SEQ ID NO: 3236326 - RNA, 14 nt, Human
ugaaggaggccacc

SEQ ID NO: 3236327 - RNA, 17 nt, Human
ugaaggaggccaccucc

SEQ ID NO: 3236328 - RNA, 16 nt, Human
ugaaggaggccaccuc

SEQ ID NO: 3236329 - RNA, 19 nt, Human
ugaaggaggcuccaggcag

SEQ ID NO: 3236330 - RNA, 21 nt, Human
ugaaggaggccaccuccuaaa

SEQ ID NO: 3236331 - RNA, 20 nt, Human
ugaaggaggccaccuccuaa

SEQ ID NO: 3236332 - RNA, 18 nt, Human
ugaaggaggccaccuccu

SEQ ID NO: 3236333 - RNA, 19 nt, Human
ugaagauacuuuguauugu

SEQ ID NO: 3236334 - RNA, 20 nt, Human
ugaaggagagcccuucauuu

SEQ ID NO: 3236335 - RNA, 22 nt, Human
ugaagaugggggccucuuucag

SEQ ID NO: 3236336 - RNA, 18 nt, Human
ugaagaugggggccucuu

SEQ ID NO: 3236337 - RNA, 14 nt, Human
ugaagacagagcua

SEQ ID NO: 3236338 - RNA, 16 nt, Human
ugaagacagagcuaca

SEQ ID NO: 3236339 - RNA, 13 nt, Human
ugaagacagagcu

SEQ ID NO: 3236340 - RNA, 14 nt, Human
ugaacuuggcgcug

SEQ ID NO: 3236341 - RNA, 12 nt, Human
ugaacuugguuc

SEQ ID NO: 3236342 - RNA, 19 nt, Human
ugaacuggguacuugugga

SEQ ID NO: 3236343 - RNA, 17 nt, Human
ugaagacuuuucuuuca

SEQ ID NO: 3236344 - RNA, 22 nt, Human
ugaagacuuuucuuucagccaa

SEQ ID NO: 3236345 - RNA, 15 nt, Human
ugaagaggaggagga

SEQ ID NO: 3236346 - RNA, 18 nt, Human
ugaagaggaggaggaggg

SEQ ID NO: 3236347 - RNA, 14 nt, Human
ugaagacuuuucuu

SEQ ID NO: 3236348 - RNA, 23 nt, Human
ugaagaccuaaccagggccagaa

SEQ ID NO: 3236349 - RNA, 22 nt, Human
ugaagaccuaaccagggccaga

SEQ ID NO: 3236350 - RNA, 19 nt, Human
ugaagaccuaaccagggcc

SEQ ID NO: 3236351 - RNA, 17 nt, Human
ugaagaccuaaccaggg

SEQ ID NO: 3236352 - RNA, 23 nt, Human
ugaagacagcccgauccuccccu

SEQ ID NO: 3236353 - RNA, 15 nt, Human
ugaagaccuaaccag

SEQ ID NO: 3236354 - RNA, 16 nt, Human
ugaacuuggaagcaca

SEQ ID NO: 3236355 - RNA, 15 nt, Human
ugaagacagcccgau

SEQ ID NO: 3236356 - RNA, 15 nt, Human
ucuguguguguguau

SEQ ID NO: 3236357 - RNA, 18 nt, Human
ucuguguguguguaugug

SEQ ID NO: 3236358 - RNA, 19 nt, Human
ucuguguguguguaugugg

SEQ ID NO: 3236359 - RNA, 21 nt, Human
ucuguguguguguaugugggg

SEQ ID NO: 3236360 - RNA, 13 nt, Human
ucugugugugugu

SEQ ID NO: 3236361 - RNA, 23 nt, Human
ucuguggguuucuaaagcugcca

SEQ ID NO: 3236362 - RNA, 12 nt, Human
ucugugguuggc

SEQ ID NO: 3236363 - RNA, 13 nt, Human
ucugugguuggcu

SEQ ID NO: 3236364 - RNA, 14 nt, Human
ucugugguuggcug

SEQ ID NO: 3236365 - RNA, 19 nt, Human
ucugugguuggcugggaaa

SEQ ID NO: 3236366 - RNA, 20 nt, Human
ucugugguuggcugggaaau

SEQ ID NO: 3236367 - RNA, 22 nt, Human
ucugugucagguggggcagcuu

SEQ ID NO: 3236368 - RNA, 12 nt, Human
ucuguacauauu

SEQ ID NO: 3236369 - RNA, 23 nt, Human
ucuguacagagccguaaaaacug

SEQ ID NO: 3236370 - RNA, 17 nt, Human
ucuguacgucugacagg

SEQ ID NO: 3236371 - RNA, 22 nt, Human
ucuguggguuucuaaagcugcc

SEQ ID NO: 3236372 - RNA, 19 nt, Human
ucuguccgagcuuugaaaa

SEQ ID NO: 3236373 - RNA, 18 nt, Human
ucuguacaucucuacuua

SEQ ID NO: 3236374 - RNA, 15 nt, Human
ucuguguguuuaugu

SEQ ID NO: 3236375 - RNA, 16 nt, Human
ucuguguguuuaugug

SEQ ID NO: 3236376 - RNA, 22 nt, Human
ucuguguguguguauguggggg

SEQ ID NO: 3236377 - RNA, 12 nt, Human
ucuguguguucc

SEQ ID NO: 3236378 - RNA, 13 nt, Human
ucuguguguuccu

SEQ ID NO: 3236379 - RNA, 14 nt, Human
ucuguguguuccug

SEQ ID NO: 3236380 - RNA, 15 nt, Human
ucuguguguuccugg

SEQ ID NO: 3236381 - RNA, 16 nt, Human
ucuguguguuccuggc

SEQ ID NO: 3236382 - RNA, 19 nt, Human
ucuguguguuuaugugugu

SEQ ID NO: 3236383 - RNA, 20 nt, Human
ucuguguguuuaugugugug

SEQ ID NO: 3236384 - RNA, 19 nt, Human
ucuguuacacuuuuuggaa

SEQ ID NO: 3236385 - RNA, 13 nt, Human
ucuguuagaugcu

SEQ ID NO: 3236386 - RNA, 14 nt, Human
ucuguuagaugcua

SEQ ID NO: 3236387 - RNA, 22 nt, Human
ucuguuacaaaauguaacuguu

SEQ ID NO: 3236388 - RNA, 14 nt, Human
ucuguuacaaaaug

SEQ ID NO: 3236389 - RNA, 12 nt, Human
ucuguuacaaaa

SEQ ID NO: 3236390 - RNA, 20 nt, Human
ucuguuacaaaauguaacug

SEQ ID NO: 3236391 - RNA, 19 nt, Human
ucuguuacaaaauguaacu

SEQ ID NO: 3236392 - RNA, 17 nt, Human
ucuguuacaaaauguaa

SEQ ID NO: 3236393 - RNA, 16 nt, Human
ucuguuacaaaaugua

SEQ ID NO: 3236394 - RNA, 14 nt, Human
ucuguuaaaaugca

SEQ ID NO: 3236395 - RNA, 13 nt, Human
ucuguuaaaaugc

SEQ ID NO: 3236396 - RNA, 15 nt, Human
ucuguuaaaaugcau

SEQ ID NO: 3236397 - RNA, 20 nt, Human
ucuguguuuacagagauguc

SEQ ID NO: 3236398 - RNA, 17 nt, Human
ucuguguuuauucaaac

SEQ ID NO: 3236399 - RNA, 12 nt, Human
ucuguguuuauu

SEQ ID NO: 3236400 - RNA, 14 nt, Human
ucuguucagcguuu

SEQ ID NO: 3236401 - RNA, 20 nt, Human
ucuguucagcguuuugcaag

SEQ ID NO: 3236402 - RNA, 19 nt, Human
ucuguucagcguuuugcaa

SEQ ID NO: 3236403 - RNA, 21 nt, Human
ucuguuauagguccuuuagaa

SEQ ID NO: 3236404 - RNA, 23 nt, Human
ucuguuauagguccuuuagaaac

SEQ ID NO: 3236405 - RNA, 22 nt, Human
ucuguuauagguccuuuagaaa

SEQ ID NO: 3236406 - RNA, 22 nt, Human
ucuguucaggaaguccuuaucu

SEQ ID NO: 3236407 - RNA, 14 nt, Human
ucuguucaggaagu

SEQ ID NO: 3236408 - RNA, 18 nt, Human
ucuuaaaaaguggaaaaa

SEQ ID NO: 3236409 - RNA, 22 nt, Human
ucuguuuucaaucucguauaga

SEQ ID NO: 3236410 - RNA, 12 nt, Human
ucuguuuucaau

SEQ ID NO: 3236411 - RNA, 14 nt, Human
ucuggagagcccag

SEQ ID NO: 3236412 - RNA, 23 nt, Human
ucuggccuucggccuccauccug

SEQ ID NO: 3236413 - RNA, 17 nt, Human
ucuggaggaccugcccg

SEQ ID NO: 3236414 - RNA, 16 nt, Human
ucuggcucuacacaua

SEQ ID NO: 3236415 - RNA, 23 nt, Human
ucuguaagcuguuugguuuuaaa

SEQ ID NO: 3236416 - RNA, 22 nt, Human
ucuguaagcuguuugguuuuaa

SEQ ID NO: 3236417 - RNA, 23 nt, Human
ucuguacagagcccacgccccca

SEQ ID NO: 3236418 - RNA, 22 nt, Human
ucuguacagagccguaaaaacu

SEQ ID NO: 3236419 - RNA, 13 nt, Human
ucuguaauauuua

SEQ ID NO: 3236420 - RNA, 17 nt, Human
ucuguaauauuuacaau

SEQ ID NO: 3236421 - RNA, 18 nt, Human
ucuguaauauuuacaaug

SEQ ID NO: 3236422 - RNA, 19 nt, Human
ucuguaauauuuacaaugu

SEQ ID NO: 3236423 - RNA, 20 nt, Human
ucuguaauauuuacaaugua

SEQ ID NO: 3236424 - RNA, 22 nt, Human
ucuguaauauuuacaauguauu

SEQ ID NO: 3236425 - RNA, 23 nt, Human
ucuguaauauuuacaauguauua

SEQ ID NO: 3236426 - RNA, 18 nt, Human
ucuguaagcauaagcuua

SEQ ID NO: 3236427 - RNA, 21 nt, Human
ucuguaaaacuaagaaacuua

SEQ ID NO: 3236428 - RNA, 14 nt, Human
ucuguaaaacuaag

SEQ ID NO: 3236429 - RNA, 12 nt, Human
ucugggacacag

SEQ ID NO: 3236430 - RNA, 14 nt, Human
ucugggaauguaua

SEQ ID NO: 3236431 - RNA, 17 nt, Human
ucugggaauguauagua

SEQ ID NO: 3236432 - RNA, 15 nt, Human
ucuggcucuuccagg

SEQ ID NO: 3236433 - RNA, 16 nt, Human
ucuggcucuuccaggc

SEQ ID NO: 3236434 - RNA, 17 nt, Human
ucuggcucuuccaggcu

SEQ ID NO: 3236435 - RNA, 21 nt, Human
ucuuaguguugcguccugccu

SEQ ID NO: 3236436 - RNA, 23 nt, Human
ucuuaaaauggcaaguuuuccau

SEQ ID NO: 3236437 - RNA, 14 nt, Human
ucuuauacauuuga

SEQ ID NO: 3236438 - RNA, 15 nt, Human
ucuuauacauuugau

SEQ ID NO: 3236439 - RNA, 16 nt, Human
ucuuaguggauguucu

SEQ ID NO: 3236440 - RNA, 14 nt, Human
ucuuagugugugca

SEQ ID NO: 3236441 - RNA, 13 nt, Human
ucuuaaaaagugg

SEQ ID NO: 3236442 - RNA, 19 nt, Human
ucuuaaaagcuaucuucau

SEQ ID NO: 3236443 - RNA, 24 nt, Human
ucuuaaaagcuaucuucauguaaa

SEQ ID NO: 3236444 - RNA, 15 nt, Human
ucuucaguaagccgu

SEQ ID NO: 3236445 - RNA, 20 nt, Human
ucuuaugcuuccagaaacac

SEQ ID NO: 3236446 - RNA, 17 nt, Human
ucuuaugcuuccagaaa

SEQ ID NO: 3236447 - RNA, 13 nt, Human
ucuuaugcuucca

SEQ ID NO: 3236448 - RNA, 16 nt, Human
ucuucaguaagccgug

SEQ ID NO: 3236449 - RNA, 21 nt, Human
ucuuccacaagagcccaggcc

SEQ ID NO: 3236450 - RNA, 13 nt, Human
ucuuccacacaug

SEQ ID NO: 3236451 - RNA, 15 nt, Human
ucuuccacacaugca

SEQ ID NO: 3236452 - RNA, 22 nt, Human
ucuuccaaccauuuaucuugaa

SEQ ID NO: 3236453 - RNA, 21 nt, Human
ucuuccaaccauuuaucuuga

SEQ ID NO: 3236454 - RNA, 14 nt, Human
ucuuccaggcuggg

SEQ ID NO: 3236455 - RNA, 13 nt, Human
ucuuccaggcagc

SEQ ID NO: 3236456 - RNA, 19 nt, Human
ucuucuccacuuucuagcc

SEQ ID NO: 3236457 - RNA, 21 nt, Human
ucuucuccacuuucuagccag

SEQ ID NO: 3236458 - RNA, 13 nt, Human
ucuucuccacugg

SEQ ID NO: 3236459 - RNA, 18 nt, Human
ucuucuagcauaucuuuc

SEQ ID NO: 3236460 - RNA, 22 nt, Human
ucuucuagaugauuuuuugaaa

SEQ ID NO: 3236461 - RNA, 23 nt, Human
ucuucuagaugauuuuuugaaag

SEQ ID NO: 3236462 - RNA, 20 nt, Human
ucuugucuuccuauuucaga

SEQ ID NO: 3236463 - RNA, 19 nt, Human
ucuugucuuccuauuucag

SEQ ID NO: 3236464 - RNA, 15 nt, Human
ucuugucuuccuauu

SEQ ID NO: 3236465 - RNA, 17 nt, Human
ucuugugaaaauaauug

SEQ ID NO: 3236466 - RNA, 21 nt, Human
ucuuguuuuuuuuuuccacuu

SEQ ID NO: 3236467 - RNA, 18 nt, Human
ucuuguuuuuuuuuucca

SEQ ID NO: 3236468 - RNA, 12 nt, Human
ucuuuaaaaacu

SEQ ID NO: 3236469 - RNA, 14 nt, Human
ucuuuaaaaacugu

SEQ ID NO: 3236470 - RNA, 15 nt, Human
ucuuuaaaaacuguu

SEQ ID NO: 3236471 - RNA, 11 nt, Human
ucuugcucugc

SEQ ID NO: 3236472 - RNA, 21 nt, Human
ucuugccugccuaacaaaaua

SEQ ID NO: 3236473 - RNA, 13 nt, Human
ucuugcucugcug

SEQ ID NO: 3236474 - RNA, 12 nt, Human
ucuugcucugcu

SEQ ID NO: 3236475 - RNA, 15 nt, Human
ucuugcucucuuuua

SEQ ID NO: 3236476 - RNA, 12 nt, Human
ucuugcucuccu

SEQ ID NO: 3236477 - RNA, 17 nt, Human
ucuugaauuguaaggaa

SEQ ID NO: 3236478 - RNA, 17 nt, Human
ucuugaacucuuggccu

SEQ ID NO: 3236479 - RNA, 21 nt, Human
ucuugaauuguaaggaaugau

SEQ ID NO: 3236480 - RNA, 20 nt, Human
ucuugacagagccugcccca

SEQ ID NO: 3236481 - RNA, 15 nt, Human
ucuugaccucugccu

SEQ ID NO: 3236482 - RNA, 19 nt, Human
ucuugccucagcuucccca

SEQ ID NO: 3236483 - RNA, 20 nt, Human
ucuugccuauauuuuccuga

SEQ ID NO: 3236484 - RNA, 20 nt, Human
ucuugccucagcuuccccag

SEQ ID NO: 3236485 - RNA, 19 nt, Human
ucuugccuauauuuuccug

SEQ ID NO: 3236486 - RNA, 18 nt, Human
ucuugccucagcuucccc

SEQ ID NO: 3236487 - RNA, 12 nt, Human
ucuucuccaggc

SEQ ID NO: 3236488 - RNA, 16 nt, Human
ucuucuccacuggaug

SEQ ID NO: 3236489 - RNA, 14 nt, Human
ucuucuccaggcug

SEQ ID NO: 3236490 - RNA, 13 nt, Human
ucuucuccaggcu

SEQ ID NO: 3236491 - RNA, 18 nt, Human
ucuugaacuccuggccuc

SEQ ID NO: 3236492 - RNA, 17 nt, Human
ucuugaacuccuggccu

SEQ ID NO: 3236493 - RNA, 16 nt, Human
ucuugaacuccuggcc

SEQ ID NO: 3236494 - RNA, 15 nt, Human
uauaauguauucaua

SEQ ID NO: 3236495 - RNA, 19 nt, Human
uauaauguauucauauuug

SEQ ID NO: 3236496 - RNA, 18 nt, Human
uauaauguauucauauuu

SEQ ID NO: 3236497 - RNA, 17 nt, Human
uauaauucuacuuugag

SEQ ID NO: 3236498 - RNA, 20 nt, Human
uauaauguaagcucuacuga

SEQ ID NO: 3236499 - RNA, 19 nt, Human
uauaauguaagcucuacug

SEQ ID NO: 3236500 - RNA, 14 nt, Human
uauaauguaagcuc

SEQ ID NO: 3236501 - RNA, 18 nt, Human
uauaaugggauuggguuu

SEQ ID NO: 3236502 - RNA, 20 nt, Human
uauaauguauucauauuugu

SEQ ID NO: 3236503 - RNA, 17 nt, Human
uauacccccugcaaagc

SEQ ID NO: 3236504 - RNA, 15 nt, Human
uauacucauuagaau

SEQ ID NO: 3236505 - RNA, 16 nt, Human
uauacucauuagaauu

SEQ ID NO: 3236506 - RNA, 22 nt, Human
uauacucauuagaauuaccauu

SEQ ID NO: 3236507 - RNA, 20 nt, Human
uauacucuuauagacaacau

SEQ ID NO: 3236508 - RNA, 18 nt, Human
uaguuugcauuucagaaa

SEQ ID NO: 3236509 - RNA, 17 nt, Human
uaguuugcauuucagaa

SEQ ID NO: 3236510 - RNA, 15 nt, Human
uaguuugcauuuaag

SEQ ID NO: 3236511 - RNA, 17 nt, Human
uaguuugcauuuaagaa

SEQ ID NO: 3236512 - RNA, 21 nt, Human
uaguuugcauuuaagaauugc

SEQ ID NO: 3236513 - RNA, 16 nt, Human
uaguuugcauuucaga

SEQ ID NO: 3236514 - RNA, 13 nt, Human
uaguuugcauuuc

SEQ ID NO: 3236515 - RNA, 19 nt, Human
uaguuuuacccuauaucua

SEQ ID NO: 3236516 - RNA, 20 nt, Human
uauaaugaaugaaacauuuu

SEQ ID NO: 3236517 - RNA, 17 nt, Human
uauaaauugucuuaaug

SEQ ID NO: 3236518 - RNA, 11 nt, Human
uauaaugaaug

SEQ ID NO: 3236519 - RNA, 18 nt, Human
uauaaugaaugaaacauu

SEQ ID NO: 3236520 - RNA, 22 nt, Human
uauaaauuuauuuacugcuagu

SEQ ID NO: 3236521 - RNA, 20 nt, Human
uauaaauuucgcuucuuaga

SEQ ID NO: 3236522 - RNA, 15 nt, Human
uauaaauuuguguaa

SEQ ID NO: 3236523 - RNA, 16 nt, Human
uauaaauuuguguaau

SEQ ID NO: 3236524 - RNA, 17 nt, Human
uauaaugaacaaaauua

SEQ ID NO: 3236525 - RNA, 16 nt, Human
uauaaauuuauuuacu

SEQ ID NO: 3236526 - RNA, 15 nt, Human
uauaaauuuauuuac

SEQ ID NO: 3236527 - RNA, 14 nt, Human
uauaaauuuauuua

SEQ ID NO: 3236528 - RNA, 20 nt, Human
uauaaauugucuuaauggau

SEQ ID NO: 3236529 - RNA, 14 nt, Human
uauaaauugucuuu

SEQ ID NO: 3236530 - RNA, 22 nt, Human
uauaaauugucuuuaaaaacug

SEQ ID NO: 3236531 - RNA, 23 nt, Human
uauaaauugucuuuaaaaacugu

SEQ ID NO: 3236532 - RNA, 18 nt, Human
uagugaugguuccccugu

SEQ ID NO: 3236533 - RNA, 14 nt, Human
uagugaugguuccc

SEQ ID NO: 3236534 - RNA, 16 nt, Human
uaguggaaaauaggcu

SEQ ID NO: 3236535 - RNA, 17 nt, Human
uaguggacccugaaaug

SEQ ID NO: 3236536 - RNA, 15 nt, Human
uaguggacccugaaa

SEQ ID NO: 3236537 - RNA, 17 nt, Human
uagugcugugaaaaaaa

SEQ ID NO: 3236538 - RNA, 16 nt, Human
uagugcugugaaaaaa

SEQ ID NO: 3236539 - RNA, 13 nt, Human
uagugcugugaaa

SEQ ID NO: 3236540 - RNA, 12 nt, Human
uagugcugugaa

SEQ ID NO: 3236541 - RNA, 23 nt, Human
uagucaacaguacccugguugug

SEQ ID NO: 3236542 - RNA, 19 nt, Human
uagucaagacgaacaugua

SEQ ID NO: 3236543 - RNA, 13 nt, Human
uagugaugguucc

SEQ ID NO: 3236544 - RNA, 21 nt, Human
uaguguagauuccauuuacug

SEQ ID NO: 3236545 - RNA, 15 nt, Human
uaguggauguucuga

SEQ ID NO: 3236546 - RNA, 15 nt, Human
uaguggauggaaggg

SEQ ID NO: 3236547 - RNA, 21 nt, Human
uaguggacccugaaaugugug

SEQ ID NO: 3236548 - RNA, 20 nt, Human
uaguggacccugaaaugugu

SEQ ID NO: 3236549 - RNA, 19 nt, Human
uaguggacccugaaaugug

SEQ ID NO: 3236550 - RNA, 18 nt, Human
uaguggacccugaaaugu

SEQ ID NO: 3236551 - RNA, 18 nt, Human
uaguggauggaaggggcu

SEQ ID NO: 3236552 - RNA, 21 nt, Human
uaguuguaccgcaaugugacu

SEQ ID NO: 3236553 - RNA, 20 nt, Human
uaguuguagacaaaguacau

SEQ ID NO: 3236554 - RNA, 16 nt, Human
uaguuuacugagaaug

SEQ ID NO: 3236555 - RNA, 18 nt, Human
uaguuuagugugguuuuc

SEQ ID NO: 3236556 - RNA, 22 nt, Human
uaguuuagugugguuuucuguu

SEQ ID NO: 3236557 - RNA, 17 nt, Human
uaguuuauuuuaaaaca

SEQ ID NO: 3236558 - RNA, 12 nt, Human
uaguuugcaguu

SEQ ID NO: 3236559 - RNA, 13 nt, Human
uaguuucuccaag

SEQ ID NO: 3236560 - RNA, 14 nt, Human
uaguuucugugguu

SEQ ID NO: 3236561 - RNA, 21 nt, Human
uaucaugucaaacgugaaaau

SEQ ID NO: 3236562 - RNA, 15 nt, Human
uauccuuuucugugu

SEQ ID NO: 3236563 - RNA, 14 nt, Human
uauccuuuucugug

SEQ ID NO: 3236564 - RNA, 17 nt, Human
uauccuuuucuguguuu

SEQ ID NO: 3236565 - RNA, 16 nt, Human
uauccuuuucuguguu

SEQ ID NO: 3236566 - RNA, 18 nt, Human
uauccugggcuuuuguuu

SEQ ID NO: 3236567 - RNA, 23 nt, Human
uauccugggcuuuuguuuugcuu

SEQ ID NO: 3236568 - RNA, 15 nt, Human
uaucuaaauguugaa

SEQ ID NO: 3236569 - RNA, 15 nt, Human
uaucguuaucacugu

SEQ ID NO: 3236570 - RNA, 18 nt, Human
uaucguuaucacugugca

SEQ ID NO: 3236571 - RNA, 19 nt, Human
uaucgcccuggcaggcagg

SEQ ID NO: 3236572 - RNA, 15 nt, Human
uaucagcacgugugg

SEQ ID NO: 3236573 - RNA, 13 nt, Human
uauauuuuuaucu

SEQ ID NO: 3236574 - RNA, 22 nt, Human
uauauuuuuaucuauauaaaau

SEQ ID NO: 3236575 - RNA, 13 nt, Human
uauauuuuauaua

SEQ ID NO: 3236576 - RNA, 18 nt, Human
uauauuuuauauaaagua

SEQ ID NO: 3236577 - RNA, 17 nt, Human
uauauuuuucuuaaaaa

SEQ ID NO: 3236578 - RNA, 15 nt, Human
uauauuuuucuuaaa

SEQ ID NO: 3236579 - RNA, 20 nt, Human
uauauuuuucuuaaaaagua

SEQ ID NO: 3236580 - RNA, 18 nt, Human
uauauuuuucuuaaaaag

SEQ ID NO: 3236581 - RNA, 23 nt, Human
uaucaggauuuccucuugaacca

SEQ ID NO: 3236582 - RNA, 22 nt, Human
uaucagggaaacuaagauucuu

SEQ ID NO: 3236583 - RNA, 16 nt, Human
uaucaggauuuccucu

SEQ ID NO: 3236584 - RNA, 16 nt, Human
uaucaugucaaacgug

SEQ ID NO: 3236585 - RNA, 11 nt, Human
uaucaugaaug

SEQ ID NO: 3236586 - RNA, 12 nt, Human
uaucaugaauuu

SEQ ID NO: 3236587 - RNA, 15 nt, Human
uaucaugaauuuuaa

SEQ ID NO: 3236588 - RNA, 16 nt, Human
uaucaugaauuuuaaa

SEQ ID NO: 3236589 - RNA, 18 nt, Human
uaucaugaauuuuaaagu

SEQ ID NO: 3236590 - RNA, 19 nt, Human
uaucaugaauuuuaaagua

SEQ ID NO: 3236591 - RNA, 24 nt, Human
uaucaugaauuuuaaaguaugcau

SEQ ID NO: 3236592 - RNA, 11 nt, Human
uaucaugaagc

SEQ ID NO: 3236593 - RNA, 15 nt, Human
uaucaguguuuaugu

SEQ ID NO: 3236594 - RNA, 13 nt, Human
uauauaauaaauu

SEQ ID NO: 3236595 - RNA, 14 nt, Human
uauacuguguguga

SEQ ID NO: 3236596 - RNA, 23 nt, Human
uauacugugugugagugugaaua

SEQ ID NO: 3236597 - RNA, 21 nt, Human
uauacuuccuuacuuuuaagg

SEQ ID NO: 3236598 - RNA, 19 nt, Human
uauaugcauauauauaugu

SEQ ID NO: 3236599 - RNA, 23 nt, Human
uauauacaucacguuaaaguagg

SEQ ID NO: 3236600 - RNA, 19 nt, Human
uauauaccugcgcuuguuu

SEQ ID NO: 3236601 - RNA, 15 nt, Human
uauauaccguggggg

SEQ ID NO: 3236602 - RNA, 22 nt, Human
uauauuuccuauaccauuuccg

SEQ ID NO: 3236603 - RNA, 21 nt, Human
uauauuuccuauaccauuucc

SEQ ID NO: 3236604 - RNA, 18 nt, Human
uauauuuccuauaccauu

SEQ ID NO: 3236605 - RNA, 12 nt, Human
uauauuucaagu

SEQ ID NO: 3236606 - RNA, 21 nt, Human
uauauuucccugaaggaacca

SEQ ID NO: 3236607 - RNA, 13 nt, Human
uauauguaugugu

SEQ ID NO: 3236608 - RNA, 21 nt, Human
uauauuuauugacucuugagu

SEQ ID NO: 3236609 - RNA, 12 nt, Human
uauauuuauuga

SEQ ID NO: 3236610 - RNA, 13 nt, Human
uauauuuauugac

SEQ ID NO: 3236611 - RNA, 22 nt, Human
uauauggugguaauaagggaaa

SEQ ID NO: 3236612 - RNA, 20 nt, Human
uauauggugguaauaaggga

SEQ ID NO: 3236613 - RNA, 22 nt, Human
uauaugcauauauauaugugug

SEQ ID NO: 3236614 - RNA, 17 nt, Human
uauauggucuaauguuu

SEQ ID NO: 3236615 - RNA, 15 nt, Human
uauauggucuaaugu

SEQ ID NO: 3236616 - RNA, 15 nt, Human
uaggaacugcugggc

SEQ ID NO: 3236617 - RNA, 18 nt, Human
uaggaacugcugggcuug

SEQ ID NO: 3236618 - RNA, 17 nt, Human
uaggaacacuccuucac

SEQ ID NO: 3236619 - RNA, 14 nt, Human
uaggaacaaaucuu

SEQ ID NO: 3236620 - RNA, 22 nt, Human
uaggaacaaaucuuccuggucg

SEQ ID NO: 3236621 - RNA, 16 nt, Human
uaggaacaaaucuucc

SEQ ID NO: 3236622 - RNA, 13 nt, Human
uaggaacacuccu

SEQ ID NO: 3236623 - RNA, 14 nt, Human
uaggaacacuccuu

SEQ ID NO: 3236624 - RNA, 16 nt, Human
uagcugggaaagcaua

SEQ ID NO: 3236625 - RNA, 18 nt, Human
uagcugggaaagcauaaa

SEQ ID NO: 3236626 - RNA, 13 nt, Human
uaggaacaaaucu

SEQ ID NO: 3236627 - RNA, 16 nt, Human
uaggaagacuuuggaa

SEQ ID NO: 3236628 - RNA, 17 nt, Human
uaggaagacuuuggaaa

SEQ ID NO: 3236629 - RNA, 21 nt, Human
uaggaagacacauuaucuucu

SEQ ID NO: 3236630 - RNA, 21 nt, Human
uaggaaggcacuucugccuga

SEQ ID NO: 3236631 - RNA, 19 nt, Human
uaggaaggcacuucugccu

SEQ ID NO: 3236632 - RNA, 17 nt, Human
uaggaaggcacuucugc

SEQ ID NO: 3236633 - RNA, 14 nt, Human
uaggaagacuuugg

SEQ ID NO: 3236634 - RNA, 15 nt, Human
uaggaagacuuugga

SEQ ID NO: 3236635 - RNA, 13 nt, Human
uaggaagacuuug

SEQ ID NO: 3236636 - RNA, 15 nt, Human
uaggccaaagacaaa

SEQ ID NO: 3236637 - RNA, 23 nt, Human
uaggaauugacccacaagaaaug

SEQ ID NO: 3236638 - RNA, 20 nt, Human
uaggaauugacccacaagaa

SEQ ID NO: 3236639 - RNA, 15 nt, Human
uaggaagguuaaugu

SEQ ID NO: 3236640 - RNA, 14 nt, Human
uaggaaggucauuu

SEQ ID NO: 3236641 - RNA, 19 nt, Human
uaggaaguuaaaagcacaa

SEQ ID NO: 3236642 - RNA, 23 nt, Human
uaggaaggucauuuccauguaug

SEQ ID NO: 3236643 - RNA, 19 nt, Human
uaggaaggucauuuccaug

SEQ ID NO: 3236644 - RNA, 18 nt, Human
uaggaaggucauuuccau

SEQ ID NO: 3236645 - RNA, 16 nt, Human
uaggaaggucauuucc

SEQ ID NO: 3236646 - RNA, 13 nt, Human
uaggccaugggac

SEQ ID NO: 3236647 - RNA, 17 nt, Human
uaggccguuccuucaaa

SEQ ID NO: 3236648 - RNA, 22 nt, Human
uaggccuacuggggaucagagu

SEQ ID NO: 3236649 - RNA, 18 nt, Human
uaggccaaagacaaauag

SEQ ID NO: 3236650 - RNA, 21 nt, Human
uaggaaguuagccuuuaucua

SEQ ID NO: 3236651 - RNA, 19 nt, Human
uaggccaaagacaaauagu

SEQ ID NO: 3236652 - RNA, 18 nt, Human
uaggccaaucagaagcua

SEQ ID NO: 3236653 - RNA, 14 nt, Human
uaggccuggccaga

SEQ ID NO: 3236654 - RNA, 19 nt, Human
uaggccucaggugaaacuc

SEQ ID NO: 3236655 - RNA, 13 nt, Human
uaggccuggccag

SEQ ID NO: 3236656 - RNA, 16 nt, Human
uagccccacaggaggu

SEQ ID NO: 3236657 - RNA, 12 nt, Human
uagcccugcccg

SEQ ID NO: 3236658 - RNA, 18 nt, Human
uagcccucacccuggggc

SEQ ID NO: 3236659 - RNA, 16 nt, Human
uagccuaggugacaga

SEQ ID NO: 3236660 - RNA, 11 nt, Human
uagccucacgc

SEQ ID NO: 3236661 - RNA, 14 nt, Human
uagcccaaaaccaa

SEQ ID NO: 3236662 - RNA, 20 nt, Human
uagcccaggauauauuuuau

SEQ ID NO: 3236663 - RNA, 22 nt, Human
uagcccaggauauauuuuauuu

SEQ ID NO: 3236664 - RNA, 21 nt, Human
uagcccaggauauauuuuauu

SEQ ID NO: 3236665 - RNA, 17 nt, Human
uagcucuguacaucuuu

SEQ ID NO: 3236666 - RNA, 11 nt, Human
uagcugggacu

SEQ ID NO: 3236667 - RNA, 19 nt, Human
uagcugggacuacaggcac

SEQ ID NO: 3236668 - RNA, 20 nt, Human
uagcugggacuacaggcacc

SEQ ID NO: 3236669 - RNA, 18 nt, Human
uagcugggacuacaggug

SEQ ID NO: 3236670 - RNA, 22 nt, Human
uagcugggagaaagagagagcu

SEQ ID NO: 3236671 - RNA, 17 nt, Human
uagcuggagaggagccc

SEQ ID NO: 3236672 - RNA, 23 nt, Human
uagcuggagaggagcccugccuc

SEQ ID NO: 3236673 - RNA, 19 nt, Human
uagcuggagaggagcccug

SEQ ID NO: 3236674 - RNA, 21 nt, Human
uagcucuaggagggcuggcaa

SEQ ID NO: 3236675 - RNA, 11 nt, Human
uagaugugugg

SEQ ID NO: 3236676 - RNA, 16 nt, Human
uagaugugcugcuuug

SEQ ID NO: 3236677 - RNA, 15 nt, Human
uagaugugagaaaac

SEQ ID NO: 3236678 - RNA, 21 nt, Human
uagauacaccucaacuaaauc

SEQ ID NO: 3236679 - RNA, 15 nt, Human
uagauaauuaaccaa

SEQ ID NO: 3236680 - RNA, 12 nt, Human
uagauacaauca

SEQ ID NO: 3236681 - RNA, 13 nt, Human
uagauacaaucag

SEQ ID NO: 3236682 - RNA, 14 nt, Human
uagauacaaucagc

SEQ ID NO: 3236683 - RNA, 16 nt, Human
uagauacaaucagcug

SEQ ID NO: 3236684 - RNA, 17 nt, Human
uagauacaaucagcugc

SEQ ID NO: 3236685 - RNA, 19 nt, Human
uagauacaaucagcugcuu

SEQ ID NO: 3236686 - RNA, 21 nt, Human
uagauacaaucagcugcuuug

SEQ ID NO: 3236687 - RNA, 22 nt, Human
uagauacaaucagcugcuuugu

SEQ ID NO: 3236688 - RNA, 12 nt, Human
uagauguauaua

SEQ ID NO: 3236689 - RNA, 16 nt, Human
uagauguaauuuugug

SEQ ID NO: 3236690 - RNA, 14 nt, Human
uagauguaaauuuu

SEQ ID NO: 3236691 - RNA, 13 nt, Human
uagauguaaauuu

SEQ ID NO: 3236692 - RNA, 20 nt, Human
uagcagggcauggcugggaa

SEQ ID NO: 3236693 - RNA, 23 nt, Human
uagcagagaaugaaagggcccag

SEQ ID NO: 3236694 - RNA, 19 nt, Human
uagcagagaaugaaagggc

SEQ ID NO: 3236695 - RNA, 13 nt, Human
uagcagaguuaaa

SEQ ID NO: 3236696 - RNA, 14 nt, Human
uagcagaguuaaau

SEQ ID NO: 3236697 - RNA, 16 nt, Human
uagcagaguuaaaucu

SEQ ID NO: 3236698 - RNA, 17 nt, Human
uagcagaucuguuuugu

SEQ ID NO: 3236699 - RNA, 16 nt, Human
uagcacuuugggaggc

SEQ ID NO: 3236700 - RNA, 15 nt, Human
uagauugagaaaugu

SEQ ID NO: 3236701 - RNA, 13 nt, Human
uagauguuuuaua

SEQ ID NO: 3236702 - RNA, 18 nt, Human
uagauuaaaucauacucc

SEQ ID NO: 3236703 - RNA, 21 nt, Human
uagagucauuguaauguugug

SEQ ID NO: 3236704 - RNA, 19 nt, Human
uagagucauuguaauguug

SEQ ID NO: 3236705 - RNA, 16 nt, Human
uagagucauuguaaug

SEQ ID NO: 3236706 - RNA, 15 nt, Human
uagagucauuguaau

SEQ ID NO: 3236707 - RNA, 14 nt, Human
uagagucauuguaa

SEQ ID NO: 3236708 - RNA, 18 nt, Human
uagagucaacuacacaaa

SEQ ID NO: 3236709 - RNA, 21 nt, Human
uagagucaacuacacaaagca

SEQ ID NO: 3236710 - RNA, 19 nt, Human
uagaguagagguauaauug

SEQ ID NO: 3236711 - RNA, 13 nt, Human
uagaguacacugc

SEQ ID NO: 3236712 - RNA, 19 nt, Human
uagaguaaaaagaaaacaa

SEQ ID NO: 3236713 - RNA, 17 nt, Human
uagaguacacugccugc

SEQ ID NO: 3236714 - RNA, 21 nt, Human
uagaguacacugccugccuua

SEQ ID NO: 3236715 - RNA, 22 nt, Human
uagaguacacugccugccuuaa

SEQ ID NO: 3236716 - RNA, 16 nt, Human
uagagagagaccacuu

SEQ ID NO: 3236717 - RNA, 17 nt, Human
uagaguaaaaagaaaac

SEQ ID NO: 3236718 - RNA, 20 nt, Human
uagacugccacaaggaagaa

SEQ ID NO: 3236719 - RNA, 21 nt, Human
uagaccuauaauccuugauaa

SEQ ID NO: 3236720 - RNA, 16 nt, Human
uagaacccuugcacag

SEQ ID NO: 3236721 - RNA, 12 nt, Human
uagaaccaggca

SEQ ID NO: 3236722 - RNA, 23 nt, Human
uagaaccaggcaacuugggaacu

SEQ ID NO: 3236723 - RNA, 22 nt, Human
uagacugccagcucuuccuagc

SEQ ID NO: 3236724 - RNA, 20 nt, Human
uagacuggccugaaccacag

SEQ ID NO: 3236725 - RNA, 17 nt, Human
uagacugccagcucuuc

SEQ ID NO: 3236726 - RNA, 16 nt, Human
uagacugccagcucuu

SEQ ID NO: 3236727 - RNA, 14 nt, Human
uagacugccagcuc

SEQ ID NO: 3236728 - RNA, 13 nt, Human
uagacugccagcu

SEQ ID NO: 3236729 - RNA, 12 nt, Human
uagacugccagc

SEQ ID NO: 3236730 - RNA, 11 nt, Human
uagacugccag

SEQ ID NO: 3236731 - RNA, 23 nt, Human
uagacugccacaaggaagaaauu

SEQ ID NO: 3236732 - RNA, 22 nt, Human
uagacugccacaaggaagaaau

SEQ ID NO: 3236733 - RNA, 11 nt, Human
uagagacaggg

SEQ ID NO: 3236734 - RNA, 17 nt, Human
uagagaacuaaacuagu

SEQ ID NO: 3236735 - RNA, 23 nt, Human
uagacuuuuccaauaugugauuu

SEQ ID NO: 3236736 - RNA, 20 nt, Human
uagacuuuuccaauauguga

SEQ ID NO: 3236737 - RNA, 14 nt, Human
uagacuuuuccaau

SEQ ID NO: 3236738 - RNA, 13 nt, Human
uagacuugaaaag

SEQ ID NO: 3236739 - RNA, 14 nt, Human
uagacuugaaaaga

SEQ ID NO: 3236740 - RNA, 18 nt, Human
uagacuugaaaagagaca

SEQ ID NO: 3236741 - RNA, 19 nt, Human
uagacuugaaaagagacag

SEQ ID NO: 3236742 - RNA, 20 nt, Human
uagacuugaaaagagacagg

SEQ ID NO: 3236743 - RNA, 23 nt, Human
uagacuugaaaagagacaggcag

SEQ ID NO: 3236744 - RNA, 17 nt, Human
uaauuuugacacugaaa

SEQ ID NO: 3236745 - RNA, 20 nt, Human
uaauuuugacacugaaauaa

SEQ ID NO: 3236746 - RNA, 20 nt, Human
uaauuuugauagugggacca

SEQ ID NO: 3236747 - RNA, 18 nt, Human
uaauuuugauagugggac

SEQ ID NO: 3236748 - RNA, 19 nt, Human
uaauuuuguaauguaucaa

SEQ ID NO: 3236749 - RNA, 12 nt, Human
uaauuuuguaau

SEQ ID NO: 3236750 - RNA, 11 nt, Human
uaauuuugucu

SEQ ID NO: 3236751 - RNA, 13 nt, Human
uacaauuuuuauu

SEQ ID NO: 3236752 - RNA, 17 nt, Human
uacaauuuuuauuucuu

SEQ ID NO: 3236753 - RNA, 22 nt, Human
uacaauuuuuauuucuuuuacu

SEQ ID NO: 3236754 - RNA, 20 nt, Human
uacacaaaaucaaauaauac

SEQ ID NO: 3236755 - RNA, 13 nt, Human
uacacaaaaucaa

SEQ ID NO: 3236756 - RNA, 19 nt, Human
uacaagagcuuaacagugu

SEQ ID NO: 3236757 - RNA, 17 nt, Human
uacaagacaacauugua

SEQ ID NO: 3236758 - RNA, 15 nt, Human
uacaagacacaguga

SEQ ID NO: 3236759 - RNA, 18 nt, Human
uacaagacaacauuguaa

SEQ ID NO: 3236760 - RNA, 15 nt, Human
uacacacgcugccuu

SEQ ID NO: 3236761 - RNA, 14 nt, Human
uacacacgcugccu

SEQ ID NO: 3236762 - RNA, 15 nt, Human
uacacacacauacac

SEQ ID NO: 3236763 - RNA, 21 nt, Human
uacacacacacgcgugcacac

SEQ ID NO: 3236764 - RNA, 21 nt, Human
uacacaaugguuuucuugugu

SEQ ID NO: 3236765 - RNA, 17 nt, Human
uacacaaugguuuucuu

SEQ ID NO: 3236766 - RNA, 16 nt, Human
uacacugugcugaguc

SEQ ID NO: 3236767 - RNA, 23 nt, Human
uacacuggcaaugguaguuucug

SEQ ID NO: 3236768 - RNA, 24 nt, Human
uacacuggcaaugguaguuucugu

SEQ ID NO: 3236769 - RNA, 18 nt, Human
uacacugccugccuuaag

SEQ ID NO: 3236770 - RNA, 21 nt, Human
uacacugccugccuuaaguga

SEQ ID NO: 3236771 - RNA, 20 nt, Human
uacacuggcaaugguaguuu

SEQ ID NO: 3236772 - RNA, 22 nt, Human
uacacuggcaaugguaguuucu

SEQ ID NO: 3236773 - RNA, 18 nt, Human
uacacuggcaaugguagu

SEQ ID NO: 3236774 - RNA, 16 nt, Human
uacacacgcugccuuc

SEQ ID NO: 3236775 - RNA, 17 nt, Human
uacacugccugccuuaa

SEQ ID NO: 3236776 - RNA, 17 nt, Human
uacagcccaccuggcuu

SEQ ID NO: 3236777 - RNA, 21 nt, Human
uacagcuugaccgugaggcca

SEQ ID NO: 3236778 - RNA, 22 nt, Human
uacagcuugaccgugaggccag

SEQ ID NO: 3236779 - RNA, 18 nt, Human
uacaggaaaagcugcuga

SEQ ID NO: 3236780 - RNA, 17 nt, Human
uacaggaaaagcugcug

SEQ ID NO: 3236781 - RNA, 23 nt, Human
uacagcuugaccgugaggccaga

SEQ ID NO: 3236782 - RNA, 20 nt, Human
uacagccuuaauauuuuccu

SEQ ID NO: 3236783 - RNA, 16 nt, Human
uacaggcacccaccau

SEQ ID NO: 3236784 - RNA, 19 nt, Human
uacaggaaaagcugcugac

SEQ ID NO: 3236785 - RNA, 18 nt, Human
uacagaaucuuguuuuga

SEQ ID NO: 3236786 - RNA, 14 nt, Human
uacagaauuugaau

SEQ ID NO: 3236787 - RNA, 16 nt, Human
uacagaauuugaauua

SEQ ID NO: 3236788 - RNA, 17 nt, Human
uacagaauuugaauuau

SEQ ID NO: 3236789 - RNA, 13 nt, Human
uacacuuuaugca

SEQ ID NO: 3236790 - RNA, 19 nt, Human
uacagaaaaacaaugguaa

SEQ ID NO: 3236791 - RNA, 21 nt, Human
uacaugagguacugagaguga

SEQ ID NO: 3236792 - RNA, 22 nt, Human
uacaugagguacugagagugaa

SEQ ID NO: 3236793 - RNA, 22 nt, Human
uacaugaugauuucagaaacaa

SEQ ID NO: 3236794 - RNA, 17 nt, Human
uacaugaugauuucaga

SEQ ID NO: 3236795 - RNA, 15 nt, Human
uacaugaugauuuca

SEQ ID NO: 3236796 - RNA, 11 nt, Human
uaccaaaauaa

SEQ ID NO: 3236797 - RNA, 18 nt, Human
uacauuuguauuuuucca

SEQ ID NO: 3236798 - RNA, 17 nt, Human
uacauuuguaauuuaag

SEQ ID NO: 3236799 - RNA, 19 nt, Human
uacauuuguaauuuaaggu

SEQ ID NO: 3236800 - RNA, 23 nt, Human
uacauuuuauuaagcuuuuugga

SEQ ID NO: 3236801 - RNA, 16 nt, Human
uaccaacacgagcagg

SEQ ID NO: 3236802 - RNA, 13 nt, Human
uaccaaaauuuua

SEQ ID NO: 3236803 - RNA, 14 nt, Human
uaccaaaauuuuaa

SEQ ID NO: 3236804 - RNA, 23 nt, Human
uaccaaaauuuuaaaaaagggag

SEQ ID NO: 3236805 - RNA, 21 nt, Human
uaccaacuuucaagaacuugu

SEQ ID NO: 3236806 - RNA, 15 nt, Human
uaccaacuuucaaga

SEQ ID NO: 3236807 - RNA, 14 nt, Human
uaccaacuuucaag

SEQ ID NO: 3236808 - RNA, 12 nt, Human
uaccaacuuuac

SEQ ID NO: 3236809 - RNA, 14 nt, Human
uaccaacuuuacug

SEQ ID NO: 3236810 - RNA, 13 nt, Human
uaccaacuuucaa

SEQ ID NO: 3236811 - RNA, 12 nt, Human
uaccaacuuuca

SEQ ID NO: 3236812 - RNA, 13 nt, Human
uaccaaauuaaaa

SEQ ID NO: 3236813 - RNA, 19 nt, Human
uaccaaauuaaaaaaaaau

SEQ ID NO: 3236814 - RNA, 23 nt, Human
uaccaaauuaaaaaaaaauugua

SEQ ID NO: 3236815 - RNA, 22 nt, Human
uacauaagauaaaugugcugaa

SEQ ID NO: 3236816 - RNA, 17 nt, Human
uacaguuacuuuuccuu

SEQ ID NO: 3236817 - RNA, 16 nt, Human
uacaguuacuuuuccu

SEQ ID NO: 3236818 - RNA, 15 nt, Human
uacaguuacuuuucc

SEQ ID NO: 3236819 - RNA, 14 nt, Human
uacaguuacuuuuc

SEQ ID NO: 3236820 - RNA, 19 nt, Human
uacauaagauaaaugugcu

SEQ ID NO: 3236821 - RNA, 18 nt, Human
uacauaagauaaaugugc

SEQ ID NO: 3236822 - RNA, 13 nt, Human
uacaguuauaaaa

SEQ ID NO: 3236823 - RNA, 14 nt, Human
uacaguuauaaaau

SEQ ID NO: 3236824 - RNA, 17 nt, Human
uacaguuauaaaauuaa

SEQ ID NO: 3236825 - RNA, 17 nt, Human
uacauaagauaaaugug

SEQ ID NO: 3236826 - RNA, 15 nt, Human
uaccaccacgcccgg

SEQ ID NO: 3236827 - RNA, 20 nt, Human
uaccauuggaaauuucacgu

SEQ ID NO: 3236828 - RNA, 19 nt, Human
uaccauuggaaauuucacg

SEQ ID NO: 3236829 - RNA, 17 nt, Human
uaccauuggaaauuuca

SEQ ID NO: 3236830 - RNA, 15 nt, Human
uaccauuggaaauuu

SEQ ID NO: 3236831 - RNA, 13 nt, Human
uaccauuggaaau

SEQ ID NO: 3236832 - RNA, 23 nt, Human
uaccauuuugggguacccacugc

SEQ ID NO: 3236833 - RNA, 22 nt, Human
uaccauuuccguaauucuuauu

SEQ ID NO: 3236834 - RNA, 20 nt, Human
uaccauuuccguaauucuua

SEQ ID NO: 3236835 - RNA, 19 nt, Human
uaccauuuccguaauucuu

SEQ ID NO: 3236836 - RNA, 13 nt, Human
uaccauuucagua

SEQ ID NO: 3236837 - RNA, 21 nt, Human
uaccaaugcucuuuucacagc

SEQ ID NO: 3236838 - RNA, 21 nt, Human
uaccaagaaaggaaccuguca

SEQ ID NO: 3236839 - RNA, 22 nt, Human
uacccaggugcuaggaacacuc

SEQ ID NO: 3236840 - RNA, 18 nt, Human
uacccagcgagcccuggu

SEQ ID NO: 3236841 - RNA, 16 nt, Human
uacccagcgagcccug

SEQ ID NO: 3236842 - RNA, 14 nt, Human
uacccacugcucug

SEQ ID NO: 3236843 - RNA, 13 nt, Human
uacccacugcucu

SEQ ID NO: 3236844 - RNA, 12 nt, Human
uacccacugcuc

SEQ ID NO: 3236845 - RNA, 11 nt, Human
uacccacugcu

SEQ ID NO: 3236846 - RNA, 17 nt, Human
uacccacccccacccaa

SEQ ID NO: 3236847 - RNA, 19 nt, Human
uacccacccccacccaagg

SEQ ID NO: 3236848 - RNA, 23 nt, Human
uacccacccccacccaagggccu

SEQ ID NO: 3236849 - RNA, 12 nt, Human
uacccaccccca

SEQ ID NO: 3236850 - RNA, 15 nt, Human
uacccacccccaccc

SEQ ID NO: 3236851 - RNA, 12 nt, Human
uagaacagguuu

SEQ ID NO: 3236852 - RNA, 14 nt, Human
uagaacagguuuuu

SEQ ID NO: 3236853 - RNA, 18 nt, Human
uagaacaguggaaacuau

SEQ ID NO: 3236854 - RNA, 20 nt, Human
uagaacaguggaaacuaugu

SEQ ID NO: 3236855 - RNA, 13 nt, Human
uagaacagguuuu

SEQ ID NO: 3236856 - RNA, 17 nt, Human
uagaaauguuugcugaa

SEQ ID NO: 3236857 - RNA, 15 nt, Human
uagaaauguuugcug

SEQ ID NO: 3236858 - RNA, 17 nt, Human
uagaacaacauauacaa

SEQ ID NO: 3236859 - RNA, 23 nt, Human
uagaaauaucugaaaauguaugu

SEQ ID NO: 3236860 - RNA, 21 nt, Human
uagaaauaucugaaaauguau

SEQ ID NO: 3236861 - RNA, 20 nt, Human
uagaaauaucugaaaaugua

SEQ ID NO: 3236862 - RNA, 15 nt, Human
uagaaauauaauuga

SEQ ID NO: 3236863 - RNA, 15 nt, Human
uagaaauauucacau

SEQ ID NO: 3236864 - RNA, 13 nt, Human
uacuuuauagaag

SEQ ID NO: 3236865 - RNA, 16 nt, Human
uacuuuaccucucugu

SEQ ID NO: 3236866 - RNA, 17 nt, Human
uacuuuaccucucuguc

SEQ ID NO: 3236867 - RNA, 18 nt, Human
uacuuuaccucucuguca

SEQ ID NO: 3236868 - RNA, 19 nt, Human
uacuuuaccucucugucau

SEQ ID NO: 3236869 - RNA, 22 nt, Human
uacuuuaccucucugucaugug

SEQ ID NO: 3236870 - RNA, 18 nt, Human
uagaaacuggaaauacua

SEQ ID NO: 3236871 - RNA, 17 nt, Human
uagaaacuggaaauacu

SEQ ID NO: 3236872 - RNA, 14 nt, Human
uagaaacuggaaau

SEQ ID NO: 3236873 - RNA, 15 nt, Human
uacuuuccaauucuc

SEQ ID NO: 3236874 - RNA, 21 nt, Human
uacuuuaucaugaaugcuuuu

SEQ ID NO: 3236875 - RNA, 22 nt, Human
uacuuuaucaugaaugcuuuua

SEQ ID NO: 3236876 - RNA, 19 nt, Human
uacuuuauagaagaaugca

SEQ ID NO: 3236877 - RNA, 18 nt, Human
uacuuuauagaagaaugc

SEQ ID NO: 3236878 - RNA, 16 nt, Human
uacuuuauagaagaau

SEQ ID NO: 3236879 - RNA, 14 nt, Human
uacuuuauagaaga

SEQ ID NO: 3236880 - RNA, 15 nt, Human
uagaaauaaaccuua

SEQ ID NO: 3236881 - RNA, 21 nt, Human
uagaaaguguucuguuacaaa

SEQ ID NO: 3236882 - RNA, 20 nt, Human
uagaaaguguucuguuacaa

SEQ ID NO: 3236883 - RNA, 22 nt, Human
uagaaaguguucuguuacaaaa

SEQ ID NO: 3236884 - RNA, 22 nt, Human
uagaaagcuuuguugaaagaaa

SEQ ID NO: 3236885 - RNA, 19 nt, Human
uagaaaguguucuguuaca

SEQ ID NO: 3236886 - RNA, 16 nt, Human
uagaaaguguucuguu

SEQ ID NO: 3236887 - RNA, 23 nt, Human
uagaaagcugcugugaucccagu

SEQ ID NO: 3236888 - RNA, 16 nt, Human
uacuugcacucuucua

SEQ ID NO: 3236889 - RNA, 16 nt, Human
uacuugcccugaccau

SEQ ID NO: 3236890 - RNA, 22 nt, Human
uacuugcccugaccaugcauuu

SEQ ID NO: 3236891 - RNA, 14 nt, Human
uacuugcacucuuc

SEQ ID NO: 3236892 - RNA, 16 nt, Human
uacuugauaagggacu

SEQ ID NO: 3236893 - RNA, 21 nt, Human
uacuugauaacaauguuuuaa

SEQ ID NO: 3236894 - RNA, 17 nt, Human
uacuugauaacaauguu

SEQ ID NO: 3236895 - RNA, 14 nt, Human
uacuugaauaguau

SEQ ID NO: 3236896 - RNA, 15 nt, Human
uacuugaauaguauu

SEQ ID NO: 3236897 - RNA, 21 nt, Human
uacuuagcacuuggccugaga

SEQ ID NO: 3236898 - RNA, 17 nt, Human
uacuuagcacuuggccu

SEQ ID NO: 3236899 - RNA, 17 nt, Human
uacuuggaaauauuaaa

SEQ ID NO: 3236900 - RNA, 21 nt, Human
uacuuggaaauauuaaaagaa

SEQ ID NO: 3236901 - RNA, 14 nt, Human
uacuuguggacaca

SEQ ID NO: 3236902 - RNA, 19 nt, Human
uacuuggucacagccaggc

SEQ ID NO: 3236903 - RNA, 15 nt, Human
uacuuggucacagcc

SEQ ID NO: 3236904 - RNA, 18 nt, Human
uacuuggucacagccagg

SEQ ID NO: 3236905 - RNA, 17 nt, Human
uacuuggucacagccag

SEQ ID NO: 3236906 - RNA, 18 nt, Human
uacuuguggacacagcuc

SEQ ID NO: 3236907 - RNA, 15 nt, Human
uacuuguggacacag

SEQ ID NO: 3236908 - RNA, 19 nt, Human
uacuuguggacacagcucu

SEQ ID NO: 3236909 - RNA, 23 nt, Human
uacuuuaacuuaguuuugcauag

SEQ ID NO: 3236910 - RNA, 22 nt, Human
uacuuuaacuuaguuuugcaua

SEQ ID NO: 3236911 - RNA, 21 nt, Human
uacuuuaacuuaguuuugcau

SEQ ID NO: 3236912 - RNA, 13 nt, Human
uacuuuaacaugc

SEQ ID NO: 3236913 - RNA, 14 nt, Human
uacuuuaacaugcc

SEQ ID NO: 3236914 - RNA, 17 nt, Human
uacugugugugagugug

SEQ ID NO: 3236915 - RNA, 23 nt, Human
uacugugugugagugugaauaua

SEQ ID NO: 3236916 - RNA, 21 nt, Human
uacuguuuaagacacuuccgu

SEQ ID NO: 3236917 - RNA, 16 nt, Human
uacgaaguucaagauc

SEQ ID NO: 3236918 - RNA, 17 nt, Human
uacgaaguucaagauca

SEQ ID NO: 3236919 - RNA, 18 nt, Human
uacgaaguucaagaucaa

SEQ ID NO: 3236920 - RNA, 21 nt, Human
uacgacaaaggacgcucccag

SEQ ID NO: 3236921 - RNA, 21 nt, Human
uacgacucuuuuccaaacaca

SEQ ID NO: 3236922 - RNA, 12 nt, Human
uacuaacuucua

SEQ ID NO: 3236923 - RNA, 18 nt, Human
uacuaacuucuaaaacug

SEQ ID NO: 3236924 - RNA, 17 nt, Human
uacuaacuucuaaaacu

SEQ ID NO: 3236925 - RNA, 15 nt, Human
uacuacagucaagau

SEQ ID NO: 3236926 - RNA, 17 nt, Human
uacuacagucaagauag

SEQ ID NO: 3236927 - RNA, 21 nt, Human
uacuacagucaagauagaaag

SEQ ID NO: 3236928 - RNA, 17 nt, Human
uacuacaauauguacau

SEQ ID NO: 3236929 - RNA, 14 nt, Human
uacuacaauaugua

SEQ ID NO: 3236930 - RNA, 12 nt, Human
uacuacaguccu

SEQ ID NO: 3236931 - RNA, 17 nt, Human
uacuacaguccucccau

SEQ ID NO: 3236932 - RNA, 22 nt, Human
uacuaauaaaauuuaaaagucu

SEQ ID NO: 3236933 - RNA, 20 nt, Human
uacuaacuucuaaaacugua

SEQ ID NO: 3236934 - RNA, 19 nt, Human
uacuaacuucuaaaacugu

SEQ ID NO: 3236935 - RNA, 19 nt, Human
uaccuugucauuuuggucu

SEQ ID NO: 3236936 - RNA, 23 nt, Human
uaccuugcacacaucaucuguaa

SEQ ID NO: 3236937 - RNA, 12 nt, Human
uaccuugcccca

SEQ ID NO: 3236938 - RNA, 15 nt, Human
uaccuugccccaacc

SEQ ID NO: 3236939 - RNA, 16 nt, Human
uaccuugccccaaccc

SEQ ID NO: 3236940 - RNA, 20 nt, Human
uaccuugccccaacccuucu

SEQ ID NO: 3236941 - RNA, 21 nt, Human
uaccuugccccaacccuucuu

SEQ ID NO: 3236942 - RNA, 23 nt, Human
uaccuugccccaacccuucuuca

SEQ ID NO: 3236943 - RNA, 20 nt, Human
uaccuuugaauucaagaaca

SEQ ID NO: 3236944 - RNA, 16 nt, Human
uaccuugaacugaagg

SEQ ID NO: 3236945 - RNA, 21 nt, Human
uaccuugcacacaucaucugu

SEQ ID NO: 3236946 - RNA, 22 nt, Human
uacccaucccauaugccugggc

SEQ ID NO: 3236947 - RNA, 23 nt, Human
uacugauguuccuagugaaagag

SEQ ID NO: 3236948 - RNA, 14 nt, Human
uacugauggaauuu

SEQ ID NO: 3236949 - RNA, 22 nt, Human
uacugaggauauggacacuggu

SEQ ID NO: 3236950 - RNA, 21 nt, Human
uacugagcagugauauucuuu

SEQ ID NO: 3236951 - RNA, 19 nt, Human
uacugagagugaacaaauu

SEQ ID NO: 3236952 - RNA, 18 nt, Human
uacugagcagugauauuc

SEQ ID NO: 3236953 - RNA, 15 nt, Human
uacugagcagugaua

SEQ ID NO: 3236954 - RNA, 15 nt, Human
uacugaggugcuaug

SEQ ID NO: 3236955 - RNA, 12 nt, Human
uacucccaucug

SEQ ID NO: 3236956 - RNA, 14 nt, Human
uacucccaucugug

SEQ ID NO: 3236957 - RNA, 16 nt, Human
uacucccaucugugaa

SEQ ID NO: 3236958 - RNA, 17 nt, Human
uacucccaucugugaaa

SEQ ID NO: 3236959 - RNA, 16 nt, Human
uacucauggaagagau

SEQ ID NO: 3236960 - RNA, 19 nt, Human
uacuccugucuucugcuuu

SEQ ID NO: 3236961 - RNA, 17 nt, Human
uacuccugucuucugcu

SEQ ID NO: 3236962 - RNA, 15 nt, Human
uacuccugucuucug

SEQ ID NO: 3236963 - RNA, 13 nt, Human
uacuccugucuuc

SEQ ID NO: 3236964 - RNA, 21 nt, Human
uacuccugucuucugcuuugu

SEQ ID NO: 3236965 - RNA, 20 nt, Human
uacuccugucuucugcuuug

SEQ ID NO: 3236966 - RNA, 22 nt, Human
uacuccugucuucugcuuuguu

SEQ ID NO: 3236967 - RNA, 15 nt, Human
uacuaccuccucucc

SEQ ID NO: 3236968 - RNA, 17 nt, Human
uacuaccuccucuccug

SEQ ID NO: 3236969 - RNA, 14 nt, Human
uacuaccuguaaug

SEQ ID NO: 3236970 - RNA, 14 nt, Human
uacucaccucaccc

SEQ ID NO: 3236971 - RNA, 12 nt, Human
uacucaccucac

SEQ ID NO: 3236972 - RNA, 19 nt, Human
uaauucuuugaccuguugg

SEQ ID NO: 3236973 - RNA, 13 nt, Human
uaauucuuugcaa

SEQ ID NO: 3236974 - RNA, 11 nt, Human
uaauucuuugc

SEQ ID NO: 3236975 - RNA, 21 nt, Human
uaauucuuugcaaaaauccaa

SEQ ID NO: 3236976 - RNA, 17 nt, Human
uaauucuuugcaaaaau

SEQ ID NO: 3236977 - RNA, 16 nt, Human
uaauucuuugcaaaaa

SEQ ID NO: 3236978 - RNA, 14 nt, Human
uaauucuuugcaaa

SEQ ID NO: 3236979 - RNA, 22 nt, Human
uaauucuuauuccauauuagaa

SEQ ID NO: 3236980 - RNA, 19 nt, Human
uaauucuuauuccauauua

SEQ ID NO: 3236981 - RNA, 17 nt, Human
uaauucuuauuccauau

SEQ ID NO: 3236982 - RNA, 16 nt, Human
uaauucuuauuccaua

SEQ ID NO: 3236983 - RNA, 15 nt, Human
uaauucuuauuccau

SEQ ID NO: 3236984 - RNA, 20 nt, Human
uaauugacaggauuauugga

SEQ ID NO: 3236985 - RNA, 15 nt, Human
uaauucuuuuuuauu

SEQ ID NO: 3236986 - RNA, 16 nt, Human
uaauucuuuuuuauua

SEQ ID NO: 3236987 - RNA, 17 nt, Human
uaauucuuuuuuauuaa

SEQ ID NO: 3236988 - RNA, 18 nt, Human
uaauucuuuuuuauuaau

SEQ ID NO: 3236989 - RNA, 19 nt, Human
uaauucuuuuuuauuaauc

SEQ ID NO: 3236990 - RNA, 20 nt, Human
uaauucuuuuuuauuaauca

SEQ ID NO: 3236991 - RNA, 21 nt, Human
uaauucuuuuuuauuaaucac

SEQ ID NO: 3236992 - RNA, 23 nt, Human
uaauugaaaagaaguagugucug

SEQ ID NO: 3236993 - RNA, 22 nt, Human
uaauugacaggauuauuggaaa

SEQ ID NO: 3236994 - RNA, 19 nt, Human
uaauugacaggcgaaagaa

SEQ ID NO: 3236995 - RNA, 17 nt, Human
uaauugaaagaauguaa

SEQ ID NO: 3236996 - RNA, 15 nt, Human
uaauugaaagaaugu

SEQ ID NO: 3236997 - RNA, 14 nt, Human
uaauucuuauucca

SEQ ID NO: 3236998 - RNA, 15 nt, Human
uaauucuguucugau

SEQ ID NO: 3236999 - RNA, 20 nt, Human
uaauucuguucugauauuaa

SEQ ID NO: 3237000 - RNA, 21 nt, Human
uaauucuguucugauauuaau

SEQ ID NO: 3237001 - RNA, 22 nt, Human
uaauucuguucugauauuaauu

SEQ ID NO: 3237002 - RNA, 14 nt, Human
uaauucugaaguua

SEQ ID NO: 3237003 - RNA, 20 nt, Human
uaauucugaaguuauauuuc

SEQ ID NO: 3237004 - RNA, 19 nt, Human
uaauucugaaguuauauuu

SEQ ID NO: 3237005 - RNA, 17 nt, Human
uaauucugaaguuauau

SEQ ID NO: 3237006 - RNA, 16 nt, Human
uaauucugaaguuaua

SEQ ID NO: 3237007 - RNA, 23 nt, Human
uaauucugaaguuauauuuccua

SEQ ID NO: 3237008 - RNA, 22 nt, Human
uaauuacagugccuaaaauaag

SEQ ID NO: 3237009 - RNA, 15 nt, Human
uaauuaauuuggagc

SEQ ID NO: 3237010 - RNA, 20 nt, Human
uaauuaauuuggagcacaaa

SEQ ID NO: 3237011 - RNA, 19 nt, Human
uaauuacagugccuaaaau

SEQ ID NO: 3237012 - RNA, 19 nt, Human
uaauuacaauauuucugau

SEQ ID NO: 3237013 - RNA, 18 nt, Human
uaauuacaauauuucuga

SEQ ID NO: 3237014 - RNA, 16 nt, Human
uaauuacaauauuucu

SEQ ID NO: 3237015 - RNA, 14 nt, Human
uaauuaauuucagu

SEQ ID NO: 3237016 - RNA, 13 nt, Human
uaauuaauuucag

SEQ ID NO: 3237017 - RNA, 11 nt, Human
uaauuaauuuc

SEQ ID NO: 3237018 - RNA, 14 nt, Human
uaauuaaacuguua

SEQ ID NO: 3237019 - RNA, 15 nt, Human
uaauuaaacuguuaa

SEQ ID NO: 3237020 - RNA, 20 nt, Human
uaauuaaaagaauauuuuaa

SEQ ID NO: 3237021 - RNA, 17 nt, Human
uaauuaaaacacaacau

SEQ ID NO: 3237022 - RNA, 20 nt, Human
uaauuaaguacuauguauca

SEQ ID NO: 3237023 - RNA, 17 nt, Human
uaauuaauauauuaaaa

SEQ ID NO: 3237024 - RNA, 20 nt, Human
uaauuaauauauuaaaauuc

SEQ ID NO: 3237025 - RNA, 22 nt, Human
uaauuaauauauuaaaauucca

SEQ ID NO: 3237026 - RNA, 16 nt, Human
uaauguuuaagcagaa

SEQ ID NO: 3237027 - RNA, 23 nt, Human
uaaugcgcaggcuggcccugccc

SEQ ID NO: 3237028 - RNA, 15 nt, Human
uaauguuuauuaaau

SEQ ID NO: 3237029 - RNA, 16 nt, Human
uaauguuuauuaaaug

SEQ ID NO: 3237030 - RNA, 17 nt, Human
uaauguuuauuaaaugc

SEQ ID NO: 3237031 - RNA, 22 nt, Human
uaauguuuauuaaaugcuucau

SEQ ID NO: 3237032 - RNA, 22 nt, Human
uaauguuuaagcagaauuggaa

SEQ ID NO: 3237033 - RNA, 19 nt, Human
uaaugcgcaggcuggcccu

SEQ ID NO: 3237034 - RNA, 22 nt, Human
uaaugcgcaggcuggcccugcc

SEQ ID NO: 3237035 - RNA, 15 nt, Human
uaaugccuuuguaac

SEQ ID NO: 3237036 - RNA, 15 nt, Human
uaaugccugcuuuuu

SEQ ID NO: 3237037 - RNA, 20 nt, Human
uaaugccugcuuuuuggaaa

SEQ ID NO: 3237038 - RNA, 22 nt, Human
uaauuuuccuuuaauaugaaau

SEQ ID NO: 3237039 - RNA, 14 nt, Human
uaauuuuauuuugu

SEQ ID NO: 3237040 - RNA, 15 nt, Human
uaauuuuauuccaga

SEQ ID NO: 3237041 - RNA, 18 nt, Human
uaauuuuauuuuaaaauu

SEQ ID NO: 3237042 - RNA, 19 nt, Human
uaauuuuauuuuaaaauuu

SEQ ID NO: 3237043 - RNA, 19 nt, Human
uaauuuggaccauuuuccu

SEQ ID NO: 3237044 - RNA, 15 nt, Human
uaauuuguguguuuu

SEQ ID NO: 3237045 - RNA, 21 nt, Human
uaauuuguuggggcuuuacau

SEQ ID NO: 3237046 - RNA, 22 nt, Human
uaauuuguuggggcuuuacaua

SEQ ID NO: 3237047 - RNA, 12 nt, Human
uaauuuguuucc

SEQ ID NO: 3237048 - RNA, 16 nt, Human
uaauuuguuuccagca

SEQ ID NO: 3237049 - RNA, 17 nt, Human
uaauuuguggugauuug

SEQ ID NO: 3237050 - RNA, 15 nt, Human
uaauuuguaagaaua

SEQ ID NO: 3237051 - RNA, 17 nt, Human
uaauuuggaaacuaaua

SEQ ID NO: 3237052 - RNA, 19 nt, Human
uaauuuggaaacuaauaaa

SEQ ID NO: 3237053 - RNA, 20 nt, Human
uaauuuggaaacuaauaaaa

SEQ ID NO: 3237054 - RNA, 21 nt, Human
uaauuuggaaacuaauaaaau

SEQ ID NO: 3237055 - RNA, 22 nt, Human
uaauuuggaaacuaauaaaaua

SEQ ID NO: 3237056 - RNA, 23 nt, Human
uaauuuggaaacuaauaaaauau

SEQ ID NO: 3237057 - RNA, 20 nt, Human
uaauuuggaccauuuuccug

SEQ ID NO: 3237058 - RNA, 17 nt, Human
uaauuuggagcacaaaa

SEQ ID NO: 3237059 - RNA, 21 nt, Human
uaauuuggagcacaaaauuca

SEQ ID NO: 3237060 - RNA, 23 nt, Human
uaauuuggagcacaaaauucaaa

SEQ ID NO: 3237061 - RNA, 17 nt, Human
uaauuuggaccauuuuc

SEQ ID NO: 3237062 - RNA, 20 nt, Human
uaauuggcuuuacuauuuuu

SEQ ID NO: 3237063 - RNA, 20 nt, Human
uaauugguuaucaugggaaa

SEQ ID NO: 3237064 - RNA, 14 nt, Human
uaauugcacaacag

SEQ ID NO: 3237065 - RNA, 17 nt, Human
uaauugcauuugcuuuu

SEQ ID NO: 3237066 - RNA, 17 nt, Human
uaauugaucaguuuuca

SEQ ID NO: 3237067 - RNA, 16 nt, Human
uaauugcugaggcaug

SEQ ID NO: 3237068 - RNA, 22 nt, Human
uaauugugcaagcuuuuccuaa

SEQ ID NO: 3237069 - RNA, 12 nt, Human
uaauuguauuuu

SEQ ID NO: 3237070 - RNA, 15 nt, Human
uaauuguauuuuugu

SEQ ID NO: 3237071 - RNA, 12 nt, Human
uaauugugugaa

SEQ ID NO: 3237072 - RNA, 19 nt, Human
uaauugugugaacuuggaa

SEQ ID NO: 3237073 - RNA, 20 nt, Human
uaauugugugaacuuggaag

SEQ ID NO: 3237074 - RNA, 21 nt, Human
uaauugugugaacuuggaagc

SEQ ID NO: 3237075 - RNA, 22 nt, Human
uaauugugugaacuuggaagca

SEQ ID NO: 3237076 - RNA, 19 nt, Human
uaauugugugauauuucag

SEQ ID NO: 3237077 - RNA, 15 nt, Human
uaauugugugauauu

SEQ ID NO: 3237078 - RNA, 12 nt, Human
uaauuguuccag

SEQ ID NO: 3237079 - RNA, 14 nt, Human
uaauuguugcauag

SEQ ID NO: 3237080 - RNA, 22 nt, Human
uaauugugugauauuucagaaa

SEQ ID NO: 3237081 - RNA, 21 nt, Human
uaauugugugauauuucagaa

SEQ ID NO: 3237082 - RNA, 20 nt, Human
uaauugugugauauuucaga

SEQ ID NO: 3237083 - RNA, 15 nt, Human
uaauauauuuaaagg

SEQ ID NO: 3237084 - RNA, 19 nt, Human
uaauauauuuaaagggaaa

SEQ ID NO: 3237085 - RNA, 18 nt, Human
uaauauauuuaaagggaa

SEQ ID NO: 3237086 - RNA, 22 nt, Human
uaauauauuuaaagggaaauug

SEQ ID NO: 3237087 - RNA, 18 nt, Human
uaauauaauacacaaaau

SEQ ID NO: 3237088 - RNA, 12 nt, Human
uaauauagaaaa

SEQ ID NO: 3237089 - RNA, 19 nt, Human
uaauauagaaaaaaacauu

SEQ ID NO: 3237090 - RNA, 22 nt, Human
uaauauagaaaaaaacauucua

SEQ ID NO: 3237091 - RNA, 23 nt, Human
uaauauagaaaaaaacauucuau

SEQ ID NO: 3237092 - RNA, 12 nt, Human
uaauauauuaaa

SEQ ID NO: 3237093 - RNA, 15 nt, Human
uaauauauuaaaauu

SEQ ID NO: 3237094 - RNA, 16 nt, Human
uaauauauuaaaauuc

SEQ ID NO: 3237095 - RNA, 21 nt, Human
uaauauauuaaaauuccaaau

SEQ ID NO: 3237096 - RNA, 18 nt, Human
uaauauguuuccuucccu

SEQ ID NO: 3237097 - RNA, 20 nt, Human
uaauccucuaggaggucucu

SEQ ID NO: 3237098 - RNA, 15 nt, Human
uaauccuugauaaua

SEQ ID NO: 3237099 - RNA, 16 nt, Human
uaauccuugauaauau

SEQ ID NO: 3237100 - RNA, 13 nt, Human
uaaucgaccugcc

SEQ ID NO: 3237101 - RNA, 14 nt, Human
uaaucgaccugccu

SEQ ID NO: 3237102 - RNA, 16 nt, Human
uaaucgaccugccucg

SEQ ID NO: 3237103 - RNA, 16 nt, Human
uaaucguguccccuau

SEQ ID NO: 3237104 - RNA, 17 nt, Human
uaaucgggguauaauag

SEQ ID NO: 3237105 - RNA, 16 nt, Human
uaaugauaugcuugua

SEQ ID NO: 3237106 - RNA, 18 nt, Human
uaaugaucgaaaaaauaa

SEQ ID NO: 3237107 - RNA, 19 nt, Human
uaaugaucgaaaaaauaau

SEQ ID NO: 3237108 - RNA, 20 nt, Human
uaaugaucgaaaaaauaauu

SEQ ID NO: 3237109 - RNA, 13 nt, Human
uaaugauauacug

SEQ ID NO: 3237110 - RNA, 15 nt, Human
uaaugauaugcuugu

SEQ ID NO: 3237111 - RNA, 19 nt, Human
uaaugccacuaaauugaca

SEQ ID NO: 3237112 - RNA, 23 nt, Human
uaaugaugucguuugaaucacag

SEQ ID NO: 3237113 - RNA, 17 nt, Human
uaaugaugucguuugaa

SEQ ID NO: 3237114 - RNA, 12 nt, Human
uaaugauuguuu

SEQ ID NO: 3237115 - RNA, 14 nt, Human
uaaucuuaauguau

SEQ ID NO: 3237116 - RNA, 16 nt, Human
uaaucuuaauguauau

SEQ ID NO: 3237117 - RNA, 14 nt, Human
uaaucucuucuuau

SEQ ID NO: 3237118 - RNA, 15 nt, Human
uaaucucuucuuaua

SEQ ID NO: 3237119 - RNA, 16 nt, Human
uaaucucagugcuuuc

SEQ ID NO: 3237120 - RNA, 20 nt, Human
uaauaaagcgaaaaacucaa

SEQ ID NO: 3237121 - RNA, 17 nt, Human
uaauaaagcgaaaaacu

SEQ ID NO: 3237122 - RNA, 14 nt, Human
uaauaaccagacac

SEQ ID NO: 3237123 - RNA, 13 nt, Human
uaauaaccagaca

SEQ ID NO: 3237124 - RNA, 19 nt, Human
uaauaaccuuuaagucaga

SEQ ID NO: 3237125 - RNA, 15 nt, Human
uaauaaccagacaca

SEQ ID NO: 3237126 - RNA, 23 nt, Human
uaauaagggaaaaaucaaguauu

SEQ ID NO: 3237127 - RNA, 18 nt, Human
uaauaagggaaaaaucaa

SEQ ID NO: 3237128 - RNA, 17 nt, Human
uaauaagggaaaaauca

SEQ ID NO: 3237129 - RNA, 16 nt, Human
uaauaagggaaaaauc

SEQ ID NO: 3237130 - RNA, 15 nt, Human
uaauaagggaaaaau

SEQ ID NO: 3237131 - RNA, 14 nt, Human
uaauaagggaaaaa

SEQ ID NO: 3237132 - RNA, 15 nt, Human
uaauaaagacucuac

SEQ ID NO: 3237133 - RNA, 14 nt, Human
uaauaaagacucua

SEQ ID NO: 3237134 - RNA, 15 nt, Human
uaaggcaugaaggau

SEQ ID NO: 3237135 - RNA, 22 nt, Human
uaaggccaaguacacugagagc

SEQ ID NO: 3237136 - RNA, 16 nt, Human
uaauaauaaagaauag

SEQ ID NO: 3237137 - RNA, 21 nt, Human
uaauaguucagguaacaggca

SEQ ID NO: 3237138 - RNA, 20 nt, Human
uaauaauuuuuaagaaauaa

SEQ ID NO: 3237139 - RNA, 16 nt, Human
uaauacacaaaaucaa

SEQ ID NO: 3237140 - RNA, 14 nt, Human
uaauacacaaaauc

SEQ ID NO: 3237141 - RNA, 17 nt, Human
uaauacacaaaaucaaa

SEQ ID NO: 3237142 - RNA, 19 nt, Human
uaagaucucagugguuaag

SEQ ID NO: 3237143 - RNA, 13 nt, Human
uaagaucucagug

SEQ ID NO: 3237144 - RNA, 17 nt, Human
uaagaucgguuaacaaa

SEQ ID NO: 3237145 - RNA, 16 nt, Human
uaagaucgguuaacaa

SEQ ID NO: 3237146 - RNA, 19 nt, Human
uaagaucgguuaacaaaua

SEQ ID NO: 3237147 - RNA, 22 nt, Human
uaagcaugacagaaaauaugua

SEQ ID NO: 3237148 - RNA, 23 nt, Human
uaagcaucuaaggacaagguaag

SEQ ID NO: 3237149 - RNA, 17 nt, Human
uaagcaucuaaggacaa

SEQ ID NO: 3237150 - RNA, 13 nt, Human
uaagccagacauc

SEQ ID NO: 3237151 - RNA, 17 nt, Human
uaagccaaaauuaaggu

SEQ ID NO: 3237152 - RNA, 19 nt, Human
uaagccaaaauuaaggugu

SEQ ID NO: 3237153 - RNA, 21 nt, Human
uaagccaaaauuaagguguuu

SEQ ID NO: 3237154 - RNA, 13 nt, Human
uaaggcaugaagg

SEQ ID NO: 3237155 - RNA, 20 nt, Human
uaagccagacaucaacagau

SEQ ID NO: 3237156 - RNA, 21 nt, Human
uaagccagacaucaacagaua

SEQ ID NO: 3237157 - RNA, 21 nt, Human
uaagccuuuggaaacagcucg

SEQ ID NO: 3237158 - RNA, 21 nt, Human
uaagccuuuguugaacuguua

SEQ ID NO: 3237159 - RNA, 14 nt, Human
uaagccuuuggaaa

SEQ ID NO: 3237160 - RNA, 17 nt, Human
uaagccuuuggaaacag

SEQ ID NO: 3237161 - RNA, 13 nt, Human
uaagccaugagaa

SEQ ID NO: 3237162 - RNA, 13 nt, Human
uaagaaauaaauc

SEQ ID NO: 3237163 - RNA, 19 nt, Human
uaagaacugcuuucuuucg

SEQ ID NO: 3237164 - RNA, 22 nt, Human
uaagaacugcuuucuuucguuu

SEQ ID NO: 3237165 - RNA, 13 nt, Human
uaagaagaaacua

SEQ ID NO: 3237166 - RNA, 22 nt, Human
uaagaggcagggucucacucug

SEQ ID NO: 3237167 - RNA, 22 nt, Human
uaagagauuggaucaaguauua

SEQ ID NO: 3237168 - RNA, 24 nt, Human
uaagaaagacuaucuaaauguuga

SEQ ID NO: 3237169 - RNA, 22 nt, Human
uaagaaccuuuugagugccuua

SEQ ID NO: 3237170 - RNA, 15 nt, Human
uaagaaauaucugug

SEQ ID NO: 3237171 - RNA, 18 nt, Human
uaagaaauaucugugaaa

SEQ ID NO: 3237172 - RNA, 19 nt, Human
uaagaaauaucugugaaau

SEQ ID NO: 3237173 - RNA, 18 nt, Human
uaagaaauacuguacaau

SEQ ID NO: 3237174 - RNA, 16 nt, Human
uaagaaauacuguaca

SEQ ID NO: 3237175 - RNA, 15 nt, Human
uaagaaauacagacu

SEQ ID NO: 3237176 - RNA, 23 nt, Human
uaagagggauuagggagagaaga

SEQ ID NO: 3237177 - RNA, 23 nt, Human
uaagagggagggagggcuccaga

SEQ ID NO: 3237178 - RNA, 12 nt, Human
uaagagggaggg

SEQ ID NO: 3237179 - RNA, 22 nt, Human
uaagagggagggagggcuccag

SEQ ID NO: 3237180 - RNA, 14 nt, Human
uaagauaaaugugc

SEQ ID NO: 3237181 - RNA, 17 nt, Human
uaagauaaaugugcuga

SEQ ID NO: 3237182 - RNA, 16 nt, Human
uaagauaaaugugcug

SEQ ID NO: 3237183 - RNA, 21 nt, Human
uaagaucacuguuuagauuug

SEQ ID NO: 3237184 - RNA, 18 nt, Human
uaagaucacuguuuagau

SEQ ID NO: 3237185 - RNA, 20 nt, Human
uaagaucacuguuuagauuu

SEQ ID NO: 3237186 - RNA, 12 nt, Human
uaagaucacugu

SEQ ID NO: 3237187 - RNA, 13 nt, Human
uaagaucacuguu

SEQ ID NO: 3237188 - RNA, 14 nt, Human
uaagaucacuguuu

SEQ ID NO: 3237189 - RNA, 15 nt, Human
uaagaucacuguuua

SEQ ID NO: 3237190 - RNA, 17 nt, Human
uaagaucacuguuuaga

SEQ ID NO: 3237191 - RNA, 12 nt, Human
uaagauacuguu

SEQ ID NO: 3237192 - RNA, 23 nt, Human
uaagauauacuuguuuuuguaaa

SEQ ID NO: 3237193 - RNA, 16 nt, Human
uaagauauacuuguuu

SEQ ID NO: 3237194 - RNA, 15 nt, Human
uaagauauuugcagu

SEQ ID NO: 3237195 - RNA, 22 nt, Human
uaagauauuugcaguuuuucau

SEQ ID NO: 3237196 - RNA, 17 nt, Human
uaacagcaguuucaggu

SEQ ID NO: 3237197 - RNA, 15 nt, Human
uaacagcaguuucag

SEQ ID NO: 3237198 - RNA, 15 nt, Human
uaacagccgcuccag

SEQ ID NO: 3237199 - RNA, 18 nt, Human
uaacagccgcuccagagu

SEQ ID NO: 3237200 - RNA, 16 nt, Human
uaacagccgcuccaga

SEQ ID NO: 3237201 - RNA, 22 nt, Human
uaacaggcaaacauuuucucuu

SEQ ID NO: 3237202 - RNA, 20 nt, Human
uaacaggcaaacauuuucuc

SEQ ID NO: 3237203 - RNA, 15 nt, Human
uaacaggcaaacauu

SEQ ID NO: 3237204 - RNA, 13 nt, Human
uaacaggcaaaca

SEQ ID NO: 3237205 - RNA, 22 nt, Human
uaaauuuaaguaaguuuuauaa

SEQ ID NO: 3237206 - RNA, 23 nt, Human
uaaauuuaaguaaguuuuauaag

SEQ ID NO: 3237207 - RNA, 23 nt, Human
uaaauugggguuuauuucagcaa

SEQ ID NO: 3237208 - RNA, 13 nt, Human
uaaauuguaaaac

SEQ ID NO: 3237209 - RNA, 14 nt, Human
uaaauugucuuaau

SEQ ID NO: 3237210 - RNA, 15 nt, Human
uaaauugucuuuaaa

SEQ ID NO: 3237211 - RNA, 16 nt, Human
uaaauugucuuuaaaa

SEQ ID NO: 3237212 - RNA, 18 nt, Human
uaaauugucuuuaaaaac

SEQ ID NO: 3237213 - RNA, 22 nt, Human
uaaauugucuuuaaaaacuguu

SEQ ID NO: 3237214 - RNA, 23 nt, Human
uaaauugucuuuaaaaacuguuu

SEQ ID NO: 3237215 - RNA, 14 nt, Human
uaacaauuaauugu

SEQ ID NO: 3237216 - RNA, 17 nt, Human
uaacaauuaauugucuu

SEQ ID NO: 3237217 - RNA, 20 nt, Human
uaacaauuaauugucuugca

SEQ ID NO: 3237218 - RNA, 20 nt, Human
uaaauuguuuaguggaaaau

SEQ ID NO: 3237219 - RNA, 23 nt, Human
uaaauugacacuuaaaaaugguu

SEQ ID NO: 3237220 - RNA, 15 nt, Human
uaaauugcuccuuga

SEQ ID NO: 3237221 - RNA, 24 nt, Human
uaaauugcucacaguuauuacaua

SEQ ID NO: 3237222 - RNA, 19 nt, Human
uaaauugcucacaguuauu

SEQ ID NO: 3237223 - RNA, 19 nt, Human
uaaauugauguugaugcaa

SEQ ID NO: 3237224 - RNA, 18 nt, Human
uaaauugauguugaugca

SEQ ID NO: 3237225 - RNA, 20 nt, Human
uaaauugauguugaugcaau

SEQ ID NO: 3237226 - RNA, 13 nt, Human
uaaauugcaagaa

SEQ ID NO: 3237227 - RNA, 12 nt, Human
uaaauugacugu

SEQ ID NO: 3237228 - RNA, 19 nt, Human
uaaauccacccauguuauc

SEQ ID NO: 3237229 - RNA, 15 nt, Human
uaaauugauguugau

SEQ ID NO: 3237230 - RNA, 14 nt, Human
uaaauugauguuga

SEQ ID NO: 3237231 - RNA, 13 nt, Human
uaaauugauguug

SEQ ID NO: 3237232 - RNA, 12 nt, Human
uaaauugauguu

SEQ ID NO: 3237233 - RNA, 21 nt, Human
uaacauuaaugccugcuuuuu

SEQ ID NO: 3237234 - RNA, 19 nt, Human
uaacaggcagauacaggaa

SEQ ID NO: 3237235 - RNA, 23 nt, Human
uaaccacagcuccuuuuccagag

SEQ ID NO: 3237236 - RNA, 21 nt, Human
uaaccacagcuccuuuuccag

SEQ ID NO: 3237237 - RNA, 19 nt, Human
uaaccacagcuccuuuucc

SEQ ID NO: 3237238 - RNA, 14 nt, Human
uaaccacaacuuuc

SEQ ID NO: 3237239 - RNA, 21 nt, Human
uaaccacaacuuucacuauaa

SEQ ID NO: 3237240 - RNA, 18 nt, Human
uaaccacagcuccuuuuc

SEQ ID NO: 3237241 - RNA, 17 nt, Human
uaaccacagcuccuuuu

SEQ ID NO: 3237242 - RNA, 14 nt, Human
uaaccacagcuccu

SEQ ID NO: 3237243 - RNA, 13 nt, Human
uaaccacagcucc

SEQ ID NO: 3237244 - RNA, 21 nt, Human
uaaccaagguagaaugaccuu

SEQ ID NO: 3237245 - RNA, 19 nt, Human
uaaccaggccauuuuuggu

SEQ ID NO: 3237246 - RNA, 16 nt, Human
uaaccagggccagaag

SEQ ID NO: 3237247 - RNA, 23 nt, Human
uaacuguccguaguaucagagau

SEQ ID NO: 3237248 - RNA, 23 nt, Human
uaacuguccuuuuucuucccuua

SEQ ID NO: 3237249 - RNA, 18 nt, Human
uaacuggugauauaucuc

SEQ ID NO: 3237250 - RNA, 17 nt, Human
uaacuggugauauaucu

SEQ ID NO: 3237251 - RNA, 16 nt, Human
uaacuguauauuugua

SEQ ID NO: 3237252 - RNA, 17 nt, Human
uaacuguauauuuguau

SEQ ID NO: 3237253 - RNA, 19 nt, Human
uaacuguauauuuguauga

SEQ ID NO: 3237254 - RNA, 20 nt, Human
uaacuguauauuuguaugau

SEQ ID NO: 3237255 - RNA, 19 nt, Human
uaacuguaauuauuugaau

SEQ ID NO: 3237256 - RNA, 18 nt, Human
uaacuguaauuauuugaa

SEQ ID NO: 3237257 - RNA, 16 nt, Human
uaacuguaauuauuug

SEQ ID NO: 3237258 - RNA, 23 nt, Human
uaacugcaaccuuguuuauuaaa

SEQ ID NO: 3237259 - RNA, 17 nt, Human
uaacugagugccuuuug

SEQ ID NO: 3237260 - RNA, 23 nt, Human
uaacugauuaguaagucuugccu

SEQ ID NO: 3237261 - RNA, 18 nt, Human
uaacugacuuaguucuuc

SEQ ID NO: 3237262 - RNA, 21 nt, Human
uaaccuaauuaauauauuaaa

SEQ ID NO: 3237263 - RNA, 13 nt, Human
uaaccuaguuaaa

SEQ ID NO: 3237264 - RNA, 17 nt, Human
uaaccuaguuaaagaaa

SEQ ID NO: 3237265 - RNA, 19 nt, Human
uaaccuaguuaaagaaagg

SEQ ID NO: 3237266 - RNA, 20 nt, Human
uaaccuaguuaaagaaagga

SEQ ID NO: 3237267 - RNA, 22 nt, Human
uaaccuaguuaaagaaaggaaa

SEQ ID NO: 3237268 - RNA, 16 nt, Human
uaacugagugccuuuu

SEQ ID NO: 3237269 - RNA, 14 nt, Human
uaacuccacugcuu

SEQ ID NO: 3237270 - RNA, 20 nt, Human
guuucuuugaauuuucauuu

SEQ ID NO: 3237271 - RNA, 19 nt, Human
guuucuuugaauuuucauu

SEQ ID NO: 3237272 - RNA, 18 nt, Human
guuucuuugaauuuucau

SEQ ID NO: 3237273 - RNA, 17 nt, Human
guuucuuugaauuuuca

SEQ ID NO: 3237274 - RNA, 12 nt, Human
guuucuuugaau

SEQ ID NO: 3237275 - RNA, 20 nt, Human
guuucuuucucugaggacaa

SEQ ID NO: 3237276 - RNA, 19 nt, Human
guuucuuucucugaggaca

SEQ ID NO: 3237277 - RNA, 16 nt, Human
guuugaaccaagaacu

SEQ ID NO: 3237278 - RNA, 20 nt, Human
guuucuuugaucaugaauaa

SEQ ID NO: 3237279 - RNA, 21 nt, Human
guuucuuugaauuuucauuuu

SEQ ID NO: 3237280 - RNA, 18 nt, Human
guuugagaucagccuggg

SEQ ID NO: 3237281 - RNA, 14 nt, Human
guuucuaaagcugc

SEQ ID NO: 3237282 - RNA, 15 nt, Human
guuucuaaagcugcc

SEQ ID NO: 3237283 - RNA, 16 nt, Human
guuucuaaagcugcca

SEQ ID NO: 3237284 - RNA, 21 nt, Human
guuuccuugaggggagccagg

SEQ ID NO: 3237285 - RNA, 13 nt, Human
guuuccuucccuc

SEQ ID NO: 3237286 - RNA, 19 nt, Human
guuuguggaaaaugaaaau

SEQ ID NO: 3237287 - RNA, 18 nt, Human
guuuguuccccaagacau

SEQ ID NO: 3237288 - RNA, 13 nt, Human
guuugucucuucu

SEQ ID NO: 3237289 - RNA, 15 nt, Human
guuugucucuucugg

SEQ ID NO: 3237290 - RNA, 14 nt, Human
guuugucucuucug

SEQ ID NO: 3237291 - RNA, 16 nt, Human
guuugguuuuaaaaua

SEQ ID NO: 3237292 - RNA, 14 nt, Human
guuugguuuuuauu

SEQ ID NO: 3237293 - RNA, 17 nt, Human
guuugguuuuaaaauac

SEQ ID NO: 3237294 - RNA, 15 nt, Human
guuuguaaaaaugua

SEQ ID NO: 3237295 - RNA, 22 nt, Human
guuugguuuuuauuucuccuuu

SEQ ID NO: 3237296 - RNA, 20 nt, Human
guuugaugcauuaaaagaaa

SEQ ID NO: 3237297 - RNA, 13 nt, Human
guuugaucuuccu

SEQ ID NO: 3237298 - RNA, 22 nt, Human
guuugaucuuccucugcuaaau

SEQ ID NO: 3237299 - RNA, 21 nt, Human
guuugaucuuccucugcuaaa

SEQ ID NO: 3237300 - RNA, 15 nt, Human
guuugauaaauagug

SEQ ID NO: 3237301 - RNA, 14 nt, Human
guuugauaaauagu

SEQ ID NO: 3237302 - RNA, 18 nt, Human
guuugaggaaauuugcag

SEQ ID NO: 3237303 - RNA, 22 nt, Human
guuugaggauuaguuuagaaca

SEQ ID NO: 3237304 - RNA, 19 nt, Human
gguugggagaaugucagua

SEQ ID NO: 3237305 - RNA, 17 nt, Human
guuuacucacagccagc

SEQ ID NO: 3237306 - RNA, 16 nt, Human
guuuacucacagccag

SEQ ID NO: 3237307 - RNA, 23 nt, Human
gguugggacccaguggcagggca

SEQ ID NO: 3237308 - RNA, 14 nt, Human
guuuacuuuaacuu

SEQ ID NO: 3237309 - RNA, 13 nt, Human
guuuacuuuaacu

SEQ ID NO: 3237310 - RNA, 13 nt, Human
guuuagaaagcuu

SEQ ID NO: 3237311 - RNA, 21 nt, Human
gguuggccccugcccggcugc

SEQ ID NO: 3237312 - RNA, 18 nt, Human
gguuggcaaaaaggcagg

SEQ ID NO: 3237313 - RNA, 19 nt, Human
gguuggcugggaaaucgag

SEQ ID NO: 3237314 - RNA, 19 nt, Human
gguugggacccaguggcag

SEQ ID NO: 3237315 - RNA, 22 nt, Human
gguugggacccaguggcagggc

SEQ ID NO: 3237316 - RNA, 21 nt, Human
gguugggacccaguggcaggg

SEQ ID NO: 3237317 - RNA, 20 nt, Human
guuuaggauguugaaaaagu

SEQ ID NO: 3237318 - RNA, 12 nt, Human
guuuagauuugc

SEQ ID NO: 3237319 - RNA, 22 nt, Human
guuuagauuugccauagaguac

SEQ ID NO: 3237320 - RNA, 14 nt, Human
guuuagauuuugug

SEQ ID NO: 3237321 - RNA, 22 nt, Human
guuuagauuuuguguuuauucu

SEQ ID NO: 3237322 - RNA, 17 nt, Human
guuuagauuuuguguuu

SEQ ID NO: 3237323 - RNA, 22 nt, Human
guuuccugcccugggaggcagu

SEQ ID NO: 3237324 - RNA, 21 nt, Human
guuuccuggcacugcuuccag

SEQ ID NO: 3237325 - RNA, 22 nt, Human
guuuccuggcacugcuuccagu

SEQ ID NO: 3237326 - RNA, 16 nt, Human
guuuccuggcacugcu

SEQ ID NO: 3237327 - RNA, 20 nt, Human
guuuccuggcacugcuucca

SEQ ID NO: 3237328 - RNA, 13 nt, Human
guuuccugcccug

SEQ ID NO: 3237329 - RNA, 17 nt, Human
guuuccugcccugggag

SEQ ID NO: 3237330 - RNA, 23 nt, Human
guuucagguagaggugcaugccu

SEQ ID NO: 3237331 - RNA, 14 nt, Human
guuuccauaguuua

SEQ ID NO: 3237332 - RNA, 19 nt, Human
guuucagguagaggugcau

SEQ ID NO: 3237333 - RNA, 14 nt, Human
uaaaaaaagaaaaa

SEQ ID NO: 3237334 - RNA, 15 nt, Human
uaaaaaaagaaaaaa

SEQ ID NO: 3237335 - RNA, 11 nt, Human
uaaaaaaagaa

SEQ ID NO: 3237336 - RNA, 10 nt, Human
uaaaaaaaga

SEQ ID NO: 3237337 - RNA, 14 nt, Human
uaaaaaaacagcuu

SEQ ID NO: 3237338 - RNA, 15 nt, Human
uaaaaaaaaauugua

SEQ ID NO: 3237339 - RNA, 12 nt, Human
uaaaaaaaagaa

SEQ ID NO: 3237340 - RNA, 14 nt, Human
uaaaaaaaagaaaa

SEQ ID NO: 3237341 - RNA, 11 nt, Human
uaaaaaaaaga

SEQ ID NO: 3237342 - RNA, 20 nt, Human
uaaaaaaaacucuuuaacuu

SEQ ID NO: 3237343 - RNA, 17 nt, Human
uaaaaaaaagaaaaaag

SEQ ID NO: 3237344 - RNA, 16 nt, Human
uaaaaaaaagaaaaaa

SEQ ID NO: 3237345 - RNA, 15 nt, Human
uaaaaaaaagaaaaa

SEQ ID NO: 3237346 - RNA, 17 nt, Human
guuuuuauuucuccuuu

SEQ ID NO: 3237347 - RNA, 16 nt, Human
guuuuuauuucuccuu

SEQ ID NO: 3237348 - RNA, 12 nt, Human
guuuuucaguuc

SEQ ID NO: 3237349 - RNA, 20 nt, Human
guuuuucaguucaaagucau

SEQ ID NO: 3237350 - RNA, 21 nt, Human
guuuuucaguucaaagucaug

SEQ ID NO: 3237351 - RNA, 20 nt, Human
uaaaaaacugcugacuguuu

SEQ ID NO: 3237352 - RNA, 23 nt, Human
uaaaaaacugcugacuguuuucu

SEQ ID NO: 3237353 - RNA, 15 nt, Human
uaaaaaagcugugug

SEQ ID NO: 3237354 - RNA, 21 nt, Human
uaaaaaacuuucuacucauuu

SEQ ID NO: 3237355 - RNA, 21 nt, Human
uaaaaagaaaacaaaaccaaa

SEQ ID NO: 3237356 - RNA, 22 nt, Human
uaaaaaugagguacucuccugg

SEQ ID NO: 3237357 - RNA, 17 nt, Human
uaaaaagaaaacaaaac

SEQ ID NO: 3237358 - RNA, 14 nt, Human
uaaaaacugaaguu

SEQ ID NO: 3237359 - RNA, 16 nt, Human
uaaaaacugaaguucu

SEQ ID NO: 3237360 - RNA, 15 nt, Human
uaaaaacugaaguuc

SEQ ID NO: 3237361 - RNA, 21 nt, Human
uaaaaaauuuaaaaagcccaa

SEQ ID NO: 3237362 - RNA, 15 nt, Human
uaaaaacaaaaggca

SEQ ID NO: 3237363 - RNA, 14 nt, Human
uaaaaaaugacaaa

SEQ ID NO: 3237364 - RNA, 22 nt, Human
uaaaaaaucaugccaguauuuu

SEQ ID NO: 3237365 - RNA, 16 nt, Human
guuuucauuaucucaa

SEQ ID NO: 3237366 - RNA, 13 nt, Human
guuuuccugaaga

SEQ ID NO: 3237367 - RNA, 22 nt, Human
guuuucggugccaucagugccc

SEQ ID NO: 3237368 - RNA, 16 nt, Human
guuuucaguguacaug

SEQ ID NO: 3237369 - RNA, 17 nt, Human
guuuucaguguacaugg

SEQ ID NO: 3237370 - RNA, 22 nt, Human
guuuucaggugcucaaaaugca

SEQ ID NO: 3237371 - RNA, 16 nt, Human
guuuguugugaggauu

SEQ ID NO: 3237372 - RNA, 18 nt, Human
guuuguucuuguuuuuaa

SEQ ID NO: 3237373 - RNA, 19 nt, Human
guuuguugagcugguaaca

SEQ ID NO: 3237374 - RNA, 21 nt, Human
guuuguugagcugguaacauc

SEQ ID NO: 3237375 - RNA, 22 nt, Human
guuuguugagcugguaacaucg

SEQ ID NO: 3237376 - RNA, 10 nt, Human
guuuguuuca

SEQ ID NO: 3237377 - RNA, 15 nt, Human
guuuuuaaaaauuag

SEQ ID NO: 3237378 - RNA, 14 nt, Human
guuuuuaaaaauua

SEQ ID NO: 3237379 - RNA, 16 nt, Human
guuuuguuuuuugagu

SEQ ID NO: 3237380 - RNA, 15 nt, Human
guuuuuaaaaucuua

SEQ ID NO: 3237381 - RNA, 13 nt, Human
guuuuuaaaaucu

SEQ ID NO: 3237382 - RNA, 20 nt, Human
guuuuuaaaaucuuauuaaa

SEQ ID NO: 3237383 - RNA, 12 nt, Human
guuuucucuuga

SEQ ID NO: 3237384 - RNA, 19 nt, Human
guuuucucuugagagggug

SEQ ID NO: 3237385 - RNA, 13 nt, Human
guuuucucucuau

SEQ ID NO: 3237386 - RNA, 13 nt, Human
guuuuguuuuuug

SEQ ID NO: 3237387 - RNA, 13 nt, Human
guuuugugaaauu

SEQ ID NO: 3237388 - RNA, 18 nt, Human
guuuugugaaauuuuuca

SEQ ID NO: 3237389 - RNA, 14 nt, Human
guuuugugaaauuu

SEQ ID NO: 3237390 - RNA, 17 nt, Human
guuuugugguuuggaau

SEQ ID NO: 3237391 - RNA, 23 nt, Human
guuuugugaaauuuuucauauuu

SEQ ID NO: 3237392 - RNA, 22 nt, Human
guuuugugaaauuuuucauauu

SEQ ID NO: 3237393 - RNA, 20 nt, Human
guuuugugaaauuuuucaua

SEQ ID NO: 3237394 - RNA, 19 nt, Human
guuuugugaaauuuuucau

SEQ ID NO: 3237395 - RNA, 17 nt, Human
uaaacuuugaaauauau

SEQ ID NO: 3237396 - RNA, 14 nt, Human
uaaacuuuuaccac

SEQ ID NO: 3237397 - RNA, 22 nt, Human
uaaacuuuuaccacuugcugca

SEQ ID NO: 3237398 - RNA, 16 nt, Human
uaaacuuugaaauaua

SEQ ID NO: 3237399 - RNA, 15 nt, Human
uaaacuuugaaauau

SEQ ID NO: 3237400 - RNA, 14 nt, Human
uaaacuuugaaaua

SEQ ID NO: 3237401 - RNA, 13 nt, Human
uaaacuuugaaau

SEQ ID NO: 3237402 - RNA, 12 nt, Human
uaaacuuugaaa

SEQ ID NO: 3237403 - RNA, 11 nt, Human
uaaacuuugaa

SEQ ID NO: 3237404 - RNA, 18 nt, Human
uaaacuuucuuaauauuu

SEQ ID NO: 3237405 - RNA, 23 nt, Human
uaaagcauauccauucagaauga

SEQ ID NO: 3237406 - RNA, 14 nt, Human
uaaagcgaaaaacu

SEQ ID NO: 3237407 - RNA, 17 nt, Human
uaaagcgaaaaacucaa

SEQ ID NO: 3237408 - RNA, 14 nt, Human
uaaagcucaaauga

SEQ ID NO: 3237409 - RNA, 15 nt, Human
uaaagcucaaaugaa

SEQ ID NO: 3237410 - RNA, 17 nt, Human
uaaagcucaaaugaaau

SEQ ID NO: 3237411 - RNA, 18 nt, Human
uaaagcucaaaugaaaug

SEQ ID NO: 3237412 - RNA, 19 nt, Human
uaaagcucaaaugaaaugu

SEQ ID NO: 3237413 - RNA, 20 nt, Human
uaaagcucaaaugaaaugua

SEQ ID NO: 3237414 - RNA, 17 nt, Human
uaaaguuugaucuuccu

SEQ ID NO: 3237415 - RNA, 13 nt, Human
uaaaguuucuguu

SEQ ID NO: 3237416 - RNA, 15 nt, Human
uaaaguuugaucuuc

SEQ ID NO: 3237417 - RNA, 12 nt, Human
uaaaguuugauc

SEQ ID NO: 3237418 - RNA, 24 nt, Human
uaaaguuucaaaaaucugaagauu

SEQ ID NO: 3237419 - RNA, 19 nt, Human
uaaaucagccguguaacca

SEQ ID NO: 3237420 - RNA, 22 nt, Human
uaaaucaaccaccuauuuuuga

SEQ ID NO: 3237421 - RNA, 19 nt, Human
uaaaucaaguuggcuucua

SEQ ID NO: 3237422 - RNA, 15 nt, Human
uaaaucauaaaguca

SEQ ID NO: 3237423 - RNA, 16 nt, Human
uaaaucauaaagucag

SEQ ID NO: 3237424 - RNA, 17 nt, Human
uaaaucauaaagucagu

SEQ ID NO: 3237425 - RNA, 22 nt, Human
uaaaucauacuccuaugcuuua

SEQ ID NO: 3237426 - RNA, 20 nt, Human
uaaaucauauauaauaaauu

SEQ ID NO: 3237427 - RNA, 19 nt, Human
uaaauauguagauaaugga

SEQ ID NO: 3237428 - RNA, 14 nt, Human
uaaauauuaagcau

SEQ ID NO: 3237429 - RNA, 19 nt, Human
uaaauauucacacuugaac

SEQ ID NO: 3237430 - RNA, 18 nt, Human
uaaauauucacacuugaa

SEQ ID NO: 3237431 - RNA, 14 nt, Human
uaaauauucacacu

SEQ ID NO: 3237432 - RNA, 17 nt, Human
uaaauauaccacucuuu

SEQ ID NO: 3237433 - RNA, 19 nt, Human
uaaauauaccacucuuuac

SEQ ID NO: 3237434 - RNA, 21 nt, Human
uaaauauaccacucuuuaccu

SEQ ID NO: 3237435 - RNA, 21 nt, Human
uaaauauagcaguagucuuuu

SEQ ID NO: 3237436 - RNA, 11 nt, Human
uaaacacuguu

SEQ ID NO: 3237437 - RNA, 14 nt, Human
uaaacacuguguau

SEQ ID NO: 3237438 - RNA, 18 nt, Human
uaaacaaaguuucagagu

SEQ ID NO: 3237439 - RNA, 23 nt, Human
uaaacaaaguuucagaguauauu

SEQ ID NO: 3237440 - RNA, 16 nt, Human
uaaacaaaucuuucca

SEQ ID NO: 3237441 - RNA, 13 nt, Human
uaaacaaaucuuu

SEQ ID NO: 3237442 - RNA, 19 nt, Human
uaaaauggcaaguuuucca

SEQ ID NO: 3237443 - RNA, 22 nt, Human
uaaaauggcaacaaacugcaca

SEQ ID NO: 3237444 - RNA, 20 nt, Human
uaaaauggcaacaaacugca

SEQ ID NO: 3237445 - RNA, 18 nt, Human
uaaaauggcaacaaacug

SEQ ID NO: 3237446 - RNA, 13 nt, Human
uaaaaugcaaaaa

SEQ ID NO: 3237447 - RNA, 20 nt, Human
uaaaaugcaaaaaaucuuaa

SEQ ID NO: 3237448 - RNA, 19 nt, Human
uaaaaugcaaaaaaucuua

SEQ ID NO: 3237449 - RNA, 18 nt, Human
uaaaaugcaaaaaaucuu

SEQ ID NO: 3237450 - RNA, 17 nt, Human
uaaaaugcaaaaaaucu

SEQ ID NO: 3237451 - RNA, 15 nt, Human
uaaaaugcaaaaaau

SEQ ID NO: 3237452 - RNA, 20 nt, Human
uaaaauggaaaacuuaguuu

SEQ ID NO: 3237453 - RNA, 17 nt, Human
uaaaauggcaacaaacu

SEQ ID NO: 3237454 - RNA, 16 nt, Human
uaaaauggcaacaaac

SEQ ID NO: 3237455 - RNA, 20 nt, Human
uaaacugcccccucugcccu

SEQ ID NO: 3237456 - RNA, 21 nt, Human
uaaacugcccccucugcccug

SEQ ID NO: 3237457 - RNA, 22 nt, Human
uaaacugcccccucugcccugc

SEQ ID NO: 3237458 - RNA, 23 nt, Human
uaaacugcccccucugcccugcg

SEQ ID NO: 3237459 - RNA, 17 nt, Human
uaaaaugaagaauuuaa

SEQ ID NO: 3237460 - RNA, 15 nt, Human
uaaaaugaagaauuu

SEQ ID NO: 3237461 - RNA, 16 nt, Human
uaaaaugaagaauuua

SEQ ID NO: 3237462 - RNA, 15 nt, Human
uaaaaugauugaaaa

SEQ ID NO: 3237463 - RNA, 22 nt, Human
uaaaauauuuaugaagaaaaua

SEQ ID NO: 3237464 - RNA, 15 nt, Human
uaaaaucuccuaaau

SEQ ID NO: 3237465 - RNA, 17 nt, Human
uaaaaucuccuaaaugc

SEQ ID NO: 3237466 - RNA, 15 nt, Human
uaaaaucacguuaaa

SEQ ID NO: 3237467 - RNA, 12 nt, Human
uaaaauauuuuc

SEQ ID NO: 3237468 - RNA, 21 nt, Human
uaaaauauuuaugaagaaaau

SEQ ID NO: 3237469 - RNA, 12 nt, Human
uaaaaggcccag

SEQ ID NO: 3237470 - RNA, 14 nt, Human
uaaaaggcccagag

SEQ ID NO: 3237471 - RNA, 13 nt, Human
uaaaaggcccaga

SEQ ID NO: 3237472 - RNA, 13 nt, Human
uaaaauauuuucu

SEQ ID NO: 3237473 - RNA, 14 nt, Human
uaaaauauuuucug

SEQ ID NO: 3237474 - RNA, 15 nt, Human
uaaaauauuuucugu

SEQ ID NO: 3237475 - RNA, 16 nt, Human
uaaaauauuuucugug

SEQ ID NO: 3237476 - RNA, 17 nt, Human
uaaaauauuuucugugu

SEQ ID NO: 3237477 - RNA, 18 nt, Human
uaaaauauuuucugugug

SEQ ID NO: 3237478 - RNA, 19 nt, Human
uaaaauauuuucugugugu

SEQ ID NO: 3237479 - RNA, 20 nt, Human
uaaaauauuuucuguguguu

SEQ ID NO: 3237480 - RNA, 21 nt, Human
uaaaauauuuucuguguguuc

SEQ ID NO: 3237481 - RNA, 22 nt, Human
uaaaauauuuucuguguguucc

SEQ ID NO: 3237482 - RNA, 23 nt, Human
uaaaauauuuucuguguguuccu

SEQ ID NO: 3237483 - RNA, 24 nt, Human
uaaaauauuuucuguguguuccug

SEQ ID NO: 3237484 - RNA, 12 nt, Human
uaaaagcccagg

SEQ ID NO: 3237485 - RNA, 18 nt, Human
uaaaagcauuuuguaaua

SEQ ID NO: 3237486 - RNA, 17 nt, Human
uaaaagcauuuuguaau

SEQ ID NO: 3237487 - RNA, 14 nt, Human
uaaaagcauuuugu

SEQ ID NO: 3237488 - RNA, 16 nt, Human
uaaaagcauuuuguaa

SEQ ID NO: 3237489 - RNA, 15 nt, Human
uaaaagcauuuugua

SEQ ID NO: 3237490 - RNA, 22 nt, Human
uaaaagcuaucuucauguaaau

SEQ ID NO: 3237491 - RNA, 15 nt, Human
uaaaagcuuucaugu

SEQ ID NO: 3237492 - RNA, 16 nt, Human
uaaaagcuuucauguc

SEQ ID NO: 3237493 - RNA, 12 nt, Human
uaaaagccuugg

SEQ ID NO: 3237494 - RNA, 21 nt, Human
uaaaagccuuggccucagagg

SEQ ID NO: 3237495 - RNA, 19 nt, Human
uaaaagccuuggccucaga

SEQ ID NO: 3237496 - RNA, 19 nt, Human
uaaaagccuaggucuauuu

SEQ ID NO: 3237497 - RNA, 19 nt, Human
uaaaagcccaggagcccau

SEQ ID NO: 3237498 - RNA, 18 nt, Human
uaaaagcccaggagccca

SEQ ID NO: 3237499 - RNA, 17 nt, Human
uaaaagcccaggagccc

SEQ ID NO: 3237500 - RNA, 16 nt, Human
uaaaagcccaggagcc

SEQ ID NO: 3237501 - RNA, 15 nt, Human
uaaaagcccaggagc

SEQ ID NO: 3237502 - RNA, 14 nt, Human
uaaaagcccaggag

SEQ ID NO: 3237503 - RNA, 20 nt, Human
uaaaaaugguaucaaaauua

SEQ ID NO: 3237504 - RNA, 16 nt, Human
uaaaagaugcaaugua

SEQ ID NO: 3237505 - RNA, 14 nt, Human
uaaaagaugaaaau

SEQ ID NO: 3237506 - RNA, 17 nt, Human
ugggguggggaccucag

SEQ ID NO: 3237507 - RNA, 16 nt, Human
uggggcauccaugggg

SEQ ID NO: 3237508 - RNA, 22 nt, Human
ugggucaugaugcucuuuccca

SEQ ID NO: 3237509 - RNA, 17 nt, Human
uggguagggcucugaca

SEQ ID NO: 3237510 - RNA, 22 nt, Human
uggguagcuguaaggcaugaag

SEQ ID NO: 3237511 - RNA, 22 nt, Human
ugggguggggggaugguaagag

SEQ ID NO: 3237512 - RNA, 13 nt, Human
uggguagcuguaa

SEQ ID NO: 3237513 - RNA, 23 nt, Human
ugggugucaagagggucugagga

SEQ ID NO: 3237514 - RNA, 21 nt, Human
ugggugucaagagggucugag

SEQ ID NO: 3237515 - RNA, 23 nt, Human
uggguccaggccuacuccugucu

SEQ ID NO: 3237516 - RNA, 21 nt, Human
uggguccaggccuacuccugu

SEQ ID NO: 3237517 - RNA, 18 nt, Human
uggguccaggccuacucc

SEQ ID NO: 3237518 - RNA, 17 nt, Human
uggguccaggccuacuc

SEQ ID NO: 3237519 - RNA, 16 nt, Human
uggguucacugcaacc

SEQ ID NO: 3237520 - RNA, 23 nt, Human
uggguucaagcgauucuucugcu

SEQ ID NO: 3237521 - RNA, 14 nt, Human
uggguuaguggaug

SEQ ID NO: 3237522 - RNA, 17 nt, Human
uggguuggaaaacagua

SEQ ID NO: 3237523 - RNA, 21 nt, Human
uggguuccagcaauucuccug

SEQ ID NO: 3237524 - RNA, 21 nt, Human
uggguuccuuccucugagccu

SEQ ID NO: 3237525 - RNA, 22 nt, Human
uggguuccuuccucugagccuu

SEQ ID NO: 3237526 - RNA, 18 nt, Human
ugggccuucagggaguga

SEQ ID NO: 3237527 - RNA, 15 nt, Human
ugggccuucagggag

SEQ ID NO: 3237528 - RNA, 16 nt, Human
ugggccuccugugugu

SEQ ID NO: 3237529 - RNA, 14 nt, Human
ugggccuccugugu

SEQ ID NO: 3237530 - RNA, 23 nt, Human
ugggcauuacuguuuaagacacu

SEQ ID NO: 3237531 - RNA, 14 nt, Human
ugggcagucauuuu

SEQ ID NO: 3237532 - RNA, 24 nt, Human
ugggagcugccuguucagcuccag

SEQ ID NO: 3237533 - RNA, 18 nt, Human
ugggagcuggaguccacu

SEQ ID NO: 3237534 - RNA, 19 nt, Human
ugggcuucaguggcagcug

SEQ ID NO: 3237535 - RNA, 18 nt, Human
ugggcuucaguggcagcu

SEQ ID NO: 3237536 - RNA, 18 nt, Human
ugggcgugagaccugccc

SEQ ID NO: 3237537 - RNA, 19 nt, Human
ugggcgugagaccugcccc

SEQ ID NO: 3237538 - RNA, 17 nt, Human
ugggcgugagaccugcc

SEQ ID NO: 3237539 - RNA, 13 nt, Human
uggggcagcuuga

SEQ ID NO: 3237540 - RNA, 21 nt, Human
ugggcuuggggaccagagcug

SEQ ID NO: 3237541 - RNA, 16 nt, Human
uggggcagcuugaggg

SEQ ID NO: 3237542 - RNA, 19 nt, Human
ugggcuuggggaccagagc

SEQ ID NO: 3237543 - RNA, 20 nt, Human
ugggcuucaguggcagcugc

SEQ ID NO: 3237544 - RNA, 17 nt, Human
ugggcuucaguggcagc

SEQ ID NO: 3237545 - RNA, 14 nt, Human
uggcucuacacaua

SEQ ID NO: 3237546 - RNA, 12 nt, Human
uggcucuacaca

SEQ ID NO: 3237547 - RNA, 15 nt, Human
uggcucuacacauau

SEQ ID NO: 3237548 - RNA, 13 nt, Human
uggcucuuccagg

SEQ ID NO: 3237549 - RNA, 15 nt, Human
uggcucuuccaggcu

SEQ ID NO: 3237550 - RNA, 12 nt, Human
uggcugggggcc

SEQ ID NO: 3237551 - RNA, 16 nt, Human
uggcucuuccaggcug

SEQ ID NO: 3237552 - RNA, 20 nt, Human
uggcucagguggggucacuc

SEQ ID NO: 3237553 - RNA, 22 nt, Human
uggcucagguggggucacucug

SEQ ID NO: 3237554 - RNA, 15 nt, Human
uggcuccugcccacu

SEQ ID NO: 3237555 - RNA, 13 nt, Human
uggcuccugccca

SEQ ID NO: 3237556 - RNA, 18 nt, Human
uggcgaaucucaaaauua

SEQ ID NO: 3237557 - RNA, 18 nt, Human
uggcgcuagaggccaugg

SEQ ID NO: 3237558 - RNA, 14 nt, Human
uggcgcugccccug

SEQ ID NO: 3237559 - RNA, 22 nt, Human
uggcgugcaguggugcgaucug

SEQ ID NO: 3237560 - RNA, 14 nt, Human
uggccuucggccuc

SEQ ID NO: 3237561 - RNA, 18 nt, Human
uggccuugggauccaggc

SEQ ID NO: 3237562 - RNA, 15 nt, Human
uggccuuguggucca

SEQ ID NO: 3237563 - RNA, 16 nt, Human
uggccuugugguccaa

SEQ ID NO: 3237564 - RNA, 19 nt, Human
uggccuugugguccaaaua

SEQ ID NO: 3237565 - RNA, 21 nt, Human
uggccuugugguccaaauagg

SEQ ID NO: 3237566 - RNA, 21 nt, Human
uggccuugggauccaggcccc

SEQ ID NO: 3237567 - RNA, 17 nt, Human
uggccuucggccuccau

SEQ ID NO: 3237568 - RNA, 18 nt, Human
uggccuucggccuccauc

SEQ ID NO: 3237569 - RNA, 16 nt, Human
ugggacaugggaaagg

SEQ ID NO: 3237570 - RNA, 19 nt, Human
ugggacauccugucaucug

SEQ ID NO: 3237571 - RNA, 16 nt, Human
ugggacagggcauggc

SEQ ID NO: 3237572 - RNA, 20 nt, Human
ugggaccacaggugcccgcc

SEQ ID NO: 3237573 - RNA, 22 nt, Human
ugggacccaguggcagggcaca

SEQ ID NO: 3237574 - RNA, 21 nt, Human
ugggacccaguggcagggcac

SEQ ID NO: 3237575 - RNA, 20 nt, Human
ugggacccaguggcagggca

SEQ ID NO: 3237576 - RNA, 19 nt, Human
ugggacccaguggcagggc

SEQ ID NO: 3237577 - RNA, 18 nt, Human
ugggacccaguggcaggg

SEQ ID NO: 3237578 - RNA, 17 nt, Human
ugggacccaguggcagg

SEQ ID NO: 3237579 - RNA, 14 nt, Human
ugggacccaguggc

SEQ ID NO: 3237580 - RNA, 23 nt, Human
ugggagcugccuguucagcucca

SEQ ID NO: 3237581 - RNA, 23 nt, Human
ugggagccgggcaaacuggccgc

SEQ ID NO: 3237582 - RNA, 13 nt, Human
ugggagccgggca

SEQ ID NO: 3237583 - RNA, 20 nt, Human
ugggaauguauaguauuuga

SEQ ID NO: 3237584 - RNA, 14 nt, Human
ugggaauguauagu

SEQ ID NO: 3237585 - RNA, 23 nt, Human
ugggaauguauaguauuugaaaa

SEQ ID NO: 3237586 - RNA, 22 nt, Human
ugggaauguauaguauuugaaa

SEQ ID NO: 3237587 - RNA, 21 nt, Human
ugggaauguauaguauuugaa

SEQ ID NO: 3237588 - RNA, 21 nt, Human
ugggaaugaaugucaguguga

SEQ ID NO: 3237589 - RNA, 22 nt, Human
ugggaaugaaugucagugugac

SEQ ID NO: 3237590 - RNA, 14 nt, Human
uggcuuuucacugc

SEQ ID NO: 3237591 - RNA, 17 nt, Human
uggcuuuuacccuuuuu

SEQ ID NO: 3237592 - RNA, 22 nt, Human
uggcugguuagagguucccuuu

SEQ ID NO: 3237593 - RNA, 14 nt, Human
uggcugggggccuc

SEQ ID NO: 3237594 - RNA, 15 nt, Human
uggaauuauuuuaaa

SEQ ID NO: 3237595 - RNA, 23 nt, Human
uggaauuagaacccuugcacagc

SEQ ID NO: 3237596 - RNA, 22 nt, Human
uggaauuagaacccuugcacag

SEQ ID NO: 3237597 - RNA, 12 nt, Human
uggaauauuaaa

SEQ ID NO: 3237598 - RNA, 13 nt, Human
uggaauauuaaaa

SEQ ID NO: 3237599 - RNA, 20 nt, Human
uggaaucauuguccagagcu

SEQ ID NO: 3237600 - RNA, 18 nt, Human
uggaaucauuguccagag

SEQ ID NO: 3237601 - RNA, 21 nt, Human
uggaagugugggucugugugu

SEQ ID NO: 3237602 - RNA, 20 nt, Human
uggaagugugggucugugug

SEQ ID NO: 3237603 - RNA, 14 nt, Human
uggaagacagcucu

SEQ ID NO: 3237604 - RNA, 23 nt, Human
uggaagugugggucugugugugu

SEQ ID NO: 3237605 - RNA, 21 nt, Human
uggaagugugugaucuguggg

SEQ ID NO: 3237606 - RNA, 18 nt, Human
uggaaguuaaagugaggc

SEQ ID NO: 3237607 - RNA, 12 nt, Human
uggaaaaauaaa

SEQ ID NO: 3237608 - RNA, 17 nt, Human
uggaaaaauaaaacugu

SEQ ID NO: 3237609 - RNA, 15 nt, Human
uggaaaauaaaucaa

SEQ ID NO: 3237610 - RNA, 11 nt, Human
uggaaaauaaa

SEQ ID NO: 3237611 - RNA, 14 nt, Human
uggaaaaaaacauc

SEQ ID NO: 3237612 - RNA, 16 nt, Human
uggaaaauaaauuauu

SEQ ID NO: 3237613 - RNA, 15 nt, Human
uggaaaauaaauuau

SEQ ID NO: 3237614 - RNA, 14 nt, Human
uggaacucucgagc

SEQ ID NO: 3237615 - RNA, 23 nt, Human
uggaacucuugacagcuauaauu

SEQ ID NO: 3237616 - RNA, 11 nt, Human
uggaagacagc

SEQ ID NO: 3237617 - RNA, 12 nt, Human
uggaagacagcu

SEQ ID NO: 3237618 - RNA, 18 nt, Human
ugcuucucugcccagcuu

SEQ ID NO: 3237619 - RNA, 16 nt, Human
ugcuucuucagagacu

SEQ ID NO: 3237620 - RNA, 12 nt, Human
ugcuucugccac

SEQ ID NO: 3237621 - RNA, 13 nt, Human
ugcuucugccacc

SEQ ID NO: 3237622 - RNA, 19 nt, Human
ugcuuccagugaggcucug

SEQ ID NO: 3237623 - RNA, 20 nt, Human
ugcuuccagugaggcucugc

SEQ ID NO: 3237624 - RNA, 16 nt, Human
ugcuuccagugaggcu

SEQ ID NO: 3237625 - RNA, 18 nt, Human
ugcuuccagugaggcucu

SEQ ID NO: 3237626 - RNA, 13 nt, Human
ugcugccucaugc

SEQ ID NO: 3237627 - RNA, 14 nt, Human
ugcugccuccagaa

SEQ ID NO: 3237628 - RNA, 15 nt, Human
ugcugccucaggaau

SEQ ID NO: 3237629 - RNA, 13 nt, Human
ugcugccucagga

SEQ ID NO: 3237630 - RNA, 14 nt, Human
ugcuuuccaaagcc

SEQ ID NO: 3237631 - RNA, 23 nt, Human
ugcuuucaagaucuaaaucauau

SEQ ID NO: 3237632 - RNA, 20 nt, Human
ugcuuuuuuugaaacuuuga

SEQ ID NO: 3237633 - RNA, 15 nt, Human
ugcuuuuuuugaaac

SEQ ID NO: 3237634 - RNA, 13 nt, Human
ugcuuuuuuugaa

SEQ ID NO: 3237635 - RNA, 19 nt, Human
ugcuuuuuuccaaaacaaa

SEQ ID NO: 3237636 - RNA, 20 nt, Human
ugcuuuuuuccaaaacaaaa

SEQ ID NO: 3237637 - RNA, 22 nt, Human
ugcuuuccauauuuuuuuccuu

SEQ ID NO: 3237638 - RNA, 21 nt, Human
ugcuuuccauauuuuuuuccu

SEQ ID NO: 3237639 - RNA, 15 nt, Human
ugcuuuccauauuuu

SEQ ID NO: 3237640 - RNA, 14 nt, Human
ugcuuuccauauuu

SEQ ID NO: 3237641 - RNA, 18 nt, Human
ugcuuguuaacugagugc

SEQ ID NO: 3237642 - RNA, 14 nt, Human
ugcuugaacuuaca

SEQ ID NO: 3237643 - RNA, 16 nt, Human
ugcuuguuaacugagu

SEQ ID NO: 3237644 - RNA, 14 nt, Human
ugcuuguugacaga

SEQ ID NO: 3237645 - RNA, 18 nt, Human
ugcuuuagacuugaaaag

SEQ ID NO: 3237646 - RNA, 19 nt, Human
ugcuuuagacuugaaaaga

SEQ ID NO: 3237647 - RNA, 21 nt, Human
ugcuuuagacuugaaaagaga

SEQ ID NO: 3237648 - RNA, 16 nt, Human
uggagagcccagaguc

SEQ ID NO: 3237649 - RNA, 14 nt, Human
uggagagauaggaa

SEQ ID NO: 3237650 - RNA, 20 nt, Human
uggagaggcccggccucuca

SEQ ID NO: 3237651 - RNA, 17 nt, Human
uggaauuauuuuaaaag

SEQ ID NO: 3237652 - RNA, 16 nt, Human
uggacaggcauguucu

SEQ ID NO: 3237653 - RNA, 12 nt, Human
uggacaggcaug

SEQ ID NO: 3237654 - RNA, 13 nt, Human
uggagagaaauau

SEQ ID NO: 3237655 - RNA, 17 nt, Human
uggagacugucucaaga

SEQ ID NO: 3237656 - RNA, 14 nt, Human
uggaggcucaaauu

SEQ ID NO: 3237657 - RNA, 20 nt, Human
uggaggcauugaugcaugcu

SEQ ID NO: 3237658 - RNA, 22 nt, Human
uggaggcaugugaugagaggaa

SEQ ID NO: 3237659 - RNA, 15 nt, Human
uggauaccauuauau

SEQ ID NO: 3237660 - RNA, 13 nt, Human
uggauaccauuau

SEQ ID NO: 3237661 - RNA, 17 nt, Human
uggauacgugucaaugu

SEQ ID NO: 3237662 - RNA, 21 nt, Human
uggauacgugucaaugugugc

SEQ ID NO: 3237663 - RNA, 20 nt, Human
uggccacuccagaccccugg

SEQ ID NO: 3237664 - RNA, 22 nt, Human
uggccacuccagaccccuggcu

SEQ ID NO: 3237665 - RNA, 20 nt, Human
uggcagugggagcugccugu

SEQ ID NO: 3237666 - RNA, 21 nt, Human
uggcagggcacagggccuggc

SEQ ID NO: 3237667 - RNA, 20 nt, Human
uggcagggcacagggccugg

SEQ ID NO: 3237668 - RNA, 19 nt, Human
uggcagggcacagggccug

SEQ ID NO: 3237669 - RNA, 19 nt, Human
uggcagugggagcugccug

SEQ ID NO: 3237670 - RNA, 16 nt, Human
uggcagugggagcugc

SEQ ID NO: 3237671 - RNA, 15 nt, Human
uggcagugggagcug

SEQ ID NO: 3237672 - RNA, 14 nt, Human
uggcagugggagcu

SEQ ID NO: 3237673 - RNA, 13 nt, Human
uggcagugggagc

SEQ ID NO: 3237674 - RNA, 18 nt, Human
uggcagggcacagggccu

SEQ ID NO: 3237675 - RNA, 17 nt, Human
uggcagggcacagggcc

SEQ ID NO: 3237676 - RNA, 16 nt, Human
uggcagggcacagggc

SEQ ID NO: 3237677 - RNA, 15 nt, Human
uggcagggcacaggg

SEQ ID NO: 3237678 - RNA, 14 nt, Human
uggcagggcacagg

SEQ ID NO: 3237679 - RNA, 13 nt, Human
uggcagggcacag

SEQ ID NO: 3237680 - RNA, 21 nt, Human
uggcaggcaggggcccugcag

SEQ ID NO: 3237681 - RNA, 11 nt, Human
uggcaggcagg

SEQ ID NO: 3237682 - RNA, 12 nt, Human
uggcaggcaggg

SEQ ID NO: 3237683 - RNA, 22 nt, Human
uggcagcugcgguccacccagg

SEQ ID NO: 3237684 - RNA, 21 nt, Human
uggcagcugcgguccacccag

SEQ ID NO: 3237685 - RNA, 19 nt, Human
uggcagcugcgguccaccc

SEQ ID NO: 3237686 - RNA, 22 nt, Human
uggcacuugccauuccaaaaua

SEQ ID NO: 3237687 - RNA, 14 nt, Human
uggaugccuggugg

SEQ ID NO: 3237688 - RNA, 20 nt, Human
uggaugccucauuaugucaa

SEQ ID NO: 3237689 - RNA, 14 nt, Human
uggcacugcuucca

SEQ ID NO: 3237690 - RNA, 16 nt, Human
uggcacugcuuccagu

SEQ ID NO: 3237691 - RNA, 18 nt, Human
uggcacugcuuccaguga

SEQ ID NO: 3237692 - RNA, 17 nt, Human
ugcaggaaauggcugug

SEQ ID NO: 3237693 - RNA, 22 nt, Human
ugcagcuuuaaaaaauuaaucu

SEQ ID NO: 3237694 - RNA, 14 nt, Human
ugcaggaccucagg

SEQ ID NO: 3237695 - RNA, 15 nt, Human
ugcaggaccucaggu

SEQ ID NO: 3237696 - RNA, 16 nt, Human
ugcaggaccucaggug

SEQ ID NO: 3237697 - RNA, 18 nt, Human
ugcaggaccucaggugag

SEQ ID NO: 3237698 - RNA, 13 nt, Human
ugcagcuuuaaaa

SEQ ID NO: 3237699 - RNA, 17 nt, Human
ugcagccacuuaggaca

SEQ ID NO: 3237700 - RNA, 16 nt, Human
ugcagccacuuaggac

SEQ ID NO: 3237701 - RNA, 16 nt, Human
ugcagauaaacaguag

SEQ ID NO: 3237702 - RNA, 20 nt, Human
ugcagaguauuuuuguauuc

SEQ ID NO: 3237703 - RNA, 24 nt, Human
ugcagaguucagggaagauaaguu

SEQ ID NO: 3237704 - RNA, 19 nt, Human
ugcagaguucagggaagau

SEQ ID NO: 3237705 - RNA, 15 nt, Human
ugcacuuuguucugg

SEQ ID NO: 3237706 - RNA, 18 nt, Human
ugcacuuuguucuggcuc

SEQ ID NO: 3237707 - RNA, 19 nt, Human
ugcacuuuguucuggcucu

SEQ ID NO: 3237708 - RNA, 16 nt, Human
ugcacguacacacaca

SEQ ID NO: 3237709 - RNA, 16 nt, Human
ugcacuugcagacucu

SEQ ID NO: 3237710 - RNA, 21 nt, Human
ugcacuugcagacucuacaga

SEQ ID NO: 3237711 - RNA, 21 nt, Human
ugcacuugggggcucagcaag

SEQ ID NO: 3237712 - RNA, 19 nt, Human
ugcacuugggggcucagca

SEQ ID NO: 3237713 - RNA, 22 nt, Human
ugcacuugggggcucagcaagg

SEQ ID NO: 3237714 - RNA, 21 nt, Human
ugcacuuggggcacagggaga

SEQ ID NO: 3237715 - RNA, 17 nt, Human
ugcacuuggggcacagg

SEQ ID NO: 3237716 - RNA, 18 nt, Human
ugcacagcuaacauggaa

SEQ ID NO: 3237717 - RNA, 20 nt, Human
ugcacagcuaacauggaagu

SEQ ID NO: 3237718 - RNA, 23 nt, Human
ugcacagcuaacauggaaguacu

SEQ ID NO: 3237719 - RNA, 23 nt, Human
ugcacaggcagagcccagacccu

SEQ ID NO: 3237720 - RNA, 12 nt, Human
ugcacaggcaga

SEQ ID NO: 3237721 - RNA, 18 nt, Human
ugcacagugcaucucagc

SEQ ID NO: 3237722 - RNA, 20 nt, Human
ugcacagugcaucucagccc

SEQ ID NO: 3237723 - RNA, 19 nt, Human
ugcacagugcaucucagcc

SEQ ID NO: 3237724 - RNA, 18 nt, Human
ugcacauaaacucuuuua

SEQ ID NO: 3237725 - RNA, 13 nt, Human
ugaaguccggaac

SEQ ID NO: 3237726 - RNA, 17 nt, Human
ugaagucuuuguacaga

SEQ ID NO: 3237727 - RNA, 20 nt, Human
ugaagucuuuguacagacaa

SEQ ID NO: 3237728 - RNA, 22 nt, Human
ugaagucuuuguacagacaaca

SEQ ID NO: 3237729 - RNA, 17 nt, Human
ugaagucuguauuguaa

SEQ ID NO: 3237730 - RNA, 17 nt, Human
ugcacagcuaacaugga

SEQ ID NO: 3237731 - RNA, 19 nt, Human
ugcauuaaaagaaaauaaa

SEQ ID NO: 3237732 - RNA, 18 nt, Human
ugccaacugaucuguuau

SEQ ID NO: 3237733 - RNA, 21 nt, Human
ugccaaccucgcuccaacucc

SEQ ID NO: 3237734 - RNA, 19 nt, Human
ugccaaccucgcuccaacu

SEQ ID NO: 3237735 - RNA, 15 nt, Human
ugccaaccucgcucc

SEQ ID NO: 3237736 - RNA, 22 nt, Human
ugccaaaacccagcugcacccc

SEQ ID NO: 3237737 - RNA, 21 nt, Human
ugccaaaacccagcugcaccc

SEQ ID NO: 3237738 - RNA, 20 nt, Human
ugccaaaacccagcugcacc

SEQ ID NO: 3237739 - RNA, 19 nt, Human
ugccaaaacccagcugcac

SEQ ID NO: 3237740 - RNA, 18 nt, Human
ugccaaaacccagcugca

SEQ ID NO: 3237741 - RNA, 17 nt, Human
ugccaaaacccagcugc

SEQ ID NO: 3237742 - RNA, 16 nt, Human
ugccaaaacccagcug

SEQ ID NO: 3237743 - RNA, 22 nt, Human
ugcaucagcugcugaaacaaca

SEQ ID NO: 3237744 - RNA, 19 nt, Human
ugcaucagcugcugaaaca

SEQ ID NO: 3237745 - RNA, 17 nt, Human
ugcaggcagccaggcca

SEQ ID NO: 3237746 - RNA, 18 nt, Human
ugcaggcagccaggccac

SEQ ID NO: 3237747 - RNA, 16 nt, Human
ugcaggcagccaggcc

SEQ ID NO: 3237748 - RNA, 22 nt, Human
ugcaggagcaguaucaugaagc

SEQ ID NO: 3237749 - RNA, 13 nt, Human
ugcaggagcuucu

SEQ ID NO: 3237750 - RNA, 15 nt, Human
ugcaucguuucaucu

SEQ ID NO: 3237751 - RNA, 16 nt, Human
ugcaugugucuuuaua

SEQ ID NO: 3237752 - RNA, 21 nt, Human
ugcauccuccgccucccgggu

SEQ ID NO: 3237753 - RNA, 15 nt, Human
ugcauccuccgccuc

SEQ ID NO: 3237754 - RNA, 18 nt, Human
ugcauccuccgccucccg

SEQ ID NO: 3237755 - RNA, 12 nt, Human
ugcaucaguucu

SEQ ID NO: 3237756 - RNA, 19 nt, Human
ugcaucaucuugaacauua

SEQ ID NO: 3237757 - RNA, 13 nt, Human
ugccaguauuuuu

SEQ ID NO: 3237758 - RNA, 18 nt, Human
ugccaguauuuuuaaagg

SEQ ID NO: 3237759 - RNA, 14 nt, Human
ugccagucaccccg

SEQ ID NO: 3237760 - RNA, 23 nt, Human
ugccaguaccagccccacccugu

SEQ ID NO: 3237761 - RNA, 22 nt, Human
ugccaguaccagccccacccug

SEQ ID NO: 3237762 - RNA, 24 nt, Human
ugccagguuuuuggucugacccac

SEQ ID NO: 3237763 - RNA, 24 nt, Human
ugccaguaacacaggccacccugu

SEQ ID NO: 3237764 - RNA, 23 nt, Human
ugccaguaacacaggccacccug

SEQ ID NO: 3237765 - RNA, 23 nt, Human
ugccaagagcccgucugcuccug

SEQ ID NO: 3237766 - RNA, 19 nt, Human
ugccaagagcccgucugcu

SEQ ID NO: 3237767 - RNA, 11 nt, Human
ugccagggaca

SEQ ID NO: 3237768 - RNA, 22 nt, Human
ugccagggacagaggggguggc

SEQ ID NO: 3237769 - RNA, 15 nt, Human
ugcccaccuggccuc

SEQ ID NO: 3237770 - RNA, 17 nt, Human
ugcccaccuggccucug

SEQ ID NO: 3237771 - RNA, 18 nt, Human
ugcccaccuggccucugc

SEQ ID NO: 3237772 - RNA, 14 nt, Human
ugcccaccuggccu

SEQ ID NO: 3237773 - RNA, 10 nt, Human
ugcccagccc

SEQ ID NO: 3237774 - RNA, 15 nt, Human
ugccaucucugcucc

SEQ ID NO: 3237775 - RNA, 13 nt, Human
ugccaucucugcu

SEQ ID NO: 3237776 - RNA, 16 nt, Human
ugccaucucugcucca

SEQ ID NO: 3237777 - RNA, 20 nt, Human
ugcucagcugucaaggcuca

SEQ ID NO: 3237778 - RNA, 16 nt, Human
ugcucagcugucaagg

SEQ ID NO: 3237779 - RNA, 19 nt, Human
ugcuccucuccccagcaag

SEQ ID NO: 3237780 - RNA, 18 nt, Human
ugcuccucuccccagcaa

SEQ ID NO: 3237781 - RNA, 21 nt, Human
ugcuccugagcccccagcuuc

SEQ ID NO: 3237782 - RNA, 16 nt, Human
ugcuccugagccccca

SEQ ID NO: 3237783 - RNA, 15 nt, Human
ugcuccugagccccc

SEQ ID NO: 3237784 - RNA, 14 nt, Human
ugcuccugagcccc

SEQ ID NO: 3237785 - RNA, 13 nt, Human
ugcuccugagccc

SEQ ID NO: 3237786 - RNA, 12 nt, Human
ugcuccugagcc

SEQ ID NO: 3237787 - RNA, 20 nt, Human
ugcucaucucaguccucaaa

SEQ ID NO: 3237788 - RNA, 23 nt, Human
ugcucaucucaguccucaaagcu

SEQ ID NO: 3237789 - RNA, 20 nt, Human
ugcuagaacucccuuucaac

SEQ ID NO: 3237790 - RNA, 21 nt, Human
ugcuagaacucccuuucaaca

SEQ ID NO: 3237791 - RNA, 16 nt, Human
ugcuaggaacacuccu

SEQ ID NO: 3237792 - RNA, 17 nt, Human
ugcuaggaacacuccuu

SEQ ID NO: 3237793 - RNA, 19 nt, Human
ugcuaggaacacuccuuca

SEQ ID NO: 3237794 - RNA, 19 nt, Human
ugcuagaacucccuuucaa

SEQ ID NO: 3237795 - RNA, 18 nt, Human
ugcuagaacucccuuuca

SEQ ID NO: 3237796 - RNA, 16 nt, Human
ugcguaugcaguguag

SEQ ID NO: 3237797 - RNA, 23 nt, Human
ugcucuuuggccugaugaccaau

SEQ ID NO: 3237798 - RNA, 20 nt, Human
ugcucuuuggccugaugacc

SEQ ID NO: 3237799 - RNA, 21 nt, Human
ugcucuuucuucuuccacaca

SEQ ID NO: 3237800 - RNA, 19 nt, Human
ugcuccuggcccacugcau

SEQ ID NO: 3237801 - RNA, 16 nt, Human
ugcuccuucccuugcu

SEQ ID NO: 3237802 - RNA, 22 nt, Human
ugcugaaugguuuucaaaauaa

SEQ ID NO: 3237803 - RNA, 18 nt, Human
ugcugaaugguuuucaaa

SEQ ID NO: 3237804 - RNA, 17 nt, Human
ugcugaaugguuuucaa

SEQ ID NO: 3237805 - RNA, 16 nt, Human
ugcugaaguccggaac

SEQ ID NO: 3237806 - RNA, 18 nt, Human
ugcugaauacagaggcaa

SEQ ID NO: 3237807 - RNA, 23 nt, Human
ugcugaauacagaggcaacugca

SEQ ID NO: 3237808 - RNA, 21 nt, Human
ugcugaaggcucgagcaugcc

SEQ ID NO: 3237809 - RNA, 22 nt, Human
ugcugaaaauugccuuucugug

SEQ ID NO: 3237810 - RNA, 21 nt, Human
ugcugagucuguucugguaau

SEQ ID NO: 3237811 - RNA, 16 nt, Human
ugcugagucuguucug

SEQ ID NO: 3237812 - RNA, 19 nt, Human
ugcugagucuguucuggua

SEQ ID NO: 3237813 - RNA, 23 nt, Human
ugcugaugacccccccagcuuca

SEQ ID NO: 3237814 - RNA, 22 nt, Human
ugcugaugacccccccagcuuc

SEQ ID NO: 3237815 - RNA, 16 nt, Human
ugcugacagacacagg

SEQ ID NO: 3237816 - RNA, 23 nt, Human
ugcugagucugaaggcuggguuc

SEQ ID NO: 3237817 - RNA, 15 nt, Human
ugcugacagacacag

SEQ ID NO: 3237818 - RNA, 18 nt, Human
ugcugauggugcaaugac

SEQ ID NO: 3237819 - RNA, 20 nt, Human
ugcugauggugcaaugaccu

SEQ ID NO: 3237820 - RNA, 23 nt, Human
ugcugauggugcaaugaccuuuc

SEQ ID NO: 3237821 - RNA, 15 nt, Human
ugcugcaguugccag

SEQ ID NO: 3237822 - RNA, 13 nt, Human
ugcugcagauacu

SEQ ID NO: 3237823 - RNA, 21 nt, Human
ugcugcagggcuuuaaaauuc

SEQ ID NO: 3237824 - RNA, 16 nt, Human
ugcugcagggcuuuaa

SEQ ID NO: 3237825 - RNA, 23 nt, Human
ugcggugcuaucucccccagccc

SEQ ID NO: 3237826 - RNA, 21 nt, Human
ugcggugcuaucucccccagc

SEQ ID NO: 3237827 - RNA, 13 nt, Human
ugcgcaggcuggc

SEQ ID NO: 3237828 - RNA, 16 nt, Human
ugcgcaggcuggcccu

SEQ ID NO: 3237829 - RNA, 17 nt, Human
ugcgcaggcuggcccug

SEQ ID NO: 3237830 - RNA, 18 nt, Human
ugccuuauggaacacucu

SEQ ID NO: 3237831 - RNA, 20 nt, Human
ugccuuauggaacacucuga

SEQ ID NO: 3237832 - RNA, 21 nt, Human
ugccuuauggaacacucugag

SEQ ID NO: 3237833 - RNA, 22 nt, Human
ugccuuauggaacacucugaga

SEQ ID NO: 3237834 - RNA, 21 nt, Human
ugccuggauggggcugcaccg

SEQ ID NO: 3237835 - RNA, 18 nt, Human
ugccuucagcucuacagc

SEQ ID NO: 3237836 - RNA, 17 nt, Human
ugccuucagcucuacag

SEQ ID NO: 3237837 - RNA, 17 nt, Human
ugccuuauguugaaaaa

SEQ ID NO: 3237838 - RNA, 13 nt, Human
ugccuucagcucu

SEQ ID NO: 3237839 - RNA, 16 nt, Human
ugccuccuuugugagg

SEQ ID NO: 3237840 - RNA, 17 nt, Human
ugccuccuuugugagga

SEQ ID NO: 3237841 - RNA, 18 nt, Human
ugccuccuuugugaggaa

SEQ ID NO: 3237842 - RNA, 14 nt, Human
ugccucugggacug

SEQ ID NO: 3237843 - RNA, 18 nt, Human
ugccuccuugauauuugu

SEQ ID NO: 3237844 - RNA, 22 nt, Human
ugccuccuugauauuuguauuu

SEQ ID NO: 3237845 - RNA, 17 nt, Human
ugccugaagucacacag

SEQ ID NO: 3237846 - RNA, 18 nt, Human
ugccugaagucacacagu

SEQ ID NO: 3237847 - RNA, 22 nt, Human
ugccugaagucacacagugagu

SEQ ID NO: 3237848 - RNA, 23 nt, Human
ugccuaggauucacaccccaccu

SEQ ID NO: 3237849 - RNA, 22 nt, Human
ugccuaggauucacaccccacc

SEQ ID NO: 3237850 - RNA, 20 nt, Human
ugccuaggauucacacccca

SEQ ID NO: 3237851 - RNA, 19 nt, Human
ugccuaaggcugaacuugu

SEQ ID NO: 3237852 - RNA, 11 nt, Human
ugcccagcccc

SEQ ID NO: 3237853 - RNA, 20 nt, Human
ugcccagaucagccagaagc

SEQ ID NO: 3237854 - RNA, 17 nt, Human
ugcccagaucagccaga

SEQ ID NO: 3237855 - RNA, 16 nt, Human
ugcccagaucagccag

SEQ ID NO: 3237856 - RNA, 23 nt, Human
ugcccaggcuggcgugcaguggu

SEQ ID NO: 3237857 - RNA, 22 nt, Human
ugcccagcccccuggucuuuga

SEQ ID NO: 3237858 - RNA, 14 nt, Human
uguauuuguagugu

SEQ ID NO: 3237859 - RNA, 17 nt, Human
uguauuuguaguguuau

SEQ ID NO: 3237860 - RNA, 12 nt, Human
ugucagugugac

SEQ ID NO: 3237861 - RNA, 20 nt, Human
ugucagugugacugaucucu

SEQ ID NO: 3237862 - RNA, 14 nt, Human
ugucagucacuaaa

SEQ ID NO: 3237863 - RNA, 14 nt, Human
ugucaguguuuggu

SEQ ID NO: 3237864 - RNA, 14 nt, Human
ugucaguuuauguu

SEQ ID NO: 3237865 - RNA, 18 nt, Human
ugucauaaagugagaaaa

SEQ ID NO: 3237866 - RNA, 20 nt, Human
ugucauaaagugagaaaacu

SEQ ID NO: 3237867 - RNA, 22 nt, Human
ugucauaaagugagaaaacugu

SEQ ID NO: 3237868 - RNA, 22 nt, Human
ugucaguuuauguuuuggucca

SEQ ID NO: 3237869 - RNA, 16 nt, Human
ugucaguuuauguuuu

SEQ ID NO: 3237870 - RNA, 20 nt, Human
ugucauacucgagucugagg

SEQ ID NO: 3237871 - RNA, 16 nt, Human
ugucaucaccauggaa

SEQ ID NO: 3237872 - RNA, 21 nt, Human
ugucauagaauagcauguugu

SEQ ID NO: 3237873 - RNA, 13 nt, Human
ugucauagccagu

SEQ ID NO: 3237874 - RNA, 23 nt, Human
ugucauucgcuacuaugauuuaa

SEQ ID NO: 3237875 - RNA, 13 nt, Human
ugucauugcuucu

SEQ ID NO: 3237876 - RNA, 18 nt, Human
ugucauugcuucuucuga

SEQ ID NO: 3237877 - RNA, 17 nt, Human
ugucauugcuucuucug

SEQ ID NO: 3237878 - RNA, 24 nt, Human
ugucauuagugagacauauuuaca

SEQ ID NO: 3237879 - RNA, 22 nt, Human
ugucauuagugagacauauuua

SEQ ID NO: 3237880 - RNA, 19 nt, Human
ugucccaugugagcugcug

SEQ ID NO: 3237881 - RNA, 14 nt, Human
uguccauuuuuaca

SEQ ID NO: 3237882 - RNA, 16 nt, Human
uguccauuuuuacaag

SEQ ID NO: 3237883 - RNA, 23 nt, Human
uguagcaaacccugucaaacauu

SEQ ID NO: 3237884 - RNA, 22 nt, Human
uguagcaaacccugucaaacau

SEQ ID NO: 3237885 - RNA, 21 nt, Human
uguagcaaacccugucaaaca

SEQ ID NO: 3237886 - RNA, 19 nt, Human
uguagcaaacccugucaaa

SEQ ID NO: 3237887 - RNA, 18 nt, Human
uguagcaaacccugucaa

SEQ ID NO: 3237888 - RNA, 15 nt, Human
uguagcaaacccugu

SEQ ID NO: 3237889 - RNA, 16 nt, Human
uguagauuugauuuuu

SEQ ID NO: 3237890 - RNA, 17 nt, Human
uguagauuuuauagugu

SEQ ID NO: 3237891 - RNA, 18 nt, Human
uguagauuuuauagugug

SEQ ID NO: 3237892 - RNA, 13 nt, Human
uguagauuugauu

SEQ ID NO: 3237893 - RNA, 14 nt, Human
uguauaauauugaa

SEQ ID NO: 3237894 - RNA, 20 nt, Human
uguauaauauugaaaauuga

SEQ ID NO: 3237895 - RNA, 21 nt, Human
uguauaauauugaaaauugaa

SEQ ID NO: 3237896 - RNA, 22 nt, Human
uguauaauauugaaaauugaaa

SEQ ID NO: 3237897 - RNA, 20 nt, Human
uguauaauucaaagcaccaa

SEQ ID NO: 3237898 - RNA, 15 nt, Human
uguauaauacuuugu

SEQ ID NO: 3237899 - RNA, 17 nt, Human
uguauaauacuuuguau

SEQ ID NO: 3237900 - RNA, 20 nt, Human
uguauaauacuuuguauaca

SEQ ID NO: 3237901 - RNA, 22 nt, Human
uguauaauacuuuguauacaag

SEQ ID NO: 3237902 - RNA, 19 nt, Human
uguauacguuucaaaaaca

SEQ ID NO: 3237903 - RNA, 12 nt, Human
uguauacaugug

SEQ ID NO: 3237904 - RNA, 18 nt, Human
uguauacaaguacuggua

SEQ ID NO: 3237905 - RNA, 19 nt, Human
uguauacaaguacugguaa

SEQ ID NO: 3237906 - RNA, 23 nt, Human
uguaucccaugagccucagcauc

SEQ ID NO: 3237907 - RNA, 19 nt, Human
uguaucccaugagccucag

SEQ ID NO: 3237908 - RNA, 16 nt, Human
uguaucccaugagccu

SEQ ID NO: 3237909 - RNA, 12 nt, Human
uguaucuaagaa

SEQ ID NO: 3237910 - RNA, 15 nt, Human
uguaucuaagaauaa

SEQ ID NO: 3237911 - RNA, 19 nt, Human
uguaucuaagaauaauaaa

SEQ ID NO: 3237912 - RNA, 20 nt, Human
uguaucuaagaauaauaaaa

SEQ ID NO: 3237913 - RNA, 21 nt, Human
uguaucuaagaauaauaaaau

SEQ ID NO: 3237914 - RNA, 20 nt, Human
uguaugcaagcaguuucaau

SEQ ID NO: 3237915 - RNA, 19 nt, Human
uguaugcaagcaguuucaa

SEQ ID NO: 3237916 - RNA, 18 nt, Human
uguaugcaagcaguuuca

SEQ ID NO: 3237917 - RNA, 16 nt, Human
uguaugcaagcaguuu

SEQ ID NO: 3237918 - RNA, 14 nt, Human
uguaugcacuuugu

SEQ ID NO: 3237919 - RNA, 12 nt, Human
uguaugcauaau

SEQ ID NO: 3237920 - RNA, 22 nt, Human
uguaugcauaauaauccugcaa

SEQ ID NO: 3237921 - RNA, 17 nt, Human
uguaugcauaauaaucc

SEQ ID NO: 3237922 - RNA, 12 nt, Human
uguauuugaaag

SEQ ID NO: 3237923 - RNA, 13 nt, Human
uguauuugaaagu

SEQ ID NO: 3237924 - RNA, 13 nt, Human
uguauugcuuucu

SEQ ID NO: 3237925 - RNA, 17 nt, Human
uguauugcuuucuuuca

SEQ ID NO: 3237926 - RNA, 17 nt, Human
uguauuguaacuauguu

SEQ ID NO: 3237927 - RNA, 17 nt, Human
uguaaacacucagcugu

SEQ ID NO: 3237928 - RNA, 18 nt, Human
uguaaacacucagcuguu

SEQ ID NO: 3237929 - RNA, 14 nt, Human
uguaaacaaaucuu

SEQ ID NO: 3237930 - RNA, 19 nt, Human
uguaaacaaaucuuuccau

SEQ ID NO: 3237931 - RNA, 18 nt, Human
uggguuuccaacaauuca

SEQ ID NO: 3237932 - RNA, 14 nt, Human
ugguaguuucugug

SEQ ID NO: 3237933 - RNA, 17 nt, Human
ugguaguugaggaaagc

SEQ ID NO: 3237934 - RNA, 20 nt, Human
ugguagugguuguaucugug

SEQ ID NO: 3237935 - RNA, 15 nt, Human
uguaaauuuauguga

SEQ ID NO: 3237936 - RNA, 22 nt, Human
uguaaauugacuguacuaggcc

SEQ ID NO: 3237937 - RNA, 16 nt, Human
uguaaauuuaugugau

SEQ ID NO: 3237938 - RNA, 15 nt, Human
uguaaauucugauuu

SEQ ID NO: 3237939 - RNA, 18 nt, Human
uguaaauucugauuucuu

SEQ ID NO: 3237940 - RNA, 19 nt, Human
uguaaauucugauuucuuu

SEQ ID NO: 3237941 - RNA, 22 nt, Human
uguaaauucugauuucuuuuca

SEQ ID NO: 3237942 - RNA, 13 nt, Human
uguaaauucugau

SEQ ID NO: 3237943 - RNA, 14 nt, Human
uguaaauucugauu

SEQ ID NO: 3237944 - RNA, 12 nt, Human
uguaaauucuga

SEQ ID NO: 3237945 - RNA, 23 nt, Human
uguaacuaaaauaauuuuguaau

SEQ ID NO: 3237946 - RNA, 19 nt, Human
uguaacgugugcuguguuu

SEQ ID NO: 3237947 - RNA, 18 nt, Human
uguaacgugugcuguguu

SEQ ID NO: 3237948 - RNA, 22 nt, Human
uguaacgugugcuguguuugcu

SEQ ID NO: 3237949 - RNA, 15 nt, Human
uguaacuaaaauaau

SEQ ID NO: 3237950 - RNA, 14 nt, Human
uguaacuaaaauaa

SEQ ID NO: 3237951 - RNA, 14 nt, Human
uguaaucacagcua

SEQ ID NO: 3237952 - RNA, 21 nt, Human
uguaacuguuaccauuggaaa

SEQ ID NO: 3237953 - RNA, 15 nt, Human
uguaaucacagcuac

SEQ ID NO: 3237954 - RNA, 12 nt, Human
uguaauccagca

SEQ ID NO: 3237955 - RNA, 20 nt, Human
uguaacuguuaccauuggaa

SEQ ID NO: 3237956 - RNA, 17 nt, Human
uguaacuguuaccauug

SEQ ID NO: 3237957 - RNA, 14 nt, Human
uguaacuguuacca

SEQ ID NO: 3237958 - RNA, 12 nt, Human
uguaacuguuac

SEQ ID NO: 3237959 - RNA, 15 nt, Human
uguaacuguuacagu

SEQ ID NO: 3237960 - RNA, 16 nt, Human
uguaacuguuacagua

SEQ ID NO: 3237961 - RNA, 18 nt, Human
uguaacuguuacaguaau

SEQ ID NO: 3237962 - RNA, 23 nt, Human
uguaacugcucuugggcaauauu

SEQ ID NO: 3237963 - RNA, 22 nt, Human
uguaacugcucuugggcaauau

SEQ ID NO: 3237964 - RNA, 17 nt, Human
uguaacuauguuuuauc

SEQ ID NO: 3237965 - RNA, 13 nt, Human
uguaacuauguuu

SEQ ID NO: 3237966 - RNA, 12 nt, Human
uguaacuauguu

SEQ ID NO: 3237967 - RNA, 13 nt, Human
uguacuccuccca

SEQ ID NO: 3237968 - RNA, 12 nt, Human
uguacuccuccc

SEQ ID NO: 3237969 - RNA, 20 nt, Human
uguacuauaacauagaauug

SEQ ID NO: 3237970 - RNA, 18 nt, Human
uguacuaucuuaucucag

SEQ ID NO: 3237971 - RNA, 19 nt, Human
uguacuauaacauagaauu

SEQ ID NO: 3237972 - RNA, 16 nt, Human
uguacgucugacaggc

SEQ ID NO: 3237973 - RNA, 17 nt, Human
uguacgucugacaggca

SEQ ID NO: 3237974 - RNA, 14 nt, Human
uguagagugggagc

SEQ ID NO: 3237975 - RNA, 17 nt, Human
uguacugauuucaguaa

SEQ ID NO: 3237976 - RNA, 12 nt, Human
uguagauuugau

SEQ ID NO: 3237977 - RNA, 23 nt, Human
uguaccauuaaaauaugcacuaa

SEQ ID NO: 3237978 - RNA, 19 nt, Human
uguaccauuaaaauaugca

SEQ ID NO: 3237979 - RNA, 17 nt, Human
uguaccauuaaaauaug

SEQ ID NO: 3237980 - RNA, 15 nt, Human
uguaccauuaaaaua

SEQ ID NO: 3237981 - RNA, 12 nt, Human
uguaaugacagg

SEQ ID NO: 3237982 - RNA, 20 nt, Human
uguaauguaggggaaaguuu

SEQ ID NO: 3237983 - RNA, 14 nt, Human
uguaauguaacugc

SEQ ID NO: 3237984 - RNA, 13 nt, Human
uguaauguaacug

SEQ ID NO: 3237985 - RNA, 12 nt, Human
uguaauguaacu

SEQ ID NO: 3237986 - RNA, 18 nt, Human
uguaauguaacugcucuu

SEQ ID NO: 3237987 - RNA, 15 nt, Human
uguaauguaacugcu

SEQ ID NO: 3237988 - RNA, 23 nt, Human
uguaauguaucaaauacauuuaa

SEQ ID NO: 3237989 - RNA, 14 nt, Human
uguaccauuaaaau

SEQ ID NO: 3237990 - RNA, 13 nt, Human
uguaccauuaaaa

SEQ ID NO: 3237991 - RNA, 14 nt, Human
ugugcaagagaggg

SEQ ID NO: 3237992 - RNA, 18 nt, Human
ugugcaagcuuuuccuaa

SEQ ID NO: 3237993 - RNA, 17 nt, Human
ugugauauaaacagcuu

SEQ ID NO: 3237994 - RNA, 19 nt, Human
ugugcaagcuuuuccuaau

SEQ ID NO: 3237995 - RNA, 21 nt, Human
ugugaguuuguuucuuugaau

SEQ ID NO: 3237996 - RNA, 19 nt, Human
ugugaguuuguuucuuuga

SEQ ID NO: 3237997 - RNA, 17 nt, Human
ugugaguuuguuucuuu

SEQ ID NO: 3237998 - RNA, 15 nt, Human
ugugaguauucucau

SEQ ID NO: 3237999 - RNA, 13 nt, Human
ugugaguauucuc

SEQ ID NO: 3238000 - RNA, 23 nt, Human
ugugaguauucucauucuuccca

SEQ ID NO: 3238001 - RNA, 18 nt, Human
ugugaggggcucucucau

SEQ ID NO: 3238002 - RNA, 18 nt, Human
ugugaguacuacaguccu

SEQ ID NO: 3238003 - RNA, 12 nt, Human
ugugagggcagu

SEQ ID NO: 3238004 - RNA, 22 nt, Human
ugugagggaaagagcuuuccua

SEQ ID NO: 3238005 - RNA, 15 nt, Human
ugugagggaaagagc

SEQ ID NO: 3238006 - RNA, 14 nt, Human
ugugagggaaagag

SEQ ID NO: 3238007 - RNA, 19 nt, Human
ugugaguacuacaguccuc

SEQ ID NO: 3238008 - RNA, 20 nt, Human
ugugaguacuacaguccucc

SEQ ID NO: 3238009 - RNA, 23 nt, Human
ugugaguacuacaguccucccau

SEQ ID NO: 3238010 - RNA, 15 nt, Human
ugugagggcagugca

SEQ ID NO: 3238011 - RNA, 21 nt, Human
ugugaauacugcuugaauaaa

SEQ ID NO: 3238012 - RNA, 16 nt, Human
ugugaauaauuacagu

SEQ ID NO: 3238013 - RNA, 14 nt, Human
ugugaauaauuaca

SEQ ID NO: 3238014 - RNA, 14 nt, Human
ugugaauacugcuu

SEQ ID NO: 3238015 - RNA, 18 nt, Human
ugugaauacugcuugaau

SEQ ID NO: 3238016 - RNA, 15 nt, Human
ugugaauauaaaugu

SEQ ID NO: 3238017 - RNA, 17 nt, Human
ugugaauauaaaugugu

SEQ ID NO: 3238018 - RNA, 18 nt, Human
ugugaauauaaaugugug

SEQ ID NO: 3238019 - RNA, 20 nt, Human
ugugaauauaaaugugugua

SEQ ID NO: 3238020 - RNA, 21 nt, Human
ugugacaaggauugcuacugu

SEQ ID NO: 3238021 - RNA, 22 nt, Human
ugugaauuuucuaaaagcuuuc

SEQ ID NO: 3238022 - RNA, 22 nt, Human
ugugaccacugcagaagacagu

SEQ ID NO: 3238023 - RNA, 21 nt, Human
ugugacaucucuauuccccac

SEQ ID NO: 3238024 - RNA, 20 nt, Human
ugugacaucucuauucccca

SEQ ID NO: 3238025 - RNA, 13 nt, Human
ugugacaguguug

SEQ ID NO: 3238026 - RNA, 16 nt, Human
ugucuuuuuucacuac

SEQ ID NO: 3238027 - RNA, 19 nt, Human
ugucuuuggacccugaggc

SEQ ID NO: 3238028 - RNA, 22 nt, Human
ugucuuuggacccugaggccca

SEQ ID NO: 3238029 - RNA, 17 nt, Human
ugucuuuggacccugag

SEQ ID NO: 3238030 - RNA, 18 nt, Human
ugucuuuggacccugagg

SEQ ID NO: 3238031 - RNA, 16 nt, Human
ugucugcuccagcucu

SEQ ID NO: 3238032 - RNA, 20 nt, Human
ugugaaaaaaaaaaugcuga

SEQ ID NO: 3238033 - RNA, 17 nt, Human
ugugaaaaaaaaaaugc

SEQ ID NO: 3238034 - RNA, 14 nt, Human
ugugaaaggaaaga

SEQ ID NO: 3238035 - RNA, 13 nt, Human
ugugaaaggaaag

SEQ ID NO: 3238036 - RNA, 13 nt, Human
ugugaaaaaucug

SEQ ID NO: 3238037 - RNA, 17 nt, Human
ugugaaaaugugugugu

SEQ ID NO: 3238038 - RNA, 14 nt, Human
ugugaaacagacuu

SEQ ID NO: 3238039 - RNA, 14 nt, Human
ugucuggcugcaga

SEQ ID NO: 3238040 - RNA, 17 nt, Human
ugucuggcugcagagca

SEQ ID NO: 3238041 - RNA, 16 nt, Human
ugucuggcugcagagc

SEQ ID NO: 3238042 - RNA, 16 nt, Human
ugucugccccaaguuu

SEQ ID NO: 3238043 - RNA, 19 nt, Human
ugucugcccaaugaauaau

SEQ ID NO: 3238044 - RNA, 22 nt, Human
ugucugccccaaguuuugugaa

SEQ ID NO: 3238045 - RNA, 17 nt, Human
ugucugccccaaguuuu

SEQ ID NO: 3238046 - RNA, 18 nt, Human
ugucugccacauuaacua

SEQ ID NO: 3238047 - RNA, 16 nt, Human
ugucugccacauuaac

SEQ ID NO: 3238048 - RNA, 21 nt, Human
ugucucaguccaugaagaugu

SEQ ID NO: 3238049 - RNA, 22 nt, Human
ugucccaugugagcugcugcca

SEQ ID NO: 3238050 - RNA, 20 nt, Human
ugucccaugugagcugcugc

SEQ ID NO: 3238051 - RNA, 19 nt, Human
ugucucaagagggcacugg

SEQ ID NO: 3238052 - RNA, 12 nt, Human
uguccccaccau

SEQ ID NO: 3238053 - RNA, 11 nt, Human
uguccccacca

SEQ ID NO: 3238054 - RNA, 21 nt, Human
uguccccaccaucugcugucu

SEQ ID NO: 3238055 - RNA, 17 nt, Human
uguccccaccaucugcu

SEQ ID NO: 3238056 - RNA, 16 nt, Human
uguccccaccaucugc

SEQ ID NO: 3238057 - RNA, 14 nt, Human
uguccccaccaucu

SEQ ID NO: 3238058 - RNA, 17 nt, Human
ugucucaggucccugca

SEQ ID NO: 3238059 - RNA, 16 nt, Human
ugucucaggucccugc

SEQ ID NO: 3238060 - RNA, 21 nt, Human
ugucucaagagggcacuggug

SEQ ID NO: 3238061 - RNA, 20 nt, Human
ugucucaagagggcacuggu

SEQ ID NO: 3238062 - RNA, 23 nt, Human
ugucucaagagggcacugguggc

SEQ ID NO: 3238063 - RNA, 19 nt, Human
uguggaaaagccaagaggc

SEQ ID NO: 3238064 - RNA, 23 nt, Human
uguggaaaagccaagaggcugca

SEQ ID NO: 3238065 - RNA, 21 nt, Human
uguggaaaagccaagaggcug

SEQ ID NO: 3238066 - RNA, 17 nt, Human
uguggaaaaugaaaauu

SEQ ID NO: 3238067 - RNA, 13 nt, Human
uguggacacagcu

SEQ ID NO: 3238068 - RNA, 14 nt, Human
uguggacacagcuc

SEQ ID NO: 3238069 - RNA, 12 nt, Human
uguggagaagcg

SEQ ID NO: 3238070 - RNA, 21 nt, Human
uguggcuccuggggguucuuu

SEQ ID NO: 3238071 - RNA, 15 nt, Human
uguggacacagcucu

SEQ ID NO: 3238072 - RNA, 15 nt, Human
uguggacuuaggaag

SEQ ID NO: 3238073 - RNA, 16 nt, Human
ugugggggucugugug

SEQ ID NO: 3238074 - RNA, 13 nt, Human
uguggggggaggc

SEQ ID NO: 3238075 - RNA, 23 nt, Human
uguggggggaggcugacuccugg

SEQ ID NO: 3238076 - RNA, 21 nt, Human
ugugggggccccgucucaggu

SEQ ID NO: 3238077 - RNA, 14 nt, Human
ugugggucugugug

SEQ ID NO: 3238078 - RNA, 16 nt, Human
ugugggucugugugug

SEQ ID NO: 3238079 - RNA, 12 nt, Human
uguggcuucugg

SEQ ID NO: 3238080 - RNA, 12 nt, Human
ugugggaagggg

SEQ ID NO: 3238081 - RNA, 22 nt, Human
ugugggcuaguugggcuuccuc

SEQ ID NO: 3238082 - RNA, 20 nt, Human
ugugcguaugcaguguagau

SEQ ID NO: 3238083 - RNA, 20 nt, Human
ugugcgugcauguguguuca

SEQ ID NO: 3238084 - RNA, 15 nt, Human
ugugccuuauguuga

SEQ ID NO: 3238085 - RNA, 23 nt, Human
ugugccugcuucagccucccaca

SEQ ID NO: 3238086 - RNA, 14 nt, Human
ugugccugcuucag

SEQ ID NO: 3238087 - RNA, 18 nt, Human
ugugcaugugucuuuaua

SEQ ID NO: 3238088 - RNA, 17 nt, Human
ugugccucugggacugg

SEQ ID NO: 3238089 - RNA, 15 nt, Human
ugugccucugccugu

SEQ ID NO: 3238090 - RNA, 19 nt, Human
ugugcuguguuugcucccc

SEQ ID NO: 3238091 - RNA, 21 nt, Human
ugugcuguguuugcuccccuu

SEQ ID NO: 3238092 - RNA, 20 nt, Human
ugugcuguguuugcuccccu

SEQ ID NO: 3238093 - RNA, 15 nt, Human
ugugcuaaacgugua

SEQ ID NO: 3238094 - RNA, 22 nt, Human
ugugcuaaacguguauguuuuu

SEQ ID NO: 3238095 - RNA, 21 nt, Human
ugugcuaaacguguauguuuu

SEQ ID NO: 3238096 - RNA, 21 nt, Human
ugugcguggggcucccgccuc

SEQ ID NO: 3238097 - RNA, 22 nt, Human
ugugcguggggcucccgccucc

SEQ ID NO: 3238098 - RNA, 22 nt, Human
ugugcuuauguaugagguacaa

SEQ ID NO: 3238099 - RNA, 15 nt, Human
ugugcuucugccacc

SEQ ID NO: 3238100 - RNA, 16 nt, Human
ugugccucugggacug

SEQ ID NO: 3238101 - RNA, 15 nt, Human
ugugccucugggacu

SEQ ID NO: 3238102 - RNA, 13 nt, Human
ugugccucuggga

SEQ ID NO: 3238103 - RNA, 14 nt, Human
ugugccucugccug

SEQ ID NO: 3238104 - RNA, 13 nt, Human
ugugccucugccu

SEQ ID NO: 3238105 - RNA, 16 nt, Human
ugugcaguugcuguuu

SEQ ID NO: 3238106 - RNA, 19 nt, Human
ugugcaguugcuguuuacu

SEQ ID NO: 3238107 - RNA, 22 nt, Human
ugugcacaugcacgugugugca

SEQ ID NO: 3238108 - RNA, 16 nt, Human
ugugcacaugcacgug

SEQ ID NO: 3238109 - RNA, 15 nt, Human
ugugcaccugggcuc

SEQ ID NO: 3238110 - RNA, 21 nt, Human
ugugcagagcugaagagcugg

SEQ ID NO: 3238111 - RNA, 13 nt, Human
ugugcagaugaag

SEQ ID NO: 3238112 - RNA, 15 nt, Human
ugugcagagcugaag

SEQ ID NO: 3238113 - RNA, 16 nt, Human
ugugcaguaucuguga

SEQ ID NO: 3238114 - RNA, 14 nt, Human
ugugcaguaacuug

SEQ ID NO: 3238115 - RNA, 15 nt, Human
uuacagaggacagua

SEQ ID NO: 3238116 - RNA, 16 nt, Human
uuacagagaugucucu

SEQ ID NO: 3238117 - RNA, 13 nt, Human
uuacaauguauua

SEQ ID NO: 3238118 - RNA, 14 nt, Human
uuacaauguauuaa

SEQ ID NO: 3238119 - RNA, 20 nt, Human
uuacagagacagaaagcaga

SEQ ID NO: 3238120 - RNA, 15 nt, Human
uuacaauguaacuuu

SEQ ID NO: 3238121 - RNA, 15 nt, Human
uuacaaguuauagua

SEQ ID NO: 3238122 - RNA, 19 nt, Human
uuacaaguuauaguacuag

SEQ ID NO: 3238123 - RNA, 23 nt, Human
uuacaauaaaaucuugaaaaugc

SEQ ID NO: 3238124 - RNA, 13 nt, Human
uuacaauauuugu

SEQ ID NO: 3238125 - RNA, 16 nt, Human
uuacaauauuugugug

SEQ ID NO: 3238126 - RNA, 15 nt, Human
uuacaauauuugugu

SEQ ID NO: 3238127 - RNA, 22 nt, Human
uuacaauauuugugugcuaaac

SEQ ID NO: 3238128 - RNA, 18 nt, Human
uuacaauauuugugugcu

SEQ ID NO: 3238129 - RNA, 13 nt, Human
uuacauuuguaau

SEQ ID NO: 3238130 - RNA, 15 nt, Human
uuacauuucgauguu

SEQ ID NO: 3238131 - RNA, 19 nt, Human
uuacauuuguaauuuaagg

SEQ ID NO: 3238132 - RNA, 18 nt, Human
uuacauuuguaauuuaag

SEQ ID NO: 3238133 - RNA, 14 nt, Human
uuacauuuguaauu

SEQ ID NO: 3238134 - RNA, 20 nt, Human
uuacgguuuuccagguuuaa

SEQ ID NO: 3238135 - RNA, 19 nt, Human
uuacgaaguucaagaucaa

SEQ ID NO: 3238136 - RNA, 20 nt, Human
uuacgaaguucaagaucaaa

SEQ ID NO: 3238137 - RNA, 17 nt, Human
uuaaugucacaggcagg

SEQ ID NO: 3238138 - RNA, 18 nt, Human
uuaauggaugaaaucaua

SEQ ID NO: 3238139 - RNA, 12 nt, Human
uuaauggaugaa

SEQ ID NO: 3238140 - RNA, 14 nt, Human
uuaauggaaauguu

SEQ ID NO: 3238141 - RNA, 18 nt, Human
uuaaugucacaggcaggu

SEQ ID NO: 3238142 - RNA, 22 nt, Human
uuaauguccucucaaaguaaaa

SEQ ID NO: 3238143 - RNA, 19 nt, Human
uuaauuauuauaaaaauau

SEQ ID NO: 3238144 - RNA, 14 nt, Human
uuaauaucuuucug

SEQ ID NO: 3238145 - RNA, 16 nt, Human
uuaauaucuuucugca

SEQ ID NO: 3238146 - RNA, 13 nt, Human
uuaauaugaaauu

SEQ ID NO: 3238147 - RNA, 23 nt, Human
uuaauaugaaauuuuuuuucaug

SEQ ID NO: 3238148 - RNA, 14 nt, Human
uuaauaugaaauuu

SEQ ID NO: 3238149 - RNA, 16 nt, Human
uuaaugccugcuuuuu

SEQ ID NO: 3238150 - RNA, 18 nt, Human
uuaaugccugcuuuuugg

SEQ ID NO: 3238151 - RNA, 19 nt, Human
uuaaugccugcuuuuugga

SEQ ID NO: 3238152 - RNA, 21 nt, Human
uuaaugccugcuuuuuggaaa

SEQ ID NO: 3238153 - RNA, 23 nt, Human
uuaaugcuaaucuugugaaaaua

SEQ ID NO: 3238154 - RNA, 22 nt, Human
uuaaugcuaaucuugugaaaau

SEQ ID NO: 3238155 - RNA, 18 nt, Human
uuaaugcuaaucuuguga

SEQ ID NO: 3238156 - RNA, 17 nt, Human
uuaaugcuaaucuugug

SEQ ID NO: 3238157 - RNA, 15 nt, Human
uuaaggccacaucca

SEQ ID NO: 3238158 - RNA, 14 nt, Human
uuaaggauaaauca

SEQ ID NO: 3238159 - RNA, 22 nt, Human
uuaaggauaaaucauaaaguca

SEQ ID NO: 3238160 - RNA, 23 nt, Human
uuaaggauaaaucauaaagucag

SEQ ID NO: 3238161 - RNA, 21 nt, Human
uuaauaauuagaaacaccaaa

SEQ ID NO: 3238162 - RNA, 21 nt, Human
uuaaggaagacaaugugaaaa

SEQ ID NO: 3238163 - RNA, 13 nt, Human
uuaagcuuuuugg

SEQ ID NO: 3238164 - RNA, 14 nt, Human
uuaagcuuuuugga

SEQ ID NO: 3238165 - RNA, 16 nt, Human
uuaagcuuuuuggaau

SEQ ID NO: 3238166 - RNA, 23 nt, Human
uuaaggaaauuuguaccauuuca

SEQ ID NO: 3238167 - RNA, 15 nt, Human
uuaaggacugacuga

SEQ ID NO: 3238168 - RNA, 16 nt, Human
uuaaggacugacugag

SEQ ID NO: 3238169 - RNA, 18 nt, Human
uuaaggacugacugaggc

SEQ ID NO: 3238170 - RNA, 17 nt, Human
uuaaggagaaucauguu

SEQ ID NO: 3238171 - RNA, 22 nt, Human
uuaaggagaaucauguuucuuu

SEQ ID NO: 3238172 - RNA, 21 nt, Human
uuaaggagaaucauguuucuu

SEQ ID NO: 3238173 - RNA, 20 nt, Human
uuaaggagaaucauguuucu

SEQ ID NO: 3238174 - RNA, 18 nt, Human
uuaaggagaaucauguuu

SEQ ID NO: 3238175 - RNA, 20 nt, Human
uuaaagcuuauuaaaacuca

SEQ ID NO: 3238176 - RNA, 11 nt, Human
uuaaagaugua

SEQ ID NO: 3238177 - RNA, 16 nt, Human
uuaaagauguagcaaa

SEQ ID NO: 3238178 - RNA, 15 nt, Human
uuaaagauguagcaa

SEQ ID NO: 3238179 - RNA, 21 nt, Human
uuaaagauguagcaaacccug

SEQ ID NO: 3238180 - RNA, 18 nt, Human
uuaaaagauaaauauuau

SEQ ID NO: 3238181 - RNA, 16 nt, Human
uuaaaacaucauuccu

SEQ ID NO: 3238182 - RNA, 18 nt, Human
uuaaaacaucauuccuuu

SEQ ID NO: 3238183 - RNA, 23 nt, Human
uuaaaacaucauuccuuuuuauu

SEQ ID NO: 3238184 - RNA, 15 nt, Human
uuaaaacauuaaaau

SEQ ID NO: 3238185 - RNA, 14 nt, Human
uuaacaugcugugu

SEQ ID NO: 3238186 - RNA, 23 nt, Human
uuaacaugcuguguaagcugugu

SEQ ID NO: 3238187 - RNA, 17 nt, Human
uuaaaugcccagccccu

SEQ ID NO: 3238188 - RNA, 18 nt, Human
uuaaaugcccagccccuu

SEQ ID NO: 3238189 - RNA, 16 nt, Human
uuaaaugcuucauuug

SEQ ID NO: 3238190 - RNA, 20 nt, Human
uuaaaugcaguuacaaauua

SEQ ID NO: 3238191 - RNA, 18 nt, Human
uuaaauaguaaaaauaaa

SEQ ID NO: 3238192 - RNA, 17 nt, Human
uguuuguugucagcuga

SEQ ID NO: 3238193 - RNA, 16 nt, Human
uguuuguugucagcug

SEQ ID NO: 3238194 - RNA, 20 nt, Human
uguuuccuggcacugcuucc

SEQ ID NO: 3238195 - RNA, 21 nt, Human
uguuuccuggcacugcuucca

SEQ ID NO: 3238196 - RNA, 22 nt, Human
uguuuccuggcacugcuuccag

SEQ ID NO: 3238197 - RNA, 15 nt, Human
uguuuccuggcacug

SEQ ID NO: 3238198 - RNA, 16 nt, Human
uguuucucccgugcuu

SEQ ID NO: 3238199 - RNA, 15 nt, Human
uguuucucccgugcu

SEQ ID NO: 3238200 - RNA, 16 nt, Human
uguuuugccagcccau

SEQ ID NO: 3238201 - RNA, 17 nt, Human
uguuuuggacuuuguua

SEQ ID NO: 3238202 - RNA, 19 nt, Human
uguuuuggacuuuguuaca

SEQ ID NO: 3238203 - RNA, 19 nt, Human
uguuuugcuuuugcucgau

SEQ ID NO: 3238204 - RNA, 17 nt, Human
uguuuugcuuccccucc

SEQ ID NO: 3238205 - RNA, 17 nt, Human
uguuuugccagcccauu

SEQ ID NO: 3238206 - RNA, 22 nt, Human
uguuuuggauuuggagagaaau

SEQ ID NO: 3238207 - RNA, 21 nt, Human
uguuuuggauuuggagagaaa

SEQ ID NO: 3238208 - RNA, 19 nt, Human
uguuuuucaguucaaaguc

SEQ ID NO: 3238209 - RNA, 17 nt, Human
uguuuuucaguucaaag

SEQ ID NO: 3238210 - RNA, 15 nt, Human
uguuuuucaguucaa

SEQ ID NO: 3238211 - RNA, 14 nt, Human
uguuuuucaguuca

SEQ ID NO: 3238212 - RNA, 13 nt, Human
uguuuuucaguuc

SEQ ID NO: 3238213 - RNA, 12 nt, Human
uguuuuucaguu

SEQ ID NO: 3238214 - RNA, 22 nt, Human
uguuuuguaaacuuugaaauau

SEQ ID NO: 3238215 - RNA, 15 nt, Human
uguuuuguaaacuuu

SEQ ID NO: 3238216 - RNA, 13 nt, Human
uguuuuguaaacu

SEQ ID NO: 3238217 - RNA, 21 nt, Human
uguuuuguaaacuuugaaaua

SEQ ID NO: 3238218 - RNA, 20 nt, Human
uguuuuguaaacuuugaaau

SEQ ID NO: 3238219 - RNA, 19 nt, Human
uguuuuguaaacuuugaaa

SEQ ID NO: 3238220 - RNA, 18 nt, Human
uguuuuguaaacuuugaa

SEQ ID NO: 3238221 - RNA, 17 nt, Human
uguuuuguaaacuuuga

SEQ ID NO: 3238222 - RNA, 16 nt, Human
uguuuuguaaacuuug

SEQ ID NO: 3238223 - RNA, 17 nt, Human
uguuuuucgucauucca

SEQ ID NO: 3238224 - RNA, 13 nt, Human
uguuuuugucuua

SEQ ID NO: 3238225 - RNA, 11 nt, Human
uguuuuucuca

SEQ ID NO: 3238226 - RNA, 14 nt, Human
uguuuuuguuuugu

SEQ ID NO: 3238227 - RNA, 19 nt, Human
uguuuuuuaagauggcaau

SEQ ID NO: 3238228 - RNA, 17 nt, Human
uguuuuuugagucuuuu

SEQ ID NO: 3238229 - RNA, 16 nt, Human
uguuuuuugaaguguu

SEQ ID NO: 3238230 - RNA, 15 nt, Human
uguuuuuugaagugu

SEQ ID NO: 3238231 - RNA, 13 nt, Human
uguuuuuugaagu

SEQ ID NO: 3238232 - RNA, 13 nt, Human
uuaaaacacguuu

SEQ ID NO: 3238233 - RNA, 19 nt, Human
uuaaaacacguuuuaagga

SEQ ID NO: 3238234 - RNA, 21 nt, Human
uuaaaacacguuuuaaggacu

SEQ ID NO: 3238235 - RNA, 22 nt, Human
uuaaaacacguuuuaaggacug

SEQ ID NO: 3238236 - RNA, 23 nt, Human
uuaaaacacguuuuaaggacuga

SEQ ID NO: 3238237 - RNA, 18 nt, Human
uguuuuuguuuuguugca

SEQ ID NO: 3238238 - RNA, 9 nt, Human
uguuuuuug

SEQ ID NO: 3238239 - RNA, 12 nt, Human
uguucaguguua

SEQ ID NO: 3238240 - RNA, 18 nt, Human
uguucaggaaguccuuau

SEQ ID NO: 3238241 - RNA, 17 nt, Human
uguucacuaaacucuga

SEQ ID NO: 3238242 - RNA, 15 nt, Human
uguucacuaaacucu

SEQ ID NO: 3238243 - RNA, 17 nt, Human
uguucagcuuuuauucc

SEQ ID NO: 3238244 - RNA, 21 nt, Human
uguucaggaaaagguugaaua

SEQ ID NO: 3238245 - RNA, 23 nt, Human
uguucaggaaaagguugaauaau

SEQ ID NO: 3238246 - RNA, 12 nt, Human
uguucucugccc

SEQ ID NO: 3238247 - RNA, 16 nt, Human
uguucucugcccucca

SEQ ID NO: 3238248 - RNA, 18 nt, Human
uguucucugaggacacua

SEQ ID NO: 3238249 - RNA, 16 nt, Human
uguucucugaggacac

SEQ ID NO: 3238250 - RNA, 13 nt, Human
uguucucugagga

SEQ ID NO: 3238251 - RNA, 11 nt, Human
uguugaaagau

SEQ ID NO: 3238252 - RNA, 15 nt, Human
uguucugacccugcu

SEQ ID NO: 3238253 - RNA, 19 nt, Human
uguucucugcccuccaaga

SEQ ID NO: 3238254 - RNA, 18 nt, Human
uguucugacccugcuuca

SEQ ID NO: 3238255 - RNA, 15 nt, Human
uguucugauauuaau

SEQ ID NO: 3238256 - RNA, 17 nt, Human
uguucugcacacagcac

SEQ ID NO: 3238257 - RNA, 14 nt, Human
uguuuacagaggac

SEQ ID NO: 3238258 - RNA, 21 nt, Human
uguuuacagaggacaguauuu

SEQ ID NO: 3238259 - RNA, 17 nt, Human
uguuuacagauccccaa

SEQ ID NO: 3238260 - RNA, 13 nt, Human
uguuuaaaaucau

SEQ ID NO: 3238261 - RNA, 12 nt, Human
uguuguuuguau

SEQ ID NO: 3238262 - RNA, 14 nt, Human
uguuguuuuguaca

SEQ ID NO: 3238263 - RNA, 19 nt, Human
uguuguuuuguacagaugu

SEQ ID NO: 3238264 - RNA, 16 nt, Human
uguuguuuuguacaga

SEQ ID NO: 3238265 - RNA, 12 nt, Human
uguuuaaaacac

SEQ ID NO: 3238266 - RNA, 20 nt, Human
uguuuaaaacaccuucuaua

SEQ ID NO: 3238267 - RNA, 14 nt, Human
uguuggccaggcug

SEQ ID NO: 3238268 - RNA, 13 nt, Human
uguuggccaggcu

SEQ ID NO: 3238269 - RNA, 13 nt, Human
uguuguuuaagug

SEQ ID NO: 3238270 - RNA, 20 nt, Human
uguuguuucuuaauuuggaa

SEQ ID NO: 3238271 - RNA, 19 nt, Human
uguuguucuuggcaauaaa

SEQ ID NO: 3238272 - RNA, 23 nt, Human
uguuguucuuggcaauaaauuuu

SEQ ID NO: 3238273 - RNA, 13 nt, Human
uguuggaaaaaau

SEQ ID NO: 3238274 - RNA, 14 nt, Human
uguuggaaaaaauu

SEQ ID NO: 3238275 - RNA, 15 nt, Human
uguuggaaaaaauuu

SEQ ID NO: 3238276 - RNA, 20 nt, Human
uguugcuuauguuguuuugu

SEQ ID NO: 3238277 - RNA, 14 nt, Human
uguugcuuauguug

SEQ ID NO: 3238278 - RNA, 14 nt, Human
uguugcugccucau

SEQ ID NO: 3238279 - RNA, 11 nt, Human
uguuggccagg

SEQ ID NO: 3238280 - RNA, 15 nt, Human
uguuggccaaagcca

SEQ ID NO: 3238281 - RNA, 14 nt, Human
uguugaacuguuag

SEQ ID NO: 3238282 - RNA, 15 nt, Human
uguugaacuguuaga

SEQ ID NO: 3238283 - RNA, 12 nt, Human
uguugaacaaaa

SEQ ID NO: 3238284 - RNA, 19 nt, Human
uguugaacaaaauaaauug

SEQ ID NO: 3238285 - RNA, 18 nt, Human
uguugaacaaaauaaauu

SEQ ID NO: 3238286 - RNA, 15 nt, Human
uguugaacaaaauaa

SEQ ID NO: 3238287 - RNA, 14 nt, Human
uguugaacaaaaua

SEQ ID NO: 3238288 - RNA, 13 nt, Human
uguugaagagcag

SEQ ID NO: 3238289 - RNA, 11 nt, Human
uguugaagagc

SEQ ID NO: 3238290 - RNA, 18 nt, Human
uguugaagagcagcuccu

SEQ ID NO: 3238291 - RNA, 13 nt, Human
uguugcugccuca

SEQ ID NO: 3238292 - RNA, 16 nt, Human
uguugcugauuuuauu

SEQ ID NO: 3238293 - RNA, 14 nt, Human
uguugcugauuuua

SEQ ID NO: 3238294 - RNA, 21 nt, Human
uguugagcugguaacaucguu

SEQ ID NO: 3238295 - RNA, 22 nt, Human
uguugaggcuuauauuugugua

SEQ ID NO: 3238296 - RNA, 19 nt, Human
uguugauaaaaauacugac

SEQ ID NO: 3238297 - RNA, 11 nt, Human
uguguguaugu

SEQ ID NO: 3238298 - RNA, 19 nt, Human
ugugugcggagucauuuug

SEQ ID NO: 3238299 - RNA, 20 nt, Human
ugugugccucuagcugaauu

SEQ ID NO: 3238300 - RNA, 12 nt, Human
uguguguaugug

SEQ ID NO: 3238301 - RNA, 18 nt, Human
ugugugccucuagcugaa

SEQ ID NO: 3238302 - RNA, 17 nt, Human
ugugugccucuagcuga

SEQ ID NO: 3238303 - RNA, 16 nt, Human
ugugugccucuagcug

SEQ ID NO: 3238304 - RNA, 22 nt, Human
ugugugccgagcccuugcccau

SEQ ID NO: 3238305 - RNA, 13 nt, Human
ugugugcccagcu

SEQ ID NO: 3238306 - RNA, 14 nt, Human
ugugugcccagcuu

SEQ ID NO: 3238307 - RNA, 21 nt, Human
ugugugccgagcccuugccca

SEQ ID NO: 3238308 - RNA, 20 nt, Human
ugugugccgagcccuugccc

SEQ ID NO: 3238309 - RNA, 18 nt, Human
ugugugccgagcccuugc

SEQ ID NO: 3238310 - RNA, 17 nt, Human
ugugugcagagcugaag

SEQ ID NO: 3238311 - RNA, 14 nt, Human
ugugugcagagcug

SEQ ID NO: 3238312 - RNA, 17 nt, Human
ugugugagugugaauau

SEQ ID NO: 3238313 - RNA, 19 nt, Human
ugugugcacuuuuuuucua

SEQ ID NO: 3238314 - RNA, 15 nt, Human
ugugugauauuucag

SEQ ID NO: 3238315 - RNA, 15 nt, Human
uguguuuaugugugu

SEQ ID NO: 3238316 - RNA, 23 nt, Human
uguguuuauucaaacugaaaagc

SEQ ID NO: 3238317 - RNA, 22 nt, Human
uguguuuauucaaacugaaaag

SEQ ID NO: 3238318 - RNA, 14 nt, Human
uguguuuauucaaa

SEQ ID NO: 3238319 - RNA, 12 nt, Human
uguguuuauuca

SEQ ID NO: 3238320 - RNA, 20 nt, Human
uguguuuauucuugaugaaa

SEQ ID NO: 3238321 - RNA, 15 nt, Human
uguguuuauucuuga

SEQ ID NO: 3238322 - RNA, 14 nt, Human
uguguuuauucuug

SEQ ID NO: 3238323 - RNA, 12 nt, Human
uguguuuauucu

SEQ ID NO: 3238324 - RNA, 13 nt, Human
uguguuuaugugu

SEQ ID NO: 3238325 - RNA, 12 nt, Human
uguguuuauaug

SEQ ID NO: 3238326 - RNA, 15 nt, Human
uguguuuauauggaa

SEQ ID NO: 3238327 - RNA, 22 nt, Human
uguguuuagaauugaagguuuu

SEQ ID NO: 3238328 - RNA, 14 nt, Human
uguguugugugugg

SEQ ID NO: 3238329 - RNA, 23 nt, Human
uguguugugugugggagugugua

SEQ ID NO: 3238330 - RNA, 13 nt, Human
uguguugugcuuu

SEQ ID NO: 3238331 - RNA, 19 nt, Human
uguguguccccuugcagcc

SEQ ID NO: 3238332 - RNA, 17 nt, Human
uguguuuacagagaugu

SEQ ID NO: 3238333 - RNA, 17 nt, Human
uguguuuagaauugaag

SEQ ID NO: 3238334 - RNA, 18 nt, Human
uguguuuagaauugaagg

SEQ ID NO: 3238335 - RNA, 23 nt, Human
uguguaugugggggucugugugu

SEQ ID NO: 3238336 - RNA, 13 nt, Human
uguguaugugugu

SEQ ID NO: 3238337 - RNA, 14 nt, Human
uguguauguggggg

SEQ ID NO: 3238338 - RNA, 13 nt, Human
uguguaugugggg

SEQ ID NO: 3238339 - RNA, 21 nt, Human
uguguauauuugauuuauuaa

SEQ ID NO: 3238340 - RNA, 15 nt, Human
uguguauauuugauu

SEQ ID NO: 3238341 - RNA, 16 nt, Human
uguguagggcgggagg

SEQ ID NO: 3238342 - RNA, 15 nt, Human
uguguagauaguaug

SEQ ID NO: 3238343 - RNA, 16 nt, Human
uguguauaaauugucu

SEQ ID NO: 3238344 - RNA, 22 nt, Human
ugugugaagcuuaagggucaua

SEQ ID NO: 3238345 - RNA, 23 nt, Human
uguguauuucaguuauugucccu

SEQ ID NO: 3238346 - RNA, 15 nt, Human
uguguauuuucaguc

SEQ ID NO: 3238347 - RNA, 20 nt, Human
uguguauuguuguaaaaugu

SEQ ID NO: 3238348 - RNA, 13 nt, Human
uguguauuguugu

SEQ ID NO: 3238349 - RNA, 16 nt, Human
uguucacagccagacu

SEQ ID NO: 3238350 - RNA, 18 nt, Human
uguucaauuauuuccccc

SEQ ID NO: 3238351 - RNA, 14 nt, Human
uguucagcuccagc

SEQ ID NO: 3238352 - RNA, 11 nt, Human
uguucagcugg

SEQ ID NO: 3238353 - RNA, 22 nt, Human
uguucagcuccagcucaccagc

SEQ ID NO: 3238354 - RNA, 16 nt, Human
uguucagcuccagcuc

SEQ ID NO: 3238355 - RNA, 15 nt, Human
uguucagcuccagcu

SEQ ID NO: 3238356 - RNA, 14 nt, Human
uguuaguuuuccuu

SEQ ID NO: 3238357 - RNA, 21 nt, Human
uguucaaaggagcaagaacuu

SEQ ID NO: 3238358 - RNA, 22 nt, Human
uguucaaaggagcaagaacuuu

SEQ ID NO: 3238359 - RNA, 20 nt, Human
uguuagauuaagaaauagac

SEQ ID NO: 3238360 - RNA, 17 nt, Human
uguuagauuaagaaaua

SEQ ID NO: 3238361 - RNA, 12 nt, Human
uguuagauguuu

SEQ ID NO: 3238362 - RNA, 17 nt, Human
uguuagauguuuguuga

SEQ ID NO: 3238363 - RNA, 19 nt, Human
uguuagaauguaagguaua

SEQ ID NO: 3238364 - RNA, 13 nt, Human
uguuagaauguaa

SEQ ID NO: 3238365 - RNA, 16 nt, Human
uguuaccauuggaaau

SEQ ID NO: 3238366 - RNA, 19 nt, Human
uguuacauaagauaaaugu

SEQ ID NO: 3238367 - RNA, 15 nt, Human
uguuacauguaucaa

SEQ ID NO: 3238368 - RNA, 12 nt, Human
uguuacauguau

SEQ ID NO: 3238369 - RNA, 15 nt, Human
uguuacugucuucag

SEQ ID NO: 3238370 - RNA, 16 nt, Human
uguuacugucuucagu

SEQ ID NO: 3238371 - RNA, 17 nt, Human
uguuaccauuggaaauu

SEQ ID NO: 3238372 - RNA, 23 nt, Human
uguguuuauucuugaugaaaagc

SEQ ID NO: 3238373 - RNA, 22 nt, Human
uguguuuauucuugaugaaaag

SEQ ID NO: 3238374 - RNA, 16 nt, Human
uguguuugcuccccuu

SEQ ID NO: 3238375 - RNA, 19 nt, Human
uuuagaagaagugugucac

SEQ ID NO: 3238376 - RNA, 14 nt, Human
uuuagaacagguuu

SEQ ID NO: 3238377 - RNA, 15 nt, Human
uuuagaacagguuuu

SEQ ID NO: 3238378 - RNA, 17 nt, Human
uuuagaagaaguguguc

SEQ ID NO: 3238379 - RNA, 22 nt, Human
uuuagaaaagggaguuuaaaaa

SEQ ID NO: 3238380 - RNA, 12 nt, Human
uuuagacuugaa

SEQ ID NO: 3238381 - RNA, 13 nt, Human
uuuagacuugaaa

SEQ ID NO: 3238382 - RNA, 14 nt, Human
uuuagacuugaaaa

SEQ ID NO: 3238383 - RNA, 15 nt, Human
uuuagacuugaaaag

SEQ ID NO: 3238384 - RNA, 19 nt, Human
uuuagacuugaaaagagac

SEQ ID NO: 3238385 - RNA, 20 nt, Human
uuuagacuugaaaagagaca

SEQ ID NO: 3238386 - RNA, 21 nt, Human
uuuagacuugaaaagagacag

SEQ ID NO: 3238387 - RNA, 22 nt, Human
uuuagacuugaaaagagacagg

SEQ ID NO: 3238388 - RNA, 23 nt, Human
uuuagacuugaaaagagacaggc

SEQ ID NO: 3238389 - RNA, 15 nt, Human
uuuacuuuguguuca

SEQ ID NO: 3238390 - RNA, 23 nt, Human
uuuacuuuuuuuaguaaguuaau

SEQ ID NO: 3238391 - RNA, 21 nt, Human
uuuacuuuuuuuuuauuuuau

SEQ ID NO: 3238392 - RNA, 22 nt, Human
uuuacuuuuuuuuuauuuuauu

SEQ ID NO: 3238393 - RNA, 13 nt, Human
uuuacaauguauu

SEQ ID NO: 3238394 - RNA, 14 nt, Human
uuuacaauguauua

SEQ ID NO: 3238395 - RNA, 15 nt, Human
uuuacaauguauuaa

SEQ ID NO: 3238396 - RNA, 18 nt, Human
uuuaaucuacugcauuua

SEQ ID NO: 3238397 - RNA, 20 nt, Human
uuuacaagacaacauuguaa

SEQ ID NO: 3238398 - RNA, 16 nt, Human
uuuaaucuacugcauu

SEQ ID NO: 3238399 - RNA, 17 nt, Human
uuuaaucuacugcauuu

SEQ ID NO: 3238400 - RNA, 13 nt, Human
uuuaaucuacugc

SEQ ID NO: 3238401 - RNA, 15 nt, Human
uuuaaucaugaauau

SEQ ID NO: 3238402 - RNA, 20 nt, Human
uuuaaucaugaauaugauga

SEQ ID NO: 3238403 - RNA, 18 nt, Human
uuguauuguuagauguuu

SEQ ID NO: 3238404 - RNA, 20 nt, Human
uuguauuguuagauguuugu

SEQ ID NO: 3238405 - RNA, 16 nt, Human
uuguauuguccuauua

SEQ ID NO: 3238406 - RNA, 18 nt, Human
uuguauucaauuaaagaa

SEQ ID NO: 3238407 - RNA, 13 nt, Human
uuguauucaauua

SEQ ID NO: 3238408 - RNA, 14 nt, Human
uuguauucugucuu

SEQ ID NO: 3238409 - RNA, 21 nt, Human
uuguauucaauuaaagaaaua

SEQ ID NO: 3238410 - RNA, 15 nt, Human
uuguauuuauuuagu

SEQ ID NO: 3238411 - RNA, 9 nt, Human
uuguauuuu

SEQ ID NO: 3238412 - RNA, 14 nt, Human
uuguauuuauucuu

SEQ ID NO: 3238413 - RNA, 14 nt, Human
uuuaugcagugcug

SEQ ID NO: 3238414 - RNA, 16 nt, Human
uuuaugcagugcugcu

SEQ ID NO: 3238415 - RNA, 17 nt, Human
uuuaugcagugcugcuu

SEQ ID NO: 3238416 - RNA, 19 nt, Human
uuuaugcagugcugcuuug

SEQ ID NO: 3238417 - RNA, 18 nt, Human
uuuaugcaaggucuugca

SEQ ID NO: 3238418 - RNA, 23 nt, Human
uuuauuauuuauuuuuuuuaauu

SEQ ID NO: 3238419 - RNA, 14 nt, Human
uuuauucaaacuga

SEQ ID NO: 3238420 - RNA, 13 nt, Human
uuuauuccagagc

SEQ ID NO: 3238421 - RNA, 23 nt, Human
uuuauugcaucuggguagcugua

SEQ ID NO: 3238422 - RNA, 24 nt, Human
uuuauugcaucuggguagcuguaa

SEQ ID NO: 3238423 - RNA, 22 nt, Human
uuuauugccaaaacccagcugc

SEQ ID NO: 3238424 - RNA, 14 nt, Human
uuuauugucaaagu

SEQ ID NO: 3238425 - RNA, 16 nt, Human
uuuauugucaaagugg

SEQ ID NO: 3238426 - RNA, 19 nt, Human
uuuauuuaguuccuugagu

SEQ ID NO: 3238427 - RNA, 12 nt, Human
uuuauugucugu

SEQ ID NO: 3238428 - RNA, 14 nt, Human
uuuauugucuguaa

SEQ ID NO: 3238429 - RNA, 15 nt, Human
uuuauuuauauguau

SEQ ID NO: 3238430 - RNA, 15 nt, Human
uuuauuuauauuuau

SEQ ID NO: 3238431 - RNA, 17 nt, Human
uuuauuuauauuuauug

SEQ ID NO: 3238432 - RNA, 15 nt, Human
uuuaugaagaaaaua

SEQ ID NO: 3238433 - RNA, 18 nt, Human
uuuaugaagaaaauacuu

SEQ ID NO: 3238434 - RNA, 16 nt, Human
uuuaugaagaaaauac

SEQ ID NO: 3238435 - RNA, 12 nt, Human
uuuaugaagaaa

SEQ ID NO: 3238436 - RNA, 13 nt, Human
uuuaugaagaaaa

SEQ ID NO: 3238437 - RNA, 20 nt, Human
uuuaucuagauguaaauuuu

SEQ ID NO: 3238438 - RNA, 17 nt, Human
uuuaucuagauguaaau

SEQ ID NO: 3238439 - RNA, 16 nt, Human
uuuaucuagauguaaa

SEQ ID NO: 3238440 - RNA, 15 nt, Human
uuuaucuagauguaa

SEQ ID NO: 3238441 - RNA, 12 nt, Human
uuuaucuauaua

SEQ ID NO: 3238442 - RNA, 15 nt, Human
uuuaucuauauaaaa

SEQ ID NO: 3238443 - RNA, 20 nt, Human
uuuaucuauauaaaauaacu

SEQ ID NO: 3238444 - RNA, 12 nt, Human
uuuaucuuugau

SEQ ID NO: 3238445 - RNA, 16 nt, Human
uuuaucuuugauaaca

SEQ ID NO: 3238446 - RNA, 21 nt, Human
uuuaucuaccaacuuucaaga

SEQ ID NO: 3238447 - RNA, 14 nt, Human
uuucuaaagcugcc

SEQ ID NO: 3238448 - RNA, 17 nt, Human
uuucuaaagcugccagc

SEQ ID NO: 3238449 - RNA, 21 nt, Human
uuuccucuuuggucuacacug

SEQ ID NO: 3238450 - RNA, 23 nt, Human
uuuccugacagaaggacucaggu

SEQ ID NO: 3238451 - RNA, 12 nt, Human
uuuccucuugaa

SEQ ID NO: 3238452 - RNA, 22 nt, Human
uuuccucuuagucgagccaagu

SEQ ID NO: 3238453 - RNA, 14 nt, Human
uuuccuauaccauu

SEQ ID NO: 3238454 - RNA, 16 nt, Human
uuuccuauaugaugau

SEQ ID NO: 3238455 - RNA, 17 nt, Human
uuuccuaucauguuaac

SEQ ID NO: 3238456 - RNA, 16 nt, Human
uuuccuauaccauuuc

SEQ ID NO: 3238457 - RNA, 21 nt, Human
uuuccuacuugcacucuucua

SEQ ID NO: 3238458 - RNA, 22 nt, Human
uuucugagaaagacuauucaaa

SEQ ID NO: 3238459 - RNA, 14 nt, Human
uuucucuuugaaac

SEQ ID NO: 3238460 - RNA, 13 nt, Human
uuucucuuugaaa

SEQ ID NO: 3238461 - RNA, 15 nt, Human
uuucugagaaagacu

SEQ ID NO: 3238462 - RNA, 12 nt, Human
uuucucuuugaa

SEQ ID NO: 3238463 - RNA, 12 nt, Human
uuucucuuagaa

SEQ ID NO: 3238464 - RNA, 13 nt, Human
uuucucuucuccc

SEQ ID NO: 3238465 - RNA, 12 nt, Human
uuucucuucaua

SEQ ID NO: 3238466 - RNA, 13 nt, Human
uuucucuuagaaa

SEQ ID NO: 3238467 - RNA, 20 nt, Human
uuucucuucuccccuuccau

SEQ ID NO: 3238468 - RNA, 19 nt, Human
uuucucuucuccccuucca

SEQ ID NO: 3238469 - RNA, 16 nt, Human
uuucucuucuccccuu

SEQ ID NO: 3238470 - RNA, 15 nt, Human
uuucuagccagagga

SEQ ID NO: 3238471 - RNA, 20 nt, Human
uuucuaagguaacaagauga

SEQ ID NO: 3238472 - RNA, 17 nt, Human
uuucuagaguuccuacc

SEQ ID NO: 3238473 - RNA, 19 nt, Human
uuucuagcauauauguguc

SEQ ID NO: 3238474 - RNA, 18 nt, Human
uuucuagcuuuuuaauua

SEQ ID NO: 3238475 - RNA, 17 nt, Human
uuucuccguaugcacau

SEQ ID NO: 3238476 - RNA, 18 nt, Human
uuucauugcugugacagu

SEQ ID NO: 3238477 - RNA, 15 nt, Human
uuucauugcugugac

SEQ ID NO: 3238478 - RNA, 13 nt, Human
uuuccaggaaggc

SEQ ID NO: 3238479 - RNA, 19 nt, Human
uuuccagagcauuccaguc

SEQ ID NO: 3238480 - RNA, 13 nt, Human
uuuccaaauuauu

SEQ ID NO: 3238481 - RNA, 14 nt, Human
uuuccaaauuauuu

SEQ ID NO: 3238482 - RNA, 22 nt, Human
uuuccaaauuauuucuuaauua

SEQ ID NO: 3238483 - RNA, 12 nt, Human
uuuccagagcau

SEQ ID NO: 3238484 - RNA, 17 nt, Human
uuuccagagcauuccag

SEQ ID NO: 3238485 - RNA, 13 nt, Human
uuuccagagcauu

SEQ ID NO: 3238486 - RNA, 22 nt, Human
uuucauugcugggcuugucugu

SEQ ID NO: 3238487 - RNA, 22 nt, Human
uuucagguagaggugcaugccu

SEQ ID NO: 3238488 - RNA, 15 nt, Human
uuucagccaagaauu

SEQ ID NO: 3238489 - RNA, 12 nt, Human
uuucaggaaaau

SEQ ID NO: 3238490 - RNA, 14 nt, Human
uuucagcaggcagc

SEQ ID NO: 3238491 - RNA, 18 nt, Human
uuucagcaugaaaaugug

SEQ ID NO: 3238492 - RNA, 13 nt, Human
uuucagcaggcag

SEQ ID NO: 3238493 - RNA, 19 nt, Human
uuucaaucucguauagaag

SEQ ID NO: 3238494 - RNA, 13 nt, Human
uuucaaucucgua

SEQ ID NO: 3238495 - RNA, 23 nt, Human
uuucaaucucguauagaagucuu

SEQ ID NO: 3238496 - RNA, 13 nt, Human
uuuauuuuaaaac

SEQ ID NO: 3238497 - RNA, 17 nt, Human
uuucaauauuuuccuuc

SEQ ID NO: 3238498 - RNA, 20 nt, Human
uuucaauaggaaaaacugau

SEQ ID NO: 3238499 - RNA, 22 nt, Human
uuucaauaggaaaaacugauuu

SEQ ID NO: 3238500 - RNA, 19 nt, Human
uuucaauaggaaaaacuga

SEQ ID NO: 3238501 - RNA, 21 nt, Human
uuuauuucuccuuuuguguuc

SEQ ID NO: 3238502 - RNA, 13 nt, Human
uuuauuucuuuua

SEQ ID NO: 3238503 - RNA, 19 nt, Human
uuuauuucagcaaacuugu

SEQ ID NO: 3238504 - RNA, 16 nt, Human
uuuauuucagcaaacu

SEQ ID NO: 3238505 - RNA, 14 nt, Human
uuuauuucaaugua

SEQ ID NO: 3238506 - RNA, 15 nt, Human
uuuauuucaauguaa

SEQ ID NO: 3238507 - RNA, 13 nt, Human
uuuauuuccagug

SEQ ID NO: 3238508 - RNA, 20 nt, Human
uuuauuuccaauguuucaag

SEQ ID NO: 3238509 - RNA, 17 nt, Human
uuuauuucuccuuuugu

SEQ ID NO: 3238510 - RNA, 16 nt, Human
uuuauuucuccuuuug

SEQ ID NO: 3238511 - RNA, 15 nt, Human
uuuauuucuccuuuu

SEQ ID NO: 3238512 - RNA, 13 nt, Human
uuuauuucuccuu

SEQ ID NO: 3238513 - RNA, 21 nt, Human
uuugcagaggcuaugggaaga

SEQ ID NO: 3238514 - RNA, 14 nt, Human
uuugcagcucagaa

SEQ ID NO: 3238515 - RNA, 14 nt, Human
uuugcagacaggca

SEQ ID NO: 3238516 - RNA, 22 nt, Human
uuugcacuuuuucuuaaucauu

SEQ ID NO: 3238517 - RNA, 13 nt, Human
uuugcacuuuucu

SEQ ID NO: 3238518 - RNA, 16 nt, Human
uuugauauaccaaauu

SEQ ID NO: 3238519 - RNA, 21 nt, Human
uuugauauaccaaauuaaaaa

SEQ ID NO: 3238520 - RNA, 22 nt, Human
uuugauauaccaaauuaaaaaa

SEQ ID NO: 3238521 - RNA, 20 nt, Human
uuugccaugugcuucugcca

SEQ ID NO: 3238522 - RNA, 21 nt, Human
uuuggaacagugcuacugaaa

SEQ ID NO: 3238523 - RNA, 18 nt, Human
uuugccauguuggccagg

SEQ ID NO: 3238524 - RNA, 21 nt, Human
uuugcauagauucccugagca

SEQ ID NO: 3238525 - RNA, 15 nt, Human
uuugcagcuuccaau

SEQ ID NO: 3238526 - RNA, 16 nt, Human
uuugccagugggaacu

SEQ ID NO: 3238527 - RNA, 15 nt, Human
uuugccagugggaac

SEQ ID NO: 3238528 - RNA, 14 nt, Human
uuugccaugugcuu

SEQ ID NO: 3238529 - RNA, 22 nt, Human
uuugccauagaguacacugccu

SEQ ID NO: 3238530 - RNA, 18 nt, Human
uuugccaucucugcucca

SEQ ID NO: 3238531 - RNA, 15 nt, Human
uuugccaucucugcu

SEQ ID NO: 3238532 - RNA, 16 nt, Human
uuugagguggaagagg

SEQ ID NO: 3238533 - RNA, 19 nt, Human
uuugagucaaagacuuaaa

SEQ ID NO: 3238534 - RNA, 23 nt, Human
uuugagguuggaaaauaucuuug

SEQ ID NO: 3238535 - RNA, 22 nt, Human
uuugagucuuuuuuuuuuaagu

SEQ ID NO: 3238536 - RNA, 12 nt, Human
uuugagucuuuu

SEQ ID NO: 3238537 - RNA, 14 nt, Human
uuugagcucagccc

SEQ ID NO: 3238538 - RNA, 18 nt, Human
uuugagcuacuggauucu

SEQ ID NO: 3238539 - RNA, 20 nt, Human
uuugagcuacuggauucuua

SEQ ID NO: 3238540 - RNA, 10 nt, Human
uuugagcucc

SEQ ID NO: 3238541 - RNA, 19 nt, Human
uuugagcucccacuucugc

SEQ ID NO: 3238542 - RNA, 17 nt, Human
uuugaggaaauuugcag

SEQ ID NO: 3238543 - RNA, 13 nt, Human
uuucuuagacuuu

SEQ ID NO: 3238544 - RNA, 15 nt, Human
uuugagcagggcuca

SEQ ID NO: 3238545 - RNA, 15 nt, Human
uuugagcccuuguuu

SEQ ID NO: 3238546 - RNA, 13 nt, Human
uuucuuaauauau

SEQ ID NO: 3238547 - RNA, 20 nt, Human
uuucuuaauauauagcauuu

SEQ ID NO: 3238548 - RNA, 16 nt, Human
uuucuuaauauauagc

SEQ ID NO: 3238549 - RNA, 15 nt, Human
uuucuuaaucauuuu

SEQ ID NO: 3238550 - RNA, 22 nt, Human
uuucuuaauauauagcauuuau

SEQ ID NO: 3238551 - RNA, 21 nt, Human
uuucuuaaucauuuuuuauau

SEQ ID NO: 3238552 - RNA, 21 nt, Human
uuucuuaauuauuauaaaaau

SEQ ID NO: 3238553 - RNA, 23 nt, Human
uuucuuaauuauuauaaaaauau

SEQ ID NO: 3238554 - RNA, 14 nt, Human
uuucuuaauuugga

SEQ ID NO: 3238555 - RNA, 15 nt, Human
uuucuuaauuuggaa

SEQ ID NO: 3238556 - RNA, 17 nt, Human
uuucuuaauuuggaaac

SEQ ID NO: 3238557 - RNA, 18 nt, Human
uuucuuaauuuggaaacu

SEQ ID NO: 3238558 - RNA, 17 nt, Human
uuuguuaauaaagugca

SEQ ID NO: 3238559 - RNA, 16 nt, Human
uuuguuaauaucacuc

SEQ ID NO: 3238560 - RNA, 23 nt, Human
uuuguucauuucauccuuucacu

SEQ ID NO: 3238561 - RNA, 23 nt, Human
uuuguugugugccucuagcugaa

SEQ ID NO: 3238562 - RNA, 21 nt, Human
uuuguugugugccucuagcug

SEQ ID NO: 3238563 - RNA, 13 nt, Human
uuuguugugugcc

SEQ ID NO: 3238564 - RNA, 16 nt, Human
uuuguugucagcugaa

SEQ ID NO: 3238565 - RNA, 18 nt, Human
uuuguuccagaaucugua

SEQ ID NO: 3238566 - RNA, 18 nt, Human
uuuguccuccugcugcca

SEQ ID NO: 3238567 - RNA, 13 nt, Human
uuuguguuccaaa

SEQ ID NO: 3238568 - RNA, 21 nt, Human
uuugucauuuucauuagcaaa

SEQ ID NO: 3238569 - RNA, 22 nt, Human
uuuguguuuauucuugaugaaa

SEQ ID NO: 3238570 - RNA, 16 nt, Human
uuuguguuuauucuug

SEQ ID NO: 3238571 - RNA, 15 nt, Human
uuuguguuuauucuu

SEQ ID NO: 3238572 - RNA, 12 nt, Human
uuuguguuuauu

SEQ ID NO: 3238573 - RNA, 13 nt, Human
uuuguccccaccg

SEQ ID NO: 3238574 - RNA, 21 nt, Human
uuuguccccaccgcagacagg

SEQ ID NO: 3238575 - RNA, 18 nt, Human
uuugucauuuucauuagc

SEQ ID NO: 3238576 - RNA, 16 nt, Human
uuugucauuuucauua

SEQ ID NO: 3238577 - RNA, 15 nt, Human
uuugucauuuucauu

SEQ ID NO: 3238578 - RNA, 14 nt, Human
uuugucauuuucau

SEQ ID NO: 3238579 - RNA, 14 nt, Human
uuuguauacaagua

SEQ ID NO: 3238580 - RNA, 21 nt, Human
uuugguuauagugcaauauau

SEQ ID NO: 3238581 - RNA, 15 nt, Human
uuugucacugcuuca

SEQ ID NO: 3238582 - RNA, 23 nt, Human
uuugucaguguagaucaacucau

SEQ ID NO: 3238583 - RNA, 13 nt, Human
uuugguuauagug

SEQ ID NO: 3238584 - RNA, 18 nt, Human
uuugguuauagugcaaua

SEQ ID NO: 3238585 - RNA, 16 nt, Human
uuugguuauagugcaa

SEQ ID NO: 3238586 - RNA, 20 nt, Human
uuugguuaugaauacuuugc

SEQ ID NO: 3238587 - RNA, 15 nt, Human
uuuggaauauuaaaa

SEQ ID NO: 3238588 - RNA, 16 nt, Human
uuuggugucuuucucu

SEQ ID NO: 3238589 - RNA, 12 nt, Human
uuuuaaaaugua

SEQ ID NO: 3238590 - RNA, 15 nt, Human
uuuuaaaauguacau

SEQ ID NO: 3238591 - RNA, 14 nt, Human
uuuuaaaauguaca

SEQ ID NO: 3238592 - RNA, 13 nt, Human
uuuuaaaauuuua

SEQ ID NO: 3238593 - RNA, 23 nt, Human
uuuuaaaauuguacaugaacaug

SEQ ID NO: 3238594 - RNA, 21 nt, Human
uuuuaaaauguacauguauua

SEQ ID NO: 3238595 - RNA, 15 nt, Human
uuuuaaaauuucaua

SEQ ID NO: 3238596 - RNA, 22 nt, Human
uuuuaaaaucuuauuaaaguuu

SEQ ID NO: 3238597 - RNA, 15 nt, Human
uuuuaaaaucuuauu

SEQ ID NO: 3238598 - RNA, 14 nt, Human
uuuuaaaaucuuau

SEQ ID NO: 3238599 - RNA, 13 nt, Human
uuuuaaaaucuua

SEQ ID NO: 3238600 - RNA, 22 nt, Human
uuuguuguuucuuaauuuggaa

SEQ ID NO: 3238601 - RNA, 19 nt, Human
uuuuaauuucaagcuuauu

SEQ ID NO: 3238602 - RNA, 16 nt, Human
uuuuaauuuugucugc

SEQ ID NO: 3238603 - RNA, 13 nt, Human
uuuuaauuuuguc

SEQ ID NO: 3238604 - RNA, 16 nt, Human
uuuuacagcugccugc

SEQ ID NO: 3238605 - RNA, 23 nt, Human
uuuuaccaucacacauguucaga

SEQ ID NO: 3238606 - RNA, 22 nt, Human
uuuuacuccagguuauugcaau

SEQ ID NO: 3238607 - RNA, 23 nt, Human
uuuuacuccagguuauugcaaua

SEQ ID NO: 3238608 - RNA, 14 nt, Human
uuuuaucaggauuu

SEQ ID NO: 3238609 - RNA, 20 nt, Human
uuuuauaucaauuuaaaaaa

SEQ ID NO: 3238610 - RNA, 16 nt, Human
uuuuauauauaugcau

SEQ ID NO: 3238611 - RNA, 20 nt, Human
uuuucacugcuggcugccuu

SEQ ID NO: 3238612 - RNA, 19 nt, Human
uuuucacugcuggcugccu

SEQ ID NO: 3238613 - RNA, 15 nt, Human
uuuucacaguucucu

SEQ ID NO: 3238614 - RNA, 24 nt, Human
uuuucaaucucguauagaagucuu

SEQ ID NO: 3238615 - RNA, 20 nt, Human
uuuucaaucucguauagaag

SEQ ID NO: 3238616 - RNA, 16 nt, Human
uuuucaauauauuugu

SEQ ID NO: 3238617 - RNA, 13 nt, Human
uuuucaaugugau

SEQ ID NO: 3238618 - RNA, 13 nt, Human
uuuuaugaugacg

SEQ ID NO: 3238619 - RNA, 20 nt, Human
uuuuaugaugacguacaagu

SEQ ID NO: 3238620 - RNA, 22 nt, Human
uuuucaacgcagcccugcuuug

SEQ ID NO: 3238621 - RNA, 21 nt, Human
uuuucaacgcagcccugcuuu

SEQ ID NO: 3238622 - RNA, 19 nt, Human
uuuucaaccucuagaauuu

SEQ ID NO: 3238623 - RNA, 17 nt, Human
uuuucaaccucuagaau

SEQ ID NO: 3238624 - RNA, 17 nt, Human
uuuucaacgcagcccug

SEQ ID NO: 3238625 - RNA, 20 nt, Human
uuuucaaguauuuaagccua

SEQ ID NO: 3238626 - RNA, 17 nt, Human
uuuucaaguauuuaagc

SEQ ID NO: 3238627 - RNA, 16 nt, Human
uuuucaaguauuuaag

SEQ ID NO: 3238628 - RNA, 12 nt, Human
uuuucaaguauu

SEQ ID NO: 3238629 - RNA, 16 nt, Human
uuuucaagaaguucuu

SEQ ID NO: 3238630 - RNA, 14 nt, Human
uuuuccauuuuaua

SEQ ID NO: 3238631 - RNA, 13 nt, Human
uuuuccauuuuau

SEQ ID NO: 3238632 - RNA, 18 nt, Human
uuuuccaugaguccccug

SEQ ID NO: 3238633 - RNA, 19 nt, Human
uuuuccaugaguccccugu

SEQ ID NO: 3238634 - RNA, 17 nt, Human
uuuuccuaucauguuaa

SEQ ID NO: 3238635 - RNA, 15 nt, Human
uuuuccauuuuauaa

SEQ ID NO: 3238636 - RNA, 17 nt, Human
uuuuccuucagauauuu

SEQ ID NO: 3238637 - RNA, 18 nt, Human
uuuuccucgcuucuuuca

SEQ ID NO: 3238638 - RNA, 17 nt, Human
uuuuccucgcuucuuuc

SEQ ID NO: 3238639 - RNA, 13 nt, Human
uuuucuaaaagcu

SEQ ID NO: 3238640 - RNA, 14 nt, Human
uuuucuaaaagcuu

SEQ ID NO: 3238641 - RNA, 14 nt, Human
uuuucuucucccuc

SEQ ID NO: 3238642 - RNA, 17 nt, Human
uuuucuugcaugaggcu

SEQ ID NO: 3238643 - RNA, 19 nt, Human
uuuucuugauaauuuuccu

SEQ ID NO: 3238644 - RNA, 16 nt, Human
uuuucuugauaauuuu

SEQ ID NO: 3238645 - RNA, 12 nt, Human
uuuucuugauaa

SEQ ID NO: 3238646 - RNA, 15 nt, Human
uuuuccuucagugcc

SEQ ID NO: 3238647 - RNA, 21 nt, Human
uuuuccucgcuucuuucaagg

SEQ ID NO: 3238648 - RNA, 17 nt, Human
uuuuccucuuagaagaa

SEQ ID NO: 3238649 - RNA, 14 nt, Human
uuuuccuugcauac

SEQ ID NO: 3238650 - RNA, 13 nt, Human
uuuuccuugcaua

SEQ ID NO: 3238651 - RNA, 13 nt, Human
uuuuucuuaauca

SEQ ID NO: 3238652 - RNA, 18 nt, Human
uuuuuuaggguuucugau

SEQ ID NO: 3238653 - RNA, 23 nt, Human
uuuuuuaguaaguuaauguauau

SEQ ID NO: 3238654 - RNA, 21 nt, Human
uuuuucuuaauauauagcauu

SEQ ID NO: 3238655 - RNA, 15 nt, Human
uuuuucuuaaaaagu

SEQ ID NO: 3238656 - RNA, 17 nt, Human
uuuuuuccuucagugcc

SEQ ID NO: 3238657 - RNA, 15 nt, Human
uuuuuucuaccuaua

SEQ ID NO: 3238658 - RNA, 22 nt, Human
uuuugaaaaaugcacugggaaa

SEQ ID NO: 3238659 - RNA, 22 nt, Human
uuuugaaaucaguaaacacugu

SEQ ID NO: 3238660 - RNA, 11 nt, Human
uuuugaaaagu

SEQ ID NO: 3238661 - RNA, 20 nt, Human
uuuugaaaaguaauauuuau

SEQ ID NO: 3238662 - RNA, 15 nt, Human
uuuugaaacugcauu

SEQ ID NO: 3238663 - RNA, 11 nt, Human
uuuuucuguau

SEQ ID NO: 3238664 - RNA, 11 nt, Human
uuuuucugugg

SEQ ID NO: 3238665 - RNA, 13 nt, Human
uuuuucugcuuua

SEQ ID NO: 3238666 - RNA, 20 nt, Human
uuuuucugcuuuagacuuga

SEQ ID NO: 3238667 - RNA, 20 nt, Human
uuuugaaaugcugaaaauug

SEQ ID NO: 3238668 - RNA, 18 nt, Human
uuuugaaaugcugaaaau

SEQ ID NO: 3238669 - RNA, 16 nt, Human
uuuugaaaugcugaaa

SEQ ID NO: 3238670 - RNA, 13 nt, Human
uuuugaaaugcug

SEQ ID NO: 3238671 - RNA, 13 nt, Human
uuccuuccucuga

SEQ ID NO: 3238672 - RNA, 17 nt, Human
uuccuuccucugagccu

SEQ ID NO: 3238673 - RNA, 15 nt, Human
uuccuucagugccuu

SEQ ID NO: 3238674 - RNA, 19 nt, Human
uuccuucauucaacccacc

SEQ ID NO: 3238675 - RNA, 23 nt, Human
uuccuucagugccuuauggaaca

SEQ ID NO: 3238676 - RNA, 16 nt, Human
uuccuucagugccuua

SEQ ID NO: 3238677 - RNA, 19 nt, Human
uuccuucagugccuuaugg

SEQ ID NO: 3238678 - RNA, 13 nt, Human
uuccugcccuggg

SEQ ID NO: 3238679 - RNA, 16 nt, Human
uuccugcccugggagg

SEQ ID NO: 3238680 - RNA, 22 nt, Human
uuccugcccugggaggcaguga

SEQ ID NO: 3238681 - RNA, 19 nt, Human
uuccugcccugcuguuuau

SEQ ID NO: 3238682 - RNA, 11 nt, Human
uuccugcccug

SEQ ID NO: 3238683 - RNA, 18 nt, Human
uucggccuccauccugag

SEQ ID NO: 3238684 - RNA, 19 nt, Human
uucggccuccauccugagg

SEQ ID NO: 3238685 - RNA, 12 nt, Human
uuccuuucuuga

SEQ ID NO: 3238686 - RNA, 15 nt, Human
uucggccuccauccu

SEQ ID NO: 3238687 - RNA, 13 nt, Human
uucuaaagacagg

SEQ ID NO: 3238688 - RNA, 12 nt, Human
uucuaaagauag

SEQ ID NO: 3238689 - RNA, 19 nt, Human
uucuaaacuaggcuccuuc

SEQ ID NO: 3238690 - RNA, 20 nt, Human
uucuaaacuaggcuccuuca

SEQ ID NO: 3238691 - RNA, 23 nt, Human
uucuaauaagcuaguugaauacu

SEQ ID NO: 3238692 - RNA, 17 nt, Human
uucuaauaagcuaguug

SEQ ID NO: 3238693 - RNA, 19 nt, Human
uucuaauaagcuaguugaa

SEQ ID NO: 3238694 - RNA, 20 nt, Human
uucuaauaagcuaguugaau

SEQ ID NO: 3238695 - RNA, 14 nt, Human
uuccuagccaccgc

SEQ ID NO: 3238696 - RNA, 21 nt, Human
uuccuagccaccgccuccuac

SEQ ID NO: 3238697 - RNA, 15 nt, Human
uuccuagccaccgcc

SEQ ID NO: 3238698 - RNA, 19 nt, Human
uucccuuugacgccauccc

SEQ ID NO: 3238699 - RNA, 14 nt, Human
uuccuagagaacug

SEQ ID NO: 3238700 - RNA, 20 nt, Human
uucccuuccaguuuauucca

SEQ ID NO: 3238701 - RNA, 15 nt, Human
uucccuuuagcugug

SEQ ID NO: 3238702 - RNA, 22 nt, Human
uuccccacuugagaauuacccu

SEQ ID NO: 3238703 - RNA, 22 nt, Human
uuccccacccuccccuucccag

SEQ ID NO: 3238704 - RNA, 21 nt, Human
uuccccacccuccccuuccca

SEQ ID NO: 3238705 - RNA, 18 nt, Human
uucccugguaagaaaaag

SEQ ID NO: 3238706 - RNA, 17 nt, Human
uucccugguaagaaaaa

SEQ ID NO: 3238707 - RNA, 16 nt, Human
uucccugguaagaaaa

SEQ ID NO: 3238708 - RNA, 23 nt, Human
uucccuggguuagacugccagcu

SEQ ID NO: 3238709 - RNA, 21 nt, Human
uucccuggguuagacugccag

SEQ ID NO: 3238710 - RNA, 13 nt, Human
uucccuggguuag

SEQ ID NO: 3238711 - RNA, 22 nt, Human
uucccugguaagaaaaagcaaa

SEQ ID NO: 3238712 - RNA, 22 nt, Human
uuccuagccaccgccuccuaca

SEQ ID NO: 3238713 - RNA, 12 nt, Human
uuccuagugaaa

SEQ ID NO: 3238714 - RNA, 18 nt, Human
uuccuaggggaaugaggg

SEQ ID NO: 3238715 - RNA, 18 nt, Human
uuccuaguucaucccuuc

SEQ ID NO: 3238716 - RNA, 22 nt, Human
uuccuagcuggagaggagcccu

SEQ ID NO: 3238717 - RNA, 23 nt, Human
uuccucauaguaugguggcuggg

SEQ ID NO: 3238718 - RNA, 22 nt, Human
uuccuaguucaucccuucucuu

SEQ ID NO: 3238719 - RNA, 21 nt, Human
uuccuaguucaucccuucucu

SEQ ID NO: 3238720 - RNA, 15 nt, Human
uuccuauaacacugu

SEQ ID NO: 3238721 - RNA, 22 nt, Human
uuccucccucccucuuucccuc

SEQ ID NO: 3238722 - RNA, 12 nt, Human
uuccuccugaca

SEQ ID NO: 3238723 - RNA, 20 nt, Human
uuccuccugacaccccacuu

SEQ ID NO: 3238724 - RNA, 19 nt, Human
uuccuccugacaccccacu

SEQ ID NO: 3238725 - RNA, 21 nt, Human
uuccucccucccucuuucccu

SEQ ID NO: 3238726 - RNA, 19 nt, Human
uuccucccucccucuuucc

SEQ ID NO: 3238727 - RNA, 12 nt, Human
uuccucccuccc

SEQ ID NO: 3238728 - RNA, 16 nt, Human
uucucuccagccccug

SEQ ID NO: 3238729 - RNA, 18 nt, Human
uucucuccagccccugga

SEQ ID NO: 3238730 - RNA, 12 nt, Human
uucucuccauuu

SEQ ID NO: 3238731 - RNA, 20 nt, Human
uucucucuacugguccucuu

SEQ ID NO: 3238732 - RNA, 21 nt, Human
uucucucucucucaaaauuau

SEQ ID NO: 3238733 - RNA, 16 nt, Human
uucuccaagcaggaca

SEQ ID NO: 3238734 - RNA, 13 nt, Human
uucuccacccugc

SEQ ID NO: 3238735 - RNA, 11 nt, Human
uucuccaggcu

SEQ ID NO: 3238736 - RNA, 16 nt, Human
uucugacccaugcugc

SEQ ID NO: 3238737 - RNA, 18 nt, Human
uucucuguacauauuagc

SEQ ID NO: 3238738 - RNA, 12 nt, Human
uucucuguacau

SEQ ID NO: 3238739 - RNA, 11 nt, Human
uucucuguaca

SEQ ID NO: 3238740 - RNA, 22 nt, Human
uucucugguacaauuucuuuug

SEQ ID NO: 3238741 - RNA, 18 nt, Human
uucugacccaugcugccc

SEQ ID NO: 3238742 - RNA, 20 nt, Human
uucugacccaugcugcccug

SEQ ID NO: 3238743 - RNA, 21 nt, Human
uucugacccaugcugcccugu

SEQ ID NO: 3238744 - RNA, 21 nt, Human
uucugacccugcuucaaauau

SEQ ID NO: 3238745 - RNA, 20 nt, Human
uucucugaggacacuaacca

SEQ ID NO: 3238746 - RNA, 12 nt, Human
uucucucugcuc

SEQ ID NO: 3238747 - RNA, 17 nt, Human
uucucugcccuccaaga

SEQ ID NO: 3238748 - RNA, 20 nt, Human
uucucugcccagcuuuucau

SEQ ID NO: 3238749 - RNA, 18 nt, Human
uucucugcccagcuuuuc

SEQ ID NO: 3238750 - RNA, 15 nt, Human
uucucugcccagcuu

SEQ ID NO: 3238751 - RNA, 14 nt, Human
uucuauuguuucuu

SEQ ID NO: 3238752 - RNA, 13 nt, Human
uucuauuuauaau

SEQ ID NO: 3238753 - RNA, 13 nt, Human
uucuauuuuacaa

SEQ ID NO: 3238754 - RNA, 22 nt, Human
uucuauuuucucugauacuuuu

SEQ ID NO: 3238755 - RNA, 16 nt, Human
uucuauuuucucugau

SEQ ID NO: 3238756 - RNA, 23 nt, Human
uucucaucuugacagagccugcc

SEQ ID NO: 3238757 - RNA, 11 nt, Human
uucucaugccu

SEQ ID NO: 3238758 - RNA, 12 nt, Human
uucucaugccuc

SEQ ID NO: 3238759 - RNA, 14 nt, Human
uucucaugccucag

SEQ ID NO: 3238760 - RNA, 23 nt, Human
uucaaagcauggacauuuagaag

SEQ ID NO: 3238761 - RNA, 19 nt, Human
uucaaagcaccaaaauaag

SEQ ID NO: 3238762 - RNA, 23 nt, Human
uucaaagcaccaaaauaagaaaa

SEQ ID NO: 3238763 - RNA, 21 nt, Human
uucaaagcaccaaaauaagaa

SEQ ID NO: 3238764 - RNA, 13 nt, Human
uuauuuugaugua

SEQ ID NO: 3238765 - RNA, 15 nt, Human
uucaaagcaaauguc

SEQ ID NO: 3238766 - RNA, 14 nt, Human
uuauuuucuaaagu

SEQ ID NO: 3238767 - RNA, 16 nt, Human
uuauuuugauguaaag

SEQ ID NO: 3238768 - RNA, 15 nt, Human
uucaaagagaaaaca

SEQ ID NO: 3238769 - RNA, 23 nt, Human
uucaaagagaaaacaucucauca

SEQ ID NO: 3238770 - RNA, 14 nt, Human
uuauuuucagcaug

SEQ ID NO: 3238771 - RNA, 12 nt, Human
uuauuuucuaaa

SEQ ID NO: 3238772 - RNA, 13 nt, Human
uuacgugaguccu

SEQ ID NO: 3238773 - RNA, 14 nt, Human
uuacgugaguccug

SEQ ID NO: 3238774 - RNA, 18 nt, Human
uucaauucucauuuguca

SEQ ID NO: 3238775 - RNA, 14 nt, Human
uucaauuauuuccc

SEQ ID NO: 3238776 - RNA, 17 nt, Human
uucaauuauuuccccca

SEQ ID NO: 3238777 - RNA, 16 nt, Human
uucaauuaaagaaaua

SEQ ID NO: 3238778 - RNA, 15 nt, Human
uucaauuaaagaaau

SEQ ID NO: 3238779 - RNA, 14 nt, Human
uucaauuaaagaaa

SEQ ID NO: 3238780 - RNA, 14 nt, Human
uucaauguguauaa

SEQ ID NO: 3238781 - RNA, 19 nt, Human
uucaauguguauaaauugu

SEQ ID NO: 3238782 - RNA, 21 nt, Human
uucaauguguauaaauugucu

SEQ ID NO: 3238783 - RNA, 22 nt, Human
uucaaugugauauaaacagcuu

SEQ ID NO: 3238784 - RNA, 15 nt, Human
uucaauguaauuaaa

SEQ ID NO: 3238785 - RNA, 16 nt, Human
uucaauguaauuaaac

SEQ ID NO: 3238786 - RNA, 23 nt, Human
uucaaucucguauagaagucuuc

SEQ ID NO: 3238787 - RNA, 22 nt, Human
uucaaucucguauagaagucuu

SEQ ID NO: 3238788 - RNA, 16 nt, Human
uucaaucccaggaugu

SEQ ID NO: 3238789 - RNA, 15 nt, Human
uucaaccucuagaau

SEQ ID NO: 3238790 - RNA, 23 nt, Human
uucaaccucuagaauuuuaagcc

SEQ ID NO: 3238791 - RNA, 14 nt, Human
uucaacgcagcccu

SEQ ID NO: 3238792 - RNA, 20 nt, Human
uucaacccccuuaacuguau

SEQ ID NO: 3238793 - RNA, 13 nt, Human
uucaacgcagccc

SEQ ID NO: 3238794 - RNA, 20 nt, Human
uucaaccauuccccauggga

SEQ ID NO: 3238795 - RNA, 17 nt, Human
uucaaccauuccccaug

SEQ ID NO: 3238796 - RNA, 20 nt, Human
uucaacaaggcuugcugcag

SEQ ID NO: 3238797 - RNA, 15 nt, Human
uucaaccauucccca

SEQ ID NO: 3238798 - RNA, 19 nt, Human
uucaacagcaagugugaau

SEQ ID NO: 3238799 - RNA, 20 nt, Human
uucaacagcaagugugaaua

SEQ ID NO: 3238800 - RNA, 14 nt, Human
uucacucuuggagc

SEQ ID NO: 3238801 - RNA, 19 nt, Human
uucacucuuggagccugca

SEQ ID NO: 3238802 - RNA, 18 nt, Human
uucacucuuggagccugc

SEQ ID NO: 3238803 - RNA, 14 nt, Human
uucacucuccuugg

SEQ ID NO: 3238804 - RNA, 20 nt, Human
uucaccccaucccuccuuaa

SEQ ID NO: 3238805 - RNA, 23 nt, Human
uucaccccaucccuccuuaagag

SEQ ID NO: 3238806 - RNA, 22 nt, Human
uucagcuccagcucaccagccc

SEQ ID NO: 3238807 - RNA, 22 nt, Human
uucagaggcucagauuguaaua

SEQ ID NO: 3238808 - RNA, 13 nt, Human
uucagaggcucag

SEQ ID NO: 3238809 - RNA, 12 nt, Human
uucagaggcuca

SEQ ID NO: 3238810 - RNA, 13 nt, Human
uucagacucucuc

SEQ ID NO: 3238811 - RNA, 15 nt, Human
uucagagacuccugc

SEQ ID NO: 3238812 - RNA, 17 nt, Human
uucagcugacuuuucug

SEQ ID NO: 3238813 - RNA, 16 nt, Human
uucaggaagcucaggg

SEQ ID NO: 3238814 - RNA, 17 nt, Human
uucagcucugcaagaau

SEQ ID NO: 3238815 - RNA, 24 nt, Human
uucagcucugcaagaauugaagca

SEQ ID NO: 3238816 - RNA, 23 nt, Human
uucagcuccagcucaccagcccc

SEQ ID NO: 3238817 - RNA, 15 nt, Human
uucaggaagcucagg

SEQ ID NO: 3238818 - RNA, 20 nt, Human
uucaggaagcucagggccug

SEQ ID NO: 3238819 - RNA, 17 nt, Human
uucaggaagcucagggc

SEQ ID NO: 3238820 - RNA, 19 nt, Human
uucaggaagcucagggccu

SEQ ID NO: 3238821 - RNA, 16 nt, Human
uucaggcauauuuuaa

SEQ ID NO: 3238822 - RNA, 17 nt, Human
uucaggcauuuuccccc

SEQ ID NO: 3238823 - RNA, 15 nt, Human
uucaggcucuucucc

SEQ ID NO: 3238824 - RNA, 14 nt, Human
uuccagccugccac

SEQ ID NO: 3238825 - RNA, 12 nt, Human
uuccagccugcc

SEQ ID NO: 3238826 - RNA, 16 nt, Human
uuccagccugccacuc

SEQ ID NO: 3238827 - RNA, 17 nt, Human
uuccaucuaaaaauaua

SEQ ID NO: 3238828 - RNA, 20 nt, Human
uuccagcacaaccuucaagc

SEQ ID NO: 3238829 - RNA, 23 nt, Human
uuccagcaauucuccugccucag

SEQ ID NO: 3238830 - RNA, 13 nt, Human
uuccagcaggagg

SEQ ID NO: 3238831 - RNA, 12 nt, Human
uuccagcaggag

SEQ ID NO: 3238832 - RNA, 23 nt, Human
uuccagcaggagggacagucuca

SEQ ID NO: 3238833 - RNA, 24 nt, Human
uuccagcaugagguaucuaaggau

SEQ ID NO: 3238834 - RNA, 19 nt, Human
uuccacuuauaggaauuga

SEQ ID NO: 3238835 - RNA, 21 nt, Human
uuccacuuagaaauugcauuu

SEQ ID NO: 3238836 - RNA, 17 nt, Human
uucauuuugcuuuaauu

SEQ ID NO: 3238837 - RNA, 15 nt, Human
uucauuuugcuuuaa

SEQ ID NO: 3238838 - RNA, 13 nt, Human
uuccacugagacc

SEQ ID NO: 3238839 - RNA, 19 nt, Human
uucauuuuacaguuacuuu

SEQ ID NO: 3238840 - RNA, 14 nt, Human
uucauuuugcuuua

SEQ ID NO: 3238841 - RNA, 13 nt, Human
uucauuuugcuuu

SEQ ID NO: 3238842 - RNA, 17 nt, Human
uuccaugaguccccugu

SEQ ID NO: 3238843 - RNA, 19 nt, Human
uuccaugucgccucugcau

SEQ ID NO: 3238844 - RNA, 18 nt, Human
uuccaugucgccucugca

SEQ ID NO: 3238845 - RNA, 16 nt, Human
uuccaugucgccucug

SEQ ID NO: 3238846 - RNA, 21 nt, Human
uuccaugaguuaucaugaauu

SEQ ID NO: 3238847 - RNA, 17 nt, Human
uuccaugucgccucugc

SEQ ID NO: 3238848 - RNA, 14 nt, Human
uuccaucugauucc

SEQ ID NO: 3238849 - RNA, 17 nt, Human
uuccaucugauuccagc

SEQ ID NO: 3238850 - RNA, 17 nt, Human
uuccaugaauguuccug

SEQ ID NO: 3238851 - RNA, 13 nt, Human
uuccaugacaaua

SEQ ID NO: 3238852 - RNA, 12 nt, Human
uuccaugaaugu

SEQ ID NO: 3238853 - RNA, 17 nt, Human
uuccauuuacugcauuc

SEQ ID NO: 3238854 - RNA, 21 nt, Human
uuccaugucgccucugcauuc

SEQ ID NO: 3238855 - RNA, 20 nt, Human
uuccaugucgccucugcauu

SEQ ID NO: 3238856 - RNA, 14 nt, Human
uuccccaaauacaa

SEQ ID NO: 3238857 - RNA, 14 nt, Human
uuccccaagacauu

SEQ ID NO: 3238858 - RNA, 13 nt, Human
uucauaaugacuu

SEQ ID NO: 3238859 - RNA, 23 nt, Human
uucauaaugacuuaagcacacuu

SEQ ID NO: 3238860 - RNA, 22 nt, Human
uucaguuuauuugaaccaauaa

SEQ ID NO: 3238861 - RNA, 18 nt, Human
uucaguuucuaaaauuga

SEQ ID NO: 3238862 - RNA, 19 nt, Human
uucaguuucuaaaauugag

SEQ ID NO: 3238863 - RNA, 14 nt, Human
uucauaagauauuu

SEQ ID NO: 3238864 - RNA, 19 nt, Human
uucagugccuuauggaaca

SEQ ID NO: 3238865 - RNA, 21 nt, Human
uucagugccuuauggaacacu

SEQ ID NO: 3238866 - RNA, 16 nt, Human
uucaggcucuucuccu

SEQ ID NO: 3238867 - RNA, 22 nt, Human
uucaggcuuuaggcauaugcuu

SEQ ID NO: 3238868 - RNA, 19 nt, Human
uucagggaagauaaguugg

SEQ ID NO: 3238869 - RNA, 18 nt, Human
uucagggaagauaaguug

SEQ ID NO: 3238870 - RNA, 21 nt, Human
uucagggaagauaaguuggaa

SEQ ID NO: 3238871 - RNA, 20 nt, Human
uucagggaagauaaguugga

SEQ ID NO: 3238872 - RNA, 23 nt, Human
uucagggaagauaaguuggaaac

SEQ ID NO: 3238873 - RNA, 18 nt, Human
uucagugccuuauggaac

SEQ ID NO: 3238874 - RNA, 23 nt, Human
uucaucucuagggaccagaacca

SEQ ID NO: 3238875 - RNA, 20 nt, Human
uucaucuuccaacucaaacu

SEQ ID NO: 3238876 - RNA, 11 nt, Human
uucaucuugaa

SEQ ID NO: 3238877 - RNA, 12 nt, Human
uucaucuugaau

SEQ ID NO: 3238878 - RNA, 13 nt, Human
uucaugaaaugcu

SEQ ID NO: 3238879 - RNA, 12 nt, Human
uucaugaaaugc

SEQ ID NO: 3238880 - RNA, 23 nt, Human
uucaugaaaugcuaugucauuuc

SEQ ID NO: 3238881 - RNA, 22 nt, Human
uucaugaaaugcuaugucauuu

SEQ ID NO: 3238882 - RNA, 21 nt, Human
uucaugaaaugcuaugucauu

SEQ ID NO: 3238883 - RNA, 20 nt, Human
uucaugaaaugcuaugucau

SEQ ID NO: 3238884 - RNA, 15 nt, Human
uucaugaaaugcuau

SEQ ID NO: 3238885 - RNA, 16 nt, Human
uucauuucauccuuuc

SEQ ID NO: 3238886 - RNA, 14 nt, Human
uucauuucauccuu

SEQ ID NO: 3238887 - RNA, 17 nt, Human
uucauuuguaugucaaa

SEQ ID NO: 3238888 - RNA, 18 nt, Human
uucauuuguaugucaaag

SEQ ID NO: 3238889 - RNA, 15 nt, Human
uucauuuuaaaaagu

SEQ ID NO: 3238890 - RNA, 16 nt, Human
uucauuuuaaaaaguc

SEQ ID NO: 3238891 - RNA, 18 nt, Human
uucauuuaggugaggaag

SEQ ID NO: 3238892 - RNA, 19 nt, Human
uucauuuaggugaggaagc

SEQ ID NO: 3238893 - RNA, 17 nt, Human
uuggauucugagagcug

SEQ ID NO: 3238894 - RNA, 15 nt, Human
uuggauucugagagc

SEQ ID NO: 3238895 - RNA, 20 nt, Human
uuggcaaacucuccaccaca

SEQ ID NO: 3238896 - RNA, 16 nt, Human
uuggcaaacucuccac

SEQ ID NO: 3238897 - RNA, 17 nt, Human
uuggcaaaaaggcagga

SEQ ID NO: 3238898 - RNA, 14 nt, Human
uuggaccauuuucc

SEQ ID NO: 3238899 - RNA, 15 nt, Human
uuggaaguuuuaauc

SEQ ID NO: 3238900 - RNA, 20 nt, Human
uuggaagggcuuuucaaaau

SEQ ID NO: 3238901 - RNA, 20 nt, Human
uuggaagugaaaacuuugua

SEQ ID NO: 3238902 - RNA, 11 nt, Human
uuggaaggaac

SEQ ID NO: 3238903 - RNA, 19 nt, Human
uuggaaggaacguccccug

SEQ ID NO: 3238904 - RNA, 14 nt, Human
uuggaaauauuaaa

SEQ ID NO: 3238905 - RNA, 17 nt, Human
uuggaaauauuaaaaga

SEQ ID NO: 3238906 - RNA, 12 nt, Human
uuggaaagucag

SEQ ID NO: 3238907 - RNA, 14 nt, Human
uuggaaagucagaa

SEQ ID NO: 3238908 - RNA, 23 nt, Human
uuggaaagaguaggaagacuuug

SEQ ID NO: 3238909 - RNA, 16 nt, Human
uuggaaaucaaaugua

SEQ ID NO: 3238910 - RNA, 19 nt, Human
uuggaaaucaaauguaaag

SEQ ID NO: 3238911 - RNA, 18 nt, Human
uuggaaaucaaauguaaa

SEQ ID NO: 3238912 - RNA, 21 nt, Human
uuggaaaucaaauguaaaguu

SEQ ID NO: 3238913 - RNA, 20 nt, Human
uuggaacaguaaucaguuug

SEQ ID NO: 3238914 - RNA, 19 nt, Human
uuggaacaguaaucaguuu

SEQ ID NO: 3238915 - RNA, 13 nt, Human
uuggaaauuucac

SEQ ID NO: 3238916 - RNA, 23 nt, Human
uugcugccucggauccccuuccu

SEQ ID NO: 3238917 - RNA, 22 nt, Human
uugcugccucggauccccuucc

SEQ ID NO: 3238918 - RNA, 16 nt, Human
uugcugguaaaaugaa

SEQ ID NO: 3238919 - RNA, 23 nt, Human
uugcugguaaaaugaagaauuua

SEQ ID NO: 3238920 - RNA, 15 nt, Human
uugcugguaaaauga

SEQ ID NO: 3238921 - RNA, 14 nt, Human
uugcugguacacac

SEQ ID NO: 3238922 - RNA, 12 nt, Human
uugcuuaaaugu

SEQ ID NO: 3238923 - RNA, 24 nt, Human
uugcuuaaaugugaauuacuaacu

SEQ ID NO: 3238924 - RNA, 20 nt, Human
uugcuuaaaugugaauuacu

SEQ ID NO: 3238925 - RNA, 17 nt, Human
uugcuuaaaugugaauu

SEQ ID NO: 3238926 - RNA, 16 nt, Human
uugcuuaaaugugaau

SEQ ID NO: 3238927 - RNA, 15 nt, Human
uugcuuaaaugugaa

SEQ ID NO: 3238928 - RNA, 14 nt, Human
uugcuuaaauguga

SEQ ID NO: 3238929 - RNA, 13 nt, Human
uugcuuaaaugug

SEQ ID NO: 3238930 - RNA, 21 nt, Human
uugcuuaauuacaauauuucu

SEQ ID NO: 3238931 - RNA, 18 nt, Human
uugcugcaauuuuauaag

SEQ ID NO: 3238932 - RNA, 17 nt, Human
uugcugcacucuugcac

SEQ ID NO: 3238933 - RNA, 19 nt, Human
uugcugcacucuugcacau

SEQ ID NO: 3238934 - RNA, 20 nt, Human
uugcugauuuuauucuugau

SEQ ID NO: 3238935 - RNA, 11 nt, Human
uugcugccuca

SEQ ID NO: 3238936 - RNA, 12 nt, Human
uugcugccucau

SEQ ID NO: 3238937 - RNA, 15 nt, Human
uugcugccucaugcu

SEQ ID NO: 3238938 - RNA, 22 nt, Human
uugcugauggugcaaugaccuu

SEQ ID NO: 3238939 - RNA, 17 nt, Human
uugcugauuuuauucuu

SEQ ID NO: 3238940 - RNA, 19 nt, Human
uugcugauuuuauucuuga

SEQ ID NO: 3238941 - RNA, 18 nt, Human
uugcugauuuuauucuug

SEQ ID NO: 3238942 - RNA, 20 nt, Human
uugcugauggugcaaugacc

SEQ ID NO: 3238943 - RNA, 19 nt, Human
uugcugauggugcaaugac

SEQ ID NO: 3238944 - RNA, 18 nt, Human
uugccucugccucugaca

SEQ ID NO: 3238945 - RNA, 16 nt, Human
uugccucugccucuga

SEQ ID NO: 3238946 - RNA, 14 nt, Human
uugccucugccucu

SEQ ID NO: 3238947 - RNA, 11 nt, Human
uugccucugcc

SEQ ID NO: 3238948 - RNA, 19 nt, Human
uugcccagccucuuucccu

SEQ ID NO: 3238949 - RNA, 16 nt, Human
uugcccagccucuuuc

SEQ ID NO: 3238950 - RNA, 12 nt, Human
uugcccagccuc

SEQ ID NO: 3238951 - RNA, 21 nt, Human
uugccagucuuuuguccugca

SEQ ID NO: 3238952 - RNA, 18 nt, Human
uugccagucaccccggcc

SEQ ID NO: 3238953 - RNA, 13 nt, Human
uugccagucaccc

SEQ ID NO: 3238954 - RNA, 18 nt, Human
uugccacugccucuuccu

SEQ ID NO: 3238955 - RNA, 17 nt, Human
uugccauagaguacacu

SEQ ID NO: 3238956 - RNA, 23 nt, Human
uugcccacgcuggagugcaguga

SEQ ID NO: 3238957 - RNA, 23 nt, Human
uugccauagaguacacugccugc

SEQ ID NO: 3238958 - RNA, 21 nt, Human
uugcccacuccugcucugcuc

SEQ ID NO: 3238959 - RNA, 17 nt, Human
uugcccacuccugcucu

SEQ ID NO: 3238960 - RNA, 16 nt, Human
uugcccacuccugcuc

SEQ ID NO: 3238961 - RNA, 15 nt, Human
uugcccacuccugcu

SEQ ID NO: 3238962 - RNA, 22 nt, Human
uugcccacuccugcucugcucg

SEQ ID NO: 3238963 - RNA, 22 nt, Human
uuggguggggggcuucauacac

SEQ ID NO: 3238964 - RNA, 21 nt, Human
uuggguggggggcuucauaca

SEQ ID NO: 3238965 - RNA, 20 nt, Human
uuggguggggggcuucauac

SEQ ID NO: 3238966 - RNA, 19 nt, Human
uuggguggggggcuucaua

SEQ ID NO: 3238967 - RNA, 17 nt, Human
uuggguggggggcuuca

SEQ ID NO: 3238968 - RNA, 16 nt, Human
uuggguggaugccugg

SEQ ID NO: 3238969 - RNA, 12 nt, Human
uugggaggcuga

SEQ ID NO: 3238970 - RNA, 16 nt, Human
uugggaggccauuugu

SEQ ID NO: 3238971 - RNA, 22 nt, Human
uuggcuuuggguugcaggaccu

SEQ ID NO: 3238972 - RNA, 23 nt, Human
uuggcaaacucuccaccacacgu

SEQ ID NO: 3238973 - RNA, 13 nt, Human
uuggcauucccca

SEQ ID NO: 3238974 - RNA, 24 nt, Human
uuggccaaagccaaagcuaggccu

SEQ ID NO: 3238975 - RNA, 14 nt, Human
uuggccaggcuggu

SEQ ID NO: 3238976 - RNA, 21 nt, Human
uuggccauaagcaacaauuuu

SEQ ID NO: 3238977 - RNA, 16 nt, Human
uuggcugcugaaggcu

SEQ ID NO: 3238978 - RNA, 18 nt, Human
uuggcugggggccucagu

SEQ ID NO: 3238979 - RNA, 22 nt, Human
uuggcugggggccucagugcca

SEQ ID NO: 3238980 - RNA, 21 nt, Human
uuggcugggggccucagugcc

SEQ ID NO: 3238981 - RNA, 18 nt, Human
uuguaaauaaaggaacca

SEQ ID NO: 3238982 - RNA, 23 nt, Human
uuguaaagaaaaauauuuaaugu

SEQ ID NO: 3238983 - RNA, 18 nt, Human
uuguaaagauuucuguuc

SEQ ID NO: 3238984 - RNA, 17 nt, Human
uuguaaagauuucuguu

SEQ ID NO: 3238985 - RNA, 16 nt, Human
uuguaaagauuucugu

SEQ ID NO: 3238986 - RNA, 12 nt, Human
uugguccugcug

SEQ ID NO: 3238987 - RNA, 17 nt, Human
uuguaaagaaaaauauu

SEQ ID NO: 3238988 - RNA, 22 nt, Human
uuggucccccuuccauggacuu

SEQ ID NO: 3238989 - RNA, 16 nt, Human
uuggucccccuuccau

SEQ ID NO: 3238990 - RNA, 18 nt, Human
uuguaaaugugcuuuuaa

SEQ ID NO: 3238991 - RNA, 14 nt, Human
uuguaaaugugcuu

SEQ ID NO: 3238992 - RNA, 11 nt, Human
uuguaaaugug

SEQ ID NO: 3238993 - RNA, 23 nt, Human
uuguacacccaugaaagaaaacu

SEQ ID NO: 3238994 - RNA, 12 nt, Human
uuguacagacaa

SEQ ID NO: 3238995 - RNA, 13 nt, Human
uuguacagacaac

SEQ ID NO: 3238996 - RNA, 12 nt, Human
uuguagauuuga

SEQ ID NO: 3238997 - RNA, 19 nt, Human
uuguaucacaaaucuuaac

SEQ ID NO: 3238998 - RNA, 13 nt, Human
uuguacauaaaca

SEQ ID NO: 3238999 - RNA, 18 nt, Human
uuguagauacaaucagcu

SEQ ID NO: 3239000 - RNA, 20 nt, Human
uuguagauacaaucagcugc

SEQ ID NO: 3239001 - RNA, 22 nt, Human
uuguagauacaaucagcugcuu

SEQ ID NO: 3239002 - RNA, 15 nt, Human
uuguagagccagggu

SEQ ID NO: 3239003 - RNA, 14 nt, Human
uuguagagccaggg

SEQ ID NO: 3239004 - RNA, 18 nt, Human
uuguacagauucuuuauu

SEQ ID NO: 3239005 - RNA, 16 nt, Human
uugaacugagcuugga

SEQ ID NO: 3239006 - RNA, 15 nt, Human
uugaacugagcuugg

SEQ ID NO: 3239007 - RNA, 19 nt, Human
uugaacucuucaaucucuu

SEQ ID NO: 3239008 - RNA, 16 nt, Human
uugaacucuucucauu

SEQ ID NO: 3239009 - RNA, 19 nt, Human
uugaacucuucucauuacu

SEQ ID NO: 3239010 - RNA, 20 nt, Human
uugaacucuucucauuacuu

SEQ ID NO: 3239011 - RNA, 15 nt, Human
uugaaagaauguaaa

SEQ ID NO: 3239012 - RNA, 21 nt, Human
uugaacucuucucauuacuug

SEQ ID NO: 3239013 - RNA, 12 nt, Human
uugaacugaagg

SEQ ID NO: 3239014 - RNA, 14 nt, Human
uugaagagacagag

SEQ ID NO: 3239015 - RNA, 20 nt, Human
uugaagagacagagacaagu

SEQ ID NO: 3239016 - RNA, 14 nt, Human
uugaaucuuuaauu

SEQ ID NO: 3239017 - RNA, 13 nt, Human
uugaaucuuuaau

SEQ ID NO: 3239018 - RNA, 17 nt, Human
uugaagacagagcuaca

SEQ ID NO: 3239019 - RNA, 19 nt, Human
uugaagacuuuucuuucag

SEQ ID NO: 3239020 - RNA, 20 nt, Human
uugaagaccuaaccagggcc

SEQ ID NO: 3239021 - RNA, 16 nt, Human
uugaagacuucaaaau

SEQ ID NO: 3239022 - RNA, 20 nt, Human
uugaagacuucaaaauauug

SEQ ID NO: 3239023 - RNA, 23 nt, Human
uucuuucaagggcuuuccugugc

SEQ ID NO: 3239024 - RNA, 19 nt, Human
uucuuucaagggcuuuccu

SEQ ID NO: 3239025 - RNA, 19 nt, Human
uugaaaacacuguucucug

SEQ ID NO: 3239026 - RNA, 21 nt, Human
uugaaaacacuguucucugcc

SEQ ID NO: 3239027 - RNA, 18 nt, Human
uucuuuauaauucuacuu

SEQ ID NO: 3239028 - RNA, 12 nt, Human
uucuuguaucug

SEQ ID NO: 3239029 - RNA, 14 nt, Human
uucuuguaucugga

SEQ ID NO: 3239030 - RNA, 22 nt, Human
uucuuguaucuggauucaaauu

SEQ ID NO: 3239031 - RNA, 20 nt, Human
uucuuuaguagcaacuaaaa

SEQ ID NO: 3239032 - RNA, 12 nt, Human
uucuuuagucuu

SEQ ID NO: 3239033 - RNA, 23 nt, Human
uugaaaagacuccaaagaaaugu

SEQ ID NO: 3239034 - RNA, 22 nt, Human
uugaaaagacuccaaagaaaug

SEQ ID NO: 3239035 - RNA, 18 nt, Human
uugaaaagacuccaaaga

SEQ ID NO: 3239036 - RNA, 16 nt, Human
uugaaaagacuccaaa

SEQ ID NO: 3239037 - RNA, 23 nt, Human
uugaaacugagaugugaacacau

SEQ ID NO: 3239038 - RNA, 14 nt, Human
uugaaacuuugaga

SEQ ID NO: 3239039 - RNA, 16 nt, Human
uugaaacugcauuugu

SEQ ID NO: 3239040 - RNA, 17 nt, Human
uugaaacugcauuugug

SEQ ID NO: 3239041 - RNA, 18 nt, Human
uugaaacugcauuugugc

SEQ ID NO: 3239042 - RNA, 20 nt, Human
uugaaacuuugagaucuaaa

SEQ ID NO: 3239043 - RNA, 16 nt, Human
uugaaacuuugagauc

SEQ ID NO: 3239044 - RNA, 20 nt, Human
uucugagcaccgaauauuga

SEQ ID NO: 3239045 - RNA, 21 nt, Human
uucugagcaccgaauauugag

SEQ ID NO: 3239046 - RNA, 14 nt, Human
uucugacucuuccc

SEQ ID NO: 3239047 - RNA, 17 nt, Human
uucuguccgagcuuuga

SEQ ID NO: 3239048 - RNA, 21 nt, Human
uucuguccgagcuuugaaaau

SEQ ID NO: 3239049 - RNA, 23 nt, Human
uucuguggguuucuaaagcugcc

SEQ ID NO: 3239050 - RNA, 16 nt, Human
uucuguggcucacaga

SEQ ID NO: 3239051 - RNA, 12 nt, Human
uucuguggcuca

SEQ ID NO: 3239052 - RNA, 17 nt, Human
uucuguccuacucugug

SEQ ID NO: 3239053 - RNA, 20 nt, Human
uucugagcuuacguaguucu

SEQ ID NO: 3239054 - RNA, 14 nt, Human
uucugagcuggccu

SEQ ID NO: 3239055 - RNA, 20 nt, Human
uucugugguuggcugggaaa

SEQ ID NO: 3239056 - RNA, 22 nt, Human
uucuguggcgaggcaugcuauc

SEQ ID NO: 3239057 - RNA, 22 nt, Human
uucuguuaaaaugcaugauugc

SEQ ID NO: 3239058 - RNA, 16 nt, Human
uucuguuaaaaugcau

SEQ ID NO: 3239059 - RNA, 13 nt, Human
uucuguuaaaaug

SEQ ID NO: 3239060 - RNA, 17 nt, Human
uucuguguuuauucaaa

SEQ ID NO: 3239061 - RNA, 22 nt, Human
uucuguuacaaaauguaacugu

SEQ ID NO: 3239062 - RNA, 20 nt, Human
uucuguuacaaaauguaacu

SEQ ID NO: 3239063 - RNA, 17 nt, Human
uucuguuacaaaaugua

SEQ ID NO: 3239064 - RNA, 16 nt, Human
uucuguuacaaaaugu

SEQ ID NO: 3239065 - RNA, 15 nt, Human
uucuguuacaaaaug

SEQ ID NO: 3239066 - RNA, 14 nt, Human
uucuguuacaaaau

SEQ ID NO: 3239067 - RNA, 13 nt, Human
uucuguuacaaaa

SEQ ID NO: 3239068 - RNA, 15 nt, Human
uucuuauuucauuuc

SEQ ID NO: 3239069 - RNA, 11 nt, Human
uucuucaaaau

SEQ ID NO: 3239070 - RNA, 17 nt, Human
uucuuauuuuuguacuu

SEQ ID NO: 3239071 - RNA, 21 nt, Human
uucuucaaaauauaaaaugcc

SEQ ID NO: 3239072 - RNA, 16 nt, Human
uucuucaaaccuuugu

SEQ ID NO: 3239073 - RNA, 23 nt, Human
uucuucaaaauauaaaaugccaa

SEQ ID NO: 3239074 - RNA, 14 nt, Human
uucuucaacucccu

SEQ ID NO: 3239075 - RNA, 23 nt, Human
uucuuauuuaaugaaagacugua

SEQ ID NO: 3239076 - RNA, 19 nt, Human
uucuuauuuaaugaaagac

SEQ ID NO: 3239077 - RNA, 13 nt, Human
uucuguucugaua

SEQ ID NO: 3239078 - RNA, 18 nt, Human
uucuuauuuaaucuuuuc

SEQ ID NO: 3239079 - RNA, 21 nt, Human
uucuuauuuaaucuuuucuua

SEQ ID NO: 3239080 - RNA, 18 nt, Human
uucuucacucaaauuuug

SEQ ID NO: 3239081 - RNA, 18 nt, Human
uugaauguaugcuucaua

SEQ ID NO: 3239082 - RNA, 20 nt, Human
uugaauggcaauguuuugcu

SEQ ID NO: 3239083 - RNA, 20 nt, Human
uugaccgugaggccagagac

SEQ ID NO: 3239084 - RNA, 21 nt, Human
uugaccgugaggccagagaca

SEQ ID NO: 3239085 - RNA, 15 nt, Human
uugaccucaggugau

SEQ ID NO: 3239086 - RNA, 14 nt, Human
uugacgccauccca

SEQ ID NO: 3239087 - RNA, 22 nt, Human
uugacgccaucccagccccaau

SEQ ID NO: 3239088 - RNA, 12 nt, Human
uugaccugaggc

SEQ ID NO: 3239089 - RNA, 19 nt, Human
uugaccugaggcccuucuc

SEQ ID NO: 3239090 - RNA, 22 nt, Human
uugaccugaggcccuucucucc

SEQ ID NO: 3239091 - RNA, 20 nt, Human
uugacgccaucccagcccca

SEQ ID NO: 3239092 - RNA, 19 nt, Human
uugacguauuauuguccuu

SEQ ID NO: 3239093 - RNA, 17 nt, Human
uugaggaaauuugcagc

SEQ ID NO: 3239094 - RNA, 21 nt, Human
uugaggaaaaauaugugaagg

SEQ ID NO: 3239095 - RNA, 20 nt, Human
uugaggaaaaauaugugaag

SEQ ID NO: 3239096 - RNA, 17 nt, Human
uugaggaaaaauaugug

SEQ ID NO: 3239097 - RNA, 15 nt, Human
uugaggaaaaauaug

SEQ ID NO: 3239098 - RNA, 14 nt, Human
uugagcugguaaca

SEQ ID NO: 3239099 - RNA, 21 nt, Human
uugagcugcuuuuuuugaaac

SEQ ID NO: 3239100 - RNA, 20 nt, Human
uugagcugcuuuuuuugaaa

SEQ ID NO: 3239101 - RNA, 18 nt, Human
uugagcugcuuuuuuuga

SEQ ID NO: 3239102 - RNA, 19 nt, Human
uugauagcacagacccugc

SEQ ID NO: 3239103 - RNA, 20 nt, Human
uugauagcacagacccugcc

SEQ ID NO: 3239104 - RNA, 20 nt, Human
uugcauacaaacaagcauau

SEQ ID NO: 3239105 - RNA, 14 nt, Human
uugcauacaaacaa

SEQ ID NO: 3239106 - RNA, 13 nt, Human
uugcauacaaaca

SEQ ID NO: 3239107 - RNA, 18 nt, Human
uugcauagauucccugag

SEQ ID NO: 3239108 - RNA, 15 nt, Human
uugccacugccucuu

SEQ ID NO: 3239109 - RNA, 14 nt, Human
uugccacugccucu

SEQ ID NO: 3239110 - RNA, 16 nt, Human
uugcagacaggcaagc

SEQ ID NO: 3239111 - RNA, 21 nt, Human
uugcagaacuugaagccugcu

SEQ ID NO: 3239112 - RNA, 11 nt, Human
uugcagaacuu

SEQ ID NO: 3239113 - RNA, 17 nt, Human
uugcaacaaaauacauu

SEQ ID NO: 3239114 - RNA, 23 nt, Human
uugcaggagcaguaucaugaagc

SEQ ID NO: 3239115 - RNA, 14 nt, Human
uugaugaaaagcuu

SEQ ID NO: 3239116 - RNA, 15 nt, Human
uugaugaaaagcuuu

SEQ ID NO: 3239117 - RNA, 13 nt, Human
uugauuuauuaac

SEQ ID NO: 3239118 - RNA, 14 nt, Human
uugauuuauuaacu

SEQ ID NO: 3239119 - RNA, 15 nt, Human
uugauuuauuaacuu

SEQ ID NO: 3239120 - RNA, 17 nt, Human
uugauuuauuaacuuaa

SEQ ID NO: 3239121 - RNA, 20 nt, Human
uugauuuauuaacuuaauaa

SEQ ID NO: 3239122 - RNA, 18 nt, Human
uugauagcacagacccug

SEQ ID NO: 3239123 - RNA, 21 nt, Human
uugauagcacagacccugccc

SEQ ID NO: 3239124 - RNA, 19 nt, Human
uugaucuuccucugcuaaa

SEQ ID NO: 3239125 - RNA, 17 nt, Human
uugaucuuccucugcua

SEQ ID NO: 3239126 - RNA, 22 nt, Human
uugauuucuaguuauuuauucu

SEQ ID NO: 3239127 - RNA, 22 nt, Human
uugauuuuccaucuaaaaauau

SEQ ID NO: 3239128 - RNA, 19 nt, Human
uugauuuuccaucuaaaaa

SEQ ID NO: 3239129 - RNA, 21 nt, Human
uugauuuauuaacuuaauaau

SEQ ID NO: 3239130 - RNA, 13 nt, Human
uugcaaaaaucca

SEQ ID NO: 3239131 - RNA, 19 nt, Human
uugauuuuuuuuuuuaauc

SEQ ID NO: 3239132 - RNA, 17 nt, Human
uugcaacaggcugggcu

SEQ ID NO: 3239133 - RNA, 14 nt, Human
uugcaacaggcugg

SEQ ID NO: 3239134 - RNA, 13 nt, Human
uugcaacaaaaua

SEQ ID NO: 3239135 - RNA, 12 nt, Human
uugcaacaaaau

SEQ ID NO: 3239136 - RNA, 12 nt, Human
ccaucagcccaa

SEQ ID NO: 3239137 - RNA, 22 nt, Human
ccaucauugaaaucuuuuugcu

SEQ ID NO: 3239138 - RNA, 21 nt, Human
ccauccaccguccccucccag

SEQ ID NO: 3239139 - RNA, 12 nt, Human
ccaucauuucug

SEQ ID NO: 3239140 - RNA, 17 nt, Human
ccaucauugaaaucuuu

SEQ ID NO: 3239141 - RNA, 13 nt, Human
ccaucauuucugg

SEQ ID NO: 3239142 - RNA, 18 nt, Human
ccauccuccuccuuccua

SEQ ID NO: 3239143 - RNA, 16 nt, Human
ccauccuccuccuucc

SEQ ID NO: 3239144 - RNA, 12 nt, Human
ccauccucugua

SEQ ID NO: 3239145 - RNA, 19 nt, Human
ccauccucuguacagagcc

SEQ ID NO: 3239146 - RNA, 19 nt, Human
ccaucuccuuucucuggua

SEQ ID NO: 3239147 - RNA, 19 nt, Human
ccaucuggagagcccagag

SEQ ID NO: 3239148 - RNA, 12 nt, Human
ccaucuggagag

SEQ ID NO: 3239149 - RNA, 22 nt, Human
ccaucugcugucuuuucuuugc

SEQ ID NO: 3239150 - RNA, 17 nt, Human
ccagugaggcucugccc

SEQ ID NO: 3239151 - RNA, 20 nt, Human
ccagugaggcucugcccuug

SEQ ID NO: 3239152 - RNA, 18 nt, Human
ccagugaggcucugcccu

SEQ ID NO: 3239153 - RNA, 19 nt, Human
ccagugaggcucugcccuu

SEQ ID NO: 3239154 - RNA, 14 nt, Human
ccauagugacuuuu

SEQ ID NO: 3239155 - RNA, 13 nt, Human
ccauacuaauuau

SEQ ID NO: 3239156 - RNA, 23 nt, Human
ccauacuaauuauacccccugca

SEQ ID NO: 3239157 - RNA, 12 nt, Human
ccauacuaauua

SEQ ID NO: 3239158 - RNA, 19 nt, Human
ccauauccauagugacuuu

SEQ ID NO: 3239159 - RNA, 21 nt, Human
ccauaucaaaagacacagggg

SEQ ID NO: 3239160 - RNA, 18 nt, Human
ccauaucaaaagacacag

SEQ ID NO: 3239161 - RNA, 13 nt, Human
ccauauagaaagc

SEQ ID NO: 3239162 - RNA, 18 nt, Human
ccauaguugacaguucca

SEQ ID NO: 3239163 - RNA, 18 nt, Human
ccauaguuacuguaaaau

SEQ ID NO: 3239164 - RNA, 17 nt, Human
ccauaguuacuguaaaa

SEQ ID NO: 3239165 - RNA, 19 nt, Human
ccauaguuaaagaagacau

SEQ ID NO: 3239166 - RNA, 14 nt, Human
ccauaugcagaaau

SEQ ID NO: 3239167 - RNA, 16 nt, Human
ccauaugcagaaauag

SEQ ID NO: 3239168 - RNA, 14 nt, Human
ccaucacagcuugu

SEQ ID NO: 3239169 - RNA, 15 nt, Human
ccaucacagcuuguu

SEQ ID NO: 3239170 - RNA, 14 nt, Human
ccaugaagauguag

SEQ ID NO: 3239171 - RNA, 22 nt, Human
ccaucuggagagcccagagucc

SEQ ID NO: 3239172 - RNA, 22 nt, Human
ccaugaacugucaagugugugu

SEQ ID NO: 3239173 - RNA, 18 nt, Human
ccaugauguuuuccauga

SEQ ID NO: 3239174 - RNA, 19 nt, Human
ccaugauuaaccacuucag

SEQ ID NO: 3239175 - RNA, 21 nt, Human
ccaugauuaaccacuucagcu

SEQ ID NO: 3239176 - RNA, 12 nt, Human
ccaugccagccg

SEQ ID NO: 3239177 - RNA, 14 nt, Human
ccaugcugcccugu

SEQ ID NO: 3239178 - RNA, 11 nt, Human
ccaugcugccc

SEQ ID NO: 3239179 - RNA, 13 nt, Human
ccaugcugcccug

SEQ ID NO: 3239180 - RNA, 20 nt, Human
ccauccucuguacagagccc

SEQ ID NO: 3239181 - RNA, 18 nt, Human
cccaaaccaccagaagcc

SEQ ID NO: 3239182 - RNA, 17 nt, Human
cccaaaccaccagaagc

SEQ ID NO: 3239183 - RNA, 22 nt, Human
cccaaaccaccagaagcccaga

SEQ ID NO: 3239184 - RNA, 15 nt, Human
cccaaaccuuucccc

SEQ ID NO: 3239185 - RNA, 12 nt, Human
cccaaagaugca

SEQ ID NO: 3239186 - RNA, 15 nt, Human
cccaaagaugcagcc

SEQ ID NO: 3239187 - RNA, 16 nt, Human
cccaaagcagugcaug

SEQ ID NO: 3239188 - RNA, 18 nt, Human
cccaaaaggcagaagcaa

SEQ ID NO: 3239189 - RNA, 13 nt, Human
cccaaaaggcaga

SEQ ID NO: 3239190 - RNA, 22 nt, Human
ccauuuuggugucuuucucuuu

SEQ ID NO: 3239191 - RNA, 21 nt, Human
ccauuuuggugucuuucucuu

SEQ ID NO: 3239192 - RNA, 20 nt, Human
ccauuuuggugucuuucucu

SEQ ID NO: 3239193 - RNA, 20 nt, Human
cccaaaacucuccucugcug

SEQ ID NO: 3239194 - RNA, 23 nt, Human
ccauuuuggauucuuauggacaa

SEQ ID NO: 3239195 - RNA, 20 nt, Human
ccauuuugggguacccacug

SEQ ID NO: 3239196 - RNA, 22 nt, Human
ccauuuugggguacccacugcu

SEQ ID NO: 3239197 - RNA, 19 nt, Human
ccauuuuggugucuuucuc

SEQ ID NO: 3239198 - RNA, 18 nt, Human
ccauuuuggugucuuucu

SEQ ID NO: 3239199 - RNA, 21 nt, Human
ccaugcuguuuucccuuugcc

SEQ ID NO: 3239200 - RNA, 18 nt, Human
ccaugcugucuggcacag

SEQ ID NO: 3239201 - RNA, 16 nt, Human
ccaugcugucuggcac

SEQ ID NO: 3239202 - RNA, 23 nt, Human
ccaugcugucuggcacagccugc

SEQ ID NO: 3239203 - RNA, 22 nt, Human
ccaugcugucuggcacagccug

SEQ ID NO: 3239204 - RNA, 21 nt, Human
ccaugcugucuggcacagccu

SEQ ID NO: 3239205 - RNA, 20 nt, Human
ccaugcugucuggcacagcc

SEQ ID NO: 3239206 - RNA, 13 nt, Human
ccauggacuuugu

SEQ ID NO: 3239207 - RNA, 14 nt, Human
ccauggacuuuguu

SEQ ID NO: 3239208 - RNA, 15 nt, Human
ccauucuccaccugc

SEQ ID NO: 3239209 - RNA, 16 nt, Human
ccauucuccaccugcc

SEQ ID NO: 3239210 - RNA, 18 nt, Human
ccauucugccugcccagg

SEQ ID NO: 3239211 - RNA, 17 nt, Human
ccauucugccugcccag

SEQ ID NO: 3239212 - RNA, 17 nt, Human
ccauucuccaccugcca

SEQ ID NO: 3239213 - RNA, 16 nt, Human
ccauucugccugccca

SEQ ID NO: 3239214 - RNA, 20 nt, Human
ccauucugccugcccaggcc

SEQ ID NO: 3239215 - RNA, 19 nt, Human
ccauucugccugcccaggc

SEQ ID NO: 3239216 - RNA, 14 nt, Human
ccauucuccaccug

SEQ ID NO: 3239217 - RNA, 21 nt, Human
ccauucugccugcccaggccc

SEQ ID NO: 3239218 - RNA, 22 nt, Human
ccaggaaguagcacaggcugag

SEQ ID NO: 3239219 - RNA, 20 nt, Human
ccaggaagccagcaggcucu

SEQ ID NO: 3239220 - RNA, 22 nt, Human
ccaggaagccagcaggcucuca

SEQ ID NO: 3239221 - RNA, 21 nt, Human
ccaggaaguagcacaggcuga

SEQ ID NO: 3239222 - RNA, 19 nt, Human
ccaggaaguagcacaggcu

SEQ ID NO: 3239223 - RNA, 18 nt, Human
ccaggaaguagcacaggc

SEQ ID NO: 3239224 - RNA, 16 nt, Human
ccaggaaguagcacag

SEQ ID NO: 3239225 - RNA, 20 nt, Human
ccaggacaggagaugcugug

SEQ ID NO: 3239226 - RNA, 14 nt, Human
ccagcucuggucca

SEQ ID NO: 3239227 - RNA, 17 nt, Human
ccagcucugguccauag

SEQ ID NO: 3239228 - RNA, 21 nt, Human
ccagcucugguccauagagag

SEQ ID NO: 3239229 - RNA, 22 nt, Human
ccagcucugguccauagagagc

SEQ ID NO: 3239230 - RNA, 18 nt, Human
ccagcugccuaggauuca

SEQ ID NO: 3239231 - RNA, 20 nt, Human
ccagcugcuugggcuucauc

SEQ ID NO: 3239232 - RNA, 15 nt, Human
ccagcugcugagccg

SEQ ID NO: 3239233 - RNA, 14 nt, Human
ccagcugcugagcc

SEQ ID NO: 3239234 - RNA, 19 nt, Human
ccagcugcugagccgcaga

SEQ ID NO: 3239235 - RNA, 18 nt, Human
ccagcugcugagccgcag

SEQ ID NO: 3239236 - RNA, 17 nt, Human
ccagcugcugagccgca

SEQ ID NO: 3239237 - RNA, 16 nt, Human
ccagcugcugagccgc

SEQ ID NO: 3239238 - RNA, 23 nt, Human
ccagcugcuugggcuucauccuc

SEQ ID NO: 3239239 - RNA, 23 nt, Human
ccagcugcugagccgcagagaag

SEQ ID NO: 3239240 - RNA, 19 nt, Human
ccagccuugaccauucucc

SEQ ID NO: 3239241 - RNA, 20 nt, Human
ccagccuugaccauucucca

SEQ ID NO: 3239242 - RNA, 16 nt, Human
ccagagcccaccuugg

SEQ ID NO: 3239243 - RNA, 19 nt, Human
ccagagcauuccagucagg

SEQ ID NO: 3239244 - RNA, 18 nt, Human
ccagagcauuccagucag

SEQ ID NO: 3239245 - RNA, 22 nt, Human
ccagagcccaccuuggcucaag

SEQ ID NO: 3239246 - RNA, 23 nt, Human
ccagagcauuccagucaggcucu

SEQ ID NO: 3239247 - RNA, 21 nt, Human
ccagagcauuccagucaggcu

SEQ ID NO: 3239248 - RNA, 16 nt, Human
ccagcgagcccuggug

SEQ ID NO: 3239249 - RNA, 15 nt, Human
ccagcgagcccuggu

SEQ ID NO: 3239250 - RNA, 13 nt, Human
ccagcgagcccug

SEQ ID NO: 3239251 - RNA, 14 nt, Human
ccagcgagcccugg

SEQ ID NO: 3239252 - RNA, 12 nt, Human
ccagcucugguc

SEQ ID NO: 3239253 - RNA, 13 nt, Human
ccagcucuggucc

SEQ ID NO: 3239254 - RNA, 11 nt, Human
ccagcucuggu

SEQ ID NO: 3239255 - RNA, 19 nt, Human
ccaggcuuucuagaaagaa

SEQ ID NO: 3239256 - RNA, 12 nt, Human
ccaggcuuucua

SEQ ID NO: 3239257 - RNA, 13 nt, Human
ccagggccaaaag

SEQ ID NO: 3239258 - RNA, 13 nt, Human
ccaggccccugcc

SEQ ID NO: 3239259 - RNA, 16 nt, Human
ccaggccccccuguca

SEQ ID NO: 3239260 - RNA, 15 nt, Human
ccaggccccccuguc

SEQ ID NO: 3239261 - RNA, 19 nt, Human
ccaggcuggucucaaacuc

SEQ ID NO: 3239262 - RNA, 14 nt, Human
ccaggcuggucuca

SEQ ID NO: 3239263 - RNA, 21 nt, Human
ccaggcuggucucgaacuccu

SEQ ID NO: 3239264 - RNA, 20 nt, Human
ccaggcuguaucccaugagc

SEQ ID NO: 3239265 - RNA, 18 nt, Human
ccaggccccucccucucc

SEQ ID NO: 3239266 - RNA, 16 nt, Human
ccaggccccucccucu

SEQ ID NO: 3239267 - RNA, 12 nt, Human
ccaggccccucc

SEQ ID NO: 3239268 - RNA, 20 nt, Human
ccagugaaaucaguuacucu

SEQ ID NO: 3239269 - RNA, 13 nt, Human
ccagucuuuuguc

SEQ ID NO: 3239270 - RNA, 15 nt, Human
ccagucuuuuguccu

SEQ ID NO: 3239271 - RNA, 18 nt, Human
ccaguauaaaauuacagu

SEQ ID NO: 3239272 - RNA, 21 nt, Human
ccaguauaaaauuacagugga

SEQ ID NO: 3239273 - RNA, 23 nt, Human
ccaguagcugggaccacaggugc

SEQ ID NO: 3239274 - RNA, 15 nt, Human
ccaguagcaggcccg

SEQ ID NO: 3239275 - RNA, 22 nt, Human
ccaguacauucucaguuuuucu

SEQ ID NO: 3239276 - RNA, 19 nt, Human
ccaguacauucucaguuuu

SEQ ID NO: 3239277 - RNA, 17 nt, Human
ccaguacauucucaguu

SEQ ID NO: 3239278 - RNA, 15 nt, Human
ccaguacauucucag

SEQ ID NO: 3239279 - RNA, 23 nt, Human
ccaguaccuggguccccagcccu

SEQ ID NO: 3239280 - RNA, 19 nt, Human
ccaguaccuggguccccag

SEQ ID NO: 3239281 - RNA, 14 nt, Human
ccagguucagcuug

SEQ ID NO: 3239282 - RNA, 22 nt, Human
ccagguggugggcauucucucu

SEQ ID NO: 3239283 - RNA, 20 nt, Human
ccaguaacacaggccacccu

SEQ ID NO: 3239284 - RNA, 12 nt, Human
ccaguaacacag

SEQ ID NO: 3239285 - RNA, 12 nt, Human
ccaguaagauca

SEQ ID NO: 3239286 - RNA, 14 nt, Human
ccaguaagaucacu

SEQ ID NO: 3239287 - RNA, 15 nt, Human
ccaguaagaucacug

SEQ ID NO: 3239288 - RNA, 16 nt, Human
ccaguaagaucacugu

SEQ ID NO: 3239289 - RNA, 17 nt, Human
ccaguaagaucacuguu

SEQ ID NO: 3239290 - RNA, 21 nt, Human
ccaguaagaucacuguuuaga

SEQ ID NO: 3239291 - RNA, 17 nt, Human
ccaguacaagaucucag

SEQ ID NO: 3239292 - RNA, 22 nt, Human
ccaggucccuuucauuugcuau

SEQ ID NO: 3239293 - RNA, 17 nt, Human
ccaggugccaguuaugg

SEQ ID NO: 3239294 - RNA, 13 nt, Human
ccaggugccaguu

SEQ ID NO: 3239295 - RNA, 19 nt, Human
ccaggugcuaggaacacuc

SEQ ID NO: 3239296 - RNA, 15 nt, Human
ccaggugccuccuga

SEQ ID NO: 3239297 - RNA, 21 nt, Human
ccaggugaaggaggcuccagg

SEQ ID NO: 3239298 - RNA, 20 nt, Human
ccaggugaaggaggcuccag

SEQ ID NO: 3239299 - RNA, 16 nt, Human
ccaggugaaggaggcu

SEQ ID NO: 3239300 - RNA, 23 nt, Human
ccaggucuaccccucccggcccu

SEQ ID NO: 3239301 - RNA, 15 nt, Human
ccaggagcagccaca

SEQ ID NO: 3239302 - RNA, 16 nt, Human
ccaggagcagccacau

SEQ ID NO: 3239303 - RNA, 15 nt, Human
ccaggagccccgagg

SEQ ID NO: 3239304 - RNA, 13 nt, Human
ccaggcauggugg

SEQ ID NO: 3239305 - RNA, 14 nt, Human
ccaggcauucccca

SEQ ID NO: 3239306 - RNA, 24 nt, Human
ccaggcauuccccaggaggccagc

SEQ ID NO: 3239307 - RNA, 23 nt, Human
ccaggcauuccccaggaggccag

SEQ ID NO: 3239308 - RNA, 22 nt, Human
ccaggcauuccccaggaggcca

SEQ ID NO: 3239309 - RNA, 13 nt, Human
ccaggagccuccu

SEQ ID NO: 3239310 - RNA, 14 nt, Human
ccaggagccuccug

SEQ ID NO: 3239311 - RNA, 18 nt, Human
ccaggagccuccugcccu

SEQ ID NO: 3239312 - RNA, 12 nt, Human
ccaggagccucc

SEQ ID NO: 3239313 - RNA, 12 nt, Human
ccaggaggccag

SEQ ID NO: 3239314 - RNA, 12 nt, Human
ccaggagcccau

SEQ ID NO: 3239315 - RNA, 11 nt, Human
ccaggagccca

SEQ ID NO: 3239316 - RNA, 13 nt, Human
ccaggagcccauu

SEQ ID NO: 3239317 - RNA, 13 nt, Human
ccaggaggccagc

SEQ ID NO: 3239318 - RNA, 17 nt, Human
cccaagggccuggccug

SEQ ID NO: 3239319 - RNA, 13 nt, Human
cccaacacaaaga

SEQ ID NO: 3239320 - RNA, 13 nt, Human
cccaaauuuaauu

SEQ ID NO: 3239321 - RNA, 23 nt, Human
cccaaauggaaaugggcagagca

SEQ ID NO: 3239322 - RNA, 19 nt, Human
cccaaaugugugcccagcu

SEQ ID NO: 3239323 - RNA, 18 nt, Human
cccaaaugugugcccagc

SEQ ID NO: 3239324 - RNA, 17 nt, Human
cccaaaugugugcccag

SEQ ID NO: 3239325 - RNA, 21 nt, Human
cccaaauugucaccugcuucu

SEQ ID NO: 3239326 - RNA, 18 nt, Human
cccaagggccuggccuga

SEQ ID NO: 3239327 - RNA, 19 nt, Human
cccaagggccuggccugag

SEQ ID NO: 3239328 - RNA, 23 nt, Human
cccaagggccuggccugagcugg

SEQ ID NO: 3239329 - RNA, 19 nt, Human
cccaaguuuugugaaauuu

SEQ ID NO: 3239330 - RNA, 17 nt, Human
cccaaguuuugugaaau

SEQ ID NO: 3239331 - RNA, 16 nt, Human
cccaauaccccaugga

SEQ ID NO: 3239332 - RNA, 21 nt, Human
cccaaguuuugugaaauuuuu

SEQ ID NO: 3239333 - RNA, 17 nt, Human
cccaauaccccauggac

SEQ ID NO: 3239334 - RNA, 23 nt, Human
cccaaugcacuuuguucuggcuc

SEQ ID NO: 3239335 - RNA, 16 nt, Human
cccaauccaucagugc

SEQ ID NO: 3239336 - RNA, 16 nt, Human
cccacaccuccugggg

SEQ ID NO: 3239337 - RNA, 20 nt, Human
cccagagggccugcaaggga

SEQ ID NO: 3239338 - RNA, 18 nt, Human
cccagagggccugcaagg

SEQ ID NO: 3239339 - RNA, 15 nt, Human
cccagagucccccca

SEQ ID NO: 3239340 - RNA, 20 nt, Human
cccagaguccccccacuccc

SEQ ID NO: 3239341 - RNA, 18 nt, Human
cccagcaagugagagcug

SEQ ID NO: 3239342 - RNA, 16 nt, Human
cccagcaagugagagc

SEQ ID NO: 3239343 - RNA, 22 nt, Human
cccagauugcaacaggcugggc

SEQ ID NO: 3239344 - RNA, 21 nt, Human
cccagauugcaacaggcuggg

SEQ ID NO: 3239345 - RNA, 20 nt, Human
cccagauugcaacaggcugg

SEQ ID NO: 3239346 - RNA, 15 nt, Human
cccagaucagccaga

SEQ ID NO: 3239347 - RNA, 14 nt, Human
cccagaucagccag

SEQ ID NO: 3239348 - RNA, 19 nt, Human
cccagaucagccagaagcc

SEQ ID NO: 3239349 - RNA, 15 nt, Human
cccagcgagcccugg

SEQ ID NO: 3239350 - RNA, 18 nt, Human
cccagcgagcccuggugg

SEQ ID NO: 3239351 - RNA, 17 nt, Human
cccagcgagcccuggug

SEQ ID NO: 3239352 - RNA, 23 nt, Human
cccagcgagcccugguggcagug

SEQ ID NO: 3239353 - RNA, 19 nt, Human
cccagcgagcccugguggc

SEQ ID NO: 3239354 - RNA, 21 nt, Human
cccagcgcugacgugucagga

SEQ ID NO: 3239355 - RNA, 16 nt, Human
cccagcgagggcccca

SEQ ID NO: 3239356 - RNA, 20 nt, Human
cccagcgugaagccagggcc

SEQ ID NO: 3239357 - RNA, 14 nt, Human
cccagcuccacccc

SEQ ID NO: 3239358 - RNA, 12 nt, Human
cccagccugcua

SEQ ID NO: 3239359 - RNA, 21 nt, Human
cccagccucaaauccaggacc

SEQ ID NO: 3239360 - RNA, 16 nt, Human
cccagccucuuucccu

SEQ ID NO: 3239361 - RNA, 15 nt, Human
cccagccucuuuccc

SEQ ID NO: 3239362 - RNA, 13 nt, Human
cccagccucuuuc

SEQ ID NO: 3239363 - RNA, 19 nt, Human
cccagcccuuccucugcuc

SEQ ID NO: 3239364 - RNA, 22 nt, Human
cccagcaagugagagcugggug

SEQ ID NO: 3239365 - RNA, 21 nt, Human
cccagcaagugagagcugggu

SEQ ID NO: 3239366 - RNA, 20 nt, Human
cccagcaagugagagcuggg

SEQ ID NO: 3239367 - RNA, 19 nt, Human
cccagcaagugagagcugg

SEQ ID NO: 3239368 - RNA, 11 nt, Human
cccagccccuu

SEQ ID NO: 3239369 - RNA, 13 nt, Human
cccaggcaggucu

SEQ ID NO: 3239370 - RNA, 11 nt, Human
cccaggcaggu

SEQ ID NO: 3239371 - RNA, 14 nt, Human
cccaggcaaauaaa

SEQ ID NO: 3239372 - RNA, 15 nt, Human
cccaggcaaauaaaa

SEQ ID NO: 3239373 - RNA, 16 nt, Human
cccaggcaaauaaaau

SEQ ID NO: 3239374 - RNA, 21 nt, Human
cccaggcaaauaaaauucccu

SEQ ID NO: 3239375 - RNA, 22 nt, Human
cccaggcaaauaaaauucccua

SEQ ID NO: 3239376 - RNA, 17 nt, Human
cccaggauauauuuuau

SEQ ID NO: 3239377 - RNA, 15 nt, Human
cccaggauauauuuu

SEQ ID NO: 3239378 - RNA, 18 nt, Human
cccaggaggccagccuug

SEQ ID NO: 3239379 - RNA, 10 nt, Human
cccaggaggg

SEQ ID NO: 3239380 - RNA, 13 nt, Human
cccaggaggccag

SEQ ID NO: 3239381 - RNA, 22 nt, Human
cccaggaggccagccuugacca

SEQ ID NO: 3239382 - RNA, 18 nt, Human
cccaggagccccgaggcc

SEQ ID NO: 3239383 - RNA, 21 nt, Human
cccaggagccccgaggccuuc

SEQ ID NO: 3239384 - RNA, 19 nt, Human
cccaggagccugcccagcc

SEQ ID NO: 3239385 - RNA, 17 nt, Human
cccaggagccugcccag

SEQ ID NO: 3239386 - RNA, 19 nt, Human
cccaggaggacucccugcu

SEQ ID NO: 3239387 - RNA, 22 nt, Human
cccaggccccugccacccuggg

SEQ ID NO: 3239388 - RNA, 21 nt, Human
cccaggccccugccacccugg

SEQ ID NO: 3239389 - RNA, 18 nt, Human
cccaggccccugccaccc

SEQ ID NO: 3239390 - RNA, 16 nt, Human
cccaggccccugccac

SEQ ID NO: 3239391 - RNA, 11 nt, Human
cccaggccccu

SEQ ID NO: 3239392 - RNA, 22 nt, Human
cccaggcauuccccaggaggcc

SEQ ID NO: 3239393 - RNA, 23 nt, Human
cccaggcauuccccaggaggcca

SEQ ID NO: 3239394 - RNA, 20 nt, Human
cccaggcauuccccaggagg

SEQ ID NO: 3239395 - RNA, 21 nt, Human
cccaggcauuccccaggaggc

SEQ ID NO: 3239396 - RNA, 18 nt, Human
cccaggcauuccccagga

SEQ ID NO: 3239397 - RNA, 17 nt, Human
cccaggcaggucuugaa

SEQ ID NO: 3239398 - RNA, 13 nt, Human
cccaggugccagu

SEQ ID NO: 3239399 - RNA, 22 nt, Human
cccaggugcuaggaacacuccu

SEQ ID NO: 3239400 - RNA, 23 nt, Human
cccaggugcuaggaacacuccuu

SEQ ID NO: 3239401 - RNA, 15 nt, Human
cccagguggcugugg

SEQ ID NO: 3239402 - RNA, 14 nt, Human
cccagguggcugug

SEQ ID NO: 3239403 - RNA, 13 nt, Human
cccagugcccaca

SEQ ID NO: 3239404 - RNA, 20 nt, Human
cccagucuggaaugcagugg

SEQ ID NO: 3239405 - RNA, 13 nt, Human
cccagucccagca

SEQ ID NO: 3239406 - RNA, 19 nt, Human
cccagucccagcagccagc

SEQ ID NO: 3239407 - RNA, 17 nt, Human
cccagucccagcagcca

SEQ ID NO: 3239408 - RNA, 15 nt, Human
cccagucccagcagc

SEQ ID NO: 3239409 - RNA, 14 nt, Human
cccagucccagcag

SEQ ID NO: 3239410 - RNA, 21 nt, Human
cccagucaauuacauguuugg

SEQ ID NO: 3239411 - RNA, 17 nt, Human
cccaggccuccuacagc

SEQ ID NO: 3239412 - RNA, 18 nt, Human
cccaggccuccuacagcu

SEQ ID NO: 3239413 - RNA, 18 nt, Human
cccaggcgccccuucccc

SEQ ID NO: 3239414 - RNA, 16 nt, Human
cccaggccugccuguu

SEQ ID NO: 3239415 - RNA, 15 nt, Human
cccaggccugccugu

SEQ ID NO: 3239416 - RNA, 14 nt, Human
cccaggcugagccu

SEQ ID NO: 3239417 - RNA, 22 nt, Human
cccagggggcuuccugagggga

SEQ ID NO: 3239418 - RNA, 19 nt, Human
cccagggugagguggcaug

SEQ ID NO: 3239419 - RNA, 22 nt, Human
ccccaaauggaaaugggcagag

SEQ ID NO: 3239420 - RNA, 21 nt, Human
ccccaaauggaaaugggcaga

SEQ ID NO: 3239421 - RNA, 14 nt, Human
ccccacccaagggc

SEQ ID NO: 3239422 - RNA, 20 nt, Human
ccccacccaagggccuggcc

SEQ ID NO: 3239423 - RNA, 13 nt, Human
ccccaccaucugc

SEQ ID NO: 3239424 - RNA, 19 nt, Human
ccccaccaucugcugucuu

SEQ ID NO: 3239425 - RNA, 18 nt, Human
ccccaccaucugcugucu

SEQ ID NO: 3239426 - RNA, 15 nt, Human
ccccaccaucugcug

SEQ ID NO: 3239427 - RNA, 14 nt, Human
ccccaccaucugcu

SEQ ID NO: 3239428 - RNA, 17 nt, Human
ccccaagcgcccuggcc

SEQ ID NO: 3239429 - RNA, 13 nt, Human
ccccaagccuggc

SEQ ID NO: 3239430 - RNA, 14 nt, Human
ccccaagccuggca

SEQ ID NO: 3239431 - RNA, 13 nt, Human
ccccaagcgcccu

SEQ ID NO: 3239432 - RNA, 17 nt, Human
cccaugcugcccuguga

SEQ ID NO: 3239433 - RNA, 14 nt, Human
cccauggaccaugc

SEQ ID NO: 3239434 - RNA, 16 nt, Human
cccaugggcaggagac

SEQ ID NO: 3239435 - RNA, 14 nt, Human
cccaugggcaggag

SEQ ID NO: 3239436 - RNA, 16 nt, Human
cccaugggaggcugga

SEQ ID NO: 3239437 - RNA, 13 nt, Human
cccaugggaggga

SEQ ID NO: 3239438 - RNA, 21 nt, Human
cccaugggagggagcugagaa

SEQ ID NO: 3239439 - RNA, 23 nt, Human
cccaugggagggagcugagaaga

SEQ ID NO: 3239440 - RNA, 23 nt, Human
cccauggccggcuuucaggagcu

SEQ ID NO: 3239441 - RNA, 15 nt, Human
cccaugcugcccugu

SEQ ID NO: 3239442 - RNA, 16 nt, Human
cccaugcugcccugug

SEQ ID NO: 3239443 - RNA, 23 nt, Human
cccaguggcagggcacagggccu

SEQ ID NO: 3239444 - RNA, 22 nt, Human
cccaguggcagggcacagggcc

SEQ ID NO: 3239445 - RNA, 20 nt, Human
cccaguggcagggcacaggg

SEQ ID NO: 3239446 - RNA, 17 nt, Human
cccaguggcagggcaca

SEQ ID NO: 3239447 - RNA, 16 nt, Human
cccaguggcagggcac

SEQ ID NO: 3239448 - RNA, 15 nt, Human
cccaguggcagggca

SEQ ID NO: 3239449 - RNA, 14 nt, Human
cccaguggcagggc

SEQ ID NO: 3239450 - RNA, 13 nt, Human
cccaguggcaggg

SEQ ID NO: 3239451 - RNA, 18 nt, Human
cccagugccgagaaggaa

SEQ ID NO: 3239452 - RNA, 17 nt, Human
cccagugccgagaagga

SEQ ID NO: 3239453 - RNA, 20 nt, Human
cccagugcccacaggaucag

SEQ ID NO: 3239454 - RNA, 15 nt, Human
cccagugcccacagg

SEQ ID NO: 3239455 - RNA, 17 nt, Human
ccccaggaggccagccu

SEQ ID NO: 3239456 - RNA, 16 nt, Human
ccacggccuccuuucc

SEQ ID NO: 3239457 - RNA, 23 nt, Human
ccacggccaggccagagggagug

SEQ ID NO: 3239458 - RNA, 18 nt, Human
ccacggccaggccagagg

SEQ ID NO: 3239459 - RNA, 16 nt, Human
ccacggccaggccaga

SEQ ID NO: 3239460 - RNA, 18 nt, Human
ccacgcuggagugcagug

SEQ ID NO: 3239461 - RNA, 15 nt, Human
ccacccccacccaag

SEQ ID NO: 3239462 - RNA, 13 nt, Human
ccaccccauggcc

SEQ ID NO: 3239463 - RNA, 13 nt, Human
ccacgcuggagug

SEQ ID NO: 3239464 - RNA, 16 nt, Human
ccacgcuggagugcag

SEQ ID NO: 3239465 - RNA, 15 nt, Human
ccaccccacacacgc

SEQ ID NO: 3239466 - RNA, 15 nt, Human
ccacuagacccacug

SEQ ID NO: 3239467 - RNA, 17 nt, Human
ccacuagacccacugga

SEQ ID NO: 3239468 - RNA, 22 nt, Human
ccacuccagaccccuggcuuuu

SEQ ID NO: 3239469 - RNA, 21 nt, Human
ccacuccagaccccuggcuuu

SEQ ID NO: 3239470 - RNA, 20 nt, Human
ccacuccagaccccuggcuu

SEQ ID NO: 3239471 - RNA, 13 nt, Human
ccagaagcccaga

SEQ ID NO: 3239472 - RNA, 12 nt, Human
ccagaagcccag

SEQ ID NO: 3239473 - RNA, 20 nt, Human
ccagaagccacccaaagcag

SEQ ID NO: 3239474 - RNA, 23 nt, Human
ccagaaguuugagaucagccugg

SEQ ID NO: 3239475 - RNA, 14 nt, Human
ccagaagcccagaa

SEQ ID NO: 3239476 - RNA, 22 nt, Human
ccagaaguuugagaucagccug

SEQ ID NO: 3239477 - RNA, 18 nt, Human
ccagaaaugucccuuucu

SEQ ID NO: 3239478 - RNA, 10 nt, Human
ccagaaauuc

SEQ ID NO: 3239479 - RNA, 22 nt, Human
ccagaaaugucccuuucuucuc

SEQ ID NO: 3239480 - RNA, 13 nt, Human
ccacuucagcuga

SEQ ID NO: 3239481 - RNA, 14 nt, Human
ccacuucagcugac

SEQ ID NO: 3239482 - RNA, 15 nt, Human
ccacuucaaaacaaa

SEQ ID NO: 3239483 - RNA, 14 nt, Human
ccacuucaaaacaa

SEQ ID NO: 3239484 - RNA, 20 nt, Human
ccacuuagccuuucuuuucu

SEQ ID NO: 3239485 - RNA, 21 nt, Human
ccacuuagaaauugcauuucc

SEQ ID NO: 3239486 - RNA, 13 nt, Human
ccacugcagaaga

SEQ ID NO: 3239487 - RNA, 18 nt, Human
ccacugcagaagacagua

SEQ ID NO: 3239488 - RNA, 22 nt, Human
ccacucccagcaucgcacucug

SEQ ID NO: 3239489 - RNA, 19 nt, Human
ccacuuagaaauugcauuu

SEQ ID NO: 3239490 - RNA, 23 nt, Human
ccacugcacuccagccuggguga

SEQ ID NO: 3239491 - RNA, 20 nt, Human
ccagacaccuugacagggca

SEQ ID NO: 3239492 - RNA, 18 nt, Human
ccagacacaaacugccaa

SEQ ID NO: 3239493 - RNA, 12 nt, Human
ccagacacaaac

SEQ ID NO: 3239494 - RNA, 23 nt, Human
ccagacaagcuguugaccaggca

SEQ ID NO: 3239495 - RNA, 15 nt, Human
ccagacaagcuguug

SEQ ID NO: 3239496 - RNA, 21 nt, Human
ccagacaccuugacagggcac

SEQ ID NO: 3239497 - RNA, 21 nt, Human
ccagaauuucccaaagcagug

SEQ ID NO: 3239498 - RNA, 18 nt, Human
ccagaauuucccaaagca

SEQ ID NO: 3239499 - RNA, 12 nt, Human
ccagaauuuccc

SEQ ID NO: 3239500 - RNA, 19 nt, Human
ccagaauuucccaaagcag

SEQ ID NO: 3239501 - RNA, 13 nt, Human
ccagaauuucaaa

SEQ ID NO: 3239502 - RNA, 14 nt, Human
ccagaauuauuuuu

SEQ ID NO: 3239503 - RNA, 16 nt, Human
ccagaaugcuuuagga

SEQ ID NO: 3239504 - RNA, 23 nt, Human
ccagaauggucuuucuaaugugu

SEQ ID NO: 3239505 - RNA, 17 nt, Human
ccagaccccuggcuuuu

SEQ ID NO: 3239506 - RNA, 16 nt, Human
ccagaccccuggcuuu

SEQ ID NO: 3239507 - RNA, 15 nt, Human
ccagaccccuggcuu

SEQ ID NO: 3239508 - RNA, 14 nt, Human
ccagaccccuggcu

SEQ ID NO: 3239509 - RNA, 16 nt, Human
ccacacccucacugcu

SEQ ID NO: 3239510 - RNA, 22 nt, Human
ccacacccagcccacuucugcc

SEQ ID NO: 3239511 - RNA, 21 nt, Human
ccacacccagcccacuucugc

SEQ ID NO: 3239512 - RNA, 15 nt, Human
ccacacccagcccac

SEQ ID NO: 3239513 - RNA, 20 nt, Human
ccacacccagcccacuucug

SEQ ID NO: 3239514 - RNA, 14 nt, Human
ccacaccagcccca

SEQ ID NO: 3239515 - RNA, 13 nt, Human
ccacaccagcccc

SEQ ID NO: 3239516 - RNA, 20 nt, Human
ccacacagacuugggcaggg

SEQ ID NO: 3239517 - RNA, 14 nt, Human
ccacacaugcaagg

SEQ ID NO: 3239518 - RNA, 20 nt, Human
ccacacaugcaagggaugaa

SEQ ID NO: 3239519 - RNA, 20 nt, Human
ccacacauuucacugucugu

SEQ ID NO: 3239520 - RNA, 19 nt, Human
ccacacauuucacugucug

SEQ ID NO: 3239521 - RNA, 22 nt, Human
ccaauaugugauuuuuuuuccc

SEQ ID NO: 3239522 - RNA, 22 nt, Human
ccacacguaaugaaacuuggau

SEQ ID NO: 3239523 - RNA, 14 nt, Human
ccacagcugcucaa

SEQ ID NO: 3239524 - RNA, 12 nt, Human
ccacacuccagc

SEQ ID NO: 3239525 - RNA, 16 nt, Human
ccacaggaucagucug

SEQ ID NO: 3239526 - RNA, 16 nt, Human
ccacaggcccuuccuc

SEQ ID NO: 3239527 - RNA, 15 nt, Human
ccacaggcccuuccu

SEQ ID NO: 3239528 - RNA, 16 nt, Human
ccacaggcauguccca

SEQ ID NO: 3239529 - RNA, 22 nt, Human
ccacaggcccuuccucuccacu

SEQ ID NO: 3239530 - RNA, 19 nt, Human
ccacaggcccuuccucucc

SEQ ID NO: 3239531 - RNA, 18 nt, Human
ccacaggcccuuccucuc

SEQ ID NO: 3239532 - RNA, 17 nt, Human
ccacaggcccuuccucu

SEQ ID NO: 3239533 - RNA, 23 nt, Human
ccacaggcccuuccucuccacug

SEQ ID NO: 3239534 - RNA, 18 nt, Human
ccacaggcaugucccaug

SEQ ID NO: 3239535 - RNA, 21 nt, Human
ccaccaacauacucccaucug

SEQ ID NO: 3239536 - RNA, 22 nt, Human
ccacauguuacuggauaaauug

SEQ ID NO: 3239537 - RNA, 15 nt, Human
ccaccaacccucaga

SEQ ID NO: 3239538 - RNA, 17 nt, Human
ccacaucuugcucugcu

SEQ ID NO: 3239539 - RNA, 18 nt, Human
ccacaucuugcucugcug

SEQ ID NO: 3239540 - RNA, 19 nt, Human
ccacaucuugcucugcuga

SEQ ID NO: 3239541 - RNA, 16 nt, Human
ccacaugccaggggcc

SEQ ID NO: 3239542 - RNA, 16 nt, Human
ccacauuccugaugcu

SEQ ID NO: 3239543 - RNA, 16 nt, Human
ccacaugugcacaugc

SEQ ID NO: 3239544 - RNA, 18 nt, Human
ccacagguaauuucuccu

SEQ ID NO: 3239545 - RNA, 14 nt, Human
ccacaggugcccgc

SEQ ID NO: 3239546 - RNA, 23 nt, Human
ccacaguauauuuuauuucaaug

SEQ ID NO: 3239547 - RNA, 14 nt, Human
ccacaucccucucu

SEQ ID NO: 3239548 - RNA, 21 nt, Human
ccacaucccucucugcuggac

SEQ ID NO: 3239549 - RNA, 21 nt, Human
ccacauccggggccagcuccg

SEQ ID NO: 3239550 - RNA, 19 nt, Human
ccacagucucccccacccu

SEQ ID NO: 3239551 - RNA, 21 nt, Human
ccacaguguaccauuaaaaua

SEQ ID NO: 3239552 - RNA, 16 nt, Human
ccacauccacagucuc

SEQ ID NO: 3239553 - RNA, 12 nt, Human
ccacauccacag

SEQ ID NO: 3239554 - RNA, 16 nt, Human
ccaauauucauagcag

SEQ ID NO: 3239555 - RNA, 17 nt, Human
ccacccccacccaaggg

SEQ ID NO: 3239556 - RNA, 23 nt, Human
ccacccaggagccccgaggccuu

SEQ ID NO: 3239557 - RNA, 17 nt, Human
ccacccaagcaggaggc

SEQ ID NO: 3239558 - RNA, 21 nt, Human
ccacccaggagccccgaggcc

SEQ ID NO: 3239559 - RNA, 15 nt, Human
ccacccaagcaggag

SEQ ID NO: 3239560 - RNA, 16 nt, Human
ccacccaaagcagugg

SEQ ID NO: 3239561 - RNA, 13 nt, Human
ccacccaaagcag

SEQ ID NO: 3239562 - RNA, 20 nt, Human
ccaagccuggucagcccaaa

SEQ ID NO: 3239563 - RNA, 19 nt, Human
ccaagccuggucagcccaa

SEQ ID NO: 3239564 - RNA, 19 nt, Human
ccaagccuuggcucuaccc

SEQ ID NO: 3239565 - RNA, 15 nt, Human
ccaagccuggcaagg

SEQ ID NO: 3239566 - RNA, 22 nt, Human
ccaagccuacuuuugccauuga

SEQ ID NO: 3239567 - RNA, 13 nt, Human
ccaagccguggcu

SEQ ID NO: 3239568 - RNA, 15 nt, Human
ccaagcucccaggca

SEQ ID NO: 3239569 - RNA, 16 nt, Human
ccaagcucccaggcau

SEQ ID NO: 3239570 - RNA, 22 nt, Human
ccaagcucccaggcauucccca

SEQ ID NO: 3239571 - RNA, 17 nt, Human
ccaaggccaaaggaagc

SEQ ID NO: 3239572 - RNA, 14 nt, Human
ccaagcucccaggc

SEQ ID NO: 3239573 - RNA, 13 nt, Human
ccaagcgcccugg

SEQ ID NO: 3239574 - RNA, 16 nt, Human
ccaagcgcccuggccc

SEQ ID NO: 3239575 - RNA, 14 nt, Human
ccaagcgcccuggc

SEQ ID NO: 3239576 - RNA, 22 nt, Human
ccaagcgcccuggcccccacau

SEQ ID NO: 3239577 - RNA, 17 nt, Human
ccaagcgcccuggcccc

SEQ ID NO: 3239578 - RNA, 22 nt, Human
ccaagcauaccaacacgagcag

SEQ ID NO: 3239579 - RNA, 20 nt, Human
ccaagguagaaugaccuugu

SEQ ID NO: 3239580 - RNA, 19 nt, Human
ccaagggguccccuccagg

SEQ ID NO: 3239581 - RNA, 22 nt, Human
ccaaggggaauguuugccucug

SEQ ID NO: 3239582 - RNA, 19 nt, Human
ccaagggccuggccugagc

SEQ ID NO: 3239583 - RNA, 16 nt, Human
ccaagggccuggccug

SEQ ID NO: 3239584 - RNA, 18 nt, Human
ccaagggccuggccugag

SEQ ID NO: 3239585 - RNA, 18 nt, Human
ccaaggccaaaggaagca

SEQ ID NO: 3239586 - RNA, 21 nt, Human
ccaaggccaaaggaagcacau

SEQ ID NO: 3239587 - RNA, 16 nt, Human
ccaaggccaaaggaag

SEQ ID NO: 3239588 - RNA, 15 nt, Human
ccaagggccuggccu

SEQ ID NO: 3239589 - RNA, 23 nt, Human
ccaagguuuggggaagaacgaag

SEQ ID NO: 3239590 - RNA, 13 nt, Human
ccaaggugggagg

SEQ ID NO: 3239591 - RNA, 15 nt, Human
ccaaggugauguugu

SEQ ID NO: 3239592 - RNA, 20 nt, Human
ccaagucaagugaaaaagga

SEQ ID NO: 3239593 - RNA, 14 nt, Human
ccaaguacacugag

SEQ ID NO: 3239594 - RNA, 22 nt, Human
ccaaguuuugugaaauuuuuca

SEQ ID NO: 3239595 - RNA, 17 nt, Human
ccaaguuuugugaaauu

SEQ ID NO: 3239596 - RNA, 16 nt, Human
ccaaguuuugugaaau

SEQ ID NO: 3239597 - RNA, 12 nt, Human
ccaaguuuugug

SEQ ID NO: 3239598 - RNA, 22 nt, Human
ccaauaguuguugauuggcagg

SEQ ID NO: 3239599 - RNA, 16 nt, Human
ccaauaggcaaauuaa

SEQ ID NO: 3239600 - RNA, 18 nt, Human
ccaauaggcaaauuaauc

SEQ ID NO: 3239601 - RNA, 19 nt, Human
ccaauaggcaaauuaauca

SEQ ID NO: 3239602 - RNA, 17 nt, Human
ccaauaccccauggacc

SEQ ID NO: 3239603 - RNA, 16 nt, Human
ccaauaccccauggac

SEQ ID NO: 3239604 - RNA, 14 nt, Human
ccaauaccccaugg

SEQ ID NO: 3239605 - RNA, 19 nt, Human
ccaacaagaauaaaggcag

SEQ ID NO: 3239606 - RNA, 21 nt, Human
ccaacaagaauaaaggcagcu

SEQ ID NO: 3239607 - RNA, 23 nt, Human
ccaaauuucauaccuaucaucuu

SEQ ID NO: 3239608 - RNA, 23 nt, Human
ccaaauuuuaauuuuugcuuuua

SEQ ID NO: 3239609 - RNA, 17 nt, Human
ccaacauacucccaucu

SEQ ID NO: 3239610 - RNA, 18 nt, Human
ccaacauacucccaucug

SEQ ID NO: 3239611 - RNA, 19 nt, Human
ccaacauacucccaucugu

SEQ ID NO: 3239612 - RNA, 20 nt, Human
ccaacauacucccaucugug

SEQ ID NO: 3239613 - RNA, 16 nt, Human
ccaacauacucccauc

SEQ ID NO: 3239614 - RNA, 20 nt, Human
ccaacagccacucagaaaag

SEQ ID NO: 3239615 - RNA, 21 nt, Human
ccaacauacucccaucuguga

SEQ ID NO: 3239616 - RNA, 22 nt, Human
ccaacauacucccaucugugaa

SEQ ID NO: 3239617 - RNA, 20 nt, Human
ccaaccaaguggcucccaca

SEQ ID NO: 3239618 - RNA, 20 nt, Human
ccaacagguagcauagcucu

SEQ ID NO: 3239619 - RNA, 17 nt, Human
ccaacaggggcuccaug

SEQ ID NO: 3239620 - RNA, 21 nt, Human
ccaaccacacuugucggcucc

SEQ ID NO: 3239621 - RNA, 17 nt, Human
ccaaagcgaauuuuaaa

SEQ ID NO: 3239622 - RNA, 15 nt, Human
ccaaagcuaggccug

SEQ ID NO: 3239623 - RNA, 17 nt, Human
ccaaagcuaggccuggc

SEQ ID NO: 3239624 - RNA, 16 nt, Human
ccaaagcuaggccugg

SEQ ID NO: 3239625 - RNA, 21 nt, Human
ccaaagcuaggccuggccaga

SEQ ID NO: 3239626 - RNA, 15 nt, Human
ccaaaggaagcacau

SEQ ID NO: 3239627 - RNA, 23 nt, Human
ccaaaggaagcacaugccucucu

SEQ ID NO: 3239628 - RNA, 14 nt, Human
ccaaagccaaugug

SEQ ID NO: 3239629 - RNA, 23 nt, Human
ccaaagcaguggagcccaggagu

SEQ ID NO: 3239630 - RNA, 12 nt, Human
ccaaacauuaau

SEQ ID NO: 3239631 - RNA, 19 nt, Human
ccaaagcaguggagcccag

SEQ ID NO: 3239632 - RNA, 17 nt, Human
ccaaagccuccuccagc

SEQ ID NO: 3239633 - RNA, 22 nt, Human
ccaaagccuccuccagccgcca

SEQ ID NO: 3239634 - RNA, 19 nt, Human
ccaaagcagugcaugcugu

SEQ ID NO: 3239635 - RNA, 23 nt, Human
ccaaagcagugcaugcugucccu

SEQ ID NO: 3239636 - RNA, 19 nt, Human
ccaaagccaaagcuaggcc

SEQ ID NO: 3239637 - RNA, 20 nt, Human
ccaaacucaccugccccuca

SEQ ID NO: 3239638 - RNA, 17 nt, Human
ccaaacagugcuguuuc

SEQ ID NO: 3239639 - RNA, 15 nt, Human
ccaagaggcugcagc

SEQ ID NO: 3239640 - RNA, 14 nt, Human
ccaagaggcugcag

SEQ ID NO: 3239641 - RNA, 21 nt, Human
ccaagacuuauuuucacaugu

SEQ ID NO: 3239642 - RNA, 16 nt, Human
ccaagaggcugcagcc

SEQ ID NO: 3239643 - RNA, 23 nt, Human
ccaagagguuuggcuccugccca

SEQ ID NO: 3239644 - RNA, 22 nt, Human
ccaagagguuuggcuccugccc

SEQ ID NO: 3239645 - RNA, 21 nt, Human
ccaagagguuuggcuccugcc

SEQ ID NO: 3239646 - RNA, 21 nt, Human
ccaagaguggccccaccuggc

SEQ ID NO: 3239647 - RNA, 15 nt, Human
ccaagaguggcccca

SEQ ID NO: 3239648 - RNA, 13 nt, Human
ccaagaguggccc

SEQ ID NO: 3239649 - RNA, 20 nt, Human
ccaagaguggccccaccugg

SEQ ID NO: 3239650 - RNA, 19 nt, Human
ccaagaguggccccaccug

SEQ ID NO: 3239651 - RNA, 18 nt, Human
ccaagaguggccccaccu

SEQ ID NO: 3239652 - RNA, 16 nt, Human
ccaagaguggccccac

SEQ ID NO: 3239653 - RNA, 22 nt, Human
ccaaccccucgcccagucccag

SEQ ID NO: 3239654 - RNA, 18 nt, Human
ccaaccccucgcccaguc

SEQ ID NO: 3239655 - RNA, 17 nt, Human
ccaaccccucgcccagu

SEQ ID NO: 3239656 - RNA, 15 nt, Human
ccaagaagcccagga

SEQ ID NO: 3239657 - RNA, 12 nt, Human
ccaacccucauc

SEQ ID NO: 3239658 - RNA, 15 nt, Human
ccaacccucagagcc

SEQ ID NO: 3239659 - RNA, 14 nt, Human
ccaacccucagagc

SEQ ID NO: 3239660 - RNA, 19 nt, Human
ccaagaagcccaggaaagg

SEQ ID NO: 3239661 - RNA, 20 nt, Human
ccaagaagcccaggaaaggc

SEQ ID NO: 3239662 - RNA, 19 nt, Human
ccaagaauagaugcugacu

SEQ ID NO: 3239663 - RNA, 20 nt, Human
ccaagaauagaugcugacug

SEQ ID NO: 3239664 - RNA, 17 nt, Human
ccaagaaguuuaaggaa

SEQ ID NO: 3239665 - RNA, 18 nt, Human
ccaaacaggcccuccucc

SEQ ID NO: 3239666 - RNA, 16 nt, Human
ccaaacaggcccuccu

SEQ ID NO: 3239667 - RNA, 17 nt, Human
ccaaacucaccugcccc

SEQ ID NO: 3239668 - RNA, 19 nt, Human
ccaaacauccuacaagaca

SEQ ID NO: 3239669 - RNA, 20 nt, Human
ccaaacauccuacaagacac

SEQ ID NO: 3239670 - RNA, 20 nt, Human
cauuuuucccaggcaaauaa

SEQ ID NO: 3239671 - RNA, 21 nt, Human
cauuuuguguugaagagcagc

SEQ ID NO: 3239672 - RNA, 12 nt, Human
cauuuuucaaua

SEQ ID NO: 3239673 - RNA, 21 nt, Human
cauuuuucaaaaaguaaaaag

SEQ ID NO: 3239674 - RNA, 16 nt, Human
cauuuuagcuaauuua

SEQ ID NO: 3239675 - RNA, 13 nt, Human
cauuuuaaaaagu

SEQ ID NO: 3239676 - RNA, 18 nt, Human
cauuuguuugguuauagu

SEQ ID NO: 3239677 - RNA, 18 nt, Human
cauuuuguguugaagagc

SEQ ID NO: 3239678 - RNA, 12 nt, Human
cauuuuguaaua

SEQ ID NO: 3239679 - RNA, 16 nt, Human
cauuuuguaauaauaa

SEQ ID NO: 3239680 - RNA, 13 nt, Human
cauuuuguaauaa

SEQ ID NO: 3239681 - RNA, 13 nt, Human
cauuugcuccuuu

SEQ ID NO: 3239682 - RNA, 14 nt, Human
cauuugcuccuuuc

SEQ ID NO: 3239683 - RNA, 18 nt, Human
cauuugagcagggcucag

SEQ ID NO: 3239684 - RNA, 17 nt, Human
cauuugagcagggcuca

SEQ ID NO: 3239685 - RNA, 20 nt, Human
cauuugagcagggcucagcg

SEQ ID NO: 3239686 - RNA, 16 nt, Human
cauuugagcagggcuc

SEQ ID NO: 3239687 - RNA, 21 nt, Human
cauuugaaaccccuguaggcc

SEQ ID NO: 3239688 - RNA, 19 nt, Human
cauuugaaaccccuguagg

SEQ ID NO: 3239689 - RNA, 15 nt, Human
cauuguagagcuucu

SEQ ID NO: 3239690 - RNA, 21 nt, Human
cauugccguggcaucuuaaaa

SEQ ID NO: 3239691 - RNA, 23 nt, Human
cauugccccaaauggauuccugu

SEQ ID NO: 3239692 - RNA, 22 nt, Human
cauugccccaaauggauuccug

SEQ ID NO: 3239693 - RNA, 21 nt, Human
cauuguagagcuucuggcacu

SEQ ID NO: 3239694 - RNA, 19 nt, Human
cauuguagagcuucuggca

SEQ ID NO: 3239695 - RNA, 17 nt, Human
cauuguagagcuucugg

SEQ ID NO: 3239696 - RNA, 16 nt, Human
cauuguagagcuucug

SEQ ID NO: 3239697 - RNA, 19 nt, Human
cauuguauagauauaauga

SEQ ID NO: 3239698 - RNA, 20 nt, Human
cauuguauagauauaaugaa

SEQ ID NO: 3239699 - RNA, 24 nt, Human
cauuguauagauauaaugaacaaa

SEQ ID NO: 3239700 - RNA, 14 nt, Human
cacccaagggccug

SEQ ID NO: 3239701 - RNA, 15 nt, Human
cacccaagggccugg

SEQ ID NO: 3239702 - RNA, 15 nt, Human
cauuguccagagcug

SEQ ID NO: 3239703 - RNA, 14 nt, Human
cauuguccagagcu

SEQ ID NO: 3239704 - RNA, 19 nt, Human
cauugucccugaagagaag

SEQ ID NO: 3239705 - RNA, 22 nt, Human
cauuguccagagcugcuucccc

SEQ ID NO: 3239706 - RNA, 19 nt, Human
cauuguccccaaugaauau

SEQ ID NO: 3239707 - RNA, 20 nt, Human
cauuguccagagcugcuucc

SEQ ID NO: 3239708 - RNA, 18 nt, Human
cauuguccagagcugcuu

SEQ ID NO: 3239709 - RNA, 16 nt, Human
cauuguccagagcugc

SEQ ID NO: 3239710 - RNA, 15 nt, Human
cauugucugucugca

SEQ ID NO: 3239711 - RNA, 18 nt, Human
cauuguuggccaaagcca

SEQ ID NO: 3239712 - RNA, 17 nt, Human
cauuguuggacauuugg

SEQ ID NO: 3239713 - RNA, 17 nt, Human
cauuguuggccaaagcc

SEQ ID NO: 3239714 - RNA, 20 nt, Human
cauuuccugacagaaggacu

SEQ ID NO: 3239715 - RNA, 13 nt, Human
cauuuccugacag

SEQ ID NO: 3239716 - RNA, 17 nt, Human
cauuuaggccaugggac

SEQ ID NO: 3239717 - RNA, 17 nt, Human
cauuuagggaguauucu

SEQ ID NO: 3239718 - RNA, 20 nt, Human
cauuuagggaguauucuaau

SEQ ID NO: 3239719 - RNA, 21 nt, Human
cauuuagggaguauucuaaua

SEQ ID NO: 3239720 - RNA, 13 nt, Human
cauuuaaaagaca

SEQ ID NO: 3239721 - RNA, 21 nt, Human
cauuuaaaacauuaaaauaua

SEQ ID NO: 3239722 - RNA, 20 nt, Human
cauuuaaaacauuaaaauau

SEQ ID NO: 3239723 - RNA, 13 nt, Human
cauuuccuguguc

SEQ ID NO: 3239724 - RNA, 12 nt, Human
cauuuccugugu

SEQ ID NO: 3239725 - RNA, 18 nt, Human
cauuucuaauuccuguuu

SEQ ID NO: 3239726 - RNA, 16 nt, Human
cauuucuaauuccugu

SEQ ID NO: 3239727 - RNA, 20 nt, Human
ccgacuugugcacaggcaga

SEQ ID NO: 3239728 - RNA, 19 nt, Human
ccgacuugugcacaggcag

SEQ ID NO: 3239729 - RNA, 18 nt, Human
ccgacuugugcacaggca

SEQ ID NO: 3239730 - RNA, 19 nt, Human
cccuuuuuuggcugcugaa

SEQ ID NO: 3239731 - RNA, 15 nt, Human
cccuuuuuuccuuuc

SEQ ID NO: 3239732 - RNA, 21 nt, Human
cccuuuuuuccuuuccaccuu

SEQ ID NO: 3239733 - RNA, 17 nt, Human
ccgagaaggaagccucc

SEQ ID NO: 3239734 - RNA, 18 nt, Human
ccgagauagccaaggcca

SEQ ID NO: 3239735 - RNA, 17 nt, Human
ccgagacggcacugaga

SEQ ID NO: 3239736 - RNA, 19 nt, Human
ccgagauagccaaggccaa

SEQ ID NO: 3239737 - RNA, 22 nt, Human
ccgagauagccaaggccaaagg

SEQ ID NO: 3239738 - RNA, 11 nt, Human
cccuuuuccuu

SEQ ID NO: 3239739 - RNA, 9 nt, Human
cccuuuucc

SEQ ID NO: 3239740 - RNA, 13 nt, Human
cccuuuucuguuu

SEQ ID NO: 3239741 - RNA, 17 nt, Human
cccuuuuuuggcugcug

SEQ ID NO: 3239742 - RNA, 18 nt, Human
cccuuuuuuggcugcuga

SEQ ID NO: 3239743 - RNA, 17 nt, Human
ccgaggccuucucugaa

SEQ ID NO: 3239744 - RNA, 18 nt, Human
ccgagaucacgccacugc

SEQ ID NO: 3239745 - RNA, 19 nt, Human
ccgauccuccccuggacuc

SEQ ID NO: 3239746 - RNA, 20 nt, Human
ccgauccuccccuggacucc

SEQ ID NO: 3239747 - RNA, 23 nt, Human
ccgaguguguuucauccuuccca

SEQ ID NO: 3239748 - RNA, 22 nt, Human
ccgaguguguuucauccuuccc

SEQ ID NO: 3239749 - RNA, 22 nt, Human
ccgagucucuucuccacuggau

SEQ ID NO: 3239750 - RNA, 21 nt, Human
ccgagucucuucuccacugga

SEQ ID NO: 3239751 - RNA, 16 nt, Human
ccgccccugagcccac

SEQ ID NO: 3239752 - RNA, 15 nt, Human
ccgccccugagccca

SEQ ID NO: 3239753 - RNA, 17 nt, Human
ccgccccugagcccacu

SEQ ID NO: 3239754 - RNA, 14 nt, Human
ccgccccugagccc

SEQ ID NO: 3239755 - RNA, 13 nt, Human
ccgccccugagcc

SEQ ID NO: 3239756 - RNA, 15 nt, Human
ccgaucgccagcaaa

SEQ ID NO: 3239757 - RNA, 20 nt, Human
ccgaugcaaacauuggaaga

SEQ ID NO: 3239758 - RNA, 17 nt, Human
ccgaugcaaacauugga

SEQ ID NO: 3239759 - RNA, 20 nt, Human
cccuuccucuccacugccuu

SEQ ID NO: 3239760 - RNA, 17 nt, Human
cccuuccucuccacugc

SEQ ID NO: 3239761 - RNA, 16 nt, Human
cccuuccucuccacug

SEQ ID NO: 3239762 - RNA, 17 nt, Human
cccuuaccacugcucug

SEQ ID NO: 3239763 - RNA, 21 nt, Human
cccuuaccacugcucugauga

SEQ ID NO: 3239764 - RNA, 15 nt, Human
cccuuccuccauccu

SEQ ID NO: 3239765 - RNA, 13 nt, Human
cccuuccucucca

SEQ ID NO: 3239766 - RNA, 21 nt, Human
cccuuccuaauuccacagcug

SEQ ID NO: 3239767 - RNA, 17 nt, Human
cccuugccgucuaccug

SEQ ID NO: 3239768 - RNA, 18 nt, Human
cccuugccgucuaccuga

SEQ ID NO: 3239769 - RNA, 12 nt, Human
cccuugcagccg

SEQ ID NO: 3239770 - RNA, 12 nt, Human
cccuuggcucuc

SEQ ID NO: 3239771 - RNA, 18 nt, Human
cccuuggggagcaggcuc

SEQ ID NO: 3239772 - RNA, 14 nt, Human
cccuugugguccca

SEQ ID NO: 3239773 - RNA, 16 nt, Human
cccuuguggucccacc

SEQ ID NO: 3239774 - RNA, 18 nt, Human
cccuuguggucccacccc

SEQ ID NO: 3239775 - RNA, 20 nt, Human
cccuuugacgccaucccagc

SEQ ID NO: 3239776 - RNA, 21 nt, Human
cccuuucuucucccccauccu

SEQ ID NO: 3239777 - RNA, 17 nt, Human
cccuuucuucuccccca

SEQ ID NO: 3239778 - RNA, 14 nt, Human
cccuuucuucuccc

SEQ ID NO: 3239779 - RNA, 13 nt, Human
cccuuucuuccuc

SEQ ID NO: 3239780 - RNA, 12 nt, Human
cccuuucuuccu

SEQ ID NO: 3239781 - RNA, 22 nt, Human
cccuuucugggcaccggggccu

SEQ ID NO: 3239782 - RNA, 18 nt, Human
cccuuucuacuuccaaga

SEQ ID NO: 3239783 - RNA, 17 nt, Human
cccuuuguccuccugcu

SEQ ID NO: 3239784 - RNA, 22 nt, Human
cccuuuguccuccugcugccag

SEQ ID NO: 3239785 - RNA, 21 nt, Human
cccuuuguccuccugcugcca

SEQ ID NO: 3239786 - RNA, 21 nt, Human
cccccgcugucagccauuccu

SEQ ID NO: 3239787 - RNA, 12 nt, Human
ccccccugucac

SEQ ID NO: 3239788 - RNA, 13 nt, Human
cccccucugcccu

SEQ ID NO: 3239789 - RNA, 14 nt, Human
cccccucugcccug

SEQ ID NO: 3239790 - RNA, 16 nt, Human
cccccucugcccugcg

SEQ ID NO: 3239791 - RNA, 16 nt, Human
ccccgucccccucugg

SEQ ID NO: 3239792 - RNA, 20 nt, Human
ccccgucccccucuggcucc

SEQ ID NO: 3239793 - RNA, 21 nt, Human
ccccgucucugguuccucccc

SEQ ID NO: 3239794 - RNA, 13 nt, Human
ccccgucucaggu

SEQ ID NO: 3239795 - RNA, 13 nt, Human
ccccccacuccca

SEQ ID NO: 3239796 - RNA, 12 nt, Human
ccccccagcuuc

SEQ ID NO: 3239797 - RNA, 16 nt, Human
cccccaucucuucugg

SEQ ID NO: 3239798 - RNA, 11 nt, Human
cccccaggucu

SEQ ID NO: 3239799 - RNA, 12 nt, Human
cccccagcccca

SEQ ID NO: 3239800 - RNA, 19 nt, Human
cccccagcuucacuucuga

SEQ ID NO: 3239801 - RNA, 18 nt, Human
cccccagcuuccagcagg

SEQ ID NO: 3239802 - RNA, 14 nt, Human
cccccagcuuccag

SEQ ID NO: 3239803 - RNA, 12 nt, Human
ccccacugguga

SEQ ID NO: 3239804 - RNA, 13 nt, Human
ccccacuggugac

SEQ ID NO: 3239805 - RNA, 18 nt, Human
ccccagcccuuccucugc

SEQ ID NO: 3239806 - RNA, 19 nt, Human
ccccagcccuccuuaucaa

SEQ ID NO: 3239807 - RNA, 20 nt, Human
ccccagcgcugacgugucag

SEQ ID NO: 3239808 - RNA, 19 nt, Human
ccccagcgagagucccugc

SEQ ID NO: 3239809 - RNA, 20 nt, Human
ccccagcccuuccucugcuc

SEQ ID NO: 3239810 - RNA, 22 nt, Human
ccccagccucaaauccaggacc

SEQ ID NO: 3239811 - RNA, 13 nt, Human
ccccaggaggcca

SEQ ID NO: 3239812 - RNA, 15 nt, Human
ccccagcuugggcag

SEQ ID NO: 3239813 - RNA, 21 nt, Human
ccccagcuucucagcucgcug

SEQ ID NO: 3239814 - RNA, 21 nt, Human
ccccagcuuccagcaggaggg

SEQ ID NO: 3239815 - RNA, 19 nt, Human
ccccagcuuccagcaggag

SEQ ID NO: 3239816 - RNA, 18 nt, Human
ccccagcuuccagcagga

SEQ ID NO: 3239817 - RNA, 10 nt, Human
ccccagcucc

SEQ ID NO: 3239818 - RNA, 11 nt, Human
ccccagcuccc

SEQ ID NO: 3239819 - RNA, 17 nt, Human
ccccagcuuccagcagg

SEQ ID NO: 3239820 - RNA, 16 nt, Human
ccccagcuuccagcag

SEQ ID NO: 3239821 - RNA, 14 nt, Human
ccccagcuuccagc

SEQ ID NO: 3239822 - RNA, 18 nt, Human
ccccagcuucacuucuga

SEQ ID NO: 3239823 - RNA, 14 nt, Human
ccccaggaggccag

SEQ ID NO: 3239824 - RNA, 15 nt, Human
ccccaggaggccagc

SEQ ID NO: 3239825 - RNA, 21 nt, Human
ccccaggaggccagccuugac

SEQ ID NO: 3239826 - RNA, 22 nt, Human
ccccaggaggccagccuugacc

SEQ ID NO: 3239827 - RNA, 23 nt, Human
cccccaaccaaguggcucccaca

SEQ ID NO: 3239828 - RNA, 16 nt, Human
ccccucagggucccug

SEQ ID NO: 3239829 - RNA, 13 nt, Human
ccccucccaggga

SEQ ID NO: 3239830 - RNA, 18 nt, Human
ccccucccccagccacuc

SEQ ID NO: 3239831 - RNA, 17 nt, Human
ccccucccccagccacu

SEQ ID NO: 3239832 - RNA, 19 nt, Human
cccugguggcagugggagc

SEQ ID NO: 3239833 - RNA, 16 nt, Human
cccugguggcaguggg

SEQ ID NO: 3239834 - RNA, 15 nt, Human
cccugguggcagugg

SEQ ID NO: 3239835 - RNA, 21 nt, Human
cccugguuuccugcccuggga

SEQ ID NO: 3239836 - RNA, 19 nt, Human
ccccuaaagccucaaaaca

SEQ ID NO: 3239837 - RNA, 15 nt, Human
ccccgucugccuggc

SEQ ID NO: 3239838 - RNA, 18 nt, Human
ccccucagggucccuggu

SEQ ID NO: 3239839 - RNA, 20 nt, Human
ccccucagggucccuggugg

SEQ ID NO: 3239840 - RNA, 17 nt, Human
ccccucagggucccugg

SEQ ID NO: 3239841 - RNA, 16 nt, Human
cccugugggcccccaa

SEQ ID NO: 3239842 - RNA, 15 nt, Human
cccugugggccccca

SEQ ID NO: 3239843 - RNA, 22 nt, Human
cccugguuuccugcccugggag

SEQ ID NO: 3239844 - RNA, 23 nt, Human
cccugguuuccugcccugggagg

SEQ ID NO: 3239845 - RNA, 15 nt, Human
cccuguuuguuucug

SEQ ID NO: 3239846 - RNA, 16 nt, Human
cccuguuucagaggcu

SEQ ID NO: 3239847 - RNA, 19 nt, Human
cccuguuucagaggcucag

SEQ ID NO: 3239848 - RNA, 18 nt, Human
cccugugggcccccaaau

SEQ ID NO: 3239849 - RNA, 13 nt, Human
cccugugugaaug

SEQ ID NO: 3239850 - RNA, 13 nt, Human
cccuguguuaauu

SEQ ID NO: 3239851 - RNA, 22 nt, Human
ccgggaggcagagguugcagug

SEQ ID NO: 3239852 - RNA, 13 nt, Human
ccggcuggccugg

SEQ ID NO: 3239853 - RNA, 15 nt, Human
ccgggcacucagaag

SEQ ID NO: 3239854 - RNA, 12 nt, Human
ccggcuggccug

SEQ ID NO: 3239855 - RNA, 12 nt, Human
ccggcugcccuu

SEQ ID NO: 3239856 - RNA, 23 nt, Human
ccgcuuucuacccagcgagcccu

SEQ ID NO: 3239857 - RNA, 14 nt, Human
ccgcuggggccagu

SEQ ID NO: 3239858 - RNA, 23 nt, Human
ccguuugauuugucacugcuuca

SEQ ID NO: 3239859 - RNA, 21 nt, Human
ccguuugauuugucacugcuu

SEQ ID NO: 3239860 - RNA, 13 nt, Human
ccuaaaaauuggu

SEQ ID NO: 3239861 - RNA, 15 nt, Human
ccuaaaaauaaagca

SEQ ID NO: 3239862 - RNA, 14 nt, Human
ccuaaaaauaaagc

SEQ ID NO: 3239863 - RNA, 12 nt, Human
ccuaaaaauaaa

SEQ ID NO: 3239864 - RNA, 11 nt, Human
ccuaaaaauaa

SEQ ID NO: 3239865 - RNA, 23 nt, Human
ccguggcuucccgcucagcccuc

SEQ ID NO: 3239866 - RNA, 21 nt, Human
ccguggcuucccgcucagccc

SEQ ID NO: 3239867 - RNA, 15 nt, Human
ccguggcuucccgcu

SEQ ID NO: 3239868 - RNA, 17 nt, Human
ccgugccuucagcucua

SEQ ID NO: 3239869 - RNA, 16 nt, Human
ccgugccuucagcucu

SEQ ID NO: 3239870 - RNA, 15 nt, Human
ccgugccuucagcuc

SEQ ID NO: 3239871 - RNA, 14 nt, Human
ccgugccuucagcu

SEQ ID NO: 3239872 - RNA, 17 nt, Human
ccgggcaaacuggccgc

SEQ ID NO: 3239873 - RNA, 16 nt, Human
ccgggaugggagccgg

SEQ ID NO: 3239874 - RNA, 19 nt, Human
ccgggccuggagaacuaga

SEQ ID NO: 3239875 - RNA, 19 nt, Human
ccuaaagccucaaaacaaa

SEQ ID NO: 3239876 - RNA, 13 nt, Human
ccuaaagccucaa

SEQ ID NO: 3239877 - RNA, 16 nt, Human
ccuaaagauuuugauc

SEQ ID NO: 3239878 - RNA, 13 nt, Human
ccuaauuccacag

SEQ ID NO: 3239879 - RNA, 12 nt, Human
ccuaaagagaua

SEQ ID NO: 3239880 - RNA, 15 nt, Human
ccuaaagauuuugau

SEQ ID NO: 3239881 - RNA, 14 nt, Human
ccuaauuccacagc

SEQ ID NO: 3239882 - RNA, 15 nt, Human
ccuaauuccacagcu

SEQ ID NO: 3239883 - RNA, 16 nt, Human
ccuaauuccacagcug

SEQ ID NO: 3239884 - RNA, 17 nt, Human
ccuaauuccacagcugc

SEQ ID NO: 3239885 - RNA, 17 nt, Human
ccuaauucuaugccugu

SEQ ID NO: 3239886 - RNA, 12 nt, Human
ccuaccugguaa

SEQ ID NO: 3239887 - RNA, 14 nt, Human
ccuaccccugacuu

SEQ ID NO: 3239888 - RNA, 21 nt, Human
ccuagagagugugauguucac

SEQ ID NO: 3239889 - RNA, 19 nt, Human
ccuaucaaaaagauaucaa

SEQ ID NO: 3239890 - RNA, 16 nt, Human
ccuaucaaaaagauau

SEQ ID NO: 3239891 - RNA, 14 nt, Human
ccuauauuuuccug

SEQ ID NO: 3239892 - RNA, 17 nt, Human
ccuaucagaaguuucuc

SEQ ID NO: 3239893 - RNA, 14 nt, Human
ccuaucauguuaac

SEQ ID NO: 3239894 - RNA, 17 nt, Human
ccucacaguccuuacca

SEQ ID NO: 3239895 - RNA, 12 nt, Human
ccucaauuucaa

SEQ ID NO: 3239896 - RNA, 23 nt, Human
ccucaagugauucuccugccuca

SEQ ID NO: 3239897 - RNA, 19 nt, Human
ccuauguagacaauauaag

SEQ ID NO: 3239898 - RNA, 12 nt, Human
ccucaccccacu

SEQ ID NO: 3239899 - RNA, 20 nt, Human
ccucacaguccuuaccagca

SEQ ID NO: 3239900 - RNA, 22 nt, Human
ccucacaguccuuaccagcaga

SEQ ID NO: 3239901 - RNA, 15 nt, Human
ccucaccccacugug

SEQ ID NO: 3239902 - RNA, 17 nt, Human
ccucaccuuucccaucu

SEQ ID NO: 3239903 - RNA, 16 nt, Human
ccucacgugcaaagcc

SEQ ID NO: 3239904 - RNA, 14 nt, Human
ccucucacugccuc

SEQ ID NO: 3239905 - RNA, 12 nt, Human
ccucucacugcc

SEQ ID NO: 3239906 - RNA, 23 nt, Human
ccuccugugugugcgccuacagg

SEQ ID NO: 3239907 - RNA, 18 nt, Human
ccuccuuaucaaaggaca

SEQ ID NO: 3239908 - RNA, 20 nt, Human
ccuccuuaucaaaggacacc

SEQ ID NO: 3239909 - RNA, 12 nt, Human
ccucucccauca

SEQ ID NO: 3239910 - RNA, 16 nt, Human
ccucuccacugccuuc

SEQ ID NO: 3239911 - RNA, 14 nt, Human
ccucuccacugccu

SEQ ID NO: 3239912 - RNA, 13 nt, Human
ccucuccacugcc

SEQ ID NO: 3239913 - RNA, 12 nt, Human
ccucuccacugc

SEQ ID NO: 3239914 - RNA, 13 nt, Human
ccucucugcccua

SEQ ID NO: 3239915 - RNA, 18 nt, Human
ccucuccccgcaguguuu

SEQ ID NO: 3239916 - RNA, 23 nt, Human
ccucugaaaaccaauguucucuc

SEQ ID NO: 3239917 - RNA, 15 nt, Human
ccucugacacacagc

SEQ ID NO: 3239918 - RNA, 16 nt, Human
ccucugacacacagcu

SEQ ID NO: 3239919 - RNA, 22 nt, Human
ccucugcacuccccugcugggu

SEQ ID NO: 3239920 - RNA, 16 nt, Human
ccucugcauaaauauu

SEQ ID NO: 3239921 - RNA, 14 nt, Human
ccucugcacucccc

SEQ ID NO: 3239922 - RNA, 19 nt, Human
ccucugcacuccccugcug

SEQ ID NO: 3239923 - RNA, 20 nt, Human
ccucugcacuccccugcugg

SEQ ID NO: 3239924 - RNA, 21 nt, Human
ccucugcacuccccugcuggg

SEQ ID NO: 3239925 - RNA, 20 nt, Human
ccucugcacaagcugcaccc

SEQ ID NO: 3239926 - RNA, 17 nt, Human
ccucugcacaagcugca

SEQ ID NO: 3239927 - RNA, 19 nt, Human
ccucugcacaagcugcacc

SEQ ID NO: 3239928 - RNA, 11 nt, Human
ccucugcacaa

SEQ ID NO: 3239929 - RNA, 15 nt, Human
ccucugcacaagcug

SEQ ID NO: 3239930 - RNA, 17 nt, Human
ccucugacacacagcuc

SEQ ID NO: 3239931 - RNA, 15 nt, Human
ccucugcuuuuaucu

SEQ ID NO: 3239932 - RNA, 12 nt, Human
ccucugggacug

SEQ ID NO: 3239933 - RNA, 11 nt, Human
ccucugggccc

SEQ ID NO: 3239934 - RNA, 16 nt, Human
ccucuggcuccagcug

SEQ ID NO: 3239935 - RNA, 17 nt, Human
ccucuggcuccagcugg

SEQ ID NO: 3239936 - RNA, 16 nt, Human
ccucuggcucuacaca

SEQ ID NO: 3239937 - RNA, 13 nt, Human
ccuccuggacucc

SEQ ID NO: 3239938 - RNA, 13 nt, Human
ccuccugggcuaa

SEQ ID NO: 3239939 - RNA, 22 nt, Human
ccuccugugugugcgccuacag

SEQ ID NO: 3239940 - RNA, 15 nt, Human
ccuccugugugugcg

SEQ ID NO: 3239941 - RNA, 13 nt, Human
ccuccugugugug

SEQ ID NO: 3239942 - RNA, 18 nt, Human
ccuccuguggccugccag

SEQ ID NO: 3239943 - RNA, 14 nt, Human
ccuccuccuggacu

SEQ ID NO: 3239944 - RNA, 22 nt, Human
ccuccugaguugaagucaugcu

SEQ ID NO: 3239945 - RNA, 13 nt, Human
ccucccggugccc

SEQ ID NO: 3239946 - RNA, 15 nt, Human
ccucccggcccugcc

SEQ ID NO: 3239947 - RNA, 17 nt, Human
ccucccggcccugccug

SEQ ID NO: 3239948 - RNA, 22 nt, Human
ccucccggcccugccugcuggu

SEQ ID NO: 3239949 - RNA, 18 nt, Human
ccucccggcccugccugc

SEQ ID NO: 3239950 - RNA, 15 nt, Human
ccucccucccucuuu

SEQ ID NO: 3239951 - RNA, 13 nt, Human
ccucccucccucu

SEQ ID NO: 3239952 - RNA, 16 nt, Human
ccucccggugcccaag

SEQ ID NO: 3239953 - RNA, 16 nt, Human
ccucccucccucuuuc

SEQ ID NO: 3239954 - RNA, 15 nt, Human
ccuccucccacugcc

SEQ ID NO: 3239955 - RNA, 14 nt, Human
ccuccucccacugc

SEQ ID NO: 3239956 - RNA, 13 nt, Human
ccucccugccagu

SEQ ID NO: 3239957 - RNA, 22 nt, Human
ccuccucccacugcccacuggc

SEQ ID NO: 3239958 - RNA, 19 nt, Human
ccuccucccucccagcucc

SEQ ID NO: 3239959 - RNA, 21 nt, Human
ccucacuaggcuucugguuga

SEQ ID NO: 3239960 - RNA, 21 nt, Human
ccucacuaucccggcugcccu

SEQ ID NO: 3239961 - RNA, 16 nt, Human
ccucagaaaaugagua

SEQ ID NO: 3239962 - RNA, 14 nt, Human
ccucagcauccugg

SEQ ID NO: 3239963 - RNA, 17 nt, Human
ccucagcauccuggcac

SEQ ID NO: 3239964 - RNA, 16 nt, Human
ccucagcauccuggca

SEQ ID NO: 3239965 - RNA, 14 nt, Human
ccucaggccugggg

SEQ ID NO: 3239966 - RNA, 21 nt, Human
ccucaggccugggggcugggc

SEQ ID NO: 3239967 - RNA, 10 nt, Human
ccucaggccu

SEQ ID NO: 3239968 - RNA, 11 nt, Human
ccucaggccug

SEQ ID NO: 3239969 - RNA, 14 nt, Human
ccucagggucccug

SEQ ID NO: 3239970 - RNA, 14 nt, Human
ccucagucucccuc

SEQ ID NO: 3239971 - RNA, 15 nt, Human
ccucagucuggcccu

SEQ ID NO: 3239972 - RNA, 19 nt, Human
ccucaggugauccacccac

SEQ ID NO: 3239973 - RNA, 17 nt, Human
ccucaggugauccaccc

SEQ ID NO: 3239974 - RNA, 22 nt, Human
ccucaggugagaagcagaggaa

SEQ ID NO: 3239975 - RNA, 22 nt, Human
ccucaggugauccacccaccuc

SEQ ID NO: 3239976 - RNA, 22 nt, Human
ccucagggucccugguggcagc

SEQ ID NO: 3239977 - RNA, 21 nt, Human
ccucagguaaucgaccugccu

SEQ ID NO: 3239978 - RNA, 16 nt, Human
ccucaggugagaagca

SEQ ID NO: 3239979 - RNA, 22 nt, Human
ccucagguaaucgaccugccuc

SEQ ID NO: 3239980 - RNA, 23 nt, Human
ccucagguaaucgaccugccucg

SEQ ID NO: 3239981 - RNA, 15 nt, Human
ccugaggcagguccc

SEQ ID NO: 3239982 - RNA, 13 nt, Human
ccugacaaauuuu

SEQ ID NO: 3239983 - RNA, 18 nt, Human
ccugaggcagguccccag

SEQ ID NO: 3239984 - RNA, 12 nt, Human
ccugaggcccag

SEQ ID NO: 3239985 - RNA, 13 nt, Human
ccugaggcccaga

SEQ ID NO: 3239986 - RNA, 14 nt, Human
ccugaggcccagag

SEQ ID NO: 3239987 - RNA, 12 nt, Human
ccugacaacacu

SEQ ID NO: 3239988 - RNA, 14 nt, Human
ccugacaacacuca

SEQ ID NO: 3239989 - RNA, 15 nt, Human
ccugacaacacucau

SEQ ID NO: 3239990 - RNA, 16 nt, Human
ccugacaacacucauu

SEQ ID NO: 3239991 - RNA, 19 nt, Human
ccugaggcagguccccaga

SEQ ID NO: 3239992 - RNA, 17 nt, Human
ccugaggcuccacuugg

SEQ ID NO: 3239993 - RNA, 23 nt, Human
ccugaggcccuucucuccagccc

SEQ ID NO: 3239994 - RNA, 21 nt, Human
ccugaggcccuucucuccagc

SEQ ID NO: 3239995 - RNA, 22 nt, Human
ccugaggcccuucucuccagcc

SEQ ID NO: 3239996 - RNA, 16 nt, Human
ccugaggcccuucucu

SEQ ID NO: 3239997 - RNA, 17 nt, Human
ccugaggcccuucucuc

SEQ ID NO: 3239998 - RNA, 19 nt, Human
ccugaggcccuucucucca

SEQ ID NO: 3239999 - RNA, 20 nt, Human
ccugaggcccuucucuccag

SEQ ID NO: 3240000 - RNA, 18 nt, Human
ccugaggcuccacuuggu

SEQ ID NO: 3240001 - RNA, 20 nt, Human
ccugaggcuccacuuggucu

SEQ ID NO: 3240002 - RNA, 14 nt, Human
ccugaggcccuucu

SEQ ID NO: 3240003 - RNA, 14 nt, Human
ccugaugcuucuuc

SEQ ID NO: 3240004 - RNA, 19 nt, Human
ccugauugugucucuuggu

SEQ ID NO: 3240005 - RNA, 23 nt, Human
ccugauugugucucuugguccug

SEQ ID NO: 3240006 - RNA, 17 nt, Human
ccugaugcuucuucaga

SEQ ID NO: 3240007 - RNA, 18 nt, Human
ccugaugcuucuucagag

SEQ ID NO: 3240008 - RNA, 22 nt, Human
ccugaugcuucuucagagacuc

SEQ ID NO: 3240009 - RNA, 17 nt, Human
ccugaacaacgagccuu

SEQ ID NO: 3240010 - RNA, 23 nt, Human
ccugaaccacaggagaggauggc

SEQ ID NO: 3240011 - RNA, 17 nt, Human
ccugaagucacacagug

SEQ ID NO: 3240012 - RNA, 16 nt, Human
ccugaagucacacagu

SEQ ID NO: 3240013 - RNA, 13 nt, Human
ccugaaggccccg

SEQ ID NO: 3240014 - RNA, 15 nt, Human
ccugaagucacacag

SEQ ID NO: 3240015 - RNA, 19 nt, Human
ccugaauccaaaagaaaaa

SEQ ID NO: 3240016 - RNA, 18 nt, Human
ccugaaagaggaaugaag

SEQ ID NO: 3240017 - RNA, 13 nt, Human
ccugaaagaggaa

SEQ ID NO: 3240018 - RNA, 24 nt, Human
ccucuuuugcuugccaaaguacag

SEQ ID NO: 3240019 - RNA, 12 nt, Human
ccucuuuugugc

SEQ ID NO: 3240020 - RNA, 18 nt, Human
ccucuuuuguuguuucuu

SEQ ID NO: 3240021 - RNA, 23 nt, Human
ccugaaagaggaaugaaguacuc

SEQ ID NO: 3240022 - RNA, 22 nt, Human
ccucuuuggucuacacugugcu

SEQ ID NO: 3240023 - RNA, 19 nt, Human
ccucuuuggucuacacugu

SEQ ID NO: 3240024 - RNA, 19 nt, Human
ccucuuccucccucauucc

SEQ ID NO: 3240025 - RNA, 16 nt, Human
ccucuuccuccugaca

SEQ ID NO: 3240026 - RNA, 13 nt, Human
ccucuuccuccug

SEQ ID NO: 3240027 - RNA, 10 nt, Human
ccucuuccuc

SEQ ID NO: 3240028 - RNA, 16 nt, Human
ccucuuccucccucau

SEQ ID NO: 3240029 - RNA, 15 nt, Human
ccucuuccucccuca

SEQ ID NO: 3240030 - RNA, 17 nt, Human
ccucuuaugggcugggu

SEQ ID NO: 3240031 - RNA, 21 nt, Human
ccucuuagaagaauauuguau

SEQ ID NO: 3240032 - RNA, 23 nt, Human
ccucuuagaagaauauuguauug

SEQ ID NO: 3240033 - RNA, 21 nt, Human
ccucuucccugguaagaaaaa

SEQ ID NO: 3240034 - RNA, 17 nt, Human
ccucuguccaggcacug

SEQ ID NO: 3240035 - RNA, 14 nt, Human
ccucuguacagagc

SEQ ID NO: 3240036 - RNA, 15 nt, Human
ccucuguacagagcc

SEQ ID NO: 3240037 - RNA, 16 nt, Human
ccucuguacagagccc

SEQ ID NO: 3240038 - RNA, 17 nt, Human
ccucuguacagagccca

SEQ ID NO: 3240039 - RNA, 18 nt, Human
ccucuguacagagcccac

SEQ ID NO: 3240040 - RNA, 23 nt, Human
ccucuguacagagcccacgcccc

SEQ ID NO: 3240041 - RNA, 14 nt, Human
ccucuuaugggcug

SEQ ID NO: 3240042 - RNA, 15 nt, Human
ccucuuaugggcugg

SEQ ID NO: 3240043 - RNA, 16 nt, Human
ccucuuaugggcuggg

SEQ ID NO: 3240044 - RNA, 14 nt, Human
ccucuuagaaaaac

SEQ ID NO: 3240045 - RNA, 21 nt, Human
ccucuguucugcacacagcac

SEQ ID NO: 3240046 - RNA, 23 nt, Human
ccuuugacgccaucccagcccca

SEQ ID NO: 3240047 - RNA, 17 nt, Human
ccuuucuuuucuuucuu

SEQ ID NO: 3240048 - RNA, 17 nt, Human
ccuuucuucucccccau

SEQ ID NO: 3240049 - RNA, 12 nt, Human
ccuuucuucucc

SEQ ID NO: 3240050 - RNA, 19 nt, Human
ccuuucuuccucauucccu

SEQ ID NO: 3240051 - RNA, 15 nt, Human
ccuuucuuccucauu

SEQ ID NO: 3240052 - RNA, 13 nt, Human
ccuuucuuccuca

SEQ ID NO: 3240053 - RNA, 12 nt, Human
ccuuucuuccuc

SEQ ID NO: 3240054 - RNA, 11 nt, Human
ccuuucuuccu

SEQ ID NO: 3240055 - RNA, 12 nt, Human
ccuuucuguguu

SEQ ID NO: 3240056 - RNA, 14 nt, Human
ccuuugcuucccuu

SEQ ID NO: 3240057 - RNA, 21 nt, Human
ccuuugcuucccuuuuuuccu

SEQ ID NO: 3240058 - RNA, 15 nt, Human
ccuuugcagcucaga

SEQ ID NO: 3240059 - RNA, 13 nt, Human
ccuuggcugcagg

SEQ ID NO: 3240060 - RNA, 12 nt, Human
ccuuggcugcag

SEQ ID NO: 3240061 - RNA, 16 nt, Human
ccuuguggucccaccc

SEQ ID NO: 3240062 - RNA, 19 nt, Human
ccuuguggucccaccccac

SEQ ID NO: 3240063 - RNA, 20 nt, Human
ccuuguggucccaccccaca

SEQ ID NO: 3240064 - RNA, 16 nt, Human
ccuuucugaucuucac

SEQ ID NO: 3240065 - RNA, 15 nt, Human
ccuuucugaucuuca

SEQ ID NO: 3240066 - RNA, 13 nt, Human
ccuuuaagagaaa

SEQ ID NO: 3240067 - RNA, 18 nt, Human
ccuuuaaagaaacauggu

SEQ ID NO: 3240068 - RNA, 21 nt, Human
cgauugcaggagucccugcca

SEQ ID NO: 3240069 - RNA, 21 nt, Human
cgauucuucugcuucagccuc

SEQ ID NO: 3240070 - RNA, 19 nt, Human
cgauucuucugcuucagcc

SEQ ID NO: 3240071 - RNA, 13 nt, Human
cgauucuucugcu

SEQ ID NO: 3240072 - RNA, 19 nt, Human
cgaucuggguucacugcaa

SEQ ID NO: 3240073 - RNA, 15 nt, Human
cgauccuucaaaguc

SEQ ID NO: 3240074 - RNA, 14 nt, Human
cgauccuccccugg

SEQ ID NO: 3240075 - RNA, 23 nt, Human
cgauugcaggagucccugccauc

SEQ ID NO: 3240076 - RNA, 22 nt, Human
cgcaagcaccauccccuccggc

SEQ ID NO: 3240077 - RNA, 18 nt, Human
cgcaagggaggcccagcg

SEQ ID NO: 3240078 - RNA, 11 nt, Human
cgcaaugugac

SEQ ID NO: 3240079 - RNA, 23 nt, Human
cgcacuucgggaggucgaggcag

SEQ ID NO: 3240080 - RNA, 12 nt, Human
cgaggacaggga

SEQ ID NO: 3240081 - RNA, 13 nt, Human
cgaggacagggag

SEQ ID NO: 3240082 - RNA, 19 nt, Human
cgaggccuucucugaagga

SEQ ID NO: 3240083 - RNA, 18 nt, Human
cgaggccuucucugaagg

SEQ ID NO: 3240084 - RNA, 23 nt, Human
ccuuuguaaauugucagaugcug

SEQ ID NO: 3240085 - RNA, 12 nt, Human
ccuuuguaacca

SEQ ID NO: 3240086 - RNA, 24 nt, Human
cgagcugggaccaguaccuggguc

SEQ ID NO: 3240087 - RNA, 16 nt, Human
cgcgacaaugcaaacc

SEQ ID NO: 3240088 - RNA, 17 nt, Human
cgcgacaaugcaaacca

SEQ ID NO: 3240089 - RNA, 15 nt, Human
cgcgacaaugcaaac

SEQ ID NO: 3240090 - RNA, 15 nt, Human
cgcccccacugguga

SEQ ID NO: 3240091 - RNA, 19 nt, Human
cgcccaggcuggagugcaa

SEQ ID NO: 3240092 - RNA, 20 nt, Human
cgcccaggcuggagugcaau

SEQ ID NO: 3240093 - RNA, 12 nt, Human
cgcccaggcugg

SEQ ID NO: 3240094 - RNA, 13 nt, Human
cgcagacaggacc

SEQ ID NO: 3240095 - RNA, 14 nt, Human
cgcagacaggacca

SEQ ID NO: 3240096 - RNA, 16 nt, Human
cgcuagcacagcuccc

SEQ ID NO: 3240097 - RNA, 15 nt, Human
cgcuagcacagcucc

SEQ ID NO: 3240098 - RNA, 20 nt, Human
cgcuacuaugauuuaauuug

SEQ ID NO: 3240099 - RNA, 22 nt, Human
cgcuaacuugcuuaaaugugaa

SEQ ID NO: 3240100 - RNA, 14 nt, Human
cgcuaagagggagg

SEQ ID NO: 3240101 - RNA, 15 nt, Human
cgcuaagagggaggg

SEQ ID NO: 3240102 - RNA, 16 nt, Human
cgcuaagagggaggga

SEQ ID NO: 3240103 - RNA, 20 nt, Human
cgcgugcacacaccagagcc

SEQ ID NO: 3240104 - RNA, 19 nt, Human
cgcgugcacacaccagagc

SEQ ID NO: 3240105 - RNA, 16 nt, Human
cgcgugcacacaccag

SEQ ID NO: 3240106 - RNA, 20 nt, Human
cgggaggauguucugggaca

SEQ ID NO: 3240107 - RNA, 22 nt, Human
cgggagccugaucaccugcccu

SEQ ID NO: 3240108 - RNA, 21 nt, Human
cgggagccugaucaccugccc

SEQ ID NO: 3240109 - RNA, 14 nt, Human
cggccuuucccacu

SEQ ID NO: 3240110 - RNA, 13 nt, Human
cggccuuucccac

SEQ ID NO: 3240111 - RNA, 12 nt, Human
cgggcaugacac

SEQ ID NO: 3240112 - RNA, 15 nt, Human
cgggcaucauucucu

SEQ ID NO: 3240113 - RNA, 15 nt, Human
cgggcaugacacgaa

SEQ ID NO: 3240114 - RNA, 16 nt, Human
cgggcauggcagcccu

SEQ ID NO: 3240115 - RNA, 17 nt, Human
cgggaggucgaggcagg

SEQ ID NO: 3240116 - RNA, 16 nt, Human
cgggaggucgaggcag

SEQ ID NO: 3240117 - RNA, 14 nt, Human
cggccuccauccug

SEQ ID NO: 3240118 - RNA, 16 nt, Human
cggccuccauccugag

SEQ ID NO: 3240119 - RNA, 17 nt, Human
cggccuccauccugagg

SEQ ID NO: 3240120 - RNA, 19 nt, Human
cggccccagcuucucagcu

SEQ ID NO: 3240121 - RNA, 14 nt, Human
cggccccagcuucu

SEQ ID NO: 3240122 - RNA, 15 nt, Human
cggcuggccuggccc

SEQ ID NO: 3240123 - RNA, 16 nt, Human
cggcuggccuggcccc

SEQ ID NO: 3240124 - RNA, 14 nt, Human
cggcuggccuggcc

SEQ ID NO: 3240125 - RNA, 18 nt, Human
cggcuggccuggccccuc

SEQ ID NO: 3240126 - RNA, 17 nt, Human
cgcuauugucaccaggg

SEQ ID NO: 3240127 - RNA, 20 nt, Human
cgcuagguagagucugaggg

SEQ ID NO: 3240128 - RNA, 21 nt, Human
cgcuagguagagucugagggc

SEQ ID NO: 3240129 - RNA, 20 nt, Human
cgcuauaguuacuguccugu

SEQ ID NO: 3240130 - RNA, 22 nt, Human
cgcucgaaguugaucuccccag

SEQ ID NO: 3240131 - RNA, 13 nt, Human
cgcuccugugucu

SEQ ID NO: 3240132 - RNA, 20 nt, Human
cggaaugaaccacaucuugc

SEQ ID NO: 3240133 - RNA, 12 nt, Human
cggacaaaauau

SEQ ID NO: 3240134 - RNA, 13 nt, Human
cggacaaaauauc

SEQ ID NO: 3240135 - RNA, 18 nt, Human
cggaaccugugagcugca

SEQ ID NO: 3240136 - RNA, 19 nt, Human
cggaaccugugagcugcac

SEQ ID NO: 3240137 - RNA, 18 nt, Human
cggacagccacggccagg

SEQ ID NO: 3240138 - RNA, 16 nt, Human
cggacagccacggcca

SEQ ID NO: 3240139 - RNA, 15 nt, Human
cggacagccacggcc

SEQ ID NO: 3240140 - RNA, 21 nt, Human
cggauccugcacugacucugg

SEQ ID NO: 3240141 - RNA, 22 nt, Human
cggauccugcacugacucugga

SEQ ID NO: 3240142 - RNA, 22 nt, Human
cggcaauaaaagcccaggagcc

SEQ ID NO: 3240143 - RNA, 20 nt, Human
cggcaauaaaagcccaggag

SEQ ID NO: 3240144 - RNA, 19 nt, Human
cggcaauaaaagcccagga

SEQ ID NO: 3240145 - RNA, 18 nt, Human
cggcaauaaaagcccagg

SEQ ID NO: 3240146 - RNA, 17 nt, Human
cggcaauaaaagcccag

SEQ ID NO: 3240147 - RNA, 16 nt, Human
cggcaauaaaagccca

SEQ ID NO: 3240148 - RNA, 13 nt, Human
cggcacagccugg

SEQ ID NO: 3240149 - RNA, 13 nt, Human
cggcaaaaggaaa

SEQ ID NO: 3240150 - RNA, 15 nt, Human
cggauugcaaagcaa

SEQ ID NO: 3240151 - RNA, 15 nt, Human
cguagugcagcaggg

SEQ ID NO: 3240152 - RNA, 18 nt, Human
cguagucggcacagccug

SEQ ID NO: 3240153 - RNA, 21 nt, Human
cguagucggcacagccugguc

SEQ ID NO: 3240154 - RNA, 19 nt, Human
cguagucggcacagccugg

SEQ ID NO: 3240155 - RNA, 13 nt, Human
cguagcuugucug

SEQ ID NO: 3240156 - RNA, 23 nt, Human
cggugcuaucucccccagcccca

SEQ ID NO: 3240157 - RNA, 14 nt, Human
cggggccagcuccg

SEQ ID NO: 3240158 - RNA, 22 nt, Human
cguccacgugcguguuuucuga

SEQ ID NO: 3240159 - RNA, 14 nt, Human
cgucccccucuggc

SEQ ID NO: 3240160 - RNA, 21 nt, Human
cgucccccucuggcuccagcu

SEQ ID NO: 3240161 - RNA, 15 nt, Human
cguauguuauacaac

SEQ ID NO: 3240162 - RNA, 15 nt, Human
cguauggcuuuauuu

SEQ ID NO: 3240163 - RNA, 20 nt, Human
cguaugcaguguagauuuua

SEQ ID NO: 3240164 - RNA, 22 nt, Human
cguauaugucucaggucccugc

SEQ ID NO: 3240165 - RNA, 14 nt, Human
cguauagaagucuu

SEQ ID NO: 3240166 - RNA, 16 nt, Human
cguauagaagucuuca

SEQ ID NO: 3240167 - RNA, 16 nt, Human
cgucacuaccuggcug

SEQ ID NO: 3240168 - RNA, 17 nt, Human
cgucacuuuauuucauu

SEQ ID NO: 3240169 - RNA, 17 nt, Human
cgucugcuccugcgagg

SEQ ID NO: 3240170 - RNA, 14 nt, Human
cgucugacaggcaa

SEQ ID NO: 3240171 - RNA, 13 nt, Human
cgucugacaggca

SEQ ID NO: 3240172 - RNA, 14 nt, Human
cgucuacagcuccc

SEQ ID NO: 3240173 - RNA, 13 nt, Human
cgucuacagcucc

SEQ ID NO: 3240174 - RNA, 17 nt, Human
cgucuacagcuccccca

SEQ ID NO: 3240175 - RNA, 19 nt, Human
cgucuacauuucacauuau

SEQ ID NO: 3240176 - RNA, 14 nt, Human
cgucuaccugaggg

SEQ ID NO: 3240177 - RNA, 21 nt, Human
cgucuaaccacagcuccuuuu

SEQ ID NO: 3240178 - RNA, 19 nt, Human
cgucuaaccacagcuccuu

SEQ ID NO: 3240179 - RNA, 18 nt, Human
cgucuaaccacagcuccu

SEQ ID NO: 3240180 - RNA, 17 nt, Human
cgucuaaccacagcucc

SEQ ID NO: 3240181 - RNA, 11 nt, Human
cguccccuguc

SEQ ID NO: 3240182 - RNA, 22 nt, Human
cgucccccucuggcuccagcug

SEQ ID NO: 3240183 - RNA, 14 nt, Human
cguccccugucccc

SEQ ID NO: 3240184 - RNA, 10 nt, Human
cguccccucc

SEQ ID NO: 3240185 - RNA, 22 nt, Human
cgugcacacaccagagcccacc

SEQ ID NO: 3240186 - RNA, 22 nt, Human
cgugcaguggugcgaucugggu

SEQ ID NO: 3240187 - RNA, 21 nt, Human
cgugcacacaccagagcccac

SEQ ID NO: 3240188 - RNA, 20 nt, Human
cgugcacacaccagagccca

SEQ ID NO: 3240189 - RNA, 16 nt, Human
cgugaagauacuuugu

SEQ ID NO: 3240190 - RNA, 17 nt, Human
cgugaagauacuuugua

SEQ ID NO: 3240191 - RNA, 18 nt, Human
cgugaagauacuuuguau

SEQ ID NO: 3240192 - RNA, 19 nt, Human
cgugaagauacuuuguauu

SEQ ID NO: 3240193 - RNA, 21 nt, Human
cgugaagauacuuuguauugu

SEQ ID NO: 3240194 - RNA, 22 nt, Human
cgugaagauacuuuguauuguc

SEQ ID NO: 3240195 - RNA, 16 nt, Human
cguuuugcaagguaaa

SEQ ID NO: 3240196 - RNA, 15 nt, Human
cguuuacucacagcc

SEQ ID NO: 3240197 - RNA, 22 nt, Human
cguuccuucaaagcaaaugucu

SEQ ID NO: 3240198 - RNA, 12 nt, Human
cguggcugcuuc

SEQ ID NO: 3240199 - RNA, 14 nt, Human
cguggcugcuucaa

SEQ ID NO: 3240200 - RNA, 15 nt, Human
cguggcugcuucaag

SEQ ID NO: 3240201 - RNA, 18 nt, Human
cgugccuucagcucuaca

SEQ ID NO: 3240202 - RNA, 16 nt, Human
cgugccuucagcucua

SEQ ID NO: 3240203 - RNA, 15 nt, Human
cgugccuucagcucu

SEQ ID NO: 3240204 - RNA, 13 nt, Human
cgugccuucagcu

SEQ ID NO: 3240205 - RNA, 12 nt, Human
cgugccuggcca

SEQ ID NO: 3240206 - RNA, 16 nt, Human
cgugccuggccacgcc

SEQ ID NO: 3240207 - RNA, 15 nt, Human
ccugcuuuuuggaaa

SEQ ID NO: 3240208 - RNA, 20 nt, Human
ccugcuuuuuggaaagucag

SEQ ID NO: 3240209 - RNA, 21 nt, Human
ccuggaaaaaaacaucagaaa

SEQ ID NO: 3240210 - RNA, 15 nt, Human
ccuggaaaccugucu

SEQ ID NO: 3240211 - RNA, 17 nt, Human
ccugcuuugggcugccc

SEQ ID NO: 3240212 - RNA, 18 nt, Human
ccugcuuugggcugcccu

SEQ ID NO: 3240213 - RNA, 15 nt, Human
ccugcuuggcccagg

SEQ ID NO: 3240214 - RNA, 14 nt, Human
ccugcuuggcccag

SEQ ID NO: 3240215 - RNA, 13 nt, Human
ccugcuuggccca

SEQ ID NO: 3240216 - RNA, 17 nt, Human
ccugcuucucugcccag

SEQ ID NO: 3240217 - RNA, 15 nt, Human
ccugcuucucugccc

SEQ ID NO: 3240218 - RNA, 14 nt, Human
ccugcuucucugcc

SEQ ID NO: 3240219 - RNA, 12 nt, Human
ccugcuucucug

SEQ ID NO: 3240220 - RNA, 21 nt, Human
ccugcuggguguggcgcagca

SEQ ID NO: 3240221 - RNA, 13 nt, Human
ccugcugguucag

SEQ ID NO: 3240222 - RNA, 22 nt, Human
ccugcucccuccgggucuuccu

SEQ ID NO: 3240223 - RNA, 19 nt, Human
ccugcugguucaggguugg

SEQ ID NO: 3240224 - RNA, 15 nt, Human
ccugcugucauugcu

SEQ ID NO: 3240225 - RNA, 22 nt, Human
ccugcugucauugcuucuucug

SEQ ID NO: 3240226 - RNA, 20 nt, Human
ccugcugucauugcuucuuc

SEQ ID NO: 3240227 - RNA, 15 nt, Human
ccugcuuccucagag

SEQ ID NO: 3240228 - RNA, 23 nt, Human
ccugcgucucauacucaccucac

SEQ ID NO: 3240229 - RNA, 22 nt, Human
ccugcaaccaaacucccaucag

SEQ ID NO: 3240230 - RNA, 20 nt, Human
ccugcaaccaaacucccauc

SEQ ID NO: 3240231 - RNA, 23 nt, Human
ccugcaaaguacagguacuuugu

SEQ ID NO: 3240232 - RNA, 22 nt, Human
ccugcaaaguacagguacuuug

SEQ ID NO: 3240233 - RNA, 19 nt, Human
ccugcaacaccuuguuucc

SEQ ID NO: 3240234 - RNA, 16 nt, Human
ccugcaaccugauugu

SEQ ID NO: 3240235 - RNA, 18 nt, Human
ccugcaacaccuuguuuc

SEQ ID NO: 3240236 - RNA, 19 nt, Human
ccugcaaagcccagcuuga

SEQ ID NO: 3240237 - RNA, 18 nt, Human
ccugauuuuaauugugaa

SEQ ID NO: 3240238 - RNA, 15 nt, Human
ccugauuucuccugc

SEQ ID NO: 3240239 - RNA, 13 nt, Human
ccugcuccagcug

SEQ ID NO: 3240240 - RNA, 14 nt, Human
ccugcuccagcugu

SEQ ID NO: 3240241 - RNA, 22 nt, Human
ccugcuccagcuguucagcugg

SEQ ID NO: 3240242 - RNA, 12 nt, Human
ccugcuccagcu

SEQ ID NO: 3240243 - RNA, 17 nt, Human
ccugcguguucucagag

SEQ ID NO: 3240244 - RNA, 14 nt, Human
ccuggacuccugca

SEQ ID NO: 3240245 - RNA, 17 nt, Human
ccuggacucccguguag

SEQ ID NO: 3240246 - RNA, 12 nt, Human
ccuggacucccg

SEQ ID NO: 3240247 - RNA, 13 nt, Human
ccuggacccugug

SEQ ID NO: 3240248 - RNA, 14 nt, Human
ccuggacccugugg

SEQ ID NO: 3240249 - RNA, 17 nt, Human
ccuggaccccagccuca

SEQ ID NO: 3240250 - RNA, 16 nt, Human
ccuggaccccagccuc

SEQ ID NO: 3240251 - RNA, 15 nt, Human
ccuggaccccagccu

SEQ ID NO: 3240252 - RNA, 14 nt, Human
ccuggaccccagcc

SEQ ID NO: 3240253 - RNA, 13 nt, Human
ccuggaccccagc

SEQ ID NO: 3240254 - RNA, 12 nt, Human
ccuggaccccag

SEQ ID NO: 3240255 - RNA, 14 nt, Human
ccuggacaggccag

SEQ ID NO: 3240256 - RNA, 20 nt, Human
ccuggcacugcuuccaguga

SEQ ID NO: 3240257 - RNA, 17 nt, Human
ccuggcacugcuuccag

SEQ ID NO: 3240258 - RNA, 21 nt, Human
ccuggcacugcuuccagugag

SEQ ID NO: 3240259 - RNA, 14 nt, Human
ccuggcagccccug

SEQ ID NO: 3240260 - RNA, 16 nt, Human
ccuggcagccccuguu

SEQ ID NO: 3240261 - RNA, 16 nt, Human
ccuggcaugggaauga

SEQ ID NO: 3240262 - RNA, 17 nt, Human
ccuggcaugggaaugaa

SEQ ID NO: 3240263 - RNA, 14 nt, Human
ccuggcaugggaau

SEQ ID NO: 3240264 - RNA, 19 nt, Human
ccuggcagccgugccuuca

SEQ ID NO: 3240265 - RNA, 18 nt, Human
ccuggcagccgugccuuc

SEQ ID NO: 3240266 - RNA, 12 nt, Human
ccuggcagccgu

SEQ ID NO: 3240267 - RNA, 14 nt, Human
ccuggccccucagg

SEQ ID NO: 3240268 - RNA, 18 nt, Human
ccuggcaugggaaugaau

SEQ ID NO: 3240269 - RNA, 22 nt, Human
ccuggcagcccgcaucagcugc

SEQ ID NO: 3240270 - RNA, 21 nt, Human
ccuggcccccacauggugaug

SEQ ID NO: 3240271 - RNA, 15 nt, Human
ccuggcccccacaug

SEQ ID NO: 3240272 - RNA, 13 nt, Human
ccugggaggcagu

SEQ ID NO: 3240273 - RNA, 16 nt, Human
ccugggaucccucauc

SEQ ID NO: 3240274 - RNA, 20 nt, Human
ccugggaucccucauccuca

SEQ ID NO: 3240275 - RNA, 20 nt, Human
ccugggaggucaaggcugca

SEQ ID NO: 3240276 - RNA, 17 nt, Human
ccugggauaggggcaga

SEQ ID NO: 3240277 - RNA, 23 nt, Human
ccugggcacacgcugcucugccc

SEQ ID NO: 3240278 - RNA, 14 nt, Human
ccugggcagaagga

SEQ ID NO: 3240279 - RNA, 23 nt, Human
ccugggauaggggcagaggaggc

SEQ ID NO: 3240280 - RNA, 18 nt, Human
ccugggauaggggcagag

SEQ ID NO: 3240281 - RNA, 12 nt, Human
ccugggcagaag

SEQ ID NO: 3240282 - RNA, 19 nt, Human
ccugggcacacgcugcucu

SEQ ID NO: 3240283 - RNA, 18 nt, Human
ccugggcacacgcugcuc

SEQ ID NO: 3240284 - RNA, 17 nt, Human
ccugggcacacgcugcu

SEQ ID NO: 3240285 - RNA, 15 nt, Human
ccugggcacacgcug

SEQ ID NO: 3240286 - RNA, 20 nt, Human
ccugugaguacuacaguccu

SEQ ID NO: 3240287 - RNA, 16 nt, Human
ccugugagcugcacca

SEQ ID NO: 3240288 - RNA, 14 nt, Human
ccugugagcugcac

SEQ ID NO: 3240289 - RNA, 13 nt, Human
ccugugagcugca

SEQ ID NO: 3240290 - RNA, 18 nt, Human
ccugugacuucagcucug

SEQ ID NO: 3240291 - RNA, 14 nt, Human
ccugugagaugugu

SEQ ID NO: 3240292 - RNA, 23 nt, Human
ccugugagauguguaucaguguu

SEQ ID NO: 3240293 - RNA, 17 nt, Human
ccugucccccugacaac

SEQ ID NO: 3240294 - RNA, 16 nt, Human
ccugucccccugacaa

SEQ ID NO: 3240295 - RNA, 18 nt, Human
ccuguccccgcacugggc

SEQ ID NO: 3240296 - RNA, 22 nt, Human
ccugucaaacauuaguacuuua

SEQ ID NO: 3240297 - RNA, 17 nt, Human
ccugugccucugggacu

SEQ ID NO: 3240298 - RNA, 15 nt, Human
ccugugccucuggga

SEQ ID NO: 3240299 - RNA, 21 nt, Human
ccugugccaggugaaggaggc

SEQ ID NO: 3240300 - RNA, 14 nt, Human
ccugugccagguga

SEQ ID NO: 3240301 - RNA, 12 nt, Human
ccugugccaggu

SEQ ID NO: 3240302 - RNA, 19 nt, Human
ccugugccagcccagaggc

SEQ ID NO: 3240303 - RNA, 17 nt, Human
ccugugccagcccagag

SEQ ID NO: 3240304 - RNA, 15 nt, Human
ccugugccagcccag

SEQ ID NO: 3240305 - RNA, 14 nt, Human
ccugugccagccca

SEQ ID NO: 3240306 - RNA, 20 nt, Human
ccugugauggggcccugccu

SEQ ID NO: 3240307 - RNA, 21 nt, Human
ccugugauggggcccugccuc

SEQ ID NO: 3240308 - RNA, 22 nt, Human
ccugugauggggcccugccucc

SEQ ID NO: 3240309 - RNA, 18 nt, Human
ccugugauggggcccugc

SEQ ID NO: 3240310 - RNA, 19 nt, Human
ccugugauggggcccugcc

SEQ ID NO: 3240311 - RNA, 17 nt, Human
ccugugauggggcccug

SEQ ID NO: 3240312 - RNA, 15 nt, Human
ccuggugcugccaca

SEQ ID NO: 3240313 - RNA, 21 nt, Human
ccuggugcugccacacuucag

SEQ ID NO: 3240314 - RNA, 18 nt, Human
ccuggugcugccacacuu

SEQ ID NO: 3240315 - RNA, 13 nt, Human
ccugguggcagcu

SEQ ID NO: 3240316 - RNA, 12 nt, Human
ccugguggcagc

SEQ ID NO: 3240317 - RNA, 14 nt, Human
ccugguggcagcuc

SEQ ID NO: 3240318 - RNA, 16 nt, Human
ccugguggcagcucac

SEQ ID NO: 3240319 - RNA, 17 nt, Human
ccugguggcagcucacc

SEQ ID NO: 3240320 - RNA, 18 nt, Human
ccugguggcagcucaccu

SEQ ID NO: 3240321 - RNA, 23 nt, Human
ccuguaauuguuguuuguaugua

SEQ ID NO: 3240322 - RNA, 20 nt, Human
ccuguaauccuagcacuuug

SEQ ID NO: 3240323 - RNA, 21 nt, Human
ccuguagagugggagcugagu

SEQ ID NO: 3240324 - RNA, 19 nt, Human
ccuguagagugggagcuga

SEQ ID NO: 3240325 - RNA, 23 nt, Human
ccuguagagugggagcugagugg

SEQ ID NO: 3240326 - RNA, 16 nt, Human
ccugucaaacauuagu

SEQ ID NO: 3240327 - RNA, 14 nt, Human
ccugucaaacauua

SEQ ID NO: 3240328 - RNA, 13 nt, Human
ccugucaaacauu

SEQ ID NO: 3240329 - RNA, 21 nt, Human
ccuugacaaagucaagccaca

SEQ ID NO: 3240330 - RNA, 23 nt, Human
ccuugacaaagucaagccacaug

SEQ ID NO: 3240331 - RNA, 13 nt, Human
ccuugacagggca

SEQ ID NO: 3240332 - RNA, 14 nt, Human
ccuugacacauuac

SEQ ID NO: 3240333 - RNA, 14 nt, Human
ccuugacagggcac

SEQ ID NO: 3240334 - RNA, 19 nt, Human
ccuugaccauucuccaccu

SEQ ID NO: 3240335 - RNA, 20 nt, Human
ccuugaccauucuccaccug

SEQ ID NO: 3240336 - RNA, 17 nt, Human
ccuugacagggcacacc

SEQ ID NO: 3240337 - RNA, 15 nt, Human
ccuugacagggcaca

SEQ ID NO: 3240338 - RNA, 19 nt, Human
ccuuggauuguccccgacc

SEQ ID NO: 3240339 - RNA, 15 nt, Human
ccuugauauuuguau

SEQ ID NO: 3240340 - RNA, 16 nt, Human
ccuugauaauauauug

SEQ ID NO: 3240341 - RNA, 23 nt, Human
ccuugauaauauauuguguugac

SEQ ID NO: 3240342 - RNA, 22 nt, Human
ccuugaugaaauaacacagcag

SEQ ID NO: 3240343 - RNA, 22 nt, Human
ccuugaguugauucagcucugc

SEQ ID NO: 3240344 - RNA, 23 nt, Human
ccuugaguugauucagcucugca

SEQ ID NO: 3240345 - RNA, 21 nt, Human
ccuugaccauucuccaccugc

SEQ ID NO: 3240346 - RNA, 20 nt, Human
ccuugaguugauucagcucu

SEQ ID NO: 3240347 - RNA, 17 nt, Human
ccuugaaugaugccaug

SEQ ID NO: 3240348 - RNA, 16 nt, Human
ccuugaacuggguacu

SEQ ID NO: 3240349 - RNA, 19 nt, Human
ccuugaaaacacuguucuc

SEQ ID NO: 3240350 - RNA, 21 nt, Human
ccuugaaaacacuguucucug

SEQ ID NO: 3240351 - RNA, 22 nt, Human
ccuugaaaacacuguucucugc

SEQ ID NO: 3240352 - RNA, 14 nt, Human
ccuugaacugggua

SEQ ID NO: 3240353 - RNA, 18 nt, Human
ccuucgcuccugugucuu

SEQ ID NO: 3240354 - RNA, 15 nt, Human
ccuucgcuccugugu

SEQ ID NO: 3240355 - RNA, 14 nt, Human
ccuucgcuccugug

SEQ ID NO: 3240356 - RNA, 13 nt, Human
ccuucgcuccugu

SEQ ID NO: 3240357 - RNA, 15 nt, Human
ccuugaaaacacugu

SEQ ID NO: 3240358 - RNA, 16 nt, Human
ccuucuuuuucuucuu

SEQ ID NO: 3240359 - RNA, 14 nt, Human
ccuucuuuuucuuc

SEQ ID NO: 3240360 - RNA, 16 nt, Human
ccuucuuugcccuuua

SEQ ID NO: 3240361 - RNA, 11 nt, Human
ccuuuggcuuc

SEQ ID NO: 3240362 - RNA, 12 nt, Human
ccuucagccuga

SEQ ID NO: 3240363 - RNA, 13 nt, Human
ccuucagugccuu

SEQ ID NO: 3240364 - RNA, 14 nt, Human
ccuucagugccuua

SEQ ID NO: 3240365 - RNA, 12 nt, Human
ccuucagugccu

SEQ ID NO: 3240366 - RNA, 20 nt, Human
ccuucagugccuuauggaac

SEQ ID NO: 3240367 - RNA, 17 nt, Human
ccuucaguuuuuguguu

SEQ ID NO: 3240368 - RNA, 15 nt, Human
ccuucagugccuuau

SEQ ID NO: 3240369 - RNA, 19 nt, Human
ccuucagugccuuauggaa

SEQ ID NO: 3240370 - RNA, 16 nt, Human
ccuuccaccucuggga

SEQ ID NO: 3240371 - RNA, 17 nt, Human
ccuuccaccugcucugc

SEQ ID NO: 3240372 - RNA, 16 nt, Human
ccuuccaccugcucug

SEQ ID NO: 3240373 - RNA, 15 nt, Human
ccuuccaccugcucu

SEQ ID NO: 3240374 - RNA, 17 nt, Human
ccuuccaccucugggag

SEQ ID NO: 3240375 - RNA, 15 nt, Human
ccuuccagggguggg

SEQ ID NO: 3240376 - RNA, 16 nt, Human
ccuuccagggguggga

SEQ ID NO: 3240377 - RNA, 19 nt, Human
ccuuccaccugcucugcug

SEQ ID NO: 3240378 - RNA, 18 nt, Human
ccuuccaccugcucugcu

SEQ ID NO: 3240379 - RNA, 18 nt, Human
ccuuccaggggugggaca

SEQ ID NO: 3240380 - RNA, 23 nt, Human
ccuuccaugucgccucugcauuc

SEQ ID NO: 3240381 - RNA, 21 nt, Human
ccuuccaugucgccucugcau

SEQ ID NO: 3240382 - RNA, 20 nt, Human
ccuuccaugucgccucugca

SEQ ID NO: 3240383 - RNA, 19 nt, Human
ccuuccaugucgccucugc

SEQ ID NO: 3240384 - RNA, 14 nt, Human
ccuuccucuuucca

SEQ ID NO: 3240385 - RNA, 12 nt, Human
ccuuccucugcu

SEQ ID NO: 3240386 - RNA, 14 nt, Human
ccuuccucugaggc

SEQ ID NO: 3240387 - RNA, 17 nt, Human
ccuuccauuucugccuu

SEQ ID NO: 3240388 - RNA, 15 nt, Human
ccuucgauacaccgg

SEQ ID NO: 3240389 - RNA, 13 nt, Human
ccuuccucugcuc

SEQ ID NO: 3240390 - RNA, 13 nt, Human
ccuucgccaccug

SEQ ID NO: 3240391 - RNA, 23 nt, Human
ccuucgauacaccgggccuggag

SEQ ID NO: 3240392 - RNA, 22 nt, Human
ccuucgauacaccgggccugga

SEQ ID NO: 3240393 - RNA, 20 nt, Human
ccuucgauacaccgggccug

SEQ ID NO: 3240394 - RNA, 19 nt, Human
ccuguggaaggcagagaaa

SEQ ID NO: 3240395 - RNA, 20 nt, Human
ccuguggaaggcagagaaau

SEQ ID NO: 3240396 - RNA, 14 nt, Human
ccuuaccagcagag

SEQ ID NO: 3240397 - RNA, 15 nt, Human
ccuuaccagcagagc

SEQ ID NO: 3240398 - RNA, 16 nt, Human
ccuuaccagcagagca

SEQ ID NO: 3240399 - RNA, 15 nt, Human
ccuguggccugccag

SEQ ID NO: 3240400 - RNA, 20 nt, Human
ccuuaccucggugccuuccu

SEQ ID NO: 3240401 - RNA, 14 nt, Human
ccuuagacaguccc

SEQ ID NO: 3240402 - RNA, 21 nt, Human
ccuuagaagguauuaagauua

SEQ ID NO: 3240403 - RNA, 18 nt, Human
ccuuagaagguauuaaga

SEQ ID NO: 3240404 - RNA, 21 nt, Human
ccuuagacagucccugccaau

SEQ ID NO: 3240405 - RNA, 18 nt, Human
ccuuagacagucccugcc

SEQ ID NO: 3240406 - RNA, 19 nt, Human
ccuuagacagucccugcca

SEQ ID NO: 3240407 - RNA, 16 nt, Human
ccuuagacagucccug

SEQ ID NO: 3240408 - RNA, 17 nt, Human
ccuuagacagucccugc

SEQ ID NO: 3240409 - RNA, 18 nt, Human
ccuuagaaccuuucuuac

SEQ ID NO: 3240410 - RNA, 16 nt, Human
ccuuagaaccuuucuu

SEQ ID NO: 3240411 - RNA, 15 nt, Human
ccuuagaaccuuucu

SEQ ID NO: 3240412 - RNA, 14 nt, Human
ccuuagaaccuuuc

SEQ ID NO: 3240413 - RNA, 15 nt, Human
ccuucaaagcaaaug

SEQ ID NO: 3240414 - RNA, 15 nt, Human
ccuucaagcugcuuu

SEQ ID NO: 3240415 - RNA, 14 nt, Human
ccuucaaccauucc

SEQ ID NO: 3240416 - RNA, 19 nt, Human
ccuucaacaaggcuugcug

SEQ ID NO: 3240417 - RNA, 14 nt, Human
ccuucaacaaggcu

SEQ ID NO: 3240418 - RNA, 23 nt, Human
ccuucaacaaggcuugcugcaga

SEQ ID NO: 3240419 - RNA, 19 nt, Human
ccuucaaagcaaaugucuu

SEQ ID NO: 3240420 - RNA, 22 nt, Human
ccuucaaagucucaaugaaaua

SEQ ID NO: 3240421 - RNA, 15 nt, Human
cugccagcaacgcag

SEQ ID NO: 3240422 - RNA, 14 nt, Human
cugccacccugggg

SEQ ID NO: 3240423 - RNA, 20 nt, Human
cugccacccuggggagaaag

SEQ ID NO: 3240424 - RNA, 16 nt, Human
cugccacccuggggag

SEQ ID NO: 3240425 - RNA, 15 nt, Human
cugccacccugggga

SEQ ID NO: 3240426 - RNA, 19 nt, Human
cugcagggcuuuaaaauuc

SEQ ID NO: 3240427 - RNA, 18 nt, Human
cugcagggcuuuaaaauu

SEQ ID NO: 3240428 - RNA, 22 nt, Human
cugccacacuucaggcucuucu

SEQ ID NO: 3240429 - RNA, 17 nt, Human
cugccacacuucaggcu

SEQ ID NO: 3240430 - RNA, 13 nt, Human
cugccacacuuca

SEQ ID NO: 3240431 - RNA, 19 nt, Human
cugccaccacgcccggcua

SEQ ID NO: 3240432 - RNA, 17 nt, Human
cugccaggcacaggcag

SEQ ID NO: 3240433 - RNA, 16 nt, Human
cugccaggcacaggca

SEQ ID NO: 3240434 - RNA, 15 nt, Human
cugccaggcacaggc

SEQ ID NO: 3240435 - RNA, 14 nt, Human
cugccaggcacagg

SEQ ID NO: 3240436 - RNA, 13 nt, Human
cugccaggcacag

SEQ ID NO: 3240437 - RNA, 15 nt, Human
cugccaugccagcuu

SEQ ID NO: 3240438 - RNA, 21 nt, Human
cugccaggcacaggcagggca

SEQ ID NO: 3240439 - RNA, 20 nt, Human
cugccaggcacaggcagggc

SEQ ID NO: 3240440 - RNA, 19 nt, Human
cugccaggcacaggcaggg

SEQ ID NO: 3240441 - RNA, 18 nt, Human
cugccaggcacaggcagg

SEQ ID NO: 3240442 - RNA, 17 nt, Human
cugccaugccagcuuau

SEQ ID NO: 3240443 - RNA, 19 nt, Human
cugccaugccagcuuaucu

SEQ ID NO: 3240444 - RNA, 22 nt, Human
cugccaggcacaggcagggcag

SEQ ID NO: 3240445 - RNA, 19 nt, Human
cugccagccgagauagcca

SEQ ID NO: 3240446 - RNA, 15 nt, Human
cugccaggaagccag

SEQ ID NO: 3240447 - RNA, 16 nt, Human
cugccaggaagccagc

SEQ ID NO: 3240448 - RNA, 18 nt, Human
cugccaggaagccagcag

SEQ ID NO: 3240449 - RNA, 19 nt, Human
cugcccuccaagaccuucu

SEQ ID NO: 3240450 - RNA, 15 nt, Human
cugcccggcugcgga

SEQ ID NO: 3240451 - RNA, 11 nt, Human
cugcccggcug

SEQ ID NO: 3240452 - RNA, 23 nt, Human
cugccccugcuacugccaaccuc

SEQ ID NO: 3240453 - RNA, 22 nt, Human
cugccccugcuacugccaaccu

SEQ ID NO: 3240454 - RNA, 22 nt, Human
cugcccuccacacccgcgcccc

SEQ ID NO: 3240455 - RNA, 13 nt, Human
cugcccugcccac

SEQ ID NO: 3240456 - RNA, 14 nt, Human
cugcccugcccacc

SEQ ID NO: 3240457 - RNA, 15 nt, Human
cugcccugcccaccu

SEQ ID NO: 3240458 - RNA, 16 nt, Human
cugcccugcccaccug

SEQ ID NO: 3240459 - RNA, 16 nt, Human
cugccauuucugagau

SEQ ID NO: 3240460 - RNA, 17 nt, Human
cugcccaaccugcucuc

SEQ ID NO: 3240461 - RNA, 20 nt, Human
cugcccagcuuuucauugcu

SEQ ID NO: 3240462 - RNA, 14 nt, Human
cugccccuggcagc

SEQ ID NO: 3240463 - RNA, 15 nt, Human
cugccccuggcagcc

SEQ ID NO: 3240464 - RNA, 16 nt, Human
cugccccuggcagccc

SEQ ID NO: 3240465 - RNA, 20 nt, Human
cugcccggcaggguccuaga

SEQ ID NO: 3240466 - RNA, 18 nt, Human
cugcccaggccugccugu

SEQ ID NO: 3240467 - RNA, 17 nt, Human
cugcccaggccugccug

SEQ ID NO: 3240468 - RNA, 19 nt, Human
cugcccaggccugccuguu

SEQ ID NO: 3240469 - RNA, 23 nt, Human
cugccucuccgccccugagccca

SEQ ID NO: 3240470 - RNA, 22 nt, Human
cugccucuccgccccugagccc

SEQ ID NO: 3240471 - RNA, 21 nt, Human
cugccucuccgccccugagcc

SEQ ID NO: 3240472 - RNA, 19 nt, Human
cugccucuccgccccugag

SEQ ID NO: 3240473 - RNA, 13 nt, Human
cugccucuucucu

SEQ ID NO: 3240474 - RNA, 23 nt, Human
cugccugaagucacacagugagu

SEQ ID NO: 3240475 - RNA, 12 nt, Human
cugccucuuccu

SEQ ID NO: 3240476 - RNA, 23 nt, Human
cugccuguugggccaggagccuc

SEQ ID NO: 3240477 - RNA, 14 nt, Human
cugccugcccaggc

SEQ ID NO: 3240478 - RNA, 13 nt, Human
cugccugcccagg

SEQ ID NO: 3240479 - RNA, 22 nt, Human
cugccugaggggcagccugccu

SEQ ID NO: 3240480 - RNA, 20 nt, Human
cugccugaggggcagccugc

SEQ ID NO: 3240481 - RNA, 23 nt, Human
cugccugaggggcagccugccuu

SEQ ID NO: 3240482 - RNA, 20 nt, Human
cugccugacagagggaugga

SEQ ID NO: 3240483 - RNA, 15 nt, Human
cugccuaagugcagc

SEQ ID NO: 3240484 - RNA, 15 nt, Human
cugcccugggaggca

SEQ ID NO: 3240485 - RNA, 22 nt, Human
cugcccugggaggcagugaugg

SEQ ID NO: 3240486 - RNA, 12 nt, Human
cugcccugggag

SEQ ID NO: 3240487 - RNA, 13 nt, Human
cugcccugggagg

SEQ ID NO: 3240488 - RNA, 11 nt, Human
cugcccuggga

SEQ ID NO: 3240489 - RNA, 13 nt, Human
cugccucagccuc

SEQ ID NO: 3240490 - RNA, 14 nt, Human
cugccucuccgccc

SEQ ID NO: 3240491 - RNA, 17 nt, Human
cugcuccucuccccagc

SEQ ID NO: 3240492 - RNA, 16 nt, Human
cugcuccucuccccag

SEQ ID NO: 3240493 - RNA, 14 nt, Human
cugcucccccuuuu

SEQ ID NO: 3240494 - RNA, 17 nt, Human
cugcucccccuuuuccc

SEQ ID NO: 3240495 - RNA, 19 nt, Human
cugcuccagcucuggcaug

SEQ ID NO: 3240496 - RNA, 14 nt, Human
cugcuccagcucug

SEQ ID NO: 3240497 - RNA, 19 nt, Human
cugcucccccuuuucccuc

SEQ ID NO: 3240498 - RNA, 18 nt, Human
cugcucccccuuuucccu

SEQ ID NO: 3240499 - RNA, 19 nt, Human
cugcuccccuaaagccuca

SEQ ID NO: 3240500 - RNA, 22 nt, Human
cugcucccuccgggucuuccua

SEQ ID NO: 3240501 - RNA, 18 nt, Human
cugcuccucuccccagca

SEQ ID NO: 3240502 - RNA, 20 nt, Human
cugcuccugagcccccagcu

SEQ ID NO: 3240503 - RNA, 18 nt, Human
cugcuccugagcccccag

SEQ ID NO: 3240504 - RNA, 17 nt, Human
cugcuccugagccccca

SEQ ID NO: 3240505 - RNA, 16 nt, Human
cugcuccugagccccc

SEQ ID NO: 3240506 - RNA, 17 nt, Human
cugcuccuucccuugcu

SEQ ID NO: 3240507 - RNA, 16 nt, Human
cugcuccuucccuugc

SEQ ID NO: 3240508 - RNA, 15 nt, Human
cugcuccuguggccu

SEQ ID NO: 3240509 - RNA, 12 nt, Human
cugcuccuuccc

SEQ ID NO: 3240510 - RNA, 14 nt, Human
cugcuccuucccuu

SEQ ID NO: 3240511 - RNA, 11 nt, Human
cugcucugacg

SEQ ID NO: 3240512 - RNA, 20 nt, Human
cugcggaaugaaccacaucu

SEQ ID NO: 3240513 - RNA, 13 nt, Human
cugccuuaaguga

SEQ ID NO: 3240514 - RNA, 16 nt, Human
cugccuuaagugagga

SEQ ID NO: 3240515 - RNA, 15 nt, Human
cugcgguccacccag

SEQ ID NO: 3240516 - RNA, 21 nt, Human
cugcggaaugaaccacaucuu

SEQ ID NO: 3240517 - RNA, 16 nt, Human
cugcgguccacccagg

SEQ ID NO: 3240518 - RNA, 17 nt, Human
cugcguguucucagagg

SEQ ID NO: 3240519 - RNA, 16 nt, Human
cugcguguucucagag

SEQ ID NO: 3240520 - RNA, 14 nt, Human
cugcuccagcuguu

SEQ ID NO: 3240521 - RNA, 22 nt, Human
cugcuaaggauuagucccuggc

SEQ ID NO: 3240522 - RNA, 22 nt, Human
cugcuaaauugauguugaugca

SEQ ID NO: 3240523 - RNA, 19 nt, Human
cugcuaaauugauguugau

SEQ ID NO: 3240524 - RNA, 18 nt, Human
cugcuaaauugauguuga

SEQ ID NO: 3240525 - RNA, 17 nt, Human
cugcuaaauugauguug

SEQ ID NO: 3240526 - RNA, 14 nt, Human
cugcuaaauugaug

SEQ ID NO: 3240527 - RNA, 20 nt, Human
cugauccagcccugaguucc

SEQ ID NO: 3240528 - RNA, 19 nt, Human
cugauagcauaugacaaau

SEQ ID NO: 3240529 - RNA, 16 nt, Human
cugauacuuuuuugaa

SEQ ID NO: 3240530 - RNA, 15 nt, Human
cugauacuuuuuuga

SEQ ID NO: 3240531 - RNA, 17 nt, Human
cugauagccccucuccc

SEQ ID NO: 3240532 - RNA, 22 nt, Human
cugauagcauaugacaaauguu

SEQ ID NO: 3240533 - RNA, 12 nt, Human
cugaugugaaac

SEQ ID NO: 3240534 - RNA, 13 nt, Human
cugaugugaaacu

SEQ ID NO: 3240535 - RNA, 16 nt, Human
cugauguguugccacu

SEQ ID NO: 3240536 - RNA, 17 nt, Human
cugauguauuuugugag

SEQ ID NO: 3240537 - RNA, 21 nt, Human
cugauguuccuagugaaagag

SEQ ID NO: 3240538 - RNA, 20 nt, Human
cugauguuccuagugaaaga

SEQ ID NO: 3240539 - RNA, 18 nt, Human
cugauguuccuagugaaa

SEQ ID NO: 3240540 - RNA, 13 nt, Human
cugauguuccuag

SEQ ID NO: 3240541 - RNA, 13 nt, Human
cugauguuugugc

SEQ ID NO: 3240542 - RNA, 17 nt, Human
cugauguucccuccggu

SEQ ID NO: 3240543 - RNA, 16 nt, Human
cugauguucccuccgg

SEQ ID NO: 3240544 - RNA, 20 nt, Human
cugauuauugaguuccaguu

SEQ ID NO: 3240545 - RNA, 22 nt, Human
cugauuaguaagucuugccuau

SEQ ID NO: 3240546 - RNA, 15 nt, Human
cugauucccaagcuc

SEQ ID NO: 3240547 - RNA, 18 nt, Human
cugauucccaagcucugc

SEQ ID NO: 3240548 - RNA, 17 nt, Human
cugauucccaagcucug

SEQ ID NO: 3240549 - RNA, 20 nt, Human
cugauucccaagcucugcuc

SEQ ID NO: 3240550 - RNA, 19 nt, Human
cugauucccaagcucugcu

SEQ ID NO: 3240551 - RNA, 22 nt, Human
cugauucccaagcucugcuccu

SEQ ID NO: 3240552 - RNA, 13 nt, Human
cugagucugaagg

SEQ ID NO: 3240553 - RNA, 14 nt, Human
cugagucugaaggc

SEQ ID NO: 3240554 - RNA, 15 nt, Human
cugagucugaaggcu

SEQ ID NO: 3240555 - RNA, 16 nt, Human
cugagucugaaggcug

SEQ ID NO: 3240556 - RNA, 14 nt, Human
cugagugccuuuug

SEQ ID NO: 3240557 - RNA, 21 nt, Human
cugagugcaggcccacccugc

SEQ ID NO: 3240558 - RNA, 14 nt, Human
cugagugcaggccc

SEQ ID NO: 3240559 - RNA, 13 nt, Human
cugagugcaggcc

SEQ ID NO: 3240560 - RNA, 20 nt, Human
cugagugcaggcccacccug

SEQ ID NO: 3240561 - RNA, 17 nt, Human
cugagugcaggcccacc

SEQ ID NO: 3240562 - RNA, 16 nt, Human
cugagugcaggcccac

SEQ ID NO: 3240563 - RNA, 15 nt, Human
cugagugcaggccca

SEQ ID NO: 3240564 - RNA, 20 nt, Human
cugagugagaggggaggcca

SEQ ID NO: 3240565 - RNA, 16 nt, Human
cugagugagaggggag

SEQ ID NO: 3240566 - RNA, 15 nt, Human
cugagugagagggga

SEQ ID NO: 3240567 - RNA, 15 nt, Human
cugagugccuuuugg

SEQ ID NO: 3240568 - RNA, 16 nt, Human
cugagugccuuuuggu

SEQ ID NO: 3240569 - RNA, 20 nt, Human
cugagucccaggcugagccu

SEQ ID NO: 3240570 - RNA, 15 nt, Human
cugaggggagacaga

SEQ ID NO: 3240571 - RNA, 13 nt, Human
cugaguccgaccu

SEQ ID NO: 3240572 - RNA, 14 nt, Human
cugagggcuuguag

SEQ ID NO: 3240573 - RNA, 17 nt, Human
cugagggcuuguaguuc

SEQ ID NO: 3240574 - RNA, 20 nt, Human
cugagggcuuguaguucuuu

SEQ ID NO: 3240575 - RNA, 14 nt, Human
cugaggggagacag

SEQ ID NO: 3240576 - RNA, 13 nt, Human
cugcacaaagccc

SEQ ID NO: 3240577 - RNA, 20 nt, Human
cugcacaaagcccuuccaug

SEQ ID NO: 3240578 - RNA, 18 nt, Human
cugcacaaagcccuucca

SEQ ID NO: 3240579 - RNA, 21 nt, Human
cugcacaaagcccuuccaugu

SEQ ID NO: 3240580 - RNA, 17 nt, Human
cugcacccucaggcagg

SEQ ID NO: 3240581 - RNA, 16 nt, Human
cugcacccucaggcag

SEQ ID NO: 3240582 - RNA, 18 nt, Human
cugcacccucaggcaggu

SEQ ID NO: 3240583 - RNA, 21 nt, Human
cugcacagugcaucucagccc

SEQ ID NO: 3240584 - RNA, 22 nt, Human
cugcaccagguagaacgccagg

SEQ ID NO: 3240585 - RNA, 13 nt, Human
cugcacaagcugc

SEQ ID NO: 3240586 - RNA, 14 nt, Human
cugcacaagcugca

SEQ ID NO: 3240587 - RNA, 15 nt, Human
cugcacaagcugcac

SEQ ID NO: 3240588 - RNA, 16 nt, Human
cugcacaagcugcacc

SEQ ID NO: 3240589 - RNA, 18 nt, Human
cugcacagugcaucucag

SEQ ID NO: 3240590 - RNA, 23 nt, Human
cugcagccaggccacuggccccu

SEQ ID NO: 3240591 - RNA, 22 nt, Human
cugcagccaggccacuggcccc

SEQ ID NO: 3240592 - RNA, 17 nt, Human
cugcagccaggccacug

SEQ ID NO: 3240593 - RNA, 16 nt, Human
cugcagccaggccacu

SEQ ID NO: 3240594 - RNA, 11 nt, Human
cugcagccuca

SEQ ID NO: 3240595 - RNA, 12 nt, Human
cugcagcccugg

SEQ ID NO: 3240596 - RNA, 13 nt, Human
cugcagcccuggc

SEQ ID NO: 3240597 - RNA, 15 nt, Human
cugcagcccuggccc

SEQ ID NO: 3240598 - RNA, 17 nt, Human
cugcagcccuggcccau

SEQ ID NO: 3240599 - RNA, 15 nt, Human
cugcagccaggccac

SEQ ID NO: 3240600 - RNA, 21 nt, Human
cugcagauacuacugaccaga

SEQ ID NO: 3240601 - RNA, 20 nt, Human
cugcagauacuacugaccag

SEQ ID NO: 3240602 - RNA, 20 nt, Human
cugcagccucaaccuccugg

SEQ ID NO: 3240603 - RNA, 19 nt, Human
cugcagccucaaccuccug

SEQ ID NO: 3240604 - RNA, 22 nt, Human
cugcagccucaaccuccugggc

SEQ ID NO: 3240605 - RNA, 22 nt, Human
cugcagggaguccgaaagggac

SEQ ID NO: 3240606 - RNA, 16 nt, Human
cugcagggccaagcac

SEQ ID NO: 3240607 - RNA, 17 nt, Human
cugcagggacugccagu

SEQ ID NO: 3240608 - RNA, 15 nt, Human
cugcagggacugcca

SEQ ID NO: 3240609 - RNA, 18 nt, Human
cugcagagcagugggccu

SEQ ID NO: 3240610 - RNA, 20 nt, Human
cugcagagcaggaaacauga

SEQ ID NO: 3240611 - RNA, 23 nt, Human
cugcagagcagugggccuggcca

SEQ ID NO: 3240612 - RNA, 21 nt, Human
cugcagagcagugggccuggc

SEQ ID NO: 3240613 - RNA, 21 nt, Human
cugcagagcugcgggcugggu

SEQ ID NO: 3240614 - RNA, 12 nt, Human
cugcagagcugc

SEQ ID NO: 3240615 - RNA, 21 nt, Human
cugcagagcaguaagggaaca

SEQ ID NO: 3240616 - RNA, 23 nt, Human
cugcagaagacaguauggcagcu

SEQ ID NO: 3240617 - RNA, 13 nt, Human
cugcagaagacag

SEQ ID NO: 3240618 - RNA, 20 nt, Human
cugcagaacagcuucauguu

SEQ ID NO: 3240619 - RNA, 17 nt, Human
cugcaccggcuggccug

SEQ ID NO: 3240620 - RNA, 18 nt, Human
cugcaccggcuggccugg

SEQ ID NO: 3240621 - RNA, 19 nt, Human
cugcaccggcuggccuggc

SEQ ID NO: 3240622 - RNA, 16 nt, Human
cugcacuugcagacuc

SEQ ID NO: 3240623 - RNA, 14 nt, Human
cugcacuugcagac

SEQ ID NO: 3240624 - RNA, 16 nt, Human
cugcaccggcuggccu

SEQ ID NO: 3240625 - RNA, 23 nt, Human
cuggauuauucaaaaugauguau

SEQ ID NO: 3240626 - RNA, 17 nt, Human
cuggauucaaauuuauu

SEQ ID NO: 3240627 - RNA, 16 nt, Human
cuggauggggcugcac

SEQ ID NO: 3240628 - RNA, 15 nt, Human
cuggauguaccacca

SEQ ID NO: 3240629 - RNA, 17 nt, Human
cuggaggagcugggccc

SEQ ID NO: 3240630 - RNA, 15 nt, Human
cuggaggcucaaauu

SEQ ID NO: 3240631 - RNA, 21 nt, Human
cuggaggcucaaauuuugagu

SEQ ID NO: 3240632 - RNA, 18 nt, Human
cuggaggcucaaauuuug

SEQ ID NO: 3240633 - RNA, 15 nt, Human
cuggauggggcugca

SEQ ID NO: 3240634 - RNA, 21 nt, Human
cuggauggcggaagcugcuac

SEQ ID NO: 3240635 - RNA, 21 nt, Human
cuggauggaggaaaaccaagc

SEQ ID NO: 3240636 - RNA, 16 nt, Human
cuggcacagggcagug

SEQ ID NO: 3240637 - RNA, 14 nt, Human
cuggcacagccugc

SEQ ID NO: 3240638 - RNA, 13 nt, Human
cuggcacagccug

SEQ ID NO: 3240639 - RNA, 17 nt, Human
cuggcacagggcagugg

SEQ ID NO: 3240640 - RNA, 15 nt, Human
cuggcacagccugca

SEQ ID NO: 3240641 - RNA, 19 nt, Human
cuggcacaguuuucugaga

SEQ ID NO: 3240642 - RNA, 18 nt, Human
cuggcacaguuuucugag

SEQ ID NO: 3240643 - RNA, 22 nt, Human
cuggcacuauaauguaagcucu

SEQ ID NO: 3240644 - RNA, 23 nt, Human
cuggcacuauaauguaagcucua

SEQ ID NO: 3240645 - RNA, 13 nt, Human
cuggcacugcuuc

SEQ ID NO: 3240646 - RNA, 14 nt, Human
cuggcacugcuucc

SEQ ID NO: 3240647 - RNA, 12 nt, Human
cuggauuuaacu

SEQ ID NO: 3240648 - RNA, 22 nt, Human
cuggcaauggaugaacugaaag

SEQ ID NO: 3240649 - RNA, 12 nt, Human
cuggcacagccu

SEQ ID NO: 3240650 - RNA, 22 nt, Human
cuggcaaugguaguuucugugg

SEQ ID NO: 3240651 - RNA, 16 nt, Human
cuggcaaugguaguuu

SEQ ID NO: 3240652 - RNA, 21 nt, Human
cuggcaaugguaguuucugug

SEQ ID NO: 3240653 - RNA, 12 nt, Human
cuggcccacugc

SEQ ID NO: 3240654 - RNA, 13 nt, Human
cuggcccacugca

SEQ ID NO: 3240655 - RNA, 16 nt, Human
cuggccaacgggguga

SEQ ID NO: 3240656 - RNA, 16 nt, Human
cuggccagaugcacca

SEQ ID NO: 3240657 - RNA, 15 nt, Human
cuggcacugcuucca

SEQ ID NO: 3240658 - RNA, 16 nt, Human
cuggcacugcuuccag

SEQ ID NO: 3240659 - RNA, 17 nt, Human
cuggcacugcuuccagu

SEQ ID NO: 3240660 - RNA, 20 nt, Human
cuggccagaugcaccagccc

SEQ ID NO: 3240661 - RNA, 19 nt, Human
cuggccagaugcaccagcc

SEQ ID NO: 3240662 - RNA, 18 nt, Human
cuggccagaugcaccagc

SEQ ID NO: 3240663 - RNA, 17 nt, Human
cuggccagaugcaccag

SEQ ID NO: 3240664 - RNA, 21 nt, Human
cuggccagaugcaccagcccu

SEQ ID NO: 3240665 - RNA, 20 nt, Human
cuggaggaccugcccggugg

SEQ ID NO: 3240666 - RNA, 16 nt, Human
cuggacucaccucccc

SEQ ID NO: 3240667 - RNA, 15 nt, Human
cuggacuauagcugu

SEQ ID NO: 3240668 - RNA, 23 nt, Human
cuggagaggagcccugccucucc

SEQ ID NO: 3240669 - RNA, 21 nt, Human
cuggagaggagcccugccucu

SEQ ID NO: 3240670 - RNA, 18 nt, Human
cuggagaggagcccugcc

SEQ ID NO: 3240671 - RNA, 17 nt, Human
cuggagaggagcccugc

SEQ ID NO: 3240672 - RNA, 17 nt, Human
cuggagagcccagaguc

SEQ ID NO: 3240673 - RNA, 16 nt, Human
cuggagagcccagagu

SEQ ID NO: 3240674 - RNA, 17 nt, Human
cugcuuuccaaagccaa

SEQ ID NO: 3240675 - RNA, 15 nt, Human
cugcuuuccaaagcc

SEQ ID NO: 3240676 - RNA, 13 nt, Human
cugcugaaacaac

SEQ ID NO: 3240677 - RNA, 14 nt, Human
cugcucuuuggccu

SEQ ID NO: 3240678 - RNA, 17 nt, Human
cugcucuuucuucuucc

SEQ ID NO: 3240679 - RNA, 12 nt, Human
cugcucugauga

SEQ ID NO: 3240680 - RNA, 19 nt, Human
cugcucuugggcaauauuc

SEQ ID NO: 3240681 - RNA, 15 nt, Human
cugcucuugggcaau

SEQ ID NO: 3240682 - RNA, 18 nt, Human
cugcuuugggcugcccug

SEQ ID NO: 3240683 - RNA, 17 nt, Human
cugcuuugggcugcccu

SEQ ID NO: 3240684 - RNA, 20 nt, Human
cugcuuugggcugcccuggu

SEQ ID NO: 3240685 - RNA, 19 nt, Human
cugcuuugggcugcccugg

SEQ ID NO: 3240686 - RNA, 15 nt, Human
cugcuccugagcccc

SEQ ID NO: 3240687 - RNA, 17 nt, Human
cugcuuuguugugugcc

SEQ ID NO: 3240688 - RNA, 14 nt, Human
cugcuuugucuccu

SEQ ID NO: 3240689 - RNA, 13 nt, Human
cugcuuuguuacc

SEQ ID NO: 3240690 - RNA, 19 nt, Human
cugcuuuguuaccuuaaaa

SEQ ID NO: 3240691 - RNA, 23 nt, Human
cugcuuugggcugcccuggugcu

SEQ ID NO: 3240692 - RNA, 22 nt, Human
cugcuuugggcugcccuggugc

SEQ ID NO: 3240693 - RNA, 21 nt, Human
cugcuuugggcugcccuggug

SEQ ID NO: 3240694 - RNA, 15 nt, Human
cugcuuuuaucucag

SEQ ID NO: 3240695 - RNA, 17 nt, Human
cugcuuuuaucucagau

SEQ ID NO: 3240696 - RNA, 23 nt, Human
cugcuuuguugugugccucuagc

SEQ ID NO: 3240697 - RNA, 21 nt, Human
cugcuuuguugugugccucua

SEQ ID NO: 3240698 - RNA, 20 nt, Human
cugcuuuguugugugccucu

SEQ ID NO: 3240699 - RNA, 20 nt, Human
cuggaagcagugcccaggug

SEQ ID NO: 3240700 - RNA, 19 nt, Human
cuggaagcagugcccaggu

SEQ ID NO: 3240701 - RNA, 18 nt, Human
cuggaagcagugcccagg

SEQ ID NO: 3240702 - RNA, 17 nt, Human
cuggaagcagugcccag

SEQ ID NO: 3240703 - RNA, 16 nt, Human
cuggaagcagugccca

SEQ ID NO: 3240704 - RNA, 15 nt, Human
cuggaagcagugccc

SEQ ID NO: 3240705 - RNA, 15 nt, Human
cuggaagcacagcuu

SEQ ID NO: 3240706 - RNA, 18 nt, Human
cuggaagcacagcuucau

SEQ ID NO: 3240707 - RNA, 14 nt, Human
cuggaagcacagcu

SEQ ID NO: 3240708 - RNA, 14 nt, Human
cuggaagcagugcc

SEQ ID NO: 3240709 - RNA, 15 nt, Human
cuggaaugcaguggu

SEQ ID NO: 3240710 - RNA, 14 nt, Human
cuggaaugcagugg

SEQ ID NO: 3240711 - RNA, 18 nt, Human
cuggaaguuaaagugagg

SEQ ID NO: 3240712 - RNA, 19 nt, Human
cuggaaguuaaagugaggc

SEQ ID NO: 3240713 - RNA, 22 nt, Human
cugggcacacgcugcucugccc

SEQ ID NO: 3240714 - RNA, 18 nt, Human
cugggcaccacaaaauau

SEQ ID NO: 3240715 - RNA, 20 nt, Human
cugggcaccacaaaauauac

SEQ ID NO: 3240716 - RNA, 21 nt, Human
cugggcacacgcugcucugcc

SEQ ID NO: 3240717 - RNA, 20 nt, Human
cugggcacacgcugcucugc

SEQ ID NO: 3240718 - RNA, 18 nt, Human
cugggcacacgcugcucu

SEQ ID NO: 3240719 - RNA, 16 nt, Human
cugggcacacgcugcu

SEQ ID NO: 3240720 - RNA, 15 nt, Human
cugggcacacgcugc

SEQ ID NO: 3240721 - RNA, 14 nt, Human
cugggcacacgcug

SEQ ID NO: 3240722 - RNA, 20 nt, Human
cugggcaaugugauaaaacc

SEQ ID NO: 3240723 - RNA, 12 nt, Human
cugggagugagc

SEQ ID NO: 3240724 - RNA, 13 nt, Human
cugggagugagcu

SEQ ID NO: 3240725 - RNA, 16 nt, Human
cugggagugagcuggu

SEQ ID NO: 3240726 - RNA, 21 nt, Human
cugggauuacaggcuccugcc

SEQ ID NO: 3240727 - RNA, 22 nt, Human
cugggauuacaggcuccugcca

SEQ ID NO: 3240728 - RNA, 19 nt, Human
cugggauuacaggcuccug

SEQ ID NO: 3240729 - RNA, 20 nt, Human
cugggauuacaggcuccugc

SEQ ID NO: 3240730 - RNA, 17 nt, Human
cugggauaggggcagag

SEQ ID NO: 3240731 - RNA, 21 nt, Human
cugggauuacaggcgugagcc

SEQ ID NO: 3240732 - RNA, 16 nt, Human
cugggaggcagugaug

SEQ ID NO: 3240733 - RNA, 14 nt, Human
cugggaggcaguga

SEQ ID NO: 3240734 - RNA, 18 nt, Human
cugggaggucaaggcugc

SEQ ID NO: 3240735 - RNA, 22 nt, Human
cugggaacccaaguccaagcau

SEQ ID NO: 3240736 - RNA, 14 nt, Human
cugggaacagaacu

SEQ ID NO: 3240737 - RNA, 15 nt, Human
cugggaacagaacuc

SEQ ID NO: 3240738 - RNA, 15 nt, Human
cugggagcucugcag

SEQ ID NO: 3240739 - RNA, 14 nt, Human
cugggagcucugca

SEQ ID NO: 3240740 - RNA, 13 nt, Human
cugggagcucugc

SEQ ID NO: 3240741 - RNA, 20 nt, Human
cuggcuguuggcugggggcc

SEQ ID NO: 3240742 - RNA, 18 nt, Human
cuggcuguuggcuggggg

SEQ ID NO: 3240743 - RNA, 18 nt, Human
cuggcuuacacuggcaau

SEQ ID NO: 3240744 - RNA, 12 nt, Human
cuggcuuauuua

SEQ ID NO: 3240745 - RNA, 14 nt, Human
cuggcuucacagau

SEQ ID NO: 3240746 - RNA, 14 nt, Human
cuggcuuacacugg

SEQ ID NO: 3240747 - RNA, 21 nt, Human
cuggcuggguggcaccagcag

SEQ ID NO: 3240748 - RNA, 19 nt, Human
cuggcuguuggcugggggc

SEQ ID NO: 3240749 - RNA, 20 nt, Human
cuggcuuuucacugcuggcu

SEQ ID NO: 3240750 - RNA, 19 nt, Human
cuggcuuuucacugcuggc

SEQ ID NO: 3240751 - RNA, 17 nt, Human
cuggcuuuucacugcug

SEQ ID NO: 3240752 - RNA, 19 nt, Human
cugggaacaccauagguca

SEQ ID NO: 3240753 - RNA, 16 nt, Human
cuggcuuuucacugcu

SEQ ID NO: 3240754 - RNA, 15 nt, Human
cuggcuuuucacugc

SEQ ID NO: 3240755 - RNA, 19 nt, Human
cuggcuugaauuggugaca

SEQ ID NO: 3240756 - RNA, 18 nt, Human
cuggcucuuccaggcugg

SEQ ID NO: 3240757 - RNA, 19 nt, Human
cuggcucuuccaggcuggg

SEQ ID NO: 3240758 - RNA, 17 nt, Human
cuggcucuuccaggcug

SEQ ID NO: 3240759 - RNA, 21 nt, Human
cuggccugaaccacaggagag

SEQ ID NO: 3240760 - RNA, 15 nt, Human
cuggccucuucuaga

SEQ ID NO: 3240761 - RNA, 13 nt, Human
cuggccugagcug

SEQ ID NO: 3240762 - RNA, 19 nt, Human
cuggcugccuuagaaccuu

SEQ ID NO: 3240763 - RNA, 14 nt, Human
cuggcugccuuaga

SEQ ID NO: 3240764 - RNA, 17 nt, Human
cuggcugggacugggaa

SEQ ID NO: 3240765 - RNA, 15 nt, Human
cuggcugggacuggg

SEQ ID NO: 3240766 - RNA, 18 nt, Human
cuggcugcggggcgggca

SEQ ID NO: 3240767 - RNA, 12 nt, Human
cuggcugcgggg

SEQ ID NO: 3240768 - RNA, 17 nt, Human
cugggguggggaccuca

SEQ ID NO: 3240769 - RNA, 18 nt, Human
cugggguggggaccucag

SEQ ID NO: 3240770 - RNA, 19 nt, Human
cugggguggggaccucagg

SEQ ID NO: 3240771 - RNA, 17 nt, Human
cugggggccucagugcc

SEQ ID NO: 3240772 - RNA, 13 nt, Human
cugggggccucag

SEQ ID NO: 3240773 - RNA, 21 nt, Human
cugggguggggaccucaggcc

SEQ ID NO: 3240774 - RNA, 22 nt, Human
cugggguggggaccucaggccu

SEQ ID NO: 3240775 - RNA, 23 nt, Human
cugggguggggaccucaggccug

SEQ ID NO: 3240776 - RNA, 20 nt, Human
cuggguacuuguggacacag

SEQ ID NO: 3240777 - RNA, 23 nt, Human
cuggguacuuguggacacagcuc

SEQ ID NO: 3240778 - RNA, 21 nt, Human
cuggguacuuguggacacagc

SEQ ID NO: 3240779 - RNA, 19 nt, Human
cuggguacuuguggacaca

SEQ ID NO: 3240780 - RNA, 14 nt, Human
cuggguagcuguaa

SEQ ID NO: 3240781 - RNA, 13 nt, Human
cuggguagcugua

SEQ ID NO: 3240782 - RNA, 15 nt, Human
cuggguagcuguaag

SEQ ID NO: 3240783 - RNA, 20 nt, Human
cugggcuucaguggcagcug

SEQ ID NO: 3240784 - RNA, 19 nt, Human
cugggcuucaguggcagcu

SEQ ID NO: 3240785 - RNA, 17 nt, Human
cugggcuucaguggcag

SEQ ID NO: 3240786 - RNA, 18 nt, Human
cugggcuucaguggcagc

SEQ ID NO: 3240787 - RNA, 21 nt, Human
cugggcuuggggaccagagcu

SEQ ID NO: 3240788 - RNA, 19 nt, Human
cugggcucccguguaucug

SEQ ID NO: 3240789 - RNA, 17 nt, Human
cugggcuuggggaccag

SEQ ID NO: 3240790 - RNA, 20 nt, Human
cugggcuuggggaccagagc

SEQ ID NO: 3240791 - RNA, 13 nt, Human
cugggcuugggga

SEQ ID NO: 3240792 - RNA, 22 nt, Human
cugggcuucaguggcagcugcu

SEQ ID NO: 3240793 - RNA, 21 nt, Human
cugggcuucaguggcagcugc

SEQ ID NO: 3240794 - RNA, 14 nt, Human
cuggucgccuucca

SEQ ID NO: 3240795 - RNA, 18 nt, Human
cugguccauagagagcaa

SEQ ID NO: 3240796 - RNA, 14 nt, Human
cuggucccacucag

SEQ ID NO: 3240797 - RNA, 18 nt, Human
cuggucccacucagucca

SEQ ID NO: 3240798 - RNA, 15 nt, Human
cuggucccacucagu

SEQ ID NO: 3240799 - RNA, 15 nt, Human
cugguccauagagag

SEQ ID NO: 3240800 - RNA, 17 nt, Human
cugguccauagagagca

SEQ ID NO: 3240801 - RNA, 13 nt, Human
cuggguuggaggg

SEQ ID NO: 3240802 - RNA, 18 nt, Human
cuggguuggaaaacagua

SEQ ID NO: 3240803 - RNA, 13 nt, Human
cuggguuggaaaa

SEQ ID NO: 3240804 - RNA, 19 nt, Human
cuggguucuacccaggugc

SEQ ID NO: 3240805 - RNA, 23 nt, Human
cugguggcagugggagcugccug

SEQ ID NO: 3240806 - RNA, 19 nt, Human
cugguggcagugggagcug

SEQ ID NO: 3240807 - RNA, 19 nt, Human
cuggucuauaccuuaagaa

SEQ ID NO: 3240808 - RNA, 22 nt, Human
cuggucguaaacaucucagaga

SEQ ID NO: 3240809 - RNA, 21 nt, Human
cuggucguaaacaucucagag

SEQ ID NO: 3240810 - RNA, 20 nt, Human
cuggucguaaacaucucaga

SEQ ID NO: 3240811 - RNA, 15 nt, Human
cuggucgccuuccac

SEQ ID NO: 3240812 - RNA, 17 nt, Human
cuccauugguguugaca

SEQ ID NO: 3240813 - RNA, 14 nt, Human
cuccaugugggcua

SEQ ID NO: 3240814 - RNA, 22 nt, Human
cucccaaggggcccaaauucuu

SEQ ID NO: 3240815 - RNA, 21 nt, Human
cucccaaggggcccaaauucu

SEQ ID NO: 3240816 - RNA, 15 nt, Human
cucccaggcauuccc

SEQ ID NO: 3240817 - RNA, 17 nt, Human
cucccagucauuuaaua

SEQ ID NO: 3240818 - RNA, 14 nt, Human
cucccaggcgcccc

SEQ ID NO: 3240819 - RNA, 22 nt, Human
cucccaggcauuccccaggagg

SEQ ID NO: 3240820 - RNA, 17 nt, Human
cucccaggcauucccca

SEQ ID NO: 3240821 - RNA, 19 nt, Human
cucccaggcauuccccagg

SEQ ID NO: 3240822 - RNA, 20 nt, Human
cucccaggcauuccccagga

SEQ ID NO: 3240823 - RNA, 21 nt, Human
cucccaggcauuccccaggag

SEQ ID NO: 3240824 - RNA, 23 nt, Human
cuccauccugaggcuccacuugg

SEQ ID NO: 3240825 - RNA, 17 nt, Human
cuccaucuaaacugccc

SEQ ID NO: 3240826 - RNA, 20 nt, Human
cuccaucgcugucaucucag

SEQ ID NO: 3240827 - RNA, 18 nt, Human
cuccaucuaaacugcccc

SEQ ID NO: 3240828 - RNA, 13 nt, Human
cuccaucuccacu

SEQ ID NO: 3240829 - RNA, 21 nt, Human
cuccauccugaggcuccacuu

SEQ ID NO: 3240830 - RNA, 20 nt, Human
cuccauccugaggcuccacu

SEQ ID NO: 3240831 - RNA, 11 nt, Human
cuccaggcucc

SEQ ID NO: 3240832 - RNA, 13 nt, Human
cuccagcuguuca

SEQ ID NO: 3240833 - RNA, 19 nt, Human
cuccagcuggguuggaaaa

SEQ ID NO: 3240834 - RNA, 23 nt, Human
cuccagccuggaaaccugucuga

SEQ ID NO: 3240835 - RNA, 18 nt, Human
cuccagcuguucagcugg

SEQ ID NO: 3240836 - RNA, 19 nt, Human
cuccagcuguucagcuggu

SEQ ID NO: 3240837 - RNA, 21 nt, Human
cuccacucuccucuuccaggc

SEQ ID NO: 3240838 - RNA, 11 nt, Human
cuccacugccu

SEQ ID NO: 3240839 - RNA, 18 nt, Human
cuccagaccccuggcuuu

SEQ ID NO: 3240840 - RNA, 17 nt, Human
cuccagaccccuggcuu

SEQ ID NO: 3240841 - RNA, 15 nt, Human
cuccagaccccuggc

SEQ ID NO: 3240842 - RNA, 14 nt, Human
cuccagaccccugg

SEQ ID NO: 3240843 - RNA, 20 nt, Human
cuccagaccccuggcuuuuc

SEQ ID NO: 3240844 - RNA, 19 nt, Human
cuccagaccccuggcuuuu

SEQ ID NO: 3240845 - RNA, 20 nt, Human
cuccagcucaccagccccag

SEQ ID NO: 3240846 - RNA, 19 nt, Human
cuccagcucaccagcccca

SEQ ID NO: 3240847 - RNA, 14 nt, Human
cuccagcaggccca

SEQ ID NO: 3240848 - RNA, 22 nt, Human
cuccagcaggcccaugggaggc

SEQ ID NO: 3240849 - RNA, 12 nt, Human
cuccacccugcu

SEQ ID NO: 3240850 - RNA, 15 nt, Human
cuccaccugccaggg

SEQ ID NO: 3240851 - RNA, 17 nt, Human
cuccaccugccagggac

SEQ ID NO: 3240852 - RNA, 18 nt, Human
cuccaccugccagggaca

SEQ ID NO: 3240853 - RNA, 21 nt, Human
cuccaccugccagggacagag

SEQ ID NO: 3240854 - RNA, 11 nt, Human
cuccacccugc

SEQ ID NO: 3240855 - RNA, 20 nt, Human
cuccacauauuucagugagg

SEQ ID NO: 3240856 - RNA, 22 nt, Human
cucagugucuggcugcagagca

SEQ ID NO: 3240857 - RNA, 21 nt, Human
cucagugucuggcugcagagc

SEQ ID NO: 3240858 - RNA, 13 nt, Human
cucaggucugagu

SEQ ID NO: 3240859 - RNA, 23 nt, Human
cucaggucccaggcuccuaugca

SEQ ID NO: 3240860 - RNA, 20 nt, Human
cucagugucuggcugcagag

SEQ ID NO: 3240861 - RNA, 19 nt, Human
cucaggugucccugcacuu

SEQ ID NO: 3240862 - RNA, 18 nt, Human
cucaggugucccugcacu

SEQ ID NO: 3240863 - RNA, 17 nt, Human
cucaggugucccugcac

SEQ ID NO: 3240864 - RNA, 19 nt, Human
cucauaguaugguggcugg

SEQ ID NO: 3240865 - RNA, 18 nt, Human
cucauaguaugguggcug

SEQ ID NO: 3240866 - RNA, 15 nt, Human
cucauagguuaaaaa

SEQ ID NO: 3240867 - RNA, 22 nt, Human
cucauagguuaaaaaaaaaagu

SEQ ID NO: 3240868 - RNA, 22 nt, Human
cucagguggggucacucuggca

SEQ ID NO: 3240869 - RNA, 23 nt, Human
cucagguggggucacucuggcag

SEQ ID NO: 3240870 - RNA, 16 nt, Human
cucaggugucccugca

SEQ ID NO: 3240871 - RNA, 15 nt, Human
cucaggugucccugc

SEQ ID NO: 3240872 - RNA, 20 nt, Human
cucagguacuucucucuccu

SEQ ID NO: 3240873 - RNA, 18 nt, Human
cucaggucccugcagggc

SEQ ID NO: 3240874 - RNA, 17 nt, Human
cucaggucccugcaggg

SEQ ID NO: 3240875 - RNA, 12 nt, Human
cucagggucccu

SEQ ID NO: 3240876 - RNA, 23 nt, Human
cuaaaaggcccagagagaagagc

SEQ ID NO: 3240877 - RNA, 18 nt, Human
cuaaaaggcccagagaga

SEQ ID NO: 3240878 - RNA, 14 nt, Human
cuaaaaggcccaga

SEQ ID NO: 3240879 - RNA, 13 nt, Human
cuaaaaggcccag

SEQ ID NO: 3240880 - RNA, 12 nt, Human
cuaaaaggccca

SEQ ID NO: 3240881 - RNA, 23 nt, Human
cuaaaagguaugcaaucaaaucu

SEQ ID NO: 3240882 - RNA, 22 nt, Human
cguuuugcaagguaaaauuuua

SEQ ID NO: 3240883 - RNA, 17 nt, Human
cucauuccagaggaagg

SEQ ID NO: 3240884 - RNA, 15 nt, Human
cucauuccagaggaa

SEQ ID NO: 3240885 - RNA, 21 nt, Human
cucauuccaccuucccaugcc

SEQ ID NO: 3240886 - RNA, 16 nt, Human
cucauucagcaucuga

SEQ ID NO: 3240887 - RNA, 18 nt, Human
cucauuccaccuucccau

SEQ ID NO: 3240888 - RNA, 12 nt, Human
cucauucuucug

SEQ ID NO: 3240889 - RNA, 21 nt, Human
cucauucccucgucuuuccca

SEQ ID NO: 3240890 - RNA, 20 nt, Human
cucauucccucgucuuuccc

SEQ ID NO: 3240891 - RNA, 14 nt, Human
cucauucuucugua

SEQ ID NO: 3240892 - RNA, 13 nt, Human
cucauucuucugu

SEQ ID NO: 3240893 - RNA, 13 nt, Human
cucauugaccuga

SEQ ID NO: 3240894 - RNA, 15 nt, Human
cucauugaccugagg

SEQ ID NO: 3240895 - RNA, 23 nt, Human
cucauucuucuguacgucugaca

SEQ ID NO: 3240896 - RNA, 16 nt, Human
cucauugaccugaggc

SEQ ID NO: 3240897 - RNA, 21 nt, Human
cucauuagcauuuugcuaaau

SEQ ID NO: 3240898 - RNA, 17 nt, Human
cucauuaggauggcuag

SEQ ID NO: 3240899 - RNA, 18 nt, Human
cucauuaggauggcuagu

SEQ ID NO: 3240900 - RNA, 15 nt, Human
cucauucagcaucug

SEQ ID NO: 3240901 - RNA, 14 nt, Human
cucauucagcaucu

SEQ ID NO: 3240902 - RNA, 17 nt, Human
cucaucucaguccucaa

SEQ ID NO: 3240903 - RNA, 23 nt, Human
cucauuaggcaugguuuugggcu

SEQ ID NO: 3240904 - RNA, 12 nt, Human
cucaucauuuuu

SEQ ID NO: 3240905 - RNA, 14 nt, Human
cuccuucaccuuug

SEQ ID NO: 3240906 - RNA, 16 nt, Human
cuccuucaccuuuguc

SEQ ID NO: 3240907 - RNA, 19 nt, Human
cuccuucaccuuugucccc

SEQ ID NO: 3240908 - RNA, 21 nt, Human
cuccuucaccuuuguccccac

SEQ ID NO: 3240909 - RNA, 15 nt, Human
cuccugcaggcagcc

SEQ ID NO: 3240910 - RNA, 21 nt, Human
cuccugcaggcagccaggcca

SEQ ID NO: 3240911 - RNA, 22 nt, Human
cuccugcaggcagccaggccac

SEQ ID NO: 3240912 - RNA, 11 nt, Human
cuccugugugu

SEQ ID NO: 3240913 - RNA, 23 nt, Human
cuccugugucuugcaauggcagc

SEQ ID NO: 3240914 - RNA, 15 nt, Human
cuccugugucuugca

SEQ ID NO: 3240915 - RNA, 11 nt, Human
cuccugccacc

SEQ ID NO: 3240916 - RNA, 20 nt, Human
cuccuucuguccuacucugu

SEQ ID NO: 3240917 - RNA, 15 nt, Human
cuccuucuguccuac

SEQ ID NO: 3240918 - RNA, 14 nt, Human
cuccuucuguccua

SEQ ID NO: 3240919 - RNA, 13 nt, Human
cuccuucaccuuu

SEQ ID NO: 3240920 - RNA, 13 nt, Human
cuccuucacuguu

SEQ ID NO: 3240921 - RNA, 15 nt, Human
cuccuucacuguuuc

SEQ ID NO: 3240922 - RNA, 16 nt, Human
cucgaacuggcugcaa

SEQ ID NO: 3240923 - RNA, 22 nt, Human
cuccuugauauuuguauuuauu

SEQ ID NO: 3240924 - RNA, 15 nt, Human
cuccuugauauuugu

SEQ ID NO: 3240925 - RNA, 11 nt, Human
cuccuucuucc

SEQ ID NO: 3240926 - RNA, 21 nt, Human
cuccuugaaaacacuguucuc

SEQ ID NO: 3240927 - RNA, 19 nt, Human
cucuaacaguggacaaagu

SEQ ID NO: 3240928 - RNA, 15 nt, Human
cucuaacaguggaca

SEQ ID NO: 3240929 - RNA, 22 nt, Human
cucuaaagucuguugauuaaag

SEQ ID NO: 3240930 - RNA, 22 nt, Human
cucggccucccaaagugcuggg

SEQ ID NO: 3240931 - RNA, 23 nt, Human
cucggccucccaaagugcuggga

SEQ ID NO: 3240932 - RNA, 23 nt, Human
cucggauccccuuccuaccaccc

SEQ ID NO: 3240933 - RNA, 14 nt, Human
cucggaucagcuga

SEQ ID NO: 3240934 - RNA, 18 nt, Human
cucggaucaggcucccag

SEQ ID NO: 3240935 - RNA, 15 nt, Human
cucggauccccuucc

SEQ ID NO: 3240936 - RNA, 12 nt, Human
cucggagaagag

SEQ ID NO: 3240937 - RNA, 18 nt, Human
cucggacuuagcugggag

SEQ ID NO: 3240938 - RNA, 19 nt, Human
cucggacuuagcugggaga

SEQ ID NO: 3240939 - RNA, 20 nt, Human
cucggagaagagcuguucac

SEQ ID NO: 3240940 - RNA, 13 nt, Human
cucggagaagagc

SEQ ID NO: 3240941 - RNA, 23 nt, Human
cucggaaccugugagcugcacca

SEQ ID NO: 3240942 - RNA, 21 nt, Human
cucgcuauugucaccagggcu

SEQ ID NO: 3240943 - RNA, 19 nt, Human
cucgcuacauuuccgccac

SEQ ID NO: 3240944 - RNA, 13 nt, Human
cucgcgacaaugc

SEQ ID NO: 3240945 - RNA, 15 nt, Human
cucgcgacaaugcaa

SEQ ID NO: 3240946 - RNA, 19 nt, Human
cucgcuauugucaccaggg

SEQ ID NO: 3240947 - RNA, 21 nt, Human
cucgcggccucuucucucaga

SEQ ID NO: 3240948 - RNA, 20 nt, Human
cucgcccagucccagcagcc

SEQ ID NO: 3240949 - RNA, 19 nt, Human
cucgcccagucccagcagc

SEQ ID NO: 3240950 - RNA, 18 nt, Human
cucgcccagucccagcag

SEQ ID NO: 3240951 - RNA, 16 nt, Human
cucgcccagucccagc

SEQ ID NO: 3240952 - RNA, 14 nt, Human
cucgcccaguccca

SEQ ID NO: 3240953 - RNA, 14 nt, Human
cucgaugcagacag

SEQ ID NO: 3240954 - RNA, 16 nt, Human
cucgaguuacagacaa

SEQ ID NO: 3240955 - RNA, 20 nt, Human
cucgaguuacagacaaagcg

SEQ ID NO: 3240956 - RNA, 21 nt, Human
cucgaaguugaucuccccagc

SEQ ID NO: 3240957 - RNA, 12 nt, Human
cucgagucugag

SEQ ID NO: 3240958 - RNA, 19 nt, Human
cucgacauuuuauggaaag

SEQ ID NO: 3240959 - RNA, 12 nt, Human
cuccucagaucu

SEQ ID NO: 3240960 - RNA, 14 nt, Human
cuccucagaucuuc

SEQ ID NO: 3240961 - RNA, 22 nt, Human
cuccucuauccugggcuuuugu

SEQ ID NO: 3240962 - RNA, 18 nt, Human
cuccucuugccacugccu

SEQ ID NO: 3240963 - RNA, 19 nt, Human
cuccucuugccacugccuc

SEQ ID NO: 3240964 - RNA, 17 nt, Human
cuccucuauccugggcu

SEQ ID NO: 3240965 - RNA, 22 nt, Human
cuccucggcuggcuguccaccc

SEQ ID NO: 3240966 - RNA, 21 nt, Human
cuccucggcuggcuguccacc

SEQ ID NO: 3240967 - RNA, 20 nt, Human
cuccucggcuggcuguccac

SEQ ID NO: 3240968 - RNA, 19 nt, Human
cuccucggcuggcugucca

SEQ ID NO: 3240969 - RNA, 15 nt, Human
cuccucggcuggcug

SEQ ID NO: 3240970 - RNA, 13 nt, Human
cuccugcaggcag

SEQ ID NO: 3240971 - RNA, 14 nt, Human
cuccugcaggcagc

SEQ ID NO: 3240972 - RNA, 12 nt, Human
cuccugcaggca

SEQ ID NO: 3240973 - RNA, 17 nt, Human
cuccugaguagcuggga

SEQ ID NO: 3240974 - RNA, 23 nt, Human
cuccugagcccccagcuuccagc

SEQ ID NO: 3240975 - RNA, 22 nt, Human
cuccugagcccccagcuuccag

SEQ ID NO: 3240976 - RNA, 21 nt, Human
cuccugagcccccagcuucca

SEQ ID NO: 3240977 - RNA, 20 nt, Human
cuccugagcccccagcuucc

SEQ ID NO: 3240978 - RNA, 19 nt, Human
cuccugagcccccagcuuc

SEQ ID NO: 3240979 - RNA, 17 nt, Human
cuccugagcccccagcu

SEQ ID NO: 3240980 - RNA, 14 nt, Human
cuccugagccccca

SEQ ID NO: 3240981 - RNA, 11 nt, Human
cuccugagccc

SEQ ID NO: 3240982 - RNA, 13 nt, Human
cuccugagccccc

SEQ ID NO: 3240983 - RNA, 12 nt, Human
cuccugagcccc

SEQ ID NO: 3240984 - RNA, 14 nt, Human
cuccugaccuuagg

SEQ ID NO: 3240985 - RNA, 14 nt, Human
cuccugaccucagg

SEQ ID NO: 3240986 - RNA, 19 nt, Human
cuccugacacaccugcagc

SEQ ID NO: 3240987 - RNA, 20 nt, Human
cuccugacacaccugcagcc

SEQ ID NO: 3240988 - RNA, 22 nt, Human
cuccugacacaccugcagccuc

SEQ ID NO: 3240989 - RNA, 20 nt, Human
cuccugacaccccacuuagc

SEQ ID NO: 3240990 - RNA, 19 nt, Human
cuccugacaccccacuuag

SEQ ID NO: 3240991 - RNA, 16 nt, Human
cuccugacaccccacu

SEQ ID NO: 3240992 - RNA, 15 nt, Human
cuccugacaccccac

SEQ ID NO: 3240993 - RNA, 13 nt, Human
cucccuuucaaca

SEQ ID NO: 3240994 - RNA, 12 nt, Human
cucccuuucaac

SEQ ID NO: 3240995 - RNA, 17 nt, Human
cucccuuggauuguccc

SEQ ID NO: 3240996 - RNA, 23 nt, Human
cuccuagguagcccccucuuccc

SEQ ID NO: 3240997 - RNA, 23 nt, Human
cuccuaguagggguaccacugaa

SEQ ID NO: 3240998 - RNA, 16 nt, Human
cucccuucucuucaca

SEQ ID NO: 3240999 - RNA, 17 nt, Human
cucccuugaccugcuga

SEQ ID NO: 3241000 - RNA, 14 nt, Human
cucccuucuguuga

SEQ ID NO: 3241001 - RNA, 15 nt, Human
cucccuugaccugcu

SEQ ID NO: 3241002 - RNA, 13 nt, Human
cucccuuccucuu

SEQ ID NO: 3241003 - RNA, 14 nt, Human
cucccuuccucuuu

SEQ ID NO: 3241004 - RNA, 14 nt, Human
cucccaucucacac

SEQ ID NO: 3241005 - RNA, 15 nt, Human
cucccaucucacaca

SEQ ID NO: 3241006 - RNA, 18 nt, Human
cucccaucucacacauga

SEQ ID NO: 3241007 - RNA, 10 nt, Human
cucccuuccu

SEQ ID NO: 3241008 - RNA, 23 nt, Human
cucccuucccaccucucucacuc

SEQ ID NO: 3241009 - RNA, 20 nt, Human
cucccuucaaccauucccca

SEQ ID NO: 3241010 - RNA, 19 nt, Human
cucccuucaaccauucccc

SEQ ID NO: 3241011 - RNA, 18 nt, Human
cucccuucaaccauuccc

SEQ ID NO: 3241012 - RNA, 12 nt, Human
cucccuucaacc

SEQ ID NO: 3241013 - RNA, 21 nt, Human
cugaagagaagggcagggcug

SEQ ID NO: 3241014 - RNA, 11 nt, Human
cugaagaggag

SEQ ID NO: 3241015 - RNA, 14 nt, Human
cugaagaggaggag

SEQ ID NO: 3241016 - RNA, 15 nt, Human
cugaagaggaggagg

SEQ ID NO: 3241017 - RNA, 21 nt, Human
cugaagacucauucuucugua

SEQ ID NO: 3241018 - RNA, 19 nt, Human
cugaagacucauucuucug

SEQ ID NO: 3241019 - RNA, 19 nt, Human
cugaacgauccuucaaagu

SEQ ID NO: 3241020 - RNA, 20 nt, Human
cugaacgauccuucaaaguc

SEQ ID NO: 3241021 - RNA, 16 nt, Human
cugaacuuggcgcugc

SEQ ID NO: 3241022 - RNA, 21 nt, Human
cugaacuuggcgcugccccug

SEQ ID NO: 3241023 - RNA, 15 nt, Human
cugaacuuggcgcug

SEQ ID NO: 3241024 - RNA, 16 nt, Human
cugaaccugucuuuug

SEQ ID NO: 3241025 - RNA, 14 nt, Human
cugaaccugucuuu

SEQ ID NO: 3241026 - RNA, 13 nt, Human
cugaaccugucuu

SEQ ID NO: 3241027 - RNA, 19 nt, Human
cucuuuggucuacacugug

SEQ ID NO: 3241028 - RNA, 18 nt, Human
cucuuugggccuggcucc

SEQ ID NO: 3241029 - RNA, 13 nt, Human
cucuuuggaaaag

SEQ ID NO: 3241030 - RNA, 12 nt, Human
cucuuuggaaaa

SEQ ID NO: 3241031 - RNA, 21 nt, Human
cugaaccuggguaacuaggga

SEQ ID NO: 3241032 - RNA, 20 nt, Human
cugaaccugggaaagagauu

SEQ ID NO: 3241033 - RNA, 19 nt, Human
cugaaccugggaaagagau

SEQ ID NO: 3241034 - RNA, 22 nt, Human
cugaagucacugcacagugcau

SEQ ID NO: 3241035 - RNA, 16 nt, Human
cugaagucacugcaca

SEQ ID NO: 3241036 - RNA, 17 nt, Human
cugaagucacugcacag

SEQ ID NO: 3241037 - RNA, 24 nt, Human
cugaagucuuuguacagacaacaa

SEQ ID NO: 3241038 - RNA, 15 nt, Human
cugaagucacacagu

SEQ ID NO: 3241039 - RNA, 14 nt, Human
cugaagucacacag

SEQ ID NO: 3241040 - RNA, 16 nt, Human
cugaauacagaggcaa

SEQ ID NO: 3241041 - RNA, 19 nt, Human
cugaauaagcacuuuuuaa

SEQ ID NO: 3241042 - RNA, 18 nt, Human
cugaauaagcacuuuuua

SEQ ID NO: 3241043 - RNA, 16 nt, Human
cugaauaagcacuuuu

SEQ ID NO: 3241044 - RNA, 16 nt, Human
cugaauaccaguggag

SEQ ID NO: 3241045 - RNA, 19 nt, Human
cugacagacacaggcccgg

SEQ ID NO: 3241046 - RNA, 14 nt, Human
cugaauuuaucuuu

SEQ ID NO: 3241047 - RNA, 17 nt, Human
cugaauuuaucuuugau

SEQ ID NO: 3241048 - RNA, 16 nt, Human
cugaauuuaucuuuga

SEQ ID NO: 3241049 - RNA, 21 nt, Human
cugaauuggaaugcacucaga

SEQ ID NO: 3241050 - RNA, 23 nt, Human
cugaauugagccuaaaaauaaag

SEQ ID NO: 3241051 - RNA, 22 nt, Human
cugaauugagccuaaaaauaaa

SEQ ID NO: 3241052 - RNA, 21 nt, Human
cugaauugagccuaaaaauaa

SEQ ID NO: 3241053 - RNA, 20 nt, Human
cugaauugagccuaaaaaua

SEQ ID NO: 3241054 - RNA, 21 nt, Human
cugacagacacaggcccggcu

SEQ ID NO: 3241055 - RNA, 17 nt, Human
cugacagacagcccucc

SEQ ID NO: 3241056 - RNA, 19 nt, Human
cugacagacagcccuccau

SEQ ID NO: 3241057 - RNA, 11 nt, Human
cugacaggcaa

SEQ ID NO: 3241058 - RNA, 16 nt, Human
cugacagagggaugga

SEQ ID NO: 3241059 - RNA, 20 nt, Human
cugaauuuaucuuugauaac

SEQ ID NO: 3241060 - RNA, 18 nt, Human
cugaauuuaucuuugaua

SEQ ID NO: 3241061 - RNA, 20 nt, Human
cugaauucaccacagacuuu

SEQ ID NO: 3241062 - RNA, 15 nt, Human
cugaaucuucugaaa

SEQ ID NO: 3241063 - RNA, 15 nt, Human
cugaaucuguacaga

SEQ ID NO: 3241064 - RNA, 14 nt, Human
cugaaucuguacag

SEQ ID NO: 3241065 - RNA, 12 nt, Human
cugaaucuguac

SEQ ID NO: 3241066 - RNA, 13 nt, Human
cugaaucccugua

SEQ ID NO: 3241067 - RNA, 19 nt, Human
cugaauccaaaagaaaaac

SEQ ID NO: 3241068 - RNA, 17 nt, Human
cugaauccaaaagaaaa

SEQ ID NO: 3241069 - RNA, 21 nt, Human
cugaauauugccauuaugcuu

SEQ ID NO: 3241070 - RNA, 19 nt, Human
cugacaggcaaugcuggcu

SEQ ID NO: 3241071 - RNA, 18 nt, Human
cugacaggcaaugcuggc

SEQ ID NO: 3241072 - RNA, 17 nt, Human
cugacaggcaaugcugg

SEQ ID NO: 3241073 - RNA, 16 nt, Human
cugacaggcaaugcug

SEQ ID NO: 3241074 - RNA, 20 nt, Human
cugacaggcaaugcuggcug

SEQ ID NO: 3241075 - RNA, 17 nt, Human
cugacauuguuggccaa

SEQ ID NO: 3241076 - RNA, 11 nt, Human
cugacccacug

SEQ ID NO: 3241077 - RNA, 14 nt, Human
cugaccaugcauuu

SEQ ID NO: 3241078 - RNA, 15 nt, Human
cugaccaugcauuuu

SEQ ID NO: 3241079 - RNA, 17 nt, Human
cucuugaacugagcuug

SEQ ID NO: 3241080 - RNA, 16 nt, Human
cucuugaacugagcuu

SEQ ID NO: 3241081 - RNA, 18 nt, Human
cucuugaacuccugaccu

SEQ ID NO: 3241082 - RNA, 19 nt, Human
cucuugaacugagcuugga

SEQ ID NO: 3241083 - RNA, 15 nt, Human
cucuugaccucaggu

SEQ ID NO: 3241084 - RNA, 13 nt, Human
cucuugaccucag

SEQ ID NO: 3241085 - RNA, 16 nt, Human
cucuugaccucaggug

SEQ ID NO: 3241086 - RNA, 16 nt, Human
cucuugacucuugccu

SEQ ID NO: 3241087 - RNA, 22 nt, Human
cucuuggagccugcagagcugc

SEQ ID NO: 3241088 - RNA, 15 nt, Human
cucuuggagccugca

SEQ ID NO: 3241089 - RNA, 22 nt, Human
cucuugggcaauauucucugua

SEQ ID NO: 3241090 - RNA, 20 nt, Human
cucuugggcaauauucucug

SEQ ID NO: 3241091 - RNA, 16 nt, Human
cucuugggcaauauuc

SEQ ID NO: 3241092 - RNA, 15 nt, Human
cucuugggcaauauu

SEQ ID NO: 3241093 - RNA, 12 nt, Human
cucuugggacau

SEQ ID NO: 3241094 - RNA, 18 nt, Human
cucuugguccugcugcag

SEQ ID NO: 3241095 - RNA, 19 nt, Human
cucuugguccugcugcagu

SEQ ID NO: 3241096 - RNA, 17 nt, Human
cucuugguccugcugca

SEQ ID NO: 3241097 - RNA, 21 nt, Human
cucuuggggacaugggucgcc

SEQ ID NO: 3241098 - RNA, 17 nt, Human
cucuugucuuccuauuu

SEQ ID NO: 3241099 - RNA, 17 nt, Human
cucuuuccaucuacccu

SEQ ID NO: 3241100 - RNA, 15 nt, Human
cucuuucccacccag

SEQ ID NO: 3241101 - RNA, 11 nt, Human
cucuuucagug

SEQ ID NO: 3241102 - RNA, 14 nt, Human
cucuuuauugucug

SEQ ID NO: 3241103 - RNA, 20 nt, Human
cucuuuauugucuguaaauc

SEQ ID NO: 3241104 - RNA, 23 nt, Human
cucuugucuuccuauuucagaag

SEQ ID NO: 3241105 - RNA, 21 nt, Human
cucuugucuuccuauuucaga

SEQ ID NO: 3241106 - RNA, 15 nt, Human
cucuuuggacacuca

SEQ ID NO: 3241107 - RNA, 18 nt, Human
cucuuuggacacucacac

SEQ ID NO: 3241108 - RNA, 17 nt, Human
cucuuucuauuguuucu

SEQ ID NO: 3241109 - RNA, 10 nt, Human
cucuuucccu

SEQ ID NO: 3241110 - RNA, 20 nt, Human
cucuuucccacccagccugg

SEQ ID NO: 3241111 - RNA, 19 nt, Human
cucuuucccacccagccug

SEQ ID NO: 3241112 - RNA, 18 nt, Human
cucuuucccacccagccu

SEQ ID NO: 3241113 - RNA, 17 nt, Human
cucuuucccacccagcc

SEQ ID NO: 3241114 - RNA, 16 nt, Human
cucuggcagcucagag

SEQ ID NO: 3241115 - RNA, 17 nt, Human
cucuggcagcucagaga

SEQ ID NO: 3241116 - RNA, 18 nt, Human
cucuggcagcucagagag

SEQ ID NO: 3241117 - RNA, 19 nt, Human
cucuggcagcucagagagg

SEQ ID NO: 3241118 - RNA, 19 nt, Human
cucuguucugcacacagca

SEQ ID NO: 3241119 - RNA, 20 nt, Human
cucuguucugcacacagcac

SEQ ID NO: 3241120 - RNA, 21 nt, Human
cucuguucugcacacagcacg

SEQ ID NO: 3241121 - RNA, 24 nt, Human
cucuuaaaacccaagugccuuagc

SEQ ID NO: 3241122 - RNA, 20 nt, Human
cucuuaaaagaggaaaauga

SEQ ID NO: 3241123 - RNA, 13 nt, Human
cucuuaaaaccca

SEQ ID NO: 3241124 - RNA, 20 nt, Human
cucuucaguuaagccuuugg

SEQ ID NO: 3241125 - RNA, 23 nt, Human
cucuucaguuaagccuuuggaaa

SEQ ID NO: 3241126 - RNA, 19 nt, Human
cucuucaguuaagccuuug

SEQ ID NO: 3241127 - RNA, 17 nt, Human
cucuucucucugcucug

SEQ ID NO: 3241128 - RNA, 15 nt, Human
cucuucucucugcuc

SEQ ID NO: 3241129 - RNA, 14 nt, Human
cucuucucucugcu

SEQ ID NO: 3241130 - RNA, 21 nt, Human
cucuucuccccuuccauuucu

SEQ ID NO: 3241131 - RNA, 20 nt, Human
cucuucuccccuuccauuuc

SEQ ID NO: 3241132 - RNA, 17 nt, Human
cucuucuccccuuccau

SEQ ID NO: 3241133 - RNA, 16 nt, Human
cucuucuccuuucaca

SEQ ID NO: 3241134 - RNA, 13 nt, Human
cucuucucucaga

SEQ ID NO: 3241135 - RNA, 14 nt, Human
cucuucucucagac

SEQ ID NO: 3241136 - RNA, 23 nt, Human
cucuucucucagaccgucuuccu

SEQ ID NO: 3241137 - RNA, 15 nt, Human
cucuucuccuuucac

SEQ ID NO: 3241138 - RNA, 13 nt, Human
cucuucuccuuuc

SEQ ID NO: 3241139 - RNA, 14 nt, Human
cucuucuggaaugg

SEQ ID NO: 3241140 - RNA, 22 nt, Human
cucuuccaggcugggagagccu

SEQ ID NO: 3241141 - RNA, 21 nt, Human
cucuuccaggcugggagagcc

SEQ ID NO: 3241142 - RNA, 23 nt, Human
cucuuccaggcugggagagccuu

SEQ ID NO: 3241143 - RNA, 17 nt, Human
cucuucauauucagcuu

SEQ ID NO: 3241144 - RNA, 12 nt, Human
cucuucuccagg

SEQ ID NO: 3241145 - RNA, 16 nt, Human
cucuucuccccuucca

SEQ ID NO: 3241146 - RNA, 14 nt, Human
cucuucuccccuuc

SEQ ID NO: 3241147 - RNA, 19 nt, Human
cucuucuccacuggaugga

SEQ ID NO: 3241148 - RNA, 14 nt, Human
cucuucuccacugg

SEQ ID NO: 3241149 - RNA, 17 nt, Human
cucuucuccacuggaug

SEQ ID NO: 3241150 - RNA, 15 nt, Human
cucuucuccacugga

SEQ ID NO: 3241151 - RNA, 16 nt, Human
cucuccacugccuucg

SEQ ID NO: 3241152 - RNA, 18 nt, Human
cucuaaguguuugcugca

SEQ ID NO: 3241153 - RNA, 16 nt, Human
cucuaaggcaggaugu

SEQ ID NO: 3241154 - RNA, 23 nt, Human
cucucaggccagcugcuugggcu

SEQ ID NO: 3241155 - RNA, 22 nt, Human
cucucaggccagcugcuugggc

SEQ ID NO: 3241156 - RNA, 16 nt, Human
cucuccagcaggccca

SEQ ID NO: 3241157 - RNA, 12 nt, Human
cucuccagcagg

SEQ ID NO: 3241158 - RNA, 13 nt, Human
cucuccagccccu

SEQ ID NO: 3241159 - RNA, 12 nt, Human
cucuccagcccc

SEQ ID NO: 3241160 - RNA, 15 nt, Human
cucuccacugccuuc

SEQ ID NO: 3241161 - RNA, 22 nt, Human
cucuccauuuuggugucuuucu

SEQ ID NO: 3241162 - RNA, 18 nt, Human
cucucccaucacuucccu

SEQ ID NO: 3241163 - RNA, 14 nt, Human
cucucccaucacuu

SEQ ID NO: 3241164 - RNA, 20 nt, Human
cucucccaucacuucccuac

SEQ ID NO: 3241165 - RNA, 13 nt, Human
cucucccaucacu

SEQ ID NO: 3241166 - RNA, 15 nt, Human
cucucucacuccuug

SEQ ID NO: 3241167 - RNA, 16 nt, Human
cucucucacuccuuga

SEQ ID NO: 3241168 - RNA, 12 nt, Human
cucucucaggcc

SEQ ID NO: 3241169 - RNA, 17 nt, Human
cucucugaguauuuccu

SEQ ID NO: 3241170 - RNA, 21 nt, Human
cucucugaaggaggccaccuc

SEQ ID NO: 3241171 - RNA, 20 nt, Human
cucucugaaggaggccaccu

SEQ ID NO: 3241172 - RNA, 19 nt, Human
cucucugaaggaggccacc

SEQ ID NO: 3241173 - RNA, 14 nt, Human
cucucucacuccuu

SEQ ID NO: 3241174 - RNA, 15 nt, Human
cucucgcggccucuu

SEQ ID NO: 3241175 - RNA, 22 nt, Human
cucucgcggccucuucucucag

SEQ ID NO: 3241176 - RNA, 23 nt, Human
cucucgcggccucuucucucaga

SEQ ID NO: 3241177 - RNA, 22 nt, Human
cucuggacaggcauguucucug

SEQ ID NO: 3241178 - RNA, 15 nt, Human
cucugcuuuggaaau

SEQ ID NO: 3241179 - RNA, 18 nt, Human
cucugccuuugcucuggu

SEQ ID NO: 3241180 - RNA, 15 nt, Human
cucugccuuugcucu

SEQ ID NO: 3241181 - RNA, 13 nt, Human
cucugccuuugcu

SEQ ID NO: 3241182 - RNA, 14 nt, Human
cucugccucugaca

SEQ ID NO: 3241183 - RNA, 16 nt, Human
cucugccuccucuuca

SEQ ID NO: 3241184 - RNA, 15 nt, Human
cucugccuccucuuc

SEQ ID NO: 3241185 - RNA, 14 nt, Human
cucugcccuccaag

SEQ ID NO: 3241186 - RNA, 15 nt, Human
cucugcccuccaaga

SEQ ID NO: 3241187 - RNA, 16 nt, Human
cucugcccuccaagac

SEQ ID NO: 3241188 - RNA, 23 nt, Human
cucugcccuccaagaccuucucc

SEQ ID NO: 3241189 - RNA, 23 nt, Human
cucugcccuaaugcgcaggcugg

SEQ ID NO: 3241190 - RNA, 11 nt, Human
cucugcccugc

SEQ ID NO: 3241191 - RNA, 12 nt, Human
cucugcccugcg

SEQ ID NO: 3241192 - RNA, 14 nt, Human
cucugccuccucuu

SEQ ID NO: 3241193 - RNA, 22 nt, Human
cucugcccuaaugcgcaggcug

SEQ ID NO: 3241194 - RNA, 21 nt, Human
cucugccccagcuugggcaga

SEQ ID NO: 3241195 - RNA, 15 nt, Human
cucugccccagcuug

SEQ ID NO: 3241196 - RNA, 13 nt, Human
cucugccccagcu

SEQ ID NO: 3241197 - RNA, 22 nt, Human
cucugcccagcuuuucauugcu

SEQ ID NO: 3241198 - RNA, 14 nt, Human
cucugcccagcuuu

SEQ ID NO: 3241199 - RNA, 13 nt, Human
cucugcccagcuu

SEQ ID NO: 3241200 - RNA, 16 nt, Human
cucugcaaaggaaaua

SEQ ID NO: 3241201 - RNA, 19 nt, Human
cucugcaguacuugaugua

SEQ ID NO: 3241202 - RNA, 23 nt, Human
cucugcauacucauuaggauggc

SEQ ID NO: 3241203 - RNA, 22 nt, Human
cucugcaagaauugaagcagga

SEQ ID NO: 3241204 - RNA, 16 nt, Human
cucugauguauuuugu

SEQ ID NO: 3241205 - RNA, 18 nt, Human
cucugauuuauuuuguau

SEQ ID NO: 3241206 - RNA, 13 nt, Human
cucugauguauuu

SEQ ID NO: 3241207 - RNA, 18 nt, Human
cucugauacuuuuuugaa

SEQ ID NO: 3241208 - RNA, 22 nt, Human
cucugauacuuuuuugaaauca

SEQ ID NO: 3241209 - RNA, 20 nt, Human
cucugauacuuuuuugaaau

SEQ ID NO: 3241210 - RNA, 17 nt, Human
cucugauacuuuuuuga

SEQ ID NO: 3241211 - RNA, 17 nt, Human
cucugaugaagaggagu

SEQ ID NO: 3241212 - RNA, 16 nt, Human
cucugaggacacuaac

SEQ ID NO: 3241213 - RNA, 15 nt, Human
cucugagccuuggga

SEQ ID NO: 3241214 - RNA, 16 nt, Human
cucugagcaaaugugg

SEQ ID NO: 3241215 - RNA, 19 nt, Human
cucugaggaugauguacuu

SEQ ID NO: 3241216 - RNA, 13 nt, Human
cucucugcccuaa

SEQ ID NO: 3241217 - RNA, 21 nt, Human
cucucugcccuaaugcgcagg

SEQ ID NO: 3241218 - RNA, 12 nt, Human
cucucugcccua

SEQ ID NO: 3241219 - RNA, 14 nt, Human
cucucugcucugac

SEQ ID NO: 3241220 - RNA, 16 nt, Human
cuuccuaguucauccc

SEQ ID NO: 3241221 - RNA, 20 nt, Human
cuuccuagcuggagaggagc

SEQ ID NO: 3241222 - RNA, 18 nt, Human
cuuccuacucuucucucu

SEQ ID NO: 3241223 - RNA, 16 nt, Human
cuuccuacucuucucu

SEQ ID NO: 3241224 - RNA, 15 nt, Human
cuuccuacucuucuc

SEQ ID NO: 3241225 - RNA, 14 nt, Human
cuuccuacucuucu

SEQ ID NO: 3241226 - RNA, 17 nt, Human
cuuccuagccuugcacu

SEQ ID NO: 3241227 - RNA, 14 nt, Human
cuuccuagccuugc

SEQ ID NO: 3241228 - RNA, 23 nt, Human
cuuccuacucuucucucugcucu

SEQ ID NO: 3241229 - RNA, 22 nt, Human
cuuccuacucuucucucugcuc

SEQ ID NO: 3241230 - RNA, 21 nt, Human
cuuccuacucuucucucugcu

SEQ ID NO: 3241231 - RNA, 19 nt, Human
cuuccuacucuucucucug

SEQ ID NO: 3241232 - RNA, 17 nt, Human
cuuccuugccagucuuu

SEQ ID NO: 3241233 - RNA, 18 nt, Human
cuuccuucuuugcccuuu

SEQ ID NO: 3241234 - RNA, 16 nt, Human
cuuccuucuuugcccu

SEQ ID NO: 3241235 - RNA, 15 nt, Human
cuuccuucuuugccc

SEQ ID NO: 3241236 - RNA, 19 nt, Human
cuuccuuggacucauuuua

SEQ ID NO: 3241237 - RNA, 15 nt, Human
cuucgcuccuguguc

SEQ ID NO: 3241238 - RNA, 14 nt, Human
cuucgcuccugugu

SEQ ID NO: 3241239 - RNA, 13 nt, Human
cuucgcuccugug

SEQ ID NO: 3241240 - RNA, 17 nt, Human
cuucggccuccauccug

SEQ ID NO: 3241241 - RNA, 13 nt, Human
cuucggcauuuga

SEQ ID NO: 3241242 - RNA, 18 nt, Human
cuucggccuccauccuga

SEQ ID NO: 3241243 - RNA, 20 nt, Human
cuucgggaggucgaggcagg

SEQ ID NO: 3241244 - RNA, 21 nt, Human
cuucgggaggucgaggcagga

SEQ ID NO: 3241245 - RNA, 21 nt, Human
cuucuaaaacuguacuuugau

SEQ ID NO: 3241246 - RNA, 20 nt, Human
cuucuaaaacuguacuuuga

SEQ ID NO: 3241247 - RNA, 19 nt, Human
cuucuaaaacuguacuuug

SEQ ID NO: 3241248 - RNA, 18 nt, Human
cuucuaaaacuguacuuu

SEQ ID NO: 3241249 - RNA, 14 nt, Human
cuucuaaaacugua

SEQ ID NO: 3241250 - RNA, 17 nt, Human
cuucugccauauucugu

SEQ ID NO: 3241251 - RNA, 15 nt, Human
cuucugccauauucu

SEQ ID NO: 3241252 - RNA, 12 nt, Human
cuucucucagac

SEQ ID NO: 3241253 - RNA, 21 nt, Human
cuucucucagaccgucuuccu

SEQ ID NO: 3241254 - RNA, 22 nt, Human
cuucucucagaccgucuuccuc

SEQ ID NO: 3241255 - RNA, 23 nt, Human
cuucucucagaccgucuuccucc

SEQ ID NO: 3241256 - RNA, 21 nt, Human
cuucugccauauucuguuggc

SEQ ID NO: 3241257 - RNA, 17 nt, Human
cuucugcuucagccucc

SEQ ID NO: 3241258 - RNA, 16 nt, Human
cuucugcuucagccuc

SEQ ID NO: 3241259 - RNA, 13 nt, Human
cuucugcuucagc

SEQ ID NO: 3241260 - RNA, 18 nt, Human
cuucugcuucagccuccc

SEQ ID NO: 3241261 - RNA, 11 nt, Human
cuucugcuuug

SEQ ID NO: 3241262 - RNA, 22 nt, Human
cuucugcuuuguugugugccuc

SEQ ID NO: 3241263 - RNA, 20 nt, Human
cuucugcuuuguugugugcc

SEQ ID NO: 3241264 - RNA, 15 nt, Human
cuucugcuuuguugu

SEQ ID NO: 3241265 - RNA, 12 nt, Human
cuucugcuuugu

SEQ ID NO: 3241266 - RNA, 22 nt, Human
cuucuccuucaccuuugucccc

SEQ ID NO: 3241267 - RNA, 19 nt, Human
cuucuccuucaccuuuguc

SEQ ID NO: 3241268 - RNA, 17 nt, Human
cuucuccuuucacaacc

SEQ ID NO: 3241269 - RNA, 14 nt, Human
cuucuccuuucaca

SEQ ID NO: 3241270 - RNA, 22 nt, Human
cuucuccuuucacaaccuucug

SEQ ID NO: 3241271 - RNA, 20 nt, Human
cuucuccuuucacaaccuuc

SEQ ID NO: 3241272 - RNA, 15 nt, Human
cuucuccacccugcu

SEQ ID NO: 3241273 - RNA, 14 nt, Human
cuucuccacccugc

SEQ ID NO: 3241274 - RNA, 14 nt, Human
cuucuccaggcugu

SEQ ID NO: 3241275 - RNA, 17 nt, Human
cuucuccaggcuguauc

SEQ ID NO: 3241276 - RNA, 14 nt, Human
cuuccaagagccug

SEQ ID NO: 3241277 - RNA, 19 nt, Human
cuuccaaccauuuaucuug

SEQ ID NO: 3241278 - RNA, 21 nt, Human
cuuccaaccauuuaucuugaa

SEQ ID NO: 3241279 - RNA, 14 nt, Human
cuucauuuggagau

SEQ ID NO: 3241280 - RNA, 13 nt, Human
cuucauuuggaga

SEQ ID NO: 3241281 - RNA, 21 nt, Human
cuuccaaagcagagagcauua

SEQ ID NO: 3241282 - RNA, 15 nt, Human
cuuccaagagccuga

SEQ ID NO: 3241283 - RNA, 22 nt, Human
cuuccacaagagcccaggccuc

SEQ ID NO: 3241284 - RNA, 23 nt, Human
cuuccacaagagcccaggccucc

SEQ ID NO: 3241285 - RNA, 11 nt, Human
cuucagugccu

SEQ ID NO: 3241286 - RNA, 12 nt, Human
cuucagugccuu

SEQ ID NO: 3241287 - RNA, 22 nt, Human
cuucagguaaagggcaaauaau

SEQ ID NO: 3241288 - RNA, 23 nt, Human
cuucagguaaagggcaaauaaug

SEQ ID NO: 3241289 - RNA, 13 nt, Human
cuucagugccuua

SEQ ID NO: 3241290 - RNA, 14 nt, Human
cuucagugccuuau

SEQ ID NO: 3241291 - RNA, 18 nt, Human
cuucauuuccugugucuu

SEQ ID NO: 3241292 - RNA, 19 nt, Human
cuucaaaacaaacagaugc

SEQ ID NO: 3241293 - RNA, 18 nt, Human
cuuauuuuggagagauag

SEQ ID NO: 3241294 - RNA, 23 nt, Human
cuuauuuuuauaacaucuuuauu

SEQ ID NO: 3241295 - RNA, 11 nt, Human
cuucagcugac

SEQ ID NO: 3241296 - RNA, 14 nt, Human
cuucaggcucuucu

SEQ ID NO: 3241297 - RNA, 18 nt, Human
cuucaggcucuucuccuu

SEQ ID NO: 3241298 - RNA, 17 nt, Human
cuucaggcucuucuccu

SEQ ID NO: 3241299 - RNA, 16 nt, Human
cuucaggcucuucucc

SEQ ID NO: 3241300 - RNA, 15 nt, Human
cuucaggcucuucuc

SEQ ID NO: 3241301 - RNA, 16 nt, Human
cuuccacauguuacug

SEQ ID NO: 3241302 - RNA, 12 nt, Human
cuuccagcagga

SEQ ID NO: 3241303 - RNA, 11 nt, Human
cuuccagcagg

SEQ ID NO: 3241304 - RNA, 23 nt, Human
cuuccagcaggagggacagucuc

SEQ ID NO: 3241305 - RNA, 13 nt, Human
cuuccagcaggag

SEQ ID NO: 3241306 - RNA, 21 nt, Human
cuuccaggggugggacacccu

SEQ ID NO: 3241307 - RNA, 22 nt, Human
cuuccaggggugggacacccug

SEQ ID NO: 3241308 - RNA, 24 nt, Human
cuuccaggggugggacacccugug

SEQ ID NO: 3241309 - RNA, 15 nt, Human
cuuccagugaggcuc

SEQ ID NO: 3241310 - RNA, 16 nt, Human
cuucccacucuucuca

SEQ ID NO: 3241311 - RNA, 15 nt, Human
cuucccacucuucuc

SEQ ID NO: 3241312 - RNA, 14 nt, Human
cuucccacucuucu

SEQ ID NO: 3241313 - RNA, 13 nt, Human
cuucccacucugu

SEQ ID NO: 3241314 - RNA, 14 nt, Human
cuuccagugaggcu

SEQ ID NO: 3241315 - RNA, 12 nt, Human
cuucccagggca

SEQ ID NO: 3241316 - RNA, 23 nt, Human
cuucccgccgcccagcccacccc

SEQ ID NO: 3241317 - RNA, 20 nt, Human
cuucccgccgcccagcccac

SEQ ID NO: 3241318 - RNA, 15 nt, Human
cuucccgcucagccc

SEQ ID NO: 3241319 - RNA, 18 nt, Human
cuucccucccugcuguca

SEQ ID NO: 3241320 - RNA, 16 nt, Human
cuucccucccugcugu

SEQ ID NO: 3241321 - RNA, 14 nt, Human
cuucccucccugcu

SEQ ID NO: 3241322 - RNA, 13 nt, Human
cuucccucccugc

SEQ ID NO: 3241323 - RNA, 17 nt, Human
cuucccgcucagcccuc

SEQ ID NO: 3241324 - RNA, 16 nt, Human
cuucccgcucagcccu

SEQ ID NO: 3241325 - RNA, 23 nt, Human
cuuccuaccacccgguccccacu

SEQ ID NO: 3241326 - RNA, 22 nt, Human
cuuccuaccacccgguccccac

SEQ ID NO: 3241327 - RNA, 22 nt, Human
cuuaacugugguguugaggcuu

SEQ ID NO: 3241328 - RNA, 17 nt, Human
cuuaacuguauagcucu

SEQ ID NO: 3241329 - RNA, 14 nt, Human
cuuaaauuccucaa

SEQ ID NO: 3241330 - RNA, 20 nt, Human
cuuaaauuccucaacagugu

SEQ ID NO: 3241331 - RNA, 22 nt, Human
cuuaaauuccucaacaguguuu

SEQ ID NO: 3241332 - RNA, 22 nt, Human
cuuaacccugacaaauuuuaau

SEQ ID NO: 3241333 - RNA, 15 nt, Human
cuuaacccagugucc

SEQ ID NO: 3241334 - RNA, 13 nt, Human
cuuaaauuuuaac

SEQ ID NO: 3241335 - RNA, 16 nt, Human
cuuaaauuuuaacuaa

SEQ ID NO: 3241336 - RNA, 18 nt, Human
cuuaaauuuuaacuaaau

SEQ ID NO: 3241337 - RNA, 23 nt, Human
cuuaaauuuuaacuaaauuuuaa

SEQ ID NO: 3241338 - RNA, 19 nt, Human
cuuaaauuaguacagcacu

SEQ ID NO: 3241339 - RNA, 18 nt, Human
cuuaaauguuauguauau

SEQ ID NO: 3241340 - RNA, 17 nt, Human
cuuaaauguuauguaua

SEQ ID NO: 3241341 - RNA, 16 nt, Human
cuuaaauguuauguau

SEQ ID NO: 3241342 - RNA, 22 nt, Human
cuuaaaugugaauuacuaacuu

SEQ ID NO: 3241343 - RNA, 19 nt, Human
cuuaaaugugaauuacuaa

SEQ ID NO: 3241344 - RNA, 17 nt, Human
cuuaaaugugaauuacu

SEQ ID NO: 3241345 - RNA, 22 nt, Human
cuuaaaugcaaccauuugaaac

SEQ ID NO: 3241346 - RNA, 16 nt, Human
cuuaaaugugaauuac

SEQ ID NO: 3241347 - RNA, 14 nt, Human
cuuaaaugugaauu

SEQ ID NO: 3241348 - RNA, 13 nt, Human
cuuaaaugugaau

SEQ ID NO: 3241349 - RNA, 12 nt, Human
cuuaaaugugaa

SEQ ID NO: 3241350 - RNA, 19 nt, Human
cuuaaaaaaaacucuuuaa

SEQ ID NO: 3241351 - RNA, 18 nt, Human
cuuaaugccacuaaauug

SEQ ID NO: 3241352 - RNA, 22 nt, Human
cuuaaucauuuuuuauauauau

SEQ ID NO: 3241353 - RNA, 18 nt, Human
cuuaaucauuuuuuauau

SEQ ID NO: 3241354 - RNA, 23 nt, Human
cuuaaucauuuuuuauauauaug

SEQ ID NO: 3241355 - RNA, 20 nt, Human
cuuaaugagcaauaucugcu

SEQ ID NO: 3241356 - RNA, 16 nt, Human
cuuaaguuuauacucu

SEQ ID NO: 3241357 - RNA, 21 nt, Human
cuuaaguuaguuccacugaga

SEQ ID NO: 3241358 - RNA, 19 nt, Human
cuuaaguuaguuccacuga

SEQ ID NO: 3241359 - RNA, 12 nt, Human
cuuaaucauuuu

SEQ ID NO: 3241360 - RNA, 11 nt, Human
cuuaauauuuc

SEQ ID NO: 3241361 - RNA, 12 nt, Human
cuuaauauuucu

SEQ ID NO: 3241362 - RNA, 15 nt, Human
cuuaauauuucuuca

SEQ ID NO: 3241363 - RNA, 19 nt, Human
cuuaauauuucuucaaaua

SEQ ID NO: 3241364 - RNA, 20 nt, Human
cuuaauauuucuucaaauau

SEQ ID NO: 3241365 - RNA, 14 nt, Human
cuuaauauuuuuac

SEQ ID NO: 3241366 - RNA, 16 nt, Human
cuuaauauuuuuacau

SEQ ID NO: 3241367 - RNA, 15 nt, Human
cuuaauauuuuuaca

SEQ ID NO: 3241368 - RNA, 12 nt, Human
cuuaagaaauaa

SEQ ID NO: 3241369 - RNA, 11 nt, Human
cuuaagaaaaa

SEQ ID NO: 3241370 - RNA, 16 nt, Human
cuuaagaacugcuuuc

SEQ ID NO: 3241371 - RNA, 15 nt, Human
cuuaagaaauaaauc

SEQ ID NO: 3241372 - RNA, 20 nt, Human
cuuaagugaggaaaucaaag

SEQ ID NO: 3241373 - RNA, 21 nt, Human
cuuaagugaggaaaucaaagu

SEQ ID NO: 3241374 - RNA, 19 nt, Human
cuuaagugaggaaaucaaa

SEQ ID NO: 3241375 - RNA, 18 nt, Human
cuuaagugaggaaaucaa

SEQ ID NO: 3241376 - RNA, 17 nt, Human
cuguuuugaguuccuau

SEQ ID NO: 3241377 - RNA, 17 nt, Human
cuguuuucucuugagag

SEQ ID NO: 3241378 - RNA, 18 nt, Human
cuguuuugugguuuggaa

SEQ ID NO: 3241379 - RNA, 19 nt, Human
cuguuuugugguuuggaau

SEQ ID NO: 3241380 - RNA, 20 nt, Human
cuguuuugugguuuggaaua

SEQ ID NO: 3241381 - RNA, 14 nt, Human
cuguuuugccagcc

SEQ ID NO: 3241382 - RNA, 21 nt, Human
cuguuuguuucugaaagggac

SEQ ID NO: 3241383 - RNA, 23 nt, Human
cuguuuguuucugaaagggacgc

SEQ ID NO: 3241384 - RNA, 13 nt, Human
cuguuuucucuug

SEQ ID NO: 3241385 - RNA, 14 nt, Human
cuguuuucucuuga

SEQ ID NO: 3241386 - RNA, 15 nt, Human
cuguuuacaguguuc

SEQ ID NO: 3241387 - RNA, 13 nt, Human
cuguuuacagugu

SEQ ID NO: 3241388 - RNA, 17 nt, Human
cugguugaugccuguga

SEQ ID NO: 3241389 - RNA, 19 nt, Human
cuguuuacuugaauaguau

SEQ ID NO: 3241390 - RNA, 19 nt, Human
cuguuuaucccuuaagaau

SEQ ID NO: 3241391 - RNA, 18 nt, Human
cuguuuaucccuuaagaa

SEQ ID NO: 3241392 - RNA, 19 nt, Human
cuguuuagucuccuuuuua

SEQ ID NO: 3241393 - RNA, 18 nt, Human
cuguuuguuucugaaagg

SEQ ID NO: 3241394 - RNA, 20 nt, Human
cuguuucuaauuugcugcug

SEQ ID NO: 3241395 - RNA, 18 nt, Human
cuguuucucagucucaca

SEQ ID NO: 3241396 - RNA, 17 nt, Human
cuguuucucagucucac

SEQ ID NO: 3241397 - RNA, 14 nt, Human
cuuaugacuaugua

SEQ ID NO: 3241398 - RNA, 23 nt, Human
cuuaugauagcaaauggccucau

SEQ ID NO: 3241399 - RNA, 15 nt, Human
cuuauuuaaugaaag

SEQ ID NO: 3241400 - RNA, 15 nt, Human
cuuauuuaaucuuuu

SEQ ID NO: 3241401 - RNA, 22 nt, Human
cuuauuuaaucuuuucuuauuu

SEQ ID NO: 3241402 - RNA, 14 nt, Human
cuuaucaaaggaca

SEQ ID NO: 3241403 - RNA, 17 nt, Human
cuuauauuguaagaaau

SEQ ID NO: 3241404 - RNA, 14 nt, Human
cuuauauuguaaga

SEQ ID NO: 3241405 - RNA, 18 nt, Human
cuuauauuguaagaaaua

SEQ ID NO: 3241406 - RNA, 20 nt, Human
cuuauauuuacaacacuuua

SEQ ID NO: 3241407 - RNA, 16 nt, Human
cuuaucaaaggacacc

SEQ ID NO: 3241408 - RNA, 19 nt, Human
cuuaucaaaguagcaaaug

SEQ ID NO: 3241409 - RNA, 14 nt, Human
cuuauauuugugua

SEQ ID NO: 3241410 - RNA, 17 nt, Human
cuuauaaccuaguuaaa

SEQ ID NO: 3241411 - RNA, 19 nt, Human
cuuauaaccuaguuaaaga

SEQ ID NO: 3241412 - RNA, 21 nt, Human
cuuauaaccuaguuaaagaaa

SEQ ID NO: 3241413 - RNA, 22 nt, Human
cuuauaaccuaguuaaagaaag

SEQ ID NO: 3241414 - RNA, 20 nt, Human
cuuaggugauccacucgccu

SEQ ID NO: 3241415 - RNA, 17 nt, Human
cuuaggguuuucucucu

SEQ ID NO: 3241416 - RNA, 17 nt, Human
cuuagguuggcaaaaag

SEQ ID NO: 3241417 - RNA, 20 nt, Human
cuuauaaaacagaguaaucu

SEQ ID NO: 3241418 - RNA, 15 nt, Human
cuuauaaaacagagu

SEQ ID NO: 3241419 - RNA, 21 nt, Human
cuuauaaaacagaguaaucuu

SEQ ID NO: 3241420 - RNA, 19 nt, Human
cuuauaggaauugacccac

SEQ ID NO: 3241421 - RNA, 13 nt, Human
cuuagaucauagu

SEQ ID NO: 3241422 - RNA, 16 nt, Human
cuuagaucauaguuuu

SEQ ID NO: 3241423 - RNA, 17 nt, Human
cuuagaucauaguuuua

SEQ ID NO: 3241424 - RNA, 18 nt, Human
cuuagaucauaguuuuau

SEQ ID NO: 3241425 - RNA, 19 nt, Human
cuuagaucauaguuuuauu

SEQ ID NO: 3241426 - RNA, 21 nt, Human
cuuagaucauaguuuuauuua

SEQ ID NO: 3241427 - RNA, 22 nt, Human
cuuagaucauaguuuuauuuau

SEQ ID NO: 3241428 - RNA, 17 nt, Human
cuuagacagucccugcc

SEQ ID NO: 3241429 - RNA, 18 nt, Human
cuuagacagucccugcca

SEQ ID NO: 3241430 - RNA, 19 nt, Human
cuuagacagucccugccaa

SEQ ID NO: 3241431 - RNA, 11 nt, Human
cuuagacaguc

SEQ ID NO: 3241432 - RNA, 15 nt, Human
cuuagacagucccug

SEQ ID NO: 3241433 - RNA, 16 nt, Human
cuuagacagucccugc

SEQ ID NO: 3241434 - RNA, 14 nt, Human
cuuagacagucccu

SEQ ID NO: 3241435 - RNA, 15 nt, Human
cuuagaagucacaca

SEQ ID NO: 3241436 - RNA, 15 nt, Human
cuuagaaccuuucuu

SEQ ID NO: 3241437 - RNA, 16 nt, Human
cuuagaagaauauugu

SEQ ID NO: 3241438 - RNA, 17 nt, Human
cuuagaagaauauugua

SEQ ID NO: 3241439 - RNA, 21 nt, Human
cuuagaagaauauuguauugu

SEQ ID NO: 3241440 - RNA, 21 nt, Human
cuuagaagguauuaagauuau

SEQ ID NO: 3241441 - RNA, 14 nt, Human
cuuagaagguauua

SEQ ID NO: 3241442 - RNA, 20 nt, Human
cuuagaacaguggaaacuau

SEQ ID NO: 3241443 - RNA, 17 nt, Human
cuuagaaauugcauuuc

SEQ ID NO: 3241444 - RNA, 16 nt, Human
cuuagaaauugcauuu

SEQ ID NO: 3241445 - RNA, 15 nt, Human
cuuacuuuguaaauu

SEQ ID NO: 3241446 - RNA, 17 nt, Human
cuuacuuuguaaauucu

SEQ ID NO: 3241447 - RNA, 19 nt, Human
cuuacuuuguaaauucuga

SEQ ID NO: 3241448 - RNA, 20 nt, Human
cuuacuuuguaaauucugau

SEQ ID NO: 3241449 - RNA, 21 nt, Human
cuuacuuuguaaauucugauu

SEQ ID NO: 3241450 - RNA, 21 nt, Human
cuuacuuuuaaggauaaauca

SEQ ID NO: 3241451 - RNA, 14 nt, Human
cuuaauggaugaaa

SEQ ID NO: 3241452 - RNA, 19 nt, Human
cuuaauggaugaaaucaua

SEQ ID NO: 3241453 - RNA, 19 nt, Human
cuuacuaguuucccuugca

SEQ ID NO: 3241454 - RNA, 15 nt, Human
cuuacgugaguccug

SEQ ID NO: 3241455 - RNA, 18 nt, Human
cuuacuuuccugaaaaua

SEQ ID NO: 3241456 - RNA, 19 nt, Human
cuuacuuuaccucucuguc

SEQ ID NO: 3241457 - RNA, 20 nt, Human
cuuacuuuaccucucuguca

SEQ ID NO: 3241458 - RNA, 12 nt, Human
cuuacuuuguaa

SEQ ID NO: 3241459 - RNA, 14 nt, Human
cuuacuuuguaaau

SEQ ID NO: 3241460 - RNA, 11 nt, Human
cuuacuuugua

SEQ ID NO: 3241461 - RNA, 22 nt, Human
cuuugacacuuuucauaucauu

SEQ ID NO: 3241462 - RNA, 22 nt, Human
cuuugacagcgcacagcugcuc

SEQ ID NO: 3241463 - RNA, 20 nt, Human
cuuugacagcgcacagcugc

SEQ ID NO: 3241464 - RNA, 19 nt, Human
cuuugacagcgcacagcug

SEQ ID NO: 3241465 - RNA, 19 nt, Human
cuuugaauuuucauuuuac

SEQ ID NO: 3241466 - RNA, 21 nt, Human
cuuugaauuuucauuuuacag

SEQ ID NO: 3241467 - RNA, 20 nt, Human
cuuugaauuuucauuuuaca

SEQ ID NO: 3241468 - RNA, 20 nt, Human
cuuugcauugucugucugca

SEQ ID NO: 3241469 - RNA, 17 nt, Human
cuuugccaaaaagcaua

SEQ ID NO: 3241470 - RNA, 23 nt, Human
cuuuggaaagacuuuuccaaccc

SEQ ID NO: 3241471 - RNA, 12 nt, Human
cuuuggaaagac

SEQ ID NO: 3241472 - RNA, 15 nt, Human
cuuuguucuggcucu

SEQ ID NO: 3241473 - RNA, 15 nt, Human
cuuuguggugagaau

SEQ ID NO: 3241474 - RNA, 16 nt, Human
cuuuguucuggcucuu

SEQ ID NO: 3241475 - RNA, 21 nt, Human
cuuuguucuggcucuuccagg

SEQ ID NO: 3241476 - RNA, 19 nt, Human
cuuugugaggaagccgcug

SEQ ID NO: 3241477 - RNA, 13 nt, Human
cuuuguggcuucc

SEQ ID NO: 3241478 - RNA, 23 nt, Human
cuuugugaggaagccgcuggggc

SEQ ID NO: 3241479 - RNA, 23 nt, Human
cuuugggaggccaaggugggagg

SEQ ID NO: 3241480 - RNA, 16 nt, Human
cuuuggcacucugacu

SEQ ID NO: 3241481 - RNA, 14 nt, Human
cuuucugucucucu

SEQ ID NO: 3241482 - RNA, 13 nt, Human
cuuucuguguuua

SEQ ID NO: 3241483 - RNA, 15 nt, Human
cuuucuguuaaaaug

SEQ ID NO: 3241484 - RNA, 14 nt, Human
cuuucuguuaaaau

SEQ ID NO: 3241485 - RNA, 13 nt, Human
cuuucuguuaaaa

SEQ ID NO: 3241486 - RNA, 19 nt, Human
cuuucuguguuuauucaaa

SEQ ID NO: 3241487 - RNA, 16 nt, Human
cuuucuuccucugcug

SEQ ID NO: 3241488 - RNA, 19 nt, Human
cuuucuguuaaaaugcaug

SEQ ID NO: 3241489 - RNA, 16 nt, Human
cuuucuguuaaaaugc

SEQ ID NO: 3241490 - RNA, 17 nt, Human
cuuucugaucuucacua

SEQ ID NO: 3241491 - RNA, 16 nt, Human
cuuucugcacacaaau

SEQ ID NO: 3241492 - RNA, 19 nt, Human
cuuucugcacacaaauauu

SEQ ID NO: 3241493 - RNA, 16 nt, Human
cuuugaaaauauauac

SEQ ID NO: 3241494 - RNA, 19 nt, Human
cuuucuuuuuuuuuuuuga

SEQ ID NO: 3241495 - RNA, 15 nt, Human
cuuucuuuucuuucu

SEQ ID NO: 3241496 - RNA, 10 nt, Human
cuuucuuuuu

SEQ ID NO: 3241497 - RNA, 19 nt, Human
cuuucuugcucccugacug

SEQ ID NO: 3241498 - RNA, 15 nt, Human
cuuucuugcucccug

SEQ ID NO: 3241499 - RNA, 14 nt, Human
cuuucuugcucccu

SEQ ID NO: 3241500 - RNA, 13 nt, Human
cuuucuugcuccc

SEQ ID NO: 3241501 - RNA, 14 nt, Human
cuuucuucuuccca

SEQ ID NO: 3241502 - RNA, 16 nt, Human
cuuucuucuuccacac

SEQ ID NO: 3241503 - RNA, 12 nt, Human
cuuucuucuccc

SEQ ID NO: 3241504 - RNA, 19 nt, Human
cuuuccucaaaacuucaga

SEQ ID NO: 3241505 - RNA, 13 nt, Human
cuuuagguuuuuu

SEQ ID NO: 3241506 - RNA, 18 nt, Human
cuuuagguuuuuuuaaug

SEQ ID NO: 3241507 - RNA, 20 nt, Human
cuuuagguuuuuuuaaugau

SEQ ID NO: 3241508 - RNA, 22 nt, Human
cuuuagguuuuuuuaaugauau

SEQ ID NO: 3241509 - RNA, 15 nt, Human
cuuuagcgcccaguu

SEQ ID NO: 3241510 - RNA, 21 nt, Human
cuuuaggcauaugcuucuuua

SEQ ID NO: 3241511 - RNA, 15 nt, Human
cuuuagcuuucugag

SEQ ID NO: 3241512 - RNA, 18 nt, Human
cuuuagcuuauuuuuaca

SEQ ID NO: 3241513 - RNA, 14 nt, Human
cuuuagcuguguua

SEQ ID NO: 3241514 - RNA, 14 nt, Human
cuuuagcugacaga

SEQ ID NO: 3241515 - RNA, 17 nt, Human
cuuuagacuugaaaaga

SEQ ID NO: 3241516 - RNA, 21 nt, Human
cuuuagacuugaaaagagaca

SEQ ID NO: 3241517 - RNA, 20 nt, Human
cuuuagagaagauggauaug

SEQ ID NO: 3241518 - RNA, 14 nt, Human
cuuuagagaagaug

SEQ ID NO: 3241519 - RNA, 18 nt, Human
cuuuccuccuucacuguu

SEQ ID NO: 3241520 - RNA, 19 nt, Human
cuuuccuccuucacuguuu

SEQ ID NO: 3241521 - RNA, 21 nt, Human
cuuucugagcaagaggauuuu

SEQ ID NO: 3241522 - RNA, 16 nt, Human
gaaaaguaauauuuau

SEQ ID NO: 3241523 - RNA, 17 nt, Human
gaaaaguaauauuuauu

SEQ ID NO: 3241524 - RNA, 19 nt, Human
gaaaaguaauauuuauuaa

SEQ ID NO: 3241525 - RNA, 20 nt, Human
gaaaaguaauauuuauuaaa

SEQ ID NO: 3241526 - RNA, 14 nt, Human
gaaaaguaauauuu

SEQ ID NO: 3241527 - RNA, 22 nt, Human
gaaaagucaaggguaggguggg

SEQ ID NO: 3241528 - RNA, 13 nt, Human
gaaaaccuagaaa

SEQ ID NO: 3241529 - RNA, 15 nt, Human
gaaaaccccuuccca

SEQ ID NO: 3241530 - RNA, 16 nt, Human
gaaaacauggaacagu

SEQ ID NO: 3241531 - RNA, 17 nt, Human
gaaaagggaguuuaaaa

SEQ ID NO: 3241532 - RNA, 22 nt, Human
gaaaagggaguuuaaaaauggu

SEQ ID NO: 3241533 - RNA, 13 nt, Human
gaaaagguugaau

SEQ ID NO: 3241534 - RNA, 16 nt, Human
gaaaagguugaauaau

SEQ ID NO: 3241535 - RNA, 19 nt, Human
gaaaagguugaauaauaua

SEQ ID NO: 3241536 - RNA, 19 nt, Human
gaaaaggugauaaaaucau

SEQ ID NO: 3241537 - RNA, 18 nt, Human
gaaaaggugauaaaauca

SEQ ID NO: 3241538 - RNA, 15 nt, Human
gaaaaccuagaaaac

SEQ ID NO: 3241539 - RNA, 18 nt, Human
gaaaacgauuuaauuuau

SEQ ID NO: 3241540 - RNA, 17 nt, Human
gaaaacgauuuaauuua

SEQ ID NO: 3241541 - RNA, 20 nt, Human
gaaaacacuguucucugccc

SEQ ID NO: 3241542 - RNA, 21 nt, Human
gaaaacacuguucucugcccu

SEQ ID NO: 3241543 - RNA, 18 nt, Human
gaaaacacuguucucugc

SEQ ID NO: 3241544 - RNA, 22 nt, Human
gaaaacaaaaccaaaaguuauu

SEQ ID NO: 3241545 - RNA, 19 nt, Human
gaaaacacuguucucugcc

SEQ ID NO: 3241546 - RNA, 19 nt, Human
gaaaacaaaaccaaaaguu

SEQ ID NO: 3241547 - RNA, 18 nt, Human
gaaaaauuugaaaaugau

SEQ ID NO: 3241548 - RNA, 14 nt, Human
gaaaaauuucacga

SEQ ID NO: 3241549 - RNA, 15 nt, Human
gaaaaauuucacgau

SEQ ID NO: 3241550 - RNA, 20 nt, Human
gaaaaauaucuguaagagug

SEQ ID NO: 3241551 - RNA, 12 nt, Human
gaaaaauaugug

SEQ ID NO: 3241552 - RNA, 13 nt, Human
cuuuuuuacaaag

SEQ ID NO: 3241553 - RNA, 21 nt, Human
gaaaaaucaaguauuauaaac

SEQ ID NO: 3241554 - RNA, 20 nt, Human
gaaaaauauuuaauguugaa

SEQ ID NO: 3241555 - RNA, 16 nt, Human
gaaaaauauuuaaugu

SEQ ID NO: 3241556 - RNA, 15 nt, Human
gaaaaauauuuaaug

SEQ ID NO: 3241557 - RNA, 20 nt, Human
gaaaaaucaaguauuauaaa

SEQ ID NO: 3241558 - RNA, 13 nt, Human
gaaaaauauguga

SEQ ID NO: 3241559 - RNA, 15 nt, Human
gaaaaauaugugaag

SEQ ID NO: 3241560 - RNA, 14 nt, Human
gaaaaauaugugaa

SEQ ID NO: 3241561 - RNA, 10 nt, Human
gaaaaauauu

SEQ ID NO: 3241562 - RNA, 16 nt, Human
gaaaaauaugugaagg

SEQ ID NO: 3241563 - RNA, 18 nt, Human
cuuuuugcucuaaaauau

SEQ ID NO: 3241564 - RNA, 16 nt, Human
cuuuuugcucuaaaau

SEQ ID NO: 3241565 - RNA, 15 nt, Human
cuuuuugcucuaaaa

SEQ ID NO: 3241566 - RNA, 14 nt, Human
cuuuuuuaaauuaa

SEQ ID NO: 3241567 - RNA, 15 nt, Human
cuuuuuuaaauuaau

SEQ ID NO: 3241568 - RNA, 16 nt, Human
cuuuuuuaaauuaaua

SEQ ID NO: 3241569 - RNA, 11 nt, Human
cuuuuuggaau

SEQ ID NO: 3241570 - RNA, 12 nt, Human
cuuuuuggaauc

SEQ ID NO: 3241571 - RNA, 18 nt, Human
cuuuuuggaaucuuugua

SEQ ID NO: 3241572 - RNA, 14 nt, Human
cuuuuugcucuaaa

SEQ ID NO: 3241573 - RNA, 18 nt, Human
cuuuuugaaucuuuaauu

SEQ ID NO: 3241574 - RNA, 13 nt, Human
cuuuuugaaucuu

SEQ ID NO: 3241575 - RNA, 17 nt, Human
cuuuuugaaucuuuaau

SEQ ID NO: 3241576 - RNA, 15 nt, Human
cuuuuugaaucuuua

SEQ ID NO: 3241577 - RNA, 21 nt, Human
cuuuuguuuuuugaaguguug

SEQ ID NO: 3241578 - RNA, 23 nt, Human
cuuuuuaaagcuuuugauguggu

SEQ ID NO: 3241579 - RNA, 19 nt, Human
cuuuuguuuuuugaagugu

SEQ ID NO: 3241580 - RNA, 18 nt, Human
cuuuuguuuuuugaagug

SEQ ID NO: 3241581 - RNA, 17 nt, Human
cuuuuguuuuuugaagu

SEQ ID NO: 3241582 - RNA, 13 nt, Human
cuuuuguuuuuug

SEQ ID NO: 3241583 - RNA, 15 nt, Human
cuuuuguuuugcuuu

SEQ ID NO: 3241584 - RNA, 14 nt, Human
cuuuuguuuugcuu

SEQ ID NO: 3241585 - RNA, 15 nt, Human
cuuuuguuguuucuu

SEQ ID NO: 3241586 - RNA, 17 nt, Human
cuuuuguuguuucuuaa

SEQ ID NO: 3241587 - RNA, 15 nt, Human
cuuuucuguuugcua

SEQ ID NO: 3241588 - RNA, 23 nt, Human
cuuuucuguccgagcuuugaaaa

SEQ ID NO: 3241589 - RNA, 11 nt, Human
cuuuucuuauu

SEQ ID NO: 3241590 - RNA, 17 nt, Human
cuuuucuuauuuuugua

SEQ ID NO: 3241591 - RNA, 18 nt, Human
cuuuucuguguuuacaga

SEQ ID NO: 3241592 - RNA, 13 nt, Human
cuuuucuguguuu

SEQ ID NO: 3241593 - RNA, 22 nt, Human
cuuuucuguguuuacagagaug

SEQ ID NO: 3241594 - RNA, 22 nt, Human
cuuuguugugugccucuagcug

SEQ ID NO: 3241595 - RNA, 21 nt, Human
cuuuguuuguugucagcugaa

SEQ ID NO: 3241596 - RNA, 17 nt, Human
cuuuguuuuacugucuu

SEQ ID NO: 3241597 - RNA, 20 nt, Human
cuuuguuuguugucagcuga

SEQ ID NO: 3241598 - RNA, 18 nt, Human
cuuuguugugugccucua

SEQ ID NO: 3241599 - RNA, 17 nt, Human
cuuuguugugugccucu

SEQ ID NO: 3241600 - RNA, 13 nt, Human
cuuuguugugugc

SEQ ID NO: 3241601 - RNA, 22 nt, Human
cuuuguugaacuguuagaaugu

SEQ ID NO: 3241602 - RNA, 17 nt, Human
cuuuguugaacuguuag

SEQ ID NO: 3241603 - RNA, 16 nt, Human
cuuuguugaaagaaag

SEQ ID NO: 3241604 - RNA, 13 nt, Human
cuuuguugaaaga

SEQ ID NO: 3241605 - RNA, 14 nt, Human
cuuggaagcuccgc

SEQ ID NO: 3241606 - RNA, 20 nt, Human
cuuggaagcuccgcuuucua

SEQ ID NO: 3241607 - RNA, 20 nt, Human
cuugcuucaaccccaugaga

SEQ ID NO: 3241608 - RNA, 16 nt, Human
cuugcugcacucuugc

SEQ ID NO: 3241609 - RNA, 17 nt, Human
cuugcugcacucuugca

SEQ ID NO: 3241610 - RNA, 21 nt, Human
cuugcugcacucuugcacaug

SEQ ID NO: 3241611 - RNA, 23 nt, Human
cuugcugcacucuugcacaugga

SEQ ID NO: 3241612 - RNA, 22 nt, Human
cuugcccuguuaaaagaugaaa

SEQ ID NO: 3241613 - RNA, 16 nt, Human
cuugccccaacccuuc

SEQ ID NO: 3241614 - RNA, 22 nt, Human
cuugcucugcugacagacacag

SEQ ID NO: 3241615 - RNA, 17 nt, Human
cuugcucugcugacaga

SEQ ID NO: 3241616 - RNA, 21 nt, Human
cuugcccaugcugggcucccg

SEQ ID NO: 3241617 - RNA, 17 nt, Human
cuugcccaugcugggcu

SEQ ID NO: 3241618 - RNA, 18 nt, Human
cuugcccuggugccucac

SEQ ID NO: 3241619 - RNA, 14 nt, Human
cuugcccuguuaaa

SEQ ID NO: 3241620 - RNA, 12 nt, Human
cuugccagucuu

SEQ ID NO: 3241621 - RNA, 22 nt, Human
cuugccagcugcugagccgcag

SEQ ID NO: 3241622 - RNA, 13 nt, Human
cuugcaugaggcu

SEQ ID NO: 3241623 - RNA, 14 nt, Human
cuugcaugaggcua

SEQ ID NO: 3241624 - RNA, 23 nt, Human
cuugcaucaauuuuucuuauuuc

SEQ ID NO: 3241625 - RNA, 21 nt, Human
cuugcagacucuacagaggcc

SEQ ID NO: 3241626 - RNA, 20 nt, Human
cuugcagacucuacagaggc

SEQ ID NO: 3241627 - RNA, 12 nt, Human
cuugcacauuug

SEQ ID NO: 3241628 - RNA, 14 nt, Human
cuugcacacaucau

SEQ ID NO: 3241629 - RNA, 13 nt, Human
cuugcacacauca

SEQ ID NO: 3241630 - RNA, 23 nt, Human
cuugcacacaucaucuguaagcu

SEQ ID NO: 3241631 - RNA, 20 nt, Human
cuugcacacaucaucuguaa

SEQ ID NO: 3241632 - RNA, 19 nt, Human
cuugcacacaucaucugua

SEQ ID NO: 3241633 - RNA, 18 nt, Human
cuugcacacaucaucugu

SEQ ID NO: 3241634 - RNA, 20 nt, Human
cuugaguugauucagcucug

SEQ ID NO: 3241635 - RNA, 20 nt, Human
cuugaggggagccaggaggg

SEQ ID NO: 3241636 - RNA, 17 nt, Human
cuugaggggagccagga

SEQ ID NO: 3241637 - RNA, 18 nt, Human
cuugaguugauucagcuc

SEQ ID NO: 3241638 - RNA, 19 nt, Human
cuugaguugauucagcucu

SEQ ID NO: 3241639 - RNA, 18 nt, Human
cuugcaauggcagccuug

SEQ ID NO: 3241640 - RNA, 17 nt, Human
cuugcaauggcagccuu

SEQ ID NO: 3241641 - RNA, 16 nt, Human
cuugcaauggcagccu

SEQ ID NO: 3241642 - RNA, 15 nt, Human
cuugcaauggcagcc

SEQ ID NO: 3241643 - RNA, 12 nt, Human
cuugagccuggg

SEQ ID NO: 3241644 - RNA, 15 nt, Human
cuugagccugggagg

SEQ ID NO: 3241645 - RNA, 17 nt, Human
cuugaggguugggcugg

SEQ ID NO: 3241646 - RNA, 15 nt, Human
cuugaggguugggcu

SEQ ID NO: 3241647 - RNA, 16 nt, Human
cuugaggggagccagg

SEQ ID NO: 3241648 - RNA, 17 nt, Human
cuucuggcacuuggaga

SEQ ID NO: 3241649 - RNA, 14 nt, Human
cuuguagauuugau

SEQ ID NO: 3241650 - RNA, 15 nt, Human
cuuguagauuugauu

SEQ ID NO: 3241651 - RNA, 20 nt, Human
cuuguaauguaacugcucuu

SEQ ID NO: 3241652 - RNA, 13 nt, Human
cuuguaauguaac

SEQ ID NO: 3241653 - RNA, 15 nt, Human
cuuguaauguaacug

SEQ ID NO: 3241654 - RNA, 14 nt, Human
cuuguaauguaacu

SEQ ID NO: 3241655 - RNA, 15 nt, Human
cuuggggccuaugca

SEQ ID NO: 3241656 - RNA, 15 nt, Human
cuugggggaaaauac

SEQ ID NO: 3241657 - RNA, 18 nt, Human
cuugggcucugcugaguc

SEQ ID NO: 3241658 - RNA, 14 nt, Human
cuugggcucugcug

SEQ ID NO: 3241659 - RNA, 13 nt, Human
cuugggcucugcu

SEQ ID NO: 3241660 - RNA, 18 nt, Human
cuugggccgagccugccu

SEQ ID NO: 3241661 - RNA, 15 nt, Human
cuuggaagcuucugg

SEQ ID NO: 3241662 - RNA, 15 nt, Human
cuuggaagcuguuug

SEQ ID NO: 3241663 - RNA, 16 nt, Human
cuuggaagcuguuugg

SEQ ID NO: 3241664 - RNA, 19 nt, Human
cuuggaagcuguuuggaaa

SEQ ID NO: 3241665 - RNA, 20 nt, Human
cuuggaagcuguuuggaaaa

SEQ ID NO: 3241666 - RNA, 16 nt, Human
cuuggacucauuuuaa

SEQ ID NO: 3241667 - RNA, 22 nt, Human
cuuggagccaauggagacuguc

SEQ ID NO: 3241668 - RNA, 18 nt, Human
cuugggccacugugaaga

SEQ ID NO: 3241669 - RNA, 20 nt, Human
cuugggccacugugaagaga

SEQ ID NO: 3241670 - RNA, 20 nt, Human
cuugggagugugguuucuuu

SEQ ID NO: 3241671 - RNA, 17 nt, Human
cuugggauccaggcccc

SEQ ID NO: 3241672 - RNA, 19 nt, Human
cuugggcaauauucucugu

SEQ ID NO: 3241673 - RNA, 15 nt, Human
cuugggcaauauucu

SEQ ID NO: 3241674 - RNA, 13 nt, Human
cuugggcaauauu

SEQ ID NO: 3241675 - RNA, 21 nt, Human
cuugggcaauauucucuguac

SEQ ID NO: 3241676 - RNA, 20 nt, Human
cuugggcaauauucucugua

SEQ ID NO: 3241677 - RNA, 22 nt, Human
cuugggcaauauucucuguaca

SEQ ID NO: 3241678 - RNA, 19 nt, Human
cuuuaaaaaagcuauaaau

SEQ ID NO: 3241679 - RNA, 14 nt, Human
cuuguuuauuaaau

SEQ ID NO: 3241680 - RNA, 12 nt, Human
cuuguuucuccc

SEQ ID NO: 3241681 - RNA, 12 nt, Human
cuuguugacaga

SEQ ID NO: 3241682 - RNA, 15 nt, Human
cuuguugaauuuauu

SEQ ID NO: 3241683 - RNA, 20 nt, Human
cuuguucuuccaaagcagag

SEQ ID NO: 3241684 - RNA, 18 nt, Human
cuuguucuuccaaagcag

SEQ ID NO: 3241685 - RNA, 13 nt, Human
cuuguucuuccaa

SEQ ID NO: 3241686 - RNA, 20 nt, Human
cuuguugccuauaagccaaa

SEQ ID NO: 3241687 - RNA, 12 nt, Human
cuuuagacuuga

SEQ ID NO: 3241688 - RNA, 13 nt, Human
cuuuagacuugaa

SEQ ID NO: 3241689 - RNA, 14 nt, Human
cuuuagacuugaaa

SEQ ID NO: 3241690 - RNA, 15 nt, Human
cuuuagacuugaaaa

SEQ ID NO: 3241691 - RNA, 17 nt, Human
cuuuaccugugaagugu

SEQ ID NO: 3241692 - RNA, 16 nt, Human
cuuuaccucucuguca

SEQ ID NO: 3241693 - RNA, 22 nt, Human
cuuuaaaaaauuaaucugggcc

SEQ ID NO: 3241694 - RNA, 22 nt, Human
cuuuaaaaaagcuauaaauuau

SEQ ID NO: 3241695 - RNA, 21 nt, Human
cuuuaaaaagcuccaaaugca

SEQ ID NO: 3241696 - RNA, 13 nt, Human
cuuuaaaaacugu

SEQ ID NO: 3241697 - RNA, 14 nt, Human
cuuuaaaaacuguu

SEQ ID NO: 3241698 - RNA, 15 nt, Human
cuuuaaaaauuuacu

SEQ ID NO: 3241699 - RNA, 12 nt, Human
cuuguucuucca

SEQ ID NO: 3241700 - RNA, 14 nt, Human
cuuguucuuacuuu

SEQ ID NO: 3241701 - RNA, 16 nt, Human
cuuguuaagauaguua

SEQ ID NO: 3241702 - RNA, 21 nt, Human
cuugugggugugagcagcacc

SEQ ID NO: 3241703 - RNA, 14 nt, Human
cuugugguccaaau

SEQ ID NO: 3241704 - RNA, 15 nt, Human
cuugugguccaaaua

SEQ ID NO: 3241705 - RNA, 16 nt, Human
cuuguggucccacccc

SEQ ID NO: 3241706 - RNA, 19 nt, Human
cuuguggucccaccccaca

SEQ ID NO: 3241707 - RNA, 15 nt, Human
cuuguggucccaccc

SEQ ID NO: 3241708 - RNA, 17 nt, Human
cuuguagauuugauuuu

SEQ ID NO: 3241709 - RNA, 22 nt, Human
gaagggguaggauuacuaggug

SEQ ID NO: 3241710 - RNA, 16 nt, Human
gaagggggcugggaca

SEQ ID NO: 3241711 - RNA, 19 nt, Human
gaagggggcugggacaugg

SEQ ID NO: 3241712 - RNA, 14 nt, Human
gaagcggcuggcag

SEQ ID NO: 3241713 - RNA, 15 nt, Human
gaagggggcugggac

SEQ ID NO: 3241714 - RNA, 22 nt, Human
gaagguggccuuccugcuguua

SEQ ID NO: 3241715 - RNA, 15 nt, Human
gaaguacuggagaaa

SEQ ID NO: 3241716 - RNA, 12 nt, Human
gaaguagcacag

SEQ ID NO: 3241717 - RNA, 16 nt, Human
gaaguaccuuaucaaa

SEQ ID NO: 3241718 - RNA, 18 nt, Human
gaaguacuauaauuuacc

SEQ ID NO: 3241719 - RNA, 14 nt, Human
gaaguauccuucag

SEQ ID NO: 3241720 - RNA, 14 nt, Human
gaaguagcuuugca

SEQ ID NO: 3241721 - RNA, 18 nt, Human
gaaguagcacaggcugag

SEQ ID NO: 3241722 - RNA, 16 nt, Human
gaaguagcacaggcug

SEQ ID NO: 3241723 - RNA, 15 nt, Human
gaaguagcacaggcu

SEQ ID NO: 3241724 - RNA, 13 nt, Human
gaaguagcacagg

SEQ ID NO: 3241725 - RNA, 16 nt, Human
gaaguaggggaagaau

SEQ ID NO: 3241726 - RNA, 18 nt, Human
gaaguagggguggcccga

SEQ ID NO: 3241727 - RNA, 21 nt, Human
gaaguaggggaagaauaauuu

SEQ ID NO: 3241728 - RNA, 23 nt, Human
gaaguagugucuggaucaguaaa

SEQ ID NO: 3241729 - RNA, 21 nt, Human
gaagucaugcuccccugugcc

SEQ ID NO: 3241730 - RNA, 16 nt, Human
gaaguauccuucagcc

SEQ ID NO: 3241731 - RNA, 21 nt, Human
gaaguuucugccgcagcccug

SEQ ID NO: 3241732 - RNA, 15 nt, Human
gaagucuuagaugua

SEQ ID NO: 3241733 - RNA, 20 nt, Human
gaaguuucugccgcagcccu

SEQ ID NO: 3241734 - RNA, 17 nt, Human
gaauauuugaauguaug

SEQ ID NO: 3241735 - RNA, 19 nt, Human
gaauagggcccaugggagg

SEQ ID NO: 3241736 - RNA, 21 nt, Human
gaauagggcccaugggaggga

SEQ ID NO: 3241737 - RNA, 16 nt, Human
gaauauuuuaacuucc

SEQ ID NO: 3241738 - RNA, 17 nt, Human
gaaucaaauaaaaauuc

SEQ ID NO: 3241739 - RNA, 22 nt, Human
gaauagcugggacuacaggugu

SEQ ID NO: 3241740 - RNA, 23 nt, Human
gaauagcugggacuacaggugug

SEQ ID NO: 3241741 - RNA, 21 nt, Human
gaauaggacuuguuuuuguuu

SEQ ID NO: 3241742 - RNA, 19 nt, Human
gaauaggacuuguuuuugu

SEQ ID NO: 3241743 - RNA, 18 nt, Human
gaauaggacuuguuuuug

SEQ ID NO: 3241744 - RNA, 22 nt, Human
gaauagcuuuaaugauaugcuu

SEQ ID NO: 3241745 - RNA, 15 nt, Human
gaauaccuguccccc

SEQ ID NO: 3241746 - RNA, 13 nt, Human
gaauaccuguccc

SEQ ID NO: 3241747 - RNA, 17 nt, Human
gaauaauacaguaucuc

SEQ ID NO: 3241748 - RNA, 17 nt, Human
gaauaagcacuuuuuaa

SEQ ID NO: 3241749 - RNA, 16 nt, Human
gaauaagcacuuuuua

SEQ ID NO: 3241750 - RNA, 21 nt, Human
gaauacagaggcaacugcauu

SEQ ID NO: 3241751 - RNA, 19 nt, Human
gaauaacauguaauuaagu

SEQ ID NO: 3241752 - RNA, 18 nt, Human
gaauaacauguaauuaag

SEQ ID NO: 3241753 - RNA, 14 nt, Human
gaauaacauguaau

SEQ ID NO: 3241754 - RNA, 16 nt, Human
gaauaaaaauuccaga

SEQ ID NO: 3241755 - RNA, 20 nt, Human
gaaguuugagaucagccugg

SEQ ID NO: 3241756 - RNA, 15 nt, Human
gaaguuugauaaaua

SEQ ID NO: 3241757 - RNA, 19 nt, Human
gaaguuugauaaauagugu

SEQ ID NO: 3241758 - RNA, 16 nt, Human
gaaguuugauaaauag

SEQ ID NO: 3241759 - RNA, 20 nt, Human
gaaguuugauaaauaguguu

SEQ ID NO: 3241760 - RNA, 18 nt, Human
gaauguaugcuucauaca

SEQ ID NO: 3241761 - RNA, 16 nt, Human
gaauguaugcuucaua

SEQ ID NO: 3241762 - RNA, 22 nt, Human
gaaugguuuucaaaauaaaaau

SEQ ID NO: 3241763 - RNA, 13 nt, Human
gaauguaaagcaa

SEQ ID NO: 3241764 - RNA, 21 nt, Human
gaauguaugcuucauacaggg

SEQ ID NO: 3241765 - RNA, 13 nt, Human
gaaugucagugug

SEQ ID NO: 3241766 - RNA, 14 nt, Human
gaaugucaguguga

SEQ ID NO: 3241767 - RNA, 18 nt, Human
gaauggcaauguuuugcu

SEQ ID NO: 3241768 - RNA, 15 nt, Human
gaauggacauuucua

SEQ ID NO: 3241769 - RNA, 16 nt, Human
gaauggugauuuuaaa

SEQ ID NO: 3241770 - RNA, 14 nt, Human
gaauggugauuuua

SEQ ID NO: 3241771 - RNA, 21 nt, Human
gaauggugauuuuaaaugugu

SEQ ID NO: 3241772 - RNA, 17 nt, Human
gaauggugcauuguaua

SEQ ID NO: 3241773 - RNA, 19 nt, Human
gaauggugauuuuaaaugu

SEQ ID NO: 3241774 - RNA, 23 nt, Human
gaaugaaccacaucuugcucugc

SEQ ID NO: 3241775 - RNA, 16 nt, Human
gaaugaagaauucaga

SEQ ID NO: 3241776 - RNA, 18 nt, Human
gaaugaaccacaucuugc

SEQ ID NO: 3241777 - RNA, 22 nt, Human
gaaugaaccacaucuugcucug

SEQ ID NO: 3241778 - RNA, 19 nt, Human
gaaucuuuguaccaaaauu

SEQ ID NO: 3241779 - RNA, 12 nt, Human
gaaugaaaauaa

SEQ ID NO: 3241780 - RNA, 13 nt, Human
gaaugaaaauaac

SEQ ID NO: 3241781 - RNA, 20 nt, Human
gaaugaaaauaacugaauuu

SEQ ID NO: 3241782 - RNA, 23 nt, Human
gaaugaaaauaacugaauuugga

SEQ ID NO: 3241783 - RNA, 16 nt, Human
gaaucuuguuuugaaa

SEQ ID NO: 3241784 - RNA, 20 nt, Human
gaaucuuguuuugaaaauaa

SEQ ID NO: 3241785 - RNA, 13 nt, Human
gaaucuuuaauua

SEQ ID NO: 3241786 - RNA, 18 nt, Human
gaaucuuuaauuaaaacc

SEQ ID NO: 3241787 - RNA, 11 nt, Human
gaaugcagugg

SEQ ID NO: 3241788 - RNA, 16 nt, Human
gaaugaagcaguauuu

SEQ ID NO: 3241789 - RNA, 17 nt, Human
gaaugaagcaguauuuu

SEQ ID NO: 3241790 - RNA, 14 nt, Human
gaaugcauaaaaug

SEQ ID NO: 3241791 - RNA, 14 nt, Human
gaaugaagguuuuu

SEQ ID NO: 3241792 - RNA, 21 nt, Human
gaaugcaugcuuuccauauuu

SEQ ID NO: 3241793 - RNA, 18 nt, Human
gaaugcaugcuuuccaua

SEQ ID NO: 3241794 - RNA, 13 nt, Human
gaaugcuuuagga

SEQ ID NO: 3241795 - RNA, 21 nt, Human
gaaugcuuuuagugugugcau

SEQ ID NO: 3241796 - RNA, 22 nt, Human
gaauuguuuagauuuuguguuu

SEQ ID NO: 3241797 - RNA, 20 nt, Human
gaauuguuuagauuuugugu

SEQ ID NO: 3241798 - RNA, 15 nt, Human
gaauuguaaggaaug

SEQ ID NO: 3241799 - RNA, 22 nt, Human
gaauuguaaggaaugauuaauu

SEQ ID NO: 3241800 - RNA, 21 nt, Human
gaauuuauuuuuaagaaagaa

SEQ ID NO: 3241801 - RNA, 15 nt, Human
gaauuucccaaagca

SEQ ID NO: 3241802 - RNA, 16 nt, Human
gaauuuaucuuugaua

SEQ ID NO: 3241803 - RNA, 15 nt, Human
gaauuuaucuuugau

SEQ ID NO: 3241804 - RNA, 20 nt, Human
gaauuuaaagaaaaaaaugu

SEQ ID NO: 3241805 - RNA, 22 nt, Human
gaauuuaaagaaaaaaauguca

SEQ ID NO: 3241806 - RNA, 19 nt, Human
gaauucuuuaaaauuacaa

SEQ ID NO: 3241807 - RNA, 14 nt, Human
gaauugaaaaacca

SEQ ID NO: 3241808 - RNA, 19 nt, Human
gaauugagccuaaaaauaa

SEQ ID NO: 3241809 - RNA, 17 nt, Human
gaauucucagaaucuca

SEQ ID NO: 3241810 - RNA, 20 nt, Human
gaaugucagugugacugauc

SEQ ID NO: 3241811 - RNA, 21 nt, Human
gaaugucagugugacugaucu

SEQ ID NO: 3241812 - RNA, 19 nt, Human
gaauucaccacagacuuua

SEQ ID NO: 3241813 - RNA, 18 nt, Human
gaauucaccacagacuuu

SEQ ID NO: 3241814 - RNA, 11 nt, Human
gaauguaugua

SEQ ID NO: 3241815 - RNA, 12 nt, Human
gaauucauucau

SEQ ID NO: 3241816 - RNA, 17 nt, Human
gaagagaagggcagggc

SEQ ID NO: 3241817 - RNA, 19 nt, Human
gaagagaaugcacaaacag

SEQ ID NO: 3241818 - RNA, 19 nt, Human
gaagacuucaucccucugg

SEQ ID NO: 3241819 - RNA, 20 nt, Human
gaagacuuuucuuucagcca

SEQ ID NO: 3241820 - RNA, 14 nt, Human
gaagacuuuggaaa

SEQ ID NO: 3241821 - RNA, 17 nt, Human
gaagacuuuggaaagag

SEQ ID NO: 3241822 - RNA, 19 nt, Human
gaagagccccacucucaga

SEQ ID NO: 3241823 - RNA, 16 nt, Human
gaagagccccacucuc

SEQ ID NO: 3241824 - RNA, 15 nt, Human
gaagagccccacucu

SEQ ID NO: 3241825 - RNA, 13 nt, Human
gaagagccccacu

SEQ ID NO: 3241826 - RNA, 12 nt, Human
gaagagccccac

SEQ ID NO: 3241827 - RNA, 16 nt, Human
gaagagcagcuccuuc

SEQ ID NO: 3241828 - RNA, 12 nt, Human
gaacuuuguaua

SEQ ID NO: 3241829 - RNA, 15 nt, Human
gaacuuuguauaguu

SEQ ID NO: 3241830 - RNA, 21 nt, Human
gaacuuuguauaguuauguaa

SEQ ID NO: 3241831 - RNA, 11 nt, Human
gaagacuuugg

SEQ ID NO: 3241832 - RNA, 13 nt, Human
gaagacuuuggaa

SEQ ID NO: 3241833 - RNA, 19 nt, Human
gaagaacucaccaggguuu

SEQ ID NO: 3241834 - RNA, 16 nt, Human
gaagaacugaaaggcu

SEQ ID NO: 3241835 - RNA, 17 nt, Human
gaagaacucaugugauu

SEQ ID NO: 3241836 - RNA, 17 nt, Human
gaagcauuuacuuugug

SEQ ID NO: 3241837 - RNA, 12 nt, Human
gaagagggcugc

SEQ ID NO: 3241838 - RNA, 20 nt, Human
gaagauaauauuaaggaaga

SEQ ID NO: 3241839 - RNA, 17 nt, Human
gaagauguagaggagaa

SEQ ID NO: 3241840 - RNA, 18 nt, Human
gaagauguagaggagaaa

SEQ ID NO: 3241841 - RNA, 14 nt, Human
gaagauaaguugga

SEQ ID NO: 3241842 - RNA, 12 nt, Human
gaagauacuuug

SEQ ID NO: 3241843 - RNA, 13 nt, Human
gaagauacuuugu

SEQ ID NO: 3241844 - RNA, 23 nt, Human
gaagagacagagacaaguaauuu

SEQ ID NO: 3241845 - RNA, 18 nt, Human
gaagauaaguuggaaaca

SEQ ID NO: 3241846 - RNA, 14 nt, Human
gaagauacuuugua

SEQ ID NO: 3241847 - RNA, 15 nt, Human
gaagauacuuuguau

SEQ ID NO: 3241848 - RNA, 20 nt, Human
gaagccagcaggcucucagg

SEQ ID NO: 3241849 - RNA, 19 nt, Human
gaagccagcaggcucucag

SEQ ID NO: 3241850 - RNA, 21 nt, Human
gaagccagcaggcucucaggc

SEQ ID NO: 3241851 - RNA, 22 nt, Human
gaagccagcaggcucucaggcc

SEQ ID NO: 3241852 - RNA, 13 nt, Human
gaagcccaggaaa

SEQ ID NO: 3241853 - RNA, 15 nt, Human
gaagcccaggaaagg

SEQ ID NO: 3241854 - RNA, 16 nt, Human
gaagcccaggaaaggc

SEQ ID NO: 3241855 - RNA, 23 nt, Human
gaagcccuucuaccuuccugcaa

SEQ ID NO: 3241856 - RNA, 23 nt, Human
gaagcccaggaaaggcuccagga

SEQ ID NO: 3241857 - RNA, 17 nt, Human
gaagccacccaaagcag

SEQ ID NO: 3241858 - RNA, 22 nt, Human
gaaccuuuugagugccuuacac

SEQ ID NO: 3241859 - RNA, 12 nt, Human
gaacgcccacuu

SEQ ID NO: 3241860 - RNA, 13 nt, Human
gaacgccagggac

SEQ ID NO: 3241861 - RNA, 16 nt, Human
gaacgauccuucaaag

SEQ ID NO: 3241862 - RNA, 18 nt, Human
gaacgauccuucaaaguc

SEQ ID NO: 3241863 - RNA, 13 nt, Human
gaacuaaacuagu

SEQ ID NO: 3241864 - RNA, 19 nt, Human
gaacuaaacuaguuuuucc

SEQ ID NO: 3241865 - RNA, 22 nt, Human
gaacuaaacuaguuuuuccuau

SEQ ID NO: 3241866 - RNA, 23 nt, Human
gaacuaaacuaguuuuuccuauc

SEQ ID NO: 3241867 - RNA, 21 nt, Human
gaacguuugguucaaaugugu

SEQ ID NO: 3241868 - RNA, 18 nt, Human
gaacguuugguucaaaug

SEQ ID NO: 3241869 - RNA, 19 nt, Human
gaaccuuuugagugccuua

SEQ ID NO: 3241870 - RNA, 21 nt, Human
gaaccuuuugagugccuuaca

SEQ ID NO: 3241871 - RNA, 18 nt, Human
gaaccuuuugagugccuu

SEQ ID NO: 3241872 - RNA, 14 nt, Human
gaaccucugauuua

SEQ ID NO: 3241873 - RNA, 15 nt, Human
gaacauugguucuuu

SEQ ID NO: 3241874 - RNA, 23 nt, Human
gaacauugcauauaacuuauauu

SEQ ID NO: 3241875 - RNA, 21 nt, Human
gaacauugcauauaacuuaua

SEQ ID NO: 3241876 - RNA, 21 nt, Human
gaaccaaacccacccuuucua

SEQ ID NO: 3241877 - RNA, 22 nt, Human
gaaccaaacccacccuuucuac

SEQ ID NO: 3241878 - RNA, 13 nt, Human
gaacacucugaga

SEQ ID NO: 3241879 - RNA, 14 nt, Human
gaacacucugagac

SEQ ID NO: 3241880 - RNA, 16 nt, Human
gaaauuucacgucaua

SEQ ID NO: 3241881 - RNA, 12 nt, Human
gaaauuucacgu

SEQ ID NO: 3241882 - RNA, 11 nt, Human
gaaauuucacg

SEQ ID NO: 3241883 - RNA, 22 nt, Human
gaaauuuauugaggaaaaauau

SEQ ID NO: 3241884 - RNA, 21 nt, Human
gaaauuuauugaggaaaaaua

SEQ ID NO: 3241885 - RNA, 23 nt, Human
gaaaauaguuuauuuuaaaacaa

SEQ ID NO: 3241886 - RNA, 19 nt, Human
gaaaauaguuuauuuuaaa

SEQ ID NO: 3241887 - RNA, 20 nt, Human
gaaaauaguuuauuuuaaaa

SEQ ID NO: 3241888 - RNA, 23 nt, Human
gaaaauaaaucaaugcuauaacu

SEQ ID NO: 3241889 - RNA, 18 nt, Human
gaaaauagagaugagcuu

SEQ ID NO: 3241890 - RNA, 21 nt, Human
gaaaauacuuaaauguuaugu

SEQ ID NO: 3241891 - RNA, 17 nt, Human
gaaaauacuuaaauguu

SEQ ID NO: 3241892 - RNA, 16 nt, Human
gaaaauacuuaaaugu

SEQ ID NO: 3241893 - RNA, 15 nt, Human
gaaaauacuuaaaug

SEQ ID NO: 3241894 - RNA, 13 nt, Human
gaaaauaguuuau

SEQ ID NO: 3241895 - RNA, 14 nt, Human
gaaaauaguuuauu

SEQ ID NO: 3241896 - RNA, 15 nt, Human
gaaaauaguuuauuu

SEQ ID NO: 3241897 - RNA, 13 nt, Human
gaaaauaggcuuu

SEQ ID NO: 3241898 - RNA, 19 nt, Human
gaaaauaggaacgacucua

SEQ ID NO: 3241899 - RNA, 22 nt, Human
gaacagaugaccccugcccaga

SEQ ID NO: 3241900 - RNA, 20 nt, Human
gaacagaugaccccugccca

SEQ ID NO: 3241901 - RNA, 20 nt, Human
gaaauuucacgucauaggaa

SEQ ID NO: 3241902 - RNA, 15 nt, Human
gaacacucugagacu

SEQ ID NO: 3241903 - RNA, 21 nt, Human
gaacagcggcuggacuuggag

SEQ ID NO: 3241904 - RNA, 16 nt, Human
gaacagugauuaccag

SEQ ID NO: 3241905 - RNA, 20 nt, Human
gaacagugauuaccagggac

SEQ ID NO: 3241906 - RNA, 14 nt, Human
gaacauaauucuua

SEQ ID NO: 3241907 - RNA, 13 nt, Human
gaacauacaaaug

SEQ ID NO: 3241908 - RNA, 16 nt, Human
gaacauaauucuuauu

SEQ ID NO: 3241909 - RNA, 15 nt, Human
gaacauacaaaugca

SEQ ID NO: 3241910 - RNA, 17 nt, Human
gaacauacaaaugcauc

SEQ ID NO: 3241911 - RNA, 22 nt, Human
gaacauacaaaugcaucuuuga

SEQ ID NO: 3241912 - RNA, 23 nt, Human
gaacauacaaaugcaucuuugau

SEQ ID NO: 3241913 - RNA, 15 nt, Human
gaacauaaaauacaa

SEQ ID NO: 3241914 - RNA, 18 nt, Human
gaacagugcaccugggac

SEQ ID NO: 3241915 - RNA, 21 nt, Human
gaacaguguggccucuucuga

SEQ ID NO: 3241916 - RNA, 18 nt, Human
gacucuacaugcuuguug

SEQ ID NO: 3241917 - RNA, 21 nt, Human
gacucuacagaggccaugggc

SEQ ID NO: 3241918 - RNA, 15 nt, Human
gacucuacagaggcc

SEQ ID NO: 3241919 - RNA, 15 nt, Human
gacucuaaagucugu

SEQ ID NO: 3241920 - RNA, 13 nt, Human
gacuacagggccg

SEQ ID NO: 3241921 - RNA, 18 nt, Human
gacuccugcaggcagcca

SEQ ID NO: 3241922 - RNA, 19 nt, Human
gacuccugcaggcagccag

SEQ ID NO: 3241923 - RNA, 20 nt, Human
gacuccugcaggcagccagg

SEQ ID NO: 3241924 - RNA, 15 nt, Human
gacuacaggcaccca

SEQ ID NO: 3241925 - RNA, 13 nt, Human
gacuacaggcacc

SEQ ID NO: 3241926 - RNA, 18 nt, Human
gacuacaggcacccacca

SEQ ID NO: 3241927 - RNA, 12 nt, Human
gacuacagggcc

SEQ ID NO: 3241928 - RNA, 14 nt, Human
gacugacugaggca

SEQ ID NO: 3241929 - RNA, 15 nt, Human
gacugacugaggcag

SEQ ID NO: 3241930 - RNA, 16 nt, Human
gacugacugaggcagu

SEQ ID NO: 3241931 - RNA, 16 nt, Human
gacugaggggagggga

SEQ ID NO: 3241932 - RNA, 14 nt, Human
gacugccacaagga

SEQ ID NO: 3241933 - RNA, 20 nt, Human
gacugccagucccccugccc

SEQ ID NO: 3241934 - RNA, 18 nt, Human
gacugccagcucuuccua

SEQ ID NO: 3241935 - RNA, 15 nt, Human
gacugccagcucuuc

SEQ ID NO: 3241936 - RNA, 14 nt, Human
gacugccagcucuu

SEQ ID NO: 3241937 - RNA, 13 nt, Human
gacugccagcucu

SEQ ID NO: 3241938 - RNA, 16 nt, Human
gacugccaccuccccu

SEQ ID NO: 3241939 - RNA, 15 nt, Human
gacugccaccucccc

SEQ ID NO: 3241940 - RNA, 14 nt, Human
gacugccaccuccc

SEQ ID NO: 3241941 - RNA, 13 nt, Human
gacugccaccucc

SEQ ID NO: 3241942 - RNA, 12 nt, Human
gacugccaccuc

SEQ ID NO: 3241943 - RNA, 19 nt, Human
gacugccacaaggaagaaa

SEQ ID NO: 3241944 - RNA, 18 nt, Human
gacugccacaaggaagaa

SEQ ID NO: 3241945 - RNA, 12 nt, Human
gacugaucucag

SEQ ID NO: 3241946 - RNA, 16 nt, Human
gacugauguuugugca

SEQ ID NO: 3241947 - RNA, 19 nt, Human
gacugcuccugagccccca

SEQ ID NO: 3241948 - RNA, 17 nt, Human
gacugcuccugagcccc

SEQ ID NO: 3241949 - RNA, 14 nt, Human
gacuggcacaguuu

SEQ ID NO: 3241950 - RNA, 22 nt, Human
gacuggcacaguuuucugagaa

SEQ ID NO: 3241951 - RNA, 18 nt, Human
gacuggcacaguuuucug

SEQ ID NO: 3241952 - RNA, 21 nt, Human
gacugccagcucuuccuagcu

SEQ ID NO: 3241953 - RNA, 19 nt, Human
gacugccagcucuuccuag

SEQ ID NO: 3241954 - RNA, 16 nt, Human
gacugcuccugagccc

SEQ ID NO: 3241955 - RNA, 14 nt, Human
gacugcuccugagc

SEQ ID NO: 3241956 - RNA, 16 nt, Human
gacuggcaagaaaaga

SEQ ID NO: 3241957 - RNA, 17 nt, Human
gacuggauguaccacca

SEQ ID NO: 3241958 - RNA, 23 nt, Human
gacuggccaagguuuggggaaga

SEQ ID NO: 3241959 - RNA, 16 nt, Human
gacugggaacagaacu

SEQ ID NO: 3241960 - RNA, 12 nt, Human
gacuucaucccu

SEQ ID NO: 3241961 - RNA, 20 nt, Human
gacuucaucccucuggggcu

SEQ ID NO: 3241962 - RNA, 22 nt, Human
gacuucagggagucagcuguuu

SEQ ID NO: 3241963 - RNA, 14 nt, Human
gacuucagcucugu

SEQ ID NO: 3241964 - RNA, 17 nt, Human
gacuucaaaauauugag

SEQ ID NO: 3241965 - RNA, 19 nt, Human
gacuucaaaauauugagca

SEQ ID NO: 3241966 - RNA, 19 nt, Human
gacuuaguggacaggggag

SEQ ID NO: 3241967 - RNA, 15 nt, Human
gacuuagcugggaga

SEQ ID NO: 3241968 - RNA, 12 nt, Human
gacuuagaaucc

SEQ ID NO: 3241969 - RNA, 20 nt, Human
gacuuagaaucccuguguua

SEQ ID NO: 3241970 - RNA, 21 nt, Human
gacuuagaaucccuguguuaa

SEQ ID NO: 3241971 - RNA, 23 nt, Human
gacuuagaaucccuguguuaauu

SEQ ID NO: 3241972 - RNA, 18 nt, Human
gaccuuccaagagccuga

SEQ ID NO: 3241973 - RNA, 22 nt, Human
gaccuucacucuaagauguuau

SEQ ID NO: 3241974 - RNA, 17 nt, Human
gaccuuccaagagccug

SEQ ID NO: 3241975 - RNA, 16 nt, Human
gaccuuccaagagccu

SEQ ID NO: 3241976 - RNA, 20 nt, Human
gaccuucacucuaagauguu

SEQ ID NO: 3241977 - RNA, 19 nt, Human
gaccuucacucuaagaugu

SEQ ID NO: 3241978 - RNA, 20 nt, Human
gaccuucuccuucaccuuug

SEQ ID NO: 3241979 - RNA, 21 nt, Human
gaccuucuccuucaccuuugu

SEQ ID NO: 3241980 - RNA, 14 nt, Human
gaccuugaacuggg

SEQ ID NO: 3241981 - RNA, 15 nt, Human
gaccuucuccuucac

SEQ ID NO: 3241982 - RNA, 16 nt, Human
gaccuucuccuucacc

SEQ ID NO: 3241983 - RNA, 14 nt, Human
gaccuucuccuuca

SEQ ID NO: 3241984 - RNA, 20 nt, Human
gacccuugccgucuaccuga

SEQ ID NO: 3241985 - RNA, 23 nt, Human
gacccuugccgucuaccugaggg

SEQ ID NO: 3241986 - RNA, 19 nt, Human
gacccuugccgucuaccug

SEQ ID NO: 3241987 - RNA, 19 nt, Human
gaccuggggcugcugugaa

SEQ ID NO: 3241988 - RNA, 16 nt, Human
gaccuggccugucugu

SEQ ID NO: 3241989 - RNA, 15 nt, Human
gaccuggccugucug

SEQ ID NO: 3241990 - RNA, 14 nt, Human
gaccuuaaaugcaa

SEQ ID NO: 3241991 - RNA, 18 nt, Human
gaccuguuaaaauuauac

SEQ ID NO: 3241992 - RNA, 13 nt, Human
gaccuggucaggg

SEQ ID NO: 3241993 - RNA, 18 nt, Human
gacuaaccccaccacacc

SEQ ID NO: 3241994 - RNA, 16 nt, Human
gacuaacuugucuuug

SEQ ID NO: 3241995 - RNA, 23 nt, Human
gacuaacuugucuuuggacccug

SEQ ID NO: 3241996 - RNA, 23 nt, Human
gacuaagaucgguuaacaaauaa

SEQ ID NO: 3241997 - RNA, 22 nt, Human
gacuaagaucgguuaacaaaua

SEQ ID NO: 3241998 - RNA, 11 nt, Human
gacguguuaug

SEQ ID NO: 3241999 - RNA, 14 nt, Human
gacguguuaugacu

SEQ ID NO: 3242000 - RNA, 22 nt, Human
gaccuuuaagagaaaugagcug

SEQ ID NO: 3242001 - RNA, 11 nt, Human
gaccuuucaau

SEQ ID NO: 3242002 - RNA, 19 nt, Human
gaccuuucaauaggaaaaa

SEQ ID NO: 3242003 - RNA, 20 nt, Human
gaccuuucaauaggaaaaac

SEQ ID NO: 3242004 - RNA, 22 nt, Human
gacgcugugcugcccugcccac

SEQ ID NO: 3242005 - RNA, 21 nt, Human
gacgcugugcugcccugccca

SEQ ID NO: 3242006 - RNA, 18 nt, Human
gacgcuucacaggacagg

SEQ ID NO: 3242007 - RNA, 13 nt, Human
gacggagucccac

SEQ ID NO: 3242008 - RNA, 23 nt, Human
gacggagucccaccuuggcugca

SEQ ID NO: 3242009 - RNA, 21 nt, Human
gacggcgagaaaugccucugg

SEQ ID NO: 3242010 - RNA, 22 nt, Human
gacggcacugagagagcgcagc

SEQ ID NO: 3242011 - RNA, 16 nt, Human
gacguggcaccuccuc

SEQ ID NO: 3242012 - RNA, 14 nt, Human
gacguggcaccucc

SEQ ID NO: 3242013 - RNA, 14 nt, Human
gacaguugugcagg

SEQ ID NO: 3242014 - RNA, 14 nt, Human
gacaucaacagaua

SEQ ID NO: 3242015 - RNA, 16 nt, Human
gacaucaacugcauca

SEQ ID NO: 3242016 - RNA, 23 nt, Human
gacaucaacugcaucaagaugug

SEQ ID NO: 3242017 - RNA, 13 nt, Human
gacaucacuggca

SEQ ID NO: 3242018 - RNA, 22 nt, Human
gacaggcauguucucugaggac

SEQ ID NO: 3242019 - RNA, 14 nt, Human
gacagggcauggcc

SEQ ID NO: 3242020 - RNA, 15 nt, Human
gacaggccagguggu

SEQ ID NO: 3242021 - RNA, 22 nt, Human
gacagggcauggccagguggcc

SEQ ID NO: 3242022 - RNA, 20 nt, Human
gacagggcauggccaggugg

SEQ ID NO: 3242023 - RNA, 15 nt, Human
gacagggcauggcca

SEQ ID NO: 3242024 - RNA, 22 nt, Human
gacaguuaagagaaaugagcuu

SEQ ID NO: 3242025 - RNA, 19 nt, Human
gacaguucauucagggccg

SEQ ID NO: 3242026 - RNA, 18 nt, Human
gacaguucauucagggcc

SEQ ID NO: 3242027 - RNA, 18 nt, Human
gacaggcaagcaccuccu

SEQ ID NO: 3242028 - RNA, 17 nt, Human
gacaggcaagcaccucc

SEQ ID NO: 3242029 - RNA, 13 nt, Human
gacaggcaagcac

SEQ ID NO: 3242030 - RNA, 22 nt, Human
gacagcagucuuaugcuuccag

SEQ ID NO: 3242031 - RNA, 19 nt, Human
gacagcagucuuaugcuuc

SEQ ID NO: 3242032 - RNA, 19 nt, Human
gacaggcaaugcuggcugu

SEQ ID NO: 3242033 - RNA, 18 nt, Human
gacaggcaaugcuggcug

SEQ ID NO: 3242034 - RNA, 20 nt, Human
gacaggcaagcaccuccugc

SEQ ID NO: 3242035 - RNA, 21 nt, Human
gacaggcauguucucugagga

SEQ ID NO: 3242036 - RNA, 20 nt, Human
gacaggcauguucucugagg

SEQ ID NO: 3242037 - RNA, 23 nt, Human
gacaggcaaugcuggcuguuggc

SEQ ID NO: 3242038 - RNA, 13 nt, Human
gacagagccugcc

SEQ ID NO: 3242039 - RNA, 17 nt, Human
gacagagcgacagagca

SEQ ID NO: 3242040 - RNA, 21 nt, Human
gacagagccugccccagcgcu

SEQ ID NO: 3242041 - RNA, 16 nt, Human
gacagagccugcccca

SEQ ID NO: 3242042 - RNA, 15 nt, Human
gacagagccugcccc

SEQ ID NO: 3242043 - RNA, 20 nt, Human
gacagagcuacacaggggaa

SEQ ID NO: 3242044 - RNA, 18 nt, Human
gacagagcgacagagcag

SEQ ID NO: 3242045 - RNA, 16 nt, Human
gacagacagcccucca

SEQ ID NO: 3242046 - RNA, 16 nt, Human
gacagagugagacucu

SEQ ID NO: 3242047 - RNA, 21 nt, Human
gacagagucucacuguugccc

SEQ ID NO: 3242048 - RNA, 23 nt, Human
gacagaggcagccccauucugcc

SEQ ID NO: 3242049 - RNA, 14 nt, Human
gacagagucucacu

SEQ ID NO: 3242050 - RNA, 22 nt, Human
gaauuucccaaagcagugcaug

SEQ ID NO: 3242051 - RNA, 16 nt, Human
gaauuucccaaagcag

SEQ ID NO: 3242052 - RNA, 18 nt, Human
gaauuucccaaagcagug

SEQ ID NO: 3242053 - RNA, 22 nt, Human
gacacgaauauugcugauggug

SEQ ID NO: 3242054 - RNA, 21 nt, Human
gacacuaaccacgcuggaccu

SEQ ID NO: 3242055 - RNA, 22 nt, Human
gacagacacaggcccggcucca

SEQ ID NO: 3242056 - RNA, 20 nt, Human
gacagacacaggcccggcuc

SEQ ID NO: 3242057 - RNA, 16 nt, Human
gacacuagaagauuuu

SEQ ID NO: 3242058 - RNA, 17 nt, Human
gacagacacaggcccgg

SEQ ID NO: 3242059 - RNA, 12 nt, Human
gacccccuggag

SEQ ID NO: 3242060 - RNA, 10 nt, Human
gacccugagg

SEQ ID NO: 3242061 - RNA, 11 nt, Human
gacccugaggc

SEQ ID NO: 3242062 - RNA, 12 nt, Human
gacccugaggcc

SEQ ID NO: 3242063 - RNA, 16 nt, Human
gacccugaggcccaga

SEQ ID NO: 3242064 - RNA, 17 nt, Human
gacccugcccugugggc

SEQ ID NO: 3242065 - RNA, 20 nt, Human
gacccugcccugugggcccc

SEQ ID NO: 3242066 - RNA, 22 nt, Human
gacccugcccugugggccccca

SEQ ID NO: 3242067 - RNA, 17 nt, Human
gacccaugcugcccugu

SEQ ID NO: 3242068 - RNA, 14 nt, Human
gacccaugggcagg

SEQ ID NO: 3242069 - RNA, 16 nt, Human
gacccaugggcaggag

SEQ ID NO: 3242070 - RNA, 15 nt, Human
gacccaugggcagga

SEQ ID NO: 3242071 - RNA, 18 nt, Human
gacccaugggcaggagac

SEQ ID NO: 3242072 - RNA, 17 nt, Human
gacccaugggcaggaga

SEQ ID NO: 3242073 - RNA, 20 nt, Human
gacccaugggcaggagacug

SEQ ID NO: 3242074 - RNA, 11 nt, Human
gaccccagaau

SEQ ID NO: 3242075 - RNA, 14 nt, Human
gaccccagccucaa

SEQ ID NO: 3242076 - RNA, 12 nt, Human
gaccccagccuc

SEQ ID NO: 3242077 - RNA, 15 nt, Human
gacccccccagcuuc

SEQ ID NO: 3242078 - RNA, 18 nt, Human
gacccaaaaggcagaagc

SEQ ID NO: 3242079 - RNA, 19 nt, Human
gacccaaaaggcagaagca

SEQ ID NO: 3242080 - RNA, 11 nt, Human
gaccagccagg

SEQ ID NO: 3242081 - RNA, 14 nt, Human
gaccagcccacgcu

SEQ ID NO: 3242082 - RNA, 12 nt, Human
gaccagcccacg

SEQ ID NO: 3242083 - RNA, 11 nt, Human
gaccagcccac

SEQ ID NO: 3242084 - RNA, 23 nt, Human
gaccagccagggaaagacuggca

SEQ ID NO: 3242085 - RNA, 17 nt, Human
gaccagcagucugccug

SEQ ID NO: 3242086 - RNA, 12 nt, Human
gacccacugcuu

SEQ ID NO: 3242087 - RNA, 19 nt, Human
gacccacuggacucaccuc

SEQ ID NO: 3242088 - RNA, 23 nt, Human
gaccagcccacgcugacuacagg

SEQ ID NO: 3242089 - RNA, 16 nt, Human
gaccagcccacgcuga

SEQ ID NO: 3242090 - RNA, 19 nt, Human
gacccaugcugcccuguga

SEQ ID NO: 3242091 - RNA, 20 nt, Human
gacccaugcugcccugugag

SEQ ID NO: 3242092 - RNA, 18 nt, Human
gacccaugcugcccugug

SEQ ID NO: 3242093 - RNA, 23 nt, Human
gacccaguggcagggcacagggc

SEQ ID NO: 3242094 - RNA, 12 nt, Human
gacccaguggca

SEQ ID NO: 3242095 - RNA, 22 nt, Human
gacccaguggcagggcacaggg

SEQ ID NO: 3242096 - RNA, 20 nt, Human
gacccaguggcagggcacag

SEQ ID NO: 3242097 - RNA, 19 nt, Human
gacccaguggcagggcaca

SEQ ID NO: 3242098 - RNA, 18 nt, Human
gacccaguggcagggcac

SEQ ID NO: 3242099 - RNA, 17 nt, Human
gacccaguggcagggca

SEQ ID NO: 3242100 - RNA, 16 nt, Human
gacccaguggcagggc

SEQ ID NO: 3242101 - RNA, 15 nt, Human
gacccaguggcaggg

SEQ ID NO: 3242102 - RNA, 14 nt, Human
gacccaguggcagg

SEQ ID NO: 3242103 - RNA, 16 nt, Human
gaccacugcagaagac

SEQ ID NO: 3242104 - RNA, 21 nt, Human
gaccagacaccuugacagggc

SEQ ID NO: 3242105 - RNA, 22 nt, Human
gaccagacaccuugacagggca

SEQ ID NO: 3242106 - RNA, 16 nt, Human
gaccacccauaucaug

SEQ ID NO: 3242107 - RNA, 12 nt, Human
gaccaccagagg

SEQ ID NO: 3242108 - RNA, 23 nt, Human
gaccacaggugcccgccaccaca

SEQ ID NO: 3242109 - RNA, 19 nt, Human
gaccacaggugcccgccac

SEQ ID NO: 3242110 - RNA, 20 nt, Human
gaccagcaccaucucuccuc

SEQ ID NO: 3242111 - RNA, 21 nt, Human
gaccagcaccaucucuccucc

SEQ ID NO: 3242112 - RNA, 14 nt, Human
gaccagcacacucc

SEQ ID NO: 3242113 - RNA, 13 nt, Human
gaccagcacacuc

SEQ ID NO: 3242114 - RNA, 18 nt, Human
gaccagcacacucccgag

SEQ ID NO: 3242115 - RNA, 19 nt, Human
gaccagagcugccaccugc

SEQ ID NO: 3242116 - RNA, 23 nt, Human
gaccagacaccuugacagggcac

SEQ ID NO: 3242117 - RNA, 21 nt, Human
gaccagagcugccaccugccu

SEQ ID NO: 3242118 - RNA, 18 nt, Human
gaccacaaaacuuuucua

SEQ ID NO: 3242119 - RNA, 13 nt, Human
gaccaauuuuaac

SEQ ID NO: 3242120 - RNA, 16 nt, Human
gaccacacuccagcug

SEQ ID NO: 3242121 - RNA, 22 nt, Human
gaccacacuccagcugggauca

SEQ ID NO: 3242122 - RNA, 14 nt, Human
gaccacacuccagc

SEQ ID NO: 3242123 - RNA, 17 nt, Human
gaccaaguauaaacuuu

SEQ ID NO: 3242124 - RNA, 18 nt, Human
gaccaaggcucugaaaua

SEQ ID NO: 3242125 - RNA, 21 nt, Human
gaguguguaauuuaaaauugu

SEQ ID NO: 3242126 - RNA, 22 nt, Human
gacuuccugauugguuucucuu

SEQ ID NO: 3242127 - RNA, 22 nt, Human
gaguguguaauuuaaaauugug

SEQ ID NO: 3242128 - RNA, 21 nt, Human
gacuuccugauugguuucucu

SEQ ID NO: 3242129 - RNA, 20 nt, Human
gacuuccccaauaucuugcu

SEQ ID NO: 3242130 - RNA, 18 nt, Human
gacuuccccaauaucuug

SEQ ID NO: 3242131 - RNA, 17 nt, Human
gacuuccccaauaucuu

SEQ ID NO: 3242132 - RNA, 23 nt, Human
gauaaaaucauaaguauuuggaa

SEQ ID NO: 3242133 - RNA, 19 nt, Human
gauaaaaucauaaguauuu

SEQ ID NO: 3242134 - RNA, 13 nt, Human
gauaaaaucauaa

SEQ ID NO: 3242135 - RNA, 13 nt, Human
gauaaacaguagu

SEQ ID NO: 3242136 - RNA, 16 nt, Human
gauaaagaccagaaau

SEQ ID NO: 3242137 - RNA, 18 nt, Human
gauaaagaccagaaauuc

SEQ ID NO: 3242138 - RNA, 18 nt, Human
gauaaaccuagauaaaga

SEQ ID NO: 3242139 - RNA, 22 nt, Human
gauaaauuaugguaaaauuuug

SEQ ID NO: 3242140 - RNA, 22 nt, Human
gauaacaauguuuuaacaagaa

SEQ ID NO: 3242141 - RNA, 21 nt, Human
gauaacaccaccauucacaag

SEQ ID NO: 3242142 - RNA, 19 nt, Human
gauaacaauguuuuaacaa

SEQ ID NO: 3242143 - RNA, 13 nt, Human
gauaaguuggaaa

SEQ ID NO: 3242144 - RNA, 22 nt, Human
gauaaguuggaaacacuaaaug

SEQ ID NO: 3242145 - RNA, 19 nt, Human
gauaaguuggaaacacuaa

SEQ ID NO: 3242146 - RNA, 18 nt, Human
gauaaguuggaaacacua

SEQ ID NO: 3242147 - RNA, 17 nt, Human
gauaaguuggaaacacu

SEQ ID NO: 3242148 - RNA, 23 nt, Human
gauaacagggauugauuuuaaaa

SEQ ID NO: 3242149 - RNA, 14 nt, Human
gauaaccauagcau

SEQ ID NO: 3242150 - RNA, 22 nt, Human
gauaacagggauugauuuuaaa

SEQ ID NO: 3242151 - RNA, 20 nt, Human
gauaacagggauugauuuua

SEQ ID NO: 3242152 - RNA, 17 nt, Human
gauaaccauagcauagg

SEQ ID NO: 3242153 - RNA, 14 nt, Human
gaucaggcucccag

SEQ ID NO: 3242154 - RNA, 15 nt, Human
gaucaggcucccagg

SEQ ID NO: 3242155 - RNA, 20 nt, Human
gaucacggcucacugcagcc

SEQ ID NO: 3242156 - RNA, 23 nt, Human
gaucacggcucacugcagccuca

SEQ ID NO: 3242157 - RNA, 14 nt, Human
gaucacugaaauaa

SEQ ID NO: 3242158 - RNA, 20 nt, Human
gaucacugaaauaaaagcua

SEQ ID NO: 3242159 - RNA, 18 nt, Human
gaucacugaaauaaaagc

SEQ ID NO: 3242160 - RNA, 14 nt, Human
gaucacagccucug

SEQ ID NO: 3242161 - RNA, 16 nt, Human
gaucacauguggacuu

SEQ ID NO: 3242162 - RNA, 17 nt, Human
gauaucuguuagaugcu

SEQ ID NO: 3242163 - RNA, 13 nt, Human
gauaucaaaggca

SEQ ID NO: 3242164 - RNA, 22 nt, Human
gauaauuuuccuuuaauaugaa

SEQ ID NO: 3242165 - RNA, 18 nt, Human
gauaauucuagcuuugag

SEQ ID NO: 3242166 - RNA, 16 nt, Human
gauaauauauuguguu

SEQ ID NO: 3242167 - RNA, 23 nt, Human
gauaauuaaccaagguagaauga

SEQ ID NO: 3242168 - RNA, 18 nt, Human
gauaggaaggucauuucc

SEQ ID NO: 3242169 - RNA, 17 nt, Human
gauaggaaggucauuuc

SEQ ID NO: 3242170 - RNA, 22 nt, Human
gauaggaaggucauuuccaugu

SEQ ID NO: 3242171 - RNA, 21 nt, Human
gauaggaaggucauuuccaug

SEQ ID NO: 3242172 - RNA, 23 nt, Human
gauaggaaggucauuuccaugua

SEQ ID NO: 3242173 - RNA, 18 nt, Human
gauauaugcucugcaugu

SEQ ID NO: 3242174 - RNA, 21 nt, Human
gauauagagucauuguaaugu

SEQ ID NO: 3242175 - RNA, 14 nt, Human
gauauaaacagcuu

SEQ ID NO: 3242176 - RNA, 20 nt, Human
gauagugucccacggugccu

SEQ ID NO: 3242177 - RNA, 13 nt, Human
gauaggggcagag

SEQ ID NO: 3242178 - RNA, 21 nt, Human
gauaguugaauguugcaaugu

SEQ ID NO: 3242179 - RNA, 12 nt, Human
gauccugagcca

SEQ ID NO: 3242180 - RNA, 16 nt, Human
gauccucccaggcuuc

SEQ ID NO: 3242181 - RNA, 17 nt, Human
gauccuccccuggacuc

SEQ ID NO: 3242182 - RNA, 15 nt, Human
gauccuccccuggac

SEQ ID NO: 3242183 - RNA, 18 nt, Human
gauccuccccuggacucc

SEQ ID NO: 3242184 - RNA, 13 nt, Human
gaucuaggaagac

SEQ ID NO: 3242185 - RNA, 14 nt, Human
gaucuaggaagacu

SEQ ID NO: 3242186 - RNA, 18 nt, Human
gaucuaggaagacuuugg

SEQ ID NO: 3242187 - RNA, 20 nt, Human
gaucuggguucacugcaacc

SEQ ID NO: 3242188 - RNA, 20 nt, Human
gaucuaggaagacuuuggaa

SEQ ID NO: 3242189 - RNA, 17 nt, Human
gauccucccaccucagc

SEQ ID NO: 3242190 - RNA, 21 nt, Human
gauccucccaccucagccucc

SEQ ID NO: 3242191 - RNA, 14 nt, Human
gauccuccaggugc

SEQ ID NO: 3242192 - RNA, 16 nt, Human
gauccucccaccucag

SEQ ID NO: 3242193 - RNA, 23 nt, Human
gaucccuuccaccugcucugcug

SEQ ID NO: 3242194 - RNA, 22 nt, Human
gaucccuuccaccugcucugcu

SEQ ID NO: 3242195 - RNA, 20 nt, Human
gaucccuuccaccugcucug

SEQ ID NO: 3242196 - RNA, 23 nt, Human
gauccuaaugaaugcauaaaaug

SEQ ID NO: 3242197 - RNA, 12 nt, Human
gauccuccaggu

SEQ ID NO: 3242198 - RNA, 13 nt, Human
gaucauccacugu

SEQ ID NO: 3242199 - RNA, 22 nt, Human
gaucauaguuuuauuuauauuu

SEQ ID NO: 3242200 - RNA, 12 nt, Human
gaucauaguuuu

SEQ ID NO: 3242201 - RNA, 13 nt, Human
gaucauaguuuua

SEQ ID NO: 3242202 - RNA, 14 nt, Human
gaucauaguuuuau

SEQ ID NO: 3242203 - RNA, 15 nt, Human
gaucauaguuuuauu

SEQ ID NO: 3242204 - RNA, 16 nt, Human
gaucauaguuuuauuu

SEQ ID NO: 3242205 - RNA, 18 nt, Human
gaucauaguuuuauuuau

SEQ ID NO: 3242206 - RNA, 19 nt, Human
gaucauaguuuuauuuaua

SEQ ID NO: 3242207 - RNA, 19 nt, Human
gaucccuuccaccugcucu

SEQ ID NO: 3242208 - RNA, 13 nt, Human
gaucccuuccacc

SEQ ID NO: 3242209 - RNA, 21 nt, Human
gaugaaaugaggucagagccu

SEQ ID NO: 3242210 - RNA, 15 nt, Human
gaugaaaugagguca

SEQ ID NO: 3242211 - RNA, 19 nt, Human
gaucuucuuuauaauucua

SEQ ID NO: 3242212 - RNA, 18 nt, Human
gaucuuccucugcuaaau

SEQ ID NO: 3242213 - RNA, 17 nt, Human
gaucuuccucugcuaaa

SEQ ID NO: 3242214 - RNA, 22 nt, Human
gaucuucuguggguuucuaaag

SEQ ID NO: 3242215 - RNA, 15 nt, Human
gaugaccccugccca

SEQ ID NO: 3242216 - RNA, 14 nt, Human
gaugaccccugccc

SEQ ID NO: 3242217 - RNA, 22 nt, Human
gaugaauuguaaaagcaacauc

SEQ ID NO: 3242218 - RNA, 18 nt, Human
gaugaccaauuuuaacuu

SEQ ID NO: 3242219 - RNA, 22 nt, Human
gaugaauaaauguuauagcugc

SEQ ID NO: 3242220 - RNA, 16 nt, Human
gaugaaauguaaauac

SEQ ID NO: 3242221 - RNA, 23 nt, Human
gaugcaccagcccuuagcaggga

SEQ ID NO: 3242222 - RNA, 15 nt, Human
gaugcaccagcccuu

SEQ ID NO: 3242223 - RNA, 14 nt, Human
gaugagaggaaauc

SEQ ID NO: 3242224 - RNA, 14 nt, Human
gaugcaccagcccu

SEQ ID NO: 3242225 - RNA, 23 nt, Human
gaugagaaauaaaguuucuguug

SEQ ID NO: 3242226 - RNA, 18 nt, Human
gaugaccuugaaugaugc

SEQ ID NO: 3242227 - RNA, 20 nt, Human
gaugagaacagauaaagauu

SEQ ID NO: 3242228 - RNA, 16 nt, Human
gaugccugguggcagc

SEQ ID NO: 3242229 - RNA, 15 nt, Human
gaugccugguggcag

SEQ ID NO: 3242230 - RNA, 14 nt, Human
gaugcagugcuucc

SEQ ID NO: 3242231 - RNA, 14 nt, Human
gaugccugguggca

SEQ ID NO: 3242232 - RNA, 19 nt, Human
gaugcagccucacaguccu

SEQ ID NO: 3242233 - RNA, 21 nt, Human
gaugcagacagggggccagaa

SEQ ID NO: 3242234 - RNA, 20 nt, Human
gaugcagacagggggccaga

SEQ ID NO: 3242235 - RNA, 16 nt, Human
gaugcagcucuuccug

SEQ ID NO: 3242236 - RNA, 23 nt, Human
gcaaacuggccgcgggggcaggg

SEQ ID NO: 3242237 - RNA, 15 nt, Human
gcaaaccaucauuga

SEQ ID NO: 3242238 - RNA, 19 nt, Human
gcaaaccuaauugcacaac

SEQ ID NO: 3242239 - RNA, 20 nt, Human
gcaaacccugucaaacauua

SEQ ID NO: 3242240 - RNA, 19 nt, Human
gcaaacccugucaaacauu

SEQ ID NO: 3242241 - RNA, 15 nt, Human
gcaaacccugucaaa

SEQ ID NO: 3242242 - RNA, 22 nt, Human
gcaaaccuuucuauaauuuuac

SEQ ID NO: 3242243 - RNA, 17 nt, Human
gcaaaccaucauugaaa

SEQ ID NO: 3242244 - RNA, 19 nt, Human
gcaaaccaucauugaaauc

SEQ ID NO: 3242245 - RNA, 20 nt, Human
gcaaaccaucauugaaaucu

SEQ ID NO: 3242246 - RNA, 21 nt, Human
gcaaaccaucauugaaaucuu

SEQ ID NO: 3242247 - RNA, 16 nt, Human
gcaaaccaucauugaa

SEQ ID NO: 3242248 - RNA, 16 nt, Human
gauuuuaaauguguga

SEQ ID NO: 3242249 - RNA, 15 nt, Human
gauuuuaaaugugug

SEQ ID NO: 3242250 - RNA, 14 nt, Human
gauuuuaaaugugu

SEQ ID NO: 3242251 - RNA, 12 nt, Human
gauuuuaaaugu

SEQ ID NO: 3242252 - RNA, 22 nt, Human
gauuuuaaaauguacauguauu

SEQ ID NO: 3242253 - RNA, 21 nt, Human
gauuuuaaaauguacauguau

SEQ ID NO: 3242254 - RNA, 18 nt, Human
gauuuuaaaauguacaug

SEQ ID NO: 3242255 - RNA, 13 nt, Human
gauuuuaaaaugu

SEQ ID NO: 3242256 - RNA, 12 nt, Human
gauuuuaaaaug

SEQ ID NO: 3242257 - RNA, 23 nt, Human
gcaaagaaaaaaaaaaaagccag

SEQ ID NO: 3242258 - RNA, 22 nt, Human
gcaaagaacucuuacccuggca

SEQ ID NO: 3242259 - RNA, 14 nt, Human
gcaaagaacucuua

SEQ ID NO: 3242260 - RNA, 19 nt, Human
gcaaagagacccagucaau

SEQ ID NO: 3242261 - RNA, 23 nt, Human
gcaaaguucccuacuuccuguga

SEQ ID NO: 3242262 - RNA, 20 nt, Human
gcaaauaaugaucgaaaaaa

SEQ ID NO: 3242263 - RNA, 14 nt, Human
gcaaauggccucau

SEQ ID NO: 3242264 - RNA, 18 nt, Human
gcaacugcauuggcuuug

SEQ ID NO: 3242265 - RNA, 23 nt, Human
gcaacuuucuggggccuaauaaa

SEQ ID NO: 3242266 - RNA, 16 nt, Human
gcaagaugugggcagu

SEQ ID NO: 3242267 - RNA, 16 nt, Human
gcaagauugauguuuc

SEQ ID NO: 3242268 - RNA, 12 nt, Human
gcaagauguggg

SEQ ID NO: 3242269 - RNA, 17 nt, Human
gcaagauggcacagggc

SEQ ID NO: 3242270 - RNA, 22 nt, Human
gcaagauggcacagggcaugaa

SEQ ID NO: 3242271 - RNA, 19 nt, Human
gcaagauggcacagggcau

SEQ ID NO: 3242272 - RNA, 15 nt, Human
gcaagcaccaucccc

SEQ ID NO: 3242273 - RNA, 18 nt, Human
gcaagcaagaaacacugg

SEQ ID NO: 3242274 - RNA, 16 nt, Human
gcaagcaccuccugcc

SEQ ID NO: 3242275 - RNA, 15 nt, Human
gcaagcaccuccugc

SEQ ID NO: 3242276 - RNA, 20 nt, Human
gcaagcaccuccugccucga

SEQ ID NO: 3242277 - RNA, 18 nt, Human
gcaagcaccuccugccuc

SEQ ID NO: 3242278 - RNA, 22 nt, Human
gcaagcaguuucaauaaaguuu

SEQ ID NO: 3242279 - RNA, 14 nt, Human
gcaagcugaaauuu

SEQ ID NO: 3242280 - RNA, 17 nt, Human
gcaagcugaaauuuuag

SEQ ID NO: 3242281 - RNA, 15 nt, Human
gcaagcaguuucaau

SEQ ID NO: 3242282 - RNA, 14 nt, Human
gcaagcaguuucaa

SEQ ID NO: 3242283 - RNA, 18 nt, Human
gcaagcaccauccccucc

SEQ ID NO: 3242284 - RNA, 17 nt, Human
gcaagcaccauccccuc

SEQ ID NO: 3242285 - RNA, 14 nt, Human
gcaaggcugucaau

SEQ ID NO: 3242286 - RNA, 18 nt, Human
gcaaggcugucaauuaca

SEQ ID NO: 3242287 - RNA, 14 nt, Human
gcaagggaggccca

SEQ ID NO: 3242288 - RNA, 21 nt, Human
gcaagggaauuucuucaacuc

SEQ ID NO: 3242289 - RNA, 13 nt, Human
gcaaggcugucaa

SEQ ID NO: 3242290 - RNA, 20 nt, Human
gcaaggaagguaaaaaguua

SEQ ID NO: 3242291 - RNA, 17 nt, Human
gcaauccugcaagaaca

SEQ ID NO: 3242292 - RNA, 13 nt, Human
gcaauccuuacaa

SEQ ID NO: 3242293 - RNA, 16 nt, Human
gcaauccuuacaaaug

SEQ ID NO: 3242294 - RNA, 14 nt, Human
gcaauccuuacaaa

SEQ ID NO: 3242295 - RNA, 14 nt, Human
gcaaucuauaauau

SEQ ID NO: 3242296 - RNA, 19 nt, Human
gcaauccuuacaaaugauu

SEQ ID NO: 3242297 - RNA, 18 nt, Human
gcaaggucuugcucuccu

SEQ ID NO: 3242298 - RNA, 15 nt, Human
gcaagggaggcccag

SEQ ID NO: 3242299 - RNA, 15 nt, Human
gauugggccccugcc

SEQ ID NO: 3242300 - RNA, 14 nt, Human
gauuguuauuaaau

SEQ ID NO: 3242301 - RNA, 16 nt, Human
gauuguuauuaaaugu

SEQ ID NO: 3242302 - RNA, 14 nt, Human
gauuuaaacucuga

SEQ ID NO: 3242303 - RNA, 13 nt, Human
gauuuaaacucug

SEQ ID NO: 3242304 - RNA, 11 nt, Human
gauuguuuaaa

SEQ ID NO: 3242305 - RNA, 21 nt, Human
gauuguuuaucuagauguaaa

SEQ ID NO: 3242306 - RNA, 17 nt, Human
gauuuaaacucugaauu

SEQ ID NO: 3242307 - RNA, 19 nt, Human
gauuuguuaaugauagcua

SEQ ID NO: 3242308 - RNA, 17 nt, Human
gauuuguugauucucuc

SEQ ID NO: 3242309 - RNA, 14 nt, Human
gauuuccaagccuc

SEQ ID NO: 3242310 - RNA, 19 nt, Human
gauucuuuccugaggcugg

SEQ ID NO: 3242311 - RNA, 17 nt, Human
gauucccaagcucugcu

SEQ ID NO: 3242312 - RNA, 16 nt, Human
gauucccaagcucugc

SEQ ID NO: 3242313 - RNA, 20 nt, Human
gauucuuuccugaggcuggg

SEQ ID NO: 3242314 - RNA, 22 nt, Human
gauucuuuccugaggcugggcu

SEQ ID NO: 3242315 - RNA, 16 nt, Human
gauugcaacaggcugg

SEQ ID NO: 3242316 - RNA, 19 nt, Human
gauucuuuuaaauuagaaa

SEQ ID NO: 3242317 - RNA, 20 nt, Human
gauucuuuuaaauuagaaaa

SEQ ID NO: 3242318 - RNA, 17 nt, Human
gauugcaacaggcuggg

SEQ ID NO: 3242319 - RNA, 15 nt, Human
gauugcaacaggcug

SEQ ID NO: 3242320 - RNA, 22 nt, Human
gauuggauuuuauguugacauu

SEQ ID NO: 3242321 - RNA, 19 nt, Human
gauuggauuuuauguugac

SEQ ID NO: 3242322 - RNA, 23 nt, Human
gauugcuguguguugccugggac

SEQ ID NO: 3242323 - RNA, 21 nt, Human
gauuaauuucugccauuucau

SEQ ID NO: 3242324 - RNA, 21 nt, Human
gauuacaagcgugagccacug

SEQ ID NO: 3242325 - RNA, 13 nt, Human
gauuacaagcgug

SEQ ID NO: 3242326 - RNA, 13 nt, Human
gauucagacagcu

SEQ ID NO: 3242327 - RNA, 14 nt, Human
gauucagacagcug

SEQ ID NO: 3242328 - RNA, 17 nt, Human
gauucagacagcugccu

SEQ ID NO: 3242329 - RNA, 15 nt, Human
gauucccaagcucug

SEQ ID NO: 3242330 - RNA, 18 nt, Human
gauucauuuuugaaacug

SEQ ID NO: 3242331 - RNA, 20 nt, Human
gauucaggcauuuucccccu

SEQ ID NO: 3242332 - RNA, 17 nt, Human
gauucaggcauuuuccc

SEQ ID NO: 3242333 - RNA, 19 nt, Human
gauucaguuucuaaaauug

SEQ ID NO: 3242334 - RNA, 14 nt, Human
gauguuugugcagu

SEQ ID NO: 3242335 - RNA, 16 nt, Human
gauguuugagcagugg

SEQ ID NO: 3242336 - RNA, 18 nt, Human
gauguucuggauaccauu

SEQ ID NO: 3242337 - RNA, 16 nt, Human
gaugcuagaacucccu

SEQ ID NO: 3242338 - RNA, 15 nt, Human
gaugcgcaguugcug

SEQ ID NO: 3242339 - RNA, 18 nt, Human
gaugcgggcauggcagcc

SEQ ID NO: 3242340 - RNA, 20 nt, Human
gaugccugugaacugaacuc

SEQ ID NO: 3242341 - RNA, 18 nt, Human
gauguucuagcauggcug

SEQ ID NO: 3242342 - RNA, 15 nt, Human
gaugcuacuaagaaa

SEQ ID NO: 3242343 - RNA, 21 nt, Human
gcacaggcugagugcaggccc

SEQ ID NO: 3242344 - RNA, 20 nt, Human
gcacaggcugagugcaggcc

SEQ ID NO: 3242345 - RNA, 22 nt, Human
gcacaugccucucucaggccaa

SEQ ID NO: 3242346 - RNA, 19 nt, Human
gcacaggcugagugcaggc

SEQ ID NO: 3242347 - RNA, 18 nt, Human
gcacaggcugagugcagg

SEQ ID NO: 3242348 - RNA, 17 nt, Human
gcacaggcugagugcag

SEQ ID NO: 3242349 - RNA, 13 nt, Human
gcacaggcugagu

SEQ ID NO: 3242350 - RNA, 21 nt, Human
gcacaggcagggcaggaccag

SEQ ID NO: 3242351 - RNA, 20 nt, Human
gcacaggcagggcaggacca

SEQ ID NO: 3242352 - RNA, 16 nt, Human
gcacaggcagggcagg

SEQ ID NO: 3242353 - RNA, 15 nt, Human
gcacaggcagggcag

SEQ ID NO: 3242354 - RNA, 11 nt, Human
gcacaggcaga

SEQ ID NO: 3242355 - RNA, 14 nt, Human
gcacaggcagggca

SEQ ID NO: 3242356 - RNA, 13 nt, Human
gcacaggcagggc

SEQ ID NO: 3242357 - RNA, 16 nt, Human
gcacagcuucauuucc

SEQ ID NO: 3242358 - RNA, 19 nt, Human
gcacagcuaacauggaagu

SEQ ID NO: 3242359 - RNA, 14 nt, Human
gcacagcugcucug

SEQ ID NO: 3242360 - RNA, 20 nt, Human
gcacagcucccuucuguuga

SEQ ID NO: 3242361 - RNA, 19 nt, Human
gcacagcguuaugugucug

SEQ ID NO: 3242362 - RNA, 13 nt, Human
gcaaugaccuuuc

SEQ ID NO: 3242363 - RNA, 14 nt, Human
gcaaugaccuuuca

SEQ ID NO: 3242364 - RNA, 19 nt, Human
gcaccacugcacuccagcc

SEQ ID NO: 3242365 - RNA, 13 nt, Human
gcaccacccuccu

SEQ ID NO: 3242366 - RNA, 17 nt, Human
gcaccacccuccuuccc

SEQ ID NO: 3242367 - RNA, 16 nt, Human
gcaccacccuccuucc

SEQ ID NO: 3242368 - RNA, 15 nt, Human
gcaccacccuccuuc

SEQ ID NO: 3242369 - RNA, 18 nt, Human
gcaccacucaagaccaaa

SEQ ID NO: 3242370 - RNA, 17 nt, Human
gcaccacucaagaccaa

SEQ ID NO: 3242371 - RNA, 13 nt, Human
gcaccacucaaga

SEQ ID NO: 3242372 - RNA, 15 nt, Human
gcaccuccugccucg

SEQ ID NO: 3242373 - RNA, 14 nt, Human
gcaccuccugccuc

SEQ ID NO: 3242374 - RNA, 17 nt, Human
gcacccggccccugcug

SEQ ID NO: 3242375 - RNA, 15 nt, Human
gcacccggccccugc

SEQ ID NO: 3242376 - RNA, 14 nt, Human
gcacccggccccug

SEQ ID NO: 3242377 - RNA, 16 nt, Human
gcacccauccaccguc

SEQ ID NO: 3242378 - RNA, 23 nt, Human
gcacccauccaccguccccuccc

SEQ ID NO: 3242379 - RNA, 22 nt, Human
gcacccauccaccguccccucc

SEQ ID NO: 3242380 - RNA, 15 nt, Human
gcacugucaagauga

SEQ ID NO: 3242381 - RNA, 22 nt, Human
gcacugggcuuggggaccagag

SEQ ID NO: 3242382 - RNA, 23 nt, Human
gcacugggcuuggggaccagagc

SEQ ID NO: 3242383 - RNA, 14 nt, Human
gcacugggcuuggg

SEQ ID NO: 3242384 - RNA, 14 nt, Human
gcagaagacaguau

SEQ ID NO: 3242385 - RNA, 19 nt, Human
gcagaacuugaagccugcu

SEQ ID NO: 3242386 - RNA, 13 nt, Human
gcagaaggaagac

SEQ ID NO: 3242387 - RNA, 14 nt, Human
gcagaaggaagacu

SEQ ID NO: 3242388 - RNA, 12 nt, Human
gcagaaggaaga

SEQ ID NO: 3242389 - RNA, 18 nt, Human
gcacuaaggugugcucug

SEQ ID NO: 3242390 - RNA, 17 nt, Human
gcacugaggaccagcca

SEQ ID NO: 3242391 - RNA, 22 nt, Human
gcacugauauauuuaaaaacaa

SEQ ID NO: 3242392 - RNA, 17 nt, Human
gcacuaaggugugcucu

SEQ ID NO: 3242393 - RNA, 11 nt, Human
gcaggaggaag

SEQ ID NO: 3242394 - RNA, 22 nt, Human
gcaggagcuucugggagauuuu

SEQ ID NO: 3242395 - RNA, 22 nt, Human
gcaggagcaguaucaugaagcc

SEQ ID NO: 3242396 - RNA, 17 nt, Human
gcaggagcaguaucaug

SEQ ID NO: 3242397 - RNA, 13 nt, Human
gcaggagcaguau

SEQ ID NO: 3242398 - RNA, 22 nt, Human
gcaggaccagcccacgcugacu

SEQ ID NO: 3242399 - RNA, 14 nt, Human
gcaggaccagccca

SEQ ID NO: 3242400 - RNA, 13 nt, Human
gcaggaccagccc

SEQ ID NO: 3242401 - RNA, 19 nt, Human
gcaggaccagcccacgcug

SEQ ID NO: 3242402 - RNA, 18 nt, Human
gcaggaccagcccacgcu

SEQ ID NO: 3242403 - RNA, 16 nt, Human
gcaggaccagcccacg

SEQ ID NO: 3242404 - RNA, 15 nt, Human
gcaggaccagcccac

SEQ ID NO: 3242405 - RNA, 14 nt, Human
gcagccuggacccu

SEQ ID NO: 3242406 - RNA, 12 nt, Human
gcagccuggcuc

SEQ ID NO: 3242407 - RNA, 13 nt, Human
gcagccuggcucc

SEQ ID NO: 3242408 - RNA, 14 nt, Human
gcagccuggcuccc

SEQ ID NO: 3242409 - RNA, 22 nt, Human
gcagccucaaccuccugggcua

SEQ ID NO: 3242410 - RNA, 21 nt, Human
gcagccucaaccuccugggcu

SEQ ID NO: 3242411 - RNA, 18 nt, Human
gcagccgugccuucagcu

SEQ ID NO: 3242412 - RNA, 24 nt, Human
gcagccugccuugcccacuccugc

SEQ ID NO: 3242413 - RNA, 20 nt, Human
gcagccucaaccuccugggc

SEQ ID NO: 3242414 - RNA, 19 nt, Human
gcagccucaaccuccuggg

SEQ ID NO: 3242415 - RNA, 17 nt, Human
gcagccgugccuucagc

SEQ ID NO: 3242416 - RNA, 15 nt, Human
gcagccgugccuuca

SEQ ID NO: 3242417 - RNA, 14 nt, Human
gcagccgugccuuc

SEQ ID NO: 3242418 - RNA, 20 nt, Human
gcagcagggagggcuucugc

SEQ ID NO: 3242419 - RNA, 12 nt, Human
gcagcagggcag

SEQ ID NO: 3242420 - RNA, 19 nt, Human
gcagauuuugcccuugaca

SEQ ID NO: 3242421 - RNA, 13 nt, Human
gcagaugccuggg

SEQ ID NO: 3242422 - RNA, 14 nt, Human
gcagaugcagcucu

SEQ ID NO: 3242423 - RNA, 19 nt, Human
gcagaugcagcucuuccug

SEQ ID NO: 3242424 - RNA, 15 nt, Human
gcagaugcagcucuu

SEQ ID NO: 3242425 - RNA, 15 nt, Human
gcagaguuacuugau

SEQ ID NO: 3242426 - RNA, 13 nt, Human
gcagaguuacuug

SEQ ID NO: 3242427 - RNA, 14 nt, Human
gcagaguucaggga

SEQ ID NO: 3242428 - RNA, 19 nt, Human
gcagaguugaagacagagc

SEQ ID NO: 3242429 - RNA, 16 nt, Human
gcagaguugaagacag

SEQ ID NO: 3242430 - RNA, 17 nt, Human
gcagaguugaagacaga

SEQ ID NO: 3242431 - RNA, 21 nt, Human
gcagcaaggucuugcucuccu

SEQ ID NO: 3242432 - RNA, 21 nt, Human
gcagcacccagguuuugcacu

SEQ ID NO: 3242433 - RNA, 15 nt, Human
gcagcacagcugaga

SEQ ID NO: 3242434 - RNA, 19 nt, Human
gcagcaccgccucuucccg

SEQ ID NO: 3242435 - RNA, 16 nt, Human
gcagcaccgccucuuc

SEQ ID NO: 3242436 - RNA, 17 nt, Human
gcagcaaggucuugcuc

SEQ ID NO: 3242437 - RNA, 16 nt, Human
gcagauuuuggccaug

SEQ ID NO: 3242438 - RNA, 14 nt, Human
gcagcaacacacau

SEQ ID NO: 3242439 - RNA, 15 nt, Human
gcagaguugaagaca

SEQ ID NO: 3242440 - RNA, 13 nt, Human
gcagaguuaaauc

SEQ ID NO: 3242441 - RNA, 21 nt, Human
gcagaguuaaaucucaaauag

SEQ ID NO: 3242442 - RNA, 17 nt, Human
gcagagaccaucccuga

SEQ ID NO: 3242443 - RNA, 14 nt, Human
gcagagaccauccc

SEQ ID NO: 3242444 - RNA, 15 nt, Human
gcagagaccaucccu

SEQ ID NO: 3242445 - RNA, 23 nt, Human
gcagagaaugaaagggcccagag

SEQ ID NO: 3242446 - RNA, 22 nt, Human
gcagagaaugaaagggcccaga

SEQ ID NO: 3242447 - RNA, 21 nt, Human
gcagagaauucucuuauccaa

SEQ ID NO: 3242448 - RNA, 21 nt, Human
gcagagaagugacgguuccua

SEQ ID NO: 3242449 - RNA, 21 nt, Human
gcagagaaugaaagggcccag

SEQ ID NO: 3242450 - RNA, 20 nt, Human
gcagagaaugaaagggccca

SEQ ID NO: 3242451 - RNA, 19 nt, Human
gcagagaaugaaagggccc

SEQ ID NO: 3242452 - RNA, 16 nt, Human
gcaucaggccaggccc

SEQ ID NO: 3242453 - RNA, 17 nt, Human
gcaucaggccaggcccu

SEQ ID NO: 3242454 - RNA, 13 nt, Human
gcaucaggccagg

SEQ ID NO: 3242455 - RNA, 15 nt, Human
gcaucaggccaggcc

SEQ ID NO: 3242456 - RNA, 17 nt, Human
gcaugccuggauggggc

SEQ ID NO: 3242457 - RNA, 22 nt, Human
gcaugccuggauggggcugcac

SEQ ID NO: 3242458 - RNA, 21 nt, Human
gcaugcaucccacugcugacu

SEQ ID NO: 3242459 - RNA, 15 nt, Human
gcaugcugucccuua

SEQ ID NO: 3242460 - RNA, 14 nt, Human
gcaugcuuuccaua

SEQ ID NO: 3242461 - RNA, 21 nt, Human
gcaugcuguauuaugaaaucg

SEQ ID NO: 3242462 - RNA, 14 nt, Human
gcaugcuuaaauuu

SEQ ID NO: 3242463 - RNA, 18 nt, Human
gcaugcuuaaauuuuaac

SEQ ID NO: 3242464 - RNA, 15 nt, Human
gcaugccuggauggg

SEQ ID NO: 3242465 - RNA, 15 nt, Human
gcaugccuucaaauc

SEQ ID NO: 3242466 - RNA, 19 nt, Human
gcauggagaaugcaccaua

SEQ ID NO: 3242467 - RNA, 22 nt, Human
gcauguucucugaggacacuaa

SEQ ID NO: 3242468 - RNA, 20 nt, Human
gcauggacauuuagaagaaa

SEQ ID NO: 3242469 - RNA, 22 nt, Human
gcauggacauuuagaagaaaga

SEQ ID NO: 3242470 - RNA, 17 nt, Human
gcauuagugggaaaaag

SEQ ID NO: 3242471 - RNA, 17 nt, Human
gcauuccagucaggcuc

SEQ ID NO: 3242472 - RNA, 21 nt, Human
gcauuagagucaacuacacaa

SEQ ID NO: 3242473 - RNA, 20 nt, Human
gcauuagauuucucauuugc

SEQ ID NO: 3242474 - RNA, 15 nt, Human
gcauguuuugcaugu

SEQ ID NO: 3242475 - RNA, 13 nt, Human
gcauguuuugcau

SEQ ID NO: 3242476 - RNA, 14 nt, Human
gcauuaaaagaaaa

SEQ ID NO: 3242477 - RNA, 13 nt, Human
gcauuaaaagaaa

SEQ ID NO: 3242478 - RNA, 12 nt, Human
gcauuuuaccau

SEQ ID NO: 3242479 - RNA, 17 nt, Human
gcauuugcugaauacag

SEQ ID NO: 3242480 - RNA, 14 nt, Human
gcauuugcuuuugu

SEQ ID NO: 3242481 - RNA, 23 nt, Human
gcauuugcugaauacagaggcaa

SEQ ID NO: 3242482 - RNA, 12 nt, Human
gcauuccccacu

SEQ ID NO: 3242483 - RNA, 15 nt, Human
gcauucucacuccua

SEQ ID NO: 3242484 - RNA, 13 nt, Human
gcauucucacucc

SEQ ID NO: 3242485 - RNA, 14 nt, Human
gcauucggagggag

SEQ ID NO: 3242486 - RNA, 21 nt, Human
gcauugccucggcuggcuccc

SEQ ID NO: 3242487 - RNA, 23 nt, Human
gcauugccaguaacacaggccac

SEQ ID NO: 3242488 - RNA, 14 nt, Human
gcauucucucucca

SEQ ID NO: 3242489 - RNA, 23 nt, Human
gcauucucuccauuucacuggcu

SEQ ID NO: 3242490 - RNA, 18 nt, Human
gcauucucacuccuaccu

SEQ ID NO: 3242491 - RNA, 22 nt, Human
gcauuuugcuaaaugugaauga

SEQ ID NO: 3242492 - RNA, 20 nt, Human
gcauuuucccccuuggcucu

SEQ ID NO: 3242493 - RNA, 19 nt, Human
gccaaaacccagcugcacc

SEQ ID NO: 3242494 - RNA, 16 nt, Human
gccaaaacccagcugc

SEQ ID NO: 3242495 - RNA, 13 nt, Human
gccaaaacccagc

SEQ ID NO: 3242496 - RNA, 13 nt, Human
gcauuuuggcgcu

SEQ ID NO: 3242497 - RNA, 12 nt, Human
gcauuuuguaau

SEQ ID NO: 3242498 - RNA, 22 nt, Human
gccaaaagcuucccucccugcu

SEQ ID NO: 3242499 - RNA, 20 nt, Human
gccaaaagcuucccucccug

SEQ ID NO: 3242500 - RNA, 15 nt, Human
gccaaaagcuucccu

SEQ ID NO: 3242501 - RNA, 14 nt, Human
gccaaaagcuuccc

SEQ ID NO: 3242502 - RNA, 14 nt, Human
gccaaaauuaaggu

SEQ ID NO: 3242503 - RNA, 21 nt, Human
gccaaaauuaagguguuugaa

SEQ ID NO: 3242504 - RNA, 23 nt, Human
gccaaacaaaaugagaucucauu

SEQ ID NO: 3242505 - RNA, 16 nt, Human
gccaaaggaagcacau

SEQ ID NO: 3242506 - RNA, 20 nt, Human
gccaaaggaagcacaugccu

SEQ ID NO: 3242507 - RNA, 14 nt, Human
gccaaaggaagcac

SEQ ID NO: 3242508 - RNA, 12 nt, Human
gccaaagacaaa

SEQ ID NO: 3242509 - RNA, 15 nt, Human
gccaaagacaaauag

SEQ ID NO: 3242510 - RNA, 14 nt, Human
gccaaagacaaaua

SEQ ID NO: 3242511 - RNA, 21 nt, Human
gccaaacucaccugccccuca

SEQ ID NO: 3242512 - RNA, 23 nt, Human
gccaaacauuaauguugauuucu

SEQ ID NO: 3242513 - RNA, 22 nt, Human
gccaaacauuaauguugauuuc

SEQ ID NO: 3242514 - RNA, 24 nt, Human
gccaaacauuaauguugauuucua

SEQ ID NO: 3242515 - RNA, 19 nt, Human
gccaaacucaccugccccu

SEQ ID NO: 3242516 - RNA, 23 nt, Human
gccaaaauuaagguguuugaaaa

SEQ ID NO: 3242517 - RNA, 13 nt, Human
gccaaacacacag

SEQ ID NO: 3242518 - RNA, 19 nt, Human
gccaaacauuaauguugau

SEQ ID NO: 3242519 - RNA, 12 nt, Human
gccaaacauuaa

SEQ ID NO: 3242520 - RNA, 11 nt, Human
gccaaacauua

SEQ ID NO: 3242521 - RNA, 14 nt, Human
gccaaacaggcccu

SEQ ID NO: 3242522 - RNA, 15 nt, Human
gcauauucaggaagc

SEQ ID NO: 3242523 - RNA, 21 nt, Human
gcauauauuaaagcaucagga

SEQ ID NO: 3242524 - RNA, 18 nt, Human
gcauauauauaugugugu

SEQ ID NO: 3242525 - RNA, 14 nt, Human
gcauauauauaugu

SEQ ID NO: 3242526 - RNA, 17 nt, Human
gcauauucaggaagcuc

SEQ ID NO: 3242527 - RNA, 18 nt, Human
gcauauucaggaagcuca

SEQ ID NO: 3242528 - RNA, 20 nt, Human
gcauauucaggaagcucagg

SEQ ID NO: 3242529 - RNA, 21 nt, Human
gcauauucuaguaauaaagac

SEQ ID NO: 3242530 - RNA, 21 nt, Human
gcaucaagaugugacauguuu

SEQ ID NO: 3242531 - RNA, 14 nt, Human
gcauauugacuuuu

SEQ ID NO: 3242532 - RNA, 23 nt, Human
gcauauucuaguaauaaagacuc

SEQ ID NO: 3242533 - RNA, 22 nt, Human
gcauauucuaguaauaaagacu

SEQ ID NO: 3242534 - RNA, 23 nt, Human
gcauaggccugcuuugucuccuc

SEQ ID NO: 3242535 - RNA, 22 nt, Human
gcauaggccugcuuugucuccu

SEQ ID NO: 3242536 - RNA, 16 nt, Human
gcauaggccugcuuug

SEQ ID NO: 3242537 - RNA, 23 nt, Human
gcauauaacuuauauuguaagaa

SEQ ID NO: 3242538 - RNA, 16 nt, Human
gcauauaacuuauauu

SEQ ID NO: 3242539 - RNA, 15 nt, Human
gcauauaacuuauau

SEQ ID NO: 3242540 - RNA, 18 nt, Human
gcauagauucccugagca

SEQ ID NO: 3242541 - RNA, 20 nt, Human
gcauagcaguauauguuaau

SEQ ID NO: 3242542 - RNA, 18 nt, Human
gcagugggagcugccugu

SEQ ID NO: 3242543 - RNA, 17 nt, Human
gcagugggagcugccug

SEQ ID NO: 3242544 - RNA, 20 nt, Human
gcaguuacaaauuauaaugu

SEQ ID NO: 3242545 - RNA, 13 nt, Human
gcaguuacaaauu

SEQ ID NO: 3242546 - RNA, 16 nt, Human
gcaguucgaccagcca

SEQ ID NO: 3242547 - RNA, 23 nt, Human
gcaguuccccuggaagcagugcc

SEQ ID NO: 3242548 - RNA, 17 nt, Human
gcaguuccccuggaagc

SEQ ID NO: 3242549 - RNA, 18 nt, Human
gcaguucgaccagccagg

SEQ ID NO: 3242550 - RNA, 14 nt, Human
gcagguccccagac

SEQ ID NO: 3242551 - RNA, 23 nt, Human
gcagguccccagacuccaccaag

SEQ ID NO: 3242552 - RNA, 16 nt, Human
gcagugggagcugccu

SEQ ID NO: 3242553 - RNA, 23 nt, Human
gcagugcuuccaaggauggacca

SEQ ID NO: 3242554 - RNA, 15 nt, Human
gcaggcuacugucag

SEQ ID NO: 3242555 - RNA, 14 nt, Human
gcagggagggccug

SEQ ID NO: 3242556 - RNA, 17 nt, Human
gcagggagggccugggc

SEQ ID NO: 3242557 - RNA, 20 nt, Human
gcaggauucuuccucccucc

SEQ ID NO: 3242558 - RNA, 12 nt, Human
gcagggcucagc

SEQ ID NO: 3242559 - RNA, 16 nt, Human
gcagggagggcuucug

SEQ ID NO: 3242560 - RNA, 18 nt, Human
gcagggagggccugggcc

SEQ ID NO: 3242561 - RNA, 22 nt, Human
gcagggagggccugggccccag

SEQ ID NO: 3242562 - RNA, 13 nt, Human
gccuauuguaaua

SEQ ID NO: 3242563 - RNA, 21 nt, Human
gccuauuguaauauagaaaaa

SEQ ID NO: 3242564 - RNA, 14 nt, Human
gccucaaauccagg

SEQ ID NO: 3242565 - RNA, 18 nt, Human
gccucaaauccaggaccc

SEQ ID NO: 3242566 - RNA, 16 nt, Human
gccucaaauccaggac

SEQ ID NO: 3242567 - RNA, 15 nt, Human
gccucaaauccagga

SEQ ID NO: 3242568 - RNA, 21 nt, Human
gccuauuuucaugauuucuuu

SEQ ID NO: 3242569 - RNA, 23 nt, Human
gccuauuuuuuuagauugagaaa

SEQ ID NO: 3242570 - RNA, 21 nt, Human
gccuaagauauacuuguuuuu

SEQ ID NO: 3242571 - RNA, 21 nt, Human
gccucagcauccuggcacccg

SEQ ID NO: 3242572 - RNA, 17 nt, Human
gccucagcauccuggca

SEQ ID NO: 3242573 - RNA, 18 nt, Human
gccucagcauccuggcac

SEQ ID NO: 3242574 - RNA, 24 nt, Human
gccucaagugauucuccugccuca

SEQ ID NO: 3242575 - RNA, 22 nt, Human
gccucaagugauucuccugccu

SEQ ID NO: 3242576 - RNA, 22 nt, Human
gccucaaauccaggacccugcc

SEQ ID NO: 3242577 - RNA, 19 nt, Human
gccucaaauccaggacccu

SEQ ID NO: 3242578 - RNA, 17 nt, Human
gccguugcugacuuaga

SEQ ID NO: 3242579 - RNA, 18 nt, Human
gccguugcugacuuagaa

SEQ ID NO: 3242580 - RNA, 18 nt, Human
gccguugccgcugauguu

SEQ ID NO: 3242581 - RNA, 15 nt, Human
gccuaaaaauaaagc

SEQ ID NO: 3242582 - RNA, 19 nt, Human
gccguugcugacuuagaau

SEQ ID NO: 3242583 - RNA, 13 nt, Human
gccguggcuuccc

SEQ ID NO: 3242584 - RNA, 12 nt, Human
gccguggcuucc

SEQ ID NO: 3242585 - RNA, 11 nt, Human
gccguggcuuc

SEQ ID NO: 3242586 - RNA, 18 nt, Human
gccgucuaccugaggggc

SEQ ID NO: 3242587 - RNA, 20 nt, Human
gccgucuaccugaggggccu

SEQ ID NO: 3242588 - RNA, 22 nt, Human
gccgucuaccugaggggccucu

SEQ ID NO: 3242589 - RNA, 23 nt, Human
gccgucuaccugaggggccucuu

SEQ ID NO: 3242590 - RNA, 13 nt, Human
gccgcagcccugc

SEQ ID NO: 3242591 - RNA, 16 nt, Human
gccgggcaaacuggcc

SEQ ID NO: 3242592 - RNA, 17 nt, Human
gccgggcagagcacagc

SEQ ID NO: 3242593 - RNA, 14 nt, Human
gccgggcagagcac

SEQ ID NO: 3242594 - RNA, 21 nt, Human
gccggggcuucugugcaccug

SEQ ID NO: 3242595 - RNA, 16 nt, Human
gccgcagcccugcaga

SEQ ID NO: 3242596 - RNA, 17 nt, Human
gccgcagcccugcagag

SEQ ID NO: 3242597 - RNA, 15 nt, Human
gccgcagcccugcag

SEQ ID NO: 3242598 - RNA, 17 nt, Human
gccgagauagccaaggc

SEQ ID NO: 3242599 - RNA, 16 nt, Human
gccgagauagccaagg

SEQ ID NO: 3242600 - RNA, 15 nt, Human
gcccuugcccaugcu

SEQ ID NO: 3242601 - RNA, 23 nt, Human
gcccuucucuccagccccuggau

SEQ ID NO: 3242602 - RNA, 13 nt, Human
gcccuucucucca

SEQ ID NO: 3242603 - RNA, 21 nt, Human
gcccuucggaggaccagggcu

SEQ ID NO: 3242604 - RNA, 21 nt, Human
gcccuuccucuccacugccuu

SEQ ID NO: 3242605 - RNA, 22 nt, Human
gcccuuccucuccacugccuuc

SEQ ID NO: 3242606 - RNA, 17 nt, Human
gcccuuccucugcuccc

SEQ ID NO: 3242607 - RNA, 15 nt, Human
gcccuuccucugcuc

SEQ ID NO: 3242608 - RNA, 14 nt, Human
gcccuuccucugcu

SEQ ID NO: 3242609 - RNA, 13 nt, Human
gcccuuccucugc

SEQ ID NO: 3242610 - RNA, 15 nt, Human
gccugcagagcugcg

SEQ ID NO: 3242611 - RNA, 20 nt, Human
gccugcagagcugcgggcug

SEQ ID NO: 3242612 - RNA, 14 nt, Human
gccuggacccugug

SEQ ID NO: 3242613 - RNA, 22 nt, Human
gccugcuggcucccuuacuuua

SEQ ID NO: 3242614 - RNA, 11 nt, Human
gccugcccagg

SEQ ID NO: 3242615 - RNA, 21 nt, Human
gccucugcacuccccugcugg

SEQ ID NO: 3242616 - RNA, 15 nt, Human
gccucugcacucccc

SEQ ID NO: 3242617 - RNA, 12 nt, Human
gccucugcauuc

SEQ ID NO: 3242618 - RNA, 16 nt, Human
gccugaaauccugguu

SEQ ID NO: 3242619 - RNA, 19 nt, Human
gccugaaauccugguuccu

SEQ ID NO: 3242620 - RNA, 14 nt, Human
gccugagaugccug

SEQ ID NO: 3242621 - RNA, 13 nt, Human
gccugagaugccu

SEQ ID NO: 3242622 - RNA, 17 nt, Human
gccucugcacuccccug

SEQ ID NO: 3242623 - RNA, 18 nt, Human
gccucugcacuccccugc

SEQ ID NO: 3242624 - RNA, 19 nt, Human
gccucugcacuccccugcu

SEQ ID NO: 3242625 - RNA, 20 nt, Human
gccucugcacuccccugcug

SEQ ID NO: 3242626 - RNA, 16 nt, Human
gccucugcacuccccu

SEQ ID NO: 3242627 - RNA, 15 nt, Human
gccucugacacacag

SEQ ID NO: 3242628 - RNA, 15 nt, Human
gccucucccaucacu

SEQ ID NO: 3242629 - RNA, 14 nt, Human
gccucccugccagu

SEQ ID NO: 3242630 - RNA, 23 nt, Human
gccucccuccgcggcgggcccug

SEQ ID NO: 3242631 - RNA, 19 nt, Human
gccucccgaauagcuggga

SEQ ID NO: 3242632 - RNA, 18 nt, Human
gccucccgaauagcuggg

SEQ ID NO: 3242633 - RNA, 23 nt, Human
gccucccgaguagcugggacuac

SEQ ID NO: 3242634 - RNA, 21 nt, Human
gccucccgaguagcugggacu

SEQ ID NO: 3242635 - RNA, 20 nt, Human
gccucccgaauagcugggac

SEQ ID NO: 3242636 - RNA, 20 nt, Human
gccucccgaguagcugggac

SEQ ID NO: 3242637 - RNA, 14 nt, Human
gccucagccuccca

SEQ ID NO: 3242638 - RNA, 12 nt, Human
gccucagccucc

SEQ ID NO: 3242639 - RNA, 17 nt, Human
gccucccaucacccgcu

SEQ ID NO: 3242640 - RNA, 14 nt, Human
gcuaagaauauuug

SEQ ID NO: 3242641 - RNA, 23 nt, Human
gcuaagaaaccaggaguaaaaga

SEQ ID NO: 3242642 - RNA, 22 nt, Human
gcuaacuugcuuaaaugugaau

SEQ ID NO: 3242643 - RNA, 20 nt, Human
gcuaacuugcuuaaauguga

SEQ ID NO: 3242644 - RNA, 19 nt, Human
gcuaacuugcuuaaaugug

SEQ ID NO: 3242645 - RNA, 18 nt, Human
gcuaacuugcuuaaaugu

SEQ ID NO: 3242646 - RNA, 22 nt, Human
gcuacacaggggaaaagaggag

SEQ ID NO: 3242647 - RNA, 15 nt, Human
gcgugagaccugccc

SEQ ID NO: 3242648 - RNA, 14 nt, Human
gcgugagccacugc

SEQ ID NO: 3242649 - RNA, 15 nt, Human
gcgugagccacugca

SEQ ID NO: 3242650 - RNA, 16 nt, Human
gcgugagaccugcccc

SEQ ID NO: 3242651 - RNA, 17 nt, Human
gcuaacauggaaguacu

SEQ ID NO: 3242652 - RNA, 18 nt, Human
gcuaacauggaaguacua

SEQ ID NO: 3242653 - RNA, 14 nt, Human
gcuaacauggaagu

SEQ ID NO: 3242654 - RNA, 15 nt, Human
gcuacauuuccgcca

SEQ ID NO: 3242655 - RNA, 20 nt, Human
gcuacauggggucugggugg

SEQ ID NO: 3242656 - RNA, 21 nt, Human
gcuacauuuccgccacauccc

SEQ ID NO: 3242657 - RNA, 18 nt, Human
gcuagagaaauucuuguu

SEQ ID NO: 3242658 - RNA, 21 nt, Human
gcuagacgagcaggcuucuuc

SEQ ID NO: 3242659 - RNA, 22 nt, Human
gcuagacgagcaggcuucuucc

SEQ ID NO: 3242660 - RNA, 23 nt, Human
gcgguccacccaggagccccgag

SEQ ID NO: 3242661 - RNA, 20 nt, Human
gcgguccacccaggagcccc

SEQ ID NO: 3242662 - RNA, 23 nt, Human
gcggggacagcuccuucuguccu

SEQ ID NO: 3242663 - RNA, 21 nt, Human
gcgcuucacuuggguccaggc

SEQ ID NO: 3242664 - RNA, 19 nt, Human
gcggacagccacggccagg

SEQ ID NO: 3242665 - RNA, 16 nt, Human
gcggacagccacggcc

SEQ ID NO: 3242666 - RNA, 23 nt, Human
gcggacagccacggccaggccag

SEQ ID NO: 3242667 - RNA, 19 nt, Human
gcggggacagcuccuucug

SEQ ID NO: 3242668 - RNA, 18 nt, Human
gcggggacagcuccuucu

SEQ ID NO: 3242669 - RNA, 18 nt, Human
gcgccuacaggagugagc

SEQ ID NO: 3242670 - RNA, 21 nt, Human
gcgccuacaggagugagcacu

SEQ ID NO: 3242671 - RNA, 20 nt, Human
gcgccuacaggagugagcac

SEQ ID NO: 3242672 - RNA, 22 nt, Human
gcgcuccgggacguggcaccuc

SEQ ID NO: 3242673 - RNA, 21 nt, Human
gcgccucaacucugcugaggg

SEQ ID NO: 3242674 - RNA, 22 nt, Human
gcgccucaacucugcugagggu

SEQ ID NO: 3242675 - RNA, 19 nt, Human
gcgcucccuugaccugcug

SEQ ID NO: 3242676 - RNA, 14 nt, Human
gcgcugccccuggc

SEQ ID NO: 3242677 - RNA, 23 nt, Human
gcgcucgaaguugaucuccccag

SEQ ID NO: 3242678 - RNA, 16 nt, Human
gccuggugguuuucaa

SEQ ID NO: 3242679 - RNA, 14 nt, Human
gccuggugguuuuc

SEQ ID NO: 3242680 - RNA, 18 nt, Human
gccuguaaucacagcuac

SEQ ID NO: 3242681 - RNA, 17 nt, Human
gccugguggcagcugcg

SEQ ID NO: 3242682 - RNA, 16 nt, Human
gccugguggcagcugc

SEQ ID NO: 3242683 - RNA, 15 nt, Human
gccugguggcagcug

SEQ ID NO: 3242684 - RNA, 14 nt, Human
gccugguggcagcu

SEQ ID NO: 3242685 - RNA, 20 nt, Human
gccuuagaagucacacagua

SEQ ID NO: 3242686 - RNA, 16 nt, Human
gccuuagaaccuuucu

SEQ ID NO: 3242687 - RNA, 21 nt, Human
gccuuauggaacacucugaga

SEQ ID NO: 3242688 - RNA, 22 nt, Human
gccuuauggaacacucugagac

SEQ ID NO: 3242689 - RNA, 23 nt, Human
gccuuauggaacacucugagacu

SEQ ID NO: 3242690 - RNA, 16 nt, Human
gccuuauguugaaaaa

SEQ ID NO: 3242691 - RNA, 17 nt, Human
gccuuauguugaaaaaa

SEQ ID NO: 3242692 - RNA, 20 nt, Human
gccuuauggaacacucugag

SEQ ID NO: 3242693 - RNA, 13 nt, Human
gccuucaaaucaa

SEQ ID NO: 3242694 - RNA, 18 nt, Human
gccuucggccuccauccu

SEQ ID NO: 3242695 - RNA, 21 nt, Human
gccuuccaggggugggacacc

SEQ ID NO: 3242696 - RNA, 13 nt, Human
gccuucagcucua

SEQ ID NO: 3242697 - RNA, 17 nt, Human
gccuugggcucugcuga

SEQ ID NO: 3242698 - RNA, 16 nt, Human
gccuugggcucugcug

SEQ ID NO: 3242699 - RNA, 15 nt, Human
gccuugggcucugcu

SEQ ID NO: 3242700 - RNA, 19 nt, Human
gccuugggauccaggcccc

SEQ ID NO: 3242701 - RNA, 14 nt, Human
gccuugggcucugc

SEQ ID NO: 3242702 - RNA, 22 nt, Human
gccuuuaucuaccaacuuucaa

SEQ ID NO: 3242703 - RNA, 21 nt, Human
gccuuuaucuaccaacuuuca

SEQ ID NO: 3242704 - RNA, 15 nt, Human
gccuuggggacaacc

SEQ ID NO: 3242705 - RNA, 22 nt, Human
gcgacagugagacucugucuca

SEQ ID NO: 3242706 - RNA, 18 nt, Human
gcgacaucucugacuuuc

SEQ ID NO: 3242707 - RNA, 21 nt, Human
gccuuuuguucauuucauccu

SEQ ID NO: 3242708 - RNA, 13 nt, Human
gccuuuggcuuca

SEQ ID NO: 3242709 - RNA, 18 nt, Human
gccuuucagcaggcagcc

SEQ ID NO: 3242710 - RNA, 17 nt, Human
gccuuucagcaggcagc

SEQ ID NO: 3242711 - RNA, 16 nt, Human
gccuuucagcaggcag

SEQ ID NO: 3242712 - RNA, 17 nt, Human
gccuuugggugcuguuu

SEQ ID NO: 3242713 - RNA, 22 nt, Human
gccuuugggugcuguuuugcca

SEQ ID NO: 3242714 - RNA, 11 nt, Human
gccuuuguaac

SEQ ID NO: 3242715 - RNA, 22 nt, Human
gccuuuguaaccacaacuuuca

SEQ ID NO: 3242716 - RNA, 14 nt, Human
gccccgcccaggcu

SEQ ID NO: 3242717 - RNA, 22 nt, Human
gccccgaggccuucucugaagg

SEQ ID NO: 3242718 - RNA, 23 nt, Human
gccccauucugccugcccaggcc

SEQ ID NO: 3242719 - RNA, 22 nt, Human
gccccauucugccugcccaggc

SEQ ID NO: 3242720 - RNA, 23 nt, Human
gccccgaggccuucucugaagga

SEQ ID NO: 3242721 - RNA, 15 nt, Human
gccccauucugccug

SEQ ID NO: 3242722 - RNA, 17 nt, Human
gccccgugggguuccuc

SEQ ID NO: 3242723 - RNA, 17 nt, Human
gccccgucucaggucug

SEQ ID NO: 3242724 - RNA, 14 nt, Human
gccccgucucaggu

SEQ ID NO: 3242725 - RNA, 13 nt, Human
gccccgucucagg

SEQ ID NO: 3242726 - RNA, 21 nt, Human
gccccgucuacagcuccccca

SEQ ID NO: 3242727 - RNA, 21 nt, Human
gccccgucccccucuggcucc

SEQ ID NO: 3242728 - RNA, 18 nt, Human
gccccgucuacagcuccc

SEQ ID NO: 3242729 - RNA, 17 nt, Human
gccccgucccccucugg

SEQ ID NO: 3242730 - RNA, 20 nt, Human
gccccugagaucucugcagg

SEQ ID NO: 3242731 - RNA, 11 nt, Human
gccccugagcc

SEQ ID NO: 3242732 - RNA, 13 nt, Human
gccccugcacaaa

SEQ ID NO: 3242733 - RNA, 15 nt, Human
gccccugagcccacu

SEQ ID NO: 3242734 - RNA, 14 nt, Human
gccccugagcccac

SEQ ID NO: 3242735 - RNA, 13 nt, Human
gccccugagccca

SEQ ID NO: 3242736 - RNA, 12 nt, Human
gccccugagccc

SEQ ID NO: 3242737 - RNA, 19 nt, Human
gccccugcacuccagccug

SEQ ID NO: 3242738 - RNA, 23 nt, Human
gccccuggcagccccuguucugg

SEQ ID NO: 3242739 - RNA, 16 nt, Human
gccccugagcccacug

SEQ ID NO: 3242740 - RNA, 17 nt, Human
gccccuucccccuccaa

SEQ ID NO: 3242741 - RNA, 19 nt, Human
gccccucagggucccuggu

SEQ ID NO: 3242742 - RNA, 21 nt, Human
gccccucagggucccuggugg

SEQ ID NO: 3242743 - RNA, 18 nt, Human
gccccucagggucccugg

SEQ ID NO: 3242744 - RNA, 15 nt, Human
gccccguucuguuug

SEQ ID NO: 3242745 - RNA, 22 nt, Human
gcccuccucccucccagcucca

SEQ ID NO: 3242746 - RNA, 20 nt, Human
gcccuccucccucccagcuc

SEQ ID NO: 3242747 - RNA, 18 nt, Human
gcccuccucccucccagc

SEQ ID NO: 3242748 - RNA, 19 nt, Human
gcccucugcccacucccug

SEQ ID NO: 3242749 - RNA, 22 nt, Human
gcccucugcccacucccugcaa

SEQ ID NO: 3242750 - RNA, 19 nt, Human
gcccgggcucugccuccca

SEQ ID NO: 3242751 - RNA, 20 nt, Human
gcccgggcucugccucccau

SEQ ID NO: 3242752 - RNA, 15 nt, Human
gcccucccugccccu

SEQ ID NO: 3242753 - RNA, 13 nt, Human
gcccgggcucugc

SEQ ID NO: 3242754 - RNA, 14 nt, Human
gcccgggcucugcc

SEQ ID NO: 3242755 - RNA, 15 nt, Human
gcccgggcucugccu

SEQ ID NO: 3242756 - RNA, 18 nt, Human
gcccgggcucugccuccc

SEQ ID NO: 3242757 - RNA, 12 nt, Human
gcccgggcucug

SEQ ID NO: 3242758 - RNA, 14 nt, Human
gcccggcuccaggc

SEQ ID NO: 3242759 - RNA, 13 nt, Human
gcccggcuccagg

SEQ ID NO: 3242760 - RNA, 12 nt, Human
gcccggcuccag

SEQ ID NO: 3242761 - RNA, 19 nt, Human
gccccuucugacccaugcu

SEQ ID NO: 3242762 - RNA, 18 nt, Human
gcccaugauauaacuuua

SEQ ID NO: 3242763 - RNA, 17 nt, Human
gcccaugagagcgcagc

SEQ ID NO: 3242764 - RNA, 19 nt, Human
gcccaugagagcgcagccc

SEQ ID NO: 3242765 - RNA, 20 nt, Human
gcccaugagagcgcagcccg

SEQ ID NO: 3242766 - RNA, 17 nt, Human
gccccagcuugggcaga

SEQ ID NO: 3242767 - RNA, 23 nt, Human
gccccagcgcugacgugucagga

SEQ ID NO: 3242768 - RNA, 14 nt, Human
gccccagcgcugac

SEQ ID NO: 3242769 - RNA, 17 nt, Human
gccccagugcccacagg

SEQ ID NO: 3242770 - RNA, 16 nt, Human
gccccagugcccacag

SEQ ID NO: 3242771 - RNA, 15 nt, Human
gccccagugcccaca

SEQ ID NO: 3242772 - RNA, 21 nt, Human
gccccauucugccugcccagg

SEQ ID NO: 3242773 - RNA, 20 nt, Human
gccccauucugccugcccag

SEQ ID NO: 3242774 - RNA, 18 nt, Human
gccccauucugccugccc

SEQ ID NO: 3242775 - RNA, 17 nt, Human
gccccauucugccugcc

SEQ ID NO: 3242776 - RNA, 23 nt, Human
gccccauccucuguacagagccc

SEQ ID NO: 3242777 - RNA, 15 nt, Human
gcccaggcuggcgug

SEQ ID NO: 3242778 - RNA, 14 nt, Human
gcccaggcuggcgu

SEQ ID NO: 3242779 - RNA, 16 nt, Human
gcccaggcuggcgugc

SEQ ID NO: 3242780 - RNA, 20 nt, Human
gcccagucuggaaugcagug

SEQ ID NO: 3242781 - RNA, 20 nt, Human
gcccagucccagcagccagc

SEQ ID NO: 3242782 - RNA, 19 nt, Human
gcccagucccagcagccag

SEQ ID NO: 3242783 - RNA, 18 nt, Human
gcccagucccagcagcca

SEQ ID NO: 3242784 - RNA, 22 nt, Human
gcccagucuggaaugcaguggu

SEQ ID NO: 3242785 - RNA, 14 nt, Human
gcccaguacauuua

SEQ ID NO: 3242786 - RNA, 19 nt, Human
gcccaguacauuuaaauuu

SEQ ID NO: 3242787 - RNA, 22 nt, Human
gcccaguacauuuaaauuuuuu

SEQ ID NO: 3242788 - RNA, 13 nt, Human
gcccagucccagc

SEQ ID NO: 3242789 - RNA, 12 nt, Human
gcccagucccag

SEQ ID NO: 3242790 - RNA, 17 nt, Human
gcccagucccagcagcc

SEQ ID NO: 3242791 - RNA, 16 nt, Human
gcccagucccagcagc

SEQ ID NO: 3242792 - RNA, 15 nt, Human
gcccagucccagcag

SEQ ID NO: 3242793 - RNA, 14 nt, Human
gcccagucccagca

SEQ ID NO: 3242794 - RNA, 12 nt, Human
gcccaggaaagg

SEQ ID NO: 3242795 - RNA, 15 nt, Human
gcccaggaaaggcuc

SEQ ID NO: 3242796 - RNA, 16 nt, Human
gcccaggaaaggcucc

SEQ ID NO: 3242797 - RNA, 18 nt, Human
gcccaggccuccuacagc

SEQ ID NO: 3242798 - RNA, 11 nt, Human
gcccaggcugg

SEQ ID NO: 3242799 - RNA, 13 nt, Human
gcccaggccuccu

SEQ ID NO: 3242800 - RNA, 23 nt, Human
gcccagcuuuucauugcugugac

SEQ ID NO: 3242801 - RNA, 17 nt, Human
gcccaggccugccuguu

SEQ ID NO: 3242802 - RNA, 23 nt, Human
gcccacccugcuuggcccagggg

SEQ ID NO: 3242803 - RNA, 22 nt, Human
gcccacccugcuuggcccaggg

SEQ ID NO: 3242804 - RNA, 21 nt, Human
gcccacccugcuuggcccagg

SEQ ID NO: 3242805 - RNA, 14 nt, Human
gccacucaggccca

SEQ ID NO: 3242806 - RNA, 22 nt, Human
gccacucaggcccaaagccucg

SEQ ID NO: 3242807 - RNA, 18 nt, Human
gccacuccagaccccugg

SEQ ID NO: 3242808 - RNA, 16 nt, Human
gccacuccagaccccu

SEQ ID NO: 3242809 - RNA, 19 nt, Human
gccacuccagaccccuggc

SEQ ID NO: 3242810 - RNA, 18 nt, Human
gccacugcaccgggccac

SEQ ID NO: 3242811 - RNA, 17 nt, Human
gccacugcaccgggcca

SEQ ID NO: 3242812 - RNA, 18 nt, Human
gccagagggagugacaga

SEQ ID NO: 3242813 - RNA, 17 nt, Human
gccagagggagugacag

SEQ ID NO: 3242814 - RNA, 12 nt, Human
gccagagacaca

SEQ ID NO: 3242815 - RNA, 15 nt, Human
gccagagacacaagc

SEQ ID NO: 3242816 - RNA, 22 nt, Human
gccacguucuuacuaguuuccc

SEQ ID NO: 3242817 - RNA, 14 nt, Human
gccacguuuucacc

SEQ ID NO: 3242818 - RNA, 16 nt, Human
gccacggccaggccag

SEQ ID NO: 3242819 - RNA, 21 nt, Human
gccacuauuguuagucucuug

SEQ ID NO: 3242820 - RNA, 20 nt, Human
gccacuauuguuagucucuu

SEQ ID NO: 3242821 - RNA, 15 nt, Human
gccacggccaggcca

SEQ ID NO: 3242822 - RNA, 14 nt, Human
gccacggccaggcc

SEQ ID NO: 3242823 - RNA, 12 nt, Human
gccaaaggaagc

SEQ ID NO: 3242824 - RNA, 15 nt, Human
gccaaaguacagaau

SEQ ID NO: 3242825 - RNA, 17 nt, Human
gccaaaguacagaauuu

SEQ ID NO: 3242826 - RNA, 19 nt, Human
gccaaauaaaguuaaaagu

SEQ ID NO: 3242827 - RNA, 14 nt, Human
gccagcugcuuggg

SEQ ID NO: 3242828 - RNA, 15 nt, Human
gccagcugcugagcc

SEQ ID NO: 3242829 - RNA, 20 nt, Human
gccagcugcugagccgcaga

SEQ ID NO: 3242830 - RNA, 19 nt, Human
gccagcugcugagccgcag

SEQ ID NO: 3242831 - RNA, 18 nt, Human
gccagcugcugagccgca

SEQ ID NO: 3242832 - RNA, 16 nt, Human
gccagcugcugagccg

SEQ ID NO: 3242833 - RNA, 15 nt, Human
gccagcugcuugggc

SEQ ID NO: 3242834 - RNA, 22 nt, Human
gccagcugcugagccgcagaga

SEQ ID NO: 3242835 - RNA, 14 nt, Human
gccagccuugacca

SEQ ID NO: 3242836 - RNA, 20 nt, Human
gccagccuugaccauucucc

SEQ ID NO: 3242837 - RNA, 21 nt, Human
gccagccuugaccauucucca

SEQ ID NO: 3242838 - RNA, 22 nt, Human
gccagccuugaccauucuccac

SEQ ID NO: 3242839 - RNA, 20 nt, Human
gccagccgagauagccaagg

SEQ ID NO: 3242840 - RNA, 12 nt, Human
gccagccuugac

SEQ ID NO: 3242841 - RNA, 16 nt, Human
gccagauucuuuccug

SEQ ID NO: 3242842 - RNA, 20 nt, Human
gccagagggagugacagagg

SEQ ID NO: 3242843 - RNA, 19 nt, Human
gccagagggagugacagag

SEQ ID NO: 3242844 - RNA, 17 nt, Human
gccagauucuuuccuga

SEQ ID NO: 3242845 - RNA, 15 nt, Human
gccagauguccuaau

SEQ ID NO: 3242846 - RNA, 14 nt, Human
gcccacaccuccug

SEQ ID NO: 3242847 - RNA, 15 nt, Human
gcccacaccuccugg

SEQ ID NO: 3242848 - RNA, 18 nt, Human
gcccacaccuccuggggc

SEQ ID NO: 3242849 - RNA, 15 nt, Human
gcccaaaugcuggcu

SEQ ID NO: 3242850 - RNA, 15 nt, Human
gcccaaagaugcagc

SEQ ID NO: 3242851 - RNA, 16 nt, Human
gcccaaagaugcagcc

SEQ ID NO: 3242852 - RNA, 18 nt, Human
gcccacaggaucagucug

SEQ ID NO: 3242853 - RNA, 13 nt, Human
gcccacaggauca

SEQ ID NO: 3242854 - RNA, 19 nt, Human
gcccacaggaucagucuga

SEQ ID NO: 3242855 - RNA, 15 nt, Human
gcccaccccucaaca

SEQ ID NO: 3242856 - RNA, 20 nt, Human
gcccacccugcuuggcccag

SEQ ID NO: 3242857 - RNA, 20 nt, Human
gcccacccgguucaguguuu

SEQ ID NO: 3242858 - RNA, 14 nt, Human
gccaugggacaggg

SEQ ID NO: 3242859 - RNA, 19 nt, Human
gccaugggacagggaggac

SEQ ID NO: 3242860 - RNA, 13 nt, Human
gccauggaggcag

SEQ ID NO: 3242861 - RNA, 22 nt, Human
gccauuuaaagcuuauuaaaac

SEQ ID NO: 3242862 - RNA, 17 nt, Human
gccauuucuuccacaag

SEQ ID NO: 3242863 - RNA, 11 nt, Human
gccauuucaug

SEQ ID NO: 3242864 - RNA, 14 nt, Human
gccauuucaugucc

SEQ ID NO: 3242865 - RNA, 20 nt, Human
gccauuucuuccacaagagc

SEQ ID NO: 3242866 - RNA, 22 nt, Human
gccauuucuuccacaagagccc

SEQ ID NO: 3242867 - RNA, 17 nt, Human
gccaucccagccccaau

SEQ ID NO: 3242868 - RNA, 14 nt, Human
gccauccagguuca

SEQ ID NO: 3242869 - RNA, 13 nt, Human
gccaucccagccc

SEQ ID NO: 3242870 - RNA, 14 nt, Human
gccaucccagcccc

SEQ ID NO: 3242871 - RNA, 15 nt, Human
gccaucccagcccca

SEQ ID NO: 3242872 - RNA, 16 nt, Human
gccaucccagccccaa

SEQ ID NO: 3242873 - RNA, 20 nt, Human
gccauccagguucagcuugu

SEQ ID NO: 3242874 - RNA, 19 nt, Human
gccauccagguucagcuug

SEQ ID NO: 3242875 - RNA, 15 nt, Human
gccaggugccuccug

SEQ ID NO: 3242876 - RNA, 16 nt, Human
gccaggugccuccuga

SEQ ID NO: 3242877 - RNA, 23 nt, Human
gccaggggaaaaucagccugcuc

SEQ ID NO: 3242878 - RNA, 21 nt, Human
gccaggggaaaaucagccugc

SEQ ID NO: 3242879 - RNA, 22 nt, Human
gccaggggaaaaucagccugcu

SEQ ID NO: 3242880 - RNA, 17 nt, Human
gccaggggaaaaucagc

SEQ ID NO: 3242881 - RNA, 19 nt, Human
gccaggaagccagcaggcu

SEQ ID NO: 3242882 - RNA, 17 nt, Human
gccaggaagccagcagg

SEQ ID NO: 3242883 - RNA, 18 nt, Human
gccaggaagccagcaggc

SEQ ID NO: 3242884 - RNA, 15 nt, Human
gccaggaagccagca

SEQ ID NO: 3242885 - RNA, 19 nt, Human
gcuguucagauuggacaua

SEQ ID NO: 3242886 - RNA, 21 nt, Human
gcuuccagugaggcucugccc

SEQ ID NO: 3242887 - RNA, 19 nt, Human
gcuuccagugaggcucugc

SEQ ID NO: 3242888 - RNA, 20 nt, Human
gcuuccagugaggcucugcc

SEQ ID NO: 3242889 - RNA, 16 nt, Human
gcuguucacagccaga

SEQ ID NO: 3242890 - RNA, 15 nt, Human
gcuguucacagccag

SEQ ID NO: 3242891 - RNA, 23 nt, Human
gcuguucacagccagacuggcac

SEQ ID NO: 3242892 - RNA, 18 nt, Human
gcuuccagugaggcucug

SEQ ID NO: 3242893 - RNA, 19 nt, Human
gcuucuggugaccuuccaa

SEQ ID NO: 3242894 - RNA, 16 nt, Human
gcuucugugcaccugg

SEQ ID NO: 3242895 - RNA, 17 nt, Human
gcuucugugcaccuggg

SEQ ID NO: 3242896 - RNA, 18 nt, Human
gcuucugugcaccugggc

SEQ ID NO: 3242897 - RNA, 22 nt, Human
gcuugaggguugggcugguguc

SEQ ID NO: 3242898 - RNA, 16 nt, Human
gcuucuguugcugccu

SEQ ID NO: 3242899 - RNA, 15 nt, Human
gcuucugugcccaga

SEQ ID NO: 3242900 - RNA, 19 nt, Human
gcuucugugcccagaauac

SEQ ID NO: 3242901 - RNA, 21 nt, Human
gcuucugugcccagaauacug

SEQ ID NO: 3242902 - RNA, 14 nt, Human
gcuugccaaaguac

SEQ ID NO: 3242903 - RNA, 21 nt, Human
gcuugccaaaguacagaauuu

SEQ ID NO: 3242904 - RNA, 22 nt, Human
gcuugccaaaguacagaauuug

SEQ ID NO: 3242905 - RNA, 18 nt, Human
gcuugcacucucuuggcu

SEQ ID NO: 3242906 - RNA, 22 nt, Human
gcuugcagagaugaggccgcca

SEQ ID NO: 3242907 - RNA, 14 nt, Human
gcuugcacucucuu

SEQ ID NO: 3242908 - RNA, 13 nt, Human
gcuugauuaaauc

SEQ ID NO: 3242909 - RNA, 17 nt, Human
gcuugccauuuuucaaa

SEQ ID NO: 3242910 - RNA, 18 nt, Human
gcuugccauuuuucaaaa

SEQ ID NO: 3242911 - RNA, 22 nt, Human
gcuugcccaguacauuuaaauu

SEQ ID NO: 3242912 - RNA, 23 nt, Human
gcuugcccaguacauuuaaauuu

SEQ ID NO: 3242913 - RNA, 17 nt, Human
gcuugcccuggugccuc

SEQ ID NO: 3242914 - RNA, 19 nt, Human
gcuugcccuggugccucac

SEQ ID NO: 3242915 - RNA, 13 nt, Human
gcuuggaggaagg

SEQ ID NO: 3242916 - RNA, 14 nt, Human
gcuuggaggaagga

SEQ ID NO: 3242917 - RNA, 15 nt, Human
gcuuggaggaaggaa

SEQ ID NO: 3242918 - RNA, 19 nt, Human
gcuuuacauacuuuaucaa

SEQ ID NO: 3242919 - RNA, 20 nt, Human
gcuuuaauuccaugaauguu

SEQ ID NO: 3242920 - RNA, 19 nt, Human
gcuuuaauuccaugaaugu

SEQ ID NO: 3242921 - RNA, 14 nt, Human
gcuuugggcugccc

SEQ ID NO: 3242922 - RNA, 12 nt, Human
gcuuggcccugg

SEQ ID NO: 3242923 - RNA, 14 nt, Human
gcuuggcccagggg

SEQ ID NO: 3242924 - RNA, 13 nt, Human
gcuuggcccaggg

SEQ ID NO: 3242925 - RNA, 17 nt, Human
gcuuggcccuggcagcc

SEQ ID NO: 3242926 - RNA, 15 nt, Human
gcuuggcccuggcag

SEQ ID NO: 3242927 - RNA, 14 nt, Human
gcuuggcccuggca

SEQ ID NO: 3242928 - RNA, 13 nt, Human
gcuuuaaucagaa

SEQ ID NO: 3242929 - RNA, 14 nt, Human
gcuuuuacuuaaac

SEQ ID NO: 3242930 - RNA, 22 nt, Human
gcuuuuacccuuuuucuugaau

SEQ ID NO: 3242931 - RNA, 17 nt, Human
gcuuuuacccuuuuucu

SEQ ID NO: 3242932 - RNA, 23 nt, Human
ggaaaaaauugcuuuugagagaa

SEQ ID NO: 3242933 - RNA, 12 nt, Human
gcuuuuagaaaa

SEQ ID NO: 3242934 - RNA, 13 nt, Human
gcuuuuagaaaag

SEQ ID NO: 3242935 - RNA, 17 nt, Human
gcuuuuaaaaaaaaaua

SEQ ID NO: 3242936 - RNA, 16 nt, Human
gcuuugggcugcccug

SEQ ID NO: 3242937 - RNA, 15 nt, Human
gcuuugggcugcccu

SEQ ID NO: 3242938 - RNA, 13 nt, Human
gcuuuuacccuuu

SEQ ID NO: 3242939 - RNA, 18 nt, Human
gcuuuuaaggaaaggcaa

SEQ ID NO: 3242940 - RNA, 16 nt, Human
gcuuuuaaaauuuuaa

SEQ ID NO: 3242941 - RNA, 14 nt, Human
gcuuuuaaaauuuu

SEQ ID NO: 3242942 - RNA, 12 nt, Human
gcuuuuaaaauu

SEQ ID NO: 3242943 - RNA, 20 nt, Human
gcuuuuaaaacuacuuagca

SEQ ID NO: 3242944 - RNA, 14 nt, Human
gcuuuuaaaacuac

SEQ ID NO: 3242945 - RNA, 15 nt, Human
ggaaaaauagccugc

SEQ ID NO: 3242946 - RNA, 22 nt, Human
ggaaaaccaagccguggcuucc

SEQ ID NO: 3242947 - RNA, 16 nt, Human
ggaaaaauaugugaag

SEQ ID NO: 3242948 - RNA, 13 nt, Human
ggaaaaauaugug

SEQ ID NO: 3242949 - RNA, 12 nt, Human
ggaaaaauaugu

SEQ ID NO: 3242950 - RNA, 22 nt, Human
ggaaaaaguauuaauucucuuu

SEQ ID NO: 3242951 - RNA, 21 nt, Human
ggaaaaccaagccguggcuuc

SEQ ID NO: 3242952 - RNA, 15 nt, Human
ggaaaacgauuuaau

SEQ ID NO: 3242953 - RNA, 14 nt, Human
ggaaaagaaaucua

SEQ ID NO: 3242954 - RNA, 13 nt, Human
ggaaaagaaaucu

SEQ ID NO: 3242955 - RNA, 14 nt, Human
ggaaaaacugauuu

SEQ ID NO: 3242956 - RNA, 13 nt, Human
ggaaaaauagccu

SEQ ID NO: 3242957 - RNA, 16 nt, Human
ggaagauaaguuggaa

SEQ ID NO: 3242958 - RNA, 18 nt, Human
ggaagauaaguuggaaac

SEQ ID NO: 3242959 - RNA, 13 nt, Human
ggaagagccuugc

SEQ ID NO: 3242960 - RNA, 13 nt, Human
ggaagcacaugcc

SEQ ID NO: 3242961 - RNA, 14 nt, Human
ggaagcacaugccu

SEQ ID NO: 3242962 - RNA, 15 nt, Human
ggaagcacaugccuc

SEQ ID NO: 3242963 - RNA, 17 nt, Human
ggaagcacaugccucuc

SEQ ID NO: 3242964 - RNA, 17 nt, Human
ggaagcacagcuucauu

SEQ ID NO: 3242965 - RNA, 21 nt, Human
ggaagcacaugccucucucag

SEQ ID NO: 3242966 - RNA, 22 nt, Human
ggaagcacaugccucucucagg

SEQ ID NO: 3242967 - RNA, 23 nt, Human
ggaagcacaugccucucucaggc

SEQ ID NO: 3242968 - RNA, 13 nt, Human
ggaagcagaagga

SEQ ID NO: 3242969 - RNA, 13 nt, Human
ggaagcagcuuuc

SEQ ID NO: 3242970 - RNA, 22 nt, Human
ggaagcagguuaaauguuuugu

SEQ ID NO: 3242971 - RNA, 14 nt, Human
ggaagcagugccca

SEQ ID NO: 3242972 - RNA, 16 nt, Human
ggaagcagugcccagg

SEQ ID NO: 3242973 - RNA, 15 nt, Human
ggaagcagugcccag

SEQ ID NO: 3242974 - RNA, 18 nt, Human
ggaagcagugcccaggug

SEQ ID NO: 3242975 - RNA, 15 nt, Human
ggaagccagcaggcu

SEQ ID NO: 3242976 - RNA, 16 nt, Human
ggaagccagcaggcuc

SEQ ID NO: 3242977 - RNA, 17 nt, Human
ggaagccagcaggcucu

SEQ ID NO: 3242978 - RNA, 18 nt, Human
ggaagccagcaggcucuc

SEQ ID NO: 3242979 - RNA, 13 nt, Human
ggaagccagcagg

SEQ ID NO: 3242980 - RNA, 14 nt, Human
ggaagccagcaggc

SEQ ID NO: 3242981 - RNA, 20 nt, Human
ggaacagacuggaagcacag

SEQ ID NO: 3242982 - RNA, 19 nt, Human
ggaacagacuggaagcaca

SEQ ID NO: 3242983 - RNA, 23 nt, Human
ggaacguagucggcacagccugg

SEQ ID NO: 3242984 - RNA, 23 nt, Human
ggaacuagacucccaagcuggac

SEQ ID NO: 3242985 - RNA, 20 nt, Human
ggaaaguggcaccugucugc

SEQ ID NO: 3242986 - RNA, 17 nt, Human
ggaacagacuggaagca

SEQ ID NO: 3242987 - RNA, 17 nt, Human
ggaaaucaaagugcuau

SEQ ID NO: 3242988 - RNA, 20 nt, Human
ggaaaucaaagugcuauuac

SEQ ID NO: 3242989 - RNA, 15 nt, Human
ggaaaagacuaagau

SEQ ID NO: 3242990 - RNA, 14 nt, Human
ggaaaauaaauuau

SEQ ID NO: 3242991 - RNA, 19 nt, Human
ggaaaauaggcuuuuuaau

SEQ ID NO: 3242992 - RNA, 21 nt, Human
ggaaaauaaaaaaagaaaaaa

SEQ ID NO: 3242993 - RNA, 20 nt, Human
ggaaaauaaaaaaagaaaaa

SEQ ID NO: 3242994 - RNA, 19 nt, Human
ggaaaauaaaaaaagaaaa

SEQ ID NO: 3242995 - RNA, 17 nt, Human
ggaaaauaaaaaaagaa

SEQ ID NO: 3242996 - RNA, 15 nt, Human
ggaaaaucagccugc

SEQ ID NO: 3242997 - RNA, 22 nt, Human
ggaaaguacauuuuuugaaaug

SEQ ID NO: 3242998 - RNA, 23 nt, Human
ggaaaguauucucuuuucaagaa

SEQ ID NO: 3242999 - RNA, 11 nt, Human
ggaaagucaga

SEQ ID NO: 3243000 - RNA, 18 nt, Human
ggaaagucagaaucagaa

SEQ ID NO: 3243001 - RNA, 21 nt, Human
ggaaaguacauuuuuugaaau

SEQ ID NO: 3243002 - RNA, 23 nt, Human
ggaaaguaagggaagcagaagga

SEQ ID NO: 3243003 - RNA, 20 nt, Human
gcugggacaugggaaagggg

SEQ ID NO: 3243004 - RNA, 16 nt, Human
gcugggacgcucugcu

SEQ ID NO: 3243005 - RNA, 12 nt, Human
gcuggcccugcc

SEQ ID NO: 3243006 - RNA, 17 nt, Human
gcuggccgggagccuga

SEQ ID NO: 3243007 - RNA, 20 nt, Human
gcugggacuacaggcaccca

SEQ ID NO: 3243008 - RNA, 19 nt, Human
gcugggacuacaggcaccc

SEQ ID NO: 3243009 - RNA, 18 nt, Human
gcugggacuacaggcacc

SEQ ID NO: 3243010 - RNA, 13 nt, Human
gcugggacuacag

SEQ ID NO: 3243011 - RNA, 19 nt, Human
gcugggacuacagguguga

SEQ ID NO: 3243012 - RNA, 17 nt, Human
gcugggacgcucugcug

SEQ ID NO: 3243013 - RNA, 21 nt, Human
gcuggaccuugaacuggguac

SEQ ID NO: 3243014 - RNA, 17 nt, Human
gcugcuugggcuucauc

SEQ ID NO: 3243015 - RNA, 18 nt, Human
gcuggaccuugaacuggg

SEQ ID NO: 3243016 - RNA, 16 nt, Human
gcuggaccuugaacug

SEQ ID NO: 3243017 - RNA, 16 nt, Human
gcugcgguccacccag

SEQ ID NO: 3243018 - RNA, 12 nt, Human
gcugcccuguga

SEQ ID NO: 3243019 - RNA, 14 nt, Human
gcugcccugugagu

SEQ ID NO: 3243020 - RNA, 23 nt, Human
gcugcccuggugcugccacacuu

SEQ ID NO: 3243021 - RNA, 17 nt, Human
gcugcccuuucugggca

SEQ ID NO: 3243022 - RNA, 19 nt, Human
gcugcccuggugcugccac

SEQ ID NO: 3243023 - RNA, 18 nt, Human
gcugcccuggugcugcca

SEQ ID NO: 3243024 - RNA, 11 nt, Human
gcugcccugug

SEQ ID NO: 3243025 - RNA, 22 nt, Human
gcugcccuggugcugccacacu

SEQ ID NO: 3243026 - RNA, 20 nt, Human
gcugcccuggugcugccaca

SEQ ID NO: 3243027 - RNA, 20 nt, Human
gcuagaggccauggaggcag

SEQ ID NO: 3243028 - RNA, 17 nt, Human
gcuagaggauuaguaag

SEQ ID NO: 3243029 - RNA, 24 nt, Human
gcuagaggccauggaggcaguagg

SEQ ID NO: 3243030 - RNA, 12 nt, Human
gcuagcaaauag

SEQ ID NO: 3243031 - RNA, 15 nt, Human
gcuagcacagcuccc

SEQ ID NO: 3243032 - RNA, 14 nt, Human
gcuagcacagcucc

SEQ ID NO: 3243033 - RNA, 16 nt, Human
gcuagcaaauaguaau

SEQ ID NO: 3243034 - RNA, 18 nt, Human
gcugcgguccacccagga

SEQ ID NO: 3243035 - RNA, 17 nt, Human
gcugcgguccacccagg

SEQ ID NO: 3243036 - RNA, 13 nt, Human
gcugcuucaagga

SEQ ID NO: 3243037 - RNA, 16 nt, Human
gcugcuugggcuucau

SEQ ID NO: 3243038 - RNA, 21 nt, Human
gcugcuucaaggauccugagc

SEQ ID NO: 3243039 - RNA, 22 nt, Human
gcugcuucaaggauccugagcc

SEQ ID NO: 3243040 - RNA, 23 nt, Human
gcugcuucaaggauccugagcca

SEQ ID NO: 3243041 - RNA, 20 nt, Human
gcugcuguguguggcuucug

SEQ ID NO: 3243042 - RNA, 15 nt, Human
gcugcuucauguuug

SEQ ID NO: 3243043 - RNA, 18 nt, Human
gcugggcuucaguggcag

SEQ ID NO: 3243044 - RNA, 15 nt, Human
gcuggggcagccucu

SEQ ID NO: 3243045 - RNA, 23 nt, Human
gcugggggaagaagcucucuccu

SEQ ID NO: 3243046 - RNA, 12 nt, Human
gcuggggccagu

SEQ ID NO: 3243047 - RNA, 19 nt, Human
gcuggucccacucagucca

SEQ ID NO: 3243048 - RNA, 15 nt, Human
gcuggucccacucag

SEQ ID NO: 3243049 - RNA, 20 nt, Human
gcugggggccucagugccac

SEQ ID NO: 3243050 - RNA, 19 nt, Human
gcugggggccucagugcca

SEQ ID NO: 3243051 - RNA, 19 nt, Human
gcugggggaugggccugag

SEQ ID NO: 3243052 - RNA, 18 nt, Human
gcugggggaugggccuga

SEQ ID NO: 3243053 - RNA, 21 nt, Human
gcugggaugauuggagggggg

SEQ ID NO: 3243054 - RNA, 16 nt, Human
gcugggagcucugcag

SEQ ID NO: 3243055 - RNA, 15 nt, Human
gcugggagcucugca

SEQ ID NO: 3243056 - RNA, 17 nt, Human
gcugggcuucaguggca

SEQ ID NO: 3243057 - RNA, 17 nt, Human
gcugggauuacaggcgu

SEQ ID NO: 3243058 - RNA, 18 nt, Human
gcugggauuacaggcgug

SEQ ID NO: 3243059 - RNA, 19 nt, Human
gcugggauuacaggcuccu

SEQ ID NO: 3243060 - RNA, 20 nt, Human
gcugggauuacaggcuccug

SEQ ID NO: 3243061 - RNA, 12 nt, Human
gcugggagagcc

SEQ ID NO: 3243062 - RNA, 13 nt, Human
gcugggagagccu

SEQ ID NO: 3243063 - RNA, 17 nt, Human
gcugggagagccuucca

SEQ ID NO: 3243064 - RNA, 18 nt, Human
gcugggagagccuuccag

SEQ ID NO: 3243065 - RNA, 19 nt, Human
gcugggagagccuuccagg

SEQ ID NO: 3243066 - RNA, 22 nt, Human
gcugggagagccuuccaggggu

SEQ ID NO: 3243067 - RNA, 14 nt, Human
gcugggacugggaa

SEQ ID NO: 3243068 - RNA, 22 nt, Human
gcugguucaggguuggccccug

SEQ ID NO: 3243069 - RNA, 16 nt, Human
gcugucaauuacagga

SEQ ID NO: 3243070 - RNA, 14 nt, Human
gcugucaaggcuca

SEQ ID NO: 3243071 - RNA, 21 nt, Human
gcugguuagagguucccuuug

SEQ ID NO: 3243072 - RNA, 15 nt, Human
gcugguucaggguug

SEQ ID NO: 3243073 - RNA, 14 nt, Human
gcuggucccacuca

SEQ ID NO: 3243074 - RNA, 20 nt, Human
gcuggucccacucaguccau

SEQ ID NO: 3243075 - RNA, 18 nt, Human
gcuggugucaccugaaga

SEQ ID NO: 3243076 - RNA, 16 nt, Human
gcuggugucaccugaa

SEQ ID NO: 3243077 - RNA, 17 nt, Human
gcugucaauuacaggaa

SEQ ID NO: 3243078 - RNA, 19 nt, Human
gcugucaauuacaggaagu

SEQ ID NO: 3243079 - RNA, 22 nt, Human
gcugucaauuacaggaaguacu

SEQ ID NO: 3243080 - RNA, 23 nt, Human
gcugucaauuacaggaaguacug

SEQ ID NO: 3243081 - RNA, 21 nt, Human
gcugucccuuacgugaguccu

SEQ ID NO: 3243082 - RNA, 19 nt, Human
gcugucccuuacgugaguc

SEQ ID NO: 3243083 - RNA, 17 nt, Human
gcugucuccauguuuga

SEQ ID NO: 3243084 - RNA, 23 nt, Human
gcugucuguuguauucauugugg

SEQ ID NO: 3243085 - RNA, 19 nt, Human
gcugucuggcacagccugc

SEQ ID NO: 3243086 - RNA, 15 nt, Human
gcugucuggcacagc

SEQ ID NO: 3243087 - RNA, 19 nt, Human
gcugucuuucuugcucccu

SEQ ID NO: 3243088 - RNA, 18 nt, Human
gcugucuuucuugcuccc

SEQ ID NO: 3243089 - RNA, 17 nt, Human
gcugucuuucuugcucc

SEQ ID NO: 3243090 - RNA, 16 nt, Human
gcugucuuucuugcuc

SEQ ID NO: 3243091 - RNA, 19 nt, Human
ggauccaggccccucccuc

SEQ ID NO: 3243092 - RNA, 19 nt, Human
ggcaacccccagccugcua

SEQ ID NO: 3243093 - RNA, 18 nt, Human
ggauccaggccccucccu

SEQ ID NO: 3243094 - RNA, 17 nt, Human
ggauccaggccccuccc

SEQ ID NO: 3243095 - RNA, 13 nt, Human
ggauccaggcccc

SEQ ID NO: 3243096 - RNA, 12 nt, Human
ggauccaggccc

SEQ ID NO: 3243097 - RNA, 21 nt, Human
ggaucagucugauucccaagc

SEQ ID NO: 3243098 - RNA, 16 nt, Human
ggaucaggcucccagg

SEQ ID NO: 3243099 - RNA, 18 nt, Human
ggaucaggcucccaggag

SEQ ID NO: 3243100 - RNA, 13 nt, Human
ggaucagcugagc

SEQ ID NO: 3243101 - RNA, 12 nt, Human
ggauccccuucc

SEQ ID NO: 3243102 - RNA, 18 nt, Human
ggcaacugcauuggcuuu

SEQ ID NO: 3243103 - RNA, 19 nt, Human
ggcaacugcauuggcuuug

SEQ ID NO: 3243104 - RNA, 15 nt, Human
ggcaaggcugucaau

SEQ ID NO: 3243105 - RNA, 23 nt, Human
ggcaacuugggaacuagacuccc

SEQ ID NO: 3243106 - RNA, 18 nt, Human
ggcaacuugggaacuaga

SEQ ID NO: 3243107 - RNA, 20 nt, Human
ggcagagcagagaccauccc

SEQ ID NO: 3243108 - RNA, 15 nt, Human
ggcagagcagagacc

SEQ ID NO: 3243109 - RNA, 16 nt, Human
ggcagagcagagacca

SEQ ID NO: 3243110 - RNA, 12 nt, Human
ggcagagcagag

SEQ ID NO: 3243111 - RNA, 16 nt, Human
ggcacccggccccugc

SEQ ID NO: 3243112 - RNA, 15 nt, Human
ggcacccggccccug

SEQ ID NO: 3243113 - RNA, 16 nt, Human
ggcaaggcugucaauu

SEQ ID NO: 3243114 - RNA, 20 nt, Human
ggcaaguuuuccauauuuuu

SEQ ID NO: 3243115 - RNA, 16 nt, Human
ggcaaggggaaucugg

SEQ ID NO: 3243116 - RNA, 22 nt, Human
ggcaauaaaagcccaggagccc

SEQ ID NO: 3243117 - RNA, 20 nt, Human
ggcaauaaaagcccaggagc

SEQ ID NO: 3243118 - RNA, 17 nt, Human
ggcaauaaaagcccagg

SEQ ID NO: 3243119 - RNA, 16 nt, Human
ggcaauaaaagcccag

SEQ ID NO: 3243120 - RNA, 16 nt, Human
ggcaaguuuucccuga

SEQ ID NO: 3243121 - RNA, 19 nt, Human
ggcagguccccagacucca

SEQ ID NO: 3243122 - RNA, 14 nt, Human
ggcagguccccaga

SEQ ID NO: 3243123 - RNA, 23 nt, Human
ggcaggucuugaacuccuggccu

SEQ ID NO: 3243124 - RNA, 13 nt, Human
ggcagguccaggg

SEQ ID NO: 3243125 - RNA, 14 nt, Human
ggcaggaaggcuga

SEQ ID NO: 3243126 - RNA, 19 nt, Human
ggcagcugcgguccaccca

SEQ ID NO: 3243127 - RNA, 21 nt, Human
ggcagcuugaggguugggcug

SEQ ID NO: 3243128 - RNA, 16 nt, Human
ggcagcucaccucucc

SEQ ID NO: 3243129 - RNA, 22 nt, Human
ggcagcucaccucucccuugga

SEQ ID NO: 3243130 - RNA, 18 nt, Human
ggcagcucaccucucccu

SEQ ID NO: 3243131 - RNA, 21 nt, Human
ggcagcucaccucucccuugg

SEQ ID NO: 3243132 - RNA, 19 nt, Human
ggcagcaccgccucuuccc

SEQ ID NO: 3243133 - RNA, 13 nt, Human
ggcagcacccagg

SEQ ID NO: 3243134 - RNA, 12 nt, Human
ggcagcaccgcc

SEQ ID NO: 3243135 - RNA, 19 nt, Human
ggcagaucucccacaugcc

SEQ ID NO: 3243136 - RNA, 13 nt, Human
ggcagaucuccca

SEQ ID NO: 3243137 - RNA, 18 nt, Human
ggcagaugcagcucuucc

SEQ ID NO: 3243138 - RNA, 15 nt, Human
ggcagaugcagcucu

SEQ ID NO: 3243139 - RNA, 21 nt, Human
ggcagaugcagcucuuccugg

SEQ ID NO: 3243140 - RNA, 20 nt, Human
ggcagaugcagcucuuccug

SEQ ID NO: 3243141 - RNA, 23 nt, Human
ggcagaguugaagacagagcuac

SEQ ID NO: 3243142 - RNA, 23 nt, Human
ggcagauacaggaaaagcugcug

SEQ ID NO: 3243143 - RNA, 21 nt, Human
ggcagaguugaagacagagcu

SEQ ID NO: 3243144 - RNA, 17 nt, Human
ggcagaggaaagcaaag

SEQ ID NO: 3243145 - RNA, 22 nt, Human
ggcagaggagaacuugcugccu

SEQ ID NO: 3243146 - RNA, 21 nt, Human
ggcagaggagaacuugcugcc

SEQ ID NO: 3243147 - RNA, 11 nt, Human
ggccaggcugg

SEQ ID NO: 3243148 - RNA, 16 nt, Human
ggccaggccagaggga

SEQ ID NO: 3243149 - RNA, 14 nt, Human
ggccaggccagagg

SEQ ID NO: 3243150 - RNA, 16 nt, Human
ggccacugugaagaga

SEQ ID NO: 3243151 - RNA, 14 nt, Human
ggccaggagccucc

SEQ ID NO: 3243152 - RNA, 16 nt, Human
ggccaggagccuccug

SEQ ID NO: 3243153 - RNA, 11 nt, Human
ggccacuguga

SEQ ID NO: 3243154 - RNA, 12 nt, Human
ggccacugaaga

SEQ ID NO: 3243155 - RNA, 14 nt, Human
ggccacugaagagg

SEQ ID NO: 3243156 - RNA, 15 nt, Human
ggccacugaagagga

SEQ ID NO: 3243157 - RNA, 17 nt, Human
ggccacugaagaggagg

SEQ ID NO: 3243158 - RNA, 19 nt, Human
ggccacugaagaggaggag

SEQ ID NO: 3243159 - RNA, 15 nt, Human
ggcagguuggugggg

SEQ ID NO: 3243160 - RNA, 23 nt, Human
ggcauguucucugaggacacuaa

SEQ ID NO: 3243161 - RNA, 15 nt, Human
ggcauuccccaggag

SEQ ID NO: 3243162 - RNA, 16 nt, Human
ggccacaagacccuug

SEQ ID NO: 3243163 - RNA, 17 nt, Human
ggccacaagacccuugu

SEQ ID NO: 3243164 - RNA, 16 nt, Human
ggccaccugcggugcu

SEQ ID NO: 3243165 - RNA, 22 nt, Human
ggccaccugcggugcuaucucc

SEQ ID NO: 3243166 - RNA, 16 nt, Human
ggccaaucagaagcua

SEQ ID NO: 3243167 - RNA, 17 nt, Human
ggccacacaagugcagu

SEQ ID NO: 3243168 - RNA, 21 nt, Human
ggccccugagaucucugcagg

SEQ ID NO: 3243169 - RNA, 17 nt, Human
ggccccugagaucucug

SEQ ID NO: 3243170 - RNA, 12 nt, Human
ggccccugccac

SEQ ID NO: 3243171 - RNA, 16 nt, Human
ggccccugccacccug

SEQ ID NO: 3243172 - RNA, 13 nt, Human
ggccccugccacc

SEQ ID NO: 3243173 - RNA, 19 nt, Human
ggccccugccagacccccu

SEQ ID NO: 3243174 - RNA, 17 nt, Human
ggccccugccagacccc

SEQ ID NO: 3243175 - RNA, 13 nt, Human
ggccccugcccgg

SEQ ID NO: 3243176 - RNA, 18 nt, Human
ggccccugccacccuggg

SEQ ID NO: 3243177 - RNA, 17 nt, Human
ggccccugccacccugg

SEQ ID NO: 3243178 - RNA, 16 nt, Human
ggccccucaggguccc

SEQ ID NO: 3243179 - RNA, 19 nt, Human
ggccccucagggucccugg

SEQ ID NO: 3243180 - RNA, 20 nt, Human
ggccccucagggucccuggu

SEQ ID NO: 3243181 - RNA, 21 nt, Human
ggccccucagggucccuggug

SEQ ID NO: 3243182 - RNA, 23 nt, Human
ggccccucccucuccagcaggcc

SEQ ID NO: 3243183 - RNA, 15 nt, Human
ggccccucccucucc

SEQ ID NO: 3243184 - RNA, 22 nt, Human
ggccaugggacagggaggacgc

SEQ ID NO: 3243185 - RNA, 13 nt, Human
ggccaugggccuc

SEQ ID NO: 3243186 - RNA, 16 nt, Human
ggccaggcugcucuug

SEQ ID NO: 3243187 - RNA, 15 nt, Human
ggccauggaggcagu

SEQ ID NO: 3243188 - RNA, 13 nt, Human
ggcccccacaugg

SEQ ID NO: 3243189 - RNA, 17 nt, Human
ggcccccugccugcccu

SEQ ID NO: 3243190 - RNA, 13 nt, Human
ggcccccugccug

SEQ ID NO: 3243191 - RNA, 12 nt, Human
ggcccccugccu

SEQ ID NO: 3243192 - RNA, 15 nt, Human
ggccccgucucaggu

SEQ ID NO: 3243193 - RNA, 19 nt, Human
ggccccgucucaggucuga

SEQ ID NO: 3243194 - RNA, 18 nt, Human
ggccccgucucaggucug

SEQ ID NO: 3243195 - RNA, 18 nt, Human
ggaccagcuuggcucagg

SEQ ID NO: 3243196 - RNA, 17 nt, Human
ggaccagcuuggcucag

SEQ ID NO: 3243197 - RNA, 20 nt, Human
ggaagccagcaggcucucag

SEQ ID NO: 3243198 - RNA, 13 nt, Human
ggaaggaggaaga

SEQ ID NO: 3243199 - RNA, 21 nt, Human
ggacccaguggcagggcacag

SEQ ID NO: 3243200 - RNA, 14 nt, Human
ggacccaguggcag

SEQ ID NO: 3243201 - RNA, 11 nt, Human
ggacccagugg

SEQ ID NO: 3243202 - RNA, 19 nt, Human
ggacccaguggcagggcac

SEQ ID NO: 3243203 - RNA, 18 nt, Human
ggacccaguggcagggca

SEQ ID NO: 3243204 - RNA, 17 nt, Human
ggacccaguggcagggc

SEQ ID NO: 3243205 - RNA, 16 nt, Human
ggacccaguggcaggg

SEQ ID NO: 3243206 - RNA, 12 nt, Human
ggacuccucugu

SEQ ID NO: 3243207 - RNA, 14 nt, Human
ggacuccucugucc

SEQ ID NO: 3243208 - RNA, 15 nt, Human
ggacuccucugucca

SEQ ID NO: 3243209 - RNA, 22 nt, Human
ggaccuucacucuaagauguua

SEQ ID NO: 3243210 - RNA, 21 nt, Human
ggaccuucacucuaagauguu

SEQ ID NO: 3243211 - RNA, 13 nt, Human
ggacucuaaaguc

SEQ ID NO: 3243212 - RNA, 21 nt, Human
ggacucuucagcacaaaagga

SEQ ID NO: 3243213 - RNA, 11 nt, Human
ggacucugccu

SEQ ID NO: 3243214 - RNA, 10 nt, Human
ggacugccac

SEQ ID NO: 3243215 - RNA, 17 nt, Human
ggacugccaccuccccu

SEQ ID NO: 3243216 - RNA, 15 nt, Human
ggacugccaccuccc

SEQ ID NO: 3243217 - RNA, 14 nt, Human
ggacugccaccucc

SEQ ID NO: 3243218 - RNA, 13 nt, Human
ggacugccaccuc

SEQ ID NO: 3243219 - RNA, 19 nt, Human
ggagcccugccucuccgcc

SEQ ID NO: 3243220 - RNA, 12 nt, Human
ggagcccugccu

SEQ ID NO: 3243221 - RNA, 20 nt, Human
ggagcaaaaucgaugcagug

SEQ ID NO: 3243222 - RNA, 22 nt, Human
ggagauuuuuuugagucaaaga

SEQ ID NO: 3243223 - RNA, 15 nt, Human
ggagaggggcacagg

SEQ ID NO: 3243224 - RNA, 24 nt, Human
ggagaugcugugccccuggccuug

SEQ ID NO: 3243225 - RNA, 23 nt, Human
ggagaugcugugccccuggccuu

SEQ ID NO: 3243226 - RNA, 15 nt, Human
ggagaugcugugccc

SEQ ID NO: 3243227 - RNA, 14 nt, Human
ggagaugcugugcc

SEQ ID NO: 3243228 - RNA, 17 nt, Human
ggagagcuagcagcagg

SEQ ID NO: 3243229 - RNA, 21 nt, Human
ggagagcuagcagcagggagg

SEQ ID NO: 3243230 - RNA, 21 nt, Human
ggagaccccuuggggagcagg

SEQ ID NO: 3243231 - RNA, 21 nt, Human
ggacugccagucccccugccc

SEQ ID NO: 3243232 - RNA, 23 nt, Human
ggacugccaccuccccuugccag

SEQ ID NO: 3243233 - RNA, 21 nt, Human
ggacugccaccuccccuugcc

SEQ ID NO: 3243234 - RNA, 13 nt, Human
ggauagaugugug

SEQ ID NO: 3243235 - RNA, 14 nt, Human
ggauagaugugugg

SEQ ID NO: 3243236 - RNA, 15 nt, Human
ggauagaugugugga

SEQ ID NO: 3243237 - RNA, 16 nt, Human
ggaucacagccucuga

SEQ ID NO: 3243238 - RNA, 21 nt, Human
ggagugacagaggcagcccca

SEQ ID NO: 3243239 - RNA, 19 nt, Human
ggagugacagaggcagccc

SEQ ID NO: 3243240 - RNA, 18 nt, Human
ggagugacagaggcagcc

SEQ ID NO: 3243241 - RNA, 17 nt, Human
ggagugacagaggcagc

SEQ ID NO: 3243242 - RNA, 21 nt, Human
ggagugaguugauagcacaga

SEQ ID NO: 3243243 - RNA, 14 nt, Human
ggagugagcugguu

SEQ ID NO: 3243244 - RNA, 12 nt, Human
ggagugagcugg

SEQ ID NO: 3243245 - RNA, 16 nt, Human
ggagugacagaggcag

SEQ ID NO: 3243246 - RNA, 11 nt, Human
ggagugacaga

SEQ ID NO: 3243247 - RNA, 20 nt, Human
ggagucccaccuuggcugca

SEQ ID NO: 3243248 - RNA, 17 nt, Human
ggagggcuccagacaca

SEQ ID NO: 3243249 - RNA, 14 nt, Human
ggagggcuccagac

SEQ ID NO: 3243250 - RNA, 15 nt, Human
ggagggcuccagaca

SEQ ID NO: 3243251 - RNA, 14 nt, Human
ggaggggagacuuu

SEQ ID NO: 3243252 - RNA, 16 nt, Human
ggaggggagacuuuga

SEQ ID NO: 3243253 - RNA, 20 nt, Human
ggaguccaggacaggagaug

SEQ ID NO: 3243254 - RNA, 16 nt, Human
ggagucauuucugauu

SEQ ID NO: 3243255 - RNA, 21 nt, Human
ggagucauuuuguguugaaga

SEQ ID NO: 3243256 - RNA, 12 nt, Human
ggagggauuugg

SEQ ID NO: 3243257 - RNA, 12 nt, Human
ggagggcuccag

SEQ ID NO: 3243258 - RNA, 13 nt, Human
ggagggcuccaga

SEQ ID NO: 3243259 - RNA, 13 nt, Human
ggagggacagucu

SEQ ID NO: 3243260 - RNA, 23 nt, Human
ggaggaucacuugaguccagaag

SEQ ID NO: 3243261 - RNA, 17 nt, Human
ggaggaucucuugagcc

SEQ ID NO: 3243262 - RNA, 21 nt, Human
ggaggaucucuugagccuggg

SEQ ID NO: 3243263 - RNA, 20 nt, Human
ggaggagggucuagaggccu

SEQ ID NO: 3243264 - RNA, 12 nt, Human
ggaggaggaggg

SEQ ID NO: 3243265 - RNA, 19 nt, Human
ggaggacgcucucuggccu

SEQ ID NO: 3243266 - RNA, 20 nt, Human
ggagcccugccucuccgccc

SEQ ID NO: 3243267 - RNA, 20 nt, Human
ggaggacgcucucuggccuu

SEQ ID NO: 3243268 - RNA, 21 nt, Human
ggaggacgcucucuggccuuc

SEQ ID NO: 3243269 - RNA, 21 nt, Human
ggagccgggcaaacuggccgc

SEQ ID NO: 3243270 - RNA, 23 nt, Human
ggugguucacucuuggagccugc

SEQ ID NO: 3243271 - RNA, 22 nt, Human
ggugguucacucuuggagccug

SEQ ID NO: 3243272 - RNA, 21 nt, Human
ggugguuauggagaggguguc

SEQ ID NO: 3243273 - RNA, 18 nt, Human
gguguaaucaugaaggag

SEQ ID NO: 3243274 - RNA, 17 nt, Human
ggugucaagagggucug

SEQ ID NO: 3243275 - RNA, 19 nt, Human
ggugucaagagggucugag

SEQ ID NO: 3243276 - RNA, 19 nt, Human
ggugucaccugaagacuca

SEQ ID NO: 3243277 - RNA, 16 nt, Human
ggugucccagaccccg

SEQ ID NO: 3243278 - RNA, 21 nt, Human
gguguccccaccaucugcugu

SEQ ID NO: 3243279 - RNA, 18 nt, Human
gguguccccaccaucugc

SEQ ID NO: 3243280 - RNA, 13 nt, Human
gguguccccacca

SEQ ID NO: 3243281 - RNA, 16 nt, Human
gguggugaccucugcc

SEQ ID NO: 3243282 - RNA, 15 nt, Human
gguggugaccucugc

SEQ ID NO: 3243283 - RNA, 14 nt, Human
gguggugaccucug

SEQ ID NO: 3243284 - RNA, 15 nt, Human
gguggguuaauuaaa

SEQ ID NO: 3243285 - RNA, 15 nt, Human
ggugggugaaaggaa

SEQ ID NO: 3243286 - RNA, 23 nt, Human
gguucacucuuggagccugcaga

SEQ ID NO: 3243287 - RNA, 21 nt, Human
gguucacucuuggagccugca

SEQ ID NO: 3243288 - RNA, 12 nt, Human
gguucuguaaaa

SEQ ID NO: 3243289 - RNA, 16 nt, Human
gguucuuucuuccucu

SEQ ID NO: 3243290 - RNA, 14 nt, Human
gguucuuucuuccu

SEQ ID NO: 3243291 - RNA, 13 nt, Human
gguugagguuuca

SEQ ID NO: 3243292 - RNA, 18 nt, Human
gguucuuucauuugcuuu

SEQ ID NO: 3243293 - RNA, 20 nt, Human
gguucacucuuggagccugc

SEQ ID NO: 3243294 - RNA, 19 nt, Human
gguucacucuuggagccug

SEQ ID NO: 3243295 - RNA, 16 nt, Human
gguucaccauugagac

SEQ ID NO: 3243296 - RNA, 19 nt, Human
gguucaagugauucucuug

SEQ ID NO: 3243297 - RNA, 17 nt, Human
gguucaaaccugugaag

SEQ ID NO: 3243298 - RNA, 23 nt, Human
gguuauuuugauguaaagauguu

SEQ ID NO: 3243299 - RNA, 18 nt, Human
gguuauuuaaaauguaaa

SEQ ID NO: 3243300 - RNA, 16 nt, Human
gguuauuuaaaaugua

SEQ ID NO: 3243301 - RNA, 12 nt, Human
gguuaaaaugga

SEQ ID NO: 3243302 - RNA, 14 nt, Human
gguuaaauguuuug

SEQ ID NO: 3243303 - RNA, 13 nt, Human
gguuaaauguuuu

SEQ ID NO: 3243304 - RNA, 16 nt, Human
gguuaaaaaaaaaagu

SEQ ID NO: 3243305 - RNA, 21 nt, Human
gguuacccaguuagcucucaa

SEQ ID NO: 3243306 - RNA, 21 nt, Human
gguuaacaaauaacaacuuuu

SEQ ID NO: 3243307 - RNA, 13 nt, Human
gguuaacaaauaa

SEQ ID NO: 3243308 - RNA, 17 nt, Human
gguuaggcauuguggga

SEQ ID NO: 3243309 - RNA, 14 nt, Human
gguuagauauagag

SEQ ID NO: 3243310 - RNA, 18 nt, Human
gguuaccgauuucaaagu

SEQ ID NO: 3243311 - RNA, 13 nt, Human
gguuauggagagg

SEQ ID NO: 3243312 - RNA, 15 nt, Human
gguuauagugcaaua

SEQ ID NO: 3243313 - RNA, 17 nt, Human
gguuauagugcaauaua

SEQ ID NO: 3243314 - RNA, 21 nt, Human
gguuaguggauggaaggggcu

SEQ ID NO: 3243315 - RNA, 22 nt, Human
gguuaguggauggaaggggcug

SEQ ID NO: 3243316 - RNA, 21 nt, Human
ggugaccuuccaagagccuga

SEQ ID NO: 3243317 - RNA, 20 nt, Human
ggugaccuuccaagagccug

SEQ ID NO: 3243318 - RNA, 19 nt, Human
ggugaccuuccaagagccu

SEQ ID NO: 3243319 - RNA, 21 nt, Human
ggugaccucugccugaaguca

SEQ ID NO: 3243320 - RNA, 22 nt, Human
ggugaccagcaccaucucuccu

SEQ ID NO: 3243321 - RNA, 14 nt, Human
ggucugacccacug

SEQ ID NO: 3243322 - RNA, 21 nt, Human
ggucugaguuguuaccccaag

SEQ ID NO: 3243323 - RNA, 21 nt, Human
ggugacagagugagacucugu

SEQ ID NO: 3243324 - RNA, 19 nt, Human
ggucucuagugcugugaaa

SEQ ID NO: 3243325 - RNA, 16 nt, Human
ggucucuagugcugug

SEQ ID NO: 3243326 - RNA, 19 nt, Human
ggucucggaucaggcuccc

SEQ ID NO: 3243327 - RNA, 18 nt, Human
ggucucagggugucccag

SEQ ID NO: 3243328 - RNA, 18 nt, Human
ggucucaugcuccuuaau

SEQ ID NO: 3243329 - RNA, 23 nt, Human
ggucucucacagacaggaccccu

SEQ ID NO: 3243330 - RNA, 21 nt, Human
ggucucucacagacaggaccc

SEQ ID NO: 3243331 - RNA, 17 nt, Human
ggucccaccccacacac

SEQ ID NO: 3243332 - RNA, 14 nt, Human
ggucccaccccaca

SEQ ID NO: 3243333 - RNA, 19 nt, Human
ggucagguugacaggaggu

SEQ ID NO: 3243334 - RNA, 23 nt, Human
ggucucacucugucgcccagucu

SEQ ID NO: 3243335 - RNA, 22 nt, Human
ggucucacucugucgcccaguc

SEQ ID NO: 3243336 - RNA, 16 nt, Human
ggucucacucugucgc

SEQ ID NO: 3243337 - RNA, 23 nt, Human
ggugcuacaaaaacacagcaagg

SEQ ID NO: 3243338 - RNA, 21 nt, Human
ggugcuacaaaaacacagcaa

SEQ ID NO: 3243339 - RNA, 16 nt, Human
ggugcuaucuccccca

SEQ ID NO: 3243340 - RNA, 17 nt, Human
ggugcuaucucccccag

SEQ ID NO: 3243341 - RNA, 19 nt, Human
ggugcuaucucccccagcc

SEQ ID NO: 3243342 - RNA, 20 nt, Human
ggugcuaucucccccagccc

SEQ ID NO: 3243343 - RNA, 16 nt, Human
ggugagaggggaacag

SEQ ID NO: 3243344 - RNA, 15 nt, Human
ggugagaagcagagg

SEQ ID NO: 3243345 - RNA, 19 nt, Human
ggugagcauuacaggcaag

SEQ ID NO: 3243346 - RNA, 23 nt, Human
gguggccucccaacucaccccag

SEQ ID NO: 3243347 - RNA, 22 nt, Human
gguggcgcuagaggccauggag

SEQ ID NO: 3243348 - RNA, 20 nt, Human
gguggcgugagccuguaguc

SEQ ID NO: 3243349 - RNA, 22 nt, Human
gguggccucccaacucacccca

SEQ ID NO: 3243350 - RNA, 23 nt, Human
gguggccacuccagaccccuggc

SEQ ID NO: 3243351 - RNA, 22 nt, Human
gguggccacuccagaccccugg

SEQ ID NO: 3243352 - RNA, 21 nt, Human
gguggccacuccagaccccug

SEQ ID NO: 3243353 - RNA, 20 nt, Human
gguggccacuccagaccccu

SEQ ID NO: 3243354 - RNA, 16 nt, Human
gguggcagugggagcu

SEQ ID NO: 3243355 - RNA, 21 nt, Human
gguggcaucauuccaggcccg

SEQ ID NO: 3243356 - RNA, 22 nt, Human
gguggcagugggagcugccugu

SEQ ID NO: 3243357 - RNA, 19 nt, Human
gguggcagugggagcugcc

SEQ ID NO: 3243358 - RNA, 15 nt, Human
ggugcugccauccag

SEQ ID NO: 3243359 - RNA, 18 nt, Human
ggugcugcaguauguugc

SEQ ID NO: 3243360 - RNA, 17 nt, Human
gggguggggaccucagg

SEQ ID NO: 3243361 - RNA, 22 nt, Human
gggguggcccgaaagggucucc

SEQ ID NO: 3243362 - RNA, 18 nt, Human
gggggagcacccugaggg

SEQ ID NO: 3243363 - RNA, 19 nt, Human
gggggagcacccugagggc

SEQ ID NO: 3243364 - RNA, 12 nt, Human
gggguggccucc

SEQ ID NO: 3243365 - RNA, 22 nt, Human
gggggaggugggauccuccagg

SEQ ID NO: 3243366 - RNA, 19 nt, Human
ggggcugaggugggaggau

SEQ ID NO: 3243367 - RNA, 12 nt, Human
ggggcugcaccg

SEQ ID NO: 3243368 - RNA, 21 nt, Human
ggggcugcaccggcuggccug

SEQ ID NO: 3243369 - RNA, 22 nt, Human
ggggcugcaccggcuggccugg

SEQ ID NO: 3243370 - RNA, 11 nt, Human
gggguuuuucu

SEQ ID NO: 3243371 - RNA, 17 nt, Human
ggguaagugagagaggg

SEQ ID NO: 3243372 - RNA, 14 nt, Human
gggucucacucugu

SEQ ID NO: 3243373 - RNA, 12 nt, Human
gggucucacucu

SEQ ID NO: 3243374 - RNA, 22 nt, Human
gggucucagggugucccagacc

SEQ ID NO: 3243375 - RNA, 21 nt, Human
gggucugaggaauccagaccc

SEQ ID NO: 3243376 - RNA, 12 nt, Human
gggucugaggaa

SEQ ID NO: 3243377 - RNA, 24 nt, Human
gggucucucacagacaggaccccu

SEQ ID NO: 3243378 - RNA, 17 nt, Human
gggucuccucaggacca

SEQ ID NO: 3243379 - RNA, 15 nt, Human
gggucucuagugcug

SEQ ID NO: 3243380 - RNA, 20 nt, Human
gggucucuagugcugugaaa

SEQ ID NO: 3243381 - RNA, 22 nt, Human
gggucucucacagacaggaccc

SEQ ID NO: 3243382 - RNA, 18 nt, Human
gggucucucacagacagg

SEQ ID NO: 3243383 - RNA, 15 nt, Human
ggggaaaagagauga

SEQ ID NO: 3243384 - RNA, 21 nt, Human
ggggaaaaucagccugcucca

SEQ ID NO: 3243385 - RNA, 15 nt, Human
ggggaggccaucugg

SEQ ID NO: 3243386 - RNA, 18 nt, Human
ggggaggggcugugggcg

SEQ ID NO: 3243387 - RNA, 11 nt, Human
gggccugggcc

SEQ ID NO: 3243388 - RNA, 15 nt, Human
gggccugggccuggc

SEQ ID NO: 3243389 - RNA, 22 nt, Human
gggcuuggggaccagagcugcc

SEQ ID NO: 3243390 - RNA, 17 nt, Human
gggcuuguaguucuuua

SEQ ID NO: 3243391 - RNA, 17 nt, Human
gggcuugucauagccag

SEQ ID NO: 3243392 - RNA, 13 nt, Human
gggcuuuaaaauu

SEQ ID NO: 3243393 - RNA, 17 nt, Human
ggggaaaaucagccugc

SEQ ID NO: 3243394 - RNA, 19 nt, Human
ggggaaaaucagccugcuc

SEQ ID NO: 3243395 - RNA, 16 nt, Human
ggggaaaaucagccug

SEQ ID NO: 3243396 - RNA, 21 nt, Human
gggcuuuccugugccagguga

SEQ ID NO: 3243397 - RNA, 17 nt, Human
gggcuuuccugugccag

SEQ ID NO: 3243398 - RNA, 16 nt, Human
ggggcaacccugguga

SEQ ID NO: 3243399 - RNA, 13 nt, Human
ggggcacagggag

SEQ ID NO: 3243400 - RNA, 17 nt, Human
ggggcugaggugggagg

SEQ ID NO: 3243401 - RNA, 21 nt, Human
ggggcucagcaaggccaccuc

SEQ ID NO: 3243402 - RNA, 20 nt, Human
ggggcucagcaaggccaccu

SEQ ID NO: 3243403 - RNA, 15 nt, Human
ggggcucagcaaggc

SEQ ID NO: 3243404 - RNA, 20 nt, Human
ggggcucccgccuccaaccc

SEQ ID NO: 3243405 - RNA, 14 nt, Human
ggggcucagcaagg

SEQ ID NO: 3243406 - RNA, 12 nt, Human
ggggcucagcaa

SEQ ID NO: 3243407 - RNA, 20 nt, Human
gggucuugguuccagccugc

SEQ ID NO: 3243408 - RNA, 11 nt, Human
gggucuuccua

SEQ ID NO: 3243409 - RNA, 22 nt, Human
gggucuugcaaaauuccugacg

SEQ ID NO: 3243410 - RNA, 18 nt, Human
gggucuugcaaaauuccu

SEQ ID NO: 3243411 - RNA, 19 nt, Human
gggugacagagcaagugag

SEQ ID NO: 3243412 - RNA, 17 nt, Human
gggugcagcaucuggaa

SEQ ID NO: 3243413 - RNA, 20 nt, Human
gggugcugcuaauucuuugc

SEQ ID NO: 3243414 - RNA, 18 nt, Human
gggugaguccuccagaac

SEQ ID NO: 3243415 - RNA, 15 nt, Human
gggugaccuccggcc

SEQ ID NO: 3243416 - RNA, 22 nt, Human
ggguucaagcgauucuucugcu

SEQ ID NO: 3243417 - RNA, 18 nt, Human
ggguuagacugccagcuc

SEQ ID NO: 3243418 - RNA, 23 nt, Human
ggguucaagcgauucuucugcuu

SEQ ID NO: 3243419 - RNA, 12 nt, Human
ggguucuaccca

SEQ ID NO: 3243420 - RNA, 20 nt, Human
ggguuccuuccucugagccu

SEQ ID NO: 3243421 - RNA, 21 nt, Human
ggguuccuuccucugagccuu

SEQ ID NO: 3243422 - RNA, 19 nt, Human
ggguuccuuccucugagcc

SEQ ID NO: 3243423 - RNA, 16 nt, Human
ggguucuuucuuccuc

SEQ ID NO: 3243424 - RNA, 17 nt, Human
ggguucuuucuuccucu

SEQ ID NO: 3243425 - RNA, 19 nt, Human
ggguucuuucuuccucugc

SEQ ID NO: 3243426 - RNA, 13 nt, Human
ggguuccuucugg

SEQ ID NO: 3243427 - RNA, 19 nt, Human
gguauuuggauaucuguua

SEQ ID NO: 3243428 - RNA, 23 nt, Human
gguagaaauaucugaaaauguau

SEQ ID NO: 3243429 - RNA, 22 nt, Human
gguagaagcccuucuaccuucc

SEQ ID NO: 3243430 - RNA, 18 nt, Human
gguagaaugaccuuguaa

SEQ ID NO: 3243431 - RNA, 23 nt, Human
gguagaacgccagggaccccaga

SEQ ID NO: 3243432 - RNA, 14 nt, Human
gguagaacgccagg

SEQ ID NO: 3243433 - RNA, 20 nt, Human
gguagaggugcaugccuaau

SEQ ID NO: 3243434 - RNA, 13 nt, Human
gguacccacugcu

SEQ ID NO: 3243435 - RNA, 11 nt, Human
gguacccacug

SEQ ID NO: 3243436 - RNA, 22 nt, Human
gguagaaauaucugaaaaugua

SEQ ID NO: 3243437 - RNA, 17 nt, Human
gguacuuguggacacag

SEQ ID NO: 3243438 - RNA, 16 nt, Human
gguacuuguggacaca

SEQ ID NO: 3243439 - RNA, 17 nt, Human
ggucagaagagagggug

SEQ ID NO: 3243440 - RNA, 15 nt, Human
ggucacuucuucugu

SEQ ID NO: 3243441 - RNA, 15 nt, Human
ggucccaccccacac

SEQ ID NO: 3243442 - RNA, 16 nt, Human
ggucccaccccacaca

SEQ ID NO: 3243443 - RNA, 17 nt, Human
ggucaggccgggcagag

SEQ ID NO: 3243444 - RNA, 21 nt, Human
ggucaccucacucagcaccac

SEQ ID NO: 3243445 - RNA, 19 nt, Human
ggucaccucacucagcacc

SEQ ID NO: 3243446 - RNA, 22 nt, Human
ggucaccucacucagcaccacu

SEQ ID NO: 3243447 - RNA, 18 nt, Human
ggucacaggacucugccu

SEQ ID NO: 3243448 - RNA, 16 nt, Human
ggucacaggacucugc

SEQ ID NO: 3243449 - RNA, 16 nt, Human
ggucaaaugcuagaaa

SEQ ID NO: 3243450 - RNA, 14 nt, Human
gggcauccaugggg

SEQ ID NO: 3243451 - RNA, 23 nt, Human
gggcauccauggggucucucaca

SEQ ID NO: 3243452 - RNA, 12 nt, Human
gggcaugacacg

SEQ ID NO: 3243453 - RNA, 18 nt, Human
gggcauucucucuccaag

SEQ ID NO: 3243454 - RNA, 13 nt, Human
gggcauucucucu

SEQ ID NO: 3243455 - RNA, 20 nt, Human
gggcauggccagguggccac

SEQ ID NO: 3243456 - RNA, 17 nt, Human
gggcauggccagguggc

SEQ ID NO: 3243457 - RNA, 15 nt, Human
gggcauggccaggug

SEQ ID NO: 3243458 - RNA, 23 nt, Human
gggccacagagaaaguacuucuc

SEQ ID NO: 3243459 - RNA, 16 nt, Human
gggccacagagaaagu

SEQ ID NO: 3243460 - RNA, 20 nt, Human
gggccaaaagcuucccuccc

SEQ ID NO: 3243461 - RNA, 17 nt, Human
gggcccagagagggugg

SEQ ID NO: 3243462 - RNA, 21 nt, Human
gggcccacccaagcaggaggc

SEQ ID NO: 3243463 - RNA, 13 nt, Human
gggccccugccag

SEQ ID NO: 3243464 - RNA, 23 nt, Human
gggcccccagcgagagucccugc

SEQ ID NO: 3243465 - RNA, 14 nt, Human
gggccccagaggcu

SEQ ID NO: 3243466 - RNA, 12 nt, Human
gggccccaccug

SEQ ID NO: 3243467 - RNA, 22 nt, Human
gggccccaccugcagcucccuc

SEQ ID NO: 3243468 - RNA, 15 nt, Human
gggcccaugggaggg

SEQ ID NO: 3243469 - RNA, 18 nt, Human
gggcccaugggagggagc

SEQ ID NO: 3243470 - RNA, 15 nt, Human
gggccuggcucccuc

SEQ ID NO: 3243471 - RNA, 17 nt, Human
gggccuggcucccucac

SEQ ID NO: 3243472 - RNA, 14 nt, Human
gggccuggccugag

SEQ ID NO: 3243473 - RNA, 18 nt, Human
gggccuggccugagcugg

SEQ ID NO: 3243474 - RNA, 17 nt, Human
gggccuggcucaggugg

SEQ ID NO: 3243475 - RNA, 13 nt, Human
gggccuggcuccc

SEQ ID NO: 3243476 - RNA, 12 nt, Human
gggcccugccca

SEQ ID NO: 3243477 - RNA, 21 nt, Human
gggcccugcagcucucaugcu

SEQ ID NO: 3243478 - RNA, 14 nt, Human
gggcccugcagcuc

SEQ ID NO: 3243479 - RNA, 13 nt, Human
gggcccugccucc

SEQ ID NO: 3243480 - RNA, 13 nt, Human
gggccuggccuga

SEQ ID NO: 3243481 - RNA, 12 nt, Human
gggccuggccug

SEQ ID NO: 3243482 - RNA, 13 nt, Human
gggauagaugugu

SEQ ID NO: 3243483 - RNA, 13 nt, Human
gggauagagagag

SEQ ID NO: 3243484 - RNA, 14 nt, Human
gggauagaugugug

SEQ ID NO: 3243485 - RNA, 15 nt, Human
gggauaggggcagag

SEQ ID NO: 3243486 - RNA, 21 nt, Human
gggauaugauuuaaaucagcc

SEQ ID NO: 3243487 - RNA, 15 nt, Human
gggauccuccaggug

SEQ ID NO: 3243488 - RNA, 16 nt, Human
gggauccuccaggugc

SEQ ID NO: 3243489 - RNA, 23 nt, Human
gggauccuggaguucugguuccu

SEQ ID NO: 3243490 - RNA, 18 nt, Human
gggcaacccuggugacca

SEQ ID NO: 3243491 - RNA, 20 nt, Human
gggcaacccccagccugcua

SEQ ID NO: 3243492 - RNA, 13 nt, Human
gggcaauggaaau

SEQ ID NO: 3243493 - RNA, 19 nt, Human
gggcaauauucucuguaca

SEQ ID NO: 3243494 - RNA, 16 nt, Human
gggcaauauucucugu

SEQ ID NO: 3243495 - RNA, 23 nt, Human
gggcaauauucucuguacauauu

SEQ ID NO: 3243496 - RNA, 20 nt, Human
gggcaauauucucuguacau

SEQ ID NO: 3243497 - RNA, 11 nt, Human
gggagugugua

SEQ ID NO: 3243498 - RNA, 21 nt, Human
gggagugugguuucuuuuuga

SEQ ID NO: 3243499 - RNA, 14 nt, Human
gggagugagcuggu

SEQ ID NO: 3243500 - RNA, 11 nt, Human
gggagugagcu

SEQ ID NO: 3243501 - RNA, 18 nt, Human
gggagugacagaggcagc

SEQ ID NO: 3243502 - RNA, 17 nt, Human
gggagugacagaggcag

SEQ ID NO: 3243503 - RNA, 10 nt, Human
gggacucugc

SEQ ID NO: 3243504 - RNA, 17 nt, Human
gggaggugggauccucc

SEQ ID NO: 3243505 - RNA, 16 nt, Human
gggaggugaccccagg

SEQ ID NO: 3243506 - RNA, 17 nt, Human
gggcagguugguggggg

SEQ ID NO: 3243507 - RNA, 11 nt, Human
gggcagagcag

SEQ ID NO: 3243508 - RNA, 11 nt, Human
gggcagagagg

SEQ ID NO: 3243509 - RNA, 20 nt, Human
gggcaggggaggccaucugg

SEQ ID NO: 3243510 - RNA, 19 nt, Human
gggcaggggaggccaucug

SEQ ID NO: 3243511 - RNA, 18 nt, Human
gggcagagaggcuguggu

SEQ ID NO: 3243512 - RNA, 14 nt, Human
gggcagagaggcug

SEQ ID NO: 3243513 - RNA, 14 nt, Human
gggcagagcacagc

SEQ ID NO: 3243514 - RNA, 18 nt, Human
gggcagaaggaagacuuc

SEQ ID NO: 3243515 - RNA, 14 nt, Human
gggcagaaggaaga

SEQ ID NO: 3243516 - RNA, 20 nt, Human
gggcacucagaagacacuga

SEQ ID NO: 3243517 - RNA, 19 nt, Human
gggcacgugguugaguggg

SEQ ID NO: 3243518 - RNA, 17 nt, Human
gggcacugcucucaccu

SEQ ID NO: 3243519 - RNA, 16 nt, Human
gggcacugcucucacc

SEQ ID NO: 3243520 - RNA, 16 nt, Human
gggcacugguggcccg

SEQ ID NO: 3243521 - RNA, 13 nt, Human
gggcacugguggc

SEQ ID NO: 3243522 - RNA, 23 nt, Human
gggcacaccgggcacucagaaga

SEQ ID NO: 3243523 - RNA, 17 nt, Human
gggcacaccuccuccca

SEQ ID NO: 3243524 - RNA, 15 nt, Human
gggcacaccuccucc

SEQ ID NO: 3243525 - RNA, 18 nt, Human
gggcacagaaaauggaag

SEQ ID NO: 3243526 - RNA, 16 nt, Human
gggcacacgcugcucu

SEQ ID NO: 3243527 - RNA, 13 nt, Human
gggcacacgcugc

SEQ ID NO: 3243528 - RNA, 22 nt, Human
gggcacacgcugcucugcccca

SEQ ID NO: 3243529 - RNA, 20 nt, Human
gggcacacgcugcucugccc

SEQ ID NO: 3243530 - RNA, 19 nt, Human
gggcacacgcugcucugcc

SEQ ID NO: 3243531 - RNA, 18 nt, Human
gggcacacgcugcucugc

SEQ ID NO: 3243532 - RNA, 20 nt, Human
gggcacagaaaauggaagac

SEQ ID NO: 3243533 - RNA, 21 nt, Human
gggcacagaaaauggaagaca

SEQ ID NO: 3243534 - RNA, 23 nt, Human
gggcacacgcugcucugccccag

SEQ ID NO: 3243535 - RNA, 13 nt, Human
gggcacagggccu

SEQ ID NO: 3243536 - RNA, 16 nt, Human
gggcacagggccuggc

SEQ ID NO: 3243537 - RNA, 14 nt, Human
gggcacagggccug

SEQ ID NO: 3243538 - RNA, 19 nt, Human
gggcacucagaagacacug

SEQ ID NO: 3243539 - RNA, 16 nt, Human
gggcacucagaagaca

SEQ ID NO: 3243540 - RNA, 14 nt, Human
gggcaccggggccu

SEQ ID NO: 3243541 - RNA, 13 nt, Human
gggcacagggucu

SEQ ID NO: 3243542 - RNA, 16 nt, Human
gggcacagggucucua

SEQ ID NO: 3243543 - RNA, 15 nt, Human
gggcacaggucaggc

SEQ ID NO: 3243544 - RNA, 13 nt, Human
gggcacaggucag

SEQ ID NO: 3243545 - RNA, 20 nt, Human
gggcacagggccuggcccau

SEQ ID NO: 3243546 - RNA, 18 nt, Human
gggcacagggccuggccc

SEQ ID NO: 3243547 - RNA, 17 nt, Human
gggcaccacaaaauaua

SEQ ID NO: 3243548 - RNA, 22 nt, Human
gggcaccacaaaauauacaaaa

SEQ ID NO: 3243549 - RNA, 15 nt, Human
ggcugcuuuccaaag

SEQ ID NO: 3243550 - RNA, 23 nt, Human
ggcugcuucaaggauccugagcc

SEQ ID NO: 3243551 - RNA, 21 nt, Human
ggcugcuucaaggauccugag

SEQ ID NO: 3243552 - RNA, 19 nt, Human
ggcugggagagccuuccag

SEQ ID NO: 3243553 - RNA, 14 nt, Human
ggcuggaaggagga

SEQ ID NO: 3243554 - RNA, 15 nt, Human
ggcuggaaggaggaa

SEQ ID NO: 3243555 - RNA, 16 nt, Human
ggcuggaaggaggaag

SEQ ID NO: 3243556 - RNA, 17 nt, Human
ggcuggaaggaggaaga

SEQ ID NO: 3243557 - RNA, 18 nt, Human
ggcugggagagccuucca

SEQ ID NO: 3243558 - RNA, 15 nt, Human
ggcugggcagaggaa

SEQ ID NO: 3243559 - RNA, 19 nt, Human
ggcugggcagaggaaagca

SEQ ID NO: 3243560 - RNA, 13 nt, Human
ggcugggcagagg

SEQ ID NO: 3243561 - RNA, 14 nt, Human
ggcugggcagagga

SEQ ID NO: 3243562 - RNA, 20 nt, Human
ggcugggagagccuuccagg

SEQ ID NO: 3243563 - RNA, 23 nt, Human
ggcugggagagccuuccaggggu

SEQ ID NO: 3243564 - RNA, 13 nt, Human
ggcugcugaaggc

SEQ ID NO: 3243565 - RNA, 18 nt, Human
ggcugcugaaggcucgag

SEQ ID NO: 3243566 - RNA, 15 nt, Human
ggcugcugaaggcuc

SEQ ID NO: 3243567 - RNA, 17 nt, Human
ggcugcugaaggcucga

SEQ ID NO: 3243568 - RNA, 14 nt, Human
ggcugcugaaggcu

SEQ ID NO: 3243569 - RNA, 13 nt, Human
ggcugcagggagu

SEQ ID NO: 3243570 - RNA, 12 nt, Human
ggcugcagggag

SEQ ID NO: 3243571 - RNA, 11 nt, Human
ggcugcuucaa

SEQ ID NO: 3243572 - RNA, 12 nt, Human
ggcugcuucaag

SEQ ID NO: 3243573 - RNA, 14 nt, Human
ggcugcuucaagga

SEQ ID NO: 3243574 - RNA, 22 nt, Human
ggcugcuucaaggauccugagc

SEQ ID NO: 3243575 - RNA, 14 nt, Human
ggcugcugugaagc

SEQ ID NO: 3243576 - RNA, 16 nt, Human
ggcugcagccaggcca

SEQ ID NO: 3243577 - RNA, 22 nt, Human
ggcugcagccaggccacuggcc

SEQ ID NO: 3243578 - RNA, 18 nt, Human
ggcugcaccggcuggccu

SEQ ID NO: 3243579 - RNA, 19 nt, Human
ggcugcaccggcuggccug

SEQ ID NO: 3243580 - RNA, 17 nt, Human
ggcugcaccggcuggcc

SEQ ID NO: 3243581 - RNA, 24 nt, Human
ggcugcaaaggguaucaggugcug

SEQ ID NO: 3243582 - RNA, 23 nt, Human
ggcugcaaaggguaucaggugcu

SEQ ID NO: 3243583 - RNA, 22 nt, Human
ggcugcaaaggguaucaggugc

SEQ ID NO: 3243584 - RNA, 18 nt, Human
ggcugcaaaggguaucag

SEQ ID NO: 3243585 - RNA, 22 nt, Human
ggcugagugcaggcccacccug

SEQ ID NO: 3243586 - RNA, 21 nt, Human
ggcugagugcaggcccacccu

SEQ ID NO: 3243587 - RNA, 20 nt, Human
ggcugagugcaggcccaccc

SEQ ID NO: 3243588 - RNA, 19 nt, Human
ggcugagugcaggcccacc

SEQ ID NO: 3243589 - RNA, 18 nt, Human
ggcugagugcaggcccac

SEQ ID NO: 3243590 - RNA, 17 nt, Human
ggcugaguagcucugcc

SEQ ID NO: 3243591 - RNA, 17 nt, Human
ggcugagugcaggccca

SEQ ID NO: 3243592 - RNA, 16 nt, Human
ggcugagugcaggccc

SEQ ID NO: 3243593 - RNA, 15 nt, Human
ggcugagugcaggcc

SEQ ID NO: 3243594 - RNA, 13 nt, Human
ggcugagugcagg

SEQ ID NO: 3243595 - RNA, 20 nt, Human
ggccccugccagacccccug

SEQ ID NO: 3243596 - RNA, 17 nt, Human
ggccccugcccggcugc

SEQ ID NO: 3243597 - RNA, 16 nt, Human
ggccccugcccggcug

SEQ ID NO: 3243598 - RNA, 17 nt, Human
ggcucugccucccauca

SEQ ID NO: 3243599 - RNA, 20 nt, Human
ggccccugcccggcugcgga

SEQ ID NO: 3243600 - RNA, 13 nt, Human
ggcugagguggga

SEQ ID NO: 3243601 - RNA, 15 nt, Human
ggcugaggugggagg

SEQ ID NO: 3243602 - RNA, 22 nt, Human
gggaaggcagggagggccuggg

SEQ ID NO: 3243603 - RNA, 14 nt, Human
gggaagggggcugg

SEQ ID NO: 3243604 - RNA, 16 nt, Human
gggaagggggcuggga

SEQ ID NO: 3243605 - RNA, 17 nt, Human
gggaagggggcugggac

SEQ ID NO: 3243606 - RNA, 18 nt, Human
gggaaggggggucagaag

SEQ ID NO: 3243607 - RNA, 11 nt, Human
gggaaugaggg

SEQ ID NO: 3243608 - RNA, 12 nt, Human
gggaaugagggg

SEQ ID NO: 3243609 - RNA, 13 nt, Human
gggaaugaggggg

SEQ ID NO: 3243610 - RNA, 20 nt, Human
gggaccccuggugguucacu

SEQ ID NO: 3243611 - RNA, 14 nt, Human
gggaccccugagcu

SEQ ID NO: 3243612 - RNA, 24 nt, Human
gggacccuccaaggccaggccuug

SEQ ID NO: 3243613 - RNA, 20 nt, Human
gggacccuccaaggccaggc

SEQ ID NO: 3243614 - RNA, 20 nt, Human
gggacaaguagccaccugag

SEQ ID NO: 3243615 - RNA, 20 nt, Human
gggacaaccuuggcuuggcc

SEQ ID NO: 3243616 - RNA, 15 nt, Human
gggacaaccuuggcu

SEQ ID NO: 3243617 - RNA, 17 nt, Human
gggaauuucuucaacuc

SEQ ID NO: 3243618 - RNA, 23 nt, Human
gggacaaggacuaggguccuggg

SEQ ID NO: 3243619 - RNA, 12 nt, Human
gggaccucaggc

SEQ ID NO: 3243620 - RNA, 13 nt, Human
gggaccucaggcc

SEQ ID NO: 3243621 - RNA, 15 nt, Human
gggaccucaggccug

SEQ ID NO: 3243622 - RNA, 17 nt, Human
gggacuacaggcaccca

SEQ ID NO: 3243623 - RNA, 19 nt, Human
ggcuuggggaccagagcug

SEQ ID NO: 3243624 - RNA, 21 nt, Human
ggcuuggggaccagagcugcc

SEQ ID NO: 3243625 - RNA, 13 nt, Human
ggcuuguaguucu

SEQ ID NO: 3243626 - RNA, 16 nt, Human
ggcuugucauagccag

SEQ ID NO: 3243627 - RNA, 16 nt, Human
ggcuuguaguucuuua

SEQ ID NO: 3243628 - RNA, 12 nt, Human
ggcuuuaaaauu

SEQ ID NO: 3243629 - RNA, 14 nt, Human
ggcuuuaaaauucu

SEQ ID NO: 3243630 - RNA, 20 nt, Human
ggcuuuacauacuuuaucaa

SEQ ID NO: 3243631 - RNA, 22 nt, Human
ggcuuuucacugcuggcugccu

SEQ ID NO: 3243632 - RNA, 19 nt, Human
ggcuuuucacugcuggcug

SEQ ID NO: 3243633 - RNA, 17 nt, Human
ggcuuuucacugcuggc

SEQ ID NO: 3243634 - RNA, 15 nt, Human
ggcuuuucacugcug

SEQ ID NO: 3243635 - RNA, 13 nt, Human
ggcuuuucacugc

SEQ ID NO: 3243636 - RNA, 19 nt, Human
ggcuuuccugugccaggug

SEQ ID NO: 3243637 - RNA, 14 nt, Human
ggcuuuucacugcu

SEQ ID NO: 3243638 - RNA, 23 nt, Human
ggcuuucaggagcuccauacaca

SEQ ID NO: 3243639 - RNA, 17 nt, Human
ggcuuuauuuuuuugaa

SEQ ID NO: 3243640 - RNA, 22 nt, Human
ggcuuuauuuuuuugaacucuu

SEQ ID NO: 3243641 - RNA, 15 nt, Human
ggcuuagucacugag

SEQ ID NO: 3243642 - RNA, 21 nt, Human
ggcuuagucacugagacagcc

SEQ ID NO: 3243643 - RNA, 14 nt, Human
ggcuuauaaaacag

SEQ ID NO: 3243644 - RNA, 16 nt, Human
ggcuuauauuugugua

SEQ ID NO: 3243645 - RNA, 17 nt, Human
ggcugggcuucaguggc

SEQ ID NO: 3243646 - RNA, 13 nt, Human
ggcugggcuucag

SEQ ID NO: 3243647 - RNA, 15 nt, Human
ggcuuaaaacaacac

SEQ ID NO: 3243648 - RNA, 12 nt, Human
ggcugggcuuca

SEQ ID NO: 3243649 - RNA, 17 nt, Human
ggcugggcucccuuccc

SEQ ID NO: 3243650 - RNA, 17 nt, Human
cccagugagcauccacg

SEQ ID NO: 3243651 - RNA, 21 nt, Human
gcugucuuuucuuugccaucu

SEQ ID NO: 3243652 - RNA, 17 nt, Human
ggagaaucacaggcugg

SEQ ID NO: 3243653 - RNA, 23 nt, Human
ggaugucauguccuccaggcugg

SEQ ID NO: 3243654 - RNA, 19 nt, Human
ggggcaggggaggccaucu

SEQ ID NO: 3243655 - RNA, 15 nt, Human
acauaccuggcccug

SEQ ID NO: 3243656 - RNA, 19 nt, Human
acagcaagucacuggccag

SEQ ID NO: 3243657 - RNA, 12 nt, Human
aggcccagcuga

SEQ ID NO: 3243658 - RNA, 18 nt, Human
agcucuucuccaggcugu

SEQ ID NO: 3243659 - RNA, 16 nt, Human
gauugcaacaggcugg

SEQ ID NO: 3243660 - RNA, 14 nt, Human
ggcaaacuggccgc

SEQ ID NO: 3243661 - RNA, 21 nt, Human
ggggccccgucucaggucuga

SEQ ID NO: 3243662 - RNA, 20 nt, Human
gccugugccuuuugccaucc

SEQ ID NO: 3243663 - RNA, 18 nt, Human
ggaggucugccaggcugu

SEQ ID NO: 3243664 - RNA, 14 nt, Human
guagcacaggcuga

SEQ ID NO: 3243665 - RNA, 15 nt, Human
guaggccucagguga

SEQ ID NO: 3243666 - RNA, 20 nt, Human
guagugccgcucuuggggac

SEQ ID NO: 3243667 - RNA, 17 nt, Human
ggguuagacugccagcu

SEQ ID NO: 3243668 - RNA, 16 nt, Human
gucacuaccuggcugc

SEQ ID NO: 3243669 - RNA, 14 nt, Human
gucgcccaggcugg

SEQ ID NO: 3243670 - RNA, 14 nt, Human
ggggacugccaccu

SEQ ID NO: 3243671 - RNA, 14 nt, Human
guugcccaggcugg

SEQ ID NO: 3243672 - RNA, 14 nt, Human
guuggccaggcugg

SEQ ID NO: 3243673 - RNA, 17 nt, Human
cguacucuuuggggcag

SEQ ID NO: 3243674 - RNA, 18 nt, Human
cgugaggcccguggggcc

SEQ ID NO: 3243675 - RNA, 15 nt, Human
gagaccccaggcugu

SEQ ID NO: 3243676 - RNA, 16 nt, Human
gaggagcccugccucu

SEQ ID NO: 3243677 - RNA, 12 nt, Human
gccccaggcugc

SEQ ID NO: 3243678 - RNA, 17 nt, Human
cuugguuccuggggcau

SEQ ID NO: 3243679 - RNA, 17 nt, Human
cucggaucaggcuccca

SEQ ID NO: 3243680 - RNA, 19 nt, Human
gcaggagucccugccauca

SEQ ID NO: 3243681 - RNA, 14 nt, Human
guuggccaggcugc

SEQ ID NO: 3243682 - RNA, 13 nt, Human
augcgcaggcugg

SEQ ID NO: 3243683 - RNA, 14 nt, Human
cuaggccuggggac

SEQ ID NO: 3243684 - RNA, 18 nt, Human
cuggucuuugagcuccca

SEQ ID NO: 3243685 - RNA, 13 nt, Human
cugggcugggcac

SEQ ID NO: 3243686 - RNA, 12 nt, Human
caggcuggggcc

SEQ ID NO: 3243687 - RNA, 19 nt, Human
cagagcucccucugcccca

SEQ ID NO: 3243688 - RNA, 16 nt, Human
cagcacguguggccug

SEQ ID NO: 3243689 - RNA, 21 nt, Human
ccagcaauacagugcucgcca

SEQ ID NO: 3243690 - RNA, 19 nt, Human
caggagaugcugugccccu

SEQ ID NO: 3243691 - RNA, 16 nt, Human
caugggucagugccca

SEQ ID NO: 3243692 - RNA, 17 nt, Human
cacgcugcucugcccca

SEQ ID NO: 3243693 - RNA, 22 nt, Human
aggcucccuccccauggggcag

SEQ ID NO: 3243694 - RNA, 19 nt, Rubella virus
gacuccggagggccccgcc

SEQ ID NO: 3243695 - RNA, 18 nt, Rubella virus
ccgcgccugucgccgccg

SEQ ID NO: 3243696 - RNA, 16 nt, Rubella virus
cgacccccugcugcgc

SEQ ID NO: 3243697 - RNA, 15 nt, Rubella virus
gugggggcucugccc

SEQ ID NO: 3243698 - RNA, 17 nt, Rubella virus
cggccccgauugggccu

SEQ ID NO: 3243699 - RNA, 14 nt, Rubella virus
gcugcgcacugccc

SEQ ID NO: 3243700 - RNA, 19 nt, Rubella virus
ggcacccaccgaggccugc

SEQ ID NO: 3243701 - RNA, 12 nt, Rubella virus
cgccugcgccac

SEQ ID NO: 3243702 - RNA, 14 nt, Rubella virus
cgccggcccccugc

SEQ ID NO: 3243703 - RNA, 18 nt, Rubella virus
gcuuucaccuaccucugc

SEQ ID NO: 3243704 - RNA, 15 nt, Rubella virus
caccgccgcccuccu

SEQ ID NO: 3243705 - RNA, 18 nt, Rubella virus
cgccauuugcgcccuccc

SEQ ID NO: 3243706 - RNA, 15 nt, Rubella virus
gagugggcugcugcc

SEQ ID NO: 3243707 - RNA, 15 nt, Rubella virus
agcgacgugcugccc

SEQ ID NO: 3243708 - RNA, 23 nt, Rubella virus
ccuggguacccgcagccccuugc

SEQ ID NO: 3243709 - RNA, 21 nt, Rubella virus
accgggcgugggggcucugcc

SEQ ID NO: 3243710 - RNA, 14 nt, Rubella virus
caccaaccugggca

SEQ ID NO: 3243711 - RNA, 22 nt, Rubella virus
cuccacgaccgccgccaccccc

SEQ ID NO: 3243712 - RNA, 16 nt, Rubella virus
gccgccacccccgcca

SEQ ID NO: 3243713 - RNA, 15 nt, Rubella virus
ccugcugcgcacugc

SEQ ID NO: 3243714 - RNA, 15 nt, Rubella virus
ucaaugacagcugcg

SEQ ID NO: 3243715 - RNA, 21 nt, Rubella virus
gaccugggcggagugggcugc

SEQ ID NO: 3243716 - RNA, 21 nt, Rubella virus
gcugcccauugguggcagcuc

SEQ ID NO: 3243717 - RNA, 15 nt, Rubella virus
augcgguggggccuu

SEQ ID NO: 3243718 - RNA, 22 nt, Rubella virus
gcagccguggcgcguggccugc

SEQ ID NO: 3243719 - RNA, 20 nt, Rubella virus
caacccuugcgggcccgagc

SEQ ID NO: 3243720 - RNA, 22 nt, Rubella virus
acacagcgacgcggccugcugg

SEQ ID NO: 3243721 - RNA, 21 nt, Rubella virus
gcccgcucacgucguccgcgc

SEQ ID NO: 3243722 - RNA, 23 nt, Rubella virus
ccacgcccacaccaccagcgacc

SEQ ID NO: 3243723 - RNA, 17 nt, Rubella virus
cgcccauccaggcgccc

SEQ ID NO: 3243724 - RNA, 21 nt, Rubella virus
cacucgcuggcuuacucgcuu

SEQ ID NO: 3243725 - RNA, 14 nt, Rubella virus
gacaccgaggcacc

SEQ ID NO: 3243726 - RNA, 14 nt, Rubella virus
ggcucuugcucgcc

SEQ ID NO: 3243727 - RNA, 12 nt, Rubella virus
gagcuggggcca

SEQ ID NO: 3243728 - RNA, 13 nt, Rubella virus
cgccgccgcggcg

SEQ ID NO: 3243729 - RNA, 18 nt, Rubella virus
cccgugcgccucgcuggc

SEQ ID NO: 3243730 - RNA, 14 nt, Rubella virus
cgacgcggccugcu

SEQ ID NO: 3243731 - RNA, 19 nt, Rubella virus
cgccgggcuccagccccgc

SEQ ID NO: 3243732 - RNA, 13 nt, Rubella virus
ccugucgccgccg

SEQ ID NO: 3243733 - RNA, 23 nt, Rubella virus
cgcagggacugguccagggcccc

SEQ ID NO: 3243734 - RNA, 20 nt, Rubella virus
ggguacaacccccccgccua

SEQ ID NO: 3243735 - RNA, 14 nt, Rubella virus
ccgaccgccgcccg

SEQ ID NO: 3243736 - RNA, 15 nt, Rubella virus
guggaaggccuugcc

SEQ ID NO: 3243737 - RNA, 17 nt, Rubella virus
cugccguuccucgggca

SEQ ID NO: 3243738 - RNA, 17 nt, Rubella virus
ggcauccaccgggcccc

SEQ ID NO: 3243739 - RNA, 21 nt, Rubella virus
ugcauuucaccaaccugggca

SEQ ID NO: 3243740 - RNA, 22 nt, Rubella virus
gacacagcgacgcggccugcug

SEQ ID NO: 3243741 - RNA, 16 nt, Rubella virus
cguccuuaccgcccgc

SEQ ID NO: 3243742 - RNA, 18 nt, Rubella virus
ucgccgccgcggcgccgc

SEQ ID NO: 3243743 - RNA, 14 nt, Rubella virus
ccggcgugguguau

SEQ ID NO: 3243744 - RNA, 15 nt, Rubella virus
gcggcuucuugucug

SEQ ID NO: 3243745 - RNA, 20 nt, Rubella virus
acacagcgacgcggccugcu

SEQ ID NO: 3243746 - RNA, 18 nt, Rubella virus
ccgggcgugggggcucug

SEQ ID NO: 3243747 - RNA, 18 nt, Rubella virus
gcugccguuccucgggca

SEQ ID NO: 3243748 - RNA, 17 nt, Rubella virus
gcgaaacccgcacuagg

SEQ ID NO: 3243749 - RNA, 20 nt, Rubella virus
cacggccccgauugggccuc

SEQ ID NO: 3243750 - RNA, 24 nt, Rubella virus
gucgccguuggcaccgcgcgcgcc

SEQ ID NO: 3243751 - RNA, 14 nt, Rubella virus
cagugcgguacccc

SEQ ID NO: 3243752 - RNA, 20 nt, Rubella virus
accucgaggccacuggagcc

SEQ ID NO: 3243753 - RNA, 19 nt, Rubella virus
ugacuccggagggccccgc

SEQ ID NO: 3243754 - RNA, 12 nt, Rubella virus
agaccugggcgg

SEQ ID NO: 3243755 - RNA, 22 nt, Rubella virus
ccgcccuaccaagucagcugcg

SEQ ID NO: 3243756 - RNA, 15 nt, Rubella virus
gaaacgccagcgacg

SEQ ID NO: 3243757 - RNA, 20 nt, Rubella virus
accaccagcgaccccuggca

SEQ ID NO: 3243758 - RNA, 19 nt, Rubella virus
gccagugcgcggccucgac

SEQ ID NO: 3243759 - RNA, 23 nt, Rubella virus
ggcggcugcuuugccccauggga

SEQ ID NO: 3243760 - RNA, 14 nt, Rubella virus
acacgccgcacgga

SEQ ID NO: 3243761 - RNA, 21 nt, Rubella virus
gcgcauccgcuucggugcccc

SEQ ID NO: 3243762 - RNA, 20 nt, Rubella virus
cggccaucauggcggcaccu

SEQ ID NO: 3243763 - RNA, 22 nt, Rubella virus
gacccgcucggcgcgccauccu

SEQ ID NO: 3243764 - RNA, 21 nt, Rubella virus
ucccagacuccggccccgaag

SEQ ID NO: 3243765 - RNA, 21 nt, Rubella virus
uacgcugccgcagccccccug

SEQ ID NO: 3243766 - RNA, 19 nt, Rubella virus
ccugauauuuauggugugc

SEQ ID NO: 3243767 - RNA, 15 nt, Rubella virus
cgccgccgcccucac

SEQ ID NO: 3243768 - RNA, 15 nt, Rubella virus
gacgacccccugcug

SEQ ID NO: 3243769 - RNA, 18 nt, Rubella virus
ugcaccggggugcgccac

SEQ ID NO: 3243770 - RNA, 16 nt, Rubella virus
acagagaccaggaccg

SEQ ID NO: 3243771 - RNA, 18 nt, Rubella virus
acuccacauacgcgcugg

SEQ ID NO: 3243772 - RNA, 15 nt, Rubella virus
cagcauuacggccac

SEQ ID NO: 3243773 - RNA, 16 nt, Rubella virus
accuccuacgcugccg

SEQ ID NO: 3243774 - RNA, 20 nt, Rubella virus
gcgcccccggcugcgccugg

SEQ ID NO: 3243775 - RNA, 21 nt, Rubella virus
ggcaccagggcacucaugucu

SEQ ID NO: 3243776 - RNA, 15 nt, Rubella virus
ucaccgccgcccucc

SEQ ID NO: 3243777 - RNA, 19 nt, Rubella virus
acgccucucaccaccgcgg

SEQ ID NO: 3243778 - RNA, 13 nt, Rubella virus
cuggcggcagcua

SEQ ID NO: 3243779 - RNA, 14 nt, Rubella virus
gcaccuguccccgu

SEQ ID NO: 3243780 - RNA, 17 nt, Rubella virus
gccccccaggccuuccu

SEQ ID NO: 3243781 - RNA, 15 nt, Rubella virus
gagggcuugggggcc

SEQ ID NO: 3243782 - RNA, 17 nt, Rubella virus
gccucgcuagugggccc

SEQ ID NO: 3243783 - RNA, 22 nt, Rubella virus
cgccuacccgguuuggcugcgc

SEQ ID NO: 3243784 - RNA, 19 nt, Rubella virus
caccgaggcacccaccgag

SEQ ID NO: 3243785 - RNA, 20 nt, Rubella virus
gccuuccccccugggaacug

SEQ ID NO: 3243786 - RNA, 19 nt, Rubella virus
cggccccgauugggccucc

SEQ ID NO: 3243787 - RNA, 23 nt, Rubella virus
gccugcgugaccucguggcuuug

SEQ ID NO: 3243788 - RNA, 14 nt, Rubella virus
gcgcacgggcagca

SEQ ID NO: 3243789 - RNA, 13 nt, Rubella virus
accaucagcugcc

SEQ ID NO: 3243790 - RNA, 17 nt, Rubella virus
cauccaggcgcccgcug

SEQ ID NO: 3243791 - RNA, 20 nt, Rubella virus
ugcuggucccguggguccug

SEQ ID NO: 3243792 - RNA, 18 nt, Rubella virus
caccgcgcgcgccgggcu

SEQ ID NO: 3243793 - RNA, 20 nt, Rubella virus
caggccuuccuugccgggcu

SEQ ID NO: 3243794 - RNA, 13 nt, Rubella virus
accgacugcugcg

SEQ ID NO: 3243795 - RNA, 12 nt, Rubella virus
ggagugggcugc

SEQ ID NO: 3243796 - RNA, 15 nt, Rubella virus
cugggugcgggccga

SEQ ID NO: 3243797 - RNA, 16 nt, Rubella virus
cggcugcgccuggucg

SEQ ID NO: 3243798 - RNA, 22 nt, Rubella virus
gccucuuacuucaacccuggcg

SEQ ID NO: 3243799 - RNA, 14 nt, Rubella virus
acccuugcgggccc

SEQ ID NO: 3243800 - RNA, 12 nt, Rubella virus
cgccccccccgg

SEQ ID NO: 3243801 - RNA, 17 nt, Rubella virus
cuggaccguacggccau

SEQ ID NO: 3243802 - RNA, 15 nt, Rubella virus
agugggcugcugccc

SEQ ID NO: 3243803 - RNA, 14 nt, Rubella virus
cgucaccgccgccc

SEQ ID NO: 3243804 - RNA, 17 nt, Rubella virus
cggagugggcugcugcc

SEQ ID NO: 3243805 - RNA, 20 nt, Rubella virus
aguacccgccuacccgguuu

SEQ ID NO: 3243806 - RNA, 22 nt, Rubella virus
ccgcagccccccugugcgcacg

SEQ ID NO: 3243807 - RNA, 12 nt, Rubella virus
ccuggcggcagc

SEQ ID NO: 3243808 - RNA, 22 nt, Rubella virus
gcgcauugagacccgcucggcg

SEQ ID NO: 3243809 - RNA, 13 nt, Rubella virus
acccccgcgcugg

SEQ ID NO: 3243810 - RNA, 17 nt, Rubella virus
cgcuagugggcccccgc

SEQ ID NO: 3243811 - RNA, 18 nt, Rubella virus
cucguggcuuuggagcga

SEQ ID NO: 3243812 - RNA, 13 nt, Rubella virus
cgccauccuuggc

SEQ ID NO: 3243813 - RNA, 18 nt, Rubella virus
cugccguuccucgggcac

SEQ ID NO: 3243814 - RNA, 22 nt, Rubella virus
uauggcacacacaccacugcug

SEQ ID NO: 3243815 - RNA, 14 nt, Rubella virus
uauggcggcaccuc

SEQ ID NO: 3243816 - RNA, 18 nt, Rubella virus
cuaccaagucagcugcgg

SEQ ID NO: 3243817 - RNA, 15 nt, Rubella virus
gcuccaaggcggcug

SEQ ID NO: 3243818 - RNA, 18 nt, Rubella virus
cuccacgacccugacacc

SEQ ID NO: 3243819 - RNA, 19 nt, Rubella virus
cugcaccggggugcgccac

SEQ ID NO: 3243820 - RNA, 11 nt, Rubella virus
cugccacgccg

SEQ ID NO: 3243821 - RNA, 21 nt, Rubella virus
ccuccccgguuugccaacgcc

SEQ ID NO: 3243822 - RNA, 17 nt, Rubella virus
gccgcgccugucgccgc

SEQ ID NO: 3243823 - RNA, 17 nt, Rubella virus
gacgaggacggccgcug

SEQ ID NO: 3243824 - RNA, 16 nt, Rubella virus
caccuucugggcuguc

SEQ ID NO: 3243825 - RNA, 14 nt, Rubella virus
gcaccagggcacuc

SEQ ID NO: 3243826 - RNA, 19 nt, Rubella virus
aggcacccaccgaggccug

SEQ ID NO: 3243827 - RNA, 21 nt, Rubella virus
ggagcccgaauugccacggcc

SEQ ID NO: 3243828 - RNA, 14 nt, Rubella virus
uggcgaggaccucg

SEQ ID NO: 3243829 - RNA, 23 nt, Rubella virus
gcaaaccgggcgugggggcucug

SEQ ID NO: 3243830 - RNA, 17 nt, Rubella virus
cccucccacucgcuggc

SEQ ID NO: 3243831 - RNA, 19 nt, Rubella virus
cucgaggccacuggagccu

SEQ ID NO: 3243832 - RNA, 19 nt, Rubella virus
cccucuggcucgccacagc

SEQ ID NO: 3243833 - RNA, 15 nt, Rubella virus
ggcgugggggcucug

SEQ ID NO: 3243834 - RNA, 13 nt, Rubella virus
cggggccguggcc

SEQ ID NO: 3243835 - RNA, 16 nt, Rubella virus
cacuagauccccgcac

SEQ ID NO: 3243836 - RNA, 15 nt, Rubella virus
ggccacuggagccug

SEQ ID NO: 3243837 - RNA, 19 nt, Rubella virus
uccagggccccgccccccc

SEQ ID NO: 3243838 - RNA, 18 nt, Rubella virus
cuggcaccgacugcugcg

SEQ ID NO: 3243839 - RNA, 20 nt, Rubella virus
gccucuuacuucaacccugg

SEQ ID NO: 3243840 - RNA, 22 nt, Rubella virus
ggccagcgcagggacuggucca

SEQ ID NO: 3243841 - RNA, 22 nt, Rubella virus
cgacccccugcugcgcacugcc

SEQ ID NO: 3243842 - RNA, 14 nt, Rubella virus
ugcgccucgcuggc

SEQ ID NO: 3243843 - RNA, 20 nt, Rubella virus
cugccgcagccccccugugc

SEQ ID NO: 3243844 - RNA, 13 nt, Rubella virus
auggugugccgcc

SEQ ID NO: 3243845 - RNA, 19 nt, Rubella virus
gcgcguacaaucaaccugc

SEQ ID NO: 3243846 - RNA, 16 nt, Rubella virus
gcgccugcgccacggc

SEQ ID NO: 3243847 - RNA, 19 nt, Rubella virus
cagcgaccccuggcaucca

SEQ ID NO: 3243848 - RNA, 10 nt, Rubella virus
aucagcugcc

SEQ ID NO: 3243849 - RNA, 19 nt, Rubella virus
cgcccgaccccggggaccu

SEQ ID NO: 3243850 - RNA, 23 nt, Rubella virus
gaggcuuucaccuaccucugcac

SEQ ID NO: 3243851 - RNA, 14 nt, Rubella virus
cuguccaccaccgc

SEQ ID NO: 3243852 - RNA, 21 nt, Rubella virus
cgcagggacugguccagggcc

SEQ ID NO: 3243853 - RNA, 19 nt, Rubella virus
cgggcgugggggcucugcc

SEQ ID NO: 3243854 - RNA, 19 nt, Rubella virus
gcugcgcuaugcggugggg

SEQ ID NO: 3243855 - RNA, 16 nt, Rubella virus
gcaccuucugggcugu

SEQ ID NO: 3243856 - RNA, 16 nt, Rubella virus
ccccaggccuuccuug

SEQ ID NO: 3243857 - RNA, 15 nt, Rubella virus
cggccacuggcucca

SEQ ID NO: 3243858 - RNA, 16 nt, Rubella virus
caacgucaccacugaa

SEQ ID NO: 3243859 - RNA, 14 nt, Rubella virus
aggcgagcgcaccu

SEQ ID NO: 3243860 - RNA, 14 nt, Rubella virus
uccccugacugcuc

SEQ ID NO: 3243861 - RNA, 19 nt, Rubella virus
cgcgaaacccgcacuaggc

SEQ ID NO: 3243862 - RNA, 17 nt, Rubella virus
cgacgacccccugcugc

SEQ ID NO: 3243863 - RNA, 20 nt, Rubella virus
cggccccgauugggccuccc

SEQ ID NO: 3243864 - RNA, 15 nt, Rubella virus
gugccgccgcgccug

SEQ ID NO: 3243865 - RNA, 21 nt, Rubella virus
aagcaccuguccccgugcgcc

SEQ ID NO: 3243866 - RNA, 19 nt, Rubella virus
gauccacgcccacaccacc

SEQ ID NO: 3243867 - RNA, 15 nt, Rubella virus
cuccucaacaccccc

SEQ ID NO: 3243868 - RNA, 14 nt, Rubella virus
ccaaccugggcacc

SEQ ID NO: 3243869 - RNA, 17 nt, Rubella virus
gccguuccucgggcacg

SEQ ID NO: 3243870 - RNA, 17 nt, Rubella virus
gcgcugacacccggugc

SEQ ID NO: 3243871 - RNA, 20 nt, Rubella virus
gacggccaucauggcggcac

SEQ ID NO: 3243872 - RNA, 14 nt, Rubella virus
cacacacaccacug

SEQ ID NO: 3243873 - RNA, 13 nt, Rubella virus
uucguccugcugg

SEQ ID NO: 3243874 - RNA, 19 nt, Rubella virus
gccugcgugaccucguggc

SEQ ID NO: 3243875 - RNA, 13 nt, Rubella virus
ccccaugggaccu

SEQ ID NO: 3243876 - RNA, 21 nt, Rubella virus
cgccccgagcuggggccaccg

SEQ ID NO: 3243877 - RNA, 13 nt, Rubella virus
cccccgccacugc

SEQ ID NO: 3243878 - RNA, 17 nt, Rubella virus
ggccugcuggggcuucc

SEQ ID NO: 3243879 - RNA, 13 nt, Rubella virus
uaccgcccgcccc

SEQ ID NO: 3243880 - RNA, 20 nt, Rubella virus
cggucgccguuggcaccgcg

SEQ ID NO: 3243881 - RNA, 22 nt, Rubella virus
cacgaccgccgccacccccgcc

SEQ ID NO: 3243882 - RNA, 22 nt, Rubella virus
uugccgggcucuugcucgccac

SEQ ID NO: 3243883 - RNA, 12 nt, Rubella virus
gacgugcugccc

SEQ ID NO: 3243884 - RNA, 14 nt, Rubella virus
ccccgcgcuggugg

SEQ ID NO: 3243885 - RNA, 18 nt, Rubella virus
cacccaccgaggccugcg

SEQ ID NO: 3243886 - RNA, 18 nt, Rubella virus
cccuaccaagucagcugc

SEQ ID NO: 3243887 - RNA, 11 nt, Rubella virus
ccagggccccg

SEQ ID NO: 3243888 - RNA, 19 nt, Rubella virus
cacagcgacgcggccugcu

SEQ ID NO: 3243889 - RNA, 21 nt, Rubella virus
gccacagcgaacgcgcugucu

SEQ ID NO: 3243890 - RNA, 20 nt, Rubella virus
agccccccugugcgcacggg

SEQ ID NO: 3243891 - RNA, 15 nt, Rubella virus
caaccugggcacccc

SEQ ID NO: 3243892 - RNA, 13 nt, Rubella virus
ggcgccgccgccg

SEQ ID NO: 3243893 - RNA, 16 nt, Rubella virus
ccggcagaccugggcg

SEQ ID NO: 3243894 - RNA, 12 nt, Rubella virus
cucucaccaccg

SEQ ID NO: 3243895 - RNA, 18 nt, Rubella virus
ggcuguccaccaccgccc

SEQ ID NO: 3243896 - RNA, 21 nt, Rubella virus
cagggguacaacccccccgcc

SEQ ID NO: 3243897 - RNA, 15 nt, Rubella virus
gcucacucugggcgc

SEQ ID NO: 3243898 - RNA, 17 nt, Rubella virus
caacccuugcgggcccg

SEQ ID NO: 3243899 - RNA, 14 nt, Rubella virus
ggagggccccgccg

SEQ ID NO: 3243900 - RNA, 14 nt, Rubella virus
acgcggccugcugg

SEQ ID NO: 3243901 - RNA, 13 nt, Rubella virus
uguugcuguauag

SEQ ID NO: 3243902 - RNA, 12 nt, Rubella virus
uccccccuggga

SEQ ID NO: 3243903 - RNA, 18 nt, Rubella virus
gcgcagcuggccucuuac

SEQ ID NO: 3243904 - RNA, 19 nt, Rubella virus
cggcccucuggcucgccac

SEQ ID NO: 3243905 - RNA, 20 nt, Rubella virus
ccucaaugacagcugcggcg

SEQ ID NO: 3243906 - RNA, 21 nt, Rubella virus
cugccgcagccccccugugcg

SEQ ID NO: 3243907 - RNA, 16 nt, Rubella virus
gacuccggagggcccc

SEQ ID NO: 3243908 - RNA, 18 nt, Rubella virus
auggcgaggaccucggcg

SEQ ID NO: 3243909 - RNA, 22 nt, Rubella virus
guugaucugcgggcuguccacc

SEQ ID NO: 3243910 - RNA, 22 nt, Rubella virus
ucgccgccgcggcgccgccgcc

SEQ ID NO: 3243911 - RNA, 14 nt, Rubella virus
ggccuuccccccug

SEQ ID NO: 3243912 - RNA, 20 nt, Rubella virus
cgccacugcgccggcccccu

SEQ ID NO: 3243913 - RNA, 12 nt, Rubella virus
acacccccccgc

SEQ ID NO: 3243914 - RNA, 14 nt, Rubella virus
cuguugcuguauag

SEQ ID NO: 3243915 - RNA, 22 nt, Rubella virus
cauuugcgagauccccacugau

SEQ ID NO: 3243916 - RNA, 19 nt, Rubella virus
ugcuacaaccugagcgacu

SEQ ID NO: 3243917 - RNA, 17 nt, Rubella virus
accaccaucagcugccg

SEQ ID NO: 3243918 - RNA, 19 nt, Rubella virus
gccccgagcuggggccacc

SEQ ID NO: 3243919 - RNA, 18 nt, Rubella virus
cgccgccgcggcgccgcc

SEQ ID NO: 3243920 - RNA, 19 nt, Rubella virus
acccccugcugcgcacugc

SEQ ID NO: 3243921 - RNA, 18 nt, Rubella virus
accggcaaucagcagucc

SEQ ID NO: 3243922 - RNA, 18 nt, Rubella virus
cgccccgagcuggggcca

SEQ ID NO: 3243923 - RNA, 15 nt, Rubella virus
gcuccagccccgcgc

SEQ ID NO: 3243924 - RNA, 22 nt, Rubella virus
ccguucugcaacacgccgcacg

SEQ ID NO: 3243925 - RNA, 17 nt, Rubella virus
augcccgaguggaucca

SEQ ID NO: 3243926 - RNA, 22 nt, Rubella virus
gcuucggugccccccaggccuu

SEQ ID NO: 3243927 - RNA, 12 nt, Rubella virus
cucaccaccgcg

SEQ ID NO: 3243928 - RNA, 22 nt, Rubella virus
ccugucgccgccgcggcgccgc

SEQ ID NO: 3243929 - RNA, 20 nt, Rubella virus
cauuugcgcccucccacucg

SEQ ID NO: 3243930 - RNA, 15 nt, Rubella virus
ggccucgggagcccg

SEQ ID NO: 3243931 - RNA, 15 nt, Rubella virus
ccagacuccggcccc

SEQ ID NO: 3243932 - RNA, 18 nt, Rubella virus
acguuagcgccaccccgc

SEQ ID NO: 3243933 - RNA, 14 nt, Rubella virus
cccgcacuaggcca

SEQ ID NO: 3243934 - RNA, 23 nt, Rubella virus
ggcugcgcuaugcgguggggccu

SEQ ID NO: 3243935 - RNA, 14 nt, Rubella virus
cuggcggcagcuac

SEQ ID NO: 3243936 - RNA, 14 nt, Rubella virus
gacgcggccugcug

SEQ ID NO: 3243937 - RNA, 15 nt, Rubella virus
ugcgcacgggcagca

SEQ ID NO: 3243938 - RNA, 17 nt, Rubella virus
cuugcuccccagccucg

SEQ ID NO: 3243939 - RNA, 22 nt, Rubella virus
gugcgagggcuugggggccugg

SEQ ID NO: 3243940 - RNA, 19 nt, Rubella virus
cugggcacccccccacucg

SEQ ID NO: 3243941 - RNA, 16 nt, Rubella virus
cgccuacuccucuggc

SEQ ID NO: 3243942 - RNA, 15 nt, Rubella virus
ucauggcggcaccuu

SEQ ID NO: 3243943 - RNA, 16 nt, Rubella virus
caucgcgggcgccgcc

SEQ ID NO: 3243944 - RNA, 13 nt, Rubella virus
gugcgcggccucg

SEQ ID NO: 3243945 - RNA, 14 nt, Rubella virus
guggcccugccacg

SEQ ID NO: 3243946 - RNA, 19 nt, Rubella virus
gcuccaaggcggcuggggu

SEQ ID NO: 3243947 - RNA, 18 nt, Rubella virus
agccucggcccucuggcu

SEQ ID NO: 3243948 - RNA, 17 nt, Rubella virus
cugguccagggccccgc

SEQ ID NO: 3243949 - RNA, 13 nt, Rubella virus
cggcugcgccugg

SEQ ID NO: 3243950 - RNA, 14 nt, Rubella virus
gccgcggcaaccgg

SEQ ID NO: 3243951 - RNA, 18 nt, Rubella virus
cggagugggcugcugccc

SEQ ID NO: 3243952 - RNA, 21 nt, Rubella virus
cgcacugccccuggacccggc

SEQ ID NO: 3243953 - RNA, 21 nt, Rubella virus
uagauccccgcaccuguugcu

SEQ ID NO: 3243954 - RNA, 23 nt, Rubella virus
acuccggagggccccgccgccgc

SEQ ID NO: 3243955 - RNA, 21 nt, Rubella virus
gcggcuugugggggccacgcc

SEQ ID NO: 3243956 - RNA, 14 nt, Rubella virus
ucaccacugaacac

SEQ ID NO: 3243957 - RNA, 20 nt, Rubella virus
agcgccucgcuagugggccc

SEQ ID NO: 3243958 - RNA, 22 nt, Rubella virus
ugcgguggggccuuccccccug

SEQ ID NO: 3243959 - RNA, 15 nt, Rubella virus
cggccugcuggggcu

SEQ ID NO: 3243960 - RNA, 20 nt, Rubella virus
uccccacugaugucucgugc

SEQ ID NO: 3243961 - RNA, 20 nt, Rubella virus
cagccccuugcgcgcgcauc

SEQ ID NO: 3243962 - RNA, 21 nt, Rubella virus
uacaaccugagcgacuggcac

SEQ ID NO: 3243963 - RNA, 13 nt, Rubella virus
ccgccgccacccc

SEQ ID NO: 3243964 - RNA, 15 nt, Rubella virus
ggcucuugcucgcca

SEQ ID NO: 3243965 - RNA, 21 nt, Rubella virus
ucaacccuggcggcagcuacu

SEQ ID NO: 3243966 - RNA, 21 nt, Rubella virus
gaccugcauuucaccaaccug

SEQ ID NO: 3243967 - RNA, 13 nt, Rubella virus
caguacccgccua

SEQ ID NO: 3243968 - RNA, 18 nt, Rubella virus
ggacggccgcugggaccc

SEQ ID NO: 3243969 - RNA, 14 nt, Rubella virus
cagggacuggucca

SEQ ID NO: 3243970 - RNA, 14 nt, Rubella virus
caccuaccucugca

SEQ ID NO: 3243971 - RNA, 17 nt, Rubella virus
gccacccccgccacugc

SEQ ID NO: 3243972 - RNA, 19 nt, Rubella virus
ggccccgauugggccuccc

SEQ ID NO: 3243973 - RNA, 13 nt, Rubella virus
ucgcgggcgccgc

SEQ ID NO: 3243974 - RNA, 12 nt, Rubella virus
cgcagccccccu

SEQ ID NO: 3243975 - RNA, 16 nt, Rubella virus
accccgacgccucuca

SEQ ID NO: 3243976 - RNA, 18 nt, Rubella virus
cgccacugcgccggcccc

SEQ ID NO: 3243977 - RNA, 15 nt, Rubella virus
cccgcaccuguugcu

SEQ ID NO: 3243978 - RNA, 16 nt, Rubella virus
cguggcgcguggccug

SEQ ID NO: 3243979 - RNA, 18 nt, Rubella virus
gcccauugguggcagcuc

SEQ ID NO: 3243980 - RNA, 15 nt, Rubella virus
ccuugccgggcucuu

SEQ ID NO: 3243981 - RNA, 18 nt, Rubella virus
gcgcugauauggcggcac

SEQ ID NO: 3243982 - RNA, 13 nt, Rubella virus
caccaccgcggcg

SEQ ID NO: 3243983 - RNA, 18 nt, Rubella virus
gugcaccuucugggcugu

SEQ ID NO: 3243984 - RNA, 12 nt, Rubella virus
cgacuugcuccc

SEQ ID NO: 3243985 - RNA, 16 nt, Rubella virus
cauccaggcgcccgcu

SEQ ID NO: 3243986 - RNA, 22 nt, Rubella virus
gccggccucaaugacagcugcg

SEQ ID NO: 3243987 - RNA, 17 nt, Rubella virus
ccgcgcgcgccgggcuc

SEQ ID NO: 3243988 - RNA, 13 nt, Rubella virus
gcgccccgagcug

SEQ ID NO: 3243989 - RNA, 12 nt, Rubella virus
cgccgcgccugu

SEQ ID NO: 3243990 - RNA, 15 nt, Rubella virus
gacgcggccugcugg

SEQ ID NO: 3243991 - RNA, 13 nt, Rubella virus
ccgguggggccuc

SEQ ID NO: 3243992 - RNA, 18 nt, Rubella virus
gacgcgcgacuugcuccc

SEQ ID NO: 3243993 - RNA, 15 nt, Rubella virus
auacgcgcuggaccg

SEQ ID NO: 3243994 - RNA, 19 nt, Rubella virus
cugcugcgcaugccagugc

SEQ ID NO: 3243995 - RNA, 23 nt, Rubella virus
gccccgagcuggggccaccgacc

SEQ ID NO: 3243996 - RNA, 19 nt, Rubella virus
gacacagcgacgcggccug

SEQ ID NO: 3243997 - RNA, 15 nt, Rubella virus
ggggccguggccagc

SEQ ID NO: 3243998 - RNA, 21 nt, Rubella virus
ccuccucaacacccccccgcc

SEQ ID NO: 3243999 - RNA, 21 nt, Rubella virus
ugcgcggccucgacggcgaca

SEQ ID NO: 3244000 - RNA, 14 nt, Rubella virus
cccgcaccuguugc

SEQ ID NO: 3244001 - RNA, 18 nt, Rubella virus
cgggcucuugcucgccac

SEQ ID NO: 3244002 - RNA, 21 nt, Rubella virus
uggcgaggaccucggcgccgu

SEQ ID NO: 3244003 - RNA, 14 nt, Rubella virus
cccgagcuggggcc

SEQ ID NO: 3244004 - RNA, 14 nt, Rubella virus
acugccccuggacc

SEQ ID NO: 3244005 - RNA, 18 nt, Rubella virus
cuugugggggccacgcca

SEQ ID NO: 3244006 - RNA, 13 nt, Rubella virus
ugccgcagccccc

SEQ ID NO: 3244007 - RNA, 16 nt, Rubella virus
gacggccgcugggacc

SEQ ID NO: 3244008 - RNA, 18 nt, Rubella virus
gcgugggggcucugcccc

SEQ ID NO: 3244009 - RNA, 23 nt, Rubella virus
gccucgcuagugggcccccgcgc

SEQ ID NO: 3244010 - RNA, 15 nt, Rubella virus
gcgcacgggcagcau

SEQ ID NO: 3244011 - RNA, 21 nt, Rubella virus
acugcgccggcccccugccac

SEQ ID NO: 3244012 - RNA, 16 nt, Rubella virus
aggccacuggagccug

SEQ ID NO: 3244013 - RNA, 16 nt, Rubella virus
cccaguacccgccuac

SEQ ID NO: 3244014 - RNA, 20 nt, Rubella virus
caccgcgcgcgccgggcucc

SEQ ID NO: 3244015 - RNA, 14 nt, Rubella virus
gggcuccagccccg

SEQ ID NO: 3244016 - RNA, 22 nt, Rubella virus
caguucgcccgguggcccugcc

SEQ ID NO: 3244017 - RNA, 13 nt, Rubella virus
aaugacagcugcg

SEQ ID NO: 3244018 - RNA, 22 nt, Rubella virus
cggcacgcgcuggcaccgacug

SEQ ID NO: 3244019 - RNA, 17 nt, Rubella virus
gcgugggggcucugccc

SEQ ID NO: 3244020 - RNA, 15 nt, Rubella virus
aacccgcacuaggcc

SEQ ID NO: 3244021 - RNA, 17 nt, Rubella virus
ugccccccaggccuucc

SEQ ID NO: 3244022 - RNA, 16 nt, Rubella virus
ucaccaaccugggcac

SEQ ID NO: 3244023 - RNA, 14 nt, Rubella virus
augcaaaccgggcg

SEQ ID NO: 3244024 - RNA, 19 nt, Rubella virus
acccgcacuaggccacuag

SEQ ID NO: 3244025 - RNA, 13 nt, Rubella virus
ccgaccgccgccc

SEQ ID NO: 3244026 - RNA, 16 nt, Rubella virus
cugagcgacuggcacc

SEQ ID NO: 3244027 - RNA, 18 nt, Rubella virus
gccacccccgccacugcg

SEQ ID NO: 3244028 - RNA, 19 nt, Rubella virus
cgugacuccggagggcccc

SEQ ID NO: 3244029 - RNA, 20 nt, Rubella virus
cacugcgccggcccccugcc

SEQ ID NO: 3244030 - RNA, 13 nt, Rubella virus
cgcaccuguugcu

SEQ ID NO: 3244031 - RNA, 14 nt, Rubella virus
cucacucugggcgc

SEQ ID NO: 3244032 - RNA, 21 nt, Rubella virus
gcuggaccguacggccaugcu

SEQ ID NO: 3244033 - RNA, 15 nt, Rubella virus
cuaccucugcacugc

SEQ ID NO: 3244034 - RNA, 14 nt, Rubella virus
cgcggccugcuggg

SEQ ID NO: 3244035 - RNA, 15 nt, Rubella virus
uggcaccgacugcug

SEQ ID NO: 3244036 - RNA, 13 nt, Rubella virus
gacagcgccccgc

SEQ ID NO: 3244037 - RNA, 17 nt, Rubella virus
ccuggucgacgccgacg

SEQ ID NO: 3244038 - RNA, 15 nt, Rubella virus
gcggcugcuuugccc

SEQ ID NO: 3244039 - RNA, 20 nt, Rubella virus
ccagccucggcccucuggcu

SEQ ID NO: 3244040 - RNA, 17 nt, Rubella virus
caucgcgggcgccgcca

SEQ ID NO: 3244041 - RNA, 15 nt, Rubella virus
aguucgucaccgccg

SEQ ID NO: 3244042 - RNA, 15 nt, Rubella virus
ccuucguccugcugg

SEQ ID NO: 3244043 - RNA, 17 nt, Rubella virus
gcguguucgcccuugcu

SEQ ID NO: 3244044 - RNA, 18 nt, Rubella virus
ggacugguccagggcccc

SEQ ID NO: 3244045 - RNA, 16 nt, Rubella virus
cguccagcacccucac

SEQ ID NO: 3244046 - RNA, 15 nt, Rubella virus
cuccaaggcggcugg

SEQ ID NO: 3244047 - RNA, 15 nt, Rubella virus
ugucgccgccgcggc

SEQ ID NO: 3244048 - RNA, 20 nt, Rubella virus
acgccagcgacgugcugccc

SEQ ID NO: 3244049 - RNA, 16 nt, Rubella virus
ggccccgccgccgccg

SEQ ID NO: 3244050 - RNA, 11 nt, Rubella virus
ccacaccaccg

SEQ ID NO: 3244051 - RNA, 22 nt, Rubella virus
ggagcacgaccgaccgccgccc

SEQ ID NO: 3244052 - RNA, 13 nt, Rubella virus
gcauuacggccac

SEQ ID NO: 3244053 - RNA, 20 nt, Rubella virus
cucgcggcuugugggggcca

SEQ ID NO: 3244054 - RNA, 23 nt, Rubella virus
cccagccucggcccucuggcucg

SEQ ID NO: 3244055 - RNA, 23 nt, Rubella virus
agcuggccucuuacuucaacccu

SEQ ID NO: 3244056 - RNA, 15 nt, Rubella virus
ccucgaggccacugg

SEQ ID NO: 3244057 - RNA, 23 nt, Rubella virus
ugccacggccccgauugggccuc

SEQ ID NO: 3244058 - RNA, 13 nt, Rubella virus
cgcguggccugcg

SEQ ID NO: 3244059 - RNA, 14 nt, Rubella virus
ucaccaaccugggc

SEQ ID NO: 3244060 - RNA, 15 nt, Rubella virus
ccgcaccuguugcug

SEQ ID NO: 3244061 - RNA, 17 nt, Rubella virus
ugugucggagacccggc

SEQ ID NO: 3244062 - RNA, 17 nt, Rubella virus
ucaauggcgaggaccuc

SEQ ID NO: 3244063 - RNA, 11 nt, Rubella virus
gaccugggcgg

SEQ ID NO: 3244064 - RNA, 20 nt, Rubella virus
cacauggacuucuggugugu

SEQ ID NO: 3244065 - RNA, 14 nt, Rubella virus
cggcgacagcgccc

SEQ ID NO: 3244066 - RNA, 16 nt, Rubella virus
gccagcgacgugcugc

SEQ ID NO: 3244067 - RNA, 19 nt, Rubella virus
ccggagggccccgccgccg

SEQ ID NO: 3244068 - RNA, 15 nt, Rubella virus
ugcgcacugccccug

SEQ ID NO: 3244069 - RNA, 13 nt, Rubella virus
ccccugccacgcc

SEQ ID NO: 3244070 - RNA, 15 nt, Rubella virus
gcuacguccagcacc

SEQ ID NO: 3244071 - RNA, 22 nt, Rubella virus
gccaccaccaccaucagcugcc

SEQ ID NO: 3244072 - RNA, 16 nt, Rubella virus
cagcucacucugggcg

SEQ ID NO: 3244073 - RNA, 17 nt, Rubella virus
ccgccacaacagccuca

SEQ ID NO: 3244074 - RNA, 24 nt, Rubella virus
gagggcuugggggccuggguaccc

SEQ ID NO: 3244075 - RNA, 18 nt, Rubella virus
gucggagacccggcagac

SEQ ID NO: 3244076 - RNA, 21 nt, Rubella virus
ugcccgaguggauccacgccc

SEQ ID NO: 3244077 - RNA, 19 nt, Rubella virus
gacccggcgaggugugggu

SEQ ID NO: 3244078 - RNA, 16 nt, Rubella virus
guggcgcguggccugc

SEQ ID NO: 3244079 - RNA, 16 nt, Rubella virus
ccucgaggccacugga

SEQ ID NO: 3244080 - RNA, 15 nt, Rubella virus
agccaucgcgggcgc

SEQ ID NO: 3244081 - RNA, 18 nt, Rubella virus
ccugcagggguacaaccc

SEQ ID NO: 3244082 - RNA, 18 nt, Rubella virus
accugagcgacuggcacc

SEQ ID NO: 3244083 - RNA, 13 nt, Rubella virus
caccuucugggcu

SEQ ID NO: 3244084 - RNA, 14 nt, Rubella virus
ccugcgcccgccuc

SEQ ID NO: 3244085 - RNA, 19 nt, Rubella virus
ccgagcuggggccaccgac

SEQ ID NO: 3244086 - RNA, 16 nt, Rubella virus
caccgaggcacccacc

SEQ ID NO: 3244087 - RNA, 15 nt, Rubella virus
cggcagaccugggcg

SEQ ID NO: 3244088 - RNA, 16 nt, Rubella virus
cccugcugcgcacugc

SEQ ID NO: 3244089 - RNA, 19 nt, Rubella virus
ugccgcagccccccugugc

SEQ ID NO: 3244090 - RNA, 13 nt, Rubella virus
ccuugccgggcuc

SEQ ID NO: 3244091 - RNA, 15 nt, Rubella virus
cuggcaccagggcac

SEQ ID NO: 3244092 - RNA, 23 nt, Rubella virus
gcgcccgccucuccacgacccug

SEQ ID NO: 3244093 - RNA, 22 nt, Rubella virus
cuggcggguacgcgcagcuggc

SEQ ID NO: 3244094 - RNA, 13 nt, Rubella virus
agacccgcucggc

SEQ ID NO: 3244095 - RNA, 16 nt, Rubella virus
gcauccaccgggcccc

SEQ ID NO: 3244096 - RNA, 13 nt, Rubella virus
gccugcuggggcu

SEQ ID NO: 3244097 - RNA, 13 nt, Rubella virus
ggcacgacggcca

SEQ ID NO: 3244098 - RNA, 17 nt, Rubella virus
gccggcccccugccacg

SEQ ID NO: 3244099 - RNA, 16 nt, Rubella virus
gccucaacccccgcgc

SEQ ID NO: 3244100 - RNA, 18 nt, Rubella virus
gccucaaugacagcugcg

SEQ ID NO: 3244101 - RNA, 16 nt, Rubella virus
gcugcgcacugccccu

SEQ ID NO: 3244102 - RNA, 16 nt, Rubella virus
gauccccgcaccuguu

SEQ ID NO: 3244103 - RNA, 22 nt, Rubella virus
ggccuggguacccgcagccccu

SEQ ID NO: 3244104 - RNA, 23 nt, Rubella virus
aguucgcccgguggcccugccac

SEQ ID NO: 3244105 - RNA, 19 nt, Rubella virus
cggcuggacuugccgcggc

SEQ ID NO: 3244106 - RNA, 13 nt, Rubella virus
gaccccggggacc

SEQ ID NO: 3244107 - RNA, 14 nt, Rubella virus
ccucucaccaccgc

SEQ ID NO: 3244108 - RNA, 14 nt, Rubella virus
cagccccccugugc

SEQ ID NO: 3244109 - RNA, 14 nt, Rubella virus
gguacgcgcagcug

SEQ ID NO: 3244110 - RNA, 15 nt, Rubella virus
uggcagcucacucug

SEQ ID NO: 3244111 - RNA, 18 nt, Rubella virus
gcggccuucguccugcug

SEQ ID NO: 3244112 - RNA, 13 nt, Rubella virus
aauugccacggcc

SEQ ID NO: 3244113 - RNA, 15 nt, Rubella virus
cgcugccgcagcccc

SEQ ID NO: 3244114 - RNA, 18 nt, Rubella virus
ccucggcccucuggcucg

SEQ ID NO: 3244115 - RNA, 15 nt, Rubella virus
cgcccccggcugcgc

SEQ ID NO: 3244116 - RNA, 14 nt, Rubella virus
uacggccaccacca

SEQ ID NO: 3244117 - RNA, 19 nt, Rubella virus
gacggcggcugcuuugccc

SEQ ID NO: 3244118 - RNA, 11 nt, Rubella virus
agagcgccccc

SEQ ID NO: 3244119 - RNA, 19 nt, Rubella virus
gcuggcaccgacugcugcg

SEQ ID NO: 3244120 - RNA, 14 nt, Rubella virus
ccugagcgacuggc

SEQ ID NO: 3244121 - RNA, 19 nt, Rubella virus
ccguggcgcguggccugcg

SEQ ID NO: 3244122 - RNA, 23 nt, Rubella virus
ccugcuggggcuuccccaccgac

SEQ ID NO: 3244123 - RNA, 19 nt, Rubella virus
ugcgcccucccacucgcug

SEQ ID NO: 3244124 - RNA, 15 nt, Rubella virus
acgcgcuggcaccga

SEQ ID NO: 3244125 - RNA, 18 nt, Rubella virus
caacgccauuccccugac

SEQ ID NO: 3244126 - RNA, 16 nt, Rubella virus
cuugaucacgcccucg

SEQ ID NO: 3244127 - RNA, 14 nt, Rubella virus
gccguuggcaccgc

SEQ ID NO: 3244128 - RNA, 13 nt, Rubella virus
cagggccccgccc

SEQ ID NO: 3244129 - RNA, 15 nt, Rubella virus
acaaucaaccugccg

SEQ ID NO: 3244130 - RNA, 15 nt, Rubella virus
ggaccucggcgccgu

SEQ ID NO: 3244131 - RNA, 18 nt, Rubella virus
auuucaccaaccugggca

SEQ ID NO: 3244132 - RNA, 17 nt, Rubella virus
cuggucccguggguccu

SEQ ID NO: 3244133 - RNA, 19 nt, Rubella virus
ccuggcauccaccgggccc

SEQ ID NO: 3244134 - RNA, 19 nt, Rubella virus
gcccgaauugccacggccc

SEQ ID NO: 3244135 - RNA, 23 nt, Rubella virus
ugcucgcggcuugugggggccac

SEQ ID NO: 3244136 - RNA, 19 nt, Rubella virus
gaccucggcgccguccccc

SEQ ID NO: 3244137 - RNA, 14 nt, Rubella virus
cgcacuaggccacu

SEQ ID NO: 3244138 - RNA, 14 nt, Rubella virus
acgcugccgcagcc

SEQ ID NO: 3244139 - RNA, 19 nt, Rubella virus
ugcuggggcuuccccaccg

SEQ ID NO: 3244140 - RNA, 20 nt, Rubella virus
ggacacagcgacgcggccug

SEQ ID NO: 3244141 - RNA, 21 nt, Rubella virus
aggcuuucaccuaccucugca

SEQ ID NO: 3244142 - RNA, 16 nt, Rubella virus
ggccacuggagccugc

SEQ ID NO: 3244143 - RNA, 14 nt, Rubella virus
ccgcacuaggccac

SEQ ID NO: 3244144 - RNA, 14 nt, Rubella virus
auacgcgcuggacc

SEQ ID NO: 3244145 - RNA, 21 nt, Rubella virus
uccccagccucggcccucugg

SEQ ID NO: 3244146 - RNA, 18 nt, Rubella virus
gcugcccggccacuggcu

SEQ ID NO: 3244147 - RNA, 19 nt, Rubella virus
caaugugcgugugaccggg

SEQ ID NO: 3244148 - RNA, 16 nt, Rubella virus
gcauccgcuucggugc

SEQ ID NO: 3244149 - RNA, 18 nt, Rubella virus
gcgugcaccuucugggcu

SEQ ID NO: 3244150 - RNA, 20 nt, Rubella virus
cacgacccugacaccgaggc

SEQ ID NO: 3244151 - RNA, 20 nt, Rubella virus
uugaaccugccuucggacac

SEQ ID NO: 3244152 - RNA, 16 nt, Rubella virus
agcucacucugggcgc

SEQ ID NO: 3244153 - RNA, 21 nt, Rubella virus
gcauugagacccgcucggcgc

SEQ ID NO: 3244154 - RNA, 17 nt, Rubella virus
gcacacacaccacugcu

SEQ ID NO: 3244155 - RNA, 22 nt, Rubella virus
ugcugugucggagacccggcag

SEQ ID NO: 3244156 - RNA, 16 nt, Rubella virus
gccaucauggcggcac

SEQ ID NO: 3244157 - RNA, 14 nt, Rubella virus
gcccgguggcccug

SEQ ID NO: 3244158 - RNA, 22 nt, Rubella virus
ggcaccgcgcgcgccgggcucc

SEQ ID NO: 3244159 - RNA, 16 nt, Rubella virus
ugccccuggacccggc

SEQ ID NO: 3244160 - RNA, 21 nt, Rubella virus
cacucgacgaggacggccgcu

SEQ ID NO: 3244161 - RNA, 22 nt, Rubella virus
cacaccaccagcgaccccuggc

SEQ ID NO: 3244162 - RNA, 16 nt, Rubella virus
ccacggcgcugacacc

SEQ ID NO: 3244163 - RNA, 22 nt, Rubella virus
uagauccccgcaccuguugcug

SEQ ID NO: 3244164 - RNA, 22 nt, Rubella virus
ggcaccuugcgcgucggccagc

SEQ ID NO: 3244165 - RNA, 16 nt, Rubella virus
uuucaccuaccucugc

SEQ ID NO: 3244166 - RNA, 13 nt, Rubella virus
cugacugcucgcg

SEQ ID NO: 3244167 - RNA, 15 nt, Rubella virus
agcucacucugggcg

SEQ ID NO: 3244168 - RNA, 15 nt, Rubella virus
caacccuggcggcag

SEQ ID NO: 3244169 - RNA, 15 nt, Rubella virus
gccccgagcuggggc

SEQ ID NO: 3244170 - RNA, 23 nt, Rubella virus
ugacuccggagggccccgccgcc

SEQ ID NO: 3244171 - RNA, 19 nt, Rubella virus
auuuauggugugccgccgc

SEQ ID NO: 3244172 - RNA, 13 nt, Rubella virus
accagggcacuca

SEQ ID NO: 3244173 - RNA, 18 nt, Rubella virus
gcucugccccgcgccccg

SEQ ID NO: 3244174 - RNA, 21 nt, Rubella virus
gcugggguugcuacaaccuga

SEQ ID NO: 3244175 - RNA, 16 nt, Rubella virus
gcccaguacccgccua

SEQ ID NO: 3244176 - RNA, 18 nt, Rubella virus
cugccccgcgccccgagc

SEQ ID NO: 3244177 - RNA, 11 nt, Rubella virus
cgcgcagcugg

SEQ ID NO: 3244178 - RNA, 14 nt, Rubella virus
acgaccgccgccac

SEQ ID NO: 3244179 - RNA, 15 nt, Rubella virus
cggccgcugggaccc

SEQ ID NO: 3244180 - RNA, 15 nt, Rubella virus
ugguggaaggccuug

SEQ ID NO: 3244181 - RNA, 13 nt, Rubella virus
gcgccugcgccac

SEQ ID NO: 3244182 - RNA, 18 nt, Rubella virus
agcguguucgcccuugcu

SEQ ID NO: 3244183 - RNA, 16 nt, Rubella virus
ggcgccguccccccug

SEQ ID NO: 3244184 - RNA, 22 nt, Rubella virus
accccuggcauccaccgggccc

SEQ ID NO: 3244185 - RNA, 16 nt, Rubella virus
ggcagcauuacggcca

SEQ ID NO: 3244186 - RNA, 16 nt, Rubella virus
cgccacucaagcaccu

SEQ ID NO: 3244187 - RNA, 14 nt, Rubella virus
ggccuuccuugccg

SEQ ID NO: 3244188 - RNA, 18 nt, Rubella virus
agcccgaauugccacggc

SEQ ID NO: 3244189 - RNA, 14 nt, Rubella virus
ugcgccugcgccac

SEQ ID NO: 3244190 - RNA, 21 nt, Rubella virus
uaccagugcgguacccccgcg

SEQ ID NO: 3244191 - RNA, 12 nt, Rubella virus
gugggggcucug

SEQ ID NO: 3244192 - RNA, 15 nt, Rubella virus
ugcaccuucugggcu

SEQ ID NO: 3244193 - RNA, 16 nt, Rubella virus
cgcguggccugcgccc

SEQ ID NO: 3244194 - RNA, 17 nt, Rubella virus
ggcggagugggcugcug

SEQ ID NO: 3244195 - RNA, 14 nt, Rubella virus
ccccggcugcgccu

SEQ ID NO: 3244196 - RNA, 21 nt, Rubella virus
cgcggccuucguccugcuggu

SEQ ID NO: 3244197 - RNA, 21 nt, Rubella virus
cacagcgacgcggccugcugg

SEQ ID NO: 3244198 - RNA, 19 nt, Rubella virus
ggguacaacccccccgccu

SEQ ID NO: 3244199 - RNA, 15 nt, Rubella virus
ggccgaugcgccugc

SEQ ID NO: 3244200 - RNA, 17 nt, Rubella virus
ggccaucauggcggcac

SEQ ID NO: 3244201 - RNA, 21 nt, Rubella virus
agauccccgcaccuguugcug

SEQ ID NO: 3244202 - RNA, 17 nt, Rubella virus
gacagcugcggcggcuu

SEQ ID NO: 3244203 - RNA, 13 nt, Rubella virus
cucacucugggcg

SEQ ID NO: 3244204 - RNA, 22 nt, Rubella virus
gcggcugggguugcuacaaccu

SEQ ID NO: 3244205 - RNA, 15 nt, Rubella virus
accaagucagcugcg

SEQ ID NO: 3244206 - RNA, 15 nt, Rubella virus
acuggcaccagggca

SEQ ID NO: 3244207 - RNA, 17 nt, Rubella virus
gucccgguggggccucg

SEQ ID NO: 3244208 - RNA, 16 nt, Rubella virus
cgacgcggccugcugg

SEQ ID NO: 3244209 - RNA, 13 nt, Rubella virus
auccaccgggccc

SEQ ID NO: 3244210 - RNA, 16 nt, Rubella virus
caacucuccguugccg

SEQ ID NO: 3244211 - RNA, 19 nt, Rubella virus
uccgcuucggugcccccca

SEQ ID NO: 3244212 - RNA, 21 nt, Rubella virus
ccugcugcgcacugccccugg

SEQ ID NO: 3244213 - RNA, 13 nt, Rubella virus
gaaggccuugccc

SEQ ID NO: 3244214 - RNA, 22 nt, Rubella virus
ugcugcccggccacuggcucca

SEQ ID NO: 3244215 - RNA, 10 nt, Rubella virus
uccaccaccg

SEQ ID NO: 3244216 - RNA, 13 nt, Rubella virus
acaacccccccgc

SEQ ID NO: 3244217 - RNA, 19 nt, Rubella virus
acgaccgaccgccgcccgc

SEQ ID NO: 3244218 - RNA, 17 nt, Rubella virus
gcuagcuacguccagca

SEQ ID NO: 3244219 - RNA, 21 nt, Rubella virus
cacguuagcgccaccccgcaa

SEQ ID NO: 3244220 - RNA, 20 nt, Rubella virus
acccuugcgggcccgagccg

SEQ ID NO: 3244221 - RNA, 19 nt, Rubella virus
ugcgccacggcgcugacac

SEQ ID NO: 3244222 - RNA, 17 nt, Rubella virus
gccaucauggcggcacc

SEQ ID NO: 3244223 - RNA, 16 nt, Rubella virus
ugagcgacuggcacca

SEQ ID NO: 3244224 - RNA, 13 nt, Rubella virus
gcccucaccgcgg

SEQ ID NO: 3244225 - RNA, 18 nt, Rubella virus
caauggcgaggaccucgg

SEQ ID NO: 3244226 - RNA, 16 nt, Rubella virus
gugcaccuucugggcu

SEQ ID NO: 3244227 - RNA, 16 nt, Rubella virus
gccgcggcgugcccgc

SEQ ID NO: 3244228 - RNA, 15 nt, Rubella virus
cccggcagaccuggg

SEQ ID NO: 3244229 - RNA, 21 nt, Rubella virus
cccugcgcucauguacaaccc

SEQ ID NO: 3244230 - RNA, 11 nt, Rubella virus
ccacaccacca

SEQ ID NO: 3244231 - RNA, 11 nt, Rubella virus
cguccugcugg

SEQ ID NO: 3244232 - RNA, 13 nt, Rubella virus
cagcgacgcggcc

SEQ ID NO: 3244233 - RNA, 15 nt, Rubella virus
ccacgaccgccgcca

SEQ ID NO: 3244234 - RNA, 13 nt, Rubella virus
aaacccgcacuag

SEQ ID NO: 3244235 - RNA, 19 nt, Rubella virus
gccuggguacccgcagccc

SEQ ID NO: 3244236 - RNA, 22 nt, Rubella virus
cugccacgcacguuagcgccac

SEQ ID NO: 3244237 - RNA, 22 nt, Rubella virus
ccugcgugaccucguggcuuug

SEQ ID NO: 3244238 - RNA, 20 nt, Rubella virus
acgccugucauaggcucuca

SEQ ID NO: 3244239 - RNA, 13 nt, Rubella virus
gccguggccagcg

SEQ ID NO: 3244240 - RNA, 17 nt, Rubella virus
cgggcccgagccgcccg

SEQ ID NO: 3244241 - RNA, 13 nt, Rubella virus
guccccccuggga

SEQ ID NO: 3244242 - RNA, 12 nt, Rubella virus
ugucgccgccgc

SEQ ID NO: 3244243 - RNA, 16 nt, Rubella virus
gcacuaggccacuaga

SEQ ID NO: 3244244 - RNA, 17 nt, Rubella virus
acgccgacgacccccug

SEQ ID NO: 3244245 - RNA, 16 nt, Rubella virus
acgacccccugcugcg

SEQ ID NO: 3244246 - RNA, 14 nt, Rubella virus
cuccacgacccuga

SEQ ID NO: 3244247 - RNA, 17 nt, Rubella virus
ccagccccgcgcugaua

SEQ ID NO: 3244248 - RNA, 17 nt, Rubella virus
accgcgcgcgccgggcu

SEQ ID NO: 3244249 - RNA, 15 nt, Rubella virus
cagcgacgugcugcc

SEQ ID NO: 3244250 - RNA, 15 nt, Rubella virus
cuccggagggccccg

SEQ ID NO: 3244251 - RNA, 17 nt, Rubella virus
accgaggcacccaccga

SEQ ID NO: 3244252 - RNA, 16 nt, Rubella virus
acccccugcugcgcac

SEQ ID NO: 3244253 - RNA, 22 nt, Rubella virus
uccccagccucggcccucuggc

SEQ ID NO: 3244254 - RNA, 13 nt, Rubella virus
ggcuccagccccg

SEQ ID NO: 3244255 - RNA, 16 nt, Rubella virus
ccgcgucggcggcacg

SEQ ID NO: 3244256 - RNA, 17 nt, Rubella virus
cagcauuacggccacca

SEQ ID NO: 3244257 - RNA, 16 nt, Rubella virus
cagacuccggccccga

SEQ ID NO: 3244258 - RNA, 17 nt, Rubella virus
gcuucuugucugggugc

SEQ ID NO: 3244259 - RNA, 14 nt, Rubella virus
uggugagccccaug

SEQ ID NO: 3244260 - RNA, 15 nt, Rubella virus
cguguucgcccuugc

SEQ ID NO: 3244261 - RNA, 16 nt, Rubella virus
cggcacgcgcuggcac

SEQ ID NO: 3244262 - RNA, 14 nt, Rubella virus
cgcugggacccugc

SEQ ID NO: 3244263 - RNA, 19 nt, Rubella virus
acccgguuuggcugcgcua

SEQ ID NO: 3244264 - RNA, 20 nt, Rubella virus
ugccuucggacacagcgacg

SEQ ID NO: 3244265 - RNA, 21 nt, Rubella virus
gccucuuacuucaacccuggc

SEQ ID NO: 3244266 - RNA, 14 nt, Rubella virus
ugggacgcgcgacu

SEQ ID NO: 3244267 - RNA, 17 nt, Rubella virus
gagaccaggaccgucug

SEQ ID NO: 3244268 - RNA, 17 nt, Rubella virus
uggugagccccauggga

SEQ ID NO: 3244269 - RNA, 17 nt, Rubella virus
gucgccgccgcggcgcc

SEQ ID NO: 3244270 - RNA, 21 nt, Rubella virus
cugcgcuaugcgguggggccu

SEQ ID NO: 3244271 - RNA, 20 nt, Rubella virus
ggcuccaaggcggcuggggu

SEQ ID NO: 3244272 - RNA, 15 nt, Rubella virus
gacccggcagaccug

SEQ ID NO: 3244273 - RNA, 23 nt, Rubella virus
cgaggcacccaccgaggccugcg

SEQ ID NO: 3244274 - RNA, 13 nt, Rubella virus
ccccgccacugcg

SEQ ID NO: 3244275 - RNA, 13 nt, Rubella virus
gcgcgcgugcacc

SEQ ID NO: 3244276 - RNA, 20 nt, Rubella virus
acuagauccccgcaccuguu

SEQ ID NO: 3244277 - RNA, 22 nt, Rubella virus
cugggcgccauuugcgcccucc

SEQ ID NO: 3244278 - RNA, 16 nt, Rubella virus
accaccaucagcugcc

SEQ ID NO: 3244279 - RNA, 16 nt, Rubella virus
uaccaagucagcugcg

SEQ ID NO: 3244280 - RNA, 22 nt, Rubella virus
ccauccuuggcgcauccgcuuc

SEQ ID NO: 3244281 - RNA, 19 nt, Rubella virus
ccacagcgaacgcgcuguc

SEQ ID NO: 3244282 - RNA, 17 nt, Rubella virus
cagcgacgcggccugcu

SEQ ID NO: 3244283 - RNA, 14 nt, Rubella virus
gggccccgccgccg

SEQ ID NO: 3244284 - RNA, 16 nt, Rubella virus
ccuaccucugcacugc

SEQ ID NO: 3244285 - RNA, 20 nt, Rubella virus
cgcauccgcuucggugcccc

SEQ ID NO: 3244286 - RNA, 16 nt, Rubella virus
acccgcacuaggccac

SEQ ID NO: 3244287 - RNA, 14 nt, Rubella virus
ggcccucuggcucg

SEQ ID NO: 3244288 - RNA, 14 nt, Rubella virus
accgcccgccccga

SEQ ID NO: 3244289 - RNA, 14 nt, Rubella virus
ggcgcguggccugc

SEQ ID NO: 3244290 - RNA, 14 nt, Rubella virus
cagugcgcggccuc

SEQ ID NO: 3244291 - RNA, 21 nt, Rubella virus
accuccuacgcugccgcagcc

SEQ ID NO: 3244292 - RNA, 15 nt, Rubella virus
cccgccacugcgccg

SEQ ID NO: 3244293 - RNA, 17 nt, Rubella virus
cggagggccccgccgcc

SEQ ID NO: 3244294 - RNA, 19 nt, Rubella virus
agcagucccgguggggccu

SEQ ID NO: 3244295 - RNA, 21 nt, Rubella virus
gcgccccgagcuggggccacc

SEQ ID NO: 3244296 - RNA, 17 nt, Rubella virus
cuccaaggcggcugggg

SEQ ID NO: 3244297 - RNA, 22 nt, Rubella virus
aggccacuagauccccgcaccu

SEQ ID NO: 3244298 - RNA, 22 nt, Rubella virus
cgaggccugcgugaccucgugg

SEQ ID NO: 3244299 - RNA, 13 nt, Rubella virus
caucgaccccgcc

SEQ ID NO: 3244300 - RNA, 18 nt, Rubella virus
acccggcagaccugggcg

SEQ ID NO: 3244301 - RNA, 20 nt, Rubella virus
cgccccgaagacggcuggac

SEQ ID NO: 3244302 - RNA, 14 nt, Rubella virus
auggcggcaccucc

SEQ ID NO: 3244303 - RNA, 22 nt, Rubella virus
acucgacgaggacggccgcugg

SEQ ID NO: 3244304 - RNA, 20 nt, Rubella virus
accugcauuucaccaaccug

SEQ ID NO: 3244305 - RNA, 12 nt, Rubella virus
gacggcgacagc

SEQ ID NO: 3244306 - RNA, 13 nt, Rubella virus
gcgucggcggcac

SEQ ID NO: 3244307 - RNA, 16 nt, Rubella virus
gcgguggggccuuccc

SEQ ID NO: 3244308 - RNA, 15 nt, Rubella virus
gccagcgcagggacu

SEQ ID NO: 3244309 - RNA, 15 nt, Rubella virus
ggcggcuucuugucu

SEQ ID NO: 3244310 - RNA, 16 nt, Rubella virus
cgggcacgacggccau

SEQ ID NO: 3244311 - RNA, 22 nt, Rubella virus
gcgcccgccucuccacgacccu

SEQ ID NO: 3244312 - RNA, 19 nt, Rubella virus
cgcggcuugugggggccac

SEQ ID NO: 3244313 - RNA, 17 nt, Rubella virus
cccugcugcgcacugcc

SEQ ID NO: 3244314 - RNA, 19 nt, Rubella virus
gacugguccagggccccgc

SEQ ID NO: 3244315 - RNA, 16 nt, Rubella virus
cgcagggacuggucca

SEQ ID NO: 3244316 - RNA, 14 nt, Rubella virus
cccggggaccuggu

SEQ ID NO: 3244317 - RNA, 18 nt, Rubella virus
gcugccgcagccccccug

SEQ ID NO: 3244318 - RNA, 19 nt, Rubella virus
cggccugcuggggcuuccc

SEQ ID NO: 3244319 - RNA, 19 nt, Rubella virus
gcccacaccaccagcgacc

SEQ ID NO: 3244320 - RNA, 21 nt, Rubella virus
cgcgccccgagcuggggccac

SEQ ID NO: 3244321 - RNA, 18 nt, Rubella virus
acugcaccggggugcgcc

SEQ ID NO: 3244322 - RNA, 20 nt, Rubella virus
uccgcuucggugccccccag

SEQ ID NO: 3244323 - RNA, 20 nt, Rubella virus
gccgugacuccggagggccc

SEQ ID NO: 3244324 - RNA, 17 nt, Rubella virus
cuacccgguuuggcugc

SEQ ID NO: 3244325 - RNA, 17 nt, Rubella virus
uucaccaaccugggcac

SEQ ID NO: 3244326 - RNA, 14 nt, Rubella virus
gccccgcgccccga

SEQ ID NO: 3244327 - RNA, 12 nt, Rubella virus
gcucugccccgc

SEQ ID NO: 3244328 - RNA, 17 nt, Rubella virus
ugcuccccagccucggc

SEQ ID NO: 3244329 - RNA, 19 nt, Rubella virus
gccgcugggacccugcgcu

SEQ ID NO: 3244330 - RNA, 22 nt, Rubella virus
cgugggggcucugccccgcgcc

SEQ ID NO: 3244331 - RNA, 22 nt, Rubella virus
caccgaggcacccaccgaggcc

SEQ ID NO: 3244332 - RNA, 18 nt, Rubella virus
acccaccgaggccugcgu

SEQ ID NO: 3244333 - RNA, 17 nt, Rubella virus
gcugcccggccacuggc

SEQ ID NO: 3244334 - RNA, 17 nt, Rubella virus
agcuacguccagcaccc

SEQ ID NO: 3244335 - RNA, 16 nt, Rubella virus
acggccaccaccacca

SEQ ID NO: 3244336 - RNA, 18 nt, Rubella virus
uccggagggccccgccgc

SEQ ID NO: 3244337 - RNA, 19 nt, Rubella virus
ccgccgcggcgccgccgcc

SEQ ID NO: 3244338 - RNA, 20 nt, Rubella virus
cacuagauccccgcaccugu

SEQ ID NO: 3244339 - RNA, 15 nt, Rubella virus
auccacgcccacacc

SEQ ID NO: 3244340 - RNA, 16 nt, Rubella virus
ccucaaugacagcugc

SEQ ID NO: 3244341 - RNA, 16 nt, Rubella virus
cuuccccccugggaac

SEQ ID NO: 3244342 - RNA, 19 nt, Rubella virus
gcacgcgcuggcaccgacu

SEQ ID NO: 3244343 - RNA, 22 nt, Rubella virus
cccgcccuaccaagucagcugc

SEQ ID NO: 3244344 - RNA, 20 nt, Rubella virus
cgcccgccucuccacgaccc

SEQ ID NO: 3244345 - RNA, 22 nt, Rubella virus
ccgcgcgaaacccgcacuaggc

SEQ ID NO: 3244346 - RNA, 20 nt, Rubella virus
gacuuccgcgucggcggcac

SEQ ID NO: 3244347 - RNA, 20 nt, Rubella virus
cgggccgaugcgccugcgcc

SEQ ID NO: 3244348 - RNA, 16 nt, Rubella virus
uugaucacgcccucgc

SEQ ID NO: 3244349 - RNA, 22 nt, Rubella virus
ggcggcaccuccuacgcugccg

SEQ ID NO: 3244350 - RNA, 22 nt, Rubella virus
guuccucgggcacgacggccau

SEQ ID NO: 3244351 - RNA, 18 nt, Rubella virus
ggcacccaccgaggccug

SEQ ID NO: 3244352 - RNA, 19 nt, Rubella virus
cgcgacuugcuccccagcc

SEQ ID NO: 3244353 - RNA, 21 nt, Rubella virus
cggccgcugggacccugcgcu

SEQ ID NO: 3244354 - RNA, 20 nt, Rubella virus
gcgugcccgcccauccaggc

SEQ ID NO: 3244355 - RNA, 15 nt, Rubella virus
acuugcuccccagcc

SEQ ID NO: 3244356 - RNA, 15 nt, Rubella virus
gccuacuccucuggc

SEQ ID NO: 3244357 - RNA, 20 nt, Rubella virus
gcgggcuguccaccaccgcc

SEQ ID NO: 3244358 - RNA, 20 nt, Rubella virus
ugucggagacccggcagacc

SEQ ID NO: 3244359 - RNA, 16 nt, Rubella virus
cauccaccgggccccu

SEQ ID NO: 3244360 - RNA, 13 nt, Rubella virus
cgacgugcugccc

SEQ ID NO: 3244361 - RNA, 21 nt, Rubella virus
guggcagcucacucugggcgc

SEQ ID NO: 3244362 - RNA, 14 nt, Rubella virus
ccaccaucagcugc

SEQ ID NO: 3244363 - RNA, 21 nt, Rubella virus
cugggcggagugggcugcugc

SEQ ID NO: 3244364 - RNA, 23 nt, Rubella virus
aaugcccgaguggauccacgccc

SEQ ID NO: 3244365 - RNA, 16 nt, Rubella virus
cccgcacuaggccacu

SEQ ID NO: 3244366 - RNA, 17 nt, Rubella virus
ccgaugcgccugcgcca

SEQ ID NO: 3244367 - RNA, 12 nt, Rubella virus
cgccgccacccc

SEQ ID NO: 3244368 - RNA, 20 nt, Rubella virus
agagcgcccccggcugcgcc

SEQ ID NO: 3244369 - RNA, 15 nt, Rubella virus
acugccccuggaccc

SEQ ID NO: 3244370 - RNA, 13 nt, Rubella virus
ggcgcguggccug

SEQ ID NO: 3244371 - RNA, 12 nt, Rubella virus
cgcugggacccu

SEQ ID NO: 3244372 - RNA, 15 nt, Rubella virus
agcauuacggccacc

SEQ ID NO: 3244373 - RNA, 16 nt, Rubella virus
cuucccccccacacca

SEQ ID NO: 3244374 - RNA, 18 nt, Rubella virus
ggcagcauuacggccacc

SEQ ID NO: 3244375 - RNA, 22 nt, Rubella virus
accugcauuucaccaaccuggg

SEQ ID NO: 3244376 - RNA, 16 nt, Rubella virus
gccccgccccccccgg

SEQ ID NO: 3244377 - RNA, 14 nt, Rubella virus
cucggcccucuggc

SEQ ID NO: 3244378 - RNA, 12 nt, Rubella virus
caggucccgccc

SEQ ID NO: 3244379 - RNA, 13 nt, Rubella virus
cgcagggacuggu

SEQ ID NO: 3244380 - RNA, 20 nt, Rubella virus
uggguacccgcagccccuug

SEQ ID NO: 3244381 - RNA, 19 nt, Rubella virus
ccgcugggacccugcgcuc

SEQ ID NO: 3244382 - RNA, 12 nt, Rubella virus
cuguugcuguau

SEQ ID NO: 3244383 - RNA, 12 nt, Rubella virus
guccagggcccc

SEQ ID NO: 3244384 - RNA, 15 nt, Rubella virus
caggcgcccgcugcc

SEQ ID NO: 3244385 - RNA, 17 nt, Rubella virus
gcucgcggcuugugggg

SEQ ID NO: 3244386 - RNA, 13 nt, Rubella virus
ucacucugggcgc

SEQ ID NO: 3244387 - RNA, 17 nt, Rubella virus
cugucaacgccuacucc

SEQ ID NO: 3244388 - RNA, 21 nt, Rubella virus
agcgccucgcuagugggcccc

SEQ ID NO: 3244389 - RNA, 15 nt, Rubella virus
cgccugcgccacggc

SEQ ID NO: 3244390 - RNA, 15 nt, Rubella virus
gcacugccccuggac

SEQ ID NO: 3244391 - RNA, 22 nt, Rubella virus
agcgcccccggcugcgccuggu

SEQ ID NO: 3244392 - RNA, 12 nt, Rubella virus
gaugucucgugc

SEQ ID NO: 3244393 - RNA, 22 nt, Rubella virus
ucgacgaggacggccgcuggga

SEQ ID NO: 3244394 - RNA, 20 nt, Rubella virus
cagcgacgugcugcccggcc

SEQ ID NO: 3244395 - RNA, 12 nt, Rubella virus
ugccgggcucuu

SEQ ID NO: 3244396 - RNA, 23 nt, Rubella virus
cgggagcccgaauugccacggcc

SEQ ID NO: 3244397 - RNA, 23 nt, Rubella virus
cgcucggcgcgccauccuuggcg

SEQ ID NO: 3244398 - RNA, 17 nt, Rubella virus
gacgacccccugcugcg

SEQ ID NO: 3244399 - RNA, 23 nt, Rubella virus
cagggguacaacccccccgccua

SEQ ID NO: 3244400 - RNA, 23 nt, Rubella virus
ucuggcggguacgcgcagcuggc

SEQ ID NO: 3244401 - RNA, 19 nt, Rubella virus
cguggccugcgcccgccuc

SEQ ID NO: 3244402 - RNA, 20 nt, Rubella virus
ccgcgccccgagcuggggcc

SEQ ID NO: 3244403 - RNA, 19 nt, Rubella virus
gcuucccccccacaccacc

SEQ ID NO: 3244404 - RNA, 16 nt, Rubella virus
gcgccgggcuccagcc

SEQ ID NO: 3244405 - RNA, 22 nt, Rubella virus
cugcuuugccccaugggaccuc

SEQ ID NO: 3244406 - RNA, 15 nt, Rubella virus
cagagcgcccccggc

SEQ ID NO: 3244407 - RNA, 19 nt, Rubella virus
cgugggggcucugccccgc

SEQ ID NO: 3244408 - RNA, 20 nt, Rubella virus
cucuggcggguacgcgcagc

SEQ ID NO: 3244409 - RNA, 16 nt, Rubella virus
ggcaccgcgcgcgccg

SEQ ID NO: 3244410 - RNA, 17 nt, Rubella virus
accagcgaccccuggca

SEQ ID NO: 3244411 - RNA, 20 nt, Rubella virus
gcgcaucuggaauggcacac

SEQ ID NO: 3244412 - RNA, 16 nt, Rubella virus
ggccugcgcccgccuc

SEQ ID NO: 3244413 - RNA, 19 nt, Rubella virus
cccgcaccuguugcuguau

SEQ ID NO: 3244414 - RNA, 18 nt, Rubella virus
cgccacucaagcaccugu

SEQ ID NO: 3244415 - RNA, 22 nt, Rubella virus
acgcgcuggcaccgacugcugc

SEQ ID NO: 3244416 - RNA, 14 nt, Rubella virus
agggguacaacccc

SEQ ID NO: 3244417 - RNA, 13 nt, Rubella virus
cgcgccgggcucc

SEQ ID NO: 3244418 - RNA, 21 nt, Rubella virus
cugucgccgccgcggcgccgc

SEQ ID NO: 3244419 - RNA, 13 nt, Rubella virus
gccccuuggggcu

SEQ ID NO: 3244420 - RNA, 19 nt, Rubella virus
cggcgcuauagcgccucgc

SEQ ID NO: 3244421 - RNA, 19 nt, Rubella virus
gcggcgcuauagcgccucg

SEQ ID NO: 3244422 - RNA, 13 nt, Rubella virus
cgccccgcuuccc

SEQ ID NO: 3244423 - RNA, 13 nt, Rubella virus
ggacacagcgacg

SEQ ID NO: 3244424 - RNA, 17 nt, Rubella virus
gacaguucgcccggugg

SEQ ID NO: 3244425 - RNA, 16 nt, Rubella virus
uccccgcaccuguugc

SEQ ID NO: 3244426 - RNA, 16 nt, Rubella virus
gagugggcugcugccc

SEQ ID NO: 3244427 - RNA, 20 nt, Rubella virus
cuugucugggugcgggccga

SEQ ID NO: 3244428 - RNA, 14 nt, Rubella virus
gcgggcuguccacc

SEQ ID NO: 3244429 - RNA, 15 nt, Rubella virus
cggugccccccaggc

SEQ ID NO: 3244430 - RNA, 18 nt, Rubella virus
ccccgugcgccucgcugg

SEQ ID NO: 3244431 - RNA, 16 nt, Rubella virus
uaccucugcacugcac

SEQ ID NO: 3244432 - RNA, 23 nt, Rubella virus
cgacggcgacagcgccccgcuuc

SEQ ID NO: 3244433 - RNA, 18 nt, Rubella virus
cggccccgauugggccuc

SEQ ID NO: 3244434 - RNA, 19 nt, Rubella virus
acucgacgaggacggccgc

SEQ ID NO: 3244435 - RNA, 17 nt, Rubella virus
cugugcgcacgggcagc

SEQ ID NO: 3244436 - RNA, 22 nt, Rubella virus
gccaacgccauuccccugacug

SEQ ID NO: 3244437 - RNA, 12 nt, Rubella virus
gccgcagccccc

SEQ ID NO: 3244438 - RNA, 12 nt, Rubella virus
aagucagcugcg

SEQ ID NO: 3244439 - RNA, 16 nt, Rubella virus
gcuugugggggccacg

SEQ ID NO: 3244440 - RNA, 22 nt, Rubella virus
acggccgcugggacccugcgcu

SEQ ID NO: 3244441 - RNA, 16 nt, Rubella virus
caggcgcccgcugccc

SEQ ID NO: 3244442 - RNA, 18 nt, Rubella virus
ccucgcuagugggccccc

SEQ ID NO: 3244443 - RNA, 16 nt, Rubella virus
ugcgggcccgagccgc

SEQ ID NO: 3244444 - RNA, 18 nt, Rubella virus
acgcccucgcggccuucg

SEQ ID NO: 3244445 - RNA, 15 nt, Rubella virus
acuucaacccuggcg

SEQ ID NO: 3244446 - RNA, 15 nt, Rubella virus
gcgcgucggccagca

SEQ ID NO: 3244447 - RNA, 21 nt, Rubella virus
caccgcccaguacccgccuac

SEQ ID NO: 3244448 - RNA, 22 nt, Rubella virus
gcugcuuugccccaugggaccu

SEQ ID NO: 3244449 - RNA, 16 nt, Rubella virus
cuugccgggcucuugc

SEQ ID NO: 3244450 - RNA, 17 nt, Rubella virus
ugcccggccacuggcuc

SEQ ID NO: 3244451 - RNA, 18 nt, Rubella virus
cccccugcugcgcacugc

SEQ ID NO: 3244452 - RNA, 17 nt, Rubella virus
ggcccucuggcucgcca

SEQ ID NO: 3244453 - RNA, 20 nt, Rubella virus
cggcgccgccgccgcccuca

SEQ ID NO: 3244454 - RNA, 13 nt, Rubella virus
accucggcgccgu

SEQ ID NO: 3244455 - RNA, 21 nt, Rubella virus
uggcauccaccgggccccuug

SEQ ID NO: 3244456 - RNA, 16 nt, Rubella virus
cugccccgcgccccga

SEQ ID NO: 3244457 - RNA, 18 nt, Rubella virus
gcaccuacgccgagcagg

SEQ ID NO: 3244458 - RNA, 21 nt, Rubella virus
ggccccgccccccccggagga

SEQ ID NO: 3244459 - RNA, 15 nt, Rubella virus
gcgaacuccacgacc

SEQ ID NO: 3244460 - RNA, 22 nt, Rubella virus
gcgcugguggaaggccuugccc

SEQ ID NO: 3244461 - RNA, 16 nt, Rubella virus
gccgcgccugucgccg

SEQ ID NO: 3244462 - RNA, 14 nt, Rubella virus
cgccauuugcgccc

SEQ ID NO: 3244463 - RNA, 15 nt, Rubella virus
gcugcgcacugcccc

SEQ ID NO: 3244464 - RNA, 18 nt, Rubella virus
gauuguggacggcggcug

SEQ ID NO: 3244465 - RNA, 16 nt, Rubella virus
agggcuugggggccug

SEQ ID NO: 3244466 - RNA, 12 nt, Rubella virus
gucccggugggg

SEQ ID NO: 3244467 - RNA, 15 nt, Rubella virus
acgcccacaccacca

SEQ ID NO: 3244468 - RNA, 14 nt, Rubella virus
acacccccccgccc

SEQ ID NO: 3244469 - RNA, 15 nt, Rubella virus
gcugcccggccacug

SEQ ID NO: 3244470 - RNA, 16 nt, Rubella virus
gcugauauggcggcac

SEQ ID NO: 3244471 - RNA, 20 nt, Rubella virus
cgccgcccuccucaacaccc

SEQ ID NO: 3244472 - RNA, 19 nt, Rubella virus
caggcgcccgcugccccga

SEQ ID NO: 3244473 - RNA, 13 nt, Rubella virus
agcgcccccggcu

SEQ ID NO: 3244474 - RNA, 18 nt, Rubella virus
uggguacccgcagccccu

SEQ ID NO: 3244475 - RNA, 13 nt, Rubella virus
ggccugcuggggc

SEQ ID NO: 3244476 - RNA, 16 nt, Rubella virus
ggcccucuggcucgcc

SEQ ID NO: 3244477 - RNA, 23 nt, Rubella virus
cgcccgcgaccccgacgccucuc

SEQ ID NO: 3244478 - RNA, 20 nt, Rubella virus
acgaccgccgccacccccgc

SEQ ID NO: 3244479 - RNA, 22 nt, Rubella virus
acggucgccguuggcaccgcgc

SEQ ID NO: 3244480 - RNA, 19 nt, Rubella virus
cccgcacuaggccacuaga

SEQ ID NO: 3244481 - RNA, 19 nt, Rubella virus
cauccaggcgcccgcugcc

SEQ ID NO: 3244482 - RNA, 15 nt, Rubella virus
ccugugcgcacgggc

SEQ ID NO: 3244483 - RNA, 13 nt, Rubella virus
ccgguggcccugc

SEQ ID NO: 3244484 - RNA, 23 nt, Rubella virus
ggccacuagauccccgcaccugu

SEQ ID NO: 3244485 - RNA, 22 nt, Rubella virus
ugcgcucauguacaacccuugc

SEQ ID NO: 3244486 - RNA, 14 nt, Rubella virus
ucgcgggcgccgcc

SEQ ID NO: 3244487 - RNA, 14 nt, Rubella virus
gcgccccgagcugg

SEQ ID NO: 3244488 - RNA, 12 nt, Rubella virus
cagggccccgcc

SEQ ID NO: 3244489 - RNA, 17 nt, Rubella virus
gccucuccacgacccug

SEQ ID NO: 3244490 - RNA, 21 nt, Rubella virus
gccccccugugcgcacgggca

SEQ ID NO: 3244491 - RNA, 22 nt, Rubella virus
ccggcgugguguauggcacaca

SEQ ID NO: 3244492 - RNA, 17 nt, Rubella virus
cgggccgaugcgccugc

SEQ ID NO: 3244493 - RNA, 16 nt, Rubella virus
accgcccaguacccgc

SEQ ID NO: 3244494 - RNA, 17 nt, Rubella virus
augcgguggggccuucc

SEQ ID NO: 3244495 - RNA, 19 nt, Rubella virus
cccgcgccccgagcugggg

SEQ ID NO: 3244496 - RNA, 23 nt, Rubella virus
gggacugguccagggccccgccc

SEQ ID NO: 3244497 - RNA, 16 nt, Rubella virus
gccucggcccucuggc

SEQ ID NO: 3244498 - RNA, 19 nt, Rubella virus
ccuugcgcgcgcaucugga

SEQ ID NO: 3244499 - RNA, 14 nt, Rubella virus
cgcacugccccugg

SEQ ID NO: 3244500 - RNA, 14 nt, Rubella virus
ugcuuugccccaug

SEQ ID NO: 3244501 - RNA, 17 nt, Rubella virus
cccggccacuggcucca

SEQ ID NO: 3244502 - RNA, 20 nt, Rubella virus
cguggccugcgcccgccucu

SEQ ID NO: 3244503 - RNA, 14 nt, Rubella virus
cggcccccugccac

SEQ ID NO: 3244504 - RNA, 20 nt, Rubella virus
uggcacacacaccacugcug

SEQ ID NO: 3244505 - RNA, 15 nt, Rubella virus
cccgaagacggcugg

SEQ ID NO: 3244506 - RNA, 17 nt, Rubella virus
aggcgcccgcugccccg

SEQ ID NO: 3244507 - RNA, 21 nt, Rubella virus
cgcugauauggcggcaccucc

SEQ ID NO: 3244508 - RNA, 15 nt, Rubella virus
ugcgccggcccccug

SEQ ID NO: 3244509 - RNA, 14 nt, Rubella virus
ggaccguacggcca

SEQ ID NO: 3244510 - RNA, 11 nt, Rubella virus
ggcggcagcua

SEQ ID NO: 3244511 - RNA, 22 nt, Rubella virus
gcauuucaccaaccugggcacc

SEQ ID NO: 3244512 - RNA, 13 nt, Rubella virus
gccgcccgcucac

SEQ ID NO: 3244513 - RNA, 20 nt, Rubella virus
accuaccucugcacugcacc

SEQ ID NO: 3244514 - RNA, 22 nt, Rubella virus
cacugcaccggggugcgccacu

SEQ ID NO: 3244515 - RNA, 18 nt, Rubella virus
gacggcgacagcgccccg

SEQ ID NO: 3244516 - RNA, 14 nt, Rubella virus
gucccgcccgaccc

SEQ ID NO: 3244517 - RNA, 14 nt, Rubella virus
gaccguacggccau

SEQ ID NO: 3244518 - RNA, 17 nt, Rubella virus
accuccuacgcugccgc

SEQ ID NO: 3244519 - RNA, 20 nt, Rubella virus
cuggggccaccgaccaaccc

SEQ ID NO: 3244520 - RNA, 20 nt, Rubella virus
cauccaggcgcccgcugccc

SEQ ID NO: 3244521 - RNA, 16 nt, Rubella virus
cgggcucuugcucgcc

SEQ ID NO: 3244522 - RNA, 17 nt, Rubella virus
gccugcgcccgccucuc

SEQ ID NO: 3244523 - RNA, 12 nt, Rubella virus
cggagacccggc

SEQ ID NO: 3244524 - RNA, 23 nt, Rubella virus
ccccugggaaguucgucaccgcc

SEQ ID NO: 3244525 - RNA, 13 nt, Rubella virus
cgguggggccucg

SEQ ID NO: 3244526 - RNA, 22 nt, Rubella virus
ucagcagucccgguggggccuc

SEQ ID NO: 3244527 - RNA, 17 nt, Rubella virus
gcugccguuccucgggc

SEQ ID NO: 3244528 - RNA, 22 nt, Rubella virus
cgcgaaacccgcacuaggccac

SEQ ID NO: 3244529 - RNA, 16 nt, Rubella virus
cacaccacugcugugu

SEQ ID NO: 3244530 - RNA, 17 nt, Rubella virus
cgcacguuagcgccacc

SEQ ID NO: 3244531 - RNA, 12 nt, Rubella virus
ccaccgggcccc

SEQ ID NO: 3244532 - RNA, 14 nt, Rubella virus
uucccccccacacc

SEQ ID NO: 3244533 - RNA, 15 nt, Rubella virus
cugcccggccacugg

SEQ ID NO: 3244534 - RNA, 15 nt, Rubella virus
gcguggccugcgccc

SEQ ID NO: 3244535 - RNA, 17 nt, Rubella virus
cgucaccgccgcccucc

SEQ ID NO: 3244536 - RNA, 16 nt, Rubella virus
gggcuugggggccugg

SEQ ID NO: 3244537 - RNA, 14 nt, Rubella virus
gaggacggccgcug

SEQ ID NO: 3244538 - RNA, 19 nt, Rubella virus
ucgcuagugggcccccgcg

SEQ ID NO: 3244539 - RNA, 13 nt, Rubella virus
agcuggggccacc

SEQ ID NO: 3244540 - RNA, 15 nt, Rubella virus
cagcagucccggugg

SEQ ID NO: 3244541 - RNA, 22 nt, Rubella virus
cgacuugcuccccagccucggc

SEQ ID NO: 3244542 - RNA, 18 nt, Rubella virus
acgccuacuccucuggcg

SEQ ID NO: 3244543 - RNA, 20 nt, Rubella virus
ggcgugggggcucugccccg

SEQ ID NO: 3244544 - RNA, 18 nt, Rubella virus
cgacgacccccugcugcg

SEQ ID NO: 3244545 - RNA, 23 nt, Rubella virus
accgcgcgggucaucgaccccgc

SEQ ID NO: 3244546 - RNA, 16 nt, Rubella virus
gguccagggccccgcc

SEQ ID NO: 3244547 - RNA, 14 nt, Rubella virus
gcgaucgcgcgacc

SEQ ID NO: 3244548 - RNA, 21 nt, Rubella virus
acuugcuccccagccucggcc

SEQ ID NO: 3244549 - RNA, 13 nt, Rubella virus
ucuggcucgccac

SEQ ID NO: 3244550 - RNA, 17 nt, Rubella virus
ccccgaagacggcugga

SEQ ID NO: 3244551 - RNA, 18 nt, Rubella virus
agggcuugggggccuggg

SEQ ID NO: 3244552 - RNA, 20 nt, Rubella virus
gacacagcgacgcggccugc

SEQ ID NO: 3244553 - RNA, 21 nt, Rubella virus
uccuuaccgcccgccccgaag

SEQ ID NO: 3244554 - RNA, 16 nt, Rubella virus
ugggccuccccgguuu

SEQ ID NO: 3244555 - RNA, 18 nt, Rubella virus
uccacauacgcgcuggac

SEQ ID NO: 3244556 - RNA, 23 nt, Rubella virus
gacuugcuccccagccucggccc

SEQ ID NO: 3244557 - RNA, 12 nt, Rubella virus
ccacucgcuggc

SEQ ID NO: 3244558 - RNA, 18 nt, Rubella virus
gccccgccgccgccgcgg

SEQ ID NO: 3244559 - RNA, 17 nt, Rubella virus
cucuggcucgccacagc

SEQ ID NO: 3244560 - RNA, 18 nt, Rubella virus
gcgcucauguacaacccu

SEQ ID NO: 3244561 - RNA, 17 nt, Rubella virus
aggcacccaccgaggcc

SEQ ID NO: 3244562 - RNA, 20 nt, Rubella virus
uggggccuuccccccuggga

SEQ ID NO: 3244563 - RNA, 14 nt, Rubella virus
gcgacgcggccugc

SEQ ID NO: 3244564 - RNA, 23 nt, Rubella virus
gccgugacuccggagggccccgc

SEQ ID NO: 3244565 - RNA, 16 nt, Rubella virus
gccacugcgccggccc

SEQ ID NO: 3244566 - RNA, 15 nt, Rubella virus
cugguguguggagca

SEQ ID NO: 3244567 - RNA, 18 nt, Rubella virus
gccgcugggacccugcgc

SEQ ID NO: 3244568 - RNA, 14 nt, Rubella virus
caccgacugcugcg

SEQ ID NO: 3244569 - RNA, 23 nt, Rubella virus
ggccccgaagccaucgcgggcgc

SEQ ID NO: 3244570 - RNA, 20 nt, Rubella virus
gggggaggcaauugccaucu

SEQ ID NO: 3244571 - RNA, 17 nt, Rubella virus
ccagugcgcggccucga

SEQ ID NO: 3244572 - RNA, 22 nt, Rubella virus
gucgccguuggcaccgcgcgcg

SEQ ID NO: 3244573 - RNA, 21 nt, Rubella virus
guaccacccuaccgcgugcga

SEQ ID NO: 3244574 - RNA, 18 nt, Rubella virus
gcgcugauauggcggcac

SEQ ID NO: 3244575 - RNA, 20 nt, Rubella virus
cucggcccucuggcucgcca

SEQ ID NO: 3244576 - RNA, 23 nt, Rubella virus
cugugcgcacgggcagcauuacg

SEQ ID NO: 3244577 - RNA, 17 nt, Rubella virus
gcagccccuugcgcgcg

SEQ ID NO: 3244578 - RNA, 15 nt, Rubella virus
uggcaccgcgcgcgc

SEQ ID NO: 3244579 - RNA, 18 nt, Rubella virus
uggcaccgacugcugcgc

SEQ ID NO: 3244580 - RNA, 21 nt, Rubella virus
uggcacacagcgcgcgugcac

SEQ ID NO: 3244581 - RNA, 20 nt, Rubella virus
ccaccaccaucagcugccgu

SEQ ID NO: 3244582 - RNA, 15 nt, Rubella virus
gagagcgaucgcgcg

SEQ ID NO: 3244583 - RNA, 20 nt, Rubella virus
gacggccaucauggcggcac

SEQ ID NO: 3244584 - RNA, 20 nt, Rubella virus
gacuuccgcgucggcggcac

SEQ ID NO: 3244585 - RNA, 15 nt, Rubella virus
gcggccucgacggcg

SEQ ID NO: 3244586 - RNA, 19 nt, Rubella virus
ucaauggcgaggaccucgg

SEQ ID NO: 3244587 - RNA, 14 nt, Rubella virus
uggacccggcgagg

SEQ ID NO: 3244588 - RNA, 13 nt, Rubella virus
ugccgcggcgugc

SEQ ID NO: 3244589 - RNA, 14 nt, Rubella virus
uccgcgucggcggc

SEQ ID NO: 3244590 - RNA, 20 nt, Rubella virus
ugcgcggccucgacggcgac

SEQ ID NO: 3244591 - RNA, 15 nt, Rubella virus
ugcgcgucggccagc

SEQ ID NO: 3244592 - RNA, 17 nt, Rubella virus
uggcgcguggccugcgc

SEQ ID NO: 3244593 - RNA, 15 nt, Rubella virus
uggggccucgggagc

SEQ ID NO: 3244594 - RNA, 16 nt, Rubella virus
ugggguaaaggcgagc

SEQ ID NO: 3244595 - RNA, 17 nt, Rubella virus
ugucgccgccgcggcgc

SEQ ID NO: 3244596 - RNA, 13 nt, Rubella virus
uguccccgugcgc

SEQ ID NO: 3244597 - RNA, 18 nt, Rubella virus
ugcgccuggucgacgccg

SEQ ID NO: 3244598 - RNA, 21 nt, Rubella virus
gugagccccaugggacgcgcg

SEQ ID NO: 3244599 - RNA, 18 nt, Rubella virus
cgcugucucuugaucacg

SEQ ID NO: 3244600 - RNA, 14 nt, Rubella virus
ccuuggcgcauccg

SEQ ID NO: 3244601 - RNA, 16 nt, Rubella virus
ccuccuacgcugccgc

SEQ ID NO: 3244602 - RNA, 16 nt, Rubella virus
cccguucugcaacacg

SEQ ID NO: 3244603 - RNA, 19 nt, Rubella virus
cccgagccgcccgcucacg

SEQ ID NO: 3244604 - RNA, 14 nt, Rubella virus
ccaugggaccucga

SEQ ID NO: 3244605 - RNA, 17 nt, Human
cucucuggccuucggcc

SEQ ID NO: 3244606 - RNA, 19 nt, Human
cucucuggccuucggccuc

SEQ ID NO: 3244607 - RNA, 21 nt, Human
cuccagugagacagcucugca

SEQ ID NO: 3244608 - RNA, 17 nt, Human
cugaaagaggaaugaag

SEQ ID NO: 3244609 - RNA, 13 nt, Human
cugaaagaggaau

SEQ ID NO: 3244610 - RNA, 23 nt, Human
cggagaagagcuguucacagcca

SEQ ID NO: 3244611 - RNA, 24 nt, Human
cggagaagagcuguucacagccag

SEQ ID NO: 3244612 - RNA, 15 nt, Human
cgguuuauauaagcu

SEQ ID NO: 3244613 - RNA, 13 nt, Human
cucaaaacugcac

SEQ ID NO: 3244614 - RNA, 17 nt, Human
cucaccccuugccauaa

SEQ ID NO: 3244615 - RNA, 19 nt, Human
cucagaaaacaaggaugaa

SEQ ID NO: 3244616 - RNA, 23 nt, Human
cucagaaaacaaggaugaauuaa

SEQ ID NO: 3244617 - RNA, 12 nt, Human
cucagaauauug

SEQ ID NO: 3244618 - RNA, 20 nt, Human
cccauauuuguacaccaaua

SEQ ID NO: 3244619 - RNA, 13 nt, Human
cccaacuccagaa

SEQ ID NO: 3244620 - RNA, 12 nt, Human
ccucggagaaga

SEQ ID NO: 3244621 - RNA, 14 nt, Human
ccucggagaagagc

SEQ ID NO: 3244622 - RNA, 16 nt, Human
ccucccuucucuucac

SEQ ID NO: 3244623 - RNA, 17 nt, Human
ccugucucuacuaaaaa

SEQ ID NO: 3244624 - RNA, 20 nt, Human
caauaaaauccauacauuug

SEQ ID NO: 3244625 - RNA, 23 nt, Human
caauaaaauccauacauuugugu

SEQ ID NO: 3244626 - RNA, 12 nt, Human
cacuccagccug

SEQ ID NO: 3244627 - RNA, 13 nt, Human
cacuccagccuga

SEQ ID NO: 3244628 - RNA, 23 nt, Human
cacuccagccugagcgacaguga

SEQ ID NO: 3244629 - RNA, 17 nt, Human
cagaacagugauuacca

SEQ ID NO: 3244630 - RNA, 12 nt, Human
cagaacagugau

SEQ ID NO: 3244631 - RNA, 11 nt, Human
cagaacaguga

SEQ ID NO: 3244632 - RNA, 16 nt, Human
cagaaaguuauugaua

SEQ ID NO: 3244633 - RNA, 11 nt, Human
cagaaaguuau

SEQ ID NO: 3244634 - RNA, 15 nt, Human
cacuuaaaaaugguu

SEQ ID NO: 3244635 - RNA, 22 nt, Human
cacuguuuugaaucucauaauu

SEQ ID NO: 3244636 - RNA, 18 nt, Human
auuaugaauuacauuugu

SEQ ID NO: 3244637 - RNA, 19 nt, Human
auuaugaauuacauuugua

SEQ ID NO: 3244638 - RNA, 20 nt, Human
auuaugaauuacauuuguau

SEQ ID NO: 3244639 - RNA, 14 nt, Human
auuguguugugaau

SEQ ID NO: 3244640 - RNA, 17 nt, Human
auuguguugugaauguu

SEQ ID NO: 3244641 - RNA, 16 nt, Human
auuuaauaaaugugcc

SEQ ID NO: 3244642 - RNA, 20 nt, Human
auuucauaccuaucaucuua

SEQ ID NO: 3244643 - RNA, 16 nt, Human
auuucauaugcuguau

SEQ ID NO: 3244644 - RNA, 20 nt, Human
auuucuaugaaauauuaugu

SEQ ID NO: 3244645 - RNA, 19 nt, Human
caagacccaaaaggcagaa

SEQ ID NO: 3244646 - RNA, 16 nt, Human
caagaugguucuagca

SEQ ID NO: 3244647 - RNA, 13 nt, Human
caagaugguucua

SEQ ID NO: 3244648 - RNA, 21 nt, Human
caaaucuuaacuugaaggagu

SEQ ID NO: 3244649 - RNA, 18 nt, Human
caaagggugaaaauuauu

SEQ ID NO: 3244650 - RNA, 21 nt, Human
auuuuauaucaauuuaaaaaa

SEQ ID NO: 3244651 - RNA, 12 nt, Human
auuuuauaucuu

SEQ ID NO: 3244652 - RNA, 16 nt, Human
auuuuauaucuuguag

SEQ ID NO: 3244653 - RNA, 14 nt, Human
auuuuauaucuugu

SEQ ID NO: 3244654 - RNA, 15 nt, Human
auuuuuauauuugaa

SEQ ID NO: 3244655 - RNA, 16 nt, Human
caaacagucucaggaa

SEQ ID NO: 3244656 - RNA, 17 nt, Human
caaacagucucaggaaa

SEQ ID NO: 3244657 - RNA, 15 nt, Human
caaacagucucagga

SEQ ID NO: 3244658 - RNA, 15 nt, Human
caaaccaaauaaaaa

SEQ ID NO: 3244659 - RNA, 14 nt, Human
caaaccaaauaaaa

SEQ ID NO: 3244660 - RNA, 22 nt, Human
caggaaaucaaauaugcaaagc

SEQ ID NO: 3244661 - RNA, 23 nt, Human
caggaaaucaaauaugcaaagca

SEQ ID NO: 3244662 - RNA, 20 nt, Human
caggaaagagaacuuccaga

SEQ ID NO: 3244663 - RNA, 17 nt, Human
cagcuccccucggagaa

SEQ ID NO: 3244664 - RNA, 18 nt, Human
cagcuccccucggagaag

SEQ ID NO: 3244665 - RNA, 16 nt, Human
cagcuccccucggaga

SEQ ID NO: 3244666 - RNA, 15 nt, Human
cagcccuucuuucca

SEQ ID NO: 3244667 - RNA, 19 nt, Human
cagcccuucuuuccacaga

SEQ ID NO: 3244668 - RNA, 19 nt, Human
cagccugagcgacagugag

SEQ ID NO: 3244669 - RNA, 18 nt, Human
cagccugagcgacaguga

SEQ ID NO: 3244670 - RNA, 20 nt, Human
cagcaguugaaaagacucca

SEQ ID NO: 3244671 - RNA, 21 nt, Human
cagcaguugaaaagacuccaa

SEQ ID NO: 3244672 - RNA, 17 nt, Human
cagcaguugaaaagacu

SEQ ID NO: 3244673 - RNA, 15 nt, Human
cagucucaggaaauc

SEQ ID NO: 3244674 - RNA, 18 nt, Human
cagggaggacgcucucug

SEQ ID NO: 3244675 - RNA, 17 nt, Human
cagggaggacgcucucu

SEQ ID NO: 3244676 - RNA, 18 nt, Human
ccacagaagcuccaggua

SEQ ID NO: 3244677 - RNA, 18 nt, Human
ccaccagucugacuguuu

SEQ ID NO: 3244678 - RNA, 16 nt, Human
ccacagaagcuccagg

SEQ ID NO: 3244679 - RNA, 21 nt, Human
cauuuggagacacaacuauuu

SEQ ID NO: 3244680 - RNA, 19 nt, Human
cauuguaaauaguauuuga

SEQ ID NO: 3244681 - RNA, 12 nt, Human
cauuaucucaaa

SEQ ID NO: 3244682 - RNA, 13 nt, Human
cauuaucucaaaa

SEQ ID NO: 3244683 - RNA, 13 nt, Human
cauaauuuauaca

SEQ ID NO: 3244684 - RNA, 20 nt, Human
cauaauuuauacaggucaua

SEQ ID NO: 3244685 - RNA, 16 nt, Human
gaacccaaguccaagc

SEQ ID NO: 3244686 - RNA, 17 nt, Human
gaacccaaguccaagca

SEQ ID NO: 3244687 - RNA, 17 nt, Human
gaacccgggaggcagag

SEQ ID NO: 3244688 - RNA, 23 nt, Human
gaaaauuauuuuguucauacaua

SEQ ID NO: 3244689 - RNA, 16 nt, Human
gaaaagacuccaaaga

SEQ ID NO: 3244690 - RNA, 17 nt, Human
gaaaagacuccaaagaa

SEQ ID NO: 3244691 - RNA, 14 nt, Human
gaaaagacuccaaa

SEQ ID NO: 3244692 - RNA, 22 nt, Human
gaaaauuauuuuguucauacau

SEQ ID NO: 3244693 - RNA, 21 nt, Human
gaaaauuauuuuguucauaca

SEQ ID NO: 3244694 - RNA, 20 nt, Human
gaaaauuauuuuguucauac

SEQ ID NO: 3244695 - RNA, 18 nt, Human
gaaagaaaaucaggcugg

SEQ ID NO: 3244696 - RNA, 16 nt, Human
cuuggucugugagaug

SEQ ID NO: 3244697 - RNA, 19 nt, Human
cuuggucugugagaugcua

SEQ ID NO: 3244698 - RNA, 13 nt, Human
cuucuaaguaaaa

SEQ ID NO: 3244699 - RNA, 17 nt, Human
cuucuaaguaaaaccac

SEQ ID NO: 3244700 - RNA, 21 nt, Human
cuucuaaguaaaaccacagca

SEQ ID NO: 3244701 - RNA, 20 nt, Human
cuucucacauuuauauuuuu

SEQ ID NO: 3244702 - RNA, 13 nt, Human
cuucucacauuua

SEQ ID NO: 3244703 - RNA, 13 nt, Human
cuguuauaaucuu

SEQ ID NO: 3244704 - RNA, 21 nt, Human
cuuaaaaaugguuuaaauggu

SEQ ID NO: 3244705 - RNA, 18 nt, Human
gcaauagucaaauugugu

SEQ ID NO: 3244706 - RNA, 15 nt, Human
gcagcuuauucacaa

SEQ ID NO: 3244707 - RNA, 22 nt, Human
gcaguugaaaagacuccaaaga

SEQ ID NO: 3244708 - RNA, 16 nt, Human
gcauuguaaaugugcu

SEQ ID NO: 3244709 - RNA, 18 nt, Human
gcauggcauauuuuucac

SEQ ID NO: 3244710 - RNA, 15 nt, Human
gagcgacagugagac

SEQ ID NO: 3244711 - RNA, 13 nt, Human
gagcgacagugag

SEQ ID NO: 3244712 - RNA, 20 nt, Human
gacagaaagcagaacaguga

SEQ ID NO: 3244713 - RNA, 21 nt, Human
gacagcccuucuuuccacaga

SEQ ID NO: 3244714 - RNA, 14 nt, Human
gacagaaagcagaa

SEQ ID NO: 3244715 - RNA, 17 nt, Human
gacgcucucuggccuuc

SEQ ID NO: 3244716 - RNA, 15 nt, Human
gacuauucaaacagu

SEQ ID NO: 3244717 - RNA, 16 nt, Human
gacuauucaaacaguc

SEQ ID NO: 3244718 - RNA, 14 nt, Human
ggcuccacuugguc

SEQ ID NO: 3244719 - RNA, 14 nt, Human
aaaaccacagcagu

SEQ ID NO: 3244720 - RNA, 17 nt, Human
aaaaaugguuuaaaugg

SEQ ID NO: 3244721 - RNA, 15 nt, Human
aaaacuucagacaua

SEQ ID NO: 3244722 - RNA, 21 nt, Human
aaaagauuuucagaaaauauu

SEQ ID NO: 3244723 - RNA, 14 nt, Human
aaaaauaacaauga

SEQ ID NO: 3244724 - RNA, 20 nt, Human
gggaacccaaguccaagcau

SEQ ID NO: 3244725 - RNA, 22 nt, Human
gggacagucaccucauggaauu

SEQ ID NO: 3244726 - RNA, 20 nt, Human
gggacagucaccucauggaa

SEQ ID NO: 3244727 - RNA, 21 nt, Human
gggacagucaccucauggaau

SEQ ID NO: 3244728 - RNA, 13 nt, Human
ggccuccauccug

SEQ ID NO: 3244729 - RNA, 15 nt, Human
ggccuccauccugag

SEQ ID NO: 3244730 - RNA, 14 nt, Human
ggccuccauccuga

SEQ ID NO: 3244731 - RNA, 21 nt, Human
ggcacaguuuucugagaaaga

SEQ ID NO: 3244732 - RNA, 14 nt, Human
aaauaaaaauauug

SEQ ID NO: 3244733 - RNA, 18 nt, Human
aaaguauguuagugcaaa

SEQ ID NO: 3244734 - RNA, 20 nt, Human
aaagguauuuuaaucaccaa

SEQ ID NO: 3244735 - RNA, 17 nt, Human
aaaguauguuagugcaa

SEQ ID NO: 3244736 - RNA, 23 nt, Human
aaaguucugcagauaaacaguag

SEQ ID NO: 3244737 - RNA, 22 nt, Human
aaauaauuuuuauauuugaaau

SEQ ID NO: 3244738 - RNA, 23 nt, Human
aaauaauuuuuauauuugaaaua

SEQ ID NO: 3244739 - RNA, 15 nt, Human
aaauacacacucaaa

SEQ ID NO: 3244740 - RNA, 21 nt, Human
aaauaauuuuuauauuugaaa

SEQ ID NO: 3244741 - RNA, 19 nt, Human
aaauacacacucaaaucaa

SEQ ID NO: 3244742 - RNA, 19 nt, Human
guaauagagcaaaauugau

SEQ ID NO: 3244743 - RNA, 20 nt, Human
guaauaggcguaacuaauuu

SEQ ID NO: 3244744 - RNA, 15 nt, Human
guaauaacugugaag

SEQ ID NO: 3244745 - RNA, 16 nt, Human
guaauaacugugaagu

SEQ ID NO: 3244746 - RNA, 22 nt, Human
guaauaacugugaaguuuacau

SEQ ID NO: 3244747 - RNA, 15 nt, Human
aaauccauacauuug

SEQ ID NO: 3244748 - RNA, 15 nt, Human
guacauuuggagaca

SEQ ID NO: 3244749 - RNA, 12 nt, Human
aaaucauuucug

SEQ ID NO: 3244750 - RNA, 19 nt, Human
aaaucauuucugcaucagc

SEQ ID NO: 3244751 - RNA, 21 nt, Human
aaaucauuucugcaucagcug

SEQ ID NO: 3244752 - RNA, 22 nt, Human
aaaucauuucugcaucagcugc

SEQ ID NO: 3244753 - RNA, 23 nt, Human
aaaucauuucugcaucagcugcu

SEQ ID NO: 3244754 - RNA, 11 nt, Human
aaaucauuucu

SEQ ID NO: 3244755 - RNA, 14 nt, Human
aaauauuauguguu

SEQ ID NO: 3244756 - RNA, 17 nt, Human
aaauauuauguuaaaac

SEQ ID NO: 3244757 - RNA, 15 nt, Human
aaauauuauguguuu

SEQ ID NO: 3244758 - RNA, 14 nt, Human
guacuuaacuauuc

SEQ ID NO: 3244759 - RNA, 21 nt, Human
guacuucaaauccuugaagau

SEQ ID NO: 3244760 - RNA, 22 nt, Human
guacuucaaauccuugaagauu

SEQ ID NO: 3244761 - RNA, 12 nt, Human
aaacacagcaag

SEQ ID NO: 3244762 - RNA, 14 nt, Human
aaacacagcaaggg

SEQ ID NO: 3244763 - RNA, 11 nt, Human
aaacacagcaa

SEQ ID NO: 3244764 - RNA, 15 nt, Human
aaacagucucaggaa

SEQ ID NO: 3244765 - RNA, 14 nt, Human
aaacaguagugaua

SEQ ID NO: 3244766 - RNA, 19 nt, Human
ggggaauugaggacacuga

SEQ ID NO: 3244767 - RNA, 15 nt, Human
aaacucguuaauuug

SEQ ID NO: 3244768 - RNA, 12 nt, Human
aaaccacagcag

SEQ ID NO: 3244769 - RNA, 15 nt, Human
aaagaggaaugaagu

SEQ ID NO: 3244770 - RNA, 15 nt, Human
aaagacuccaaagaa

SEQ ID NO: 3244771 - RNA, 21 nt, Human
aaagacuccaaagaaauguaa

SEQ ID NO: 3244772 - RNA, 14 nt, Human
aaagacuccaaaga

SEQ ID NO: 3244773 - RNA, 18 nt, Human
aaagacuauucaaacagu

SEQ ID NO: 3244774 - RNA, 19 nt, Human
aaagacuauucaaacaguc

SEQ ID NO: 3244775 - RNA, 17 nt, Human
aaagacuauucaaacag

SEQ ID NO: 3244776 - RNA, 22 nt, Human
aaagaccuuuggagcaaagcug

SEQ ID NO: 3244777 - RNA, 13 nt, Human
aaagacagugaaa

SEQ ID NO: 3244778 - RNA, 23 nt, Human
aaacuucagcgguuuauauaagc

SEQ ID NO: 3244779 - RNA, 19 nt, Human
aaacuucagacauagaauu

SEQ ID NO: 3244780 - RNA, 17 nt, Human
aaagcacugacuucuaa

SEQ ID NO: 3244781 - RNA, 21 nt, Human
aaagcacugacuucuaaguaa

SEQ ID NO: 3244782 - RNA, 17 nt, Human
aaagggugaaaauuauu

SEQ ID NO: 3244783 - RNA, 14 nt, Human
aaagguacuucaaa

SEQ ID NO: 3244784 - RNA, 22 nt, Human
ggugaaaauuauuuuguucaua

SEQ ID NO: 3244785 - RNA, 14 nt, Human
ggugaaaauuauuu

SEQ ID NO: 3244786 - RNA, 13 nt, Human
ggugaaaauuauu

SEQ ID NO: 3244787 - RNA, 13 nt, Human
ggagaaacuggaa

SEQ ID NO: 3244788 - RNA, 22 nt, Human
ggacucauuuuaaaaaauggaa

SEQ ID NO: 3244789 - RNA, 15 nt, Human
gccucuuagaugcag

SEQ ID NO: 3244790 - RNA, 21 nt, Human
gccuucggccuccauccugag

SEQ ID NO: 3244791 - RNA, 19 nt, Human
gccuucggccuccauccug

SEQ ID NO: 3244792 - RNA, 20 nt, Human
gccuucggccuccauccuga

SEQ ID NO: 3244793 - RNA, 15 nt, Human
gcuccacuuggucug

SEQ ID NO: 3244794 - RNA, 18 nt, Human
gcuccacuuggucuguga

SEQ ID NO: 3244795 - RNA, 21 nt, Human
gcuccccucggagaagagcug

SEQ ID NO: 3244796 - RNA, 18 nt, Human
gcuccccucggagaagag

SEQ ID NO: 3244797 - RNA, 15 nt, Human
gcuagaacucccuuu

SEQ ID NO: 3244798 - RNA, 14 nt, Human
gcuagaacucccuu

SEQ ID NO: 3244799 - RNA, 13 nt, Human
gcuagaacucccu

SEQ ID NO: 3244800 - RNA, 12 nt, Human
gcuagaacuccc

SEQ ID NO: 3244801 - RNA, 16 nt, Human
gcuagaacucccuuuc

SEQ ID NO: 3244802 - RNA, 15 nt, Human
aaugaaugaaugaau

SEQ ID NO: 3244803 - RNA, 20 nt, Human
aaugaauacuuuauaaagga

SEQ ID NO: 3244804 - RNA, 17 nt, Human
uaauguaauaacuguga

SEQ ID NO: 3244805 - RNA, 17 nt, Human
uaaucagugugucuaaa

SEQ ID NO: 3244806 - RNA, 18 nt, Human
uaaucagugugucuaaau

SEQ ID NO: 3244807 - RNA, 16 nt, Human
uacaaaaacacagcaa

SEQ ID NO: 3244808 - RNA, 17 nt, Human
uacaaaaacacagcaag

SEQ ID NO: 3244809 - RNA, 18 nt, Human
uacaaaaacacagcaagg

SEQ ID NO: 3244810 - RNA, 16 nt, Human
aaugguuuaaaugguc

SEQ ID NO: 3244811 - RNA, 19 nt, Human
uacauaaguaauucaagaa

SEQ ID NO: 3244812 - RNA, 15 nt, Human
uacauaaguaauuca

SEQ ID NO: 3244813 - RNA, 16 nt, Human
uacauaaguaauucaa

SEQ ID NO: 3244814 - RNA, 17 nt, Human
uacauaaguaauucaag

SEQ ID NO: 3244815 - RNA, 18 nt, Human
aauguugacaugggacau

SEQ ID NO: 3244816 - RNA, 22 nt, Human
aauuaaauuuugaguucuacau

SEQ ID NO: 3244817 - RNA, 23 nt, Human
uacauuguacgaagaguauuuuu

SEQ ID NO: 3244818 - RNA, 22 nt, Human
uacauuguacgaagaguauuuu

SEQ ID NO: 3244819 - RNA, 20 nt, Human
uacauuguacgaagaguauu

SEQ ID NO: 3244820 - RNA, 21 nt, Human
uacuucaaauccuugaagauu

SEQ ID NO: 3244821 - RNA, 18 nt, Human
uagaacucccuuucaaca

SEQ ID NO: 3244822 - RNA, 19 nt, Human
aauuuuuauauuugaaaua

SEQ ID NO: 3244823 - RNA, 19 nt, Human
aauuuuuucucuaggaaau

SEQ ID NO: 3244824 - RNA, 16 nt, Human
acaaaaacacagcaag

SEQ ID NO: 3244825 - RNA, 20 nt, Human
acaaaaaaauauauuuaaug

SEQ ID NO: 3244826 - RNA, 13 nt, Human
acaaaaaaauaua

SEQ ID NO: 3244827 - RNA, 17 nt, Human
acaaaaaaauauauuua

SEQ ID NO: 3244828 - RNA, 22 nt, Human
acaagaaaugaaagcagggacu

SEQ ID NO: 3244829 - RNA, 18 nt, Human
acaagcacuaaacaaaga

SEQ ID NO: 3244830 - RNA, 18 nt, Human
uagcaugucgucaaagcu

SEQ ID NO: 3244831 - RNA, 21 nt, Human
uagcaugucgucaaagcugaa

SEQ ID NO: 3244832 - RNA, 16 nt, Human
uagaugcaguucugaa

SEQ ID NO: 3244833 - RNA, 17 nt, Human
uagaugcaguucugaag

SEQ ID NO: 3244834 - RNA, 19 nt, Human
uagaugcaguucugaagaa

SEQ ID NO: 3244835 - RNA, 23 nt, Human
aauugugugaaagguacuucaaa

SEQ ID NO: 3244836 - RNA, 14 nt, Human
uacuucaaauccuu

SEQ ID NO: 3244837 - RNA, 19 nt, Human
uacuucaaauccuugaaga

SEQ ID NO: 3244838 - RNA, 20 nt, Human
aauuucucccagucauuuaa

SEQ ID NO: 3244839 - RNA, 19 nt, Human
aauuucucccagucauuua

SEQ ID NO: 3244840 - RNA, 15 nt, Human
aauucuugaaggaaa

SEQ ID NO: 3244841 - RNA, 16 nt, Human
aauucuugaaggaaaa

SEQ ID NO: 3244842 - RNA, 21 nt, Human
aauucuugaaggaaaaugaua

SEQ ID NO: 3244843 - RNA, 21 nt, Human
aauucuugccaaauauaaaua

SEQ ID NO: 3244844 - RNA, 19 nt, Human
aauugacccacaagaaaug

SEQ ID NO: 3244845 - RNA, 16 nt, Human
aauugacccacaagaa

SEQ ID NO: 3244846 - RNA, 13 nt, Human
aauugacccacaa

SEQ ID NO: 3244847 - RNA, 17 nt, Human
uauugucuagugaaacu

SEQ ID NO: 3244848 - RNA, 18 nt, Human
uauuuauuuuaauaaugu

SEQ ID NO: 3244849 - RNA, 14 nt, Human
uauuuauuuuaaua

SEQ ID NO: 3244850 - RNA, 16 nt, Human
uauuuauuuuaauaau

SEQ ID NO: 3244851 - RNA, 19 nt, Human
uauuuaaugauaaguaaau

SEQ ID NO: 3244852 - RNA, 23 nt, Human
acaguucggugagcuacaaaugc

SEQ ID NO: 3244853 - RNA, 22 nt, Human
acaguucggugagcuacaaaug

SEQ ID NO: 3244854 - RNA, 19 nt, Human
acaguucggugagcuacaa

SEQ ID NO: 3244855 - RNA, 21 nt, Human
acaguauggcagcuuuccuca

SEQ ID NO: 3244856 - RNA, 18 nt, Human
acagugagacucugucuc

SEQ ID NO: 3244857 - RNA, 14 nt, Human
acagugagacucug

SEQ ID NO: 3244858 - RNA, 21 nt, Human
acaguuaccucugccucagaa

SEQ ID NO: 3244859 - RNA, 13 nt, Human
acagucucaggaa

SEQ ID NO: 3244860 - RNA, 14 nt, Human
acagucucaggaaa

SEQ ID NO: 3244861 - RNA, 15 nt, Human
acagucucaggaaau

SEQ ID NO: 3244862 - RNA, 16 nt, Human
acagucucaggaaauc

SEQ ID NO: 3244863 - RNA, 17 nt, Human
acagucucaggaaauca

SEQ ID NO: 3244864 - RNA, 20 nt, Human
acagugaaagaaaauaacaa

SEQ ID NO: 3244865 - RNA, 15 nt, Human
uauuagaauaccaca

SEQ ID NO: 3244866 - RNA, 23 nt, Human
uauucauagcagcuuauucacaa

SEQ ID NO: 3244867 - RNA, 16 nt, Human
uauucaggagaguaga

SEQ ID NO: 3244868 - RNA, 12 nt, Human
uauuaaaacuca

SEQ ID NO: 3244869 - RNA, 14 nt, Human
uauauuuacaaaug

SEQ ID NO: 3244870 - RNA, 15 nt, Human
uauauuuacaaaugg

SEQ ID NO: 3244871 - RNA, 14 nt, Human
uaucuaguaugaaa

SEQ ID NO: 3244872 - RNA, 17 nt, Human
uaucuaguaugaaauua

SEQ ID NO: 3244873 - RNA, 16 nt, Human
uaucuaguaugaaauu

SEQ ID NO: 3244874 - RNA, 18 nt, Human
uaugagcuuccuucugug

SEQ ID NO: 3244875 - RNA, 21 nt, Human
uaugagcuuccuucugugaaa

SEQ ID NO: 3244876 - RNA, 16 nt, Human
uauggcuauaggugcu

SEQ ID NO: 3244877 - RNA, 17 nt, Human
uauggcuauaggugcua

SEQ ID NO: 3244878 - RNA, 22 nt, Human
acacaucagcuugcccuguuaa

SEQ ID NO: 3244879 - RNA, 21 nt, Human
uauaaaauaauuuuuauauuu

SEQ ID NO: 3244880 - RNA, 22 nt, Human
uauaaaauaauuuuuauauuug

SEQ ID NO: 3244881 - RNA, 22 nt, Human
uagugagcagucaggaaagaga

SEQ ID NO: 3244882 - RNA, 15 nt, Human
uaguuuuauaugcuu

SEQ ID NO: 3244883 - RNA, 16 nt, Human
uaguuuuauaugcuuc

SEQ ID NO: 3244884 - RNA, 12 nt, Human
uauaggaauuga

SEQ ID NO: 3244885 - RNA, 13 nt, Human
uauaggaauugac

SEQ ID NO: 3244886 - RNA, 14 nt, Human
uauaggaauugacc

SEQ ID NO: 3244887 - RNA, 21 nt, Human
uauaggugcuacaaaaacaca

SEQ ID NO: 3244888 - RNA, 20 nt, Human
uauaggugcuacaaaaacac

SEQ ID NO: 3244889 - RNA, 23 nt, Human
uauaggugcuacaaaaacacagc

SEQ ID NO: 3244890 - RNA, 16 nt, Human
uauauccuuucuaaca

SEQ ID NO: 3244891 - RNA, 21 nt, Human
uauacaggucauauuaauaua

SEQ ID NO: 3244892 - RNA, 14 nt, Human
uauaauuuugugaa

SEQ ID NO: 3244893 - RNA, 18 nt, Human
uauaacaaugcuguauuu

SEQ ID NO: 3244894 - RNA, 19 nt, Human
aagauguagaggagaaacu

SEQ ID NO: 3244895 - RNA, 13 nt, Human
aagcaaaauguga

SEQ ID NO: 3244896 - RNA, 22 nt, Human
aagauguagaggagaaacugga

SEQ ID NO: 3244897 - RNA, 19 nt, Human
aagcaaaauuuuuucucua

SEQ ID NO: 3244898 - RNA, 16 nt, Human
aagcaaguauuagaau

SEQ ID NO: 3244899 - RNA, 13 nt, Human
aagacuauucaaa

SEQ ID NO: 3244900 - RNA, 14 nt, Human
aagacuauucaaac

SEQ ID NO: 3244901 - RNA, 14 nt, Human
aagacuccaaagaa

SEQ ID NO: 3244902 - RNA, 16 nt, Human
aagacuccaaagaaau

SEQ ID NO: 3244903 - RNA, 17 nt, Human
aagacuccaaagaaaug

SEQ ID NO: 3244904 - RNA, 17 nt, Human
aagacugcauuauauuu

SEQ ID NO: 3244905 - RNA, 18 nt, Human
aagagcuguucacagcca

SEQ ID NO: 3244906 - RNA, 14 nt, Human
guggguagacacac

SEQ ID NO: 3244907 - RNA, 22 nt, Human
aagaagcaccaaucaugaauua

SEQ ID NO: 3244908 - RNA, 13 nt, Human
aagaaaauaucac

SEQ ID NO: 3244909 - RNA, 13 nt, Human
aagacccaaaagg

SEQ ID NO: 3244910 - RNA, 13 nt, Human
aagaauauuuuaa

SEQ ID NO: 3244911 - RNA, 13 nt, Human
gucuucacaacag

SEQ ID NO: 3244912 - RNA, 13 nt, Human
aacugaaaucaua

SEQ ID NO: 3244913 - RNA, 20 nt, Human
aacugaaaucauacuucuua

SEQ ID NO: 3244914 - RNA, 13 nt, Human
aacuauauuguuu

SEQ ID NO: 3244915 - RNA, 20 nt, Human
aacuaucucauuuccaagca

SEQ ID NO: 3244916 - RNA, 16 nt, Human
gugaagugaaugaaac

SEQ ID NO: 3244917 - RNA, 23 nt, Human
guccaugaagauguagaggagaa

SEQ ID NO: 3244918 - RNA, 19 nt, Human
aacagauuauuaccuuaca

SEQ ID NO: 3244919 - RNA, 19 nt, Human
aacagucucaggaaaucaa

SEQ ID NO: 3244920 - RNA, 14 nt, Human
aacagucucaggaa

SEQ ID NO: 3244921 - RNA, 17 nt, Human
aacagucucaggaaauc

SEQ ID NO: 3244922 - RNA, 16 nt, Human
aacauauauaacaaug

SEQ ID NO: 3244923 - RNA, 12 nt, Human
aacauaauuaaa

SEQ ID NO: 3244924 - RNA, 23 nt, Human
gucucaguccaugaagauguaga

SEQ ID NO: 3244925 - RNA, 12 nt, Human
aaccacagcagu

SEQ ID NO: 3244926 - RNA, 18 nt, Human
uaaaccucaaaaugucua

SEQ ID NO: 3244927 - RNA, 19 nt, Human
uaaaccucaaaaugucuaa

SEQ ID NO: 3244928 - RNA, 19 nt, Human
uaaaccaaggcuagaacca

SEQ ID NO: 3244929 - RNA, 15 nt, Human
aaguucauacauugu

SEQ ID NO: 3244930 - RNA, 13 nt, Human
aaguucauacauu

SEQ ID NO: 3244931 - RNA, 12 nt, Human
aaguucauacau

SEQ ID NO: 3244932 - RNA, 23 nt, Human
aaguuauugauaaguucauacau

SEQ ID NO: 3244933 - RNA, 22 nt, Human
aaguuauugauaaguucauaca

SEQ ID NO: 3244934 - RNA, 18 nt, Human
aaguuuacauuguaaaua

SEQ ID NO: 3244935 - RNA, 19 nt, Human
aaguuuacauuguaaauag

SEQ ID NO: 3244936 - RNA, 20 nt, Human
aaguuauugauaaguucaua

SEQ ID NO: 3244937 - RNA, 19 nt, Human
aaguuauugauaaguucau

SEQ ID NO: 3244938 - RNA, 22 nt, Human
aauaaaauccauacauuugugu

SEQ ID NO: 3244939 - RNA, 22 nt, Human
aauaaaaauauuguguugugaa

SEQ ID NO: 3244940 - RNA, 12 nt, Human
aauaaaaauaau

SEQ ID NO: 3244941 - RNA, 19 nt, Human
aauaauguuucaaacauau

SEQ ID NO: 3244942 - RNA, 12 nt, Human
aauaaaugugcc

SEQ ID NO: 3244943 - RNA, 21 nt, Human
aauaaaugugccuucauuuuu

SEQ ID NO: 3244944 - RNA, 15 nt, Human
aauaacaauaaaaga

SEQ ID NO: 3244945 - RNA, 15 nt, Human
aauaacgauaaaaga

SEQ ID NO: 3244946 - RNA, 14 nt, Human
aauacacacucaaa

SEQ ID NO: 3244947 - RNA, 18 nt, Human
uaaauaguauuugagagu

SEQ ID NO: 3244948 - RNA, 17 nt, Human
uaaaugauuucauucaa

SEQ ID NO: 3244949 - RNA, 15 nt, Human
uaaauguugacaugg

SEQ ID NO: 3244950 - RNA, 13 nt, Human
uaacaaugcugua

SEQ ID NO: 3244951 - RNA, 15 nt, Human
uaacaaugcuguauu

SEQ ID NO: 3244952 - RNA, 17 nt, Human
uaacaaugcuguauuuu

SEQ ID NO: 3244953 - RNA, 20 nt, Human
uaacaaaaaaauauauuuaa

SEQ ID NO: 3244954 - RNA, 23 nt, Human
uaacaaaaaaauauauuuaauga

SEQ ID NO: 3244955 - RNA, 16 nt, Human
uaaauuuugaguucua

SEQ ID NO: 3244956 - RNA, 14 nt, Human
uaaauuuuauaucu

SEQ ID NO: 3244957 - RNA, 23 nt, Human
guuuuuuuuuaaaaaagaaacau

SEQ ID NO: 3244958 - RNA, 22 nt, Human
guuuucugagaaagacuauuca

SEQ ID NO: 3244959 - RNA, 16 nt, Human
guuuucugagaaagac

SEQ ID NO: 3244960 - RNA, 17 nt, Human
guuuucugagaaagacu

SEQ ID NO: 3244961 - RNA, 23 nt, Human
aaguauguuagugcaaauuguca

SEQ ID NO: 3244962 - RNA, 21 nt, Human
aaguauguuagugcaaauugu

SEQ ID NO: 3244963 - RNA, 15 nt, Human
aaguauucuaaauuu

SEQ ID NO: 3244964 - RNA, 13 nt, Human
aaguauucuaaau

SEQ ID NO: 3244965 - RNA, 15 nt, Human
guuuucugagaaaga

SEQ ID NO: 3244966 - RNA, 15 nt, Human
guuuuauaauuuugu

SEQ ID NO: 3244967 - RNA, 22 nt, Human
guuuuauaauuuugugaagcaa

SEQ ID NO: 3244968 - RNA, 21 nt, Human
aagggugaugggaaagcauug

SEQ ID NO: 3244969 - RNA, 19 nt, Human
aagggugaugggaaagcau

SEQ ID NO: 3244970 - RNA, 15 nt, Human
aaguaaaaccacagc

SEQ ID NO: 3244971 - RNA, 16 nt, Human
aaguaaaaccacagca

SEQ ID NO: 3244972 - RNA, 14 nt, Human
aaguaaaaccacag

SEQ ID NO: 3244973 - RNA, 17 nt, Human
aaguaaaaccacagcag

SEQ ID NO: 3244974 - RNA, 18 nt, Human
aaguaaaaccacagcagu

SEQ ID NO: 3244975 - RNA, 16 nt, Human
aaggaaaaaauaacaa

SEQ ID NO: 3244976 - RNA, 14 nt, Human
aaggaucuucaucu

SEQ ID NO: 3244977 - RNA, 14 nt, Human
aaggaaaaugauac

SEQ ID NO: 3244978 - RNA, 12 nt, Human
aaggaaaaugau

SEQ ID NO: 3244979 - RNA, 22 nt, Human
acugaggggaggggagcauggg

SEQ ID NO: 3244980 - RNA, 17 nt, Human
acugaggggaggggagc

SEQ ID NO: 3244981 - RNA, 20 nt, Human
acugccuucucaacuccaaa

SEQ ID NO: 3244982 - RNA, 22 nt, Human
acugccuucucaacuccaaacu

SEQ ID NO: 3244983 - RNA, 21 nt, Human
acuggcacaguuuucugagaa

SEQ ID NO: 3244984 - RNA, 22 nt, Human
acuggcacaguuuucugagaaa

SEQ ID NO: 3244985 - RNA, 13 nt, Human
uccuucagccuga

SEQ ID NO: 3244986 - RNA, 13 nt, Human
acuaaaaauacaa

SEQ ID NO: 3244987 - RNA, 15 nt, Human
ucccagugaauucuu

SEQ ID NO: 3244988 - RNA, 20 nt, Human
uccucaaaacuucagacaua

SEQ ID NO: 3244989 - RNA, 21 nt, Human
acuccaaagaaauguaaggga

SEQ ID NO: 3244990 - RNA, 14 nt, Human
accagggacugagg

SEQ ID NO: 3244991 - RNA, 15 nt, Human
acccaaaaggcagaa

SEQ ID NO: 3244992 - RNA, 13 nt, Human
acccaaaaggcag

SEQ ID NO: 3244993 - RNA, 20 nt, Human
acccaaauguucaucaauga

SEQ ID NO: 3244994 - RNA, 18 nt, Human
acccaaaaggcagaagca

SEQ ID NO: 3244995 - RNA, 21 nt, Human
acccaaauguucaucaaugaa

SEQ ID NO: 3244996 - RNA, 11 nt, Human
accacagcagu

SEQ ID NO: 3244997 - RNA, 12 nt, Human
uauuucauuucu

SEQ ID NO: 3244998 - RNA, 18 nt, Human
accacuuguguuuugcaa

SEQ ID NO: 3244999 - RNA, 19 nt, Human
accacugcagaagacagua

SEQ ID NO: 3245000 - RNA, 14 nt, Human
accacugcagaaga

SEQ ID NO: 3245001 - RNA, 13 nt, Human
accacugcagaag

SEQ ID NO: 3245002 - RNA, 14 nt, Human
ucaccucauggaau

SEQ ID NO: 3245003 - RNA, 19 nt, Human
accacuuguguuuugcaag

SEQ ID NO: 3245004 - RNA, 23 nt, Human
accacuuguguuuugcaagccag

SEQ ID NO: 3245005 - RNA, 19 nt, Human
ucauauuaauauauuucca

SEQ ID NO: 3245006 - RNA, 22 nt, Human
ucaugaauuaguuuuauaugcu

SEQ ID NO: 3245007 - RNA, 21 nt, Human
ucaugaauuaguuuuauaugc

SEQ ID NO: 3245008 - RNA, 20 nt, Human
uccagccugagcgacaguga

SEQ ID NO: 3245009 - RNA, 21 nt, Human
uccagccugagcgacagugag

SEQ ID NO: 3245010 - RNA, 18 nt, Human
accuuuggagcaaagcug

SEQ ID NO: 3245011 - RNA, 15 nt, Human
ucucccagucauuua

SEQ ID NO: 3245012 - RNA, 22 nt, Human
acuuuuuauggcacuaguauuu

SEQ ID NO: 3245013 - RNA, 13 nt, Human
ucucuucuuuaaa

SEQ ID NO: 3245014 - RNA, 12 nt, Human
ucucuucuuuaa

SEQ ID NO: 3245015 - RNA, 17 nt, Human
ucucuggccuucggccu

SEQ ID NO: 3245016 - RNA, 16 nt, Human
ucucuggccuucggcc

SEQ ID NO: 3245017 - RNA, 13 nt, Human
ucucuggccuucg

SEQ ID NO: 3245018 - RNA, 13 nt, Human
agaaacuggaacu

SEQ ID NO: 3245019 - RNA, 14 nt, Human
agaaagaaaaucag

SEQ ID NO: 3245020 - RNA, 15 nt, Human
agaaacauuugguaa

SEQ ID NO: 3245021 - RNA, 16 nt, Human
agaaaacaaggaugaa

SEQ ID NO: 3245022 - RNA, 19 nt, Human
agaaaacaaggaugaauua

SEQ ID NO: 3245023 - RNA, 21 nt, Human
ucugagaaagacuauucaaac

SEQ ID NO: 3245024 - RNA, 22 nt, Human
ucugagaaagacuauucaaaca

SEQ ID NO: 3245025 - RNA, 23 nt, Human
ucugagaaagacuauucaaacag

SEQ ID NO: 3245026 - RNA, 19 nt, Human
agaaagacuauucaaacag

SEQ ID NO: 3245027 - RNA, 18 nt, Human
agaaagacuauucaaaca

SEQ ID NO: 3245028 - RNA, 20 nt, Human
agaaagacuauucaaacagu

SEQ ID NO: 3245029 - RNA, 14 nt, Human
ucugagaaagacua

SEQ ID NO: 3245030 - RNA, 15 nt, Human
ucugagaaagacuau

SEQ ID NO: 3245031 - RNA, 19 nt, Human
ucugagaaagacuauucaa

SEQ ID NO: 3245032 - RNA, 20 nt, Human
ucugagaaagacuauucaaa

SEQ ID NO: 3245033 - RNA, 21 nt, Human
ucugacuguuuccaucaaggg

SEQ ID NO: 3245034 - RNA, 14 nt, Human
agaacucccuuuca

SEQ ID NO: 3245035 - RNA, 21 nt, Human
agaagaacugaaaucauacuu

SEQ ID NO: 3245036 - RNA, 15 nt, Human
ucuucacaacagauu

SEQ ID NO: 3245037 - RNA, 18 nt, Human
ucuuaauuaaaagaauau

SEQ ID NO: 3245038 - RNA, 21 nt, Human
ucuuaauuaaaagaauauuuu

SEQ ID NO: 3245039 - RNA, 14 nt, Human
ucuuaauuaaaaga

SEQ ID NO: 3245040 - RNA, 18 nt, Human
ucuguuuuauaauuuugu

SEQ ID NO: 3245041 - RNA, 21 nt, Human
agacuauucaaacagucucag

SEQ ID NO: 3245042 - RNA, 18 nt, Human
agacuauucaaacagucu

SEQ ID NO: 3245043 - RNA, 20 nt, Human
agacuauucaaacagucuca

SEQ ID NO: 3245044 - RNA, 12 nt, Human
agacuccaaaga

SEQ ID NO: 3245045 - RNA, 13 nt, Human
agacuccaaagaa

SEQ ID NO: 3245046 - RNA, 14 nt, Human
agacuccaaagaaa

SEQ ID NO: 3245047 - RNA, 16 nt, Human
agacuauucaaacagu

SEQ ID NO: 3245048 - RNA, 16 nt, Human
agacuccaaagaaaug

SEQ ID NO: 3245049 - RNA, 19 nt, Human
agacuccaaagaaauguaa

SEQ ID NO: 3245050 - RNA, 21 nt, Human
ucuuuaaagggauggcaagau

SEQ ID NO: 3245051 - RNA, 17 nt, Human
ucuuuaaaauacacacu

SEQ ID NO: 3245052 - RNA, 18 nt, Human
agagacacacugaagaag

SEQ ID NO: 3245053 - RNA, 20 nt, Human
agagacacacugaagaagca

SEQ ID NO: 3245054 - RNA, 15 nt, Human
agagaaugagagaca

SEQ ID NO: 3245055 - RNA, 17 nt, Human
agagacacacugaagaa

SEQ ID NO: 3245056 - RNA, 14 nt, Human
agacuggcacaguu

SEQ ID NO: 3245057 - RNA, 15 nt, Human
agacuggcacaguuu

SEQ ID NO: 3245058 - RNA, 22 nt, Human
agagugaacaaauuuacagaga

SEQ ID NO: 3245059 - RNA, 14 nt, Human
agagugaacaaauu

SEQ ID NO: 3245060 - RNA, 19 nt, Human
agauaaucagugugucuaa

SEQ ID NO: 3245061 - RNA, 14 nt, Human
ugaagaagauggua

SEQ ID NO: 3245062 - RNA, 20 nt, Human
ugaagaagcaccaaucauga

SEQ ID NO: 3245063 - RNA, 22 nt, Human
ugaacuuguaaaggaauuuaaa

SEQ ID NO: 3245064 - RNA, 17 nt, Human
ugaagauguagaggaga

SEQ ID NO: 3245065 - RNA, 18 nt, Human
ugaagauguagaggagaa

SEQ ID NO: 3245066 - RNA, 16 nt, Human
agauugugccccugca

SEQ ID NO: 3245067 - RNA, 16 nt, Human
agauuuaccacuugug

SEQ ID NO: 3245068 - RNA, 17 nt, Human
agauuuucagaaaauau

SEQ ID NO: 3245069 - RNA, 12 nt, Human
agauuuucagaa

SEQ ID NO: 3245070 - RNA, 24 nt, Human
ugacuucuaaguaaaaccacagca

SEQ ID NO: 3245071 - RNA, 15 nt, Human
ugacuguuuccauca

SEQ ID NO: 3245072 - RNA, 22 nt, Human
agauguauguacuucaugcugu

SEQ ID NO: 3245073 - RNA, 22 nt, Human
agaugcuagaacucccuuucaa

SEQ ID NO: 3245074 - RNA, 23 nt, Human
agaugcuagaacucccuuucaac

SEQ ID NO: 3245075 - RNA, 19 nt, Human
agaugaugaugaucuuuaa

SEQ ID NO: 3245076 - RNA, 14 nt, Human
agauccuggaaauc

SEQ ID NO: 3245077 - RNA, 16 nt, Human
agcaccaaucaugaau

SEQ ID NO: 3245078 - RNA, 22 nt, Human
agcacagccucuuagaugcagu

SEQ ID NO: 3245079 - RNA, 20 nt, Human
ugagcgacagugagacucug

SEQ ID NO: 3245080 - RNA, 16 nt, Human
ugagcgacagugagac

SEQ ID NO: 3245081 - RNA, 14 nt, Human
ugagcgacagugag

SEQ ID NO: 3245082 - RNA, 13 nt, Human
ugagcgacaguga

SEQ ID NO: 3245083 - RNA, 14 nt, Human
agcagaacagugau

SEQ ID NO: 3245084 - RNA, 15 nt, Human
ugaggacacugauau

SEQ ID NO: 3245085 - RNA, 16 nt, Human
ugagcuacaaaugcau

SEQ ID NO: 3245086 - RNA, 14 nt, Human
ugagcuacaaaugc

SEQ ID NO: 3245087 - RNA, 13 nt, Human
ugagcuacaaaug

SEQ ID NO: 3245088 - RNA, 22 nt, Human
ugagguacugagagugaacaaa

SEQ ID NO: 3245089 - RNA, 17 nt, Human
ugagguacugagaguga

SEQ ID NO: 3245090 - RNA, 21 nt, Human
agcagauggaaugcuguguua

SEQ ID NO: 3245091 - RNA, 15 nt, Human
aguuuagcuggaaaa

SEQ ID NO: 3245092 - RNA, 19 nt, Human
uuaaaaaagaaacauuugg

SEQ ID NO: 3245093 - RNA, 15 nt, Human
aguuuacauuguaaa

SEQ ID NO: 3245094 - RNA, 17 nt, Human
aguuuacauuguaaaua

SEQ ID NO: 3245095 - RNA, 13 nt, Human
aguuuacauugua

SEQ ID NO: 3245096 - RNA, 20 nt, Human
aguuuaaauuguaauaggcg

SEQ ID NO: 3245097 - RNA, 17 nt, Human
aguuuaaauuguaauag

SEQ ID NO: 3245098 - RNA, 16 nt, Human
uuaaaaaauggaacau

SEQ ID NO: 3245099 - RNA, 22 nt, Human
uuaaaaucauuucugcaucagc

SEQ ID NO: 3245100 - RNA, 14 nt, Human
uuaaaaucauuucu

SEQ ID NO: 3245101 - RNA, 15 nt, Human
uuaaauuuugaguuc

SEQ ID NO: 3245102 - RNA, 20 nt, Human
uuaaauuuugaguucuacau

SEQ ID NO: 3245103 - RNA, 16 nt, Human
aguuuuauaugcuucu

SEQ ID NO: 3245104 - RNA, 14 nt, Human
uuaggguuaugauu

SEQ ID NO: 3245105 - RNA, 16 nt, Human
uuaggguuaugauuaa

SEQ ID NO: 3245106 - RNA, 14 nt, Human
uuagggagagaaga

SEQ ID NO: 3245107 - RNA, 15 nt, Human
uuagggagagaagau

SEQ ID NO: 3245108 - RNA, 14 nt, Human
auaaucuuucacag

SEQ ID NO: 3245109 - RNA, 19 nt, Human
auaauuuauacaggucaua

SEQ ID NO: 3245110 - RNA, 21 nt, Human
auaauuuauacaggucauauu

SEQ ID NO: 3245111 - RNA, 17 nt, Human
auaauucagaaggaucu

SEQ ID NO: 3245112 - RNA, 17 nt, Human
auacuauggaauuucuc

SEQ ID NO: 3245113 - RNA, 15 nt, Human
uuauauuugaaauau

SEQ ID NO: 3245114 - RNA, 19 nt, Human
uuauauuugaaauauugac

SEQ ID NO: 3245115 - RNA, 22 nt, Human
auaccacaggaaccacaagacu

SEQ ID NO: 3245116 - RNA, 23 nt, Human
auacgcaacauaauuaaauuuug

SEQ ID NO: 3245117 - RNA, 21 nt, Human
uuaugaauuacauuuguauaa

SEQ ID NO: 3245118 - RNA, 14 nt, Human
uuaugaauuacauu

SEQ ID NO: 3245119 - RNA, 16 nt, Human
uuaugaauuacauuug

SEQ ID NO: 3245120 - RNA, 17 nt, Human
uuaugaauuacauuugu

SEQ ID NO: 3245121 - RNA, 19 nt, Human
uuaugauuaaguaaugaua

SEQ ID NO: 3245122 - RNA, 16 nt, Human
auacucauuaggaugg

SEQ ID NO: 3245123 - RNA, 19 nt, Human
uuauguuaaaacugggaca

SEQ ID NO: 3245124 - RNA, 14 nt, Human
uuauuauauuuaca

SEQ ID NO: 3245125 - RNA, 15 nt, Human
uuauuauauuuacaa

SEQ ID NO: 3245126 - RNA, 17 nt, Human
auagaauuaacacauga

SEQ ID NO: 3245127 - RNA, 13 nt, Human
auagaaguaaaaa

SEQ ID NO: 3245128 - RNA, 21 nt, Human
auagaguguacuuaacuauuc

SEQ ID NO: 3245129 - RNA, 14 nt, Human
auagaguguacuua

SEQ ID NO: 3245130 - RNA, 19 nt, Human
auagaguguacuuaacuau

SEQ ID NO: 3245131 - RNA, 18 nt, Human
auagauaggucagugcaa

SEQ ID NO: 3245132 - RNA, 15 nt, Human
auagagcaaaauuga

SEQ ID NO: 3245133 - RNA, 17 nt, Human
auagagcaaaauugaug

SEQ ID NO: 3245134 - RNA, 21 nt, Human
auagagcaaaauugauguguu

SEQ ID NO: 3245135 - RNA, 22 nt, Human
auagagcaaaauugauguguuu

SEQ ID NO: 3245136 - RNA, 13 nt, Human
agucucaggaaau

SEQ ID NO: 3245137 - RNA, 22 nt, Human
ugucucaguccaugaagaugua

SEQ ID NO: 3245138 - RNA, 14 nt, Human
agucaggaaagaga

SEQ ID NO: 3245139 - RNA, 19 nt, Human
uguaagggaaacugccagc

SEQ ID NO: 3245140 - RNA, 13 nt, Human
uguaagggaaacu

SEQ ID NO: 3245141 - RNA, 18 nt, Human
uguaagggaaacugccag

SEQ ID NO: 3245142 - RNA, 14 nt, Human
agguugcagugagc

SEQ ID NO: 3245143 - RNA, 16 nt, Human
aguaaaaccacagcag

SEQ ID NO: 3245144 - RNA, 17 nt, Human
aguaaaaccacagcagu

SEQ ID NO: 3245145 - RNA, 19 nt, Human
aguaaaaccacagcaguug

SEQ ID NO: 3245146 - RNA, 15 nt, Human
aguaaaaccacagca

SEQ ID NO: 3245147 - RNA, 19 nt, Human
aguacauuuggagacacaa

SEQ ID NO: 3245148 - RNA, 15 nt, Human
aguaauucaagaaaa

SEQ ID NO: 3245149 - RNA, 19 nt, Human
aguaauucaagaaaacaac

SEQ ID NO: 3245150 - RNA, 12 nt, Human
aguaauuggaaa

SEQ ID NO: 3245151 - RNA, 13 nt, Human
aguaauuggaaag

SEQ ID NO: 3245152 - RNA, 17 nt, Human
uguaguguuggagaaga

SEQ ID NO: 3245153 - RNA, 18 nt, Human
uguaguguuggagaagaa

SEQ ID NO: 3245154 - RNA, 18 nt, Human
uguauauccuuucuaaca

SEQ ID NO: 3245155 - RNA, 16 nt, Human
uguaguguuggagaag

SEQ ID NO: 3245156 - RNA, 16 nt, Human
aguacauuuggagaca

SEQ ID NO: 3245157 - RNA, 23 nt, Human
agugaacaaauuuacagagacag

SEQ ID NO: 3245158 - RNA, 22 nt, Human
agugaacaaauuuacagagaca

SEQ ID NO: 3245159 - RNA, 21 nt, Human
agugaacaaauuuacagagac

SEQ ID NO: 3245160 - RNA, 20 nt, Human
agugaacaaauuuacagaga

SEQ ID NO: 3245161 - RNA, 16 nt, Human
agucuuucacauuuaa

SEQ ID NO: 3245162 - RNA, 22 nt, Human
agugcaaauugucacaggacag

SEQ ID NO: 3245163 - RNA, 23 nt, Human
aguguuggagaagaacugaaauc

SEQ ID NO: 3245164 - RNA, 22 nt, Human
uguugcccacagcuguaugauu

SEQ ID NO: 3245165 - RNA, 15 nt, Human
uguucuaagaaguga

SEQ ID NO: 3245166 - RNA, 18 nt, Human
uguuccuagugaaagagg

SEQ ID NO: 3245167 - RNA, 19 nt, Human
ugugucuaaauuugaaugu

SEQ ID NO: 3245168 - RNA, 22 nt, Human
ugugucuaaauuugaauguuaa

SEQ ID NO: 3245169 - RNA, 14 nt, Human
uguguaaaauguga

SEQ ID NO: 3245170 - RNA, 22 nt, Human
uguguuaaguauguguaaaaug

SEQ ID NO: 3245171 - RNA, 23 nt, Human
uguuaagcagauggaaugcugug

SEQ ID NO: 3245172 - RNA, 22 nt, Human
agggcuguuauaaucuuucaca

SEQ ID NO: 3245173 - RNA, 13 nt, Human
agggagagaagau

SEQ ID NO: 3245174 - RNA, 14 nt, Human
agggagagaagaua

SEQ ID NO: 3245175 - RNA, 23 nt, Human
agggacuucugucuucacaacag

SEQ ID NO: 3245176 - RNA, 19 nt, Human
ugggaggcugagaugggag

SEQ ID NO: 3245177 - RNA, 20 nt, Human
ugggaacccaaguccaagca

SEQ ID NO: 3245178 - RNA, 16 nt, Human
agggaaacugccagca

SEQ ID NO: 3245179 - RNA, 19 nt, Human
agggaaacugccagcaacg

SEQ ID NO: 3245180 - RNA, 21 nt, Human
agggaaacugccagcaacgca

SEQ ID NO: 3245181 - RNA, 23 nt, Human
agggaaacugccagcaacgcagg

SEQ ID NO: 3245182 - RNA, 14 nt, Human
agggaaacugccag

SEQ ID NO: 3245183 - RNA, 15 nt, Human
agggaaacugccagc

SEQ ID NO: 3245184 - RNA, 23 nt, Human
uggcuauaggugcuacaaaaaca

SEQ ID NO: 3245185 - RNA, 18 nt, Human
uggcuaagcaaaauguga

SEQ ID NO: 3245186 - RNA, 15 nt, Human
uggcuauaggugcua

SEQ ID NO: 3245187 - RNA, 19 nt, Human
uggcuauaggugcuacaaa

SEQ ID NO: 3245188 - RNA, 17 nt, Human
ugggaaagcauuguaaa

SEQ ID NO: 3245189 - RNA, 18 nt, Human
ugggaaagcauuguaaau

SEQ ID NO: 3245190 - RNA, 14 nt, Human
ugggaaagcauugu

SEQ ID NO: 3245191 - RNA, 16 nt, Human
ugggaaagcauuguaa

SEQ ID NO: 3245192 - RNA, 18 nt, Human
ugggaaacaaaaggauaa

SEQ ID NO: 3245193 - RNA, 14 nt, Human
uggagaagaacuga

SEQ ID NO: 3245194 - RNA, 16 nt, Human
uggagaagaacugaaa

SEQ ID NO: 3245195 - RNA, 21 nt, Human
uggagcucgugggacagucac

SEQ ID NO: 3245196 - RNA, 22 nt, Human
uggaauuucucccagucauuua

SEQ ID NO: 3245197 - RNA, 21 nt, Human
uggaacaagaugguucuagca

SEQ ID NO: 3245198 - RNA, 22 nt, Human
aggcuccacuuggucugugaga

SEQ ID NO: 3245199 - RNA, 21 nt, Human
aggcuccacuuggucugugag

SEQ ID NO: 3245200 - RNA, 17 nt, Human
aggcuccacuuggucug

SEQ ID NO: 3245201 - RNA, 11 nt, Human
aggcuccacuu

SEQ ID NO: 3245202 - RNA, 13 nt, Human
aggaaauauuuau

SEQ ID NO: 3245203 - RNA, 14 nt, Human
aggaaauauuuauu

SEQ ID NO: 3245204 - RNA, 18 nt, Human
aggaaauauuuauuuuaa

SEQ ID NO: 3245205 - RNA, 19 nt, Human
aggaauugacccacaagaa

SEQ ID NO: 3245206 - RNA, 20 nt, Human
agcuuauuaaaacucauuuu

SEQ ID NO: 3245207 - RNA, 15 nt, Human
agcuuauuaaaacuc

SEQ ID NO: 3245208 - RNA, 21 nt, Human
agcuuauugucuagugaaacu

SEQ ID NO: 3245209 - RNA, 14 nt, Human
ugcuaguaauugga

SEQ ID NO: 3245210 - RNA, 16 nt, Human
ugcuaguaauuggaaa

SEQ ID NO: 3245211 - RNA, 13 nt, Human
aggaaagagaacu

SEQ ID NO: 3245212 - RNA, 19 nt, Human
aggaaagagaacuuccaga

SEQ ID NO: 3245213 - RNA, 13 nt, Human
agcuggaaaagua

SEQ ID NO: 3245214 - RNA, 19 nt, Human
agcuacuaauuuuaaaaug

SEQ ID NO: 3245215 - RNA, 17 nt, Human
agcccuucuuuccacag

SEQ ID NO: 3245216 - RNA, 18 nt, Human
agcccuucuuuccacaga

SEQ ID NO: 3245217 - RNA, 19 nt, Human
agcccuucuuuccacagaa

SEQ ID NO: 3245218 - RNA, 14 nt, Human
ugcagugagccgag

SEQ ID NO: 3245219 - RNA, 18 nt, Human
agccugagcgacagugag

SEQ ID NO: 3245220 - RNA, 19 nt, Human
agccugcaauuucauaugc

SEQ ID NO: 3245221 - RNA, 21 nt, Human
agccugcaauuucauaugcug

SEQ ID NO: 3245222 - RNA, 19 nt, Human
auugacacuuaaaaauggu

SEQ ID NO: 3245223 - RNA, 17 nt, Human
auugacacuuaaaaaug

SEQ ID NO: 3245224 - RNA, 15 nt, Human
auugacacuuaaaaa

SEQ ID NO: 3245225 - RNA, 15 nt, Human
auucuagcuaaugua

SEQ ID NO: 3245226 - RNA, 18 nt, Human
auucuagcuaauguaaua

SEQ ID NO: 3245227 - RNA, 17 nt, Human
auuauauuuacaaaugg

SEQ ID NO: 3245228 - RNA, 15 nt, Human
auuauauuuauuacu

SEQ ID NO: 3245229 - RNA, 18 nt, Human
auuauauuuauuacugua

SEQ ID NO: 3245230 - RNA, 21 nt, Human
auuauguuaaaacugggacag

SEQ ID NO: 3245231 - RNA, 20 nt, Human
auuauuaccuuacagaaguu

SEQ ID NO: 3245232 - RNA, 19 nt, Human
auucaaacagucucaggaa

SEQ ID NO: 3245233 - RNA, 16 nt, Human
auucaaacagucucag

SEQ ID NO: 3245234 - RNA, 18 nt, Human
auucaaacagucucagga

SEQ ID NO: 3245235 - RNA, 19 nt, Human
auuauuuuguucauacaua

SEQ ID NO: 3245236 - RNA, 18 nt, Human
auuauuuuguucauacau

SEQ ID NO: 3245237 - RNA, 17 nt, Human
auuauuuuguucauaca

SEQ ID NO: 3245238 - RNA, 16 nt, Human
auuauuuuguucauac

SEQ ID NO: 3245239 - RNA, 15 nt, Human
auuauuuuguucaua

SEQ ID NO: 3245240 - RNA, 14 nt, Human
auucuaaauuuuau

SEQ ID NO: 3245241 - RNA, 18 nt, Human
auucagaaggaucuucau

SEQ ID NO: 3245242 - RNA, 24 nt, Human
auucagaaggaucuucaucugacu

SEQ ID NO: 3245243 - RNA, 14 nt, Human
auuuuccugaaaac

SEQ ID NO: 3245244 - RNA, 15 nt, Human
auuuucuauaauuua

SEQ ID NO: 3245245 - RNA, 14 nt, Human
auuuucuauaauuu

SEQ ID NO: 3245246 - RNA, 12 nt, Human
auuuuguucaua

SEQ ID NO: 3245247 - RNA, 18 nt, Human
auuuuguucauacauauu

SEQ ID NO: 3245248 - RNA, 16 nt, Human
auuuuguucauacaua

SEQ ID NO: 3245249 - RNA, 15 nt, Human
auuuuguucauacau

SEQ ID NO: 3245250 - RNA, 14 nt, Human
auuuuguucauaca

SEQ ID NO: 3245251 - RNA, 18 nt, Human
auuuuuuguuaaaugauu

SEQ ID NO: 3245252 - RNA, 20 nt, Human
auuuuuucucuaggaaauau

SEQ ID NO: 3245253 - RNA, 23 nt, Human
auuuuuucucuaggaaauauuua

SEQ ID NO: 3245254 - RNA, 21 nt, Human
auuuuuguuuucauuaucuca

SEQ ID NO: 3245255 - RNA, 22 nt, Human
auuuuugugauuuugugauuga

SEQ ID NO: 3245256 - RNA, 21 nt, Human
auuuuuguagcacugacagau

SEQ ID NO: 3245257 - RNA, 20 nt, Human
auuuuuguagcacugacaga

SEQ ID NO: 3245258 - RNA, 15 nt, Human
auuuuucuuauuuca

SEQ ID NO: 3245259 - RNA, 19 nt, Human
auuuuucuuauuucauuuc

SEQ ID NO: 3245260 - RNA, 20 nt, Human
auuuuucuuauuucauuucu

SEQ ID NO: 3245261 - RNA, 15 nt, Human
auuuuugacagaaua

SEQ ID NO: 3245262 - RNA, 14 nt, Human
auuuuugacagaau

SEQ ID NO: 3245263 - RNA, 13 nt, Human
auuuuugacagaa

SEQ ID NO: 3245264 - RNA, 12 nt, Human
auuuuugacaga

SEQ ID NO: 3245265 - RNA, 22 nt, Human
auuuuugacagaauauguuuca

SEQ ID NO: 3245266 - RNA, 15 nt, Human
auuuuuccaaaauaa

SEQ ID NO: 3245267 - RNA, 15 nt, Human
auuuuucacauaucu

SEQ ID NO: 3245268 - RNA, 21 nt, Human
auuuuucacauaucuaguaug

SEQ ID NO: 3245269 - RNA, 18 nt, Human
auuuuucacauaucuagu

SEQ ID NO: 3245270 - RNA, 13 nt, Human
auugucuagugaa

SEQ ID NO: 3245271 - RNA, 16 nt, Human
auuguacgaagaguau

SEQ ID NO: 3245272 - RNA, 19 nt, Human
auuggagcucgugggacag

SEQ ID NO: 3245273 - RNA, 19 nt, Human
auuggacaguaaaauccac

SEQ ID NO: 3245274 - RNA, 13 nt, Human
auugacuuuuuau

SEQ ID NO: 3245275 - RNA, 18 nt, Human
auugcuuuggucauauga

SEQ ID NO: 3245276 - RNA, 14 nt, Human
auugcuuuggucau

SEQ ID NO: 3245277 - RNA, 16 nt, Human
auuuuaaaagaaugau

SEQ ID NO: 3245278 - RNA, 23 nt, Human
auuuuaaaagaaugauuaugaau

SEQ ID NO: 3245279 - RNA, 19 nt, Human
auuuguaguguuggagaag

SEQ ID NO: 3245280 - RNA, 22 nt, Human
auuuguaguguuggagaagaac

SEQ ID NO: 3245281 - RNA, 14 nt, Human
auuuguauaaaaua

SEQ ID NO: 3245282 - RNA, 14 nt, Human
auuuauuuuaauaa

SEQ ID NO: 3245283 - RNA, 15 nt, Human
augaauuaaguuuuu

SEQ ID NO: 3245284 - RNA, 15 nt, Human
augaauuacauuugu

SEQ ID NO: 3245285 - RNA, 23 nt, Human
augaauggcuaagcaaaauguga

SEQ ID NO: 3245286 - RNA, 16 nt, Human
augaauuacauuugua

SEQ ID NO: 3245287 - RNA, 19 nt, Human
augaaauuauauaaguauu

SEQ ID NO: 3245288 - RNA, 21 nt, Human
augaaauuauauaaguauucu

SEQ ID NO: 3245289 - RNA, 18 nt, Human
uuggagacacaacuauuu

SEQ ID NO: 3245290 - RNA, 20 nt, Human
uuggagacacaacuauuuuu

SEQ ID NO: 3245291 - RNA, 18 nt, Human
aucuuguagcuuuaucaa

SEQ ID NO: 3245292 - RNA, 20 nt, Human
aucuuguagcuuuaucaaag

SEQ ID NO: 3245293 - RNA, 19 nt, Human
aucuuguagcuuuaucaaa

SEQ ID NO: 3245294 - RNA, 13 nt, Human
uugcaucaauuuu

SEQ ID NO: 3245295 - RNA, 22 nt, Human
uugcaagccagauuuuccugaa

SEQ ID NO: 3245296 - RNA, 19 nt, Human
aucuacacuccagugagac

SEQ ID NO: 3245297 - RNA, 18 nt, Human
aucuacacuccagugaga

SEQ ID NO: 3245298 - RNA, 20 nt, Human
uugacagaauauguuucaaa

SEQ ID NO: 3245299 - RNA, 17 nt, Human
uugacagaauauguuuc

SEQ ID NO: 3245300 - RNA, 14 nt, Human
auccauacauuugu

SEQ ID NO: 3245301 - RNA, 12 nt, Human
uucucuaggaaa

SEQ ID NO: 3245302 - RNA, 19 nt, Human
uugaacccgggaggcagag

SEQ ID NO: 3245303 - RNA, 18 nt, Human
uugaacccgggaggcaga

SEQ ID NO: 3245304 - RNA, 17 nt, Human
uugaaauuguauuacaa

SEQ ID NO: 3245305 - RNA, 14 nt, Human
aucaacagauaaau

SEQ ID NO: 3245306 - RNA, 20 nt, Human
auauuuuuuguuaaaugauu

SEQ ID NO: 3245307 - RNA, 18 nt, Human
auauuuuuuguuaaauga

SEQ ID NO: 3245308 - RNA, 12 nt, Human
auauuuuucaca

SEQ ID NO: 3245309 - RNA, 15 nt, Human
auauuuuucacauau

SEQ ID NO: 3245310 - RNA, 14 nt, Human
auauuuuucacaua

SEQ ID NO: 3245311 - RNA, 13 nt, Human
auauuuuucacau

SEQ ID NO: 3245312 - RNA, 19 nt, Human
uuccguagguuauuuucag

SEQ ID NO: 3245313 - RNA, 14 nt, Human
uucggccuccaucc

SEQ ID NO: 3245314 - RNA, 14 nt, Human
uucuagcauggcau

SEQ ID NO: 3245315 - RNA, 21 nt, Human
uucuagcauggcauauuuuuc

SEQ ID NO: 3245316 - RNA, 20 nt, Human
uucuagcauggcauauuuuu

SEQ ID NO: 3245317 - RNA, 18 nt, Human
uucuagcauggcauauuu

SEQ ID NO: 3245318 - RNA, 15 nt, Human
uucuagcauggcaua

SEQ ID NO: 3245319 - RNA, 22 nt, Human
uucuagcauggcauauuuuuca

SEQ ID NO: 3245320 - RNA, 17 nt, Human
uucuagcuaauguaaua

SEQ ID NO: 3245321 - RNA, 16 nt, Human
uucuaaguaaaaccac

SEQ ID NO: 3245322 - RNA, 15 nt, Human
uucuaaguaaaacca

SEQ ID NO: 3245323 - RNA, 13 nt, Human
uucuaagaaguga

SEQ ID NO: 3245324 - RNA, 23 nt, Human
uucuaagaagugaaaaucuacac

SEQ ID NO: 3245325 - RNA, 14 nt, Human
uucuaaauuuuaua

SEQ ID NO: 3245326 - RNA, 22 nt, Human
aucacuugucaauaaaauccau

SEQ ID NO: 3245327 - RNA, 17 nt, Human
aucaggguuaguauugu

SEQ ID NO: 3245328 - RNA, 15 nt, Human
augauaacuggaaac

SEQ ID NO: 3245329 - RNA, 17 nt, Human
augauaaguaaaugcua

SEQ ID NO: 3245330 - RNA, 20 nt, Human
uuguguuaaguauguguaaa

SEQ ID NO: 3245331 - RNA, 18 nt, Human
augauuaaguaaugauaa

SEQ ID NO: 3245332 - RNA, 14 nt, Human
augauuaaguaaug

SEQ ID NO: 3245333 - RNA, 17 nt, Human
augccauuuaaagcuua

SEQ ID NO: 3245334 - RNA, 21 nt, Human
augccauuuaaagcuuauuaa

SEQ ID NO: 3245335 - RNA, 13 nt, Human
augcaguucugaa

SEQ ID NO: 3245336 - RNA, 21 nt, Human
augcuagaacucccuuucaac

SEQ ID NO: 3245337 - RNA, 20 nt, Human
augcuagaacucccuuucaa

SEQ ID NO: 3245338 - RNA, 22 nt, Human
augcuagaacucccuuucaaca

SEQ ID NO: 3245339 - RNA, 19 nt, Human
augcuagaacucccuuuca

SEQ ID NO: 3245340 - RNA, 18 nt, Human
augcuagguuaauuccaa

SEQ ID NO: 3245341 - RNA, 21 nt, Human
uuuaucaaagggugaaaauua

SEQ ID NO: 3245342 - RNA, 16 nt, Human
uuucaaacauauauaa

SEQ ID NO: 3245343 - RNA, 19 nt, Human
auggcuaagcaaaauguga

SEQ ID NO: 3245344 - RNA, 23 nt, Human
auggcuauaggugcuacaaaaac

SEQ ID NO: 3245345 - RNA, 14 nt, Human
auggcacuaguauu

SEQ ID NO: 3245346 - RNA, 16 nt, Human
auggcacuaguauuuc

SEQ ID NO: 3245347 - RNA, 18 nt, Human
auggcauauuuuucacau

SEQ ID NO: 3245348 - RNA, 23 nt, Human
auggcauauuuuucacauaucua

SEQ ID NO: 3245349 - RNA, 22 nt, Human
auggcauauuuuucacauaucu

SEQ ID NO: 3245350 - RNA, 21 nt, Human
auggcauauuuuucacauauc

SEQ ID NO: 3245351 - RNA, 20 nt, Human
auggcauauuuuucacauau

SEQ ID NO: 3245352 - RNA, 14 nt, Human
uuucaaacuuugga

SEQ ID NO: 3245353 - RNA, 17 nt, Human
uuucucccagucauuua

SEQ ID NO: 3245354 - RNA, 18 nt, Human
uuucucccagucauuuaa

SEQ ID NO: 3245355 - RNA, 15 nt, Human
uuugaaauauugacu

SEQ ID NO: 3245356 - RNA, 21 nt, Human
augguucccuugaugaagaag

SEQ ID NO: 3245357 - RNA, 14 nt, Human
uuugcaagccagau

SEQ ID NO: 3245358 - RNA, 13 nt, Human
uuugcucauggaa

SEQ ID NO: 3245359 - RNA, 16 nt, Human
auguacuucaugcugu

SEQ ID NO: 3245360 - RNA, 13 nt, Human
auguagaggagaa

SEQ ID NO: 3245361 - RNA, 12 nt, Human
auguagaggaga

SEQ ID NO: 3245362 - RNA, 19 nt, Human
auguagaggagaaacugga

SEQ ID NO: 3245363 - RNA, 17 nt, Human
auguagaggagaaacug

SEQ ID NO: 3245364 - RNA, 22 nt, Human
uuugacagaauauguuucaaac

SEQ ID NO: 3245365 - RNA, 21 nt, Human
uuugacagaauauguuucaaa

SEQ ID NO: 3245366 - RNA, 17 nt, Human
auguccacugguucuuc

SEQ ID NO: 3245367 - RNA, 16 nt, Human
auguccacugguucuu

SEQ ID NO: 3245368 - RNA, 17 nt, Human
uuuguaguguuggagaa

SEQ ID NO: 3245369 - RNA, 19 nt, Human
uuuguaguguuggagaaga

SEQ ID NO: 3245370 - RNA, 21 nt, Human
uuuguaguguuggagaagaac

SEQ ID NO: 3245371 - RNA, 17 nt, Human
uuugugaagcaaaauuu

SEQ ID NO: 3245372 - RNA, 13 nt, Human
aaaaacacagcaa

SEQ ID NO: 3245373 - RNA, 18 nt, Human
aaaaacacagcaagggug

SEQ ID NO: 3245374 - RNA, 12 nt, Human
aaaaacacagca

SEQ ID NO: 3245375 - RNA, 18 nt, Human
auaaaggauuaaugucaa

SEQ ID NO: 3245376 - RNA, 14 nt, Human
auaaaaauauugug

SEQ ID NO: 3245377 - RNA, 17 nt, Human
auacacacucaaaucaa

SEQ ID NO: 3245378 - RNA, 18 nt, Human
auacacacucaaaucaag

SEQ ID NO: 3245379 - RNA, 23 nt, Human
auaauguuucaaacauauauaac

SEQ ID NO: 3245380 - RNA, 20 nt, Human
auaauuaaauuuugaguucu

SEQ ID NO: 3245381 - RNA, 18 nt, Human
auagcagcuuauucacaa

SEQ ID NO: 3245382 - RNA, 14 nt, Human
auaggugcuacaaa

SEQ ID NO: 3245383 - RNA, 15 nt, Human
auaggugcuacaaaa

SEQ ID NO: 3245384 - RNA, 21 nt, Human
auaggugcuacaaaaacacag

SEQ ID NO: 3245385 - RNA, 23 nt, Human
auaggugcuacaaaaacacagca

SEQ ID NO: 3245386 - RNA, 15 nt, Human
auagguuuaauaauu

SEQ ID NO: 3245387 - RNA, 20 nt, Human
auaguauuugagaguucuaa

SEQ ID NO: 3245388 - RNA, 21 nt, Human
auaguauuugagaguucuaaa

SEQ ID NO: 3245389 - RNA, 23 nt, Human
auaguauuugagaguucuaaauu

SEQ ID NO: 3245390 - RNA, 14 nt, Human
auagucaaauugug

SEQ ID NO: 3245391 - RNA, 20 nt, Human
auaugcuucuguuuuauaau

SEQ ID NO: 3245392 - RNA, 22 nt, Human
auaugcuucuguuuuauaauuu

SEQ ID NO: 3245393 - RNA, 22 nt, Human
auauuuauuacuguaagaaaau

SEQ ID NO: 3245394 - RNA, 13 nt, Human
auauuuauuuuaa

SEQ ID NO: 3245395 - RNA, 16 nt, Human
auauuauguuaaaacu

SEQ ID NO: 3245396 - RNA, 12 nt, Human
aguccuguaaug

SEQ ID NO: 3245397 - RNA, 23 nt, Human
agucaaauugugugaaagguacu

SEQ ID NO: 3245398 - RNA, 19 nt, Human
agucaaauugugugaaagg

SEQ ID NO: 3245399 - RNA, 16 nt, Human
aguaugaaauuauaua

SEQ ID NO: 3245400 - RNA, 14 nt, Human
aguaugaaauuaua

SEQ ID NO: 3245401 - RNA, 22 nt, Human
aguugaaaagacuccaaagaaa

SEQ ID NO: 3245402 - RNA, 23 nt, Human
aguugaaaaucuuauaauuuaaa

SEQ ID NO: 3245403 - RNA, 21 nt, Human
aguugaaaagacuccaaagaa

SEQ ID NO: 3245404 - RNA, 22 nt, Human
aguugaaaaucuuauaauuuaa

SEQ ID NO: 3245405 - RNA, 15 nt, Human
aguucauacauugua

SEQ ID NO: 3245406 - RNA, 11 nt, Human
aguucauacau

SEQ ID NO: 3245407 - RNA, 10 nt, Human
aguucauaca

SEQ ID NO: 3245408 - RNA, 17 nt, Human
agugucuuaauuaaaag

SEQ ID NO: 3245409 - RNA, 18 nt, Human
agugucuuaauuaaaaga

SEQ ID NO: 3245410 - RNA, 15 nt, Human
agugucuuaauuaaa

SEQ ID NO: 3245411 - RNA, 17 nt, Human
augcauagguuuagcag

SEQ ID NO: 3245412 - RNA, 21 nt, Human
augcauagguuuagcaguaua

SEQ ID NO: 3245413 - RNA, 19 nt, Human
auguaagggaaacugccag

SEQ ID NO: 3245414 - RNA, 14 nt, Human
auguaagggaaacu

SEQ ID NO: 3245415 - RNA, 16 nt, Human
auguaagggaaacugc

SEQ ID NO: 3245416 - RNA, 20 nt, Human
auguauucuagcuaauguaa

SEQ ID NO: 3245417 - RNA, 19 nt, Human
auguauucuagcuaaugua

SEQ ID NO: 3245418 - RNA, 18 nt, Human
augugggcagugauguca

SEQ ID NO: 3245419 - RNA, 17 nt, Human
auguucuaagaagugaa

SEQ ID NO: 3245420 - RNA, 13 nt, Human
auguuucaaacuu

SEQ ID NO: 3245421 - RNA, 12 nt, Human
auguuucaaacu

SEQ ID NO: 3245422 - RNA, 17 nt, Human
auguuucaaacuuugga

SEQ ID NO: 3245423 - RNA, 14 nt, Human
auguuucaaacuuu

SEQ ID NO: 3245424 - RNA, 21 nt, Human
auguuucaaacauauauaaca

SEQ ID NO: 3245425 - RNA, 22 nt, Human
aucagcugcugaaacaacaaau

SEQ ID NO: 3245426 - RNA, 23 nt, Human
aucagcugcugaaacaacaaaua

SEQ ID NO: 3245427 - RNA, 17 nt, Human
aucagcugcugaaacaa

SEQ ID NO: 3245428 - RNA, 17 nt, Human
auauuuauuuuaauaau

SEQ ID NO: 3245429 - RNA, 14 nt, Human
auauuuauuuuaau

SEQ ID NO: 3245430 - RNA, 15 nt, Human
auauuuauuuuaaua

SEQ ID NO: 3245431 - RNA, 21 nt, Human
aucagcugcugaaacaacaaa

SEQ ID NO: 3245432 - RNA, 23 nt, Human
aggugcuacaaaaacacagcaag

SEQ ID NO: 3245433 - RNA, 24 nt, Human
aggugcuacaaaaacacagcaagg

SEQ ID NO: 3245434 - RNA, 16 nt, Human
aggugcuacaaaaaca

SEQ ID NO: 3245435 - RNA, 18 nt, Human
aggugcuacaaaaacaca

SEQ ID NO: 3245436 - RNA, 19 nt, Human
aggugcuacaaaaacacag

SEQ ID NO: 3245437 - RNA, 20 nt, Human
aggugcuacaaaaacacagc

SEQ ID NO: 3245438 - RNA, 21 nt, Human
aggugcuacaaaaacacagca

SEQ ID NO: 3245439 - RNA, 22 nt, Human
aggugcuacaaaaacacagcaa

SEQ ID NO: 3245440 - RNA, 20 nt, Human
agguaaaagcaucacaugaa

SEQ ID NO: 3245441 - RNA, 15 nt, Human
aggcuagauguaugu

SEQ ID NO: 3245442 - RNA, 16 nt, Human
aggcuagauguaugua

SEQ ID NO: 3245443 - RNA, 21 nt, Human
aggcuagaaccaccugccuau

SEQ ID NO: 3245444 - RNA, 17 nt, Human
aggcuacugucagcucc

SEQ ID NO: 3245445 - RNA, 23 nt, Human
aggaugguucccuugaugaagaa

SEQ ID NO: 3245446 - RNA, 17 nt, Human
aggauguugaaaaaguu

SEQ ID NO: 3245447 - RNA, 22 nt, Human
agcuccccucggagaagagcug

SEQ ID NO: 3245448 - RNA, 17 nt, Human
agagaacuuccagaucc

SEQ ID NO: 3245449 - RNA, 21 nt, Human
agacugcauuauauuuauuac

SEQ ID NO: 3245450 - RNA, 13 nt, Human
agcaguugaaaag

SEQ ID NO: 3245451 - RNA, 16 nt, Human
agcaguugaaaagacu

SEQ ID NO: 3245452 - RNA, 18 nt, Human
agcacugacagauuucca

SEQ ID NO: 3245453 - RNA, 14 nt, Human
agcacugacagauu

SEQ ID NO: 3245454 - RNA, 13 nt, Human
agcacugacagau

SEQ ID NO: 3245455 - RNA, 21 nt, Human
acacgagcaggcuacugucag

SEQ ID NO: 3245456 - RNA, 14 nt, Human
acacgagcaggcua

SEQ ID NO: 3245457 - RNA, 19 nt, Human
acacgagcaggcuacuguc

SEQ ID NO: 3245458 - RNA, 21 nt, Human
acagcaguugaaaagacucca

SEQ ID NO: 3245459 - RNA, 22 nt, Human
acagcaguugaaaagacuccaa

SEQ ID NO: 3245460 - RNA, 23 nt, Human
acagcaguugaaaagacuccaaa

SEQ ID NO: 3245461 - RNA, 18 nt, Human
acagcaguugaaaagacu

SEQ ID NO: 3245462 - RNA, 20 nt, Human
accaaggcugauuaaaccaa

SEQ ID NO: 3245463 - RNA, 21 nt, Human
acauuuguauaaaauaauuuu

SEQ ID NO: 3245464 - RNA, 21 nt, Human
acccacaagaaaugaaagcag

SEQ ID NO: 3245465 - RNA, 17 nt, Human
acccacaagaaaugaaa

SEQ ID NO: 3245466 - RNA, 15 nt, Human
acccacaagaaauga

SEQ ID NO: 3245467 - RNA, 22 nt, Human
acuuuauuuucuauaauuuaaa

SEQ ID NO: 3245468 - RNA, 16 nt, Human
agaaaaucaggcuggc

SEQ ID NO: 3245469 - RNA, 14 nt, Human
agaaaauaacaaua

SEQ ID NO: 3245470 - RNA, 22 nt, Human
acuuuauacccagaaaguuauu

SEQ ID NO: 3245471 - RNA, 20 nt, Human
acuuuauacccagaaaguua

SEQ ID NO: 3245472 - RNA, 11 nt, Human
agaaaguuauu

SEQ ID NO: 3245473 - RNA, 23 nt, Human
agaaaguuauugauaaguucaua

SEQ ID NO: 3245474 - RNA, 21 nt, Human
acuuggucugugagaugcuag

SEQ ID NO: 3245475 - RNA, 21 nt, Human
acuucugucuucacaacagau

SEQ ID NO: 3245476 - RNA, 22 nt, Human
acuguaagaaaauaucacuugu

SEQ ID NO: 3245477 - RNA, 19 nt, Human
acuguaagaaaauaucacu

SEQ ID NO: 3245478 - RNA, 13 nt, Human
acuguaagaaaau

SEQ ID NO: 3245479 - RNA, 22 nt, Human
acugugaaguuuacauuguaaa

SEQ ID NO: 3245480 - RNA, 17 nt, Human
acucugucucaguccau

SEQ ID NO: 3245481 - RNA, 18 nt, Human
acucugucucaguccaug

SEQ ID NO: 3245482 - RNA, 20 nt, Human
acucugucucaguccaugaa

SEQ ID NO: 3245483 - RNA, 13 nt, Human
acugccagcaacg

SEQ ID NO: 3245484 - RNA, 17 nt, Human
acucuauguucuaagaa

SEQ ID NO: 3245485 - RNA, 21 nt, Human
acucauaaaaagccugcaauu

SEQ ID NO: 3245486 - RNA, 14 nt, Human
acucaaaucaagaa

SEQ ID NO: 3245487 - RNA, 19 nt, Human
acuaguauuucuaugaaau

SEQ ID NO: 3245488 - RNA, 20 nt, Human
acuaguauuucuaugaaaua

SEQ ID NO: 3245489 - RNA, 21 nt, Human
acuauucaaacagucucagga

SEQ ID NO: 3245490 - RNA, 18 nt, Human
acuauucaaacagucuca

SEQ ID NO: 3245491 - RNA, 22 nt, Human
acuauucaggagaguagaacag

SEQ ID NO: 3245492 - RNA, 19 nt, Human
acgcaggcccccaggugcc

SEQ ID NO: 3245493 - RNA, 22 nt, Human
acgcaggcccccaggugccagu

SEQ ID NO: 3245494 - RNA, 13 nt, Human
acuaagagagaau

SEQ ID NO: 3245495 - RNA, 16 nt, Human
aaaaucucaauauuuc

SEQ ID NO: 3245496 - RNA, 21 nt, Human
aaaauugauguguuuauuuau

SEQ ID NO: 3245497 - RNA, 12 nt, Human
aaaauugaugug

SEQ ID NO: 3245498 - RNA, 14 nt, Human
aaaauugauguguu

SEQ ID NO: 3245499 - RNA, 24 nt, Human
aaacacucaguuguucaauaauaa

SEQ ID NO: 3245500 - RNA, 16 nt, Human
aaaaagaaacauuugg

SEQ ID NO: 3245501 - RNA, 18 nt, Human
aaaaguucugcagauaaa

SEQ ID NO: 3245502 - RNA, 21 nt, Human
aaaaucuacacuccagugaga

SEQ ID NO: 3245503 - RNA, 17 nt, Human
aaaaucaguuguacagu

SEQ ID NO: 3245504 - RNA, 21 nt, Human
aaacugagaugugaacacauc

SEQ ID NO: 3245505 - RNA, 23 nt, Human
aaacugagaugugaacacaucag

SEQ ID NO: 3245506 - RNA, 15 nt, Human
aaaucaaauaugcaa

SEQ ID NO: 3245507 - RNA, 12 nt, Human
aaaucaaauaug

SEQ ID NO: 3245508 - RNA, 14 nt, Human
aaaucaaauaugca

SEQ ID NO: 3245509 - RNA, 20 nt, Human
aaauauuuauuuuaauaaug

SEQ ID NO: 3245510 - RNA, 13 nt, Human
aaauauuuauuuu

SEQ ID NO: 3245511 - RNA, 15 nt, Human
aaauauuuauuuuaa

SEQ ID NO: 3245512 - RNA, 14 nt, Human
aaaggcagaagcaa

SEQ ID NO: 3245513 - RNA, 20 nt, Human
aacugagaugugaacacauc

SEQ ID NO: 3245514 - RNA, 19 nt, Human
aacugacucuuaagaagac

SEQ ID NO: 3245515 - RNA, 20 nt, Human
aacugacucuuaagaagacu

SEQ ID NO: 3245516 - RNA, 15 nt, Human
aacugacucuuaaga

SEQ ID NO: 3245517 - RNA, 18 nt, Human
aacugacucuuaagaaga

SEQ ID NO: 3245518 - RNA, 21 nt, Human
aacuuuaugcuaagugaaaua

SEQ ID NO: 3245519 - RNA, 20 nt, Human
aacuuuaugcuaagugaaau

SEQ ID NO: 3245520 - RNA, 23 nt, Human
aacuuuauacccagaaaguuauu

SEQ ID NO: 3245521 - RNA, 22 nt, Human
aacuuuauacccagaaaguuau

SEQ ID NO: 3245522 - RNA, 18 nt, Human
aacaaauuuacagagaca

SEQ ID NO: 3245523 - RNA, 12 nt, Human
aacacaucagcu

SEQ ID NO: 3245524 - RNA, 16 nt, Human
aacacaucagcuugcc

SEQ ID NO: 3245525 - RNA, 19 nt, Human
aaauugacacuuaaaaaug

SEQ ID NO: 3245526 - RNA, 22 nt, Human
aaauguuguucucuucuuuaaa

SEQ ID NO: 3245527 - RNA, 17 nt, Human
aaaucuuauaauuuaaa

SEQ ID NO: 3245528 - RNA, 16 nt, Human
aacccgggaggcagag

SEQ ID NO: 3245529 - RNA, 22 nt, Human
aaccacuggaaaguuuaugguu

SEQ ID NO: 3245530 - RNA, 20 nt, Human
aagcagauggaaugcugugu

SEQ ID NO: 3245531 - RNA, 17 nt, Human
aagcagauggaaugcug

SEQ ID NO: 3245532 - RNA, 19 nt, Human
aagcagauggaaugcugug

SEQ ID NO: 3245533 - RNA, 20 nt, Human
aaggcagcucuaaaugucaa

SEQ ID NO: 3245534 - RNA, 23 nt, Human
aagggaaacugccagcaacgcag

SEQ ID NO: 3245535 - RNA, 16 nt, Human
aagggaaacugccagc

SEQ ID NO: 3245536 - RNA, 17 nt, Human
aagggaaacugccagca

SEQ ID NO: 3245537 - RNA, 18 nt, Human
aaguccaagcauuuagau

SEQ ID NO: 3245538 - RNA, 17 nt, Human
aaguccaagcauaccaa

SEQ ID NO: 3245539 - RNA, 21 nt, Human
aaguagggacuucugucuuca

SEQ ID NO: 3245540 - RNA, 21 nt, Human
aaugauuaugaauuacauuug

SEQ ID NO: 3245541 - RNA, 15 nt, Human
aaugauuaugaauua

SEQ ID NO: 3245542 - RNA, 15 nt, Human
aaucaagaaacuuaa

SEQ ID NO: 3245543 - RNA, 15 nt, Human
aaucaccaaaggcuc

SEQ ID NO: 3245544 - RNA, 15 nt, Human
aauauguuucaaacu

SEQ ID NO: 3245545 - RNA, 13 nt, Human
aauauguuucaaa

SEQ ID NO: 3245546 - RNA, 17 nt, Human
aauauguuucaaacuuu

SEQ ID NO: 3245547 - RNA, 16 nt, Human
aauauguuucaaacuu

SEQ ID NO: 3245548 - RNA, 23 nt, Human
aauguuucaaacauauauaacaa

SEQ ID NO: 3245549 - RNA, 21 nt, Human
aaugcuagguuaauuccaauu

SEQ ID NO: 3245550 - RNA, 18 nt, Human
aaugcuagguuaauucca

SEQ ID NO: 3245551 - RNA, 19 nt, Human
aaugcuagguuaauuccaa

SEQ ID NO: 3245552 - RNA, 22 nt, Human
caaugaaugaaugaauggcuaa

SEQ ID NO: 3245553 - RNA, 21 nt, Human
caauaucuuuuuuuuaauaaa

SEQ ID NO: 3245554 - RNA, 11 nt, Human
cacaacagauu

SEQ ID NO: 3245555 - RNA, 19 nt, Human
cacacucaaaucaagaaac

SEQ ID NO: 3245556 - RNA, 14 nt, Human
cacacugaagaagc

SEQ ID NO: 3245557 - RNA, 14 nt, Human
cacaacuauuuuuc

SEQ ID NO: 3245558 - RNA, 19 nt, Human
cacaacuauuuuuccaaaa

SEQ ID NO: 3245559 - RNA, 13 nt, Human
cacaacuauauug

SEQ ID NO: 3245560 - RNA, 22 nt, Human
cacagcaguugaaaagacucca

SEQ ID NO: 3245561 - RNA, 19 nt, Human
cacaggaaccacaagacug

SEQ ID NO: 3245562 - RNA, 20 nt, Human
cacaggaaccacaagacugc

SEQ ID NO: 3245563 - RNA, 14 nt, Human
cacaguuuucugag

SEQ ID NO: 3245564 - RNA, 23 nt, Human
cacauaucuaguaugaaauuaua

SEQ ID NO: 3245565 - RNA, 20 nt, Human
caaggaaaaaauaacaauga

SEQ ID NO: 3245566 - RNA, 17 nt, Human
caagcacuaaacaaaga

SEQ ID NO: 3245567 - RNA, 15 nt, Human
caaauuuacagagac

SEQ ID NO: 3245568 - RNA, 14 nt, Human
caaauuuacagaga

SEQ ID NO: 3245569 - RNA, 15 nt, Human
caaauugugugaaag

SEQ ID NO: 3245570 - RNA, 12 nt, Human
caacuuuauacc

SEQ ID NO: 3245571 - RNA, 18 nt, Human
caagaaaacaacuucaau

SEQ ID NO: 3245572 - RNA, 23 nt, Human
caaaaaaauauauuuaaugauaa

SEQ ID NO: 3245573 - RNA, 16 nt, Human
caaauaugcaaagcac

SEQ ID NO: 3245574 - RNA, 17 nt, Human
caaauaugcaaagcacu

SEQ ID NO: 3245575 - RNA, 18 nt, Human
caaauaugcaaagcacug

SEQ ID NO: 3245576 - RNA, 20 nt, Human
caaauguucaucaaugaaug

SEQ ID NO: 3245577 - RNA, 21 nt, Human
caaauguucaucaaugaauga

SEQ ID NO: 3245578 - RNA, 14 nt, Human
caaauaugcaaagc

SEQ ID NO: 3245579 - RNA, 14 nt, Human
cuaagagagaauga

SEQ ID NO: 3245580 - RNA, 15 nt, Human
cuaagagagaaugag

SEQ ID NO: 3245581 - RNA, 16 nt, Human
cuaagauaguaacaau

SEQ ID NO: 3245582 - RNA, 19 nt, Human
cuaaauugacacuuaaaaa

SEQ ID NO: 3245583 - RNA, 13 nt, Human
cuaaauuuuauau

SEQ ID NO: 3245584 - RNA, 16 nt, Human
cuaaauuuuauaucuu

SEQ ID NO: 3245585 - RNA, 15 nt, Human
cuaaauuuuauaucu

SEQ ID NO: 3245586 - RNA, 20 nt, Human
cuaaauuuuauaucuuguag

SEQ ID NO: 3245587 - RNA, 20 nt, Human
cgggaggcagagguugcagu

SEQ ID NO: 3245588 - RNA, 14 nt, Human
cuacacuaagagag

SEQ ID NO: 3245589 - RNA, 23 nt, Human
cuacacgagauacagaauuuuau

SEQ ID NO: 3245590 - RNA, 14 nt, Human
cuaaguaaaaccac

SEQ ID NO: 3245591 - RNA, 18 nt, Human
cuaaguaaaaccacagca

SEQ ID NO: 3245592 - RNA, 19 nt, Human
cuaaguaaaaccacagcag

SEQ ID NO: 3245593 - RNA, 21 nt, Human
cuaagcuucacuguaaaauaa

SEQ ID NO: 3245594 - RNA, 12 nt, Human
cuauaauuuaaa

SEQ ID NO: 3245595 - RNA, 18 nt, Human
cuaugaaauauuauguua

SEQ ID NO: 3245596 - RNA, 19 nt, Human
cuaugaaauauuauguuaa

SEQ ID NO: 3245597 - RNA, 21 nt, Human
cuauucaggagaguagaacag

SEQ ID NO: 3245598 - RNA, 14 nt, Human
cuaggaaauauuua

SEQ ID NO: 3245599 - RNA, 15 nt, Human
cuaggaaauauuuau

SEQ ID NO: 3245600 - RNA, 19 nt, Human
cuaggaaauauuuauuuua

SEQ ID NO: 3245601 - RNA, 20 nt, Human
cuaggaaauauuuauuuuaa

SEQ ID NO: 3245602 - RNA, 22 nt, Human
cuagcuaauguaauaacuguga

SEQ ID NO: 3245603 - RNA, 18 nt, Human
cuagaguuuagcuggaaa

SEQ ID NO: 3245604 - RNA, 19 nt, Human
cuagaguuuagcuggaaaa

SEQ ID NO: 3245605 - RNA, 22 nt, Human
cucaggaaaucaaauaugcaaa

SEQ ID NO: 3245606 - RNA, 14 nt, Human
cuccccucggagaa

SEQ ID NO: 3245607 - RNA, 17 nt, Human
cucauuuccaagcaagu

SEQ ID NO: 3245608 - RNA, 13 nt, Human
cucauuuccaagc

SEQ ID NO: 3245609 - RNA, 14 nt, Human
cucauuuccaagca

SEQ ID NO: 3245610 - RNA, 12 nt, Human
cucauuuccaag

SEQ ID NO: 3245611 - RNA, 17 nt, Human
ccugccccugagcccau

SEQ ID NO: 3245612 - RNA, 14 nt, Human
ccugaggcuccacu

SEQ ID NO: 3245613 - RNA, 13 nt, Human
ccugaggcuccac

SEQ ID NO: 3245614 - RNA, 15 nt, Human
ccuuggacucauuuu

SEQ ID NO: 3245615 - RNA, 18 nt, Human
ccuucggccuccauccug

SEQ ID NO: 3245616 - RNA, 17 nt, Human
ccuucggccuccauccu

SEQ ID NO: 3245617 - RNA, 16 nt, Human
ccuucggccuccaucc

SEQ ID NO: 3245618 - RNA, 23 nt, Human
cgaagaguauuuuugacagaaua

SEQ ID NO: 3245619 - RNA, 15 nt, Human
ccccucggagaagag

SEQ ID NO: 3245620 - RNA, 14 nt, Human
ccagacaucaacag

SEQ ID NO: 3245621 - RNA, 15 nt, Human
ccacugguucuucuu

SEQ ID NO: 3245622 - RNA, 19 nt, Human
ccagccugagcgacaguga

SEQ ID NO: 3245623 - RNA, 18 nt, Human
ccauccugaggcuccacu

SEQ ID NO: 3245624 - RNA, 20 nt, Human
ccauccugaggcuccacuug

SEQ ID NO: 3245625 - RNA, 16 nt, Human
ccauccugaggcucca

SEQ ID NO: 3245626 - RNA, 12 nt, Human
ccaggugccagu

SEQ ID NO: 3245627 - RNA, 23 nt, Human
ccagugaauucuugaaggaaaau

SEQ ID NO: 3245628 - RNA, 20 nt, Human
ccagguagaggguguguaag

SEQ ID NO: 3245629 - RNA, 22 nt, Human
cuggccuucggccuccauccug

SEQ ID NO: 3245630 - RNA, 23 nt, Human
cuggccuucggccuccauccuga

SEQ ID NO: 3245631 - RNA, 20 nt, Human
cuggcacaguuuucugagaa

SEQ ID NO: 3245632 - RNA, 21 nt, Human
cuggcacaguuuucugagaaa

SEQ ID NO: 3245633 - RNA, 22 nt, Human
cuggcacaguuuucugagaaag

SEQ ID NO: 3245634 - RNA, 16 nt, Human
cuggagcucugcccau

SEQ ID NO: 3245635 - RNA, 13 nt, Human
cuggagcucugcc

SEQ ID NO: 3245636 - RNA, 12 nt, Human
cuggagcucugc

SEQ ID NO: 3245637 - RNA, 18 nt, Human
cugcugaaacaacaaaua

SEQ ID NO: 3245638 - RNA, 22 nt, Human
cuguauuuuaaaagaaugauua

SEQ ID NO: 3245639 - RNA, 20 nt, Human
cuguauuuuaaaagaaugau

SEQ ID NO: 3245640 - RNA, 19 nt, Human
cuguauuuuaaaagaauga

SEQ ID NO: 3245641 - RNA, 20 nt, Human
cugucuacacuaagagagaa

SEQ ID NO: 3245642 - RNA, 23 nt, Human
cuguaaucacagcuacuugggag

SEQ ID NO: 3245643 - RNA, 22 nt, Human
cugggggggauuguaaaauggu

SEQ ID NO: 3245644 - RNA, 20 nt, Human
cuguuaaaagaugaaaauau

SEQ ID NO: 3245645 - RNA, 21 nt, Human
cuguuaaaagaugaaaauauu

SEQ ID NO: 3245646 - RNA, 23 nt, Human
cuguuaaaagaugaaaauauuug

SEQ ID NO: 3245647 - RNA, 20 nt, Human
cuugaacccgggaggcagag

SEQ ID NO: 3245648 - RNA, 14 nt, Human
cuucugugaaagua

SEQ ID NO: 3245649 - RNA, 18 nt, Human
cuucugucuucacaacag

SEQ ID NO: 3245650 - RNA, 21 nt, Human
cuucugucuucacaacagauu

SEQ ID NO: 3245651 - RNA, 22 nt, Human
cuucugucuucacaacagauua

SEQ ID NO: 3245652 - RNA, 14 nt, Human
cuuauuucauuucu

SEQ ID NO: 3245653 - RNA, 15 nt, Human
cuuauuucauuucuu

SEQ ID NO: 3245654 - RNA, 20 nt, Human
cuuagaugcaguucugaaga

SEQ ID NO: 3245655 - RNA, 22 nt, Human
cuuagaugcaguucugaagaag

SEQ ID NO: 3245656 - RNA, 14 nt, Human
gaaagcagggacuu

SEQ ID NO: 3245657 - RNA, 17 nt, Human
gaaagagaacuuccaga

SEQ ID NO: 3245658 - RNA, 20 nt, Human
gaaagaggcagcuugaaacu

SEQ ID NO: 3245659 - RNA, 21 nt, Human
gaaagaggaaugaaguacuca

SEQ ID NO: 3245660 - RNA, 17 nt, Human
gaaagcagaacagugau

SEQ ID NO: 3245661 - RNA, 14 nt, Human
gaaagcagaacagu

SEQ ID NO: 3245662 - RNA, 22 nt, Human
gaaagcagaacagugauuacca

SEQ ID NO: 3245663 - RNA, 23 nt, Human
gaaacucguuaauuuguaguguu

SEQ ID NO: 3245664 - RNA, 14 nt, Human
gaaacccugucucu

SEQ ID NO: 3245665 - RNA, 20 nt, Human
gaaaaugauacgcaacauaa

SEQ ID NO: 3245666 - RNA, 11 nt, Human
gaaacauuugg

SEQ ID NO: 3245667 - RNA, 16 nt, Human
gaaacacaacuauauu

SEQ ID NO: 3245668 - RNA, 22 nt, Human
gaaaaucuacacuccagugaga

SEQ ID NO: 3245669 - RNA, 18 nt, Human
gaaaauauuuguaucaca

SEQ ID NO: 3245670 - RNA, 21 nt, Human
gaaaauauuauguguuuccau

SEQ ID NO: 3245671 - RNA, 19 nt, Human
cuugaguuuaaauuguaau

SEQ ID NO: 3245672 - RNA, 23 nt, Human
cuugucaauaaaauccauacauu

SEQ ID NO: 3245673 - RNA, 22 nt, Human
cuuuaucaaagggugaaaauua

SEQ ID NO: 3245674 - RNA, 21 nt, Human
cuuuaucaaagggugaaaauu

SEQ ID NO: 3245675 - RNA, 16 nt, Human
cuuucugcuuguguua

SEQ ID NO: 3245676 - RNA, 19 nt, Human
gauguugaaaaaguucugc

SEQ ID NO: 3245677 - RNA, 20 nt, Human
gaugcuagaacucccuuuca

SEQ ID NO: 3245678 - RNA, 18 nt, Human
gaugcuagaacucccuuu

SEQ ID NO: 3245679 - RNA, 16 nt, Human
gcaaauugucacagga

SEQ ID NO: 3245680 - RNA, 21 nt, Human
gcaaagcugaugacaacuucc

SEQ ID NO: 3245681 - RNA, 14 nt, Human
gcaauuucauaugc

SEQ ID NO: 3245682 - RNA, 15 nt, Human
gcacugacuucuaag

SEQ ID NO: 3245683 - RNA, 18 nt, Human
gcacugacuucuaaguaa

SEQ ID NO: 3245684 - RNA, 23 nt, Human
gagugaacaaauuuacagagaca

SEQ ID NO: 3245685 - RNA, 18 nt, Human
gaguguacuuaacuauuc

SEQ ID NO: 3245686 - RNA, 20 nt, Human
gacauagaauuaacacauga

SEQ ID NO: 3245687 - RNA, 17 nt, Human
gacagggaggacgcucu

SEQ ID NO: 3245688 - RNA, 18 nt, Human
gacagggaggacgcucuc

SEQ ID NO: 3245689 - RNA, 15 nt, Human
gacccacaagaaaug

SEQ ID NO: 3245690 - RNA, 16 nt, Human
gacccaaaaggcagaa

SEQ ID NO: 3245691 - RNA, 20 nt, Human
gacccaaaaggcagaagcaa

SEQ ID NO: 3245692 - RNA, 18 nt, Human
gaccacugcagaagacag

SEQ ID NO: 3245693 - RNA, 21 nt, Human
gaccacugcagaagacaguau

SEQ ID NO: 3245694 - RNA, 16 nt, Human
gacaugggacauuugc

SEQ ID NO: 3245695 - RNA, 15 nt, Human
gacaagcucacagac

SEQ ID NO: 3245696 - RNA, 16 nt, Human
gacaaggaaaaaauaa

SEQ ID NO: 3245697 - RNA, 13 nt, Human
gacacaacuauuu

SEQ ID NO: 3245698 - RNA, 16 nt, Human
gaauuggagcucgugg

SEQ ID NO: 3245699 - RNA, 21 nt, Human
gaauugacccacaagaaauga

SEQ ID NO: 3245700 - RNA, 16 nt, Human
gaauugacccacaaga

SEQ ID NO: 3245701 - RNA, 18 nt, Human
gaauucuugaaggaaaau

SEQ ID NO: 3245702 - RNA, 15 nt, Human
gaauguuaagcagau

SEQ ID NO: 3245703 - RNA, 14 nt, Human
gaauguuaagcaga

SEQ ID NO: 3245704 - RNA, 14 nt, Human
gaaugcuguguuaa

SEQ ID NO: 3245705 - RNA, 13 nt, Human
gaaugcuguguua

SEQ ID NO: 3245706 - RNA, 19 nt, Human
gaaucucauaauuuauaca

SEQ ID NO: 3245707 - RNA, 18 nt, Human
gaaucucauaauuuauac

SEQ ID NO: 3245708 - RNA, 21 nt, Human
gacucauuuuaaaaaauggaa

SEQ ID NO: 3245709 - RNA, 11 nt, Human
gacuccaaaga

SEQ ID NO: 3245710 - RNA, 12 nt, Human
gacuccaaagaa

SEQ ID NO: 3245711 - RNA, 15 nt, Human
gacuccaaagaaaug

SEQ ID NO: 3245712 - RNA, 16 nt, Human
gacuccaaagaaaugu

SEQ ID NO: 3245713 - RNA, 14 nt, Human
gacugcauuauauu

SEQ ID NO: 3245714 - RNA, 16 nt, Human
gacugcauuauauuua

SEQ ID NO: 3245715 - RNA, 17 nt, Human
gacuucuaaguaaaacc

SEQ ID NO: 3245716 - RNA, 18 nt, Human
gacuucuaaguaaaacca

SEQ ID NO: 3245717 - RNA, 16 nt, Human
gacuucuaaguaaaac

SEQ ID NO: 3245718 - RNA, 19 nt, Human
gacuucuaaguaaaaccac

SEQ ID NO: 3245719 - RNA, 23 nt, Human
gacuucuaaguaaaaccacagca

SEQ ID NO: 3245720 - RNA, 24 nt, Human
gacuucuaaguaaaaccacagcag

SEQ ID NO: 3245721 - RNA, 20 nt, Human
gacuucugucuucacaacag

SEQ ID NO: 3245722 - RNA, 23 nt, Human
gacuucugucuucacaacagauu

SEQ ID NO: 3245723 - RNA, 17 nt, Human
gagaaugagagacacac

SEQ ID NO: 3245724 - RNA, 22 nt, Human
gagaacuuccagauccuggaaa

SEQ ID NO: 3245725 - RNA, 23 nt, Human
gagaacuuccagauccuggaaau

SEQ ID NO: 3245726 - RNA, 21 nt, Human
gagaaccuagggugauauuaa

SEQ ID NO: 3245727 - RNA, 22 nt, Human
gagaaccuagggugauauuaac

SEQ ID NO: 3245728 - RNA, 19 nt, Human
gagagacacacugaagaag

SEQ ID NO: 3245729 - RNA, 15 nt, Human
gagaguagaacagau

SEQ ID NO: 3245730 - RNA, 20 nt, Human
gagaaugagagacacacuga

SEQ ID NO: 3245731 - RNA, 20 nt, Human
gagacagcucugcauacuca

SEQ ID NO: 3245732 - RNA, 18 nt, Human
gagacagcucugcauacu

SEQ ID NO: 3245733 - RNA, 13 nt, Human
gagcaaagcugau

SEQ ID NO: 3245734 - RNA, 17 nt, Human
gccuaagugcagccccg

SEQ ID NO: 3245735 - RNA, 22 nt, Human
gccuauauuuuuuguuaaauga

SEQ ID NO: 3245736 - RNA, 15 nt, Human
gccugcaauuucaua

SEQ ID NO: 3245737 - RNA, 11 nt, Human
gcucucuggcc

SEQ ID NO: 3245738 - RNA, 13 nt, Human
gcucucuggccuu

SEQ ID NO: 3245739 - RNA, 12 nt, Human
gcucucuggccu

SEQ ID NO: 3245740 - RNA, 20 nt, Human
gcucucuggccuucggccuc

SEQ ID NO: 3245741 - RNA, 19 nt, Human
gcucucuggccuucggccu

SEQ ID NO: 3245742 - RNA, 15 nt, Human
gcucucuggccuucg

SEQ ID NO: 3245743 - RNA, 14 nt, Human
gcucucuggccuuc

SEQ ID NO: 3245744 - RNA, 17 nt, Human
gcuaagcaaaaugugau

SEQ ID NO: 3245745 - RNA, 14 nt, Human
gcuaagcauuccaa

SEQ ID NO: 3245746 - RNA, 14 nt, Human
ggcauggcugggaa

SEQ ID NO: 3245747 - RNA, 20 nt, Human
gcugucuacacuaagagaga

SEQ ID NO: 3245748 - RNA, 17 nt, Human
ggaaaucaaauaugcaa

SEQ ID NO: 3245749 - RNA, 16 nt, Human
ggaaaucaaauaugca

SEQ ID NO: 3245750 - RNA, 14 nt, Human
ggacgcucucuggc

SEQ ID NO: 3245751 - RNA, 13 nt, Human
ggacgcucucugg

SEQ ID NO: 3245752 - RNA, 19 nt, Human
ggagaaucacuugaacccg

SEQ ID NO: 3245753 - RNA, 15 nt, Human
ggagaaucacuugaa

SEQ ID NO: 3245754 - RNA, 23 nt, Human
ggaauuucucccagucauuuaau

SEQ ID NO: 3245755 - RNA, 16 nt, Human
ggaauuggagcucgug

SEQ ID NO: 3245756 - RNA, 22 nt, Human
ggaauuggagcucgugggacag

SEQ ID NO: 3245757 - RNA, 14 nt, Human
ggaaugcuguguua

SEQ ID NO: 3245758 - RNA, 20 nt, Human
ggaagugacgguuuaauggg

SEQ ID NO: 3245759 - RNA, 18 nt, Human
guaagggaaacugccagc

SEQ ID NO: 3245760 - RNA, 17 nt, Human
guaagggaaacugccag

SEQ ID NO: 3245761 - RNA, 15 nt, Human
guaaauaguauuuga

SEQ ID NO: 3245762 - RNA, 16 nt, Human
guaaauaguauuugag

SEQ ID NO: 3245763 - RNA, 17 nt, Human
guaaauaguauuugaga

SEQ ID NO: 3245764 - RNA, 14 nt, Human
guaaaaccacagca

SEQ ID NO: 3245765 - RNA, 15 nt, Human
guaaaaccacagcag

SEQ ID NO: 3245766 - RNA, 16 nt, Human
guaaaaccacagcagu

SEQ ID NO: 3245767 - RNA, 18 nt, Human
guaaaaccacagcaguug

SEQ ID NO: 3245768 - RNA, 23 nt, Human
guaaaaccacagcaguugaaaag

SEQ ID NO: 3245769 - RNA, 15 nt, Human
guaccgcaaugugac

SEQ ID NO: 3245770 - RNA, 15 nt, Human
guacuucaugcuguc

SEQ ID NO: 3245771 - RNA, 15 nt, Human
guacgaagaguauuu

SEQ ID NO: 3245772 - RNA, 15 nt, Human
guagaggagaaacug

SEQ ID NO: 3245773 - RNA, 23 nt, Human
guacuuuauuuucuauaauuuaa

SEQ ID NO: 3245774 - RNA, 23 nt, Human
guacacugccuucucaacuccaa

SEQ ID NO: 3245775 - RNA, 19 nt, Human
guaaugauaacuggaaacu

SEQ ID NO: 3245776 - RNA, 13 nt, Human
guaauucaagaaa

SEQ ID NO: 3245777 - RNA, 14 nt, Human
guaauucaagaaaa

SEQ ID NO: 3245778 - RNA, 15 nt, Human
guaauuggaaaggca

SEQ ID NO: 3245779 - RNA, 22 nt, Human
gguagacacacaugaaguccaa

SEQ ID NO: 3245780 - RNA, 15 nt, Human
gguagacacacauga

SEQ ID NO: 3245781 - RNA, 22 nt, Human
gguacuucaaauccuugaagau

SEQ ID NO: 3245782 - RNA, 19 nt, Human
ggugcuacaaaaacacagc

SEQ ID NO: 3245783 - RNA, 23 nt, Human
gucuacacuaagagagaaugaga

SEQ ID NO: 3245784 - RNA, 17 nt, Human
gucuacacuaagagaga

SEQ ID NO: 3245785 - RNA, 23 nt, Human
gucuaagauaguaacaaugaaga

SEQ ID NO: 3245786 - RNA, 16 nt, Human
guauuuuaaaagaaug

SEQ ID NO: 3245787 - RNA, 17 nt, Human
guauuuuaaaagaauga

SEQ ID NO: 3245788 - RNA, 14 nt, Human
gucaccucauggaa

SEQ ID NO: 3245789 - RNA, 15 nt, Human
gucaauaaaauccau

SEQ ID NO: 3245790 - RNA, 21 nt, Human
gucaauaaaauccauacauuu

SEQ ID NO: 3245791 - RNA, 22 nt, Human
guauuucuaugaaauauuaugu

SEQ ID NO: 3245792 - RNA, 17 nt, Human
guauuucuaugaaauau

SEQ ID NO: 3245793 - RNA, 19 nt, Human
guauuugagaguucuaaau

SEQ ID NO: 3245794 - RNA, 21 nt, Human
guauuugagaguucuaaauuu

SEQ ID NO: 3245795 - RNA, 15 nt, Human
gugaaaauuauuuug

SEQ ID NO: 3245796 - RNA, 12 nt, Human
gugaaaauuauu

SEQ ID NO: 3245797 - RNA, 19 nt, Human
gugaaagaaaauaacaaua

SEQ ID NO: 3245798 - RNA, 20 nt, Human
gugaaacucguuaauuugua

SEQ ID NO: 3245799 - RNA, 17 nt, Human
gugaaaguacauuugga

SEQ ID NO: 3245800 - RNA, 16 nt, Human
gugagcagucaggaaa

SEQ ID NO: 3245801 - RNA, 14 nt, Human
gugagcuacaaaug

SEQ ID NO: 3245802 - RNA, 18 nt, Human
gugcaaauugucacagga

SEQ ID NO: 3245803 - RNA, 20 nt, Human
ugcugggggggauuguaaaa

SEQ ID NO: 3245804 - RNA, 11 nt, Human
ugcuguguuaa

SEQ ID NO: 3245805 - RNA, 18 nt, Human
ugcuguguuaaauaaacc

SEQ ID NO: 3245806 - RNA, 17 nt, Human
ugcuagaacucccuuuc

SEQ ID NO: 3245807 - RNA, 15 nt, Human
ugcuagaacucccuu

SEQ ID NO: 3245808 - RNA, 14 nt, Human
ugcuagaacucccu

SEQ ID NO: 3245809 - RNA, 13 nt, Human
ugcuagaacuccc

SEQ ID NO: 3245810 - RNA, 13 nt, Human
ugcaucagcugcu

SEQ ID NO: 3245811 - RNA, 16 nt, Human
ugccacuaaauugaca

SEQ ID NO: 3245812 - RNA, 22 nt, Human
ugcaucaauuuuucuuauuuca

SEQ ID NO: 3245813 - RNA, 12 nt, Human
ugcaguucugaa

SEQ ID NO: 3245814 - RNA, 16 nt, Human
ugcauagguuuagcag

SEQ ID NO: 3245815 - RNA, 15 nt, Human
uggcacuaguauuuc

SEQ ID NO: 3245816 - RNA, 20 nt, Human
uggcaauagucaaauugugu

SEQ ID NO: 3245817 - RNA, 13 nt, Human
ugguauguuuuca

SEQ ID NO: 3245818 - RNA, 17 nt, Human
uggucacaggaaguaga

SEQ ID NO: 3245819 - RNA, 22 nt, Human
uggucacaggaaguagaggagg

SEQ ID NO: 3245820 - RNA, 19 nt, Human
ucuuuccacagaagcucca

SEQ ID NO: 3245821 - RNA, 12 nt, Human
ucuuugccaagu

SEQ ID NO: 3245822 - RNA, 17 nt, Human
ucuuucacauuuaaaua

SEQ ID NO: 3245823 - RNA, 15 nt, Human
ugaaagguacuucaa

SEQ ID NO: 3245824 - RNA, 16 nt, Human
ugaaagguacuucaaa

SEQ ID NO: 3245825 - RNA, 23 nt, Human
ugaaagcagggacuugaacccau

SEQ ID NO: 3245826 - RNA, 18 nt, Human
ugaaagaggaaugaagua

SEQ ID NO: 3245827 - RNA, 18 nt, Human
ugaaagaggcagcuugaa

SEQ ID NO: 3245828 - RNA, 22 nt, Human
ugaaacaacaaauaggaauugu

SEQ ID NO: 3245829 - RNA, 18 nt, Human
ugaaauauuauguuaaaa

SEQ ID NO: 3245830 - RNA, 16 nt, Human
ugaaauauugacuuuu

SEQ ID NO: 3245831 - RNA, 19 nt, Human
ugaaauggacuuuuguaca

SEQ ID NO: 3245832 - RNA, 11 nt, Human
ugaaguccaag

SEQ ID NO: 3245833 - RNA, 15 nt, Human
ugaauuacauuugua

SEQ ID NO: 3245834 - RNA, 16 nt, Human
ugaauuacauuuguau

SEQ ID NO: 3245835 - RNA, 18 nt, Human
ugaauuacauuuguauaa

SEQ ID NO: 3245836 - RNA, 14 nt, Human
ugaauuacauuugu

SEQ ID NO: 3245837 - RNA, 20 nt, Human
ugaaugaauggcuaagcaaa

SEQ ID NO: 3245838 - RNA, 18 nt, Human
ugacaugggacauuugcu

SEQ ID NO: 3245839 - RNA, 16 nt, Human
ugacaugggacauuug

SEQ ID NO: 3245840 - RNA, 17 nt, Human
ugacaugggacauuugc

SEQ ID NO: 3245841 - RNA, 20 nt, Human
ugaccacugcagaagacagu

SEQ ID NO: 3245842 - RNA, 18 nt, Human
ugaccacugcagaagaca

SEQ ID NO: 3245843 - RNA, 15 nt, Human
ugacaagcucacaga

SEQ ID NO: 3245844 - RNA, 20 nt, Human
ugacaagcucacagaccuuu

SEQ ID NO: 3245845 - RNA, 12 nt, Human
ugacaagcucac

SEQ ID NO: 3245846 - RNA, 16 nt, Human
ugacagaauauguuuc

SEQ ID NO: 3245847 - RNA, 24 nt, Human
ugaucagcuuauugucuagugaaa

SEQ ID NO: 3245848 - RNA, 17 nt, Human
ugaucagcuuauugucu

SEQ ID NO: 3245849 - RNA, 14 nt, Human
ugaucuuuaaaaua

SEQ ID NO: 3245850 - RNA, 17 nt, Human
ugaucuuuaaaauacac

SEQ ID NO: 3245851 - RNA, 20 nt, Human
ugaugcuacaggauuugaaa

SEQ ID NO: 3245852 - RNA, 15 nt, Human
ugauggugguauguu

SEQ ID NO: 3245853 - RNA, 21 nt, Human
ugauguauucuagcuaaugua

SEQ ID NO: 3245854 - RNA, 14 nt, Human
ugauguguuuauuu

SEQ ID NO: 3245855 - RNA, 18 nt, Human
ugauguguuuauuuauag

SEQ ID NO: 3245856 - RNA, 21 nt, Human
ugauuaugaauuacauuugua

SEQ ID NO: 3245857 - RNA, 22 nt, Human
ugauuaugaauuacauuuguau

SEQ ID NO: 3245858 - RNA, 16 nt, Human
ugauuaccagggacug

SEQ ID NO: 3245859 - RNA, 13 nt, Human
ugauuauauguca

SEQ ID NO: 3245860 - RNA, 17 nt, Human
ugauuaugaauuacauu

SEQ ID NO: 3245861 - RNA, 19 nt, Human
ugauuaugaauuacauuug

SEQ ID NO: 3245862 - RNA, 16 nt, Human
ugauaacuggaaacuu

SEQ ID NO: 3245863 - RNA, 22 nt, Human
ugaguucuacauaaguaauuca

SEQ ID NO: 3245864 - RNA, 20 nt, Human
ugaggcuccacuuggucugu

SEQ ID NO: 3245865 - RNA, 18 nt, Human
ugaggcuccacuuggucu

SEQ ID NO: 3245866 - RNA, 16 nt, Human
ugagagugaacaaauu

SEQ ID NO: 3245867 - RNA, 23 nt, Human
ugagacguuuuuggaagaguagu

SEQ ID NO: 3245868 - RNA, 13 nt, Human
ugagccccaaaag

SEQ ID NO: 3245869 - RNA, 12 nt, Human
uccauacauuug

SEQ ID NO: 3245870 - RNA, 19 nt, Human
uccagguagagggugugua

SEQ ID NO: 3245871 - RNA, 15 nt, Human
uccauacauuugugu

SEQ ID NO: 3245872 - RNA, 17 nt, Human
uccacuuggucugugag

SEQ ID NO: 3245873 - RNA, 21 nt, Human
uccacuuggucugugagaugc

SEQ ID NO: 3245874 - RNA, 23 nt, Human
uccacuuggucugugagaugcua

SEQ ID NO: 3245875 - RNA, 11 nt, Human
ucauagcagcu

SEQ ID NO: 3245876 - RNA, 17 nt, Human
ucaucaaugaaugaaug

SEQ ID NO: 3245877 - RNA, 16 nt, Human
ucauuaggauggcuag

SEQ ID NO: 3245878 - RNA, 12 nt, Human
uccaaagaaaug

SEQ ID NO: 3245879 - RNA, 14 nt, Human
uccaaagaaaugua

SEQ ID NO: 3245880 - RNA, 17 nt, Human
uccaaagaaauguaagg

SEQ ID NO: 3245881 - RNA, 16 nt, Human
uccaaaccaaauaaaa

SEQ ID NO: 3245882 - RNA, 22 nt, Human
uccaaaaagauuuucagaaaau

SEQ ID NO: 3245883 - RNA, 20 nt, Human
uccaaaaagauuuucagaaa

SEQ ID NO: 3245884 - RNA, 14 nt, Human
uccuagugaaagag

SEQ ID NO: 3245885 - RNA, 23 nt, Human
uccuagugaaagaggcagcuuga

SEQ ID NO: 3245886 - RNA, 20 nt, Human
uccugaggcuccacuugguc

SEQ ID NO: 3245887 - RNA, 19 nt, Human
uccugaggcuccacuuggu

SEQ ID NO: 3245888 - RNA, 17 nt, Human
uccugaggcuccacuug

SEQ ID NO: 3245889 - RNA, 17 nt, Human
uccugccccugagccca

SEQ ID NO: 3245890 - RNA, 18 nt, Human
uccugccccugagcccau

SEQ ID NO: 3245891 - RNA, 14 nt, Human
ucggagaagagcug

SEQ ID NO: 3245892 - RNA, 16 nt, Human
ucggagaagagcuguu

SEQ ID NO: 3245893 - RNA, 12 nt, Human
ucggagaagagc

SEQ ID NO: 3245894 - RNA, 18 nt, Human
ucuaugaaauauuauguu

SEQ ID NO: 3245895 - RNA, 23 nt, Human
ucucaguccaugaagauguagag

SEQ ID NO: 3245896 - RNA, 23 nt, Human
ucucauaauuuauacaggucaua

SEQ ID NO: 3245897 - RNA, 17 nt, Human
uauguucuaagaaguga

SEQ ID NO: 3245898 - RNA, 19 nt, Human
uauguuagugcaaauuguc

SEQ ID NO: 3245899 - RNA, 12 nt, Human
uauguuaaaacu

SEQ ID NO: 3245900 - RNA, 19 nt, Human
uauggaggcuuugcauaga

SEQ ID NO: 3245901 - RNA, 12 nt, Human
uauuauguguuu

SEQ ID NO: 3245902 - RNA, 16 nt, Human
uauuauguuaaaacug

SEQ ID NO: 3245903 - RNA, 17 nt, Human
uauuauauuuacaaaug

SEQ ID NO: 3245904 - RNA, 16 nt, Human
uauuguuuaaaaucau

SEQ ID NO: 3245905 - RNA, 17 nt, Human
uauuguuuaaaaucauu

SEQ ID NO: 3245906 - RNA, 15 nt, Human
uauuguuuaaaauca

SEQ ID NO: 3245907 - RNA, 23 nt, Human
uauugauaaguucauacauugua

SEQ ID NO: 3245908 - RNA, 16 nt, Human
uauugauaaguucaua

SEQ ID NO: 3245909 - RNA, 14 nt, Human
uauugauaaguuca

SEQ ID NO: 3245910 - RNA, 20 nt, Human
uauuguuuaaaaucauuucu

SEQ ID NO: 3245911 - RNA, 14 nt, Human
uauuuauuacugua

SEQ ID NO: 3245912 - RNA, 13 nt, Human
uauuuauuacugu

SEQ ID NO: 3245913 - RNA, 13 nt, Human
uauuucuaugaaa

SEQ ID NO: 3245914 - RNA, 14 nt, Human
uauuucuaugaaau

SEQ ID NO: 3245915 - RNA, 15 nt, Human
uauuucuaugaaaua

SEQ ID NO: 3245916 - RNA, 19 nt, Human
ucaacuccaaacugacucu

SEQ ID NO: 3245917 - RNA, 22 nt, Human
ucaacuccaaacugacucuuaa

SEQ ID NO: 3245918 - RNA, 22 nt, Human
ucaaacagucucaggaaaucaa

SEQ ID NO: 3245919 - RNA, 17 nt, Human
ucaaacauauauaacaa

SEQ ID NO: 3245920 - RNA, 18 nt, Human
ucaaauaugcaaagcacu

SEQ ID NO: 3245921 - RNA, 19 nt, Human
ucaaauaugcaaagcacug

SEQ ID NO: 3245922 - RNA, 16 nt, Human
ucaaauccuugaagau

SEQ ID NO: 3245923 - RNA, 15 nt, Human
ucaaauccuugaaga

SEQ ID NO: 3245924 - RNA, 16 nt, Human
ucaaauaugcaaagca

SEQ ID NO: 3245925 - RNA, 17 nt, Human
ucaaauaugcaaagcac

SEQ ID NO: 3245926 - RNA, 20 nt, Human
ucaaagagagaaaauaaaga

SEQ ID NO: 3245927 - RNA, 15 nt, Human
ucaaagagagaaaau

SEQ ID NO: 3245928 - RNA, 22 nt, Human
ucacaagacccaaaaggcagaa

SEQ ID NO: 3245929 - RNA, 18 nt, Human
ucacaagacccaaaaggc

SEQ ID NO: 3245930 - RNA, 12 nt, Human
ucacauuuaaau

SEQ ID NO: 3245931 - RNA, 13 nt, Human
uauaugcuucugu

SEQ ID NO: 3245932 - RNA, 13 nt, Human
uagucaaauugug

SEQ ID NO: 3245933 - RNA, 14 nt, Human
uagugcaaauuguc

SEQ ID NO: 3245934 - RNA, 15 nt, Human
uagugcaaauuguca

SEQ ID NO: 3245935 - RNA, 13 nt, Human
uaguaucaaaaga

SEQ ID NO: 3245936 - RNA, 18 nt, Human
uaguauuucuaugaaaua

SEQ ID NO: 3245937 - RNA, 19 nt, Human
uaguauuucuaugaaauau

SEQ ID NO: 3245938 - RNA, 13 nt, Human
uaguaugaaauua

SEQ ID NO: 3245939 - RNA, 23 nt, Human
uaguaugaaauuauauaaguauu

SEQ ID NO: 3245940 - RNA, 15 nt, Human
uaguaugaaauuaua

SEQ ID NO: 3245941 - RNA, 16 nt, Human
uaguauuucuaugaaa

SEQ ID NO: 3245942 - RNA, 16 nt, Human
uaggccaugggacagg

SEQ ID NO: 3245943 - RNA, 18 nt, Human
uaggccaugggacaggga

SEQ ID NO: 3245944 - RNA, 12 nt, Human
uaggaauugacc

SEQ ID NO: 3245945 - RNA, 16 nt, Human
uaggucagugcaaaua

SEQ ID NO: 3245946 - RNA, 17 nt, Human
uaugaauuacauuugua

SEQ ID NO: 3245947 - RNA, 23 nt, Human
uaugaauuacauuuguauaaaau

SEQ ID NO: 3245948 - RNA, 23 nt, Human
uaugacauaaaaacaacuuuaua

SEQ ID NO: 3245949 - RNA, 22 nt, Human
uaugacauaaaaacaacuuuau

SEQ ID NO: 3245950 - RNA, 19 nt, Human
uaugacauaaaaacaacuu

SEQ ID NO: 3245951 - RNA, 14 nt, Human
uauccuucagccug

SEQ ID NO: 3245952 - RNA, 15 nt, Human
uauccuucagccuga

SEQ ID NO: 3245953 - RNA, 17 nt, Human
uauccuuucuaacaaaa

SEQ ID NO: 3245954 - RNA, 15 nt, Human
uaugcuucuguuuua

SEQ ID NO: 3245955 - RNA, 16 nt, Human
uaugcuucuguuuuau

SEQ ID NO: 3245956 - RNA, 15 nt, Human
uaugcaaagcacuga

SEQ ID NO: 3245957 - RNA, 13 nt, Human
uaugcaaagcacu

SEQ ID NO: 3245958 - RNA, 14 nt, Human
uaugcaaagcacug

SEQ ID NO: 3245959 - RNA, 12 nt, Human
uaugcaaagcac

SEQ ID NO: 3245960 - RNA, 21 nt, Human
uaugauuaaguaaugauaacu

SEQ ID NO: 3245961 - RNA, 16 nt, Human
uaugauucccagccag

SEQ ID NO: 3245962 - RNA, 20 nt, Human
uuagaugcaguucugaagaa

SEQ ID NO: 3245963 - RNA, 21 nt, Human
uuagaugcaguucugaagaag

SEQ ID NO: 3245964 - RNA, 12 nt, Human
uuagcuggaaaa

SEQ ID NO: 3245965 - RNA, 13 nt, Human
uuagcuggaaaag

SEQ ID NO: 3245966 - RNA, 18 nt, Human
uuaggauguugaaaaagu

SEQ ID NO: 3245967 - RNA, 17 nt, Human
uuacuaguuucccuugc

SEQ ID NO: 3245968 - RNA, 14 nt, Human
uuaauauauuucca

SEQ ID NO: 3245969 - RNA, 13 nt, Human
uuaauauauuucc

SEQ ID NO: 3245970 - RNA, 21 nt, Human
uuaaugauaaguaaaugcuag

SEQ ID NO: 3245971 - RNA, 17 nt, Human
uuaaugauaaguaaaug

SEQ ID NO: 3245972 - RNA, 21 nt, Human
uuaagcagauggaaugcugug

SEQ ID NO: 3245973 - RNA, 21 nt, Human
uuaaaagaauauuuuaacuuc

SEQ ID NO: 3245974 - RNA, 22 nt, Human
uuaaaagaauauuuuaacuucc

SEQ ID NO: 3245975 - RNA, 19 nt, Human
uuaaaauacacacucaaau

SEQ ID NO: 3245976 - RNA, 15 nt, Human
uuaaaagaugaaaau

SEQ ID NO: 3245977 - RNA, 18 nt, Human
uuaaaagaugaaaauauu

SEQ ID NO: 3245978 - RNA, 21 nt, Human
uguuucaaacauauauaacaa

SEQ ID NO: 3245979 - RNA, 22 nt, Human
uguuucaaacauauauaacaau

SEQ ID NO: 3245980 - RNA, 19 nt, Human
uguuucaaacauauauaac

SEQ ID NO: 3245981 - RNA, 19 nt, Human
uuccagauccuggaaauca

SEQ ID NO: 3245982 - RNA, 13 nt, Human
uuccaaaauaauu

SEQ ID NO: 3245983 - RNA, 21 nt, Human
uuccaaaauaauuuuaagaaa

SEQ ID NO: 3245984 - RNA, 19 nt, Human
uucaugcauagguuuagca

SEQ ID NO: 3245985 - RNA, 12 nt, Human
uuccaaaauaau

SEQ ID NO: 3245986 - RNA, 22 nt, Human
uucggccuccauccugaggcuc

SEQ ID NO: 3245987 - RNA, 20 nt, Human
uuccuuggacucauuuuaaa

SEQ ID NO: 3245988 - RNA, 17 nt, Human
uuccuuggacucauuuu

SEQ ID NO: 3245989 - RNA, 20 nt, Human
uuccuucugugaaaguacau

SEQ ID NO: 3245990 - RNA, 17 nt, Human
uucccuugaugaagaag

SEQ ID NO: 3245991 - RNA, 15 nt, Human
uuauugucuagugaa

SEQ ID NO: 3245992 - RNA, 15 nt, Human
uuauuuuaauaaugu

SEQ ID NO: 3245993 - RNA, 16 nt, Human
uuauuuuaauaauguu

SEQ ID NO: 3245994 - RNA, 16 nt, Human
uucagacauagaauua

SEQ ID NO: 3245995 - RNA, 20 nt, Human
uucagacauagaauuaacac

SEQ ID NO: 3245996 - RNA, 17 nt, Human
uuauggcuauaggugcu

SEQ ID NO: 3245997 - RNA, 17 nt, Human
uuauuacuguaagaaaa

SEQ ID NO: 3245998 - RNA, 18 nt, Human
uuauuacuguaagaaaau

SEQ ID NO: 3245999 - RNA, 16 nt, Human
uuauuacuguaagaaa

SEQ ID NO: 3246000 - RNA, 20 nt, Human
uuauugauaaguucauacau

SEQ ID NO: 3246001 - RNA, 19 nt, Human
uuauugauaaguucauaca

SEQ ID NO: 3246002 - RNA, 15 nt, Human
uuauugauaaguuca

SEQ ID NO: 3246003 - RNA, 21 nt, Human
uuauggcacuaguauuucuau

SEQ ID NO: 3246004 - RNA, 19 nt, Human
uuuaaaauacacacucaaa

SEQ ID NO: 3246005 - RNA, 16 nt, Human
uuuaaaaucauuucug

SEQ ID NO: 3246006 - RNA, 14 nt, Human
uuuaaaagaaugau

SEQ ID NO: 3246007 - RNA, 17 nt, Human
uuuaaaagaaugauuau

SEQ ID NO: 3246008 - RNA, 12 nt, Human
uuuaaaaugucu

SEQ ID NO: 3246009 - RNA, 18 nt, Human
uuguuuaaaaucauuucu

SEQ ID NO: 3246010 - RNA, 17 nt, Human
uuguuuaaaaucauuuc

SEQ ID NO: 3246011 - RNA, 15 nt, Human
uuuauacaggucaua

SEQ ID NO: 3246012 - RNA, 19 nt, Human
uuuaauaauguuucaaaca

SEQ ID NO: 3246013 - RNA, 13 nt, Human
uuuaauaaaccau

SEQ ID NO: 3246014 - RNA, 14 nt, Human
uuuaauaauguuuc

SEQ ID NO: 3246015 - RNA, 15 nt, Human
uuuaauaauguuuca

SEQ ID NO: 3246016 - RNA, 13 nt, Human
uuuacagagacag

SEQ ID NO: 3246017 - RNA, 18 nt, Human
uuugguaaggggaauuga

SEQ ID NO: 3246018 - RNA, 21 nt, Human
uuugaaauuguauuacaaauc

SEQ ID NO: 3246019 - RNA, 14 nt, Human
uuugagaguucuaa

SEQ ID NO: 3246020 - RNA, 16 nt, Human
uuugagaguucuaaau

SEQ ID NO: 3246021 - RNA, 12 nt, Human
uuugaguucuac

SEQ ID NO: 3246022 - RNA, 13 nt, Human
uuugaguucuaca

SEQ ID NO: 3246023 - RNA, 12 nt, Human
uuucucuaggaa

SEQ ID NO: 3246024 - RNA, 15 nt, Human
uuucacauaucuagu

SEQ ID NO: 3246025 - RNA, 15 nt, Human
uugaggacacugaua

SEQ ID NO: 3246026 - RNA, 20 nt, Human
uugauaugccuuuucccaac

SEQ ID NO: 3246027 - RNA, 24 nt, Human
uucuaaguaaaaccacagcaguug

SEQ ID NO: 3246028 - RNA, 21 nt, Human
uucuaaguaaaaccacagcag

SEQ ID NO: 3246029 - RNA, 19 nt, Human
uucuuaggguuaugauuaa

SEQ ID NO: 3246030 - RNA, 18 nt, Human
uucuuuccacagaagcuc

SEQ ID NO: 3246031 - RNA, 21 nt, Human
uugaaaaucuuauaauuuaaa

SEQ ID NO: 3246032 - RNA, 14 nt, Human
uugaauguuaagca

SEQ ID NO: 3246033 - RNA, 17 nt, Human
uugaauguuaagcagau

SEQ ID NO: 3246034 - RNA, 15 nt, Human
uugucuagugaaacu

SEQ ID NO: 3246035 - RNA, 20 nt, Human
uuguaaaauggugugaccac

SEQ ID NO: 3246036 - RNA, 16 nt, Human
uuguaccgcaauguga

SEQ ID NO: 3246037 - RNA, 16 nt, Human
uuguacgaagaguauu

SEQ ID NO: 3246038 - RNA, 22 nt, Human
uuguagcacugacagauuucca

SEQ ID NO: 3246039 - RNA, 18 nt, Human
uuguagcacugacagauu

SEQ ID NO: 3246040 - RNA, 17 nt, Human
uuguagcacugacagau

SEQ ID NO: 3246041 - RNA, 16 nt, Human
uuguagcacugacaga

SEQ ID NO: 3246042 - RNA, 14 nt, Human
uuguagcacugaca

SEQ ID NO: 3246043 - RNA, 13 nt, Human
uuguaaaauggug

SEQ ID NO: 3246044 - RNA, 12 nt, Human
uuguaaaauggu

SEQ ID NO: 3246045 - RNA, 20 nt, Human
uugguaaggggaauugagga

SEQ ID NO: 3246046 - RNA, 16 nt, Human
uugcuaagcauuccaa

SEQ ID NO: 3246047 - RNA, 18 nt, Human
uugcuaagcauuccaacu

SEQ ID NO: 3246048 - RNA, 15 nt, Human
cugaaacaacaaaua

SEQ ID NO: 3246049 - RNA, 13 nt, Human
cugaaacuucccu

SEQ ID NO: 3246050 - RNA, 22 nt, Human
cucuuagaugcaguucugaaga

SEQ ID NO: 3246051 - RNA, 21 nt, Human
cucuuagaugcaguucugaag

SEQ ID NO: 3246052 - RNA, 14 nt, Human
cucguuaauuugua

SEQ ID NO: 3246053 - RNA, 19 nt, Human
cuccccaugauguuuagaa

SEQ ID NO: 3246054 - RNA, 23 nt, Human
cuccacuuggucugugagaugcu

SEQ ID NO: 3246055 - RNA, 22 nt, Human
cuccacuuggucugugagaugc

SEQ ID NO: 3246056 - RNA, 21 nt, Human
cuccacuuggucugugagaug

SEQ ID NO: 3246057 - RNA, 17 nt, Human
cuccacuuggucuguga

SEQ ID NO: 3246058 - RNA, 16 nt, Human
cuccacuuggucugug

SEQ ID NO: 3246059 - RNA, 15 nt, Human
cuccacuuggucugu

SEQ ID NO: 3246060 - RNA, 13 nt, Human
cuccacuuggucu

SEQ ID NO: 3246061 - RNA, 18 nt, Human
cgcaggcccccaggugcc

SEQ ID NO: 3246062 - RNA, 23 nt, Human
cgccacuguuuugaaucucauaa

SEQ ID NO: 3246063 - RNA, 23 nt, Human
cucaaaauaccaugccauuuaaa

SEQ ID NO: 3246064 - RNA, 17 nt, Human
cucaaaacugcacuguc

SEQ ID NO: 3246065 - RNA, 12 nt, Human
cuagaacucccu

SEQ ID NO: 3246066 - RNA, 18 nt, Human
cuacaugagguacugaga

SEQ ID NO: 3246067 - RNA, 20 nt, Human
cuacaugagguacugagagu

SEQ ID NO: 3246068 - RNA, 18 nt, Human
cuacaaaaacacagcaag

SEQ ID NO: 3246069 - RNA, 16 nt, Human
cuacaaaaacacagca

SEQ ID NO: 3246070 - RNA, 17 nt, Human
cuacaaaaacacagcaa

SEQ ID NO: 3246071 - RNA, 15 nt, Human
cuacaaaaacacagc

SEQ ID NO: 3246072 - RNA, 18 nt, Human
cuacauacuauggaauuu

SEQ ID NO: 3246073 - RNA, 20 nt, Human
cuaaguaaaaccacagcagu

SEQ ID NO: 3246074 - RNA, 22 nt, Human
cuaaguaaaaccacagcaguug

SEQ ID NO: 3246075 - RNA, 23 nt, Human
cuaaguaaaaccacagcaguuga

SEQ ID NO: 3246076 - RNA, 23 nt, Human
ccucauggaauuggagcucgugg

SEQ ID NO: 3246077 - RNA, 15 nt, Human
ccuguaaucacagcu

SEQ ID NO: 3246078 - RNA, 13 nt, Human
ccccugcacucca

SEQ ID NO: 3246079 - RNA, 18 nt, Human
ccccugcacuccagccug

SEQ ID NO: 3246080 - RNA, 13 nt, Human
ccauacauuugug

SEQ ID NO: 3246081 - RNA, 13 nt, Human
ccauuuaaagcuu

SEQ ID NO: 3246082 - RNA, 22 nt, Human
ccauuuaaagcuuauuaaaacu

SEQ ID NO: 3246083 - RNA, 14 nt, Human
caugauguuuagaa

SEQ ID NO: 3246084 - RNA, 19 nt, Human
cauauuaauauauuuccau

SEQ ID NO: 3246085 - RNA, 15 nt, Human
cauauuaauauauuu

SEQ ID NO: 3246086 - RNA, 14 nt, Human
cauauuaauauauu

SEQ ID NO: 3246087 - RNA, 23 nt, Human
cauaugcuguauauccuuucuaa

SEQ ID NO: 3246088 - RNA, 19 nt, Human
cauuuguauaaaauaauuu

SEQ ID NO: 3246089 - RNA, 20 nt, Human
cauuuguauaaaauaauuuu

SEQ ID NO: 3246090 - RNA, 17 nt, Human
cauuuguauaaaauaau

SEQ ID NO: 3246091 - RNA, 17 nt, Human
ccaaauguucaucaaug

SEQ ID NO: 3246092 - RNA, 12 nt, Human
ccacagcaguug

SEQ ID NO: 3246093 - RNA, 17 nt, Human
ccacagcaguugaaaag

SEQ ID NO: 3246094 - RNA, 18 nt, Human
ccacagcaguugaaaaga

SEQ ID NO: 3246095 - RNA, 23 nt, Human
ccacagcaguugaaaagacucca

SEQ ID NO: 3246096 - RNA, 21 nt, Human
cagcuccccucggagaagagc

SEQ ID NO: 3246097 - RNA, 22 nt, Human
cagcuccccucggagaagagcu

SEQ ID NO: 3246098 - RNA, 20 nt, Human
cagcuccccucggagaagag

SEQ ID NO: 3246099 - RNA, 20 nt, Human
cagcccuucuuuccacagaa

SEQ ID NO: 3246100 - RNA, 22 nt, Human
cagcaguugaaaagacuccaaa

SEQ ID NO: 3246101 - RNA, 12 nt, Human
cagauccuggaa

SEQ ID NO: 3246102 - RNA, 16 nt, Human
cagagguugcagugag

SEQ ID NO: 3246103 - RNA, 17 nt, Human
cagagguugcagugagc

SEQ ID NO: 3246104 - RNA, 15 nt, Human
cagucacauuccaag

SEQ ID NO: 3246105 - RNA, 16 nt, Human
cagucaccucauggaa

SEQ ID NO: 3246106 - RNA, 15 nt, Human
cagucaccucaugga

SEQ ID NO: 3246107 - RNA, 19 nt, Human
cagucaccucauggaauug

SEQ ID NO: 3246108 - RNA, 19 nt, Human
caggugccaguuauggcua

SEQ ID NO: 3246109 - RNA, 20 nt, Human
cagucugacuguuuccauca

SEQ ID NO: 3246110 - RNA, 14 nt, Human
caaguauuagaaua

SEQ ID NO: 3246111 - RNA, 20 nt, Human
caaguauuagaauaccacag

SEQ ID NO: 3246112 - RNA, 14 nt, Human
caaugcuguauuuu

SEQ ID NO: 3246113 - RNA, 23 nt, Human
caaugcuguauuuuaaaagaaug

SEQ ID NO: 3246114 - RNA, 12 nt, Human
caauauuucaga

SEQ ID NO: 3246115 - RNA, 20 nt, Human
caauauuucagauaaucaca

SEQ ID NO: 3246116 - RNA, 12 nt, Human
caauuuaaaaaa

SEQ ID NO: 3246117 - RNA, 23 nt, Human
cacaagacccaaaaggcagaagc

SEQ ID NO: 3246118 - RNA, 16 nt, Human
cacaagacugcacauc

SEQ ID NO: 3246119 - RNA, 23 nt, Human
caccucaaaauaccaugccauuu

SEQ ID NO: 3246120 - RNA, 21 nt, Human
caccuacaugagguacugaga

SEQ ID NO: 3246121 - RNA, 20 nt, Human
cacuuggucugugagaugcu

SEQ ID NO: 3246122 - RNA, 17 nt, Human
cacuuggucugugagau

SEQ ID NO: 3246123 - RNA, 13 nt, Human
cagaauauugcuu

SEQ ID NO: 3246124 - RNA, 20 nt, Human
cagaauauguuucaaacuuu

SEQ ID NO: 3246125 - RNA, 18 nt, Human
cagaauauguuucaaacu

SEQ ID NO: 3246126 - RNA, 17 nt, Human
cagaauauguuucaaac

SEQ ID NO: 3246127 - RNA, 15 nt, Human
cagaauauguuucaa

SEQ ID NO: 3246128 - RNA, 14 nt, Human
cagaauauguuuca

SEQ ID NO: 3246129 - RNA, 13 nt, Human
cagaauauguuuc

SEQ ID NO: 3246130 - RNA, 12 nt, Human
cagaauauguuu

SEQ ID NO: 3246131 - RNA, 19 nt, Human
caacccaaauguucaucaa

SEQ ID NO: 3246132 - RNA, 21 nt, Human
caacuaucucauuuccaagca

SEQ ID NO: 3246133 - RNA, 20 nt, Human
caacuauuuuuccaaaauaa

SEQ ID NO: 3246134 - RNA, 15 nt, Human
caaauccuugaagau

SEQ ID NO: 3246135 - RNA, 18 nt, Human
caaaaaaauauauuuaau

SEQ ID NO: 3246136 - RNA, 15 nt, Human
auuucuaugaaauau

SEQ ID NO: 3246137 - RNA, 18 nt, Human
auuucuaugaaauauuau

SEQ ID NO: 3246138 - RNA, 14 nt, Human
auuucuaugaaaua

SEQ ID NO: 3246139 - RNA, 19 nt, Human
auuuauacaggucauauua

SEQ ID NO: 3246140 - RNA, 22 nt, Human
auuuaaugauaaguaaaugcua

SEQ ID NO: 3246141 - RNA, 15 nt, Human
auuguuuaaaaucau

SEQ ID NO: 3246142 - RNA, 19 nt, Human
auuguuuaaaaucauuucu

SEQ ID NO: 3246143 - RNA, 14 nt, Human
auuguaaaugugcu

SEQ ID NO: 3246144 - RNA, 15 nt, Human
auuguaaaugugcuu

SEQ ID NO: 3246145 - RNA, 17 nt, Human
auuguaaaugugcuuuu

SEQ ID NO: 3246146 - RNA, 14 nt, Human
auuguaaauaguau

SEQ ID NO: 3246147 - RNA, 18 nt, Human
auucacaagacccaaaag

SEQ ID NO: 3246148 - RNA, 22 nt, Human
auucaagaaaacaacuucaaua

SEQ ID NO: 3246149 - RNA, 18 nt, Human
auuaaauuuugaguucua

SEQ ID NO: 3246150 - RNA, 18 nt, Human
auugacuuuuuauggcac

SEQ ID NO: 3246151 - RNA, 17 nt, Human
auucuugccaaauauaa

SEQ ID NO: 3246152 - RNA, 23 nt, Human
cuggaaaaguauguuagugcaaa

SEQ ID NO: 3246153 - RNA, 12 nt, Human
cuuaaaaauggu

SEQ ID NO: 3246154 - RNA, 20 nt, Human
cuuaaaaaugguuuaaaugg

SEQ ID NO: 3246155 - RNA, 13 nt, Human
cuuaaaaaugguu

SEQ ID NO: 3246156 - RNA, 23 nt, Human
cugugagaugcuagaacucccuu

SEQ ID NO: 3246157 - RNA, 21 nt, Human
cugugagaugcuagaacuccc

SEQ ID NO: 3246158 - RNA, 18 nt, Human
cugugaaguuuacauugu

SEQ ID NO: 3246159 - RNA, 23 nt, Human
cugugaaguuuacauuguaaaua

SEQ ID NO: 3246160 - RNA, 19 nt, Human
cuguuauaaucuuucacag

SEQ ID NO: 3246161 - RNA, 22 nt, Human
cuguucacagccagacuggcac

SEQ ID NO: 3246162 - RNA, 12 nt, Human
cuguucacagcc

SEQ ID NO: 3246163 - RNA, 19 nt, Human
cuguucacagccagacugg

SEQ ID NO: 3246164 - RNA, 20 nt, Human
cuguaagaaaauaucacuug

SEQ ID NO: 3246165 - RNA, 23 nt, Human
gaaacuucagcgguuuauauaag

SEQ ID NO: 3246166 - RNA, 17 nt, Human
gaaaugaaagcagggac

SEQ ID NO: 3246167 - RNA, 23 nt, Human
gaaaucaaauaugcaaagcacug

SEQ ID NO: 3246168 - RNA, 18 nt, Human
gaaaugaaagcagggacu

SEQ ID NO: 3246169 - RNA, 18 nt, Human
gaacaaauuuacagagac

SEQ ID NO: 3246170 - RNA, 17 nt, Human
gaacaaauuuacagaga

SEQ ID NO: 3246171 - RNA, 23 nt, Human
gaacaaauuuacagagacagaaa

SEQ ID NO: 3246172 - RNA, 16 nt, Human
gaacaagaugguucua

SEQ ID NO: 3246173 - RNA, 22 nt, Human
gaaauauuuauuuuaauaaugu

SEQ ID NO: 3246174 - RNA, 21 nt, Human
gaaaucaaauaugcaaagcac

SEQ ID NO: 3246175 - RNA, 16 nt, Human
gaaaucaaauaugcaa

SEQ ID NO: 3246176 - RNA, 19 nt, Human
gaaaucaaagagagaaaau

SEQ ID NO: 3246177 - RNA, 20 nt, Human
gaaaagacuccaaagaaaug

SEQ ID NO: 3246178 - RNA, 18 nt, Human
gaaaagacuccaaagaaa

SEQ ID NO: 3246179 - RNA, 21 nt, Human
gaaaagacuccaaagaaaugu

SEQ ID NO: 3246180 - RNA, 23 nt, Human
cuuggucucagugucaaugcagc

SEQ ID NO: 3246181 - RNA, 17 nt, Human
gacauuugcucauggaa

SEQ ID NO: 3246182 - RNA, 12 nt, Human
gacagcucugca

SEQ ID NO: 3246183 - RNA, 18 nt, Human
gacagucaccucauggaa

SEQ ID NO: 3246184 - RNA, 17 nt, Human
gacagucaccucaugga

SEQ ID NO: 3246185 - RNA, 14 nt, Human
gacgcucucuggcc

SEQ ID NO: 3246186 - RNA, 14 nt, Human
gaaugaauggcuaa

SEQ ID NO: 3246187 - RNA, 22 nt, Human
gaaugauuaugaauuacauuug

SEQ ID NO: 3246188 - RNA, 14 nt, Human
gaaugauuaugaau

SEQ ID NO: 3246189 - RNA, 15 nt, Human
gaaugaauggcuaag

SEQ ID NO: 3246190 - RNA, 15 nt, Human
gaauuaacacaugau

SEQ ID NO: 3246191 - RNA, 14 nt, Human
gaauuaacacauga

SEQ ID NO: 3246192 - RNA, 13 nt, Human
gaauuacauuugu

SEQ ID NO: 3246193 - RNA, 20 nt, Human
gaauuacauuuguauaaaau

SEQ ID NO: 3246194 - RNA, 15 nt, Human
gaauuacauuuguau

SEQ ID NO: 3246195 - RNA, 18 nt, Human
gaauuacauuuguauaaa

SEQ ID NO: 3246196 - RNA, 17 nt, Human
gagcuguucacagccag

SEQ ID NO: 3246197 - RNA, 20 nt, Human
gagcuguucacagccagacu

SEQ ID NO: 3246198 - RNA, 22 nt, Human
gagcuguucacagccagacugg

SEQ ID NO: 3246199 - RNA, 14 nt, Human
gagcagucaggaaa

SEQ ID NO: 3246200 - RNA, 12 nt, Human
gaggcuccacuu

SEQ ID NO: 3246201 - RNA, 15 nt, Human
gaggcuccacuuggu

SEQ ID NO: 3246202 - RNA, 17 nt, Human
gaggcuccacuuggucu

SEQ ID NO: 3246203 - RNA, 18 nt, Human
gaggcugagaugggagaa

SEQ ID NO: 3246204 - RNA, 14 nt, Human
gaggagaaacugga

SEQ ID NO: 3246205 - RNA, 12 nt, Human
gaggagaaacug

SEQ ID NO: 3246206 - RNA, 20 nt, Human
gaggacgcucucuggccuuc

SEQ ID NO: 3246207 - RNA, 21 nt, Human
gaggacgcucucuggccuucg

SEQ ID NO: 3246208 - RNA, 22 nt, Human
gacuuuuuauggcacuaguauu

SEQ ID NO: 3246209 - RNA, 21 nt, Human
gagauugugccccugcacucc

SEQ ID NO: 3246210 - RNA, 16 nt, Human
gagaugcuagaacucc

SEQ ID NO: 3246211 - RNA, 20 nt, Human
gagaugcuagaacucccuuu

SEQ ID NO: 3246212 - RNA, 13 nt, Human
gcagaacagugau

SEQ ID NO: 3246213 - RNA, 12 nt, Human
gcagaacaguga

SEQ ID NO: 3246214 - RNA, 22 nt, Human
gcagaacagugauuaccaggga

SEQ ID NO: 3246215 - RNA, 18 nt, Human
gcagaacagugauuacca

SEQ ID NO: 3246216 - RNA, 22 nt, Human
gcaguuguugcccacagcugua

SEQ ID NO: 3246217 - RNA, 23 nt, Human
ggaucuucaucugacuaugacau

SEQ ID NO: 3246218 - RNA, 22 nt, Human
ggaucuucaucugacuaugaca

SEQ ID NO: 3246219 - RNA, 15 nt, Human
ggauuguaaaauggu

SEQ ID NO: 3246220 - RNA, 23 nt, Human
aaaaagauuuucagaaaauauua

SEQ ID NO: 3246221 - RNA, 13 nt, Human
aaaaauacaaaaa

SEQ ID NO: 3246222 - RNA, 16 nt, Human
ggccuucggccuccau

SEQ ID NO: 3246223 - RNA, 18 nt, Human
ggccuucggccuccaucc

SEQ ID NO: 3246224 - RNA, 20 nt, Human
ggcuaagcuucacuguaaaa

SEQ ID NO: 3246225 - RNA, 18 nt, Human
aaaaugguuuaaaugguc

SEQ ID NO: 3246226 - RNA, 16 nt, Human
aaaaugguuuaaaugg

SEQ ID NO: 3246227 - RNA, 14 nt, Human
aaaauacacacuca

SEQ ID NO: 3246228 - RNA, 16 nt, Human
aaaauaauuuuuauau

SEQ ID NO: 3246229 - RNA, 17 nt, Human
aaaauaauuuuuauauu

SEQ ID NO: 3246230 - RNA, 11 nt, Human
aaaauaauuuu

SEQ ID NO: 3246231 - RNA, 17 nt, Human
aaaaucucaauauuuca

SEQ ID NO: 3246232 - RNA, 16 nt, Human
aaaauauauuuaauga

SEQ ID NO: 3246233 - RNA, 15 nt, Human
aaaauauauuuaaug

SEQ ID NO: 3246234 - RNA, 14 nt, Human
ggucagugcaaaua

SEQ ID NO: 3246235 - RNA, 21 nt, Human
aaacuucccuuucugcuugug

SEQ ID NO: 3246236 - RNA, 20 nt, Human
ggguuuuauuguuuaaaauc

SEQ ID NO: 3246237 - RNA, 21 nt, Human
aaauaccaugccauuuaaagc

SEQ ID NO: 3246238 - RNA, 22 nt, Human
aaauaucacuugucaauaaaau

SEQ ID NO: 3246239 - RNA, 15 nt, Human
aaauauauuuaauga

SEQ ID NO: 3246240 - RNA, 14 nt, Human
aaauauauuuaaug

SEQ ID NO: 3246241 - RNA, 18 nt, Human
aaauauaugcuaagucuu

SEQ ID NO: 3246242 - RNA, 13 nt, Human
aaauaugcaaagc

SEQ ID NO: 3246243 - RNA, 15 nt, Human
aaauaugcaaagcac

SEQ ID NO: 3246244 - RNA, 16 nt, Human
aaauaugcaaagcacu

SEQ ID NO: 3246245 - RNA, 17 nt, Human
aaauaugcaaagcacug

SEQ ID NO: 3246246 - RNA, 20 nt, Human
aaauauuguguugugaaugu

SEQ ID NO: 3246247 - RNA, 15 nt, Human
guaauagagcaaaau

SEQ ID NO: 3246248 - RNA, 19 nt, Human
aaacuuuaugcuaagugaa

SEQ ID NO: 3246249 - RNA, 12 nt, Human
aaacuuuaugcu

SEQ ID NO: 3246250 - RNA, 16 nt, Human
aaagcagaacagugau

SEQ ID NO: 3246251 - RNA, 17 nt, Human
aaagcagggacuugaac

SEQ ID NO: 3246252 - RNA, 20 nt, Human
aaagggauggcaagaugugg

SEQ ID NO: 3246253 - RNA, 20 nt, Human
aaagggcuguuauaaucuuu

SEQ ID NO: 3246254 - RNA, 22 nt, Human
aaagggcuguuauaaucuuuca

SEQ ID NO: 3246255 - RNA, 19 nt, Human
gguuuuauuguuuaaaauc

SEQ ID NO: 3246256 - RNA, 20 nt, Human
gguucuagcauggcauauuu

SEQ ID NO: 3246257 - RNA, 23 nt, Human
gccuucggccuccauccugaggc

SEQ ID NO: 3246258 - RNA, 22 nt, Human
gccucauguccacugguucuuc

SEQ ID NO: 3246259 - RNA, 12 nt, Human
gccuccauccug

SEQ ID NO: 3246260 - RNA, 14 nt, Human
gccuccauccugag

SEQ ID NO: 3246261 - RNA, 13 nt, Human
gccuccauccuga

SEQ ID NO: 3246262 - RNA, 12 nt, Human
gcauuuagaugu

SEQ ID NO: 3246263 - RNA, 19 nt, Human
gcauuuaggccaugggaca

SEQ ID NO: 3246264 - RNA, 13 nt, Human
gcauuuagaugua

SEQ ID NO: 3246265 - RNA, 11 nt, Human
gccccaaaagg

SEQ ID NO: 3246266 - RNA, 13 nt, Human
ggaaacugccagc

SEQ ID NO: 3246267 - RNA, 19 nt, Human
ggaaaucaggguuaguauu

SEQ ID NO: 3246268 - RNA, 21 nt, Human
ggacagucaccucauggaauu

SEQ ID NO: 3246269 - RNA, 17 nt, Human
ggacagucaccucaugg

SEQ ID NO: 3246270 - RNA, 18 nt, Human
ggacagucaccucaugga

SEQ ID NO: 3246271 - RNA, 21 nt, Human
gcuguauuuuaaaagaaugau

SEQ ID NO: 3246272 - RNA, 20 nt, Human
gcuguauuuuaaaagaauga

SEQ ID NO: 3246273 - RNA, 18 nt, Human
gcuguauuuuaaaagaau

SEQ ID NO: 3246274 - RNA, 13 nt, Human
gcugcugaaacaa

SEQ ID NO: 3246275 - RNA, 14 nt, Human
gucaggaaagagaa

SEQ ID NO: 3246276 - RNA, 13 nt, Human
gucaggaaagaga

SEQ ID NO: 3246277 - RNA, 15 nt, Human
gucacaggaaguaga

SEQ ID NO: 3246278 - RNA, 13 nt, Human
gucacaggaagua

SEQ ID NO: 3246279 - RNA, 21 nt, Human
gucaauuuuguuauguauauu

SEQ ID NO: 3246280 - RNA, 20 nt, Human
gucacaggaaguagaggagg

SEQ ID NO: 3246281 - RNA, 18 nt, Human
aaaugugccuucauuuuu

SEQ ID NO: 3246282 - RNA, 15 nt, Human
aaaugugcuuuuaaa

SEQ ID NO: 3246283 - RNA, 17 nt, Human
aaauuguauuacaaauc

SEQ ID NO: 3246284 - RNA, 17 nt, Human
aaauuccaagugauuga

SEQ ID NO: 3246285 - RNA, 19 nt, Human
guauucuagcuaauguaau

SEQ ID NO: 3246286 - RNA, 24 nt, Human
guauucuaaauuuuauaucuugua

SEQ ID NO: 3246287 - RNA, 21 nt, Human
guauucuaaauuuuauaucuu

SEQ ID NO: 3246288 - RNA, 13 nt, Human
aacagucucagga

SEQ ID NO: 3246289 - RNA, 14 nt, Human
aacauaaaauacaa

SEQ ID NO: 3246290 - RNA, 12 nt, Human
aacauauauaac

SEQ ID NO: 3246291 - RNA, 18 nt, Human
aacacagcaagggugaug

SEQ ID NO: 3246292 - RNA, 20 nt, Human
aacacagcaagggugauggg

SEQ ID NO: 3246293 - RNA, 17 nt, Human
aacacaacuauauuguu

SEQ ID NO: 3246294 - RNA, 22 nt, Human
guccaugaagauguagaggaga

SEQ ID NO: 3246295 - RNA, 21 nt, Human
aacucauuuuuguuuucauua

SEQ ID NO: 3246296 - RNA, 24 nt, Human
aacucauuuuuguuuucauuaucu

SEQ ID NO: 3246297 - RNA, 23 nt, Human
aacuauucaggagaguagaacag

SEQ ID NO: 3246298 - RNA, 14 nt, Human
gucuuaauuaaaag

SEQ ID NO: 3246299 - RNA, 19 nt, Human
gucuuauauauuguagaua

SEQ ID NO: 3246300 - RNA, 14 nt, Human
gugaaguuuacauu

SEQ ID NO: 3246301 - RNA, 23 nt, Human
aacuuccuuggacucauuuuaaa

SEQ ID NO: 3246302 - RNA, 22 nt, Human
aacuuccuuggacucauuuuaa

SEQ ID NO: 3246303 - RNA, 18 nt, Human
aacuucagcgguuuauau

SEQ ID NO: 3246304 - RNA, 13 nt, Human
aacuucagacaua

SEQ ID NO: 3246305 - RNA, 17 nt, Human
aacugugaaguuuacau

SEQ ID NO: 3246306 - RNA, 19 nt, Human
aacugugaaguuuacauug

SEQ ID NO: 3246307 - RNA, 16 nt, Human
gugauuaccagggacu

SEQ ID NO: 3246308 - RNA, 11 nt, Human
gugauuaccag

SEQ ID NO: 3246309 - RNA, 17 nt, Human
gugauuaccagggacug

SEQ ID NO: 3246310 - RNA, 11 nt, Human
aagaaacauuu

SEQ ID NO: 3246311 - RNA, 13 nt, Human
aagaaagaaaauc

SEQ ID NO: 3246312 - RNA, 14 nt, Human
aagaaagaaaauca

SEQ ID NO: 3246313 - RNA, 16 nt, Human
aagaaagaaaaucagg

SEQ ID NO: 3246314 - RNA, 14 nt, Human
aagaaaacaacuuc

SEQ ID NO: 3246315 - RNA, 18 nt, Human
gugcuaguaauuggaaag

SEQ ID NO: 3246316 - RNA, 21 nt, Human
gugcuacaaaaacacagcaag

SEQ ID NO: 3246317 - RNA, 22 nt, Human
gugcuacaaaaacacagcaagg

SEQ ID NO: 3246318 - RNA, 14 nt, Human
guuuaugauuccac

SEQ ID NO: 3246319 - RNA, 17 nt, Human
aagggcuguuauaaucu

SEQ ID NO: 3246320 - RNA, 17 nt, Human
aaggggaauugaggaca

SEQ ID NO: 3246321 - RNA, 15 nt, Human
aagggcuguuauaau

SEQ ID NO: 3246322 - RNA, 12 nt, Human
aaguaaaugcua

SEQ ID NO: 3246323 - RNA, 19 nt, Human
aaguaaugauaacuggaaa

SEQ ID NO: 3246324 - RNA, 19 nt, Human
aaguauguguaaaauguga

SEQ ID NO: 3246325 - RNA, 18 nt, Human
aaguauguuagugcaaau

SEQ ID NO: 3246326 - RNA, 19 nt, Human
aaguauguuagugcaaauu

SEQ ID NO: 3246327 - RNA, 18 nt, Human
aaguauguguaaaaugug

SEQ ID NO: 3246328 - RNA, 13 nt, Human
uaaaagaauauuu

SEQ ID NO: 3246329 - RNA, 21 nt, Human
uaaaauacacacucaaaucaa

SEQ ID NO: 3246330 - RNA, 22 nt, Human
uaaaauaauuuuuauauuugaa

SEQ ID NO: 3246331 - RNA, 20 nt, Human
uaaaauaauuuuuauauuug

SEQ ID NO: 3246332 - RNA, 14 nt, Human
uaaaaccacagcag

SEQ ID NO: 3246333 - RNA, 15 nt, Human
uaaaaccacagcagu

SEQ ID NO: 3246334 - RNA, 13 nt, Human
uaaaaccacagca

SEQ ID NO: 3246335 - RNA, 21 nt, Human
uaaaaauauuguguugugaau

SEQ ID NO: 3246336 - RNA, 14 nt, Human
uaaaaauauugugu

SEQ ID NO: 3246337 - RNA, 21 nt, Human
uaaaaaaaaaccugagcccca

SEQ ID NO: 3246338 - RNA, 19 nt, Human
uaaaaagccugcaauuuca

SEQ ID NO: 3246339 - RNA, 22 nt, Human
uaaaaagccugcaauuucauau

SEQ ID NO: 3246340 - RNA, 9 nt, Human
uaaaauggu

SEQ ID NO: 3246341 - RNA, 11 nt, Human
uaaaaugugaa

SEQ ID NO: 3246342 - RNA, 13 nt, Human
uaaaaugugaagu

SEQ ID NO: 3246343 - RNA, 19 nt, Human
aaggaaaaaauaacaauga

SEQ ID NO: 3246344 - RNA, 18 nt, Human
guucccuugaugaagaag

SEQ ID NO: 3246345 - RNA, 22 nt, Human
guucuagcauggcauauuuuuc

SEQ ID NO: 3246346 - RNA, 19 nt, Human
guucuagcauggcauauuu

SEQ ID NO: 3246347 - RNA, 19 nt, Human
guuaauuccaauuauauga

SEQ ID NO: 3246348 - RNA, 22 nt, Human
guuauugauaaguucauacauu

SEQ ID NO: 3246349 - RNA, 21 nt, Human
guuauugauaaguucauacau

SEQ ID NO: 3246350 - RNA, 18 nt, Human
guuauugauaaguucaua

SEQ ID NO: 3246351 - RNA, 17 nt, Human
guuauuauauuuacaaa

SEQ ID NO: 3246352 - RNA, 19 nt, Human
guuauuauauuuacaaaug

SEQ ID NO: 3246353 - RNA, 16 nt, Human
aagcacugacuucuaa

SEQ ID NO: 3246354 - RNA, 17 nt, Human
aagcacugacuucuaag

SEQ ID NO: 3246355 - RNA, 16 nt, Human
aagcacuaaacaaaga

SEQ ID NO: 3246356 - RNA, 19 nt, Human
aagcauuguaaaugugcuu

SEQ ID NO: 3246357 - RNA, 19 nt, Human
aagcacugacuucuaagua

SEQ ID NO: 3246358 - RNA, 20 nt, Human
aagcacugacuucuaaguaa

SEQ ID NO: 3246359 - RNA, 18 nt, Human
aagcauuguaaaugugcu

SEQ ID NO: 3246360 - RNA, 15 nt, Human
aagauagcagggcau

SEQ ID NO: 3246361 - RNA, 14 nt, Human
aagauagcagggca

SEQ ID NO: 3246362 - RNA, 15 nt, Human
guguaaaaugugaag

SEQ ID NO: 3246363 - RNA, 22 nt, Human
gugucuuaauuaaaagaauauu

SEQ ID NO: 3246364 - RNA, 17 nt, Human
aagcaacccaaauguuc

SEQ ID NO: 3246365 - RNA, 19 nt, Human
uauccaaaccaaauaaaaa

SEQ ID NO: 3246366 - RNA, 19 nt, Human
uauaauuuugugaagcaaa

SEQ ID NO: 3246367 - RNA, 15 nt, Human
uauauuguuugcuaa

SEQ ID NO: 3246368 - RNA, 19 nt, Human
uaugaaauuauauaaguau

SEQ ID NO: 3246369 - RNA, 21 nt, Human
uaugaaauauuauguuaaaac

SEQ ID NO: 3246370 - RNA, 20 nt, Human
acagauuuccauccuaguca

SEQ ID NO: 3246371 - RNA, 19 nt, Human
uaugccccauucaacaucu

SEQ ID NO: 3246372 - RNA, 15 nt, Human
uaugccccauucaac

SEQ ID NO: 3246373 - RNA, 16 nt, Human
uaugauuaaguaauga

SEQ ID NO: 3246374 - RNA, 20 nt, Human
uaugauuaaguaaugauaac

SEQ ID NO: 3246375 - RNA, 16 nt, Human
acagccucuuagaugc

SEQ ID NO: 3246376 - RNA, 21 nt, Human
acagggaggacgcucucuggc

SEQ ID NO: 3246377 - RNA, 20 nt, Human
acagggaggacgcucucugg

SEQ ID NO: 3246378 - RNA, 17 nt, Human
acagucaccucauggaa

SEQ ID NO: 3246379 - RNA, 18 nt, Human
acagucaccucauggaau

SEQ ID NO: 3246380 - RNA, 16 nt, Human
acagucaccucaugga

SEQ ID NO: 3246381 - RNA, 14 nt, Human
uauuacuguaagaa

SEQ ID NO: 3246382 - RNA, 15 nt, Human
uauucaaacagucuc

SEQ ID NO: 3246383 - RNA, 23 nt, Human
uauucaaacagucucaggaaauc

SEQ ID NO: 3246384 - RNA, 22 nt, Human
acaggaaccacaagacugcaca

SEQ ID NO: 3246385 - RNA, 17 nt, Human
acaggaaguagaggagg

SEQ ID NO: 3246386 - RNA, 16 nt, Human
uauuaaaacucauuuu

SEQ ID NO: 3246387 - RNA, 21 nt, Human
uauguuuucaggcuagaugua

SEQ ID NO: 3246388 - RNA, 17 nt, Human
uauguguaaaaugugaa

SEQ ID NO: 3246389 - RNA, 19 nt, Human
acaaauuuacagagacaga

SEQ ID NO: 3246390 - RNA, 18 nt, Human
acaaauuuacagagacag

SEQ ID NO: 3246391 - RNA, 20 nt, Human
acaagacccaaaaggcagaa

SEQ ID NO: 3246392 - RNA, 15 nt, Human
uagaugcaguucuga

SEQ ID NO: 3246393 - RNA, 22 nt, Human
uagcauggcauauuuuucacau

SEQ ID NO: 3246394 - RNA, 21 nt, Human
uagcauggcauauuuuucaca

SEQ ID NO: 3246395 - RNA, 22 nt, Human
uagaggagaaacuggaacucuc

SEQ ID NO: 3246396 - RNA, 19 nt, Human
uagaggagaaacuggaacu

SEQ ID NO: 3246397 - RNA, 22 nt, Human
uagagcaaaauugauguguuua

SEQ ID NO: 3246398 - RNA, 14 nt, Human
uagagcaaaauuga

SEQ ID NO: 3246399 - RNA, 21 nt, Human
uagagcaaaauugauguguuu

SEQ ID NO: 3246400 - RNA, 13 nt, Human
acaagacugcaca

SEQ ID NO: 3246401 - RNA, 14 nt, Human
acaagacugcacau

SEQ ID NO: 3246402 - RNA, 23 nt, Human
acaauacaucccuuaccugggaa

SEQ ID NO: 3246403 - RNA, 12 nt, Human
uagcuaauguaa

SEQ ID NO: 3246404 - RNA, 19 nt, Human
uagcuaauguaauaacugu

SEQ ID NO: 3246405 - RNA, 18 nt, Human
uaggaaauauuuauuuua

SEQ ID NO: 3246406 - RNA, 19 nt, Human
uaggaaauauuuauuuuaa

SEQ ID NO: 3246407 - RNA, 14 nt, Human
uagggagagaagau

SEQ ID NO: 3246408 - RNA, 15 nt, Human
uagggagagaagaua

SEQ ID NO: 3246409 - RNA, 18 nt, Human
uaggcaaccuuuauuuuu

SEQ ID NO: 3246410 - RNA, 17 nt, Human
uaguguuggagaagaac

SEQ ID NO: 3246411 - RNA, 23 nt, Human
uaguguuggagaagaacugaaau

SEQ ID NO: 3246412 - RNA, 22 nt, Human
uagugaaacucguuaauuugua

SEQ ID NO: 3246413 - RNA, 15 nt, Human
acacacucaaaucaa

SEQ ID NO: 3246414 - RNA, 18 nt, Human
acaaugcuguauuuuaaa

SEQ ID NO: 3246415 - RNA, 22 nt, Human
acaaugcuguauuuuaaaagaa

SEQ ID NO: 3246416 - RNA, 18 nt, Human
acacaugauccugcaauu

SEQ ID NO: 3246417 - RNA, 15 nt, Human
acacaucagcuugcc

SEQ ID NO: 3246418 - RNA, 15 nt, Human
acacaugaaguccaa

SEQ ID NO: 3246419 - RNA, 19 nt, Human
acacucaaaucaagaaacu

SEQ ID NO: 3246420 - RNA, 13 nt, Human
acacuaagagaga

SEQ ID NO: 3246421 - RNA, 18 nt, Human
acacucaaaucaagaaac

SEQ ID NO: 3246422 - RNA, 23 nt, Human
uacaggucauauuaauauauuuc

SEQ ID NO: 3246423 - RNA, 17 nt, Human
uacauuguaaauaguau

SEQ ID NO: 3246424 - RNA, 18 nt, Human
uaccaccagucugacugu

SEQ ID NO: 3246425 - RNA, 13 nt, Human
aauguuaagcaga

SEQ ID NO: 3246426 - RNA, 14 nt, Human
uacacuaagagaga

SEQ ID NO: 3246427 - RNA, 12 nt, Human
aaugcuguguua

SEQ ID NO: 3246428 - RNA, 16 nt, Human
aaugcuguauuuuaaa

SEQ ID NO: 3246429 - RNA, 13 nt, Human
aaugcuguguuaa

SEQ ID NO: 3246430 - RNA, 22 nt, Human
aauuccacuuauaggaauugac

SEQ ID NO: 3246431 - RNA, 18 nt, Human
aauuccaagugauugaaa

SEQ ID NO: 3246432 - RNA, 22 nt, Human
aauuauuuuguucauacauauu

SEQ ID NO: 3246433 - RNA, 21 nt, Human
aauuauuuuguucauacauau

SEQ ID NO: 3246434 - RNA, 20 nt, Human
aauuauuuuguucauacaua

SEQ ID NO: 3246435 - RNA, 19 nt, Human
aauuauuuuguucauacau

SEQ ID NO: 3246436 - RNA, 18 nt, Human
aauuauuuuguucauaca

SEQ ID NO: 3246437 - RNA, 16 nt, Human
aauuauuuuguucaua

SEQ ID NO: 3246438 - RNA, 19 nt, Human
uacauuguacgaagaguau

SEQ ID NO: 3246439 - RNA, 21 nt, Human
aauugacccacaagaaaugaa

SEQ ID NO: 3246440 - RNA, 22 nt, Human
aauugacccacaagaaaugaaa

SEQ ID NO: 3246441 - RNA, 14 nt, Human
aauugauguguuua

SEQ ID NO: 3246442 - RNA, 13 nt, Human
aauugauguguuu

SEQ ID NO: 3246443 - RNA, 14 nt, Human
uacuguaagaaaau

SEQ ID NO: 3246444 - RNA, 13 nt, Human
uacuguaagaaaa

SEQ ID NO: 3246445 - RNA, 13 nt, Human
uaaucuuucacag

SEQ ID NO: 3246446 - RNA, 16 nt, Human
aaucuuauaauuuaaa

SEQ ID NO: 3246447 - RNA, 12 nt, Human
uaauagagcaaa

SEQ ID NO: 3246448 - RNA, 21 nt, Human
uaauagagcaaaauugaugug

SEQ ID NO: 3246449 - RNA, 18 nt, Human
uaauguaauaacugugaa

SEQ ID NO: 3246450 - RNA, 22 nt, Human
aaugaauggcuaagcaaaaugu

SEQ ID NO: 3246451 - RNA, 19 nt, Human
aaugaaacacucaguuguu

SEQ ID NO: 3246452 - RNA, 12 nt, Human
aaucaugaauua

SEQ ID NO: 3246453 - RNA, 15 nt, Human
aaucaugaauuaguu

SEQ ID NO: 3246454 - RNA, 16 nt, Human
uaagcuuguauuccuu

SEQ ID NO: 3246455 - RNA, 19 nt, Human
uaaguaaaaccacagcagu

SEQ ID NO: 3246456 - RNA, 13 nt, Human
uaaguaaaugcua

SEQ ID NO: 3246457 - RNA, 14 nt, Human
uaaguucauacauu

SEQ ID NO: 3246458 - RNA, 16 nt, Human
uaaguauucuaaauuu

SEQ ID NO: 3246459 - RNA, 19 nt, Human
aaucuacacuccagugaga

SEQ ID NO: 3246460 - RNA, 19 nt, Human
aaucuuauaauuuaaaaua

SEQ ID NO: 3246461 - RNA, 21 nt, Human
uaagcaaaaugugauauguac

SEQ ID NO: 3246462 - RNA, 22 nt, Human
aaucaggguuaguauuguccag

SEQ ID NO: 3246463 - RNA, 16 nt, Human
aaucaggguuaguauu

SEQ ID NO: 3246464 - RNA, 21 nt, Human
aaucaggguuaguauugucca

SEQ ID NO: 3246465 - RNA, 21 nt, Human
aauaugccccauucaacaucu

SEQ ID NO: 3246466 - RNA, 24 nt, Human
aauaugccccauucaacaucuagu

SEQ ID NO: 3246467 - RNA, 15 nt, Human
aauauuuauuuuaau

SEQ ID NO: 3246468 - RNA, 19 nt, Human
aauauuuauuuuaauaaug

SEQ ID NO: 3246469 - RNA, 18 nt, Human
aauauuuauuuuaauaau

SEQ ID NO: 3246470 - RNA, 17 nt, Human
aauauuguguugugaau

SEQ ID NO: 3246471 - RNA, 22 nt, Human
aauaucacuugucaauaaaauc

SEQ ID NO: 3246472 - RNA, 20 nt, Human
aauaucacuugucaauaaaa

SEQ ID NO: 3246473 - RNA, 20 nt, Human
aauaguauuugagaguucua

SEQ ID NO: 3246474 - RNA, 22 nt, Human
aauaguauuugagaguucuaaa

SEQ ID NO: 3246475 - RNA, 16 nt, Human
aauagucaaauugugu

SEQ ID NO: 3246476 - RNA, 15 nt, Human
aauaguauuugagag

SEQ ID NO: 3246477 - RNA, 23 nt, Human
aauaguauuugagaguucuaaau

SEQ ID NO: 3246478 - RNA, 18 nt, Human
uaagaagugaaaaucuac

SEQ ID NO: 3246479 - RNA, 14 nt, Human
uccagugagacagc

SEQ ID NO: 3246480 - RNA, 18 nt, Human
uccagugagacagcucug

SEQ ID NO: 3246481 - RNA, 11 nt, Human
acgcucucugg

SEQ ID NO: 3246482 - RNA, 22 nt, Human
uccacugguucuucuuggucuc

SEQ ID NO: 3246483 - RNA, 20 nt, Human
accuuuuggucuggagggaa

SEQ ID NO: 3246484 - RNA, 19 nt, Human
accuugaaaacuuuaugcu

SEQ ID NO: 3246485 - RNA, 15 nt, Human
acuaucucauuucca

SEQ ID NO: 3246486 - RNA, 16 nt, Human
acuaucucauuuccaa

SEQ ID NO: 3246487 - RNA, 17 nt, Human
acuaucucauuuccaag

SEQ ID NO: 3246488 - RNA, 17 nt, Human
acuauauuguuugcuaa

SEQ ID NO: 3246489 - RNA, 22 nt, Human
acuauauuguuugcuaagcauu

SEQ ID NO: 3246490 - RNA, 15 nt, Human
acuaauuuuaaaaug

SEQ ID NO: 3246491 - RNA, 15 nt, Human
uccauccugaggcuc

SEQ ID NO: 3246492 - RNA, 12 nt, Human
uccauccugagg

SEQ ID NO: 3246493 - RNA, 11 nt, Human
uccauccugag

SEQ ID NO: 3246494 - RNA, 19 nt, Human
acuccagugagacagcucu

SEQ ID NO: 3246495 - RNA, 20 nt, Human
acucuuaagaagacugcauu

SEQ ID NO: 3246496 - RNA, 21 nt, Human
acucuuaagaagacugcauua

SEQ ID NO: 3246497 - RNA, 20 nt, Human
acugacucuuaagaagacug

SEQ ID NO: 3246498 - RNA, 17 nt, Human
acugacucuuaagaaga

SEQ ID NO: 3246499 - RNA, 18 nt, Human
acugacucuuaagaagac

SEQ ID NO: 3246500 - RNA, 13 nt, Human
acugacuucuaag

SEQ ID NO: 3246501 - RNA, 15 nt, Human
acugacuucuaagua

SEQ ID NO: 3246502 - RNA, 16 nt, Human
acugacuucuaaguaa

SEQ ID NO: 3246503 - RNA, 22 nt, Human
acugacuucuaaguaaaaccac

SEQ ID NO: 3246504 - RNA, 13 nt, Human
acugacucuuaag

SEQ ID NO: 3246505 - RNA, 14 nt, Human
acugacucuuaaga

SEQ ID NO: 3246506 - RNA, 15 nt, Human
acugacucuuaagaa

SEQ ID NO: 3246507 - RNA, 16 nt, Human
acugacucuuaagaag

SEQ ID NO: 3246508 - RNA, 18 nt, Human
acugagagugaacaaauu

SEQ ID NO: 3246509 - RNA, 17 nt, Human
acugagaugugaacaca

SEQ ID NO: 3246510 - RNA, 22 nt, Human
acugagaugugaacacaucagc

SEQ ID NO: 3246511 - RNA, 22 nt, Human
uccugaaaacccuugccaugug

SEQ ID NO: 3246512 - RNA, 16 nt, Human
uccuggaaaucagggu

SEQ ID NO: 3246513 - RNA, 18 nt, Human
ucaaauugugugaaaggu

SEQ ID NO: 3246514 - RNA, 15 nt, Human
ucaaauugugugaaa

SEQ ID NO: 3246515 - RNA, 21 nt, Human
acaugggacauuugcucaugg

SEQ ID NO: 3246516 - RNA, 15 nt, Human
acaugggacauuugc

SEQ ID NO: 3246517 - RNA, 20 nt, Human
acaugggacauuugcucaug

SEQ ID NO: 3246518 - RNA, 11 nt, Human
acaugggacau

SEQ ID NO: 3246519 - RNA, 14 nt, Human
acaugggacauuug

SEQ ID NO: 3246520 - RNA, 23 nt, Human
acaugagguacugagagugaaca

SEQ ID NO: 3246521 - RNA, 20 nt, Human
acaugagguacugagaguga

SEQ ID NO: 3246522 - RNA, 16 nt, Human
acaugagguacugaga

SEQ ID NO: 3246523 - RNA, 16 nt, Human
acaugaaguccaagca

SEQ ID NO: 3246524 - RNA, 22 nt, Human
ucaauaucuuuuuuuuaauaaa

SEQ ID NO: 3246525 - RNA, 18 nt, Human
ucaauauccaaaccaaau

SEQ ID NO: 3246526 - RNA, 19 nt, Human
ucaauauuucagauaauca

SEQ ID NO: 3246527 - RNA, 15 nt, Human
ucaauauuucagaua

SEQ ID NO: 3246528 - RNA, 23 nt, Human
ucaaugaaugaaugaauggcuaa

SEQ ID NO: 3246529 - RNA, 19 nt, Human
acauucuuccaaaaagauu

SEQ ID NO: 3246530 - RNA, 23 nt, Human
accaaaaaucucaauauuucaga

SEQ ID NO: 3246531 - RNA, 19 nt, Human
acauuguacgaagaguauu

SEQ ID NO: 3246532 - RNA, 23 nt, Human
ucacuugaacccgggaggcagag

SEQ ID NO: 3246533 - RNA, 14 nt, Human
accagucugacugu

SEQ ID NO: 3246534 - RNA, 12 nt, Human
ucaccucaugga

SEQ ID NO: 3246535 - RNA, 13 nt, Human
ucaccucauggaa

SEQ ID NO: 3246536 - RNA, 21 nt, Human
ucacaacagauuauuaccuua

SEQ ID NO: 3246537 - RNA, 16 nt, Human
ucaauucuugccaaau

SEQ ID NO: 3246538 - RNA, 22 nt, Human
ucauaaaaagccugcaauuuca

SEQ ID NO: 3246539 - RNA, 17 nt, Human
ucaguuuuugugaaaag

SEQ ID NO: 3246540 - RNA, 15 nt, Human
ucaguuuuugugaaa

SEQ ID NO: 3246541 - RNA, 17 nt, Human
acccgggaggcagaggu

SEQ ID NO: 3246542 - RNA, 15 nt, Human
acccgggaggcagag

SEQ ID NO: 3246543 - RNA, 14 nt, Human
accccugcuucuga

SEQ ID NO: 3246544 - RNA, 15 nt, Human
acuuuggaacaagau

SEQ ID NO: 3246545 - RNA, 12 nt, Human
ucucaggaaauc

SEQ ID NO: 3246546 - RNA, 14 nt, Human
ucucaggaaaucaa

SEQ ID NO: 3246547 - RNA, 21 nt, Human
ucucaggaaaucaaauaugca

SEQ ID NO: 3246548 - RNA, 23 nt, Human
ucucaggaaaucaaauaugcaaa

SEQ ID NO: 3246549 - RNA, 15 nt, Human
ucucauuuccaagca

SEQ ID NO: 3246550 - RNA, 15 nt, Human
acuugucaauaaaau

SEQ ID NO: 3246551 - RNA, 14 nt, Human
ucuaaguaaaacca

SEQ ID NO: 3246552 - RNA, 15 nt, Human
ucuaaguaaaaccac

SEQ ID NO: 3246553 - RNA, 19 nt, Human
ucuaaguaaaaccacagca

SEQ ID NO: 3246554 - RNA, 23 nt, Human
acuuaacuauucaggagaguaga

SEQ ID NO: 3246555 - RNA, 17 nt, Human
ucuaggaaauauuuauu

SEQ ID NO: 3246556 - RNA, 16 nt, Human
ucuaggaaauauuuau

SEQ ID NO: 3246557 - RNA, 23 nt, Human
ucuagcauggcauauuuuucaca

SEQ ID NO: 3246558 - RNA, 22 nt, Human
ucuagcauggcauauuuuucac

SEQ ID NO: 3246559 - RNA, 18 nt, Human
ucuagcauggcauauuuu

SEQ ID NO: 3246560 - RNA, 21 nt, Human
ucuagcauggcauauuuuuca

SEQ ID NO: 3246561 - RNA, 15 nt, Human
agaauuaacacauga

SEQ ID NO: 3246562 - RNA, 13 nt, Human
agaauauguuuca

SEQ ID NO: 3246563 - RNA, 18 nt, Human
agaauauguuucaaacuu

SEQ ID NO: 3246564 - RNA, 17 nt, Human
agaauauguuucaaacu

SEQ ID NO: 3246565 - RNA, 21 nt, Human
agaauauguuucaaacuuugg

SEQ ID NO: 3246566 - RNA, 19 nt, Human
agaauauguuucaaacuuu

SEQ ID NO: 3246567 - RNA, 14 nt, Human
ucugcuuguguuaa

SEQ ID NO: 3246568 - RNA, 12 nt, Human
agacacacauga

SEQ ID NO: 3246569 - RNA, 14 nt, Human
ucugugagaugcua

SEQ ID NO: 3246570 - RNA, 22 nt, Human
ucugugagaugcuagaacuccc

SEQ ID NO: 3246571 - RNA, 17 nt, Human
ucugugagaugcuagaa

SEQ ID NO: 3246572 - RNA, 23 nt, Human
ucugugagaugcuagaacucccu

SEQ ID NO: 3246573 - RNA, 16 nt, Human
ucugugaaaguacauu

SEQ ID NO: 3246574 - RNA, 14 nt, Human
agaaaugaaagcag

SEQ ID NO: 3246575 - RNA, 15 nt, Human
ucugcagauaaacag

SEQ ID NO: 3246576 - RNA, 18 nt, Human
ucugcagauaaacaguag

SEQ ID NO: 3246577 - RNA, 18 nt, Human
agaagaugguaccaccag

SEQ ID NO: 3246578 - RNA, 13 nt, Human
agaagaacugaaa

SEQ ID NO: 3246579 - RNA, 14 nt, Human
agaagaacugaaau

SEQ ID NO: 3246580 - RNA, 13 nt, Human
ugaacaaauuuac

SEQ ID NO: 3246581 - RNA, 18 nt, Human
ugaacccgggaggcagag

SEQ ID NO: 3246582 - RNA, 22 nt, Human
ugaacccauauuuguacaccaa

SEQ ID NO: 3246583 - RNA, 22 nt, Human
ugaagaagcaccaaucaugaau

SEQ ID NO: 3246584 - RNA, 18 nt, Human
agagcuguucacagccag

SEQ ID NO: 3246585 - RNA, 17 nt, Human
ugaagauuuaccacuug

SEQ ID NO: 3246586 - RNA, 20 nt, Human
ugaagauuuaccacuugugu

SEQ ID NO: 3246587 - RNA, 17 nt, Human
ugaaguacucauacaug

SEQ ID NO: 3246588 - RNA, 20 nt, Human
agacuggcacaguuuucuga

SEQ ID NO: 3246589 - RNA, 21 nt, Human
agacuggcacaguuuucugag

SEQ ID NO: 3246590 - RNA, 18 nt, Human
agacuggcacaguuuucu

SEQ ID NO: 3246591 - RNA, 23 nt, Human
agacuggcacaguuuucugagaa

SEQ ID NO: 3246592 - RNA, 22 nt, Human
agacuccaaagaaauguaaggg

SEQ ID NO: 3246593 - RNA, 16 nt, Human
agagacacacugaaga

SEQ ID NO: 3246594 - RNA, 14 nt, Human
agagacagaaagca

SEQ ID NO: 3246595 - RNA, 17 nt, Human
ugaaagaggaaugaagu

SEQ ID NO: 3246596 - RNA, 17 nt, Human
ugaaaauauuuguauca

SEQ ID NO: 3246597 - RNA, 21 nt, Human
ugaaaauauuuguaucacaaa

SEQ ID NO: 3246598 - RNA, 22 nt, Human
ugaaaauauuuguaucacaaau

SEQ ID NO: 3246599 - RNA, 20 nt, Human
ugaaaaucuuauaauuuaaa

SEQ ID NO: 3246600 - RNA, 22 nt, Human
ugaaacugagaugugaacacau

SEQ ID NO: 3246601 - RNA, 13 nt, Human
ugaaagaaaauaa

SEQ ID NO: 3246602 - RNA, 21 nt, Human
agauugugccccugcacucca

SEQ ID NO: 3246603 - RNA, 22 nt, Human
agaugugaacacaucagcuugc

SEQ ID NO: 3246604 - RNA, 17 nt, Human
agaugugaacacaucag

SEQ ID NO: 3246605 - RNA, 14 nt, Human
ugacuaugacauaa

SEQ ID NO: 3246606 - RNA, 13 nt, Human
agauccuggaaau

SEQ ID NO: 3246607 - RNA, 19 nt, Human
agaugcuagaacucccuuu

SEQ ID NO: 3246608 - RNA, 21 nt, Human
agaugcaguucugaagaagau

SEQ ID NO: 3246609 - RNA, 20 nt, Human
agaugcaguucugaagaaga

SEQ ID NO: 3246610 - RNA, 15 nt, Human
agaugcuagaacucc

SEQ ID NO: 3246611 - RNA, 21 nt, Human
agaugcuagaacucccuuuca

SEQ ID NO: 3246612 - RNA, 15 nt, Human
ugacacuuaaaaaug

SEQ ID NO: 3246613 - RNA, 16 nt, Human
agcaagggugauggga

SEQ ID NO: 3246614 - RNA, 20 nt, Human
agcaagggugaugggaaagc

SEQ ID NO: 3246615 - RNA, 22 nt, Human
agcaagggugaugggaaagcau

SEQ ID NO: 3246616 - RNA, 20 nt, Human
ugagacucugucucagucca

SEQ ID NO: 3246617 - RNA, 16 nt, Human
ugagagacacacugaa

SEQ ID NO: 3246618 - RNA, 17 nt, Human
ugagagacacacugaag

SEQ ID NO: 3246619 - RNA, 19 nt, Human
ugagagacacacugaagaa

SEQ ID NO: 3246620 - RNA, 20 nt, Human
ugagagacacacugaagaag

SEQ ID NO: 3246621 - RNA, 16 nt, Human
agauuuuccugaaaac

SEQ ID NO: 3246622 - RNA, 15 nt, Human
agauuuuccugaaaa

SEQ ID NO: 3246623 - RNA, 14 nt, Human
agauuuuccugaaa

SEQ ID NO: 3246624 - RNA, 18 nt, Human
ugagaugugaacacauca

SEQ ID NO: 3246625 - RNA, 19 nt, Human
ugagaugugaacacaucag

SEQ ID NO: 3246626 - RNA, 24 nt, Human
ugagaugugaacacaucagcuugc

SEQ ID NO: 3246627 - RNA, 20 nt, Human
ugagaugcuagaacucccuu

SEQ ID NO: 3246628 - RNA, 13 nt, Human
ugagaugugaaca

SEQ ID NO: 3246629 - RNA, 21 nt, Human
ugagagacacacugaagaagc

SEQ ID NO: 3246630 - RNA, 22 nt, Human
ugagagacacacugaagaagca

SEQ ID NO: 3246631 - RNA, 17 nt, Human
auguuuucaggcuagau

SEQ ID NO: 3246632 - RNA, 21 nt, Human
auguuuucaggcuagauguau

SEQ ID NO: 3246633 - RNA, 15 nt, Human
auguuuucaggcuag

SEQ ID NO: 3246634 - RNA, 15 nt, Human
uuuucugagaaagac

SEQ ID NO: 3246635 - RNA, 18 nt, Human
uuuucugagaaagacuau

SEQ ID NO: 3246636 - RNA, 14 nt, Human
uuuucucuaggaaa

SEQ ID NO: 3246637 - RNA, 18 nt, Human
auguucaucaaugaauga

SEQ ID NO: 3246638 - RNA, 13 nt, Human
auguuaagcagau

SEQ ID NO: 3246639 - RNA, 16 nt, Human
uuuuaauaauguuuca

SEQ ID NO: 3246640 - RNA, 19 nt, Human
augugcuaguaauuggaaa

SEQ ID NO: 3246641 - RNA, 12 nt, Human
uuuuaauaaugu

SEQ ID NO: 3246642 - RNA, 13 nt, Human
uuuuaauaauguu

SEQ ID NO: 3246643 - RNA, 14 nt, Human
uuuuaauaauguuu

SEQ ID NO: 3246644 - RNA, 12 nt, Human
auuaccagggac

SEQ ID NO: 3246645 - RNA, 16 nt, Human
auuacauuuguauaaa

SEQ ID NO: 3246646 - RNA, 17 nt, Human
auuacauuuguauaaaa

SEQ ID NO: 3246647 - RNA, 18 nt, Human
auuacauuuguauaaaau

SEQ ID NO: 3246648 - RNA, 19 nt, Human
uuuuugugaaaagcuccau

SEQ ID NO: 3246649 - RNA, 21 nt, Human
auuaaguaaugauaacuggaa

SEQ ID NO: 3246650 - RNA, 23 nt, Human
auuaaguaaugauaacuggaaac

SEQ ID NO: 3246651 - RNA, 20 nt, Human
auuauauaaguauucuaaau

SEQ ID NO: 3246652 - RNA, 17 nt, Human
auuauauaaguauucua

SEQ ID NO: 3246653 - RNA, 14 nt, Human
auuauauaaguauu

SEQ ID NO: 3246654 - RNA, 19 nt, Human
uuuuuauauuugaaauauu

SEQ ID NO: 3246655 - RNA, 17 nt, Human
uuuuuauauuugaaaua

SEQ ID NO: 3246656 - RNA, 17 nt, Human
uuuuguucauacauauu

SEQ ID NO: 3246657 - RNA, 14 nt, Human
uuuuguucauacau

SEQ ID NO: 3246658 - RNA, 14 nt, Human
uuuugaguucuaca

SEQ ID NO: 3246659 - RNA, 18 nt, Human
auuuuaaaagaaugauua

SEQ ID NO: 3246660 - RNA, 22 nt, Human
auuuuaaaagaaugauuaugaa

SEQ ID NO: 3246661 - RNA, 17 nt, Human
auuuuaaaagaaugauu

SEQ ID NO: 3246662 - RNA, 19 nt, Human
auuuguauaaaauaauuuu

SEQ ID NO: 3246663 - RNA, 15 nt, Human
auuuguauaaaauaa

SEQ ID NO: 3246664 - RNA, 18 nt, Human
auuuguauaaaauaauuu

SEQ ID NO: 3246665 - RNA, 22 nt, Human
auuuucaguuauuauauuuaca

SEQ ID NO: 3246666 - RNA, 14 nt, Human
auuuucagaaaaua

SEQ ID NO: 3246667 - RNA, 17 nt, Human
auuuucagaaaauauua

SEQ ID NO: 3246668 - RNA, 18 nt, Human
auugacccacaagaaaug

SEQ ID NO: 3246669 - RNA, 15 nt, Human
auuguauuacaaauc

SEQ ID NO: 3246670 - RNA, 13 nt, Human
auuuagauguaua

SEQ ID NO: 3246671 - RNA, 17 nt, Human
auuuauuuuaauaaugu

SEQ ID NO: 3246672 - RNA, 12 nt, Human
auuucauuucuu

SEQ ID NO: 3246673 - RNA, 19 nt, Human
auuuauuuuaauaauguuu

SEQ ID NO: 3246674 - RNA, 20 nt, Human
auuuauuuuaauaauguuuc

SEQ ID NO: 3246675 - RNA, 14 nt, Human
auuugaaauauuga

SEQ ID NO: 3246676 - RNA, 14 nt, Human
aucaauuuuucuua

SEQ ID NO: 3246677 - RNA, 13 nt, Human
aucaauuuaaaaa

SEQ ID NO: 3246678 - RNA, 21 nt, Human
aucaaggguacacugccuucu

SEQ ID NO: 3246679 - RNA, 16 nt, Human
aucaaggguacacugc

SEQ ID NO: 3246680 - RNA, 16 nt, Human
aucaaauaugcaaagc

SEQ ID NO: 3246681 - RNA, 17 nt, Human
aucaaauaugcaaagca

SEQ ID NO: 3246682 - RNA, 18 nt, Human
aucaaauaugcaaagcac

SEQ ID NO: 3246683 - RNA, 15 nt, Human
aucaaauaugcaaag

SEQ ID NO: 3246684 - RNA, 15 nt, Human
auauuuuuguagcac

SEQ ID NO: 3246685 - RNA, 23 nt, Human
auauuuuuguagcacugacagau

SEQ ID NO: 3246686 - RNA, 16 nt, Human
auauuuuuguagcacu

SEQ ID NO: 3246687 - RNA, 18 nt, Human
auauuuuucacauaucua

SEQ ID NO: 3246688 - RNA, 17 nt, Human
auauuuuucacauaucu

SEQ ID NO: 3246689 - RNA, 14 nt, Human
auauuguuugcuaa

SEQ ID NO: 3246690 - RNA, 13 nt, Human
auauuuacaaaug

SEQ ID NO: 3246691 - RNA, 12 nt, Human
auauuuaaugau

SEQ ID NO: 3246692 - RNA, 13 nt, Human
auauuuaaugaua

SEQ ID NO: 3246693 - RNA, 23 nt, Human
auauuuaaugauaaguaaaugcu

SEQ ID NO: 3246694 - RNA, 16 nt, Human
auauguuucaaacuuu

SEQ ID NO: 3246695 - RNA, 14 nt, Human
auauguuucaaacu

SEQ ID NO: 3246696 - RNA, 13 nt, Human
auauguuucaaac

SEQ ID NO: 3246697 - RNA, 17 nt, Human
uucccagugaauucuug

SEQ ID NO: 3246698 - RNA, 14 nt, Human
uucauuaucucaaa

SEQ ID NO: 3246699 - RNA, 23 nt, Human
auauguaccuaacgaaguauccu

SEQ ID NO: 3246700 - RNA, 13 nt, Human
auaugcaaagcac

SEQ ID NO: 3246701 - RNA, 14 nt, Human
auaugcaaagcacu

SEQ ID NO: 3246702 - RNA, 21 nt, Human
auaugagcuuccuucugugaa

SEQ ID NO: 3246703 - RNA, 22 nt, Human
auaugagcuuccuucugugaaa

SEQ ID NO: 3246704 - RNA, 15 nt, Human
uucaucaaugaauga

SEQ ID NO: 3246705 - RNA, 13 nt, Human
auauaugcuaagu

SEQ ID NO: 3246706 - RNA, 16 nt, Human
auauauuuaaugauaa

SEQ ID NO: 3246707 - RNA, 15 nt, Human
auauauuuaaugaua

SEQ ID NO: 3246708 - RNA, 17 nt, Human
uucagcgguuuauauaa

SEQ ID NO: 3246709 - RNA, 16 nt, Human
uucuguuuuauaauuu

SEQ ID NO: 3246710 - RNA, 17 nt, Human
uucuguuuuauaauuuu

SEQ ID NO: 3246711 - RNA, 14 nt, Human
uucugaagaagaug

SEQ ID NO: 3246712 - RNA, 23 nt, Human
aucacuugaacccgggaggcaga

SEQ ID NO: 3246713 - RNA, 23 nt, Human
aucagugugucuaaauuugaaug

SEQ ID NO: 3246714 - RNA, 20 nt, Human
aucagugugucuaaauuuga

SEQ ID NO: 3246715 - RNA, 17 nt, Human
uugacacuuaaaaaugg

SEQ ID NO: 3246716 - RNA, 17 nt, Human
uugaagggaaauuucag

SEQ ID NO: 3246717 - RNA, 17 nt, Human
uugaaggaaaaugauac

SEQ ID NO: 3246718 - RNA, 19 nt, Human
uugacacuuaaaaaugguu

SEQ ID NO: 3246719 - RNA, 14 nt, Human
uugagaguucuaaa

SEQ ID NO: 3246720 - RNA, 17 nt, Human
uugauaaguucauacau

SEQ ID NO: 3246721 - RNA, 16 nt, Human
uugauaaguucauaca

SEQ ID NO: 3246722 - RNA, 18 nt, Human
auccugaggcuccacuug

SEQ ID NO: 3246723 - RNA, 16 nt, Human
auccugaggcuccacu

SEQ ID NO: 3246724 - RNA, 13 nt, Human
auccugaggcucc

SEQ ID NO: 3246725 - RNA, 11 nt, Human
auccugaggcu

SEQ ID NO: 3246726 - RNA, 16 nt, Human
auccugcaauuccacu

SEQ ID NO: 3246727 - RNA, 22 nt, Human
auccugaggcuccacuuggucu

SEQ ID NO: 3246728 - RNA, 13 nt, Human
auccugccccuga

SEQ ID NO: 3246729 - RNA, 23 nt, Human
auggaauuggagcucgugggaca

SEQ ID NO: 3246730 - RNA, 22 nt, Human
uuucagaaaauauuauguguuu

SEQ ID NO: 3246731 - RNA, 16 nt, Human
uuuauuuuaauaaugu

SEQ ID NO: 3246732 - RNA, 16 nt, Human
auggaacauaaaauac

SEQ ID NO: 3246733 - RNA, 14 nt, Human
augcuguauuuuaa

SEQ ID NO: 3246734 - RNA, 23 nt, Human
augcugucuacacuaagagagaa

SEQ ID NO: 3246735 - RNA, 19 nt, Human
uuuauuacuguaagaaaau

SEQ ID NO: 3246736 - RNA, 19 nt, Human
augcuguauauccuuucua

SEQ ID NO: 3246737 - RNA, 17 nt, Human
uuuauaugcuucuguuu

SEQ ID NO: 3246738 - RNA, 16 nt, Human
uuuauuacuguaagaa

SEQ ID NO: 3246739 - RNA, 13 nt, Human
augcuaagugaaa

SEQ ID NO: 3246740 - RNA, 24 nt, Human
uuuaaagcuuauuaaaacucauuu

SEQ ID NO: 3246741 - RNA, 16 nt, Human
auggcuauaggugcua

SEQ ID NO: 3246742 - RNA, 19 nt, Human
auggcuauaggugcuacaa

SEQ ID NO: 3246743 - RNA, 21 nt, Human
auggcuauaggugcuacaaaa

SEQ ID NO: 3246744 - RNA, 22 nt, Human
augggacauuugcucauggaau

SEQ ID NO: 3246745 - RNA, 21 nt, Human
augggacauuugcucauggaa

SEQ ID NO: 3246746 - RNA, 17 nt, Human
auggaauuucucccagu

SEQ ID NO: 3246747 - RNA, 15 nt, Human
auggcuauaggugcu

SEQ ID NO: 3246748 - RNA, 13 nt, Human
uuucuaugaaaua

SEQ ID NO: 3246749 - RNA, 14 nt, Human
uuucuaugaaauau

SEQ ID NO: 3246750 - RNA, 20 nt, Human
uuucuaugaaauauuauguu

SEQ ID NO: 3246751 - RNA, 14 nt, Human
uuucugcaucagcu

SEQ ID NO: 3246752 - RNA, 14 nt, Human
uuugaaauauugac

SEQ ID NO: 3246753 - RNA, 17 nt, Human
augaauuacauuuguau

SEQ ID NO: 3246754 - RNA, 18 nt, Human
augaauuacauuuguaua

SEQ ID NO: 3246755 - RNA, 19 nt, Human
augaauuacauuuguauaa

SEQ ID NO: 3246756 - RNA, 23 nt, Human
augaauuaguuuuauaugcuucu

SEQ ID NO: 3246757 - RNA, 22 nt, Human
augaauuacauuuguauaaaau

SEQ ID NO: 3246758 - RNA, 21 nt, Human
augaauuaguuuuauaugcuu

SEQ ID NO: 3246759 - RNA, 19 nt, Human
uuguauaaaauaauuuuua

SEQ ID NO: 3246760 - RNA, 13 nt, Human
uuguauaaaauaa

SEQ ID NO: 3246761 - RNA, 23 nt, Human
uuguaguguuggagaagaacuga

SEQ ID NO: 3246762 - RNA, 21 nt, Human
augaaauauuauguuaaaacu

SEQ ID NO: 3246763 - RNA, 20 nt, Human
augaaauauuauguuaaaac

SEQ ID NO: 3246764 - RNA, 11 nt, Human
uugcucaugga

SEQ ID NO: 3246765 - RNA, 12 nt, Human
uugcucauggaa

SEQ ID NO: 3246766 - RNA, 20 nt, Human
uuuaaaaaagaaacauuugg

SEQ ID NO: 3246767 - RNA, 18 nt, Human
uugugaagcaaaauuuuu

SEQ ID NO: 3246768 - RNA, 23 nt, Human
augagagacacacugaagaagca

SEQ ID NO: 3246769 - RNA, 19 nt, Human
augacauaaaaacaacuuu

SEQ ID NO: 3246770 - RNA, 14 nt, Human
augauaacuggaaa

SEQ ID NO: 3246771 - RNA, 21 nt, Human
ugggaaagcauuguaaaugug

SEQ ID NO: 3246772 - RNA, 22 nt, Human
uggcacaguuuucugagaaaga

SEQ ID NO: 3246773 - RNA, 20 nt, Human
uggcacaguuuucugagaaa

SEQ ID NO: 3246774 - RNA, 18 nt, Human
uggacgagaaaacaauaa

SEQ ID NO: 3246775 - RNA, 23 nt, Human
ugcuguauuuuaaaagaaugauu

SEQ ID NO: 3246776 - RNA, 14 nt, Human
ugcuggagcucugc

SEQ ID NO: 3246777 - RNA, 13 nt, Human
ugcuggagcucug

SEQ ID NO: 3246778 - RNA, 23 nt, Human
aggacagcccuucuuuccacaga

SEQ ID NO: 3246779 - RNA, 14 nt, Human
aggacacugauaug

SEQ ID NO: 3246780 - RNA, 23 nt, Human
aggaauugacccacaagaaauga

SEQ ID NO: 3246781 - RNA, 11 nt, Human
aggaauuuaaa

SEQ ID NO: 3246782 - RNA, 17 nt, Human
ugcuuuuaaaaaaaaau

SEQ ID NO: 3246783 - RNA, 11 nt, Human
aggagaaacug

SEQ ID NO: 3246784 - RNA, 18 nt, Human
uggaauuggagcucgugg

SEQ ID NO: 3246785 - RNA, 18 nt, Human
agcccauggcacucuaug

SEQ ID NO: 3246786 - RNA, 20 nt, Human
agccucauguccacugguuc

SEQ ID NO: 3246787 - RNA, 15 nt, Human
ugcagaagacaguau

SEQ ID NO: 3246788 - RNA, 14 nt, Human
ugcagaagacagua

SEQ ID NO: 3246789 - RNA, 19 nt, Human
agccagacuggcacaguuu

SEQ ID NO: 3246790 - RNA, 18 nt, Human
ugauuaaguaaugauaac

SEQ ID NO: 3246791 - RNA, 23 nt, Human
ugauuaaguaaugauaacuggaa

SEQ ID NO: 3246792 - RNA, 16 nt, Human
ugauuaaguaaugaua

SEQ ID NO: 3246793 - RNA, 11 nt, Human
ugaugaagaag

SEQ ID NO: 3246794 - RNA, 14 nt, Human
ugaugggaaagcau

SEQ ID NO: 3246795 - RNA, 19 nt, Human
ugaugggaaagcauuguaa

SEQ ID NO: 3246796 - RNA, 16 nt, Human
ugccccauucaacauc

SEQ ID NO: 3246797 - RNA, 22 nt, Human
ugccauuuaaagcuuauuaaaa

SEQ ID NO: 3246798 - RNA, 19 nt, Human
agcuauggugucauaggcu

SEQ ID NO: 3246799 - RNA, 23 nt, Human
agcucugcccauccugccccuga

SEQ ID NO: 3246800 - RNA, 15 nt, Human
ugccucaccccuugc

SEQ ID NO: 3246801 - RNA, 18 nt, Human
ugccucagaaaacaagga

SEQ ID NO: 3246802 - RNA, 15 nt, Human
aguucugaagaagau

SEQ ID NO: 3246803 - RNA, 13 nt, Human
aguucugaagaag

SEQ ID NO: 3246804 - RNA, 14 nt, Human
aguucugaagaaga

SEQ ID NO: 3246805 - RNA, 21 nt, Human
aguugauaugccuuuucccaa

SEQ ID NO: 3246806 - RNA, 19 nt, Human
uguuugcuaagcauuccaa

SEQ ID NO: 3246807 - RNA, 15 nt, Human
uguuugcuaagcauu

SEQ ID NO: 3246808 - RNA, 13 nt, Human
uguuuuauaauuu

SEQ ID NO: 3246809 - RNA, 20 nt, Human
uguuuuauaauuuugugaag

SEQ ID NO: 3246810 - RNA, 20 nt, Human
uuaaaaaugguuuaaauggu

SEQ ID NO: 3246811 - RNA, 22 nt, Human
aguugcauagguuuaauaauuu

SEQ ID NO: 3246812 - RNA, 15 nt, Human
uuaaaaaagaaacau

SEQ ID NO: 3246813 - RNA, 18 nt, Human
uuaaaaaagaaacauuug

SEQ ID NO: 3246814 - RNA, 19 nt, Human
aguuauggcuauaggugcu

SEQ ID NO: 3246815 - RNA, 20 nt, Human
aguuauuauauuuacaaaug

SEQ ID NO: 3246816 - RNA, 23 nt, Human
aguuauugauaaguucauacauu

SEQ ID NO: 3246817 - RNA, 22 nt, Human
aguuauugauaaguucauacau

SEQ ID NO: 3246818 - RNA, 21 nt, Human
aguuauugauaaguucauaca

SEQ ID NO: 3246819 - RNA, 19 nt, Human
aguuauugauaaguucaua

SEQ ID NO: 3246820 - RNA, 17 nt, Human
aguuauugauaaguuca

SEQ ID NO: 3246821 - RNA, 20 nt, Human
aguucggugagcuacaaaug

SEQ ID NO: 3246822 - RNA, 15 nt, Human
aguucuaaauuuugu

SEQ ID NO: 3246823 - RNA, 14 nt, Human
auaaauaaaaauaa

SEQ ID NO: 3246824 - RNA, 12 nt, Human
aguuuucugaga

SEQ ID NO: 3246825 - RNA, 13 nt, Human
aguuuucugagaa

SEQ ID NO: 3246826 - RNA, 14 nt, Human
aguuuucugagaaa

SEQ ID NO: 3246827 - RNA, 17 nt, Human
aguuuucugagaaagac

SEQ ID NO: 3246828 - RNA, 16 nt, Human
auaaaccucaaaaugu

SEQ ID NO: 3246829 - RNA, 12 nt, Human
auaacuggaaac

SEQ ID NO: 3246830 - RNA, 19 nt, Human
auaaaugugccuucauuuu

SEQ ID NO: 3246831 - RNA, 12 nt, Human
auaacugugaag

SEQ ID NO: 3246832 - RNA, 21 nt, Human
auaaguucauacauuguacga

SEQ ID NO: 3246833 - RNA, 15 nt, Human
auaaguucauacauu

SEQ ID NO: 3246834 - RNA, 14 nt, Human
auaaguucauacau

SEQ ID NO: 3246835 - RNA, 13 nt, Human
auaaguucauaca

SEQ ID NO: 3246836 - RNA, 11 nt, Human
auaaguucaua

SEQ ID NO: 3246837 - RNA, 23 nt, Human
uuagaugcaguucugaagaagau

SEQ ID NO: 3246838 - RNA, 22 nt, Human
uuagaugcaguucugaagaaga

SEQ ID NO: 3246839 - RNA, 21 nt, Human
auaaucuuucacaggggacag

SEQ ID NO: 3246840 - RNA, 20 nt, Human
auaaucagugugucuaaauu

SEQ ID NO: 3246841 - RNA, 14 nt, Human
auaaugaauacuuu

SEQ ID NO: 3246842 - RNA, 22 nt, Human
auacaaaaaaaaaaaaaaauua

SEQ ID NO: 3246843 - RNA, 21 nt, Human
auaauuuuuauauuugaaaua

SEQ ID NO: 3246844 - RNA, 22 nt, Human
auaauuuuuauauuugaaauau

SEQ ID NO: 3246845 - RNA, 14 nt, Human
auaauuuuuauauu

SEQ ID NO: 3246846 - RNA, 16 nt, Human
auaauuuuuauauuug

SEQ ID NO: 3246847 - RNA, 19 nt, Human
auaauuuuuauauuugaaa

SEQ ID NO: 3246848 - RNA, 13 nt, Human
auaauuuugugaa

SEQ ID NO: 3246849 - RNA, 14 nt, Human
auaauuuugugaag

SEQ ID NO: 3246850 - RNA, 15 nt, Human
auaauuuugugaagc

SEQ ID NO: 3246851 - RNA, 20 nt, Human
auaauuuugugaagcaaaau

SEQ ID NO: 3246852 - RNA, 18 nt, Human
uuauauaagcuuguauuc

SEQ ID NO: 3246853 - RNA, 13 nt, Human
uuauauaaguauu

SEQ ID NO: 3246854 - RNA, 16 nt, Human
uuauauaaguauucua

SEQ ID NO: 3246855 - RNA, 14 nt, Human
uuauauaaguauuc

SEQ ID NO: 3246856 - RNA, 14 nt, Human
auaauuuuaagaaa

SEQ ID NO: 3246857 - RNA, 15 nt, Human
auaauuuuaagaaau

SEQ ID NO: 3246858 - RNA, 21 nt, Human
auaauuuuaagaaaucaaaga

SEQ ID NO: 3246859 - RNA, 23 nt, Human
uuauacccagaaaguuauugaua

SEQ ID NO: 3246860 - RNA, 19 nt, Human
uuauacccagaaaguuauu

SEQ ID NO: 3246861 - RNA, 18 nt, Human
uuauacccagaaaguuau

SEQ ID NO: 3246862 - RNA, 23 nt, Human
uuauagaguguacuuaacuauuc

SEQ ID NO: 3246863 - RNA, 21 nt, Human
auacaggucauauuaauauau

SEQ ID NO: 3246864 - RNA, 15 nt, Human
auacaggucauauua

SEQ ID NO: 3246865 - RNA, 21 nt, Human
auacaguucggugagcuacaa

SEQ ID NO: 3246866 - RNA, 19 nt, Human
auacauauuuuuguagcac

SEQ ID NO: 3246867 - RNA, 20 nt, Human
auacaucccuuaccugggaa

SEQ ID NO: 3246868 - RNA, 14 nt, Human
auacauuguacgaa

SEQ ID NO: 3246869 - RNA, 22 nt, Human
auacauuguacgaagaguauuu

SEQ ID NO: 3246870 - RNA, 21 nt, Human
auacauuguacgaagaguauu

SEQ ID NO: 3246871 - RNA, 22 nt, Human
uuaucaaagggugaaaauuauu

SEQ ID NO: 3246872 - RNA, 17 nt, Human
uguaagaaaauaucacu

SEQ ID NO: 3246873 - RNA, 18 nt, Human
uguaagaaaauaucacuu

SEQ ID NO: 3246874 - RNA, 15 nt, Human
uguacuuaacuauuc

SEQ ID NO: 3246875 - RNA, 23 nt, Human
uggugugaccacugcagaagaca

SEQ ID NO: 3246876 - RNA, 15 nt, Human
aggucagugcaaaua

SEQ ID NO: 3246877 - RNA, 20 nt, Human
aggguuuauguuuaggaugu

SEQ ID NO: 3246878 - RNA, 17 nt, Human
aggguuaugauuaagua

SEQ ID NO: 3246879 - RNA, 22 nt, Human
uggucugugagaugcuagaacu

SEQ ID NO: 3246880 - RNA, 22 nt, Human
ugguccaugggccauaugaaaa

SEQ ID NO: 3246881 - RNA, 21 nt, Human
agggugaugggaaagcauugu

SEQ ID NO: 3246882 - RNA, 22 nt, Human
agggugaugggaaagcauugua

SEQ ID NO: 3246883 - RNA, 15 nt, Human
agggugaaaauuauu

SEQ ID NO: 3246884 - RNA, 16 nt, Human
aggggaauugaggaca

SEQ ID NO: 3246885 - RNA, 20 nt, Human
agucacauuccaagccucau

SEQ ID NO: 3246886 - RNA, 15 nt, Human
aguauuguccagguc

SEQ ID NO: 3246887 - RNA, 16 nt, Human
aguauuguccaggucu

SEQ ID NO: 3246888 - RNA, 14 nt, Human
aguauguguaaaau

SEQ ID NO: 3246889 - RNA, 21 nt, Human
aguauuagaauaccacaggaa

SEQ ID NO: 3246890 - RNA, 18 nt, Human
aguauguuagugcaaauu

SEQ ID NO: 3246891 - RNA, 21 nt, Human
aguauguuagugcaaauuguc

SEQ ID NO: 3246892 - RNA, 22 nt, Human
uguauuacaaauccaaugaaau

SEQ ID NO: 3246893 - RNA, 20 nt, Human
ugucagcuccccucggagaa

SEQ ID NO: 3246894 - RNA, 21 nt, Human
ugucagcuccccucggagaag

SEQ ID NO: 3246895 - RNA, 23 nt, Human
ugucagcuccccucggagaagag

SEQ ID NO: 3246896 - RNA, 15 nt, Human
ugucuaagauaguaa

SEQ ID NO: 3246897 - RNA, 14 nt, Human
ugucuaagauagua

SEQ ID NO: 3246898 - RNA, 18 nt, Human
ugucuaaauuugaauguu

SEQ ID NO: 3246899 - RNA, 14 nt, Human
ugucuucacaacag

SEQ ID NO: 3246900 - RNA, 14 nt, Human
ugucuuaauuaaaa

SEQ ID NO: 3246901 - RNA, 12 nt, Human
ugucuuaauuaa

SEQ ID NO: 3246902 - RNA, 17 nt, Human
ugucucuacuaaaaaua

SEQ ID NO: 3246903 - RNA, 14 nt, Human
ugugaagcaaaauu

SEQ ID NO: 3246904 - RNA, 22 nt, Human
ugugagaugcuagaacucccuu

SEQ ID NO: 3246905 - RNA, 22 nt, Human
agugaaagaggcagcuugaaac

SEQ ID NO: 3246906 - RNA, 14 nt, Human
agugagacagcucu

SEQ ID NO: 3246907 - RNA, 16 nt, Human
agugaaagaggcagcu

SEQ ID NO: 3246908 - RNA, 17 nt, Human
agugaaagaaaauaaca

SEQ ID NO: 3246909 - RNA, 21 nt, Human
agugagcagucaggaaagaga

SEQ ID NO: 3246910 - RNA, 16 nt, Human
agugagccgagauugu

SEQ ID NO: 3246911 - RNA, 16 nt, Human
ugugauguauucuagc

SEQ ID NO: 3246912 - RNA, 12 nt, Human
aaaaacaacuuu

SEQ ID NO: 3246913 - RNA, 18 nt, Human
aaaacacagcaaggguga

SEQ ID NO: 3246914 - RNA, 12 nt, Human
aaaacacagcaa

SEQ ID NO: 3246915 - RNA, 13 nt, Human
aaaacacagcaag

SEQ ID NO: 3246916 - RNA, 17 nt, Human
aaaacaaggaugaauua

SEQ ID NO: 3246917 - RNA, 12 nt, Human
aaaacaacuuua

SEQ ID NO: 3246918 - RNA, 14 nt, Human
aaaacaaggaugaa

SEQ ID NO: 3246919 - RNA, 21 nt, Human
aaaauuauuuuguucauacau

SEQ ID NO: 3246920 - RNA, 13 nt, Human
aaagaugaaaaua

SEQ ID NO: 3246921 - RNA, 16 nt, Human
aaagaugaaaauauuu

SEQ ID NO: 3246922 - RNA, 17 nt, Human
aaagaugaaaauauuug

SEQ ID NO: 3246923 - RNA, 15 nt, Human
aaagaaauguaaggg

SEQ ID NO: 3246924 - RNA, 14 nt, Human
aaacugccagcaac

SEQ ID NO: 3246925 - RNA, 15 nt, Human
aaacugccagcaacg

SEQ ID NO: 3246926 - RNA, 17 nt, Human
aaacugacucuuaagaa

SEQ ID NO: 3246927 - RNA, 16 nt, Human
aaacugacucuuaaga

SEQ ID NO: 3246928 - RNA, 19 nt, Human
aaacugccagcaacgcagg

SEQ ID NO: 3246929 - RNA, 12 nt, Human
aaauaacaauga

SEQ ID NO: 3246930 - RNA, 18 nt, Human
aaaucaaauaugcaaagc

SEQ ID NO: 3246931 - RNA, 19 nt, Human
aaaucaaauaugcaaagca

SEQ ID NO: 3246932 - RNA, 16 nt, Human
aaaucaaauaugcaaa

SEQ ID NO: 3246933 - RNA, 14 nt, Human
aaauaguauuugag

SEQ ID NO: 3246934 - RNA, 13 nt, Human
aagaaauguaagg

SEQ ID NO: 3246935 - RNA, 14 nt, Human
aagaaauguaaggg

SEQ ID NO: 3246936 - RNA, 16 nt, Human
aacuuuggaacaagau

SEQ ID NO: 3246937 - RNA, 15 nt, Human
aacacgagcaggcua

SEQ ID NO: 3246938 - RNA, 21 nt, Human
aaauugauguguuuauuuaua

SEQ ID NO: 3246939 - RNA, 13 nt, Human
aagccagauuuuc

SEQ ID NO: 3246940 - RNA, 16 nt, Human
aagauuuaccacuugu

SEQ ID NO: 3246941 - RNA, 21 nt, Human
aauaauccuaaacauaugaau

SEQ ID NO: 3246942 - RNA, 13 nt, Human
aaucacaauacau

SEQ ID NO: 3246943 - RNA, 14 nt, Human
aauauuauguguuu

SEQ ID NO: 3246944 - RNA, 16 nt, Human
aauauuauguuaaaac

SEQ ID NO: 3246945 - RNA, 16 nt, Human
aaucucauaauuuaua

SEQ ID NO: 3246946 - RNA, 17 nt, Human
aaugauaacuggaaacu

SEQ ID NO: 3246947 - RNA, 21 nt, Human
aaugauaaguaaaugcuaggu

SEQ ID NO: 3246948 - RNA, 18 nt, Human
aaugauaaguaaaugcua

SEQ ID NO: 3246949 - RNA, 20 nt, Human
aaugauaacuggaaacuuca

SEQ ID NO: 3246950 - RNA, 13 nt, Human
aauccauacauuu

SEQ ID NO: 3246951 - RNA, 18 nt, Human
aaucucauaauuuauaca

SEQ ID NO: 3246952 - RNA, 14 nt, Human
aauuaaauuuugag

SEQ ID NO: 3246953 - RNA, 14 nt, Human
aauuaguuuuauau

SEQ ID NO: 3246954 - RNA, 17 nt, Human
aauuaguuuuauaugcu

SEQ ID NO: 3246955 - RNA, 20 nt, Human
aauuaguuuuauaugcuucu

SEQ ID NO: 3246956 - RNA, 19 nt, Human
acuuuauacccagaaaguu

SEQ ID NO: 3246957 - RNA, 23 nt, Human
agaaaauauuauguguuuccaua

SEQ ID NO: 3246958 - RNA, 12 nt, Human
acuggaacucuc

SEQ ID NO: 3246959 - RNA, 12 nt, Human
acuguuuugaau

SEQ ID NO: 3246960 - RNA, 13 nt, Human
acuuggucuguga

SEQ ID NO: 3246961 - RNA, 14 nt, Human
acuuggucugugag

SEQ ID NO: 3246962 - RNA, 15 nt, Human
acuuggucugugaga

SEQ ID NO: 3246963 - RNA, 18 nt, Human
acuuguaaaggaauuuaa

SEQ ID NO: 3246964 - RNA, 20 nt, Human
acuuguaaaggaauuuaaaa

SEQ ID NO: 3246965 - RNA, 19 nt, Human
acuuguaaaggaauuuaaa

SEQ ID NO: 3246966 - RNA, 13 nt, Human
acucccuuucaac

SEQ ID NO: 3246967 - RNA, 12 nt, Human
acucccuuucaa

SEQ ID NO: 3246968 - RNA, 14 nt, Human
acuagcuauggugu

SEQ ID NO: 3246969 - RNA, 15 nt, Human
acuaagagagaauga

SEQ ID NO: 3246970 - RNA, 16 nt, Human
acuaagagagaaugag

SEQ ID NO: 3246971 - RNA, 13 nt, Human
acagccagacugg

SEQ ID NO: 3246972 - RNA, 15 nt, Human
acagccagacuggca

SEQ ID NO: 3246973 - RNA, 16 nt, Human
acagccagacuggcac

SEQ ID NO: 3246974 - RNA, 15 nt, Human
acagcaguugaaaag

SEQ ID NO: 3246975 - RNA, 17 nt, Human
acagaauauguuucaaa

SEQ ID NO: 3246976 - RNA, 16 nt, Human
acagaauauguuucaa

SEQ ID NO: 3246977 - RNA, 21 nt, Human
acagaauauguuucaaacuuu

SEQ ID NO: 3246978 - RNA, 19 nt, Human
acagaauauguuucaaacu

SEQ ID NO: 3246979 - RNA, 20 nt, Human
acagcucugcauacucauua

SEQ ID NO: 3246980 - RNA, 19 nt, Human
acaggucauauuaauauau

SEQ ID NO: 3246981 - RNA, 13 nt, Human
acaacuauauugu

SEQ ID NO: 3246982 - RNA, 20 nt, Human
aauuuugaguucuacauaag

SEQ ID NO: 3246983 - RNA, 15 nt, Human
aauuuuauaucuugu

SEQ ID NO: 3246984 - RNA, 14 nt, Human
acaacuuuauaccc

SEQ ID NO: 3246985 - RNA, 13 nt, Human
acaacuuuauacc

SEQ ID NO: 3246986 - RNA, 18 nt, Human
acaacuucccagugaauu

SEQ ID NO: 3246987 - RNA, 17 nt, Human
acaacuucaauauccaa

SEQ ID NO: 3246988 - RNA, 16 nt, Human
acaacuauuuuuccaa

SEQ ID NO: 3246989 - RNA, 18 nt, Human
acauuugcucauggaauu

SEQ ID NO: 3246990 - RNA, 16 nt, Human
acauuugcucauggaa

SEQ ID NO: 3246991 - RNA, 13 nt, Human
acauguuacaaca

SEQ ID NO: 3246992 - RNA, 16 nt, Human
acccaaguccaagcau

SEQ ID NO: 3246993 - RNA, 21 nt, Human
agccgggcgugguggugagug

SEQ ID NO: 3246994 - RNA, 23 nt, Human
agcaguugaaaagacuccaaaga

SEQ ID NO: 3246995 - RNA, 21 nt, Human
agcaguugaaaagacuccaaa

SEQ ID NO: 3246996 - RNA, 14 nt, Human
agauguagaggaga

SEQ ID NO: 3246997 - RNA, 21 nt, Human
agaugggagaaucacuugaac

SEQ ID NO: 3246998 - RNA, 15 nt, Human
agccagauuuuccug

SEQ ID NO: 3246999 - RNA, 19 nt, Human
agccagauuuuccugaaaa

SEQ ID NO: 3247000 - RNA, 21 nt, Human
agauaggucagugcaaauacu

SEQ ID NO: 3247001 - RNA, 17 nt, Human
agacugcauuauauuua

SEQ ID NO: 3247002 - RNA, 14 nt, Human
agacacaacuauuu

SEQ ID NO: 3247003 - RNA, 18 nt, Human
agcuucacuguaaaauaa

SEQ ID NO: 3247004 - RNA, 19 nt, Human
agcuuccuucugugaaagu

SEQ ID NO: 3247005 - RNA, 14 nt, Human
aggauguugaaaaa

SEQ ID NO: 3247006 - RNA, 15 nt, Human
agguuaauuccaauu

SEQ ID NO: 3247007 - RNA, 22 nt, Human
agguuaauuccaauuauaugag

SEQ ID NO: 3247008 - RNA, 18 nt, Human
auauuuauuuuaauaaug

SEQ ID NO: 3247009 - RNA, 14 nt, Human
auauuuauuacugu

SEQ ID NO: 3247010 - RNA, 19 nt, Human
auauuuauuacuguaagaa

SEQ ID NO: 3247011 - RNA, 15 nt, Human
auaucaauuuaaaaa

SEQ ID NO: 3247012 - RNA, 18 nt, Human
auaucacuugucaauaaa

SEQ ID NO: 3247013 - RNA, 23 nt, Human
auaugcuucuguuuuauaauuuu

SEQ ID NO: 3247014 - RNA, 15 nt, Human
auauccuuucuaaca

SEQ ID NO: 3247015 - RNA, 16 nt, Human
auauccuuucuaacaa

SEQ ID NO: 3247016 - RNA, 19 nt, Human
auauaaguauucuaaauuu

SEQ ID NO: 3247017 - RNA, 22 nt, Human
auauaaguauucuaaauuuuau

SEQ ID NO: 3247018 - RNA, 14 nt, Human
auaauuacuauguc

SEQ ID NO: 3247019 - RNA, 15 nt, Human
agucaaauuguguga

SEQ ID NO: 3247020 - RNA, 17 nt, Human
agucaaauugugugaaa

SEQ ID NO: 3247021 - RNA, 13 nt, Human
agucaaauugugu

SEQ ID NO: 3247022 - RNA, 21 nt, Human
aguccaagcauuuagauguau

SEQ ID NO: 3247023 - RNA, 11 nt, Human
aguccaagcau

SEQ ID NO: 3247024 - RNA, 16 nt, Human
aguccaagcauuuaga

SEQ ID NO: 3247025 - RNA, 15 nt, Human
agugauuaccaggga

SEQ ID NO: 3247026 - RNA, 18 nt, Human
agugauuaccagggacug

SEQ ID NO: 3247027 - RNA, 21 nt, Human
agugucuuaauuaaaagaaua

SEQ ID NO: 3247028 - RNA, 18 nt, Human
aguuguaccgcaauguga

SEQ ID NO: 3247029 - RNA, 19 nt, Human
aguuguaccgcaaugugac

SEQ ID NO: 3247030 - RNA, 22 nt, Human
aucuuauaauuuaaaauaugcu

SEQ ID NO: 3247031 - RNA, 16 nt, Human
aucuuauaauuuaaaa

SEQ ID NO: 3247032 - RNA, 20 nt, Human
augaaacacucaguuguuca

SEQ ID NO: 3247033 - RNA, 14 nt, Human
augacucagaauau

SEQ ID NO: 3247034 - RNA, 13 nt, Human
auccuuucuaaca

SEQ ID NO: 3247035 - RNA, 20 nt, Human
auguaagggaaacugccagc

SEQ ID NO: 3247036 - RNA, 21 nt, Human
auguaagggaaacugccagca

SEQ ID NO: 3247037 - RNA, 22 nt, Human
auguaagggaaacugccagcaa

SEQ ID NO: 3247038 - RNA, 17 nt, Human
auguaauaacugugaag

SEQ ID NO: 3247039 - RNA, 16 nt, Human
cacaguuuucugagaa

SEQ ID NO: 3247040 - RNA, 17 nt, Human
cacaguuuucugagaaa

SEQ ID NO: 3247041 - RNA, 19 nt, Human
cacaguuuucugagaaaga

SEQ ID NO: 3247042 - RNA, 15 nt, Human
cacaguuuucugaga

SEQ ID NO: 3247043 - RNA, 19 nt, Human
caaauaugcaaagcacuga

SEQ ID NO: 3247044 - RNA, 21 nt, Human
caaauaugcaaagcacugacu

SEQ ID NO: 3247045 - RNA, 16 nt, Human
caaaauuuuuucucua

SEQ ID NO: 3247046 - RNA, 21 nt, Human
caaaauuuuuucucuaggaaa

SEQ ID NO: 3247047 - RNA, 22 nt, Human
caaaauugauguguuuauuuau

SEQ ID NO: 3247048 - RNA, 15 nt, Human
caaaauugauguguu

SEQ ID NO: 3247049 - RNA, 16 nt, Human
caaaauugauguguuu

SEQ ID NO: 3247050 - RNA, 19 nt, Human
caaagcugaugacaacuuc

SEQ ID NO: 3247051 - RNA, 15 nt, Human
caaaaacacagcaag

SEQ ID NO: 3247052 - RNA, 17 nt, Human
caaaaacacagcaaggg

SEQ ID NO: 3247053 - RNA, 13 nt, Human
caaaaacacagca

SEQ ID NO: 3247054 - RNA, 14 nt, Human
caaaaacacagcaa

SEQ ID NO: 3247055 - RNA, 13 nt, Human
auuuuccugaaaa

SEQ ID NO: 3247056 - RNA, 23 nt, Human
caaaacuucagacauagaauuaa

SEQ ID NO: 3247057 - RNA, 19 nt, Human
caaaaaucucaauauuuca

SEQ ID NO: 3247058 - RNA, 23 nt, Human
caauacaucccuuaccugggaaa

SEQ ID NO: 3247059 - RNA, 22 nt, Human
caaugugacuuaaugccacuaa

SEQ ID NO: 3247060 - RNA, 17 nt, Human
caaggcugauuaaacca

SEQ ID NO: 3247061 - RNA, 21 nt, Human
caagccagauuuuccugaaaa

SEQ ID NO: 3247062 - RNA, 15 nt, Human
caagaaaacaacuuc

SEQ ID NO: 3247063 - RNA, 20 nt, Human
caggucauauuaauauauuu

SEQ ID NO: 3247064 - RNA, 21 nt, Human
caggucauauuaauauauuuc

SEQ ID NO: 3247065 - RNA, 12 nt, Human
caguauggcagc

SEQ ID NO: 3247066 - RNA, 12 nt, Human
caguagugauag

SEQ ID NO: 3247067 - RNA, 13 nt, Human
caguccaugaaga

SEQ ID NO: 3247068 - RNA, 22 nt, Human
cagucaggaaagagaacuucca

SEQ ID NO: 3247069 - RNA, 15 nt, Human
cagucaggaaagaga

SEQ ID NO: 3247070 - RNA, 18 nt, Human
cagucaggaaagagaacu

SEQ ID NO: 3247071 - RNA, 17 nt, Human
cagugauuaccagggac

SEQ ID NO: 3247072 - RNA, 18 nt, Human
cagugauuaccagggacu

SEQ ID NO: 3247073 - RNA, 15 nt, Human
cagugagacagcucu

SEQ ID NO: 3247074 - RNA, 12 nt, Human
cagugaauucuu

SEQ ID NO: 3247075 - RNA, 20 nt, Human
cagugaaagaaaauaacaau

SEQ ID NO: 3247076 - RNA, 16 nt, Human
cagugaaagaaaauaa

SEQ ID NO: 3247077 - RNA, 14 nt, Human
caggcuacugucag

SEQ ID NO: 3247078 - RNA, 13 nt, Human
caggcuagaugua

SEQ ID NO: 3247079 - RNA, 19 nt, Human
caggcuagauguauguacu

SEQ ID NO: 3247080 - RNA, 11 nt, Human
caggcuacugu

SEQ ID NO: 3247081 - RNA, 18 nt, Human
cagggacaggauaagagg

SEQ ID NO: 3247082 - RNA, 17 nt, Human
cagggcauggcugggaa

SEQ ID NO: 3247083 - RNA, 11 nt, Human
caggggacagg

SEQ ID NO: 3247084 - RNA, 16 nt, Human
caggggacaggauggu

SEQ ID NO: 3247085 - RNA, 12 nt, Human
caggagaguaga

SEQ ID NO: 3247086 - RNA, 20 nt, Human
caggcccccaggugccaguu

SEQ ID NO: 3247087 - RNA, 14 nt, Human
caggcccccaggug

SEQ ID NO: 3247088 - RNA, 19 nt, Human
caggcccccaggugccagu

SEQ ID NO: 3247089 - RNA, 21 nt, Human
caggaugguucccuugaugaa

SEQ ID NO: 3247090 - RNA, 23 nt, Human
caggaugguucccuugaugaaga

SEQ ID NO: 3247091 - RNA, 16 nt, Human
caggauuuuaaucuuu

SEQ ID NO: 3247092 - RNA, 16 nt, Human
cagccuaguugaucag

SEQ ID NO: 3247093 - RNA, 19 nt, Human
cagcuacuugggaggcuga

SEQ ID NO: 3247094 - RNA, 20 nt, Human
cagcucugcauacucauuag

SEQ ID NO: 3247095 - RNA, 20 nt, Human
cagcugcugaaacaacaaau

SEQ ID NO: 3247096 - RNA, 21 nt, Human
cagcugcugaaacaacaaaua

SEQ ID NO: 3247097 - RNA, 18 nt, Human
cagcuguaugauucccag

SEQ ID NO: 3247098 - RNA, 18 nt, Human
cagcuugaaacugagaug

SEQ ID NO: 3247099 - RNA, 23 nt, Human
cagcuuuccucaaaacuucagac

SEQ ID NO: 3247100 - RNA, 18 nt, Human
caggaaccacaagacugc

SEQ ID NO: 3247101 - RNA, 15 nt, Human
caggaaguagaggag

SEQ ID NO: 3247102 - RNA, 16 nt, Human
caggaaguagaggagg

SEQ ID NO: 3247103 - RNA, 22 nt, Human
cagcaagggugaugggaaagca

SEQ ID NO: 3247104 - RNA, 23 nt, Human
cagcaagggugaugggaaagcau

SEQ ID NO: 3247105 - RNA, 19 nt, Human
cagcaagggugaugggaaa

SEQ ID NO: 3247106 - RNA, 14 nt, Human
cagauuuuccugaa

SEQ ID NO: 3247107 - RNA, 15 nt, Human
cagauuuuccugaaa

SEQ ID NO: 3247108 - RNA, 23 nt, Human
cagcaacgcaggcccccaggugc

SEQ ID NO: 3247109 - RNA, 16 nt, Human
cagauggaaugcugug

SEQ ID NO: 3247110 - RNA, 17 nt, Human
cagauggaaugcugugu

SEQ ID NO: 3247111 - RNA, 19 nt, Human
cagauggaaugcuguguua

SEQ ID NO: 3247112 - RNA, 21 nt, Human
cagauggaaugcuguguuaaa

SEQ ID NO: 3247113 - RNA, 14 nt, Human
cagauccuggaaau

SEQ ID NO: 3247114 - RNA, 13 nt, Human
cagauccuggaaa

SEQ ID NO: 3247115 - RNA, 14 nt, Human
cagauaaacaguag

SEQ ID NO: 3247116 - RNA, 23 nt, Human
cagauaaauaguuuaugauucca

SEQ ID NO: 3247117 - RNA, 14 nt, Human
cagauaaucagugu

SEQ ID NO: 3247118 - RNA, 14 nt, Human
cagauaaucacaau

SEQ ID NO: 3247119 - RNA, 23 nt, Human
cagaacagugauuaccagggacu

SEQ ID NO: 3247120 - RNA, 18 nt, Human
cagaacagugauuaccag

SEQ ID NO: 3247121 - RNA, 19 nt, Human
cagaaagcagaacagugau

SEQ ID NO: 3247122 - RNA, 18 nt, Human
cagaaagcagaacaguga

SEQ ID NO: 3247123 - RNA, 19 nt, Human
cagaaaauauuauguguuu

SEQ ID NO: 3247124 - RNA, 20 nt, Human
cagaagcaacccaaauguuc

SEQ ID NO: 3247125 - RNA, 19 nt, Human
cagaagcaacccaaauguu

SEQ ID NO: 3247126 - RNA, 17 nt, Human
cagaaggaucuucaucu

SEQ ID NO: 3247127 - RNA, 19 nt, Human
cagacauagaauuaacaca

SEQ ID NO: 3247128 - RNA, 17 nt, Human
cagacauagaauuaaca

SEQ ID NO: 3247129 - RNA, 11 nt, Human
caccucaugga

SEQ ID NO: 3247130 - RNA, 12 nt, Human
caccucauggaa

SEQ ID NO: 3247131 - RNA, 14 nt, Human
caccucauggaauu

SEQ ID NO: 3247132 - RNA, 21 nt, Human
cacugacuucuaaguaaaacc

SEQ ID NO: 3247133 - RNA, 14 nt, Human
cacugacuucuaag

SEQ ID NO: 3247134 - RNA, 15 nt, Human
cacugacuucuaagu

SEQ ID NO: 3247135 - RNA, 16 nt, Human
cacugacuucuaagua

SEQ ID NO: 3247136 - RNA, 20 nt, Human
cacugacuucuaaguaaaac

SEQ ID NO: 3247137 - RNA, 22 nt, Human
cacugacagauuuccauccuag

SEQ ID NO: 3247138 - RNA, 17 nt, Human
cacugacagauuuccau

SEQ ID NO: 3247139 - RNA, 11 nt, Human
cacugacagau

SEQ ID NO: 3247140 - RNA, 13 nt, Human
cacugacagauuu

SEQ ID NO: 3247141 - RNA, 20 nt, Human
cacugccuucucaacuccaa

SEQ ID NO: 3247142 - RNA, 19 nt, Human
cacuguggguagacacaca

SEQ ID NO: 3247143 - RNA, 22 nt, Human
cacuguggguagacacacauga

SEQ ID NO: 3247144 - RNA, 24 nt, Human
cacuguggguagacacacaugaag

SEQ ID NO: 3247145 - RNA, 14 nt, Human
cacugucaagauga

SEQ ID NO: 3247146 - RNA, 15 nt, Human
cacuuggucugugag

SEQ ID NO: 3247147 - RNA, 23 nt, Human
cacuugaacccgggaggcagagg

SEQ ID NO: 3247148 - RNA, 21 nt, Human
cacuugaacccgggaggcaga

SEQ ID NO: 3247149 - RNA, 20 nt, Human
cacuugaacccgggaggcag

SEQ ID NO: 3247150 - RNA, 16 nt, Human
cacucaaaucaagaaa

SEQ ID NO: 3247151 - RNA, 14 nt, Human
cacuaguauuucua

SEQ ID NO: 3247152 - RNA, 19 nt, Human
cacuaguauuucuaugaaa

SEQ ID NO: 3247153 - RNA, 17 nt, Human
cacuaagagagaaugag

SEQ ID NO: 3247154 - RNA, 21 nt, Human
cacuaaauugacacuuaaaaa

SEQ ID NO: 3247155 - RNA, 19 nt, Human
cacgagcaggcuacuguca

SEQ ID NO: 3247156 - RNA, 20 nt, Human
cacgagcaggcuacugucag

SEQ ID NO: 3247157 - RNA, 17 nt, Human
cacgagcaggcuacugu

SEQ ID NO: 3247158 - RNA, 22 nt, Human
cacgagcaggcuacugucagcu

SEQ ID NO: 3247159 - RNA, 13 nt, Human
cacuaaacaaaga

SEQ ID NO: 3247160 - RNA, 22 nt, Human
cacguucuuacuaguuucccuu

SEQ ID NO: 3247161 - RNA, 21 nt, Human
ggcagagguugcagugagccg

SEQ ID NO: 3247162 - RNA, 17 nt, Human
ggauuagggagagaaga

SEQ ID NO: 3247163 - RNA, 19 nt, Human
ggacgcucucuggccuucg

SEQ ID NO: 3247164 - RNA, 16 nt, Human
ggacgcucucuggccu

SEQ ID NO: 3247165 - RNA, 15 nt, Human
ggacgcucucuggcc

SEQ ID NO: 3247166 - RNA, 15 nt, Human
ggagaagagcuguuc

SEQ ID NO: 3247167 - RNA, 11 nt, Human
ggagaagaacu

SEQ ID NO: 3247168 - RNA, 14 nt, Human
ggagaagaacugaa

SEQ ID NO: 3247169 - RNA, 23 nt, Human
ggagaagagcuguucacagccag

SEQ ID NO: 3247170 - RNA, 20 nt, Human
ggacauuugcucauggaauu

SEQ ID NO: 3247171 - RNA, 16 nt, Human
ggacauuugcucaugg

SEQ ID NO: 3247172 - RNA, 17 nt, Human
ggacauuugcucaugga

SEQ ID NO: 3247173 - RNA, 19 nt, Human
ggaggggagcaugggaagu

SEQ ID NO: 3247174 - RNA, 16 nt, Human
ggaggacgcucucugg

SEQ ID NO: 3247175 - RNA, 21 nt, Human
gggacugaggggaggggagca

SEQ ID NO: 3247176 - RNA, 20 nt, Human
gggaggacgcucucuggccu

SEQ ID NO: 3247177 - RNA, 17 nt, Human
gggaggacgcucucugg

SEQ ID NO: 3247178 - RNA, 20 nt, Human
ggcuaguaucaaaagaaaga

SEQ ID NO: 3247179 - RNA, 23 nt, Human
ggcuauaggugcuacaaaaacac

SEQ ID NO: 3247180 - RNA, 16 nt, Human
ggcuccacuuggucug

SEQ ID NO: 3247181 - RNA, 21 nt, Human
gcuauaggugcuacaaaaaca

SEQ ID NO: 3247182 - RNA, 19 nt, Human
gcuauaggugcuacaaaaa

SEQ ID NO: 3247183 - RNA, 13 nt, Human
gcuagauguaugu

SEQ ID NO: 3247184 - RNA, 14 nt, Human
gcuagauguaugua

SEQ ID NO: 3247185 - RNA, 20 nt, Human
gcuccauuuuuagugaaaua

SEQ ID NO: 3247186 - RNA, 20 nt, Human
gccugagcgacagugagacu

SEQ ID NO: 3247187 - RNA, 17 nt, Human
gccugagcgacagugag

SEQ ID NO: 3247188 - RNA, 18 nt, Human
gccuuggggcugaugcag

SEQ ID NO: 3247189 - RNA, 21 nt, Human
gcuggaaaaguauguuagugc

SEQ ID NO: 3247190 - RNA, 23 nt, Human
gcuggaaaaguauguuagugcaa

SEQ ID NO: 3247191 - RNA, 21 nt, Human
gcugauuaaaccaaggcuaga

SEQ ID NO: 3247192 - RNA, 19 nt, Human
gcuucuguuuuauaauuuu

SEQ ID NO: 3247193 - RNA, 18 nt, Human
gcuugcccuguuaaaaga

SEQ ID NO: 3247194 - RNA, 12 nt, Human
gcuuguguuaag

SEQ ID NO: 3247195 - RNA, 18 nt, Human
gcuguguuaaauaaaccu

SEQ ID NO: 3247196 - RNA, 19 nt, Human
gcacuguggguagacacac

SEQ ID NO: 3247197 - RNA, 15 nt, Human
gcacagccucuuaga

SEQ ID NO: 3247198 - RNA, 18 nt, Human
gcagagguugcagugagc

SEQ ID NO: 3247199 - RNA, 23 nt, Human
gcagagguugcagugagccgaga

SEQ ID NO: 3247200 - RNA, 22 nt, Human
gcagauggaaugcuguguuaaa

SEQ ID NO: 3247201 - RNA, 12 nt, Human
gcaucagcugcu

SEQ ID NO: 3247202 - RNA, 23 nt, Human
gcaucagcugcugaaacaacaaa

SEQ ID NO: 3247203 - RNA, 22 nt, Human
gcaucagcugcugaaacaacaa

SEQ ID NO: 3247204 - RNA, 20 nt, Human
gcaucuagcaugucgucaaa

SEQ ID NO: 3247205 - RNA, 21 nt, Human
gcaguugaaaagacuccaaag

SEQ ID NO: 3247206 - RNA, 16 nt, Human
gcaguugaaaagacuc

SEQ ID NO: 3247207 - RNA, 19 nt, Human
gcaguugaaaagacuccaa

SEQ ID NO: 3247208 - RNA, 15 nt, Human
gcaguugaaaagacu

SEQ ID NO: 3247209 - RNA, 23 nt, Human
gccaugggacagggaggacgcuc

SEQ ID NO: 3247210 - RNA, 22 nt, Human
gccaugggacagggaggacgcu

SEQ ID NO: 3247211 - RNA, 15 nt, Human
gccagacuggcacag

SEQ ID NO: 3247212 - RNA, 18 nt, Human
gccagacuggcacaguuu

SEQ ID NO: 3247213 - RNA, 19 nt, Human
gccagacuggcacaguuuu

SEQ ID NO: 3247214 - RNA, 19 nt, Human
gaggcagagguugcaguga

SEQ ID NO: 3247215 - RNA, 13 nt, Human
gagcuacaaaugc

SEQ ID NO: 3247216 - RNA, 12 nt, Human
gagcuacaaaug

SEQ ID NO: 3247217 - RNA, 14 nt, Human
gagcuacaaaugca

SEQ ID NO: 3247218 - RNA, 19 nt, Human
gagugaacaaauuuacaga

SEQ ID NO: 3247219 - RNA, 22 nt, Human
gagugaacaaauuuacagagac

SEQ ID NO: 3247220 - RNA, 19 nt, Human
gagugucuuaauuaaaaga

SEQ ID NO: 3247221 - RNA, 21 nt, Human
gaguugaaaaucuuauaauuu

SEQ ID NO: 3247222 - RNA, 13 nt, Human
gauagcagggcau

SEQ ID NO: 3247223 - RNA, 21 nt, Human
gauaaucagugugucuaaauu

SEQ ID NO: 3247224 - RNA, 17 nt, Human
gaguauuuuugacagaa

SEQ ID NO: 3247225 - RNA, 16 nt, Human
gaguauuuuugacaga

SEQ ID NO: 3247226 - RNA, 14 nt, Human
gaguauuuuugaca

SEQ ID NO: 3247227 - RNA, 18 nt, Human
gaguauuuuugacagaau

SEQ ID NO: 3247228 - RNA, 16 nt, Human
gaugggaaagcauugu

SEQ ID NO: 3247229 - RNA, 22 nt, Human
gaugcuagaacucccuuucaac

SEQ ID NO: 3247230 - RNA, 18 nt, Human
gaugcaguucugaagaag

SEQ ID NO: 3247231 - RNA, 14 nt, Human
gaucuuuaaaauac

SEQ ID NO: 3247232 - RNA, 13 nt, Human
gaucuuuaaaaua

SEQ ID NO: 3247233 - RNA, 23 nt, Human
gaucuucaucugacuaugacaua

SEQ ID NO: 3247234 - RNA, 16 nt, Human
gaucuucaucugacua

SEQ ID NO: 3247235 - RNA, 13 nt, Human
gauugugccccug

SEQ ID NO: 3247236 - RNA, 12 nt, Human
cugagaaagacu

SEQ ID NO: 3247237 - RNA, 13 nt, Human
cugagaaagacua

SEQ ID NO: 3247238 - RNA, 15 nt, Human
cugagaaagacuauu

SEQ ID NO: 3247239 - RNA, 18 nt, Human
cugagaaagacuauucaa

SEQ ID NO: 3247240 - RNA, 16 nt, Human
cugagaugugaacaca

SEQ ID NO: 3247241 - RNA, 20 nt, Human
cugagaugugaacacaucag

SEQ ID NO: 3247242 - RNA, 19 nt, Human
cugagaaagacuauucaaa

SEQ ID NO: 3247243 - RNA, 20 nt, Human
cugagaaagacuauucaaac

SEQ ID NO: 3247244 - RNA, 21 nt, Human
cugagaugugaacacaucagc

SEQ ID NO: 3247245 - RNA, 16 nt, Human
cugagcaggauuuuaa

SEQ ID NO: 3247246 - RNA, 19 nt, Human
cucuuaagaagacugcauu

SEQ ID NO: 3247247 - RNA, 13 nt, Human
cucuuaagaagac

SEQ ID NO: 3247248 - RNA, 22 nt, Human
cucuggccuucggccuccaucc

SEQ ID NO: 3247249 - RNA, 19 nt, Human
cucuggccuucggccucca

SEQ ID NO: 3247250 - RNA, 21 nt, Human
cucuggccuucggccuccauc

SEQ ID NO: 3247251 - RNA, 21 nt, Human
cugaggcuccacuuggucugu

SEQ ID NO: 3247252 - RNA, 15 nt, Human
cugaggcuccacuug

SEQ ID NO: 3247253 - RNA, 20 nt, Human
cugcaucagcugcugaaaca

SEQ ID NO: 3247254 - RNA, 11 nt, Human
cuccauccuga

SEQ ID NO: 3247255 - RNA, 12 nt, Human
cuccauccugag

SEQ ID NO: 3247256 - RNA, 13 nt, Human
cuccaaagaaaug

SEQ ID NO: 3247257 - RNA, 12 nt, Human
cuccaaagaaau

SEQ ID NO: 3247258 - RNA, 21 nt, Human
cuccaaacugacucuuaagaa

SEQ ID NO: 3247259 - RNA, 21 nt, Human
cucauuuccaagcaaguauua

SEQ ID NO: 3247260 - RNA, 13 nt, Human
cuccauccugagg

SEQ ID NO: 3247261 - RNA, 18 nt, Human
cuagugaaagaggcagcu

SEQ ID NO: 3247262 - RNA, 19 nt, Human
cuagugaaagaggcagcuu

SEQ ID NO: 3247263 - RNA, 20 nt, Human
cuagugaaacucguuaauuu

SEQ ID NO: 3247264 - RNA, 21 nt, Human
cuagugagcagucaggaaaga

SEQ ID NO: 3247265 - RNA, 16 nt, Human
cuaguaauuggaaagg

SEQ ID NO: 3247266 - RNA, 18 nt, Human
cuauucaaacagucucag

SEQ ID NO: 3247267 - RNA, 16 nt, Human
cuauucaaacagucuc

SEQ ID NO: 3247268 - RNA, 23 nt, Human
cuauucaaacagucucaggaaau

SEQ ID NO: 3247269 - RNA, 20 nt, Human
cuauaggugcuacaaaaaca

SEQ ID NO: 3247270 - RNA, 21 nt, Human
cuauaggugcuacaaaaacac

SEQ ID NO: 3247271 - RNA, 22 nt, Human
cuauaggugcuacaaaaacaca

SEQ ID NO: 3247272 - RNA, 15 nt, Human
cuauaggugcuacaa

SEQ ID NO: 3247273 - RNA, 13 nt, Human
cuauaauuuaaau

SEQ ID NO: 3247274 - RNA, 13 nt, Human
cucacauuuauau

SEQ ID NO: 3247275 - RNA, 12 nt, Human
cucaaauuugga

SEQ ID NO: 3247276 - RNA, 22 nt, Human
gaaaacaauaacgauaaaagac

SEQ ID NO: 3247277 - RNA, 14 nt, Human
gaaaacaaggauga

SEQ ID NO: 3247278 - RNA, 20 nt, Human
gaaaaucuuauaauuuaaaa

SEQ ID NO: 3247279 - RNA, 19 nt, Human
gaaaauaacaauaaaagac

SEQ ID NO: 3247280 - RNA, 19 nt, Human
gaaaauaacgauaaaagac

SEQ ID NO: 3247281 - RNA, 18 nt, Human
gaaaaucuuauaauuuaa

SEQ ID NO: 3247282 - RNA, 19 nt, Human
gaaaaucuuauaauuuaaa

SEQ ID NO: 3247283 - RNA, 17 nt, Human
gaaaauauuauguguuu

SEQ ID NO: 3247284 - RNA, 12 nt, Human
gaaaauaucacu

SEQ ID NO: 3247285 - RNA, 18 nt, Human
cuuguaaaggaauuuaaa

SEQ ID NO: 3247286 - RNA, 19 nt, Human
cuuguaaaggaauuuaaaa

SEQ ID NO: 3247287 - RNA, 18 nt, Human
cuuuaaagggauggcaag

SEQ ID NO: 3247288 - RNA, 19 nt, Human
cuuguguuaaguaugugua

SEQ ID NO: 3247289 - RNA, 13 nt, Human
cuuuccacagaag

SEQ ID NO: 3247290 - RNA, 13 nt, Human
gaaauauuauguu

SEQ ID NO: 3247291 - RNA, 16 nt, Human
gaaauauuauguuaaa

SEQ ID NO: 3247292 - RNA, 18 nt, Human
gaaauuguauuacaaauc

SEQ ID NO: 3247293 - RNA, 22 nt, Human
gaacuuccagauccuggaaauc

SEQ ID NO: 3247294 - RNA, 14 nt, Human
gaacucccuuucaa

SEQ ID NO: 3247295 - RNA, 21 nt, Human
gaagaagcaccaaucaugaau

SEQ ID NO: 3247296 - RNA, 21 nt, Human
gaacuuguaaaggaauuuaaa

SEQ ID NO: 3247297 - RNA, 21 nt, Human
gaacuagaguuuagcuggaaa

SEQ ID NO: 3247298 - RNA, 22 nt, Human
gaacuagaguuuagcuggaaaa

SEQ ID NO: 3247299 - RNA, 21 nt, Human
gaagccuuggggcugaugcag

SEQ ID NO: 3247300 - RNA, 14 nt, Human
gaaggaaaaugaua

SEQ ID NO: 3247301 - RNA, 16 nt, Human
gaaguuuacauuguaa

SEQ ID NO: 3247302 - RNA, 17 nt, Human
gaaguuuacauuguaaa

SEQ ID NO: 3247303 - RNA, 14 nt, Human
gaauacuuuauaaa

SEQ ID NO: 3247304 - RNA, 20 nt, Human
gaauaauccuaaacauauga

SEQ ID NO: 3247305 - RNA, 20 nt, Human
cuuccuuggacucauuuuaa

SEQ ID NO: 3247306 - RNA, 20 nt, Human
cuucggccuccauccugagg

SEQ ID NO: 3247307 - RNA, 19 nt, Human
cuucggccuccauccugag

SEQ ID NO: 3247308 - RNA, 12 nt, Human
cuucacaacaga

SEQ ID NO: 3247309 - RNA, 14 nt, Human
cuucacaacagauu

SEQ ID NO: 3247310 - RNA, 17 nt, Human
cuucaaauccuugaaga

SEQ ID NO: 3247311 - RNA, 15 nt, Human
cuucagccugaaaga

SEQ ID NO: 3247312 - RNA, 15 nt, Human
cuguuuuauaauuuu

SEQ ID NO: 3247313 - RNA, 14 nt, Human
cuguuuuauaauuu

SEQ ID NO: 3247314 - RNA, 16 nt, Human
cuuaauuaaaagaaua

SEQ ID NO: 3247315 - RNA, 17 nt, Human
cuuaauuaaaagaauau

SEQ ID NO: 3247316 - RNA, 19 nt, Human
cuuaauuaaaagaauauuu

SEQ ID NO: 3247317 - RNA, 20 nt, Human
cuuaauuaaaagaauauuuu

SEQ ID NO: 3247318 - RNA, 23 nt, Human
cuuaagaagacugcauuauauuu

SEQ ID NO: 3247319 - RNA, 21 nt, Human
cuuaagaagacugcauuauau

SEQ ID NO: 3247320 - RNA, 18 nt, Human
cugucuucacaacagauu

SEQ ID NO: 3247321 - RNA, 18 nt, Human
cugugaaaguacauuugg

SEQ ID NO: 3247322 - RNA, 15 nt, Human
cuguuaaaagaugaa

SEQ ID NO: 3247323 - RNA, 16 nt, Human
cuguuaaaagaugaaa

SEQ ID NO: 3247324 - RNA, 19 nt, Human
cuguuaaaagaugaaaaua

SEQ ID NO: 3247325 - RNA, 13 nt, Human
cccacaagaaaug

SEQ ID NO: 3247326 - RNA, 20 nt, Human
cccacaagaaaugaaagcag

SEQ ID NO: 3247327 - RNA, 15 nt, Human
cccgugggguuccuc

SEQ ID NO: 3247328 - RNA, 16 nt, Human
ccgggcguggugguga

SEQ ID NO: 3247329 - RNA, 14 nt, Human
ccuccauccugagg

SEQ ID NO: 3247330 - RNA, 20 nt, Human
ccuucggccuccauccugag

SEQ ID NO: 3247331 - RNA, 19 nt, Human
ccuucggccuccauccuga

SEQ ID NO: 3247332 - RNA, 14 nt, Human
ccuucggccuccau

SEQ ID NO: 3247333 - RNA, 20 nt, Human
ccuugaaaacuuuaugcuaa

SEQ ID NO: 3247334 - RNA, 15 nt, Human
ccuucugugaaagua

SEQ ID NO: 3247335 - RNA, 19 nt, Human
ccuuggggcugaugcaguu

SEQ ID NO: 3247336 - RNA, 14 nt, Human
ccuugaugaagaag

SEQ ID NO: 3247337 - RNA, 20 nt, Human
ccuguuaaaagaugaaaaua

SEQ ID NO: 3247338 - RNA, 21 nt, Human
ccuguuaaaagaugaaaauau

SEQ ID NO: 3247339 - RNA, 18 nt, Human
cgagcaggcuacugucag

SEQ ID NO: 3247340 - RNA, 21 nt, Human
cgaagaguauuuuugacagaa

SEQ ID NO: 3247341 - RNA, 23 nt, Human
ccuggaaaucaggguuaguauug

SEQ ID NO: 3247342 - RNA, 19 nt, Human
ccugcaauuucauaugcug

SEQ ID NO: 3247343 - RNA, 11 nt, Human
ccugagcccca

SEQ ID NO: 3247344 - RNA, 19 nt, Human
ccaugggacagggaggacg

SEQ ID NO: 3247345 - RNA, 16 nt, Human
ccaugggacagggagg

SEQ ID NO: 3247346 - RNA, 14 nt, Human
ccaguuauggcuau

SEQ ID NO: 3247347 - RNA, 19 nt, Human
caugaagauguagaggaga

SEQ ID NO: 3247348 - RNA, 18 nt, Human
caugaagauguagaggag

SEQ ID NO: 3247349 - RNA, 19 nt, Human
caugagguacugagaguga

SEQ ID NO: 3247350 - RNA, 16 nt, Human
caugagguacugagag

SEQ ID NO: 3247351 - RNA, 17 nt, Human
caucugacuaugacaua

SEQ ID NO: 3247352 - RNA, 15 nt, Human
cauauauaacaaugc

SEQ ID NO: 3247353 - RNA, 15 nt, Human
cauaucuaguaugaa

SEQ ID NO: 3247354 - RNA, 18 nt, Human
cauaucuaguaugaaauu

SEQ ID NO: 3247355 - RNA, 17 nt, Human
cauaucuaguaugaaau

SEQ ID NO: 3247356 - RNA, 13 nt, Human
cauauauaacaau

SEQ ID NO: 3247357 - RNA, 16 nt, Human
cauagguuuaauaauu

SEQ ID NO: 3247358 - RNA, 21 nt, Human
cauaucuaguaugaaauuaua

SEQ ID NO: 3247359 - RNA, 18 nt, Human
caucccuuaccugggaaa

SEQ ID NO: 3247360 - RNA, 20 nt, Human
cauggaauuggagcucgugg

SEQ ID NO: 3247361 - RNA, 23 nt, Human
caugggacagggaggacgcucuc

SEQ ID NO: 3247362 - RNA, 19 nt, Human
cauggcauauuuuucacau

SEQ ID NO: 3247363 - RNA, 15 nt, Human
cauggcauauuuuuc

SEQ ID NO: 3247364 - RNA, 23 nt, Human
cauggcauauuuuucacauaucu

SEQ ID NO: 3247365 - RNA, 13 nt, Human
cauggcauauuuu

SEQ ID NO: 3247366 - RNA, 20 nt, Human
caugugcuaguaauuggaaa

SEQ ID NO: 3247367 - RNA, 21 nt, Human
cauuaaaaaaucaguuguaca

SEQ ID NO: 3247368 - RNA, 21 nt, Human
cauuguaaaugugcuuuuaaa

SEQ ID NO: 3247369 - RNA, 19 nt, Human
cauuguacgaagaguauuu

SEQ ID NO: 3247370 - RNA, 13 nt, Human
cauucuggaauaa

SEQ ID NO: 3247371 - RNA, 22 nt, Human
cauuccaacuaucucauuucca

SEQ ID NO: 3247372 - RNA, 23 nt, Human
uuuuuuaaaaaagaaacauuugg

SEQ ID NO: 3247373 - RNA, 11 nt, Human
uuuugacagaa

SEQ ID NO: 3247374 - RNA, 22 nt, Human
uuuugacagaauauguuucaaa

SEQ ID NO: 3247375 - RNA, 23 nt, Human
uuuugacagaauauguuucaaac

SEQ ID NO: 3247376 - RNA, 15 nt, Human
uuuccacagaagcuc

SEQ ID NO: 3247377 - RNA, 17 nt, Human
uuuguauaaaauaauuu

SEQ ID NO: 3247378 - RNA, 16 nt, Human
uuuguauaaaauaauu

SEQ ID NO: 3247379 - RNA, 18 nt, Human
uuuguauaaaauaauuuu

SEQ ID NO: 3247380 - RNA, 13 nt, Human
uuuucuuauuuca

SEQ ID NO: 3247381 - RNA, 22 nt, Human
uuuucagaaaauauuauguguu

SEQ ID NO: 3247382 - RNA, 16 nt, Human
uuuucacauaucuagu

SEQ ID NO: 3247383 - RNA, 23 nt, Human
uuuucagaaaauauuauguguuu

SEQ ID NO: 3247384 - RNA, 21 nt, Human
uuuuaaaguaacccuacaaaa

SEQ ID NO: 3247385 - RNA, 23 nt, Human
uuuuauaauuuugugaagcaaaa

SEQ ID NO: 3247386 - RNA, 21 nt, Human
uuuuauaauuuugugaagcaa

SEQ ID NO: 3247387 - RNA, 13 nt, Human
uuuuauauuugaa

SEQ ID NO: 3247388 - RNA, 18 nt, Human
uuuuauauuugaaauauu

SEQ ID NO: 3247389 - RNA, 23 nt, Human
uucaguuauuauauuuacaaaug

SEQ ID NO: 3247390 - RNA, 20 nt, Human
uucaucugacuaugacauaa

SEQ ID NO: 3247391 - RNA, 18 nt, Human
uuccagauccuggaaauc

SEQ ID NO: 3247392 - RNA, 21 nt, Human
uuccaaaaagauuuucagaaa

SEQ ID NO: 3247393 - RNA, 20 nt, Human
uucagauaaucacaauacau

SEQ ID NO: 3247394 - RNA, 17 nt, Human
uucaaauccuugaagau

SEQ ID NO: 3247395 - RNA, 14 nt, Human
uuauuuuguucaua

SEQ ID NO: 3247396 - RNA, 16 nt, Human
uucaauaauaaauauu

SEQ ID NO: 3247397 - RNA, 17 nt, Human
uuauuuuaauaauguuu

SEQ ID NO: 3247398 - RNA, 19 nt, Human
uuauuuuaauaauguuuca

SEQ ID NO: 3247399 - RNA, 20 nt, Human
uuauuuuaauaauguuucaa

SEQ ID NO: 3247400 - RNA, 11 nt, Human
uuauaaucuuu

SEQ ID NO: 3247401 - RNA, 12 nt, Human
uuauaauuuaaa

SEQ ID NO: 3247402 - RNA, 14 nt, Human
uuauaauuuuguga

SEQ ID NO: 3247403 - RNA, 15 nt, Human
uuauaauuuugugaa

SEQ ID NO: 3247404 - RNA, 14 nt, Human
uuauacaggucaua

SEQ ID NO: 3247405 - RNA, 18 nt, Human
uuauaauuuugugaagca

SEQ ID NO: 3247406 - RNA, 16 nt, Human
uuauaauuuugugaag

SEQ ID NO: 3247407 - RNA, 17 nt, Human
uuauaauuuugugaagc

SEQ ID NO: 3247408 - RNA, 22 nt, Human
uuauacaggucauauuaauaua

SEQ ID NO: 3247409 - RNA, 15 nt, Human
uuauaucuuguagcu

SEQ ID NO: 3247410 - RNA, 22 nt, Human
uuauaucuuguagcuuuaucaa

SEQ ID NO: 3247411 - RNA, 13 nt, Human
uuauauuugaaau

SEQ ID NO: 3247412 - RNA, 20 nt, Human
uuauauuuauuacuguaaga

SEQ ID NO: 3247413 - RNA, 12 nt, Human
uuauauuugaaa

SEQ ID NO: 3247414 - RNA, 16 nt, Human
uuauauuuacaaaugg

SEQ ID NO: 3247415 - RNA, 11 nt, Human
uuaucucaaaa

SEQ ID NO: 3247416 - RNA, 22 nt, Human
uuaugauuaaguaaugauaacu

SEQ ID NO: 3247417 - RNA, 18 nt, Human
uuauggcuauaggugcua

SEQ ID NO: 3247418 - RNA, 17 nt, Human
uucugucuucacaacag

SEQ ID NO: 3247419 - RNA, 18 nt, Human
uucugcuuguguuaagua

SEQ ID NO: 3247420 - RNA, 17 nt, Human
uucuuccaaaaagauuu

SEQ ID NO: 3247421 - RNA, 23 nt, Human
uugaaaagacuccaaagaaaugu

SEQ ID NO: 3247422 - RNA, 23 nt, Human
uugaugaagaaguugauaugccu

SEQ ID NO: 3247423 - RNA, 13 nt, Human
uugaugaagaagu

SEQ ID NO: 3247424 - RNA, 14 nt, Human
uugaugaagaaguu

SEQ ID NO: 3247425 - RNA, 17 nt, Human
uugacccacaagaaaug

SEQ ID NO: 3247426 - RNA, 14 nt, Human
uugacccacaagaa

SEQ ID NO: 3247427 - RNA, 14 nt, Human
uucuaugaaauauu

SEQ ID NO: 3247428 - RNA, 23 nt, Human
uucucuccucuccccaugauguu

SEQ ID NO: 3247429 - RNA, 15 nt, Human
uucugagaaagacua

SEQ ID NO: 3247430 - RNA, 16 nt, Human
uucugagaaagacuau

SEQ ID NO: 3247431 - RNA, 21 nt, Human
uucugagaaagacuauucaaa

SEQ ID NO: 3247432 - RNA, 15 nt, Human
uucuacauacuaugg

SEQ ID NO: 3247433 - RNA, 22 nt, Human
uucuacauaaguaauucaagaa

SEQ ID NO: 3247434 - RNA, 18 nt, Human
uucggugagcuacaaaug

SEQ ID NO: 3247435 - RNA, 14 nt, Human
uuguuuaaaaucau

SEQ ID NO: 3247436 - RNA, 18 nt, Human
uuguguuuugcaagccag

SEQ ID NO: 3247437 - RNA, 12 nt, Human
uugugccccugc

SEQ ID NO: 3247438 - RNA, 13 nt, Human
uuguguugugaau

SEQ ID NO: 3247439 - RNA, 16 nt, Human
uuggucugugagaugc

SEQ ID NO: 3247440 - RNA, 15 nt, Human
uuggucugugagaug

SEQ ID NO: 3247441 - RNA, 17 nt, Human
uuguaaauaguauuuga

SEQ ID NO: 3247442 - RNA, 23 nt, Human
uuguacgaagaguauuuuugaca

SEQ ID NO: 3247443 - RNA, 21 nt, Human
uuguacgaagaguauuuuuga

SEQ ID NO: 3247444 - RNA, 19 nt, Human
uuguacgaagaguauuuuu

SEQ ID NO: 3247445 - RNA, 20 nt, Human
uuuacauuguaaauaguauu

SEQ ID NO: 3247446 - RNA, 13 nt, Human
uuuaccacuugug

SEQ ID NO: 3247447 - RNA, 13 nt, Human
uuuaauaauguuu

SEQ ID NO: 3247448 - RNA, 19 nt, Human
uuuaacucuauaauguguu

SEQ ID NO: 3247449 - RNA, 22 nt, Human
uuuauaauuuugugaagcaaaa

SEQ ID NO: 3247450 - RNA, 17 nt, Human
uuuauggcacuaguauu

SEQ ID NO: 3247451 - RNA, 22 nt, Human
uuuauuguuuaaaaucauuucu

SEQ ID NO: 3247452 - RNA, 21 nt, Human
uuucagauaaucacaauacau

SEQ ID NO: 3247453 - RNA, 17 nt, Human
ugcuucuguuuuauaau

SEQ ID NO: 3247454 - RNA, 22 nt, Human
ugcuucuguuuuauaauuuugu

SEQ ID NO: 3247455 - RNA, 12 nt, Human
ugcuuguguuaa

SEQ ID NO: 3247456 - RNA, 15 nt, Human
ugcuuguguuaagua

SEQ ID NO: 3247457 - RNA, 17 nt, Human
uggagacacaacuauuu

SEQ ID NO: 3247458 - RNA, 21 nt, Human
uggcuugaguuuaaauuguaa

SEQ ID NO: 3247459 - RNA, 23 nt, Human
uggccuucggccuccauccugag

SEQ ID NO: 3247460 - RNA, 20 nt, Human
uggccuucggccuccauccu

SEQ ID NO: 3247461 - RNA, 22 nt, Human
uggccuucggccuccauccuga

SEQ ID NO: 3247462 - RNA, 14 nt, Human
uggguagacacaca

SEQ ID NO: 3247463 - RNA, 16 nt, Human
ugguucccuugaugaa

SEQ ID NO: 3247464 - RNA, 17 nt, Human
ugguucccuugaugaag

SEQ ID NO: 3247465 - RNA, 20 nt, Human
ugguucccuugaugaagaag

SEQ ID NO: 3247466 - RNA, 11 nt, Human
uguaaaauggu

SEQ ID NO: 3247467 - RNA, 12 nt, Human
uguaaaauggug

SEQ ID NO: 3247468 - RNA, 14 nt, Human
uguaauaacuguga

SEQ ID NO: 3247469 - RNA, 22 nt, Human
uguaauaacugugaaguuuaca

SEQ ID NO: 3247470 - RNA, 15 nt, Human
uguagcuuuaucaaa

SEQ ID NO: 3247471 - RNA, 14 nt, Human
uguagcuuuaucaa

SEQ ID NO: 3247472 - RNA, 13 nt, Human
uguauaaaauaau

SEQ ID NO: 3247473 - RNA, 14 nt, Human
uguauaaaauaauu

SEQ ID NO: 3247474 - RNA, 19 nt, Human
uguaguguuggagaagaac

SEQ ID NO: 3247475 - RNA, 20 nt, Human
uguaguguuggagaagaacu

SEQ ID NO: 3247476 - RNA, 21 nt, Human
uguaguguuggagaagaacug

SEQ ID NO: 3247477 - RNA, 18 nt, Human
uguauuuuaaaagaauga

SEQ ID NO: 3247478 - RNA, 19 nt, Human
uguauuuuaaaagaaugau

SEQ ID NO: 3247479 - RNA, 22 nt, Human
ugucuacacuaagagagaauga

SEQ ID NO: 3247480 - RNA, 17 nt, Human
ugucuacacuaagagag

SEQ ID NO: 3247481 - RNA, 20 nt, Human
ugagcagucaggaaagagaa

SEQ ID NO: 3247482 - RNA, 17 nt, Human
ugagcagucaggaaaga

SEQ ID NO: 3247483 - RNA, 15 nt, Human
ugagcagucaggaaa

SEQ ID NO: 3247484 - RNA, 16 nt, Human
ugagaugcuagaacuc

SEQ ID NO: 3247485 - RNA, 14 nt, Human
ugagaugcuagaac

SEQ ID NO: 3247486 - RNA, 12 nt, Human
ugagacagcucu

SEQ ID NO: 3247487 - RNA, 16 nt, Human
ugagacagcucugcau

SEQ ID NO: 3247488 - RNA, 14 nt, Human
ugagacagcucugc

SEQ ID NO: 3247489 - RNA, 16 nt, Human
ugagaaagacuauuca

SEQ ID NO: 3247490 - RNA, 17 nt, Human
ugagaaagacuauucaa

SEQ ID NO: 3247491 - RNA, 18 nt, Human
ugagaaagacuauucaaa

SEQ ID NO: 3247492 - RNA, 15 nt, Human
ugagaaagacuauuc

SEQ ID NO: 3247493 - RNA, 12 nt, Human
ugacucuuaaga

SEQ ID NO: 3247494 - RNA, 19 nt, Human
ucuugaaggaaaaugauac

SEQ ID NO: 3247495 - RNA, 24 nt, Human
ugauaguuguaccgcaaugugacu

SEQ ID NO: 3247496 - RNA, 14 nt, Human
ugauguauucuagc

SEQ ID NO: 3247497 - RNA, 20 nt, Human
ugauguauucuagcuaaugu

SEQ ID NO: 3247498 - RNA, 13 nt, Human
ugauguauucuag

SEQ ID NO: 3247499 - RNA, 23 nt, Human
ugaugcuacaggauuugaaauug

SEQ ID NO: 3247500 - RNA, 17 nt, Human
ugcagauaaacaguagu

SEQ ID NO: 3247501 - RNA, 19 nt, Human
ugcagauaaacaguaguga

SEQ ID NO: 3247502 - RNA, 17 nt, Human
ugcaugguuuagaaagc

SEQ ID NO: 3247503 - RNA, 21 nt, Human
ugcauuauauuuauuacugua

SEQ ID NO: 3247504 - RNA, 16 nt, Human
ugcacugucaagauga

SEQ ID NO: 3247505 - RNA, 14 nt, Human
ugcaauuucauaug

SEQ ID NO: 3247506 - RNA, 20 nt, Human
ugcaauuucauaugcuguau

SEQ ID NO: 3247507 - RNA, 15 nt, Human
ucccuugaugaagaa

SEQ ID NO: 3247508 - RNA, 16 nt, Human
ucccuugaugaagaag

SEQ ID NO: 3247509 - RNA, 20 nt, Human
uccugccuaagugcagcccc

SEQ ID NO: 3247510 - RNA, 17 nt, Human
uccuggcaauagucaaa

SEQ ID NO: 3247511 - RNA, 16 nt, Human
uccuuggacucauuuu

SEQ ID NO: 3247512 - RNA, 22 nt, Human
ucuagugagcagucaggaaaga

SEQ ID NO: 3247513 - RNA, 19 nt, Human
ucuagugagcagucaggaa

SEQ ID NO: 3247514 - RNA, 17 nt, Human
ucuaugaaauauuaugu

SEQ ID NO: 3247515 - RNA, 13 nt, Human
ucuaugaaauauu

SEQ ID NO: 3247516 - RNA, 14 nt, Human
ucuaugaaauauua

SEQ ID NO: 3247517 - RNA, 15 nt, Human
ucucaacuccaaacu

SEQ ID NO: 3247518 - RNA, 17 nt, Human
ucggccuccauccugag

SEQ ID NO: 3247519 - RNA, 18 nt, Human
ucggccuccauccugagg

SEQ ID NO: 3247520 - RNA, 21 nt, Human
ucguggaacaguuaccucugc

SEQ ID NO: 3247521 - RNA, 22 nt, Human
ucgugggacagucaccucaugg

SEQ ID NO: 3247522 - RNA, 13 nt, Human
ucguuaauuugua

SEQ ID NO: 3247523 - RNA, 23 nt, Human
ucucuggccuucggccuccaucc

SEQ ID NO: 3247524 - RNA, 19 nt, Human
ucucuaggaaauauuuauu

SEQ ID NO: 3247525 - RNA, 19 nt, Human
ucugcaucagcugcugaaa

SEQ ID NO: 3247526 - RNA, 21 nt, Human
ucugcaucagcugcugaaaca

SEQ ID NO: 3247527 - RNA, 14 nt, Human
ucugcaucagcugc

SEQ ID NO: 3247528 - RNA, 19 nt, Human
ucuucaucugacuaugaca

SEQ ID NO: 3247529 - RNA, 15 nt, Human
ucugucuucacaaca

SEQ ID NO: 3247530 - RNA, 18 nt, Human
ucuuaagaagacugcauu

SEQ ID NO: 3247531 - RNA, 12 nt, Human
ucuuaagaagac

SEQ ID NO: 3247532 - RNA, 18 nt, Human
ucuggccuucggccucca

SEQ ID NO: 3247533 - RNA, 17 nt, Human
ucuggccuucggccucc

SEQ ID NO: 3247534 - RNA, 10 nt, Human
ucuggccuuc

SEQ ID NO: 3247535 - RNA, 18 nt, Human
ucagcuccccucggagaa

SEQ ID NO: 3247536 - RNA, 17 nt, Human
ucagcuccccucggaga

SEQ ID NO: 3247537 - RNA, 13 nt, Human
ucaggcuagaugu

SEQ ID NO: 3247538 - RNA, 17 nt, Human
ucaggcuagauguaugu

SEQ ID NO: 3247539 - RNA, 16 nt, Human
uccacuuggucuguga

SEQ ID NO: 3247540 - RNA, 15 nt, Human
uccacuuggucugug

SEQ ID NO: 3247541 - RNA, 14 nt, Human
uccacuuggucugu

SEQ ID NO: 3247542 - RNA, 19 nt, Human
uccacagaagcuccaggua

SEQ ID NO: 3247543 - RNA, 15 nt, Human
uccaaaauaauuuua

SEQ ID NO: 3247544 - RNA, 19 nt, Human
uccaaaauaauuuuaagaa

SEQ ID NO: 3247545 - RNA, 12 nt, Human
ucauagcagcuu

SEQ ID NO: 3247546 - RNA, 18 nt, Human
ucauaccuaucaucuuaa

SEQ ID NO: 3247547 - RNA, 18 nt, Human
ucaucugacuaugacaua

SEQ ID NO: 3247548 - RNA, 17 nt, Human
ucaucugacuaugacau

SEQ ID NO: 3247549 - RNA, 13 nt, Human
ucauuuccaagca

SEQ ID NO: 3247550 - RNA, 16 nt, Human
ucauuuccaagcaagu

SEQ ID NO: 3247551 - RNA, 13 nt, Human
ucauuaucucaaa

SEQ ID NO: 3247552 - RNA, 19 nt, Human
ucauuaucucaaaacugca

SEQ ID NO: 3247553 - RNA, 20 nt, Human
ucauuaucucaaaacugcac

SEQ ID NO: 3247554 - RNA, 13 nt, Human
ucacaagacccaa

SEQ ID NO: 3247555 - RNA, 17 nt, Human
ucacaagacccaaaagg

SEQ ID NO: 3247556 - RNA, 16 nt, Human
ucacagucacauucca

SEQ ID NO: 3247557 - RNA, 14 nt, Human
ucaccaaggcugau

SEQ ID NO: 3247558 - RNA, 13 nt, Human
ucaaugcagcccc

SEQ ID NO: 3247559 - RNA, 21 nt, Human
ucaauaaaauccauacauuug

SEQ ID NO: 3247560 - RNA, 14 nt, Human
ucaauaaaauccau

SEQ ID NO: 3247561 - RNA, 14 nt, Human
ucaaauaugcaaag

SEQ ID NO: 3247562 - RNA, 20 nt, Human
ucaaaucaagaaacuuaagg

SEQ ID NO: 3247563 - RNA, 14 nt, Human
ucaaauugugugaa

SEQ ID NO: 3247564 - RNA, 13 nt, Human
uauguacuucaug

SEQ ID NO: 3247565 - RNA, 17 nt, Human
uauguacuucaugcugu

SEQ ID NO: 3247566 - RNA, 12 nt, Human
uauuaauauauu

SEQ ID NO: 3247567 - RNA, 16 nt, Human
uauguuucaaacuuug

SEQ ID NO: 3247568 - RNA, 15 nt, Human
uauguuucaaacuuu

SEQ ID NO: 3247569 - RNA, 13 nt, Human
uauguuucaaacu

SEQ ID NO: 3247570 - RNA, 14 nt, Human
uauuguguugugaa

SEQ ID NO: 3247571 - RNA, 16 nt, Human
uauuauucccauucua

SEQ ID NO: 3247572 - RNA, 14 nt, Human
uauucuaaauuuua

SEQ ID NO: 3247573 - RNA, 20 nt, Human
uauucuaaauuuuauaucuu

SEQ ID NO: 3247574 - RNA, 19 nt, Human
uauucuaaauuuuauaucu

SEQ ID NO: 3247575 - RNA, 15 nt, Human
uauucuaaauuuuau

SEQ ID NO: 3247576 - RNA, 19 nt, Human
uauucuagcuaauguaaua

SEQ ID NO: 3247577 - RNA, 20 nt, Human
cucuuagaugcaguucugaa

SEQ ID NO: 3247578 - RNA, 19 nt, Human
cucuauguucuaagaagug

SEQ ID NO: 3247579 - RNA, 12 nt, Human
cucucuggccuu

SEQ ID NO: 3247580 - RNA, 11 nt, Human
cucucuggccu

SEQ ID NO: 3247581 - RNA, 15 nt, Human
cucuuagaugcaguu

SEQ ID NO: 3247582 - RNA, 16 nt, Human
cgacagugagacucug

SEQ ID NO: 3247583 - RNA, 15 nt, Human
cgacagugagacucu

SEQ ID NO: 3247584 - RNA, 23 nt, Human
cuaguugaucagcuuauugucua

SEQ ID NO: 3247585 - RNA, 13 nt, Human
cuagaacucccuu

SEQ ID NO: 3247586 - RNA, 19 nt, Human
cuagaacucccuuucaaca

SEQ ID NO: 3247587 - RNA, 18 nt, Human
cuagaacucccuuucaac

SEQ ID NO: 3247588 - RNA, 17 nt, Human
cuagaacucccuuucaa

SEQ ID NO: 3247589 - RNA, 16 nt, Human
cuagaacucccuuuca

SEQ ID NO: 3247590 - RNA, 23 nt, Human
cuaagugaaauaagccagacauc

SEQ ID NO: 3247591 - RNA, 20 nt, Human
cuaagugaaauaagccagac

SEQ ID NO: 3247592 - RNA, 15 nt, Human
cuacaugagguacug

SEQ ID NO: 3247593 - RNA, 22 nt, Human
cuacauaaguaauucaagaaaa

SEQ ID NO: 3247594 - RNA, 23 nt, Human
cuacauaaguaauucaagaaaac

SEQ ID NO: 3247595 - RNA, 14 nt, Human
cuaacuggacuggu

SEQ ID NO: 3247596 - RNA, 15 nt, Human
ccucauguccacugg

SEQ ID NO: 3247597 - RNA, 20 nt, Human
ccucauguccacugguucuu

SEQ ID NO: 3247598 - RNA, 16 nt, Human
ccguagguuauuuuca

SEQ ID NO: 3247599 - RNA, 21 nt, Human
ccaguuauggcuauaggugcu

SEQ ID NO: 3247600 - RNA, 15 nt, Human
ccagauccuggaaau

SEQ ID NO: 3247601 - RNA, 23 nt, Human
cccgggaggcagagguugcagug

SEQ ID NO: 3247602 - RNA, 23 nt, Human
cccauuguggucacaggaaguag

SEQ ID NO: 3247603 - RNA, 22 nt, Human
cccauuguggucacaggaagua

SEQ ID NO: 3247604 - RNA, 15 nt, Human
cauuaggauggcuag

SEQ ID NO: 3247605 - RNA, 19 nt, Human
ccaaaaagauuuucagaaa

SEQ ID NO: 3247606 - RNA, 18 nt, Human
ccaaauguucaucaauga

SEQ ID NO: 3247607 - RNA, 17 nt, Human
cauagauucccugagca

SEQ ID NO: 3247608 - RNA, 18 nt, Human
cauagauucccugagcag

SEQ ID NO: 3247609 - RNA, 20 nt, Human
cauagcagcuuauucacaag

SEQ ID NO: 3247610 - RNA, 20 nt, Human
caucagcuugcccuguuaaa

SEQ ID NO: 3247611 - RNA, 17 nt, Human
caucagcugcugaaaca

SEQ ID NO: 3247612 - RNA, 18 nt, Human
caucagcugcugaaacaa

SEQ ID NO: 3247613 - RNA, 15 nt, Human
caucagcugcugaaa

SEQ ID NO: 3247614 - RNA, 13 nt, Human
caucagcugcuga

SEQ ID NO: 3247615 - RNA, 16 nt, Human
caugaauuaguuuuau

SEQ ID NO: 3247616 - RNA, 16 nt, Human
cagcuuauucacaaga

SEQ ID NO: 3247617 - RNA, 21 nt, Human
caggaaaucaaauaugcaaag

SEQ ID NO: 3247618 - RNA, 19 nt, Human
caggaaaucaaauaugcaa

SEQ ID NO: 3247619 - RNA, 23 nt, Human
caggacagcccuucuuuccacag

SEQ ID NO: 3247620 - RNA, 24 nt, Human
caggacagcccuucuuuccacaga

SEQ ID NO: 3247621 - RNA, 19 nt, Human
cagggaggacgcucucugg

SEQ ID NO: 3247622 - RNA, 22 nt, Human
cagggaggacgcucucuggccu

SEQ ID NO: 3247623 - RNA, 20 nt, Human
cagccagacuggcacaguuu

SEQ ID NO: 3247624 - RNA, 22 nt, Human
cagcacagccucuuagaugcag

SEQ ID NO: 3247625 - RNA, 23 nt, Human
cagccugagcgacagugagacuc

SEQ ID NO: 3247626 - RNA, 22 nt, Human
cagccugagcgacagugagacu

SEQ ID NO: 3247627 - RNA, 19 nt, Human
cagccccgugggguuccuc

SEQ ID NO: 3247628 - RNA, 20 nt, Human
caaagcacugacuucuaagu

SEQ ID NO: 3247629 - RNA, 22 nt, Human
caaagcacugacuucuaaguaa

SEQ ID NO: 3247630 - RNA, 15 nt, Human
caacacgagcaggcu

SEQ ID NO: 3247631 - RNA, 23 nt, Human
caacacgagcaggcuacugucag

SEQ ID NO: 3247632 - RNA, 20 nt, Human
caaaaaaaaaaaaaaauuag

SEQ ID NO: 3247633 - RNA, 21 nt, Human
caaaaggauaaugaauacuuu

SEQ ID NO: 3247634 - RNA, 15 nt, Human
caaaaggcagaagca

SEQ ID NO: 3247635 - RNA, 14 nt, Human
auuugcucauggaa

SEQ ID NO: 3247636 - RNA, 17 nt, Human
auuugcucauggaauug

SEQ ID NO: 3247637 - RNA, 19 nt, Human
auuuuauagcuacuaauuu

SEQ ID NO: 3247638 - RNA, 17 nt, Human
auuuuauagcuacuaau

SEQ ID NO: 3247639 - RNA, 19 nt, Human
auucacaagacccaaaagg

SEQ ID NO: 3247640 - RNA, 22 nt, Human
auuaugaauuacauuuguauaa

SEQ ID NO: 3247641 - RNA, 14 nt, Human
auuaugaauuacau

SEQ ID NO: 3247642 - RNA, 17 nt, Human
auuaugaauuacauuug

SEQ ID NO: 3247643 - RNA, 16 nt, Human
auuagggagagaagau

SEQ ID NO: 3247644 - RNA, 22 nt, Human
auucauagcagcuuauucacaa

SEQ ID NO: 3247645 - RNA, 19 nt, Human
auucauagcagcuuauuca

SEQ ID NO: 3247646 - RNA, 14 nt, Human
auuguaaaauggug

SEQ ID NO: 3247647 - RNA, 13 nt, Human
auuguaaaauggu

SEQ ID NO: 3247648 - RNA, 23 nt, Human
auuguaauaggcguaacuaauuu

SEQ ID NO: 3247649 - RNA, 15 nt, Human
auucuugaaggaaaa

SEQ ID NO: 3247650 - RNA, 18 nt, Human
auucuugaaggaaaauga

SEQ ID NO: 3247651 - RNA, 21 nt, Human
auugauaaguucauacauugu

SEQ ID NO: 3247652 - RNA, 22 nt, Human
auugauaaguucauacauugua

SEQ ID NO: 3247653 - RNA, 14 nt, Human
caaguccaagcaua

SEQ ID NO: 3247654 - RNA, 22 nt, Human
cacacaugaaguccaagcauuu

SEQ ID NO: 3247655 - RNA, 17 nt, Human
cacacaugaaguccaag

SEQ ID NO: 3247656 - RNA, 21 nt, Human
cacagccucuuagaugcaguu

SEQ ID NO: 3247657 - RNA, 17 nt, Human
cacagccucuuagaugc

SEQ ID NO: 3247658 - RNA, 18 nt, Human
cacaagacugcacaucaa

SEQ ID NO: 3247659 - RNA, 16 nt, Human
caaugcuguauuuuaa

SEQ ID NO: 3247660 - RNA, 17 nt, Human
caaugcuguauuuuaaa

SEQ ID NO: 3247661 - RNA, 15 nt, Human
caaugcuguauuuua

SEQ ID NO: 3247662 - RNA, 15 nt, Human
caauucuugccaaau

SEQ ID NO: 3247663 - RNA, 20 nt, Human
cacuagggcagggacaggau

SEQ ID NO: 3247664 - RNA, 21 nt, Human
cacuagggcagggacaggaua

SEQ ID NO: 3247665 - RNA, 22 nt, Human
cacugguucuucuuggucucag

SEQ ID NO: 3247666 - RNA, 16 nt, Human
cacuugucaauaaaau

SEQ ID NO: 3247667 - RNA, 19 nt, Human
cacuuguguuuugcaagcc

SEQ ID NO: 3247668 - RNA, 17 nt, Human
cacuuguguuuugcaag

SEQ ID NO: 3247669 - RNA, 22 nt, Human
cacuuguguuuugcaagccaga

SEQ ID NO: 3247670 - RNA, 21 nt, Human
cacugcagaagacaguauggc

SEQ ID NO: 3247671 - RNA, 17 nt, Human
ggcauauuuuucacaua

SEQ ID NO: 3247672 - RNA, 15 nt, Human
ggcauauuuuucaca

SEQ ID NO: 3247673 - RNA, 23 nt, Human
ggccuucggccuccauccugagg

SEQ ID NO: 3247674 - RNA, 22 nt, Human
ggccuucggccuccauccugag

SEQ ID NO: 3247675 - RNA, 12 nt, Human
ggauggcaagau

SEQ ID NO: 3247676 - RNA, 20 nt, Human
aaaguuauugauaaguucau

SEQ ID NO: 3247677 - RNA, 23 nt, Human
aaaguuauugauaaguucauaca

SEQ ID NO: 3247678 - RNA, 18 nt, Human
aaauaauuuuuauauuug

SEQ ID NO: 3247679 - RNA, 20 nt, Human
aaauaauuuuuauauuugaa

SEQ ID NO: 3247680 - RNA, 15 nt, Human
aaauaauuuuuauau

SEQ ID NO: 3247681 - RNA, 17 nt, Human
guaacaaugaagauaaa

SEQ ID NO: 3247682 - RNA, 12 nt, Human
guaaaaugugaa

SEQ ID NO: 3247683 - RNA, 19 nt, Human
guaaaaugugaagugaaug

SEQ ID NO: 3247684 - RNA, 20 nt, Human
guaaaaugugaagugaauga

SEQ ID NO: 3247685 - RNA, 22 nt, Human
guaaaaugugaagugaaugaaa

SEQ ID NO: 3247686 - RNA, 16 nt, Human
gguuuagaaagcuugc

SEQ ID NO: 3247687 - RNA, 16 nt, Human
ggugugaccacugcag

SEQ ID NO: 3247688 - RNA, 15 nt, Human
aaagacuauucaaac

SEQ ID NO: 3247689 - RNA, 13 nt, Human
aaagauuuucaga

SEQ ID NO: 3247690 - RNA, 24 nt, Human
ggucugugagaugcuagaacuccc

SEQ ID NO: 3247691 - RNA, 14 nt, Human
aaagacuauucaaa

SEQ ID NO: 3247692 - RNA, 19 nt, Human
aaaaguauguuagugcaaa

SEQ ID NO: 3247693 - RNA, 15 nt, Human
gggcgugguggugag

SEQ ID NO: 3247694 - RNA, 20 nt, Human
aaacagucucaggaaaucaa

SEQ ID NO: 3247695 - RNA, 22 nt, Human
aaaauuuuuucucuaggaaaua

SEQ ID NO: 3247696 - RNA, 15 nt, Human
aaaaugugauaugua

SEQ ID NO: 3247697 - RNA, 12 nt, Human
aaaaugugaagu

SEQ ID NO: 3247698 - RNA, 12 nt, Human
aaaaccacagca

SEQ ID NO: 3247699 - RNA, 22 nt, Human
aaaaauggaacauaaaauacaa

SEQ ID NO: 3247700 - RNA, 17 nt, Human
aaaagaugaaaauauuu

SEQ ID NO: 3247701 - RNA, 13 nt, Human
aaaacucauuuuu

SEQ ID NO: 3247702 - RNA, 13 nt, Human
aaaaccacagcag

SEQ ID NO: 3247703 - RNA, 19 nt, Human
gggacauuugcucauggaa

SEQ ID NO: 3247704 - RNA, 20 nt, Human
gggacauuugcucauggaau

SEQ ID NO: 3247705 - RNA, 21 nt, Human
gggacauuugcucauggaauu

SEQ ID NO: 3247706 - RNA, 13 nt, Human
aaaaauauauuua

SEQ ID NO: 3247707 - RNA, 15 nt, Human
aaaaauauauuuaau

SEQ ID NO: 3247708 - RNA, 19 nt, Human
aaaaauauauuuaaugaua

SEQ ID NO: 3247709 - RNA, 17 nt, Human
gggauuguaaaauggug

SEQ ID NO: 3247710 - RNA, 16 nt, Human
gggauuguaaaauggu

SEQ ID NO: 3247711 - RNA, 15 nt, Human
gcucugcccauccug

SEQ ID NO: 3247712 - RNA, 21 nt, Human
gcucugcccauccugccccug

SEQ ID NO: 3247713 - RNA, 16 nt, Human
gcugaaacaacaaaua

SEQ ID NO: 3247714 - RNA, 20 nt, Human
gcuccacuuggucugugaga

SEQ ID NO: 3247715 - RNA, 19 nt, Human
gcuccacuuggucugugag

SEQ ID NO: 3247716 - RNA, 12 nt, Human
gcuguauuuuaa

SEQ ID NO: 3247717 - RNA, 13 nt, Human
gcuguauuuuaaa

SEQ ID NO: 3247718 - RNA, 19 nt, Human
gcuuccuggcaauagucaa

SEQ ID NO: 3247719 - RNA, 22 nt, Human
gccaugugcuaguaauuggaaa

SEQ ID NO: 3247720 - RNA, 22 nt, Human
gccaguuauggcuauaggugcu

SEQ ID NO: 3247721 - RNA, 20 nt, Human
gccuccauccugaggcucca

SEQ ID NO: 3247722 - RNA, 16 nt, Human
gccuccauccugaggc

SEQ ID NO: 3247723 - RNA, 15 nt, Human
gccuccauccugagg

SEQ ID NO: 3247724 - RNA, 17 nt, Human
gcuacuugggaggcuga

SEQ ID NO: 3247725 - RNA, 15 nt, Human
gcuacugucagcucc

SEQ ID NO: 3247726 - RNA, 18 nt, Human
gcuacaaaaacacagcaa

SEQ ID NO: 3247727 - RNA, 19 nt, Human
gcuacaaaaacacagcaag

SEQ ID NO: 3247728 - RNA, 17 nt, Human
gcuacaaaaacacagca

SEQ ID NO: 3247729 - RNA, 17 nt, Human
gauuagggagagaagau

SEQ ID NO: 3247730 - RNA, 14 nt, Human
gaugugaacacauc

SEQ ID NO: 3247731 - RNA, 16 nt, Human
gaugugaacacaucag

SEQ ID NO: 3247732 - RNA, 14 nt, Human
gauuaccagggacu

SEQ ID NO: 3247733 - RNA, 20 nt, Human
gauauguaccuaacgaagua

SEQ ID NO: 3247734 - RNA, 16 nt, Human
gaguuuaaauuguaau

SEQ ID NO: 3247735 - RNA, 16 nt, Human
gaguuuagcuggaaaa

SEQ ID NO: 3247736 - RNA, 19 nt, Human
gcagggacuugaacccaua

SEQ ID NO: 3247737 - RNA, 12 nt, Human
gcacugacagau

SEQ ID NO: 3247738 - RNA, 17 nt, Human
gcacugacagauuucca

SEQ ID NO: 3247739 - RNA, 14 nt, Human
gcacaguuuucuga

SEQ ID NO: 3247740 - RNA, 17 nt, Human
gcacaguuuucugagaa

SEQ ID NO: 3247741 - RNA, 18 nt, Human
gcacaguuuucugagaaa

SEQ ID NO: 3247742 - RNA, 21 nt, Human
gagcaggcuacugucagcucc

SEQ ID NO: 3247743 - RNA, 22 nt, Human
gacuauucaaacagucucagga

SEQ ID NO: 3247744 - RNA, 13 nt, Human
gacuaugacauaa

SEQ ID NO: 3247745 - RNA, 17 nt, Human
gacucuuaagaagacug

SEQ ID NO: 3247746 - RNA, 15 nt, Human
gacucuuaagaagac

SEQ ID NO: 3247747 - RNA, 16 nt, Human
gacucuuaagaagacu

SEQ ID NO: 3247748 - RNA, 15 nt, Human
gagaaucacuugaac

SEQ ID NO: 3247749 - RNA, 14 nt, Human
gagaaucacuugaa

SEQ ID NO: 3247750 - RNA, 22 nt, Human
gagacguuuuuggaagaguagu

SEQ ID NO: 3247751 - RNA, 20 nt, Human
gaaugaauggcuaagcaaaa

SEQ ID NO: 3247752 - RNA, 20 nt, Human
gaaugagagacacacugaag

SEQ ID NO: 3247753 - RNA, 22 nt, Human
gaaugagagacacacugaagaa

SEQ ID NO: 3247754 - RNA, 23 nt, Human
gaaugagagacacacugaagaag

SEQ ID NO: 3247755 - RNA, 12 nt, Human
gacacacaugaa

SEQ ID NO: 3247756 - RNA, 13 nt, Human
gacacacugaaga

SEQ ID NO: 3247757 - RNA, 11 nt, Human
gaauuaguuuu

SEQ ID NO: 3247758 - RNA, 16 nt, Human
gacacuuaaaaauggu

SEQ ID NO: 3247759 - RNA, 16 nt, Human
gacagaauauguuuca

SEQ ID NO: 3247760 - RNA, 20 nt, Human
gacaguauggcagcuuuccu

SEQ ID NO: 3247761 - RNA, 17 nt, Human
gaaauauuuauuuuaau

SEQ ID NO: 3247762 - RNA, 16 nt, Human
gaaauauuuauuuuaa

SEQ ID NO: 3247763 - RNA, 19 nt, Human
gaaaucaaauaugcaaagc

SEQ ID NO: 3247764 - RNA, 20 nt, Human
gaaaucaaauaugcaaagca

SEQ ID NO: 3247765 - RNA, 18 nt, Human
gaaaucaaauaugcaaag

SEQ ID NO: 3247766 - RNA, 17 nt, Human
gaaaucaaauaugcaaa

SEQ ID NO: 3247767 - RNA, 18 nt, Human
gaaauauuuauuuuaaua

SEQ ID NO: 3247768 - RNA, 14 nt, Human
gaaagacuauucaa

SEQ ID NO: 3247769 - RNA, 15 nt, Human
gaaagacuauucaaa

SEQ ID NO: 3247770 - RNA, 21 nt, Human
gaaaacuuuaugcuaagugaa

SEQ ID NO: 3247771 - RNA, 12 nt, Human
cuugaugaagaa

SEQ ID NO: 3247772 - RNA, 13 nt, Human
cuugaugaagaag

SEQ ID NO: 3247773 - RNA, 22 nt, Human
cuucuaaguaaaaccacagcag

SEQ ID NO: 3247774 - RNA, 23 nt, Human
cuucuaaguaaaaccacagcagu

SEQ ID NO: 3247775 - RNA, 15 nt, Human
cuucacuguaaaaua

SEQ ID NO: 3247776 - RNA, 21 nt, Human
cuucaucugacuaugacauaa

SEQ ID NO: 3247777 - RNA, 19 nt, Human
cuucaucugacuaugacau

SEQ ID NO: 3247778 - RNA, 20 nt, Human
cuucaugcauagguuuagca

SEQ ID NO: 3247779 - RNA, 16 nt, Human
cugugagaugcuagaa

SEQ ID NO: 3247780 - RNA, 23 nt, Human
cugucagcuccccucggagaaga

SEQ ID NO: 3247781 - RNA, 21 nt, Human
cugucagcuccccucggagaa

SEQ ID NO: 3247782 - RNA, 21 nt, Human
cuggaaaucaggguuaguauu

SEQ ID NO: 3247783 - RNA, 13 nt, Human
uaggauguugaaa

SEQ ID NO: 3247784 - RNA, 13 nt, Human
acacaacuauauu

SEQ ID NO: 3247785 - RNA, 19 nt, Human
uagcacugacagauuucca

SEQ ID NO: 3247786 - RNA, 14 nt, Human
uagcacugacagau

SEQ ID NO: 3247787 - RNA, 14 nt, Human
uagaggguguguaa

SEQ ID NO: 3247788 - RNA, 18 nt, Human
acaaaaggauaaugaaua

SEQ ID NO: 3247789 - RNA, 14 nt, Human
acaaaaacacagca

SEQ ID NO: 3247790 - RNA, 15 nt, Human
acaaaaacacagcaa

SEQ ID NO: 3247791 - RNA, 13 nt, Human
acaaaaacacagc

SEQ ID NO: 3247792 - RNA, 15 nt, Human
uagaaacacaacuau

SEQ ID NO: 3247793 - RNA, 17 nt, Human
uagaacucccuuucaac

SEQ ID NO: 3247794 - RNA, 16 nt, Human
uagaacucccuuucaa

SEQ ID NO: 3247795 - RNA, 15 nt, Human
uagaacucccuuuca

SEQ ID NO: 3247796 - RNA, 17 nt, Human
aauuccaauuauaugag

SEQ ID NO: 3247797 - RNA, 13 nt, Human
uagacacacauga

SEQ ID NO: 3247798 - RNA, 16 nt, Human
aauuuggauugcuaau

SEQ ID NO: 3247799 - RNA, 14 nt, Human
acagcuguaugauu

SEQ ID NO: 3247800 - RNA, 19 nt, Human
acagcuguaugauucccag

SEQ ID NO: 3247801 - RNA, 20 nt, Human
acagcuguaugauucccagc

SEQ ID NO: 3247802 - RNA, 23 nt, Human
acagcuguaugauucccagccag

SEQ ID NO: 3247803 - RNA, 18 nt, Human
acagcaagggugauggga

SEQ ID NO: 3247804 - RNA, 13 nt, Human
acacucaaaucaa

SEQ ID NO: 3247805 - RNA, 19 nt, Human
acacuaagagagaaugaga

SEQ ID NO: 3247806 - RNA, 17 nt, Human
acacucaaaucaagaaa

SEQ ID NO: 3247807 - RNA, 16 nt, Human
uauacaggucauauua

SEQ ID NO: 3247808 - RNA, 15 nt, Human
uauacaggucauauu

SEQ ID NO: 3247809 - RNA, 19 nt, Human
uauaggaauugacccacaa

SEQ ID NO: 3247810 - RNA, 16 nt, Human
uauaggugcuacaaaa

SEQ ID NO: 3247811 - RNA, 16 nt, Human
acacucaguuguucaa

SEQ ID NO: 3247812 - RNA, 17 nt, Human
uauauccuuucuaacaa

SEQ ID NO: 3247813 - RNA, 20 nt, Human
uauauccuuucuaacaaaaa

SEQ ID NO: 3247814 - RNA, 19 nt, Human
acagaaagcagaacaguga

SEQ ID NO: 3247815 - RNA, 14 nt, Human
uaucacaaaucuua

SEQ ID NO: 3247816 - RNA, 16 nt, Human
uaucacaaaucuuaac

SEQ ID NO: 3247817 - RNA, 20 nt, Human
uaucacaaaucuuaacuuga

SEQ ID NO: 3247818 - RNA, 14 nt, Human
acagaccuuugaac

SEQ ID NO: 3247819 - RNA, 22 nt, Human
uaucaaagggugaaaauuauuu

SEQ ID NO: 3247820 - RNA, 19 nt, Human
uaucaaagggugaaaauua

SEQ ID NO: 3247821 - RNA, 18 nt, Human
uaucaaagggugaaaauu

SEQ ID NO: 3247822 - RNA, 16 nt, Human
uaaaugugcuuuuaaa

SEQ ID NO: 3247823 - RNA, 17 nt, Human
uaacaaugaagauaaaa

SEQ ID NO: 3247824 - RNA, 23 nt, Human
aauaccacaggaaccacaagacu

SEQ ID NO: 3247825 - RNA, 18 nt, Human
aauaccaugccauuuaaa

SEQ ID NO: 3247826 - RNA, 23 nt, Human
aauacaucccuuaccugggaaag

SEQ ID NO: 3247827 - RNA, 22 nt, Human
aauagagcaaaauugauguguu

SEQ ID NO: 3247828 - RNA, 20 nt, Human
aauagagcaaaauugaugug

SEQ ID NO: 3247829 - RNA, 21 nt, Human
uaacuuccuuggacucauuuu

SEQ ID NO: 3247830 - RNA, 13 nt, Human
uaagaagugaaaa

SEQ ID NO: 3247831 - RNA, 19 nt, Human
aauagucaaauugugugaa

SEQ ID NO: 3247832 - RNA, 14 nt, Human
aauauauuuaauga

SEQ ID NO: 3247833 - RNA, 20 nt, Human
uaacgauaaaagacagugaa

SEQ ID NO: 3247834 - RNA, 20 nt, Human
aauccucaguuuuugugaaa

SEQ ID NO: 3247835 - RNA, 14 nt, Human
aaucagugugucua

SEQ ID NO: 3247836 - RNA, 17 nt, Human
aaucagugugucuaaau

SEQ ID NO: 3247837 - RNA, 18 nt, Human
aaucagugugucuaaauu

SEQ ID NO: 3247838 - RNA, 22 nt, Human
aaucagugugucuaaauuugaa

SEQ ID NO: 3247839 - RNA, 18 nt, Human
uaaguuuuuuuuuaaaaa

SEQ ID NO: 3247840 - RNA, 13 nt, Human
uaaguaaaaccac

SEQ ID NO: 3247841 - RNA, 15 nt, Human
uaaguaaaaccacag

SEQ ID NO: 3247842 - RNA, 18 nt, Human
uaagguuaccuuuguucc

SEQ ID NO: 3247843 - RNA, 16 nt, Human
uaaguaaaaccacagc

SEQ ID NO: 3247844 - RNA, 17 nt, Human
uaaguaaaaccacagca

SEQ ID NO: 3247845 - RNA, 18 nt, Human
uaaguaaaaccacagcag

SEQ ID NO: 3247846 - RNA, 19 nt, Human
uaaguaaugauaacuggaa

SEQ ID NO: 3247847 - RNA, 16 nt, Human
uaaguaauucaagaaa

SEQ ID NO: 3247848 - RNA, 20 nt, Human
uaaguaaugauaacuggaaa

SEQ ID NO: 3247849 - RNA, 16 nt, Human
aaucagccuaguugau

SEQ ID NO: 3247850 - RNA, 14 nt, Human
uaagcaaaauguga

SEQ ID NO: 3247851 - RNA, 15 nt, Human
uaagcaaaaugugau

SEQ ID NO: 3247852 - RNA, 22 nt, Human
uaagcagauggaaugcuguguu

SEQ ID NO: 3247853 - RNA, 17 nt, Human
uaauuuuuauauuugaa

SEQ ID NO: 3247854 - RNA, 20 nt, Human
aaugcuguauuuuaaaagaa

SEQ ID NO: 3247855 - RNA, 21 nt, Human
aaugcuguauuuuaaaagaau

SEQ ID NO: 3247856 - RNA, 22 nt, Human
aaugcuguauuuuaaaagaaug

SEQ ID NO: 3247857 - RNA, 20 nt, Human
aauguaagggaaacugccag

SEQ ID NO: 3247858 - RNA, 17 nt, Human
uacagagacagaaagca

SEQ ID NO: 3247859 - RNA, 13 nt, Human
uacagaauuuuau

SEQ ID NO: 3247860 - RNA, 23 nt, Human
aaugauuaugaauuacauuugua

SEQ ID NO: 3247861 - RNA, 22 nt, Human
aaugagagacacacugaagaag

SEQ ID NO: 3247862 - RNA, 21 nt, Human
aaugagagacacacugaagaa

SEQ ID NO: 3247863 - RNA, 16 nt, Human
aaugauuucauucaau

SEQ ID NO: 3247864 - RNA, 16 nt, Human
uaauuuauacagguca

SEQ ID NO: 3247865 - RNA, 18 nt, Human
uaauuuuuauauuugaaa

SEQ ID NO: 3247866 - RNA, 19 nt, Human
uaauuuuuauauuugaaau

SEQ ID NO: 3247867 - RNA, 21 nt, Human
uaauuuuuauauuugaaauau

SEQ ID NO: 3247868 - RNA, 22 nt, Human
uaauuccguagguuauuuucag

SEQ ID NO: 3247869 - RNA, 20 nt, Human
aauguucaucaaugaaugaa

SEQ ID NO: 3247870 - RNA, 16 nt, Human
aauguucaucaaugaa

SEQ ID NO: 3247871 - RNA, 13 nt, Human
aauguucaucaau

SEQ ID NO: 3247872 - RNA, 19 nt, Human
uaccagggacugaggggag

SEQ ID NO: 3247873 - RNA, 16 nt, Human
uaccaugccauuuaaa

SEQ ID NO: 3247874 - RNA, 12 nt, Human
aauucaagaaaa

SEQ ID NO: 3247875 - RNA, 20 nt, Human
aauucaagaaaacaacuuca

SEQ ID NO: 3247876 - RNA, 15 nt, Human
aauucagaaggaucu

SEQ ID NO: 3247877 - RNA, 21 nt, Human
aauucagaaggaucuucaucu

SEQ ID NO: 3247878 - RNA, 14 nt, Human
aauuacauuuguau

SEQ ID NO: 3247879 - RNA, 13 nt, Human
aauuacauuugua

SEQ ID NO: 3247880 - RNA, 13 nt, Human
aaguauuagaaua

SEQ ID NO: 3247881 - RNA, 14 nt, Human
aaguaaugauaacu

SEQ ID NO: 3247882 - RNA, 22 nt, Human
aagucuuauauauuguagauaa

SEQ ID NO: 3247883 - RNA, 16 nt, Human
aagucuuucacauuua

SEQ ID NO: 3247884 - RNA, 16 nt, Human
uaaaagaauauuuuaa

SEQ ID NO: 3247885 - RNA, 23 nt, Human
uaaaagaauauuuuaacuuccuu

SEQ ID NO: 3247886 - RNA, 12 nt, Human
uaaaagaaugau

SEQ ID NO: 3247887 - RNA, 22 nt, Human
uaaaaauauuguguugugaaug

SEQ ID NO: 3247888 - RNA, 20 nt, Human
uaaaagacagugaaagaaaa

SEQ ID NO: 3247889 - RNA, 13 nt, Human
aaggauaaugaau

SEQ ID NO: 3247890 - RNA, 14 nt, Human
aagguacuucaaau

SEQ ID NO: 3247891 - RNA, 15 nt, Human
aagggugaaaauuau

SEQ ID NO: 3247892 - RNA, 16 nt, Human
aagggugaaaauuauu

SEQ ID NO: 3247893 - RNA, 13 nt, Human
aagguacuucaaa

SEQ ID NO: 3247894 - RNA, 12 nt, Human
guuucaaacuuu

SEQ ID NO: 3247895 - RNA, 20 nt, Human
guuauuauauuuacaaaugg

SEQ ID NO: 3247896 - RNA, 13 nt, Human
aagcuccagguag

SEQ ID NO: 3247897 - RNA, 14 nt, Human
aagcuccagguaga

SEQ ID NO: 3247898 - RNA, 20 nt, Human
aagcucacagaccuuugaac

SEQ ID NO: 3247899 - RNA, 17 nt, Human
aagccugcaauuucaua

SEQ ID NO: 3247900 - RNA, 22 nt, Human
aagccugcaauuucauaugcug

SEQ ID NO: 3247901 - RNA, 16 nt, Human
aagcauuuagauguau

SEQ ID NO: 3247902 - RNA, 13 nt, Human
aagcauuguaaau

SEQ ID NO: 3247903 - RNA, 13 nt, Human
aagaugaaaauau

SEQ ID NO: 3247904 - RNA, 14 nt, Human
aagaugaaaauauu

SEQ ID NO: 3247905 - RNA, 13 nt, Human
aagauguagagga

SEQ ID NO: 3247906 - RNA, 16 nt, Human
aagacugcacaucaaa

SEQ ID NO: 3247907 - RNA, 23 nt, Human
aagaccuugcuuaugauugcaga

SEQ ID NO: 3247908 - RNA, 21 nt, Human
aagaccuuuggagcaaagcug

SEQ ID NO: 3247909 - RNA, 23 nt, Human
aagaggaaugaaguacucauaca

SEQ ID NO: 3247910 - RNA, 17 nt, Human
guaguguuggagaagaa

SEQ ID NO: 3247911 - RNA, 20 nt, Human
guaguguuggagaagaacug

SEQ ID NO: 3247912 - RNA, 16 nt, Human
guauauuuuauaucaa

SEQ ID NO: 3247913 - RNA, 15 nt, Human
guauaaaauaauuuu

SEQ ID NO: 3247914 - RNA, 21 nt, Human
guauaaaauaauuuuuauauu

SEQ ID NO: 3247915 - RNA, 18 nt, Human
guauguacuucaugcugu

SEQ ID NO: 3247916 - RNA, 16 nt, Human
gucaaauugugugaaa

SEQ ID NO: 3247917 - RNA, 15 nt, Human
guauuuuugacagaa

SEQ ID NO: 3247918 - RNA, 12 nt, Human
guauuuuugaca

SEQ ID NO: 3247919 - RNA, 15 nt, Human
aacacagcaagggug

SEQ ID NO: 3247920 - RNA, 22 nt, Human
aacagugauuaccagggacuga

SEQ ID NO: 3247921 - RNA, 15 nt, Human
aacagugauuaccag

SEQ ID NO: 3247922 - RNA, 16 nt, Human
aacagauaaauaguuu

SEQ ID NO: 3247923 - RNA, 13 nt, Human
aacagauaaucag

SEQ ID NO: 3247924 - RNA, 17 nt, Human
aacaaugcuguauuuua

SEQ ID NO: 3247925 - RNA, 22 nt, Human
aacaaugcuguauuuuaaaaga

SEQ ID NO: 3247926 - RNA, 15 nt, Human
aacacaacuauauug

SEQ ID NO: 3247927 - RNA, 16 nt, Human
aacacaacuauauugu

SEQ ID NO: 3247928 - RNA, 12 nt, Human
aacaauaaaaga

SEQ ID NO: 3247929 - RNA, 14 nt, Human
aacaaugcuguauu

SEQ ID NO: 3247930 - RNA, 15 nt, Human
aacaaugcuguauuu

SEQ ID NO: 3247931 - RNA, 20 nt, Human
aaauuuuuucucuaggaaau

SEQ ID NO: 3247932 - RNA, 19 nt, Human
aacaagaugguucuagcau

SEQ ID NO: 3247933 - RNA, 21 nt, Human
gugagaugcuagaacucccuu

SEQ ID NO: 3247934 - RNA, 12 nt, Human
aacugaaaucau

SEQ ID NO: 3247935 - RNA, 19 nt, Human
aacugcacugucaagauga

SEQ ID NO: 3247936 - RNA, 19 nt, Human
aacuggacugguucaaaug

SEQ ID NO: 3247937 - RNA, 17 nt, Human
aacugggacaggggaga

SEQ ID NO: 3247938 - RNA, 17 nt, Human
gugaugggaaagcauug

SEQ ID NO: 3247939 - RNA, 21 nt, Human
aacuucagcgguuuauauaag

SEQ ID NO: 3247940 - RNA, 18 nt, Human
aacuucccagugaauucu

SEQ ID NO: 3247941 - RNA, 18 nt, Human
aacuuccagauccuggaa

SEQ ID NO: 3247942 - RNA, 21 nt, Human
aacuagaguuuagcuggaaaa

SEQ ID NO: 3247943 - RNA, 23 nt, Human
aacuaucucauuuccaagcaagu

SEQ ID NO: 3247944 - RNA, 18 nt, Human
aaccuugaaaacuuuaug

SEQ ID NO: 3247945 - RNA, 16 nt, Human
gucuuucacauuuaaa

SEQ ID NO: 3247946 - RNA, 20 nt, Human
aaccugagccccaaaaggua

SEQ ID NO: 3247947 - RNA, 18 nt, Human
aaccugagccccaaaagg

SEQ ID NO: 3247948 - RNA, 23 nt, Human
aacccaaauguucaucaaugaau

SEQ ID NO: 3247949 - RNA, 18 nt, Human
aacccaaguccaagcaua

SEQ ID NO: 3247950 - RNA, 14 nt, Human
agcaacgcaggccc

SEQ ID NO: 3247951 - RNA, 23 nt, Human
agcaacgcaggcccccaggugcc

SEQ ID NO: 3247952 - RNA, 15 nt, Human
agauucccugagcag

SEQ ID NO: 3247953 - RNA, 22 nt, Human
ugacuucuaaguaaaaccacag

SEQ ID NO: 3247954 - RNA, 23 nt, Human
ugacuucuaaguaaaaccacagc

SEQ ID NO: 3247955 - RNA, 15 nt, Human
ugacuucuaaguaaa

SEQ ID NO: 3247956 - RNA, 16 nt, Human
ugacacuuaaaaaugg

SEQ ID NO: 3247957 - RNA, 17 nt, Human
ugacacuuaaaaauggu

SEQ ID NO: 3247958 - RNA, 16 nt, Human
agaugcaguucugaag

SEQ ID NO: 3247959 - RNA, 18 nt, Human
agauggaaugcuguguua

SEQ ID NO: 3247960 - RNA, 13 nt, Human
agauggaaugcug

SEQ ID NO: 3247961 - RNA, 15 nt, Human
agauggaaugcugug

SEQ ID NO: 3247962 - RNA, 15 nt, Human
ugaauacuuuauaaa

SEQ ID NO: 3247963 - RNA, 18 nt, Human
agaguauuuuugacagaa

SEQ ID NO: 3247964 - RNA, 17 nt, Human
agaguauuuuugacaga

SEQ ID NO: 3247965 - RNA, 23 nt, Human
ugaaaguacauuuggagacacaa

SEQ ID NO: 3247966 - RNA, 14 nt, Human
ugaaaguacauuug

SEQ ID NO: 3247967 - RNA, 14 nt, Human
agaguauuuuugac

SEQ ID NO: 3247968 - RNA, 17 nt, Human
agaguuuagcuggaaaa

SEQ ID NO: 3247969 - RNA, 15 nt, Human
agaguauuuuugaca

SEQ ID NO: 3247970 - RNA, 20 nt, Human
agaguauuuuugacagaaua

SEQ ID NO: 3247971 - RNA, 22 nt, Human
ugaaaaagaccuuuggagcaaa

SEQ ID NO: 3247972 - RNA, 22 nt, Human
ugaaaaaguucugcagauaaac

SEQ ID NO: 3247973 - RNA, 20 nt, Human
ugaaaagcuccauuuuuagu

SEQ ID NO: 3247974 - RNA, 19 nt, Human
ugaaacucguuaauuugua

SEQ ID NO: 3247975 - RNA, 14 nt, Human
agagagaaaauaaa

SEQ ID NO: 3247976 - RNA, 20 nt, Human
agagcaaaauugauguguuu

SEQ ID NO: 3247977 - RNA, 14 nt, Human
agaaucacuugaac

SEQ ID NO: 3247978 - RNA, 21 nt, Human
agacauagaauuaacacauga

SEQ ID NO: 3247979 - RNA, 14 nt, Human
agacauagaauuaa

SEQ ID NO: 3247980 - RNA, 18 nt, Human
agacaucaacagauaaau

SEQ ID NO: 3247981 - RNA, 17 nt, Human
agacaucaacagauaaa

SEQ ID NO: 3247982 - RNA, 19 nt, Human
agacauucuuccaaaaaga

SEQ ID NO: 3247983 - RNA, 12 nt, Human
agacuauucaaa

SEQ ID NO: 3247984 - RNA, 14 nt, Human
agacuauucaaaca

SEQ ID NO: 3247985 - RNA, 15 nt, Human
agacuauucaaacag

SEQ ID NO: 3247986 - RNA, 15 nt, Human
ucuuuaacucauaaa

SEQ ID NO: 3247987 - RNA, 23 nt, Human
agaaagacuauucaaacagucuc

SEQ ID NO: 3247988 - RNA, 16 nt, Human
agaaagacuauucaaa

SEQ ID NO: 3247989 - RNA, 20 nt, Human
agaaagcagaacagugauua

SEQ ID NO: 3247990 - RNA, 18 nt, Human
agaaagcagaacagugau

SEQ ID NO: 3247991 - RNA, 17 nt, Human
agaaagcagaacaguga

SEQ ID NO: 3247992 - RNA, 16 nt, Human
agaaacacaacuauau

SEQ ID NO: 3247993 - RNA, 15 nt, Human
agaaacuggaacucu

SEQ ID NO: 3247994 - RNA, 20 nt, Human
ucugcccauccugccccuga

SEQ ID NO: 3247995 - RNA, 19 nt, Human
agaagcaccaaucaugaau

SEQ ID NO: 3247996 - RNA, 19 nt, Human
agaagcaacccaaauguuc

SEQ ID NO: 3247997 - RNA, 16 nt, Human
agaacucccuuucaac

SEQ ID NO: 3247998 - RNA, 15 nt, Human
agaacucccuuucaa

SEQ ID NO: 3247999 - RNA, 17 nt, Human
agaacucccuuucaaca

SEQ ID NO: 3248000 - RNA, 13 nt, Human
agaaguugauaug

SEQ ID NO: 3248001 - RNA, 16 nt, Human
agaaggaucuucaucu

SEQ ID NO: 3248002 - RNA, 14 nt, Human
agaagcuccaggua

SEQ ID NO: 3248003 - RNA, 23 nt, Human
acuugaacccgggaggcagaggu

SEQ ID NO: 3248004 - RNA, 21 nt, Human
acuugaacccgggaggcagag

SEQ ID NO: 3248005 - RNA, 18 nt, Human
acuucuaaguaaaaccac

SEQ ID NO: 3248006 - RNA, 19 nt, Human
acuucuaaguaaaaccaca

SEQ ID NO: 3248007 - RNA, 13 nt, Human
acuucuaaguaaa

SEQ ID NO: 3248008 - RNA, 14 nt, Human
acuucccuuucugc

SEQ ID NO: 3248009 - RNA, 22 nt, Human
acuucccuuucugcuuguguua

SEQ ID NO: 3248010 - RNA, 17 nt, Human
ucuagcauggcauauuu

SEQ ID NO: 3248011 - RNA, 17 nt, Human
acuucccagugaauucu

SEQ ID NO: 3248012 - RNA, 13 nt, Human
ucuauaauuuaaa

SEQ ID NO: 3248013 - RNA, 20 nt, Human
acuuccagauccuggaaauc

SEQ ID NO: 3248014 - RNA, 16 nt, Human
ucuacauacuauggaa

SEQ ID NO: 3248015 - RNA, 21 nt, Human
ucuaagauaguaacaaugaag

SEQ ID NO: 3248016 - RNA, 22 nt, Human
acugucagcuccccucggagaa

SEQ ID NO: 3248017 - RNA, 23 nt, Human
acugucagcuccccucggagaag

SEQ ID NO: 3248018 - RNA, 22 nt, Human
acugaagaagcaccaaucauga

SEQ ID NO: 3248019 - RNA, 12 nt, Human
acugaagaagca

SEQ ID NO: 3248020 - RNA, 20 nt, Human
acuagaguuuagcuggaaaa

SEQ ID NO: 3248021 - RNA, 13 nt, Human
acuauucaaacag

SEQ ID NO: 3248022 - RNA, 14 nt, Human
acuauucaaacagu

SEQ ID NO: 3248023 - RNA, 16 nt, Human
acuauucaaacagucu

SEQ ID NO: 3248024 - RNA, 22 nt, Human
acuaugacauaaaaacaacuuu

SEQ ID NO: 3248025 - RNA, 20 nt, Human
acucauuuuaaaaaauggaa

SEQ ID NO: 3248026 - RNA, 14 nt, Human
acucagaauauugc

SEQ ID NO: 3248027 - RNA, 14 nt, Human
acuccagaaaguga

SEQ ID NO: 3248028 - RNA, 17 nt, Human
uccucuccccaugaugu

SEQ ID NO: 3248029 - RNA, 21 nt, Human
uccugaaaacccuugccaugu

SEQ ID NO: 3248030 - RNA, 13 nt, Human
acugaaacuuccc

SEQ ID NO: 3248031 - RNA, 17 nt, Human
accugagccccaaaagg

SEQ ID NO: 3248032 - RNA, 12 nt, Human
accugagcccca

SEQ ID NO: 3248033 - RNA, 16 nt, Human
ucauaauaaguugcau

SEQ ID NO: 3248034 - RNA, 19 nt, Human
uccaaaaagauuuucagaa

SEQ ID NO: 3248035 - RNA, 16 nt, Human
acgcucucuggccuuc

SEQ ID NO: 3248036 - RNA, 15 nt, Human
acgcucucuggccuu

SEQ ID NO: 3248037 - RNA, 14 nt, Human
acgcucucuggccu

SEQ ID NO: 3248038 - RNA, 17 nt, Human
acgcucucuggccuucg

SEQ ID NO: 3248039 - RNA, 20 nt, Human
acgaagaguauuuuugacag

SEQ ID NO: 3248040 - RNA, 22 nt, Human
acgaagaguauuuuugacagaa

SEQ ID NO: 3248041 - RNA, 22 nt, Human
uccaugaagauguagaggagaa

SEQ ID NO: 3248042 - RNA, 16 nt, Human
acccaaauguucauca

SEQ ID NO: 3248043 - RNA, 23 nt, Human
ucaauauuucagauaaucacaau

SEQ ID NO: 3248044 - RNA, 17 nt, Human
acauuguaaauaguauu

SEQ ID NO: 3248045 - RNA, 19 nt, Human
acauuguaaauaguauuug

SEQ ID NO: 3248046 - RNA, 21 nt, Human
acauuguaaauaguauuugag

SEQ ID NO: 3248047 - RNA, 17 nt, Human
ucacagccagacuggca

SEQ ID NO: 3248048 - RNA, 23 nt, Human
ucacagccagacuggcacaguuu

SEQ ID NO: 3248049 - RNA, 16 nt, Human
ucacagaccuuugaac

SEQ ID NO: 3248050 - RNA, 13 nt, Human
ucaauuuaaaaaa

SEQ ID NO: 3248051 - RNA, 12 nt, Human
ucaauuuaaaaa

SEQ ID NO: 3248052 - RNA, 16 nt, Human
accacaagacugcaca

SEQ ID NO: 3248053 - RNA, 14 nt, Human
accaacacgagcag

SEQ ID NO: 3248054 - RNA, 19 nt, Human
accaacacgagcaggcuac

SEQ ID NO: 3248055 - RNA, 16 nt, Human
accaaauaaaaauauu

SEQ ID NO: 3248056 - RNA, 18 nt, Human
accaaauaaaaauauugu

SEQ ID NO: 3248057 - RNA, 20 nt, Human
ucaaacagucucaggaaauc

SEQ ID NO: 3248058 - RNA, 21 nt, Human
ucaaacagucucaggaaauca

SEQ ID NO: 3248059 - RNA, 13 nt, Human
ucaaacagucuca

SEQ ID NO: 3248060 - RNA, 15 nt, Human
uauuuuuguagcacu

SEQ ID NO: 3248061 - RNA, 22 nt, Human
uauuuuaauaauguuucaaaca

SEQ ID NO: 3248062 - RNA, 19 nt, Human
uauuuuaauaauguuucaa

SEQ ID NO: 3248063 - RNA, 16 nt, Human
uauuuuguucauacau

SEQ ID NO: 3248064 - RNA, 15 nt, Human
uauuuuguucauaca

SEQ ID NO: 3248065 - RNA, 13 nt, Human
uauuuuucacaua

SEQ ID NO: 3248066 - RNA, 12 nt, Human
uauuuuucacau

SEQ ID NO: 3248067 - RNA, 13 nt, Human
uauuuuuguagca

SEQ ID NO: 3248068 - RNA, 14 nt, Human
uauuuuaaaagaau

SEQ ID NO: 3248069 - RNA, 18 nt, Human
uauuuuaaaagaaugauu

SEQ ID NO: 3248070 - RNA, 14 nt, Human
uauguguaaaaugu

SEQ ID NO: 3248071 - RNA, 19 nt, Human
aguuuucugagaaagacua

SEQ ID NO: 3248072 - RNA, 18 nt, Human
aguuuucugagaaagacu

SEQ ID NO: 3248073 - RNA, 23 nt, Human
aguuuucugagaaagacuauuca

SEQ ID NO: 3248074 - RNA, 22 nt, Human
auaaaauaauuuuuauauuuga

SEQ ID NO: 3248075 - RNA, 12 nt, Human
auaaaauaauuu

SEQ ID NO: 3248076 - RNA, 14 nt, Human
uuaaguauguguaa

SEQ ID NO: 3248077 - RNA, 13 nt, Human
uguuucaaacaua

SEQ ID NO: 3248078 - RNA, 14 nt, Human
aguuuaaauuguaa

SEQ ID NO: 3248079 - RNA, 19 nt, Human
uuagaaacacaacuauauu

SEQ ID NO: 3248080 - RNA, 13 nt, Human
auaacugugaagu

SEQ ID NO: 3248081 - RNA, 22 nt, Human
auaacgauaaaagacagugaaa

SEQ ID NO: 3248082 - RNA, 13 nt, Human
auaaauaaaaaua

SEQ ID NO: 3248083 - RNA, 15 nt, Human
auaaauaguuuauga

SEQ ID NO: 3248084 - RNA, 18 nt, Human
auaaauauuuuugccaua

SEQ ID NO: 3248085 - RNA, 18 nt, Human
auaauccuaaacauauga

SEQ ID NO: 3248086 - RNA, 14 nt, Human
aguguuggagaaga

SEQ ID NO: 3248087 - RNA, 16 nt, Human
aguguuggagaagaac

SEQ ID NO: 3248088 - RNA, 17 nt, Human
aguguuggagaagaacu

SEQ ID NO: 3248089 - RNA, 18 nt, Human
aguguuggagaagaacug

SEQ ID NO: 3248090 - RNA, 19 nt, Human
aguucggugagcuacaaau

SEQ ID NO: 3248091 - RNA, 15 nt, Human
aguucuacauaagua

SEQ ID NO: 3248092 - RNA, 12 nt, Human
uguugugaaugu

SEQ ID NO: 3248093 - RNA, 13 nt, Human
uguugugaauguu

SEQ ID NO: 3248094 - RNA, 14 nt, Human
uguugugauguauu

SEQ ID NO: 3248095 - RNA, 20 nt, Human
uguugugauguauucuagcu

SEQ ID NO: 3248096 - RNA, 14 nt, Human
agugcaaauuguca

SEQ ID NO: 3248097 - RNA, 18 nt, Human
agugcaaauugucacagg

SEQ ID NO: 3248098 - RNA, 21 nt, Human
agugcaaauugucacaggaca

SEQ ID NO: 3248099 - RNA, 21 nt, Human
agugccuguaaucacagcuac

SEQ ID NO: 3248100 - RNA, 19 nt, Human
aguagauaggccaugggca

SEQ ID NO: 3248101 - RNA, 13 nt, Human
aguagaacagaua

SEQ ID NO: 3248102 - RNA, 19 nt, Human
aguagaacagauaaucagu

SEQ ID NO: 3248103 - RNA, 16 nt, Human
uguagaggagaaacug

SEQ ID NO: 3248104 - RNA, 18 nt, Human
uguagaggagaaacugga

SEQ ID NO: 3248105 - RNA, 16 nt, Human
agucaggaaagagaac

SEQ ID NO: 3248106 - RNA, 15 nt, Human
agucaggaaagagaa

SEQ ID NO: 3248107 - RNA, 20 nt, Human
ugucaaucagccuaguugau

SEQ ID NO: 3248108 - RNA, 21 nt, Human
ugucaauaaaauccauacauu

SEQ ID NO: 3248109 - RNA, 22 nt, Human
aguauuucuaugaaauauuaug

SEQ ID NO: 3248110 - RNA, 16 nt, Human
aguauuugagaguucu

SEQ ID NO: 3248111 - RNA, 13 nt, Human
aguauuucuauga

SEQ ID NO: 3248112 - RNA, 15 nt, Human
aguauuucuaugaaa

SEQ ID NO: 3248113 - RNA, 23 nt, Human
ugucauuugcuggagcucugccc

SEQ ID NO: 3248114 - RNA, 17 nt, Human
agggcagggacaggaua

SEQ ID NO: 3248115 - RNA, 23 nt, Human
agguacuucaaauccuugaagau

SEQ ID NO: 3248116 - RNA, 19 nt, Human
aggucauauuaauauauuu

SEQ ID NO: 3248117 - RNA, 18 nt, Human
aggucauauuaauauauu

SEQ ID NO: 3248118 - RNA, 16 nt, Human
aggucauauuaauaua

SEQ ID NO: 3248119 - RNA, 20 nt, Human
ugguaaggggaauugaggac

SEQ ID NO: 3248120 - RNA, 15 nt, Human
ugcuacaaaaacaca

SEQ ID NO: 3248121 - RNA, 16 nt, Human
ugcuacaaaaacacag

SEQ ID NO: 3248122 - RNA, 17 nt, Human
ugcuacaaaaacacagc

SEQ ID NO: 3248123 - RNA, 18 nt, Human
ugcuacaaaaacacagca

SEQ ID NO: 3248124 - RNA, 19 nt, Human
ugcuacaaaaacacagcaa

SEQ ID NO: 3248125 - RNA, 20 nt, Human
ugcuacaaaaacacagcaag

SEQ ID NO: 3248126 - RNA, 17 nt, Human
agcuugaaacugagaug

SEQ ID NO: 3248127 - RNA, 16 nt, Human
agcuguucacagccag

SEQ ID NO: 3248128 - RNA, 19 nt, Human
agcuguucacagccagacu

SEQ ID NO: 3248129 - RNA, 14 nt, Human
agcuguucacagcc

SEQ ID NO: 3248130 - RNA, 23 nt, Human
aggaaaucaaauaugcaaagcac

SEQ ID NO: 3248131 - RNA, 12 nt, Human
aggaaauauuua

SEQ ID NO: 3248132 - RNA, 14 nt, Human
ugcucauggaauug

SEQ ID NO: 3248133 - RNA, 11 nt, Human
ugcucauggaa

SEQ ID NO: 3248134 - RNA, 23 nt, Human
agcuuuaucaaagggugaaaauu

SEQ ID NO: 3248135 - RNA, 17 nt, Human
aggacacugauaugggu

SEQ ID NO: 3248136 - RNA, 13 nt, Human
ugcuguauuuuaa

SEQ ID NO: 3248137 - RNA, 21 nt, Human
ugcuguauuuuaaaagaauga

SEQ ID NO: 3248138 - RNA, 22 nt, Human
ugcuguauuuuaaaagaaugau

SEQ ID NO: 3248139 - RNA, 13 nt, Human
uggagaagaacug

SEQ ID NO: 3248140 - RNA, 13 nt, Human
uggaaaggcagcu

SEQ ID NO: 3248141 - RNA, 19 nt, Human
uggcacaguuuucugagaa

SEQ ID NO: 3248142 - RNA, 18 nt, Human
uggcacaguuuucugaga

SEQ ID NO: 3248143 - RNA, 17 nt, Human
uggcauauuuuucacau

SEQ ID NO: 3248144 - RNA, 16 nt, Human
uggcauauuuuucaca

SEQ ID NO: 3248145 - RNA, 20 nt, Human
agccuuggggcugaugcagu

SEQ ID NO: 3248146 - RNA, 18 nt, Human
agcuacuugggaggcuga

SEQ ID NO: 3248147 - RNA, 17 nt, Human
agcuacuugggaggcug

SEQ ID NO: 3248148 - RNA, 18 nt, Human
agccccgugggguuccuc

SEQ ID NO: 3248149 - RNA, 15 nt, Human
agccucauguccacu

SEQ ID NO: 3248150 - RNA, 22 nt, Human
agccugaaagaggaaugaagua

SEQ ID NO: 3248151 - RNA, 12 nt, Human
ugauuaaaccaa

SEQ ID NO: 3248152 - RNA, 14 nt, Human
ugauuaccagggac

SEQ ID NO: 3248153 - RNA, 14 nt, Human
ugaugaucuuuaaa

SEQ ID NO: 3248154 - RNA, 22 nt, Human
ugauguuuagaaacacaacuau

SEQ ID NO: 3248155 - RNA, 12 nt, Human
ugaugaagaagu

SEQ ID NO: 3248156 - RNA, 17 nt, Human
ugaugaagaaguugaua

SEQ ID NO: 3248157 - RNA, 14 nt, Human
agccagacuggcac

SEQ ID NO: 3248158 - RNA, 20 nt, Human
agcaugucgucaaagcugaa

SEQ ID NO: 3248159 - RNA, 17 nt, Human
agcaugucgucaaagcu

SEQ ID NO: 3248160 - RNA, 22 nt, Human
agcauggcauauuuuucacaua

SEQ ID NO: 3248161 - RNA, 21 nt, Human
agcauggcauauuuuucacau

SEQ ID NO: 3248162 - RNA, 19 nt, Human
agcauggcauauuuuucac

SEQ ID NO: 3248163 - RNA, 18 nt, Human
agcauggcauauuuuuca

SEQ ID NO: 3248164 - RNA, 17 nt, Human
agcauuguaaaugugcu

SEQ ID NO: 3248165 - RNA, 18 nt, Human
agcauuguaaaugugcuu

SEQ ID NO: 3248166 - RNA, 12 nt, Human
ugauaugggucu

SEQ ID NO: 3248167 - RNA, 22 nt, Human
ugaguaacugauuuguaacaag

SEQ ID NO: 3248168 - RNA, 23 nt, Human
agcauaaauguugacaugggaca

SEQ ID NO: 3248169 - RNA, 22 nt, Human
agcauaccaacacgagcaggcu

SEQ ID NO: 3248170 - RNA, 19 nt, Human
ugauacgcaacauaauuaa

SEQ ID NO: 3248171 - RNA, 12 nt, Human
uucccaaauuuc

SEQ ID NO: 3248172 - RNA, 18 nt, Human
uucccaacuccagaaagu

SEQ ID NO: 3248173 - RNA, 13 nt, Human
uucauaugcugua

SEQ ID NO: 3248174 - RNA, 19 nt, Human
uucauacauuguacgaaga

SEQ ID NO: 3248175 - RNA, 13 nt, Human
uucauacauugua

SEQ ID NO: 3248176 - RNA, 23 nt, Human
uucauacauauuuuuguagcacu

SEQ ID NO: 3248177 - RNA, 12 nt, Human
uucauacauauu

SEQ ID NO: 3248178 - RNA, 13 nt, Human
auauauuuaauga

SEQ ID NO: 3248179 - RNA, 17 nt, Human
auaucuaguaugaaauu

SEQ ID NO: 3248180 - RNA, 15 nt, Human
auaucuaguaugaaa

SEQ ID NO: 3248181 - RNA, 14 nt, Human
auaucuaguaugaa

SEQ ID NO: 3248182 - RNA, 13 nt, Human
auaucuuguagcu

SEQ ID NO: 3248183 - RNA, 23 nt, Human
uucacaagacccaaaaggcagaa

SEQ ID NO: 3248184 - RNA, 22 nt, Human
uucacaagacccaaaaggcaga

SEQ ID NO: 3248185 - RNA, 22 nt, Human
auaggaauugacccacaagaaa

SEQ ID NO: 3248186 - RNA, 17 nt, Human
auaggcguaacuaauuu

SEQ ID NO: 3248187 - RNA, 18 nt, Human
uucaaacagucucaggaa

SEQ ID NO: 3248188 - RNA, 17 nt, Human
uuauuuuguucauacau

SEQ ID NO: 3248189 - RNA, 16 nt, Human
uuauuuuguucauaca

SEQ ID NO: 3248190 - RNA, 21 nt, Human
uuauuuuguucauacauauuu

SEQ ID NO: 3248191 - RNA, 19 nt, Human
auauauaacaaugcuguau

SEQ ID NO: 3248192 - RNA, 17 nt, Human
auauaacaaugcuguau

SEQ ID NO: 3248193 - RNA, 20 nt, Human
auaguuguaccgcaauguga

SEQ ID NO: 3248194 - RNA, 13 nt, Human
auagucuuucagu

SEQ ID NO: 3248195 - RNA, 19 nt, Human
uugaaauauugacuuuuua

SEQ ID NO: 3248196 - RNA, 20 nt, Human
auccuagucacuaccuucau

SEQ ID NO: 3248197 - RNA, 20 nt, Human
aucaaauaugcaaagcacug

SEQ ID NO: 3248198 - RNA, 19 nt, Human
uucuaaguaaaaccacagc

SEQ ID NO: 3248199 - RNA, 20 nt, Human
uucuaaguaaaaccacagca

SEQ ID NO: 3248200 - RNA, 17 nt, Human
uucuaaguaaaaccaca

SEQ ID NO: 3248201 - RNA, 19 nt, Human
uucuaacaaaaaaauauau

SEQ ID NO: 3248202 - RNA, 20 nt, Human
uucuaacaaaaaaauauauu

SEQ ID NO: 3248203 - RNA, 14 nt, Human
uucuauaauuuaaa

SEQ ID NO: 3248204 - RNA, 13 nt, Human
uucuauaauuuaa

SEQ ID NO: 3248205 - RNA, 15 nt, Human
augcaguucugaaga

SEQ ID NO: 3248206 - RNA, 17 nt, Human
augcaguucugaagaag

SEQ ID NO: 3248207 - RNA, 17 nt, Human
augccacuaaauugaca

SEQ ID NO: 3248208 - RNA, 15 nt, Human
augccacuaaauuga

SEQ ID NO: 3248209 - RNA, 18 nt, Human
augcaguucugaagaaga

SEQ ID NO: 3248210 - RNA, 19 nt, Human
augcaguucugaagaagau

SEQ ID NO: 3248211 - RNA, 14 nt, Human
uuguuuucauuauc

SEQ ID NO: 3248212 - RNA, 23 nt, Human
uugugugaaagguacuucaaauc

SEQ ID NO: 3248213 - RNA, 20 nt, Human
augagagacacacugaagaa

SEQ ID NO: 3248214 - RNA, 21 nt, Human
augagagacacacugaagaag

SEQ ID NO: 3248215 - RNA, 15 nt, Human
augcaaagcacugac

SEQ ID NO: 3248216 - RNA, 22 nt, Human
augauuaugaauuacauuugua

SEQ ID NO: 3248217 - RNA, 12 nt, Human
augauucccagc

SEQ ID NO: 3248218 - RNA, 15 nt, Human
augcuagaacucccu

SEQ ID NO: 3248219 - RNA, 16 nt, Human
augcuagaacucccuu

SEQ ID NO: 3248220 - RNA, 22 nt, Human
augcugucuacacuaagagaga

SEQ ID NO: 3248221 - RNA, 20 nt, Human
uuuagcuggaaaaguauguu

SEQ ID NO: 3248222 - RNA, 22 nt, Human
uuuagcuggaaaaguauguuag

SEQ ID NO: 3248223 - RNA, 13 nt, Human
uuuauauaagcuu

SEQ ID NO: 3248224 - RNA, 20 nt, Human
auggcuaguaucaaaagaaa

SEQ ID NO: 3248225 - RNA, 16 nt, Human
auggaaugcuguguua

SEQ ID NO: 3248226 - RNA, 15 nt, Human
uuucauaugcuguau

SEQ ID NO: 3248227 - RNA, 13 nt, Human
augaaugaauggc

SEQ ID NO: 3248228 - RNA, 18 nt, Human
augaagauguagaggaga

SEQ ID NO: 3248229 - RNA, 18 nt, Human
augaaauauuauguuaaa

SEQ ID NO: 3248230 - RNA, 13 nt, Human
augaaauauuaug

SEQ ID NO: 3248231 - RNA, 17 nt, Human
augaaauauuauguuaa

SEQ ID NO: 3248232 - RNA, 15 nt, Human
augaaagcagggacu

SEQ ID NO: 3248233 - RNA, 13 nt, Human
aucuuuuucuaac

SEQ ID NO: 3248234 - RNA, 16 nt, Human
uuguauaaaauaauuu

SEQ ID NO: 3248235 - RNA, 15 nt, Human
uuguauaaaauaauu

SEQ ID NO: 3248236 - RNA, 16 nt, Human
uuguaucacaaaucuu

SEQ ID NO: 3248237 - RNA, 17 nt, Human
uuguauaaaauaauuuu

SEQ ID NO: 3248238 - RNA, 13 nt, Human
augagagacacac

SEQ ID NO: 3248239 - RNA, 14 nt, Human
augagagacacacu

SEQ ID NO: 3248240 - RNA, 17 nt, Human
augagagacacacugaa

SEQ ID NO: 3248241 - RNA, 19 nt, Human
augagagacacacugaaga

SEQ ID NO: 3248242 - RNA, 13 nt, Human
aucucaauauuuc

SEQ ID NO: 3248243 - RNA, 14 nt, Human
aucucauuuccaag

SEQ ID NO: 3248244 - RNA, 23 nt, Human
aucucauuuccaagcaaguauua

SEQ ID NO: 3248245 - RNA, 18 nt, Human
aucucauaauuuauacag

SEQ ID NO: 3248246 - RNA, 21 nt, Human
aucucauuuccaagcaaguau

SEQ ID NO: 3248247 - RNA, 17 nt, Human
aucucauaauuuauaca

SEQ ID NO: 3248248 - RNA, 18 nt, Human
uugauggugguauguuuu

SEQ ID NO: 3248249 - RNA, 19 nt, Human
uugauggugguauguuuuc

SEQ ID NO: 3248250 - RNA, 11 nt, Human
uugauguguuu

SEQ ID NO: 3248251 - RNA, 13 nt, Human
uugcccuguuaaa

SEQ ID NO: 3248252 - RNA, 15 nt, Human
auuacauuuguauaa

SEQ ID NO: 3248253 - RNA, 20 nt, Human
auuacauuuguauaaaauaa

SEQ ID NO: 3248254 - RNA, 13 nt, Human
auuacauuuguau

SEQ ID NO: 3248255 - RNA, 15 nt, Human
auuaauauauuucca

SEQ ID NO: 3248256 - RNA, 13 nt, Human
auuaaguaaugau

SEQ ID NO: 3248257 - RNA, 15 nt, Human
auuaaguaaugauaa

SEQ ID NO: 3248258 - RNA, 18 nt, Human
auuaucucaaaacugcac

SEQ ID NO: 3248259 - RNA, 23 nt, Human
auuaucucaaaacugcacuguca

SEQ ID NO: 3248260 - RNA, 15 nt, Human
auuauauuuacaaau

SEQ ID NO: 3248261 - RNA, 16 nt, Human
auuauauuuacaaaug

SEQ ID NO: 3248262 - RNA, 20 nt, Human
auuccacuuauaggaauuga

SEQ ID NO: 3248263 - RNA, 14 nt, Human
auucaaacagucuc

SEQ ID NO: 3248264 - RNA, 15 nt, Human
auucaaacagucuca

SEQ ID NO: 3248265 - RNA, 13 nt, Human
uuuuaaaaaagaa

SEQ ID NO: 3248266 - RNA, 14 nt, Human
uuuuaaaagaauga

SEQ ID NO: 3248267 - RNA, 11 nt, Human
uuuuaagaaau

SEQ ID NO: 3248268 - RNA, 19 nt, Human
uuuguagcacugacagauu

SEQ ID NO: 3248269 - RNA, 17 nt, Human
uuuguagcacugacaga

SEQ ID NO: 3248270 - RNA, 19 nt, Human
uuugcuaagcauuccaacu

SEQ ID NO: 3248271 - RNA, 11 nt, Human
uuugcucaugg

SEQ ID NO: 3248272 - RNA, 12 nt, Human
uuugcucaugga

SEQ ID NO: 3248273 - RNA, 19 nt, Human
auguucaucaaugaaugaa

SEQ ID NO: 3248274 - RNA, 15 nt, Human
auguugacaugggac

SEQ ID NO: 3248275 - RNA, 16 nt, Human
uuuucuauaauuuaaa

SEQ ID NO: 3248276 - RNA, 14 nt, Human
uuuuauaauuuugu

SEQ ID NO: 3248277 - RNA, 23 nt, Human
uuuuauggaggcuuugcauagau

SEQ ID NO: 3248278 - RNA, 19 nt, Human
uuuuauggcacuaguauuu

SEQ ID NO: 3248279 - RNA, 15 nt, Human
auuaaaagaauauuu

SEQ ID NO: 3248280 - RNA, 16 nt, Human
auuaaaagaauauuuu

SEQ ID NO: 3248281 - RNA, 20 nt, Human
auuaaaaaaucaguuguaca

SEQ ID NO: 3248282 - RNA, 18 nt, Human
auguuucaaacauauaua

SEQ ID NO: 3248283 - RNA, 15 nt, Human
auguugugauguauu

SEQ ID NO: 3248284 - RNA, 20 nt, Human
auuuauuacuguaagaaaau

SEQ ID NO: 3248285 - RNA, 22 nt, Human
auuuauuacuguaagaaaauau

SEQ ID NO: 3248286 - RNA, 18 nt, Human
auuuguaguguuggagaa

SEQ ID NO: 3248287 - RNA, 23 nt, Human
auuugguaaggggaauugaggac

SEQ ID NO: 3248288 - RNA, 20 nt, Human
auuuggagacacaacuauuu

SEQ ID NO: 3248289 - RNA, 21 nt, Human
auuuguauaaaauaauuuuua

SEQ ID NO: 3248290 - RNA, 15 nt, Human
auuuguaucacaaau

SEQ ID NO: 3248291 - RNA, 15 nt, Human
auuuuaauaauguuu

SEQ ID NO: 3248292 - RNA, 12 nt, Human
auuuuaauaaug

SEQ ID NO: 3248293 - RNA, 14 nt, Human
auuuuaauaauguu

SEQ ID NO: 3248294 - RNA, 14 nt, Human
auuguauuacaaau

SEQ ID NO: 3248295 - RNA, 13 nt, Human
auugugccccugc

SEQ ID NO: 3248296 - RNA, 21 nt, Human
auugcuaaucaccaaaggcuc

SEQ ID NO: 3248297 - RNA, 16 nt, Human
auuuacaaaugggaaa

SEQ ID NO: 3248298 - RNA, 19 nt, Human
auuuaaagcuuauuaaaac

SEQ ID NO: 3248299 - RNA, 20 nt, Human
auugacacuuaaaaaugguu

SEQ ID NO: 3248300 - RNA, 21 nt, Human
auugacccacaagaaaugaaa

SEQ ID NO: 3248301 - RNA, 17 nt, Human
auguuccuagugaaaga

SEQ ID NO: 3248302 - RNA, 15 nt, Human
auguuccuagugaaa

SEQ ID NO: 3248303 - RNA, 16 nt, Human
auguuccuagugaaag

SEQ ID NO: 3248304 - RNA, 15 nt, Human
auguguaaaauguga

SEQ ID NO: 3248305 - RNA, 21 nt, Human
augucaaucagccuaguugau

SEQ ID NO: 3248306 - RNA, 16 nt, Human
augucaaucagccuag

SEQ ID NO: 3248307 - RNA, 15 nt, Human
augugaacacaucag

SEQ ID NO: 3248308 - RNA, 16 nt, Human
augaucuuuaaaauac

SEQ ID NO: 3248309 - RNA, 18 nt, Human
augaugaucuuuaaaaua

SEQ ID NO: 3248310 - RNA, 21 nt, Human
augaugaucuuuaaaauacac

SEQ ID NO: 3248311 - RNA, 21 nt, Human
augaaguacucauacauguua

SEQ ID NO: 3248312 - RNA, 13 nt, Human
augaaguacucau

SEQ ID NO: 3248313 - RNA, 20 nt, Human
augaaguccaagcauuuaga

SEQ ID NO: 3248314 - RNA, 23 nt, Human
augaaguccaagcauuuagaugu

SEQ ID NO: 3248315 - RNA, 19 nt, Human
aucuaguaugaaauuauau

SEQ ID NO: 3248316 - RNA, 18 nt, Human
aucuaguaugaaauuaua

SEQ ID NO: 3248317 - RNA, 17 nt, Human
aucuaguaugaaauuau

SEQ ID NO: 3248318 - RNA, 16 nt, Human
aucuaguaugaaauua

SEQ ID NO: 3248319 - RNA, 15 nt, Human
aucuaguaugaaauu

SEQ ID NO: 3248320 - RNA, 14 nt, Human
aucuaguaugaaau

SEQ ID NO: 3248321 - RNA, 14 nt, Human
aucaaauaugcaaa

SEQ ID NO: 3248322 - RNA, 22 nt, Human
aucagcuugcccuguuaaaaga

SEQ ID NO: 3248323 - RNA, 13 nt, Human
aucagcuuauugu

SEQ ID NO: 3248324 - RNA, 17 nt, Human
aucaugaauuaguuuua

SEQ ID NO: 3248325 - RNA, 19 nt, Human
auccucaguuuuugugaaa

SEQ ID NO: 3248326 - RNA, 14 nt, Human
auaagccagacauc

SEQ ID NO: 3248327 - RNA, 22 nt, Human
auaagccagacaucaacagaua

SEQ ID NO: 3248328 - RNA, 21 nt, Human
auaagccagacaucaacagau

SEQ ID NO: 3248329 - RNA, 13 nt, Human
auaauguuucaaa

SEQ ID NO: 3248330 - RNA, 18 nt, Human
auaauguuucaaacauau

SEQ ID NO: 3248331 - RNA, 17 nt, Human
auacccagaaaguuauu

SEQ ID NO: 3248332 - RNA, 14 nt, Human
auaacaaugaaagu

SEQ ID NO: 3248333 - RNA, 15 nt, Human
auaacaaugcuguau

SEQ ID NO: 3248334 - RNA, 17 nt, Human
auaacaaugcuguauuu

SEQ ID NO: 3248335 - RNA, 21 nt, Human
auaacaaugcuguauuuuaaa

SEQ ID NO: 3248336 - RNA, 19 nt, Human
auaacaaugcuguauuuua

SEQ ID NO: 3248337 - RNA, 20 nt, Human
auaacaaugcuguauuuuaa

SEQ ID NO: 3248338 - RNA, 22 nt, Human
auaaaaagccugcaauuucaua

SEQ ID NO: 3248339 - RNA, 20 nt, Human
auaaaaagccugcaauuuca

SEQ ID NO: 3248340 - RNA, 15 nt, Human
auagcagcuuauuca

SEQ ID NO: 3248341 - RNA, 23 nt, Human
auauuucagauaaucacaauaca

SEQ ID NO: 3248342 - RNA, 14 nt, Human
auauuauguuaaaa

SEQ ID NO: 3248343 - RNA, 13 nt, Human
auauuauguguuu

SEQ ID NO: 3248344 - RNA, 17 nt, Human
auauuauguguuuccau

SEQ ID NO: 3248345 - RNA, 13 nt, Human
auauuauguuaaa

SEQ ID NO: 3248346 - RNA, 19 nt, Human
agugucaaugcagccccca

SEQ ID NO: 3248347 - RNA, 19 nt, Human
aguugaaaagacuccaaag

SEQ ID NO: 3248348 - RNA, 20 nt, Human
aguugaaaagacuccaaaga

SEQ ID NO: 3248349 - RNA, 14 nt, Human
aguugaaaagacuc

SEQ ID NO: 3248350 - RNA, 18 nt, Human
aguugaaaagacuccaaa

SEQ ID NO: 3248351 - RNA, 23 nt, Human
aguaaaugcuagguuaauuccaa

SEQ ID NO: 3248352 - RNA, 11 nt, Human
aguaaaugcua

SEQ ID NO: 3248353 - RNA, 22 nt, Human
aguaaaugcuagguuaauucca

SEQ ID NO: 3248354 - RNA, 19 nt, Human
aguaacaaugaagauaaaa

SEQ ID NO: 3248355 - RNA, 18 nt, Human
aguauuuuugacagaaua

SEQ ID NO: 3248356 - RNA, 17 nt, Human
aguauuuuugacagaau

SEQ ID NO: 3248357 - RNA, 16 nt, Human
aguauuuuugacagaa

SEQ ID NO: 3248358 - RNA, 13 nt, Human
aguauuuuugaca

SEQ ID NO: 3248359 - RNA, 20 nt, Human
agugaauucuugaaggaaaa

SEQ ID NO: 3248360 - RNA, 15 nt, Human
agggauuagggagag

SEQ ID NO: 3248361 - RNA, 21 nt, Human
aggccaugggcacugugggua

SEQ ID NO: 3248362 - RNA, 15 nt, Human
agggacugaggggag

SEQ ID NO: 3248363 - RNA, 13 nt, Human
aggaaguagagga

SEQ ID NO: 3248364 - RNA, 17 nt, Human
agcgacagugagacucu

SEQ ID NO: 3248365 - RNA, 23 nt, Human
agcuaauguaauaacugugaagu

SEQ ID NO: 3248366 - RNA, 20 nt, Human
agcugcugaaacaacaaaua

SEQ ID NO: 3248367 - RNA, 17 nt, Human
agcuccccucggagaag

SEQ ID NO: 3248368 - RNA, 19 nt, Human
agcuccccucggagaagag

SEQ ID NO: 3248369 - RNA, 20 nt, Human
agcuccccucggagaagagc

SEQ ID NO: 3248370 - RNA, 24 nt, Human
agcaaaauuuuuucucuaggaaau

SEQ ID NO: 3248371 - RNA, 23 nt, Human
agcaaaauuuuuucucuaggaaa

SEQ ID NO: 3248372 - RNA, 23 nt, Human
agcaaagcugaugacaacuuccc

SEQ ID NO: 3248373 - RNA, 21 nt, Human
agcaaagcugaugacaacuuc

SEQ ID NO: 3248374 - RNA, 16 nt, Human
agauguagaggagaaa

SEQ ID NO: 3248375 - RNA, 19 nt, Human
agauguagaggagaaacug

SEQ ID NO: 3248376 - RNA, 14 nt, Human
agaugguucuagca

SEQ ID NO: 3248377 - RNA, 22 nt, Human
agaagagcuguucacagccaga

SEQ ID NO: 3248378 - RNA, 21 nt, Human
agaagagcuguucacagccag

SEQ ID NO: 3248379 - RNA, 17 nt, Human
agaaugauuaugaauua

SEQ ID NO: 3248380 - RNA, 17 nt, Human
agaaugagagacacacu

SEQ ID NO: 3248381 - RNA, 22 nt, Human
agaaugagagacacacugaaga

SEQ ID NO: 3248382 - RNA, 21 nt, Human
agaagugaaaaucuacacucc

SEQ ID NO: 3248383 - RNA, 19 nt, Human
agacccaaaaggcagaagc

SEQ ID NO: 3248384 - RNA, 17 nt, Human
agacccaaaaggcagaa

SEQ ID NO: 3248385 - RNA, 18 nt, Human
agacucugucucagucca

SEQ ID NO: 3248386 - RNA, 13 nt, Human
agaggaaugaagu

SEQ ID NO: 3248387 - RNA, 19 nt, Human
aaagcauuguaaaugugcu

SEQ ID NO: 3248388 - RNA, 20 nt, Human
aaagcauuguaaaugugcuu

SEQ ID NO: 3248389 - RNA, 19 nt, Human
aaaggcagaagcaacccaa

SEQ ID NO: 3248390 - RNA, 20 nt, Human
aaauaaaaauauuguguugu

SEQ ID NO: 3248391 - RNA, 19 nt, Human
aaauaaaccucaaaauguc

SEQ ID NO: 3248392 - RNA, 13 nt, Human
aaagaaacauuug

SEQ ID NO: 3248393 - RNA, 21 nt, Human
aaacccugucucuacuaaaaa

SEQ ID NO: 3248394 - RNA, 17 nt, Human
aaaccucaaaaugucua

SEQ ID NO: 3248395 - RNA, 22 nt, Human
aaaccucaaaaugucuaagaua

SEQ ID NO: 3248396 - RNA, 20 nt, Human
aaaauuauuuuguucauaca

SEQ ID NO: 3248397 - RNA, 18 nt, Human
aaaauuauuuuguucaua

SEQ ID NO: 3248398 - RNA, 16 nt, Human
aaaauuauuuuguuca

SEQ ID NO: 3248399 - RNA, 19 nt, Human
aaaauccauacauuugugu

SEQ ID NO: 3248400 - RNA, 21 nt, Human
aaaaucauuucugcaucagcu

SEQ ID NO: 3248401 - RNA, 14 nt, Human
aaaucuuaacuuga

SEQ ID NO: 3248402 - RNA, 20 nt, Human
aaaugcuagguuaauuccaa

SEQ ID NO: 3248403 - RNA, 20 nt, Human
aaauguucaucaaugaauga

SEQ ID NO: 3248404 - RNA, 17 nt, Human
aaauguucaucaaugaa

SEQ ID NO: 3248405 - RNA, 22 nt, Human
aaauugacacuuaaaaaugguu

SEQ ID NO: 3248406 - RNA, 14 nt, Human
aaauugauguguuu

SEQ ID NO: 3248407 - RNA, 23 nt, Human
aacugagaugugaacacaucagc

SEQ ID NO: 3248408 - RNA, 12 nt, Human
aauaauguuuca

SEQ ID NO: 3248409 - RNA, 14 nt, Human
aauaauguuucaaa

SEQ ID NO: 3248410 - RNA, 17 nt, Human
aaguucugcagauaaac

SEQ ID NO: 3248411 - RNA, 22 nt, Human
aaguugauaugccuuuucccaa

SEQ ID NO: 3248412 - RNA, 10 nt, Human
aauaaaccau

SEQ ID NO: 3248413 - RNA, 17 nt, Human
aauaaaccucaaaaugu

SEQ ID NO: 3248414 - RNA, 14 nt, Human
aauaauaaauauuu

SEQ ID NO: 3248415 - RNA, 20 nt, Human
aauaaaccucaaaaugucua

SEQ ID NO: 3248416 - RNA, 15 nt, Human
aaucaaauaugcaaa

SEQ ID NO: 3248417 - RNA, 16 nt, Human
aaucaaauaugcaaag

SEQ ID NO: 3248418 - RNA, 22 nt, Human
aaucaaauaugcaaagcacuga

SEQ ID NO: 3248419 - RNA, 22 nt, Human
aaucauuucugcaucagcugcu

SEQ ID NO: 3248420 - RNA, 14 nt, Human
aaugauaacuggaa

SEQ ID NO: 3248421 - RNA, 15 nt, Human
aaugauaacuggaaa

SEQ ID NO: 3248422 - RNA, 16 nt, Human
aaugauaacuggaaac

SEQ ID NO: 3248423 - RNA, 14 nt, Human
aauccauacauuug

SEQ ID NO: 3248424 - RNA, 17 nt, Human
aauccauacauuugugu

SEQ ID NO: 3248425 - RNA, 16 nt, Human
aauccauacauuugug

SEQ ID NO: 3248426 - RNA, 15 nt, Human
aauccaaugaaauga

SEQ ID NO: 3248427 - RNA, 19 nt, Human
aagccagauuuuccugaaa

SEQ ID NO: 3248428 - RNA, 12 nt, Human
aaguagaggagg

SEQ ID NO: 3248429 - RNA, 14 nt, Human
aagggauggcaaga

SEQ ID NO: 3248430 - RNA, 17 nt, Human
aagggauggcaagaugu

SEQ ID NO: 3248431 - RNA, 15 nt, Human
aagcagggacuugaa

SEQ ID NO: 3248432 - RNA, 13 nt, Human
aagauuuucagaa

SEQ ID NO: 3248433 - RNA, 23 nt, Human
aagacagugaaagaaaauaacaa

SEQ ID NO: 3248434 - RNA, 21 nt, Human
aagacauucuuccaaaaagau

SEQ ID NO: 3248435 - RNA, 15 nt, Human
aagagaacuuccaga

SEQ ID NO: 3248436 - RNA, 19 nt, Human
acuucaaauccuugaagau

SEQ ID NO: 3248437 - RNA, 14 nt, Human
acuuaaaaaugguu

SEQ ID NO: 3248438 - RNA, 13 nt, Human
acuuaaaaauggu

SEQ ID NO: 3248439 - RNA, 22 nt, Human
acuucugucuucacaacagauu

SEQ ID NO: 3248440 - RNA, 19 nt, Human
acuucagcgguuuauauaa

SEQ ID NO: 3248441 - RNA, 20 nt, Human
acuucaaauccuugaagauu

SEQ ID NO: 3248442 - RNA, 17 nt, Human
acuucagcgguuuauau

SEQ ID NO: 3248443 - RNA, 18 nt, Human
acuucagcgguuuauaua

SEQ ID NO: 3248444 - RNA, 22 nt, Human
acuugggaggcugagaugggag

SEQ ID NO: 3248445 - RNA, 17 nt, Human
acuuuaugcuaagugaa

SEQ ID NO: 3248446 - RNA, 12 nt, Human
acuuuaugcuaa

SEQ ID NO: 3248447 - RNA, 15 nt, Human
acucugucucagucc

SEQ ID NO: 3248448 - RNA, 14 nt, Human
acucuuaagaagac

SEQ ID NO: 3248449 - RNA, 15 nt, Human
acucuuaagaagacu

SEQ ID NO: 3248450 - RNA, 19 nt, Human
acggacgaaccuugaaaac

SEQ ID NO: 3248451 - RNA, 18 nt, Human
acuaguauuucuaugaaa

SEQ ID NO: 3248452 - RNA, 17 nt, Human
accucugccucagaaaa

SEQ ID NO: 3248453 - RNA, 18 nt, Human
accucugccucagaaaac

SEQ ID NO: 3248454 - RNA, 13 nt, Human
acaagaaaugaaa

SEQ ID NO: 3248455 - RNA, 16 nt, Human
acaagaaaugaaagca

SEQ ID NO: 3248456 - RNA, 15 nt, Human
acaagaaaugaaagc

SEQ ID NO: 3248457 - RNA, 21 nt, Human
acaaggaugaauuaaguuuuu

SEQ ID NO: 3248458 - RNA, 18 nt, Human
aauuuugugaagcaaaau

SEQ ID NO: 3248459 - RNA, 13 nt, Human
aauuuugugaagc

SEQ ID NO: 3248460 - RNA, 17 nt, Human
aauuuugugaagcaaaa

SEQ ID NO: 3248461 - RNA, 16 nt, Human
acagaagcuccaggua

SEQ ID NO: 3248462 - RNA, 20 nt, Human
acagugauuaccagggacug

SEQ ID NO: 3248463 - RNA, 21 nt, Human
acagugauuaccagggacuga

SEQ ID NO: 3248464 - RNA, 20 nt, Human
acaucccuuaccugggaaag

SEQ ID NO: 3248465 - RNA, 15 nt, Human
acauaaguaauucaa

SEQ ID NO: 3248466 - RNA, 19 nt, Human
acauaauuaaauuuugagu

SEQ ID NO: 3248467 - RNA, 19 nt, Human
accaaggcugauuaaacca

SEQ ID NO: 3248468 - RNA, 22 nt, Human
caaaauuuuuucucuaggaaau

SEQ ID NO: 3248469 - RNA, 16 nt, Human
caaacugacucuuaag

SEQ ID NO: 3248470 - RNA, 17 nt, Human
caaacugacucuuaaga

SEQ ID NO: 3248471 - RNA, 21 nt, Human
caaacugacucuuaagaagac

SEQ ID NO: 3248472 - RNA, 14 nt, Human
caaaacugcacugu

SEQ ID NO: 3248473 - RNA, 17 nt, Human
caaaacugcacugucaa

SEQ ID NO: 3248474 - RNA, 18 nt, Human
caaaacugcacugucaag

SEQ ID NO: 3248475 - RNA, 18 nt, Human
caaaauaauuuuaagaaa

SEQ ID NO: 3248476 - RNA, 22 nt, Human
caaaauaauuuuaagaaaucaa

SEQ ID NO: 3248477 - RNA, 19 nt, Human
caagaaaugaaagcaggga

SEQ ID NO: 3248478 - RNA, 17 nt, Human
caagaaaugaaagcagg

SEQ ID NO: 3248479 - RNA, 15 nt, Human
caagaaaugaaagca

SEQ ID NO: 3248480 - RNA, 18 nt, Human
caaauguucaucaaugaa

SEQ ID NO: 3248481 - RNA, 14 nt, Human
caaauguucaucaa

SEQ ID NO: 3248482 - RNA, 13 nt, Human
caaauaugcaaag

SEQ ID NO: 3248483 - RNA, 12 nt, Human
caaauaugcaaa

SEQ ID NO: 3248484 - RNA, 16 nt, Human
caaauaaaaauauugu

SEQ ID NO: 3248485 - RNA, 18 nt, Human
caaauaaaaauauugugu

SEQ ID NO: 3248486 - RNA, 15 nt, Human
caaauaaaaauauug

SEQ ID NO: 3248487 - RNA, 16 nt, Human
caaagagagaaaauaa

SEQ ID NO: 3248488 - RNA, 19 nt, Human
caaagagagaaaauaaaga

SEQ ID NO: 3248489 - RNA, 18 nt, Human
cacaagaaaugaaagcag

SEQ ID NO: 3248490 - RNA, 20 nt, Human
cacaagaaaugaaagcaggg

SEQ ID NO: 3248491 - RNA, 22 nt, Human
caauuuuucuuauuucauuucu

SEQ ID NO: 3248492 - RNA, 17 nt, Human
cacagccagacuggcac

SEQ ID NO: 3248493 - RNA, 18 nt, Human
cacagccagacuggcaca

SEQ ID NO: 3248494 - RNA, 19 nt, Human
cacagcaguugaaaagacu

SEQ ID NO: 3248495 - RNA, 21 nt, Human
cacagcaguugaaaagacucc

SEQ ID NO: 3248496 - RNA, 13 nt, Human
cacacugaagaag

SEQ ID NO: 3248497 - RNA, 23 nt, Human
caagggugaugggaaagcauugu

SEQ ID NO: 3248498 - RNA, 21 nt, Human
caagggugaugggaaagcauu

SEQ ID NO: 3248499 - RNA, 17 nt, Human
caauagucaaauugugu

SEQ ID NO: 3248500 - RNA, 19 nt, Human
caauagucaaauuguguga

SEQ ID NO: 3248501 - RNA, 19 nt, Human
caauaauaaauauuuuugc

SEQ ID NO: 3248502 - RNA, 18 nt, Human
caaggaaaaaauaacaau

SEQ ID NO: 3248503 - RNA, 13 nt, Human
ccuaaacauauga

SEQ ID NO: 3248504 - RNA, 17 nt, Human
cccuucuuuccacagaa

SEQ ID NO: 3248505 - RNA, 13 nt, Human
ccuccauccugag

SEQ ID NO: 3248506 - RNA, 12 nt, Human
ccuccauccuga

SEQ ID NO: 3248507 - RNA, 14 nt, Human
ccccaggugccagu

SEQ ID NO: 3248508 - RNA, 23 nt, Human
ccauggcacucuauguucuaaga

SEQ ID NO: 3248509 - RNA, 15 nt, Human
ccauccugaggcucc

SEQ ID NO: 3248510 - RNA, 19 nt, Human
cauuuaaagcuuauuaaaa

SEQ ID NO: 3248511 - RNA, 12 nt, Human
cauuuccaagca

SEQ ID NO: 3248512 - RNA, 23 nt, Human
cauuucugcaucagcugcugaaa

SEQ ID NO: 3248513 - RNA, 16 nt, Human
cauuugcucauggaau

SEQ ID NO: 3248514 - RNA, 15 nt, Human
cauuugcucauggaa

SEQ ID NO: 3248515 - RNA, 14 nt, Human
cauuugcucaugga

SEQ ID NO: 3248516 - RNA, 17 nt, Human
ccaaagaaauguaaggg

SEQ ID NO: 3248517 - RNA, 14 nt, Human
ccaacacgagcagg

SEQ ID NO: 3248518 - RNA, 21 nt, Human
ccaacacgagcaggcuacugu

SEQ ID NO: 3248519 - RNA, 18 nt, Human
ccaaggcuagaaccaccu

SEQ ID NO: 3248520 - RNA, 22 nt, Human
ccacaagaaaugaaagcaggga

SEQ ID NO: 3248521 - RNA, 16 nt, Human
ccacaagaaaugaaag

SEQ ID NO: 3248522 - RNA, 20 nt, Human
ccaauauucauagcagcuua

SEQ ID NO: 3248523 - RNA, 19 nt, Human
ccaaggcugauuaaaccaa

SEQ ID NO: 3248524 - RNA, 23 nt, Human
caugcugucuacacuaagagaga

SEQ ID NO: 3248525 - RNA, 17 nt, Human
caugggacagggaggac

SEQ ID NO: 3248526 - RNA, 23 nt, Human
caguugaaaagacuccaaagaaa

SEQ ID NO: 3248527 - RNA, 21 nt, Human
caguugaaaagacuccaaaga

SEQ ID NO: 3248528 - RNA, 22 nt, Human
caguugaaaagacuccaaagaa

SEQ ID NO: 3248529 - RNA, 14 nt, Human
caguugaaaagacu

SEQ ID NO: 3248530 - RNA, 18 nt, Human
caguugaaaagacuccaa

SEQ ID NO: 3248531 - RNA, 14 nt, Human
caguuuucugagaa

SEQ ID NO: 3248532 - RNA, 15 nt, Human
caguuuucugagaaa

SEQ ID NO: 3248533 - RNA, 19 nt, Human
caguuuucugagaaagacu

SEQ ID NO: 3248534 - RNA, 20 nt, Human
caguuuucugagaaagacua

SEQ ID NO: 3248535 - RNA, 15 nt, Human
cauaaaaacaacuuu

SEQ ID NO: 3248536 - RNA, 23 nt, Human
cauaaaaagccugcaauuucaua

SEQ ID NO: 3248537 - RNA, 23 nt, Human
cauaaaaacaacuuuauacccag

SEQ ID NO: 3248538 - RNA, 21 nt, Human
cauaaaaacaacuuuauaccc

SEQ ID NO: 3248539 - RNA, 20 nt, Human
cauaaaaacaacuuuauacc

SEQ ID NO: 3248540 - RNA, 17 nt, Human
cauaaaaacaacuuuau

SEQ ID NO: 3248541 - RNA, 17 nt, Human
cauaccaacacgagcag

SEQ ID NO: 3248542 - RNA, 15 nt, Human
cauacauuguacgaa

SEQ ID NO: 3248543 - RNA, 19 nt, Human
cauacauauuuuuguagca

SEQ ID NO: 3248544 - RNA, 12 nt, Human
cauacauauuuu

SEQ ID NO: 3248545 - RNA, 11 nt, Human
cauacauauuu

SEQ ID NO: 3248546 - RNA, 16 nt, Human
cauaaguaauucaaga

SEQ ID NO: 3248547 - RNA, 17 nt, Human
cauaaguaauucaagaa

SEQ ID NO: 3248548 - RNA, 18 nt, Human
cauaaguaauucaagaaa

SEQ ID NO: 3248549 - RNA, 22 nt, Human
cauaaguaauucaagaaaacaa

SEQ ID NO: 3248550 - RNA, 12 nt, Human
caguucugaaga

SEQ ID NO: 3248551 - RNA, 13 nt, Human
caguucugaagaa

SEQ ID NO: 3248552 - RNA, 14 nt, Human
caguucugaagaag

SEQ ID NO: 3248553 - RNA, 22 nt, Human
caguucugaagaagaugguacc

SEQ ID NO: 3248554 - RNA, 15 nt, Human
caguucugaagaaga

SEQ ID NO: 3248555 - RNA, 16 nt, Human
caguucugaagaagau

SEQ ID NO: 3248556 - RNA, 22 nt, Human
caguucggugagcuacaaaugc

SEQ ID NO: 3248557 - RNA, 21 nt, Human
caguuaccucugccucagaaa

SEQ ID NO: 3248558 - RNA, 14 nt, Human
cagugucaaugcag

SEQ ID NO: 3248559 - RNA, 14 nt, Human
cagugugucuaaau

SEQ ID NO: 3248560 - RNA, 23 nt, Human
cagugugucuaaauuugaauguu

SEQ ID NO: 3248561 - RNA, 18 nt, Human
caucaaugaaugaaugaa

SEQ ID NO: 3248562 - RNA, 22 nt, Human
caucaagucuuucacauuuaaa

SEQ ID NO: 3248563 - RNA, 18 nt, Human
cauauuuuucacauaucu

SEQ ID NO: 3248564 - RNA, 21 nt, Human
cauauuuuucacauaucuagu

SEQ ID NO: 3248565 - RNA, 14 nt, Human
cauauuuuucacau

SEQ ID NO: 3248566 - RNA, 20 nt, Human
cauauauaacaaugcuguau

SEQ ID NO: 3248567 - RNA, 22 nt, Human
caucuagugagcagucaggaaa

SEQ ID NO: 3248568 - RNA, 14 nt, Human
caucuagugagcag

SEQ ID NO: 3248569 - RNA, 19 nt, Human
gccaugggcacugugggua

SEQ ID NO: 3248570 - RNA, 20 nt, Human
gccgggcgugguggugagug

SEQ ID NO: 3248571 - RNA, 13 nt, Human
gcuauaggugcua

SEQ ID NO: 3248572 - RNA, 18 nt, Human
gcuagaacucccuuucaa

SEQ ID NO: 3248573 - RNA, 19 nt, Human
gcuagaacucccuuucaac

SEQ ID NO: 3248574 - RNA, 12 nt, Human
gcgacagugaga

SEQ ID NO: 3248575 - RNA, 20 nt, Human
gcagccccgugggguuccuc

SEQ ID NO: 3248576 - RNA, 18 nt, Human
gcagauaaacaguaguga

SEQ ID NO: 3248577 - RNA, 15 nt, Human
gcaguucugaagaag

SEQ ID NO: 3248578 - RNA, 13 nt, Human
gcauagaaguaaa

SEQ ID NO: 3248579 - RNA, 14 nt, Human
gcaguucugaagaa

SEQ ID NO: 3248580 - RNA, 17 nt, Human
gcaguucugaagaagau

SEQ ID NO: 3248581 - RNA, 17 nt, Human
gcauagguuuaauaauu

SEQ ID NO: 3248582 - RNA, 20 nt, Human
gcauauuuuucacauaucua

SEQ ID NO: 3248583 - RNA, 19 nt, Human
gcauauuuuucacauaucu

SEQ ID NO: 3248584 - RNA, 16 nt, Human
gcauauuuuucacaua

SEQ ID NO: 3248585 - RNA, 15 nt, Human
gcauauuuuucacau

SEQ ID NO: 3248586 - RNA, 14 nt, Human
gcauauuuuucaca

SEQ ID NO: 3248587 - RNA, 13 nt, Human
gcagugaugucac

SEQ ID NO: 3248588 - RNA, 13 nt, Human
gcauuauauuuau

SEQ ID NO: 3248589 - RNA, 14 nt, Human
gcaagggugauggg

SEQ ID NO: 3248590 - RNA, 10 nt, Human
gcaagccaga

SEQ ID NO: 3248591 - RNA, 23 nt, Human
gcaaagcacugacuucuaaguaa

SEQ ID NO: 3248592 - RNA, 17 nt, Human
gcaaaauugauguguuu

SEQ ID NO: 3248593 - RNA, 15 nt, Human
gauuuuccugaaaac

SEQ ID NO: 3248594 - RNA, 21 nt, Human
gauggcuaguaucaaaagaaa

SEQ ID NO: 3248595 - RNA, 17 nt, Human
gaugacaacuucccagu

SEQ ID NO: 3248596 - RNA, 14 nt, Human
gaugaaaauauuug

SEQ ID NO: 3248597 - RNA, 22 nt, Human
gauaaauaguuuaugauuccac

SEQ ID NO: 3248598 - RNA, 12 nt, Human
gauaaguucaua

SEQ ID NO: 3248599 - RNA, 14 nt, Human
gauaaguucauaca

SEQ ID NO: 3248600 - RNA, 23 nt, Human
gauagauaggucagugcaaauac

SEQ ID NO: 3248601 - RNA, 17 nt, Human
gauaggucagugcaaau

SEQ ID NO: 3248602 - RNA, 14 nt, Human
gauagucuuucagu

SEQ ID NO: 3248603 - RNA, 15 nt, Human
gauaguaacaaugaa

SEQ ID NO: 3248604 - RNA, 22 nt, Human
gauagucuuucaguuaaggaga

SEQ ID NO: 3248605 - RNA, 16 nt, Human
gagcucgugggacagu

SEQ ID NO: 3248606 - RNA, 13 nt, Human
gagaaagacuauu

SEQ ID NO: 3248607 - RNA, 15 nt, Human
gagaaagacuauuca

SEQ ID NO: 3248608 - RNA, 17 nt, Human
gagaaagacuauucaaa

SEQ ID NO: 3248609 - RNA, 18 nt, Human
gagaaagacuauucaaac

SEQ ID NO: 3248610 - RNA, 18 nt, Human
gagacacacugaagaagc

SEQ ID NO: 3248611 - RNA, 15 nt, Human
gagaagagcuguuca

SEQ ID NO: 3248612 - RNA, 22 nt, Human
gagaagagcuguucacagccag

SEQ ID NO: 3248613 - RNA, 13 nt, Human
gagaagagcuguu

SEQ ID NO: 3248614 - RNA, 16 nt, Human
gagaagaacugaaauc

SEQ ID NO: 3248615 - RNA, 13 nt, Human
gagaagaacugaa

SEQ ID NO: 3248616 - RNA, 14 nt, Human
gagaagaacugaaa

SEQ ID NO: 3248617 - RNA, 21 nt, Human
gagaaugagagacacacugaa

SEQ ID NO: 3248618 - RNA, 13 nt, Human
gagacagcucugc

SEQ ID NO: 3248619 - RNA, 15 nt, Human
gagacagcucugcau

SEQ ID NO: 3248620 - RNA, 15 nt, Human
gagagugaacaaauu

SEQ ID NO: 3248621 - RNA, 19 nt, Human
gagagugaacaaauuuaca

SEQ ID NO: 3248622 - RNA, 17 nt, Human
gagauacagaauuuuau

SEQ ID NO: 3248623 - RNA, 17 nt, Human
gacaugggacauuugcu

SEQ ID NO: 3248624 - RNA, 22 nt, Human
gacaugggacauuugcucaugg

SEQ ID NO: 3248625 - RNA, 22 nt, Human
gacccacaagaaaugaaagcag

SEQ ID NO: 3248626 - RNA, 23 nt, Human
gaccugauuucugagcauuuaau

SEQ ID NO: 3248627 - RNA, 18 nt, Human
gacuccaaagaaauguaa

SEQ ID NO: 3248628 - RNA, 21 nt, Human
cuugcaugguuuagaaagcuu

SEQ ID NO: 3248629 - RNA, 13 nt, Human
cuucuuuccacag

SEQ ID NO: 3248630 - RNA, 19 nt, Human
cuucuuuccacagaagcuc

SEQ ID NO: 3248631 - RNA, 14 nt, Human
cuugaacccgggag

SEQ ID NO: 3248632 - RNA, 19 nt, Human
cuugaacccgggaggcaga

SEQ ID NO: 3248633 - RNA, 17 nt, Human
cuugccaaauauaaaua

SEQ ID NO: 3248634 - RNA, 16 nt, Human
cuuuggaacaagaugg

SEQ ID NO: 3248635 - RNA, 21 nt, Human
cuuuauuuucuauaauuuaaa

SEQ ID NO: 3248636 - RNA, 21 nt, Human
gaaagcuugcccuggugccuc

SEQ ID NO: 3248637 - RNA, 23 nt, Human
gaaaguuauugauaaguucauac

SEQ ID NO: 3248638 - RNA, 13 nt, Human
gaaagcagaacag

SEQ ID NO: 3248639 - RNA, 22 nt, Human
gaaagacuauucaaacagucuc

SEQ ID NO: 3248640 - RNA, 23 nt, Human
gaaagacuauucaaacagucuca

SEQ ID NO: 3248641 - RNA, 17 nt, Human
gaaagacuauucaaaca

SEQ ID NO: 3248642 - RNA, 19 nt, Human
gaaagacuauucaaacagu

SEQ ID NO: 3248643 - RNA, 13 nt, Human
gaaacugccagca

SEQ ID NO: 3248644 - RNA, 15 nt, Human
gaaacugccagcaac

SEQ ID NO: 3248645 - RNA, 22 nt, Human
gaaauguaagggaaacugccag

SEQ ID NO: 3248646 - RNA, 13 nt, Human
gaaauauuuauuu

SEQ ID NO: 3248647 - RNA, 15 nt, Human
gaaauauuuauuuua

SEQ ID NO: 3248648 - RNA, 24 nt, Human
gaacaguuaccucugccucagaaa

SEQ ID NO: 3248649 - RNA, 23 nt, Human
gaaauuauauaaguauucuaaau

SEQ ID NO: 3248650 - RNA, 17 nt, Human
gaaauuauauaaguauu

SEQ ID NO: 3248651 - RNA, 23 nt, Human
gaaguccaagcauuuagauguau

SEQ ID NO: 3248652 - RNA, 14 nt, Human
gaaccacaagacug

SEQ ID NO: 3248653 - RNA, 15 nt, Human
gaaccacaagacugc

SEQ ID NO: 3248654 - RNA, 16 nt, Human
gaacucccuuucaaca

SEQ ID NO: 3248655 - RNA, 15 nt, Human
gaacucccuuucaac

SEQ ID NO: 3248656 - RNA, 22 nt, Human
gaacuuguaaaggaauuuaaaa

SEQ ID NO: 3248657 - RNA, 15 nt, Human
gaagagcuguucaca

SEQ ID NO: 3248658 - RNA, 20 nt, Human
gaagagcuguucacagccag

SEQ ID NO: 3248659 - RNA, 13 nt, Human
gaagagcuguuca

SEQ ID NO: 3248660 - RNA, 23 nt, Human
gaagagcuguucacagccagacu

SEQ ID NO: 3248661 - RNA, 20 nt, Human
gaagaguauuuuugacagaa

SEQ ID NO: 3248662 - RNA, 12 nt, Human
cugcacugucaa

SEQ ID NO: 3248663 - RNA, 15 nt, Human
cuggccuucggccuc

SEQ ID NO: 3248664 - RNA, 21 nt, Human
cuggccuucggccuccauccu

SEQ ID NO: 3248665 - RNA, 18 nt, Human
cuggccuucggccuccau

SEQ ID NO: 3248666 - RNA, 17 nt, Human
cuggccuucggccucca

SEQ ID NO: 3248667 - RNA, 16 nt, Human
cuggccuucggccucc

SEQ ID NO: 3248668 - RNA, 18 nt, Human
cugucucuacuaaaaaua

SEQ ID NO: 3248669 - RNA, 13 nt, Human
cuguauuuuaaaa

SEQ ID NO: 3248670 - RNA, 16 nt, Human
cuguauuuuaaaagaa

SEQ ID NO: 3248671 - RNA, 15 nt, Human
cuguaugauucccag

SEQ ID NO: 3248672 - RNA, 16 nt, Human
cuccauccugaggcuc

SEQ ID NO: 3248673 - RNA, 14 nt, Human
cuccauccugaggc

SEQ ID NO: 3248674 - RNA, 18 nt, Human
cuccauccugaggcucca

SEQ ID NO: 3248675 - RNA, 17 nt, Human
cucuaggaaauauuuau

SEQ ID NO: 3248676 - RNA, 15 nt, Human
cucuaggaaauauuu

SEQ ID NO: 3248677 - RNA, 21 nt, Human
cucuccugauagucuuucagu

SEQ ID NO: 3248678 - RNA, 20 nt, Human
cugagcgacagugagacucu

SEQ ID NO: 3248679 - RNA, 16 nt, Human
cugagcgacagugaga

SEQ ID NO: 3248680 - RNA, 22 nt, Human
cugagaaagacuauucaaacag

SEQ ID NO: 3248681 - RNA, 23 nt, Human
cugagaaagacuauucaaacagu

SEQ ID NO: 3248682 - RNA, 13 nt, Human
cugacuucuaagu

SEQ ID NO: 3248683 - RNA, 15 nt, Human
cugacuucuaaguaa

SEQ ID NO: 3248684 - RNA, 16 nt, Human
cugacuucuaaguaaa

SEQ ID NO: 3248685 - RNA, 17 nt, Human
cugacucuuaagaagac

SEQ ID NO: 3248686 - RNA, 15 nt, Human
cugacuaugacauaa

SEQ ID NO: 3248687 - RNA, 15 nt, Human
cugacagauuuccau

SEQ ID NO: 3248688 - RNA, 11 nt, Human
cugacagauuu

SEQ ID NO: 3248689 - RNA, 12 nt, Human
cucuggccuucg

SEQ ID NO: 3248690 - RNA, 14 nt, Human
cugaagaagauggu

SEQ ID NO: 3248691 - RNA, 23 nt, Human
cugaagaagcaccaaucaugaau

SEQ ID NO: 3248692 - RNA, 22 nt, Human
cucuucuuuaaagggauggcaa

SEQ ID NO: 3248693 - RNA, 15 nt, Human
cgcucucuggccuuc

SEQ ID NO: 3248694 - RNA, 14 nt, Human
cgcucucuggccuu

SEQ ID NO: 3248695 - RNA, 12 nt, Human
cggccuccaucc

SEQ ID NO: 3248696 - RNA, 22 nt, Human
cggucggguuuuauuguuuaaa

SEQ ID NO: 3248697 - RNA, 17 nt, Human
cggugagcuacaaaugc

SEQ ID NO: 3248698 - RNA, 21 nt, Human
cggguuuuauuguuuaaaauc

SEQ ID NO: 3248699 - RNA, 23 nt, Human
cuaaauugacacuuaaaaauggu

SEQ ID NO: 3248700 - RNA, 23 nt, Human
cuaaauuugaauguuaagcagau

SEQ ID NO: 3248701 - RNA, 21 nt, Human
cuaugacauaaaaacaacuuu

SEQ ID NO: 3248702 - RNA, 17 nt, Human
cuaguaucaaaagaaag

SEQ ID NO: 3248703 - RNA, 15 nt, Human
cuaguaucaaaagaa

SEQ ID NO: 3248704 - RNA, 23 nt, Human
cuaguaucaaaagaaagaaaauc

SEQ ID NO: 3248705 - RNA, 16 nt, Human
cuaguaugaaauuaua

SEQ ID NO: 3248706 - RNA, 22 nt, Human
cuaguauuucuaugaaauauua

SEQ ID NO: 3248707 - RNA, 19 nt, Human
cuaguauuucuaugaaaua

SEQ ID NO: 3248708 - RNA, 20 nt, Human
cuaguauuucuaugaaauau

SEQ ID NO: 3248709 - RNA, 22 nt, Human
cuaggaaauauuuauuuuaaua

SEQ ID NO: 3248710 - RNA, 20 nt, Human
cuauauuuuuuguuaaauga

SEQ ID NO: 3248711 - RNA, 19 nt, Human
cuauauuguuugcuaagca

SEQ ID NO: 3248712 - RNA, 18 nt, Human
cuauauuguuugcuaagc

SEQ ID NO: 3248713 - RNA, 22 nt, Human
cuauauuuuuuguuaaaugauu

SEQ ID NO: 3248714 - RNA, 13 nt, Human
cuaugaaauauua

SEQ ID NO: 3248715 - RNA, 18 nt, Human
cuaugacauaaaaacaac

SEQ ID NO: 3248716 - RNA, 19 nt, Human
cuacuugggaggcugagau

SEQ ID NO: 3248717 - RNA, 18 nt, Human
cuacuugggaggcugaga

SEQ ID NO: 3248718 - RNA, 15 nt, Human
cuacuugggaggcug

SEQ ID NO: 3248719 - RNA, 14 nt, Human
cuaagcaaaaugug

SEQ ID NO: 3248720 - RNA, 18 nt, Human
cuaagcaaaaugugauau

SEQ ID NO: 3248721 - RNA, 15 nt, Human
cuaagcaaaauguga

SEQ ID NO: 3248722 - RNA, 17 nt, Human
cuacacuccagugagac

SEQ ID NO: 3248723 - RNA, 16 nt, Human
cuacacuccagugaga

SEQ ID NO: 3248724 - RNA, 19 nt, Human
cuaauguaauaacugugaa

SEQ ID NO: 3248725 - RNA, 19 nt, Human
uuuuucucuaggaaauauu

SEQ ID NO: 3248726 - RNA, 18 nt, Human
uuuuuaaaaaagaaacau

SEQ ID NO: 3248727 - RNA, 19 nt, Human
uuuuguagcacugacagau

SEQ ID NO: 3248728 - RNA, 18 nt, Human
uuuuguagcacugacaga

SEQ ID NO: 3248729 - RNA, 13 nt, Human
uuuuccugaaaac

SEQ ID NO: 3248730 - RNA, 14 nt, Human
uuuuccugaaaacc

SEQ ID NO: 3248731 - RNA, 18 nt, Human
uuuuggucuggagggaag

SEQ ID NO: 3248732 - RNA, 20 nt, Human
uuuugaaucucauaauuuau

SEQ ID NO: 3248733 - RNA, 22 nt, Human
uuuccucaaaacuucagacaua

SEQ ID NO: 3248734 - RNA, 13 nt, Human
uuucugagaaaga

SEQ ID NO: 3248735 - RNA, 17 nt, Human
uuucuuauuucauuucu

SEQ ID NO: 3248736 - RNA, 18 nt, Human
uuugaaucaucaagucuu

SEQ ID NO: 3248737 - RNA, 22 nt, Human
uuugaaucucauaauuuauaca

SEQ ID NO: 3248738 - RNA, 21 nt, Human
uuugaaucucauaauuuauac

SEQ ID NO: 3248739 - RNA, 20 nt, Human
uuugaaucucauaauuuaua

SEQ ID NO: 3248740 - RNA, 19 nt, Human
uuugaaucucauaauuuau

SEQ ID NO: 3248741 - RNA, 16 nt, Human
uuugaaucucauaauu

SEQ ID NO: 3248742 - RNA, 20 nt, Human
uuuuaauaauguuucaaaca

SEQ ID NO: 3248743 - RNA, 21 nt, Human
uuuuaaaagaaugauuaugaa

SEQ ID NO: 3248744 - RNA, 15 nt, Human
uuuuaaaagaaugau

SEQ ID NO: 3248745 - RNA, 13 nt, Human
uuuguauaaaaua

SEQ ID NO: 3248746 - RNA, 14 nt, Human
uuuguauaaaauaa

SEQ ID NO: 3248747 - RNA, 13 nt, Human
guauuuuaaucac

SEQ ID NO: 3248748 - RNA, 20 nt, Human
guauuuuaaaagaaugauua

SEQ ID NO: 3248749 - RNA, 18 nt, Human
guauuuuaaaagaaugau

SEQ ID NO: 3248750 - RNA, 15 nt, Human
gucaaugcagccccc

SEQ ID NO: 3248751 - RNA, 22 nt, Human
gucaauaaaauccauacauuug

SEQ ID NO: 3248752 - RNA, 23 nt, Human
gucaauaaaauccauacauuugu

SEQ ID NO: 3248753 - RNA, 19 nt, Human
gucagcuccccucggagaa

SEQ ID NO: 3248754 - RNA, 21 nt, Human
gucagcuccccucggagaaga

SEQ ID NO: 3248755 - RNA, 22 nt, Human
gucagcuccccucggagaagag

SEQ ID NO: 3248756 - RNA, 23 nt, Human
gucagcuccccucggagaagagc

SEQ ID NO: 3248757 - RNA, 17 nt, Human
guauguuagugcaaauu

SEQ ID NO: 3248758 - RNA, 23 nt, Human
guaugaaauuauauaaguauucu

SEQ ID NO: 3248759 - RNA, 13 nt, Human
guaugaaauuaua

SEQ ID NO: 3248760 - RNA, 18 nt, Human
gcuauaggugcuacaaaa

SEQ ID NO: 3248761 - RNA, 15 nt, Human
guagcacugacagau

SEQ ID NO: 3248762 - RNA, 14 nt, Human
guagcacugacaga

SEQ ID NO: 3248763 - RNA, 14 nt, Human
guaguguuggagaa

SEQ ID NO: 3248764 - RNA, 15 nt, Human
guaguguuggagaag

SEQ ID NO: 3248765 - RNA, 21 nt, Human
gugaacaaauuuacagagaca

SEQ ID NO: 3248766 - RNA, 13 nt, Human
gugaacacaucag

SEQ ID NO: 3248767 - RNA, 16 nt, Human
gugacaagcucacaga

SEQ ID NO: 3248768 - RNA, 22 nt, Human
gugaauucuugaaggaaaauga

SEQ ID NO: 3248769 - RNA, 18 nt, Human
gugaauucuugaaggaaa

SEQ ID NO: 3248770 - RNA, 23 nt, Human
gucugugagaugcuagaacuccc

SEQ ID NO: 3248771 - RNA, 22 nt, Human
gucugugagaugcuagaacucc

SEQ ID NO: 3248772 - RNA, 21 nt, Human
gucugugagaugcuagaacuc

SEQ ID NO: 3248773 - RNA, 17 nt, Human
gucugugagaugcuaga

SEQ ID NO: 3248774 - RNA, 16 nt, Human
gucugugagaugcuag

SEQ ID NO: 3248775 - RNA, 15 nt, Human
gucugugagaugcua

SEQ ID NO: 3248776 - RNA, 13 nt, Human
gucugacuguuuc

SEQ ID NO: 3248777 - RNA, 18 nt, Human
gucgucaaagcugaaaug

SEQ ID NO: 3248778 - RNA, 21 nt, Human
gucuaagauaguaacaaugaa

SEQ ID NO: 3248779 - RNA, 13 nt, Human
gucuaaauuugaa

SEQ ID NO: 3248780 - RNA, 23 nt, Human
gucggguuuuauuguuuaaaauc

SEQ ID NO: 3248781 - RNA, 23 nt, Human
guuaccucugccucagaaaacaa

SEQ ID NO: 3248782 - RNA, 18 nt, Human
guucaauaauaaauauuu

SEQ ID NO: 3248783 - RNA, 16 nt, Human
guucaucaaugaauga

SEQ ID NO: 3248784 - RNA, 20 nt, Human
guugauggugguauguuuuc

SEQ ID NO: 3248785 - RNA, 21 nt, Human
guugauggugguauguuuuca

SEQ ID NO: 3248786 - RNA, 17 nt, Human
guugaaaagacuccaaa

SEQ ID NO: 3248787 - RNA, 22 nt, Human
guugaaaagacuccaaagaaau

SEQ ID NO: 3248788 - RNA, 23 nt, Human
guugaaaagacuccaaagaaaug

SEQ ID NO: 3248789 - RNA, 12 nt, Human
guucugaagaag

SEQ ID NO: 3248790 - RNA, 13 nt, Human
guucugaagaaga

SEQ ID NO: 3248791 - RNA, 14 nt, Human
guucugaagaagau

SEQ ID NO: 3248792 - RNA, 15 nt, Human
guucugaagaagaug

SEQ ID NO: 3248793 - RNA, 20 nt, Human
guuaaaagaugaaaauauuu

SEQ ID NO: 3248794 - RNA, 14 nt, Human
guuaaaagaugaaa

SEQ ID NO: 3248795 - RNA, 16 nt, Human
guuaaaagaugaaaau

SEQ ID NO: 3248796 - RNA, 15 nt, Human
gugcuacaaaaacac

SEQ ID NO: 3248797 - RNA, 20 nt, Human
gugcuacaaaaacacagcaa

SEQ ID NO: 3248798 - RNA, 21 nt, Human
guguaaguagauaggccaugg

SEQ ID NO: 3248799 - RNA, 15 nt, Human
guguacuuaacuauu

SEQ ID NO: 3248800 - RNA, 23 nt, Human
uacugucagcuccccucggagaa

SEQ ID NO: 3248801 - RNA, 13 nt, Human
uacuuaacuauuc

SEQ ID NO: 3248802 - RNA, 23 nt, Human
uaccuuuguucccaaauuucaua

SEQ ID NO: 3248803 - RNA, 16 nt, Human
uaccuaucaucuuaag

SEQ ID NO: 3248804 - RNA, 22 nt, Human
uaccuaacgaaguauccuucag

SEQ ID NO: 3248805 - RNA, 14 nt, Human
uacccagaaaguua

SEQ ID NO: 3248806 - RNA, 16 nt, Human
uaauuuuuauauuuga

SEQ ID NO: 3248807 - RNA, 12 nt, Human
uaauuuuuauau

SEQ ID NO: 3248808 - RNA, 18 nt, Human
uaauuuugugaagcaaaa

SEQ ID NO: 3248809 - RNA, 13 nt, Human
uaauuuugugaag

SEQ ID NO: 3248810 - RNA, 17 nt, Human
uacacacucaaaucaag

SEQ ID NO: 3248811 - RNA, 16 nt, Human
uacacacucaaaucaa

SEQ ID NO: 3248812 - RNA, 14 nt, Human
uacacuccagugag

SEQ ID NO: 3248813 - RNA, 23 nt, Human
uacaguucggugagcuacaaaug

SEQ ID NO: 3248814 - RNA, 18 nt, Human
uagaauuaacacaugauc

SEQ ID NO: 3248815 - RNA, 16 nt, Human
uagaauuaacacauga

SEQ ID NO: 3248816 - RNA, 15 nt, Human
uagaauuaacacaug

SEQ ID NO: 3248817 - RNA, 23 nt, Human
uagaauaccacaggaaccacaag

SEQ ID NO: 3248818 - RNA, 14 nt, Human
uagauaggccaugg

SEQ ID NO: 3248819 - RNA, 15 nt, Human
uagcauggcauauuu

SEQ ID NO: 3248820 - RNA, 18 nt, Human
uagcauggcauauuuuuc

SEQ ID NO: 3248821 - RNA, 17 nt, Human
uagcauggcauauuuuu

SEQ ID NO: 3248822 - RNA, 20 nt, Human
uaggugcuacaaaaacacag

SEQ ID NO: 3248823 - RNA, 22 nt, Human
uaggugcuacaaaaacacagca

SEQ ID NO: 3248824 - RNA, 23 nt, Human
uaggugcuacaaaaacacagcaa

SEQ ID NO: 3248825 - RNA, 18 nt, Human
uaggugcuacaaaaacac

SEQ ID NO: 3248826 - RNA, 22 nt, Human
uagguuaauuccaauuauauga

SEQ ID NO: 3248827 - RNA, 17 nt, Human
uaguauuguccaggucu

SEQ ID NO: 3248828 - RNA, 13 nt, Human
uauauaacaaugc

SEQ ID NO: 3248829 - RNA, 17 nt, Human
uauauaacaaugcugua

SEQ ID NO: 3248830 - RNA, 19 nt, Human
uauauaacaaugcuguauu

SEQ ID NO: 3248831 - RNA, 14 nt, Human
uauaucuuguagcu

SEQ ID NO: 3248832 - RNA, 14 nt, Human
uaucaaaagaaaga

SEQ ID NO: 3248833 - RNA, 19 nt, Human
uauauuuuuuguuaaauga

SEQ ID NO: 3248834 - RNA, 21 nt, Human
uauauuuuuuguuaaaugauu

SEQ ID NO: 3248835 - RNA, 16 nt, Human
uauaugcuucuguuuu

SEQ ID NO: 3248836 - RNA, 14 nt, Human
uauaugcuucuguu

SEQ ID NO: 3248837 - RNA, 20 nt, Human
uauauuugaaauauugacuu

SEQ ID NO: 3248838 - RNA, 10 nt, Human
uaaaaucauu

SEQ ID NO: 3248839 - RNA, 13 nt, Human
uaaaaucauuucu

SEQ ID NO: 3248840 - RNA, 18 nt, Human
uaaaaucauuucugcauc

SEQ ID NO: 3248841 - RNA, 22 nt, Human
uaaaaucauuucugcaucagcu

SEQ ID NO: 3248842 - RNA, 15 nt, Human
uaaaauccauacauu

SEQ ID NO: 3248843 - RNA, 17 nt, Human
uaaaauccauacauuug

SEQ ID NO: 3248844 - RNA, 22 nt, Human
uaaaacaagcacuaaacaaaga

SEQ ID NO: 3248845 - RNA, 19 nt, Human
uaaaaaugguuuaaauggu

SEQ ID NO: 3248846 - RNA, 18 nt, Human
uaaaaaugguuuaaaugg

SEQ ID NO: 3248847 - RNA, 15 nt, Human
uaaaaaugguuuaaa

SEQ ID NO: 3248848 - RNA, 21 nt, Human
uaaaaagacauucuuccaaaa

SEQ ID NO: 3248849 - RNA, 13 nt, Human
uaaaaacaacuuu

SEQ ID NO: 3248850 - RNA, 19 nt, Human
uaaaaacaacuuuauaccc

SEQ ID NO: 3248851 - RNA, 18 nt, Human
uaaaaacaacuuuauacc

SEQ ID NO: 3248852 - RNA, 14 nt, Human
uaaaguguuugaaa

SEQ ID NO: 3248853 - RNA, 20 nt, Human
guuuauauaagcuuguauuc

SEQ ID NO: 3248854 - RNA, 20 nt, Human
guuuagcuggaaaaguaugu

SEQ ID NO: 3248855 - RNA, 21 nt, Human
guuuagcuggaaaaguauguu

SEQ ID NO: 3248856 - RNA, 17 nt, Human
guuuagaaagcuugccc

SEQ ID NO: 3248857 - RNA, 14 nt, Human
guugugaauguugu

SEQ ID NO: 3248858 - RNA, 17 nt, Human
uaaccaggggccaugaa

SEQ ID NO: 3248859 - RNA, 15 nt, Human
uaacuggaaacuuca

SEQ ID NO: 3248860 - RNA, 13 nt, Human
uaacugugaaguu

SEQ ID NO: 3248861 - RNA, 17 nt, Human
uaacugugaaguuuaca

SEQ ID NO: 3248862 - RNA, 18 nt, Human
uaacugugaaguuuacau

SEQ ID NO: 3248863 - RNA, 13 nt, Human
uaagagagaauga

SEQ ID NO: 3248864 - RNA, 14 nt, Human
uaagagagaaugag

SEQ ID NO: 3248865 - RNA, 21 nt, Human
uaagaaaauaucacuugucaa

SEQ ID NO: 3248866 - RNA, 19 nt, Human
uaagaaaucaaagagagaa

SEQ ID NO: 3248867 - RNA, 20 nt, Human
uaaauggcuuccuggcaaua

SEQ ID NO: 3248868 - RNA, 16 nt, Human
uaaaugugccuucauu

SEQ ID NO: 3248869 - RNA, 20 nt, Human
uaaauugacacuuaaaaaug

SEQ ID NO: 3248870 - RNA, 14 nt, Human
uaaauuugaauguu

SEQ ID NO: 3248871 - RNA, 22 nt, Human
uaaauuugaauguuaagcagau

SEQ ID NO: 3248872 - RNA, 22 nt, Human
uaauguuucaaacauauauaac

SEQ ID NO: 3248873 - RNA, 16 nt, Human
uaaugauaacuggaaa

SEQ ID NO: 3248874 - RNA, 17 nt, Human
uaaugauaacuggaaac

SEQ ID NO: 3248875 - RNA, 22 nt, Human
uaaugauaacuggaaacuucag

SEQ ID NO: 3248876 - RNA, 13 nt, Human
uaagugaaauaag

SEQ ID NO: 3248877 - RNA, 21 nt, Human
uaauaacugugaaguuuacau

SEQ ID NO: 3248878 - RNA, 15 nt, Human
uaauaacugugaagu

SEQ ID NO: 3248879 - RNA, 18 nt, Human
uuaaaauacacacucaaa

SEQ ID NO: 3248880 - RNA, 22 nt, Human
uuaaaaaaaaaccugagcccca

SEQ ID NO: 3248881 - RNA, 19 nt, Human
uguuuccauauuuuauagg

SEQ ID NO: 3248882 - RNA, 20 nt, Human
uuacauuuguauaaaauaau

SEQ ID NO: 3248883 - RNA, 12 nt, Human
uuacauuguaaa

SEQ ID NO: 3248884 - RNA, 13 nt, Human
uuacauuguaaau

SEQ ID NO: 3248885 - RNA, 16 nt, Human
uuaaugauaaguaaau

SEQ ID NO: 3248886 - RNA, 21 nt, Human
uguuaaaagaugaaaauauuu

SEQ ID NO: 3248887 - RNA, 23 nt, Human
uguucauacauauuuuuguagca

SEQ ID NO: 3248888 - RNA, 14 nt, Human
uguucauacauauu

SEQ ID NO: 3248889 - RNA, 12 nt, Human
uguucauacaua

SEQ ID NO: 3248890 - RNA, 21 nt, Human
ugugugaaagguacuucaaau

SEQ ID NO: 3248891 - RNA, 22 nt, Human
ugugugaaagguacuucaaauc

SEQ ID NO: 3248892 - RNA, 20 nt, Human
ugugugaaagguacuucaaa

SEQ ID NO: 3248893 - RNA, 13 nt, Human
uguguuuugcaag

SEQ ID NO: 3248894 - RNA, 19 nt, Human
uguguuuugcaagccagau

SEQ ID NO: 3248895 - RNA, 14 nt, Human
uguuggagaagaac

SEQ ID NO: 3248896 - RNA, 16 nt, Human
uguuggagaagaacug

SEQ ID NO: 3248897 - RNA, 17 nt, Human
uguuggagaagaacuga

SEQ ID NO: 3248898 - RNA, 19 nt, Human
uguuggagaagaacugaaa

SEQ ID NO: 3248899 - RNA, 17 nt, Human
uguuuaaaaucauuucu

SEQ ID NO: 3248900 - RNA, 18 nt, Human
uguuuaaaaucauuucug

SEQ ID NO: 3248901 - RNA, 14 nt, Human
uguuuaaaaucauu

SEQ ID NO: 3248902 - RNA, 20 nt, Human
uguugacaugggacauuugc

SEQ ID NO: 3248903 - RNA, 19 nt, Human
ugugcuaguaauuggaaag

SEQ ID NO: 3248904 - RNA, 21 nt, Human
ugugaauguugugauguauuc

SEQ ID NO: 3248905 - RNA, 18 nt, Human
ugugaagugaaugaaaca

SEQ ID NO: 3248906 - RNA, 15 nt, Human
uguaugauucccagc

SEQ ID NO: 3248907 - RNA, 16 nt, Human
uguaccgcaaugugac

SEQ ID NO: 3248908 - RNA, 15 nt, Human
uguaccgcaauguga

SEQ ID NO: 3248909 - RNA, 22 nt, Human
uguaguguuggagaagaacuga

SEQ ID NO: 3248910 - RNA, 17 nt, Human
uguagauaauacaguuc

SEQ ID NO: 3248911 - RNA, 14 nt, Human
uguacgaagaguau

SEQ ID NO: 3248912 - RNA, 22 nt, Human
uguacgaagaguauuuuugaca

SEQ ID NO: 3248913 - RNA, 17 nt, Human
ugcugaaacaacaaaua

SEQ ID NO: 3248914 - RNA, 15 nt, Human
ugcuaagcauuccaa

SEQ ID NO: 3248915 - RNA, 19 nt, Human
ugcuaagcauuccaacuau

SEQ ID NO: 3248916 - RNA, 15 nt, Human
ugccuucucaacucc

SEQ ID NO: 3248917 - RNA, 18 nt, Human
ugccuguaaucacagcua

SEQ ID NO: 3248918 - RNA, 19 nt, Human
ugcagugagccgagauugu

SEQ ID NO: 3248919 - RNA, 14 nt, Human
ugcaguucugaaga

SEQ ID NO: 3248920 - RNA, 15 nt, Human
ugcaguucugaagaa

SEQ ID NO: 3248921 - RNA, 16 nt, Human
ugcaguucugaagaag

SEQ ID NO: 3248922 - RNA, 17 nt, Human
ugcaguucugaagaaga

SEQ ID NO: 3248923 - RNA, 18 nt, Human
ugcaguucugaagaagau

SEQ ID NO: 3248924 - RNA, 19 nt, Human
ugcaguucugaagaagaug

SEQ ID NO: 3248925 - RNA, 22 nt, Human
ugcaguucugaagaagauggua

SEQ ID NO: 3248926 - RNA, 18 nt, Human
ugccaaauauaaauaaaa

SEQ ID NO: 3248927 - RNA, 17 nt, Human
ugccaaauauaaauaaa

SEQ ID NO: 3248928 - RNA, 22 nt, Human
ugccaaauauaaauaaaaauaa

SEQ ID NO: 3248929 - RNA, 19 nt, Human
ugccaaauauaaauaaaaa

SEQ ID NO: 3248930 - RNA, 20 nt, Human
ugccacuaaauugacacuua

SEQ ID NO: 3248931 - RNA, 16 nt, Human
uggcuuccuggcaaua

SEQ ID NO: 3248932 - RNA, 14 nt, Human
ugggaguacaaaag

SEQ ID NO: 3248933 - RNA, 21 nt, Human
ugguauguuuucaggcuagau

SEQ ID NO: 3248934 - RNA, 11 nt, Human
uggagggaagc

SEQ ID NO: 3248935 - RNA, 23 nt, Human
uggaaacuucagcgguuuauaua

SEQ ID NO: 3248936 - RNA, 20 nt, Human
uggaacauaaaauacaaugu

SEQ ID NO: 3248937 - RNA, 21 nt, Human
uggaacauaaaauacaauguu

SEQ ID NO: 3248938 - RNA, 22 nt, Human
uggaauaauccuaaacauauga

SEQ ID NO: 3248939 - RNA, 16 nt, Human
uggaaugcuguguuaa

SEQ ID NO: 3248940 - RNA, 21 nt, Human
uccugaggcuccacuuggucu

SEQ ID NO: 3248941 - RNA, 16 nt, Human
uccugaggcuccacuu

SEQ ID NO: 3248942 - RNA, 15 nt, Human
uccugaggcuccacu

SEQ ID NO: 3248943 - RNA, 12 nt, Human
ucuacuaaaaau

SEQ ID NO: 3248944 - RNA, 15 nt, Human
ucuacuaaaaauaca

SEQ ID NO: 3248945 - RNA, 19 nt, Human
ucuacuaaaaauacaaaaa

SEQ ID NO: 3248946 - RNA, 22 nt, Human
ucucauaauuuauacaggucau

SEQ ID NO: 3248947 - RNA, 16 nt, Human
ucucauaauuuauaca

SEQ ID NO: 3248948 - RNA, 16 nt, Human
ucggccuccauccuga

SEQ ID NO: 3248949 - RNA, 15 nt, Human
ucggccuccauccug

SEQ ID NO: 3248950 - RNA, 15 nt, Human
uccuugcaucaauuu

SEQ ID NO: 3248951 - RNA, 17 nt, Human
uccuugcaucaauuuuu

SEQ ID NO: 3248952 - RNA, 16 nt, Human
ucagcugcugaaacaa

SEQ ID NO: 3248953 - RNA, 22 nt, Human
ucaggagaguagaacagauaau

SEQ ID NO: 3248954 - RNA, 22 nt, Human
ucagcuccccucggagaagagc

SEQ ID NO: 3248955 - RNA, 21 nt, Human
ucagcuccccucggagaagag

SEQ ID NO: 3248956 - RNA, 18 nt, Human
ucaguccaugaagaugua

SEQ ID NO: 3248957 - RNA, 19 nt, Human
ucagugugucuaaauuuga

SEQ ID NO: 3248958 - RNA, 21 nt, Human
ucauggaauuggagcucgugg

SEQ ID NO: 3248959 - RNA, 19 nt, Human
ucauggaauuggagcucgu

SEQ ID NO: 3248960 - RNA, 20 nt, Human
uccaagcauuuagauguaua

SEQ ID NO: 3248961 - RNA, 14 nt, Human
ucugucucagucca

SEQ ID NO: 3248962 - RNA, 16 nt, Human
ucuucuuggucucagu

SEQ ID NO: 3248963 - RNA, 19 nt, Human
ucuugccaaauauaaauaa

SEQ ID NO: 3248964 - RNA, 18 nt, Human
ucuuguagcuuuaucaaa

SEQ ID NO: 3248965 - RNA, 22 nt, Human
ucuuaggguuaugauuaaguaa

SEQ ID NO: 3248966 - RNA, 14 nt, Human
ucuuauaauuuaaa

SEQ ID NO: 3248967 - RNA, 13 nt, Human
ucuuauaauuuaa

SEQ ID NO: 3248968 - RNA, 17 nt, Human
ucuuuccacagaagcuc

SEQ ID NO: 3248969 - RNA, 19 nt, Human
ugaaaauuauuuuguucau

SEQ ID NO: 3248970 - RNA, 23 nt, Human
ugaaaauuauuuuguucauacau

SEQ ID NO: 3248971 - RNA, 22 nt, Human
ugaaaauuauuuuguucauaca

SEQ ID NO: 3248972 - RNA, 23 nt, Human
ugaaacacucaguuguucaauaa

SEQ ID NO: 3248973 - RNA, 20 nt, Human
ugagaaagacuauucaaaca

SEQ ID NO: 3248974 - RNA, 20 nt, Human
ugagcaggauuuuaaucuuu

SEQ ID NO: 3248975 - RNA, 15 nt, Human
ugagcaggauuuuaa

SEQ ID NO: 3248976 - RNA, 13 nt, Human
ugacucuuaagaa

SEQ ID NO: 3248977 - RNA, 16 nt, Human
ugacucuuaagaagac

SEQ ID NO: 3248978 - RNA, 14 nt, Human
ugacucuuaagaag

SEQ ID NO: 3248979 - RNA, 15 nt, Human
ugacucuuaagaaga

SEQ ID NO: 3248980 - RNA, 14 nt, Human
ugaauuaaguuuuu

SEQ ID NO: 3248981 - RNA, 13 nt, Human
ugaauuacauuug

SEQ ID NO: 3248982 - RNA, 22 nt, Human
ugacaacuucccagugaauucu

SEQ ID NO: 3248983 - RNA, 22 nt, Human
ugacagaauauguuucaaacuu

SEQ ID NO: 3248984 - RNA, 21 nt, Human
ugacagaauauguuucaaacu

SEQ ID NO: 3248985 - RNA, 18 nt, Human
ugacagaauauguuucaa

SEQ ID NO: 3248986 - RNA, 17 nt, Human
ugaccacugcagaagac

SEQ ID NO: 3248987 - RNA, 16 nt, Human
ugaccacugcagaaga

SEQ ID NO: 3248988 - RNA, 23 nt, Human
ugacagaauauguuucaaacuuu

SEQ ID NO: 3248989 - RNA, 15 nt, Human
ugaaugaauggcuaa

SEQ ID NO: 3248990 - RNA, 20 nt, Human
ugaaucucauaauuuauaca

SEQ ID NO: 3248991 - RNA, 13 nt, Human
ugaaucucauaau

SEQ ID NO: 3248992 - RNA, 16 nt, Human
ugaaguuuacauugua

SEQ ID NO: 3248993 - RNA, 20 nt, Human
ugaaguuuacauuguaaaua

SEQ ID NO: 3248994 - RNA, 14 nt, Human
ugaaguuuacauug

SEQ ID NO: 3248995 - RNA, 15 nt, Human
ugaaggaaaaugaua

SEQ ID NO: 3248996 - RNA, 22 nt, Human
cucucuggccuucggccuccau

SEQ ID NO: 3248997 - RNA, 16 nt, Human
cucuccccaugauguu

SEQ ID NO: 3248998 - RNA, 15 nt, Human
cucuccccaugaugu

SEQ ID NO: 3248999 - RNA, 13 nt, Human
cucucuggccuuc

SEQ ID NO: 3249000 - RNA, 16 nt, Human
cucucuggccuucggc

SEQ ID NO: 3249001 - RNA, 14 nt, Human
cucucuggccuucg

SEQ ID NO: 3249002 - RNA, 18 nt, Human
cuaucucauuuccaagca

SEQ ID NO: 3249003 - RNA, 23 nt, Human
cuaugucauuugcuggagcucug

SEQ ID NO: 3249004 - RNA, 18 nt, Human
cuauguucuaagaaguga

SEQ ID NO: 3249005 - RNA, 16 nt, Human
cucaguccaugaagau

SEQ ID NO: 3249006 - RNA, 17 nt, Human
ccuucucuucacaguca

SEQ ID NO: 3249007 - RNA, 18 nt, Human
cgcucucuggccuucggc

SEQ ID NO: 3249008 - RNA, 12 nt, Human
ccuuuucccaac

SEQ ID NO: 3249009 - RNA, 20 nt, Human
cuacaaaaacacagcaaggg

SEQ ID NO: 3249010 - RNA, 20 nt, Human
cuaacgaaguauccuucagc

SEQ ID NO: 3249011 - RNA, 13 nt, Human
cccucggagaaga

SEQ ID NO: 3249012 - RNA, 14 nt, Human
cccugagcaggauu

SEQ ID NO: 3249013 - RNA, 20 nt, Human
ccuaacgaaguauccuucag

SEQ ID NO: 3249014 - RNA, 15 nt, Human
ccuaacgaaguaucc

SEQ ID NO: 3249015 - RNA, 18 nt, Human
ccaugggcacugugggua

SEQ ID NO: 3249016 - RNA, 22 nt, Human
ccauuguggucacaggaaguag

SEQ ID NO: 3249017 - RNA, 15 nt, Human
ccccauuguggucac

SEQ ID NO: 3249018 - RNA, 15 nt, Human
ccaggggccaugaau

SEQ ID NO: 3249019 - RNA, 12 nt, Human
ccacuuggucug

SEQ ID NO: 3249020 - RNA, 19 nt, Human
ccacuuggucugugagaug

SEQ ID NO: 3249021 - RNA, 17 nt, Human
ccacuuggucugugaga

SEQ ID NO: 3249022 - RNA, 16 nt, Human
ccacuuggucugugag

SEQ ID NO: 3249023 - RNA, 15 nt, Human
ccacuuggucuguga

SEQ ID NO: 3249024 - RNA, 22 nt, Human
ccacuuggucugugagaugcua

SEQ ID NO: 3249025 - RNA, 20 nt, Human
ccacuuggucugugagaugc

SEQ ID NO: 3249026 - RNA, 16 nt, Human
caggaaagagaacuuc

SEQ ID NO: 3249027 - RNA, 20 nt, Human
cagcuguaugauucccagcc

SEQ ID NO: 3249028 - RNA, 14 nt, Human
cagcuuauugucua

SEQ ID NO: 3249029 - RNA, 17 nt, Human
cagcuuauucacaagac

SEQ ID NO: 3249030 - RNA, 20 nt, Human
cagcuuauugucuagugaaa

SEQ ID NO: 3249031 - RNA, 19 nt, Human
cagcuguaugauucccagc

SEQ ID NO: 3249032 - RNA, 17 nt, Human
cagacuggcacaguuuu

SEQ ID NO: 3249033 - RNA, 18 nt, Human
cagacuggcacaguuuuc

SEQ ID NO: 3249034 - RNA, 22 nt, Human
cagacuggcacaguuuucugag

SEQ ID NO: 3249035 - RNA, 23 nt, Human
cagacuggcacaguuuucugaga

SEQ ID NO: 3249036 - RNA, 15 nt, Human
cagccagacuggcac

SEQ ID NO: 3249037 - RNA, 18 nt, Human
cagccagacuggcacagu

SEQ ID NO: 3249038 - RNA, 14 nt, Human
cagccagacuggca

SEQ ID NO: 3249039 - RNA, 21 nt, Human
ccaacuccagaaagugacaag

SEQ ID NO: 3249040 - RNA, 19 nt, Human
ccaauucgaacuuuuucca

SEQ ID NO: 3249041 - RNA, 22 nt, Human
ccaauuauaugagacguuuuug

SEQ ID NO: 3249042 - RNA, 14 nt, Human
cauuuguauaaaau

SEQ ID NO: 3249043 - RNA, 16 nt, Human
cauuuguauaaaauaa

SEQ ID NO: 3249044 - RNA, 14 nt, Human
ccaaaaggcagaag

SEQ ID NO: 3249045 - RNA, 19 nt, Human
cauuauauuuauuacugua

SEQ ID NO: 3249046 - RNA, 22 nt, Human
caguuauuauauuuacaaaugg

SEQ ID NO: 3249047 - RNA, 22 nt, Human
cagugauuaccagggacugagg

SEQ ID NO: 3249048 - RNA, 19 nt, Human
caguuauggcuauaggugc

SEQ ID NO: 3249049 - RNA, 20 nt, Human
caguuauggcuauaggugcu

SEQ ID NO: 3249050 - RNA, 13 nt, Human
caguuauggcuau

SEQ ID NO: 3249051 - RNA, 21 nt, Human
caguuauuauauuuacaaaug

SEQ ID NO: 3249052 - RNA, 17 nt, Human
caguuauuauauuuaca

SEQ ID NO: 3249053 - RNA, 19 nt, Human
cauagcagcuuauucacaa

SEQ ID NO: 3249054 - RNA, 23 nt, Human
caguuguucaauaauaaauauuu

SEQ ID NO: 3249055 - RNA, 19 nt, Human
cauccugaggcuccacuug

SEQ ID NO: 3249056 - RNA, 18 nt, Human
cauccugaggcuccacuu

SEQ ID NO: 3249057 - RNA, 22 nt, Human
auugaggacacugauauggguc

SEQ ID NO: 3249058 - RNA, 20 nt, Human
auuaaauuuugaguucuaca

SEQ ID NO: 3249059 - RNA, 16 nt, Human
auuucagcagcugcag

SEQ ID NO: 3249060 - RNA, 15 nt, Human
auugauaaguucaua

SEQ ID NO: 3249061 - RNA, 12 nt, Human
auugauaaguuc

SEQ ID NO: 3249062 - RNA, 19 nt, Human
auugauaaguucauacauu

SEQ ID NO: 3249063 - RNA, 18 nt, Human
auugauaaguucauacau

SEQ ID NO: 3249064 - RNA, 17 nt, Human
auugauaaguucauaca

SEQ ID NO: 3249065 - RNA, 16 nt, Human
auugauaaguucauac

SEQ ID NO: 3249066 - RNA, 19 nt, Human
auuuucuauaauuuaaaua

SEQ ID NO: 3249067 - RNA, 18 nt, Human
auuuucuauaauuuaaau

SEQ ID NO: 3249068 - RNA, 17 nt, Human
auuuucuauaauuuaaa

SEQ ID NO: 3249069 - RNA, 21 nt, Human
caaaagguauuuuaaucacca

SEQ ID NO: 3249070 - RNA, 17 nt, Human
caaacauauauaacaau

SEQ ID NO: 3249071 - RNA, 16 nt, Human
auuuuuauauuugaaa

SEQ ID NO: 3249072 - RNA, 19 nt, Human
auuuuuauauuugaaauau

SEQ ID NO: 3249073 - RNA, 17 nt, Human
caaucagccuaguugau

SEQ ID NO: 3249074 - RNA, 21 nt, Human
caauauuucagauaaucacaa

SEQ ID NO: 3249075 - RNA, 14 nt, Human
caagcaaguauuag

SEQ ID NO: 3249076 - RNA, 19 nt, Human
caacuauauuguuugcuaa

SEQ ID NO: 3249077 - RNA, 19 nt, Human
caacuaucucauuuccaag

SEQ ID NO: 3249078 - RNA, 15 nt, Human
caacuauuuuuccaa

SEQ ID NO: 3249079 - RNA, 12 nt, Human
caacuccagaaa

SEQ ID NO: 3249080 - RNA, 13 nt, Human
cacaucagcuugc

SEQ ID NO: 3249081 - RNA, 23 nt, Human
cacaucagcuugcccuguuaaaa

SEQ ID NO: 3249082 - RNA, 21 nt, Human
cacuccagugagacagcucug

SEQ ID NO: 3249083 - RNA, 16 nt, Human
cacuccagugagacag

SEQ ID NO: 3249084 - RNA, 11 nt, Human
cacugaagaag

SEQ ID NO: 3249085 - RNA, 23 nt, Human
cacugaagaagcaccaaucauga

SEQ ID NO: 3249086 - RNA, 19 nt, Human
ggaggcugagaugggagaa

SEQ ID NO: 3249087 - RNA, 15 nt, Human
ggaggcugagauggg

SEQ ID NO: 3249088 - RNA, 22 nt, Human
ggauguugaaaaaguucugcag

SEQ ID NO: 3249089 - RNA, 22 nt, Human
ggaugguucccuugaugaagaa

SEQ ID NO: 3249090 - RNA, 23 nt, Human
ggaugguucccuugaugaagaag

SEQ ID NO: 3249091 - RNA, 16 nt, Human
ggccuccauccugagg

SEQ ID NO: 3249092 - RNA, 20 nt, Human
aaaaagccugcaauuucaua

SEQ ID NO: 3249093 - RNA, 11 nt, Human
gggaggcagag

SEQ ID NO: 3249094 - RNA, 20 nt, Human
gggaggcagagguugcagug

SEQ ID NO: 3249095 - RNA, 22 nt, Human
aaaagcuccauuuuuagugaaa

SEQ ID NO: 3249096 - RNA, 21 nt, Human
aaaacuuuaugcuaagugaaa

SEQ ID NO: 3249097 - RNA, 19 nt, Human
aaaagccugcaauuucaua

SEQ ID NO: 3249098 - RNA, 21 nt, Human
aaaauaauuuuuauauuugaa

SEQ ID NO: 3249099 - RNA, 23 nt, Human
aaaauaauuuuuauauuugaaau

SEQ ID NO: 3249100 - RNA, 20 nt, Human
aaaauaauuuuuauauuuga

SEQ ID NO: 3249101 - RNA, 14 nt, Human
aaaauauauuuaau

SEQ ID NO: 3249102 - RNA, 18 nt, Human
aaagagaacuuccagauc

SEQ ID NO: 3249103 - RNA, 21 nt, Human
aaagacuauucaaacagucuc

SEQ ID NO: 3249104 - RNA, 13 nt, Human
aaagacuccaaag

SEQ ID NO: 3249105 - RNA, 23 nt, Human
aaagacuauucaaacagucucag

SEQ ID NO: 3249106 - RNA, 22 nt, Human
aaagacuauucaaacagucuca

SEQ ID NO: 3249107 - RNA, 15 nt, Human
aaagaggcagcuuga

SEQ ID NO: 3249108 - RNA, 20 nt, Human
aaagaggcagcuugaaacug

SEQ ID NO: 3249109 - RNA, 14 nt, Human
aaagauuuucagaa

SEQ ID NO: 3249110 - RNA, 15 nt, Human
aaagauuuucagaaa

SEQ ID NO: 3249111 - RNA, 16 nt, Human
aaagaaugauuaugaa

SEQ ID NO: 3249112 - RNA, 18 nt, Human
ggucauauuaauauauuu

SEQ ID NO: 3249113 - RNA, 21 nt, Human
ggucauauuaauauauuucca

SEQ ID NO: 3249114 - RNA, 13 nt, Human
aaagcuuauuaaa

SEQ ID NO: 3249115 - RNA, 13 nt, Human
aaaggaauuuaaa

SEQ ID NO: 3249116 - RNA, 14 nt, Human
ggucugugagaugc

SEQ ID NO: 3249117 - RNA, 21 nt, Human
aaagauuuucagaaaauauua

SEQ ID NO: 3249118 - RNA, 15 nt, Human
ggugccaguuauggc

SEQ ID NO: 3249119 - RNA, 16 nt, Human
aaaccacagcaguuga

SEQ ID NO: 3249120 - RNA, 15 nt, Human
aaaccacagcaguug

SEQ ID NO: 3249121 - RNA, 13 nt, Human
aaacauauauaac

SEQ ID NO: 3249122 - RNA, 16 nt, Human
aaacauauauaacaau

SEQ ID NO: 3249123 - RNA, 19 nt, Human
aaacauauauaacaaugcu

SEQ ID NO: 3249124 - RNA, 21 nt, Human
aaacauauauaacaaugcugu

SEQ ID NO: 3249125 - RNA, 14 nt, Human
aaacacaacuauau

SEQ ID NO: 3249126 - RNA, 20 nt, Human
aaacaagcacuaaacaaaga

SEQ ID NO: 3249127 - RNA, 17 nt, Human
aaacaaggaugaauuaa

SEQ ID NO: 3249128 - RNA, 19 nt, Human
aaacaacuucaauauccaa

SEQ ID NO: 3249129 - RNA, 19 nt, Human
aaaauuuuuucucuaggaa

SEQ ID NO: 3249130 - RNA, 14 nt, Human
aaaauauuaugugu

SEQ ID NO: 3249131 - RNA, 15 nt, Human
aaaauauuauguguu

SEQ ID NO: 3249132 - RNA, 21 nt, Human
aaaauauuauguguuuccaua

SEQ ID NO: 3249133 - RNA, 16 nt, Human
gcccccaggugccagu

SEQ ID NO: 3249134 - RNA, 14 nt, Human
gcccuguuaaaaga

SEQ ID NO: 3249135 - RNA, 17 nt, Human
gcccuguuaaaagauga

SEQ ID NO: 3249136 - RNA, 13 nt, Human
gcccuguuaaaag

SEQ ID NO: 3249137 - RNA, 16 nt, Human
gccauaugaaaaggcu

SEQ ID NO: 3249138 - RNA, 22 nt, Human
gccagacaucaacagauaaaua

SEQ ID NO: 3249139 - RNA, 19 nt, Human
gccagauuuuccugaaaac

SEQ ID NO: 3249140 - RNA, 21 nt, Human
gccacuguuuugaaucucaua

SEQ ID NO: 3249141 - RNA, 17 nt, Human
gcuggagcucugcccau

SEQ ID NO: 3249142 - RNA, 14 nt, Human
gcuggagcucugcc

SEQ ID NO: 3249143 - RNA, 22 nt, Human
gcuuccuucugugaaaguacau

SEQ ID NO: 3249144 - RNA, 16 nt, Human
gcuaguaucaaaagaa

SEQ ID NO: 3249145 - RNA, 21 nt, Human
gcuaguaauuggaaaggcagc

SEQ ID NO: 3249146 - RNA, 15 nt, Human
gcuccccucggagaa

SEQ ID NO: 3249147 - RNA, 14 nt, Human
gacacacugaagaa

SEQ ID NO: 3249148 - RNA, 15 nt, Human
gacacacugaagaag

SEQ ID NO: 3249149 - RNA, 16 nt, Human
gacacacugaagaagc

SEQ ID NO: 3249150 - RNA, 21 nt, Human
gacagaaagcagaacagugau

SEQ ID NO: 3249151 - RNA, 16 nt, Human
gacauuugcucaugga

SEQ ID NO: 3249152 - RNA, 21 nt, Human
gacagugagacucugucucag

SEQ ID NO: 3249153 - RNA, 14 nt, Human
gacagugaaagaaa

SEQ ID NO: 3249154 - RNA, 14 nt, Human
gacucuuaagaaga

SEQ ID NO: 3249155 - RNA, 18 nt, Human
gacucuuaagaagacugc

SEQ ID NO: 3249156 - RNA, 21 nt, Human
gacucuuaagaagacugcauu

SEQ ID NO: 3249157 - RNA, 16 nt, Human
gacgcucucuggccuu

SEQ ID NO: 3249158 - RNA, 15 nt, Human
gacgcucucuggccu

SEQ ID NO: 3249159 - RNA, 14 nt, Human
gaagcaaaauuuuu

SEQ ID NO: 3249160 - RNA, 23 nt, Human
gaagcaacccaaauguucaucaa

SEQ ID NO: 3249161 - RNA, 19 nt, Human
gaacccgggaggcagaggu

SEQ ID NO: 3249162 - RNA, 14 nt, Human
gaacugaaaucaua

SEQ ID NO: 3249163 - RNA, 13 nt, Human
gaacugaaaucau

SEQ ID NO: 3249164 - RNA, 22 nt, Human
gaauauugcuuuggucauauga

SEQ ID NO: 3249165 - RNA, 15 nt, Human
gaauauguuucaaac

SEQ ID NO: 3249166 - RNA, 14 nt, Human
gaauauguuucaaa

SEQ ID NO: 3249167 - RNA, 20 nt, Human
gaauauguuucaaacuuugg

SEQ ID NO: 3249168 - RNA, 15 nt, Human
gauuuaccacuugug

SEQ ID NO: 3249169 - RNA, 16 nt, Human
gauuuaccacuugugu

SEQ ID NO: 3249170 - RNA, 16 nt, Human
gaugaucuuuaaaaua

SEQ ID NO: 3249171 - RNA, 18 nt, Human
gauguagaggagaaacug

SEQ ID NO: 3249172 - RNA, 17 nt, Human
gauguagaggagaaacu

SEQ ID NO: 3249173 - RNA, 14 nt, Human
gaugguucuagcau

SEQ ID NO: 3249174 - RNA, 22 nt, Human
gaugguucccuugaugaagaag

SEQ ID NO: 3249175 - RNA, 20 nt, Human
gcacaguuuucugagaaaga

SEQ ID NO: 3249176 - RNA, 22 nt, Human
gcacaguuuucugagaaagacu

SEQ ID NO: 3249177 - RNA, 23 nt, Human
gcacaguuuucugagaaagacua

SEQ ID NO: 3249178 - RNA, 22 nt, Human
gcaauagucaaauugugugaaa

SEQ ID NO: 3249179 - RNA, 20 nt, Human
gcaaguauuagaauaccaca

SEQ ID NO: 3249180 - RNA, 15 nt, Human
gaggacgcucucugg

SEQ ID NO: 3249181 - RNA, 23 nt, Human
gaggcuccacuuggucugugaga

SEQ ID NO: 3249182 - RNA, 18 nt, Human
gaggcuccacuuggucug

SEQ ID NO: 3249183 - RNA, 19 nt, Human
gaggcuccacuuggucugu

SEQ ID NO: 3249184 - RNA, 15 nt, Human
cuucuguuuuauaau

SEQ ID NO: 3249185 - RNA, 20 nt, Human
cuucuguuuuauaauuuugu

SEQ ID NO: 3249186 - RNA, 20 nt, Human
cuuuaaagggauggcaagau

SEQ ID NO: 3249187 - RNA, 21 nt, Human
cuuugagugucuuaauuaaaa

SEQ ID NO: 3249188 - RNA, 11 nt, Human
cuucagacaua

SEQ ID NO: 3249189 - RNA, 12 nt, Human
cuucaucugacu

SEQ ID NO: 3249190 - RNA, 18 nt, Human
cuucaucugacuaugaca

SEQ ID NO: 3249191 - RNA, 23 nt, Human
cuucaugcugucuacacuaagag

SEQ ID NO: 3249192 - RNA, 10 nt, Human
cugggacagg

SEQ ID NO: 3249193 - RNA, 21 nt, Human
cuggugccucaccccuugcca

SEQ ID NO: 3249194 - RNA, 12 nt, Human
cuggugccucac

SEQ ID NO: 3249195 - RNA, 16 nt, Human
cugcacuccagccuga

SEQ ID NO: 3249196 - RNA, 20 nt, Human
cugcacuccagccugagcga

SEQ ID NO: 3249197 - RNA, 17 nt, Human
cugcacuccagccugag

SEQ ID NO: 3249198 - RNA, 21 nt, Human
aauaacaaugaaaguugauaa

SEQ ID NO: 3249199 - RNA, 13 nt, Human
aauaacugugaag

SEQ ID NO: 3249200 - RNA, 16 nt, Human
aauaauuuuuauauuu

SEQ ID NO: 3249201 - RNA, 17 nt, Human
aauaauuuuuauauuug

SEQ ID NO: 3249202 - RNA, 19 nt, Human
aauaauuuuuauauuugaa

SEQ ID NO: 3249203 - RNA, 21 nt, Human
aauaauuuuaagaaaucaaag

SEQ ID NO: 3249204 - RNA, 20 nt, Human
aauaacugugaaguuuacau

SEQ ID NO: 3249205 - RNA, 14 nt, Human
aauaacugugaagu

SEQ ID NO: 3249206 - RNA, 16 nt, Human
aauaacugugaaguuu

SEQ ID NO: 3249207 - RNA, 20 nt, Human
aauaauuuuuauauuugaaa

SEQ ID NO: 3249208 - RNA, 17 nt, Human
uaaauuuugaguucuac

SEQ ID NO: 3249209 - RNA, 19 nt, Human
aauaucuuuuuuuuaauaa

SEQ ID NO: 3249210 - RNA, 24 nt, Human
aauaugcaaagcacugacuucuaa

SEQ ID NO: 3249211 - RNA, 15 nt, Human
aauaugcaaagcacu

SEQ ID NO: 3249212 - RNA, 17 nt, Human
aauaugcaaagcacuga

SEQ ID NO: 3249213 - RNA, 14 nt, Human
aauauuucagauaa

SEQ ID NO: 3249214 - RNA, 15 nt, Human
aauauuucagauaau

SEQ ID NO: 3249215 - RNA, 20 nt, Human
aauauugcuuuggucauaug

SEQ ID NO: 3249216 - RNA, 18 nt, Human
aauauuguguugugaaug

SEQ ID NO: 3249217 - RNA, 18 nt, Human
aauaggcguaacuaauuu

SEQ ID NO: 3249218 - RNA, 20 nt, Human
uaaauuuugucuuuaacuca

SEQ ID NO: 3249219 - RNA, 18 nt, Human
uaaauuuugaguucuaca

SEQ ID NO: 3249220 - RNA, 19 nt, Human
uaaauuuugaguucuacau

SEQ ID NO: 3249221 - RNA, 12 nt, Human
aauaucacuugu

SEQ ID NO: 3249222 - RNA, 15 nt, Human
aauaucacuugucaa

SEQ ID NO: 3249223 - RNA, 15 nt, Human
aaucaucaagucuuu

SEQ ID NO: 3249224 - RNA, 23 nt, Human
aaucaugaauuaguuuuauaugc

SEQ ID NO: 3249225 - RNA, 19 nt, Human
aaucaugaauuaguuuuau

SEQ ID NO: 3249226 - RNA, 17 nt, Human
aaucaugaauuaguuuu

SEQ ID NO: 3249227 - RNA, 20 nt, Human
uaaguauguguaaaauguga

SEQ ID NO: 3249228 - RNA, 13 nt, Human
uaaguucauacau

SEQ ID NO: 3249229 - RNA, 12 nt, Human
uaaguucauaca

SEQ ID NO: 3249230 - RNA, 13 nt, Human
aauccuugaagau

SEQ ID NO: 3249231 - RNA, 14 nt, Human
aaucuuauaauuua

SEQ ID NO: 3249232 - RNA, 20 nt, Human
aaugacucagaauauugcuu

SEQ ID NO: 3249233 - RNA, 14 nt, Human
uaaugguguuuuaa

SEQ ID NO: 3249234 - RNA, 23 nt, Human
uaaucagugugucuaaauuugaa

SEQ ID NO: 3249235 - RNA, 11 nt, Human
aaugugauaug

SEQ ID NO: 3249236 - RNA, 18 nt, Human
uacauauuuuuguagcac

SEQ ID NO: 3249237 - RNA, 17 nt, Human
uacauauuuuuguagca

SEQ ID NO: 3249238 - RNA, 19 nt, Human
aauggacuuuuguacauag

SEQ ID NO: 3249239 - RNA, 18 nt, Human
uacacuaagagagaauga

SEQ ID NO: 3249240 - RNA, 19 nt, Human
uacacuaagagagaaugag

SEQ ID NO: 3249241 - RNA, 15 nt, Human
uacaaaaacacagca

SEQ ID NO: 3249242 - RNA, 21 nt, Human
uacaaaaaaaaaaaaaaauua

SEQ ID NO: 3249243 - RNA, 13 nt, Human
uacaaaaacacag

SEQ ID NO: 3249244 - RNA, 14 nt, Human
uacaaaaacacagc

SEQ ID NO: 3249245 - RNA, 13 nt, Human
uaauucaagaaaa

SEQ ID NO: 3249246 - RNA, 17 nt, Human
uaauuuauacaggucau

SEQ ID NO: 3249247 - RNA, 14 nt, Human
uacuaaaaauacaa

SEQ ID NO: 3249248 - RNA, 18 nt, Human
uacuaaaaauacaaaaaa

SEQ ID NO: 3249249 - RNA, 17 nt, Human
uacugagagugaacaaa

SEQ ID NO: 3249250 - RNA, 18 nt, Human
aauugaggacacugauau

SEQ ID NO: 3249251 - RNA, 16 nt, Human
uacuucaugcugucua

SEQ ID NO: 3249252 - RNA, 19 nt, Human
uacuucuuaggguuaugau

SEQ ID NO: 3249253 - RNA, 18 nt, Human
aauuuacagagacagaaa

SEQ ID NO: 3249254 - RNA, 17 nt, Human
aauuuacagagacagaa

SEQ ID NO: 3249255 - RNA, 17 nt, Human
aauuuauacaggucaua

SEQ ID NO: 3249256 - RNA, 16 nt, Human
aauuuauacaggucau

SEQ ID NO: 3249257 - RNA, 22 nt, Human
acaagcucacagaccuuugaac

SEQ ID NO: 3249258 - RNA, 17 nt, Human
acaagaugguucuagca

SEQ ID NO: 3249259 - RNA, 17 nt, Human
acaaauuuacagagaca

SEQ ID NO: 3249260 - RNA, 16 nt, Human
uagcuacuaauuuuaa

SEQ ID NO: 3249261 - RNA, 18 nt, Human
acaaugaagauaaaaaga

SEQ ID NO: 3249262 - RNA, 22 nt, Human
aauuuuuucucuaggaaauauu

SEQ ID NO: 3249263 - RNA, 21 nt, Human
aauuuuucuuauuucauuucu

SEQ ID NO: 3249264 - RNA, 21 nt, Human
uagaugcaguucugaagaaga

SEQ ID NO: 3249265 - RNA, 20 nt, Human
uagaugcaguucugaagaag

SEQ ID NO: 3249266 - RNA, 17 nt, Human
uagauaggccaugggca

SEQ ID NO: 3249267 - RNA, 22 nt, Human
uagauaggucagugcaaauacu

SEQ ID NO: 3249268 - RNA, 12 nt, Human
acacugaagaag

SEQ ID NO: 3249269 - RNA, 14 nt, Human
acacugaagaagca

SEQ ID NO: 3249270 - RNA, 14 nt, Human
acacuccagugaga

SEQ ID NO: 3249271 - RNA, 16 nt, Human
uauaaguauucuaaau

SEQ ID NO: 3249272 - RNA, 15 nt, Human
acacuuaaaaauggu

SEQ ID NO: 3249273 - RNA, 13 nt, Human
acacuuaaaaaug

SEQ ID NO: 3249274 - RNA, 15 nt, Human
uauauuuaaugauaa

SEQ ID NO: 3249275 - RNA, 12 nt, Human
uauauuuacaaa

SEQ ID NO: 3249276 - RNA, 19 nt, Human
uauauuuauuacuguaaga

SEQ ID NO: 3249277 - RNA, 15 nt, Human
uauauuuauuacugu

SEQ ID NO: 3249278 - RNA, 17 nt, Human
uaucucaaaacugcacu

SEQ ID NO: 3249279 - RNA, 20 nt, Human
acagcccuucuuuccacaga

SEQ ID NO: 3249280 - RNA, 21 nt, Human
acagcccuucuuuccacagaa

SEQ ID NO: 3249281 - RNA, 19 nt, Human
acagcccuucuuuccacag

SEQ ID NO: 3249282 - RNA, 16 nt, Human
uaucuuguagcuuuau

SEQ ID NO: 3249283 - RNA, 14 nt, Human
acagauaaucagug

SEQ ID NO: 3249284 - RNA, 20 nt, Human
acacacucaaaucaagaaac

SEQ ID NO: 3249285 - RNA, 13 nt, Human
acacacugaagaa

SEQ ID NO: 3249286 - RNA, 14 nt, Human
acaaugcuguauuu

SEQ ID NO: 3249287 - RNA, 17 nt, Human
acaaugcuguauuuuaa

SEQ ID NO: 3249288 - RNA, 14 nt, Human
acacaacuauauug

SEQ ID NO: 3249289 - RNA, 17 nt, Human
acacaacuauauuguuu

SEQ ID NO: 3249290 - RNA, 18 nt, Human
acacaacuauuuuuccaa

SEQ ID NO: 3249291 - RNA, 14 nt, Human
acacacugaagaag

SEQ ID NO: 3249292 - RNA, 14 nt, Human
uaguaauagagcaa

SEQ ID NO: 3249293 - RNA, 12 nt, Human
uaguguuggaga

SEQ ID NO: 3249294 - RNA, 16 nt, Human
uaguguuggagaagaa

SEQ ID NO: 3249295 - RNA, 20 nt, Human
uaguaauagagcaaaauuga

SEQ ID NO: 3249296 - RNA, 23 nt, Human
uauaaaauaauuuuuauauuuga

SEQ ID NO: 3249297 - RNA, 17 nt, Human
acacuaagagagaauga

SEQ ID NO: 3249298 - RNA, 14 nt, Human
acacuaagagagaa

SEQ ID NO: 3249299 - RNA, 18 nt, Human
acacuaagagagaaugag

SEQ ID NO: 3249300 - RNA, 23 nt, Human
aagcuuguauuccuuuuucucuc

SEQ ID NO: 3249301 - RNA, 18 nt, Human
aagcuuauuaaaacucau

SEQ ID NO: 3249302 - RNA, 14 nt, Human
guugacaugggaca

SEQ ID NO: 3249303 - RNA, 18 nt, Human
guugacaugggacauuug

SEQ ID NO: 3249304 - RNA, 13 nt, Human
guugacaugggac

SEQ ID NO: 3249305 - RNA, 18 nt, Human
guucuagcauggcauauu

SEQ ID NO: 3249306 - RNA, 9 nt, Human
guucauaca

SEQ ID NO: 3249307 - RNA, 23 nt, Human
guucauacauauuuuuguagcac

SEQ ID NO: 3249308 - RNA, 14 nt, Human
guucauacauauuu

SEQ ID NO: 3249309 - RNA, 13 nt, Human
guucauacauauu

SEQ ID NO: 3249310 - RNA, 10 nt, Human
guucauacau

SEQ ID NO: 3249311 - RNA, 14 nt, Human
guucauacauugua

SEQ ID NO: 3249312 - RNA, 11 nt, Human
guucauacauu

SEQ ID NO: 3249313 - RNA, 14 nt, Human
guuaaguaugugua

SEQ ID NO: 3249314 - RNA, 21 nt, Human
guuucaaacauauauaacaau

SEQ ID NO: 3249315 - RNA, 23 nt, Human
guuuucugagaaagacuauucaa

SEQ ID NO: 3249316 - RNA, 10 nt, Human
guuuaaaauc

SEQ ID NO: 3249317 - RNA, 16 nt, Human
guuuaaaaucauuucu

SEQ ID NO: 3249318 - RNA, 18 nt, Human
guuguaccgcaaugugac

SEQ ID NO: 3249319 - RNA, 22 nt, Human
aagaagugaaaaucuacacucc

SEQ ID NO: 3249320 - RNA, 16 nt, Human
aagaagugaaaaucua

SEQ ID NO: 3249321 - RNA, 18 nt, Human
aagaaugauuaugaauua

SEQ ID NO: 3249322 - RNA, 16 nt, Human
aagaaugauuaugaau

SEQ ID NO: 3249323 - RNA, 19 nt, Human
aagagcuguucacagccag

SEQ ID NO: 3249324 - RNA, 21 nt, Human
gugggacagucaccucaugga

SEQ ID NO: 3249325 - RNA, 21 nt, Human
gugugaccacugcagaagaca

SEQ ID NO: 3249326 - RNA, 13 nt, Human
guguuuauuuaua

SEQ ID NO: 3249327 - RNA, 18 nt, Human
guguuuccauauuuuaua

SEQ ID NO: 3249328 - RNA, 22 nt, Human
aaaugaaagcagggacuugaac

SEQ ID NO: 3249329 - RNA, 21 nt, Human
aaaugaaagcagggacuugaa

SEQ ID NO: 3249330 - RNA, 19 nt, Human
aaauggcuuccuggcaaua

SEQ ID NO: 3249331 - RNA, 18 nt, Human
aaauggcuuccuggcaau

SEQ ID NO: 3249332 - RNA, 14 nt, Human
aaaugcauuucuaa

SEQ ID NO: 3249333 - RNA, 14 nt, Human
aaauccuugaagau

SEQ ID NO: 3249334 - RNA, 19 nt, Human
aaaucuacacuccagugag

SEQ ID NO: 3249335 - RNA, 18 nt, Human
aaauccauacauuugugu

SEQ ID NO: 3249336 - RNA, 18 nt, Human
aaauuucagcagcugcag

SEQ ID NO: 3249337 - RNA, 17 nt, Human
aaauuucagcagcugca

SEQ ID NO: 3249338 - RNA, 16 nt, Human
guauuuuugacagaau

SEQ ID NO: 3249339 - RNA, 20 nt, Human
guauuuuugacagaauaugu

SEQ ID NO: 3249340 - RNA, 22 nt, Human
aaauuauuuuguucauacauau

SEQ ID NO: 3249341 - RNA, 21 nt, Human
aaauuauuuuguucauacaua

SEQ ID NO: 3249342 - RNA, 20 nt, Human
aaauuauuuuguucauacau

SEQ ID NO: 3249343 - RNA, 22 nt, Human
aaauuauauaaguauucuaaau

SEQ ID NO: 3249344 - RNA, 19 nt, Human
aaauuauuuuguucauaca

SEQ ID NO: 3249345 - RNA, 17 nt, Human
aaauuauuuuguucaua

SEQ ID NO: 3249346 - RNA, 18 nt, Human
aaauuauauaaguauucu

SEQ ID NO: 3249347 - RNA, 16 nt, Human
aaauuauauaaguauu

SEQ ID NO: 3249348 - RNA, 22 nt, Human
aaauguaagggaaacugccagc

SEQ ID NO: 3249349 - RNA, 16 nt, Human
aaauguaagggaaacu

SEQ ID NO: 3249350 - RNA, 14 nt, Human
guaugauucccagc

SEQ ID NO: 3249351 - RNA, 19 nt, Human
gucuuaauuaaaagaauau

SEQ ID NO: 3249352 - RNA, 21 nt, Human
gucuuaauuaaaagaauauuu

SEQ ID NO: 3249353 - RNA, 22 nt, Human
gucuuaauuaaaagaauauuuu

SEQ ID NO: 3249354 - RNA, 14 nt, Human
aacuccagaaagug

SEQ ID NO: 3249355 - RNA, 21 nt, Human
aacuccagaaagugacaagcu

SEQ ID NO: 3249356 - RNA, 15 nt, Human
gugaacacaucagcu

SEQ ID NO: 3249357 - RNA, 14 nt, Human
aacucccuuucaac

SEQ ID NO: 3249358 - RNA, 13 nt, Human
aacucccuuucaa

SEQ ID NO: 3249359 - RNA, 18 nt, Human
aacucguuaauuuguagu

SEQ ID NO: 3249360 - RNA, 13 nt, Human
aacccaaauguuc

SEQ ID NO: 3249361 - RNA, 18 nt, Human
aacccaaauguucaucaa

SEQ ID NO: 3249362 - RNA, 20 nt, Human
aacccauauuuguacaccaa

SEQ ID NO: 3249363 - RNA, 17 nt, Human
aaccuagggugauauua

SEQ ID NO: 3249364 - RNA, 20 nt, Human
aaccuagggugauauuaacc

SEQ ID NO: 3249365 - RNA, 17 nt, Human
aaccucaaaaugucuaa

SEQ ID NO: 3249366 - RNA, 22 nt, Human
aacaguagugauaguuguaccg

SEQ ID NO: 3249367 - RNA, 18 nt, Human
aacauuugguaaggggaa

SEQ ID NO: 3249368 - RNA, 21 nt, Human
aacaagccuccuuuuaaagua

SEQ ID NO: 3249369 - RNA, 15 nt, Human
aacaaggaugaauua

SEQ ID NO: 3249370 - RNA, 18 nt, Human
aacaaugaagauaaaaag

SEQ ID NO: 3249371 - RNA, 14 nt, Human
aacaaugaagauaa

SEQ ID NO: 3249372 - RNA, 24 nt, Human
guccaagcauaccaacacgagcag

SEQ ID NO: 3249373 - RNA, 21 nt, Human
guccaagcauuuagauguaua

SEQ ID NO: 3249374 - RNA, 15 nt, Human
agagacagaaagcag

SEQ ID NO: 3249375 - RNA, 24 nt, Human
agagacagaaagcagaacagugau

SEQ ID NO: 3249376 - RNA, 23 nt, Human
agacuauucaaacagucucagga

SEQ ID NO: 3249377 - RNA, 15 nt, Human
ucuuauuucauuucu

SEQ ID NO: 3249378 - RNA, 16 nt, Human
ucuuauuucauuucuu

SEQ ID NO: 3249379 - RNA, 23 nt, Human
ucuuagaugcaguucugaagaag

SEQ ID NO: 3249380 - RNA, 22 nt, Human
ucuuagaugcaguucugaagaa

SEQ ID NO: 3249381 - RNA, 17 nt, Human
agacacacugaagaagc

SEQ ID NO: 3249382 - RNA, 16 nt, Human
agacacacugaagaag

SEQ ID NO: 3249383 - RNA, 15 nt, Human
agacacacaugaagu

SEQ ID NO: 3249384 - RNA, 19 nt, Human
agacacaacuauuuuucca

SEQ ID NO: 3249385 - RNA, 20 nt, Human
agacacaacuauuuuuccaa

SEQ ID NO: 3249386 - RNA, 23 nt, Human
agaauuaacacaugauccugcaa

SEQ ID NO: 3249387 - RNA, 16 nt, Human
agaguuuagcuggaaa

SEQ ID NO: 3249388 - RNA, 17 nt, Human
ugacauaaaaacaacuu

SEQ ID NO: 3249389 - RNA, 20 nt, Human
ugacauaaaaacaacuuuau

SEQ ID NO: 3249390 - RNA, 18 nt, Human
ugacauaaaaacaacuuu

SEQ ID NO: 3249391 - RNA, 17 nt, Human
ugacccacaagaaauga

SEQ ID NO: 3249392 - RNA, 14 nt, Human
agaugcuagaacuc

SEQ ID NO: 3249393 - RNA, 18 nt, Human
agaugcaguucugaagaa

SEQ ID NO: 3249394 - RNA, 19 nt, Human
agaugcaguucugaagaag

SEQ ID NO: 3249395 - RNA, 17 nt, Human
agaugcaguucugaaga

SEQ ID NO: 3249396 - RNA, 14 nt, Human
agagcaaaauugau

SEQ ID NO: 3249397 - RNA, 23 nt, Human
ugaaauaagccagacaucaacag

SEQ ID NO: 3249398 - RNA, 20 nt, Human
ugaaauaagccagacaucaa

SEQ ID NO: 3249399 - RNA, 18 nt, Human
ugaaauaagccagacauc

SEQ ID NO: 3249400 - RNA, 17 nt, Human
ugaaauaagccagacau

SEQ ID NO: 3249401 - RNA, 14 nt, Human
ugaaauaagccaga

SEQ ID NO: 3249402 - RNA, 15 nt, Human
ugaaauuguauuaca

SEQ ID NO: 3249403 - RNA, 21 nt, Human
agagcuguucacagccagacu

SEQ ID NO: 3249404 - RNA, 19 nt, Human
agagcuguucacagccaga

SEQ ID NO: 3249405 - RNA, 18 nt, Human
ugaacaaauuuacagaga

SEQ ID NO: 3249406 - RNA, 20 nt, Human
ugaacaaauuuacagagaca

SEQ ID NO: 3249407 - RNA, 19 nt, Human
ugaacaaauuuacagagac

SEQ ID NO: 3249408 - RNA, 23 nt, Human
ugaacuagaguuuagcuggaaaa

SEQ ID NO: 3249409 - RNA, 15 nt, Human
agagguugcagugag

SEQ ID NO: 3249410 - RNA, 17 nt, Human
ucuaccaaaaaucucaa

SEQ ID NO: 3249411 - RNA, 22 nt, Human
ucuacauaaguaauucaagaaa

SEQ ID NO: 3249412 - RNA, 20 nt, Human
ucuaaagccauuguaguccu

SEQ ID NO: 3249413 - RNA, 21 nt, Human
ucuaaguaaaaccacagcagu

SEQ ID NO: 3249414 - RNA, 22 nt, Human
ucuaaguaaaaccacagcaguu

SEQ ID NO: 3249415 - RNA, 20 nt, Human
ucuaaguaaaaccacagcag

SEQ ID NO: 3249416 - RNA, 23 nt, Human
ucuaaguaaaaccacagcaguug

SEQ ID NO: 3249417 - RNA, 17 nt, Human
ucuacauaaguaauuca

SEQ ID NO: 3249418 - RNA, 20 nt, Human
ucuacauaaguaauucaaga

SEQ ID NO: 3249419 - RNA, 21 nt, Human
acugucagcuccccucggaga

SEQ ID NO: 3249420 - RNA, 18 nt, Human
acugggacaggggagaac

SEQ ID NO: 3249421 - RNA, 13 nt, Human
acuguggguagac

SEQ ID NO: 3249422 - RNA, 18 nt, Human
acuguggguagacacaca

SEQ ID NO: 3249423 - RNA, 22 nt, Human
ucggguuuuauuguuuaaaauc

SEQ ID NO: 3249424 - RNA, 13 nt, Human
acuggcacaguuu

SEQ ID NO: 3249425 - RNA, 19 nt, Human
acuggcacaguuuucugag

SEQ ID NO: 3249426 - RNA, 20 nt, Human
acuggcacaguuuucugaga

SEQ ID NO: 3249427 - RNA, 13 nt, Human
acugccuucucaa

SEQ ID NO: 3249428 - RNA, 19 nt, Human
acugccuucucaacuccaa

SEQ ID NO: 3249429 - RNA, 15 nt, Human
acugcauuauauuua

SEQ ID NO: 3249430 - RNA, 14 nt, Human
acugcauuauauuu

SEQ ID NO: 3249431 - RNA, 22 nt, Human
uccuuucuaacaaaaaaauaua

SEQ ID NO: 3249432 - RNA, 16 nt, Human
acuugucaauaaaauc

SEQ ID NO: 3249433 - RNA, 20 nt, Human
acuugaacccgggaggcaga

SEQ ID NO: 3249434 - RNA, 19 nt, Human
acuugaacccgggaggcag

SEQ ID NO: 3249435 - RNA, 21 nt, Human
acuugaacccauauuuguaca

SEQ ID NO: 3249436 - RNA, 21 nt, Human
acuucuaaguaaaaccacagc

SEQ ID NO: 3249437 - RNA, 23 nt, Human
acuucuaaguaaaaccacagcag

SEQ ID NO: 3249438 - RNA, 16 nt, Human
acuuguguuuugcaag

SEQ ID NO: 3249439 - RNA, 12 nt, Human
ucucuggccuuc

SEQ ID NO: 3249440 - RNA, 22 nt, Human
ucucuggccuucggccuccauc

SEQ ID NO: 3249441 - RNA, 21 nt, Human
ucucuggccuucggccuccau

SEQ ID NO: 3249442 - RNA, 23 nt, Human
agaaacuuaagguuaccuuuguu

SEQ ID NO: 3249443 - RNA, 12 nt, Human
ucugaagaagau

SEQ ID NO: 3249444 - RNA, 17 nt, Human
agaaaucaaagagagaa

SEQ ID NO: 3249445 - RNA, 14 nt, Human
ucugacuaugacau

SEQ ID NO: 3249446 - RNA, 16 nt, Human
ucugacuaugacauaa

SEQ ID NO: 3249447 - RNA, 14 nt, Human
ucccagucauuuaa

SEQ ID NO: 3249448 - RNA, 22 nt, Human
ucccagucauuuaauaaaugug

SEQ ID NO: 3249449 - RNA, 21 nt, Human
uccaugaagauguagaggaga

SEQ ID NO: 3249450 - RNA, 13 nt, Human
uccaugaagaugu

SEQ ID NO: 3249451 - RNA, 21 nt, Human
uccauccugaggcuccacuug

SEQ ID NO: 3249452 - RNA, 20 nt, Human
uccauccugaggcuccacuu

SEQ ID NO: 3249453 - RNA, 19 nt, Human
uccauccugaggcuccacu

SEQ ID NO: 3249454 - RNA, 17 nt, Human
uccccucggagaagagc

SEQ ID NO: 3249455 - RNA, 16 nt, Human
uccccucggagaagag

SEQ ID NO: 3249456 - RNA, 11 nt, Human
ucccugagcag

SEQ ID NO: 3249457 - RNA, 21 nt, Human
acuccaaacugacucuuaaga

SEQ ID NO: 3249458 - RNA, 19 nt, Human
ucccuuucugcuuguguua

SEQ ID NO: 3249459 - RNA, 14 nt, Human
acuccaaagaaaug

SEQ ID NO: 3249460 - RNA, 15 nt, Human
acuccaaagaaaugu

SEQ ID NO: 3249461 - RNA, 18 nt, Human
acuccaaagaaauguaag

SEQ ID NO: 3249462 - RNA, 18 nt, Human
acuccagaaagugacaag

SEQ ID NO: 3249463 - RNA, 16 nt, Human
ucaugaauuaguuuua

SEQ ID NO: 3249464 - RNA, 22 nt, Human
ucaggaaaucaaauaugcaaag

SEQ ID NO: 3249465 - RNA, 23 nt, Human
ucaggaaaucaaauaugcaaagc

SEQ ID NO: 3249466 - RNA, 21 nt, Human
accuagggugauauuaaccag

SEQ ID NO: 3249467 - RNA, 16 nt, Human
accuagggugauauua

SEQ ID NO: 3249468 - RNA, 16 nt, Human
accucaaaaugucuaa

SEQ ID NO: 3249469 - RNA, 19 nt, Human
accucaaaaugucuaagau

SEQ ID NO: 3249470 - RNA, 21 nt, Human
uccaacuaucucauuuccaag

SEQ ID NO: 3249471 - RNA, 19 nt, Human
acgagcaggcuacugucag

SEQ ID NO: 3249472 - RNA, 20 nt, Human
acgagcaggcuacugucagc

SEQ ID NO: 3249473 - RNA, 14 nt, Human
acgagaaaacaaua

SEQ ID NO: 3249474 - RNA, 17 nt, Human
ucacuaccuucaugcau

SEQ ID NO: 3249475 - RNA, 15 nt, Human
accaaucaugaauua

SEQ ID NO: 3249476 - RNA, 13 nt, Human
accaaucaugaau

SEQ ID NO: 3249477 - RNA, 20 nt, Human
ucaauuuuucuuauuucauu

SEQ ID NO: 3249478 - RNA, 23 nt, Human
ucaauuuuucuuauuucauuucu

SEQ ID NO: 3249479 - RNA, 15 nt, Human
ucaauucuugccaaa

SEQ ID NO: 3249480 - RNA, 14 nt, Human
ucacauaucuagua

SEQ ID NO: 3249481 - RNA, 22 nt, Human
ucacauaucuaguaugaaauua

SEQ ID NO: 3249482 - RNA, 21 nt, Human
ucacauaucuaguaugaaauu

SEQ ID NO: 3249483 - RNA, 17 nt, Human
ucacauaucuaguauga

SEQ ID NO: 3249484 - RNA, 20 nt, Human
ucaggaaaucaaauaugcaa

SEQ ID NO: 3249485 - RNA, 21 nt, Human
ucaggaaaucaaauaugcaaa

SEQ ID NO: 3249486 - RNA, 19 nt, Human
ucaggaaagagaacuucca

SEQ ID NO: 3249487 - RNA, 13 nt, Human
ucaggaaagagaa

SEQ ID NO: 3249488 - RNA, 23 nt, Human
accauuucuugagguaaaagcau

SEQ ID NO: 3249489 - RNA, 16 nt, Human
acaguuuucugagaaa

SEQ ID NO: 3249490 - RNA, 17 nt, Human
acaguuuucugagaaag

SEQ ID NO: 3249491 - RNA, 15 nt, Human
acaguuuucugagaa

SEQ ID NO: 3249492 - RNA, 18 nt, Human
acaguuuucugagaaaga

SEQ ID NO: 3249493 - RNA, 19 nt, Human
acaguuuucugagaaagac

SEQ ID NO: 3249494 - RNA, 20 nt, Human
acaguuuucugagaaagacu

SEQ ID NO: 3249495 - RNA, 21 nt, Human
acaguuuucugagaaagacua

SEQ ID NO: 3249496 - RNA, 21 nt, Human
acauaaaaacaacuuuauacc

SEQ ID NO: 3249497 - RNA, 19 nt, Human
acauaaaaacaacuuuaua

SEQ ID NO: 3249498 - RNA, 16 nt, Human
acauaaaaacaacuuu

SEQ ID NO: 3249499 - RNA, 13 nt, Human
uauuucauuucuu

SEQ ID NO: 3249500 - RNA, 21 nt, Human
uauuuccauuaaaaaaucagu

SEQ ID NO: 3249501 - RNA, 13 nt, Human
acaucaacagaua

SEQ ID NO: 3249502 - RNA, 19 nt, Human
acauauauaacaaugcugu

SEQ ID NO: 3249503 - RNA, 18 nt, Human
acauagaauuaacacaug

SEQ ID NO: 3249504 - RNA, 14 nt, Human
acauagaauuaaca

SEQ ID NO: 3249505 - RNA, 17 nt, Human
acauaucuaguaugaaa

SEQ ID NO: 3249506 - RNA, 23 nt, Human
acauaucuaguaugaaauuauau

SEQ ID NO: 3249507 - RNA, 22 nt, Human
acauaucuaguaugaaauuaua

SEQ ID NO: 3249508 - RNA, 20 nt, Human
acauaucuaguaugaaauua

SEQ ID NO: 3249509 - RNA, 17 nt, Human
ucaagaaaacaacuuca

SEQ ID NO: 3249510 - RNA, 22 nt, Human
ucaagaugaugaugaucuuuaa

SEQ ID NO: 3249511 - RNA, 19 nt, Human
acaugauccugcaauucca

SEQ ID NO: 3249512 - RNA, 14 nt, Human
ucaaagcugaaaug

SEQ ID NO: 3249513 - RNA, 17 nt, Human
ucaaagggugaaaauua

SEQ ID NO: 3249514 - RNA, 23 nt, Human
ucaaaauaccaugccauuuaaag

SEQ ID NO: 3249515 - RNA, 21 nt, Human
ucaaaauaugccccauucaac

SEQ ID NO: 3249516 - RNA, 21 nt, Human
ucaaaauaccaugccauuuaa

SEQ ID NO: 3249517 - RNA, 14 nt, Human
ucaaaaugucuaag

SEQ ID NO: 3249518 - RNA, 18 nt, Human
ucaaaagaaagaaaauca

SEQ ID NO: 3249519 - RNA, 13 nt, Human
ucaaaacugcacu

SEQ ID NO: 3249520 - RNA, 23 nt, Human
uauuuuugacagaauauguuuca

SEQ ID NO: 3249521 - RNA, 19 nt, Human
uauuuuugacagaauaugu

SEQ ID NO: 3249522 - RNA, 13 nt, Human
uauuuuugacaga

SEQ ID NO: 3249523 - RNA, 15 nt, Human
uauuuuugacagaau

SEQ ID NO: 3249524 - RNA, 14 nt, Human
uauuuuugacagaa

SEQ ID NO: 3249525 - RNA, 14 nt, Human
uguuccuagugaaa

SEQ ID NO: 3249526 - RNA, 14 nt, Human
agugugucuaaauu

SEQ ID NO: 3249527 - RNA, 12 nt, Human
uguuauaaucuu

SEQ ID NO: 3249528 - RNA, 15 nt, Human
uguuauaaucuuuca

SEQ ID NO: 3249529 - RNA, 17 nt, Human
aguguacuuaacuauuc

SEQ ID NO: 3249530 - RNA, 20 nt, Human
uguggucacaggaaguagag

SEQ ID NO: 3249531 - RNA, 13 nt, Human
uguguaaguagau

SEQ ID NO: 3249532 - RNA, 15 nt, Human
uguuaaguaugugua

SEQ ID NO: 3249533 - RNA, 16 nt, Human
uguuaaguauguguaa

SEQ ID NO: 3249534 - RNA, 19 nt, Human
uguguuaaguauguguaaa

SEQ ID NO: 3249535 - RNA, 16 nt, Human
agugaacaaauuuaca

SEQ ID NO: 3249536 - RNA, 15 nt, Human
agugaaagaaaauaa

SEQ ID NO: 3249537 - RNA, 14 nt, Human
ugugauguauucua

SEQ ID NO: 3249538 - RNA, 18 nt, Human
agucacuaccuucaugca

SEQ ID NO: 3249539 - RNA, 20 nt, Human
agugaaacucguuaauuugu

SEQ ID NO: 3249540 - RNA, 18 nt, Human
agucuuucacauuuaaau

SEQ ID NO: 3249541 - RNA, 16 nt, Human
agucucaggaaaucaa

SEQ ID NO: 3249542 - RNA, 22 nt, Human
agucucaggaaaucaaauaugc

SEQ ID NO: 3249543 - RNA, 19 nt, Human
ugugagaugcuagaacucc

SEQ ID NO: 3249544 - RNA, 15 nt, Human
ugugagaugcuagaa

SEQ ID NO: 3249545 - RNA, 18 nt, Human
auaaaauccauacauuug

SEQ ID NO: 3249546 - RNA, 19 nt, Human
auaaaauccauacauuugu

SEQ ID NO: 3249547 - RNA, 15 nt, Human
auaaaauaauuuuua

SEQ ID NO: 3249548 - RNA, 16 nt, Human
auaaaauaauuuuuau

SEQ ID NO: 3249549 - RNA, 21 nt, Human
auaaaauaauuuuuauauuug

SEQ ID NO: 3249550 - RNA, 18 nt, Human
uuaaguaaugauaacugg

SEQ ID NO: 3249551 - RNA, 20 nt, Human
uuaagaagacugcauuauau

SEQ ID NO: 3249552 - RNA, 22 nt, Human
uuaagaagacugcauuauauuu

SEQ ID NO: 3249553 - RNA, 17 nt, Human
uuaauuccaauuauaug

SEQ ID NO: 3249554 - RNA, 14 nt, Human
uuaccuuacagaag

SEQ ID NO: 3249555 - RNA, 12 nt, Human
uuaccugggaaa

SEQ ID NO: 3249556 - RNA, 15 nt, Human
uuacuguaagaaaau

SEQ ID NO: 3249557 - RNA, 16 nt, Human
aguuuagcuggaaaag

SEQ ID NO: 3249558 - RNA, 14 nt, Human
uguuuauuuauaga

SEQ ID NO: 3249559 - RNA, 24 nt, Human
uguuuauuuauagaguguacuuaa

SEQ ID NO: 3249560 - RNA, 19 nt, Human
uguuuucauuaucucaaaa

SEQ ID NO: 3249561 - RNA, 19 nt, Human
uguuuugaaucucauaauu

SEQ ID NO: 3249562 - RNA, 16 nt, Human
aguucugaagaagaug

SEQ ID NO: 3249563 - RNA, 14 nt, Human
uguuuugcaagcca

SEQ ID NO: 3249564 - RNA, 16 nt, Human
aguucugcagauaaac

SEQ ID NO: 3249565 - RNA, 21 nt, Human
aguucugcagauaaacaguag

SEQ ID NO: 3249566 - RNA, 13 nt, Human
agggaaauuucag

SEQ ID NO: 3249567 - RNA, 22 nt, Human
agggaggacgcucucuggccuu

SEQ ID NO: 3249568 - RNA, 21 nt, Human
agggaggacgcucucuggccu

SEQ ID NO: 3249569 - RNA, 23 nt, Human
agggaggacgcucucuggccuuc

SEQ ID NO: 3249570 - RNA, 18 nt, Human
aggggagcaugggaagug

SEQ ID NO: 3249571 - RNA, 16 nt, Human
uguaaaggaauuuaaa

SEQ ID NO: 3249572 - RNA, 16 nt, Human
uguaaauaguauuuga

SEQ ID NO: 3249573 - RNA, 17 nt, Human
agucaccucauggaauu

SEQ ID NO: 3249574 - RNA, 14 nt, Human
agucaccucaugga

SEQ ID NO: 3249575 - RNA, 15 nt, Human
agucaccucauggaa

SEQ ID NO: 3249576 - RNA, 18 nt, Human
aguauuucuaugaaauau

SEQ ID NO: 3249577 - RNA, 17 nt, Human
aguauuucuaugaaaua

SEQ ID NO: 3249578 - RNA, 16 nt, Human
aguauuucuaugaaau

SEQ ID NO: 3249579 - RNA, 18 nt, Human
aguauuagaauaccacag

SEQ ID NO: 3249580 - RNA, 16 nt, Human
aguaguaauagagcaa

SEQ ID NO: 3249581 - RNA, 22 nt, Human
uguauucuagcuaauguaauaa

SEQ ID NO: 3249582 - RNA, 13 nt, Human
uguauuacaaauc

SEQ ID NO: 3249583 - RNA, 20 nt, Human
uguauucuagcuaauguaau

SEQ ID NO: 3249584 - RNA, 15 nt, Human
uguaucacaaaucuu

SEQ ID NO: 3249585 - RNA, 18 nt, Human
uguaucacaaaucuuaac

SEQ ID NO: 3249586 - RNA, 15 nt, Human
uguaguguuggagaa

SEQ ID NO: 3249587 - RNA, 14 nt, Human
uguaguguuggaga

SEQ ID NO: 3249588 - RNA, 13 nt, Human
aguaauagagcaa

SEQ ID NO: 3249589 - RNA, 14 nt, Human
aguaauagagcaaa

SEQ ID NO: 3249590 - RNA, 13 nt, Human
aguaaugauaacu

SEQ ID NO: 3249591 - RNA, 17 nt, Human
aguaaugauaacuggaa

SEQ ID NO: 3249592 - RNA, 18 nt, Human
aguaaugauaacuggaaa

SEQ ID NO: 3249593 - RNA, 20 nt, Human
aguaaugauaacuggaaacu

SEQ ID NO: 3249594 - RNA, 20 nt, Human
aguaaaaccacagcaguuga

SEQ ID NO: 3249595 - RNA, 13 nt, Human
aguaaaauccaca

SEQ ID NO: 3249596 - RNA, 20 nt, Human
aggcauuuaggccaugggac

SEQ ID NO: 3249597 - RNA, 15 nt, Human
aggcagcuugaaacu

SEQ ID NO: 3249598 - RNA, 20 nt, Human
aggcagcucuaaaugucaau

SEQ ID NO: 3249599 - RNA, 14 nt, Human
uggagcucguggaa

SEQ ID NO: 3249600 - RNA, 17 nt, Human
uggagcucguggaacag

SEQ ID NO: 3249601 - RNA, 21 nt, Human
uggagcucguggaacaguuac

SEQ ID NO: 3249602 - RNA, 15 nt, Human
uggagcaaagcugau

SEQ ID NO: 3249603 - RNA, 15 nt, Human
aggcccccaggugcc

SEQ ID NO: 3249604 - RNA, 14 nt, Human
uggaguugaaaauc

SEQ ID NO: 3249605 - RNA, 20 nt, Human
aggacgcucucuggccuucg

SEQ ID NO: 3249606 - RNA, 19 nt, Human
aggacgcucucuggccuuc

SEQ ID NO: 3249607 - RNA, 17 nt, Human
aggacgcucucuggccu

SEQ ID NO: 3249608 - RNA, 16 nt, Human
aggacgcucucuggcc

SEQ ID NO: 3249609 - RNA, 14 nt, Human
aggacgcucucugg

SEQ ID NO: 3249610 - RNA, 13 nt, Human
aggacgcucucug

SEQ ID NO: 3249611 - RNA, 17 nt, Human
aggagaaacuggaacuc

SEQ ID NO: 3249612 - RNA, 19 nt, Human
aggagaaacuggaacucuc

SEQ ID NO: 3249613 - RNA, 18 nt, Human
aggagaaacuggaacucu

SEQ ID NO: 3249614 - RNA, 17 nt, Human
aggagaguagaacagau

SEQ ID NO: 3249615 - RNA, 20 nt, Human
agcuugcccuggugccucac

SEQ ID NO: 3249616 - RNA, 16 nt, Human
agcuugcccuguuaaa

SEQ ID NO: 3249617 - RNA, 18 nt, Human
agcuugcccuguuaaaag

SEQ ID NO: 3249618 - RNA, 19 nt, Human
agcuugcccuguuaaaaga

SEQ ID NO: 3249619 - RNA, 14 nt, Human
ugcuacaaaaacac

SEQ ID NO: 3249620 - RNA, 17 nt, Human
ugccuuuucccaacucc

SEQ ID NO: 3249621 - RNA, 19 nt, Human
ugccuuuucccaacuccag

SEQ ID NO: 3249622 - RNA, 21 nt, Human
aggaaaucaaauaugcaaagc

SEQ ID NO: 3249623 - RNA, 22 nt, Human
aggaaaucaaauaugcaaagca

SEQ ID NO: 3249624 - RNA, 20 nt, Human
aggaaaucaaauaugcaaag

SEQ ID NO: 3249625 - RNA, 19 nt, Human
aggaaaucaaauaugcaaa

SEQ ID NO: 3249626 - RNA, 20 nt, Human
ugcccuguuaaaagaugaaa

SEQ ID NO: 3249627 - RNA, 19 nt, Human
ugcccuguuaaaagaugaa

SEQ ID NO: 3249628 - RNA, 13 nt, Human
ugauuucauucaa

SEQ ID NO: 3249629 - RNA, 20 nt, Human
ugcaaagcacugacuucuaa

SEQ ID NO: 3249630 - RNA, 22 nt, Human
ugcaaagcacugacuucuaagu

SEQ ID NO: 3249631 - RNA, 18 nt, Human
ugcaaagcacugacuucu

SEQ ID NO: 3249632 - RNA, 15 nt, Human
ugcaagccagauuuu

SEQ ID NO: 3249633 - RNA, 21 nt, Human
ugcaagccagauuuuccugaa

SEQ ID NO: 3249634 - RNA, 17 nt, Human
ugcacuccagccugagc

SEQ ID NO: 3249635 - RNA, 22 nt, Human
ugcagaagacaguauggcagcu

SEQ ID NO: 3249636 - RNA, 15 nt, Human
ugcacuccagccuga

SEQ ID NO: 3249637 - RNA, 13 nt, Human
ugccauaauuacu

SEQ ID NO: 3249638 - RNA, 17 nt, Human
ugccaguuauggcuaua

SEQ ID NO: 3249639 - RNA, 19 nt, Human
agccugagcgacagugaga

SEQ ID NO: 3249640 - RNA, 13 nt, Human
ugcauacucauua

SEQ ID NO: 3249641 - RNA, 19 nt, Human
ugcauacucauuaggaugg

SEQ ID NO: 3249642 - RNA, 20 nt, Human
ugcauagauucccugagcag

SEQ ID NO: 3249643 - RNA, 19 nt, Human
agcauaccaacacgagcag

SEQ ID NO: 3249644 - RNA, 13 nt, Human
agcauaccaacac

SEQ ID NO: 3249645 - RNA, 19 nt, Human
agcagucaggaaagagaac

SEQ ID NO: 3249646 - RNA, 17 nt, Human
agcagucaggaaagaga

SEQ ID NO: 3249647 - RNA, 18 nt, Human
agcagucaggaaagagaa

SEQ ID NO: 3249648 - RNA, 18 nt, Human
ugagugucuuaauuaaaa

SEQ ID NO: 3249649 - RNA, 15 nt, Human
ugaguucuacauaag

SEQ ID NO: 3249650 - RNA, 20 nt, Human
ugaguucuacauaaguaauu

SEQ ID NO: 3249651 - RNA, 16 nt, Human
ugauaaguaaaugcua

SEQ ID NO: 3249652 - RNA, 12 nt, Human
ugauaaguaaau

SEQ ID NO: 3249653 - RNA, 19 nt, Human
ugauaaguucauacauugu

SEQ ID NO: 3249654 - RNA, 17 nt, Human
ugauaaguucauacauu

SEQ ID NO: 3249655 - RNA, 15 nt, Human
ugauaaguucauaca

SEQ ID NO: 3249656 - RNA, 13 nt, Human
ugauaaguucaua

SEQ ID NO: 3249657 - RNA, 16 nt, Human
agcaggcuacugucag

SEQ ID NO: 3249658 - RNA, 17 nt, Human
agcaggcuacugucagc

SEQ ID NO: 3249659 - RNA, 19 nt, Human
agcaggcuacugucagcuc

SEQ ID NO: 3249660 - RNA, 20 nt, Human
agcaggcuacugucagcucc

SEQ ID NO: 3249661 - RNA, 14 nt, Human
agcaggcuacuguc

SEQ ID NO: 3249662 - RNA, 19 nt, Human
agcagggcauggcugggaa

SEQ ID NO: 3249663 - RNA, 22 nt, Human
agcauuuagauguauagguuga

SEQ ID NO: 3249664 - RNA, 20 nt, Human
agcaucacaugaacuuguaa

SEQ ID NO: 3249665 - RNA, 17 nt, Human
ugaugaucuuuaaaaua

SEQ ID NO: 3249666 - RNA, 15 nt, Human
ugauuaaguaaugau

SEQ ID NO: 3249667 - RNA, 19 nt, Human
auugauguguuuauuuaua

SEQ ID NO: 3249668 - RNA, 12 nt, Human
auugauguguuu

SEQ ID NO: 3249669 - RNA, 17 nt, Human
auuguacgaagaguauu

SEQ ID NO: 3249670 - RNA, 16 nt, Human
auuggagcucguggaa

SEQ ID NO: 3249671 - RNA, 17 nt, Human
auuggagcucgugggac

SEQ ID NO: 3249672 - RNA, 13 nt, Human
auuugaauguuaa

SEQ ID NO: 3249673 - RNA, 18 nt, Human
auuugaauguuaagcaga

SEQ ID NO: 3249674 - RNA, 20 nt, Human
auuucuugagguaaaagcau

SEQ ID NO: 3249675 - RNA, 19 nt, Human
auuugaauguuaagcagau

SEQ ID NO: 3249676 - RNA, 21 nt, Human
auuuggagacacaacuauuuu

SEQ ID NO: 3249677 - RNA, 19 nt, Human
auuuauuacuguaagaaaa

SEQ ID NO: 3249678 - RNA, 21 nt, Human
auuuauuuuaauaauguuuca

SEQ ID NO: 3249679 - RNA, 17 nt, Human
auuuaaaaaaaaaccug

SEQ ID NO: 3249680 - RNA, 16 nt, Human
auuguaguccuguaau

SEQ ID NO: 3249681 - RNA, 15 nt, Human
auuuaccacuugugu

SEQ ID NO: 3249682 - RNA, 22 nt, Human
auuuaccacuuguguuuugcaa

SEQ ID NO: 3249683 - RNA, 15 nt, Human
auuacuguaagaaaa

SEQ ID NO: 3249684 - RNA, 16 nt, Human
auuacuguaagaaaau

SEQ ID NO: 3249685 - RNA, 14 nt, Human
uuuugugaagcaaa

SEQ ID NO: 3249686 - RNA, 15 nt, Human
uuuuguuuucauuau

SEQ ID NO: 3249687 - RNA, 15 nt, Human
uuuuugaagcuguau

SEQ ID NO: 3249688 - RNA, 13 nt, Human
uuuuugacagaau

SEQ ID NO: 3249689 - RNA, 12 nt, Human
uuuuugacagaa

SEQ ID NO: 3249690 - RNA, 21 nt, Human
uuuuuguagcacugacagauu

SEQ ID NO: 3249691 - RNA, 20 nt, Human
uuuuuguagcacugacagau

SEQ ID NO: 3249692 - RNA, 19 nt, Human
uuuuuguagcacugacaga

SEQ ID NO: 3249693 - RNA, 17 nt, Human
uuuuuguagcacugaca

SEQ ID NO: 3249694 - RNA, 20 nt, Human
auucaaacagucucaggaaa

SEQ ID NO: 3249695 - RNA, 22 nt, Human
auucaaacagucucaggaaauc

SEQ ID NO: 3249696 - RNA, 21 nt, Human
auuauuuuguucauacauauu

SEQ ID NO: 3249697 - RNA, 20 nt, Human
auuauauggcuugaguuuaa

SEQ ID NO: 3249698 - RNA, 17 nt, Human
auuccaagugauugaaa

SEQ ID NO: 3249699 - RNA, 21 nt, Human
auucaggagaguagaacagau

SEQ ID NO: 3249700 - RNA, 22 nt, Human
auucaggagaguagaacagaua

SEQ ID NO: 3249701 - RNA, 16 nt, Human
uuuucucuaggaaaua

SEQ ID NO: 3249702 - RNA, 20 nt, Human
uuuucaggcuagauguaugu

SEQ ID NO: 3249703 - RNA, 15 nt, Human
uuuuccaaaauaauu

SEQ ID NO: 3249704 - RNA, 22 nt, Human
uuuuauggcacuaguauuucua

SEQ ID NO: 3249705 - RNA, 20 nt, Human
augugcuaguaauuggaaag

SEQ ID NO: 3249706 - RNA, 21 nt, Human
augugcuaguaauuggaaagg

SEQ ID NO: 3249707 - RNA, 12 nt, Human
auguguuuccau

SEQ ID NO: 3249708 - RNA, 12 nt, Human
auguuaagcaga

SEQ ID NO: 3249709 - RNA, 20 nt, Human
uuugcuggagcucugcccau

SEQ ID NO: 3249710 - RNA, 20 nt, Human
uuugacagaauauguuucaa

SEQ ID NO: 3249711 - RNA, 19 nt, Human
uuugacagaauauguuuca

SEQ ID NO: 3249712 - RNA, 18 nt, Human
uuugacagaauauguuuc

SEQ ID NO: 3249713 - RNA, 13 nt, Human
uuugagaguucua

SEQ ID NO: 3249714 - RNA, 19 nt, Human
auguauauuuuauaucaau

SEQ ID NO: 3249715 - RNA, 23 nt, Human
augucgucaaagcugaaauggac

SEQ ID NO: 3249716 - RNA, 17 nt, Human
auagucaaauuguguga

SEQ ID NO: 3249717 - RNA, 18 nt, Human
auagucaaauugugugaa

SEQ ID NO: 3249718 - RNA, 14 nt, Human
auauauaacaaugc

SEQ ID NO: 3249719 - RNA, 17 nt, Human
auauauaacaaugcugu

SEQ ID NO: 3249720 - RNA, 18 nt, Human
auauauaacaaugcugua

SEQ ID NO: 3249721 - RNA, 12 nt, Human
auauaacaaugc

SEQ ID NO: 3249722 - RNA, 15 nt, Human
auauaacaaugcugu

SEQ ID NO: 3249723 - RNA, 17 nt, Human
auauaaguauucuaaau

SEQ ID NO: 3249724 - RNA, 19 nt, Human
auauaagcuuguauuccuu

SEQ ID NO: 3249725 - RNA, 21 nt, Human
uucagaaaauauuauguguuu

SEQ ID NO: 3249726 - RNA, 13 nt, Human
uucagaaaauauu

SEQ ID NO: 3249727 - RNA, 14 nt, Human
uucagaaaauauua

SEQ ID NO: 3249728 - RNA, 20 nt, Human
uucagaaaauauuauguguu

SEQ ID NO: 3249729 - RNA, 16 nt, Human
auaugcaaagcacuga

SEQ ID NO: 3249730 - RNA, 15 nt, Human
auaugcaaagcacug

SEQ ID NO: 3249731 - RNA, 23 nt, Human
auaugcaaagcacugacuucuaa

SEQ ID NO: 3249732 - RNA, 14 nt, Human
uucaaacauauaua

SEQ ID NO: 3249733 - RNA, 15 nt, Human
uucaaacauauauaa

SEQ ID NO: 3249734 - RNA, 16 nt, Human
uucaaacuuuggaaca

SEQ ID NO: 3249735 - RNA, 22 nt, Human
uucaagaaaacaacuucaauau

SEQ ID NO: 3249736 - RNA, 21 nt, Human
auaggaauugacccacaagaa

SEQ ID NO: 3249737 - RNA, 21 nt, Human
uucacauaucuaguaugaaau

SEQ ID NO: 3249738 - RNA, 20 nt, Human
uucacauaucuaguaugaaa

SEQ ID NO: 3249739 - RNA, 17 nt, Human
uuauuguuuaaaaucau

SEQ ID NO: 3249740 - RNA, 17 nt, Human
auagcuacuaauuuuaa

SEQ ID NO: 3249741 - RNA, 14 nt, Human
auagcuacuaauuu

SEQ ID NO: 3249742 - RNA, 18 nt, Human
auagcuacuaauuuuaaa

SEQ ID NO: 3249743 - RNA, 19 nt, Human
aucaauuuuucuuauuuca

SEQ ID NO: 3249744 - RNA, 17 nt, Human
auauguuucaaacuuug

SEQ ID NO: 3249745 - RNA, 13 nt, Human
auauuugaaauau

SEQ ID NO: 3249746 - RNA, 18 nt, Human
auauuguguugugaaugu

SEQ ID NO: 3249747 - RNA, 17 nt, Human
auauuguguugugaaug

SEQ ID NO: 3249748 - RNA, 12 nt, Human
auauuuuaacuu

SEQ ID NO: 3249749 - RNA, 22 nt, Human
auauuuguaucacaaaucuuaa

SEQ ID NO: 3249750 - RNA, 23 nt, Human
auauuugaaauauugacuuuuua

SEQ ID NO: 3249751 - RNA, 14 nt, Human
auauuugaaauauu

SEQ ID NO: 3249752 - RNA, 19 nt, Human
auauuugaaauauugacuu

SEQ ID NO: 3249753 - RNA, 12 nt, Human
uucugaagaaga

SEQ ID NO: 3249754 - RNA, 13 nt, Human
uucugaagaagau

SEQ ID NO: 3249755 - RNA, 23 nt, Human
uucugcaucagcugcugaaacaa

SEQ ID NO: 3249756 - RNA, 16 nt, Human
uucugcaucagcugcu

SEQ ID NO: 3249757 - RNA, 20 nt, Human
aucauuucugcaucagcugc

SEQ ID NO: 3249758 - RNA, 14 nt, Human
uucucaacuccaaa

SEQ ID NO: 3249759 - RNA, 18 nt, Human
uucucaacuccaaacuga

SEQ ID NO: 3249760 - RNA, 19 nt, Human
aucagugugucuaaauuug

SEQ ID NO: 3249761 - RNA, 19 nt, Human
aucucaaaacugcacuguc

SEQ ID NO: 3249762 - RNA, 20 nt, Human
aucucaaaacugcacuguca

SEQ ID NO: 3249763 - RNA, 15 nt, Human
aucucaaaacugcac

SEQ ID NO: 3249764 - RNA, 12 nt, Human
uugacuuuuuau

SEQ ID NO: 3249765 - RNA, 13 nt, Human
uugacaugggaca

SEQ ID NO: 3249766 - RNA, 20 nt, Human
uugauguguuuauuuauaga

SEQ ID NO: 3249767 - RNA, 17 nt, Human
aucugacuaugacauaa

SEQ ID NO: 3249768 - RNA, 14 nt, Human
aucugacuaugaca

SEQ ID NO: 3249769 - RNA, 18 nt, Human
augaacuuguaaaggaau

SEQ ID NO: 3249770 - RNA, 12 nt, Human
aucuuuaaaaua

SEQ ID NO: 3249771 - RNA, 15 nt, Human
aucuuuaaaauacac

SEQ ID NO: 3249772 - RNA, 15 nt, Human
uuggagaagaacuga

SEQ ID NO: 3249773 - RNA, 17 nt, Human
uuggagaagaacugaaa

SEQ ID NO: 3249774 - RNA, 22 nt, Human
uuggagaagaacugaaaucaua

SEQ ID NO: 3249775 - RNA, 15 nt, Human
aucuuauaauuuaaa

SEQ ID NO: 3249776 - RNA, 14 nt, Human
aucuuauaauuuaa

SEQ ID NO: 3249777 - RNA, 19 nt, Human
augcuguauuuuaaaagaa

SEQ ID NO: 3249778 - RNA, 22 nt, Human
augcuguauuuuaaaagaauga

SEQ ID NO: 3249779 - RNA, 23 nt, Human
augcuguauuuuaaaagaaugau

SEQ ID NO: 3249780 - RNA, 21 nt, Human
auggaaugcuguguuaaauaa

SEQ ID NO: 3249781 - RNA, 17 nt, Human
auggaaugcuguguuaa

SEQ ID NO: 3249782 - RNA, 17 nt, Human
uuucaaacauauauaac

SEQ ID NO: 3249783 - RNA, 22 nt, Human
uuucacauaucuaguaugaaau

SEQ ID NO: 3249784 - RNA, 21 nt, Human
uuucacauaucuaguaugaaa

SEQ ID NO: 3249785 - RNA, 19 nt, Human
uuucaaacauauauaacaa

SEQ ID NO: 3249786 - RNA, 19 nt, Human
uuuauaugcuucuguuuua

SEQ ID NO: 3249787 - RNA, 21 nt, Human
uuuauaugcuucuguuuuaua

SEQ ID NO: 3249788 - RNA, 14 nt, Human
augccuuuucccaa

SEQ ID NO: 3249789 - RNA, 20 nt, Human
augccuuuucccaacuccag

SEQ ID NO: 3249790 - RNA, 22 nt, Human
augccuuuucccaacuccagaa

SEQ ID NO: 3249791 - RNA, 18 nt, Human
augcuacaggauuugaaa

SEQ ID NO: 3249792 - RNA, 18 nt, Human
uuuaaauauaugcuaagu

SEQ ID NO: 3249793 - RNA, 21 nt, Human
uuuaaauauaugcuaagucuu

SEQ ID NO: 3249794 - RNA, 12 nt, Human
augcaaagcacu

SEQ ID NO: 3249795 - RNA, 13 nt, Human
augcaaagcacug

SEQ ID NO: 3249796 - RNA, 14 nt, Human
augcaaagcacuga

SEQ ID NO: 3249797 - RNA, 18 nt, Human
uuuaaaaaaauuccaagu

SEQ ID NO: 3249798 - RNA, 13 nt, Human
augauuucauuca

SEQ ID NO: 3249799 - RNA, 18 nt, Human
uuguucauacauauuuuu

SEQ ID NO: 3249800 - RNA, 16 nt, Human
uuguucauacauauuu

SEQ ID NO: 3249801 - RNA, 18 nt, Human
augagguacugagaguga

SEQ ID NO: 3249802 - RNA, 17 nt, Human
augagguacugagagug

SEQ ID NO: 3249803 - RNA, 15 nt, Human
augagguacugagag

SEQ ID NO: 3249804 - RNA, 17 nt, Human
uuguagcuuuaucaaag

SEQ ID NO: 3249805 - RNA, 16 nt, Human
uuguagcuuuaucaaa

SEQ ID NO: 3249806 - RNA, 20 nt, Human
uugucaauaaaauccauaca

SEQ ID NO: 3249807 - RNA, 20 nt, Human
uuguucaauaauaaauauuu

SEQ ID NO: 3249808 - RNA, 22 nt, Human
uuguucaauaauaaauauuuuu

SEQ ID NO: 3249809 - RNA, 19 nt, Human
uuguucaauaauaaauauu

SEQ ID NO: 3249810 - RNA, 13 nt, Human
uuguucauacaua

SEQ ID NO: 3249811 - RNA, 14 nt, Human
aucaaaagaaagaa

SEQ ID NO: 3249812 - RNA, 18 nt, Human
aucaaagagagaaaauaa

SEQ ID NO: 3249813 - RNA, 20 nt, Human
aucaaagggugaaaauuauu

SEQ ID NO: 3249814 - RNA, 12 nt, Human
auccuugaagau

SEQ ID NO: 3249815 - RNA, 21 nt, Human
aucaugaauuaguuuuauaug

SEQ ID NO: 3249816 - RNA, 23 nt, Human
auggcuuccuggcaauagucaaa

SEQ ID NO: 3249817 - RNA, 14 nt, Human
augggaaagcauug

SEQ ID NO: 3249818 - RNA, 20 nt, Human
augggaaagcauuguaaaug

SEQ ID NO: 3249819 - RNA, 15 nt, Human
augggacagggagga

SEQ ID NO: 3249820 - RNA, 20 nt, Human
augggacauuugcucaugga

SEQ ID NO: 3249821 - RNA, 21 nt, Human
augcuucuguuuuauaauuuu

SEQ ID NO: 3249822 - RNA, 20 nt, Human
aguuguucaauaauaaauau

SEQ ID NO: 3249823 - RNA, 22 nt, Human
auaaaaauauuguguugugaau

SEQ ID NO: 3249824 - RNA, 23 nt, Human
auaaaaauauuguguugugaaug

SEQ ID NO: 3249825 - RNA, 15 nt, Human
auaaaagacagugaa

SEQ ID NO: 3249826 - RNA, 16 nt, Human
auaaaagacagugaaa

SEQ ID NO: 3249827 - RNA, 20 nt, Human
auaaaaagacauucuuccaa

SEQ ID NO: 3249828 - RNA, 14 nt, Human
auaaaaacaacuuu

SEQ ID NO: 3249829 - RNA, 20 nt, Human
auacacacucaaaucaagaa

SEQ ID NO: 3249830 - RNA, 17 nt, Human
auaaguaauucaagaaa

SEQ ID NO: 3249831 - RNA, 15 nt, Human
auaaguaaaugcuag

SEQ ID NO: 3249832 - RNA, 13 nt, Human
aguacucauacau

SEQ ID NO: 3249833 - RNA, 13 nt, Human
agucauuuaauaa

SEQ ID NO: 3249834 - RNA, 19 nt, Human
agugaugucacuagggcag

SEQ ID NO: 3249835 - RNA, 13 nt, Human
agugauuaccagg

SEQ ID NO: 3249836 - RNA, 13 nt, Human
agugaaugaaaca

SEQ ID NO: 3249837 - RNA, 13 nt, Human
agcuacaaaugca

SEQ ID NO: 3249838 - RNA, 12 nt, Human
agcuacaaaugc

SEQ ID NO: 3249839 - RNA, 15 nt, Human
agcgacagugagacu

SEQ ID NO: 3249840 - RNA, 13 nt, Human
agcgacagugaga

SEQ ID NO: 3249841 - RNA, 14 nt, Human
agcuguaugauucc

SEQ ID NO: 3249842 - RNA, 14 nt, Human
agcugcugaaacaa

SEQ ID NO: 3249843 - RNA, 15 nt, Human
agcugcugaaacaac

SEQ ID NO: 3249844 - RNA, 16 nt, Human
agcugcugaaacaaca

SEQ ID NO: 3249845 - RNA, 18 nt, Human
aggaaaaaauaacaauga

SEQ ID NO: 3249846 - RNA, 17 nt, Human
agcuguaugauucccag

SEQ ID NO: 3249847 - RNA, 18 nt, Human
agcuguaugauucccagc

SEQ ID NO: 3249848 - RNA, 20 nt, Human
aggcagagguugcagugagc

SEQ ID NO: 3249849 - RNA, 23 nt, Human
aggccaugggcacuguggguaga

SEQ ID NO: 3249850 - RNA, 20 nt, Human
agggauuagggagagaagau

SEQ ID NO: 3249851 - RNA, 17 nt, Human
agggacaggauaagagg

SEQ ID NO: 3249852 - RNA, 17 nt, Human
aggcuagauguauguac

SEQ ID NO: 3249853 - RNA, 20 nt, Human
agauagauaggucagugcaa

SEQ ID NO: 3249854 - RNA, 13 nt, Human
agcaaaauugaug

SEQ ID NO: 3249855 - RNA, 19 nt, Human
agcaaaauugauguguuua

SEQ ID NO: 3249856 - RNA, 23 nt, Human
agcaaaauugauguguuuauuua

SEQ ID NO: 3249857 - RNA, 19 nt, Human
agcacugacuucuaaguaa

SEQ ID NO: 3249858 - RNA, 16 nt, Human
agcacugacuucuaag

SEQ ID NO: 3249859 - RNA, 17 nt, Human
agcacugacuucuaagu

SEQ ID NO: 3249860 - RNA, 22 nt, Human
agaacagugauuaccagggacu

SEQ ID NO: 3249861 - RNA, 19 nt, Human
agaacagauaaucagugug

SEQ ID NO: 3249862 - RNA, 18 nt, Human
agaagacugcauuauauu

SEQ ID NO: 3249863 - RNA, 21 nt, Human
agaagacugcauuauauuuau

SEQ ID NO: 3249864 - RNA, 13 nt, Human
agaagagcuguuc

SEQ ID NO: 3249865 - RNA, 20 nt, Human
agaagagcuguucacagcca

SEQ ID NO: 3249866 - RNA, 13 nt, Human
agaagauagcagg

SEQ ID NO: 3249867 - RNA, 19 nt, Human
agacaaggaaaaaauaaca

SEQ ID NO: 3249868 - RNA, 24 nt, Human
acaggaugguucccuugaugaaga

SEQ ID NO: 3249869 - RNA, 22 nt, Human
acaggaugguucccuugaugaa

SEQ ID NO: 3249870 - RNA, 19 nt, Human
acagugauuaccagggacu

SEQ ID NO: 3249871 - RNA, 15 nt, Human
acauuugcucaugga

SEQ ID NO: 3249872 - RNA, 14 nt, Human
acauuuguauaaaa

SEQ ID NO: 3249873 - RNA, 16 nt, Human
acauuuguauaaaaua

SEQ ID NO: 3249874 - RNA, 19 nt, Human
acauuuguauaaaauaauu

SEQ ID NO: 3249875 - RNA, 20 nt, Human
acauaaguaauucaagaaaa

SEQ ID NO: 3249876 - RNA, 21 nt, Human
acauaaguaauucaagaaaac

SEQ ID NO: 3249877 - RNA, 15 nt, Human
acaccaauauucaua

SEQ ID NO: 3249878 - RNA, 22 nt, Human
aauuucauaccuaucaucuuaa

SEQ ID NO: 3249879 - RNA, 11 nt, Human
aauuguaauag

SEQ ID NO: 3249880 - RNA, 16 nt, Human
aauuucauaugcugua

SEQ ID NO: 3249881 - RNA, 18 nt, Human
aauuucauaugcuguaua

SEQ ID NO: 3249882 - RNA, 15 nt, Human
aauuggagcucgugg

SEQ ID NO: 3249883 - RNA, 17 nt, Human
aauuauauaaguauucu

SEQ ID NO: 3249884 - RNA, 16 nt, Human
aauuauauaaguauuc

SEQ ID NO: 3249885 - RNA, 15 nt, Human
aauuauauaaguauu

SEQ ID NO: 3249886 - RNA, 14 nt, Human
acucccuuucaaca

SEQ ID NO: 3249887 - RNA, 14 nt, Human
acucguuaauuugu

SEQ ID NO: 3249888 - RNA, 19 nt, Human
acucguuaauuuguagugu

SEQ ID NO: 3249889 - RNA, 16 nt, Human
acugacagauuuccau

SEQ ID NO: 3249890 - RNA, 19 nt, Human
acugauaugggucuugaua

SEQ ID NO: 3249891 - RNA, 21 nt, Human
acuuaaaaaugguuuaaaugg

SEQ ID NO: 3249892 - RNA, 22 nt, Human
acuuaaaaaugguuuaaauggu

SEQ ID NO: 3249893 - RNA, 12 nt, Human
acuucagacaua

SEQ ID NO: 3249894 - RNA, 18 nt, Human
acuucaaauccuugaaga

SEQ ID NO: 3249895 - RNA, 17 nt, Human
acuucaaauccuugaag

SEQ ID NO: 3249896 - RNA, 21 nt, Human
acuucagacauagaauuaaca

SEQ ID NO: 3249897 - RNA, 17 nt, Human
acuguaaaauaauaacu

SEQ ID NO: 3249898 - RNA, 20 nt, Human
accucugccucagaaaacaa

SEQ ID NO: 3249899 - RNA, 21 nt, Human
acccugucucuacuaaaaaua

SEQ ID NO: 3249900 - RNA, 21 nt, Human
aagccuuggggcugaugcagu

SEQ ID NO: 3249901 - RNA, 20 nt, Human
aacgcaggcccccaggugcc

SEQ ID NO: 3249902 - RNA, 11 nt, Human
aagaacugaaa

SEQ ID NO: 3249903 - RNA, 12 nt, Human
aagaacugaaau

SEQ ID NO: 3249904 - RNA, 13 nt, Human
aagaacugaaauc

SEQ ID NO: 3249905 - RNA, 15 nt, Human
aagaacugaaaucau

SEQ ID NO: 3249906 - RNA, 15 nt, Human
aagaagacugcauua

SEQ ID NO: 3249907 - RNA, 21 nt, Human
aagacaaggaaaaaauaacaa

SEQ ID NO: 3249908 - RNA, 20 nt, Human
aagaagacugcauuauauuu

SEQ ID NO: 3249909 - RNA, 14 nt, Human
aagagagaaaauaa

SEQ ID NO: 3249910 - RNA, 16 nt, Human
aagaguaguaauagag

SEQ ID NO: 3249911 - RNA, 19 nt, Human
aagaguauuuuugacagaa

SEQ ID NO: 3249912 - RNA, 16 nt, Human
aaucucaauauuucag

SEQ ID NO: 3249913 - RNA, 19 nt, Human
aaacccuugccaugugcua

SEQ ID NO: 3249914 - RNA, 15 nt, Human
aaacugcacugucaa

SEQ ID NO: 3249915 - RNA, 15 nt, Human
aaagcauuguaaaug

SEQ ID NO: 3249916 - RNA, 17 nt, Human
aaagcauuguaaaugug

SEQ ID NO: 3249917 - RNA, 13 nt, Human
aaagccugcaauu

SEQ ID NO: 3249918 - RNA, 18 nt, Human
aaagccugcaauuucaua

SEQ ID NO: 3249919 - RNA, 11 nt, Human
aaaaucauuuc

SEQ ID NO: 3249920 - RNA, 12 nt, Human
aaaaucauuucu

SEQ ID NO: 3249921 - RNA, 10 nt, Human
aaaaucauuu

SEQ ID NO: 3249922 - RNA, 17 nt, Human
aaaagaaagaaaaucag

SEQ ID NO: 3249923 - RNA, 12 nt, Human
aaaagaauauuu

SEQ ID NO: 3249924 - RNA, 13 nt, Human
aaaagacuccaaa

SEQ ID NO: 3249925 - RNA, 11 nt, Human
aaaagaaugau

SEQ ID NO: 3249926 - RNA, 13 nt, Human
aaaagaauauuuu

SEQ ID NO: 3249927 - RNA, 20 nt, Human
aaaagacaaggaaaaaauaa

SEQ ID NO: 3249928 - RNA, 13 nt, Human
aaauguucaucaa

SEQ ID NO: 3249929 - RNA, 22 nt, Human
aaauguugacaugggacauuug

SEQ ID NO: 3249930 - RNA, 23 nt, Human
aaauguugacaugggacauuugc

SEQ ID NO: 3249931 - RNA, 21 nt, Human
aaauauuuauuuuaauaaugu

SEQ ID NO: 3249932 - RNA, 23 nt, Human
aaaucucaaauuuggauugcuaa

SEQ ID NO: 3249933 - RNA, 18 nt, Human
aaaucucaauauuucaga

SEQ ID NO: 3249934 - RNA, 20 nt, Human
cacaguuuucugagaaagac

SEQ ID NO: 3249935 - RNA, 16 nt, Human
cacaugaaguccaagc

SEQ ID NO: 3249936 - RNA, 17 nt, Human
cacaugaaguccaagca

SEQ ID NO: 3249937 - RNA, 20 nt, Human
cacaugaaguccaagcauuu

SEQ ID NO: 3249938 - RNA, 21 nt, Human
cacaguuuucugagaaagacu

SEQ ID NO: 3249939 - RNA, 22 nt, Human
cacaguuuucugagaaagacua

SEQ ID NO: 3249940 - RNA, 15 nt, Human
cacaggaaguagagg

SEQ ID NO: 3249941 - RNA, 23 nt, Human
cacaagaaaugaaagcagggacu

SEQ ID NO: 3249942 - RNA, 13 nt, Human
cacaagaaaugaa

SEQ ID NO: 3249943 - RNA, 21 nt, Human
cacaagaaaugaaagcaggga

SEQ ID NO: 3249944 - RNA, 15 nt, Human
cacaagaaaugaaag

SEQ ID NO: 3249945 - RNA, 23 nt, Human
caaauuuacagagacagaaagca

SEQ ID NO: 3249946 - RNA, 17 nt, Human
caaauuuacagagacag

SEQ ID NO: 3249947 - RNA, 16 nt, Human
caaauuuacagagaca

SEQ ID NO: 3249948 - RNA, 16 nt, Human
caagcauaccaacacg

SEQ ID NO: 3249949 - RNA, 21 nt, Human
caagcauaccaacacgagcag

SEQ ID NO: 3249950 - RNA, 16 nt, Human
caagcauuuagaugua

SEQ ID NO: 3249951 - RNA, 19 nt, Human
caagcauuuagauguauag

SEQ ID NO: 3249952 - RNA, 13 nt, Human
caagaaaugaaag

SEQ ID NO: 3249953 - RNA, 19 nt, Human
caagacugcacaucaaaau

SEQ ID NO: 3249954 - RNA, 16 nt, Human
auuuuaauaauguuuc

SEQ ID NO: 3249955 - RNA, 18 nt, Human
auuuuaauaauguuucaa

SEQ ID NO: 3249956 - RNA, 19 nt, Human
auuuuaauaauguuucaaa

SEQ ID NO: 3249957 - RNA, 14 nt, Human
caaagaaauguaag

SEQ ID NO: 3249958 - RNA, 22 nt, Human
ggcuugaguuuaaauuguaaua

SEQ ID NO: 3249959 - RNA, 14 nt, Human
gggaauugaggaca

SEQ ID NO: 3249960 - RNA, 21 nt, Human
ggugcuacaaaaacacagcaa

SEQ ID NO: 3249961 - RNA, 23 nt, Human
ggugcuacaaaaacacagcaagg

SEQ ID NO: 3249962 - RNA, 17 nt, Human
gguguuuuaaaaaaucu

SEQ ID NO: 3249963 - RNA, 21 nt, Human
ggaggacgcucucuggccuuc

SEQ ID NO: 3249964 - RNA, 20 nt, Human
ggaggacgcucucuggccuu

SEQ ID NO: 3249965 - RNA, 19 nt, Human
ggaggacgcucucuggccu

SEQ ID NO: 3249966 - RNA, 22 nt, Human
ggccaugggacagggaggacgc

SEQ ID NO: 3249967 - RNA, 22 nt, Human
gcuguauuuuaaaagaaugauu

SEQ ID NO: 3249968 - RNA, 18 nt, Human
gcuagauguauguacuuc

SEQ ID NO: 3249969 - RNA, 16 nt, Human
gcuagauguauguacu

SEQ ID NO: 3249970 - RNA, 17 nt, Human
ggaaauauuuauuuuaa

SEQ ID NO: 3249971 - RNA, 18 nt, Human
ggaaauauuuauuuuaau

SEQ ID NO: 3249972 - RNA, 12 nt, Human
ggaaauauuuau

SEQ ID NO: 3249973 - RNA, 13 nt, Human
ggaaauauuuauu

SEQ ID NO: 3249974 - RNA, 15 nt, Human
ggaaauauuuauuuu

SEQ ID NO: 3249975 - RNA, 17 nt, Human
gcuuuuaaaaaaaaaua

SEQ ID NO: 3249976 - RNA, 16 nt, Human
ggaaaaaauaacaaug

SEQ ID NO: 3249977 - RNA, 20 nt, Human
ggaaaaaauaacaaugaaag

SEQ ID NO: 3249978 - RNA, 14 nt, Human
gcuuuaucaaaggg

SEQ ID NO: 3249979 - RNA, 19 nt, Human
gcuugcccuggugccucac

SEQ ID NO: 3249980 - RNA, 17 nt, Human
gcuugcccuggugccuc

SEQ ID NO: 3249981 - RNA, 23 nt, Human
gcuguucacagccagacuggcac

SEQ ID NO: 3249982 - RNA, 15 nt, Human
gcuguucacagccag

SEQ ID NO: 3249983 - RNA, 16 nt, Human
gcuguucacagccaga

SEQ ID NO: 3249984 - RNA, 22 nt, Human
gccauuuaaagcuuauuaaaac

SEQ ID NO: 3249985 - RNA, 19 nt, Human
gccaugggacagggaggac

SEQ ID NO: 3249986 - RNA, 14 nt, Human
gccaugggacaggg

SEQ ID NO: 3249987 - RNA, 16 nt, Human
gcccacagcuguauga

SEQ ID NO: 3249988 - RNA, 22 nt, Human
gccacguucuuacuaguuuccc

SEQ ID NO: 3249989 - RNA, 19 nt, Human
gccccugcacuccagccug

SEQ ID NO: 3249990 - RNA, 17 nt, Human
gccccgugggguuccuc

SEQ ID NO: 3249991 - RNA, 22 nt, Human
gcgacagugagacucugucuca

SEQ ID NO: 3249992 - RNA, 18 nt, Human
gccuucggccuccauccu

SEQ ID NO: 3249993 - RNA, 18 nt, Human
gccuguaaucacagcuac

SEQ ID NO: 3249994 - RNA, 19 nt, Human
gcccuucuuuccacagaag

SEQ ID NO: 3249995 - RNA, 15 nt, Human
gcaggcuacugucag

SEQ ID NO: 3249996 - RNA, 18 nt, Human
gcauagauucccugagca

SEQ ID NO: 3249997 - RNA, 13 nt, Human
gcaguucugaaga

SEQ ID NO: 3249998 - RNA, 18 nt, Human
gcagauggaaugcugugu

SEQ ID NO: 3249999 - RNA, 14 nt, Human
gcagaagacaguau

SEQ ID NO: 3250000 - RNA, 15 nt, Human
gcacugucaagauga

SEQ ID NO: 3250001 - RNA, 18 nt, Human
gcacagccucuuagaugc

SEQ ID NO: 3250002 - RNA, 20 nt, Human
gcacagccucuuagaugcag

SEQ ID NO: 3250003 - RNA, 16 nt, Human
gaugcuagaacucccu

SEQ ID NO: 3250004 - RNA, 22 nt, Human
gauuaaguaaugauaacuggaa

SEQ ID NO: 3250005 - RNA, 14 nt, Human
gauuaaguaaugau

SEQ ID NO: 3250006 - RNA, 12 nt, Human
gcaagauguggg

SEQ ID NO: 3250007 - RNA, 16 nt, Human
gcaagaugugggcagu

SEQ ID NO: 3250008 - RNA, 13 nt, Human
gauccuggaaauc

SEQ ID NO: 3250009 - RNA, 14 nt, Human
gauccuggaaauca

SEQ ID NO: 3250010 - RNA, 23 nt, Human
gaucagcuuauugucuagugaaa

SEQ ID NO: 3250011 - RNA, 16 nt, Human
gauaaguucauacauu

SEQ ID NO: 3250012 - RNA, 22 nt, Human
gauaaauggcuuccuggcaaua

SEQ ID NO: 3250013 - RNA, 13 nt, Human
gauaaacaguagu

SEQ ID NO: 3250014 - RNA, 11 nt, Human
gaguucuacau

SEQ ID NO: 3250015 - RNA, 16 nt, Human
gaccacugcagaagac

SEQ ID NO: 3250016 - RNA, 19 nt, Human
gacccaaaaggcagaagca

SEQ ID NO: 3250017 - RNA, 18 nt, Human
gacccaaaaggcagaagc

SEQ ID NO: 3250018 - RNA, 23 nt, Human
gacaggaugguucccuugaugaa

SEQ ID NO: 3250019 - RNA, 14 nt, Human
gacaucaacagaua

SEQ ID NO: 3250020 - RNA, 17 nt, Human
gacauaaaaacaacuuu

SEQ ID NO: 3250021 - RNA, 18 nt, Human
gacuggcacaguuuucug

SEQ ID NO: 3250022 - RNA, 22 nt, Human
gacuggcacaguuuucugagaa

SEQ ID NO: 3250023 - RNA, 14 nt, Human
gacuggcacaguuu

SEQ ID NO: 3250024 - RNA, 24 nt, Human
gacugcauuauauuuauuacugua

SEQ ID NO: 3250025 - RNA, 16 nt, Human
gacugaggggagggga

SEQ ID NO: 3250026 - RNA, 15 nt, Human
gaacauaaaauacaa

SEQ ID NO: 3250027 - RNA, 20 nt, Human
gaacagugauuaccagggac

SEQ ID NO: 3250028 - RNA, 16 nt, Human
gaacagugauuaccag

SEQ ID NO: 3250029 - RNA, 18 nt, Human
gaacagauaaucagugug

SEQ ID NO: 3250030 - RNA, 16 nt, Human
gaaauuguauuacaaa

SEQ ID NO: 3250031 - RNA, 18 nt, Human
gaagauguagaggagaaa

SEQ ID NO: 3250032 - RNA, 17 nt, Human
gaagauguagaggagaa

SEQ ID NO: 3250033 - RNA, 19 nt, Human
gaagacugcauuauauuua

SEQ ID NO: 3250034 - RNA, 12 nt, Human
gaagaacugaaa

SEQ ID NO: 3250035 - RNA, 17 nt, Human
gaagacugcauuauauu

SEQ ID NO: 3250036 - RNA, 23 nt, Human
gaauucuugaaggaaaaugauac

SEQ ID NO: 3250037 - RNA, 16 nt, Human
gaauauuuuaacuucc

SEQ ID NO: 3250038 - RNA, 12 nt, Human
gaaguccaagca

SEQ ID NO: 3250039 - RNA, 22 nt, Human
gaaguccaagcauuuagaugua

SEQ ID NO: 3250040 - RNA, 16 nt, Human
gaaguauccuucagcc

SEQ ID NO: 3250041 - RNA, 14 nt, Human
gaaguauccuucag

SEQ ID NO: 3250042 - RNA, 16 nt, Human
cuuggacucauuuuaa

SEQ ID NO: 3250043 - RNA, 16 nt, Human
cuuggggcugaugcag

SEQ ID NO: 3250044 - RNA, 18 nt, Human
cuuggggcugaugcaguu

SEQ ID NO: 3250045 - RNA, 17 nt, Human
cuuguacuuuauuuucu

SEQ ID NO: 3250046 - RNA, 23 nt, Human
cuugcaucaauuuuucuuauuuc

SEQ ID NO: 3250047 - RNA, 14 nt, Human
cuugcccuguuaaa

SEQ ID NO: 3250048 - RNA, 18 nt, Human
cuugcccuggugccucac

SEQ ID NO: 3250049 - RNA, 22 nt, Human
cuugcccuguuaaaagaugaaa

SEQ ID NO: 3250050 - RNA, 20 nt, Human
cuugcuugauuguauggugg

SEQ ID NO: 3250051 - RNA, 14 nt, Human
gaaaaguauguuag

SEQ ID NO: 3250052 - RNA, 20 nt, Human
gaaaaguauguuagugcaaa

SEQ ID NO: 3250053 - RNA, 19 nt, Human
cuuuccucaaaacuucaga

SEQ ID NO: 3250054 - RNA, 19 nt, Human
cuuacuaguuucccuugca

SEQ ID NO: 3250055 - RNA, 19 nt, Human
cuuagaugcaguucugaag

SEQ ID NO: 3250056 - RNA, 19 nt, Human
cuuauaggaauugacccac

SEQ ID NO: 3250057 - RNA, 14 nt, Human
cuuauaauuuaaaa

SEQ ID NO: 3250058 - RNA, 21 nt, Human
cuuaggguuaugauuaaguaa

SEQ ID NO: 3250059 - RNA, 13 nt, Human
cuuauaauuuaaa

SEQ ID NO: 3250060 - RNA, 15 nt, Human
cuuaugauugcagau

SEQ ID NO: 3250061 - RNA, 19 nt, Human
cuguuuuauaauuuuguga

SEQ ID NO: 3250062 - RNA, 18 nt, Human
cuguuuugaaucucauaa

SEQ ID NO: 3250063 - RNA, 18 nt, Human
cuuaaugccacuaaauug

SEQ ID NO: 3250064 - RNA, 11 nt, Human
cuuaacuauuc

SEQ ID NO: 3250065 - RNA, 13 nt, Human
cuucccuuucugc

SEQ ID NO: 3250066 - RNA, 19 nt, Human
cuuccagauccuggaaauc

SEQ ID NO: 3250067 - RNA, 16 nt, Human
cuucagcgguuuauau

SEQ ID NO: 3250068 - RNA, 18 nt, Human
cuucagcgguuuauauaa

SEQ ID NO: 3250069 - RNA, 18 nt, Human
cuucggccuccauccuga

SEQ ID NO: 3250070 - RNA, 17 nt, Human
cuucggccuccauccug

SEQ ID NO: 3250071 - RNA, 19 nt, Human
cuuccuuggacucauuuua

SEQ ID NO: 3250072 - RNA, 23 nt, Human
cucugcauacucauuaggauggc

SEQ ID NO: 3250073 - RNA, 16 nt, Human
cucccuucucuucaca

SEQ ID NO: 3250074 - RNA, 12 nt, Human
cucccuuucaac

SEQ ID NO: 3250075 - RNA, 13 nt, Human
cucccuuucaaca

SEQ ID NO: 3250076 - RNA, 13 nt, Human
cucggagaagagc

SEQ ID NO: 3250077 - RNA, 20 nt, Human
cucggagaagagcuguucac

SEQ ID NO: 3250078 - RNA, 12 nt, Human
cucggagaagag

SEQ ID NO: 3250079 - RNA, 18 nt, Human
cucauuaggauggcuagu

SEQ ID NO: 3250080 - RNA, 17 nt, Human
cucauuaggauggcuag

SEQ ID NO: 3250081 - RNA, 15 nt, Human
cucauaauuuauaca

SEQ ID NO: 3250082 - RNA, 13 nt, Human
cucauaauuuaua

SEQ ID NO: 3250083 - RNA, 22 nt, Human
cucauaauuuauacaggucaua

SEQ ID NO: 3250084 - RNA, 21 nt, Human
cucauaaaaagccugcaauuu

SEQ ID NO: 3250085 - RNA, 20 nt, Human
cuccauccugaggcuccacu

SEQ ID NO: 3250086 - RNA, 21 nt, Human
cuccauccugaggcuccacuu

SEQ ID NO: 3250087 - RNA, 23 nt, Human
cuccauccugaggcuccacuugg

SEQ ID NO: 3250088 - RNA, 17 nt, Human
cucccagucauuuaaua

SEQ ID NO: 3250089 - RNA, 22 nt, Human
cugggaacccaaguccaagcau

SEQ ID NO: 3250090 - RNA, 23 nt, Human
cuggaauaauccuaaacauauga

SEQ ID NO: 3250091 - RNA, 13 nt, Human
cugcugaaacaac

SEQ ID NO: 3250092 - RNA, 16 nt, Human
cuggccaacgggguga

SEQ ID NO: 3250093 - RNA, 18 nt, Human
cuggcacaguuuucugag

SEQ ID NO: 3250094 - RNA, 19 nt, Human
cuggcacaguuuucugaga

SEQ ID NO: 3250095 - RNA, 13 nt, Human
cugcagaagacag

SEQ ID NO: 3250096 - RNA, 23 nt, Human
cugcagaagacaguauggcagcu

SEQ ID NO: 3250097 - RNA, 20 nt, Human
cugcaauuucauaugcugua

SEQ ID NO: 3250098 - RNA, 18 nt, Human
cugcaauuucauaugcug

SEQ ID NO: 3250099 - RNA, 13 nt, Human
cugauguuccuag

SEQ ID NO: 3250100 - RNA, 18 nt, Human
cugauguuccuagugaaa

SEQ ID NO: 3250101 - RNA, 20 nt, Human
cugauguuccuagugaaaga

SEQ ID NO: 3250102 - RNA, 21 nt, Human
cugauguuccuagugaaagag

SEQ ID NO: 3250103 - RNA, 15 nt, Human
cugccuaagugcagc

SEQ ID NO: 3250104 - RNA, 15 nt, Human
cugccagcaacgcag

SEQ ID NO: 3250105 - RNA, 12 nt, Human
ccuucagccuga

SEQ ID NO: 3250106 - RNA, 17 nt, Human
cggccuccauccugagg

SEQ ID NO: 3250107 - RNA, 16 nt, Human
cggccuccauccugag

SEQ ID NO: 3250108 - RNA, 14 nt, Human
cggccuccauccug

SEQ ID NO: 3250109 - RNA, 11 nt, Human
cgcaaugugac

SEQ ID NO: 3250110 - RNA, 23 nt, Human
ccucuuagaugcaguucugaaga

SEQ ID NO: 3250111 - RNA, 23 nt, Human
ccugaaagaggaaugaaguacuc

SEQ ID NO: 3250112 - RNA, 13 nt, Human
ccugaaagaggaa

SEQ ID NO: 3250113 - RNA, 18 nt, Human
ccugaaagaggaaugaag

SEQ ID NO: 3250114 - RNA, 20 nt, Human
ccugaggcuccacuuggucu

SEQ ID NO: 3250115 - RNA, 18 nt, Human
ccugaggcuccacuuggu

SEQ ID NO: 3250116 - RNA, 17 nt, Human
ccugaggcuccacuugg

SEQ ID NO: 3250117 - RNA, 20 nt, Human
ccucagaaaacaaggaugaa

SEQ ID NO: 3250118 - RNA, 22 nt, Human
ccgggaggcagagguugcagug

SEQ ID NO: 3250119 - RNA, 15 nt, Human
cccuugaugaagaag

SEQ ID NO: 3250120 - RNA, 16 nt, Human
cccuugaugaagaagu

SEQ ID NO: 3250121 - RNA, 17 nt, Human
cauuuaggccaugggac

SEQ ID NO: 3250122 - RNA, 20 nt, Human
cauuguacgaagaguauuuu

SEQ ID NO: 3250123 - RNA, 13 nt, Human
cauuugcucaugg

SEQ ID NO: 3250124 - RNA, 18 nt, Human
cauuugcucauggaauug

SEQ ID NO: 3250125 - RNA, 22 nt, Human
ccaaacugacucuuaagaagac

SEQ ID NO: 3250126 - RNA, 16 nt, Human
ccaaaggcucucuccu

SEQ ID NO: 3250127 - RNA, 23 nt, Human
ccaaauuucauaccuaucaucuu

SEQ ID NO: 3250128 - RNA, 22 nt, Human
ccaagcauaccaacacgagcag

SEQ ID NO: 3250129 - RNA, 17 nt, Human
ccaagcauuuagaugua

SEQ ID NO: 3250130 - RNA, 14 nt, Human
ccaagcaaguauua

SEQ ID NO: 3250131 - RNA, 16 nt, Human
ccaauauucauagcag

SEQ ID NO: 3250132 - RNA, 20 nt, Human
ccacaggaaccacaagacug

SEQ ID NO: 3250133 - RNA, 18 nt, Human
ccacugcagaagacagua

SEQ ID NO: 3250134 - RNA, 13 nt, Human
ccacugcagaaga

SEQ ID NO: 3250135 - RNA, 13 nt, Human
cccaggugccagu

SEQ ID NO: 3250136 - RNA, 13 nt, Human
ccaggugccaguu

SEQ ID NO: 3250137 - RNA, 17 nt, Human
ccaggugccaguuaugg

SEQ ID NO: 3250138 - RNA, 16 nt, Human
ccagugaauucuugaa

SEQ ID NO: 3250139 - RNA, 20 nt, Human
ccagugaauucuugaaggaa

SEQ ID NO: 3250140 - RNA, 13 nt, Human
cccaaaaggcaga

SEQ ID NO: 3250141 - RNA, 18 nt, Human
cccaaaaggcagaagcaa

SEQ ID NO: 3250142 - RNA, 16 nt, Human
ccaugauguuuagaaa

SEQ ID NO: 3250143 - RNA, 14 nt, Human
ccaugaagauguag

SEQ ID NO: 3250144 - RNA, 18 nt, Human
ccaucaaggguacacugc

SEQ ID NO: 3250145 - RNA, 14 nt, Human
ccauacauuugugu

SEQ ID NO: 3250146 - RNA, 12 nt, Human
uugaugaagaag

SEQ ID NO: 3250147 - RNA, 18 nt, Human
uugcauagauucccugag

SEQ ID NO: 3250148 - RNA, 14 nt, Human
uugaggacacugau

SEQ ID NO: 3250149 - RNA, 15 nt, Human
uucuuauuucauuuc

SEQ ID NO: 3250150 - RNA, 14 nt, Human
uucugagcauuuaa

SEQ ID NO: 3250151 - RNA, 23 nt, Human
uugaaacugagaugugaacacau

SEQ ID NO: 3250152 - RNA, 16 nt, Human
uugaaaagacuccaaa

SEQ ID NO: 3250153 - RNA, 18 nt, Human
uugaaaagacuccaaaga

SEQ ID NO: 3250154 - RNA, 22 nt, Human
uugaaaagacuccaaagaaaug

SEQ ID NO: 3250155 - RNA, 15 nt, Human
uugaaucucauaauu

SEQ ID NO: 3250156 - RNA, 21 nt, Human
uugaaucucauaauuuauaca

SEQ ID NO: 3250157 - RNA, 19 nt, Human
uuguaucacaaaucuuaac

SEQ ID NO: 3250158 - RNA, 14 nt, Human
uuguauuacaaauc

SEQ ID NO: 3250159 - RNA, 11 nt, Human
uuguaaaugug

SEQ ID NO: 3250160 - RNA, 14 nt, Human
uuguaaaugugcuu

SEQ ID NO: 3250161 - RNA, 18 nt, Human
uuguaaaugugcuuuuaa

SEQ ID NO: 3250162 - RNA, 16 nt, Human
uuguaaaggaauuuaa

SEQ ID NO: 3250163 - RNA, 12 nt, Human
uugggaggcuga

SEQ ID NO: 3250164 - RNA, 17 nt, Human
uucaucugacuaugaca

SEQ ID NO: 3250165 - RNA, 19 nt, Human
uuccacuuauaggaauuga

SEQ ID NO: 3250166 - RNA, 21 nt, Human
uuccauccuagucacuaccuu

SEQ ID NO: 3250167 - RNA, 21 nt, Human
uucuaugaaauauuauguuaa

SEQ ID NO: 3250168 - RNA, 12 nt, Human
uuccuagugaaa

SEQ ID NO: 3250169 - RNA, 18 nt, Human
uucccuugaugaagaagu

SEQ ID NO: 3250170 - RNA, 15 nt, Human
uucggccuccauccu

SEQ ID NO: 3250171 - RNA, 19 nt, Human
uucggccuccauccugagg

SEQ ID NO: 3250172 - RNA, 18 nt, Human
uucggccuccauccugag

SEQ ID NO: 3250173 - RNA, 17 nt, Human
uuccuucugugaaagua

SEQ ID NO: 3250174 - RNA, 16 nt, Human
uuuucagaaaauauua

SEQ ID NO: 3250175 - RNA, 13 nt, Human
uuuucacauaucu

SEQ ID NO: 3250176 - RNA, 15 nt, Human
uuuucagaaaauauu

SEQ ID NO: 3250177 - RNA, 20 nt, Human
uuuuauaucaauuuaaaaaa

SEQ ID NO: 3250178 - RNA, 15 nt, Human
uuuuauaugcuucug

SEQ ID NO: 3250179 - RNA, 20 nt, Human
uuuuauaugcuucuguuuua

SEQ ID NO: 3250180 - RNA, 10 nt, Human
uuuuauauuu

SEQ ID NO: 3250181 - RNA, 19 nt, Human
uuuguauaaaauaauuuuu

SEQ ID NO: 3250182 - RNA, 21 nt, Human
uuuguauaaaauaauuuuuau

SEQ ID NO: 3250183 - RNA, 16 nt, Human
uuuguucauacauauu

SEQ ID NO: 3250184 - RNA, 13 nt, Human
uuuguucauacau

SEQ ID NO: 3250185 - RNA, 21 nt, Human
uuugcauagauucccugagca

SEQ ID NO: 3250186 - RNA, 23 nt, Human
uuuggaacaagaugguucuagca

SEQ ID NO: 3250187 - RNA, 15 nt, Human
uuucagauaaucaca

SEQ ID NO: 3250188 - RNA, 15 nt, Human
uuucagcagcugcag

SEQ ID NO: 3250189 - RNA, 14 nt, Human
uuuccaaaauaauu

SEQ ID NO: 3250190 - RNA, 15 nt, Human
uuucugagaaagacu

SEQ ID NO: 3250191 - RNA, 22 nt, Human
uuucugagaaagacuauucaaa

SEQ ID NO: 3250192 - RNA, 21 nt, Human
uuucuaacaaaaaaauauauu

SEQ ID NO: 3250193 - RNA, 12 nt, Human
uuuagaaacaca

SEQ ID NO: 3250194 - RNA, 15 nt, Human
uuuacauuguaaaua

SEQ ID NO: 3250195 - RNA, 13 nt, Human
uuuacauuguaaa

SEQ ID NO: 3250196 - RNA, 20 nt, Human
uuuagaaacacaacuauauu

SEQ ID NO: 3250197 - RNA, 14 nt, Human
uguuagugcaaauu

SEQ ID NO: 3250198 - RNA, 16 nt, Human
uguucacagccagacu

SEQ ID NO: 3250199 - RNA, 13 nt, Human
uguguugugaaug

SEQ ID NO: 3250200 - RNA, 20 nt, Human
uguuggagaagaacugaaau

SEQ ID NO: 3250201 - RNA, 21 nt, Human
uguuggagaagaacugaaauc

SEQ ID NO: 3250202 - RNA, 13 nt, Human
uguuuaaaaucau

SEQ ID NO: 3250203 - RNA, 12 nt, Human
uguuuuaaaaaa

SEQ ID NO: 3250204 - RNA, 19 nt, Human
uuaaaagaaugauuaugaa

SEQ ID NO: 3250205 - RNA, 13 nt, Human
uuaaaagaaugau

SEQ ID NO: 3250206 - RNA, 20 nt, Human
uuaaagcuuauuaaaacuca

SEQ ID NO: 3250207 - RNA, 18 nt, Human
uuaauaauguuucaaaca

SEQ ID NO: 3250208 - RNA, 16 nt, Human
uuaauaauguuucaaa

SEQ ID NO: 3250209 - RNA, 22 nt, Human
uuaaugucaauucuugccaaau

SEQ ID NO: 3250210 - RNA, 21 nt, Human
uuaccacuuguguuuugcaag

SEQ ID NO: 3250211 - RNA, 14 nt, Human
uuacauuuguauaa

SEQ ID NO: 3250212 - RNA, 15 nt, Human
uuacauuuguauaaa

SEQ ID NO: 3250213 - RNA, 20 nt, Human
uuacagagacagaaagcaga

SEQ ID NO: 3250214 - RNA, 21 nt, Human
ugucucaguccaugaagaugu

SEQ ID NO: 3250215 - RNA, 20 nt, Human
ugugaaguuuacauuguaaa

SEQ ID NO: 3250216 - RNA, 14 nt, Human
ugugaaguuuacau

SEQ ID NO: 3250217 - RNA, 22 nt, Human
ugugaccacugcagaagacagu

SEQ ID NO: 3250218 - RNA, 15 nt, Human
uguaaucacagcuac

SEQ ID NO: 3250219 - RNA, 14 nt, Human
uguaaucacagcua

SEQ ID NO: 3250220 - RNA, 20 nt, Human
uguaaaaugugaagugaaug

SEQ ID NO: 3250221 - RNA, 16 nt, Human
uguaugauucccagcc

SEQ ID NO: 3250222 - RNA, 16 nt, Human
uguagcacugacagau

SEQ ID NO: 3250223 - RNA, 22 nt, Human
uguagcacugacagauuuccau

SEQ ID NO: 3250224 - RNA, 17 nt, Human
uguagcacugacagauu

SEQ ID NO: 3250225 - RNA, 17 nt, Human
ugccuucucaacuccaa

SEQ ID NO: 3250226 - RNA, 22 nt, Human
ugccuucucaacuccaaacuga

SEQ ID NO: 3250227 - RNA, 18 nt, Human
ugcuagaacucccuuuca

SEQ ID NO: 3250228 - RNA, 19 nt, Human
ugcuagaacucccuuucaa

SEQ ID NO: 3250229 - RNA, 21 nt, Human
ugcuagaacucccuuucaaca

SEQ ID NO: 3250230 - RNA, 20 nt, Human
ugcuagaacucccuuucaac

SEQ ID NO: 3250231 - RNA, 16 nt, Human
ugcuagguuaauucca

SEQ ID NO: 3250232 - RNA, 23 nt, Human
ugcuagguuaauuccaauuauau

SEQ ID NO: 3250233 - RNA, 19 nt, Human
ugcaucagcugcugaaaca

SEQ ID NO: 3250234 - RNA, 22 nt, Human
ugcaucagcugcugaaacaaca

SEQ ID NO: 3250235 - RNA, 15 nt, Human
ugcauuauauuuauu

SEQ ID NO: 3250236 - RNA, 14 nt, Human
ugcauuauauuuau

SEQ ID NO: 3250237 - RNA, 20 nt, Human
ugcauuauauuuauuacugu

SEQ ID NO: 3250238 - RNA, 13 nt, Human
ugaaguccaagca

SEQ ID NO: 3250239 - RNA, 15 nt, Human
ugcacaucaaaauau

SEQ ID NO: 3250240 - RNA, 16 nt, Human
ugcagauaaacaguag

SEQ ID NO: 3250241 - RNA, 14 nt, Human
ugcuucuguuuuau

SEQ ID NO: 3250242 - RNA, 14 nt, Human
uggaacucucgagc

SEQ ID NO: 3250243 - RNA, 22 nt, Human
uggaaaaguauguuagugcaaa

SEQ ID NO: 3250244 - RNA, 18 nt, Human
ugggacagucaccucaug

SEQ ID NO: 3250245 - RNA, 20 nt, Human
ugggacagucaccucaugga

SEQ ID NO: 3250246 - RNA, 21 nt, Human
ugggacagucaccucauggaa

SEQ ID NO: 3250247 - RNA, 14 nt, Human
ugggacagggagga

SEQ ID NO: 3250248 - RNA, 19 nt, Human
ugggacauuugcucaugga

SEQ ID NO: 3250249 - RNA, 20 nt, Human
ugggacauuugcucauggaa

SEQ ID NO: 3250250 - RNA, 18 nt, Human
uggccuucggccuccauc

SEQ ID NO: 3250251 - RNA, 17 nt, Human
uggccuucggccuccau

SEQ ID NO: 3250252 - RNA, 14 nt, Human
uggccuucggccuc

SEQ ID NO: 3250253 - RNA, 17 nt, Human
uggguagacacacauga

SEQ ID NO: 3250254 - RNA, 16 nt, Human
uggguagacacacaug

SEQ ID NO: 3250255 - RNA, 14 nt, Human
uaaaagaugaaaau

SEQ ID NO: 3250256 - RNA, 19 nt, Human
uaaaauccauacauuugug

SEQ ID NO: 3250257 - RNA, 18 nt, Human
uaaaauccauacauuugu

SEQ ID NO: 3250258 - RNA, 22 nt, Human
uaaauaaaccucaaaaugucua

SEQ ID NO: 3250259 - RNA, 18 nt, Human
uaaauauaugcuaagucu

SEQ ID NO: 3250260 - RNA, 17 nt, Human
uaaauaaaaauaauccu

SEQ ID NO: 3250261 - RNA, 14 nt, Human
uaaaggaauuuaaa

SEQ ID NO: 3250262 - RNA, 18 nt, Human
guuuucaggcuagaugua

SEQ ID NO: 3250263 - RNA, 16 nt, Human
guuuucauuaucucaa

SEQ ID NO: 3250264 - RNA, 16 nt, Human
uaaaaaagaaacauuu

SEQ ID NO: 3250265 - RNA, 20 nt, Human
guuuaggauguugaaaaagu

SEQ ID NO: 3250266 - RNA, 13 nt, Human
guuuagcaguaua

SEQ ID NO: 3250267 - RNA, 13 nt, Human
guuuagaaagcuu

SEQ ID NO: 3250268 - RNA, 23 nt, Human
uaaauugacacuuaaaaaugguu

SEQ ID NO: 3250269 - RNA, 19 nt, Human
uaacaaugcuguauuuuaa

SEQ ID NO: 3250270 - RNA, 23 nt, Human
uaagagggauuagggagagaaga

SEQ ID NO: 3250271 - RNA, 23 nt, Human
uaagagagaaugagagacacacu

SEQ ID NO: 3250272 - RNA, 21 nt, Human
uaagccagacaucaacagaua

SEQ ID NO: 3250273 - RNA, 20 nt, Human
uaagccagacaucaacagau

SEQ ID NO: 3250274 - RNA, 13 nt, Human
uaagccagacauc

SEQ ID NO: 3250275 - RNA, 20 nt, Human
uaagcauuccaacuaucuca

SEQ ID NO: 3250276 - RNA, 16 nt, Human
uaagcauuccaacuau

SEQ ID NO: 3250277 - RNA, 18 nt, Human
uaagcauuccaacuaucu

SEQ ID NO: 3250278 - RNA, 15 nt, Human
uaauaauguuucaaa

SEQ ID NO: 3250279 - RNA, 14 nt, Human
uaauaauguuucaa

SEQ ID NO: 3250280 - RNA, 19 nt, Human
uaauaaauauuuuugccau

SEQ ID NO: 3250281 - RNA, 19 nt, Human
uaaugccacuaaauugaca

SEQ ID NO: 3250282 - RNA, 19 nt, Human
uaaugauaaguaaaugcua

SEQ ID NO: 3250283 - RNA, 23 nt, Human
uaaugauaacuggaaacuucagc

SEQ ID NO: 3250284 - RNA, 14 nt, Human
uaauauauuuccau

SEQ ID NO: 3250285 - RNA, 22 nt, Human
uaauuggaaaggcagcucuaaa

SEQ ID NO: 3250286 - RNA, 20 nt, Human
uaauuuguaguguuggagaa

SEQ ID NO: 3250287 - RNA, 23 nt, Human
uaauuuguaguguuggagaagaa

SEQ ID NO: 3250288 - RNA, 13 nt, Human
uaauuuuaagaaa

SEQ ID NO: 3250289 - RNA, 15 nt, Human
uaauguuucaaacau

SEQ ID NO: 3250290 - RNA, 14 nt, Human
uaauguuucaaaca

SEQ ID NO: 3250291 - RNA, 20 nt, Human
uaauuaaaagaauauuuuaa

SEQ ID NO: 3250292 - RNA, 23 nt, Human
uaauuaaauuuugaguucuacau

SEQ ID NO: 3250293 - RNA, 19 nt, Human
uacugagagugaacaaauu

SEQ ID NO: 3250294 - RNA, 23 nt, Human
uacugauguuccuagugaaagag

SEQ ID NO: 3250295 - RNA, 23 nt, Human
uacgaagaguauuuuugacagaa

SEQ ID NO: 3250296 - RNA, 22 nt, Human
uacgaagaguauuuuugacaga

SEQ ID NO: 3250297 - RNA, 20 nt, Human
uacgaagaguauuuuugaca

SEQ ID NO: 3250298 - RNA, 17 nt, Human
uagaacagauaaucagu

SEQ ID NO: 3250299 - RNA, 23 nt, Human
uaccacaggaaccacaagacugc

SEQ ID NO: 3250300 - RNA, 20 nt, Human
uacaucccuuaccugggaaa

SEQ ID NO: 3250301 - RNA, 16 nt, Human
uaccaacacgagcagg

SEQ ID NO: 3250302 - RNA, 22 nt, Human
uaccaaaaaucucaauauuuca

SEQ ID NO: 3250303 - RNA, 22 nt, Human
uacaugagguacugagagugaa

SEQ ID NO: 3250304 - RNA, 21 nt, Human
uacaugagguacugagaguga

SEQ ID NO: 3250305 - RNA, 23 nt, Human
uacauuuggagacacaacuauuu

SEQ ID NO: 3250306 - RNA, 16 nt, Human
uacauuuguauaaaau

SEQ ID NO: 3250307 - RNA, 17 nt, Human
uacauuuguauaaaaua

SEQ ID NO: 3250308 - RNA, 11 nt, Human
uacauuugugu

SEQ ID NO: 3250309 - RNA, 14 nt, Human
uacaggauuugaaa

SEQ ID NO: 3250310 - RNA, 17 nt, Human
uagaguuuagcuggaaa

SEQ ID NO: 3250311 - RNA, 18 nt, Human
uagaguuuagcuggaaaa

SEQ ID NO: 3250312 - RNA, 20 nt, Human
uagcagggcauggcugggaa

SEQ ID NO: 3250313 - RNA, 16 nt, Human
uagauguauguacuuc

SEQ ID NO: 3250314 - RNA, 20 nt, Human
uagauguauguacuucaugc

SEQ ID NO: 3250315 - RNA, 13 nt, Human
uaggccaugggac

SEQ ID NO: 3250316 - RNA, 20 nt, Human
uaggaauugacccacaagaa

SEQ ID NO: 3250317 - RNA, 23 nt, Human
uaggaauugacccacaagaaaug

SEQ ID NO: 3250318 - RNA, 20 nt, Human
uauauuuauuacuguaagaa

SEQ ID NO: 3250319 - RNA, 23 nt, Human
uauauuuauuacuguaagaaaau

SEQ ID NO: 3250320 - RNA, 13 nt, Human
uauauuugaaaua

SEQ ID NO: 3250321 - RNA, 14 nt, Human
uauauuugaaauau

SEQ ID NO: 3250322 - RNA, 18 nt, Human
uauauaaguauucuaaau

SEQ ID NO: 3250323 - RNA, 21 nt, Human
uaguuguaccgcaaugugacu

SEQ ID NO: 3250324 - RNA, 14 nt, Human
uagucaaauugugu

SEQ ID NO: 3250325 - RNA, 18 nt, Human
uagucaaauugugugaaa

SEQ ID NO: 3250326 - RNA, 16 nt, Human
uauacccagaaaguua

SEQ ID NO: 3250327 - RNA, 21 nt, Human
uauaauucagaaggaucuuca

SEQ ID NO: 3250328 - RNA, 23 nt, Human
ucuggccuucggccuccauccug

SEQ ID NO: 3250329 - RNA, 22 nt, Human
ucuguuuuauaauuuugugaag

SEQ ID NO: 3250330 - RNA, 20 nt, Human
ucuguuuuauaauuuuguga

SEQ ID NO: 3250331 - RNA, 21 nt, Human
ugaaguccaagcauuuagaug

SEQ ID NO: 3250332 - RNA, 22 nt, Human
ugaaguccaagcauuuagaugu

SEQ ID NO: 3250333 - RNA, 14 nt, Human
ugaacacaucagcu

SEQ ID NO: 3250334 - RNA, 19 nt, Human
ugaaagcagggacuugaac

SEQ ID NO: 3250335 - RNA, 18 nt, Human
ugaaagcagggacuugaa

SEQ ID NO: 3250336 - RNA, 22 nt, Human
ugaaaagacuccaaagaaaugu

SEQ ID NO: 3250337 - RNA, 18 nt, Human
ugaaacccugucucuacu

SEQ ID NO: 3250338 - RNA, 15 nt, Human
ugaaaagacuccaaa

SEQ ID NO: 3250339 - RNA, 16 nt, Human
ugaaaagacuccaaag

SEQ ID NO: 3250340 - RNA, 17 nt, Human
ugaaaagacuccaaaga

SEQ ID NO: 3250341 - RNA, 19 nt, Human
ugaaaagacuccaaagaaa

SEQ ID NO: 3250342 - RNA, 19 nt, Human
ugaaaacuuuaugcuaagu

SEQ ID NO: 3250343 - RNA, 13 nt, Human
ucucuaggaaaua

SEQ ID NO: 3250344 - RNA, 21 nt, Human
ucucagugucaaugcagcccc

SEQ ID NO: 3250345 - RNA, 18 nt, Human
ucucuucacagucacauu

SEQ ID NO: 3250346 - RNA, 17 nt, Human
ucuacacuccagugaga

SEQ ID NO: 3250347 - RNA, 17 nt, Human
ucuacacuaagagagaa

SEQ ID NO: 3250348 - RNA, 13 nt, Human
ucuaaauuugaau

SEQ ID NO: 3250349 - RNA, 17 nt, Human
ucuaaauuugaauguua

SEQ ID NO: 3250350 - RNA, 19 nt, Human
ucuaacaaaaaaauauauu

SEQ ID NO: 3250351 - RNA, 22 nt, Human
ucuaaauuugaauguuaagcag

SEQ ID NO: 3250352 - RNA, 23 nt, Human
ucuaaauuugaauguuaagcaga

SEQ ID NO: 3250353 - RNA, 23 nt, Human
ucuaaauuuuauaucuuguagcu

SEQ ID NO: 3250354 - RNA, 18 nt, Human
ucuaaauuuuauaucuug

SEQ ID NO: 3250355 - RNA, 21 nt, Human
ucuacacuaagagagaaugag

SEQ ID NO: 3250356 - RNA, 17 nt, Human
ucucaaaacugcacugu

SEQ ID NO: 3250357 - RNA, 17 nt, Human
ucuaguaugaaauuaua

SEQ ID NO: 3250358 - RNA, 15 nt, Human
ucuaguaugaaauua

SEQ ID NO: 3250359 - RNA, 21 nt, Human
ucucaaauuuggauugcuaau

SEQ ID NO: 3250360 - RNA, 20 nt, Human
uccuucugugaaaguacauu

SEQ ID NO: 3250361 - RNA, 15 nt, Human
ucauaauuuauacag

SEQ ID NO: 3250362 - RNA, 16 nt, Human
ucauacauuguacgaa

SEQ ID NO: 3250363 - RNA, 15 nt, Human
ucauacauuguacga

SEQ ID NO: 3250364 - RNA, 13 nt, Human
ucauacauuguac

SEQ ID NO: 3250365 - RNA, 13 nt, Human
ucaguuguacagu

SEQ ID NO: 3250366 - RNA, 14 nt, Human
uccagauccuggaa

SEQ ID NO: 3250367 - RNA, 16 nt, Human
uccagauccuggaaau

SEQ ID NO: 3250368 - RNA, 17 nt, Human
uccagauccuggaaauc

SEQ ID NO: 3250369 - RNA, 13 nt, Human
uccacuuggucug

SEQ ID NO: 3250370 - RNA, 12 nt, Human
uccacuuggucu

SEQ ID NO: 3250371 - RNA, 14 nt, Human
uccaccuacaugag

SEQ ID NO: 3250372 - RNA, 23 nt, Human
uccaaacugacucuuaagaagac

SEQ ID NO: 3250373 - RNA, 16 nt, Human
ucauuucugcaucagc

SEQ ID NO: 3250374 - RNA, 22 nt, Human
ucauuucugcaucagcugcuga

SEQ ID NO: 3250375 - RNA, 14 nt, Human
ucauuucuuugagu

SEQ ID NO: 3250376 - RNA, 23 nt, Human
uccaagcauaccaacacgagcag

SEQ ID NO: 3250377 - RNA, 17 nt, Human
uccaagcauuuagaugu

SEQ ID NO: 3250378 - RNA, 16 nt, Human
ucccaaauuucauacc

SEQ ID NO: 3250379 - RNA, 20 nt, Human
uccaugggccauaugaaaag

SEQ ID NO: 3250380 - RNA, 23 nt, Human
ucacaggacagcccuucuuucca

SEQ ID NO: 3250381 - RNA, 19 nt, Human
ucacaggaaguagaggagg

SEQ ID NO: 3250382 - RNA, 14 nt, Human
ucacaggaaguaga

SEQ ID NO: 3250383 - RNA, 21 nt, Human
uauuucuaugaaauauuaugu

SEQ ID NO: 3250384 - RNA, 22 nt, Human
uauuucuaugaaauauuauguu

SEQ ID NO: 3250385 - RNA, 15 nt, Human
uauuugagaguucua

SEQ ID NO: 3250386 - RNA, 16 nt, Human
uauuugagaguucuaa

SEQ ID NO: 3250387 - RNA, 18 nt, Human
uauuugagaguucuaaau

SEQ ID NO: 3250388 - RNA, 19 nt, Human
uauuugagaguucuaaauu

SEQ ID NO: 3250389 - RNA, 19 nt, Human
uauuuuuguagcacugaca

SEQ ID NO: 3250390 - RNA, 19 nt, Human
ucagacauagaauuaacac

SEQ ID NO: 3250391 - RNA, 22 nt, Human
ucagacauagaauuaacacaug

SEQ ID NO: 3250392 - RNA, 17 nt, Human
ucacuugucaauaaaau

SEQ ID NO: 3250393 - RNA, 17 nt, Human
ucagaaaauauuaugug

SEQ ID NO: 3250394 - RNA, 19 nt, Human
ucagaaaauauuauguguu

SEQ ID NO: 3250395 - RNA, 20 nt, Human
ucagaaaauauuauguguuu

SEQ ID NO: 3250396 - RNA, 20 nt, Human
aaaaguauguuagugcaaau

SEQ ID NO: 3250397 - RNA, 22 nt, Human
acuuuauacccagaaaguuauu

SEQ ID NO: 3250398 - RNA, 17 nt, Human
cugagccgggccuuguc

SEQ ID NO: 3250399 - RNA, 18 nt, Human
cugccccugagcccugug

SEQ ID NO: 3250400 - RNA, 15 nt, Human
aucucauaauuuaua

SEQ ID NO: 3250401 - RNA, 14 nt, Human
acaagacugcacau

SEQ ID NO: 3250402 - RNA, 15 nt, Human
caggccuggccuugg

SEQ ID NO: 3250403 - RNA, 14 nt, Human
cagaccugccuuug

SEQ ID NO: 3250404 - RNA, 22 nt, Human
caauauuucagauaaucacaau

SEQ ID NO: 3250405 - RNA, 15 nt, SARS coronavirus
ugcuuaucauggcag

SEQ ID NO: 3250406 - RNA, 23 nt, SARS coronavirus
aacaaggcgauuagucaaauuca

SEQ ID NO: 3250407 - RNA, 13 nt, SARS coronavirus
agcuuguuuuccu

SEQ ID NO: 3250408 - RNA, 22 nt, SARS coronavirus
uccagaacaaacccaaggaaau

SEQ ID NO: 3250409 - RNA, 17 nt, SARS coronavirus
cuguacuacuaaaagaa

SEQ ID NO: 3250410 - RNA, 14 nt, SARS coronavirus
gaaagacagaauga

SEQ ID NO: 3250411 - RNA, 16 nt, SARS coronavirus
cacaauucaaagacaa

SEQ ID NO: 3250412 - RNA, 21 nt, SARS coronavirus
accgugcuacaacuuccucaa

SEQ ID NO: 3250413 - RNA, 16 nt, SARS coronavirus
uggcugacuuaucaug

SEQ ID NO: 3250414 - RNA, 19 nt, SARS coronavirus
ucaccaaacugcugcauuu

SEQ ID NO: 3250415 - RNA, 14 nt, SARS coronavirus
ccauuaaaugauua

SEQ ID NO: 3250416 - RNA, 17 nt, SARS coronavirus
uuacugcacagccagua

SEQ ID NO: 3250417 - RNA, 18 nt, SARS coronavirus
augcaguugcauaugcac

SEQ ID NO: 3250418 - RNA, 15 nt, SARS coronavirus
augaagcucagccuu

SEQ ID NO: 3250419 - RNA, 15 nt, SARS coronavirus
gagcucagccccaga

SEQ ID NO: 3250420 - RNA, 18 nt, SARS coronavirus
acccaaaauguucucuau

SEQ ID NO: 3250421 - RNA, 20 nt, SARS coronavirus
aaacgaacaugaaacuucuc

SEQ ID NO: 3250422 - RNA, 16 nt, SARS coronavirus
cuugaagauccuugua

SEQ ID NO: 3250423 - RNA, 21 nt, SARS coronavirus
ucaacugucaagauccagcug

SEQ ID NO: 3250424 - RNA, 20 nt, SARS coronavirus
augccuguuucuauggcuaa

SEQ ID NO: 3250425 - RNA, 24 nt, SARS coronavirus
cugcaaguacuguucaugcuacag

SEQ ID NO: 3250426 - RNA, 20 nt, SARS coronavirus
cacuaagaaaucugcugcug

SEQ ID NO: 3250427 - RNA, 12 nt, SARS coronavirus
cuugaagauccu

SEQ ID NO: 3250428 - RNA, 19 nt, SARS coronavirus
ccauuuuauucuaauguua

SEQ ID NO: 3250429 - RNA, 19 nt, SARS coronavirus
acuaagaaaucugcugcug

SEQ ID NO: 3250430 - RNA, 15 nt, SARS coronavirus
ucuuauuauuucuua

SEQ ID NO: 3250431 - RNA, 19 nt, SARS coronavirus
uucaauagugagacaauua

SEQ ID NO: 3250432 - RNA, 14 nt, SARS coronavirus
uuuuuaaugcuacu

SEQ ID NO: 3250433 - RNA, 15 nt, SARS coronavirus
aaaauuucuaauugu

SEQ ID NO: 3250434 - RNA, 18 nt, SARS coronavirus
ucacuaagaaaucugcug

SEQ ID NO: 3250435 - RNA, 16 nt, SARS coronavirus
uguucuuggacaauca

SEQ ID NO: 3250436 - RNA, 20 nt, SARS coronavirus
ccucgcgcuauugcugcuag

SEQ ID NO: 3250437 - RNA, 22 nt, SARS coronavirus
agacauuucaccuugcgcuuuu

SEQ ID NO: 3250438 - RNA, 20 nt, SARS coronavirus
uacuucuuuuucuugcuuuc

SEQ ID NO: 3250439 - RNA, 22 nt, SARS coronavirus
uuacaggcagacuucaaagccu

SEQ ID NO: 3250440 - RNA, 21 nt, SARS coronavirus
cuauuuuguuggcuauuuaaa

SEQ ID NO: 3250441 - RNA, 14 nt, SARS coronavirus
ucaacgcauguaga

SEQ ID NO: 3250442 - RNA, 21 nt, SARS coronavirus
cuacgcagagggaagcagagg

SEQ ID NO: 3250443 - RNA, 15 nt, SARS coronavirus
uuccauuuuauucua

SEQ ID NO: 3250444 - RNA, 13 nt, SARS coronavirus
gcuugauguggcu

SEQ ID NO: 3250445 - RNA, 21 nt, SARS coronavirus
aaggaacaacauugccaaaag

SEQ ID NO: 3250446 - RNA, 14 nt, SARS coronavirus
aguugccucaaggg

SEQ ID NO: 3250447 - RNA, 22 nt, SARS coronavirus
ugcugccuacacugcugcucua

SEQ ID NO: 3250448 - RNA, 18 nt, SARS coronavirus
cuaugucuuuaggugcug

SEQ ID NO: 3250449 - RNA, 20 nt, SARS coronavirus
cauggguuguguccuugcuu

SEQ ID NO: 3250450 - RNA, 11 nt, SARS coronavirus
cuauguuuaua

SEQ ID NO: 3250451 - RNA, 17 nt, SARS coronavirus
uuacauuugguggaccc

SEQ ID NO: 3250452 - RNA, 21 nt, SARS coronavirus
uaaaaauuuaaaugaaucacu

SEQ ID NO: 3250453 - RNA, 23 nt, SARS coronavirus
auugaaccagcuugagagcaaag

SEQ ID NO: 3250454 - RNA, 21 nt, SARS coronavirus
caacuacuuuguuugcuggca

SEQ ID NO: 3250455 - RNA, 17 nt, SARS coronavirus
gacagauugaaccagcu

SEQ ID NO: 3250456 - RNA, 20 nt, SARS coronavirus
ugguauuuauuuugcugcca

SEQ ID NO: 3250457 - RNA, 13 nt, SARS coronavirus
gugcuugcugcug

SEQ ID NO: 3250458 - RNA, 23 nt, SARS coronavirus
uggggcaaggccaaaacagcgcc

SEQ ID NO: 3250459 - RNA, 19 nt, SARS coronavirus
gauaguucaauugcuuacu

SEQ ID NO: 3250460 - RNA, 15 nt, SARS coronavirus
uuuugcuugugcuga

SEQ ID NO: 3250461 - RNA, 14 nt, SARS coronavirus
acugagggagccuu

SEQ ID NO: 3250462 - RNA, 18 nt, SARS coronavirus
acccagaaacaaacauuc

SEQ ID NO: 3250463 - RNA, 17 nt, SARS coronavirus
agcgccaggacaaacug

SEQ ID NO: 3250464 - RNA, 18 nt, SARS coronavirus
cucgaauggcuagcggag

SEQ ID NO: 3250465 - RNA, 20 nt, SARS coronavirus
cuaagaaaucugcugcugag

SEQ ID NO: 3250466 - RNA, 15 nt, SARS coronavirus
uuaaucaauguguaa

SEQ ID NO: 3250467 - RNA, 22 nt, SARS coronavirus
uucugcugauucaacucaggca

SEQ ID NO: 3250468 - RNA, 15 nt, SARS coronavirus
cuaaucuugcugcua

SEQ ID NO: 3250469 - RNA, 20 nt, SARS coronavirus
aacaacuccuggaacaaugg

SEQ ID NO: 3250470 - RNA, 18 nt, SARS coronavirus
gauguuucugauuucacu

SEQ ID NO: 3250471 - RNA, 17 nt, SARS coronavirus
augaguggagcuucugc

SEQ ID NO: 3250472 - RNA, 13 nt, SARS coronavirus
aaguguaauuaca

SEQ ID NO: 3250473 - RNA, 23 nt, SARS coronavirus
cugccaccgugcuacaacuuccu

SEQ ID NO: 3250474 - RNA, 15 nt, SARS coronavirus
acaaucacagaugcu

SEQ ID NO: 3250475 - RNA, 19 nt, SARS coronavirus
gcuuaucauggcagacaac

SEQ ID NO: 3250476 - RNA, 18 nt, SARS coronavirus
uauaccuacuaacuuuuc

SEQ ID NO: 3250477 - RNA, 22 nt, SARS coronavirus
accacauuuucaucgaggccac

SEQ ID NO: 3250478 - RNA, 18 nt, SARS coronavirus
cuugcuuuguugcaugac

SEQ ID NO: 3250479 - RNA, 23 nt, SARS coronavirus
cacauaaacgaacuuauggauuu

SEQ ID NO: 3250480 - RNA, 19 nt, SARS coronavirus
ugacgcauacaaaacauuc

SEQ ID NO: 3250481 - RNA, 18 nt, SARS coronavirus
acagccuuuucaccugcu

SEQ ID NO: 3250482 - RNA, 16 nt, SARS coronavirus
uucucauuguuuugac

SEQ ID NO: 3250483 - RNA, 22 nt, SARS coronavirus
ccaugaguggagcuucugcuga

SEQ ID NO: 3250484 - RNA, 15 nt, SARS coronavirus
ucaagucaaacaaau

SEQ ID NO: 3250485 - RNA, 18 nt, SARS coronavirus
gcaauucaccauuucacc

SEQ ID NO: 3250486 - RNA, 14 nt, SARS coronavirus
aauggcacuucuug

SEQ ID NO: 3250487 - RNA, 15 nt, SARS coronavirus
uauaucaagauguua

SEQ ID NO: 3250488 - RNA, 17 nt, SARS coronavirus
caaugugccucuccggg

SEQ ID NO: 3250489 - RNA, 15 nt, SARS coronavirus
uuuaacaagcuuguu

SEQ ID NO: 3250490 - RNA, 13 nt, SARS coronavirus
acugcugaacaag

SEQ ID NO: 3250491 - RNA, 15 nt, SARS coronavirus
uaagaagaauuauuc

SEQ ID NO: 3250492 - RNA, 10 nt, SARS coronavirus
cuugcugcug

SEQ ID NO: 3250493 - RNA, 21 nt, SARS coronavirus
uaauuucaggguuguucccuc

SEQ ID NO: 3250494 - RNA, 13 nt, SARS coronavirus
gucauacugcuga

SEQ ID NO: 3250495 - RNA, 17 nt, SARS coronavirus
ugccuacacugcugcuc

SEQ ID NO: 3250496 - RNA, 22 nt, SARS coronavirus
auagugguccagaugaccaaau

SEQ ID NO: 3250497 - RNA, 17 nt, SARS coronavirus
augaaggcaaagcauac

SEQ ID NO: 3250498 - RNA, 18 nt, SARS coronavirus
auguucaagcuccuaauu

SEQ ID NO: 3250499 - RNA, 15 nt, SARS coronavirus
uucacagcucucacu

SEQ ID NO: 3250500 - RNA, 17 nt, SARS coronavirus
gaugaccaaauuggcua

SEQ ID NO: 3250501 - RNA, 18 nt, SARS coronavirus
uaguauuuuuaauacuuu

SEQ ID NO: 3250502 - RNA, 21 nt, SARS coronavirus
uggugguuuuaauuuuucaca

SEQ ID NO: 3250503 - RNA, 23 nt, SARS coronavirus
uucucauuguuuugacuuguauu

SEQ ID NO: 3250504 - RNA, 12 nt, SARS coronavirus
gguauucuugcu

SEQ ID NO: 3250505 - RNA, 18 nt, SARS coronavirus
ggcacugauucagguuuu

SEQ ID NO: 3250506 - RNA, 15 nt, SARS coronavirus
cgcuccucaucacgu

SEQ ID NO: 3250507 - RNA, 19 nt, SARS coronavirus
ucaagaaauucaacuccug

SEQ ID NO: 3250508 - RNA, 18 nt, SARS coronavirus
ugguuuucacucgaaauc

SEQ ID NO: 3250509 - RNA, 20 nt, SARS coronavirus
gcacucucagguauugcugc

SEQ ID NO: 3250510 - RNA, 19 nt, SARS coronavirus
uuacagccuuuucaccugc

SEQ ID NO: 3250511 - RNA, 22 nt, SARS coronavirus
cugccaaaagagaucacugugg

SEQ ID NO: 3250512 - RNA, 13 nt, SARS coronavirus
gcuauugcugcua

SEQ ID NO: 3250513 - RNA, 17 nt, SARS coronavirus
caauuagcauuacuaca

SEQ ID NO: 3250514 - RNA, 23 nt, SARS coronavirus
ucaggcauaaacacucaugauga

SEQ ID NO: 3250515 - RNA, 20 nt, SARS coronavirus
gcuucugcugauucaacuca

SEQ ID NO: 3250516 - RNA, 14 nt, SARS coronavirus
uguuuauuuucuua

SEQ ID NO: 3250517 - RNA, 18 nt, SARS coronavirus
aacugguguuauugcuga

SEQ ID NO: 3250518 - RNA, 16 nt, SARS coronavirus
cacuaagaaaucugcu

SEQ ID NO: 3250519 - RNA, 19 nt, SARS coronavirus
uagcuacuucguugcuucc

SEQ ID NO: 3250520 - RNA, 19 nt, SARS coronavirus
agggaggacuugaaagagc

SEQ ID NO: 3250521 - RNA, 21 nt, SARS coronavirus
acauacgagggcaauucacca

SEQ ID NO: 3250522 - RNA, 17 nt, SARS coronavirus
agcucagccccagaugg

SEQ ID NO: 3250523 - RNA, 14 nt, SARS coronavirus
augauguucaagcu

SEQ ID NO: 3250524 - RNA, 16 nt, SARS coronavirus
acucaaagaagacuac

SEQ ID NO: 3250525 - RNA, 15 nt, SARS coronavirus
auaacaaugcugcca

SEQ ID NO: 3250526 - RNA, 15 nt, SARS coronavirus
cuuguauuucucuau

SEQ ID NO: 3250527 - RNA, 23 nt, SARS coronavirus
cuugaaagagccaccacauuuuc

SEQ ID NO: 3250528 - RNA, 16 nt, SARS coronavirus
uaaaggccaacaacaa

SEQ ID NO: 3250529 - RNA, 18 nt, SARS coronavirus
cgcagagggaagcagagg

SEQ ID NO: 3250530 - RNA, 17 nt, SARS coronavirus
ucucauuguugcugcuc

SEQ ID NO: 3250531 - RNA, 16 nt, SARS coronavirus
caauggggcaaggcca

SEQ ID NO: 3250532 - RNA, 17 nt, SARS coronavirus
aacugauuacaaacauu

SEQ ID NO: 3250533 - RNA, 21 nt, SARS coronavirus
cuuauguccuucccacaagca

SEQ ID NO: 3250534 - RNA, 12 nt, SARS coronavirus
gaagcucagccu

SEQ ID NO: 3250535 - RNA, 15 nt, SARS coronavirus
aacaaauuaaaaugu

SEQ ID NO: 3250536 - RNA, 17 nt, SARS coronavirus
guugaaugaucuuugcu

SEQ ID NO: 3250537 - RNA, 16 nt, SARS coronavirus
cucauuguugcugcuc

SEQ ID NO: 3250538 - RNA, 15 nt, SARS coronavirus
ugaacuuuuaaaugc

SEQ ID NO: 3250539 - RNA, 22 nt, SARS coronavirus
uucugucgucaacauucaaaaa

SEQ ID NO: 3250540 - RNA, 12 nt, SARS coronavirus
aacaagcacauu

SEQ ID NO: 3250541 - RNA, 13 nt, SARS coronavirus
guacaacgucacu

SEQ ID NO: 3250542 - RNA, 20 nt, SARS coronavirus
cuaauguuacuaucaacugu

SEQ ID NO: 3250543 - RNA, 13 nt, SARS coronavirus
cuggcagcaguag

SEQ ID NO: 3250544 - RNA, 19 nt, SARS coronavirus
cgauacauagucuacucuu

SEQ ID NO: 3250545 - RNA, 22 nt, SARS coronavirus
gacucugagccaguucucaagg

SEQ ID NO: 3250546 - RNA, 16 nt, SARS coronavirus
agucuacucuugugca

SEQ ID NO: 3250547 - RNA, 18 nt, SARS coronavirus
auucaacccagaaacaaa

SEQ ID NO: 3250548 - RNA, 23 nt, SARS coronavirus
ugcgagcuauaucacuaucagga

SEQ ID NO: 3250549 - RNA, 18 nt, SARS coronavirus
auaauaaguucaauagug

SEQ ID NO: 3250550 - RNA, 15 nt, SARS coronavirus
agaaugcucaagcau

SEQ ID NO: 3250551 - RNA, 13 nt, SARS coronavirus
auugcuuaucaug

SEQ ID NO: 3250552 - RNA, 13 nt, SARS coronavirus
caauguguaacau

SEQ ID NO: 3250553 - RNA, 13 nt, SARS coronavirus
ucuucugaaggag

SEQ ID NO: 3250554 - RNA, 20 nt, SARS coronavirus
aguuacccaaaauguucucu

SEQ ID NO: 3250555 - RNA, 20 nt, SARS coronavirus
aaggucaccaaacugcugca

SEQ ID NO: 3250556 - RNA, 12 nt, SARS coronavirus
ucacagaugcug

SEQ ID NO: 3250557 - RNA, 22 nt, SARS coronavirus
augaaaauuauucucuuccuga

SEQ ID NO: 3250558 - RNA, 23 nt, SARS coronavirus
cauuggaguuacccaaaauguuc

SEQ ID NO: 3250559 - RNA, 17 nt, SARS coronavirus
ucaugaaggcaaagcau

SEQ ID NO: 3250560 - RNA, 23 nt, SARS coronavirus
ugcacucucagguauugcugcug

SEQ ID NO: 3250561 - RNA, 23 nt, SARS coronavirus
cacuugcuuguuuugugcuugcu

SEQ ID NO: 3250562 - RNA, 14 nt, SARS coronavirus
ugaugaaaauggua

SEQ ID NO: 3250563 - RNA, 14 nt, SARS coronavirus
ugacucauucaaag

SEQ ID NO: 3250564 - RNA, 13 nt, SARS coronavirus
uuauuauuauucu

SEQ ID NO: 3250565 - RNA, 13 nt, SARS coronavirus
caaaaacaaaucg

SEQ ID NO: 3250566 - RNA, 13 nt, SARS coronavirus
auggguuucucua

SEQ ID NO: 3250567 - RNA, 21 nt, SARS coronavirus
gcucuugugguucuugcugca

SEQ ID NO: 3250568 - RNA, 16 nt, SARS coronavirus
ccaggaucuagaagaa

SEQ ID NO: 3250569 - RNA, 20 nt, SARS coronavirus
auggcacacuaugguucaaa

SEQ ID NO: 3250570 - RNA, 17 nt, SARS coronavirus
gacaacagauguuucau

SEQ ID NO: 3250571 - RNA, 21 nt, SARS coronavirus
agcguacuucuuuuucuugcu

SEQ ID NO: 3250572 - RNA, 16 nt, SARS coronavirus
uuuacuaccagcuuga

SEQ ID NO: 3250573 - RNA, 20 nt, SARS coronavirus
uaauacuuauagcacugcuu

SEQ ID NO: 3250574 - RNA, 13 nt, SARS coronavirus
ugccgcagagaca

SEQ ID NO: 3250575 - RNA, 13 nt, SARS coronavirus
acuacaauuugcc

SEQ ID NO: 3250576 - RNA, 18 nt, SARS coronavirus
cuacagcaauucaugcag

SEQ ID NO: 3250577 - RNA, 14 nt, SARS coronavirus
ucauuguugcugcu

SEQ ID NO: 3250578 - RNA, 13 nt, SARS coronavirus
cuaauaacaaugc

SEQ ID NO: 3250579 - RNA, 17 nt, SARS coronavirus
cauagauggcacacuau

SEQ ID NO: 3250580 - RNA, 24 nt, SARS coronavirus
augccuugauauauuuucuacaau

SEQ ID NO: 3250581 - RNA, 17 nt, SARS coronavirus
aguuugaugaggaugac

SEQ ID NO: 3250582 - RNA, 16 nt, SARS coronavirus
augugauuuuaauagc

SEQ ID NO: 3250583 - RNA, 14 nt, SARS coronavirus
aacauacuucaucu

SEQ ID NO: 3250584 - RNA, 14 nt, SARS coronavirus
caaaguuucuggua

SEQ ID NO: 3250585 - RNA, 18 nt, SARS coronavirus
ucagcauggcaaggagga

SEQ ID NO: 3250586 - RNA, 13 nt, SARS coronavirus
cagcccacuguga

SEQ ID NO: 3250587 - RNA, 15 nt, SARS coronavirus
agaaaucugcugcug

SEQ ID NO: 3250588 - RNA, 14 nt, SARS coronavirus
cccaggagaggaac

SEQ ID NO: 3250589 - RNA, 18 nt, SARS coronavirus
auacgagcauguaacuuu

SEQ ID NO: 3250590 - RNA, 20 nt, SARS coronavirus
uggaaugucacgcauuggca

SEQ ID NO: 3250591 - RNA, 15 nt, SARS coronavirus
uucaucuuguugacu

SEQ ID NO: 3250592 - RNA, 14 nt, SARS coronavirus
gauaugauugcugc

SEQ ID NO: 3250593 - RNA, 22 nt, SARS coronavirus
ugacucuucuuccugcggcuga

SEQ ID NO: 3250594 - RNA, 17 nt, SARS coronavirus
aaaccaacguagugccc

SEQ ID NO: 3250595 - RNA, 19 nt, SARS coronavirus
uauuuaaagccaacuacau

SEQ ID NO: 3250596 - RNA, 13 nt, SARS coronavirus
cuaccgaagagcu

SEQ ID NO: 3250597 - RNA, 14 nt, SARS coronavirus
auguagaauuauua

SEQ ID NO: 3250598 - RNA, 21 nt, SARS coronavirus
uguuucaucuuguugacuucc

SEQ ID NO: 3250599 - RNA, 16 nt, SARS coronavirus
aaguugcuguucuaua

SEQ ID NO: 3250600 - RNA, 18 nt, SARS coronavirus
aaauuaaauacagaccac

SEQ ID NO: 3250601 - RNA, 21 nt, SARS coronavirus
gugacaacagauguuucaucu

SEQ ID NO: 3250602 - RNA, 13 nt, SARS coronavirus
cugucaagaucca

SEQ ID NO: 3250603 - RNA, 12 nt, SARS coronavirus
gcucaauguggu

SEQ ID NO: 3250604 - RNA, 15 nt, SARS coronavirus
caauauugcuuugcu

SEQ ID NO: 3250605 - RNA, 16 nt, SARS coronavirus
auccuaauaacaaugc

SEQ ID NO: 3250606 - RNA, 22 nt, SARS coronavirus
ggccaaacugucacuaagaaau

SEQ ID NO: 3250607 - RNA, 14 nt, SARS coronavirus
cuacaacuuccuca

SEQ ID NO: 3250608 - RNA, 16 nt, SARS coronavirus
cuagagaucucauuug

SEQ ID NO: 3250609 - RNA, 22 nt, SARS coronavirus
ugaugaccacacaaggcagaug

SEQ ID NO: 3250610 - RNA, 18 nt, SARS coronavirus
uucaaacaugcacaccua

SEQ ID NO: 3250611 - RNA, 21 nt, SARS coronavirus
gaggacgcaauggggcaaggc

SEQ ID NO: 3250612 - RNA, 16 nt, SARS coronavirus
cuaacaaagaaggcau

SEQ ID NO: 3250613 - RNA, 17 nt, SARS coronavirus
aggcaucuaaaaagccu

SEQ ID NO: 3250614 - RNA, 22 nt, SARS coronavirus
ugcacuagcacacacuuugcuu

SEQ ID NO: 3250615 - RNA, 22 nt, SARS coronavirus
gcaucuaauaaaccucaugugc

SEQ ID NO: 3250616 - RNA, 17 nt, SARS coronavirus
gaacuugucauuggugc

SEQ ID NO: 3250617 - RNA, 19 nt, SARS coronavirus
ugagcaauauauuaaaugg

SEQ ID NO: 3250618 - RNA, 14 nt, SARS coronavirus
acauaaacgaacuu

SEQ ID NO: 3250619 - RNA, 18 nt, SARS coronavirus
aacaacauugccaaaagg

SEQ ID NO: 3250620 - RNA, 19 nt, SARS coronavirus
acaacgguacuauuaccgu

SEQ ID NO: 3250621 - RNA, 18 nt, SARS coronavirus
caccgaaguuuacuacca

SEQ ID NO: 3250622 - RNA, 14 nt, SARS coronavirus
ggcaaaaugaaaga

SEQ ID NO: 3250623 - RNA, 16 nt, SARS coronavirus
ucuucucgcuccucau

SEQ ID NO: 3250624 - RNA, 20 nt, SARS coronavirus
gucacuaagaaaucugcugc

SEQ ID NO: 3250625 - RNA, 22 nt, SARS coronavirus
uuaaggaugguauuuauuuugc

SEQ ID NO: 3250626 - RNA, 18 nt, SARS coronavirus
aauauauuaaauggccuu

SEQ ID NO: 3250627 - RNA, 15 nt, SARS coronavirus
gcuggcgcugcucuu

SEQ ID NO: 3250628 - RNA, 12 nt, SARS coronavirus
uuuaacauugcu

SEQ ID NO: 3250629 - RNA, 14 nt, SARS coronavirus
ugccaccucugcuc

SEQ ID NO: 3250630 - RNA, 11 nt, SARS coronavirus
caacuccugga

SEQ ID NO: 3250631 - RNA, 20 nt, SARS coronavirus
ugaugaaaaugguacaauca

SEQ ID NO: 3250632 - RNA, 19 nt, SARS coronavirus
acuauuauuauuauucugu

SEQ ID NO: 3250633 - RNA, 20 nt, SARS coronavirus
ccuacggcgcuaacaaagaa

SEQ ID NO: 3250634 - RNA, 17 nt, SARS coronavirus
gcaauuuacugcugcua

SEQ ID NO: 3250635 - RNA, 14 nt, SARS coronavirus
aaugauuaugguuu

SEQ ID NO: 3250636 - RNA, 17 nt, SARS coronavirus
acacucaugaugaccac

SEQ ID NO: 3250637 - RNA, 13 nt, SARS coronavirus
cauucuuuggaau

SEQ ID NO: 3250638 - RNA, 20 nt, SARS coronavirus
cacugcuggauggacauuug

SEQ ID NO: 3250639 - RNA, 13 nt, SARS coronavirus
cuccuggcagcag

SEQ ID NO: 3250640 - RNA, 13 nt, SARS coronavirus
ccuugcgcuuuug

SEQ ID NO: 3250641 - RNA, 15 nt, SARS coronavirus
gcuauaccuacuaac

SEQ ID NO: 3250642 - RNA, 21 nt, SARS coronavirus
cuaguuagugguacugccacu

SEQ ID NO: 3250643 - RNA, 20 nt, SARS coronavirus
auuauaaauauagguaucuu

SEQ ID NO: 3250644 - RNA, 13 nt, SARS coronavirus
auuguugcugcuc

SEQ ID NO: 3250645 - RNA, 13 nt, SARS coronavirus
cugauuacaaaca

SEQ ID NO: 3250646 - RNA, 17 nt, SARS coronavirus
caacaacaacaaggcca

SEQ ID NO: 3250647 - RNA, 12 nt, SARS coronavirus
gaaaauuauucu

SEQ ID NO: 3250648 - RNA, 23 nt, SARS coronavirus
gugcuugcugcugucuacagaau

SEQ ID NO: 3250649 - RNA, 23 nt, SARS coronavirus
gaugaagcucagccuuugccgca

SEQ ID NO: 3250650 - RNA, 18 nt, SARS coronavirus
auuugcaauuuacugcug

SEQ ID NO: 3250651 - RNA, 17 nt, SARS coronavirus
cucgcgcuauugcugcu

SEQ ID NO: 3250652 - RNA, 15 nt, SARS coronavirus
uaaugccuguuucua

SEQ ID NO: 3250653 - RNA, 23 nt, SARS coronavirus
caaauagcgccaggacaaacugg

SEQ ID NO: 3250654 - RNA, 14 nt, SARS coronavirus
uaaaaaggacaaaa

SEQ ID NO: 3250655 - RNA, 23 nt, SARS coronavirus
gucacuaagaaaucugcugcuga

SEQ ID NO: 3250656 - RNA, 22 nt, SARS coronavirus
ugauguuucuacagcaauucau

SEQ ID NO: 3250657 - RNA, 20 nt, SARS coronavirus
uuugcaauuuacugcugcua

SEQ ID NO: 3250658 - RNA, 17 nt, SARS coronavirus
ugugacucuucuuccug

SEQ ID NO: 3250659 - RNA, 13 nt, SARS coronavirus
auacacccaaaga

SEQ ID NO: 3250660 - RNA, 14 nt, SARS coronavirus
augguucaaacaug

SEQ ID NO: 3250661 - RNA, 15 nt, SARS coronavirus
cgcucaauaaaagau

SEQ ID NO: 3250662 - RNA, 21 nt, SARS coronavirus
gccacuuuuucucauuguugc

SEQ ID NO: 3250663 - RNA, 20 nt, SARS coronavirus
cuucuucaaagagauuucaa

SEQ ID NO: 3250664 - RNA, 18 nt, SARS coronavirus
acucaggcauaaacacuc

SEQ ID NO: 3250665 - RNA, 20 nt, SARS coronavirus
ugcuaauuugcuucuccaau

SEQ ID NO: 3250666 - RNA, 15 nt, SARS coronavirus
cucgcuccucaucac

SEQ ID NO: 3250667 - RNA, 13 nt, SARS coronavirus
uaauaacaaugcu

SEQ ID NO: 3250668 - RNA, 23 nt, SARS coronavirus
auggaccccaaucaaaccaacgu

SEQ ID NO: 3250669 - RNA, 22 nt, SARS coronavirus
cauuuggugcuggcgcugcucu

SEQ ID NO: 3250670 - RNA, 20 nt, SARS coronavirus
ucauuguuuugacuuguauu

SEQ ID NO: 3250671 - RNA, 19 nt, SARS coronavirus
cacuaagaaaucugcugcu

SEQ ID NO: 3250672 - RNA, 15 nt, SARS coronavirus
accaaaacuuuucau

SEQ ID NO: 3250673 - RNA, 18 nt, SARS coronavirus
uaaaaagccucgccaaaa

SEQ ID NO: 3250674 - RNA, 13 nt, SARS coronavirus
aacauucuucuca

SEQ ID NO: 3250675 - RNA, 20 nt, SARS coronavirus
aucugaaauauuagacauuu

SEQ ID NO: 3250676 - RNA, 14 nt, SARS coronavirus
gcgcuaacaaagaa

SEQ ID NO: 3250677 - RNA, 21 nt, SARS coronavirus
agagauuucaaccauuucaac

SEQ ID NO: 3250678 - RNA, 20 nt, SARS coronavirus
uguaacuuugaauuguguga

SEQ ID NO: 3250679 - RNA, 16 nt, SARS coronavirus
aagacguuguuaacca

SEQ ID NO: 3250680 - RNA, 20 nt, SARS coronavirus
ugcugccuacacugcugcuc

SEQ ID NO: 3250681 - RNA, 15 nt, SARS coronavirus
uaaugcuagggagag

SEQ ID NO: 3250682 - RNA, 23 nt, SARS coronavirus
cugcccucgcgcuauugcugcua

SEQ ID NO: 3250683 - RNA, 22 nt, SARS coronavirus
ucuacuggaaacaauguauucc

SEQ ID NO: 3250684 - RNA, 22 nt, SARS coronavirus
auuguggcuuauacuaugucuu

SEQ ID NO: 3250685 - RNA, 21 nt, SARS coronavirus
gcauuaaacacacuuguuaaa

SEQ ID NO: 3250686 - RNA, 14 nt, SARS coronavirus
uucucauuguugcu

SEQ ID NO: 3250687 - RNA, 18 nt, SARS coronavirus
cucgccacuuuuucucau

SEQ ID NO: 3250688 - RNA, 13 nt, SARS coronavirus
uccaaugucuaug

SEQ ID NO: 3250689 - RNA, 14 nt, SARS coronavirus
guuaaagacccacc

SEQ ID NO: 3250690 - RNA, 21 nt, SARS coronavirus
auuauuaacaauucuacuaau

SEQ ID NO: 3250691 - RNA, 18 nt, SARS coronavirus
ucaaauucaagaaucacu

SEQ ID NO: 3250692 - RNA, 12 nt, SARS coronavirus
acaaacauucuu

SEQ ID NO: 3250693 - RNA, 15 nt, SARS coronavirus
cugcuaaucuugcug

SEQ ID NO: 3250694 - RNA, 20 nt, SARS coronavirus
uggaagagcccuaaugugua

SEQ ID NO: 3250695 - RNA, 15 nt, SARS coronavirus
ugucuacagaauuaa

SEQ ID NO: 3250696 - RNA, 16 nt, SARS coronavirus
cuaagaaaucugcugc

SEQ ID NO: 3250697 - RNA, 17 nt, SARS coronavirus
auuauucuguuuggaac

SEQ ID NO: 3250698 - RNA, 21 nt, SARS coronavirus
cauuugcaauuuacugcugcu

SEQ ID NO: 3250699 - RNA, 15 nt, SARS coronavirus
aucuuagacauggca

SEQ ID NO: 3250700 - RNA, 14 nt, SARS coronavirus
ugaaacuucucauu

SEQ ID NO: 3250701 - RNA, 22 nt, SARS coronavirus
agggggguuuacuauccugaug

SEQ ID NO: 3250702 - RNA, 16 nt, SARS coronavirus
augaccaaauuggcua

SEQ ID NO: 3250703 - RNA, 15 nt, SARS coronavirus
uggcgacauuucagg

SEQ ID NO: 3250704 - RNA, 11 nt, SARS coronavirus
cuucucauugu

SEQ ID NO: 3250705 - RNA, 20 nt, SARS coronavirus
aaaauuauccacugaccuua

SEQ ID NO: 3250706 - RNA, 14 nt, SARS coronavirus
caauucaaagacaa

SEQ ID NO: 3250707 - RNA, 13 nt, SARS coronavirus
cuuugugcucuag

SEQ ID NO: 3250708 - RNA, 15 nt, SARS coronavirus
auaccuuuugcuaug

SEQ ID NO: 3250709 - RNA, 23 nt, SARS coronavirus
gucaccaaacugcugcauuuaga

SEQ ID NO: 3250710 - RNA, 15 nt, SARS coronavirus
auucucuuccugaca

SEQ ID NO: 3250711 - RNA, 17 nt, SARS coronavirus
acaaucaaaaagaguug

SEQ ID NO: 3250712 - RNA, 22 nt, SARS coronavirus
gugacggcaaaaugaaagagcu

SEQ ID NO: 3250713 - RNA, 15 nt, SARS coronavirus
cucauggaaagugaa

SEQ ID NO: 3250714 - RNA, 16 nt, SARS coronavirus
acuauaaauuaaauac

SEQ ID NO: 3250715 - RNA, 18 nt, SARS coronavirus
aacuaaucagggcugcug

SEQ ID NO: 3250716 - RNA, 15 nt, SARS coronavirus
auaucugaugccuuu

SEQ ID NO: 3250717 - RNA, 18 nt, SARS coronavirus
gcucggcuucauugcugg

SEQ ID NO: 3250718 - RNA, 22 nt, SARS coronavirus
cuaggaacuggcccagaagcuu

SEQ ID NO: 3250719 - RNA, 15 nt, SARS coronavirus
caucuuguugacuuc

SEQ ID NO: 3250720 - RNA, 18 nt, SARS coronavirus
ucacacuagccauccuua

SEQ ID NO: 3250721 - RNA, 14 nt, SARS coronavirus
cuuccuacauguca

SEQ ID NO: 3250722 - RNA, 18 nt, SARS coronavirus
aaugaucuuugcuucucc

SEQ ID NO: 3250723 - RNA, 16 nt, SARS coronavirus
cuucaaagagauuuca

SEQ ID NO: 3250724 - RNA, 13 nt, SARS coronavirus
uggcgcugcucuu

SEQ ID NO: 3250725 - RNA, 17 nt, SARS coronavirus
uuguuaccaucuauuca

SEQ ID NO: 3250726 - RNA, 19 nt, SARS coronavirus
gcuucuuaggagaaugaca

SEQ ID NO: 3250727 - RNA, 14 nt, SARS coronavirus
aggcauaaacacuc

SEQ ID NO: 3250728 - RNA, 19 nt, SARS coronavirus
aagaaccuuguaccaaagu

SEQ ID NO: 3250729 - RNA, 22 nt, SARS coronavirus
caaacugguguuauugcugauu

SEQ ID NO: 3250730 - RNA, 19 nt, SARS coronavirus
gguucaacaagagcucuac

SEQ ID NO: 3250731 - RNA, 17 nt, SARS coronavirus
cuguucaugcuacagca

SEQ ID NO: 3250732 - RNA, 15 nt, SARS coronavirus
acaaaugcuucaucu

SEQ ID NO: 3250733 - RNA, 12 nt, SARS coronavirus
cgacacuucuua

SEQ ID NO: 3250734 - RNA, 22 nt, SARS coronavirus
ucuugcugcuacuaaaaugucu

SEQ ID NO: 3250735 - RNA, 19 nt, SARS coronavirus
uuagaugaugaagaaccua

SEQ ID NO: 3250736 - RNA, 12 nt, SARS coronavirus
uccuggcagcag

SEQ ID NO: 3250737 - RNA, 23 nt, SARS coronavirus
ggcuucuacgcagagggaagcag

SEQ ID NO: 3250738 - RNA, 23 nt, SARS coronavirus
uccugcaaguacuguucaugcua

SEQ ID NO: 3250739 - RNA, 16 nt, SARS coronavirus
uaauucaagaaauuca

SEQ ID NO: 3250740 - RNA, 13 nt, SARS coronavirus
uauucucuuccug

SEQ ID NO: 3250741 - RNA, 15 nt, SARS coronavirus
uuggcauggaaguca

SEQ ID NO: 3250742 - RNA, 22 nt, SARS coronavirus
cugauguuucuacagcaauuca

SEQ ID NO: 3250743 - RNA, 20 nt, SARS coronavirus
ccagaacaaacccaaggaaa

SEQ ID NO: 3250744 - RNA, 18 nt, SARS coronavirus
auugaccgccucaaugag

SEQ ID NO: 3250745 - RNA, 21 nt, SARS coronavirus
ugauuucuccagacaacuuca

SEQ ID NO: 3250746 - RNA, 18 nt, SARS coronavirus
cggcaaaaugaaagagcu

SEQ ID NO: 3250747 - RNA, 23 nt, SARS coronavirus
gcuuguuuugugcuugcugcugu

SEQ ID NO: 3250748 - RNA, 13 nt, SARS coronavirus
cugauaauggacc

SEQ ID NO: 3250749 - RNA, 13 nt, SARS coronavirus
uaccuuuugcuau

SEQ ID NO: 3250750 - RNA, 14 nt, SARS coronavirus
uaguacagcgcugu

SEQ ID NO: 3250751 - RNA, 15 nt, SARS coronavirus
uugugcuugcugcug

SEQ ID NO: 3250752 - RNA, 16 nt, SARS coronavirus
aauuuacugcugcuau

SEQ ID NO: 3250753 - RNA, 12 nt, SARS coronavirus
uuguugcugcuc

SEQ ID NO: 3250754 - RNA, 17 nt, SARS coronavirus
cuacaucacgaacgcuu

SEQ ID NO: 3250755 - RNA, 20 nt, SARS coronavirus
ucuaugagaaccaaaaacaa

SEQ ID NO: 3250756 - RNA, 23 nt, SARS coronavirus
cuuuguaagcacaagaaagugag

SEQ ID NO: 3250757 - RNA, 20 nt, SARS coronavirus
cuaauuuuggugcaauuuca

SEQ ID NO: 3250758 - RNA, 19 nt, SARS coronavirus
gcaucuaauaaaccucaug

SEQ ID NO: 3250759 - RNA, 19 nt, SARS coronavirus
gacaauauugcuuugcuag

SEQ ID NO: 3250760 - RNA, 17 nt, SARS coronavirus
acagguacguuaauagu

SEQ ID NO: 3250761 - RNA, 15 nt, SARS coronavirus
agagauuucaaccau

SEQ ID NO: 3250762 - RNA, 23 nt, SARS coronavirus
uacucuaauaacaccauugcuau

SEQ ID NO: 3250763 - RNA, 12 nt, SARS coronavirus
agagcucagccc

SEQ ID NO: 3250764 - RNA, 13 nt, SARS coronavirus
accccaagguuua

SEQ ID NO: 3250765 - RNA, 19 nt, SARS coronavirus
uucgauaaugcauuuaauu

SEQ ID NO: 3250766 - RNA, 14 nt, SARS coronavirus
cuacacugcugcuc

SEQ ID NO: 3250767 - RNA, 22 nt, SARS coronavirus
gagccuugaauacacccaaaga

SEQ ID NO: 3250768 - RNA, 13 nt, SARS coronavirus
gaaaucugcugcu

SEQ ID NO: 3250769 - RNA, 22 nt, SARS coronavirus
uaguauuuuuaauacuuugcuu

SEQ ID NO: 3250770 - RNA, 15 nt, SARS coronavirus
uacuuauagcacugc

SEQ ID NO: 3250771 - RNA, 12 nt, SARS coronavirus
ugcuugcugcug

SEQ ID NO: 3250772 - RNA, 15 nt, SARS coronavirus
acaugaaaauuauuc

SEQ ID NO: 3250773 - RNA, 19 nt, SARS coronavirus
auuauccacugaccuuauu

SEQ ID NO: 3250774 - RNA, 21 nt, SARS coronavirus
augauuaugguuuuuacacca

SEQ ID NO: 3250775 - RNA, 15 nt, SARS coronavirus
aauaaagauggguuu

SEQ ID NO: 3250776 - RNA, 22 nt, SARS coronavirus
cuuuucuccacaaauaauuacu

SEQ ID NO: 3250777 - RNA, 14 nt, SARS coronavirus
ugccuacacugcug

SEQ ID NO: 3250778 - RNA, 19 nt, SARS coronavirus
uacauuuaugcucaaguau

SEQ ID NO: 3250779 - RNA, 13 nt, SARS coronavirus
ugaacucuucuga

SEQ ID NO: 3250780 - RNA, 22 nt, SARS coronavirus
gagccuaaaaaggacaaaaaga

SEQ ID NO: 3250781 - RNA, 15 nt, SARS coronavirus
uauuuugguuuucac

SEQ ID NO: 3250782 - RNA, 15 nt, SARS coronavirus
uacuaucaacuguca

SEQ ID NO: 3250783 - RNA, 14 nt, SARS coronavirus
uuaaacaacuccug

SEQ ID NO: 3250784 - RNA, 17 nt, SARS coronavirus
cuucuggucuaaacgaa

SEQ ID NO: 3250785 - RNA, 19 nt, SARS coronavirus
auuuuggugguuuuaauuu

SEQ ID NO: 3250786 - RNA, 18 nt, SARS coronavirus
cacagcucucacucagca

SEQ ID NO: 3250787 - RNA, 17 nt, SARS coronavirus
ugugcucuaggaaaggu

SEQ ID NO: 3250788 - RNA, 22 nt, SARS coronavirus
aaaugaaagagcucagccccag

SEQ ID NO: 3250789 - RNA, 16 nt, SARS coronavirus
cuguugauuguucuca

SEQ ID NO: 3250790 - RNA, 15 nt, SARS coronavirus
uuauuauucuguuug

SEQ ID NO: 3250791 - RNA, 21 nt, SARS coronavirus
uggucauucaacccagaaaca

SEQ ID NO: 3250792 - RNA, 22 nt, SARS coronavirus
gaaagagccaccacauuuucau

SEQ ID NO: 3250793 - RNA, 20 nt, SARS coronavirus
gcaagaucaguuucaccaaa

SEQ ID NO: 3250794 - RNA, 13 nt, SARS coronavirus
uuauucugaggau

SEQ ID NO: 3250795 - RNA, 14 nt, SARS coronavirus
ccacaaaacaguac

SEQ ID NO: 3250796 - RNA, 19 nt, SARS coronavirus
gccgcagagacaaaagaag

SEQ ID NO: 3250797 - RNA, 16 nt, SARS coronavirus
gcccucgcgcuauugc

SEQ ID NO: 3250798 - RNA, 12 nt, SARS coronavirus
cugcuuggcuuu

SEQ ID NO: 3250799 - RNA, 21 nt, SARS coronavirus
auuugcaauuuacugcugcua

SEQ ID NO: 3250800 - RNA, 21 nt, SARS coronavirus
ccacagagaaaucaaauguug

SEQ ID NO: 3250801 - RNA, 21 nt, SARS coronavirus
gaaggucaccaaacugcugca

SEQ ID NO: 3250802 - RNA, 14 nt, SARS coronavirus
ccuauuggagcugg

SEQ ID NO: 3250803 - RNA, 22 nt, SARS coronavirus
uacaauugucguuacugaaggu

SEQ ID NO: 3250804 - RNA, 13 nt, SARS coronavirus
acguacugccaca

SEQ ID NO: 3250805 - RNA, 14 nt, SARS coronavirus
cagcauggcaagga

SEQ ID NO: 3250806 - RNA, 23 nt, SARS coronavirus
ugccaaaaggcuucuacgcagag

SEQ ID NO: 3250807 - RNA, 21 nt, SARS coronavirus
auucaacccagaaacaaacau

SEQ ID NO: 3250808 - RNA, 21 nt, SARS coronavirus
ucuaugagggggguuuacuau

SEQ ID NO: 3250809 - RNA, 19 nt, SARS coronavirus
gugacaacagauguuucau

SEQ ID NO: 3250810 - RNA, 23 nt, SARS coronavirus
gucaagccucuucucgcuccuca

SEQ ID NO: 3250811 - RNA, 21 nt, SARS coronavirus
cauggaugauuucuccagaca

SEQ ID NO: 3250812 - RNA, 17 nt, SARS coronavirus
ucuccgggggacaauug

SEQ ID NO: 3250813 - RNA, 19 nt, SARS coronavirus
accuuuaagugcuauggcg

SEQ ID NO: 3250814 - RNA, 16 nt, SARS coronavirus
cucaggcauaaacacu

SEQ ID NO: 3250815 - RNA, 20 nt, SARS coronavirus
aaaauuccaugaguggagcu

SEQ ID NO: 3250816 - RNA, 20 nt, SARS coronavirus
caagggugcaugcucuugug

SEQ ID NO: 3250817 - RNA, 21 nt, SARS coronavirus
aauuuuagagccauucuuaca

SEQ ID NO: 3250818 - RNA, 16 nt, SARS coronavirus
aucuuggcgacauuuc

SEQ ID NO: 3250819 - RNA, 21 nt, SARS coronavirus
caccauuaagagaaagacaga

SEQ ID NO: 3250820 - RNA, 17 nt, SARS coronavirus
cgaacuuauguacucau

SEQ ID NO: 3250821 - RNA, 13 nt, SARS coronavirus
caauggacuuaca

SEQ ID NO: 3250822 - RNA, 18 nt, SARS coronavirus
uauucggaguuagaugau

SEQ ID NO: 3250823 - RNA, 23 nt, SARS coronavirus
aacugcccucgcgcuauugcugc

SEQ ID NO: 3250824 - RNA, 17 nt, SARS coronavirus
guccagaugaccaaauu

SEQ ID NO: 3250825 - RNA, 12 nt, SARS coronavirus
cgguacuauuac

SEQ ID NO: 3250826 - RNA, 23 nt, SARS coronavirus
aggaacuggcccagaagcuucac

SEQ ID NO: 3250827 - RNA, 14 nt, SARS coronavirus
cugauuacaaacau

SEQ ID NO: 3250828 - RNA, 19 nt, SARS coronavirus
uguucuuggacaaucaaaa

SEQ ID NO: 3250829 - RNA, 19 nt, SARS coronavirus
ugcuauuccuuguuuuaau

SEQ ID NO: 3250830 - RNA, 15 nt, SARS coronavirus
uucuuauuauuucuu

SEQ ID NO: 3250831 - RNA, 21 nt, SARS coronavirus
aggccaacaacaacaaggcca

SEQ ID NO: 3250832 - RNA, 16 nt, SARS coronavirus
ucuuugcuguuucuaa

SEQ ID NO: 3250833 - RNA, 15 nt, SARS coronavirus
auuucaaccauuuca

SEQ ID NO: 3250834 - RNA, 20 nt, SARS coronavirus
uugccucaagggugcaugcu

SEQ ID NO: 3250835 - RNA, 13 nt, SARS coronavirus
uucuguuuggaac

SEQ ID NO: 3250836 - RNA, 17 nt, SARS coronavirus
aaauauuagacauuuca

SEQ ID NO: 3250837 - RNA, 16 nt, SARS coronavirus
cuagggcgcugugaca

SEQ ID NO: 3250838 - RNA, 16 nt, SARS coronavirus
cucaaagaagacuacc

SEQ ID NO: 3250839 - RNA, 14 nt, SARS coronavirus
uaccuucaugaagg

SEQ ID NO: 3250840 - RNA, 12 nt, SARS coronavirus
uguuauugcuga

SEQ ID NO: 3250841 - RNA, 12 nt, SARS coronavirus
gcugguggugcg

SEQ ID NO: 3250842 - RNA, 18 nt, SARS coronavirus
ugcaauuuacugcugcua

SEQ ID NO: 3250843 - RNA, 14 nt, SARS coronavirus
cacugauguuucua

SEQ ID NO: 3250844 - RNA, 17 nt, SARS coronavirus
acaagccucacucccuu

SEQ ID NO: 3250845 - RNA, 23 nt, SARS coronavirus
gaacuugucauuggugcugugau

SEQ ID NO: 3250846 - RNA, 14 nt, SARS coronavirus
uggugaaacugccc

SEQ ID NO: 3250847 - RNA, 18 nt, SARS coronavirus
gccacuuuuucucauugu

SEQ ID NO: 3250848 - RNA, 19 nt, SARS coronavirus
ucacuaagaaaucugcugc

SEQ ID NO: 3250849 - RNA, 22 nt, SARS coronavirus
ucaauagugagacaauuauuua

SEQ ID NO: 3250850 - RNA, 22 nt, SARS coronavirus
caacacuagggguaauacuuau

SEQ ID NO: 3250851 - RNA, 13 nt, SARS coronavirus
ugauuacaaacau

SEQ ID NO: 3250852 - RNA, 14 nt, SARS coronavirus
uacaaaacauuccc

SEQ ID NO: 3250853 - RNA, 13 nt, SARS coronavirus
ucuauaucaagau

SEQ ID NO: 3250854 - RNA, 16 nt, SARS coronavirus
uaaacaacuccuggaa

SEQ ID NO: 3250855 - RNA, 15 nt, SARS coronavirus
acucaacauacuuca

SEQ ID NO: 3250856 - RNA, 15 nt, SARS coronavirus
caacuuccucaagga

SEQ ID NO: 3250857 - RNA, 14 nt, SARS coronavirus
accaauuuaacaag

SEQ ID NO: 3250858 - RNA, 17 nt, SARS coronavirus
ugcuaaucuugcugcua

SEQ ID NO: 3250859 - RNA, 13 nt, SARS coronavirus
cacacacuuugcu

SEQ ID NO: 3250860 - RNA, 22 nt, SARS coronavirus
gcacugauucagguuuugcugc

SEQ ID NO: 3250861 - RNA, 15 nt, SARS coronavirus
agaucaguuucacca

SEQ ID NO: 3250862 - RNA, 11 nt, SARS coronavirus
uucuccugcuc

SEQ ID NO: 3250863 - RNA, 20 nt, SARS coronavirus
gaggcaucuaaaaagccucg

SEQ ID NO: 3250864 - RNA, 18 nt, SARS coronavirus
uugcuuguuuugugcuug

SEQ ID NO: 3250865 - RNA, 16 nt, SARS coronavirus
cucaggauuuauuucu

SEQ ID NO: 3250866 - RNA, 12 nt, SARS coronavirus
gaaaaugcuaca

SEQ ID NO: 3250867 - RNA, 21 nt, SARS coronavirus
gaccccaagguuuacccaaua

SEQ ID NO: 3250868 - RNA, 20 nt, SARS coronavirus
uuugagagagacauaucuaa

SEQ ID NO: 3250869 - RNA, 21 nt, SARS coronavirus
uacuacagacaauacauuugu

SEQ ID NO: 3250870 - RNA, 21 nt, SARS coronavirus
acaacauugccaaaaggcuuc

SEQ ID NO: 3250871 - RNA, 23 nt, SARS coronavirus
aauacuuugcuucaccauuaaga

SEQ ID NO: 3250872 - RNA, 14 nt, SARS coronavirus
gugcguacugcugc

SEQ ID NO: 3250873 - RNA, 21 nt, SARS coronavirus
gcccucgcgcuauugcugcua

SEQ ID NO: 3250874 - RNA, 20 nt, SARS coronavirus
cauacugcugaacaagcaca

SEQ ID NO: 3250875 - RNA, 14 nt, SARS coronavirus
aaacgaacaugaaa

SEQ ID NO: 3250876 - RNA, 16 nt, SARS coronavirus
gauuucuccagacaac

SEQ ID NO: 3250877 - RNA, 22 nt, SARS coronavirus
guaacacaacaacuaaucaggg

SEQ ID NO: 3250878 - RNA, 17 nt, SARS coronavirus
gaggacuugaaagagcc

SEQ ID NO: 3250879 - RNA, 20 nt, SARS coronavirus
uggaagucacaccuucggga

SEQ ID NO: 3250880 - RNA, 17 nt, SARS coronavirus
uagugagacaauuauuu

SEQ ID NO: 3250881 - RNA, 16 nt, SARS coronavirus
ugaaugaucuuugcuu

SEQ ID NO: 3250882 - RNA, 14 nt, SARS coronavirus
ugcuccaagugccu

SEQ ID NO: 3250883 - RNA, 16 nt, SARS coronavirus
cucuaggaaagguuuu

SEQ ID NO: 3250884 - RNA, 22 nt, SARS coronavirus
uccuauuggagcuggcauuugu

SEQ ID NO: 3250885 - RNA, 16 nt, SARS coronavirus
uacaguguugccaccu

SEQ ID NO: 3250886 - RNA, 15 nt, SARS coronavirus
gacuugcucuuuaau

SEQ ID NO: 3250887 - RNA, 15 nt, SARS coronavirus
ucacuaagaaaucug

SEQ ID NO: 3250888 - RNA, 19 nt, SARS coronavirus
caugaguggagcuucugcu

SEQ ID NO: 3250889 - RNA, 13 nt, SARS coronavirus
gaacaacauugcc

SEQ ID NO: 3250890 - RNA, 20 nt, SARS coronavirus
acagccuuuucaccugcuca

SEQ ID NO: 3250891 - RNA, 14 nt, SARS coronavirus
caacaacaaggcca

SEQ ID NO: 3250892 - RNA, 19 nt, SARS coronavirus
cauuugguggacccacaga

SEQ ID NO: 3250893 - RNA, 21 nt, SARS coronavirus
uugccucaagggugcaugcuc

SEQ ID NO: 3250894 - RNA, 20 nt, SARS coronavirus
aggugcugauaguucaauug

SEQ ID NO: 3250895 - RNA, 16 nt, SARS coronavirus
aggacgcaauggggca

SEQ ID NO: 3250896 - RNA, 18 nt, SARS coronavirus
uucaagaaauucaacucc

SEQ ID NO: 3250897 - RNA, 14 nt, SARS coronavirus
cugccaaaagagau

SEQ ID NO: 3250898 - RNA, 14 nt, SARS coronavirus
agucuacacaaauu

SEQ ID NO: 3250899 - RNA, 14 nt, SARS coronavirus
ucuccagacaacuu

SEQ ID NO: 3250900 - RNA, 13 nt, SARS coronavirus
acaacaaggccaa

SEQ ID NO: 3250901 - RNA, 12 nt, SARS coronavirus
cguacugcugca

SEQ ID NO: 3250902 - RNA, 18 nt, SARS coronavirus
agugcgacauuccuauug

SEQ ID NO: 3250903 - RNA, 14 nt, SARS coronavirus
caaggccaaacugu

SEQ ID NO: 3250904 - RNA, 15 nt, SARS coronavirus
uaccaugaacaacaa

SEQ ID NO: 3250905 - RNA, 18 nt, SARS coronavirus
ugcacaccuaauguuacu

SEQ ID NO: 3250906 - RNA, 14 nt, SARS coronavirus
auacaaaacauucc

SEQ ID NO: 3250907 - RNA, 23 nt, SARS coronavirus
auucuguuuggaacuuuaacauu

SEQ ID NO: 3250908 - RNA, 15 nt, SARS coronavirus
ucgcuugauguuuca

SEQ ID NO: 3250909 - RNA, 12 nt, SARS coronavirus
uaauuacuacag

SEQ ID NO: 3250910 - RNA, 18 nt, SARS coronavirus
gcacaccuaauguuacua

SEQ ID NO: 3250911 - RNA, 17 nt, SARS coronavirus
ucgccacuuuuucucau

SEQ ID NO: 3250912 - RNA, 14 nt, SARS coronavirus
gguucacagcucuc

SEQ ID NO: 3250913 - RNA, 23 nt, SARS coronavirus
guuugcucguacccgcucaaugu

SEQ ID NO: 3250914 - RNA, 19 nt, SARS coronavirus
uucugaaggaguuccugau

SEQ ID NO: 3250915 - RNA, 19 nt, SARS coronavirus
ucauacaucaccagauguu

SEQ ID NO: 3250916 - RNA, 21 nt, SARS coronavirus
gacaaagauccacaauucaaa

SEQ ID NO: 3250917 - RNA, 22 nt, SARS coronavirus
auucaacccagaaacaaacauu

SEQ ID NO: 3250918 - RNA, 16 nt, SARS coronavirus
gugauauuaaugcuag

SEQ ID NO: 3250919 - RNA, 21 nt, SARS coronavirus
uguuauuggccauuaaaugau

SEQ ID NO: 3250920 - RNA, 21 nt, SARS coronavirus
augcuguugauuguucucaaa

SEQ ID NO: 3250921 - RNA, 15 nt, SARS coronavirus
ucaaagagauuucaa

SEQ ID NO: 3250922 - RNA, 20 nt, SARS coronavirus
ucuaauaacaccauugcuau

SEQ ID NO: 3250923 - RNA, 18 nt, SARS coronavirus
ccaagaccuaaucagaca

SEQ ID NO: 3250924 - RNA, 17 nt, SARS coronavirus
acugacaauaaccagaa

SEQ ID NO: 3250925 - RNA, 22 nt, SARS coronavirus
cuucugcuaaucuugcugcuac

SEQ ID NO: 3250926 - RNA, 17 nt, SARS coronavirus
augaaagagcucagccc

SEQ ID NO: 3250927 - RNA, 20 nt, SARS coronavirus
ugacggcaaaaugaaagagc

SEQ ID NO: 3250928 - RNA, 24 nt, SARS coronavirus
auuugcacuaacuugcacuagcac

SEQ ID NO: 3250929 - RNA, 15 nt, SARS coronavirus
uacuaaaaugucuga

SEQ ID NO: 3250930 - RNA, 15 nt, SARS coronavirus
cuugcugcugucuac

SEQ ID NO: 3250931 - RNA, 14 nt, SARS coronavirus
cucgcuccucauca

SEQ ID NO: 3250932 - RNA, 12 nt, SARS coronavirus
ccuaauguguaa

SEQ ID NO: 3250933 - RNA, 20 nt, SARS coronavirus
uuagacauuucaccuugcgc

SEQ ID NO: 3250934 - RNA, 15 nt, SARS coronavirus
ugagauguuggcuuu

SEQ ID NO: 3250935 - RNA, 22 nt, SARS coronavirus
uaacaacacaguuuaugauccu

SEQ ID NO: 3250936 - RNA, 15 nt, SARS coronavirus
gcugcaaguuugaug

SEQ ID NO: 3250937 - RNA, 22 nt, SARS coronavirus
aacuaacuauuauuauuauucu

SEQ ID NO: 3250938 - RNA, 12 nt, SARS coronavirus
uucaaacaugca

SEQ ID NO: 3250939 - RNA, 19 nt, SARS coronavirus
caauggggcaaggccaaaa

SEQ ID NO: 3250940 - RNA, 20 nt, SARS coronavirus
augguucaaacaugcacacc

SEQ ID NO: 3250941 - RNA, 15 nt, SARS coronavirus
uaugguucaaacaug

SEQ ID NO: 3250942 - RNA, 22 nt, SARS coronavirus
uguccuuuuggagagguuuuua

SEQ ID NO: 3250943 - RNA, 18 nt, SARS coronavirus
guugcuguucuauaucaa

SEQ ID NO: 3250944 - RNA, 19 nt, SARS coronavirus
ggagccuugaauacaccca

SEQ ID NO: 3250945 - RNA, 15 nt, SARS coronavirus
cacuagcacacacuu

SEQ ID NO: 3250946 - RNA, 17 nt, SARS coronavirus
auugacaaugcuucucc

SEQ ID NO: 3250947 - RNA, 16 nt, SARS coronavirus
cuuguaagguacaaca

SEQ ID NO: 3250948 - RNA, 14 nt, SARS coronavirus
auacacccaaagac

SEQ ID NO: 3250949 - RNA, 13 nt, SARS coronavirus
caauaaauuugca

SEQ ID NO: 3250950 - RNA, 17 nt, SARS coronavirus
uaauuguguugcugauu

SEQ ID NO: 3250951 - RNA, 21 nt, SARS coronavirus
uuauuuaagccucuaacuaag

SEQ ID NO: 3250952 - RNA, 14 nt, SARS coronavirus
aaaagaagcagccc

SEQ ID NO: 3250953 - RNA, 22 nt, SARS coronavirus
cgauaaugcauuuaauugcacu

SEQ ID NO: 3250954 - RNA, 18 nt, SARS coronavirus
uagauucccucgaggcca

SEQ ID NO: 3250955 - RNA, 17 nt, SARS coronavirus
cuucaaaauuccaugag

SEQ ID NO: 3250956 - RNA, 21 nt, SARS coronavirus
agggcuuccaguucauuugca

SEQ ID NO: 3250957 - RNA, 14 nt, SARS coronavirus
caagauccagcugg

SEQ ID NO: 3250958 - RNA, 17 nt, SARS coronavirus
gcggcagucaagccucu

SEQ ID NO: 3250959 - RNA, 21 nt, SARS coronavirus
cacucucagguauugcugcug

SEQ ID NO: 3250960 - RNA, 12 nt, SARS coronavirus
ccuuucugcuau

SEQ ID NO: 3250961 - RNA, 13 nt, SARS coronavirus
ugccuauucuaau

SEQ ID NO: 3250962 - RNA, 21 nt, SARS coronavirus
uccuaauuacacucaacauac

SEQ ID NO: 3250963 - RNA, 12 nt, SARS coronavirus
gaguacauaucu

SEQ ID NO: 3250964 - RNA, 14 nt, SARS coronavirus
uaagguacaacacu

SEQ ID NO: 3250965 - RNA, 24 nt, SARS coronavirus
guuacaaucuugcuuuguugcaug

SEQ ID NO: 3250966 - RNA, 17 nt, SARS coronavirus
gcacaccuaauguuacu

SEQ ID NO: 3250967 - RNA, 22 nt, SARS coronavirus
auucaacugacaauaaccagaa

SEQ ID NO: 3250968 - RNA, 21 nt, SARS coronavirus
ggaacauacgagggcaauuca

SEQ ID NO: 3250969 - RNA, 22 nt, SARS coronavirus
uuuaagugcuauggcguuucug

SEQ ID NO: 3250970 - RNA, 17 nt, SARS coronavirus
ccaagaccuaaucagac

SEQ ID NO: 3250971 - RNA, 22 nt, SARS coronavirus
uguuuuaauaaugcuuauuaua

SEQ ID NO: 3250972 - RNA, 20 nt, SARS coronavirus
ucaagcauuaaacacacuug

SEQ ID NO: 3250973 - RNA, 20 nt, SARS coronavirus
uaaccagaaugcucaagcau

SEQ ID NO: 3250974 - RNA, 14 nt, SARS coronavirus
caugaugaccacac

SEQ ID NO: 3250975 - RNA, 21 nt, SARS coronavirus
uuucaggauugcuauuuggaa

SEQ ID NO: 3250976 - RNA, 20 nt, SARS coronavirus
agacagauugaaccagcuug

SEQ ID NO: 3250977 - RNA, 16 nt, SARS coronavirus
cagagccuaaaaagga

SEQ ID NO: 3250978 - RNA, 12 nt, SARS coronavirus
acuuuucaauua

SEQ ID NO: 3250979 - RNA, 14 nt, SARS coronavirus
aaauuuuagagcca

SEQ ID NO: 3250980 - RNA, 17 nt, SARS coronavirus
cuacacugcugcucuag

SEQ ID NO: 3250981 - RNA, 14 nt, SARS coronavirus
acugaugaagcuca

SEQ ID NO: 3250982 - RNA, 17 nt, SARS coronavirus
acuuacgagaguuugug

SEQ ID NO: 3250983 - RNA, 12 nt, SARS coronavirus
aaaucaaauguu

SEQ ID NO: 3250984 - RNA, 16 nt, SARS coronavirus
aggaacuuagauuccc

SEQ ID NO: 3250985 - RNA, 13 nt, SARS coronavirus
auacaguuucuuu

SEQ ID NO: 3250986 - RNA, 18 nt, SARS coronavirus
ugcuuugcuaguacagua

SEQ ID NO: 3250987 - RNA, 19 nt, SARS coronavirus
gacgaguucguggugguga

SEQ ID NO: 3250988 - RNA, 21 nt, SARS coronavirus
caaauucaagaaucacuuaca

SEQ ID NO: 3250989 - RNA, 19 nt, SARS coronavirus
caggauugcuauuuggaau

SEQ ID NO: 3250990 - RNA, 13 nt, SARS coronavirus
ugcuaauuugcuu

SEQ ID NO: 3250991 - RNA, 14 nt, SARS coronavirus
aaucagacaaggaa

SEQ ID NO: 3250992 - RNA, 22 nt, SARS coronavirus
ugcuuguuuugugcuugcugcu

SEQ ID NO: 3250993 - RNA, 14 nt, SARS coronavirus
auuggaugacaaag

SEQ ID NO: 3250994 - RNA, 23 nt, SARS coronavirus
acucuuagaucaauuacugcaca

SEQ ID NO: 3250995 - RNA, 21 nt, SARS coronavirus
aggaacugauuacaaacauug

SEQ ID NO: 3250996 - RNA, 12 nt, SARS coronavirus
uuugaacuuuua

SEQ ID NO: 3250997 - RNA, 20 nt, SARS coronavirus
uauaaauuaaauacagacca

SEQ ID NO: 3250998 - RNA, 15 nt, SARS coronavirus
uugugcuaguuacca

SEQ ID NO: 3250999 - RNA, 13 nt, SARS coronavirus
ugcaguugccuca

SEQ ID NO: 3251000 - RNA, 19 nt, SARS coronavirus
ccgugcuacaacuuccuca

SEQ ID NO: 3251001 - RNA, 17 nt, SARS coronavirus
aucuugcugcuacuaaa

SEQ ID NO: 3251002 - RNA, 20 nt, SARS coronavirus
ccgugcuacaacuuccucaa

SEQ ID NO: 3251003 - RNA, 16 nt, SARS coronavirus
uaagaagaauuauucg

SEQ ID NO: 3251004 - RNA, 21 nt, SARS coronavirus
ccauccuuacugcgcuucgau

SEQ ID NO: 3251005 - RNA, 23 nt, SARS coronavirus
aggagauguugugagauucccua

SEQ ID NO: 3251006 - RNA, 17 nt, SARS coronavirus
uacuacaauuugccuau

SEQ ID NO: 3251007 - RNA, 14 nt, SARS coronavirus
uuacaaauuuuaga

SEQ ID NO: 3251008 - RNA, 20 nt, SARS coronavirus
uuguacauaauaaagcuugu

SEQ ID NO: 3251009 - RNA, 14 nt, SARS coronavirus
ugcacuagcacaca

SEQ ID NO: 3251010 - RNA, 19 nt, SARS coronavirus
ucauuggugcugugaucau

SEQ ID NO: 3251011 - RNA, 21 nt, SARS coronavirus
aaaccuugcaccccaccugcu

SEQ ID NO: 3251012 - RNA, 15 nt, SARS coronavirus
cucuugcugacaaua

SEQ ID NO: 3251013 - RNA, 13 nt, SARS coronavirus
uuuucaaccuuua

SEQ ID NO: 3251014 - RNA, 12 nt, SARS coronavirus
caaagaccacau

SEQ ID NO: 3251015 - RNA, 12 nt, SARS coronavirus
aggaacuucuuu

SEQ ID NO: 3251016 - RNA, 18 nt, SARS coronavirus
caagauguuaacugcacu

SEQ ID NO: 3251017 - RNA, 16 nt, SARS coronavirus
cuaagaggucuuuuau

SEQ ID NO: 3251018 - RNA, 22 nt, SARS coronavirus
auuauaaauugccagaugauuu

SEQ ID NO: 3251019 - RNA, 22 nt, SARS coronavirus
ugaccagaccgcucauggaaag

SEQ ID NO: 3251020 - RNA, 14 nt, SARS coronavirus
uuguugacuuccag

SEQ ID NO: 3251021 - RNA, 14 nt, SARS coronavirus
cauugauuguauuu

SEQ ID NO: 3251022 - RNA, 20 nt, SARS coronavirus
gguaauacuuauagcacugc

SEQ ID NO: 3251023 - RNA, 13 nt, SARS coronavirus
auauauuaaaugg

SEQ ID NO: 3251024 - RNA, 20 nt, SARS coronavirus
caccauuucacccucuugcu

SEQ ID NO: 3251025 - RNA, 19 nt, SARS coronavirus
gccagggcguuccaaucaa

SEQ ID NO: 3251026 - RNA, 18 nt, SARS coronavirus
uggggcaaggccaaaaca

SEQ ID NO: 3251027 - RNA, 20 nt, SARS coronavirus
augagauguuggcuuuguug

SEQ ID NO: 3251028 - RNA, 17 nt, SARS coronavirus
ccuggcagcaguagggg

SEQ ID NO: 3251029 - RNA, 15 nt, SARS coronavirus
caauuuacugcugcu

SEQ ID NO: 3251030 - RNA, 15 nt, SARS coronavirus
uugccaccucugcuc

SEQ ID NO: 3251031 - RNA, 15 nt, SARS coronavirus
aauucaacuccuggc

SEQ ID NO: 3251032 - RNA, 15 nt, SARS coronavirus
aagagauuucaacca

SEQ ID NO: 3251033 - RNA, 20 nt, SARS coronavirus
aaauuauucucuuccugaca

SEQ ID NO: 3251034 - RNA, 17 nt, SARS coronavirus
cagaugguacuucuauu

SEQ ID NO: 3251035 - RNA, 20 nt, SARS coronavirus
acucuuagaucaauuacugc

SEQ ID NO: 3251036 - RNA, 16 nt, SARS coronavirus
cuaaaaaggacaaaaa

SEQ ID NO: 3251037 - RNA, 23 nt, SARS coronavirus
ugcaugggagagaaaaaaaauuu

SEQ ID NO: 3251038 - RNA, 19 nt, SARS coronavirus
uggcuacuaccgaagagcu

SEQ ID NO: 3251039 - RNA, 17 nt, SARS coronavirus
aacgaacuuauggauuu

SEQ ID NO: 3251040 - RNA, 21 nt, SARS coronavirus
caagaccuaaucagacaagga

SEQ ID NO: 3251041 - RNA, 13 nt, SARS coronavirus
gguauugcugcug

SEQ ID NO: 3251042 - RNA, 23 nt, SARS coronavirus
augaaggucaccaaacugcugca

SEQ ID NO: 3251043 - RNA, 19 nt, SARS coronavirus
ccucgcgcuauugcugcua

SEQ ID NO: 3251044 - RNA, 13 nt, SARS coronavirus
uaacuaaacagca

SEQ ID NO: 3251045 - RNA, 13 nt, SARS coronavirus
cucugugcucuac

SEQ ID NO: 3251046 - RNA, 20 nt, SARS coronavirus
agccauucuuacagccuuuu

SEQ ID NO: 3251047 - RNA, 19 nt, SARS coronavirus
cuauuccuuguuuuaauaa

SEQ ID NO: 3251048 - RNA, 22 nt, SARS coronavirus
acguacuuguuguuuuaaauaa

SEQ ID NO: 3251049 - RNA, 19 nt, SARS coronavirus
ugacuuccagguuacaaua

SEQ ID NO: 3251050 - RNA, 18 nt, SARS coronavirus
augugcuaauuugcuucu

SEQ ID NO: 3251051 - RNA, 18 nt, SARS coronavirus
ucccaccaacagagccua

SEQ ID NO: 3251052 - RNA, 18 nt, SARS coronavirus
uugacuuguauuucucua

SEQ ID NO: 3251053 - RNA, 20 nt, SARS coronavirus
uggcuacuaccgaagagcua

SEQ ID NO: 3251054 - RNA, 16 nt, SARS coronavirus
cguacccgcucaaugu

SEQ ID NO: 3251055 - RNA, 22 nt, SARS coronavirus
guacgacuguacuacuaaaaga

SEQ ID NO: 3251056 - RNA, 12 nt, SARS coronavirus
auuauuaacaau

SEQ ID NO: 3251057 - RNA, 20 nt, SARS coronavirus
ucacuuuaauugacuucuau

SEQ ID NO: 3251058 - RNA, 19 nt, SARS coronavirus
uaccaaccuuacagaguug

SEQ ID NO: 3251059 - RNA, 13 nt, SARS coronavirus
caaucaacaccaa

SEQ ID NO: 3251060 - RNA, 20 nt, SARS coronavirus
ucauucguuucggaagaaac

SEQ ID NO: 3251061 - RNA, 16 nt, SARS coronavirus
ccuauuggagcuggca

SEQ ID NO: 3251062 - RNA, 19 nt, SARS coronavirus
cugaaguugcuguucuaua

SEQ ID NO: 3251063 - RNA, 19 nt, SARS coronavirus
uguuggaagugcaaaucca

SEQ ID NO: 3251064 - RNA, 15 nt, SARS coronavirus
uguuucugauuucac

SEQ ID NO: 3251065 - RNA, 18 nt, SARS coronavirus
gccuauuuuguuggcuau

SEQ ID NO: 3251066 - RNA, 18 nt, SARS coronavirus
acuucuauuaccuaggaa

SEQ ID NO: 3251067 - RNA, 17 nt, SARS coronavirus
aggcggcagucaagccu

SEQ ID NO: 3251068 - RNA, 13 nt, SARS coronavirus
ugaagcucagccu

SEQ ID NO: 3251069 - RNA, 15 nt, SARS coronavirus
gacgugguccagaac

SEQ ID NO: 3251070 - RNA, 15 nt, SARS coronavirus
gcuucuccugcaagu

SEQ ID NO: 3251071 - RNA, 17 nt, SARS coronavirus
augcaguugcauaugca

SEQ ID NO: 3251072 - RNA, 19 nt, SARS coronavirus
gaguugcuaauccagcaau

SEQ ID NO: 3251073 - RNA, 21 nt, SARS coronavirus
ugacaacccuuucuuugcugu

SEQ ID NO: 3251074 - RNA, 12 nt, SARS coronavirus
aaaaucuauugu

SEQ ID NO: 3251075 - RNA, 21 nt, SARS coronavirus
ucaaguaugaugaaaauggua

SEQ ID NO: 3251076 - RNA, 18 nt, SARS coronavirus
gacuuucaggauugcuau

SEQ ID NO: 3251077 - RNA, 17 nt, SARS coronavirus
cuugcuagucacacuag

SEQ ID NO: 3251078 - RNA, 23 nt, SARS coronavirus
cacugaugauaugauugcugccu

SEQ ID NO: 3251079 - RNA, 23 nt, SARS coronavirus
uuuaccagaccucuaauuucagg

SEQ ID NO: 3251080 - RNA, 20 nt, SARS coronavirus
aaaagacugaugaagcucag

SEQ ID NO: 3251081 - RNA, 13 nt, SARS coronavirus
cguuucugccacu

SEQ ID NO: 3251082 - RNA, 12 nt, SARS coronavirus
agagacaaaaga

SEQ ID NO: 3251083 - RNA, 21 nt, SARS coronavirus
uccaugaguggagcuucugcu

SEQ ID NO: 3251084 - RNA, 18 nt, SARS coronavirus
uugcuggacuaauugcca

SEQ ID NO: 3251085 - RNA, 18 nt, SARS coronavirus
agacauaucuaaugugcc

SEQ ID NO: 3251086 - RNA, 21 nt, SARS coronavirus
cgcauuggcauggaagucaca

SEQ ID NO: 3251087 - RNA, 13 nt, SARS coronavirus
acuaaauucccuu

SEQ ID NO: 3251088 - RNA, 18 nt, SARS coronavirus
guuaccaucuauucacau

SEQ ID NO: 3251089 - RNA, 20 nt, SARS coronavirus
auugugugcguacugcugca

SEQ ID NO: 3251090 - RNA, 16 nt, SARS coronavirus
ccugcucgaauggcua

SEQ ID NO: 3251091 - RNA, 18 nt, SARS coronavirus
uggugguuauucugagga

SEQ ID NO: 3251092 - RNA, 21 nt, SARS coronavirus
caagaaauucaacuccuggca

SEQ ID NO: 3251093 - RNA, 15 nt, SARS coronavirus
ucucauuguugcugc

SEQ ID NO: 3251094 - RNA, 20 nt, SARS coronavirus
ugucaagauccagcuggugg

SEQ ID NO: 3251095 - RNA, 13 nt, SARS coronavirus
cgcuauugcugcu

SEQ ID NO: 3251096 - RNA, 21 nt, SARS coronavirus
uuuaaggaugguauuuauuuu

SEQ ID NO: 3251097 - RNA, 21 nt, SARS coronavirus
acuaaucagggcugcugaaau

SEQ ID NO: 3251098 - RNA, 17 nt, SARS coronavirus
uaccuuuuaaggauggu

SEQ ID NO: 3251099 - RNA, 22 nt, SARS coronavirus
cgggggacaauugugaccagac

SEQ ID NO: 3251100 - RNA, 14 nt, SARS coronavirus
ugguaccuucauga

SEQ ID NO: 3251101 - RNA, 19 nt, SARS coronavirus
cucguacccgcucaaugug

SEQ ID NO: 3251102 - RNA, 20 nt, SARS coronavirus
auuacuacagaaguaaugcc

SEQ ID NO: 3251103 - RNA, 16 nt, SARS coronavirus
cucaugugcuugaaga

SEQ ID NO: 3251104 - RNA, 14 nt, SARS coronavirus
augaaacuucucau

SEQ ID NO: 3251105 - RNA, 14 nt, SARS coronavirus
ugcuuccuucaggc

SEQ ID NO: 3251106 - RNA, 15 nt, SARS coronavirus
cuugacucauucaaa

SEQ ID NO: 3251107 - RNA, 19 nt, SARS coronavirus
uggcuagcggaggugguga

SEQ ID NO: 3251108 - RNA, 15 nt, SARS coronavirus
ggugcaugcucuugu

SEQ ID NO: 3251109 - RNA, 22 nt, SARS coronavirus
aaggaacugauuacaaacauug

SEQ ID NO: 3251110 - RNA, 15 nt, SARS coronavirus
accagcuugagagca

SEQ ID NO: 3251111 - RNA, 20 nt, SARS coronavirus
uuacaccuggaacaaaugcu

SEQ ID NO: 3251112 - RNA, 16 nt, SARS coronavirus
aaagccucgccaaaaa

SEQ ID NO: 3251113 - RNA, 24 nt, SARS coronavirus
cuugcuuucgugguauucuugcua

SEQ ID NO: 3251114 - RNA, 12 nt, SARS coronavirus
cguugcauuucu

SEQ ID NO: 3251115 - RNA, 16 nt, SARS coronavirus
cugcaaguuugaugag

SEQ ID NO: 3251116 - RNA, 12 nt, SARS coronavirus
auacuucaucua

SEQ ID NO: 3251117 - RNA, 22 nt, SARS coronavirus
cuguuuuucagagcgcuaccaa

SEQ ID NO: 3251118 - RNA, 17 nt, SARS coronavirus
uucucauuguuuugacu

SEQ ID NO: 3251119 - RNA, 22 nt, SARS coronavirus
gcuuguuuugugcuugcugcug

SEQ ID NO: 3251120 - RNA, 18 nt, SARS coronavirus
ucaagucaaacaaaugua

SEQ ID NO: 3251121 - RNA, 19 nt, SARS coronavirus
cacucagguguuaaagacu

SEQ ID NO: 3251122 - RNA, 17 nt, SARS coronavirus
ggucaccaaacugcugc

SEQ ID NO: 3251123 - RNA, 16 nt, SARS coronavirus
accgcuacaagccuca

SEQ ID NO: 3251124 - RNA, 17 nt, SARS coronavirus
gcacacacuuugcuuuu

SEQ ID NO: 3251125 - RNA, 14 nt, SARS coronavirus
caauugcuuacucu

SEQ ID NO: 3251126 - RNA, 13 nt, SARS coronavirus
ugugacucuucuu

SEQ ID NO: 3251127 - RNA, 22 nt, SARS coronavirus
auuuaagccucuaacuaagaag

SEQ ID NO: 3251128 - RNA, 21 nt, SARS coronavirus
cuucaggcuguuugcucguac

SEQ ID NO: 3251129 - RNA, 19 nt, SARS coronavirus
gcugccuacacugcugcuc

SEQ ID NO: 3251130 - RNA, 15 nt, SARS coronavirus
aaacaaacauucuuc

SEQ ID NO: 3251131 - RNA, 22 nt, SARS coronavirus
ucacucauugaccuucaagaau

SEQ ID NO: 3251132 - RNA, 21 nt, SARS coronavirus
acaaguagguuuaguuaacuu

SEQ ID NO: 3251133 - RNA, 17 nt, SARS coronavirus
acugccacaaaacagua

SEQ ID NO: 3251134 - RNA, 16 nt, SARS coronavirus
uauugaggacuugcuc

SEQ ID NO: 3251135 - RNA, 20 nt, SARS coronavirus
ucaagaaucacuuacaacaa

SEQ ID NO: 3251136 - RNA, 19 nt, SARS coronavirus
gcugaacucaaaugcucug

SEQ ID NO: 3251137 - RNA, 20 nt, SARS coronavirus
uacaucaccagauguugauc

SEQ ID NO: 3251138 - RNA, 12 nt, SARS coronavirus
gaaaucagggcu

SEQ ID NO: 3251139 - RNA, 15 nt, SARS coronavirus
uuguugcugcucuag

SEQ ID NO: 3251140 - RNA, 14 nt, SARS coronavirus
uaaacaacuccugg

SEQ ID NO: 3251141 - RNA, 21 nt, SARS coronavirus
acguacugccacaaaacagua

SEQ ID NO: 3251142 - RNA, 20 nt, SARS coronavirus
uuacagaguuguaguacuuu

SEQ ID NO: 3251143 - RNA, 21 nt, SARS coronavirus
acuaugguucaaacaugcaca

SEQ ID NO: 3251144 - RNA, 18 nt, SARS coronavirus
cuugcuuguuuugugcuu

SEQ ID NO: 3251145 - RNA, 16 nt, SARS coronavirus
aguacuguucaugcua

SEQ ID NO: 3251146 - RNA, 17 nt, SARS coronavirus
uuucugauuucacugau

SEQ ID NO: 3251147 - RNA, 15 nt, SARS coronavirus
gucuaaacgaacaug

SEQ ID NO: 3251148 - RNA, 22 nt, SARS coronavirus
cacacgugaaguguucgcucaa

SEQ ID NO: 3251149 - RNA, 22 nt, SARS coronavirus
ugguaccuucaugaaggucacc

SEQ ID NO: 3251150 - RNA, 21 nt, SARS coronavirus
aacgaacaugaaaauuauucu

SEQ ID NO: 3251151 - RNA, 12 nt, SARS coronavirus
auaacaaugcug

SEQ ID NO: 3251152 - RNA, 23 nt, SARS coronavirus
cuugauauauuuucuacaaugca

SEQ ID NO: 3251153 - RNA, 14 nt, SARS coronavirus
acaauucuacuaau

SEQ ID NO: 3251154 - RNA, 11 nt, SARS coronavirus
gaaacaaacau

SEQ ID NO: 3251155 - RNA, 21 nt, SARS coronavirus
uagggaggacuugaaagagcc

SEQ ID NO: 3251156 - RNA, 17 nt, SARS coronavirus
gacaaguacuucaaaaa

SEQ ID NO: 3251157 - RNA, 18 nt, SARS coronavirus
uauggcguuucugccacu

SEQ ID NO: 3251158 - RNA, 18 nt, SARS coronavirus
auugugugcguacugcug

SEQ ID NO: 3251159 - RNA, 17 nt, SARS coronavirus
acgcauacaaaacauuc

SEQ ID NO: 3251160 - RNA, 17 nt, SARS coronavirus
aucuugacguuauaaua

SEQ ID NO: 3251161 - RNA, 21 nt, SARS coronavirus
ugaaggucaccaaacugcugc

SEQ ID NO: 3251162 - RNA, 12 nt, SARS coronavirus
cuucucaaugug

SEQ ID NO: 3251163 - RNA, 15 nt, SARS coronavirus
gccccccgcauuaca

SEQ ID NO: 3251164 - RNA, 21 nt, SARS coronavirus
ugccaccgugcuacaacuucc

SEQ ID NO: 3251165 - RNA, 21 nt, SARS coronavirus
ccuugcaccccaccugcucuu

SEQ ID NO: 3251166 - RNA, 17 nt, SARS coronavirus
cuagggcgcugugacau

SEQ ID NO: 3251167 - RNA, 17 nt, SARS coronavirus
ccgcagagacaaaagaa

SEQ ID NO: 3251168 - RNA, 23 nt, SARS coronavirus
cuucugguuuuaacacuuugaaa

SEQ ID NO: 3251169 - RNA, 18 nt, SARS coronavirus
ucuuccauuuuauucuaa

SEQ ID NO: 3251170 - RNA, 17 nt, SARS coronavirus
ugugucaauuuuaauuu

SEQ ID NO: 3251171 - RNA, 14 nt, SARS coronavirus
uauugauuaucauu

SEQ ID NO: 3251172 - RNA, 18 nt, SARS coronavirus
cugacuuaucauggagcc

SEQ ID NO: 3251173 - RNA, 21 nt, SARS coronavirus
ugcacuaacuugcacuagcac

SEQ ID NO: 3251174 - RNA, 15 nt, SARS coronavirus
caggaucuagaagaa

SEQ ID NO: 3251175 - RNA, 13 nt, SARS coronavirus
aagacuaccaaau

SEQ ID NO: 3251176 - RNA, 20 nt, SARS coronavirus
aagucagguaauuuuaaaca

SEQ ID NO: 3251177 - RNA, 17 nt, SARS coronavirus
agaacccauuacuuuau

SEQ ID NO: 3251178 - RNA, 12 nt, SARS coronavirus
augcuucaucug

SEQ ID NO: 3251179 - RNA, 23 nt, SARS coronavirus
acuacuuuguuugcuggcacaca

SEQ ID NO: 3251180 - RNA, 14 nt, SARS coronavirus
ucuuguggccagua

SEQ ID NO: 3251181 - RNA, 20 nt, SARS coronavirus
cuugcuagucacacuagcca

SEQ ID NO: 3251182 - RNA, 11 nt, SARS coronavirus
ggagaggaacu

SEQ ID NO: 3251183 - RNA, 20 nt, SARS coronavirus
gaaagguuuuaccuuuucau

SEQ ID NO: 3251184 - RNA, 20 nt, SARS coronavirus
acuaagaaaucugcugcuga

SEQ ID NO: 3251185 - RNA, 14 nt, SARS coronavirus
gcagauucuuuugu

SEQ ID NO: 3251186 - RNA, 16 nt, SARS coronavirus
auaauuacuacagaca

SEQ ID NO: 3251187 - RNA, 14 nt, SARS coronavirus
accaaacugcugca

SEQ ID NO: 3251188 - RNA, 20 nt, SARS coronavirus
aggacaaaaagaaaaagacu

SEQ ID NO: 3251189 - RNA, 15 nt, SARS coronavirus
caaacccaaggaaau

SEQ ID NO: 3251190 - RNA, 21 nt, SARS coronavirus
cuagccauccuuacugcgcuu

SEQ ID NO: 3251191 - RNA, 18 nt, SARS coronavirus
acagagccuaaaaaggac

SEQ ID NO: 3251192 - RNA, 13 nt, SARS coronavirus
cucagguauugcu

SEQ ID NO: 3251193 - RNA, 16 nt, SARS coronavirus
acauggcuauuucacc

SEQ ID NO: 3251194 - RNA, 12 nt, SARS coronavirus
uucaagaaauuc

SEQ ID NO: 3251195 - RNA, 18 nt, SARS coronavirus
cggagguacaaauugaca

SEQ ID NO: 3251196 - RNA, 20 nt, SARS coronavirus
cauugcuauaccuacuaacu

SEQ ID NO: 3251197 - RNA, 15 nt, SARS coronavirus
augaucuuugcuucu

SEQ ID NO: 3251198 - RNA, 23 nt, SARS coronavirus
agcugcaagacguuguuaaccag

SEQ ID NO: 3251199 - RNA, 18 nt, SARS coronavirus
guuuuuaaugcuacuaaa

SEQ ID NO: 3251200 - RNA, 18 nt, SARS coronavirus
aggccaacaacaacaagg

SEQ ID NO: 3251201 - RNA, 13 nt, SARS coronavirus
uccagaacaaacc

SEQ ID NO: 3251202 - RNA, 18 nt, SARS coronavirus
cagaggaacuucuuuucu

SEQ ID NO: 3251203 - RNA, 14 nt, SARS coronavirus
agcgccagcaauuu

SEQ ID NO: 3251204 - RNA, 20 nt, SARS coronavirus
gucacgcauuggcauggaag

SEQ ID NO: 3251205 - RNA, 12 nt, SARS coronavirus
aucauuaacaac

SEQ ID NO: 3251206 - RNA, 18 nt, SARS coronavirus
ggcaaaaugaaagagcuc

SEQ ID NO: 3251207 - RNA, 16 nt, SARS coronavirus
uggcccagaagcuuca

SEQ ID NO: 3251208 - RNA, 15 nt, SARS coronavirus
gcugcagguauggag

SEQ ID NO: 3251209 - RNA, 18 nt, SARS coronavirus
augucgacacuucuuaug

SEQ ID NO: 3251210 - RNA, 23 nt, SARS coronavirus
gcuucugucgucaacauucaaaa

SEQ ID NO: 3251211 - RNA, 19 nt, SARS coronavirus
uggaugauuucuccagaca

SEQ ID NO: 3251212 - RNA, 13 nt, SARS coronavirus
ucuucuuccugcg

SEQ ID NO: 3251213 - RNA, 19 nt, SARS coronavirus
auucgauaaugcauuuaau

SEQ ID NO: 3251214 - RNA, 23 nt, SARS coronavirus
aggaacaacauugccaaaaggcu

SEQ ID NO: 3251215 - RNA, 11 nt, SARS coronavirus
aagcucagccu

SEQ ID NO: 3251216 - RNA, 15 nt, SARS coronavirus
agcacaaguagguuu

SEQ ID NO: 3251217 - RNA, 13 nt, SARS coronavirus
uugcugaacucaa

SEQ ID NO: 3251218 - RNA, 21 nt, SARS coronavirus
gauugugugcguacugcugca

SEQ ID NO: 3251219 - RNA, 19 nt, SARS coronavirus
aaaauuauucucuuccuga

SEQ ID NO: 3251220 - RNA, 15 nt, SARS coronavirus
ugucgucaacauuca

SEQ ID NO: 3251221 - RNA, 23 nt, SARS coronavirus
ugaaagagccaccacauuuucau

SEQ ID NO: 3251222 - RNA, 19 nt, SARS coronavirus
auguuacuaucaacuguca

SEQ ID NO: 3251223 - RNA, 15 nt, SARS coronavirus
uaaaaauuuaaauga

SEQ ID NO: 3251224 - RNA, 22 nt, SARS coronavirus
auuaaauggccuugguauguuu

SEQ ID NO: 3251225 - RNA, 20 nt, SARS coronavirus
agcucucacucagcauggca

SEQ ID NO: 3251226 - RNA, 16 nt, SARS coronavirus
guucaugcuacagcaa

SEQ ID NO: 3251227 - RNA, 23 nt, SARS coronavirus
caaaaagaaaaagacugaugaag

SEQ ID NO: 3251228 - RNA, 15 nt, SARS coronavirus
ugcuggcacacacau

SEQ ID NO: 3251229 - RNA, 15 nt, SARS coronavirus
uuuucaucagacaag

SEQ ID NO: 3251230 - RNA, 14 nt, SARS coronavirus
gaaaucugcugcug

SEQ ID NO: 3251231 - RNA, 17 nt, SARS coronavirus
cagcucucacucagcau

SEQ ID NO: 3251232 - RNA, 19 nt, SARS coronavirus
auuucuaauuguguugcug

SEQ ID NO: 3251233 - RNA, 16 nt, SARS coronavirus
aaugugcaaauacaca

SEQ ID NO: 3251234 - RNA, 14 nt, SARS coronavirus
auuagacauuucac

SEQ ID NO: 3251235 - RNA, 20 nt, SARS coronavirus
acucagguguuaaagacuau

SEQ ID NO: 3251236 - RNA, 18 nt, SARS coronavirus
cagcugcagccuauuuug

SEQ ID NO: 3251237 - RNA, 18 nt, SARS coronavirus
acuuccucaaggaacaac

SEQ ID NO: 3251238 - RNA, 16 nt, SARS coronavirus
acgaacaugaaacuuc

SEQ ID NO: 3251239 - RNA, 17 nt, SARS coronavirus
uucacaucuuuugcuug

SEQ ID NO: 3251240 - RNA, 20 nt, SARS coronavirus
uguugucuuccuacauguca

SEQ ID NO: 3251241 - RNA, 13 nt, SARS coronavirus
uucucuuccugac

SEQ ID NO: 3251242 - RNA, 16 nt, SARS coronavirus
gcauuucaacaccaaa

SEQ ID NO: 3251243 - RNA, 19 nt, SARS coronavirus
uguaggcuugauguggcuu

SEQ ID NO: 3251244 - RNA, 19 nt, SARS coronavirus
acccaaggaaauuucgggg

SEQ ID NO: 3251245 - RNA, 18 nt, SARS coronavirus
ugacuucuauuugugcuu

SEQ ID NO: 3251246 - RNA, 17 nt, SARS coronavirus
uccauaaaacgaacaug

SEQ ID NO: 3251247 - RNA, 19 nt, SARS coronavirus
gcaguugccucaagggugc

SEQ ID NO: 3251248 - RNA, 13 nt, SARS coronavirus
cacugcugcucua

SEQ ID NO: 3251249 - RNA, 14 nt, SARS coronavirus
uggcauggaaguca

SEQ ID NO: 3251250 - RNA, 15 nt, SARS coronavirus
acccucuugcugaca

SEQ ID NO: 3251251 - RNA, 18 nt, SARS coronavirus
gcugccaccgugcuacaa

SEQ ID NO: 3251252 - RNA, 14 nt, SARS coronavirus
uaaaugauauccuu

SEQ ID NO: 3251253 - RNA, 22 nt, SARS coronavirus
uuaaugcuacuaaauucccuuc

SEQ ID NO: 3251254 - RNA, 19 nt, SARS coronavirus
gagcugccuauauggaaga

SEQ ID NO: 3251255 - RNA, 15 nt, SARS coronavirus
uggaaugucacgcau

SEQ ID NO: 3251256 - RNA, 18 nt, SARS coronavirus
ucaaauaccuuuugcuau

SEQ ID NO: 3251257 - RNA, 17 nt, SARS coronavirus
gcuugagucuacacaaa

SEQ ID NO: 3251258 - RNA, 23 nt, SARS coronavirus
guucauuugcaauuuacugcugc

SEQ ID NO: 3251259 - RNA, 14 nt, SARS coronavirus
auuuugguuuucac

SEQ ID NO: 3251260 - RNA, 14 nt, SARS coronavirus
caugacuaguuguu

SEQ ID NO: 3251261 - RNA, 17 nt, SARS coronavirus
uuucaucuuguugacuu

SEQ ID NO: 3251262 - RNA, 20 nt, SARS coronavirus
uggagagguuuuuaaugcua

SEQ ID NO: 3251263 - RNA, 13 nt, SARS coronavirus
auuuuaauagcuu

SEQ ID NO: 3251264 - RNA, 17 nt, SARS coronavirus
augugcaaauacacaca

SEQ ID NO: 3251265 - RNA, 17 nt, SARS coronavirus
uucccaccaacagagcc

SEQ ID NO: 3251266 - RNA, 12 nt, SARS coronavirus
ggcucuucagga

SEQ ID NO: 3251267 - RNA, 20 nt, SARS coronavirus
cauuggcuaccaaccuuaca

SEQ ID NO: 3251268 - RNA, 15 nt, SARS coronavirus
guaaugccuguuucu

SEQ ID NO: 3251269 - RNA, 16 nt, SARS coronavirus
accugccaaaagagau

SEQ ID NO: 3251270 - RNA, 21 nt, SARS coronavirus
cuacaugucacguaugugcca

SEQ ID NO: 3251271 - RNA, 22 nt, SARS coronavirus
ugcaguugcauaugcacuguag

SEQ ID NO: 3251272 - RNA, 22 nt, SARS coronavirus
ugacaauaaccagaauggagga

SEQ ID NO: 3251273 - RNA, 15 nt, SARS coronavirus
ugaugccuuuucgcu

SEQ ID NO: 3251274 - RNA, 14 nt, SARS coronavirus
ugcugucuacagaa

SEQ ID NO: 3251275 - RNA, 22 nt, SARS coronavirus
aaaacguacugccacaaaacag

SEQ ID NO: 3251276 - RNA, 14 nt, SARS coronavirus
gaugaagcucagcc

SEQ ID NO: 3251277 - RNA, 15 nt, SARS coronavirus
cuaagaaaucugcug

SEQ ID NO: 3251278 - RNA, 17 nt, SARS coronavirus
gugcaccacuuuugaug

SEQ ID NO: 3251279 - RNA, 18 nt, SARS coronavirus
cgcaauggggcaaggcca

SEQ ID NO: 3251280 - RNA, 17 nt, SARS coronavirus
acugauuacaaacauug

SEQ ID NO: 3251281 - RNA, 11 nt, SARS coronavirus
caacaaggcca

SEQ ID NO: 3251282 - RNA, 22 nt, SARS coronavirus
acucauugaccuucaagaauug

SEQ ID NO: 3251283 - RNA, 13 nt, SARS coronavirus
acccaaagaccac

SEQ ID NO: 3251284 - RNA, 21 nt, SARS coronavirus
cugcaaguacuguucaugcua

SEQ ID NO: 3251285 - RNA, 20 nt, SARS coronavirus
uuuucaaccuuuaagugcua

SEQ ID NO: 3251286 - RNA, 14 nt, SARS coronavirus
uccagaacaaaccc

SEQ ID NO: 3251287 - RNA, 22 nt, SARS coronavirus
aaacauucccaccaacagagcc

SEQ ID NO: 3251288 - RNA, 18 nt, SARS coronavirus
cugcaaguacuguucaug

SEQ ID NO: 3251289 - RNA, 23 nt, SARS coronavirus
aaacugguguuauugcugauuau

SEQ ID NO: 3251290 - RNA, 19 nt, SARS coronavirus
ugauguuucugauuucacu

SEQ ID NO: 3251291 - RNA, 16 nt, SARS coronavirus
ugacucugagccaguu

SEQ ID NO: 3251292 - RNA, 19 nt, SARS coronavirus
cugaaugugcuaauuugcu

SEQ ID NO: 3251293 - RNA, 16 nt, SARS coronavirus
ugagagagacauaucu

SEQ ID NO: 3251294 - RNA, 19 nt, SARS coronavirus
aguuucugguaaaggccaa

SEQ ID NO: 3251295 - RNA, 15 nt, SARS coronavirus
agagacaaaagaagc

SEQ ID NO: 3251296 - RNA, 23 nt, SARS coronavirus
cuccgggggacaauugugaccag

SEQ ID NO: 3251297 - RNA, 16 nt, SARS coronavirus
cuaauccagcaaugga

SEQ ID NO: 3251298 - RNA, 16 nt, SARS coronavirus
cugaugaagcucagcc

SEQ ID NO: 3251299 - RNA, 16 nt, SARS coronavirus
uaacuaaacagcacaa

SEQ ID NO: 3251300 - RNA, 18 nt, SARS coronavirus
acuguacuacuaaaagaa

SEQ ID NO: 3251301 - RNA, 13 nt, SARS coronavirus
uuccuauuccuag

SEQ ID NO: 3251302 - RNA, 22 nt, SARS coronavirus
cacucagcauggcaaggaggaa

SEQ ID NO: 3251303 - RNA, 18 nt, SARS coronavirus
cuugguauuaacauuaca

SEQ ID NO: 3251304 - RNA, 15 nt, SARS coronavirus
cgaacuaacuauuau

SEQ ID NO: 3251305 - RNA, 17 nt, SARS coronavirus
gccuugaauacacccaa

SEQ ID NO: 3251306 - RNA, 21 nt, SARS coronavirus
cucaagucaaacaaauguaca

SEQ ID NO: 3251307 - RNA, 17 nt, SARS coronavirus
cuuugaaaccuauuuuu

SEQ ID NO: 3251308 - RNA, 21 nt, SARS coronavirus
auuucuuccauuuuauucuaa

SEQ ID NO: 3251309 - RNA, 17 nt, SARS coronavirus
gaguuagaugaugaaga

SEQ ID NO: 3251310 - RNA, 17 nt, SARS coronavirus
uuucaucgaggccacgc

SEQ ID NO: 3251311 - RNA, 21 nt, SARS coronavirus
guuguuaaccagaaugcucaa

SEQ ID NO: 3251312 - RNA, 14 nt, SARS coronavirus
cgugguccagaaca

SEQ ID NO: 3251313 - RNA, 15 nt, SARS coronavirus
cuuagaucaauuacu

SEQ ID NO: 3251314 - RNA, 23 nt, SARS coronavirus
uaaaacgaacaugaaaauuauuc

SEQ ID NO: 3251315 - RNA, 13 nt, SARS coronavirus
cauucuucucaau

SEQ ID NO: 3251316 - RNA, 20 nt, SARS coronavirus
ucuggcucuuguggccagua

SEQ ID NO: 3251317 - RNA, 21 nt, SARS coronavirus
gagauguuggcuuuguuggaa

SEQ ID NO: 3251318 - RNA, 15 nt, SARS coronavirus
cagcaguaggggaaa

SEQ ID NO: 3251319 - RNA, 18 nt, SARS coronavirus
guaaaaauugacaaugcu

SEQ ID NO: 3251320 - RNA, 15 nt, SARS coronavirus
cgcauacaaaacauu

SEQ ID NO: 3251321 - RNA, 15 nt, SARS coronavirus
cuuggcgacauuuca

SEQ ID NO: 3251322 - RNA, 22 nt, SARS coronavirus
guugcaguugccucaagggugc

SEQ ID NO: 3251323 - RNA, 13 nt, SARS coronavirus
uucaucgaggcca

SEQ ID NO: 3251324 - RNA, 12 nt, SARS coronavirus
aaauucaagaau

SEQ ID NO: 3251325 - RNA, 15 nt, SARS coronavirus
cuacugaaugugcua

SEQ ID NO: 3251326 - RNA, 13 nt, SARS coronavirus
aucuauuguggcu

SEQ ID NO: 3251327 - RNA, 14 nt, SARS coronavirus
uaacaaugcugcca

SEQ ID NO: 3251328 - RNA, 21 nt, SARS coronavirus
ucaacgcauguagaauuauua

SEQ ID NO: 3251329 - RNA, 24 nt, SARS coronavirus
ugcuucaccauuaagagaaagaca

SEQ ID NO: 3251330 - RNA, 16 nt, SARS coronavirus
agaacaaacccaagga

SEQ ID NO: 3251331 - RNA, 14 nt, SARS coronavirus
augcauuuaauugc

SEQ ID NO: 3251332 - RNA, 20 nt, SARS coronavirus
aagaccuaaucagacaagga

SEQ ID NO: 3251333 - RNA, 20 nt, SARS coronavirus
gcuagcccuuuauaagggcu

SEQ ID NO: 3251334 - RNA, 14 nt, SARS coronavirus
uugcuauuuggaau

SEQ ID NO: 3251335 - RNA, 13 nt, SARS coronavirus
ucauuaacaacac

SEQ ID NO: 3251336 - RNA, 16 nt, SARS coronavirus
cuacuaacuuuucaau

SEQ ID NO: 3251337 - RNA, 16 nt, SARS coronavirus
cacgaacgcuuucuua

SEQ ID NO: 3251338 - RNA, 14 nt, SARS coronavirus
cuggucuaaacgaa

SEQ ID NO: 3251339 - RNA, 14 nt, SARS coronavirus
gcaaauugcacaau

SEQ ID NO: 3251340 - RNA, 15 nt, SARS coronavirus
aacagagccuaaaaa

SEQ ID NO: 3251341 - RNA, 14 nt, SARS coronavirus
augaagcucagccu

SEQ ID NO: 3251342 - RNA, 23 nt, SARS coronavirus
accagaaugcucaagcauuaaac

SEQ ID NO: 3251343 - RNA, 21 nt, SARS coronavirus
cuaaguugaaugaucuuugcu

SEQ ID NO: 3251344 - RNA, 18 nt, SARS coronavirus
cacauugacgcauacaaa

SEQ ID NO: 3251345 - RNA, 19 nt, SARS coronavirus
cgguacucgacauaccuau

SEQ ID NO: 3251346 - RNA, 15 nt, SARS coronavirus
ucauuguugcugcuc

SEQ ID NO: 3251347 - RNA, 16 nt, SARS coronavirus
cuuugaaauauuuugg

SEQ ID NO: 3251348 - RNA, 16 nt, SARS coronavirus
uggugacggcaaaaug

SEQ ID NO: 3251349 - RNA, 18 nt, SARS coronavirus
ucaucugaaguugcuguu

SEQ ID NO: 3251350 - RNA, 17 nt, SARS coronavirus
cuacagaaguaaugccu

SEQ ID NO: 3251351 - RNA, 14 nt, SARS coronavirus
agauggguuucucu

SEQ ID NO: 3251352 - RNA, 13 nt, SARS coronavirus
cugcucgaauggc

SEQ ID NO: 3251353 - RNA, 13 nt, SARS coronavirus
aaagagccaccac

SEQ ID NO: 3251354 - RNA, 11 nt, SARS coronavirus
gcuugcugcug

SEQ ID NO: 3251355 - RNA, 17 nt, SARS coronavirus
cugauguuucuacagca

SEQ ID NO: 3251356 - RNA, 18 nt, SARS coronavirus
uugcuucuccaaugucua

SEQ ID NO: 3251357 - RNA, 20 nt, SARS coronavirus
ucaauaaaagauggcagcua

SEQ ID NO: 3251358 - RNA, 17 nt, SARS coronavirus
acuucuauuugugcuuu

SEQ ID NO: 3251359 - RNA, 22 nt, SARS coronavirus
cuugagagcaaaguuucuggua

SEQ ID NO: 3251360 - RNA, 22 nt, SARS coronavirus
uaugaugaaaaugguacaauca

SEQ ID NO: 3251361 - RNA, 22 nt, SARS coronavirus
ucuaguuagugguacugccacu

SEQ ID NO: 3251362 - RNA, 13 nt, SARS coronavirus
cuugaaagagcca

SEQ ID NO: 3251363 - RNA, 13 nt, SARS coronavirus
agacaacuucaaa

SEQ ID NO: 3251364 - RNA, 12 nt, SARS coronavirus
uuuaaguugccu

SEQ ID NO: 3251365 - RNA, 20 nt, SARS coronavirus
ucccuaauauuacaaacuug

SEQ ID NO: 3251366 - RNA, 22 nt, SARS coronavirus
ucaacugacaauaaccagaaug

SEQ ID NO: 3251367 - RNA, 14 nt, SARS coronavirus
uaucauuaugagga

SEQ ID NO: 3251368 - RNA, 22 nt, SARS coronavirus
uuuaacucaggauuuauuucuu

SEQ ID NO: 3251369 - RNA, 16 nt, SARS coronavirus
cuacuaccgaagagcu

SEQ ID NO: 3251370 - RNA, 20 nt, SARS coronavirus
ugacguuauaauaaguucaa

SEQ ID NO: 3251371 - RNA, 16 nt, SARS coronavirus
ucaaggaacaacauug

SEQ ID NO: 3251372 - RNA, 12 nt, SARS coronavirus
aguaugaugaaa

SEQ ID NO: 3251373 - RNA, 19 nt, SARS coronavirus
aggucaccaaacugcugca

SEQ ID NO: 3251374 - RNA, 17 nt, SARS coronavirus
uauuggccauuaaauga

SEQ ID NO: 3251375 - RNA, 19 nt, SARS coronavirus
ucaagugugcuaaaugaua

SEQ ID NO: 3251376 - RNA, 13 nt, SARS coronavirus
guguaaaauuaau

SEQ ID NO: 3251377 - RNA, 14 nt, SARS coronavirus
ugaugaccacacaa

SEQ ID NO: 3251378 - RNA, 23 nt, SARS coronavirus
augacaaagauccacaauucaaa

SEQ ID NO: 3251379 - RNA, 18 nt, SARS coronavirus
ccgcauuacauuuggugg

SEQ ID NO: 3251380 - RNA, 14 nt, SARS coronavirus
ugauauuaaugcua

SEQ ID NO: 3251381 - RNA, 18 nt, SARS coronavirus
caagggugucaaauuaca

SEQ ID NO: 3251382 - RNA, 21 nt, SARS coronavirus
gcaaguacuguucaugcuaca

SEQ ID NO: 3251383 - RNA, 19 nt, SARS coronavirus
agagacaaaagaagcagcc

SEQ ID NO: 3251384 - RNA, 21 nt, SARS coronavirus
guuagauuauccauaaaacga

SEQ ID NO: 3251385 - RNA, 19 nt, SARS coronavirus
ggcuacuaccgaagagcua

SEQ ID NO: 3251386 - RNA, 13 nt, SARS coronavirus
acguuauaauaag

SEQ ID NO: 3251387 - RNA, 24 nt, SARS coronavirus
ccuuuaagugcuauggcguuucug

SEQ ID NO: 3251388 - RNA, 16 nt, SARS coronavirus
auucuuuggaauguca

SEQ ID NO: 3251389 - RNA, 20 nt, SARS coronavirus
uuugcuugucgcugcaggua

SEQ ID NO: 3251390 - RNA, 16 nt, SARS coronavirus
ugacucuucuuccugc

SEQ ID NO: 3251391 - RNA, 21 nt, SARS coronavirus
cuggaacaaaugcuucaucug

SEQ ID NO: 3251392 - RNA, 15 nt, SARS coronavirus
caccauuaagagaaa

SEQ ID NO: 3251393 - RNA, 19 nt, SARS coronavirus
uacacucaacauacuucau

SEQ ID NO: 3251394 - RNA, 16 nt, SARS coronavirus
cagaggcggcagucaa

SEQ ID NO: 3251395 - RNA, 18 nt, SARS coronavirus
uuggaaugucacgcauug

SEQ ID NO: 3251396 - RNA, 16 nt, SARS coronavirus
gacaaagauccacaau

SEQ ID NO: 3251397 - RNA, 24 nt, SARS coronavirus
aaggcaucguauggguugcaacug

SEQ ID NO: 3251398 - RNA, 21 nt, SARS coronavirus
aucagacacucuuuauuuaac

SEQ ID NO: 3251399 - RNA, 18 nt, SARS coronavirus
caaauugcacaauuugcu

SEQ ID NO: 3251400 - RNA, 11 nt, SARS coronavirus
aucugcugcug

SEQ ID NO: 3251401 - RNA, 16 nt, SARS coronavirus
ucaacuccuggcagca

SEQ ID NO: 3251402 - RNA, 20 nt, SARS coronavirus
uaaauuugcacuaacuugca

SEQ ID NO: 3251403 - RNA, 22 nt, SARS coronavirus
uauucuacuggaaacaauguau

SEQ ID NO: 3251404 - RNA, 12 nt, SARS coronavirus
acuuuuaaaugc

SEQ ID NO: 3251405 - RNA, 19 nt, SARS coronavirus
uaacuaugacuacuguaua

SEQ ID NO: 3251406 - RNA, 18 nt, SARS coronavirus
caagcuccuaauuacacu

SEQ ID NO: 3251407 - RNA, 16 nt, SARS coronavirus
auacuuauagcacugc

SEQ ID NO: 3251408 - RNA, 16 nt, SARS coronavirus
gcugcugaaaucaggg

SEQ ID NO: 3251409 - RNA, 14 nt, SARS coronavirus
cauuaacgcuucug

SEQ ID NO: 3251410 - RNA, 13 nt, SARS coronavirus
aaaucugcugcug

SEQ ID NO: 3251411 - RNA, 12 nt, SARS coronavirus
gccacugcugga

SEQ ID NO: 3251412 - RNA, 19 nt, SARS coronavirus
aaacaguacaacgucacuc

SEQ ID NO: 3251413 - RNA, 14 nt, SARS coronavirus
guuagauuauccau

SEQ ID NO: 3251414 - RNA, 20 nt, SARS coronavirus
accaacagagccuaaaaagg

SEQ ID NO: 3251415 - RNA, 15 nt, SARS coronavirus
aauaaauuugcacua

SEQ ID NO: 3251416 - RNA, 23 nt, SARS coronavirus
aauauuacaaacuuguguccuuu

SEQ ID NO: 3251417 - RNA, 14 nt, SARS coronavirus
ccgugauguuucug

SEQ ID NO: 3251418 - RNA, 23 nt, SARS coronavirus
ugccacaaaacaguacaacguca

SEQ ID NO: 3251419 - RNA, 23 nt, SARS coronavirus
ucagacaaggaacugauuacaaa

SEQ ID NO: 3251420 - RNA, 21 nt, SARS coronavirus
ccuaggaacuggcccagaagc

SEQ ID NO: 3251421 - RNA, 17 nt, SARS coronavirus
aacgucacucaagcauu

SEQ ID NO: 3251422 - RNA, 17 nt, SARS coronavirus
aaauugacaaugcuucu

SEQ ID NO: 3251423 - RNA, 22 nt, SARS coronavirus
cuugucauuggugcugugauca

SEQ ID NO: 3251424 - RNA, 23 nt, SARS coronavirus
gaccacacaaggcagaugggcua

SEQ ID NO: 3251425 - RNA, 21 nt, SARS coronavirus
agaucaguuucaccaaaacuu

SEQ ID NO: 3251426 - RNA, 23 nt, SARS coronavirus
auguaguucgugaucuaccuucu

SEQ ID NO: 3251427 - RNA, 13 nt, SARS coronavirus
agccuuucugcua

SEQ ID NO: 3251428 - RNA, 17 nt, SARS coronavirus
acaauauugcuuugcua

SEQ ID NO: 3251429 - RNA, 16 nt, SARS coronavirus
uuuggugguuuuaauu

SEQ ID NO: 3251430 - RNA, 15 nt, SARS coronavirus
cccucgaggccaggg

SEQ ID NO: 3251431 - RNA, 19 nt, SARS coronavirus
guugacuuccagguuacaa

SEQ ID NO: 3251432 - RNA, 18 nt, SARS coronavirus
ccuaaucagacaaggaac

SEQ ID NO: 3251433 - RNA, 15 nt, SARS coronavirus
uagggguaauacuua

SEQ ID NO: 3251434 - RNA, 16 nt, SARS coronavirus
ucagguauugcugcug

SEQ ID NO: 3251435 - RNA, 14 nt, SARS coronavirus
accuuauguccuuc

SEQ ID NO: 3251436 - RNA, 23 nt, SARS coronavirus
ggacuugaaagagccaccacauu

SEQ ID NO: 3251437 - RNA, 24 nt, SARS coronavirus
guucaagcuccuaauuacacucaa

SEQ ID NO: 3251438 - RNA, 15 nt, SARS coronavirus
uacuacagacaauac

SEQ ID NO: 3251439 - RNA, 13 nt, SARS coronavirus
ugugucaauuuua

SEQ ID NO: 3251440 - RNA, 12 nt, SARS coronavirus
acuuauagcacu

SEQ ID NO: 3251441 - RNA, 23 nt, SARS coronavirus
aauaaugcuagggagagcugccu

SEQ ID NO: 3251442 - RNA, 18 nt, SARS coronavirus
uugcugccuacacugcug

SEQ ID NO: 3251443 - RNA, 14 nt, SARS coronavirus
uaugguucaaacau

SEQ ID NO: 3251444 - RNA, 18 nt, SARS coronavirus
gaacaaacccaaggaaau

SEQ ID NO: 3251445 - RNA, 18 nt, SARS coronavirus
uggaaacuauaaauuaaa

SEQ ID NO: 3251446 - RNA, 14 nt, SARS coronavirus
uaaucuugcugcua

SEQ ID NO: 3251447 - RNA, 16 nt, SARS coronavirus
gauugcgauugcaaug

SEQ ID NO: 3251448 - RNA, 19 nt, SARS coronavirus
aguucgugaucuaccuucu

SEQ ID NO: 3251449 - RNA, 18 nt, SARS coronavirus
ugacagguuaauuacagg

SEQ ID NO: 3251450 - RNA, 21 nt, SARS coronavirus
auguauuccagacucaagcag

SEQ ID NO: 3251451 - RNA, 14 nt, SARS coronavirus
caacaaggccaaac

SEQ ID NO: 3251452 - RNA, 15 nt, SARS coronavirus
cgaggccacgcggag

SEQ ID NO: 3251453 - RNA, 20 nt, SARS coronavirus
uuccugacauugauuguauu

SEQ ID NO: 3251454 - RNA, 20 nt, SARS coronavirus
uuaccagaccucuaauuuca

SEQ ID NO: 3251455 - RNA, 21 nt, SARS coronavirus
ccucaugugcuugaagauccu

SEQ ID NO: 3251456 - RNA, 14 nt, SARS coronavirus
augaaagagcucag

SEQ ID NO: 3251457 - RNA, 16 nt, SARS coronavirus
gcaauuuacugcugcu

SEQ ID NO: 3251458 - RNA, 19 nt, SARS coronavirus
uauuccuagccuggauuau

SEQ ID NO: 3251459 - RNA, 16 nt, SARS coronavirus
ucaccaaacugcugca

SEQ ID NO: 3251460 - RNA, 17 nt, SARS coronavirus
auucucuuccugacauu

SEQ ID NO: 3251461 - RNA, 14 nt, SARS coronavirus
cagguauugcugcu

SEQ ID NO: 3251462 - RNA, 16 nt, SARS coronavirus
cuggaacaauggaacc

SEQ ID NO: 3251463 - RNA, 23 nt, SARS coronavirus
cagaguuguaguacuuucuuuug

SEQ ID NO: 3251464 - RNA, 12 nt, SARS coronavirus
gcuauugcugcu

SEQ ID NO: 3251465 - RNA, 14 nt, SARS coronavirus
acgucauacugcug

SEQ ID NO: 3251466 - RNA, 19 nt, SARS coronavirus
ugcuagagaucucauuugu

SEQ ID NO: 3251467 - RNA, 14 nt, SARS coronavirus
gaaguugcuguucu

SEQ ID NO: 3251468 - RNA, 21 nt, SARS coronavirus
ggcaaaaugaaagagcucagc

SEQ ID NO: 3251469 - RNA, 13 nt, SARS coronavirus
cacaucuuuugcu

SEQ ID NO: 3251470 - RNA, 13 nt, SARS coronavirus
guaguacuuucuu

SEQ ID NO: 3251471 - RNA, 15 nt, SARS coronavirus
uacagccuuuucacc

SEQ ID NO: 3251472 - RNA, 15 nt, SARS coronavirus
uaacugcacugaugu

SEQ ID NO: 3251473 - RNA, 13 nt, SARS coronavirus
ucuuaggagaaug

SEQ ID NO: 3251474 - RNA, 22 nt, SARS coronavirus
uuuguacauaauaaagcuuguu

SEQ ID NO: 3251475 - RNA, 18 nt, SARS coronavirus
cuuuugaugauguucaag

SEQ ID NO: 3251476 - RNA, 13 nt, SARS coronavirus
gcucaauaaaaga

SEQ ID NO: 3251477 - RNA, 15 nt, SARS coronavirus
ccuauuuuguuggcu

SEQ ID NO: 3251478 - RNA, 13 nt, SARS coronavirus
acaaauaauuacu

SEQ ID NO: 3251479 - RNA, 19 nt, SARS coronavirus
cucagccuuugccgcagag

SEQ ID NO: 3251480 - RNA, 17 nt, SARS coronavirus
gaaugaucuuugcuucu

SEQ ID NO: 3251481 - RNA, 16 nt, SARS coronavirus
cuaaucuugcugcuac

SEQ ID NO: 3251482 - RNA, 16 nt, SARS coronavirus
uaauaacaaugcugcc

SEQ ID NO: 3251483 - RNA, 19 nt, SARS coronavirus
cuacuucguugcuuccuuc

SEQ ID NO: 3251484 - RNA, 13 nt, SARS coronavirus
cuauugcugcuag

SEQ ID NO: 3251485 - RNA, 16 nt, SARS coronavirus
ucuccugcaaguacug

SEQ ID NO: 3251486 - RNA, 18 nt, SARS coronavirus
cgaaugugcaaauacaca

SEQ ID NO: 3251487 - RNA, 20 nt, SARS coronavirus
ugcuggacuaauugccaucg

SEQ ID NO: 3251488 - RNA, 20 nt, SARS coronavirus
guuuuaauaaugcuuauuau

SEQ ID NO: 3251489 - RNA, 22 nt, SARS coronavirus
acuuugcuucaccauuaagaga

SEQ ID NO: 3251490 - RNA, 13 nt, SARS coronavirus
uuuacugcugcua

SEQ ID NO: 3251491 - RNA, 22 nt, SARS coronavirus
auuucaaccauuucaacaauuu

SEQ ID NO: 3251492 - RNA, 12 nt, SARS coronavirus
ucgaggccaggg

SEQ ID NO: 3251493 - RNA, 16 nt, SARS coronavirus
gcugaacaagcacauu

SEQ ID NO: 3251494 - RNA, 23 nt, SARS coronavirus
caacagagccuaaaaaggacaaa

SEQ ID NO: 3251495 - RNA, 14 nt, SARS coronavirus
cuugaaagagccac

SEQ ID NO: 3251496 - RNA, 13 nt, SARS coronavirus
gacaaaggaauuu

SEQ ID NO: 3251497 - RNA, 13 nt, SARS coronavirus
cuaacuugcacua

SEQ ID NO: 3251498 - RNA, 18 nt, SARS coronavirus
caaucacagaugcuguug

SEQ ID NO: 3251499 - RNA, 17 nt, SARS coronavirus
cuaagaaaucugcugcu

SEQ ID NO: 3251500 - RNA, 15 nt, SARS coronavirus
ccaccucugcucacu

SEQ ID NO: 3251501 - RNA, 15 nt, SARS coronavirus
cagcccacugugacu

SEQ ID NO: 3251502 - RNA, 21 nt, SARS coronavirus
acgacaauauugcuuugcuag

SEQ ID NO: 3251503 - RNA, 23 nt, SARS coronavirus
uaggaacuggcccagaagcuuca

SEQ ID NO: 3251504 - RNA, 20 nt, SARS coronavirus
uggugacggcaaaaugaaag

SEQ ID NO: 3251505 - RNA, 15 nt, SARS coronavirus
uacuucguugcuucc

SEQ ID NO: 3251506 - RNA, 23 nt, SARS coronavirus
uccaugaguggagcuucugcuga

SEQ ID NO: 3251507 - RNA, 15 nt, SARS coronavirus
cuuuuucuugcuuuc

SEQ ID NO: 3251508 - RNA, 22 nt, SARS coronavirus
ugaugccuuuucgcuugauguu

SEQ ID NO: 3251509 - RNA, 18 nt, SARS coronavirus
ugcaacugagggagccuu

SEQ ID NO: 3251510 - RNA, 16 nt, SARS coronavirus
gcauguaacuuugaau

SEQ ID NO: 3251511 - RNA, 16 nt, SARS coronavirus
augucgacacuucuua

SEQ ID NO: 3251512 - RNA, 20 nt, SARS coronavirus
auugacgcauacaaaacauu

SEQ ID NO: 3251513 - RNA, 20 nt, SARS coronavirus
cauaacuaugacuacuguau

SEQ ID NO: 3251514 - RNA, 24 nt, SARS coronavirus
ugcugacgguacucgacauaccua

SEQ ID NO: 3251515 - RNA, 16 nt, SARS coronavirus
caagucaaacaaaugu

SEQ ID NO: 3251516 - RNA, 20 nt, SARS coronavirus
caaaaugaaagagcucagcc

SEQ ID NO: 3251517 - RNA, 18 nt, SARS coronavirus
auggaguuagauuaucca

SEQ ID NO: 3251518 - RNA, 22 nt, SARS coronavirus
aggucgcuaaaaauuuaaauga

SEQ ID NO: 3251519 - RNA, 18 nt, SARS coronavirus
uuaggagaaugacaaaaa

SEQ ID NO: 3251520 - RNA, 20 nt, SARS coronavirus
ugauuccguucgagauccua

SEQ ID NO: 3251521 - RNA, 16 nt, SARS coronavirus
acguagugccccccgc

SEQ ID NO: 3251522 - RNA, 16 nt, SARS coronavirus
cagaugguacuucuau

SEQ ID NO: 3251523 - RNA, 18 nt, SARS coronavirus
caguugcauaugcacugu

SEQ ID NO: 3251524 - RNA, 14 nt, SARS coronavirus
ugcucaaguaugau

SEQ ID NO: 3251525 - RNA, 22 nt, SARS coronavirus
cuuuaggugcugauaguucaau

SEQ ID NO: 3251526 - RNA, 14 nt, SARS coronavirus
ucaccaaacugcug

SEQ ID NO: 3251527 - RNA, 14 nt, SARS coronavirus
ugaacucuucugaa

SEQ ID NO: 3251528 - RNA, 16 nt, SARS coronavirus
uagugguacugccacu

SEQ ID NO: 3251529 - RNA, 18 nt, SARS coronavirus
uuuacaucuugcgagcua

SEQ ID NO: 3251530 - RNA, 14 nt, SARS coronavirus
cuuuucaucagaca

SEQ ID NO: 3251531 - RNA, 22 nt, SARS coronavirus
ugcccucgcgcuauugcugcua

SEQ ID NO: 3251532 - RNA, 22 nt, SARS coronavirus
gcugccuauauggaagagcccu

SEQ ID NO: 3251533 - RNA, 21 nt, SARS coronavirus
ucacagcucucacucagcaug

SEQ ID NO: 3251534 - RNA, 22 nt, SARS coronavirus
aaggacaaaaagaaaaagacug

SEQ ID NO: 3251535 - RNA, 14 nt, SARS coronavirus
aucucacauagcaa

SEQ ID NO: 3251536 - RNA, 15 nt, SARS coronavirus
uuguugcaguugccu

SEQ ID NO: 3251537 - RNA, 20 nt, SARS coronavirus
cugccaaaagagaucacugu

SEQ ID NO: 3251538 - RNA, 16 nt, SARS coronavirus
aaggaccugccaaaag

SEQ ID NO: 3251539 - RNA, 21 nt, SARS coronavirus
uuuaauagcuucuuaggagaa

SEQ ID NO: 3251540 - RNA, 22 nt, SARS coronavirus
agcucuaauuuuggugcaauuu

SEQ ID NO: 3251541 - RNA, 19 nt, SARS coronavirus
gacaauuauuuaagccucu

SEQ ID NO: 3251542 - RNA, 12 nt, SARS coronavirus
cucacucagcau

SEQ ID NO: 3251543 - RNA, 16 nt, SARS coronavirus
cugcagccuauuuugu

SEQ ID NO: 3251544 - RNA, 18 nt, SARS coronavirus
uaacugcacugauguuuc

SEQ ID NO: 3251545 - RNA, 20 nt, SARS coronavirus
cuguaguacagcgcugugca

SEQ ID NO: 3251546 - RNA, 21 nt, SARS coronavirus
cuugaauacacccaaagacca

SEQ ID NO: 3251547 - RNA, 12 nt, SARS coronavirus
uacauuacacau

SEQ ID NO: 3251548 - RNA, 12 nt, SARS coronavirus
ugaugaagcuca

SEQ ID NO: 3251549 - RNA, 20 nt, SARS coronavirus
cuugauauauuuucuacaau

SEQ ID NO: 3251550 - RNA, 13 nt, SARS coronavirus
auugggcaagcug

SEQ ID NO: 3251551 - RNA, 14 nt, SARS coronavirus
cuauccugaugaaa

SEQ ID NO: 3251552 - RNA, 14 nt, SARS coronavirus
gucauucaacccag

SEQ ID NO: 3251553 - RNA, 13 nt, SARS coronavirus
gcucaaugugguc

SEQ ID NO: 3251554 - RNA, 16 nt, SARS coronavirus
ucuagaagaaccuugu

SEQ ID NO: 3251555 - RNA, 14 nt, SARS coronavirus
cucacucagcaugg

SEQ ID NO: 3251556 - RNA, 14 nt, SARS coronavirus
uggaacaaaugcuu

SEQ ID NO: 3251557 - RNA, 15 nt, SARS coronavirus
gcuagggagagcugc

SEQ ID NO: 3251558 - RNA, 16 nt, SARS coronavirus
gcaagacguuguuaac

SEQ ID NO: 3251559 - RNA, 18 nt, SARS coronavirus
ugccuauauggaagagcc

SEQ ID NO: 3251560 - RNA, 18 nt, SARS coronavirus
ucuuggcgacauuucagg

SEQ ID NO: 3251561 - RNA, 16 nt, SARS coronavirus
cuugcgaauggccgga

SEQ ID NO: 3251562 - RNA, 15 nt, SARS coronavirus
uugagagagacauau

SEQ ID NO: 3251563 - RNA, 14 nt, SARS coronavirus
cauucuuacagccu

SEQ ID NO: 3251564 - RNA, 23 nt, SARS coronavirus
ggcaaaaugaaagagcucagccc

SEQ ID NO: 3251565 - RNA, 23 nt, SARS coronavirus
gcauuacauuugguggacccaca

SEQ ID NO: 3251566 - RNA, 14 nt, SARS coronavirus
ccccaccugcucuu

SEQ ID NO: 3251567 - RNA, 21 nt, SARS coronavirus
caugaaggucaccaaacugcu

SEQ ID NO: 3251568 - RNA, 21 nt, SARS coronavirus
cuaauaaaccucaugugcuug

SEQ ID NO: 3251569 - RNA, 19 nt, SARS coronavirus
agaaagugaguacgaacuu

SEQ ID NO: 3251570 - RNA, 16 nt, SARS coronavirus
gguucuugcugcaagu

SEQ ID NO: 3251571 - RNA, 14 nt, SARS coronavirus
aggguuucauacua

SEQ ID NO: 3251572 - RNA, 20 nt, SARS coronavirus
ucaagaaauucaacuccugg

SEQ ID NO: 3251573 - RNA, 20 nt, SARS coronavirus
cuaugucuuuaggugcugau

SEQ ID NO: 3251574 - RNA, 14 nt, SARS coronavirus
cuuauaggagcuga

SEQ ID NO: 3251575 - RNA, 14 nt, SARS coronavirus
cuauuuguuaccau

SEQ ID NO: 3251576 - RNA, 13 nt, SARS coronavirus
gcuugugcugacg

SEQ ID NO: 3251577 - RNA, 14 nt, SARS coronavirus
auuuacugcugcua

SEQ ID NO: 3251578 - RNA, 16 nt, SARS coronavirus
ugcuggacuaauugcc

SEQ ID NO: 3251579 - RNA, 22 nt, SARS coronavirus
uucaauagugagacaauuauuu

SEQ ID NO: 3251580 - RNA, 21 nt, SARS coronavirus
ugucacgcauuggcauggaag

SEQ ID NO: 3251581 - RNA, 18 nt, SARS coronavirus
ucuucaaagagauuucaa

SEQ ID NO: 3251582 - RNA, 12 nt, SARS coronavirus
aagaagaauuau

SEQ ID NO: 3251583 - RNA, 21 nt, SARS coronavirus
uuauccauaaaacgaacauga

SEQ ID NO: 3251584 - RNA, 16 nt, SARS coronavirus
cucucagguauugcug

SEQ ID NO: 3251585 - RNA, 21 nt, SARS coronavirus
guauugaaaaugcuacauucu

SEQ ID NO: 3251586 - RNA, 17 nt, SARS coronavirus
uagucaagggagaugau

SEQ ID NO: 3251587 - RNA, 18 nt, SARS coronavirus
acacaaggcagaugggcu

SEQ ID NO: 3251588 - RNA, 15 nt, SARS coronavirus
gacacugguauugaa

SEQ ID NO: 3251589 - RNA, 23 nt, SARS coronavirus
cuaugcaguugcauaugcacugu

SEQ ID NO: 3251590 - RNA, 14 nt, SARS coronavirus
ugagauuuuuuacu

SEQ ID NO: 3251591 - RNA, 20 nt, SARS coronavirus
ucucaaaauccacuugcuga

SEQ ID NO: 3251592 - RNA, 16 nt, SARS coronavirus
aucaacaccaauagug

SEQ ID NO: 3251593 - RNA, 20 nt, SARS coronavirus
ccacagcgccagcaauuugu

SEQ ID NO: 3251594 - RNA, 14 nt, SARS coronavirus
aauuggaugacaaa

SEQ ID NO: 3251595 - RNA, 16 nt, SARS coronavirus
cuaaucagggcugcug

SEQ ID NO: 3251596 - RNA, 20 nt, SARS coronavirus
gcauugggcaagcugcaaga

SEQ ID NO: 3251597 - RNA, 15 nt, SARS coronavirus
cauucuucucaaugu

SEQ ID NO: 3251598 - RNA, 17 nt, SARS coronavirus
aagagaucacuguggcu

SEQ ID NO: 3251599 - RNA, 13 nt, SARS coronavirus
ccaccucugcuca

SEQ ID NO: 3251600 - RNA, 17 nt, SARS coronavirus
uaccauacaguuucuuu

SEQ ID NO: 3251601 - RNA, 12 nt, SARS coronavirus
uguuaacugcac

SEQ ID NO: 3251602 - RNA, 13 nt, SARS coronavirus
ucacaccagcuug

SEQ ID NO: 3251603 - RNA, 13 nt, SARS coronavirus
uccaaucaacacc

SEQ ID NO: 3251604 - RNA, 21 nt, SARS coronavirus
aauagugguccagaugaccaa

SEQ ID NO: 3251605 - RNA, 15 nt, SARS coronavirus
uugcugauuauaauu

SEQ ID NO: 3251606 - RNA, 23 nt, SARS coronavirus
guuucaccaaaacuuuucaucag

SEQ ID NO: 3251607 - RNA, 18 nt, SARS coronavirus
gaaaaaaaauuucuaauu

SEQ ID NO: 3251608 - RNA, 16 nt, SARS coronavirus
uauaaauugccagaug

SEQ ID NO: 3251609 - RNA, 17 nt, SARS coronavirus
cuuagcucuaauuuugg

SEQ ID NO: 3251610 - RNA, 15 nt, SARS coronavirus
uggagcuucugcuga

SEQ ID NO: 3251611 - RNA, 12 nt, SARS coronavirus
uuuuauucuaau

SEQ ID NO: 3251612 - RNA, 17 nt, SARS coronavirus
uguuacaggguuucaua

SEQ ID NO: 3251613 - RNA, 18 nt, SARS coronavirus
gugcaagaucaguuucac

SEQ ID NO: 3251614 - RNA, 19 nt, SARS coronavirus
gacuacuguauaccauaua

SEQ ID NO: 3251615 - RNA, 15 nt, SARS coronavirus
aagaaaucugcugcu

SEQ ID NO: 3251616 - RNA, 13 nt, SARS coronavirus
cuggaacaaaugc

SEQ ID NO: 3251617 - RNA, 13 nt, SARS coronavirus
aauuaaaaugucu

SEQ ID NO: 3251618 - RNA, 16 nt, SARS coronavirus
auaauuauaaauugcc

SEQ ID NO: 3251619 - RNA, 16 nt, SARS coronavirus
ccagcuugagucuaca

SEQ ID NO: 3251620 - RNA, 18 nt, SARS coronavirus
uaauacuuugcuucacca

SEQ ID NO: 3251621 - RNA, 23 nt, SARS coronavirus
ucauuugcaauuuacugcugcua

SEQ ID NO: 3251622 - RNA, 14 nt, SARS coronavirus
agaucacuguggcu

SEQ ID NO: 3251623 - RNA, 20 nt, SARS coronavirus
ccaacuacauuuaugcucaa

SEQ ID NO: 3251624 - RNA, 20 nt, SARS coronavirus
uuacuacagacacugguauu

SEQ ID NO: 3251625 - RNA, 15 nt, SARS coronavirus
aaccauuucaacaau

SEQ ID NO: 3251626 - RNA, 23 nt, SARS coronavirus
gaaacaaacauucuucucaaugu

SEQ ID NO: 3251627 - RNA, 17 nt, SARS coronavirus
ucacguaugugccaucc

SEQ ID NO: 3251628 - RNA, 20 nt, SARS coronavirus
cugcugauucaacucaggca

SEQ ID NO: 3251629 - RNA, 16 nt, SARS coronavirus
aaauauuagacauuuc

SEQ ID NO: 3251630 - RNA, 11 nt, SARS coronavirus
ugaaagagcuc

SEQ ID NO: 3251631 - RNA, 15 nt, SARS coronavirus
acauuucaggcauua

SEQ ID NO: 3251632 - RNA, 14 nt, SARS coronavirus
aagaagcagcccac

SEQ ID NO: 3251633 - RNA, 12 nt, SARS coronavirus
caaauuacuaca

SEQ ID NO: 3251634 - RNA, 22 nt, SARS coronavirus
gcaaauugcacaauuugcucca

SEQ ID NO: 3251635 - RNA, 13 nt, SARS coronavirus
cgaacaaauuaaa

SEQ ID NO: 3251636 - RNA, 13 nt, SARS coronavirus
auucagguuuugc

SEQ ID NO: 3251637 - RNA, 21 nt, SARS coronavirus
agucaagggagaugauguaag

SEQ ID NO: 3251638 - RNA, 19 nt, SARS coronavirus
acacuaugguucaaacaug

SEQ ID NO: 3251639 - RNA, 12 nt, SARS coronavirus
gacuaccaaauu

SEQ ID NO: 3251640 - RNA, 17 nt, SARS coronavirus
gcugcuauuuguuacca

SEQ ID NO: 3251641 - RNA, 14 nt, SARS coronavirus
aaucugaacucuuc

SEQ ID NO: 3251642 - RNA, 19 nt, SARS coronavirus
cuucuucaaagagauuuca

SEQ ID NO: 3251643 - RNA, 12 nt, SARS coronavirus
ugaaaauuauuc

SEQ ID NO: 3251644 - RNA, 19 nt, SARS coronavirus
cucagcauggcaaggagga

SEQ ID NO: 3251645 - RNA, 14 nt, SARS coronavirus
cuuuaaucaaugug

SEQ ID NO: 3251646 - RNA, 23 nt, SARS coronavirus
aauaaaccucaugugcuugaaga

SEQ ID NO: 3251647 - RNA, 15 nt, SARS coronavirus
ugcucuacaacucaa

SEQ ID NO: 3251648 - RNA, 13 nt, SARS coronavirus
ucuucaaauaccu

SEQ ID NO: 3251649 - RNA, 20 nt, SARS coronavirus
gacugaugaagcucagccuu

SEQ ID NO: 3251650 - RNA, 21 nt, SARS coronavirus
ggaacauggcugacuuaucau

SEQ ID NO: 3251651 - RNA, 17 nt, SARS coronavirus
ucuaaaaagccucgcca

SEQ ID NO: 3251652 - RNA, 15 nt, SARS coronavirus
caagugccucugcau

SEQ ID NO: 3251653 - RNA, 15 nt, SARS coronavirus
uaauacuuugcuuca

SEQ ID NO: 3251654 - RNA, 18 nt, SARS coronavirus
caacgucauacugcugaa

SEQ ID NO: 3251655 - RNA, 12 nt, SARS coronavirus
ucuaauuucagg

SEQ ID NO: 3251656 - RNA, 16 nt, SARS coronavirus
ugaaagagcucagccc

SEQ ID NO: 3251657 - RNA, 17 nt, SARS coronavirus
ucuuagaucaauuacug

SEQ ID NO: 3251658 - RNA, 13 nt, SARS coronavirus
auuuauuuugcug

SEQ ID NO: 3251659 - RNA, 19 nt, SARS coronavirus
auugcgauugcaauggcuu

SEQ ID NO: 3251660 - RNA, 18 nt, SARS coronavirus
cagcaauuugucaugaag

SEQ ID NO: 3251661 - RNA, 17 nt, SARS coronavirus
ucggauggcuuguuauu

SEQ ID NO: 3251662 - RNA, 21 nt, SARS coronavirus
uaccagaccucuaauuucagg

SEQ ID NO: 3251663 - RNA, 22 nt, SARS coronavirus
gugccucugcauucuuuggaau

SEQ ID NO: 3251664 - RNA, 15 nt, SARS coronavirus
acgcauacaaaacau

SEQ ID NO: 3251665 - RNA, 18 nt, SARS coronavirus
auuccagacucaagcagg

SEQ ID NO: 3251666 - RNA, 16 nt, SARS coronavirus
gaggacuugaaagagc

SEQ ID NO: 3251667 - RNA, 15 nt, SARS coronavirus
uaaagccaacuacau

SEQ ID NO: 3251668 - RNA, 15 nt, SARS coronavirus
caaagaagacuacca

SEQ ID NO: 3251669 - RNA, 19 nt, SARS coronavirus
ggcaaaaugaaagagcuca

SEQ ID NO: 3251670 - RNA, 18 nt, SARS coronavirus
ugcuauccccaugugauu

SEQ ID NO: 3251671 - RNA, 12 nt, SARS coronavirus
ucggauggcuug

SEQ ID NO: 3251672 - RNA, 18 nt, SARS coronavirus
acacagaggaacuucuuu

SEQ ID NO: 3251673 - RNA, 15 nt, SARS coronavirus
caccaaacugcugca

SEQ ID NO: 3251674 - RNA, 15 nt, SARS coronavirus
acuacaauuugccua

SEQ ID NO: 3251675 - RNA, 22 nt, SARS coronavirus
cucacugaugauaugauugcug

SEQ ID NO: 3251676 - RNA, 22 nt, SARS coronavirus
cacaccuucgggaacauggcug

SEQ ID NO: 3251677 - RNA, 23 nt, SARS coronavirus
aaaaucauacaucaccagauguu

SEQ ID NO: 3251678 - RNA, 14 nt, SARS coronavirus
ugauuguauuuaca

SEQ ID NO: 3251679 - RNA, 21 nt, SARS coronavirus
caauuuggccgugauguuucu

SEQ ID NO: 3251680 - RNA, 17 nt, SARS coronavirus
gucaagccucuucucgc

SEQ ID NO: 3251681 - RNA, 13 nt, SARS coronavirus
ucugucuaugcau

SEQ ID NO: 3251682 - RNA, 20 nt, SARS coronavirus
augcuacuaaauucccuucu

SEQ ID NO: 3251683 - RNA, 15 nt, SARS coronavirus
caaauaauuacuaca

SEQ ID NO: 3251684 - RNA, 22 nt, SARS coronavirus
acugcacagccaguaaaaauug

SEQ ID NO: 3251685 - RNA, 17 nt, SARS coronavirus
acccgacgaguucgugg

SEQ ID NO: 3251686 - RNA, 15 nt, SARS coronavirus
auuucggggaccaag

SEQ ID NO: 3251687 - RNA, 17 nt, SARS coronavirus
cagcgccgaccccaagg

SEQ ID NO: 3251688 - RNA, 20 nt, SARS coronavirus
gcugugaucauucgugguca

SEQ ID NO: 3251689 - RNA, 18 nt, SARS coronavirus
uugcauaugcacuguagu

SEQ ID NO: 3251690 - RNA, 21 nt, SARS coronavirus
caauugcuuacucuaauaaca

SEQ ID NO: 3251691 - RNA, 13 nt, SARS coronavirus
cuaauauuacaaa

SEQ ID NO: 3251692 - RNA, 22 nt, SARS coronavirus
uucaacccagaaacaaacauuc

SEQ ID NO: 3251693 - RNA, 18 nt, SARS coronavirus
caagugugcuaaaugaua

SEQ ID NO: 3251694 - RNA, 17 nt, SARS coronavirus
uaacagugucacagaua

SEQ ID NO: 3251695 - RNA, 16 nt, SARS coronavirus
aauagcguacuucuuu

SEQ ID NO: 3251696 - RNA, 13 nt, SARS coronavirus
auuucuuccauuu

SEQ ID NO: 3251697 - RNA, 22 nt, SARS coronavirus
agucgaggcggagguacaaauu

SEQ ID NO: 3251698 - RNA, 21 nt, SARS coronavirus
caucacgaacgcuuucuuauu

SEQ ID NO: 3251699 - RNA, 12 nt, SARS coronavirus
acacucuuuauu

SEQ ID NO: 3251700 - RNA, 21 nt, SARS coronavirus
gacugaugaagcucagccuuu

SEQ ID NO: 3251701 - RNA, 18 nt, SARS coronavirus
uggguugcaacugaggga

SEQ ID NO: 3251702 - RNA, 11 nt, SARS coronavirus
ugaaacuucuc

SEQ ID NO: 3251703 - RNA, 22 nt, SARS coronavirus
ugcuuuuuagccuuucugcuau

SEQ ID NO: 3251704 - RNA, 15 nt, SARS coronavirus
uggcuauuucaccga

SEQ ID NO: 3251705 - RNA, 19 nt, SARS coronavirus
aauaaauuugcacuaacuu

SEQ ID NO: 3251706 - RNA, 17 nt, SARS coronavirus
gcguuccaaucaacacc

SEQ ID NO: 3251707 - RNA, 20 nt, SARS coronavirus
gcauucuuuggaaugucacg

SEQ ID NO: 3251708 - RNA, 19 nt, SARS coronavirus
uucuacgcagagggaagca

SEQ ID NO: 3251709 - RNA, 15 nt, SARS coronavirus
ucggggaccaagacc

SEQ ID NO: 3251710 - RNA, 20 nt, SARS coronavirus
gcuccaagugccucugcauu

SEQ ID NO: 3251711 - RNA, 17 nt, SARS coronavirus
uuuacccaauaauacug

SEQ ID NO: 3251712 - RNA, 15 nt, SARS coronavirus
auaaaacgaacauga

SEQ ID NO: 3251713 - RNA, 13 nt, SARS coronavirus
cuuauagcacugc

SEQ ID NO: 3251714 - RNA, 20 nt, SARS coronavirus
gagccaguucucaagggugu

SEQ ID NO: 3251715 - RNA, 14 nt, SARS coronavirus
ugccuauauggaag

SEQ ID NO: 3251716 - RNA, 15 nt, SARS coronavirus
auuugguggacccac

SEQ ID NO: 3251717 - RNA, 19 nt, SARS coronavirus
caaacugguguuauugcug

SEQ ID NO: 3251718 - RNA, 14 nt, SARS coronavirus
uacaacuuccucaa

SEQ ID NO: 3251719 - RNA, 12 nt, SARS coronavirus
caaacugcugca

SEQ ID NO: 3251720 - RNA, 15 nt, SARS coronavirus
uauuagacauuucac

SEQ ID NO: 3251721 - RNA, 19 nt, SARS coronavirus
uccaagugccucugcauuc

SEQ ID NO: 3251722 - RNA, 18 nt, SARS coronavirus
caaguaugaugaaaaugg

SEQ ID NO: 3251723 - RNA, 15 nt, SARS coronavirus
cuaauguuacuauca

SEQ ID NO: 3251724 - RNA, 14 nt, SARS coronavirus
uuuaacaagcuugu

SEQ ID NO: 3251725 - RNA, 14 nt, SARS coronavirus
auguuucuacagca

SEQ ID NO: 3251726 - RNA, 22 nt, SARS coronavirus
agauugacaaaggaauuuacca

SEQ ID NO: 3251727 - RNA, 20 nt, SARS coronavirus
cagcucucacucagcauggc

SEQ ID NO: 3251728 - RNA, 22 nt, SARS coronavirus
aaaaugaaagagcucagcccca

SEQ ID NO: 3251729 - RNA, 21 nt, SARS coronavirus
ucaugguuacaaucuugcuuu

SEQ ID NO: 3251730 - RNA, 22 nt, SARS coronavirus
cuuguaccaaagucuaaacgaa

SEQ ID NO: 3251731 - RNA, 23 nt, SARS coronavirus
ucaagccucuucucgcuccucau

SEQ ID NO: 3251732 - RNA, 16 nt, SARS coronavirus
uaccaaaauaauugcg

SEQ ID NO: 3251733 - RNA, 20 nt, SARS coronavirus
auugaugcuacuucaacugg

SEQ ID NO: 3251734 - RNA, 18 nt, SARS coronavirus
ucaacaccaaaacucaaa

SEQ ID NO: 3251735 - RNA, 21 nt, SARS coronavirus
uucaagaaucacuuacaacaa

SEQ ID NO: 3251736 - RNA, 16 nt, SARS coronavirus
cuuuaauugacuucua

SEQ ID NO: 3251737 - RNA, 13 nt, SARS coronavirus
uugcuuuugcuug

SEQ ID NO: 3251738 - RNA, 13 nt, SARS coronavirus
ugaaacuucucau

SEQ ID NO: 3251739 - RNA, 17 nt, SARS coronavirus
ccucuucucgcuccuca

SEQ ID NO: 3251740 - RNA, 13 nt, SARS coronavirus
uggggcaaggcca

SEQ ID NO: 3251741 - RNA, 13 nt, SARS coronavirus
cccagaaacaaac

SEQ ID NO: 3251742 - RNA, 16 nt, SARS coronavirus
guuuuaaauaaacgaa

SEQ ID NO: 3251743 - RNA, 19 nt, SARS coronavirus
aauugacagguuaauuaca

SEQ ID NO: 3251744 - RNA, 18 nt, SARS coronavirus
aucuugacguuauaauaa

SEQ ID NO: 3251745 - RNA, 23 nt, SARS coronavirus
aauuguuauuggccauuaaauga

SEQ ID NO: 3251746 - RNA, 15 nt, SARS coronavirus
acuugcacuagcaca

SEQ ID NO: 3251747 - RNA, 18 nt, SARS coronavirus
uucuaauuguguugcuga

SEQ ID NO: 3251748 - RNA, 22 nt, SARS coronavirus
cucacuuuaauugacuucuauu

SEQ ID NO: 3251749 - RNA, 21 nt, SARS coronavirus
uaagagaaagacagaaugaau

SEQ ID NO: 3251750 - RNA, 16 nt, SARS coronavirus
ugucguuacugaaggu

SEQ ID NO: 3251751 - RNA, 15 nt, SARS coronavirus
cacucagcauggcaa

SEQ ID NO: 3251752 - RNA, 13 nt, SARS coronavirus
auuuacugcugcu

SEQ ID NO: 3251753 - RNA, 21 nt, SARS coronavirus
ccacuuuuucucauuguugcu

SEQ ID NO: 3251754 - RNA, 16 nt, SARS coronavirus
cuacacugcugcucua

SEQ ID NO: 3251755 - RNA, 13 nt, SARS coronavirus
aggacaaaaagaa

SEQ ID NO: 3251756 - RNA, 23 nt, SARS coronavirus
cucaaugaggucgcuaaaaauuu

SEQ ID NO: 3251757 - RNA, 19 nt, SARS coronavirus
acauuuucaucgaggccac

SEQ ID NO: 3251758 - RNA, 15 nt, SARS coronavirus
auuuuggugcaauuu

SEQ ID NO: 3251759 - RNA, 22 nt, SARS coronavirus
uuugguuuucacucgaaaucca

SEQ ID NO: 3251760 - RNA, 20 nt, SARS coronavirus
gcugccuauauggaagagcc

SEQ ID NO: 3251761 - RNA, 22 nt, SARS coronavirus
gaauggcuagcggaggugguga

SEQ ID NO: 3251762 - RNA, 16 nt, SARS coronavirus
caugaaggucaccaaa

SEQ ID NO: 3251763 - RNA, 20 nt, SARS coronavirus
auuugcaauuuacugcugcu

SEQ ID NO: 3251764 - RNA, 17 nt, SARS coronavirus
ucgcgcuauugcugcua

SEQ ID NO: 3251765 - RNA, 15 nt, SARS coronavirus
aaagauggcagcuag

SEQ ID NO: 3251766 - RNA, 12 nt, SARS coronavirus
cuguggcuacau

SEQ ID NO: 3251767 - RNA, 17 nt, SARS coronavirus
gguacugccacugcugg

SEQ ID NO: 3251768 - RNA, 15 nt, SARS coronavirus
cuguuuggaacuuua

SEQ ID NO: 3251769 - RNA, 17 nt, SARS coronavirus
aaugaaagagcucagcc

SEQ ID NO: 3251770 - RNA, 18 nt, SARS coronavirus
uuuaccagaccucuaauu

SEQ ID NO: 3251771 - RNA, 20 nt, SARS coronavirus
ccuugcaccccaccugcucu

SEQ ID NO: 3251772 - RNA, 19 nt, SARS coronavirus
auuuuuaauacuuugcuuc

SEQ ID NO: 3251773 - RNA, 17 nt, SARS coronavirus
aggaacauacgagggca

SEQ ID NO: 3251774 - RNA, 22 nt, SARS coronavirus
uacaucaccagauguugaucuu

SEQ ID NO: 3251775 - RNA, 14 nt, SARS coronavirus
gaucacuguggcua

SEQ ID NO: 3251776 - RNA, 20 nt, SARS coronavirus
ggaggacuugaaagagccac

SEQ ID NO: 3251777 - RNA, 17 nt, SARS coronavirus
aaacgaacaugaaacuu

SEQ ID NO: 3251778 - RNA, 15 nt, SARS coronavirus
uuguaguacuuucuu

SEQ ID NO: 3251779 - RNA, 16 nt, SARS coronavirus
aauaaacgaacaaauu

SEQ ID NO: 3251780 - RNA, 14 nt, SARS coronavirus
aauauuacaaacuu

SEQ ID NO: 3251781 - RNA, 20 nt, SARS coronavirus
ugcccucgcgcuauugcugc

SEQ ID NO: 3251782 - RNA, 18 nt, SARS coronavirus
agauucccucgaggccag

SEQ ID NO: 3251783 - RNA, 19 nt, SARS coronavirus
caacaccaaaacucaaaga

SEQ ID NO: 3251784 - RNA, 15 nt, SARS coronavirus
aucaacugucaagau

SEQ ID NO: 3251785 - RNA, 16 nt, SARS coronavirus
ucaaauaccuuuugcu

SEQ ID NO: 3251786 - RNA, 18 nt, SARS coronavirus
acuucuuuuucuugcuuu

SEQ ID NO: 3251787 - RNA, 20 nt, SARS coronavirus
auaccuacuaacuuuucaau

SEQ ID NO: 3251788 - RNA, 20 nt, SARS coronavirus
cauuguuuugacuuguauuu

SEQ ID NO: 3251789 - RNA, 14 nt, SARS coronavirus
cgcuauugcugcua

SEQ ID NO: 3251790 - RNA, 15 nt, SARS coronavirus
uuauagcacugcuug

SEQ ID NO: 3251791 - RNA, 15 nt, SARS coronavirus
ggaacaacauugcca

SEQ ID NO: 3251792 - RNA, 17 nt, SARS coronavirus
caacuccuggcagcagu

SEQ ID NO: 3251793 - RNA, 18 nt, SARS coronavirus
cuuauggauuuguuuaug

SEQ ID NO: 3251794 - RNA, 14 nt, SARS coronavirus
gaacaaacccaagg

SEQ ID NO: 3251795 - RNA, 22 nt, SARS coronavirus
ucuaauuuuggugcaauuucaa

SEQ ID NO: 3251796 - RNA, 18 nt, SARS coronavirus
cacucgcugaugcuggcu

SEQ ID NO: 3251797 - RNA, 13 nt, SARS coronavirus
auggcacuucuug

SEQ ID NO: 3251798 - RNA, 17 nt, SARS coronavirus
uacauaucugaugccuu

SEQ ID NO: 3251799 - RNA, 15 nt, SARS coronavirus
augaccacacaaggc

SEQ ID NO: 3251800 - RNA, 20 nt, SARS coronavirus
gcaacgacaauauugcuuug

SEQ ID NO: 3251801 - RNA, 23 nt, SARS coronavirus
ucaagaaucacuuacaacaacau

SEQ ID NO: 3251802 - RNA, 21 nt, SARS coronavirus
aaaucgccaaccaauuuaaca

SEQ ID NO: 3251803 - RNA, 22 nt, SARS coronavirus
acucugagccaguucucaaggg

SEQ ID NO: 3251804 - RNA, 20 nt, SARS coronavirus
gaaugugcuaauuugcuucu

SEQ ID NO: 3251805 - RNA, 17 nt, SARS coronavirus
gcaauggggcaaggcca

SEQ ID NO: 3251806 - RNA, 20 nt, SARS coronavirus
caugaguggagcuucugcug

SEQ ID NO: 3251807 - RNA, 22 nt, SARS coronavirus
aagcagcccacugugacucuuc

SEQ ID NO: 3251808 - RNA, 14 nt, SARS coronavirus
gcuacaacuuccuc

SEQ ID NO: 3251809 - RNA, 17 nt, SARS coronavirus
cagguauggaggcgcaa

SEQ ID NO: 3251810 - RNA, 14 nt, SARS coronavirus
ucuugugcagaaug

SEQ ID NO: 3251811 - RNA, 15 nt, SARS coronavirus
caauggcuuguauug

SEQ ID NO: 3251812 - RNA, 17 nt, SARS coronavirus
aacaacuaaucagggcu

SEQ ID NO: 3251813 - RNA, 19 nt, SARS coronavirus
cacagauucaacugacaau

SEQ ID NO: 3251814 - RNA, 21 nt, SARS coronavirus
auagcuucuuaggagaaugac

SEQ ID NO: 3251815 - RNA, 15 nt, SARS coronavirus
ugaacucaaaugcuc

SEQ ID NO: 3251816 - RNA, 20 nt, SARS coronavirus
ccaccugcucuuaauuguua

SEQ ID NO: 3251817 - RNA, 22 nt, SARS coronavirus
ucaagccucuucucgcuccuca

SEQ ID NO: 3251818 - RNA, 21 nt, SARS coronavirus
cagaaguaaugccuguuucua

SEQ ID NO: 3251819 - RNA, 11 nt, SARS coronavirus
aagagaaagac

SEQ ID NO: 3251820 - RNA, 19 nt, SARS coronavirus
aaaauuauccacugaccuu

SEQ ID NO: 3251821 - RNA, 21 nt, SARS coronavirus
ucucacucagcauggcaagga

SEQ ID NO: 3251822 - RNA, 16 nt, SARS coronavirus
cuaaacgaacaugaaa

SEQ ID NO: 3251823 - RNA, 17 nt, SARS coronavirus
auaucuaaugugccuuu

SEQ ID NO: 3251824 - RNA, 19 nt, SARS coronavirus
ugauucagguuuugcugca

SEQ ID NO: 3251825 - RNA, 15 nt, SARS coronavirus
acgucacucaagcau

SEQ ID NO: 3251826 - RNA, 21 nt, SARS coronavirus
uaaacgaacuaacuauuauua

SEQ ID NO: 3251827 - RNA, 21 nt, SARS coronavirus
cugaugauaugauugcugccu

SEQ ID NO: 3251828 - RNA, 20 nt, SARS coronavirus
uucuacugaaugugcuaauu

SEQ ID NO: 3251829 - RNA, 17 nt, SARS coronavirus
accuucaugaaggucac

SEQ ID NO: 3251830 - RNA, 14 nt, SARS coronavirus
ucgauaaugcauuu

SEQ ID NO: 3251831 - RNA, 21 nt, SARS coronavirus
cuucugucgucaacauucaaa

SEQ ID NO: 3251832 - RNA, 21 nt, SARS coronavirus
cugguauugaaaaugcuacau

SEQ ID NO: 3251833 - RNA, 14 nt, SARS coronavirus
cauuguugcugcuc

SEQ ID NO: 3251834 - RNA, 21 nt, SARS coronavirus
acauuggccgcaaauugcaca

SEQ ID NO: 3251835 - RNA, 17 nt, SARS coronavirus
gccgacgacgacuacua

SEQ ID NO: 3251836 - RNA, 23 nt, SARS coronavirus
uuucugccacuaaguugaaugau

SEQ ID NO: 3251837 - RNA, 18 nt, SARS coronavirus
cacucagcauggcaagga

SEQ ID NO: 3251838 - RNA, 20 nt, SARS coronavirus
aacaaaucgccaaccaauuu

SEQ ID NO: 3251839 - RNA, 21 nt, SARS coronavirus
aauucuacuaauguuguuaua

SEQ ID NO: 3251840 - RNA, 19 nt, SARS coronavirus
ccuucgggaacauggcuga

SEQ ID NO: 3251841 - RNA, 17 nt, SARS coronavirus
acuaagaagaauuauuc

SEQ ID NO: 3251842 - RNA, 15 nt, SARS coronavirus
guggucauucaaccc

SEQ ID NO: 3251843 - RNA, 24 nt, SARS coronavirus
cucuggcucuuguggccaguaaca

SEQ ID NO: 3251844 - RNA, 13 nt, SARS coronavirus
ugacauggaugau

SEQ ID NO: 3251845 - RNA, 12 nt, SARS coronavirus
cuugaaagagcc

SEQ ID NO: 3251846 - RNA, 24 nt, SARS coronavirus
cuuacaguguugccaccucugcuc

SEQ ID NO: 3251847 - RNA, 18 nt, SARS coronavirus
cauugcuuaucauggcag

SEQ ID NO: 3251848 - RNA, 23 nt, SARS coronavirus
ucugauaauggaccccaaucaaa

SEQ ID NO: 3251849 - RNA, 14 nt, SARS coronavirus
agccaguucucaag

SEQ ID NO: 3251850 - RNA, 21 nt, SARS coronavirus
ucaugaaggucaccaaacugc

SEQ ID NO: 3251851 - RNA, 14 nt, SARS coronavirus
uugccuauucuaau

SEQ ID NO: 3251852 - RNA, 23 nt, SARS coronavirus
uauguacaucugcggagauucua

SEQ ID NO: 3251853 - RNA, 13 nt, SARS coronavirus
aguaauagguuuc

SEQ ID NO: 3251854 - RNA, 23 nt, SARS coronavirus
caaaaacguacugccacaaaaca

SEQ ID NO: 3251855 - RNA, 22 nt, SARS coronavirus
uuuacgauacauagucuacucu

SEQ ID NO: 3251856 - RNA, 14 nt, SARS coronavirus
cugagcuugacuca

SEQ ID NO: 3251857 - RNA, 13 nt, SARS coronavirus
cauagauggcaca

SEQ ID NO: 3251858 - RNA, 16 nt, SARS coronavirus
agugagacaauuauuu

SEQ ID NO: 3251859 - RNA, 19 nt, SARS coronavirus
ugaucuuggcgacauuuca

SEQ ID NO: 3251860 - RNA, 11 nt, SARS coronavirus
uagaauuauua

SEQ ID NO: 3251861 - RNA, 19 nt, SARS coronavirus
acaaacccaaggaaauuuc

SEQ ID NO: 3251862 - RNA, 12 nt, SARS coronavirus
ggcaaaaugaaa

SEQ ID NO: 3251863 - RNA, 22 nt, SARS coronavirus
gcccucgcgcuauugcugcuag

SEQ ID NO: 3251864 - RNA, 16 nt, SARS coronavirus
gaccuaaucagacaag

SEQ ID NO: 3251865 - RNA, 14 nt, SARS coronavirus
cuuuaauugacuuc

SEQ ID NO: 3251866 - RNA, 17 nt, SARS coronavirus
auucccuucugucuaug

SEQ ID NO: 3251867 - RNA, 16 nt, SARS coronavirus
cuacauuuaugcucaa

SEQ ID NO: 3251868 - RNA, 14 nt, SARS coronavirus
uccagacaacuuca

SEQ ID NO: 3251869 - RNA, 21 nt, SARS coronavirus
augguguugucuuccuacaug

SEQ ID NO: 3251870 - RNA, 15 nt, SARS coronavirus
cugauuacaaacauu

SEQ ID NO: 3251871 - RNA, 16 nt, SARS coronavirus
gguucaacaagagcuc

SEQ ID NO: 3251872 - RNA, 18 nt, SARS coronavirus
ucgccacuuuuucucauu

SEQ ID NO: 3251873 - RNA, 16 nt, SARS coronavirus
caauaaccagaaugga

SEQ ID NO: 3251874 - RNA, 16 nt, SARS coronavirus
ugaacuuuuaaaugca

SEQ ID NO: 3251875 - RNA, 12 nt, SARS coronavirus
auugcuuugcua

SEQ ID NO: 3251876 - RNA, 13 nt, SARS coronavirus
caaauaccuuuug

SEQ ID NO: 3251877 - RNA, 16 nt, SARS coronavirus
ggccauuaaaugauua

SEQ ID NO: 3251878 - RNA, 18 nt, SARS coronavirus
ugcuagggagagcugccu

SEQ ID NO: 3251879 - RNA, 19 nt, SARS coronavirus
uggauuauguuacuacaau

SEQ ID NO: 3251880 - RNA, 14 nt, SARS coronavirus
aggacuugcucuuu

SEQ ID NO: 3251881 - RNA, 19 nt, SARS coronavirus
aauagcuucuuaggagaau

SEQ ID NO: 3251882 - RNA, 14 nt, SARS coronavirus
cuaauguuguuaua

SEQ ID NO: 3251883 - RNA, 18 nt, SARS coronavirus
acaaacauucuucucaau

SEQ ID NO: 3251884 - RNA, 15 nt, SARS coronavirus
uaauuuuaauggacu

SEQ ID NO: 3251885 - RNA, 16 nt, SARS coronavirus
auacaguuucuuuauu

SEQ ID NO: 3251886 - RNA, 14 nt, SARS coronavirus
caauggcuuguauu

SEQ ID NO: 3251887 - RNA, 18 nt, SARS coronavirus
acagcucucacucagcau

SEQ ID NO: 3251888 - RNA, 22 nt, SARS coronavirus
aaagacaacgucauacugcuga

SEQ ID NO: 3251889 - RNA, 22 nt, SARS coronavirus
cuuacagccuuuucaccugcuc

SEQ ID NO: 3251890 - RNA, 23 nt, SARS coronavirus
uuaaauggccuugguauguuugg

SEQ ID NO: 3251891 - RNA, 13 nt, SARS coronavirus
gaugcuguugauu

SEQ ID NO: 3251892 - RNA, 19 nt, SARS coronavirus
gcccucgcgcuauugcugc

SEQ ID NO: 3251893 - RNA, 13 nt, SARS coronavirus
cagaaacaaacau

SEQ ID NO: 3251894 - RNA, 14 nt, SARS coronavirus
aaacuuguguccuu

SEQ ID NO: 3251895 - RNA, 22 nt, SARS coronavirus
ucaaggaacaacauugccaaaa

SEQ ID NO: 3251896 - RNA, 14 nt, SARS coronavirus
uacugccacugcug

SEQ ID NO: 3251897 - RNA, 17 nt, SARS coronavirus
uucccucgaggccaggg

SEQ ID NO: 3251898 - RNA, 17 nt, SARS coronavirus
ccaguucucaagggugu

SEQ ID NO: 3251899 - RNA, 22 nt, SARS coronavirus
aaacugcccucgcgcuauugcu

SEQ ID NO: 3251900 - RNA, 21 nt, SARS coronavirus
cagaauggaggacgcaauggg

SEQ ID NO: 3251901 - RNA, 20 nt, SARS coronavirus
cugcagguauggaggcgcaa

SEQ ID NO: 3251902 - RNA, 22 nt, SARS coronavirus
acugauguuucuacagcaauuc

SEQ ID NO: 3251903 - RNA, 20 nt, SARS coronavirus
aacauguuuauuuucuuauu

SEQ ID NO: 3251904 - RNA, 18 nt, SARS coronavirus
uucaaaaaucauacauca

SEQ ID NO: 3251905 - RNA, 23 nt, SARS coronavirus
cuacagacaauacauuugucuca

SEQ ID NO: 3251906 - RNA, 21 nt, SARS coronavirus
aauuauuaugagauguuggcu

SEQ ID NO: 3251907 - RNA, 22 nt, SARS coronavirus
cucacucccuuucggauggcuu

SEQ ID NO: 3251908 - RNA, 20 nt, SARS coronavirus
cuccugcaaguacuguucau

SEQ ID NO: 3251909 - RNA, 20 nt, SARS coronavirus
cccuuucuuugcuguuucua

SEQ ID NO: 3251910 - RNA, 15 nt, SARS coronavirus
aguuagaugaugaag

SEQ ID NO: 3251911 - RNA, 21 nt, SARS coronavirus
cucuaguuagugguacugcca

SEQ ID NO: 3251912 - RNA, 22 nt, SARS coronavirus
ggccaaaacagcgccgacccca

SEQ ID NO: 3251913 - RNA, 14 nt, SARS coronavirus
gucacucaagcauu

SEQ ID NO: 3251914 - RNA, 22 nt, SARS coronavirus
cuucuccaaugucuaugcagau

SEQ ID NO: 3251915 - RNA, 13 nt, SARS coronavirus
ugaaaauuauucu

SEQ ID NO: 3251916 - RNA, 16 nt, SARS coronavirus
auggguuguguccuug

SEQ ID NO: 3251917 - RNA, 14 nt, SARS coronavirus
ucaaauucaagaau

SEQ ID NO: 3251918 - RNA, 20 nt, SARS coronavirus
acgcaauggggcaaggccaa

SEQ ID NO: 3251919 - RNA, 12 nt, SARS coronavirus
uuacugcugcua

SEQ ID NO: 3251920 - RNA, 23 nt, SARS coronavirus
ugggagagaaaaaaaauuucuaa

SEQ ID NO: 3251921 - RNA, 15 nt, SARS coronavirus
uacacugcugcucua

SEQ ID NO: 3251922 - RNA, 15 nt, SARS coronavirus
ugcacaauuugcucc

SEQ ID NO: 3251923 - RNA, 14 nt, SARS coronavirus
acaugaaacuucuc

SEQ ID NO: 3251924 - RNA, 19 nt, SARS coronavirus
aucaauuacugcacagcca

SEQ ID NO: 3251925 - RNA, 19 nt, SARS coronavirus
uuauaauuauaaauugcca

SEQ ID NO: 3251926 - RNA, 18 nt, SARS coronavirus
cucuugugcagaaugaau

SEQ ID NO: 3251927 - RNA, 20 nt, SARS coronavirus
gacacucgcugaugcuggcu

SEQ ID NO: 3251928 - RNA, 14 nt, SARS coronavirus
auaauggaccccaa

SEQ ID NO: 3251929 - RNA, 21 nt, SARS coronavirus
uuguguuuaauggcacuucuu

SEQ ID NO: 3251930 - RNA, 17 nt, SARS coronavirus
guguugguaccuucaug

SEQ ID NO: 3251931 - RNA, 18 nt, SARS coronavirus
ugacaaugcuucuccugc

SEQ ID NO: 3251932 - RNA, 15 nt, SARS coronavirus
ugacguuauaauaag

SEQ ID NO: 3251933 - RNA, 22 nt, SARS coronavirus
aaagaagcagcccacugugacu

SEQ ID NO: 3251934 - RNA, 22 nt, SARS coronavirus
cccaugugauuuuaauagcuuc

SEQ ID NO: 3251935 - RNA, 12 nt, SARS coronavirus
cacugcugcucu

SEQ ID NO: 3251936 - RNA, 16 nt, SARS coronavirus
ggcgcuaacaaagaag

SEQ ID NO: 3251937 - RNA, 21 nt, SARS coronavirus
acacagaggaacuucuuuucu

SEQ ID NO: 3251938 - RNA, 19 nt, SARS coronavirus
cagcuugagucuacacaaa

SEQ ID NO: 3251939 - RNA, 19 nt, SARS coronavirus
uauuuauuuugcugccaca

SEQ ID NO: 3251940 - RNA, 19 nt, SARS coronavirus
ucaauuagcauuacuacag

SEQ ID NO: 3251941 - RNA, 18 nt, SARS coronavirus
uuugacuuguauuucucu

SEQ ID NO: 3251942 - RNA, 14 nt, SARS coronavirus
ccccaacuuugaaa

SEQ ID NO: 3251943 - RNA, 18 nt, SARS coronavirus
acuaagaaaucugcugcu

SEQ ID NO: 3251944 - RNA, 15 nt, SARS coronavirus
aaaaugucugagugu

SEQ ID NO: 3251945 - RNA, 23 nt, SARS coronavirus
aaaugauuaugguuuuuacacca

SEQ ID NO: 3251946 - RNA, 14 nt, SARS coronavirus
uacaggcagacuuc

SEQ ID NO: 3251947 - RNA, 16 nt, SARS coronavirus
agcauuaaacacacuu

SEQ ID NO: 3251948 - RNA, 12 nt, SARS coronavirus
ucaacaauuugg

SEQ ID NO: 3251949 - RNA, 17 nt, SARS coronavirus
ugaacucuucugaagga

SEQ ID NO: 3251950 - RNA, 20 nt, SARS coronavirus
ccagaagcuucacuucccua

SEQ ID NO: 3251951 - RNA, 20 nt, SARS coronavirus
cugaaauauuagacauuuca

SEQ ID NO: 3251952 - RNA, 16 nt, SARS coronavirus
acaaaagaagcagccc

SEQ ID NO: 3251953 - RNA, 21 nt, SARS coronavirus
cuaauuuuggugcaauuucaa

SEQ ID NO: 3251954 - RNA, 15 nt, SARS coronavirus
uauucgauaaugcau

SEQ ID NO: 3251955 - RNA, 19 nt, SARS coronavirus
auucccaccaacagagccu

SEQ ID NO: 3251956 - RNA, 23 nt, SARS coronavirus
uugaauacacccaaagaccacau

SEQ ID NO: 3251957 - RNA, 20 nt, SARS coronavirus
ucuccugcaaguacuguuca

SEQ ID NO: 3251958 - RNA, 13 nt, SARS coronavirus
ugcaucuaauaaa

SEQ ID NO: 3251959 - RNA, 15 nt, SARS coronavirus
cgaaguuuacuacca

SEQ ID NO: 3251960 - RNA, 18 nt, SARS coronavirus
cuggcagcaguaggggaa

SEQ ID NO: 3251961 - RNA, 21 nt, SARS coronavirus
ccauuaaauuggaugacaaag

SEQ ID NO: 3251962 - RNA, 20 nt, SARS coronavirus
gcuucuccaaugucuaugca

SEQ ID NO: 3251963 - RNA, 13 nt, SARS coronavirus
aaggccaaaacag

SEQ ID NO: 3251964 - RNA, 16 nt, SARS coronavirus
ggaugacaaagaucca

SEQ ID NO: 3251965 - RNA, 19 nt, SARS coronavirus
auguaaacguuuucgcaau

SEQ ID NO: 3251966 - RNA, 14 nt, SARS coronavirus
gcuugauguggcuu

SEQ ID NO: 3251967 - RNA, 18 nt, SARS coronavirus
uuaaauaaacgaacaaau

SEQ ID NO: 3251968 - RNA, 16 nt, SARS coronavirus
ucuauaucaagauguu

SEQ ID NO: 3251969 - RNA, 12 nt, SARS coronavirus
ugugcagaauga

SEQ ID NO: 3251970 - RNA, 20 nt, SARS coronavirus
ugacaaagauccacaauuca

SEQ ID NO: 3251971 - RNA, 14 nt, SARS coronavirus
ucaggauugcuauu

SEQ ID NO: 3251972 - RNA, 15 nt, SARS coronavirus
gcgcuauugcugcua

SEQ ID NO: 3251973 - RNA, 22 nt, SARS coronavirus
gaauacacccaaagaccacauu

SEQ ID NO: 3251974 - RNA, 18 nt, SARS coronavirus
gugcuaauuugcuucucc

SEQ ID NO: 3251975 - RNA, 15 nt, SARS coronavirus
ccagaaacaaacauu

SEQ ID NO: 3251976 - RNA, 13 nt, SARS coronavirus
cacgucagcugca

SEQ ID NO: 3251977 - RNA, 16 nt, SARS coronavirus
acugaugaagcucagc

SEQ ID NO: 3251978 - RNA, 15 nt, SARS coronavirus
aaacacucaugauga

SEQ ID NO: 3251979 - RNA, 21 nt, SARS coronavirus
cgggauugcgauugcaauggc

SEQ ID NO: 3251980 - RNA, 22 nt, SARS coronavirus
aguaaugccuguuucuauggcu

SEQ ID NO: 3251981 - RNA, 12 nt, SARS coronavirus
accucaugugcu

SEQ ID NO: 3251982 - RNA, 18 nt, SARS coronavirus
ugcaccccaccugcucuu

SEQ ID NO: 3251983 - RNA, 18 nt, SARS coronavirus
uuggaugacaaagaucca

SEQ ID NO: 3251984 - RNA, 19 nt, SARS coronavirus
ggagguacaaauugacagg

SEQ ID NO: 3251985 - RNA, 14 nt, SARS coronavirus
auuuugcugccaca

SEQ ID NO: 3251986 - RNA, 14 nt, SARS coronavirus
cuacuaacuuuuca

SEQ ID NO: 3251987 - RNA, 15 nt, SARS coronavirus
uaauugacuucuauu

SEQ ID NO: 3251988 - RNA, 17 nt, SARS coronavirus
cugaugaagcucagccu

SEQ ID NO: 3251989 - RNA, 21 nt, SARS coronavirus
gguuuauuacacagaggaacu

SEQ ID NO: 3251990 - RNA, 23 nt, SARS coronavirus
gacaaggaacugauuacaaacau

SEQ ID NO: 3251991 - RNA, 15 nt, SARS coronavirus
gccaguucucaaggg

SEQ ID NO: 3251992 - RNA, 19 nt, SARS coronavirus
auucuacugaaugugcuaa

SEQ ID NO: 3251993 - RNA, 21 nt, SARS coronavirus
ggcaucuaaaaagccucgcca

SEQ ID NO: 3251994 - RNA, 15 nt, SARS coronavirus
ucagcauggcaagga

SEQ ID NO: 3251995 - RNA, 19 nt, SARS coronavirus
guauuuuuaauacuuugcu

SEQ ID NO: 3251996 - RNA, 12 nt, SARS coronavirus
agccucuucucg

SEQ ID NO: 3251997 - RNA, 16 nt, SARS coronavirus
caacugucaagaucca

SEQ ID NO: 3251998 - RNA, 23 nt, SARS coronavirus
agaauuauuaugagauguuggcu

SEQ ID NO: 3251999 - RNA, 20 nt, SARS coronavirus
auagcgccaggacaaacugg

SEQ ID NO: 3252000 - RNA, 23 nt, SARS coronavirus
caugaaaauuauucucuuccuga

SEQ ID NO: 3252001 - RNA, 16 nt, SARS coronavirus
uguucuauaucaagau

SEQ ID NO: 3252002 - RNA, 16 nt, SARS coronavirus
aguacagcgcugugca

SEQ ID NO: 3252003 - RNA, 15 nt, SARS coronavirus
guugcauaugcacug

SEQ ID NO: 3252004 - RNA, 21 nt, SARS coronavirus
cagacaaggaacugauuacaa

SEQ ID NO: 3252005 - RNA, 15 nt, SARS coronavirus
aaaacgaacaugaaa

SEQ ID NO: 3252006 - RNA, 15 nt, SARS coronavirus
acaaaagaagcagcc

SEQ ID NO: 3252007 - RNA, 21 nt, SARS coronavirus
uggcuuugugcucuaggaaag

SEQ ID NO: 3252008 - RNA, 15 nt, SARS coronavirus
gugcguacugcugca

SEQ ID NO: 3252009 - RNA, 14 nt, SARS coronavirus
ucaaggaacaacau

SEQ ID NO: 3252010 - RNA, 15 nt, SARS coronavirus
cuacuaaaaugucug

SEQ ID NO: 3252011 - RNA, 22 nt, SARS coronavirus
ucuaaacgaacaugaaacuucu

SEQ ID NO: 3252012 - RNA, 21 nt, SARS coronavirus
gauugcugccuacacugcugc

SEQ ID NO: 3252013 - RNA, 18 nt, SARS coronavirus
gacaacgucauacugcug

SEQ ID NO: 3252014 - RNA, 20 nt, SARS coronavirus
gaagcagcccacugugacuc

SEQ ID NO: 3252015 - RNA, 16 nt, SARS coronavirus
cauaucugaugccuuu

SEQ ID NO: 3252016 - RNA, 20 nt, SARS coronavirus
cuucuuaggagaaugacaaa

SEQ ID NO: 3252017 - RNA, 18 nt, SARS coronavirus
caaacuuguguccuuuug

SEQ ID NO: 3252018 - RNA, 18 nt, SARS coronavirus
ccucuucucgcuccucau

SEQ ID NO: 3252019 - RNA, 15 nt, SARS coronavirus
cauuuggugcuggcg

SEQ ID NO: 3252020 - RNA, 20 nt, SARS coronavirus
uguugcaguugccucaaggg

SEQ ID NO: 3252021 - RNA, 20 nt, SARS coronavirus
ccuuugccgcagagacaaaa

SEQ ID NO: 3252022 - RNA, 23 nt, SARS coronavirus
cuugguuuauuacacagaggaac

SEQ ID NO: 3252023 - RNA, 15 nt, SARS coronavirus
cuagggcgcugugac

SEQ ID NO: 3252024 - RNA, 19 nt, SARS coronavirus
caccugcucaagacauuug

SEQ ID NO: 3252025 - RNA, 17 nt, SARS coronavirus
aacagcgccgaccccaa

SEQ ID NO: 3252026 - RNA, 16 nt, SARS coronavirus
ugcuacaacuuccuca

SEQ ID NO: 3252027 - RNA, 18 nt, SARS coronavirus
agagauauugauuaucau

SEQ ID NO: 3252028 - RNA, 17 nt, SARS coronavirus
accaaagucuaaacgaa

SEQ ID NO: 3252029 - RNA, 23 nt, SARS coronavirus
gacacucccuagggcgcugugac

SEQ ID NO: 3252030 - RNA, 19 nt, SARS coronavirus
cagagccuaaaaaggacaa

SEQ ID NO: 3252031 - RNA, 22 nt, SARS coronavirus
cacuagccauccuuacugcgcu

SEQ ID NO: 3252032 - RNA, 15 nt, SARS coronavirus
uugggcaagcugcaa

SEQ ID NO: 3252033 - RNA, 20 nt, SARS coronavirus
gccuuucuccccugauggca

SEQ ID NO: 3252034 - RNA, 21 nt, SARS coronavirus
cgucauacugcugaacaagca

SEQ ID NO: 3252035 - RNA, 21 nt, SARS coronavirus
aguacauaucugaugccuuuu

SEQ ID NO: 3252036 - RNA, 21 nt, SARS coronavirus
cuguaguacagcgcugugcau

SEQ ID NO: 3252037 - RNA, 23 nt, SARS coronavirus
ggcuucugcuaaucuugcugcua

SEQ ID NO: 3252038 - RNA, 12 nt, SARS coronavirus
gcauuucuugcu

SEQ ID NO: 3252039 - RNA, 19 nt, SARS coronavirus
cuagcacacacuuugcuuu

SEQ ID NO: 3252040 - RNA, 16 nt, SARS coronavirus
uguucccucaggagau

SEQ ID NO: 3252041 - RNA, 14 nt, SARS coronavirus
uggaugacaaagau

SEQ ID NO: 3252042 - RNA, 15 nt, SARS coronavirus
cugcucacugaugau

SEQ ID NO: 3252043 - RNA, 20 nt, SARS coronavirus
gaaaaugcuacauucuucau

SEQ ID NO: 3252044 - RNA, 18 nt, SARS coronavirus
auacugcugaacaagcac

SEQ ID NO: 3252045 - RNA, 15 nt, SARS coronavirus
gcgccgaccccaagg

SEQ ID NO: 3252046 - RNA, 17 nt, SARS coronavirus
agcacacacuuugcuuu

SEQ ID NO: 3252047 - RNA, 21 nt, SARS coronavirus
caauggggcaaggccaaaaca

SEQ ID NO: 3252048 - RNA, 18 nt, SARS coronavirus
aggccagggcguuccaau

SEQ ID NO: 3252049 - RNA, 19 nt, SARS coronavirus
acuaaaagaaccuugccca

SEQ ID NO: 3252050 - RNA, 13 nt, SARS coronavirus
cugcaaguacugu

SEQ ID NO: 3252051 - RNA, 16 nt, SARS coronavirus
acaauaaauuugcacu

SEQ ID NO: 3252052 - RNA, 17 nt, SARS coronavirus
ggggaaauucuccugcu

SEQ ID NO: 3252053 - RNA, 16 nt, SARS coronavirus
caauuuacugcugcua

SEQ ID NO: 3252054 - RNA, 17 nt, SARS coronavirus
uaagaaaucugcugcug

SEQ ID NO: 3252055 - RNA, 19 nt, SARS coronavirus
acauuugguggacccacag

SEQ ID NO: 3252056 - RNA, 20 nt, SARS coronavirus
uuucaagugugcuaaaugau

SEQ ID NO: 3252057 - RNA, 20 nt, SARS coronavirus
cuaaucuugcugcuacuaaa

SEQ ID NO: 3252058 - RNA, 17 nt, SARS coronavirus
aaccuuuaagugcuaug

SEQ ID NO: 3252059 - RNA, 13 nt, SARS coronavirus
uaaauuggaugac

SEQ ID NO: 3252060 - RNA, 23 nt, SARS coronavirus
gcguacuucuuuuucuugcuuuc

SEQ ID NO: 3252061 - RNA, 20 nt, SARS coronavirus
ucacagcucucacucagcau

SEQ ID NO: 3252062 - RNA, 22 nt, SARS coronavirus
uugcugcuacuaaaaugucuga

SEQ ID NO: 3252063 - RNA, 18 nt, SARS coronavirus
uuguaagguacaacacua

SEQ ID NO: 3252064 - RNA, 17 nt, SARS coronavirus
agaugaccaaauuggcu

SEQ ID NO: 3252065 - RNA, 17 nt, SARS coronavirus
cucacucagcauggcaa

SEQ ID NO: 3252066 - RNA, 19 nt, SARS coronavirus
gcuugagagcaaaguuucu

SEQ ID NO: 3252067 - RNA, 14 nt, SARS coronavirus
uuaucauggagcca

SEQ ID NO: 3252068 - RNA, 19 nt, SARS coronavirus
ugcaagaucaguuucacca

SEQ ID NO: 3252069 - RNA, 21 nt, SARS coronavirus
acuugucauuggugcugugau

SEQ ID NO: 3252070 - RNA, 19 nt, SARS coronavirus
aaauauuagacauuucacc

SEQ ID NO: 3252071 - RNA, 21 nt, SARS coronavirus
uuacaacaacaucaacugcau

SEQ ID NO: 3252072 - RNA, 17 nt, SARS coronavirus
uuaacauugcuuaucau

SEQ ID NO: 3252073 - RNA, 20 nt, SARS coronavirus
acuucucauuguuuugacuu

SEQ ID NO: 3252074 - RNA, 20 nt, SARS coronavirus
cucguacccgcucaaugugg

SEQ ID NO: 3252075 - RNA, 12 nt, SARS coronavirus
aagcucagccuu

SEQ ID NO: 3252076 - RNA, 23 nt, SARS coronavirus
acgaguucgugguggugacggca

SEQ ID NO: 3252077 - RNA, 20 nt, SARS coronavirus
uuauaaauauagguaucuua

SEQ ID NO: 3252078 - RNA, 13 nt, SARS coronavirus
gaccacauuggca

SEQ ID NO: 3252079 - RNA, 15 nt, SARS coronavirus
uccagaugaccaaau

SEQ ID NO: 3252080 - RNA, 13 nt, SARS coronavirus
aacaagcuuguua

SEQ ID NO: 3252081 - RNA, 17 nt, SARS coronavirus
acagagaaaucaaaugu

SEQ ID NO: 3252082 - RNA, 19 nt, SARS coronavirus
uguauuccagacucaagca

SEQ ID NO: 3252083 - RNA, 17 nt, SARS coronavirus
caagucaaacaaaugua

SEQ ID NO: 3252084 - RNA, 22 nt, SARS coronavirus
ugacgcauacaaaacauuccca

SEQ ID NO: 3252085 - RNA, 16 nt, SARS coronavirus
uuaaauaaacgaacaa

SEQ ID NO: 3252086 - RNA, 16 nt, SARS coronavirus
ucaucagacaagagga

SEQ ID NO: 3252087 - RNA, 18 nt, SARS coronavirus
ugacaauaaccagaaugg

SEQ ID NO: 3252088 - RNA, 15 nt, SARS coronavirus
augucgacacuucuu

SEQ ID NO: 3252089 - RNA, 21 nt, SARS coronavirus
guuuccuauuccuagccugga

SEQ ID NO: 3252090 - RNA, 16 nt, SARS coronavirus
aaagagccaccacauu

SEQ ID NO: 3252091 - RNA, 16 nt, SARS coronavirus
ucaaccuauagaugua

SEQ ID NO: 3252092 - RNA, 23 nt, SARS coronavirus
ccaugaguggagcuucugcugau

SEQ ID NO: 3252093 - RNA, 15 nt, SARS coronavirus
ucacaucuuuugcuu

SEQ ID NO: 3252094 - RNA, 13 nt, SARS coronavirus
aacuacuuuguuu

SEQ ID NO: 3252095 - RNA, 18 nt, SARS coronavirus
ccaauaugguagcuuuug

SEQ ID NO: 3252096 - RNA, 12 nt, SARS coronavirus
auuacaaacauu

SEQ ID NO: 3252097 - RNA, 19 nt, SARS coronavirus
gugcucuaggaaagguuuu

SEQ ID NO: 3252098 - RNA, 23 nt, SARS coronavirus
cuagcggagguggugaaacugcc

SEQ ID NO: 3252099 - RNA, 14 nt, SARS coronavirus
gcaauccuaauaac

SEQ ID NO: 3252100 - RNA, 15 nt, SARS coronavirus
uaagcacaagaaagu

SEQ ID NO: 3252101 - RNA, 15 nt, SARS coronavirus
augccuguuucuaug

SEQ ID NO: 3252102 - RNA, 14 nt, SARS coronavirus
aaggucaccaaacu

SEQ ID NO: 3252103 - RNA, 23 nt, SARS coronavirus
ccaucaggaacauacgagggcaa

SEQ ID NO: 3252104 - RNA, 20 nt, SARS coronavirus
ucauuguugcugcucuagua

SEQ ID NO: 3252105 - RNA, 12 nt, SARS coronavirus
ccgcagagacaa

SEQ ID NO: 3252106 - RNA, 14 nt, SARS coronavirus
ccuaaaaaggacaa

SEQ ID NO: 3252107 - RNA, 21 nt, SARS coronavirus
aguacuagccaaaaaucuauu

SEQ ID NO: 3252108 - RNA, 22 nt, SARS coronavirus
aagcauuaaacacacuuguuaa

SEQ ID NO: 3252109 - RNA, 23 nt, SARS coronavirus
cauagucuacucuugugcagaau

SEQ ID NO: 3252110 - RNA, 17 nt, SARS coronavirus
auuucuuccauuuuauu

SEQ ID NO: 3252111 - RNA, 22 nt, SARS coronavirus
auucuacuggaaacaauguauu

SEQ ID NO: 3252112 - RNA, 15 nt, SARS coronavirus
acaaagauccacaau

SEQ ID NO: 3252113 - RNA, 14 nt, SARS coronavirus
aauuuuaauuuuaa

SEQ ID NO: 3252114 - RNA, 23 nt, SARS coronavirus
accuuuuaaggaugguauuuauu

SEQ ID NO: 3252115 - RNA, 17 nt, SARS coronavirus
agagcugccuauaugga

SEQ ID NO: 3252116 - RNA, 22 nt, SARS coronavirus
aacauggcugacuuaucaugga

SEQ ID NO: 3252117 - RNA, 17 nt, SARS coronavirus
gcugugaucauucgugg

SEQ ID NO: 3252118 - RNA, 11 nt, SARS coronavirus
uuaauuguuau

SEQ ID NO: 3252119 - RNA, 20 nt, SARS coronavirus
cuuugcuucaccauuaagag

SEQ ID NO: 3252120 - RNA, 20 nt, SARS coronavirus
aagcugcaagacguuguuaa

SEQ ID NO: 3252121 - RNA, 17 nt, SARS coronavirus
aagucagguaauuuuaa

SEQ ID NO: 3252122 - RNA, 13 nt, SARS coronavirus
acacucaugauga

SEQ ID NO: 3252123 - RNA, 23 nt, SARS coronavirus
acauuggccgcaaauugcacaau

SEQ ID NO: 3252124 - RNA, 18 nt, Human
cugacccucaucuuucuu

SEQ ID NO: 3252125 - RNA, 23 nt, Human
cugaggaagagggacuguucuuu

SEQ ID NO: 3252126 - RNA, 18 nt, Human
cugaggaagagggacugu

SEQ ID NO: 3252127 - RNA, 15 nt, Human
cuaggguggggagag

SEQ ID NO: 3252128 - RNA, 13 nt, Human
cuaguucugccag

SEQ ID NO: 3252129 - RNA, 16 nt, Human
cuaguucugccaggag

SEQ ID NO: 3252130 - RNA, 15 nt, Human
cuaguucugccagga

SEQ ID NO: 3252131 - RNA, 14 nt, Human
cuaguucugccagg

SEQ ID NO: 3252132 - RNA, 15 nt, Human
cuaggcuaggguggg

SEQ ID NO: 3252133 - RNA, 21 nt, Human
ccugucucccuccucugcccg

SEQ ID NO: 3252134 - RNA, 18 nt, Human
ccuggugguggcucggga

SEQ ID NO: 3252135 - RNA, 21 nt, Human
ccuggugguggcucgggaggc

SEQ ID NO: 3252136 - RNA, 18 nt, Human
ccugacccucaucuuucu

SEQ ID NO: 3252137 - RNA, 19 nt, Human
ccugacccucaucuuucuu

SEQ ID NO: 3252138 - RNA, 20 nt, Human
ccugccaucauguuuacaga

SEQ ID NO: 3252139 - RNA, 18 nt, Human
ccugccaucauguuuaca

SEQ ID NO: 3252140 - RNA, 12 nt, Human
ccauucuuuccc

SEQ ID NO: 3252141 - RNA, 20 nt, Human
ccauucuuucccaacaccuc

SEQ ID NO: 3252142 - RNA, 14 nt, Human
ccauucuuucccaa

SEQ ID NO: 3252143 - RNA, 19 nt, Human
cauccauggggcugauugu

SEQ ID NO: 3252144 - RNA, 15 nt, Human
caggccugacucuca

SEQ ID NO: 3252145 - RNA, 18 nt, Human
cagucugagagaggccau

SEQ ID NO: 3252146 - RNA, 17 nt, Human
cagucugagagaggcca

SEQ ID NO: 3252147 - RNA, 14 nt, Human
cuuugaccuguugg

SEQ ID NO: 3252148 - RNA, 19 nt, Human
cuucuaguucugccaggag

SEQ ID NO: 3252149 - RNA, 16 nt, Human
cuucuaguucugccag

SEQ ID NO: 3252150 - RNA, 18 nt, Human
cuucuaguucugccagga

SEQ ID NO: 3252151 - RNA, 17 nt, Human
cuucuaguucugccagg

SEQ ID NO: 3252152 - RNA, 18 nt, Human
cugggaauaagugccagg

SEQ ID NO: 3252153 - RNA, 16 nt, Human
cuggggaugucucuca

SEQ ID NO: 3252154 - RNA, 16 nt, Human
cugugccuuuugccau

SEQ ID NO: 3252155 - RNA, 20 nt, Human
cugugccuugucacgccaga

SEQ ID NO: 3252156 - RNA, 15 nt, Human
cuuaggccagcacca

SEQ ID NO: 3252157 - RNA, 18 nt, Human
gcauuucccuuccuuccu

SEQ ID NO: 3252158 - RNA, 15 nt, Human
gacuauggagcugag

SEQ ID NO: 3252159 - RNA, 19 nt, Human
gacccucaucuuucuucca

SEQ ID NO: 3252160 - RNA, 15 nt, Human
gacccucaucuuucu

SEQ ID NO: 3252161 - RNA, 14 nt, Human
ggcucagagugggg

SEQ ID NO: 3252162 - RNA, 20 nt, Human
ggcucagaggguguccugca

SEQ ID NO: 3252163 - RNA, 22 nt, Human
gggacaccuaggcuaggguggg

SEQ ID NO: 3252164 - RNA, 15 nt, Human
ggcagggcugaggcc

SEQ ID NO: 3252165 - RNA, 15 nt, Human
ggcacuggggcaggg

SEQ ID NO: 3252166 - RNA, 22 nt, Human
ggugcuucuaguucugccagga

SEQ ID NO: 3252167 - RNA, 18 nt, Human
ggguggggagagacgggc

SEQ ID NO: 3252168 - RNA, 14 nt, Human
ggguggggagagac

SEQ ID NO: 3252169 - RNA, 13 nt, Human
ggguggggagaga

SEQ ID NO: 3252170 - RNA, 18 nt, Human
gggggcgcggcugggagg

SEQ ID NO: 3252171 - RNA, 17 nt, Human
ggggccgggggcagucu

SEQ ID NO: 3252172 - RNA, 15 nt, Human
guagagccagagguc

SEQ ID NO: 3252173 - RNA, 20 nt, Human
guaauuuaaaauugugaugu

SEQ ID NO: 3252174 - RNA, 19 nt, Human
guaauuuaaaauugugaug

SEQ ID NO: 3252175 - RNA, 23 nt, Human
guaauuuaaaauugugauguguc

SEQ ID NO: 3252176 - RNA, 17 nt, Human
gcuucuaguucugccag

SEQ ID NO: 3252177 - RNA, 16 nt, Human
gcuucuaguucugcca

SEQ ID NO: 3252178 - RNA, 20 nt, Human
ggaacugcugggcuuggcag

SEQ ID NO: 3252179 - RNA, 15 nt, Human
ggaacugcugggcuu

SEQ ID NO: 3252180 - RNA, 12 nt, Human
ggaagugugggu

SEQ ID NO: 3252181 - RNA, 22 nt, Human
ggaagugugggucugugugugu

SEQ ID NO: 3252182 - RNA, 21 nt, Human
ggaagugugggucugugugug

SEQ ID NO: 3252183 - RNA, 23 nt, Human
gccuccauccuacccccugugcc

SEQ ID NO: 3252184 - RNA, 19 nt, Human
gcucaggaaccgaggcagg

SEQ ID NO: 3252185 - RNA, 16 nt, Human
gcucaggaaccgaggc

SEQ ID NO: 3252186 - RNA, 21 nt, Human
gcucaggaaccgaggcaggga

SEQ ID NO: 3252187 - RNA, 20 nt, Human
gcucaggaaccgaggcaggg

SEQ ID NO: 3252188 - RNA, 22 nt, Human
gcuaauucuuugaccuguuggg

SEQ ID NO: 3252189 - RNA, 16 nt, Human
augugacucuuuccaa

SEQ ID NO: 3252190 - RNA, 12 nt, Human
augugacucuuu

SEQ ID NO: 3252191 - RNA, 21 nt, Human
augugacucuuuccaaccggc

SEQ ID NO: 3252192 - RNA, 16 nt, Human
augucaguauguggaa

SEQ ID NO: 3252193 - RNA, 16 nt, Human
augguucucaggccug

SEQ ID NO: 3252194 - RNA, 20 nt, Human
auggggauagauguguggac

SEQ ID NO: 3252195 - RNA, 16 nt, Human
aucaggccauuguccc

SEQ ID NO: 3252196 - RNA, 13 nt, Human
aucaggccauugu

SEQ ID NO: 3252197 - RNA, 16 nt, Human
auccuacccccugugc

SEQ ID NO: 3252198 - RNA, 14 nt, Human
auccuacccccugu

SEQ ID NO: 3252199 - RNA, 13 nt, Human
uucugccaggaga

SEQ ID NO: 3252200 - RNA, 19 nt, Human
auccauagcaccuccacau

SEQ ID NO: 3252201 - RNA, 20 nt, Human
uugcuaugagcuggggaugu

SEQ ID NO: 3252202 - RNA, 16 nt, Human
auuucccuuccuuccu

SEQ ID NO: 3252203 - RNA, 18 nt, Human
auuuguaaauuuauguga

SEQ ID NO: 3252204 - RNA, 19 nt, Human
auuuguaaauuuaugugau

SEQ ID NO: 3252205 - RNA, 12 nt, Human
auuuuucucaug

SEQ ID NO: 3252206 - RNA, 12 nt, Human
auuccagaggaa

SEQ ID NO: 3252207 - RNA, 19 nt, Human
agccugacccucaucuuuc

SEQ ID NO: 3252208 - RNA, 15 nt, Human
agcuggggaugucuc

SEQ ID NO: 3252209 - RNA, 17 nt, Human
ugccuugucacgccaga

SEQ ID NO: 3252210 - RNA, 19 nt, Human
ugccuugugaaggaauuau

SEQ ID NO: 3252211 - RNA, 20 nt, Human
aggcucagaggguguccugc

SEQ ID NO: 3252212 - RNA, 19 nt, Human
aggcucagaggguguccug

SEQ ID NO: 3252213 - RNA, 18 nt, Human
aggcucagaggguguccu

SEQ ID NO: 3252214 - RNA, 18 nt, Human
aggcgaagcguuguccuc

SEQ ID NO: 3252215 - RNA, 14 nt, Human
aggccauucuuucc

SEQ ID NO: 3252216 - RNA, 22 nt, Human
uggcacagccuggcuguggccu

SEQ ID NO: 3252217 - RNA, 20 nt, Human
uggcauccagagucccugcc

SEQ ID NO: 3252218 - RNA, 22 nt, Human
uggcauccagagucccugccug

SEQ ID NO: 3252219 - RNA, 21 nt, Human
uggcauccagagucccugccu

SEQ ID NO: 3252220 - RNA, 16 nt, Human
aggccugacucucagc

SEQ ID NO: 3252221 - RNA, 14 nt, Human
uggaaguguggguc

SEQ ID NO: 3252222 - RNA, 13 nt, Human
uggaagugugggu

SEQ ID NO: 3252223 - RNA, 17 nt, Human
uggcuguggcauccaga

SEQ ID NO: 3252224 - RNA, 20 nt, Human
uggcuguggccuaaccugcc

SEQ ID NO: 3252225 - RNA, 16 nt, Human
agugggguagguuggg

SEQ ID NO: 3252226 - RNA, 18 nt, Human
uguguguuguguguggga

SEQ ID NO: 3252227 - RNA, 9 nt, Human
aguguguaa

SEQ ID NO: 3252228 - RNA, 21 nt, Human
agugauuuuuaugccaccuga

SEQ ID NO: 3252229 - RNA, 20 nt, Human
agugauuuuuaugccaccug

SEQ ID NO: 3252230 - RNA, 16 nt, Human
agugauuuuuaugcca

SEQ ID NO: 3252231 - RNA, 14 nt, Human
agugaggaugucug

SEQ ID NO: 3252232 - RNA, 18 nt, Human
agugccaggauggaauga

SEQ ID NO: 3252233 - RNA, 20 nt, Human
uguagugauuuuuaugccac

SEQ ID NO: 3252234 - RNA, 16 nt, Human
aguccaucagccucca

SEQ ID NO: 3252235 - RNA, 14 nt, Human
aguauuugugggga

SEQ ID NO: 3252236 - RNA, 11 nt, Human
auagaugugug

SEQ ID NO: 3252237 - RNA, 13 nt, Human
auagaugugugga

SEQ ID NO: 3252238 - RNA, 12 nt, Human
auagaugugugg

SEQ ID NO: 3252239 - RNA, 14 nt, Human
auagauguguggac

SEQ ID NO: 3252240 - RNA, 19 nt, Human
auagaaggcuauggggaua

SEQ ID NO: 3252241 - RNA, 10 nt, Human
uuaugugugu

SEQ ID NO: 3252242 - RNA, 14 nt, Human
uuaugugugugugu

SEQ ID NO: 3252243 - RNA, 12 nt, Human
uuaugugugugu

SEQ ID NO: 3252244 - RNA, 18 nt, Human
auaaucacaacccuucag

SEQ ID NO: 3252245 - RNA, 22 nt, Human
ugagggugacuauggagcugag

SEQ ID NO: 3252246 - RNA, 17 nt, Human
ugaggaagagggacugu

SEQ ID NO: 3252247 - RNA, 14 nt, Human
agacuuaucaacau

SEQ ID NO: 3252248 - RNA, 11 nt, Human
ucuggcccuau

SEQ ID NO: 3252249 - RNA, 18 nt, Human
accugaauaaagaaugaa

SEQ ID NO: 3252250 - RNA, 22 nt, Human
ucaugauagaaggcuaugggga

SEQ ID NO: 3252251 - RNA, 18 nt, Human
accagagaaaaagggagg

SEQ ID NO: 3252252 - RNA, 20 nt, Human
accagagaaaaagggagggg

SEQ ID NO: 3252253 - RNA, 22 nt, Human
ucagauuugccuuauuggcagc

SEQ ID NO: 3252254 - RNA, 22 nt, Human
acccagcuaugguucucucgca

SEQ ID NO: 3252255 - RNA, 16 nt, Human
ucagccccgcguggaa

SEQ ID NO: 3252256 - RNA, 18 nt, Human
ucaggaaccgaggcaggg

SEQ ID NO: 3252257 - RNA, 17 nt, Human
ucaggaaccgaggcagg

SEQ ID NO: 3252258 - RNA, 15 nt, Human
ucaggccgaaggagg

SEQ ID NO: 3252259 - RNA, 16 nt, Human
acucaugugacucuuu

SEQ ID NO: 3252260 - RNA, 15 nt, Human
acucaugugacucuu

SEQ ID NO: 3252261 - RNA, 17 nt, Human
acucaugugacucuuuc

SEQ ID NO: 3252262 - RNA, 11 nt, Human
uccucagcccc

SEQ ID NO: 3252263 - RNA, 14 nt, Human
acuggggcaggggc

SEQ ID NO: 3252264 - RNA, 23 nt, Human
ucgagaucccaacacugccagca

SEQ ID NO: 3252265 - RNA, 22 nt, Human
ucgagaucccaacacugccagc

SEQ ID NO: 3252266 - RNA, 20 nt, Human
uccugcaccggggccugggc

SEQ ID NO: 3252267 - RNA, 21 nt, Human
uccugcaccggggccugggca

SEQ ID NO: 3252268 - RNA, 21 nt, Human
guugggagaaugucaguaugu

SEQ ID NO: 3252269 - RNA, 14 nt, Human
guugggagaauguc

SEQ ID NO: 3252270 - RNA, 12 nt, Human
guguuuaugugu

SEQ ID NO: 3252271 - RNA, 16 nt, Human
guguuuaugugugugu

SEQ ID NO: 3252272 - RNA, 20 nt, Human
guccugcaccggggccuggg

SEQ ID NO: 3252273 - RNA, 19 nt, Human
guccugcaccggggccugg

SEQ ID NO: 3252274 - RNA, 15 nt, Human
guccugcaccggggc

SEQ ID NO: 3252275 - RNA, 18 nt, Human
guggcacuggggcagggg

SEQ ID NO: 3252276 - RNA, 17 nt, Human
guggcacuggggcaggg

SEQ ID NO: 3252277 - RNA, 14 nt, Human
gugggggucugugu

SEQ ID NO: 3252278 - RNA, 16 nt, Human
gugggggucugugugu

SEQ ID NO: 3252279 - RNA, 15 nt, Human
gugggggucugugug

SEQ ID NO: 3252280 - RNA, 15 nt, Human
guguuguguguggga

SEQ ID NO: 3252281 - RNA, 14 nt, Human
guguguguaugugg

SEQ ID NO: 3252282 - RNA, 17 nt, Human
guguguguugugugugg

SEQ ID NO: 3252283 - RNA, 16 nt, Human
gugugugggagugugu

SEQ ID NO: 3252284 - RNA, 13 nt, Human
guguguguaugug

SEQ ID NO: 3252285 - RNA, 20 nt, Human
acaccuaggcuagggugggg

SEQ ID NO: 3252286 - RNA, 23 nt, Human
acaccuaggcuaggguggggaga

SEQ ID NO: 3252287 - RNA, 14 nt, Human
uaguucugccagga

SEQ ID NO: 3252288 - RNA, 13 nt, Human
uaguucugccagg

SEQ ID NO: 3252289 - RNA, 12 nt, Human
acagccuggcug

SEQ ID NO: 3252290 - RNA, 19 nt, Human
uauggggauagaugugugg

SEQ ID NO: 3252291 - RNA, 18 nt, Human
uauggggauagaugugug

SEQ ID NO: 3252292 - RNA, 17 nt, Human
uauggggauagaugugu

SEQ ID NO: 3252293 - RNA, 21 nt, Human
acagacacucccacuuggcau

SEQ ID NO: 3252294 - RNA, 23 nt, Human
uauguguguguguuguguguggg

SEQ ID NO: 3252295 - RNA, 11 nt, Human
uaugugugugu

SEQ ID NO: 3252296 - RNA, 22 nt, Human
uauguguguguguugugugugg

SEQ ID NO: 3252297 - RNA, 14 nt, Human
uauguguguguguu

SEQ ID NO: 3252298 - RNA, 22 nt, Human
aauucuuugaccuguugggagu

SEQ ID NO: 3252299 - RNA, 18 nt, Human
aauucuuugaccuguugg

SEQ ID NO: 3252300 - RNA, 15 nt, Human
aaugucaguaugugg

SEQ ID NO: 3252301 - RNA, 13 nt, Human
aaugucaguaugu

SEQ ID NO: 3252302 - RNA, 23 nt, Human
accugccgagaguccaucagccu

SEQ ID NO: 3252303 - RNA, 16 nt, Human
accugccgagagucca

SEQ ID NO: 3252304 - RNA, 12 nt, Human
acugccagcauu

SEQ ID NO: 3252305 - RNA, 13 nt, Human
acccccugugccu

SEQ ID NO: 3252306 - RNA, 14 nt, Human
agccgggagccuga

SEQ ID NO: 3252307 - RNA, 20 nt, Human
agaggacaguauuugugggg

SEQ ID NO: 3252308 - RNA, 22 nt, Human
agcuccuuaaggcucuuuugua

SEQ ID NO: 3252309 - RNA, 18 nt, Human
agcuccuuaaggcucuuu

SEQ ID NO: 3252310 - RNA, 14 nt, Human
agcugagcaggugu

SEQ ID NO: 3252311 - RNA, 17 nt, Human
agcugcuccccacguca

SEQ ID NO: 3252312 - RNA, 14 nt, Human
agcugcuccccacg

SEQ ID NO: 3252313 - RNA, 21 nt, Human
aggagucccugccaucauguu

SEQ ID NO: 3252314 - RNA, 17 nt, Human
aggggccgggggcaguc

SEQ ID NO: 3252315 - RNA, 14 nt, Human
aucagccugugcca

SEQ ID NO: 3252316 - RNA, 19 nt, Human
augagcuccuuaaggcucu

SEQ ID NO: 3252317 - RNA, 16 nt, Human
aguggcuggaucugug

SEQ ID NO: 3252318 - RNA, 18 nt, Human
aguucauaaauuuauggu

SEQ ID NO: 3252319 - RNA, 16 nt, Human
caccccgacuuuuguu

SEQ ID NO: 3252320 - RNA, 16 nt, Human
uuggcagcucuacucu

SEQ ID NO: 3252321 - RNA, 14 nt, Human
uuuaugccaccuga

SEQ ID NO: 3252322 - RNA, 20 nt, Human
uuuacagaggacaguauuug

SEQ ID NO: 3252323 - RNA, 18 nt, Human
uuguuuagaagaagugug

SEQ ID NO: 3252324 - RNA, 15 nt, Human
uuguuuagaagaagu

SEQ ID NO: 3252325 - RNA, 16 nt, Human
uuuaaaauugugaugu

SEQ ID NO: 3252326 - RNA, 16 nt, Human
uuaugccaccugaaua

SEQ ID NO: 3252327 - RNA, 13 nt, Human
uuaugccaccuga

SEQ ID NO: 3252328 - RNA, 19 nt, Human
uguuuagaagaaguguguc

SEQ ID NO: 3252329 - RNA, 16 nt, Human
uguuuagaagaagugu

SEQ ID NO: 3252330 - RNA, 12 nt, Human
uuaacucagucu

SEQ ID NO: 3252331 - RNA, 11 nt, Human
uuuguggggag

SEQ ID NO: 3252332 - RNA, 23 nt, Human
uaugagcuggggaugucucucau

SEQ ID NO: 3252333 - RNA, 16 nt, Human
uaggcuagggugggga

SEQ ID NO: 3252334 - RNA, 15 nt, Human
uaggcuagggugggg

SEQ ID NO: 3252335 - RNA, 23 nt, Human
uccugucucccuccucugcccgg

SEQ ID NO: 3252336 - RNA, 15 nt, Human
uccugucucccuccu

SEQ ID NO: 3252337 - RNA, 17 nt, Human
uccuacccccugugccu

SEQ ID NO: 3252338 - RNA, 16 nt, Human
uccuacccccugugcc

SEQ ID NO: 3252339 - RNA, 15 nt, Human
uccuacccccugugc

SEQ ID NO: 3252340 - RNA, 13 nt, Human
uccuacccccugu

SEQ ID NO: 3252341 - RNA, 14 nt, Human
uccaaacaggcuca

SEQ ID NO: 3252342 - RNA, 22 nt, Human
ucagucuuuaaucugagaggcc

SEQ ID NO: 3252343 - RNA, 18 nt, Human
uccagagucccugccugg

SEQ ID NO: 3252344 - RNA, 15 nt, Human
uccagagucccugcc

SEQ ID NO: 3252345 - RNA, 21 nt, Human
uccagagucccugccuggacc

SEQ ID NO: 3252346 - RNA, 20 nt, Human
uccagagucccugccuggac

SEQ ID NO: 3252347 - RNA, 19 nt, Human
uccagagucccugccugga

SEQ ID NO: 3252348 - RNA, 21 nt, Human
ugagcuccuuaaggcucuuuu

SEQ ID NO: 3252349 - RNA, 19 nt, Human
ugagcuccuuaaggcucuu

SEQ ID NO: 3252350 - RNA, 20 nt, Human
ugagcuggggaugucucuca

SEQ ID NO: 3252351 - RNA, 17 nt, Human
ugacauacauccaacau

SEQ ID NO: 3252352 - RNA, 18 nt, Human
ugggcaggagggaggugc

SEQ ID NO: 3252353 - RNA, 16 nt, Human
ugggcaggagggaggu

SEQ ID NO: 3252354 - RNA, 15 nt, Human
ugggcaggagggagg

SEQ ID NO: 3252355 - RNA, 13 nt, Human
ugggcaggaggga

SEQ ID NO: 3252356 - RNA, 22 nt, Human
ugggagugaggaugucugggcc

SEQ ID NO: 3252357 - RNA, 11 nt, Human
ugggagugugu

SEQ ID NO: 3252358 - RNA, 20 nt, Human
uggggaguuuaggguggggg

SEQ ID NO: 3252359 - RNA, 20 nt, Human
uggggauagauguguggaca

SEQ ID NO: 3252360 - RNA, 18 nt, Human
uggggauagaugugugga

SEQ ID NO: 3252361 - RNA, 17 nt, Human
uggggauagaugugugg

SEQ ID NO: 3252362 - RNA, 16 nt, Human
uggggauagaugugug

SEQ ID NO: 3252363 - RNA, 14 nt, Human
ugggggucugugug

SEQ ID NO: 3252364 - RNA, 19 nt, Human
uggaucugugaggggcucu

SEQ ID NO: 3252365 - RNA, 15 nt, Human
uggaucugugagggg

SEQ ID NO: 3252366 - RNA, 15 nt, Human
uggaccagccucucc

SEQ ID NO: 3252367 - RNA, 20 nt, Human
uggcuccauugguguugaca

SEQ ID NO: 3252368 - RNA, 20 nt, Human
gugauuuuuaugccaccuga

SEQ ID NO: 3252369 - RNA, 19 nt, Human
gugauuuuuaugccaccug

SEQ ID NO: 3252370 - RNA, 17 nt, Human
gugauuuuuaugccacc

SEQ ID NO: 3252371 - RNA, 16 nt, Human
gugauuuuuaugccac

SEQ ID NO: 3252372 - RNA, 15 nt, Human
gugaggaugucuggg

SEQ ID NO: 3252373 - RNA, 12 nt, Human
gugacucuuucc

SEQ ID NO: 3252374 - RNA, 19 nt, Human
gugccuugucacgccagac

SEQ ID NO: 3252375 - RNA, 20 nt, Human
gugcuucuaguucugccagg

SEQ ID NO: 3252376 - RNA, 22 nt, Human
gugcuucuaguucugccaggag

SEQ ID NO: 3252377 - RNA, 21 nt, Human
gugcuucuaguucugccagga

SEQ ID NO: 3252378 - RNA, 18 nt, Human
guggcucgggaggcgaag

SEQ ID NO: 3252379 - RNA, 16 nt, Human
guggcucgggaggcga

SEQ ID NO: 3252380 - RNA, 14 nt, Human
guggcauccagagu

SEQ ID NO: 3252381 - RNA, 20 nt, Human
gucccagaaugccuccugca

SEQ ID NO: 3252382 - RNA, 14 nt, Human
gucacgccagacuu

SEQ ID NO: 3252383 - RNA, 23 nt, Human
gucccugccuggaccagccucuc

SEQ ID NO: 3252384 - RNA, 22 nt, Human
gucccugccuggaccagccucu

SEQ ID NO: 3252385 - RNA, 14 nt, Human
gucccugccuggac

SEQ ID NO: 3252386 - RNA, 21 nt, Human
gucccugccuggaccagccuc

SEQ ID NO: 3252387 - RNA, 20 nt, Human
gucccugccuggaccagccu

SEQ ID NO: 3252388 - RNA, 12 nt, Human
guccucagcccc

SEQ ID NO: 3252389 - RNA, 13 nt, Human
ggggauagaugug

SEQ ID NO: 3252390 - RNA, 18 nt, Human
ggggaguuuagggugggg

SEQ ID NO: 3252391 - RNA, 14 nt, Human
gggcgcggcuggga

SEQ ID NO: 3252392 - RNA, 19 nt, Human
gguugggagaaugucagua

SEQ ID NO: 3252393 - RNA, 22 nt, Human
ggaaggaucccaugagcuccuu

SEQ ID NO: 3252394 - RNA, 23 nt, Human
ggaagggacaccaagccuuggcu

SEQ ID NO: 3252395 - RNA, 22 nt, Human
ggagaaugucaguauguggaag

SEQ ID NO: 3252396 - RNA, 22 nt, Human
gcuuuguggcacuggggcaggg

SEQ ID NO: 3252397 - RNA, 14 nt, Human
gcuuuguggcacug

SEQ ID NO: 3252398 - RNA, 20 nt, Human
ggccauucuuucccaacacc

SEQ ID NO: 3252399 - RNA, 17 nt, Human
ggauggaaugauggguc

SEQ ID NO: 3252400 - RNA, 12 nt, Human
ggcccugugccu

SEQ ID NO: 3252401 - RNA, 22 nt, Human
ggccuaaccugccgagagucca

SEQ ID NO: 3252402 - RNA, 21 nt, Human
ggccuaaccugccgagagucc

SEQ ID NO: 3252403 - RNA, 16 nt, Human
ggcuaggguggggaga

SEQ ID NO: 3252404 - RNA, 21 nt, Human
ggcuauggggauagaugugug

SEQ ID NO: 3252405 - RNA, 13 nt, Human
ggccugggcagga

SEQ ID NO: 3252406 - RNA, 14 nt, Human
ggccugggcaggag

SEQ ID NO: 3252407 - RNA, 16 nt, Human
ggcgcggcugggagga

SEQ ID NO: 3252408 - RNA, 21 nt, Human
gcucagaggguguccugcacc

SEQ ID NO: 3252409 - RNA, 17 nt, Human
gcuaugagcuggggaug

SEQ ID NO: 3252410 - RNA, 23 nt, Human
gcccuggugguggcucgggaggc

SEQ ID NO: 3252411 - RNA, 20 nt, Human
gagaucccaacacugccagc

SEQ ID NO: 3252412 - RNA, 19 nt, Human
gagaucccaacacugccag

SEQ ID NO: 3252413 - RNA, 18 nt, Human
gagaucccaacacugcca

SEQ ID NO: 3252414 - RNA, 17 nt, Human
gagaaugucaguaugug

SEQ ID NO: 3252415 - RNA, 13 nt, Human
gagagacgggccc

SEQ ID NO: 3252416 - RNA, 19 nt, Human
gaaugucaguauguggaag

SEQ ID NO: 3252417 - RNA, 13 nt, Human
gaaugucaguaug

SEQ ID NO: 3252418 - RNA, 18 nt, Human
gaaugucaguauguggaa

SEQ ID NO: 3252419 - RNA, 16 nt, Human
gaaugucaguaugugg

SEQ ID NO: 3252420 - RNA, 14 nt, Human
gaccagccucucca

SEQ ID NO: 3252421 - RNA, 13 nt, Human
gaguguguaauuu

SEQ ID NO: 3252422 - RNA, 22 nt, Human
gauagauguguggacacauugg

SEQ ID NO: 3252423 - RNA, 14 nt, Human
gauagaugugugga

SEQ ID NO: 3252424 - RNA, 19 nt, Human
gagucccugccuggaccag

SEQ ID NO: 3252425 - RNA, 23 nt, Human
gagucccugccuggaccagccuc

SEQ ID NO: 3252426 - RNA, 21 nt, Human
gagucccugccuggaccagcc

SEQ ID NO: 3252427 - RNA, 13 nt, Human
gaggguguccugc

SEQ ID NO: 3252428 - RNA, 14 nt, Human
gagggggagagggc

SEQ ID NO: 3252429 - RNA, 14 nt, Human
gaggcagggaagga

SEQ ID NO: 3252430 - RNA, 21 nt, Human
gaggcgaagcguuguccucag

SEQ ID NO: 3252431 - RNA, 20 nt, Human
gaggcgaagcguuguccuca

SEQ ID NO: 3252432 - RNA, 22 nt, Human
gaggccucucauuccagaggaa

SEQ ID NO: 3252433 - RNA, 23 nt, Human
gcacuggggcaggggccgggggc

SEQ ID NO: 3252434 - RNA, 18 nt, Human
gcacuggggcaggggccg

SEQ ID NO: 3252435 - RNA, 15 nt, Human
gcacuggggcagggg

SEQ ID NO: 3252436 - RNA, 23 nt, Human
gauugcaggagucccugccauca

SEQ ID NO: 3252437 - RNA, 21 nt, Human
gaugggucaguuguaucagca

SEQ ID NO: 3252438 - RNA, 15 nt, Human
gaugggucaguugua

SEQ ID NO: 3252439 - RNA, 22 nt, Human
cuuucuuccaaacaggcucaga

SEQ ID NO: 3252440 - RNA, 13 nt, Human
cuugucacgccag

SEQ ID NO: 3252441 - RNA, 16 nt, Human
cuugucacgccagacu

SEQ ID NO: 3252442 - RNA, 14 nt, Human
cuuuguggcacugg

SEQ ID NO: 3252443 - RNA, 17 nt, Human
cuguguguuuaugugug

SEQ ID NO: 3252444 - RNA, 16 nt, Human
cuguguguuuaugugu

SEQ ID NO: 3252445 - RNA, 21 nt, Human
cuguguguguguauguggggg

SEQ ID NO: 3252446 - RNA, 19 nt, Human
cugugaggggcucucucau

SEQ ID NO: 3252447 - RNA, 21 nt, Human
cugucucccuccucugcccgg

SEQ ID NO: 3252448 - RNA, 11 nt, Human
cugcugggcuu

SEQ ID NO: 3252449 - RNA, 22 nt, Human
cugccgagaguccaucagccuc

SEQ ID NO: 3252450 - RNA, 23 nt, Human
cugccgagaguccaucagccucc

SEQ ID NO: 3252451 - RNA, 17 nt, Human
cuggagguuuguuuaga

SEQ ID NO: 3252452 - RNA, 12 nt, Human
cuggagguuugu

SEQ ID NO: 3252453 - RNA, 18 nt, Human
cuggaccagccucuccac

SEQ ID NO: 3252454 - RNA, 14 nt, Human
cuggaccagccucu

SEQ ID NO: 3252455 - RNA, 21 nt, Human
cuggccaguggcuggaucugu

SEQ ID NO: 3252456 - RNA, 15 nt, Human
cccacggcuccucga

SEQ ID NO: 3252457 - RNA, 15 nt, Human
cccacgucagcuggg

SEQ ID NO: 3252458 - RNA, 14 nt, Human
cccaacacugccag

SEQ ID NO: 3252459 - RNA, 16 nt, Human
cccaacacugccagca

SEQ ID NO: 3252460 - RNA, 15 nt, Human
cccaacacugccagc

SEQ ID NO: 3252461 - RNA, 14 nt, Human
ccccugugccuugu

SEQ ID NO: 3252462 - RNA, 22 nt, Human
cccaugagcuccuuaaggcucu

SEQ ID NO: 3252463 - RNA, 15 nt, Human
cccaugagcuccuua

SEQ ID NO: 3252464 - RNA, 14 nt, Human
cccaugagcuccuu

SEQ ID NO: 3252465 - RNA, 13 nt, Human
cccaugagcuccu

SEQ ID NO: 3252466 - RNA, 20 nt, Human
ccggggccugggcaggaggg

SEQ ID NO: 3252467 - RNA, 21 nt, Human
ccgggggcagucugagagagg

SEQ ID NO: 3252468 - RNA, 21 nt, Human
ccgagaguccaucagccucca

SEQ ID NO: 3252469 - RNA, 20 nt, Human
ccgagaguccaucagccucc

SEQ ID NO: 3252470 - RNA, 13 nt, Human
ccuaaccugccga

SEQ ID NO: 3252471 - RNA, 12 nt, Human
ccuaaccugccg

SEQ ID NO: 3252472 - RNA, 23 nt, Human
ccguggcuguggcauccagaguc

SEQ ID NO: 3252473 - RNA, 21 nt, Human
cgaagcguuguccucagcccc

SEQ ID NO: 3252474 - RNA, 17 nt, Human
cgaagcguuguccucag

SEQ ID NO: 3252475 - RNA, 16 nt, Human
cgaagcguuguccuca

SEQ ID NO: 3252476 - RNA, 15 nt, Human
cgaagcguuguccuc

SEQ ID NO: 3252477 - RNA, 14 nt, Human
ccuuugucccagaa

SEQ ID NO: 3252478 - RNA, 17 nt, Human
ccugugccuuuugccau

SEQ ID NO: 3252479 - RNA, 19 nt, Human
cgggacaccuaggcuaggg

SEQ ID NO: 3252480 - RNA, 18 nt, Human
cgggacaccuaggcuagg

SEQ ID NO: 3252481 - RNA, 16 nt, Human
cgcggcugggaggagg

SEQ ID NO: 3252482 - RNA, 12 nt, Human
cgcggcugggag

SEQ ID NO: 3252483 - RNA, 11 nt, Human
cgcggcuggga

SEQ ID NO: 3252484 - RNA, 15 nt, Human
ccugcaccggggccu

SEQ ID NO: 3252485 - RNA, 17 nt, Human
ccugcaccggggccugg

SEQ ID NO: 3252486 - RNA, 19 nt, Human
ccugaagagaagggcaggg

SEQ ID NO: 3252487 - RNA, 14 nt, Human
ccugccgagagucc

SEQ ID NO: 3252488 - RNA, 23 nt, Human
ccugccgagaguccaucagccuc

SEQ ID NO: 3252489 - RNA, 22 nt, Human
ccugccgagaguccaucagccu

SEQ ID NO: 3252490 - RNA, 16 nt, Human
cuccacucaugugacu

SEQ ID NO: 3252491 - RNA, 22 nt, Human
cuccacucaugugacucuuucc

SEQ ID NO: 3252492 - RNA, 20 nt, Human
cuccccacgucagcugggac

SEQ ID NO: 3252493 - RNA, 17 nt, Human
cucaggaaccgaggcag

SEQ ID NO: 3252494 - RNA, 19 nt, Human
cucaggaaccgaggcaggg

SEQ ID NO: 3252495 - RNA, 18 nt, Human
cucaggaaccgaggcagg

SEQ ID NO: 3252496 - RNA, 16 nt, Human
cucagaggguguccug

SEQ ID NO: 3252497 - RNA, 17 nt, Human
cucagccccgcguggaa

SEQ ID NO: 3252498 - RNA, 22 nt, Human
cuacucuggagguuuguuuaga

SEQ ID NO: 3252499 - RNA, 21 nt, Human
cuauggggauagaugugugga

SEQ ID NO: 3252500 - RNA, 20 nt, Human
cuauggggauagaugugugg

SEQ ID NO: 3252501 - RNA, 19 nt, Human
cuauggggauagaugugug

SEQ ID NO: 3252502 - RNA, 22 nt, Human
cugagagaggccauucuuuccc

SEQ ID NO: 3252503 - RNA, 21 nt, Human
cugagagaggccauucuuucc

SEQ ID NO: 3252504 - RNA, 14 nt, Human
cugagagaggccau

SEQ ID NO: 3252505 - RNA, 13 nt, Human
cugagagaggcca

SEQ ID NO: 3252506 - RNA, 12 nt, Human
cugagaggccac

SEQ ID NO: 3252507 - RNA, 15 nt, Human
cucgugucuggcaca

SEQ ID NO: 3252508 - RNA, 14 nt, Human
cucaugugacucuu

SEQ ID NO: 3252509 - RNA, 18 nt, Human
cucaugugacucuuucca

SEQ ID NO: 3252510 - RNA, 22 nt, Human
cuaauucuuugaccuguuggga

SEQ ID NO: 3252511 - RNA, 21 nt, Human
cuaauucuuugaccuguuggg

SEQ ID NO: 3252512 - RNA, 19 nt, Human
auucuuugaccuguuggga

SEQ ID NO: 3252513 - RNA, 18 nt, Human
caacaccucuuggggagu

SEQ ID NO: 3252514 - RNA, 13 nt, Human
cacuggggcaggg

SEQ ID NO: 3252515 - RNA, 15 nt, Human
cacuggggcaggggc

SEQ ID NO: 3252516 - RNA, 18 nt, Human
cagggcugaggccucuca

SEQ ID NO: 3252517 - RNA, 16 nt, Human
cagggcugaggccucu

SEQ ID NO: 3252518 - RNA, 17 nt, Human
cagaggguguccugcac

SEQ ID NO: 3252519 - RNA, 23 nt, Human
cuggcccuaugcuuccggccucc

SEQ ID NO: 3252520 - RNA, 14 nt, Human
cuuuugucccagaa

SEQ ID NO: 3252521 - RNA, 17 nt, Human
cuucuaccucuuggcug

SEQ ID NO: 3252522 - RNA, 19 nt, Human
cuuccucuccugucucccu

SEQ ID NO: 3252523 - RNA, 15 nt, Human
cuuccucuccugucu

SEQ ID NO: 3252524 - RNA, 20 nt, Human
gacccucaucuuucuuccaa

SEQ ID NO: 3252525 - RNA, 22 nt, Human
gaggacaguauuuguggggagg

SEQ ID NO: 3252526 - RNA, 16 nt, Human
gagacgggcccuggug

SEQ ID NO: 3252527 - RNA, 13 nt, Human
gauggaaugaugg

SEQ ID NO: 3252528 - RNA, 19 nt, Human
gaucccaacacugccagca

SEQ ID NO: 3252529 - RNA, 18 nt, Human
gaucccaacacugccagc

SEQ ID NO: 3252530 - RNA, 17 nt, Human
gaucccaacacugccag

SEQ ID NO: 3252531 - RNA, 21 nt, Human
gcauccagagucccugccugg

SEQ ID NO: 3252532 - RNA, 23 nt, Human
gcauccagagucccugccuggac

SEQ ID NO: 3252533 - RNA, 22 nt, Human
gcauccagagucccugccugga

SEQ ID NO: 3252534 - RNA, 17 nt, Human
gcaucggggagccggga

SEQ ID NO: 3252535 - RNA, 12 nt, Human
ggcaggggccgg

SEQ ID NO: 3252536 - RNA, 14 nt, Human
ggcaggagggaggu

SEQ ID NO: 3252537 - RNA, 22 nt, Human
ggcaucggggagccgggagccu

SEQ ID NO: 3252538 - RNA, 18 nt, Human
ggcauccagagucccugc

SEQ ID NO: 3252539 - RNA, 16 nt, Human
ggcauccagagucccu

SEQ ID NO: 3252540 - RNA, 23 nt, Human
ggcaucggggagccgggagccug

SEQ ID NO: 3252541 - RNA, 14 nt, Human
ggagggggagaggg

SEQ ID NO: 3252542 - RNA, 22 nt, Human
ggaguguguaauuuaaaauugu

SEQ ID NO: 3252543 - RNA, 11 nt, Human
ggaguguguaa

SEQ ID NO: 3252544 - RNA, 22 nt, Human
gguggggggggggcgcggcugg

SEQ ID NO: 3252545 - RNA, 22 nt, Human
gguuuguuuagaagaagugugu

SEQ ID NO: 3252546 - RNA, 21 nt, Human
ggguguccugcaccggggccu

SEQ ID NO: 3252547 - RNA, 17 nt, Human
ggguguccugcaccggg

SEQ ID NO: 3252548 - RNA, 16 nt, Human
gguaggaacugcuggg

SEQ ID NO: 3252549 - RNA, 18 nt, Human
gguaggaacugcugggcu

SEQ ID NO: 3252550 - RNA, 22 nt, Human
gggggcagucugagagaggcca

SEQ ID NO: 3252551 - RNA, 18 nt, Human
gggucauucauggccugg

SEQ ID NO: 3252552 - RNA, 21 nt, Human
gggucaucuguaccucugccu

SEQ ID NO: 3252553 - RNA, 19 nt, Human
gcucagaggguguccugca

SEQ ID NO: 3252554 - RNA, 18 nt, Human
gcucagaggguguccugc

SEQ ID NO: 3252555 - RNA, 18 nt, Human
gcuaggguggggagagac

SEQ ID NO: 3252556 - RNA, 17 nt, Human
gcuaggguggggagaga

SEQ ID NO: 3252557 - RNA, 21 nt, Human
gcguggaacucgugucuggca

SEQ ID NO: 3252558 - RNA, 12 nt, Human
gccauucuuucc

SEQ ID NO: 3252559 - RNA, 19 nt, Human
gccauucuuucccaacacc

SEQ ID NO: 3252560 - RNA, 22 nt, Human
gcuuuuccucaaagggagagag

SEQ ID NO: 3252561 - RNA, 19 nt, Human
ggacaguauuuguggggag

SEQ ID NO: 3252562 - RNA, 18 nt, Human
ggacaguauuugugggga

SEQ ID NO: 3252563 - RNA, 16 nt, Human
ggacaccuaggcuagg

SEQ ID NO: 3252564 - RNA, 16 nt, Human
ggacaccccgacuuuu

SEQ ID NO: 3252565 - RNA, 20 nt, Human
gcugggaauaagugccagga

SEQ ID NO: 3252566 - RNA, 11 nt, Human
ugugauguguc

SEQ ID NO: 3252567 - RNA, 13 nt, Human
agucccugccugg

SEQ ID NO: 3252568 - RNA, 14 nt, Human
aguccaucagccuc

SEQ ID NO: 3252569 - RNA, 13 nt, Human
aguccaucagccu

SEQ ID NO: 3252570 - RNA, 22 nt, Human
uguauccauccauggggcugau

SEQ ID NO: 3252571 - RNA, 22 nt, Human
uguaugugggggucuguguguu

SEQ ID NO: 3252572 - RNA, 21 nt, Human
uguaugugggggucugugugu

SEQ ID NO: 3252573 - RNA, 20 nt, Human
uguaugugggggucugugug

SEQ ID NO: 3252574 - RNA, 23 nt, Human
ugggaauaagugccaggauggaa

SEQ ID NO: 3252575 - RNA, 13 nt, Human
ugggucugugugu

SEQ ID NO: 3252576 - RNA, 15 nt, Human
ugggucugugugugu

SEQ ID NO: 3252577 - RNA, 14 nt, Human
uuaucaacauuugu

SEQ ID NO: 3252578 - RNA, 18 nt, Human
uguugggagugaggaugu

SEQ ID NO: 3252579 - RNA, 14 nt, Human
agcugccugugccu

SEQ ID NO: 3252580 - RNA, 22 nt, Human
uggaccagccucuccacucaug

SEQ ID NO: 3252581 - RNA, 16 nt, Human
uggaccagccucucca

SEQ ID NO: 3252582 - RNA, 13 nt, Human
ugcuccccacguc

SEQ ID NO: 3252583 - RNA, 18 nt, Human
ugcuauuguagagccaga

SEQ ID NO: 3252584 - RNA, 22 nt, Human
ugcuauuguagagccagagguc

SEQ ID NO: 3252585 - RNA, 22 nt, Human
uggaccuuuccugaggaagagg

SEQ ID NO: 3252586 - RNA, 15 nt, Human
aggccauucuuuccc

SEQ ID NO: 3252587 - RNA, 21 nt, Human
aggccucucauuccagaggaa

SEQ ID NO: 3252588 - RNA, 19 nt, Human
aggccauucuuucccaaca

SEQ ID NO: 3252589 - RNA, 18 nt, Human
aggccauucuuucccaac

SEQ ID NO: 3252590 - RNA, 17 nt, Human
aggccauucuuucccaa

SEQ ID NO: 3252591 - RNA, 15 nt, Human
uggccaguggcugga

SEQ ID NO: 3252592 - RNA, 14 nt, Human
uggccaguggcugg

SEQ ID NO: 3252593 - RNA, 16 nt, Human
uggccaguggcuggau

SEQ ID NO: 3252594 - RNA, 22 nt, Human
uggcugccuugugaaggaauua

SEQ ID NO: 3252595 - RNA, 22 nt, Human
uuguccucagccccgcguggaa

SEQ ID NO: 3252596 - RNA, 18 nt, Human
uugucccugaagagaagg

SEQ ID NO: 3252597 - RNA, 20 nt, Human
uugucacgccagacuuccca

SEQ ID NO: 3252598 - RNA, 13 nt, Human
uugucacgccaga

SEQ ID NO: 3252599 - RNA, 16 nt, Human
uugugugugggagugu

SEQ ID NO: 3252600 - RNA, 13 nt, Human
uugugugugggag

SEQ ID NO: 3252601 - RNA, 10 nt, Human
uugugugugg

SEQ ID NO: 3252602 - RNA, 16 nt, Human
aucggggagccgggag

SEQ ID NO: 3252603 - RNA, 18 nt, Human
aucggggagccgggagcc

SEQ ID NO: 3252604 - RNA, 20 nt, Human
aucauuaucagccugugcca

SEQ ID NO: 3252605 - RNA, 20 nt, Human
auccauggggcugauuguau

SEQ ID NO: 3252606 - RNA, 16 nt, Human
uucagauuugccuuau

SEQ ID NO: 3252607 - RNA, 20 nt, Human
auuucccuuccuuccucucc

SEQ ID NO: 3252608 - RNA, 12 nt, Human
auugguguugac

SEQ ID NO: 3252609 - RNA, 15 nt, Human
auugugauguguccu

SEQ ID NO: 3252610 - RNA, 14 nt, Human
auugugaugugucc

SEQ ID NO: 3252611 - RNA, 13 nt, Human
auugugauguguc

SEQ ID NO: 3252612 - RNA, 16 nt, Human
uuuuguuuaccagaga

SEQ ID NO: 3252613 - RNA, 10 nt, Human
augugugugu

SEQ ID NO: 3252614 - RNA, 13 nt, Human
auguggaagugug

SEQ ID NO: 3252615 - RNA, 16 nt, Human
auguggaagugugggu

SEQ ID NO: 3252616 - RNA, 15 nt, Human
auguggaaguguggg

SEQ ID NO: 3252617 - RNA, 23 nt, Human
auguggaagugugggucugugug

SEQ ID NO: 3252618 - RNA, 22 nt, Human
auguggaagugugggucugugu

SEQ ID NO: 3252619 - RNA, 13 nt, Human
ugagagaggccau

SEQ ID NO: 3252620 - RNA, 14 nt, Human
agaagaaguguguc

SEQ ID NO: 3252621 - RNA, 14 nt, Human
ucuaguucugccag

SEQ ID NO: 3252622 - RNA, 17 nt, Human
ucuaguucugccaggag

SEQ ID NO: 3252623 - RNA, 16 nt, Human
ucuaguucugccagga

SEQ ID NO: 3252624 - RNA, 15 nt, Human
ucuaguucugccagg

SEQ ID NO: 3252625 - RNA, 17 nt, Human
ucagauuugccuuauug

SEQ ID NO: 3252626 - RNA, 12 nt, Human
ucaguaugugga

SEQ ID NO: 3252627 - RNA, 14 nt, Human
ucaguauguggaag

SEQ ID NO: 3252628 - RNA, 13 nt, Human
accgaggcaggga

SEQ ID NO: 3252629 - RNA, 16 nt, Human
ucauaaauuuaugguu

SEQ ID NO: 3252630 - RNA, 17 nt, Human
ucaugugacucuuucca

SEQ ID NO: 3252631 - RNA, 14 nt, Human
ucaugugacucuuu

SEQ ID NO: 3252632 - RNA, 19 nt, Human
ucaugugacucuuuccaac

SEQ ID NO: 3252633 - RNA, 18 nt, Human
ucaugugacucuuuccaa

SEQ ID NO: 3252634 - RNA, 17 nt, Human
ucauguuuacagaggac

SEQ ID NO: 3252635 - RNA, 17 nt, Human
accuaggcuaggguggg

SEQ ID NO: 3252636 - RNA, 12 nt, Human
accuaggcuagg

SEQ ID NO: 3252637 - RNA, 23 nt, Human
ucacagcaagucacuggccagug

SEQ ID NO: 3252638 - RNA, 19 nt, Human
uccugcaccggggccuggg

SEQ ID NO: 3252639 - RNA, 18 nt, Human
uccugcaccggggccugg

SEQ ID NO: 3252640 - RNA, 21 nt, Human
acucuggagguuuguuuagaa

SEQ ID NO: 3252641 - RNA, 22 nt, Human
uaacuuaaaagaacauguauau

SEQ ID NO: 3252642 - RNA, 16 nt, Human
acaccucuuggggagu

SEQ ID NO: 3252643 - RNA, 16 nt, Human
uauguggaaguguggg

SEQ ID NO: 3252644 - RNA, 12 nt, Human
uauguggaagug

SEQ ID NO: 3252645 - RNA, 20 nt, Human
uauggggauagaugugugga

SEQ ID NO: 3252646 - RNA, 21 nt, Human
guguaugugggggucugugug

SEQ ID NO: 3252647 - RNA, 13 nt, Human
guguauguggggg

SEQ ID NO: 3252648 - RNA, 16 nt, Human
uaaaauugugaugugu

SEQ ID NO: 3252649 - RNA, 15 nt, Human
uaaaauugugaugug

SEQ ID NO: 3252650 - RNA, 18 nt, Human
aagugugggucugugugu

SEQ ID NO: 3252651 - RNA, 17 nt, Human
aagugugggucugugug

SEQ ID NO: 3252652 - RNA, 10 nt, Human
aagugugggu

SEQ ID NO: 3252653 - RNA, 20 nt, Human
aagugugggucugugugugu

SEQ ID NO: 3252654 - RNA, 21 nt, Human
aagucacuggccaguggcugg

SEQ ID NO: 3252655 - RNA, 19 nt, Human
aagaagugugucacccuua

SEQ ID NO: 3252656 - RNA, 10 nt, Human
gugauguguc

SEQ ID NO: 3252657 - RNA, 15 nt, Human
guccaucagccucca

SEQ ID NO: 3252658 - RNA, 22 nt, Human
gucccgggacaccuaggcuagg

SEQ ID NO: 3252659 - RNA, 18 nt, Human
augugggggucugugugu

SEQ ID NO: 3252660 - RNA, 17 nt, Human
augugggggucugugug

SEQ ID NO: 3252661 - RNA, 16 nt, Human
augugggggucugugu

SEQ ID NO: 3252662 - RNA, 23 nt, Human
aguuguaucagcacguguggccu

SEQ ID NO: 3252663 - RNA, 20 nt, Human
aguuguaucagcacgugugg

SEQ ID NO: 3252664 - RNA, 23 nt, Human
aggugcuucuaguucugccagga

SEQ ID NO: 3252665 - RNA, 22 nt, Human
aggugcuucuaguucugccagg

SEQ ID NO: 3252666 - RNA, 21 nt, Human
aggugcuucuaguucugccag

SEQ ID NO: 3252667 - RNA, 19 nt, Human
aggcuauggggauagaugu

SEQ ID NO: 3252668 - RNA, 22 nt, Human
aggcuauggggauagaugugug

SEQ ID NO: 3252669 - RNA, 21 nt, Human
aggcuauggggauagaugugu

SEQ ID NO: 3252670 - RNA, 14 nt, Human
agacgggcccuggu

SEQ ID NO: 3252671 - RNA, 16 nt, Human
agaggguguccugcac

SEQ ID NO: 3252672 - RNA, 13 nt, Human
agccagaggucug

SEQ ID NO: 3252673 - RNA, 15 nt, Human
accccgacuuuuguu

SEQ ID NO: 3252674 - RNA, 12 nt, Human
accccgacuuuu

SEQ ID NO: 3252675 - RNA, 15 nt, Human
acagguuagcugcuc

SEQ ID NO: 3252676 - RNA, 11 nt, Human
acacugccagc

SEQ ID NO: 3252677 - RNA, 22 nt, Human
acgccagacuucccacggcucc

SEQ ID NO: 3252678 - RNA, 16 nt, Human
acgccagacuucccac

SEQ ID NO: 3252679 - RNA, 13 nt, Human
acucagucuuuaa

SEQ ID NO: 3252680 - RNA, 22 nt, Human
aaugucaguauguggaagugug

SEQ ID NO: 3252681 - RNA, 16 nt, Human
aaugucaguaugugga

SEQ ID NO: 3252682 - RNA, 17 nt, Human
aauaagugccaggaugg

SEQ ID NO: 3252683 - RNA, 12 nt, Human
caacacugccag

SEQ ID NO: 3252684 - RNA, 14 nt, Human
caacacugccagca

SEQ ID NO: 3252685 - RNA, 13 nt, Human
caacacugccagc

SEQ ID NO: 3252686 - RNA, 22 nt, Human
caaccggcuuuguggcacuggg

SEQ ID NO: 3252687 - RNA, 13 nt, Human
caaccggcuuugu

SEQ ID NO: 3252688 - RNA, 12 nt, Human
uauucccaugag

SEQ ID NO: 3252689 - RNA, 14 nt, Human
ucauuccagaggaa

SEQ ID NO: 3252690 - RNA, 19 nt, Human
ucagaggguguccugcacc

SEQ ID NO: 3252691 - RNA, 15 nt, Human
ucugccaggagacag

SEQ ID NO: 3252692 - RNA, 21 nt, Human
ucgugucuggcacagccuggc

SEQ ID NO: 3252693 - RNA, 14 nt, Human
ucgugucuggcaca

SEQ ID NO: 3252694 - RNA, 19 nt, Human
ucccuuccuuccucuccug

SEQ ID NO: 3252695 - RNA, 16 nt, Human
ucccuuccuuccucuc

SEQ ID NO: 3252696 - RNA, 13 nt, Human
ucccugccuggac

SEQ ID NO: 3252697 - RNA, 21 nt, Human
ucccgggacaccuaggcuagg

SEQ ID NO: 3252698 - RNA, 16 nt, Human
ucccuccucugcccgg

SEQ ID NO: 3252699 - RNA, 18 nt, Human
ugauuuuuaugccaccug

SEQ ID NO: 3252700 - RNA, 21 nt, Human
ugcauuauauuuguaaauuua

SEQ ID NO: 3252701 - RNA, 22 nt, Human
ugccaucauguuuacagaggac

SEQ ID NO: 3252702 - RNA, 17 nt, Human
ugcccgggagcucagga

SEQ ID NO: 3252703 - RNA, 18 nt, Human
ugcccgggagcucaggaa

SEQ ID NO: 3252704 - RNA, 17 nt, Human
ugaguuggcugggaaua

SEQ ID NO: 3252705 - RNA, 16 nt, Human
ugaguuggcugggaau

SEQ ID NO: 3252706 - RNA, 14 nt, Human
ugaguuggcuggga

SEQ ID NO: 3252707 - RNA, 21 nt, Human
ugacccucaucuuucuuccaa

SEQ ID NO: 3252708 - RNA, 18 nt, Human
uguccugcaccggggccu

SEQ ID NO: 3252709 - RNA, 13 nt, Human
uguccucagcccc

SEQ ID NO: 3252710 - RNA, 17 nt, Human
uguaaauuuaugugaug

SEQ ID NO: 3252711 - RNA, 16 nt, Human
uggccuaaccugccga

SEQ ID NO: 3252712 - RNA, 23 nt, Human
uggccuaaccugccgagagucca

SEQ ID NO: 3252713 - RNA, 17 nt, Human
ugggaggagggcaggca

SEQ ID NO: 3252714 - RNA, 14 nt, Human
ugggaggagggcag

SEQ ID NO: 3252715 - RNA, 13 nt, Human
ugggaguguguaa

SEQ ID NO: 3252716 - RNA, 18 nt, Human
ugggaggagggcaggcau

SEQ ID NO: 3252717 - RNA, 19 nt, Human
uuuccaaccggcuuugugg

SEQ ID NO: 3252718 - RNA, 21 nt, Human
uuccugaggaagagggacugu

SEQ ID NO: 3252719 - RNA, 21 nt, Human
uuuuauuuuucucaugaugag

SEQ ID NO: 3252720 - RNA, 13 nt, Human
cauuccagaggaa

SEQ ID NO: 3252721 - RNA, 14 nt, Human
cauuccagaggaag

SEQ ID NO: 3252722 - RNA, 12 nt, Human
cauucuuuccca

SEQ ID NO: 3252723 - RNA, 14 nt, Human
cauucuuucccaac

SEQ ID NO: 3252724 - RNA, 14 nt, Human
caugugacucuuuc

SEQ ID NO: 3252725 - RNA, 17 nt, Human
caugugacucuuuccaa

SEQ ID NO: 3252726 - RNA, 16 nt, Human
caugugacucuuucca

SEQ ID NO: 3252727 - RNA, 17 nt, Human
cauccagagucccugcc

SEQ ID NO: 3252728 - RNA, 13 nt, Human
cauccagaguccc

SEQ ID NO: 3252729 - RNA, 20 nt, Human
cauccagagucccugccugg

SEQ ID NO: 3252730 - RNA, 18 nt, Human
cauccagagucccugccu

SEQ ID NO: 3252731 - RNA, 13 nt, Human
caucauguuuaca

SEQ ID NO: 3252732 - RNA, 21 nt, Human
caucauguuuacagaggacag

SEQ ID NO: 3252733 - RNA, 19 nt, Human
caucauguuuacagaggac

SEQ ID NO: 3252734 - RNA, 15 nt, Human
cauccuacccccugu

SEQ ID NO: 3252735 - RNA, 18 nt, Human
cauccuacccccugugcc

SEQ ID NO: 3252736 - RNA, 23 nt, Human
caugagcuccuuaaggcucuuuu

SEQ ID NO: 3252737 - RNA, 19 nt, Human
caugaguuggcugggaaua

SEQ ID NO: 3252738 - RNA, 13 nt, Human
ccaggagacaggu

SEQ ID NO: 3252739 - RNA, 17 nt, Human
ccauccuacccccugug

SEQ ID NO: 3252740 - RNA, 18 nt, Human
ccauccuacccccugugc

SEQ ID NO: 3252741 - RNA, 21 nt, Human
ccagcauuucccuuccuuccu

SEQ ID NO: 3252742 - RNA, 16 nt, Human
ccagcauuucccuucc

SEQ ID NO: 3252743 - RNA, 20 nt, Human
ccaccugaauaaagaaugaa

SEQ ID NO: 3252744 - RNA, 22 nt, Human
ccacucaugugacucuuuccaa

SEQ ID NO: 3252745 - RNA, 19 nt, Human
ccacucaugugacucuuuc

SEQ ID NO: 3252746 - RNA, 19 nt, Human
ccugaggaagagggacugu

SEQ ID NO: 3252747 - RNA, 12 nt, Human
ccugggcaggag

SEQ ID NO: 3252748 - RNA, 14 nt, Human
ccugggcaggaggg

SEQ ID NO: 3252749 - RNA, 22 nt, Human
cgagaucccaacacugccagca

SEQ ID NO: 3252750 - RNA, 13 nt, Human
cgagaucccaaca

SEQ ID NO: 3252751 - RNA, 21 nt, Human
cgagaucccaacacugccagc

SEQ ID NO: 3252752 - RNA, 15 nt, Human
cgagaucccaacacu

SEQ ID NO: 3252753 - RNA, 13 nt, Human
ccuuaaggcucuu

SEQ ID NO: 3252754 - RNA, 18 nt, Human
ccuuaaggcucuuuugua

SEQ ID NO: 3252755 - RNA, 16 nt, Human
ccuuaaggcucuuuug

SEQ ID NO: 3252756 - RNA, 18 nt, Human
ccuugucacgccagacuu

SEQ ID NO: 3252757 - RNA, 15 nt, Human
ccuugucacgccaga

SEQ ID NO: 3252758 - RNA, 18 nt, Human
ccucucauuccagaggaa

SEQ ID NO: 3252759 - RNA, 18 nt, Human
ccucuccacucaugugac

SEQ ID NO: 3252760 - RNA, 22 nt, Human
ccgggucaucuguaccucugcc

SEQ ID NO: 3252761 - RNA, 19 nt, Human
ccgggacaccuaggcuagg

SEQ ID NO: 3252762 - RNA, 20 nt, Human
ccgggacaccuaggcuaggg

SEQ ID NO: 3252763 - RNA, 15 nt, Human
ccgaggcagggaagg

SEQ ID NO: 3252764 - RNA, 16 nt, Human
ccuaggcuaggguggg

SEQ ID NO: 3252765 - RNA, 14 nt, Human
cuguguguguguau

SEQ ID NO: 3252766 - RNA, 16 nt, Human
cuguguguguguaugu

SEQ ID NO: 3252767 - RNA, 15 nt, Human
cuguguguguguaug

SEQ ID NO: 3252768 - RNA, 20 nt, Human
cuguguguuuaugugugugu

SEQ ID NO: 3252769 - RNA, 18 nt, Human
cuguguguuuaugugugu

SEQ ID NO: 3252770 - RNA, 20 nt, Human
cuguguguguguaugugggg

SEQ ID NO: 3252771 - RNA, 18 nt, Human
cuguguguguguaugugg

SEQ ID NO: 3252772 - RNA, 18 nt, Human
cuguggccuaaccugccg

SEQ ID NO: 3252773 - RNA, 22 nt, Human
cuggugguggcucgggaggcga

SEQ ID NO: 3252774 - RNA, 14 nt, Human
cuggugguggcucg

SEQ ID NO: 3252775 - RNA, 15 nt, Human
cuuaaggcucuuuug

SEQ ID NO: 3252776 - RNA, 19 nt, Human
cuuccaaacaggcucagag

SEQ ID NO: 3252777 - RNA, 20 nt, Human
gaauaagugccaggauggaa

SEQ ID NO: 3252778 - RNA, 17 nt, Human
gaauaaagaaugaaugg

SEQ ID NO: 3252779 - RNA, 14 nt, Human
gaaugccuccugca

SEQ ID NO: 3252780 - RNA, 19 nt, Human
gaaggaucccaugagcucc

SEQ ID NO: 3252781 - RNA, 13 nt, Human
gaacuauuagagc

SEQ ID NO: 3252782 - RNA, 17 nt, Human
cuuucccaacaccucuu

SEQ ID NO: 3252783 - RNA, 13 nt, Human
cuuucccaacacc

SEQ ID NO: 3252784 - RNA, 14 nt, Human
cuauuguagagcca

SEQ ID NO: 3252785 - RNA, 13 nt, Human
cucgagaucccaa

SEQ ID NO: 3252786 - RNA, 23 nt, Human
cucgagaucccaacacugccagc

SEQ ID NO: 3252787 - RNA, 22 nt, Human
cucgagaucccaacacugccag

SEQ ID NO: 3252788 - RNA, 21 nt, Human
cucgagaucccaacacugcca

SEQ ID NO: 3252789 - RNA, 17 nt, Human
cugccuggaccagccuc

SEQ ID NO: 3252790 - RNA, 13 nt, Human
cugauuguauuua

SEQ ID NO: 3252791 - RNA, 20 nt, Human
cucugcccgggagcucagga

SEQ ID NO: 3252792 - RNA, 14 nt, Human
cucugcccgggagc

SEQ ID NO: 3252793 - RNA, 12 nt, Human
cugagcaggugu

SEQ ID NO: 3252794 - RNA, 21 nt, Human
gauguguccugauaagcugag

SEQ ID NO: 3252795 - RNA, 20 nt, Human
gauggcaaagaaggagagca

SEQ ID NO: 3252796 - RNA, 14 nt, Human
gagucccugccauc

SEQ ID NO: 3252797 - RNA, 15 nt, Human
gagucccugccugga

SEQ ID NO: 3252798 - RNA, 14 nt, Human
gagucccugccugg

SEQ ID NO: 3252799 - RNA, 16 nt, Human
gagucccugccuggac

SEQ ID NO: 3252800 - RNA, 22 nt, Human
gagguuuguuuagaagaagugu

SEQ ID NO: 3252801 - RNA, 22 nt, Human
gagcucaggaaccgaggcaggg

SEQ ID NO: 3252802 - RNA, 23 nt, Human
gagcucaggaaccgaggcaggga

SEQ ID NO: 3252803 - RNA, 15 nt, Human
gaggaugucugggcc

SEQ ID NO: 3252804 - RNA, 15 nt, Human
gaggagggcaggcau

SEQ ID NO: 3252805 - RNA, 14 nt, Human
gaggagggcaggca

SEQ ID NO: 3252806 - RNA, 13 nt, Human
gaggagggcaggc

SEQ ID NO: 3252807 - RNA, 21 nt, Human
gccagacuucccacggcuccu

SEQ ID NO: 3252808 - RNA, 16 nt, Human
gccaccugaauaaaga

SEQ ID NO: 3252809 - RNA, 15 nt, Human
gccacgauugcagga

SEQ ID NO: 3252810 - RNA, 23 nt, Human
gcaggcaucggggagccgggagc

SEQ ID NO: 3252811 - RNA, 22 nt, Human
gcaggcaucggggagccgggag

SEQ ID NO: 3252812 - RNA, 21 nt, Human
gcaggcaucggggagccggga

SEQ ID NO: 3252813 - RNA, 20 nt, Human
gcuguggccuaaccugccga

SEQ ID NO: 3252814 - RNA, 19 nt, Human
gcuguggccuaaccugccg

SEQ ID NO: 3252815 - RNA, 14 nt, Human
gcuggggaugucuc

SEQ ID NO: 3252816 - RNA, 21 nt, Human
gcugggaggagggcaggcauc

SEQ ID NO: 3252817 - RNA, 22 nt, Human
gcugggcuuggcagcccggguc

SEQ ID NO: 3252818 - RNA, 14 nt, Human
gcugauuguauuua

SEQ ID NO: 3252819 - RNA, 17 nt, Human
gccuugucacgccagac

SEQ ID NO: 3252820 - RNA, 16 nt, Human
gccuugucacgccaga

SEQ ID NO: 3252821 - RNA, 15 nt, Human
gccuugucacgccag

SEQ ID NO: 3252822 - RNA, 17 nt, Human
gcgaagcguuguccuca

SEQ ID NO: 3252823 - RNA, 16 nt, Human
gccuggaccagccucu

SEQ ID NO: 3252824 - RNA, 17 nt, Human
gccuggaccagccucuc

SEQ ID NO: 3252825 - RNA, 16 nt, Human
gccugggcaggaggga

SEQ ID NO: 3252826 - RNA, 21 nt, Human
gcuccuuaaggcucuuuugua

SEQ ID NO: 3252827 - RNA, 17 nt, Human
gcuccuuaaggcucuuu

SEQ ID NO: 3252828 - RNA, 15 nt, Human
gcuccuuaaggcucu

SEQ ID NO: 3252829 - RNA, 20 nt, Human
ggccucucauuccagaggaa

SEQ ID NO: 3252830 - RNA, 16 nt, Human
ggccuaaccugccgag

SEQ ID NO: 3252831 - RNA, 15 nt, Human
ggccuaaccugccga

SEQ ID NO: 3252832 - RNA, 19 nt, Human
ggccugggcaggagggagg

SEQ ID NO: 3252833 - RNA, 17 nt, Human
ggccugggcaggaggga

SEQ ID NO: 3252834 - RNA, 15 nt, Human
ggccugggcaggagg

SEQ ID NO: 3252835 - RNA, 16 nt, Human
ggccugacucucagca

SEQ ID NO: 3252836 - RNA, 12 nt, Human
gggaggagggca

SEQ ID NO: 3252837 - RNA, 16 nt, Human
gggaggagggcaggca

SEQ ID NO: 3252838 - RNA, 23 nt, Human
gggagcucaggaaccgaggcagg

SEQ ID NO: 3252839 - RNA, 22 nt, Human
gggagcucaggaaccgaggcag

SEQ ID NO: 3252840 - RNA, 12 nt, Human
gggagcucagga

SEQ ID NO: 3252841 - RNA, 13 nt, Human
gggagccgggagc

SEQ ID NO: 3252842 - RNA, 14 nt, Human
gggacaccuaggcu

SEQ ID NO: 3252843 - RNA, 20 nt, Human
gggacaccaagccuuggcuc

SEQ ID NO: 3252844 - RNA, 23 nt, Human
ggcuguggcauccagagucccug

SEQ ID NO: 3252845 - RNA, 21 nt, Human
ggcuguggcauccagaguccc

SEQ ID NO: 3252846 - RNA, 13 nt, Human
ggcugggaggagg

SEQ ID NO: 3252847 - RNA, 21 nt, Human
ggcugggaggagggcaggcau

SEQ ID NO: 3252848 - RNA, 20 nt, Human
ggcugggaggagggcaggca

SEQ ID NO: 3252849 - RNA, 14 nt, Human
ggagggcaggcauc

SEQ ID NO: 3252850 - RNA, 21 nt, Human
ggagcucaggaaccgaggcag

SEQ ID NO: 3252851 - RNA, 12 nt, Human
ggaccagccucu

SEQ ID NO: 3252852 - RNA, 19 nt, Human
ggagacagguuagcugcuc

SEQ ID NO: 3252853 - RNA, 19 nt, Human
cacguguggccuguucuuc

SEQ ID NO: 3252854 - RNA, 22 nt, Human
cacggcuccucgagaucccaac

SEQ ID NO: 3252855 - RNA, 20 nt, Human
cacggcuccucgagauccca

SEQ ID NO: 3252856 - RNA, 22 nt, Human
cacucaugugacucuuuccaac

SEQ ID NO: 3252857 - RNA, 16 nt, Human
cacucaugugacucuu

SEQ ID NO: 3252858 - RNA, 22 nt, Human
caccggggccugggcaggaggg

SEQ ID NO: 3252859 - RNA, 21 nt, Human
caccggggccugggcaggagg

SEQ ID NO: 3252860 - RNA, 14 nt, Human
caccggggccuggg

SEQ ID NO: 3252861 - RNA, 22 nt, Human
cagacuucccacggcuccucga

SEQ ID NO: 3252862 - RNA, 12 nt, Human
cagacuucccac

SEQ ID NO: 3252863 - RNA, 12 nt, Human
cagagaaaaagg

SEQ ID NO: 3252864 - RNA, 18 nt, Human
cagagaaaaagggagggg

SEQ ID NO: 3252865 - RNA, 17 nt, Human
cagagaaaaagggaggg

SEQ ID NO: 3252866 - RNA, 14 nt, Human
cagagucccugccu

SEQ ID NO: 3252867 - RNA, 18 nt, Human
cagagucccugccuggac

SEQ ID NO: 3252868 - RNA, 22 nt, Human
cagaggacaguauuugugggga

SEQ ID NO: 3252869 - RNA, 15 nt, Human
cagcauuucccuucc

SEQ ID NO: 3252870 - RNA, 18 nt, Human
caggaaccgaggcaggga

SEQ ID NO: 3252871 - RNA, 17 nt, Human
caggaaccgaggcaggg

SEQ ID NO: 3252872 - RNA, 15 nt, Human
caggaaccgaggcag

SEQ ID NO: 3252873 - RNA, 23 nt, Human
cagccuggcuguggccuaaccug

SEQ ID NO: 3252874 - RNA, 23 nt, Human
cagccucuccacucaugugacuc

SEQ ID NO: 3252875 - RNA, 21 nt, Human
cagccuccauccuacccccug

SEQ ID NO: 3252876 - RNA, 18 nt, Human
cagccuccauccuacccc

SEQ ID NO: 3252877 - RNA, 21 nt, Human
caggcaucggggagccgggag

SEQ ID NO: 3252878 - RNA, 20 nt, Human
caggcaucggggagccggga

SEQ ID NO: 3252879 - RNA, 23 nt, Human
caggagacagguuagcugcuccc

SEQ ID NO: 3252880 - RNA, 14 nt, Human
caggagucccugcc

SEQ ID NO: 3252881 - RNA, 21 nt, Human
caggagucccugccaucaugu

SEQ ID NO: 3252882 - RNA, 15 nt, Human
caggagucccugcca

SEQ ID NO: 3252883 - RNA, 18 nt, Human
cagggaaggaucccauga

SEQ ID NO: 3252884 - RNA, 13 nt, Human
cagggaaggaucc

SEQ ID NO: 3252885 - RNA, 11 nt, Human
caggcucagag

SEQ ID NO: 3252886 - RNA, 15 nt, Human
caggcucagagggug

SEQ ID NO: 3252887 - RNA, 22 nt, Human
cagucuuuaaucugagaggcca

SEQ ID NO: 3252888 - RNA, 12 nt, Human
caguauguggaa

SEQ ID NO: 3252889 - RNA, 12 nt, Human
cagguguucuuc

SEQ ID NO: 3252890 - RNA, 13 nt, Human
cucccuccucugc

SEQ ID NO: 3252891 - RNA, 14 nt, Human
cucccuccucugcc

SEQ ID NO: 3252892 - RNA, 16 nt, Human
cucaucuuucuuccaa

SEQ ID NO: 3252893 - RNA, 12 nt, Human
cuaaccugccga

SEQ ID NO: 3252894 - RNA, 21 nt, Human
cuaaccugccgagaguccauc

SEQ ID NO: 3252895 - RNA, 19 nt, Human
cuaaccugccgagagucca

SEQ ID NO: 3252896 - RNA, 21 nt, Human
cgugucuggcacagccuggcu

SEQ ID NO: 3252897 - RNA, 13 nt, Human
cgugucuggcaca

SEQ ID NO: 3252898 - RNA, 14 nt, Human
cgugucuggcacag

SEQ ID NO: 3252899 - RNA, 23 nt, Human
cggcuccucgagaucccaacacu

SEQ ID NO: 3252900 - RNA, 14 nt, Human
ccccgacuuuuguu

SEQ ID NO: 3252901 - RNA, 14 nt, Human
cccgggagcucagg

SEQ ID NO: 3252902 - RNA, 16 nt, Human
ccagagucccugccug

SEQ ID NO: 3252903 - RNA, 22 nt, Human
ccagagucccugccuggaccag

SEQ ID NO: 3252904 - RNA, 19 nt, Human
ccagagucccugccuggac

SEQ ID NO: 3252905 - RNA, 18 nt, Human
ccagagucccugccugga

SEQ ID NO: 3252906 - RNA, 17 nt, Human
ccagagucccugccugg

SEQ ID NO: 3252907 - RNA, 24 nt, Human
cccugugccuuggugugcuguauc

SEQ ID NO: 3252908 - RNA, 15 nt, Human
cccugugccuuguca

SEQ ID NO: 3252909 - RNA, 22 nt, Human
cccugugccuugucacgccaga

SEQ ID NO: 3252910 - RNA, 20 nt, Human
cccugugccuugucacgcca

SEQ ID NO: 3252911 - RNA, 14 nt, Human
ccugacucucagca

SEQ ID NO: 3252912 - RNA, 22 nt, Human
ccugacccucaucuuucuucca

SEQ ID NO: 3252913 - RNA, 22 nt, Human
cacugccagcauuucccuuccu

SEQ ID NO: 3252914 - RNA, 18 nt, Human
cacugccagcauuucccu

SEQ ID NO: 3252915 - RNA, 19 nt, Human
cacuggggcaggggccggg

SEQ ID NO: 3252916 - RNA, 13 nt, Human
auucuuucccaac

SEQ ID NO: 3252917 - RNA, 19 nt, Human
auucuuucccaacaccucu

SEQ ID NO: 3252918 - RNA, 16 nt, Human
auucuuucccaacacc

SEQ ID NO: 3252919 - RNA, 22 nt, Human
auuuguggggagggauuugggg

SEQ ID NO: 3252920 - RNA, 20 nt, Human
auuugcuaugagcuggggau

SEQ ID NO: 3252921 - RNA, 16 nt, Human
auuugcuaugagcugg

SEQ ID NO: 3252922 - RNA, 15 nt, Human
caaacaggcucagag

SEQ ID NO: 3252923 - RNA, 14 nt, Human
caaacaggcucaga

SEQ ID NO: 3252924 - RNA, 24 nt, Human
cagccccgcguggaacucgugucu

SEQ ID NO: 3252925 - RNA, 24 nt, Human
cagccucuccacucaugugacucu

SEQ ID NO: 3252926 - RNA, 23 nt, Human
cagaucauuaucagccugugcca

SEQ ID NO: 3252927 - RNA, 15 nt, Human
caguauuugugggga

SEQ ID NO: 3252928 - RNA, 17 nt, Human
ggcccugugccuuggug

SEQ ID NO: 3252929 - RNA, 22 nt, Human
ggcauccagagucccugccugg

SEQ ID NO: 3252930 - RNA, 19 nt, Human
ggccaguggcuggaucugu

SEQ ID NO: 3252931 - RNA, 22 nt, Human
ggcgaagcguuguccucagccc

SEQ ID NO: 3252932 - RNA, 13 nt, Human
ggcacagccuggc

SEQ ID NO: 3252933 - RNA, 12 nt, Human
ggcacagccugg

SEQ ID NO: 3252934 - RNA, 14 nt, Human
aaaagggaggggga

SEQ ID NO: 3252935 - RNA, 19 nt, Human
gggagaaugucaguaugug

SEQ ID NO: 3252936 - RNA, 22 nt, Human
gggagaaugucaguauguggaa

SEQ ID NO: 3252937 - RNA, 14 nt, Human
gggaugucucucau

SEQ ID NO: 3252938 - RNA, 18 nt, Human
gggcucagagugggguag

SEQ ID NO: 3252939 - RNA, 22 nt, Human
gggcccuggugguggcucggga

SEQ ID NO: 3252940 - RNA, 23 nt, Human
ggguguccugcaccggggccugg

SEQ ID NO: 3252941 - RNA, 17 nt, Human
ggucuguguguguguau

SEQ ID NO: 3252942 - RNA, 11 nt, Human
ggucugugugu

SEQ ID NO: 3252943 - RNA, 21 nt, Human
ggugcuucuaguucugccagg

SEQ ID NO: 3252944 - RNA, 21 nt, Human
ggucuguguguguguaugugg

SEQ ID NO: 3252945 - RNA, 20 nt, Human
ggucuguguguguguaugug

SEQ ID NO: 3252946 - RNA, 21 nt, Human
gguggggagagacgggcccug

SEQ ID NO: 3252947 - RNA, 17 nt, Human
guaaauuuaugugaugg

SEQ ID NO: 3252948 - RNA, 16 nt, Human
guaaauuuaugugaug

SEQ ID NO: 3252949 - RNA, 22 nt, Human
gcugcuccccacgucagcuggg

SEQ ID NO: 3252950 - RNA, 13 nt, Human
gcugcuccccacg

SEQ ID NO: 3252951 - RNA, 14 nt, Human
gcugaggccucuca

SEQ ID NO: 3252952 - RNA, 18 nt, Human
gcuccucgagaucccaac

SEQ ID NO: 3252953 - RNA, 14 nt, Human
ggaacugcugggcu

SEQ ID NO: 3252954 - RNA, 20 nt, Human
gcuguagacauuugcuauga

SEQ ID NO: 3252955 - RNA, 19 nt, Human
gcuuuccucaucaggccau

SEQ ID NO: 3252956 - RNA, 14 nt, Human
gccaggauggaaug

SEQ ID NO: 3252957 - RNA, 23 nt, Human
gccaguggcuggaucugugaggg

SEQ ID NO: 3252958 - RNA, 14 nt, Human
gccaguggcuggau

SEQ ID NO: 3252959 - RNA, 14 nt, Human
gcggcugggaggag

SEQ ID NO: 3252960 - RNA, 13 nt, Human
gcggcugggagga

SEQ ID NO: 3252961 - RNA, 22 nt, Human
gcggcugggaggagggcaggca

SEQ ID NO: 3252962 - RNA, 19 nt, Human
gcggcugggaggagggcag

SEQ ID NO: 3252963 - RNA, 18 nt, Human
gcggcugggaggagggca

SEQ ID NO: 3252964 - RNA, 17 nt, Human
gcggcugggaggagggc

SEQ ID NO: 3252965 - RNA, 16 nt, Human
gaucccaacacugcca

SEQ ID NO: 3252966 - RNA, 12 nt, Human
gaucccaacacu

SEQ ID NO: 3252967 - RNA, 16 nt, Human
gaguccaucagccucc

SEQ ID NO: 3252968 - RNA, 15 nt, Human
gaguccaucagccuc

SEQ ID NO: 3252969 - RNA, 14 nt, Human
gaguccaucagccu

SEQ ID NO: 3252970 - RNA, 13 nt, Human
gaguccaucagcc

SEQ ID NO: 3252971 - RNA, 18 nt, Human
gagugaggaugucugggc

SEQ ID NO: 3252972 - RNA, 15 nt, Human
gaguuuagggugggg

SEQ ID NO: 3252973 - RNA, 14 nt, Human
gaguuuaggguggg

SEQ ID NO: 3252974 - RNA, 13 nt, Human
gaguuggcuggga

SEQ ID NO: 3252975 - RNA, 19 nt, Human
gcaccggggccugggcagg

SEQ ID NO: 3252976 - RNA, 20 nt, Human
gcaccggggccugggcagga

SEQ ID NO: 3252977 - RNA, 19 nt, Human
gagcuggggaugucucuca

SEQ ID NO: 3252978 - RNA, 19 nt, Human
gaagggcagggcugaggcc

SEQ ID NO: 3252979 - RNA, 15 nt, Human
gaaggcuauggggau

SEQ ID NO: 3252980 - RNA, 18 nt, Human
gaagugugggucugugug

SEQ ID NO: 3252981 - RNA, 17 nt, Human
gaagugugggucugugu

SEQ ID NO: 3252982 - RNA, 19 nt, Human
gaagugugggucugugugu

SEQ ID NO: 3252983 - RNA, 15 nt, Human
gacaguauuuguggg

SEQ ID NO: 3252984 - RNA, 16 nt, Human
gacagguuagcugcuc

SEQ ID NO: 3252985 - RNA, 18 nt, Human
cuuauuggcagcucuacu

SEQ ID NO: 3252986 - RNA, 22 nt, Human
cuggggaugucucucaugacca

SEQ ID NO: 3252987 - RNA, 17 nt, Human
cuggggaugucucucau

SEQ ID NO: 3252988 - RNA, 22 nt, Human
cugccaucauguuuacagagga

SEQ ID NO: 3252989 - RNA, 17 nt, Human
cugccaucauguuuaca

SEQ ID NO: 3252990 - RNA, 23 nt, Human
cugccaucauguuuacagaggac

SEQ ID NO: 3252991 - RNA, 23 nt, Human
auugcaggagucccugccaucau

SEQ ID NO: 3252992 - RNA, 20 nt, Human
auuuaaaauugugauguguc

SEQ ID NO: 3252993 - RNA, 19 nt, Human
auuuaaaauugugaugugu

SEQ ID NO: 3252994 - RNA, 19 nt, Human
auguuuacagaggacagua

SEQ ID NO: 3252995 - RNA, 17 nt, Human
auguuuacagaggacag

SEQ ID NO: 3252996 - RNA, 15 nt, Human
auguuuacagaggac

SEQ ID NO: 3252997 - RNA, 19 nt, Human
uuugcuaugagcuggggau

SEQ ID NO: 3252998 - RNA, 14 nt, Human
augucaguaugugg

SEQ ID NO: 3252999 - RNA, 13 nt, Human
augucaguaugug

SEQ ID NO: 3253000 - RNA, 17 nt, Human
uuuguaaauuuauguga

SEQ ID NO: 3253001 - RNA, 20 nt, Human
aucugagaggccacagugca

SEQ ID NO: 3253002 - RNA, 16 nt, Human
aucuguaccucugccu

SEQ ID NO: 3253003 - RNA, 21 nt, Human
auggaaugaugggucaguugu

SEQ ID NO: 3253004 - RNA, 16 nt, Human
auggccugggggaugu

SEQ ID NO: 3253005 - RNA, 12 nt, Human
uuuaugugaugg

SEQ ID NO: 3253006 - RNA, 13 nt, Human
uuuaugugugugu

SEQ ID NO: 3253007 - RNA, 11 nt, Human
uuuaugugugu

SEQ ID NO: 3253008 - RNA, 15 nt, Human
uucuaguucugccag

SEQ ID NO: 3253009 - RNA, 24 nt, Human
ugauaagcagucauccucagauca

SEQ ID NO: 3253010 - RNA, 18 nt, Human
ugaguucauaaauuuaug

SEQ ID NO: 3253011 - RNA, 21 nt, Human
ugauagaaggcuauggggaua

SEQ ID NO: 3253012 - RNA, 17 nt, Human
agcauuucccuuccuuc

SEQ ID NO: 3253013 - RNA, 18 nt, Human
agccugacccucaucuuu

SEQ ID NO: 3253014 - RNA, 20 nt, Human
agcucaggaaccgaggcagg

SEQ ID NO: 3253015 - RNA, 22 nt, Human
agcucaggaaccgaggcaggga

SEQ ID NO: 3253016 - RNA, 21 nt, Human
agcucaggaaccgaggcaggg

SEQ ID NO: 3253017 - RNA, 23 nt, Human
uggccaguggcuggaucugugag

SEQ ID NO: 3253018 - RNA, 21 nt, Human
uggccuguucuucuauggguu

SEQ ID NO: 3253019 - RNA, 19 nt, Human
aggacaguauuugugggga

SEQ ID NO: 3253020 - RNA, 12 nt, Human
aggacaguauuu

SEQ ID NO: 3253021 - RNA, 19 nt, Human
aggaucccaugagcuccuu

SEQ ID NO: 3253022 - RNA, 23 nt, Human
ugcuguauccauccauggggcug

SEQ ID NO: 3253023 - RNA, 15 nt, Human
ugcuguagacauuug

SEQ ID NO: 3253024 - RNA, 21 nt, Human
agcugggacaccccgacuuuu

SEQ ID NO: 3253025 - RNA, 20 nt, Human
ugguaggaacugcugggcuu

SEQ ID NO: 3253026 - RNA, 13 nt, Human
ugguaggaacugc

SEQ ID NO: 3253027 - RNA, 12 nt, Human
ugggucugugug

SEQ ID NO: 3253028 - RNA, 16 nt, Human
agggggagagggcugc

SEQ ID NO: 3253029 - RNA, 15 nt, Human
agggggagagggcug

SEQ ID NO: 3253030 - RNA, 19 nt, Human
uggggaguuuagggugggg

SEQ ID NO: 3253031 - RNA, 18 nt, Human
uggggaguuuaggguggg

SEQ ID NO: 3253032 - RNA, 15 nt, Human
ugggguagguuggga

SEQ ID NO: 3253033 - RNA, 21 nt, Human
ugggguagguugggagaaugu

SEQ ID NO: 3253034 - RNA, 14 nt, Human
uggggcugauugua

SEQ ID NO: 3253035 - RNA, 22 nt, Human
ugucaguauguggaaguguggg

SEQ ID NO: 3253036 - RNA, 18 nt, Human
ugucaguauguggaagug

SEQ ID NO: 3253037 - RNA, 20 nt, Human
ugucaguauguggaagugug

SEQ ID NO: 3253038 - RNA, 19 nt, Human
ugucaguauguggaagugu

SEQ ID NO: 3253039 - RNA, 19 nt, Human
aguauguggaagugugggu

SEQ ID NO: 3253040 - RNA, 17 nt, Human
aguauguggaagugugg

SEQ ID NO: 3253041 - RNA, 15 nt, Human
aguauguggaagugu

SEQ ID NO: 3253042 - RNA, 23 nt, Human
agucccugccuggaccagccucu

SEQ ID NO: 3253043 - RNA, 22 nt, Human
agucccugccuggaccagccuc

SEQ ID NO: 3253044 - RNA, 14 nt, Human
agucccugccugga

SEQ ID NO: 3253045 - RNA, 21 nt, Human
agucccugccuggaccagccu

SEQ ID NO: 3253046 - RNA, 15 nt, Human
agucccugccuggac

SEQ ID NO: 3253047 - RNA, 22 nt, Human
uguaauuuaaaauugugaugug

SEQ ID NO: 3253048 - RNA, 21 nt, Human
uguaauuuaaaauugugaugu

SEQ ID NO: 3253049 - RNA, 20 nt, Human
uguaauuuaaaauugugaug

SEQ ID NO: 3253050 - RNA, 18 nt, Human
uguaauuuaaaauuguga

SEQ ID NO: 3253051 - RNA, 17 nt, Human
uguaauuuaaaauugug

SEQ ID NO: 3253052 - RNA, 23 nt, Human
agguugggagaaugucaguaugu

SEQ ID NO: 3253053 - RNA, 13 nt, Human
uguguguguguau

SEQ ID NO: 3253054 - RNA, 16 nt, Human
uguguguguguaugug

SEQ ID NO: 3253055 - RNA, 19 nt, Human
uguggcacuggggcagggg

SEQ ID NO: 3253056 - RNA, 16 nt, Human
uguugugugugggagu

SEQ ID NO: 3253057 - RNA, 15 nt, Human
uguugugugugggag

SEQ ID NO: 3253058 - RNA, 14 nt, Human
uguuguguguggga

SEQ ID NO: 3253059 - RNA, 23 nt, Human
agugugggucuguguguguguau

SEQ ID NO: 3253060 - RNA, 19 nt, Human
agugugggucugugugugu

SEQ ID NO: 3253061 - RNA, 15 nt, Human
agugugggucugugu

SEQ ID NO: 3253062 - RNA, 17 nt, Human
agugugggucugugugu

SEQ ID NO: 3253063 - RNA, 16 nt, Human
agugugggucugugug

SEQ ID NO: 3253064 - RNA, 16 nt, Human
uuagccuuugucccag

SEQ ID NO: 3253065 - RNA, 20 nt, Human
uaugugggggucuguguguu

SEQ ID NO: 3253066 - RNA, 19 nt, Human
uaugugggggucugugugu

SEQ ID NO: 3253067 - RNA, 18 nt, Human
uaugugggggucugugug

SEQ ID NO: 3253068 - RNA, 16 nt, Human
ucaguauguggaagug

SEQ ID NO: 3253069 - RNA, 20 nt, Human
uccauccuacccccugugcc

SEQ ID NO: 3253070 - RNA, 16 nt, Human
uccauccuacccccug

SEQ ID NO: 3253071 - RNA, 22 nt, Human
uccucugcccgggagcucagga

SEQ ID NO: 3253072 - RNA, 16 nt, Human
uccucugcccgggagc

SEQ ID NO: 3253073 - RNA, 13 nt, Human
uccucuccugucu

SEQ ID NO: 3253074 - RNA, 23 nt, Human
acucgugucuggcacagccuggc

SEQ ID NO: 3253075 - RNA, 22 nt, Human
acucgugucuggcacagccugg

SEQ ID NO: 3253076 - RNA, 16 nt, Human
acuggggcaggggccg

SEQ ID NO: 3253077 - RNA, 20 nt, Human
ucggggagccgggagccuga

SEQ ID NO: 3253078 - RNA, 15 nt, Human
ucuaccucuuggcug

SEQ ID NO: 3253079 - RNA, 23 nt, Human
acuugucccgggacaccuaggcu

SEQ ID NO: 3253080 - RNA, 22 nt, Human
ucuggcacagccuggcuguggc

SEQ ID NO: 3253081 - RNA, 23 nt, Human
ucuuggggaguuuaggguggggg

SEQ ID NO: 3253082 - RNA, 22 nt, Human
ucuuggggaguuuagggugggg

SEQ ID NO: 3253083 - RNA, 17 nt, Human
agagacgggcccuggug

SEQ ID NO: 3253084 - RNA, 22 nt, Human
agagggacuguucuuuuguccc

SEQ ID NO: 3253085 - RNA, 19 nt, Human
gucucccuccucugcccgg

SEQ ID NO: 3253086 - RNA, 19 nt, Human
gucuggcacagccuggcug

SEQ ID NO: 3253087 - RNA, 17 nt, Human
gucuggcacagccuggc

SEQ ID NO: 3253088 - RNA, 17 nt, Human
gucaguauguggaagug

SEQ ID NO: 3253089 - RNA, 21 nt, Human
gucaguauguggaaguguggg

SEQ ID NO: 3253090 - RNA, 13 nt, Human
gucaguuguauca

SEQ ID NO: 3253091 - RNA, 15 nt, Human
aaauuuaugugaugg

SEQ ID NO: 3253092 - RNA, 12 nt, Human
aaauuuauguga

SEQ ID NO: 3253093 - RNA, 12 nt, Human
aaauugugaugu

SEQ ID NO: 3253094 - RNA, 15 nt, Human
aaauugugauguguc

SEQ ID NO: 3253095 - RNA, 22 nt, Human
guggccuaaccugccgagaguc

SEQ ID NO: 3253096 - RNA, 21 nt, Human
guggccuaaccugccgagagu

SEQ ID NO: 3253097 - RNA, 15 nt, Human
guguguauguggggg

SEQ ID NO: 3253098 - RNA, 13 nt, Human
guguguauguggg

SEQ ID NO: 3253099 - RNA, 20 nt, Human
gugugucacccuuaggccag

SEQ ID NO: 3253100 - RNA, 14 nt, Human
gugugggucugugu

SEQ ID NO: 3253101 - RNA, 12 nt, Human
guguguaugugg

SEQ ID NO: 3253102 - RNA, 19 nt, Human
gugggguagguugggagaa

SEQ ID NO: 3253103 - RNA, 14 nt, Human
aaggcucuuuugua

SEQ ID NO: 3253104 - RNA, 15 nt, Human
uacccccugugccuu

SEQ ID NO: 3253105 - RNA, 13 nt, Human
uaccucuuggcug

SEQ ID NO: 3253106 - RNA, 19 nt, Human
uaccagagaaaaagggagg

SEQ ID NO: 3253107 - RNA, 20 nt, Human
uaauuuaaaauugugaugug

SEQ ID NO: 3253108 - RNA, 19 nt, Human
uaauuuaaaauugugaugu

SEQ ID NO: 3253109 - RNA, 14 nt, Human
uaucagcacgugug

SEQ ID NO: 3253110 - RNA, 21 nt, Human
uaugguaggaacugcugggcu

SEQ ID NO: 3253111 - RNA, 20 nt, Human
uaugccaccugaauaaagaa

SEQ ID NO: 3253112 - RNA, 21 nt, Human
uagacauuugcuaugagcugg

SEQ ID NO: 3253113 - RNA, 16 nt, Human
aauuccacacccucac

SEQ ID NO: 3253114 - RNA, 14 nt, Human
uagaagaagugugu

SEQ ID NO: 3253115 - RNA, 14 nt, Human
accaucucuuuacc

SEQ ID NO: 3253116 - RNA, 23 nt, Human
acagaggacaguauuugugggga

SEQ ID NO: 3253117 - RNA, 11 nt, Human
aauugugaugu

SEQ ID NO: 3253118 - RNA, 15 nt, Human
aauugugaugugucc

SEQ ID NO: 3253119 - RNA, 14 nt, Human
aauugugauguguc

SEQ ID NO: 3253120 - RNA, 19 nt, Human
accggggccugggcaggag

SEQ ID NO: 3253121 - RNA, 18 nt, Human
aagagaagggcagggcug

SEQ ID NO: 3253122 - RNA, 13 nt, Human
aagggagggggag

SEQ ID NO: 3253123 - RNA, 10 nt, Human
agagggcugc

SEQ ID NO: 3253124 - RNA, 23 nt, Human
agagaggccauucuuucccaaca

SEQ ID NO: 3253125 - RNA, 17 nt, Human
agcuccuuaaggcucuu

SEQ ID NO: 3253126 - RNA, 16 nt, Human
agcuccuuaaggcucu

SEQ ID NO: 3253127 - RNA, 19 nt, Human
agcuaauucuuugaccugu

SEQ ID NO: 3253128 - RNA, 16 nt, Human
aggaacugcugggcuu

SEQ ID NO: 3253129 - RNA, 16 nt, Human
aggaaccgaggcaggg

SEQ ID NO: 3253130 - RNA, 22 nt, Human
aggaacugcugggcuuggcagc

SEQ ID NO: 3253131 - RNA, 23 nt, Human
agucugagagaggccauucuuuc

SEQ ID NO: 3253132 - RNA, 16 nt, Human
agucugagagaggcca

SEQ ID NO: 3253133 - RNA, 19 nt, Human
auccagagucccugccugg

SEQ ID NO: 3253134 - RNA, 21 nt, Human
auccagagucccugccuggac

SEQ ID NO: 3253135 - RNA, 20 nt, Human
auccagagucccugccugga

SEQ ID NO: 3253136 - RNA, 16 nt, Human
augaugggucaguugu

SEQ ID NO: 3253137 - RNA, 17 nt, Human
caagccuuggcucuacc

SEQ ID NO: 3253138 - RNA, 22 nt, Human
ugaagagaagggcagggcugag

SEQ ID NO: 3253139 - RNA, 20 nt, Human
ugaagagaagggcagggcug

SEQ ID NO: 3253140 - RNA, 19 nt, Human
ugacucuuuccaaccggcu

SEQ ID NO: 3253141 - RNA, 13 nt, Human
ugacucuuuccaa

SEQ ID NO: 3253142 - RNA, 16 nt, Human
ugacucuuuccaaccg

SEQ ID NO: 3253143 - RNA, 14 nt, Human
ugacucuuuccaac

SEQ ID NO: 3253144 - RNA, 19 nt, Human
ucuuuccaaccggcuuugu

SEQ ID NO: 3253145 - RNA, 11 nt, Human
ucugugugugu

SEQ ID NO: 3253146 - RNA, 22 nt, Human
ucuucauuaccucagugagaag

SEQ ID NO: 3253147 - RNA, 15 nt, Human
ucccaacacugccag

SEQ ID NO: 3253148 - RNA, 14 nt, Human
ucccaacacugcca

SEQ ID NO: 3253149 - RNA, 16 nt, Human
ucccaacacugccagc

SEQ ID NO: 3253150 - RNA, 17 nt, Human
ucaucuuucuuccaaac

SEQ ID NO: 3253151 - RNA, 14 nt, Human
ucaucuuucuucca

SEQ ID NO: 3253152 - RNA, 12 nt, Human
ucaucuuucuuc

SEQ ID NO: 3253153 - RNA, 23 nt, Human
ucagccuccauccuacccccugu

SEQ ID NO: 3253154 - RNA, 20 nt, Human
ucagaucauuaucagccugu

SEQ ID NO: 3253155 - RNA, 19 nt, Human
uccugucccucauccauag

SEQ ID NO: 3253156 - RNA, 23 nt, Human
uccucgagaucccaacacugcca

SEQ ID NO: 3253157 - RNA, 16 nt, Human
uccucgagaucccaac

SEQ ID NO: 3253158 - RNA, 23 nt, Human
ucccaugagcuccuuaaggcucu

SEQ ID NO: 3253159 - RNA, 20 nt, Human
uggaaugaugggucaguugu

SEQ ID NO: 3253160 - RNA, 18 nt, Human
uggaacucgugucuggca

SEQ ID NO: 3253161 - RNA, 11 nt, Human
ugggggaugua

SEQ ID NO: 3253162 - RNA, 15 nt, Human
ugggggucugugugu

SEQ ID NO: 3253163 - RNA, 18 nt, Human
ugggggucuguguguuua

SEQ ID NO: 3253164 - RNA, 21 nt, Human
ugggagugaggaugucugggc

SEQ ID NO: 3253165 - RNA, 21 nt, Human
ugggacaccccgacuuuuguu

SEQ ID NO: 3253166 - RNA, 18 nt, Human
ugccaggauggaaugaug

SEQ ID NO: 3253167 - RNA, 12 nt, Human
ugcaccggggcc

SEQ ID NO: 3253168 - RNA, 22 nt, Human
ugcaccggggccugggcaggag

SEQ ID NO: 3253169 - RNA, 16 nt, Human
ugcaccggggccuggg

SEQ ID NO: 3253170 - RNA, 14 nt, Human
uguaccucugccuc

SEQ ID NO: 3253171 - RNA, 22 nt, Human
ugucacccuuaggccagcacca

SEQ ID NO: 3253172 - RNA, 21 nt, Human
uguccucagccccgcguggaa

SEQ ID NO: 3253173 - RNA, 17 nt, Human
ugucuggcacagccugg

SEQ ID NO: 3253174 - RNA, 16 nt, Human
ugugccuuuugccauc

SEQ ID NO: 3253175 - RNA, 17 nt, Human
ugugccuuggugugcug

SEQ ID NO: 3253176 - RNA, 17 nt, Human
ugugccuugucacgcca

SEQ ID NO: 3253177 - RNA, 20 nt, Human
ugugccuugucacgccagac

SEQ ID NO: 3253178 - RNA, 19 nt, Human
ugugccuugucacgccaga

SEQ ID NO: 3253179 - RNA, 18 nt, Human
uguguaauuuaaaauugu

SEQ ID NO: 3253180 - RNA, 11 nt, Human
uguguaauuua

SEQ ID NO: 3253181 - RNA, 23 nt, Human
uguguaauuuaaaauugugaugu

SEQ ID NO: 3253182 - RNA, 22 nt, Human
uguguaauuuaaaauugugaug

SEQ ID NO: 3253183 - RNA, 19 nt, Human
uguguaauuuaaaauugug

SEQ ID NO: 3253184 - RNA, 15 nt, Human
uguggccuaaccugc

SEQ ID NO: 3253185 - RNA, 15 nt, Human
uguggaagugugggu

SEQ ID NO: 3253186 - RNA, 15 nt, Human
ugugggaguguguaa

SEQ ID NO: 3253187 - RNA, 14 nt, Human
ugugggagugugua

SEQ ID NO: 3253188 - RNA, 16 nt, Human
uguucuuuugucccag

SEQ ID NO: 3253189 - RNA, 16 nt, Human
ugugugggagugugua

SEQ ID NO: 3253190 - RNA, 12 nt, Human
uguguauguggg

SEQ ID NO: 3253191 - RNA, 11 nt, Human
uguguaugugg

SEQ ID NO: 3253192 - RNA, 15 nt, Human
ugugugggagugugu

SEQ ID NO: 3253193 - RNA, 14 nt, Human
ugugugggagugug

SEQ ID NO: 3253194 - RNA, 22 nt, Human
uaagugccaggauggaaugaug

SEQ ID NO: 3253195 - RNA, 13 nt, Human
uaaauuuauguga

SEQ ID NO: 3253196 - RNA, 22 nt, Human
guugugugugggaguguguaau

SEQ ID NO: 3253197 - RNA, 16 nt, Human
guugugugugggagug

SEQ ID NO: 3253198 - RNA, 14 nt, Human
guugugugugggag

SEQ ID NO: 3253199 - RNA, 13 nt, Human
guuguguguggga

SEQ ID NO: 3253200 - RNA, 12 nt, Human
guuguguguggg

SEQ ID NO: 3253201 - RNA, 23 nt, Human
guuguccucagccccgcguggaa

SEQ ID NO: 3253202 - RNA, 17 nt, Human
guuguccucagccccgc

SEQ ID NO: 3253203 - RNA, 16 nt, Human
guuuagaagaagugug

SEQ ID NO: 3253204 - RNA, 20 nt, Human
uauauuuguaaauuuaugug

SEQ ID NO: 3253205 - RNA, 22 nt, Human
uauaaacaugcuugcauuauau

SEQ ID NO: 3253206 - RNA, 20 nt, Human
guguaauuuaaaauugugau

SEQ ID NO: 3253207 - RNA, 23 nt, Human
guguaauuuaaaauugugaugug

SEQ ID NO: 3253208 - RNA, 22 nt, Human
guguaauuuaaaauugugaugu

SEQ ID NO: 3253209 - RNA, 17 nt, Human
guggcuggaucugugag

SEQ ID NO: 3253210 - RNA, 21 nt, Human
guggggagagacgggcccugg

SEQ ID NO: 3253211 - RNA, 17 nt, Human
guguguuguguguggga

SEQ ID NO: 3253212 - RNA, 14 nt, Human
guguguugugugug

SEQ ID NO: 3253213 - RNA, 12 nt, Human
guguguugugug

SEQ ID NO: 3253214 - RNA, 15 nt, Human
guguguuuaugugug

SEQ ID NO: 3253215 - RNA, 14 nt, Human
guguguuuaugugu

SEQ ID NO: 3253216 - RNA, 16 nt, Human
guguguuuaugugugu

SEQ ID NO: 3253217 - RNA, 17 nt, Human
gugugggaguguguaau

SEQ ID NO: 3253218 - RNA, 17 nt, Human
gugucuggcacagccug

SEQ ID NO: 3253219 - RNA, 21 nt, Human
guguccugcaccggggccugg

SEQ ID NO: 3253220 - RNA, 12 nt, Human
guucugccagga

SEQ ID NO: 3253221 - RNA, 14 nt, Human
guucugccaggaga

SEQ ID NO: 3253222 - RNA, 13 nt, Human
guucugccaggag

SEQ ID NO: 3253223 - RNA, 13 nt, Human
gucccugccugga

SEQ ID NO: 3253224 - RNA, 18 nt, Human
gucugagagaggccauuc

SEQ ID NO: 3253225 - RNA, 15 nt, Human
gucugagagaggcca

SEQ ID NO: 3253226 - RNA, 14 nt, Human
gucugagagaggcc

SEQ ID NO: 3253227 - RNA, 13 nt, Human
gucugagagaggc

SEQ ID NO: 3253228 - RNA, 22 nt, Human
gucuguguguuuaugugugugu

SEQ ID NO: 3253229 - RNA, 21 nt, Human
gucuguguguuuaugugugug

SEQ ID NO: 3253230 - RNA, 11 nt, Human
gucuguguguu

SEQ ID NO: 3253231 - RNA, 20 nt, Human
gucuguguguguguaugugg

SEQ ID NO: 3253232 - RNA, 16 nt, Human
gucuguguguguguau

SEQ ID NO: 3253233 - RNA, 12 nt, Human
gucugugugugu

SEQ ID NO: 3253234 - RNA, 11 nt, Human
gucugugugug

SEQ ID NO: 3253235 - RNA, 21 nt, Human
gugacuauggagcugagcagg

SEQ ID NO: 3253236 - RNA, 21 nt, Human
gugccaggauggaaugauggg

SEQ ID NO: 3253237 - RNA, 14 nt, Human
gugccuuuugccau

SEQ ID NO: 3253238 - RNA, 21 nt, Human
gugauuuuuaugccaccugaa

SEQ ID NO: 3253239 - RNA, 19 nt, Human
guagugauuuuuaugccac

SEQ ID NO: 3253240 - RNA, 14 nt, Human
guagguugggagaa

SEQ ID NO: 3253241 - RNA, 22 nt, Human
gucagcugggacaccccgacuu

SEQ ID NO: 3253242 - RNA, 16 nt, Human
gucccugaagagaagg

SEQ ID NO: 3253243 - RNA, 14 nt, Human
cuacccccugugcc

SEQ ID NO: 3253244 - RNA, 13 nt, Human
cuacccccugugc

SEQ ID NO: 3253245 - RNA, 16 nt, Human
cguuguccucagcccc

SEQ ID NO: 3253246 - RNA, 23 nt, Human
cguggcuguggcauccagagucc

SEQ ID NO: 3253247 - RNA, 15 nt, Human
cgggucaucuguacc

SEQ ID NO: 3253248 - RNA, 22 nt, Human
cgggucaucuguaccucugccu

SEQ ID NO: 3253249 - RNA, 19 nt, Human
cggggccugggcaggaggg

SEQ ID NO: 3253250 - RNA, 17 nt, Human
cggggccugggcaggag

SEQ ID NO: 3253251 - RNA, 17 nt, Human
cgggggcagucugagag

SEQ ID NO: 3253252 - RNA, 21 nt, Human
cgggggcagucugagagaggc

SEQ ID NO: 3253253 - RNA, 18 nt, Human
cgggggcagucugagaga

SEQ ID NO: 3253254 - RNA, 17 nt, Human
cgggagccugacccuca

SEQ ID NO: 3253255 - RNA, 12 nt, Human
cggcugggagga

SEQ ID NO: 3253256 - RNA, 23 nt, Human
cucuuggggaguuuagggugggg

SEQ ID NO: 3253257 - RNA, 21 nt, Human
cucuuggggaguuuagggugg

SEQ ID NO: 3253258 - RNA, 18 nt, Human
cucuccugucucccuccu

SEQ ID NO: 3253259 - RNA, 17 nt, Human
cucuccugucucccucc

SEQ ID NO: 3253260 - RNA, 15 nt, Human
cucuccugucucccu

SEQ ID NO: 3253261 - RNA, 22 nt, Human
cucuccacucaugugacucuuu

SEQ ID NO: 3253262 - RNA, 21 nt, Human
cucuccacucaugugacucuu

SEQ ID NO: 3253263 - RNA, 23 nt, Human
cuccauccuacccccugugccuu

SEQ ID NO: 3253264 - RNA, 22 nt, Human
cuccauccuacccccugugccu

SEQ ID NO: 3253265 - RNA, 20 nt, Human
cuccauccuacccccugugc

SEQ ID NO: 3253266 - RNA, 18 nt, Human
cuccauccuacccccugu

SEQ ID NO: 3253267 - RNA, 17 nt, Human
cuccucgagaucccaac

SEQ ID NO: 3253268 - RNA, 24 nt, Human
cuccucgagaucccaacacugcca

SEQ ID NO: 3253269 - RNA, 21 nt, Human
cuccucgagaucccaacacug

SEQ ID NO: 3253270 - RNA, 14 nt, Human
cuguaccucugccu

SEQ ID NO: 3253271 - RNA, 23 nt, Human
cuggcacagccuggcuguggccu

SEQ ID NO: 3253272 - RNA, 15 nt, Human
cuggcacagccuggc

SEQ ID NO: 3253273 - RNA, 21 nt, Human
cuggcacagccuggcuguggc

SEQ ID NO: 3253274 - RNA, 16 nt, Human
cuggcacagccuggcu

SEQ ID NO: 3253275 - RNA, 18 nt, Human
cuggcuguggccuaaccu

SEQ ID NO: 3253276 - RNA, 19 nt, Human
cugggaggagggcaggcau

SEQ ID NO: 3253277 - RNA, 19 nt, Human
cugcccgggagcucaggaa

SEQ ID NO: 3253278 - RNA, 18 nt, Human
cugcccgggagcucagga

SEQ ID NO: 3253279 - RNA, 11 nt, Human
cugccaggaga

SEQ ID NO: 3253280 - RNA, 13 nt, Human
gaagaaguguguc

SEQ ID NO: 3253281 - RNA, 21 nt, Human
gaaggaucccaugagcuccuu

SEQ ID NO: 3253282 - RNA, 13 nt, Human
cuuucuuccaaac

SEQ ID NO: 3253283 - RNA, 19 nt, Human
cuuucuuccaaacaggcuc

SEQ ID NO: 3253284 - RNA, 12 nt, Human
cuuuggacuugu

SEQ ID NO: 3253285 - RNA, 18 nt, Human
cuugucacgccagacuuc

SEQ ID NO: 3253286 - RNA, 23 nt, Human
cuugucacgccagacuucccacg

SEQ ID NO: 3253287 - RNA, 21 nt, Human
cuuggggaguuuagggugggg

SEQ ID NO: 3253288 - RNA, 20 nt, Human
cuuggggaguuuaggguggg

SEQ ID NO: 3253289 - RNA, 17 nt, Human
gaccuuuccugaggaag

SEQ ID NO: 3253290 - RNA, 20 nt, Human
gacaccuaggcuaggguggg

SEQ ID NO: 3253291 - RNA, 16 nt, Human
gacaccuaggcuaggg

SEQ ID NO: 3253292 - RNA, 15 nt, Human
gacaccuaggcuagg

SEQ ID NO: 3253293 - RNA, 21 nt, Human
gagagaggccauucuuuccca

SEQ ID NO: 3253294 - RNA, 13 nt, Human
gagagaggccauu

SEQ ID NO: 3253295 - RNA, 22 nt, Human
gagaagccagcuuuccucauca

SEQ ID NO: 3253296 - RNA, 18 nt, Human
gacuugucccgggacacc

SEQ ID NO: 3253297 - RNA, 20 nt, Human
gagcuccuuaaggcucuuuu

SEQ ID NO: 3253298 - RNA, 20 nt, Human
gagcucaggaaccgaggcag

SEQ ID NO: 3253299 - RNA, 21 nt, Human
gagcucaggaaccgaggcagg

SEQ ID NO: 3253300 - RNA, 21 nt, Human
gagccugacccucaucuuucu

SEQ ID NO: 3253301 - RNA, 17 nt, Human
gaucccaugagcuccuu

SEQ ID NO: 3253302 - RNA, 15 nt, Human
gaucccaugagcucc

SEQ ID NO: 3253303 - RNA, 14 nt, Human
gaucauuaucagcc

SEQ ID NO: 3253304 - RNA, 13 nt, Human
gauagaugugugg

SEQ ID NO: 3253305 - RNA, 21 nt, Human
gaucugugaggggcucucuca

SEQ ID NO: 3253306 - RNA, 20 nt, Human
gauuuggggcucagaguggg

SEQ ID NO: 3253307 - RNA, 18 nt, Human
gcauuauauuuguaaauu

SEQ ID NO: 3253308 - RNA, 20 nt, Human
gcaggggccgggggcagucu

SEQ ID NO: 3253309 - RNA, 19 nt, Human
gcaggggccgggggcaguc

SEQ ID NO: 3253310 - RNA, 18 nt, Human
gcgcggcugggaggaggg

SEQ ID NO: 3253311 - RNA, 12 nt, Human
gcgcggcuggga

SEQ ID NO: 3253312 - RNA, 18 nt, Human
gccuuuggacuugucccg

SEQ ID NO: 3253313 - RNA, 19 nt, Human
gccucucauuccagaggaa

SEQ ID NO: 3253314 - RNA, 17 nt, Human
gccugacccucaucuuu

SEQ ID NO: 3253315 - RNA, 20 nt, Human
gccucucauuccagaggaag

SEQ ID NO: 3253316 - RNA, 21 nt, Human
gccucuccacucaugugacuc

SEQ ID NO: 3253317 - RNA, 24 nt, Human
gccucuccacucaugugacucuuu

SEQ ID NO: 3253318 - RNA, 21 nt, Human
gccaucauguuuacagaggac

SEQ ID NO: 3253319 - RNA, 17 nt, Human
gccaucauguuuacaga

SEQ ID NO: 3253320 - RNA, 15 nt, Human
gcccgggagcucagg

SEQ ID NO: 3253321 - RNA, 19 nt, Human
gcccgggagcucaggaacc

SEQ ID NO: 3253322 - RNA, 17 nt, Human
gcccgggagcucaggaa

SEQ ID NO: 3253323 - RNA, 19 nt, Human
cauccuacccccugugccu

SEQ ID NO: 3253324 - RNA, 21 nt, Human
cauccagagucccugccugga

SEQ ID NO: 3253325 - RNA, 16 nt, Human
caguggcuggaucugu

SEQ ID NO: 3253326 - RNA, 20 nt, Human
caguggcuggaucugugagg

SEQ ID NO: 3253327 - RNA, 18 nt, Human
caguggcuggaucuguga

SEQ ID NO: 3253328 - RNA, 18 nt, Human
cauaaucacaacccuuca

SEQ ID NO: 3253329 - RNA, 15 nt, Human
cauaccuggcccugu

SEQ ID NO: 3253330 - RNA, 19 nt, Human
cauggggcugauuguauuu

SEQ ID NO: 3253331 - RNA, 22 nt, Human
cauuaccucagugagaagccag

SEQ ID NO: 3253332 - RNA, 21 nt, Human
cauuaccucagugagaagcca

SEQ ID NO: 3253333 - RNA, 22 nt, Human
ccaucauguuuacagaggacag

SEQ ID NO: 3253334 - RNA, 20 nt, Human
ccaucauguuuacagaggac

SEQ ID NO: 3253335 - RNA, 18 nt, Human
cccagaaugccuccugca

SEQ ID NO: 3253336 - RNA, 21 nt, Human
cccagcuaugguucucucgca

SEQ ID NO: 3253337 - RNA, 14 nt, Human
cccucaucuuucuu

SEQ ID NO: 3253338 - RNA, 20 nt, Human
cccugccaucauguuuacag

SEQ ID NO: 3253339 - RNA, 18 nt, Human
cccugccuggaccagccu

SEQ ID NO: 3253340 - RNA, 13 nt, Human
cccugccuggacc

SEQ ID NO: 3253341 - RNA, 12 nt, Human
cccugccuggac

SEQ ID NO: 3253342 - RNA, 23 nt, Human
ccuccauccuacccccugugccu

SEQ ID NO: 3253343 - RNA, 22 nt, Human
ccuccauccuacccccugugcc

SEQ ID NO: 3253344 - RNA, 17 nt, Human
ccuccauccuacccccu

SEQ ID NO: 3253345 - RNA, 16 nt, Human
ccggcuuuguggcacu

SEQ ID NO: 3253346 - RNA, 19 nt, Human
ccggcuuuguggcacuggg

SEQ ID NO: 3253347 - RNA, 17 nt, Human
ccggcuuuguggcacug

SEQ ID NO: 3253348 - RNA, 15 nt, Human
ccgggagcucaggaa

SEQ ID NO: 3253349 - RNA, 13 nt, Human
ccgggagcucagg

SEQ ID NO: 3253350 - RNA, 15 nt, Human
ccggggccugggcag

SEQ ID NO: 3253351 - RNA, 19 nt, Human
ccggggccugggcaggagg

SEQ ID NO: 3253352 - RNA, 18 nt, Human
ccucagccccgcguggaa

SEQ ID NO: 3253353 - RNA, 14 nt, Human
aacaggcucagagg

SEQ ID NO: 3253354 - RNA, 14 nt, Human
acccucaucuuucu

SEQ ID NO: 3253355 - RNA, 13 nt, Human
acccucaucuuuc

SEQ ID NO: 3253356 - RNA, 19 nt, Human
acccucaucuuucuuccaa

SEQ ID NO: 3253357 - RNA, 16 nt, Human
acccucaucuuucuuc

SEQ ID NO: 3253358 - RNA, 13 nt, Human
accggggccuggg

SEQ ID NO: 3253359 - RNA, 22 nt, Human
agagaggccauucuuucccaac

SEQ ID NO: 3253360 - RNA, 12 nt, Human
agagaggccauu

SEQ ID NO: 3253361 - RNA, 13 nt, Human
agcaucucccagu

SEQ ID NO: 3253362 - RNA, 19 nt, Human
agagugggguagguuggga

SEQ ID NO: 3253363 - RNA, 19 nt, Human
aggcuaggguggggagaga

SEQ ID NO: 3253364 - RNA, 16 nt, Human
aggcuaggguggggag

SEQ ID NO: 3253365 - RNA, 15 nt, Human
aggcuagggugggga

SEQ ID NO: 3253366 - RNA, 14 nt, Human
aggcuagggugggg

SEQ ID NO: 3253367 - RNA, 22 nt, Human
agggauuuggggcucagagugg

SEQ ID NO: 3253368 - RNA, 19 nt, Human
aggcaucggggagccggga

SEQ ID NO: 3253369 - RNA, 15 nt, Human
aggagggcaggcauc

SEQ ID NO: 3253370 - RNA, 13 nt, Human
aggagggcaggca

SEQ ID NO: 3253371 - RNA, 15 nt, Human
aggagggaggugcuu

SEQ ID NO: 3253372 - RNA, 20 nt, Human
aggagacagguuagcugcuc

SEQ ID NO: 3253373 - RNA, 13 nt, Human
aggaugucugggc

SEQ ID NO: 3253374 - RNA, 16 nt, Human
cuccugucucccuccu

SEQ ID NO: 3253375 - RNA, 24 nt, Human
cuccucugcccgggagcucaggaa

SEQ ID NO: 3253376 - RNA, 22 nt, Human
cuccucugcccgggagcucagg

SEQ ID NO: 3253377 - RNA, 23 nt, Human
cucaugauagaaggcuaugggga

SEQ ID NO: 3253378 - RNA, 23 nt, Human
cucaggccgaaggaggagucagg

SEQ ID NO: 3253379 - RNA, 20 nt, Human
cucaggccugacucucagca

SEQ ID NO: 3253380 - RNA, 18 nt, Human
ccagagaaaaagggaggg

SEQ ID NO: 3253381 - RNA, 23 nt, Human
ccagacuucccacggcuccucga

SEQ ID NO: 3253382 - RNA, 22 nt, Human
cccccugugccuugucacgcca

SEQ ID NO: 3253383 - RNA, 21 nt, Human
ccccgcguggaacucgugucu

SEQ ID NO: 3253384 - RNA, 13 nt, Human
ccauugguguuga

SEQ ID NO: 3253385 - RNA, 21 nt, Human
ccaugagcuccuuaaggcucu

SEQ ID NO: 3253386 - RNA, 12 nt, Human
ccaugagcuccu

SEQ ID NO: 3253387 - RNA, 22 nt, Human
ccucugcccgggagcucaggaa

SEQ ID NO: 3253388 - RNA, 21 nt, Human
ccucugcccgggagcucagga

SEQ ID NO: 3253389 - RNA, 15 nt, Human
ccucuuggcugccuu

SEQ ID NO: 3253390 - RNA, 22 nt, Human
ccucuuggggaguuuagggugg

SEQ ID NO: 3253391 - RNA, 23 nt, Human
ccucuuggggaguuuaggguggg

SEQ ID NO: 3253392 - RNA, 12 nt, Human
ccugccuggacc

SEQ ID NO: 3253393 - RNA, 19 nt, Human
ccugccuggaccagccucu

SEQ ID NO: 3253394 - RNA, 17 nt, Human
caccuaggcuagggugg

SEQ ID NO: 3253395 - RNA, 19 nt, Human
caccuaggcuagggugggg

SEQ ID NO: 3253396 - RNA, 18 nt, Human
caccuaggcuaggguggg

SEQ ID NO: 3253397 - RNA, 17 nt, Human
auuuuuaugccaccuga

SEQ ID NO: 3253398 - RNA, 17 nt, Human
auucauggccuggggga

SEQ ID NO: 3253399 - RNA, 17 nt, Human
caucuguaccucugccu

SEQ ID NO: 3253400 - RNA, 17 nt, Human
cagcacguguggccugu

SEQ ID NO: 3253401 - RNA, 17 nt, Human
ggagagacgggcccugg

SEQ ID NO: 3253402 - RNA, 15 nt, Human
ggagagacgggcccu

SEQ ID NO: 3253403 - RNA, 23 nt, Human
ggcaggcaucggggagccgggag

SEQ ID NO: 3253404 - RNA, 13 nt, Human
ggaugucugggcc

SEQ ID NO: 3253405 - RNA, 18 nt, Human
ggccagcaccaucucuuu

SEQ ID NO: 3253406 - RNA, 20 nt, Human
ggcuccucgagaucccaaca

SEQ ID NO: 3253407 - RNA, 17 nt, Human
ggcuggaucugugaggg

SEQ ID NO: 3253408 - RNA, 15 nt, Human
aaaaagggaggggga

SEQ ID NO: 3253409 - RNA, 14 nt, Human
gggagggggagagg

SEQ ID NO: 3253410 - RNA, 16 nt, Human
aaaauugugauguguc

SEQ ID NO: 3253411 - RNA, 23 nt, Human
ggggucuguguguuuaugugugu

SEQ ID NO: 3253412 - RNA, 15 nt, Human
ggggccugggcagga

SEQ ID NO: 3253413 - RNA, 12 nt, Human
ggggccugggca

SEQ ID NO: 3253414 - RNA, 19 nt, Human
gcuauggggauagaugugu

SEQ ID NO: 3253415 - RNA, 21 nt, Human
gcuauggggauagaugugugg

SEQ ID NO: 3253416 - RNA, 15 nt, Human
gaaccgaggcaggga

SEQ ID NO: 3253417 - RNA, 12 nt, Human
gaaccgaggcag

SEQ ID NO: 3253418 - RNA, 20 nt, Human
gaacugcugggcuuggcagc

SEQ ID NO: 3253419 - RNA, 17 nt, Human
gaacugcugggcuuggc

SEQ ID NO: 3253420 - RNA, 24 nt, Human
gaagugugggucugugugugugua

SEQ ID NO: 3253421 - RNA, 21 nt, Human
gaagugugggucugugugugu

SEQ ID NO: 3253422 - RNA, 16 nt, Human
gcaccggggccugggc

SEQ ID NO: 3253423 - RNA, 14 nt, Human
gcaccggggccugg

SEQ ID NO: 3253424 - RNA, 18 nt, Human
gagucagggagagcugaa

SEQ ID NO: 3253425 - RNA, 17 nt, Human
gaguccaucagccucca

SEQ ID NO: 3253426 - RNA, 23 nt, Human
gaggugcuucuaguucugccagg

SEQ ID NO: 3253427 - RNA, 22 nt, Human
gaggugcuucuaguucugccag

SEQ ID NO: 3253428 - RNA, 16 nt, Human
gagggcugccuuugga

SEQ ID NO: 3253429 - RNA, 9 nt, Human
gagggcugc

SEQ ID NO: 3253430 - RNA, 14 nt, Human
cuggaucugugagg

SEQ ID NO: 3253431 - RNA, 13 nt, Human
cuggcccugugcc

SEQ ID NO: 3253432 - RNA, 13 nt, Human
cugggcaggaggg

SEQ ID NO: 3253433 - RNA, 16 nt, Human
cugcaccggggccugg

SEQ ID NO: 3253434 - RNA, 14 nt, Human
cugcaccggggccu

SEQ ID NO: 3253435 - RNA, 19 nt, Human
cugcaccggggccugggca

SEQ ID NO: 3253436 - RNA, 18 nt, Human
cugcaccggggccugggc

SEQ ID NO: 3253437 - RNA, 12 nt, Human
uugugauguguc

SEQ ID NO: 3253438 - RNA, 18 nt, Human
augaguuggcugggaaua

SEQ ID NO: 3253439 - RNA, 22 nt, Human
aucugugaggggcucucucaug

SEQ ID NO: 3253440 - RNA, 21 nt, Human
aucugugaggggcucucucau

SEQ ID NO: 3253441 - RNA, 16 nt, Human
uuggacuugucccggg

SEQ ID NO: 3253442 - RNA, 19 nt, Human
uuguaaauuuaugugaugg

SEQ ID NO: 3253443 - RNA, 23 nt, Human
aucauguuuacagaggacaguau

SEQ ID NO: 3253444 - RNA, 18 nt, Human
aucauguuuacagaggac

SEQ ID NO: 3253445 - RNA, 17 nt, Human
uucuaguucugccagga

SEQ ID NO: 3253446 - RNA, 16 nt, Human
uucuaguucugccagg

SEQ ID NO: 3253447 - RNA, 17 nt, Human
aucccaacacugccagc

SEQ ID NO: 3253448 - RNA, 16 nt, Human
aucccaacacugccag

SEQ ID NO: 3253449 - RNA, 15 nt, Human
aucccaacacugcca

SEQ ID NO: 3253450 - RNA, 11 nt, Human
aucccaacacu

SEQ ID NO: 3253451 - RNA, 12 nt, Human
uucugccaggag

SEQ ID NO: 3253452 - RNA, 20 nt, Human
auauuuguaaauuuauguga

SEQ ID NO: 3253453 - RNA, 18 nt, Human
uuuguaagguuuuuguag

SEQ ID NO: 3253454 - RNA, 15 nt, Human
uuuguagugauuuuu

SEQ ID NO: 3253455 - RNA, 22 nt, Human
uuuguagugauuuuuaugccac

SEQ ID NO: 3253456 - RNA, 23 nt, Human
uuugaccuguugggagugaggau

SEQ ID NO: 3253457 - RNA, 19 nt, Human
uuucccuuccuuccucucc

SEQ ID NO: 3253458 - RNA, 17 nt, Human
auguauauaaacaugcu

SEQ ID NO: 3253459 - RNA, 23 nt, Human
auguguguguguuguguguggga

SEQ ID NO: 3253460 - RNA, 22 nt, Human
auguguguguguuguguguggg

SEQ ID NO: 3253461 - RNA, 18 nt, Human
auguguguguguugugug

SEQ ID NO: 3253462 - RNA, 15 nt, Human
auuuaaaauugugau

SEQ ID NO: 3253463 - RNA, 18 nt, Human
auuguagagccagagguc

SEQ ID NO: 3253464 - RNA, 17 nt, Human
auuguagagccagaggu

SEQ ID NO: 3253465 - RNA, 15 nt, Human
ugaugggucaguugu

SEQ ID NO: 3253466 - RNA, 16 nt, Human
agccucuccacucaug

SEQ ID NO: 3253467 - RNA, 23 nt, Human
agccccgcguggaacucgugucu

SEQ ID NO: 3253468 - RNA, 22 nt, Human
ugccgagaguccaucagccucc

SEQ ID NO: 3253469 - RNA, 16 nt, Human
ugccaucauguuuaca

SEQ ID NO: 3253470 - RNA, 16 nt, Human
ugcuaugagcugggga

SEQ ID NO: 3253471 - RNA, 20 nt, Human
ugcuaugagcuggggauguc

SEQ ID NO: 3253472 - RNA, 19 nt, Human
ugcuaugagcuggggaugu

SEQ ID NO: 3253473 - RNA, 22 nt, Human
ugcuaugagcuggggaugucuc

SEQ ID NO: 3253474 - RNA, 15 nt, Human
ugccuugucacgcca

SEQ ID NO: 3253475 - RNA, 16 nt, Human
ugccuuggugugcugu

SEQ ID NO: 3253476 - RNA, 19 nt, Human
agguuuuuguagugauuuu

SEQ ID NO: 3253477 - RNA, 23 nt, Human
agguuuguuuagaagaagugugu

SEQ ID NO: 3253478 - RNA, 21 nt, Human
uguagugauuuuuaugccacc

SEQ ID NO: 3253479 - RNA, 12 nt, Human
uguauguggggg

SEQ ID NO: 3253480 - RNA, 21 nt, Human
aggguggggggggggcgcggc

SEQ ID NO: 3253481 - RNA, 14 nt, Human
uggggagggauuug

SEQ ID NO: 3253482 - RNA, 13 nt, Human
uggggagagacgg

SEQ ID NO: 3253483 - RNA, 22 nt, Human
uggggagggauuuggggcucag

SEQ ID NO: 3253484 - RNA, 15 nt, Human
uggggcucagagugg

SEQ ID NO: 3253485 - RNA, 22 nt, Human
ugggagaaugucaguaugugga

SEQ ID NO: 3253486 - RNA, 20 nt, Human
ugggagaaugucaguaugug

SEQ ID NO: 3253487 - RNA, 19 nt, Human
ugggagaaugucaguaugu

SEQ ID NO: 3253488 - RNA, 22 nt, Human
agggaaggaucccaugagcucc

SEQ ID NO: 3253489 - RNA, 15 nt, Human
agggaaggaucccau

SEQ ID NO: 3253490 - RNA, 23 nt, Human
agggaaggaucccaugagcuccu

SEQ ID NO: 3253491 - RNA, 12 nt, Human
aguucugccagg

SEQ ID NO: 3253492 - RNA, 20 nt, Human
aguucugccaggagacaggu

SEQ ID NO: 3253493 - RNA, 14 nt, Human
aguucugccaggag

SEQ ID NO: 3253494 - RNA, 13 nt, Human
aguucugccagga

SEQ ID NO: 3253495 - RNA, 13 nt, Human
uguuuaugugugu

SEQ ID NO: 3253496 - RNA, 16 nt, Human
uguuuaugugugugug

SEQ ID NO: 3253497 - RNA, 14 nt, Human
aguuuagggugggg

SEQ ID NO: 3253498 - RNA, 13 nt, Human
aguuuaggguggg

SEQ ID NO: 3253499 - RNA, 12 nt, Human
aguuuagggugg

SEQ ID NO: 3253500 - RNA, 18 nt, Human
uuaaaauugugauguguc

SEQ ID NO: 3253501 - RNA, 13 nt, Human
uuaaaauugugau

SEQ ID NO: 3253502 - RNA, 15 nt, Human
uuagaagaagugugu

SEQ ID NO: 3253503 - RNA, 14 nt, Human
uuagaagaagugug

SEQ ID NO: 3253504 - RNA, 16 nt, Human
uuagaagaaguguguc

SEQ ID NO: 3253505 - RNA, 17 nt, Human
ugugacucuuuccaacc

SEQ ID NO: 3253506 - RNA, 15 nt, Human
ugugacucuuuccaa

SEQ ID NO: 3253507 - RNA, 14 nt, Human
ugugacucuuucca

SEQ ID NO: 3253508 - RNA, 12 nt, Human
ugugacucuuuc

SEQ ID NO: 3253509 - RNA, 16 nt, Human
uguggcauccagaguc

SEQ ID NO: 3253510 - RNA, 21 nt, Human
uguggcauccagagucccugc

SEQ ID NO: 3253511 - RNA, 19 nt, Human
uguggcauccagagucccu

SEQ ID NO: 3253512 - RNA, 14 nt, Human
uguguguguaugug

SEQ ID NO: 3253513 - RNA, 20 nt, Human
ugugugugggaguguguaau

SEQ ID NO: 3253514 - RNA, 12 nt, Human
ugugugugggag

SEQ ID NO: 3253515 - RNA, 20 nt, Human
ugugggucugugugugugua

SEQ ID NO: 3253516 - RNA, 16 nt, Human
uauuuguaaauuuaug

SEQ ID NO: 3253517 - RNA, 22 nt, Human
uauuuguaaauuuaugugaugg

SEQ ID NO: 3253518 - RNA, 17 nt, Human
uauuuguaaauuuaugu

SEQ ID NO: 3253519 - RNA, 21 nt, Human
uccacucaugugacucuuucc

SEQ ID NO: 3253520 - RNA, 14 nt, Human
uccacucaugugac

SEQ ID NO: 3253521 - RNA, 21 nt, Human
uccaaccggcuuuguggcacu

SEQ ID NO: 3253522 - RNA, 19 nt, Human
acucaugugacucuuucca

SEQ ID NO: 3253523 - RNA, 18 nt, Human
acucaugugacucuuucc

SEQ ID NO: 3253524 - RNA, 20 nt, Human
ucugagagaggccauucuuu

SEQ ID NO: 3253525 - RNA, 14 nt, Human
ucugagagaggcca

SEQ ID NO: 3253526 - RNA, 16 nt, Human
ucucauuccagaggaa

SEQ ID NO: 3253527 - RNA, 17 nt, Human
ucgagaucccaacacug

SEQ ID NO: 3253528 - RNA, 21 nt, Human
ucgagaucccaacacugccag

SEQ ID NO: 3253529 - RNA, 18 nt, Human
ucgagaucccaacacugc

SEQ ID NO: 3253530 - RNA, 23 nt, Human
acuggccaguggcuggaucugug

SEQ ID NO: 3253531 - RNA, 21 nt, Human
agaggccauucuuucccaaca

SEQ ID NO: 3253532 - RNA, 20 nt, Human
agaucccaacacugccagca

SEQ ID NO: 3253533 - RNA, 19 nt, Human
agaucccaacacugccagc

SEQ ID NO: 3253534 - RNA, 18 nt, Human
agaucccaacacugccag

SEQ ID NO: 3253535 - RNA, 17 nt, Human
agagucccugccuggac

SEQ ID NO: 3253536 - RNA, 14 nt, Human
agagucccugccug

SEQ ID NO: 3253537 - RNA, 23 nt, Human
agaguccaucagccuccauccua

SEQ ID NO: 3253538 - RNA, 19 nt, Human
agaaugucaguauguggaa

SEQ ID NO: 3253539 - RNA, 17 nt, Human
agaaugucaguaugugg

SEQ ID NO: 3253540 - RNA, 13 nt, Human
agaaugucaguau

SEQ ID NO: 3253541 - RNA, 16 nt, Human
agaaugucaguaugug

SEQ ID NO: 3253542 - RNA, 15 nt, Human
agaaugucaguaugu

SEQ ID NO: 3253543 - RNA, 21 nt, Human
agacauuugcuaugagcuggg

SEQ ID NO: 3253544 - RNA, 19 nt, Human
agacuucccacggcuccuc

SEQ ID NO: 3253545 - RNA, 13 nt, Human
ucuuucuuccaaa

SEQ ID NO: 3253546 - RNA, 22 nt, Human
aacacugccagcauuucccuuc

SEQ ID NO: 3253547 - RNA, 12 nt, Human
aacacugccagc

SEQ ID NO: 3253548 - RNA, 16 nt, Human
gucucccuccucugcc

SEQ ID NO: 3253549 - RNA, 12 nt, Human
gucucccuccuc

SEQ ID NO: 3253550 - RNA, 19 nt, Human
aacucgugucuggcacagc

SEQ ID NO: 3253551 - RNA, 15 nt, Human
guauguggaagugug

SEQ ID NO: 3253552 - RNA, 17 nt, Human
guauguggaaguguggg

SEQ ID NO: 3253553 - RNA, 16 nt, Human
guauguggaagugugg

SEQ ID NO: 3253554 - RNA, 20 nt, Human
guaugugggggucugugugu

SEQ ID NO: 3253555 - RNA, 19 nt, Human
guaugugggggucugugug

SEQ ID NO: 3253556 - RNA, 21 nt, Human
guauguggaagugugggucug

SEQ ID NO: 3253557 - RNA, 18 nt, Human
guauguggaagugugggu

SEQ ID NO: 3253558 - RNA, 16 nt, Human
guaggaacugcugggc

SEQ ID NO: 3253559 - RNA, 14 nt, Human
guguguaauuuaaa

SEQ ID NO: 3253560 - RNA, 14 nt, Human
gugggaguguguaa

SEQ ID NO: 3253561 - RNA, 13 nt, Human
gugggagugugua

SEQ ID NO: 3253562 - RNA, 14 nt, Human
gugguggcucggga

SEQ ID NO: 3253563 - RNA, 16 nt, Human
gugggucugugugugu

SEQ ID NO: 3253564 - RNA, 13 nt, Human
gugggucugugug

SEQ ID NO: 3253565 - RNA, 23 nt, Human
guggggggggggcgcggcuggga

SEQ ID NO: 3253566 - RNA, 14 nt, Human
guggcacuggggca

SEQ ID NO: 3253567 - RNA, 22 nt, Human
guggaagugugggucugugugu

SEQ ID NO: 3253568 - RNA, 21 nt, Human
guggaagugugggucugugug

SEQ ID NO: 3253569 - RNA, 20 nt, Human
guggaagugugggucugugu

SEQ ID NO: 3253570 - RNA, 19 nt, Human
guggaagugugggucugug

SEQ ID NO: 3253571 - RNA, 15 nt, Human
guggaaguguggguc

SEQ ID NO: 3253572 - RNA, 14 nt, Human
guggaagugugggu

SEQ ID NO: 3253573 - RNA, 23 nt, Human
gugcuauuguagagccagagguc

SEQ ID NO: 3253574 - RNA, 18 nt, Human
guuguaucagcacgugug

SEQ ID NO: 3253575 - RNA, 16 nt, Human
guuuaugugugugugu

SEQ ID NO: 3253576 - RNA, 13 nt, Human
guuuaugugugug

SEQ ID NO: 3253577 - RNA, 23 nt, Human
aaggcuauggggauagaugugug

SEQ ID NO: 3253578 - RNA, 16 nt, Human
guuuucuuaacuuaaa

SEQ ID NO: 3253579 - RNA, 17 nt, Human
acaccccgacuuuuguu

SEQ ID NO: 3253580 - RNA, 14 nt, Human
aauuuaugugaugg

SEQ ID NO: 3253581 - RNA, 16 nt, Human
uaauuuaaaauuguga

SEQ ID NO: 3253582 - RNA, 15 nt, Human
uaauuuaaaauugug

SEQ ID NO: 3253583 - RNA, 18 nt, Human
uacagaggacaguauuug

SEQ ID NO: 3253584 - RNA, 14 nt, Human
uacagaggacagua

SEQ ID NO: 3253585 - RNA, 18 nt, Human
ucacgccagacuucccac

SEQ ID NO: 3253586 - RNA, 16 nt, Human
uccuuaaggcucuuuu

SEQ ID NO: 3253587 - RNA, 19 nt, Human
uccuuaaggcucuuuugua

SEQ ID NO: 3253588 - RNA, 18 nt, Human
ucucccuccucugcccgg

SEQ ID NO: 3253589 - RNA, 19 nt, Human
ucuuuuguaagguuuuugu

SEQ ID NO: 3253590 - RNA, 20 nt, Human
ucuguguguuuaugugugug

SEQ ID NO: 3253591 - RNA, 19 nt, Human
ucuguguguuuaugugugu

SEQ ID NO: 3253592 - RNA, 22 nt, Human
ucuguguguguguauguggggg

SEQ ID NO: 3253593 - RNA, 16 nt, Human
ucuguguguuuaugug

SEQ ID NO: 3253594 - RNA, 15 nt, Human
ucuguguguuuaugu

SEQ ID NO: 3253595 - RNA, 13 nt, Human
ucugugugugugu

SEQ ID NO: 3253596 - RNA, 21 nt, Human
ucuguguguguguaugugggg

SEQ ID NO: 3253597 - RNA, 19 nt, Human
ucuguguguguguaugugg

SEQ ID NO: 3253598 - RNA, 18 nt, Human
ucuguguguguguaugug

SEQ ID NO: 3253599 - RNA, 15 nt, Human
ucuguguguguguau

SEQ ID NO: 3253600 - RNA, 13 nt, Human
uaggcuagggugg

SEQ ID NO: 3253601 - RNA, 21 nt, Human
uagugauuuuuaugccaccug

SEQ ID NO: 3253602 - RNA, 20 nt, Human
uagugauuuuuaugccaccu

SEQ ID NO: 3253603 - RNA, 22 nt, Human
uagugauuuuuaugccaccuga

SEQ ID NO: 3253604 - RNA, 15 nt, Human
uaucagcacgugugg

SEQ ID NO: 3253605 - RNA, 18 nt, Human
uaggaacugcugggcuug

SEQ ID NO: 3253606 - RNA, 15 nt, Human
uaggaacugcugggc

SEQ ID NO: 3253607 - RNA, 11 nt, Human
uagaugugugg

SEQ ID NO: 3253608 - RNA, 19 nt, Human
uaauucuuugaccuguugg

SEQ ID NO: 3253609 - RNA, 16 nt, Human
uggggcaggggccggg

SEQ ID NO: 3253610 - RNA, 18 nt, Human
uggggcaggggccggggg

SEQ ID NO: 3253611 - RNA, 23 nt, Human
uggaagugugggucugugugugu

SEQ ID NO: 3253612 - RNA, 20 nt, Human
uggaagugugggucugugug

SEQ ID NO: 3253613 - RNA, 21 nt, Human
uggaagugugggucugugugu

SEQ ID NO: 3253614 - RNA, 20 nt, Human
ugcuucuaguucugccagga

SEQ ID NO: 3253615 - RNA, 19 nt, Human
ugcuucuaguucugccagg

SEQ ID NO: 3253616 - RNA, 18 nt, Human
ugcuucuaguucugccag

SEQ ID NO: 3253617 - RNA, 14 nt, Human
ugucacgccagacu

SEQ ID NO: 3253618 - RNA, 16 nt, Human
uguaaauuuaugugau

SEQ ID NO: 3253619 - RNA, 15 nt, Human
uguaaauuuauguga

SEQ ID NO: 3253620 - RNA, 18 nt, Human
ugugaggggcucucucau

SEQ ID NO: 3253621 - RNA, 16 nt, Human
ugugggucugugugug

SEQ ID NO: 3253622 - RNA, 14 nt, Human
ugugggucugugug

SEQ ID NO: 3253623 - RNA, 16 nt, Human
ugugggggucugugug

SEQ ID NO: 3253624 - RNA, 15 nt, Human
uuacagaggacagua

SEQ ID NO: 3253625 - RNA, 21 nt, Human
uguuuacagaggacaguauuu

SEQ ID NO: 3253626 - RNA, 14 nt, Human
uguuuacagaggac

SEQ ID NO: 3253627 - RNA, 23 nt, Human
uguguugugugugggagugugua

SEQ ID NO: 3253628 - RNA, 14 nt, Human
uguguugugugugg

SEQ ID NO: 3253629 - RNA, 13 nt, Human
uguguuuaugugu

SEQ ID NO: 3253630 - RNA, 15 nt, Human
uguguuuaugugugu

SEQ ID NO: 3253631 - RNA, 11 nt, Human
uguguguaugu

SEQ ID NO: 3253632 - RNA, 13 nt, Human
uguguaugugggg

SEQ ID NO: 3253633 - RNA, 14 nt, Human
uguguauguggggg

SEQ ID NO: 3253634 - RNA, 23 nt, Human
uguguaugugggggucugugugu

SEQ ID NO: 3253635 - RNA, 17 nt, Human
uuuagaagaaguguguc

SEQ ID NO: 3253636 - RNA, 19 nt, Human
uuuagaagaagugugucac

SEQ ID NO: 3253637 - RNA, 13 nt, Human
ccaucagccucca

SEQ ID NO: 3253638 - RNA, 13 nt, Human
cccaacaccucuu

SEQ ID NO: 3253639 - RNA, 21 nt, Human
ccacgucagcugggacacccc

SEQ ID NO: 3253640 - RNA, 20 nt, Human
ccacacagacuugggcaggg

SEQ ID NO: 3253641 - RNA, 16 nt, Human
ccacacccucacugcu

SEQ ID NO: 3253642 - RNA, 19 nt, Human
ccaagccuuggcucuaccc

SEQ ID NO: 3253643 - RNA, 13 nt, Human
ccaacacugccag

SEQ ID NO: 3253644 - RNA, 16 nt, Human
ccaacacugccagcau

SEQ ID NO: 3253645 - RNA, 15 nt, Human
ccaacacugccagca

SEQ ID NO: 3253646 - RNA, 14 nt, Human
ccaacacugccagc

SEQ ID NO: 3253647 - RNA, 16 nt, Human
ccaaacaggcucagag

SEQ ID NO: 3253648 - RNA, 19 nt, Human
cauugucccugaagagaag

SEQ ID NO: 3253649 - RNA, 22 nt, Human
ccgacuuuuguuuaccagagaa

SEQ ID NO: 3253650 - RNA, 15 nt, Human
ccuccucugcccggg

SEQ ID NO: 3253651 - RNA, 14 nt, Human
ccuccucugcccgg

SEQ ID NO: 3253652 - RNA, 23 nt, Human
ccucuccacucaugugacucuuu

SEQ ID NO: 3253653 - RNA, 23 nt, Human
cgauugcaggagucccugccauc

SEQ ID NO: 3253654 - RNA, 21 nt, Human
cgauugcaggagucccugcca

SEQ ID NO: 3253655 - RNA, 23 nt, Human
cggcugggaggagggcaggcauc

SEQ ID NO: 3253656 - RNA, 18 nt, Human
cggcugggaggagggcag

SEQ ID NO: 3253657 - RNA, 22 nt, Human
cggcugggaggagggcaggcau

SEQ ID NO: 3253658 - RNA, 16 nt, Human
cgggagcucaggaacc

SEQ ID NO: 3253659 - RNA, 19 nt, Human
cgucagcugggacaccccg

SEQ ID NO: 3253660 - RNA, 14 nt, Human
ccuggaccagccuc

SEQ ID NO: 3253661 - RNA, 16 nt, Human
ccuggaccagccucuc

SEQ ID NO: 3253662 - RNA, 15 nt, Human
ccuggaccagccucu

SEQ ID NO: 3253663 - RNA, 20 nt, Human
cugccagcauuucccuuccu

SEQ ID NO: 3253664 - RNA, 16 nt, Human
cugccaggagacaggu

SEQ ID NO: 3253665 - RNA, 14 nt, Human
cuggcacagccugg

SEQ ID NO: 3253666 - RNA, 12 nt, Human
cuggaccagccu

SEQ ID NO: 3253667 - RNA, 17 nt, Human
cuccauugguguugaca

SEQ ID NO: 3253668 - RNA, 15 nt, Human
cucauuccagaggaa

SEQ ID NO: 3253669 - RNA, 17 nt, Human
cucauuccagaggaagg

SEQ ID NO: 3253670 - RNA, 13 nt, Human
cuccuuaaggcuc

SEQ ID NO: 3253671 - RNA, 22 nt, Human
cuccuuaaggcucuuuuguaag

SEQ ID NO: 3253672 - RNA, 19 nt, Human
cucuccacucaugugacuc

SEQ ID NO: 3253673 - RNA, 21 nt, Human
cugaagagaagggcagggcug

SEQ ID NO: 3253674 - RNA, 14 nt, Human
cuuccuuccucucc

SEQ ID NO: 3253675 - RNA, 20 nt, Human
gaagcguuguccucagcccc

SEQ ID NO: 3253676 - RNA, 19 nt, Human
gaagcguuguccucagccc

SEQ ID NO: 3253677 - RNA, 13 nt, Human
gaagcguuguccu

SEQ ID NO: 3253678 - RNA, 17 nt, Human
gaagagaagggcagggc

SEQ ID NO: 3253679 - RNA, 18 nt, Human
gacuucccacggcuccuc

SEQ ID NO: 3253680 - RNA, 22 nt, Human
gaguguguaauuuaaaauugug

SEQ ID NO: 3253681 - RNA, 21 nt, Human
gaguguguaauuuaaaauugu

SEQ ID NO: 3253682 - RNA, 19 nt, Human
gcacagccuggcuguggcc

SEQ ID NO: 3253683 - RNA, 12 nt, Human
gcacagccuggc

SEQ ID NO: 3253684 - RNA, 15 nt, Human
gcaggagggaggugc

SEQ ID NO: 3253685 - RNA, 21 nt, Human
gccgagaguccaucagccucc

SEQ ID NO: 3253686 - RNA, 19 nt, Human
gccgggagccugacccuca

SEQ ID NO: 3253687 - RNA, 14 nt, Human
gccgggagccugac

SEQ ID NO: 3253688 - RNA, 13 nt, Human
gccgggagccuga

SEQ ID NO: 3253689 - RNA, 17 nt, Human
gccuaaccugccgagag

SEQ ID NO: 3253690 - RNA, 13 nt, Human
gccccgcguggaa

SEQ ID NO: 3253691 - RNA, 18 nt, Human
gcuucuaguucugccagg

SEQ ID NO: 3253692 - RNA, 21 nt, Human
gcuucuaguucugccaggaga

SEQ ID NO: 3253693 - RNA, 20 nt, Human
gcuucuaguucugccaggag

SEQ ID NO: 3253694 - RNA, 19 nt, Human
gcuucuaguucugccagga

SEQ ID NO: 3253695 - RNA, 20 nt, Human
ggaaccgaggcagggaagga

SEQ ID NO: 3253696 - RNA, 16 nt, Human
ggaaccgaggcaggga

SEQ ID NO: 3253697 - RNA, 15 nt, Human
ggaaccgaggcaggg

SEQ ID NO: 3253698 - RNA, 17 nt, Human
ggaacucgugucuggca

SEQ ID NO: 3253699 - RNA, 20 nt, Human
gcugccuuuggacuuguccc

SEQ ID NO: 3253700 - RNA, 15 nt, Human
gcugccuuuggacuu

SEQ ID NO: 3253701 - RNA, 13 nt, Human
gcuggaucuguga

SEQ ID NO: 3253702 - RNA, 23 nt, Human
gcugggacaccccgacuuuuguu

SEQ ID NO: 3253703 - RNA, 19 nt, Human
gcugggaggagggcaggca

SEQ ID NO: 3253704 - RNA, 17 nt, Human
gcugggaggagggcagg

SEQ ID NO: 3253705 - RNA, 20 nt, Human
ggcagucugagagaggccau

SEQ ID NO: 3253706 - RNA, 20 nt, Human
ggaucccaugagcuccuuaa

SEQ ID NO: 3253707 - RNA, 17 nt, Human
ggaucccaugagcuccu

SEQ ID NO: 3253708 - RNA, 16 nt, Human
ggagccgggagccuga

SEQ ID NO: 3253709 - RNA, 20 nt, Human
ggaggagggcaggcaucggg

SEQ ID NO: 3253710 - RNA, 15 nt, Human
ggaggagggcaggca

SEQ ID NO: 3253711 - RNA, 14 nt, Human
ggaggagggcaggc

SEQ ID NO: 3253712 - RNA, 13 nt, Human
ggagggcaggcau

SEQ ID NO: 3253713 - RNA, 12 nt, Human
ggagggauuugg

SEQ ID NO: 3253714 - RNA, 15 nt, Human
ggauagaugugugga

SEQ ID NO: 3253715 - RNA, 14 nt, Human
ggauagaugugugg

SEQ ID NO: 3253716 - RNA, 13 nt, Human
ggauagaugugug

SEQ ID NO: 3253717 - RNA, 17 nt, Human
ggaaggaucccaugagc

SEQ ID NO: 3253718 - RNA, 21 nt, Human
gguguccugcaccggggccug

SEQ ID NO: 3253719 - RNA, 15 nt, Human
ggugguggcucggga

SEQ ID NO: 3253720 - RNA, 15 nt, Human
ggggcagucugagag

SEQ ID NO: 3253721 - RNA, 18 nt, Human
ggggcagucugagagagg

SEQ ID NO: 3253722 - RNA, 19 nt, Human
ggggcagucugagagaggc

SEQ ID NO: 3253723 - RNA, 16 nt, Human
ggggcgcggcugggag

SEQ ID NO: 3253724 - RNA, 15 nt, Human
ggggcgcggcuggga

SEQ ID NO: 3253725 - RNA, 17 nt, Human
gggccugggcaggaggg

SEQ ID NO: 3253726 - RNA, 16 nt, Human
gggccugggcaggagg

SEQ ID NO: 3253727 - RNA, 15 nt, Human
gggggagagggcugc

SEQ ID NO: 3253728 - RNA, 15 nt, Human
gggaaggaucccaug

SEQ ID NO: 3253729 - RNA, 17 nt, Human
gggcagucugagagagg

SEQ ID NO: 3253730 - RNA, 19 nt, Human
gggcagucugagagaggcc

SEQ ID NO: 3253731 - RNA, 18 nt, Human
gggcagucugagagaggc

SEQ ID NO: 3253732 - RNA, 23 nt, Human
gggaggugcuucuaguucugcca

SEQ ID NO: 3253733 - RNA, 11 nt, Human
gggagugugua

SEQ ID NO: 3253734 - RNA, 16 nt, Human
gggaguuuaggguggg

SEQ ID NO: 3253735 - RNA, 14 nt, Human
gggauagaugugug

SEQ ID NO: 3253736 - RNA, 13 nt, Human
gggauagaugugu

SEQ ID NO: 3253737 - RNA, 12 nt, Human
gggccugggcag

SEQ ID NO: 3253738 - RNA, 15 nt, Human
gggccugggcaggag

SEQ ID NO: 3253739 - RNA, 13 nt, Human
gggccugggcagg

SEQ ID NO: 3253740 - RNA, 21 nt, Human
gggcagucugagagaggccau

SEQ ID NO: 3253741 - RNA, 20 nt, Human
gggcagucugagagaggcca

SEQ ID NO: 3253742 - RNA, 17 nt, Human
uuggacaaccucauuuu

SEQ ID NO: 3253743 - RNA, 13 nt, Human
ugccaucauguuu

SEQ ID NO: 3253744 - RNA, 18 nt, Human
aaggaauuauucccauga

SEQ ID NO: 3253745 - RNA, 21 nt, Human
uuggcagcccgggucaucugu

SEQ ID NO: 3253746 - RNA, 16 nt, Human
auagcaccuccacaua

SEQ ID NO: 3253747 - RNA, 17 nt, Human
aauaagugccaggaugg

SEQ ID NO: 3253748 - RNA, 16 nt, Human
aaugucaguaugugga

SEQ ID NO: 3253749 - RNA, 22 nt, Human
aaugucaguauguggaagugug

SEQ ID NO: 3253750 - RNA, 13 nt, Human
acucagucuuuaa

SEQ ID NO: 3253751 - RNA, 16 nt, Human
acgccagacuucccac

SEQ ID NO: 3253752 - RNA, 22 nt, Human
acgccagacuucccacggcucc

SEQ ID NO: 3253753 - RNA, 11 nt, Human
acacugccagc

SEQ ID NO: 3253754 - RNA, 15 nt, Human
acagguuagcugcuc

SEQ ID NO: 3253755 - RNA, 12 nt, Human
accccgacuuuu

SEQ ID NO: 3253756 - RNA, 15 nt, Human
accccgacuuuuguu

SEQ ID NO: 3253757 - RNA, 13 nt, Human
agccagaggucug

SEQ ID NO: 3253758 - RNA, 16 nt, Human
agaggguguccugcac

SEQ ID NO: 3253759 - RNA, 14 nt, Human
agacgggcccuggu

SEQ ID NO: 3253760 - RNA, 21 nt, Human
aggcuauggggauagaugugu

SEQ ID NO: 3253761 - RNA, 22 nt, Human
aggcuauggggauagaugugug

SEQ ID NO: 3253762 - RNA, 19 nt, Human
aggcuauggggauagaugu

SEQ ID NO: 3253763 - RNA, 21 nt, Human
aggugcuucuaguucugccag

SEQ ID NO: 3253764 - RNA, 22 nt, Human
aggugcuucuaguucugccagg

SEQ ID NO: 3253765 - RNA, 23 nt, Human
aggugcuucuaguucugccagga

SEQ ID NO: 3253766 - RNA, 20 nt, Human
aguuguaucagcacgugugg

SEQ ID NO: 3253767 - RNA, 23 nt, Human
aguuguaucagcacguguggccu

SEQ ID NO: 3253768 - RNA, 16 nt, Human
augugggggucugugu

SEQ ID NO: 3253769 - RNA, 17 nt, Human
augugggggucugugug

SEQ ID NO: 3253770 - RNA, 18 nt, Human
augugggggucugugugu

SEQ ID NO: 3253771 - RNA, 22 nt, Human
gucccgggacaccuaggcuagg

SEQ ID NO: 3253772 - RNA, 15 nt, Human
guccaucagccucca

SEQ ID NO: 3253773 - RNA, 10 nt, Human
gugauguguc

SEQ ID NO: 3253774 - RNA, 19 nt, Human
aagaagugugucacccuua

SEQ ID NO: 3253775 - RNA, 21 nt, Human
aagucacuggccaguggcugg

SEQ ID NO: 3253776 - RNA, 20 nt, Human
aagugugggucugugugugu

SEQ ID NO: 3253777 - RNA, 10 nt, Human
aagugugggu

SEQ ID NO: 3253778 - RNA, 17 nt, Human
aagugugggucugugug

SEQ ID NO: 3253779 - RNA, 18 nt, Human
aagugugggucugugugu

SEQ ID NO: 3253780 - RNA, 15 nt, Human
uaaaauugugaugug

SEQ ID NO: 3253781 - RNA, 16 nt, Human
uaaaauugugaugugu

SEQ ID NO: 3253782 - RNA, 13 nt, Human
guguauguggggg

SEQ ID NO: 3253783 - RNA, 21 nt, Human
guguaugugggggucugugug

SEQ ID NO: 3253784 - RNA, 20 nt, Human
uauggggauagaugugugga

SEQ ID NO: 3253785 - RNA, 19 nt, Human
uauggggauagaugugugg

SEQ ID NO: 3253786 - RNA, 12 nt, Human
uauguggaagug

SEQ ID NO: 3253787 - RNA, 16 nt, Human
uauguggaaguguggg

SEQ ID NO: 3253788 - RNA, 16 nt, Human
acaccucuuggggagu

SEQ ID NO: 3253789 - RNA, 22 nt, Human
uaacuuaaaagaacauguauau

SEQ ID NO: 3253790 - RNA, 21 nt, Human
acucuggagguuuguuuagaa

SEQ ID NO: 3253791 - RNA, 18 nt, Human
uccugcaccggggccugg

SEQ ID NO: 3253792 - RNA, 23 nt, Human
ucacagcaagucacuggccagug

SEQ ID NO: 3253793 - RNA, 12 nt, Human
accuaggcuagg

SEQ ID NO: 3253794 - RNA, 17 nt, Human
accuaggcuaggguggg

SEQ ID NO: 3253795 - RNA, 17 nt, Human
ucauguuuacagaggac

SEQ ID NO: 3253796 - RNA, 18 nt, Human
ucaugugacucuuuccaa

SEQ ID NO: 3253797 - RNA, 19 nt, Human
ucaugugacucuuuccaac

SEQ ID NO: 3253798 - RNA, 14 nt, Human
ucaugugacucuuu

SEQ ID NO: 3253799 - RNA, 17 nt, Human
ucaugugacucuuucca

SEQ ID NO: 3253800 - RNA, 16 nt, Human
ucauaaauuuaugguu

SEQ ID NO: 3253801 - RNA, 13 nt, Human
accgaggcaggga

SEQ ID NO: 3253802 - RNA, 14 nt, Human
ucaguauguggaag

SEQ ID NO: 3253803 - RNA, 12 nt, Human
ucaguaugugga

SEQ ID NO: 3253804 - RNA, 17 nt, Human
ucagauuugccuuauug

SEQ ID NO: 3253805 - RNA, 15 nt, Human
ucuaguucugccagg

SEQ ID NO: 3253806 - RNA, 16 nt, Human
ucuaguucugccagga

SEQ ID NO: 3253807 - RNA, 17 nt, Human
ucuaguucugccaggag

SEQ ID NO: 3253808 - RNA, 14 nt, Human
ucuaguucugccag

SEQ ID NO: 3253809 - RNA, 14 nt, Human
agaagaaguguguc

SEQ ID NO: 3253810 - RNA, 13 nt, Human
ugagagaggccau

SEQ ID NO: 3253811 - RNA, 22 nt, Human
auguggaagugugggucugugu

SEQ ID NO: 3253812 - RNA, 23 nt, Human
auguggaagugugggucugugug

SEQ ID NO: 3253813 - RNA, 15 nt, Human
auguggaaguguggg

SEQ ID NO: 3253814 - RNA, 16 nt, Human
auguggaagugugggu

SEQ ID NO: 3253815 - RNA, 13 nt, Human
auguggaagugug

SEQ ID NO: 3253816 - RNA, 10 nt, Human
augugugugu

SEQ ID NO: 3253817 - RNA, 16 nt, Human
uuuuguuuaccagaga

SEQ ID NO: 3253818 - RNA, 13 nt, Human
auugugauguguc

SEQ ID NO: 3253819 - RNA, 14 nt, Human
auugugaugugucc

SEQ ID NO: 3253820 - RNA, 15 nt, Human
auugugauguguccu

SEQ ID NO: 3253821 - RNA, 12 nt, Human
auugguguugac

SEQ ID NO: 3253822 - RNA, 20 nt, Human
auuucccuuccuuccucucc

SEQ ID NO: 3253823 - RNA, 16 nt, Human
uucagauuugccuuau

SEQ ID NO: 3253824 - RNA, 20 nt, Human
auccauggggcugauuguau

SEQ ID NO: 3253825 - RNA, 20 nt, Human
aucauuaucagccugugcca

SEQ ID NO: 3253826 - RNA, 18 nt, Human
aucggggagccgggagcc

SEQ ID NO: 3253827 - RNA, 16 nt, Human
aucggggagccgggag

SEQ ID NO: 3253828 - RNA, 10 nt, Human
uugugugugg

SEQ ID NO: 3253829 - RNA, 13 nt, Human
uugugugugggag

SEQ ID NO: 3253830 - RNA, 16 nt, Human
uugugugugggagugu

SEQ ID NO: 3253831 - RNA, 13 nt, Human
uugucacgccaga

SEQ ID NO: 3253832 - RNA, 20 nt, Human
uugucacgccagacuuccca

SEQ ID NO: 3253833 - RNA, 18 nt, Human
uugucccugaagagaagg

SEQ ID NO: 3253834 - RNA, 22 nt, Human
uuguccucagccccgcguggaa

SEQ ID NO: 3253835 - RNA, 22 nt, Human
uggcugccuugugaaggaauua

SEQ ID NO: 3253836 - RNA, 16 nt, Human
uggccaguggcuggau

SEQ ID NO: 3253837 - RNA, 14 nt, Human
uggccaguggcugg

SEQ ID NO: 3253838 - RNA, 15 nt, Human
uggccaguggcugga

SEQ ID NO: 3253839 - RNA, 17 nt, Human
aggccauucuuucccaa

SEQ ID NO: 3253840 - RNA, 18 nt, Human
aggccauucuuucccaac

SEQ ID NO: 3253841 - RNA, 19 nt, Human
aggccauucuuucccaaca

SEQ ID NO: 3253842 - RNA, 21 nt, Human
aggccucucauuccagaggaa

SEQ ID NO: 3253843 - RNA, 15 nt, Human
aggccauucuuuccc

SEQ ID NO: 3253844 - RNA, 22 nt, Human
uggaccuuuccugaggaagagg

SEQ ID NO: 3253845 - RNA, 22 nt, Human
ugcuauuguagagccagagguc

SEQ ID NO: 3253846 - RNA, 18 nt, Human
ugcuauuguagagccaga

SEQ ID NO: 3253847 - RNA, 13 nt, Human
ugcuccccacguc

SEQ ID NO: 3253848 - RNA, 16 nt, Human
uggaccagccucucca

SEQ ID NO: 3253849 - RNA, 22 nt, Human
uggaccagccucuccacucaug

SEQ ID NO: 3253850 - RNA, 14 nt, Human
agcugccugugccu

SEQ ID NO: 3253851 - RNA, 18 nt, Human
uguugggagugaggaugu

SEQ ID NO: 3253852 - RNA, 14 nt, Human
uuaucaacauuugu

SEQ ID NO: 3253853 - RNA, 15 nt, Human
ugggucugugugugu

SEQ ID NO: 3253854 - RNA, 13 nt, Human
ugggucugugugu

SEQ ID NO: 3253855 - RNA, 23 nt, Human
ugggaauaagugccaggauggaa

SEQ ID NO: 3253856 - RNA, 20 nt, Human
uguaugugggggucugugug

SEQ ID NO: 3253857 - RNA, 21 nt, Human
uguaugugggggucugugugu

SEQ ID NO: 3253858 - RNA, 22 nt, Human
uguaugugggggucuguguguu

SEQ ID NO: 3253859 - RNA, 22 nt, Human
uguauccauccauggggcugau

SEQ ID NO: 3253860 - RNA, 13 nt, Human
aguccaucagccu

SEQ ID NO: 3253861 - RNA, 14 nt, Human
aguccaucagccuc

SEQ ID NO: 3253862 - RNA, 13 nt, Human
agucccugccugg

SEQ ID NO: 3253863 - RNA, 11 nt, Human
ugugauguguc

SEQ ID NO: 3253864 - RNA, 20 nt, Human
gcugggaauaagugccagga

SEQ ID NO: 3253865 - RNA, 16 nt, Human
ggacaccccgacuuuu

SEQ ID NO: 3253866 - RNA, 16 nt, Human
ggacaccuaggcuagg

SEQ ID NO: 3253867 - RNA, 18 nt, Human
ggacaguauuugugggga

SEQ ID NO: 3253868 - RNA, 19 nt, Human
ggacaguauuuguggggag

SEQ ID NO: 3253869 - RNA, 22 nt, Human
gcuuuuccucaaagggagagag

SEQ ID NO: 3253870 - RNA, 19 nt, Human
gccauucuuucccaacacc

SEQ ID NO: 3253871 - RNA, 12 nt, Human
gccauucuuucc

SEQ ID NO: 3253872 - RNA, 21 nt, Human
gcguggaacucgugucuggca

SEQ ID NO: 3253873 - RNA, 17 nt, Human
gcuaggguggggagaga

SEQ ID NO: 3253874 - RNA, 18 nt, Human
gcuaggguggggagagac

SEQ ID NO: 3253875 - RNA, 18 nt, Human
gcucagaggguguccugc

SEQ ID NO: 3253876 - RNA, 19 nt, Human
gcucagaggguguccugca

SEQ ID NO: 3253877 - RNA, 21 nt, Human
gggucaucuguaccucugccu

SEQ ID NO: 3253878 - RNA, 18 nt, Human
gggucauucauggccugg

SEQ ID NO: 3253879 - RNA, 22 nt, Human
gggggcagucugagagaggcca

SEQ ID NO: 3253880 - RNA, 18 nt, Human
gguaggaacugcugggcu

SEQ ID NO: 3253881 - RNA, 16 nt, Human
gguaggaacugcuggg

SEQ ID NO: 3253882 - RNA, 17 nt, Human
ggguguccugcaccggg

SEQ ID NO: 3253883 - RNA, 21 nt, Human
ggguguccugcaccggggccu

SEQ ID NO: 3253884 - RNA, 22 nt, Human
gguuuguuuagaagaagugugu

SEQ ID NO: 3253885 - RNA, 22 nt, Human
gguggggggggggcgcggcugg

SEQ ID NO: 3253886 - RNA, 11 nt, Human
ggaguguguaa

SEQ ID NO: 3253887 - RNA, 22 nt, Human
ggaguguguaauuuaaaauugu

SEQ ID NO: 3253888 - RNA, 14 nt, Human
ggagggggagaggg

SEQ ID NO: 3253889 - RNA, 23 nt, Human
ggcaucggggagccgggagccug

SEQ ID NO: 3253890 - RNA, 16 nt, Human
ggcauccagagucccu

SEQ ID NO: 3253891 - RNA, 22 nt, Human
ggcaucggggagccgggagccu

SEQ ID NO: 3253892 - RNA, 14 nt, Human
ggcaggagggaggu

SEQ ID NO: 3253893 - RNA, 12 nt, Human
ggcaggggccgg

SEQ ID NO: 3253894 - RNA, 17 nt, Human
gcaucggggagccggga

SEQ ID NO: 3253895 - RNA, 22 nt, Human
gcauccagagucccugccugga

SEQ ID NO: 3253896 - RNA, 23 nt, Human
gcauccagagucccugccuggac

SEQ ID NO: 3253897 - RNA, 21 nt, Human
gcauccagagucccugccugg

SEQ ID NO: 3253898 - RNA, 17 nt, Human
gaucccaacacugccag

SEQ ID NO: 3253899 - RNA, 18 nt, Human
gaucccaacacugccagc

SEQ ID NO: 3253900 - RNA, 19 nt, Human
gaucccaacacugccagca

SEQ ID NO: 3253901 - RNA, 13 nt, Human
gauggaaugaugg

SEQ ID NO: 3253902 - RNA, 16 nt, Human
gagacgggcccuggug

SEQ ID NO: 3253903 - RNA, 22 nt, Human
gaggacaguauuuguggggagg

SEQ ID NO: 3253904 - RNA, 20 nt, Human
gacccucaucuuucuuccaa

SEQ ID NO: 3253905 - RNA, 15 nt, Human
cuuccucuccugucu

SEQ ID NO: 3253906 - RNA, 17 nt, Human
cuucuaccucuuggcug

SEQ ID NO: 3253907 - RNA, 14 nt, Human
cuuuugucccagaa

SEQ ID NO: 3253908 - RNA, 23 nt, Human
cuggcccuaugcuuccggccucc

SEQ ID NO: 3253909 - RNA, 17 nt, Human
cagaggguguccugcac

SEQ ID NO: 3253910 - RNA, 16 nt, Human
cagggcugaggccucu

SEQ ID NO: 3253911 - RNA, 18 nt, Human
cagggcugaggccucuca

SEQ ID NO: 3253912 - RNA, 15 nt, Human
cacuggggcaggggc

SEQ ID NO: 3253913 - RNA, 13 nt, Human
cacuggggcaggg

SEQ ID NO: 3253914 - RNA, 18 nt, Human
caacaccucuuggggagu

SEQ ID NO: 3253915 - RNA, 19 nt, Human
auucuuugaccuguuggga

SEQ ID NO: 3253916 - RNA, 21 nt, Human
cuaauucuuugaccuguuggg

SEQ ID NO: 3253917 - RNA, 22 nt, Human
cuaauucuuugaccuguuggga

SEQ ID NO: 3253918 - RNA, 18 nt, Human
cucaugugacucuuucca

SEQ ID NO: 3253919 - RNA, 14 nt, Human
cucaugugacucuu

SEQ ID NO: 3253920 - RNA, 15 nt, Human
cucgugucuggcaca

SEQ ID NO: 3253921 - RNA, 12 nt, Human
cugagaggccac

SEQ ID NO: 3253922 - RNA, 13 nt, Human
cugagagaggcca

SEQ ID NO: 3253923 - RNA, 14 nt, Human
cugagagaggccau

SEQ ID NO: 3253924 - RNA, 21 nt, Human
cugagagaggccauucuuucc

SEQ ID NO: 3253925 - RNA, 22 nt, Human
cugagagaggccauucuuuccc

SEQ ID NO: 3253926 - RNA, 13 nt, Human
caaccggcuuugu

SEQ ID NO: 3253927 - RNA, 22 nt, Human
caaccggcuuuguggcacuggg

SEQ ID NO: 3253928 - RNA, 13 nt, Human
caacacugccagc

SEQ ID NO: 3253929 - RNA, 14 nt, Human
caacacugccagca

SEQ ID NO: 3253930 - RNA, 12 nt, Human
caacacugccag

SEQ ID NO: 3253931 - RNA, 12 nt, Human
cagguguucuuc

SEQ ID NO: 3253932 - RNA, 12 nt, Human
caguauguggaa

SEQ ID NO: 3253933 - RNA, 22 nt, Human
cagucuuuaaucugagaggcca

SEQ ID NO: 3253934 - RNA, 15 nt, Human
caggcucagagggug

SEQ ID NO: 3253935 - RNA, 11 nt, Human
caggcucagag

SEQ ID NO: 3253936 - RNA, 13 nt, Human
cagggaaggaucc

SEQ ID NO: 3253937 - RNA, 18 nt, Human
cagggaaggaucccauga

SEQ ID NO: 3253938 - RNA, 15 nt, Human
caggagucccugcca

SEQ ID NO: 3253939 - RNA, 21 nt, Human
caggagucccugccaucaugu

SEQ ID NO: 3253940 - RNA, 14 nt, Human
caggagucccugcc

SEQ ID NO: 3253941 - RNA, 23 nt, Human
caggagacagguuagcugcuccc

SEQ ID NO: 3253942 - RNA, 20 nt, Human
caggcaucggggagccggga

SEQ ID NO: 3253943 - RNA, 21 nt, Human
caggcaucggggagccgggag

SEQ ID NO: 3253944 - RNA, 18 nt, Human
cagccuccauccuacccc

SEQ ID NO: 3253945 - RNA, 21 nt, Human
cagccuccauccuacccccug

SEQ ID NO: 3253946 - RNA, 23 nt, Human
cagccucuccacucaugugacuc

SEQ ID NO: 3253947 - RNA, 23 nt, Human
cagccuggcuguggccuaaccug

SEQ ID NO: 3253948 - RNA, 15 nt, Human
caggaaccgaggcag

SEQ ID NO: 3253949 - RNA, 17 nt, Human
caggaaccgaggcaggg

SEQ ID NO: 3253950 - RNA, 18 nt, Human
caggaaccgaggcaggga

SEQ ID NO: 3253951 - RNA, 15 nt, Human
cagcauuucccuucc

SEQ ID NO: 3253952 - RNA, 22 nt, Human
cagaggacaguauuugugggga

SEQ ID NO: 3253953 - RNA, 18 nt, Human
cagagucccugccuggac

SEQ ID NO: 3253954 - RNA, 14 nt, Human
cagagucccugccu

SEQ ID NO: 3253955 - RNA, 17 nt, Human
cagagaaaaagggaggg

SEQ ID NO: 3253956 - RNA, 18 nt, Human
cagagaaaaagggagggg

SEQ ID NO: 3253957 - RNA, 12 nt, Human
cagagaaaaagg

SEQ ID NO: 3253958 - RNA, 12 nt, Human
cagacuucccac

SEQ ID NO: 3253959 - RNA, 22 nt, Human
cagacuucccacggcuccucga

SEQ ID NO: 3253960 - RNA, 14 nt, Human
caccggggccuggg

SEQ ID NO: 3253961 - RNA, 21 nt, Human
caccggggccugggcaggagg

SEQ ID NO: 3253962 - RNA, 22 nt, Human
caccggggccugggcaggaggg

SEQ ID NO: 3253963 - RNA, 16 nt, Human
cacucaugugacucuu

SEQ ID NO: 3253964 - RNA, 22 nt, Human
cacucaugugacucuuuccaac

SEQ ID NO: 3253965 - RNA, 20 nt, Human
cacggcuccucgagauccca

SEQ ID NO: 3253966 - RNA, 22 nt, Human
cacggcuccucgagaucccaac

SEQ ID NO: 3253967 - RNA, 19 nt, Human
cacguguggccuguucuuc

SEQ ID NO: 3253968 - RNA, 19 nt, Human
ggagacagguuagcugcuc

SEQ ID NO: 3253969 - RNA, 12 nt, Human
ggaccagccucu

SEQ ID NO: 3253970 - RNA, 21 nt, Human
ggagcucaggaaccgaggcag

SEQ ID NO: 3253971 - RNA, 14 nt, Human
ggagggcaggcauc

SEQ ID NO: 3253972 - RNA, 20 nt, Human
ggcugggaggagggcaggca

SEQ ID NO: 3253973 - RNA, 21 nt, Human
ggcugggaggagggcaggcau

SEQ ID NO: 3253974 - RNA, 13 nt, Human
ggcugggaggagg

SEQ ID NO: 3253975 - RNA, 21 nt, Human
ggcuguggcauccagaguccc

SEQ ID NO: 3253976 - RNA, 23 nt, Human
ggcuguggcauccagagucccug

SEQ ID NO: 3253977 - RNA, 20 nt, Human
gggacaccaagccuuggcuc

SEQ ID NO: 3253978 - RNA, 14 nt, Human
gggacaccuaggcu

SEQ ID NO: 3253979 - RNA, 13 nt, Human
gggagccgggagc

SEQ ID NO: 3253980 - RNA, 12 nt, Human
gggagcucagga

SEQ ID NO: 3253981 - RNA, 22 nt, Human
gggagcucaggaaccgaggcag

SEQ ID NO: 3253982 - RNA, 23 nt, Human
gggagcucaggaaccgaggcagg

SEQ ID NO: 3253983 - RNA, 16 nt, Human
gggaggagggcaggca

SEQ ID NO: 3253984 - RNA, 12 nt, Human
gggaggagggca

SEQ ID NO: 3253985 - RNA, 16 nt, Human
ggccugacucucagca

SEQ ID NO: 3253986 - RNA, 15 nt, Human
ggccugggcaggagg

SEQ ID NO: 3253987 - RNA, 17 nt, Human
ggccugggcaggaggga

SEQ ID NO: 3253988 - RNA, 19 nt, Human
ggccugggcaggagggagg

SEQ ID NO: 3253989 - RNA, 15 nt, Human
ggccuaaccugccga

SEQ ID NO: 3253990 - RNA, 16 nt, Human
ggccuaaccugccgag

SEQ ID NO: 3253991 - RNA, 20 nt, Human
ggccucucauuccagaggaa

SEQ ID NO: 3253992 - RNA, 15 nt, Human
gcuccuuaaggcucu

SEQ ID NO: 3253993 - RNA, 17 nt, Human
gcuccuuaaggcucuuu

SEQ ID NO: 3253994 - RNA, 21 nt, Human
gcuccuuaaggcucuuuugua

SEQ ID NO: 3253995 - RNA, 16 nt, Human
gccugggcaggaggga

SEQ ID NO: 3253996 - RNA, 17 nt, Human
gccuggaccagccucuc

SEQ ID NO: 3253997 - RNA, 16 nt, Human
gccuggaccagccucu

SEQ ID NO: 3253998 - RNA, 17 nt, Human
gcgaagcguuguccuca

SEQ ID NO: 3253999 - RNA, 15 nt, Human
gccuugucacgccag

SEQ ID NO: 3254000 - RNA, 16 nt, Human
gccuugucacgccaga

SEQ ID NO: 3254001 - RNA, 17 nt, Human
gccuugucacgccagac

SEQ ID NO: 3254002 - RNA, 14 nt, Human
gcugauuguauuua

SEQ ID NO: 3254003 - RNA, 22 nt, Human
gcugggcuuggcagcccggguc

SEQ ID NO: 3254004 - RNA, 21 nt, Human
gcugggaggagggcaggcauc

SEQ ID NO: 3254005 - RNA, 19 nt, Human
gcugggaggagggcaggca

SEQ ID NO: 3254006 - RNA, 14 nt, Human
gcuggggaugucuc

SEQ ID NO: 3254007 - RNA, 19 nt, Human
gcuguggccuaaccugccg

SEQ ID NO: 3254008 - RNA, 20 nt, Human
gcuguggccuaaccugccga

SEQ ID NO: 3254009 - RNA, 21 nt, Human
gcaggcaucggggagccggga

SEQ ID NO: 3254010 - RNA, 22 nt, Human
gcaggcaucggggagccgggag

SEQ ID NO: 3254011 - RNA, 23 nt, Human
gcaggcaucggggagccgggagc

SEQ ID NO: 3254012 - RNA, 15 nt, Human
gccacgauugcagga

SEQ ID NO: 3254013 - RNA, 16 nt, Human
gccaccugaauaaaga

SEQ ID NO: 3254014 - RNA, 13 nt, Human
gaggagggcaggc

SEQ ID NO: 3254015 - RNA, 14 nt, Human
gaggagggcaggca

SEQ ID NO: 3254016 - RNA, 15 nt, Human
gaggagggcaggcau

SEQ ID NO: 3254017 - RNA, 15 nt, Human
gaggaugucugggcc

SEQ ID NO: 3254018 - RNA, 23 nt, Human
gagcucaggaaccgaggcaggga

SEQ ID NO: 3254019 - RNA, 22 nt, Human
gagcucaggaaccgaggcaggg

SEQ ID NO: 3254020 - RNA, 22 nt, Human
gagguuuguuuagaagaagugu

SEQ ID NO: 3254021 - RNA, 16 nt, Human
gagucccugccuggac

SEQ ID NO: 3254022 - RNA, 14 nt, Human
gagucccugccugg

SEQ ID NO: 3254023 - RNA, 15 nt, Human
gagucccugccugga

SEQ ID NO: 3254024 - RNA, 14 nt, Human
gagucccugccauc

SEQ ID NO: 3254025 - RNA, 20 nt, Human
gauggcaaagaaggagagca

SEQ ID NO: 3254026 - RNA, 21 nt, Human
gauguguccugauaagcugag

SEQ ID NO: 3254027 - RNA, 12 nt, Human
cugagcaggugu

SEQ ID NO: 3254028 - RNA, 14 nt, Human
cucugcccgggagc

SEQ ID NO: 3254029 - RNA, 20 nt, Human
cucugcccgggagcucagga

SEQ ID NO: 3254030 - RNA, 13 nt, Human
cugauuguauuua

SEQ ID NO: 3254031 - RNA, 17 nt, Human
cugccuggaccagccuc

SEQ ID NO: 3254032 - RNA, 21 nt, Human
cucgagaucccaacacugcca

SEQ ID NO: 3254033 - RNA, 22 nt, Human
cucgagaucccaacacugccag

SEQ ID NO: 3254034 - RNA, 23 nt, Human
cucgagaucccaacacugccagc

SEQ ID NO: 3254035 - RNA, 13 nt, Human
cucgagaucccaa

SEQ ID NO: 3254036 - RNA, 14 nt, Human
cuauuguagagcca

SEQ ID NO: 3254037 - RNA, 13 nt, Human
cuuucccaacacc

SEQ ID NO: 3254038 - RNA, 17 nt, Human
cuuucccaacaccucuu

SEQ ID NO: 3254039 - RNA, 13 nt, Human
gaacuauuagagc

SEQ ID NO: 3254040 - RNA, 19 nt, Human
gaaggaucccaugagcucc

SEQ ID NO: 3254041 - RNA, 14 nt, Human
gaaugccuccugca

SEQ ID NO: 3254042 - RNA, 17 nt, Human
gaauaaagaaugaaugg

SEQ ID NO: 3254043 - RNA, 20 nt, Human
gaauaagugccaggauggaa

SEQ ID NO: 3254044 - RNA, 19 nt, Human
cuuccaaacaggcucagag

SEQ ID NO: 3254045 - RNA, 15 nt, Human
cuuaaggcucuuuug

SEQ ID NO: 3254046 - RNA, 14 nt, Human
cuggugguggcucg

SEQ ID NO: 3254047 - RNA, 22 nt, Human
cuggugguggcucgggaggcga

SEQ ID NO: 3254048 - RNA, 18 nt, Human
cuguggccuaaccugccg

SEQ ID NO: 3254049 - RNA, 18 nt, Human
cuguguguguguaugugg

SEQ ID NO: 3254050 - RNA, 20 nt, Human
cuguguguguguaugugggg

SEQ ID NO: 3254051 - RNA, 18 nt, Human
cuguguguuuaugugugu

SEQ ID NO: 3254052 - RNA, 20 nt, Human
cuguguguuuaugugugugu

SEQ ID NO: 3254053 - RNA, 15 nt, Human
cuguguguguguaug

SEQ ID NO: 3254054 - RNA, 16 nt, Human
cuguguguguguaugu

SEQ ID NO: 3254055 - RNA, 14 nt, Human
cuguguguguguau

SEQ ID NO: 3254056 - RNA, 16 nt, Human
ccuaggcuaggguggg

SEQ ID NO: 3254057 - RNA, 15 nt, Human
ccgaggcagggaagg

SEQ ID NO: 3254058 - RNA, 20 nt, Human
ccgggacaccuaggcuaggg

SEQ ID NO: 3254059 - RNA, 19 nt, Human
ccgggacaccuaggcuagg

SEQ ID NO: 3254060 - RNA, 22 nt, Human
ccgggucaucuguaccucugcc

SEQ ID NO: 3254061 - RNA, 18 nt, Human
ccucuccacucaugugac

SEQ ID NO: 3254062 - RNA, 18 nt, Human
ccucucauuccagaggaa

SEQ ID NO: 3254063 - RNA, 15 nt, Human
ccuugucacgccaga

SEQ ID NO: 3254064 - RNA, 18 nt, Human
ccuugucacgccagacuu

SEQ ID NO: 3254065 - RNA, 16 nt, Human
ccuuaaggcucuuuug

SEQ ID NO: 3254066 - RNA, 18 nt, Human
ccuuaaggcucuuuugua

SEQ ID NO: 3254067 - RNA, 13 nt, Human
ccuuaaggcucuu

SEQ ID NO: 3254068 - RNA, 15 nt, Human
cgagaucccaacacu

SEQ ID NO: 3254069 - RNA, 21 nt, Human
cgagaucccaacacugccagc

SEQ ID NO: 3254070 - RNA, 13 nt, Human
cgagaucccaaca

SEQ ID NO: 3254071 - RNA, 22 nt, Human
cgagaucccaacacugccagca

SEQ ID NO: 3254072 - RNA, 14 nt, Human
ccugggcaggaggg

SEQ ID NO: 3254073 - RNA, 12 nt, Human
ccugggcaggag

SEQ ID NO: 3254074 - RNA, 19 nt, Human
ccugaggaagagggacugu

SEQ ID NO: 3254075 - RNA, 19 nt, Human
ccacucaugugacucuuuc

SEQ ID NO: 3254076 - RNA, 22 nt, Human
ccacucaugugacucuuuccaa

SEQ ID NO: 3254077 - RNA, 20 nt, Human
ccaccugaauaaagaaugaa

SEQ ID NO: 3254078 - RNA, 16 nt, Human
ccagcauuucccuucc

SEQ ID NO: 3254079 - RNA, 21 nt, Human
ccagcauuucccuuccuuccu

SEQ ID NO: 3254080 - RNA, 18 nt, Human
ccauccuacccccugugc

SEQ ID NO: 3254081 - RNA, 17 nt, Human
ccauccuacccccugug

SEQ ID NO: 3254082 - RNA, 13 nt, Human
ccaggagacaggu

SEQ ID NO: 3254083 - RNA, 19 nt, Human
caugaguuggcugggaaua

SEQ ID NO: 3254084 - RNA, 23 nt, Human
caugagcuccuuaaggcucuuuu

SEQ ID NO: 3254085 - RNA, 18 nt, Human
cauccuacccccugugcc

SEQ ID NO: 3254086 - RNA, 15 nt, Human
cauccuacccccugu

SEQ ID NO: 3254087 - RNA, 19 nt, Human
caucauguuuacagaggac

SEQ ID NO: 3254088 - RNA, 21 nt, Human
caucauguuuacagaggacag

SEQ ID NO: 3254089 - RNA, 13 nt, Human
caucauguuuaca

SEQ ID NO: 3254090 - RNA, 18 nt, Human
cauccagagucccugccu

SEQ ID NO: 3254091 - RNA, 20 nt, Human
cauccagagucccugccugg

SEQ ID NO: 3254092 - RNA, 13 nt, Human
cauccagaguccc

SEQ ID NO: 3254093 - RNA, 17 nt, Human
cauccagagucccugcc

SEQ ID NO: 3254094 - RNA, 16 nt, Human
caugugacucuuucca

SEQ ID NO: 3254095 - RNA, 17 nt, Human
caugugacucuuuccaa

SEQ ID NO: 3254096 - RNA, 14 nt, Human
caugugacucuuuc

SEQ ID NO: 3254097 - RNA, 14 nt, Human
cauucuuucccaac

SEQ ID NO: 3254098 - RNA, 12 nt, Human
cauucuuuccca

SEQ ID NO: 3254099 - RNA, 14 nt, Human
cauuccagaggaag

SEQ ID NO: 3254100 - RNA, 13 nt, Human
cauuccagaggaa

SEQ ID NO: 3254101 - RNA, 21 nt, Human
uuuuauuuuucucaugaugag

SEQ ID NO: 3254102 - RNA, 21 nt, Human
uuccugaggaagagggacugu

SEQ ID NO: 3254103 - RNA, 19 nt, Human
uuuccaaccggcuuugugg

SEQ ID NO: 3254104 - RNA, 18 nt, Human
ugggaggagggcaggcau

SEQ ID NO: 3254105 - RNA, 13 nt, Human
ugggaguguguaa

SEQ ID NO: 3254106 - RNA, 14 nt, Human
ugggaggagggcag

SEQ ID NO: 3254107 - RNA, 17 nt, Human
ugggaggagggcaggca

SEQ ID NO: 3254108 - RNA, 23 nt, Human
uggccuaaccugccgagagucca

SEQ ID NO: 3254109 - RNA, 16 nt, Human
uggccuaaccugccga

SEQ ID NO: 3254110 - RNA, 17 nt, Human
uguaaauuuaugugaug

SEQ ID NO: 3254111 - RNA, 13 nt, Human
uguccucagcccc

SEQ ID NO: 3254112 - RNA, 18 nt, Human
uguccugcaccggggccu

SEQ ID NO: 3254113 - RNA, 21 nt, Human
ugacccucaucuuucuuccaa

SEQ ID NO: 3254114 - RNA, 14 nt, Human
ugaguuggcuggga

SEQ ID NO: 3254115 - RNA, 16 nt, Human
ugaguuggcugggaau

SEQ ID NO: 3254116 - RNA, 17 nt, Human
ugaguuggcugggaaua

SEQ ID NO: 3254117 - RNA, 18 nt, Human
ugcccgggagcucaggaa

SEQ ID NO: 3254118 - RNA, 17 nt, Human
ugcccgggagcucagga

SEQ ID NO: 3254119 - RNA, 22 nt, Human
ugccaucauguuuacagaggac

SEQ ID NO: 3254120 - RNA, 21 nt, Human
ugcauuauauuuguaaauuua

SEQ ID NO: 3254121 - RNA, 18 nt, Human
ugauuuuuaugccaccug

SEQ ID NO: 3254122 - RNA, 16 nt, Human
ucccuccucugcccgg

SEQ ID NO: 3254123 - RNA, 21 nt, Human
ucccgggacaccuaggcuagg

SEQ ID NO: 3254124 - RNA, 13 nt, Human
ucccugccuggac

SEQ ID NO: 3254125 - RNA, 16 nt, Human
ucccuuccuuccucuc

SEQ ID NO: 3254126 - RNA, 19 nt, Human
ucccuuccuuccucuccug

SEQ ID NO: 3254127 - RNA, 14 nt, Human
ucgugucuggcaca

SEQ ID NO: 3254128 - RNA, 21 nt, Human
ucgugucuggcacagccuggc

SEQ ID NO: 3254129 - RNA, 15 nt, Human
ucugccaggagacag

SEQ ID NO: 3254130 - RNA, 19 nt, Human
ucagaggguguccugcacc

SEQ ID NO: 3254131 - RNA, 14 nt, Human
ucauuccagaggaa

SEQ ID NO: 3254132 - RNA, 12 nt, Human
uauucccaugag

SEQ ID NO: 3254133 - RNA, 16 nt, Human
caccccgacuuuuguu

SEQ ID NO: 3254134 - RNA, 18 nt, Human
aguucauaaauuuauggu

SEQ ID NO: 3254135 - RNA, 16 nt, Human
aguggcuggaucugug

SEQ ID NO: 3254136 - RNA, 19 nt, Human
augagcuccuuaaggcucu

SEQ ID NO: 3254137 - RNA, 14 nt, Human
aucagccugugcca

SEQ ID NO: 3254138 - RNA, 17 nt, Human
aggggccgggggcaguc

SEQ ID NO: 3254139 - RNA, 21 nt, Human
aggagucccugccaucauguu

SEQ ID NO: 3254140 - RNA, 14 nt, Human
agcugcuccccacg

SEQ ID NO: 3254141 - RNA, 17 nt, Human
agcugcuccccacguca

SEQ ID NO: 3254142 - RNA, 14 nt, Human
agcugagcaggugu

SEQ ID NO: 3254143 - RNA, 18 nt, Human
agcuccuuaaggcucuuu

SEQ ID NO: 3254144 - RNA, 22 nt, Human
agcuccuuaaggcucuuuugua

SEQ ID NO: 3254145 - RNA, 20 nt, Human
agaggacaguauuugugggg

SEQ ID NO: 3254146 - RNA, 14 nt, Human
agccgggagccuga

SEQ ID NO: 3254147 - RNA, 13 nt, Human
acccccugugccu

SEQ ID NO: 3254148 - RNA, 12 nt, Human
acugccagcauu

SEQ ID NO: 3254149 - RNA, 16 nt, Human
accugccgagagucca

SEQ ID NO: 3254150 - RNA, 23 nt, Human
accugccgagaguccaucagccu

SEQ ID NO: 3254151 - RNA, 13 nt, Human
aaugucaguaugu

SEQ ID NO: 3254152 - RNA, 15 nt, Human
aaugucaguaugugg

SEQ ID NO: 3254153 - RNA, 18 nt, Human
aauucuuugaccuguugg

SEQ ID NO: 3254154 - RNA, 22 nt, Human
aauucuuugaccuguugggagu

SEQ ID NO: 3254155 - RNA, 14 nt, Human
uauguguguguguu

SEQ ID NO: 3254156 - RNA, 22 nt, Human
uauguguguguguugugugugg

SEQ ID NO: 3254157 - RNA, 11 nt, Human
uaugugugugu

SEQ ID NO: 3254158 - RNA, 21 nt, Human
acagacacucccacuuggcau

SEQ ID NO: 3254159 - RNA, 17 nt, Human
uauggggauagaugugu

SEQ ID NO: 3254160 - RNA, 18 nt, Human
uauggggauagaugugug

SEQ ID NO: 3254161 - RNA, 12 nt, Human
acagccuggcug

SEQ ID NO: 3254162 - RNA, 13 nt, Human
uaguucugccagg

SEQ ID NO: 3254163 - RNA, 14 nt, Human
uaguucugccagga

SEQ ID NO: 3254164 - RNA, 23 nt, Human
acaccuaggcuaggguggggaga

SEQ ID NO: 3254165 - RNA, 20 nt, Human
acaccuaggcuagggugggg

SEQ ID NO: 3254166 - RNA, 13 nt, Human
guguguguaugug

SEQ ID NO: 3254167 - RNA, 16 nt, Human
gugugugggagugugu

SEQ ID NO: 3254168 - RNA, 17 nt, Human
guguguguugugugugg

SEQ ID NO: 3254169 - RNA, 14 nt, Human
guguguguaugugg

SEQ ID NO: 3254170 - RNA, 15 nt, Human
guguuguguguggga

SEQ ID NO: 3254171 - RNA, 15 nt, Human
gugggggucugugug

SEQ ID NO: 3254172 - RNA, 16 nt, Human
gugggggucugugugu

SEQ ID NO: 3254173 - RNA, 14 nt, Human
gugggggucugugu

SEQ ID NO: 3254174 - RNA, 17 nt, Human
guggcacuggggcaggg

SEQ ID NO: 3254175 - RNA, 18 nt, Human
guggcacuggggcagggg

SEQ ID NO: 3254176 - RNA, 15 nt, Human
guccugcaccggggc

SEQ ID NO: 3254177 - RNA, 19 nt, Human
guccugcaccggggccugg

SEQ ID NO: 3254178 - RNA, 20 nt, Human
guccugcaccggggccuggg

SEQ ID NO: 3254179 - RNA, 16 nt, Human
guguuuaugugugugu

SEQ ID NO: 3254180 - RNA, 12 nt, Human
guguuuaugugu

SEQ ID NO: 3254181 - RNA, 14 nt, Human
guugggagaauguc

SEQ ID NO: 3254182 - RNA, 21 nt, Human
guugggagaaugucaguaugu

SEQ ID NO: 3254183 - RNA, 21 nt, Human
uccugcaccggggccugggca

SEQ ID NO: 3254184 - RNA, 20 nt, Human
uccugcaccggggccugggc

SEQ ID NO: 3254185 - RNA, 19 nt, Human
uccugcaccggggccuggg

SEQ ID NO: 3254186 - RNA, 22 nt, Human
ucgagaucccaacacugccagc

SEQ ID NO: 3254187 - RNA, 23 nt, Human
ucgagaucccaacacugccagca

SEQ ID NO: 3254188 - RNA, 14 nt, Human
acuggggcaggggc

SEQ ID NO: 3254189 - RNA, 11 nt, Human
uccucagcccc

SEQ ID NO: 3254190 - RNA, 17 nt, Human
acucaugugacucuuuc

SEQ ID NO: 3254191 - RNA, 15 nt, Human
acucaugugacucuu

SEQ ID NO: 3254192 - RNA, 16 nt, Human
acucaugugacucuuu

SEQ ID NO: 3254193 - RNA, 15 nt, Human
ucaggccgaaggagg

SEQ ID NO: 3254194 - RNA, 17 nt, Human
ucaggaaccgaggcagg

SEQ ID NO: 3254195 - RNA, 18 nt, Human
ucaggaaccgaggcaggg

SEQ ID NO: 3254196 - RNA, 16 nt, Human
ucagccccgcguggaa

SEQ ID NO: 3254197 - RNA, 22 nt, Human
acccagcuaugguucucucgca

SEQ ID NO: 3254198 - RNA, 22 nt, Human
ucagauuugccuuauuggcagc

SEQ ID NO: 3254199 - RNA, 20 nt, Human
accagagaaaaagggagggg

SEQ ID NO: 3254200 - RNA, 18 nt, Human
accagagaaaaagggagg

SEQ ID NO: 3254201 - RNA, 22 nt, Human
ucaugauagaaggcuaugggga

SEQ ID NO: 3254202 - RNA, 18 nt, Human
accugaauaaagaaugaa

SEQ ID NO: 3254203 - RNA, 11 nt, Human
ucuggcccuau

SEQ ID NO: 3254204 - RNA, 14 nt, Human
agacuuaucaacau

SEQ ID NO: 3254205 - RNA, 17 nt, Human
ugaggaagagggacugu

SEQ ID NO: 3254206 - RNA, 22 nt, Human
ugagggugacuauggagcugag

SEQ ID NO: 3254207 - RNA, 18 nt, Human
auaaucacaacccuucag

SEQ ID NO: 3254208 - RNA, 12 nt, Human
uuaugugugugu

SEQ ID NO: 3254209 - RNA, 14 nt, Human
uuaugugugugugu

SEQ ID NO: 3254210 - RNA, 10 nt, Human
uuaugugugu

SEQ ID NO: 3254211 - RNA, 19 nt, Human
auagaaggcuauggggaua

SEQ ID NO: 3254212 - RNA, 14 nt, Human
auagauguguggac

SEQ ID NO: 3254213 - RNA, 12 nt, Human
auagaugugugg

SEQ ID NO: 3254214 - RNA, 13 nt, Human
auagaugugugga

SEQ ID NO: 3254215 - RNA, 11 nt, Human
auagaugugug

SEQ ID NO: 3254216 - RNA, 14 nt, Human
aguauuugugggga

SEQ ID NO: 3254217 - RNA, 16 nt, Human
aguccaucagccucca

SEQ ID NO: 3254218 - RNA, 20 nt, Human
uguagugauuuuuaugccac

SEQ ID NO: 3254219 - RNA, 18 nt, Human
agugccaggauggaauga

SEQ ID NO: 3254220 - RNA, 14 nt, Human
agugaggaugucug

SEQ ID NO: 3254221 - RNA, 16 nt, Human
agugauuuuuaugcca

SEQ ID NO: 3254222 - RNA, 20 nt, Human
agugauuuuuaugccaccug

SEQ ID NO: 3254223 - RNA, 21 nt, Human
agugauuuuuaugccaccuga

SEQ ID NO: 3254224 - RNA, 9 nt, Human
aguguguaa

SEQ ID NO: 3254225 - RNA, 18 nt, Human
uguguguuguguguggga

SEQ ID NO: 3254226 - RNA, 16 nt, Human
agugggguagguuggg

SEQ ID NO: 3254227 - RNA, 20 nt, Human
uggcuguggccuaaccugcc

SEQ ID NO: 3254228 - RNA, 17 nt, Human
uggcuguggcauccaga

SEQ ID NO: 3254229 - RNA, 13 nt, Human
uggaagugugggu

SEQ ID NO: 3254230 - RNA, 14 nt, Human
uggaaguguggguc

SEQ ID NO: 3254231 - RNA, 16 nt, Human
aggccugacucucagc

SEQ ID NO: 3254232 - RNA, 21 nt, Human
uggcauccagagucccugccu

SEQ ID NO: 3254233 - RNA, 22 nt, Human
uggcauccagagucccugccug

SEQ ID NO: 3254234 - RNA, 20 nt, Human
uggcauccagagucccugcc

SEQ ID NO: 3254235 - RNA, 22 nt, Human
uggcacagccuggcuguggccu

SEQ ID NO: 3254236 - RNA, 14 nt, Human
aggccauucuuucc

SEQ ID NO: 3254237 - RNA, 18 nt, Human
aggcgaagcguuguccuc

SEQ ID NO: 3254238 - RNA, 18 nt, Human
aggcucagaggguguccu

SEQ ID NO: 3254239 - RNA, 19 nt, Human
aggcucagaggguguccug

SEQ ID NO: 3254240 - RNA, 20 nt, Human
aggcucagaggguguccugc

SEQ ID NO: 3254241 - RNA, 19 nt, Human
ugccuugugaaggaauuau

SEQ ID NO: 3254242 - RNA, 17 nt, Human
ugccuugucacgccaga

SEQ ID NO: 3254243 - RNA, 15 nt, Human
agcuggggaugucuc

SEQ ID NO: 3254244 - RNA, 19 nt, Human
agccugacccucaucuuuc

SEQ ID NO: 3254245 - RNA, 18 nt, Human
agccugacccucaucuuu

SEQ ID NO: 3254246 - RNA, 12 nt, Human
auuccagaggaa

SEQ ID NO: 3254247 - RNA, 12 nt, Human
auuuuucucaug

SEQ ID NO: 3254248 - RNA, 19 nt, Human
auuuguaaauuuaugugau

SEQ ID NO: 3254249 - RNA, 18 nt, Human
auuuguaaauuuauguga

SEQ ID NO: 3254250 - RNA, 16 nt, Human
auuucccuuccuuccu

SEQ ID NO: 3254251 - RNA, 20 nt, Human
uugcuaugagcuggggaugu

SEQ ID NO: 3254252 - RNA, 19 nt, Human
auccauagcaccuccacau

SEQ ID NO: 3254253 - RNA, 13 nt, Human
uucugccaggaga

SEQ ID NO: 3254254 - RNA, 14 nt, Human
auccuacccccugu

SEQ ID NO: 3254255 - RNA, 16 nt, Human
auccuacccccugugc

SEQ ID NO: 3254256 - RNA, 13 nt, Human
aucaggccauugu

SEQ ID NO: 3254257 - RNA, 16 nt, Human
aucaggccauuguccc

SEQ ID NO: 3254258 - RNA, 20 nt, Human
auggggauagauguguggac

SEQ ID NO: 3254259 - RNA, 16 nt, Human
augguucucaggccug

SEQ ID NO: 3254260 - RNA, 16 nt, Human
augucaguauguggaa

SEQ ID NO: 3254261 - RNA, 21 nt, Human
augugacucuuuccaaccggc

SEQ ID NO: 3254262 - RNA, 12 nt, Human
augugacucuuu

SEQ ID NO: 3254263 - RNA, 16 nt, Human
augugacucuuuccaa

SEQ ID NO: 3254264 - RNA, 22 nt, Human
gcuaauucuuugaccuguuggg

SEQ ID NO: 3254265 - RNA, 20 nt, Human
gcucaggaaccgaggcaggg

SEQ ID NO: 3254266 - RNA, 21 nt, Human
gcucaggaaccgaggcaggga

SEQ ID NO: 3254267 - RNA, 16 nt, Human
gcucaggaaccgaggc

SEQ ID NO: 3254268 - RNA, 19 nt, Human
gcucaggaaccgaggcagg

SEQ ID NO: 3254269 - RNA, 23 nt, Human
gccuccauccuacccccugugcc

SEQ ID NO: 3254270 - RNA, 21 nt, Human
ggaagugugggucugugugug

SEQ ID NO: 3254271 - RNA, 22 nt, Human
ggaagugugggucugugugugu

SEQ ID NO: 3254272 - RNA, 12 nt, Human
ggaagugugggu

SEQ ID NO: 3254273 - RNA, 15 nt, Human
ggaacugcugggcuu

SEQ ID NO: 3254274 - RNA, 20 nt, Human
ggaacugcugggcuuggcag

SEQ ID NO: 3254275 - RNA, 16 nt, Human
gcuucuaguucugcca

SEQ ID NO: 3254276 - RNA, 17 nt, Human
gcuucuaguucugccag

SEQ ID NO: 3254277 - RNA, 23 nt, Human
guaauuuaaaauugugauguguc

SEQ ID NO: 3254278 - RNA, 19 nt, Human
guaauuuaaaauugugaug

SEQ ID NO: 3254279 - RNA, 20 nt, Human
guaauuuaaaauugugaugu

SEQ ID NO: 3254280 - RNA, 15 nt, Human
guagagccagagguc

SEQ ID NO: 3254281 - RNA, 17 nt, Human
ggggccgggggcagucu

SEQ ID NO: 3254282 - RNA, 18 nt, Human
gggggcgcggcugggagg

SEQ ID NO: 3254283 - RNA, 13 nt, Human
ggguggggagaga

SEQ ID NO: 3254284 - RNA, 14 nt, Human
ggguggggagagac

SEQ ID NO: 3254285 - RNA, 18 nt, Human
ggguggggagagacgggc

SEQ ID NO: 3254286 - RNA, 22 nt, Human
ggugcuucuaguucugccagga

SEQ ID NO: 3254287 - RNA, 15 nt, Human
ggcacuggggcaggg

SEQ ID NO: 3254288 - RNA, 15 nt, Human
ggcagggcugaggcc

SEQ ID NO: 3254289 - RNA, 22 nt, Human
gggacaccuaggcuaggguggg

SEQ ID NO: 3254290 - RNA, 20 nt, Human
ggcucagaggguguccugca

SEQ ID NO: 3254291 - RNA, 14 nt, Human
ggcucagagugggg

SEQ ID NO: 3254292 - RNA, 15 nt, Human
gacccucaucuuucu

SEQ ID NO: 3254293 - RNA, 19 nt, Human
gacccucaucuuucuucca

SEQ ID NO: 3254294 - RNA, 15 nt, Human
gacuauggagcugag

SEQ ID NO: 3254295 - RNA, 18 nt, Human
gcauuucccuuccuuccu

SEQ ID NO: 3254296 - RNA, 15 nt, Human
cuuaggccagcacca

SEQ ID NO: 3254297 - RNA, 20 nt, Human
cugugccuugucacgccaga

SEQ ID NO: 3254298 - RNA, 16 nt, Human
cugugccuuuugccau

SEQ ID NO: 3254299 - RNA, 16 nt, Human
cuggggaugucucuca

SEQ ID NO: 3254300 - RNA, 18 nt, Human
cugggaauaagugccagg

SEQ ID NO: 3254301 - RNA, 17 nt, Human
cuucuaguucugccagg

SEQ ID NO: 3254302 - RNA, 18 nt, Human
cuucuaguucugccagga

SEQ ID NO: 3254303 - RNA, 16 nt, Human
cuucuaguucugccag

SEQ ID NO: 3254304 - RNA, 19 nt, Human
cuucuaguucugccaggag

SEQ ID NO: 3254305 - RNA, 19 nt, Human
cuuccucuccugucucccu

SEQ ID NO: 3254306 - RNA, 14 nt, Human
cuuugaccuguugg

SEQ ID NO: 3254307 - RNA, 17 nt, Human
cagucugagagaggcca

SEQ ID NO: 3254308 - RNA, 18 nt, Human
cagucugagagaggccau

SEQ ID NO: 3254309 - RNA, 15 nt, Human
caggccugacucuca

SEQ ID NO: 3254310 - RNA, 19 nt, Human
cauccauggggcugauugu

SEQ ID NO: 3254311 - RNA, 14 nt, Human
ccauucuuucccaa

SEQ ID NO: 3254312 - RNA, 20 nt, Human
ccauucuuucccaacaccuc

SEQ ID NO: 3254313 - RNA, 12 nt, Human
ccauucuuuccc

SEQ ID NO: 3254314 - RNA, 18 nt, Human
ccugccaucauguuuaca

SEQ ID NO: 3254315 - RNA, 20 nt, Human
ccugccaucauguuuacaga

SEQ ID NO: 3254316 - RNA, 19 nt, Human
ccugacccucaucuuucuu

SEQ ID NO: 3254317 - RNA, 18 nt, Human
ccugacccucaucuuucu

SEQ ID NO: 3254318 - RNA, 21 nt, Human
ccuggugguggcucgggaggc

SEQ ID NO: 3254319 - RNA, 18 nt, Human
ccuggugguggcucggga

SEQ ID NO: 3254320 - RNA, 21 nt, Human
ccugucucccuccucugcccg

SEQ ID NO: 3254321 - RNA, 15 nt, Human
cuaggcuaggguggg

SEQ ID NO: 3254322 - RNA, 14 nt, Human
cuaguucugccagg

SEQ ID NO: 3254323 - RNA, 15 nt, Human
cuaguucugccagga

SEQ ID NO: 3254324 - RNA, 16 nt, Human
cuaguucugccaggag

SEQ ID NO: 3254325 - RNA, 13 nt, Human
cuaguucugccag

SEQ ID NO: 3254326 - RNA, 15 nt, Human
cuaggguggggagag

SEQ ID NO: 3254327 - RNA, 18 nt, Human
cugaggaagagggacugu

SEQ ID NO: 3254328 - RNA, 23 nt, Human
cugaggaagagggacuguucuuu

SEQ ID NO: 3254329 - RNA, 18 nt, Human
cugacccucaucuuucuu

SEQ ID NO: 3254330 - RNA, 19 nt, Human
cuauggggauagaugugug

SEQ ID NO: 3254331 - RNA, 20 nt, Human
cuauggggauagaugugugg

SEQ ID NO: 3254332 - RNA, 21 nt, Human
cuauggggauagaugugugga

SEQ ID NO: 3254333 - RNA, 22 nt, Human
cuacucuggagguuuguuuaga

SEQ ID NO: 3254334 - RNA, 17 nt, Human
cucagccccgcguggaa

SEQ ID NO: 3254335 - RNA, 16 nt, Human
cucagaggguguccug

SEQ ID NO: 3254336 - RNA, 18 nt, Human
cucaggaaccgaggcagg

SEQ ID NO: 3254337 - RNA, 19 nt, Human
cucaggaaccgaggcaggg

SEQ ID NO: 3254338 - RNA, 17 nt, Human
cucaggaaccgaggcag

SEQ ID NO: 3254339 - RNA, 20 nt, Human
cuccccacgucagcugggac

SEQ ID NO: 3254340 - RNA, 22 nt, Human
cuccacucaugugacucuuucc

SEQ ID NO: 3254341 - RNA, 16 nt, Human
cuccacucaugugacu

SEQ ID NO: 3254342 - RNA, 22 nt, Human
ccugccgagaguccaucagccu

SEQ ID NO: 3254343 - RNA, 23 nt, Human
ccugccgagaguccaucagccuc

SEQ ID NO: 3254344 - RNA, 14 nt, Human
ccugccgagagucc

SEQ ID NO: 3254345 - RNA, 19 nt, Human
ccugaagagaagggcaggg

SEQ ID NO: 3254346 - RNA, 17 nt, Human
ccugcaccggggccugg

SEQ ID NO: 3254347 - RNA, 15 nt, Human
ccugcaccggggccu

SEQ ID NO: 3254348 - RNA, 11 nt, Human
cgcggcuggga

SEQ ID NO: 3254349 - RNA, 12 nt, Human
cgcggcugggag

SEQ ID NO: 3254350 - RNA, 16 nt, Human
cgcggcugggaggagg

SEQ ID NO: 3254351 - RNA, 18 nt, Human
cgggacaccuaggcuagg

SEQ ID NO: 3254352 - RNA, 19 nt, Human
cgggacaccuaggcuaggg

SEQ ID NO: 3254353 - RNA, 17 nt, Human
ccugugccuuuugccau

SEQ ID NO: 3254354 - RNA, 14 nt, Human
ccuuugucccagaa

SEQ ID NO: 3254355 - RNA, 15 nt, Human
cgaagcguuguccuc

SEQ ID NO: 3254356 - RNA, 16 nt, Human
cgaagcguuguccuca

SEQ ID NO: 3254357 - RNA, 17 nt, Human
cgaagcguuguccucag

SEQ ID NO: 3254358 - RNA, 21 nt, Human
cgaagcguuguccucagcccc

SEQ ID NO: 3254359 - RNA, 23 nt, Human
ccguggcuguggcauccagaguc

SEQ ID NO: 3254360 - RNA, 12 nt, Human
ccuaaccugccg

SEQ ID NO: 3254361 - RNA, 13 nt, Human
ccuaaccugccga

SEQ ID NO: 3254362 - RNA, 20 nt, Human
ccgagaguccaucagccucc

SEQ ID NO: 3254363 - RNA, 21 nt, Human
ccgagaguccaucagccucca

SEQ ID NO: 3254364 - RNA, 21 nt, Human
ccgggggcagucugagagagg

SEQ ID NO: 3254365 - RNA, 20 nt, Human
ccggggccugggcaggaggg

SEQ ID NO: 3254366 - RNA, 19 nt, Human
ccggggccugggcaggagg

SEQ ID NO: 3254367 - RNA, 13 nt, Human
cccaugagcuccu

SEQ ID NO: 3254368 - RNA, 14 nt, Human
cccaugagcuccuu

SEQ ID NO: 3254369 - RNA, 15 nt, Human
cccaugagcuccuua

SEQ ID NO: 3254370 - RNA, 22 nt, Human
cccaugagcuccuuaaggcucu

SEQ ID NO: 3254371 - RNA, 14 nt, Human
ccccugugccuugu

SEQ ID NO: 3254372 - RNA, 15 nt, Human
cccaacacugccagc

SEQ ID NO: 3254373 - RNA, 16 nt, Human
cccaacacugccagca

SEQ ID NO: 3254374 - RNA, 14 nt, Human
cccaacacugccag

SEQ ID NO: 3254375 - RNA, 15 nt, Human
cccacgucagcuggg

SEQ ID NO: 3254376 - RNA, 15 nt, Human
cccacggcuccucga

SEQ ID NO: 3254377 - RNA, 21 nt, Human
cuggccaguggcuggaucugu

SEQ ID NO: 3254378 - RNA, 14 nt, Human
cuggaccagccucu

SEQ ID NO: 3254379 - RNA, 18 nt, Human
cuggaccagccucuccac

SEQ ID NO: 3254380 - RNA, 12 nt, Human
cuggagguuugu

SEQ ID NO: 3254381 - RNA, 17 nt, Human
cuggagguuuguuuaga

SEQ ID NO: 3254382 - RNA, 23 nt, Human
cugccgagaguccaucagccucc

SEQ ID NO: 3254383 - RNA, 22 nt, Human
cugccgagaguccaucagccuc

SEQ ID NO: 3254384 - RNA, 11 nt, Human
cugcugggcuu

SEQ ID NO: 3254385 - RNA, 21 nt, Human
cugucucccuccucugcccgg

SEQ ID NO: 3254386 - RNA, 19 nt, Human
cugugaggggcucucucau

SEQ ID NO: 3254387 - RNA, 21 nt, Human
cuguguguguguauguggggg

SEQ ID NO: 3254388 - RNA, 16 nt, Human
cuguguguuuaugugu

SEQ ID NO: 3254389 - RNA, 17 nt, Human
cuguguguuuaugugug

SEQ ID NO: 3254390 - RNA, 14 nt, Human
cuuuguggcacugg

SEQ ID NO: 3254391 - RNA, 16 nt, Human
cuugucacgccagacu

SEQ ID NO: 3254392 - RNA, 13 nt, Human
cuugucacgccag

SEQ ID NO: 3254393 - RNA, 22 nt, Human
cuuucuuccaaacaggcucaga

SEQ ID NO: 3254394 - RNA, 15 nt, Human
gaugggucaguugua

SEQ ID NO: 3254395 - RNA, 21 nt, Human
gaugggucaguuguaucagca

SEQ ID NO: 3254396 - RNA, 23 nt, Human
gauugcaggagucccugccauca

SEQ ID NO: 3254397 - RNA, 15 nt, Human
gcacuggggcagggg

SEQ ID NO: 3254398 - RNA, 18 nt, Human
gcacuggggcaggggccg

SEQ ID NO: 3254399 - RNA, 23 nt, Human
gcacuggggcaggggccgggggc

SEQ ID NO: 3254400 - RNA, 22 nt, Human
gaggccucucauuccagaggaa

SEQ ID NO: 3254401 - RNA, 20 nt, Human
gaggcgaagcguuguccuca

SEQ ID NO: 3254402 - RNA, 21 nt, Human
gaggcgaagcguuguccucag

SEQ ID NO: 3254403 - RNA, 14 nt, Human
gaggcagggaagga

SEQ ID NO: 3254404 - RNA, 14 nt, Human
gagggggagagggc

SEQ ID NO: 3254405 - RNA, 13 nt, Human
gaggguguccugc

SEQ ID NO: 3254406 - RNA, 21 nt, Human
gagucccugccuggaccagcc

SEQ ID NO: 3254407 - RNA, 23 nt, Human
gagucccugccuggaccagccuc

SEQ ID NO: 3254408 - RNA, 19 nt, Human
gagucccugccuggaccag

SEQ ID NO: 3254409 - RNA, 14 nt, Human
gauagaugugugga

SEQ ID NO: 3254410 - RNA, 22 nt, Human
gauagauguguggacacauugg

SEQ ID NO: 3254411 - RNA, 13 nt, Human
gauagaugugugg

SEQ ID NO: 3254412 - RNA, 13 nt, Human
gaguguguaauuu

SEQ ID NO: 3254413 - RNA, 14 nt, Human
gaccagccucucca

SEQ ID NO: 3254414 - RNA, 16 nt, Human
gaaugucaguaugugg

SEQ ID NO: 3254415 - RNA, 18 nt, Human
gaaugucaguauguggaa

SEQ ID NO: 3254416 - RNA, 13 nt, Human
gaaugucaguaug

SEQ ID NO: 3254417 - RNA, 19 nt, Human
gaaugucaguauguggaag

SEQ ID NO: 3254418 - RNA, 13 nt, Human
gagagacgggccc

SEQ ID NO: 3254419 - RNA, 17 nt, Human
gagaaugucaguaugug

SEQ ID NO: 3254420 - RNA, 18 nt, Human
gagaucccaacacugcca

SEQ ID NO: 3254421 - RNA, 19 nt, Human
gagaucccaacacugccag

SEQ ID NO: 3254422 - RNA, 20 nt, Human
gagaucccaacacugccagc

SEQ ID NO: 3254423 - RNA, 23 nt, Human
gcccuggugguggcucgggaggc

SEQ ID NO: 3254424 - RNA, 17 nt, Human
gcuaugagcuggggaug

SEQ ID NO: 3254425 - RNA, 21 nt, Human
gcucagaggguguccugcacc

SEQ ID NO: 3254426 - RNA, 16 nt, Human
ggcgcggcugggagga

SEQ ID NO: 3254427 - RNA, 14 nt, Human
ggccugggcaggag

SEQ ID NO: 3254428 - RNA, 13 nt, Human
ggccugggcagga

SEQ ID NO: 3254429 - RNA, 21 nt, Human
ggcuauggggauagaugugug

SEQ ID NO: 3254430 - RNA, 16 nt, Human
ggcuaggguggggaga

SEQ ID NO: 3254431 - RNA, 21 nt, Human
ggccuaaccugccgagagucc

SEQ ID NO: 3254432 - RNA, 22 nt, Human
ggccuaaccugccgagagucca

SEQ ID NO: 3254433 - RNA, 12 nt, Human
ggcccugugccu

SEQ ID NO: 3254434 - RNA, 17 nt, Human
ggauggaaugauggguc

SEQ ID NO: 3254435 - RNA, 20 nt, Human
ggccauucuuucccaacacc

SEQ ID NO: 3254436 - RNA, 14 nt, Human
gcuuuguggcacug

SEQ ID NO: 3254437 - RNA, 22 nt, Human
gcuuuguggcacuggggcaggg

SEQ ID NO: 3254438 - RNA, 22 nt, Human
ggagaaugucaguauguggaag

SEQ ID NO: 3254439 - RNA, 23 nt, Human
ggaagggacaccaagccuuggcu

SEQ ID NO: 3254440 - RNA, 22 nt, Human
ggaaggaucccaugagcuccuu

SEQ ID NO: 3254441 - RNA, 19 nt, Human
gguugggagaaugucagua

SEQ ID NO: 3254442 - RNA, 14 nt, Human
gggcgcggcuggga

SEQ ID NO: 3254443 - RNA, 18 nt, Human
ggggaguuuagggugggg

SEQ ID NO: 3254444 - RNA, 13 nt, Human
ggggauagaugug

SEQ ID NO: 3254445 - RNA, 23 nt, Human
ggggucuguguguuuaugugugu

SEQ ID NO: 3254446 - RNA, 12 nt, Human
guccucagcccc

SEQ ID NO: 3254447 - RNA, 20 nt, Human
gucccugccuggaccagccu

SEQ ID NO: 3254448 - RNA, 21 nt, Human
gucccugccuggaccagccuc

SEQ ID NO: 3254449 - RNA, 14 nt, Human
gucccugccuggac

SEQ ID NO: 3254450 - RNA, 22 nt, Human
gucccugccuggaccagccucu

SEQ ID NO: 3254451 - RNA, 23 nt, Human
gucccugccuggaccagccucuc

SEQ ID NO: 3254452 - RNA, 14 nt, Human
gucacgccagacuu

SEQ ID NO: 3254453 - RNA, 20 nt, Human
gucccagaaugccuccugca

SEQ ID NO: 3254454 - RNA, 14 nt, Human
guggcauccagagu

SEQ ID NO: 3254455 - RNA, 16 nt, Human
guggcucgggaggcga

SEQ ID NO: 3254456 - RNA, 18 nt, Human
guggcucgggaggcgaag

SEQ ID NO: 3254457 - RNA, 21 nt, Human
gugcuucuaguucugccagga

SEQ ID NO: 3254458 - RNA, 22 nt, Human
gugcuucuaguucugccaggag

SEQ ID NO: 3254459 - RNA, 20 nt, Human
gugcuucuaguucugccagg

SEQ ID NO: 3254460 - RNA, 19 nt, Human
gugccuugucacgccagac

SEQ ID NO: 3254461 - RNA, 12 nt, Human
gugacucuuucc

SEQ ID NO: 3254462 - RNA, 15 nt, Human
gugaggaugucuggg

SEQ ID NO: 3254463 - RNA, 16 nt, Human
gugauuuuuaugccac

SEQ ID NO: 3254464 - RNA, 17 nt, Human
gugauuuuuaugccacc

SEQ ID NO: 3254465 - RNA, 19 nt, Human
gugauuuuuaugccaccug

SEQ ID NO: 3254466 - RNA, 20 nt, Human
gugauuuuuaugccaccuga

SEQ ID NO: 3254467 - RNA, 20 nt, Human
uggcuccauugguguugaca

SEQ ID NO: 3254468 - RNA, 15 nt, Human
uggaccagccucucc

SEQ ID NO: 3254469 - RNA, 15 nt, Human
uggaucugugagggg

SEQ ID NO: 3254470 - RNA, 19 nt, Human
uggaucugugaggggcucu

SEQ ID NO: 3254471 - RNA, 14 nt, Human
ugggggucugugug

SEQ ID NO: 3254472 - RNA, 16 nt, Human
uggggauagaugugug

SEQ ID NO: 3254473 - RNA, 17 nt, Human
uggggauagaugugugg

SEQ ID NO: 3254474 - RNA, 18 nt, Human
uggggauagaugugugga

SEQ ID NO: 3254475 - RNA, 20 nt, Human
uggggauagauguguggaca

SEQ ID NO: 3254476 - RNA, 20 nt, Human
uggggaguuuaggguggggg

SEQ ID NO: 3254477 - RNA, 11 nt, Human
ugggagugugu

SEQ ID NO: 3254478 - RNA, 22 nt, Human
ugggagugaggaugucugggcc

SEQ ID NO: 3254479 - RNA, 13 nt, Human
ugggcaggaggga

SEQ ID NO: 3254480 - RNA, 15 nt, Human
ugggcaggagggagg

SEQ ID NO: 3254481 - RNA, 16 nt, Human
ugggcaggagggaggu

SEQ ID NO: 3254482 - RNA, 18 nt, Human
ugggcaggagggaggugc

SEQ ID NO: 3254483 - RNA, 17 nt, Human
ugacauacauccaacau

SEQ ID NO: 3254484 - RNA, 20 nt, Human
ugagcuggggaugucucuca

SEQ ID NO: 3254485 - RNA, 19 nt, Human
ugagcuccuuaaggcucuu

SEQ ID NO: 3254486 - RNA, 21 nt, Human
ugagcuccuuaaggcucuuuu

SEQ ID NO: 3254487 - RNA, 19 nt, Human
uccagagucccugccugga

SEQ ID NO: 3254488 - RNA, 20 nt, Human
uccagagucccugccuggac

SEQ ID NO: 3254489 - RNA, 21 nt, Human
uccagagucccugccuggacc

SEQ ID NO: 3254490 - RNA, 15 nt, Human
uccagagucccugcc

SEQ ID NO: 3254491 - RNA, 18 nt, Human
uccagagucccugccugg

SEQ ID NO: 3254492 - RNA, 22 nt, Human
ucagucuuuaaucugagaggcc

SEQ ID NO: 3254493 - RNA, 14 nt, Human
uccaaacaggcuca

SEQ ID NO: 3254494 - RNA, 13 nt, Human
uccuacccccugu

SEQ ID NO: 3254495 - RNA, 15 nt, Human
uccuacccccugugc

SEQ ID NO: 3254496 - RNA, 16 nt, Human
uccuacccccugugcc

SEQ ID NO: 3254497 - RNA, 17 nt, Human
uccuacccccugugccu

SEQ ID NO: 3254498 - RNA, 15 nt, Human
uccugucucccuccu

SEQ ID NO: 3254499 - RNA, 23 nt, Human
uccugucucccuccucugcccgg

SEQ ID NO: 3254500 - RNA, 15 nt, Human
uaggcuagggugggg

SEQ ID NO: 3254501 - RNA, 16 nt, Human
uaggcuagggugggga

SEQ ID NO: 3254502 - RNA, 23 nt, Human
uaugagcuggggaugucucucau

SEQ ID NO: 3254503 - RNA, 23 nt, Human
uauguguguguguuguguguggg

SEQ ID NO: 3254504 - RNA, 11 nt, Human
uuuguggggag

SEQ ID NO: 3254505 - RNA, 12 nt, Human
uuaacucagucu

SEQ ID NO: 3254506 - RNA, 16 nt, Human
uguuuagaagaagugu

SEQ ID NO: 3254507 - RNA, 19 nt, Human
uguuuagaagaaguguguc

SEQ ID NO: 3254508 - RNA, 13 nt, Human
uuaugccaccuga

SEQ ID NO: 3254509 - RNA, 16 nt, Human
uuaugccaccugaaua

SEQ ID NO: 3254510 - RNA, 16 nt, Human
uuuaaaauugugaugu

SEQ ID NO: 3254511 - RNA, 15 nt, Human
uuguuuagaagaagu

SEQ ID NO: 3254512 - RNA, 18 nt, Human
uuguuuagaagaagugug

SEQ ID NO: 3254513 - RNA, 20 nt, Human
uuuacagaggacaguauuug

SEQ ID NO: 3254514 - RNA, 14 nt, Human
uuuaugccaccuga

SEQ ID NO: 3254515 - RNA, 16 nt, Human
uuggcagcucuacucu

SEQ ID NO: 3254516 - RNA, 23 nt, Human
cugccaucauguuuacagaggac

SEQ ID NO: 3254517 - RNA, 17 nt, Human
cugccaucauguuuaca

SEQ ID NO: 3254518 - RNA, 22 nt, Human
cugccaucauguuuacagagga

SEQ ID NO: 3254519 - RNA, 17 nt, Human
cuggggaugucucucau

SEQ ID NO: 3254520 - RNA, 22 nt, Human
cuggggaugucucucaugacca

SEQ ID NO: 3254521 - RNA, 18 nt, Human
cuuauuggcagcucuacu

SEQ ID NO: 3254522 - RNA, 16 nt, Human
gacagguuagcugcuc

SEQ ID NO: 3254523 - RNA, 15 nt, Human
gacaguauuuguggg

SEQ ID NO: 3254524 - RNA, 19 nt, Human
gaagugugggucugugugu

SEQ ID NO: 3254525 - RNA, 17 nt, Human
gaagugugggucugugu

SEQ ID NO: 3254526 - RNA, 18 nt, Human
gaagugugggucugugug

SEQ ID NO: 3254527 - RNA, 15 nt, Human
gaaggcuauggggau

SEQ ID NO: 3254528 - RNA, 19 nt, Human
gaagggcagggcugaggcc

SEQ ID NO: 3254529 - RNA, 19 nt, Human
gagcuggggaugucucuca

SEQ ID NO: 3254530 - RNA, 20 nt, Human
gcaccggggccugggcagga

SEQ ID NO: 3254531 - RNA, 19 nt, Human
gcaccggggccugggcagg

SEQ ID NO: 3254532 - RNA, 13 nt, Human
gaguuggcuggga

SEQ ID NO: 3254533 - RNA, 14 nt, Human
gaguuuaggguggg

SEQ ID NO: 3254534 - RNA, 15 nt, Human
gaguuuagggugggg

SEQ ID NO: 3254535 - RNA, 18 nt, Human
gagugaggaugucugggc

SEQ ID NO: 3254536 - RNA, 13 nt, Human
gaguccaucagcc

SEQ ID NO: 3254537 - RNA, 14 nt, Human
gaguccaucagccu

SEQ ID NO: 3254538 - RNA, 15 nt, Human
gaguccaucagccuc

SEQ ID NO: 3254539 - RNA, 16 nt, Human
gaguccaucagccucc

SEQ ID NO: 3254540 - RNA, 12 nt, Human
gaucccaacacu

SEQ ID NO: 3254541 - RNA, 16 nt, Human
gaucccaacacugcca

SEQ ID NO: 3254542 - RNA, 17 nt, Human
gcggcugggaggagggc

SEQ ID NO: 3254543 - RNA, 18 nt, Human
gcggcugggaggagggca

SEQ ID NO: 3254544 - RNA, 19 nt, Human
gcggcugggaggagggcag

SEQ ID NO: 3254545 - RNA, 22 nt, Human
gcggcugggaggagggcaggca

SEQ ID NO: 3254546 - RNA, 13 nt, Human
gcggcugggagga

SEQ ID NO: 3254547 - RNA, 14 nt, Human
gcggcugggaggag

SEQ ID NO: 3254548 - RNA, 14 nt, Human
gccaguggcuggau

SEQ ID NO: 3254549 - RNA, 23 nt, Human
gccaguggcuggaucugugaggg

SEQ ID NO: 3254550 - RNA, 14 nt, Human
gccaggauggaaug

SEQ ID NO: 3254551 - RNA, 19 nt, Human
gcuuuccucaucaggccau

SEQ ID NO: 3254552 - RNA, 20 nt, Human
gcuguagacauuugcuauga

SEQ ID NO: 3254553 - RNA, 14 nt, Human
ggaacugcugggcu

SEQ ID NO: 3254554 - RNA, 18 nt, Human
gcuccucgagaucccaac

SEQ ID NO: 3254555 - RNA, 14 nt, Human
gcugaggccucuca

SEQ ID NO: 3254556 - RNA, 13 nt, Human
gcugcuccccacg

SEQ ID NO: 3254557 - RNA, 22 nt, Human
gcugcuccccacgucagcuggg

SEQ ID NO: 3254558 - RNA, 16 nt, Human
guaaauuuaugugaug

SEQ ID NO: 3254559 - RNA, 17 nt, Human
guaaauuuaugugaugg

SEQ ID NO: 3254560 - RNA, 21 nt, Human
gguggggagagacgggcccug

SEQ ID NO: 3254561 - RNA, 20 nt, Human
ggucuguguguguguaugug

SEQ ID NO: 3254562 - RNA, 21 nt, Human
ggucuguguguguguaugugg

SEQ ID NO: 3254563 - RNA, 21 nt, Human
ggugcuucuaguucugccagg

SEQ ID NO: 3254564 - RNA, 11 nt, Human
ggucugugugu

SEQ ID NO: 3254565 - RNA, 17 nt, Human
ggucuguguguguguau

SEQ ID NO: 3254566 - RNA, 23 nt, Human
ggguguccugcaccggggccugg

SEQ ID NO: 3254567 - RNA, 22 nt, Human
gggcccuggugguggcucggga

SEQ ID NO: 3254568 - RNA, 18 nt, Human
gggcucagagugggguag

SEQ ID NO: 3254569 - RNA, 14 nt, Human
gggaugucucucau

SEQ ID NO: 3254570 - RNA, 22 nt, Human
gggagaaugucaguauguggaa

SEQ ID NO: 3254571 - RNA, 19 nt, Human
gggagaaugucaguaugug

SEQ ID NO: 3254572 - RNA, 14 nt, Human
aaaagggaggggga

SEQ ID NO: 3254573 - RNA, 12 nt, Human
ggcacagccugg

SEQ ID NO: 3254574 - RNA, 13 nt, Human
ggcacagccuggc

SEQ ID NO: 3254575 - RNA, 22 nt, Human
ggcgaagcguuguccucagccc

SEQ ID NO: 3254576 - RNA, 19 nt, Human
ggccaguggcuggaucugu

SEQ ID NO: 3254577 - RNA, 22 nt, Human
ggcauccagagucccugccugg

SEQ ID NO: 3254578 - RNA, 18 nt, Human
ggcauccagagucccugc

SEQ ID NO: 3254579 - RNA, 17 nt, Human
ggcccugugccuuggug

SEQ ID NO: 3254580 - RNA, 15 nt, Human
caguauuugugggga

SEQ ID NO: 3254581 - RNA, 23 nt, Human
cagaucauuaucagccugugcca

SEQ ID NO: 3254582 - RNA, 24 nt, Human
cagccucuccacucaugugacucu

SEQ ID NO: 3254583 - RNA, 24 nt, Human
cagccccgcguggaacucgugucu

SEQ ID NO: 3254584 - RNA, 14 nt, Human
caaacaggcucaga

SEQ ID NO: 3254585 - RNA, 15 nt, Human
caaacaggcucagag

SEQ ID NO: 3254586 - RNA, 16 nt, Human
auuugcuaugagcugg

SEQ ID NO: 3254587 - RNA, 20 nt, Human
auuugcuaugagcuggggau

SEQ ID NO: 3254588 - RNA, 22 nt, Human
auuuguggggagggauuugggg

SEQ ID NO: 3254589 - RNA, 16 nt, Human
auucuuucccaacacc

SEQ ID NO: 3254590 - RNA, 19 nt, Human
auucuuucccaacaccucu

SEQ ID NO: 3254591 - RNA, 13 nt, Human
auucuuucccaac

SEQ ID NO: 3254592 - RNA, 19 nt, Human
cacuggggcaggggccggg

SEQ ID NO: 3254593 - RNA, 18 nt, Human
cacugccagcauuucccu

SEQ ID NO: 3254594 - RNA, 22 nt, Human
cacugccagcauuucccuuccu

SEQ ID NO: 3254595 - RNA, 22 nt, Human
ccugacccucaucuuucuucca

SEQ ID NO: 3254596 - RNA, 14 nt, Human
ccugacucucagca

SEQ ID NO: 3254597 - RNA, 20 nt, Human
cccugugccuugucacgcca

SEQ ID NO: 3254598 - RNA, 22 nt, Human
cccugugccuugucacgccaga

SEQ ID NO: 3254599 - RNA, 15 nt, Human
cccugugccuuguca

SEQ ID NO: 3254600 - RNA, 24 nt, Human
cccugugccuuggugugcuguauc

SEQ ID NO: 3254601 - RNA, 17 nt, Human
ccagagucccugccugg

SEQ ID NO: 3254602 - RNA, 18 nt, Human
ccagagucccugccugga

SEQ ID NO: 3254603 - RNA, 19 nt, Human
ccagagucccugccuggac

SEQ ID NO: 3254604 - RNA, 22 nt, Human
ccagagucccugccuggaccag

SEQ ID NO: 3254605 - RNA, 16 nt, Human
ccagagucccugccug

SEQ ID NO: 3254606 - RNA, 14 nt, Human
cccgggagcucagg

SEQ ID NO: 3254607 - RNA, 14 nt, Human
ccccgacuuuuguu

SEQ ID NO: 3254608 - RNA, 23 nt, Human
cggcuccucgagaucccaacacu

SEQ ID NO: 3254609 - RNA, 14 nt, Human
cgugucuggcacag

SEQ ID NO: 3254610 - RNA, 13 nt, Human
cgugucuggcaca

SEQ ID NO: 3254611 - RNA, 21 nt, Human
cgugucuggcacagccuggcu

SEQ ID NO: 3254612 - RNA, 19 nt, Human
cuaaccugccgagagucca

SEQ ID NO: 3254613 - RNA, 21 nt, Human
cuaaccugccgagaguccauc

SEQ ID NO: 3254614 - RNA, 12 nt, Human
cuaaccugccga

SEQ ID NO: 3254615 - RNA, 16 nt, Human
cucaucuuucuuccaa

SEQ ID NO: 3254616 - RNA, 14 nt, Human
cucccuccucugcc

SEQ ID NO: 3254617 - RNA, 13 nt, Human
cucccuccucugc

SEQ ID NO: 3254618 - RNA, 14 nt, Human
uagaagaagugugu

SEQ ID NO: 3254619 - RNA, 16 nt, Human
aauuccacacccucac

SEQ ID NO: 3254620 - RNA, 21 nt, Human
uagacauuugcuaugagcugg

SEQ ID NO: 3254621 - RNA, 20 nt, Human
uaugccaccugaauaaagaa

SEQ ID NO: 3254622 - RNA, 21 nt, Human
uaugguaggaacugcugggcu

SEQ ID NO: 3254623 - RNA, 14 nt, Human
uaucagcacgugug

SEQ ID NO: 3254624 - RNA, 19 nt, Human
uaauuuaaaauugugaugu

SEQ ID NO: 3254625 - RNA, 20 nt, Human
uaauuuaaaauugugaugug

SEQ ID NO: 3254626 - RNA, 19 nt, Human
uaccagagaaaaagggagg

SEQ ID NO: 3254627 - RNA, 13 nt, Human
uaccucuuggcug

SEQ ID NO: 3254628 - RNA, 15 nt, Human
uacccccugugccuu

SEQ ID NO: 3254629 - RNA, 14 nt, Human
aaggcucuuuugua

SEQ ID NO: 3254630 - RNA, 19 nt, Human
gugggguagguugggagaa

SEQ ID NO: 3254631 - RNA, 12 nt, Human
guguguaugugg

SEQ ID NO: 3254632 - RNA, 14 nt, Human
gugugggucugugu

SEQ ID NO: 3254633 - RNA, 20 nt, Human
gugugucacccuuaggccag

SEQ ID NO: 3254634 - RNA, 13 nt, Human
guguguauguggg

SEQ ID NO: 3254635 - RNA, 15 nt, Human
guguguauguggggg

SEQ ID NO: 3254636 - RNA, 21 nt, Human
guggccuaaccugccgagagu

SEQ ID NO: 3254637 - RNA, 22 nt, Human
guggccuaaccugccgagaguc

SEQ ID NO: 3254638 - RNA, 15 nt, Human
aaauugugauguguc

SEQ ID NO: 3254639 - RNA, 12 nt, Human
aaauugugaugu

SEQ ID NO: 3254640 - RNA, 12 nt, Human
aaauuuauguga

SEQ ID NO: 3254641 - RNA, 15 nt, Human
aaauuuaugugaugg

SEQ ID NO: 3254642 - RNA, 13 nt, Human
gucaguuguauca

SEQ ID NO: 3254643 - RNA, 21 nt, Human
gucaguauguggaaguguggg

SEQ ID NO: 3254644 - RNA, 17 nt, Human
gucaguauguggaagug

SEQ ID NO: 3254645 - RNA, 17 nt, Human
gucuggcacagccuggc

SEQ ID NO: 3254646 - RNA, 19 nt, Human
gucuggcacagccuggcug

SEQ ID NO: 3254647 - RNA, 19 nt, Human
gucucccuccucugcccgg

SEQ ID NO: 3254648 - RNA, 22 nt, Human
agagggacuguucuuuuguccc

SEQ ID NO: 3254649 - RNA, 17 nt, Human
agagacgggcccuggug

SEQ ID NO: 3254650 - RNA, 22 nt, Human
ucuuggggaguuuagggugggg

SEQ ID NO: 3254651 - RNA, 23 nt, Human
ucuuggggaguuuaggguggggg

SEQ ID NO: 3254652 - RNA, 22 nt, Human
ucuggcacagccuggcuguggc

SEQ ID NO: 3254653 - RNA, 23 nt, Human
acuugucccgggacaccuaggcu

SEQ ID NO: 3254654 - RNA, 15 nt, Human
ucuaccucuuggcug

SEQ ID NO: 3254655 - RNA, 20 nt, Human
ucggggagccgggagccuga

SEQ ID NO: 3254656 - RNA, 16 nt, Human
acuggggcaggggccg

SEQ ID NO: 3254657 - RNA, 22 nt, Human
acucgugucuggcacagccugg

SEQ ID NO: 3254658 - RNA, 23 nt, Human
acucgugucuggcacagccuggc

SEQ ID NO: 3254659 - RNA, 13 nt, Human
uccucuccugucu

SEQ ID NO: 3254660 - RNA, 16 nt, Human
uccucugcccgggagc

SEQ ID NO: 3254661 - RNA, 22 nt, Human
uccucugcccgggagcucagga

SEQ ID NO: 3254662 - RNA, 16 nt, Human
uccauccuacccccug

SEQ ID NO: 3254663 - RNA, 20 nt, Human
uccauccuacccccugugcc

SEQ ID NO: 3254664 - RNA, 16 nt, Human
ucaguauguggaagug

SEQ ID NO: 3254665 - RNA, 18 nt, Human
uaugugggggucugugug

SEQ ID NO: 3254666 - RNA, 19 nt, Human
uaugugggggucugugugu

SEQ ID NO: 3254667 - RNA, 20 nt, Human
uaugugggggucuguguguu

SEQ ID NO: 3254668 - RNA, 16 nt, Human
uuagccuuugucccag

SEQ ID NO: 3254669 - RNA, 16 nt, Human
agugugggucugugug

SEQ ID NO: 3254670 - RNA, 17 nt, Human
agugugggucugugugu

SEQ ID NO: 3254671 - RNA, 15 nt, Human
agugugggucugugu

SEQ ID NO: 3254672 - RNA, 19 nt, Human
agugugggucugugugugu

SEQ ID NO: 3254673 - RNA, 23 nt, Human
agugugggucuguguguguguau

SEQ ID NO: 3254674 - RNA, 14 nt, Human
uguuguguguggga

SEQ ID NO: 3254675 - RNA, 15 nt, Human
uguugugugugggag

SEQ ID NO: 3254676 - RNA, 16 nt, Human
uguugugugugggagu

SEQ ID NO: 3254677 - RNA, 19 nt, Human
uguggcacuggggcagggg

SEQ ID NO: 3254678 - RNA, 16 nt, Human
uguguguguguaugug

SEQ ID NO: 3254679 - RNA, 13 nt, Human
uguguguguguau

SEQ ID NO: 3254680 - RNA, 23 nt, Human
agguugggagaaugucaguaugu

SEQ ID NO: 3254681 - RNA, 17 nt, Human
uguaauuuaaaauugug

SEQ ID NO: 3254682 - RNA, 18 nt, Human
uguaauuuaaaauuguga

SEQ ID NO: 3254683 - RNA, 20 nt, Human
uguaauuuaaaauugugaug

SEQ ID NO: 3254684 - RNA, 21 nt, Human
uguaauuuaaaauugugaugu

SEQ ID NO: 3254685 - RNA, 22 nt, Human
uguaauuuaaaauugugaugug

SEQ ID NO: 3254686 - RNA, 15 nt, Human
agucccugccuggac

SEQ ID NO: 3254687 - RNA, 21 nt, Human
agucccugccuggaccagccu

SEQ ID NO: 3254688 - RNA, 14 nt, Human
agucccugccugga

SEQ ID NO: 3254689 - RNA, 22 nt, Human
agucccugccuggaccagccuc

SEQ ID NO: 3254690 - RNA, 23 nt, Human
agucccugccuggaccagccucu

SEQ ID NO: 3254691 - RNA, 15 nt, Human
aguauguggaagugu

SEQ ID NO: 3254692 - RNA, 17 nt, Human
aguauguggaagugugg

SEQ ID NO: 3254693 - RNA, 19 nt, Human
aguauguggaagugugggu

SEQ ID NO: 3254694 - RNA, 19 nt, Human
ugucaguauguggaagugu

SEQ ID NO: 3254695 - RNA, 20 nt, Human
ugucaguauguggaagugug

SEQ ID NO: 3254696 - RNA, 18 nt, Human
ugucaguauguggaagug

SEQ ID NO: 3254697 - RNA, 22 nt, Human
ugucaguauguggaaguguggg

SEQ ID NO: 3254698 - RNA, 14 nt, Human
uggggcugauugua

SEQ ID NO: 3254699 - RNA, 21 nt, Human
ugggguagguugggagaaugu

SEQ ID NO: 3254700 - RNA, 15 nt, Human
ugggguagguuggga

SEQ ID NO: 3254701 - RNA, 18 nt, Human
uggggaguuuaggguggg

SEQ ID NO: 3254702 - RNA, 19 nt, Human
uggggaguuuagggugggg

SEQ ID NO: 3254703 - RNA, 15 nt, Human
agggggagagggcug

SEQ ID NO: 3254704 - RNA, 16 nt, Human
agggggagagggcugc

SEQ ID NO: 3254705 - RNA, 12 nt, Human
ugggucugugug

SEQ ID NO: 3254706 - RNA, 13 nt, Human
ugguaggaacugc

SEQ ID NO: 3254707 - RNA, 20 nt, Human
ugguaggaacugcugggcuu

SEQ ID NO: 3254708 - RNA, 21 nt, Human
agcugggacaccccgacuuuu

SEQ ID NO: 3254709 - RNA, 15 nt, Human
ugcuguagacauuug

SEQ ID NO: 3254710 - RNA, 23 nt, Human
ugcuguauccauccauggggcug

SEQ ID NO: 3254711 - RNA, 19 nt, Human
aggaucccaugagcuccuu

SEQ ID NO: 3254712 - RNA, 12 nt, Human
aggacaguauuu

SEQ ID NO: 3254713 - RNA, 19 nt, Human
aggacaguauuugugggga

SEQ ID NO: 3254714 - RNA, 21 nt, Human
uggccuguucuucuauggguu

SEQ ID NO: 3254715 - RNA, 23 nt, Human
uggccaguggcuggaucugugag

SEQ ID NO: 3254716 - RNA, 21 nt, Human
agcucaggaaccgaggcaggg

SEQ ID NO: 3254717 - RNA, 22 nt, Human
agcucaggaaccgaggcaggga

SEQ ID NO: 3254718 - RNA, 20 nt, Human
agcucaggaaccgaggcagg

SEQ ID NO: 3254719 - RNA, 17 nt, Human
agcauuucccuuccuuc

SEQ ID NO: 3254720 - RNA, 21 nt, Human
ugauagaaggcuauggggaua

SEQ ID NO: 3254721 - RNA, 18 nt, Human
ugaguucauaaauuuaug

SEQ ID NO: 3254722 - RNA, 24 nt, Human
ugauaagcagucauccucagauca

SEQ ID NO: 3254723 - RNA, 15 nt, Human
uucuaguucugccag

SEQ ID NO: 3254724 - RNA, 11 nt, Human
uuuaugugugu

SEQ ID NO: 3254725 - RNA, 13 nt, Human
uuuaugugugugu

SEQ ID NO: 3254726 - RNA, 12 nt, Human
uuuaugugaugg

SEQ ID NO: 3254727 - RNA, 16 nt, Human
auggccugggggaugu

SEQ ID NO: 3254728 - RNA, 21 nt, Human
auggaaugaugggucaguugu

SEQ ID NO: 3254729 - RNA, 16 nt, Human
aucuguaccucugccu

SEQ ID NO: 3254730 - RNA, 20 nt, Human
aucugagaggccacagugca

SEQ ID NO: 3254731 - RNA, 17 nt, Human
uuuguaaauuuauguga

SEQ ID NO: 3254732 - RNA, 13 nt, Human
augucaguaugug

SEQ ID NO: 3254733 - RNA, 14 nt, Human
augucaguaugugg

SEQ ID NO: 3254734 - RNA, 19 nt, Human
uuugcuaugagcuggggau

SEQ ID NO: 3254735 - RNA, 15 nt, Human
auguuuacagaggac

SEQ ID NO: 3254736 - RNA, 17 nt, Human
auguuuacagaggacag

SEQ ID NO: 3254737 - RNA, 19 nt, Human
auguuuacagaggacagua

SEQ ID NO: 3254738 - RNA, 19 nt, Human
auuuaaaauugugaugugu

SEQ ID NO: 3254739 - RNA, 20 nt, Human
auuuaaaauugugauguguc

SEQ ID NO: 3254740 - RNA, 23 nt, Human
auugcaggagucccugccaucau

SEQ ID NO: 3254741 - RNA, 16 nt, Human
augaugggucaguugu

SEQ ID NO: 3254742 - RNA, 20 nt, Human
auccagagucccugccugga

SEQ ID NO: 3254743 - RNA, 21 nt, Human
auccagagucccugccuggac

SEQ ID NO: 3254744 - RNA, 19 nt, Human
auccagagucccugccugg

SEQ ID NO: 3254745 - RNA, 16 nt, Human
agucugagagaggcca

SEQ ID NO: 3254746 - RNA, 23 nt, Human
agucugagagaggccauucuuuc

SEQ ID NO: 3254747 - RNA, 22 nt, Human
aggaacugcugggcuuggcagc

SEQ ID NO: 3254748 - RNA, 16 nt, Human
aggaaccgaggcaggg

SEQ ID NO: 3254749 - RNA, 16 nt, Human
aggaacugcugggcuu

SEQ ID NO: 3254750 - RNA, 19 nt, Human
agcuaauucuuugaccugu

SEQ ID NO: 3254751 - RNA, 16 nt, Human
agcuccuuaaggcucu

SEQ ID NO: 3254752 - RNA, 17 nt, Human
agcuccuuaaggcucuu

SEQ ID NO: 3254753 - RNA, 23 nt, Human
agagaggccauucuuucccaaca

SEQ ID NO: 3254754 - RNA, 10 nt, Human
agagggcugc

SEQ ID NO: 3254755 - RNA, 13 nt, Human
aagggagggggag

SEQ ID NO: 3254756 - RNA, 18 nt, Human
aagagaagggcagggcug

SEQ ID NO: 3254757 - RNA, 19 nt, Human
accggggccugggcaggag

SEQ ID NO: 3254758 - RNA, 14 nt, Human
aauugugauguguc

SEQ ID NO: 3254759 - RNA, 15 nt, Human
aauugugaugugucc

SEQ ID NO: 3254760 - RNA, 11 nt, Human
aauugugaugu

SEQ ID NO: 3254761 - RNA, 23 nt, Human
acagaggacaguauuugugggga

SEQ ID NO: 3254762 - RNA, 14 nt, Human
accaucucuuuacc

SEQ ID NO: 3254763 - RNA, 17 nt, Human
caagccuuggcucuacc

SEQ ID NO: 3254764 - RNA, 18 nt, Human
ccucagccccgcguggaa

SEQ ID NO: 3254765 - RNA, 15 nt, Human
ccggggccugggcag

SEQ ID NO: 3254766 - RNA, 13 nt, Human
ccgggagcucagg

SEQ ID NO: 3254767 - RNA, 15 nt, Human
ccgggagcucaggaa

SEQ ID NO: 3254768 - RNA, 17 nt, Human
ccggcuuuguggcacug

SEQ ID NO: 3254769 - RNA, 19 nt, Human
ccggcuuuguggcacuggg

SEQ ID NO: 3254770 - RNA, 16 nt, Human
ccggcuuuguggcacu

SEQ ID NO: 3254771 - RNA, 17 nt, Human
ccuccauccuacccccu

SEQ ID NO: 3254772 - RNA, 22 nt, Human
ccuccauccuacccccugugcc

SEQ ID NO: 3254773 - RNA, 23 nt, Human
ccuccauccuacccccugugccu

SEQ ID NO: 3254774 - RNA, 12 nt, Human
cccugccuggac

SEQ ID NO: 3254775 - RNA, 13 nt, Human
cccugccuggacc

SEQ ID NO: 3254776 - RNA, 18 nt, Human
cccugccuggaccagccu

SEQ ID NO: 3254777 - RNA, 20 nt, Human
cccugccaucauguuuacag

SEQ ID NO: 3254778 - RNA, 14 nt, Human
cccucaucuuucuu

SEQ ID NO: 3254779 - RNA, 21 nt, Human
cccagcuaugguucucucgca

SEQ ID NO: 3254780 - RNA, 18 nt, Human
cccagaaugccuccugca

SEQ ID NO: 3254781 - RNA, 20 nt, Human
ccaucauguuuacagaggac

SEQ ID NO: 3254782 - RNA, 22 nt, Human
ccaucauguuuacagaggacag

SEQ ID NO: 3254783 - RNA, 21 nt, Human
cauuaccucagugagaagcca

SEQ ID NO: 3254784 - RNA, 22 nt, Human
cauuaccucagugagaagccag

SEQ ID NO: 3254785 - RNA, 19 nt, Human
cauggggcugauuguauuu

SEQ ID NO: 3254786 - RNA, 15 nt, Human
cauaccuggcccugu

SEQ ID NO: 3254787 - RNA, 18 nt, Human
cauaaucacaacccuuca

SEQ ID NO: 3254788 - RNA, 18 nt, Human
caguggcuggaucuguga

SEQ ID NO: 3254789 - RNA, 20 nt, Human
caguggcuggaucugugagg

SEQ ID NO: 3254790 - RNA, 16 nt, Human
caguggcuggaucugu

SEQ ID NO: 3254791 - RNA, 21 nt, Human
cauccagagucccugccugga

SEQ ID NO: 3254792 - RNA, 19 nt, Human
cauccuacccccugugccu

SEQ ID NO: 3254793 - RNA, 17 nt, Human
gcccgggagcucaggaa

SEQ ID NO: 3254794 - RNA, 19 nt, Human
gcccgggagcucaggaacc

SEQ ID NO: 3254795 - RNA, 15 nt, Human
gcccgggagcucagg

SEQ ID NO: 3254796 - RNA, 17 nt, Human
gccaucauguuuacaga

SEQ ID NO: 3254797 - RNA, 21 nt, Human
gccaucauguuuacagaggac

SEQ ID NO: 3254798 - RNA, 24 nt, Human
gccucuccacucaugugacucuuu

SEQ ID NO: 3254799 - RNA, 21 nt, Human
gccucuccacucaugugacuc

SEQ ID NO: 3254800 - RNA, 20 nt, Human
gccucucauuccagaggaag

SEQ ID NO: 3254801 - RNA, 17 nt, Human
gccugacccucaucuuu

SEQ ID NO: 3254802 - RNA, 19 nt, Human
gccucucauuccagaggaa

SEQ ID NO: 3254803 - RNA, 18 nt, Human
gccuuuggacuugucccg

SEQ ID NO: 3254804 - RNA, 12 nt, Human
gcgcggcuggga

SEQ ID NO: 3254805 - RNA, 18 nt, Human
gcgcggcugggaggaggg

SEQ ID NO: 3254806 - RNA, 19 nt, Human
gcaggggccgggggcaguc

SEQ ID NO: 3254807 - RNA, 20 nt, Human
gcaggggccgggggcagucu

SEQ ID NO: 3254808 - RNA, 18 nt, Human
gcauuauauuuguaaauu

SEQ ID NO: 3254809 - RNA, 20 nt, Human
gauuuggggcucagaguggg

SEQ ID NO: 3254810 - RNA, 21 nt, Human
gaucugugaggggcucucuca

SEQ ID NO: 3254811 - RNA, 14 nt, Human
gaucauuaucagcc

SEQ ID NO: 3254812 - RNA, 15 nt, Human
gaucccaugagcucc

SEQ ID NO: 3254813 - RNA, 17 nt, Human
gaucccaugagcuccuu

SEQ ID NO: 3254814 - RNA, 21 nt, Human
gagccugacccucaucuuucu

SEQ ID NO: 3254815 - RNA, 21 nt, Human
gagcucaggaaccgaggcagg

SEQ ID NO: 3254816 - RNA, 20 nt, Human
gagcucaggaaccgaggcag

SEQ ID NO: 3254817 - RNA, 20 nt, Human
gagcuccuuaaggcucuuuu

SEQ ID NO: 3254818 - RNA, 18 nt, Human
gacuugucccgggacacc

SEQ ID NO: 3254819 - RNA, 22 nt, Human
gagaagccagcuuuccucauca

SEQ ID NO: 3254820 - RNA, 13 nt, Human
gagagaggccauu

SEQ ID NO: 3254821 - RNA, 21 nt, Human
gagagaggccauucuuuccca

SEQ ID NO: 3254822 - RNA, 15 nt, Human
gacaccuaggcuagg

SEQ ID NO: 3254823 - RNA, 16 nt, Human
gacaccuaggcuaggg

SEQ ID NO: 3254824 - RNA, 20 nt, Human
gacaccuaggcuaggguggg

SEQ ID NO: 3254825 - RNA, 17 nt, Human
gaccuuuccugaggaag

SEQ ID NO: 3254826 - RNA, 20 nt, Human
cuuggggaguuuaggguggg

SEQ ID NO: 3254827 - RNA, 21 nt, Human
cuuggggaguuuagggugggg

SEQ ID NO: 3254828 - RNA, 23 nt, Human
cuugucacgccagacuucccacg

SEQ ID NO: 3254829 - RNA, 18 nt, Human
cuugucacgccagacuuc

SEQ ID NO: 3254830 - RNA, 12 nt, Human
cuuuggacuugu

SEQ ID NO: 3254831 - RNA, 19 nt, Human
cuuucuuccaaacaggcuc

SEQ ID NO: 3254832 - RNA, 13 nt, Human
cuuucuuccaaac

SEQ ID NO: 3254833 - RNA, 21 nt, Human
gaaggaucccaugagcuccuu

SEQ ID NO: 3254834 - RNA, 13 nt, Human
gaagaaguguguc

SEQ ID NO: 3254835 - RNA, 11 nt, Human
cugccaggaga

SEQ ID NO: 3254836 - RNA, 18 nt, Human
cugcccgggagcucagga

SEQ ID NO: 3254837 - RNA, 19 nt, Human
cugcccgggagcucaggaa

SEQ ID NO: 3254838 - RNA, 19 nt, Human
cugggaggagggcaggcau

SEQ ID NO: 3254839 - RNA, 18 nt, Human
cuggcuguggccuaaccu

SEQ ID NO: 3254840 - RNA, 16 nt, Human
cuggcacagccuggcu

SEQ ID NO: 3254841 - RNA, 21 nt, Human
cuggcacagccuggcuguggc

SEQ ID NO: 3254842 - RNA, 15 nt, Human
cuggcacagccuggc

SEQ ID NO: 3254843 - RNA, 23 nt, Human
cuggcacagccuggcuguggccu

SEQ ID NO: 3254844 - RNA, 14 nt, Human
cuguaccucugccu

SEQ ID NO: 3254845 - RNA, 21 nt, Human
cuccucgagaucccaacacug

SEQ ID NO: 3254846 - RNA, 24 nt, Human
cuccucgagaucccaacacugcca

SEQ ID NO: 3254847 - RNA, 17 nt, Human
cuccucgagaucccaac

SEQ ID NO: 3254848 - RNA, 18 nt, Human
cuccauccuacccccugu

SEQ ID NO: 3254849 - RNA, 20 nt, Human
cuccauccuacccccugugc

SEQ ID NO: 3254850 - RNA, 22 nt, Human
cuccauccuacccccugugccu

SEQ ID NO: 3254851 - RNA, 23 nt, Human
cuccauccuacccccugugccuu

SEQ ID NO: 3254852 - RNA, 21 nt, Human
cucuccacucaugugacucuu

SEQ ID NO: 3254853 - RNA, 19 nt, Human
cucuccacucaugugacuc

SEQ ID NO: 3254854 - RNA, 22 nt, Human
cucuccacucaugugacucuuu

SEQ ID NO: 3254855 - RNA, 15 nt, Human
cucuccugucucccu

SEQ ID NO: 3254856 - RNA, 17 nt, Human
cucuccugucucccucc

SEQ ID NO: 3254857 - RNA, 18 nt, Human
cucuccugucucccuccu

SEQ ID NO: 3254858 - RNA, 21 nt, Human
cucuuggggaguuuagggugg

SEQ ID NO: 3254859 - RNA, 23 nt, Human
cucuuggggaguuuagggugggg

SEQ ID NO: 3254860 - RNA, 12 nt, Human
cggcugggagga

SEQ ID NO: 3254861 - RNA, 17 nt, Human
cgggagccugacccuca

SEQ ID NO: 3254862 - RNA, 18 nt, Human
cgggggcagucugagaga

SEQ ID NO: 3254863 - RNA, 21 nt, Human
cgggggcagucugagagaggc

SEQ ID NO: 3254864 - RNA, 17 nt, Human
cgggggcagucugagag

SEQ ID NO: 3254865 - RNA, 17 nt, Human
cggggccugggcaggag

SEQ ID NO: 3254866 - RNA, 19 nt, Human
cggggccugggcaggaggg

SEQ ID NO: 3254867 - RNA, 22 nt, Human
cgggucaucuguaccucugccu

SEQ ID NO: 3254868 - RNA, 15 nt, Human
cgggucaucuguacc

SEQ ID NO: 3254869 - RNA, 23 nt, Human
cguggcuguggcauccagagucc

SEQ ID NO: 3254870 - RNA, 16 nt, Human
cguuguccucagcccc

SEQ ID NO: 3254871 - RNA, 13 nt, Human
cuacccccugugc

SEQ ID NO: 3254872 - RNA, 14 nt, Human
cuacccccugugcc

SEQ ID NO: 3254873 - RNA, 16 nt, Human
gucccugaagagaagg

SEQ ID NO: 3254874 - RNA, 22 nt, Human
gucagcugggacaccccgacuu

SEQ ID NO: 3254875 - RNA, 14 nt, Human
guagguugggagaa

SEQ ID NO: 3254876 - RNA, 19 nt, Human
guagugauuuuuaugccac

SEQ ID NO: 3254877 - RNA, 21 nt, Human
gugauuuuuaugccaccugaa

SEQ ID NO: 3254878 - RNA, 14 nt, Human
gugccuuuugccau

SEQ ID NO: 3254879 - RNA, 21 nt, Human
gugccaggauggaaugauggg

SEQ ID NO: 3254880 - RNA, 21 nt, Human
gugacuauggagcugagcagg

SEQ ID NO: 3254881 - RNA, 11 nt, Human
gucugugugug

SEQ ID NO: 3254882 - RNA, 12 nt, Human
gucugugugugu

SEQ ID NO: 3254883 - RNA, 16 nt, Human
gucuguguguguguau

SEQ ID NO: 3254884 - RNA, 20 nt, Human
gucuguguguguguaugugg

SEQ ID NO: 3254885 - RNA, 11 nt, Human
gucuguguguu

SEQ ID NO: 3254886 - RNA, 21 nt, Human
gucuguguguuuaugugugug

SEQ ID NO: 3254887 - RNA, 22 nt, Human
gucuguguguuuaugugugugu

SEQ ID NO: 3254888 - RNA, 13 nt, Human
gucugagagaggc

SEQ ID NO: 3254889 - RNA, 14 nt, Human
gucugagagaggcc

SEQ ID NO: 3254890 - RNA, 15 nt, Human
gucugagagaggcca

SEQ ID NO: 3254891 - RNA, 18 nt, Human
gucugagagaggccauuc

SEQ ID NO: 3254892 - RNA, 13 nt, Human
gucccugccugga

SEQ ID NO: 3254893 - RNA, 13 nt, Human
guucugccaggag

SEQ ID NO: 3254894 - RNA, 14 nt, Human
guucugccaggaga

SEQ ID NO: 3254895 - RNA, 12 nt, Human
guucugccagga

SEQ ID NO: 3254896 - RNA, 21 nt, Human
guguccugcaccggggccugg

SEQ ID NO: 3254897 - RNA, 17 nt, Human
gugucuggcacagccug

SEQ ID NO: 3254898 - RNA, 17 nt, Human
gugugggaguguguaau

SEQ ID NO: 3254899 - RNA, 16 nt, Human
guguguuuaugugugu

SEQ ID NO: 3254900 - RNA, 14 nt, Human
guguguuuaugugu

SEQ ID NO: 3254901 - RNA, 15 nt, Human
guguguuuaugugug

SEQ ID NO: 3254902 - RNA, 12 nt, Human
guguguugugug

SEQ ID NO: 3254903 - RNA, 14 nt, Human
guguguugugugug

SEQ ID NO: 3254904 - RNA, 17 nt, Human
guguguuguguguggga

SEQ ID NO: 3254905 - RNA, 21 nt, Human
guggggagagacgggcccugg

SEQ ID NO: 3254906 - RNA, 17 nt, Human
guggcuggaucugugag

SEQ ID NO: 3254907 - RNA, 22 nt, Human
guguaauuuaaaauugugaugu

SEQ ID NO: 3254908 - RNA, 23 nt, Human
guguaauuuaaaauugugaugug

SEQ ID NO: 3254909 - RNA, 20 nt, Human
guguaauuuaaaauugugau

SEQ ID NO: 3254910 - RNA, 22 nt, Human
uauaaacaugcuugcauuauau

SEQ ID NO: 3254911 - RNA, 20 nt, Human
uauauuuguaaauuuaugug

SEQ ID NO: 3254912 - RNA, 16 nt, Human
guuuagaagaagugug

SEQ ID NO: 3254913 - RNA, 17 nt, Human
guuguccucagccccgc

SEQ ID NO: 3254914 - RNA, 23 nt, Human
guuguccucagccccgcguggaa

SEQ ID NO: 3254915 - RNA, 12 nt, Human
guuguguguggg

SEQ ID NO: 3254916 - RNA, 13 nt, Human
guuguguguggga

SEQ ID NO: 3254917 - RNA, 14 nt, Human
guugugugugggag

SEQ ID NO: 3254918 - RNA, 16 nt, Human
guugugugugggagug

SEQ ID NO: 3254919 - RNA, 22 nt, Human
guugugugugggaguguguaau

SEQ ID NO: 3254920 - RNA, 13 nt, Human
uaaauuuauguga

SEQ ID NO: 3254921 - RNA, 22 nt, Human
uaagugccaggauggaaugaug

SEQ ID NO: 3254922 - RNA, 14 nt, Human
ugugugggagugug

SEQ ID NO: 3254923 - RNA, 15 nt, Human
ugugugggagugugu

SEQ ID NO: 3254924 - RNA, 11 nt, Human
uguguaugugg

SEQ ID NO: 3254925 - RNA, 12 nt, Human
uguguauguggg

SEQ ID NO: 3254926 - RNA, 16 nt, Human
ugugugggagugugua

SEQ ID NO: 3254927 - RNA, 16 nt, Human
uguucuuuugucccag

SEQ ID NO: 3254928 - RNA, 14 nt, Human
ugugggagugugua

SEQ ID NO: 3254929 - RNA, 15 nt, Human
ugugggaguguguaa

SEQ ID NO: 3254930 - RNA, 15 nt, Human
uguggaagugugggu

SEQ ID NO: 3254931 - RNA, 15 nt, Human
uguggccuaaccugc

SEQ ID NO: 3254932 - RNA, 19 nt, Human
uguguaauuuaaaauugug

SEQ ID NO: 3254933 - RNA, 22 nt, Human
uguguaauuuaaaauugugaug

SEQ ID NO: 3254934 - RNA, 23 nt, Human
uguguaauuuaaaauugugaugu

SEQ ID NO: 3254935 - RNA, 11 nt, Human
uguguaauuua

SEQ ID NO: 3254936 - RNA, 18 nt, Human
uguguaauuuaaaauugu

SEQ ID NO: 3254937 - RNA, 19 nt, Human
ugugccuugucacgccaga

SEQ ID NO: 3254938 - RNA, 20 nt, Human
ugugccuugucacgccagac

SEQ ID NO: 3254939 - RNA, 17 nt, Human
ugugccuugucacgcca

SEQ ID NO: 3254940 - RNA, 17 nt, Human
ugugccuuggugugcug

SEQ ID NO: 3254941 - RNA, 16 nt, Human
ugugccuuuugccauc

SEQ ID NO: 3254942 - RNA, 17 nt, Human
ugucuggcacagccugg

SEQ ID NO: 3254943 - RNA, 21 nt, Human
uguccucagccccgcguggaa

SEQ ID NO: 3254944 - RNA, 22 nt, Human
ugucacccuuaggccagcacca

SEQ ID NO: 3254945 - RNA, 14 nt, Human
uguaccucugccuc

SEQ ID NO: 3254946 - RNA, 16 nt, Human
ugcaccggggccuggg

SEQ ID NO: 3254947 - RNA, 22 nt, Human
ugcaccggggccugggcaggag

SEQ ID NO: 3254948 - RNA, 12 nt, Human
ugcaccggggcc

SEQ ID NO: 3254949 - RNA, 18 nt, Human
ugccaggauggaaugaug

SEQ ID NO: 3254950 - RNA, 21 nt, Human
ugggacaccccgacuuuuguu

SEQ ID NO: 3254951 - RNA, 21 nt, Human
ugggagugaggaugucugggc

SEQ ID NO: 3254952 - RNA, 18 nt, Human
ugggggucuguguguuua

SEQ ID NO: 3254953 - RNA, 15 nt, Human
ugggggucugugugu

SEQ ID NO: 3254954 - RNA, 11 nt, Human
ugggggaugua

SEQ ID NO: 3254955 - RNA, 18 nt, Human
uggaacucgugucuggca

SEQ ID NO: 3254956 - RNA, 20 nt, Human
uggaaugaugggucaguugu

SEQ ID NO: 3254957 - RNA, 23 nt, Human
ucccaugagcuccuuaaggcucu

SEQ ID NO: 3254958 - RNA, 16 nt, Human
uccucgagaucccaac

SEQ ID NO: 3254959 - RNA, 23 nt, Human
uccucgagaucccaacacugcca

SEQ ID NO: 3254960 - RNA, 19 nt, Human
uccugucccucauccauag

SEQ ID NO: 3254961 - RNA, 20 nt, Human
ucagaucauuaucagccugu

SEQ ID NO: 3254962 - RNA, 23 nt, Human
ucagccuccauccuacccccugu

SEQ ID NO: 3254963 - RNA, 12 nt, Human
ucaucuuucuuc

SEQ ID NO: 3254964 - RNA, 14 nt, Human
ucaucuuucuucca

SEQ ID NO: 3254965 - RNA, 17 nt, Human
ucaucuuucuuccaaac

SEQ ID NO: 3254966 - RNA, 16 nt, Human
ucccaacacugccagc

SEQ ID NO: 3254967 - RNA, 14 nt, Human
ucccaacacugcca

SEQ ID NO: 3254968 - RNA, 15 nt, Human
ucccaacacugccag

SEQ ID NO: 3254969 - RNA, 22 nt, Human
ucuucauuaccucagugagaag

SEQ ID NO: 3254970 - RNA, 11 nt, Human
ucugugugugu

SEQ ID NO: 3254971 - RNA, 19 nt, Human
ucuuuccaaccggcuuugu

SEQ ID NO: 3254972 - RNA, 14 nt, Human
ugacucuuuccaac

SEQ ID NO: 3254973 - RNA, 16 nt, Human
ugacucuuuccaaccg

SEQ ID NO: 3254974 - RNA, 13 nt, Human
ugacucuuuccaa

SEQ ID NO: 3254975 - RNA, 19 nt, Human
ugacucuuuccaaccggcu

SEQ ID NO: 3254976 - RNA, 20 nt, Human
ugaagagaagggcagggcug

SEQ ID NO: 3254977 - RNA, 22 nt, Human
ugaagagaagggcagggcugag

SEQ ID NO: 3254978 - RNA, 13 nt, Human
aggaugucugggc

SEQ ID NO: 3254979 - RNA, 20 nt, Human
aggagacagguuagcugcuc

SEQ ID NO: 3254980 - RNA, 15 nt, Human
aggagggaggugcuu

SEQ ID NO: 3254981 - RNA, 13 nt, Human
aggagggcaggca

SEQ ID NO: 3254982 - RNA, 15 nt, Human
aggagggcaggcauc

SEQ ID NO: 3254983 - RNA, 19 nt, Human
aggcaucggggagccggga

SEQ ID NO: 3254984 - RNA, 22 nt, Human
agggauuuggggcucagagugg

SEQ ID NO: 3254985 - RNA, 14 nt, Human
aggcuagggugggg

SEQ ID NO: 3254986 - RNA, 15 nt, Human
aggcuagggugggga

SEQ ID NO: 3254987 - RNA, 16 nt, Human
aggcuaggguggggag

SEQ ID NO: 3254988 - RNA, 19 nt, Human
aggcuaggguggggagaga

SEQ ID NO: 3254989 - RNA, 19 nt, Human
agagugggguagguuggga

SEQ ID NO: 3254990 - RNA, 13 nt, Human
agcaucucccagu

SEQ ID NO: 3254991 - RNA, 12 nt, Human
agagaggccauu

SEQ ID NO: 3254992 - RNA, 22 nt, Human
agagaggccauucuuucccaac

SEQ ID NO: 3254993 - RNA, 13 nt, Human
accggggccuggg

SEQ ID NO: 3254994 - RNA, 16 nt, Human
acccucaucuuucuuc

SEQ ID NO: 3254995 - RNA, 19 nt, Human
acccucaucuuucuuccaa

SEQ ID NO: 3254996 - RNA, 13 nt, Human
acccucaucuuuc

SEQ ID NO: 3254997 - RNA, 14 nt, Human
acccucaucuuucu

SEQ ID NO: 3254998 - RNA, 14 nt, Human
aacaggcucagagg

SEQ ID NO: 3254999 - RNA, 14 nt, Human
uacagaggacagua

SEQ ID NO: 3255000 - RNA, 18 nt, Human
uacagaggacaguauuug

SEQ ID NO: 3255001 - RNA, 15 nt, Human
uaauuuaaaauugug

SEQ ID NO: 3255002 - RNA, 16 nt, Human
uaauuuaaaauuguga

SEQ ID NO: 3255003 - RNA, 14 nt, Human
aauuuaugugaugg

SEQ ID NO: 3255004 - RNA, 17 nt, Human
acaccccgacuuuuguu

SEQ ID NO: 3255005 - RNA, 16 nt, Human
guuuucuuaacuuaaa

SEQ ID NO: 3255006 - RNA, 23 nt, Human
aaggcuauggggauagaugugug

SEQ ID NO: 3255007 - RNA, 13 nt, Human
guuuaugugugug

SEQ ID NO: 3255008 - RNA, 16 nt, Human
guuuaugugugugugu

SEQ ID NO: 3255009 - RNA, 18 nt, Human
guuguaucagcacgugug

SEQ ID NO: 3255010 - RNA, 23 nt, Human
gugcuauuguagagccagagguc

SEQ ID NO: 3255011 - RNA, 14 nt, Human
guggaagugugggu

SEQ ID NO: 3255012 - RNA, 15 nt, Human
guggaaguguggguc

SEQ ID NO: 3255013 - RNA, 19 nt, Human
guggaagugugggucugug

SEQ ID NO: 3255014 - RNA, 20 nt, Human
guggaagugugggucugugu

SEQ ID NO: 3255015 - RNA, 21 nt, Human
guggaagugugggucugugug

SEQ ID NO: 3255016 - RNA, 22 nt, Human
guggaagugugggucugugugu

SEQ ID NO: 3255017 - RNA, 14 nt, Human
guggcacuggggca

SEQ ID NO: 3255018 - RNA, 23 nt, Human
guggggggggggcgcggcuggga

SEQ ID NO: 3255019 - RNA, 13 nt, Human
gugggucugugug

SEQ ID NO: 3255020 - RNA, 16 nt, Human
gugggucugugugugu

SEQ ID NO: 3255021 - RNA, 14 nt, Human
gugguggcucggga

SEQ ID NO: 3255022 - RNA, 13 nt, Human
gugggagugugua

SEQ ID NO: 3255023 - RNA, 14 nt, Human
gugggaguguguaa

SEQ ID NO: 3255024 - RNA, 14 nt, Human
guguguaauuuaaa

SEQ ID NO: 3255025 - RNA, 16 nt, Human
guaggaacugcugggc

SEQ ID NO: 3255026 - RNA, 18 nt, Human
guauguggaagugugggu

SEQ ID NO: 3255027 - RNA, 21 nt, Human
guauguggaagugugggucug

SEQ ID NO: 3255028 - RNA, 19 nt, Human
guaugugggggucugugug

SEQ ID NO: 3255029 - RNA, 20 nt, Human
guaugugggggucugugugu

SEQ ID NO: 3255030 - RNA, 16 nt, Human
guauguggaagugugg

SEQ ID NO: 3255031 - RNA, 17 nt, Human
guauguggaaguguggg

SEQ ID NO: 3255032 - RNA, 15 nt, Human
guauguggaagugug

SEQ ID NO: 3255033 - RNA, 19 nt, Human
aacucgugucuggcacagc

SEQ ID NO: 3255034 - RNA, 12 nt, Human
gucucccuccuc

SEQ ID NO: 3255035 - RNA, 16 nt, Human
gucucccuccucugcc

SEQ ID NO: 3255036 - RNA, 12 nt, Human
aacacugccagc

SEQ ID NO: 3255037 - RNA, 22 nt, Human
aacacugccagcauuucccuuc

SEQ ID NO: 3255038 - RNA, 13 nt, Human
ucuuucuuccaaa

SEQ ID NO: 3255039 - RNA, 19 nt, Human
agacuucccacggcuccuc

SEQ ID NO: 3255040 - RNA, 21 nt, Human
agacauuugcuaugagcuggg

SEQ ID NO: 3255041 - RNA, 15 nt, Human
agaaugucaguaugu

SEQ ID NO: 3255042 - RNA, 16 nt, Human
agaaugucaguaugug

SEQ ID NO: 3255043 - RNA, 13 nt, Human
agaaugucaguau

SEQ ID NO: 3255044 - RNA, 17 nt, Human
agaaugucaguaugugg

SEQ ID NO: 3255045 - RNA, 19 nt, Human
agaaugucaguauguggaa

SEQ ID NO: 3255046 - RNA, 23 nt, Human
agaguccaucagccuccauccua

SEQ ID NO: 3255047 - RNA, 14 nt, Human
agagucccugccug

SEQ ID NO: 3255048 - RNA, 17 nt, Human
agagucccugccuggac

SEQ ID NO: 3255049 - RNA, 18 nt, Human
agaucccaacacugccag

SEQ ID NO: 3255050 - RNA, 19 nt, Human
agaucccaacacugccagc

SEQ ID NO: 3255051 - RNA, 20 nt, Human
agaucccaacacugccagca

SEQ ID NO: 3255052 - RNA, 21 nt, Human
agaggccauucuuucccaaca

SEQ ID NO: 3255053 - RNA, 23 nt, Human
acuggccaguggcuggaucugug

SEQ ID NO: 3255054 - RNA, 18 nt, Human
ucgagaucccaacacugc

SEQ ID NO: 3255055 - RNA, 21 nt, Human
ucgagaucccaacacugccag

SEQ ID NO: 3255056 - RNA, 17 nt, Human
ucgagaucccaacacug

SEQ ID NO: 3255057 - RNA, 16 nt, Human
ucucauuccagaggaa

SEQ ID NO: 3255058 - RNA, 14 nt, Human
ucugagagaggcca

SEQ ID NO: 3255059 - RNA, 20 nt, Human
ucugagagaggccauucuuu

SEQ ID NO: 3255060 - RNA, 18 nt, Human
acucaugugacucuuucc

SEQ ID NO: 3255061 - RNA, 19 nt, Human
acucaugugacucuuucca

SEQ ID NO: 3255062 - RNA, 21 nt, Human
uccaaccggcuuuguggcacu

SEQ ID NO: 3255063 - RNA, 14 nt, Human
uccacucaugugac

SEQ ID NO: 3255064 - RNA, 21 nt, Human
uccacucaugugacucuuucc

SEQ ID NO: 3255065 - RNA, 17 nt, Human
uauuuguaaauuuaugu

SEQ ID NO: 3255066 - RNA, 22 nt, Human
uauuuguaaauuuaugugaugg

SEQ ID NO: 3255067 - RNA, 16 nt, Human
uauuuguaaauuuaug

SEQ ID NO: 3255068 - RNA, 20 nt, Human
ugugggucugugugugugua

SEQ ID NO: 3255069 - RNA, 12 nt, Human
ugugugugggag

SEQ ID NO: 3255070 - RNA, 20 nt, Human
ugugugugggaguguguaau

SEQ ID NO: 3255071 - RNA, 14 nt, Human
uguguguguaugug

SEQ ID NO: 3255072 - RNA, 19 nt, Human
uguggcauccagagucccu

SEQ ID NO: 3255073 - RNA, 21 nt, Human
uguggcauccagagucccugc

SEQ ID NO: 3255074 - RNA, 16 nt, Human
uguggcauccagaguc

SEQ ID NO: 3255075 - RNA, 12 nt, Human
ugugacucuuuc

SEQ ID NO: 3255076 - RNA, 14 nt, Human
ugugacucuuucca

SEQ ID NO: 3255077 - RNA, 15 nt, Human
ugugacucuuuccaa

SEQ ID NO: 3255078 - RNA, 17 nt, Human
ugugacucuuuccaacc

SEQ ID NO: 3255079 - RNA, 16 nt, Human
uuagaagaaguguguc

SEQ ID NO: 3255080 - RNA, 14 nt, Human
uuagaagaagugug

SEQ ID NO: 3255081 - RNA, 15 nt, Human
uuagaagaagugugu

SEQ ID NO: 3255082 - RNA, 13 nt, Human
uuaaaauugugau

SEQ ID NO: 3255083 - RNA, 18 nt, Human
uuaaaauugugauguguc

SEQ ID NO: 3255084 - RNA, 12 nt, Human
aguuuagggugg

SEQ ID NO: 3255085 - RNA, 13 nt, Human
aguuuaggguggg

SEQ ID NO: 3255086 - RNA, 14 nt, Human
aguuuagggugggg

SEQ ID NO: 3255087 - RNA, 16 nt, Human
uguuuaugugugugug

SEQ ID NO: 3255088 - RNA, 13 nt, Human
uguuuaugugugu

SEQ ID NO: 3255089 - RNA, 13 nt, Human
aguucugccagga

SEQ ID NO: 3255090 - RNA, 14 nt, Human
aguucugccaggag

SEQ ID NO: 3255091 - RNA, 20 nt, Human
aguucugccaggagacaggu

SEQ ID NO: 3255092 - RNA, 12 nt, Human
aguucugccagg

SEQ ID NO: 3255093 - RNA, 23 nt, Human
agggaaggaucccaugagcuccu

SEQ ID NO: 3255094 - RNA, 15 nt, Human
agggaaggaucccau

SEQ ID NO: 3255095 - RNA, 22 nt, Human
agggaaggaucccaugagcucc

SEQ ID NO: 3255096 - RNA, 19 nt, Human
ugggagaaugucaguaugu

SEQ ID NO: 3255097 - RNA, 20 nt, Human
ugggagaaugucaguaugug

SEQ ID NO: 3255098 - RNA, 22 nt, Human
ugggagaaugucaguaugugga

SEQ ID NO: 3255099 - RNA, 15 nt, Human
uggggcucagagugg

SEQ ID NO: 3255100 - RNA, 22 nt, Human
uggggagggauuuggggcucag

SEQ ID NO: 3255101 - RNA, 13 nt, Human
uggggagagacgg

SEQ ID NO: 3255102 - RNA, 14 nt, Human
uggggagggauuug

SEQ ID NO: 3255103 - RNA, 21 nt, Human
aggguggggggggggcgcggc

SEQ ID NO: 3255104 - RNA, 12 nt, Human
uguauguggggg

SEQ ID NO: 3255105 - RNA, 21 nt, Human
uguagugauuuuuaugccacc

SEQ ID NO: 3255106 - RNA, 23 nt, Human
agguuuguuuagaagaagugugu

SEQ ID NO: 3255107 - RNA, 19 nt, Human
agguuuuuguagugauuuu

SEQ ID NO: 3255108 - RNA, 16 nt, Human
ugccuuggugugcugu

SEQ ID NO: 3255109 - RNA, 15 nt, Human
ugccuugucacgcca

SEQ ID NO: 3255110 - RNA, 22 nt, Human
ugcuaugagcuggggaugucuc

SEQ ID NO: 3255111 - RNA, 19 nt, Human
ugcuaugagcuggggaugu

SEQ ID NO: 3255112 - RNA, 20 nt, Human
ugcuaugagcuggggauguc

SEQ ID NO: 3255113 - RNA, 16 nt, Human
ugcuaugagcugggga

SEQ ID NO: 3255114 - RNA, 16 nt, Human
ugccaucauguuuaca

SEQ ID NO: 3255115 - RNA, 22 nt, Human
ugccgagaguccaucagccucc

SEQ ID NO: 3255116 - RNA, 23 nt, Human
agccccgcguggaacucgugucu

SEQ ID NO: 3255117 - RNA, 16 nt, Human
agccucuccacucaug

SEQ ID NO: 3255118 - RNA, 15 nt, Human
ugaugggucaguugu

SEQ ID NO: 3255119 - RNA, 17 nt, Human
auuguagagccagaggu

SEQ ID NO: 3255120 - RNA, 18 nt, Human
auuguagagccagagguc

SEQ ID NO: 3255121 - RNA, 15 nt, Human
auuuaaaauugugau

SEQ ID NO: 3255122 - RNA, 18 nt, Human
auguguguguguugugug

SEQ ID NO: 3255123 - RNA, 22 nt, Human
auguguguguguuguguguggg

SEQ ID NO: 3255124 - RNA, 23 nt, Human
auguguguguguuguguguggga

SEQ ID NO: 3255125 - RNA, 17 nt, Human
auguauauaaacaugcu

SEQ ID NO: 3255126 - RNA, 19 nt, Human
uuucccuuccuuccucucc

SEQ ID NO: 3255127 - RNA, 23 nt, Human
uuugaccuguugggagugaggau

SEQ ID NO: 3255128 - RNA, 22 nt, Human
uuuguagugauuuuuaugccac

SEQ ID NO: 3255129 - RNA, 15 nt, Human
uuuguagugauuuuu

SEQ ID NO: 3255130 - RNA, 18 nt, Human
uuuguaagguuuuuguag

SEQ ID NO: 3255131 - RNA, 20 nt, Human
auauuuguaaauuuauguga

SEQ ID NO: 3255132 - RNA, 12 nt, Human
uucugccaggag

SEQ ID NO: 3255133 - RNA, 11 nt, Human
aucccaacacu

SEQ ID NO: 3255134 - RNA, 15 nt, Human
aucccaacacugcca

SEQ ID NO: 3255135 - RNA, 16 nt, Human
aucccaacacugccag

SEQ ID NO: 3255136 - RNA, 17 nt, Human
aucccaacacugccagc

SEQ ID NO: 3255137 - RNA, 16 nt, Human
uucuaguucugccagg

SEQ ID NO: 3255138 - RNA, 17 nt, Human
uucuaguucugccagga

SEQ ID NO: 3255139 - RNA, 18 nt, Human
aucauguuuacagaggac

SEQ ID NO: 3255140 - RNA, 23 nt, Human
aucauguuuacagaggacaguau

SEQ ID NO: 3255141 - RNA, 19 nt, Human
uuguaaauuuaugugaugg

SEQ ID NO: 3255142 - RNA, 16 nt, Human
uuggacuugucccggg

SEQ ID NO: 3255143 - RNA, 21 nt, Human
aucugugaggggcucucucau

SEQ ID NO: 3255144 - RNA, 22 nt, Human
aucugugaggggcucucucaug

SEQ ID NO: 3255145 - RNA, 18 nt, Human
augaguuggcugggaaua

SEQ ID NO: 3255146 - RNA, 12 nt, Human
uugugauguguc

SEQ ID NO: 3255147 - RNA, 18 nt, Human
cugcaccggggccugggc

SEQ ID NO: 3255148 - RNA, 19 nt, Human
cugcaccggggccugggca

SEQ ID NO: 3255149 - RNA, 14 nt, Human
cugcaccggggccu

SEQ ID NO: 3255150 - RNA, 16 nt, Human
cugcaccggggccugg

SEQ ID NO: 3255151 - RNA, 13 nt, Human
cugggcaggaggg

SEQ ID NO: 3255152 - RNA, 13 nt, Human
cuggcccugugcc

SEQ ID NO: 3255153 - RNA, 14 nt, Human
cuggaucugugagg

SEQ ID NO: 3255154 - RNA, 9 nt, Human
gagggcugc

SEQ ID NO: 3255155 - RNA, 16 nt, Human
gagggcugccuuugga

SEQ ID NO: 3255156 - RNA, 22 nt, Human
gaggugcuucuaguucugccag

SEQ ID NO: 3255157 - RNA, 23 nt, Human
gaggugcuucuaguucugccagg

SEQ ID NO: 3255158 - RNA, 17 nt, Human
gaguccaucagccucca

SEQ ID NO: 3255159 - RNA, 18 nt, Human
gagucagggagagcugaa

SEQ ID NO: 3255160 - RNA, 14 nt, Human
gcaccggggccugg

SEQ ID NO: 3255161 - RNA, 16 nt, Human
gcaccggggccugggc

SEQ ID NO: 3255162 - RNA, 21 nt, Human
gaagugugggucugugugugu

SEQ ID NO: 3255163 - RNA, 24 nt, Human
gaagugugggucugugugugugua

SEQ ID NO: 3255164 - RNA, 17 nt, Human
gaacugcugggcuuggc

SEQ ID NO: 3255165 - RNA, 20 nt, Human
gaacugcugggcuuggcagc

SEQ ID NO: 3255166 - RNA, 12 nt, Human
gaaccgaggcag

SEQ ID NO: 3255167 - RNA, 15 nt, Human
gaaccgaggcaggga

SEQ ID NO: 3255168 - RNA, 21 nt, Human
gcuauggggauagaugugugg

SEQ ID NO: 3255169 - RNA, 19 nt, Human
gcuauggggauagaugugu

SEQ ID NO: 3255170 - RNA, 12 nt, Human
ggggccugggca

SEQ ID NO: 3255171 - RNA, 15 nt, Human
ggggccugggcagga

SEQ ID NO: 3255172 - RNA, 16 nt, Human
aaaauugugauguguc

SEQ ID NO: 3255173 - RNA, 14 nt, Human
gggagggggagagg

SEQ ID NO: 3255174 - RNA, 15 nt, Human
aaaaagggaggggga

SEQ ID NO: 3255175 - RNA, 17 nt, Human
ggcuggaucugugaggg

SEQ ID NO: 3255176 - RNA, 20 nt, Human
ggcuccucgagaucccaaca

SEQ ID NO: 3255177 - RNA, 18 nt, Human
ggccagcaccaucucuuu

SEQ ID NO: 3255178 - RNA, 13 nt, Human
ggaugucugggcc

SEQ ID NO: 3255179 - RNA, 23 nt, Human
ggcaggcaucggggagccgggag

SEQ ID NO: 3255180 - RNA, 15 nt, Human
ggagagacgggcccu

SEQ ID NO: 3255181 - RNA, 17 nt, Human
ggagagacgggcccugg

SEQ ID NO: 3255182 - RNA, 17 nt, Human
cagcacguguggccugu

SEQ ID NO: 3255183 - RNA, 17 nt, Human
caucuguaccucugccu

SEQ ID NO: 3255184 - RNA, 17 nt, Human
auucauggccuggggga

SEQ ID NO: 3255185 - RNA, 17 nt, Human
auuuuuaugccaccuga

SEQ ID NO: 3255186 - RNA, 18 nt, Human
caccuaggcuaggguggg

SEQ ID NO: 3255187 - RNA, 19 nt, Human
caccuaggcuagggugggg

SEQ ID NO: 3255188 - RNA, 17 nt, Human
caccuaggcuagggugg

SEQ ID NO: 3255189 - RNA, 19 nt, Human
ccugccuggaccagccucu

SEQ ID NO: 3255190 - RNA, 12 nt, Human
ccugccuggacc

SEQ ID NO: 3255191 - RNA, 23 nt, Human
ccucuuggggaguuuaggguggg

SEQ ID NO: 3255192 - RNA, 22 nt, Human
ccucuuggggaguuuagggugg

SEQ ID NO: 3255193 - RNA, 15 nt, Human
ccucuuggcugccuu

SEQ ID NO: 3255194 - RNA, 21 nt, Human
ccucugcccgggagcucagga

SEQ ID NO: 3255195 - RNA, 22 nt, Human
ccucugcccgggagcucaggaa

SEQ ID NO: 3255196 - RNA, 12 nt, Human
ccaugagcuccu

SEQ ID NO: 3255197 - RNA, 21 nt, Human
ccaugagcuccuuaaggcucu

SEQ ID NO: 3255198 - RNA, 13 nt, Human
ccauugguguuga

SEQ ID NO: 3255199 - RNA, 21 nt, Human
ccccgcguggaacucgugucu

SEQ ID NO: 3255200 - RNA, 22 nt, Human
cccccugugccuugucacgcca

SEQ ID NO: 3255201 - RNA, 23 nt, Human
ccagacuucccacggcuccucga

SEQ ID NO: 3255202 - RNA, 18 nt, Human
ccagagaaaaagggaggg

SEQ ID NO: 3255203 - RNA, 20 nt, Human
cucaggccugacucucagca

SEQ ID NO: 3255204 - RNA, 23 nt, Human
cucaggccgaaggaggagucagg

SEQ ID NO: 3255205 - RNA, 23 nt, Human
cucaugauagaaggcuaugggga

SEQ ID NO: 3255206 - RNA, 22 nt, Human
cuccucugcccgggagcucagg

SEQ ID NO: 3255207 - RNA, 24 nt, Human
cuccucugcccgggagcucaggaa

SEQ ID NO: 3255208 - RNA, 16 nt, Human
cuccugucucccuccu

SEQ ID NO: 3255209 - RNA, 20 nt, Human
gggcagucugagagaggcca

SEQ ID NO: 3255210 - RNA, 21 nt, Human
gggcagucugagagaggccau

SEQ ID NO: 3255211 - RNA, 13 nt, Human
gggccugggcagg

SEQ ID NO: 3255212 - RNA, 15 nt, Human
gggccugggcaggag

SEQ ID NO: 3255213 - RNA, 12 nt, Human
gggccugggcag

SEQ ID NO: 3255214 - RNA, 13 nt, Human
gggauagaugugu

SEQ ID NO: 3255215 - RNA, 14 nt, Human
gggauagaugugug

SEQ ID NO: 3255216 - RNA, 16 nt, Human
gggaguuuaggguggg

SEQ ID NO: 3255217 - RNA, 11 nt, Human
gggagugugua

SEQ ID NO: 3255218 - RNA, 23 nt, Human
gggaggugcuucuaguucugcca

SEQ ID NO: 3255219 - RNA, 18 nt, Human
gggcagucugagagaggc

SEQ ID NO: 3255220 - RNA, 19 nt, Human
gggcagucugagagaggcc

SEQ ID NO: 3255221 - RNA, 17 nt, Human
gggcagucugagagagg

SEQ ID NO: 3255222 - RNA, 15 nt, Human
gggaaggaucccaug

SEQ ID NO: 3255223 - RNA, 15 nt, Human
gggggagagggcugc

SEQ ID NO: 3255224 - RNA, 16 nt, Human
gggccugggcaggagg

SEQ ID NO: 3255225 - RNA, 17 nt, Human
gggccugggcaggaggg

SEQ ID NO: 3255226 - RNA, 15 nt, Human
ggggcgcggcuggga

SEQ ID NO: 3255227 - RNA, 16 nt, Human
ggggcgcggcugggag

SEQ ID NO: 3255228 - RNA, 19 nt, Human
ggggcagucugagagaggc

SEQ ID NO: 3255229 - RNA, 18 nt, Human
ggggcagucugagagagg

SEQ ID NO: 3255230 - RNA, 15 nt, Human
ggggcagucugagag

SEQ ID NO: 3255231 - RNA, 15 nt, Human
ggugguggcucggga

SEQ ID NO: 3255232 - RNA, 21 nt, Human
gguguccugcaccggggccug

SEQ ID NO: 3255233 - RNA, 17 nt, Human
ggaaggaucccaugagc

SEQ ID NO: 3255234 - RNA, 13 nt, Human
ggauagaugugug

SEQ ID NO: 3255235 - RNA, 14 nt, Human
ggauagaugugugg

SEQ ID NO: 3255236 - RNA, 15 nt, Human
ggauagaugugugga

SEQ ID NO: 3255237 - RNA, 12 nt, Human
ggagggauuugg

SEQ ID NO: 3255238 - RNA, 13 nt, Human
ggagggcaggcau

SEQ ID NO: 3255239 - RNA, 14 nt, Human
ggaggagggcaggc

SEQ ID NO: 3255240 - RNA, 15 nt, Human
ggaggagggcaggca

SEQ ID NO: 3255241 - RNA, 20 nt, Human
ggaggagggcaggcaucggg

SEQ ID NO: 3255242 - RNA, 16 nt, Human
ggagccgggagccuga

SEQ ID NO: 3255243 - RNA, 17 nt, Human
ggaucccaugagcuccu

SEQ ID NO: 3255244 - RNA, 20 nt, Human
ggaucccaugagcuccuuaa

SEQ ID NO: 3255245 - RNA, 20 nt, Human
ggcagucugagagaggccau

SEQ ID NO: 3255246 - RNA, 17 nt, Human
gcugggaggagggcagg

SEQ ID NO: 3255247 - RNA, 23 nt, Human
gcugggacaccccgacuuuuguu

SEQ ID NO: 3255248 - RNA, 13 nt, Human
gcuggaucuguga

SEQ ID NO: 3255249 - RNA, 15 nt, Human
gcugccuuuggacuu

SEQ ID NO: 3255250 - RNA, 20 nt, Human
gcugccuuuggacuuguccc

SEQ ID NO: 3255251 - RNA, 17 nt, Human
ggaacucgugucuggca

SEQ ID NO: 3255252 - RNA, 15 nt, Human
ggaaccgaggcaggg

SEQ ID NO: 3255253 - RNA, 16 nt, Human
ggaaccgaggcaggga

SEQ ID NO: 3255254 - RNA, 20 nt, Human
ggaaccgaggcagggaagga

SEQ ID NO: 3255255 - RNA, 19 nt, Human
gcuucuaguucugccagga

SEQ ID NO: 3255256 - RNA, 20 nt, Human
gcuucuaguucugccaggag

SEQ ID NO: 3255257 - RNA, 21 nt, Human
gcuucuaguucugccaggaga

SEQ ID NO: 3255258 - RNA, 18 nt, Human
gcuucuaguucugccagg

SEQ ID NO: 3255259 - RNA, 13 nt, Human
gccccgcguggaa

SEQ ID NO: 3255260 - RNA, 21 nt, Human
gccagacuucccacggcuccu

SEQ ID NO: 3255261 - RNA, 17 nt, Human
gccuaaccugccgagag

SEQ ID NO: 3255262 - RNA, 13 nt, Human
gccgggagccuga

SEQ ID NO: 3255263 - RNA, 14 nt, Human
gccgggagccugac

SEQ ID NO: 3255264 - RNA, 19 nt, Human
gccgggagccugacccuca

SEQ ID NO: 3255265 - RNA, 21 nt, Human
gccgagaguccaucagccucc

SEQ ID NO: 3255266 - RNA, 15 nt, Human
gcaggagggaggugc

SEQ ID NO: 3255267 - RNA, 12 nt, Human
gcacagccuggc

SEQ ID NO: 3255268 - RNA, 19 nt, Human
gcacagccuggcuguggcc

SEQ ID NO: 3255269 - RNA, 21 nt, Human
gaguguguaauuuaaaauugu

SEQ ID NO: 3255270 - RNA, 22 nt, Human
gaguguguaauuuaaaauugug

SEQ ID NO: 3255271 - RNA, 18 nt, Human
gacuucccacggcuccuc

SEQ ID NO: 3255272 - RNA, 17 nt, Human
gaagagaagggcagggc

SEQ ID NO: 3255273 - RNA, 13 nt, Human
gaagcguuguccu

SEQ ID NO: 3255274 - RNA, 19 nt, Human
gaagcguuguccucagccc

SEQ ID NO: 3255275 - RNA, 20 nt, Human
gaagcguuguccucagcccc

SEQ ID NO: 3255276 - RNA, 14 nt, Human
cuuccuuccucucc

SEQ ID NO: 3255277 - RNA, 21 nt, Human
cugaagagaagggcagggcug

SEQ ID NO: 3255278 - RNA, 22 nt, Human
cuccuuaaggcucuuuuguaag

SEQ ID NO: 3255279 - RNA, 13 nt, Human
cuccuuaaggcuc

SEQ ID NO: 3255280 - RNA, 17 nt, Human
cucauuccagaggaagg

SEQ ID NO: 3255281 - RNA, 15 nt, Human
cucauuccagaggaa

SEQ ID NO: 3255282 - RNA, 17 nt, Human
cuccauugguguugaca

SEQ ID NO: 3255283 - RNA, 12 nt, Human
cuggaccagccu

SEQ ID NO: 3255284 - RNA, 14 nt, Human
cuggcacagccugg

SEQ ID NO: 3255285 - RNA, 16 nt, Human
cugccaggagacaggu

SEQ ID NO: 3255286 - RNA, 20 nt, Human
cugccagcauuucccuuccu

SEQ ID NO: 3255287 - RNA, 15 nt, Human
ccuggaccagccucu

SEQ ID NO: 3255288 - RNA, 16 nt, Human
ccuggaccagccucuc

SEQ ID NO: 3255289 - RNA, 14 nt, Human
ccuggaccagccuc

SEQ ID NO: 3255290 - RNA, 19 nt, Human
cgucagcugggacaccccg

SEQ ID NO: 3255291 - RNA, 16 nt, Human
cgggagcucaggaacc

SEQ ID NO: 3255292 - RNA, 22 nt, Human
cggcugggaggagggcaggcau

SEQ ID NO: 3255293 - RNA, 18 nt, Human
cggcugggaggagggcag

SEQ ID NO: 3255294 - RNA, 23 nt, Human
cggcugggaggagggcaggcauc

SEQ ID NO: 3255295 - RNA, 21 nt, Human
cgauugcaggagucccugcca

SEQ ID NO: 3255296 - RNA, 23 nt, Human
cgauugcaggagucccugccauc

SEQ ID NO: 3255297 - RNA, 23 nt, Human
ccucuccacucaugugacucuuu

SEQ ID NO: 3255298 - RNA, 14 nt, Human
ccuccucugcccgg

SEQ ID NO: 3255299 - RNA, 15 nt, Human
ccuccucugcccggg

SEQ ID NO: 3255300 - RNA, 22 nt, Human
ccgacuuuuguuuaccagagaa

SEQ ID NO: 3255301 - RNA, 19 nt, Human
cauugucccugaagagaag

SEQ ID NO: 3255302 - RNA, 16 nt, Human
ccaaacaggcucagag

SEQ ID NO: 3255303 - RNA, 14 nt, Human
ccaacacugccagc

SEQ ID NO: 3255304 - RNA, 15 nt, Human
ccaacacugccagca

SEQ ID NO: 3255305 - RNA, 16 nt, Human
ccaacacugccagcau

SEQ ID NO: 3255306 - RNA, 13 nt, Human
ccaacacugccag

SEQ ID NO: 3255307 - RNA, 19 nt, Human
ccaagccuuggcucuaccc

SEQ ID NO: 3255308 - RNA, 16 nt, Human
ccacacccucacugcu

SEQ ID NO: 3255309 - RNA, 20 nt, Human
ccacacagacuugggcaggg

SEQ ID NO: 3255310 - RNA, 21 nt, Human
ccacgucagcugggacacccc

SEQ ID NO: 3255311 - RNA, 13 nt, Human
cccaacaccucuu

SEQ ID NO: 3255312 - RNA, 13 nt, Human
ccaucagccucca

SEQ ID NO: 3255313 - RNA, 19 nt, Human
uuuagaagaagugugucac

SEQ ID NO: 3255314 - RNA, 17 nt, Human
uuuagaagaaguguguc

SEQ ID NO: 3255315 - RNA, 23 nt, Human
uguguaugugggggucugugugu

SEQ ID NO: 3255316 - RNA, 14 nt, Human
uguguauguggggg

SEQ ID NO: 3255317 - RNA, 13 nt, Human
uguguaugugggg

SEQ ID NO: 3255318 - RNA, 11 nt, Human
uguguguaugu

SEQ ID NO: 3255319 - RNA, 15 nt, Human
uguguuuaugugugu

SEQ ID NO: 3255320 - RNA, 13 nt, Human
uguguuuaugugu

SEQ ID NO: 3255321 - RNA, 14 nt, Human
uguguugugugugg

SEQ ID NO: 3255322 - RNA, 23 nt, Human
uguguugugugugggagugugua

SEQ ID NO: 3255323 - RNA, 14 nt, Human
uguuuacagaggac

SEQ ID NO: 3255324 - RNA, 21 nt, Human
uguuuacagaggacaguauuu

SEQ ID NO: 3255325 - RNA, 15 nt, Human
uuacagaggacagua

SEQ ID NO: 3255326 - RNA, 16 nt, Human
ugugggggucugugug

SEQ ID NO: 3255327 - RNA, 14 nt, Human
ugugggucugugug

SEQ ID NO: 3255328 - RNA, 16 nt, Human
ugugggucugugugug

SEQ ID NO: 3255329 - RNA, 18 nt, Human
ugugaggggcucucucau

SEQ ID NO: 3255330 - RNA, 15 nt, Human
uguaaauuuauguga

SEQ ID NO: 3255331 - RNA, 16 nt, Human
uguaaauuuaugugau

SEQ ID NO: 3255332 - RNA, 14 nt, Human
ugucacgccagacu

SEQ ID NO: 3255333 - RNA, 18 nt, Human
ugcuucuaguucugccag

SEQ ID NO: 3255334 - RNA, 19 nt, Human
ugcuucuaguucugccagg

SEQ ID NO: 3255335 - RNA, 20 nt, Human
ugcuucuaguucugccagga

SEQ ID NO: 3255336 - RNA, 21 nt, Human
uggaagugugggucugugugu

SEQ ID NO: 3255337 - RNA, 20 nt, Human
uggaagugugggucugugug

SEQ ID NO: 3255338 - RNA, 23 nt, Human
uggaagugugggucugugugugu

SEQ ID NO: 3255339 - RNA, 18 nt, Human
uggggcaggggccggggg

SEQ ID NO: 3255340 - RNA, 16 nt, Human
uggggcaggggccggg

SEQ ID NO: 3255341 - RNA, 19 nt, Human
uaauucuuugaccuguugg

SEQ ID NO: 3255342 - RNA, 11 nt, Human
uagaugugugg

SEQ ID NO: 3255343 - RNA, 15 nt, Human
uaggaacugcugggc

SEQ ID NO: 3255344 - RNA, 18 nt, Human
uaggaacugcugggcuug

SEQ ID NO: 3255345 - RNA, 15 nt, Human
uaucagcacgugugg

SEQ ID NO: 3255346 - RNA, 22 nt, Human
uagugauuuuuaugccaccuga

SEQ ID NO: 3255347 - RNA, 20 nt, Human
uagugauuuuuaugccaccu

SEQ ID NO: 3255348 - RNA, 21 nt, Human
uagugauuuuuaugccaccug

SEQ ID NO: 3255349 - RNA, 13 nt, Human
uaggcuagggugg

SEQ ID NO: 3255350 - RNA, 15 nt, Human
ucuguguguguguau

SEQ ID NO: 3255351 - RNA, 18 nt, Human
ucuguguguguguaugug

SEQ ID NO: 3255352 - RNA, 19 nt, Human
ucuguguguguguaugugg

SEQ ID NO: 3255353 - RNA, 21 nt, Human
ucuguguguguguaugugggg

SEQ ID NO: 3255354 - RNA, 13 nt, Human
ucugugugugugu

SEQ ID NO: 3255355 - RNA, 15 nt, Human
ucuguguguuuaugu

SEQ ID NO: 3255356 - RNA, 16 nt, Human
ucuguguguuuaugug

SEQ ID NO: 3255357 - RNA, 22 nt, Human
ucuguguguguguauguggggg

SEQ ID NO: 3255358 - RNA, 19 nt, Human
ucuguguguuuaugugugu

SEQ ID NO: 3255359 - RNA, 20 nt, Human
ucuguguguuuaugugugug

SEQ ID NO: 3255360 - RNA, 19 nt, Human
ucuuuuguaagguuuuugu

SEQ ID NO: 3255361 - RNA, 18 nt, Human
ucucccuccucugcccgg

SEQ ID NO: 3255362 - RNA, 19 nt, Human
uccuuaaggcucuuuugua

SEQ ID NO: 3255363 - RNA, 16 nt, Human
uccuuaaggcucuuuu

SEQ ID NO: 3255364 - RNA, 18 nt, Human
ucacgccagacuucccac

SEQ ID NO: 3255365 - RNA, 17 nt, Sin Nombre virus
ccagauuauauucacau

SEQ ID NO: 3255366 - RNA, 23 nt, Sin Nombre virus
acuaaucaggguuuauugcacua

SEQ ID NO: 3255367 - RNA, 20 nt, Sin Nombre virus
aauuuuuauuuuuauacaag

SEQ ID NO: 3255368 - RNA, 16 nt, Sin Nombre virus
uuguuaaguuguauua

SEQ ID NO: 3255369 - RNA, 23 nt, Sin Nombre virus
acuaacacugugacucuguaaag

SEQ ID NO: 3255370 - RNA, 16 nt, Sin Nombre virus
aaccaugacuuguucu

SEQ ID NO: 3255371 - RNA, 17 nt, Sin Nombre virus
acaacaaucuaccucau

SEQ ID NO: 3255372 - RNA, 15 nt, Sin Nombre virus
aguguuauuguagua

SEQ ID NO: 3255373 - RNA, 20 nt, Sin Nombre virus
guaaauucuugauugcuuuu

SEQ ID NO: 3255374 - RNA, 20 nt, Sin Nombre virus
cuuuauuccaaaccaugacu

SEQ ID NO: 3255375 - RNA, 16 nt, Sin Nombre virus
gcucuguucucggagc

SEQ ID NO: 3255376 - RNA, 18 nt, Sin Nombre virus
caucauuaaucaggguuu

SEQ ID NO: 3255377 - RNA, 14 nt, Sin Nombre virus
aauaguacaugaca

SEQ ID NO: 3255378 - RNA, 14 nt, Sin Nombre virus
auuaagucauaugu

SEQ ID NO: 3255379 - RNA, 19 nt, Sin Nombre virus
uuaaaucuuguuaaguuug

SEQ ID NO: 3255380 - RNA, 17 nt, Sin Nombre virus
ggcacuaaucaggguuu

SEQ ID NO: 3255381 - RNA, 16 nt, Sin Nombre virus
cuuauuacgaggcuuu

SEQ ID NO: 3255382 - RNA, 17 nt, Sin Nombre virus
auauguauguucuuaua

SEQ ID NO: 3255383 - RNA, 18 nt, Sin Nombre virus
acaaaacuaccucauuau

SEQ ID NO: 3255384 - RNA, 19 nt, Sin Nombre virus
aguauuaagucauauguau

SEQ ID NO: 3255385 - RNA, 22 nt, Sin Nombre virus
cauuaaucaggguuuauaaaau

SEQ ID NO: 3255386 - RNA, 20 nt, Sin Nombre virus
acuuguucucucuacugcuc

SEQ ID NO: 3255387 - RNA, 19 nt, Sin Nombre virus
uuauauucacaucuguaua

SEQ ID NO: 3255388 - RNA, 17 nt, Sin Nombre virus
ugauaguauuaagucau

SEQ ID NO: 3255389 - RNA, 15 nt, Sin Nombre virus
uauaaguaaauucuu

SEQ ID NO: 3255390 - RNA, 21 nt, Sin Nombre virus
cucuacugcucuguucucgga

SEQ ID NO: 3255391 - RNA, 19 nt, Sin Nombre virus
cugcucuguucucggagca

SEQ ID NO: 3255392 - RNA, 20 nt, Sin Nombre virus
acugcucuguucucggagca

SEQ ID NO: 3255393 - RNA, 13 nt, Sin Nombre virus
ucuacugcucugu

SEQ ID NO: 3255394 - RNA, 23 nt, Sin Nombre virus
gcucuguucucggagcauacuac

SEQ ID NO: 3255395 - RNA, 15 nt, Sin Nombre virus
uccaaaccaugacuu

SEQ ID NO: 3255396 - RNA, 22 nt, Sin Nombre virus
caugacuuguucucucuacugc

SEQ ID NO: 3255397 - RNA, 21 nt, Sin Nombre virus
auuauauucacaucuguauau

SEQ ID NO: 3255398 - RNA, 17 nt, Sin Nombre virus
uucgguaagucuguuaa

SEQ ID NO: 3255399 - RNA, 18 nt, Sin Nombre virus
aauaagauuuauauacau

SEQ ID NO: 3255400 - RNA, 17 nt, Sin Nombre virus
aguauuguauuauguau

SEQ ID NO: 3255401 - RNA, 14 nt, Sin Nombre virus
ugugacucuguaaa

SEQ ID NO: 3255402 - RNA, 17 nt, Sin Nombre virus
ugugagcaagaguauga

SEQ ID NO: 3255403 - RNA, 23 nt, Sin Nombre virus
uuaucuguuuaaugcuaagucua

SEQ ID NO: 3255404 - RNA, 21 nt, Sin Nombre virus
agauuauauucacaucuguau

SEQ ID NO: 3255405 - RNA, 10 nt, Sin Nombre virus
uacugcucug

SEQ ID NO: 3255406 - RNA, 16 nt, Sin Nombre virus
auuuuaucaacucauu

SEQ ID NO: 3255407 - RNA, 18 nt, Sin Nombre virus
ucuauauuguuuaguguu

SEQ ID NO: 3255408 - RNA, 23 nt, Sin Nombre virus
acuaggguggguucaagggccaa

SEQ ID NO: 3255409 - RNA, 14 nt, Sin Nombre virus
ggcacuaaucaggg

SEQ ID NO: 3255410 - RNA, 15 nt, Sin Nombre virus
ccaaaccaugacuug

SEQ ID NO: 3255411 - RNA, 16 nt, Sin Nombre virus
aaaccaugacuuguuc

SEQ ID NO: 3255412 - RNA, 19 nt, Sin Nombre virus
aauugauuucuucauuaca

SEQ ID NO: 3255413 - RNA, 22 nt, Sin Nombre virus
uuuauuccaaaccaugacuugu

SEQ ID NO: 3255414 - RNA, 17 nt, Sin Nombre virus
aucuugauaguauuaag

SEQ ID NO: 3255415 - RNA, 20 nt, Sin Nombre virus
cacuaggguggguucaaggg

SEQ ID NO: 3255416 - RNA, 14 nt, Sin Nombre virus
uacugcucuguucu

SEQ ID NO: 3255417 - RNA, 15 nt, Sin Nombre virus
uauuccaaaccauga

SEQ ID NO: 3255418 - RNA, 14 nt, Sin Nombre virus
uaaaucuuguuaag

SEQ ID NO: 3255419 - RNA, 17 nt, Sin Nombre virus
acuuguucucucuacug

SEQ ID NO: 3255420 - RNA, 23 nt, Sin Nombre virus
gacuuguucucucuacugcucug

SEQ ID NO: 3255421 - RNA, 13 nt, Sin Nombre virus
aucaacucauuau

SEQ ID NO: 3255422 - RNA, 20 nt, Sin Nombre virus
cucuguucucggagcauacu

SEQ ID NO: 3255423 - RNA, 14 nt, Sin Nombre virus
augacuuguucucu

SEQ ID NO: 3255424 - RNA, 16 nt, Sin Nombre virus
guuaaguuuuguuaag

SEQ ID NO: 3255425 - RNA, 16 nt, Sin Nombre virus
aacaaucuaccucauu

SEQ ID NO: 3255426 - RNA, 22 nt, Sin Nombre virus
ucuuuauuccaaaccaugacuu

SEQ ID NO: 3255427 - RNA, 12 nt, Sin Nombre virus
cauuaacagcua

SEQ ID NO: 3255428 - RNA, 17 nt, Sin Nombre virus
uauuaaguuuuguuaag

SEQ ID NO: 3255429 - RNA, 22 nt, Sin Nombre virus
uauucacaucuguauauaugga

SEQ ID NO: 3255430 - RNA, 18 nt, Sin Nombre virus
caucuguauauauggaug

SEQ ID NO: 3255431 - RNA, 15 nt, Sin Nombre virus
aaugcuaagucuaua

SEQ ID NO: 3255432 - RNA, 13 nt, Sin Nombre virus
accaugacuuguu

SEQ ID NO: 3255433 - RNA, 23 nt, Sin Nombre virus
ccaaaccaugacuuguucucucu

SEQ ID NO: 3255434 - RNA, 18 nt, Sin Nombre virus
uuaagcuuauuaaaucuu

SEQ ID NO: 3255435 - RNA, 15 nt, Sin Nombre virus
uaagucuguuaaaug

SEQ ID NO: 3255436 - RNA, 13 nt, Sin Nombre virus
uauauauggaugu

SEQ ID NO: 3255437 - RNA, 14 nt, Sin Nombre virus
cccuauuaccucaa

SEQ ID NO: 3255438 - RNA, 15 nt, Sin Nombre virus
acugcucuguucucg

SEQ ID NO: 3255439 - RNA, 14 nt, Sin Nombre virus
caauuauaucacag

SEQ ID NO: 3255440 - RNA, 12 nt, Sin Nombre virus
cucggagcauac

SEQ ID NO: 3255441 - RNA, 16 nt, Sin Nombre virus
aauuuuuauuuuuaua

SEQ ID NO: 3255442 - RNA, 21 nt, Sin Nombre virus
agcuaaaaaaaacaaauccuu

SEQ ID NO: 3255443 - RNA, 14 nt, Sin Nombre virus
caaaacuaccucau

SEQ ID NO: 3255444 - RNA, 14 nt, Sin Nombre virus
agcuuauuaaaucu

SEQ ID NO: 3255445 - RNA, 21 nt, Sin Nombre virus
guucaagggccaauuauauca

SEQ ID NO: 3255446 - RNA, 10 nt, Sin Nombre virus
cauuaacagc

SEQ ID NO: 3255447 - RNA, 15 nt, Sin Nombre virus
auuaaguuuuguuaa

SEQ ID NO: 3255448 - RNA, 15 nt, Sin Nombre virus
gacuuguucucucua

SEQ ID NO: 3255449 - RNA, 21 nt, Sin Nombre virus
auuacgaggcuuuuguuccug

SEQ ID NO: 3255450 - RNA, 13 nt, Sin Nombre virus
ucucuacugcucu

SEQ ID NO: 3255451 - RNA, 13 nt, Sin Nombre virus
uuuauaaaauuuu

SEQ ID NO: 3255452 - RNA, 20 nt, Sin Nombre virus
uauaucaauaacauuuguau

SEQ ID NO: 3255453 - RNA, 21 nt, Sin Nombre virus
acuuguucucucuacugcucu

SEQ ID NO: 3255454 - RNA, 17 nt, Sin Nombre virus
acauuuguauauuccca

SEQ ID NO: 3255455 - RNA, 22 nt, Sin Nombre virus
cauagauuuauuuuauauacau

SEQ ID NO: 3255456 - RNA, 13 nt, Sin Nombre virus
ugcuuuucaagga

SEQ ID NO: 3255457 - RNA, 13 nt, Sin Nombre virus
uauauuggaagau

SEQ ID NO: 3255458 - RNA, 14 nt, Sin Nombre virus
uuguauuaaguuuu

SEQ ID NO: 3255459 - RNA, 18 nt, Sin Nombre virus
aaccaugacuuguucucu

SEQ ID NO: 3255460 - RNA, 17 nt, Sin Nombre virus
uauuaaaucuuguuaag

SEQ ID NO: 3255461 - RNA, 20 nt, Sin Nombre virus
auucccauaaccgaaauauu

SEQ ID NO: 3255462 - RNA, 21 nt, Sin Nombre virus
auuaaccguucaaacuggaac

SEQ ID NO: 3255463 - RNA, 17 nt, Sin Nombre virus
uuucauuauauguaugu

SEQ ID NO: 3255464 - RNA, 16 nt, Sin Nombre virus
aucccuauauuggaag

SEQ ID NO: 3255465 - RNA, 15 nt, Sin Nombre virus
ucuuuauuccaaacc

SEQ ID NO: 3255466 - RNA, 13 nt, Sin Nombre virus
augcuaagucuau

SEQ ID NO: 3255467 - RNA, 20 nt, Sin Nombre virus
uaacuaacccauuaacagcu

SEQ ID NO: 3255468 - RNA, 16 nt, Sin Nombre virus
uaagucuguuaaaugu

SEQ ID NO: 3255469 - RNA, 23 nt, Sin Nombre virus
acuuguucucucuacugcucugu

SEQ ID NO: 3255470 - RNA, 16 nt, Sin Nombre virus
gaggcuuuuguuccug

SEQ ID NO: 3255471 - RNA, 15 nt, Sin Nombre virus
guuuuguuaaguugu

SEQ ID NO: 3255472 - RNA, 22 nt, Sin Nombre virus
uguaugggggguguuuaguguu

SEQ ID NO: 3255473 - RNA, 14 nt, Sin Nombre virus
uaguguuaagucau

SEQ ID NO: 3255474 - RNA, 21 nt, Sin Nombre virus
uguauauauggauguaaauuu

SEQ ID NO: 3255475 - RNA, 16 nt, Sin Nombre virus
caacaaucuaccucau

SEQ ID NO: 3255476 - RNA, 17 nt, Sin Nombre virus
cuuaacaccuauauaau

SEQ ID NO: 3255477 - RNA, 16 nt, Sin Nombre virus
uuguaguauuguauua

SEQ ID NO: 3255478 - RNA, 19 nt, Sin Nombre virus
uauauaaucccauuugcuu

SEQ ID NO: 3255479 - RNA, 17 nt, Sin Nombre virus
acugugacucuguaaag

SEQ ID NO: 3255480 - RNA, 22 nt, Sin Nombre virus
acuuguucucucuacugcucug

SEQ ID NO: 3255481 - RNA, 15 nt, Sin Nombre virus
auuaaaucuuguuaa

SEQ ID NO: 3255482 - RNA, 20 nt, Sin Nombre virus
uguuaaauguaguuaaucuu

SEQ ID NO: 3255483 - RNA, 17 nt, Sin Nombre virus
gcucuguucucggagca

SEQ ID NO: 3255484 - RNA, 12 nt, Sin Nombre virus
cugcucuguucu

SEQ ID NO: 3255485 - RNA, 17 nt, Sin Nombre virus
ugacuuguucucucuac

SEQ ID NO: 3255486 - RNA, 13 nt, Sin Nombre virus
acugcucuguucu

SEQ ID NO: 3255487 - RNA, 23 nt, Sin Nombre virus
uuucuuuauuccaaaccaugacu

SEQ ID NO: 3255488 - RNA, 16 nt, Sin Nombre virus
guuucgguaagucugu

SEQ ID NO: 3255489 - RNA, 23 nt, Sin Nombre virus
aauuauaucacaggguauauaau

SEQ ID NO: 3255490 - RNA, 13 nt, Sin Nombre virus
auguauguucuua

SEQ ID NO: 3255491 - RNA, 12 nt, Sin Nombre virus
cuauuaccucaa

SEQ ID NO: 3255492 - RNA, 18 nt, Sin Nombre virus
auauucacaucuguauau

SEQ ID NO: 3255493 - RNA, 19 nt, Sin Nombre virus
gacacuaaugcuugcuuug

SEQ ID NO: 3255494 - RNA, 19 nt, Sin Nombre virus
cucucaucauuaaucaggg

SEQ ID NO: 3255495 - RNA, 14 nt, Sin Nombre virus
acaacauuauuuca

SEQ ID NO: 3255496 - RNA, 21 nt, Sin Nombre virus
aucaacuuauauucagggcau

SEQ ID NO: 3255497 - RNA, 23 nt, Sin Nombre virus
caugacuuguucucucuacugcu

SEQ ID NO: 3255498 - RNA, 15 nt, Sin Nombre virus
uucucucuacugcuc

SEQ ID NO: 3255499 - RNA, 14 nt, Sin Nombre virus
cucuacugcucugu

SEQ ID NO: 3255500 - RNA, 20 nt, Sin Nombre virus
gcuuauuaaaucuuguuaag

SEQ ID NO: 3255501 - RNA, 24 nt, Sin Nombre virus
cauaaccgaaauauuuauacuaau

SEQ ID NO: 3255502 - RNA, 16 nt, Sin Nombre virus
auaucaauaacauuug

SEQ ID NO: 3255503 - RNA, 19 nt, Sin Nombre virus
aaucaaaauaagauuuaua

SEQ ID NO: 3255504 - RNA, 21 nt, Sin Nombre virus
uguuaaguuucgguaagucug

SEQ ID NO: 3255505 - RNA, 14 nt, Sin Nombre virus
aaucaggguuuaua

SEQ ID NO: 3255506 - RNA, 23 nt, Sin Nombre virus
aucuugauaguauuaagucauau

SEQ ID NO: 3255507 - RNA, 20 nt, Sin Nombre virus
auuuuuauuuuuauacaagu

SEQ ID NO: 3255508 - RNA, 15 nt, Sin Nombre virus
auuccaaaccaugac

SEQ ID NO: 3255509 - RNA, 18 nt, Sin Nombre virus
guaaucaacuuauauuca

SEQ ID NO: 3255510 - RNA, 17 nt, Sin Nombre virus
aacaaaacuaccucauu

SEQ ID NO: 3255511 - RNA, 21 nt, Sin Nombre virus
cuauauuguuuaguguuauug

SEQ ID NO: 3255512 - RNA, 19 nt, Sin Nombre virus
uuaaguuguauuaaguuuu

SEQ ID NO: 3255513 - RNA, 12 nt, Sin Nombre virus
caaaccaugacu

SEQ ID NO: 3255514 - RNA, 15 nt, Sin Nombre virus
uaagcuuauuaaauc

SEQ ID NO: 3255515 - RNA, 21 nt, Sin Nombre virus
uacugcucuguucucggagca

SEQ ID NO: 3255516 - RNA, 18 nt, Sin Nombre virus
uuuucuuuauuccaaacc

SEQ ID NO: 3255517 - RNA, 13 nt, Sin Nombre virus
gcuuuuguuccug

SEQ ID NO: 3255518 - RNA, 22 nt, Sin Nombre virus
caggucuaucccuauauuggaa

SEQ ID NO: 3255519 - RNA, 15 nt, Sin Nombre virus
ccguucaaacuggaa

SEQ ID NO: 3255520 - RNA, 16 nt, Sin Nombre virus
acaaauccuuaacacc

SEQ ID NO: 3255521 - RNA, 21 nt, Sin Nombre virus
uuguuaaguuuguuaaguuuu

SEQ ID NO: 3255522 - RNA, 21 nt, Sin Nombre virus
uuccaaaccaugacuuguucu

SEQ ID NO: 3255523 - RNA, 14 nt, Sin Nombre virus
ucucuacugcucug

SEQ ID NO: 3255524 - RNA, 20 nt, Sin Nombre virus
uuuuguuaaguuguauuaag

SEQ ID NO: 3255525 - RNA, 22 nt, Sin Nombre virus
caauuuucuuuauuccaaacca

SEQ ID NO: 3255526 - RNA, 15 nt, Sin Nombre virus
auuaaguuuuguuaa

SEQ ID NO: 3255527 - RNA, 18 nt, Sin Nombre virus
acauagauuuauuuuaua

SEQ ID NO: 3255528 - RNA, 19 nt, Sin Nombre virus
aaucaaaauaagauuuaua

SEQ ID NO: 3255529 - RNA, 11 nt, Sin Nombre virus
aaguuuguuaa

SEQ ID NO: 3255530 - RNA, 20 nt, Sin Nombre virus
auauaaucccauuugcuuau

SEQ ID NO: 3255531 - RNA, 19 nt, Human
cucucuggccuucggccuc

SEQ ID NO: 3255532 - RNA, 17 nt, Human
cucucuggccuucggcc

SEQ ID NO: 3255533 - RNA, 21 nt, Human
cuccagugagacagcucugca

SEQ ID NO: 3255534 - RNA, 23 nt, Human
cugaggaagagggacuguucuuu

SEQ ID NO: 3255535 - RNA, 18 nt, Human
cugaggaagagggacugu

SEQ ID NO: 3255536 - RNA, 13 nt, Human
cugaaagaggaau

SEQ ID NO: 3255537 - RNA, 17 nt, Human
cugaaagaggaaugaag

SEQ ID NO: 3255538 - RNA, 17 nt, Human
cucaccccuugccauaa

SEQ ID NO: 3255539 - RNA, 17 nt, Human
ccugucucuacuaaaaa

SEQ ID NO: 3255540 - RNA, 20 nt, Human
ccugccaucauguuuacaga

SEQ ID NO: 3255541 - RNA, 18 nt, Human
ccugccaucauguuuaca

SEQ ID NO: 3255542 - RNA, 16 nt, Human
ccucccuucucuucac

SEQ ID NO: 3255543 - RNA, 20 nt, Human
cccauauuuguacaccaaua

SEQ ID NO: 3255544 - RNA, 19 nt, Human
cauccauggggcugauugu

SEQ ID NO: 3255545 - RNA, 15 nt, Human
caggccugacucuca

SEQ ID NO: 3255546 - RNA, 17 nt, Human
cagggaggacgcucucu

SEQ ID NO: 3255547 - RNA, 18 nt, Human
cagggaggacgcucucug

SEQ ID NO: 3255548 - RNA, 18 nt, Human
cagccugagcgacaguga

SEQ ID NO: 3255549 - RNA, 19 nt, Human
cagccugagcgacagugag

SEQ ID NO: 3255550 - RNA, 21 nt, Human
auuuuauaucaauuuaaaaaa

SEQ ID NO: 3255551 - RNA, 19 nt, Human
caagacccaaaaggcagaa

SEQ ID NO: 3255552 - RNA, 15 nt, Human
cacuuaaaaaugguu

SEQ ID NO: 3255553 - RNA, 11 nt, Human
cagaacaguga

SEQ ID NO: 3255554 - RNA, 12 nt, Human
cagaacagugau

SEQ ID NO: 3255555 - RNA, 17 nt, Human
cagaacagugauuacca

SEQ ID NO: 3255556 - RNA, 23 nt, Human
cacuccagccugagcgacaguga

SEQ ID NO: 3255557 - RNA, 13 nt, Human
cacuccagccuga

SEQ ID NO: 3255558 - RNA, 12 nt, Human
cacuccagccug

SEQ ID NO: 3255559 - RNA, 20 nt, Human
gccuucggccuccauccuga

SEQ ID NO: 3255560 - RNA, 19 nt, Human
gccuucggccuccauccug

SEQ ID NO: 3255561 - RNA, 21 nt, Human
gccuucggccuccauccugag

SEQ ID NO: 3255562 - RNA, 22 nt, Human
gcuaauucuuugaccuguuggg

SEQ ID NO: 3255563 - RNA, 16 nt, Human
gcuagaacucccuuuc

SEQ ID NO: 3255564 - RNA, 12 nt, Human
gcuagaacuccc

SEQ ID NO: 3255565 - RNA, 13 nt, Human
gcuagaacucccu

SEQ ID NO: 3255566 - RNA, 14 nt, Human
gcuagaacucccuu

SEQ ID NO: 3255567 - RNA, 15 nt, Human
gcuagaacucccuuu

SEQ ID NO: 3255568 - RNA, 21 nt, Human
gcucugcccauccugccccug

SEQ ID NO: 3255569 - RNA, 15 nt, Human
gcuccacuuggucug

SEQ ID NO: 3255570 - RNA, 18 nt, Human
gcuccacuuggucuguga

SEQ ID NO: 3255571 - RNA, 13 nt, Human
ggagaaacuggaa

SEQ ID NO: 3255572 - RNA, 20 nt, Human
ggaacugcugggcuuggcag

SEQ ID NO: 3255573 - RNA, 15 nt, Human
ggaacugcugggcuu

SEQ ID NO: 3255574 - RNA, 12 nt, Human
ggaagugugggu

SEQ ID NO: 3255575 - RNA, 22 nt, Human
ggaagugugggucugugugugu

SEQ ID NO: 3255576 - RNA, 21 nt, Human
ggaagugugggucugugugug

SEQ ID NO: 3255577 - RNA, 14 nt, Human
ggccuccauccuga

SEQ ID NO: 3255578 - RNA, 15 nt, Human
ggccuccauccugag

SEQ ID NO: 3255579 - RNA, 13 nt, Human
ggccuccauccug

SEQ ID NO: 3255580 - RNA, 15 nt, Human
ggcagggcugaggcc

SEQ ID NO: 3255581 - RNA, 14 nt, Human
ggcucagagugggg

SEQ ID NO: 3255582 - RNA, 14 nt, Human
ggcuccacuugguc

SEQ ID NO: 3255583 - RNA, 15 nt, Human
aaaacuucagacaua

SEQ ID NO: 3255584 - RNA, 17 nt, Human
aaaaaugguuuaaaugg

SEQ ID NO: 3255585 - RNA, 19 nt, Human
aaacuucagacauagaauu

SEQ ID NO: 3255586 - RNA, 15 nt, Human
aaagaggaaugaagu

SEQ ID NO: 3255587 - RNA, 14 nt, Human
aaacaguagugaua

SEQ ID NO: 3255588 - RNA, 15 nt, Human
guagagccagagguc

SEQ ID NO: 3255589 - RNA, 20 nt, Human
guaauuuaaaauugugaugu

SEQ ID NO: 3255590 - RNA, 19 nt, Human
guaauuuaaaauugugaug

SEQ ID NO: 3255591 - RNA, 23 nt, Human
guaauuuaaaauugugauguguc

SEQ ID NO: 3255592 - RNA, 23 nt, Human
aaaguucugcagauaaacaguag

SEQ ID NO: 3255593 - RNA, 20 nt, Human
aaagguauuuuaaucaccaa

SEQ ID NO: 3255594 - RNA, 13 nt, Human
gagcgacagugag

SEQ ID NO: 3255595 - RNA, 15 nt, Human
gagcgacagugagac

SEQ ID NO: 3255596 - RNA, 14 nt, Human
gacagaaagcagaa

SEQ ID NO: 3255597 - RNA, 20 nt, Human
gacagaaagcagaacaguga

SEQ ID NO: 3255598 - RNA, 17 nt, Human
gacgcucucuggccuuc

SEQ ID NO: 3255599 - RNA, 15 nt, Human
gacuauggagcugag

SEQ ID NO: 3255600 - RNA, 15 nt, Human
gcagcuuauucacaa

SEQ ID NO: 3255601 - RNA, 21 nt, Human
cuuaaaaaugguuuaaauggu

SEQ ID NO: 3255602 - RNA, 15 nt, Human
cuuaggccagcacca

SEQ ID NO: 3255603 - RNA, 16 nt, Human
cugugccuuuugccau

SEQ ID NO: 3255604 - RNA, 18 nt, Human
cugggaauaagugccagg

SEQ ID NO: 3255605 - RNA, 16 nt, Human
cuggggaugucucuca

SEQ ID NO: 3255606 - RNA, 17 nt, Human
gaacccgggaggcagag

SEQ ID NO: 3255607 - RNA, 18 nt, Human
gaaagaaaaucaggcugg

SEQ ID NO: 3255608 - RNA, 14 nt, Human
cuuugaccuguugg

SEQ ID NO: 3255609 - RNA, 19 nt, Human
cuuggucugugagaugcua

SEQ ID NO: 3255610 - RNA, 16 nt, Human
cuuggucugugagaug

SEQ ID NO: 3255611 - RNA, 16 nt, Human
augucaguauguggaa

SEQ ID NO: 3255612 - RNA, 16 nt, Human
auguccacugguucuu

SEQ ID NO: 3255613 - RNA, 17 nt, Human
auguccacugguucuuc

SEQ ID NO: 3255614 - RNA, 17 nt, Human
auguagaggagaaacug

SEQ ID NO: 3255615 - RNA, 19 nt, Human
auguagaggagaaacugga

SEQ ID NO: 3255616 - RNA, 12 nt, Human
auguagaggaga

SEQ ID NO: 3255617 - RNA, 13 nt, Human
auguagaggagaa

SEQ ID NO: 3255618 - RNA, 16 nt, Human
augguucucaggccug

SEQ ID NO: 3255619 - RNA, 20 nt, Human
auggggauagauguguggac

SEQ ID NO: 3255620 - RNA, 19 nt, Human
auggcuaagcaaaauguga

SEQ ID NO: 3255621 - RNA, 19 nt, Human
augcuagaacucccuuuca

SEQ ID NO: 3255622 - RNA, 22 nt, Human
augcuagaacucccuuucaaca

SEQ ID NO: 3255623 - RNA, 20 nt, Human
augcuagaacucccuuucaa

SEQ ID NO: 3255624 - RNA, 21 nt, Human
augcuagaacucccuuucaac

SEQ ID NO: 3255625 - RNA, 16 nt, Human
aucaggccauuguccc

SEQ ID NO: 3255626 - RNA, 13 nt, Human
aucaggccauugu

SEQ ID NO: 3255627 - RNA, 23 nt, Human
uucuaagaagugaaaaucuacac

SEQ ID NO: 3255628 - RNA, 13 nt, Human
uucuaagaaguga

SEQ ID NO: 3255629 - RNA, 14 nt, Human
uucggccuccaucc

SEQ ID NO: 3255630 - RNA, 18 nt, Human
auauuuuuuguuaaauga

SEQ ID NO: 3255631 - RNA, 20 nt, Human
auauuuuuuguuaaaugauu

SEQ ID NO: 3255632 - RNA, 14 nt, Human
aucaacagauaaau

SEQ ID NO: 3255633 - RNA, 18 nt, Human
uugaacccgggaggcaga

SEQ ID NO: 3255634 - RNA, 19 nt, Human
uugaacccgggaggcagag

SEQ ID NO: 3255635 - RNA, 19 nt, Human
auccauagcaccuccacau

SEQ ID NO: 3255636 - RNA, 20 nt, Human
uugcuaugagcuggggaugu

SEQ ID NO: 3255637 - RNA, 23 nt, Human
augaauggcuaagcaaaauguga

SEQ ID NO: 3255638 - RNA, 19 nt, Human
uugacacuuaaaaaugguu

SEQ ID NO: 3255639 - RNA, 18 nt, Human
aucuacacuccagugaga

SEQ ID NO: 3255640 - RNA, 19 nt, Human
aucuacacuccagugagac

SEQ ID NO: 3255641 - RNA, 18 nt, Human
auuuguaaauuuauguga

SEQ ID NO: 3255642 - RNA, 19 nt, Human
auuuguaaauuuaugugau

SEQ ID NO: 3255643 - RNA, 12 nt, Human
auuuuucucaug

SEQ ID NO: 3255644 - RNA, 18 nt, Human
auuuuuuguuaaaugauu

SEQ ID NO: 3255645 - RNA, 12 nt, Human
auuccagaggaa

SEQ ID NO: 3255646 - RNA, 15 nt, Human
auugacacuuaaaaa

SEQ ID NO: 3255647 - RNA, 17 nt, Human
auugacacuuaaaaaug

SEQ ID NO: 3255648 - RNA, 19 nt, Human
auugacacuuaaaaauggu

SEQ ID NO: 3255649 - RNA, 18 nt, Human
agccugagcgacagugag

SEQ ID NO: 3255650 - RNA, 14 nt, Human
ugcagugagccgag

SEQ ID NO: 3255651 - RNA, 15 nt, Human
agcuggggaugucuc

SEQ ID NO: 3255652 - RNA, 19 nt, Human
ugccuugugaaggaauuau

SEQ ID NO: 3255653 - RNA, 19 nt, Human
aggaauugacccacaagaa

SEQ ID NO: 3255654 - RNA, 11 nt, Human
aggcuccacuu

SEQ ID NO: 3255655 - RNA, 17 nt, Human
aggcuccacuuggucug

SEQ ID NO: 3255656 - RNA, 21 nt, Human
aggcuccacuuggucugugag

SEQ ID NO: 3255657 - RNA, 22 nt, Human
aggcuccacuuggucugugaga

SEQ ID NO: 3255658 - RNA, 16 nt, Human
aggccugacucucagc

SEQ ID NO: 3255659 - RNA, 14 nt, Human
uggaaguguggguc

SEQ ID NO: 3255660 - RNA, 13 nt, Human
uggaagugugggu

SEQ ID NO: 3255661 - RNA, 18 nt, Human
uggcuaagcaaaauguga

SEQ ID NO: 3255662 - RNA, 19 nt, Human
ugggaggcugagaugggag

SEQ ID NO: 3255663 - RNA, 16 nt, Human
agugggguagguuggg

SEQ ID NO: 3255664 - RNA, 18 nt, Human
uguguguuguguguggga

SEQ ID NO: 3255665 - RNA, 9 nt, Human
aguguguaa

SEQ ID NO: 3255666 - RNA, 15 nt, Human
uguucuaagaaguga

SEQ ID NO: 3255667 - RNA, 14 nt, Human
agugaggaugucug

SEQ ID NO: 3255668 - RNA, 18 nt, Human
agugccaggauggaauga

SEQ ID NO: 3255669 - RNA, 20 nt, Human
agugaacaaauuuacagaga

SEQ ID NO: 3255670 - RNA, 21 nt, Human
agugaacaaauuuacagagac

SEQ ID NO: 3255671 - RNA, 22 nt, Human
agugaacaaauuuacagagaca

SEQ ID NO: 3255672 - RNA, 23 nt, Human
agugaacaaauuuacagagacag

SEQ ID NO: 3255673 - RNA, 16 nt, Human
agugagccgagauugu

SEQ ID NO: 3255674 - RNA, 14 nt, Human
agguugcagugagc

SEQ ID NO: 3255675 - RNA, 22 nt, Human
ugucucaguccaugaagaugua

SEQ ID NO: 3255676 - RNA, 14 nt, Human
aguauuugugggga

SEQ ID NO: 3255677 - RNA, 11 nt, Human
auagaugugug

SEQ ID NO: 3255678 - RNA, 13 nt, Human
auagaugugugga

SEQ ID NO: 3255679 - RNA, 12 nt, Human
auagaugugugg

SEQ ID NO: 3255680 - RNA, 14 nt, Human
auagauguguggac

SEQ ID NO: 3255681 - RNA, 19 nt, Human
auagaaggcuauggggaua

SEQ ID NO: 3255682 - RNA, 17 nt, Human
auagaauuaacacauga

SEQ ID NO: 3255683 - RNA, 16 nt, Human
auacucauuaggaugg

SEQ ID NO: 3255684 - RNA, 10 nt, Human
uuaugugugu

SEQ ID NO: 3255685 - RNA, 14 nt, Human
uuaugugugugugu

SEQ ID NO: 3255686 - RNA, 12 nt, Human
uuaugugugugu

SEQ ID NO: 3255687 - RNA, 18 nt, Human
auaaucacaacccuucag

SEQ ID NO: 3255688 - RNA, 22 nt, Human
ugagggugacuauggagcugag

SEQ ID NO: 3255689 - RNA, 17 nt, Human
ugagguacugagaguga

SEQ ID NO: 3255690 - RNA, 22 nt, Human
ugagguacugagagugaacaaa

SEQ ID NO: 3255691 - RNA, 17 nt, Human
ugaggaagagggacugu

SEQ ID NO: 3255692 - RNA, 14 nt, Human
agcagaacagugau

SEQ ID NO: 3255693 - RNA, 13 nt, Human
ugagcgacaguga

SEQ ID NO: 3255694 - RNA, 14 nt, Human
ugagcgacagugag

SEQ ID NO: 3255695 - RNA, 16 nt, Human
ugagcgacagugagac

SEQ ID NO: 3255696 - RNA, 20 nt, Human
ugagcgacagugagacucug

SEQ ID NO: 3255697 - RNA, 23 nt, Human
agaugcuagaacucccuuucaac

SEQ ID NO: 3255698 - RNA, 22 nt, Human
agaugcuagaacucccuuucaa

SEQ ID NO: 3255699 - RNA, 16 nt, Human
agauugugccccugca

SEQ ID NO: 3255700 - RNA, 18 nt, Human
ugaagauguagaggagaa

SEQ ID NO: 3255701 - RNA, 17 nt, Human
ugaagauguagaggaga

SEQ ID NO: 3255702 - RNA, 14 nt, Human
agagugaacaaauu

SEQ ID NO: 3255703 - RNA, 22 nt, Human
agagugaacaaauuuacagaga

SEQ ID NO: 3255704 - RNA, 14 nt, Human
agacuuaucaacau

SEQ ID NO: 3255705 - RNA, 11 nt, Human
ucuggcccuau

SEQ ID NO: 3255706 - RNA, 14 nt, Human
agaacucccuuuca

SEQ ID NO: 3255707 - RNA, 14 nt, Human
agaaagaaaaucag

SEQ ID NO: 3255708 - RNA, 13 nt, Human
agaaacuggaacu

SEQ ID NO: 3255709 - RNA, 13 nt, Human
ucucuggccuucg

SEQ ID NO: 3255710 - RNA, 16 nt, Human
ucucuggccuucggcc

SEQ ID NO: 3255711 - RNA, 17 nt, Human
ucucuggccuucggccu

SEQ ID NO: 3255712 - RNA, 21 nt, Human
uccagccugagcgacagugag

SEQ ID NO: 3255713 - RNA, 20 nt, Human
uccagccugagcgacaguga

SEQ ID NO: 3255714 - RNA, 22 nt, Human
ucaugauagaaggcuaugggga

SEQ ID NO: 3255715 - RNA, 13 nt, Human
accacugcagaag

SEQ ID NO: 3255716 - RNA, 14 nt, Human
accacugcagaaga

SEQ ID NO: 3255717 - RNA, 19 nt, Human
accacugcagaagacagua

SEQ ID NO: 3255718 - RNA, 21 nt, Human
acccaaauguucaucaaugaa

SEQ ID NO: 3255719 - RNA, 18 nt, Human
acccaaaaggcagaagca

SEQ ID NO: 3255720 - RNA, 20 nt, Human
acccaaauguucaucaauga

SEQ ID NO: 3255721 - RNA, 13 nt, Human
acccaaaaggcag

SEQ ID NO: 3255722 - RNA, 15 nt, Human
acccaaaaggcagaa

SEQ ID NO: 3255723 - RNA, 14 nt, Human
accagggacugagg

SEQ ID NO: 3255724 - RNA, 22 nt, Human
ucagauuugccuuauuggcagc

SEQ ID NO: 3255725 - RNA, 22 nt, Human
acccagcuaugguucucucgca

SEQ ID NO: 3255726 - RNA, 15 nt, Human
ucaggccgaaggagg

SEQ ID NO: 3255727 - RNA, 20 nt, Human
uccucaaaacuucagacaua

SEQ ID NO: 3255728 - RNA, 13 nt, Human
acuaaaaauacaa

SEQ ID NO: 3255729 - RNA, 13 nt, Human
uccuucagccuga

SEQ ID NO: 3255730 - RNA, 17 nt, Human
acugaggggaggggagc

SEQ ID NO: 3255731 - RNA, 22 nt, Human
acugaggggaggggagcauggg

SEQ ID NO: 3255732 - RNA, 21 nt, Human
guugggagaaugucaguaugu

SEQ ID NO: 3255733 - RNA, 14 nt, Human
guugggagaauguc

SEQ ID NO: 3255734 - RNA, 12 nt, Human
guguuuaugugu

SEQ ID NO: 3255735 - RNA, 16 nt, Human
guguuuaugugugugu

SEQ ID NO: 3255736 - RNA, 17 nt, Human
uaaaugauuucauucaa

SEQ ID NO: 3255737 - RNA, 19 nt, Human
uaaaccaaggcuagaacca

SEQ ID NO: 3255738 - RNA, 23 nt, Human
guccaugaagauguagaggagaa

SEQ ID NO: 3255739 - RNA, 13 nt, Human
aagacccaaaagg

SEQ ID NO: 3255740 - RNA, 14 nt, Human
gugggggucugugu

SEQ ID NO: 3255741 - RNA, 16 nt, Human
gugggggucugugugu

SEQ ID NO: 3255742 - RNA, 15 nt, Human
gugggggucugugug

SEQ ID NO: 3255743 - RNA, 15 nt, Human
guguuguguguggga

SEQ ID NO: 3255744 - RNA, 14 nt, Human
guguguguaugugg

SEQ ID NO: 3255745 - RNA, 17 nt, Human
guguguguugugugugg

SEQ ID NO: 3255746 - RNA, 16 nt, Human
gugugugggagugugu

SEQ ID NO: 3255747 - RNA, 13 nt, Human
guguguguaugug

SEQ ID NO: 3255748 - RNA, 22 nt, Human
aagauguagaggagaaacugga

SEQ ID NO: 3255749 - RNA, 13 nt, Human
aagcaaaauguga

SEQ ID NO: 3255750 - RNA, 19 nt, Human
aagauguagaggagaaacu

SEQ ID NO: 3255751 - RNA, 14 nt, Human
uauaggaauugacc

SEQ ID NO: 3255752 - RNA, 13 nt, Human
uauaggaauugac

SEQ ID NO: 3255753 - RNA, 12 nt, Human
uauaggaauuga

SEQ ID NO: 3255754 - RNA, 18 nt, Human
uauggggauagaugugug

SEQ ID NO: 3255755 - RNA, 17 nt, Human
uauggggauagaugugu

SEQ ID NO: 3255756 - RNA, 21 nt, Human
acagacacucccacuuggcau

SEQ ID NO: 3255757 - RNA, 11 nt, Human
uaugugugugu

SEQ ID NO: 3255758 - RNA, 22 nt, Human
uauguguguguguugugugugg

SEQ ID NO: 3255759 - RNA, 14 nt, Human
uauguguguguguu

SEQ ID NO: 3255760 - RNA, 23 nt, Human
uauucauagcagcuuauucacaa

SEQ ID NO: 3255761 - RNA, 14 nt, Human
acagugagacucug

SEQ ID NO: 3255762 - RNA, 18 nt, Human
acagugagacucugucuc

SEQ ID NO: 3255763 - RNA, 21 nt, Human
acaguauggcagcuuuccuca

SEQ ID NO: 3255764 - RNA, 22 nt, Human
aauucuuugaccuguugggagu

SEQ ID NO: 3255765 - RNA, 18 nt, Human
aauucuuugaccuguugg

SEQ ID NO: 3255766 - RNA, 13 nt, Human
aauugacccacaa

SEQ ID NO: 3255767 - RNA, 16 nt, Human
aauugacccacaagaa

SEQ ID NO: 3255768 - RNA, 19 nt, Human
aauugacccacaagaaaug

SEQ ID NO: 3255769 - RNA, 22 nt, Human
acaagaaaugaaagcagggacu

SEQ ID NO: 3255770 - RNA, 18 nt, Human
uagaacucccuuucaaca

SEQ ID NO: 3255771 - RNA, 16 nt, Human
aaugguuuaaaugguc

SEQ ID NO: 3255772 - RNA, 15 nt, Human
aaugaaugaaugaau

SEQ ID NO: 3255773 - RNA, 15 nt, Human
aaugucaguaugugg

SEQ ID NO: 3255774 - RNA, 13 nt, Human
aaugucaguaugu

SEQ ID NO: 3255775 - RNA, 16 nt, Human
aacccgggaggcagag

SEQ ID NO: 3255776 - RNA, 19 nt, Human
aaauugacacuuaaaaaug

SEQ ID NO: 3255777 - RNA, 18 nt, Human
aacaaauuuacagagaca

SEQ ID NO: 3255778 - RNA, 20 nt, Human
aacuuuaugcuaagugaaau

SEQ ID NO: 3255779 - RNA, 21 nt, Human
aacuuuaugcuaagugaaaua

SEQ ID NO: 3255780 - RNA, 14 nt, Human
aaaggcagaagcaa

SEQ ID NO: 3255781 - RNA, 21 nt, Human
aaaaucuacacuccagugaga

SEQ ID NO: 3255782 - RNA, 18 nt, Human
aaaaguucugcagauaaa

SEQ ID NO: 3255783 - RNA, 17 nt, Human
acucuauguucuaagaa

SEQ ID NO: 3255784 - RNA, 20 nt, Human
acucugucucaguccaugaa

SEQ ID NO: 3255785 - RNA, 18 nt, Human
acucugucucaguccaug

SEQ ID NO: 3255786 - RNA, 17 nt, Human
acucugucucaguccau

SEQ ID NO: 3255787 - RNA, 21 nt, Human
acuuggucugugagaugcuag

SEQ ID NO: 3255788 - RNA, 16 nt, Human
agaaaaucaggcuggc

SEQ ID NO: 3255789 - RNA, 15 nt, Human
acccacaagaaauga

SEQ ID NO: 3255790 - RNA, 17 nt, Human
acccacaagaaaugaaa

SEQ ID NO: 3255791 - RNA, 21 nt, Human
acccacaagaaaugaaagcag

SEQ ID NO: 3255792 - RNA, 20 nt, Human
accaaggcugauuaaaccaa

SEQ ID NO: 3255793 - RNA, 20 nt, Human
agaggacaguauuugugggg

SEQ ID NO: 3255794 - RNA, 14 nt, Human
agcugagcaggugu

SEQ ID NO: 3255795 - RNA, 21 nt, Human
aggagucccugccaucauguu

SEQ ID NO: 3255796 - RNA, 17 nt, Human
aggauguugaaaaaguu

SEQ ID NO: 3255797 - RNA, 21 nt, Human
aggcuagaaccaccugccuau

SEQ ID NO: 3255798 - RNA, 14 nt, Human
aucagccugugcca

SEQ ID NO: 3255799 - RNA, 17 nt, Human
auguucuaagaagugaa

SEQ ID NO: 3255800 - RNA, 16 nt, Human
aguggcuggaucugug

SEQ ID NO: 3255801 - RNA, 18 nt, Human
aguucauaaauuuauggu

SEQ ID NO: 3255802 - RNA, 18 nt, Human
auagcagcuuauucacaa

SEQ ID NO: 3255803 - RNA, 21 nt, Human
caaauguucaucaaugaauga

SEQ ID NO: 3255804 - RNA, 20 nt, Human
caaauguucaucaaugaaug

SEQ ID NO: 3255805 - RNA, 14 nt, Human
caaauuuacagaga

SEQ ID NO: 3255806 - RNA, 15 nt, Human
caaauuuacagagac

SEQ ID NO: 3255807 - RNA, 21 nt, Human
caauaucuuuuuuuuaauaaa

SEQ ID NO: 3255808 - RNA, 22 nt, Human
caaugaaugaaugaauggcuaa

SEQ ID NO: 3255809 - RNA, 16 nt, Human
uuggcagcucuacucu

SEQ ID NO: 3255810 - RNA, 12 nt, Human
uuguaaaauggu

SEQ ID NO: 3255811 - RNA, 13 nt, Human
uuguaaaauggug

SEQ ID NO: 3255812 - RNA, 16 nt, Human
uuguaccgcaauguga

SEQ ID NO: 3255813 - RNA, 20 nt, Human
uuguaaaauggugugaccac

SEQ ID NO: 3255814 - RNA, 20 nt, Human
uuuacagaggacaguauuug

SEQ ID NO: 3255815 - RNA, 13 nt, Human
uuuacagagacag

SEQ ID NO: 3255816 - RNA, 13 nt, Human
uuuaauaaaccau

SEQ ID NO: 3255817 - RNA, 18 nt, Human
uuguuuagaagaagugug

SEQ ID NO: 3255818 - RNA, 15 nt, Human
uuguuuagaagaagu

SEQ ID NO: 3255819 - RNA, 16 nt, Human
uuuaaaauugugaugu

SEQ ID NO: 3255820 - RNA, 20 nt, Human
uucagacauagaauuaacac

SEQ ID NO: 3255821 - RNA, 16 nt, Human
uucagacauagaauua

SEQ ID NO: 3255822 - RNA, 22 nt, Human
uucggccuccauccugaggcuc

SEQ ID NO: 3255823 - RNA, 19 nt, Human
uguuuagaagaaguguguc

SEQ ID NO: 3255824 - RNA, 16 nt, Human
uguuuagaagaagugu

SEQ ID NO: 3255825 - RNA, 12 nt, Human
uuaacucagucu

SEQ ID NO: 3255826 - RNA, 17 nt, Human
uuacuaguuucccuugc

SEQ ID NO: 3255827 - RNA, 18 nt, Human
uuaggauguugaaaaagu

SEQ ID NO: 3255828 - RNA, 11 nt, Human
uuuguggggag

SEQ ID NO: 3255829 - RNA, 23 nt, Human
uauguguguguguuguguguggg

SEQ ID NO: 3255830 - RNA, 17 nt, Human
uauguucuaagaaguga

SEQ ID NO: 3255831 - RNA, 18 nt, Human
ucacaagacccaaaaggc

SEQ ID NO: 3255832 - RNA, 22 nt, Human
ucacaagacccaaaaggcagaa

SEQ ID NO: 3255833 - RNA, 23 nt, Human
uaugagcuggggaugucucucau

SEQ ID NO: 3255834 - RNA, 15 nt, Human
uauccuucagccuga

SEQ ID NO: 3255835 - RNA, 14 nt, Human
uauccuucagccug

SEQ ID NO: 3255836 - RNA, 12 nt, Human
uaggaauugacc

SEQ ID NO: 3255837 - RNA, 18 nt, Human
uaggccaugggacaggga

SEQ ID NO: 3255838 - RNA, 16 nt, Human
uaggccaugggacagg

SEQ ID NO: 3255839 - RNA, 13 nt, Human
uaguaucaaaaga

SEQ ID NO: 3255840 - RNA, 18 nt, Human
uccugccccugagcccau

SEQ ID NO: 3255841 - RNA, 17 nt, Human
uccugccccugagccca

SEQ ID NO: 3255842 - RNA, 17 nt, Human
uccugaggcuccacuug

SEQ ID NO: 3255843 - RNA, 19 nt, Human
uccugaggcuccacuuggu

SEQ ID NO: 3255844 - RNA, 20 nt, Human
uccugaggcuccacuugguc

SEQ ID NO: 3255845 - RNA, 23 nt, Human
ucucaguccaugaagauguagag

SEQ ID NO: 3255846 - RNA, 16 nt, Human
ucauuaggauggcuag

SEQ ID NO: 3255847 - RNA, 17 nt, Human
ucaucaaugaaugaaug

SEQ ID NO: 3255848 - RNA, 11 nt, Human
ucauagcagcu

SEQ ID NO: 3255849 - RNA, 22 nt, Human
ucagucuuuaaucugagaggcc

SEQ ID NO: 3255850 - RNA, 23 nt, Human
uccacuuggucugugagaugcua

SEQ ID NO: 3255851 - RNA, 21 nt, Human
uccacuuggucugugagaugc

SEQ ID NO: 3255852 - RNA, 17 nt, Human
uccacuuggucugugag

SEQ ID NO: 3255853 - RNA, 13 nt, Human
ugagccccaaaag

SEQ ID NO: 3255854 - RNA, 16 nt, Human
ugagagugaacaaauu

SEQ ID NO: 3255855 - RNA, 20 nt, Human
ugagcuggggaugucucuca

SEQ ID NO: 3255856 - RNA, 18 nt, Human
ugaggcuccacuuggucu

SEQ ID NO: 3255857 - RNA, 20 nt, Human
ugaggcuccacuuggucugu

SEQ ID NO: 3255858 - RNA, 16 nt, Human
ugauuaccagggacug

SEQ ID NO: 3255859 - RNA, 17 nt, Human
ugacauacauccaacau

SEQ ID NO: 3255860 - RNA, 18 nt, Human
ugaccacugcagaagaca

SEQ ID NO: 3255861 - RNA, 20 nt, Human
ugaccacugcagaagacagu

SEQ ID NO: 3255862 - RNA, 20 nt, Human
ugaaugaauggcuaagcaaa

SEQ ID NO: 3255863 - RNA, 18 nt, Human
ugaaagaggaaugaagua

SEQ ID NO: 3255864 - RNA, 23 nt, Human
ugaaagcagggacuugaacccau

SEQ ID NO: 3255865 - RNA, 22 nt, Human
ugggagugaggaugucugggcc

SEQ ID NO: 3255866 - RNA, 11 nt, Human
ugggagugugu

SEQ ID NO: 3255867 - RNA, 20 nt, Human
uggggauagauguguggaca

SEQ ID NO: 3255868 - RNA, 18 nt, Human
uggggauagaugugugga

SEQ ID NO: 3255869 - RNA, 17 nt, Human
uggggauagaugugugg

SEQ ID NO: 3255870 - RNA, 16 nt, Human
uggggauagaugugug

SEQ ID NO: 3255871 - RNA, 14 nt, Human
ugggggucugugug

SEQ ID NO: 3255872 - RNA, 22 nt, Human
uggucacaggaaguagaggagg

SEQ ID NO: 3255873 - RNA, 17 nt, Human
uggucacaggaaguaga

SEQ ID NO: 3255874 - RNA, 19 nt, Human
uggaucugugaggggcucu

SEQ ID NO: 3255875 - RNA, 15 nt, Human
uggaucugugagggg

SEQ ID NO: 3255876 - RNA, 20 nt, Human
uggcuccauugguguugaca

SEQ ID NO: 3255877 - RNA, 16 nt, Human
ugccacuaaauugaca

SEQ ID NO: 3255878 - RNA, 13 nt, Human
ugcuagaacuccc

SEQ ID NO: 3255879 - RNA, 14 nt, Human
ugcuagaacucccu

SEQ ID NO: 3255880 - RNA, 15 nt, Human
ugcuagaacucccuu

SEQ ID NO: 3255881 - RNA, 17 nt, Human
ugcuagaacucccuuuc

SEQ ID NO: 3255882 - RNA, 20 nt, Human
ugcugggggggauuguaaaa

SEQ ID NO: 3255883 - RNA, 15 nt, Human
gugaggaugucuggg

SEQ ID NO: 3255884 - RNA, 20 nt, Human
gucccagaaugccuccugca

SEQ ID NO: 3255885 - RNA, 23 nt, Human
ggggucuguguguuuaugugugu

SEQ ID NO: 3255886 - RNA, 13 nt, Human
ggggauagaugug

SEQ ID NO: 3255887 - RNA, 19 nt, Human
gguugggagaaugucagua

SEQ ID NO: 3255888 - RNA, 15 nt, Human
guagaggagaaacug

SEQ ID NO: 3255889 - RNA, 15 nt, Human
guaccgcaaugugac

SEQ ID NO: 3255890 - RNA, 23 nt, Human
ggaagggacaccaagccuuggcu

SEQ ID NO: 3255891 - RNA, 20 nt, Human
ggaagugacgguuuaauggg

SEQ ID NO: 3255892 - RNA, 22 nt, Human
ggagaaugucaguauguggaag

SEQ ID NO: 3255893 - RNA, 15 nt, Human
ggagaaucacuugaa

SEQ ID NO: 3255894 - RNA, 19 nt, Human
ggagaaucacuugaacccg

SEQ ID NO: 3255895 - RNA, 13 nt, Human
ggacgcucucugg

SEQ ID NO: 3255896 - RNA, 14 nt, Human
ggacgcucucuggc

SEQ ID NO: 3255897 - RNA, 17 nt, Human
ggauggaaugauggguc

SEQ ID NO: 3255898 - RNA, 12 nt, Human
ggcccugugccu

SEQ ID NO: 3255899 - RNA, 21 nt, Human
ggcuauggggauagaugugug

SEQ ID NO: 3255900 - RNA, 17 nt, Human
gcuaugagcuggggaug

SEQ ID NO: 3255901 - RNA, 17 nt, Human
gcuaagcaaaaugugau

SEQ ID NO: 3255902 - RNA, 14 nt, Human
gcucucuggccuuc

SEQ ID NO: 3255903 - RNA, 15 nt, Human
gcucucuggccuucg

SEQ ID NO: 3255904 - RNA, 19 nt, Human
gcucucuggccuucggccu

SEQ ID NO: 3255905 - RNA, 20 nt, Human
gcucucuggccuucggccuc

SEQ ID NO: 3255906 - RNA, 12 nt, Human
gcucucuggccu

SEQ ID NO: 3255907 - RNA, 13 nt, Human
gcucucuggccuu

SEQ ID NO: 3255908 - RNA, 11 nt, Human
gcucucuggcc

SEQ ID NO: 3255909 - RNA, 22 nt, Human
gccuauauuuuuuguuaaauga

SEQ ID NO: 3255910 - RNA, 17 nt, Human
gccuaagugcagccccg

SEQ ID NO: 3255911 - RNA, 17 nt, Human
gagaaugucaguaugug

SEQ ID NO: 3255912 - RNA, 18 nt, Human
gagacagcucugcauacu

SEQ ID NO: 3255913 - RNA, 20 nt, Human
gagacagcucugcauacuca

SEQ ID NO: 3255914 - RNA, 19 nt, Human
gaaugucaguauguggaag

SEQ ID NO: 3255915 - RNA, 13 nt, Human
gaaugucaguaug

SEQ ID NO: 3255916 - RNA, 18 nt, Human
gaaugucaguauguggaa

SEQ ID NO: 3255917 - RNA, 16 nt, Human
gaaugucaguaugugg

SEQ ID NO: 3255918 - RNA, 16 nt, Human
gaauugacccacaaga

SEQ ID NO: 3255919 - RNA, 21 nt, Human
gaauugacccacaagaaauga

SEQ ID NO: 3255920 - RNA, 21 nt, Human
gaccacugcagaagacaguau

SEQ ID NO: 3255921 - RNA, 18 nt, Human
gaccacugcagaagacag

SEQ ID NO: 3255922 - RNA, 20 nt, Human
gacccaaaaggcagaagcaa

SEQ ID NO: 3255923 - RNA, 16 nt, Human
gacccaaaaggcagaa

SEQ ID NO: 3255924 - RNA, 15 nt, Human
gacccacaagaaaug

SEQ ID NO: 3255925 - RNA, 18 nt, Human
gacagggaggacgcucuc

SEQ ID NO: 3255926 - RNA, 17 nt, Human
gacagggaggacgcucu

SEQ ID NO: 3255927 - RNA, 20 nt, Human
gacauagaauuaacacauga

SEQ ID NO: 3255928 - RNA, 13 nt, Human
gaguguguaauuu

SEQ ID NO: 3255929 - RNA, 13 nt, Human
gauagaugugugg

SEQ ID NO: 3255930 - RNA, 22 nt, Human
gauagauguguggacacauugg

SEQ ID NO: 3255931 - RNA, 14 nt, Human
gauagaugugugga

SEQ ID NO: 3255932 - RNA, 23 nt, Human
gagugaacaaauuuacagagaca

SEQ ID NO: 3255933 - RNA, 22 nt, Human
gaggccucucauuccagaggaa

SEQ ID NO: 3255934 - RNA, 23 nt, Human
gauugcaggagucccugccauca

SEQ ID NO: 3255935 - RNA, 21 nt, Human
gaugggucaguuguaucagca

SEQ ID NO: 3255936 - RNA, 15 nt, Human
gaugggucaguugua

SEQ ID NO: 3255937 - RNA, 18 nt, Human
gaugcuagaacucccuuu

SEQ ID NO: 3255938 - RNA, 20 nt, Human
gaugcuagaacucccuuuca

SEQ ID NO: 3255939 - RNA, 19 nt, Human
gauguugaaaaaguucugc

SEQ ID NO: 3255940 - RNA, 22 nt, Human
gaaaaucuacacuccagugaga

SEQ ID NO: 3255941 - RNA, 14 nt, Human
gaaacccugucucu

SEQ ID NO: 3255942 - RNA, 22 nt, Human
gaaagcagaacagugauuacca

SEQ ID NO: 3255943 - RNA, 14 nt, Human
gaaagcagaacagu

SEQ ID NO: 3255944 - RNA, 17 nt, Human
gaaagcagaacagugau

SEQ ID NO: 3255945 - RNA, 21 nt, Human
gaaagaggaaugaaguacuca

SEQ ID NO: 3255946 - RNA, 14 nt, Human
gaaagcagggacuu

SEQ ID NO: 3255947 - RNA, 20 nt, Human
cuugaacccgggaggcagag

SEQ ID NO: 3255948 - RNA, 17 nt, Human
cuguguguuuaugugug

SEQ ID NO: 3255949 - RNA, 16 nt, Human
cuguguguuuaugugu

SEQ ID NO: 3255950 - RNA, 21 nt, Human
cuguguguguguauguggggg

SEQ ID NO: 3255951 - RNA, 19 nt, Human
cugugaggggcucucucau

SEQ ID NO: 3255952 - RNA, 22 nt, Human
cugggggggauuguaaaauggu

SEQ ID NO: 3255953 - RNA, 23 nt, Human
cuguaaucacagcuacuugggag

SEQ ID NO: 3255954 - RNA, 11 nt, Human
cugcugggcuu

SEQ ID NO: 3255955 - RNA, 17 nt, Human
cuggagguuuguuuaga

SEQ ID NO: 3255956 - RNA, 12 nt, Human
cuggagguuugu

SEQ ID NO: 3255957 - RNA, 12 nt, Human
cuggagcucugc

SEQ ID NO: 3255958 - RNA, 13 nt, Human
cuggagcucugcc

SEQ ID NO: 3255959 - RNA, 16 nt, Human
cuggagcucugcccau

SEQ ID NO: 3255960 - RNA, 21 nt, Human
cuggccaguggcuggaucugu

SEQ ID NO: 3255961 - RNA, 23 nt, Human
cuggccuucggccuccauccuga

SEQ ID NO: 3255962 - RNA, 21 nt, Human
cuggccuucggccuccauccu

SEQ ID NO: 3255963 - RNA, 22 nt, Human
cuggccuucggccuccauccug

SEQ ID NO: 3255964 - RNA, 16 nt, Human
ccauccugaggcucca

SEQ ID NO: 3255965 - RNA, 20 nt, Human
ccauccugaggcuccacuug

SEQ ID NO: 3255966 - RNA, 18 nt, Human
ccauccugaggcuccacu

SEQ ID NO: 3255967 - RNA, 19 nt, Human
ccagccugagcgacaguga

SEQ ID NO: 3255968 - RNA, 15 nt, Human
ccacugguucuucuu

SEQ ID NO: 3255969 - RNA, 14 nt, Human
ccagacaucaacag

SEQ ID NO: 3255970 - RNA, 14 nt, Human
ccuuugucccagaa

SEQ ID NO: 3255971 - RNA, 17 nt, Human
ccugugccuuuugccau

SEQ ID NO: 3255972 - RNA, 16 nt, Human
ccuucggccuccaucc

SEQ ID NO: 3255973 - RNA, 17 nt, Human
ccuucggccuccauccu

SEQ ID NO: 3255974 - RNA, 18 nt, Human
ccuucggccuccauccug

SEQ ID NO: 3255975 - RNA, 13 nt, Human
ccugaggcuccac

SEQ ID NO: 3255976 - RNA, 14 nt, Human
ccugaggcuccacu

SEQ ID NO: 3255977 - RNA, 19 nt, Human
ccugaagagaagggcaggg

SEQ ID NO: 3255978 - RNA, 17 nt, Human
ccugccccugagcccau

SEQ ID NO: 3255979 - RNA, 22 nt, Human
cuacucuggagguuuguuuaga

SEQ ID NO: 3255980 - RNA, 21 nt, Human
cuauggggauagaugugugga

SEQ ID NO: 3255981 - RNA, 20 nt, Human
cuauggggauagaugugugg

SEQ ID NO: 3255982 - RNA, 19 nt, Human
cuauggggauagaugugug

SEQ ID NO: 3255983 - RNA, 20 nt, Human
cgggaggcagagguugcagu

SEQ ID NO: 3255984 - RNA, 19 nt, Human
cuaaauugacacuuaaaaa

SEQ ID NO: 3255985 - RNA, 13 nt, Human
cuccacuuggucu

SEQ ID NO: 3255986 - RNA, 15 nt, Human
cuccacuuggucugu

SEQ ID NO: 3255987 - RNA, 16 nt, Human
cuccacuuggucugug

SEQ ID NO: 3255988 - RNA, 17 nt, Human
cuccacuuggucuguga

SEQ ID NO: 3255989 - RNA, 21 nt, Human
cuccacuuggucugugagaug

SEQ ID NO: 3255990 - RNA, 22 nt, Human
cuccacuuggucugugagaugc

SEQ ID NO: 3255991 - RNA, 23 nt, Human
cuccacuuggucugugagaugcu

SEQ ID NO: 3255992 - RNA, 12 nt, Human
cugagaggccac

SEQ ID NO: 3255993 - RNA, 22 nt, Human
cuaauucuuugaccuguuggga

SEQ ID NO: 3255994 - RNA, 21 nt, Human
cuaauucuuugaccuguuggg

SEQ ID NO: 3255995 - RNA, 20 nt, Human
cuacaugagguacugagagu

SEQ ID NO: 3255996 - RNA, 18 nt, Human
cuacaugagguacugaga

SEQ ID NO: 3255997 - RNA, 12 nt, Human
cuagaacucccu

SEQ ID NO: 3255998 - RNA, 18 nt, Human
ccccugcacuccagccug

SEQ ID NO: 3255999 - RNA, 13 nt, Human
ccccugcacucca

SEQ ID NO: 3256000 - RNA, 15 nt, Human
ccuguaaucacagcu

SEQ ID NO: 3256001 - RNA, 19 nt, Human
auucuuugaccuguuggga

SEQ ID NO: 3256002 - RNA, 18 nt, Human
auucacaagacccaaaag

SEQ ID NO: 3256003 - RNA, 19 nt, Human
caacccaaauguucaucaa

SEQ ID NO: 3256004 - RNA, 17 nt, Human
cacuuggucugugagau

SEQ ID NO: 3256005 - RNA, 20 nt, Human
cacuuggucugugagaugcu

SEQ ID NO: 3256006 - RNA, 21 nt, Human
caccuacaugagguacugaga

SEQ ID NO: 3256007 - RNA, 23 nt, Human
cacaagacccaaaaggcagaagc

SEQ ID NO: 3256008 - RNA, 12 nt, Human
caauuuaaaaaa

SEQ ID NO: 3256009 - RNA, 18 nt, Human
cagggcugaggccucuca

SEQ ID NO: 3256010 - RNA, 16 nt, Human
cagggcugaggccucu

SEQ ID NO: 3256011 - RNA, 15 nt, Human
cagucacauuccaag

SEQ ID NO: 3256012 - RNA, 17 nt, Human
cagagguugcagugagc

SEQ ID NO: 3256013 - RNA, 16 nt, Human
cagagguugcagugag

SEQ ID NO: 3256014 - RNA, 17 nt, Human
ccaaauguucaucaaug

SEQ ID NO: 3256015 - RNA, 20 nt, Human
gcugggaauaagugccagga

SEQ ID NO: 3256016 - RNA, 19 nt, Human
ggacaguauuuguggggag

SEQ ID NO: 3256017 - RNA, 18 nt, Human
ggacaguauuugugggga

SEQ ID NO: 3256018 - RNA, 22 nt, Human
gcuuuuccucaaagggagagag

SEQ ID NO: 3256019 - RNA, 23 nt, Human
gccuucggccuccauccugaggc

SEQ ID NO: 3256020 - RNA, 19 nt, Human
gcauuuaggccaugggaca

SEQ ID NO: 3256021 - RNA, 11 nt, Human
gccccaaaagg

SEQ ID NO: 3256022 - RNA, 22 nt, Human
gccucauguccacugguucuuc

SEQ ID NO: 3256023 - RNA, 13 nt, Human
gccuccauccuga

SEQ ID NO: 3256024 - RNA, 14 nt, Human
gccuccauccugag

SEQ ID NO: 3256025 - RNA, 12 nt, Human
gccuccauccug

SEQ ID NO: 3256026 - RNA, 18 nt, Human
ggccuucggccuccaucc

SEQ ID NO: 3256027 - RNA, 16 nt, Human
ggccuucggccuccau

SEQ ID NO: 3256028 - RNA, 13 nt, Human
aaaaauacaaaaa

SEQ ID NO: 3256029 - RNA, 22 nt, Human
ggaguguguaauuuaaaauugu

SEQ ID NO: 3256030 - RNA, 11 nt, Human
ggaguguguaa

SEQ ID NO: 3256031 - RNA, 15 nt, Human
ggauuguaaaauggu

SEQ ID NO: 3256032 - RNA, 22 nt, Human
gguuuguuuagaagaagugugu

SEQ ID NO: 3256033 - RNA, 17 nt, Human
aaagcagggacuugaac

SEQ ID NO: 3256034 - RNA, 16 nt, Human
aaagcagaacagugau

SEQ ID NO: 3256035 - RNA, 12 nt, Human
aaacuuuaugcu

SEQ ID NO: 3256036 - RNA, 19 nt, Human
aaacuuuaugcuaagugaa

SEQ ID NO: 3256037 - RNA, 16 nt, Human
gguaggaacugcuggg

SEQ ID NO: 3256038 - RNA, 18 nt, Human
gguaggaacugcugggcu

SEQ ID NO: 3256039 - RNA, 18 nt, Human
gggucauucauggccugg

SEQ ID NO: 3256040 - RNA, 21 nt, Human
gggucaucuguaccucugccu

SEQ ID NO: 3256041 - RNA, 16 nt, Human
aaaaugguuuaaaugg

SEQ ID NO: 3256042 - RNA, 18 nt, Human
aaaaugguuuaaaugguc

SEQ ID NO: 3256043 - RNA, 12 nt, Human
gcagaacaguga

SEQ ID NO: 3256044 - RNA, 13 nt, Human
gcagaacagugau

SEQ ID NO: 3256045 - RNA, 18 nt, Human
gcagaacagugauuacca

SEQ ID NO: 3256046 - RNA, 22 nt, Human
gcagaacagugauuaccaggga

SEQ ID NO: 3256047 - RNA, 13 nt, Human
gauggaaugaugg

SEQ ID NO: 3256048 - RNA, 12 nt, Human
gacagcucugca

SEQ ID NO: 3256049 - RNA, 14 nt, Human
gacgcucucuggcc

SEQ ID NO: 3256050 - RNA, 14 nt, Human
gaaugaauggcuaa

SEQ ID NO: 3256051 - RNA, 14 nt, Human
gaauuaacacauga

SEQ ID NO: 3256052 - RNA, 15 nt, Human
gaauuaacacaugau

SEQ ID NO: 3256053 - RNA, 15 nt, Human
gaaugaauggcuaag

SEQ ID NO: 3256054 - RNA, 22 nt, Human
gaggacaguauuuguggggagg

SEQ ID NO: 3256055 - RNA, 21 nt, Human
gaggacgcucucuggccuucg

SEQ ID NO: 3256056 - RNA, 20 nt, Human
gaggacgcucucuggccuuc

SEQ ID NO: 3256057 - RNA, 12 nt, Human
gaggagaaacug

SEQ ID NO: 3256058 - RNA, 14 nt, Human
gaggagaaacugga

SEQ ID NO: 3256059 - RNA, 18 nt, Human
gaggcugagaugggagaa

SEQ ID NO: 3256060 - RNA, 17 nt, Human
gaggcuccacuuggucu

SEQ ID NO: 3256061 - RNA, 15 nt, Human
gaggcuccacuuggu

SEQ ID NO: 3256062 - RNA, 12 nt, Human
gaggcuccacuu

SEQ ID NO: 3256063 - RNA, 21 nt, Human
gagauugugccccugcacucc

SEQ ID NO: 3256064 - RNA, 20 nt, Human
gagaugcuagaacucccuuu

SEQ ID NO: 3256065 - RNA, 16 nt, Human
gagaugcuagaacucc

SEQ ID NO: 3256066 - RNA, 23 nt, Human
cuuggucucagugucaaugcagc

SEQ ID NO: 3256067 - RNA, 17 nt, Human
cuucuaccucuuggcug

SEQ ID NO: 3256068 - RNA, 14 nt, Human
cuuuugucccagaa

SEQ ID NO: 3256069 - RNA, 23 nt, Human
gaacaaauuuacagagacagaaa

SEQ ID NO: 3256070 - RNA, 17 nt, Human
gaacaaauuuacagaga

SEQ ID NO: 3256071 - RNA, 18 nt, Human
gaacaaauuuacagagac

SEQ ID NO: 3256072 - RNA, 18 nt, Human
gaaaugaaagcagggacu

SEQ ID NO: 3256073 - RNA, 17 nt, Human
gaaaugaaagcagggac

SEQ ID NO: 3256074 - RNA, 13 nt, Human
cuuaaaaaugguu

SEQ ID NO: 3256075 - RNA, 20 nt, Human
cuuaaaaaugguuuaaaugg

SEQ ID NO: 3256076 - RNA, 12 nt, Human
cuuaaaaauggu

SEQ ID NO: 3256077 - RNA, 21 nt, Human
cugugagaugcuagaacuccc

SEQ ID NO: 3256078 - RNA, 23 nt, Human
cugugagaugcuagaacucccuu

SEQ ID NO: 3256079 - RNA, 23 nt, Human
cuggcccuaugcuuccggccucc

SEQ ID NO: 3256080 - RNA, 11 nt, Human
ugugauguguc

SEQ ID NO: 3256081 - RNA, 14 nt, Human
agugagacagcucu

SEQ ID NO: 3256082 - RNA, 22 nt, Human
ugugagaugcuagaacucccuu

SEQ ID NO: 3256083 - RNA, 17 nt, Human
ugucucuacuaaaaaua

SEQ ID NO: 3256084 - RNA, 22 nt, Human
uguauccauccauggggcugau

SEQ ID NO: 3256085 - RNA, 22 nt, Human
uguaugugggggucuguguguu

SEQ ID NO: 3256086 - RNA, 21 nt, Human
uguaugugggggucugugugu

SEQ ID NO: 3256087 - RNA, 20 nt, Human
uguaugugggggucugugug

SEQ ID NO: 3256088 - RNA, 20 nt, Human
agucacauuccaagccucau

SEQ ID NO: 3256089 - RNA, 23 nt, Human
ugggaauaagugccaggauggaa

SEQ ID NO: 3256090 - RNA, 13 nt, Human
ugggucugugugu

SEQ ID NO: 3256091 - RNA, 15 nt, Human
ugggucugugugugu

SEQ ID NO: 3256092 - RNA, 22 nt, Human
uggucugugagaugcuagaacu

SEQ ID NO: 3256093 - RNA, 20 nt, Human
aggguuuauguuuaggaugu

SEQ ID NO: 3256094 - RNA, 23 nt, Human
uggugugaccacugcagaagaca

SEQ ID NO: 3256095 - RNA, 14 nt, Human
uuaucaacauuugu

SEQ ID NO: 3256096 - RNA, 22 nt, Human
auacaaaaaaaaaaaaaaauua

SEQ ID NO: 3256097 - RNA, 18 nt, Human
uguugggagugaggaugu

SEQ ID NO: 3256098 - RNA, 20 nt, Human
uuaaaaaugguuuaaauggu

SEQ ID NO: 3256099 - RNA, 14 nt, Human
agcugccugugccu

SEQ ID NO: 3256100 - RNA, 15 nt, Human
ugccucaccccuugc

SEQ ID NO: 3256101 - RNA, 23 nt, Human
agcucugcccauccugccccuga

SEQ ID NO: 3256102 - RNA, 14 nt, Human
ugcagaagacagua

SEQ ID NO: 3256103 - RNA, 15 nt, Human
ugcagaagacaguau

SEQ ID NO: 3256104 - RNA, 20 nt, Human
agccucauguccacugguuc

SEQ ID NO: 3256105 - RNA, 18 nt, Human
agcccauggcacucuaug

SEQ ID NO: 3256106 - RNA, 11 nt, Human
aggagaaacug

SEQ ID NO: 3256107 - RNA, 18 nt, Human
ugcuauuguagagccaga

SEQ ID NO: 3256108 - RNA, 22 nt, Human
ugcuauuguagagccagagguc

SEQ ID NO: 3256109 - RNA, 23 nt, Human
aggaauugacccacaagaaauga

SEQ ID NO: 3256110 - RNA, 13 nt, Human
ugcuggagcucug

SEQ ID NO: 3256111 - RNA, 14 nt, Human
ugcuggagcucugc

SEQ ID NO: 3256112 - RNA, 22 nt, Human
uggaccuuuccugaggaagagg

SEQ ID NO: 3256113 - RNA, 21 nt, Human
aggccucucauuccagaggaa

SEQ ID NO: 3256114 - RNA, 15 nt, Human
uggccaguggcugga

SEQ ID NO: 3256115 - RNA, 14 nt, Human
uggccaguggcugg

SEQ ID NO: 3256116 - RNA, 16 nt, Human
uggccaguggcuggau

SEQ ID NO: 3256117 - RNA, 22 nt, Human
uggcugccuugugaaggaauua

SEQ ID NO: 3256118 - RNA, 18 nt, Human
uugucccugaagagaagg

SEQ ID NO: 3256119 - RNA, 16 nt, Human
uugugugugggagugu

SEQ ID NO: 3256120 - RNA, 13 nt, Human
uugugugugggag

SEQ ID NO: 3256121 - RNA, 10 nt, Human
uugugugugg

SEQ ID NO: 3256122 - RNA, 13 nt, Human
augcuaagugaaa

SEQ ID NO: 3256123 - RNA, 13 nt, Human
auccugccccuga

SEQ ID NO: 3256124 - RNA, 22 nt, Human
auccugaggcuccacuuggucu

SEQ ID NO: 3256125 - RNA, 16 nt, Human
auccugcaauuccacu

SEQ ID NO: 3256126 - RNA, 11 nt, Human
auccugaggcu

SEQ ID NO: 3256127 - RNA, 13 nt, Human
auccugaggcucc

SEQ ID NO: 3256128 - RNA, 16 nt, Human
auccugaggcuccacu

SEQ ID NO: 3256129 - RNA, 18 nt, Human
auccugaggcuccacuug

SEQ ID NO: 3256130 - RNA, 17 nt, Human
uugacacuuaaaaaugg

SEQ ID NO: 3256131 - RNA, 20 nt, Human
aucauuaucagccugugcca

SEQ ID NO: 3256132 - RNA, 23 nt, Human
aucacuugaacccgggaggcaga

SEQ ID NO: 3256133 - RNA, 20 nt, Human
auccauggggcugauuguau

SEQ ID NO: 3256134 - RNA, 16 nt, Human
uucagauuugccuuau

SEQ ID NO: 3256135 - RNA, 15 nt, Human
uucaucaaugaauga

SEQ ID NO: 3256136 - RNA, 23 nt, Human
auauguaccuaacgaaguauccu

SEQ ID NO: 3256137 - RNA, 13 nt, Human
aucaauuuaaaaa

SEQ ID NO: 3256138 - RNA, 12 nt, Human
auugguguugac

SEQ ID NO: 3256139 - RNA, 15 nt, Human
auugugauguguccu

SEQ ID NO: 3256140 - RNA, 14 nt, Human
auugugaugugucc

SEQ ID NO: 3256141 - RNA, 13 nt, Human
auugugauguguc

SEQ ID NO: 3256142 - RNA, 18 nt, Human
auugacccacaagaaaug

SEQ ID NO: 3256143 - RNA, 12 nt, Human
auuaccagggac

SEQ ID NO: 3256144 - RNA, 10 nt, Human
augugugugu

SEQ ID NO: 3256145 - RNA, 13 nt, Human
auguggaagugug

SEQ ID NO: 3256146 - RNA, 16 nt, Human
auguggaagugugggu

SEQ ID NO: 3256147 - RNA, 15 nt, Human
auguggaaguguggg

SEQ ID NO: 3256148 - RNA, 23 nt, Human
auguggaagugugggucugugug

SEQ ID NO: 3256149 - RNA, 22 nt, Human
auguggaagugugggucugugu

SEQ ID NO: 3256150 - RNA, 20 nt, Human
ugagaugcuagaacucccuu

SEQ ID NO: 3256151 - RNA, 20 nt, Human
ugagacucugucucagucca

SEQ ID NO: 3256152 - RNA, 15 nt, Human
ugacacuuaaaaaug

SEQ ID NO: 3256153 - RNA, 21 nt, Human
agaugcuagaacucccuuuca

SEQ ID NO: 3256154 - RNA, 15 nt, Human
agaugcuagaacucc

SEQ ID NO: 3256155 - RNA, 19 nt, Human
agaugcuagaacucccuuu

SEQ ID NO: 3256156 - RNA, 21 nt, Human
agauugugccccugcacucca

SEQ ID NO: 3256157 - RNA, 17 nt, Human
ugaaagaggaaugaagu

SEQ ID NO: 3256158 - RNA, 14 nt, Human
agagacagaaagca

SEQ ID NO: 3256159 - RNA, 17 nt, Human
ugaaguacucauacaug

SEQ ID NO: 3256160 - RNA, 22 nt, Human
ugaacccauauuuguacaccaa

SEQ ID NO: 3256161 - RNA, 18 nt, Human
ugaacccgggaggcagag

SEQ ID NO: 3256162 - RNA, 13 nt, Human
ugaacaaauuuac

SEQ ID NO: 3256163 - RNA, 14 nt, Human
agaagaaguguguc

SEQ ID NO: 3256164 - RNA, 18 nt, Human
ucugcagauaaacaguag

SEQ ID NO: 3256165 - RNA, 15 nt, Human
ucugcagauaaacag

SEQ ID NO: 3256166 - RNA, 14 nt, Human
agaaaugaaagcag

SEQ ID NO: 3256167 - RNA, 23 nt, Human
ucugugagaugcuagaacucccu

SEQ ID NO: 3256168 - RNA, 17 nt, Human
ucugugagaugcuagaa

SEQ ID NO: 3256169 - RNA, 22 nt, Human
ucugugagaugcuagaacuccc

SEQ ID NO: 3256170 - RNA, 14 nt, Human
ucugugagaugcua

SEQ ID NO: 3256171 - RNA, 15 nt, Human
agaauuaacacauga

SEQ ID NO: 3256172 - RNA, 17 nt, Human
ucagauuugccuuauug

SEQ ID NO: 3256173 - RNA, 15 nt, Human
acccgggaggcagag

SEQ ID NO: 3256174 - RNA, 17 nt, Human
acccgggaggcagaggu

SEQ ID NO: 3256175 - RNA, 12 nt, Human
ucaguaugugga

SEQ ID NO: 3256176 - RNA, 14 nt, Human
ucaguauguggaag

SEQ ID NO: 3256177 - RNA, 16 nt, Human
ucauaaauuuaugguu

SEQ ID NO: 3256178 - RNA, 17 nt, Human
ucauguuuacagaggac

SEQ ID NO: 3256179 - RNA, 23 nt, Human
ucacagcaagucacuggccagug

SEQ ID NO: 3256180 - RNA, 23 nt, Human
ucacuugaacccgggaggcagag

SEQ ID NO: 3256181 - RNA, 23 nt, Human
ucaaugaaugaaugaauggcuaa

SEQ ID NO: 3256182 - RNA, 22 nt, Human
ucaauaucuuuuuuuuaauaaa

SEQ ID NO: 3256183 - RNA, 16 nt, Human
acaugagguacugaga

SEQ ID NO: 3256184 - RNA, 20 nt, Human
acaugagguacugagaguga

SEQ ID NO: 3256185 - RNA, 23 nt, Human
acaugagguacugagagugaaca

SEQ ID NO: 3256186 - RNA, 18 nt, Human
acugagagugaacaaauu

SEQ ID NO: 3256187 - RNA, 21 nt, Human
acucuggagguuuguuuagaa

SEQ ID NO: 3256188 - RNA, 19 nt, Human
acuccagugagacagcucu

SEQ ID NO: 3256189 - RNA, 11 nt, Human
uccauccugag

SEQ ID NO: 3256190 - RNA, 12 nt, Human
uccauccugagg

SEQ ID NO: 3256191 - RNA, 15 nt, Human
uccauccugaggcuc

SEQ ID NO: 3256192 - RNA, 19 nt, Human
accuugaaaacuuuaugcu

SEQ ID NO: 3256193 - RNA, 22 nt, Human
uccacugguucuucuuggucuc

SEQ ID NO: 3256194 - RNA, 11 nt, Human
acgcucucugg

SEQ ID NO: 3256195 - RNA, 18 nt, Human
uccagugagacagcucug

SEQ ID NO: 3256196 - RNA, 14 nt, Human
uccagugagacagc

SEQ ID NO: 3256197 - RNA, 22 nt, Human
uaacuuaaaagaacauguauau

SEQ ID NO: 3256198 - RNA, 18 nt, Human
uaagaagugaaaaucuac

SEQ ID NO: 3256199 - RNA, 21 nt, Human
uaagcaaaaugugauauguac

SEQ ID NO: 3256200 - RNA, 19 nt, Human
aaucuacacuccagugaga

SEQ ID NO: 3256201 - RNA, 22 nt, Human
aaugaauggcuaagcaaaaugu

SEQ ID NO: 3256202 - RNA, 22 nt, Human
aauugacccacaagaaaugaaa

SEQ ID NO: 3256203 - RNA, 21 nt, Human
aauugacccacaagaaaugaa

SEQ ID NO: 3256204 - RNA, 22 nt, Human
aauuccacuuauaggaauugac

SEQ ID NO: 3256205 - RNA, 18 nt, Human
acacaugauccugcaauu

SEQ ID NO: 3256206 - RNA, 19 nt, Human
uagaggagaaacuggaacu

SEQ ID NO: 3256207 - RNA, 22 nt, Human
uagaggagaaacuggaacucuc

SEQ ID NO: 3256208 - RNA, 20 nt, Human
acaagacccaaaaggcagaa

SEQ ID NO: 3256209 - RNA, 18 nt, Human
acaaauuuacagagacag

SEQ ID NO: 3256210 - RNA, 19 nt, Human
acaaauuuacagagacaga

SEQ ID NO: 3256211 - RNA, 16 nt, Human
uauguggaaguguggg

SEQ ID NO: 3256212 - RNA, 12 nt, Human
uauguggaagug

SEQ ID NO: 3256213 - RNA, 17 nt, Human
acaggaaguagaggagg

SEQ ID NO: 3256214 - RNA, 20 nt, Human
acagggaggacgcucucugg

SEQ ID NO: 3256215 - RNA, 21 nt, Human
acagggaggacgcucucuggc

SEQ ID NO: 3256216 - RNA, 19 nt, Human
uauggggauagaugugugg

SEQ ID NO: 3256217 - RNA, 20 nt, Human
uauggggauagaugugugga

SEQ ID NO: 3256218 - RNA, 21 nt, Human
guguaugugggggucugugug

SEQ ID NO: 3256219 - RNA, 13 nt, Human
guguauguggggg

SEQ ID NO: 3256220 - RNA, 17 nt, Human
aagcaacccaaauguuc

SEQ ID NO: 3256221 - RNA, 16 nt, Human
uaaaauugugaugugu

SEQ ID NO: 3256222 - RNA, 15 nt, Human
uaaaauugugaugug

SEQ ID NO: 3256223 - RNA, 9 nt, Human
uaaaauggu

SEQ ID NO: 3256224 - RNA, 18 nt, Human
aagugugggucugugugu

SEQ ID NO: 3256225 - RNA, 17 nt, Human
aagugugggucugugug

SEQ ID NO: 3256226 - RNA, 10 nt, Human
aagugugggu

SEQ ID NO: 3256227 - RNA, 20 nt, Human
aagugugggucugugugugu

SEQ ID NO: 3256228 - RNA, 21 nt, Human
uaaaaaaaaaccugagcccca

SEQ ID NO: 3256229 - RNA, 21 nt, Human
aagucacuggccaguggcugg

SEQ ID NO: 3256230 - RNA, 14 nt, Human
guuuaugauuccac

SEQ ID NO: 3256231 - RNA, 19 nt, Human
aagaagugugucacccuua

SEQ ID NO: 3256232 - RNA, 16 nt, Human
aagaaagaaaaucagg

SEQ ID NO: 3256233 - RNA, 14 nt, Human
aagaaagaaaauca

SEQ ID NO: 3256234 - RNA, 13 nt, Human
aagaaagaaaauc

SEQ ID NO: 3256235 - RNA, 10 nt, Human
gugauguguc

SEQ ID NO: 3256236 - RNA, 17 nt, Human
gugauuaccagggacug

SEQ ID NO: 3256237 - RNA, 11 nt, Human
gugauuaccag

SEQ ID NO: 3256238 - RNA, 16 nt, Human
gugauuaccagggacu

SEQ ID NO: 3256239 - RNA, 13 nt, Human
aacuucagacaua

SEQ ID NO: 3256240 - RNA, 14 nt, Human
aacucccuuucaac

SEQ ID NO: 3256241 - RNA, 22 nt, Human
guccaugaagauguagaggaga

SEQ ID NO: 3256242 - RNA, 20 nt, Human
gucacaggaaguagaggagg

SEQ ID NO: 3256243 - RNA, 21 nt, Human
gucaauuuuguuauguauauu

SEQ ID NO: 3256244 - RNA, 13 nt, Human
gucacaggaagua

SEQ ID NO: 3256245 - RNA, 15 nt, Human
gucacaggaaguaga

SEQ ID NO: 3256246 - RNA, 18 nt, Human
augugggggucugugugu

SEQ ID NO: 3256247 - RNA, 17 nt, Human
augugggggucugugug

SEQ ID NO: 3256248 - RNA, 16 nt, Human
augugggggucugugu

SEQ ID NO: 3256249 - RNA, 23 nt, Human
aguuguaucagcacguguggccu

SEQ ID NO: 3256250 - RNA, 20 nt, Human
aguuguaucagcacgugugg

SEQ ID NO: 3256251 - RNA, 19 nt, Human
aguuguaccgcaaugugac

SEQ ID NO: 3256252 - RNA, 18 nt, Human
aguuguaccgcaauguga

SEQ ID NO: 3256253 - RNA, 18 nt, Human
agugauuaccagggacug

SEQ ID NO: 3256254 - RNA, 15 nt, Human
agugauuaccaggga

SEQ ID NO: 3256255 - RNA, 14 nt, Human
auaauuacuauguc

SEQ ID NO: 3256256 - RNA, 15 nt, Human
auaucaauuuaaaaa

SEQ ID NO: 3256257 - RNA, 19 nt, Human
aggcuauggggauagaugu

SEQ ID NO: 3256258 - RNA, 22 nt, Human
aggcuauggggauagaugugug

SEQ ID NO: 3256259 - RNA, 21 nt, Human
aggcuauggggauagaugugu

SEQ ID NO: 3256260 - RNA, 14 nt, Human
aggauguugaaaaa

SEQ ID NO: 3256261 - RNA, 13 nt, Human
agccagaggucug

SEQ ID NO: 3256262 - RNA, 21 nt, Human
agaugggagaaucacuugaac

SEQ ID NO: 3256263 - RNA, 14 nt, Human
agauguagaggaga

SEQ ID NO: 3256264 - RNA, 21 nt, Human
agccgggcgugguggugagug

SEQ ID NO: 3256265 - RNA, 13 nt, Human
acauguuacaaca

SEQ ID NO: 3256266 - RNA, 20 nt, Human
acagcucugcauacucauua

SEQ ID NO: 3256267 - RNA, 13 nt, Human
acucagucuuuaa

SEQ ID NO: 3256268 - RNA, 12 nt, Human
acucccuuucaa

SEQ ID NO: 3256269 - RNA, 15 nt, Human
acuuggucugugaga

SEQ ID NO: 3256270 - RNA, 14 nt, Human
acuuggucugugag

SEQ ID NO: 3256271 - RNA, 13 nt, Human
acuuggucuguga

SEQ ID NO: 3256272 - RNA, 12 nt, Human
acuggaacucuc

SEQ ID NO: 3256273 - RNA, 22 nt, Human
aaugucaguauguggaagugug

SEQ ID NO: 3256274 - RNA, 16 nt, Human
aaugucaguaugugga

SEQ ID NO: 3256275 - RNA, 17 nt, Human
aauaagugccaggaugg

SEQ ID NO: 3256276 - RNA, 17 nt, Human
caaggcugauuaaacca

SEQ ID NO: 3256277 - RNA, 22 nt, Human
caaugugacuuaaugccacuaa

SEQ ID NO: 3256278 - RNA, 23 nt, Human
caaaacuucagacauagaauuaa

SEQ ID NO: 3256279 - RNA, 12 nt, Human
uauucccaugag

SEQ ID NO: 3256280 - RNA, 13 nt, Human
ucaaugcagcccc

SEQ ID NO: 3256281 - RNA, 14 nt, Human
ucaccaaggcugau

SEQ ID NO: 3256282 - RNA, 16 nt, Human
ucacagucacauucca

SEQ ID NO: 3256283 - RNA, 17 nt, Human
ucacaagacccaaaagg

SEQ ID NO: 3256284 - RNA, 13 nt, Human
ucacaagacccaa

SEQ ID NO: 3256285 - RNA, 14 nt, Human
ucauuccagaggaa

SEQ ID NO: 3256286 - RNA, 12 nt, Human
ucauagcagcuu

SEQ ID NO: 3256287 - RNA, 14 nt, Human
uccacuuggucugu

SEQ ID NO: 3256288 - RNA, 15 nt, Human
uccacuuggucugug

SEQ ID NO: 3256289 - RNA, 16 nt, Human
uccacuuggucuguga

SEQ ID NO: 3256290 - RNA, 10 nt, Human
ucuggccuuc

SEQ ID NO: 3256291 - RNA, 17 nt, Human
ucuggccuucggccucc

SEQ ID NO: 3256292 - RNA, 18 nt, Human
ucuggccuucggccucca

SEQ ID NO: 3256293 - RNA, 23 nt, Human
ucucuggccuucggccuccaucc

SEQ ID NO: 3256294 - RNA, 18 nt, Human
ucggccuccauccugagg

SEQ ID NO: 3256295 - RNA, 17 nt, Human
ucggccuccauccugag

SEQ ID NO: 3256296 - RNA, 20 nt, Human
uccugccuaagugcagcccc

SEQ ID NO: 3256297 - RNA, 21 nt, Human
ugcauuauauuuguaaauuua

SEQ ID NO: 3256298 - RNA, 17 nt, Human
ugcaugguuuagaaagc

SEQ ID NO: 3256299 - RNA, 19 nt, Human
ugcagauaaacaguaguga

SEQ ID NO: 3256300 - RNA, 17 nt, Human
ugcagauaaacaguagu

SEQ ID NO: 3256301 - RNA, 22 nt, Human
ugccaucauguuuacagaggac

SEQ ID NO: 3256302 - RNA, 16 nt, Human
ugccaucauguuuaca

SEQ ID NO: 3256303 - RNA, 17 nt, Human
ugaguuggcugggaaua

SEQ ID NO: 3256304 - RNA, 16 nt, Human
ugaguuggcugggaau

SEQ ID NO: 3256305 - RNA, 14 nt, Human
ugaguuggcuggga

SEQ ID NO: 3256306 - RNA, 24 nt, Human
ugauaguuguaccgcaaugugacu

SEQ ID NO: 3256307 - RNA, 14 nt, Human
ugagacagcucugc

SEQ ID NO: 3256308 - RNA, 16 nt, Human
ugagacagcucugcau

SEQ ID NO: 3256309 - RNA, 12 nt, Human
ugagacagcucu

SEQ ID NO: 3256310 - RNA, 14 nt, Human
ugagaugcuagaac

SEQ ID NO: 3256311 - RNA, 16 nt, Human
ugagaugcuagaacuc

SEQ ID NO: 3256312 - RNA, 17 nt, Human
uguaaauuuaugugaug

SEQ ID NO: 3256313 - RNA, 12 nt, Human
uguaaaauggug

SEQ ID NO: 3256314 - RNA, 11 nt, Human
uguaaaauggu

SEQ ID NO: 3256315 - RNA, 22 nt, Human
uggccuucggccuccauccuga

SEQ ID NO: 3256316 - RNA, 20 nt, Human
uggccuucggccuccauccu

SEQ ID NO: 3256317 - RNA, 23 nt, Human
uggccuucggccuccauccugag

SEQ ID NO: 3256318 - RNA, 13 nt, Human
ugggaguguguaa

SEQ ID NO: 3256319 - RNA, 15 nt, Human
uuggucugugagaug

SEQ ID NO: 3256320 - RNA, 16 nt, Human
uuggucugugagaugc

SEQ ID NO: 3256321 - RNA, 12 nt, Human
uugugccccugc

SEQ ID NO: 3256322 - RNA, 21 nt, Human
uuccugaggaagagggacugu

SEQ ID NO: 3256323 - RNA, 14 nt, Human
uugacccacaagaa

SEQ ID NO: 3256324 - RNA, 17 nt, Human
uugacccacaagaaaug

SEQ ID NO: 3256325 - RNA, 21 nt, Human
uuuuauuuuucucaugaugag

SEQ ID NO: 3256326 - RNA, 13 nt, Human
cauuccagaggaa

SEQ ID NO: 3256327 - RNA, 14 nt, Human
cauuccagaggaag

SEQ ID NO: 3256328 - RNA, 23 nt, Human
caugggacagggaggacgcucuc

SEQ ID NO: 3256329 - RNA, 13 nt, Human
caucauguuuaca

SEQ ID NO: 3256330 - RNA, 21 nt, Human
caucauguuuacagaggacag

SEQ ID NO: 3256331 - RNA, 19 nt, Human
caucauguuuacagaggac

SEQ ID NO: 3256332 - RNA, 16 nt, Human
caugagguacugagag

SEQ ID NO: 3256333 - RNA, 19 nt, Human
caugaguuggcugggaaua

SEQ ID NO: 3256334 - RNA, 19 nt, Human
caugagguacugagaguga

SEQ ID NO: 3256335 - RNA, 18 nt, Human
caugaagauguagaggag

SEQ ID NO: 3256336 - RNA, 19 nt, Human
caugaagauguagaggaga

SEQ ID NO: 3256337 - RNA, 16 nt, Human
ccaugggacagggagg

SEQ ID NO: 3256338 - RNA, 19 nt, Human
ccaugggacagggaggacg

SEQ ID NO: 3256339 - RNA, 19 nt, Human
ccugaggaagagggacugu

SEQ ID NO: 3256340 - RNA, 11 nt, Human
ccugagcccca

SEQ ID NO: 3256341 - RNA, 20 nt, Human
ccuugaaaacuuuaugcuaa

SEQ ID NO: 3256342 - RNA, 14 nt, Human
ccuucggccuccau

SEQ ID NO: 3256343 - RNA, 19 nt, Human
ccuucggccuccauccuga

SEQ ID NO: 3256344 - RNA, 20 nt, Human
ccuucggccuccauccugag

SEQ ID NO: 3256345 - RNA, 18 nt, Human
ccucucauuccagaggaa

SEQ ID NO: 3256346 - RNA, 14 nt, Human
ccuccauccugagg

SEQ ID NO: 3256347 - RNA, 22 nt, Human
ccgggucaucuguaccucugcc

SEQ ID NO: 3256348 - RNA, 16 nt, Human
ccgggcguggugguga

SEQ ID NO: 3256349 - RNA, 15 nt, Human
cccgugggguuccuc

SEQ ID NO: 3256350 - RNA, 20 nt, Human
cccacaagaaaugaaagcag

SEQ ID NO: 3256351 - RNA, 13 nt, Human
cccacaagaaaug

SEQ ID NO: 3256352 - RNA, 14 nt, Human
cuguguguguguau

SEQ ID NO: 3256353 - RNA, 16 nt, Human
cuguguguguguaugu

SEQ ID NO: 3256354 - RNA, 15 nt, Human
cuguguguguguaug

SEQ ID NO: 3256355 - RNA, 20 nt, Human
cuguguguuuaugugugugu

SEQ ID NO: 3256356 - RNA, 18 nt, Human
cuguguguuuaugugugu

SEQ ID NO: 3256357 - RNA, 20 nt, Human
cuguguguguguaugugggg

SEQ ID NO: 3256358 - RNA, 18 nt, Human
cuguguguguguaugugg

SEQ ID NO: 3256359 - RNA, 15 nt, Human
cuucagccugaaaga

SEQ ID NO: 3256360 - RNA, 19 nt, Human
cuucggccuccauccugag

SEQ ID NO: 3256361 - RNA, 20 nt, Human
cuucggccuccauccugagg

SEQ ID NO: 3256362 - RNA, 20 nt, Human
gaauaagugccaggauggaa

SEQ ID NO: 3256363 - RNA, 14 nt, Human
gaaugccuccugca

SEQ ID NO: 3256364 - RNA, 13 nt, Human
gaacuauuagagc

SEQ ID NO: 3256365 - RNA, 14 nt, Human
gaacucccuuucaa

SEQ ID NO: 3256366 - RNA, 14 nt, Human
cuauuguagagcca

SEQ ID NO: 3256367 - RNA, 13 nt, Human
cuccauccugagg

SEQ ID NO: 3256368 - RNA, 12 nt, Human
cuccauccugag

SEQ ID NO: 3256369 - RNA, 11 nt, Human
cuccauccuga

SEQ ID NO: 3256370 - RNA, 13 nt, Human
cugauuguauuua

SEQ ID NO: 3256371 - RNA, 15 nt, Human
cugaggcuccacuug

SEQ ID NO: 3256372 - RNA, 21 nt, Human
cugaggcuccacuuggucugu

SEQ ID NO: 3256373 - RNA, 21 nt, Human
cucuggccuucggccuccauc

SEQ ID NO: 3256374 - RNA, 19 nt, Human
cucuggccuucggccucca

SEQ ID NO: 3256375 - RNA, 22 nt, Human
cucuggccuucggccuccaucc

SEQ ID NO: 3256376 - RNA, 12 nt, Human
cugagcaggugu

SEQ ID NO: 3256377 - RNA, 21 nt, Human
gauguguccugauaagcugag

SEQ ID NO: 3256378 - RNA, 13 nt, Human
gauugugccccug

SEQ ID NO: 3256379 - RNA, 20 nt, Human
gauggcaaagaaggagagca

SEQ ID NO: 3256380 - RNA, 22 nt, Human
gaugcuagaacucccuuucaac

SEQ ID NO: 3256381 - RNA, 14 nt, Human
gagucccugccauc

SEQ ID NO: 3256382 - RNA, 22 nt, Human
gagguuuguuuagaagaagugu

SEQ ID NO: 3256383 - RNA, 22 nt, Human
gagugaacaaauuuacagagac

SEQ ID NO: 3256384 - RNA, 19 nt, Human
gagugaacaaauuuacaga

SEQ ID NO: 3256385 - RNA, 15 nt, Human
gaggaugucugggcc

SEQ ID NO: 3256386 - RNA, 19 nt, Human
gaggcagagguugcaguga

SEQ ID NO: 3256387 - RNA, 15 nt, Human
gccacgauugcagga

SEQ ID NO: 3256388 - RNA, 22 nt, Human
gccaugggacagggaggacgcu

SEQ ID NO: 3256389 - RNA, 23 nt, Human
gccaugggacagggaggacgcuc

SEQ ID NO: 3256390 - RNA, 23 nt, Human
gcagagguugcagugagccgaga

SEQ ID NO: 3256391 - RNA, 18 nt, Human
gcagagguugcagugagc

SEQ ID NO: 3256392 - RNA, 14 nt, Human
gcuggggaugucuc

SEQ ID NO: 3256393 - RNA, 22 nt, Human
gcugggcuuggcagcccggguc

SEQ ID NO: 3256394 - RNA, 14 nt, Human
gcugauuguauuua

SEQ ID NO: 3256395 - RNA, 21 nt, Human
gcugauuaaaccaaggcuaga

SEQ ID NO: 3256396 - RNA, 17 nt, Human
gccugagcgacagugag

SEQ ID NO: 3256397 - RNA, 20 nt, Human
gccugagcgacagugagacu

SEQ ID NO: 3256398 - RNA, 20 nt, Human
ggccucucauuccagaggaa

SEQ ID NO: 3256399 - RNA, 16 nt, Human
ggccugacucucagca

SEQ ID NO: 3256400 - RNA, 16 nt, Human
ggcuccacuuggucug

SEQ ID NO: 3256401 - RNA, 20 nt, Human
ggcuaguaucaaaagaaaga

SEQ ID NO: 3256402 - RNA, 17 nt, Human
gggaggacgcucucugg

SEQ ID NO: 3256403 - RNA, 20 nt, Human
gggaggacgcucucuggccu

SEQ ID NO: 3256404 - RNA, 20 nt, Human
gggacaccaagccuuggcuc

SEQ ID NO: 3256405 - RNA, 21 nt, Human
gggacugaggggaggggagca

SEQ ID NO: 3256406 - RNA, 16 nt, Human
ggaggacgcucucugg

SEQ ID NO: 3256407 - RNA, 19 nt, Human
ggaggggagcaugggaagu

SEQ ID NO: 3256408 - RNA, 15 nt, Human
ggacgcucucuggcc

SEQ ID NO: 3256409 - RNA, 16 nt, Human
ggacgcucucuggccu

SEQ ID NO: 3256410 - RNA, 19 nt, Human
ggacgcucucuggccuucg

SEQ ID NO: 3256411 - RNA, 21 nt, Human
ggcagagguugcagugagccg

SEQ ID NO: 3256412 - RNA, 19 nt, Human
cacguguggccuguucuuc

SEQ ID NO: 3256413 - RNA, 22 nt, Human
cacguucuuacuaguuucccuu

SEQ ID NO: 3256414 - RNA, 21 nt, Human
cacuaaauugacacuuaaaaa

SEQ ID NO: 3256415 - RNA, 20 nt, Human
cacuugaacccgggaggcag

SEQ ID NO: 3256416 - RNA, 21 nt, Human
cacuugaacccgggaggcaga

SEQ ID NO: 3256417 - RNA, 23 nt, Human
cacuugaacccgggaggcagagg

SEQ ID NO: 3256418 - RNA, 15 nt, Human
cacuuggucugugag

SEQ ID NO: 3256419 - RNA, 17 nt, Human
cagacauagaauuaaca

SEQ ID NO: 3256420 - RNA, 19 nt, Human
cagacauagaauuaacaca

SEQ ID NO: 3256421 - RNA, 19 nt, Human
cagaagcaacccaaauguu

SEQ ID NO: 3256422 - RNA, 20 nt, Human
cagaagcaacccaaauguuc

SEQ ID NO: 3256423 - RNA, 18 nt, Human
cagaaagcagaacaguga

SEQ ID NO: 3256424 - RNA, 19 nt, Human
cagaaagcagaacagugau

SEQ ID NO: 3256425 - RNA, 18 nt, Human
cagaacagugauuaccag

SEQ ID NO: 3256426 - RNA, 23 nt, Human
cagaacagugauuaccagggacu

SEQ ID NO: 3256427 - RNA, 23 nt, Human
cagauaaauaguuuaugauucca

SEQ ID NO: 3256428 - RNA, 14 nt, Human
cagauaaacaguag

SEQ ID NO: 3256429 - RNA, 22 nt, Human
cagaggacaguauuugugggga

SEQ ID NO: 3256430 - RNA, 16 nt, Human
caggaaguagaggagg

SEQ ID NO: 3256431 - RNA, 15 nt, Human
caggaaguagaggag

SEQ ID NO: 3256432 - RNA, 23 nt, Human
cagcuuuccucaaaacuucagac

SEQ ID NO: 3256433 - RNA, 20 nt, Human
cagcucugcauacucauuag

SEQ ID NO: 3256434 - RNA, 19 nt, Human
cagcuacuugggaggcuga

SEQ ID NO: 3256435 - RNA, 14 nt, Human
caggagucccugcc

SEQ ID NO: 3256436 - RNA, 21 nt, Human
caggagucccugccaucaugu

SEQ ID NO: 3256437 - RNA, 15 nt, Human
caggagucccugcca

SEQ ID NO: 3256438 - RNA, 22 nt, Human
cagucuuuaaucugagaggcca

SEQ ID NO: 3256439 - RNA, 15 nt, Human
cagugagacagcucu

SEQ ID NO: 3256440 - RNA, 18 nt, Human
cagugauuaccagggacu

SEQ ID NO: 3256441 - RNA, 17 nt, Human
cagugauuaccagggac

SEQ ID NO: 3256442 - RNA, 12 nt, Human
caguauguggaa

SEQ ID NO: 3256443 - RNA, 13 nt, Human
caguccaugaaga

SEQ ID NO: 3256444 - RNA, 12 nt, Human
caguagugauag

SEQ ID NO: 3256445 - RNA, 12 nt, Human
caguauggcagc

SEQ ID NO: 3256446 - RNA, 12 nt, Human
cagguguucuuc

SEQ ID NO: 3256447 - RNA, 16 nt, Human
cugugagaugcuagaa

SEQ ID NO: 3256448 - RNA, 22 nt, Human
cuggggaugucucucaugacca

SEQ ID NO: 3256449 - RNA, 17 nt, Human
cuggggaugucucucau

SEQ ID NO: 3256450 - RNA, 22 nt, Human
cugccaucauguuuacagagga

SEQ ID NO: 3256451 - RNA, 17 nt, Human
cugccaucauguuuaca

SEQ ID NO: 3256452 - RNA, 23 nt, Human
cugccaucauguuuacagaggac

SEQ ID NO: 3256453 - RNA, 21 nt, Human
gaaaacuuuaugcuaagugaa

SEQ ID NO: 3256454 - RNA, 18 nt, Human
cuuauuggcagcucuacu

SEQ ID NO: 3256455 - RNA, 15 nt, Human
gacaguauuuguggg

SEQ ID NO: 3256456 - RNA, 20 nt, Human
gacaguauggcagcuuuccu

SEQ ID NO: 3256457 - RNA, 16 nt, Human
gacacuuaaaaauggu

SEQ ID NO: 3256458 - RNA, 19 nt, Human
gaagggcagggcugaggcc

SEQ ID NO: 3256459 - RNA, 15 nt, Human
gaaggcuauggggau

SEQ ID NO: 3256460 - RNA, 18 nt, Human
gaagugugggucugugug

SEQ ID NO: 3256461 - RNA, 17 nt, Human
gaagugugggucugugu

SEQ ID NO: 3256462 - RNA, 20 nt, Human
gaaugaauggcuaagcaaaa

SEQ ID NO: 3256463 - RNA, 14 nt, Human
gagaaucacuugaa

SEQ ID NO: 3256464 - RNA, 15 nt, Human
gagaaucacuugaac

SEQ ID NO: 3256465 - RNA, 19 nt, Human
gagcuggggaugucucuca

SEQ ID NO: 3256466 - RNA, 19 nt, Human
gcagggacuugaacccaua

SEQ ID NO: 3256467 - RNA, 20 nt, Human
gauauguaccuaacgaagua

SEQ ID NO: 3256468 - RNA, 18 nt, Human
gagugaggaugucugggc

SEQ ID NO: 3256469 - RNA, 13 nt, Human
gaguuggcuggga

SEQ ID NO: 3256470 - RNA, 14 nt, Human
gauuaccagggacu

SEQ ID NO: 3256471 - RNA, 15 nt, Human
gccuccauccugagg

SEQ ID NO: 3256472 - RNA, 16 nt, Human
gccuccauccugaggc

SEQ ID NO: 3256473 - RNA, 20 nt, Human
gccuccauccugaggcucca

SEQ ID NO: 3256474 - RNA, 17 nt, Human
gcuacuugggaggcuga

SEQ ID NO: 3256475 - RNA, 14 nt, Human
gccaggauggaaug

SEQ ID NO: 3256476 - RNA, 23 nt, Human
gccaguggcuggaucugugaggg

SEQ ID NO: 3256477 - RNA, 14 nt, Human
gccaguggcuggau

SEQ ID NO: 3256478 - RNA, 14 nt, Human
gcugaggccucuca

SEQ ID NO: 3256479 - RNA, 15 nt, Human
gcucugcccauccug

SEQ ID NO: 3256480 - RNA, 20 nt, Human
gcuccacuuggucugugaga

SEQ ID NO: 3256481 - RNA, 19 nt, Human
gcuccacuuggucugugag

SEQ ID NO: 3256482 - RNA, 14 nt, Human
ggaacugcugggcu

SEQ ID NO: 3256483 - RNA, 20 nt, Human
gcuguagacauuugcuauga

SEQ ID NO: 3256484 - RNA, 19 nt, Human
gcuuuccucaucaggccau

SEQ ID NO: 3256485 - RNA, 19 nt, Human
ggccaguggcuggaucugu

SEQ ID NO: 3256486 - RNA, 18 nt, Human
ggccagcaccaucucuuu

SEQ ID NO: 3256487 - RNA, 17 nt, Human
ggcccugugccuuggug

SEQ ID NO: 3256488 - RNA, 22 nt, Human
ggccuucggccuccauccugag

SEQ ID NO: 3256489 - RNA, 23 nt, Human
ggccuucggccuccauccugagg

SEQ ID NO: 3256490 - RNA, 16 nt, Human
gggauuguaaaauggu

SEQ ID NO: 3256491 - RNA, 19 nt, Human
gggagaaugucaguaugug

SEQ ID NO: 3256492 - RNA, 22 nt, Human
gggagaaugucaguauguggaa

SEQ ID NO: 3256493 - RNA, 14 nt, Human
gggaugucucucau

SEQ ID NO: 3256494 - RNA, 18 nt, Human
gggcucagagugggguag

SEQ ID NO: 3256495 - RNA, 15 nt, Human
aaaaugugauaugua

SEQ ID NO: 3256496 - RNA, 15 nt, Human
gggcgugguggugag

SEQ ID NO: 3256497 - RNA, 17 nt, Human
ggucuguguguguguau

SEQ ID NO: 3256498 - RNA, 11 nt, Human
ggucugugugu

SEQ ID NO: 3256499 - RNA, 24 nt, Human
ggucugugagaugcuagaacuccc

SEQ ID NO: 3256500 - RNA, 21 nt, Human
ggucuguguguguguaugugg

SEQ ID NO: 3256501 - RNA, 20 nt, Human
ggucuguguguguguaugug

SEQ ID NO: 3256502 - RNA, 16 nt, Human
ggugugaccacugcag

SEQ ID NO: 3256503 - RNA, 16 nt, Human
gguuuagaaagcuugc

SEQ ID NO: 3256504 - RNA, 17 nt, Human
guaaauuuaugugaugg

SEQ ID NO: 3256505 - RNA, 16 nt, Human
guaaauuuaugugaug

SEQ ID NO: 3256506 - RNA, 11 nt, Human
cucucuggccu

SEQ ID NO: 3256507 - RNA, 12 nt, Human
cucucuggccuu

SEQ ID NO: 3256508 - RNA, 19 nt, Human
cucuauguucuaagaagug

SEQ ID NO: 3256509 - RNA, 15 nt, Human
cuacaugagguacug

SEQ ID NO: 3256510 - RNA, 20 nt, Human
cuaagugaaauaagccagac

SEQ ID NO: 3256511 - RNA, 23 nt, Human
cuaagugaaauaagccagacauc

SEQ ID NO: 3256512 - RNA, 16 nt, Human
cuagaacucccuuuca

SEQ ID NO: 3256513 - RNA, 17 nt, Human
cuagaacucccuuucaa

SEQ ID NO: 3256514 - RNA, 18 nt, Human
cuagaacucccuuucaac

SEQ ID NO: 3256515 - RNA, 19 nt, Human
cuagaacucccuuucaaca

SEQ ID NO: 3256516 - RNA, 13 nt, Human
cuagaacucccuu

SEQ ID NO: 3256517 - RNA, 15 nt, Human
cgacagugagacucu

SEQ ID NO: 3256518 - RNA, 16 nt, Human
cgacagugagacucug

SEQ ID NO: 3256519 - RNA, 22 nt, Human
cccauuguggucacaggaagua

SEQ ID NO: 3256520 - RNA, 23 nt, Human
cccauuguggucacaggaaguag

SEQ ID NO: 3256521 - RNA, 23 nt, Human
cccgggaggcagagguugcagug

SEQ ID NO: 3256522 - RNA, 24 nt, Human
cccugugccuuggugugcuguauc

SEQ ID NO: 3256523 - RNA, 20 nt, Human
ccucauguccacugguucuu

SEQ ID NO: 3256524 - RNA, 15 nt, Human
ccucauguccacugg

SEQ ID NO: 3256525 - RNA, 14 nt, Human
ccugacucucagca

SEQ ID NO: 3256526 - RNA, 21 nt, Human
cacugcagaagacaguauggc

SEQ ID NO: 3256527 - RNA, 22 nt, Human
cacugguucuucuuggucucag

SEQ ID NO: 3256528 - RNA, 13 nt, Human
auuguaaaauggu

SEQ ID NO: 3256529 - RNA, 14 nt, Human
auuguaaaauggug

SEQ ID NO: 3256530 - RNA, 19 nt, Human
auucauagcagcuuauuca

SEQ ID NO: 3256531 - RNA, 22 nt, Human
auucauagcagcuuauucacaa

SEQ ID NO: 3256532 - RNA, 19 nt, Human
auucacaagacccaaaagg

SEQ ID NO: 3256533 - RNA, 22 nt, Human
auuuguggggagggauuugggg

SEQ ID NO: 3256534 - RNA, 20 nt, Human
auuugcuaugagcuggggau

SEQ ID NO: 3256535 - RNA, 16 nt, Human
auuugcuaugagcugg

SEQ ID NO: 3256536 - RNA, 15 nt, Human
caaaaggcagaagca

SEQ ID NO: 3256537 - RNA, 20 nt, Human
caaaaaaaaaaaaaaauuag

SEQ ID NO: 3256538 - RNA, 19 nt, Human
cagccccgugggguuccuc

SEQ ID NO: 3256539 - RNA, 22 nt, Human
cagccugagcgacagugagacu

SEQ ID NO: 3256540 - RNA, 23 nt, Human
cagccugagcgacagugagacuc

SEQ ID NO: 3256541 - RNA, 23 nt, Human
cagaucauuaucagccugugcca

SEQ ID NO: 3256542 - RNA, 15 nt, Human
caguauuugugggga

SEQ ID NO: 3256543 - RNA, 22 nt, Human
cagggaggacgcucucuggccu

SEQ ID NO: 3256544 - RNA, 19 nt, Human
cagggaggacgcucucugg

SEQ ID NO: 3256545 - RNA, 16 nt, Human
cagcuuauucacaaga

SEQ ID NO: 3256546 - RNA, 20 nt, Human
cauagcagcuuauucacaag

SEQ ID NO: 3256547 - RNA, 18 nt, Human
ccaaauguucaucaauga

SEQ ID NO: 3256548 - RNA, 15 nt, Human
cauuaggauggcuag

SEQ ID NO: 3256549 - RNA, 23 nt, Human
auugcaggagucccugccaucau

SEQ ID NO: 3256550 - RNA, 21 nt, Human
auugacccacaagaaaugaaa

SEQ ID NO: 3256551 - RNA, 20 nt, Human
auugacacuuaaaaaugguu

SEQ ID NO: 3256552 - RNA, 20 nt, Human
auuuaaaauugugauguguc

SEQ ID NO: 3256553 - RNA, 19 nt, Human
auuuaaaauugugaugugu

SEQ ID NO: 3256554 - RNA, 13 nt, Human
auugugccccugc

SEQ ID NO: 3256555 - RNA, 19 nt, Human
auguuuacagaggacagua

SEQ ID NO: 3256556 - RNA, 17 nt, Human
auguuuacagaggacag

SEQ ID NO: 3256557 - RNA, 15 nt, Human
auguuuacagaggac

SEQ ID NO: 3256558 - RNA, 19 nt, Human
auguucaucaaugaaugaa

SEQ ID NO: 3256559 - RNA, 18 nt, Human
auguucaucaaugaauga

SEQ ID NO: 3256560 - RNA, 19 nt, Human
uuugcuaugagcuggggau

SEQ ID NO: 3256561 - RNA, 14 nt, Human
augucaguaugugg

SEQ ID NO: 3256562 - RNA, 13 nt, Human
augucaguaugug

SEQ ID NO: 3256563 - RNA, 17 nt, Human
uuuguaaauuuauguga

SEQ ID NO: 3256564 - RNA, 20 nt, Human
auuccacuuauaggaauuga

SEQ ID NO: 3256565 - RNA, 20 nt, Human
aucugagaggccacagugca

SEQ ID NO: 3256566 - RNA, 16 nt, Human
aucuguaccucugccu

SEQ ID NO: 3256567 - RNA, 15 nt, Human
augaaagcagggacu

SEQ ID NO: 3256568 - RNA, 18 nt, Human
augaagauguagaggaga

SEQ ID NO: 3256569 - RNA, 13 nt, Human
augaaugaauggc

SEQ ID NO: 3256570 - RNA, 21 nt, Human
auggaaugaugggucaguugu

SEQ ID NO: 3256571 - RNA, 16 nt, Human
auggccugggggaugu

SEQ ID NO: 3256572 - RNA, 20 nt, Human
auggcuaguaucaaaagaaa

SEQ ID NO: 3256573 - RNA, 12 nt, Human
uuuaugugaugg

SEQ ID NO: 3256574 - RNA, 13 nt, Human
uuuaugugugugu

SEQ ID NO: 3256575 - RNA, 11 nt, Human
uuuaugugugu

SEQ ID NO: 3256576 - RNA, 16 nt, Human
augcuagaacucccuu

SEQ ID NO: 3256577 - RNA, 15 nt, Human
augcuagaacucccu

SEQ ID NO: 3256578 - RNA, 15 nt, Human
augccacuaaauuga

SEQ ID NO: 3256579 - RNA, 17 nt, Human
augccacuaaauugaca

SEQ ID NO: 3256580 - RNA, 20 nt, Human
auaguuguaccgcaauguga

SEQ ID NO: 3256581 - RNA, 22 nt, Human
auaggaauugacccacaagaaa

SEQ ID NO: 3256582 - RNA, 22 nt, Human
uucacaagacccaaaaggcaga

SEQ ID NO: 3256583 - RNA, 23 nt, Human
uucacaagacccaaaaggcagaa

SEQ ID NO: 3256584 - RNA, 24 nt, Human
ugauaagcagucauccucagauca

SEQ ID NO: 3256585 - RNA, 18 nt, Human
ugaguucauaaauuuaug

SEQ ID NO: 3256586 - RNA, 21 nt, Human
ugauagaaggcuauggggaua

SEQ ID NO: 3256587 - RNA, 14 nt, Human
ugauuaccagggac

SEQ ID NO: 3256588 - RNA, 12 nt, Human
ugauuaaaccaa

SEQ ID NO: 3256589 - RNA, 17 nt, Human
agcuacuugggaggcug

SEQ ID NO: 3256590 - RNA, 18 nt, Human
agcuacuugggaggcuga

SEQ ID NO: 3256591 - RNA, 22 nt, Human
agccugaaagaggaaugaagua

SEQ ID NO: 3256592 - RNA, 15 nt, Human
agccucauguccacu

SEQ ID NO: 3256593 - RNA, 18 nt, Human
agccccgugggguuccuc

SEQ ID NO: 3256594 - RNA, 23 nt, Human
uggccaguggcuggaucugugag

SEQ ID NO: 3256595 - RNA, 21 nt, Human
uggccuguucuucuauggguu

SEQ ID NO: 3256596 - RNA, 19 nt, Human
aggacaguauuugugggga

SEQ ID NO: 3256597 - RNA, 12 nt, Human
aggacaguauuu

SEQ ID NO: 3256598 - RNA, 23 nt, Human
ugcuguauccauccauggggcug

SEQ ID NO: 3256599 - RNA, 15 nt, Human
ugcuguagacauuug

SEQ ID NO: 3256600 - RNA, 20 nt, Human
ugguaggaacugcugggcuu

SEQ ID NO: 3256601 - RNA, 13 nt, Human
ugguaggaacugc

SEQ ID NO: 3256602 - RNA, 12 nt, Human
ugggucugugug

SEQ ID NO: 3256603 - RNA, 15 nt, Human
ugggguagguuggga

SEQ ID NO: 3256604 - RNA, 21 nt, Human
ugggguagguugggagaaugu

SEQ ID NO: 3256605 - RNA, 14 nt, Human
uggggcugauugua

SEQ ID NO: 3256606 - RNA, 22 nt, Human
ugucaguauguggaaguguggg

SEQ ID NO: 3256607 - RNA, 23 nt, Human
ugucauuugcuggagcucugccc

SEQ ID NO: 3256608 - RNA, 18 nt, Human
ugucaguauguggaagug

SEQ ID NO: 3256609 - RNA, 20 nt, Human
ugucaguauguggaagugug

SEQ ID NO: 3256610 - RNA, 19 nt, Human
ugucaguauguggaagugu

SEQ ID NO: 3256611 - RNA, 19 nt, Human
aguauguggaagugugggu

SEQ ID NO: 3256612 - RNA, 17 nt, Human
aguauguggaagugugg

SEQ ID NO: 3256613 - RNA, 15 nt, Human
aguauguggaagugu

SEQ ID NO: 3256614 - RNA, 22 nt, Human
uguaauuuaaaauugugaugug

SEQ ID NO: 3256615 - RNA, 21 nt, Human
uguaauuuaaaauugugaugu

SEQ ID NO: 3256616 - RNA, 18 nt, Human
uguagaggagaaacugga

SEQ ID NO: 3256617 - RNA, 16 nt, Human
uguagaggagaaacug

SEQ ID NO: 3256618 - RNA, 20 nt, Human
uguaauuuaaaauugugaug

SEQ ID NO: 3256619 - RNA, 18 nt, Human
uguaauuuaaaauuguga

SEQ ID NO: 3256620 - RNA, 17 nt, Human
uguaauuuaaaauugug

SEQ ID NO: 3256621 - RNA, 23 nt, Human
agguugggagaaugucaguaugu

SEQ ID NO: 3256622 - RNA, 13 nt, Human
uguguguguguau

SEQ ID NO: 3256623 - RNA, 16 nt, Human
uguguguguguaugug

SEQ ID NO: 3256624 - RNA, 21 nt, Human
agugccuguaaucacagcuac

SEQ ID NO: 3256625 - RNA, 16 nt, Human
uguugugugugggagu

SEQ ID NO: 3256626 - RNA, 15 nt, Human
uguugugugugggag

SEQ ID NO: 3256627 - RNA, 14 nt, Human
uguuguguguggga

SEQ ID NO: 3256628 - RNA, 23 nt, Human
agugugggucuguguguguguau

SEQ ID NO: 3256629 - RNA, 19 nt, Human
agugugggucugugugugu

SEQ ID NO: 3256630 - RNA, 15 nt, Human
agugugggucugugu

SEQ ID NO: 3256631 - RNA, 17 nt, Human
agugugggucugugugu

SEQ ID NO: 3256632 - RNA, 16 nt, Human
agugugggucugugug

SEQ ID NO: 3256633 - RNA, 16 nt, Human
uuagccuuugucccag

SEQ ID NO: 3256634 - RNA, 15 nt, Human
auaaauaguuuauga

SEQ ID NO: 3256635 - RNA, 20 nt, Human
uaugugggggucuguguguu

SEQ ID NO: 3256636 - RNA, 19 nt, Human
uaugugggggucugugugu

SEQ ID NO: 3256637 - RNA, 18 nt, Human
uaugugggggucugugug

SEQ ID NO: 3256638 - RNA, 12 nt, Human
ucaauuuaaaaa

SEQ ID NO: 3256639 - RNA, 13 nt, Human
ucaauuuaaaaaa

SEQ ID NO: 3256640 - RNA, 16 nt, Human
ucaguauguggaagug

SEQ ID NO: 3256641 - RNA, 16 nt, Human
acccaaauguucauca

SEQ ID NO: 3256642 - RNA, 22 nt, Human
uccaugaagauguagaggagaa

SEQ ID NO: 3256643 - RNA, 17 nt, Human
acgcucucuggccuucg

SEQ ID NO: 3256644 - RNA, 14 nt, Human
acgcucucuggccu

SEQ ID NO: 3256645 - RNA, 15 nt, Human
acgcucucuggccuu

SEQ ID NO: 3256646 - RNA, 16 nt, Human
acgcucucuggccuuc

SEQ ID NO: 3256647 - RNA, 12 nt, Human
accugagcccca

SEQ ID NO: 3256648 - RNA, 17 nt, Human
accugagccccaaaagg

SEQ ID NO: 3256649 - RNA, 15 nt, Human
ucuaccucuuggcug

SEQ ID NO: 3256650 - RNA, 21 nt, Human
acuugaacccgggaggcagag

SEQ ID NO: 3256651 - RNA, 23 nt, Human
acuugaacccgggaggcagaggu

SEQ ID NO: 3256652 - RNA, 17 nt, Human
agaacucccuuucaaca

SEQ ID NO: 3256653 - RNA, 15 nt, Human
agaacucccuuucaa

SEQ ID NO: 3256654 - RNA, 16 nt, Human
agaacucccuuucaac

SEQ ID NO: 3256655 - RNA, 19 nt, Human
agaagcaacccaaauguuc

SEQ ID NO: 3256656 - RNA, 20 nt, Human
ucugcccauccugccccuga

SEQ ID NO: 3256657 - RNA, 15 nt, Human
agaaacuggaacucu

SEQ ID NO: 3256658 - RNA, 17 nt, Human
agaaagcagaacaguga

SEQ ID NO: 3256659 - RNA, 18 nt, Human
agaaagcagaacagugau

SEQ ID NO: 3256660 - RNA, 20 nt, Human
agaaagcagaacagugauua

SEQ ID NO: 3256661 - RNA, 17 nt, Human
agacaucaacagauaaa

SEQ ID NO: 3256662 - RNA, 18 nt, Human
agacaucaacagauaaau

SEQ ID NO: 3256663 - RNA, 14 nt, Human
agacauagaauuaa

SEQ ID NO: 3256664 - RNA, 21 nt, Human
agacauagaauuaacacauga

SEQ ID NO: 3256665 - RNA, 14 nt, Human
agaaucacuugaac

SEQ ID NO: 3256666 - RNA, 22 nt, Human
ugaaaaaguucugcagauaaac

SEQ ID NO: 3256667 - RNA, 22 nt, Human
agagggacuguucuuuuguccc

SEQ ID NO: 3256668 - RNA, 17 nt, Human
ugacacuuaaaaauggu

SEQ ID NO: 3256669 - RNA, 16 nt, Human
ugacacuuaaaaaugg

SEQ ID NO: 3256670 - RNA, 23 nt, Human
aacccaaauguucaucaaugaau

SEQ ID NO: 3256671 - RNA, 18 nt, Human
aaccugagccccaaaagg

SEQ ID NO: 3256672 - RNA, 20 nt, Human
aaccugagccccaaaaggua

SEQ ID NO: 3256673 - RNA, 18 nt, Human
aaccuugaaaacuuuaug

SEQ ID NO: 3256674 - RNA, 21 nt, Human
gugagaugcuagaacucccuu

SEQ ID NO: 3256675 - RNA, 17 nt, Human
gucaguauguggaagug

SEQ ID NO: 3256676 - RNA, 21 nt, Human
gucaguauguggaaguguggg

SEQ ID NO: 3256677 - RNA, 13 nt, Human
gucaguuguauca

SEQ ID NO: 3256678 - RNA, 16 nt, Human
aacagauaaauaguuu

SEQ ID NO: 3256679 - RNA, 15 nt, Human
aacagugauuaccag

SEQ ID NO: 3256680 - RNA, 22 nt, Human
aacagugauuaccagggacuga

SEQ ID NO: 3256681 - RNA, 15 nt, Human
aaauuuaugugaugg

SEQ ID NO: 3256682 - RNA, 12 nt, Human
aaauuuauguga

SEQ ID NO: 3256683 - RNA, 12 nt, Human
aaauugugaugu

SEQ ID NO: 3256684 - RNA, 15 nt, Human
aaauugugauguguc

SEQ ID NO: 3256685 - RNA, 16 nt, Human
guauauuuuauaucaa

SEQ ID NO: 3256686 - RNA, 23 nt, Human
aagaggaaugaaguacucauaca

SEQ ID NO: 3256687 - RNA, 15 nt, Human
guguguauguggggg

SEQ ID NO: 3256688 - RNA, 13 nt, Human
guguguauguggg

SEQ ID NO: 3256689 - RNA, 20 nt, Human
gugugucacccuuaggccag

SEQ ID NO: 3256690 - RNA, 14 nt, Human
gugugggucugugu

SEQ ID NO: 3256691 - RNA, 12 nt, Human
guguguaugugg

SEQ ID NO: 3256692 - RNA, 13 nt, Human
aagauguagagga

SEQ ID NO: 3256693 - RNA, 19 nt, Human
gugggguagguugggagaa

SEQ ID NO: 3256694 - RNA, 13 nt, Human
uaccucuuggcug

SEQ ID NO: 3256695 - RNA, 19 nt, Human
uaccagggacugaggggag

SEQ ID NO: 3256696 - RNA, 13 nt, Human
aauguucaucaau

SEQ ID NO: 3256697 - RNA, 16 nt, Human
aauguucaucaaugaa

SEQ ID NO: 3256698 - RNA, 20 nt, Human
aauguucaucaaugaaugaa

SEQ ID NO: 3256699 - RNA, 20 nt, Human
uaauuuaaaauugugaugug

SEQ ID NO: 3256700 - RNA, 19 nt, Human
uaauuuaaaauugugaugu

SEQ ID NO: 3256701 - RNA, 16 nt, Human
aaugauuucauucaau

SEQ ID NO: 3256702 - RNA, 17 nt, Human
uacagagacagaaagca

SEQ ID NO: 3256703 - RNA, 15 nt, Human
uaagcaaaaugugau

SEQ ID NO: 3256704 - RNA, 14 nt, Human
uaagcaaaauguga

SEQ ID NO: 3256705 - RNA, 13 nt, Human
uaagaagugaaaa

SEQ ID NO: 3256706 - RNA, 14 nt, Human
uaucagcacgugug

SEQ ID NO: 3256707 - RNA, 19 nt, Human
acagaaagcagaacaguga

SEQ ID NO: 3256708 - RNA, 19 nt, Human
uauaggaauugacccacaa

SEQ ID NO: 3256709 - RNA, 21 nt, Human
uaugguaggaacugcugggcu

SEQ ID NO: 3256710 - RNA, 21 nt, Human
uagacauuugcuaugagcugg

SEQ ID NO: 3256711 - RNA, 16 nt, Human
aauuccacacccucac

SEQ ID NO: 3256712 - RNA, 14 nt, Human
uagaagaagugugu

SEQ ID NO: 3256713 - RNA, 15 nt, Human
uagaacucccuuuca

SEQ ID NO: 3256714 - RNA, 16 nt, Human
uagaacucccuuucaa

SEQ ID NO: 3256715 - RNA, 17 nt, Human
uagaacucccuuucaac

SEQ ID NO: 3256716 - RNA, 13 nt, Human
uaggauguugaaa

SEQ ID NO: 3256717 - RNA, 14 nt, Human
accaucucuuuacc

SEQ ID NO: 3256718 - RNA, 19 nt, Human
accaaggcugauuaaacca

SEQ ID NO: 3256719 - RNA, 21 nt, Human
acagugauuaccagggacuga

SEQ ID NO: 3256720 - RNA, 20 nt, Human
acagugauuaccagggacug

SEQ ID NO: 3256721 - RNA, 23 nt, Human
acagaggacaguauuugugggga

SEQ ID NO: 3256722 - RNA, 11 nt, Human
aauugugaugu

SEQ ID NO: 3256723 - RNA, 15 nt, Human
aauugugaugugucc

SEQ ID NO: 3256724 - RNA, 14 nt, Human
aauugugauguguc

SEQ ID NO: 3256725 - RNA, 15 nt, Human
acaagaaaugaaagc

SEQ ID NO: 3256726 - RNA, 16 nt, Human
acaagaaaugaaagca

SEQ ID NO: 3256727 - RNA, 13 nt, Human
acaagaaaugaaa

SEQ ID NO: 3256728 - RNA, 19 nt, Human
acggacgaaccuugaaaac

SEQ ID NO: 3256729 - RNA, 15 nt, Human
acucugucucagucc

SEQ ID NO: 3256730 - RNA, 12 nt, Human
acuuuaugcuaa

SEQ ID NO: 3256731 - RNA, 17 nt, Human
acuuuaugcuaagugaa

SEQ ID NO: 3256732 - RNA, 22 nt, Human
acuugggaggcugagaugggag

SEQ ID NO: 3256733 - RNA, 13 nt, Human
acuuaaaaauggu

SEQ ID NO: 3256734 - RNA, 14 nt, Human
acuuaaaaaugguu

SEQ ID NO: 3256735 - RNA, 18 nt, Human
aagagaagggcagggcug

SEQ ID NO: 3256736 - RNA, 15 nt, Human
aagcagggacuugaa

SEQ ID NO: 3256737 - RNA, 12 nt, Human
aaguagaggagg

SEQ ID NO: 3256738 - RNA, 10 nt, Human
aauaaaccau

SEQ ID NO: 3256739 - RNA, 17 nt, Human
aaguucugcagauaaac

SEQ ID NO: 3256740 - RNA, 22 nt, Human
aaauugacacuuaaaaaugguu

SEQ ID NO: 3256741 - RNA, 17 nt, Human
aaauguucaucaaugaa

SEQ ID NO: 3256742 - RNA, 20 nt, Human
aaauguucaucaaugaauga

SEQ ID NO: 3256743 - RNA, 21 nt, Human
aaacccugucucuacuaaaaa

SEQ ID NO: 3256744 - RNA, 19 nt, Human
aaaggcagaagcaacccaa

SEQ ID NO: 3256745 - RNA, 13 nt, Human
agaggaaugaagu

SEQ ID NO: 3256746 - RNA, 18 nt, Human
agacucugucucagucca

SEQ ID NO: 3256747 - RNA, 17 nt, Human
agacccaaaaggcagaa

SEQ ID NO: 3256748 - RNA, 19 nt, Human
agacccaaaaggcagaagc

SEQ ID NO: 3256749 - RNA, 21 nt, Human
agaagugaaaaucuacacucc

SEQ ID NO: 3256750 - RNA, 19 nt, Human
agauguagaggagaaacug

SEQ ID NO: 3256751 - RNA, 16 nt, Human
agauguagaggagaaa

SEQ ID NO: 3256752 - RNA, 19 nt, Human
agcuaauucuuugaccugu

SEQ ID NO: 3256753 - RNA, 17 nt, Human
agcgacagugagacucu

SEQ ID NO: 3256754 - RNA, 16 nt, Human
aggaacugcugggcuu

SEQ ID NO: 3256755 - RNA, 22 nt, Human
aggaacugcugggcuuggcagc

SEQ ID NO: 3256756 - RNA, 13 nt, Human
aggaaguagagga

SEQ ID NO: 3256757 - RNA, 15 nt, Human
agggacugaggggag

SEQ ID NO: 3256758 - RNA, 19 nt, Human
agugucaaugcagccccca

SEQ ID NO: 3256759 - RNA, 15 nt, Human
auagcagcuuauuca

SEQ ID NO: 3256760 - RNA, 21 nt, Human
auaagccagacaucaacagau

SEQ ID NO: 3256761 - RNA, 22 nt, Human
auaagccagacaucaacagaua

SEQ ID NO: 3256762 - RNA, 14 nt, Human
auaagccagacauc

SEQ ID NO: 3256763 - RNA, 13 nt, Human
augaaguacucau

SEQ ID NO: 3256764 - RNA, 21 nt, Human
augaaguacucauacauguua

SEQ ID NO: 3256765 - RNA, 16 nt, Human
augaugggucaguugu

SEQ ID NO: 3256766 - RNA, 17 nt, Human
caagccuuggcucuacc

SEQ ID NO: 3256767 - RNA, 20 nt, Human
cacaagaaaugaaagcaggg

SEQ ID NO: 3256768 - RNA, 18 nt, Human
cacaagaaaugaaagcag

SEQ ID NO: 3256769 - RNA, 14 nt, Human
caaauguucaucaa

SEQ ID NO: 3256770 - RNA, 18 nt, Human
caaauguucaucaaugaa

SEQ ID NO: 3256771 - RNA, 15 nt, Human
caagaaaugaaagca

SEQ ID NO: 3256772 - RNA, 17 nt, Human
caagaaaugaaagcagg

SEQ ID NO: 3256773 - RNA, 19 nt, Human
caagaaaugaaagcaggga

SEQ ID NO: 3256774 - RNA, 22 nt, Human
ugaagagaagggcagggcugag

SEQ ID NO: 3256775 - RNA, 20 nt, Human
ugaagagaagggcagggcug

SEQ ID NO: 3256776 - RNA, 15 nt, Human
ugaaugaauggcuaa

SEQ ID NO: 3256777 - RNA, 16 nt, Human
ugaccacugcagaaga

SEQ ID NO: 3256778 - RNA, 17 nt, Human
ugaccacugcagaagac

SEQ ID NO: 3256779 - RNA, 11 nt, Human
ucugugugugu

SEQ ID NO: 3256780 - RNA, 22 nt, Human
ucuucauuaccucagugagaag

SEQ ID NO: 3256781 - RNA, 16 nt, Human
ucuucuuggucucagu

SEQ ID NO: 3256782 - RNA, 14 nt, Human
ucugucucagucca

SEQ ID NO: 3256783 - RNA, 18 nt, Human
ucaguccaugaagaugua

SEQ ID NO: 3256784 - RNA, 20 nt, Human
ucagaucauuaucagccugu

SEQ ID NO: 3256785 - RNA, 19 nt, Human
uccugucccucauccauag

SEQ ID NO: 3256786 - RNA, 15 nt, Human
ucggccuccauccug

SEQ ID NO: 3256787 - RNA, 16 nt, Human
ucggccuccauccuga

SEQ ID NO: 3256788 - RNA, 19 nt, Human
ucuacuaaaaauacaaaaa

SEQ ID NO: 3256789 - RNA, 15 nt, Human
ucuacuaaaaauaca

SEQ ID NO: 3256790 - RNA, 12 nt, Human
ucuacuaaaaau

SEQ ID NO: 3256791 - RNA, 15 nt, Human
uccugaggcuccacu

SEQ ID NO: 3256792 - RNA, 16 nt, Human
uccugaggcuccacuu

SEQ ID NO: 3256793 - RNA, 21 nt, Human
uccugaggcuccacuuggucu

SEQ ID NO: 3256794 - RNA, 20 nt, Human
uggaaugaugggucaguugu

SEQ ID NO: 3256795 - RNA, 11 nt, Human
ugggggaugua

SEQ ID NO: 3256796 - RNA, 15 nt, Human
ugggggucugugugu

SEQ ID NO: 3256797 - RNA, 18 nt, Human
ugggggucuguguguuua

SEQ ID NO: 3256798 - RNA, 21 nt, Human
ugggagugaggaugucugggc

SEQ ID NO: 3256799 - RNA, 18 nt, Human
ugccaggauggaaugaug

SEQ ID NO: 3256800 - RNA, 20 nt, Human
ugccacuaaauugacacuua

SEQ ID NO: 3256801 - RNA, 19 nt, Human
ugcagugagccgagauugu

SEQ ID NO: 3256802 - RNA, 18 nt, Human
ugccuguaaucacagcua

SEQ ID NO: 3256803 - RNA, 14 nt, Human
uguaccucugccuc

SEQ ID NO: 3256804 - RNA, 15 nt, Human
uguaccgcaauguga

SEQ ID NO: 3256805 - RNA, 16 nt, Human
uguaccgcaaugugac

SEQ ID NO: 3256806 - RNA, 22 nt, Human
ugucacccuuaggccagcacca

SEQ ID NO: 3256807 - RNA, 16 nt, Human
ugugccuuuugccauc

SEQ ID NO: 3256808 - RNA, 17 nt, Human
ugugccuuggugugcug

SEQ ID NO: 3256809 - RNA, 18 nt, Human
uguguaauuuaaaauugu

SEQ ID NO: 3256810 - RNA, 11 nt, Human
uguguaauuua

SEQ ID NO: 3256811 - RNA, 23 nt, Human
uguguaauuuaaaauugugaugu

SEQ ID NO: 3256812 - RNA, 22 nt, Human
uguguaauuuaaaauugugaug

SEQ ID NO: 3256813 - RNA, 19 nt, Human
uguguaauuuaaaauugug

SEQ ID NO: 3256814 - RNA, 15 nt, Human
uguggaagugugggu

SEQ ID NO: 3256815 - RNA, 15 nt, Human
ugugggaguguguaa

SEQ ID NO: 3256816 - RNA, 14 nt, Human
ugugggagugugua

SEQ ID NO: 3256817 - RNA, 16 nt, Human
uguucuuuugucccag

SEQ ID NO: 3256818 - RNA, 16 nt, Human
ugugugggagugugua

SEQ ID NO: 3256819 - RNA, 12 nt, Human
uguguauguggg

SEQ ID NO: 3256820 - RNA, 11 nt, Human
uguguaugugg

SEQ ID NO: 3256821 - RNA, 15 nt, Human
ugugugggagugugu

SEQ ID NO: 3256822 - RNA, 14 nt, Human
ugugugggagugug

SEQ ID NO: 3256823 - RNA, 22 nt, Human
uuaaaaaaaaaccugagcccca

SEQ ID NO: 3256824 - RNA, 22 nt, Human
uaagugccaggauggaaugaug

SEQ ID NO: 3256825 - RNA, 13 nt, Human
uaagugaaauaag

SEQ ID NO: 3256826 - RNA, 13 nt, Human
uaaauuuauguga

SEQ ID NO: 3256827 - RNA, 20 nt, Human
uaaauugacacuuaaaaaug

SEQ ID NO: 3256828 - RNA, 22 nt, Human
guugugugugggaguguguaau

SEQ ID NO: 3256829 - RNA, 16 nt, Human
guugugugugggagug

SEQ ID NO: 3256830 - RNA, 14 nt, Human
guugugugugggag

SEQ ID NO: 3256831 - RNA, 13 nt, Human
guuguguguggga

SEQ ID NO: 3256832 - RNA, 12 nt, Human
guuguguguggg

SEQ ID NO: 3256833 - RNA, 16 nt, Human
guuuagaagaagugug

SEQ ID NO: 3256834 - RNA, 17 nt, Human
guuuagaaagcuugccc

SEQ ID NO: 3256835 - RNA, 15 nt, Human
uaaaaaugguuuaaa

SEQ ID NO: 3256836 - RNA, 18 nt, Human
uaaaaaugguuuaaaugg

SEQ ID NO: 3256837 - RNA, 19 nt, Human
uaaaaaugguuuaaauggu

SEQ ID NO: 3256838 - RNA, 20 nt, Human
uauauuuguaaauuuaugug

SEQ ID NO: 3256839 - RNA, 21 nt, Human
uauauuuuuuguuaaaugauu

SEQ ID NO: 3256840 - RNA, 19 nt, Human
uauauuuuuuguuaaauga

SEQ ID NO: 3256841 - RNA, 14 nt, Human
uaucaaaagaaaga

SEQ ID NO: 3256842 - RNA, 22 nt, Human
uauaaacaugcuugcauuauau

SEQ ID NO: 3256843 - RNA, 15 nt, Human
uagaauuaacacaug

SEQ ID NO: 3256844 - RNA, 16 nt, Human
uagaauuaacacauga

SEQ ID NO: 3256845 - RNA, 18 nt, Human
uagaauuaacacaugauc

SEQ ID NO: 3256846 - RNA, 14 nt, Human
uacacuccagugag

SEQ ID NO: 3256847 - RNA, 22 nt, Human
uaccuaacgaaguauccuucag

SEQ ID NO: 3256848 - RNA, 20 nt, Human
guguaauuuaaaauugugau

SEQ ID NO: 3256849 - RNA, 23 nt, Human
guguaauuuaaaauugugaugug

SEQ ID NO: 3256850 - RNA, 22 nt, Human
guguaauuuaaaauugugaugu

SEQ ID NO: 3256851 - RNA, 17 nt, Human
guggcuggaucugugag

SEQ ID NO: 3256852 - RNA, 17 nt, Human
guguguuguguguggga

SEQ ID NO: 3256853 - RNA, 14 nt, Human
guguguugugugug

SEQ ID NO: 3256854 - RNA, 12 nt, Human
guguguugugug

SEQ ID NO: 3256855 - RNA, 15 nt, Human
guguguuuaugugug

SEQ ID NO: 3256856 - RNA, 14 nt, Human
guguguuuaugugu

SEQ ID NO: 3256857 - RNA, 16 nt, Human
guguguuuaugugugu

SEQ ID NO: 3256858 - RNA, 17 nt, Human
gugugggaguguguaau

SEQ ID NO: 3256859 - RNA, 16 nt, Human
guucaucaaugaauga

SEQ ID NO: 3256860 - RNA, 15 nt, Human
gucugugagaugcua

SEQ ID NO: 3256861 - RNA, 16 nt, Human
gucugugagaugcuag

SEQ ID NO: 3256862 - RNA, 17 nt, Human
gucugugagaugcuaga

SEQ ID NO: 3256863 - RNA, 21 nt, Human
gucugugagaugcuagaacuc

SEQ ID NO: 3256864 - RNA, 22 nt, Human
gucugugagaugcuagaacucc

SEQ ID NO: 3256865 - RNA, 23 nt, Human
gucugugagaugcuagaacuccc

SEQ ID NO: 3256866 - RNA, 22 nt, Human
gucuguguguuuaugugugugu

SEQ ID NO: 3256867 - RNA, 21 nt, Human
gucuguguguuuaugugugug

SEQ ID NO: 3256868 - RNA, 11 nt, Human
gucuguguguu

SEQ ID NO: 3256869 - RNA, 20 nt, Human
gucuguguguguguaugugg

SEQ ID NO: 3256870 - RNA, 16 nt, Human
gucuguguguguguau

SEQ ID NO: 3256871 - RNA, 12 nt, Human
gucugugugugu

SEQ ID NO: 3256872 - RNA, 11 nt, Human
gucugugugug

SEQ ID NO: 3256873 - RNA, 21 nt, Human
gugacuauggagcugagcagg

SEQ ID NO: 3256874 - RNA, 21 nt, Human
gugaacaaauuuacagagaca

SEQ ID NO: 3256875 - RNA, 21 nt, Human
gugccaggauggaaugauggg

SEQ ID NO: 3256876 - RNA, 14 nt, Human
gugccuuuugccau

SEQ ID NO: 3256877 - RNA, 14 nt, Human
guagguugggagaa

SEQ ID NO: 3256878 - RNA, 16 nt, Human
gucccugaagagaagg

SEQ ID NO: 3256879 - RNA, 15 nt, Human
gucaaugcagccccc

SEQ ID NO: 3256880 - RNA, 13 nt, Human
guauuuuaaucac

SEQ ID NO: 3256881 - RNA, 22 nt, Human
uuuccucaaaacuucagacaua

SEQ ID NO: 3256882 - RNA, 16 nt, Human
cuacacuccagugaga

SEQ ID NO: 3256883 - RNA, 17 nt, Human
cuacacuccagugagac

SEQ ID NO: 3256884 - RNA, 15 nt, Human
cuaagcaaaauguga

SEQ ID NO: 3256885 - RNA, 18 nt, Human
cuaagcaaaaugugauau

SEQ ID NO: 3256886 - RNA, 14 nt, Human
cuaagcaaaaugug

SEQ ID NO: 3256887 - RNA, 15 nt, Human
cuacuugggaggcug

SEQ ID NO: 3256888 - RNA, 18 nt, Human
cuacuugggaggcugaga

SEQ ID NO: 3256889 - RNA, 19 nt, Human
cuacuugggaggcugagau

SEQ ID NO: 3256890 - RNA, 22 nt, Human
cuauauuuuuuguuaaaugauu

SEQ ID NO: 3256891 - RNA, 20 nt, Human
cuauauuuuuuguuaaauga

SEQ ID NO: 3256892 - RNA, 23 nt, Human
cuaguaucaaaagaaagaaaauc

SEQ ID NO: 3256893 - RNA, 15 nt, Human
cuaguaucaaaagaa

SEQ ID NO: 3256894 - RNA, 17 nt, Human
cuaguaucaaaagaaag

SEQ ID NO: 3256895 - RNA, 23 nt, Human
cuaaauugacacuuaaaaauggu

SEQ ID NO: 3256896 - RNA, 15 nt, Human
cgggucaucuguacc

SEQ ID NO: 3256897 - RNA, 22 nt, Human
cgggucaucuguaccucugccu

SEQ ID NO: 3256898 - RNA, 12 nt, Human
cggccuccaucc

SEQ ID NO: 3256899 - RNA, 14 nt, Human
cgcucucuggccuu

SEQ ID NO: 3256900 - RNA, 15 nt, Human
cgcucucuggccuuc

SEQ ID NO: 3256901 - RNA, 12 nt, Human
cucuggccuucg

SEQ ID NO: 3256902 - RNA, 16 nt, Human
cugagcgacagugaga

SEQ ID NO: 3256903 - RNA, 20 nt, Human
cugagcgacagugagacucu

SEQ ID NO: 3256904 - RNA, 18 nt, Human
cuccauccugaggcucca

SEQ ID NO: 3256905 - RNA, 14 nt, Human
cuccauccugaggc

SEQ ID NO: 3256906 - RNA, 16 nt, Human
cuccauccugaggcuc

SEQ ID NO: 3256907 - RNA, 14 nt, Human
cuguaccucugccu

SEQ ID NO: 3256908 - RNA, 18 nt, Human
cugucucuacuaaaaaua

SEQ ID NO: 3256909 - RNA, 16 nt, Human
cuggccuucggccucc

SEQ ID NO: 3256910 - RNA, 17 nt, Human
cuggccuucggccucca

SEQ ID NO: 3256911 - RNA, 18 nt, Human
cuggccuucggccuccau

SEQ ID NO: 3256912 - RNA, 15 nt, Human
cuggccuucggccuc

SEQ ID NO: 3256913 - RNA, 13 nt, Human
gaagaaguguguc

SEQ ID NO: 3256914 - RNA, 15 nt, Human
gaacucccuuucaac

SEQ ID NO: 3256915 - RNA, 16 nt, Human
gaacucccuuucaaca

SEQ ID NO: 3256916 - RNA, 13 nt, Human
gaaagcagaacag

SEQ ID NO: 3256917 - RNA, 21 nt, Human
gaaagcuugcccuggugccuc

SEQ ID NO: 3256918 - RNA, 19 nt, Human
cuugaacccgggaggcaga

SEQ ID NO: 3256919 - RNA, 14 nt, Human
cuugaacccgggag

SEQ ID NO: 3256920 - RNA, 21 nt, Human
cuugcaugguuuagaaagcuu

SEQ ID NO: 3256921 - RNA, 17 nt, Human
gaccuuuccugaggaag

SEQ ID NO: 3256922 - RNA, 22 nt, Human
gacccacaagaaaugaaagcag

SEQ ID NO: 3256923 - RNA, 19 nt, Human
gagagugaacaaauuuaca

SEQ ID NO: 3256924 - RNA, 15 nt, Human
gagagugaacaaauu

SEQ ID NO: 3256925 - RNA, 15 nt, Human
gagacagcucugcau

SEQ ID NO: 3256926 - RNA, 13 nt, Human
gagacagcucugc

SEQ ID NO: 3256927 - RNA, 22 nt, Human
gagaagccagcuuuccucauca

SEQ ID NO: 3256928 - RNA, 14 nt, Human
gaucauuaucagcc

SEQ ID NO: 3256929 - RNA, 22 nt, Human
gauaaauaguuuaugauuccac

SEQ ID NO: 3256930 - RNA, 21 nt, Human
gaucugugaggggcucucuca

SEQ ID NO: 3256931 - RNA, 21 nt, Human
gauggcuaguaucaaaagaaa

SEQ ID NO: 3256932 - RNA, 20 nt, Human
gauuuggggcucagaguggg

SEQ ID NO: 3256933 - RNA, 18 nt, Human
gcauuauauuuguaaauu

SEQ ID NO: 3256934 - RNA, 18 nt, Human
gcagauaaacaguaguga

SEQ ID NO: 3256935 - RNA, 20 nt, Human
gcagccccgugggguuccuc

SEQ ID NO: 3256936 - RNA, 12 nt, Human
gcgacagugaga

SEQ ID NO: 3256937 - RNA, 19 nt, Human
gcuagaacucccuuucaac

SEQ ID NO: 3256938 - RNA, 18 nt, Human
gcuagaacucccuuucaa

SEQ ID NO: 3256939 - RNA, 19 nt, Human
gccucucauuccagaggaa

SEQ ID NO: 3256940 - RNA, 20 nt, Human
gccucucauuccagaggaag

SEQ ID NO: 3256941 - RNA, 20 nt, Human
gccgggcgugguggugagug

SEQ ID NO: 3256942 - RNA, 21 nt, Human
gccaucauguuuacagaggac

SEQ ID NO: 3256943 - RNA, 17 nt, Human
gccaucauguuuacaga

SEQ ID NO: 3256944 - RNA, 18 nt, Human
caucaaugaaugaaugaa

SEQ ID NO: 3256945 - RNA, 16 nt, Human
caguggcuggaucugu

SEQ ID NO: 3256946 - RNA, 20 nt, Human
caguggcuggaucugugagg

SEQ ID NO: 3256947 - RNA, 18 nt, Human
caguggcuggaucuguga

SEQ ID NO: 3256948 - RNA, 14 nt, Human
cagugucaaugcag

SEQ ID NO: 3256949 - RNA, 18 nt, Human
cauaaucacaacccuuca

SEQ ID NO: 3256950 - RNA, 15 nt, Human
cauaccuggcccugu

SEQ ID NO: 3256951 - RNA, 19 nt, Human
cauggggcugauuguauuu

SEQ ID NO: 3256952 - RNA, 17 nt, Human
caugggacagggaggac

SEQ ID NO: 3256953 - RNA, 22 nt, Human
cauuaccucagugagaagccag

SEQ ID NO: 3256954 - RNA, 21 nt, Human
cauuaccucagugagaagcca

SEQ ID NO: 3256955 - RNA, 19 nt, Human
ccaaggcugauuaaaccaa

SEQ ID NO: 3256956 - RNA, 20 nt, Human
ccaauauucauagcagcuua

SEQ ID NO: 3256957 - RNA, 16 nt, Human
ccacaagaaaugaaag

SEQ ID NO: 3256958 - RNA, 22 nt, Human
ccacaagaaaugaaagcaggga

SEQ ID NO: 3256959 - RNA, 18 nt, Human
ccaaggcuagaaccaccu

SEQ ID NO: 3256960 - RNA, 22 nt, Human
ccaucauguuuacagaggacag

SEQ ID NO: 3256961 - RNA, 20 nt, Human
ccaucauguuuacagaggac

SEQ ID NO: 3256962 - RNA, 15 nt, Human
ccauccugaggcucc

SEQ ID NO: 3256963 - RNA, 18 nt, Human
cccagaaugccuccugca

SEQ ID NO: 3256964 - RNA, 23 nt, Human
ccauggcacucuauguucuaaga

SEQ ID NO: 3256965 - RNA, 21 nt, Human
cccagcuaugguucucucgca

SEQ ID NO: 3256966 - RNA, 20 nt, Human
cccugccaucauguuuacag

SEQ ID NO: 3256967 - RNA, 12 nt, Human
ccuccauccuga

SEQ ID NO: 3256968 - RNA, 13 nt, Human
ccuccauccugag

SEQ ID NO: 3256969 - RNA, 13 nt, Human
aaauguucaucaa

SEQ ID NO: 3256970 - RNA, 17 nt, Human
aaaagaaagaaaaucag

SEQ ID NO: 3256971 - RNA, 21 nt, Human
acccugucucuacuaaaaaua

SEQ ID NO: 3256972 - RNA, 21 nt, Human
acuucagacauagaauuaaca

SEQ ID NO: 3256973 - RNA, 12 nt, Human
acuucagacaua

SEQ ID NO: 3256974 - RNA, 22 nt, Human
acuuaaaaaugguuuaaauggu

SEQ ID NO: 3256975 - RNA, 21 nt, Human
acuuaaaaaugguuuaaaugg

SEQ ID NO: 3256976 - RNA, 14 nt, Human
acucccuuucaaca

SEQ ID NO: 3256977 - RNA, 13 nt, Human
acucccuuucaac

SEQ ID NO: 3256978 - RNA, 15 nt, Human
acaccaauauucaua

SEQ ID NO: 3256979 - RNA, 19 nt, Human
acagugauuaccagggacu

SEQ ID NO: 3256980 - RNA, 22 nt, Human
agaacagugauuaccagggacu

SEQ ID NO: 3256981 - RNA, 13 nt, Human
agcaucucccagu

SEQ ID NO: 3256982 - RNA, 19 nt, Human
agagugggguagguuggga

SEQ ID NO: 3256983 - RNA, 22 nt, Human
agggauuuggggcucagagugg

SEQ ID NO: 3256984 - RNA, 20 nt, Human
aggcagagguugcagugagc

SEQ ID NO: 3256985 - RNA, 13 nt, Human
aggaugucugggc

SEQ ID NO: 3256986 - RNA, 13 nt, Human
agcgacagugaga

SEQ ID NO: 3256987 - RNA, 15 nt, Human
agcgacagugagacu

SEQ ID NO: 3256988 - RNA, 13 nt, Human
agugauuaccagg

SEQ ID NO: 3256989 - RNA, 13 nt, Human
aguacucauacau

SEQ ID NO: 3256990 - RNA, 15 nt, Human
augggacagggagga

SEQ ID NO: 3256991 - RNA, 14 nt, Human
aucaaaagaaagaa

SEQ ID NO: 3256992 - RNA, 11 nt, Human
cuucagacaua

SEQ ID NO: 3256993 - RNA, 17 nt, Human
cugcacuccagccugag

SEQ ID NO: 3256994 - RNA, 20 nt, Human
cugcacuccagccugagcga

SEQ ID NO: 3256995 - RNA, 16 nt, Human
cugcacuccagccuga

SEQ ID NO: 3256996 - RNA, 13 nt, Human
cuggcccugugcc

SEQ ID NO: 3256997 - RNA, 12 nt, Human
cuggugccucac

SEQ ID NO: 3256998 - RNA, 21 nt, Human
cuggugccucaccccuugcca

SEQ ID NO: 3256999 - RNA, 14 nt, Human
cuggaucugugagg

SEQ ID NO: 3257000 - RNA, 18 nt, Human
gagucagggagagcugaa

SEQ ID NO: 3257001 - RNA, 19 nt, Human
gaggcuccacuuggucugu

SEQ ID NO: 3257002 - RNA, 18 nt, Human
gaggcuccacuuggucug

SEQ ID NO: 3257003 - RNA, 23 nt, Human
gaggcuccacuuggucugugaga

SEQ ID NO: 3257004 - RNA, 15 nt, Human
gaggacgcucucugg

SEQ ID NO: 3257005 - RNA, 17 nt, Human
gauguagaggagaaacu

SEQ ID NO: 3257006 - RNA, 18 nt, Human
gauguagaggagaaacug

SEQ ID NO: 3257007 - RNA, 16 nt, Human
gacgcucucuggccuu

SEQ ID NO: 3257008 - RNA, 15 nt, Human
gacgcucucuggccu

SEQ ID NO: 3257009 - RNA, 21 nt, Human
gacagugagacucugucucag

SEQ ID NO: 3257010 - RNA, 21 nt, Human
gacagaaagcagaacagugau

SEQ ID NO: 3257011 - RNA, 19 nt, Human
gaacccgggaggcagaggu

SEQ ID NO: 3257012 - RNA, 20 nt, Human
gaacugcugggcuuggcagc

SEQ ID NO: 3257013 - RNA, 17 nt, Human
gaacugcugggcuuggc

SEQ ID NO: 3257014 - RNA, 23 nt, Human
gaagcaacccaaauguucaucaa

SEQ ID NO: 3257015 - RNA, 24 nt, Human
gaagugugggucugugugugugua

SEQ ID NO: 3257016 - RNA, 21 nt, Human
gaagugugggucugugugugu

SEQ ID NO: 3257017 - RNA, 19 nt, Human
gaagugugggucugugugu

SEQ ID NO: 3257018 - RNA, 22 nt, Human
gccagacaucaacagauaaaua

SEQ ID NO: 3257019 - RNA, 19 nt, Human
gcuauggggauagaugugu

SEQ ID NO: 3257020 - RNA, 21 nt, Human
gcuauggggauagaugugugg

SEQ ID NO: 3257021 - RNA, 16 nt, Human
gcuaguaucaaaagaa

SEQ ID NO: 3257022 - RNA, 14 nt, Human
gcuggagcucugcc

SEQ ID NO: 3257023 - RNA, 17 nt, Human
gcuggagcucugcccau

SEQ ID NO: 3257024 - RNA, 16 nt, Human
ggccuccauccugagg

SEQ ID NO: 3257025 - RNA, 13 nt, Human
ggaugucugggcc

SEQ ID NO: 3257026 - RNA, 22 nt, Human
ggauguugaaaaaguucugcag

SEQ ID NO: 3257027 - RNA, 15 nt, Human
ggaggcugagauggg

SEQ ID NO: 3257028 - RNA, 19 nt, Human
ggaggcugagaugggagaa

SEQ ID NO: 3257029 - RNA, 17 nt, Human
ggcuggaucugugaggg

SEQ ID NO: 3257030 - RNA, 17 nt, Human
gggauuguaaaauggug

SEQ ID NO: 3257031 - RNA, 21 nt, Human
aaaacuuuaugcuaagugaaa

SEQ ID NO: 3257032 - RNA, 20 nt, Human
gggaggcagagguugcagug

SEQ ID NO: 3257033 - RNA, 11 nt, Human
gggaggcagag

SEQ ID NO: 3257034 - RNA, 16 nt, Human
aaaauugugauguguc

SEQ ID NO: 3257035 - RNA, 14 nt, Human
ggucugugagaugc

SEQ ID NO: 3257036 - RNA, 22 nt, Human
cucucuggccuucggccuccau

SEQ ID NO: 3257037 - RNA, 14 nt, Human
cucucuggccuucg

SEQ ID NO: 3257038 - RNA, 16 nt, Human
cucucuggccuucggc

SEQ ID NO: 3257039 - RNA, 13 nt, Human
cucucuggccuuc

SEQ ID NO: 3257040 - RNA, 23 nt, Human
cucaugauagaaggcuaugggga

SEQ ID NO: 3257041 - RNA, 16 nt, Human
cucaguccaugaagau

SEQ ID NO: 3257042 - RNA, 23 nt, Human
cucaggccgaaggaggagucagg

SEQ ID NO: 3257043 - RNA, 20 nt, Human
cucaggccugacucucagca

SEQ ID NO: 3257044 - RNA, 18 nt, Human
cuauguucuaagaaguga

SEQ ID NO: 3257045 - RNA, 23 nt, Human
cuaugucauuugcuggagcucug

SEQ ID NO: 3257046 - RNA, 20 nt, Human
cuaacgaaguauccuucagc

SEQ ID NO: 3257047 - RNA, 18 nt, Human
cgcucucuggccuucggc

SEQ ID NO: 3257048 - RNA, 17 nt, Human
ccuucucuucacaguca

SEQ ID NO: 3257049 - RNA, 20 nt, Human
ccacuuggucugugagaugc

SEQ ID NO: 3257050 - RNA, 22 nt, Human
ccacuuggucugugagaugcua

SEQ ID NO: 3257051 - RNA, 15 nt, Human
ccacuuggucuguga

SEQ ID NO: 3257052 - RNA, 16 nt, Human
ccacuuggucugugag

SEQ ID NO: 3257053 - RNA, 17 nt, Human
ccacuuggucugugaga

SEQ ID NO: 3257054 - RNA, 19 nt, Human
ccacuuggucugugagaug

SEQ ID NO: 3257055 - RNA, 12 nt, Human
ccacuuggucug

SEQ ID NO: 3257056 - RNA, 15 nt, Human
ccccauuguggucac

SEQ ID NO: 3257057 - RNA, 13 nt, Human
ccauugguguuga

SEQ ID NO: 3257058 - RNA, 22 nt, Human
ccauuguggucacaggaaguag

SEQ ID NO: 3257059 - RNA, 15 nt, Human
ccucuuggcugccuu

SEQ ID NO: 3257060 - RNA, 15 nt, Human
ccuaacgaaguaucc

SEQ ID NO: 3257061 - RNA, 20 nt, Human
ccuaacgaaguauccuucag

SEQ ID NO: 3257062 - RNA, 16 nt, Human
cacuccagugagacag

SEQ ID NO: 3257063 - RNA, 21 nt, Human
cacuccagugagacagcucug

SEQ ID NO: 3257064 - RNA, 21 nt, Human
caaaagguauuuuaaucacca

SEQ ID NO: 3257065 - RNA, 17 nt, Human
auucauggccuggggga

SEQ ID NO: 3257066 - RNA, 17 nt, Human
caucuguaccucugccu

SEQ ID NO: 3257067 - RNA, 18 nt, Human
cauccugaggcuccacuu

SEQ ID NO: 3257068 - RNA, 19 nt, Human
cauccugaggcuccacuug

SEQ ID NO: 3257069 - RNA, 19 nt, Human
cauagcagcuuauucacaa

SEQ ID NO: 3257070 - RNA, 22 nt, Human
cagugauuaccagggacugagg

SEQ ID NO: 3257071 - RNA, 14 nt, Human
ccaaaaggcagaag

SEQ ID NO: 3257072 - RNA, 17 nt, Human
cagcacguguggccugu

SEQ ID NO: 3257073 - RNA, 17 nt, Human
cagcuuauucacaagac

SEQ ID NO: 3257074 - RNA, 12 nt, Human
uugugauguguc

SEQ ID NO: 3257075 - RNA, 18 nt, Human
augaguuggcugggaaua

SEQ ID NO: 3257076 - RNA, 15 nt, Human
augagguacugagag

SEQ ID NO: 3257077 - RNA, 17 nt, Human
augagguacugagagug

SEQ ID NO: 3257078 - RNA, 18 nt, Human
augagguacugagaguga

SEQ ID NO: 3257079 - RNA, 13 nt, Human
augauuucauuca

SEQ ID NO: 3257080 - RNA, 22 nt, Human
aucugugaggggcucucucaug

SEQ ID NO: 3257081 - RNA, 21 nt, Human
aucugugaggggcucucucau

SEQ ID NO: 3257082 - RNA, 19 nt, Human
uuguaaauuuaugugaugg

SEQ ID NO: 3257083 - RNA, 23 nt, Human
aucauguuuacagaggacaguau

SEQ ID NO: 3257084 - RNA, 18 nt, Human
aucauguuuacagaggac

SEQ ID NO: 3257085 - RNA, 20 nt, Human
auauuuguaaauuuauguga

SEQ ID NO: 3257086 - RNA, 21 nt, Human
auaggaauugacccacaagaa

SEQ ID NO: 3257087 - RNA, 19 nt, Human
auguauauuuuauaucaau

SEQ ID NO: 3257088 - RNA, 23 nt, Human
uuugaccuguugggagugaggau

SEQ ID NO: 3257089 - RNA, 17 nt, Human
auguauauaaacaugcu

SEQ ID NO: 3257090 - RNA, 20 nt, Human
uuugcuggagcucugcccau

SEQ ID NO: 3257091 - RNA, 23 nt, Human
auguguguguguuguguguggga

SEQ ID NO: 3257092 - RNA, 22 nt, Human
auguguguguguuguguguggg

SEQ ID NO: 3257093 - RNA, 18 nt, Human
auguguguguguugugug

SEQ ID NO: 3257094 - RNA, 15 nt, Human
auuuaaaauugugau

SEQ ID NO: 3257095 - RNA, 18 nt, Human
auuguagagccagagguc

SEQ ID NO: 3257096 - RNA, 17 nt, Human
auuguagagccagaggu

SEQ ID NO: 3257097 - RNA, 17 nt, Human
auuuaaaaaaaaaccug

SEQ ID NO: 3257098 - RNA, 15 nt, Human
ugaugggucaguugu

SEQ ID NO: 3257099 - RNA, 19 nt, Human
ugcauacucauuaggaugg

SEQ ID NO: 3257100 - RNA, 13 nt, Human
ugcauacucauua

SEQ ID NO: 3257101 - RNA, 19 nt, Human
agccugagcgacagugaga

SEQ ID NO: 3257102 - RNA, 13 nt, Human
ugccauaauuacu

SEQ ID NO: 3257103 - RNA, 15 nt, Human
ugcacuccagccuga

SEQ ID NO: 3257104 - RNA, 22 nt, Human
ugcagaagacaguauggcagcu

SEQ ID NO: 3257105 - RNA, 17 nt, Human
ugcacuccagccugagc

SEQ ID NO: 3257106 - RNA, 13 nt, Human
ugauuucauucaa

SEQ ID NO: 3257107 - RNA, 16 nt, Human
ugcuaugagcugggga

SEQ ID NO: 3257108 - RNA, 20 nt, Human
ugcuaugagcuggggauguc

SEQ ID NO: 3257109 - RNA, 19 nt, Human
ugcuaugagcuggggaugu

SEQ ID NO: 3257110 - RNA, 22 nt, Human
ugcuaugagcuggggaugucuc

SEQ ID NO: 3257111 - RNA, 16 nt, Human
ugccuuggugugcugu

SEQ ID NO: 3257112 - RNA, 20 nt, Human
agcuugcccuggugccucac

SEQ ID NO: 3257113 - RNA, 18 nt, Human
aggagaaacuggaacucu

SEQ ID NO: 3257114 - RNA, 19 nt, Human
aggagaaacuggaacucuc

SEQ ID NO: 3257115 - RNA, 17 nt, Human
aggagaaacuggaacuc

SEQ ID NO: 3257116 - RNA, 13 nt, Human
aggacgcucucug

SEQ ID NO: 3257117 - RNA, 14 nt, Human
aggacgcucucugg

SEQ ID NO: 3257118 - RNA, 16 nt, Human
aggacgcucucuggcc

SEQ ID NO: 3257119 - RNA, 17 nt, Human
aggacgcucucuggccu

SEQ ID NO: 3257120 - RNA, 19 nt, Human
aggacgcucucuggccuuc

SEQ ID NO: 3257121 - RNA, 20 nt, Human
aggacgcucucuggccuucg

SEQ ID NO: 3257122 - RNA, 20 nt, Human
aggcauuuaggccaugggac

SEQ ID NO: 3257123 - RNA, 23 nt, Human
agguuuguuuagaagaagugugu

SEQ ID NO: 3257124 - RNA, 12 nt, Human
uguauguggggg

SEQ ID NO: 3257125 - RNA, 18 nt, Human
aggggagcaugggaagug

SEQ ID NO: 3257126 - RNA, 14 nt, Human
uggggagggauuug

SEQ ID NO: 3257127 - RNA, 22 nt, Human
uggggagggauuuggggcucag

SEQ ID NO: 3257128 - RNA, 15 nt, Human
uggggcucagagugg

SEQ ID NO: 3257129 - RNA, 22 nt, Human
ugggagaaugucaguaugugga

SEQ ID NO: 3257130 - RNA, 20 nt, Human
ugggagaaugucaguaugug

SEQ ID NO: 3257131 - RNA, 19 nt, Human
ugggagaaugucaguaugu

SEQ ID NO: 3257132 - RNA, 23 nt, Human
agggaggacgcucucuggccuuc

SEQ ID NO: 3257133 - RNA, 21 nt, Human
agggaggacgcucucuggccu

SEQ ID NO: 3257134 - RNA, 22 nt, Human
agggaggacgcucucuggccuu

SEQ ID NO: 3257135 - RNA, 21 nt, Human
aguucugcagauaaacaguag

SEQ ID NO: 3257136 - RNA, 16 nt, Human
aguucugcagauaaac

SEQ ID NO: 3257137 - RNA, 13 nt, Human
uguuuaugugugu

SEQ ID NO: 3257138 - RNA, 16 nt, Human
uguuuaugugugugug

SEQ ID NO: 3257139 - RNA, 18 nt, Human
uuaaaauugugauguguc

SEQ ID NO: 3257140 - RNA, 13 nt, Human
uuaaaauugugau

SEQ ID NO: 3257141 - RNA, 15 nt, Human
uuagaagaagugugu

SEQ ID NO: 3257142 - RNA, 14 nt, Human
uuagaagaagugug

SEQ ID NO: 3257143 - RNA, 16 nt, Human
uuagaagaaguguguc

SEQ ID NO: 3257144 - RNA, 15 nt, Human
ugugagaugcuagaa

SEQ ID NO: 3257145 - RNA, 19 nt, Human
ugugagaugcuagaacucc

SEQ ID NO: 3257146 - RNA, 16 nt, Human
agugaacaaauuuaca

SEQ ID NO: 3257147 - RNA, 14 nt, Human
uguguguguaugug

SEQ ID NO: 3257148 - RNA, 20 nt, Human
ugugugugggaguguguaau

SEQ ID NO: 3257149 - RNA, 12 nt, Human
ugugugugggag

SEQ ID NO: 3257150 - RNA, 20 nt, Human
ugugggucugugugugugua

SEQ ID NO: 3257151 - RNA, 20 nt, Human
uguggucacaggaaguagag

SEQ ID NO: 3257152 - RNA, 16 nt, Human
uauuuguaaauuuaug

SEQ ID NO: 3257153 - RNA, 22 nt, Human
uauuuguaaauuuaugugaugg

SEQ ID NO: 3257154 - RNA, 17 nt, Human
uauuuguaaauuuaugu

SEQ ID NO: 3257155 - RNA, 18 nt, Human
ucaaaagaaagaaaauca

SEQ ID NO: 3257156 - RNA, 19 nt, Human
acaugauccugcaauucca

SEQ ID NO: 3257157 - RNA, 14 nt, Human
acauagaauuaaca

SEQ ID NO: 3257158 - RNA, 18 nt, Human
acauagaauuaacacaug

SEQ ID NO: 3257159 - RNA, 13 nt, Human
acaucaacagaua

SEQ ID NO: 3257160 - RNA, 19 nt, Human
uccauccugaggcuccacu

SEQ ID NO: 3257161 - RNA, 20 nt, Human
uccauccugaggcuccacuu

SEQ ID NO: 3257162 - RNA, 21 nt, Human
uccauccugaggcuccacuug

SEQ ID NO: 3257163 - RNA, 13 nt, Human
uccaugaagaugu

SEQ ID NO: 3257164 - RNA, 21 nt, Human
uccaugaagauguagaggaga

SEQ ID NO: 3257165 - RNA, 21 nt, Human
ucucuggccuucggccuccau

SEQ ID NO: 3257166 - RNA, 22 nt, Human
ucucuggccuucggccuccauc

SEQ ID NO: 3257167 - RNA, 12 nt, Human
ucucuggccuuc

SEQ ID NO: 3257168 - RNA, 16 nt, Human
ucucauuccagaggaa

SEQ ID NO: 3257169 - RNA, 21 nt, Human
acuugaacccauauuuguaca

SEQ ID NO: 3257170 - RNA, 19 nt, Human
acuugaacccgggaggcag

SEQ ID NO: 3257171 - RNA, 20 nt, Human
acuugaacccgggaggcaga

SEQ ID NO: 3257172 - RNA, 23 nt, Human
acuggccaguggcuggaucugug

SEQ ID NO: 3257173 - RNA, 15 nt, Human
agagguugcagugag

SEQ ID NO: 3257174 - RNA, 19 nt, Human
ugaacaaauuuacagagac

SEQ ID NO: 3257175 - RNA, 20 nt, Human
ugaacaaauuuacagagaca

SEQ ID NO: 3257176 - RNA, 18 nt, Human
ugaacaaauuuacagaga

SEQ ID NO: 3257177 - RNA, 14 nt, Human
ugaaauaagccaga

SEQ ID NO: 3257178 - RNA, 17 nt, Human
ugaaauaagccagacau

SEQ ID NO: 3257179 - RNA, 18 nt, Human
ugaaauaagccagacauc

SEQ ID NO: 3257180 - RNA, 20 nt, Human
ugaaauaagccagacaucaa

SEQ ID NO: 3257181 - RNA, 23 nt, Human
ugaaauaagccagacaucaacag

SEQ ID NO: 3257182 - RNA, 14 nt, Human
agaugcuagaacuc

SEQ ID NO: 3257183 - RNA, 17 nt, Human
ugacccacaagaaauga

SEQ ID NO: 3257184 - RNA, 19 nt, Human
agaaugucaguauguggaa

SEQ ID NO: 3257185 - RNA, 17 nt, Human
agaaugucaguaugugg

SEQ ID NO: 3257186 - RNA, 23 nt, Human
agaauuaacacaugauccugcaa

SEQ ID NO: 3257187 - RNA, 13 nt, Human
agaaugucaguau

SEQ ID NO: 3257188 - RNA, 16 nt, Human
agaaugucaguaugug

SEQ ID NO: 3257189 - RNA, 15 nt, Human
agaaugucaguaugu

SEQ ID NO: 3257190 - RNA, 21 nt, Human
agacauuugcuaugagcuggg

SEQ ID NO: 3257191 - RNA, 24 nt, Human
agagacagaaagcagaacagugau

SEQ ID NO: 3257192 - RNA, 15 nt, Human
agagacagaaagcag

SEQ ID NO: 3257193 - RNA, 22 nt, Human
aacaguagugauaguuguaccg

SEQ ID NO: 3257194 - RNA, 23 nt, Human
gucucaguccaugaagauguaga

SEQ ID NO: 3257195 - RNA, 20 nt, Human
aacccauauuuguacaccaa

SEQ ID NO: 3257196 - RNA, 18 nt, Human
aacccaaauguucaucaa

SEQ ID NO: 3257197 - RNA, 13 nt, Human
aacccaaauguuc

SEQ ID NO: 3257198 - RNA, 13 nt, Human
aacucccuuucaa

SEQ ID NO: 3257199 - RNA, 15 nt, Human
guauguggaagugug

SEQ ID NO: 3257200 - RNA, 17 nt, Human
guauguggaaguguggg

SEQ ID NO: 3257201 - RNA, 16 nt, Human
guauguggaagugugg

SEQ ID NO: 3257202 - RNA, 20 nt, Human
guaugugggggucugugugu

SEQ ID NO: 3257203 - RNA, 19 nt, Human
guaugugggggucugugug

SEQ ID NO: 3257204 - RNA, 21 nt, Human
guauguggaagugugggucug

SEQ ID NO: 3257205 - RNA, 18 nt, Human
guauguggaagugugggu

SEQ ID NO: 3257206 - RNA, 16 nt, Human
guaggaacugcugggc

SEQ ID NO: 3257207 - RNA, 19 nt, Human
aaaucuacacuccagugag

SEQ ID NO: 3257208 - RNA, 21 nt, Human
aaaugaaagcagggacuugaa

SEQ ID NO: 3257209 - RNA, 22 nt, Human
aaaugaaagcagggacuugaac

SEQ ID NO: 3257210 - RNA, 14 nt, Human
guguguaauuuaaa

SEQ ID NO: 3257211 - RNA, 21 nt, Human
gugugaccacugcagaagaca

SEQ ID NO: 3257212 - RNA, 14 nt, Human
gugggaguguguaa

SEQ ID NO: 3257213 - RNA, 13 nt, Human
gugggagugugua

SEQ ID NO: 3257214 - RNA, 16 nt, Human
gugggucugugugugu

SEQ ID NO: 3257215 - RNA, 13 nt, Human
gugggucugugug

SEQ ID NO: 3257216 - RNA, 22 nt, Human
guggaagugugggucugugugu

SEQ ID NO: 3257217 - RNA, 21 nt, Human
guggaagugugggucugugug

SEQ ID NO: 3257218 - RNA, 20 nt, Human
guggaagugugggucugugu

SEQ ID NO: 3257219 - RNA, 19 nt, Human
guggaagugugggucugug

SEQ ID NO: 3257220 - RNA, 15 nt, Human
guggaaguguggguc

SEQ ID NO: 3257221 - RNA, 14 nt, Human
guggaagugugggu

SEQ ID NO: 3257222 - RNA, 23 nt, Human
gugcuauuguagagccagagguc

SEQ ID NO: 3257223 - RNA, 16 nt, Human
aagaagugaaaaucua

SEQ ID NO: 3257224 - RNA, 22 nt, Human
aagaagugaaaaucuacacucc

SEQ ID NO: 3257225 - RNA, 18 nt, Human
guuguaucagcacgugug

SEQ ID NO: 3257226 - RNA, 18 nt, Human
guuguaccgcaaugugac

SEQ ID NO: 3257227 - RNA, 16 nt, Human
guuuaugugugugugu

SEQ ID NO: 3257228 - RNA, 13 nt, Human
guuuaugugugug

SEQ ID NO: 3257229 - RNA, 23 nt, Human
aaggcuauggggauagaugugug

SEQ ID NO: 3257230 - RNA, 16 nt, Human
guuuucuuaacuuaaa

SEQ ID NO: 3257231 - RNA, 13 nt, Human
acacuuaaaaaug

SEQ ID NO: 3257232 - RNA, 15 nt, Human
acacuuaaaaauggu

SEQ ID NO: 3257233 - RNA, 14 nt, Human
acacuccagugaga

SEQ ID NO: 3257234 - RNA, 14 nt, Human
aauuuaugugaugg

SEQ ID NO: 3257235 - RNA, 17 nt, Human
aauuuacagagacagaa

SEQ ID NO: 3257236 - RNA, 18 nt, Human
aauuuacagagacagaaa

SEQ ID NO: 3257237 - RNA, 17 nt, Human
uacugagagugaacaaa

SEQ ID NO: 3257238 - RNA, 18 nt, Human
uacuaaaaauacaaaaaa

SEQ ID NO: 3257239 - RNA, 14 nt, Human
uacuaaaaauacaa

SEQ ID NO: 3257240 - RNA, 17 nt, Human
acaaauuuacagagaca

SEQ ID NO: 3257241 - RNA, 16 nt, Human
uaauuuaaaauuguga

SEQ ID NO: 3257242 - RNA, 15 nt, Human
uaauuuaaaauugug

SEQ ID NO: 3257243 - RNA, 21 nt, Human
uacaaaaaaaaaaaaaaauua

SEQ ID NO: 3257244 - RNA, 18 nt, Human
uacagaggacaguauuug

SEQ ID NO: 3257245 - RNA, 14 nt, Human
uacagaggacagua

SEQ ID NO: 3257246 - RNA, 11 nt, Human
aaugugauaug

SEQ ID NO: 3257247 - RNA, 19 nt, Human
aauaucuuuuuuuuaauaa

SEQ ID NO: 3257248 - RNA, 13 nt, Human
caagaaaugaaag

SEQ ID NO: 3257249 - RNA, 16 nt, Human
caaauuuacagagaca

SEQ ID NO: 3257250 - RNA, 17 nt, Human
caaauuuacagagacag

SEQ ID NO: 3257251 - RNA, 23 nt, Human
caaauuuacagagacagaaagca

SEQ ID NO: 3257252 - RNA, 15 nt, Human
cacaagaaaugaaag

SEQ ID NO: 3257253 - RNA, 21 nt, Human
cacaagaaaugaaagcaggga

SEQ ID NO: 3257254 - RNA, 13 nt, Human
cacaagaaaugaa

SEQ ID NO: 3257255 - RNA, 23 nt, Human
cacaagaaaugaaagcagggacu

SEQ ID NO: 3257256 - RNA, 15 nt, Human
cacaggaaguagagg

SEQ ID NO: 3257257 - RNA, 22 nt, Human
ucagacauagaauuaacacaug

SEQ ID NO: 3257258 - RNA, 19 nt, Human
ucagacauagaauuaacac

SEQ ID NO: 3257259 - RNA, 14 nt, Human
ucacaggaaguaga

SEQ ID NO: 3257260 - RNA, 19 nt, Human
ucacaggaaguagaggagg

SEQ ID NO: 3257261 - RNA, 14 nt, Human
uccaccuacaugag

SEQ ID NO: 3257262 - RNA, 12 nt, Human
uccacuuggucu

SEQ ID NO: 3257263 - RNA, 13 nt, Human
uccacuuggucug

SEQ ID NO: 3257264 - RNA, 17 nt, Human
ucuacacuccagugaga

SEQ ID NO: 3257265 - RNA, 21 nt, Human
ucucagugucaaugcagcccc

SEQ ID NO: 3257266 - RNA, 18 nt, Human
ucucuucacagucacauu

SEQ ID NO: 3257267 - RNA, 19 nt, Human
ugaaaacuuuaugcuaagu

SEQ ID NO: 3257268 - RNA, 18 nt, Human
ugaaacccugucucuacu

SEQ ID NO: 3257269 - RNA, 18 nt, Human
ugaaagcagggacuugaa

SEQ ID NO: 3257270 - RNA, 19 nt, Human
ugaaagcagggacuugaac

SEQ ID NO: 3257271 - RNA, 20 nt, Human
ucuguguguuuaugugugug

SEQ ID NO: 3257272 - RNA, 19 nt, Human
ucuguguguuuaugugugu

SEQ ID NO: 3257273 - RNA, 22 nt, Human
ucuguguguguguauguggggg

SEQ ID NO: 3257274 - RNA, 16 nt, Human
ucuguguguuuaugug

SEQ ID NO: 3257275 - RNA, 15 nt, Human
ucuguguguuuaugu

SEQ ID NO: 3257276 - RNA, 13 nt, Human
ucugugugugugu

SEQ ID NO: 3257277 - RNA, 21 nt, Human
ucuguguguguguaugugggg

SEQ ID NO: 3257278 - RNA, 19 nt, Human
ucuguguguguguaugugg

SEQ ID NO: 3257279 - RNA, 18 nt, Human
ucuguguguguguaugug

SEQ ID NO: 3257280 - RNA, 15 nt, Human
ucuguguguguguau

SEQ ID NO: 3257281 - RNA, 23 nt, Human
ucuggccuucggccuccauccug

SEQ ID NO: 3257282 - RNA, 21 nt, Human
uaguuguaccgcaaugugacu

SEQ ID NO: 3257283 - RNA, 15 nt, Human
uaucagcacgugugg

SEQ ID NO: 3257284 - RNA, 18 nt, Human
uaggaacugcugggcuug

SEQ ID NO: 3257285 - RNA, 15 nt, Human
uaggaacugcugggc

SEQ ID NO: 3257286 - RNA, 23 nt, Human
uaggaauugacccacaagaaaug

SEQ ID NO: 3257287 - RNA, 20 nt, Human
uaggaauugacccacaagaa

SEQ ID NO: 3257288 - RNA, 13 nt, Human
uaggccaugggac

SEQ ID NO: 3257289 - RNA, 11 nt, Human
uagaugugugg

SEQ ID NO: 3257290 - RNA, 21 nt, Human
uacaugagguacugagaguga

SEQ ID NO: 3257291 - RNA, 22 nt, Human
uacaugagguacugagagugaa

SEQ ID NO: 3257292 - RNA, 19 nt, Human
uacugagagugaacaaauu

SEQ ID NO: 3257293 - RNA, 19 nt, Human
uaauucuuugaccuguugg

SEQ ID NO: 3257294 - RNA, 19 nt, Human
uaaugccacuaaauugaca

SEQ ID NO: 3257295 - RNA, 13 nt, Human
uaagccagacauc

SEQ ID NO: 3257296 - RNA, 20 nt, Human
uaagccagacaucaacagau

SEQ ID NO: 3257297 - RNA, 21 nt, Human
uaagccagacaucaacagaua

SEQ ID NO: 3257298 - RNA, 23 nt, Human
uaaauugacacuuaaaaaugguu

SEQ ID NO: 3257299 - RNA, 13 nt, Human
guuuagaaagcuu

SEQ ID NO: 3257300 - RNA, 20 nt, Human
guuuaggauguugaaaaagu

SEQ ID NO: 3257301 - RNA, 14 nt, Human
uggccuucggccuc

SEQ ID NO: 3257302 - RNA, 17 nt, Human
uggccuucggccuccau

SEQ ID NO: 3257303 - RNA, 18 nt, Human
uggccuucggccuccauc

SEQ ID NO: 3257304 - RNA, 14 nt, Human
ugggacagggagga

SEQ ID NO: 3257305 - RNA, 23 nt, Human
uggaagugugggucugugugugu

SEQ ID NO: 3257306 - RNA, 20 nt, Human
uggaagugugggucugugug

SEQ ID NO: 3257307 - RNA, 21 nt, Human
uggaagugugggucugugugu

SEQ ID NO: 3257308 - RNA, 14 nt, Human
uggaacucucgagc

SEQ ID NO: 3257309 - RNA, 16 nt, Human
ugcagauaaacaguag

SEQ ID NO: 3257310 - RNA, 20 nt, Human
ugcuagaacucccuuucaac

SEQ ID NO: 3257311 - RNA, 21 nt, Human
ugcuagaacucccuuucaaca

SEQ ID NO: 3257312 - RNA, 19 nt, Human
ugcuagaacucccuuucaa

SEQ ID NO: 3257313 - RNA, 18 nt, Human
ugcuagaacucccuuuca

SEQ ID NO: 3257314 - RNA, 16 nt, Human
uguaaauuuaugugau

SEQ ID NO: 3257315 - RNA, 15 nt, Human
uguaaauuuauguga

SEQ ID NO: 3257316 - RNA, 14 nt, Human
uguaaucacagcua

SEQ ID NO: 3257317 - RNA, 15 nt, Human
uguaaucacagcuac

SEQ ID NO: 3257318 - RNA, 18 nt, Human
ugugaggggcucucucau

SEQ ID NO: 3257319 - RNA, 22 nt, Human
ugugaccacugcagaagacagu

SEQ ID NO: 3257320 - RNA, 21 nt, Human
ugucucaguccaugaagaugu

SEQ ID NO: 3257321 - RNA, 16 nt, Human
ugugggucugugugug

SEQ ID NO: 3257322 - RNA, 14 nt, Human
ugugggucugugug

SEQ ID NO: 3257323 - RNA, 16 nt, Human
ugugggggucugugug

SEQ ID NO: 3257324 - RNA, 15 nt, Human
uuacagaggacagua

SEQ ID NO: 3257325 - RNA, 20 nt, Human
uuacagagacagaaagcaga

SEQ ID NO: 3257326 - RNA, 21 nt, Human
uguuuacagaggacaguauuu

SEQ ID NO: 3257327 - RNA, 14 nt, Human
uguuuacagaggac

SEQ ID NO: 3257328 - RNA, 23 nt, Human
uguguugugugugggagugugua

SEQ ID NO: 3257329 - RNA, 14 nt, Human
uguguugugugugg

SEQ ID NO: 3257330 - RNA, 13 nt, Human
uguguuuaugugu

SEQ ID NO: 3257331 - RNA, 15 nt, Human
uguguuuaugugugu

SEQ ID NO: 3257332 - RNA, 11 nt, Human
uguguguaugu

SEQ ID NO: 3257333 - RNA, 13 nt, Human
uguguaugugggg

SEQ ID NO: 3257334 - RNA, 14 nt, Human
uguguauguggggg

SEQ ID NO: 3257335 - RNA, 23 nt, Human
uguguaugugggggucugugugu

SEQ ID NO: 3257336 - RNA, 17 nt, Human
uuuagaagaaguguguc

SEQ ID NO: 3257337 - RNA, 19 nt, Human
uuuagaagaagugugucac

SEQ ID NO: 3257338 - RNA, 20 nt, Human
uuuuauaucaauuuaaaaaa

SEQ ID NO: 3257339 - RNA, 18 nt, Human
uucggccuccauccugag

SEQ ID NO: 3257340 - RNA, 19 nt, Human
uucggccuccauccugagg

SEQ ID NO: 3257341 - RNA, 15 nt, Human
uucggccuccauccu

SEQ ID NO: 3257342 - RNA, 19 nt, Human
uuccacuuauaggaauuga

SEQ ID NO: 3257343 - RNA, 12 nt, Human
uugggaggcuga

SEQ ID NO: 3257344 - RNA, 14 nt, Human
ccaugaagauguag

SEQ ID NO: 3257345 - RNA, 18 nt, Human
cccaaaaggcagaagcaa

SEQ ID NO: 3257346 - RNA, 13 nt, Human
cccaaaaggcaga

SEQ ID NO: 3257347 - RNA, 13 nt, Human
ccacugcagaaga

SEQ ID NO: 3257348 - RNA, 18 nt, Human
ccacugcagaagacagua

SEQ ID NO: 3257349 - RNA, 20 nt, Human
ccacacagacuugggcaggg

SEQ ID NO: 3257350 - RNA, 16 nt, Human
ccacacccucacugcu

SEQ ID NO: 3257351 - RNA, 16 nt, Human
ccaauauucauagcag

SEQ ID NO: 3257352 - RNA, 19 nt, Human
ccaagccuuggcucuaccc

SEQ ID NO: 3257353 - RNA, 19 nt, Human
cauugucccugaagagaag

SEQ ID NO: 3257354 - RNA, 17 nt, Human
cauuuaggccaugggac

SEQ ID NO: 3257355 - RNA, 22 nt, Human
ccgggaggcagagguugcagug

SEQ ID NO: 3257356 - RNA, 17 nt, Human
ccugaggcuccacuugg

SEQ ID NO: 3257357 - RNA, 18 nt, Human
ccugaggcuccacuuggu

SEQ ID NO: 3257358 - RNA, 20 nt, Human
ccugaggcuccacuuggucu

SEQ ID NO: 3257359 - RNA, 18 nt, Human
ccugaaagaggaaugaag

SEQ ID NO: 3257360 - RNA, 13 nt, Human
ccugaaagaggaa

SEQ ID NO: 3257361 - RNA, 23 nt, Human
ccugaaagaggaaugaaguacuc

SEQ ID NO: 3257362 - RNA, 23 nt, Human
cgauugcaggagucccugccauc

SEQ ID NO: 3257363 - RNA, 11 nt, Human
cgcaaugugac

SEQ ID NO: 3257364 - RNA, 21 nt, Human
cgauugcaggagucccugcca

SEQ ID NO: 3257365 - RNA, 14 nt, Human
cggccuccauccug

SEQ ID NO: 3257366 - RNA, 16 nt, Human
cggccuccauccugag

SEQ ID NO: 3257367 - RNA, 17 nt, Human
cggccuccauccugagg

SEQ ID NO: 3257368 - RNA, 12 nt, Human
ccuucagccuga

SEQ ID NO: 3257369 - RNA, 15 nt, Human
cugccuaagugcagc

SEQ ID NO: 3257370 - RNA, 23 nt, Human
cugcagaagacaguauggcagcu

SEQ ID NO: 3257371 - RNA, 13 nt, Human
cugcagaagacag

SEQ ID NO: 3257372 - RNA, 16 nt, Human
cuggccaacgggguga

SEQ ID NO: 3257373 - RNA, 17 nt, Human
cuccauugguguugaca

SEQ ID NO: 3257374 - RNA, 23 nt, Human
cuccauccugaggcuccacuugg

SEQ ID NO: 3257375 - RNA, 21 nt, Human
cuccauccugaggcuccacuu

SEQ ID NO: 3257376 - RNA, 20 nt, Human
cuccauccugaggcuccacu

SEQ ID NO: 3257377 - RNA, 15 nt, Human
cucauuccagaggaa

SEQ ID NO: 3257378 - RNA, 17 nt, Human
cucauuccagaggaagg

SEQ ID NO: 3257379 - RNA, 17 nt, Human
cucauuaggauggcuag

SEQ ID NO: 3257380 - RNA, 18 nt, Human
cucauuaggauggcuagu

SEQ ID NO: 3257381 - RNA, 13 nt, Human
cucccuuucaaca

SEQ ID NO: 3257382 - RNA, 12 nt, Human
cucccuuucaac

SEQ ID NO: 3257383 - RNA, 16 nt, Human
cucccuucucuucaca

SEQ ID NO: 3257384 - RNA, 21 nt, Human
cugaagagaagggcagggcug

SEQ ID NO: 3257385 - RNA, 23 nt, Human
cucugcauacucauuaggauggc

SEQ ID NO: 3257386 - RNA, 17 nt, Human
cuucggccuccauccug

SEQ ID NO: 3257387 - RNA, 18 nt, Human
cuucggccuccauccuga

SEQ ID NO: 3257388 - RNA, 18 nt, Human
cuuaaugccacuaaauug

SEQ ID NO: 3257389 - RNA, 19 nt, Human
cuuauaggaauugacccac

SEQ ID NO: 3257390 - RNA, 19 nt, Human
cuuacuaguuucccuugca

SEQ ID NO: 3257391 - RNA, 19 nt, Human
cuuuccucaaaacuucaga

SEQ ID NO: 3257392 - RNA, 18 nt, Human
cuugcccuggugccucac

SEQ ID NO: 3257393 - RNA, 14 nt, Human
gaaguauccuucag

SEQ ID NO: 3257394 - RNA, 16 nt, Human
gaaguauccuucagcc

SEQ ID NO: 3257395 - RNA, 17 nt, Human
gaagagaagggcagggc

SEQ ID NO: 3257396 - RNA, 17 nt, Human
gaagauguagaggagaa

SEQ ID NO: 3257397 - RNA, 18 nt, Human
gaagauguagaggagaaa

SEQ ID NO: 3257398 - RNA, 16 nt, Human
gaacagugauuaccag

SEQ ID NO: 3257399 - RNA, 20 nt, Human
gaacagugauuaccagggac

SEQ ID NO: 3257400 - RNA, 16 nt, Human
gacugaggggagggga

SEQ ID NO: 3257401 - RNA, 14 nt, Human
gacaucaacagaua

SEQ ID NO: 3257402 - RNA, 18 nt, Human
gacccaaaaggcagaagc

SEQ ID NO: 3257403 - RNA, 19 nt, Human
gacccaaaaggcagaagca

SEQ ID NO: 3257404 - RNA, 16 nt, Human
gaccacugcagaagac

SEQ ID NO: 3257405 - RNA, 22 nt, Human
gaguguguaauuuaaaauugug

SEQ ID NO: 3257406 - RNA, 21 nt, Human
gaguguguaauuuaaaauugu

SEQ ID NO: 3257407 - RNA, 13 nt, Human
gauaaacaguagu

SEQ ID NO: 3257408 - RNA, 16 nt, Human
gaugcuagaacucccu

SEQ ID NO: 3257409 - RNA, 14 nt, Human
gcagaagacaguau

SEQ ID NO: 3257410 - RNA, 18 nt, Human
gccuguaaucacagcuac

SEQ ID NO: 3257411 - RNA, 18 nt, Human
gccuucggccuccauccu

SEQ ID NO: 3257412 - RNA, 22 nt, Human
gcgacagugagacucugucuca

SEQ ID NO: 3257413 - RNA, 22 nt, Human
gccacguucuuacuaguuuccc

SEQ ID NO: 3257414 - RNA, 14 nt, Human
gccaugggacaggg

SEQ ID NO: 3257415 - RNA, 19 nt, Human
gccaugggacagggaggac

SEQ ID NO: 3257416 - RNA, 17 nt, Human
gccccgugggguuccuc

SEQ ID NO: 3257417 - RNA, 19 nt, Human
gccccugcacuccagccug

SEQ ID NO: 3257418 - RNA, 17 nt, Human
gcuugcccuggugccuc

SEQ ID NO: 3257419 - RNA, 19 nt, Human
gcuugcccuggugccucac

SEQ ID NO: 3257420 - RNA, 13 nt, Human
gcuggaucuguga

SEQ ID NO: 3257421 - RNA, 22 nt, Human
ggccaugggacagggaggacgc

SEQ ID NO: 3257422 - RNA, 19 nt, Human
ggaggacgcucucuggccu

SEQ ID NO: 3257423 - RNA, 20 nt, Human
ggaggacgcucucuggccuu

SEQ ID NO: 3257424 - RNA, 21 nt, Human
ggaggacgcucucuggccuuc

SEQ ID NO: 3257425 - RNA, 12 nt, Human
ggagggauuugg

SEQ ID NO: 3257426 - RNA, 15 nt, Human
ggauagaugugugga

SEQ ID NO: 3257427 - RNA, 14 nt, Human
ggauagaugugugg

SEQ ID NO: 3257428 - RNA, 13 nt, Human
ggauagaugugug

SEQ ID NO: 3257429 - RNA, 11 nt, Human
gggagugugua

SEQ ID NO: 3257430 - RNA, 14 nt, Human
gggauagaugugug

SEQ ID NO: 3257431 - RNA, 13 nt, Human
gggauagaugugu

SEQ ID NO: 3257432 - RNA, 17 nt, Human
aagugacgguuuaaugg

SEQ ID NO: 3257433 - RNA, 20 nt, Human
aauuccacacccucacugcu

SEQ ID NO: 3257434 - RNA, 11 nt, Human
uuguuaaauga

SEQ ID NO: 3257435 - RNA, 14 nt, Human
aaugguuuaaaugg

SEQ ID NO: 3257436 - RNA, 17 nt, Human
auguauauaaacaugcu

SEQ ID NO: 3257437 - RNA, 22 nt, Human
augucucucaugaccaaaugcu

SEQ ID NO: 3257438 - RNA, 13 nt, Tula virus
gcucuuuucucgg

SEQ ID NO: 3257439 - RNA, 22 nt, Tula virus
uaagcugggguagguaaguuua

SEQ ID NO: 3257440 - RNA, 17 nt, Tula virus
uuauaucaaacugaacu

SEQ ID NO: 3257441 - RNA, 13 nt, Tula virus
uaugaauuugaag

SEQ ID NO: 3257442 - RNA, 12 nt, Tula virus
uuaaacauuucu

SEQ ID NO: 3257443 - RNA, 22 nt, Tula virus
cacucagguaaucugcugcucu

SEQ ID NO: 3257444 - RNA, 18 nt, Tula virus
acugagcuaucaucucug

SEQ ID NO: 3257445 - RNA, 13 nt, Tula virus
uacaauucacaca

SEQ ID NO: 3257446 - RNA, 19 nt, Tula virus
guacacuuauauauaugca

SEQ ID NO: 3257447 - RNA, 23 nt, Tula virus
cuuuacuacuacucuaccucaua

SEQ ID NO: 3257448 - RNA, 13 nt, Tula virus
cuucaucucuauu

SEQ ID NO: 3257449 - RNA, 15 nt, Tula virus
acaccaaugcaugau

SEQ ID NO: 3257450 - RNA, 22 nt, Tula virus
auagcccucauacuacuuccaa

SEQ ID NO: 3257451 - RNA, 12 nt, Tula virus
uaaaauuguaag

SEQ ID NO: 3257452 - RNA, 22 nt, Tula virus
ucuuuucucggagcauacuacu

SEQ ID NO: 3257453 - RNA, 19 nt, Tula virus
ucacuaguguaaguucauu

SEQ ID NO: 3257454 - RNA, 16 nt, Tula virus
augauuacaauucaca

SEQ ID NO: 3257455 - RNA, 12 nt, Tula virus
cugcucuguaug

SEQ ID NO: 3257456 - RNA, 19 nt, Tula virus
augauuacaauucacacau

SEQ ID NO: 3257457 - RNA, 16 nt, Tula virus
auuuguugcucuuuuc

SEQ ID NO: 3257458 - RNA, 22 nt, Tula virus
uuguaaguccuuguuuggugua

SEQ ID NO: 3257459 - RNA, 16 nt, Tula virus
auugcacuacagcuug

SEQ ID NO: 3257460 - RNA, 13 nt, Tula virus
guacgauuccacu

SEQ ID NO: 3257461 - RNA, 18 nt, Tula virus
ucauaucgaucauuccug

SEQ ID NO: 3257462 - RNA, 23 nt, Tula virus
caccaaugcaugauuacaauuca

SEQ ID NO: 3257463 - RNA, 16 nt, Tula virus
gcacauccaaugauau

SEQ ID NO: 3257464 - RNA, 13 nt, Tula virus
ucugcugcucugu

SEQ ID NO: 3257465 - RNA, 15 nt, Tula virus
uuaaguuuaaaauug

SEQ ID NO: 3257466 - RNA, 12 nt, Tula virus
cccaauaaugug

SEQ ID NO: 3257467 - RNA, 18 nt, Tula virus
cuauuuguugcucuuuuc

SEQ ID NO: 3257468 - RNA, 18 nt, Tula virus
acuauuuguugcucuuuu

SEQ ID NO: 3257469 - RNA, 18 nt, Tula virus
uguuuauaucaaacugaa

SEQ ID NO: 3257470 - RNA, 17 nt, Tula virus
auuuguugcucuuuucu

SEQ ID NO: 3257471 - RNA, 17 nt, Tula virus
cacugauuggguugggu

SEQ ID NO: 3257472 - RNA, 16 nt, Tula virus
uggacuuuuguuccug

SEQ ID NO: 3257473 - RNA, 19 nt, Tula virus
acaauucacacauacacug

SEQ ID NO: 3257474 - RNA, 14 nt, Tula virus
uuauauauaugcac

SEQ ID NO: 3257475 - RNA, 23 nt, Tula virus
gcuaucaucucugucucuuuucu

SEQ ID NO: 3257476 - RNA, 14 nt, Tula virus
uuccuuaaugcaua

SEQ ID NO: 3257477 - RNA, 22 nt, Tula virus
acucagguaaucugcugcucug

SEQ ID NO: 3257478 - RNA, 14 nt, Tula virus
acaaaauucacacc

SEQ ID NO: 3257479 - RNA, 19 nt, Tula virus
uacgauuccacuaccucag

SEQ ID NO: 3257480 - RNA, 19 nt, Tula virus
uaucaaacugaacuguaua

SEQ ID NO: 3257481 - RNA, 15 nt, Tula virus
aguguaaguucauua

SEQ ID NO: 3257482 - RNA, 22 nt, Tula virus
auaacuuuuuauuauuccuuaa

SEQ ID NO: 3257483 - RNA, 13 nt, Tula virus
guugauuauugca

SEQ ID NO: 3257484 - RNA, 14 nt, Tula virus
uuuucuucaucucu

SEQ ID NO: 3257485 - RNA, 23 nt, Tula virus
ugugaaacugagcuaucaucucu

SEQ ID NO: 3257486 - RNA, 14 nt, Tula virus
cuauauuaacagua

SEQ ID NO: 3257487 - RNA, 13 nt, Tula virus
acaguauguguuu

SEQ ID NO: 3257488 - RNA, 11 nt, Tula virus
cggagcauacu

SEQ ID NO: 3257489 - RNA, 18 nt, Tula virus
aacuaccacuuuacuacu

SEQ ID NO: 3257490 - RNA, 15 nt, Tula virus
auguacuuauaccuu

SEQ ID NO: 3257491 - RNA, 16 nt, Tula virus
gcucuuuucucggagc

SEQ ID NO: 3257492 - RNA, 14 nt, Tula virus
aaaacuaccacuuu

SEQ ID NO: 3257493 - RNA, 20 nt, Tula virus
augcaugauuacaauucaca

SEQ ID NO: 3257494 - RNA, 15 nt, Tula virus
uaccacuuuacuacu

SEQ ID NO: 3257495 - RNA, 15 nt, Tula virus
gcacauccaaugaua

SEQ ID NO: 3257496 - RNA, 14 nt, Tula virus
auaucaaacugaac

SEQ ID NO: 3257497 - RNA, 18 nt, Tula virus
aucugcugcucuguaugu

SEQ ID NO: 3257498 - RNA, 22 nt, Tula virus
gcacaaaauucacaccaaugca

SEQ ID NO: 3257499 - RNA, 14 nt, Tula virus
caaacugaacugua

SEQ ID NO: 3257500 - RNA, 14 nt, Tula virus
ucuguauguuuauu

SEQ ID NO: 3257501 - RNA, 16 nt, Tula virus
aucucuauuuaaacau

SEQ ID NO: 3257502 - RNA, 19 nt, Tula virus
uauaucuuauauuacuaau

SEQ ID NO: 3257503 - RNA, 23 nt, Tula virus
acugagcuaucaucucugucucu

SEQ ID NO: 3257504 - RNA, 21 nt, Tula virus
ugauuacaauucacacauaca

SEQ ID NO: 3257505 - RNA, 22 nt, Tula virus
ugggucaaaucaaacacauaua

SEQ ID NO: 3257506 - RNA, 11 nt, Tula virus
aaaucaaacac

SEQ ID NO: 3257507 - RNA, 15 nt, Tula virus
auguguuuauaucaa

SEQ ID NO: 3257508 - RNA, 16 nt, Tula virus
acuacuacucuaccuc

SEQ ID NO: 3257509 - RNA, 15 nt, Tula virus
caguauguguuuaua

SEQ ID NO: 3257510 - RNA, 19 nt, Tula virus
uugggcacaaaauucacac

SEQ ID NO: 3257511 - RNA, 13 nt, Tula virus
uuacaauucacac

SEQ ID NO: 3257512 - RNA, 21 nt, Tula virus
auuccuggacuuuuguuccug

SEQ ID NO: 3257513 - RNA, 18 nt, Tula virus
cucagacaguuguuuucu

SEQ ID NO: 3257514 - RNA, 18 nt, Tula virus
ucgaucauuccuggacuu

SEQ ID NO: 3257515 - RNA, 13 nt, Tula virus
guugcucuuuucu

SEQ ID NO: 3257516 - RNA, 23 nt, Tula virus
cuauuuguugcucuuuucucgga

SEQ ID NO: 3257517 - RNA, 18 nt, Tula virus
uguugcucuuuucucgga

SEQ ID NO: 3257518 - RNA, 22 nt, Tula virus
cuuauauuacuaaucuccuaua

SEQ ID NO: 3257519 - RNA, 17 nt, Tula virus
ugagcuaucaucucugu

SEQ ID NO: 3257520 - RNA, 19 nt, Tula virus
guugggcacaaaauucaca

SEQ ID NO: 3257521 - RNA, 19 nt, Tula virus
guauuaugucacuagugua

SEQ ID NO: 3257522 - RNA, 14 nt, Tula virus
uauaagcuggggua

SEQ ID NO: 3257523 - RNA, 18 nt, Tula virus
acacacgcacauccaaug

SEQ ID NO: 3257524 - RNA, 13 nt, Tula virus
aaugcauauguac

SEQ ID NO: 3257525 - RNA, 12 nt, Tula virus
cucggagcauac

SEQ ID NO: 3257526 - RNA, 16 nt, Tula virus
uacuauuuguugcucu

SEQ ID NO: 3257527 - RNA, 21 nt, Tula virus
cuuaaugcauauguacuuaua

SEQ ID NO: 3257528 - RNA, 13 nt, Tula virus
uugauuauugcac

SEQ ID NO: 3257529 - RNA, 21 nt, Tula virus
uucaucucuauuuaaacauuu

SEQ ID NO: 3257530 - RNA, 14 nt, Tula virus
ucaucucuauuuaa

SEQ ID NO: 3257531 - RNA, 22 nt, Tula virus
cuuuuuauuauuccuuaaugca

SEQ ID NO: 3257532 - RNA, 13 nt, Tula virus
acuuuuguuccug

SEQ ID NO: 3257533 - RNA, 13 nt, Tula virus
cuauuuguugcuc

SEQ ID NO: 3257534 - RNA, 16 nt, Tula virus
caaaucaaacacauau

SEQ ID NO: 3257535 - RNA, 22 nt, Tula virus
acuguauagcccucauacuacu

SEQ ID NO: 3257536 - RNA, 15 nt, Tula virus
acauuucuaccuccg

SEQ ID NO: 3257537 - RNA, 14 nt, Tula virus
acugaacuguauag

SEQ ID NO: 3257538 - RNA, 20 nt, Tula virus
augaauuugaaggguugggc

SEQ ID NO: 3257539 - RNA, 22 nt, Tula virus
uguuuucuugauugcuuuucaa

SEQ ID NO: 3257540 - RNA, 15 nt, Tula virus
uaucgaucauuccug

SEQ ID NO: 3257541 - RNA, 19 nt, Tula virus
aguccuuguuugguguaaa

SEQ ID NO: 3257542 - RNA, 17 nt, Tula virus
uacuaaucguaagguag

SEQ ID NO: 3257543 - RNA, 13 nt, Tula virus
uuuguuaaguuua

SEQ ID NO: 3257544 - RNA, 15 nt, Tula virus
uuuguuaaguuuaaa

SEQ ID NO: 3257545 - RNA, 14 nt, Tula virus
caauucacacauac

SEQ ID NO: 3257546 - RNA, 18 nt, Tula virus
gucucuuuucuucaucuc

SEQ ID NO: 3257547 - RNA, 12 nt, Tula virus
ugcucuuuucuc

SEQ ID NO: 3257548 - RNA, 16 nt, Tula virus
uucuucaucucuauuu

SEQ ID NO: 3257549 - RNA, 19 nt, Tula virus
uuguugcucuuuucucgga

SEQ ID NO: 3257550 - RNA, 15 nt, Uukuniemi virus
cucaauugcagugaa

SEQ ID NO: 3257551 - RNA, 16 nt, Uukuniemi virus
agaguuggauggacag

SEQ ID NO: 3257552 - RNA, 15 nt, Uukuniemi virus
aggugauccagugcu

SEQ ID NO: 3257553 - RNA, 14 nt, Uukuniemi virus
uuuaauucggccaa

SEQ ID NO: 3257554 - RNA, 13 nt, Uukuniemi virus
ucaaacaugaagu

SEQ ID NO: 3257555 - RNA, 16 nt, Uukuniemi virus
ccaaacuacagugauc

SEQ ID NO: 3257556 - RNA, 14 nt, Uukuniemi virus
agugcuccucaagg

SEQ ID NO: 3257557 - RNA, 23 nt, Uukuniemi virus
aacgcuuagguucauaguugcaa

SEQ ID NO: 3257558 - RNA, 21 nt, Uukuniemi virus
cugcaauggucccccuuguga

SEQ ID NO: 3257559 - RNA, 17 nt, Uukuniemi virus
ugugacuagucuuuucu

SEQ ID NO: 3257560 - RNA, 21 nt, Uukuniemi virus
uggacaguaagguucuuccga

SEQ ID NO: 3257561 - RNA, 23 nt, Uukuniemi virus
caucccauaacgcuuagguucau

SEQ ID NO: 3257562 - RNA, 22 nt, Uukuniemi virus
cagugauccuacgacuggccaa

SEQ ID NO: 3257563 - RNA, 14 nt, Uukuniemi virus
agcacucucaaagg

SEQ ID NO: 3257564 - RNA, 12 nt, Uukuniemi virus
uagucuuuucug

SEQ ID NO: 3257565 - RNA, 16 nt, Uukuniemi virus
gauucugcccagugac

SEQ ID NO: 3257566 - RNA, 14 nt, Uukuniemi virus
gcaaggugcuugcu

SEQ ID NO: 3257567 - RNA, 18 nt, Uukuniemi virus
uucaccagauucugccca

SEQ ID NO: 3257568 - RNA, 17 nt, Uukuniemi virus
gaaguucaugugcuucu

SEQ ID NO: 3257569 - RNA, 18 nt, Uukuniemi virus
agcacucucaaaggugau

SEQ ID NO: 3257570 - RNA, 22 nt, Uukuniemi virus
ucgcucccuagcacucucaaag

SEQ ID NO: 3257571 - RNA, 21 nt, Uukuniemi virus
aaagggcuucggcccaaacua

SEQ ID NO: 3257572 - RNA, 21 nt, Uukuniemi virus
caauccuuggugaauguggug

SEQ ID NO: 3257573 - RNA, 20 nt, Uukuniemi virus
cucccuagcacucucaaagg

SEQ ID NO: 3257574 - RNA, 19 nt, Uukuniemi virus
cucaaaggugauccagugc

SEQ ID NO: 3257575 - RNA, 11 nt, Uukuniemi virus
auccagugcuc

SEQ ID NO: 3257576 - RNA, 21 nt, Uukuniemi virus
gaaccuuuucucugcaauggu

SEQ ID NO: 3257577 - RNA, 15 nt, Uukuniemi virus
cccaaacuacaguga

SEQ ID NO: 3257578 - RNA, 22 nt, Uukuniemi virus
caagaauguggagaaggcacag

SEQ ID NO: 3257579 - RNA, 19 nt, Uukuniemi virus
acuggccaauccuugguga

SEQ ID NO: 3257580 - RNA, 14 nt, Uukuniemi virus
aaguucaugugcuu

SEQ ID NO: 3257581 - RNA, 19 nt, Uukuniemi virus
ugauccuacgacuggccaa

SEQ ID NO: 3257582 - RNA, 14 nt, Uukuniemi virus
uaauucggccaaau

SEQ ID NO: 3257583 - RNA, 23 nt, Uukuniemi virus
acucucaaaggugauccagugcu

SEQ ID NO: 3257584 - RNA, 22 nt, Uukuniemi virus
caaacaugaaguucaugugcuu

SEQ ID NO: 3257585 - RNA, 13 nt, Uukuniemi virus
acaguaagguucu

SEQ ID NO: 3257586 - RNA, 20 nt, Uukuniemi virus
uaaaagggcuucggcccaaa

SEQ ID NO: 3257587 - RNA, 16 nt, Uukuniemi virus
ugauccagugcuccuc

SEQ ID NO: 3257588 - RNA, 16 nt, Uukuniemi virus
ugcaaggugcuugcuc

SEQ ID NO: 3257589 - RNA, 21 nt, Uukuniemi virus
acagauccuucaccagauucu

SEQ ID NO: 3257590 - RNA, 17 nt, Uukuniemi virus
cucaauugcagugaaga

SEQ ID NO: 3257591 - RNA, 14 nt, Uukuniemi virus
cucaauugcaguga

SEQ ID NO: 3257592 - RNA, 19 nt, Uukuniemi virus
agugcuccucaagguugac

SEQ ID NO: 3257593 - RNA, 14 nt, Uukuniemi virus
aacaugaaguucau

SEQ ID NO: 3257594 - RNA, 21 nt, Uukuniemi virus
accagauucugcccagugacc

SEQ ID NO: 3257595 - RNA, 13 nt, Uukuniemi virus
ugcccagugaccu

SEQ ID NO: 3257596 - RNA, 14 nt, Uukuniemi virus
cagauucugcccag

SEQ ID NO: 3257597 - RNA, 13 nt, Uukuniemi virus
agaaccuuuucuc

SEQ ID NO: 3257598 - RNA, 17 nt, Uukuniemi virus
uccagugcuccucaagg

SEQ ID NO: 3257599 - RNA, 21 nt, Uukuniemi virus
ugcagugaagaaccuuuucuc

SEQ ID NO: 3257600 - RNA, 14 nt, Uukuniemi virus
ucugcaaugguccc

SEQ ID NO: 3257601 - RNA, 21 nt, Uukuniemi virus
cucuaauuggacucuaaaagg

SEQ ID NO: 3257602 - RNA, 16 nt, Uukuniemi virus
uccagcagucgcuccc

SEQ ID NO: 3257603 - RNA, 15 nt, Uukuniemi virus
ccaaacuacagugau

SEQ ID NO: 3257604 - RNA, 13 nt, Uukuniemi virus
cuagucuuuucug

SEQ ID NO: 3257605 - RNA, 15 nt, Uukuniemi virus
ugauccagugcuccu

SEQ ID NO: 3257606 - RNA, 15 nt, Uukuniemi virus
aguugcaaggugcuu

SEQ ID NO: 3257607 - RNA, 11 nt, Uukuniemi virus
auucaaacaug

SEQ ID NO: 3257608 - RNA, 12 nt, Uukuniemi virus
ucugcccaguga

SEQ ID NO: 3257609 - RNA, 13 nt, Uukuniemi virus
aguugcaaggugc

SEQ ID NO: 3257610 - RNA, 14 nt, Uukuniemi virus
augugcuucuucuu

SEQ ID NO: 3257611 - RNA, 16 nt, Uukuniemi virus
caaacaugaaguucau

SEQ ID NO: 3257612 - RNA, 22 nt, Uukuniemi virus
aggugcuugcucaauugcagug

SEQ ID NO: 3257613 - RNA, 18 nt, Vaccinia virus
uauuaauguauuauuaua

SEQ ID NO: 3257614 - RNA, 20 nt, Vaccinia virus
ucauuuaacacuauacucau

SEQ ID NO: 3257615 - RNA, 21 nt, Vaccinia virus
agcaacuaaucaauagcuuaa

SEQ ID NO: 3257616 - RNA, 15 nt, Vaccinia virus
aaaauuuaaagaaug

SEQ ID NO: 3257617 - RNA, 19 nt, Vaccinia virus
uuuauaaacuuaacccauu

SEQ ID NO: 3257618 - RNA, 12 nt, Vaccinia virus
cauaaacaaauu

SEQ ID NO: 3257619 - RNA, 18 nt, Vaccinia virus
agacuaugugguuaaaug

SEQ ID NO: 3257620 - RNA, 14 nt, Vaccinia virus
cauuaacuauuuuu

SEQ ID NO: 3257621 - RNA, 15 nt, Vaccinia virus
uauaauaaauacuuu

SEQ ID NO: 3257622 - RNA, 16 nt, Vaccinia virus
ucauucucuagaagau

SEQ ID NO: 3257623 - RNA, 16 nt, Vaccinia virus
caacaaguuggaugau

SEQ ID NO: 3257624 - RNA, 21 nt, Vaccinia virus
augugucuacauaaauaugca

SEQ ID NO: 3257625 - RNA, 16 nt, Vaccinia virus
auaguggauuaauaua

SEQ ID NO: 3257626 - RNA, 19 nt, Vaccinia virus
acgauuaguucuuuaaaga

SEQ ID NO: 3257627 - RNA, 22 nt, Vaccinia virus
caacaacgaaccaaaaugaauu

SEQ ID NO: 3257628 - RNA, 17 nt, Vaccinia virus
ucaccaguauguauucc

SEQ ID NO: 3257629 - RNA, 19 nt, Vaccinia virus
ccgucaagagaguuaucug

SEQ ID NO: 3257630 - RNA, 19 nt, Vaccinia virus
uaguauuauucauuuucua

SEQ ID NO: 3257631 - RNA, 20 nt, Vaccinia virus
gaaacuuuuuagaauaucua

SEQ ID NO: 3257632 - RNA, 20 nt, Vaccinia virus
augaucaucuauuguuauau

SEQ ID NO: 3257633 - RNA, 17 nt, Vaccinia virus
gguggauggagucccag

SEQ ID NO: 3257634 - RNA, 15 nt, Vaccinia virus
aacaauaugcaaaua

SEQ ID NO: 3257635 - RNA, 16 nt, Vaccinia virus
acaaaguccaaugauu

SEQ ID NO: 3257636 - RNA, 14 nt, Vaccinia virus
aguaagaauaagac

SEQ ID NO: 3257637 - RNA, 18 nt, Vaccinia virus
augccucagguucaucga

SEQ ID NO: 3257638 - RNA, 23 nt, Vaccinia virus
aucucuuuagaauguuaucgaug

SEQ ID NO: 3257639 - RNA, 21 nt, Vaccinia virus
gaacuuacugacaaaguuaag

SEQ ID NO: 3257640 - RNA, 21 nt, Vaccinia virus
uuccuuuacgugauaaaucau

SEQ ID NO: 3257641 - RNA, 16 nt, Vaccinia virus
cuuaaucauaucacau

SEQ ID NO: 3257642 - RNA, 16 nt, Vaccinia virus
auagucuccagaaauc

SEQ ID NO: 3257643 - RNA, 16 nt, Vaccinia virus
aauguauacaaaugua

SEQ ID NO: 3257644 - RNA, 21 nt, Vaccinia virus
uaaaaacucuaacauguguuu

SEQ ID NO: 3257645 - RNA, 17 nt, Vaccinia virus
aucuauguaaucauaug

SEQ ID NO: 3257646 - RNA, 17 nt, Vaccinia virus
cguguaacaaaguauua

SEQ ID NO: 3257647 - RNA, 19 nt, Vaccinia virus
cuuaacaugagacauaaau

SEQ ID NO: 3257648 - RNA, 16 nt, Vaccinia virus
ucaggugccccgacuc

SEQ ID NO: 3257649 - RNA, 15 nt, Vaccinia virus
cacauauuaaugcag

SEQ ID NO: 3257650 - RNA, 17 nt, Vaccinia virus
uauaucaucauuuugau

SEQ ID NO: 3257651 - RNA, 15 nt, Vaccinia virus
cauuccuuauacaau

SEQ ID NO: 3257652 - RNA, 12 nt, Vaccinia virus
aaaaaaucuuca

SEQ ID NO: 3257653 - RNA, 16 nt, Vaccinia virus
ugcuuuagugaaauuu

SEQ ID NO: 3257654 - RNA, 16 nt, Vaccinia virus
auuucacaacuuuacu

SEQ ID NO: 3257655 - RNA, 22 nt, Vaccinia virus
uauuaacaguucguuugaugau

SEQ ID NO: 3257656 - RNA, 15 nt, Vaccinia virus
acagguucucaauau

SEQ ID NO: 3257657 - RNA, 12 nt, Vaccinia virus
ucaggaaaugua

SEQ ID NO: 3257658 - RNA, 20 nt, Vaccinia virus
aagaguuaaugaauaucauu

SEQ ID NO: 3257659 - RNA, 14 nt, Vaccinia virus
auuauauacugaac

SEQ ID NO: 3257660 - RNA, 19 nt, Vaccinia virus
caaucguuccaugaugggu

SEQ ID NO: 3257661 - RNA, 14 nt, Vaccinia virus
ucuucaucaaacag

SEQ ID NO: 3257662 - RNA, 16 nt, Vaccinia virus
cacaaagaaagcugua

SEQ ID NO: 3257663 - RNA, 16 nt, Vaccinia virus
agucuagguucacaau

SEQ ID NO: 3257664 - RNA, 19 nt, Vaccinia virus
aaacguuuggaaacuauac

SEQ ID NO: 3257665 - RNA, 15 nt, Vaccinia virus
aguaaguaugauauc

SEQ ID NO: 3257666 - RNA, 16 nt, Vaccinia virus
acaguucuuuucuagc

SEQ ID NO: 3257667 - RNA, 14 nt, Vaccinia virus
ccaucauuucucaa

SEQ ID NO: 3257668 - RNA, 16 nt, Vaccinia virus
auuacuuuaauaguug

SEQ ID NO: 3257669 - RNA, 20 nt, Vaccinia virus
guuccaauauguaucaaaga

SEQ ID NO: 3257670 - RNA, 19 nt, Vaccinia virus
uaauauuaaaaauaagaau

SEQ ID NO: 3257671 - RNA, 22 nt, Vaccinia virus
caaguauuguuuugauaacgau

SEQ ID NO: 3257672 - RNA, 23 nt, Vaccinia virus
aauauuaugaaugagagauaccu

SEQ ID NO: 3257673 - RNA, 19 nt, Vaccinia virus
cgauaaugugguuacucuu

SEQ ID NO: 3257674 - RNA, 19 nt, Vaccinia virus
gacuauagacauaauacua

SEQ ID NO: 3257675 - RNA, 16 nt, Vaccinia virus
acgauuauuauaaaau

SEQ ID NO: 3257676 - RNA, 12 nt, Vaccinia virus
ugacuguuuucu

SEQ ID NO: 3257677 - RNA, 18 nt, Vaccinia virus
uuuaaaaaaaaaauacuu

SEQ ID NO: 3257678 - RNA, 15 nt, Vaccinia virus
cauuaaauguuucau

SEQ ID NO: 3257679 - RNA, 23 nt, Vaccinia virus
caaucaaugauagacuagaagaa

SEQ ID NO: 3257680 - RNA, 22 nt, Vaccinia virus
agaauugauaauauaaauauga

SEQ ID NO: 3257681 - RNA, 13 nt, Vaccinia virus
caacacuauguua

SEQ ID NO: 3257682 - RNA, 15 nt, Vaccinia virus
uucugauuuuaacga

SEQ ID NO: 3257683 - RNA, 22 nt, Vaccinia virus
uaauacuuauucauauuuuagu

SEQ ID NO: 3257684 - RNA, 14 nt, Vaccinia virus
gaugagacauaucc

SEQ ID NO: 3257685 - RNA, 23 nt, Vaccinia virus
gaaauaccauaaauauauuucua

SEQ ID NO: 3257686 - RNA, 20 nt, Vaccinia virus
aaagcauuaauacaguuaug

SEQ ID NO: 3257687 - RNA, 18 nt, Vaccinia virus
auaaaaaauauucuucau

SEQ ID NO: 3257688 - RNA, 22 nt, Vaccinia virus
caaaucagacguuguaaauuau

SEQ ID NO: 3257689 - RNA, 22 nt, Vaccinia virus
gauagucguucucguucagaau

SEQ ID NO: 3257690 - RNA, 20 nt, Vaccinia virus
ugaguauugguauuacuaua

SEQ ID NO: 3257691 - RNA, 14 nt, Vaccinia virus
ucuacaaagucucu

SEQ ID NO: 3257692 - RNA, 15 nt, Vaccinia virus
aaauaaaaucuauau

SEQ ID NO: 3257693 - RNA, 22 nt, Vaccinia virus
gauaaaagaugcauauauuaga

SEQ ID NO: 3257694 - RNA, 16 nt, Vaccinia virus
acuauggcaauaauug

SEQ ID NO: 3257695 - RNA, 11 nt, Vaccinia virus
ccaaaaugaaa

SEQ ID NO: 3257696 - RNA, 14 nt, Vaccinia virus
caugaugagauguu

SEQ ID NO: 3257697 - RNA, 15 nt, Vaccinia virus
auuaacugaggauga

SEQ ID NO: 3257698 - RNA, 10 nt, Vaccinia virus
cauuugagaa

SEQ ID NO: 3257699 - RNA, 21 nt, Vaccinia virus
agaaaucauguuauaguguuu

SEQ ID NO: 3257700 - RNA, 19 nt, Vaccinia virus
ccgguuugcaaaacaaaaa

SEQ ID NO: 3257701 - RNA, 15 nt, Vaccinia virus
auaauacgaauauau

SEQ ID NO: 3257702 - RNA, 15 nt, Vaccinia virus
uauaaucguuaaauu

SEQ ID NO: 3257703 - RNA, 13 nt, Vaccinia virus
gauuauuuccugc

SEQ ID NO: 3257704 - RNA, 12 nt, Vaccinia virus
aaagauauuguu

SEQ ID NO: 3257705 - RNA, 21 nt, Vaccinia virus
uacaaacuauagaaauuauuu

SEQ ID NO: 3257706 - RNA, 14 nt, Vaccinia virus
auacaaauuuuacu

SEQ ID NO: 3257707 - RNA, 16 nt, Vaccinia virus
uacuuuauuacuccau

SEQ ID NO: 3257708 - RNA, 18 nt, Vaccinia virus
uaauauuucuauuucuau

SEQ ID NO: 3257709 - RNA, 15 nt, Vaccinia virus
uauaagauuaucaaa

SEQ ID NO: 3257710 - RNA, 16 nt, Vaccinia virus
aagucauaugugguau

SEQ ID NO: 3257711 - RNA, 13 nt, Vaccinia virus
auuaguuucuuga

SEQ ID NO: 3257712 - RNA, 19 nt, Vaccinia virus
uccguuuauuauuauacau

SEQ ID NO: 3257713 - RNA, 20 nt, Vaccinia virus
ccucaaacucgauauauuua

SEQ ID NO: 3257714 - RNA, 21 nt, Vaccinia virus
acuaguauaaaaucuguaucg

SEQ ID NO: 3257715 - RNA, 19 nt, Vaccinia virus
uaaaucuguauaucuuucc

SEQ ID NO: 3257716 - RNA, 19 nt, Vaccinia virus
auuggauaguuuuuuugaa

SEQ ID NO: 3257717 - RNA, 16 nt, Vaccinia virus
uuauaguuaacauuuu

SEQ ID NO: 3257718 - RNA, 18 nt, Vaccinia virus
aucacuaucgcccaggag

SEQ ID NO: 3257719 - RNA, 21 nt, Vaccinia virus
aguauauauaaguuauugcau

SEQ ID NO: 3257720 - RNA, 19 nt, Vaccinia virus
uuuuauggcaaacuuuacu

SEQ ID NO: 3257721 - RNA, 20 nt, Vaccinia virus
agauaugugauaaaaaucgu

SEQ ID NO: 3257722 - RNA, 17 nt, Vaccinia virus
gacagcgugaauaaugu

SEQ ID NO: 3257723 - RNA, 19 nt, Vaccinia virus
gacucauaagaaagagaau

SEQ ID NO: 3257724 - RNA, 17 nt, Vaccinia virus
uccuccuguagauaugu

SEQ ID NO: 3257725 - RNA, 15 nt, Vaccinia virus
aacaucuuaaaaauu

SEQ ID NO: 3257726 - RNA, 18 nt, Vaccinia virus
ugaugaguuguacaucuu

SEQ ID NO: 3257727 - RNA, 22 nt, Vaccinia virus
aauagacaaacuguaaguaugu

SEQ ID NO: 3257728 - RNA, 22 nt, Vaccinia virus
gcauccccuuucaauaguucuc

SEQ ID NO: 3257729 - RNA, 16 nt, Vaccinia virus
ucaucggaucuguaaa

SEQ ID NO: 3257730 - RNA, 11 nt, Vaccinia virus
ucacagucugu

SEQ ID NO: 3257731 - RNA, 12 nt, Vaccinia virus
auucaagagaau

SEQ ID NO: 3257732 - RNA, 22 nt, Vaccinia virus
uuugauauacuaagcaaguaca

SEQ ID NO: 3257733 - RNA, 19 nt, Vaccinia virus
guuuaaauucuuuaauauc

SEQ ID NO: 3257734 - RNA, 18 nt, Vaccinia virus
aagacuaucggacucuuc

SEQ ID NO: 3257735 - RNA, 15 nt, Vaccinia virus
augcaaucaacaagu

SEQ ID NO: 3257736 - RNA, 20 nt, Vaccinia virus
uaguuuuuauagauucuuua

SEQ ID NO: 3257737 - RNA, 15 nt, Vaccinia virus
aauacgaauuaugca

SEQ ID NO: 3257738 - RNA, 11 nt, Vaccinia virus
uuguagucuuu

SEQ ID NO: 3257739 - RNA, 14 nt, Vaccinia virus
uacuacguacugua

SEQ ID NO: 3257740 - RNA, 17 nt, Vaccinia virus
aucaucaccuaucuugu

SEQ ID NO: 3257741 - RNA, 15 nt, Vaccinia virus
aucguuuaaaguaaa

SEQ ID NO: 3257742 - RNA, 20 nt, Vaccinia virus
uaaauguggcuacaaacuuu

SEQ ID NO: 3257743 - RNA, 20 nt, Vaccinia virus
auccuuuaccaccaaauaaa

SEQ ID NO: 3257744 - RNA, 20 nt, Vaccinia virus
augaaauaucuuaaggagaa

SEQ ID NO: 3257745 - RNA, 18 nt, Vaccinia virus
guaagacuugacuagauc

SEQ ID NO: 3257746 - RNA, 15 nt, Vaccinia virus
uaaaaauaauuauua

SEQ ID NO: 3257747 - RNA, 17 nt, Vaccinia virus
ucuuaaaagguuucaua

SEQ ID NO: 3257748 - RNA, 21 nt, Vaccinia virus
ugauaucaaacggauauugcc

SEQ ID NO: 3257749 - RNA, 16 nt, Vaccinia virus
aaggagauauugaaac

SEQ ID NO: 3257750 - RNA, 20 nt, Vaccinia virus
cuacauggacucauuaaaac

SEQ ID NO: 3257751 - RNA, 19 nt, Vaccinia virus
caguuaaagaaaaauacuc

SEQ ID NO: 3257752 - RNA, 18 nt, Vaccinia virus
aacuauaucuauguugau

SEQ ID NO: 3257753 - RNA, 21 nt, Vaccinia virus
gauugaaauuauauucuuuuu

SEQ ID NO: 3257754 - RNA, 22 nt, Vaccinia virus
ccaauaauguauagacaauuau

SEQ ID NO: 3257755 - RNA, 12 nt, Vaccinia virus
gauuuuugucca

SEQ ID NO: 3257756 - RNA, 14 nt, Vaccinia virus
gucuaacaucucuc

SEQ ID NO: 3257757 - RNA, 20 nt, Vaccinia virus
uuauuagcccaaucuguaaa

SEQ ID NO: 3257758 - RNA, 14 nt, Vaccinia virus
ucuaagauguugua

SEQ ID NO: 3257759 - RNA, 19 nt, Vaccinia virus
aauggaugaggaagugaua

SEQ ID NO: 3257760 - RNA, 22 nt, Vaccinia virus
cucaugagaauggaaaggaaac

SEQ ID NO: 3257761 - RNA, 12 nt, Vaccinia virus
aauguuaccaua

SEQ ID NO: 3257762 - RNA, 14 nt, Vaccinia virus
acugaaucauauau

SEQ ID NO: 3257763 - RNA, 14 nt, Vaccinia virus
augguuacauuuau

SEQ ID NO: 3257764 - RNA, 20 nt, Vaccinia virus
acggcaaaccaaaaacauuu

SEQ ID NO: 3257765 - RNA, 13 nt, Vaccinia virus
uuaaaaaaauuaa

SEQ ID NO: 3257766 - RNA, 13 nt, Vaccinia virus
aguuaaaaugaua

SEQ ID NO: 3257767 - RNA, 16 nt, Vaccinia virus
agauucucuaugagac

SEQ ID NO: 3257768 - RNA, 16 nt, Vaccinia virus
acuaacgaaauuaaua

SEQ ID NO: 3257769 - RNA, 16 nt, Vaccinia virus
ucuaaagagauuuaga

SEQ ID NO: 3257770 - RNA, 12 nt, Vaccinia virus
uguaauaucuua

SEQ ID NO: 3257771 - RNA, 16 nt, Vaccinia virus
auaggauacuuuguaa

SEQ ID NO: 3257772 - RNA, 18 nt, Vaccinia virus
acacauauugaugugucu

SEQ ID NO: 3257773 - RNA, 21 nt, Vaccinia virus
uuugauaggaucuauaaugua

SEQ ID NO: 3257774 - RNA, 23 nt, Vaccinia virus
cuauagaagagcgacagacaucu

SEQ ID NO: 3257775 - RNA, 19 nt, Vaccinia virus
auacuaguagcuucacaaa

SEQ ID NO: 3257776 - RNA, 14 nt, Vaccinia virus
cagaagcaauaaau

SEQ ID NO: 3257777 - RNA, 16 nt, Vaccinia virus
gaauccgcuacauauu

SEQ ID NO: 3257778 - RNA, 17 nt, Vaccinia virus
aaacuaguucugagaaa

SEQ ID NO: 3257779 - RNA, 16 nt, Vaccinia virus
cguaaacgcagauauu

SEQ ID NO: 3257780 - RNA, 22 nt, Vaccinia virus
uaugguauugauaaaauuaaug

SEQ ID NO: 3257781 - RNA, 16 nt, Vaccinia virus
uuaacuagauuauaca

SEQ ID NO: 3257782 - RNA, 16 nt, Vaccinia virus
auuaaacuuuaaugau

SEQ ID NO: 3257783 - RNA, 18 nt, Vaccinia virus
ucacaauuaaaucauuga

SEQ ID NO: 3257784 - RNA, 12 nt, Vaccinia virus
agcugaaaugag

SEQ ID NO: 3257785 - RNA, 11 nt, Vaccinia virus
acuauuucauu

SEQ ID NO: 3257786 - RNA, 13 nt, Vaccinia virus
auaauaucuauau

SEQ ID NO: 3257787 - RNA, 17 nt, Vaccinia virus
uuaacuuccacauuaau

SEQ ID NO: 3257788 - RNA, 19 nt, Vaccinia virus
aucuuuggagaaucgucua

SEQ ID NO: 3257789 - RNA, 20 nt, Vaccinia virus
acuaaugcaucuauuucauc

SEQ ID NO: 3257790 - RNA, 19 nt, Vaccinia virus
aagauugucauguggauua

SEQ ID NO: 3257791 - RNA, 16 nt, Vaccinia virus
augucuguagaaaaaa

SEQ ID NO: 3257792 - RNA, 18 nt, Vaccinia virus
acgacucuugagacuuua

SEQ ID NO: 3257793 - RNA, 12 nt, Vaccinia virus
uuaaagauauca

SEQ ID NO: 3257794 - RNA, 23 nt, Vaccinia virus
agaauaucuaucgacucuagaug

SEQ ID NO: 3257795 - RNA, 22 nt, Vaccinia virus
auguucgugguguuaugaaaca

SEQ ID NO: 3257796 - RNA, 22 nt, Vaccinia virus
gaugucugaaacguauucucuu

SEQ ID NO: 3257797 - RNA, 15 nt, Vaccinia virus
uaacauaaaaacuua

SEQ ID NO: 3257798 - RNA, 18 nt, Vaccinia virus
agaacucuuuaaacgaua

SEQ ID NO: 3257799 - RNA, 22 nt, Vaccinia virus
acuguuaguauaacgugaaugu

SEQ ID NO: 3257800 - RNA, 21 nt, Vaccinia virus
auuuguaauaauccuaucuaa

SEQ ID NO: 3257801 - RNA, 23 nt, Vaccinia virus
aucuaacaaaaauuaugaaauaa

SEQ ID NO: 3257802 - RNA, 19 nt, Vaccinia virus
ucuaguauccauuuuacau

SEQ ID NO: 3257803 - RNA, 19 nt, Vaccinia virus
uuaauuuguacauucuuaa

SEQ ID NO: 3257804 - RNA, 22 nt, Vaccinia virus
acucuaucauggcaauaacaca

SEQ ID NO: 3257805 - RNA, 19 nt, Vaccinia virus
ugucuacauaaauaugcaa

SEQ ID NO: 3257806 - RNA, 15 nt, Vaccinia virus
auauuacaaauacuu

SEQ ID NO: 3257807 - RNA, 14 nt, Vaccinia virus
aaaguuaagaucug

SEQ ID NO: 3257808 - RNA, 17 nt, Vaccinia virus
acccuuccagauaaugu

SEQ ID NO: 3257809 - RNA, 20 nt, Vaccinia virus
ccaugucaauugaguuuaua

SEQ ID NO: 3257810 - RNA, 19 nt, Vaccinia virus
aguuaaaacuuguaagaag

SEQ ID NO: 3257811 - RNA, 21 nt, Vaccinia virus
gcuaacgaugagauucaucgu

SEQ ID NO: 3257812 - RNA, 22 nt, Vaccinia virus
uccaggaucguuucuacaaaau

SEQ ID NO: 3257813 - RNA, 19 nt, Vaccinia virus
acacauuaaacaaaaaucu

SEQ ID NO: 3257814 - RNA, 13 nt, Vaccinia virus
augcaccauccga

SEQ ID NO: 3257815 - RNA, 16 nt, Vaccinia virus
gucggaggauguguua

SEQ ID NO: 3257816 - RNA, 19 nt, Vaccinia virus
aucaagagugauuuaagaa

SEQ ID NO: 3257817 - RNA, 13 nt, Vaccinia virus
auccuaacaauga

SEQ ID NO: 3257818 - RNA, 21 nt, Vaccinia virus
agcauauuccuaaauacaucu

SEQ ID NO: 3257819 - RNA, 21 nt, Vaccinia virus
caaauuccggaauagauguau

SEQ ID NO: 3257820 - RNA, 12 nt, Vaccinia virus
caauuaaaugua

SEQ ID NO: 3257821 - RNA, 19 nt, Vaccinia virus
uggaaugacgaauccuguu

SEQ ID NO: 3257822 - RNA, 18 nt, Vaccinia virus
cuauugauugaguacugu

SEQ ID NO: 3257823 - RNA, 16 nt, Vaccinia virus
aaacuaaacuuauuua

SEQ ID NO: 3257824 - RNA, 19 nt, Vaccinia virus
auauuguugauaauacaac

SEQ ID NO: 3257825 - RNA, 17 nt, Vaccinia virus
uaguauaacacacaugu

SEQ ID NO: 3257826 - RNA, 14 nt, Vaccinia virus
uuucgaauaaguuu

SEQ ID NO: 3257827 - RNA, 21 nt, Vaccinia virus
aaauagcucuuaguaugggaa

SEQ ID NO: 3257828 - RNA, 18 nt, Vaccinia virus
aagaccaauuaacgauga

SEQ ID NO: 3257829 - RNA, 18 nt, Vaccinia virus
cuacuaccgaugauguaa

SEQ ID NO: 3257830 - RNA, 18 nt, Vaccinia virus
aacagaaacguuuagaga

SEQ ID NO: 3257831 - RNA, 18 nt, Vaccinia virus
aguauucucggauacucu

SEQ ID NO: 3257832 - RNA, 12 nt, Vaccinia virus
auuaauacuuuu

SEQ ID NO: 3257833 - RNA, 22 nt, Vaccinia virus
ggagaguauccucuaugaagaa

SEQ ID NO: 3257834 - RNA, 14 nt, Vaccinia virus
gucaacaaaaaugu

SEQ ID NO: 3257835 - RNA, 19 nt, Vaccinia virus
aucuccaucgaugauacau

SEQ ID NO: 3257836 - RNA, 15 nt, Vaccinia virus
uagaacaauguguga

SEQ ID NO: 3257837 - RNA, 15 nt, Vaccinia virus
auuuuauacuagagu

SEQ ID NO: 3257838 - RNA, 16 nt, Vaccinia virus
auuacggagugugaaa

SEQ ID NO: 3257839 - RNA, 19 nt, Vaccinia virus
uagaaugugauaauuauuu

SEQ ID NO: 3257840 - RNA, 15 nt, Vaccinia virus
uuauguaacuguaaa

SEQ ID NO: 3257841 - RNA, 18 nt, Vaccinia virus
uauccaacgauuuuuagu

SEQ ID NO: 3257842 - RNA, 15 nt, Vaccinia virus
uggaggcucaacaag

SEQ ID NO: 3257843 - RNA, 23 nt, Vaccinia virus
augcggugccauucaugaaaaug

SEQ ID NO: 3257844 - RNA, 23 nt, Vaccinia virus
cuaaaaaauagcgcugaaaauaa

SEQ ID NO: 3257845 - RNA, 12 nt, Vaccinia virus
gaacuaauaaag

SEQ ID NO: 3257846 - RNA, 15 nt, Vaccinia virus
cagucugaacgcauu

SEQ ID NO: 3257847 - RNA, 23 nt, Vaccinia virus
aauaagaucguccguaacaaagu

SEQ ID NO: 3257848 - RNA, 19 nt, Vaccinia virus
uaauauucguauuuugcau

SEQ ID NO: 3257849 - RNA, 16 nt, Vaccinia virus
augacauggaaauauc

SEQ ID NO: 3257850 - RNA, 14 nt, Vaccinia virus
uaucgaauuucuac

SEQ ID NO: 3257851 - RNA, 18 nt, Vaccinia virus
gacguuagaaucaagaau

SEQ ID NO: 3257852 - RNA, 22 nt, Vaccinia virus
ucucucaaucacuacaucuuua

SEQ ID NO: 3257853 - RNA, 22 nt, Vaccinia virus
uugaaccaguccauggaaaaga

SEQ ID NO: 3257854 - RNA, 19 nt, Vaccinia virus
aaaguaauauucauaugua

SEQ ID NO: 3257855 - RNA, 15 nt, Vaccinia virus
aaaaugcuagaauua

SEQ ID NO: 3257856 - RNA, 19 nt, Vaccinia virus
cuaucaaaauauguagaaa

SEQ ID NO: 3257857 - RNA, 20 nt, Vaccinia virus
gaauaaaguuggaaguuuaa

SEQ ID NO: 3257858 - RNA, 20 nt, Vaccinia virus
uaauaaagacuucuuucuca

SEQ ID NO: 3257859 - RNA, 17 nt, Vaccinia virus
uuucuaccuuuucaauu

SEQ ID NO: 3257860 - RNA, 17 nt, Vaccinia virus
uguauggcguuuacuau

SEQ ID NO: 3257861 - RNA, 19 nt, Vaccinia virus
cuauuaucuccguuauaga

SEQ ID NO: 3257862 - RNA, 22 nt, Vaccinia virus
auagauauuaauuaucacauau

SEQ ID NO: 3257863 - RNA, 22 nt, Vaccinia virus
uaguuguauacugagaauugac

SEQ ID NO: 3257864 - RNA, 20 nt, Vaccinia virus
uaaacuuuauccauaucucu

SEQ ID NO: 3257865 - RNA, 14 nt, Vaccinia virus
auaaguaaaugaaa

SEQ ID NO: 3257866 - RNA, 23 nt, Vaccinia virus
acccuuccuuaaacgugaaugau

SEQ ID NO: 3257867 - RNA, 23 nt, Vaccinia virus
ccaguauggaagaggauuuucua

SEQ ID NO: 3257868 - RNA, 16 nt, Vaccinia virus
aaucgauuuuguaaua

SEQ ID NO: 3257869 - RNA, 23 nt, Vaccinia virus
agauaugguaaaauuaaauagua

SEQ ID NO: 3257870 - RNA, 21 nt, Vaccinia virus
aaauguauaacaaauacagaa

SEQ ID NO: 3257871 - RNA, 16 nt, Vaccinia virus
auugaacgguaucuuc

SEQ ID NO: 3257872 - RNA, 19 nt, Vaccinia virus
uaguaugucgauauacuua

SEQ ID NO: 3257873 - RNA, 12 nt, Vaccinia virus
uuaguuaacaua

SEQ ID NO: 3257874 - RNA, 14 nt, Vaccinia virus
agaaggaaacuucu

SEQ ID NO: 3257875 - RNA, 13 nt, Vaccinia virus
caaacaauguaua

SEQ ID NO: 3257876 - RNA, 17 nt, Vaccinia virus
guaauaagaauaaaaug

SEQ ID NO: 3257877 - RNA, 22 nt, Vaccinia virus
auucuaugucgucuacuggaug

SEQ ID NO: 3257878 - RNA, 12 nt, Vaccinia virus
uaacgaaaauau

SEQ ID NO: 3257879 - RNA, 15 nt, Vaccinia virus
acagaacaauauauu

SEQ ID NO: 3257880 - RNA, 15 nt, Vaccinia virus
aacaaacaucucacc

SEQ ID NO: 3257881 - RNA, 19 nt, Vaccinia virus
uaguucuuugaacaucuug

SEQ ID NO: 3257882 - RNA, 22 nt, Vaccinia virus
aaacuuuagaagaauaucucaa

SEQ ID NO: 3257883 - RNA, 16 nt, Vaccinia virus
uuauaacuuauugucu

SEQ ID NO: 3257884 - RNA, 20 nt, Vaccinia virus
ucauacgauaugccuccaga

SEQ ID NO: 3257885 - RNA, 17 nt, Vaccinia virus
augagcauuaguauuuc

SEQ ID NO: 3257886 - RNA, 20 nt, Vaccinia virus
gacaaacgcugauagaugau

SEQ ID NO: 3257887 - RNA, 13 nt, Vaccinia virus
agauuaaaaaugg

SEQ ID NO: 3257888 - RNA, 20 nt, Vaccinia virus
uacuaaaagaucaaccaaaa

SEQ ID NO: 3257889 - RNA, 22 nt, Vaccinia virus
aaucaagauucauuuuuaaaau

SEQ ID NO: 3257890 - RNA, 14 nt, Vaccinia virus
ucagaaucaaauau

SEQ ID NO: 3257891 - RNA, 13 nt, Vaccinia virus
acuuuaucuaaau

SEQ ID NO: 3257892 - RNA, 16 nt, Vaccinia virus
uuagccguuguuugag

SEQ ID NO: 3257893 - RNA, 22 nt, Vaccinia virus
auaaaucuacucagauuauucu

SEQ ID NO: 3257894 - RNA, 22 nt, Vaccinia virus
aaaagacaaauauauguggugu

SEQ ID NO: 3257895 - RNA, 13 nt, Vaccinia virus
uggaaaaaugaug

SEQ ID NO: 3257896 - RNA, 15 nt, Vaccinia virus
auuucaaaauuauuu

SEQ ID NO: 3257897 - RNA, 22 nt, Vaccinia virus
auaaauaggaguuagaauaaua

SEQ ID NO: 3257898 - RNA, 21 nt, Vaccinia virus
uaacucuuucgaauacuuauu

SEQ ID NO: 3257899 - RNA, 14 nt, Vaccinia virus
gauuaguaaauuca

SEQ ID NO: 3257900 - RNA, 20 nt, Vaccinia virus
ucaugaauacguuuaauguu

SEQ ID NO: 3257901 - RNA, 21 nt, Vaccinia virus
ucuacaaaaaggacauguaua

SEQ ID NO: 3257902 - RNA, 22 nt, Vaccinia virus
ucuaaaguuaagagauuuagaa

SEQ ID NO: 3257903 - RNA, 15 nt, Vaccinia virus
aagauaaaagaauuc

SEQ ID NO: 3257904 - RNA, 20 nt, Vaccinia virus
acacuauucuuaaauuucau

SEQ ID NO: 3257905 - RNA, 13 nt, Vaccinia virus
uauuuccauaaua

SEQ ID NO: 3257906 - RNA, 13 nt, Vaccinia virus
aagauuguucucu

SEQ ID NO: 3257907 - RNA, 12 nt, Vaccinia virus
aaauaaaguuau

SEQ ID NO: 3257908 - RNA, 17 nt, Vaccinia virus
uuagaugguuucuuuuu

SEQ ID NO: 3257909 - RNA, 13 nt, Vaccinia virus
aagaaaacucguc

SEQ ID NO: 3257910 - RNA, 19 nt, Vaccinia virus
cuauaaaaagaguuucaaa

SEQ ID NO: 3257911 - RNA, 12 nt, Vaccinia virus
aauauuaggaau

SEQ ID NO: 3257912 - RNA, 13 nt, Vaccinia virus
cgugguagauguu

SEQ ID NO: 3257913 - RNA, 13 nt, Vaccinia virus
uccuuccaaugau

SEQ ID NO: 3257914 - RNA, 14 nt, Vaccinia virus
cggauaaaaguuuu

SEQ ID NO: 3257915 - RNA, 15 nt, Vaccinia virus
uagcgugaaggauau

SEQ ID NO: 3257916 - RNA, 17 nt, Vaccinia virus
aguuaucccacuagaga

SEQ ID NO: 3257917 - RNA, 18 nt, Vaccinia virus
ugaaaacuuuaaauacuu

SEQ ID NO: 3257918 - RNA, 22 nt, Vaccinia virus
ucuauaggugaugcugguucug

SEQ ID NO: 3257919 - RNA, 20 nt, Vaccinia virus
aacuccguguuuaugaugcc

SEQ ID NO: 3257920 - RNA, 13 nt, Vaccinia virus
acaugcuguauac

SEQ ID NO: 3257921 - RNA, 14 nt, Vaccinia virus
aggagcauacagua

SEQ ID NO: 3257922 - RNA, 17 nt, Vaccinia virus
gaauaguaguagcucua

SEQ ID NO: 3257923 - RNA, 16 nt, Vaccinia virus
gagauaaucuauauca

SEQ ID NO: 3257924 - RNA, 18 nt, Vaccinia virus
cucuuuaacgaaauuaaa

SEQ ID NO: 3257925 - RNA, 20 nt, Vaccinia virus
cauaaugcagauuuauugaa

SEQ ID NO: 3257926 - RNA, 18 nt, Vaccinia virus
augcagauuuauugaaaa

SEQ ID NO: 3257927 - RNA, 15 nt, Vaccinia virus
aauuugauaaagaua

SEQ ID NO: 3257928 - RNA, 18 nt, Vaccinia virus
ucaguaacuauguucauu

SEQ ID NO: 3257929 - RNA, 18 nt, Vaccinia virus
uauucuguucuauucaaa

SEQ ID NO: 3257930 - RNA, 18 nt, Vaccinia virus
cagaaggcgguaauagaa

SEQ ID NO: 3257931 - RNA, 24 nt, Vaccinia virus
agaucgcuuucugguaacaugaua

SEQ ID NO: 3257932 - RNA, 16 nt, Vaccinia virus
augguacaaaaaagaa

SEQ ID NO: 3257933 - RNA, 19 nt, Vaccinia virus
acaaacuuuuccuuuucca

SEQ ID NO: 3257934 - RNA, 14 nt, Vaccinia virus
aauaguuuaucaua

SEQ ID NO: 3257935 - RNA, 18 nt, Vaccinia virus
auugauaaaauuaaugag

SEQ ID NO: 3257936 - RNA, 15 nt, Vaccinia virus
acuuggaaacaucuc

SEQ ID NO: 3257937 - RNA, 17 nt, Vaccinia virus
cguauauagaugucaau

SEQ ID NO: 3257938 - RNA, 14 nt, Vaccinia virus
uucccauucuaaug

SEQ ID NO: 3257939 - RNA, 16 nt, Vaccinia virus
guuaagccugaauuua

SEQ ID NO: 3257940 - RNA, 15 nt, Vaccinia virus
cuauacaagucgucu

SEQ ID NO: 3257941 - RNA, 16 nt, Vaccinia virus
uccauuauuaauaaga

SEQ ID NO: 3257942 - RNA, 13 nt, Vaccinia virus
cauucaaauguug

SEQ ID NO: 3257943 - RNA, 20 nt, Vaccinia virus
gaauauagaucgaaaaauau

SEQ ID NO: 3257944 - RNA, 21 nt, Vaccinia virus
cuguacacauaguguuacaaa

SEQ ID NO: 3257945 - RNA, 22 nt, Vaccinia virus
aacauacuauuguuuauuaucu

SEQ ID NO: 3257946 - RNA, 14 nt, Vaccinia virus
acauccgaaaaagu

SEQ ID NO: 3257947 - RNA, 14 nt, Vaccinia virus
uucaagauuaucuu

SEQ ID NO: 3257948 - RNA, 14 nt, Vaccinia virus
uguaaaauaucuuc

SEQ ID NO: 3257949 - RNA, 23 nt, Vaccinia virus
uauauucaguaaccaaauacaua

SEQ ID NO: 3257950 - RNA, 18 nt, Vaccinia virus
gaaggaggaacaguuuua

SEQ ID NO: 3257951 - RNA, 21 nt, Vaccinia virus
cuagaccgaugaccauuuaaa

SEQ ID NO: 3257952 - RNA, 14 nt, Vaccinia virus
caaauaauaaacua

SEQ ID NO: 3257953 - RNA, 23 nt, Vaccinia virus
cggcauuucuuuuuaaugauaua

SEQ ID NO: 3257954 - RNA, 14 nt, Vaccinia virus
auuauuauguugau

SEQ ID NO: 3257955 - RNA, 13 nt, Vaccinia virus
ugauugaacgauu

SEQ ID NO: 3257956 - RNA, 13 nt, Vaccinia virus
agauaaacuaaau

SEQ ID NO: 3257957 - RNA, 12 nt, Vaccinia virus
aauaaauacuuu

SEQ ID NO: 3257958 - RNA, 14 nt, Vaccinia virus
uggagaucauuaaa

SEQ ID NO: 3257959 - RNA, 17 nt, Vaccinia virus
uagaucauuugaaauua

SEQ ID NO: 3257960 - RNA, 16 nt, Vaccinia virus
acaaugacugauauau

SEQ ID NO: 3257961 - RNA, 18 nt, Vaccinia virus
uaucuacgauccaucaaa

SEQ ID NO: 3257962 - RNA, 16 nt, Vaccinia virus
gcuaucgcauaaucug

SEQ ID NO: 3257963 - RNA, 14 nt, Vaccinia virus
aggcgucaaagaua

SEQ ID NO: 3257964 - RNA, 19 nt, Vaccinia virus
uuugaauauacuuuuaauu

SEQ ID NO: 3257965 - RNA, 15 nt, Vaccinia virus
agcauuuuuauaauu

SEQ ID NO: 3257966 - RNA, 13 nt, Vaccinia virus
agaaauaaaaauu

SEQ ID NO: 3257967 - RNA, 12 nt, Vaccinia virus
uuucauacauau

SEQ ID NO: 3257968 - RNA, 17 nt, Vaccinia virus
aacuucucuaaaugagu

SEQ ID NO: 3257969 - RNA, 14 nt, Vaccinia virus
uaauugacaucuau

SEQ ID NO: 3257970 - RNA, 17 nt, Vaccinia virus
uaguauacccaaagaga

SEQ ID NO: 3257971 - RNA, 23 nt, Vaccinia virus
uacuaaaaaauguagaaauugaa

SEQ ID NO: 3257972 - RNA, 20 nt, Vaccinia virus
aaguuucugaaauaagauua

SEQ ID NO: 3257973 - RNA, 18 nt, Vaccinia virus
uaagagacgggaaaauag

SEQ ID NO: 3257974 - RNA, 16 nt, Vaccinia virus
uauaaacucucaacau

SEQ ID NO: 3257975 - RNA, 16 nt, Vaccinia virus
aacaacaccaugagau

SEQ ID NO: 3257976 - RNA, 16 nt, Vaccinia virus
uuuaaccuauacauga

SEQ ID NO: 3257977 - RNA, 22 nt, Vaccinia virus
uaaauguuuaaacaucaaacau

SEQ ID NO: 3257978 - RNA, 14 nt, Vaccinia virus
uguaggaaaaagau

SEQ ID NO: 3257979 - RNA, 22 nt, Vaccinia virus
uuauugguauuucuuacauaaa

SEQ ID NO: 3257980 - RNA, 21 nt, Vaccinia virus
cguagcaaaaguaagcauuuc

SEQ ID NO: 3257981 - RNA, 22 nt, Vaccinia virus
auucuaccuuuuuauuuucuaa

SEQ ID NO: 3257982 - RNA, 12 nt, Vaccinia virus
auaaacuagaga

SEQ ID NO: 3257983 - RNA, 14 nt, Vaccinia virus
cauagccaauggau

SEQ ID NO: 3257984 - RNA, 20 nt, Vaccinia virus
ccgcaauaacaugguaacug

SEQ ID NO: 3257985 - RNA, 19 nt, Vaccinia virus
aaaugaaccucuggaauua

SEQ ID NO: 3257986 - RNA, 20 nt, Vaccinia virus
uccacaccgccucuagauau

SEQ ID NO: 3257987 - RNA, 23 nt, Vaccinia virus
gugauccuauaaacaugaauuua

SEQ ID NO: 3257988 - RNA, 21 nt, Vaccinia virus
auauaucuacuucuuccacug

SEQ ID NO: 3257989 - RNA, 21 nt, Vaccinia virus
aguuuuauuauaaguuaaaau

SEQ ID NO: 3257990 - RNA, 16 nt, Vaccinia virus
auauguauuuuaauaa

SEQ ID NO: 3257991 - RNA, 15 nt, Vaccinia virus
ucguuaaaaaguuuu

SEQ ID NO: 3257992 - RNA, 19 nt, Vaccinia virus
uuuauugucguacuuuaua

SEQ ID NO: 3257993 - RNA, 14 nt, Vaccinia virus
gaaaaauauaaugu

SEQ ID NO: 3257994 - RNA, 21 nt, Vaccinia virus
uagauuucgaaaauacuaaau

SEQ ID NO: 3257995 - RNA, 13 nt, Vaccinia virus
cgcauaaacauua

SEQ ID NO: 3257996 - RNA, 18 nt, Vaccinia virus
aauuaauaguuuugauau

SEQ ID NO: 3257997 - RNA, 12 nt, Vaccinia virus
agaaauaaagua

SEQ ID NO: 3257998 - RNA, 13 nt, Vaccinia virus
uauacuucuccaa

SEQ ID NO: 3257999 - RNA, 23 nt, Vaccinia virus
aaugaauuaauuaagauauuguu

SEQ ID NO: 3258000 - RNA, 22 nt, Vaccinia virus
acauaguuugggaaaagaaauc

SEQ ID NO: 3258001 - RNA, 23 nt, Vaccinia virus
auaagaugacuguagaacucaug

SEQ ID NO: 3258002 - RNA, 14 nt, Vaccinia virus
auuuagauuaucaa

SEQ ID NO: 3258003 - RNA, 15 nt, Vaccinia virus
auuguacgaacgaag

SEQ ID NO: 3258004 - RNA, 17 nt, Vaccinia virus
gaaacgauaucaugaac

SEQ ID NO: 3258005 - RNA, 17 nt, Vaccinia virus
gaucacuguagugcuau

SEQ ID NO: 3258006 - RNA, 14 nt, Vaccinia virus
uauauucuaucaua

SEQ ID NO: 3258007 - RNA, 13 nt, Vaccinia virus
accaaacauucuu

SEQ ID NO: 3258008 - RNA, 22 nt, Vaccinia virus
auaauuucuguaaauucaugau

SEQ ID NO: 3258009 - RNA, 13 nt, Vaccinia virus
guccauuuucugu

SEQ ID NO: 3258010 - RNA, 16 nt, Vaccinia virus
auuugagaguuuuaua

SEQ ID NO: 3258011 - RNA, 17 nt, Vaccinia virus
aaauguugauagcugaa

SEQ ID NO: 3258012 - RNA, 16 nt, Vaccinia virus
caaauaaguauuauca

SEQ ID NO: 3258013 - RNA, 20 nt, Vaccinia virus
cagaaggaggaacaguuuua

SEQ ID NO: 3258014 - RNA, 19 nt, Vaccinia virus
aauuguauuauugauacaa

SEQ ID NO: 3258015 - RNA, 21 nt, Vaccinia virus
gaugcuauguuuauagauguu

SEQ ID NO: 3258016 - RNA, 16 nt, Vaccinia virus
cuauacgaugaauaca

SEQ ID NO: 3258017 - RNA, 19 nt, Vaccinia virus
gcagaaaugcaauuaaaaa

SEQ ID NO: 3258018 - RNA, 19 nt, Vaccinia virus
gaaauuuggguacugugaa

SEQ ID NO: 3258019 - RNA, 14 nt, Vaccinia virus
ccuguucaaauuua

SEQ ID NO: 3258020 - RNA, 22 nt, Vaccinia virus
ccaagauccucucuuaaaugaa

SEQ ID NO: 3258021 - RNA, 20 nt, Vaccinia virus
ugcauugacuuuguuaguga

SEQ ID NO: 3258022 - RNA, 15 nt, Vaccinia virus
aacguaaaauacaua

SEQ ID NO: 3258023 - RNA, 13 nt, Vaccinia virus
uauaaaaacuuuu

SEQ ID NO: 3258024 - RNA, 17 nt, Vaccinia virus
gaauuaguuagauauau

SEQ ID NO: 3258025 - RNA, 16 nt, Vaccinia virus
auacuaugaugucuag

SEQ ID NO: 3258026 - RNA, 18 nt, Vaccinia virus
ccauguugucuauuucca

SEQ ID NO: 3258027 - RNA, 16 nt, Vaccinia virus
aucucccauaaucuug

SEQ ID NO: 3258028 - RNA, 15 nt, Vaccinia virus
auuccuauucauuuu

SEQ ID NO: 3258029 - RNA, 16 nt, Vaccinia virus
auuaucuacaguguau

SEQ ID NO: 3258030 - RNA, 18 nt, Vaccinia virus
ucuaauccuccuauuaca

SEQ ID NO: 3258031 - RNA, 17 nt, Vaccinia virus
uucuauuuuuaauauag

SEQ ID NO: 3258032 - RNA, 12 nt, Vaccinia virus
aaauauauuguu

SEQ ID NO: 3258033 - RNA, 13 nt, Vaccinia virus
aucacaaaucaca

SEQ ID NO: 3258034 - RNA, 20 nt, Vaccinia virus
uccauguugucuauuuccaa

SEQ ID NO: 3258035 - RNA, 23 nt, Vaccinia virus
cuuuuagagguucccaauuccaa

SEQ ID NO: 3258036 - RNA, 14 nt, Vaccinia virus
uccaaguuucuauu

SEQ ID NO: 3258037 - RNA, 14 nt, Vaccinia virus
auaccaaucauuua

SEQ ID NO: 3258038 - RNA, 13 nt, Vaccinia virus
auuacuacugaag

SEQ ID NO: 3258039 - RNA, 16 nt, Vaccinia virus
gcggcaucuaaauuaa

SEQ ID NO: 3258040 - RNA, 20 nt, Vaccinia virus
agcuuucacuuaaacuguau

SEQ ID NO: 3258041 - RNA, 15 nt, Vaccinia virus
uacaaaauguuugac

SEQ ID NO: 3258042 - RNA, 22 nt, Vaccinia virus
aucaccauggacauaaagauag

SEQ ID NO: 3258043 - RNA, 24 nt, Vaccinia virus
uagaaucagcgucguuuaacacaa

SEQ ID NO: 3258044 - RNA, 14 nt, Vaccinia virus
auaauaucagaugu

SEQ ID NO: 3258045 - RNA, 23 nt, Vaccinia virus
uuuuuagccggaauaacaucauc

SEQ ID NO: 3258046 - RNA, 15 nt, Vaccinia virus
auacuuuuucuagaa

SEQ ID NO: 3258047 - RNA, 15 nt, Vaccinia virus
guaucauuuaaacau

SEQ ID NO: 3258048 - RNA, 14 nt, Vaccinia virus
uuagugaaacauuc

SEQ ID NO: 3258049 - RNA, 22 nt, Vaccinia virus
aagaguuucaaaaauauucauu

SEQ ID NO: 3258050 - RNA, 19 nt, Vaccinia virus
aauacuauuacagaaguuu

SEQ ID NO: 3258051 - RNA, 18 nt, Vaccinia virus
cucucucacuacacuuuu

SEQ ID NO: 3258052 - RNA, 12 nt, Vaccinia virus
ugccacaaauga

SEQ ID NO: 3258053 - RNA, 13 nt, Vaccinia virus
agaaauauauacu

SEQ ID NO: 3258054 - RNA, 14 nt, Vaccinia virus
uguuauuaucuguu

SEQ ID NO: 3258055 - RNA, 12 nt, Vaccinia virus
gaguaguuuaug

SEQ ID NO: 3258056 - RNA, 14 nt, Vaccinia virus
agaaugaaacagua

SEQ ID NO: 3258057 - RNA, 19 nt, Vaccinia virus
uagaaauaucuaggacaau

SEQ ID NO: 3258058 - RNA, 23 nt, Vaccinia virus
auuucuccaaagaauauaucuaa

SEQ ID NO: 3258059 - RNA, 14 nt, Vaccinia virus
aaagaaguauacua

SEQ ID NO: 3258060 - RNA, 19 nt, Vaccinia virus
uaagaccuaccucucuuaa

SEQ ID NO: 3258061 - RNA, 21 nt, Vaccinia virus
acgauaaaaauaauauuguuu

SEQ ID NO: 3258062 - RNA, 21 nt, Vaccinia virus
aauaauaucccacauuaucau

SEQ ID NO: 3258063 - RNA, 16 nt, Vaccinia virus
agcauucaaauccgaa

SEQ ID NO: 3258064 - RNA, 19 nt, Vaccinia virus
uaauauuucacaugaugua

SEQ ID NO: 3258065 - RNA, 14 nt, Vaccinia virus
guagauacauggcu

SEQ ID NO: 3258066 - RNA, 17 nt, Vaccinia virus
ccaaucauugauaucuu

SEQ ID NO: 3258067 - RNA, 16 nt, Vaccinia virus
gaaaaacacauaucua

SEQ ID NO: 3258068 - RNA, 15 nt, Vaccinia virus
auauuuuuuaauagu

SEQ ID NO: 3258069 - RNA, 21 nt, Vaccinia virus
agauaccucaccgaguuaaaa

SEQ ID NO: 3258070 - RNA, 12 nt, Vaccinia virus
caaucuaucuau

SEQ ID NO: 3258071 - RNA, 18 nt, Vaccinia virus
uaacaaauuuccuaaaua

SEQ ID NO: 3258072 - RNA, 18 nt, Vaccinia virus
uacucauuuaacagaugu

SEQ ID NO: 3258073 - RNA, 22 nt, Vaccinia virus
auaucaucuuuucacuaaauaa

SEQ ID NO: 3258074 - RNA, 13 nt, Vaccinia virus
uaccuuaaucaug

SEQ ID NO: 3258075 - RNA, 15 nt, Vaccinia virus
uuauuagauuuggua

SEQ ID NO: 3258076 - RNA, 17 nt, Vaccinia virus
cacgaauauuacuaauu

SEQ ID NO: 3258077 - RNA, 14 nt, Vaccinia virus
uggacaacauuaau

SEQ ID NO: 3258078 - RNA, 21 nt, Vaccinia virus
auucugguuuaaaaacacaca

SEQ ID NO: 3258079 - RNA, 21 nt, Vaccinia virus
aguaugaagaccuauuaauaa

SEQ ID NO: 3258080 - RNA, 21 nt, Vaccinia virus
auaugcucauauauuuauaga

SEQ ID NO: 3258081 - RNA, 20 nt, Vaccinia virus
aaaaauuagaucaaagaaua

SEQ ID NO: 3258082 - RNA, 16 nt, Vaccinia virus
uuuagaguauuucuca

SEQ ID NO: 3258083 - RNA, 22 nt, Vaccinia virus
aaugacuucguaaaaaauaaua

SEQ ID NO: 3258084 - RNA, 14 nt, Vaccinia virus
aaaucaauccacua

SEQ ID NO: 3258085 - RNA, 15 nt, Vaccinia virus
uggccaagaaaauag

SEQ ID NO: 3258086 - RNA, 23 nt, Vaccinia virus
agaucuucucuccuuucaaacuu

SEQ ID NO: 3258087 - RNA, 22 nt, Vaccinia virus
aucauauuccggcguaugaauu

SEQ ID NO: 3258088 - RNA, 16 nt, Vaccinia virus
gcuuagaaauaaacga

SEQ ID NO: 3258089 - RNA, 18 nt, Vaccinia virus
aauucauagcugagaaua

SEQ ID NO: 3258090 - RNA, 20 nt, Vaccinia virus
aacucucguauagucauaga

SEQ ID NO: 3258091 - RNA, 13 nt, Vaccinia virus
acuuguuaauagu

SEQ ID NO: 3258092 - RNA, 16 nt, Vaccinia virus
auuuucacaaauacua

SEQ ID NO: 3258093 - RNA, 13 nt, Vaccinia virus
gauuuucuagauc

SEQ ID NO: 3258094 - RNA, 17 nt, Vaccinia virus
uuucauggaacaauaaa

SEQ ID NO: 3258095 - RNA, 18 nt, Vaccinia virus
cagaaaugacuccaugaa

SEQ ID NO: 3258096 - RNA, 18 nt, Vaccinia virus
uccaucguugcaauaaua

SEQ ID NO: 3258097 - RNA, 19 nt, Vaccinia virus
accaauuguuuuuguacau

SEQ ID NO: 3258098 - RNA, 18 nt, Vaccinia virus
aauugguagaguuuuaua

SEQ ID NO: 3258099 - RNA, 18 nt, Vaccinia virus
aauuugggucuaggagau

SEQ ID NO: 3258100 - RNA, 23 nt, Vaccinia virus
ugaugaaucuucauuaucugaua

SEQ ID NO: 3258101 - RNA, 20 nt, Vaccinia virus
aaauaaaaagguagauguuc

SEQ ID NO: 3258102 - RNA, 19 nt, Vaccinia virus
aucacagucuguuuuggua

SEQ ID NO: 3258103 - RNA, 19 nt, Vaccinia virus
aacuaacaaacuauacaag

SEQ ID NO: 3258104 - RNA, 13 nt, Vaccinia virus
agaauuguaacuu

SEQ ID NO: 3258105 - RNA, 18 nt, Vaccinia virus
ugguauauccaaaccauc

SEQ ID NO: 3258106 - RNA, 13 nt, Vaccinia virus
ccauuuaaaguua

SEQ ID NO: 3258107 - RNA, 16 nt, Vaccinia virus
caugaaggagauuuag

SEQ ID NO: 3258108 - RNA, 18 nt, Vaccinia virus
uuuguccuuaagacuaua

SEQ ID NO: 3258109 - RNA, 18 nt, Vaccinia virus
auugaacacuguucacau

SEQ ID NO: 3258110 - RNA, 20 nt, Vaccinia virus
uuagauauauagaauuagua

SEQ ID NO: 3258111 - RNA, 14 nt, Vaccinia virus
uuaucgcauacuag

SEQ ID NO: 3258112 - RNA, 20 nt, Vaccinia virus
aaucaaccaccgaugaugcg

SEQ ID NO: 3258113 - RNA, 18 nt, Vaccinia virus
uacugggauaagauuucc

SEQ ID NO: 3258114 - RNA, 21 nt, Vaccinia virus
cuauaaaauuguauauucaga

SEQ ID NO: 3258115 - RNA, 18 nt, Vaccinia virus
uuccaacauaauaaaagu

SEQ ID NO: 3258116 - RNA, 18 nt, Vaccinia virus
guuuccaguuauaaaaca

SEQ ID NO: 3258117 - RNA, 14 nt, Vaccinia virus
aaucugaagaaagu

SEQ ID NO: 3258118 - RNA, 16 nt, Vaccinia virus
agaagucgucaagcau

SEQ ID NO: 3258119 - RNA, 21 nt, Vaccinia virus
ucagaaagaguuuccacaugu

SEQ ID NO: 3258120 - RNA, 16 nt, Vaccinia virus
uuuacagaucuaguau

SEQ ID NO: 3258121 - RNA, 22 nt, Vaccinia virus
ugaugaaguugagaaugauaug

SEQ ID NO: 3258122 - RNA, 17 nt, Vaccinia virus
auuucaucguuuuguau

SEQ ID NO: 3258123 - RNA, 18 nt, Vaccinia virus
uacguguaaucagucucu

SEQ ID NO: 3258124 - RNA, 21 nt, Vaccinia virus
caucagaauaaaucaauaucu

SEQ ID NO: 3258125 - RNA, 23 nt, Vaccinia virus
uuccuagauauguaaaauaaucc

SEQ ID NO: 3258126 - RNA, 14 nt, Vaccinia virus
auauaguaccuaga

SEQ ID NO: 3258127 - RNA, 14 nt, Vaccinia virus
guuucuacuaacuu

SEQ ID NO: 3258128 - RNA, 20 nt, Vaccinia virus
caacuuauccauuuauacau

SEQ ID NO: 3258129 - RNA, 20 nt, Vaccinia virus
aucuaccucuccaaaaagaa

SEQ ID NO: 3258130 - RNA, 16 nt, Vaccinia virus
uacuagaauaaagcag

SEQ ID NO: 3258131 - RNA, 13 nt, Vaccinia virus
aguuauauauacu

SEQ ID NO: 3258132 - RNA, 14 nt, Vaccinia virus
gaagaauuucuguu

SEQ ID NO: 3258133 - RNA, 17 nt, Vaccinia virus
auccuguuucuacuaac

SEQ ID NO: 3258134 - RNA, 12 nt, Vaccinia virus
cuaauauacaau

SEQ ID NO: 3258135 - RNA, 18 nt, Vaccinia virus
uaaacuacucgaacagau

SEQ ID NO: 3258136 - RNA, 24 nt, Vaccinia virus
uuaauaauugcggguaucacuguu

SEQ ID NO: 3258137 - RNA, 21 nt, Vaccinia virus
augucucuuuuucagaaauua

SEQ ID NO: 3258138 - RNA, 14 nt, Vaccinia virus
ugacuaaaaugcug

SEQ ID NO: 3258139 - RNA, 16 nt, Vaccinia virus
cuuuagaagaauaucu

SEQ ID NO: 3258140 - RNA, 18 nt, Vaccinia virus
uuauaccaugucauuaac

SEQ ID NO: 3258141 - RNA, 13 nt, Vaccinia virus
ucaacuucaucau

SEQ ID NO: 3258142 - RNA, 17 nt, Vaccinia virus
cugggguaaaguaagua

SEQ ID NO: 3258143 - RNA, 12 nt, Vaccinia virus
acaauuacaaau

SEQ ID NO: 3258144 - RNA, 15 nt, Vaccinia virus
uauccugcucugaua

SEQ ID NO: 3258145 - RNA, 12 nt, Vaccinia virus
cuaaaaaacuaa

SEQ ID NO: 3258146 - RNA, 14 nt, Vaccinia virus
aaguguguagauau

SEQ ID NO: 3258147 - RNA, 23 nt, Vaccinia virus
aauacuuccaucaacauuguuuc

SEQ ID NO: 3258148 - RNA, 18 nt, Vaccinia virus
guacaugggaaaugaaau

SEQ ID NO: 3258149 - RNA, 14 nt, Vaccinia virus
ucgauauuagauuu

SEQ ID NO: 3258150 - RNA, 15 nt, Vaccinia virus
auuuaguauuaaaug

SEQ ID NO: 3258151 - RNA, 14 nt, Vaccinia virus
aguacuaucauaau

SEQ ID NO: 3258152 - RNA, 16 nt, Vaccinia virus
uauucggcauuucuaa

SEQ ID NO: 3258153 - RNA, 18 nt, Vaccinia virus
uuagauaacggacaacaa

SEQ ID NO: 3258154 - RNA, 13 nt, Vaccinia virus
aaagucaucucuu

SEQ ID NO: 3258155 - RNA, 20 nt, Vaccinia virus
ggucauauuauagauuuaau

SEQ ID NO: 3258156 - RNA, 19 nt, Vaccinia virus
ugacgucguucuacauaaa

SEQ ID NO: 3258157 - RNA, 13 nt, Vaccinia virus
uuaaauucuuuaa

SEQ ID NO: 3258158 - RNA, 15 nt, Vaccinia virus
aauauaguuaauagu

SEQ ID NO: 3258159 - RNA, 21 nt, Vaccinia virus
uuugcucuauaaacugaauau

SEQ ID NO: 3258160 - RNA, 16 nt, Vaccinia virus
guuucucauguggauc

SEQ ID NO: 3258161 - RNA, 16 nt, Vaccinia virus
aucuuagcgaacugaa

SEQ ID NO: 3258162 - RNA, 15 nt, Vaccinia virus
ucgcuaaaauuuuca

SEQ ID NO: 3258163 - RNA, 17 nt, Vaccinia virus
ccauuuauccagucuga

SEQ ID NO: 3258164 - RNA, 21 nt, Vaccinia virus
agauguuagaaaaaaugaugc

SEQ ID NO: 3258165 - RNA, 22 nt, Vaccinia virus
uuaauucuagacuauuuggaca

SEQ ID NO: 3258166 - RNA, 15 nt, Vaccinia virus
uaguauaaauaguua

SEQ ID NO: 3258167 - RNA, 16 nt, Vaccinia virus
uaagucuguggaggau

SEQ ID NO: 3258168 - RNA, 19 nt, Vaccinia virus
uaucucucugauacaauca

SEQ ID NO: 3258169 - RNA, 12 nt, Vaccinia virus
uaucaaaucuuu

SEQ ID NO: 3258170 - RNA, 16 nt, Vaccinia virus
uaugauaagauacaua

SEQ ID NO: 3258171 - RNA, 20 nt, Vaccinia virus
uauuuucuauuuuuuaaauu

SEQ ID NO: 3258172 - RNA, 15 nt, Vaccinia virus
uagucgguauuucau

SEQ ID NO: 3258173 - RNA, 14 nt, Vaccinia virus
ugaauguauucacu

SEQ ID NO: 3258174 - RNA, 20 nt, Vaccinia virus
uauagcauuguuauguauuu

SEQ ID NO: 3258175 - RNA, 18 nt, Vaccinia virus
uuuacuuuuucaucuuua

SEQ ID NO: 3258176 - RNA, 22 nt, Vaccinia virus
aucagagccaauaauaauagau

SEQ ID NO: 3258177 - RNA, 14 nt, Vaccinia virus
aauccauaccgucc

SEQ ID NO: 3258178 - RNA, 19 nt, Vaccinia virus
aguuaagagauuuagaaaa

SEQ ID NO: 3258179 - RNA, 22 nt, Vaccinia virus
ucuucaaaguuucugaaauaag

SEQ ID NO: 3258180 - RNA, 22 nt, Vaccinia virus
gacaucgacgccuuagaaauaa

SEQ ID NO: 3258181 - RNA, 20 nt, Vaccinia virus
auaaaacuugucuguauaug

SEQ ID NO: 3258182 - RNA, 20 nt, Vaccinia virus
cgacgauaacgaaguauuua

SEQ ID NO: 3258183 - RNA, 15 nt, Vaccinia virus
uuguagaacguggau

SEQ ID NO: 3258184 - RNA, 16 nt, Vaccinia virus
aaaauucguuagaaua

SEQ ID NO: 3258185 - RNA, 14 nt, Vaccinia virus
acaaaaaaugaauu

SEQ ID NO: 3258186 - RNA, 21 nt, Vaccinia virus
aaaagaaaaacagaacaauau

SEQ ID NO: 3258187 - RNA, 15 nt, Vaccinia virus
agaaccaaaugauua

SEQ ID NO: 3258188 - RNA, 12 nt, Vaccinia virus
agaagaacauau

SEQ ID NO: 3258189 - RNA, 16 nt, Vaccinia virus
acaauuauuauauaau

SEQ ID NO: 3258190 - RNA, 14 nt, Vaccinia virus
aucugauagaaaga

SEQ ID NO: 3258191 - RNA, 13 nt, Vaccinia virus
aauuauuuaacuu

SEQ ID NO: 3258192 - RNA, 23 nt, Vaccinia virus
ucuugauuaccuggcucauugau

SEQ ID NO: 3258193 - RNA, 22 nt, Vaccinia virus
aacaauuuuguauuauucugaa

SEQ ID NO: 3258194 - RNA, 15 nt, Vaccinia virus
agucucuugguuuua

SEQ ID NO: 3258195 - RNA, 15 nt, Vaccinia virus
auaacaaucguauau

SEQ ID NO: 3258196 - RNA, 14 nt, Vaccinia virus
uccaauuaaaugua

SEQ ID NO: 3258197 - RNA, 23 nt, Vaccinia virus
aucacugccgaguuuaaaacuuc

SEQ ID NO: 3258198 - RNA, 13 nt, Vaccinia virus
aaugcucaguaaa

SEQ ID NO: 3258199 - RNA, 12 nt, Vaccinia virus
uucguguuugac

SEQ ID NO: 3258200 - RNA, 16 nt, Vaccinia virus
guauuacuauaauagg

SEQ ID NO: 3258201 - RNA, 12 nt, Vaccinia virus
gcaaaauaauua

SEQ ID NO: 3258202 - RNA, 13 nt, Vaccinia virus
aucaauaaauagu

SEQ ID NO: 3258203 - RNA, 13 nt, Vaccinia virus
acucuuaauuaug

SEQ ID NO: 3258204 - RNA, 17 nt, Vaccinia virus
gauagacgcaaauuaga

SEQ ID NO: 3258205 - RNA, 20 nt, Vaccinia virus
uauuucuccacuacauaucc

SEQ ID NO: 3258206 - RNA, 18 nt, Vaccinia virus
uauuauugucauaaacau

SEQ ID NO: 3258207 - RNA, 15 nt, Vaccinia virus
accaaggacuuugua

SEQ ID NO: 3258208 - RNA, 19 nt, Vaccinia virus
ugguagauuuucaauuaug

SEQ ID NO: 3258209 - RNA, 15 nt, Vaccinia virus
uugucuagaauauca

SEQ ID NO: 3258210 - RNA, 21 nt, Vaccinia virus
acgcuauaaaaagaguuucaa

SEQ ID NO: 3258211 - RNA, 21 nt, Vaccinia virus
auuaguuagauauauagaauu

SEQ ID NO: 3258212 - RNA, 21 nt, Vaccinia virus
gcauccuauucgaauaaugag

SEQ ID NO: 3258213 - RNA, 16 nt, Vaccinia virus
uacuaucuuuaacaua

SEQ ID NO: 3258214 - RNA, 22 nt, Vaccinia virus
ggucaaccccuaagucuuuuua

SEQ ID NO: 3258215 - RNA, 18 nt, Vaccinia virus
uuacgaauauauaaaaga

SEQ ID NO: 3258216 - RNA, 13 nt, Vaccinia virus
uacuuuucuaaau

SEQ ID NO: 3258217 - RNA, 15 nt, Vaccinia virus
aauugcaguaucuau

SEQ ID NO: 3258218 - RNA, 23 nt, Vaccinia virus
auuaaaaacaaacuuuuuauccu

SEQ ID NO: 3258219 - RNA, 19 nt, Vaccinia virus
gaaaaaugcuagaauuaga

SEQ ID NO: 3258220 - RNA, 14 nt, Vaccinia virus
aauaauuauuagaa

SEQ ID NO: 3258221 - RNA, 19 nt, Vaccinia virus
guagucaguagacaucuga

SEQ ID NO: 3258222 - RNA, 15 nt, Vaccinia virus
uuauaacucuagaau

SEQ ID NO: 3258223 - RNA, 16 nt, Vaccinia virus
cauugauugcauaauu

SEQ ID NO: 3258224 - RNA, 21 nt, Vaccinia virus
auacuuuguaaucuagacaua

SEQ ID NO: 3258225 - RNA, 16 nt, Vaccinia virus
aguacaucuacuauau

SEQ ID NO: 3258226 - RNA, 13 nt, Vaccinia virus
uguacauguaguu

SEQ ID NO: 3258227 - RNA, 13 nt, Vaccinia virus
aaucuguacuucu

SEQ ID NO: 3258228 - RNA, 15 nt, Vaccinia virus
caucuaccaauucau

SEQ ID NO: 3258229 - RNA, 23 nt, Vaccinia virus
aucgaauaacgaacauaacuuua

SEQ ID NO: 3258230 - RNA, 14 nt, Vaccinia virus
aauuuauuucuaaa

SEQ ID NO: 3258231 - RNA, 15 nt, Vaccinia virus
aacaauaguuauuac

SEQ ID NO: 3258232 - RNA, 15 nt, Vaccinia virus
uauuaagauuaucua

SEQ ID NO: 3258233 - RNA, 20 nt, Vaccinia virus
aacaaaaugugauauagaaa

SEQ ID NO: 3258234 - RNA, 18 nt, Vaccinia virus
guuucauguuuauaaaaa

SEQ ID NO: 3258235 - RNA, 22 nt, Vaccinia virus
cauauucauuaggauuaucaaa

SEQ ID NO: 3258236 - RNA, 21 nt, Vaccinia virus
aaacauugacggauaaaacaa

SEQ ID NO: 3258237 - RNA, 12 nt, Vaccinia virus
aaggucagaaaa

SEQ ID NO: 3258238 - RNA, 23 nt, Vaccinia virus
caacuucaucaugaguuaaauau

SEQ ID NO: 3258239 - RNA, 16 nt, Vaccinia virus
aucggacgcagaaauu

SEQ ID NO: 3258240 - RNA, 23 nt, Vaccinia virus
aaaaaugcuagaauuagaaaagu

SEQ ID NO: 3258241 - RNA, 23 nt, Vaccinia virus
auaucuucuaugaaaggagagaa

SEQ ID NO: 3258242 - RNA, 21 nt, Vaccinia virus
cucauaagaugauaaaaagug

SEQ ID NO: 3258243 - RNA, 14 nt, Vaccinia virus
aaugggagcuuaaa

SEQ ID NO: 3258244 - RNA, 18 nt, Vaccinia virus
caucuaucaaacaaaauu

SEQ ID NO: 3258245 - RNA, 13 nt, Vaccinia virus
aacauaaaaauau

SEQ ID NO: 3258246 - RNA, 21 nt, Vaccinia virus
auguggucuguuguauaugau

SEQ ID NO: 3258247 - RNA, 18 nt, Vaccinia virus
cuggucuaaaauuuccau

SEQ ID NO: 3258248 - RNA, 18 nt, Vaccinia virus
auaaaguaugaacaaaga

SEQ ID NO: 3258249 - RNA, 15 nt, Vaccinia virus
ucauuuggagaguau

SEQ ID NO: 3258250 - RNA, 12 nt, Vaccinia virus
ugaaaauacguu

SEQ ID NO: 3258251 - RNA, 12 nt, Vaccinia virus
uuaaaauacuuu

SEQ ID NO: 3258252 - RNA, 17 nt, Vaccinia virus
auagaaugaagaaugcc

SEQ ID NO: 3258253 - RNA, 19 nt, Vaccinia virus
acaauguauacaaauguac

SEQ ID NO: 3258254 - RNA, 21 nt, Vaccinia virus
gaugaaaaauuuuuagagguu

SEQ ID NO: 3258255 - RNA, 15 nt, Vaccinia virus
uaaagacaaacaaug

SEQ ID NO: 3258256 - RNA, 16 nt, Vaccinia virus
guguagcuguuggaac

SEQ ID NO: 3258257 - RNA, 18 nt, Vaccinia virus
ccaaagagaaaacaaaac

SEQ ID NO: 3258258 - RNA, 15 nt, Vaccinia virus
uauuaauaauuacuu

SEQ ID NO: 3258259 - RNA, 17 nt, Vaccinia virus
gaaaauacuaaaucaga

SEQ ID NO: 3258260 - RNA, 22 nt, Vaccinia virus
agcgcuuaaucucaaaauaugu

SEQ ID NO: 3258261 - RNA, 20 nt, Vaccinia virus
uuauuaaauauuuuuggaca

SEQ ID NO: 3258262 - RNA, 21 nt, Vaccinia virus
cagucuaugauagcaauuacu

SEQ ID NO: 3258263 - RNA, 17 nt, Vaccinia virus
aauacgaaaauccaugc

SEQ ID NO: 3258264 - RNA, 23 nt, Vaccinia virus
aucuucucuccuguuaauaacuc

SEQ ID NO: 3258265 - RNA, 23 nt, Vaccinia virus
aauaguuuguuuuggaaauagau

SEQ ID NO: 3258266 - RNA, 21 nt, Vaccinia virus
ugaaccaaacauucuuucaaa

SEQ ID NO: 3258267 - RNA, 16 nt, Vaccinia virus
uuaucaaaucuuuaau

SEQ ID NO: 3258268 - RNA, 22 nt, Vaccinia virus
uuuggcuaaacuauauaauucu

SEQ ID NO: 3258269 - RNA, 23 nt, Vaccinia virus
aaguaaauaauaaaacaauaaau

SEQ ID NO: 3258270 - RNA, 19 nt, Vaccinia virus
agcuucuccuccuauuugu

SEQ ID NO: 3258271 - RNA, 22 nt, Vaccinia virus
uaaauguuuuacaacuaucaua

SEQ ID NO: 3258272 - RNA, 18 nt, Vaccinia virus
caugaacacgaugauaua

SEQ ID NO: 3258273 - RNA, 20 nt, Vaccinia virus
aguaacagucugaacgcauu

SEQ ID NO: 3258274 - RNA, 21 nt, Vaccinia virus
ucuuuaccauaacuguauaaa

SEQ ID NO: 3258275 - RNA, 12 nt, Vaccinia virus
aucuauauuaac

SEQ ID NO: 3258276 - RNA, 15 nt, Vaccinia virus
guuauauuuuuuucu

SEQ ID NO: 3258277 - RNA, 16 nt, Vaccinia virus
ucguucaaauuuuuaa

SEQ ID NO: 3258278 - RNA, 14 nt, Vaccinia virus
auauacaugugcaa

SEQ ID NO: 3258279 - RNA, 21 nt, Vaccinia virus
agaucuuuucucaaagauguu

SEQ ID NO: 3258280 - RNA, 14 nt, Vaccinia virus
auuucauccaauuu

SEQ ID NO: 3258281 - RNA, 20 nt, Vaccinia virus
agaauucacaccuagagaca

SEQ ID NO: 3258282 - RNA, 15 nt, Vaccinia virus
guauccauaaacaau

SEQ ID NO: 3258283 - RNA, 20 nt, Vaccinia virus
uagaaaaaauagaacuuauc

SEQ ID NO: 3258284 - RNA, 17 nt, Vaccinia virus
cgagauacagaaaagcu

SEQ ID NO: 3258285 - RNA, 20 nt, Vaccinia virus
ggauugguggauauauacgu

SEQ ID NO: 3258286 - RNA, 18 nt, Vaccinia virus
agauugguacgaaauaua

SEQ ID NO: 3258287 - RNA, 22 nt, Vaccinia virus
uccaauuuuucagauuuuugaa

SEQ ID NO: 3258288 - RNA, 12 nt, Vaccinia virus
aacuuuaaauac

SEQ ID NO: 3258289 - RNA, 17 nt, Vaccinia virus
auucuuaugagaauaga

SEQ ID NO: 3258290 - RNA, 21 nt, Vaccinia virus
gacuccaucaucgaucuaaua

SEQ ID NO: 3258291 - RNA, 16 nt, Vaccinia virus
aaucauauuuagaaaa

SEQ ID NO: 3258292 - RNA, 17 nt, Vaccinia virus
uaauuuuuuuauuacau

SEQ ID NO: 3258293 - RNA, 16 nt, Vaccinia virus
uguagccgauaaacaa

SEQ ID NO: 3258294 - RNA, 18 nt, Vaccinia virus
ucaaaaucuuaauaucuu

SEQ ID NO: 3258295 - RNA, 16 nt, Vaccinia virus
ucauguguagaugcua

SEQ ID NO: 3258296 - RNA, 16 nt, Vaccinia virus
cugauagcaguuucaa

SEQ ID NO: 3258297 - RNA, 16 nt, Vaccinia virus
gcacugguuuaguuca

SEQ ID NO: 3258298 - RNA, 23 nt, Vaccinia virus
auguuggauuaaucuuuaccaua

SEQ ID NO: 3258299 - RNA, 17 nt, Vaccinia virus
gaugaucugaauuauau

SEQ ID NO: 3258300 - RNA, 14 nt, Vaccinia virus
uacucaaauagcac

SEQ ID NO: 3258301 - RNA, 15 nt, Vaccinia virus
cagaauguacacuau

SEQ ID NO: 3258302 - RNA, 18 nt, Vaccinia virus
uacugagccaacaaauau

SEQ ID NO: 3258303 - RNA, 16 nt, Vaccinia virus
uuugucauuaacuuua

SEQ ID NO: 3258304 - RNA, 20 nt, Vaccinia virus
uaaaucaugacguaaaugua

SEQ ID NO: 3258305 - RNA, 16 nt, Vaccinia virus
uuauuucucuauuaca

SEQ ID NO: 3258306 - RNA, 20 nt, Vaccinia virus
gaauauaaaauaacuacagu

SEQ ID NO: 3258307 - RNA, 17 nt, Vaccinia virus
guagaauuuuuuaaaaa

SEQ ID NO: 3258308 - RNA, 20 nt, Vaccinia virus
guaaaaaaaccuauaaugau

SEQ ID NO: 3258309 - RNA, 18 nt, Vaccinia virus
auucuggcggcuagaaug

SEQ ID NO: 3258310 - RNA, 16 nt, Vaccinia virus
agaauggaaaggaaac

SEQ ID NO: 3258311 - RNA, 14 nt, Vaccinia virus
uuaucuaucuuaaa

SEQ ID NO: 3258312 - RNA, 19 nt, Vaccinia virus
uacaucaugaaaugaugau

SEQ ID NO: 3258313 - RNA, 18 nt, Vaccinia virus
ucuagacagauagaugau

SEQ ID NO: 3258314 - RNA, 21 nt, Vaccinia virus
uucaaaguuucugaaauaaga

SEQ ID NO: 3258315 - RNA, 13 nt, Vaccinia virus
uacuaucuuuaau

SEQ ID NO: 3258316 - RNA, 22 nt, Vaccinia virus
gaaaaagaauuuuuauaaauuu

SEQ ID NO: 3258317 - RNA, 15 nt, Vaccinia virus
agauauguuuauuca

SEQ ID NO: 3258318 - RNA, 21 nt, Vaccinia virus
ucguaacaaaacuauuucaga

SEQ ID NO: 3258319 - RNA, 16 nt, Vaccinia virus
aucguuuaaaauacua

SEQ ID NO: 3258320 - RNA, 18 nt, Vaccinia virus
uaucucagugcaaagauu

SEQ ID NO: 3258321 - RNA, 16 nt, Vaccinia virus
auuagauauuaaugag

SEQ ID NO: 3258322 - RNA, 17 nt, Vaccinia virus
aucagacguuguaaauu

SEQ ID NO: 3258323 - RNA, 22 nt, Vaccinia virus
aauguucaugacauccauuaca

SEQ ID NO: 3258324 - RNA, 15 nt, Vaccinia virus
uuaauguauaucuuu

SEQ ID NO: 3258325 - RNA, 14 nt, Vaccinia virus
auguuauugucaca

SEQ ID NO: 3258326 - RNA, 13 nt, Vaccinia virus
gcuuacuacuaac

SEQ ID NO: 3258327 - RNA, 16 nt, Vaccinia virus
ucguuuuucuuaagaa

SEQ ID NO: 3258328 - RNA, 16 nt, Vaccinia virus
ugaauacaauaauuca

SEQ ID NO: 3258329 - RNA, 16 nt, Vaccinia virus
cacuuacagaaaagau

SEQ ID NO: 3258330 - RNA, 21 nt, Vaccinia virus
uaauguaaucucuaaauucau

SEQ ID NO: 3258331 - RNA, 15 nt, Vaccinia virus
agaauauaaaaaauu

SEQ ID NO: 3258332 - RNA, 15 nt, Vaccinia virus
uuaaaaauaugugcu

SEQ ID NO: 3258333 - RNA, 15 nt, Vaccinia virus
aauuaaaaccaagua

SEQ ID NO: 3258334 - RNA, 15 nt, Vaccinia virus
ugcauguuucauaac

SEQ ID NO: 3258335 - RNA, 17 nt, Vaccinia virus
gaacaaguaucaaaaga

SEQ ID NO: 3258336 - RNA, 22 nt, Vaccinia virus
augauucuccggccacuauuau

SEQ ID NO: 3258337 - RNA, 19 nt, Vaccinia virus
acacguguagaauaucuac

SEQ ID NO: 3258338 - RNA, 20 nt, Vaccinia virus
guacauucugcaauauuguu

SEQ ID NO: 3258339 - RNA, 19 nt, Vaccinia virus
uagaaaaacuauaucuaug

SEQ ID NO: 3258340 - RNA, 13 nt, Vaccinia virus
agaauauauguau

SEQ ID NO: 3258341 - RNA, 18 nt, Vaccinia virus
gugucuuuaaucauguac

SEQ ID NO: 3258342 - RNA, 18 nt, Vaccinia virus
acgcauuauauaguuuuu

SEQ ID NO: 3258343 - RNA, 16 nt, Vaccinia virus
agaauuucuacauaau

SEQ ID NO: 3258344 - RNA, 24 nt, Vaccinia virus
guuaauaucuauauauguauuuua

SEQ ID NO: 3258345 - RNA, 22 nt, Vaccinia virus
gaaacaauguuucuuacauauu

SEQ ID NO: 3258346 - RNA, 20 nt, Vaccinia virus
gucauugaaggauaaacucg

SEQ ID NO: 3258347 - RNA, 14 nt, Vaccinia virus
uuauuuuuggaaga

SEQ ID NO: 3258348 - RNA, 14 nt, Vaccinia virus
agacuuguauucaa

SEQ ID NO: 3258349 - RNA, 15 nt, Vaccinia virus
aaacaauguauacaa

SEQ ID NO: 3258350 - RNA, 13 nt, Vaccinia virus
ucguuuucaucuu

SEQ ID NO: 3258351 - RNA, 19 nt, Vaccinia virus
ucuauacugucuguaacuc

SEQ ID NO: 3258352 - RNA, 23 nt, Vaccinia virus
acuuuacaaacgauguacugaag

SEQ ID NO: 3258353 - RNA, 14 nt, Vaccinia virus
uguuuucaucauuu

SEQ ID NO: 3258354 - RNA, 16 nt, Vaccinia virus
agaacuaccaauaugu

SEQ ID NO: 3258355 - RNA, 19 nt, Vaccinia virus
ucauaugacuaaaaugcug

SEQ ID NO: 3258356 - RNA, 12 nt, Vaccinia virus
guauaacauucu

SEQ ID NO: 3258357 - RNA, 19 nt, Vaccinia virus
uacucggccgacauaaugu

SEQ ID NO: 3258358 - RNA, 13 nt, Vaccinia virus
aaguuguuaaaaa

SEQ ID NO: 3258359 - RNA, 23 nt, Vaccinia virus
uuuauuauauucaguaaccaaau

SEQ ID NO: 3258360 - RNA, 13 nt, Vaccinia virus
gacucauaaucuc

SEQ ID NO: 3258361 - RNA, 17 nt, Vaccinia virus
uacaaaauguugauaau

SEQ ID NO: 3258362 - RNA, 16 nt, Vaccinia virus
guucaccuucuauaga

SEQ ID NO: 3258363 - RNA, 22 nt, Vaccinia virus
ucauuccaucauuuaagaaggc

SEQ ID NO: 3258364 - RNA, 19 nt, Vaccinia virus
ccauggacucauaaucucu

SEQ ID NO: 3258365 - RNA, 17 nt, Vaccinia virus
ucuauaaacauaaguau

SEQ ID NO: 3258366 - RNA, 14 nt, Vaccinia virus
acauuccuaugaug

SEQ ID NO: 3258367 - RNA, 14 nt, Vaccinia virus
aaacuaaacuuauu

SEQ ID NO: 3258368 - RNA, 18 nt, Vaccinia virus
acugcguucaagucauaa

SEQ ID NO: 3258369 - RNA, 18 nt, Vaccinia virus
uagaaggaaaaucaucau

SEQ ID NO: 3258370 - RNA, 19 nt, Vaccinia virus
uaauaauuuuuuaaauccu

SEQ ID NO: 3258371 - RNA, 19 nt, Vaccinia virus
auguuuaaacaucaaacau

SEQ ID NO: 3258372 - RNA, 17 nt, Vaccinia virus
auuaugccguuaucauu

SEQ ID NO: 3258373 - RNA, 19 nt, Vaccinia virus
aagcaugacggcaugauaa

SEQ ID NO: 3258374 - RNA, 21 nt, Vaccinia virus
aucuuuuuauuaguaggcauc

SEQ ID NO: 3258375 - RNA, 21 nt, Vaccinia virus
auacuaucuuuaauagaacuc

SEQ ID NO: 3258376 - RNA, 16 nt, Vaccinia virus
augcaucuauuucauc

SEQ ID NO: 3258377 - RNA, 17 nt, Vaccinia virus
uugucaaauauugcucg

SEQ ID NO: 3258378 - RNA, 14 nt, Vaccinia virus
uauauaagacguau

SEQ ID NO: 3258379 - RNA, 14 nt, Vaccinia virus
auaauaaucaaaau

SEQ ID NO: 3258380 - RNA, 18 nt, Vaccinia virus
cgaugaccauuuaaaaac

SEQ ID NO: 3258381 - RNA, 13 nt, Vaccinia virus
cagauuuuaauau

SEQ ID NO: 3258382 - RNA, 13 nt, Vaccinia virus
gauguuguaauau

SEQ ID NO: 3258383 - RNA, 16 nt, Vaccinia virus
ugaugcugguucugga

SEQ ID NO: 3258384 - RNA, 17 nt, Vaccinia virus
aauuaaucauauacaac

SEQ ID NO: 3258385 - RNA, 20 nt, Vaccinia virus
uuuuaucgauucaucuaauu

SEQ ID NO: 3258386 - RNA, 13 nt, Vaccinia virus
uaugauucuguaa

SEQ ID NO: 3258387 - RNA, 17 nt, Vaccinia virus
auucucuauuaaauacc

SEQ ID NO: 3258388 - RNA, 22 nt, Vaccinia virus
guuccugguauauagauaaaga

SEQ ID NO: 3258389 - RNA, 23 nt, Vaccinia virus
uaucuaaauuucuaguacuugua

SEQ ID NO: 3258390 - RNA, 19 nt, Vaccinia virus
uauucuuaaaagguuucau

SEQ ID NO: 3258391 - RNA, 14 nt, Vaccinia virus
uacauuguuucaua

SEQ ID NO: 3258392 - RNA, 22 nt, Vaccinia virus
ucuagacuugauuuaaaaccga

SEQ ID NO: 3258393 - RNA, 12 nt, Vaccinia virus
guugauauuaac

SEQ ID NO: 3258394 - RNA, 14 nt, Vaccinia virus
uuaaaaauacgguu

SEQ ID NO: 3258395 - RNA, 14 nt, Vaccinia virus
auaucucaacgaug

SEQ ID NO: 3258396 - RNA, 17 nt, Vaccinia virus
cuucucaucucuuucag

SEQ ID NO: 3258397 - RNA, 20 nt, Vaccinia virus
caucuucuuugauuaaugau

SEQ ID NO: 3258398 - RNA, 23 nt, Vaccinia virus
uacaguaaguacaucaucuggaa

SEQ ID NO: 3258399 - RNA, 20 nt, Vaccinia virus
auaauaugcaccugaaacau

SEQ ID NO: 3258400 - RNA, 18 nt, Vaccinia virus
gcaaaucuaguaaaucaa

SEQ ID NO: 3258401 - RNA, 16 nt, Vaccinia virus
auguugcaugaaauaa

SEQ ID NO: 3258402 - RNA, 15 nt, Vaccinia virus
auuaaacuaauucau

SEQ ID NO: 3258403 - RNA, 21 nt, Vaccinia virus
cagaaucgcaacgcuaaaaga

SEQ ID NO: 3258404 - RNA, 17 nt, Vaccinia virus
gaaaacauuauauccuc

SEQ ID NO: 3258405 - RNA, 20 nt, Vaccinia virus
uuaaauuucaguuuauguuu

SEQ ID NO: 3258406 - RNA, 13 nt, Vaccinia virus
uuugauuucaauu

SEQ ID NO: 3258407 - RNA, 15 nt, Vaccinia virus
guagaugugauuuuu

SEQ ID NO: 3258408 - RNA, 22 nt, Vaccinia virus
auuucacagaaacacuagcauu

SEQ ID NO: 3258409 - RNA, 21 nt, Vaccinia virus
uaauuucacaacuuuacuguu

SEQ ID NO: 3258410 - RNA, 19 nt, Vaccinia virus
gaucaacggauaaucugaa

SEQ ID NO: 3258411 - RNA, 18 nt, Vaccinia virus
cuauaucgcuaaaauuuu

SEQ ID NO: 3258412 - RNA, 20 nt, Vaccinia virus
aaccagguaggcaguuuuau

SEQ ID NO: 3258413 - RNA, 16 nt, Vaccinia virus
aauauauguugauaau

SEQ ID NO: 3258414 - RNA, 22 nt, Vaccinia virus
aaugcgcgaaccaaaaugugau

SEQ ID NO: 3258415 - RNA, 20 nt, Vaccinia virus
auugcuuauauuuucaucua

SEQ ID NO: 3258416 - RNA, 14 nt, Vaccinia virus
agaacuaacacaac

SEQ ID NO: 3258417 - RNA, 19 nt, Vaccinia virus
uuauaaacggguguaaaca

SEQ ID NO: 3258418 - RNA, 22 nt, Vaccinia virus
cgaacacuaacgcgcaugauuu

SEQ ID NO: 3258419 - RNA, 17 nt, Vaccinia virus
ucaaaauauguuauguu

SEQ ID NO: 3258420 - RNA, 16 nt, Vaccinia virus
aguuuguuuucauuau

SEQ ID NO: 3258421 - RNA, 14 nt, Vaccinia virus
gccaagauagcuuc

SEQ ID NO: 3258422 - RNA, 18 nt, Vaccinia virus
gcuuucaagaauaaacga

SEQ ID NO: 3258423 - RNA, 23 nt, Vaccinia virus
uauauaaaaucucguuacauguu

SEQ ID NO: 3258424 - RNA, 15 nt, Vaccinia virus
aauucuuaucaauaa

SEQ ID NO: 3258425 - RNA, 20 nt, Vaccinia virus
cuuaaaauuuaaaaugauau

SEQ ID NO: 3258426 - RNA, 18 nt, Vaccinia virus
cagauuuuugaaugaaug

SEQ ID NO: 3258427 - RNA, 14 nt, Vaccinia virus
ugauuauuuacuau

SEQ ID NO: 3258428 - RNA, 14 nt, Vaccinia virus
acauugauuaaauu

SEQ ID NO: 3258429 - RNA, 17 nt, Vaccinia virus
ucaaaaaguaagauauu

SEQ ID NO: 3258430 - RNA, 14 nt, Vaccinia virus
uauguauucagaau

SEQ ID NO: 3258431 - RNA, 21 nt, Vaccinia virus
uacaaugauaaugauacagua

SEQ ID NO: 3258432 - RNA, 22 nt, Vaccinia virus
guacacagcauguuauaacuaa

SEQ ID NO: 3258433 - RNA, 20 nt, Vaccinia virus
uugagaugucucauuagaau

SEQ ID NO: 3258434 - RNA, 16 nt, Vaccinia virus
auccuucuagaauuag

SEQ ID NO: 3258435 - RNA, 19 nt, Vaccinia virus
aucaugacaaaauuaaaaa

SEQ ID NO: 3258436 - RNA, 17 nt, Vaccinia virus
auauguauuuucuuucc

SEQ ID NO: 3258437 - RNA, 17 nt, Vaccinia virus
aucuugauuuauagaug

SEQ ID NO: 3258438 - RNA, 19 nt, Vaccinia virus
auuauucuauuucgaauuu

SEQ ID NO: 3258439 - RNA, 13 nt, Vaccinia virus
ucuaucuuugcau

SEQ ID NO: 3258440 - RNA, 19 nt, Vaccinia virus
uaucuccaguauuuacauu

SEQ ID NO: 3258441 - RNA, 23 nt, Vaccinia virus
aaugcacuguucaagaauuuaua

SEQ ID NO: 3258442 - RNA, 19 nt, Vaccinia virus
guugcugcucguauaaucu

SEQ ID NO: 3258443 - RNA, 20 nt, Vaccinia virus
auaaaacguggaaagaaucu

SEQ ID NO: 3258444 - RNA, 17 nt, Vaccinia virus
gaugccaucauagauau

SEQ ID NO: 3258445 - RNA, 22 nt, Vaccinia virus
gauaaaacguggaaagaaucua

SEQ ID NO: 3258446 - RNA, 17 nt, Vaccinia virus
auguauggcuucaagau

SEQ ID NO: 3258447 - RNA, 14 nt, Vaccinia virus
aauucuuuaauauc

SEQ ID NO: 3258448 - RNA, 17 nt, Vaccinia virus
aacaucucaaugucuuu

SEQ ID NO: 3258449 - RNA, 18 nt, Vaccinia virus
aguaugauacaauacuua

SEQ ID NO: 3258450 - RNA, 16 nt, Vaccinia virus
aacacuggcuagaaaa

SEQ ID NO: 3258451 - RNA, 14 nt, Vaccinia virus
gaaacuaucuuuuu

SEQ ID NO: 3258452 - RNA, 15 nt, Vaccinia virus
uguauugcacauguu

SEQ ID NO: 3258453 - RNA, 23 nt, Vaccinia virus
uaagaaagugaguuacgaagaua

SEQ ID NO: 3258454 - RNA, 17 nt, Vaccinia virus
auuacaaauaaagcgga

SEQ ID NO: 3258455 - RNA, 15 nt, Vaccinia virus
guaugucuuauguau

SEQ ID NO: 3258456 - RNA, 17 nt, Vaccinia virus
gaacauaaaacuaauau

SEQ ID NO: 3258457 - RNA, 19 nt, Vaccinia virus
auuaaauuuuuuuauuaau

SEQ ID NO: 3258458 - RNA, 13 nt, Vaccinia virus
uuugacuagauaa

SEQ ID NO: 3258459 - RNA, 16 nt, Vaccinia virus
auguuuuaaauaucaa

SEQ ID NO: 3258460 - RNA, 17 nt, Vaccinia virus
gguacauagauuaucca

SEQ ID NO: 3258461 - RNA, 15 nt, Vaccinia virus
uaaauugaaagcgag

SEQ ID NO: 3258462 - RNA, 18 nt, Vaccinia virus
uaucgccggucaucauaa

SEQ ID NO: 3258463 - RNA, 13 nt, Vaccinia virus
auucuaauggaug

SEQ ID NO: 3258464 - RNA, 13 nt, Vaccinia virus
auuaacuauuuug

SEQ ID NO: 3258465 - RNA, 16 nt, Vaccinia virus
uauuguuuugaagaaa

SEQ ID NO: 3258466 - RNA, 18 nt, Vaccinia virus
acuuucgaauaaguuugc

SEQ ID NO: 3258467 - RNA, 17 nt, Vaccinia virus
ugaguauaucagaucau

SEQ ID NO: 3258468 - RNA, 17 nt, Vaccinia virus
auuagauuuaauagcau

SEQ ID NO: 3258469 - RNA, 16 nt, Vaccinia virus
uggauccuaacaauga

SEQ ID NO: 3258470 - RNA, 21 nt, Vaccinia virus
cuaaacccgacuuaguuauau

SEQ ID NO: 3258471 - RNA, 22 nt, Vaccinia virus
uucagauauaaaaaucuguuuu

SEQ ID NO: 3258472 - RNA, 16 nt, Vaccinia virus
gguuaacaucuuauaa

SEQ ID NO: 3258473 - RNA, 15 nt, Vaccinia virus
cuaacuuuaaacaag

SEQ ID NO: 3258474 - RNA, 15 nt, Vaccinia virus
acauaaauaugcaaa

SEQ ID NO: 3258475 - RNA, 12 nt, Vaccinia virus
gcgguguauuua

SEQ ID NO: 3258476 - RNA, 14 nt, Vaccinia virus
auaaucauucuuaa

SEQ ID NO: 3258477 - RNA, 22 nt, Vaccinia virus
auuacaaguuaagucacacuaa

SEQ ID NO: 3258478 - RNA, 17 nt, Vaccinia virus
ucauuaauaauuucuag

SEQ ID NO: 3258479 - RNA, 18 nt, Vaccinia virus
auuuuaugguauuaauaa

SEQ ID NO: 3258480 - RNA, 14 nt, Vaccinia virus
gugcuauuagaauu

SEQ ID NO: 3258481 - RNA, 12 nt, Vaccinia virus
aaaaguaaauga

SEQ ID NO: 3258482 - RNA, 23 nt, Vaccinia virus
auguuuaauacuuauucauauuu

SEQ ID NO: 3258483 - RNA, 15 nt, Vaccinia virus
auauucuaaaauggu

SEQ ID NO: 3258484 - RNA, 15 nt, Vaccinia virus
uaaagaccgaauaca

SEQ ID NO: 3258485 - RNA, 21 nt, Vaccinia virus
cacauccuuuauuuuaucuau

SEQ ID NO: 3258486 - RNA, 19 nt, Vaccinia virus
uuuccuaguauucgucaaa

SEQ ID NO: 3258487 - RNA, 22 nt, Vaccinia virus
auucauaauaagauaaauccau

SEQ ID NO: 3258488 - RNA, 16 nt, Vaccinia virus
uuucgaagaucuucuu

SEQ ID NO: 3258489 - RNA, 18 nt, Vaccinia virus
aaacuacgucaagacucu

SEQ ID NO: 3258490 - RNA, 21 nt, Vaccinia virus
uucuaccuuacccauaaacaa

SEQ ID NO: 3258491 - RNA, 17 nt, Vaccinia virus
uguuuagaaaaaugcua

SEQ ID NO: 3258492 - RNA, 15 nt, Vaccinia virus
aaaauaauaugauua

SEQ ID NO: 3258493 - RNA, 18 nt, Vaccinia virus
agacgaauacauauaccg

SEQ ID NO: 3258494 - RNA, 21 nt, Vaccinia virus
cucauuaauuaaccauuccaa

SEQ ID NO: 3258495 - RNA, 21 nt, Vaccinia virus
ccauuuuaugcgauguuuaua

SEQ ID NO: 3258496 - RNA, 22 nt, Vaccinia virus
ucuaaccuuucccauugaucau

SEQ ID NO: 3258497 - RNA, 22 nt, Vaccinia virus
uuaacacuauacucauauuaau

SEQ ID NO: 3258498 - RNA, 19 nt, Vaccinia virus
aacuaaaugguauacacau

SEQ ID NO: 3258499 - RNA, 17 nt, Vaccinia virus
uaaaaaaaaugacuugu

SEQ ID NO: 3258500 - RNA, 16 nt, Vaccinia virus
auaucaucgacaaaga

SEQ ID NO: 3258501 - RNA, 23 nt, Vaccinia virus
aaugaugccucugccuuuuuaua

SEQ ID NO: 3258502 - RNA, 13 nt, Vaccinia virus
uguaaauaucuuu

SEQ ID NO: 3258503 - RNA, 18 nt, Vaccinia virus
gaaaacuuuaaauacuua

SEQ ID NO: 3258504 - RNA, 17 nt, Vaccinia virus
guuuucuagauggaaau

SEQ ID NO: 3258505 - RNA, 13 nt, Vaccinia virus
cuuaaugcauuuu

SEQ ID NO: 3258506 - RNA, 16 nt, Vaccinia virus
agcauccaguaugaau

SEQ ID NO: 3258507 - RNA, 21 nt, Vaccinia virus
ugcaacgaauuauuagucugu

SEQ ID NO: 3258508 - RNA, 17 nt, Vaccinia virus
aucuaucuuaaaaacua

SEQ ID NO: 3258509 - RNA, 19 nt, Vaccinia virus
uauacgaaauauuauacau

SEQ ID NO: 3258510 - RNA, 17 nt, Vaccinia virus
aguaugaagaaaaaugu

SEQ ID NO: 3258511 - RNA, 23 nt, Vaccinia virus
aauacuccucauuacguuucauu

SEQ ID NO: 3258512 - RNA, 22 nt, Vaccinia virus
uuauaggcucuaaccauuuuca

SEQ ID NO: 3258513 - RNA, 15 nt, Vaccinia virus
acucucaaaaugcug

SEQ ID NO: 3258514 - RNA, 21 nt, Vaccinia virus
caucuuggggaaauauggaag

SEQ ID NO: 3258515 - RNA, 17 nt, Vaccinia virus
auugugcuuaauuauuu

SEQ ID NO: 3258516 - RNA, 14 nt, Vaccinia virus
cgauuucuacauau

SEQ ID NO: 3258517 - RNA, 18 nt, Vaccinia virus
agauuauggagcaaacau

SEQ ID NO: 3258518 - RNA, 18 nt, Vaccinia virus
aaaauauuuauuagaaca

SEQ ID NO: 3258519 - RNA, 22 nt, Vaccinia virus
aaauuuuuugagguaaucuucu

SEQ ID NO: 3258520 - RNA, 17 nt, Vaccinia virus
uaauaagugguauucca

SEQ ID NO: 3258521 - RNA, 14 nt, Vaccinia virus
gaaacacuagcauu

SEQ ID NO: 3258522 - RNA, 20 nt, Vaccinia virus
guuaggauuugguaaaucau

SEQ ID NO: 3258523 - RNA, 21 nt, Vaccinia virus
aucuguacuauguguuaaaaa

SEQ ID NO: 3258524 - RNA, 19 nt, Vaccinia virus
aagaauaugugacaaaguc

SEQ ID NO: 3258525 - RNA, 12 nt, Vaccinia virus
uaucucaaugag

SEQ ID NO: 3258526 - RNA, 15 nt, Vaccinia virus
guucagaauauguua

SEQ ID NO: 3258527 - RNA, 16 nt, Vaccinia virus
uuaaugacaaacauuu

SEQ ID NO: 3258528 - RNA, 18 nt, Vaccinia virus
acagaguuuucagaagau

SEQ ID NO: 3258529 - RNA, 15 nt, Vaccinia virus
auacacauuuucaaa

SEQ ID NO: 3258530 - RNA, 21 nt, Vaccinia virus
acaacaacgaaccaaaaugaa

SEQ ID NO: 3258531 - RNA, 16 nt, Vaccinia virus
guucuuugaacaucuu

SEQ ID NO: 3258532 - RNA, 21 nt, Vaccinia virus
caucaucguuacaauaaaaaa

SEQ ID NO: 3258533 - RNA, 16 nt, Vaccinia virus
uauaucuuauaucuua

SEQ ID NO: 3258534 - RNA, 21 nt, Vaccinia virus
uugacauuaaucuauuagaau

SEQ ID NO: 3258535 - RNA, 22 nt, Vaccinia virus
acuauuccuagcaucagcaaaa

SEQ ID NO: 3258536 - RNA, 14 nt, Vaccinia virus
auguaaagaaggag

SEQ ID NO: 3258537 - RNA, 21 nt, Vaccinia virus
accuaaucccgcauuuauaca

SEQ ID NO: 3258538 - RNA, 15 nt, Vaccinia virus
cauaauuacauuuag

SEQ ID NO: 3258539 - RNA, 17 nt, Vaccinia virus
gcgaguguuacaacauc

SEQ ID NO: 3258540 - RNA, 15 nt, Vaccinia virus
ucauaugauuucagu

SEQ ID NO: 3258541 - RNA, 20 nt, Vaccinia virus
cuauaaaacgauuaaacaau

SEQ ID NO: 3258542 - RNA, 12 nt, Vaccinia virus
aaauauuucauu

SEQ ID NO: 3258543 - RNA, 13 nt, Vaccinia virus
acuuucucuaaau

SEQ ID NO: 3258544 - RNA, 14 nt, Vaccinia virus
ugaugaauuuaccu

SEQ ID NO: 3258545 - RNA, 20 nt, Vaccinia virus
cuguauuguuaauagauaua

SEQ ID NO: 3258546 - RNA, 18 nt, Vaccinia virus
aucgauuauauucuaaga

SEQ ID NO: 3258547 - RNA, 14 nt, Vaccinia virus
cuauagauaaugac

SEQ ID NO: 3258548 - RNA, 16 nt, Vaccinia virus
auacaugaacaugucg

SEQ ID NO: 3258549 - RNA, 19 nt, Vaccinia virus
cauuuuccagaugauaugu

SEQ ID NO: 3258550 - RNA, 15 nt, Vaccinia virus
ucuccaccaaacaua

SEQ ID NO: 3258551 - RNA, 20 nt, Vaccinia virus
cgaaaaaaaagcuauuauca

SEQ ID NO: 3258552 - RNA, 23 nt, Vaccinia virus
auacuuucgguucuuuaaaagaa

SEQ ID NO: 3258553 - RNA, 19 nt, Vaccinia virus
ugucuagaauggcaaaucu

SEQ ID NO: 3258554 - RNA, 12 nt, Vaccinia virus
uagauacaaaau

SEQ ID NO: 3258555 - RNA, 14 nt, Vaccinia virus
cgaguuuaauaacc

SEQ ID NO: 3258556 - RNA, 16 nt, Vaccinia virus
uuaauccuucuagaau

SEQ ID NO: 3258557 - RNA, 19 nt, Vaccinia virus
acguaaauacaaaacagag

SEQ ID NO: 3258558 - RNA, 19 nt, Vaccinia virus
guauucauuuaucacaaaa

SEQ ID NO: 3258559 - RNA, 14 nt, Vaccinia virus
aucgauaauuauuu

SEQ ID NO: 3258560 - RNA, 18 nt, Vaccinia virus
acauacgagaaaguggau

SEQ ID NO: 3258561 - RNA, 14 nt, Vaccinia virus
uagagaacauaaug

SEQ ID NO: 3258562 - RNA, 13 nt, Vaccinia virus
acauuuauaucca

SEQ ID NO: 3258563 - RNA, 14 nt, Vaccinia virus
uauaaauggaugaa

SEQ ID NO: 3258564 - RNA, 20 nt, Vaccinia virus
caucuauauugcuacauaau

SEQ ID NO: 3258565 - RNA, 20 nt, Vaccinia virus
uugauaguauaccaacuaua

SEQ ID NO: 3258566 - RNA, 22 nt, Vaccinia virus
cagaaauggaagaguuaaugaa

SEQ ID NO: 3258567 - RNA, 21 nt, Vaccinia virus
uauaaagucugucaaaucauc

SEQ ID NO: 3258568 - RNA, 23 nt, Vaccinia virus
agcacgaucgugguuaacaauau

SEQ ID NO: 3258569 - RNA, 15 nt, Vaccinia virus
aggaucgacuccaua

SEQ ID NO: 3258570 - RNA, 20 nt, Vaccinia virus
auaauuauuucaauauacua

SEQ ID NO: 3258571 - RNA, 16 nt, Vaccinia virus
cuacucauagaaaggu

SEQ ID NO: 3258572 - RNA, 16 nt, Vaccinia virus
cggauagcaguauuuc

SEQ ID NO: 3258573 - RNA, 16 nt, Vaccinia virus
agaacagaauaaacaa

SEQ ID NO: 3258574 - RNA, 18 nt, Vaccinia virus
augauaacuucaggaaau

SEQ ID NO: 3258575 - RNA, 14 nt, Vaccinia virus
ucuauaaaauacua

SEQ ID NO: 3258576 - RNA, 14 nt, Vaccinia virus
cugucaauaagaca

SEQ ID NO: 3258577 - RNA, 14 nt, Vaccinia virus
cagaccucucuuaa

SEQ ID NO: 3258578 - RNA, 22 nt, Vaccinia virus
ugcuuuuaucaggauaaauaca

SEQ ID NO: 3258579 - RNA, 20 nt, Vaccinia virus
aaauaacaccguuacacgaa

SEQ ID NO: 3258580 - RNA, 18 nt, Vaccinia virus
ucaacaauaugcaaauag

SEQ ID NO: 3258581 - RNA, 22 nt, Vaccinia virus
auaacuuuuuaccucauaugaa

SEQ ID NO: 3258582 - RNA, 17 nt, Vaccinia virus
acguaucucgucuaaau

SEQ ID NO: 3258583 - RNA, 14 nt, Vaccinia virus
uccguuuacuacaa

SEQ ID NO: 3258584 - RNA, 20 nt, Vaccinia virus
ucauugacagcgguagaugu

SEQ ID NO: 3258585 - RNA, 17 nt, Vaccinia virus
acuacacuuuuuaucau

SEQ ID NO: 3258586 - RNA, 21 nt, Vaccinia virus
auauagagaucgaaaaaagag

SEQ ID NO: 3258587 - RNA, 12 nt, Vaccinia virus
auauuauacaaa

SEQ ID NO: 3258588 - RNA, 19 nt, Vaccinia virus
aucaaagauuaauacauua

SEQ ID NO: 3258589 - RNA, 14 nt, Vaccinia virus
uagacauaauacua

SEQ ID NO: 3258590 - RNA, 19 nt, Vaccinia virus
uccuuaucuucauagaaua

SEQ ID NO: 3258591 - RNA, 21 nt, Vaccinia virus
auugcauuuugauaguuuauc

SEQ ID NO: 3258592 - RNA, 22 nt, Vaccinia virus
caaagaacagaauaaacaaaau

SEQ ID NO: 3258593 - RNA, 19 nt, Vaccinia virus
ucuuggauaaaagcaucca

SEQ ID NO: 3258594 - RNA, 23 nt, Vaccinia virus
ugacgauagcuuuacucugaaaa

SEQ ID NO: 3258595 - RNA, 23 nt, Vaccinia virus
gaauaagugguuugauauuucau

SEQ ID NO: 3258596 - RNA, 21 nt, Vaccinia virus
uguauuaguuaaauauuaaaa

SEQ ID NO: 3258597 - RNA, 18 nt, Vaccinia virus
agaauuuuuauacauuau

SEQ ID NO: 3258598 - RNA, 21 nt, Vaccinia virus
auaguucguguacuagucaua

SEQ ID NO: 3258599 - RNA, 16 nt, Vaccinia virus
auagaucucucauuau

SEQ ID NO: 3258600 - RNA, 13 nt, Vaccinia virus
aaaaaaauuaaua

SEQ ID NO: 3258601 - RNA, 14 nt, Vaccinia virus
aaguuucugaaaua

SEQ ID NO: 3258602 - RNA, 18 nt, Vaccinia virus
auuaguaaaacuagcauu

SEQ ID NO: 3258603 - RNA, 17 nt, Vaccinia virus
agcacuguggaugugac

SEQ ID NO: 3258604 - RNA, 22 nt, Vaccinia virus
aguaauaaaacaaaaaaaagaa

SEQ ID NO: 3258605 - RNA, 15 nt, Vaccinia virus
auuauccaugauaga

SEQ ID NO: 3258606 - RNA, 15 nt, Vaccinia virus
accagucaagucaau

SEQ ID NO: 3258607 - RNA, 23 nt, Vaccinia virus
uauagagcccacguuuaaacauu

SEQ ID NO: 3258608 - RNA, 22 nt, Vaccinia virus
guuagaugguaaaauacaaaau

SEQ ID NO: 3258609 - RNA, 16 nt, Vaccinia virus
uuaauccauuauuuca

SEQ ID NO: 3258610 - RNA, 21 nt, Vaccinia virus
guauaauacggacuucauaau

SEQ ID NO: 3258611 - RNA, 16 nt, Vaccinia virus
auacauaauuuuguaa

SEQ ID NO: 3258612 - RNA, 17 nt, Vaccinia virus
auaauagagugugguau

SEQ ID NO: 3258613 - RNA, 15 nt, Vaccinia virus
aauauauuaagaaau

SEQ ID NO: 3258614 - RNA, 21 nt, Vaccinia virus
aaaaauguaaaauauuuuucu

SEQ ID NO: 3258615 - RNA, 16 nt, Vaccinia virus
cauacuaauagaugua

SEQ ID NO: 3258616 - RNA, 15 nt, Vaccinia virus
auaugcuacauguaa

SEQ ID NO: 3258617 - RNA, 14 nt, Vaccinia virus
ucuuuauacaauga

SEQ ID NO: 3258618 - RNA, 19 nt, Vaccinia virus
guucugauuuuaucuuuua

SEQ ID NO: 3258619 - RNA, 21 nt, Vaccinia virus
gcuauucuggugcuaauuauu

SEQ ID NO: 3258620 - RNA, 16 nt, Vaccinia virus
uaaagauauuguuaca

SEQ ID NO: 3258621 - RNA, 23 nt, Vaccinia virus
auguacgauccaaacaauguuuc

SEQ ID NO: 3258622 - RNA, 23 nt, Vaccinia virus
aauaucauaacuuaguucuuuua

SEQ ID NO: 3258623 - RNA, 20 nt, Vaccinia virus
acuaugccaagcguaugcug

SEQ ID NO: 3258624 - RNA, 15 nt, Vaccinia virus
acuuucgguuucaua

SEQ ID NO: 3258625 - RNA, 13 nt, Vaccinia virus
uuauuuuuggaau

SEQ ID NO: 3258626 - RNA, 19 nt, Vaccinia virus
auguucgugguguuaugaa

SEQ ID NO: 3258627 - RNA, 17 nt, Vaccinia virus
auacgcauguagaaugu

SEQ ID NO: 3258628 - RNA, 15 nt, Vaccinia virus
ccaaaggauguuuaa

SEQ ID NO: 3258629 - RNA, 23 nt, Vaccinia virus
uacucuaugaauggauacuugua

SEQ ID NO: 3258630 - RNA, 19 nt, Vaccinia virus
ugaaaaauuuuccacaucu

SEQ ID NO: 3258631 - RNA, 16 nt, Vaccinia virus
augcaccugaaacauc

SEQ ID NO: 3258632 - RNA, 18 nt, Vaccinia virus
uaacaauuuauuuuguau

SEQ ID NO: 3258633 - RNA, 13 nt, Vaccinia virus
cagacuguuuaug

SEQ ID NO: 3258634 - RNA, 14 nt, Vaccinia virus
aucguuuucaucuu

SEQ ID NO: 3258635 - RNA, 17 nt, Vaccinia virus
aucuguacuucuguaca

SEQ ID NO: 3258636 - RNA, 17 nt, Vaccinia virus
auauuuacauauuuacu

SEQ ID NO: 3258637 - RNA, 17 nt, Vaccinia virus
aaauuauaaaauuauau

SEQ ID NO: 3258638 - RNA, 18 nt, Vaccinia virus
uaugaccgguuuaauguu

SEQ ID NO: 3258639 - RNA, 20 nt, Vaccinia virus
aggacuuucuucaaagaaaa

SEQ ID NO: 3258640 - RNA, 13 nt, Vaccinia virus
cgaauaaauagau

SEQ ID NO: 3258641 - RNA, 21 nt, Vaccinia virus
acaccaucuucauaauaaaua

SEQ ID NO: 3258642 - RNA, 21 nt, Vaccinia virus
uaccagcauuaguaacagcuu

SEQ ID NO: 3258643 - RNA, 12 nt, Vaccinia virus
auauauguugau

SEQ ID NO: 3258644 - RNA, 21 nt, Vaccinia virus
caaucauaaaaaaaauacaug

SEQ ID NO: 3258645 - RNA, 18 nt, Vaccinia virus
auucaaggaaagaauaaa

SEQ ID NO: 3258646 - RNA, 13 nt, Vaccinia virus
auaacauucuuaa

SEQ ID NO: 3258647 - RNA, 22 nt, Vaccinia virus
cuguauccgucaaucuaauauu

SEQ ID NO: 3258648 - RNA, 19 nt, Vaccinia virus
cuuuaauaacaaagaaaga

SEQ ID NO: 3258649 - RNA, 13 nt, Vaccinia virus
aaagagacuacaa

SEQ ID NO: 3258650 - RNA, 19 nt, Vaccinia virus
aguaaucauauaaauguuu

SEQ ID NO: 3258651 - RNA, 22 nt, Vaccinia virus
gaaaauaaauccaaaauaacua

SEQ ID NO: 3258652 - RNA, 20 nt, Vaccinia virus
caguuaccaaagagaaaaca

SEQ ID NO: 3258653 - RNA, 16 nt, Vaccinia virus
aguaaagucaggacug

SEQ ID NO: 3258654 - RNA, 22 nt, Vaccinia virus
cgucuaaaacaauaaaugcauu

SEQ ID NO: 3258655 - RNA, 19 nt, Vaccinia virus
uuaaaucgccgaaugaaca

SEQ ID NO: 3258656 - RNA, 17 nt, Vaccinia virus
uuaauaaauguuuugau

SEQ ID NO: 3258657 - RNA, 21 nt, Vaccinia virus
auuuugauauuacuuauaaua

SEQ ID NO: 3258658 - RNA, 23 nt, Vaccinia virus
ugauuaucuucuugagacauaac

SEQ ID NO: 3258659 - RNA, 13 nt, Vaccinia virus
uauauaucuggag

SEQ ID NO: 3258660 - RNA, 20 nt, Vaccinia virus
gcuaaguauacgaucuuuua

SEQ ID NO: 3258661 - RNA, 14 nt, Vaccinia virus
aaauauauacauau

SEQ ID NO: 3258662 - RNA, 10 nt, Vaccinia virus
cuaaauuaau

SEQ ID NO: 3258663 - RNA, 13 nt, Vaccinia virus
auuuguuaaaaga

SEQ ID NO: 3258664 - RNA, 14 nt, Vaccinia virus
augacuuaugaaua

SEQ ID NO: 3258665 - RNA, 23 nt, Vaccinia virus
uugauaauaucuauauaugaucu

SEQ ID NO: 3258666 - RNA, 18 nt, Vaccinia virus
caacaaaauucagauucu

SEQ ID NO: 3258667 - RNA, 16 nt, Vaccinia virus
uguuauuguauacugu

SEQ ID NO: 3258668 - RNA, 15 nt, Vaccinia virus
uagaugagaacagaa

SEQ ID NO: 3258669 - RNA, 13 nt, Vaccinia virus
uaugauucaaugu

SEQ ID NO: 3258670 - RNA, 14 nt, Vaccinia virus
ugcucuuucggugg

SEQ ID NO: 3258671 - RNA, 19 nt, Vaccinia virus
cauaacuugagagcaucca

SEQ ID NO: 3258672 - RNA, 15 nt, Vaccinia virus
uauaaagacaaacaa

SEQ ID NO: 3258673 - RNA, 20 nt, Vaccinia virus
acaucggcugccaaaguuau

SEQ ID NO: 3258674 - RNA, 23 nt, Vaccinia virus
cacaugauccauuuauaguuaua

SEQ ID NO: 3258675 - RNA, 16 nt, Vaccinia virus
auuauaagauuaaaug

SEQ ID NO: 3258676 - RNA, 20 nt, Vaccinia virus
auuguuuugaagaaaugaua

SEQ ID NO: 3258677 - RNA, 14 nt, Vaccinia virus
aaugaucauccaga

SEQ ID NO: 3258678 - RNA, 16 nt, Vaccinia virus
ucuuccauuuaaauau

SEQ ID NO: 3258679 - RNA, 13 nt, Vaccinia virus
uaaauaucauaau

SEQ ID NO: 3258680 - RNA, 15 nt, Vaccinia virus
ccaaaaauauccaua

SEQ ID NO: 3258681 - RNA, 17 nt, Vaccinia virus
accggcaagaaagugaa

SEQ ID NO: 3258682 - RNA, 22 nt, Vaccinia virus
augcgccggcagucacaucugu

SEQ ID NO: 3258683 - RNA, 19 nt, Vaccinia virus
cugauagcaauucauguac

SEQ ID NO: 3258684 - RNA, 21 nt, Vaccinia virus
agauauuuggcuaaacuauau

SEQ ID NO: 3258685 - RNA, 20 nt, Vaccinia virus
cuaucguuacuaguaaaaug

SEQ ID NO: 3258686 - RNA, 17 nt, Vaccinia virus
acauccgccuuaaaugu

SEQ ID NO: 3258687 - RNA, 15 nt, Vaccinia virus
acaggcuauuuacaa

SEQ ID NO: 3258688 - RNA, 18 nt, Vaccinia virus
acuauaaaauaaaaugag

SEQ ID NO: 3258689 - RNA, 14 nt, Vaccinia virus
uacuagaguacuua

SEQ ID NO: 3258690 - RNA, 13 nt, Vaccinia virus
aaucuguauuuca

SEQ ID NO: 3258691 - RNA, 17 nt, Vaccinia virus
uagauauccuuuuucau

SEQ ID NO: 3258692 - RNA, 17 nt, Vaccinia virus
aaacaauacagugauug

SEQ ID NO: 3258693 - RNA, 19 nt, Vaccinia virus
gauugcauagugaauauau

SEQ ID NO: 3258694 - RNA, 17 nt, Vaccinia virus
gauuauuagaucuuuuc

SEQ ID NO: 3258695 - RNA, 17 nt, Vaccinia virus
augaauuagagaauuac

SEQ ID NO: 3258696 - RNA, 23 nt, Vaccinia virus
aggauauuagcgaauauaucaaa

SEQ ID NO: 3258697 - RNA, 20 nt, Vaccinia virus
aggcaauagcgacauaaaca

SEQ ID NO: 3258698 - RNA, 23 nt, Vaccinia virus
caauuucauacgcuccucuuuug

SEQ ID NO: 3258699 - RNA, 14 nt, Vaccinia virus
guuagucauauuac

SEQ ID NO: 3258700 - RNA, 21 nt, Vaccinia virus
uguuuaccagcuccaugacuu

SEQ ID NO: 3258701 - RNA, 13 nt, Vaccinia virus
uugaaaauuauuu

SEQ ID NO: 3258702 - RNA, 13 nt, Vaccinia virus
guauauacauaga

SEQ ID NO: 3258703 - RNA, 12 nt, Vaccinia virus
aucuggaaaauc

SEQ ID NO: 3258704 - RNA, 13 nt, Vaccinia virus
auauuauuacaca

SEQ ID NO: 3258705 - RNA, 17 nt, Vaccinia virus
ggagacauccauugaua

SEQ ID NO: 3258706 - RNA, 17 nt, Vaccinia virus
uaaauguagacaaauau

SEQ ID NO: 3258707 - RNA, 24 nt, Vaccinia virus
cgcguuuugacgacguguacaaaa

SEQ ID NO: 3258708 - RNA, 16 nt, Vaccinia virus
uuguucauuggaugag

SEQ ID NO: 3258709 - RNA, 14 nt, Vaccinia virus
aauaucuaauggau

SEQ ID NO: 3258710 - RNA, 17 nt, Vaccinia virus
aagaaguuccaugaugu

SEQ ID NO: 3258711 - RNA, 17 nt, Vaccinia virus
ucauuacagaaacugua

SEQ ID NO: 3258712 - RNA, 21 nt, Vaccinia virus
aauaccauaaauauauuucua

SEQ ID NO: 3258713 - RNA, 13 nt, Vaccinia virus
guaauuaaugaaa

SEQ ID NO: 3258714 - RNA, 13 nt, Vaccinia virus
aauccaaauauga

SEQ ID NO: 3258715 - RNA, 19 nt, Vaccinia virus
gauaccuuuguuauuuauu

SEQ ID NO: 3258716 - RNA, 14 nt, Vaccinia virus
acuuguauaauaag

SEQ ID NO: 3258717 - RNA, 20 nt, Vaccinia virus
uuagacaagcggguaaauga

SEQ ID NO: 3258718 - RNA, 23 nt, Vaccinia virus
cugguuuucuauaaauaaaagac

SEQ ID NO: 3258719 - RNA, 15 nt, Vaccinia virus
acaagaucuuuguuu

SEQ ID NO: 3258720 - RNA, 15 nt, Vaccinia virus
uaauagauuaaugau

SEQ ID NO: 3258721 - RNA, 14 nt, Vaccinia virus
auaagauuaucaaa

SEQ ID NO: 3258722 - RNA, 19 nt, Vaccinia virus
agaagauggagagucacua

SEQ ID NO: 3258723 - RNA, 14 nt, Vaccinia virus
uaaaugacaaguau

SEQ ID NO: 3258724 - RNA, 12 nt, Vaccinia virus
uuaaaaugugua

SEQ ID NO: 3258725 - RNA, 14 nt, Vaccinia virus
uguacuucuguaca

SEQ ID NO: 3258726 - RNA, 13 nt, Vaccinia virus
aaugauaacuaga

SEQ ID NO: 3258727 - RNA, 13 nt, Vaccinia virus
uucaucauauuca

SEQ ID NO: 3258728 - RNA, 17 nt, Vaccinia virus
acucauaaauaaaaaug

SEQ ID NO: 3258729 - RNA, 18 nt, Vaccinia virus
uccacugucacuggaaag

SEQ ID NO: 3258730 - RNA, 19 nt, Vaccinia virus
auguaacccuuuuuaucga

SEQ ID NO: 3258731 - RNA, 19 nt, Vaccinia virus
uaccauuaaagaauucuua

SEQ ID NO: 3258732 - RNA, 19 nt, Vaccinia virus
uuauuucagaaauuauucg

SEQ ID NO: 3258733 - RNA, 18 nt, Vaccinia virus
aucggaugauauuaaugu

SEQ ID NO: 3258734 - RNA, 23 nt, Vaccinia virus
agggauaggaguaggaaugccac

SEQ ID NO: 3258735 - RNA, 16 nt, Vaccinia virus
aauuucagaagaaaac

SEQ ID NO: 3258736 - RNA, 22 nt, Vaccinia virus
agaugaaaaauuuuccacaucu

SEQ ID NO: 3258737 - RNA, 18 nt, Vaccinia virus
auuugccauauauggaua

SEQ ID NO: 3258738 - RNA, 15 nt, Vaccinia virus
uuucccauacuaauu

SEQ ID NO: 3258739 - RNA, 13 nt, Vaccinia virus
agaaucaaaggau

SEQ ID NO: 3258740 - RNA, 15 nt, Vaccinia virus
aaaacaauacaguga

SEQ ID NO: 3258741 - RNA, 21 nt, Vaccinia virus
uaaugauugcccauagaguau

SEQ ID NO: 3258742 - RNA, 20 nt, Vaccinia virus
aauuucuagaacaucaucuc

SEQ ID NO: 3258743 - RNA, 23 nt, Vaccinia virus
ccaucugguucaggaaagacagc

SEQ ID NO: 3258744 - RNA, 18 nt, Vaccinia virus
cuauaucaucuacauaau

SEQ ID NO: 3258745 - RNA, 17 nt, Vaccinia virus
aauuuauuucagaaauu

SEQ ID NO: 3258746 - RNA, 12 nt, Vaccinia virus
uugguuguauug

SEQ ID NO: 3258747 - RNA, 22 nt, Vaccinia virus
ucuuacauauuuuuuucuuauu

SEQ ID NO: 3258748 - RNA, 14 nt, Vaccinia virus
uuuaaaaaguuauc

SEQ ID NO: 3258749 - RNA, 11 nt, Vaccinia virus
cucuagauaug

SEQ ID NO: 3258750 - RNA, 13 nt, Vaccinia virus
cucaaauagcacc

SEQ ID NO: 3258751 - RNA, 19 nt, Vaccinia virus
agauacgugauuaauacau

SEQ ID NO: 3258752 - RNA, 21 nt, Vaccinia virus
cuuauaaaacuauauuuggaa

SEQ ID NO: 3258753 - RNA, 23 nt, Vaccinia virus
gacuuaugucacgaugauggaau

SEQ ID NO: 3258754 - RNA, 22 nt, Vaccinia virus
auuaacuuccacauuaauacag

SEQ ID NO: 3258755 - RNA, 18 nt, Vaccinia virus
ucauuauaacucuagaau

SEQ ID NO: 3258756 - RNA, 13 nt, Vaccinia virus
uuacuuuuggaau

SEQ ID NO: 3258757 - RNA, 13 nt, Vaccinia virus
caaagauauggaa

SEQ ID NO: 3258758 - RNA, 12 nt, Vaccinia virus
gauaauuuccau

SEQ ID NO: 3258759 - RNA, 22 nt, Vaccinia virus
aaauaauagggauaaaguucau

SEQ ID NO: 3258760 - RNA, 18 nt, Vaccinia virus
uaucaaauugcauaccua

SEQ ID NO: 3258761 - RNA, 20 nt, Vaccinia virus
auuuuacuaaauaauggcug

SEQ ID NO: 3258762 - RNA, 17 nt, Vaccinia virus
gaaagaacugauugcag

SEQ ID NO: 3258763 - RNA, 15 nt, Vaccinia virus
aggauaaagaugucu

SEQ ID NO: 3258764 - RNA, 15 nt, Vaccinia virus
uaaaaauaaacauug

SEQ ID NO: 3258765 - RNA, 21 nt, Vaccinia virus
aguauggaagaggauuuucua

SEQ ID NO: 3258766 - RNA, 12 nt, Vaccinia virus
uaauaaauuaga

SEQ ID NO: 3258767 - RNA, 13 nt, Vaccinia virus
agagaauacgcau

SEQ ID NO: 3258768 - RNA, 22 nt, Vaccinia virus
gauuuuauuuaguguagauaug

SEQ ID NO: 3258769 - RNA, 17 nt, Vaccinia virus
gccuuauauagcacuuu

SEQ ID NO: 3258770 - RNA, 18 nt, Vaccinia virus
ggauauugcaugauagaa

SEQ ID NO: 3258771 - RNA, 20 nt, Vaccinia virus
auaauggugcuuguaucgaa

SEQ ID NO: 3258772 - RNA, 11 nt, Vaccinia virus
aguaauguuua

SEQ ID NO: 3258773 - RNA, 14 nt, Vaccinia virus
uauuguuugagaac

SEQ ID NO: 3258774 - RNA, 14 nt, Vaccinia virus
cuucuuauuuagau

SEQ ID NO: 3258775 - RNA, 14 nt, Vaccinia virus
acauggaacucaug

SEQ ID NO: 3258776 - RNA, 22 nt, Vaccinia virus
cauaauacucccacaaauacug

SEQ ID NO: 3258777 - RNA, 21 nt, Vaccinia virus
cagacaaauggucaaugauau

SEQ ID NO: 3258778 - RNA, 17 nt, Vaccinia virus
acaacauacuauuguuu

SEQ ID NO: 3258779 - RNA, 20 nt, Vaccinia virus
cauaagcuugacuacauuug

SEQ ID NO: 3258780 - RNA, 21 nt, Vaccinia virus
aaguauucuccagaugaaugg

SEQ ID NO: 3258781 - RNA, 15 nt, Vaccinia virus
gcuguugaaucuuua

SEQ ID NO: 3258782 - RNA, 18 nt, Vaccinia virus
uuccgguuugcaaaacaa

SEQ ID NO: 3258783 - RNA, 21 nt, Vaccinia virus
gcuaauuuuuguaaauaacua

SEQ ID NO: 3258784 - RNA, 23 nt, Vaccinia virus
aaaugacuaauuuuguagcauua

SEQ ID NO: 3258785 - RNA, 18 nt, Vaccinia virus
gaauauaaaaaauuuaua

SEQ ID NO: 3258786 - RNA, 16 nt, Vaccinia virus
aauauuuauuagaaca

SEQ ID NO: 3258787 - RNA, 17 nt, Vaccinia virus
auaauaauccagaaugu

SEQ ID NO: 3258788 - RNA, 16 nt, Vaccinia virus
cacaauauauguugau

SEQ ID NO: 3258789 - RNA, 15 nt, Vaccinia virus
cauaacauauuuuga

SEQ ID NO: 3258790 - RNA, 21 nt, Vaccinia virus
auuaaaugcaauaacaaagau

SEQ ID NO: 3258791 - RNA, 23 nt, Vaccinia virus
gcacuacuguuaagaaugauuac

SEQ ID NO: 3258792 - RNA, 22 nt, Vaccinia virus
aauauggacacgcggcuguaaa

SEQ ID NO: 3258793 - RNA, 22 nt, Vaccinia virus
uaucuuuaacuaagucaaugau

SEQ ID NO: 3258794 - RNA, 16 nt, Vaccinia virus
cagaaagacgaauaca

SEQ ID NO: 3258795 - RNA, 19 nt, Vaccinia virus
uacucucuauaacaaauau

SEQ ID NO: 3258796 - RNA, 15 nt, Vaccinia virus
uguuugaaaacagaa

SEQ ID NO: 3258797 - RNA, 17 nt, Vaccinia virus
ugacgucagccauagca

SEQ ID NO: 3258798 - RNA, 19 nt, Vaccinia virus
auaucggauuauuaacaua

SEQ ID NO: 3258799 - RNA, 23 nt, Vaccinia virus
uuaaagagacuacaauauauucu

SEQ ID NO: 3258800 - RNA, 18 nt, Vaccinia virus
uuggacaaaucuggaaaa

SEQ ID NO: 3258801 - RNA, 19 nt, Vaccinia virus
aaacgauuuaauuacagag

SEQ ID NO: 3258802 - RNA, 18 nt, Vaccinia virus
aaaacuugauaauuaaua

SEQ ID NO: 3258803 - RNA, 20 nt, Vaccinia virus
auuauggaaaucaacauaau

SEQ ID NO: 3258804 - RNA, 13 nt, Vaccinia virus
gauaauaauacac

SEQ ID NO: 3258805 - RNA, 21 nt, Vaccinia virus
aagauagcggaagauacgacu

SEQ ID NO: 3258806 - RNA, 18 nt, Vaccinia virus
caauacacacaauagaca

SEQ ID NO: 3258807 - RNA, 11 nt, Vaccinia virus
aaccaaacauu

SEQ ID NO: 3258808 - RNA, 22 nt, Vaccinia virus
agacacauaugguuucuaaauc

SEQ ID NO: 3258809 - RNA, 21 nt, Vaccinia virus
uacauagcaucuucacaaauu

SEQ ID NO: 3258810 - RNA, 22 nt, Vaccinia virus
acauuguuauugaucaaacauu

SEQ ID NO: 3258811 - RNA, 14 nt, Vaccinia virus
uacuaucaauauua

SEQ ID NO: 3258812 - RNA, 15 nt, Vaccinia virus
aucuucuuaaucucu

SEQ ID NO: 3258813 - RNA, 15 nt, Vaccinia virus
uauuuuuuuuaucua

SEQ ID NO: 3258814 - RNA, 18 nt, Vaccinia virus
auaucugagcuaucuaga

SEQ ID NO: 3258815 - RNA, 12 nt, Vaccinia virus
uaagcauugucu

SEQ ID NO: 3258816 - RNA, 20 nt, Vaccinia virus
uaugaccggcaaucaugaau

SEQ ID NO: 3258817 - RNA, 18 nt, Vaccinia virus
aagaauguauauacaugu

SEQ ID NO: 3258818 - RNA, 20 nt, Vaccinia virus
guuuuagagacuuugaagcu

SEQ ID NO: 3258819 - RNA, 15 nt, Vaccinia virus
cuauaaacaugaauu

SEQ ID NO: 3258820 - RNA, 17 nt, Vaccinia virus
auacugguuaaaauccu

SEQ ID NO: 3258821 - RNA, 18 nt, Vaccinia virus
guucucuuugauaaaagu

SEQ ID NO: 3258822 - RNA, 21 nt, Vaccinia virus
auaugaaaaacaugucucucu

SEQ ID NO: 3258823 - RNA, 17 nt, Vaccinia virus
aauuuacaaaacuggua

SEQ ID NO: 3258824 - RNA, 20 nt, Vaccinia virus
aaauuaucuaucuacaucau

SEQ ID NO: 3258825 - RNA, 18 nt, Vaccinia virus
gcauuuuuugguuucuuu

SEQ ID NO: 3258826 - RNA, 14 nt, Vaccinia virus
aauauauacaguag

SEQ ID NO: 3258827 - RNA, 21 nt, Vaccinia virus
gauuaaguauuguuuuuucau

SEQ ID NO: 3258828 - RNA, 16 nt, Vaccinia virus
ucucauaauaaauuuu

SEQ ID NO: 3258829 - RNA, 21 nt, Vaccinia virus
aaugauuuagaaaugaaguua

SEQ ID NO: 3258830 - RNA, 19 nt, Vaccinia virus
aucauuuuugcaucauuua

SEQ ID NO: 3258831 - RNA, 23 nt, Vaccinia virus
caaguuaucgucuguauuaaugu

SEQ ID NO: 3258832 - RNA, 21 nt, Vaccinia virus
uuauuaaauccuuguuugaua

SEQ ID NO: 3258833 - RNA, 12 nt, Vaccinia virus
cuagauccucau

SEQ ID NO: 3258834 - RNA, 21 nt, Vaccinia virus
uuuaacuucauccguuuccuu

SEQ ID NO: 3258835 - RNA, 21 nt, Vaccinia virus
auauuaacgaguuccauuuau

SEQ ID NO: 3258836 - RNA, 14 nt, Vaccinia virus
aguagaaaauaaua

SEQ ID NO: 3258837 - RNA, 17 nt, Vaccinia virus
agaaauucuuguucaau

SEQ ID NO: 3258838 - RNA, 17 nt, Vaccinia virus
aaaauauaguagaauuu

SEQ ID NO: 3258839 - RNA, 20 nt, Vaccinia virus
ucgucaacaaguuggaugau

SEQ ID NO: 3258840 - RNA, 19 nt, Vaccinia virus
ucuugaagccauacauucg

SEQ ID NO: 3258841 - RNA, 13 nt, Vaccinia virus
uauuaaucuuuuu

SEQ ID NO: 3258842 - RNA, 13 nt, Vaccinia virus
auuaaaucaauau

SEQ ID NO: 3258843 - RNA, 15 nt, Vaccinia virus
auguguuaaaaagaa

SEQ ID NO: 3258844 - RNA, 19 nt, Vaccinia virus
acaacauggagcuaaucua

SEQ ID NO: 3258845 - RNA, 18 nt, Vaccinia virus
aauauaguaauaagauuu

SEQ ID NO: 3258846 - RNA, 21 nt, Vaccinia virus
cuauuuagaucauuaacucua

SEQ ID NO: 3258847 - RNA, 19 nt, Vaccinia virus
gccgguugccgcaaauaga

SEQ ID NO: 3258848 - RNA, 14 nt, Vaccinia virus
aagauauaaaugac

SEQ ID NO: 3258849 - RNA, 13 nt, Vaccinia virus
auauaaugauaua

SEQ ID NO: 3258850 - RNA, 13 nt, Vaccinia virus
uauuaauguauua

SEQ ID NO: 3258851 - RNA, 15 nt, Vaccinia virus
uguauguuugggaga

SEQ ID NO: 3258852 - RNA, 23 nt, Vaccinia virus
gauacuccguauccuauuccaca

SEQ ID NO: 3258853 - RNA, 13 nt, Vaccinia virus
cgugaaauaaagu

SEQ ID NO: 3258854 - RNA, 18 nt, Vaccinia virus
uagaaugcucuuaaauaa

SEQ ID NO: 3258855 - RNA, 18 nt, Vaccinia virus
uuauaucuauuuuauuca

SEQ ID NO: 3258856 - RNA, 17 nt, Vaccinia virus
aacaauuucuauuuccu

SEQ ID NO: 3258857 - RNA, 14 nt, Vaccinia virus
aucuauuuuaaaua

SEQ ID NO: 3258858 - RNA, 15 nt, Vaccinia virus
ucauaauaucuuuaa

SEQ ID NO: 3258859 - RNA, 20 nt, Vaccinia virus
gaauuggaacuaguauuuau

SEQ ID NO: 3258860 - RNA, 17 nt, Vaccinia virus
acgagaagccauuuuau

SEQ ID NO: 3258861 - RNA, 18 nt, Vaccinia virus
gaauaauguuucuauguu

SEQ ID NO: 3258862 - RNA, 12 nt, Vaccinia virus
uaauucauuaau

SEQ ID NO: 3258863 - RNA, 21 nt, Vaccinia virus
uuauacggcuacaauuucaua

SEQ ID NO: 3258864 - RNA, 17 nt, Vaccinia virus
auaucaacaucugaugc

SEQ ID NO: 3258865 - RNA, 13 nt, Vaccinia virus
aauucaucaucug

SEQ ID NO: 3258866 - RNA, 16 nt, Vaccinia virus
uauaacuucuaaucuu

SEQ ID NO: 3258867 - RNA, 17 nt, Vaccinia virus
accaaaaaaucguauau

SEQ ID NO: 3258868 - RNA, 22 nt, Vaccinia virus
aauacucuauaaggucagaaaa

SEQ ID NO: 3258869 - RNA, 21 nt, Vaccinia virus
uaccucucggcgaaauaguua

SEQ ID NO: 3258870 - RNA, 16 nt, Vaccinia virus
aucacuacaauaauua

SEQ ID NO: 3258871 - RNA, 19 nt, Vaccinia virus
gucacauacacuagugaua

SEQ ID NO: 3258872 - RNA, 14 nt, Vaccinia virus
uuaauaauaauuca

SEQ ID NO: 3258873 - RNA, 14 nt, Vaccinia virus
caaagagaaaacaa

SEQ ID NO: 3258874 - RNA, 13 nt, Vaccinia virus
acucauaaaauac

SEQ ID NO: 3258875 - RNA, 21 nt, Vaccinia virus
aaucugauaaauauacaauag

SEQ ID NO: 3258876 - RNA, 14 nt, Vaccinia virus
aauaaaaauguuuu

SEQ ID NO: 3258877 - RNA, 16 nt, Vaccinia virus
cauuaauagaaugaag

SEQ ID NO: 3258878 - RNA, 18 nt, Vaccinia virus
aacaugucucuaaaugug

SEQ ID NO: 3258879 - RNA, 22 nt, Vaccinia virus
uuaaagauggaguauaaucuuu

SEQ ID NO: 3258880 - RNA, 16 nt, Vaccinia virus
uaagaaaaauagagag

SEQ ID NO: 3258881 - RNA, 20 nt, Vaccinia virus
uucuagaacuauaaaaacag

SEQ ID NO: 3258882 - RNA, 18 nt, Vaccinia virus
uuguaucaugacauucaa

SEQ ID NO: 3258883 - RNA, 16 nt, Vaccinia virus
cucaaccauagauaua

SEQ ID NO: 3258884 - RNA, 15 nt, Vaccinia virus
ucucaauaguuucau

SEQ ID NO: 3258885 - RNA, 20 nt, Vaccinia virus
uguaaaaacaaauuuguaca

SEQ ID NO: 3258886 - RNA, 13 nt, Vaccinia virus
auuaauaauaauu

SEQ ID NO: 3258887 - RNA, 13 nt, Vaccinia virus
aauacuaaauuga

SEQ ID NO: 3258888 - RNA, 15 nt, Vaccinia virus
acaaaaauacauaaa

SEQ ID NO: 3258889 - RNA, 17 nt, Vaccinia virus
auuggaacuaguauuua

SEQ ID NO: 3258890 - RNA, 16 nt, Vaccinia virus
accaacgguauaugaa

SEQ ID NO: 3258891 - RNA, 14 nt, Vaccinia virus
agauguaaauauau

SEQ ID NO: 3258892 - RNA, 19 nt, Vaccinia virus
cuauaaaacgauuaaacaa

SEQ ID NO: 3258893 - RNA, 23 nt, Vaccinia virus
cacaaauaguaaaugagagaucu

SEQ ID NO: 3258894 - RNA, 18 nt, Vaccinia virus
aaguuuucccauacuaau

SEQ ID NO: 3258895 - RNA, 17 nt, Vaccinia virus
guucugggaauagaaac

SEQ ID NO: 3258896 - RNA, 14 nt, Vaccinia virus
guuuauagauguuc

SEQ ID NO: 3258897 - RNA, 19 nt, Vaccinia virus
agaacgguagaaacuauac

SEQ ID NO: 3258898 - RNA, 23 nt, Vaccinia virus
cauuaguuaaugaaaauaacucu

SEQ ID NO: 3258899 - RNA, 14 nt, Vaccinia virus
cauauagauuacaa

SEQ ID NO: 3258900 - RNA, 17 nt, Vaccinia virus
aauauucagaguccucu

SEQ ID NO: 3258901 - RNA, 17 nt, Vaccinia virus
guuagugaugaauaucu

SEQ ID NO: 3258902 - RNA, 17 nt, Vaccinia virus
auaaaauguuaauacau

SEQ ID NO: 3258903 - RNA, 12 nt, Vaccinia virus
aaggcagaaaug

SEQ ID NO: 3258904 - RNA, 13 nt, Vaccinia virus
auaucuuaaauaa

SEQ ID NO: 3258905 - RNA, 13 nt, Vaccinia virus
aguuacuuaaaug

SEQ ID NO: 3258906 - RNA, 21 nt, Vaccinia virus
uuaaacaaauaaguauuauca

SEQ ID NO: 3258907 - RNA, 14 nt, Vaccinia virus
uaauaauuauauca

SEQ ID NO: 3258908 - RNA, 16 nt, Vaccinia virus
uucgauagauauucuu

SEQ ID NO: 3258909 - RNA, 23 nt, Vaccinia virus
acuucauccguuuccuuaugaag

SEQ ID NO: 3258910 - RNA, 18 nt, Vaccinia virus
auaacucguuuuucuuaa

SEQ ID NO: 3258911 - RNA, 22 nt, Vaccinia virus
aacuccuccuaggauauuugua

SEQ ID NO: 3258912 - RNA, 20 nt, Vaccinia virus
guuugaaaaucgucuuuuau

SEQ ID NO: 3258913 - RNA, 13 nt, Vaccinia virus
aucgaaaucuuaa

SEQ ID NO: 3258914 - RNA, 14 nt, Vaccinia virus
agacuugugggaaa

SEQ ID NO: 3258915 - RNA, 21 nt, Vaccinia virus
ccugguagacggaauguuuua

SEQ ID NO: 3258916 - RNA, 13 nt, Vaccinia virus
agaauaugucucu

SEQ ID NO: 3258917 - RNA, 21 nt, Vaccinia virus
auuuuacuacauaguuaucua

SEQ ID NO: 3258918 - RNA, 17 nt, Vaccinia virus
auacuaucuauaaacau

SEQ ID NO: 3258919 - RNA, 23 nt, Vaccinia virus
aagacaacgaauacaaacgccau

SEQ ID NO: 3258920 - RNA, 15 nt, Vaccinia virus
aacaucuaacuauau

SEQ ID NO: 3258921 - RNA, 22 nt, Vaccinia virus
uuuuugugggaagcgauucaaa

SEQ ID NO: 3258922 - RNA, 23 nt, Vaccinia virus
uauuaauaacaguuauauaucua

SEQ ID NO: 3258923 - RNA, 19 nt, Vaccinia virus
auauugguacgugucuaua

SEQ ID NO: 3258924 - RNA, 16 nt, Vaccinia virus
uguaucagacgauaau

SEQ ID NO: 3258925 - RNA, 15 nt, Vaccinia virus
ugaauaucuacaaau

SEQ ID NO: 3258926 - RNA, 17 nt, Vaccinia virus
auuggucagaaauauug

SEQ ID NO: 3258927 - RNA, 12 nt, Vaccinia virus
ccaguauaacac

SEQ ID NO: 3258928 - RNA, 13 nt, Vaccinia virus
agucaauaucuuu

SEQ ID NO: 3258929 - RNA, 23 nt, Vaccinia virus
aacagacuauuuaucagaacacu

SEQ ID NO: 3258930 - RNA, 19 nt, Vaccinia virus
acuauaucgacauauuuca

SEQ ID NO: 3258931 - RNA, 21 nt, Vaccinia virus
caauuguauuauugauacaau

SEQ ID NO: 3258932 - RNA, 14 nt, Vaccinia virus
uaauuauauuuaca

SEQ ID NO: 3258933 - RNA, 15 nt, Vaccinia virus
acaaacgaagaaaga

SEQ ID NO: 3258934 - RNA, 19 nt, Vaccinia virus
aaaugucacuauuaaagau

SEQ ID NO: 3258935 - RNA, 14 nt, Vaccinia virus
cgcagaaaauaucu

SEQ ID NO: 3258936 - RNA, 16 nt, Vaccinia virus
uguaaaagcauauguu

SEQ ID NO: 3258937 - RNA, 17 nt, Vaccinia virus
augaucaagaaggaaau

SEQ ID NO: 3258938 - RNA, 21 nt, Vaccinia virus
cuaucaaccgcauaauacaau

SEQ ID NO: 3258939 - RNA, 13 nt, Vaccinia virus
caaaaauaaugac

SEQ ID NO: 3258940 - RNA, 14 nt, Vaccinia virus
cacguuuaaacauu

SEQ ID NO: 3258941 - RNA, 10 nt, Vaccinia virus
aaaagucaac

SEQ ID NO: 3258942 - RNA, 13 nt, Vaccinia virus
aauccugaauaua

SEQ ID NO: 3258943 - RNA, 18 nt, Vaccinia virus
uuuacuuucgguuucaua

SEQ ID NO: 3258944 - RNA, 15 nt, Vaccinia virus
caugauuaguauuuu

SEQ ID NO: 3258945 - RNA, 14 nt, Vaccinia virus
ugaacuauuucuug

SEQ ID NO: 3258946 - RNA, 18 nt, Vaccinia virus
cagauuuugauauucuau

SEQ ID NO: 3258947 - RNA, 16 nt, Vaccinia virus
cuauuggcaauuguag

SEQ ID NO: 3258948 - RNA, 17 nt, Vaccinia virus
gcaauagcugauuauuu

SEQ ID NO: 3258949 - RNA, 22 nt, Vaccinia virus
auugcuguuaguauaauuauug

SEQ ID NO: 3258950 - RNA, 15 nt, Vaccinia virus
aucuagguugccaaa

SEQ ID NO: 3258951 - RNA, 13 nt, Vaccinia virus
aaacacauaucca

SEQ ID NO: 3258952 - RNA, 19 nt, Vaccinia virus
uuaaucuuggaaauuauuu

SEQ ID NO: 3258953 - RNA, 18 nt, Vaccinia virus
aacguacaaauggauaaa

SEQ ID NO: 3258954 - RNA, 17 nt, Vaccinia virus
aguaauuuguucaaaau

SEQ ID NO: 3258955 - RNA, 17 nt, Vaccinia virus
uaucuaacaaauuuccu

SEQ ID NO: 3258956 - RNA, 16 nt, Vaccinia virus
aacaauguauacaaau

SEQ ID NO: 3258957 - RNA, 19 nt, Vaccinia virus
uagaggaucuauuagaugu

SEQ ID NO: 3258958 - RNA, 18 nt, Vaccinia virus
gaauaaucguuauuauca

SEQ ID NO: 3258959 - RNA, 16 nt, Vaccinia virus
uauccauuuagcaaaa

SEQ ID NO: 3258960 - RNA, 17 nt, Vaccinia virus
uuagaagagucauuaaa

SEQ ID NO: 3258961 - RNA, 19 nt, Vaccinia virus
ucaauucguucgaugagua

SEQ ID NO: 3258962 - RNA, 19 nt, Vaccinia virus
aagguuagcgcucagaaua

SEQ ID NO: 3258963 - RNA, 20 nt, Vaccinia virus
aucagcauccacucauauag

SEQ ID NO: 3258964 - RNA, 23 nt, Vaccinia virus
uaaacauauagggaaucauauau

SEQ ID NO: 3258965 - RNA, 16 nt, Vaccinia virus
uauauccucggaugau

SEQ ID NO: 3258966 - RNA, 15 nt, Vaccinia virus
ugauauuacuuauaa

SEQ ID NO: 3258967 - RNA, 15 nt, Vaccinia virus
aauaguuuauaacau

SEQ ID NO: 3258968 - RNA, 13 nt, Vaccinia virus
acgauuacuacau

SEQ ID NO: 3258969 - RNA, 20 nt, Vaccinia virus
ugauauguguaagaacucuc

SEQ ID NO: 3258970 - RNA, 18 nt, Vaccinia virus
agcgacggggaugaugaa

SEQ ID NO: 3258971 - RNA, 14 nt, Vaccinia virus
aucuugugcauuuu

SEQ ID NO: 3258972 - RNA, 22 nt, Vaccinia virus
uuccaugggacuauauaauuuu

SEQ ID NO: 3258973 - RNA, 17 nt, Vaccinia virus
gacgcauuuaauagaga

SEQ ID NO: 3258974 - RNA, 15 nt, Vaccinia virus
augaaucuaaaagaa

SEQ ID NO: 3258975 - RNA, 19 nt, Vaccinia virus
uagaacugcuaauggaugu

SEQ ID NO: 3258976 - RNA, 19 nt, Vaccinia virus
gauaucuuuacuaagaaag

SEQ ID NO: 3258977 - RNA, 23 nt, Vaccinia virus
ccaauaugucuguacaaauguua

SEQ ID NO: 3258978 - RNA, 21 nt, Vaccinia virus
auguguuuacaguaguaauga

SEQ ID NO: 3258979 - RNA, 15 nt, Vaccinia virus
acaaguuuucauauu

SEQ ID NO: 3258980 - RNA, 23 nt, Vaccinia virus
gaccgauuaucgaguuuaaauca

SEQ ID NO: 3258981 - RNA, 13 nt, Vaccinia virus
uauucuacuauca

SEQ ID NO: 3258982 - RNA, 18 nt, Vaccinia virus
auacuuuaaagcaaaaug

SEQ ID NO: 3258983 - RNA, 16 nt, Vaccinia virus
ggaaacuuucuagaac

SEQ ID NO: 3258984 - RNA, 23 nt, Vaccinia virus
uaguauuuaacaagagaagagau

SEQ ID NO: 3258985 - RNA, 16 nt, Vaccinia virus
auauugucacaugucu

SEQ ID NO: 3258986 - RNA, 21 nt, Vaccinia virus
aauacacuuacagaaaagaua

SEQ ID NO: 3258987 - RNA, 15 nt, Vaccinia virus
ggccguuuguuuccu

SEQ ID NO: 3258988 - RNA, 15 nt, Vaccinia virus
aucuaaugaaugaag

SEQ ID NO: 3258989 - RNA, 19 nt, Vaccinia virus
uuuaaacaaaaaaguuauc

SEQ ID NO: 3258990 - RNA, 13 nt, Vaccinia virus
ucuucaaauuccg

SEQ ID NO: 3258991 - RNA, 18 nt, Vaccinia virus
agcuaauccugauauuaa

SEQ ID NO: 3258992 - RNA, 15 nt, Vaccinia virus
caacaaauauaaaau

SEQ ID NO: 3258993 - RNA, 15 nt, Vaccinia virus
cauaggauacucuau

SEQ ID NO: 3258994 - RNA, 22 nt, Vaccinia virus
aauuaaaauaacaccauuuagu

SEQ ID NO: 3258995 - RNA, 14 nt, Vaccinia virus
ucauguagauaguu

SEQ ID NO: 3258996 - RNA, 13 nt, Vaccinia virus
agacauaauacua

SEQ ID NO: 3258997 - RNA, 22 nt, Vaccinia virus
gauucacguuauauaacuauca

SEQ ID NO: 3258998 - RNA, 17 nt, Vaccinia virus
ucuacuguuccuaauau

SEQ ID NO: 3258999 - RNA, 18 nt, Vaccinia virus
gacuuguuaguuaaaaug

SEQ ID NO: 3259000 - RNA, 18 nt, Vaccinia virus
ucauucgcggaacuacau

SEQ ID NO: 3259001 - RNA, 19 nt, Vaccinia virus
guuccuguagauaauaacu

SEQ ID NO: 3259002 - RNA, 15 nt, Vaccinia virus
cuuaaugucuguauc

SEQ ID NO: 3259003 - RNA, 17 nt, Vaccinia virus
cuuaaaaacuauaccau

SEQ ID NO: 3259004 - RNA, 23 nt, Vaccinia virus
uauucggagcgcgcaauuuuuaa

SEQ ID NO: 3259005 - RNA, 14 nt, Vaccinia virus
aucuacacaaauag

SEQ ID NO: 3259006 - RNA, 22 nt, Vaccinia virus
uagcaucuuuccaaucaauaau

SEQ ID NO: 3259007 - RNA, 16 nt, Vaccinia virus
agcucuuaguauggga

SEQ ID NO: 3259008 - RNA, 23 nt, Vaccinia virus
caacaaguguguagauaucuuua

SEQ ID NO: 3259009 - RNA, 16 nt, Vaccinia virus
uacccaaaucugaaaa

SEQ ID NO: 3259010 - RNA, 22 nt, Vaccinia virus
aucaagacguggcaaacaaugu

SEQ ID NO: 3259011 - RNA, 21 nt, Vaccinia virus
uuuccggagauagauuuccaa

SEQ ID NO: 3259012 - RNA, 21 nt, Vaccinia virus
aaaccaacgaggaggaauauc

SEQ ID NO: 3259013 - RNA, 19 nt, Vaccinia virus
caugauucacguuauauaa

SEQ ID NO: 3259014 - RNA, 13 nt, Vaccinia virus
acaaauucuauau

SEQ ID NO: 3259015 - RNA, 12 nt, Vaccinia virus
ucucuuaguguu

SEQ ID NO: 3259016 - RNA, 17 nt, Vaccinia virus
guacuccucccauaaua

SEQ ID NO: 3259017 - RNA, 17 nt, Vaccinia virus
cugacugaauacauccu

SEQ ID NO: 3259018 - RNA, 15 nt, Vaccinia virus
ucaauagacauccaa

SEQ ID NO: 3259019 - RNA, 14 nt, Vaccinia virus
aauggaugucauga

SEQ ID NO: 3259020 - RNA, 14 nt, Vaccinia virus
ugauaaauauacaa

SEQ ID NO: 3259021 - RNA, 13 nt, Vaccinia virus
aucuccucuauuu

SEQ ID NO: 3259022 - RNA, 17 nt, Vaccinia virus
aaaugauagaaauauau

SEQ ID NO: 3259023 - RNA, 17 nt, Vaccinia virus
auacucuauugagaaaa

SEQ ID NO: 3259024 - RNA, 17 nt, Vaccinia virus
uuucaauuuauuguaaa

SEQ ID NO: 3259025 - RNA, 23 nt, Vaccinia virus
auuaaaucauugacugcuagaga

SEQ ID NO: 3259026 - RNA, 12 nt, Vaccinia virus
ucauuagaauau

SEQ ID NO: 3259027 - RNA, 22 nt, Vaccinia virus
aaucguacucauuauuggaaaa

SEQ ID NO: 3259028 - RNA, 15 nt, Vaccinia virus
caacauauacacauu

SEQ ID NO: 3259029 - RNA, 18 nt, Vaccinia virus
cagaagaauaugaugauu

SEQ ID NO: 3259030 - RNA, 20 nt, Vaccinia virus
aaugcuaauauauucuuaca

SEQ ID NO: 3259031 - RNA, 14 nt, Vaccinia virus
ccccauauaauuuu

SEQ ID NO: 3259032 - RNA, 20 nt, Vaccinia virus
uauacagcuggagauuauca

SEQ ID NO: 3259033 - RNA, 21 nt, Vaccinia virus
ggauugguuucuaaauucaug

SEQ ID NO: 3259034 - RNA, 23 nt, Vaccinia virus
acuuuuugguaggacaaagugaa

SEQ ID NO: 3259035 - RNA, 18 nt, Vaccinia virus
cuggaagcaaaaaaucug

SEQ ID NO: 3259036 - RNA, 19 nt, Vaccinia virus
gcgcuauagaguagacauu

SEQ ID NO: 3259037 - RNA, 17 nt, Vaccinia virus
uucagucagacaauguc

SEQ ID NO: 3259038 - RNA, 20 nt, Vaccinia virus
auacaaauaugucuuuguua

SEQ ID NO: 3259039 - RNA, 15 nt, Vaccinia virus
cuauuuuuacaguac

SEQ ID NO: 3259040 - RNA, 16 nt, Vaccinia virus
agaauaucuaauggau

SEQ ID NO: 3259041 - RNA, 19 nt, Vaccinia virus
caaagauuuaaauccuaau

SEQ ID NO: 3259042 - RNA, 12 nt, Vaccinia virus
uauuaaaacuga

SEQ ID NO: 3259043 - RNA, 17 nt, Vaccinia virus
guuagaaguuuuaaaaa

SEQ ID NO: 3259044 - RNA, 12 nt, Vaccinia virus
aaacauuacaaa

SEQ ID NO: 3259045 - RNA, 17 nt, Vaccinia virus
ucuucuauuuuaucauu

SEQ ID NO: 3259046 - RNA, 23 nt, Vaccinia virus
ugcacguaaccauucuaaacaau

SEQ ID NO: 3259047 - RNA, 20 nt, Vaccinia virus
gcauguauuuuuuucugaau

SEQ ID NO: 3259048 - RNA, 14 nt, Vaccinia virus
guaaaauaaucaua

SEQ ID NO: 3259049 - RNA, 14 nt, Vaccinia virus
aaagagaauuauau

SEQ ID NO: 3259050 - RNA, 23 nt, Vaccinia virus
uuuagaaaacucucuauuucuua

SEQ ID NO: 3259051 - RNA, 18 nt, Vaccinia virus
agaacuaauguauauucu

SEQ ID NO: 3259052 - RNA, 18 nt, Vaccinia virus
aagauggaguauaaucuu

SEQ ID NO: 3259053 - RNA, 18 nt, Vaccinia virus
uaaacaagcuaucucuug

SEQ ID NO: 3259054 - RNA, 16 nt, Vaccinia virus
acguaguuauguagag

SEQ ID NO: 3259055 - RNA, 16 nt, Vaccinia virus
uuuaguugucuaguau

SEQ ID NO: 3259056 - RNA, 16 nt, Vaccinia virus
uaagaaaguuaagaau

SEQ ID NO: 3259057 - RNA, 17 nt, Vaccinia virus
aauaagugugaugauug

SEQ ID NO: 3259058 - RNA, 22 nt, Vaccinia virus
auauccaaaauuuuguaugaag

SEQ ID NO: 3259059 - RNA, 18 nt, Vaccinia virus
aaccagaaguuuuauccu

SEQ ID NO: 3259060 - RNA, 18 nt, Vaccinia virus
ucuuaugcauguuucaua

SEQ ID NO: 3259061 - RNA, 19 nt, Vaccinia virus
cucggauuugaagaaauca

SEQ ID NO: 3259062 - RNA, 19 nt, Vaccinia virus
accaacgggucaugugaca

SEQ ID NO: 3259063 - RNA, 16 nt, Vaccinia virus
gagcuauuaaacuguu

SEQ ID NO: 3259064 - RNA, 22 nt, Vaccinia virus
agaugaguccaugacuugguau

SEQ ID NO: 3259065 - RNA, 16 nt, Vaccinia virus
aauuaguuuuucuuua

SEQ ID NO: 3259066 - RNA, 17 nt, Vaccinia virus
uauaaauggaugaagca

SEQ ID NO: 3259067 - RNA, 17 nt, Vaccinia virus
agccauagcaauacuuc

SEQ ID NO: 3259068 - RNA, 15 nt, Vaccinia virus
augugauaauuauuu

SEQ ID NO: 3259069 - RNA, 22 nt, Vaccinia virus
augacaucgccuacaaaugaca

SEQ ID NO: 3259070 - RNA, 15 nt, Vaccinia virus
aaaacugcugugaau

SEQ ID NO: 3259071 - RNA, 15 nt, Vaccinia virus
uauauauuugaaaau

SEQ ID NO: 3259072 - RNA, 21 nt, Vaccinia virus
gaauauuccucuaacagauau

SEQ ID NO: 3259073 - RNA, 16 nt, Vaccinia virus
aaaucuagagguagaa

SEQ ID NO: 3259074 - RNA, 17 nt, Vaccinia virus
cagugacuguaucacac

SEQ ID NO: 3259075 - RNA, 12 nt, Vaccinia virus
augaaaaugaug

SEQ ID NO: 3259076 - RNA, 17 nt, Vaccinia virus
gcugguaaaguaaauca

SEQ ID NO: 3259077 - RNA, 15 nt, Vaccinia virus
aaguacgauguuauu

SEQ ID NO: 3259078 - RNA, 13 nt, Vaccinia virus
auuaauaauuaau

SEQ ID NO: 3259079 - RNA, 16 nt, Vaccinia virus
aauuagaaauucccaa

SEQ ID NO: 3259080 - RNA, 17 nt, Vaccinia virus
uggcauaguagaauaau

SEQ ID NO: 3259081 - RNA, 20 nt, Vaccinia virus
uuaauaagauuuuuaucauu

SEQ ID NO: 3259082 - RNA, 23 nt, Vaccinia virus
acaauauuuuucguuuacaaaau

SEQ ID NO: 3259083 - RNA, 13 nt, Vaccinia virus
auugauagauuac

SEQ ID NO: 3259084 - RNA, 17 nt, Vaccinia virus
aauaaauuuuuccaaga

SEQ ID NO: 3259085 - RNA, 15 nt, Vaccinia virus
cauguugucuauuuc

SEQ ID NO: 3259086 - RNA, 14 nt, Vaccinia virus
uacaucuugacauu

SEQ ID NO: 3259087 - RNA, 19 nt, Vaccinia virus
acuaaaggcaacaaagaaa

SEQ ID NO: 3259088 - RNA, 15 nt, Vaccinia virus
aucaauauuauucau

SEQ ID NO: 3259089 - RNA, 20 nt, Vaccinia virus
guaucuaauuuccugauuua

SEQ ID NO: 3259090 - RNA, 21 nt, Vaccinia virus
auuccuuauucacacaaaaag

SEQ ID NO: 3259091 - RNA, 15 nt, Vaccinia virus
acgaaauagcuauau

SEQ ID NO: 3259092 - RNA, 13 nt, Vaccinia virus
gcuauuacuuauu

SEQ ID NO: 3259093 - RNA, 13 nt, Vaccinia virus
auaauuucuguaa

SEQ ID NO: 3259094 - RNA, 21 nt, Vaccinia virus
ggaauuaaucuaguagaaaag

SEQ ID NO: 3259095 - RNA, 20 nt, Vaccinia virus
acgauaguuuguuucuggaa

SEQ ID NO: 3259096 - RNA, 14 nt, Vaccinia virus
auaucgauaauaga

SEQ ID NO: 3259097 - RNA, 17 nt, Vaccinia virus
aguuaaaaguuaaugag

SEQ ID NO: 3259098 - RNA, 22 nt, Vaccinia virus
auaaauagcuuuacuucuauau

SEQ ID NO: 3259099 - RNA, 20 nt, Vaccinia virus
acucuguuguuuuucuuaua

SEQ ID NO: 3259100 - RNA, 20 nt, Vaccinia virus
cguggagaucauuaaauguu

SEQ ID NO: 3259101 - RNA, 18 nt, Vaccinia virus
acaaucugucgaaaaagu

SEQ ID NO: 3259102 - RNA, 19 nt, Vaccinia virus
uucauagcugagaauaucu

SEQ ID NO: 3259103 - RNA, 15 nt, Vaccinia virus
guucuuuuagaaaau

SEQ ID NO: 3259104 - RNA, 16 nt, Vaccinia virus
uuaguucuuuuagaaa

SEQ ID NO: 3259105 - RNA, 18 nt, Vaccinia virus
auucauggaguuagaaaa

SEQ ID NO: 3259106 - RNA, 13 nt, Vaccinia virus
guauuugauuuug

SEQ ID NO: 3259107 - RNA, 20 nt, Vaccinia virus
ccaccagugguuuuauuuua

SEQ ID NO: 3259108 - RNA, 12 nt, Vaccinia virus
aaucacaaacau

SEQ ID NO: 3259109 - RNA, 20 nt, Vaccinia virus
cauacuaggagccaucauuu

SEQ ID NO: 3259110 - RNA, 17 nt, Vaccinia virus
cagaugcgccauauuua

SEQ ID NO: 3259111 - RNA, 15 nt, Vaccinia virus
uaggagaacuuauag

SEQ ID NO: 3259112 - RNA, 15 nt, Vaccinia virus
cgaaaucuuaaauac

SEQ ID NO: 3259113 - RNA, 15 nt, Vaccinia virus
cccacguuuaaacau

SEQ ID NO: 3259114 - RNA, 23 nt, Vaccinia virus
auuuucgaaacucguaaaaagau

SEQ ID NO: 3259115 - RNA, 19 nt, Vaccinia virus
guaucuaauauagauuuua

SEQ ID NO: 3259116 - RNA, 18 nt, Vaccinia virus
uaauaaucuugauuguac

SEQ ID NO: 3259117 - RNA, 16 nt, Vaccinia virus
aaacuauuuaguuaug

SEQ ID NO: 3259118 - RNA, 19 nt, Vaccinia virus
aggaugaguacauuucaca

SEQ ID NO: 3259119 - RNA, 14 nt, Vaccinia virus
guuuguuuuggaaa

SEQ ID NO: 3259120 - RNA, 19 nt, Vaccinia virus
cuuauaauuaauguccaag

SEQ ID NO: 3259121 - RNA, 19 nt, Vaccinia virus
ucgcaacauuaacaucuug

SEQ ID NO: 3259122 - RNA, 18 nt, Vaccinia virus
uaugacucugauuucuug

SEQ ID NO: 3259123 - RNA, 14 nt, Vaccinia virus
aucucuuuagaaug

SEQ ID NO: 3259124 - RNA, 15 nt, Vaccinia virus
auaaugauagaauua

SEQ ID NO: 3259125 - RNA, 14 nt, Vaccinia virus
uacaucaagagagc

SEQ ID NO: 3259126 - RNA, 16 nt, Vaccinia virus
uaucaucauuaucauu

SEQ ID NO: 3259127 - RNA, 21 nt, Vaccinia virus
accauccuuuaaaaaaaauga

SEQ ID NO: 3259128 - RNA, 18 nt, Vaccinia virus
augcacaaagaagaauuc

SEQ ID NO: 3259129 - RNA, 15 nt, Vaccinia virus
acuauuauaacaaga

SEQ ID NO: 3259130 - RNA, 13 nt, Vaccinia virus
aaguauaauucuu

SEQ ID NO: 3259131 - RNA, 18 nt, Vaccinia virus
agacguggcaaacaaugu

SEQ ID NO: 3259132 - RNA, 22 nt, Vaccinia virus
guaucgcgauuaguguauacac

SEQ ID NO: 3259133 - RNA, 13 nt, Vaccinia virus
acauguuaguaga

SEQ ID NO: 3259134 - RNA, 21 nt, Vaccinia virus
auauucuuaaaagguuucaua

SEQ ID NO: 3259135 - RNA, 18 nt, Vaccinia virus
cuaugaaaggagagaaug

SEQ ID NO: 3259136 - RNA, 15 nt, Vaccinia virus
guuaaaaauuuagau

SEQ ID NO: 3259137 - RNA, 17 nt, Vaccinia virus
auaacaugguaacugga

SEQ ID NO: 3259138 - RNA, 21 nt, Vaccinia virus
acacacuuaccuucaacagua

SEQ ID NO: 3259139 - RNA, 20 nt, Vaccinia virus
cuaauaaacauuccacauuc

SEQ ID NO: 3259140 - RNA, 14 nt, Vaccinia virus
cuuccaguucugga

SEQ ID NO: 3259141 - RNA, 20 nt, Vaccinia virus
uucucaucuauguaaucaua

SEQ ID NO: 3259142 - RNA, 19 nt, Vaccinia virus
aucagucgagauacagaaa

SEQ ID NO: 3259143 - RNA, 22 nt, Vaccinia virus
aguauuuuuguguuaaaacaau

SEQ ID NO: 3259144 - RNA, 12 nt, Vaccinia virus
aaacuagcaaac

SEQ ID NO: 3259145 - RNA, 19 nt, Vaccinia virus
aucuuauauacacauaauu

SEQ ID NO: 3259146 - RNA, 12 nt, Vaccinia virus
auggaugauaua

SEQ ID NO: 3259147 - RNA, 16 nt, Vaccinia virus
ugucuacauaaaucua

SEQ ID NO: 3259148 - RNA, 19 nt, Vaccinia virus
agauucauguuaacacucu

SEQ ID NO: 3259149 - RNA, 21 nt, Vaccinia virus
cauuuccaaaucuaacuucua

SEQ ID NO: 3259150 - RNA, 13 nt, Vaccinia virus
auuacuauaaaug

SEQ ID NO: 3259151 - RNA, 22 nt, Vaccinia virus
ucugucauauguauaaaugaag

SEQ ID NO: 3259152 - RNA, 19 nt, Vaccinia virus
ucuauaguuuguuuucauu

SEQ ID NO: 3259153 - RNA, 21 nt, Vaccinia virus
ugaauggaucaccguguuuau

SEQ ID NO: 3259154 - RNA, 15 nt, Vaccinia virus
aacuuauucuugaua

SEQ ID NO: 3259155 - RNA, 13 nt, Vaccinia virus
gaugaugugaauu

SEQ ID NO: 3259156 - RNA, 12 nt, Vaccinia virus
auauccaaaauu

SEQ ID NO: 3259157 - RNA, 15 nt, Vaccinia virus
caauuaaaucaauau

SEQ ID NO: 3259158 - RNA, 14 nt, Vaccinia virus
auuaauaaauccgu

SEQ ID NO: 3259159 - RNA, 14 nt, Vaccinia virus
uuguucuuggaugu

SEQ ID NO: 3259160 - RNA, 15 nt, Vaccinia virus
agauuccuuuucuac

SEQ ID NO: 3259161 - RNA, 14 nt, Vaccinia virus
uagauaaauuuauc

SEQ ID NO: 3259162 - RNA, 14 nt, Vaccinia virus
aaauauuuacuaau

SEQ ID NO: 3259163 - RNA, 16 nt, Vaccinia virus
auccuguucuaucaac

SEQ ID NO: 3259164 - RNA, 16 nt, Vaccinia virus
agaccauuuaauacga

SEQ ID NO: 3259165 - RNA, 14 nt, Vaccinia virus
gaagaagaugaugg

SEQ ID NO: 3259166 - RNA, 19 nt, Vaccinia virus
auagaacaaaauacauaau

SEQ ID NO: 3259167 - RNA, 14 nt, Vaccinia virus
aaacuacuggaaua

SEQ ID NO: 3259168 - RNA, 14 nt, Vaccinia virus
ccaacaguaugaaa

SEQ ID NO: 3259169 - RNA, 14 nt, Vaccinia virus
cauaaaacaucauu

SEQ ID NO: 3259170 - RNA, 23 nt, Vaccinia virus
acuagauuaauuuuugugggaag

SEQ ID NO: 3259171 - RNA, 21 nt, Vaccinia virus
auauauucgcauauauuccca

SEQ ID NO: 3259172 - RNA, 15 nt, Vaccinia virus
aauaucuuuauaaga

SEQ ID NO: 3259173 - RNA, 13 nt, Vaccinia virus
ucacuucucuuca

SEQ ID NO: 3259174 - RNA, 20 nt, Vaccinia virus
gauaagaagaggacaaaguu

SEQ ID NO: 3259175 - RNA, 12 nt, Vaccinia virus
uuuuccaugaua

SEQ ID NO: 3259176 - RNA, 14 nt, Vaccinia virus
uuuauccaaaaaga

SEQ ID NO: 3259177 - RNA, 23 nt, Vaccinia virus
auaugguuuuuggccaaaaugau

SEQ ID NO: 3259178 - RNA, 18 nt, Vaccinia virus
guauuucuggugauaaau

SEQ ID NO: 3259179 - RNA, 12 nt, Vaccinia virus
aagguuguaaau

SEQ ID NO: 3259180 - RNA, 23 nt, Vaccinia virus
caauacuaauucaaauuguuaaa

SEQ ID NO: 3259181 - RNA, 13 nt, Vaccinia virus
auuaaacauaaau

SEQ ID NO: 3259182 - RNA, 23 nt, Vaccinia virus
aaauguuaauuuugaaacuaugu

SEQ ID NO: 3259183 - RNA, 14 nt, Vaccinia virus
gcuuauauuuucau

SEQ ID NO: 3259184 - RNA, 21 nt, Vaccinia virus
acaguuacgguuguacauuau

SEQ ID NO: 3259185 - RNA, 13 nt, Vaccinia virus
aauauuaaaacuu

SEQ ID NO: 3259186 - RNA, 21 nt, Vaccinia virus
uagagaggcugcugaaaauaa

SEQ ID NO: 3259187 - RNA, 18 nt, Vaccinia virus
ugccuuuuuauacauguu

SEQ ID NO: 3259188 - RNA, 20 nt, Vaccinia virus
gauucauccuuaaauguuuu

SEQ ID NO: 3259189 - RNA, 21 nt, Vaccinia virus
cauagauauuaauuaucacau

SEQ ID NO: 3259190 - RNA, 19 nt, Vaccinia virus
cauaucuauaggaaaggau

SEQ ID NO: 3259191 - RNA, 14 nt, Vaccinia virus
cuucaucaucuguu

SEQ ID NO: 3259192 - RNA, 23 nt, Vaccinia virus
auguguuuuagaauauauauacg

SEQ ID NO: 3259193 - RNA, 18 nt, Vaccinia virus
acaaaugguucaaagacu

SEQ ID NO: 3259194 - RNA, 21 nt, Vaccinia virus
aucugauagaaagaauaagaa

SEQ ID NO: 3259195 - RNA, 14 nt, Vaccinia virus
guaaaauauucuuu

SEQ ID NO: 3259196 - RNA, 15 nt, Vaccinia virus
ugaaauugagaagau

SEQ ID NO: 3259197 - RNA, 23 nt, Vaccinia virus
ucuaguuuuauuuuuuuguacgu

SEQ ID NO: 3259198 - RNA, 22 nt, Vaccinia virus
auucucauugcuuauauuuuca

SEQ ID NO: 3259199 - RNA, 21 nt, Vaccinia virus
uaccuaauacuaaauacauua

SEQ ID NO: 3259200 - RNA, 23 nt, Vaccinia virus
auuuggaaaacgucaacguguau

SEQ ID NO: 3259201 - RNA, 22 nt, Vaccinia virus
acauuugggccauuauaccucu

SEQ ID NO: 3259202 - RNA, 18 nt, Vaccinia virus
auauuagugaugaauuga

SEQ ID NO: 3259203 - RNA, 17 nt, Vaccinia virus
aaauuugaaagaacuac

SEQ ID NO: 3259204 - RNA, 23 nt, Vaccinia virus
cuaauauucccaaacauacaucu

SEQ ID NO: 3259205 - RNA, 21 nt, Vaccinia virus
ucaucacauaucgccacaaaa

SEQ ID NO: 3259206 - RNA, 15 nt, Vaccinia virus
aauguaguaaauaua

SEQ ID NO: 3259207 - RNA, 13 nt, Vaccinia virus
uuuuguauucaau

SEQ ID NO: 3259208 - RNA, 22 nt, Vaccinia virus
uauccaaggacaaggaugaaaa

SEQ ID NO: 3259209 - RNA, 14 nt, Vaccinia virus
auuccuugaauaac

SEQ ID NO: 3259210 - RNA, 14 nt, Vaccinia virus
aauuuuuauuucuc

SEQ ID NO: 3259211 - RNA, 15 nt, Vaccinia virus
aaauuagaaagauua

SEQ ID NO: 3259212 - RNA, 18 nt, Vaccinia virus
auuaauuuccacaucgau

SEQ ID NO: 3259213 - RNA, 15 nt, Vaccinia virus
uucuauacauagaug

SEQ ID NO: 3259214 - RNA, 19 nt, Vaccinia virus
ucuaaacaagcgauuuaga

SEQ ID NO: 3259215 - RNA, 18 nt, Vaccinia virus
auguguaaaaaguuuuaa

SEQ ID NO: 3259216 - RNA, 13 nt, Vaccinia virus
agucuuacacauu

SEQ ID NO: 3259217 - RNA, 23 nt, Vaccinia virus
caagaauccgaucccacuucugu

SEQ ID NO: 3259218 - RNA, 16 nt, Vaccinia virus
auuguuagcuguuuuc

SEQ ID NO: 3259219 - RNA, 12 nt, Vaccinia virus
ccacaucaucua

SEQ ID NO: 3259220 - RNA, 22 nt, Vaccinia virus
auauauugcuuacuagauguug

SEQ ID NO: 3259221 - RNA, 15 nt, Vaccinia virus
aaaaccaaggacuuu

SEQ ID NO: 3259222 - RNA, 15 nt, Vaccinia virus
cuuuugugaaaagau

SEQ ID NO: 3259223 - RNA, 20 nt, Vaccinia virus
ccgaucuaaaaaaaacuauc

SEQ ID NO: 3259224 - RNA, 18 nt, Vaccinia virus
uugaucaugcuguaauca

SEQ ID NO: 3259225 - RNA, 19 nt, Vaccinia virus
uauagcauucuuggaugaa

SEQ ID NO: 3259226 - RNA, 17 nt, Vaccinia virus
agaaccacgaaacuaau

SEQ ID NO: 3259227 - RNA, 22 nt, Vaccinia virus
augaaauagcguucgucaacau

SEQ ID NO: 3259228 - RNA, 21 nt, Vaccinia virus
uuauguucgguauaaaaauua

SEQ ID NO: 3259229 - RNA, 19 nt, Vaccinia virus
uuaaacuaauucauuuuca

SEQ ID NO: 3259230 - RNA, 12 nt, Vaccinia virus
gccaacaaauau

SEQ ID NO: 3259231 - RNA, 11 nt, Vaccinia virus
guauaaacucc

SEQ ID NO: 3259232 - RNA, 14 nt, Vaccinia virus
cuauagacauaaua

SEQ ID NO: 3259233 - RNA, 16 nt, Vaccinia virus
ugauagaauagaugcu

SEQ ID NO: 3259234 - RNA, 18 nt, Vaccinia virus
auagaguauuaaauauua

SEQ ID NO: 3259235 - RNA, 19 nt, Vaccinia virus
aagagcuacgugagacuua

SEQ ID NO: 3259236 - RNA, 14 nt, Vaccinia virus
agaaaaaaauggaa

SEQ ID NO: 3259237 - RNA, 14 nt, Vaccinia virus
auaucaucaaacaa

SEQ ID NO: 3259238 - RNA, 17 nt, Vaccinia virus
aggcucaguauguaaac

SEQ ID NO: 3259239 - RNA, 16 nt, Vaccinia virus
gaagaucauacagaca

SEQ ID NO: 3259240 - RNA, 22 nt, Vaccinia virus
guacgugucaaagguauaugau

SEQ ID NO: 3259241 - RNA, 23 nt, Vaccinia virus
uuuaaggaggcuuccuuuucuaa

SEQ ID NO: 3259242 - RNA, 22 nt, Vaccinia virus
cuaaagcacaacgagagauauu

SEQ ID NO: 3259243 - RNA, 14 nt, Vaccinia virus
cuuugauaaaaguu

SEQ ID NO: 3259244 - RNA, 13 nt, Vaccinia virus
agcauauaacuaa

SEQ ID NO: 3259245 - RNA, 16 nt, Vaccinia virus
uuccugugacaaaaau

SEQ ID NO: 3259246 - RNA, 15 nt, Vaccinia virus
acuuucgguucuuua

SEQ ID NO: 3259247 - RNA, 18 nt, Vaccinia virus
uaguucuaucaugcuucc

SEQ ID NO: 3259248 - RNA, 23 nt, Vaccinia virus
aauguuuuugaaacuagaaucgu

SEQ ID NO: 3259249 - RNA, 23 nt, Vaccinia virus
uacuuacggcuacggcauuagau

SEQ ID NO: 3259250 - RNA, 13 nt, Vaccinia virus
uuauuuaacaauu

SEQ ID NO: 3259251 - RNA, 12 nt, Vaccinia virus
auuauaauguau

SEQ ID NO: 3259252 - RNA, 21 nt, Vaccinia virus
ccaacggcggacguaguucua

SEQ ID NO: 3259253 - RNA, 20 nt, Vaccinia virus
auauuaucgagauuuaauaa

SEQ ID NO: 3259254 - RNA, 17 nt, Vaccinia virus
aacacucgacacaauau

SEQ ID NO: 3259255 - RNA, 17 nt, Vaccinia virus
gcaucauaaaaaugagu

SEQ ID NO: 3259256 - RNA, 12 nt, Vaccinia virus
aauguaaagaua

SEQ ID NO: 3259257 - RNA, 16 nt, Vaccinia virus
uaggagaguaaugggu

SEQ ID NO: 3259258 - RNA, 16 nt, Vaccinia virus
ucgauuuucuacagau

SEQ ID NO: 3259259 - RNA, 22 nt, Vaccinia virus
agacaugauaauauuaaagaua

SEQ ID NO: 3259260 - RNA, 20 nt, Vaccinia virus
auuaucgaggauaucucaaa

SEQ ID NO: 3259261 - RNA, 21 nt, Vaccinia virus
agcuucaucuauaucuagauu

SEQ ID NO: 3259262 - RNA, 14 nt, Vaccinia virus
auacacaucaaaau

SEQ ID NO: 3259263 - RNA, 14 nt, Vaccinia virus
auaaacaucaacau

SEQ ID NO: 3259264 - RNA, 11 nt, Vaccinia virus
guaaguuuauu

SEQ ID NO: 3259265 - RNA, 14 nt, Vaccinia virus
caagauuauuacgu

SEQ ID NO: 3259266 - RNA, 17 nt, Vaccinia virus
guaaaagucaaauuaga

SEQ ID NO: 3259267 - RNA, 16 nt, Vaccinia virus
caacauuggaauaaua

SEQ ID NO: 3259268 - RNA, 13 nt, Vaccinia virus
uuaaucauguaca

SEQ ID NO: 3259269 - RNA, 15 nt, Vaccinia virus
gaaaaauauaaugua

SEQ ID NO: 3259270 - RNA, 15 nt, Vaccinia virus
gaaaauuauaaugaa

SEQ ID NO: 3259271 - RNA, 23 nt, Vaccinia virus
auguuugcggaagucaaauacga

SEQ ID NO: 3259272 - RNA, 13 nt, Vaccinia virus
caaaaauauucua

SEQ ID NO: 3259273 - RNA, 23 nt, Vaccinia virus
aaauaaaauauaaaauauuggaa

SEQ ID NO: 3259274 - RNA, 15 nt, Vaccinia virus
uuccgccaaauuuuc

SEQ ID NO: 3259275 - RNA, 21 nt, Vaccinia virus
acuucagguuucuuagcuugu

SEQ ID NO: 3259276 - RNA, 20 nt, Vaccinia virus
auuuacuaaucgauuuugca

SEQ ID NO: 3259277 - RNA, 17 nt, Vaccinia virus
caaacaauguauacaaa

SEQ ID NO: 3259278 - RNA, 11 nt, Vaccinia virus
gauacaaauaa

SEQ ID NO: 3259279 - RNA, 20 nt, Vaccinia virus
auuaccagaagguguuguaa

SEQ ID NO: 3259280 - RNA, 23 nt, Vaccinia virus
auagaagcguauaaccuguauac

SEQ ID NO: 3259281 - RNA, 13 nt, Vaccinia virus
ucaaauuaagcau

SEQ ID NO: 3259282 - RNA, 13 nt, Vaccinia virus
agcaaaaaaccau

SEQ ID NO: 3259283 - RNA, 21 nt, Vaccinia virus
gauuacaucucugaacuauau

SEQ ID NO: 3259284 - RNA, 20 nt, Vaccinia virus
acauuagaccguuuaauaga

SEQ ID NO: 3259285 - RNA, 15 nt, Vaccinia virus
uaauuacuaaaucug

SEQ ID NO: 3259286 - RNA, 11 nt, Vaccinia virus
acauaaauguc

SEQ ID NO: 3259287 - RNA, 21 nt, Vaccinia virus
aucauauaucugaagauauac

SEQ ID NO: 3259288 - RNA, 13 nt, Vaccinia virus
gacauauuucauu

SEQ ID NO: 3259289 - RNA, 18 nt, Vaccinia virus
uuguaaaguuaaaauugu

SEQ ID NO: 3259290 - RNA, 20 nt, Vaccinia virus
cgucgucaaaauauuuacua

SEQ ID NO: 3259291 - RNA, 15 nt, Vaccinia virus
uaggcguaaauuaug

SEQ ID NO: 3259292 - RNA, 15 nt, Vaccinia virus
uaauauaucaaacau

SEQ ID NO: 3259293 - RNA, 18 nt, Vaccinia virus
uauaaucaucguaacugc

SEQ ID NO: 3259294 - RNA, 19 nt, Vaccinia virus
auuaaacguggauaaaaug

SEQ ID NO: 3259295 - RNA, 21 nt, Vaccinia virus
caauagcuuaacggauacuug

SEQ ID NO: 3259296 - RNA, 18 nt, Vaccinia virus
cauaauccuuguaaugau

SEQ ID NO: 3259297 - RNA, 19 nt, Vaccinia virus
agauuugccauauauggau

SEQ ID NO: 3259298 - RNA, 13 nt, Vaccinia virus
aaucagaaauugg

SEQ ID NO: 3259299 - RNA, 18 nt, Vaccinia virus
uauuuugcaauuucuuca

SEQ ID NO: 3259300 - RNA, 19 nt, Vaccinia virus
gcaaaaauauauuagacaa

SEQ ID NO: 3259301 - RNA, 19 nt, Vaccinia virus
ugauagagguaaacuucua

SEQ ID NO: 3259302 - RNA, 16 nt, Vaccinia virus
uagauccaacauuaau

SEQ ID NO: 3259303 - RNA, 22 nt, Vaccinia virus
ugaauuugauuauuuugaagac

SEQ ID NO: 3259304 - RNA, 20 nt, Vaccinia virus
gagauccugcauagaaauau

SEQ ID NO: 3259305 - RNA, 23 nt, Vaccinia virus
auuaauauuacuguuaauaacug

SEQ ID NO: 3259306 - RNA, 16 nt, Vaccinia virus
aaauuuagauacaucu

SEQ ID NO: 3259307 - RNA, 14 nt, Vaccinia virus
ggacccauagagaa

SEQ ID NO: 3259308 - RNA, 14 nt, Vaccinia virus
ucauauauuuuugg

SEQ ID NO: 3259309 - RNA, 16 nt, Vaccinia virus
acauacguauaaucug

SEQ ID NO: 3259310 - RNA, 17 nt, Vaccinia virus
agguguguuuuuuacca

SEQ ID NO: 3259311 - RNA, 17 nt, Vaccinia virus
cgcauguuuuaaugcau

SEQ ID NO: 3259312 - RNA, 14 nt, Vaccinia virus
auaauccagauuuu

SEQ ID NO: 3259313 - RNA, 14 nt, Vaccinia virus
caaagaaauuaaua

SEQ ID NO: 3259314 - RNA, 15 nt, Vaccinia virus
gcaauaguauaauua

SEQ ID NO: 3259315 - RNA, 19 nt, Vaccinia virus
guuaauuuaucacauauca

SEQ ID NO: 3259316 - RNA, 20 nt, Vaccinia virus
caaauauaucaauaguagua

SEQ ID NO: 3259317 - RNA, 16 nt, Vaccinia virus
auuaaaggauguacuc

SEQ ID NO: 3259318 - RNA, 22 nt, Vaccinia virus
uucugacaauauuuaguuuauu

SEQ ID NO: 3259319 - RNA, 15 nt, Vaccinia virus
uauaaauguagacuc

SEQ ID NO: 3259320 - RNA, 14 nt, Vaccinia virus
auaaaaauaauauu

SEQ ID NO: 3259321 - RNA, 14 nt, Vaccinia virus
aaaauauaauguac

SEQ ID NO: 3259322 - RNA, 23 nt, Vaccinia virus
gaggauaguugauuuauuacuua

SEQ ID NO: 3259323 - RNA, 22 nt, Vaccinia virus
cauucuucggauccaaaugcug

SEQ ID NO: 3259324 - RNA, 15 nt, Vaccinia virus
aaaaugauagaaaua

SEQ ID NO: 3259325 - RNA, 17 nt, Vaccinia virus
ccauggauggaaacauu

SEQ ID NO: 3259326 - RNA, 19 nt, Vaccinia virus
aggacuuuguagaaauauu

SEQ ID NO: 3259327 - RNA, 17 nt, Vaccinia virus
acaaacagucuaaacaa

SEQ ID NO: 3259328 - RNA, 20 nt, Vaccinia virus
agauaaaccguuuauguauu

SEQ ID NO: 3259329 - RNA, 16 nt, Vaccinia virus
accccauauaauuuua

SEQ ID NO: 3259330 - RNA, 22 nt, Vaccinia virus
aaacagucagcuggucuaaaau

SEQ ID NO: 3259331 - RNA, 23 nt, Vaccinia virus
aucaaaacauauagauagacgag

SEQ ID NO: 3259332 - RNA, 16 nt, Vaccinia virus
uuaacaaaguuauuca

SEQ ID NO: 3259333 - RNA, 18 nt, Vaccinia virus
acucucuauuucuuaaug

SEQ ID NO: 3259334 - RNA, 14 nt, Vaccinia virus
cguauauguuucua

SEQ ID NO: 3259335 - RNA, 17 nt, Vaccinia virus
agaaaauucuauauauu

SEQ ID NO: 3259336 - RNA, 22 nt, Vaccinia virus
acauugaucuauuauuuaauga

SEQ ID NO: 3259337 - RNA, 14 nt, Vaccinia virus
cuaauaauaauuau

SEQ ID NO: 3259338 - RNA, 22 nt, Vaccinia virus
gauuaguaugaagauaaacacu

SEQ ID NO: 3259339 - RNA, 15 nt, Vaccinia virus
auccauaucguauau

SEQ ID NO: 3259340 - RNA, 12 nt, Vaccinia virus
caucugucauau

SEQ ID NO: 3259341 - RNA, 17 nt, Vaccinia virus
guuuacaacacuuuucu

SEQ ID NO: 3259342 - RNA, 14 nt, Vaccinia virus
aaugaaaauggaua

SEQ ID NO: 3259343 - RNA, 17 nt, Vaccinia virus
uuucuagccccugcgga

SEQ ID NO: 3259344 - RNA, 21 nt, Vaccinia virus
acuuacagauggauaaaacuu

SEQ ID NO: 3259345 - RNA, 19 nt, Vaccinia virus
uucacaagaugaauucagu

SEQ ID NO: 3259346 - RNA, 23 nt, Vaccinia virus
uaucaaaacauauagauagacga

SEQ ID NO: 3259347 - RNA, 17 nt, Vaccinia virus
uugauaucuuuagauau

SEQ ID NO: 3259348 - RNA, 17 nt, Vaccinia virus
cauacauacuaucuuua

SEQ ID NO: 3259349 - RNA, 13 nt, Vaccinia virus
caccgaugaugga

SEQ ID NO: 3259350 - RNA, 16 nt, Vaccinia virus
uuccaucaaacuguau

SEQ ID NO: 3259351 - RNA, 14 nt, Vaccinia virus
aaaaaaagaauaua

SEQ ID NO: 3259352 - RNA, 18 nt, Vaccinia virus
uguaaaaguaaaaaagaa

SEQ ID NO: 3259353 - RNA, 13 nt, Vaccinia virus
cagaauaaaucaa

SEQ ID NO: 3259354 - RNA, 18 nt, Vaccinia virus
cauaucaauuuguacauc

SEQ ID NO: 3259355 - RNA, 18 nt, Vaccinia virus
ucaccugccauaaauaaa

SEQ ID NO: 3259356 - RNA, 18 nt, Vaccinia virus
aaaaacauaauagcuccc

SEQ ID NO: 3259357 - RNA, 17 nt, Vaccinia virus
uacaucgucucaucugu

SEQ ID NO: 3259358 - RNA, 22 nt, Vaccinia virus
aaugaguaagacaauaggaaau

SEQ ID NO: 3259359 - RNA, 15 nt, Vaccinia virus
caaacaugacauuuu

SEQ ID NO: 3259360 - RNA, 15 nt, Vaccinia virus
uauuaaugaugaaag

SEQ ID NO: 3259361 - RNA, 18 nt, Vaccinia virus
aauacugcaauaauuuuc

SEQ ID NO: 3259362 - RNA, 18 nt, Vaccinia virus
ucugaaauaagauuagua

SEQ ID NO: 3259363 - RNA, 17 nt, Vaccinia virus
guuucaaaaauauucau

SEQ ID NO: 3259364 - RNA, 15 nt, Vaccinia virus
uguauucucuuacaa

SEQ ID NO: 3259365 - RNA, 17 nt, Vaccinia virus
guuauggcacucuuauu

SEQ ID NO: 3259366 - RNA, 19 nt, Vaccinia virus
uaauaucggucuuauucuu

SEQ ID NO: 3259367 - RNA, 19 nt, Vaccinia virus
uagaaaauaauauagauuu

SEQ ID NO: 3259368 - RNA, 19 nt, Vaccinia virus
cguuuacaaacugaauaau

SEQ ID NO: 3259369 - RNA, 18 nt, Vaccinia virus
cacgguaauaaaauguua

SEQ ID NO: 3259370 - RNA, 22 nt, Vaccinia virus
cgaauuuacucgcauuucuaau

SEQ ID NO: 3259371 - RNA, 21 nt, Vaccinia virus
aacggagaauaucuauacaua

SEQ ID NO: 3259372 - RNA, 20 nt, Vaccinia virus
cuaagcaauagguaauaacu

SEQ ID NO: 3259373 - RNA, 17 nt, Vaccinia virus
auaauguagaagaucau

SEQ ID NO: 3259374 - RNA, 22 nt, Vaccinia virus
cguuuaauaaacugaguguaaa

SEQ ID NO: 3259375 - RNA, 19 nt, Vaccinia virus
auaguauucucagaguuga

SEQ ID NO: 3259376 - RNA, 23 nt, Vaccinia virus
agaaauaagagacuuaaacaacg

SEQ ID NO: 3259377 - RNA, 21 nt, Vaccinia virus
gauuagaaaauauaaauuaau

SEQ ID NO: 3259378 - RNA, 20 nt, Vaccinia virus
uuagaaggauuggucuuaaa

SEQ ID NO: 3259379 - RNA, 16 nt, Vaccinia virus
aaaccaucgucugaau

SEQ ID NO: 3259380 - RNA, 20 nt, Vaccinia virus
augaaaucgcuuaauagaca

SEQ ID NO: 3259381 - RNA, 17 nt, Vaccinia virus
aaugaaucccaaacauu

SEQ ID NO: 3259382 - RNA, 11 nt, Vaccinia virus
cuguauauacu

SEQ ID NO: 3259383 - RNA, 13 nt, Vaccinia virus
aaaauauaauuua

SEQ ID NO: 3259384 - RNA, 17 nt, Vaccinia virus
ugugcuuaauguuucca

SEQ ID NO: 3259385 - RNA, 22 nt, Vaccinia virus
caaaugaaacaggacauuauca

SEQ ID NO: 3259386 - RNA, 17 nt, Vaccinia virus
uguguuuacaguaguaa

SEQ ID NO: 3259387 - RNA, 17 nt, Vaccinia virus
uaggauacucuaugaau

SEQ ID NO: 3259388 - RNA, 16 nt, Vaccinia virus
agaacgaauguuguag

SEQ ID NO: 3259389 - RNA, 14 nt, Vaccinia virus
agaauaaaaugauu

SEQ ID NO: 3259390 - RNA, 14 nt, Vaccinia virus
augaauaaagaaaa

SEQ ID NO: 3259391 - RNA, 22 nt, Vaccinia virus
caauaaauagcuuuacuucuau

SEQ ID NO: 3259392 - RNA, 20 nt, Vaccinia virus
uaguacgcgaaauaauauua

SEQ ID NO: 3259393 - RNA, 13 nt, Vaccinia virus
gauuaagauugcu

SEQ ID NO: 3259394 - RNA, 18 nt, Vaccinia virus
cucauauuaucaggaaca

SEQ ID NO: 3259395 - RNA, 15 nt, Vaccinia virus
aucgacaucgagaac

SEQ ID NO: 3259396 - RNA, 14 nt, Vaccinia virus
auauuagauuuacu

SEQ ID NO: 3259397 - RNA, 14 nt, Vaccinia virus
acauucuaggaaug

SEQ ID NO: 3259398 - RNA, 14 nt, Vaccinia virus
guuauauaauuauc

SEQ ID NO: 3259399 - RNA, 13 nt, Vaccinia virus
aaaauacuacugu

SEQ ID NO: 3259400 - RNA, 22 nt, Vaccinia virus
auucccccugccauuuuagaga

SEQ ID NO: 3259401 - RNA, 22 nt, Vaccinia virus
gauaauaaaaucacuaguauca

SEQ ID NO: 3259402 - RNA, 21 nt, Vaccinia virus
aguuauacgucauuucaucug

SEQ ID NO: 3259403 - RNA, 19 nt, Vaccinia virus
gaacuaauccacauaugau

SEQ ID NO: 3259404 - RNA, 13 nt, Vaccinia virus
guacuuaaugaag

SEQ ID NO: 3259405 - RNA, 22 nt, Vaccinia virus
agcuaugaacuuguuuaaugac

SEQ ID NO: 3259406 - RNA, 20 nt, Vaccinia virus
uaguuuccuuuuuauaaaau

SEQ ID NO: 3259407 - RNA, 20 nt, Vaccinia virus
uagacgagggguuagauggu

SEQ ID NO: 3259408 - RNA, 16 nt, Vaccinia virus
uguuauauauugucua

SEQ ID NO: 3259409 - RNA, 12 nt, Vaccinia virus
uuuaguuucuuc

SEQ ID NO: 3259410 - RNA, 19 nt, Vaccinia virus
ucucuaaauaccucauaaa

SEQ ID NO: 3259411 - RNA, 20 nt, Vaccinia virus
aguacacuccguuuaauaaa

SEQ ID NO: 3259412 - RNA, 17 nt, Vaccinia virus
auuuacuuuuucauaau

SEQ ID NO: 3259413 - RNA, 19 nt, Vaccinia virus
cguuuuuaaguucuggaau

SEQ ID NO: 3259414 - RNA, 11 nt, Vaccinia virus
cuauaaauguc

SEQ ID NO: 3259415 - RNA, 15 nt, Vaccinia virus
aacuauagacaaaau

SEQ ID NO: 3259416 - RNA, 19 nt, Vaccinia virus
agauauuccgacaaaggau

SEQ ID NO: 3259417 - RNA, 20 nt, Vaccinia virus
uacgucucagaauucuaaau

SEQ ID NO: 3259418 - RNA, 21 nt, Vaccinia virus
augaauuugauaagacuuuga

SEQ ID NO: 3259419 - RNA, 16 nt, Vaccinia virus
cauauagaucaaucau

SEQ ID NO: 3259420 - RNA, 15 nt, Vaccinia virus
uccaauuuuauucua

SEQ ID NO: 3259421 - RNA, 16 nt, Vaccinia virus
augauugggaaccagu

SEQ ID NO: 3259422 - RNA, 20 nt, Vaccinia virus
ugguauccuggcgaauauua

SEQ ID NO: 3259423 - RNA, 14 nt, Vaccinia virus
auccuauacucuga

SEQ ID NO: 3259424 - RNA, 22 nt, Vaccinia virus
cuugaggagaucuaaacaaucu

SEQ ID NO: 3259425 - RNA, 17 nt, Vaccinia virus
agugccacaaaacagaa

SEQ ID NO: 3259426 - RNA, 18 nt, Vaccinia virus
ugauacccgcaauuauua

SEQ ID NO: 3259427 - RNA, 12 nt, Vaccinia virus
agauaaauggaa

SEQ ID NO: 3259428 - RNA, 18 nt, Vaccinia virus
gugacggauauacaaaac

SEQ ID NO: 3259429 - RNA, 14 nt, Vaccinia virus
augagacgauguau

SEQ ID NO: 3259430 - RNA, 13 nt, Vaccinia virus
acacgaugaugau

SEQ ID NO: 3259431 - RNA, 17 nt, Vaccinia virus
auaugccuccagaaguu

SEQ ID NO: 3259432 - RNA, 15 nt, Vaccinia virus
auacauuuuucuaug

SEQ ID NO: 3259433 - RNA, 16 nt, Vaccinia virus
auucuugguaauuaau

SEQ ID NO: 3259434 - RNA, 16 nt, Vaccinia virus
gaaugcccgcauauau

SEQ ID NO: 3259435 - RNA, 17 nt, Vaccinia virus
cguaagcgcuauacaaa

SEQ ID NO: 3259436 - RNA, 19 nt, Vaccinia virus
aguacccucaauuaguuua

SEQ ID NO: 3259437 - RNA, 14 nt, Vaccinia virus
gguaaguucauuau

SEQ ID NO: 3259438 - RNA, 17 nt, Vaccinia virus
uaguaaaguuagaugug

SEQ ID NO: 3259439 - RNA, 18 nt, Vaccinia virus
cugcuugggaauuuuuua

SEQ ID NO: 3259440 - RNA, 17 nt, Vaccinia virus
auuuaaggcuuuaaaau

SEQ ID NO: 3259441 - RNA, 15 nt, Vaccinia virus
auuaaaaauaaaguu

SEQ ID NO: 3259442 - RNA, 17 nt, Vaccinia virus
ccaaacugcaaauguag

SEQ ID NO: 3259443 - RNA, 16 nt, Vaccinia virus
ccuacacccgaagaga

SEQ ID NO: 3259444 - RNA, 17 nt, Vaccinia virus
guaaaucauuaucuaca

SEQ ID NO: 3259445 - RNA, 14 nt, Vaccinia virus
uaagcaacaugucu

SEQ ID NO: 3259446 - RNA, 21 nt, Vaccinia virus
auuaugcauucguuuaaagau

SEQ ID NO: 3259447 - RNA, 21 nt, Vaccinia virus
gaguagugaugguuuucuaaa

SEQ ID NO: 3259448 - RNA, 19 nt, Vaccinia virus
uucauaaauaaaaacuugg

SEQ ID NO: 3259449 - RNA, 15 nt, Vaccinia virus
auaaaugacaaguau

SEQ ID NO: 3259450 - RNA, 18 nt, Vaccinia virus
uauuggaccgaauuacag

SEQ ID NO: 3259451 - RNA, 21 nt, Vaccinia virus
uugguaauauggauacuaauu

SEQ ID NO: 3259452 - RNA, 14 nt, Vaccinia virus
gaguauauauuaag

SEQ ID NO: 3259453 - RNA, 22 nt, Vaccinia virus
aaguuccagaaaauguagaauu

SEQ ID NO: 3259454 - RNA, 22 nt, Vaccinia virus
agcaucuugaauagaaacgaua

SEQ ID NO: 3259455 - RNA, 15 nt, Vaccinia virus
uuuuaaagguaucua

SEQ ID NO: 3259456 - RNA, 16 nt, Vaccinia virus
uacaccgcuauguuua

SEQ ID NO: 3259457 - RNA, 15 nt, Vaccinia virus
ucucugguuugcuac

SEQ ID NO: 3259458 - RNA, 21 nt, Vaccinia virus
uaacaaaaauuaugaaauaac

SEQ ID NO: 3259459 - RNA, 18 nt, Vaccinia virus
uauggagaaccaaucauu

SEQ ID NO: 3259460 - RNA, 21 nt, Vaccinia virus
ugacuuuuuuuguaccuuugu

SEQ ID NO: 3259461 - RNA, 22 nt, Vaccinia virus
acucuaaacaauuggacaaauu

SEQ ID NO: 3259462 - RNA, 22 nt, Vaccinia virus
accauauuuucuggaaguggau

SEQ ID NO: 3259463 - RNA, 18 nt, Vaccinia virus
guaugucccaauauuaau

SEQ ID NO: 3259464 - RNA, 15 nt, Vaccinia virus
gcaagaaaauuuaua

SEQ ID NO: 3259465 - RNA, 20 nt, Vaccinia virus
caauguggagauuuaaucug

SEQ ID NO: 3259466 - RNA, 20 nt, Vaccinia virus
caaacucagaaccaaaugau

SEQ ID NO: 3259467 - RNA, 15 nt, Vaccinia virus
cuaacacauuucaac

SEQ ID NO: 3259468 - RNA, 15 nt, Vaccinia virus
aucacaaagaaagcu

SEQ ID NO: 3259469 - RNA, 21 nt, Vaccinia virus
gucuguaacucugauaaucuc

SEQ ID NO: 3259470 - RNA, 15 nt, Vaccinia virus
gcuaguuauuaaaca

SEQ ID NO: 3259471 - RNA, 18 nt, Vaccinia virus
gauaauaauuaauaucua

SEQ ID NO: 3259472 - RNA, 16 nt, Vaccinia virus
cuaaaucucuuuagaa

SEQ ID NO: 3259473 - RNA, 12 nt, Vaccinia virus
uuuuauaaacau

SEQ ID NO: 3259474 - RNA, 19 nt, Vaccinia virus
uaacgagugaucaaaucau

SEQ ID NO: 3259475 - RNA, 16 nt, Vaccinia virus
acuucaauaaaugauu

SEQ ID NO: 3259476 - RNA, 20 nt, Vaccinia virus
acauccgaaauacaaaaugu

SEQ ID NO: 3259477 - RNA, 21 nt, Vaccinia virus
gaugauagugacuauuucauu

SEQ ID NO: 3259478 - RNA, 15 nt, Vaccinia virus
uaauaagauuucuau

SEQ ID NO: 3259479 - RNA, 14 nt, Vaccinia virus
uccauaaauuuaua

SEQ ID NO: 3259480 - RNA, 21 nt, Vaccinia virus
acauaauccagcuagugaaua

SEQ ID NO: 3259481 - RNA, 21 nt, Vaccinia virus
cacaaagaauuuuagacacua

SEQ ID NO: 3259482 - RNA, 20 nt, Vaccinia virus
auaaacucagauaauagcaa

SEQ ID NO: 3259483 - RNA, 15 nt, Vaccinia virus
cauauaaaaaaugau

SEQ ID NO: 3259484 - RNA, 19 nt, Vaccinia virus
gauuucuaucccgaaagaa

SEQ ID NO: 3259485 - RNA, 14 nt, Vaccinia virus
agcauuguuauuag

SEQ ID NO: 3259486 - RNA, 17 nt, Vaccinia virus
gacacuaguuaagaaca

SEQ ID NO: 3259487 - RNA, 15 nt, Vaccinia virus
ugaauauauaugaca

SEQ ID NO: 3259488 - RNA, 16 nt, Vaccinia virus
cauugcuuauauuuuc

SEQ ID NO: 3259489 - RNA, 18 nt, Vaccinia virus
accaauaauaguagaauu

SEQ ID NO: 3259490 - RNA, 19 nt, Vaccinia virus
aaugaaggauuugaaucau

SEQ ID NO: 3259491 - RNA, 20 nt, Vaccinia virus
ucauauguauaaaugaagua

SEQ ID NO: 3259492 - RNA, 17 nt, Vaccinia virus
uaacagcucuauuauau

SEQ ID NO: 3259493 - RNA, 14 nt, Vaccinia virus
cugcaauauauauu

SEQ ID NO: 3259494 - RNA, 22 nt, Vaccinia virus
gauuaguauauuccuuauucac

SEQ ID NO: 3259495 - RNA, 11 nt, Vaccinia virus
uauucucuuuc

SEQ ID NO: 3259496 - RNA, 17 nt, Vaccinia virus
uuaaaguacguaaaucu

SEQ ID NO: 3259497 - RNA, 20 nt, Vaccinia virus
auuauugcgacguucauaga

SEQ ID NO: 3259498 - RNA, 14 nt, Vaccinia virus
agaauuucuguuca

SEQ ID NO: 3259499 - RNA, 23 nt, Vaccinia virus
uguuacucaguugaacagaugau

SEQ ID NO: 3259500 - RNA, 20 nt, Vaccinia virus
uauuuaccgaacaggcauuu

SEQ ID NO: 3259501 - RNA, 14 nt, Vaccinia virus
uggaaaucguaaua

SEQ ID NO: 3259502 - RNA, 18 nt, Vaccinia virus
uuccacagauaauauuag

SEQ ID NO: 3259503 - RNA, 20 nt, Vaccinia virus
ccaaagucaucaaucaucau

SEQ ID NO: 3259504 - RNA, 18 nt, Vaccinia virus
aauuaaucuaguagaaaa

SEQ ID NO: 3259505 - RNA, 14 nt, Vaccinia virus
aaugauuuagaaau

SEQ ID NO: 3259506 - RNA, 16 nt, Vaccinia virus
uuucuaucgaauguag

SEQ ID NO: 3259507 - RNA, 14 nt, Vaccinia virus
ucgugaauaauguu

SEQ ID NO: 3259508 - RNA, 19 nt, Vaccinia virus
aauacacgauuuaauccau

SEQ ID NO: 3259509 - RNA, 23 nt, Vaccinia virus
uuaagcuguucaaaauauagcau

SEQ ID NO: 3259510 - RNA, 20 nt, Vaccinia virus
aaucauucucuucuaucuuu

SEQ ID NO: 3259511 - RNA, 15 nt, Vaccinia virus
acuaacacauuucaa

SEQ ID NO: 3259512 - RNA, 21 nt, Vaccinia virus
auacugucuguaacucugaua

SEQ ID NO: 3259513 - RNA, 17 nt, Vaccinia virus
aaucucugguucuaguu

SEQ ID NO: 3259514 - RNA, 22 nt, Vaccinia virus
gauaagagacguguuauuacau

SEQ ID NO: 3259515 - RNA, 18 nt, Vaccinia virus
augucauuuuuuuauccg

SEQ ID NO: 3259516 - RNA, 18 nt, Vaccinia virus
augauauaucuaguguuu

SEQ ID NO: 3259517 - RNA, 21 nt, Vaccinia virus
ugauauauccagauuacuaac

SEQ ID NO: 3259518 - RNA, 15 nt, Vaccinia virus
auggccgaugaaugg

SEQ ID NO: 3259519 - RNA, 13 nt, Vaccinia virus
uuauccaauacag

SEQ ID NO: 3259520 - RNA, 19 nt, Vaccinia virus
auuguugucugaaauacga

SEQ ID NO: 3259521 - RNA, 21 nt, Vaccinia virus
aauacaagagaaugaaauaua

SEQ ID NO: 3259522 - RNA, 13 nt, Vaccinia virus
gccacgcuacuaa

SEQ ID NO: 3259523 - RNA, 17 nt, Vaccinia virus
uggaugaggaagugaua

SEQ ID NO: 3259524 - RNA, 20 nt, Vaccinia virus
auaaaaucauuugagaaauu

SEQ ID NO: 3259525 - RNA, 15 nt, Vaccinia virus
aacagaaaaaacaau

SEQ ID NO: 3259526 - RNA, 16 nt, Vaccinia virus
acaaaagaguuaaguu

SEQ ID NO: 3259527 - RNA, 16 nt, Vaccinia virus
aaucuuugucaaauau

SEQ ID NO: 3259528 - RNA, 22 nt, Vaccinia virus
aaaccauguugugaaagaguuu

SEQ ID NO: 3259529 - RNA, 16 nt, Vaccinia virus
uucuauaauaaacuuu

SEQ ID NO: 3259530 - RNA, 15 nt, Vaccinia virus
aucauuuccaaaucu

SEQ ID NO: 3259531 - RNA, 22 nt, Vaccinia virus
ucuccgcaauacauuucucaaa

SEQ ID NO: 3259532 - RNA, 15 nt, Vaccinia virus
ucauaacguccagaa

SEQ ID NO: 3259533 - RNA, 17 nt, Vaccinia virus
auaugucuguacaaaug

SEQ ID NO: 3259534 - RNA, 16 nt, Vaccinia virus
augguauuaagaauuc

SEQ ID NO: 3259535 - RNA, 13 nt, Vaccinia virus
uucauuaaucuuu

SEQ ID NO: 3259536 - RNA, 13 nt, Vaccinia virus
cuuugauggauuc

SEQ ID NO: 3259537 - RNA, 14 nt, Vaccinia virus
aaacauaaaauaac

SEQ ID NO: 3259538 - RNA, 22 nt, Vaccinia virus
aaauauaguagaauuucauuuu

SEQ ID NO: 3259539 - RNA, 18 nt, Vaccinia virus
acguauauaacauuguuu

SEQ ID NO: 3259540 - RNA, 20 nt, Vaccinia virus
aauccagucuuuaaugaauu

SEQ ID NO: 3259541 - RNA, 18 nt, Vaccinia virus
auacaucucuggaaauag

SEQ ID NO: 3259542 - RNA, 20 nt, Vaccinia virus
gaacaucauuuccaaaucua

SEQ ID NO: 3259543 - RNA, 17 nt, Vaccinia virus
uaaacacauagaaauaa

SEQ ID NO: 3259544 - RNA, 13 nt, Vaccinia virus
aaauccaaacauu

SEQ ID NO: 3259545 - RNA, 17 nt, Vaccinia virus
caaaguguccuccuauu

SEQ ID NO: 3259546 - RNA, 21 nt, Vaccinia virus
ugaugguagucaauugauguu

SEQ ID NO: 3259547 - RNA, 17 nt, Vaccinia virus
gcgguaaacauucaugu

SEQ ID NO: 3259548 - RNA, 17 nt, Vaccinia virus
aaacuuuuuagaauauc

SEQ ID NO: 3259549 - RNA, 22 nt, Vaccinia virus
uuaucuuguuucgguggcugau

SEQ ID NO: 3259550 - RNA, 23 nt, Vaccinia virus
auaugcccgguaguugcgauaua

SEQ ID NO: 3259551 - RNA, 12 nt, Vaccinia virus
auucaaaaauug

SEQ ID NO: 3259552 - RNA, 13 nt, Vaccinia virus
aaaucaacucaua

SEQ ID NO: 3259553 - RNA, 16 nt, Vaccinia virus
augguuucugugacua

SEQ ID NO: 3259554 - RNA, 17 nt, Vaccinia virus
ccagaaugaaaaacucu

SEQ ID NO: 3259555 - RNA, 22 nt, Vaccinia virus
aucaaaauaucucccggaauug

SEQ ID NO: 3259556 - RNA, 16 nt, Vaccinia virus
accagcggcuacuaaa

SEQ ID NO: 3259557 - RNA, 16 nt, Vaccinia virus
augcuauuagaaaugg

SEQ ID NO: 3259558 - RNA, 23 nt, Vaccinia virus
cccguauagaaguucaaagguua

SEQ ID NO: 3259559 - RNA, 17 nt, Vaccinia virus
ccaucugguucaggaaa

SEQ ID NO: 3259560 - RNA, 18 nt, Vaccinia virus
gugcuucggauucaucca

SEQ ID NO: 3259561 - RNA, 15 nt, Vaccinia virus
auuucgaaaauacua

SEQ ID NO: 3259562 - RNA, 14 nt, Vaccinia virus
auuuuaguuuuggc

SEQ ID NO: 3259563 - RNA, 17 nt, Vaccinia virus
uucuauggcguacaaag

SEQ ID NO: 3259564 - RNA, 22 nt, Vaccinia virus
uaaguauuuggcuagucaagau

SEQ ID NO: 3259565 - RNA, 15 nt, Vaccinia virus
uacguauauuuagau

SEQ ID NO: 3259566 - RNA, 19 nt, Vaccinia virus
aaugagaugcauaaaacuu

SEQ ID NO: 3259567 - RNA, 18 nt, Vaccinia virus
auccuuuaagaucaacau

SEQ ID NO: 3259568 - RNA, 19 nt, Vaccinia virus
aaagcaauugacuaauaaa

SEQ ID NO: 3259569 - RNA, 12 nt, Vaccinia virus
acuaagaaaguu

SEQ ID NO: 3259570 - RNA, 15 nt, Vaccinia virus
aacuauuuuaccguu

SEQ ID NO: 3259571 - RNA, 13 nt, Vaccinia virus
uguaguuuucaca

SEQ ID NO: 3259572 - RNA, 18 nt, Vaccinia virus
cugaucuucuuuugucgu

SEQ ID NO: 3259573 - RNA, 19 nt, Vaccinia virus
uauuaaaugcgucaaucau

SEQ ID NO: 3259574 - RNA, 16 nt, Vaccinia virus
aucauuaaaaaaauua

SEQ ID NO: 3259575 - RNA, 15 nt, Vaccinia virus
agcauuguuauguau

SEQ ID NO: 3259576 - RNA, 18 nt, Vaccinia virus
auaucagacagcauggug

SEQ ID NO: 3259577 - RNA, 16 nt, Vaccinia virus
caaagauggcugaaau

SEQ ID NO: 3259578 - RNA, 22 nt, Vaccinia virus
uuuauucgguaagacaaucauu

SEQ ID NO: 3259579 - RNA, 21 nt, Vaccinia virus
accccauauaauguagacaug

SEQ ID NO: 3259580 - RNA, 12 nt, Vaccinia virus
aaacgauuaaac

SEQ ID NO: 3259581 - RNA, 23 nt, Vaccinia virus
auucauaaaacauaaucaaggau

SEQ ID NO: 3259582 - RNA, 14 nt, Vaccinia virus
uggucauagaaaau

SEQ ID NO: 3259583 - RNA, 22 nt, Vaccinia virus
uauauagauaauucuaauugcu

SEQ ID NO: 3259584 - RNA, 20 nt, Vaccinia virus
gugcuuguaucgaaaaacuu

SEQ ID NO: 3259585 - RNA, 23 nt, Vaccinia virus
agaugaugauacguauauacacu

SEQ ID NO: 3259586 - RNA, 15 nt, Vaccinia virus
guaauaccauguuua

SEQ ID NO: 3259587 - RNA, 13 nt, Vaccinia virus
ucaaaagaaaucu

SEQ ID NO: 3259588 - RNA, 17 nt, Vaccinia virus
acuaaaaaauguagaaa

SEQ ID NO: 3259589 - RNA, 14 nt, Vaccinia virus
cuuaauuauuuugc

SEQ ID NO: 3259590 - RNA, 14 nt, Vaccinia virus
uauugcuacauaau

SEQ ID NO: 3259591 - RNA, 15 nt, Vaccinia virus
auucuaauacauaau

SEQ ID NO: 3259592 - RNA, 14 nt, Vaccinia virus
ucaauaucaucaaa

SEQ ID NO: 3259593 - RNA, 18 nt, Vaccinia virus
uagaacagauuuaacaau

SEQ ID NO: 3259594 - RNA, 14 nt, Vaccinia virus
uuaaauucuuuaau

SEQ ID NO: 3259595 - RNA, 15 nt, Vaccinia virus
cacgaaauaucucau

SEQ ID NO: 3259596 - RNA, 19 nt, Vaccinia virus
aguacuguucaaacaugau

SEQ ID NO: 3259597 - RNA, 22 nt, Vaccinia virus
uaauaucagaccguacauacau

SEQ ID NO: 3259598 - RNA, 17 nt, Vaccinia virus
uguuuucaucaagauuu

SEQ ID NO: 3259599 - RNA, 19 nt, Vaccinia virus
aagaccgaauacauaacag

SEQ ID NO: 3259600 - RNA, 14 nt, Vaccinia virus
agagacaaacuauu

SEQ ID NO: 3259601 - RNA, 17 nt, Vaccinia virus
aguacaagaaauauuuc

SEQ ID NO: 3259602 - RNA, 23 nt, Vaccinia virus
gaccgacgauaauauaaacaucu

SEQ ID NO: 3259603 - RNA, 18 nt, Vaccinia virus
cagagcucaucuaaaaaa

SEQ ID NO: 3259604 - RNA, 14 nt, Vaccinia virus
acuggcgaaauggu

SEQ ID NO: 3259605 - RNA, 16 nt, Vaccinia virus
uagaugaggauagcaa

SEQ ID NO: 3259606 - RNA, 15 nt, Vaccinia virus
acgaaagaaaaagaa

SEQ ID NO: 3259607 - RNA, 20 nt, Vaccinia virus
gaaaucauggcgauguuuua

SEQ ID NO: 3259608 - RNA, 22 nt, Vaccinia virus
ucuaggagguggauauuucuga

SEQ ID NO: 3259609 - RNA, 19 nt, Vaccinia virus
ccucaaucauguacuagcu

SEQ ID NO: 3259610 - RNA, 14 nt, Vaccinia virus
aacuuaaacaaaau

SEQ ID NO: 3259611 - RNA, 13 nt, Vaccinia virus
auuuuauugcuaa

SEQ ID NO: 3259612 - RNA, 17 nt, Vaccinia virus
aauucaucuucuauaua

SEQ ID NO: 3259613 - RNA, 21 nt, Vaccinia virus
cauaugguacgauguuguaaa

SEQ ID NO: 3259614 - RNA, 22 nt, Vaccinia virus
ucauuugcucggcaguaaucaa

SEQ ID NO: 3259615 - RNA, 20 nt, Vaccinia virus
aauacauguaacaaaguuuc

SEQ ID NO: 3259616 - RNA, 17 nt, Vaccinia virus
gacucuaccugaugaau

SEQ ID NO: 3259617 - RNA, 14 nt, Vaccinia virus
guauauaguuuaua

SEQ ID NO: 3259618 - RNA, 21 nt, Vaccinia virus
auucaagcaaaaacaaaaaac

SEQ ID NO: 3259619 - RNA, 15 nt, Vaccinia virus
aguaaagaaaagaua

SEQ ID NO: 3259620 - RNA, 14 nt, Vaccinia virus
aaauuugucauuua

SEQ ID NO: 3259621 - RNA, 15 nt, Vaccinia virus
aaauuaucaaauguu

SEQ ID NO: 3259622 - RNA, 21 nt, Vaccinia virus
uaacgauuuccaugucuacau

SEQ ID NO: 3259623 - RNA, 13 nt, Vaccinia virus
uggauauaugaua

SEQ ID NO: 3259624 - RNA, 18 nt, Vaccinia virus
aagaaguuauagaaugua

SEQ ID NO: 3259625 - RNA, 13 nt, Vaccinia virus
ucaguuacaaaac

SEQ ID NO: 3259626 - RNA, 20 nt, Vaccinia virus
agaugccaagauaucuauau

SEQ ID NO: 3259627 - RNA, 15 nt, Vaccinia virus
uguucaacaaacuaa

SEQ ID NO: 3259628 - RNA, 12 nt, Vaccinia virus
cuucuaucuugu

SEQ ID NO: 3259629 - RNA, 20 nt, Vaccinia virus
augaugaaacacaagaucaa

SEQ ID NO: 3259630 - RNA, 23 nt, Vaccinia virus
uuauuccgguacugguuuagaua

SEQ ID NO: 3259631 - RNA, 18 nt, Vaccinia virus
auaucugaguaugaugau

SEQ ID NO: 3259632 - RNA, 14 nt, Vaccinia virus
uguaauaguuucca

SEQ ID NO: 3259633 - RNA, 20 nt, Vaccinia virus
cagaaauugguauaaauguu

SEQ ID NO: 3259634 - RNA, 12 nt, Vaccinia virus
gcugaaaugaga

SEQ ID NO: 3259635 - RNA, 17 nt, Vaccinia virus
guacaauaaauagcuuu

SEQ ID NO: 3259636 - RNA, 19 nt, Vaccinia virus
acaaaugcgccaaaguuau

SEQ ID NO: 3259637 - RNA, 12 nt, Vaccinia virus
gcaauguaaugg

SEQ ID NO: 3259638 - RNA, 20 nt, Vaccinia virus
uuuuguuggagaacuugaua

SEQ ID NO: 3259639 - RNA, 14 nt, Vaccinia virus
uagauaaaauacug

SEQ ID NO: 3259640 - RNA, 23 nt, Vaccinia virus
uaguuauuagugauaaaauagua

SEQ ID NO: 3259641 - RNA, 20 nt, Vaccinia virus
uggauaccgcacuagguaca

SEQ ID NO: 3259642 - RNA, 13 nt, Vaccinia virus
aucauaauauuaa

SEQ ID NO: 3259643 - RNA, 13 nt, Vaccinia virus
guaaaaaauguac

SEQ ID NO: 3259644 - RNA, 16 nt, Vaccinia virus
caaauagauaagaaua

SEQ ID NO: 3259645 - RNA, 22 nt, Vaccinia virus
uaauuugaccugauuacauuuu

SEQ ID NO: 3259646 - RNA, 18 nt, Vaccinia virus
aaguacagauuuuagaaa

SEQ ID NO: 3259647 - RNA, 15 nt, Vaccinia virus
ugaguaaugaaaucc

SEQ ID NO: 3259648 - RNA, 14 nt, Vaccinia virus
ccauaucaacaucu

SEQ ID NO: 3259649 - RNA, 19 nt, Vaccinia virus
auaucacauaguguuuuau

SEQ ID NO: 3259650 - RNA, 19 nt, Vaccinia virus
cauauaggaaacuauaaag

SEQ ID NO: 3259651 - RNA, 18 nt, Vaccinia virus
aagugaaggauugauaac

SEQ ID NO: 3259652 - RNA, 21 nt, Vaccinia virus
uaucgcauuuucuaacgugau

SEQ ID NO: 3259653 - RNA, 20 nt, Vaccinia virus
auaggauacucuaugaaugg

SEQ ID NO: 3259654 - RNA, 12 nt, Vaccinia virus
acacaagaucug

SEQ ID NO: 3259655 - RNA, 12 nt, Vaccinia virus
aaguaaacuucg

SEQ ID NO: 3259656 - RNA, 14 nt, Vaccinia virus
aacuguuaaauguu

SEQ ID NO: 3259657 - RNA, 24 nt, Vaccinia virus
auacaucaagagagcagaaauuac

SEQ ID NO: 3259658 - RNA, 15 nt, Vaccinia virus
uauacaauuaucauu

SEQ ID NO: 3259659 - RNA, 17 nt, Vaccinia virus
uagucauagacaaugcu

SEQ ID NO: 3259660 - RNA, 14 nt, Vaccinia virus
agacuuuguagaaa

SEQ ID NO: 3259661 - RNA, 19 nt, Vaccinia virus
cugucuucaaugaacucau

SEQ ID NO: 3259662 - RNA, 17 nt, Vaccinia virus
auuauccggauucauuu

SEQ ID NO: 3259663 - RNA, 16 nt, Vaccinia virus
aggaaguauaucugag

SEQ ID NO: 3259664 - RNA, 15 nt, Vaccinia virus
uuacucuaaaucgcu

SEQ ID NO: 3259665 - RNA, 18 nt, Vaccinia virus
cagauauggucaaaucaa

SEQ ID NO: 3259666 - RNA, 18 nt, Vaccinia virus
uauaggaaacuauaaagu

SEQ ID NO: 3259667 - RNA, 18 nt, Vaccinia virus
uugauccguaauaacauu

SEQ ID NO: 3259668 - RNA, 16 nt, Vaccinia virus
cuucucaucuauguaa

SEQ ID NO: 3259669 - RNA, 23 nt, Vaccinia virus
uugccaccuauagcaucaauaau

SEQ ID NO: 3259670 - RNA, 16 nt, Vaccinia virus
aucacaggagcaaugu

SEQ ID NO: 3259671 - RNA, 16 nt, Vaccinia virus
auagauuuugaauauu

SEQ ID NO: 3259672 - RNA, 17 nt, Vaccinia virus
uccaucagaauguuucc

SEQ ID NO: 3259673 - RNA, 21 nt, Vaccinia virus
ugaagaagagguaagauaucu

SEQ ID NO: 3259674 - RNA, 14 nt, Vaccinia virus
auuuagcaaaauua

SEQ ID NO: 3259675 - RNA, 19 nt, Vaccinia virus
cacuaguuaagaacauguc

SEQ ID NO: 3259676 - RNA, 17 nt, Vaccinia virus
ucgaggacuuggauguu

SEQ ID NO: 3259677 - RNA, 18 nt, Vaccinia virus
ugauuuucguaacagaua

SEQ ID NO: 3259678 - RNA, 18 nt, Vaccinia virus
gcuugauaauuagauaua

SEQ ID NO: 3259679 - RNA, 18 nt, Vaccinia virus
guuaaagaucuuaagaaa

SEQ ID NO: 3259680 - RNA, 22 nt, Vaccinia virus
auauuuuucuauguuaggaaua

SEQ ID NO: 3259681 - RNA, 15 nt, Vaccinia virus
cauuagguuaaauga

SEQ ID NO: 3259682 - RNA, 16 nt, Vaccinia virus
uagaguuuuauucuca

SEQ ID NO: 3259683 - RNA, 19 nt, Vaccinia virus
auaugauccaugcauagau

SEQ ID NO: 3259684 - RNA, 20 nt, Vaccinia virus
agaaaacucguuauuaacua

SEQ ID NO: 3259685 - RNA, 12 nt, Vaccinia virus
aggauucuuaau

SEQ ID NO: 3259686 - RNA, 22 nt, Vaccinia virus
uaacaguaucauuuaaacauuu

SEQ ID NO: 3259687 - RNA, 13 nt, Vaccinia virus
acaucuaguucuu

SEQ ID NO: 3259688 - RNA, 18 nt, Vaccinia virus
cuugaucucaucauucca

SEQ ID NO: 3259689 - RNA, 15 nt, Vaccinia virus
uaucauccaauauua

SEQ ID NO: 3259690 - RNA, 11 nt, Vaccinia virus
ucguuaaugaa

SEQ ID NO: 3259691 - RNA, 22 nt, Vaccinia virus
uaauaggagcuagaagaacuuc

SEQ ID NO: 3259692 - RNA, 23 nt, Vaccinia virus
acuaugaauccgaugaucucacu

SEQ ID NO: 3259693 - RNA, 23 nt, Vaccinia virus
aaaguuuuuccaauuauauggua

SEQ ID NO: 3259694 - RNA, 19 nt, Vaccinia virus
agauuuuuagcguauuauc

SEQ ID NO: 3259695 - RNA, 21 nt, Vaccinia virus
ucuaugagacgauauauagua

SEQ ID NO: 3259696 - RNA, 20 nt, Vaccinia virus
agaaaacuagauacaaaauu

SEQ ID NO: 3259697 - RNA, 15 nt, Vaccinia virus
acaauguagaaauua

SEQ ID NO: 3259698 - RNA, 21 nt, Vaccinia virus
agcuaaugaugcggauauugu

SEQ ID NO: 3259699 - RNA, 15 nt, Vaccinia virus
acaaaaaaaagaaua

SEQ ID NO: 3259700 - RNA, 17 nt, Vaccinia virus
gaucuaaagauaaucuu

SEQ ID NO: 3259701 - RNA, 13 nt, Vaccinia virus
caaaaacgauauu

SEQ ID NO: 3259702 - RNA, 20 nt, Vaccinia virus
acuaauguauacauuuucca

SEQ ID NO: 3259703 - RNA, 14 nt, Vaccinia virus
acuaucuuuaacau

SEQ ID NO: 3259704 - RNA, 17 nt, Vaccinia virus
uaaccaugaaagaaaga

SEQ ID NO: 3259705 - RNA, 22 nt, Vaccinia virus
uguucagauacuauaccguugu

SEQ ID NO: 3259706 - RNA, 19 nt, Vaccinia virus
aaaguuacaacuggucaua

SEQ ID NO: 3259707 - RNA, 13 nt, Vaccinia virus
uaaucguguauaa

SEQ ID NO: 3259708 - RNA, 17 nt, Vaccinia virus
gaacagguuauccagaa

SEQ ID NO: 3259709 - RNA, 21 nt, Vaccinia virus
auauaaggccaaaacaaaauu

SEQ ID NO: 3259710 - RNA, 12 nt, Vaccinia virus
uaccuuaaugua

SEQ ID NO: 3259711 - RNA, 19 nt, Vaccinia virus
uuucucucauguauaauaa

SEQ ID NO: 3259712 - RNA, 21 nt, Vaccinia virus
uagucuuagcugaccugaguu

SEQ ID NO: 3259713 - RNA, 14 nt, Vaccinia virus
ccaaauguuggaaa

SEQ ID NO: 3259714 - RNA, 15 nt, Vaccinia virus
uagaagaucauacag

SEQ ID NO: 3259715 - RNA, 14 nt, Vaccinia virus
uugccaaugauguc

SEQ ID NO: 3259716 - RNA, 15 nt, Vaccinia virus
uggugcuaauuauuc

SEQ ID NO: 3259717 - RNA, 15 nt, Vaccinia virus
uacuacuucauuaau

SEQ ID NO: 3259718 - RNA, 23 nt, Vaccinia virus
guccauuuaaaguacagauuuua

SEQ ID NO: 3259719 - RNA, 20 nt, Vaccinia virus
aaauacauaugacaaacauu

SEQ ID NO: 3259720 - RNA, 14 nt, Vaccinia virus
cacagaacaguaaa

SEQ ID NO: 3259721 - RNA, 22 nt, Vaccinia virus
aaaguuaggguucuuguuccau

SEQ ID NO: 3259722 - RNA, 21 nt, Vaccinia virus
gaaaauaccauccaagucaau

SEQ ID NO: 3259723 - RNA, 20 nt, Vaccinia virus
ucacaaagauggcugaaauc

SEQ ID NO: 3259724 - RNA, 14 nt, Vaccinia virus
uuauacaaaguuuu

SEQ ID NO: 3259725 - RNA, 17 nt, Vaccinia virus
cuaggaguguuggauuu

SEQ ID NO: 3259726 - RNA, 17 nt, Vaccinia virus
uaauaguuuaucauacu

SEQ ID NO: 3259727 - RNA, 16 nt, Vaccinia virus
ucaaauaggagauauu

SEQ ID NO: 3259728 - RNA, 14 nt, Vaccinia virus
augaauuaauuaag

SEQ ID NO: 3259729 - RNA, 19 nt, Vaccinia virus
auauuucuccacuacauau

SEQ ID NO: 3259730 - RNA, 14 nt, Vaccinia virus
aauaaucauacaau

SEQ ID NO: 3259731 - RNA, 17 nt, Vaccinia virus
gaccaucguuugucaua

SEQ ID NO: 3259732 - RNA, 13 nt, Vaccinia virus
aucuaaucaucaa

SEQ ID NO: 3259733 - RNA, 22 nt, Vaccinia virus
agcguagaaguuguaaaugaca

SEQ ID NO: 3259734 - RNA, 20 nt, Vaccinia virus
aaaccaggugaguguagaaa

SEQ ID NO: 3259735 - RNA, 23 nt, Vaccinia virus
uaguaagccaauuccaauuguug

SEQ ID NO: 3259736 - RNA, 24 nt, Vaccinia virus
ugcuauguuuauagauguucacau

SEQ ID NO: 3259737 - RNA, 15 nt, Vaccinia virus
aaccgauaauaaugu

SEQ ID NO: 3259738 - RNA, 23 nt, Vaccinia virus
guuauauguaacauugaguaaau

SEQ ID NO: 3259739 - RNA, 23 nt, Vaccinia virus
guuaugaaucuggauugccuaaa

SEQ ID NO: 3259740 - RNA, 19 nt, Vaccinia virus
ugguacaaaaaauaucaug

SEQ ID NO: 3259741 - RNA, 17 nt, Vaccinia virus
acuaauggaguauucca

SEQ ID NO: 3259742 - RNA, 19 nt, Vaccinia virus
uguuugcugcguguauaac

SEQ ID NO: 3259743 - RNA, 15 nt, Vaccinia virus
uucauuacuacugua

SEQ ID NO: 3259744 - RNA, 18 nt, Vaccinia virus
agaaauauguuaacaaua

SEQ ID NO: 3259745 - RNA, 13 nt, Vaccinia virus
auccuauaaacau

SEQ ID NO: 3259746 - RNA, 17 nt, Vaccinia virus
acguuacuacguucaga

SEQ ID NO: 3259747 - RNA, 21 nt, Vaccinia virus
ucagauuaaauccaucucaga

SEQ ID NO: 3259748 - RNA, 20 nt, Vaccinia virus
acugcagagggaaaaugcua

SEQ ID NO: 3259749 - RNA, 15 nt, Vaccinia virus
aaaaccguuaaaaug

SEQ ID NO: 3259750 - RNA, 21 nt, Vaccinia virus
auuaacucagaagauuauuau

SEQ ID NO: 3259751 - RNA, 16 nt, Vaccinia virus
accauuaucuuuguuu

SEQ ID NO: 3259752 - RNA, 14 nt, Vaccinia virus
uugacaucuaguau

SEQ ID NO: 3259753 - RNA, 19 nt, Vaccinia virus
aauauuagaguuaggcaau

SEQ ID NO: 3259754 - RNA, 12 nt, Vaccinia virus
aaugaaaauaua

SEQ ID NO: 3259755 - RNA, 20 nt, Vaccinia virus
accauauauccaauaaagcu

SEQ ID NO: 3259756 - RNA, 17 nt, Vaccinia virus
auuggauuggauacacu

SEQ ID NO: 3259757 - RNA, 22 nt, Vaccinia virus
ggaucgcaagaauuuauuucua

SEQ ID NO: 3259758 - RNA, 12 nt, Vaccinia virus
cuauuuggauuu

SEQ ID NO: 3259759 - RNA, 14 nt, Vaccinia virus
aaauuaagauacaa

SEQ ID NO: 3259760 - RNA, 21 nt, Vaccinia virus
uaguaauaaugauucaacaau

SEQ ID NO: 3259761 - RNA, 16 nt, Vaccinia virus
gaaagugcaaaugagg

SEQ ID NO: 3259762 - RNA, 20 nt, Vaccinia virus
cugaauaaucguuauuauca

SEQ ID NO: 3259763 - RNA, 22 nt, Vaccinia virus
aagugaacaauaauuaauucuu

SEQ ID NO: 3259764 - RNA, 14 nt, Vaccinia virus
gaauuguaacuuga

SEQ ID NO: 3259765 - RNA, 15 nt, Vaccinia virus
auccuaauucacaau

SEQ ID NO: 3259766 - RNA, 21 nt, Vaccinia virus
ucucaaaugaauaaguuuauu

SEQ ID NO: 3259767 - RNA, 14 nt, Vaccinia virus
uaaauucuguuuaa

SEQ ID NO: 3259768 - RNA, 17 nt, Vaccinia virus
aauaacuuguuagauaa

SEQ ID NO: 3259769 - RNA, 16 nt, Vaccinia virus
aaauacaaaacagaga

SEQ ID NO: 3259770 - RNA, 23 nt, Vaccinia virus
gacucucaguaagaguuaugaau

SEQ ID NO: 3259771 - RNA, 21 nt, Vaccinia virus
uuauugggccaguauacuguu

SEQ ID NO: 3259772 - RNA, 20 nt, Vaccinia virus
aauguucuuaacuacauuca

SEQ ID NO: 3259773 - RNA, 15 nt, Vaccinia virus
uuaauuuauuauuga

SEQ ID NO: 3259774 - RNA, 17 nt, Vaccinia virus
uagcugagaauaucuuu

SEQ ID NO: 3259775 - RNA, 15 nt, Vaccinia virus
aaaguuucacaugaa

SEQ ID NO: 3259776 - RNA, 23 nt, Vaccinia virus
aaggaggaucuuuacccauccaa

SEQ ID NO: 3259777 - RNA, 15 nt, Vaccinia virus
caauauuaaugcauu

SEQ ID NO: 3259778 - RNA, 21 nt, Vaccinia virus
gaaaauuagaucugauaauau

SEQ ID NO: 3259779 - RNA, 15 nt, Vaccinia virus
acaaucgauaauaua

SEQ ID NO: 3259780 - RNA, 22 nt, Vaccinia virus
cucuaacaacaacgaaccaaaa

SEQ ID NO: 3259781 - RNA, 20 nt, Vaccinia virus
cccaaucuuguuauaaacac

SEQ ID NO: 3259782 - RNA, 17 nt, Vaccinia virus
ucuaccguuguuaaaua

SEQ ID NO: 3259783 - RNA, 20 nt, Vaccinia virus
ugaaauccguagaaacaucu

SEQ ID NO: 3259784 - RNA, 21 nt, Vaccinia virus
uucuacuacuucauuaaucuu

SEQ ID NO: 3259785 - RNA, 13 nt, Vaccinia virus
acaggcauauuag

SEQ ID NO: 3259786 - RNA, 15 nt, Vaccinia virus
uagauguguauacau

SEQ ID NO: 3259787 - RNA, 18 nt, Vaccinia virus
agauuuuggugaaauuau

SEQ ID NO: 3259788 - RNA, 14 nt, Vaccinia virus
aucgauagacacug

SEQ ID NO: 3259789 - RNA, 12 nt, Vaccinia virus
ucuauaggaaag

SEQ ID NO: 3259790 - RNA, 20 nt, Vaccinia virus
agauaauugugguaauacac

SEQ ID NO: 3259791 - RNA, 22 nt, Vaccinia virus
aauaguuucauaauuguuagcu

SEQ ID NO: 3259792 - RNA, 22 nt, Vaccinia virus
uauaguuaauaguguacuacaa

SEQ ID NO: 3259793 - RNA, 16 nt, Vaccinia virus
uagaauuugaucuauu

SEQ ID NO: 3259794 - RNA, 14 nt, Vaccinia virus
ucauucuauuaaug

SEQ ID NO: 3259795 - RNA, 19 nt, Vaccinia virus
ccuugaaaaugaauacagu

SEQ ID NO: 3259796 - RNA, 17 nt, Vaccinia virus
uuccauugauaaagaag

SEQ ID NO: 3259797 - RNA, 19 nt, Vaccinia virus
ucuagauacuagaguagua

SEQ ID NO: 3259798 - RNA, 13 nt, Vaccinia virus
auaauuauuucca

SEQ ID NO: 3259799 - RNA, 22 nt, Vaccinia virus
guguauuuaaguugguagauuu

SEQ ID NO: 3259800 - RNA, 20 nt, Vaccinia virus
uguaaaggauaugauauguu

SEQ ID NO: 3259801 - RNA, 13 nt, Vaccinia virus
auaacuaaauguc

SEQ ID NO: 3259802 - RNA, 18 nt, Vaccinia virus
cuaacgccgaucucugaa

SEQ ID NO: 3259803 - RNA, 14 nt, Vaccinia virus
ugcaacaucuggag

SEQ ID NO: 3259804 - RNA, 19 nt, Vaccinia virus
cauauuuagaaaaaagauu

SEQ ID NO: 3259805 - RNA, 15 nt, Vaccinia virus
gucuauguauguacg

SEQ ID NO: 3259806 - RNA, 17 nt, Vaccinia virus
gcuauuaaaauauuuua

SEQ ID NO: 3259807 - RNA, 13 nt, Vaccinia virus
agaauuaagauua

SEQ ID NO: 3259808 - RNA, 17 nt, Vaccinia virus
aacuaaacagucuauca

SEQ ID NO: 3259809 - RNA, 15 nt, Vaccinia virus
auauaaauaugagca

SEQ ID NO: 3259810 - RNA, 23 nt, Vaccinia virus
cuugcacuuaaagucuacauugu

SEQ ID NO: 3259811 - RNA, 19 nt, Vaccinia virus
gcaauauaucaucuuuuca

SEQ ID NO: 3259812 - RNA, 13 nt, Vaccinia virus
cuaauaaacauuc

SEQ ID NO: 3259813 - RNA, 13 nt, Vaccinia virus
augauacauguau

SEQ ID NO: 3259814 - RNA, 19 nt, Vaccinia virus
uauuaaucaagucaauuau

SEQ ID NO: 3259815 - RNA, 13 nt, Vaccinia virus
uauggaaucugua

SEQ ID NO: 3259816 - RNA, 23 nt, Vaccinia virus
uuaugauauaaggaaacagcuuu

SEQ ID NO: 3259817 - RNA, 18 nt, Vaccinia virus
uagccuguuuuaacaucu

SEQ ID NO: 3259818 - RNA, 14 nt, Vaccinia virus
auaucucuaauaga

SEQ ID NO: 3259819 - RNA, 14 nt, Vaccinia virus
uauaguauuaacuu

SEQ ID NO: 3259820 - RNA, 17 nt, Vaccinia virus
ugaauguucucaagaac

SEQ ID NO: 3259821 - RNA, 15 nt, Vaccinia virus
uaacuguuaucucuu

SEQ ID NO: 3259822 - RNA, 17 nt, Vaccinia virus
ucaacaaguguguagau

SEQ ID NO: 3259823 - RNA, 14 nt, Vaccinia virus
gaauauguauauca

SEQ ID NO: 3259824 - RNA, 11 nt, Vaccinia virus
cuauaguucuc

SEQ ID NO: 3259825 - RNA, 16 nt, Vaccinia virus
agacaaauauacuuua

SEQ ID NO: 3259826 - RNA, 20 nt, Vaccinia virus
guuuuccaaccggacucauu

SEQ ID NO: 3259827 - RNA, 21 nt, Vaccinia virus
ccaaaucaguaacuauguuca

SEQ ID NO: 3259828 - RNA, 14 nt, Vaccinia virus
auauacagucuuaa

SEQ ID NO: 3259829 - RNA, 20 nt, Vaccinia virus
agccugaagcucaucuuguu

SEQ ID NO: 3259830 - RNA, 20 nt, Vaccinia virus
uagaaaucaacuuauucuug

SEQ ID NO: 3259831 - RNA, 20 nt, Vaccinia virus
caauacauguuuuauaaaau

SEQ ID NO: 3259832 - RNA, 18 nt, Vaccinia virus
auuuuauucuagaauuga

SEQ ID NO: 3259833 - RNA, 19 nt, Vaccinia virus
uagaugcauauauuucauu

SEQ ID NO: 3259834 - RNA, 21 nt, Vaccinia virus
uggaaucagaagaugauucca

SEQ ID NO: 3259835 - RNA, 21 nt, Vaccinia virus
uucuaucaacgauucuagaau

SEQ ID NO: 3259836 - RNA, 14 nt, Vaccinia virus
acgaauauaaauca

SEQ ID NO: 3259837 - RNA, 20 nt, Vaccinia virus
cuauauuuguuccuguagau

SEQ ID NO: 3259838 - RNA, 22 nt, Vaccinia virus
caucuguaggauaucuauuuuu

SEQ ID NO: 3259839 - RNA, 16 nt, Vaccinia virus
uaugcauguuucauaa

SEQ ID NO: 3259840 - RNA, 11 nt, Vaccinia virus
uaauauuugcu

SEQ ID NO: 3259841 - RNA, 20 nt, Vaccinia virus
acauuuuccauuauuaauaa

SEQ ID NO: 3259842 - RNA, 14 nt, Vaccinia virus
aaacuuuaauaaca

SEQ ID NO: 3259843 - RNA, 23 nt, Vaccinia virus
cuucgauauuagauuuuguauua

SEQ ID NO: 3259844 - RNA, 19 nt, Vaccinia virus
cuuuaguuuauacuauuac

SEQ ID NO: 3259845 - RNA, 16 nt, Vaccinia virus
uagacauuuuuagaga

SEQ ID NO: 3259846 - RNA, 22 nt, Vaccinia virus
aauauggagagguguauuucca

SEQ ID NO: 3259847 - RNA, 20 nt, Vaccinia virus
aaaacauuauaauaauauaa

SEQ ID NO: 3259848 - RNA, 18 nt, Vaccinia virus
ugucccuucaagaagaua

SEQ ID NO: 3259849 - RNA, 14 nt, Vaccinia virus
auuuaauacuuuac

SEQ ID NO: 3259850 - RNA, 20 nt, Vaccinia virus
acaaguaucaaaagauuaaa

SEQ ID NO: 3259851 - RNA, 17 nt, Vaccinia virus
uaauuuuaucaagacau

SEQ ID NO: 3259852 - RNA, 20 nt, Vaccinia virus
auauuauuuuuauguuuuau

SEQ ID NO: 3259853 - RNA, 20 nt, Vaccinia virus
uauaguucaaauuaagcauu

SEQ ID NO: 3259854 - RNA, 20 nt, Vaccinia virus
aaauaggguuguguauaauu

SEQ ID NO: 3259855 - RNA, 12 nt, Vaccinia virus
caauaaaugauu

SEQ ID NO: 3259856 - RNA, 12 nt, Vaccinia virus
cuuaaaauguaa

SEQ ID NO: 3259857 - RNA, 15 nt, Vaccinia virus
cucucucugccaaaa

SEQ ID NO: 3259858 - RNA, 15 nt, Vaccinia virus
agucauaaaaggaua

SEQ ID NO: 3259859 - RNA, 22 nt, Vaccinia virus
uguacgauguaguaguaacugu

SEQ ID NO: 3259860 - RNA, 14 nt, Vaccinia virus
auugaucaaacauu

SEQ ID NO: 3259861 - RNA, 17 nt, Vaccinia virus
ggaaacuuuuguuuugu

SEQ ID NO: 3259862 - RNA, 21 nt, Vaccinia virus
cagcaauagaucggaugauuu

SEQ ID NO: 3259863 - RNA, 22 nt, Vaccinia virus
guuucaaagcaauuguauuauu

SEQ ID NO: 3259864 - RNA, 22 nt, Vaccinia virus
uauaacuaucaauauuaacagu

SEQ ID NO: 3259865 - RNA, 18 nt, Vaccinia virus
agauaugccagaacuauu

SEQ ID NO: 3259866 - RNA, 17 nt, Vaccinia virus
auugagcggaccaucug

SEQ ID NO: 3259867 - RNA, 11 nt, Vaccinia virus
aaauacagaua

SEQ ID NO: 3259868 - RNA, 22 nt, Vaccinia virus
cuuuugauuugcuuugaaugau

SEQ ID NO: 3259869 - RNA, 23 nt, Vaccinia virus
uaaccuuggcugucucauucaau

SEQ ID NO: 3259870 - RNA, 21 nt, Vaccinia virus
aaccauucauuaauuucugau

SEQ ID NO: 3259871 - RNA, 17 nt, Vaccinia virus
augaaacguuuggaaac

SEQ ID NO: 3259872 - RNA, 21 nt, Vaccinia virus
caucgguacggguauucauuu

SEQ ID NO: 3259873 - RNA, 22 nt, Vaccinia virus
aaguaucuaguuagcaauuuuc

SEQ ID NO: 3259874 - RNA, 13 nt, Vaccinia virus
auacgaagacuau

SEQ ID NO: 3259875 - RNA, 14 nt, Vaccinia virus
auauaauaauacac

SEQ ID NO: 3259876 - RNA, 13 nt, Vaccinia virus
aaacuaaauaacg

SEQ ID NO: 3259877 - RNA, 15 nt, Vaccinia virus
ucuuguucaauggau

SEQ ID NO: 3259878 - RNA, 15 nt, Vaccinia virus
gguacaacauuccaa

SEQ ID NO: 3259879 - RNA, 18 nt, Vaccinia virus
ucugauuugaacaaugca

SEQ ID NO: 3259880 - RNA, 21 nt, Vaccinia virus
uaucuuuuagagguucccaau

SEQ ID NO: 3259881 - RNA, 18 nt, Vaccinia virus
cauuacagaaacuguaaa

SEQ ID NO: 3259882 - RNA, 10 nt, Vaccinia virus
guuacaaaag

SEQ ID NO: 3259883 - RNA, 17 nt, Vaccinia virus
aaucauugggaaacauu

SEQ ID NO: 3259884 - RNA, 18 nt, Vaccinia virus
uauggaucuauucaagau

SEQ ID NO: 3259885 - RNA, 14 nt, Vaccinia virus
gucaaucaaagaga

SEQ ID NO: 3259886 - RNA, 19 nt, Vaccinia virus
uuuaaucucgaaauucaga

SEQ ID NO: 3259887 - RNA, 20 nt, Vaccinia virus
aggauucgauuuugauguau

SEQ ID NO: 3259888 - RNA, 14 nt, Vaccinia virus
uauuacuaaacauu

SEQ ID NO: 3259889 - RNA, 22 nt, Vaccinia virus
aauaguauacgcagaaaagaua

SEQ ID NO: 3259890 - RNA, 14 nt, Vaccinia virus
aauacuguauuaug

SEQ ID NO: 3259891 - RNA, 15 nt, Vaccinia virus
acuacguugaagauc

SEQ ID NO: 3259892 - RNA, 23 nt, Vaccinia virus
ccaaaaauuuuuaaaguauaucu

SEQ ID NO: 3259893 - RNA, 18 nt, Vaccinia virus
aucuuguucagaaauaua

SEQ ID NO: 3259894 - RNA, 20 nt, Vaccinia virus
uaguacuacaauuuguauuu

SEQ ID NO: 3259895 - RNA, 19 nt, Vaccinia virus
agauggaagggucaaacuu

SEQ ID NO: 3259896 - RNA, 15 nt, Vaccinia virus
agaacggagaauugu

SEQ ID NO: 3259897 - RNA, 22 nt, Vaccinia virus
auuaaucaaaugguaaauacug

SEQ ID NO: 3259898 - RNA, 15 nt, Vaccinia virus
ucuaauauuaauauu

SEQ ID NO: 3259899 - RNA, 14 nt, Vaccinia virus
uauaaucaaagauu

SEQ ID NO: 3259900 - RNA, 16 nt, Vaccinia virus
ucaaauuagauuucga

SEQ ID NO: 3259901 - RNA, 20 nt, Vaccinia virus
aauuugggaggcuuaaagug

SEQ ID NO: 3259902 - RNA, 19 nt, Vaccinia virus
acacgauuuaauccaucug

SEQ ID NO: 3259903 - RNA, 19 nt, Vaccinia virus
agaacauacauuuguaaaa

SEQ ID NO: 3259904 - RNA, 16 nt, Vaccinia virus
ugaaucuaacaaagag

SEQ ID NO: 3259905 - RNA, 20 nt, Vaccinia virus
aaguagaugguauuucugaa

SEQ ID NO: 3259906 - RNA, 14 nt, Vaccinia virus
uauccucagacucu

SEQ ID NO: 3259907 - RNA, 17 nt, Vaccinia virus
uuagauaauugugguaa

SEQ ID NO: 3259908 - RNA, 16 nt, Vaccinia virus
cuuuuuuccaaacugc

SEQ ID NO: 3259909 - RNA, 18 nt, Vaccinia virus
aacuucauccguuuccuu

SEQ ID NO: 3259910 - RNA, 19 nt, Vaccinia virus
guguauuaaauagaauauu

SEQ ID NO: 3259911 - RNA, 14 nt, Vaccinia virus
uuuaagcuaguuau

SEQ ID NO: 3259912 - RNA, 20 nt, Vaccinia virus
ucaugccauuaagaaacuag

SEQ ID NO: 3259913 - RNA, 13 nt, Vaccinia virus
ucuuauagaugua

SEQ ID NO: 3259914 - RNA, 12 nt, Vaccinia virus
accgauuucaca

SEQ ID NO: 3259915 - RNA, 18 nt, Vaccinia virus
aaauacaugggaaaugau

SEQ ID NO: 3259916 - RNA, 21 nt, Vaccinia virus
uuaguccugcguuagauguua

SEQ ID NO: 3259917 - RNA, 19 nt, Vaccinia virus
gcauuaacuagauuaauuu

SEQ ID NO: 3259918 - RNA, 22 nt, Vaccinia virus
auuugugccgcauacagaucaa

SEQ ID NO: 3259919 - RNA, 20 nt, Vaccinia virus
aguuuaauauccucagucau

SEQ ID NO: 3259920 - RNA, 14 nt, Vaccinia virus
uaaagucugucaaa

SEQ ID NO: 3259921 - RNA, 17 nt, Vaccinia virus
uaucuaccucuccaaaa

SEQ ID NO: 3259922 - RNA, 22 nt, Vaccinia virus
auguuaaauguagacaaauaua

SEQ ID NO: 3259923 - RNA, 16 nt, Vaccinia virus
agauuuauaauacuuu

SEQ ID NO: 3259924 - RNA, 20 nt, Vaccinia virus
accaaaaugaaaauacuuua

SEQ ID NO: 3259925 - RNA, 15 nt, Vaccinia virus
guuuuguuggagaac

SEQ ID NO: 3259926 - RNA, 23 nt, Vaccinia virus
aauauccacuauugcaacuauaa

SEQ ID NO: 3259927 - RNA, 21 nt, Vaccinia virus
aagauguuuucugucagaaaa

SEQ ID NO: 3259928 - RNA, 22 nt, Vaccinia virus
uaaucaaauuugguguuguuaa

SEQ ID NO: 3259929 - RNA, 18 nt, Vaccinia virus
uguuuccaugacauauua

SEQ ID NO: 3259930 - RNA, 18 nt, Vaccinia virus
auauaguguauaauaaag

SEQ ID NO: 3259931 - RNA, 12 nt, Vaccinia virus
cauuccaaagau

SEQ ID NO: 3259932 - RNA, 17 nt, Vaccinia virus
ucuauugccauuaguuu

SEQ ID NO: 3259933 - RNA, 21 nt, Vaccinia virus
auaguuuccaccgaaagacua

SEQ ID NO: 3259934 - RNA, 16 nt, Vaccinia virus
aucuccaguauuuaca

SEQ ID NO: 3259935 - RNA, 20 nt, Vaccinia virus
acugcaaaacucaaauguua

SEQ ID NO: 3259936 - RNA, 16 nt, Vaccinia virus
aucauccaguuuucca

SEQ ID NO: 3259937 - RNA, 15 nt, Vaccinia virus
uaagaagucauaugu

SEQ ID NO: 3259938 - RNA, 15 nt, Vaccinia virus
acgaauauuacuaau

SEQ ID NO: 3259939 - RNA, 16 nt, Vaccinia virus
agagauuguuaaauua

SEQ ID NO: 3259940 - RNA, 13 nt, Vaccinia virus
uauaaaaugacau

SEQ ID NO: 3259941 - RNA, 15 nt, Vaccinia virus
aaauaucaauuauau

SEQ ID NO: 3259942 - RNA, 23 nt, Vaccinia virus
ccaguacucgggucuaacaucuc

SEQ ID NO: 3259943 - RNA, 14 nt, Vaccinia virus
accuucuucauuuc

SEQ ID NO: 3259944 - RNA, 15 nt, Vaccinia virus
aucgaaaucauuuau

SEQ ID NO: 3259945 - RNA, 15 nt, Vaccinia virus
caaaucuaacuucua

SEQ ID NO: 3259946 - RNA, 18 nt, Vaccinia virus
aauaguccguguaaucca

SEQ ID NO: 3259947 - RNA, 20 nt, Vaccinia virus
acauaagaugucuaugaaua

SEQ ID NO: 3259948 - RNA, 23 nt, Vaccinia virus
gcaucauacgaaaauagauucua

SEQ ID NO: 3259949 - RNA, 19 nt, Vaccinia virus
agagauaggucuaaugcau

SEQ ID NO: 3259950 - RNA, 23 nt, Vaccinia virus
uauaaacuuuauccauaucucua

SEQ ID NO: 3259951 - RNA, 21 nt, Vaccinia virus
gacauacuguauguaaacaau

SEQ ID NO: 3259952 - RNA, 14 nt, Vaccinia virus
uaaacuuuaaugau

SEQ ID NO: 3259953 - RNA, 23 nt, Vaccinia virus
ggugccgcagcaagcauacagac

SEQ ID NO: 3259954 - RNA, 21 nt, Vaccinia virus
agaaaauaacagauauuacaa

SEQ ID NO: 3259955 - RNA, 19 nt, Vaccinia virus
gaauauacuaaucaauaau

SEQ ID NO: 3259956 - RNA, 15 nt, Vaccinia virus
gagacggauacuguc

SEQ ID NO: 3259957 - RNA, 22 nt, Vaccinia virus
ugauaauauuaaaagauggaua

SEQ ID NO: 3259958 - RNA, 21 nt, Vaccinia virus
acucaagcagaaacuuagauu

SEQ ID NO: 3259959 - RNA, 11 nt, Vaccinia virus
uagaauuuaua

SEQ ID NO: 3259960 - RNA, 16 nt, Vaccinia virus
auagauaaucaaaauu

SEQ ID NO: 3259961 - RNA, 18 nt, Vaccinia virus
ggcuagucaagaugauga

SEQ ID NO: 3259962 - RNA, 13 nt, Vaccinia virus
acacaucaaaaua

SEQ ID NO: 3259963 - RNA, 15 nt, Vaccinia virus
guuuuauaacgaagu

SEQ ID NO: 3259964 - RNA, 17 nt, Vaccinia virus
ccacugucacuggaaag

SEQ ID NO: 3259965 - RNA, 17 nt, Vaccinia virus
augguaaauaaauacuu

SEQ ID NO: 3259966 - RNA, 22 nt, Vaccinia virus
auaaaaauaguaucaacaauca

SEQ ID NO: 3259967 - RNA, 17 nt, Vaccinia virus
cuugauacuauccagua

SEQ ID NO: 3259968 - RNA, 17 nt, Vaccinia virus
acauuguuuauggugau

SEQ ID NO: 3259969 - RNA, 20 nt, Vaccinia virus
caucggaaaaaaaucuuuuu

SEQ ID NO: 3259970 - RNA, 21 nt, Vaccinia virus
aauuaguagaaucaaaggaua

SEQ ID NO: 3259971 - RNA, 13 nt, Vaccinia virus
aauauccucaaua

SEQ ID NO: 3259972 - RNA, 14 nt, Vaccinia virus
aauuggaacacaag

SEQ ID NO: 3259973 - RNA, 15 nt, Vaccinia virus
uuggucgauguaaaa

SEQ ID NO: 3259974 - RNA, 12 nt, Vaccinia virus
uaacacaaccaa

SEQ ID NO: 3259975 - RNA, 16 nt, Vaccinia virus
uaucaauaccuuuucu

SEQ ID NO: 3259976 - RNA, 15 nt, Vaccinia virus
auaugauagaaauga

SEQ ID NO: 3259977 - RNA, 15 nt, Vaccinia virus
gaucaacagaaauau

SEQ ID NO: 3259978 - RNA, 17 nt, Vaccinia virus
ggauuacaagaaauaug

SEQ ID NO: 3259979 - RNA, 19 nt, Vaccinia virus
uaugauuuuuaaucaagau

SEQ ID NO: 3259980 - RNA, 18 nt, Vaccinia virus
acugagaaguuauuaucu

SEQ ID NO: 3259981 - RNA, 20 nt, Vaccinia virus
acuaaacacacauuauucag

SEQ ID NO: 3259982 - RNA, 22 nt, Vaccinia virus
cguguauuaaauagaauauuua

SEQ ID NO: 3259983 - RNA, 13 nt, Vaccinia virus
uucgaaaauacua

SEQ ID NO: 3259984 - RNA, 14 nt, Vaccinia virus
uagccaccauaaug

SEQ ID NO: 3259985 - RNA, 19 nt, Vaccinia virus
cauuaggaaauguuucuga

SEQ ID NO: 3259986 - RNA, 23 nt, Vaccinia virus
agacgcuauggcacgaaauaucu

SEQ ID NO: 3259987 - RNA, 21 nt, Vaccinia virus
auccagcuagugaauauauau

SEQ ID NO: 3259988 - RNA, 13 nt, Vaccinia virus
cucuuucuccuuc

SEQ ID NO: 3259989 - RNA, 17 nt, Vaccinia virus
gucaucuuauguuuuua

SEQ ID NO: 3259990 - RNA, 15 nt, Vaccinia virus
auccaugauagaaag

SEQ ID NO: 3259991 - RNA, 20 nt, Vaccinia virus
uuacaaaugaguucugugua

SEQ ID NO: 3259992 - RNA, 16 nt, Vaccinia virus
agauuccuauuuacaa

SEQ ID NO: 3259993 - RNA, 23 nt, Vaccinia virus
ucuuuaauaucgacaauuucaua

SEQ ID NO: 3259994 - RNA, 14 nt, Vaccinia virus
auacuucaaaauuu

SEQ ID NO: 3259995 - RNA, 19 nt, Vaccinia virus
ucuauguugacauguauau

SEQ ID NO: 3259996 - RNA, 19 nt, Vaccinia virus
uccauaaauuuauaauguu

SEQ ID NO: 3259997 - RNA, 18 nt, Vaccinia virus
uagguuuaguaucucaau

SEQ ID NO: 3259998 - RNA, 18 nt, Vaccinia virus
aacaguuacuguuaguau

SEQ ID NO: 3259999 - RNA, 23 nt, Vaccinia virus
uuaacgucuaccgaaacaucguu

SEQ ID NO: 3260000 - RNA, 21 nt, Vaccinia virus
auggaaacggaacagaaacua

SEQ ID NO: 3260001 - RNA, 14 nt, Vaccinia virus
aauauauugaucau

SEQ ID NO: 3260002 - RNA, 14 nt, Vaccinia virus
uugcuaacgguauu

SEQ ID NO: 3260003 - RNA, 16 nt, Vaccinia virus
gaauuguuucuuuuag

SEQ ID NO: 3260004 - RNA, 19 nt, Vaccinia virus
guuuaauacuuauucauau

SEQ ID NO: 3260005 - RNA, 18 nt, Vaccinia virus
cuagagcaucaauguccu

SEQ ID NO: 3260006 - RNA, 19 nt, Vaccinia virus
uauauaucuaucuauuaca

SEQ ID NO: 3260007 - RNA, 18 nt, Vaccinia virus
agcggggucgaucuugug

SEQ ID NO: 3260008 - RNA, 17 nt, Vaccinia virus
uauaaaaccaaggacuu

SEQ ID NO: 3260009 - RNA, 19 nt, Vaccinia virus
ugacguacaaaaaaauaaa

SEQ ID NO: 3260010 - RNA, 20 nt, Vaccinia virus
aguuucaucgauaaaggaua

SEQ ID NO: 3260011 - RNA, 15 nt, Vaccinia virus
aucuauauauguauu

SEQ ID NO: 3260012 - RNA, 16 nt, Vaccinia virus
acuaaucucauuguuu

SEQ ID NO: 3260013 - RNA, 16 nt, Vaccinia virus
gccuguacuuggauuu

SEQ ID NO: 3260014 - RNA, 23 nt, Vaccinia virus
uugaggcagcaaauacugaacca

SEQ ID NO: 3260015 - RNA, 13 nt, Vaccinia virus
acaguuucuguaa

SEQ ID NO: 3260016 - RNA, 18 nt, Vaccinia virus
gauacauuguaugaugau

SEQ ID NO: 3260017 - RNA, 20 nt, Vaccinia virus
caccagaauagcuauggauu

SEQ ID NO: 3260018 - RNA, 15 nt, Vaccinia virus
accaaauuaaugaau

SEQ ID NO: 3260019 - RNA, 12 nt, Vaccinia virus
auuuauaaugag

SEQ ID NO: 3260020 - RNA, 13 nt, Vaccinia virus
uugcaauugguaa

SEQ ID NO: 3260021 - RNA, 15 nt, Vaccinia virus
uauuuaacucaugau

SEQ ID NO: 3260022 - RNA, 17 nt, Vaccinia virus
uaguuaucuaucuuaaa

SEQ ID NO: 3260023 - RNA, 20 nt, Vaccinia virus
aauauagaucgaaaaauaua

SEQ ID NO: 3260024 - RNA, 19 nt, Vaccinia virus
cauuuauaaagacaaacaa

SEQ ID NO: 3260025 - RNA, 19 nt, Vaccinia virus
uauuacgcuuaccaucaaa

SEQ ID NO: 3260026 - RNA, 21 nt, Vaccinia virus
ggaaaagucaaagucguuuaa

SEQ ID NO: 3260027 - RNA, 23 nt, Vaccinia virus
caauauagucuguguuccauaau

SEQ ID NO: 3260028 - RNA, 12 nt, Vaccinia virus
uaauccaaauau

SEQ ID NO: 3260029 - RNA, 23 nt, Vaccinia virus
gaauagccgccggaaacuuucua

SEQ ID NO: 3260030 - RNA, 13 nt, Vaccinia virus
augaucuguuuau

SEQ ID NO: 3260031 - RNA, 22 nt, Vaccinia virus
cacaaauggauguuaauguauu

SEQ ID NO: 3260032 - RNA, 21 nt, Vaccinia virus
aaauagcgauugguguuguaa

SEQ ID NO: 3260033 - RNA, 21 nt, Vaccinia virus
acaucucuggaaauagaauuc

SEQ ID NO: 3260034 - RNA, 23 nt, Vaccinia virus
gcaaacaacaacaaaauaauaau

SEQ ID NO: 3260035 - RNA, 12 nt, Vaccinia virus
gucuuacacauu

SEQ ID NO: 3260036 - RNA, 21 nt, Vaccinia virus
ccaaacucagaaccaaaugau

SEQ ID NO: 3260037 - RNA, 11 nt, Vaccinia virus
guauuuggauu

SEQ ID NO: 3260038 - RNA, 18 nt, Vaccinia virus
augaucaggaaaguuuau

SEQ ID NO: 3260039 - RNA, 15 nt, Vaccinia virus
cgccgcguucucugu

SEQ ID NO: 3260040 - RNA, 19 nt, Vaccinia virus
cuagaaaacgaaaacaucc

SEQ ID NO: 3260041 - RNA, 22 nt, Vaccinia virus
uccaccgacucauuauuuccca

SEQ ID NO: 3260042 - RNA, 21 nt, Vaccinia virus
ucuuuacaguuucuguaauga

SEQ ID NO: 3260043 - RNA, 21 nt, Vaccinia virus
aauaugauuuggccaaaugua

SEQ ID NO: 3260044 - RNA, 24 nt, Vaccinia virus
acuauaggugcguuguauacacau

SEQ ID NO: 3260045 - RNA, 18 nt, Vaccinia virus
uguaauuuagaauacguu

SEQ ID NO: 3260046 - RNA, 12 nt, Vaccinia virus
guucaaauuaag

SEQ ID NO: 3260047 - RNA, 19 nt, Vaccinia virus
aaccugaucuggaaaauaa

SEQ ID NO: 3260048 - RNA, 15 nt, Vaccinia virus
cgaaucuaugauauu

SEQ ID NO: 3260049 - RNA, 18 nt, Vaccinia virus
ugcgccgacgaggaugaa

SEQ ID NO: 3260050 - RNA, 21 nt, Vaccinia virus
cauucacugcagcauuuugag

SEQ ID NO: 3260051 - RNA, 14 nt, Vaccinia virus
cuaacuuuaaacaa

SEQ ID NO: 3260052 - RNA, 23 nt, Vaccinia virus
aucaacuaccuaaggaauauuca

SEQ ID NO: 3260053 - RNA, 23 nt, Vaccinia virus
uauuaagccgccauuaauuacuu

SEQ ID NO: 3260054 - RNA, 22 nt, Vaccinia virus
auauuaauacacauaaugaagu

SEQ ID NO: 3260055 - RNA, 14 nt, Vaccinia virus
auaauuauuuccag

SEQ ID NO: 3260056 - RNA, 15 nt, Vaccinia virus
caugucaacaaaaau

SEQ ID NO: 3260057 - RNA, 15 nt, Vaccinia virus
uucauuaauaucuuu

SEQ ID NO: 3260058 - RNA, 17 nt, Vaccinia virus
uguaugucucaauacua

SEQ ID NO: 3260059 - RNA, 23 nt, Vaccinia virus
aguugacacguuuauuucauaua

SEQ ID NO: 3260060 - RNA, 14 nt, Vaccinia virus
agagaugaaaaauu

SEQ ID NO: 3260061 - RNA, 14 nt, Vaccinia virus
aauuauauguagaa

SEQ ID NO: 3260062 - RNA, 16 nt, Vaccinia virus
auuucuaagagaauga

SEQ ID NO: 3260063 - RNA, 17 nt, Vaccinia virus
aaaaauuuaaagaaugu

SEQ ID NO: 3260064 - RNA, 15 nt, Vaccinia virus
aauucaucuucuaua

SEQ ID NO: 3260065 - RNA, 17 nt, Vaccinia virus
gucuuccuuauguagag

SEQ ID NO: 3260066 - RNA, 13 nt, Vaccinia virus
augaagaaagaaa

SEQ ID NO: 3260067 - RNA, 20 nt, Vaccinia virus
aaauccaugcaaaaaaaugu

SEQ ID NO: 3260068 - RNA, 22 nt, Vaccinia virus
guauccuauuccacauuuuguu

SEQ ID NO: 3260069 - RNA, 19 nt, Vaccinia virus
uuuuccaucuauguagaau

SEQ ID NO: 3260070 - RNA, 14 nt, Vaccinia virus
aauuguuucuuuua

SEQ ID NO: 3260071 - RNA, 11 nt, Vaccinia virus
ugaaauuauuc

SEQ ID NO: 3260072 - RNA, 12 nt, Vaccinia virus
uauuagaauuaa

SEQ ID NO: 3260073 - RNA, 15 nt, Vaccinia virus
aagaguauacagaag

SEQ ID NO: 3260074 - RNA, 21 nt, Vaccinia virus
cauuacuaacuuuaucacaau

SEQ ID NO: 3260075 - RNA, 15 nt, Vaccinia virus
ccguuuaauuuccua

SEQ ID NO: 3260076 - RNA, 19 nt, Vaccinia virus
uagcacauccaucaaagaa

SEQ ID NO: 3260077 - RNA, 13 nt, Vaccinia virus
auuaauuguuaaa

SEQ ID NO: 3260078 - RNA, 12 nt, Vaccinia virus
ucauuaaauguu

SEQ ID NO: 3260079 - RNA, 15 nt, Vaccinia virus
aaucacuauagaaaa

SEQ ID NO: 3260080 - RNA, 21 nt, Vaccinia virus
aaaaauuuuaagcgaugauau

SEQ ID NO: 3260081 - RNA, 16 nt, Vaccinia virus
uaacugcuguguguau

SEQ ID NO: 3260082 - RNA, 19 nt, Vaccinia virus
acggauaucuaauauuaau

SEQ ID NO: 3260083 - RNA, 15 nt, Vaccinia virus
gaaaaaaauucaguu

SEQ ID NO: 3260084 - RNA, 20 nt, Vaccinia virus
aaauaacauauagauuuuau

SEQ ID NO: 3260085 - RNA, 19 nt, Vaccinia virus
uaaaaagaugauauaucua

SEQ ID NO: 3260086 - RNA, 13 nt, Vaccinia virus
uaccuacacuauu

SEQ ID NO: 3260087 - RNA, 18 nt, Vaccinia virus
auaguauuaaugauugcc

SEQ ID NO: 3260088 - RNA, 19 nt, Vaccinia virus
caaauagagauaaaacaag

SEQ ID NO: 3260089 - RNA, 22 nt, Vaccinia virus
ucaaucguuuaaaguaaacuuc

SEQ ID NO: 3260090 - RNA, 22 nt, Vaccinia virus
uauaauguucgccauuuauaua

SEQ ID NO: 3260091 - RNA, 16 nt, Vaccinia virus
uuugguauauacauag

SEQ ID NO: 3260092 - RNA, 21 nt, Vaccinia virus
uguucauaauugcuuuucuaa

SEQ ID NO: 3260093 - RNA, 16 nt, Vaccinia virus
cugaaaagaaaguauc

SEQ ID NO: 3260094 - RNA, 23 nt, Vaccinia virus
uaguaauuuauauuuuuacggua

SEQ ID NO: 3260095 - RNA, 18 nt, Vaccinia virus
aaugcacacaguauuauc

SEQ ID NO: 3260096 - RNA, 15 nt, Vaccinia virus
uauucaguuuauaga

SEQ ID NO: 3260097 - RNA, 16 nt, Vaccinia virus
accauagaagauguua

SEQ ID NO: 3260098 - RNA, 16 nt, Vaccinia virus
aaagaggaucguacau

SEQ ID NO: 3260099 - RNA, 18 nt, Vaccinia virus
gaagcaaugaaaucacuu

SEQ ID NO: 3260100 - RNA, 18 nt, Vaccinia virus
cauauagaugcagaagua

SEQ ID NO: 3260101 - RNA, 18 nt, Vaccinia virus
uaguugauuuauuacuua

SEQ ID NO: 3260102 - RNA, 13 nt, Vaccinia virus
ccauaauaguuua

SEQ ID NO: 3260103 - RNA, 16 nt, Vaccinia virus
cucaucggaucuguaa

SEQ ID NO: 3260104 - RNA, 17 nt, Vaccinia virus
ucucugacauucagaaa

SEQ ID NO: 3260105 - RNA, 15 nt, Vaccinia virus
uguuuuuguuuucau

SEQ ID NO: 3260106 - RNA, 13 nt, Vaccinia virus
uuacaucauuaag

SEQ ID NO: 3260107 - RNA, 14 nt, Vaccinia virus
caaaucaacucaua

SEQ ID NO: 3260108 - RNA, 18 nt, Vaccinia virus
agauauagaagauaaaca

SEQ ID NO: 3260109 - RNA, 21 nt, Vaccinia virus
agaauuauaccgauagauaau

SEQ ID NO: 3260110 - RNA, 14 nt, Vaccinia virus
auaauugcuuuucu

SEQ ID NO: 3260111 - RNA, 20 nt, Vaccinia virus
auauauggauaaugcuguau

SEQ ID NO: 3260112 - RNA, 15 nt, Vaccinia virus
guuauuaucaucauu

SEQ ID NO: 3260113 - RNA, 18 nt, Vaccinia virus
agauaucagagaacuucu

SEQ ID NO: 3260114 - RNA, 18 nt, Vaccinia virus
uuuaaacacucuuucuga

SEQ ID NO: 3260115 - RNA, 22 nt, Vaccinia virus
auacuguauauacuauuauaga

SEQ ID NO: 3260116 - RNA, 14 nt, Vaccinia virus
aguggauucuucua

SEQ ID NO: 3260117 - RNA, 18 nt, Vaccinia virus
uguuguaaggauccuggu

SEQ ID NO: 3260118 - RNA, 15 nt, Vaccinia virus
ugaaugcugaugaac

SEQ ID NO: 3260119 - RNA, 11 nt, Vaccinia virus
uccuguuucau

SEQ ID NO: 3260120 - RNA, 23 nt, Vaccinia virus
uucuccuggagggauaguauaau

SEQ ID NO: 3260121 - RNA, 14 nt, Vaccinia virus
cacuguuaaaguua

SEQ ID NO: 3260122 - RNA, 14 nt, Vaccinia virus
aucaacuacauaau

SEQ ID NO: 3260123 - RNA, 16 nt, Vaccinia virus
aggggagguaaauaua

SEQ ID NO: 3260124 - RNA, 15 nt, Vaccinia virus
uuacguuaauacuaa

SEQ ID NO: 3260125 - RNA, 17 nt, Vaccinia virus
cugacauucagaaagag

SEQ ID NO: 3260126 - RNA, 15 nt, Vaccinia virus
acauucuuauaacau

SEQ ID NO: 3260127 - RNA, 20 nt, Vaccinia virus
uaagucuuacaauguucgaa

SEQ ID NO: 3260128 - RNA, 15 nt, Vaccinia virus
auacauaucaauauc

SEQ ID NO: 3260129 - RNA, 22 nt, Vaccinia virus
cugaaaauuggaguuagguauu

SEQ ID NO: 3260130 - RNA, 19 nt, Vaccinia virus
caguaaccaaauacauauu

SEQ ID NO: 3260131 - RNA, 17 nt, Vaccinia virus
agcuuacaauaaacucc

SEQ ID NO: 3260132 - RNA, 16 nt, Vaccinia virus
ucuuacauucuauaga

SEQ ID NO: 3260133 - RNA, 16 nt, Vaccinia virus
acuauuuggauagaca

SEQ ID NO: 3260134 - RNA, 16 nt, Vaccinia virus
ucaucuucuauauaag

SEQ ID NO: 3260135 - RNA, 15 nt, Vaccinia virus
aauuacagacagcaa

SEQ ID NO: 3260136 - RNA, 16 nt, Vaccinia virus
uauauucgaauucaaa

SEQ ID NO: 3260137 - RNA, 19 nt, Vaccinia virus
auaucgguaccguuaaaga

SEQ ID NO: 3260138 - RNA, 16 nt, Vaccinia virus
uacucguuaguuugga

SEQ ID NO: 3260139 - RNA, 16 nt, Vaccinia virus
aauacugaugcauuuu

SEQ ID NO: 3260140 - RNA, 15 nt, Vaccinia virus
auauuaaugucguau

SEQ ID NO: 3260141 - RNA, 17 nt, Vaccinia virus
aucaaugaguaagacuu

SEQ ID NO: 3260142 - RNA, 19 nt, Vaccinia virus
ucacgauguaggaauauag

SEQ ID NO: 3260143 - RNA, 11 nt, Vaccinia virus
guuuuuacaga

SEQ ID NO: 3260144 - RNA, 13 nt, Vaccinia virus
cuguucuauuuug

SEQ ID NO: 3260145 - RNA, 22 nt, Vaccinia virus
ugcuuaauacaccguuaacaau

SEQ ID NO: 3260146 - RNA, 16 nt, Vaccinia virus
aauauaccauuaaaaa

SEQ ID NO: 3260147 - RNA, 13 nt, Vaccinia virus
uaaagauaaacau

SEQ ID NO: 3260148 - RNA, 14 nt, Vaccinia virus
ucugacauaaacau

SEQ ID NO: 3260149 - RNA, 13 nt, Vaccinia virus
aaguuauagaaug

SEQ ID NO: 3260150 - RNA, 22 nt, Vaccinia virus
uuaacgauuggaaaucauuaac

SEQ ID NO: 3260151 - RNA, 21 nt, Vaccinia virus
auacauaccugauuagaauuc

SEQ ID NO: 3260152 - RNA, 20 nt, Vaccinia virus
guauccauuuuauaucacua

SEQ ID NO: 3260153 - RNA, 12 nt, Vaccinia virus
uauaauaucuuu

SEQ ID NO: 3260154 - RNA, 12 nt, Vaccinia virus
auauauuuguau

SEQ ID NO: 3260155 - RNA, 13 nt, Vaccinia virus
cuauguuuauaga

SEQ ID NO: 3260156 - RNA, 17 nt, Vaccinia virus
auuuguucaagauagau

SEQ ID NO: 3260157 - RNA, 16 nt, Vaccinia virus
aaagcgcuauagagua

SEQ ID NO: 3260158 - RNA, 19 nt, Vaccinia virus
caauuuauacggauuucua

SEQ ID NO: 3260159 - RNA, 13 nt, Vaccinia virus
gauuguguuauau

SEQ ID NO: 3260160 - RNA, 17 nt, Vaccinia virus
uaaagaaaugucuacau

SEQ ID NO: 3260161 - RNA, 22 nt, Vaccinia virus
caaacgugaguauuuuacucau

SEQ ID NO: 3260162 - RNA, 18 nt, Vaccinia virus
ucgggacgcguauauguu

SEQ ID NO: 3260163 - RNA, 15 nt, Vaccinia virus
aguuuguuuuggaaa

SEQ ID NO: 3260164 - RNA, 14 nt, Vaccinia virus
caaaucacugaaaa

SEQ ID NO: 3260165 - RNA, 14 nt, Vaccinia virus
aaugcagaaaugau

SEQ ID NO: 3260166 - RNA, 13 nt, Vaccinia virus
cauagcaauacuu

SEQ ID NO: 3260167 - RNA, 18 nt, Vaccinia virus
uaucaccguuaaugaggu

SEQ ID NO: 3260168 - RNA, 13 nt, Vaccinia virus
gauaauuauccau

SEQ ID NO: 3260169 - RNA, 13 nt, Vaccinia virus
auacuauauguau

SEQ ID NO: 3260170 - RNA, 20 nt, Vaccinia virus
uaucauuuugauuaauuguu

SEQ ID NO: 3260171 - RNA, 19 nt, Vaccinia virus
ucaaaguccggauguauua

SEQ ID NO: 3260172 - RNA, 22 nt, Vaccinia virus
ucagaauaggaugaauauagua

SEQ ID NO: 3260173 - RNA, 18 nt, Vaccinia virus
augcgauucaaaaaagaa

SEQ ID NO: 3260174 - RNA, 20 nt, Vaccinia virus
uauacggcuacaauuucaua

SEQ ID NO: 3260175 - RNA, 14 nt, Vaccinia virus
augaauaaguguga

SEQ ID NO: 3260176 - RNA, 17 nt, Vaccinia virus
auuaaauguuugaucaa

SEQ ID NO: 3260177 - RNA, 19 nt, Vaccinia virus
auugauaucgcauagaaau

SEQ ID NO: 3260178 - RNA, 16 nt, Vaccinia virus
auagauauaauuuuau

SEQ ID NO: 3260179 - RNA, 19 nt, Vaccinia virus
acaaauucuauauauguuu

SEQ ID NO: 3260180 - RNA, 15 nt, Vaccinia virus
uaacagauacauaaa

SEQ ID NO: 3260181 - RNA, 22 nt, Vaccinia virus
cauuuauggguaucaaaaacuu

SEQ ID NO: 3260182 - RNA, 16 nt, Vaccinia virus
ugauagagacaaacua

SEQ ID NO: 3260183 - RNA, 14 nt, Vaccinia virus
aucaugaaaugaug

SEQ ID NO: 3260184 - RNA, 18 nt, Vaccinia virus
cauaguuuuuacacauag

SEQ ID NO: 3260185 - RNA, 16 nt, Vaccinia virus
uagucaaucaaagaga

SEQ ID NO: 3260186 - RNA, 12 nt, Vaccinia virus
auuuugaggaaa

SEQ ID NO: 3260187 - RNA, 20 nt, Vaccinia virus
acuauaguacaccuagagaa

SEQ ID NO: 3260188 - RNA, 15 nt, Vaccinia virus
aauauaauaaauaua

SEQ ID NO: 3260189 - RNA, 10 nt, Vaccinia virus
agauauuaau

SEQ ID NO: 3260190 - RNA, 18 nt, Vaccinia virus
guaauauggaauaguguu

SEQ ID NO: 3260191 - RNA, 13 nt, Vaccinia virus
cauguauccacuu

SEQ ID NO: 3260192 - RNA, 23 nt, Vaccinia virus
aauauuguuuuucacuuuuuaua

SEQ ID NO: 3260193 - RNA, 14 nt, Vaccinia virus
aaagacaaauauau

SEQ ID NO: 3260194 - RNA, 13 nt, Vaccinia virus
uuaaaaauuuuca

SEQ ID NO: 3260195 - RNA, 14 nt, Vaccinia virus
auauuagaaauaca

SEQ ID NO: 3260196 - RNA, 21 nt, Vaccinia virus
acagauguaaauauauuuaca

SEQ ID NO: 3260197 - RNA, 15 nt, Vaccinia virus
agauugaaauuauau

SEQ ID NO: 3260198 - RNA, 13 nt, Vaccinia virus
ucaagucaaugau

SEQ ID NO: 3260199 - RNA, 16 nt, Vaccinia virus
uagaaguuguaaauga

SEQ ID NO: 3260200 - RNA, 18 nt, Vaccinia virus
auaacugguucaaaauua

SEQ ID NO: 3260201 - RNA, 20 nt, Vaccinia virus
aauaguuuuuuuguuuccuu

SEQ ID NO: 3260202 - RNA, 19 nt, Vaccinia virus
agcucauaugauuucagua

SEQ ID NO: 3260203 - RNA, 20 nt, Vaccinia virus
ucauuguccagauugaacau

SEQ ID NO: 3260204 - RNA, 17 nt, Vaccinia virus
auaaacaugucuauugu

SEQ ID NO: 3260205 - RNA, 20 nt, Vaccinia virus
cauaaacuuucuagacaucu

SEQ ID NO: 3260206 - RNA, 20 nt, Vaccinia virus
auagaugcaagguauaaccu

SEQ ID NO: 3260207 - RNA, 13 nt, Vaccinia virus
uguuuaauacuua

SEQ ID NO: 3260208 - RNA, 20 nt, Vaccinia virus
aaucuuuguucuaaaaacug

SEQ ID NO: 3260209 - RNA, 22 nt, Vaccinia virus
uggucaauagcgauaugugauu

SEQ ID NO: 3260210 - RNA, 13 nt, Vaccinia virus
ucagacaacaucu

SEQ ID NO: 3260211 - RNA, 19 nt, Vaccinia virus
auuaugauacucuuauaga

SEQ ID NO: 3260212 - RNA, 20 nt, Vaccinia virus
gaaauguuauauauaaaaga

SEQ ID NO: 3260213 - RNA, 17 nt, Vaccinia virus
augacaacucaaacauc

SEQ ID NO: 3260214 - RNA, 16 nt, Vaccinia virus
ccaaagucgauaacga

SEQ ID NO: 3260215 - RNA, 23 nt, Vaccinia virus
ugagaaaagguucuaucaacaau

SEQ ID NO: 3260216 - RNA, 20 nt, Vaccinia virus
auggauuuaucauaucaugg

SEQ ID NO: 3260217 - RNA, 21 nt, Vaccinia virus
cuaacaaaaauuaugaaauaa

SEQ ID NO: 3260218 - RNA, 18 nt, Vaccinia virus
auauuuacaguuacuaaa

SEQ ID NO: 3260219 - RNA, 14 nt, Vaccinia virus
cuauaaacugaaua

SEQ ID NO: 3260220 - RNA, 18 nt, Vaccinia virus
aaauaccuuuaacuauau

SEQ ID NO: 3260221 - RNA, 22 nt, Vaccinia virus
uuggcauuuaacagauucacaa

SEQ ID NO: 3260222 - RNA, 18 nt, Vaccinia virus
uauuaacgcaccuauaaa

SEQ ID NO: 3260223 - RNA, 16 nt, Vaccinia virus
auuaagcaacaugucu

SEQ ID NO: 3260224 - RNA, 20 nt, Vaccinia virus
uaaaaucucagauugugcau

SEQ ID NO: 3260225 - RNA, 23 nt, Vaccinia virus
cgaagugcguguaacaaaguauu

SEQ ID NO: 3260226 - RNA, 16 nt, Vaccinia virus
aacaucucucauaaga

SEQ ID NO: 3260227 - RNA, 19 nt, Vaccinia virus
cacuuaaugguauaaugau

SEQ ID NO: 3260228 - RNA, 20 nt, Vaccinia virus
aaaauauuaaaccucuuucu

SEQ ID NO: 3260229 - RNA, 18 nt, Vaccinia virus
uucauuagauaacagugu

SEQ ID NO: 3260230 - RNA, 21 nt, Vaccinia virus
aaaagacgcuuguuaauaagu

SEQ ID NO: 3260231 - RNA, 17 nt, Vaccinia virus
auaauaaaaguuaucca

SEQ ID NO: 3260232 - RNA, 23 nt, Vaccinia virus
uuauagcguacaauacauguaca

SEQ ID NO: 3260233 - RNA, 18 nt, Vaccinia virus
uuccugaaggaaaugaac

SEQ ID NO: 3260234 - RNA, 16 nt, Vaccinia virus
gaaauaauuuuuaguu

SEQ ID NO: 3260235 - RNA, 19 nt, Vaccinia virus
gaaaaauuauaauguuucc

SEQ ID NO: 3260236 - RNA, 17 nt, Vaccinia virus
acgauacuaugcauauu

SEQ ID NO: 3260237 - RNA, 16 nt, Vaccinia virus
uuaacacucucugcca

SEQ ID NO: 3260238 - RNA, 22 nt, Vaccinia virus
acaaguuauacgucauuucauc

SEQ ID NO: 3260239 - RNA, 18 nt, Vaccinia virus
aacaacaaauaaaaaggu

SEQ ID NO: 3260240 - RNA, 21 nt, Vaccinia virus
agcguacagauacgaugauga

SEQ ID NO: 3260241 - RNA, 16 nt, Vaccinia virus
uauuccaaucauugau

SEQ ID NO: 3260242 - RNA, 23 nt, Vaccinia virus
caugaaaccacugucuaaaugua

SEQ ID NO: 3260243 - RNA, 17 nt, Vaccinia virus
acugcugugaauacagc

SEQ ID NO: 3260244 - RNA, 16 nt, Vaccinia virus
ugggucuaguuuucag

SEQ ID NO: 3260245 - RNA, 17 nt, Vaccinia virus
acacuaauauuaugaug

SEQ ID NO: 3260246 - RNA, 20 nt, Vaccinia virus
agagaggcugcugaaaauaa

SEQ ID NO: 3260247 - RNA, 14 nt, Vaccinia virus
gacgauuucugaau

SEQ ID NO: 3260248 - RNA, 13 nt, Vaccinia virus
aaaugauuuugua

SEQ ID NO: 3260249 - RNA, 16 nt, Vaccinia virus
agaauacugaucuucu

SEQ ID NO: 3260250 - RNA, 14 nt, Vaccinia virus
uuaaauuauuauua

SEQ ID NO: 3260251 - RNA, 23 nt, Vaccinia virus
uaucaucgauaguauaauuauau

SEQ ID NO: 3260252 - RNA, 14 nt, Vaccinia virus
acuuuauauuuccu

SEQ ID NO: 3260253 - RNA, 16 nt, Vaccinia virus
uaguauaccaugaccu

SEQ ID NO: 3260254 - RNA, 11 nt, Vaccinia virus
uuccaaacauu

SEQ ID NO: 3260255 - RNA, 13 nt, Vaccinia virus
uucaaaauuauuu

SEQ ID NO: 3260256 - RNA, 21 nt, Vaccinia virus
auaucgguaccguuaaagaug

SEQ ID NO: 3260257 - RNA, 24 nt, Vaccinia virus
auauucuuaaaagguuucauauuu

SEQ ID NO: 3260258 - RNA, 20 nt, Vaccinia virus
uaccagauauuauacaaaau

SEQ ID NO: 3260259 - RNA, 16 nt, Vaccinia virus
auggaguacuauuuua

SEQ ID NO: 3260260 - RNA, 11 nt, Vaccinia virus
cgaaugauaua

SEQ ID NO: 3260261 - RNA, 21 nt, Vaccinia virus
uagaucgucuaaaagaauugc

SEQ ID NO: 3260262 - RNA, 20 nt, Vaccinia virus
aucuaguuguggaaauacuu

SEQ ID NO: 3260263 - RNA, 23 nt, Vaccinia virus
aucaacgaguucaaauaugaaau

SEQ ID NO: 3260264 - RNA, 22 nt, Vaccinia virus
auccguuacaauuuguuaaaaa

SEQ ID NO: 3260265 - RNA, 15 nt, Vaccinia virus
acuuuuuauacuaau

SEQ ID NO: 3260266 - RNA, 21 nt, Vaccinia virus
auauagaaccugaucuggaaa

SEQ ID NO: 3260267 - RNA, 18 nt, Vaccinia virus
ucguguauaacaucuuug

SEQ ID NO: 3260268 - RNA, 17 nt, Vaccinia virus
aaaugguaaauacugua

SEQ ID NO: 3260269 - RNA, 16 nt, Vaccinia virus
gagguauauaucauga

SEQ ID NO: 3260270 - RNA, 23 nt, Vaccinia virus
auuauaugggguuacucuaaauc

SEQ ID NO: 3260271 - RNA, 22 nt, Vaccinia virus
uauuacaauuugcauguugcau

SEQ ID NO: 3260272 - RNA, 14 nt, Vaccinia virus
augauucaaauccu

SEQ ID NO: 3260273 - RNA, 22 nt, Vaccinia virus
uuaaauaacccgaguauugaaa

SEQ ID NO: 3260274 - RNA, 20 nt, Vaccinia virus
aguaucaacaaucaacuaau

SEQ ID NO: 3260275 - RNA, 17 nt, Vaccinia virus
ccaauuacaaaaacuac

SEQ ID NO: 3260276 - RNA, 16 nt, Vaccinia virus
ggaaccucgagaaugu

SEQ ID NO: 3260277 - RNA, 23 nt, Vaccinia virus
gaaugccacgguuccaaguauau

SEQ ID NO: 3260278 - RNA, 22 nt, Vaccinia virus
accauaacuguauaaaauggag

SEQ ID NO: 3260279 - RNA, 15 nt, Vaccinia virus
gaauagauuacucau

SEQ ID NO: 3260280 - RNA, 17 nt, Vaccinia virus
agaaugugauaagaucg

SEQ ID NO: 3260281 - RNA, 14 nt, Vaccinia virus
accgaccuguauac

SEQ ID NO: 3260282 - RNA, 13 nt, Vaccinia virus
cuaacguauucua

SEQ ID NO: 3260283 - RNA, 23 nt, Vaccinia virus
agugugaauaugaucuucaucua

SEQ ID NO: 3260284 - RNA, 21 nt, Vaccinia virus
cuuaucacgugcaaggcauuu

SEQ ID NO: 3260285 - RNA, 14 nt, Vaccinia virus
uuacuuaaaugccu

SEQ ID NO: 3260286 - RNA, 17 nt, Vaccinia virus
ccuuuuccuuaucuuca

SEQ ID NO: 3260287 - RNA, 23 nt, Vaccinia virus
uguauucagaauuaauagauaua

SEQ ID NO: 3260288 - RNA, 20 nt, Vaccinia virus
aguaaagauuucaaagaugu

SEQ ID NO: 3260289 - RNA, 16 nt, Vaccinia virus
uacugcuggaaaauaa

SEQ ID NO: 3260290 - RNA, 13 nt, Vaccinia virus
cuuauuaacauuu

SEQ ID NO: 3260291 - RNA, 22 nt, Vaccinia virus
guaaaccgauaguguauaaaga

SEQ ID NO: 3260292 - RNA, 23 nt, Vaccinia virus
ugguacguaaccgaaucuuccca

SEQ ID NO: 3260293 - RNA, 19 nt, Vaccinia virus
acuuuaaauacuuaacaga

SEQ ID NO: 3260294 - RNA, 21 nt, Vaccinia virus
aauaauuuugaagcauuggaa

SEQ ID NO: 3260295 - RNA, 15 nt, Vaccinia virus
uuuccuuccaaugau

SEQ ID NO: 3260296 - RNA, 14 nt, Vaccinia virus
uaacuuaauuuauu

SEQ ID NO: 3260297 - RNA, 14 nt, Vaccinia virus
uaucauaauuaaau

SEQ ID NO: 3260298 - RNA, 14 nt, Vaccinia virus
uucagaauuucuac

SEQ ID NO: 3260299 - RNA, 18 nt, Vaccinia virus
auuuaaggacuuaacaau

SEQ ID NO: 3260300 - RNA, 15 nt, Vaccinia virus
ucuguaaauaguuuu

SEQ ID NO: 3260301 - RNA, 15 nt, Vaccinia virus
uaccuuuaaaauaua

SEQ ID NO: 3260302 - RNA, 21 nt, Vaccinia virus
uuacauauuucgacaaaaaga

SEQ ID NO: 3260303 - RNA, 16 nt, Vaccinia virus
auggaucuauucaaga

SEQ ID NO: 3260304 - RNA, 19 nt, Vaccinia virus
aauauuauauaaacauuug

SEQ ID NO: 3260305 - RNA, 17 nt, Vaccinia virus
auaguagaguaaacauu

SEQ ID NO: 3260306 - RNA, 21 nt, Vaccinia virus
uugcagacaaacgaagaaaga

SEQ ID NO: 3260307 - RNA, 16 nt, Vaccinia virus
agcgcuuccuaaauaa

SEQ ID NO: 3260308 - RNA, 19 nt, Vaccinia virus
auacuauuaauuguaaaug

SEQ ID NO: 3260309 - RNA, 14 nt, Vaccinia virus
uugcucguaaaaga

SEQ ID NO: 3260310 - RNA, 20 nt, Vaccinia virus
aucuuuuucuacgucaaaau

SEQ ID NO: 3260311 - RNA, 21 nt, Vaccinia virus
gccauugcugccacucauaau

SEQ ID NO: 3260312 - RNA, 16 nt, Vaccinia virus
gauaacacauuuucau

SEQ ID NO: 3260313 - RNA, 13 nt, Vaccinia virus
aaagauaacuauu

SEQ ID NO: 3260314 - RNA, 17 nt, Vaccinia virus
aguuaauauuauugggu

SEQ ID NO: 3260315 - RNA, 15 nt, Vaccinia virus
gaaaaaguaaaugau

SEQ ID NO: 3260316 - RNA, 12 nt, Vaccinia virus
ucacuucagaaa

SEQ ID NO: 3260317 - RNA, 19 nt, Vaccinia virus
uacaucgguaucuagaucu

SEQ ID NO: 3260318 - RNA, 17 nt, Vaccinia virus
caucacuauauguucca

SEQ ID NO: 3260319 - RNA, 19 nt, Vaccinia virus
aacucuuucgaauacuuau

SEQ ID NO: 3260320 - RNA, 17 nt, Vaccinia virus
ugauuaguauuuucuau

SEQ ID NO: 3260321 - RNA, 23 nt, Vaccinia virus
auuuccaucucuaucuaauacag

SEQ ID NO: 3260322 - RNA, 11 nt, Vaccinia virus
uaaauuucaau

SEQ ID NO: 3260323 - RNA, 18 nt, Vaccinia virus
ugaagaaauaauuucuac

SEQ ID NO: 3260324 - RNA, 13 nt, Vaccinia virus
uucuuaauaaucg

SEQ ID NO: 3260325 - RNA, 17 nt, Vaccinia virus
aaauaaucggagaaugu

SEQ ID NO: 3260326 - RNA, 23 nt, Vaccinia virus
uagcuaugaacuuguuuaaugac

SEQ ID NO: 3260327 - RNA, 17 nt, Vaccinia virus
uauaacauuaauaucaa

SEQ ID NO: 3260328 - RNA, 19 nt, Vaccinia virus
ugaugcauucgacucaaca

SEQ ID NO: 3260329 - RNA, 13 nt, Vaccinia virus
aaucuauaauauc

SEQ ID NO: 3260330 - RNA, 13 nt, Vaccinia virus
gcaaauucuaguc

SEQ ID NO: 3260331 - RNA, 20 nt, Vaccinia virus
gauaucaguagaugcacaau

SEQ ID NO: 3260332 - RNA, 13 nt, Vaccinia virus
ucagaaauuauuc

SEQ ID NO: 3260333 - RNA, 14 nt, Vaccinia virus
uggagaucuagaaa

SEQ ID NO: 3260334 - RNA, 17 nt, Vaccinia virus
acuuuaacguauaaaug

SEQ ID NO: 3260335 - RNA, 17 nt, Vaccinia virus
uuuuaacgauaguaaac

SEQ ID NO: 3260336 - RNA, 15 nt, Vaccinia virus
agcgaaggagaccac

SEQ ID NO: 3260337 - RNA, 22 nt, Vaccinia virus
auuaacuccgaggcacauacau

SEQ ID NO: 3260338 - RNA, 23 nt, Vaccinia virus
cucuuuugaugauaaauuuccaa

SEQ ID NO: 3260339 - RNA, 13 nt, Vaccinia virus
uuauaaaaacuuu

SEQ ID NO: 3260340 - RNA, 13 nt, Vaccinia virus
aacuacuugcaua

SEQ ID NO: 3260341 - RNA, 16 nt, Vaccinia virus
aagucuuacaauguuc

SEQ ID NO: 3260342 - RNA, 18 nt, Vaccinia virus
cauucuugguuguggaua

SEQ ID NO: 3260343 - RNA, 21 nt, Vaccinia virus
ucguuccgccaaauuuucauu

SEQ ID NO: 3260344 - RNA, 22 nt, Vaccinia virus
aaucuccgcaauacauuucuca

SEQ ID NO: 3260345 - RNA, 19 nt, Vaccinia virus
guuuccuggauaaaccaca

SEQ ID NO: 3260346 - RNA, 17 nt, Vaccinia virus
ggaauaugacuauuuuc

SEQ ID NO: 3260347 - RNA, 17 nt, Vaccinia virus
agauguuaaaugaauua

SEQ ID NO: 3260348 - RNA, 20 nt, Vaccinia virus
uccuuaagauguuugagaau

SEQ ID NO: 3260349 - RNA, 18 nt, Vaccinia virus
caccacacgacaaugaac

SEQ ID NO: 3260350 - RNA, 16 nt, Vaccinia virus
uagcggguauccccgu

SEQ ID NO: 3260351 - RNA, 16 nt, Vaccinia virus
gugaauauauauguua

SEQ ID NO: 3260352 - RNA, 14 nt, Vaccinia virus
aagacggggauuuc

SEQ ID NO: 3260353 - RNA, 15 nt, Vaccinia virus
gauaacaaauuaaag

SEQ ID NO: 3260354 - RNA, 21 nt, Vaccinia virus
guuuacaaacugaauaauauc

SEQ ID NO: 3260355 - RNA, 24 nt, Vaccinia virus
aucugacauaaacauaucaaaaga

SEQ ID NO: 3260356 - RNA, 14 nt, Vaccinia virus
auauuagaaucuac

SEQ ID NO: 3260357 - RNA, 20 nt, Vaccinia virus
aauaggguaucuaauuuccu

SEQ ID NO: 3260358 - RNA, 18 nt, Vaccinia virus
uuaucaaaacauauagau

SEQ ID NO: 3260359 - RNA, 17 nt, Vaccinia virus
uacuaggagaauuauuu

SEQ ID NO: 3260360 - RNA, 16 nt, Vaccinia virus
acgcaguuuuucuuau

SEQ ID NO: 3260361 - RNA, 20 nt, Vaccinia virus
ggauuugguaagacuauuac

SEQ ID NO: 3260362 - RNA, 18 nt, Vaccinia virus
acaaaagugaauauauau

SEQ ID NO: 3260363 - RNA, 18 nt, Vaccinia virus
cucuaucauggcaauaac

SEQ ID NO: 3260364 - RNA, 19 nt, Vaccinia virus
aauauuauucuuugauucg

SEQ ID NO: 3260365 - RNA, 11 nt, Vaccinia virus
aaucuagcauu

SEQ ID NO: 3260366 - RNA, 14 nt, Vaccinia virus
auaggugaaaagau

SEQ ID NO: 3260367 - RNA, 12 nt, Vaccinia virus
guauuuggaaag

SEQ ID NO: 3260368 - RNA, 17 nt, Vaccinia virus
aauuauagaacgaagua

SEQ ID NO: 3260369 - RNA, 14 nt, Vaccinia virus
aaaguucaacauga

SEQ ID NO: 3260370 - RNA, 19 nt, Vaccinia virus
aauuccggauacaugaaca

SEQ ID NO: 3260371 - RNA, 22 nt, Vaccinia virus
uuguugagaugcugcuccugga

SEQ ID NO: 3260372 - RNA, 12 nt, Vaccinia virus
uucuuaagaaau

SEQ ID NO: 3260373 - RNA, 15 nt, Vaccinia virus
cauaauccucaucug

SEQ ID NO: 3260374 - RNA, 17 nt, Vaccinia virus
ucgcgauuaguguauac

SEQ ID NO: 3260375 - RNA, 17 nt, Vaccinia virus
uucauucguaaaucuuu

SEQ ID NO: 3260376 - RNA, 19 nt, Vaccinia virus
uccaucgaugauacaugua

SEQ ID NO: 3260377 - RNA, 15 nt, Vaccinia virus
cgauuuuaucaucuu

SEQ ID NO: 3260378 - RNA, 19 nt, Vaccinia virus
uuaagauuuuaaauguaua

SEQ ID NO: 3260379 - RNA, 18 nt, Vaccinia virus
aaaacugcguuguaucau

SEQ ID NO: 3260380 - RNA, 15 nt, Vaccinia virus
aacuaauaugauccu

SEQ ID NO: 3260381 - RNA, 21 nt, Vaccinia virus
aacaucuuuguaaacagauau

SEQ ID NO: 3260382 - RNA, 17 nt, Vaccinia virus
aaauauauuuucauuua

SEQ ID NO: 3260383 - RNA, 16 nt, Vaccinia virus
uguuuaccacaaugua

SEQ ID NO: 3260384 - RNA, 21 nt, Vaccinia virus
ugauauacaaugcucaguaaa

SEQ ID NO: 3260385 - RNA, 17 nt, Vaccinia virus
aauauuucauuagaugu

SEQ ID NO: 3260386 - RNA, 13 nt, Vaccinia virus
uauauguuuucau

SEQ ID NO: 3260387 - RNA, 17 nt, Vaccinia virus
caauuauguaucaauau

SEQ ID NO: 3260388 - RNA, 18 nt, Vaccinia virus
auagcuauucuucuuuaa

SEQ ID NO: 3260389 - RNA, 21 nt, Vaccinia virus
guucuaaugugauucucugaa

SEQ ID NO: 3260390 - RNA, 18 nt, Vaccinia virus
guucauaagucuaauaga

SEQ ID NO: 3260391 - RNA, 22 nt, Vaccinia virus
aaugaguuauuaagcaauauau

SEQ ID NO: 3260392 - RNA, 23 nt, Vaccinia virus
guaaaaguacagaauuaauuaga

SEQ ID NO: 3260393 - RNA, 17 nt, Vaccinia virus
aaugcucaguaaaugua

SEQ ID NO: 3260394 - RNA, 23 nt, Vaccinia virus
uaacagcaauaguauaauuauau

SEQ ID NO: 3260395 - RNA, 22 nt, Vaccinia virus
aauauaaaagaauauguauauc

SEQ ID NO: 3260396 - RNA, 17 nt, Vaccinia virus
auaacaggcuaaaaugu

SEQ ID NO: 3260397 - RNA, 20 nt, Vaccinia virus
guacuccucccauaauacuu

SEQ ID NO: 3260398 - RNA, 17 nt, Vaccinia virus
auaucauaaucuaaaau

SEQ ID NO: 3260399 - RNA, 18 nt, Vaccinia virus
auuuaacucaugaugaag

SEQ ID NO: 3260400 - RNA, 20 nt, Vaccinia virus
auuuaaggcuuuaaaauuga

SEQ ID NO: 3260401 - RNA, 16 nt, Vaccinia virus
cuaggauccuuuagaa

SEQ ID NO: 3260402 - RNA, 22 nt, Vaccinia virus
agauuuauuugauaaucauguu

SEQ ID NO: 3260403 - RNA, 16 nt, Vaccinia virus
auucuauuaaugucua

SEQ ID NO: 3260404 - RNA, 17 nt, Vaccinia virus
uaauucucauuaaaugg

SEQ ID NO: 3260405 - RNA, 20 nt, Vaccinia virus
uguauaauaagaugcaaaca

SEQ ID NO: 3260406 - RNA, 15 nt, Vaccinia virus
auacuguauauacua

SEQ ID NO: 3260407 - RNA, 17 nt, Vaccinia virus
ugucuuagaacaacauu

SEQ ID NO: 3260408 - RNA, 14 nt, Vaccinia virus
accgagggaaaauc

SEQ ID NO: 3260409 - RNA, 22 nt, Vaccinia virus
aucucuauaauaucuaguuuuu

SEQ ID NO: 3260410 - RNA, 16 nt, Vaccinia virus
uugugcuuaauuauuu

SEQ ID NO: 3260411 - RNA, 12 nt, Vaccinia virus
uccauuaaugug

SEQ ID NO: 3260412 - RNA, 23 nt, Vaccinia virus
aauaacucucgugcuucagaaaa

SEQ ID NO: 3260413 - RNA, 18 nt, Vaccinia virus
aaauacauaauuuuguaa

SEQ ID NO: 3260414 - RNA, 22 nt, Vaccinia virus
acguuugguaauggcaauguau

SEQ ID NO: 3260415 - RNA, 16 nt, Vaccinia virus
agugcuacuuuaagau

SEQ ID NO: 3260416 - RNA, 23 nt, Vaccinia virus
auauuaacgcguuuuaugaauga

SEQ ID NO: 3260417 - RNA, 15 nt, Vaccinia virus
agaaaauuuaauaaa

SEQ ID NO: 3260418 - RNA, 21 nt, Vaccinia virus
uaagaaucgcgauucuaaaac

SEQ ID NO: 3260419 - RNA, 14 nt, Vaccinia virus
aucuggcucucucu

SEQ ID NO: 3260420 - RNA, 16 nt, Vaccinia virus
agaugucuuauuaaaa

SEQ ID NO: 3260421 - RNA, 14 nt, Vaccinia virus
agaaucucaugaau

SEQ ID NO: 3260422 - RNA, 15 nt, Vaccinia virus
caguauauaucauuu

SEQ ID NO: 3260423 - RNA, 15 nt, Vaccinia virus
auuaaacagaaaugg

SEQ ID NO: 3260424 - RNA, 20 nt, Vaccinia virus
agcugaaucugauaaauaua

SEQ ID NO: 3260425 - RNA, 17 nt, Vaccinia virus
aaauauggaagcgaaug

SEQ ID NO: 3260426 - RNA, 22 nt, Vaccinia virus
aguauaaacgccauaauacuca

SEQ ID NO: 3260427 - RNA, 16 nt, Vaccinia virus
auaucaucuacauaau

SEQ ID NO: 3260428 - RNA, 13 nt, Vaccinia virus
auauuauuaauaa

SEQ ID NO: 3260429 - RNA, 22 nt, Vaccinia virus
cguugcgaagaaaaaaauggaa

SEQ ID NO: 3260430 - RNA, 21 nt, Vaccinia virus
uguuucuacuccauaauacuc

SEQ ID NO: 3260431 - RNA, 13 nt, Vaccinia virus
cuucuagauaucc

SEQ ID NO: 3260432 - RNA, 20 nt, Vaccinia virus
auuuuuaacagcaacacauu

SEQ ID NO: 3260433 - RNA, 15 nt, Vaccinia virus
agaucuaauuuuguu

SEQ ID NO: 3260434 - RNA, 14 nt, Vaccinia virus
uauaauauacucuu

SEQ ID NO: 3260435 - RNA, 17 nt, Vaccinia virus
aaaauauguaauaauca

SEQ ID NO: 3260436 - RNA, 18 nt, Vaccinia virus
uacaucuaguucuuugaa

SEQ ID NO: 3260437 - RNA, 18 nt, Vaccinia virus
aucuauggaauuaccacu

SEQ ID NO: 3260438 - RNA, 15 nt, Vaccinia virus
auccaagaaaaaguc

SEQ ID NO: 3260439 - RNA, 15 nt, Vaccinia virus
cuagagauaaaaucu

SEQ ID NO: 3260440 - RNA, 21 nt, Vaccinia virus
agaugccaagauaucuauaua

SEQ ID NO: 3260441 - RNA, 14 nt, Vaccinia virus
agcggcuacuaaaa

SEQ ID NO: 3260442 - RNA, 22 nt, Vaccinia virus
uuaaucuuggcuccauacugua

SEQ ID NO: 3260443 - RNA, 17 nt, Vaccinia virus
cauccuacuaugcaauu

SEQ ID NO: 3260444 - RNA, 19 nt, Vaccinia virus
gcgguuuaauaaauguuuu

SEQ ID NO: 3260445 - RNA, 19 nt, Vaccinia virus
guaauaccauguuuaagau

SEQ ID NO: 3260446 - RNA, 18 nt, Vaccinia virus
agaaauacuaaaaaaugu

SEQ ID NO: 3260447 - RNA, 20 nt, Vaccinia virus
auauagauagcguauaucuc

SEQ ID NO: 3260448 - RNA, 11 nt, Vaccinia virus
aauacagaaug

SEQ ID NO: 3260449 - RNA, 23 nt, Vaccinia virus
aaaaagaguuucaaaaauauuca

SEQ ID NO: 3260450 - RNA, 13 nt, Vaccinia virus
ugacgauauuucu

SEQ ID NO: 3260451 - RNA, 20 nt, Vaccinia virus
auuagauggagaguauauuu

SEQ ID NO: 3260452 - RNA, 16 nt, Vaccinia virus
gauuguugccguaaau

SEQ ID NO: 3260453 - RNA, 20 nt, Vaccinia virus
agcuauuaucaaauacugua

SEQ ID NO: 3260454 - RNA, 20 nt, Vaccinia virus
augcucgcaacauuaacauc

SEQ ID NO: 3260455 - RNA, 11 nt, Vaccinia virus
gauaacuguau

SEQ ID NO: 3260456 - RNA, 22 nt, Vaccinia virus
agacggcaauggauggauuaua

SEQ ID NO: 3260457 - RNA, 17 nt, Vaccinia virus
agaucauuugaaauuau

SEQ ID NO: 3260458 - RNA, 16 nt, Vaccinia virus
cuaaguccuauucucg

SEQ ID NO: 3260459 - RNA, 11 nt, Vaccinia virus
ugauagaaaau

SEQ ID NO: 3260460 - RNA, 13 nt, Vaccinia virus
uacaaaagcaauu

SEQ ID NO: 3260461 - RNA, 12 nt, Vaccinia virus
auauuuaaacaa

SEQ ID NO: 3260462 - RNA, 22 nt, Vaccinia virus
cguuucauaaagagaucaggaa

SEQ ID NO: 3260463 - RNA, 16 nt, Vaccinia virus
uccacauuaauacagc

SEQ ID NO: 3260464 - RNA, 16 nt, Vaccinia virus
gacaauacuguauuau

SEQ ID NO: 3260465 - RNA, 14 nt, Vaccinia virus
gauuuuuccaaagu

SEQ ID NO: 3260466 - RNA, 19 nt, Vaccinia virus
auucagaguccucuaauug

SEQ ID NO: 3260467 - RNA, 21 nt, Vaccinia virus
agcuauguuaucaugaaaugu

SEQ ID NO: 3260468 - RNA, 17 nt, Vaccinia virus
caaugaacuaauauuua

SEQ ID NO: 3260469 - RNA, 16 nt, Vaccinia virus
cguugacgcuguaaaa

SEQ ID NO: 3260470 - RNA, 16 nt, Vaccinia virus
auagauggaguaagua

SEQ ID NO: 3260471 - RNA, 16 nt, Vaccinia virus
auucaccgaucaaaug

SEQ ID NO: 3260472 - RNA, 16 nt, Vaccinia virus
acuuuucauuaauagg

SEQ ID NO: 3260473 - RNA, 23 nt, Vaccinia virus
guucuuauaauuguaacauccuu

SEQ ID NO: 3260474 - RNA, 14 nt, Vaccinia virus
uugaugaauuauua

SEQ ID NO: 3260475 - RNA, 15 nt, Vaccinia virus
uuauauaauuuuugg

SEQ ID NO: 3260476 - RNA, 21 nt, Vaccinia virus
auuauagcuucuggacauaau

SEQ ID NO: 3260477 - RNA, 14 nt, Vaccinia virus
gccauuauuagaaa

SEQ ID NO: 3260478 - RNA, 14 nt, Vaccinia virus
uaugaguucuucuu

SEQ ID NO: 3260479 - RNA, 20 nt, Vaccinia virus
agcuccaugacuuaugaaua

SEQ ID NO: 3260480 - RNA, 15 nt, Vaccinia virus
ucguacuauauacaa

SEQ ID NO: 3260481 - RNA, 19 nt, Vaccinia virus
gauuaaaaauaaaguuauc

SEQ ID NO: 3260482 - RNA, 18 nt, Vaccinia virus
auuuaucauauuucucca

SEQ ID NO: 3260483 - RNA, 18 nt, Vaccinia virus
uuguaucaguuucagaau

SEQ ID NO: 3260484 - RNA, 16 nt, Vaccinia virus
aguuuucuuucaaaau

SEQ ID NO: 3260485 - RNA, 21 nt, Vaccinia virus
guuguuacuccauuauauauu

SEQ ID NO: 3260486 - RNA, 17 nt, Vaccinia virus
acuaaacacacauuauu

SEQ ID NO: 3260487 - RNA, 16 nt, Vaccinia virus
agaacaacgaaauuau

SEQ ID NO: 3260488 - RNA, 14 nt, Vaccinia virus
aaaaguaaauacug

SEQ ID NO: 3260489 - RNA, 19 nt, Vaccinia virus
uauauacacucuauuucaa

SEQ ID NO: 3260490 - RNA, 19 nt, Vaccinia virus
uugcguggagaucauuaaa

SEQ ID NO: 3260491 - RNA, 12 nt, Vaccinia virus
aacuuuuuggua

SEQ ID NO: 3260492 - RNA, 20 nt, Vaccinia virus
agcgagaaauaaucauaaau

SEQ ID NO: 3260493 - RNA, 19 nt, Vaccinia virus
aucaauucuggauuauccc

SEQ ID NO: 3260494 - RNA, 16 nt, Vaccinia virus
acuuguauaauuuccc

SEQ ID NO: 3260495 - RNA, 17 nt, Vaccinia virus
agcaguuaccaaagaga

SEQ ID NO: 3260496 - RNA, 12 nt, Vaccinia virus
aaaaggaaaaua

SEQ ID NO: 3260497 - RNA, 15 nt, Vaccinia virus
gaucuaaaaauuaaa

SEQ ID NO: 3260498 - RNA, 22 nt, Vaccinia virus
acucgcauuucuaauacaugac

SEQ ID NO: 3260499 - RNA, 17 nt, Vaccinia virus
aggcauguugauggaaa

SEQ ID NO: 3260500 - RNA, 17 nt, Vaccinia virus
aacaauauauacgagua

SEQ ID NO: 3260501 - RNA, 13 nt, Vaccinia virus
uggagaugaaugc

SEQ ID NO: 3260502 - RNA, 22 nt, Vaccinia virus
uuaugaaaccauacuaauagau

SEQ ID NO: 3260503 - RNA, 17 nt, Vaccinia virus
ugacauuuauucaucau

SEQ ID NO: 3260504 - RNA, 19 nt, Vaccinia virus
uucauaggauacucuauga

SEQ ID NO: 3260505 - RNA, 20 nt, Vaccinia virus
aucgaagugacacucuauau

SEQ ID NO: 3260506 - RNA, 22 nt, Vaccinia virus
uauggagcgaguguuacaacau

SEQ ID NO: 3260507 - RNA, 17 nt, Vaccinia virus
cuuaacuuguaauaauu

SEQ ID NO: 3260508 - RNA, 13 nt, Vaccinia virus
guuacguauauau

SEQ ID NO: 3260509 - RNA, 19 nt, Vaccinia virus
uaaaaugguaaacuuuugc

SEQ ID NO: 3260510 - RNA, 17 nt, Vaccinia virus
auaaucgcuuuguuguu

SEQ ID NO: 3260511 - RNA, 21 nt, Vaccinia virus
acuaaauauucauaacuaauu

SEQ ID NO: 3260512 - RNA, 13 nt, Vaccinia virus
uuaucuguagacg

SEQ ID NO: 3260513 - RNA, 16 nt, Vaccinia virus
auauccuuuuguauaa

SEQ ID NO: 3260514 - RNA, 12 nt, Vaccinia virus
aaacaauguuuc

SEQ ID NO: 3260515 - RNA, 13 nt, Vaccinia virus
gaucuguauuaua

SEQ ID NO: 3260516 - RNA, 13 nt, Vaccinia virus
uccuguaauaucu

SEQ ID NO: 3260517 - RNA, 20 nt, Vaccinia virus
ccuacacuauuauaugauua

SEQ ID NO: 3260518 - RNA, 21 nt, Vaccinia virus
aucggacucuucuaucauuau

SEQ ID NO: 3260519 - RNA, 22 nt, Vaccinia virus
acgagauuauuauuaacaaagu

SEQ ID NO: 3260520 - RNA, 13 nt, Vaccinia virus
agugcuucuucuu

SEQ ID NO: 3260521 - RNA, 16 nt, Vaccinia virus
aaagauuaauacauua

SEQ ID NO: 3260522 - RNA, 18 nt, Vaccinia virus
gugacauaauuacauaua

SEQ ID NO: 3260523 - RNA, 21 nt, Vaccinia virus
auuaucaagauucugauguau

SEQ ID NO: 3260524 - RNA, 21 nt, Vaccinia virus
uaacaaguugaccaauucauu

SEQ ID NO: 3260525 - RNA, 17 nt, Vaccinia virus
caacuuuaggaucucua

SEQ ID NO: 3260526 - RNA, 14 nt, Vaccinia virus
uaaaaauaugugcu

SEQ ID NO: 3260527 - RNA, 16 nt, Vaccinia virus
aucaaucgauaacaag

SEQ ID NO: 3260528 - RNA, 20 nt, Vaccinia virus
uaucuacgauuuuuacaaaa

SEQ ID NO: 3260529 - RNA, 14 nt, Vaccinia virus
uauaaaacuuauga

SEQ ID NO: 3260530 - RNA, 17 nt, Vaccinia virus
aggagcaccagaaguau

SEQ ID NO: 3260531 - RNA, 15 nt, Vaccinia virus
agagcagcacaaacu

SEQ ID NO: 3260532 - RNA, 12 nt, Vaccinia virus
auucaguuuaua

SEQ ID NO: 3260533 - RNA, 16 nt, Vaccinia virus
cuauuaucuguuuaua

SEQ ID NO: 3260534 - RNA, 23 nt, Vaccinia virus
aguuguggaaauacuuccaucaa

SEQ ID NO: 3260535 - RNA, 15 nt, Vaccinia virus
cuauaucuaacaucu

SEQ ID NO: 3260536 - RNA, 23 nt, Vaccinia virus
ucaucuggaauugucacuacuaa

SEQ ID NO: 3260537 - RNA, 16 nt, Vaccinia virus
aguuuauuauccacua

SEQ ID NO: 3260538 - RNA, 19 nt, Vaccinia virus
uuaacaucucuucauuaau

SEQ ID NO: 3260539 - RNA, 22 nt, Vaccinia virus
augcuaguuaauaguaaaugaa

SEQ ID NO: 3260540 - RNA, 18 nt, Vaccinia virus
acauccgccuuaaaugua

SEQ ID NO: 3260541 - RNA, 19 nt, Vaccinia virus
uguaaccgauaauaauguu

SEQ ID NO: 3260542 - RNA, 13 nt, Vaccinia virus
aacggcuaucacu

SEQ ID NO: 3260543 - RNA, 13 nt, Vaccinia virus
aucgacuauuuua

SEQ ID NO: 3260544 - RNA, 16 nt, Vaccinia virus
guugauuacucuuuuu

SEQ ID NO: 3260545 - RNA, 19 nt, Vaccinia virus
uaugacgacuucaaucaaa

SEQ ID NO: 3260546 - RNA, 21 nt, Vaccinia virus
auucauucacuaucaaucgau

SEQ ID NO: 3260547 - RNA, 18 nt, Vaccinia virus
aauaaucguuauuaucau

SEQ ID NO: 3260548 - RNA, 17 nt, Vaccinia virus
caaugaaaugguacaau

SEQ ID NO: 3260549 - RNA, 14 nt, Vaccinia virus
aucaauaacaaugu

SEQ ID NO: 3260550 - RNA, 23 nt, Vaccinia virus
ugauauacagucuuaaauaguua

SEQ ID NO: 3260551 - RNA, 17 nt, Vaccinia virus
uugacaaaaucuuuaau

SEQ ID NO: 3260552 - RNA, 14 nt, Vaccinia virus
cuguucaacaaacu

SEQ ID NO: 3260553 - RNA, 23 nt, Vaccinia virus
cauucuauuaaugucuacucuau

SEQ ID NO: 3260554 - RNA, 23 nt, Vaccinia virus
uuaacaaaugguucaaagacuag

SEQ ID NO: 3260555 - RNA, 21 nt, Vaccinia virus
cugcggauauaaagucaucgu

SEQ ID NO: 3260556 - RNA, 18 nt, Vaccinia virus
ugucaaagguauaugaua

SEQ ID NO: 3260557 - RNA, 14 nt, Vaccinia virus
ucuauaauaucaga

SEQ ID NO: 3260558 - RNA, 21 nt, Vaccinia virus
aacucgccggcgcaucaguau

SEQ ID NO: 3260559 - RNA, 17 nt, Vaccinia virus
acaauagcgcuuaaucu

SEQ ID NO: 3260560 - RNA, 13 nt, Vaccinia virus
gugauauaaauaa

SEQ ID NO: 3260561 - RNA, 20 nt, Vaccinia virus
aguauuugagaaauauguau

SEQ ID NO: 3260562 - RNA, 21 nt, Vaccinia virus
uuaaaggaguaugucaugaau

SEQ ID NO: 3260563 - RNA, 15 nt, Vaccinia virus
guaguuguugguaac

SEQ ID NO: 3260564 - RNA, 20 nt, Vaccinia virus
guacacuuuuuaauucucua

SEQ ID NO: 3260565 - RNA, 18 nt, Vaccinia virus
aucucuuaauccaaauau

SEQ ID NO: 3260566 - RNA, 15 nt, Vaccinia virus
agaauuguaaaauua

SEQ ID NO: 3260567 - RNA, 21 nt, Vaccinia virus
agaauccuaacuauucaucca

SEQ ID NO: 3260568 - RNA, 18 nt, Vaccinia virus
uauacucuuauuaucaaa

SEQ ID NO: 3260569 - RNA, 15 nt, Vaccinia virus
ucaauucuucuacau

SEQ ID NO: 3260570 - RNA, 11 nt, Vaccinia virus
aaguuaauagc

SEQ ID NO: 3260571 - RNA, 19 nt, Vaccinia virus
gacauuuggaauguuauau

SEQ ID NO: 3260572 - RNA, 17 nt, Vaccinia virus
uuguacuaucuagagau

SEQ ID NO: 3260573 - RNA, 21 nt, Vaccinia virus
cucuaguaaagucaggacuga

SEQ ID NO: 3260574 - RNA, 23 nt, Vaccinia virus
uaagacuaaugcuugaaaaugga

SEQ ID NO: 3260575 - RNA, 23 nt, Vaccinia virus
ugcuauaucucuuccguuuauua

SEQ ID NO: 3260576 - RNA, 15 nt, Vaccinia virus
uaaaucauuaucuac

SEQ ID NO: 3260577 - RNA, 22 nt, Vaccinia virus
auuugauacgauauuuguugga

SEQ ID NO: 3260578 - RNA, 14 nt, Vaccinia virus
cuugaagaugauuu

SEQ ID NO: 3260579 - RNA, 19 nt, Vaccinia virus
uugauuuaaagucuagagu

SEQ ID NO: 3260580 - RNA, 24 nt, Vaccinia virus
aaaggggugagaauguuccagagu

SEQ ID NO: 3260581 - RNA, 15 nt, Vaccinia virus
auaaugauacaguac

SEQ ID NO: 3260582 - RNA, 20 nt, Vaccinia virus
uaauauuuuauuacaaucau

SEQ ID NO: 3260583 - RNA, 19 nt, Vaccinia virus
ucuacuuacuggaaaauag

SEQ ID NO: 3260584 - RNA, 12 nt, Vaccinia virus
uuauuucugaau

SEQ ID NO: 3260585 - RNA, 14 nt, Vaccinia virus
auauuucuggaaug

SEQ ID NO: 3260586 - RNA, 14 nt, Vaccinia virus
ccguagaaauacua

SEQ ID NO: 3260587 - RNA, 23 nt, Vaccinia virus
acauuguuacgucuccaauaaau

SEQ ID NO: 3260588 - RNA, 15 nt, Vaccinia virus
gaugguauuucugaa

SEQ ID NO: 3260589 - RNA, 17 nt, Vaccinia virus
gaguauuaaauauuaau

SEQ ID NO: 3260590 - RNA, 14 nt, Vaccinia virus
aaaguaauaaucuu

SEQ ID NO: 3260591 - RNA, 19 nt, Vaccinia virus
uacagauugcacuauacau

SEQ ID NO: 3260592 - RNA, 20 nt, Vaccinia virus
auuuguuuuguuuauuaaca

SEQ ID NO: 3260593 - RNA, 15 nt, Vaccinia virus
uaauggaugucauga

SEQ ID NO: 3260594 - RNA, 14 nt, Vaccinia virus
acaucaaaauaaua

SEQ ID NO: 3260595 - RNA, 16 nt, Vaccinia virus
cauaguaaauucuguu

SEQ ID NO: 3260596 - RNA, 14 nt, Vaccinia virus
cagaaguaaugaag

SEQ ID NO: 3260597 - RNA, 16 nt, Vaccinia virus
aauaugauuaacaagu

SEQ ID NO: 3260598 - RNA, 20 nt, Vaccinia virus
ucgaaugccauagaauaaau

SEQ ID NO: 3260599 - RNA, 16 nt, Vaccinia virus
ucaucgauaguauaau

SEQ ID NO: 3260600 - RNA, 17 nt, Vaccinia virus
aucugcuauaauuaaga

SEQ ID NO: 3260601 - RNA, 16 nt, Vaccinia virus
acuuuaauaacaaaga

SEQ ID NO: 3260602 - RNA, 14 nt, Vaccinia virus
uuaaugaaacauuu

SEQ ID NO: 3260603 - RNA, 12 nt, Vaccinia virus
uagagaugaugc

SEQ ID NO: 3260604 - RNA, 15 nt, Vaccinia virus
gaccgaauacauaac

SEQ ID NO: 3260605 - RNA, 22 nt, Vaccinia virus
uuaauccgggugaaauuauucc

SEQ ID NO: 3260606 - RNA, 20 nt, Vaccinia virus
auuuuauccaaaaagaauga

SEQ ID NO: 3260607 - RNA, 16 nt, Vaccinia virus
auacgauggugaaaga

SEQ ID NO: 3260608 - RNA, 20 nt, Vaccinia virus
agaaaguggauaaaacaaua

SEQ ID NO: 3260609 - RNA, 14 nt, Vaccinia virus
agacuaugauugac

SEQ ID NO: 3260610 - RNA, 23 nt, Vaccinia virus
aagaaaugguaaauaaauacuuu

SEQ ID NO: 3260611 - RNA, 18 nt, Vaccinia virus
guucucaauauuacuuuu

SEQ ID NO: 3260612 - RNA, 22 nt, Vaccinia virus
gcuaacacguaauuauaauaau

SEQ ID NO: 3260613 - RNA, 22 nt, Vaccinia virus
augugagcaaagauuguucucu

SEQ ID NO: 3260614 - RNA, 14 nt, Vaccinia virus
uggaccaauuuauu

SEQ ID NO: 3260615 - RNA, 22 nt, Vaccinia virus
aguauuaaccaugaaagaaaga

SEQ ID NO: 3260616 - RNA, 21 nt, Vaccinia virus
agcucucguauucaguuucau

SEQ ID NO: 3260617 - RNA, 16 nt, Vaccinia virus
caauauagcaacagua

SEQ ID NO: 3260618 - RNA, 13 nt, Vaccinia virus
guaaauacauuga

SEQ ID NO: 3260619 - RNA, 18 nt, Vaccinia virus
auuuugguuuacauguaa

SEQ ID NO: 3260620 - RNA, 22 nt, Vaccinia virus
ucaugccuuuccuggaauauca

SEQ ID NO: 3260621 - RNA, 12 nt, Vaccinia virus
caugauagauuu

SEQ ID NO: 3260622 - RNA, 15 nt, Vaccinia virus
ccauuaaucacugau

SEQ ID NO: 3260623 - RNA, 18 nt, Vaccinia virus
uaauaaacauuccacauu

SEQ ID NO: 3260624 - RNA, 14 nt, Vaccinia virus
aaauugauaaugag

SEQ ID NO: 3260625 - RNA, 15 nt, Vaccinia virus
cagaaacuguaaaga

SEQ ID NO: 3260626 - RNA, 14 nt, Vaccinia virus
uguacagaaaucau

SEQ ID NO: 3260627 - RNA, 16 nt, Vaccinia virus
agauugauuauuuccu

SEQ ID NO: 3260628 - RNA, 12 nt, Vaccinia virus
aucuguauucuc

SEQ ID NO: 3260629 - RNA, 22 nt, Vaccinia virus
acaaaauaauaauggaaguacu

SEQ ID NO: 3260630 - RNA, 20 nt, Vaccinia virus
aaucaucaauccuucagaua

SEQ ID NO: 3260631 - RNA, 23 nt, Vaccinia virus
aaucauuaucgauacuaauuaca

SEQ ID NO: 3260632 - RNA, 17 nt, Vaccinia virus
aucuacuacauuagaca

SEQ ID NO: 3260633 - RNA, 15 nt, Vaccinia virus
cuaucagaaucaguu

SEQ ID NO: 3260634 - RNA, 15 nt, Vaccinia virus
cuagacuugauuuaa

SEQ ID NO: 3260635 - RNA, 17 nt, Vaccinia virus
uuucauucgucaaggau

SEQ ID NO: 3260636 - RNA, 18 nt, Vaccinia virus
cuacuucgguuagauguu

SEQ ID NO: 3260637 - RNA, 17 nt, Vaccinia virus
uaaaaucagcagacuuu

SEQ ID NO: 3260638 - RNA, 23 nt, Vaccinia virus
uuaauuauuguauuuauuauuua

SEQ ID NO: 3260639 - RNA, 17 nt, Vaccinia virus
aguaguuuaugauaaag

SEQ ID NO: 3260640 - RNA, 12 nt, Vaccinia virus
aagcuauguaaa

SEQ ID NO: 3260641 - RNA, 23 nt, Vaccinia virus
cggauaguauucaagucaaagaa

SEQ ID NO: 3260642 - RNA, 17 nt, Vaccinia virus
uauuaacccaagcagca

SEQ ID NO: 3260643 - RNA, 19 nt, Vaccinia virus
cauuaaacgauuugaugag

SEQ ID NO: 3260644 - RNA, 21 nt, Vaccinia virus
uucccugauuaguauuuucua

SEQ ID NO: 3260645 - RNA, 15 nt, Vaccinia virus
uuauccuaucaugua

SEQ ID NO: 3260646 - RNA, 13 nt, Vaccinia virus
uguuucaaagcaa

SEQ ID NO: 3260647 - RNA, 22 nt, Vaccinia virus
agaaaaaaauauuaucgauauu

SEQ ID NO: 3260648 - RNA, 14 nt, Vaccinia virus
ucauuaauuucuga

SEQ ID NO: 3260649 - RNA, 19 nt, Vaccinia virus
ucauguauuugagaguuuu

SEQ ID NO: 3260650 - RNA, 17 nt, Vaccinia virus
uaugucaaaaauuguag

SEQ ID NO: 3260651 - RNA, 19 nt, Vaccinia virus
uccaggccguuuguuuccu

SEQ ID NO: 3260652 - RNA, 21 nt, Vaccinia virus
cuguagugucaguacuauuag

SEQ ID NO: 3260653 - RNA, 16 nt, Vaccinia virus
caugggugacauaauu

SEQ ID NO: 3260654 - RNA, 14 nt, Vaccinia virus
acccuauaguuuua

SEQ ID NO: 3260655 - RNA, 16 nt, Vaccinia virus
auuugguaagacuauu

SEQ ID NO: 3260656 - RNA, 20 nt, Vaccinia virus
agaauaaaacucuacuauau

SEQ ID NO: 3260657 - RNA, 17 nt, Vaccinia virus
aaggacuuuguagaaau

SEQ ID NO: 3260658 - RNA, 13 nt, Vaccinia virus
gcuucauccuuua

SEQ ID NO: 3260659 - RNA, 17 nt, Vaccinia virus
cuuuuuauccuuuagau

SEQ ID NO: 3260660 - RNA, 20 nt, Vaccinia virus
gaaucugaaaacguauaaau

SEQ ID NO: 3260661 - RNA, 16 nt, Vaccinia virus
aaaacagauaaugaua

SEQ ID NO: 3260662 - RNA, 14 nt, Vaccinia virus
aucccauuguaaag

SEQ ID NO: 3260663 - RNA, 16 nt, Vaccinia virus
aucuucgucuauuaca

SEQ ID NO: 3260664 - RNA, 19 nt, Vaccinia virus
ucgucaaaauauuuacuaa

SEQ ID NO: 3260665 - RNA, 16 nt, Vaccinia virus
cauaaguauguuugac

SEQ ID NO: 3260666 - RNA, 16 nt, Vaccinia virus
ucuaagauuauuuuaa

SEQ ID NO: 3260667 - RNA, 13 nt, Vaccinia virus
uauaaaaucacuu

SEQ ID NO: 3260668 - RNA, 23 nt, Vaccinia virus
aaaaucaggguuaucaaaguguu

SEQ ID NO: 3260669 - RNA, 21 nt, Vaccinia virus
ugcgcgaaccaaaaugugaua

SEQ ID NO: 3260670 - RNA, 12 nt, Vaccinia virus
uuaaacaucuuu

SEQ ID NO: 3260671 - RNA, 12 nt, Vaccinia virus
uuauacaucuua

SEQ ID NO: 3260672 - RNA, 23 nt, Vaccinia virus
aauguuauaguuuucuaaaaugu

SEQ ID NO: 3260673 - RNA, 13 nt, Vaccinia virus
ugacgcuguaaaa

SEQ ID NO: 3260674 - RNA, 14 nt, Vaccinia virus
uaauauucuaaaac

SEQ ID NO: 3260675 - RNA, 17 nt, Vaccinia virus
caugaaaugaugauaua

SEQ ID NO: 3260676 - RNA, 14 nt, Vaccinia virus
ucuugcucaaauaa

SEQ ID NO: 3260677 - RNA, 15 nt, Vaccinia virus
acaucuuuccuacau

SEQ ID NO: 3260678 - RNA, 20 nt, Vaccinia virus
uacauggaugauauagauau

SEQ ID NO: 3260679 - RNA, 19 nt, Vaccinia virus
acaauggccgucuauguau

SEQ ID NO: 3260680 - RNA, 13 nt, Vaccinia virus
aguguaaagacaa

SEQ ID NO: 3260681 - RNA, 13 nt, Vaccinia virus
aaaauauguagaa

SEQ ID NO: 3260682 - RNA, 13 nt, Vaccinia virus
auaaaauguugau

SEQ ID NO: 3260683 - RNA, 21 nt, Vaccinia virus
cauguucauuggcuguggaau

SEQ ID NO: 3260684 - RNA, 13 nt, Vaccinia virus
aagauuguacacu

SEQ ID NO: 3260685 - RNA, 18 nt, Vaccinia virus
ucuugauuacaaaaccaa

SEQ ID NO: 3260686 - RNA, 22 nt, Vaccinia virus
aaauuaauuuaccaucguguau

SEQ ID NO: 3260687 - RNA, 18 nt, Vaccinia virus
caaugucgaauaacugua

SEQ ID NO: 3260688 - RNA, 20 nt, Vaccinia virus
uuauggaucuauucaagaug

SEQ ID NO: 3260689 - RNA, 15 nt, Vaccinia virus
aaauccaauagugaa

SEQ ID NO: 3260690 - RNA, 16 nt, Vaccinia virus
aguuugaauaguuugu

SEQ ID NO: 3260691 - RNA, 18 nt, Vaccinia virus
agaucuucguuaaaaagu

SEQ ID NO: 3260692 - RNA, 18 nt, Vaccinia virus
uaauccuuuuuauuuauu

SEQ ID NO: 3260693 - RNA, 17 nt, Vaccinia virus
auugcauagugaauaua

SEQ ID NO: 3260694 - RNA, 16 nt, Vaccinia virus
ugaucaaaaagagauu

SEQ ID NO: 3260695 - RNA, 22 nt, Vaccinia virus
agcuuuuguucacaaaaauaca

SEQ ID NO: 3260696 - RNA, 18 nt, Vaccinia virus
uagaaaaugauucacaau

SEQ ID NO: 3260697 - RNA, 14 nt, Vaccinia virus
gaauaaauuauuau

SEQ ID NO: 3260698 - RNA, 19 nt, Vaccinia virus
auuucuguauaucuauaau

SEQ ID NO: 3260699 - RNA, 14 nt, Vaccinia virus
ucucagaauucuaa

SEQ ID NO: 3260700 - RNA, 16 nt, Vaccinia virus
augauaaguccaucau

SEQ ID NO: 3260701 - RNA, 19 nt, Vaccinia virus
acuuuaaagcaaaaugguu

SEQ ID NO: 3260702 - RNA, 19 nt, Vaccinia virus
agauauuuggcuaaacuau

SEQ ID NO: 3260703 - RNA, 11 nt, Vaccinia virus
gauguauauau

SEQ ID NO: 3260704 - RNA, 20 nt, Vaccinia virus
aucauggauuuuauauagau

SEQ ID NO: 3260705 - RNA, 22 nt, Vaccinia virus
gaauauauagguaauacauaua

SEQ ID NO: 3260706 - RNA, 22 nt, Vaccinia virus
gccguauggaccauuauuuuua

SEQ ID NO: 3260707 - RNA, 15 nt, Vaccinia virus
acuaaucaauaauca

SEQ ID NO: 3260708 - RNA, 18 nt, Vaccinia virus
uguagacaaauauacuuu

SEQ ID NO: 3260709 - RNA, 14 nt, Vaccinia virus
uauaaauauguucc

SEQ ID NO: 3260710 - RNA, 15 nt, Vaccinia virus
cggagauaagacuag

SEQ ID NO: 3260711 - RNA, 21 nt, Vaccinia virus
uagggagaguauaaaacauua

SEQ ID NO: 3260712 - RNA, 15 nt, Vaccinia virus
uugaucuauguaguu

SEQ ID NO: 3260713 - RNA, 16 nt, Vaccinia virus
uaucgcauauuuauau

SEQ ID NO: 3260714 - RNA, 17 nt, Vaccinia virus
ucauaauauuaaucauc

SEQ ID NO: 3260715 - RNA, 13 nt, Vaccinia virus
cguagaaguugaa

SEQ ID NO: 3260716 - RNA, 19 nt, Vaccinia virus
ucuaaugugauucucugaa

SEQ ID NO: 3260717 - RNA, 17 nt, Vaccinia virus
auaaauacaccaaauau

SEQ ID NO: 3260718 - RNA, 23 nt, Vaccinia virus
auuuucagcguggauuucucaua

SEQ ID NO: 3260719 - RNA, 23 nt, Vaccinia virus
uauacccauacugaauggaugaa

SEQ ID NO: 3260720 - RNA, 16 nt, Vaccinia virus
ugauauguguaagaac

SEQ ID NO: 3260721 - RNA, 15 nt, Vaccinia virus
cuuaguaaacagucc

SEQ ID NO: 3260722 - RNA, 15 nt, Vaccinia virus
aucugaauaaaacau

SEQ ID NO: 3260723 - RNA, 12 nt, Vaccinia virus
uuacaaaucuag

SEQ ID NO: 3260724 - RNA, 20 nt, Vaccinia virus
ugaaugcugaugaacagguu

SEQ ID NO: 3260725 - RNA, 19 nt, Vaccinia virus
acacguuuauuucauauaa

SEQ ID NO: 3260726 - RNA, 18 nt, Vaccinia virus
agauauagauuugcauuu

SEQ ID NO: 3260727 - RNA, 19 nt, Vaccinia virus
acaauuaucauuuugauua

SEQ ID NO: 3260728 - RNA, 14 nt, Vaccinia virus
acaacacuaucuga

SEQ ID NO: 3260729 - RNA, 22 nt, Vaccinia virus
uuaucuauaucaucuacauaau

SEQ ID NO: 3260730 - RNA, 15 nt, Vaccinia virus
ucucugacauucaga

SEQ ID NO: 3260731 - RNA, 14 nt, Vaccinia virus
aaaucguguugugu

SEQ ID NO: 3260732 - RNA, 18 nt, Vaccinia virus
cuguuuuaacaucuuuuu

SEQ ID NO: 3260733 - RNA, 17 nt, Vaccinia virus
uaacaguuuuacuauau

SEQ ID NO: 3260734 - RNA, 15 nt, Vaccinia virus
cucuucucugcauuu

SEQ ID NO: 3260735 - RNA, 17 nt, Vaccinia virus
auuuagucuuacacauu

SEQ ID NO: 3260736 - RNA, 19 nt, Vaccinia virus
cucagaauucuaaaugaug

SEQ ID NO: 3260737 - RNA, 20 nt, Vaccinia virus
gcagguacuauaauauuaaa

SEQ ID NO: 3260738 - RNA, 15 nt, Vaccinia virus
guucauuuauaaucu

SEQ ID NO: 3260739 - RNA, 20 nt, Vaccinia virus
uacugauaacaaaauauuag

SEQ ID NO: 3260740 - RNA, 21 nt, Vaccinia virus
uuagauuaugaggaugcuguu

SEQ ID NO: 3260741 - RNA, 20 nt, Vaccinia virus
uuacaucgacgagauuauua

SEQ ID NO: 3260742 - RNA, 13 nt, Vaccinia virus
guguuauuuuuua

SEQ ID NO: 3260743 - RNA, 22 nt, Vaccinia virus
agaauucuuaguuaauggagaa

SEQ ID NO: 3260744 - RNA, 16 nt, Vaccinia virus
auugcauuuuguuaua

SEQ ID NO: 3260745 - RNA, 18 nt, Vaccinia virus
ugacaccagaaaacgacg

SEQ ID NO: 3260746 - RNA, 15 nt, Vaccinia virus
ccaaguuaaauuuua

SEQ ID NO: 3260747 - RNA, 12 nt, Vaccinia virus
aaacaaaaaacu

SEQ ID NO: 3260748 - RNA, 19 nt, Vaccinia virus
gcucuaccgcaguuagcca

SEQ ID NO: 3260749 - RNA, 18 nt, Vaccinia virus
gacauggcuucuuccaua

SEQ ID NO: 3260750 - RNA, 16 nt, Vaccinia virus
acgaguugacauaucg

SEQ ID NO: 3260751 - RNA, 15 nt, Vaccinia virus
aauuucgaaaauaua

SEQ ID NO: 3260752 - RNA, 13 nt, Vaccinia virus
aaaagcuuaaaau

SEQ ID NO: 3260753 - RNA, 21 nt, Vaccinia virus
caauaaacuccguagagaaau

SEQ ID NO: 3260754 - RNA, 17 nt, Vaccinia virus
auuucguuaaaacauuc

SEQ ID NO: 3260755 - RNA, 15 nt, Vaccinia virus
ccuugauuauguuuu

SEQ ID NO: 3260756 - RNA, 21 nt, Vaccinia virus
ucaugcauuuguuaguuauuc

SEQ ID NO: 3260757 - RNA, 12 nt, Vaccinia virus
uaaauuguguag

SEQ ID NO: 3260758 - RNA, 17 nt, Vaccinia virus
aggaagaauaucauauu

SEQ ID NO: 3260759 - RNA, 20 nt, Vaccinia virus
agauaauuuuaccagaauac

SEQ ID NO: 3260760 - RNA, 17 nt, Vaccinia virus
uacaauacgauaaacau

SEQ ID NO: 3260761 - RNA, 18 nt, Vaccinia virus
augguaucauuacaugcu

SEQ ID NO: 3260762 - RNA, 16 nt, Vaccinia virus
ucuguuaauuuuacua

SEQ ID NO: 3260763 - RNA, 17 nt, Vaccinia virus
aucuaucaaacaaaauu

SEQ ID NO: 3260764 - RNA, 13 nt, Vaccinia virus
auauuaucaaaau

SEQ ID NO: 3260765 - RNA, 21 nt, Vaccinia virus
uuggucagaaauauuguauug

SEQ ID NO: 3260766 - RNA, 19 nt, Vaccinia virus
aucuauaauuugauccaug

SEQ ID NO: 3260767 - RNA, 15 nt, Vaccinia virus
gacuacgaaacugau

SEQ ID NO: 3260768 - RNA, 22 nt, Vaccinia virus
ucuucgcccucaauuucccaaa

SEQ ID NO: 3260769 - RNA, 16 nt, Vaccinia virus
uauucauauucuuaaa

SEQ ID NO: 3260770 - RNA, 19 nt, Vaccinia virus
agcaucagcaaaacaguua

SEQ ID NO: 3260771 - RNA, 22 nt, Vaccinia virus
acgcagaaaagauaccacgagu

SEQ ID NO: 3260772 - RNA, 17 nt, Vaccinia virus
guuauaaaugaaauugu

SEQ ID NO: 3260773 - RNA, 13 nt, Vaccinia virus
acauauaaaugua

SEQ ID NO: 3260774 - RNA, 19 nt, Vaccinia virus
caauugucuguaaaccaca

SEQ ID NO: 3260775 - RNA, 14 nt, Vaccinia virus
ugucucuguuuuua

SEQ ID NO: 3260776 - RNA, 19 nt, Vaccinia virus
uacaucccgguuaaacauu

SEQ ID NO: 3260777 - RNA, 17 nt, Vaccinia virus
auuaaucuuuucuguac

SEQ ID NO: 3260778 - RNA, 22 nt, Vaccinia virus
cagaagauagcaaagagaugau

SEQ ID NO: 3260779 - RNA, 17 nt, Vaccinia virus
auuaaaccuaaauaauu

SEQ ID NO: 3260780 - RNA, 14 nt, Vaccinia virus
aaaagaucauacaa

SEQ ID NO: 3260781 - RNA, 13 nt, Vaccinia virus
aauucaucuucua

SEQ ID NO: 3260782 - RNA, 13 nt, Vaccinia virus
aucaauuaaauaa

SEQ ID NO: 3260783 - RNA, 16 nt, Vaccinia virus
guauacgcagaaaaga

SEQ ID NO: 3260784 - RNA, 20 nt, Vaccinia virus
aacuguagagggucaacaau

SEQ ID NO: 3260785 - RNA, 17 nt, Vaccinia virus
aucucuauguuucaguu

SEQ ID NO: 3260786 - RNA, 22 nt, Vaccinia virus
auuauauagauaauucuaauug

SEQ ID NO: 3260787 - RNA, 14 nt, Vaccinia virus
uacuguucaaacau

SEQ ID NO: 3260788 - RNA, 15 nt, Vaccinia virus
cuuaacuuguaauaa

SEQ ID NO: 3260789 - RNA, 16 nt, Vaccinia virus
ucucuauaacaaauau

SEQ ID NO: 3260790 - RNA, 19 nt, Vaccinia virus
ggcuccucucucaggcucu

SEQ ID NO: 3260791 - RNA, 16 nt, Vaccinia virus
uucgucgaauaaugua

SEQ ID NO: 3260792 - RNA, 14 nt, Vaccinia virus
ugauuauuagauuu

SEQ ID NO: 3260793 - RNA, 14 nt, Vaccinia virus
acagccucauauau

SEQ ID NO: 3260794 - RNA, 21 nt, Vaccinia virus
aaaaaucugauagaaagaaua

SEQ ID NO: 3260795 - RNA, 15 nt, Vaccinia virus
uccaaguucuauagu

SEQ ID NO: 3260796 - RNA, 20 nt, Vaccinia virus
gaucuagcaaaggaaauugu

SEQ ID NO: 3260797 - RNA, 18 nt, Vaccinia virus
ucuauuaagaguaacagc

SEQ ID NO: 3260798 - RNA, 21 nt, Vaccinia virus
uuuugaaggauuggacaaauc

SEQ ID NO: 3260799 - RNA, 18 nt, Vaccinia virus
cguuaguaacgccauuau

SEQ ID NO: 3260800 - RNA, 17 nt, Vaccinia virus
gaaguuguauacuauca

SEQ ID NO: 3260801 - RNA, 16 nt, Vaccinia virus
aaaguuaauauuuucu

SEQ ID NO: 3260802 - RNA, 20 nt, Vaccinia virus
cuauaaugaugauacucuca

SEQ ID NO: 3260803 - RNA, 13 nt, Vaccinia virus
guucauaaucauc

SEQ ID NO: 3260804 - RNA, 15 nt, Vaccinia virus
cggauggaugauaua

SEQ ID NO: 3260805 - RNA, 22 nt, Vaccinia virus
ucugaaauaacguauuuaaaca

SEQ ID NO: 3260806 - RNA, 15 nt, Vaccinia virus
aauauuguagcauua

SEQ ID NO: 3260807 - RNA, 22 nt, Vaccinia virus
ggacgacauauuaaucuuuuua

SEQ ID NO: 3260808 - RNA, 18 nt, Vaccinia virus
ugauucacguuauauaac

SEQ ID NO: 3260809 - RNA, 18 nt, Vaccinia virus
ucaaaguuucugaaauaa

SEQ ID NO: 3260810 - RNA, 16 nt, Vaccinia virus
aauccauaaauaaagu

SEQ ID NO: 3260811 - RNA, 17 nt, Vaccinia virus
ugacaucgcauuuauau

SEQ ID NO: 3260812 - RNA, 13 nt, Vaccinia virus
uugcuuuucuaau

SEQ ID NO: 3260813 - RNA, 21 nt, Vaccinia virus
uuuuagauaaaaaauuauaua

SEQ ID NO: 3260814 - RNA, 14 nt, Vaccinia virus
ugguggaugauguc

SEQ ID NO: 3260815 - RNA, 11 nt, Vaccinia virus
gcauacuaucg

SEQ ID NO: 3260816 - RNA, 23 nt, Vaccinia virus
guucgugccaauugaguaacauu

SEQ ID NO: 3260817 - RNA, 14 nt, Vaccinia virus
cucugaaucucugu

SEQ ID NO: 3260818 - RNA, 21 nt, Vaccinia virus
uucuggaauaggauaauaauu

SEQ ID NO: 3260819 - RNA, 16 nt, Vaccinia virus
aaaaacucuaacaugu

SEQ ID NO: 3260820 - RNA, 22 nt, Vaccinia virus
aaaacaaggacgcguuaauaaa

SEQ ID NO: 3260821 - RNA, 16 nt, Vaccinia virus
gauacguaauaaucuu

SEQ ID NO: 3260822 - RNA, 22 nt, Vaccinia virus
ccaucaaaagcauuaauacagu

SEQ ID NO: 3260823 - RNA, 13 nt, Vaccinia virus
cauguuaaaaaug

SEQ ID NO: 3260824 - RNA, 15 nt, Vaccinia virus
agacacgcauguguu

SEQ ID NO: 3260825 - RNA, 15 nt, Vaccinia virus
uauuagguuaucauc

SEQ ID NO: 3260826 - RNA, 14 nt, Vaccinia virus
aaucgcuuaauaga

SEQ ID NO: 3260827 - RNA, 12 nt, Vaccinia virus
gcuguaaacaag

SEQ ID NO: 3260828 - RNA, 17 nt, Vaccinia virus
cauaaaaacuuauacau

SEQ ID NO: 3260829 - RNA, 14 nt, Vaccinia virus
acuuagauuaaauu

SEQ ID NO: 3260830 - RNA, 21 nt, Vaccinia virus
guuagcaacgugauucaucaa

SEQ ID NO: 3260831 - RNA, 17 nt, Vaccinia virus
agaucuaauaaauggag

SEQ ID NO: 3260832 - RNA, 18 nt, Vaccinia virus
agcuuccagauuuaaaaa

SEQ ID NO: 3260833 - RNA, 14 nt, Vaccinia virus
cugaugaaacauuu

SEQ ID NO: 3260834 - RNA, 17 nt, Vaccinia virus
auuaaaucuuucauuuc

SEQ ID NO: 3260835 - RNA, 16 nt, Vaccinia virus
uuucagaggaauacag

SEQ ID NO: 3260836 - RNA, 20 nt, Vaccinia virus
ugaucauuggcaaaauccua

SEQ ID NO: 3260837 - RNA, 14 nt, Vaccinia virus
ucuuucucucuuug

SEQ ID NO: 3260838 - RNA, 12 nt, Vaccinia virus
agcaaaaaauga

SEQ ID NO: 3260839 - RNA, 22 nt, Vaccinia virus
uacuaauaggucuaaaaaccaa

SEQ ID NO: 3260840 - RNA, 15 nt, Vaccinia virus
gaauaugguaugauu

SEQ ID NO: 3260841 - RNA, 21 nt, Vaccinia virus
aaucagacucugguauuuaua

SEQ ID NO: 3260842 - RNA, 23 nt, Vaccinia virus
uucgagauuaaaugcaauaacaa

SEQ ID NO: 3260843 - RNA, 21 nt, Vaccinia virus
aucugaugagaucaauagaca

SEQ ID NO: 3260844 - RNA, 22 nt, Vaccinia virus
auaacaaccucuuuaauagccg

SEQ ID NO: 3260845 - RNA, 18 nt, Vaccinia virus
aguuaaagaaaaauacuc

SEQ ID NO: 3260846 - RNA, 18 nt, Vaccinia virus
aaagcaauacgauuuaug

SEQ ID NO: 3260847 - RNA, 20 nt, Vaccinia virus
uguguauacgcuaacgguau

SEQ ID NO: 3260848 - RNA, 17 nt, Vaccinia virus
guaaguuuaaaaaagac

SEQ ID NO: 3260849 - RNA, 14 nt, Vaccinia virus
auucauuaauucua

SEQ ID NO: 3260850 - RNA, 16 nt, Vaccinia virus
cucauuaaaacuucua

SEQ ID NO: 3260851 - RNA, 13 nt, Vaccinia virus
auauuugaaaauc

SEQ ID NO: 3260852 - RNA, 13 nt, Vaccinia virus
gcaucugauuuuu

SEQ ID NO: 3260853 - RNA, 19 nt, Vaccinia virus
uccuuaaauguuuucucug

SEQ ID NO: 3260854 - RNA, 17 nt, Vaccinia virus
caauggauggauacaau

SEQ ID NO: 3260855 - RNA, 17 nt, Vaccinia virus
acaaaaucuagacucua

SEQ ID NO: 3260856 - RNA, 14 nt, Vaccinia virus
aguaaaaucuauca

SEQ ID NO: 3260857 - RNA, 21 nt, Vaccinia virus
aucuauaacaugcuaaaccuu

SEQ ID NO: 3260858 - RNA, 20 nt, Vaccinia virus
uaaauguaucgugucucauu

SEQ ID NO: 3260859 - RNA, 17 nt, Vaccinia virus
gauuuaucuaguuuauc

SEQ ID NO: 3260860 - RNA, 14 nt, Vaccinia virus
gaugccucuuuuag

SEQ ID NO: 3260861 - RNA, 18 nt, Vaccinia virus
auagaugugagcuacugu

SEQ ID NO: 3260862 - RNA, 16 nt, Vaccinia virus
caaaaugaaaauacuu

SEQ ID NO: 3260863 - RNA, 12 nt, Vaccinia virus
aauaaaauggau

SEQ ID NO: 3260864 - RNA, 12 nt, Vaccinia virus
agaaaaaugauu

SEQ ID NO: 3260865 - RNA, 13 nt, Vaccinia virus
uaacggacaacaa

SEQ ID NO: 3260866 - RNA, 14 nt, Vaccinia virus
cuuucaagaauaaa

SEQ ID NO: 3260867 - RNA, 14 nt, Vaccinia virus
accaugaaagaaag

SEQ ID NO: 3260868 - RNA, 12 nt, Vaccinia virus
cugcuauuucug

SEQ ID NO: 3260869 - RNA, 14 nt, Vaccinia virus
uaccagaucuuaau

SEQ ID NO: 3260870 - RNA, 17 nt, Vaccinia virus
uguuauuacgaaucauu

SEQ ID NO: 3260871 - RNA, 13 nt, Vaccinia virus
uucuacauuuuca

SEQ ID NO: 3260872 - RNA, 19 nt, Vaccinia virus
acuuaucgcauagagacua

SEQ ID NO: 3260873 - RNA, 14 nt, Vaccinia virus
gccuguucauaaau

SEQ ID NO: 3260874 - RNA, 21 nt, Vaccinia virus
aaccauccguuaucgaagaau

SEQ ID NO: 3260875 - RNA, 22 nt, Vaccinia virus
aauaugggauaacgaauccaau

SEQ ID NO: 3260876 - RNA, 19 nt, Vaccinia virus
guuauucucggaugcuaaa

SEQ ID NO: 3260877 - RNA, 15 nt, Vaccinia virus
guauguaguagauau

SEQ ID NO: 3260878 - RNA, 13 nt, Vaccinia virus
ucuauucaucuga

SEQ ID NO: 3260879 - RNA, 21 nt, Vaccinia virus
augaaaauacuuuaguaauua

SEQ ID NO: 3260880 - RNA, 17 nt, Vaccinia virus
aauaugauuagaaguua

SEQ ID NO: 3260881 - RNA, 21 nt, Vaccinia virus
uauaauguuuccucuuucaua

SEQ ID NO: 3260882 - RNA, 12 nt, Vaccinia virus
uuacuaauagaa

SEQ ID NO: 3260883 - RNA, 22 nt, Vaccinia virus
ugaaucaaauguaacuauucaa

SEQ ID NO: 3260884 - RNA, 18 nt, Vaccinia virus
gaaacaucucuucuaguu

SEQ ID NO: 3260885 - RNA, 17 nt, Vaccinia virus
aaucauauacaacucuu

SEQ ID NO: 3260886 - RNA, 18 nt, Vaccinia virus
agaacgaugucaaaauau

SEQ ID NO: 3260887 - RNA, 14 nt, Vaccinia virus
uuuuaauauaaacg

SEQ ID NO: 3260888 - RNA, 16 nt, Vaccinia virus
cgauuagagauacaau

SEQ ID NO: 3260889 - RNA, 22 nt, Vaccinia virus
uguuuaauacuuauucauauuu

SEQ ID NO: 3260890 - RNA, 20 nt, Vaccinia virus
guaauaaucuugauuguaca

SEQ ID NO: 3260891 - RNA, 15 nt, Vaccinia virus
agauagaaacuauag

SEQ ID NO: 3260892 - RNA, 15 nt, Vaccinia virus
uauuuuaccguuugu

SEQ ID NO: 3260893 - RNA, 18 nt, Vaccinia virus
caauggauacugcaucug

SEQ ID NO: 3260894 - RNA, 17 nt, Vaccinia virus
ucggaguaucaucuauu

SEQ ID NO: 3260895 - RNA, 20 nt, Vaccinia virus
ggaucuccaucauccacaug

SEQ ID NO: 3260896 - RNA, 13 nt, Vaccinia virus
caagaccaaacac

SEQ ID NO: 3260897 - RNA, 13 nt, Vaccinia virus
ggauucaaaaaga

SEQ ID NO: 3260898 - RNA, 21 nt, Vaccinia virus
ucucugauguuuguuuucgau

SEQ ID NO: 3260899 - RNA, 15 nt, Vaccinia virus
auaauuauagaucag

SEQ ID NO: 3260900 - RNA, 11 nt, Vaccinia virus
uuuauuucuag

SEQ ID NO: 3260901 - RNA, 18 nt, Vaccinia virus
guaaaaugaaauaucuua

SEQ ID NO: 3260902 - RNA, 20 nt, Vaccinia virus
uaucugaguauaguguucau

SEQ ID NO: 3260903 - RNA, 16 nt, Vaccinia virus
uacuuuaaagaaguag

SEQ ID NO: 3260904 - RNA, 18 nt, Vaccinia virus
acuaugggaucaugcauu

SEQ ID NO: 3260905 - RNA, 19 nt, Vaccinia virus
auuggcaaaucuuaucauu

SEQ ID NO: 3260906 - RNA, 13 nt, Vaccinia virus
gcucgauaaucaa

SEQ ID NO: 3260907 - RNA, 24 nt, Vaccinia virus
acuauagaagaacucaagcagaaa

SEQ ID NO: 3260908 - RNA, 19 nt, Vaccinia virus
caacaaguuggaugauauu

SEQ ID NO: 3260909 - RNA, 13 nt, Vaccinia virus
uaaacauuccaca

SEQ ID NO: 3260910 - RNA, 13 nt, Vaccinia virus
ugaccaacucauc

SEQ ID NO: 3260911 - RNA, 20 nt, Vaccinia virus
uugguauaaauguuguaauu

SEQ ID NO: 3260912 - RNA, 18 nt, Vaccinia virus
guuaccucguuuauucag

SEQ ID NO: 3260913 - RNA, 23 nt, Vaccinia virus
gauuucuaucccgaaagaacuga

SEQ ID NO: 3260914 - RNA, 17 nt, Vaccinia virus
uuaaacuguuuauuaau

SEQ ID NO: 3260915 - RNA, 20 nt, Vaccinia virus
auuuucaagagauaguuuuc

SEQ ID NO: 3260916 - RNA, 24 nt, Vaccinia virus
aguaaugaagaaaaguauuaccuc

SEQ ID NO: 3260917 - RNA, 12 nt, Vaccinia virus
cuaaauuagaac

SEQ ID NO: 3260918 - RNA, 14 nt, Vaccinia virus
guuuaaaaauggug

SEQ ID NO: 3260919 - RNA, 16 nt, Vaccinia virus
cuauuuguauaauaau

SEQ ID NO: 3260920 - RNA, 14 nt, Vaccinia virus
uucguaaaauguag

SEQ ID NO: 3260921 - RNA, 23 nt, Vaccinia virus
auauaauggauuugcaccacuuu

SEQ ID NO: 3260922 - RNA, 21 nt, Vaccinia virus
aguauacaucaugaaaugaug

SEQ ID NO: 3260923 - RNA, 16 nt, Vaccinia virus
cuucagacaacaucuc

SEQ ID NO: 3260924 - RNA, 16 nt, Vaccinia virus
uuacguuaauacuaag

SEQ ID NO: 3260925 - RNA, 13 nt, Vaccinia virus
agaguucauuuau

SEQ ID NO: 3260926 - RNA, 14 nt, Vaccinia virus
guauaaagauguua

SEQ ID NO: 3260927 - RNA, 14 nt, Vaccinia virus
ugguauaucaacau

SEQ ID NO: 3260928 - RNA, 13 nt, Vaccinia virus
ugauuuacucauu

SEQ ID NO: 3260929 - RNA, 13 nt, Vaccinia virus
aguguuugauucu

SEQ ID NO: 3260930 - RNA, 16 nt, Vaccinia virus
uaaaaucugaucuugu

SEQ ID NO: 3260931 - RNA, 14 nt, Vaccinia virus
ucagagagauuucg

SEQ ID NO: 3260932 - RNA, 14 nt, Vaccinia virus
uaauaagaauaaag

SEQ ID NO: 3260933 - RNA, 22 nt, Vaccinia virus
uaaaauagacaauggaauucau

SEQ ID NO: 3260934 - RNA, 19 nt, Vaccinia virus
gaauauaaccacuacauca

SEQ ID NO: 3260935 - RNA, 14 nt, Vaccinia virus
guuaaagaucuuaa

SEQ ID NO: 3260936 - RNA, 12 nt, Vaccinia virus
aauuuagaauga

SEQ ID NO: 3260937 - RNA, 14 nt, Vaccinia virus
caagguuagaugua

SEQ ID NO: 3260938 - RNA, 23 nt, Vaccinia virus
caaauaucggaauaaguagacau

SEQ ID NO: 3260939 - RNA, 23 nt, Vaccinia virus
guugaucucaagccgucuuuucu

SEQ ID NO: 3260940 - RNA, 15 nt, Vaccinia virus
uuauauaaauauguu

SEQ ID NO: 3260941 - RNA, 15 nt, Vaccinia virus
aaauaaaauaaugau

SEQ ID NO: 3260942 - RNA, 15 nt, Vaccinia virus
auucguaguuuuuac

SEQ ID NO: 3260943 - RNA, 17 nt, Vaccinia virus
uggacgauuuugugaua

SEQ ID NO: 3260944 - RNA, 20 nt, Vaccinia virus
augaaaacuuuaaauacuua

SEQ ID NO: 3260945 - RNA, 17 nt, Vaccinia virus
cuguaccaaagucauca

SEQ ID NO: 3260946 - RNA, 23 nt, Vaccinia virus
cuuucugauggucucauaaaaaa

SEQ ID NO: 3260947 - RNA, 16 nt, Vaccinia virus
ugauuauaguuucuau

SEQ ID NO: 3260948 - RNA, 15 nt, Vaccinia virus
guucaaaaccuuuga

SEQ ID NO: 3260949 - RNA, 18 nt, Vaccinia virus
gacgaaauauuagaaaaa

SEQ ID NO: 3260950 - RNA, 21 nt, Vaccinia virus
agaauagcguuuacauauucu

SEQ ID NO: 3260951 - RNA, 14 nt, Vaccinia virus
aaguuauagaaugu

SEQ ID NO: 3260952 - RNA, 23 nt, Vaccinia virus
guuuuuuaauuccauaucuuuua

SEQ ID NO: 3260953 - RNA, 11 nt, Vaccinia virus
ggaaaaagcuc

SEQ ID NO: 3260954 - RNA, 12 nt, Vaccinia virus
auuauucauuuu

SEQ ID NO: 3260955 - RNA, 15 nt, Vaccinia virus
gguauauguuuacca

SEQ ID NO: 3260956 - RNA, 14 nt, Vaccinia virus
ggaaauggaagaaa

SEQ ID NO: 3260957 - RNA, 23 nt, Vaccinia virus
caguauugggacaacuuaaucug

SEQ ID NO: 3260958 - RNA, 16 nt, Vaccinia virus
agaccacacggagaac

SEQ ID NO: 3260959 - RNA, 14 nt, Vaccinia virus
aaugaguauuuaua

SEQ ID NO: 3260960 - RNA, 17 nt, Vaccinia virus
uucugguguaauauucu

SEQ ID NO: 3260961 - RNA, 22 nt, Vaccinia virus
uuaagagauccgauaaacauug

SEQ ID NO: 3260962 - RNA, 14 nt, Vaccinia virus
agcauugaaaauac

SEQ ID NO: 3260963 - RNA, 23 nt, Vaccinia virus
uaggaaaacccgcacacauaaac

SEQ ID NO: 3260964 - RNA, 21 nt, Vaccinia virus
uugaugacgucaaacaauguu

SEQ ID NO: 3260965 - RNA, 18 nt, Vaccinia virus
agaacuaacaaacuauac

SEQ ID NO: 3260966 - RNA, 18 nt, Vaccinia virus
ucacacuacugaaaaaag

SEQ ID NO: 3260967 - RNA, 13 nt, Vaccinia virus
ucuuaaaagguuu

SEQ ID NO: 3260968 - RNA, 20 nt, Vaccinia virus
cucuauuucuuaaugaauuu

SEQ ID NO: 3260969 - RNA, 13 nt, Vaccinia virus
guauauuauucau

SEQ ID NO: 3260970 - RNA, 15 nt, Vaccinia virus
ccagauauauaucuu

SEQ ID NO: 3260971 - RNA, 24 nt, Vaccinia virus
auucaaaauggcaauuauacuaga

SEQ ID NO: 3260972 - RNA, 16 nt, Vaccinia virus
auaguagaguaaacau

SEQ ID NO: 3260973 - RNA, 17 nt, Vaccinia virus
uagugauuccauugaua

SEQ ID NO: 3260974 - RNA, 17 nt, Vaccinia virus
aauagaaaaaacaugug

SEQ ID NO: 3260975 - RNA, 22 nt, Vaccinia virus
uuuaugaaugaugauauauaac

SEQ ID NO: 3260976 - RNA, 18 nt, Vaccinia virus
acucaacggaaaacauuu

SEQ ID NO: 3260977 - RNA, 15 nt, Vaccinia virus
uccagugcauuucua

SEQ ID NO: 3260978 - RNA, 16 nt, Vaccinia virus
gcugauuaacuuccac

SEQ ID NO: 3260979 - RNA, 15 nt, Vaccinia virus
aauuauacaagagau

SEQ ID NO: 3260980 - RNA, 23 nt, Vaccinia virus
ucuauccuuuuccggaagcaaug

SEQ ID NO: 3260981 - RNA, 20 nt, Vaccinia virus
aauuacuuaaagauagaaau

SEQ ID NO: 3260982 - RNA, 17 nt, Vaccinia virus
uaugcauccaaaguauu

SEQ ID NO: 3260983 - RNA, 19 nt, Vaccinia virus
uacagaaggcaaacgcuau

SEQ ID NO: 3260984 - RNA, 16 nt, Vaccinia virus
uagaguagacauuaau

SEQ ID NO: 3260985 - RNA, 20 nt, Vaccinia virus
auaaaucaagaucauaauua

SEQ ID NO: 3260986 - RNA, 23 nt, Vaccinia virus
uagccagacaaauggucaaugau

SEQ ID NO: 3260987 - RNA, 15 nt, Vaccinia virus
auagauucuugguaa

SEQ ID NO: 3260988 - RNA, 19 nt, Vaccinia virus
uguauugauuacaguguau

SEQ ID NO: 3260989 - RNA, 15 nt, Vaccinia virus
ucuuuaauacagaug

SEQ ID NO: 3260990 - RNA, 14 nt, Vaccinia virus
aguuauuaaugaug

SEQ ID NO: 3260991 - RNA, 17 nt, Vaccinia virus
uuuucuuaugcauguuu

SEQ ID NO: 3260992 - RNA, 17 nt, Vaccinia virus
guauuguucuaaagcca

SEQ ID NO: 3260993 - RNA, 23 nt, Vaccinia virus
aauauggagagguguauuuccau

SEQ ID NO: 3260994 - RNA, 18 nt, Vaccinia virus
auagaauuuagaaauaua

SEQ ID NO: 3260995 - RNA, 18 nt, Vaccinia virus
uuagacuguuuguagaau

SEQ ID NO: 3260996 - RNA, 16 nt, Vaccinia virus
caagauuccuuuucua

SEQ ID NO: 3260997 - RNA, 17 nt, Vaccinia virus
auuagugauagaacguu

SEQ ID NO: 3260998 - RNA, 19 nt, Vaccinia virus
gugagaacuuguuaaagaa

SEQ ID NO: 3260999 - RNA, 23 nt, Vaccinia virus
guacuguucaaacaugaugagau

SEQ ID NO: 3261000 - RNA, 12 nt, Vaccinia virus
gacuuuguuaau

SEQ ID NO: 3261001 - RNA, 18 nt, Vaccinia virus
uaaaaaaacauuauucua

SEQ ID NO: 3261002 - RNA, 17 nt, Vaccinia virus
aacugauucaauacgaa

SEQ ID NO: 3261003 - RNA, 16 nt, Vaccinia virus
ugaaaugauaacuguu

SEQ ID NO: 3261004 - RNA, 14 nt, Vaccinia virus
acucucaaaaugcu

SEQ ID NO: 3261005 - RNA, 13 nt, Vaccinia virus
ugcaccagaauua

SEQ ID NO: 3261006 - RNA, 13 nt, Vaccinia virus
guccgcuuuagua

SEQ ID NO: 3261007 - RNA, 16 nt, Vaccinia virus
uagauauaacuucugg

SEQ ID NO: 3261008 - RNA, 13 nt, Vaccinia virus
aucacuaacaaua

SEQ ID NO: 3261009 - RNA, 15 nt, Vaccinia virus
cuacacuaaaaugau

SEQ ID NO: 3261010 - RNA, 21 nt, Vaccinia virus
ccuccaccgaugauggaguaa

SEQ ID NO: 3261011 - RNA, 18 nt, Vaccinia virus
ucaauccuuugauuauca

SEQ ID NO: 3261012 - RNA, 21 nt, Vaccinia virus
auuauuggguaaguuuaaaaa

SEQ ID NO: 3261013 - RNA, 19 nt, Vaccinia virus
uauagauaacauaguuugg

SEQ ID NO: 3261014 - RNA, 13 nt, Vaccinia virus
guauuagauaaau

SEQ ID NO: 3261015 - RNA, 19 nt, Vaccinia virus
gugaauaugaucuucaucu

SEQ ID NO: 3261016 - RNA, 16 nt, Vaccinia virus
cauaaaaaaauauauu

SEQ ID NO: 3261017 - RNA, 15 nt, Vaccinia virus
aaucugauaaauaua

SEQ ID NO: 3261018 - RNA, 19 nt, Vaccinia virus
auaacauguuaauuuccga

SEQ ID NO: 3261019 - RNA, 19 nt, Vaccinia virus
cagucaagucaaugauauu

SEQ ID NO: 3261020 - RNA, 14 nt, Vaccinia virus
ucacagucuguuuu

SEQ ID NO: 3261021 - RNA, 22 nt, Vaccinia virus
aaucccuacauauuuuagaaca

SEQ ID NO: 3261022 - RNA, 20 nt, Vaccinia virus
auuuuggagagccuuaacga

SEQ ID NO: 3261023 - RNA, 16 nt, Vaccinia virus
uaauauaaacaucuug

SEQ ID NO: 3261024 - RNA, 12 nt, Vaccinia virus
acaucuuccuuc

SEQ ID NO: 3261025 - RNA, 20 nt, Vaccinia virus
auuuaugauauauacacuuu

SEQ ID NO: 3261026 - RNA, 16 nt, Vaccinia virus
aguaaaaauaacuaga

SEQ ID NO: 3261027 - RNA, 14 nt, Vaccinia virus
ucaaaagaaaucuu

SEQ ID NO: 3261028 - RNA, 17 nt, Vaccinia virus
aauucuaugaugaaaca

SEQ ID NO: 3261029 - RNA, 23 nt, Vaccinia virus
agaaaauuagaucugauaauauu

SEQ ID NO: 3261030 - RNA, 12 nt, Vaccinia virus
aagaagaaguua

SEQ ID NO: 3261031 - RNA, 11 nt, Vaccinia virus
ugaagaaauga

SEQ ID NO: 3261032 - RNA, 21 nt, Vaccinia virus
aaugguauacacaucaaaaua

SEQ ID NO: 3261033 - RNA, 13 nt, Vaccinia virus
aaaucuaacuucu

SEQ ID NO: 3261034 - RNA, 17 nt, Vaccinia virus
ugaaugggaauuucuau

SEQ ID NO: 3261035 - RNA, 21 nt, Vaccinia virus
uuacaauguagaaauuagaaa

SEQ ID NO: 3261036 - RNA, 21 nt, Vaccinia virus
accugccauaaauaaaugcuu

SEQ ID NO: 3261037 - RNA, 18 nt, Vaccinia virus
uuacauaguugauaaaaa

SEQ ID NO: 3261038 - RNA, 14 nt, Vaccinia virus
uuauauuauuuaca

SEQ ID NO: 3261039 - RNA, 14 nt, Vaccinia virus
gcuuuccuaaagaa

SEQ ID NO: 3261040 - RNA, 15 nt, Vaccinia virus
agugguauaucuugu

SEQ ID NO: 3261041 - RNA, 20 nt, Vaccinia virus
uuaauauaugcucuagauau

SEQ ID NO: 3261042 - RNA, 16 nt, Vaccinia virus
caagauuuuuaaacaa

SEQ ID NO: 3261043 - RNA, 18 nt, Vaccinia virus
acaauccuagaacgaaua

SEQ ID NO: 3261044 - RNA, 22 nt, Vaccinia virus
uaguaaacuugacuaaaucuua

SEQ ID NO: 3261045 - RNA, 13 nt, Vaccinia virus
aauucaaauagau

SEQ ID NO: 3261046 - RNA, 16 nt, Vaccinia virus
auauauuaagaaguuc

SEQ ID NO: 3261047 - RNA, 23 nt, Vaccinia virus
acuuccucauuaagauugucaug

SEQ ID NO: 3261048 - RNA, 14 nt, Vaccinia virus
agucauuauauacu

SEQ ID NO: 3261049 - RNA, 14 nt, Vaccinia virus
auggcaacgacuau

SEQ ID NO: 3261050 - RNA, 14 nt, Vaccinia virus
caaagcaucgauuu

SEQ ID NO: 3261051 - RNA, 20 nt, Vaccinia virus
cuaaaaaauagcgcugaaaa

SEQ ID NO: 3261052 - RNA, 20 nt, Vaccinia virus
auucaagauuuuauuaucga

SEQ ID NO: 3261053 - RNA, 19 nt, Vaccinia virus
agaaacgauaccaucuucu

SEQ ID NO: 3261054 - RNA, 23 nt, Vaccinia virus
ugcacaauccaaacuuuuucaca

SEQ ID NO: 3261055 - RNA, 15 nt, Vaccinia virus
uccaauguauuuaug

SEQ ID NO: 3261056 - RNA, 14 nt, Vaccinia virus
ucaauuuguacauc

SEQ ID NO: 3261057 - RNA, 23 nt, Vaccinia virus
uuuaagacugcugaauguaucuu

SEQ ID NO: 3261058 - RNA, 21 nt, Vaccinia virus
auaucaacaacguggaauugu

SEQ ID NO: 3261059 - RNA, 19 nt, Vaccinia virus
uaugugaauaugguaugau

SEQ ID NO: 3261060 - RNA, 14 nt, Vaccinia virus
uacaauaacuacau

SEQ ID NO: 3261061 - RNA, 22 nt, Vaccinia virus
ccauuuaucauggaaaagaauu

SEQ ID NO: 3261062 - RNA, 16 nt, Vaccinia virus
aaaaguccucgaauua

SEQ ID NO: 3261063 - RNA, 14 nt, Vaccinia virus
acacaaaaagaaag

SEQ ID NO: 3261064 - RNA, 17 nt, Vaccinia virus
uauuaacgaguuccauu

SEQ ID NO: 3261065 - RNA, 13 nt, Vaccinia virus
ggccaaaaugaua

SEQ ID NO: 3261066 - RNA, 15 nt, Vaccinia virus
aauccuuugauuauc

SEQ ID NO: 3261067 - RNA, 21 nt, Vaccinia virus
auuuaaaugaaucccaaacau

SEQ ID NO: 3261068 - RNA, 14 nt, Vaccinia virus
cgaaugaauguuuu

SEQ ID NO: 3261069 - RNA, 20 nt, Vaccinia virus
cguggcaaacaauguauaca

SEQ ID NO: 3261070 - RNA, 18 nt, Vaccinia virus
uaagcuuuuuaaaaucau

SEQ ID NO: 3261071 - RNA, 20 nt, Vaccinia virus
uacguaauagaacgugucau

SEQ ID NO: 3261072 - RNA, 23 nt, Vaccinia virus
auggauuaguuagacugaaugcu

SEQ ID NO: 3261073 - RNA, 17 nt, Vaccinia virus
uugauaaagauagauga

SEQ ID NO: 3261074 - RNA, 18 nt, Vaccinia virus
cauuagguuaaaugauuu

SEQ ID NO: 3261075 - RNA, 13 nt, Vaccinia virus
agacuuuguagaa

SEQ ID NO: 3261076 - RNA, 21 nt, Vaccinia virus
auaaagaaguuauagaaugua

SEQ ID NO: 3261077 - RNA, 15 nt, Vaccinia virus
agauuacucauguaa

SEQ ID NO: 3261078 - RNA, 15 nt, Vaccinia virus
cauggucuagaugua

SEQ ID NO: 3261079 - RNA, 23 nt, Vaccinia virus
aguucucuuuucauguucgaaaa

SEQ ID NO: 3261080 - RNA, 19 nt, Vaccinia virus
aauaaaaguggaagucauu

SEQ ID NO: 3261081 - RNA, 12 nt, Vaccinia virus
aauguucauaau

SEQ ID NO: 3261082 - RNA, 14 nt, Vaccinia virus
cuagcgacucuguu

SEQ ID NO: 3261083 - RNA, 20 nt, Vaccinia virus
auugcacuauacauuuugaa

SEQ ID NO: 3261084 - RNA, 16 nt, Vaccinia virus
aauuuuuguuuccguu

SEQ ID NO: 3261085 - RNA, 12 nt, Vaccinia virus
acauuuacauau

SEQ ID NO: 3261086 - RNA, 12 nt, Vaccinia virus
uuauaacuaaac

SEQ ID NO: 3261087 - RNA, 17 nt, Vaccinia virus
ugcaacaucuggagaau

SEQ ID NO: 3261088 - RNA, 13 nt, Vaccinia virus
uaugcgauagcaa

SEQ ID NO: 3261089 - RNA, 12 nt, Vaccinia virus
aacaaacagcaa

SEQ ID NO: 3261090 - RNA, 19 nt, Vaccinia virus
uaagacuuauucucuacau

SEQ ID NO: 3261091 - RNA, 11 nt, Vaccinia virus
cuuuuaauuuu

SEQ ID NO: 3261092 - RNA, 15 nt, Vaccinia virus
uagacauuaauagaa

SEQ ID NO: 3261093 - RNA, 22 nt, Vaccinia virus
auaguuaccacgugcuguacca

SEQ ID NO: 3261094 - RNA, 17 nt, Vaccinia virus
cagacacagacgauauu

SEQ ID NO: 3261095 - RNA, 14 nt, Vaccinia virus
uuucaaagaaugag

SEQ ID NO: 3261096 - RNA, 17 nt, Vaccinia virus
ucacaaguaugaagaaa

SEQ ID NO: 3261097 - RNA, 17 nt, Vaccinia virus
acaacuaccaauuguuu

SEQ ID NO: 3261098 - RNA, 13 nt, Vaccinia virus
uauagaauugucu

SEQ ID NO: 3261099 - RNA, 19 nt, Vaccinia virus
ugagcauaaacauaauaaa

SEQ ID NO: 3261100 - RNA, 17 nt, Vaccinia virus
aucgacuauuuuaaaua

SEQ ID NO: 3261101 - RNA, 23 nt, Vaccinia virus
gauucguccuuaaccaacugauu

SEQ ID NO: 3261102 - RNA, 13 nt, Vaccinia virus
auucucuauuuug

SEQ ID NO: 3261103 - RNA, 15 nt, Vaccinia virus
aaggggugagaaugu

SEQ ID NO: 3261104 - RNA, 20 nt, Vaccinia virus
aauagaaucuauuuuaauga

SEQ ID NO: 3261105 - RNA, 19 nt, Vaccinia virus
ccaauuacugauaauguag

SEQ ID NO: 3261106 - RNA, 14 nt, Vaccinia virus
auggaugcagaaua

SEQ ID NO: 3261107 - RNA, 13 nt, Vaccinia virus
gacaaauuauucu

SEQ ID NO: 3261108 - RNA, 20 nt, Vaccinia virus
caacaaguguguagauaucu

SEQ ID NO: 3261109 - RNA, 21 nt, Vaccinia virus
cuauuuauugacauuaaucua

SEQ ID NO: 3261110 - RNA, 13 nt, Vaccinia virus
aauuaauaaugau

SEQ ID NO: 3261111 - RNA, 17 nt, Vaccinia virus
aaauuccgcuacuaaua

SEQ ID NO: 3261112 - RNA, 20 nt, Vaccinia virus
aacgaacgaggugugaaugu

SEQ ID NO: 3261113 - RNA, 18 nt, Vaccinia virus
ugacgcaguaacauauau

SEQ ID NO: 3261114 - RNA, 18 nt, Vaccinia virus
aauguuaucgaugaugua

SEQ ID NO: 3261115 - RNA, 18 nt, Vaccinia virus
auacucccacaaauacug

SEQ ID NO: 3261116 - RNA, 20 nt, Vaccinia virus
agaagauguuagaaaaaaug

SEQ ID NO: 3261117 - RNA, 23 nt, Vaccinia virus
uaaucuauuuuaccucuucugau

SEQ ID NO: 3261118 - RNA, 18 nt, Vaccinia virus
auaccaacauuaaaaugu

SEQ ID NO: 3261119 - RNA, 22 nt, Vaccinia virus
acugauaaaguagauuaugaag

SEQ ID NO: 3261120 - RNA, 22 nt, Vaccinia virus
ucgagagacuuuguagaaacaa

SEQ ID NO: 3261121 - RNA, 17 nt, Vaccinia virus
aaaguauauauaaguua

SEQ ID NO: 3261122 - RNA, 17 nt, Vaccinia virus
aacauauaauuauaaga

SEQ ID NO: 3261123 - RNA, 16 nt, Vaccinia virus
cauauguuuaaacgac

SEQ ID NO: 3261124 - RNA, 18 nt, Vaccinia virus
caaacaggaaagaaguau

SEQ ID NO: 3261125 - RNA, 16 nt, Vaccinia virus
uacgaacaauaucuua

SEQ ID NO: 3261126 - RNA, 15 nt, Vaccinia virus
cacaaccaaauacuu

SEQ ID NO: 3261127 - RNA, 16 nt, Vaccinia virus
aucaacagauagcuug

SEQ ID NO: 3261128 - RNA, 13 nt, Vaccinia virus
uaugaauaucuuc

SEQ ID NO: 3261129 - RNA, 15 nt, Vaccinia virus
auuauagauuuucca

SEQ ID NO: 3261130 - RNA, 18 nt, Vaccinia virus
ccuguaguuuuaacugga

SEQ ID NO: 3261131 - RNA, 22 nt, Vaccinia virus
caauggauaccuugcuauuuuu

SEQ ID NO: 3261132 - RNA, 22 nt, Vaccinia virus
aacacgauuauuauaaaauaac

SEQ ID NO: 3261133 - RNA, 17 nt, Vaccinia virus
uuaaauuauuuaguuuu

SEQ ID NO: 3261134 - RNA, 17 nt, Vaccinia virus
uggaaacuauaauuuug

SEQ ID NO: 3261135 - RNA, 19 nt, Vaccinia virus
uauuaagaaguuccaugau

SEQ ID NO: 3261136 - RNA, 19 nt, Vaccinia virus
uauuaaaguacguaaaucu

SEQ ID NO: 3261137 - RNA, 17 nt, Vaccinia virus
gaaacuguaaagaacag

SEQ ID NO: 3261138 - RNA, 20 nt, Vaccinia virus
ugauaucgacggaagaaguu

SEQ ID NO: 3261139 - RNA, 15 nt, Vaccinia virus
uacuagauguuguaa

SEQ ID NO: 3261140 - RNA, 12 nt, Vaccinia virus
acagacuuuaac

SEQ ID NO: 3261141 - RNA, 17 nt, Vaccinia virus
ucccauauauuccauga

SEQ ID NO: 3261142 - RNA, 17 nt, Vaccinia virus
aaaugacuaauuuugua

SEQ ID NO: 3261143 - RNA, 19 nt, Vaccinia virus
uuauaaugaggauaauaag

SEQ ID NO: 3261144 - RNA, 18 nt, Vaccinia virus
caaagaggguauauccau

SEQ ID NO: 3261145 - RNA, 22 nt, Vaccinia virus
ucacucgguggauacaauaaau

SEQ ID NO: 3261146 - RNA, 23 nt, Vaccinia virus
aaaacagaauaugagaaugaaua

SEQ ID NO: 3261147 - RNA, 24 nt, Vaccinia virus
auuaucaacguaacuauauuccaa

SEQ ID NO: 3261148 - RNA, 20 nt, Vaccinia virus
gucuguaacucugauaaucu

SEQ ID NO: 3261149 - RNA, 16 nt, Vaccinia virus
uaguuuaucauacuua

SEQ ID NO: 3261150 - RNA, 23 nt, Vaccinia virus
agaaacacugaagcuaacgauga

SEQ ID NO: 3261151 - RNA, 17 nt, Vaccinia virus
aauaacuaguauaaaau

SEQ ID NO: 3261152 - RNA, 20 nt, Vaccinia virus
uggcauagacuuauacugug

SEQ ID NO: 3261153 - RNA, 18 nt, Vaccinia virus
accaauaaaaauaaacua

SEQ ID NO: 3261154 - RNA, 22 nt, Vaccinia virus
auagcugaaucugauaaauaua

SEQ ID NO: 3261155 - RNA, 22 nt, Vaccinia virus
aaauuaacagauaaaaagacuu

SEQ ID NO: 3261156 - RNA, 12 nt, Vaccinia virus
agaauauacucu

SEQ ID NO: 3261157 - RNA, 15 nt, Vaccinia virus
uagccacaauuauug

SEQ ID NO: 3261158 - RNA, 15 nt, Vaccinia virus
augugaguauuggau

SEQ ID NO: 3261159 - RNA, 14 nt, Vaccinia virus
uaaaacauuugcau

SEQ ID NO: 3261160 - RNA, 22 nt, Vaccinia virus
uauaaucuuuuucaucuuguga

SEQ ID NO: 3261161 - RNA, 15 nt, Vaccinia virus
acauaaaaaaaaugu

SEQ ID NO: 3261162 - RNA, 14 nt, Vaccinia virus
ucucaucuaucaaa

SEQ ID NO: 3261163 - RNA, 15 nt, Vaccinia virus
uaucuaacucguaaa

SEQ ID NO: 3261164 - RNA, 19 nt, Vaccinia virus
uuuguagcucucccagauu

SEQ ID NO: 3261165 - RNA, 21 nt, Vaccinia virus
augaaaugauucucucaacau

SEQ ID NO: 3261166 - RNA, 21 nt, Vaccinia virus
ucuauaaacgucguauguaga

SEQ ID NO: 3261167 - RNA, 13 nt, Vaccinia virus
uaaacauggauuu

SEQ ID NO: 3261168 - RNA, 20 nt, Vaccinia virus
cugauaaguucuuuauacag

SEQ ID NO: 3261169 - RNA, 13 nt, Vaccinia virus
cuacaauauuuca

SEQ ID NO: 3261170 - RNA, 19 nt, Vaccinia virus
cauuauuacauagauguau

SEQ ID NO: 3261171 - RNA, 19 nt, Vaccinia virus
acggugcugaccuggaaaa

SEQ ID NO: 3261172 - RNA, 23 nt, Vaccinia virus
uaaaucuaaaauugauggaugag

SEQ ID NO: 3261173 - RNA, 15 nt, Vaccinia virus
auugauagugaauga

SEQ ID NO: 3261174 - RNA, 16 nt, Vaccinia virus
cuagcgauuaugaaaa

SEQ ID NO: 3261175 - RNA, 18 nt, Vaccinia virus
gucaucuccagaggaaau

SEQ ID NO: 3261176 - RNA, 21 nt, Vaccinia virus
aucagucuccaguuaauauau

SEQ ID NO: 3261177 - RNA, 16 nt, Vaccinia virus
aauaccucauaaaacg

SEQ ID NO: 3261178 - RNA, 13 nt, Vaccinia virus
uaaauauuucauu

SEQ ID NO: 3261179 - RNA, 17 nt, Vaccinia virus
cgucucaucuguuuaag

SEQ ID NO: 3261180 - RNA, 19 nt, Vaccinia virus
aauaugguaauuuagagaa

SEQ ID NO: 3261181 - RNA, 17 nt, Vaccinia virus
ccaauucguauaaauau

SEQ ID NO: 3261182 - RNA, 20 nt, Vaccinia virus
uaauuuaugaggugaacgau

SEQ ID NO: 3261183 - RNA, 18 nt, Vaccinia virus
guacaggacguaacuaua

SEQ ID NO: 3261184 - RNA, 14 nt, Vaccinia virus
uauuccauuaaauu

SEQ ID NO: 3261185 - RNA, 17 nt, Vaccinia virus
ugcacguuuacauaucu

SEQ ID NO: 3261186 - RNA, 14 nt, Vaccinia virus
auuaucaaaaagaa

SEQ ID NO: 3261187 - RNA, 16 nt, Vaccinia virus
auaaucaauaauauau

SEQ ID NO: 3261188 - RNA, 15 nt, Vaccinia virus
ucacuaauaaauugg

SEQ ID NO: 3261189 - RNA, 20 nt, Vaccinia virus
cuucaugaacauaaucaguu

SEQ ID NO: 3261190 - RNA, 23 nt, Vaccinia virus
auuucucuaccacaggagaaugg

SEQ ID NO: 3261191 - RNA, 23 nt, Vaccinia virus
uguagauaauaacuaaaaaucaa

SEQ ID NO: 3261192 - RNA, 22 nt, Vaccinia virus
acuaagugaacgaaagguauac

SEQ ID NO: 3261193 - RNA, 18 nt, Vaccinia virus
gcuaaaucguauauguua

SEQ ID NO: 3261194 - RNA, 12 nt, Vaccinia virus
uauaauguuucc

SEQ ID NO: 3261195 - RNA, 14 nt, Vaccinia virus
uaaacguacauuuu

SEQ ID NO: 3261196 - RNA, 18 nt, Vaccinia virus
uugagaugcugcuccugg

SEQ ID NO: 3261197 - RNA, 16 nt, Vaccinia virus
agcuuccagauuuaaa

SEQ ID NO: 3261198 - RNA, 16 nt, Vaccinia virus
guuaacauuuuauuau

SEQ ID NO: 3261199 - RNA, 12 nt, Vaccinia virus
uuaauauguaca

SEQ ID NO: 3261200 - RNA, 23 nt, Vaccinia virus
agauaucauaaaugaaauagaua

SEQ ID NO: 3261201 - RNA, 19 nt, Vaccinia virus
aagucauacuagaauaaag

SEQ ID NO: 3261202 - RNA, 20 nt, Vaccinia virus
aacucgucuccccaaacauu

SEQ ID NO: 3261203 - RNA, 15 nt, Vaccinia virus
uucccaaauaguuuu

SEQ ID NO: 3261204 - RNA, 15 nt, Vaccinia virus
auaacuguuuaaaaa

SEQ ID NO: 3261205 - RNA, 15 nt, Vaccinia virus
auagcaguauuuccc

SEQ ID NO: 3261206 - RNA, 19 nt, Vaccinia virus
uuuagacagugguuucaug

SEQ ID NO: 3261207 - RNA, 22 nt, Vaccinia virus
gauauugucccacggaagugaa

SEQ ID NO: 3261208 - RNA, 21 nt, Vaccinia virus
uuaaugccgauuuaauacguu

SEQ ID NO: 3261209 - RNA, 19 nt, Vaccinia virus
auccuccggaguauuaaug

SEQ ID NO: 3261210 - RNA, 23 nt, Vaccinia virus
auacucuaugaauggauacuugu

SEQ ID NO: 3261211 - RNA, 18 nt, Vaccinia virus
ucgugaaauaggaauaau

SEQ ID NO: 3261212 - RNA, 14 nt, Vaccinia virus
auacgaaaauagau

SEQ ID NO: 3261213 - RNA, 15 nt, Vaccinia virus
aaaguuaguacagaa

SEQ ID NO: 3261214 - RNA, 14 nt, Vaccinia virus
ugguuuaauuauuu

SEQ ID NO: 3261215 - RNA, 22 nt, Vaccinia virus
uauaaucaguagcguguuuuaa

SEQ ID NO: 3261216 - RNA, 19 nt, Vaccinia virus
uccaaguucuauaguuucu

SEQ ID NO: 3261217 - RNA, 19 nt, Vaccinia virus
aaaucuaguucugcauugu

SEQ ID NO: 3261218 - RNA, 19 nt, Vaccinia virus
aacauugauuuuaaaauua

SEQ ID NO: 3261219 - RNA, 23 nt, Vaccinia virus
agaaucagcgucguuuaacacaa

SEQ ID NO: 3261220 - RNA, 16 nt, Vaccinia virus
guacauuaauaaauga

SEQ ID NO: 3261221 - RNA, 16 nt, Vaccinia virus
gucucuauaaaaauga

SEQ ID NO: 3261222 - RNA, 18 nt, Vaccinia virus
uauuauggaaaucaacau

SEQ ID NO: 3261223 - RNA, 18 nt, Vaccinia virus
aaauuauggcguuuguau

SEQ ID NO: 3261224 - RNA, 22 nt, Vaccinia virus
uuuuacccucaaucauguacua

SEQ ID NO: 3261225 - RNA, 18 nt, Vaccinia virus
ggauuaauauauguuaua

SEQ ID NO: 3261226 - RNA, 17 nt, Vaccinia virus
uuaauuaagauauuguu

SEQ ID NO: 3261227 - RNA, 14 nt, Vaccinia virus
aauggcugaauggc

SEQ ID NO: 3261228 - RNA, 15 nt, Vaccinia virus
cucaauuaguuuauu

SEQ ID NO: 3261229 - RNA, 15 nt, Vaccinia virus
aaaaagauuuuguua

SEQ ID NO: 3261230 - RNA, 17 nt, Vaccinia virus
guuucgauauaaucauc

SEQ ID NO: 3261231 - RNA, 12 nt, Vaccinia virus
cuaauuucugaa

SEQ ID NO: 3261232 - RNA, 18 nt, Vaccinia virus
acagaucuaguauaauua

SEQ ID NO: 3261233 - RNA, 19 nt, Vaccinia virus
ugaugguuuucuaaauaga

SEQ ID NO: 3261234 - RNA, 16 nt, Vaccinia virus
acaaaaguuaauaauu

SEQ ID NO: 3261235 - RNA, 11 nt, Vaccinia virus
aauacaaaauc

SEQ ID NO: 3261236 - RNA, 14 nt, Vaccinia virus
uauaucuucuucug

SEQ ID NO: 3261237 - RNA, 19 nt, Vaccinia virus
uggaaacaauucauaauua

SEQ ID NO: 3261238 - RNA, 15 nt, Vaccinia virus
gaggauguuaaacaa

SEQ ID NO: 3261239 - RNA, 13 nt, Vaccinia virus
agaaaaaaauauu

SEQ ID NO: 3261240 - RNA, 14 nt, Vaccinia virus
cgguuuuccaucau

SEQ ID NO: 3261241 - RNA, 22 nt, Vaccinia virus
auccucuauccgacuagaauua

SEQ ID NO: 3261242 - RNA, 22 nt, Vaccinia virus
gcauucuucauucuauuaaugu

SEQ ID NO: 3261243 - RNA, 15 nt, Vaccinia virus
agaucaagaaacauu

SEQ ID NO: 3261244 - RNA, 18 nt, Vaccinia virus
aaguaggauuauguaaca

SEQ ID NO: 3261245 - RNA, 18 nt, Vaccinia virus
aaaauuauugauauguau

SEQ ID NO: 3261246 - RNA, 23 nt, Vaccinia virus
auugguugcgucaagaacuacua

SEQ ID NO: 3261247 - RNA, 20 nt, Vaccinia virus
ugauuuuucuucauuuauca

SEQ ID NO: 3261248 - RNA, 22 nt, Vaccinia virus
aaucauuucgacauuaauuccu

SEQ ID NO: 3261249 - RNA, 14 nt, Vaccinia virus
uccauaauccucua

SEQ ID NO: 3261250 - RNA, 18 nt, Vaccinia virus
uuaaaaauaguauuauca

SEQ ID NO: 3261251 - RNA, 16 nt, Vaccinia virus
gaugauuaaaauuaac

SEQ ID NO: 3261252 - RNA, 17 nt, Vaccinia virus
gucuuuaaguauauacg

SEQ ID NO: 3261253 - RNA, 19 nt, Vaccinia virus
auucuggugcuaauuauuc

SEQ ID NO: 3261254 - RNA, 15 nt, Vaccinia virus
uagauaauucuaauu

SEQ ID NO: 3261255 - RNA, 21 nt, Vaccinia virus
uaacacucgcuccauauucca

SEQ ID NO: 3261256 - RNA, 17 nt, Vaccinia virus
auucuaccauagcaaau

SEQ ID NO: 3261257 - RNA, 12 nt, Vaccinia virus
ucugauuccacc

SEQ ID NO: 3261258 - RNA, 15 nt, Vaccinia virus
auauacagacucuau

SEQ ID NO: 3261259 - RNA, 12 nt, Vaccinia virus
uucuguuuucaa

SEQ ID NO: 3261260 - RNA, 19 nt, Vaccinia virus
auagaagauagauaugcca

SEQ ID NO: 3261261 - RNA, 17 nt, Vaccinia virus
ccauauauccaauaaag

SEQ ID NO: 3261262 - RNA, 14 nt, Vaccinia virus
auaauuuagauaau

SEQ ID NO: 3261263 - RNA, 15 nt, Vaccinia virus
uaacgcauuaaugag

SEQ ID NO: 3261264 - RNA, 18 nt, Vaccinia virus
gaaaucaaaucucuauca

SEQ ID NO: 3261265 - RNA, 23 nt, Vaccinia virus
auuuugaaaggcgguauauguau

SEQ ID NO: 3261266 - RNA, 19 nt, Vaccinia virus
uacagauguuacaaaugua

SEQ ID NO: 3261267 - RNA, 23 nt, Vaccinia virus
gguagauguuuggagaaaugaga

SEQ ID NO: 3261268 - RNA, 17 nt, Vaccinia virus
gcauuaguaucaugaac

SEQ ID NO: 3261269 - RNA, 23 nt, Vaccinia virus
uacugagaauugacgaaacaaug

SEQ ID NO: 3261270 - RNA, 11 nt, Vaccinia virus
cucuauuuugg

SEQ ID NO: 3261271 - RNA, 15 nt, Vaccinia virus
aagauuccuaaauua

SEQ ID NO: 3261272 - RNA, 16 nt, Vaccinia virus
ugacacuaucuucugu

SEQ ID NO: 3261273 - RNA, 16 nt, Vaccinia virus
uugguauuucuuacau

SEQ ID NO: 3261274 - RNA, 20 nt, Vaccinia virus
acgaaauaucucaucaagaa

SEQ ID NO: 3261275 - RNA, 14 nt, Vaccinia virus
aauaaaauuaucau

SEQ ID NO: 3261276 - RNA, 21 nt, Vaccinia virus
guauuucucuacaauauuaau

SEQ ID NO: 3261277 - RNA, 14 nt, Vaccinia virus
cugcuauaauuaag

SEQ ID NO: 3261278 - RNA, 17 nt, Vaccinia virus
uggaauggaaugcuguu

SEQ ID NO: 3261279 - RNA, 23 nt, Vaccinia virus
cuuuaaacuuuggcauauacaag

SEQ ID NO: 3261280 - RNA, 19 nt, Vaccinia virus
guauacucccuugcaucau

SEQ ID NO: 3261281 - RNA, 16 nt, Vaccinia virus
uaguaucuaaaacuac

SEQ ID NO: 3261282 - RNA, 15 nt, Vaccinia virus
cauuaauuauaacgg

SEQ ID NO: 3261283 - RNA, 21 nt, Vaccinia virus
cagauauuccgacaaaggauu

SEQ ID NO: 3261284 - RNA, 16 nt, Vaccinia virus
ucugugacuaugaauu

SEQ ID NO: 3261285 - RNA, 16 nt, Vaccinia virus
ccaauauuuuauauaa

SEQ ID NO: 3261286 - RNA, 13 nt, Vaccinia virus
gugcaaaugaggu

SEQ ID NO: 3261287 - RNA, 17 nt, Vaccinia virus
uagaaaguaauggauua

SEQ ID NO: 3261288 - RNA, 19 nt, Vaccinia virus
acgauggcaagaaauggau

SEQ ID NO: 3261289 - RNA, 22 nt, Vaccinia virus
gauuuuuuuaucccauguuuca

SEQ ID NO: 3261290 - RNA, 15 nt, Vaccinia virus
aucuagcaaaaauuc

SEQ ID NO: 3261291 - RNA, 20 nt, Vaccinia virus
cuacucuauagcgcuuuagu

SEQ ID NO: 3261292 - RNA, 21 nt, Vaccinia virus
aaagaagaagaucauacaguc

SEQ ID NO: 3261293 - RNA, 15 nt, Vaccinia virus
uucauuacuauauau

SEQ ID NO: 3261294 - RNA, 17 nt, Vaccinia virus
ugacauaauuacauaua

SEQ ID NO: 3261295 - RNA, 22 nt, Vaccinia virus
cagaagauuauuauggaaauca

SEQ ID NO: 3261296 - RNA, 15 nt, Vaccinia virus
uagauguaaugguaa

SEQ ID NO: 3261297 - RNA, 20 nt, Vaccinia virus
aucucuucuaguuucacuag

SEQ ID NO: 3261298 - RNA, 22 nt, Vaccinia virus
cauaccgucccaaaacauggau

SEQ ID NO: 3261299 - RNA, 19 nt, Vaccinia virus
guuagauaacucugcucca

SEQ ID NO: 3261300 - RNA, 20 nt, Vaccinia virus
cugauuaaugagaucuucua

SEQ ID NO: 3261301 - RNA, 16 nt, Vaccinia virus
ugaaaauuaugauaca

SEQ ID NO: 3261302 - RNA, 16 nt, Vaccinia virus
uccuaacuuuaaacaa

SEQ ID NO: 3261303 - RNA, 16 nt, Vaccinia virus
uauuauguuuaucaca

SEQ ID NO: 3261304 - RNA, 24 nt, Vaccinia virus
uacugauaauguagaagaucauac

SEQ ID NO: 3261305 - RNA, 13 nt, Vaccinia virus
gucgauacaaaau

SEQ ID NO: 3261306 - RNA, 15 nt, Vaccinia virus
ucuguuaguuuccuu

SEQ ID NO: 3261307 - RNA, 15 nt, Vaccinia virus
uacggaagaagaaaa

SEQ ID NO: 3261308 - RNA, 15 nt, Vaccinia virus
aucuuacucaaaaua

SEQ ID NO: 3261309 - RNA, 16 nt, Vaccinia virus
aaacacguuagaguuu

SEQ ID NO: 3261310 - RNA, 15 nt, Vaccinia virus
cuauauaucuguauu

SEQ ID NO: 3261311 - RNA, 22 nt, Vaccinia virus
auuagguaaaguaggacauaau

SEQ ID NO: 3261312 - RNA, 19 nt, Vaccinia virus
uauuguucuauauuauaua

SEQ ID NO: 3261313 - RNA, 20 nt, Vaccinia virus
cuauugaucaaguaugcaau

SEQ ID NO: 3261314 - RNA, 13 nt, Vaccinia virus
aaaagacaugaua

SEQ ID NO: 3261315 - RNA, 23 nt, Vaccinia virus
auuuauauccuauauacgaaaaa

SEQ ID NO: 3261316 - RNA, 14 nt, Vaccinia virus
cuuaacaaaaauug

SEQ ID NO: 3261317 - RNA, 21 nt, Vaccinia virus
gaauauggggaaaauauucua

SEQ ID NO: 3261318 - RNA, 16 nt, Vaccinia virus
gaaaugagaaacuguu

SEQ ID NO: 3261319 - RNA, 23 nt, Vaccinia virus
ucacaugauguagugauagauau

SEQ ID NO: 3261320 - RNA, 17 nt, Vaccinia virus
gaauguuuuacucugga

SEQ ID NO: 3261321 - RNA, 19 nt, Vaccinia virus
uacacaucuaucaagugau

SEQ ID NO: 3261322 - RNA, 19 nt, Vaccinia virus
auaguuugggaaaagaaau

SEQ ID NO: 3261323 - RNA, 18 nt, Vaccinia virus
accaguaccagaucuuaa

SEQ ID NO: 3261324 - RNA, 16 nt, Vaccinia virus
caaucucguuuaauau

SEQ ID NO: 3261325 - RNA, 19 nt, Vaccinia virus
uauuucuucgcuuuauaua

SEQ ID NO: 3261326 - RNA, 21 nt, Vaccinia virus
cuauuccaucaaacuguauag

SEQ ID NO: 3261327 - RNA, 19 nt, Vaccinia virus
aaaaacuguuuaacaaggu

SEQ ID NO: 3261328 - RNA, 12 nt, Vaccinia virus
aaagcauauucc

SEQ ID NO: 3261329 - RNA, 20 nt, Vaccinia virus
cuaccaacgauaagauauca

SEQ ID NO: 3261330 - RNA, 18 nt, Vaccinia virus
uauugcgacguucauaga

SEQ ID NO: 3261331 - RNA, 18 nt, Vaccinia virus
auauucucuauuuuggug

SEQ ID NO: 3261332 - RNA, 16 nt, Vaccinia virus
ucuaaaaaauccuuaa

SEQ ID NO: 3261333 - RNA, 23 nt, Vaccinia virus
guauccacuuuaauaauaucaua

SEQ ID NO: 3261334 - RNA, 20 nt, Vaccinia virus
cuaacaauaacuagaucauc

SEQ ID NO: 3261335 - RNA, 18 nt, Vaccinia virus
augugcuaaaaaguuuuc

SEQ ID NO: 3261336 - RNA, 19 nt, Vaccinia virus
uauaagcucuauuguuuga

SEQ ID NO: 3261337 - RNA, 21 nt, Vaccinia virus
cauuauuacuaccaucauuau

SEQ ID NO: 3261338 - RNA, 18 nt, Vaccinia virus
uccgaggauaguaaaaua

SEQ ID NO: 3261339 - RNA, 13 nt, Vaccinia virus
gaauauaguuaua

SEQ ID NO: 3261340 - RNA, 12 nt, Vaccinia virus
acuauuaaaacu

SEQ ID NO: 3261341 - RNA, 18 nt, Vaccinia virus
acgggcgcuguaauuaau

SEQ ID NO: 3261342 - RNA, 18 nt, Vaccinia virus
aguaggauauauuaaagu

SEQ ID NO: 3261343 - RNA, 13 nt, Vaccinia virus
auaaaaagaaugu

SEQ ID NO: 3261344 - RNA, 15 nt, Vaccinia virus
uuuuuguuuaaccac

SEQ ID NO: 3261345 - RNA, 17 nt, Vaccinia virus
caacuugacaaaucuua

SEQ ID NO: 3261346 - RNA, 14 nt, Vaccinia virus
uacuuacuuuagaa

SEQ ID NO: 3261347 - RNA, 14 nt, Vaccinia virus
uauuaauucuguaa

SEQ ID NO: 3261348 - RNA, 22 nt, Vaccinia virus
uuaugaaaaaguaaaugaugaa

SEQ ID NO: 3261349 - RNA, 18 nt, Vaccinia virus
ucaagacguggcaaacaa

SEQ ID NO: 3261350 - RNA, 14 nt, Vaccinia virus
ucuaugauaguuuu

SEQ ID NO: 3261351 - RNA, 12 nt, Vaccinia virus
aaccaguauuug

SEQ ID NO: 3261352 - RNA, 16 nt, Vaccinia virus
auuuuuggauuacaag

SEQ ID NO: 3261353 - RNA, 23 nt, Vaccinia virus
cgacuaguucccgcauuaaauaa

SEQ ID NO: 3261354 - RNA, 20 nt, Vaccinia virus
aggauaaaaucguuuauccu

SEQ ID NO: 3261355 - RNA, 22 nt, Vaccinia virus
ccaguaaaugacgcguuuccua

SEQ ID NO: 3261356 - RNA, 16 nt, Vaccinia virus
acugcaauaaaacauu

SEQ ID NO: 3261357 - RNA, 12 nt, Vaccinia virus
aauauuuagaaa

SEQ ID NO: 3261358 - RNA, 16 nt, Vaccinia virus
auacuuccaucaacau

SEQ ID NO: 3261359 - RNA, 20 nt, Vaccinia virus
auaacguuaucguuuucuac

SEQ ID NO: 3261360 - RNA, 18 nt, Vaccinia virus
cucugccaagauagcuuc

SEQ ID NO: 3261361 - RNA, 23 nt, Vaccinia virus
aauauuguaacaauuuauuuugu

SEQ ID NO: 3261362 - RNA, 13 nt, Vaccinia virus
uucugcaauaucu

SEQ ID NO: 3261363 - RNA, 19 nt, Vaccinia virus
aaaugaugcugguuauuau

SEQ ID NO: 3261364 - RNA, 14 nt, Vaccinia virus
caauaucaguaucu

SEQ ID NO: 3261365 - RNA, 16 nt, Vaccinia virus
acaaaaauuaugaaau

SEQ ID NO: 3261366 - RNA, 19 nt, Vaccinia virus
ucacaccagaugucauuau

SEQ ID NO: 3261367 - RNA, 14 nt, Vaccinia virus
augaugaaauguau

SEQ ID NO: 3261368 - RNA, 17 nt, Vaccinia virus
ugauagccguagaucuu

SEQ ID NO: 3261369 - RNA, 18 nt, Vaccinia virus
uauucuugcucaauagau

SEQ ID NO: 3261370 - RNA, 17 nt, Vaccinia virus
cacccguagaaauacua

SEQ ID NO: 3261371 - RNA, 22 nt, Vaccinia virus
uccauaggcaguccagaaauau

SEQ ID NO: 3261372 - RNA, 21 nt, Vaccinia virus
acaucaacuaccuaaggaaua

SEQ ID NO: 3261373 - RNA, 13 nt, Vaccinia virus
ucgucucucuuag

SEQ ID NO: 3261374 - RNA, 15 nt, Vaccinia virus
aaauauucuacauau

SEQ ID NO: 3261375 - RNA, 17 nt, Vaccinia virus
uagaacaaaauacauaa

SEQ ID NO: 3261376 - RNA, 17 nt, Vaccinia virus
cuagaucgucaguagua

SEQ ID NO: 3261377 - RNA, 17 nt, Vaccinia virus
ucaagccggcuauauau

SEQ ID NO: 3261378 - RNA, 21 nt, Vaccinia virus
cauugauaaagaaguuauaga

SEQ ID NO: 3261379 - RNA, 23 nt, Vaccinia virus
uuuagaucauuaacucuagaaau

SEQ ID NO: 3261380 - RNA, 14 nt, Vaccinia virus
acgcuuguuaauaa

SEQ ID NO: 3261381 - RNA, 14 nt, Vaccinia virus
aacguauaaaugac

SEQ ID NO: 3261382 - RNA, 17 nt, Vaccinia virus
acuucugcaucuauaug

SEQ ID NO: 3261383 - RNA, 18 nt, Vaccinia virus
cuguauccucaaacaucc

SEQ ID NO: 3261384 - RNA, 21 nt, Vaccinia virus
auucauccuguugucuaaauc

SEQ ID NO: 3261385 - RNA, 15 nt, Vaccinia virus
gaaaacauuguguuu

SEQ ID NO: 3261386 - RNA, 19 nt, Vaccinia virus
guaucucgucuaaauuaga

SEQ ID NO: 3261387 - RNA, 15 nt, Vaccinia virus
agagacggaaauagu

SEQ ID NO: 3261388 - RNA, 17 nt, Vaccinia virus
uauucaagucaaagaaa

SEQ ID NO: 3261389 - RNA, 17 nt, Vaccinia virus
gcuaaaauuuucaucaa

SEQ ID NO: 3261390 - RNA, 20 nt, Vaccinia virus
cuauagcaucaauaauuguu

SEQ ID NO: 3261391 - RNA, 14 nt, Vaccinia virus
cauaugguacguaa

SEQ ID NO: 3261392 - RNA, 14 nt, Vaccinia virus
cagaacaauauauu

SEQ ID NO: 3261393 - RNA, 15 nt, Vaccinia virus
caauuauguaucaau

SEQ ID NO: 3261394 - RNA, 16 nt, Vaccinia virus
agauacaauauuuaca

SEQ ID NO: 3261395 - RNA, 21 nt, Vaccinia virus
ucaauagcaguuuauuaucca

SEQ ID NO: 3261396 - RNA, 17 nt, Vaccinia virus
ucgaauuucuacaaaag

SEQ ID NO: 3261397 - RNA, 18 nt, Vaccinia virus
uauggccauagaggaugu

SEQ ID NO: 3261398 - RNA, 16 nt, Vaccinia virus
ucaacggaaaacauuu

SEQ ID NO: 3261399 - RNA, 18 nt, Vaccinia virus
acgagugaagaaauaauu

SEQ ID NO: 3261400 - RNA, 20 nt, Vaccinia virus
auguuucuguuuucaaacac

SEQ ID NO: 3261401 - RNA, 21 nt, Vaccinia virus
caaaaggaagaaggacaacau

SEQ ID NO: 3261402 - RNA, 17 nt, Vaccinia virus
agauauuaguaaaagau

SEQ ID NO: 3261403 - RNA, 19 nt, Vaccinia virus
aucuuaacacucucugcca

SEQ ID NO: 3261404 - RNA, 15 nt, Vaccinia virus
acuauucauggaaau

SEQ ID NO: 3261405 - RNA, 18 nt, Vaccinia virus
guucauaaucucaucauc

SEQ ID NO: 3261406 - RNA, 18 nt, Vaccinia virus
auauuacugaauuaauaa

SEQ ID NO: 3261407 - RNA, 18 nt, Vaccinia virus
uuaaauuuuucaucuguu

SEQ ID NO: 3261408 - RNA, 18 nt, Vaccinia virus
aacucucguauagucaua

SEQ ID NO: 3261409 - RNA, 19 nt, Vaccinia virus
cauaauacuaucuauguua

SEQ ID NO: 3261410 - RNA, 13 nt, Vaccinia virus
acauucagaaaga

SEQ ID NO: 3261411 - RNA, 14 nt, Vaccinia virus
augauuaucaaaug

SEQ ID NO: 3261412 - RNA, 15 nt, Vaccinia virus
gucuuaauagacaca

SEQ ID NO: 3261413 - RNA, 16 nt, Vaccinia virus
uagacuugauuauucu

SEQ ID NO: 3261414 - RNA, 19 nt, Vaccinia virus
ccuuuuccucagacaucua

SEQ ID NO: 3261415 - RNA, 20 nt, Vaccinia virus
cauagaacugccauauguug

SEQ ID NO: 3261416 - RNA, 17 nt, Vaccinia virus
cagaaauauguuaacaa

SEQ ID NO: 3261417 - RNA, 23 nt, Vaccinia virus
cucguaaauugggauaaaaauua

SEQ ID NO: 3261418 - RNA, 20 nt, Vaccinia virus
agucccauuggauaguuuuu

SEQ ID NO: 3261419 - RNA, 18 nt, Vaccinia virus
aguaugaagauaaacacu

SEQ ID NO: 3261420 - RNA, 17 nt, Vaccinia virus
uucgaguuuaucaaaac

SEQ ID NO: 3261421 - RNA, 17 nt, Vaccinia virus
ucauuaauaguauacac

SEQ ID NO: 3261422 - RNA, 19 nt, Vaccinia virus
aaugaacauaguaagaaau

SEQ ID NO: 3261423 - RNA, 21 nt, Vaccinia virus
uauccggagacgucaucuguu

SEQ ID NO: 3261424 - RNA, 14 nt, Vaccinia virus
uaucacagucuguu

SEQ ID NO: 3261425 - RNA, 23 nt, Vaccinia virus
acuaucagaaucaguuacauguu

SEQ ID NO: 3261426 - RNA, 13 nt, Vaccinia virus
caguagucauugu

SEQ ID NO: 3261427 - RNA, 14 nt, Vaccinia virus
uacgacuguuacgu

SEQ ID NO: 3261428 - RNA, 19 nt, Vaccinia virus
gccaaauguucaauaucua

SEQ ID NO: 3261429 - RNA, 14 nt, Vaccinia virus
gcuaaaaaauuagu

SEQ ID NO: 3261430 - RNA, 13 nt, Vaccinia virus
ugaaauuaaucau

SEQ ID NO: 3261431 - RNA, 22 nt, Vaccinia virus
auauacgaaauaaaauagacaa

SEQ ID NO: 3261432 - RNA, 17 nt, Vaccinia virus
auacuaguauagucacu

SEQ ID NO: 3261433 - RNA, 20 nt, Vaccinia virus
gacuuugucaacuuuguaaa

SEQ ID NO: 3261434 - RNA, 19 nt, Vaccinia virus
agaauuaaugggaacuauu

SEQ ID NO: 3261435 - RNA, 13 nt, Vaccinia virus
agaucauuaaaug

SEQ ID NO: 3261436 - RNA, 22 nt, Vaccinia virus
auauuaucgugccgaaauucgu

SEQ ID NO: 3261437 - RNA, 16 nt, Vaccinia virus
uacuaguuuucuaagu

SEQ ID NO: 3261438 - RNA, 18 nt, Vaccinia virus
auuaucgagauuuaauaa

SEQ ID NO: 3261439 - RNA, 14 nt, Vaccinia virus
ucuaucauagauuu

SEQ ID NO: 3261440 - RNA, 15 nt, Vaccinia virus
ucuauuagaugugua

SEQ ID NO: 3261441 - RNA, 15 nt, Vaccinia virus
ccaaugcuucucugu

SEQ ID NO: 3261442 - RNA, 14 nt, Vaccinia virus
ucauucucuucuau

SEQ ID NO: 3261443 - RNA, 12 nt, Vaccinia virus
ugcuaaauacua

SEQ ID NO: 3261444 - RNA, 16 nt, Vaccinia virus
acccauggaaaaauag

SEQ ID NO: 3261445 - RNA, 16 nt, Vaccinia virus
aguauggagacauuga

SEQ ID NO: 3261446 - RNA, 22 nt, Vaccinia virus
cagaugucauaauauuggauug

SEQ ID NO: 3261447 - RNA, 21 nt, Vaccinia virus
uagguguuccggagaaucagu

SEQ ID NO: 3261448 - RNA, 23 nt, Vaccinia virus
auuuugaugauaauguuaccaua

SEQ ID NO: 3261449 - RNA, 16 nt, Vaccinia virus
cagaaggaaacuucuu

SEQ ID NO: 3261450 - RNA, 17 nt, Vaccinia virus
cgaauauaaaugauuuc

SEQ ID NO: 3261451 - RNA, 13 nt, Vaccinia virus
gucgucaaaauau

SEQ ID NO: 3261452 - RNA, 22 nt, Vaccinia virus
uuaguuucugguuuucuauaaa

SEQ ID NO: 3261453 - RNA, 16 nt, Vaccinia virus
gaaucgauaacucuau

SEQ ID NO: 3261454 - RNA, 16 nt, Vaccinia virus
aacuuuuagaaauaua

SEQ ID NO: 3261455 - RNA, 22 nt, Vaccinia virus
uuguacaucuugacauuuucuu

SEQ ID NO: 3261456 - RNA, 12 nt, Vaccinia virus
aaaaauuauccu

SEQ ID NO: 3261457 - RNA, 13 nt, Vaccinia virus
aauauuuuucuau

SEQ ID NO: 3261458 - RNA, 20 nt, Vaccinia virus
uuagauaaauggaauacuaa

SEQ ID NO: 3261459 - RNA, 23 nt, Vaccinia virus
uuuaaaaaaaaaauacuuauucu

SEQ ID NO: 3261460 - RNA, 18 nt, Vaccinia virus
uuuuuuagauguaguauc

SEQ ID NO: 3261461 - RNA, 18 nt, Vaccinia virus
caaauucugcaauaucuu

SEQ ID NO: 3261462 - RNA, 17 nt, Vaccinia virus
ucaugccuuuccuggaa

SEQ ID NO: 3261463 - RNA, 18 nt, Vaccinia virus
uaaaucuguuucuaaaga

SEQ ID NO: 3261464 - RNA, 22 nt, Vaccinia virus
ccuauguuuccccuauaaucuu

SEQ ID NO: 3261465 - RNA, 19 nt, Vaccinia virus
ugcaauggauaauuuccau

SEQ ID NO: 3261466 - RNA, 14 nt, Vaccinia virus
aauuuucaagagau

SEQ ID NO: 3261467 - RNA, 14 nt, Vaccinia virus
uaguauguuauaua

SEQ ID NO: 3261468 - RNA, 22 nt, Vaccinia virus
aaaaucuucaagagugcauuga

SEQ ID NO: 3261469 - RNA, 22 nt, Vaccinia virus
aaauggauaauauccauauuga

SEQ ID NO: 3261470 - RNA, 19 nt, Vaccinia virus
ugauauuacuuauaauaac

SEQ ID NO: 3261471 - RNA, 18 nt, Vaccinia virus
ugcacaaagaagaauucu

SEQ ID NO: 3261472 - RNA, 12 nt, Vaccinia virus
uauuuuacacau

SEQ ID NO: 3261473 - RNA, 18 nt, Vaccinia virus
uauaaaacuacuacaaug

SEQ ID NO: 3261474 - RNA, 23 nt, Vaccinia virus
agcauccuauucgaauaaugagu

SEQ ID NO: 3261475 - RNA, 16 nt, Vaccinia virus
auaaagaguccuauau

SEQ ID NO: 3261476 - RNA, 15 nt, Vaccinia virus
auaaaacuuuauuau

SEQ ID NO: 3261477 - RNA, 21 nt, Vaccinia virus
aaacucguacuaaucucuucu

SEQ ID NO: 3261478 - RNA, 22 nt, Vaccinia virus
ucauauaaauguuuaacguuuu

SEQ ID NO: 3261479 - RNA, 15 nt, Vaccinia virus
aauuauucuaucaau

SEQ ID NO: 3261480 - RNA, 19 nt, Vaccinia virus
uagucuaguaucuaaacau

SEQ ID NO: 3261481 - RNA, 13 nt, Vaccinia virus
uuuguauguacca

SEQ ID NO: 3261482 - RNA, 18 nt, Vaccinia virus
uaugaaacgaacacuauu

SEQ ID NO: 3261483 - RNA, 16 nt, Vaccinia virus
uauacagcguuacauu

SEQ ID NO: 3261484 - RNA, 14 nt, Vaccinia virus
auugcuguaaacaa

SEQ ID NO: 3261485 - RNA, 16 nt, Vaccinia virus
auaucugaguaugaug

SEQ ID NO: 3261486 - RNA, 20 nt, Vaccinia virus
auacguuuauauucuuuuaa

SEQ ID NO: 3261487 - RNA, 17 nt, Vaccinia virus
aucuaggaguaauuaag

SEQ ID NO: 3261488 - RNA, 14 nt, Vaccinia virus
aacuacaaaaaugc

SEQ ID NO: 3261489 - RNA, 16 nt, Vaccinia virus
uaaaucaacagaaguu

SEQ ID NO: 3261490 - RNA, 23 nt, Vaccinia virus
aacuaacguccaucauuacagaa

SEQ ID NO: 3261491 - RNA, 12 nt, Vaccinia virus
caaauacucuaa

SEQ ID NO: 3261492 - RNA, 19 nt, Vaccinia virus
cuguauauacuuagauaua

SEQ ID NO: 3261493 - RNA, 19 nt, Vaccinia virus
cuacgaaacugauacaauc

SEQ ID NO: 3261494 - RNA, 17 nt, Vaccinia virus
auaauagggagaaauga

SEQ ID NO: 3261495 - RNA, 17 nt, Vaccinia virus
acauauuuauauaauua

SEQ ID NO: 3261496 - RNA, 15 nt, Vaccinia virus
aauauauaaacucuu

SEQ ID NO: 3261497 - RNA, 23 nt, Vaccinia virus
agauauaaaugacaaguauaaug

SEQ ID NO: 3261498 - RNA, 16 nt, Vaccinia virus
agcucuuugaaguuuu

SEQ ID NO: 3261499 - RNA, 14 nt, Vaccinia virus
ucgagcgugauguu

SEQ ID NO: 3261500 - RNA, 15 nt, Vaccinia virus
acuuauguaugugca

SEQ ID NO: 3261501 - RNA, 23 nt, Vaccinia virus
gaaugacaucgcauuuauaucuu

SEQ ID NO: 3261502 - RNA, 15 nt, Vaccinia virus
auauucaacauguuu

SEQ ID NO: 3261503 - RNA, 21 nt, Vaccinia virus
aacuaucguuggaaaauggug

SEQ ID NO: 3261504 - RNA, 14 nt, Vaccinia virus
ucaacaucuuugau

SEQ ID NO: 3261505 - RNA, 20 nt, Vaccinia virus
ucuagauacuagaguaguau

SEQ ID NO: 3261506 - RNA, 14 nt, Vaccinia virus
uagacuuacuaaag

SEQ ID NO: 3261507 - RNA, 18 nt, Vaccinia virus
cuguuuucucaucacuua

SEQ ID NO: 3261508 - RNA, 15 nt, Vaccinia virus
auguaguaguaacug

SEQ ID NO: 3261509 - RNA, 19 nt, Vaccinia virus
uuuccaucaucgucuuauu

SEQ ID NO: 3261510 - RNA, 15 nt, Vaccinia virus
gcuaauaucuaaaua

SEQ ID NO: 3261511 - RNA, 22 nt, Vaccinia virus
gauauauauuguacgauaaugu

SEQ ID NO: 3261512 - RNA, 14 nt, Vaccinia virus
agauucugauguau

SEQ ID NO: 3261513 - RNA, 23 nt, Vaccinia virus
cauucgacuuaguauacaaaaaa

SEQ ID NO: 3261514 - RNA, 12 nt, Vaccinia virus
auuuuuucauuu

SEQ ID NO: 3261515 - RNA, 16 nt, Vaccinia virus
gaauaagugugaugau

SEQ ID NO: 3261516 - RNA, 22 nt, Vaccinia virus
agacgaggagauuuagaaaugu

SEQ ID NO: 3261517 - RNA, 12 nt, Vaccinia virus
auuauuaauaag

SEQ ID NO: 3261518 - RNA, 14 nt, Vaccinia virus
caaaaucuuaauau

SEQ ID NO: 3261519 - RNA, 22 nt, Vaccinia virus
uauauaagacacagaaauacua

SEQ ID NO: 3261520 - RNA, 18 nt, Vaccinia virus
acauauuggguacuaguu

SEQ ID NO: 3261521 - RNA, 15 nt, Vaccinia virus
aguacaucuaucacc

SEQ ID NO: 3261522 - RNA, 17 nt, Vaccinia virus
agagacgucauacucuu

SEQ ID NO: 3261523 - RNA, 18 nt, Vaccinia virus
aaaaugugggagaaucua

SEQ ID NO: 3261524 - RNA, 15 nt, Vaccinia virus
cuuuauaacugaacu

SEQ ID NO: 3261525 - RNA, 16 nt, Vaccinia virus
augaaagaaagaagac

SEQ ID NO: 3261526 - RNA, 20 nt, Vaccinia virus
gacguuggcacaugaugaau

SEQ ID NO: 3261527 - RNA, 18 nt, Vaccinia virus
agauaaacuuuauguauu

SEQ ID NO: 3261528 - RNA, 15 nt, Vaccinia virus
auaauaaauugguaa

SEQ ID NO: 3261529 - RNA, 16 nt, Vaccinia virus
caucaaaaaacaacug

SEQ ID NO: 3261530 - RNA, 17 nt, Vaccinia virus
augaauggaugcuagaa

SEQ ID NO: 3261531 - RNA, 20 nt, Vaccinia virus
uuguucuauguaucuaaaau

SEQ ID NO: 3261532 - RNA, 19 nt, Vaccinia virus
ucuacgauuuuuacaaaag

SEQ ID NO: 3261533 - RNA, 13 nt, Vaccinia virus
uacuccguuuuau

SEQ ID NO: 3261534 - RNA, 14 nt, Vaccinia virus
auuacuaaacauuu

SEQ ID NO: 3261535 - RNA, 16 nt, Vaccinia virus
ucuaucuuuagaguau

SEQ ID NO: 3261536 - RNA, 22 nt, Vaccinia virus
uaucagucgaggacuuggaugu

SEQ ID NO: 3261537 - RNA, 17 nt, Vaccinia virus
gaucuggaaaauaaucu

SEQ ID NO: 3261538 - RNA, 15 nt, Vaccinia virus
auauauauacaguga

SEQ ID NO: 3261539 - RNA, 21 nt, Vaccinia virus
ugaaaacuaaaugguauacac

SEQ ID NO: 3261540 - RNA, 22 nt, Vaccinia virus
aacaccguuacacgaagagaua

SEQ ID NO: 3261541 - RNA, 20 nt, Vaccinia virus
ugagcucauaugauuucagu

SEQ ID NO: 3261542 - RNA, 16 nt, Vaccinia virus
accucuccaaaaagaa

SEQ ID NO: 3261543 - RNA, 20 nt, Vaccinia virus
aaaagaauguaucaagaaua

SEQ ID NO: 3261544 - RNA, 23 nt, Vaccinia virus
uauaaugacaucuaugauuuuac

SEQ ID NO: 3261545 - RNA, 22 nt, Vaccinia virus
caaggcuuugauaucuaaauau

SEQ ID NO: 3261546 - RNA, 12 nt, Vaccinia virus
ucggcucaaaga

SEQ ID NO: 3261547 - RNA, 22 nt, Vaccinia virus
acguaucaccaacggaaauggu

SEQ ID NO: 3261548 - RNA, 17 nt, Vaccinia virus
uuguauccauacuguau

SEQ ID NO: 3261549 - RNA, 21 nt, Vaccinia virus
aacuguccacuguucuagaca

SEQ ID NO: 3261550 - RNA, 21 nt, Vaccinia virus
ugacgaaguaacgucauuaaa

SEQ ID NO: 3261551 - RNA, 22 nt, Vaccinia virus
agcaucauguccauuuaacuaa

SEQ ID NO: 3261552 - RNA, 20 nt, Vaccinia virus
auaacaugaacgauaaacaa

SEQ ID NO: 3261553 - RNA, 13 nt, Vaccinia virus
aagauauagcacc

SEQ ID NO: 3261554 - RNA, 19 nt, Vaccinia virus
cuauuaagaguaacagcug

SEQ ID NO: 3261555 - RNA, 12 nt, Vaccinia virus
uucauuacuaua

SEQ ID NO: 3261556 - RNA, 15 nt, Vaccinia virus
uaggaccacuagcaa

SEQ ID NO: 3261557 - RNA, 20 nt, Vaccinia virus
acuaaucucuucuuuaacag

SEQ ID NO: 3261558 - RNA, 18 nt, Vaccinia virus
agacagcgugaauaaugu

SEQ ID NO: 3261559 - RNA, 13 nt, Vaccinia virus
aaucucacaauau

SEQ ID NO: 3261560 - RNA, 18 nt, Vaccinia virus
aacuguggauacucugua

SEQ ID NO: 3261561 - RNA, 12 nt, Vaccinia virus
ucauuagauguu

SEQ ID NO: 3261562 - RNA, 15 nt, Vaccinia virus
cuuuaaccuauacau

SEQ ID NO: 3261563 - RNA, 19 nt, Vaccinia virus
aauaucuuuauucauucca

SEQ ID NO: 3261564 - RNA, 19 nt, Vaccinia virus
uccgcaauacauuucucaa

SEQ ID NO: 3261565 - RNA, 13 nt, Vaccinia virus
cauauuuugcaau

SEQ ID NO: 3261566 - RNA, 17 nt, Vaccinia virus
ucucguauacucugccc

SEQ ID NO: 3261567 - RNA, 13 nt, Vaccinia virus
uuaaauucaucau

SEQ ID NO: 3261568 - RNA, 21 nt, Vaccinia virus
ugccaauaugucaucuaugga

SEQ ID NO: 3261569 - RNA, 21 nt, Vaccinia virus
augucaaaggaugaaagaaag

SEQ ID NO: 3261570 - RNA, 14 nt, Vaccinia virus
acuuaaaaaaugaa

SEQ ID NO: 3261571 - RNA, 17 nt, Vaccinia virus
uauaaacucgcuuaaua

SEQ ID NO: 3261572 - RNA, 18 nt, Vaccinia virus
aacuacugauaacaaaau

SEQ ID NO: 3261573 - RNA, 17 nt, Vaccinia virus
uuuauccuauuauguaa

SEQ ID NO: 3261574 - RNA, 20 nt, Vaccinia virus
aguaguucugcgcaaugcau

SEQ ID NO: 3261575 - RNA, 17 nt, Vaccinia virus
gcuugcauguauuaaag

SEQ ID NO: 3261576 - RNA, 15 nt, Vaccinia virus
uuagucuuacacauu

SEQ ID NO: 3261577 - RNA, 11 nt, Vaccinia virus
aauaaggaaaa

SEQ ID NO: 3261578 - RNA, 23 nt, Vaccinia virus
cuucagacagccaaucaaaaaga

SEQ ID NO: 3261579 - RNA, 24 nt, Vaccinia virus
uuuuguggauuaguguacucucuu

SEQ ID NO: 3261580 - RNA, 22 nt, Vaccinia virus
aaugacaucgaagauuguccaa

SEQ ID NO: 3261581 - RNA, 20 nt, Vaccinia virus
auaaaaccaugaaauauauu

SEQ ID NO: 3261582 - RNA, 17 nt, Vaccinia virus
aagucauuugaauccau

SEQ ID NO: 3261583 - RNA, 21 nt, Vaccinia virus
aacaggucgcuauauccacca

SEQ ID NO: 3261584 - RNA, 16 nt, Vaccinia virus
gaauugcaauuuugau

SEQ ID NO: 3261585 - RNA, 14 nt, Vaccinia virus
uagaggagaaguaa

SEQ ID NO: 3261586 - RNA, 23 nt, Vaccinia virus
auaacaucuuucaucaucugaca

SEQ ID NO: 3261587 - RNA, 13 nt, Vaccinia virus
auacaauccauga

SEQ ID NO: 3261588 - RNA, 13 nt, Vaccinia virus
uacauuucacaga

SEQ ID NO: 3261589 - RNA, 21 nt, Vaccinia virus
gcaguacuacuagguagaaga

SEQ ID NO: 3261590 - RNA, 10 nt, Vaccinia virus
guaaauuaac

SEQ ID NO: 3261591 - RNA, 19 nt, Vaccinia virus
uggacgacgguaagaauga

SEQ ID NO: 3261592 - RNA, 21 nt, Vaccinia virus
aaaccaaaucuugauuacaaa

SEQ ID NO: 3261593 - RNA, 22 nt, Vaccinia virus
aggcaacaaguauacaauuuug

SEQ ID NO: 3261594 - RNA, 14 nt, Vaccinia virus
uaauauaaacaucu

SEQ ID NO: 3261595 - RNA, 17 nt, Vaccinia virus
ucaauagauugguaaau

SEQ ID NO: 3261596 - RNA, 14 nt, Vaccinia virus
agauuauaacuuau

SEQ ID NO: 3261597 - RNA, 16 nt, Vaccinia virus
ucuuaaucauauucuu

SEQ ID NO: 3261598 - RNA, 14 nt, Vaccinia virus
cuuacuaucuuuuu

SEQ ID NO: 3261599 - RNA, 18 nt, Vaccinia virus
ugacaucauacuagauaa

SEQ ID NO: 3261600 - RNA, 18 nt, Vaccinia virus
uagcguacaaaauuaucg

SEQ ID NO: 3261601 - RNA, 18 nt, Vaccinia virus
uucauauuaaacauacug

SEQ ID NO: 3261602 - RNA, 17 nt, Vaccinia virus
ucuuucuucuacuauau

SEQ ID NO: 3261603 - RNA, 18 nt, Vaccinia virus
aaucgauaacucuauuca

SEQ ID NO: 3261604 - RNA, 18 nt, Vaccinia virus
acaugcuacaaaauaugu

SEQ ID NO: 3261605 - RNA, 21 nt, Vaccinia virus
uauacuuuuagaugacacauu

SEQ ID NO: 3261606 - RNA, 16 nt, Vaccinia virus
acaccuagagaacuua

SEQ ID NO: 3261607 - RNA, 15 nt, Vaccinia virus
uuaaaguauaucuua

SEQ ID NO: 3261608 - RNA, 21 nt, Vaccinia virus
cgaauuauuucuuuguuuaua

SEQ ID NO: 3261609 - RNA, 23 nt, Vaccinia virus
gcaauagucagacuguaguucua

SEQ ID NO: 3261610 - RNA, 20 nt, Vaccinia virus
ccgauauagauauuaaacaa

SEQ ID NO: 3261611 - RNA, 22 nt, Vaccinia virus
uccaaggauguaauuaaauguu

SEQ ID NO: 3261612 - RNA, 16 nt, Vaccinia virus
auaaucagaauauaca

SEQ ID NO: 3261613 - RNA, 22 nt, Vaccinia virus
ucaagccggcuauauauucugc

SEQ ID NO: 3261614 - RNA, 22 nt, Vaccinia virus
agacacaucugccauagauuua

SEQ ID NO: 3261615 - RNA, 23 nt, Vaccinia virus
ugugauacgauuaugacacuauu

SEQ ID NO: 3261616 - RNA, 20 nt, Vaccinia virus
aaugaugaugaugaaaugga

SEQ ID NO: 3261617 - RNA, 13 nt, Vaccinia virus
cuauaauaaugaa

SEQ ID NO: 3261618 - RNA, 22 nt, Vaccinia virus
aagauauccagaguuuagauua

SEQ ID NO: 3261619 - RNA, 19 nt, Vaccinia virus
guuccguguguaauaaccu

SEQ ID NO: 3261620 - RNA, 13 nt, Vaccinia virus
uauuaaaaaaugu

SEQ ID NO: 3261621 - RNA, 20 nt, Vaccinia virus
agaucuacuggcgaaauggu

SEQ ID NO: 3261622 - RNA, 21 nt, Vaccinia virus
aauaugucaucuauggaauua

SEQ ID NO: 3261623 - RNA, 21 nt, Vaccinia virus
ucuaucaaaaguuaauuucua

SEQ ID NO: 3261624 - RNA, 19 nt, Vaccinia virus
uuuauuaagaaaauucaga

SEQ ID NO: 3261625 - RNA, 17 nt, Vaccinia virus
uaguuauuacuuuucuc

SEQ ID NO: 3261626 - RNA, 16 nt, Vaccinia virus
ucaaucacuacaucuu

SEQ ID NO: 3261627 - RNA, 16 nt, Vaccinia virus
cauacacuacaguaag

SEQ ID NO: 3261628 - RNA, 13 nt, Vaccinia virus
uguuuucaucauu

SEQ ID NO: 3261629 - RNA, 12 nt, Vaccinia virus
gaguuuaaaacu

SEQ ID NO: 3261630 - RNA, 21 nt, Vaccinia virus
uauccgacgacguuacucaaa

SEQ ID NO: 3261631 - RNA, 22 nt, Vaccinia virus
cuuuuagaagugauucuuugau

SEQ ID NO: 3261632 - RNA, 12 nt, Vaccinia virus
ugugauggauuu

SEQ ID NO: 3261633 - RNA, 23 nt, Vaccinia virus
caauaacuucacuauugaucaag

SEQ ID NO: 3261634 - RNA, 14 nt, Vaccinia virus
aagucaucaaucau

SEQ ID NO: 3261635 - RNA, 18 nt, Vaccinia virus
auaaccggcgcugucaug

SEQ ID NO: 3261636 - RNA, 11 nt, Vaccinia virus
gacaaauguag

SEQ ID NO: 3261637 - RNA, 19 nt, Vaccinia virus
ucuaagagaaugagaguag

SEQ ID NO: 3261638 - RNA, 12 nt, Vaccinia virus
caucuaucaucu

SEQ ID NO: 3261639 - RNA, 22 nt, Vaccinia virus
cauaaaaacucauuacauaguu

SEQ ID NO: 3261640 - RNA, 19 nt, Vaccinia virus
gaacuauaaaacuacuaca

SEQ ID NO: 3261641 - RNA, 23 nt, Vaccinia virus
accauuuuuuuuaaaaaaaauag

SEQ ID NO: 3261642 - RNA, 22 nt, Vaccinia virus
accuauggauacgguacacgua

SEQ ID NO: 3261643 - RNA, 14 nt, Vaccinia virus
uccuguuaauaacu

SEQ ID NO: 3261644 - RNA, 13 nt, Vaccinia virus
ugaauuuacagaa

SEQ ID NO: 3261645 - RNA, 22 nt, Vaccinia virus
agucauaaacuugggauguaaa

SEQ ID NO: 3261646 - RNA, 17 nt, Vaccinia virus
auaauaugacucaugau

SEQ ID NO: 3261647 - RNA, 18 nt, Vaccinia virus
guauaauaacuaaauguc

SEQ ID NO: 3261648 - RNA, 21 nt, Vaccinia virus
auauauuguuucauaauugcu

SEQ ID NO: 3261649 - RNA, 19 nt, Vaccinia virus
cugaauguaucuuccacau

SEQ ID NO: 3261650 - RNA, 14 nt, Vaccinia virus
ucgaauaauguaua

SEQ ID NO: 3261651 - RNA, 16 nt, Vaccinia virus
ccaagacgaacaaaau

SEQ ID NO: 3261652 - RNA, 16 nt, Vaccinia virus
cgguguguagaaagug

SEQ ID NO: 3261653 - RNA, 14 nt, Vaccinia virus
auuguaacaguauu

SEQ ID NO: 3261654 - RNA, 18 nt, Vaccinia virus
aaaugaaucccaaacauu

SEQ ID NO: 3261655 - RNA, 13 nt, Vaccinia virus
acugucuauacaa

SEQ ID NO: 3261656 - RNA, 13 nt, Vaccinia virus
ucuaucucaaaau

SEQ ID NO: 3261657 - RNA, 17 nt, Vaccinia virus
caucagcugaaaaacua

SEQ ID NO: 3261658 - RNA, 20 nt, Vaccinia virus
auacuuuuaauuaacaaaag

SEQ ID NO: 3261659 - RNA, 17 nt, Vaccinia virus
agaaggaguguuuucuu

SEQ ID NO: 3261660 - RNA, 13 nt, Vaccinia virus
aaauugcaaaaua

SEQ ID NO: 3261661 - RNA, 22 nt, Vaccinia virus
ucuuaagacacauuucuucauu

SEQ ID NO: 3261662 - RNA, 21 nt, Vaccinia virus
aucugugguauucuugucauu

SEQ ID NO: 3261663 - RNA, 19 nt, Vaccinia virus
auaagacuuuacuuuucua

SEQ ID NO: 3261664 - RNA, 19 nt, Vaccinia virus
uuaaaauacuaaauugaac

SEQ ID NO: 3261665 - RNA, 13 nt, Vaccinia virus
cuuaauuuugugc

SEQ ID NO: 3261666 - RNA, 15 nt, Vaccinia virus
acgauacaucuguuu

SEQ ID NO: 3261667 - RNA, 13 nt, Vaccinia virus
caauaaguaguau

SEQ ID NO: 3261668 - RNA, 21 nt, Vaccinia virus
cuuaaaauuuaaaaugauauu

SEQ ID NO: 3261669 - RNA, 14 nt, Vaccinia virus
acauaaguauaaag

SEQ ID NO: 3261670 - RNA, 17 nt, Vaccinia virus
uaccauuuuaaaaucau

SEQ ID NO: 3261671 - RNA, 18 nt, Vaccinia virus
aaauaauccugaauauau

SEQ ID NO: 3261672 - RNA, 18 nt, Vaccinia virus
cacuuuuuuauaaagaug

SEQ ID NO: 3261673 - RNA, 17 nt, Vaccinia virus
uaaaauguccacagaua

SEQ ID NO: 3261674 - RNA, 14 nt, Vaccinia virus
uuacuacauuauua

SEQ ID NO: 3261675 - RNA, 16 nt, Vaccinia virus
agcagacuagaaauaa

SEQ ID NO: 3261676 - RNA, 18 nt, Vaccinia virus
uuacauguaauacauuuu

SEQ ID NO: 3261677 - RNA, 14 nt, Vaccinia virus
aguaugcaauauau

SEQ ID NO: 3261678 - RNA, 16 nt, Vaccinia virus
uaaauauuuuaaaauu

SEQ ID NO: 3261679 - RNA, 22 nt, Vaccinia virus
ucuucgccgcgacuuucuacau

SEQ ID NO: 3261680 - RNA, 18 nt, Vaccinia virus
gcauuacaguucuuuucu

SEQ ID NO: 3261681 - RNA, 21 nt, Vaccinia virus
gauucuugauagagaugagau

SEQ ID NO: 3261682 - RNA, 14 nt, Vaccinia virus
uaaagaagacgcua

SEQ ID NO: 3261683 - RNA, 12 nt, Vaccinia virus
uucuuacaauua

SEQ ID NO: 3261684 - RNA, 21 nt, Vaccinia virus
aggcauaaaaauaaaaauaua

SEQ ID NO: 3261685 - RNA, 23 nt, Vaccinia virus
cauauacugaugauaauaaugaa

SEQ ID NO: 3261686 - RNA, 21 nt, Vaccinia virus
auauuccgacaugcaaaaaug

SEQ ID NO: 3261687 - RNA, 18 nt, Vaccinia virus
aauaaucuaguaaaacuu

SEQ ID NO: 3261688 - RNA, 22 nt, Vaccinia virus
uauuaauacaggaucuagcaaa

SEQ ID NO: 3261689 - RNA, 18 nt, Vaccinia virus
auaaacggguguaaacaa

SEQ ID NO: 3261690 - RNA, 18 nt, Vaccinia virus
uugaaccggaagaauuga

SEQ ID NO: 3261691 - RNA, 19 nt, Vaccinia virus
auguauuguuuaguuacuc

SEQ ID NO: 3261692 - RNA, 16 nt, Vaccinia virus
cuaaucucuucuuuaa

SEQ ID NO: 3261693 - RNA, 21 nt, Vaccinia virus
aguuugauuaguauaacuaga

SEQ ID NO: 3261694 - RNA, 15 nt, Vaccinia virus
gaaauggugauuuug

SEQ ID NO: 3261695 - RNA, 19 nt, Vaccinia virus
auuaauacacauaaugaag

SEQ ID NO: 3261696 - RNA, 13 nt, Vaccinia virus
caauggccaucug

SEQ ID NO: 3261697 - RNA, 19 nt, Vaccinia virus
caugauggucauguuuauu

SEQ ID NO: 3261698 - RNA, 19 nt, Vaccinia virus
agucagaaccuauuaacga

SEQ ID NO: 3261699 - RNA, 20 nt, Vaccinia virus
aguacuaauaaggaacuaga

SEQ ID NO: 3261700 - RNA, 19 nt, Vaccinia virus
uucucaaaagaucaaggaa

SEQ ID NO: 3261701 - RNA, 14 nt, Vaccinia virus
aaacaucauauaca

SEQ ID NO: 3261702 - RNA, 18 nt, Vaccinia virus
uaccacuuauuacuccau

SEQ ID NO: 3261703 - RNA, 18 nt, Vaccinia virus
uucaccaaacaacuuuua

SEQ ID NO: 3261704 - RNA, 19 nt, Vaccinia virus
uacuucuuuacgguaucua

SEQ ID NO: 3261705 - RNA, 14 nt, Vaccinia virus
uuuguguugugcau

SEQ ID NO: 3261706 - RNA, 21 nt, Vaccinia virus
aauaguuuugauauuaguaaa

SEQ ID NO: 3261707 - RNA, 23 nt, Vaccinia virus
gagagucaauguuuuugaaacua

SEQ ID NO: 3261708 - RNA, 19 nt, Vaccinia virus
acuguuauuacuacugaag

SEQ ID NO: 3261709 - RNA, 15 nt, Vaccinia virus
ucaaauaacaaacaa

SEQ ID NO: 3261710 - RNA, 14 nt, Vaccinia virus
accuaagggauuuu

SEQ ID NO: 3261711 - RNA, 17 nt, Vaccinia virus
acaaucuguauuucauu

SEQ ID NO: 3261712 - RNA, 13 nt, Vaccinia virus
caaaaaauacaau

SEQ ID NO: 3261713 - RNA, 18 nt, Vaccinia virus
uacaaaauaauagauaua

SEQ ID NO: 3261714 - RNA, 20 nt, Vaccinia virus
uagaucugagaauggaugau

SEQ ID NO: 3261715 - RNA, 18 nt, Vaccinia virus
agauuaccuauucacuua

SEQ ID NO: 3261716 - RNA, 13 nt, Vaccinia virus
ugugaucuucucg

SEQ ID NO: 3261717 - RNA, 19 nt, Vaccinia virus
aauauuuaacucaugauga

SEQ ID NO: 3261718 - RNA, 17 nt, Vaccinia virus
aacauaauuuucuaaua

SEQ ID NO: 3261719 - RNA, 21 nt, Vaccinia virus
uaauguuauauguaacauuga

SEQ ID NO: 3261720 - RNA, 21 nt, Vaccinia virus
gaaugcucggcaauaacuaau

SEQ ID NO: 3261721 - RNA, 15 nt, Vaccinia virus
caacaaaaaaugaau

SEQ ID NO: 3261722 - RNA, 13 nt, Vaccinia virus
ucuggaauuaaaa

SEQ ID NO: 3261723 - RNA, 22 nt, Vaccinia virus
acuucauaauuuaauaauguag

SEQ ID NO: 3261724 - RNA, 18 nt, Vaccinia virus
acaaagcacucaauaaau

SEQ ID NO: 3261725 - RNA, 12 nt, Vaccinia virus
gugucacauaua

SEQ ID NO: 3261726 - RNA, 13 nt, Vaccinia virus
aauuaauucuuua

SEQ ID NO: 3261727 - RNA, 18 nt, Vaccinia virus
gaggacuuggauguuugu

SEQ ID NO: 3261728 - RNA, 11 nt, Vaccinia virus
aucauuaacga

SEQ ID NO: 3261729 - RNA, 22 nt, Vaccinia virus
uucuacuaugcacauuauucua

SEQ ID NO: 3261730 - RNA, 20 nt, Vaccinia virus
ucuaugagaucgucguacau

SEQ ID NO: 3261731 - RNA, 21 nt, Vaccinia virus
aagaaauauaaaacuacuguc

SEQ ID NO: 3261732 - RNA, 17 nt, Vaccinia virus
acgcuagcgacucuguu

SEQ ID NO: 3261733 - RNA, 17 nt, Vaccinia virus
uuagaauagucucuuua

SEQ ID NO: 3261734 - RNA, 18 nt, Vaccinia virus
auuggaaaucauuaacgg

SEQ ID NO: 3261735 - RNA, 22 nt, Vaccinia virus
uuguugauggaucugugaugca

SEQ ID NO: 3261736 - RNA, 23 nt, Vaccinia virus
uccgaaaaaguugacuauguuca

SEQ ID NO: 3261737 - RNA, 14 nt, Vaccinia virus
caaguauccaucau

SEQ ID NO: 3261738 - RNA, 13 nt, Vaccinia virus
auguccuggugau

SEQ ID NO: 3261739 - RNA, 19 nt, Vaccinia virus
acaacuuaaugaagaucua

SEQ ID NO: 3261740 - RNA, 14 nt, Vaccinia virus
gaaauauaccgaua

SEQ ID NO: 3261741 - RNA, 19 nt, Vaccinia virus
ucacuguguguaagaagau

SEQ ID NO: 3261742 - RNA, 23 nt, Vaccinia virus
gugacuauuucauucucugaaaa

SEQ ID NO: 3261743 - RNA, 14 nt, Vaccinia virus
aauacuuuaguaau

SEQ ID NO: 3261744 - RNA, 17 nt, Vaccinia virus
ggucccuauuguuacag

SEQ ID NO: 3261745 - RNA, 15 nt, Vaccinia virus
auaaugaucauauag

SEQ ID NO: 3261746 - RNA, 14 nt, Vaccinia virus
ggucgaugucaaua

SEQ ID NO: 3261747 - RNA, 21 nt, Vaccinia virus
guuuauaaaaauguucuuuuu

SEQ ID NO: 3261748 - RNA, 21 nt, Vaccinia virus
uacgaaaacgaaaucuguaau

SEQ ID NO: 3261749 - RNA, 17 nt, Vaccinia virus
aguaucuucuuuaucua

SEQ ID NO: 3261750 - RNA, 14 nt, Vaccinia virus
guucuuaauagucu

SEQ ID NO: 3261751 - RNA, 14 nt, Vaccinia virus
gaaauauauacaua

SEQ ID NO: 3261752 - RNA, 15 nt, Vaccinia virus
gcaaucaugauuuua

SEQ ID NO: 3261753 - RNA, 15 nt, Vaccinia virus
ucacauccaccaaug

SEQ ID NO: 3261754 - RNA, 16 nt, Vaccinia virus
aacauggauacagaua

SEQ ID NO: 3261755 - RNA, 21 nt, Vaccinia virus
agcauccguauaaaaaucgau

SEQ ID NO: 3261756 - RNA, 17 nt, Vaccinia virus
cuuccgucgaugucuac

SEQ ID NO: 3261757 - RNA, 21 nt, Vaccinia virus
uuucuuaaucaguccaucauu

SEQ ID NO: 3261758 - RNA, 14 nt, Vaccinia virus
auuuccaugucuac

SEQ ID NO: 3261759 - RNA, 19 nt, Vaccinia virus
ugucaacaaaaaugugaua

SEQ ID NO: 3261760 - RNA, 16 nt, Vaccinia virus
gacuucuaacaaacau

SEQ ID NO: 3261761 - RNA, 14 nt, Vaccinia virus
aagcgguuaaauca

SEQ ID NO: 3261762 - RNA, 12 nt, Vaccinia virus
ucaauagaagau

SEQ ID NO: 3261763 - RNA, 23 nt, Vaccinia virus
aauacgucuugcacguaaucuau

SEQ ID NO: 3261764 - RNA, 16 nt, Vaccinia virus
uuacaucuaguucuuu

SEQ ID NO: 3261765 - RNA, 20 nt, Vaccinia virus
uagaugauaauuuauacaaa

SEQ ID NO: 3261766 - RNA, 18 nt, Vaccinia virus
gcaaaguaacgauaauca

SEQ ID NO: 3261767 - RNA, 20 nt, Vaccinia virus
uaaaucuaacauugauuuua

SEQ ID NO: 3261768 - RNA, 15 nt, Vaccinia virus
cuacauucucauuaa

SEQ ID NO: 3261769 - RNA, 20 nt, Vaccinia virus
uggaagaaauugaacuccuc

SEQ ID NO: 3261770 - RNA, 18 nt, Vaccinia virus
uacgaaccgggaaagaga

SEQ ID NO: 3261771 - RNA, 14 nt, Vaccinia virus
cacuauucauguaa

SEQ ID NO: 3261772 - RNA, 23 nt, Vaccinia virus
aucaaguuuguaggaaaggacaa

SEQ ID NO: 3261773 - RNA, 17 nt, Vaccinia virus
augauacucucaaccau

SEQ ID NO: 3261774 - RNA, 23 nt, Vaccinia virus
aguauugguaauauauaaacucu

SEQ ID NO: 3261775 - RNA, 22 nt, Vaccinia virus
aaauaaucucuuaguguuggaa

SEQ ID NO: 3261776 - RNA, 16 nt, Vaccinia virus
aacaaggcuuugauau

SEQ ID NO: 3261777 - RNA, 12 nt, Vaccinia virus
aaacaacucuuc

SEQ ID NO: 3261778 - RNA, 17 nt, Vaccinia virus
uaauauaaaaauacuua

SEQ ID NO: 3261779 - RNA, 16 nt, Vaccinia virus
agauaauaacagagua

SEQ ID NO: 3261780 - RNA, 23 nt, Vaccinia virus
ucaucaucaacaauccaauaaua

SEQ ID NO: 3261781 - RNA, 16 nt, Vaccinia virus
ucuaaaccuucuuauu

SEQ ID NO: 3261782 - RNA, 15 nt, Vaccinia virus
uaagaguaacagcug

SEQ ID NO: 3261783 - RNA, 19 nt, Vaccinia virus
acaauuuuuuuauaauaau

SEQ ID NO: 3261784 - RNA, 16 nt, Vaccinia virus
cuaaaauauuuucuag

SEQ ID NO: 3261785 - RNA, 19 nt, Vaccinia virus
gaaugacaucgcauuuaua

SEQ ID NO: 3261786 - RNA, 18 nt, Vaccinia virus
gauuccagccacuuggga

SEQ ID NO: 3261787 - RNA, 14 nt, Vaccinia virus
auccguauccauga

SEQ ID NO: 3261788 - RNA, 12 nt, Vaccinia virus
uagccuguuuua

SEQ ID NO: 3261789 - RNA, 15 nt, Vaccinia virus
uuaaugauacaaaaa

SEQ ID NO: 3261790 - RNA, 17 nt, Vaccinia virus
uacaaucagauauaucu

SEQ ID NO: 3261791 - RNA, 17 nt, Vaccinia virus
aguuaauggagaaauac

SEQ ID NO: 3261792 - RNA, 21 nt, Vaccinia virus
aagugccacaaaacagaaaua

SEQ ID NO: 3261793 - RNA, 18 nt, Vaccinia virus
caauuuguauuauccaau

SEQ ID NO: 3261794 - RNA, 18 nt, Vaccinia virus
uaauagcgucuacauuga

SEQ ID NO: 3261795 - RNA, 13 nt, Vaccinia virus
ugccauagauucu

SEQ ID NO: 3261796 - RNA, 18 nt, Vaccinia virus
aucagaaaggauagagca

SEQ ID NO: 3261797 - RNA, 18 nt, Vaccinia virus
uguaacccacguaacauu

SEQ ID NO: 3261798 - RNA, 18 nt, Vaccinia virus
cugaaauaaccacaucug

SEQ ID NO: 3261799 - RNA, 13 nt, Vaccinia virus
aacauuaaaaugu

SEQ ID NO: 3261800 - RNA, 15 nt, Vaccinia virus
augaguaaaacggaa

SEQ ID NO: 3261801 - RNA, 17 nt, Vaccinia virus
uaguggaucucaaugac

SEQ ID NO: 3261802 - RNA, 21 nt, Vaccinia virus
uagguauugaccucucagaau

SEQ ID NO: 3261803 - RNA, 14 nt, Vaccinia virus
auucucauuaaaug

SEQ ID NO: 3261804 - RNA, 19 nt, Vaccinia virus
agcauuuuggaaacauaaa

SEQ ID NO: 3261805 - RNA, 17 nt, Vaccinia virus
agaggcagucggauugg

SEQ ID NO: 3261806 - RNA, 19 nt, Vaccinia virus
uucucuuugguaacugcuu

SEQ ID NO: 3261807 - RNA, 23 nt, Vaccinia virus
aaugaaaauauaaauaguuuuua

SEQ ID NO: 3261808 - RNA, 18 nt, Vaccinia virus
auuaaaggcuuuaaaagu

SEQ ID NO: 3261809 - RNA, 14 nt, Vaccinia virus
agucucucuccaua

SEQ ID NO: 3261810 - RNA, 16 nt, Vaccinia virus
uccuuccaacauaaua

SEQ ID NO: 3261811 - RNA, 21 nt, Vaccinia virus
aaugauauccgcgaacgauau

SEQ ID NO: 3261812 - RNA, 18 nt, Vaccinia virus
auguagagguaaaaagac

SEQ ID NO: 3261813 - RNA, 21 nt, Vaccinia virus
uguuuaacaaagauauuacca

SEQ ID NO: 3261814 - RNA, 22 nt, Vaccinia virus
agacauuagaccguuuaauaga

SEQ ID NO: 3261815 - RNA, 20 nt, Vaccinia virus
ucgcauuguacgauguagua

SEQ ID NO: 3261816 - RNA, 20 nt, Vaccinia virus
cuacgaaaacgaaaucugua

SEQ ID NO: 3261817 - RNA, 14 nt, Vaccinia virus
auacucuaaucuuu

SEQ ID NO: 3261818 - RNA, 17 nt, Vaccinia virus
auacuuuucuaauucua

SEQ ID NO: 3261819 - RNA, 18 nt, Vaccinia virus
aaauuauuuuuacuaaua

SEQ ID NO: 3261820 - RNA, 14 nt, Vaccinia virus
agaaaaaacaaugu

SEQ ID NO: 3261821 - RNA, 18 nt, Vaccinia virus
uucaucggcuuuaacaau

SEQ ID NO: 3261822 - RNA, 22 nt, Vaccinia virus
aggaaucuauuaaagauuguuu

SEQ ID NO: 3261823 - RNA, 15 nt, Vaccinia virus
cuguucauaaauaaa

SEQ ID NO: 3261824 - RNA, 16 nt, Vaccinia virus
aaugccuuauucucug

SEQ ID NO: 3261825 - RNA, 20 nt, Vaccinia virus
aucuauauuguuuaauauau

SEQ ID NO: 3261826 - RNA, 16 nt, Vaccinia virus
gagaauguaauucuuu

SEQ ID NO: 3261827 - RNA, 14 nt, Vaccinia virus
augaaauuauucac

SEQ ID NO: 3261828 - RNA, 16 nt, Vaccinia virus
caagacuaacacacaa

SEQ ID NO: 3261829 - RNA, 15 nt, Vaccinia virus
agacaacgaauacaa

SEQ ID NO: 3261830 - RNA, 13 nt, Vaccinia virus
gcauacauagaag

SEQ ID NO: 3261831 - RNA, 15 nt, Vaccinia virus
aaugauaauaggaau

SEQ ID NO: 3261832 - RNA, 19 nt, Vaccinia virus
auguuauugucacacuaau

SEQ ID NO: 3261833 - RNA, 19 nt, Vaccinia virus
auuaaaaaacauauauaau

SEQ ID NO: 3261834 - RNA, 16 nt, Vaccinia virus
gaacacauuaaacaaa

SEQ ID NO: 3261835 - RNA, 20 nt, Vaccinia virus
uacaucaucgaacuucugau

SEQ ID NO: 3261836 - RNA, 14 nt, Vaccinia virus
aucgucguacaugg

SEQ ID NO: 3261837 - RNA, 23 nt, Vaccinia virus
guuaaaacauucaaauguuguua

SEQ ID NO: 3261838 - RNA, 19 nt, Vaccinia virus
agagaucaacgaaaaggaa

SEQ ID NO: 3261839 - RNA, 14 nt, Vaccinia virus
guaauauauaaacu

SEQ ID NO: 3261840 - RNA, 22 nt, Vaccinia virus
uuaaaggauggugaaauuauug

SEQ ID NO: 3261841 - RNA, 14 nt, Vaccinia virus
aacauuaauacaga

SEQ ID NO: 3261842 - RNA, 14 nt, Vaccinia virus
auaacuuuaguaaa

SEQ ID NO: 3261843 - RNA, 17 nt, Vaccinia virus
gaaguaggauuauguaa

SEQ ID NO: 3261844 - RNA, 14 nt, Vaccinia virus
auggucauguuuau

SEQ ID NO: 3261845 - RNA, 14 nt, Vaccinia virus
acaguuauauaucu

SEQ ID NO: 3261846 - RNA, 16 nt, Vaccinia virus
auaucgguaguuguau

SEQ ID NO: 3261847 - RNA, 19 nt, Vaccinia virus
aauuauuagcaaaaauaua

SEQ ID NO: 3261848 - RNA, 20 nt, Vaccinia virus
guaucgauaguguaguuauu

SEQ ID NO: 3261849 - RNA, 22 nt, Vaccinia virus
aucuaaccaagacggauaagaa

SEQ ID NO: 3261850 - RNA, 17 nt, Vaccinia virus
uggagcgaguguuacaa

SEQ ID NO: 3261851 - RNA, 12 nt, Vaccinia virus
ccucaucuucua

SEQ ID NO: 3261852 - RNA, 14 nt, Vaccinia virus
auccugauauuaau

SEQ ID NO: 3261853 - RNA, 13 nt, Vaccinia virus
agaaauuaauaaa

SEQ ID NO: 3261854 - RNA, 16 nt, Vaccinia virus
cgaguuuaaaacuucu

SEQ ID NO: 3261855 - RNA, 16 nt, Vaccinia virus
uaauacauauuauuca

SEQ ID NO: 3261856 - RNA, 11 nt, Vaccinia virus
uccucauuaac

SEQ ID NO: 3261857 - RNA, 21 nt, Vaccinia virus
guuagauccaacauuaaucaa

SEQ ID NO: 3261858 - RNA, 14 nt, Vaccinia virus
acuuuaaauacuua

SEQ ID NO: 3261859 - RNA, 18 nt, Vaccinia virus
cgaauauaucaaaacuac

SEQ ID NO: 3261860 - RNA, 17 nt, Vaccinia virus
uauagaucuuagacauu

SEQ ID NO: 3261861 - RNA, 23 nt, Vaccinia virus
guuaauauagacaauucuuuugu

SEQ ID NO: 3261862 - RNA, 21 nt, Vaccinia virus
gauauacccgaagauauacac

SEQ ID NO: 3261863 - RNA, 23 nt, Vaccinia virus
auuggcaaaaacggauauggaug

SEQ ID NO: 3261864 - RNA, 14 nt, Vaccinia virus
uugcuuuucuaauc

SEQ ID NO: 3261865 - RNA, 14 nt, Vaccinia virus
uuuagauauaucua

SEQ ID NO: 3261866 - RNA, 16 nt, Vaccinia virus
ccaaacugcauucgug

SEQ ID NO: 3261867 - RNA, 19 nt, Vaccinia virus
uauucauaaaacauaauca

SEQ ID NO: 3261868 - RNA, 17 nt, Vaccinia virus
ccggugagaacaugaga

SEQ ID NO: 3261869 - RNA, 20 nt, Vaccinia virus
uggcuuuguagauuuggaua

SEQ ID NO: 3261870 - RNA, 21 nt, Vaccinia virus
augauucuaaccuagaauuac

SEQ ID NO: 3261871 - RNA, 20 nt, Vaccinia virus
agugcggagucaacaaugaa

SEQ ID NO: 3261872 - RNA, 21 nt, Vaccinia virus
auuuugauauugugaauggua

SEQ ID NO: 3261873 - RNA, 15 nt, Vaccinia virus
ugcauuuuguuauau

SEQ ID NO: 3261874 - RNA, 18 nt, Vaccinia virus
aacucuuucgaauacuua

SEQ ID NO: 3261875 - RNA, 10 nt, Vaccinia virus
auuaauuaaa

SEQ ID NO: 3261876 - RNA, 15 nt, Vaccinia virus
gcugccaaaguuauu

SEQ ID NO: 3261877 - RNA, 15 nt, Vaccinia virus
cagucacagacacug

SEQ ID NO: 3261878 - RNA, 20 nt, Vaccinia virus
ucaaggacaguuaaaacuau

SEQ ID NO: 3261879 - RNA, 19 nt, Vaccinia virus
uaaaugcaauaacaaagau

SEQ ID NO: 3261880 - RNA, 19 nt, Vaccinia virus
gauauuguugauaauacaa

SEQ ID NO: 3261881 - RNA, 13 nt, Vaccinia virus
uaguuuuucugga

SEQ ID NO: 3261882 - RNA, 15 nt, Vaccinia virus
acuauuuuauaccuu

SEQ ID NO: 3261883 - RNA, 15 nt, Vaccinia virus
uuaguugucuaguau

SEQ ID NO: 3261884 - RNA, 22 nt, Vaccinia virus
ucucugaauauagaacaucauu

SEQ ID NO: 3261885 - RNA, 23 nt, Vaccinia virus
agaaaauaucuucuccuguaaua

SEQ ID NO: 3261886 - RNA, 20 nt, Vaccinia virus
caaauuuauuccauauuuua

SEQ ID NO: 3261887 - RNA, 22 nt, Vaccinia virus
guuagauauuuagcaauugcau

SEQ ID NO: 3261888 - RNA, 17 nt, Vaccinia virus
uacuauuuuuuacauua

SEQ ID NO: 3261889 - RNA, 23 nt, Vaccinia virus
acuuuauuacuccauuaaauaau

SEQ ID NO: 3261890 - RNA, 12 nt, Vaccinia virus
aucuauaaaagu

SEQ ID NO: 3261891 - RNA, 14 nt, Vaccinia virus
aauuuaaagaaugu

SEQ ID NO: 3261892 - RNA, 21 nt, Vaccinia virus
auuaauaaaaauacaauccuu

SEQ ID NO: 3261893 - RNA, 11 nt, Vaccinia virus
caguuugagaa

SEQ ID NO: 3261894 - RNA, 20 nt, Vaccinia virus
uggucaaccccuaagucuuu

SEQ ID NO: 3261895 - RNA, 14 nt, Vaccinia virus
acaucauauacaag

SEQ ID NO: 3261896 - RNA, 14 nt, Vaccinia virus
uuguauuuaucuaa

SEQ ID NO: 3261897 - RNA, 13 nt, Vaccinia virus
uugaucaacuaua

SEQ ID NO: 3261898 - RNA, 18 nt, Vaccinia virus
ucauuuucuauuuaaaau

SEQ ID NO: 3261899 - RNA, 18 nt, Vaccinia virus
uauugauaaaauuaauga

SEQ ID NO: 3261900 - RNA, 19 nt, Vaccinia virus
uaaugguagcaauaugcua

SEQ ID NO: 3261901 - RNA, 11 nt, Vaccinia virus
uuuccauccac

SEQ ID NO: 3261902 - RNA, 20 nt, Vaccinia virus
ugauuauccuaaucaggaau

SEQ ID NO: 3261903 - RNA, 22 nt, Vaccinia virus
acuguugaaguacuuaaugaag

SEQ ID NO: 3261904 - RNA, 17 nt, Vaccinia virus
aacauucugauuuaaga

SEQ ID NO: 3261905 - RNA, 12 nt, Vaccinia virus
cuuacaauaaac

SEQ ID NO: 3261906 - RNA, 23 nt, Vaccinia virus
uuaccacaauguauaauauaaga

SEQ ID NO: 3261907 - RNA, 16 nt, Vaccinia virus
cuuacaaauauucaca

SEQ ID NO: 3261908 - RNA, 23 nt, Vaccinia virus
ccuguacuauaccauuaucuaua

SEQ ID NO: 3261909 - RNA, 16 nt, Vaccinia virus
cuggaaaaauacuuuu

SEQ ID NO: 3261910 - RNA, 14 nt, Vaccinia virus
uuucuucauaugau

SEQ ID NO: 3261911 - RNA, 16 nt, Vaccinia virus
aguuccuuaugaugac

SEQ ID NO: 3261912 - RNA, 17 nt, Vaccinia virus
gcuaucaaaauauguag

SEQ ID NO: 3261913 - RNA, 18 nt, Vaccinia virus
caaucuaagaaauuuaaa

SEQ ID NO: 3261914 - RNA, 16 nt, Vaccinia virus
acaaaucacugaaaau

SEQ ID NO: 3261915 - RNA, 16 nt, Vaccinia virus
uguagaacguaaauua

SEQ ID NO: 3261916 - RNA, 20 nt, Vaccinia virus
uaguuuccuuaacaaaucua

SEQ ID NO: 3261917 - RNA, 16 nt, Vaccinia virus
uaauagauauaucucu

SEQ ID NO: 3261918 - RNA, 13 nt, Vaccinia virus
auuuaucauauau

SEQ ID NO: 3261919 - RNA, 11 nt, Vaccinia virus
aguucaguuuu

SEQ ID NO: 3261920 - RNA, 13 nt, Vaccinia virus
uacggaauuauug

SEQ ID NO: 3261921 - RNA, 17 nt, Vaccinia virus
augacauucucugacau

SEQ ID NO: 3261922 - RNA, 15 nt, Vaccinia virus
acgguaauaaaaugu

SEQ ID NO: 3261923 - RNA, 14 nt, Vaccinia virus
aaucauagaacugc

SEQ ID NO: 3261924 - RNA, 21 nt, Vaccinia virus
auuauacgcauaaauuguaaa

SEQ ID NO: 3261925 - RNA, 20 nt, Vaccinia virus
ucuucaguucuaucuucuaa

SEQ ID NO: 3261926 - RNA, 20 nt, Vaccinia virus
guagcaaagaaauuaauaga

SEQ ID NO: 3261927 - RNA, 22 nt, Vaccinia virus
ugauguaagauccaaacgagga

SEQ ID NO: 3261928 - RNA, 22 nt, Vaccinia virus
aauuuuuugagguaaucuucuu

SEQ ID NO: 3261929 - RNA, 19 nt, Vaccinia virus
guaaaagaucuauaauguc

SEQ ID NO: 3261930 - RNA, 22 nt, Vaccinia virus
uggaaacuauguuuuuuauuag

SEQ ID NO: 3261931 - RNA, 16 nt, Vaccinia virus
ucuuuccauaguacau

SEQ ID NO: 3261932 - RNA, 15 nt, Vaccinia virus
caguuuuaguauuuu

SEQ ID NO: 3261933 - RNA, 20 nt, Vaccinia virus
aauaaaugcgauacagacau

SEQ ID NO: 3261934 - RNA, 22 nt, Vaccinia virus
agaacugauugcaguguucauc

SEQ ID NO: 3261935 - RNA, 21 nt, Vaccinia virus
agaccaagcuucguuguagaa

SEQ ID NO: 3261936 - RNA, 14 nt, Vaccinia virus
ugcugaagcaauaa

SEQ ID NO: 3261937 - RNA, 11 nt, Vaccinia virus
ugguauauaca

SEQ ID NO: 3261938 - RNA, 22 nt, Vaccinia virus
gcguucagauugggaucuuuuc

SEQ ID NO: 3261939 - RNA, 14 nt, Vaccinia virus
gaugauaauuuaua

SEQ ID NO: 3261940 - RNA, 14 nt, Vaccinia virus
aacauaaaaacugu

SEQ ID NO: 3261941 - RNA, 16 nt, Vaccinia virus
aauuaacaauaucaau

SEQ ID NO: 3261942 - RNA, 16 nt, Vaccinia virus
ucucuaacuacuauug

SEQ ID NO: 3261943 - RNA, 16 nt, Vaccinia virus
gguaacgcgucuuuaa

SEQ ID NO: 3261944 - RNA, 19 nt, Vaccinia virus
uauaagaauuuuuauacau

SEQ ID NO: 3261945 - RNA, 15 nt, Vaccinia virus
cugacucauggauuc

SEQ ID NO: 3261946 - RNA, 18 nt, Vaccinia virus
caguaggucuuggugaag

SEQ ID NO: 3261947 - RNA, 20 nt, Vaccinia virus
uaugauccucucucauugau

SEQ ID NO: 3261948 - RNA, 18 nt, Vaccinia virus
acaauacgauaaacauug

SEQ ID NO: 3261949 - RNA, 22 nt, Vaccinia virus
cuuauucuuuguauuuuggcau

SEQ ID NO: 3261950 - RNA, 13 nt, Vaccinia virus
uauauacgaguau

SEQ ID NO: 3261951 - RNA, 20 nt, Vaccinia virus
aacucagucaauauauuaag

SEQ ID NO: 3261952 - RNA, 17 nt, Vaccinia virus
augaaguugagaaugau

SEQ ID NO: 3261953 - RNA, 15 nt, Vaccinia virus
uguaguauaucuaca

SEQ ID NO: 3261954 - RNA, 23 nt, Vaccinia virus
aaaucauuauauaguguugcuau

SEQ ID NO: 3261955 - RNA, 22 nt, Vaccinia virus
auaaaauuuaagagaaugauua

SEQ ID NO: 3261956 - RNA, 23 nt, Vaccinia virus
acucuaaacaauuggacaaauuc

SEQ ID NO: 3261957 - RNA, 19 nt, Vaccinia virus
acuauauuaacaucuaaac

SEQ ID NO: 3261958 - RNA, 20 nt, Vaccinia virus
cguauaucucuauuaaaugc

SEQ ID NO: 3261959 - RNA, 19 nt, Vaccinia virus
ucuauuugccaauauguca

SEQ ID NO: 3261960 - RNA, 17 nt, Vaccinia virus
uauuagagugucaauau

SEQ ID NO: 3261961 - RNA, 17 nt, Vaccinia virus
uaacauaaaaacucauu

SEQ ID NO: 3261962 - RNA, 15 nt, Vaccinia virus
ucuuuacccauccaa

SEQ ID NO: 3261963 - RNA, 15 nt, Vaccinia virus
cuaaacaauguuaug

SEQ ID NO: 3261964 - RNA, 16 nt, Vaccinia virus
uauccaauacagaaug

SEQ ID NO: 3261965 - RNA, 19 nt, Vaccinia virus
uuacccaugcaacugaacg

SEQ ID NO: 3261966 - RNA, 12 nt, Vaccinia virus
uaaagauauucu

SEQ ID NO: 3261967 - RNA, 14 nt, Vaccinia virus
uaacucuguuuuau

SEQ ID NO: 3261968 - RNA, 21 nt, Vaccinia virus
auaugccggagaguaaacauu

SEQ ID NO: 3261969 - RNA, 13 nt, Vaccinia virus
caagauauauaca

SEQ ID NO: 3261970 - RNA, 16 nt, Vaccinia virus
acuaguauauguggaa

SEQ ID NO: 3261971 - RNA, 20 nt, Vaccinia virus
cuacauccauguuuaucuau

SEQ ID NO: 3261972 - RNA, 14 nt, Vaccinia virus
guuuaauacuuauu

SEQ ID NO: 3261973 - RNA, 14 nt, Vaccinia virus
ucuagauauccaga

SEQ ID NO: 3261974 - RNA, 16 nt, Vaccinia virus
agcuuuacucugaaaa

SEQ ID NO: 3261975 - RNA, 16 nt, Vaccinia virus
cuauuaagaguaacag

SEQ ID NO: 3261976 - RNA, 20 nt, Vaccinia virus
ucgagaugaacauucaucug

SEQ ID NO: 3261977 - RNA, 21 nt, Vaccinia virus
auuugaacagagccuguaaca

SEQ ID NO: 3261978 - RNA, 17 nt, Vaccinia virus
augccggacaauagcac

SEQ ID NO: 3261979 - RNA, 17 nt, Vaccinia virus
auaucaucaucugaaau

SEQ ID NO: 3261980 - RNA, 13 nt, Vaccinia virus
cagggaaauuaaa

SEQ ID NO: 3261981 - RNA, 15 nt, Vaccinia virus
auaaguaaaugaaaa

SEQ ID NO: 3261982 - RNA, 20 nt, Vaccinia virus
uauugacuucguuuaucuug

SEQ ID NO: 3261983 - RNA, 18 nt, Vaccinia virus
cugcaaauguaguauuua

SEQ ID NO: 3261984 - RNA, 18 nt, Vaccinia virus
aaucacucaauaucuaga

SEQ ID NO: 3261985 - RNA, 22 nt, Vaccinia virus
cauaaauaacucuaauagcacg

SEQ ID NO: 3261986 - RNA, 13 nt, Vaccinia virus
acgugauagcucc

SEQ ID NO: 3261987 - RNA, 21 nt, Vaccinia virus
uucuacagugauaguuucauu

SEQ ID NO: 3261988 - RNA, 21 nt, Vaccinia virus
accguauccauaaacaauauu

SEQ ID NO: 3261989 - RNA, 22 nt, Vaccinia virus
uauauugauuuucguaacagau

SEQ ID NO: 3261990 - RNA, 23 nt, Vaccinia virus
ugguauucuugucauugaaggau

SEQ ID NO: 3261991 - RNA, 23 nt, Vaccinia virus
aauaagagcagcacaaacucauu

SEQ ID NO: 3261992 - RNA, 20 nt, Vaccinia virus
ccuugggaguaguuuaugau

SEQ ID NO: 3261993 - RNA, 23 nt, Vaccinia virus
gcuucuuaaaucagaauguuaca

SEQ ID NO: 3261994 - RNA, 17 nt, Vaccinia virus
uuaaaggauauuaugca

SEQ ID NO: 3261995 - RNA, 21 nt, Vaccinia virus
cauaauuguuagcuguuuuca

SEQ ID NO: 3261996 - RNA, 11 nt, Vaccinia virus
aaguuguacag

SEQ ID NO: 3261997 - RNA, 11 nt, Vaccinia virus
aauuuguacau

SEQ ID NO: 3261998 - RNA, 22 nt, Vaccinia virus
agugaugauaacacauauucau

SEQ ID NO: 3261999 - RNA, 17 nt, Vaccinia virus
cauuggugcuauccauu

SEQ ID NO: 3262000 - RNA, 16 nt, Vaccinia virus
aauuaugcaaucaaug

SEQ ID NO: 3262001 - RNA, 21 nt, Vaccinia virus
augaauuacuaaaauauacaa

SEQ ID NO: 3262002 - RNA, 14 nt, Vaccinia virus
ucaccgauagagaa

SEQ ID NO: 3262003 - RNA, 18 nt, Vaccinia virus
uaguuguggaaauacuuc

SEQ ID NO: 3262004 - RNA, 22 nt, Vaccinia virus
aggaaauauccucacaacuuaa

SEQ ID NO: 3262005 - RNA, 15 nt, Vaccinia virus
uuaauacaaguagua

SEQ ID NO: 3262006 - RNA, 19 nt, Vaccinia virus
uauuuacaucuaauuuacu

SEQ ID NO: 3262007 - RNA, 17 nt, Vaccinia virus
acaaacuguaaguaugu

SEQ ID NO: 3262008 - RNA, 18 nt, Vaccinia virus
acaugguucuccaugaau

SEQ ID NO: 3262009 - RNA, 17 nt, Vaccinia virus
aucucauucaaauccau

SEQ ID NO: 3262010 - RNA, 14 nt, Vaccinia virus
auuucaacaaacug

SEQ ID NO: 3262011 - RNA, 23 nt, Vaccinia virus
gcgucuguuuuauacauuuuuua

SEQ ID NO: 3262012 - RNA, 16 nt, Vaccinia virus
gaauuauuuacaaaau

SEQ ID NO: 3262013 - RNA, 17 nt, Vaccinia virus
augacgaauacauuuau

SEQ ID NO: 3262014 - RNA, 22 nt, Vaccinia virus
ugauaaauauacaauagaugca

SEQ ID NO: 3262015 - RNA, 15 nt, Vaccinia virus
aacaucagaaaaugu

SEQ ID NO: 3262016 - RNA, 20 nt, Vaccinia virus
aagugugaugauuguacacu

SEQ ID NO: 3262017 - RNA, 18 nt, Vaccinia virus
gcugaacacauuaaacaa

SEQ ID NO: 3262018 - RNA, 20 nt, Vaccinia virus
gaaauaaucauaaauuauuu

SEQ ID NO: 3262019 - RNA, 15 nt, Vaccinia virus
gaaaucuguaaucua

SEQ ID NO: 3262020 - RNA, 18 nt, Vaccinia virus
caaaaucguuaagaaguu

SEQ ID NO: 3262021 - RNA, 19 nt, Vaccinia virus
aauucacaccuagagacaa

SEQ ID NO: 3262022 - RNA, 16 nt, Vaccinia virus
auaaagauauaaauga

SEQ ID NO: 3262023 - RNA, 15 nt, Vaccinia virus
aaugcgccaaaguua

SEQ ID NO: 3262024 - RNA, 20 nt, Vaccinia virus
gucaaucuuauucaagcaaa

SEQ ID NO: 3262025 - RNA, 15 nt, Vaccinia virus
cuauuaauaauuacu

SEQ ID NO: 3262026 - RNA, 18 nt, Vaccinia virus
cuuuacaguuucuguaau

SEQ ID NO: 3262027 - RNA, 19 nt, Vaccinia virus
agacccuaauuauguagau

SEQ ID NO: 3262028 - RNA, 19 nt, Vaccinia virus
agcggauaaugauagaauu

SEQ ID NO: 3262029 - RNA, 12 nt, Vaccinia virus
ucauugauuuua

SEQ ID NO: 3262030 - RNA, 16 nt, Vaccinia virus
ucagaguuacaucaaa

SEQ ID NO: 3262031 - RNA, 15 nt, Vaccinia virus
agaauggaaauauau

SEQ ID NO: 3262032 - RNA, 19 nt, Vaccinia virus
cgugguaucuucuccauaa

SEQ ID NO: 3262033 - RNA, 23 nt, Vaccinia virus
uagcaagauuuuuaaacaacaau

SEQ ID NO: 3262034 - RNA, 23 nt, Vaccinia virus
uagauaguuuuuuugagccauau

SEQ ID NO: 3262035 - RNA, 16 nt, Vaccinia virus
augaugguacauauau

SEQ ID NO: 3262036 - RNA, 16 nt, Vaccinia virus
auuagagguaaugaug

SEQ ID NO: 3262037 - RNA, 19 nt, Vaccinia virus
ugcuuacaugcauacuuga

SEQ ID NO: 3262038 - RNA, 23 nt, Vaccinia virus
acgaauauaaaucauauuuagaa

SEQ ID NO: 3262039 - RNA, 21 nt, Vaccinia virus
ugauaaguucuuuauacaguu

SEQ ID NO: 3262040 - RNA, 14 nt, Vaccinia virus
uaguaauacaugua

SEQ ID NO: 3262041 - RNA, 21 nt, Vaccinia virus
cauuaaggcguugaugcaauu

SEQ ID NO: 3262042 - RNA, 19 nt, Vaccinia virus
cugcagccauuuuuaugau

SEQ ID NO: 3262043 - RNA, 13 nt, Vaccinia virus
gaaucuucccaua

SEQ ID NO: 3262044 - RNA, 17 nt, Vaccinia virus
augaguacuuguacaca

SEQ ID NO: 3262045 - RNA, 23 nt, Vaccinia virus
auuaauuucuaaaggagcaaaug

SEQ ID NO: 3262046 - RNA, 11 nt, Vaccinia virus
gaaucagcauc

SEQ ID NO: 3262047 - RNA, 17 nt, Vaccinia virus
uauaagauuaucaaaau

SEQ ID NO: 3262048 - RNA, 14 nt, Vaccinia virus
guagaaauuuuucu

SEQ ID NO: 3262049 - RNA, 20 nt, Vaccinia virus
uaauaaauuuucucuugaaa

SEQ ID NO: 3262050 - RNA, 11 nt, Vaccinia virus
caaaaagcaua

SEQ ID NO: 3262051 - RNA, 11 nt, Vaccinia virus
cgguuguacau

SEQ ID NO: 3262052 - RNA, 23 nt, Vaccinia virus
acucuacacguguccacauccuu

SEQ ID NO: 3262053 - RNA, 22 nt, Vaccinia virus
acuuuaggaucucuauugccaa

SEQ ID NO: 3262054 - RNA, 20 nt, Vaccinia virus
auauccagauggaguggaag

SEQ ID NO: 3262055 - RNA, 13 nt, Vaccinia virus
augaauaaagaaa

SEQ ID NO: 3262056 - RNA, 18 nt, Vaccinia virus
uaacauaaaaauaucauu

SEQ ID NO: 3262057 - RNA, 16 nt, Vaccinia virus
aguuaaaacuuuauca

SEQ ID NO: 3262058 - RNA, 20 nt, Vaccinia virus
agauaucgccuuuauuucca

SEQ ID NO: 3262059 - RNA, 17 nt, Vaccinia virus
uggaaugcguuccuugu

SEQ ID NO: 3262060 - RNA, 12 nt, Vaccinia virus
uaccaucauuau

SEQ ID NO: 3262061 - RNA, 18 nt, Vaccinia virus
gucuaccauuguuucgua

SEQ ID NO: 3262062 - RNA, 14 nt, Vaccinia virus
aaaagaaaauuugu

SEQ ID NO: 3262063 - RNA, 19 nt, Vaccinia virus
aauaacuauguuuuaaaaa

SEQ ID NO: 3262064 - RNA, 19 nt, Vaccinia virus
ucguacgauccaaauuccg

SEQ ID NO: 3262065 - RNA, 21 nt, Vaccinia virus
cauggcaacggauuuaauuuu

SEQ ID NO: 3262066 - RNA, 21 nt, Vaccinia virus
caucugacaaacgaugccuuu

SEQ ID NO: 3262067 - RNA, 12 nt, Vaccinia virus
uaaguauccauu

SEQ ID NO: 3262068 - RNA, 15 nt, Vaccinia virus
uuccagaucuguaug

SEQ ID NO: 3262069 - RNA, 14 nt, Vaccinia virus
gcgcuaguagauuu

SEQ ID NO: 3262070 - RNA, 15 nt, Vaccinia virus
uagauaaaauacuga

SEQ ID NO: 3262071 - RNA, 17 nt, Vaccinia virus
uacauugaauauaaaau

SEQ ID NO: 3262072 - RNA, 15 nt, Vaccinia virus
acaguaguaaugaag

SEQ ID NO: 3262073 - RNA, 22 nt, Vaccinia virus
aauauuuuucuauguuaggaau

SEQ ID NO: 3262074 - RNA, 12 nt, Vaccinia virus
ccaauuaaaugu

SEQ ID NO: 3262075 - RNA, 14 nt, Vaccinia virus
aauucauuccuaua

SEQ ID NO: 3262076 - RNA, 17 nt, Vaccinia virus
caacagugauaugugua

SEQ ID NO: 3262077 - RNA, 14 nt, Vaccinia virus
auuuuaacacuaau

SEQ ID NO: 3262078 - RNA, 12 nt, Vaccinia virus
gaaucaaaaagu

SEQ ID NO: 3262079 - RNA, 17 nt, Vaccinia virus
gcaauagguaauaacua

SEQ ID NO: 3262080 - RNA, 23 nt, Vaccinia virus
aauuauucauucuagaacuauaa

SEQ ID NO: 3262081 - RNA, 20 nt, Vaccinia virus
agauuuauugaaaaugugua

SEQ ID NO: 3262082 - RNA, 20 nt, Vaccinia virus
aauaucuaauggauaaacug

SEQ ID NO: 3262083 - RNA, 14 nt, Vaccinia virus
ucaauaaggaauua

SEQ ID NO: 3262084 - RNA, 12 nt, Vaccinia virus
uccuacaaccau

SEQ ID NO: 3262085 - RNA, 19 nt, Vaccinia virus
auacuaaaucuccuucaug

SEQ ID NO: 3262086 - RNA, 12 nt, Vaccinia virus
aacaauuacaaa

SEQ ID NO: 3262087 - RNA, 19 nt, Vaccinia virus
ccagaguguucgaaugcca

SEQ ID NO: 3262088 - RNA, 16 nt, Vaccinia virus
cugguucaaaauuaau

SEQ ID NO: 3262089 - RNA, 15 nt, Vaccinia virus
uaaaucaauaucucu

SEQ ID NO: 3262090 - RNA, 19 nt, Vaccinia virus
ggaucugacucggacucug

SEQ ID NO: 3262091 - RNA, 15 nt, Vaccinia virus
acguuuaauaauaau

SEQ ID NO: 3262092 - RNA, 12 nt, Vaccinia virus
uaucuucauaga

SEQ ID NO: 3262093 - RNA, 17 nt, Vaccinia virus
ugucugauuuuucuuca

SEQ ID NO: 3262094 - RNA, 15 nt, Vaccinia virus
auacuacuaaugaca

SEQ ID NO: 3262095 - RNA, 12 nt, Vaccinia virus
cauauaaauguc

SEQ ID NO: 3262096 - RNA, 20 nt, Vaccinia virus
auaaaccauuagauaaaguu

SEQ ID NO: 3262097 - RNA, 16 nt, Vaccinia virus
uccgucaccaaaaaag

SEQ ID NO: 3262098 - RNA, 18 nt, Vaccinia virus
ccuaaauaaauaugugua

SEQ ID NO: 3262099 - RNA, 14 nt, Vaccinia virus
aacuaacuauugaa

SEQ ID NO: 3262100 - RNA, 15 nt, Vaccinia virus
aauacuuuacgcuau

SEQ ID NO: 3262101 - RNA, 14 nt, Vaccinia virus
uagccaucguuaau

SEQ ID NO: 3262102 - RNA, 22 nt, Vaccinia virus
aaacauucuuuauuaaguguuu

SEQ ID NO: 3262103 - RNA, 18 nt, Vaccinia virus
auuccguauauagcacaa

SEQ ID NO: 3262104 - RNA, 20 nt, Vaccinia virus
uuaaaauaaaaaauauucuu

SEQ ID NO: 3262105 - RNA, 17 nt, Vaccinia virus
acuaauuguuaaccauu

SEQ ID NO: 3262106 - RNA, 23 nt, Vaccinia virus
uucguaacuggcggauuauucau

SEQ ID NO: 3262107 - RNA, 23 nt, Vaccinia virus
gacauucccacaguguugccauu

SEQ ID NO: 3262108 - RNA, 23 nt, Vaccinia virus
ugucuaaugaugaacacaaaugg

SEQ ID NO: 3262109 - RNA, 13 nt, Vaccinia virus
agaccaaacaaua

SEQ ID NO: 3262110 - RNA, 23 nt, Vaccinia virus
acuugaaauaaucggagaauguu

SEQ ID NO: 3262111 - RNA, 13 nt, Vaccinia virus
cuuaguaacucua

SEQ ID NO: 3262112 - RNA, 15 nt, Vaccinia virus
auccgauaaacauug

SEQ ID NO: 3262113 - RNA, 12 nt, Vaccinia virus
ccaaaacaaaau

SEQ ID NO: 3262114 - RNA, 14 nt, Vaccinia virus
ucuucuucuacauu

SEQ ID NO: 3262115 - RNA, 16 nt, Vaccinia virus
agcagcguauucauug

SEQ ID NO: 3262116 - RNA, 13 nt, Vaccinia virus
guaauccauaauc

SEQ ID NO: 3262117 - RNA, 22 nt, Vaccinia virus
guuucucaucuuuuacuugauu

SEQ ID NO: 3262118 - RNA, 19 nt, Vaccinia virus
ugaauaaucagauuuaccc

SEQ ID NO: 3262119 - RNA, 21 nt, Vaccinia virus
ucuuaacuacauucacaaaaa

SEQ ID NO: 3262120 - RNA, 16 nt, Vaccinia virus
agauuguaucaguuuc

SEQ ID NO: 3262121 - RNA, 14 nt, Vaccinia virus
aaugcuugaaaaug

SEQ ID NO: 3262122 - RNA, 13 nt, Vaccinia virus
aacuaucaaacaa

SEQ ID NO: 3262123 - RNA, 22 nt, Vaccinia virus
auuauagguaacauaaaaacug

SEQ ID NO: 3262124 - RNA, 13 nt, Vaccinia virus
auuuggaaaagaa

SEQ ID NO: 3262125 - RNA, 20 nt, Vaccinia virus
aucaauaaaugugagaaguu

SEQ ID NO: 3262126 - RNA, 19 nt, Vaccinia virus
agauagcguauaucucuau

SEQ ID NO: 3262127 - RNA, 16 nt, Vaccinia virus
auuuauguuuuaaaua

SEQ ID NO: 3262128 - RNA, 21 nt, Vaccinia virus
caucauacuagauaaaucguu

SEQ ID NO: 3262129 - RNA, 18 nt, Vaccinia virus
acuaacgcaacuauauag

SEQ ID NO: 3262130 - RNA, 12 nt, Vaccinia virus
guaaagaaggag

SEQ ID NO: 3262131 - RNA, 19 nt, Vaccinia virus
uuauauugaugaugucgaa

SEQ ID NO: 3262132 - RNA, 21 nt, Vaccinia virus
aucuauaugaccgauaagaga

SEQ ID NO: 3262133 - RNA, 14 nt, Vaccinia virus
auaauccugugcau

SEQ ID NO: 3262134 - RNA, 21 nt, Vaccinia virus
agcaagacuaacacacaaugu

SEQ ID NO: 3262135 - RNA, 18 nt, Vaccinia virus
aaacuuauuuagaauauc

SEQ ID NO: 3262136 - RNA, 21 nt, Vaccinia virus
gacucgcguuuagaggaguga

SEQ ID NO: 3262137 - RNA, 16 nt, Vaccinia virus
auaaugucaugucuag

SEQ ID NO: 3262138 - RNA, 16 nt, Vaccinia virus
uuagaaggaguguuuu

SEQ ID NO: 3262139 - RNA, 21 nt, Vaccinia virus
ugguauaaaguauuuggcuau

SEQ ID NO: 3262140 - RNA, 15 nt, Vaccinia virus
gugcgcugaggucgg

SEQ ID NO: 3262141 - RNA, 12 nt, Vaccinia virus
ccgauuaaacau

SEQ ID NO: 3262142 - RNA, 14 nt, Vaccinia virus
aucauaaagaacag

SEQ ID NO: 3262143 - RNA, 14 nt, Vaccinia virus
uuuucauguaucga

SEQ ID NO: 3262144 - RNA, 23 nt, Vaccinia virus
cuuaaugaagaucuauuuccaga

SEQ ID NO: 3262145 - RNA, 15 nt, Vaccinia virus
uuaauuaauguaacu

SEQ ID NO: 3262146 - RNA, 21 nt, Vaccinia virus
uaucacaacaucuauaaaagu

SEQ ID NO: 3262147 - RNA, 21 nt, Vaccinia virus
auacaucgguaaauaaaacua

SEQ ID NO: 3262148 - RNA, 17 nt, Vaccinia virus
aguucuuuuaugucaag

SEQ ID NO: 3262149 - RNA, 18 nt, Vaccinia virus
auagauaugccagaacua

SEQ ID NO: 3262150 - RNA, 21 nt, Vaccinia virus
caauuuuguauuauucugaau

SEQ ID NO: 3262151 - RNA, 12 nt, Vaccinia virus
aauaaaucaugg

SEQ ID NO: 3262152 - RNA, 19 nt, Vaccinia virus
cuagacguuuauucucaaa

SEQ ID NO: 3262153 - RNA, 14 nt, Vaccinia virus
aauaguucuguaau

SEQ ID NO: 3262154 - RNA, 16 nt, Vaccinia virus
auaacauuuuuuguaa

SEQ ID NO: 3262155 - RNA, 11 nt, Vaccinia virus
aucuaauuaau

SEQ ID NO: 3262156 - RNA, 22 nt, Vaccinia virus
uagagcccacguuuaaacauuc

SEQ ID NO: 3262157 - RNA, 17 nt, Vaccinia virus
cauaguccucguguggu

SEQ ID NO: 3262158 - RNA, 20 nt, Vaccinia virus
aauuagagacuuuauaacag

SEQ ID NO: 3262159 - RNA, 23 nt, Vaccinia virus
acucauuucauuauaauaguuua

SEQ ID NO: 3262160 - RNA, 15 nt, Vaccinia virus
ucuuaacuacauuca

SEQ ID NO: 3262161 - RNA, 12 nt, Vaccinia virus
ccaauacauguu

SEQ ID NO: 3262162 - RNA, 20 nt, Vaccinia virus
uuccacauuaauacagccua

SEQ ID NO: 3262163 - RNA, 18 nt, Vaccinia virus
uauaacaugcuaaaccuu

SEQ ID NO: 3262164 - RNA, 17 nt, Vaccinia virus
acgaaagcaaagaauga

SEQ ID NO: 3262165 - RNA, 17 nt, Vaccinia virus
aguaccgauucuagaua

SEQ ID NO: 3262166 - RNA, 21 nt, Vaccinia virus
caaacaauguuugacugaaua

SEQ ID NO: 3262167 - RNA, 22 nt, Vaccinia virus
gauuaccucuaguuucagaauu

SEQ ID NO: 3262168 - RNA, 19 nt, Vaccinia virus
caaaaauauaauagcuaau

SEQ ID NO: 3262169 - RNA, 20 nt, Vaccinia virus
auauuaacgaguuccauuua

SEQ ID NO: 3262170 - RNA, 15 nt, Vaccinia virus
aauaucuaggacaau

SEQ ID NO: 3262171 - RNA, 18 nt, Vaccinia virus
uucuaucgauaauugucu

SEQ ID NO: 3262172 - RNA, 22 nt, Vaccinia virus
uuagagaacauacauuuguaaa

SEQ ID NO: 3262173 - RNA, 16 nt, Vaccinia virus
aacggaacauauuuau

SEQ ID NO: 3262174 - RNA, 12 nt, Vaccinia virus
aauauagaauau

SEQ ID NO: 3262175 - RNA, 17 nt, Vaccinia virus
uaucaaccacauaucug

SEQ ID NO: 3262176 - RNA, 13 nt, Vaccinia virus
cgagcaagagaau

SEQ ID NO: 3262177 - RNA, 17 nt, Vaccinia virus
uaacauggauacagaua

SEQ ID NO: 3262178 - RNA, 19 nt, Vaccinia virus
uacuaguuuuacuaucaua

SEQ ID NO: 3262179 - RNA, 22 nt, Vaccinia virus
auuaacuacuugaaauucucca

SEQ ID NO: 3262180 - RNA, 17 nt, Vaccinia virus
ugauauauauuuucacu

SEQ ID NO: 3262181 - RNA, 14 nt, Vaccinia virus
aauguccacaaaug

SEQ ID NO: 3262182 - RNA, 22 nt, Vaccinia virus
acggagucauaacuauuuuacc

SEQ ID NO: 3262183 - RNA, 17 nt, Vaccinia virus
uguagaaucagcaucca

SEQ ID NO: 3262184 - RNA, 22 nt, Vaccinia virus
auuuacggaacuucuaaaacug

SEQ ID NO: 3262185 - RNA, 12 nt, Vaccinia virus
cauucuuggaug

SEQ ID NO: 3262186 - RNA, 18 nt, Vaccinia virus
aguuucacaugaauuugu

SEQ ID NO: 3262187 - RNA, 19 nt, Vaccinia virus
uuccugauuauuuacuaua

SEQ ID NO: 3262188 - RNA, 19 nt, Vaccinia virus
aacaaucacaagaacagag

SEQ ID NO: 3262189 - RNA, 21 nt, Vaccinia virus
gguauuuauaaacuuuaucca

SEQ ID NO: 3262190 - RNA, 17 nt, Vaccinia virus
acagaaacaucauauac

SEQ ID NO: 3262191 - RNA, 18 nt, Vaccinia virus
auuaucaaaauuaacaga

SEQ ID NO: 3262192 - RNA, 16 nt, Vaccinia virus
acaaaaagaaagaaua

SEQ ID NO: 3262193 - RNA, 17 nt, Vaccinia virus
ccaauuaccaacuagaa

SEQ ID NO: 3262194 - RNA, 15 nt, Vaccinia virus
aagauaucugguucu

SEQ ID NO: 3262195 - RNA, 23 nt, Vaccinia virus
caaacaucacucuucgaaaagaa

SEQ ID NO: 3262196 - RNA, 20 nt, Vaccinia virus
aucuuauguuuuuaagagau

SEQ ID NO: 3262197 - RNA, 20 nt, Vaccinia virus
uaacaaaaucaggaaaaaag

SEQ ID NO: 3262198 - RNA, 16 nt, Vaccinia virus
gccuucgaauaaauaa

SEQ ID NO: 3262199 - RNA, 18 nt, Vaccinia virus
guaauaaauaugauuuug

SEQ ID NO: 3262200 - RNA, 18 nt, Vaccinia virus
auuuuggugaaauuauua

SEQ ID NO: 3262201 - RNA, 17 nt, Vaccinia virus
cuugacuacauucucau

SEQ ID NO: 3262202 - RNA, 12 nt, Vaccinia virus
cuucauuauuuu

SEQ ID NO: 3262203 - RNA, 19 nt, Vaccinia virus
acauugcuuuaaaauggac

SEQ ID NO: 3262204 - RNA, 15 nt, Vaccinia virus
aauuauguuuuuaua

SEQ ID NO: 3262205 - RNA, 22 nt, Vaccinia virus
acgcaauagucagacuguaguu

SEQ ID NO: 3262206 - RNA, 19 nt, Vaccinia virus
auaaaacgaauuauagaca

SEQ ID NO: 3262207 - RNA, 19 nt, Vaccinia virus
ucaacacuacccaauaaau

SEQ ID NO: 3262208 - RNA, 17 nt, Vaccinia virus
ugcaaacuuaacagcuc

SEQ ID NO: 3262209 - RNA, 19 nt, Vaccinia virus
agcgcugaaaauaaagaua

SEQ ID NO: 3262210 - RNA, 22 nt, Vaccinia virus
aguuacucuuggucuaauacug

SEQ ID NO: 3262211 - RNA, 13 nt, Vaccinia virus
aaucagaaaacuu

SEQ ID NO: 3262212 - RNA, 15 nt, Vaccinia virus
ugaaugaaucagaua

SEQ ID NO: 3262213 - RNA, 19 nt, Vaccinia virus
ucgauuuaccguuacuaau

SEQ ID NO: 3262214 - RNA, 13 nt, Vaccinia virus
agauaauuuuacc

SEQ ID NO: 3262215 - RNA, 14 nt, Vaccinia virus
cauugucuuauaga

SEQ ID NO: 3262216 - RNA, 17 nt, Vaccinia virus
cuauuuuaccagcauua

SEQ ID NO: 3262217 - RNA, 18 nt, Vaccinia virus
uuaacgaguuaaaaaaga

SEQ ID NO: 3262218 - RNA, 20 nt, Vaccinia virus
gcacuacuguuaagaaugau

SEQ ID NO: 3262219 - RNA, 18 nt, Vaccinia virus
aucagaaucauacaauga

SEQ ID NO: 3262220 - RNA, 19 nt, Vaccinia virus
uuugagagaucauuucuau

SEQ ID NO: 3262221 - RNA, 16 nt, Vaccinia virus
aacauuuccuacuacu

SEQ ID NO: 3262222 - RNA, 16 nt, Vaccinia virus
cuuauguaugugcauu

SEQ ID NO: 3262223 - RNA, 13 nt, Vaccinia virus
acguaaugaagau

SEQ ID NO: 3262224 - RNA, 19 nt, Vaccinia virus
auaaaugauucaaccauga

SEQ ID NO: 3262225 - RNA, 13 nt, Vaccinia virus
auguccgaagaga

SEQ ID NO: 3262226 - RNA, 13 nt, Vaccinia virus
auaauauaaacau

SEQ ID NO: 3262227 - RNA, 15 nt, Vaccinia virus
aacuaaauuaacaau

SEQ ID NO: 3262228 - RNA, 16 nt, Vaccinia virus
auaugagaaugaauau

SEQ ID NO: 3262229 - RNA, 13 nt, Vaccinia virus
auauauuaaacaa

SEQ ID NO: 3262230 - RNA, 15 nt, Vaccinia virus
cuuugucggaagaau

SEQ ID NO: 3262231 - RNA, 19 nt, Vaccinia virus
auuacuaucuuuaacauaa

SEQ ID NO: 3262232 - RNA, 19 nt, Vaccinia virus
ugaaaaaaaacuagucguu

SEQ ID NO: 3262233 - RNA, 19 nt, Vaccinia virus
cgaauaauucuaauaaacu

SEQ ID NO: 3262234 - RNA, 20 nt, Vaccinia virus
cagauacaguuaauaucuau

SEQ ID NO: 3262235 - RNA, 15 nt, Vaccinia virus
auucuuauucuuauu

SEQ ID NO: 3262236 - RNA, 18 nt, Vaccinia virus
cucaaaugaauaaguuua

SEQ ID NO: 3262237 - RNA, 19 nt, Vaccinia virus
gauuuuuuuccaugauauc

SEQ ID NO: 3262238 - RNA, 20 nt, Vaccinia virus
guauaauucuuuauaacuga

SEQ ID NO: 3262239 - RNA, 20 nt, Vaccinia virus
auucucugacauucagaaag

SEQ ID NO: 3262240 - RNA, 22 nt, Vaccinia virus
acguugauggacagaugauaca

SEQ ID NO: 3262241 - RNA, 15 nt, Vaccinia virus
gaacauaaacaaauu

SEQ ID NO: 3262242 - RNA, 16 nt, Vaccinia virus
acauucagaaagacga

SEQ ID NO: 3262243 - RNA, 19 nt, Vaccinia virus
uaauacaucucuggaaaua

SEQ ID NO: 3262244 - RNA, 18 nt, Vaccinia virus
agauguauuugauauacu

SEQ ID NO: 3262245 - RNA, 17 nt, Vaccinia virus
aaauacgaaaacgauau

SEQ ID NO: 3262246 - RNA, 21 nt, Vaccinia virus
acucaauaucuagacuuucug

SEQ ID NO: 3262247 - RNA, 20 nt, Vaccinia virus
auuuauccagucugagaaaa

SEQ ID NO: 3262248 - RNA, 22 nt, Vaccinia virus
agauauagcaccaucuauucca

SEQ ID NO: 3262249 - RNA, 20 nt, Vaccinia virus
cuuuauccauaucucuagau

SEQ ID NO: 3262250 - RNA, 15 nt, Vaccinia virus
aaagauauuccaaga

SEQ ID NO: 3262251 - RNA, 14 nt, Vaccinia virus
ucuauuguuuggaa

SEQ ID NO: 3262252 - RNA, 22 nt, Vaccinia virus
uuaaaauaaaaaauauucuuca

SEQ ID NO: 3262253 - RNA, 18 nt, Vaccinia virus
acgauuucugaauuauuu

SEQ ID NO: 3262254 - RNA, 23 nt, Vaccinia virus
ugagauuuguuuuguuaaacaau

SEQ ID NO: 3262255 - RNA, 15 nt, Vaccinia virus
augauauguugugau

SEQ ID NO: 3262256 - RNA, 18 nt, Vaccinia virus
ugugaagguuuagauguc

SEQ ID NO: 3262257 - RNA, 22 nt, Vaccinia virus
uauuuaagaguggauucuucua

SEQ ID NO: 3262258 - RNA, 14 nt, Vaccinia virus
aaucauuuaaucca

SEQ ID NO: 3262259 - RNA, 19 nt, Vaccinia virus
gaauguucucaagaacuac

SEQ ID NO: 3262260 - RNA, 17 nt, Vaccinia virus
cuguaucccgucaacga

SEQ ID NO: 3262261 - RNA, 15 nt, Vaccinia virus
ugguuucuaaaucua

SEQ ID NO: 3262262 - RNA, 12 nt, Vaccinia virus
cugcagcauuuu

SEQ ID NO: 3262263 - RNA, 20 nt, Vaccinia virus
auagacggcuucuagaaguu

SEQ ID NO: 3262264 - RNA, 21 nt, Vaccinia virus
aaaaguuccagaaaauguaga

SEQ ID NO: 3262265 - RNA, 14 nt, Vaccinia virus
uaguuuuaagaaag

SEQ ID NO: 3262266 - RNA, 19 nt, Vaccinia virus
uacucuauaaaauacuaau

SEQ ID NO: 3262267 - RNA, 18 nt, Vaccinia virus
gauaaacgugauaaaagu

SEQ ID NO: 3262268 - RNA, 20 nt, Vaccinia virus
aucaaucuagcauuucuagc

SEQ ID NO: 3262269 - RNA, 17 nt, Vaccinia virus
aauuaugauagaaauua

SEQ ID NO: 3262270 - RNA, 18 nt, Vaccinia virus
aggagaauccgaaauauu

SEQ ID NO: 3262271 - RNA, 13 nt, Vaccinia virus
aaugaaaauggau

SEQ ID NO: 3262272 - RNA, 21 nt, Vaccinia virus
ucaacaaucguuaauaaaucu

SEQ ID NO: 3262273 - RNA, 12 nt, Vaccinia virus
auucagacacuu

SEQ ID NO: 3262274 - RNA, 17 nt, Vaccinia virus
cugauaauuuagauaau

SEQ ID NO: 3262275 - RNA, 23 nt, Vaccinia virus
auaguguuuaacaaagauauuac

SEQ ID NO: 3262276 - RNA, 12 nt, Vaccinia virus
gaucaaguaaag

SEQ ID NO: 3262277 - RNA, 18 nt, Vaccinia virus
caaaggaugaaagaaagc

SEQ ID NO: 3262278 - RNA, 14 nt, Vaccinia virus
acaaggaaacuaau

SEQ ID NO: 3262279 - RNA, 15 nt, Vaccinia virus
augucaggaaauauu

SEQ ID NO: 3262280 - RNA, 13 nt, Vaccinia virus
acucauuguuuac

SEQ ID NO: 3262281 - RNA, 16 nt, Vaccinia virus
acacuguguauuguuu

SEQ ID NO: 3262282 - RNA, 16 nt, Vaccinia virus
cauaauagaauguauu

SEQ ID NO: 3262283 - RNA, 13 nt, Vaccinia virus
cugcuauauuguu

SEQ ID NO: 3262284 - RNA, 22 nt, Vaccinia virus
aaguugcgaugaaauaggagau

SEQ ID NO: 3262285 - RNA, 16 nt, Vaccinia virus
cugcugcguuaaacau

SEQ ID NO: 3262286 - RNA, 21 nt, Vaccinia virus
auauuuuucguuuacaaaauc

SEQ ID NO: 3262287 - RNA, 14 nt, Vaccinia virus
uuggaagaaucuca

SEQ ID NO: 3262288 - RNA, 18 nt, Vaccinia virus
uuauagacaaauuauuca

SEQ ID NO: 3262289 - RNA, 11 nt, Vaccinia virus
guaacaaacug

SEQ ID NO: 3262290 - RNA, 16 nt, Vaccinia virus
acuaauucuuucucau

SEQ ID NO: 3262291 - RNA, 22 nt, Vaccinia virus
cagacaauaagagcagcacaaa

SEQ ID NO: 3262292 - RNA, 15 nt, Vaccinia virus
aacuaugucaaaaau

SEQ ID NO: 3262293 - RNA, 13 nt, Vaccinia virus
caugaacauaauc

SEQ ID NO: 3262294 - RNA, 19 nt, Vaccinia virus
auaauuguaacauccuucu

SEQ ID NO: 3262295 - RNA, 22 nt, Vaccinia virus
gaagagauuccugacuuugcau

SEQ ID NO: 3262296 - RNA, 19 nt, Vaccinia virus
caaacuuccauggaaaaac

SEQ ID NO: 3262297 - RNA, 18 nt, Vaccinia virus
ucuaaaccuucuuauucu

SEQ ID NO: 3262298 - RNA, 15 nt, Vaccinia virus
gugguagauauauag

SEQ ID NO: 3262299 - RNA, 14 nt, Vaccinia virus
gaacaucuuccaua

SEQ ID NO: 3262300 - RNA, 21 nt, Vaccinia virus
gaauauacugauuagaaauaa

SEQ ID NO: 3262301 - RNA, 13 nt, Vaccinia virus
cggaauagaugua

SEQ ID NO: 3262302 - RNA, 18 nt, Vaccinia virus
uuagaaacuucaaagauu

SEQ ID NO: 3262303 - RNA, 12 nt, Vaccinia virus
uguuucauauuu

SEQ ID NO: 3262304 - RNA, 15 nt, Vaccinia virus
guauaaucuggugga

SEQ ID NO: 3262305 - RNA, 20 nt, Vaccinia virus
uugaugauaucuacaucguu

SEQ ID NO: 3262306 - RNA, 17 nt, Vaccinia virus
aagugcuuaaauauuuc

SEQ ID NO: 3262307 - RNA, 19 nt, Vaccinia virus
auguucgguauaaaaauua

SEQ ID NO: 3262308 - RNA, 23 nt, Vaccinia virus
auaaaguccgacuauuguucuau

SEQ ID NO: 3262309 - RNA, 20 nt, Vaccinia virus
acuuuuacagaucuaguaua

SEQ ID NO: 3262310 - RNA, 19 nt, Vaccinia virus
auacuuuguaaucuagaca

SEQ ID NO: 3262311 - RNA, 23 nt, Vaccinia virus
ucauaaacucauccuaucuggag

SEQ ID NO: 3262312 - RNA, 16 nt, Vaccinia virus
uugauacggcuauucu

SEQ ID NO: 3262313 - RNA, 22 nt, Vaccinia virus
guaccagcauuuguaauaaucc

SEQ ID NO: 3262314 - RNA, 21 nt, Vaccinia virus
gugccguguuucaaauauucu

SEQ ID NO: 3262315 - RNA, 20 nt, Vaccinia virus
aaguaaaagaucuauaaugu

SEQ ID NO: 3262316 - RNA, 15 nt, Vaccinia virus
cagaaggaaacuucu

SEQ ID NO: 3262317 - RNA, 14 nt, Vaccinia virus
aagauaaucuucuc

SEQ ID NO: 3262318 - RNA, 21 nt, Vaccinia virus
guucuaguuccgcauuaaaug

SEQ ID NO: 3262319 - RNA, 21 nt, Vaccinia virus
ugaugcguuccauuuguguau

SEQ ID NO: 3262320 - RNA, 13 nt, Vaccinia virus
acauuuuaaaaua

SEQ ID NO: 3262321 - RNA, 15 nt, Vaccinia virus
auagccaaaagacua

SEQ ID NO: 3262322 - RNA, 14 nt, Vaccinia virus
cccaagauuucauc

SEQ ID NO: 3262323 - RNA, 20 nt, Vaccinia virus
ucaacagaaucaguauauau

SEQ ID NO: 3262324 - RNA, 22 nt, Vaccinia virus
uguauuaaagauauuguuacac

SEQ ID NO: 3262325 - RNA, 14 nt, Vaccinia virus
auuugaacuuaacu

SEQ ID NO: 3262326 - RNA, 15 nt, Vaccinia virus
aauaacuaugauauc

SEQ ID NO: 3262327 - RNA, 15 nt, Vaccinia virus
guguauuuccaucau

SEQ ID NO: 3262328 - RNA, 16 nt, Vaccinia virus
auuuucaauuauaaua

SEQ ID NO: 3262329 - RNA, 23 nt, Vaccinia virus
uuauuuuaaaccuaaagauguua

SEQ ID NO: 3262330 - RNA, 21 nt, Vaccinia virus
uucuacaauuacguaaugaag

SEQ ID NO: 3262331 - RNA, 14 nt, Vaccinia virus
ccagugcauuucua

SEQ ID NO: 3262332 - RNA, 22 nt, Vaccinia virus
agauuguuuaagaagagaauua

SEQ ID NO: 3262333 - RNA, 13 nt, Vaccinia virus
gcaaagagaugau

SEQ ID NO: 3262334 - RNA, 16 nt, Vaccinia virus
auaaaaaaagcaaugu

SEQ ID NO: 3262335 - RNA, 19 nt, Vaccinia virus
aucucauuaagcuaauaga

SEQ ID NO: 3262336 - RNA, 21 nt, Vaccinia virus
auuggaauaagcgucuucucg

SEQ ID NO: 3262337 - RNA, 13 nt, Vaccinia virus
aucccaaacauug

SEQ ID NO: 3262338 - RNA, 20 nt, Vaccinia virus
aucuuagacauuuuuagaga

SEQ ID NO: 3262339 - RNA, 14 nt, Vaccinia virus
uugauaauaaauca

SEQ ID NO: 3262340 - RNA, 18 nt, Vaccinia virus
auuaucgagcgugauguu

SEQ ID NO: 3262341 - RNA, 15 nt, Vaccinia virus
gauagagaacauaua

SEQ ID NO: 3262342 - RNA, 22 nt, Vaccinia virus
auuaauauaguuauuaaugaug

SEQ ID NO: 3262343 - RNA, 19 nt, Vaccinia virus
guuaaauuuuacaaaucua

SEQ ID NO: 3262344 - RNA, 13 nt, Vaccinia virus
uacugcaauaaaa

SEQ ID NO: 3262345 - RNA, 15 nt, Vaccinia virus
agcuccaucaguuuu

SEQ ID NO: 3262346 - RNA, 20 nt, Vaccinia virus
auuuuuauauacauuacuga

SEQ ID NO: 3262347 - RNA, 12 nt, Vaccinia virus
auuacaaacaug

SEQ ID NO: 3262348 - RNA, 18 nt, Vaccinia virus
uaguaccaaauucuucua

SEQ ID NO: 3262349 - RNA, 15 nt, Vaccinia virus
uaucgauaauuauuu

SEQ ID NO: 3262350 - RNA, 19 nt, Vaccinia virus
auuuuucuauguuaggaau

SEQ ID NO: 3262351 - RNA, 13 nt, Vaccinia virus
aaaauuguagaac

SEQ ID NO: 3262352 - RNA, 19 nt, Vaccinia virus
caaaauacauaauuuugua

SEQ ID NO: 3262353 - RNA, 13 nt, Vaccinia virus
aaauauuugugua

SEQ ID NO: 3262354 - RNA, 19 nt, Vaccinia virus
auauaccgccuuucaaaau

SEQ ID NO: 3262355 - RNA, 15 nt, Vaccinia virus
uuaauagaacucuuu

SEQ ID NO: 3262356 - RNA, 16 nt, Vaccinia virus
aaaucauuguguuuau

SEQ ID NO: 3262357 - RNA, 20 nt, Vaccinia virus
uaugaugcaaagauguuuaa

SEQ ID NO: 3262358 - RNA, 16 nt, Vaccinia virus
aaaccuaaagauguua

SEQ ID NO: 3262359 - RNA, 22 nt, Vaccinia virus
aaucauuccucauaagaugaua

SEQ ID NO: 3262360 - RNA, 18 nt, Vaccinia virus
cuagaauacucauuuucu

SEQ ID NO: 3262361 - RNA, 15 nt, Vaccinia virus
acuaucauaauuaaa

SEQ ID NO: 3262362 - RNA, 21 nt, Vaccinia virus
guagaucuuaucuauccagau

SEQ ID NO: 3262363 - RNA, 16 nt, Vaccinia virus
guaaaucacauaucua

SEQ ID NO: 3262364 - RNA, 23 nt, Vaccinia virus
agaaacugacuugauaaaaaugg

SEQ ID NO: 3262365 - RNA, 20 nt, Vaccinia virus
uauucucccaccguuauaua

SEQ ID NO: 3262366 - RNA, 19 nt, Vaccinia virus
guauccagguagacauaga

SEQ ID NO: 3262367 - RNA, 22 nt, Vaccinia virus
auagguuacuagauuaaaaaug

SEQ ID NO: 3262368 - RNA, 11 nt, Vaccinia virus
uauauaucuuu

SEQ ID NO: 3262369 - RNA, 21 nt, Vaccinia virus
accgacgauaauauaaacauc

SEQ ID NO: 3262370 - RNA, 24 nt, Vaccinia virus
agauucgaugguuugucaucguau

SEQ ID NO: 3262371 - RNA, 14 nt, Vaccinia virus
agaccauauacuga

SEQ ID NO: 3262372 - RNA, 14 nt, Vaccinia virus
cauauucuacucuu

SEQ ID NO: 3262373 - RNA, 21 nt, Vaccinia virus
ucauauauauacugagaaguu

SEQ ID NO: 3262374 - RNA, 17 nt, Vaccinia virus
augaaauuuaaguaaca

SEQ ID NO: 3262375 - RNA, 11 nt, Vaccinia virus
aauaaaacaau

SEQ ID NO: 3262376 - RNA, 19 nt, Vaccinia virus
aauagauaaugaacauaua

SEQ ID NO: 3262377 - RNA, 20 nt, Vaccinia virus
ccagaugaaugggugucaca

SEQ ID NO: 3262378 - RNA, 19 nt, Vaccinia virus
ucugaaaauccacuaacaa

SEQ ID NO: 3262379 - RNA, 14 nt, Vaccinia virus
aucuucguuaaaaa

SEQ ID NO: 3262380 - RNA, 14 nt, Vaccinia virus
aguacgguaauaga

SEQ ID NO: 3262381 - RNA, 19 nt, Vaccinia virus
cuuccaccacauccaucaa

SEQ ID NO: 3262382 - RNA, 20 nt, Vaccinia virus
guuauuuggcaguacucauu

SEQ ID NO: 3262383 - RNA, 15 nt, Vaccinia virus
agacgacguauuaua

SEQ ID NO: 3262384 - RNA, 17 nt, Vaccinia virus
cuuauuccacaauacga

SEQ ID NO: 3262385 - RNA, 15 nt, Vaccinia virus
aaggauaugauaugu

SEQ ID NO: 3262386 - RNA, 14 nt, Vaccinia virus
uguugugaaagagu

SEQ ID NO: 3262387 - RNA, 19 nt, Vaccinia virus
auaauucuuuauaacugaa

SEQ ID NO: 3262388 - RNA, 22 nt, Vaccinia virus
uaccaaagacuuugaaauauag

SEQ ID NO: 3262389 - RNA, 18 nt, Vaccinia virus
cuuuguagaaaaaaauuc

SEQ ID NO: 3262390 - RNA, 15 nt, Vaccinia virus
ucauuguuaugaauc

SEQ ID NO: 3262391 - RNA, 15 nt, Vaccinia virus
auaagacuaaugcuu

SEQ ID NO: 3262392 - RNA, 17 nt, Vaccinia virus
aaugauaucuuagaaua

SEQ ID NO: 3262393 - RNA, 16 nt, Vaccinia virus
cuuuguguugugcauu

SEQ ID NO: 3262394 - RNA, 13 nt, Vaccinia virus
aaauuuucaauua

SEQ ID NO: 3262395 - RNA, 20 nt, Vaccinia virus
aucaacgaguucaaauauga

SEQ ID NO: 3262396 - RNA, 22 nt, Vaccinia virus
uagaauguugagcuaauuuuug

SEQ ID NO: 3262397 - RNA, 17 nt, Vaccinia virus
cuagauauuaguauuuu

SEQ ID NO: 3262398 - RNA, 21 nt, Vaccinia virus
uaugaauccgaugaucucacu

SEQ ID NO: 3262399 - RNA, 20 nt, Vaccinia virus
gccucaucuucuauauccug

SEQ ID NO: 3262400 - RNA, 18 nt, Vaccinia virus
uuauaucuaaaaauuaga

SEQ ID NO: 3262401 - RNA, 17 nt, Vaccinia virus
uauacggcagcagcuuc

SEQ ID NO: 3262402 - RNA, 22 nt, Vaccinia virus
caucaaaaauaaguaaaaagug

SEQ ID NO: 3262403 - RNA, 13 nt, Vaccinia virus
uauacccaaagag

SEQ ID NO: 3262404 - RNA, 13 nt, Vaccinia virus
acaagucuaauaa

SEQ ID NO: 3262405 - RNA, 18 nt, Vaccinia virus
auaaaaaguaauauucau

SEQ ID NO: 3262406 - RNA, 13 nt, Vaccinia virus
ccaaacuuuuuca

SEQ ID NO: 3262407 - RNA, 19 nt, Vaccinia virus
uacuuucaaugagauaaau

SEQ ID NO: 3262408 - RNA, 16 nt, Vaccinia virus
cgaauauauaaaagac

SEQ ID NO: 3262409 - RNA, 20 nt, Vaccinia virus
gccacaaaacagaaauaugu

SEQ ID NO: 3262410 - RNA, 17 nt, Vaccinia virus
accauugauugcauaau

SEQ ID NO: 3262411 - RNA, 17 nt, Vaccinia virus
aucuuuacgaauuacuu

SEQ ID NO: 3262412 - RNA, 18 nt, Vaccinia virus
uuaaauccaaacaucacu

SEQ ID NO: 3262413 - RNA, 22 nt, Vaccinia virus
agauucuuccuccaaacaguua

SEQ ID NO: 3262414 - RNA, 19 nt, Vaccinia virus
uaguuuuaacauuauuaua

SEQ ID NO: 3262415 - RNA, 19 nt, Vaccinia virus
agucucgugaguaauucca

SEQ ID NO: 3262416 - RNA, 14 nt, Vaccinia virus
aauuauaauguuuc

SEQ ID NO: 3262417 - RNA, 14 nt, Vaccinia virus
aaugugucaagaau

SEQ ID NO: 3262418 - RNA, 20 nt, Vaccinia virus
ucuauccauuguuucacauu

SEQ ID NO: 3262419 - RNA, 13 nt, Vaccinia virus
aucaaaaaauuac

SEQ ID NO: 3262420 - RNA, 15 nt, Vaccinia virus
aauguaggagaguua

SEQ ID NO: 3262421 - RNA, 20 nt, Vaccinia virus
aacaaucaucgcauauagua

SEQ ID NO: 3262422 - RNA, 19 nt, Vaccinia virus
aaacuuaaucuuauuagaa

SEQ ID NO: 3262423 - RNA, 20 nt, Vaccinia virus
cuaguauagaucaaauacuu

SEQ ID NO: 3262424 - RNA, 18 nt, Vaccinia virus
aucuccaucgaugauaca

SEQ ID NO: 3262425 - RNA, 15 nt, Vaccinia virus
ucugcggauuuauaa

SEQ ID NO: 3262426 - RNA, 15 nt, Vaccinia virus
acuguggauguaaua

SEQ ID NO: 3262427 - RNA, 18 nt, Vaccinia virus
gagaaguaauaaaacgaa

SEQ ID NO: 3262428 - RNA, 13 nt, Vaccinia virus
guguaaaguuaaa

SEQ ID NO: 3262429 - RNA, 22 nt, Vaccinia virus
cgauaauugucucauauguuuu

SEQ ID NO: 3262430 - RNA, 18 nt, Vaccinia virus
guuaaaauaucaugguua

SEQ ID NO: 3262431 - RNA, 17 nt, Vaccinia virus
uuauccgcuaaaaauuu

SEQ ID NO: 3262432 - RNA, 19 nt, Vaccinia virus
uguccauaggauacuuugu

SEQ ID NO: 3262433 - RNA, 20 nt, Vaccinia virus
uacagagacuuuaucuaaau

SEQ ID NO: 3262434 - RNA, 15 nt, Vaccinia virus
agaaaugacuccaug

SEQ ID NO: 3262435 - RNA, 17 nt, Vaccinia virus
acauaauuauucuauca

SEQ ID NO: 3262436 - RNA, 15 nt, Vaccinia virus
auuggcaaauuauuu

SEQ ID NO: 3262437 - RNA, 12 nt, Vaccinia virus
cagacugaaagu

SEQ ID NO: 3262438 - RNA, 18 nt, Vaccinia virus
guccaauaugaucaugug

SEQ ID NO: 3262439 - RNA, 18 nt, Vaccinia virus
cuguaucauccaguuuuc

SEQ ID NO: 3262440 - RNA, 15 nt, Vaccinia virus
caucaaucaucauuu

SEQ ID NO: 3262441 - RNA, 18 nt, Vaccinia virus
auuauuaaguauaauaga

SEQ ID NO: 3262442 - RNA, 16 nt, Vaccinia virus
acuaauuaaagacuua

SEQ ID NO: 3262443 - RNA, 13 nt, Vaccinia virus
uuagauuauucuc

SEQ ID NO: 3262444 - RNA, 19 nt, Vaccinia virus
gaagucguguacguaauau

SEQ ID NO: 3262445 - RNA, 12 nt, Vaccinia virus
gauauuuucuau

SEQ ID NO: 3262446 - RNA, 16 nt, Vaccinia virus
accaccucucuggaag

SEQ ID NO: 3262447 - RNA, 18 nt, Vaccinia virus
gaugccaucauagauaua

SEQ ID NO: 3262448 - RNA, 19 nt, Vaccinia virus
aucaaaugguacaaaaaag

SEQ ID NO: 3262449 - RNA, 17 nt, Vaccinia virus
auacuguguaaagaaau

SEQ ID NO: 3262450 - RNA, 18 nt, Vaccinia virus
gaugaauuaauuaauguu

SEQ ID NO: 3262451 - RNA, 22 nt, Vaccinia virus
gaucauuuugauauugugaaug

SEQ ID NO: 3262452 - RNA, 14 nt, Vaccinia virus
uaagccaaacucau

SEQ ID NO: 3262453 - RNA, 18 nt, Vaccinia virus
ugagaauggaaaggaaac

SEQ ID NO: 3262454 - RNA, 22 nt, Vaccinia virus
ucaaacucuaaugaccacaucu

SEQ ID NO: 3262455 - RNA, 22 nt, Vaccinia virus
aggauauuuguucgacuuugug

SEQ ID NO: 3262456 - RNA, 15 nt, Vaccinia virus
ucagagaacuucugc

SEQ ID NO: 3262457 - RNA, 15 nt, Vaccinia virus
uuaucauggagugau

SEQ ID NO: 3262458 - RNA, 17 nt, Vaccinia virus
gcaauucgcuaaacaau

SEQ ID NO: 3262459 - RNA, 17 nt, Vaccinia virus
ccacugaugagauguua

SEQ ID NO: 3262460 - RNA, 18 nt, Vaccinia virus
caauaagcuuuagauauu

SEQ ID NO: 3262461 - RNA, 21 nt, Vaccinia virus
caucgauucccauaugauguu

SEQ ID NO: 3262462 - RNA, 14 nt, Vaccinia virus
aaacuugacauuua

SEQ ID NO: 3262463 - RNA, 21 nt, Vaccinia virus
aacuuaccacguaaaacuuaa

SEQ ID NO: 3262464 - RNA, 17 nt, Vaccinia virus
aguaauaaaacaaaaaa

SEQ ID NO: 3262465 - RNA, 19 nt, Vaccinia virus
uccuauaccgaguacugua

SEQ ID NO: 3262466 - RNA, 22 nt, Vaccinia virus
ugguuucgacucauuauaaugu

SEQ ID NO: 3262467 - RNA, 20 nt, Vaccinia virus
aauguuuaaacaucaaacau

SEQ ID NO: 3262468 - RNA, 14 nt, Vaccinia virus
aauaucuuaaauaa

SEQ ID NO: 3262469 - RNA, 13 nt, Vaccinia virus
agcggaugaaaaa

SEQ ID NO: 3262470 - RNA, 20 nt, Vaccinia virus
uuccaaugauauauuuucca

SEQ ID NO: 3262471 - RNA, 17 nt, Vaccinia virus
auacuuauucugauucu

SEQ ID NO: 3262472 - RNA, 20 nt, Vaccinia virus
aguauuuacaauguagaaau

SEQ ID NO: 3262473 - RNA, 12 nt, Vaccinia virus
ucuacuuuuguc

SEQ ID NO: 3262474 - RNA, 12 nt, Vaccinia virus
uagaaauacuua

SEQ ID NO: 3262475 - RNA, 13 nt, Vaccinia virus
auaaucaaaauug

SEQ ID NO: 3262476 - RNA, 13 nt, Vaccinia virus
gcguuaauguuug

SEQ ID NO: 3262477 - RNA, 17 nt, Vaccinia virus
uuuuaaaguuaaucaua

SEQ ID NO: 3262478 - RNA, 22 nt, Vaccinia virus
ucuucucgcuaguuuacuaugu

SEQ ID NO: 3262479 - RNA, 15 nt, Vaccinia virus
auaagccaaagcauu

SEQ ID NO: 3262480 - RNA, 15 nt, Vaccinia virus
uaugcaaucaauggu

SEQ ID NO: 3262481 - RNA, 22 nt, Vaccinia virus
gauuguccggcauaucauguag

SEQ ID NO: 3262482 - RNA, 13 nt, Vaccinia virus
ucauuuguuucca

SEQ ID NO: 3262483 - RNA, 23 nt, Vaccinia virus
uguuugaaaacagaaacaucaua

SEQ ID NO: 3262484 - RNA, 15 nt, Vaccinia virus
aaacauugauuaaau

SEQ ID NO: 3262485 - RNA, 21 nt, Vaccinia virus
guucgugccaauugaguaaca

SEQ ID NO: 3262486 - RNA, 18 nt, Vaccinia virus
aucuauccauaugcaucu

SEQ ID NO: 3262487 - RNA, 18 nt, Vaccinia virus
acauuaugagaauaugac

SEQ ID NO: 3262488 - RNA, 16 nt, Vaccinia virus
uaagagccagauuucg

SEQ ID NO: 3262489 - RNA, 11 nt, Vaccinia virus
cauuauuggaa

SEQ ID NO: 3262490 - RNA, 13 nt, Vaccinia virus
aguuuuauuggga

SEQ ID NO: 3262491 - RNA, 17 nt, Vaccinia virus
agaacacacuuuucuca

SEQ ID NO: 3262492 - RNA, 13 nt, Vaccinia virus
aaccaaauacaua

SEQ ID NO: 3262493 - RNA, 16 nt, Vaccinia virus
caauuccuuuuugccu

SEQ ID NO: 3262494 - RNA, 22 nt, Vaccinia virus
cucuaagaacuuauuaaugaau

SEQ ID NO: 3262495 - RNA, 17 nt, Vaccinia virus
ugauucauucacuauca

SEQ ID NO: 3262496 - RNA, 14 nt, Vaccinia virus
uagauggucucauu

SEQ ID NO: 3262497 - RNA, 18 nt, Vaccinia virus
agaacggagaauaucuau

SEQ ID NO: 3262498 - RNA, 20 nt, Vaccinia virus
gcgugaacaacuuacagaug

SEQ ID NO: 3262499 - RNA, 21 nt, Vaccinia virus
auugaaacugaggcuguugaa

SEQ ID NO: 3262500 - RNA, 13 nt, Vaccinia virus
uucuuguguaauu

SEQ ID NO: 3262501 - RNA, 15 nt, Vaccinia virus
auucuuuuauuaaug

SEQ ID NO: 3262502 - RNA, 14 nt, Vaccinia virus
aauguaguaaauau

SEQ ID NO: 3262503 - RNA, 13 nt, Vaccinia virus
uaguggacaacau

SEQ ID NO: 3262504 - RNA, 14 nt, Vaccinia virus
acuauaucaguuuu

SEQ ID NO: 3262505 - RNA, 13 nt, Vaccinia virus
cggaacaauaaac

SEQ ID NO: 3262506 - RNA, 16 nt, Vaccinia virus
uacaaccaaauucuug

SEQ ID NO: 3262507 - RNA, 19 nt, Vaccinia virus
aucauugauugagaagaag

SEQ ID NO: 3262508 - RNA, 21 nt, Vaccinia virus
cauaaaaauaaaaauauaauu

SEQ ID NO: 3262509 - RNA, 17 nt, Vaccinia virus
guaugaauaaucuucau

SEQ ID NO: 3262510 - RNA, 13 nt, Vaccinia virus
uagauauagagau

SEQ ID NO: 3262511 - RNA, 22 nt, Vaccinia virus
gguggcugauuaggcuguaguc

SEQ ID NO: 3262512 - RNA, 15 nt, Vaccinia virus
uagaucacaaaucac

SEQ ID NO: 3262513 - RNA, 19 nt, Vaccinia virus
aucacaagaaguuagaaag

SEQ ID NO: 3262514 - RNA, 22 nt, Vaccinia virus
augaucauuuugauauugugaa

SEQ ID NO: 3262515 - RNA, 13 nt, Vaccinia virus
cucaaacauccuc

SEQ ID NO: 3262516 - RNA, 22 nt, Vaccinia virus
gguuucgaagaucuucuuauuu

SEQ ID NO: 3262517 - RNA, 19 nt, Vaccinia virus
aauuacuaaaauauacaaa

SEQ ID NO: 3262518 - RNA, 22 nt, Vaccinia virus
guguauauuuuuucauuuuuua

SEQ ID NO: 3262519 - RNA, 23 nt, Vaccinia virus
acgcacuagagaguuuaucagaa

SEQ ID NO: 3262520 - RNA, 16 nt, Vaccinia virus
aguuuaucauacuuag

SEQ ID NO: 3262521 - RNA, 16 nt, Vaccinia virus
aauuacacauuuccaa

SEQ ID NO: 3262522 - RNA, 22 nt, Vaccinia virus
gauugacgcauuuaauagagau

SEQ ID NO: 3262523 - RNA, 12 nt, Vaccinia virus
uuugauucuauu

SEQ ID NO: 3262524 - RNA, 13 nt, Vaccinia virus
uuauuacauguuu

SEQ ID NO: 3262525 - RNA, 12 nt, Vaccinia virus
uaucuauacaua

SEQ ID NO: 3262526 - RNA, 21 nt, Vaccinia virus
acaagauuuuuagcguauuau

SEQ ID NO: 3262527 - RNA, 14 nt, Vaccinia virus
gaacagaugauaua

SEQ ID NO: 3262528 - RNA, 17 nt, Vaccinia virus
uaaucaauacaaaacau

SEQ ID NO: 3262529 - RNA, 20 nt, Vaccinia virus
acuucuuccaguucuggaua

SEQ ID NO: 3262530 - RNA, 21 nt, Vaccinia virus
acaaaaagauuucagaaucua

SEQ ID NO: 3262531 - RNA, 22 nt, Vaccinia virus
uaauaaccuacgcguauuauca

SEQ ID NO: 3262532 - RNA, 17 nt, Vaccinia virus
auucaagauuuuauuau

SEQ ID NO: 3262533 - RNA, 16 nt, Vaccinia virus
aacaggaugaauccau

SEQ ID NO: 3262534 - RNA, 12 nt, Vaccinia virus
uccagaauguac

SEQ ID NO: 3262535 - RNA, 17 nt, Vaccinia virus
uauacugagaaguuauu

SEQ ID NO: 3262536 - RNA, 16 nt, Vaccinia virus
cauaaauuauuucauu

SEQ ID NO: 3262537 - RNA, 23 nt, Vaccinia virus
aaccaauuacugauaauguagaa

SEQ ID NO: 3262538 - RNA, 16 nt, Vaccinia virus
aaccaugagugugaaa

SEQ ID NO: 3262539 - RNA, 20 nt, Vaccinia virus
aguuguggaagacuguacaa

SEQ ID NO: 3262540 - RNA, 17 nt, Vaccinia virus
uagauccuaauucacaa

SEQ ID NO: 3262541 - RNA, 22 nt, Vaccinia virus
uuaugauuagucacgacugaaa

SEQ ID NO: 3262542 - RNA, 16 nt, Vaccinia virus
uaacauugacugaaua

SEQ ID NO: 3262543 - RNA, 19 nt, Vaccinia virus
aaacguggauaaaaugcau

SEQ ID NO: 3262544 - RNA, 18 nt, Vaccinia virus
acguaaauacaaaacaga

SEQ ID NO: 3262545 - RNA, 18 nt, Vaccinia virus
aggaccguauuagaaugu

SEQ ID NO: 3262546 - RNA, 17 nt, Vaccinia virus
aacgacuuauaauuaau

SEQ ID NO: 3262547 - RNA, 15 nt, Vaccinia virus
agaugcucaauggau

SEQ ID NO: 3262548 - RNA, 14 nt, Vaccinia virus
ugauugaaaaugaa

SEQ ID NO: 3262549 - RNA, 21 nt, Vaccinia virus
gucaucgaaaugguagauaua

SEQ ID NO: 3262550 - RNA, 20 nt, Vaccinia virus
uagauaucaaauccaaugga

SEQ ID NO: 3262551 - RNA, 22 nt, Vaccinia virus
uucaugguaaggucuuagauau

SEQ ID NO: 3262552 - RNA, 22 nt, Vaccinia virus
uucgaugccggacaauagcaca

SEQ ID NO: 3262553 - RNA, 21 nt, Vaccinia virus
ugacgacaauaacaaaaucac

SEQ ID NO: 3262554 - RNA, 15 nt, Vaccinia virus
uaauaauucauggaa

SEQ ID NO: 3262555 - RNA, 22 nt, Vaccinia virus
agaucaauggugugauguugau

SEQ ID NO: 3262556 - RNA, 15 nt, Vaccinia virus
gauggauauauuaaa

SEQ ID NO: 3262557 - RNA, 16 nt, Vaccinia virus
uagauuauaauccuua

SEQ ID NO: 3262558 - RNA, 22 nt, Vaccinia virus
agagguucccaauuccaaagau

SEQ ID NO: 3262559 - RNA, 12 nt, Vaccinia virus
aauuuauuucua

SEQ ID NO: 3262560 - RNA, 20 nt, Vaccinia virus
cucaagauuuuaaaaaacug

SEQ ID NO: 3262561 - RNA, 18 nt, Vaccinia virus
cuaaugugauucucugaa

SEQ ID NO: 3262562 - RNA, 20 nt, Vaccinia virus
gauaaugauauauuaaacaa

SEQ ID NO: 3262563 - RNA, 16 nt, Vaccinia virus
gguuuuauuuuauccu

SEQ ID NO: 3262564 - RNA, 21 nt, Vaccinia virus
guauugacaauacuguauuau

SEQ ID NO: 3262565 - RNA, 15 nt, Vaccinia virus
gauucaacauuuaua

SEQ ID NO: 3262566 - RNA, 23 nt, Vaccinia virus
uauggacgacgguaagaaugaag

SEQ ID NO: 3262567 - RNA, 16 nt, Vaccinia virus
acgacuuauaauuaau

SEQ ID NO: 3262568 - RNA, 22 nt, Vaccinia virus
aaaacuauuacuaggagaauua

SEQ ID NO: 3262569 - RNA, 14 nt, Vaccinia virus
caauuuuaaaugau

SEQ ID NO: 3262570 - RNA, 18 nt, Vaccinia virus
aagucauagaaaaauaua

SEQ ID NO: 3262571 - RNA, 22 nt, Vaccinia virus
uaccacgcaauuauauaaugua

SEQ ID NO: 3262572 - RNA, 19 nt, Vaccinia virus
auuggcacgaacaaaagga

SEQ ID NO: 3262573 - RNA, 16 nt, Vaccinia virus
acaauaaugagaaugu

SEQ ID NO: 3262574 - RNA, 22 nt, Vaccinia virus
uuaucguuuaagaauaauacag

SEQ ID NO: 3262575 - RNA, 16 nt, Vaccinia virus
cugcuaauaaauaaug

SEQ ID NO: 3262576 - RNA, 18 nt, Vaccinia virus
aaucaugaauuuacagaa

SEQ ID NO: 3262577 - RNA, 18 nt, Vaccinia virus
uaacgaauuauauagucu

SEQ ID NO: 3262578 - RNA, 21 nt, Vaccinia virus
aauugaucaagaguaacuauu

SEQ ID NO: 3262579 - RNA, 18 nt, Vaccinia virus
uaguaguacacagcaugu

SEQ ID NO: 3262580 - RNA, 14 nt, Vaccinia virus
uuuuaguuuaucaa

SEQ ID NO: 3262581 - RNA, 19 nt, Vaccinia virus
uaauuacaaguauuauuga

SEQ ID NO: 3262582 - RNA, 19 nt, Vaccinia virus
auauaucacccauccauuu

SEQ ID NO: 3262583 - RNA, 19 nt, Vaccinia virus
acccgcauacuuuaacaaa

SEQ ID NO: 3262584 - RNA, 16 nt, Vaccinia virus
ucuagcuuucacuuaa

SEQ ID NO: 3262585 - RNA, 21 nt, Vaccinia virus
accaucucauaaaauaguucu

SEQ ID NO: 3262586 - RNA, 16 nt, Vaccinia virus
gucuguuuuauacauu

SEQ ID NO: 3262587 - RNA, 19 nt, Vaccinia virus
gcauucuaccguuguuaaa

SEQ ID NO: 3262588 - RNA, 15 nt, Vaccinia virus
auauguuauaauaga

SEQ ID NO: 3262589 - RNA, 22 nt, Vaccinia virus
gugaaaauuacauacuuaaaaa

SEQ ID NO: 3262590 - RNA, 12 nt, Vaccinia virus
uaagaauuauuu

SEQ ID NO: 3262591 - RNA, 12 nt, Vaccinia virus
uaauggaguaau

SEQ ID NO: 3262592 - RNA, 19 nt, Vaccinia virus
aacuauuuugucucuguuu

SEQ ID NO: 3262593 - RNA, 22 nt, Vaccinia virus
auaucuuaaauaacucauuuau

SEQ ID NO: 3262594 - RNA, 14 nt, Vaccinia virus
uauccucaaacauc

SEQ ID NO: 3262595 - RNA, 18 nt, Vaccinia virus
cgagucaaagcauaauac

SEQ ID NO: 3262596 - RNA, 20 nt, Vaccinia virus
uucuuacauaaaugaaaaga

SEQ ID NO: 3262597 - RNA, 16 nt, Vaccinia virus
uguacuaucuagagau

SEQ ID NO: 3262598 - RNA, 14 nt, Vaccinia virus
gaauauuaaacaau

SEQ ID NO: 3262599 - RNA, 13 nt, Vaccinia virus
ugaaccaaacauu

SEQ ID NO: 3262600 - RNA, 19 nt, Vaccinia virus
agcauauuccauuaaugac

SEQ ID NO: 3262601 - RNA, 13 nt, Vaccinia virus
cuuaucgacaucu

SEQ ID NO: 3262602 - RNA, 23 nt, Vaccinia virus
aaagucguuuauaucacauugua

SEQ ID NO: 3262603 - RNA, 18 nt, Vaccinia virus
acaacaggaugaauccau

SEQ ID NO: 3262604 - RNA, 16 nt, Vaccinia virus
uaaagacuuaagacuu

SEQ ID NO: 3262605 - RNA, 20 nt, Vaccinia virus
cguucgcgacaguauguggu

SEQ ID NO: 3262606 - RNA, 15 nt, Vaccinia virus
agaucauuaaauguu

SEQ ID NO: 3262607 - RNA, 15 nt, Vaccinia virus
aaaauaguucuguaa

SEQ ID NO: 3262608 - RNA, 23 nt, Vaccinia virus
auguuuauuuuuuucauauuaaa

SEQ ID NO: 3262609 - RNA, 16 nt, Vaccinia virus
aagacaaucauuuacu

SEQ ID NO: 3262610 - RNA, 16 nt, Vaccinia virus
gaauuuauuucuaauu

SEQ ID NO: 3262611 - RNA, 22 nt, Vaccinia virus
auaccguucgaugauauaguac

SEQ ID NO: 3262612 - RNA, 17 nt, Vaccinia virus
cauguuuauaaaaaugu

SEQ ID NO: 3262613 - RNA, 16 nt, Vaccinia virus
ucaagacccauccagu

SEQ ID NO: 3262614 - RNA, 16 nt, Vaccinia virus
gguucgauauaaagga

SEQ ID NO: 3262615 - RNA, 17 nt, Vaccinia virus
uucaucagaaaugacuc

SEQ ID NO: 3262616 - RNA, 20 nt, Vaccinia virus
cuuaauacaccguuaacaau

SEQ ID NO: 3262617 - RNA, 22 nt, Vaccinia virus
uuuuguaauaagaauaaaaugc

SEQ ID NO: 3262618 - RNA, 19 nt, Vaccinia virus
cauuuauaacggucaauau

SEQ ID NO: 3262619 - RNA, 16 nt, Vaccinia virus
uaaacgaaaacuauau

SEQ ID NO: 3262620 - RNA, 23 nt, Vaccinia virus
cugaagcguguuauauauacaag

SEQ ID NO: 3262621 - RNA, 22 nt, Vaccinia virus
auuuacagauuuaguuguuuaa

SEQ ID NO: 3262622 - RNA, 20 nt, Vaccinia virus
ugaagauauuauuaaaucau

SEQ ID NO: 3262623 - RNA, 15 nt, Vaccinia virus
uaaaaugguaaacuu

SEQ ID NO: 3262624 - RNA, 19 nt, Vaccinia virus
agaaucauaaagaacagua

SEQ ID NO: 3262625 - RNA, 16 nt, Vaccinia virus
guagaacaauguguga

SEQ ID NO: 3262626 - RNA, 23 nt, Vaccinia virus
aguacguacuaugccaaaugaau

SEQ ID NO: 3262627 - RNA, 14 nt, Vaccinia virus
cuugagaauaucca

SEQ ID NO: 3262628 - RNA, 23 nt, Vaccinia virus
uaaguaguuaugagggaaaagau

SEQ ID NO: 3262629 - RNA, 17 nt, Vaccinia virus
aaaauuccgcuacuaau

SEQ ID NO: 3262630 - RNA, 17 nt, Vaccinia virus
ggaaugacauacauacu

SEQ ID NO: 3262631 - RNA, 17 nt, Vaccinia virus
uaccaucaacuacugua

SEQ ID NO: 3262632 - RNA, 20 nt, Vaccinia virus
auaguuaucuaucuuaaaaa

SEQ ID NO: 3262633 - RNA, 21 nt, Vaccinia virus
uuuuuauaaaaugacaucguu

SEQ ID NO: 3262634 - RNA, 15 nt, Vaccinia virus
agauauccagaguuu

SEQ ID NO: 3262635 - RNA, 15 nt, Vaccinia virus
auauagcuuauucca

SEQ ID NO: 3262636 - RNA, 19 nt, Vaccinia virus
gacuguagaacucaugaau

SEQ ID NO: 3262637 - RNA, 14 nt, Vaccinia virus
acuuguuagauaga

SEQ ID NO: 3262638 - RNA, 16 nt, Vaccinia virus
gagagaauguauucau

SEQ ID NO: 3262639 - RNA, 22 nt, Vaccinia virus
uauaaccuaaaacccauguaua

SEQ ID NO: 3262640 - RNA, 12 nt, Vaccinia virus
aacaagcaauug

SEQ ID NO: 3262641 - RNA, 19 nt, Vaccinia virus
gaaaauacaaguauagaua

SEQ ID NO: 3262642 - RNA, 18 nt, Vaccinia virus
agaauccacaacagacga

SEQ ID NO: 3262643 - RNA, 16 nt, Vaccinia virus
gaaaauacguucuauu

SEQ ID NO: 3262644 - RNA, 14 nt, Vaccinia virus
augccaaaaucaua

SEQ ID NO: 3262645 - RNA, 16 nt, Vaccinia virus
uauuagagguaaugau

SEQ ID NO: 3262646 - RNA, 14 nt, Vaccinia virus
agcggcaucuaaau

SEQ ID NO: 3262647 - RNA, 15 nt, Vaccinia virus
ucuucgaaaagaaac

SEQ ID NO: 3262648 - RNA, 15 nt, Vaccinia virus
uaggauaauacaucc

SEQ ID NO: 3262649 - RNA, 21 nt, Vaccinia virus
aaaaccaguauuuguagcaag

SEQ ID NO: 3262650 - RNA, 18 nt, Vaccinia virus
aauaugaguaaugaaauc

SEQ ID NO: 3262651 - RNA, 15 nt, Vaccinia virus
caaauggucaaugau

SEQ ID NO: 3262652 - RNA, 19 nt, Vaccinia virus
uaaggacauuggauaugug

SEQ ID NO: 3262653 - RNA, 16 nt, Vaccinia virus
acaauccaaaaaauga

SEQ ID NO: 3262654 - RNA, 15 nt, Vaccinia virus
aucuuuaguaaacau

SEQ ID NO: 3262655 - RNA, 17 nt, Vaccinia virus
gaauaacgaacauaacu

SEQ ID NO: 3262656 - RNA, 15 nt, Vaccinia virus
gacucugguauuuau

SEQ ID NO: 3262657 - RNA, 13 nt, Vaccinia virus
guccaaaaugaug

SEQ ID NO: 3262658 - RNA, 15 nt, Vaccinia virus
ugauuucaauuuauu

SEQ ID NO: 3262659 - RNA, 22 nt, Vaccinia virus
uaaguguagcaaauaaaaucua

SEQ ID NO: 3262660 - RNA, 16 nt, Vaccinia virus
accauuagauaaucua

SEQ ID NO: 3262661 - RNA, 17 nt, Vaccinia virus
acaaguuuucauauuau

SEQ ID NO: 3262662 - RNA, 18 nt, Vaccinia virus
auacucaugccuaguaau

SEQ ID NO: 3262663 - RNA, 21 nt, Vaccinia virus
aagucucguucguaaauaaua

SEQ ID NO: 3262664 - RNA, 19 nt, Vaccinia virus
uacauguuucccaauuugu

SEQ ID NO: 3262665 - RNA, 19 nt, Vaccinia virus
uccauuauuuauuuacaga

SEQ ID NO: 3262666 - RNA, 14 nt, Vaccinia virus
gaauacucccaaac

SEQ ID NO: 3262667 - RNA, 15 nt, Vaccinia virus
aguaucaaaucuucu

SEQ ID NO: 3262668 - RNA, 19 nt, Vaccinia virus
cgcggaaaaaacauaauag

SEQ ID NO: 3262669 - RNA, 23 nt, Vaccinia virus
uauauugcauggaaucauagaug

SEQ ID NO: 3262670 - RNA, 15 nt, Vaccinia virus
agauaaccaaaaagu

SEQ ID NO: 3262671 - RNA, 20 nt, Vaccinia virus
uguaucauuuagcgauucaa

SEQ ID NO: 3262672 - RNA, 18 nt, Vaccinia virus
gauaguaauuucacgaau

SEQ ID NO: 3262673 - RNA, 20 nt, Vaccinia virus
aaauauagguuacuagauua

SEQ ID NO: 3262674 - RNA, 21 nt, Vaccinia virus
acaaaaaaugaauuaauaaua

SEQ ID NO: 3262675 - RNA, 16 nt, Vaccinia virus
uggaaaggaaauuaug

SEQ ID NO: 3262676 - RNA, 22 nt, Vaccinia virus
auaccauauccuccuguagaua

SEQ ID NO: 3262677 - RNA, 14 nt, Vaccinia virus
auuauauguagaag

SEQ ID NO: 3262678 - RNA, 20 nt, Vaccinia virus
uauaaacguauacuguagau

SEQ ID NO: 3262679 - RNA, 22 nt, Vaccinia virus
caacaauuuuguauuauucuga

SEQ ID NO: 3262680 - RNA, 23 nt, Vaccinia virus
acuuuuaacuaucgcaucaaaag

SEQ ID NO: 3262681 - RNA, 18 nt, Vaccinia virus
gaauuuguuguuucuauu

SEQ ID NO: 3262682 - RNA, 14 nt, Vaccinia virus
auaaucauguugau

SEQ ID NO: 3262683 - RNA, 18 nt, Vaccinia virus
acuccagaacaucuucca

SEQ ID NO: 3262684 - RNA, 19 nt, Vaccinia virus
aauaauaauuuaacaaucu

SEQ ID NO: 3262685 - RNA, 14 nt, Vaccinia virus
ucuagauauuagua

SEQ ID NO: 3262686 - RNA, 10 nt, Vaccinia virus
uaucucuuuc

SEQ ID NO: 3262687 - RNA, 22 nt, Vaccinia virus
accucuuauuggucagaaauau

SEQ ID NO: 3262688 - RNA, 15 nt, Vaccinia virus
auuugcacacauaau

SEQ ID NO: 3262689 - RNA, 22 nt, Vaccinia virus
uaccaacaugucugauauuuug

SEQ ID NO: 3262690 - RNA, 22 nt, Vaccinia virus
agaaauggauuaucggaaauac

SEQ ID NO: 3262691 - RNA, 13 nt, Vaccinia virus
auuucgacaaaaa

SEQ ID NO: 3262692 - RNA, 13 nt, Vaccinia virus
cuauauuguauuc

SEQ ID NO: 3262693 - RNA, 14 nt, Vaccinia virus
gaguugacauaucg

SEQ ID NO: 3262694 - RNA, 13 nt, Vaccinia virus
cucuauuguuuga

SEQ ID NO: 3262695 - RNA, 17 nt, Vaccinia virus
aaugaaauucuuguuua

SEQ ID NO: 3262696 - RNA, 20 nt, Vaccinia virus
aaguuucauagauagauaau

SEQ ID NO: 3262697 - RNA, 20 nt, Vaccinia virus
acucugggucauauuauaga

SEQ ID NO: 3262698 - RNA, 15 nt, Vaccinia virus
uuaguaggcaucuuu

SEQ ID NO: 3262699 - RNA, 16 nt, Vaccinia virus
auuuuagucauugcaa

SEQ ID NO: 3262700 - RNA, 17 nt, Vaccinia virus
gagauacuaacacauuu

SEQ ID NO: 3262701 - RNA, 13 nt, Vaccinia virus
auucaucaauaau

SEQ ID NO: 3262702 - RNA, 16 nt, Vaccinia virus
uaaaacgauuaaacaa

SEQ ID NO: 3262703 - RNA, 21 nt, Vaccinia virus
aguuucucaugucucuauaua

SEQ ID NO: 3262704 - RNA, 23 nt, Vaccinia virus
uuuggucccgauaccauuaaaga

SEQ ID NO: 3262705 - RNA, 21 nt, Vaccinia virus
uacuugacaaaaauugucacu

SEQ ID NO: 3262706 - RNA, 14 nt, Vaccinia virus
auccaagucaauau

SEQ ID NO: 3262707 - RNA, 18 nt, Vaccinia virus
auauuccaguucauauuu

SEQ ID NO: 3262708 - RNA, 15 nt, Vaccinia virus
acaauagauagucua

SEQ ID NO: 3262709 - RNA, 15 nt, Vaccinia virus
ucauucaagauaagc

SEQ ID NO: 3262710 - RNA, 21 nt, Vaccinia virus
acgagaauggcguuugauaua

SEQ ID NO: 3262711 - RNA, 16 nt, Vaccinia virus
uaaaaauguuaauuua

SEQ ID NO: 3262712 - RNA, 23 nt, Vaccinia virus
gauaaggaguagcagauuuccua

SEQ ID NO: 3262713 - RNA, 15 nt, Vaccinia virus
gaagauuauauucua

SEQ ID NO: 3262714 - RNA, 23 nt, Vaccinia virus
acaucgguacggguauucauuua

SEQ ID NO: 3262715 - RNA, 13 nt, Vaccinia virus
aguauguaacaga

SEQ ID NO: 3262716 - RNA, 14 nt, Vaccinia virus
ucaucaauguagug

SEQ ID NO: 3262717 - RNA, 20 nt, Vaccinia virus
caugcaaagcucuaaaucca

SEQ ID NO: 3262718 - RNA, 13 nt, Vaccinia virus
ugacguaaaugua

SEQ ID NO: 3262719 - RNA, 18 nt, Vaccinia virus
uacuaauaggucuaaaaa

SEQ ID NO: 3262720 - RNA, 20 nt, Vaccinia virus
uuucguuaaaacauucaaau

SEQ ID NO: 3262721 - RNA, 17 nt, Vaccinia virus
ugacagaccagaccuag

SEQ ID NO: 3262722 - RNA, 17 nt, Vaccinia virus
uguucgauauucucauu

SEQ ID NO: 3262723 - RNA, 14 nt, Vaccinia virus
uaucauuaaaucua

SEQ ID NO: 3262724 - RNA, 19 nt, Vaccinia virus
uuuuaacaccuccacaguu

SEQ ID NO: 3262725 - RNA, 15 nt, Vaccinia virus
aaguucaccaaacaa

SEQ ID NO: 3262726 - RNA, 22 nt, Vaccinia virus
uauacauguuagagaauauuca

SEQ ID NO: 3262727 - RNA, 19 nt, Vaccinia virus
uuagauaugugauuuacag

SEQ ID NO: 3262728 - RNA, 22 nt, Vaccinia virus
cuauuuguaauauuuagacaua

SEQ ID NO: 3262729 - RNA, 17 nt, Vaccinia virus
aaaagauucgguuuuau

SEQ ID NO: 3262730 - RNA, 14 nt, Vaccinia virus
aaucuuuaauguaa

SEQ ID NO: 3262731 - RNA, 15 nt, Vaccinia virus
auuaaucaagucaau

SEQ ID NO: 3262732 - RNA, 21 nt, Vaccinia virus
uuuaauuacagaguuuucaga

SEQ ID NO: 3262733 - RNA, 13 nt, Vaccinia virus
aggaacaaauauu

SEQ ID NO: 3262734 - RNA, 13 nt, Vaccinia virus
agagaaauauauu

SEQ ID NO: 3262735 - RNA, 16 nt, Vaccinia virus
gaauuuuaguuauuac

SEQ ID NO: 3262736 - RNA, 16 nt, Vaccinia virus
agugauaugaacauau

SEQ ID NO: 3262737 - RNA, 13 nt, Vaccinia virus
aaauuacuuaaag

SEQ ID NO: 3262738 - RNA, 20 nt, Vaccinia virus
auguaugcaauucacuguau

SEQ ID NO: 3262739 - RNA, 19 nt, Vaccinia virus
ucaaagggaccuaaaucua

SEQ ID NO: 3262740 - RNA, 23 nt, Vaccinia virus
aacgauugguauucguacaggua

SEQ ID NO: 3262741 - RNA, 19 nt, Vaccinia virus
gacgaucuuguuauaauua

SEQ ID NO: 3262742 - RNA, 15 nt, Vaccinia virus
ucucuaauuaugaaa

SEQ ID NO: 3262743 - RNA, 11 nt, Vaccinia virus
caaacauuuaa

SEQ ID NO: 3262744 - RNA, 16 nt, Vaccinia virus
uagauuuccaaagaua

SEQ ID NO: 3262745 - RNA, 19 nt, Vaccinia virus
guacaaaaaauaucauguu

SEQ ID NO: 3262746 - RNA, 15 nt, Vaccinia virus
aaugcuaauauuaaa

SEQ ID NO: 3262747 - RNA, 13 nt, Vaccinia virus
aauuauuagaaua

SEQ ID NO: 3262748 - RNA, 14 nt, Vaccinia virus
aauacguuagagaa

SEQ ID NO: 3262749 - RNA, 16 nt, Vaccinia virus
aauaucagaaaggaua

SEQ ID NO: 3262750 - RNA, 17 nt, Vaccinia virus
aaagaacggagaauugu

SEQ ID NO: 3262751 - RNA, 22 nt, Vaccinia virus
ugaucucgccguagcuaccaug

SEQ ID NO: 3262752 - RNA, 14 nt, Vaccinia virus
cacaacaauaacag

SEQ ID NO: 3262753 - RNA, 16 nt, Vaccinia virus
auuuguacacaucuau

SEQ ID NO: 3262754 - RNA, 16 nt, Vaccinia virus
acuuaagacuuaaaac

SEQ ID NO: 3262755 - RNA, 14 nt, Vaccinia virus
auaaaauaucuuaa

SEQ ID NO: 3262756 - RNA, 17 nt, Vaccinia virus
uauaaacucucaacauu

SEQ ID NO: 3262757 - RNA, 15 nt, Vaccinia virus
auauauuagaaauac

SEQ ID NO: 3262758 - RNA, 14 nt, Vaccinia virus
acuuauuaaugaau

SEQ ID NO: 3262759 - RNA, 21 nt, Vaccinia virus
auguauuaacuuuguucauuu

SEQ ID NO: 3262760 - RNA, 19 nt, Vaccinia virus
gauuugucacaauaugaau

SEQ ID NO: 3262761 - RNA, 20 nt, Vaccinia virus
aucaaacuguauagguaugu

SEQ ID NO: 3262762 - RNA, 21 nt, Vaccinia virus
uuaaccuuauuuuuauguucg

SEQ ID NO: 3262763 - RNA, 14 nt, Vaccinia virus
aaaauuuagaauga

SEQ ID NO: 3262764 - RNA, 21 nt, Vaccinia virus
auaauucuauucuaguauuac

SEQ ID NO: 3262765 - RNA, 23 nt, Vaccinia virus
uagaucuuuacacaaauaauuac

SEQ ID NO: 3262766 - RNA, 20 nt, Vaccinia virus
aucaaacgcugaaguaauua

SEQ ID NO: 3262767 - RNA, 16 nt, Vaccinia virus
agucugucuguagaua

SEQ ID NO: 3262768 - RNA, 23 nt, Vaccinia virus
cauuaauaggaaaagguggauuu

SEQ ID NO: 3262769 - RNA, 18 nt, Vaccinia virus
gcguacacaaucaaucau

SEQ ID NO: 3262770 - RNA, 14 nt, Vaccinia virus
ucuuuuuuuccaaa

SEQ ID NO: 3262771 - RNA, 18 nt, Vaccinia virus
uaggagacgcccaaaaua

SEQ ID NO: 3262772 - RNA, 20 nt, Vaccinia virus
ucaacaaguaggauuuuucc

SEQ ID NO: 3262773 - RNA, 19 nt, Vaccinia virus
uucuggaacauuaaaugua

SEQ ID NO: 3262774 - RNA, 19 nt, Vaccinia virus
agauuucagaaucuagauu

SEQ ID NO: 3262775 - RNA, 19 nt, Vaccinia virus
aucaaggacaguuaaaacu

SEQ ID NO: 3262776 - RNA, 21 nt, Vaccinia virus
aaccguuauuuauagcagaua

SEQ ID NO: 3262777 - RNA, 16 nt, Vaccinia virus
gauagcaaagagauga

SEQ ID NO: 3262778 - RNA, 19 nt, Vaccinia virus
aguaacuauugacuuaaua

SEQ ID NO: 3262779 - RNA, 17 nt, Vaccinia virus
ccugccauuuuagagau

SEQ ID NO: 3262780 - RNA, 18 nt, Vaccinia virus
auuaaaugaugaaacuaa

SEQ ID NO: 3262781 - RNA, 20 nt, Vaccinia virus
cauauaauagacauaaugac

SEQ ID NO: 3262782 - RNA, 17 nt, Vaccinia virus
uuccaugcuacuaguau

SEQ ID NO: 3262783 - RNA, 17 nt, Vaccinia virus
aagauuguacagaaauc

SEQ ID NO: 3262784 - RNA, 14 nt, Vaccinia virus
agaauauacuacaa

SEQ ID NO: 3262785 - RNA, 23 nt, Vaccinia virus
aucaaugauagacuagaagaaag

SEQ ID NO: 3262786 - RNA, 19 nt, Vaccinia virus
uacuuuuucaucuuuacau

SEQ ID NO: 3262787 - RNA, 13 nt, Vaccinia virus
cauucacaaaaag

SEQ ID NO: 3262788 - RNA, 15 nt, Vaccinia virus
gccauuaauuacuuu

SEQ ID NO: 3262789 - RNA, 19 nt, Vaccinia virus
auuuuacucauuuuuuaua

SEQ ID NO: 3262790 - RNA, 22 nt, Vaccinia virus
auucuaugaugaaacacaagau

SEQ ID NO: 3262791 - RNA, 16 nt, Vaccinia virus
uuaaugcuacagauau

SEQ ID NO: 3262792 - RNA, 15 nt, Vaccinia virus
uuuugcgcuauuaaa

SEQ ID NO: 3262793 - RNA, 19 nt, Vaccinia virus
gucuacaaccgcuacauaa

SEQ ID NO: 3262794 - RNA, 13 nt, Vaccinia virus
cuaaaaaugccac

SEQ ID NO: 3262795 - RNA, 13 nt, Vaccinia virus
gguuguaucucau

SEQ ID NO: 3262796 - RNA, 17 nt, Vaccinia virus
auaacuuuuucaauauc

SEQ ID NO: 3262797 - RNA, 22 nt, Vaccinia virus
accagucucgcguucaagauua

SEQ ID NO: 3262798 - RNA, 19 nt, Vaccinia virus
ugauauuucauauacuauu

SEQ ID NO: 3262799 - RNA, 13 nt, Vaccinia virus
auaaguaguaaua

SEQ ID NO: 3262800 - RNA, 20 nt, Vaccinia virus
auagaauaaauauccuugga

SEQ ID NO: 3262801 - RNA, 22 nt, Vaccinia virus
uaucucaucgcaguauauauca

SEQ ID NO: 3262802 - RNA, 17 nt, Vaccinia virus
aauaugauuuuuaaaaa

SEQ ID NO: 3262803 - RNA, 14 nt, Vaccinia virus
aagauuguuuaaga

SEQ ID NO: 3262804 - RNA, 21 nt, Vaccinia virus
gcguauaaugaaucuaaacuu

SEQ ID NO: 3262805 - RNA, 15 nt, Vaccinia virus
auuaucugaaauggu

SEQ ID NO: 3262806 - RNA, 20 nt, Vaccinia virus
cuaauuuuguagcauuagua

SEQ ID NO: 3262807 - RNA, 13 nt, Vaccinia virus
agauacguauuag

SEQ ID NO: 3262808 - RNA, 23 nt, Vaccinia virus
acuguagaugguucuuuaauagu

SEQ ID NO: 3262809 - RNA, 16 nt, Vaccinia virus
aucauaauaugagaug

SEQ ID NO: 3262810 - RNA, 12 nt, Vaccinia virus
guuaauuuuacu

SEQ ID NO: 3262811 - RNA, 16 nt, Vaccinia virus
ccaaacaauguuucua

SEQ ID NO: 3262812 - RNA, 13 nt, Vaccinia virus
uacuuuacauaua

SEQ ID NO: 3262813 - RNA, 16 nt, Vaccinia virus
uaagagaucaaagcau

SEQ ID NO: 3262814 - RNA, 18 nt, Vaccinia virus
gauauaaaaaucuguuuu

SEQ ID NO: 3262815 - RNA, 22 nt, Vaccinia virus
cuagauacccaaucucucucaa

SEQ ID NO: 3262816 - RNA, 12 nt, Vaccinia virus
aaacugaauaua

SEQ ID NO: 3262817 - RNA, 15 nt, Vaccinia virus
cagaggaguuauuua

SEQ ID NO: 3262818 - RNA, 23 nt, Vaccinia virus
auagguguaaaucuaggaauuac

SEQ ID NO: 3262819 - RNA, 18 nt, Vaccinia virus
uagucaaucuuauucaag

SEQ ID NO: 3262820 - RNA, 15 nt, Vaccinia virus
ucacuauagaaaaug

SEQ ID NO: 3262821 - RNA, 18 nt, Vaccinia virus
auuuagauacaucuauau

SEQ ID NO: 3262822 - RNA, 21 nt, Vaccinia virus
cagcauagacuuugccacaac

SEQ ID NO: 3262823 - RNA, 20 nt, Vaccinia virus
aaaggaagaauaucauauua

SEQ ID NO: 3262824 - RNA, 17 nt, Vaccinia virus
gcguguuuuauuaauca

SEQ ID NO: 3262825 - RNA, 22 nt, Vaccinia virus
caauaucuaugacucugauuuc

SEQ ID NO: 3262826 - RNA, 18 nt, Vaccinia virus
acaaacgcuacuauauau

SEQ ID NO: 3262827 - RNA, 15 nt, Vaccinia virus
uaagaggaugaucug

SEQ ID NO: 3262828 - RNA, 20 nt, Vaccinia virus
uucaguaaccaaauacauau

SEQ ID NO: 3262829 - RNA, 19 nt, Vaccinia virus
uaaucaugaaaucaaggau

SEQ ID NO: 3262830 - RNA, 20 nt, Vaccinia virus
aaccauauaaaaacaauagu

SEQ ID NO: 3262831 - RNA, 17 nt, Vaccinia virus
uaaaucaucgauuuuca

SEQ ID NO: 3262832 - RNA, 15 nt, Vaccinia virus
ucaaugugaauguau

SEQ ID NO: 3262833 - RNA, 19 nt, Vaccinia virus
aucauuacuaacuuuauca

SEQ ID NO: 3262834 - RNA, 16 nt, Vaccinia virus
augugcuaaaaucacu

SEQ ID NO: 3262835 - RNA, 22 nt, Vaccinia virus
cuuuacaguuucuguaaugaug

SEQ ID NO: 3262836 - RNA, 14 nt, Vaccinia virus
ucuacuauucuauu

SEQ ID NO: 3262837 - RNA, 23 nt, Vaccinia virus
aaucuaguuguggaaauacuucc

SEQ ID NO: 3262838 - RNA, 15 nt, Vaccinia virus
aaaagccccaauuua

SEQ ID NO: 3262839 - RNA, 22 nt, Vaccinia virus
auuuccacauuagaugguaaau

SEQ ID NO: 3262840 - RNA, 14 nt, Vaccinia virus
cuaacucuguuuua

SEQ ID NO: 3262841 - RNA, 17 nt, Vaccinia virus
acacucgacacaauauu

SEQ ID NO: 3262842 - RNA, 23 nt, Vaccinia virus
uaaauguauuuuuuaugauauac

SEQ ID NO: 3262843 - RNA, 19 nt, Vaccinia virus
cuacuacguucucuuugau

SEQ ID NO: 3262844 - RNA, 14 nt, Vaccinia virus
aucuaucuuaaaaa

SEQ ID NO: 3262845 - RNA, 17 nt, Vaccinia virus
auuaaguguuauaagau

SEQ ID NO: 3262846 - RNA, 22 nt, Vaccinia virus
aacaagcaucaugaauacagua

SEQ ID NO: 3262847 - RNA, 21 nt, Vaccinia virus
uauuuccuguuccguuaacau

SEQ ID NO: 3262848 - RNA, 13 nt, Vaccinia virus
uucugaugaaaca

SEQ ID NO: 3262849 - RNA, 16 nt, Vaccinia virus
ugaagccauugaaaac

SEQ ID NO: 3262850 - RNA, 16 nt, Vaccinia virus
cagugacggauauaca

SEQ ID NO: 3262851 - RNA, 20 nt, Vaccinia virus
auaauuuuaccagaauacua

SEQ ID NO: 3262852 - RNA, 17 nt, Vaccinia virus
uggaucaucgugugaua

SEQ ID NO: 3262853 - RNA, 12 nt, Vaccinia virus
aaauaauccaac

SEQ ID NO: 3262854 - RNA, 23 nt, Vaccinia virus
aaguuuauuaguguuuagauaau

SEQ ID NO: 3262855 - RNA, 15 nt, Vaccinia virus
agucgguauuucauc

SEQ ID NO: 3262856 - RNA, 16 nt, Vaccinia virus
agauaaaguuuauaca

SEQ ID NO: 3262857 - RNA, 15 nt, Vaccinia virus
ugaugcaaagauguu

SEQ ID NO: 3262858 - RNA, 15 nt, Vaccinia virus
gaauuccucugaaaa

SEQ ID NO: 3262859 - RNA, 17 nt, Vaccinia virus
guuauacagauguauua

SEQ ID NO: 3262860 - RNA, 17 nt, Vaccinia virus
aaaguauuuuaauacau

SEQ ID NO: 3262861 - RNA, 12 nt, Vaccinia virus
uuauaucuuuuu

SEQ ID NO: 3262862 - RNA, 21 nt, Vaccinia virus
auuacuauaaauggagaaugu

SEQ ID NO: 3262863 - RNA, 14 nt, Vaccinia virus
acggagauauuaaa

SEQ ID NO: 3262864 - RNA, 20 nt, Vaccinia virus
cauucuacguccuauggaug

SEQ ID NO: 3262865 - RNA, 23 nt, Vaccinia virus
auaugccgugggaugaugucaaa

SEQ ID NO: 3262866 - RNA, 19 nt, Vaccinia virus
ucugaaguaguuucuaaua

SEQ ID NO: 3262867 - RNA, 22 nt, Vaccinia virus
aauacauuuaaauucaucaucu

SEQ ID NO: 3262868 - RNA, 17 nt, Vaccinia virus
agguaucuugccaugga

SEQ ID NO: 3262869 - RNA, 12 nt, Vaccinia virus
ugucaacaaugu

SEQ ID NO: 3262870 - RNA, 13 nt, Vaccinia virus
aguacauuucaca

SEQ ID NO: 3262871 - RNA, 18 nt, Vaccinia virus
guauucggcauuucuaaa

SEQ ID NO: 3262872 - RNA, 22 nt, Vaccinia virus
uacuauauuaacaucuaaacau

SEQ ID NO: 3262873 - RNA, 14 nt, Vaccinia virus
caaaaguccaugau

SEQ ID NO: 3262874 - RNA, 16 nt, Vaccinia virus
ccauucuaauacuuua

SEQ ID NO: 3262875 - RNA, 15 nt, Vaccinia virus
augaguguagaugcu

SEQ ID NO: 3262876 - RNA, 13 nt, Vaccinia virus
uacugaauuauua

SEQ ID NO: 3262877 - RNA, 18 nt, Vaccinia virus
cuagugcucaaacaaaau

SEQ ID NO: 3262878 - RNA, 18 nt, Vaccinia virus
aaguauccauuuagcaaa

SEQ ID NO: 3262879 - RNA, 22 nt, Vaccinia virus
guuacguggaucgucacaauga

SEQ ID NO: 3262880 - RNA, 12 nt, Vaccinia virus
ccacaaaacaga

SEQ ID NO: 3262881 - RNA, 15 nt, Vaccinia virus
gacaccauagagaua

SEQ ID NO: 3262882 - RNA, 22 nt, Vaccinia virus
uaacauaaaaacuuauacaucc

SEQ ID NO: 3262883 - RNA, 19 nt, Vaccinia virus
uauagagcacuauuucuaa

SEQ ID NO: 3262884 - RNA, 12 nt, Vaccinia virus
auucuaaugaug

SEQ ID NO: 3262885 - RNA, 18 nt, Vaccinia virus
cggaauuauuggcuuuca

SEQ ID NO: 3262886 - RNA, 13 nt, Vaccinia virus
uucaggaacauaa

SEQ ID NO: 3262887 - RNA, 15 nt, Vaccinia virus
agcuucguauacucu

SEQ ID NO: 3262888 - RNA, 14 nt, Vaccinia virus
aacuuuuaaauaca

SEQ ID NO: 3262889 - RNA, 21 nt, Vaccinia virus
agauacguaguuauguagagg

SEQ ID NO: 3262890 - RNA, 21 nt, Vaccinia virus
auuauaguucuuaacaucuau

SEQ ID NO: 3262891 - RNA, 13 nt, Vaccinia virus
aaaaaagaacuaa

SEQ ID NO: 3262892 - RNA, 13 nt, Vaccinia virus
uuuaauauuucga

SEQ ID NO: 3262893 - RNA, 18 nt, Vaccinia virus
aauauuggaaaacuuuaa

SEQ ID NO: 3262894 - RNA, 21 nt, Vaccinia virus
gaacucaagucgaauauaaau

SEQ ID NO: 3262895 - RNA, 14 nt, Vaccinia virus
uuugacgacaacca

SEQ ID NO: 3262896 - RNA, 20 nt, Vaccinia virus
agcaucauacgaaaauagau

SEQ ID NO: 3262897 - RNA, 16 nt, Vaccinia virus
gcauuccaaucuuaaa

SEQ ID NO: 3262898 - RNA, 23 nt, Vaccinia virus
gacgauuucugaauuauuucaua

SEQ ID NO: 3262899 - RNA, 14 nt, Vaccinia virus
aucuaauuucugaa

SEQ ID NO: 3262900 - RNA, 14 nt, Vaccinia virus
ccaguuuaucccua

SEQ ID NO: 3262901 - RNA, 20 nt, Vaccinia virus
agauucuggaggagauggau

SEQ ID NO: 3262902 - RNA, 14 nt, Vaccinia virus
uuaagaucuaauau

SEQ ID NO: 3262903 - RNA, 19 nt, Vaccinia virus
caauaaaugcauuaguuua

SEQ ID NO: 3262904 - RNA, 17 nt, Vaccinia virus
gaucaacaaaagaauac

SEQ ID NO: 3262905 - RNA, 13 nt, Vaccinia virus
cuaaaaaauguag

SEQ ID NO: 3262906 - RNA, 14 nt, Vaccinia virus
uauucaaaauauga

SEQ ID NO: 3262907 - RNA, 23 nt, Vaccinia virus
aagaaauacuaaaaaauguagaa

SEQ ID NO: 3262908 - RNA, 23 nt, Vaccinia virus
uauuauuaggaucuacguucaua

SEQ ID NO: 3262909 - RNA, 15 nt, Vaccinia virus
acguucauagaauuu

SEQ ID NO: 3262910 - RNA, 18 nt, Vaccinia virus
aauaugcuaguuaauagu

SEQ ID NO: 3262911 - RNA, 13 nt, Vaccinia virus
gaugugguaauau

SEQ ID NO: 3262912 - RNA, 17 nt, Vaccinia virus
uugagauggauucacug

SEQ ID NO: 3262913 - RNA, 20 nt, Vaccinia virus
uucuuauugagagacgucau

SEQ ID NO: 3262914 - RNA, 17 nt, Vaccinia virus
auguauaccauugacuc

SEQ ID NO: 3262915 - RNA, 18 nt, Vaccinia virus
ugggaauauauuuggauu

SEQ ID NO: 3262916 - RNA, 14 nt, Vaccinia virus
gugacguacaaaaa

SEQ ID NO: 3262917 - RNA, 15 nt, Vaccinia virus
ugcuuauauuuucau

SEQ ID NO: 3262918 - RNA, 17 nt, Vaccinia virus
aaauccuccaucacuuc

SEQ ID NO: 3262919 - RNA, 14 nt, Vaccinia virus
uaacaauguuucca

SEQ ID NO: 3262920 - RNA, 11 nt, Vaccinia virus
agacacaucug

SEQ ID NO: 3262921 - RNA, 19 nt, Vaccinia virus
gcaaugagucgucaauccu

SEQ ID NO: 3262922 - RNA, 17 nt, Vaccinia virus
gaucguaaaucuguuuc

SEQ ID NO: 3262923 - RNA, 21 nt, Vaccinia virus
cgaaagaacugauugcagugu

SEQ ID NO: 3262924 - RNA, 14 nt, Vaccinia virus
ccaucguuaauuau

SEQ ID NO: 3262925 - RNA, 19 nt, Vaccinia virus
gaaaauuauaaugaauauu

SEQ ID NO: 3262926 - RNA, 12 nt, Vaccinia virus
aucuuugaaaau

SEQ ID NO: 3262927 - RNA, 18 nt, Vaccinia virus
uuauaaaguuuagucucu

SEQ ID NO: 3262928 - RNA, 20 nt, Vaccinia virus
uauggauuaccauggaugac

SEQ ID NO: 3262929 - RNA, 18 nt, Vaccinia virus
ugucuaugaauaugauuu

SEQ ID NO: 3262930 - RNA, 16 nt, Vaccinia virus
uaucugugaauacuuu

SEQ ID NO: 3262931 - RNA, 19 nt, Vaccinia virus
aggauuaacagguucucaa

SEQ ID NO: 3262932 - RNA, 14 nt, Vaccinia virus
auguaucaaagaua

SEQ ID NO: 3262933 - RNA, 18 nt, Vaccinia virus
ucucuaucuguuuccauu

SEQ ID NO: 3262934 - RNA, 16 nt, Vaccinia virus
uaauauauaaacucuu

SEQ ID NO: 3262935 - RNA, 21 nt, Vaccinia virus
aaauuggucuguguuacauau

SEQ ID NO: 3262936 - RNA, 14 nt, Vaccinia virus
cuuuagaguauuuc

SEQ ID NO: 3262937 - RNA, 18 nt, Vaccinia virus
aaacgauuauuucugaau

SEQ ID NO: 3262938 - RNA, 14 nt, Vaccinia virus
ucuuauagauguau

SEQ ID NO: 3262939 - RNA, 19 nt, Vaccinia virus
auacguuucuauuuucuau

SEQ ID NO: 3262940 - RNA, 15 nt, Vaccinia virus
acacgacaaugaaca

SEQ ID NO: 3262941 - RNA, 13 nt, Vaccinia virus
cucuauuaaauac

SEQ ID NO: 3262942 - RNA, 16 nt, Vaccinia virus
uaaacacauuauuaau

SEQ ID NO: 3262943 - RNA, 20 nt, Vaccinia virus
uauuaacuuuguucauuuau

SEQ ID NO: 3262944 - RNA, 16 nt, Vaccinia virus
auguuccaacucuguc

SEQ ID NO: 3262945 - RNA, 13 nt, Vaccinia virus
augcaaaauaaua

SEQ ID NO: 3262946 - RNA, 13 nt, Vaccinia virus
agaucccacauca

SEQ ID NO: 3262947 - RNA, 19 nt, Vaccinia virus
uugauacuuuuucuagaaa

SEQ ID NO: 3262948 - RNA, 16 nt, Vaccinia virus
aauguuaauuuugaaa

SEQ ID NO: 3262949 - RNA, 23 nt, Vaccinia virus
uuuuacacaaggcauuguuucua

SEQ ID NO: 3262950 - RNA, 17 nt, Vaccinia virus
aacaauugucuguaaac

SEQ ID NO: 3262951 - RNA, 17 nt, Vaccinia virus
uuuaacuagucuucucu

SEQ ID NO: 3262952 - RNA, 13 nt, Vaccinia virus
ucucauguucuua

SEQ ID NO: 3262953 - RNA, 20 nt, Vaccinia virus
aauaaauguccacuauacau

SEQ ID NO: 3262954 - RNA, 21 nt, Vaccinia virus
auuucuuuuugggaaaaauug

SEQ ID NO: 3262955 - RNA, 14 nt, Vaccinia virus
uauccaccuuauuu

SEQ ID NO: 3262956 - RNA, 19 nt, Vaccinia virus
uaucaauagcaguuuauua

SEQ ID NO: 3262957 - RNA, 20 nt, Vaccinia virus
acgaaauugcaaaauaugcu

SEQ ID NO: 3262958 - RNA, 23 nt, Vaccinia virus
guaaaccagcggcuacuaaaaga

SEQ ID NO: 3262959 - RNA, 17 nt, Vaccinia virus
acuauuacuaggagaau

SEQ ID NO: 3262960 - RNA, 22 nt, Vaccinia virus
auucagaauuucuacauaauua

SEQ ID NO: 3262961 - RNA, 13 nt, Vaccinia virus
guaaauaguuuua

SEQ ID NO: 3262962 - RNA, 15 nt, Vaccinia virus
cauaauauuaucaaa

SEQ ID NO: 3262963 - RNA, 14 nt, Vaccinia virus
guuuucaucuuuua

SEQ ID NO: 3262964 - RNA, 21 nt, Vaccinia virus
uaaaauugauucuaugaaaac

SEQ ID NO: 3262965 - RNA, 20 nt, Vaccinia virus
uauaauucuuuauaacugaa

SEQ ID NO: 3262966 - RNA, 11 nt, Vaccinia virus
aauaaaaauua

SEQ ID NO: 3262967 - RNA, 16 nt, Vaccinia virus
acuacuuuguuaauaa

SEQ ID NO: 3262968 - RNA, 19 nt, Vaccinia virus
aaauuugauuguauacuuu

SEQ ID NO: 3262969 - RNA, 16 nt, Vaccinia virus
auacuaaagaaacugu

SEQ ID NO: 3262970 - RNA, 18 nt, Vaccinia virus
cguauaucucauuaagcu

SEQ ID NO: 3262971 - RNA, 19 nt, Vaccinia virus
agaaagaaaauaucuauau

SEQ ID NO: 3262972 - RNA, 22 nt, Vaccinia virus
uagagauuuugaaaauuaugua

SEQ ID NO: 3262973 - RNA, 21 nt, Vaccinia virus
caaaauacucaggaagauauu

SEQ ID NO: 3262974 - RNA, 16 nt, Vaccinia virus
ugcaaauguaguauuu

SEQ ID NO: 3262975 - RNA, 19 nt, Vaccinia virus
aacugcuuuucuggauggc

SEQ ID NO: 3262976 - RNA, 15 nt, Vaccinia virus
uuaucccuauauuca

SEQ ID NO: 3262977 - RNA, 17 nt, Vaccinia virus
auaguuguuccuagaua

SEQ ID NO: 3262978 - RNA, 20 nt, Vaccinia virus
gaucuauguaguuuuaaaac

SEQ ID NO: 3262979 - RNA, 13 nt, Vaccinia virus
uauauguaacauu

SEQ ID NO: 3262980 - RNA, 14 nt, Vaccinia virus
gucuguaaaccaca

SEQ ID NO: 3262981 - RNA, 13 nt, Vaccinia virus
ugaauugcauaca

SEQ ID NO: 3262982 - RNA, 13 nt, Vaccinia virus
cguaguaacucua

SEQ ID NO: 3262983 - RNA, 14 nt, Vaccinia virus
gcaaaaauauucua

SEQ ID NO: 3262984 - RNA, 20 nt, Vaccinia virus
gauacaaucagauauaucua

SEQ ID NO: 3262985 - RNA, 23 nt, Vaccinia virus
uauaaucucauucgaacauacga

SEQ ID NO: 3262986 - RNA, 18 nt, Vaccinia virus
aaugauaaaaucaaacuu

SEQ ID NO: 3262987 - RNA, 20 nt, Vaccinia virus
guaacgcguggaaaaagcuc

SEQ ID NO: 3262988 - RNA, 15 nt, Vaccinia virus
uacaugacaauaaag

SEQ ID NO: 3262989 - RNA, 20 nt, Vaccinia virus
cuuuccguacaacauacugu

SEQ ID NO: 3262990 - RNA, 16 nt, Vaccinia virus
auucauagcuguauuu

SEQ ID NO: 3262991 - RNA, 23 nt, Vaccinia virus
caccgagggaaaaucuaaaguug

SEQ ID NO: 3262992 - RNA, 15 nt, Vaccinia virus
uaguauaacgugaau

SEQ ID NO: 3262993 - RNA, 19 nt, Vaccinia virus
cagguugcagcauagacuu

SEQ ID NO: 3262994 - RNA, 12 nt, Vaccinia virus
gaguaguacaag

SEQ ID NO: 3262995 - RNA, 23 nt, Vaccinia virus
acaucuaguauugauaaauggaa

SEQ ID NO: 3262996 - RNA, 13 nt, Vaccinia virus
aaugauaaagaua

SEQ ID NO: 3262997 - RNA, 19 nt, Vaccinia virus
agcaacaugucucuaaaug

SEQ ID NO: 3262998 - RNA, 17 nt, Vaccinia virus
uuuuaaauauuguauua

SEQ ID NO: 3262999 - RNA, 15 nt, Vaccinia virus
auuaggauuaucaaa

SEQ ID NO: 3263000 - RNA, 13 nt, Vaccinia virus
uugauucuagcau

SEQ ID NO: 3263001 - RNA, 23 nt, Vaccinia virus
aaaucauccguuguuauauaccg

SEQ ID NO: 3263002 - RNA, 17 nt, Vaccinia virus
agaaagugcaaaugagg

SEQ ID NO: 3263003 - RNA, 16 nt, Vaccinia virus
auuauuaauaagaaug

SEQ ID NO: 3263004 - RNA, 15 nt, Vaccinia virus
caguccacuguauaa

SEQ ID NO: 3263005 - RNA, 20 nt, Vaccinia virus
agaaaaaucauuaaaaagau

SEQ ID NO: 3263006 - RNA, 15 nt, Vaccinia virus
gaagacugaagagga

SEQ ID NO: 3263007 - RNA, 17 nt, Vaccinia virus
auucggagacuguauau

SEQ ID NO: 3263008 - RNA, 16 nt, Vaccinia virus
ugucuaucucuguaaa

SEQ ID NO: 3263009 - RNA, 17 nt, Vaccinia virus
aacuuaaacaaaauaca

SEQ ID NO: 3263010 - RNA, 23 nt, Vaccinia virus
cuaauguuuccggagauagauuu

SEQ ID NO: 3263011 - RNA, 19 nt, Vaccinia virus
uaucuggcucucucugcca

SEQ ID NO: 3263012 - RNA, 18 nt, Vaccinia virus
cauguguuucccaaacaa

SEQ ID NO: 3263013 - RNA, 22 nt, Vaccinia virus
ucucauuaaaugguuagagagu

SEQ ID NO: 3263014 - RNA, 12 nt, Vaccinia virus
acaaaagguauu

SEQ ID NO: 3263015 - RNA, 11 nt, Vaccinia virus
gauugauuuuu

SEQ ID NO: 3263016 - RNA, 22 nt, Vaccinia virus
gcauguagaagacaauaaagau

SEQ ID NO: 3263017 - RNA, 17 nt, Vaccinia virus
uuacaaauauucacaag

SEQ ID NO: 3263018 - RNA, 17 nt, Vaccinia virus
aauucaaauagauguuc

SEQ ID NO: 3263019 - RNA, 16 nt, Vaccinia virus
gaguugauuguaaaua

SEQ ID NO: 3263020 - RNA, 17 nt, Vaccinia virus
cuauuuuacuaaauaau

SEQ ID NO: 3263021 - RNA, 12 nt, Vaccinia virus
ggucagaaauau

SEQ ID NO: 3263022 - RNA, 20 nt, Vaccinia virus
aaaccaucggagaaggaaua

SEQ ID NO: 3263023 - RNA, 20 nt, Vaccinia virus
uguucccgucaauagagcaa

SEQ ID NO: 3263024 - RNA, 19 nt, Vaccinia virus
agaaacugacuugauaaaa

SEQ ID NO: 3263025 - RNA, 20 nt, Vaccinia virus
auuuuacaacuuuuaacaag

SEQ ID NO: 3263026 - RNA, 21 nt, Vaccinia virus
uuugauuaguauaacuagauu

SEQ ID NO: 3263027 - RNA, 17 nt, Vaccinia virus
uucagaggaauacagac

SEQ ID NO: 3263028 - RNA, 23 nt, Vaccinia virus
ucuuaguaacucuaguaaaauaa

SEQ ID NO: 3263029 - RNA, 18 nt, Vaccinia virus
uaaaauuaaauaguagua

SEQ ID NO: 3263030 - RNA, 16 nt, Vaccinia virus
aagacaauauuaucau

SEQ ID NO: 3263031 - RNA, 11 nt, Vaccinia virus
uaucuguaaaa

SEQ ID NO: 3263032 - RNA, 17 nt, Vaccinia virus
uuacauaucuacguucu

SEQ ID NO: 3263033 - RNA, 20 nt, Vaccinia virus
cacacgaggacuauguuugg

SEQ ID NO: 3263034 - RNA, 21 nt, Vaccinia virus
auuagcgagguauuuauucau

SEQ ID NO: 3263035 - RNA, 16 nt, Vaccinia virus
auccuacuguauacuu

SEQ ID NO: 3263036 - RNA, 18 nt, Vaccinia virus
cagaauauauaagacaca

SEQ ID NO: 3263037 - RNA, 18 nt, Vaccinia virus
agauaaugcgguuuauca

SEQ ID NO: 3263038 - RNA, 18 nt, Vaccinia virus
agauccaacauuaaucaa

SEQ ID NO: 3263039 - RNA, 17 nt, Vaccinia virus
gaaaauaaucuaguaaa

SEQ ID NO: 3263040 - RNA, 14 nt, Vaccinia virus
cuauaauaaugaau

SEQ ID NO: 3263041 - RNA, 16 nt, Vaccinia virus
ucaaagucguuuauau

SEQ ID NO: 3263042 - RNA, 22 nt, Vaccinia virus
uaguugacacguuuauuucaua

SEQ ID NO: 3263043 - RNA, 15 nt, Vaccinia virus
acuuuaagcuaaaau

SEQ ID NO: 3263044 - RNA, 14 nt, Vaccinia virus
aagaguuaaugaau

SEQ ID NO: 3263045 - RNA, 20 nt, Vaccinia virus
cauugauugccauaauaauu

SEQ ID NO: 3263046 - RNA, 11 nt, Vaccinia virus
gcauaauacaa

SEQ ID NO: 3263047 - RNA, 21 nt, Vaccinia virus
ucugaaauaacauauagauuu

SEQ ID NO: 3263048 - RNA, 15 nt, Vaccinia virus
ucguaaaaaaguuuu

SEQ ID NO: 3263049 - RNA, 14 nt, Vaccinia virus
agaaagaaauuugu

SEQ ID NO: 3263050 - RNA, 16 nt, Vaccinia virus
agagaccgauaccuau

SEQ ID NO: 3263051 - RNA, 20 nt, Vaccinia virus
auaucucauucaaauccaua

SEQ ID NO: 3263052 - RNA, 17 nt, Vaccinia virus
cgccauuuauccagucu

SEQ ID NO: 3263053 - RNA, 16 nt, Vaccinia virus
cugaugauauuagaac

SEQ ID NO: 3263054 - RNA, 21 nt, Vaccinia virus
cuaaaacuggagagacugauu

SEQ ID NO: 3263055 - RNA, 17 nt, Vaccinia virus
gauaaaauuaaugagau

SEQ ID NO: 3263056 - RNA, 18 nt, Vaccinia virus
acuauucaacgcagaggu

SEQ ID NO: 3263057 - RNA, 14 nt, Vaccinia virus
aguauagaaauugu

SEQ ID NO: 3263058 - RNA, 18 nt, Vaccinia virus
aucuacguucauauguau

SEQ ID NO: 3263059 - RNA, 22 nt, Vaccinia virus
cagugguuuuauuuuauccuug

SEQ ID NO: 3263060 - RNA, 13 nt, Vaccinia virus
ucagcuuuaguuu

SEQ ID NO: 3263061 - RNA, 21 nt, Vaccinia virus
auauaaugauauauauuuuca

SEQ ID NO: 3263062 - RNA, 18 nt, Vaccinia virus
aaauauuuaacucaugau

SEQ ID NO: 3263063 - RNA, 21 nt, Vaccinia virus
auuaaacuaauucauuuucaa

SEQ ID NO: 3263064 - RNA, 19 nt, Vaccinia virus
gaggaaaucguauaaauac

SEQ ID NO: 3263065 - RNA, 13 nt, Vaccinia virus
aaguaucaaaucu

SEQ ID NO: 3263066 - RNA, 20 nt, Vaccinia virus
auuguacgguagaauugaua

SEQ ID NO: 3263067 - RNA, 12 nt, Vaccinia virus
caaaauuacaau

SEQ ID NO: 3263068 - RNA, 18 nt, Vaccinia virus
agaagugaguauacuugu

SEQ ID NO: 3263069 - RNA, 15 nt, Vaccinia virus
ugucugacugaauac

SEQ ID NO: 3263070 - RNA, 17 nt, Vaccinia virus
uaaaaugauauuucauu

SEQ ID NO: 3263071 - RNA, 17 nt, Vaccinia virus
uuauacauccuguucua

SEQ ID NO: 3263072 - RNA, 12 nt, Vaccinia virus
ccuuuauuucca

SEQ ID NO: 3263073 - RNA, 13 nt, Vaccinia virus
gaagauagauaug

SEQ ID NO: 3263074 - RNA, 19 nt, Vaccinia virus
uuacaacgccaucaugaau

SEQ ID NO: 3263075 - RNA, 18 nt, Vaccinia virus
ucaauauauuaagaaguu

SEQ ID NO: 3263076 - RNA, 18 nt, Vaccinia virus
uagaugcuacuucaucua

SEQ ID NO: 3263077 - RNA, 13 nt, Vaccinia virus
aucaauaaugacg

SEQ ID NO: 3263078 - RNA, 20 nt, Vaccinia virus
ucaauggauaccuugcuauu

SEQ ID NO: 3263079 - RNA, 15 nt, Vaccinia virus
aaauacgaacuuuau

SEQ ID NO: 3263080 - RNA, 15 nt, Vaccinia virus
auagaucaaauacuu

SEQ ID NO: 3263081 - RNA, 12 nt, Vaccinia virus
augaaaauacuu

SEQ ID NO: 3263082 - RNA, 22 nt, Vaccinia virus
aguuuccuguaaauuuucuaua

SEQ ID NO: 3263083 - RNA, 15 nt, Vaccinia virus
uuuucacuaaauaag

SEQ ID NO: 3263084 - RNA, 13 nt, Vaccinia virus
cacugcagcauuu

SEQ ID NO: 3263085 - RNA, 14 nt, Vaccinia virus
agauaacaguguaa

SEQ ID NO: 3263086 - RNA, 18 nt, Vaccinia virus
acauauggaauauaucua

SEQ ID NO: 3263087 - RNA, 21 nt, Vaccinia virus
agcauugcguguuuuagugau

SEQ ID NO: 3263088 - RNA, 20 nt, Vaccinia virus
caaguaggauuuuuccaaag

SEQ ID NO: 3263089 - RNA, 13 nt, Vaccinia virus
uaacgucauuaaa

SEQ ID NO: 3263090 - RNA, 15 nt, Vaccinia virus
auugacgaugucaau

SEQ ID NO: 3263091 - RNA, 22 nt, Vaccinia virus
gauauacgcuaucuauauccug

SEQ ID NO: 3263092 - RNA, 20 nt, Vaccinia virus
uauucucguuaaacagcauu

SEQ ID NO: 3263093 - RNA, 22 nt, Vaccinia virus
guuuaaaaacacacaguuugau

SEQ ID NO: 3263094 - RNA, 19 nt, Vaccinia virus
aucucuuucagaacugaug

SEQ ID NO: 3263095 - RNA, 16 nt, Vaccinia virus
uucuaagguagaaucu

SEQ ID NO: 3263096 - RNA, 22 nt, Vaccinia virus
cucuagguaacaaacaaacucu

SEQ ID NO: 3263097 - RNA, 14 nt, Vaccinia virus
ucacuaacuaaugu

SEQ ID NO: 3263098 - RNA, 17 nt, Vaccinia virus
aaugaguucuguguaga

SEQ ID NO: 3263099 - RNA, 12 nt, Vaccinia virus
aacgauucuaga

SEQ ID NO: 3263100 - RNA, 21 nt, Vaccinia virus
uuuaccgacacccguuucaug

SEQ ID NO: 3263101 - RNA, 17 nt, Vaccinia virus
accuuuaacuucuggaa

SEQ ID NO: 3263102 - RNA, 21 nt, Vaccinia virus
uauuagauuugguaaaaugaa

SEQ ID NO: 3263103 - RNA, 21 nt, Vaccinia virus
agaaauaagagacuuaaacaa

SEQ ID NO: 3263104 - RNA, 16 nt, Vaccinia virus
auaaauacaauaauua

SEQ ID NO: 3263105 - RNA, 23 nt, Vaccinia virus
guacuuguauguguuauaaauau

SEQ ID NO: 3263106 - RNA, 17 nt, Vaccinia virus
aagaaaaaugauuaucu

SEQ ID NO: 3263107 - RNA, 12 nt, Vaccinia virus
aguauaguuuua

SEQ ID NO: 3263108 - RNA, 15 nt, Vaccinia virus
auaaaacucauauag

SEQ ID NO: 3263109 - RNA, 11 nt, Vaccinia virus
aaguauaacga

SEQ ID NO: 3263110 - RNA, 17 nt, Vaccinia virus
cauaaauauauuucuaa

SEQ ID NO: 3263111 - RNA, 21 nt, Vaccinia virus
auuauccaugauagaaagaaa

SEQ ID NO: 3263112 - RNA, 14 nt, Vaccinia virus
gagugguaaacaac

SEQ ID NO: 3263113 - RNA, 19 nt, Vaccinia virus
aaggccaaagaaaugagua

SEQ ID NO: 3263114 - RNA, 16 nt, Vaccinia virus
cucguuaaacagcauu

SEQ ID NO: 3263115 - RNA, 17 nt, Vaccinia virus
acuaucugacauaaaca

SEQ ID NO: 3263116 - RNA, 14 nt, Vaccinia virus
gaauccuauacucu

SEQ ID NO: 3263117 - RNA, 18 nt, Vaccinia virus
auucuucgcccucaauuu

SEQ ID NO: 3263118 - RNA, 22 nt, Vaccinia virus
uacucuccgaguguaaauauua

SEQ ID NO: 3263119 - RNA, 16 nt, Vaccinia virus
aaguuuuuauucucuu

SEQ ID NO: 3263120 - RNA, 18 nt, Vaccinia virus
uaaucuaguagaaaagau

SEQ ID NO: 3263121 - RNA, 22 nt, Vaccinia virus
guaauaucugacuuauuuccua

SEQ ID NO: 3263122 - RNA, 17 nt, Vaccinia virus
auauaacuucugguaaa

SEQ ID NO: 3263123 - RNA, 14 nt, Vaccinia virus
accuucuacauaua

SEQ ID NO: 3263124 - RNA, 14 nt, Vaccinia virus
auaauuguuuugaa

SEQ ID NO: 3263125 - RNA, 20 nt, Vaccinia virus
cuaaaauauuuuuuauucuc

SEQ ID NO: 3263126 - RNA, 13 nt, Vaccinia virus
gccucuagauauc

SEQ ID NO: 3263127 - RNA, 13 nt, Vaccinia virus
auucaaaaaagaa

SEQ ID NO: 3263128 - RNA, 17 nt, Vaccinia virus
aucuggauuucagauau

SEQ ID NO: 3263129 - RNA, 12 nt, Vaccinia virus
caacuuaaacaa

SEQ ID NO: 3263130 - RNA, 21 nt, Vaccinia virus
uaucauaaaagauacaaauau

SEQ ID NO: 3263131 - RNA, 19 nt, Vaccinia virus
agccugugaaugcaaucaa

SEQ ID NO: 3263132 - RNA, 17 nt, Vaccinia virus
guacauuaauaaaugaa

SEQ ID NO: 3263133 - RNA, 17 nt, Vaccinia virus
uccuccaguaaaugacg

SEQ ID NO: 3263134 - RNA, 16 nt, Vaccinia virus
gacaauaggaaaucua

SEQ ID NO: 3263135 - RNA, 16 nt, Vaccinia virus
aaacacgcuacacaac

SEQ ID NO: 3263136 - RNA, 14 nt, Vaccinia virus
cacuagaaaccacg

SEQ ID NO: 3263137 - RNA, 23 nt, Vaccinia virus
ugcuucguuuaaauaauauauca

SEQ ID NO: 3263138 - RNA, 12 nt, Vaccinia virus
augcuugaaaau

SEQ ID NO: 3263139 - RNA, 21 nt, Vaccinia virus
acaaaauucaaggaaagaaua

SEQ ID NO: 3263140 - RNA, 18 nt, Vaccinia virus
aguaauucagacacuucu

SEQ ID NO: 3263141 - RNA, 22 nt, Vaccinia virus
aaauaaaacagggauucguuua

SEQ ID NO: 3263142 - RNA, 19 nt, Vaccinia virus
cuuuauuuccacauuagau

SEQ ID NO: 3263143 - RNA, 16 nt, Vaccinia virus
uaucacagucuguuuu

SEQ ID NO: 3263144 - RNA, 22 nt, Vaccinia virus
auuaagcaacaugucucuaaau

SEQ ID NO: 3263145 - RNA, 16 nt, Vaccinia virus
uauguguauuaucaga

SEQ ID NO: 3263146 - RNA, 18 nt, Vaccinia virus
ugcuaaacuuuauguacu

SEQ ID NO: 3263147 - RNA, 21 nt, Vaccinia virus
uuagacaacaagguaccuaua

SEQ ID NO: 3263148 - RNA, 23 nt, Vaccinia virus
uaaaauaacucuguagacgauac

SEQ ID NO: 3263149 - RNA, 17 nt, Vaccinia virus
uguagauggauguagca

SEQ ID NO: 3263150 - RNA, 22 nt, Vaccinia virus
auacugucuaauccuaagaaaa

SEQ ID NO: 3263151 - RNA, 14 nt, Vaccinia virus
ucuaucaaagccuu

SEQ ID NO: 3263152 - RNA, 16 nt, Vaccinia virus
agacuuuaucuagauc

SEQ ID NO: 3263153 - RNA, 22 nt, Vaccinia virus
aaucauugauacauuuaaaagu

SEQ ID NO: 3263154 - RNA, 20 nt, Vaccinia virus
cugaaaaagauaucagagaa

SEQ ID NO: 3263155 - RNA, 15 nt, Vaccinia virus
uuguccggcauauca

SEQ ID NO: 3263156 - RNA, 13 nt, Vaccinia virus
ucauauucucaua

SEQ ID NO: 3263157 - RNA, 17 nt, Vaccinia virus
uccagguuuuuuaucuc

SEQ ID NO: 3263158 - RNA, 12 nt, Vaccinia virus
cucuuuaauagc

SEQ ID NO: 3263159 - RNA, 19 nt, Vaccinia virus
cgugcacccaacguauuua

SEQ ID NO: 3263160 - RNA, 21 nt, Vaccinia virus
gcaaccaccgcaugauaauau

SEQ ID NO: 3263161 - RNA, 22 nt, Vaccinia virus
ucucacugaauacgaggaugau

SEQ ID NO: 3263162 - RNA, 20 nt, Vaccinia virus
aauccuuggccuuugauucg

SEQ ID NO: 3263163 - RNA, 23 nt, Vaccinia virus
ugcuuuccuuguugaugaaggau

SEQ ID NO: 3263164 - RNA, 21 nt, Vaccinia virus
cgugcacuuuuuuauaaagau

SEQ ID NO: 3263165 - RNA, 20 nt, Vaccinia virus
aggaauuaaucuaguagaaa

SEQ ID NO: 3263166 - RNA, 12 nt, Vaccinia virus
cauaaaacauca

SEQ ID NO: 3263167 - RNA, 22 nt, Vaccinia virus
uacaaacuuuuccuuuuccaca

SEQ ID NO: 3263168 - RNA, 15 nt, Vaccinia virus
auuucucuaucgaug

SEQ ID NO: 3263169 - RNA, 21 nt, Vaccinia virus
ugagauacguaguuauguaga

SEQ ID NO: 3263170 - RNA, 16 nt, Vaccinia virus
gaauuacauagaugau

SEQ ID NO: 3263171 - RNA, 21 nt, Vaccinia virus
gcaucaacaauuacaaaugag

SEQ ID NO: 3263172 - RNA, 18 nt, Vaccinia virus
uaguauaugaacaaacgu

SEQ ID NO: 3263173 - RNA, 18 nt, Vaccinia virus
ucauaugugguauucacu

SEQ ID NO: 3263174 - RNA, 20 nt, Vaccinia virus
aauauuuuucguuuacaaaa

SEQ ID NO: 3263175 - RNA, 23 nt, Vaccinia virus
uucuugauagagaugagaugcuc

SEQ ID NO: 3263176 - RNA, 12 nt, Vaccinia virus
aauuaucaaaug

SEQ ID NO: 3263177 - RNA, 20 nt, Vaccinia virus
aaacagacgacaacauguaa

SEQ ID NO: 3263178 - RNA, 19 nt, Vaccinia virus
gaauaagaguguaguauca

SEQ ID NO: 3263179 - RNA, 17 nt, Vaccinia virus
ucauaauuacauuuaga

SEQ ID NO: 3263180 - RNA, 19 nt, Vaccinia virus
ccuuaaauguuuucucugu

SEQ ID NO: 3263181 - RNA, 18 nt, Vaccinia virus
augucguuauucugaaac

SEQ ID NO: 3263182 - RNA, 16 nt, Vaccinia virus
aauguuagugaugaau

SEQ ID NO: 3263183 - RNA, 19 nt, Vaccinia virus
aucaacagaaucaguauau

SEQ ID NO: 3263184 - RNA, 17 nt, Vaccinia virus
aucgugcagguuaaaua

SEQ ID NO: 3263185 - RNA, 15 nt, Vaccinia virus
ugcuguuguacauac

SEQ ID NO: 3263186 - RNA, 15 nt, Vaccinia virus
ggaguaaauauacaa

SEQ ID NO: 3263187 - RNA, 13 nt, Vaccinia virus
gauugauuagaaa

SEQ ID NO: 3263188 - RNA, 15 nt, Vaccinia virus
auggaauuggagaaa

SEQ ID NO: 3263189 - RNA, 12 nt, Vaccinia virus
aaugaaauucuu

SEQ ID NO: 3263190 - RNA, 22 nt, Vaccinia virus
uacagauguuacaaauguagaa

SEQ ID NO: 3263191 - RNA, 15 nt, Vaccinia virus
auuauauaguguugc

SEQ ID NO: 3263192 - RNA, 17 nt, Vaccinia virus
auugauuagaaaauaua

SEQ ID NO: 3263193 - RNA, 12 nt, Vaccinia virus
aaauauguguau

SEQ ID NO: 3263194 - RNA, 13 nt, Vaccinia virus
uauacuacaauug

SEQ ID NO: 3263195 - RNA, 12 nt, Vaccinia virus
acauuuaaugau

SEQ ID NO: 3263196 - RNA, 14 nt, Vaccinia virus
cuucuguuaauuuu

SEQ ID NO: 3263197 - RNA, 18 nt, Vaccinia virus
gaucuccaucgaugauac

SEQ ID NO: 3263198 - RNA, 19 nt, Vaccinia virus
auauuaucucaacaaaauu

SEQ ID NO: 3263199 - RNA, 20 nt, Vaccinia virus
agauuguuguauagaaauuu

SEQ ID NO: 3263200 - RNA, 14 nt, Vaccinia virus
augacaaaauuaaa

SEQ ID NO: 3263201 - RNA, 18 nt, Vaccinia virus
uaguagaguuuuauucuc

SEQ ID NO: 3263202 - RNA, 20 nt, Vaccinia virus
gauucauuuuauuuguuaaa

SEQ ID NO: 3263203 - RNA, 14 nt, Vaccinia virus
ucucugauagaaug

SEQ ID NO: 3263204 - RNA, 17 nt, Vaccinia virus
uuaucaaaauuuggaaa

SEQ ID NO: 3263205 - RNA, 22 nt, Vaccinia virus
aguauucguuuucuaauucuuu

SEQ ID NO: 3263206 - RNA, 14 nt, Vaccinia virus
aaggaaaaugaaca

SEQ ID NO: 3263207 - RNA, 15 nt, Vaccinia virus
acaggaaagaaguau

SEQ ID NO: 3263208 - RNA, 20 nt, Vaccinia virus
auucuauaaucaaugagaca

SEQ ID NO: 3263209 - RNA, 18 nt, Vaccinia virus
gaugucgaugguauguau

SEQ ID NO: 3263210 - RNA, 16 nt, Vaccinia virus
aauuagaauuacaaaa

SEQ ID NO: 3263211 - RNA, 17 nt, Vaccinia virus
gcaucugguacaauaaa

SEQ ID NO: 3263212 - RNA, 17 nt, Vaccinia virus
agaugcugcuccuggau

SEQ ID NO: 3263213 - RNA, 17 nt, Vaccinia virus
gaccaagacacauaugg

SEQ ID NO: 3263214 - RNA, 15 nt, Vaccinia virus
aacuaagucuagaau

SEQ ID NO: 3263215 - RNA, 21 nt, Vaccinia virus
uugauguaguacuuugaugau

SEQ ID NO: 3263216 - RNA, 12 nt, Vaccinia virus
auguaaaugaua

SEQ ID NO: 3263217 - RNA, 14 nt, Vaccinia virus
auaauaacaucgau

SEQ ID NO: 3263218 - RNA, 16 nt, Vaccinia virus
guauacacaaaaagaa

SEQ ID NO: 3263219 - RNA, 18 nt, Vaccinia virus
aacguuuuaaaaaaagau

SEQ ID NO: 3263220 - RNA, 13 nt, Vaccinia virus
auaguaucaaacu

SEQ ID NO: 3263221 - RNA, 12 nt, Vaccinia virus
aaacuauacgaa

SEQ ID NO: 3263222 - RNA, 19 nt, Vaccinia virus
augauauacagucuuaaau

SEQ ID NO: 3263223 - RNA, 17 nt, Vaccinia virus
aucauccauuaauauaa

SEQ ID NO: 3263224 - RNA, 17 nt, Vaccinia virus
aacaaccaaaaaaauau

SEQ ID NO: 3263225 - RNA, 20 nt, Vaccinia virus
uauacaaugaacuaauauga

SEQ ID NO: 3263226 - RNA, 13 nt, Vaccinia virus
uacaguucuuggc

SEQ ID NO: 3263227 - RNA, 16 nt, Vaccinia virus
uaucuuguacguauau

SEQ ID NO: 3263228 - RNA, 16 nt, Vaccinia virus
acaagucauuacuaau

SEQ ID NO: 3263229 - RNA, 15 nt, Vaccinia virus
aaaacacaaauaugg

SEQ ID NO: 3263230 - RNA, 22 nt, Vaccinia virus
aggaaauuaugagaaugagauu

SEQ ID NO: 3263231 - RNA, 19 nt, Vaccinia virus
gccuccacuagaagagaau

SEQ ID NO: 3263232 - RNA, 18 nt, Vaccinia virus
aacaauagucuuguaaag

SEQ ID NO: 3263233 - RNA, 22 nt, Vaccinia virus
auucgucuuucugaaugucgaa

SEQ ID NO: 3263234 - RNA, 22 nt, Vaccinia virus
uaugauauaauucguggauaau

SEQ ID NO: 3263235 - RNA, 14 nt, Vaccinia virus
cgaaagauguuauu

SEQ ID NO: 3263236 - RNA, 16 nt, Vaccinia virus
gucaugaacauuaaac

SEQ ID NO: 3263237 - RNA, 22 nt, Vaccinia virus
cucgauaacacauuuucaucua

SEQ ID NO: 3263238 - RNA, 15 nt, Vaccinia virus
ucugauaaucucuaa

SEQ ID NO: 3263239 - RNA, 18 nt, Vaccinia virus
agauuuucaauuauguau

SEQ ID NO: 3263240 - RNA, 15 nt, Vaccinia virus
acaauauggaaaaac

SEQ ID NO: 3263241 - RNA, 17 nt, Vaccinia virus
cuaugucucuuauuaga

SEQ ID NO: 3263242 - RNA, 18 nt, Vaccinia virus
agaaaaggauguauuauu

SEQ ID NO: 3263243 - RNA, 12 nt, Vaccinia virus
uuacaugugauc

SEQ ID NO: 3263244 - RNA, 19 nt, Vaccinia virus
ugaauuuauaucuaagaua

SEQ ID NO: 3263245 - RNA, 23 nt, Vaccinia virus
auucugauuggucaaugugaaug

SEQ ID NO: 3263246 - RNA, 16 nt, Vaccinia virus
uuagugaaaucuuuaa

SEQ ID NO: 3263247 - RNA, 19 nt, Vaccinia virus
acuccaugauaaauuauuu

SEQ ID NO: 3263248 - RNA, 22 nt, Vaccinia virus
agaaaucauauaugauauuccu

SEQ ID NO: 3263249 - RNA, 17 nt, Vaccinia virus
ucauuaaaaaaauuaac

SEQ ID NO: 3263250 - RNA, 14 nt, Vaccinia virus
gugaucaucuucau

SEQ ID NO: 3263251 - RNA, 19 nt, Vaccinia virus
ugaaucauauauguauuca

SEQ ID NO: 3263252 - RNA, 13 nt, Vaccinia virus
ucugcucuuaaac

SEQ ID NO: 3263253 - RNA, 23 nt, Vaccinia virus
uucuaugaaaggagagaauguau

SEQ ID NO: 3263254 - RNA, 22 nt, Vaccinia virus
aaacugauuuuagcagaauaua

SEQ ID NO: 3263255 - RNA, 15 nt, Vaccinia virus
cgauuaaacuuuaau

SEQ ID NO: 3263256 - RNA, 21 nt, Vaccinia virus
gacuucuggcgguugccauag

SEQ ID NO: 3263257 - RNA, 14 nt, Vaccinia virus
gcuugauauuaaag

SEQ ID NO: 3263258 - RNA, 23 nt, Vaccinia virus
acauauggaauauaucuauaauu

SEQ ID NO: 3263259 - RNA, 15 nt, Vaccinia virus
uguccuuuacaucau

SEQ ID NO: 3263260 - RNA, 21 nt, Vaccinia virus
acaauagauggauaauggaag

SEQ ID NO: 3263261 - RNA, 13 nt, Vaccinia virus
aaaauuauaacua

SEQ ID NO: 3263262 - RNA, 14 nt, Vaccinia virus
ggauggacacauuc

SEQ ID NO: 3263263 - RNA, 20 nt, Vaccinia virus
aaucaccaaauuuuacaaaa

SEQ ID NO: 3263264 - RNA, 15 nt, Vaccinia virus
uguuuaacuuuuguu

SEQ ID NO: 3263265 - RNA, 14 nt, Vaccinia virus
aucauaaguuuaua

SEQ ID NO: 3263266 - RNA, 19 nt, Vaccinia virus
aucagaccguacauacaua

SEQ ID NO: 3263267 - RNA, 17 nt, Vaccinia virus
uuauucauauucuuaaa

SEQ ID NO: 3263268 - RNA, 21 nt, Vaccinia virus
uguuuaucuauacuauuaaaa

SEQ ID NO: 3263269 - RNA, 20 nt, Vaccinia virus
auaaacaugucuauuguuaa

SEQ ID NO: 3263270 - RNA, 23 nt, Vaccinia virus
ccauauuuuguuauuauauuaau

SEQ ID NO: 3263271 - RNA, 17 nt, Vaccinia virus
aaaaauccuuaaugaua

SEQ ID NO: 3263272 - RNA, 19 nt, Vaccinia virus
cguuuuaaauuuuguauuc

SEQ ID NO: 3263273 - RNA, 13 nt, Vaccinia virus
aguaaucaacaau

SEQ ID NO: 3263274 - RNA, 19 nt, Vaccinia virus
auuaucaugagauguguau

SEQ ID NO: 3263275 - RNA, 16 nt, Vaccinia virus
acuuaaugaaaaaugu

SEQ ID NO: 3263276 - RNA, 15 nt, Vaccinia virus
uaaauaaauaugugu

SEQ ID NO: 3263277 - RNA, 19 nt, Vaccinia virus
aauaguuacauacaaacug

SEQ ID NO: 3263278 - RNA, 15 nt, Vaccinia virus
ucucauuuucuuuaa

SEQ ID NO: 3263279 - RNA, 14 nt, Vaccinia virus
acaagucuaauaau

SEQ ID NO: 3263280 - RNA, 15 nt, Vaccinia virus
aauacuuaaaaugua

SEQ ID NO: 3263281 - RNA, 16 nt, Vaccinia virus
uccggagaucuaaaga

SEQ ID NO: 3263282 - RNA, 15 nt, Vaccinia virus
accugauuagaauuc

SEQ ID NO: 3263283 - RNA, 17 nt, Vaccinia virus
agcaucaauaauuguuu

SEQ ID NO: 3263284 - RNA, 20 nt, Vaccinia virus
auacauuaucaaaaagaacg

SEQ ID NO: 3263285 - RNA, 20 nt, Vaccinia virus
gauaauacauuuucuuacaa

SEQ ID NO: 3263286 - RNA, 20 nt, Vaccinia virus
accgauaucacuucagaaau

SEQ ID NO: 3263287 - RNA, 15 nt, Vaccinia virus
cagaaauuauauacg

SEQ ID NO: 3263288 - RNA, 21 nt, Vaccinia virus
agaacagaauaaacaaaauaa

SEQ ID NO: 3263289 - RNA, 17 nt, Vaccinia virus
uuaaacauacaucuguu

SEQ ID NO: 3263290 - RNA, 14 nt, Vaccinia virus
uaauuaucuaaaua

SEQ ID NO: 3263291 - RNA, 16 nt, Vaccinia virus
uaagaugcaaacauua

SEQ ID NO: 3263292 - RNA, 15 nt, Vaccinia virus
uaauaguuuaucaua

SEQ ID NO: 3263293 - RNA, 22 nt, Vaccinia virus
uauucugacgucguucuacaua

SEQ ID NO: 3263294 - RNA, 21 nt, Vaccinia virus
ucuauuacaccaccuccuaua

SEQ ID NO: 3263295 - RNA, 18 nt, Vaccinia virus
aucaaccgcauaauacaa

SEQ ID NO: 3263296 - RNA, 14 nt, Vaccinia virus
aauaaucuucauua

SEQ ID NO: 3263297 - RNA, 19 nt, Vaccinia virus
uaaucuacaaaacaaucau

SEQ ID NO: 3263298 - RNA, 24 nt, Vaccinia virus
ucauauugaacgguaucuucuuaa

SEQ ID NO: 3263299 - RNA, 18 nt, Vaccinia virus
aggagauuuagaaauguu

SEQ ID NO: 3263300 - RNA, 17 nt, Vaccinia virus
ugauauuggauauauca

SEQ ID NO: 3263301 - RNA, 13 nt, Vaccinia virus
augaacaaagaaa

SEQ ID NO: 3263302 - RNA, 20 nt, Vaccinia virus
ucuaaauagaauucucuuca

SEQ ID NO: 3263303 - RNA, 16 nt, Vaccinia virus
auucuaucguaucugu

SEQ ID NO: 3263304 - RNA, 16 nt, Vaccinia virus
gcuagaauuagaaaag

SEQ ID NO: 3263305 - RNA, 20 nt, Vaccinia virus
agacaccuuuucaauguuua

SEQ ID NO: 3263306 - RNA, 14 nt, Vaccinia virus
gucaagaugaugaa

SEQ ID NO: 3263307 - RNA, 15 nt, Vaccinia virus
uuuaugcuucguaaa

SEQ ID NO: 3263308 - RNA, 12 nt, Vaccinia virus
ucuuacaauguu

SEQ ID NO: 3263309 - RNA, 16 nt, Vaccinia virus
aucaaacaacugaaaa

SEQ ID NO: 3263310 - RNA, 18 nt, Vaccinia virus
auuuaauuggacagauau

SEQ ID NO: 3263311 - RNA, 20 nt, Vaccinia virus
gaaauguuuuucgauuacaa

SEQ ID NO: 3263312 - RNA, 17 nt, Vaccinia virus
cuauucuaucuccagua

SEQ ID NO: 3263313 - RNA, 19 nt, Vaccinia virus
guaacauccucaugauuua

SEQ ID NO: 3263314 - RNA, 14 nt, Vaccinia virus
agaaaagagaaauu

SEQ ID NO: 3263315 - RNA, 14 nt, Vaccinia virus
aauauaaaaauaua

SEQ ID NO: 3263316 - RNA, 14 nt, Vaccinia virus
aaagauagaaauga

SEQ ID NO: 3263317 - RNA, 15 nt, Vaccinia virus
agcuaauaccaauuu

SEQ ID NO: 3263318 - RNA, 23 nt, Vaccinia virus
uguuaaaugaucggaucuaaaau

SEQ ID NO: 3263319 - RNA, 20 nt, Vaccinia virus
aguuagcaauuucaaaauag

SEQ ID NO: 3263320 - RNA, 22 nt, Vaccinia virus
uuuaagagaucaaagcaucaaa

SEQ ID NO: 3263321 - RNA, 15 nt, Vaccinia virus
auaaauaucauauau

SEQ ID NO: 3263322 - RNA, 11 nt, Vaccinia virus
guuaucuuuug

SEQ ID NO: 3263323 - RNA, 15 nt, Vaccinia virus
acaaaaaagaacuaa

SEQ ID NO: 3263324 - RNA, 16 nt, Vaccinia virus
auacugucaacuauag

SEQ ID NO: 3263325 - RNA, 21 nt, Vaccinia virus
agacauuguugaauucuguga

SEQ ID NO: 3263326 - RNA, 16 nt, Vaccinia virus
uuuguauaacgucuuu

SEQ ID NO: 3263327 - RNA, 16 nt, Vaccinia virus
aauuuuaagaaauggu

SEQ ID NO: 3263328 - RNA, 19 nt, Vaccinia virus
agaaucaauugagaugucu

SEQ ID NO: 3263329 - RNA, 15 nt, Vaccinia virus
cugacuuauuuccua

SEQ ID NO: 3263330 - RNA, 15 nt, Vaccinia virus
cugaauuauuucaua

SEQ ID NO: 3263331 - RNA, 14 nt, Vaccinia virus
uaucuaccagagau

SEQ ID NO: 3263332 - RNA, 20 nt, Vaccinia virus
auuaaagauuguuuaagaag

SEQ ID NO: 3263333 - RNA, 18 nt, Vaccinia virus
aaucaacagaaguuaaua

SEQ ID NO: 3263334 - RNA, 22 nt, Vaccinia virus
accucagacugguagagaauga

SEQ ID NO: 3263335 - RNA, 15 nt, Vaccinia virus
aggaauuaauuauuc

SEQ ID NO: 3263336 - RNA, 15 nt, Vaccinia virus
gaaagcgugauuuua

SEQ ID NO: 3263337 - RNA, 22 nt, Vaccinia virus
cguagaaaguaucuuauauaca

SEQ ID NO: 3263338 - RNA, 15 nt, Vaccinia virus
acuacaauauuucau

SEQ ID NO: 3263339 - RNA, 20 nt, Vaccinia virus
caaauggucaaugauaugau

SEQ ID NO: 3263340 - RNA, 20 nt, Vaccinia virus
auuuuuaguuacagaaguga

SEQ ID NO: 3263341 - RNA, 18 nt, Vaccinia virus
ucuaucuuuaguaguguu

SEQ ID NO: 3263342 - RNA, 15 nt, Vaccinia virus
auucugguuuaaaaa

SEQ ID NO: 3263343 - RNA, 11 nt, Vaccinia virus
ugaaucucugu

SEQ ID NO: 3263344 - RNA, 19 nt, Vaccinia virus
uaauagcguuaacuaucaa

SEQ ID NO: 3263345 - RNA, 24 nt, Vaccinia virus
gacaggcagaacacgucaugcaau

SEQ ID NO: 3263346 - RNA, 21 nt, Vaccinia virus
gaaauauuauacaugcugaca

SEQ ID NO: 3263347 - RNA, 13 nt, Vaccinia virus
uucugaauuauuu

SEQ ID NO: 3263348 - RNA, 18 nt, Vaccinia virus
caucuauagaaacauauu

SEQ ID NO: 3263349 - RNA, 18 nt, Vaccinia virus
cuagcauccccuuucaau

SEQ ID NO: 3263350 - RNA, 16 nt, Vaccinia virus
uguaccggacacuaua

SEQ ID NO: 3263351 - RNA, 16 nt, Vaccinia virus
accguuguuaaauacu

SEQ ID NO: 3263352 - RNA, 15 nt, Vaccinia virus
gcggacuuuaaacag

SEQ ID NO: 3263353 - RNA, 23 nt, Vaccinia virus
uauaaaaacauuuuauuucuaga

SEQ ID NO: 3263354 - RNA, 21 nt, Vaccinia virus
acaauacugcgacuuuguuaa

SEQ ID NO: 3263355 - RNA, 15 nt, Vaccinia virus
gaaagauuaaaucau

SEQ ID NO: 3263356 - RNA, 23 nt, Vaccinia virus
auccuguaauauuuuuaguuuuu

SEQ ID NO: 3263357 - RNA, 22 nt, Vaccinia virus
uaauaucagaggaguuauuuac

SEQ ID NO: 3263358 - RNA, 17 nt, Vaccinia virus
auuuuaucuuuuagagg

SEQ ID NO: 3263359 - RNA, 15 nt, Vaccinia virus
aaucguauaaauacg

SEQ ID NO: 3263360 - RNA, 21 nt, Vaccinia virus
caucauacgaaaauagauucu

SEQ ID NO: 3263361 - RNA, 17 nt, Vaccinia virus
gaugagaacagaagcgu

SEQ ID NO: 3263362 - RNA, 22 nt, Vaccinia virus
auaauaucggucuuauucuuaa

SEQ ID NO: 3263363 - RNA, 21 nt, Vaccinia virus
uaguaauuauaaaaccaagga

SEQ ID NO: 3263364 - RNA, 18 nt, Vaccinia virus
caguuucuagugacaaaa

SEQ ID NO: 3263365 - RNA, 16 nt, Vaccinia virus
cugguaacaugauauc

SEQ ID NO: 3263366 - RNA, 11 nt, Vaccinia virus
uagagauuuca

SEQ ID NO: 3263367 - RNA, 16 nt, Vaccinia virus
aaguuucucaugauaa

SEQ ID NO: 3263368 - RNA, 14 nt, Vaccinia virus
acaaaaauacauaa

SEQ ID NO: 3263369 - RNA, 20 nt, Vaccinia virus
auaaauuaggagauaaucua

SEQ ID NO: 3263370 - RNA, 23 nt, Vaccinia virus
aguuaaaauuuuaagauuuuaaa

SEQ ID NO: 3263371 - RNA, 15 nt, Vaccinia virus
auggaagaaacagaa

SEQ ID NO: 3263372 - RNA, 22 nt, Vaccinia virus
cuggucuaaaauuuccaucucu

SEQ ID NO: 3263373 - RNA, 23 nt, Vaccinia virus
guuucccaaugaaaugguacaau

SEQ ID NO: 3263374 - RNA, 17 nt, Vaccinia virus
aacuguaauuugauucu

SEQ ID NO: 3263375 - RNA, 20 nt, Vaccinia virus
agauccugcauagaaauauc

SEQ ID NO: 3263376 - RNA, 18 nt, Vaccinia virus
aguauaugauaauauuaa

SEQ ID NO: 3263377 - RNA, 12 nt, Vaccinia virus
guucugauuuua

SEQ ID NO: 3263378 - RNA, 20 nt, Vaccinia virus
ucauuuauaaucuauuagaa

SEQ ID NO: 3263379 - RNA, 14 nt, Vaccinia virus
gaaauguuaaaacu

SEQ ID NO: 3263380 - RNA, 14 nt, Vaccinia virus
aaaaacaugucucu

SEQ ID NO: 3263381 - RNA, 20 nt, Vaccinia virus
aauauucacaagaugaauuc

SEQ ID NO: 3263382 - RNA, 21 nt, Vaccinia virus
ugauacguacaaugauaauga

SEQ ID NO: 3263383 - RNA, 22 nt, Vaccinia virus
ggaccacauccuucuucaucaa

SEQ ID NO: 3263384 - RNA, 15 nt, Vaccinia virus
accaaauuaucauca

SEQ ID NO: 3263385 - RNA, 12 nt, Vaccinia virus
uguauuaaauag

SEQ ID NO: 3263386 - RNA, 17 nt, Vaccinia virus
aauucauuaauauguac

SEQ ID NO: 3263387 - RNA, 18 nt, Vaccinia virus
gauauuagaacugcuaau

SEQ ID NO: 3263388 - RNA, 18 nt, Vaccinia virus
cgaaauaaauaaugaauu

SEQ ID NO: 3263389 - RNA, 19 nt, Vaccinia virus
acuuuaaccuauacaugau

SEQ ID NO: 3263390 - RNA, 14 nt, Vaccinia virus
caauuuuuuguucu

SEQ ID NO: 3263391 - RNA, 17 nt, Vaccinia virus
guacaaaaaagaacuaa

SEQ ID NO: 3263392 - RNA, 10 nt, Vaccinia virus
ugguaaaaua

SEQ ID NO: 3263393 - RNA, 12 nt, Vaccinia virus
aaaguuaaaagu

SEQ ID NO: 3263394 - RNA, 19 nt, Vaccinia virus
auuuugcauuagauuuacu

SEQ ID NO: 3263395 - RNA, 14 nt, Vaccinia virus
uuuauuuuauucua

SEQ ID NO: 3263396 - RNA, 21 nt, Vaccinia virus
ugaaacuaugucaaaaauugu

SEQ ID NO: 3263397 - RNA, 17 nt, Vaccinia virus
agagacgggaaaauagu

SEQ ID NO: 3263398 - RNA, 13 nt, Vaccinia virus
uaugauucuaaua

SEQ ID NO: 3263399 - RNA, 15 nt, Vaccinia virus
uacauauucuaauga

SEQ ID NO: 3263400 - RNA, 18 nt, Vaccinia virus
ucaacauguuuaauauau

SEQ ID NO: 3263401 - RNA, 15 nt, Vaccinia virus
uuuggcuaaacuaua

SEQ ID NO: 3263402 - RNA, 15 nt, Vaccinia virus
aguuuggauuaauaa

SEQ ID NO: 3263403 - RNA, 21 nt, Vaccinia virus
ucaauagaauaugucucuuaa

SEQ ID NO: 3263404 - RNA, 17 nt, Vaccinia virus
uaucauagaguaucuua

SEQ ID NO: 3263405 - RNA, 14 nt, Vaccinia virus
aauauaucuuauau

SEQ ID NO: 3263406 - RNA, 12 nt, Vaccinia virus
guacauacuaga

SEQ ID NO: 3263407 - RNA, 18 nt, Vaccinia virus
auauuaucaccuauugcc

SEQ ID NO: 3263408 - RNA, 15 nt, Vaccinia virus
aaguuuguaggaaag

SEQ ID NO: 3263409 - RNA, 16 nt, Vaccinia virus
aucugggaauaaaaua

SEQ ID NO: 3263410 - RNA, 17 nt, Vaccinia virus
uagauuuauaauacuuu

SEQ ID NO: 3263411 - RNA, 15 nt, Vaccinia virus
uaucugugaauacuu

SEQ ID NO: 3263412 - RNA, 19 nt, Vaccinia virus
gaguuagauauuaauaaca

SEQ ID NO: 3263413 - RNA, 14 nt, Vaccinia virus
caguaacauauauu

SEQ ID NO: 3263414 - RNA, 16 nt, Vaccinia virus
uagugaugguuuucua

SEQ ID NO: 3263415 - RNA, 17 nt, Vaccinia virus
auccgauacuuguaaga

SEQ ID NO: 3263416 - RNA, 20 nt, Vaccinia virus
aaucuucaguuuuugauauc

SEQ ID NO: 3263417 - RNA, 20 nt, Vaccinia virus
ugcacgacuacuuuguuaau

SEQ ID NO: 3263418 - RNA, 21 nt, Vaccinia virus
aguacuuugaugauuuuucca

SEQ ID NO: 3263419 - RNA, 18 nt, Vaccinia virus
auuauuaaucauuaacuu

SEQ ID NO: 3263420 - RNA, 17 nt, Vaccinia virus
uuuagacgguugagaaa

SEQ ID NO: 3263421 - RNA, 20 nt, Vaccinia virus
cguuagccaccacuucucua

SEQ ID NO: 3263422 - RNA, 18 nt, Vaccinia virus
auucgacucaacauaaau

SEQ ID NO: 3263423 - RNA, 23 nt, Vaccinia virus
aucuauuagaagcugacaaaauu

SEQ ID NO: 3263424 - RNA, 17 nt, Vaccinia virus
aagcguguuauauauac

SEQ ID NO: 3263425 - RNA, 12 nt, Vaccinia virus
gagaauguuucc

SEQ ID NO: 3263426 - RNA, 19 nt, Vaccinia virus
auugguuuaugauguauaa

SEQ ID NO: 3263427 - RNA, 18 nt, Vaccinia virus
uuauacgguucugucauu

SEQ ID NO: 3263428 - RNA, 19 nt, Vaccinia virus
aauauucauuaauucuaua

SEQ ID NO: 3263429 - RNA, 13 nt, Vaccinia virus
auauaaaaaauuu

SEQ ID NO: 3263430 - RNA, 13 nt, Vaccinia virus
aauuuaaaauaua

SEQ ID NO: 3263431 - RNA, 21 nt, Vaccinia virus
cgagaauguugggauccagag

SEQ ID NO: 3263432 - RNA, 22 nt, Vaccinia virus
uauauugagaguguauccuuga

SEQ ID NO: 3263433 - RNA, 23 nt, Vaccinia virus
uuaaacagaaauauaugagaugu

SEQ ID NO: 3263434 - RNA, 14 nt, Vaccinia virus
auuucuuaauguaa

SEQ ID NO: 3263435 - RNA, 23 nt, Vaccinia virus
ggaguacccacugaugagauguu

SEQ ID NO: 3263436 - RNA, 23 nt, Vaccinia virus
cuguauuaaagauauuguuacac

SEQ ID NO: 3263437 - RNA, 15 nt, Vaccinia virus
auaagaugcaaacau

SEQ ID NO: 3263438 - RNA, 18 nt, Vaccinia virus
uauuauccaauuauuaua

SEQ ID NO: 3263439 - RNA, 22 nt, Vaccinia virus
aagaagaaauacuaaaaaaugu

SEQ ID NO: 3263440 - RNA, 23 nt, Vaccinia virus
augccuauaaaguaauaaucuuc

SEQ ID NO: 3263441 - RNA, 19 nt, Vaccinia virus
ucuuauuggucagaaauau

SEQ ID NO: 3263442 - RNA, 19 nt, Vaccinia virus
uagacacgacuaaacauuu

SEQ ID NO: 3263443 - RNA, 18 nt, Vaccinia virus
acgucauaaaaauguuua

SEQ ID NO: 3263444 - RNA, 20 nt, Vaccinia virus
ugaugaaguucgaugauguc

SEQ ID NO: 3263445 - RNA, 21 nt, Vaccinia virus
auaauccuaucuaagauguug

SEQ ID NO: 3263446 - RNA, 15 nt, Vaccinia virus
aacacucuuucugaa

SEQ ID NO: 3263447 - RNA, 19 nt, Vaccinia virus
uauguaccgcguuaucauc

SEQ ID NO: 3263448 - RNA, 13 nt, Vaccinia virus
agaucuaaauaca

SEQ ID NO: 3263449 - RNA, 16 nt, Vaccinia virus
ugaauggauacuaguu

SEQ ID NO: 3263450 - RNA, 18 nt, Vaccinia virus
uucugucgauauagcuuu

SEQ ID NO: 3263451 - RNA, 16 nt, Vaccinia virus
uaauccagucuuuaau

SEQ ID NO: 3263452 - RNA, 18 nt, Vaccinia virus
uuauguaaaacaaacuug

SEQ ID NO: 3263453 - RNA, 16 nt, Vaccinia virus
aauguagauaaucauu

SEQ ID NO: 3263454 - RNA, 20 nt, Vaccinia virus
uaauucuuuauaacugaacu

SEQ ID NO: 3263455 - RNA, 13 nt, Vaccinia virus
uaacacauauuca

SEQ ID NO: 3263456 - RNA, 15 nt, Vaccinia virus
ugguuuauauuacca

SEQ ID NO: 3263457 - RNA, 13 nt, Vaccinia virus
gaacuaauaugau

SEQ ID NO: 3263458 - RNA, 17 nt, Vaccinia virus
ugaauauaaaauaacua

SEQ ID NO: 3263459 - RNA, 23 nt, Vaccinia virus
acacuguucacauccuuccaaga

SEQ ID NO: 3263460 - RNA, 15 nt, Vaccinia virus
agacuguuuguagaa

SEQ ID NO: 3263461 - RNA, 16 nt, Vaccinia virus
uacauauuauacagua

SEQ ID NO: 3263462 - RNA, 17 nt, Vaccinia virus
uaacgguacucuagaau

SEQ ID NO: 3263463 - RNA, 18 nt, Vaccinia virus
caucaucgugacauaagu

SEQ ID NO: 3263464 - RNA, 17 nt, Vaccinia virus
ucgauugugauuguauu

SEQ ID NO: 3263465 - RNA, 18 nt, Vaccinia virus
caugggucauagaauuua

SEQ ID NO: 3263466 - RNA, 20 nt, Vaccinia virus
uaaucaaauuugguguuguu

SEQ ID NO: 3263467 - RNA, 21 nt, Vaccinia virus
aaauuuuacccgccuucgaau

SEQ ID NO: 3263468 - RNA, 17 nt, Vaccinia virus
uaaugacaauaauuaug

SEQ ID NO: 3263469 - RNA, 13 nt, Vaccinia virus
aaaauaaaguuau

SEQ ID NO: 3263470 - RNA, 13 nt, Vaccinia virus
caucaauauaaau

SEQ ID NO: 3263471 - RNA, 12 nt, Vaccinia virus
auaugacauaau

SEQ ID NO: 3263472 - RNA, 19 nt, Vaccinia virus
uuaaacuucgcaauauuca

SEQ ID NO: 3263473 - RNA, 20 nt, Vaccinia virus
auucgcaaacuauucuaaua

SEQ ID NO: 3263474 - RNA, 20 nt, Vaccinia virus
ucguauuuuuguuagaguau

SEQ ID NO: 3263475 - RNA, 14 nt, Vaccinia virus
aaucuaagaaauuu

SEQ ID NO: 3263476 - RNA, 16 nt, Vaccinia virus
auauaguucaaauuaa

SEQ ID NO: 3263477 - RNA, 22 nt, Vaccinia virus
uugguuguggaucuucuacaau

SEQ ID NO: 3263478 - RNA, 23 nt, Vaccinia virus
cuacaguaggcauaccauuagau

SEQ ID NO: 3263479 - RNA, 14 nt, Vaccinia virus
uaguuauuaaugau

SEQ ID NO: 3263480 - RNA, 19 nt, Vaccinia virus
aguaacacguuuuuuagau

SEQ ID NO: 3263481 - RNA, 21 nt, Vaccinia virus
auauuuguuccuguagauaau

SEQ ID NO: 3263482 - RNA, 19 nt, Vaccinia virus
aguaugaaguugaacuaau

SEQ ID NO: 3263483 - RNA, 13 nt, Vaccinia virus
auagaauaaauua

SEQ ID NO: 3263484 - RNA, 13 nt, Vaccinia virus
auaucuuauucca

SEQ ID NO: 3263485 - RNA, 14 nt, Vaccinia virus
uguacauuauuaca

SEQ ID NO: 3263486 - RNA, 15 nt, Vaccinia virus
gugagaagucuuuuu

SEQ ID NO: 3263487 - RNA, 17 nt, Vaccinia virus
uaacgaggauaaacuau

SEQ ID NO: 3263488 - RNA, 17 nt, Vaccinia virus
auuauccaucuaacaaa

SEQ ID NO: 3263489 - RNA, 16 nt, Vaccinia virus
augggucauagaauuu

SEQ ID NO: 3263490 - RNA, 23 nt, Vaccinia virus
guauucucagaguugacgaauau

SEQ ID NO: 3263491 - RNA, 19 nt, Vaccinia virus
auuaaauagaauauuuaac

SEQ ID NO: 3263492 - RNA, 18 nt, Vaccinia virus
aaugcuagaauuagaaaa

SEQ ID NO: 3263493 - RNA, 23 nt, Vaccinia virus
uuaguuucuauaucuacaucuau

SEQ ID NO: 3263494 - RNA, 22 nt, Vaccinia virus
guauauaucauuuguacauugu

SEQ ID NO: 3263495 - RNA, 13 nt, Vaccinia virus
gaaaaacacauuu

SEQ ID NO: 3263496 - RNA, 15 nt, Vaccinia virus
uagauuuuggauaau

SEQ ID NO: 3263497 - RNA, 22 nt, Vaccinia virus
uuauuucaaagacuaacuuaua

SEQ ID NO: 3263498 - RNA, 15 nt, Vaccinia virus
uguuacaacaucacg

SEQ ID NO: 3263499 - RNA, 16 nt, Vaccinia virus
uaguaaggcuuuagaa

SEQ ID NO: 3263500 - RNA, 21 nt, Vaccinia virus
cauuauaugggguuacucuaa

SEQ ID NO: 3263501 - RNA, 14 nt, Vaccinia virus
gaaugaauaugaau

SEQ ID NO: 3263502 - RNA, 22 nt, Vaccinia virus
aauucuuaguuauauauacucu

SEQ ID NO: 3263503 - RNA, 19 nt, Vaccinia virus
auuuaucgcuaacaugcau

SEQ ID NO: 3263504 - RNA, 16 nt, Vaccinia virus
ucgguucuuuaaaaga

SEQ ID NO: 3263505 - RNA, 18 nt, Vaccinia virus
gacucauuauuucccaaa

SEQ ID NO: 3263506 - RNA, 21 nt, Vaccinia virus
agaaauccaaauaaaauggau

SEQ ID NO: 3263507 - RNA, 14 nt, Vaccinia virus
cugauaagauaucu

SEQ ID NO: 3263508 - RNA, 22 nt, Vaccinia virus
guaaaauggccaagaaaauaga

SEQ ID NO: 3263509 - RNA, 19 nt, Vaccinia virus
auuacauccggcaaaaaua

SEQ ID NO: 3263510 - RNA, 21 nt, Vaccinia virus
auaucuuguuuagaaaaaugc

SEQ ID NO: 3263511 - RNA, 21 nt, Vaccinia virus
gaucauagaacagaccaaaua

SEQ ID NO: 3263512 - RNA, 19 nt, Vaccinia virus
augaacaaacgugggaaga

SEQ ID NO: 3263513 - RNA, 12 nt, Vaccinia virus
auuaaaaaagau

SEQ ID NO: 3263514 - RNA, 14 nt, Vaccinia virus
ucuccagaaaucug

SEQ ID NO: 3263515 - RNA, 16 nt, Vaccinia virus
auaccucuacacuauu

SEQ ID NO: 3263516 - RNA, 17 nt, Vaccinia virus
agucauagaaaaauaua

SEQ ID NO: 3263517 - RNA, 22 nt, Vaccinia virus
cuuuaacgcccuuguauguuuu

SEQ ID NO: 3263518 - RNA, 15 nt, Vaccinia virus
aaugcaaucaaugau

SEQ ID NO: 3263519 - RNA, 20 nt, Vaccinia virus
auugauuauuucaaagacua

SEQ ID NO: 3263520 - RNA, 23 nt, Vaccinia virus
uguauaugauguuucuguuuuca

SEQ ID NO: 3263521 - RNA, 12 nt, Vaccinia virus
aacuuaaaauau

SEQ ID NO: 3263522 - RNA, 19 nt, Vaccinia virus
aucuauacugcagaauaga

SEQ ID NO: 3263523 - RNA, 24 nt, Vaccinia virus
uugucuuuaaguauauacgauaag

SEQ ID NO: 3263524 - RNA, 19 nt, Vaccinia virus
aauauacgucguucuuauc

SEQ ID NO: 3263525 - RNA, 13 nt, Vaccinia virus
agaauaaaguaau

SEQ ID NO: 3263526 - RNA, 17 nt, Vaccinia virus
cucagugaauccaucuc

SEQ ID NO: 3263527 - RNA, 19 nt, Vaccinia virus
uugcuauccauuauucuuu

SEQ ID NO: 3263528 - RNA, 17 nt, Vaccinia virus
uuaucguuuucaucuuu

SEQ ID NO: 3263529 - RNA, 13 nt, Vaccinia virus
uaauagaacucuu

SEQ ID NO: 3263530 - RNA, 22 nt, Vaccinia virus
guagauaagaaugugauaagau

SEQ ID NO: 3263531 - RNA, 18 nt, Vaccinia virus
uacaacuggucauagaaa

SEQ ID NO: 3263532 - RNA, 21 nt, Vaccinia virus
uauauagagccaagacgaaca

SEQ ID NO: 3263533 - RNA, 23 nt, Vaccinia virus
uauagauggaggggauuggcauu

SEQ ID NO: 3263534 - RNA, 16 nt, Vaccinia virus
aggucagaaaaaauuu

SEQ ID NO: 3263535 - RNA, 20 nt, Vaccinia virus
uauaaacaucuugauacuuu

SEQ ID NO: 3263536 - RNA, 12 nt, Vaccinia virus
augguauauaca

SEQ ID NO: 3263537 - RNA, 18 nt, Vaccinia virus
guuauauuauuagauauc

SEQ ID NO: 3263538 - RNA, 18 nt, Vaccinia virus
guugauaaaauguugaua

SEQ ID NO: 3263539 - RNA, 18 nt, Vaccinia virus
agauggcguauuuaagag

SEQ ID NO: 3263540 - RNA, 13 nt, Vaccinia virus
aauuuuagauaau

SEQ ID NO: 3263541 - RNA, 13 nt, Vaccinia virus
auauauagaauua

SEQ ID NO: 3263542 - RNA, 15 nt, Vaccinia virus
uaaugauagaauuau

SEQ ID NO: 3263543 - RNA, 13 nt, Vaccinia virus
uaaaguuaucaug

SEQ ID NO: 3263544 - RNA, 17 nt, Vaccinia virus
uccauauuuuagaauau

SEQ ID NO: 3263545 - RNA, 21 nt, Vaccinia virus
uauuaucaggaacauuaucaa

SEQ ID NO: 3263546 - RNA, 18 nt, Vaccinia virus
gauagauuuaucuuuccu

SEQ ID NO: 3263547 - RNA, 15 nt, Vaccinia virus
auaacauugauguau

SEQ ID NO: 3263548 - RNA, 19 nt, Vaccinia virus
uuauuuagauacagaugua

SEQ ID NO: 3263549 - RNA, 23 nt, Vaccinia virus
gcuuaaaggaagaauaucauauu

SEQ ID NO: 3263550 - RNA, 17 nt, Vaccinia virus
gucgcacuauagaugca

SEQ ID NO: 3263551 - RNA, 19 nt, Vaccinia virus
acaacuuuuaaauacaaau

SEQ ID NO: 3263552 - RNA, 23 nt, Vaccinia virus
ucuagcuuauugaguggaaaguu

SEQ ID NO: 3263553 - RNA, 20 nt, Vaccinia virus
aucuuauucugguuuaaaaa

SEQ ID NO: 3263554 - RNA, 13 nt, Vaccinia virus
uuucuguaaugau

SEQ ID NO: 3263555 - RNA, 15 nt, Vaccinia virus
guuauaguagauauc

SEQ ID NO: 3263556 - RNA, 21 nt, Vaccinia virus
auuauucuuugauucgaauuu

SEQ ID NO: 3263557 - RNA, 19 nt, Vaccinia virus
agacacgaauaugacuaga

SEQ ID NO: 3263558 - RNA, 17 nt, Vaccinia virus
auucuguaaaaaaauua

SEQ ID NO: 3263559 - RNA, 15 nt, Vaccinia virus
agccugaaaaagaua

SEQ ID NO: 3263560 - RNA, 12 nt, Vaccinia virus
uaucacauauca

SEQ ID NO: 3263561 - RNA, 22 nt, Vaccinia virus
agacaaaacuauuccaauguuu

SEQ ID NO: 3263562 - RNA, 14 nt, Vaccinia virus
aauccaaucuaaga

SEQ ID NO: 3263563 - RNA, 17 nt, Vaccinia virus
cuaccguuguuaaauac

SEQ ID NO: 3263564 - RNA, 21 nt, Vaccinia virus
cgaaugccauagaauaaauau

SEQ ID NO: 3263565 - RNA, 17 nt, Vaccinia virus
auggagucauuucugau

SEQ ID NO: 3263566 - RNA, 16 nt, Vaccinia virus
gaaccaauuacugaua

SEQ ID NO: 3263567 - RNA, 19 nt, Vaccinia virus
aggaucuagcaaaggaaau

SEQ ID NO: 3263568 - RNA, 12 nt, Vaccinia virus
aauaaauaugug

SEQ ID NO: 3263569 - RNA, 15 nt, Vaccinia virus
ucuacgaagaaaguu

SEQ ID NO: 3263570 - RNA, 17 nt, Vaccinia virus
ccaacucauuuaaauau

SEQ ID NO: 3263571 - RNA, 15 nt, Vaccinia virus
uuagucagauuauua

SEQ ID NO: 3263572 - RNA, 18 nt, Vaccinia virus
uaacauguuacagaauau

SEQ ID NO: 3263573 - RNA, 21 nt, Vaccinia virus
gagcuaaacacauuagauauu

SEQ ID NO: 3263574 - RNA, 23 nt, Vaccinia virus
uagacauaccggaucuacguucu

SEQ ID NO: 3263575 - RNA, 22 nt, Vaccinia virus
cuauaaacgaugguuuaauuug

SEQ ID NO: 3263576 - RNA, 15 nt, Vaccinia virus
ucaaauuagauuucg

SEQ ID NO: 3263577 - RNA, 13 nt, Vaccinia virus
guuacaaauguag

SEQ ID NO: 3263578 - RNA, 20 nt, Vaccinia virus
uugcuuugguuuaauuauuu

SEQ ID NO: 3263579 - RNA, 17 nt, Vaccinia virus
guuuauggaucuauuca

SEQ ID NO: 3263580 - RNA, 17 nt, Vaccinia virus
gaauauaaauuauauau

SEQ ID NO: 3263581 - RNA, 14 nt, Vaccinia virus
acuaauaauaauua

SEQ ID NO: 3263582 - RNA, 13 nt, Vaccinia virus
uuguacauuauua

SEQ ID NO: 3263583 - RNA, 14 nt, Vaccinia virus
aucgauacgcauuu

SEQ ID NO: 3263584 - RNA, 15 nt, Vaccinia virus
agauggauaaaacuu

SEQ ID NO: 3263585 - RNA, 23 nt, Vaccinia virus
auucucuuacaaauauucacaag

SEQ ID NO: 3263586 - RNA, 16 nt, Vaccinia virus
auguuuccgagaaaua

SEQ ID NO: 3263587 - RNA, 11 nt, Vaccinia virus
ucacaauaaaa

SEQ ID NO: 3263588 - RNA, 17 nt, Vaccinia virus
aguuuuaaaaauacuua

SEQ ID NO: 3263589 - RNA, 19 nt, Vaccinia virus
agucauggcgacuaaauua

SEQ ID NO: 3263590 - RNA, 19 nt, Vaccinia virus
uguaauggaugucaugaac

SEQ ID NO: 3263591 - RNA, 12 nt, Vaccinia virus
cacuaucuucug

SEQ ID NO: 3263592 - RNA, 20 nt, Vaccinia virus
caaaaccaacacuuaucaau

SEQ ID NO: 3263593 - RNA, 19 nt, Vaccinia virus
cuuuucaauguuuaauuuu

SEQ ID NO: 3263594 - RNA, 23 nt, Vaccinia virus
auagagguguuuuauuauguuua

SEQ ID NO: 3263595 - RNA, 17 nt, Vaccinia virus
ucguauguagaaauuuu

SEQ ID NO: 3263596 - RNA, 18 nt, Vaccinia virus
guuuaaagauuucuuuuu

SEQ ID NO: 3263597 - RNA, 12 nt, Vaccinia virus
ucucaauacuaa

SEQ ID NO: 3263598 - RNA, 18 nt, Vaccinia virus
augcuauaccuaauacua

SEQ ID NO: 3263599 - RNA, 22 nt, Vaccinia virus
gccauuuguagucuuucaacau

SEQ ID NO: 3263600 - RNA, 17 nt, Vaccinia virus
uaauucuucuacugcau

SEQ ID NO: 3263601 - RNA, 23 nt, Vaccinia virus
aaggaugcaaacuuacagaaaca

SEQ ID NO: 3263602 - RNA, 15 nt, Vaccinia virus
ucaguaucuucagac

SEQ ID NO: 3263603 - RNA, 16 nt, Vaccinia virus
auacucuauucgaaaa

SEQ ID NO: 3263604 - RNA, 14 nt, Vaccinia virus
ucuugcuacaaaau

SEQ ID NO: 3263605 - RNA, 15 nt, Vaccinia virus
uaauuaaucuaaaau

SEQ ID NO: 3263606 - RNA, 14 nt, Vaccinia virus
uccauaaacugaua

SEQ ID NO: 3263607 - RNA, 16 nt, Vaccinia virus
uucccauguacgacga

SEQ ID NO: 3263608 - RNA, 19 nt, Vaccinia virus
gcuguuccucuguaaauaa

SEQ ID NO: 3263609 - RNA, 17 nt, Vaccinia virus
agaauauccucuagaga

SEQ ID NO: 3263610 - RNA, 12 nt, Vaccinia virus
aucauguagaaa

SEQ ID NO: 3263611 - RNA, 13 nt, Vaccinia virus
aacagaaaaaaca

SEQ ID NO: 3263612 - RNA, 16 nt, Vaccinia virus
auaaaaauaacaauua

SEQ ID NO: 3263613 - RNA, 22 nt, Vaccinia virus
agaugauuuggcuauuaaacag

SEQ ID NO: 3263614 - RNA, 17 nt, Vaccinia virus
aucucuuuuuuaacuaa

SEQ ID NO: 3263615 - RNA, 17 nt, Vaccinia virus
auucuauggaugaugcu

SEQ ID NO: 3263616 - RNA, 21 nt, Vaccinia virus
aagacgaggagauuuagaaau

SEQ ID NO: 3263617 - RNA, 19 nt, Vaccinia virus
aaagcugggggauguucug

SEQ ID NO: 3263618 - RNA, 16 nt, Vaccinia virus
aguauguuugacuuua

SEQ ID NO: 3263619 - RNA, 14 nt, Vaccinia virus
cucaucuuucccaa

SEQ ID NO: 3263620 - RNA, 22 nt, Vaccinia virus
cauuuauuggagacguaacaau

SEQ ID NO: 3263621 - RNA, 15 nt, Vaccinia virus
cguuuaaacagaauu

SEQ ID NO: 3263622 - RNA, 17 nt, Vaccinia virus
aaggacaguuaaaacua

SEQ ID NO: 3263623 - RNA, 13 nt, Vaccinia virus
uaauauaauauua

SEQ ID NO: 3263624 - RNA, 22 nt, Vaccinia virus
auacguacugucuauaaugaca

SEQ ID NO: 3263625 - RNA, 22 nt, Vaccinia virus
aauaaauggagaauaauuggaa

SEQ ID NO: 3263626 - RNA, 23 nt, Vaccinia virus
aaguuagaagagucauuaaaaua

SEQ ID NO: 3263627 - RNA, 19 nt, Vaccinia virus
auaaaggaauaaaauauga

SEQ ID NO: 3263628 - RNA, 23 nt, Vaccinia virus
uauuacaaaauauuuugagacuc

SEQ ID NO: 3263629 - RNA, 22 nt, Vaccinia virus
aaccucacuguuaaaaauaugu

SEQ ID NO: 3263630 - RNA, 21 nt, Vaccinia virus
agaauuuaccagauaucuucu

SEQ ID NO: 3263631 - RNA, 21 nt, Vaccinia virus
gucgucguuuuuugaucuuua

SEQ ID NO: 3263632 - RNA, 19 nt, Vaccinia virus
auuuacauucuuuuugcug

SEQ ID NO: 3263633 - RNA, 15 nt, Vaccinia virus
ccuucguuguuucua

SEQ ID NO: 3263634 - RNA, 18 nt, Vaccinia virus
uuaaugaauaucauuaac

SEQ ID NO: 3263635 - RNA, 16 nt, Vaccinia virus
uaaagaauaucuuugg

SEQ ID NO: 3263636 - RNA, 19 nt, Vaccinia virus
caauaguuucauaauuguu

SEQ ID NO: 3263637 - RNA, 13 nt, Vaccinia virus
uaacaaauuaaag

SEQ ID NO: 3263638 - RNA, 21 nt, Vaccinia virus
augguacguaaccgaaucuuc

SEQ ID NO: 3263639 - RNA, 18 nt, Vaccinia virus
gauucgguuuuauacugu

SEQ ID NO: 3263640 - RNA, 21 nt, Vaccinia virus
agacaauugacaaaauucaca

SEQ ID NO: 3263641 - RNA, 21 nt, Vaccinia virus
acguaacuauauuccaaauua

SEQ ID NO: 3263642 - RNA, 15 nt, Vaccinia virus
caacauguuuaauau

SEQ ID NO: 3263643 - RNA, 19 nt, Vaccinia virus
auuguagcuauuuaaaugg

SEQ ID NO: 3263644 - RNA, 15 nt, Vaccinia virus
auuuuaucuuuuacu

SEQ ID NO: 3263645 - RNA, 17 nt, Vaccinia virus
cgcaucaggauauaaag

SEQ ID NO: 3263646 - RNA, 20 nt, Vaccinia virus
aggacaaagugaaacaauca

SEQ ID NO: 3263647 - RNA, 15 nt, Vaccinia virus
ccugauuauuuacua

SEQ ID NO: 3263648 - RNA, 19 nt, Vaccinia virus
aaaaacugcguuguaucau

SEQ ID NO: 3263649 - RNA, 15 nt, Vaccinia virus
ucuauaagguuucuu

SEQ ID NO: 3263650 - RNA, 14 nt, Vaccinia virus
cauuacuaaaaaaa

SEQ ID NO: 3263651 - RNA, 14 nt, Vaccinia virus
acaucuaaaaaugu

SEQ ID NO: 3263652 - RNA, 15 nt, Vaccinia virus
cuuccaguucuggau

SEQ ID NO: 3263653 - RNA, 17 nt, Vaccinia virus
aacaugugugaaaauau

SEQ ID NO: 3263654 - RNA, 23 nt, Vaccinia virus
uaaacggcaaaccaaaaacauuu

SEQ ID NO: 3263655 - RNA, 20 nt, Vaccinia virus
uagauguuaaaaaaacaucg

SEQ ID NO: 3263656 - RNA, 13 nt, Vaccinia virus
auuggaauuauuu

SEQ ID NO: 3263657 - RNA, 16 nt, Vaccinia virus
aaucuauucccuugau

SEQ ID NO: 3263658 - RNA, 14 nt, Vaccinia virus
acagaaguuuugaa

SEQ ID NO: 3263659 - RNA, 17 nt, Vaccinia virus
uacguaauaaaaguaau

SEQ ID NO: 3263660 - RNA, 16 nt, Vaccinia virus
aauaucaguaucuucu

SEQ ID NO: 3263661 - RNA, 19 nt, Vaccinia virus
aaguauagcuaaugaugcg

SEQ ID NO: 3263662 - RNA, 19 nt, Vaccinia virus
ggcuugcauguauuaaaga

SEQ ID NO: 3263663 - RNA, 19 nt, Vaccinia virus
uacgcauguuuuaaugcau

SEQ ID NO: 3263664 - RNA, 16 nt, Vaccinia virus
ucuucggauauucuaa

SEQ ID NO: 3263665 - RNA, 13 nt, Vaccinia virus
cauauuacauaau

SEQ ID NO: 3263666 - RNA, 20 nt, Vaccinia virus
agcauagcgauagaucuuaa

SEQ ID NO: 3263667 - RNA, 12 nt, Vaccinia virus
uuccucauuaag

SEQ ID NO: 3263668 - RNA, 12 nt, Vaccinia virus
uaucguuuucau

SEQ ID NO: 3263669 - RNA, 17 nt, Vaccinia virus
aucagcuuuaguuuaua

SEQ ID NO: 3263670 - RNA, 23 nt, Vaccinia virus
agcauuucugucgauauagcuuu

SEQ ID NO: 3263671 - RNA, 19 nt, Vaccinia virus
ggcuacggcagauauaccu

SEQ ID NO: 3263672 - RNA, 12 nt, Vaccinia virus
auuuuagaauuu

SEQ ID NO: 3263673 - RNA, 22 nt, Vaccinia virus
agaaggguucgauuaucuguau

SEQ ID NO: 3263674 - RNA, 19 nt, Vaccinia virus
uaaagcauauuccauuaau

SEQ ID NO: 3263675 - RNA, 18 nt, Vaccinia virus
cagaaacuguaaagaaca

SEQ ID NO: 3263676 - RNA, 18 nt, Vaccinia virus
ucauaauguaaucucuaa

SEQ ID NO: 3263677 - RNA, 17 nt, Vaccinia virus
cuucuauaaaaauggau

SEQ ID NO: 3263678 - RNA, 13 nt, Vaccinia virus
augcuaaagcaaa

SEQ ID NO: 3263679 - RNA, 17 nt, Vaccinia virus
uuccaccgacucauuau

SEQ ID NO: 3263680 - RNA, 18 nt, Vaccinia virus
aauaucuccucaaggaau

SEQ ID NO: 3263681 - RNA, 14 nt, Vaccinia virus
uucaucauccauga

SEQ ID NO: 3263682 - RNA, 19 nt, Vaccinia virus
uaaauuauuuaauggagua

SEQ ID NO: 3263683 - RNA, 16 nt, Vaccinia virus
aauuauaagaaauaua

SEQ ID NO: 3263684 - RNA, 18 nt, Vaccinia virus
aucuauauacgauccacg

SEQ ID NO: 3263685 - RNA, 14 nt, Vaccinia virus
acauguuuaauaua

SEQ ID NO: 3263686 - RNA, 20 nt, Vaccinia virus
auccguguuaaaaaaaauua

SEQ ID NO: 3263687 - RNA, 17 nt, Vaccinia virus
ugguuguggaucuucua

SEQ ID NO: 3263688 - RNA, 14 nt, Vaccinia virus
auugacagauagau

SEQ ID NO: 3263689 - RNA, 22 nt, Vaccinia virus
acucaugaaucuaaaagaauug

SEQ ID NO: 3263690 - RNA, 14 nt, Vaccinia virus
caaacaauguuucu

SEQ ID NO: 3263691 - RNA, 21 nt, Vaccinia virus
uaguucuuuuagaaaauucua

SEQ ID NO: 3263692 - RNA, 16 nt, Vaccinia virus
uaacauucugauuuaa

SEQ ID NO: 3263693 - RNA, 15 nt, Vaccinia virus
uuaauauuagaguua

SEQ ID NO: 3263694 - RNA, 21 nt, Vaccinia virus
ugaggaaugauugccuucauc

SEQ ID NO: 3263695 - RNA, 14 nt, Vaccinia virus
auauagaugucaau

SEQ ID NO: 3263696 - RNA, 15 nt, Vaccinia virus
ucucaauacaaccaa

SEQ ID NO: 3263697 - RNA, 23 nt, Vaccinia virus
aauaauggcuguuuguauaauag

SEQ ID NO: 3263698 - RNA, 23 nt, Vaccinia virus
uguuuaacauucuuuuuuggaga

SEQ ID NO: 3263699 - RNA, 23 nt, Vaccinia virus
acucgauaacacauuuucaucua

SEQ ID NO: 3263700 - RNA, 17 nt, Vaccinia virus
uguuuauacaagauuga

SEQ ID NO: 3263701 - RNA, 22 nt, Vaccinia virus
uauauaauuuuuggacaaaugu

SEQ ID NO: 3263702 - RNA, 20 nt, Vaccinia virus
augaugugagagagaaauac

SEQ ID NO: 3263703 - RNA, 13 nt, Vaccinia virus
uugcuaauuauuu

SEQ ID NO: 3263704 - RNA, 19 nt, Vaccinia virus
aaucaccauccuuuaaaaa

SEQ ID NO: 3263705 - RNA, 15 nt, Vaccinia virus
uagcaauauguguaa

SEQ ID NO: 3263706 - RNA, 20 nt, Vaccinia virus
gauucaucaacauuugcugu

SEQ ID NO: 3263707 - RNA, 12 nt, Vaccinia virus
aauguauaacag

SEQ ID NO: 3263708 - RNA, 23 nt, Vaccinia virus
uguaucaaagacauuaauacuuu

SEQ ID NO: 3263709 - RNA, 22 nt, Vaccinia virus
aaugcagaucuaauaaauggag

SEQ ID NO: 3263710 - RNA, 16 nt, Vaccinia virus
ugacgcuuucaagaau

SEQ ID NO: 3263711 - RNA, 19 nt, Vaccinia virus
aguagaaaauaauauagau

SEQ ID NO: 3263712 - RNA, 12 nt, Vaccinia virus
gaaugucaugau

SEQ ID NO: 3263713 - RNA, 15 nt, Vaccinia virus
acauauuauacagua

SEQ ID NO: 3263714 - RNA, 15 nt, Vaccinia virus
auuggcuuuucuuua

SEQ ID NO: 3263715 - RNA, 17 nt, Vaccinia virus
cugauagaaagaauaag

SEQ ID NO: 3263716 - RNA, 13 nt, Vaccinia virus
uaucauuaaugau

SEQ ID NO: 3263717 - RNA, 14 nt, Vaccinia virus
uacguaucuauaau

SEQ ID NO: 3263718 - RNA, 14 nt, Vaccinia virus
guuauaaucaaaga

SEQ ID NO: 3263719 - RNA, 18 nt, Vaccinia virus
auaauagauuuaucuagu

SEQ ID NO: 3263720 - RNA, 12 nt, Vaccinia virus
aucaauagcuua

SEQ ID NO: 3263721 - RNA, 16 nt, Vaccinia virus
aaucuugauuacaaaa

SEQ ID NO: 3263722 - RNA, 18 nt, Vaccinia virus
caugcucuauuuugucau

SEQ ID NO: 3263723 - RNA, 15 nt, Vaccinia virus
cacguuuauuucaua

SEQ ID NO: 3263724 - RNA, 12 nt, Vaccinia virus
aggaaacuauaa

SEQ ID NO: 3263725 - RNA, 15 nt, Vaccinia virus
aaagacaaacaaugg

SEQ ID NO: 3263726 - RNA, 16 nt, Vaccinia virus
uuggaaucaauuacag

SEQ ID NO: 3263727 - RNA, 17 nt, Vaccinia virus
guaaauguuuuuaucau

SEQ ID NO: 3263728 - RNA, 22 nt, Vaccinia virus
aauguauuaguuaaauauuaaa

SEQ ID NO: 3263729 - RNA, 12 nt, Vaccinia virus
aaacaaaaaugc

SEQ ID NO: 3263730 - RNA, 17 nt, Vaccinia virus
uccacguucuacaaaag

SEQ ID NO: 3263731 - RNA, 23 nt, Vaccinia virus
acuagauaaacuaucaguaaguu

SEQ ID NO: 3263732 - RNA, 22 nt, Vaccinia virus
guaauagaauacgaugauauua

SEQ ID NO: 3263733 - RNA, 14 nt, Vaccinia virus
aaguacagaauuaa

SEQ ID NO: 3263734 - RNA, 12 nt, Vaccinia virus
cauuuaucacaa

SEQ ID NO: 3263735 - RNA, 19 nt, Vaccinia virus
aacuuguguucuaaaugga

SEQ ID NO: 3263736 - RNA, 21 nt, Vaccinia virus
uauuuggauuuggaaaagaaa

SEQ ID NO: 3263737 - RNA, 17 nt, Vaccinia virus
auaucagacgauccaca

SEQ ID NO: 3263738 - RNA, 23 nt, Vaccinia virus
cugauguaacccacguaacauug

SEQ ID NO: 3263739 - RNA, 20 nt, Vaccinia virus
uuuaccggcaucauaaacac

SEQ ID NO: 3263740 - RNA, 15 nt, Vaccinia virus
uaaacgauauucuug

SEQ ID NO: 3263741 - RNA, 15 nt, Vaccinia virus
uaaucuuuaauguaa

SEQ ID NO: 3263742 - RNA, 16 nt, Vaccinia virus
uaucggaggaauuaag

SEQ ID NO: 3263743 - RNA, 21 nt, Vaccinia virus
cguaaaccguuuaauaauauu

SEQ ID NO: 3263744 - RNA, 22 nt, Vaccinia virus
gaaaauguacuucgaugagauu

SEQ ID NO: 3263745 - RNA, 17 nt, Vaccinia virus
agacucaucaacgauga

SEQ ID NO: 3263746 - RNA, 21 nt, Vaccinia virus
uguuauacacggucuagagca

SEQ ID NO: 3263747 - RNA, 23 nt, Vaccinia virus
ggaaaagaauuuaccagauaucu

SEQ ID NO: 3263748 - RNA, 16 nt, Vaccinia virus
gacuacgaaacugaua

SEQ ID NO: 3263749 - RNA, 16 nt, Vaccinia virus
cucucuauuucuuaau

SEQ ID NO: 3263750 - RNA, 18 nt, Vaccinia virus
ccaauaaacuauuucuaa

SEQ ID NO: 3263751 - RNA, 16 nt, Vaccinia virus
auagagaugagaugcu

SEQ ID NO: 3263752 - RNA, 18 nt, Vaccinia virus
agaucuaugauaucuucu

SEQ ID NO: 3263753 - RNA, 14 nt, Vaccinia virus
gaagaaauaaaggc

SEQ ID NO: 3263754 - RNA, 21 nt, Vaccinia virus
uggagaucauuaaauguuuca

SEQ ID NO: 3263755 - RNA, 19 nt, Vaccinia virus
cacuaaucguaauauucua

SEQ ID NO: 3263756 - RNA, 14 nt, Vaccinia virus
aggaaauaucaauu

SEQ ID NO: 3263757 - RNA, 15 nt, Vaccinia virus
ucaucgugacauaag

SEQ ID NO: 3263758 - RNA, 17 nt, Vaccinia virus
auguauguuuaaacacu

SEQ ID NO: 3263759 - RNA, 16 nt, Vaccinia virus
auaucguucucuaaau

SEQ ID NO: 3263760 - RNA, 18 nt, Vaccinia virus
auuaucaucaaaaaacaa

SEQ ID NO: 3263761 - RNA, 19 nt, Vaccinia virus
caaaacguccucuauacau

SEQ ID NO: 3263762 - RNA, 13 nt, Vaccinia virus
uaucuauacauac

SEQ ID NO: 3263763 - RNA, 15 nt, Vaccinia virus
aguaacgcaauacaa

SEQ ID NO: 3263764 - RNA, 21 nt, Vaccinia virus
uaaaguaugaacaaagaaaug

SEQ ID NO: 3263765 - RNA, 17 nt, Vaccinia virus
acauaacagguagaauu

SEQ ID NO: 3263766 - RNA, 15 nt, Vaccinia virus
cgugauguuguaaca

SEQ ID NO: 3263767 - RNA, 15 nt, Vaccinia virus
guaggauauauuaaa

SEQ ID NO: 3263768 - RNA, 20 nt, Vaccinia virus
ugacauuuuccuuguaucca

SEQ ID NO: 3263769 - RNA, 20 nt, Vaccinia virus
auaugauguuucuguuuuca

SEQ ID NO: 3263770 - RNA, 18 nt, Vaccinia virus
auuuuagcagugaaauaa

SEQ ID NO: 3263771 - RNA, 21 nt, Vaccinia virus
auugguucauacaugaaauga

SEQ ID NO: 3263772 - RNA, 20 nt, Vaccinia virus
cuauaaaaagauuauacaaa

SEQ ID NO: 3263773 - RNA, 14 nt, Vaccinia virus
gaauagauaauaau

SEQ ID NO: 3263774 - RNA, 22 nt, Vaccinia virus
ucucaaagauguuaugguugaa

SEQ ID NO: 3263775 - RNA, 15 nt, Vaccinia virus
uguuaauacaucaau

SEQ ID NO: 3263776 - RNA, 17 nt, Vaccinia virus
auauccagugcauuucu

SEQ ID NO: 3263777 - RNA, 17 nt, Vaccinia virus
agcacauccaucaaaga

SEQ ID NO: 3263778 - RNA, 15 nt, Vaccinia virus
aaagaaguuauagaa

SEQ ID NO: 3263779 - RNA, 16 nt, Vaccinia virus
uuguauuauucugaau

SEQ ID NO: 3263780 - RNA, 19 nt, Vaccinia virus
augguucccauaaguuugg

SEQ ID NO: 3263781 - RNA, 13 nt, Vaccinia virus
ucucuaguuuuau

SEQ ID NO: 3263782 - RNA, 19 nt, Vaccinia virus
ugguuguagcgguuggaua

SEQ ID NO: 3263783 - RNA, 15 nt, Vaccinia virus
guuaaugaacaaauc

SEQ ID NO: 3263784 - RNA, 13 nt, Vaccinia virus
aucaacuauccuc

SEQ ID NO: 3263785 - RNA, 19 nt, Vaccinia virus
uugccaucacucucauaau

SEQ ID NO: 3263786 - RNA, 13 nt, Vaccinia virus
uaaaugaaaagau

SEQ ID NO: 3263787 - RNA, 13 nt, Vaccinia virus
auguggaauuaug

SEQ ID NO: 3263788 - RNA, 22 nt, Vaccinia virus
aaucuuuagacgguugagaaaa

SEQ ID NO: 3263789 - RNA, 16 nt, Vaccinia virus
aggauacucuaugaau

SEQ ID NO: 3263790 - RNA, 18 nt, Vaccinia virus
uccaucagaauguuuccc

SEQ ID NO: 3263791 - RNA, 13 nt, Vaccinia virus
aaucauugauaca

SEQ ID NO: 3263792 - RNA, 16 nt, Vaccinia virus
ucaacauaaauaauuc

SEQ ID NO: 3263793 - RNA, 18 nt, Vaccinia virus
aggauaccgaagaauuaa

SEQ ID NO: 3263794 - RNA, 20 nt, Vaccinia virus
aaaguuuucuuucaaaauag

SEQ ID NO: 3263795 - RNA, 17 nt, Vaccinia virus
caggauacuaugcuauu

SEQ ID NO: 3263796 - RNA, 22 nt, Vaccinia virus
aucguuuaaaauacuaaauuga

SEQ ID NO: 3263797 - RNA, 14 nt, Vaccinia virus
uaguuuguuuucau

SEQ ID NO: 3263798 - RNA, 17 nt, Vaccinia virus
auccucgcuuuguguau

SEQ ID NO: 3263799 - RNA, 15 nt, Vaccinia virus
ucucuucaacaucuu

SEQ ID NO: 3263800 - RNA, 16 nt, Vaccinia virus
aacuuggggagaauga

SEQ ID NO: 3263801 - RNA, 22 nt, Vaccinia virus
aaaaguuuuccaucuauguaga

SEQ ID NO: 3263802 - RNA, 18 nt, Vaccinia virus
auaacacaaaaugugaac

SEQ ID NO: 3263803 - RNA, 18 nt, Vaccinia virus
cuuuaacuuuauacuuuu

SEQ ID NO: 3263804 - RNA, 18 nt, Vaccinia virus
gcguaaaagucaaauuag

SEQ ID NO: 3263805 - RNA, 20 nt, Vaccinia virus
augcuguuuuuuacuuugug

SEQ ID NO: 3263806 - RNA, 13 nt, Vaccinia virus
aucauauauaaug

SEQ ID NO: 3263807 - RNA, 14 nt, Vaccinia virus
agauuuuacuaacu

SEQ ID NO: 3263808 - RNA, 14 nt, Vaccinia virus
caaccggauuuaaa

SEQ ID NO: 3263809 - RNA, 22 nt, Vaccinia virus
cauaucuauccauaugcaucuu

SEQ ID NO: 3263810 - RNA, 11 nt, Vaccinia virus
aacaaaacaau

SEQ ID NO: 3263811 - RNA, 14 nt, Vaccinia virus
uuuuuaaaaucauu

SEQ ID NO: 3263812 - RNA, 18 nt, Vaccinia virus
aaaaauguuaauuuugaa

SEQ ID NO: 3263813 - RNA, 12 nt, Vaccinia virus
aauaguuucaua

SEQ ID NO: 3263814 - RNA, 14 nt, Vaccinia virus
gaaauggauaauau

SEQ ID NO: 3263815 - RNA, 17 nt, Vaccinia virus
cacaaugauaacaucca

SEQ ID NO: 3263816 - RNA, 14 nt, Vaccinia virus
gauuccaacagcug

SEQ ID NO: 3263817 - RNA, 14 nt, Vaccinia virus
acaauuuuguauua

SEQ ID NO: 3263818 - RNA, 20 nt, Vaccinia virus
ucgaaaucgcgacuccggaa

SEQ ID NO: 3263819 - RNA, 23 nt, Vaccinia virus
auacauaugguacgauguuguaa

SEQ ID NO: 3263820 - RNA, 19 nt, Vaccinia virus
uaguagauuuuuaagcugu

SEQ ID NO: 3263821 - RNA, 14 nt, Vaccinia virus
cguaaauacauguc

SEQ ID NO: 3263822 - RNA, 17 nt, Vaccinia virus
auuagcguauugagaag

SEQ ID NO: 3263823 - RNA, 22 nt, Vaccinia virus
ucauccgauaaacuccaauaaa

SEQ ID NO: 3263824 - RNA, 13 nt, Vaccinia virus
gcgcuaucuuuca

SEQ ID NO: 3263825 - RNA, 16 nt, Vaccinia virus
ugaucaggaaaguuua

SEQ ID NO: 3263826 - RNA, 14 nt, Vaccinia virus
auaggaucaucuau

SEQ ID NO: 3263827 - RNA, 15 nt, Vaccinia virus
aauguauuaagauua

SEQ ID NO: 3263828 - RNA, 19 nt, Vaccinia virus
auaguacuacaauuuguau

SEQ ID NO: 3263829 - RNA, 15 nt, Vaccinia virus
uaaauaaauaauguu

SEQ ID NO: 3263830 - RNA, 14 nt, Vaccinia virus
gaaaaaaauaucua

SEQ ID NO: 3263831 - RNA, 23 nt, Vaccinia virus
auuacgaaucauuaaaaaaauua

SEQ ID NO: 3263832 - RNA, 18 nt, Vaccinia virus
aaggacagaaaaaugcua

SEQ ID NO: 3263833 - RNA, 16 nt, Vaccinia virus
aagcaauaaauacaga

SEQ ID NO: 3263834 - RNA, 20 nt, Vaccinia virus
acuuagucuguacaaaaguu

SEQ ID NO: 3263835 - RNA, 17 nt, Vaccinia virus
cgacaaaaagauauaaa

SEQ ID NO: 3263836 - RNA, 13 nt, Vaccinia virus
cuaauucuuuaau

SEQ ID NO: 3263837 - RNA, 23 nt, Vaccinia virus
caaacugcguuaauguauucucu

SEQ ID NO: 3263838 - RNA, 16 nt, Vaccinia virus
agaaccaguaacauau

SEQ ID NO: 3263839 - RNA, 16 nt, Vaccinia virus
aaaaucugauagaaag

SEQ ID NO: 3263840 - RNA, 18 nt, Vaccinia virus
acuaauuuuuauuaauga

SEQ ID NO: 3263841 - RNA, 21 nt, Vaccinia virus
aaauuggaaggauauacaaag

SEQ ID NO: 3263842 - RNA, 18 nt, Vaccinia virus
uagucguuuauuaucuug

SEQ ID NO: 3263843 - RNA, 22 nt, Vaccinia virus
caaaacguaaucauagaugaau

SEQ ID NO: 3263844 - RNA, 21 nt, Vaccinia virus
aucaacguagaaaaaauagaa

SEQ ID NO: 3263845 - RNA, 14 nt, Vaccinia virus
uaucaaauacugua

SEQ ID NO: 3263846 - RNA, 22 nt, Vaccinia virus
cugcuggaaaauaaaucacuga

SEQ ID NO: 3263847 - RNA, 14 nt, Vaccinia virus
uaagcaagaaagau

SEQ ID NO: 3263848 - RNA, 17 nt, Vaccinia virus
acuauugccaucgaaug

SEQ ID NO: 3263849 - RNA, 20 nt, Vaccinia virus
auuuacuaaagucaucaaug

SEQ ID NO: 3263850 - RNA, 14 nt, Vaccinia virus
acauuuuauuucua

SEQ ID NO: 3263851 - RNA, 20 nt, Vaccinia virus
uaacaucuuuguaaacagau

SEQ ID NO: 3263852 - RNA, 19 nt, Vaccinia virus
aaauguauaaaaaacuaau

SEQ ID NO: 3263853 - RNA, 14 nt, Vaccinia virus
aaaaaucuuuguuc

SEQ ID NO: 3263854 - RNA, 15 nt, Vaccinia virus
uaacaucacuaauau

SEQ ID NO: 3263855 - RNA, 14 nt, Vaccinia virus
gaucaacaaaagaa

SEQ ID NO: 3263856 - RNA, 19 nt, Vaccinia virus
agguuuuuuaaaacagaug

SEQ ID NO: 3263857 - RNA, 20 nt, Vaccinia virus
aaacucuguuguauaucuac

SEQ ID NO: 3263858 - RNA, 15 nt, Vaccinia virus
cauagaugaaauacu

SEQ ID NO: 3263859 - RNA, 21 nt, Vaccinia virus
uuauuggcguuggaaaaauua

SEQ ID NO: 3263860 - RNA, 17 nt, Vaccinia virus
auaauauccgaauauau

SEQ ID NO: 3263861 - RNA, 15 nt, Vaccinia virus
caaaauacaauuguu

SEQ ID NO: 3263862 - RNA, 18 nt, Vaccinia virus
aaauucggacuuggauuc

SEQ ID NO: 3263863 - RNA, 16 nt, Vaccinia virus
uagaugcgucuagaag

SEQ ID NO: 3263864 - RNA, 20 nt, Vaccinia virus
aucaaaugguaaauacugua

SEQ ID NO: 3263865 - RNA, 17 nt, Vaccinia virus
agaaacaucauauacaa

SEQ ID NO: 3263866 - RNA, 13 nt, Vaccinia virus
uauuccuaccaaa

SEQ ID NO: 3263867 - RNA, 14 nt, Vaccinia virus
aacgaaauuauacu

SEQ ID NO: 3263868 - RNA, 20 nt, Vaccinia virus
uagaaauucaucaauaucca

SEQ ID NO: 3263869 - RNA, 20 nt, Vaccinia virus
aucugaaauaacauauagau

SEQ ID NO: 3263870 - RNA, 14 nt, Vaccinia virus
cacgaacaucuuuc

SEQ ID NO: 3263871 - RNA, 13 nt, Vaccinia virus
auguauaaaugaa

SEQ ID NO: 3263872 - RNA, 20 nt, Vaccinia virus
auauacgaaauaaaauagac

SEQ ID NO: 3263873 - RNA, 20 nt, Vaccinia virus
aucuauuaaacagaaauggu

SEQ ID NO: 3263874 - RNA, 20 nt, Vaccinia virus
uauugcuuuccuuuaucauu

SEQ ID NO: 3263875 - RNA, 19 nt, Vaccinia virus
ugucucuuaacuauuuccg

SEQ ID NO: 3263876 - RNA, 19 nt, Vaccinia virus
aguuuaucaauaacuacau

SEQ ID NO: 3263877 - RNA, 15 nt, Vaccinia virus
aagguaagaguuaug

SEQ ID NO: 3263878 - RNA, 22 nt, Vaccinia virus
auguuacagaauauaaauuaua

SEQ ID NO: 3263879 - RNA, 16 nt, Vaccinia virus
uauaugccacguuuau

SEQ ID NO: 3263880 - RNA, 19 nt, Vaccinia virus
ucuucguacgauccaaauu

SEQ ID NO: 3263881 - RNA, 20 nt, Vaccinia virus
uaacguauucgauacauuuu

SEQ ID NO: 3263882 - RNA, 18 nt, Vaccinia virus
agaacuuacgauacaucu

SEQ ID NO: 3263883 - RNA, 13 nt, Vaccinia virus
uaauuucacgaau

SEQ ID NO: 3263884 - RNA, 19 nt, Vaccinia virus
aaguauauaauaaauacuu

SEQ ID NO: 3263885 - RNA, 19 nt, Vaccinia virus
agaucaucaaaauauguuu

SEQ ID NO: 3263886 - RNA, 24 nt, Vaccinia virus
caucugccauaauccuauucuuga

SEQ ID NO: 3263887 - RNA, 18 nt, Vaccinia virus
ugaacugagauauauaca

SEQ ID NO: 3263888 - RNA, 23 nt, Vaccinia virus
ggucgucgauaacaaauuaaaga

SEQ ID NO: 3263889 - RNA, 16 nt, Vaccinia virus
ucuuauccauuucgaa

SEQ ID NO: 3263890 - RNA, 13 nt, Vaccinia virus
auauacuauauag

SEQ ID NO: 3263891 - RNA, 22 nt, Vaccinia virus
uauuaucauacugucaacuaua

SEQ ID NO: 3263892 - RNA, 21 nt, Vaccinia virus
agcauacgccaaauaucucaa

SEQ ID NO: 3263893 - RNA, 20 nt, Vaccinia virus
uggauggauuauaauugaug

SEQ ID NO: 3263894 - RNA, 22 nt, Vaccinia virus
guauacucugcccuuuauuaca

SEQ ID NO: 3263895 - RNA, 15 nt, Vaccinia virus
agaauuuucauggau

SEQ ID NO: 3263896 - RNA, 14 nt, Vaccinia virus
auuuauuaaauacu

SEQ ID NO: 3263897 - RNA, 15 nt, Vaccinia virus
ucaaaauauguaaua

SEQ ID NO: 3263898 - RNA, 18 nt, Vaccinia virus
acgauauuuguuggauuc

SEQ ID NO: 3263899 - RNA, 16 nt, Vaccinia virus
uguuuuauguuuauua

SEQ ID NO: 3263900 - RNA, 16 nt, Vaccinia virus
caaccuacacuauuau

SEQ ID NO: 3263901 - RNA, 18 nt, Vaccinia virus
caccaucuucauaauaaa

SEQ ID NO: 3263902 - RNA, 20 nt, Vaccinia virus
cuauaaaaaaaauaauaauu

SEQ ID NO: 3263903 - RNA, 15 nt, Vaccinia virus
aauuacuaaaauaua

SEQ ID NO: 3263904 - RNA, 20 nt, Vaccinia virus
uagauaaaaaggaaucuauu

SEQ ID NO: 3263905 - RNA, 15 nt, Vaccinia virus
gaaaguaaauaauau

SEQ ID NO: 3263906 - RNA, 16 nt, Vaccinia virus
aacacacacugagaaa

SEQ ID NO: 3263907 - RNA, 16 nt, Vaccinia virus
agguaguaaaaaauaa

SEQ ID NO: 3263908 - RNA, 12 nt, Vaccinia virus
acaauauuucau

SEQ ID NO: 3263909 - RNA, 15 nt, Vaccinia virus
cugaaagagaugaga

SEQ ID NO: 3263910 - RNA, 21 nt, Vaccinia virus
cauucaugggugcugaauaau

SEQ ID NO: 3263911 - RNA, 17 nt, Vaccinia virus
aaauaccauaaauauau

SEQ ID NO: 3263912 - RNA, 22 nt, Vaccinia virus
agucucaaucuuauuuaacuaa

SEQ ID NO: 3263913 - RNA, 22 nt, Vaccinia virus
auaauguuguccauuguaguau

SEQ ID NO: 3263914 - RNA, 15 nt, Vaccinia virus
auucauuuagaaugg

SEQ ID NO: 3263915 - RNA, 20 nt, Vaccinia virus
uacuaaaucuguauaucuuu

SEQ ID NO: 3263916 - RNA, 21 nt, Vaccinia virus
augaauaucugcaauauauau

SEQ ID NO: 3263917 - RNA, 17 nt, Vaccinia virus
agaacgaugucaaaaua

SEQ ID NO: 3263918 - RNA, 16 nt, Vaccinia virus
uaacugcuuuucugga

SEQ ID NO: 3263919 - RNA, 23 nt, Vaccinia virus
caagauccucucuuaaaugaauc

SEQ ID NO: 3263920 - RNA, 21 nt, Vaccinia virus
uauuaacgugaaacguaguau

SEQ ID NO: 3263921 - RNA, 23 nt, Vaccinia virus
ucaccgauaaacgucauuucucu

SEQ ID NO: 3263922 - RNA, 12 nt, Vaccinia virus
uaaguguuuaua

SEQ ID NO: 3263923 - RNA, 22 nt, Vaccinia virus
gaguaguaaacgcguacauaac

SEQ ID NO: 3263924 - RNA, 19 nt, Vaccinia virus
aucgacauggcuucuucca

SEQ ID NO: 3263925 - RNA, 19 nt, Vaccinia virus
uacuguugaguaaaucagu

SEQ ID NO: 3263926 - RNA, 17 nt, Vaccinia virus
gcgucauuguaaaggaa

SEQ ID NO: 3263927 - RNA, 23 nt, Vaccinia virus
uauaucacaacaucuauaaaagu

SEQ ID NO: 3263928 - RNA, 13 nt, Vaccinia virus
uaucgugucucau

SEQ ID NO: 3263929 - RNA, 17 nt, Vaccinia virus
cgaugaguguagaugcu

SEQ ID NO: 3263930 - RNA, 17 nt, Vaccinia virus
caaaaguaagcauuucc

SEQ ID NO: 3263931 - RNA, 18 nt, Vaccinia virus
ucuauauacuauauagua

SEQ ID NO: 3263932 - RNA, 15 nt, Vaccinia virus
ucauccaugguuuua

SEQ ID NO: 3263933 - RNA, 13 nt, Vaccinia virus
aacaaguuuuuau

SEQ ID NO: 3263934 - RNA, 19 nt, Vaccinia virus
uuaguaucuagcucuguaa

SEQ ID NO: 3263935 - RNA, 19 nt, Vaccinia virus
gcaauggcucuaacaacaa

SEQ ID NO: 3263936 - RNA, 17 nt, Vaccinia virus
uagagauacaauauuua

SEQ ID NO: 3263937 - RNA, 12 nt, Vaccinia virus
uagauaacucuc

SEQ ID NO: 3263938 - RNA, 19 nt, Vaccinia virus
ugauacucuuauagaugua

SEQ ID NO: 3263939 - RNA, 17 nt, Vaccinia virus
aacucgguaaaaaaauu

SEQ ID NO: 3263940 - RNA, 13 nt, Vaccinia virus
cuauuaaaguauc

SEQ ID NO: 3263941 - RNA, 13 nt, Vaccinia virus
uuucucauaauaa

SEQ ID NO: 3263942 - RNA, 14 nt, Vaccinia virus
uaguuuauuauaua

SEQ ID NO: 3263943 - RNA, 22 nt, Vaccinia virus
aauaccauaaauauauuucuaa

SEQ ID NO: 3263944 - RNA, 17 nt, Vaccinia virus
uuacaaaauucauuaac

SEQ ID NO: 3263945 - RNA, 23 nt, Vaccinia virus
uaaaugaaguacuguucaaacau

SEQ ID NO: 3263946 - RNA, 18 nt, Vaccinia virus
gcaguuacaagauuuuua

SEQ ID NO: 3263947 - RNA, 14 nt, Vaccinia virus
uguauaauuuggua

SEQ ID NO: 3263948 - RNA, 16 nt, Vaccinia virus
acauacaauuaaauca

SEQ ID NO: 3263949 - RNA, 15 nt, Vaccinia virus
uuaaaaacaaacuuu

SEQ ID NO: 3263950 - RNA, 21 nt, Vaccinia virus
ggaaucaauuacagauuucuc

SEQ ID NO: 3263951 - RNA, 20 nt, Vaccinia virus
ucaucaacuagacguuuauu

SEQ ID NO: 3263952 - RNA, 14 nt, Vaccinia virus
aguaaaguaaacaa

SEQ ID NO: 3263953 - RNA, 21 nt, Vaccinia virus
aaacuugguauuuuuugguuc

SEQ ID NO: 3263954 - RNA, 17 nt, Vaccinia virus
guuuacaguaguaauga

SEQ ID NO: 3263955 - RNA, 14 nt, Vaccinia virus
auccaucaaaaaug

SEQ ID NO: 3263956 - RNA, 13 nt, Vaccinia virus
uaugaaaauagca

SEQ ID NO: 3263957 - RNA, 18 nt, Vaccinia virus
cuuaccuucaacaguaua

SEQ ID NO: 3263958 - RNA, 16 nt, Vaccinia virus
auugguauaaauguug

SEQ ID NO: 3263959 - RNA, 17 nt, Vaccinia virus
gugaaaugguacaaaaa

SEQ ID NO: 3263960 - RNA, 15 nt, Vaccinia virus
ucuuuuuuguaccau

SEQ ID NO: 3263961 - RNA, 15 nt, Vaccinia virus
acaguuuuacuauau

SEQ ID NO: 3263962 - RNA, 22 nt, Vaccinia virus
auguugcaugaaauaauaugca

SEQ ID NO: 3263963 - RNA, 23 nt, Vaccinia virus
gacacgcucuuaggagauuaaag

SEQ ID NO: 3263964 - RNA, 22 nt, Vaccinia virus
aaguuuuaucucuuucucucuu

SEQ ID NO: 3263965 - RNA, 21 nt, Vaccinia virus
auaucuaauggauaaacugaa

SEQ ID NO: 3263966 - RNA, 16 nt, Vaccinia virus
auaaaggcagaaaugc

SEQ ID NO: 3263967 - RNA, 15 nt, Vaccinia virus
auuuucuuuauaaaa

SEQ ID NO: 3263968 - RNA, 22 nt, Vaccinia virus
gcuuccaggcuaucaaauggau

SEQ ID NO: 3263969 - RNA, 22 nt, Vaccinia virus
acuaaacuaugugaugucuugg

SEQ ID NO: 3263970 - RNA, 19 nt, Vaccinia virus
uauucugaaacaguaugau

SEQ ID NO: 3263971 - RNA, 13 nt, Vaccinia virus
aaugacaaacauu

SEQ ID NO: 3263972 - RNA, 13 nt, Vaccinia virus
cauguacaugaau

SEQ ID NO: 3263973 - RNA, 18 nt, Vaccinia virus
ugauacaaaaacgaaaua

SEQ ID NO: 3263974 - RNA, 16 nt, Vaccinia virus
aacuuuccucagagau

SEQ ID NO: 3263975 - RNA, 16 nt, Vaccinia virus
aaacucgcuuaauauc

SEQ ID NO: 3263976 - RNA, 22 nt, Vaccinia virus
aaucuguacuauguguuaaaaa

SEQ ID NO: 3263977 - RNA, 21 nt, Vaccinia virus
augaauccaucguacaagcca

SEQ ID NO: 3263978 - RNA, 15 nt, Vaccinia virus
cuaacauuguuaauu

SEQ ID NO: 3263979 - RNA, 18 nt, Vaccinia virus
acgauagucuguuaauaa

SEQ ID NO: 3263980 - RNA, 17 nt, Vaccinia virus
gauacaauggaugauau

SEQ ID NO: 3263981 - RNA, 20 nt, Vaccinia virus
auauuuuuauucagcauuac

SEQ ID NO: 3263982 - RNA, 22 nt, Vaccinia virus
uucaccaucauacucauauaau

SEQ ID NO: 3263983 - RNA, 16 nt, Vaccinia virus
auuaugaaaaaguaaa

SEQ ID NO: 3263984 - RNA, 14 nt, Vaccinia virus
cuccuuucaaacuu

SEQ ID NO: 3263985 - RNA, 12 nt, Vaccinia virus
gcuguucaaaau

SEQ ID NO: 3263986 - RNA, 17 nt, Vaccinia virus
auugauuauuucaaaga

SEQ ID NO: 3263987 - RNA, 18 nt, Vaccinia virus
aauagucuuguaaagaua

SEQ ID NO: 3263988 - RNA, 20 nt, Vaccinia virus
agugucaauuuuaaaugaug

SEQ ID NO: 3263989 - RNA, 21 nt, Vaccinia virus
acuucuacgaagaaaguuagu

SEQ ID NO: 3263990 - RNA, 12 nt, Vaccinia virus
uccucaauaacg

SEQ ID NO: 3263991 - RNA, 18 nt, Vaccinia virus
auauagugaaacaaaaua

SEQ ID NO: 3263992 - RNA, 20 nt, Vaccinia virus
uaaccauauauccaauaaag

SEQ ID NO: 3263993 - RNA, 15 nt, Vaccinia virus
agaugagaacucuau

SEQ ID NO: 3263994 - RNA, 13 nt, Vaccinia virus
uugcaucaguucu

SEQ ID NO: 3263995 - RNA, 18 nt, Vaccinia virus
uagauuucgaaaauacua

SEQ ID NO: 3263996 - RNA, 19 nt, Vaccinia virus
aaacaguuacuguuaguau

SEQ ID NO: 3263997 - RNA, 12 nt, Vaccinia virus
aaaaaauuccca

SEQ ID NO: 3263998 - RNA, 20 nt, Vaccinia virus
acacaacgcgucuagacuuc

SEQ ID NO: 3263999 - RNA, 16 nt, Vaccinia virus
acaugacauuuuccuu

SEQ ID NO: 3264000 - RNA, 19 nt, Vaccinia virus
uccauaguacauaguuguu

SEQ ID NO: 3264001 - RNA, 20 nt, Vaccinia virus
uguaauagugaaauuacauu

SEQ ID NO: 3264002 - RNA, 21 nt, Vaccinia virus
aauccauugauaauuucuugu

SEQ ID NO: 3264003 - RNA, 13 nt, Vaccinia virus
uaugauaugugau

SEQ ID NO: 3264004 - RNA, 12 nt, Vaccinia virus
cgagacuauuau

SEQ ID NO: 3264005 - RNA, 12 nt, Vaccinia virus
uauauuuccagc

SEQ ID NO: 3264006 - RNA, 22 nt, Vaccinia virus
caauuauauguguguagacaau

SEQ ID NO: 3264007 - RNA, 14 nt, Vaccinia virus
aacuauuucuaaga

SEQ ID NO: 3264008 - RNA, 19 nt, Vaccinia virus
uggcuagauucaacauuua

SEQ ID NO: 3264009 - RNA, 23 nt, Vaccinia virus
uuuucuguacucagauucaguuu

SEQ ID NO: 3264010 - RNA, 22 nt, Vaccinia virus
auuucugaaccaguuaauguau

SEQ ID NO: 3264011 - RNA, 18 nt, Vaccinia virus
cauuuauaacguacaaau

SEQ ID NO: 3264012 - RNA, 19 nt, Vaccinia virus
uguuuaacaaaguuauuca

SEQ ID NO: 3264013 - RNA, 14 nt, Vaccinia virus
uaaaagauggauau

SEQ ID NO: 3264014 - RNA, 18 nt, Vaccinia virus
auaccacauacaaaacua

SEQ ID NO: 3264015 - RNA, 19 nt, Vaccinia virus
auaacguuuuuauuuguaa

SEQ ID NO: 3264016 - RNA, 12 nt, Vaccinia virus
auauauguuuau

SEQ ID NO: 3264017 - RNA, 11 nt, Vaccinia virus
uuaaaaaauuu

SEQ ID NO: 3264018 - RNA, 21 nt, Vaccinia virus
ucuagccucgguaaucuguac

SEQ ID NO: 3264019 - RNA, 19 nt, Vaccinia virus
caggaucuccaacaaauuu

SEQ ID NO: 3264020 - RNA, 23 nt, Vaccinia virus
acucuuacaacgccaucaugaau

SEQ ID NO: 3264021 - RNA, 14 nt, Vaccinia virus
acgguauaugaaua

SEQ ID NO: 3264022 - RNA, 20 nt, Vaccinia virus
uaaguuuaugagcuuuuaua

SEQ ID NO: 3264023 - RNA, 15 nt, Vaccinia virus
gaguuacuuaaaugc

SEQ ID NO: 3264024 - RNA, 19 nt, Vaccinia virus
gccauuaguuuucaugaaa

SEQ ID NO: 3264025 - RNA, 13 nt, Vaccinia virus
uaauuauuuccag

SEQ ID NO: 3264026 - RNA, 21 nt, Vaccinia virus
ugacaauauuauuaugaagac

SEQ ID NO: 3264027 - RNA, 24 nt, Vaccinia virus
acauagaugugguaauaucugacu

SEQ ID NO: 3264028 - RNA, 18 nt, Vaccinia virus
uagaugucgaagacuuac

SEQ ID NO: 3264029 - RNA, 19 nt, Vaccinia virus
auuauagcaauauguguaa

SEQ ID NO: 3264030 - RNA, 19 nt, Vaccinia virus
acgacucuccauacgauga

SEQ ID NO: 3264031 - RNA, 16 nt, Vaccinia virus
aauaggugaugaugca

SEQ ID NO: 3264032 - RNA, 17 nt, Vaccinia virus
cuggaggagauggauua

SEQ ID NO: 3264033 - RNA, 17 nt, Vaccinia virus
cuaugacuucaucaucu

SEQ ID NO: 3264034 - RNA, 17 nt, Vaccinia virus
agucacgaauaacgaua

SEQ ID NO: 3264035 - RNA, 14 nt, Vaccinia virus
aauguuaauuuaua

SEQ ID NO: 3264036 - RNA, 17 nt, Vaccinia virus
gaauauaaaaaaaugau

SEQ ID NO: 3264037 - RNA, 14 nt, Vaccinia virus
auacauugaauauu

SEQ ID NO: 3264038 - RNA, 12 nt, Vaccinia virus
ccauuuaaauau

SEQ ID NO: 3264039 - RNA, 13 nt, Vaccinia virus
aaucugaucuugu

SEQ ID NO: 3264040 - RNA, 22 nt, Vaccinia virus
aaagaauuuuuucguguuccaa

SEQ ID NO: 3264041 - RNA, 17 nt, Vaccinia virus
guucaaaacuuaaucuc

SEQ ID NO: 3264042 - RNA, 19 nt, Vaccinia virus
acuguacccacuaugaaua

SEQ ID NO: 3264043 - RNA, 13 nt, Vaccinia virus
uuuauccaaugau

SEQ ID NO: 3264044 - RNA, 14 nt, Vaccinia virus
cauaaacugauacg

SEQ ID NO: 3264045 - RNA, 20 nt, Vaccinia virus
uuuaucucgaggauacguaa

SEQ ID NO: 3264046 - RNA, 20 nt, Vaccinia virus
cauuaauacagccuauuuuc

SEQ ID NO: 3264047 - RNA, 20 nt, Vaccinia virus
gaagauuuaacuagauuaua

SEQ ID NO: 3264048 - RNA, 16 nt, Vaccinia virus
aaaaccucaucgaaga

SEQ ID NO: 3264049 - RNA, 19 nt, Vaccinia virus
cuuugaaaauguuacugaa

SEQ ID NO: 3264050 - RNA, 14 nt, Vaccinia virus
ugaugugaauuuag

SEQ ID NO: 3264051 - RNA, 13 nt, Vaccinia virus
ucaguaucuucag

SEQ ID NO: 3264052 - RNA, 21 nt, Vaccinia virus
aguccuauauauuugaaaauc

SEQ ID NO: 3264053 - RNA, 15 nt, Vaccinia virus
uacuuaugacaaagu

SEQ ID NO: 3264054 - RNA, 17 nt, Vaccinia virus
guuucaucaauagaaga

SEQ ID NO: 3264055 - RNA, 22 nt, Vaccinia virus
ugagaucccacaucauuucaac

SEQ ID NO: 3264056 - RNA, 14 nt, Vaccinia virus
auaauauuaaauau

SEQ ID NO: 3264057 - RNA, 15 nt, Vaccinia virus
uaguauaucaaagau

SEQ ID NO: 3264058 - RNA, 14 nt, Vaccinia virus
cuauauuauguuuu

SEQ ID NO: 3264059 - RNA, 21 nt, Vaccinia virus
auauuuuuuuaguaauguuua

SEQ ID NO: 3264060 - RNA, 23 nt, Vaccinia virus
aauuucucucaucuguaggauau

SEQ ID NO: 3264061 - RNA, 13 nt, Vaccinia virus
gaaaaauauuaaa

SEQ ID NO: 3264062 - RNA, 13 nt, Vaccinia virus
cuuguugacaaaa

SEQ ID NO: 3264063 - RNA, 17 nt, Vaccinia virus
auauuguucuuaauaga

SEQ ID NO: 3264064 - RNA, 16 nt, Vaccinia virus
gaagauguuagaaaaa

SEQ ID NO: 3264065 - RNA, 15 nt, Vaccinia virus
aauauguguauuauc

SEQ ID NO: 3264066 - RNA, 13 nt, Vaccinia virus
uaacaaaauuaaa

SEQ ID NO: 3264067 - RNA, 13 nt, Vaccinia virus
aaugcauuuuaua

SEQ ID NO: 3264068 - RNA, 13 nt, Vaccinia virus
aggauuuucuaga

SEQ ID NO: 3264069 - RNA, 23 nt, Vaccinia virus
uucaagagauaguuuucaucaga

SEQ ID NO: 3264070 - RNA, 19 nt, Vaccinia virus
uaauaauauuuugaaucuu

SEQ ID NO: 3264071 - RNA, 18 nt, Vaccinia virus
aguuacauguuuaaauaa

SEQ ID NO: 3264072 - RNA, 15 nt, Vaccinia virus
agaauacgccaagga

SEQ ID NO: 3264073 - RNA, 21 nt, Vaccinia virus
aauaaaaucacuaguaucaau

SEQ ID NO: 3264074 - RNA, 17 nt, Vaccinia virus
ccaugcacguaaacauu

SEQ ID NO: 3264075 - RNA, 14 nt, Vaccinia virus
gaauucaguaauau

SEQ ID NO: 3264076 - RNA, 21 nt, Vaccinia virus
guguacuagucauaauaucuu

SEQ ID NO: 3264077 - RNA, 19 nt, Vaccinia virus
cuuaacuuacaaaauguaa

SEQ ID NO: 3264078 - RNA, 22 nt, Vaccinia virus
uacacuccucagauuuauacau

SEQ ID NO: 3264079 - RNA, 17 nt, Vaccinia virus
uagaacuuaucaaagaa

SEQ ID NO: 3264080 - RNA, 22 nt, Vaccinia virus
caauugugauuuaguguaguau

SEQ ID NO: 3264081 - RNA, 18 nt, Vaccinia virus
aacuccguagagaaauau

SEQ ID NO: 3264082 - RNA, 10 nt, Vaccinia virus
guuguauuua

SEQ ID NO: 3264083 - RNA, 20 nt, Vaccinia virus
gacacauucuuuagaacuuc

SEQ ID NO: 3264084 - RNA, 21 nt, Vaccinia virus
aaugaugaugaugaaauggau

SEQ ID NO: 3264085 - RNA, 16 nt, Vaccinia virus
acucacgcaauuauua

SEQ ID NO: 3264086 - RNA, 17 nt, Vaccinia virus
agauuaagauuaaacau

SEQ ID NO: 3264087 - RNA, 17 nt, Vaccinia virus
ucuuuaauagugucauu

SEQ ID NO: 3264088 - RNA, 15 nt, Vaccinia virus
uauaugccuguacuu

SEQ ID NO: 3264089 - RNA, 13 nt, Vaccinia virus
aaaacaauaaaua

SEQ ID NO: 3264090 - RNA, 19 nt, Vaccinia virus
uauguaaucauuguccaga

SEQ ID NO: 3264091 - RNA, 20 nt, Vaccinia virus
aagcguguaaacgaaaacua

SEQ ID NO: 3264092 - RNA, 16 nt, Vaccinia virus
uagauuuuaucuaauu

SEQ ID NO: 3264093 - RNA, 22 nt, Vaccinia virus
auauagcggaugaaaaauuugu

SEQ ID NO: 3264094 - RNA, 17 nt, Vaccinia virus
caccgauggugucacau

SEQ ID NO: 3264095 - RNA, 22 nt, Vaccinia virus
uaaggacauuggauauguggaa

SEQ ID NO: 3264096 - RNA, 22 nt, Vaccinia virus
aacuauuuccggcuguuguaua

SEQ ID NO: 3264097 - RNA, 11 nt, Vaccinia virus
ccguguuuauu

SEQ ID NO: 3264098 - RNA, 20 nt, Vaccinia virus
guaccagaaggaacauacga

SEQ ID NO: 3264099 - RNA, 22 nt, Vaccinia virus
aggaccacuagcaaaagauaaa

SEQ ID NO: 3264100 - RNA, 17 nt, Vaccinia virus
uauauuuucucaacaag

SEQ ID NO: 3264101 - RNA, 16 nt, Vaccinia virus
uuuaacgccuuccauu

SEQ ID NO: 3264102 - RNA, 13 nt, Vaccinia virus
gucaauugauucu

SEQ ID NO: 3264103 - RNA, 17 nt, Vaccinia virus
cauuacuaauacucaau

SEQ ID NO: 3264104 - RNA, 14 nt, Vaccinia virus
ugauuagaaaauau

SEQ ID NO: 3264105 - RNA, 12 nt, Vaccinia virus
ucuuuuaaauau

SEQ ID NO: 3264106 - RNA, 20 nt, Vaccinia virus
acaauacugcgacuuuguua

SEQ ID NO: 3264107 - RNA, 13 nt, Vaccinia virus
gucaaugauuuca

SEQ ID NO: 3264108 - RNA, 13 nt, Vaccinia virus
gcucauaaacuca

SEQ ID NO: 3264109 - RNA, 22 nt, Vaccinia virus
aaguuacaaacaacuaggaaau

SEQ ID NO: 3264110 - RNA, 11 nt, Vaccinia virus
cagucaugaaa

SEQ ID NO: 3264111 - RNA, 15 nt, Vaccinia virus
uaauauaaacaucuu

SEQ ID NO: 3264112 - RNA, 16 nt, Vaccinia virus
uuucagaaucuagauu

SEQ ID NO: 3264113 - RNA, 19 nt, Vaccinia virus
aauuacuuugacaaaugua

SEQ ID NO: 3264114 - RNA, 20 nt, Vaccinia virus
uauacacguuagauuauucu

SEQ ID NO: 3264115 - RNA, 12 nt, Vaccinia virus
auacuaguuuuc

SEQ ID NO: 3264116 - RNA, 15 nt, Vaccinia virus
ugauaccaugaaauu

SEQ ID NO: 3264117 - RNA, 16 nt, Vaccinia virus
ucuucugucaauugau

SEQ ID NO: 3264118 - RNA, 13 nt, Vaccinia virus
acuaucuguaaaa

SEQ ID NO: 3264119 - RNA, 12 nt, Vaccinia virus
aucaucugaaaa

SEQ ID NO: 3264120 - RNA, 21 nt, Vaccinia virus
uauugaagaagaugacaaucu

SEQ ID NO: 3264121 - RNA, 17 nt, Vaccinia virus
uguauucuuuuuaagau

SEQ ID NO: 3264122 - RNA, 19 nt, Vaccinia virus
gacuugucaaaucuauaua

SEQ ID NO: 3264123 - RNA, 19 nt, Vaccinia virus
aaagcaagaccaaacaccg

SEQ ID NO: 3264124 - RNA, 13 nt, Vaccinia virus
cuuacaaaguuuu

SEQ ID NO: 3264125 - RNA, 16 nt, Vaccinia virus
ccuugagaauauccau

SEQ ID NO: 3264126 - RNA, 21 nt, Vaccinia virus
uaaucuaaaauaguucuguaa

SEQ ID NO: 3264127 - RNA, 22 nt, Vaccinia virus
uauuaaacaaggacauuguaaa

SEQ ID NO: 3264128 - RNA, 20 nt, Vaccinia virus
uaagaugcaaacauuaugua

SEQ ID NO: 3264129 - RNA, 17 nt, Vaccinia virus
aaauacuuaacagagga

SEQ ID NO: 3264130 - RNA, 12 nt, Vaccinia virus
uugauugccaua

SEQ ID NO: 3264131 - RNA, 14 nt, Vaccinia virus
auaaagaugauaua

SEQ ID NO: 3264132 - RNA, 20 nt, Vaccinia virus
auaaccggcaagaaagugaa

SEQ ID NO: 3264133 - RNA, 17 nt, Vaccinia virus
ugagcaaagauuguucu

SEQ ID NO: 3264134 - RNA, 16 nt, Vaccinia virus
ucaucauuuuuucacc

SEQ ID NO: 3264135 - RNA, 22 nt, Vaccinia virus
uuuucuacugaugcauguauuu

SEQ ID NO: 3264136 - RNA, 17 nt, Vaccinia virus
uccaucauuucauuaau

SEQ ID NO: 3264137 - RNA, 23 nt, Vaccinia virus
aucauuugacgauauuucuggaa

SEQ ID NO: 3264138 - RNA, 11 nt, Vaccinia virus
augucauauag

SEQ ID NO: 3264139 - RNA, 16 nt, Vaccinia virus
uaauaugacucaugau

SEQ ID NO: 3264140 - RNA, 23 nt, Vaccinia virus
augcaaacuuacagaaacaauga

SEQ ID NO: 3264141 - RNA, 17 nt, Vaccinia virus
agaugauaauuuauaca

SEQ ID NO: 3264142 - RNA, 17 nt, Vaccinia virus
agucaauguuuuugaaa

SEQ ID NO: 3264143 - RNA, 18 nt, Vaccinia virus
ugauucauucacuaucaa

SEQ ID NO: 3264144 - RNA, 20 nt, Vaccinia virus
aaucuuggcauauugaucau

SEQ ID NO: 3264145 - RNA, 19 nt, Vaccinia virus
aauauauuauuaguuuaua

SEQ ID NO: 3264146 - RNA, 19 nt, Vaccinia virus
auuuguucguaugucauaa

SEQ ID NO: 3264147 - RNA, 22 nt, Vaccinia virus
aaacucuuuagcgguauaauua

SEQ ID NO: 3264148 - RNA, 19 nt, Vaccinia virus
ucagacgaguguaaacacu

SEQ ID NO: 3264149 - RNA, 15 nt, Vaccinia virus
augacucucaaauua

SEQ ID NO: 3264150 - RNA, 20 nt, Vaccinia virus
ucgauuacauuuaugggaua

SEQ ID NO: 3264151 - RNA, 17 nt, Vaccinia virus
ccuagucauauguuuaa

SEQ ID NO: 3264152 - RNA, 16 nt, Vaccinia virus
uauucaucaucaauau

SEQ ID NO: 3264153 - RNA, 20 nt, Vaccinia virus
guaaaaaaauuauacuguaa

SEQ ID NO: 3264154 - RNA, 20 nt, Vaccinia virus
aaaauucuuaaaauaauuua

SEQ ID NO: 3264155 - RNA, 13 nt, Vaccinia virus
acagauaaugaua

SEQ ID NO: 3264156 - RNA, 21 nt, Vaccinia virus
cauaaacgauugcugcuguuc

SEQ ID NO: 3264157 - RNA, 18 nt, Vaccinia virus
agaauguuccuaauguau

SEQ ID NO: 3264158 - RNA, 12 nt, Vaccinia virus
auaaaucauauu

SEQ ID NO: 3264159 - RNA, 17 nt, Vaccinia virus
auaugaaaaaacauuau

SEQ ID NO: 3264160 - RNA, 11 nt, Vaccinia virus
cuauagaaaau

SEQ ID NO: 3264161 - RNA, 18 nt, Vaccinia virus
auuauuacauagauguau

SEQ ID NO: 3264162 - RNA, 13 nt, Vaccinia virus
caacgagauaucu

SEQ ID NO: 3264163 - RNA, 16 nt, Vaccinia virus
gcugaaugaucuuuuu

SEQ ID NO: 3264164 - RNA, 18 nt, Vaccinia virus
auggaucaccguguuuau

SEQ ID NO: 3264165 - RNA, 13 nt, Vaccinia virus
gaaauauucuguu

SEQ ID NO: 3264166 - RNA, 14 nt, Vaccinia virus
uaaauuuuaucaug

SEQ ID NO: 3264167 - RNA, 16 nt, Vaccinia virus
gaacucuuugauuuug

SEQ ID NO: 3264168 - RNA, 19 nt, Vaccinia virus
aauuacugauaauguagaa

SEQ ID NO: 3264169 - RNA, 19 nt, Vaccinia virus
ugaugucguuauucugaaa

SEQ ID NO: 3264170 - RNA, 17 nt, Vaccinia virus
agucauguuaaaaauga

SEQ ID NO: 3264171 - RNA, 23 nt, Vaccinia virus
cagauuguugccguaaauccugc

SEQ ID NO: 3264172 - RNA, 16 nt, Vaccinia virus
gcauacuuuguaaucu

SEQ ID NO: 3264173 - RNA, 15 nt, Vaccinia virus
ucuaucgacaucaga

SEQ ID NO: 3264174 - RNA, 16 nt, Vaccinia virus
agucaagucaaugaua

SEQ ID NO: 3264175 - RNA, 21 nt, Vaccinia virus
caauaugucuguacaaauguu

SEQ ID NO: 3264176 - RNA, 14 nt, Vaccinia virus
acauuaauagaaug

SEQ ID NO: 3264177 - RNA, 16 nt, Vaccinia virus
uaauagaaugaagaau

SEQ ID NO: 3264178 - RNA, 15 nt, Vaccinia virus
auuauguaaaacaaa

SEQ ID NO: 3264179 - RNA, 20 nt, Vaccinia virus
uggaagagucuucaacgaua

SEQ ID NO: 3264180 - RNA, 23 nt, Vaccinia virus
uauaggauggcgacgguaacugc

SEQ ID NO: 3264181 - RNA, 21 nt, Vaccinia virus
aaauuccaaauuuuuuucauu

SEQ ID NO: 3264182 - RNA, 20 nt, Vaccinia virus
uaacaccuauaagauuauca

SEQ ID NO: 3264183 - RNA, 18 nt, Vaccinia virus
aacguucacguaaauaca

SEQ ID NO: 3264184 - RNA, 18 nt, Vaccinia virus
aaucuaggaauuacauaa

SEQ ID NO: 3264185 - RNA, 21 nt, Vaccinia virus
cugaagauuguugaaauugua

SEQ ID NO: 3264186 - RNA, 18 nt, Vaccinia virus
aguuuauaucaauaagaa

SEQ ID NO: 3264187 - RNA, 20 nt, Vaccinia virus
auaaaaguuccagaaaaugu

SEQ ID NO: 3264188 - RNA, 17 nt, Vaccinia virus
aauguuugacugaauau

SEQ ID NO: 3264189 - RNA, 17 nt, Vaccinia virus
agucauuucugaugaaa

SEQ ID NO: 3264190 - RNA, 19 nt, Vaccinia virus
auaacuucuagauguagaa

SEQ ID NO: 3264191 - RNA, 20 nt, Vaccinia virus
ucucgaaagacguuguacaa

SEQ ID NO: 3264192 - RNA, 18 nt, Vaccinia virus
uauaaaugaaguacuguu

SEQ ID NO: 3264193 - RNA, 14 nt, Vaccinia virus
ucacuguuguacau

SEQ ID NO: 3264194 - RNA, 17 nt, Vaccinia virus
auccuuuagauggugau

SEQ ID NO: 3264195 - RNA, 15 nt, Vaccinia virus
augcagaaguaauga

SEQ ID NO: 3264196 - RNA, 13 nt, Vaccinia virus
auucuaaauggau

SEQ ID NO: 3264197 - RNA, 22 nt, Vaccinia virus
uacauauaccgccuuucaaaau

SEQ ID NO: 3264198 - RNA, 12 nt, Vaccinia virus
aauacuguaaua

SEQ ID NO: 3264199 - RNA, 17 nt, Vaccinia virus
gaaagcgugauuuuaau

SEQ ID NO: 3264200 - RNA, 16 nt, Vaccinia virus
acugguuaaaauccuc

SEQ ID NO: 3264201 - RNA, 22 nt, Vaccinia virus
gaaauauaaaaccaacuaauau

SEQ ID NO: 3264202 - RNA, 22 nt, Vaccinia virus
uaacuuugauagcaaggaugaa

SEQ ID NO: 3264203 - RNA, 16 nt, Vaccinia virus
uauuuguauuuaucua

SEQ ID NO: 3264204 - RNA, 23 nt, Vaccinia virus
guuuccacaucaaccaaguaaug

SEQ ID NO: 3264205 - RNA, 12 nt, Vaccinia virus
uggaaucacaaa

SEQ ID NO: 3264206 - RNA, 13 nt, Vaccinia virus
guuaguaaucaua

SEQ ID NO: 3264207 - RNA, 15 nt, Vaccinia virus
ugaauggauuuauca

SEQ ID NO: 3264208 - RNA, 17 nt, Vaccinia virus
gggaaauauggaagaaa

SEQ ID NO: 3264209 - RNA, 19 nt, Vaccinia virus
uaauagcuccauaaacuga

SEQ ID NO: 3264210 - RNA, 15 nt, Vaccinia virus
ucgauacauuuugca

SEQ ID NO: 3264211 - RNA, 22 nt, Vaccinia virus
ugauuuuaacgacgacauauua

SEQ ID NO: 3264212 - RNA, 17 nt, Vaccinia virus
auaaaauuaaugagauu

SEQ ID NO: 3264213 - RNA, 14 nt, Vaccinia virus
guuuaauacauuga

SEQ ID NO: 3264214 - RNA, 17 nt, Vaccinia virus
aaccuaacucagucaau

SEQ ID NO: 3264215 - RNA, 13 nt, Vaccinia virus
auauaguuauaga

SEQ ID NO: 3264216 - RNA, 13 nt, Vaccinia virus
acagauuaauagu

SEQ ID NO: 3264217 - RNA, 14 nt, Vaccinia virus
aauucguuagaaua

SEQ ID NO: 3264218 - RNA, 20 nt, Vaccinia virus
gaaucauuuaucauaacuac

SEQ ID NO: 3264219 - RNA, 23 nt, Vaccinia virus
aguauguuaguggacuugucaaa

SEQ ID NO: 3264220 - RNA, 16 nt, Vaccinia virus
gauacagauacagaua

SEQ ID NO: 3264221 - RNA, 14 nt, Vaccinia virus
auuauuuaauggag

SEQ ID NO: 3264222 - RNA, 14 nt, Vaccinia virus
auugaacaauagau

SEQ ID NO: 3264223 - RNA, 15 nt, Vaccinia virus
acgaugauauggaug

SEQ ID NO: 3264224 - RNA, 15 nt, Vaccinia virus
gauauauaucuuuuc

SEQ ID NO: 3264225 - RNA, 16 nt, Vaccinia virus
auuugauauaaugaau

SEQ ID NO: 3264226 - RNA, 20 nt, Vaccinia virus
ucguacaguagagauauuug

SEQ ID NO: 3264227 - RNA, 17 nt, Vaccinia virus
gcauaggaacauuucug

SEQ ID NO: 3264228 - RNA, 13 nt, Vaccinia virus
aacauuugcauua

SEQ ID NO: 3264229 - RNA, 17 nt, Vaccinia virus
uguauucaacaugcuuu

SEQ ID NO: 3264230 - RNA, 16 nt, Vaccinia virus
ucucggacauuucagc

SEQ ID NO: 3264231 - RNA, 14 nt, Vaccinia virus
cuagauauguauuu

SEQ ID NO: 3264232 - RNA, 15 nt, Vaccinia virus
gcuuuucucuuuuaa

SEQ ID NO: 3264233 - RNA, 23 nt, Vaccinia virus
auaucuaggagguggauauuucu

SEQ ID NO: 3264234 - RNA, 15 nt, Vaccinia virus
guuagauguuaaaaa

SEQ ID NO: 3264235 - RNA, 19 nt, Vaccinia virus
ucguacauaaguuguacag

SEQ ID NO: 3264236 - RNA, 15 nt, Vaccinia virus
auccucuaaaggcug

SEQ ID NO: 3264237 - RNA, 20 nt, Vaccinia virus
cauuucugcauuacaaagaa

SEQ ID NO: 3264238 - RNA, 19 nt, Vaccinia virus
gaauuggaauaccaaauau

SEQ ID NO: 3264239 - RNA, 17 nt, Vaccinia virus
aggauuguauaaauuac

SEQ ID NO: 3264240 - RNA, 18 nt, Vaccinia virus
acauuagauacaauggau

SEQ ID NO: 3264241 - RNA, 12 nt, Vaccinia virus
ucuacuaucaaa

SEQ ID NO: 3264242 - RNA, 19 nt, Vaccinia virus
aauguuagagacggaaaua

SEQ ID NO: 3264243 - RNA, 21 nt, Vaccinia virus
guuaauuucacaacuuuacug

SEQ ID NO: 3264244 - RNA, 15 nt, Vaccinia virus
auagaaacuauagau

SEQ ID NO: 3264245 - RNA, 13 nt, Vaccinia virus
aucuauguagaau

SEQ ID NO: 3264246 - RNA, 19 nt, Vaccinia virus
gacucuauaucuauuucug

SEQ ID NO: 3264247 - RNA, 21 nt, Vaccinia virus
uaauaaaaguggaagucauuu

SEQ ID NO: 3264248 - RNA, 12 nt, Vaccinia virus
ucauuuguacau

SEQ ID NO: 3264249 - RNA, 13 nt, Vaccinia virus
aagauuaguaaau

SEQ ID NO: 3264250 - RNA, 19 nt, Vaccinia virus
acguauauuuagauguuuu

SEQ ID NO: 3264251 - RNA, 14 nt, Vaccinia virus
gaugucuauguacg

SEQ ID NO: 3264252 - RNA, 12 nt, Vaccinia virus
cguauacucuac

SEQ ID NO: 3264253 - RNA, 16 nt, Vaccinia virus
caagagauauauugga

SEQ ID NO: 3264254 - RNA, 21 nt, Vaccinia virus
aucucaaaauagguacucugu

SEQ ID NO: 3264255 - RNA, 21 nt, Vaccinia virus
uauuguuuggguaaaacagau

SEQ ID NO: 3264256 - RNA, 17 nt, Vaccinia virus
cgaauauaaaucauauu

SEQ ID NO: 3264257 - RNA, 15 nt, Vaccinia virus
uauaauacaggauua

SEQ ID NO: 3264258 - RNA, 16 nt, Vaccinia virus
uauuccuguuaucauc

SEQ ID NO: 3264259 - RNA, 18 nt, Vaccinia virus
cauaaauacacuuuuaua

SEQ ID NO: 3264260 - RNA, 20 nt, Vaccinia virus
aagucacaaagcaagaccaa

SEQ ID NO: 3264261 - RNA, 19 nt, Vaccinia virus
uuacaauguagaaauuaga

SEQ ID NO: 3264262 - RNA, 20 nt, Vaccinia virus
gauauauaguaaugaagaga

SEQ ID NO: 3264263 - RNA, 16 nt, Vaccinia virus
aacuugcaaaaaagac

SEQ ID NO: 3264264 - RNA, 15 nt, Vaccinia virus
gaugauauagaucuu

SEQ ID NO: 3264265 - RNA, 22 nt, Vaccinia virus
agaauauaacgugguaucuucu

SEQ ID NO: 3264266 - RNA, 19 nt, Vaccinia virus
acugcugcguuaaacauuc

SEQ ID NO: 3264267 - RNA, 17 nt, Vaccinia virus
cuauaaugacaauaaaa

SEQ ID NO: 3264268 - RNA, 12 nt, Vaccinia virus
aaggacaaaguu

SEQ ID NO: 3264269 - RNA, 15 nt, Vaccinia virus
uucaagauuaucuuu

SEQ ID NO: 3264270 - RNA, 17 nt, Vaccinia virus
uuaaaugaugaaacuaa

SEQ ID NO: 3264271 - RNA, 21 nt, Vaccinia virus
guuauuacuaaggauguauua

SEQ ID NO: 3264272 - RNA, 19 nt, Vaccinia virus
aggaaugauugccuucauc

SEQ ID NO: 3264273 - RNA, 14 nt, Vaccinia virus
aucaagaguaacua

SEQ ID NO: 3264274 - RNA, 20 nt, Vaccinia virus
aauccaauugauugacuauc

SEQ ID NO: 3264275 - RNA, 16 nt, Vaccinia virus
gaaauagauccuucaa

SEQ ID NO: 3264276 - RNA, 20 nt, Vaccinia virus
uuaaacgaauaaaagauauu

SEQ ID NO: 3264277 - RNA, 14 nt, Vaccinia virus
cuuuaaucuauauu

SEQ ID NO: 3264278 - RNA, 14 nt, Vaccinia virus
aagcaauaaauaca

SEQ ID NO: 3264279 - RNA, 11 nt, Vaccinia virus
ucauuucaguu

SEQ ID NO: 3264280 - RNA, 20 nt, Vaccinia virus
uaucagucacgauguaggaa

SEQ ID NO: 3264281 - RNA, 12 nt, Vaccinia virus
aaaaauaaacaa

SEQ ID NO: 3264282 - RNA, 17 nt, Vaccinia virus
uaaauucaaccaugaau

SEQ ID NO: 3264283 - RNA, 14 nt, Vaccinia virus
aacaaaaaaguuau

SEQ ID NO: 3264284 - RNA, 22 nt, Vaccinia virus
uaucguauauuaaguugggaga

SEQ ID NO: 3264285 - RNA, 15 nt, Vaccinia virus
auauuaaugcauuua

SEQ ID NO: 3264286 - RNA, 24 nt, Vaccinia virus
ucaaagagaacguaguagauuguu

SEQ ID NO: 3264287 - RNA, 22 nt, Vaccinia virus
cuauacagcgaauagauucaga

SEQ ID NO: 3264288 - RNA, 22 nt, Vaccinia virus
aggaauuggaauccaauuguuu

SEQ ID NO: 3264289 - RNA, 15 nt, Vaccinia virus
cuggauauauuuugc

SEQ ID NO: 3264290 - RNA, 15 nt, Vaccinia virus
gcaauuauauaaugu

SEQ ID NO: 3264291 - RNA, 19 nt, Vaccinia virus
cgauauuaaccuaaaagag

SEQ ID NO: 3264292 - RNA, 13 nt, Vaccinia virus
aucaugaugauuu

SEQ ID NO: 3264293 - RNA, 13 nt, Vaccinia virus
aguuuuucuggaa

SEQ ID NO: 3264294 - RNA, 19 nt, Vaccinia virus
caaaacaacauauacacau

SEQ ID NO: 3264295 - RNA, 19 nt, Vaccinia virus
gaaucuagauuccaaucau

SEQ ID NO: 3264296 - RNA, 13 nt, Vaccinia virus
uguuuuuaucauc

SEQ ID NO: 3264297 - RNA, 13 nt, Vaccinia virus
gcaaaaauaauau

SEQ ID NO: 3264298 - RNA, 16 nt, Vaccinia virus
caaucacuacaauaau

SEQ ID NO: 3264299 - RNA, 21 nt, Vaccinia virus
aaaguuucugaaauaagauua

SEQ ID NO: 3264300 - RNA, 17 nt, Vaccinia virus
gcuucuuuaauuuuuua

SEQ ID NO: 3264301 - RNA, 18 nt, Vaccinia virus
aacgcuacuauauauuau

SEQ ID NO: 3264302 - RNA, 18 nt, Vaccinia virus
agaaucagaaucauacaa

SEQ ID NO: 3264303 - RNA, 22 nt, Vaccinia virus
aauugcauacacuacaagacaa

SEQ ID NO: 3264304 - RNA, 13 nt, Vaccinia virus
agaugcuauguau

SEQ ID NO: 3264305 - RNA, 17 nt, Vaccinia virus
aggacguaauacaugca

SEQ ID NO: 3264306 - RNA, 14 nt, Vaccinia virus
auccaagauacuua

SEQ ID NO: 3264307 - RNA, 17 nt, Vaccinia virus
gaauuaauguaaucauu

SEQ ID NO: 3264308 - RNA, 14 nt, Vaccinia virus
ucaaugaagaguau

SEQ ID NO: 3264309 - RNA, 14 nt, Vaccinia virus
aucuucaugccuuu

SEQ ID NO: 3264310 - RNA, 21 nt, Vaccinia virus
accauaucgccguaauguaag

SEQ ID NO: 3264311 - RNA, 10 nt, Vaccinia virus
acuaaacaaa

SEQ ID NO: 3264312 - RNA, 22 nt, Vaccinia virus
aucaauaagaaaguuaagaauu

SEQ ID NO: 3264313 - RNA, 12 nt, Vaccinia virus
aauauuaaacaa

SEQ ID NO: 3264314 - RNA, 17 nt, Vaccinia virus
uaguuucugguuuucua

SEQ ID NO: 3264315 - RNA, 17 nt, Vaccinia virus
uauaucauuuguuuuaa

SEQ ID NO: 3264316 - RNA, 15 nt, Vaccinia virus
uuaaaauuauuaaac

SEQ ID NO: 3264317 - RNA, 22 nt, Vaccinia virus
uauaugcaguuuuaagauguca

SEQ ID NO: 3264318 - RNA, 20 nt, Vaccinia virus
gcauuagaugaaaaauggaa

SEQ ID NO: 3264319 - RNA, 12 nt, Vaccinia virus
aauauucagagu

SEQ ID NO: 3264320 - RNA, 17 nt, Vaccinia virus
auuuguucaaacuuugu

SEQ ID NO: 3264321 - RNA, 13 nt, Vaccinia virus
guucguucuggga

SEQ ID NO: 3264322 - RNA, 16 nt, Vaccinia virus
uucuagaucaagaaac

SEQ ID NO: 3264323 - RNA, 16 nt, Vaccinia virus
auuucaaauauauuua

SEQ ID NO: 3264324 - RNA, 16 nt, Vaccinia virus
aagaugauauaaguua

SEQ ID NO: 3264325 - RNA, 15 nt, Vaccinia virus
acaauuacacuacau

SEQ ID NO: 3264326 - RNA, 19 nt, Vaccinia virus
gguagcuuccagauuuaaa

SEQ ID NO: 3264327 - RNA, 17 nt, Vaccinia virus
auggaagaguuaaugaa

SEQ ID NO: 3264328 - RNA, 19 nt, Vaccinia virus
acauccuuccaagaagaag

SEQ ID NO: 3264329 - RNA, 22 nt, Vaccinia virus
auguauccguaaaguaauuucc

SEQ ID NO: 3264330 - RNA, 14 nt, Vaccinia virus
auuacuauuuguaa

SEQ ID NO: 3264331 - RNA, 15 nt, Vaccinia virus
cuuacauaaaugucu

SEQ ID NO: 3264332 - RNA, 19 nt, Vaccinia virus
uguguagaaaguguuacau

SEQ ID NO: 3264333 - RNA, 23 nt, Vaccinia virus
ucgcaauauucaucaauuuagau

SEQ ID NO: 3264334 - RNA, 16 nt, Vaccinia virus
uucauaaaguugcugg

SEQ ID NO: 3264335 - RNA, 20 nt, Vaccinia virus
uuauacgcauaaauuguaaa

SEQ ID NO: 3264336 - RNA, 15 nt, Vaccinia virus
aaguauuuauacaaa

SEQ ID NO: 3264337 - RNA, 13 nt, Vaccinia virus
guuuccuguaaau

SEQ ID NO: 3264338 - RNA, 16 nt, Vaccinia virus
acaaucucuauaucua

SEQ ID NO: 3264339 - RNA, 14 nt, Vaccinia virus
ucuccgauaucuaa

SEQ ID NO: 3264340 - RNA, 19 nt, Vaccinia virus
uguaauuggaguaacuguu

SEQ ID NO: 3264341 - RNA, 16 nt, Vaccinia virus
ugauaacacauauuca

SEQ ID NO: 3264342 - RNA, 17 nt, Vaccinia virus
aaucucaucaucgaaga

SEQ ID NO: 3264343 - RNA, 20 nt, Vaccinia virus
uacaauauuuaaaagacuua

SEQ ID NO: 3264344 - RNA, 14 nt, Vaccinia virus
gaacagauaguuua

SEQ ID NO: 3264345 - RNA, 23 nt, Vaccinia virus
cauaugaugaacuaauaaaggaa

SEQ ID NO: 3264346 - RNA, 17 nt, Vaccinia virus
uauaguagaauuucauu

SEQ ID NO: 3264347 - RNA, 23 nt, Vaccinia virus
uuuaauauccaaucuuauuacuu

SEQ ID NO: 3264348 - RNA, 19 nt, Vaccinia virus
gauaacaauagucuuguaa

SEQ ID NO: 3264349 - RNA, 20 nt, Vaccinia virus
uuacguggagaaaucauguu

SEQ ID NO: 3264350 - RNA, 20 nt, Vaccinia virus
uuauaaaaaaaucauuucga

SEQ ID NO: 3264351 - RNA, 15 nt, Vaccinia virus
auuaaugagaucuuc

SEQ ID NO: 3264352 - RNA, 22 nt, Vaccinia virus
auauuaacgcguuuuaugaaug

SEQ ID NO: 3264353 - RNA, 17 nt, Vaccinia virus
gcaaccguuagauguag

SEQ ID NO: 3264354 - RNA, 12 nt, Vaccinia virus
ucguuacaaaag

SEQ ID NO: 3264355 - RNA, 16 nt, Vaccinia virus
ccacuucggauccaua

SEQ ID NO: 3264356 - RNA, 23 nt, Vaccinia virus
cguaaaccauuuuucagaaagua

SEQ ID NO: 3264357 - RNA, 20 nt, Vaccinia virus
caugucccuauuauaaucau

SEQ ID NO: 3264358 - RNA, 22 nt, Vaccinia virus
uauacagcuggagauuaucauc

SEQ ID NO: 3264359 - RNA, 20 nt, Vaccinia virus
ucauccguuuccuuaugaag

SEQ ID NO: 3264360 - RNA, 21 nt, Vaccinia virus
uauuuaucucuucauuauaua

SEQ ID NO: 3264361 - RNA, 16 nt, Vaccinia virus
caaaauauguaacaau

SEQ ID NO: 3264362 - RNA, 15 nt, Vaccinia virus
aauuauaaaauuaua

SEQ ID NO: 3264363 - RNA, 21 nt, Vaccinia virus
ugcugaccuggaaaaauacuu

SEQ ID NO: 3264364 - RNA, 15 nt, Vaccinia virus
guucucguucguaau

SEQ ID NO: 3264365 - RNA, 18 nt, Vaccinia virus
guagaucacguuaaauca

SEQ ID NO: 3264366 - RNA, 19 nt, Vaccinia virus
aucgauccaugagaaauac

SEQ ID NO: 3264367 - RNA, 16 nt, Vaccinia virus
aauaaguguagcaaau

SEQ ID NO: 3264368 - RNA, 12 nt, Vaccinia virus
ugacaauaauua

SEQ ID NO: 3264369 - RNA, 16 nt, Vaccinia virus
ugacguauuggaugau

SEQ ID NO: 3264370 - RNA, 21 nt, Vaccinia virus
uucagaaagacgaauacauau

SEQ ID NO: 3264371 - RNA, 22 nt, Vaccinia virus
guugaugaggcacauaauaucu

SEQ ID NO: 3264372 - RNA, 16 nt, Vaccinia virus
uuugacuuacauaaau

SEQ ID NO: 3264373 - RNA, 15 nt, Vaccinia virus
augauuaucaaacac

SEQ ID NO: 3264374 - RNA, 20 nt, Vaccinia virus
aaugcuucagaauuagaaca

SEQ ID NO: 3264375 - RNA, 14 nt, Vaccinia virus
uugacaaauuauuc

SEQ ID NO: 3264376 - RNA, 15 nt, Vaccinia virus
uggauguacauguau

SEQ ID NO: 3264377 - RNA, 21 nt, Vaccinia virus
ucuauaaacgaugguuuaauu

SEQ ID NO: 3264378 - RNA, 13 nt, Vaccinia virus
aaaauauguauaa

SEQ ID NO: 3264379 - RNA, 13 nt, Vaccinia virus
uuccauaaacagu

SEQ ID NO: 3264380 - RNA, 21 nt, Vaccinia virus
gauuaaaaauaaaguuaucau

SEQ ID NO: 3264381 - RNA, 13 nt, Vaccinia virus
aguaaaugaaugc

SEQ ID NO: 3264382 - RNA, 15 nt, Vaccinia virus
augauaaacuaacua

SEQ ID NO: 3264383 - RNA, 18 nt, Vaccinia virus
gucuaguaaguagaaauu

SEQ ID NO: 3264384 - RNA, 19 nt, Vaccinia virus
cucuccuagguuucucuau

SEQ ID NO: 3264385 - RNA, 21 nt, Vaccinia virus
augauauugcgcauaauuucc

SEQ ID NO: 3264386 - RNA, 13 nt, Vaccinia virus
uuucccauacuaa

SEQ ID NO: 3264387 - RNA, 15 nt, Vaccinia virus
gaaaucauauaugau

SEQ ID NO: 3264388 - RNA, 17 nt, Vaccinia virus
cagaaccuauuaacgau

SEQ ID NO: 3264389 - RNA, 13 nt, Vaccinia virus
uguaucaaagaua

SEQ ID NO: 3264390 - RNA, 18 nt, Vaccinia virus
auuaggaaaaguauucug

SEQ ID NO: 3264391 - RNA, 19 nt, Vaccinia virus
aaaucuaacagauacaaau

SEQ ID NO: 3264392 - RNA, 17 nt, Vaccinia virus
uguauaacaaauacaga

SEQ ID NO: 3264393 - RNA, 19 nt, Vaccinia virus
acuguugccaaugauguca

SEQ ID NO: 3264394 - RNA, 12 nt, Vaccinia virus
cgaauaaaagau

SEQ ID NO: 3264395 - RNA, 14 nt, Vaccinia virus
guaucucaauauga

SEQ ID NO: 3264396 - RNA, 22 nt, Vaccinia virus
cuaauagauguauuugauauac

SEQ ID NO: 3264397 - RNA, 18 nt, Vaccinia virus
aguauuuauacuacuaau

SEQ ID NO: 3264398 - RNA, 23 nt, Vaccinia virus
auucuucuuuaaacgauuuucca

SEQ ID NO: 3264399 - RNA, 18 nt, Vaccinia virus
uuuaaugacgaauucaua

SEQ ID NO: 3264400 - RNA, 19 nt, Vaccinia virus
cauugacggauaaaacaaa

SEQ ID NO: 3264401 - RNA, 15 nt, Vaccinia virus
cauuaccucaugaac

SEQ ID NO: 3264402 - RNA, 15 nt, Vaccinia virus
aucucuaacuacuau

SEQ ID NO: 3264403 - RNA, 20 nt, Vaccinia virus
uaguuaauggagaaauacuu

SEQ ID NO: 3264404 - RNA, 17 nt, Vaccinia virus
aauugaccguguaauau

SEQ ID NO: 3264405 - RNA, 20 nt, Vaccinia virus
uaacaggggaaugaacagca

SEQ ID NO: 3264406 - RNA, 22 nt, Vaccinia virus
uuagaaaaaaugaugcugguua

SEQ ID NO: 3264407 - RNA, 12 nt, Vaccinia virus
cuucgcaauaau

SEQ ID NO: 3264408 - RNA, 17 nt, Vaccinia virus
aguacuacuagguagaa

SEQ ID NO: 3264409 - RNA, 12 nt, Vaccinia virus
gccaaaaugaua

SEQ ID NO: 3264410 - RNA, 22 nt, Vaccinia virus
guguuccggagaaucaguaaag

SEQ ID NO: 3264411 - RNA, 19 nt, Vaccinia virus
acaaauuaaacucuggaau

SEQ ID NO: 3264412 - RNA, 15 nt, Vaccinia virus
auccguagaaauaug

SEQ ID NO: 3264413 - RNA, 19 nt, Vaccinia virus
uuaucagugucguaaauua

SEQ ID NO: 3264414 - RNA, 22 nt, Vaccinia virus
auuguccauaggauacuuugua

SEQ ID NO: 3264415 - RNA, 21 nt, Vaccinia virus
auuugucuuccuuaacuauau

SEQ ID NO: 3264416 - RNA, 14 nt, Vaccinia virus
cuaguagaaaagau

SEQ ID NO: 3264417 - RNA, 13 nt, Vaccinia virus
cuggaucuggaaa

SEQ ID NO: 3264418 - RNA, 14 nt, Vaccinia virus
guuuaauauugcac

SEQ ID NO: 3264419 - RNA, 21 nt, Vaccinia virus
aauguuaagcauauccugaau

SEQ ID NO: 3264420 - RNA, 17 nt, Vaccinia virus
aggcaaaagaugucaag

SEQ ID NO: 3264421 - RNA, 15 nt, Vaccinia virus
aaucuaguaaaacuu

SEQ ID NO: 3264422 - RNA, 18 nt, Vaccinia virus
augccuuaggauauguaa

SEQ ID NO: 3264423 - RNA, 18 nt, Vaccinia virus
gaaucgauuuuguaauau

SEQ ID NO: 3264424 - RNA, 18 nt, Vaccinia virus
uauggagcgaguguuaca

SEQ ID NO: 3264425 - RNA, 13 nt, Vaccinia virus
agacauaaauaaa

SEQ ID NO: 3264426 - RNA, 22 nt, Vaccinia virus
auguguguccggaguuagaaag

SEQ ID NO: 3264427 - RNA, 22 nt, Vaccinia virus
acagacuguuauaaucaaagau

SEQ ID NO: 3264428 - RNA, 15 nt, Vaccinia virus
gauagccaacuauac

SEQ ID NO: 3264429 - RNA, 22 nt, Vaccinia virus
uuaauuuccggaucuacauuuu

SEQ ID NO: 3264430 - RNA, 18 nt, Vaccinia virus
auucucauuaauuaacca

SEQ ID NO: 3264431 - RNA, 20 nt, Vaccinia virus
acagguagaauuuauaaaca

SEQ ID NO: 3264432 - RNA, 20 nt, Vaccinia virus
caugacuuaugaauacuaau

SEQ ID NO: 3264433 - RNA, 11 nt, Vaccinia virus
cguugaugaau

SEQ ID NO: 3264434 - RNA, 23 nt, Vaccinia virus
caaaauuaacagauaaaaagacu

SEQ ID NO: 3264435 - RNA, 12 nt, Vaccinia virus
gauguauccaca

SEQ ID NO: 3264436 - RNA, 16 nt, Vaccinia virus
guauacuugucaucau

SEQ ID NO: 3264437 - RNA, 13 nt, Vaccinia virus
uggauguagauuu

SEQ ID NO: 3264438 - RNA, 17 nt, Vaccinia virus
gguaugauuuuugucca

SEQ ID NO: 3264439 - RNA, 15 nt, Vaccinia virus
acaaugauaaugaua

SEQ ID NO: 3264440 - RNA, 20 nt, Vaccinia virus
uuuuaggauaugcuuucaua

SEQ ID NO: 3264441 - RNA, 19 nt, Vaccinia virus
guggucaauuacaaauaaa

SEQ ID NO: 3264442 - RNA, 21 nt, Vaccinia virus
auagauggcacuguucuauga

SEQ ID NO: 3264443 - RNA, 13 nt, Vaccinia virus
auauauuagaaau

SEQ ID NO: 3264444 - RNA, 16 nt, Vaccinia virus
cuccuuuaaaauuaau

SEQ ID NO: 3264445 - RNA, 19 nt, Vaccinia virus
aucaaaaucguauaaaguu

SEQ ID NO: 3264446 - RNA, 17 nt, Vaccinia virus
gaugacuccaucuuuua

SEQ ID NO: 3264447 - RNA, 20 nt, Vaccinia virus
uaacaugcgguucaaaauag

SEQ ID NO: 3264448 - RNA, 17 nt, Vaccinia virus
uuauugauaaagaucua

SEQ ID NO: 3264449 - RNA, 20 nt, Vaccinia virus
caacagacgagacuccggaa

SEQ ID NO: 3264450 - RNA, 21 nt, Vaccinia virus
uggaaauacuuccaucaacau

SEQ ID NO: 3264451 - RNA, 21 nt, Vaccinia virus
agauacagauguuacaaaugu

SEQ ID NO: 3264452 - RNA, 17 nt, Vaccinia virus
cgucucugccauggaug

SEQ ID NO: 3264453 - RNA, 16 nt, Vaccinia virus
agauauaucuacuucu

SEQ ID NO: 3264454 - RNA, 17 nt, Vaccinia virus
gcagucggauuggaaca

SEQ ID NO: 3264455 - RNA, 15 nt, Vaccinia virus
cgcccaaaauagacg

SEQ ID NO: 3264456 - RNA, 19 nt, Vaccinia virus
aaaaugugucaagaaucua

SEQ ID NO: 3264457 - RNA, 16 nt, Vaccinia virus
acacuacccaauaaau

SEQ ID NO: 3264458 - RNA, 15 nt, Vaccinia virus
gccagaucuucuucu

SEQ ID NO: 3264459 - RNA, 16 nt, Vaccinia virus
gaacagauaguuuauu

SEQ ID NO: 3264460 - RNA, 14 nt, Vaccinia virus
uuaauaauguagua

SEQ ID NO: 3264461 - RNA, 21 nt, Vaccinia virus
aagccauuguugucugaaaua

SEQ ID NO: 3264462 - RNA, 13 nt, Vaccinia virus
aucuauuagaaaa

SEQ ID NO: 3264463 - RNA, 18 nt, Vaccinia virus
augagaucuucuauuuua

SEQ ID NO: 3264464 - RNA, 21 nt, Vaccinia virus
cgucuaccgaaacaucguuua

SEQ ID NO: 3264465 - RNA, 16 nt, Vaccinia virus
agcaucauaaaaauga

SEQ ID NO: 3264466 - RNA, 23 nt, Vaccinia virus
aaugaacaucgggaauauagaau

SEQ ID NO: 3264467 - RNA, 18 nt, Vaccinia virus
ugucccaucagcauguag

SEQ ID NO: 3264468 - RNA, 16 nt, Vaccinia virus
aaucuaaaagaauugg

SEQ ID NO: 3264469 - RNA, 23 nt, Vaccinia virus
aaaaaguauacguccuguggugu

SEQ ID NO: 3264470 - RNA, 15 nt, Vaccinia virus
cuaaucuuuaauaga

SEQ ID NO: 3264471 - RNA, 20 nt, Vaccinia virus
auuagaaaaaguguauucau

SEQ ID NO: 3264472 - RNA, 21 nt, Vaccinia virus
uuaaagauauuguuacaccac

SEQ ID NO: 3264473 - RNA, 16 nt, Vaccinia virus
accaauacuuuuguua

SEQ ID NO: 3264474 - RNA, 16 nt, Vaccinia virus
agugguauaucuuguu

SEQ ID NO: 3264475 - RNA, 22 nt, Vaccinia virus
ccgccuuaaauguaucuuuacu

SEQ ID NO: 3264476 - RNA, 21 nt, Vaccinia virus
auauuuuugauggguaagcca

SEQ ID NO: 3264477 - RNA, 18 nt, Vaccinia virus
ucuagaucucuagaauau

SEQ ID NO: 3264478 - RNA, 19 nt, Vaccinia virus
agaucugaauuaaauaugu

SEQ ID NO: 3264479 - RNA, 16 nt, Vaccinia virus
uauacuugucaucauu

SEQ ID NO: 3264480 - RNA, 22 nt, Vaccinia virus
agacguucacgacacuggaaaa

SEQ ID NO: 3264481 - RNA, 15 nt, Vaccinia virus
gaucuucuacaauau

SEQ ID NO: 3264482 - RNA, 20 nt, Vaccinia virus
aucgugcacccaacguauuu

SEQ ID NO: 3264483 - RNA, 13 nt, Vaccinia virus
aaguucuggaaua

SEQ ID NO: 3264484 - RNA, 16 nt, Vaccinia virus
gccacauuuaguuaac

SEQ ID NO: 3264485 - RNA, 12 nt, Vaccinia virus
aacaguauuauu

SEQ ID NO: 3264486 - RNA, 17 nt, Vaccinia virus
uauuauucauuuucuau

SEQ ID NO: 3264487 - RNA, 23 nt, Vaccinia virus
aaucuuuuuauuaguaggcaucu

SEQ ID NO: 3264488 - RNA, 16 nt, Vaccinia virus
aaaagauacguacugu

SEQ ID NO: 3264489 - RNA, 14 nt, Vaccinia virus
gaaacaauguuucu

SEQ ID NO: 3264490 - RNA, 16 nt, Vaccinia virus
agaagauuaaacauau

SEQ ID NO: 3264491 - RNA, 18 nt, Vaccinia virus
aucaugucuaaugaugaa

SEQ ID NO: 3264492 - RNA, 20 nt, Vaccinia virus
uccgagauaauuucuccaga

SEQ ID NO: 3264493 - RNA, 14 nt, Vaccinia virus
cuaagagaugaaaa

SEQ ID NO: 3264494 - RNA, 16 nt, Vaccinia virus
uauauuuucauuuaaa

SEQ ID NO: 3264495 - RNA, 16 nt, Vaccinia virus
uaacgaugaaaaccag

SEQ ID NO: 3264496 - RNA, 12 nt, Vaccinia virus
aacgaacuagag

SEQ ID NO: 3264497 - RNA, 21 nt, Vaccinia virus
uaaccaaaaugaaaauacuuu

SEQ ID NO: 3264498 - RNA, 18 nt, Vaccinia virus
agcauucgcuaaaaaauu

SEQ ID NO: 3264499 - RNA, 15 nt, Vaccinia virus
acgcgucuuuaacuc

SEQ ID NO: 3264500 - RNA, 22 nt, Vaccinia virus
augauuuggcuagauucaacau

SEQ ID NO: 3264501 - RNA, 13 nt, Vaccinia virus
auaagauuuccaa

SEQ ID NO: 3264502 - RNA, 14 nt, Vaccinia virus
uaaaugauaucuua

SEQ ID NO: 3264503 - RNA, 16 nt, Vaccinia virus
uuaccaacucuuuaau

SEQ ID NO: 3264504 - RNA, 19 nt, Vaccinia virus
gauucuucacaagugaaau

SEQ ID NO: 3264505 - RNA, 16 nt, Vaccinia virus
auaacauuaauaucaa

SEQ ID NO: 3264506 - RNA, 19 nt, Vaccinia virus
uaugacgcaguaacauaua

SEQ ID NO: 3264507 - RNA, 22 nt, Vaccinia virus
uguguuaucagccgcuacagaa

SEQ ID NO: 3264508 - RNA, 18 nt, Vaccinia virus
gugguguaacaauaucuu

SEQ ID NO: 3264509 - RNA, 22 nt, Vaccinia virus
aacaccuugugcauuauguaaa

SEQ ID NO: 3264510 - RNA, 21 nt, Vaccinia virus
agaguaaccccauauaaugua

SEQ ID NO: 3264511 - RNA, 17 nt, Vaccinia virus
auaaccuagaaaauaua

SEQ ID NO: 3264512 - RNA, 17 nt, Vaccinia virus
uucaguuucucaucuuu

SEQ ID NO: 3264513 - RNA, 14 nt, Vaccinia virus
ucuuagcgaaugau

SEQ ID NO: 3264514 - RNA, 14 nt, Vaccinia virus
ugugucuacauaaa

SEQ ID NO: 3264515 - RNA, 18 nt, Vaccinia virus
auugggauaaaaauuaug

SEQ ID NO: 3264516 - RNA, 12 nt, Vaccinia virus
uugcguauacau

SEQ ID NO: 3264517 - RNA, 23 nt, Vaccinia virus
acuaugucaguaguauacaucau

SEQ ID NO: 3264518 - RNA, 18 nt, Vaccinia virus
uucaucggcauauuauua

SEQ ID NO: 3264519 - RNA, 15 nt, Vaccinia virus
uuaaggggaaaaagc

SEQ ID NO: 3264520 - RNA, 22 nt, Vaccinia virus
ggauucauuaauaucuuuauaa

SEQ ID NO: 3264521 - RNA, 16 nt, Vaccinia virus
gaaaauaacaaaucua

SEQ ID NO: 3264522 - RNA, 18 nt, Vaccinia virus
uuuaaaucccaauucaga

SEQ ID NO: 3264523 - RNA, 17 nt, Vaccinia virus
acauuuccgaaugaaug

SEQ ID NO: 3264524 - RNA, 13 nt, Vaccinia virus
caagaauaaacga

SEQ ID NO: 3264525 - RNA, 18 nt, Vaccinia virus
uaaauguuuucucuguaa

SEQ ID NO: 3264526 - RNA, 17 nt, Vaccinia virus
augguaaaauuaaauag

SEQ ID NO: 3264527 - RNA, 21 nt, Vaccinia virus
auauguuuuaauauuuacaag

SEQ ID NO: 3264528 - RNA, 15 nt, Vaccinia virus
gaucuaauuuuucau

SEQ ID NO: 3264529 - RNA, 23 nt, Vaccinia virus
cuguuguauaugaucauuuugau

SEQ ID NO: 3264530 - RNA, 13 nt, Vaccinia virus
aaaauacauaaag

SEQ ID NO: 3264531 - RNA, 21 nt, Vaccinia virus
aucaacgaguucaaauaugaa

SEQ ID NO: 3264532 - RNA, 15 nt, Vaccinia virus
aacucguaaaaagau

SEQ ID NO: 3264533 - RNA, 13 nt, Vaccinia virus
augaucuuaauuu

SEQ ID NO: 3264534 - RNA, 20 nt, Vaccinia virus
acagcacuguggaugugaca

SEQ ID NO: 3264535 - RNA, 20 nt, Vaccinia virus
aacucucuucuauaaaaaug

SEQ ID NO: 3264536 - RNA, 14 nt, Vaccinia virus
aggcauuaacuaga

SEQ ID NO: 3264537 - RNA, 19 nt, Vaccinia virus
uuagaguaguaucauuaaa

SEQ ID NO: 3264538 - RNA, 23 nt, Vaccinia virus
aaaucuuucauuucuuccuggua

SEQ ID NO: 3264539 - RNA, 20 nt, Vaccinia virus
agaaaugaaguuaugacauu

SEQ ID NO: 3264540 - RNA, 22 nt, Vaccinia virus
uccguguaauccauaauccagu

SEQ ID NO: 3264541 - RNA, 17 nt, Vaccinia virus
cuuuugcggacauuuuc

SEQ ID NO: 3264542 - RNA, 19 nt, Vaccinia virus
uuuacccacuauaaaauaa

SEQ ID NO: 3264543 - RNA, 23 nt, Vaccinia virus
gcaguacuacuagguagaagaau

SEQ ID NO: 3264544 - RNA, 14 nt, Vaccinia virus
aaagacuucuuucu

SEQ ID NO: 3264545 - RNA, 21 nt, Vaccinia virus
auauaguucgucauuuaauaa

SEQ ID NO: 3264546 - RNA, 15 nt, Vaccinia virus
auguuagaacuguag

SEQ ID NO: 3264547 - RNA, 15 nt, Vaccinia virus
uagcgacauaaacau

SEQ ID NO: 3264548 - RNA, 19 nt, Vaccinia virus
aaucaaggaacuaaauaga

SEQ ID NO: 3264549 - RNA, 15 nt, Vaccinia virus
gagauuuaguuuauc

SEQ ID NO: 3264550 - RNA, 13 nt, Vaccinia virus
aaccauaaauaca

SEQ ID NO: 3264551 - RNA, 20 nt, Vaccinia virus
uuacugaggggaaaaucaau

SEQ ID NO: 3264552 - RNA, 16 nt, Vaccinia virus
gccaauugucuuucuc

SEQ ID NO: 3264553 - RNA, 18 nt, Vaccinia virus
uuaacgcaccuauaaaga

SEQ ID NO: 3264554 - RNA, 21 nt, Vaccinia virus
caucugauaauuuagauaauu

SEQ ID NO: 3264555 - RNA, 16 nt, Vaccinia virus
agaacacacuuuucuc

SEQ ID NO: 3264556 - RNA, 13 nt, Vaccinia virus
uacggccauccag

SEQ ID NO: 3264557 - RNA, 16 nt, Vaccinia virus
gauauauaucauaaau

SEQ ID NO: 3264558 - RNA, 15 nt, Vaccinia virus
aacuaauauuaggaa

SEQ ID NO: 3264559 - RNA, 12 nt, Vaccinia virus
augauaaaugau

SEQ ID NO: 3264560 - RNA, 16 nt, Vaccinia virus
acaaccucauacuacu

SEQ ID NO: 3264561 - RNA, 13 nt, Vaccinia virus
auaagaacuauau

SEQ ID NO: 3264562 - RNA, 12 nt, Vaccinia virus
uucuguacaaag

SEQ ID NO: 3264563 - RNA, 16 nt, Vaccinia virus
gcaaacuuaacagcuc

SEQ ID NO: 3264564 - RNA, 22 nt, Vaccinia virus
gauucugauaacauaaaaauau

SEQ ID NO: 3264565 - RNA, 19 nt, Vaccinia virus
ccguacaacauacuguuua

SEQ ID NO: 3264566 - RNA, 19 nt, Vaccinia virus
cagagguuaauauagaagc

SEQ ID NO: 3264567 - RNA, 12 nt, Vaccinia virus
aauuauauaaau

SEQ ID NO: 3264568 - RNA, 22 nt, Vaccinia virus
uauacaaggcggauguugugaa

SEQ ID NO: 3264569 - RNA, 16 nt, Vaccinia virus
auuaucaaagucacaa

SEQ ID NO: 3264570 - RNA, 18 nt, Vaccinia virus
auauauuugaaaaucguu

SEQ ID NO: 3264571 - RNA, 14 nt, Vaccinia virus
auugauuuuggaaa

SEQ ID NO: 3264572 - RNA, 16 nt, Vaccinia virus
uaauugaguaaaugaa

SEQ ID NO: 3264573 - RNA, 19 nt, Vaccinia virus
auacaugucuuagauguuc

SEQ ID NO: 3264574 - RNA, 23 nt, Vaccinia virus
aaaaauacaugggaaaugauauc

SEQ ID NO: 3264575 - RNA, 21 nt, Vaccinia virus
aauaugcggaaccucgagaau

SEQ ID NO: 3264576 - RNA, 15 nt, Vaccinia virus
uggaagauauuucca

SEQ ID NO: 3264577 - RNA, 18 nt, Vaccinia virus
cuaugucaaaaauuguag

SEQ ID NO: 3264578 - RNA, 22 nt, Vaccinia virus
auugucugacauaagaugucua

SEQ ID NO: 3264579 - RNA, 14 nt, Vaccinia virus
uucaucaaacauua

SEQ ID NO: 3264580 - RNA, 12 nt, Vaccinia virus
uggauuuggauu

SEQ ID NO: 3264581 - RNA, 13 nt, Vaccinia virus
uauaaauuuuaga

SEQ ID NO: 3264582 - RNA, 20 nt, Vaccinia virus
aucccuucucgcaaauucua

SEQ ID NO: 3264583 - RNA, 15 nt, Vaccinia virus
cgguaacaaauguuc

SEQ ID NO: 3264584 - RNA, 19 nt, Vaccinia virus
auaucgaacaaauuccaag

SEQ ID NO: 3264585 - RNA, 17 nt, Vaccinia virus
auagacuuucucuaaau

SEQ ID NO: 3264586 - RNA, 20 nt, Vaccinia virus
uaauagaucaacagaaauau

SEQ ID NO: 3264587 - RNA, 23 nt, Vaccinia virus
uauaauuuuauugagauuucuga

SEQ ID NO: 3264588 - RNA, 16 nt, Vaccinia virus
aaauagauagaaucua

SEQ ID NO: 3264589 - RNA, 16 nt, Vaccinia virus
aaggcgguauauguau

SEQ ID NO: 3264590 - RNA, 14 nt, Vaccinia virus
uuggauauguggaa

SEQ ID NO: 3264591 - RNA, 19 nt, Vaccinia virus
aaauaauacgaauauauca

SEQ ID NO: 3264592 - RNA, 19 nt, Vaccinia virus
agcuucaucuauaucuaga

SEQ ID NO: 3264593 - RNA, 23 nt, Vaccinia virus
uaaucauauuuagacugauguau

SEQ ID NO: 3264594 - RNA, 19 nt, Vaccinia virus
gaaaucuaucuuauauaca

SEQ ID NO: 3264595 - RNA, 16 nt, Vaccinia virus
agaaaauccuguaaua

SEQ ID NO: 3264596 - RNA, 15 nt, Vaccinia virus
caucuggauuucaga

SEQ ID NO: 3264597 - RNA, 18 nt, Vaccinia virus
gaaaguauagcuaaugau

SEQ ID NO: 3264598 - RNA, 18 nt, Vaccinia virus
aaaucuuuaauugucuug

SEQ ID NO: 3264599 - RNA, 21 nt, Vaccinia virus
ccagaacauugaugagacaau

SEQ ID NO: 3264600 - RNA, 14 nt, Vaccinia virus
auaugacaaacauu

SEQ ID NO: 3264601 - RNA, 14 nt, Vaccinia virus
gacaauauuuaguu

SEQ ID NO: 3264602 - RNA, 17 nt, Vaccinia virus
gaacgaggagacuauau

SEQ ID NO: 3264603 - RNA, 17 nt, Vaccinia virus
acaaagauggcugaaau

SEQ ID NO: 3264604 - RNA, 16 nt, Vaccinia virus
caguucguuugaugau

SEQ ID NO: 3264605 - RNA, 20 nt, Vaccinia virus
aauuaaaaaggaaaauacua

SEQ ID NO: 3264606 - RNA, 16 nt, Vaccinia virus
aucuacacauguauuu

SEQ ID NO: 3264607 - RNA, 14 nt, Vaccinia virus
cuucuacaauaucu

SEQ ID NO: 3264608 - RNA, 17 nt, Vaccinia virus
acuuccaauaaaauuac

SEQ ID NO: 3264609 - RNA, 14 nt, Vaccinia virus
gauauauuuuucau

SEQ ID NO: 3264610 - RNA, 18 nt, Vaccinia virus
cuaguuuucuaaguucua

SEQ ID NO: 3264611 - RNA, 17 nt, Vaccinia virus
aauagauaucaugaaga

SEQ ID NO: 3264612 - RNA, 15 nt, Vaccinia virus
uauccucaaacaucc

SEQ ID NO: 3264613 - RNA, 16 nt, Vaccinia virus
ugaugucaucuuccag

SEQ ID NO: 3264614 - RNA, 15 nt, Vaccinia virus
ucauuaaaauaugug

SEQ ID NO: 3264615 - RNA, 22 nt, Vaccinia virus
ucauaacuugagagcauccagu

SEQ ID NO: 3264616 - RNA, 19 nt, Vaccinia virus
ggauaaucagaauauacac

SEQ ID NO: 3264617 - RNA, 18 nt, Vaccinia virus
cucauauaacuucuagau

SEQ ID NO: 3264618 - RNA, 15 nt, Vaccinia virus
caugggacuauauaa

SEQ ID NO: 3264619 - RNA, 16 nt, Vaccinia virus
gauaacaaauuaaaga

SEQ ID NO: 3264620 - RNA, 13 nt, Vaccinia virus
aguauaaaaauua

SEQ ID NO: 3264621 - RNA, 19 nt, Vaccinia virus
gucacuacguaauaaaagu

SEQ ID NO: 3264622 - RNA, 21 nt, Vaccinia virus
agcgaugauauguuaaauaua

SEQ ID NO: 3264623 - RNA, 12 nt, Vaccinia virus
cauuuuuaggau

SEQ ID NO: 3264624 - RNA, 23 nt, Vaccinia virus
aaaauacauaugacaaacauugu

SEQ ID NO: 3264625 - RNA, 21 nt, Vaccinia virus
caauuuuucagauuuuugaau

SEQ ID NO: 3264626 - RNA, 15 nt, Vaccinia virus
caaggauacacucuc

SEQ ID NO: 3264627 - RNA, 14 nt, Vaccinia virus
uaguuuauaucuuu

SEQ ID NO: 3264628 - RNA, 19 nt, Vaccinia virus
uuugucuuccuuaacuaua

SEQ ID NO: 3264629 - RNA, 13 nt, Vaccinia virus
acacauauccacg

SEQ ID NO: 3264630 - RNA, 22 nt, Vaccinia virus
gucaguaguauacaucaugaaa

SEQ ID NO: 3264631 - RNA, 15 nt, Vaccinia virus
auucugaaacaguau

SEQ ID NO: 3264632 - RNA, 22 nt, Vaccinia virus
gauaguauaccaacuauauuac

SEQ ID NO: 3264633 - RNA, 21 nt, Vaccinia virus
aguauuaaauauuaauaagaa

SEQ ID NO: 3264634 - RNA, 14 nt, Vaccinia virus
aaagaaaucuuaug

SEQ ID NO: 3264635 - RNA, 14 nt, Vaccinia virus
aguggaguaauuua

SEQ ID NO: 3264636 - RNA, 21 nt, Vaccinia virus
aauaauaaccagaaaguuacg

SEQ ID NO: 3264637 - RNA, 16 nt, Vaccinia virus
cuacaucuaugucuuu

SEQ ID NO: 3264638 - RNA, 16 nt, Vaccinia virus
agauccucucuucaac

SEQ ID NO: 3264639 - RNA, 22 nt, Vaccinia virus
agauuucuuuuugggaaaaauu

SEQ ID NO: 3264640 - RNA, 15 nt, Vaccinia virus
cuacucguuuggaau

SEQ ID NO: 3264641 - RNA, 22 nt, Vaccinia virus
aggggaaaaauuauaauguuuc

SEQ ID NO: 3264642 - RNA, 21 nt, Vaccinia virus
ugcuuucugauaguauagaua

SEQ ID NO: 3264643 - RNA, 13 nt, Vaccinia virus
cauaaaacauaau

SEQ ID NO: 3264644 - RNA, 14 nt, Vaccinia virus
acugaguaaaugug

SEQ ID NO: 3264645 - RNA, 23 nt, Vaccinia virus
aauaacucauuuauauauuaaaa

SEQ ID NO: 3264646 - RNA, 21 nt, Vaccinia virus
cauuauggauaaucuauuuac

SEQ ID NO: 3264647 - RNA, 17 nt, Vaccinia virus
agcaaugcuauaccuaa

SEQ ID NO: 3264648 - RNA, 16 nt, Vaccinia virus
aaauaaguaaaaagug

SEQ ID NO: 3264649 - RNA, 16 nt, Vaccinia virus
aaauuuuuaauccaaa

SEQ ID NO: 3264650 - RNA, 16 nt, Vaccinia virus
aaaucuaguuguggaa

SEQ ID NO: 3264651 - RNA, 22 nt, Vaccinia virus
uaaaugaucggaucuaaaaucc

SEQ ID NO: 3264652 - RNA, 13 nt, Vaccinia virus
ugauaaauuauuu

SEQ ID NO: 3264653 - RNA, 20 nt, Vaccinia virus
uuugaaauaucuuaugauga

SEQ ID NO: 3264654 - RNA, 16 nt, Vaccinia virus
auacacaugauugaca

SEQ ID NO: 3264655 - RNA, 13 nt, Vaccinia virus
augucuacauaaa

SEQ ID NO: 3264656 - RNA, 17 nt, Vaccinia virus
ucauuauuauguugaua

SEQ ID NO: 3264657 - RNA, 15 nt, Vaccinia virus
acgacguuuacaucg

SEQ ID NO: 3264658 - RNA, 13 nt, Vaccinia virus
ucaaauagauguu

SEQ ID NO: 3264659 - RNA, 19 nt, Vaccinia virus
acuucaaaguuguuaaaaa

SEQ ID NO: 3264660 - RNA, 15 nt, Vaccinia virus
uagauugacgacuuu

SEQ ID NO: 3264661 - RNA, 18 nt, Vaccinia virus
gaaucacguguuaaacaa

SEQ ID NO: 3264662 - RNA, 15 nt, Vaccinia virus
uccucaggauucuaa

SEQ ID NO: 3264663 - RNA, 16 nt, Vaccinia virus
ucuuuccguacaacau

SEQ ID NO: 3264664 - RNA, 14 nt, Vaccinia virus
ugaaaauaacucuc

SEQ ID NO: 3264665 - RNA, 21 nt, Vaccinia virus
acuguaucaaccggauuuaaa

SEQ ID NO: 3264666 - RNA, 14 nt, Vaccinia virus
acuauauguuccag

SEQ ID NO: 3264667 - RNA, 15 nt, Vaccinia virus
gauaguauuauucau

SEQ ID NO: 3264668 - RNA, 20 nt, Vaccinia virus
uugauaucgcauagaaauac

SEQ ID NO: 3264669 - RNA, 23 nt, Vaccinia virus
cuaaaauaguucuguaauauguc

SEQ ID NO: 3264670 - RNA, 15 nt, Vaccinia virus
auuuucucuugaaaa

SEQ ID NO: 3264671 - RNA, 16 nt, Vaccinia virus
cuggauaauauauacg

SEQ ID NO: 3264672 - RNA, 19 nt, Vaccinia virus
guaauguccaaaucuaguu

SEQ ID NO: 3264673 - RNA, 15 nt, Vaccinia virus
aauagauuuuucaua

SEQ ID NO: 3264674 - RNA, 16 nt, Vaccinia virus
augaucuccacgcaau

SEQ ID NO: 3264675 - RNA, 17 nt, Vaccinia virus
cucuuccgucaccaaaa

SEQ ID NO: 3264676 - RNA, 19 nt, Vaccinia virus
acaaucaucuuggagcaac

SEQ ID NO: 3264677 - RNA, 16 nt, Vaccinia virus
auuagacgaugugaga

SEQ ID NO: 3264678 - RNA, 15 nt, Vaccinia virus
aucuguaaaaguugu

SEQ ID NO: 3264679 - RNA, 16 nt, Vaccinia virus
aauaauauaacucguu

SEQ ID NO: 3264680 - RNA, 20 nt, Vaccinia virus
ucgcaagaauuuauuucuaa

SEQ ID NO: 3264681 - RNA, 15 nt, Vaccinia virus
auaauuauuagaaua

SEQ ID NO: 3264682 - RNA, 18 nt, Vaccinia virus
gauagcauuaauacagua

SEQ ID NO: 3264683 - RNA, 16 nt, Vaccinia virus
guaucuacgauuuuua

SEQ ID NO: 3264684 - RNA, 17 nt, Vaccinia virus
uagaguccauuuaaagu

SEQ ID NO: 3264685 - RNA, 15 nt, Vaccinia virus
gauaacuguuuaaaa

SEQ ID NO: 3264686 - RNA, 13 nt, Vaccinia virus
auucguaaaucuu

SEQ ID NO: 3264687 - RNA, 19 nt, Vaccinia virus
cauauacuauuuauaagau

SEQ ID NO: 3264688 - RNA, 10 nt, Vaccinia virus
cgauauuaau

SEQ ID NO: 3264689 - RNA, 17 nt, Vaccinia virus
ugauguaagucuuacaa

SEQ ID NO: 3264690 - RNA, 14 nt, Vaccinia virus
uuucaucuagauac

SEQ ID NO: 3264691 - RNA, 20 nt, Vaccinia virus
auuaaacaagugauacguaa

SEQ ID NO: 3264692 - RNA, 16 nt, Vaccinia virus
aauaaaucacuuuuua

SEQ ID NO: 3264693 - RNA, 15 nt, Vaccinia virus
acuaugcuauuugca

SEQ ID NO: 3264694 - RNA, 19 nt, Vaccinia virus
gauacaaaaucuaaacaaa

SEQ ID NO: 3264695 - RNA, 17 nt, Vaccinia virus
guaaaaaguuuauuaau

SEQ ID NO: 3264696 - RNA, 17 nt, Vaccinia virus
auaguuuuuuaauucca

SEQ ID NO: 3264697 - RNA, 17 nt, Vaccinia virus
caguccagaaauauuua

SEQ ID NO: 3264698 - RNA, 13 nt, Vaccinia virus
guuaaauuauuau

SEQ ID NO: 3264699 - RNA, 19 nt, Vaccinia virus
ucuuccauguccaauauga

SEQ ID NO: 3264700 - RNA, 15 nt, Vaccinia virus
uuucuuuuuaaugau

SEQ ID NO: 3264701 - RNA, 20 nt, Vaccinia virus
aaaucuaguaucguaucauu

SEQ ID NO: 3264702 - RNA, 19 nt, Vaccinia virus
uauaaaaaaacauuauucu

SEQ ID NO: 3264703 - RNA, 18 nt, Vaccinia virus
agcaaaucuaguaaauca

SEQ ID NO: 3264704 - RNA, 15 nt, Vaccinia virus
cauauugaucauuua

SEQ ID NO: 3264705 - RNA, 21 nt, Vaccinia virus
acauuuucacaaauacuacaa

SEQ ID NO: 3264706 - RNA, 17 nt, Vaccinia virus
uuaauagauauauuaau

SEQ ID NO: 3264707 - RNA, 23 nt, Vaccinia virus
gacguagucgaacguuaguucca

SEQ ID NO: 3264708 - RNA, 16 nt, Vaccinia virus
auaauaggguaucuaa

SEQ ID NO: 3264709 - RNA, 17 nt, Vaccinia virus
gauauccauagauggag

SEQ ID NO: 3264710 - RNA, 15 nt, Vaccinia virus
uauucuauuuuacua

SEQ ID NO: 3264711 - RNA, 19 nt, Vaccinia virus
acuccugguaauacugaug

SEQ ID NO: 3264712 - RNA, 17 nt, Vaccinia virus
uauuucaggaacaggau

SEQ ID NO: 3264713 - RNA, 13 nt, Vaccinia virus
auauaaaaacauu

SEQ ID NO: 3264714 - RNA, 23 nt, Vaccinia virus
cugagauuuguuuuguuaaacaa

SEQ ID NO: 3264715 - RNA, 20 nt, Vaccinia virus
auuccuaccaaacaaaauuu

SEQ ID NO: 3264716 - RNA, 19 nt, Vaccinia virus
augauauauuaaacaagga

SEQ ID NO: 3264717 - RNA, 15 nt, Vaccinia virus
aaacaaaauuuuacu

SEQ ID NO: 3264718 - RNA, 21 nt, Vaccinia virus
gacaauauuuaguuuauucau

SEQ ID NO: 3264719 - RNA, 15 nt, Vaccinia virus
guguccauaauccuc

SEQ ID NO: 3264720 - RNA, 15 nt, Vaccinia virus
uauacuaucgaugau

SEQ ID NO: 3264721 - RNA, 22 nt, Vaccinia virus
agaugcuaguguaccaauaugu

SEQ ID NO: 3264722 - RNA, 11 nt, Vaccinia virus
aauauuucauu

SEQ ID NO: 3264723 - RNA, 13 nt, Vaccinia virus
gauauuaaacaag

SEQ ID NO: 3264724 - RNA, 20 nt, Vaccinia virus
cauacucguuaguuuggaau

SEQ ID NO: 3264725 - RNA, 21 nt, Vaccinia virus
aggcauguugauggaaaaauu

SEQ ID NO: 3264726 - RNA, 18 nt, Vaccinia virus
aagugacaacaaaaaaug

SEQ ID NO: 3264727 - RNA, 19 nt, Vaccinia virus
acaaaaucaacuacauaau

SEQ ID NO: 3264728 - RNA, 17 nt, Vaccinia virus
uaauaguguacuacaaa

SEQ ID NO: 3264729 - RNA, 19 nt, Vaccinia virus
cugauuaacuuccacauua

SEQ ID NO: 3264730 - RNA, 12 nt, Vaccinia virus
guuaucucagaa

SEQ ID NO: 3264731 - RNA, 18 nt, Vaccinia virus
uauuacagaaguuuugaa

SEQ ID NO: 3264732 - RNA, 15 nt, Vaccinia virus
aucugaauuaaauau

SEQ ID NO: 3264733 - RNA, 12 nt, Vaccinia virus
uuuaucuauacu

SEQ ID NO: 3264734 - RNA, 23 nt, Vaccinia virus
aauuuaguuacugcuauacagau

SEQ ID NO: 3264735 - RNA, 15 nt, Vaccinia virus
cgaaaaaugaugaag

SEQ ID NO: 3264736 - RNA, 18 nt, Vaccinia virus
aagucgacaaccaaacgu

SEQ ID NO: 3264737 - RNA, 19 nt, Vaccinia virus
aauaauucauguauuucga

SEQ ID NO: 3264738 - RNA, 13 nt, Vaccinia virus
aucuaaugaauga

SEQ ID NO: 3264739 - RNA, 17 nt, Vaccinia virus
acgccaauacauguuuu

SEQ ID NO: 3264740 - RNA, 14 nt, Vaccinia virus
uuauuuuugaagau

SEQ ID NO: 3264741 - RNA, 20 nt, Vaccinia virus
auugauaguaccaaauucuu

SEQ ID NO: 3264742 - RNA, 12 nt, Vaccinia virus
agugauuuuaca

SEQ ID NO: 3264743 - RNA, 23 nt, Vaccinia virus
cauuucuaauacaugacaauaaa

SEQ ID NO: 3264744 - RNA, 14 nt, Vaccinia virus
uucccaaauaauca

SEQ ID NO: 3264745 - RNA, 14 nt, Vaccinia virus
aacuuuaaauacuu

SEQ ID NO: 3264746 - RNA, 20 nt, Vaccinia virus
uuuguccacguucuuuaauu

SEQ ID NO: 3264747 - RNA, 13 nt, Vaccinia virus
aauucuaaaugau

SEQ ID NO: 3264748 - RNA, 13 nt, Vaccinia virus
cuuggaaguuuua

SEQ ID NO: 3264749 - RNA, 14 nt, Vaccinia virus
gcugguaaaguaaa

SEQ ID NO: 3264750 - RNA, 17 nt, Vaccinia virus
aauuagugaucaguuua

SEQ ID NO: 3264751 - RNA, 20 nt, Vaccinia virus
guggauacaaugaguauuua

SEQ ID NO: 3264752 - RNA, 18 nt, Vaccinia virus
acuccauuaaauaauuua

SEQ ID NO: 3264753 - RNA, 15 nt, Vaccinia virus
acaauaucauaaaca

SEQ ID NO: 3264754 - RNA, 15 nt, Vaccinia virus
cauuaggaaauguuu

SEQ ID NO: 3264755 - RNA, 13 nt, Vaccinia virus
aaucaaaaaauaa

SEQ ID NO: 3264756 - RNA, 19 nt, Vaccinia virus
acgauaccaucuucuggaa

SEQ ID NO: 3264757 - RNA, 20 nt, Vaccinia virus
gacgucaauggcaaaaauau

SEQ ID NO: 3264758 - RNA, 15 nt, Vaccinia virus
caguauuauuaauau

SEQ ID NO: 3264759 - RNA, 17 nt, Vaccinia virus
acaucccgguuaaacau

SEQ ID NO: 3264760 - RNA, 14 nt, Vaccinia virus
cuuuaauagauaua

SEQ ID NO: 3264761 - RNA, 15 nt, Vaccinia virus
acagaaacuguaaag

SEQ ID NO: 3264762 - RNA, 14 nt, Vaccinia virus
uaaauccagaaguu

SEQ ID NO: 3264763 - RNA, 18 nt, Vaccinia virus
ggauaaaacaaaaaugcu

SEQ ID NO: 3264764 - RNA, 15 nt, Vaccinia virus
uauacauaaacugau

SEQ ID NO: 3264765 - RNA, 19 nt, Vaccinia virus
auaaucaucgaauacuucg

SEQ ID NO: 3264766 - RNA, 15 nt, Vaccinia virus
auccuucuagaauua

SEQ ID NO: 3264767 - RNA, 18 nt, Vaccinia virus
uacauacgaauaacaaaa

SEQ ID NO: 3264768 - RNA, 20 nt, Vaccinia virus
aucuaaagauaaucuucucu

SEQ ID NO: 3264769 - RNA, 12 nt, Vaccinia virus
aucaaacacaag

SEQ ID NO: 3264770 - RNA, 21 nt, Vaccinia virus
aucugacucggacucuguaau

SEQ ID NO: 3264771 - RNA, 21 nt, Vaccinia virus
acuuuacgcuauuaaucuuua

SEQ ID NO: 3264772 - RNA, 15 nt, Vaccinia virus
uaaaauuacuuaaag

SEQ ID NO: 3264773 - RNA, 16 nt, Vaccinia virus
gaucauaucuacuaau

SEQ ID NO: 3264774 - RNA, 19 nt, Vaccinia virus
gauacuaauuguagcuauu

SEQ ID NO: 3264775 - RNA, 21 nt, Vaccinia virus
cuuuguaaagaaauuauuuuc

SEQ ID NO: 3264776 - RNA, 20 nt, Vaccinia virus
agaauauauagguaauacau

SEQ ID NO: 3264777 - RNA, 15 nt, Vaccinia virus
uauuccauuaaugac

SEQ ID NO: 3264778 - RNA, 19 nt, Vaccinia virus
ggagaucauuaaauguuuc

SEQ ID NO: 3264779 - RNA, 15 nt, Vaccinia virus
aaucguauaucuucu

SEQ ID NO: 3264780 - RNA, 13 nt, Vaccinia virus
auaagaaacaauu

SEQ ID NO: 3264781 - RNA, 21 nt, Vaccinia virus
uuucuacaauaacuacauauu

SEQ ID NO: 3264782 - RNA, 15 nt, Vaccinia virus
aauugucuuucucuu

SEQ ID NO: 3264783 - RNA, 15 nt, Vaccinia virus
acuaucuuuaauaga

SEQ ID NO: 3264784 - RNA, 18 nt, Vaccinia virus
uaaaucuauuauauuuua

SEQ ID NO: 3264785 - RNA, 21 nt, Vaccinia virus
acgauauuaucgacuaugaau

SEQ ID NO: 3264786 - RNA, 18 nt, Vaccinia virus
auguuuucugucagaaaa

SEQ ID NO: 3264787 - RNA, 21 nt, Vaccinia virus
cuauauacaacgaaacaucua

SEQ ID NO: 3264788 - RNA, 19 nt, Vaccinia virus
auugaaaauacuaauuguu

SEQ ID NO: 3264789 - RNA, 13 nt, Vaccinia virus
gaugguacuuaug

SEQ ID NO: 3264790 - RNA, 16 nt, Vaccinia virus
cagcgugaauaaugua

SEQ ID NO: 3264791 - RNA, 19 nt, Vaccinia virus
auucucuuaauuauaacga

SEQ ID NO: 3264792 - RNA, 17 nt, Vaccinia virus
agacgccugauauguag

SEQ ID NO: 3264793 - RNA, 24 nt, Vaccinia virus
ugaacauauaguucgucauuuaau

SEQ ID NO: 3264794 - RNA, 11 nt, Vaccinia virus
gaaagaauaaa

SEQ ID NO: 3264795 - RNA, 19 nt, Vaccinia virus
agcaauaguauaauuauau

SEQ ID NO: 3264796 - RNA, 16 nt, Vaccinia virus
ggaucuccuauuucuu

SEQ ID NO: 3264797 - RNA, 18 nt, Vaccinia virus
aaacgauauucuugaaau

SEQ ID NO: 3264798 - RNA, 15 nt, Vaccinia virus
auauuaucaccuauu

SEQ ID NO: 3264799 - RNA, 23 nt, Vaccinia virus
auaucaugaugauuugguuguau

SEQ ID NO: 3264800 - RNA, 16 nt, Vaccinia virus
agaaaacuagauacaa

SEQ ID NO: 3264801 - RNA, 17 nt, Vaccinia virus
auacaagcgagugcuuc

SEQ ID NO: 3264802 - RNA, 19 nt, Vaccinia virus
auaaauaucauuaauauau

SEQ ID NO: 3264803 - RNA, 13 nt, Vaccinia virus
acaauuacguaau

SEQ ID NO: 3264804 - RNA, 18 nt, Vaccinia virus
caauucagaaaucaaucu

SEQ ID NO: 3264805 - RNA, 22 nt, Vaccinia virus
uucaauggauacugcaucuguu

SEQ ID NO: 3264806 - RNA, 16 nt, Vaccinia virus
agauguguauguuugu

SEQ ID NO: 3264807 - RNA, 18 nt, Vaccinia virus
agauuagcuucgauguuu

SEQ ID NO: 3264808 - RNA, 22 nt, Vaccinia virus
caaauguuaaacauuaauugau

SEQ ID NO: 3264809 - RNA, 22 nt, Vaccinia virus
acagaaacuguaaagaacagug

SEQ ID NO: 3264810 - RNA, 16 nt, Vaccinia virus
uacuaaagcaaaggua

SEQ ID NO: 3264811 - RNA, 12 nt, Vaccinia virus
ccuaucucugac

SEQ ID NO: 3264812 - RNA, 21 nt, Vaccinia virus
aucuauuaaacagaaauggug

SEQ ID NO: 3264813 - RNA, 14 nt, Vaccinia virus
agaugaucauagau

SEQ ID NO: 3264814 - RNA, 13 nt, Vaccinia virus
augauaauaggaa

SEQ ID NO: 3264815 - RNA, 23 nt, Vaccinia virus
auuaaagagauaguuuuuuucau

SEQ ID NO: 3264816 - RNA, 24 nt, Vaccinia virus
cauccaugagauugaaugccauuu

SEQ ID NO: 3264817 - RNA, 14 nt, Vaccinia virus
aauaucauaaucua

SEQ ID NO: 3264818 - RNA, 14 nt, Vaccinia virus
uuccaaucauugau

SEQ ID NO: 3264819 - RNA, 17 nt, Vaccinia virus
uacguuucuauuuucua

SEQ ID NO: 3264820 - RNA, 16 nt, Vaccinia virus
aauaaaugcuugauau

SEQ ID NO: 3264821 - RNA, 19 nt, Vaccinia virus
acaucugcguuaucaauaa

SEQ ID NO: 3264822 - RNA, 16 nt, Vaccinia virus
cuaauucaaauuguua

SEQ ID NO: 3264823 - RNA, 13 nt, Vaccinia virus
acugauacuaucg

SEQ ID NO: 3264824 - RNA, 16 nt, Vaccinia virus
aaagaaguuguaucau

SEQ ID NO: 3264825 - RNA, 18 nt, Vaccinia virus
gacuuaagacuuaaaacu

SEQ ID NO: 3264826 - RNA, 14 nt, Vaccinia virus
auucguagaaagua

SEQ ID NO: 3264827 - RNA, 19 nt, Vaccinia virus
aguuuaucccuauauucaa

SEQ ID NO: 3264828 - RNA, 17 nt, Vaccinia virus
cuaaauaaauaugugua

SEQ ID NO: 3264829 - RNA, 14 nt, Vaccinia virus
auaaauuauaucua

SEQ ID NO: 3264830 - RNA, 16 nt, Vaccinia virus
aucuuaccaucuucuu

SEQ ID NO: 3264831 - RNA, 19 nt, Vaccinia virus
guuagaacgguuauagcau

SEQ ID NO: 3264832 - RNA, 13 nt, Vaccinia virus
cauuguaaagccc

SEQ ID NO: 3264833 - RNA, 14 nt, Vaccinia virus
aauugauucuauga

SEQ ID NO: 3264834 - RNA, 20 nt, Vaccinia virus
ugauacggcgaugguuuuua

SEQ ID NO: 3264835 - RNA, 20 nt, Vaccinia virus
uacgguuccaccgacucauu

SEQ ID NO: 3264836 - RNA, 13 nt, Vaccinia virus
auaucguuaaaga

SEQ ID NO: 3264837 - RNA, 12 nt, Vaccinia virus
ugagagcaucca

SEQ ID NO: 3264838 - RNA, 18 nt, Vaccinia virus
uauugagaagcauuuagu

SEQ ID NO: 3264839 - RNA, 17 nt, Vaccinia virus
cugauagcaguuucaau

SEQ ID NO: 3264840 - RNA, 16 nt, Vaccinia virus
agccaauccuaacucu

SEQ ID NO: 3264841 - RNA, 15 nt, Vaccinia virus
auagaucaagagaac

SEQ ID NO: 3264842 - RNA, 20 nt, Vaccinia virus
ucuucggcgguuuucaugga

SEQ ID NO: 3264843 - RNA, 21 nt, Vaccinia virus
ccuaacgaugauauguuuuca

SEQ ID NO: 3264844 - RNA, 21 nt, Vaccinia virus
auaaacagucuccuaauauaa

SEQ ID NO: 3264845 - RNA, 17 nt, Vaccinia virus
acauuauuaaucagaau

SEQ ID NO: 3264846 - RNA, 20 nt, Vaccinia virus
aucacagaauucuucaauaa

SEQ ID NO: 3264847 - RNA, 19 nt, Vaccinia virus
uuauuacuuaaguuguaaa

SEQ ID NO: 3264848 - RNA, 14 nt, Vaccinia virus
cuguucaucguuua

SEQ ID NO: 3264849 - RNA, 19 nt, Vaccinia virus
uguauacaucgguaaauaa

SEQ ID NO: 3264850 - RNA, 13 nt, Vaccinia virus
aaaggauauuaug

SEQ ID NO: 3264851 - RNA, 23 nt, Vaccinia virus
agaauacgaugauauuaaaauua

SEQ ID NO: 3264852 - RNA, 14 nt, Vaccinia virus
uaaugcuacagaua

SEQ ID NO: 3264853 - RNA, 15 nt, Vaccinia virus
uauguaucaaagaua

SEQ ID NO: 3264854 - RNA, 17 nt, Vaccinia virus
ucagccauagcaucagc

SEQ ID NO: 3264855 - RNA, 23 nt, Vaccinia virus
aguacgaugcaaugaguaagaca

SEQ ID NO: 3264856 - RNA, 19 nt, Vaccinia virus
augcauucguuuaaagaua

SEQ ID NO: 3264857 - RNA, 14 nt, Vaccinia virus
augacacuguguau

SEQ ID NO: 3264858 - RNA, 21 nt, Vaccinia virus
uaucuuauguauauguuugua

SEQ ID NO: 3264859 - RNA, 13 nt, Vaccinia virus
uagaacaacucuc

SEQ ID NO: 3264860 - RNA, 19 nt, Vaccinia virus
aucuguuaccauaauuccu

SEQ ID NO: 3264861 - RNA, 15 nt, Vaccinia virus
aaggcacuaugucca

SEQ ID NO: 3264862 - RNA, 21 nt, Vaccinia virus
cauacgugccagcuauguuua

SEQ ID NO: 3264863 - RNA, 23 nt, Vaccinia virus
cagauuacgagccagaucuucuu

SEQ ID NO: 3264864 - RNA, 14 nt, Vaccinia virus
ugcuaaaauaccua

SEQ ID NO: 3264865 - RNA, 19 nt, Vaccinia virus
agaauaucuauacauaccu

SEQ ID NO: 3264866 - RNA, 14 nt, Vaccinia virus
agcaaugaaaucac

SEQ ID NO: 3264867 - RNA, 21 nt, Vaccinia virus
auuauuuugugcaaauagaug

SEQ ID NO: 3264868 - RNA, 12 nt, Vaccinia virus
auucuuucaaag

SEQ ID NO: 3264869 - RNA, 18 nt, Vaccinia virus
cucuucaacaucuuugau

SEQ ID NO: 3264870 - RNA, 17 nt, Vaccinia virus
agauuauggagcaaaca

SEQ ID NO: 3264871 - RNA, 16 nt, Vaccinia virus
cgugcguaauauuguu

SEQ ID NO: 3264872 - RNA, 14 nt, Vaccinia virus
gcuaauauauugau

SEQ ID NO: 3264873 - RNA, 20 nt, Vaccinia virus
aaaccaacguaggucuaaau

SEQ ID NO: 3264874 - RNA, 16 nt, Vaccinia virus
acaaaagguauuacaa

SEQ ID NO: 3264875 - RNA, 19 nt, Vaccinia virus
aguauuuuaauacauguau

SEQ ID NO: 3264876 - RNA, 17 nt, Vaccinia virus
guucuuaacaucuauua

SEQ ID NO: 3264877 - RNA, 16 nt, Vaccinia virus
acuuugauagcaagga

SEQ ID NO: 3264878 - RNA, 17 nt, Vaccinia virus
guuaaucccaacaauga

SEQ ID NO: 3264879 - RNA, 15 nt, Vaccinia virus
guacauggaugauau

SEQ ID NO: 3264880 - RNA, 23 nt, Vaccinia virus
auugaugugucuguuuauacaau

SEQ ID NO: 3264881 - RNA, 22 nt, Vaccinia virus
cucuauuuugucauuaacuuua

SEQ ID NO: 3264882 - RNA, 14 nt, Vaccinia virus
uagucuucaauaau

SEQ ID NO: 3264883 - RNA, 12 nt, Vaccinia virus
caaaaagagagu

SEQ ID NO: 3264884 - RNA, 15 nt, Vaccinia virus
aaaacgauauuagaa

SEQ ID NO: 3264885 - RNA, 18 nt, Vaccinia virus
gaaauauauuaagaaauc

SEQ ID NO: 3264886 - RNA, 19 nt, Vaccinia virus
caaauuauuucuucugaau

SEQ ID NO: 3264887 - RNA, 13 nt, Vaccinia virus
uugauuacucuuu

SEQ ID NO: 3264888 - RNA, 16 nt, Vaccinia virus
caugucgucuauuuuc

SEQ ID NO: 3264889 - RNA, 14 nt, Vaccinia virus
ccaccguauccaua

SEQ ID NO: 3264890 - RNA, 21 nt, Vaccinia virus
uuagaucauuaacucuagaaa

SEQ ID NO: 3264891 - RNA, 18 nt, Vaccinia virus
uacuuuuaguucuuuuag

SEQ ID NO: 3264892 - RNA, 22 nt, Vaccinia virus
uagaaagaaauuuguaaucauc

SEQ ID NO: 3264893 - RNA, 15 nt, Vaccinia virus
aaacgaaaacuauau

SEQ ID NO: 3264894 - RNA, 22 nt, Vaccinia virus
acagacaugguaucaacagaua

SEQ ID NO: 3264895 - RNA, 20 nt, Vaccinia virus
caucuaguccuuuaauucca

SEQ ID NO: 3264896 - RNA, 13 nt, Vaccinia virus
uaauaacaaguau

SEQ ID NO: 3264897 - RNA, 23 nt, Vaccinia virus
ucuucucaaaagaucaaggaaau

SEQ ID NO: 3264898 - RNA, 15 nt, Vaccinia virus
uuucuagaacaucau

SEQ ID NO: 3264899 - RNA, 15 nt, Vaccinia virus
guuaauaauaaucuc

SEQ ID NO: 3264900 - RNA, 22 nt, Vaccinia virus
uacaauaauucagauaauguaa

SEQ ID NO: 3264901 - RNA, 17 nt, Vaccinia virus
ccaugcagcauuuccua

SEQ ID NO: 3264902 - RNA, 18 nt, Vaccinia virus
ucuuaacacucucugcca

SEQ ID NO: 3264903 - RNA, 15 nt, Vaccinia virus
uaucuucuuuaucua

SEQ ID NO: 3264904 - RNA, 17 nt, Vaccinia virus
gcagucuaacauuuuua

SEQ ID NO: 3264905 - RNA, 19 nt, Vaccinia virus
ucgguucuuuaaaagaaac

SEQ ID NO: 3264906 - RNA, 14 nt, Vaccinia virus
uaguucauacacca

SEQ ID NO: 3264907 - RNA, 15 nt, Vaccinia virus
gaauguguacuaucu

SEQ ID NO: 3264908 - RNA, 22 nt, Vaccinia virus
caaagaauccgacaucaaaugg

SEQ ID NO: 3264909 - RNA, 21 nt, Vaccinia virus
acauuaacucucucauuuucu

SEQ ID NO: 3264910 - RNA, 20 nt, Vaccinia virus
auggaagaguuaaugaauau

SEQ ID NO: 3264911 - RNA, 14 nt, Vaccinia virus
aucaagaucauaau

SEQ ID NO: 3264912 - RNA, 13 nt, Vaccinia virus
guuauuauacaug

SEQ ID NO: 3264913 - RNA, 14 nt, Vaccinia virus
aucucuuaacaaaa

SEQ ID NO: 3264914 - RNA, 14 nt, Vaccinia virus
auauaaaaaaauga

SEQ ID NO: 3264915 - RNA, 22 nt, Vaccinia virus
ucagaucguauagccuauccaa

SEQ ID NO: 3264916 - RNA, 14 nt, Vaccinia virus
accuuuuucagaga

SEQ ID NO: 3264917 - RNA, 11 nt, Vaccinia virus
uuuauacuguu

SEQ ID NO: 3264918 - RNA, 13 nt, Vaccinia virus
caacauuccaaag

SEQ ID NO: 3264919 - RNA, 22 nt, Vaccinia virus
acucuaagaacuuauuaaugaa

SEQ ID NO: 3264920 - RNA, 19 nt, Vaccinia virus
ugcuauuaagguuaaggau

SEQ ID NO: 3264921 - RNA, 21 nt, Vaccinia virus
gcauauuccuaaauacaucua

SEQ ID NO: 3264922 - RNA, 13 nt, Vaccinia virus
aaguaaugguaug

SEQ ID NO: 3264923 - RNA, 23 nt, Vaccinia virus
cucaaauguaguguuggauaucu

SEQ ID NO: 3264924 - RNA, 15 nt, Vaccinia virus
acgcauccauccaaa

SEQ ID NO: 3264925 - RNA, 20 nt, Vaccinia virus
uauccuugauuauguuuuau

SEQ ID NO: 3264926 - RNA, 22 nt, Vaccinia virus
aguagauacauaucaauaucau

SEQ ID NO: 3264927 - RNA, 17 nt, Vaccinia virus
ccaucucuauguuucag

SEQ ID NO: 3264928 - RNA, 13 nt, Vaccinia virus
auaguagaauuaa

SEQ ID NO: 3264929 - RNA, 21 nt, Vaccinia virus
caaaaucguuccgccaaauuu

SEQ ID NO: 3264930 - RNA, 13 nt, Vaccinia virus
uuaaaaauuuaga

SEQ ID NO: 3264931 - RNA, 14 nt, Vaccinia virus
acaucgaaaaugaa

SEQ ID NO: 3264932 - RNA, 15 nt, Vaccinia virus
gucacgaauauaaga

SEQ ID NO: 3264933 - RNA, 19 nt, Vaccinia virus
aauuugauccauguucaua

SEQ ID NO: 3264934 - RNA, 15 nt, Vaccinia virus
cuacgaaacuuugau

SEQ ID NO: 3264935 - RNA, 23 nt, Vaccinia virus
uauuaacgcaccuauaaagacuu

SEQ ID NO: 3264936 - RNA, 18 nt, Vaccinia virus
aaucuuauuaacuguuuc

SEQ ID NO: 3264937 - RNA, 21 nt, Vaccinia virus
gaaauggaagaguuaaugaau

SEQ ID NO: 3264938 - RNA, 12 nt, Vaccinia virus
caguaaauguuc

SEQ ID NO: 3264939 - RNA, 20 nt, Vaccinia virus
acuguuuuccugaaggaaau

SEQ ID NO: 3264940 - RNA, 20 nt, Vaccinia virus
aaauagcguucgucaacaua

SEQ ID NO: 3264941 - RNA, 14 nt, Vaccinia virus
auaucguguucauu

SEQ ID NO: 3264942 - RNA, 21 nt, Vaccinia virus
gcacuauacauuuugaaacua

SEQ ID NO: 3264943 - RNA, 17 nt, Vaccinia virus
uaauccuaagaaaacuc

SEQ ID NO: 3264944 - RNA, 15 nt, Vaccinia virus
uuccaaauuauucuu

SEQ ID NO: 3264945 - RNA, 18 nt, Vaccinia virus
agaagucauacuagaaua

SEQ ID NO: 3264946 - RNA, 12 nt, Vaccinia virus
auuagaauguau

SEQ ID NO: 3264947 - RNA, 15 nt, Vaccinia virus
uaaauaauuauuuca

SEQ ID NO: 3264948 - RNA, 14 nt, Vaccinia virus
auuggucagaaaua

SEQ ID NO: 3264949 - RNA, 20 nt, Vaccinia virus
cacuuaaaucgauauaacag

SEQ ID NO: 3264950 - RNA, 13 nt, Vaccinia virus
acaacauauaauu

SEQ ID NO: 3264951 - RNA, 19 nt, Vaccinia virus
aucuugacugucuaucucu

SEQ ID NO: 3264952 - RNA, 15 nt, Vaccinia virus
aauuaauauguauga

SEQ ID NO: 3264953 - RNA, 18 nt, Vaccinia virus
ucaacgauucuagaauau

SEQ ID NO: 3264954 - RNA, 23 nt, Vaccinia virus
aaaguuaauauuuucuaugagcu

SEQ ID NO: 3264955 - RNA, 14 nt, Vaccinia virus
cucaauaguuucau

SEQ ID NO: 3264956 - RNA, 14 nt, Vaccinia virus
ggaauuguauuuuc

SEQ ID NO: 3264957 - RNA, 22 nt, Vaccinia virus
gauuaauaauucauggaaauuu

SEQ ID NO: 3264958 - RNA, 20 nt, Vaccinia virus
cuauauauaccuuuccagua

SEQ ID NO: 3264959 - RNA, 13 nt, Vaccinia virus
aauacaggaucua

SEQ ID NO: 3264960 - RNA, 21 nt, Vaccinia virus
aucuucaagagugcauugacu

SEQ ID NO: 3264961 - RNA, 22 nt, Vaccinia virus
auaacauucuaggaauguuguu

SEQ ID NO: 3264962 - RNA, 19 nt, Vaccinia virus
aucgaguugauaucuaucg

SEQ ID NO: 3264963 - RNA, 16 nt, Vaccinia virus
gguuaugauuuauaca

SEQ ID NO: 3264964 - RNA, 12 nt, Vaccinia virus
ucuauguaucua

SEQ ID NO: 3264965 - RNA, 16 nt, Vaccinia virus
uucauccguuuccuua

SEQ ID NO: 3264966 - RNA, 19 nt, Vaccinia virus
uuuaaacagagaaaucagu

SEQ ID NO: 3264967 - RNA, 21 nt, Vaccinia virus
cagacauugucugacugaaua

SEQ ID NO: 3264968 - RNA, 20 nt, Vaccinia virus
guucauacaugaaaugaucu

SEQ ID NO: 3264969 - RNA, 20 nt, Vaccinia virus
cauuguaugguuuuaaauau

SEQ ID NO: 3264970 - RNA, 22 nt, Vaccinia virus
gauuagcacgccggaaaaauaa

SEQ ID NO: 3264971 - RNA, 18 nt, Vaccinia virus
ccaucuaucaaacaaaau

SEQ ID NO: 3264972 - RNA, 15 nt, Vaccinia virus
auaccaguuuggaaa

SEQ ID NO: 3264973 - RNA, 22 nt, Vaccinia virus
caugauguacagauuucggaau

SEQ ID NO: 3264974 - RNA, 17 nt, Vaccinia virus
uaaucagauucuuauau

SEQ ID NO: 3264975 - RNA, 19 nt, Vaccinia virus
acuaucuuuuuaggaaugu

SEQ ID NO: 3264976 - RNA, 15 nt, Vaccinia virus
gaaauugauaaugag

SEQ ID NO: 3264977 - RNA, 16 nt, Vaccinia virus
acuaacuaauguuucu

SEQ ID NO: 3264978 - RNA, 15 nt, Vaccinia virus
auaaagaaaauaugg

SEQ ID NO: 3264979 - RNA, 19 nt, Vaccinia virus
uucauccguuuccuuauga

SEQ ID NO: 3264980 - RNA, 22 nt, Vaccinia virus
aacugacguauuggaugaugca

SEQ ID NO: 3264981 - RNA, 22 nt, Vaccinia virus
auguucuuaaucaauguacaua

SEQ ID NO: 3264982 - RNA, 17 nt, Vaccinia virus
cgggauaaaauaauaca

SEQ ID NO: 3264983 - RNA, 21 nt, Vaccinia virus
aauuacagaguuuucagaaga

SEQ ID NO: 3264984 - RNA, 20 nt, Vaccinia virus
ucuauuaguaugguuucaua

SEQ ID NO: 3264985 - RNA, 21 nt, Vaccinia virus
uacaucgucucaucuguuuaa

SEQ ID NO: 3264986 - RNA, 22 nt, Vaccinia virus
aaauaaucccgcaauucauuuu

SEQ ID NO: 3264987 - RNA, 18 nt, Vaccinia virus
gacauacguauauuucua

SEQ ID NO: 3264988 - RNA, 16 nt, Vaccinia virus
ucuaaacgauuuagua

SEQ ID NO: 3264989 - RNA, 20 nt, Vaccinia virus
cuaaacacacauuauucaga

SEQ ID NO: 3264990 - RNA, 14 nt, Vaccinia virus
uggccaaccuuugu

SEQ ID NO: 3264991 - RNA, 13 nt, Vaccinia virus
ccauagaggaugu

SEQ ID NO: 3264992 - RNA, 22 nt, Vaccinia virus
cagaauagccgauauagauauu

SEQ ID NO: 3264993 - RNA, 14 nt, Vaccinia virus
auguauuagacaaa

SEQ ID NO: 3264994 - RNA, 22 nt, Vaccinia virus
aacguaguuaugauaaaugauu

SEQ ID NO: 3264995 - RNA, 15 nt, Vaccinia virus
uuaaucuuuaaaauu

SEQ ID NO: 3264996 - RNA, 20 nt, Vaccinia virus
cuacaaauuuggauauucua

SEQ ID NO: 3264997 - RNA, 19 nt, Vaccinia virus
aucugaauaaaacaucgau

SEQ ID NO: 3264998 - RNA, 14 nt, Vaccinia virus
ucuaaauacaaaau

SEQ ID NO: 3264999 - RNA, 14 nt, Vaccinia virus
cauuuauaucauuu

SEQ ID NO: 3265000 - RNA, 21 nt, Vaccinia virus
aucaauguccugcuauacuuc

SEQ ID NO: 3265001 - RNA, 13 nt, Vaccinia virus
ucuuauucuuauu

SEQ ID NO: 3265002 - RNA, 20 nt, Vaccinia virus
ucgaugaaauaucugauguu

SEQ ID NO: 3265003 - RNA, 14 nt, Vaccinia virus
uaucaauaacuaca

SEQ ID NO: 3265004 - RNA, 17 nt, Vaccinia virus
aacagaaaaaacaaugu

SEQ ID NO: 3265005 - RNA, 15 nt, Vaccinia virus
cgaugauuauauguu

SEQ ID NO: 3265006 - RNA, 20 nt, Vaccinia virus
auaggucuucgucuacagua

SEQ ID NO: 3265007 - RNA, 17 nt, Vaccinia virus
guauaauauuuaaacaa

SEQ ID NO: 3265008 - RNA, 20 nt, Vaccinia virus
guauagauccuccaguaaau

SEQ ID NO: 3265009 - RNA, 13 nt, Vaccinia virus
uuaacuauuuugu

SEQ ID NO: 3265010 - RNA, 19 nt, Vaccinia virus
auacauaauucuucuguua

SEQ ID NO: 3265011 - RNA, 14 nt, Vaccinia virus
ugaaacgaacacua

SEQ ID NO: 3265012 - RNA, 17 nt, Vaccinia virus
guacggucugauauuau

SEQ ID NO: 3265013 - RNA, 16 nt, Vaccinia virus
guuacaccaaaaaaga

SEQ ID NO: 3265014 - RNA, 20 nt, Vaccinia virus
aacugaguguaaaacucuau

SEQ ID NO: 3265015 - RNA, 20 nt, Vaccinia virus
caaguaucaaaagauuaaag

SEQ ID NO: 3265016 - RNA, 16 nt, Vaccinia virus
aauguaaagguuuaua

SEQ ID NO: 3265017 - RNA, 15 nt, Vaccinia virus
auaagauuaguaaca

SEQ ID NO: 3265018 - RNA, 18 nt, Vaccinia virus
uaauuguuuacuguauau

SEQ ID NO: 3265019 - RNA, 16 nt, Vaccinia virus
uucaaaauagcuaucu

SEQ ID NO: 3265020 - RNA, 16 nt, Vaccinia virus
acguuuaaacauucuu

SEQ ID NO: 3265021 - RNA, 14 nt, Vaccinia virus
uuccaagaaacuaa

SEQ ID NO: 3265022 - RNA, 12 nt, Vaccinia virus
aaugguagaugu

SEQ ID NO: 3265023 - RNA, 14 nt, Vaccinia virus
uucagaaauuauuc

SEQ ID NO: 3265024 - RNA, 16 nt, Vaccinia virus
acagaugccagauuac

SEQ ID NO: 3265025 - RNA, 18 nt, Vaccinia virus
aucaaaucauugauacau

SEQ ID NO: 3265026 - RNA, 21 nt, Vaccinia virus
aggauuaaaaauaaaguuauc

SEQ ID NO: 3265027 - RNA, 16 nt, Vaccinia virus
auuuaguauuaaauga

SEQ ID NO: 3265028 - RNA, 17 nt, Vaccinia virus
cuuuaagagagguauaa

SEQ ID NO: 3265029 - RNA, 19 nt, Vaccinia virus
ccacuaccggucucaguga

SEQ ID NO: 3265030 - RNA, 23 nt, Vaccinia virus
uaacuugcgggguuaauuucaca

SEQ ID NO: 3265031 - RNA, 16 nt, Vaccinia virus
agauaaagaguucuaa

SEQ ID NO: 3265032 - RNA, 19 nt, Vaccinia virus
aaguucauuaucugaaaua

SEQ ID NO: 3265033 - RNA, 20 nt, Vaccinia virus
auggaacaauaaaagagaau

SEQ ID NO: 3265034 - RNA, 20 nt, Vaccinia virus
uaaugggucguauugguauu

SEQ ID NO: 3265035 - RNA, 19 nt, Vaccinia virus
cuauaacauuaauaucaaa

SEQ ID NO: 3265036 - RNA, 15 nt, Vaccinia virus
uacuuaaaaaaugaa

SEQ ID NO: 3265037 - RNA, 22 nt, Vaccinia virus
accuauaugcccuauuaucaua

SEQ ID NO: 3265038 - RNA, 15 nt, Vaccinia virus
uaugaggaaugauug

SEQ ID NO: 3265039 - RNA, 14 nt, Vaccinia virus
caucauuaucauuu

SEQ ID NO: 3265040 - RNA, 12 nt, Vaccinia virus
cauauaaaugua

SEQ ID NO: 3265041 - RNA, 13 nt, Vaccinia virus
uugccguaaaucc

SEQ ID NO: 3265042 - RNA, 22 nt, Vaccinia virus
aaauagcgcugaaaauaaagau

SEQ ID NO: 3265043 - RNA, 17 nt, Vaccinia virus
agauagagacuccaaac

SEQ ID NO: 3265044 - RNA, 14 nt, Vaccinia virus
uuaaaguuaaucau

SEQ ID NO: 3265045 - RNA, 20 nt, Vaccinia virus
caacaguuacuccaauuaca

SEQ ID NO: 3265046 - RNA, 19 nt, Vaccinia virus
auuuauuuaguauuaaaug

SEQ ID NO: 3265047 - RNA, 17 nt, Vaccinia virus
acaucucaaugucuuua

SEQ ID NO: 3265048 - RNA, 17 nt, Vaccinia virus
uuaacaucuauuaauca

SEQ ID NO: 3265049 - RNA, 22 nt, Vaccinia virus
gaauaauaugacucaugaucua

SEQ ID NO: 3265050 - RNA, 16 nt, Vaccinia virus
ucagaauauacaccua

SEQ ID NO: 3265051 - RNA, 17 nt, Vaccinia virus
auuaccauagaagaugu

SEQ ID NO: 3265052 - RNA, 22 nt, Vaccinia virus
auuugcgugguuguuuaucaca

SEQ ID NO: 3265053 - RNA, 20 nt, Vaccinia virus
aaauauuuagaaauugaaau

SEQ ID NO: 3265054 - RNA, 11 nt, Vaccinia virus
ucccugaauac

SEQ ID NO: 3265055 - RNA, 14 nt, Vaccinia virus
uguuaaacaaauaa

SEQ ID NO: 3265056 - RNA, 16 nt, Vaccinia virus
aacaaguuaaugagau

SEQ ID NO: 3265057 - RNA, 21 nt, Vaccinia virus
ucaaaaaacaauuuauucaga

SEQ ID NO: 3265058 - RNA, 20 nt, Vaccinia virus
uaucuuauauacacauaauu

SEQ ID NO: 3265059 - RNA, 21 nt, Vaccinia virus
uugauaagacacgguagauca

SEQ ID NO: 3265060 - RNA, 15 nt, Vaccinia virus
uuaguauaauuauug

SEQ ID NO: 3265061 - RNA, 17 nt, Vaccinia virus
aucauccaauaguacau

SEQ ID NO: 3265062 - RNA, 15 nt, Vaccinia virus
aauuaguaacuguua

SEQ ID NO: 3265063 - RNA, 13 nt, Vaccinia virus
aagaauucuuaug

SEQ ID NO: 3265064 - RNA, 19 nt, Vaccinia virus
aucucuauaucuaugguug

SEQ ID NO: 3265065 - RNA, 11 nt, Vaccinia virus
cauuaugaauu

SEQ ID NO: 3265066 - RNA, 13 nt, Vaccinia virus
aucagaucauauu

SEQ ID NO: 3265067 - RNA, 18 nt, Vaccinia virus
uaauaacgaguacauucu

SEQ ID NO: 3265068 - RNA, 22 nt, Vaccinia virus
uaugucauaaacuguaaaugau

SEQ ID NO: 3265069 - RNA, 17 nt, Vaccinia virus
caucgcaguauauauca

SEQ ID NO: 3265070 - RNA, 17 nt, Vaccinia virus
gaauauguuauaauaga

SEQ ID NO: 3265071 - RNA, 20 nt, Vaccinia virus
ccucgacugauguggaauca

SEQ ID NO: 3265072 - RNA, 13 nt, Vaccinia virus
augcugugauaua

SEQ ID NO: 3265073 - RNA, 21 nt, Vaccinia virus
auacacgcuaaaauaacuagu

SEQ ID NO: 3265074 - RNA, 17 nt, Vaccinia virus
auaaauaucaucaauau

SEQ ID NO: 3265075 - RNA, 14 nt, Vaccinia virus
uuaauggaaacuau

SEQ ID NO: 3265076 - RNA, 17 nt, Vaccinia virus
auaaauaauaaauacaa

SEQ ID NO: 3265077 - RNA, 20 nt, Vaccinia virus
ucuggaaugacgaauccugu

SEQ ID NO: 3265078 - RNA, 17 nt, Vaccinia virus
auuuugugcaaauagau

SEQ ID NO: 3265079 - RNA, 15 nt, Vaccinia virus
cauuaauaacauccu

SEQ ID NO: 3265080 - RNA, 19 nt, Vaccinia virus
augagauguuaaaugaauu

SEQ ID NO: 3265081 - RNA, 12 nt, Vaccinia virus
caaaaaauaaua

SEQ ID NO: 3265082 - RNA, 18 nt, Vaccinia virus
aguacagaauuaauuaga

SEQ ID NO: 3265083 - RNA, 16 nt, Vaccinia virus
ucaaaauauguuaugu

SEQ ID NO: 3265084 - RNA, 16 nt, Vaccinia virus
acuguccaaaaugaug

SEQ ID NO: 3265085 - RNA, 22 nt, Vaccinia virus
uaucuacgauuuuuacaaaagu

SEQ ID NO: 3265086 - RNA, 17 nt, Vaccinia virus
uugaugucguuauucug

SEQ ID NO: 3265087 - RNA, 15 nt, Vaccinia virus
gcguaauguuagccc

SEQ ID NO: 3265088 - RNA, 13 nt, Vaccinia virus
ccguuaaaguaug

SEQ ID NO: 3265089 - RNA, 16 nt, Vaccinia virus
cuaaggaguaaaauag

SEQ ID NO: 3265090 - RNA, 14 nt, Vaccinia virus
auuuauuucuucuu

SEQ ID NO: 3265091 - RNA, 19 nt, Vaccinia virus
uuccugacgucuagaguuu

SEQ ID NO: 3265092 - RNA, 13 nt, Vaccinia virus
aucauuucuauaa

SEQ ID NO: 3265093 - RNA, 16 nt, Vaccinia virus
uccucggccauuuuaa

SEQ ID NO: 3265094 - RNA, 13 nt, Vaccinia virus
cuaaaauaauguc

SEQ ID NO: 3265095 - RNA, 18 nt, Vaccinia virus
uauugaaaauguguauaa

SEQ ID NO: 3265096 - RNA, 14 nt, Vaccinia virus
uuucauggauguag

SEQ ID NO: 3265097 - RNA, 15 nt, Vaccinia virus
uccaugucuacauua

SEQ ID NO: 3265098 - RNA, 21 nt, Vaccinia virus
acuugacuaaaucuuaauagu

SEQ ID NO: 3265099 - RNA, 22 nt, Vaccinia virus
gaauacgacgaccauaucaauu

SEQ ID NO: 3265100 - RNA, 15 nt, Vaccinia virus
uggauucuguuacaa

SEQ ID NO: 3265101 - RNA, 17 nt, Vaccinia virus
cucucauaauaaauuuu

SEQ ID NO: 3265102 - RNA, 16 nt, Vaccinia virus
auacgauaagauaugu

SEQ ID NO: 3265103 - RNA, 15 nt, Vaccinia virus
cagaguugauuguaa

SEQ ID NO: 3265104 - RNA, 21 nt, Vaccinia virus
auguaaguaguuuaucaacau

SEQ ID NO: 3265105 - RNA, 21 nt, Vaccinia virus
ugucuuuaaguauauacgaua

SEQ ID NO: 3265106 - RNA, 20 nt, Vaccinia virus
aagaaugcuguuaugugcau

SEQ ID NO: 3265107 - RNA, 20 nt, Vaccinia virus
acuauuauacucuguauuag

SEQ ID NO: 3265108 - RNA, 22 nt, Vaccinia virus
auuccauauagauauaauuuua

SEQ ID NO: 3265109 - RNA, 13 nt, Vaccinia virus
agacauuaauaga

SEQ ID NO: 3265110 - RNA, 22 nt, Vaccinia virus
uaaucauaaauuauuucauuau

SEQ ID NO: 3265111 - RNA, 12 nt, Vaccinia virus
uaaaauuuccau

SEQ ID NO: 3265112 - RNA, 13 nt, Vaccinia virus
cgauauacauaaa

SEQ ID NO: 3265113 - RNA, 14 nt, Vaccinia virus
ccucuucaauuaga

SEQ ID NO: 3265114 - RNA, 14 nt, Vaccinia virus
uuuacaaaacuggu

SEQ ID NO: 3265115 - RNA, 17 nt, Vaccinia virus
ccaauaauccaucaucu

SEQ ID NO: 3265116 - RNA, 19 nt, Vaccinia virus
ucugugguaaguaccgaua

SEQ ID NO: 3265117 - RNA, 18 nt, Vaccinia virus
gaacgagaacgacuaucu

SEQ ID NO: 3265118 - RNA, 12 nt, Vaccinia virus
uuacaauuauug

SEQ ID NO: 3265119 - RNA, 20 nt, Vaccinia virus
auaucagauaaguaugaaga

SEQ ID NO: 3265120 - RNA, 22 nt, Vaccinia virus
gaaacauccaucgauacauaua

SEQ ID NO: 3265121 - RNA, 18 nt, Vaccinia virus
uauucauaauccagaguu

SEQ ID NO: 3265122 - RNA, 13 nt, Vaccinia virus
cgcauaucaugaa

SEQ ID NO: 3265123 - RNA, 16 nt, Vaccinia virus
agagccaucuguaaaa

SEQ ID NO: 3265124 - RNA, 22 nt, Vaccinia virus
acaucguauaucgucuuuguua

SEQ ID NO: 3265125 - RNA, 16 nt, Vaccinia virus
uauaguuuuaaacuga

SEQ ID NO: 3265126 - RNA, 14 nt, Vaccinia virus
uuuaguauaaacag

SEQ ID NO: 3265127 - RNA, 19 nt, Vaccinia virus
uauuuuaaaguuaaucaua

SEQ ID NO: 3265128 - RNA, 17 nt, Vaccinia virus
aacuguguuucagguau

SEQ ID NO: 3265129 - RNA, 19 nt, Vaccinia virus
agaugcuauaucaaaauau

SEQ ID NO: 3265130 - RNA, 18 nt, Vaccinia virus
cagacgugacguguauag

SEQ ID NO: 3265131 - RNA, 11 nt, Vaccinia virus
cgcauacuuug

SEQ ID NO: 3265132 - RNA, 20 nt, Vaccinia virus
guauacacaaaaagaaagaa

SEQ ID NO: 3265133 - RNA, 19 nt, Vaccinia virus
uucuaaaaugguaaacuuu

SEQ ID NO: 3265134 - RNA, 18 nt, Vaccinia virus
uaugucuguacaaauguu

SEQ ID NO: 3265135 - RNA, 16 nt, Vaccinia virus
gauacuaucaaaauau

SEQ ID NO: 3265136 - RNA, 14 nt, Vaccinia virus
caaaauccaaauuu

SEQ ID NO: 3265137 - RNA, 16 nt, Vaccinia virus
ugauauacuaagcaag

SEQ ID NO: 3265138 - RNA, 17 nt, Vaccinia virus
uaguuugauugucucau

SEQ ID NO: 3265139 - RNA, 14 nt, Vaccinia virus
cuauuucguccaua

SEQ ID NO: 3265140 - RNA, 14 nt, Vaccinia virus
caaauuccaaauuu

SEQ ID NO: 3265141 - RNA, 19 nt, Vaccinia virus
uuuacaacacuuuucuauu

SEQ ID NO: 3265142 - RNA, 16 nt, Vaccinia virus
gauaaagauauaugau

SEQ ID NO: 3265143 - RNA, 16 nt, Vaccinia virus
aaaauacgaauaauca

SEQ ID NO: 3265144 - RNA, 19 nt, Vaccinia virus
ugacucgcaacaauuguag

SEQ ID NO: 3265145 - RNA, 12 nt, Vaccinia virus
uguaccuauuaa

SEQ ID NO: 3265146 - RNA, 21 nt, Vaccinia virus
uagaaaccacggaucguaaua

SEQ ID NO: 3265147 - RNA, 16 nt, Vaccinia virus
auuuauaauauacucu

SEQ ID NO: 3265148 - RNA, 17 nt, Vaccinia virus
caaaucauuguguuuau

SEQ ID NO: 3265149 - RNA, 21 nt, Vaccinia virus
ugacaugaugucguuaaauuu

SEQ ID NO: 3265150 - RNA, 16 nt, Vaccinia virus
uggaguaccaguuuca

SEQ ID NO: 3265151 - RNA, 13 nt, Vaccinia virus
guauacucugccc

SEQ ID NO: 3265152 - RNA, 13 nt, Vaccinia virus
agucauuaacaaa

SEQ ID NO: 3265153 - RNA, 22 nt, Vaccinia virus
uacuguuuacggagacaaaauu

SEQ ID NO: 3265154 - RNA, 20 nt, Vaccinia virus
caaauuaagcauuuuggaaa

SEQ ID NO: 3265155 - RNA, 20 nt, Vaccinia virus
ugaagagaagggaauuauug

SEQ ID NO: 3265156 - RNA, 22 nt, Vaccinia virus
cagaaagaggaucguacaucca

SEQ ID NO: 3265157 - RNA, 15 nt, Vaccinia virus
guaaaucauuaucua

SEQ ID NO: 3265158 - RNA, 20 nt, Vaccinia virus
guaaaauaaucauacaaucu

SEQ ID NO: 3265159 - RNA, 19 nt, Vaccinia virus
cauaguggacaacauuaau

SEQ ID NO: 3265160 - RNA, 15 nt, Vaccinia virus
aagguauacgaaugu

SEQ ID NO: 3265161 - RNA, 14 nt, Vaccinia virus
uagacgauaugaca

SEQ ID NO: 3265162 - RNA, 13 nt, Vaccinia virus
uguuuuucacuuu

SEQ ID NO: 3265163 - RNA, 16 nt, Vaccinia virus
uuaucuauuucaaaaa

SEQ ID NO: 3265164 - RNA, 15 nt, Vaccinia virus
uagucagacuguagu

SEQ ID NO: 3265165 - RNA, 15 nt, Vaccinia virus
uuuuagcagucuaac

SEQ ID NO: 3265166 - RNA, 16 nt, Vaccinia virus
gaaccuucuacauaua

SEQ ID NO: 3265167 - RNA, 21 nt, Vaccinia virus
gccuuaauccuagaugaugau

SEQ ID NO: 3265168 - RNA, 12 nt, Vaccinia virus
cuucuaaaacug

SEQ ID NO: 3265169 - RNA, 18 nt, Vaccinia virus
ucaaaauuguaacaacaa

SEQ ID NO: 3265170 - RNA, 11 nt, Vaccinia virus
caauuaaugau

SEQ ID NO: 3265171 - RNA, 17 nt, Vaccinia virus
ucaaaaaauaaauuaga

SEQ ID NO: 3265172 - RNA, 19 nt, Vaccinia virus
uauugguccauuaucagua

SEQ ID NO: 3265173 - RNA, 17 nt, Vaccinia virus
uauaaaauagaaaauaa

SEQ ID NO: 3265174 - RNA, 18 nt, Vaccinia virus
auugcuaccguaaauaua

SEQ ID NO: 3265175 - RNA, 20 nt, Vaccinia virus
ugauauauaauuuacagcua

SEQ ID NO: 3265176 - RNA, 13 nt, Vaccinia virus
caugauaaacgaa

SEQ ID NO: 3265177 - RNA, 17 nt, Vaccinia virus
uuuauguuaaaucaauu

SEQ ID NO: 3265178 - RNA, 21 nt, Vaccinia virus
uuaucagugucguaaauuacg

SEQ ID NO: 3265179 - RNA, 18 nt, Vaccinia virus
agaauacgccaaggaaag

SEQ ID NO: 3265180 - RNA, 16 nt, Vaccinia virus
uugcgauauacauaaa

SEQ ID NO: 3265181 - RNA, 20 nt, Vaccinia virus
caccuauagcaucaauaauu

SEQ ID NO: 3265182 - RNA, 12 nt, Vaccinia virus
uuuaccacaaag

SEQ ID NO: 3265183 - RNA, 15 nt, Vaccinia virus
aauaccauaaauaua

SEQ ID NO: 3265184 - RNA, 20 nt, Vaccinia virus
uguauauacuaacucucuaa

SEQ ID NO: 3265185 - RNA, 23 nt, Vaccinia virus
auauucuauaacuugagacuuga

SEQ ID NO: 3265186 - RNA, 14 nt, Vaccinia virus
uugacgacguguac

SEQ ID NO: 3265187 - RNA, 20 nt, Vaccinia virus
agacacuaacucuguuuuau

SEQ ID NO: 3265188 - RNA, 20 nt, Vaccinia virus
auagaaaacucguuauuaac

SEQ ID NO: 3265189 - RNA, 13 nt, Vaccinia virus
uauuuuacucauu

SEQ ID NO: 3265190 - RNA, 20 nt, Vaccinia virus
cuuaaaaaguucgaguuucu

SEQ ID NO: 3265191 - RNA, 15 nt, Vaccinia virus
uucuacuuacuuauu

SEQ ID NO: 3265192 - RNA, 21 nt, Vaccinia virus
guucauuaaaaacaaacuuuu

SEQ ID NO: 3265193 - RNA, 14 nt, Vaccinia virus
uagaugaauuauua

SEQ ID NO: 3265194 - RNA, 16 nt, Vaccinia virus
uugcgaaaugcucuaa

SEQ ID NO: 3265195 - RNA, 16 nt, Vaccinia virus
uaaaaaggaaauacuu

SEQ ID NO: 3265196 - RNA, 16 nt, Vaccinia virus
uauuaaaauucuuaaa

SEQ ID NO: 3265197 - RNA, 19 nt, Vaccinia virus
cauaaacuguaaaugauuu

SEQ ID NO: 3265198 - RNA, 14 nt, Vaccinia virus
ucaauauagaucuu

SEQ ID NO: 3265199 - RNA, 15 nt, Vaccinia virus
cacucucgaaaucac

SEQ ID NO: 3265200 - RNA, 16 nt, Vaccinia virus
auaauuuagauacuuu

SEQ ID NO: 3265201 - RNA, 13 nt, Vaccinia virus
cuaauacucuggg

SEQ ID NO: 3265202 - RNA, 15 nt, Vaccinia virus
uauuaucaaauacug

SEQ ID NO: 3265203 - RNA, 17 nt, Vaccinia virus
uugguagauuuucaauu

SEQ ID NO: 3265204 - RNA, 11 nt, Vaccinia virus
auauucuguau

SEQ ID NO: 3265205 - RNA, 15 nt, Vaccinia virus
auuucguuuaucauu

SEQ ID NO: 3265206 - RNA, 14 nt, Vaccinia virus
uauuaagauuaacu

SEQ ID NO: 3265207 - RNA, 17 nt, Vaccinia virus
acaacaucuaacuauau

SEQ ID NO: 3265208 - RNA, 15 nt, Vaccinia virus
accuaugauaaagga

SEQ ID NO: 3265209 - RNA, 18 nt, Vaccinia virus
agaugccaagauaucuau

SEQ ID NO: 3265210 - RNA, 17 nt, Vaccinia virus
ucuuuauauucuauaau

SEQ ID NO: 3265211 - RNA, 17 nt, Vaccinia virus
gauacuauccaguaaac

SEQ ID NO: 3265212 - RNA, 14 nt, Vaccinia virus
uaauaguauccauu

SEQ ID NO: 3265213 - RNA, 14 nt, Vaccinia virus
aaaaauuuaaagaa

SEQ ID NO: 3265214 - RNA, 13 nt, Vaccinia virus
uggaacaauaaaa

SEQ ID NO: 3265215 - RNA, 16 nt, Vaccinia virus
auuucagaacauagaa

SEQ ID NO: 3265216 - RNA, 22 nt, Vaccinia virus
aucaucuuaugaggaaugauug

SEQ ID NO: 3265217 - RNA, 18 nt, Vaccinia virus
uuaaaucaagucuagaau

SEQ ID NO: 3265218 - RNA, 16 nt, Vaccinia virus
gaauaauccuauauca

SEQ ID NO: 3265219 - RNA, 20 nt, Vaccinia virus
ucaucaccuaucuugugcau

SEQ ID NO: 3265220 - RNA, 18 nt, Vaccinia virus
uuaauaaaaauacaaucc

SEQ ID NO: 3265221 - RNA, 13 nt, Vaccinia virus
ucauaaaaaccau

SEQ ID NO: 3265222 - RNA, 19 nt, Vaccinia virus
uaucagaccguacauacau

SEQ ID NO: 3265223 - RNA, 15 nt, Vaccinia virus
auuguuaaauuauua

SEQ ID NO: 3265224 - RNA, 20 nt, Vaccinia virus
ugucguguuccuguuuccua

SEQ ID NO: 3265225 - RNA, 15 nt, Vaccinia virus
uuuaugauacguaca

SEQ ID NO: 3265226 - RNA, 15 nt, Vaccinia virus
cguauuagaauguau

SEQ ID NO: 3265227 - RNA, 17 nt, Vaccinia virus
ucuggaacaauuacaga

SEQ ID NO: 3265228 - RNA, 23 nt, Vaccinia virus
augauuuucugggacuauuggaa

SEQ ID NO: 3265229 - RNA, 15 nt, Vaccinia virus
aucauacucauauaa

SEQ ID NO: 3265230 - RNA, 15 nt, Vaccinia virus
cauuuucuaucuuua

SEQ ID NO: 3265231 - RNA, 13 nt, Vaccinia virus
uaacuucugauuu

SEQ ID NO: 3265232 - RNA, 18 nt, Vaccinia virus
uauuucuauauuugacuc

SEQ ID NO: 3265233 - RNA, 14 nt, Vaccinia virus
agcucaucuaaaaa

SEQ ID NO: 3265234 - RNA, 16 nt, Vaccinia virus
acaaauauaaaaugac

SEQ ID NO: 3265235 - RNA, 13 nt, Vaccinia virus
auagauagaacua

SEQ ID NO: 3265236 - RNA, 16 nt, Vaccinia virus
auaauacucuguuguu

SEQ ID NO: 3265237 - RNA, 14 nt, Vaccinia virus
auaauagacauaau

SEQ ID NO: 3265238 - RNA, 15 nt, Vaccinia virus
uaaucaaggauacac

SEQ ID NO: 3265239 - RNA, 21 nt, Vaccinia virus
uaggcauaccauuagauaauc

SEQ ID NO: 3265240 - RNA, 22 nt, Vaccinia virus
uuacaucaccucuaacaucauc

SEQ ID NO: 3265241 - RNA, 14 nt, Vaccinia virus
caguaguucauuau

SEQ ID NO: 3265242 - RNA, 14 nt, Vaccinia virus
cuuccaagaagaag

SEQ ID NO: 3265243 - RNA, 16 nt, Vaccinia virus
aguagauuuuauucca

SEQ ID NO: 3265244 - RNA, 18 nt, Vaccinia virus
uaauuuucauauauugag

SEQ ID NO: 3265245 - RNA, 19 nt, Vaccinia virus
ugacuagacugauuucucu

SEQ ID NO: 3265246 - RNA, 19 nt, Vaccinia virus
guuacaucaguuauaaaaa

SEQ ID NO: 3265247 - RNA, 17 nt, Vaccinia virus
uaguacucauuaucauu

SEQ ID NO: 3265248 - RNA, 16 nt, Vaccinia virus
augugaguauuggauu

SEQ ID NO: 3265249 - RNA, 18 nt, Vaccinia virus
cguuuaaaguaaacuucg

SEQ ID NO: 3265250 - RNA, 15 nt, Vaccinia virus
uuuuacgaauaaacg

SEQ ID NO: 3265251 - RNA, 22 nt, Vaccinia virus
auuaccaggguucuuguuauau

SEQ ID NO: 3265252 - RNA, 16 nt, Vaccinia virus
acacuauucuuaaauu

SEQ ID NO: 3265253 - RNA, 18 nt, Vaccinia virus
acuauguuuuuuauuaga

SEQ ID NO: 3265254 - RNA, 15 nt, Vaccinia virus
aaagacaucauauau

SEQ ID NO: 3265255 - RNA, 16 nt, Vaccinia virus
uuguauauuucuucuu

SEQ ID NO: 3265256 - RNA, 22 nt, Vaccinia virus
ugucucgaggcuaaaacacauu

SEQ ID NO: 3265257 - RNA, 22 nt, Vaccinia virus
gaccuauuaauaauuacuuauc

SEQ ID NO: 3265258 - RNA, 13 nt, Vaccinia virus
uacugcaaaacuc

SEQ ID NO: 3265259 - RNA, 15 nt, Vaccinia virus
acccgcgucuguuuu

SEQ ID NO: 3265260 - RNA, 16 nt, Vaccinia virus
ccuugcguuucucuga

SEQ ID NO: 3265261 - RNA, 11 nt, Vaccinia virus
aaggauaaaga

SEQ ID NO: 3265262 - RNA, 23 nt, Vaccinia virus
ucaaccaaccgaauggaguaaaa

SEQ ID NO: 3265263 - RNA, 17 nt, Vaccinia virus
cugaaacaguaugauuu

SEQ ID NO: 3265264 - RNA, 17 nt, Vaccinia virus
aagauauuguuaaauaa

SEQ ID NO: 3265265 - RNA, 15 nt, Vaccinia virus
auuuggaaaagaaaa

SEQ ID NO: 3265266 - RNA, 18 nt, Vaccinia virus
acauccgaaaaaguugac

SEQ ID NO: 3265267 - RNA, 18 nt, Vaccinia virus
uccaucuguggaaaauaa

SEQ ID NO: 3265268 - RNA, 15 nt, Vaccinia virus
agagaacaaauaaua

SEQ ID NO: 3265269 - RNA, 13 nt, Vaccinia virus
auuaaucauauac

SEQ ID NO: 3265270 - RNA, 13 nt, Vaccinia virus
ucaucuacauaau

SEQ ID NO: 3265271 - RNA, 20 nt, Vaccinia virus
uuaucacauaucacauuaau

SEQ ID NO: 3265272 - RNA, 12 nt, Vaccinia virus
uugucuagauaa

SEQ ID NO: 3265273 - RNA, 14 nt, Vaccinia virus
aacaauuguagaua

SEQ ID NO: 3265274 - RNA, 22 nt, Vaccinia virus
aaucuuuguuggaucagucucu

SEQ ID NO: 3265275 - RNA, 17 nt, Vaccinia virus
uuuuuacaaacaucacu

SEQ ID NO: 3265276 - RNA, 21 nt, Vaccinia virus
uaccauggacggagacaaauu

SEQ ID NO: 3265277 - RNA, 15 nt, Vaccinia virus
agucaagaugaugaa

SEQ ID NO: 3265278 - RNA, 17 nt, Vaccinia virus
caaaucauugauacauu

SEQ ID NO: 3265279 - RNA, 14 nt, Vaccinia virus
uaucuauguuuuua

SEQ ID NO: 3265280 - RNA, 13 nt, Vaccinia virus
cuauauuaauagg

SEQ ID NO: 3265281 - RNA, 14 nt, Vaccinia virus
aacuauauaaugaa

SEQ ID NO: 3265282 - RNA, 16 nt, Vaccinia virus
ccuaaagccguaauug

SEQ ID NO: 3265283 - RNA, 18 nt, Vaccinia virus
aacuuuuucacaaaacua

SEQ ID NO: 3265284 - RNA, 15 nt, Vaccinia virus
cauuguauuaugaug

SEQ ID NO: 3265285 - RNA, 14 nt, Vaccinia virus
cgaacguggaaggu

SEQ ID NO: 3265286 - RNA, 17 nt, Vaccinia virus
auauccgcuauuacaag

SEQ ID NO: 3265287 - RNA, 19 nt, Vaccinia virus
ccaucuaauaaauaucaua

SEQ ID NO: 3265288 - RNA, 19 nt, Vaccinia virus
aaacuugauaauuaauaau

SEQ ID NO: 3265289 - RNA, 20 nt, Vaccinia virus
gauauaguauauuccaguuc

SEQ ID NO: 3265290 - RNA, 15 nt, Vaccinia virus
aaauagauagaacua

SEQ ID NO: 3265291 - RNA, 14 nt, Vaccinia virus
uacuucauaaaaga

SEQ ID NO: 3265292 - RNA, 22 nt, Vaccinia virus
uugccuccggagucauaaaagg

SEQ ID NO: 3265293 - RNA, 17 nt, Vaccinia virus
caugaaacguuuggaaa

SEQ ID NO: 3265294 - RNA, 14 nt, Vaccinia virus
aacaaugaaguuau

SEQ ID NO: 3265295 - RNA, 14 nt, Vaccinia virus
aauuuugaagcauu

SEQ ID NO: 3265296 - RNA, 15 nt, Vaccinia virus
uuuuauuacauguuu

SEQ ID NO: 3265297 - RNA, 20 nt, Vaccinia virus
aucagcaucuugaauagaaa

SEQ ID NO: 3265298 - RNA, 16 nt, Vaccinia virus
uaugaagauaaacacu

SEQ ID NO: 3265299 - RNA, 16 nt, Vaccinia virus
uuugauacccugauau

SEQ ID NO: 3265300 - RNA, 23 nt, Vaccinia virus
aauauccaaguauuuuaauucua

SEQ ID NO: 3265301 - RNA, 16 nt, Vaccinia virus
uaugaugccgguaaau

SEQ ID NO: 3265302 - RNA, 15 nt, Vaccinia virus
uuccaauagaugucu

SEQ ID NO: 3265303 - RNA, 15 nt, Vaccinia virus
gcaacaaguauacaa

SEQ ID NO: 3265304 - RNA, 20 nt, Vaccinia virus
guuuuacguuauuaaucauc

SEQ ID NO: 3265305 - RNA, 23 nt, Vaccinia virus
aaguuuuucacccauaaauaaua

SEQ ID NO: 3265306 - RNA, 13 nt, Vaccinia virus
agucaacacuaug

SEQ ID NO: 3265307 - RNA, 19 nt, Vaccinia virus
aacuauagagaacaaauaa

SEQ ID NO: 3265308 - RNA, 15 nt, Vaccinia virus
uuauagaagauauca

SEQ ID NO: 3265309 - RNA, 22 nt, Vaccinia virus
uaaugccuuacucgguguauau

SEQ ID NO: 3265310 - RNA, 21 nt, Vaccinia virus
uauagaucagucaacggaaaa

SEQ ID NO: 3265311 - RNA, 18 nt, Vaccinia virus
aguaauggcggaaaacuu

SEQ ID NO: 3265312 - RNA, 16 nt, Vaccinia virus
aacucucaaaaugcug

SEQ ID NO: 3265313 - RNA, 22 nt, Vaccinia virus
agauaugguguagcauauguuu

SEQ ID NO: 3265314 - RNA, 17 nt, Vaccinia virus
caguuuauuauccacua

SEQ ID NO: 3265315 - RNA, 15 nt, Vaccinia virus
aaucgguaacagucc

SEQ ID NO: 3265316 - RNA, 14 nt, Vaccinia virus
ccaaugaaauggua

SEQ ID NO: 3265317 - RNA, 14 nt, Vaccinia virus
ugccaaagauuucu

SEQ ID NO: 3265318 - RNA, 14 nt, Vaccinia virus
aauccauugauaau

SEQ ID NO: 3265319 - RNA, 17 nt, Vaccinia virus
cuaugguauugauaaaa

SEQ ID NO: 3265320 - RNA, 14 nt, Vaccinia virus
uccauuuuacauua

SEQ ID NO: 3265321 - RNA, 21 nt, Vaccinia virus
auauggcgcgcguucaacauu

SEQ ID NO: 3265322 - RNA, 22 nt, Vaccinia virus
uaaucccgcauuuauacauauu

SEQ ID NO: 3265323 - RNA, 19 nt, Vaccinia virus
aguaguuuaacuagucuuc

SEQ ID NO: 3265324 - RNA, 18 nt, Vaccinia virus
guuguuaaaguuaauauu

SEQ ID NO: 3265325 - RNA, 20 nt, Vaccinia virus
agucguucucguucagaauc

SEQ ID NO: 3265326 - RNA, 16 nt, Vaccinia virus
uaaaauuccuacucau

SEQ ID NO: 3265327 - RNA, 15 nt, Vaccinia virus
uacguucagauuuca

SEQ ID NO: 3265328 - RNA, 22 nt, Vaccinia virus
agacagccaaucaaaaagauua

SEQ ID NO: 3265329 - RNA, 15 nt, Vaccinia virus
ucuucuauucuagaa

SEQ ID NO: 3265330 - RNA, 18 nt, Vaccinia virus
acuauuugucuuaauaga

SEQ ID NO: 3265331 - RNA, 11 nt, Vaccinia virus
ccguucucuga

SEQ ID NO: 3265332 - RNA, 12 nt, Vaccinia virus
uuccuuguguag

SEQ ID NO: 3265333 - RNA, 21 nt, Vaccinia virus
guacauuagccggacaaauau

SEQ ID NO: 3265334 - RNA, 12 nt, Vaccinia virus
gauuauuuucau

SEQ ID NO: 3265335 - RNA, 17 nt, Vaccinia virus
cgaaaauugcuauuuca

SEQ ID NO: 3265336 - RNA, 18 nt, Vaccinia virus
auaagagaggauaaaacg

SEQ ID NO: 3265337 - RNA, 13 nt, Vaccinia virus
auguaagucuuac

SEQ ID NO: 3265338 - RNA, 23 nt, Vaccinia virus
agauaauagggagaaaugacauu

SEQ ID NO: 3265339 - RNA, 16 nt, Vaccinia virus
guuguuccuagauaug

SEQ ID NO: 3265340 - RNA, 19 nt, Vaccinia virus
auauuuacauauuuacugg

SEQ ID NO: 3265341 - RNA, 16 nt, Vaccinia virus
auuuguuguucauaag

SEQ ID NO: 3265342 - RNA, 20 nt, Vaccinia virus
aaaugucuagcgauauuucu

SEQ ID NO: 3265343 - RNA, 17 nt, Vaccinia virus
gcauaguuuuucauaau

SEQ ID NO: 3265344 - RNA, 15 nt, Vaccinia virus
acaauauuaguaugu

SEQ ID NO: 3265345 - RNA, 15 nt, Vaccinia virus
uuaaccuaacuaaaa

SEQ ID NO: 3265346 - RNA, 16 nt, Vaccinia virus
aucaucaacaauccaa

SEQ ID NO: 3265347 - RNA, 12 nt, Vaccinia virus
ucaaagaaaaag

SEQ ID NO: 3265348 - RNA, 18 nt, Vaccinia virus
auucguauaaauauccuu

SEQ ID NO: 3265349 - RNA, 19 nt, Vaccinia virus
uacuaagcaaguacaugga

SEQ ID NO: 3265350 - RNA, 22 nt, Vaccinia virus
gcuuuugcgaucaauaaaugga

SEQ ID NO: 3265351 - RNA, 16 nt, Vaccinia virus
aaguaucaaaucgaua

SEQ ID NO: 3265352 - RNA, 17 nt, Vaccinia virus
aauauucauauccuugu

SEQ ID NO: 3265353 - RNA, 21 nt, Vaccinia virus
caacuaauguaugauauaauu

SEQ ID NO: 3265354 - RNA, 20 nt, Vaccinia virus
acaauguuugucauauguau

SEQ ID NO: 3265355 - RNA, 21 nt, Vaccinia virus
auccuuuuguuggaaaaauga

SEQ ID NO: 3265356 - RNA, 16 nt, Vaccinia virus
acuacaucuuuaagau

SEQ ID NO: 3265357 - RNA, 17 nt, Vaccinia virus
uacuguuuagaugauau

SEQ ID NO: 3265358 - RNA, 15 nt, Vaccinia virus
uaguuuuacuaucau

SEQ ID NO: 3265359 - RNA, 15 nt, Vaccinia virus
uauuaguguuuagau

SEQ ID NO: 3265360 - RNA, 15 nt, Vaccinia virus
auauuaauaggagau

SEQ ID NO: 3265361 - RNA, 19 nt, Vaccinia virus
auuaauguccaagucuuga

SEQ ID NO: 3265362 - RNA, 16 nt, Vaccinia virus
augucaggaaauguau

SEQ ID NO: 3265363 - RNA, 21 nt, Vaccinia virus
uauucuggugcuaauuauucc

SEQ ID NO: 3265364 - RNA, 20 nt, Vaccinia virus
aacaugucuucuauucuaga

SEQ ID NO: 3265365 - RNA, 22 nt, Vaccinia virus
uaacgccuauacuauguuauau

SEQ ID NO: 3265366 - RNA, 15 nt, Vaccinia virus
cuaaauucgauaucu

SEQ ID NO: 3265367 - RNA, 21 nt, Vaccinia virus
aagugaucucgagaaauaaua

SEQ ID NO: 3265368 - RNA, 12 nt, Vaccinia virus
uguuauauguaa

SEQ ID NO: 3265369 - RNA, 16 nt, Vaccinia virus
ugucucauauguuuua

SEQ ID NO: 3265370 - RNA, 22 nt, Vaccinia virus
aaaccuuugacuaguuguagaa

SEQ ID NO: 3265371 - RNA, 23 nt, Vaccinia virus
guccaugacuugguauuuggaaa

SEQ ID NO: 3265372 - RNA, 22 nt, Vaccinia virus
acaauaucauaaacaaacuaau

SEQ ID NO: 3265373 - RNA, 14 nt, Vaccinia virus
ucuuuaucucuuag

SEQ ID NO: 3265374 - RNA, 17 nt, Vaccinia virus
uuacauauuuacuggua

SEQ ID NO: 3265375 - RNA, 13 nt, Vaccinia virus
uguguuuacagua

SEQ ID NO: 3265376 - RNA, 12 nt, Vaccinia virus
aauaucauuaag

SEQ ID NO: 3265377 - RNA, 17 nt, Vaccinia virus
cucguaagauaaaguuu

SEQ ID NO: 3265378 - RNA, 13 nt, Vaccinia virus
uaauaugaguaau

SEQ ID NO: 3265379 - RNA, 18 nt, Vaccinia virus
ccaaucaccuuauaugau

SEQ ID NO: 3265380 - RNA, 21 nt, Vaccinia virus
auacauagucgugaucaacau

SEQ ID NO: 3265381 - RNA, 17 nt, Vaccinia virus
acaugucucucucaaau

SEQ ID NO: 3265382 - RNA, 12 nt, Vaccinia virus
uauaacaaccaa

SEQ ID NO: 3265383 - RNA, 21 nt, Vaccinia virus
acuaucaaucgauaacaagau

SEQ ID NO: 3265384 - RNA, 12 nt, Vaccinia virus
aggauaauacau

SEQ ID NO: 3265385 - RNA, 19 nt, Vaccinia virus
ugacauacauacuaucuuu

SEQ ID NO: 3265386 - RNA, 21 nt, Vaccinia virus
ccauaucuaaagcuauguuua

SEQ ID NO: 3265387 - RNA, 15 nt, Vaccinia virus
aauguacucaugaaa

SEQ ID NO: 3265388 - RNA, 13 nt, Vaccinia virus
cauuuagacagug

SEQ ID NO: 3265389 - RNA, 17 nt, Vaccinia virus
auagccaucguuaauua

SEQ ID NO: 3265390 - RNA, 16 nt, Vaccinia virus
acaccgccucuagaua

SEQ ID NO: 3265391 - RNA, 15 nt, Vaccinia virus
ugugcuuaauuauuu

SEQ ID NO: 3265392 - RNA, 19 nt, Vaccinia virus
acaacgaaccaaaaugaau

SEQ ID NO: 3265393 - RNA, 21 nt, Vaccinia virus
uuaccaucuucuuugauuaau

SEQ ID NO: 3265394 - RNA, 22 nt, Vaccinia virus
ucguugacaucuaguauugaua

SEQ ID NO: 3265395 - RNA, 18 nt, Vaccinia virus
agacgauuaguaauauau

SEQ ID NO: 3265396 - RNA, 12 nt, Vaccinia virus
aacaauguuucu

SEQ ID NO: 3265397 - RNA, 14 nt, Vaccinia virus
auuucauuaauagu

SEQ ID NO: 3265398 - RNA, 22 nt, Vaccinia virus
ugaaugaaggauuugaaucauc

SEQ ID NO: 3265399 - RNA, 24 nt, Vaccinia virus
aaacugguaauccacauaguugua

SEQ ID NO: 3265400 - RNA, 15 nt, Vaccinia virus
uaauauccaaucuua

SEQ ID NO: 3265401 - RNA, 13 nt, Vaccinia virus
aucguuugucaua

SEQ ID NO: 3265402 - RNA, 16 nt, Vaccinia virus
gugcaucgucuauucu

SEQ ID NO: 3265403 - RNA, 19 nt, Vaccinia virus
uauaucgacauacuacuua

SEQ ID NO: 3265404 - RNA, 18 nt, Vaccinia virus
acaaccgcuuagaaauaa

SEQ ID NO: 3265405 - RNA, 22 nt, Vaccinia virus
cguaccaacucauuuaaauauc

SEQ ID NO: 3265406 - RNA, 18 nt, Vaccinia virus
uuuucauuagcaugaauc

SEQ ID NO: 3265407 - RNA, 19 nt, Vaccinia virus
cucucugaaucucugugga

SEQ ID NO: 3265408 - RNA, 15 nt, Vaccinia virus
cauuuugauauugug

SEQ ID NO: 3265409 - RNA, 22 nt, Vaccinia virus
acauauaucugauaguauucca

SEQ ID NO: 3265410 - RNA, 15 nt, Vaccinia virus
cgaucaaaugauauc

SEQ ID NO: 3265411 - RNA, 19 nt, Vaccinia virus
ucucguauucaguuucauc

SEQ ID NO: 3265412 - RNA, 23 nt, Vaccinia virus
auuuguuuuguuaaacaauagau

SEQ ID NO: 3265413 - RNA, 15 nt, Vaccinia virus
uuuagacguagaaaa

SEQ ID NO: 3265414 - RNA, 16 nt, Vaccinia virus
ucuauguugacaugua

SEQ ID NO: 3265415 - RNA, 17 nt, Vaccinia virus
cauucuaauguucauaa

SEQ ID NO: 3265416 - RNA, 13 nt, Vaccinia virus
augaauugauucu

SEQ ID NO: 3265417 - RNA, 16 nt, Vaccinia virus
ugucaauugauucuua

SEQ ID NO: 3265418 - RNA, 21 nt, Vaccinia virus
cugccguauauaggagaaaaa

SEQ ID NO: 3265419 - RNA, 14 nt, Vaccinia virus
ugucauuuguauuu

SEQ ID NO: 3265420 - RNA, 13 nt, Vaccinia virus
aguucuuuucuag

SEQ ID NO: 3265421 - RNA, 16 nt, Vaccinia virus
gagauuuaaucuguaa

SEQ ID NO: 3265422 - RNA, 13 nt, Vaccinia virus
aauuagagaauua

SEQ ID NO: 3265423 - RNA, 18 nt, Vaccinia virus
cauaaaggaauauacaaa

SEQ ID NO: 3265424 - RNA, 20 nt, Vaccinia virus
uucuuaacuacguuaucauc

SEQ ID NO: 3265425 - RNA, 22 nt, Vaccinia virus
agaagcacucguuauuaauaca

SEQ ID NO: 3265426 - RNA, 21 nt, Vaccinia virus
uuuacauggcucguaccaaca

SEQ ID NO: 3265427 - RNA, 17 nt, Vaccinia virus
gaaucgguucaaaaauu

SEQ ID NO: 3265428 - RNA, 20 nt, Vaccinia virus
gguauaucuggaaagaaauc

SEQ ID NO: 3265429 - RNA, 17 nt, Vaccinia virus
aucuaacaccaaaaaua

SEQ ID NO: 3265430 - RNA, 21 nt, Vaccinia virus
aacuuggaaacaucucuucua

SEQ ID NO: 3265431 - RNA, 15 nt, Vaccinia virus
aacaugagacugacu

SEQ ID NO: 3265432 - RNA, 14 nt, Vaccinia virus
aauaacucuagacg

SEQ ID NO: 3265433 - RNA, 17 nt, Vaccinia virus
uuauacagaguauguaa

SEQ ID NO: 3265434 - RNA, 22 nt, Vaccinia virus
uuaacguaucgcauuaauacug

SEQ ID NO: 3265435 - RNA, 20 nt, Vaccinia virus
ugucaguaguauacaucaug

SEQ ID NO: 3265436 - RNA, 15 nt, Vaccinia virus
uaaccuuaucauuau

SEQ ID NO: 3265437 - RNA, 15 nt, Vaccinia virus
auugaguggaaaguu

SEQ ID NO: 3265438 - RNA, 12 nt, Vaccinia virus
agccaauacuuu

SEQ ID NO: 3265439 - RNA, 17 nt, Vaccinia virus
auaguauaauuauaugu

SEQ ID NO: 3265440 - RNA, 13 nt, Vaccinia virus
aucaaaaaguaag

SEQ ID NO: 3265441 - RNA, 22 nt, Vaccinia virus
cgacucuguuggauauggguuu

SEQ ID NO: 3265442 - RNA, 15 nt, Vaccinia virus
guuuaucaauaacua

SEQ ID NO: 3265443 - RNA, 17 nt, Vaccinia virus
aaguuauuguacuaucg

SEQ ID NO: 3265444 - RNA, 15 nt, Vaccinia virus
uacuaucuuuaacau

SEQ ID NO: 3265445 - RNA, 14 nt, Vaccinia virus
acuagaauaaagca

SEQ ID NO: 3265446 - RNA, 21 nt, Vaccinia virus
agauauuuuaugggaaaaacg

SEQ ID NO: 3265447 - RNA, 22 nt, Vaccinia virus
aaaguaguucaacauaauauua

SEQ ID NO: 3265448 - RNA, 22 nt, Vaccinia virus
ucuaacaaaaauuaugaaauaa

SEQ ID NO: 3265449 - RNA, 17 nt, Vaccinia virus
caaguaguaauagugau

SEQ ID NO: 3265450 - RNA, 16 nt, Vaccinia virus
ucauccguuguuauau

SEQ ID NO: 3265451 - RNA, 21 nt, Vaccinia virus
gaauaaggaauauacuaauca

SEQ ID NO: 3265452 - RNA, 22 nt, Vaccinia virus
uuaaacuguaucgaucauucuu

SEQ ID NO: 3265453 - RNA, 22 nt, Vaccinia virus
gaaucguauaaugucccuucaa

SEQ ID NO: 3265454 - RNA, 19 nt, Vaccinia virus
gaauuuauuucuaaaucua

SEQ ID NO: 3265455 - RNA, 15 nt, Vaccinia virus
auuauagauguguau

SEQ ID NO: 3265456 - RNA, 17 nt, Vaccinia virus
acauucagaaagaguuu

SEQ ID NO: 3265457 - RNA, 20 nt, Vaccinia virus
uugucgcuuauauugaugau

SEQ ID NO: 3265458 - RNA, 15 nt, Vaccinia virus
uaauucuccugaaaa

SEQ ID NO: 3265459 - RNA, 20 nt, Vaccinia virus
ucauguaaccuacuagaaug

SEQ ID NO: 3265460 - RNA, 19 nt, Vaccinia virus
uuaucaaguguauuaguca

SEQ ID NO: 3265461 - RNA, 23 nt, Vaccinia virus
cuauaccauauccuccuguagau

SEQ ID NO: 3265462 - RNA, 14 nt, Vaccinia virus
aguaugucaugaau

SEQ ID NO: 3265463 - RNA, 19 nt, Vaccinia virus
ucuggacauaauucaucua

SEQ ID NO: 3265464 - RNA, 18 nt, Vaccinia virus
gauauauuguuucauaau

SEQ ID NO: 3265465 - RNA, 15 nt, Vaccinia virus
uuaauucucucaggu

SEQ ID NO: 3265466 - RNA, 15 nt, Vaccinia virus
uaugcgagacauaua

SEQ ID NO: 3265467 - RNA, 18 nt, Vaccinia virus
aguuguuccuagauaugu

SEQ ID NO: 3265468 - RNA, 19 nt, Vaccinia virus
agaauuaauaauaucucua

SEQ ID NO: 3265469 - RNA, 21 nt, Vaccinia virus
guauucacuauaucaguuuua

SEQ ID NO: 3265470 - RNA, 15 nt, Vaccinia virus
agguuuaguaucuca

SEQ ID NO: 3265471 - RNA, 17 nt, Vaccinia virus
uagucuuaaauggagau

SEQ ID NO: 3265472 - RNA, 17 nt, Vaccinia virus
uaugcgucgaauuaaau

SEQ ID NO: 3265473 - RNA, 13 nt, Vaccinia virus
agauaaucuauau

SEQ ID NO: 3265474 - RNA, 20 nt, Vaccinia virus
guuccucuguaaauaaaucu

SEQ ID NO: 3265475 - RNA, 20 nt, Vaccinia virus
auauuauuacacauaaacau

SEQ ID NO: 3265476 - RNA, 12 nt, Vaccinia virus
cguauauguuuc

SEQ ID NO: 3265477 - RNA, 14 nt, Vaccinia virus
uuggcaaaaacgga

SEQ ID NO: 3265478 - RNA, 15 nt, Vaccinia virus
gauuaucguuuucau

SEQ ID NO: 3265479 - RNA, 14 nt, Vaccinia virus
auaacgauauauau

SEQ ID NO: 3265480 - RNA, 20 nt, Vaccinia virus
gaauuugaucuauugcccua

SEQ ID NO: 3265481 - RNA, 20 nt, Vaccinia virus
aagugaguauacuugucauc

SEQ ID NO: 3265482 - RNA, 18 nt, Vaccinia virus
uacuaacguauaauucuu

SEQ ID NO: 3265483 - RNA, 15 nt, Vaccinia virus
uucucguuuccaaaa

SEQ ID NO: 3265484 - RNA, 19 nt, Vaccinia virus
acgauuuccaugucuacau

SEQ ID NO: 3265485 - RNA, 12 nt, Vaccinia virus
ucgauauacaaa

SEQ ID NO: 3265486 - RNA, 17 nt, Vaccinia virus
auaaccuccugaaaaug

SEQ ID NO: 3265487 - RNA, 18 nt, Vaccinia virus
uuguaauaaaaagggaaa

SEQ ID NO: 3265488 - RNA, 17 nt, Vaccinia virus
accaccaaauaaaauuc

SEQ ID NO: 3265489 - RNA, 17 nt, Vaccinia virus
uguaugucuuauguaua

SEQ ID NO: 3265490 - RNA, 13 nt, Vaccinia virus
uaauaguaaauga

SEQ ID NO: 3265491 - RNA, 16 nt, Vaccinia virus
uuuuaauguauaacag

SEQ ID NO: 3265492 - RNA, 22 nt, Vaccinia virus
uauuuuacauggauuuaucaua

SEQ ID NO: 3265493 - RNA, 16 nt, Vaccinia virus
acuauuacuaugaauc

SEQ ID NO: 3265494 - RNA, 14 nt, Vaccinia virus
auuacaaaagaaac

SEQ ID NO: 3265495 - RNA, 18 nt, Vaccinia virus
agugauauaaaacuaucu

SEQ ID NO: 3265496 - RNA, 22 nt, Vaccinia virus
uuaaaucuaacgagaauauguu

SEQ ID NO: 3265497 - RNA, 14 nt, Vaccinia virus
auuucgacaaaaag

SEQ ID NO: 3265498 - RNA, 21 nt, Vaccinia virus
gaguaacuguugguaguucuu

SEQ ID NO: 3265499 - RNA, 12 nt, Vaccinia virus
acgauaucacau

SEQ ID NO: 3265500 - RNA, 14 nt, Vaccinia virus
aucucaacaaaauu

SEQ ID NO: 3265501 - RNA, 21 nt, Vaccinia virus
uuugauauuacuaaacacaca

SEQ ID NO: 3265502 - RNA, 12 nt, Vaccinia virus
aagaagaaguag

SEQ ID NO: 3265503 - RNA, 19 nt, Vaccinia virus
ccguaauguaaguaguuua

SEQ ID NO: 3265504 - RNA, 21 nt, Vaccinia virus
guaaucgucguagggagagaa

SEQ ID NO: 3265505 - RNA, 21 nt, Vaccinia virus
gaauauguuauaauagagaua

SEQ ID NO: 3265506 - RNA, 20 nt, Vaccinia virus
uaguauagaucaaauacuug

SEQ ID NO: 3265507 - RNA, 21 nt, Vaccinia virus
cgaugguuuuuauauguguuu

SEQ ID NO: 3265508 - RNA, 23 nt, Vaccinia virus
aauagguguaaaucuaggaauua

SEQ ID NO: 3265509 - RNA, 12 nt, Vaccinia virus
caauauuacuuu

SEQ ID NO: 3265510 - RNA, 15 nt, Vaccinia virus
uucaauauacuaguu

SEQ ID NO: 3265511 - RNA, 21 nt, Vaccinia virus
auaucauugaaugagauacua

SEQ ID NO: 3265512 - RNA, 16 nt, Vaccinia virus
uauaggagaaaaacaa

SEQ ID NO: 3265513 - RNA, 18 nt, Vaccinia virus
auuauuagauuuaauagc

SEQ ID NO: 3265514 - RNA, 14 nt, Vaccinia virus
uauacacauuuuca

SEQ ID NO: 3265515 - RNA, 20 nt, Vaccinia virus
gucucgucaaugucuauagu

SEQ ID NO: 3265516 - RNA, 13 nt, Vaccinia virus
ccuaauauaacag

SEQ ID NO: 3265517 - RNA, 20 nt, Vaccinia virus
uauuaucaaaauuuggaaac

SEQ ID NO: 3265518 - RNA, 15 nt, Vaccinia virus
caauaacauaacucu

SEQ ID NO: 3265519 - RNA, 14 nt, Vaccinia virus
uuaaucauuaacuu

SEQ ID NO: 3265520 - RNA, 14 nt, Vaccinia virus
uauaaaauauucua

SEQ ID NO: 3265521 - RNA, 14 nt, Vaccinia virus
uucucugaauauag

SEQ ID NO: 3265522 - RNA, 18 nt, Vaccinia virus
auucauaacgucauugau

SEQ ID NO: 3265523 - RNA, 16 nt, Vaccinia virus
uaucuauacuauuaaa

SEQ ID NO: 3265524 - RNA, 19 nt, Vaccinia virus
augagagugauaucauauu

SEQ ID NO: 3265525 - RNA, 20 nt, Vaccinia virus
auauucaguaaccaaauaca

SEQ ID NO: 3265526 - RNA, 13 nt, Vaccinia virus
auaguaaaaucua

SEQ ID NO: 3265527 - RNA, 22 nt, Vaccinia virus
auaugcaaauagagcaauuacu

SEQ ID NO: 3265528 - RNA, 22 nt, Vaccinia virus
uuuaaacuguccuauaaccucu

SEQ ID NO: 3265529 - RNA, 19 nt, Vaccinia virus
uguugugaaugacaucauc

SEQ ID NO: 3265530 - RNA, 22 nt, Vaccinia virus
agaggaaacauggggauugaaa

SEQ ID NO: 3265531 - RNA, 20 nt, Vaccinia virus
uucucucaucuaucaaaagu

SEQ ID NO: 3265532 - RNA, 14 nt, Vaccinia virus
ucacagauucuauu

SEQ ID NO: 3265533 - RNA, 18 nt, Vaccinia virus
uuguucuuccaauugcaa

SEQ ID NO: 3265534 - RNA, 23 nt, Vaccinia virus
aucaaacucuaaugaccacaucu

SEQ ID NO: 3265535 - RNA, 15 nt, Vaccinia virus
auuacaaagaagaac

SEQ ID NO: 3265536 - RNA, 18 nt, Vaccinia virus
cauaucauacaugauauu

SEQ ID NO: 3265537 - RNA, 18 nt, Vaccinia virus
uauuuaucaauucuucua

SEQ ID NO: 3265538 - RNA, 12 nt, Vaccinia virus
aaucuaccaguc

SEQ ID NO: 3265539 - RNA, 17 nt, Vaccinia virus
agaaugcauaaauuugu

SEQ ID NO: 3265540 - RNA, 15 nt, Vaccinia virus
auggugaaauuauug

SEQ ID NO: 3265541 - RNA, 12 nt, Vaccinia virus
gcuaacaucaua

SEQ ID NO: 3265542 - RNA, 13 nt, Vaccinia virus
gaucaucugaaaa

SEQ ID NO: 3265543 - RNA, 17 nt, Vaccinia virus
acauuuacauauuucga

SEQ ID NO: 3265544 - RNA, 21 nt, Vaccinia virus
uauaacucguuuuuauaugug

SEQ ID NO: 3265545 - RNA, 18 nt, Vaccinia virus
caacauaauauuaaacac

SEQ ID NO: 3265546 - RNA, 20 nt, Vaccinia virus
agaugguaaaauacaaaaua

SEQ ID NO: 3265547 - RNA, 14 nt, Vaccinia virus
gaauaucauauuac

SEQ ID NO: 3265548 - RNA, 21 nt, Vaccinia virus
cuuuaucucuuaguaaguuua

SEQ ID NO: 3265549 - RNA, 13 nt, Vaccinia virus
aucuuucauuucu

SEQ ID NO: 3265550 - RNA, 14 nt, Vaccinia virus
uugaaaauuauuuu

SEQ ID NO: 3265551 - RNA, 21 nt, Vaccinia virus
ugacaaaaucaacuacauaau

SEQ ID NO: 3265552 - RNA, 20 nt, Vaccinia virus
auuaguuaguguaauguuaa

SEQ ID NO: 3265553 - RNA, 20 nt, Vaccinia virus
uaauaauuuaguucauggaa

SEQ ID NO: 3265554 - RNA, 13 nt, Vaccinia virus
augguaaaaagac

SEQ ID NO: 3265555 - RNA, 13 nt, Vaccinia virus
ugaaauaacucuu

SEQ ID NO: 3265556 - RNA, 13 nt, Vaccinia virus
uuaucauaaaagu

SEQ ID NO: 3265557 - RNA, 22 nt, Vaccinia virus
caaaauuuuacuuuuaguucuu

SEQ ID NO: 3265558 - RNA, 19 nt, Vaccinia virus
uauaaaacuacuacaauga

SEQ ID NO: 3265559 - RNA, 17 nt, Vaccinia virus
cacgauacuaugcauau

SEQ ID NO: 3265560 - RNA, 16 nt, Vaccinia virus
auuaauguauuauuau

SEQ ID NO: 3265561 - RNA, 19 nt, Vaccinia virus
agaauuaaaucuaacgaga

SEQ ID NO: 3265562 - RNA, 18 nt, Vaccinia virus
agucguuuauuaucuugu

SEQ ID NO: 3265563 - RNA, 22 nt, Vaccinia virus
uaaucaaaaucuuaauaucuuc

SEQ ID NO: 3265564 - RNA, 20 nt, Vaccinia virus
auguacgauccaaacaaugu

SEQ ID NO: 3265565 - RNA, 21 nt, Vaccinia virus
ugauauaggggucuucauaac

SEQ ID NO: 3265566 - RNA, 15 nt, Vaccinia virus
aaacuaauucauuuu

SEQ ID NO: 3265567 - RNA, 21 nt, Vaccinia virus
gaucagguaaaacaauaaucg

SEQ ID NO: 3265568 - RNA, 23 nt, Vaccinia virus
ugauaucuauaauaggguaucua

SEQ ID NO: 3265569 - RNA, 15 nt, Vaccinia virus
auauucccaaacaua

SEQ ID NO: 3265570 - RNA, 17 nt, Vaccinia virus
aggauauauuaaagucu

SEQ ID NO: 3265571 - RNA, 11 nt, Vaccinia virus
agcaaaaaacc

SEQ ID NO: 3265572 - RNA, 17 nt, Vaccinia virus
auccuaacuuuaaacaa

SEQ ID NO: 3265573 - RNA, 20 nt, Vaccinia virus
gcagcaucgcgacuauucua

SEQ ID NO: 3265574 - RNA, 13 nt, Vaccinia virus
caauuccaaagau

SEQ ID NO: 3265575 - RNA, 13 nt, Vaccinia virus
aggagaaguaaua

SEQ ID NO: 3265576 - RNA, 15 nt, Vaccinia virus
gaauccuauacucug

SEQ ID NO: 3265577 - RNA, 16 nt, Vaccinia virus
auaaucguauacuuca

SEQ ID NO: 3265578 - RNA, 14 nt, Vaccinia virus
aaacgacauacugu

SEQ ID NO: 3265579 - RNA, 17 nt, Vaccinia virus
aauagaaacguacuacu

SEQ ID NO: 3265580 - RNA, 16 nt, Vaccinia virus
aaaauauguauaacgu

SEQ ID NO: 3265581 - RNA, 23 nt, Vaccinia virus
auaagcuauaauaauaaauguau

SEQ ID NO: 3265582 - RNA, 22 nt, Vaccinia virus
acauaaucguagauucauguua

SEQ ID NO: 3265583 - RNA, 22 nt, Vaccinia virus
uuacaaacugaauaauaucaga

SEQ ID NO: 3265584 - RNA, 17 nt, Vaccinia virus
cuauaauaauaaaugua

SEQ ID NO: 3265585 - RNA, 20 nt, Vaccinia virus
uaagaaugacuccuauguuu

SEQ ID NO: 3265586 - RNA, 23 nt, Vaccinia virus
aauaauaccguuugauauaccau

SEQ ID NO: 3265587 - RNA, 12 nt, Vaccinia virus
uucaucagauau

SEQ ID NO: 3265588 - RNA, 21 nt, Vaccinia virus
caggauuccuauucauuuuga

SEQ ID NO: 3265589 - RNA, 13 nt, Vaccinia virus
gauguauauauca

SEQ ID NO: 3265590 - RNA, 20 nt, Vaccinia virus
aauuuuuaacgauuuacugu

SEQ ID NO: 3265591 - RNA, 16 nt, Vaccinia virus
cgauuuuuagauuuca

SEQ ID NO: 3265592 - RNA, 18 nt, Vaccinia virus
auucuccguuaguguuug

SEQ ID NO: 3265593 - RNA, 14 nt, Vaccinia virus
ucaucauuaaacau

SEQ ID NO: 3265594 - RNA, 12 nt, Vaccinia virus
uauauauucucu

SEQ ID NO: 3265595 - RNA, 13 nt, Vaccinia virus
gcggauacaaaac

SEQ ID NO: 3265596 - RNA, 18 nt, Vaccinia virus
gaaaauucauauacugau

SEQ ID NO: 3265597 - RNA, 20 nt, Vaccinia virus
gauauagaaaucggaaauuu

SEQ ID NO: 3265598 - RNA, 14 nt, Vaccinia virus
auaaugauauauau

SEQ ID NO: 3265599 - RNA, 18 nt, Vaccinia virus
aaaauaaacacauagaaa

SEQ ID NO: 3265600 - RNA, 17 nt, Vaccinia virus
acaaagauaaaaaccac

SEQ ID NO: 3265601 - RNA, 20 nt, Vaccinia virus
uuaguaaaaaauuuauuucu

SEQ ID NO: 3265602 - RNA, 23 nt, Vaccinia virus
ucaucgaacuucugaucauuaau

SEQ ID NO: 3265603 - RNA, 12 nt, Vaccinia virus
uuauuuauguca

SEQ ID NO: 3265604 - RNA, 18 nt, Vaccinia virus
aaauuguaagguuguaaa

SEQ ID NO: 3265605 - RNA, 14 nt, Vaccinia virus
uauuuaauaucaaa

SEQ ID NO: 3265606 - RNA, 16 nt, Vaccinia virus
aaauaaaauacauuua

SEQ ID NO: 3265607 - RNA, 21 nt, Vaccinia virus
auaauuuaacauuuuggcaaa

SEQ ID NO: 3265608 - RNA, 21 nt, Vaccinia virus
acgauuuuuagugaaacauuc

SEQ ID NO: 3265609 - RNA, 22 nt, Vaccinia virus
uccaauaaauuaucaaauacuu

SEQ ID NO: 3265610 - RNA, 21 nt, Vaccinia virus
caaacaauccaaaaaaugaaa

SEQ ID NO: 3265611 - RNA, 22 nt, Vaccinia virus
cuguuaccauaauuccuuugau

SEQ ID NO: 3265612 - RNA, 15 nt, Vaccinia virus
acuugcaaaaaagac

SEQ ID NO: 3265613 - RNA, 17 nt, Vaccinia virus
aaauuuuuuuucaguua

SEQ ID NO: 3265614 - RNA, 14 nt, Vaccinia virus
ucuauacguuucua

SEQ ID NO: 3265615 - RNA, 19 nt, Vaccinia virus
uuagaugagaaauuauucc

SEQ ID NO: 3265616 - RNA, 16 nt, Vaccinia virus
auacaagaguggaaac

SEQ ID NO: 3265617 - RNA, 13 nt, Vaccinia virus
cuaacuauauacc

SEQ ID NO: 3265618 - RNA, 23 nt, Vaccinia virus
cguguauuuuugacguaaaugug

SEQ ID NO: 3265619 - RNA, 20 nt, Vaccinia virus
ucuuugaccaacgauuuaga

SEQ ID NO: 3265620 - RNA, 16 nt, Vaccinia virus
uaacaucuugauuaau

SEQ ID NO: 3265621 - RNA, 14 nt, Vaccinia virus
uauuacaaccaaug

SEQ ID NO: 3265622 - RNA, 22 nt, Vaccinia virus
uagauccuucaauaacuuauag

SEQ ID NO: 3265623 - RNA, 17 nt, Vaccinia virus
cgagaauaugauagaaa

SEQ ID NO: 3265624 - RNA, 20 nt, Vaccinia virus
augaaaaacucugauaacua

SEQ ID NO: 3265625 - RNA, 19 nt, Vaccinia virus
auuuuaauucuagacuauu

SEQ ID NO: 3265626 - RNA, 12 nt, Vaccinia virus
cauuuaaaguua

SEQ ID NO: 3265627 - RNA, 14 nt, Vaccinia virus
aucuagacauagau

SEQ ID NO: 3265628 - RNA, 15 nt, Vaccinia virus
uauacaaguguagau

SEQ ID NO: 3265629 - RNA, 21 nt, Vaccinia virus
auguugggauauugcaugaua

SEQ ID NO: 3265630 - RNA, 22 nt, Vaccinia virus
uucuugacugucgcuaauaucu

SEQ ID NO: 3265631 - RNA, 21 nt, Vaccinia virus
ugcugcaacaauucagacucc

SEQ ID NO: 3265632 - RNA, 22 nt, Vaccinia virus
caaucauuccucauaagaugau

SEQ ID NO: 3265633 - RNA, 15 nt, Vaccinia virus
uuucuuuaacaaauu

SEQ ID NO: 3265634 - RNA, 13 nt, Vaccinia virus
acacucuauuuca

SEQ ID NO: 3265635 - RNA, 22 nt, Vaccinia virus
uaaaaauuuuuuagauguagua

SEQ ID NO: 3265636 - RNA, 14 nt, Vaccinia virus
uuucguacaucucu

SEQ ID NO: 3265637 - RNA, 22 nt, Vaccinia virus
aaguuuucuuucaaaauagcua

SEQ ID NO: 3265638 - RNA, 16 nt, Vaccinia virus
auuauucaguaugaag

SEQ ID NO: 3265639 - RNA, 12 nt, Vaccinia virus
auaaaugggaac

SEQ ID NO: 3265640 - RNA, 17 nt, Vaccinia virus
ucauuauaacucuagaa

SEQ ID NO: 3265641 - RNA, 12 nt, Vaccinia virus
uuuuucaugauu

SEQ ID NO: 3265642 - RNA, 17 nt, Vaccinia virus
uacaucggauacgacau

SEQ ID NO: 3265643 - RNA, 15 nt, Vaccinia virus
uucuuaagacacauu

SEQ ID NO: 3265644 - RNA, 17 nt, Vaccinia virus
auaaacucacauuucaa

SEQ ID NO: 3265645 - RNA, 13 nt, Vaccinia virus
aaauaagagacuu

SEQ ID NO: 3265646 - RNA, 18 nt, Vaccinia virus
cauaaacugaucacuaau

SEQ ID NO: 3265647 - RNA, 14 nt, Vaccinia virus
uaaaacaaacuugu

SEQ ID NO: 3265648 - RNA, 11 nt, Vaccinia virus
acuuuaaugau

SEQ ID NO: 3265649 - RNA, 14 nt, Vaccinia virus
uauuauuaaucauu

SEQ ID NO: 3265650 - RNA, 21 nt, Vaccinia virus
aagauauuaucggguuuaaga

SEQ ID NO: 3265651 - RNA, 14 nt, Vaccinia virus
guauuaguaggaaa

SEQ ID NO: 3265652 - RNA, 14 nt, Vaccinia virus
gaauaaauauccuu

SEQ ID NO: 3265653 - RNA, 15 nt, Vaccinia virus
uaugauggauacaug

SEQ ID NO: 3265654 - RNA, 12 nt, Vaccinia virus
guuuaucuuuuu

SEQ ID NO: 3265655 - RNA, 21 nt, Vaccinia virus
gacucgcaaaaaauacaauau

SEQ ID NO: 3265656 - RNA, 18 nt, Vaccinia virus
agguugauguagaagaag

SEQ ID NO: 3265657 - RNA, 19 nt, Vaccinia virus
uaugucuuccguuggauau

SEQ ID NO: 3265658 - RNA, 20 nt, Vaccinia virus
aguaaucauauaaauguuua

SEQ ID NO: 3265659 - RNA, 17 nt, Vaccinia virus
uagaaagaaaauaucua

SEQ ID NO: 3265660 - RNA, 13 nt, Vaccinia virus
uuucaaauaccag

SEQ ID NO: 3265661 - RNA, 14 nt, Vaccinia virus
guaagcauuuccuu

SEQ ID NO: 3265662 - RNA, 20 nt, Vaccinia virus
auaacgaauccaauguuaug

SEQ ID NO: 3265663 - RNA, 16 nt, Vaccinia virus
acucauaaaauacaag

SEQ ID NO: 3265664 - RNA, 18 nt, Vaccinia virus
ucuguuaccauaauuccu

SEQ ID NO: 3265665 - RNA, 18 nt, Vaccinia virus
guaaccaaauacauauua

SEQ ID NO: 3265666 - RNA, 12 nt, Vaccinia virus
uuaucauuauua

SEQ ID NO: 3265667 - RNA, 20 nt, Vaccinia virus
augguucgcucaaaaauaua

SEQ ID NO: 3265668 - RNA, 18 nt, Vaccinia virus
agaacaucauuuccaaau

SEQ ID NO: 3265669 - RNA, 22 nt, Vaccinia virus
cuaucaaauucggaucguaaau

SEQ ID NO: 3265670 - RNA, 16 nt, Vaccinia virus
gaaugacgaauccugu

SEQ ID NO: 3265671 - RNA, 23 nt, Vaccinia virus
cagaauccgcugauggaaacaca

SEQ ID NO: 3265672 - RNA, 22 nt, Vaccinia virus
uauauuuucacuuuaucucauu

SEQ ID NO: 3265673 - RNA, 15 nt, Vaccinia virus
auuaauacagacgau

SEQ ID NO: 3265674 - RNA, 16 nt, Vaccinia virus
uaaauuuucuauacau

SEQ ID NO: 3265675 - RNA, 16 nt, Vaccinia virus
uagaagaauucuugga

SEQ ID NO: 3265676 - RNA, 15 nt, Vaccinia virus
uuuaucuauucauaa

SEQ ID NO: 3265677 - RNA, 18 nt, Vaccinia virus
cucuacucauuucauuau

SEQ ID NO: 3265678 - RNA, 12 nt, Vaccinia virus
aaguaugauaca

SEQ ID NO: 3265679 - RNA, 14 nt, Vaccinia virus
gaauauacaaguau

SEQ ID NO: 3265680 - RNA, 14 nt, Vaccinia virus
uucauaucauucuu

SEQ ID NO: 3265681 - RNA, 17 nt, Vaccinia virus
agacaaacgcugauaga

SEQ ID NO: 3265682 - RNA, 16 nt, Vaccinia virus
acguuuauucucaaau

SEQ ID NO: 3265683 - RNA, 17 nt, Vaccinia virus
gauaaaacgauaaaaga

SEQ ID NO: 3265684 - RNA, 21 nt, Vaccinia virus
uacuauauccggcaauauuua

SEQ ID NO: 3265685 - RNA, 21 nt, Vaccinia virus
cacugucuggcaauaaaugau

SEQ ID NO: 3265686 - RNA, 17 nt, Vaccinia virus
agaaguuauagaaugua

SEQ ID NO: 3265687 - RNA, 22 nt, Vaccinia virus
auccuaaugcauguuauagaug

SEQ ID NO: 3265688 - RNA, 17 nt, Vaccinia virus
gauaacuagaaucagaa

SEQ ID NO: 3265689 - RNA, 21 nt, Vaccinia virus
aauuauucacaauaucaguau

SEQ ID NO: 3265690 - RNA, 22 nt, Vaccinia virus
ccaccaauagaaguuuucccaa

SEQ ID NO: 3265691 - RNA, 16 nt, Vaccinia virus
auucgauaagauagau

SEQ ID NO: 3265692 - RNA, 15 nt, Vaccinia virus
aauacaaaaucaucu

SEQ ID NO: 3265693 - RNA, 14 nt, Vaccinia virus
auuuucuaacguga

SEQ ID NO: 3265694 - RNA, 12 nt, Vaccinia virus
cauauguuuauu

SEQ ID NO: 3265695 - RNA, 23 nt, Vaccinia virus
auucaaccacucucgauacauua

SEQ ID NO: 3265696 - RNA, 20 nt, Vaccinia virus
gacauuguauuaugaugaau

SEQ ID NO: 3265697 - RNA, 15 nt, Vaccinia virus
aguacuuguacacau

SEQ ID NO: 3265698 - RNA, 23 nt, Vaccinia virus
cuaugguauugauaaaauuaaug

SEQ ID NO: 3265699 - RNA, 16 nt, Vaccinia virus
gaaaucaacauaauau

SEQ ID NO: 3265700 - RNA, 15 nt, Vaccinia virus
aaugccacaaaugaa

SEQ ID NO: 3265701 - RNA, 15 nt, Vaccinia virus
accaacggaaauggu

SEQ ID NO: 3265702 - RNA, 20 nt, Vaccinia virus
aucuuguuauaauuauaaua

SEQ ID NO: 3265703 - RNA, 23 nt, Vaccinia virus
uuuaaauauuauauaaacauuug

SEQ ID NO: 3265704 - RNA, 13 nt, Vaccinia virus
caacagaaaauau

SEQ ID NO: 3265705 - RNA, 17 nt, Vaccinia virus
aaugauuuagaaaugaa

SEQ ID NO: 3265706 - RNA, 14 nt, Vaccinia virus
auuagagaagcacu

SEQ ID NO: 3265707 - RNA, 12 nt, Vaccinia virus
acuauugccauc

SEQ ID NO: 3265708 - RNA, 17 nt, Vaccinia virus
aucgucgauacaaaaug

SEQ ID NO: 3265709 - RNA, 22 nt, Vaccinia virus
cacauuauacuuuuuuuuggaa

SEQ ID NO: 3265710 - RNA, 16 nt, Vaccinia virus
gucguccaauauuuua

SEQ ID NO: 3265711 - RNA, 17 nt, Vaccinia virus
guagcaaagaaauuaau

SEQ ID NO: 3265712 - RNA, 22 nt, Vaccinia virus
gacuaauaaauuagauauuaau

SEQ ID NO: 3265713 - RNA, 16 nt, Vaccinia virus
uaaaaaauauucuuca

SEQ ID NO: 3265714 - RNA, 21 nt, Vaccinia virus
auuaaaacuaccaauaagaag

SEQ ID NO: 3265715 - RNA, 24 nt, Vaccinia virus
agaacugccauauguuggagauac

SEQ ID NO: 3265716 - RNA, 22 nt, Vaccinia virus
aucaauaacgcaaucaugauuu

SEQ ID NO: 3265717 - RNA, 17 nt, Vaccinia virus
uguauauauauuucuua

SEQ ID NO: 3265718 - RNA, 14 nt, Vaccinia virus
gccagaucuucuuc

SEQ ID NO: 3265719 - RNA, 14 nt, Vaccinia virus
uagguaacauaaaa

SEQ ID NO: 3265720 - RNA, 20 nt, Vaccinia virus
aaccaugcuacaaucauuau

SEQ ID NO: 3265721 - RNA, 15 nt, Vaccinia virus
uuguuccuguagaua

SEQ ID NO: 3265722 - RNA, 14 nt, Vaccinia virus
aaugauauauuaaa

SEQ ID NO: 3265723 - RNA, 16 nt, Vaccinia virus
accguuugauauacca

SEQ ID NO: 3265724 - RNA, 18 nt, Vaccinia virus
accacucgaaaaaguaau

SEQ ID NO: 3265725 - RNA, 14 nt, Vaccinia virus
uucuuguuaucaga

SEQ ID NO: 3265726 - RNA, 21 nt, Vaccinia virus
uaccuaucuucgauauaaaau

SEQ ID NO: 3265727 - RNA, 17 nt, Vaccinia virus
aucaccacuuucauauu

SEQ ID NO: 3265728 - RNA, 21 nt, Vaccinia virus
agaugccauaucauacaugau

SEQ ID NO: 3265729 - RNA, 22 nt, Vaccinia virus
agcagauuaguaugaagauaaa

SEQ ID NO: 3265730 - RNA, 15 nt, Vaccinia virus
uaaaauuuaaaauga

SEQ ID NO: 3265731 - RNA, 15 nt, Vaccinia virus
acgcaauaucucaau

SEQ ID NO: 3265732 - RNA, 14 nt, Vaccinia virus
gaauuauagacacu

SEQ ID NO: 3265733 - RNA, 13 nt, Vaccinia virus
gguauaauaacuu

SEQ ID NO: 3265734 - RNA, 20 nt, Vaccinia virus
caaauuauggcguuuguauu

SEQ ID NO: 3265735 - RNA, 21 nt, Vaccinia virus
acauggaaauagguuuuguuc

SEQ ID NO: 3265736 - RNA, 17 nt, Vaccinia virus
caaaauagguacucugu

SEQ ID NO: 3265737 - RNA, 14 nt, Vaccinia virus
uauaaacaaaaaua

SEQ ID NO: 3265738 - RNA, 20 nt, Vaccinia virus
uaaauaucauaaucuaaaau

SEQ ID NO: 3265739 - RNA, 14 nt, Vaccinia virus
cucuuucuccuuuc

SEQ ID NO: 3265740 - RNA, 15 nt, Vaccinia virus
ucuagccauaucuaa

SEQ ID NO: 3265741 - RNA, 20 nt, Vaccinia virus
uacagagauguacagcuucc

SEQ ID NO: 3265742 - RNA, 18 nt, Vaccinia virus
cauucaaauguuguuaaa

SEQ ID NO: 3265743 - RNA, 18 nt, Vaccinia virus
uccacguucuuuaauuuu

SEQ ID NO: 3265744 - RNA, 21 nt, Vaccinia virus
cuacugggauaagauuuccaa

SEQ ID NO: 3265745 - RNA, 18 nt, Vaccinia virus
uaauaaaaaaauuauuua

SEQ ID NO: 3265746 - RNA, 18 nt, Vaccinia virus
uuggaaucacaaacauua

SEQ ID NO: 3265747 - RNA, 21 nt, Vaccinia virus
caguacuacuagguagaagaa

SEQ ID NO: 3265748 - RNA, 13 nt, Vaccinia virus
cuaauguuguaaa

SEQ ID NO: 3265749 - RNA, 19 nt, Vaccinia virus
aauaauggauaguauaaau

SEQ ID NO: 3265750 - RNA, 14 nt, Vaccinia virus
ucgaauaaugagua

SEQ ID NO: 3265751 - RNA, 18 nt, Vaccinia virus
acaauaaauagcuuuacu

SEQ ID NO: 3265752 - RNA, 16 nt, Vaccinia virus
aauuguauuauuuccc

SEQ ID NO: 3265753 - RNA, 22 nt, Vaccinia virus
aaaagauggaggauaugguggu

SEQ ID NO: 3265754 - RNA, 16 nt, Vaccinia virus
uagagauuauaucuuu

SEQ ID NO: 3265755 - RNA, 13 nt, Vaccinia virus
uauuguuaauaga

SEQ ID NO: 3265756 - RNA, 13 nt, Vaccinia virus
uuaaaucauuaaa

SEQ ID NO: 3265757 - RNA, 16 nt, Vaccinia virus
uuaauuaguaacuguu

SEQ ID NO: 3265758 - RNA, 11 nt, Vaccinia virus
cgauagaaaaa

SEQ ID NO: 3265759 - RNA, 16 nt, Vaccinia virus
cuaauuguuuaaauaa

SEQ ID NO: 3265760 - RNA, 14 nt, Vaccinia virus
auauaauaacaaga

SEQ ID NO: 3265761 - RNA, 19 nt, Vaccinia virus
cgccuuuauuuccacauua

SEQ ID NO: 3265762 - RNA, 18 nt, Vaccinia virus
accacuuauuacuccauc

SEQ ID NO: 3265763 - RNA, 16 nt, Vaccinia virus
cuacaauauauucuca

SEQ ID NO: 3265764 - RNA, 21 nt, Vaccinia virus
uaaauuauaaaaaaagcaaug

SEQ ID NO: 3265765 - RNA, 15 nt, Vaccinia virus
uguaguuauugaacu

SEQ ID NO: 3265766 - RNA, 18 nt, Vaccinia virus
aauagcuuuacuucuaua

SEQ ID NO: 3265767 - RNA, 17 nt, Vaccinia virus
ucacaugucuaaacuuc

SEQ ID NO: 3265768 - RNA, 23 nt, Vaccinia virus
acuaugcgucgaaguaaaaauug

SEQ ID NO: 3265769 - RNA, 14 nt, Vaccinia virus
auaaacaauauuaa

SEQ ID NO: 3265770 - RNA, 19 nt, Vaccinia virus
uucagcgguaaagauaucu

SEQ ID NO: 3265771 - RNA, 17 nt, Vaccinia virus
guacauuauuacauaga

SEQ ID NO: 3265772 - RNA, 22 nt, Vaccinia virus
auauggaaaaguucaacaugau

SEQ ID NO: 3265773 - RNA, 14 nt, Vaccinia virus
auugguauaaaugu

SEQ ID NO: 3265774 - RNA, 20 nt, Vaccinia virus
uauucauuaggauuaucaaa

SEQ ID NO: 3265775 - RNA, 22 nt, Vaccinia virus
uauucaaugauccauuaucaua

SEQ ID NO: 3265776 - RNA, 15 nt, Vaccinia virus
aaacuuuuuagaaau

SEQ ID NO: 3265777 - RNA, 17 nt, Vaccinia virus
aaaguauucuuauguau

SEQ ID NO: 3265778 - RNA, 23 nt, Vaccinia virus
uuaaaugaauccaucuuauccuu

SEQ ID NO: 3265779 - RNA, 17 nt, Vaccinia virus
acauaucuaaaugaaua

SEQ ID NO: 3265780 - RNA, 18 nt, Vaccinia virus
gaacuaauccacauauga

SEQ ID NO: 3265781 - RNA, 20 nt, Vaccinia virus
auaucaaacaauccaaaaaa

SEQ ID NO: 3265782 - RNA, 13 nt, Vaccinia virus
uagacauuuacca

SEQ ID NO: 3265783 - RNA, 22 nt, Vaccinia virus
aaacuucaaucuguuaagauua

SEQ ID NO: 3265784 - RNA, 17 nt, Vaccinia virus
gaugcauauauuucauu

SEQ ID NO: 3265785 - RNA, 14 nt, Vaccinia virus
gaccaguauugaug

SEQ ID NO: 3265786 - RNA, 12 nt, Vaccinia virus
uuuccuagauac

SEQ ID NO: 3265787 - RNA, 19 nt, Vaccinia virus
cauaacgaaaauaucacag

SEQ ID NO: 3265788 - RNA, 20 nt, Vaccinia virus
uuuugguggagguguaacug

SEQ ID NO: 3265789 - RNA, 12 nt, Vaccinia virus
ucugaauuauuu

SEQ ID NO: 3265790 - RNA, 17 nt, Vaccinia virus
uuacgcaaaacauuaua

SEQ ID NO: 3265791 - RNA, 18 nt, Vaccinia virus
guauaauauuuaaacaau

SEQ ID NO: 3265792 - RNA, 19 nt, Vaccinia virus
uauugguuacccuugucau

SEQ ID NO: 3265793 - RNA, 20 nt, Vaccinia virus
gagacgguagaauaagugua

SEQ ID NO: 3265794 - RNA, 22 nt, Vaccinia virus
aaagauucuauaauaaugaaug

SEQ ID NO: 3265795 - RNA, 21 nt, Vaccinia virus
ggggaaaaauuauaauguuuc

SEQ ID NO: 3265796 - RNA, 17 nt, Vaccinia virus
uuauaaaggagacuugu

SEQ ID NO: 3265797 - RNA, 21 nt, Vaccinia virus
acgauaaugugguuacucuuc

SEQ ID NO: 3265798 - RNA, 13 nt, Vaccinia virus
aaguugaucucaa

SEQ ID NO: 3265799 - RNA, 16 nt, Vaccinia virus
uaaagcaaaaugguug

SEQ ID NO: 3265800 - RNA, 24 nt, Vaccinia virus
aauaaauguuuugauuucaauuua

SEQ ID NO: 3265801 - RNA, 18 nt, Vaccinia virus
auacuuugucggauuauc

SEQ ID NO: 3265802 - RNA, 16 nt, Vaccinia virus
ucauuguaaauuuaua

SEQ ID NO: 3265803 - RNA, 16 nt, Vaccinia virus
gauuauuuacuauaau

SEQ ID NO: 3265804 - RNA, 22 nt, Vaccinia virus
ugaaccguauuacucuacagua

SEQ ID NO: 3265805 - RNA, 13 nt, Vaccinia virus
aaagcaaaauggu

SEQ ID NO: 3265806 - RNA, 19 nt, Vaccinia virus
aguuacauacaaacugaaa

SEQ ID NO: 3265807 - RNA, 18 nt, Vaccinia virus
ugaaacaggacauuauca

SEQ ID NO: 3265808 - RNA, 15 nt, Vaccinia virus
aguaauuuuuuauca

SEQ ID NO: 3265809 - RNA, 22 nt, Vaccinia virus
aaauguuugaucaauaacaaug

SEQ ID NO: 3265810 - RNA, 19 nt, Vaccinia virus
agucucgcguucaagauua

SEQ ID NO: 3265811 - RNA, 21 nt, Vaccinia virus
aacuuuuguuuuguuucugau

SEQ ID NO: 3265812 - RNA, 21 nt, Vaccinia virus
cauaguguuuuauauuccaaa

SEQ ID NO: 3265813 - RNA, 17 nt, Vaccinia virus
gucaauuuuaaaugaug

SEQ ID NO: 3265814 - RNA, 18 nt, Vaccinia virus
gcauauaacaacaaauaa

SEQ ID NO: 3265815 - RNA, 17 nt, Vaccinia virus
uucgcuaaaaaauuagu

SEQ ID NO: 3265816 - RNA, 13 nt, Vaccinia virus
gaacuaccaauau

SEQ ID NO: 3265817 - RNA, 14 nt, Vaccinia virus
uaugauauauacac

SEQ ID NO: 3265818 - RNA, 19 nt, Vaccinia virus
acaauuauuauauaauucu

SEQ ID NO: 3265819 - RNA, 13 nt, Vaccinia virus
ucgcagaugauga

SEQ ID NO: 3265820 - RNA, 17 nt, Vaccinia virus
aauguguauaaaauaua

SEQ ID NO: 3265821 - RNA, 23 nt, Vaccinia virus
acaauggucgauuauagaaaugc

SEQ ID NO: 3265822 - RNA, 18 nt, Vaccinia virus
uagauauuaguaaauuaa

SEQ ID NO: 3265823 - RNA, 14 nt, Vaccinia virus
uaugaaugaugaua

SEQ ID NO: 3265824 - RNA, 22 nt, Vaccinia virus
ugguuccacaauucauuuccau

SEQ ID NO: 3265825 - RNA, 21 nt, Vaccinia virus
cugauaagauaucuucucaaa

SEQ ID NO: 3265826 - RNA, 13 nt, Vaccinia virus
aacuuaacagcuc

SEQ ID NO: 3265827 - RNA, 13 nt, Vaccinia virus
caauguccaaauc

SEQ ID NO: 3265828 - RNA, 14 nt, Vaccinia virus
ggaucauccuuuaa

SEQ ID NO: 3265829 - RNA, 15 nt, Vaccinia virus
ucauucguaaaucuu

SEQ ID NO: 3265830 - RNA, 14 nt, Vaccinia virus
auuuauuugaugaa

SEQ ID NO: 3265831 - RNA, 16 nt, Vaccinia virus
uagugaugaauaucug

SEQ ID NO: 3265832 - RNA, 14 nt, Vaccinia virus
uccaauuacaaaaa

SEQ ID NO: 3265833 - RNA, 22 nt, Vaccinia virus
gcgguuaaaauaguuuauaaca

SEQ ID NO: 3265834 - RNA, 18 nt, Vaccinia virus
aaagggauauauauugua

SEQ ID NO: 3265835 - RNA, 16 nt, Vaccinia virus
aucgcauagaaauaca

SEQ ID NO: 3265836 - RNA, 14 nt, Vaccinia virus
aggagaacaaagaa

SEQ ID NO: 3265837 - RNA, 16 nt, Vaccinia virus
auuaaaucauugacug

SEQ ID NO: 3265838 - RNA, 15 nt, Vaccinia virus
aacuaugucaguagu

SEQ ID NO: 3265839 - RNA, 15 nt, Vaccinia virus
uaauaauaauucauc

SEQ ID NO: 3265840 - RNA, 17 nt, Vaccinia virus
gcccucaauuucccaaa

SEQ ID NO: 3265841 - RNA, 17 nt, Vaccinia virus
uuaaaaaaaaauacuuu

SEQ ID NO: 3265842 - RNA, 14 nt, Vaccinia virus
acaucguuuaauaa

SEQ ID NO: 3265843 - RNA, 19 nt, Vaccinia virus
aauacugcaauaauuuuca

SEQ ID NO: 3265844 - RNA, 22 nt, Vaccinia virus
aucagaccguacauacauagac

SEQ ID NO: 3265845 - RNA, 16 nt, Vaccinia virus
aucugaaacauacgau

SEQ ID NO: 3265846 - RNA, 16 nt, Vaccinia virus
gaugaugucauucaca

SEQ ID NO: 3265847 - RNA, 16 nt, Vaccinia virus
uuaacagauucacaaa

SEQ ID NO: 3265848 - RNA, 16 nt, Vaccinia virus
auaguaucuauauacg

SEQ ID NO: 3265849 - RNA, 13 nt, Vaccinia virus
uucgaagauauca

SEQ ID NO: 3265850 - RNA, 23 nt, Vaccinia virus
aacacacacugagaaacagcaua

SEQ ID NO: 3265851 - RNA, 20 nt, Vaccinia virus
cauuccaagucacugugugu

SEQ ID NO: 3265852 - RNA, 16 nt, Vaccinia virus
aauagguuguaauauc

SEQ ID NO: 3265853 - RNA, 23 nt, Vaccinia virus
gucgcuucgcgaauuuagaaaau

SEQ ID NO: 3265854 - RNA, 21 nt, Vaccinia virus
caaacccuugaucuccucuau

SEQ ID NO: 3265855 - RNA, 20 nt, Vaccinia virus
uaaucguaagcgcuauacaa

SEQ ID NO: 3265856 - RNA, 14 nt, Vaccinia virus
cauaaguauauaau

SEQ ID NO: 3265857 - RNA, 22 nt, Vaccinia virus
uccauuauauauuccuugaaua

SEQ ID NO: 3265858 - RNA, 16 nt, Vaccinia virus
uagucauaauaucuuu

SEQ ID NO: 3265859 - RNA, 16 nt, Vaccinia virus
aucuauauauguauuu

SEQ ID NO: 3265860 - RNA, 18 nt, Vaccinia virus
cuuaauauugccauaauu

SEQ ID NO: 3265861 - RNA, 15 nt, Vaccinia virus
uauaauucuuuggua

SEQ ID NO: 3265862 - RNA, 16 nt, Vaccinia virus
cagaauucuaaaugau

SEQ ID NO: 3265863 - RNA, 14 nt, Vaccinia virus
auucuuuuuaagau

SEQ ID NO: 3265864 - RNA, 23 nt, Vaccinia virus
uaguauucaagucaaagaaauac

SEQ ID NO: 3265865 - RNA, 18 nt, Vaccinia virus
aucuauugacuauaacuc

SEQ ID NO: 3265866 - RNA, 14 nt, Vaccinia virus
auguuauccaacau

SEQ ID NO: 3265867 - RNA, 16 nt, Vaccinia virus
acggaaaaaugcaugu

SEQ ID NO: 3265868 - RNA, 16 nt, Vaccinia virus
uuccacauuaauacag

SEQ ID NO: 3265869 - RNA, 24 nt, Vaccinia virus
uguaacgcgucuguuuuauacauu

SEQ ID NO: 3265870 - RNA, 14 nt, Vaccinia virus
aaacucuuuucaaa

SEQ ID NO: 3265871 - RNA, 16 nt, Vaccinia virus
augaauuaauuaaugu

SEQ ID NO: 3265872 - RNA, 16 nt, Vaccinia virus
cauagucuucaauaau

SEQ ID NO: 3265873 - RNA, 13 nt, Vaccinia virus
ucauaaagaacag

SEQ ID NO: 3265874 - RNA, 21 nt, Vaccinia virus
aucuauuuuauucaagagaau

SEQ ID NO: 3265875 - RNA, 20 nt, Vaccinia virus
uaaacaaucugucgaaaaag

SEQ ID NO: 3265876 - RNA, 23 nt, Vaccinia virus
caaauuuuacuacauaguuaucu

SEQ ID NO: 3265877 - RNA, 14 nt, Vaccinia virus
uucccauaaguuug

SEQ ID NO: 3265878 - RNA, 13 nt, Vaccinia virus
auucguaguuuuu

SEQ ID NO: 3265879 - RNA, 20 nt, Vaccinia virus
uaguuguucagcuguagaac

SEQ ID NO: 3265880 - RNA, 11 nt, Vaccinia virus
aucaaacauua

SEQ ID NO: 3265881 - RNA, 19 nt, Vaccinia virus
uucacucguuucauaaaga

SEQ ID NO: 3265882 - RNA, 18 nt, Vaccinia virus
guccuaaucucuuaacaa

SEQ ID NO: 3265883 - RNA, 17 nt, Vaccinia virus
aguccuaaauuuucuaa

SEQ ID NO: 3265884 - RNA, 22 nt, Vaccinia virus
aaauaaaauauaaaauauugga

SEQ ID NO: 3265885 - RNA, 15 nt, Vaccinia virus
auauaugauauacca

SEQ ID NO: 3265886 - RNA, 20 nt, Vaccinia virus
aauuagucuauuauccaaga

SEQ ID NO: 3265887 - RNA, 19 nt, Vaccinia virus
ucuauaauaucuuauucug

SEQ ID NO: 3265888 - RNA, 17 nt, Vaccinia virus
auaugcuaguuaauagu

SEQ ID NO: 3265889 - RNA, 17 nt, Vaccinia virus
cucaucguauauuuuga

SEQ ID NO: 3265890 - RNA, 17 nt, Vaccinia virus
augauuuuacugcaaua

SEQ ID NO: 3265891 - RNA, 21 nt, Vaccinia virus
augaugauacucucaaccauu

SEQ ID NO: 3265892 - RNA, 18 nt, Vaccinia virus
acauaggauuaaaaauaa

SEQ ID NO: 3265893 - RNA, 18 nt, Vaccinia virus
aucgugguuaacaauaug

SEQ ID NO: 3265894 - RNA, 18 nt, Vaccinia virus
auuccauuaucugaaaug

SEQ ID NO: 3265895 - RNA, 17 nt, Vaccinia virus
ggauuucucauagaccu

SEQ ID NO: 3265896 - RNA, 16 nt, Vaccinia virus
ucuuuuucccagcauu

SEQ ID NO: 3265897 - RNA, 16 nt, Vaccinia virus
uacuauauguauucuu

SEQ ID NO: 3265898 - RNA, 20 nt, Vaccinia virus
uaauagcuccauaaacugau

SEQ ID NO: 3265899 - RNA, 23 nt, Vaccinia virus
gagcuaauuuuuguaaauaacua

SEQ ID NO: 3265900 - RNA, 14 nt, Vaccinia virus
gugcauaucuuuuu

SEQ ID NO: 3265901 - RNA, 18 nt, Vaccinia virus
gcaucgcuucguuuacau

SEQ ID NO: 3265902 - RNA, 21 nt, Vaccinia virus
aauccaucuguauuaaagaua

SEQ ID NO: 3265903 - RNA, 21 nt, Vaccinia virus
gaagauuauuauggaaaucaa

SEQ ID NO: 3265904 - RNA, 13 nt, Vaccinia virus
gauauuacuuaua

SEQ ID NO: 3265905 - RNA, 22 nt, Vaccinia virus
auuaacgauaucuugcaaaaua

SEQ ID NO: 3265906 - RNA, 20 nt, Vaccinia virus
augcaaacuaucuaaaugua

SEQ ID NO: 3265907 - RNA, 15 nt, Vaccinia virus
ccuccuacagauuuu

SEQ ID NO: 3265908 - RNA, 17 nt, Vaccinia virus
uacguuuacacaauugu

SEQ ID NO: 3265909 - RNA, 21 nt, Vaccinia virus
uaggaaauugguuuaugaugu

SEQ ID NO: 3265910 - RNA, 18 nt, Vaccinia virus
aacagacgacaacaugua

SEQ ID NO: 3265911 - RNA, 14 nt, Vaccinia virus
cagacaaugcuuua

SEQ ID NO: 3265912 - RNA, 14 nt, Vaccinia virus
cacggaagaacuac

SEQ ID NO: 3265913 - RNA, 18 nt, Vaccinia virus
ucucccauaaucuuggua

SEQ ID NO: 3265914 - RNA, 15 nt, Vaccinia virus
agacguauaagucua

SEQ ID NO: 3265915 - RNA, 15 nt, Vaccinia virus
cgucagcugcucuag

SEQ ID NO: 3265916 - RNA, 21 nt, Vaccinia virus
uuacuggugcuccuguagcau

SEQ ID NO: 3265917 - RNA, 22 nt, Vaccinia virus
aaaaauacaugggaaaugauau

SEQ ID NO: 3265918 - RNA, 14 nt, Vaccinia virus
cuucuacauuuuca

SEQ ID NO: 3265919 - RNA, 18 nt, Vaccinia virus
auuauucuacuaucaaag

SEQ ID NO: 3265920 - RNA, 17 nt, Vaccinia virus
aauauacgauuaguaau

SEQ ID NO: 3265921 - RNA, 14 nt, Vaccinia virus
cggaucuucuuaau

SEQ ID NO: 3265922 - RNA, 19 nt, Vaccinia virus
caaguaucuuguuccuaau

SEQ ID NO: 3265923 - RNA, 14 nt, Vaccinia virus
aauuauuucuaaua

SEQ ID NO: 3265924 - RNA, 17 nt, Vaccinia virus
uaaaacuuuauuaucca

SEQ ID NO: 3265925 - RNA, 19 nt, Vaccinia virus
aagucgaauauaaaugauu

SEQ ID NO: 3265926 - RNA, 19 nt, Vaccinia virus
auuaaucuaguagaaaaga

SEQ ID NO: 3265927 - RNA, 18 nt, Vaccinia virus
caagauucguagaagcau

SEQ ID NO: 3265928 - RNA, 19 nt, Vaccinia virus
aucuccacuuuugcuuuac

SEQ ID NO: 3265929 - RNA, 22 nt, Vaccinia virus
cuccagacuuuauaauuucauc

SEQ ID NO: 3265930 - RNA, 20 nt, Vaccinia virus
uauagaggaauaucaucaaa

SEQ ID NO: 3265931 - RNA, 17 nt, Vaccinia virus
aauaucuuuaauccaau

SEQ ID NO: 3265932 - RNA, 16 nt, Vaccinia virus
uagguauguccucugc

SEQ ID NO: 3265933 - RNA, 14 nt, Vaccinia virus
uuuaguguagauau

SEQ ID NO: 3265934 - RNA, 13 nt, Vaccinia virus
cuauacuauguua

SEQ ID NO: 3265935 - RNA, 18 nt, Vaccinia virus
cuagacuugauuauucua

SEQ ID NO: 3265936 - RNA, 17 nt, Vaccinia virus
auaacuaucagaguuac

SEQ ID NO: 3265937 - RNA, 16 nt, Vaccinia virus
auuggauggacacauu

SEQ ID NO: 3265938 - RNA, 20 nt, Vaccinia virus
acacacugagaaacagcaua

SEQ ID NO: 3265939 - RNA, 17 nt, Vaccinia virus
uuugagaauauauacag

SEQ ID NO: 3265940 - RNA, 17 nt, Vaccinia virus
gacuauaaaauauucua

SEQ ID NO: 3265941 - RNA, 24 nt, Vaccinia virus
aagaagauuaucaagauguguaug

SEQ ID NO: 3265942 - RNA, 21 nt, Vaccinia virus
caauaacuaauggcaaaugua

SEQ ID NO: 3265943 - RNA, 19 nt, Vaccinia virus
caaauucauuauuaaacag

SEQ ID NO: 3265944 - RNA, 18 nt, Vaccinia virus
gcaaaacuauuauuuuaa

SEQ ID NO: 3265945 - RNA, 23 nt, Vaccinia virus
agugaauugauugcuguuauuaa

SEQ ID NO: 3265946 - RNA, 16 nt, Vaccinia virus
uagcagcacaaaucaa

SEQ ID NO: 3265947 - RNA, 14 nt, Vaccinia virus
ucuucuauuucuaa

SEQ ID NO: 3265948 - RNA, 14 nt, Vaccinia virus
uuuggaucuaguau

SEQ ID NO: 3265949 - RNA, 18 nt, Vaccinia virus
uauucuauccaaggacaa

SEQ ID NO: 3265950 - RNA, 19 nt, Vaccinia virus
caauuuugauguauaacaa

SEQ ID NO: 3265951 - RNA, 19 nt, Vaccinia virus
uguaaaaaaauuauacugu

SEQ ID NO: 3265952 - RNA, 23 nt, Vaccinia virus
acggguuguauuguuauuuuaca

SEQ ID NO: 3265953 - RNA, 21 nt, Vaccinia virus
gaaacuuaaaauauaaugaua

SEQ ID NO: 3265954 - RNA, 17 nt, Vaccinia virus
ucgcauauaacaacaaa

SEQ ID NO: 3265955 - RNA, 16 nt, Vaccinia virus
cucccaccaaauuaau

SEQ ID NO: 3265956 - RNA, 17 nt, Vaccinia virus
uuagauacaauggauga

SEQ ID NO: 3265957 - RNA, 17 nt, Vaccinia virus
uugauacauacauuaau

SEQ ID NO: 3265958 - RNA, 15 nt, Vaccinia virus
aguguagauaugaua

SEQ ID NO: 3265959 - RNA, 18 nt, Vaccinia virus
gauccugcauagaaauau

SEQ ID NO: 3265960 - RNA, 24 nt, Vaccinia virus
caacaugauuauucuacuaucaaa

SEQ ID NO: 3265961 - RNA, 15 nt, Vaccinia virus
uaccgauuuaucauc

SEQ ID NO: 3265962 - RNA, 13 nt, Vaccinia virus
guaauauucuagu

SEQ ID NO: 3265963 - RNA, 23 nt, Vaccinia virus
ugaacgcugcccaccucauacau

SEQ ID NO: 3265964 - RNA, 20 nt, Vaccinia virus
caucugggaauaaaauacua

SEQ ID NO: 3265965 - RNA, 16 nt, Vaccinia virus
acuagacuauuaauaa

SEQ ID NO: 3265966 - RNA, 22 nt, Vaccinia virus
agccauguugauaaacuacuua

SEQ ID NO: 3265967 - RNA, 13 nt, Vaccinia virus
cuuuacuuuucua

SEQ ID NO: 3265968 - RNA, 14 nt, Vaccinia virus
cagaagauaaugaa

SEQ ID NO: 3265969 - RNA, 14 nt, Vaccinia virus
gaaauccuauuuua

SEQ ID NO: 3265970 - RNA, 15 nt, Vaccinia virus
gaaauauauacuuca

SEQ ID NO: 3265971 - RNA, 23 nt, Vaccinia virus
gaugucaucuucgucuauuucua

SEQ ID NO: 3265972 - RNA, 21 nt, Vaccinia virus
cuguagauaaacuaggauuua

SEQ ID NO: 3265973 - RNA, 21 nt, Vaccinia virus
ucacuguuguacauacaggua

SEQ ID NO: 3265974 - RNA, 19 nt, Vaccinia virus
aucgucuucacaaagaaug

SEQ ID NO: 3265975 - RNA, 19 nt, Vaccinia virus
uauagcuauucuucuuuaa

SEQ ID NO: 3265976 - RNA, 15 nt, Vaccinia virus
ucauaauuaauacaa

SEQ ID NO: 3265977 - RNA, 11 nt, Vaccinia virus
auauucuuucu

SEQ ID NO: 3265978 - RNA, 22 nt, Vaccinia virus
auacauuuugcauuagauuuac

SEQ ID NO: 3265979 - RNA, 19 nt, Vaccinia virus
ugguaaguucauuaucuga

SEQ ID NO: 3265980 - RNA, 20 nt, Vaccinia virus
auauauuccuugaauaaccu

SEQ ID NO: 3265981 - RNA, 23 nt, Vaccinia virus
uguacuucuuccaguucuggaua

SEQ ID NO: 3265982 - RNA, 16 nt, Vaccinia virus
aggcaguuaaggauaa

SEQ ID NO: 3265983 - RNA, 17 nt, Vaccinia virus
ugcuuccgaucccaaau

SEQ ID NO: 3265984 - RNA, 12 nt, Vaccinia virus
aucaaaaaauua

SEQ ID NO: 3265985 - RNA, 21 nt, Vaccinia virus
agaauuucuacauaauuauau

SEQ ID NO: 3265986 - RNA, 23 nt, Vaccinia virus
uccacucucgauaaaucuacuca

SEQ ID NO: 3265987 - RNA, 21 nt, Vaccinia virus
aauagaggagccauuaaaugu

SEQ ID NO: 3265988 - RNA, 16 nt, Vaccinia virus
uacuaaagucaucaau

SEQ ID NO: 3265989 - RNA, 21 nt, Vaccinia virus
uuaacaauauauuauuaguuu

SEQ ID NO: 3265990 - RNA, 15 nt, Vaccinia virus
acuaauacaucugaa

SEQ ID NO: 3265991 - RNA, 13 nt, Vaccinia virus
cagaugucauuau

SEQ ID NO: 3265992 - RNA, 15 nt, Vaccinia virus
aguagauuuaauagu

SEQ ID NO: 3265993 - RNA, 15 nt, Vaccinia virus
gacaaugaauugcau

SEQ ID NO: 3265994 - RNA, 23 nt, Vaccinia virus
aaacagauauaguuuuucuggaa

SEQ ID NO: 3265995 - RNA, 20 nt, Vaccinia virus
uacuaaggccacuacucaaa

SEQ ID NO: 3265996 - RNA, 19 nt, Vaccinia virus
cuauuuucgcuccaaaugu

SEQ ID NO: 3265997 - RNA, 22 nt, Vaccinia virus
acuuuuggaaucguucaaaacc

SEQ ID NO: 3265998 - RNA, 21 nt, Vaccinia virus
ggauucauccuuaaauguuuu

SEQ ID NO: 3265999 - RNA, 21 nt, Vaccinia virus
auuucauagacuuuaucuaga

SEQ ID NO: 3266000 - RNA, 21 nt, Vaccinia virus
uacuguauugauuacagugua

SEQ ID NO: 3266001 - RNA, 17 nt, Vaccinia virus
aauuaauaauauaaaau

SEQ ID NO: 3266002 - RNA, 17 nt, Vaccinia virus
aacaucaacacuuauau

SEQ ID NO: 3266003 - RNA, 15 nt, Vaccinia virus
acgauucaggaaucg

SEQ ID NO: 3266004 - RNA, 19 nt, Vaccinia virus
uaugccgugggaugauguc

SEQ ID NO: 3266005 - RNA, 21 nt, Vaccinia virus
gcuucuaucuuguuuagauuu

SEQ ID NO: 3266006 - RNA, 18 nt, Vaccinia virus
aacuuaaaagaauuacuu

SEQ ID NO: 3266007 - RNA, 21 nt, Vaccinia virus
cgaugacucuaccugaugaau

SEQ ID NO: 3266008 - RNA, 16 nt, Vaccinia virus
cuagaugaugauuuuc

SEQ ID NO: 3266009 - RNA, 12 nt, Vaccinia virus
cucacuucucuu

SEQ ID NO: 3266010 - RNA, 21 nt, Vaccinia virus
gcacguaucuaaaguauuucu

SEQ ID NO: 3266011 - RNA, 14 nt, Vaccinia virus
auaucauuaaugau

SEQ ID NO: 3266012 - RNA, 19 nt, Vaccinia virus
acaauuagacguaaguucu

SEQ ID NO: 3266013 - RNA, 17 nt, Vaccinia virus
uaauauccaaucuuauu

SEQ ID NO: 3266014 - RNA, 16 nt, Vaccinia virus
guucagaggaugaaau

SEQ ID NO: 3266015 - RNA, 17 nt, Vaccinia virus
uauaauagucaauagau

SEQ ID NO: 3266016 - RNA, 16 nt, Vaccinia virus
auauuauauaaacauu

SEQ ID NO: 3266017 - RNA, 23 nt, Vaccinia virus
ucaaaaagauuagacauaucaga

SEQ ID NO: 3266018 - RNA, 22 nt, Vaccinia virus
uguucuaucaacgauucuagaa

SEQ ID NO: 3266019 - RNA, 18 nt, Vaccinia virus
ucuauuaaaaauccaagu

SEQ ID NO: 3266020 - RNA, 15 nt, Vaccinia virus
uauccgcgacaaauu

SEQ ID NO: 3266021 - RNA, 18 nt, Vaccinia virus
aauagaucaacagaaaua

SEQ ID NO: 3266022 - RNA, 12 nt, Vaccinia virus
cauacuacuuau

SEQ ID NO: 3266023 - RNA, 18 nt, Vaccinia virus
augccauacucagaauua

SEQ ID NO: 3266024 - RNA, 15 nt, Vaccinia virus
agauuaaaugcaaua

SEQ ID NO: 3266025 - RNA, 20 nt, Vaccinia virus
acuaauucuuucucaucaac

SEQ ID NO: 3266026 - RNA, 17 nt, Vaccinia virus
ugaauuugauaagacuu

SEQ ID NO: 3266027 - RNA, 18 nt, Vaccinia virus
cuguauaucuauaauauu

SEQ ID NO: 3266028 - RNA, 21 nt, Vaccinia virus
uaagacacagaaauacuauau

SEQ ID NO: 3266029 - RNA, 17 nt, Vaccinia virus
acaauuauuauauaauu

SEQ ID NO: 3266030 - RNA, 17 nt, Vaccinia virus
augaccauuaaaauaaa

SEQ ID NO: 3266031 - RNA, 20 nt, Vaccinia virus
acauuaguagggauagaaug

SEQ ID NO: 3266032 - RNA, 12 nt, Vaccinia virus
aacuuacaaaau

SEQ ID NO: 3266033 - RNA, 12 nt, Vaccinia virus
uuauuacauucu

SEQ ID NO: 3266034 - RNA, 22 nt, Vaccinia virus
ucuuccuuaacuauauauuugu

SEQ ID NO: 3266035 - RNA, 14 nt, Vaccinia virus
ucagcgcauaauaa

SEQ ID NO: 3266036 - RNA, 18 nt, Vaccinia virus
uguugugcuguuguacau

SEQ ID NO: 3266037 - RNA, 22 nt, Vaccinia virus
uuauaucauccaauauuauuga

SEQ ID NO: 3266038 - RNA, 22 nt, Vaccinia virus
ucucacuaacuaauguuucuuu

SEQ ID NO: 3266039 - RNA, 22 nt, Vaccinia virus
aggaauaaaauaugaaauaagu

SEQ ID NO: 3266040 - RNA, 23 nt, Vaccinia virus
ugcauacaauacuagucuagaaa

SEQ ID NO: 3266041 - RNA, 20 nt, Vaccinia virus
uaacuuaaaagaauuacuua

SEQ ID NO: 3266042 - RNA, 18 nt, Vaccinia virus
guuagcuguuuucaucaa

SEQ ID NO: 3266043 - RNA, 23 nt, Vaccinia virus
ugugggaagcgauucaaaaggac

SEQ ID NO: 3266044 - RNA, 16 nt, Vaccinia virus
caaugauagacuagaa

SEQ ID NO: 3266045 - RNA, 16 nt, Vaccinia virus
aaaauuaguagaauca

SEQ ID NO: 3266046 - RNA, 22 nt, Vaccinia virus
agaaaauaauccugaauauauu

SEQ ID NO: 3266047 - RNA, 21 nt, Vaccinia virus
agacauaucgguaaaaugcau

SEQ ID NO: 3266048 - RNA, 21 nt, Vaccinia virus
cucugaauauagaacaucauu

SEQ ID NO: 3266049 - RNA, 20 nt, Vaccinia virus
ucugauaauccagucuuuaa

SEQ ID NO: 3266050 - RNA, 21 nt, Vaccinia virus
uaguaaacuugacuaaaucuu

SEQ ID NO: 3266051 - RNA, 15 nt, Vaccinia virus
uauucacuuaacagu

SEQ ID NO: 3266052 - RNA, 20 nt, Vaccinia virus
auuauaugguagauuguuaa

SEQ ID NO: 3266053 - RNA, 17 nt, Vaccinia virus
ggacacgauauagagag

SEQ ID NO: 3266054 - RNA, 19 nt, Vaccinia virus
uauguuuuuacagagacuu

SEQ ID NO: 3266055 - RNA, 15 nt, Vaccinia virus
agacauaagaaauuu

SEQ ID NO: 3266056 - RNA, 19 nt, Vaccinia virus
uauacgaaauaaauauuca

SEQ ID NO: 3266057 - RNA, 19 nt, Vaccinia virus
aacccuuacaacuacagua

SEQ ID NO: 3266058 - RNA, 11 nt, Vaccinia virus
auuaauuauug

SEQ ID NO: 3266059 - RNA, 16 nt, Vaccinia virus
caaagucaucaaucau

SEQ ID NO: 3266060 - RNA, 15 nt, Vaccinia virus
auguuuaaugauacg

SEQ ID NO: 3266061 - RNA, 20 nt, Vaccinia virus
ccgaucaaagaauuaaugau

SEQ ID NO: 3266062 - RNA, 15 nt, Vaccinia virus
uuuauacuucuaaug

SEQ ID NO: 3266063 - RNA, 14 nt, Vaccinia virus
aguuucuguaauga

SEQ ID NO: 3266064 - RNA, 16 nt, Vaccinia virus
ugauuguacacuucua

SEQ ID NO: 3266065 - RNA, 16 nt, Vaccinia virus
gaccuauuaauaauua

SEQ ID NO: 3266066 - RNA, 14 nt, Vaccinia virus
ccaaauuaaugaau

SEQ ID NO: 3266067 - RNA, 24 nt, Vaccinia virus
aucuuuguuggaucagucucuaag

SEQ ID NO: 3266068 - RNA, 21 nt, Vaccinia virus
uaauguauucucuuacaaaua

SEQ ID NO: 3266069 - RNA, 16 nt, Vaccinia virus
ggcaauuguagauaua

SEQ ID NO: 3266070 - RNA, 14 nt, Vaccinia virus
cuuguguuuggaag

SEQ ID NO: 3266071 - RNA, 19 nt, Vaccinia virus
uauaaaacgauuaaacaau

SEQ ID NO: 3266072 - RNA, 17 nt, Vaccinia virus
cuauauucuugauguag

SEQ ID NO: 3266073 - RNA, 16 nt, Vaccinia virus
uuaacuuuucauuaau

SEQ ID NO: 3266074 - RNA, 18 nt, Vaccinia virus
ucuucuuugauuaaugau

SEQ ID NO: 3266075 - RNA, 20 nt, Vaccinia virus
uuaccaucaaaagcauuaau

SEQ ID NO: 3266076 - RNA, 15 nt, Vaccinia virus
ugauacguauauaca

SEQ ID NO: 3266077 - RNA, 22 nt, Vaccinia virus
uucuagaauuagaauuacaaaa

SEQ ID NO: 3266078 - RNA, 21 nt, Vaccinia virus
auagaauucucuucauaucau

SEQ ID NO: 3266079 - RNA, 19 nt, Vaccinia virus
cguuaacgauaguaucaau

SEQ ID NO: 3266080 - RNA, 14 nt, Vaccinia virus
acauauuacaaaau

SEQ ID NO: 3266081 - RNA, 18 nt, Vaccinia virus
uucgcaaacuauucuaau

SEQ ID NO: 3266082 - RNA, 14 nt, Vaccinia virus
auguuaaaaaugac

SEQ ID NO: 3266083 - RNA, 19 nt, Vaccinia virus
uggauauguggaaaaguau

SEQ ID NO: 3266084 - RNA, 20 nt, Vaccinia virus
aacaaucguuaauaaaucug

SEQ ID NO: 3266085 - RNA, 14 nt, Vaccinia virus
aauguaauucuaaa

SEQ ID NO: 3266086 - RNA, 20 nt, Vaccinia virus
ggaaguagaaucauaaagaa

SEQ ID NO: 3266087 - RNA, 18 nt, Vaccinia virus
auguugaacauaaaacua

SEQ ID NO: 3266088 - RNA, 15 nt, Vaccinia virus
auuacguuucauuuu

SEQ ID NO: 3266089 - RNA, 17 nt, Vaccinia virus
aaugcuagaauuagaaa

SEQ ID NO: 3266090 - RNA, 17 nt, Vaccinia virus
gcuauaacuugcuucaa

SEQ ID NO: 3266091 - RNA, 20 nt, Vaccinia virus
guugcgcagagugaauaauu

SEQ ID NO: 3266092 - RNA, 19 nt, Vaccinia virus
uaauauuuugcaucauuca

SEQ ID NO: 3266093 - RNA, 14 nt, Vaccinia virus
uacuuguacacaua

SEQ ID NO: 3266094 - RNA, 20 nt, Vaccinia virus
uguucacauccaccaaugau

SEQ ID NO: 3266095 - RNA, 13 nt, Vaccinia virus
uugauuuuggaua

SEQ ID NO: 3266096 - RNA, 20 nt, Vaccinia virus
auggauaauauuuguaaugg

SEQ ID NO: 3266097 - RNA, 20 nt, Vaccinia virus
auguccggaaugaagagaag

SEQ ID NO: 3266098 - RNA, 15 nt, Vaccinia virus
gaucuaaaaaaaacu

SEQ ID NO: 3266099 - RNA, 23 nt, Vaccinia virus
aucugauaacuuuaaacauggau

SEQ ID NO: 3266100 - RNA, 15 nt, Vaccinia virus
aauaucuguuccuca

SEQ ID NO: 3266101 - RNA, 22 nt, Vaccinia virus
gcuaaagcuaucuauacuauca

SEQ ID NO: 3266102 - RNA, 13 nt, Vaccinia virus
uaaaagacuuauu

SEQ ID NO: 3266103 - RNA, 22 nt, Vaccinia virus
uuuuucauccuugcuaucaaag

SEQ ID NO: 3266104 - RNA, 14 nt, Vaccinia virus
ucauaauugcuauu

SEQ ID NO: 3266105 - RNA, 21 nt, Vaccinia virus
aguuauauuuucgucuaucca

SEQ ID NO: 3266106 - RNA, 13 nt, Vaccinia virus
gguacuauuucua

SEQ ID NO: 3266107 - RNA, 17 nt, Vaccinia virus
auauuuguauagauaau

SEQ ID NO: 3266108 - RNA, 18 nt, Vaccinia virus
aauauaaugauauacaau

SEQ ID NO: 3266109 - RNA, 16 nt, Vaccinia virus
uucuggacauagcuuu

SEQ ID NO: 3266110 - RNA, 15 nt, Vaccinia virus
aucugaugagaucaa

SEQ ID NO: 3266111 - RNA, 18 nt, Vaccinia virus
ugauauguauauuauuca

SEQ ID NO: 3266112 - RNA, 20 nt, Vaccinia virus
gaauauacaaaguuaguaca

SEQ ID NO: 3266113 - RNA, 14 nt, Vaccinia virus
auauaguaaugaag

SEQ ID NO: 3266114 - RNA, 13 nt, Vaccinia virus
auuaucaaaucuu

SEQ ID NO: 3266115 - RNA, 16 nt, Vaccinia virus
auuguuuuuuauuuuc

SEQ ID NO: 3266116 - RNA, 16 nt, Vaccinia virus
uucacuaaauaguuuu

SEQ ID NO: 3266117 - RNA, 19 nt, Vaccinia virus
aacacuuuggauacaaaau

SEQ ID NO: 3266118 - RNA, 17 nt, Vaccinia virus
gaugugucuacauaaau

SEQ ID NO: 3266119 - RNA, 23 nt, Vaccinia virus
auuucuuuucccucguucaucua

SEQ ID NO: 3266120 - RNA, 14 nt, Vaccinia virus
acgaaagcaaagaa

SEQ ID NO: 3266121 - RNA, 16 nt, Vaccinia virus
acacaaccagcaauaa

SEQ ID NO: 3266122 - RNA, 20 nt, Vaccinia virus
ugauaucgcauagaaauaca

SEQ ID NO: 3266123 - RNA, 16 nt, Vaccinia virus
aauggugguaaaacua

SEQ ID NO: 3266124 - RNA, 13 nt, Vaccinia virus
uuaauuuguacau

SEQ ID NO: 3266125 - RNA, 16 nt, Vaccinia virus
agcaaaauuauuaauu

SEQ ID NO: 3266126 - RNA, 14 nt, Vaccinia virus
aauuaaaaaagaua

SEQ ID NO: 3266127 - RNA, 23 nt, Vaccinia virus
aacagugagaggaucgacuccau

SEQ ID NO: 3266128 - RNA, 14 nt, Vaccinia virus
auuuagaaaugaag

SEQ ID NO: 3266129 - RNA, 23 nt, Vaccinia virus
guuaagaaucgcgauucuaaaac

SEQ ID NO: 3266130 - RNA, 14 nt, Vaccinia virus
aaugucaugauaca

SEQ ID NO: 3266131 - RNA, 22 nt, Vaccinia virus
aucuaaacauaagacuuauucu

SEQ ID NO: 3266132 - RNA, 17 nt, Vaccinia virus
aacuccggccauuugua

SEQ ID NO: 3266133 - RNA, 20 nt, Vaccinia virus
augacguaaccaagaaguuu

SEQ ID NO: 3266134 - RNA, 19 nt, Vaccinia virus
guucuucgcagaugaugau

SEQ ID NO: 3266135 - RNA, 15 nt, Vaccinia virus
gagaaauaauaagaa

SEQ ID NO: 3266136 - RNA, 22 nt, Vaccinia virus
uguuuugaggcagcaaauacug

SEQ ID NO: 3266137 - RNA, 13 nt, Vaccinia virus
auaagauaucuuc

SEQ ID NO: 3266138 - RNA, 22 nt, Vaccinia virus
auacgauaguuuguuucuggaa

SEQ ID NO: 3266139 - RNA, 13 nt, Vaccinia virus
caacuuauccauu

SEQ ID NO: 3266140 - RNA, 18 nt, Vaccinia virus
auauagccacaauuauug

SEQ ID NO: 3266141 - RNA, 13 nt, Vaccinia virus
agaaauauauauu

SEQ ID NO: 3266142 - RNA, 18 nt, Vaccinia virus
cauuauucuauuucgaau

SEQ ID NO: 3266143 - RNA, 13 nt, Vaccinia virus
aucuagagauugu

SEQ ID NO: 3266144 - RNA, 13 nt, Vaccinia virus
uagauuuuggaua

SEQ ID NO: 3266145 - RNA, 16 nt, Vaccinia virus
gauaucuauacuuacu

SEQ ID NO: 3266146 - RNA, 13 nt, Vaccinia virus
auuacuaugaauc

SEQ ID NO: 3266147 - RNA, 19 nt, Vaccinia virus
augaacuagacgauaaugu

SEQ ID NO: 3266148 - RNA, 13 nt, Vaccinia virus
ccagauaauaaca

SEQ ID NO: 3266149 - RNA, 14 nt, Vaccinia virus
auauguaucauaau

SEQ ID NO: 3266150 - RNA, 23 nt, Vaccinia virus
uuuguacagaacguaguaguuua

SEQ ID NO: 3266151 - RNA, 15 nt, Vaccinia virus
augagaacauaguau

SEQ ID NO: 3266152 - RNA, 17 nt, Vaccinia virus
auuaguggaagaaagau

SEQ ID NO: 3266153 - RNA, 14 nt, Vaccinia virus
guuccaacaucaua

SEQ ID NO: 3266154 - RNA, 23 nt, Vaccinia virus
aauaguuuguacugcaaaaauaa

SEQ ID NO: 3266155 - RNA, 14 nt, Vaccinia virus
uacauaaaacauca

SEQ ID NO: 3266156 - RNA, 17 nt, Vaccinia virus
cuucuuuuuauauccaa

SEQ ID NO: 3266157 - RNA, 17 nt, Vaccinia virus
auucuuacaguacacag

SEQ ID NO: 3266158 - RNA, 15 nt, Vaccinia virus
uacgauuuucuucuu

SEQ ID NO: 3266159 - RNA, 18 nt, Vaccinia virus
auauauuucuuagcuaga

SEQ ID NO: 3266160 - RNA, 23 nt, Vaccinia virus
gcguguuuuaaauccuuaauaua

SEQ ID NO: 3266161 - RNA, 13 nt, Vaccinia virus
uacauguuuucau

SEQ ID NO: 3266162 - RNA, 22 nt, Vaccinia virus
acuuuuucuagaaaaaaaauug

SEQ ID NO: 3266163 - RNA, 17 nt, Vaccinia virus
aggccaaaacaaaauuu

SEQ ID NO: 3266164 - RNA, 16 nt, Vaccinia virus
aauagucaauagauua

SEQ ID NO: 3266165 - RNA, 14 nt, Vaccinia virus
auaaaaguaauaaa

SEQ ID NO: 3266166 - RNA, 15 nt, Vaccinia virus
aaucuguaucgaaug

SEQ ID NO: 3266167 - RNA, 12 nt, Vaccinia virus
aucucaaaauag

SEQ ID NO: 3266168 - RNA, 16 nt, Vaccinia virus
gaacaauaaacaaaau

SEQ ID NO: 3266169 - RNA, 16 nt, Vaccinia virus
guugacauguauauau

SEQ ID NO: 3266170 - RNA, 21 nt, Vaccinia virus
acagugauacccgcaauuauu

SEQ ID NO: 3266171 - RNA, 17 nt, Vaccinia virus
accgauaaacuacuacu

SEQ ID NO: 3266172 - RNA, 16 nt, Vaccinia virus
aguuauuggauuaaaa

SEQ ID NO: 3266173 - RNA, 21 nt, Vaccinia virus
gcuaccaucccacucuagaga

SEQ ID NO: 3266174 - RNA, 21 nt, Vaccinia virus
uagacauaucgguaaaaugca

SEQ ID NO: 3266175 - RNA, 18 nt, Vaccinia virus
ucacuaugaaacaaaugu

SEQ ID NO: 3266176 - RNA, 21 nt, Vaccinia virus
agagaauugcugcaauauauu

SEQ ID NO: 3266177 - RNA, 20 nt, Vaccinia virus
cauaaauucaaccaugaauu

SEQ ID NO: 3266178 - RNA, 17 nt, Vaccinia virus
auuggguccuauugcuu

SEQ ID NO: 3266179 - RNA, 15 nt, Vaccinia virus
auauaguaaugaaga

SEQ ID NO: 3266180 - RNA, 23 nt, Vaccinia virus
uauuugcgaggaugacucucaaa

SEQ ID NO: 3266181 - RNA, 16 nt, Vaccinia virus
uaauuuuagaagcuau

SEQ ID NO: 3266182 - RNA, 15 nt, Vaccinia virus
guauuugaacagagc

SEQ ID NO: 3266183 - RNA, 13 nt, Vaccinia virus
uagaauacuaaag

SEQ ID NO: 3266184 - RNA, 18 nt, Vaccinia virus
uaucaucgacacaaauga

SEQ ID NO: 3266185 - RNA, 22 nt, Vaccinia virus
aaaaagauuaccguaugauaug

SEQ ID NO: 3266186 - RNA, 14 nt, Vaccinia virus
aucauaaaaaugag

SEQ ID NO: 3266187 - RNA, 15 nt, Vaccinia virus
guaucauauauuaaa

SEQ ID NO: 3266188 - RNA, 14 nt, Vaccinia virus
caaguauacaauuu

SEQ ID NO: 3266189 - RNA, 18 nt, Vaccinia virus
ucuaucuuuguagaguau

SEQ ID NO: 3266190 - RNA, 16 nt, Vaccinia virus
ucacuaacaauaacua

SEQ ID NO: 3266191 - RNA, 16 nt, Vaccinia virus
auagacaauuauguaa

SEQ ID NO: 3266192 - RNA, 14 nt, Vaccinia virus
uaaaucacauaucu

SEQ ID NO: 3266193 - RNA, 18 nt, Vaccinia virus
ucauaaauuuuuauuucu

SEQ ID NO: 3266194 - RNA, 15 nt, Vaccinia virus
uacuagcucucaagu

SEQ ID NO: 3266195 - RNA, 13 nt, Vaccinia virus
auguauacaaaug

SEQ ID NO: 3266196 - RNA, 19 nt, Vaccinia virus
uauuauugauccaaucaaa

SEQ ID NO: 3266197 - RNA, 21 nt, Vaccinia virus
aauaaauuuagugagaauaau

SEQ ID NO: 3266198 - RNA, 17 nt, Vaccinia virus
uuacaagaauauaaaaa

SEQ ID NO: 3266199 - RNA, 18 nt, Vaccinia virus
ucugcuccuuuuucuauu

SEQ ID NO: 3266200 - RNA, 22 nt, Vaccinia virus
aaaaugacaucguugcccggau

SEQ ID NO: 3266201 - RNA, 15 nt, Vaccinia virus
uguccauauuuucca

SEQ ID NO: 3266202 - RNA, 19 nt, Vaccinia virus
aaagaugcuauguauauau

SEQ ID NO: 3266203 - RNA, 14 nt, Vaccinia virus
uagaaauacaaaag

SEQ ID NO: 3266204 - RNA, 15 nt, Vaccinia virus
gagguagcaaaaaga

SEQ ID NO: 3266205 - RNA, 21 nt, Vaccinia virus
augauacgauacuauauguau

SEQ ID NO: 3266206 - RNA, 23 nt, Vaccinia virus
ucuaaauguggcuacaaacuuuu

SEQ ID NO: 3266207 - RNA, 12 nt, Vaccinia virus
uaucuucucaaa

SEQ ID NO: 3266208 - RNA, 12 nt, Vaccinia virus
cucucauuuucu

SEQ ID NO: 3266209 - RNA, 17 nt, Vaccinia virus
aaucuuaauaucuucgu

SEQ ID NO: 3266210 - RNA, 16 nt, Vaccinia virus
aguauugaaacuauau

SEQ ID NO: 3266211 - RNA, 20 nt, Vaccinia virus
cuaugcaaagaauuuggaau

SEQ ID NO: 3266212 - RNA, 13 nt, Vaccinia virus
auuacaacauaau

SEQ ID NO: 3266213 - RNA, 12 nt, Vaccinia virus
uagaauuuccaa

SEQ ID NO: 3266214 - RNA, 14 nt, Vaccinia virus
caccucauacauau

SEQ ID NO: 3266215 - RNA, 22 nt, Vaccinia virus
aguuaucugguaaguucauuau

SEQ ID NO: 3266216 - RNA, 19 nt, Vaccinia virus
aucacguguuaaacaaugg

SEQ ID NO: 3266217 - RNA, 18 nt, Vaccinia virus
aaugagauguuaaaugaa

SEQ ID NO: 3266218 - RNA, 14 nt, Vaccinia virus
uuaaagaauguaua

SEQ ID NO: 3266219 - RNA, 14 nt, Vaccinia virus
guuugguaaucauu

SEQ ID NO: 3266220 - RNA, 14 nt, Vaccinia virus
uagaacucuuuuca

SEQ ID NO: 3266221 - RNA, 21 nt, Vaccinia virus
auuuaauuuuguaguuaauuu

SEQ ID NO: 3266222 - RNA, 13 nt, Vaccinia virus
gaaaaaugauuau

SEQ ID NO: 3266223 - RNA, 16 nt, Vaccinia virus
uccugcguuagauguu

SEQ ID NO: 3266224 - RNA, 15 nt, Vaccinia virus
aaacauuuugcagaa

SEQ ID NO: 3266225 - RNA, 15 nt, Vaccinia virus
augccuauaaaguaa

SEQ ID NO: 3266226 - RNA, 22 nt, Vaccinia virus
agauuaaagacuuauagcuaga

SEQ ID NO: 3266227 - RNA, 22 nt, Vaccinia virus
aggagaugauagucauuugacu

SEQ ID NO: 3266228 - RNA, 19 nt, Vaccinia virus
aguuucauaucguaacuga

SEQ ID NO: 3266229 - RNA, 18 nt, Vaccinia virus
uuuguaaagcuauguaaa

SEQ ID NO: 3266230 - RNA, 19 nt, Vaccinia virus
auagagaacauauaaaugu

SEQ ID NO: 3266231 - RNA, 19 nt, Vaccinia virus
aaucacagcaguaguuuaa

SEQ ID NO: 3266232 - RNA, 23 nt, Vaccinia virus
uaaauccucuauuuauugacauu

SEQ ID NO: 3266233 - RNA, 20 nt, Vaccinia virus
gauccugcauagaaauaucu

SEQ ID NO: 3266234 - RNA, 22 nt, Vaccinia virus
gagcaauucccaagauuucauc

SEQ ID NO: 3266235 - RNA, 20 nt, Vaccinia virus
cauguaacacucgacacaau

SEQ ID NO: 3266236 - RNA, 15 nt, Vaccinia virus
ugucuguauauguaa

SEQ ID NO: 3266237 - RNA, 21 nt, Vaccinia virus
guaacuggaucuuuauuuuuc

SEQ ID NO: 3266238 - RNA, 19 nt, Vaccinia virus
accaccuccuauaucaaug

SEQ ID NO: 3266239 - RNA, 13 nt, Vaccinia virus
agcugaaaugaga

SEQ ID NO: 3266240 - RNA, 17 nt, Vaccinia virus
cauaacuucguuguccu

SEQ ID NO: 3266241 - RNA, 23 nt, Vaccinia virus
uuaacaaauucugcaauaucuuc

SEQ ID NO: 3266242 - RNA, 14 nt, Vaccinia virus
acgcagauagcuau

SEQ ID NO: 3266243 - RNA, 21 nt, Vaccinia virus
uagcuauucguaacaaaacua

SEQ ID NO: 3266244 - RNA, 19 nt, Vaccinia virus
uauguaaaacauuugcauu

SEQ ID NO: 3266245 - RNA, 14 nt, Vaccinia virus
auaugcucuagaua

SEQ ID NO: 3266246 - RNA, 21 nt, Vaccinia virus
uagaaacgauaccaucuucug

SEQ ID NO: 3266247 - RNA, 22 nt, Vaccinia virus
cuugauaaccuuggcugucuca

SEQ ID NO: 3266248 - RNA, 21 nt, Vaccinia virus
aguaugacauuguaaaagaca

SEQ ID NO: 3266249 - RNA, 14 nt, Vaccinia virus
auuuauagaugaag

SEQ ID NO: 3266250 - RNA, 15 nt, Vaccinia virus
acacauuuucaaaua

SEQ ID NO: 3266251 - RNA, 16 nt, Vaccinia virus
caaucgaugugucaaa

SEQ ID NO: 3266252 - RNA, 19 nt, Vaccinia virus
aaaaucaggguuaucaaag

SEQ ID NO: 3266253 - RNA, 13 nt, Vaccinia virus
ucguuuacaaaau

SEQ ID NO: 3266254 - RNA, 19 nt, Vaccinia virus
acggugagaagacaauauu

SEQ ID NO: 3266255 - RNA, 18 nt, Vaccinia virus
aucuacucauagaaaggu

SEQ ID NO: 3266256 - RNA, 18 nt, Vaccinia virus
auggcaaauguauagaac

SEQ ID NO: 3266257 - RNA, 15 nt, Vaccinia virus
gaugauagagauauu

SEQ ID NO: 3266258 - RNA, 14 nt, Vaccinia virus
auaagaauaaagua

SEQ ID NO: 3266259 - RNA, 22 nt, Vaccinia virus
auuuuauauuuuguaauaagaa

SEQ ID NO: 3266260 - RNA, 23 nt, Vaccinia virus
uaaguagagauucggguacugua

SEQ ID NO: 3266261 - RNA, 14 nt, Vaccinia virus
uacucauuaucauu

SEQ ID NO: 3266262 - RNA, 17 nt, Vaccinia virus
caguaguauuggauggg

SEQ ID NO: 3266263 - RNA, 20 nt, Vaccinia virus
aaaacuauaugucuguagaa

SEQ ID NO: 3266264 - RNA, 22 nt, Vaccinia virus
gacaaaggguaauauuuugcau

SEQ ID NO: 3266265 - RNA, 15 nt, Vaccinia virus
acgugcaaggcauuu

SEQ ID NO: 3266266 - RNA, 22 nt, Vaccinia virus
uauuuuaacaaagcaucgauuu

SEQ ID NO: 3266267 - RNA, 15 nt, Vaccinia virus
ucccucguucaucua

SEQ ID NO: 3266268 - RNA, 22 nt, Vaccinia virus
uugauucaaucuaucuagcaau

SEQ ID NO: 3266269 - RNA, 16 nt, Vaccinia virus
auuuaauuuuagauaa

SEQ ID NO: 3266270 - RNA, 20 nt, Vaccinia virus
cuuguuuuugcuaauuauuu

SEQ ID NO: 3266271 - RNA, 12 nt, Vaccinia virus
aguccagaaaua

SEQ ID NO: 3266272 - RNA, 20 nt, Vaccinia virus
gaaguuuaauaauacaauau

SEQ ID NO: 3266273 - RNA, 15 nt, Vaccinia virus
aauuuguucaaaaua

SEQ ID NO: 3266274 - RNA, 17 nt, Vaccinia virus
cuaucguaucugucaau

SEQ ID NO: 3266275 - RNA, 19 nt, Vaccinia virus
auuuauagucgcgcuuuac

SEQ ID NO: 3266276 - RNA, 15 nt, Vaccinia virus
uugaaaacuauuucu

SEQ ID NO: 3266277 - RNA, 22 nt, Vaccinia virus
gauagcuuuaguuagauugcau

SEQ ID NO: 3266278 - RNA, 13 nt, Vaccinia virus
gaaaaauauauca

SEQ ID NO: 3266279 - RNA, 16 nt, Vaccinia virus
cuauaauaucuuugaa

SEQ ID NO: 3266280 - RNA, 20 nt, Vaccinia virus
auucuagucuuaaccaaaaa

SEQ ID NO: 3266281 - RNA, 19 nt, Vaccinia virus
uauggacgcagauagcuau

SEQ ID NO: 3266282 - RNA, 15 nt, Vaccinia virus
auaaaauuaauaaua

SEQ ID NO: 3266283 - RNA, 17 nt, Vaccinia virus
ucuagauccucucuuca

SEQ ID NO: 3266284 - RNA, 20 nt, Vaccinia virus
uuaacauuuuggcaaauuga

SEQ ID NO: 3266285 - RNA, 22 nt, Vaccinia virus
gacaagagacguaaauauucua

SEQ ID NO: 3266286 - RNA, 14 nt, Vaccinia virus
uuucauguucgaaa

SEQ ID NO: 3266287 - RNA, 15 nt, Vaccinia virus
ugcaaguuauucucg

SEQ ID NO: 3266288 - RNA, 15 nt, Vaccinia virus
agaaauucauauccu

SEQ ID NO: 3266289 - RNA, 20 nt, Vaccinia virus
ucuuuguccauuauuucuau

SEQ ID NO: 3266290 - RNA, 14 nt, Vaccinia virus
auaaugauagaaua

SEQ ID NO: 3266291 - RNA, 18 nt, Vaccinia virus
cacguuuugauaaaucua

SEQ ID NO: 3266292 - RNA, 20 nt, Vaccinia virus
uauuaaaucucgauaauauc

SEQ ID NO: 3266293 - RNA, 19 nt, Vaccinia virus
auuaaauauagguauauuu

SEQ ID NO: 3266294 - RNA, 18 nt, Vaccinia virus
cuaucauuaccucaugaa

SEQ ID NO: 3266295 - RNA, 14 nt, Vaccinia virus
ugacauauuacaaa

SEQ ID NO: 3266296 - RNA, 14 nt, Vaccinia virus
aaucauauaugaua

SEQ ID NO: 3266297 - RNA, 21 nt, Vaccinia virus
aaguuaucucuaacaaaacua

SEQ ID NO: 3266298 - RNA, 18 nt, Vaccinia virus
uacccaaucucucucaaa

SEQ ID NO: 3266299 - RNA, 14 nt, Vaccinia virus
auaaacuaacacaa

SEQ ID NO: 3266300 - RNA, 16 nt, Vaccinia virus
auuacacauaaacauc

SEQ ID NO: 3266301 - RNA, 15 nt, Vaccinia virus
gaaagcgagaaauaa

SEQ ID NO: 3266302 - RNA, 15 nt, Vaccinia virus
uaacguuaaacauua

SEQ ID NO: 3266303 - RNA, 22 nt, Vaccinia virus
aaacacuguuguuagagauuuu

SEQ ID NO: 3266304 - RNA, 22 nt, Vaccinia virus
uauuauugauacaauuauuaua

SEQ ID NO: 3266305 - RNA, 23 nt, Vaccinia virus
gcauccacucauauagaagaugc

SEQ ID NO: 3266306 - RNA, 18 nt, Vaccinia virus
aaguuaauucagauacua

SEQ ID NO: 3266307 - RNA, 19 nt, Vaccinia virus
auguauacauuuuccauuu

SEQ ID NO: 3266308 - RNA, 21 nt, Vaccinia virus
cagauaauaaccuccugaaaa

SEQ ID NO: 3266309 - RNA, 23 nt, Vaccinia virus
gcaaagaacagaauaaacaaaau

SEQ ID NO: 3266310 - RNA, 17 nt, Vaccinia virus
cuaauacaaaaucaucu

SEQ ID NO: 3266311 - RNA, 22 nt, Vaccinia virus
caugucuaauggcgaacauguu

SEQ ID NO: 3266312 - RNA, 18 nt, Vaccinia virus
auauucucuauuaaauac

SEQ ID NO: 3266313 - RNA, 13 nt, Vaccinia virus
uguauacuguaug

SEQ ID NO: 3266314 - RNA, 22 nt, Vaccinia virus
aaauuacuccagccguagaaua

SEQ ID NO: 3266315 - RNA, 20 nt, Vaccinia virus
aagauuguguuauauaacgg

SEQ ID NO: 3266316 - RNA, 18 nt, Vaccinia virus
aaguaguaauaaugauuc

SEQ ID NO: 3266317 - RNA, 14 nt, Vaccinia virus
uaauaaaggaugug

SEQ ID NO: 3266318 - RNA, 20 nt, Vaccinia virus
auaaugauacgauacuauau

SEQ ID NO: 3266319 - RNA, 16 nt, Vaccinia virus
acuagauuauacaaug

SEQ ID NO: 3266320 - RNA, 17 nt, Vaccinia virus
cucuaaggauccagaag

SEQ ID NO: 3266321 - RNA, 15 nt, Vaccinia virus
aaguuuaaaaaagac

SEQ ID NO: 3266322 - RNA, 21 nt, Vaccinia virus
augucucgcauaaacauuacu

SEQ ID NO: 3266323 - RNA, 16 nt, Vaccinia virus
uaacaucuuucaucau

SEQ ID NO: 3266324 - RNA, 18 nt, Vaccinia virus
cgaaaaauauaguuccau

SEQ ID NO: 3266325 - RNA, 19 nt, Vaccinia virus
auguauuuuuuaugauaua

SEQ ID NO: 3266326 - RNA, 15 nt, Vaccinia virus
auaaacaucaacauu

SEQ ID NO: 3266327 - RNA, 17 nt, Vaccinia virus
gauaccguuacauuuga

SEQ ID NO: 3266328 - RNA, 19 nt, Vaccinia virus
aucacucucauaauguaaa

SEQ ID NO: 3266329 - RNA, 12 nt, Vaccinia virus
auaaaauagaca

SEQ ID NO: 3266330 - RNA, 20 nt, Vaccinia virus
uuagaauauccagugcauuu

SEQ ID NO: 3266331 - RNA, 17 nt, Vaccinia virus
aauguaaucauauaaau

SEQ ID NO: 3266332 - RNA, 17 nt, Vaccinia virus
auauacguguacuguau

SEQ ID NO: 3266333 - RNA, 13 nt, Vaccinia virus
uagauaauucuaa

SEQ ID NO: 3266334 - RNA, 18 nt, Vaccinia virus
caugacaaaauuaaaaaa

SEQ ID NO: 3266335 - RNA, 23 nt, Vaccinia virus
ugauauugugaaugguaaagaau

SEQ ID NO: 3266336 - RNA, 20 nt, Vaccinia virus
agaacagaauaaacaaaaua

SEQ ID NO: 3266337 - RNA, 16 nt, Vaccinia virus
uauagauccuccagua

SEQ ID NO: 3266338 - RNA, 10 nt, Vaccinia virus
acaaugaacu

SEQ ID NO: 3266339 - RNA, 16 nt, Vaccinia virus
uugaaauuauauucuu

SEQ ID NO: 3266340 - RNA, 19 nt, Vaccinia virus
acgauaaaagaugcauaua

SEQ ID NO: 3266341 - RNA, 18 nt, Vaccinia virus
guagcauuuucuuaacaa

SEQ ID NO: 3266342 - RNA, 14 nt, Vaccinia virus
cgucucaaucuuua

SEQ ID NO: 3266343 - RNA, 21 nt, Vaccinia virus
aaaacauuauucuauuucgaa

SEQ ID NO: 3266344 - RNA, 19 nt, Vaccinia virus
aaauauaaaaccaacuaau

SEQ ID NO: 3266345 - RNA, 15 nt, Vaccinia virus
uuagaugaauuauua

SEQ ID NO: 3266346 - RNA, 16 nt, Vaccinia virus
aacuucuagucuagaa

SEQ ID NO: 3266347 - RNA, 22 nt, Vaccinia virus
uuaagagauuuagaaaacauua

SEQ ID NO: 3266348 - RNA, 13 nt, Vaccinia virus
aaaaguuaaaacu

SEQ ID NO: 3266349 - RNA, 13 nt, Vaccinia virus
auggaguauauau

SEQ ID NO: 3266350 - RNA, 16 nt, Vaccinia virus
ccacguuuaaacauuc

SEQ ID NO: 3266351 - RNA, 19 nt, Vaccinia virus
aaaauuguugaucauauag

SEQ ID NO: 3266352 - RNA, 19 nt, Vaccinia virus
agagauuuaacuguucauc

SEQ ID NO: 3266353 - RNA, 13 nt, Vaccinia virus
uaacaauauggaa

SEQ ID NO: 3266354 - RNA, 19 nt, Vaccinia virus
cauuuucucuuucucucuu

SEQ ID NO: 3266355 - RNA, 15 nt, Vaccinia virus
uauauccaauaaagc

SEQ ID NO: 3266356 - RNA, 19 nt, Vaccinia virus
ucgcauuaauacuguuuuc

SEQ ID NO: 3266357 - RNA, 20 nt, Vaccinia virus
cuaaugccuuaggauaugua

SEQ ID NO: 3266358 - RNA, 16 nt, Vaccinia virus
ugauuccaaaauugaa

SEQ ID NO: 3266359 - RNA, 15 nt, Vaccinia virus
agaggcaaaagaugu

SEQ ID NO: 3266360 - RNA, 16 nt, Vaccinia virus
agcuauuuaaaugggu

SEQ ID NO: 3266361 - RNA, 20 nt, Vaccinia virus
auuaguaaggcuuuagaaac

SEQ ID NO: 3266362 - RNA, 14 nt, Vaccinia virus
uggaugaggaauga

SEQ ID NO: 3266363 - RNA, 14 nt, Vaccinia virus
aauugauucuuauu

SEQ ID NO: 3266364 - RNA, 22 nt, Vaccinia virus
auaguuuucucuauucugaaau

SEQ ID NO: 3266365 - RNA, 18 nt, Vaccinia virus
aaacgcucuacgaauauc

SEQ ID NO: 3266366 - RNA, 21 nt, Vaccinia virus
agcuccuacaggaauaucuuu

SEQ ID NO: 3266367 - RNA, 22 nt, Vaccinia virus
ccaugucugaaacgagacgcua

SEQ ID NO: 3266368 - RNA, 21 nt, Vaccinia virus
aacacccauuuauuguacaaa

SEQ ID NO: 3266369 - RNA, 15 nt, Vaccinia virus
ucagaacugaugcaa

SEQ ID NO: 3266370 - RNA, 17 nt, Vaccinia virus
uggaauauaucuauaau

SEQ ID NO: 3266371 - RNA, 17 nt, Vaccinia virus
ugucggcgacaugauua

SEQ ID NO: 3266372 - RNA, 22 nt, Vaccinia virus
cgucucugacgguaccauaaac

SEQ ID NO: 3266373 - RNA, 23 nt, Vaccinia virus
aagcacucguuauuaauacaagu

SEQ ID NO: 3266374 - RNA, 12 nt, Vaccinia virus
aaauauaaugau

SEQ ID NO: 3266375 - RNA, 17 nt, Vaccinia virus
uuuacugucuaccuaaa

SEQ ID NO: 3266376 - RNA, 12 nt, Vaccinia virus
acugagaaguua

SEQ ID NO: 3266377 - RNA, 16 nt, Vaccinia virus
cuuuuuaggaauguau

SEQ ID NO: 3266378 - RNA, 19 nt, Vaccinia virus
aucgaugaauaauacauuu

SEQ ID NO: 3266379 - RNA, 21 nt, Vaccinia virus
aucaauucuggauuaucccuc

SEQ ID NO: 3266380 - RNA, 14 nt, Vaccinia virus
gaaagaauaagaac

SEQ ID NO: 3266381 - RNA, 20 nt, Vaccinia virus
gucuaguaaguagaaauuau

SEQ ID NO: 3266382 - RNA, 23 nt, Vaccinia virus
augcaucuuaacacucucugcca

SEQ ID NO: 3266383 - RNA, 13 nt, Vaccinia virus
aucaugaaauaua

SEQ ID NO: 3266384 - RNA, 13 nt, Vaccinia virus
gagaguagauauc

SEQ ID NO: 3266385 - RNA, 20 nt, Vaccinia virus
aacgaccaucuuugaaaauu

SEQ ID NO: 3266386 - RNA, 21 nt, Vaccinia virus
auggauaauccgucuauuuua

SEQ ID NO: 3266387 - RNA, 16 nt, Vaccinia virus
agauguaaguaugaug

SEQ ID NO: 3266388 - RNA, 17 nt, Vaccinia virus
agacuuucgucaauuug

SEQ ID NO: 3266389 - RNA, 18 nt, Vaccinia virus
ucuguccaauuaaaugua

SEQ ID NO: 3266390 - RNA, 14 nt, Vaccinia virus
auacagucuuaaau

SEQ ID NO: 3266391 - RNA, 15 nt, Vaccinia virus
auagaugaagaucag

SEQ ID NO: 3266392 - RNA, 14 nt, Vaccinia virus
ucccaauaugugua

SEQ ID NO: 3266393 - RNA, 13 nt, Vaccinia virus
guccucaugauua

SEQ ID NO: 3266394 - RNA, 22 nt, Vaccinia virus
ucugagaaaaugucucucauaa

SEQ ID NO: 3266395 - RNA, 13 nt, Vaccinia virus
gacgguaucaugc

SEQ ID NO: 3266396 - RNA, 17 nt, Vaccinia virus
aauauuucgaugauaua

SEQ ID NO: 3266397 - RNA, 17 nt, Vaccinia virus
uuuaaaguaaacuucgu

SEQ ID NO: 3266398 - RNA, 17 nt, Vaccinia virus
agaauuuuuuaaaaagu

SEQ ID NO: 3266399 - RNA, 22 nt, Vaccinia virus
auugguaaauuccauagaauau

SEQ ID NO: 3266400 - RNA, 12 nt, Vaccinia virus
uucuacaucuuc

SEQ ID NO: 3266401 - RNA, 21 nt, Vaccinia virus
uugaucauauaguuauguaua

SEQ ID NO: 3266402 - RNA, 18 nt, Vaccinia virus
aauccaguaauaucaugu

SEQ ID NO: 3266403 - RNA, 13 nt, Vaccinia virus
aaauaauccugaa

SEQ ID NO: 3266404 - RNA, 15 nt, Vaccinia virus
uguagauaugugaua

SEQ ID NO: 3266405 - RNA, 16 nt, Vaccinia virus
acaauaguuagauaca

SEQ ID NO: 3266406 - RNA, 15 nt, Vaccinia virus
aacaggucauauucu

SEQ ID NO: 3266407 - RNA, 22 nt, Vaccinia virus
ugaauagcaaaaucuuuacuau

SEQ ID NO: 3266408 - RNA, 16 nt, Vaccinia virus
uuaauacuacauauuu

SEQ ID NO: 3266409 - RNA, 16 nt, Vaccinia virus
acaauguccaaaucua

SEQ ID NO: 3266410 - RNA, 17 nt, Vaccinia virus
gaaaacugguuaaaaca

SEQ ID NO: 3266411 - RNA, 12 nt, Vaccinia virus
ugaaaauacuuu

SEQ ID NO: 3266412 - RNA, 18 nt, Vaccinia virus
gaguuccauuacaaauau

SEQ ID NO: 3266413 - RNA, 18 nt, Vaccinia virus
ugucucagaaucaaauau

SEQ ID NO: 3266414 - RNA, 15 nt, Vaccinia virus
auccuagaugaugau

SEQ ID NO: 3266415 - RNA, 15 nt, Vaccinia virus
agucaaacauucaac

SEQ ID NO: 3266416 - RNA, 19 nt, Vaccinia virus
aauacauaauuuuguaaaa

SEQ ID NO: 3266417 - RNA, 12 nt, Vaccinia virus
aaaaaauauauu

SEQ ID NO: 3266418 - RNA, 11 nt, Vaccinia virus
aauaaauggau

SEQ ID NO: 3266419 - RNA, 14 nt, Vaccinia virus
gaaguaaugaagaa

SEQ ID NO: 3266420 - RNA, 23 nt, Vaccinia virus
uuucugaugaaacauuuaaugau

SEQ ID NO: 3266421 - RNA, 22 nt, Vaccinia virus
acaacgucaucgcuucaucuau

SEQ ID NO: 3266422 - RNA, 13 nt, Vaccinia virus
auaucaugaugau

SEQ ID NO: 3266423 - RNA, 18 nt, Vaccinia virus
cagauagauaaagucuug

SEQ ID NO: 3266424 - RNA, 16 nt, Vaccinia virus
aagauacaacaaauua

SEQ ID NO: 3266425 - RNA, 13 nt, Vaccinia virus
gagaauaauagau

SEQ ID NO: 3266426 - RNA, 16 nt, Vaccinia virus
agugucuauaaaugua

SEQ ID NO: 3266427 - RNA, 13 nt, Vaccinia virus
ugaucggaucuaa

SEQ ID NO: 3266428 - RNA, 18 nt, Vaccinia virus
cagauguaaauauauuua

SEQ ID NO: 3266429 - RNA, 15 nt, Vaccinia virus
accggucauauuaau

SEQ ID NO: 3266430 - RNA, 16 nt, Vaccinia virus
uagaaaauucuaaggu

SEQ ID NO: 3266431 - RNA, 23 nt, Vaccinia virus
uuauuccaaucauugauaucuuu

SEQ ID NO: 3266432 - RNA, 16 nt, Vaccinia virus
aauacgaauuaugcaa

SEQ ID NO: 3266433 - RNA, 20 nt, Vaccinia virus
agaguauccacuaaacuauu

SEQ ID NO: 3266434 - RNA, 17 nt, Vaccinia virus
uauuccuaguuuggauu

SEQ ID NO: 3266435 - RNA, 23 nt, Vaccinia virus
uaaacgccuuuagaaaaacuuua

SEQ ID NO: 3266436 - RNA, 23 nt, Vaccinia virus
guccggagaucuaaagauaaucu

SEQ ID NO: 3266437 - RNA, 17 nt, Vaccinia virus
uuaaucguacucauuau

SEQ ID NO: 3266438 - RNA, 14 nt, Vaccinia virus
uuaacuuacuuauu

SEQ ID NO: 3266439 - RNA, 17 nt, Vaccinia virus
auauucuguaguuguau

SEQ ID NO: 3266440 - RNA, 21 nt, Vaccinia virus
auugcguuuagcaucugauuu

SEQ ID NO: 3266441 - RNA, 14 nt, Vaccinia virus
uauuaaaucaugaa

SEQ ID NO: 3266442 - RNA, 19 nt, Vaccinia virus
auacauuaaguaaaguaaa

SEQ ID NO: 3266443 - RNA, 15 nt, Vaccinia virus
uguucuaucaacgau

SEQ ID NO: 3266444 - RNA, 17 nt, Vaccinia virus
uaaagacaacgaauaca

SEQ ID NO: 3266445 - RNA, 16 nt, Vaccinia virus
aucagcugaaaaacua

SEQ ID NO: 3266446 - RNA, 19 nt, Vaccinia virus
uggagaaucgucuaucuuu

SEQ ID NO: 3266447 - RNA, 16 nt, Vaccinia virus
agucauaucuagaaug

SEQ ID NO: 3266448 - RNA, 13 nt, Vaccinia virus
acaaauguagaag

SEQ ID NO: 3266449 - RNA, 18 nt, Vaccinia virus
acuucacucuauuaaaaa

SEQ ID NO: 3266450 - RNA, 20 nt, Vaccinia virus
guacuauuuuuuacauuacu

SEQ ID NO: 3266451 - RNA, 13 nt, Vaccinia virus
auuagauaaaguu

SEQ ID NO: 3266452 - RNA, 19 nt, Vaccinia virus
uguuauucuguucuauuca

SEQ ID NO: 3266453 - RNA, 14 nt, Vaccinia virus
aucguccauagcaa

SEQ ID NO: 3266454 - RNA, 21 nt, Vaccinia virus
uacaacuguuguaaauuauuu

SEQ ID NO: 3266455 - RNA, 23 nt, Vaccinia virus
gaagaacguguauuaaauagaau

SEQ ID NO: 3266456 - RNA, 22 nt, Vaccinia virus
aacuucuagucuagaaauaaua

SEQ ID NO: 3266457 - RNA, 21 nt, Vaccinia virus
auuugcaccacuuucuaucaa

SEQ ID NO: 3266458 - RNA, 11 nt, Vaccinia virus
ggaauauacaa

SEQ ID NO: 3266459 - RNA, 17 nt, Vaccinia virus
ugauauccgcuauuaca

SEQ ID NO: 3266460 - RNA, 10 nt, Vaccinia virus
ucucuauaga

SEQ ID NO: 3266461 - RNA, 14 nt, Vaccinia virus
agaugguaaacucu

SEQ ID NO: 3266462 - RNA, 17 nt, Vaccinia virus
uguuacaaauguagaag

SEQ ID NO: 3266463 - RNA, 16 nt, Vaccinia virus
gaaagagauaauagaa

SEQ ID NO: 3266464 - RNA, 21 nt, Vaccinia virus
augaacgcgauguuucuguaa

SEQ ID NO: 3266465 - RNA, 22 nt, Vaccinia virus
auuucuaucccgaaagaacuga

SEQ ID NO: 3266466 - RNA, 21 nt, Vaccinia virus
uuaagccauaacauaauuuuc

SEQ ID NO: 3266467 - RNA, 23 nt, Vaccinia virus
aacuacuccauuuuauuguggaa

SEQ ID NO: 3266468 - RNA, 22 nt, Vaccinia virus
cacuuagaacagauuuaacaau

SEQ ID NO: 3266469 - RNA, 18 nt, Vaccinia virus
acaauaggaaaucuaucu

SEQ ID NO: 3266470 - RNA, 15 nt, Vaccinia virus
gucugucucagaauc

SEQ ID NO: 3266471 - RNA, 13 nt, Vaccinia virus
aguaucaaacucu

SEQ ID NO: 3266472 - RNA, 15 nt, Vaccinia virus
aaucucuuaucaugu

SEQ ID NO: 3266473 - RNA, 17 nt, Vaccinia virus
aguuuuccguuagaaaa

SEQ ID NO: 3266474 - RNA, 19 nt, Vaccinia virus
aucaaccaccgaugaugcg

SEQ ID NO: 3266475 - RNA, 19 nt, Vaccinia virus
auuauccaugauagaaaga

SEQ ID NO: 3266476 - RNA, 16 nt, Vaccinia virus
aacauaaauaauucua

SEQ ID NO: 3266477 - RNA, 22 nt, Vaccinia virus
gauuaucguuuucaucuuuuau

SEQ ID NO: 3266478 - RNA, 11 nt, Vaccinia virus
cuuuuuaggaa

SEQ ID NO: 3266479 - RNA, 14 nt, Vaccinia virus
acaaaauacauaau

SEQ ID NO: 3266480 - RNA, 16 nt, Vaccinia virus
uaaagaaaagauaucc

SEQ ID NO: 3266481 - RNA, 22 nt, Vaccinia virus
augacacuaguuaagaacaugu

SEQ ID NO: 3266482 - RNA, 16 nt, Vaccinia virus
acaggauuauaaucuc

SEQ ID NO: 3266483 - RNA, 22 nt, Vaccinia virus
aucugugauuucguuagucaua

SEQ ID NO: 3266484 - RNA, 21 nt, Vaccinia virus
uacaaaaauauuuuuauucuc

SEQ ID NO: 3266485 - RNA, 16 nt, Vaccinia virus
acuacugaagaacuac

SEQ ID NO: 3266486 - RNA, 14 nt, Vaccinia virus
gauacgaugaugau

SEQ ID NO: 3266487 - RNA, 23 nt, Vaccinia virus
ucauaaguggacauauagaugca

SEQ ID NO: 3266488 - RNA, 16 nt, Vaccinia virus
ucacugcgauuguauu

SEQ ID NO: 3266489 - RNA, 20 nt, Vaccinia virus
ugacuaucuuuugaaaauau

SEQ ID NO: 3266490 - RNA, 13 nt, Vaccinia virus
cauuaacuuuaau

SEQ ID NO: 3266491 - RNA, 19 nt, Vaccinia virus
uugaauaggaguuugaaua

SEQ ID NO: 3266492 - RNA, 13 nt, Vaccinia virus
augucacuauuaa

SEQ ID NO: 3266493 - RNA, 15 nt, Vaccinia virus
uauaaccuuaucauu

SEQ ID NO: 3266494 - RNA, 19 nt, Vaccinia virus
uuuuagguacucaucuacu

SEQ ID NO: 3266495 - RNA, 22 nt, Vaccinia virus
uaucaauaagaaaguuaagaau

SEQ ID NO: 3266496 - RNA, 14 nt, Vaccinia virus
guaaauaauaauau

SEQ ID NO: 3266497 - RNA, 21 nt, Vaccinia virus
auaaacucacauuucaaauau

SEQ ID NO: 3266498 - RNA, 23 nt, Vaccinia virus
gucucauaccggacgacauauua

SEQ ID NO: 3266499 - RNA, 20 nt, Vaccinia virus
aaauauuucauuagauguua

SEQ ID NO: 3266500 - RNA, 18 nt, Vaccinia virus
gucaaugauaugauuuuu

SEQ ID NO: 3266501 - RNA, 13 nt, Vaccinia virus
auaaacuguaaau

SEQ ID NO: 3266502 - RNA, 20 nt, Vaccinia virus
ccguuuuaucgguuaccaua

SEQ ID NO: 3266503 - RNA, 21 nt, Vaccinia virus
augucgagaaacagaacuauu

SEQ ID NO: 3266504 - RNA, 21 nt, Vaccinia virus
uaaaaucagcagacuuuugaa

SEQ ID NO: 3266505 - RNA, 19 nt, Vaccinia virus
ccauagcuaucaagucuuu

SEQ ID NO: 3266506 - RNA, 17 nt, Vaccinia virus
uacaguaaaaauaacua

SEQ ID NO: 3266507 - RNA, 20 nt, Vaccinia virus
gcuaguuaauaguaaaugaa

SEQ ID NO: 3266508 - RNA, 18 nt, Vaccinia virus
acgccguaauaauuuccu

SEQ ID NO: 3266509 - RNA, 21 nt, Vaccinia virus
uauuguuuaauauauuauaua

SEQ ID NO: 3266510 - RNA, 23 nt, Vaccinia virus
uauuauuaaacguaguuaugaua

SEQ ID NO: 3266511 - RNA, 22 nt, Vaccinia virus
gcauccaaugaguaaaaucaaa

SEQ ID NO: 3266512 - RNA, 19 nt, Vaccinia virus
uagucgguuaauguuguau

SEQ ID NO: 3266513 - RNA, 14 nt, Vaccinia virus
caaacuuuacucuu

SEQ ID NO: 3266514 - RNA, 16 nt, Vaccinia virus
uuacauaauauauaca

SEQ ID NO: 3266515 - RNA, 19 nt, Vaccinia virus
accacgaaacaauauauau

SEQ ID NO: 3266516 - RNA, 14 nt, Vaccinia virus
uauggagcaaacau

SEQ ID NO: 3266517 - RNA, 15 nt, Vaccinia virus
uaaucguuauuauca

SEQ ID NO: 3266518 - RNA, 18 nt, Vaccinia virus
aaugcauuuuauaccgaa

SEQ ID NO: 3266519 - RNA, 17 nt, Vaccinia virus
gaauuaauuaauguuuu

SEQ ID NO: 3266520 - RNA, 16 nt, Vaccinia virus
guaucaugaacucuaa

SEQ ID NO: 3266521 - RNA, 14 nt, Vaccinia virus
auggucuauacaau

SEQ ID NO: 3266522 - RNA, 19 nt, Vaccinia virus
ucuuuuucuacgucaaaau

SEQ ID NO: 3266523 - RNA, 15 nt, Vaccinia virus
gcguuaauaaaaaca

SEQ ID NO: 3266524 - RNA, 17 nt, Vaccinia virus
uagauauuaguaaauua

SEQ ID NO: 3266525 - RNA, 14 nt, Vaccinia virus
aaguaaauacugaa

SEQ ID NO: 3266526 - RNA, 23 nt, Vaccinia virus
aauauaucuauaauuugauccau

SEQ ID NO: 3266527 - RNA, 12 nt, Vaccinia virus
guuuccauccau

SEQ ID NO: 3266528 - RNA, 16 nt, Vaccinia virus
auaaaucaaaauaugg

SEQ ID NO: 3266529 - RNA, 15 nt, Vaccinia virus
ugauuucuugaacau

SEQ ID NO: 3266530 - RNA, 19 nt, Vaccinia virus
guauaaauuuuagaaauaa

SEQ ID NO: 3266531 - RNA, 19 nt, Vaccinia virus
auaguuaccgcaaagaaac

SEQ ID NO: 3266532 - RNA, 10 nt, Vaccinia virus
ugguaaaaug

SEQ ID NO: 3266533 - RNA, 22 nt, Vaccinia virus
agaauuuuuucguguuccaaac

SEQ ID NO: 3266534 - RNA, 15 nt, Vaccinia virus
cguaucauuaaacau

SEQ ID NO: 3266535 - RNA, 14 nt, Vaccinia virus
agaauaauaugacu

SEQ ID NO: 3266536 - RNA, 15 nt, Vaccinia virus
aacgaauaaacaauu

SEQ ID NO: 3266537 - RNA, 16 nt, Vaccinia virus
aggaugacucucaaau

SEQ ID NO: 3266538 - RNA, 20 nt, Vaccinia virus
auuaguaggaaauuucuuga

SEQ ID NO: 3266539 - RNA, 16 nt, Vaccinia virus
uaauuguaacauccuu

SEQ ID NO: 3266540 - RNA, 12 nt, Vaccinia virus
auuaaacuaauu

SEQ ID NO: 3266541 - RNA, 22 nt, Vaccinia virus
uaaaauuaucuacacaaauaga

SEQ ID NO: 3266542 - RNA, 11 nt, Vaccinia virus
ucgaauacagu

SEQ ID NO: 3266543 - RNA, 22 nt, Vaccinia virus
aguauaccaugaccuucuucau

SEQ ID NO: 3266544 - RNA, 14 nt, Vaccinia virus
augaaaaaacauua

SEQ ID NO: 3266545 - RNA, 17 nt, Vaccinia virus
aauauaucccuuaaaaa

SEQ ID NO: 3266546 - RNA, 17 nt, Vaccinia virus
ucguuccgccaaauuuu

SEQ ID NO: 3266547 - RNA, 15 nt, Vaccinia virus
ucuauaucuucuuuu

SEQ ID NO: 3266548 - RNA, 20 nt, Vaccinia virus
aauucuacaacauuauuaua

SEQ ID NO: 3266549 - RNA, 20 nt, Vaccinia virus
uagagcccacguuuaaacau

SEQ ID NO: 3266550 - RNA, 20 nt, Vaccinia virus
gagcuaucuagacuacgaua

SEQ ID NO: 3266551 - RNA, 20 nt, Vaccinia virus
uuuuagccagagauaucaua

SEQ ID NO: 3266552 - RNA, 14 nt, Vaccinia virus
ccuagagaauuaau

SEQ ID NO: 3266553 - RNA, 23 nt, Vaccinia virus
gaaagcugggggauguucugguu

SEQ ID NO: 3266554 - RNA, 19 nt, Vaccinia virus
uauuacaaaauauuuugag

SEQ ID NO: 3266555 - RNA, 13 nt, Vaccinia virus
uaucaaaagacuu

SEQ ID NO: 3266556 - RNA, 22 nt, Vaccinia virus
aaaucuaucuuauauacacaua

SEQ ID NO: 3266557 - RNA, 12 nt, Vaccinia virus
aauuuuuagagg

SEQ ID NO: 3266558 - RNA, 21 nt, Vaccinia virus
uggauaacgguacucuagaau

SEQ ID NO: 3266559 - RNA, 16 nt, Vaccinia virus
gaaaagauauccagag

SEQ ID NO: 3266560 - RNA, 15 nt, Vaccinia virus
ugauauaaaacuauc

SEQ ID NO: 3266561 - RNA, 17 nt, Vaccinia virus
ugauauccgcgaacgau

SEQ ID NO: 3266562 - RNA, 15 nt, Vaccinia virus
aaguuucuauuucuu

SEQ ID NO: 3266563 - RNA, 13 nt, Vaccinia virus
gaauaucauugcu

SEQ ID NO: 3266564 - RNA, 21 nt, Vaccinia virus
accaugaaauugagaagauca

SEQ ID NO: 3266565 - RNA, 16 nt, Vaccinia virus
cuaggugcuauggaug

SEQ ID NO: 3266566 - RNA, 14 nt, Vaccinia virus
uaaaaguuaaugag

SEQ ID NO: 3266567 - RNA, 17 nt, Vaccinia virus
gauauaaaauagaaaau

SEQ ID NO: 3266568 - RNA, 21 nt, Vaccinia virus
aaucuaguaaaucaacugaua

SEQ ID NO: 3266569 - RNA, 16 nt, Vaccinia virus
aaucagaaucuaauga

SEQ ID NO: 3266570 - RNA, 22 nt, Vaccinia virus
auaguuguuguccguuaucuaa

SEQ ID NO: 3266571 - RNA, 23 nt, Vaccinia virus
auaguuaucuaucuuaaaaacua

SEQ ID NO: 3266572 - RNA, 21 nt, Vaccinia virus
ucauuuucggguuuaaauucu

SEQ ID NO: 3266573 - RNA, 17 nt, Vaccinia virus
uaaagccgguguaacau

SEQ ID NO: 3266574 - RNA, 12 nt, Vaccinia virus
aagguucuuaua

SEQ ID NO: 3266575 - RNA, 16 nt, Vaccinia virus
auccuuuguaaagaaa

SEQ ID NO: 3266576 - RNA, 23 nt, Vaccinia virus
ucauuuuccagaugauauguaug

SEQ ID NO: 3266577 - RNA, 15 nt, Vaccinia virus
cuucgauaaaaugac

SEQ ID NO: 3266578 - RNA, 19 nt, Vaccinia virus
ugcaucgugcuuuaacauc

SEQ ID NO: 3266579 - RNA, 14 nt, Vaccinia virus
augaguuaauguau

SEQ ID NO: 3266580 - RNA, 13 nt, Vaccinia virus
aaauaaaaugagu

SEQ ID NO: 3266581 - RNA, 15 nt, Vaccinia virus
ucacaugauguagug

SEQ ID NO: 3266582 - RNA, 16 nt, Vaccinia virus
aacacgauaggucaga

SEQ ID NO: 3266583 - RNA, 20 nt, Vaccinia virus
gagaucauuaaauguuucau

SEQ ID NO: 3266584 - RNA, 16 nt, Vaccinia virus
aaaucaguaacuaugu

SEQ ID NO: 3266585 - RNA, 16 nt, Vaccinia virus
acacaaggcauuguuu

SEQ ID NO: 3266586 - RNA, 19 nt, Vaccinia virus
auauaauccgcauauucca

SEQ ID NO: 3266587 - RNA, 12 nt, Vaccinia virus
agaggagaagua

SEQ ID NO: 3266588 - RNA, 20 nt, Vaccinia virus
uucuuaacuuacaaaaugua

SEQ ID NO: 3266589 - RNA, 14 nt, Vaccinia virus
caucuugacauuuu

SEQ ID NO: 3266590 - RNA, 20 nt, Vaccinia virus
uaggucuuguguuagaugau

SEQ ID NO: 3266591 - RNA, 13 nt, Vaccinia virus
uagaaaaaugcua

SEQ ID NO: 3266592 - RNA, 17 nt, Vaccinia virus
aaauauguuauguuuau

SEQ ID NO: 3266593 - RNA, 16 nt, Vaccinia virus
uuuuagaaauauacag

SEQ ID NO: 3266594 - RNA, 21 nt, Vaccinia virus
aucuauaauuugugaguuuuc

SEQ ID NO: 3266595 - RNA, 16 nt, Vaccinia virus
aaauauuuaacucaug

SEQ ID NO: 3266596 - RNA, 15 nt, Vaccinia virus
auuuuaagaaauggu

SEQ ID NO: 3266597 - RNA, 15 nt, Vaccinia virus
gaauauaaaccauau

SEQ ID NO: 3266598 - RNA, 15 nt, Vaccinia virus
aauaguguuagauaa

SEQ ID NO: 3266599 - RNA, 23 nt, Vaccinia virus
gcugaucuucaucuauaaaucaa

SEQ ID NO: 3266600 - RNA, 19 nt, Vaccinia virus
guauauucuagguacuuau

SEQ ID NO: 3266601 - RNA, 20 nt, Vaccinia virus
aaccucacuguuaaaaauau

SEQ ID NO: 3266602 - RNA, 22 nt, Vaccinia virus
uugauaggaucuauaauguagu

SEQ ID NO: 3266603 - RNA, 23 nt, Vaccinia virus
uagugccaucagaauaggaugaa

SEQ ID NO: 3266604 - RNA, 19 nt, Vaccinia virus
caaauuaagcauuuuggaa

SEQ ID NO: 3266605 - RNA, 22 nt, Vaccinia virus
aucuuggcuccauacuguacca

SEQ ID NO: 3266606 - RNA, 20 nt, Vaccinia virus
auacgcaucucuaacuacua

SEQ ID NO: 3266607 - RNA, 14 nt, Vaccinia virus
ugacuauugagacg

SEQ ID NO: 3266608 - RNA, 14 nt, Vaccinia virus
aaacauaaaaaaca

SEQ ID NO: 3266609 - RNA, 16 nt, Vaccinia virus
cauauucuaugaauuu

SEQ ID NO: 3266610 - RNA, 17 nt, Vaccinia virus
acuugcgggguuaauuu

SEQ ID NO: 3266611 - RNA, 18 nt, Vaccinia virus
aguaaaaucuaucauauu

SEQ ID NO: 3266612 - RNA, 22 nt, Vaccinia virus
caguaguugcgggaacaauauu

SEQ ID NO: 3266613 - RNA, 18 nt, Vaccinia virus
aagagacuacaauauauu

SEQ ID NO: 3266614 - RNA, 14 nt, Vaccinia virus
guuucuuacauauu

SEQ ID NO: 3266615 - RNA, 19 nt, Vaccinia virus
agaguaugacgucucucaa

SEQ ID NO: 3266616 - RNA, 18 nt, Vaccinia virus
uaauaucccacauuauca

SEQ ID NO: 3266617 - RNA, 13 nt, Vaccinia virus
agucaaaaagaua

SEQ ID NO: 3266618 - RNA, 19 nt, Vaccinia virus
aaauagcggacagcuauau

SEQ ID NO: 3266619 - RNA, 19 nt, Vaccinia virus
gcuauugaaacugacggau

SEQ ID NO: 3266620 - RNA, 19 nt, Vaccinia virus
ucucucaaucacuacaucu

SEQ ID NO: 3266621 - RNA, 19 nt, Vaccinia virus
cauuuacuuuuucauaauu

SEQ ID NO: 3266622 - RNA, 17 nt, Vaccinia virus
ugaaauaauuagaacua

SEQ ID NO: 3266623 - RNA, 22 nt, Vaccinia virus
uggcucuugaaaccaagguuuu

SEQ ID NO: 3266624 - RNA, 17 nt, Vaccinia virus
cuuucuagaacauacug

SEQ ID NO: 3266625 - RNA, 14 nt, Vaccinia virus
aaguauuuauaaaa

SEQ ID NO: 3266626 - RNA, 16 nt, Vaccinia virus
cuggaggagauggauu

SEQ ID NO: 3266627 - RNA, 15 nt, Vaccinia virus
caaaggaugaaagaa

SEQ ID NO: 3266628 - RNA, 14 nt, Vaccinia virus
aauugucuaucugu

SEQ ID NO: 3266629 - RNA, 16 nt, Vaccinia virus
gaauagugguauauaa

SEQ ID NO: 3266630 - RNA, 22 nt, Vaccinia virus
uauugaaugacguuuucucaua

SEQ ID NO: 3266631 - RNA, 19 nt, Vaccinia virus
gcauugauaaugucuauau

SEQ ID NO: 3266632 - RNA, 23 nt, Vaccinia virus
caaaucucugauccguauccaug

SEQ ID NO: 3266633 - RNA, 22 nt, Vaccinia virus
aacaauaguuuguacugcaaaa

SEQ ID NO: 3266634 - RNA, 12 nt, Vaccinia virus
ucagaucaaagu

SEQ ID NO: 3266635 - RNA, 20 nt, Vaccinia virus
auuaucgaguuuaaaucauu

SEQ ID NO: 3266636 - RNA, 20 nt, Vaccinia virus
acaauaauucagauaaugua

SEQ ID NO: 3266637 - RNA, 17 nt, Vaccinia virus
ucaaucacuacaucuuu

SEQ ID NO: 3266638 - RNA, 14 nt, Vaccinia virus
uagagguagcaaaa

SEQ ID NO: 3266639 - RNA, 14 nt, Vaccinia virus
ugauuauauagaua

SEQ ID NO: 3266640 - RNA, 19 nt, Vaccinia virus
uagauguaaguaugauguc

SEQ ID NO: 3266641 - RNA, 14 nt, Vaccinia virus
acguucauuaaaaa

SEQ ID NO: 3266642 - RNA, 18 nt, Vaccinia virus
auuugagagaucauuucu

SEQ ID NO: 3266643 - RNA, 19 nt, Vaccinia virus
gacgcauuuaauagagaua

SEQ ID NO: 3266644 - RNA, 16 nt, Vaccinia virus
aacacuauuaaaauau

SEQ ID NO: 3266645 - RNA, 17 nt, Vaccinia virus
ucuaauuaguuuuucuu

SEQ ID NO: 3266646 - RNA, 14 nt, Vaccinia virus
auccccuuucaaua

SEQ ID NO: 3266647 - RNA, 17 nt, Vaccinia virus
auuaaugcuacagauau

SEQ ID NO: 3266648 - RNA, 16 nt, Vaccinia virus
aucuaguuagcaauuu

SEQ ID NO: 3266649 - RNA, 17 nt, Vaccinia virus
augugauucucugaaaa

SEQ ID NO: 3266650 - RNA, 17 nt, Vaccinia virus
auuuacaccaaaaacuc

SEQ ID NO: 3266651 - RNA, 15 nt, Vaccinia virus
uacacauaauuauuc

SEQ ID NO: 3266652 - RNA, 19 nt, Vaccinia virus
gaaaugacuccaugaaaac

SEQ ID NO: 3266653 - RNA, 17 nt, Vaccinia virus
uaucuaugcuuacugua

SEQ ID NO: 3266654 - RNA, 13 nt, Vaccinia virus
uaccaaauauuag

SEQ ID NO: 3266655 - RNA, 13 nt, Vaccinia virus
gacguuaguucuu

SEQ ID NO: 3266656 - RNA, 18 nt, Vaccinia virus
auauuacuaauugauaga

SEQ ID NO: 3266657 - RNA, 17 nt, Vaccinia virus
aauaucuuuacgaauua

SEQ ID NO: 3266658 - RNA, 18 nt, Vaccinia virus
uaaaauaguucuguaaua

SEQ ID NO: 3266659 - RNA, 20 nt, Vaccinia virus
agagaagcacucguuauuaa

SEQ ID NO: 3266660 - RNA, 13 nt, Vaccinia virus
acauauaaauguc

SEQ ID NO: 3266661 - RNA, 18 nt, Vaccinia virus
acacccucagcuauaucu

SEQ ID NO: 3266662 - RNA, 24 nt, Vaccinia virus
uacauaaacauguccaauacguua

SEQ ID NO: 3266663 - RNA, 12 nt, Vaccinia virus
auuuauaaacau

SEQ ID NO: 3266664 - RNA, 19 nt, Vaccinia virus
uuuuugcaggaaguauauc

SEQ ID NO: 3266665 - RNA, 15 nt, Vaccinia virus
uaccucucuuaaaau

SEQ ID NO: 3266666 - RNA, 21 nt, Vaccinia virus
uuuguccauuauuucuauauu

SEQ ID NO: 3266667 - RNA, 16 nt, Vaccinia virus
uauaaaacuugucugu

SEQ ID NO: 3266668 - RNA, 15 nt, Vaccinia virus
uguaccuuauacguu

SEQ ID NO: 3266669 - RNA, 17 nt, Vaccinia virus
uuaaauccuuguuugau

SEQ ID NO: 3266670 - RNA, 15 nt, Vaccinia virus
uaauacuuaauucuu

SEQ ID NO: 3266671 - RNA, 16 nt, Vaccinia virus
uuagauaauuguggua

SEQ ID NO: 3266672 - RNA, 23 nt, Vaccinia virus
cuaguuuuauacacaucucuuca

SEQ ID NO: 3266673 - RNA, 14 nt, Vaccinia virus
ugucuaguuucgua

SEQ ID NO: 3266674 - RNA, 14 nt, Vaccinia virus
uauccaauguauuu

SEQ ID NO: 3266675 - RNA, 21 nt, Vaccinia virus
gauauucgaucccgauauccu

SEQ ID NO: 3266676 - RNA, 22 nt, Vaccinia virus
uauagauagcuuuagcuaauau

SEQ ID NO: 3266677 - RNA, 18 nt, Vaccinia virus
uaaauacuuuuuauuuac

SEQ ID NO: 3266678 - RNA, 16 nt, Vaccinia virus
cauaguaauacauauu

SEQ ID NO: 3266679 - RNA, 22 nt, Vaccinia virus
caaaauuggaaggauauacaaa

SEQ ID NO: 3266680 - RNA, 23 nt, Vaccinia virus
guuuuguuuucucuuugguaacu

SEQ ID NO: 3266681 - RNA, 18 nt, Vaccinia virus
aauccaauuguuugauau

SEQ ID NO: 3266682 - RNA, 18 nt, Vaccinia virus
aauaggaguuagaauaau

SEQ ID NO: 3266683 - RNA, 24 nt, Vaccinia virus
uccucagauuuauacauauucuaa

SEQ ID NO: 3266684 - RNA, 16 nt, Vaccinia virus
aaccaccgaugaugcg

SEQ ID NO: 3266685 - RNA, 18 nt, Vaccinia virus
aaauuagucauacguaau

SEQ ID NO: 3266686 - RNA, 15 nt, Vaccinia virus
augaauguuuucaau

SEQ ID NO: 3266687 - RNA, 19 nt, Vaccinia virus
gauguuuaaugauacgaua

SEQ ID NO: 3266688 - RNA, 13 nt, Vaccinia virus
auguaauacuuug

SEQ ID NO: 3266689 - RNA, 16 nt, Vaccinia virus
uacuaucguaaugggg

SEQ ID NO: 3266690 - RNA, 14 nt, Vaccinia virus
aaagguaagaguua

SEQ ID NO: 3266691 - RNA, 16 nt, Vaccinia virus
aacgggauauaugaau

SEQ ID NO: 3266692 - RNA, 14 nt, Vaccinia virus
gcuuuucucuuuua

SEQ ID NO: 3266693 - RNA, 14 nt, Vaccinia virus
gcauucaaauggau

SEQ ID NO: 3266694 - RNA, 23 nt, Vaccinia virus
uggaacuccuauuggaauuauuu

SEQ ID NO: 3266695 - RNA, 15 nt, Vaccinia virus
caauuaguuaauaau

SEQ ID NO: 3266696 - RNA, 12 nt, Vaccinia virus
auggagcguaaa

SEQ ID NO: 3266697 - RNA, 22 nt, Vaccinia virus
auaacuuuaccccaaucagaua

SEQ ID NO: 3266698 - RNA, 18 nt, Vaccinia virus
uacaauauucauauccuu

SEQ ID NO: 3266699 - RNA, 16 nt, Vaccinia virus
aaugaauuauuuacaa

SEQ ID NO: 3266700 - RNA, 15 nt, Vaccinia virus
uacgcgcacacaaua

SEQ ID NO: 3266701 - RNA, 15 nt, Vaccinia virus
aucuacuagaaagau

SEQ ID NO: 3266702 - RNA, 16 nt, Vaccinia virus
uacaauacacacaaua

SEQ ID NO: 3266703 - RNA, 16 nt, Vaccinia virus
cauccuuuauuaauaa

SEQ ID NO: 3266704 - RNA, 21 nt, Vaccinia virus
agauauaaaaugcguauucca

SEQ ID NO: 3266705 - RNA, 16 nt, Vaccinia virus
aguacuaucauaauua

SEQ ID NO: 3266706 - RNA, 17 nt, Vaccinia virus
uggauaauauauacguu

SEQ ID NO: 3266707 - RNA, 16 nt, Vaccinia virus
auaccaucuucuggaa

SEQ ID NO: 3266708 - RNA, 20 nt, Vaccinia virus
acacacaacgcgucuagacu

SEQ ID NO: 3266709 - RNA, 21 nt, Vaccinia virus
uauaugccacguuuauacauu

SEQ ID NO: 3266710 - RNA, 19 nt, Vaccinia virus
auccaauuguuugauauau

SEQ ID NO: 3266711 - RNA, 16 nt, Vaccinia virus
auauuacuguuaauaa

SEQ ID NO: 3266712 - RNA, 18 nt, Vaccinia virus
guuucuggauuauuuuua

SEQ ID NO: 3266713 - RNA, 20 nt, Vaccinia virus
ucaugacugauuuuuuaacu

SEQ ID NO: 3266714 - RNA, 20 nt, Vaccinia virus
gauaauauuauuuauaugau

SEQ ID NO: 3266715 - RNA, 12 nt, Vaccinia virus
ucuuaaccaaaa

SEQ ID NO: 3266716 - RNA, 17 nt, Vaccinia virus
ugacaucauacuagaua

SEQ ID NO: 3266717 - RNA, 22 nt, Vaccinia virus
auaaaaaguaauauucauaugu

SEQ ID NO: 3266718 - RNA, 21 nt, Vaccinia virus
gauaaaaauuuuuuagaugua

SEQ ID NO: 3266719 - RNA, 23 nt, Vaccinia virus
uaaacugcgccaaauuguggcau

SEQ ID NO: 3266720 - RNA, 18 nt, Vaccinia virus
aacauccuuuaaugguuu

SEQ ID NO: 3266721 - RNA, 17 nt, Vaccinia virus
auguuaccauacauuau

SEQ ID NO: 3266722 - RNA, 22 nt, Vaccinia virus
cuccgcuaggagcauacaguaa

SEQ ID NO: 3266723 - RNA, 15 nt, Vaccinia virus
aguaguucaacauaa

SEQ ID NO: 3266724 - RNA, 16 nt, Vaccinia virus
ucaucucuagauaugu

SEQ ID NO: 3266725 - RNA, 20 nt, Vaccinia virus
uacaucuacuauauuaacau

SEQ ID NO: 3266726 - RNA, 14 nt, Vaccinia virus
uauguuuguaaaau

SEQ ID NO: 3266727 - RNA, 18 nt, Vaccinia virus
agcaagauuuuuaaacaa

SEQ ID NO: 3266728 - RNA, 19 nt, Vaccinia virus
uuaugucauaaacuguaaa

SEQ ID NO: 3266729 - RNA, 18 nt, Vaccinia virus
ugcacaaucugagauuuu

SEQ ID NO: 3266730 - RNA, 16 nt, Vaccinia virus
agcuaucgucucugga

SEQ ID NO: 3266731 - RNA, 21 nt, Vaccinia virus
cguuguucuuccaauugcaau

SEQ ID NO: 3266732 - RNA, 21 nt, Vaccinia virus
ucuaaaguuaagagauuuaga

SEQ ID NO: 3266733 - RNA, 20 nt, Vaccinia virus
uuagaaauuggucuguguua

SEQ ID NO: 3266734 - RNA, 22 nt, Vaccinia virus
gauauuaacgcguuuuaugaau

SEQ ID NO: 3266735 - RNA, 22 nt, Vaccinia virus
ugaagaagugucuauaaaugua

SEQ ID NO: 3266736 - RNA, 19 nt, Vaccinia virus
acaaugcucaguaaaugua

SEQ ID NO: 3266737 - RNA, 20 nt, Vaccinia virus
ugauauagaaaagcauauca

SEQ ID NO: 3266738 - RNA, 12 nt, Vaccinia virus
auuaucuuuacc

SEQ ID NO: 3266739 - RNA, 16 nt, Vaccinia virus
cauggaggaugcauua

SEQ ID NO: 3266740 - RNA, 14 nt, Vaccinia virus
uuaaaguguaaaua

SEQ ID NO: 3266741 - RNA, 19 nt, Vaccinia virus
aucgacuugggucuucuca

SEQ ID NO: 3266742 - RNA, 21 nt, Vaccinia virus
aaaucaaucaaggaacuaaau

SEQ ID NO: 3266743 - RNA, 17 nt, Vaccinia virus
ucacuaacaauaacuag

SEQ ID NO: 3266744 - RNA, 23 nt, Vaccinia virus
ucauccguggauauuugauuuuu

SEQ ID NO: 3266745 - RNA, 21 nt, Vaccinia virus
acaaugacuuauaaaaauacu

SEQ ID NO: 3266746 - RNA, 21 nt, Vaccinia virus
uaggugccaccaauaaacuau

SEQ ID NO: 3266747 - RNA, 17 nt, Vaccinia virus
ucgaagauaucauccaa

SEQ ID NO: 3266748 - RNA, 22 nt, Vaccinia virus
uacaaaauguugauaauccuug

SEQ ID NO: 3266749 - RNA, 15 nt, Vaccinia virus
augagguguacagcg

SEQ ID NO: 3266750 - RNA, 15 nt, Vaccinia virus
gucgagguuuaaaaa

SEQ ID NO: 3266751 - RNA, 15 nt, Vaccinia virus
cccaacugcaaguga

SEQ ID NO: 3266752 - RNA, 16 nt, Vaccinia virus
uguuuuuucauuauuu

SEQ ID NO: 3266753 - RNA, 20 nt, Vaccinia virus
cguauaauucuuuauaacug

SEQ ID NO: 3266754 - RNA, 22 nt, Vaccinia virus
uaaacguuguuuacucauauag

SEQ ID NO: 3266755 - RNA, 15 nt, Vaccinia virus
ugucauuuauacguu

SEQ ID NO: 3266756 - RNA, 15 nt, Vaccinia virus
caugacguaaaugua

SEQ ID NO: 3266757 - RNA, 17 nt, Vaccinia virus
uaacacauuuucaucua

SEQ ID NO: 3266758 - RNA, 21 nt, Vaccinia virus
auagcguucgucaacauacua

SEQ ID NO: 3266759 - RNA, 14 nt, Vaccinia virus
agguguuguaacuu

SEQ ID NO: 3266760 - RNA, 23 nt, Vaccinia virus
auaucauuaaguucacuagaaua

SEQ ID NO: 3266761 - RNA, 18 nt, Vaccinia virus
uaacagcaauaguauaau

SEQ ID NO: 3266762 - RNA, 13 nt, Vaccinia virus
aacaguaaaagaa

SEQ ID NO: 3266763 - RNA, 22 nt, Vaccinia virus
caauaagcaguuuccuauucca

SEQ ID NO: 3266764 - RNA, 16 nt, Vaccinia virus
cuguuucgaaacuuua

SEQ ID NO: 3266765 - RNA, 13 nt, Vaccinia virus
ggauuaacagguu

SEQ ID NO: 3266766 - RNA, 17 nt, Vaccinia virus
uucaacaugauuauucu

SEQ ID NO: 3266767 - RNA, 15 nt, Vaccinia virus
caaaacgaguacuuu

SEQ ID NO: 3266768 - RNA, 18 nt, Vaccinia virus
uuaauaguuuacaccuuu

SEQ ID NO: 3266769 - RNA, 21 nt, Vaccinia virus
auaggauuaaaaauaaaguua

SEQ ID NO: 3266770 - RNA, 21 nt, Vaccinia virus
aagucucgcauguucagcaau

SEQ ID NO: 3266771 - RNA, 22 nt, Vaccinia virus
cgaacccguacccagaaauacc

SEQ ID NO: 3266772 - RNA, 22 nt, Vaccinia virus
acuauaguuagcacucuuccau

SEQ ID NO: 3266773 - RNA, 20 nt, Vaccinia virus
ugugauagucgauacguuau

SEQ ID NO: 3266774 - RNA, 16 nt, Vaccinia virus
auuaacgguaauacau

SEQ ID NO: 3266775 - RNA, 23 nt, Vaccinia virus
uaguuccucaggauucuaaugau

SEQ ID NO: 3266776 - RNA, 13 nt, Vaccinia virus
auaaaucauauaa

SEQ ID NO: 3266777 - RNA, 19 nt, Vaccinia virus
cuuaauuucagaagaaaac

SEQ ID NO: 3266778 - RNA, 17 nt, Vaccinia virus
auuaagcauuuuggaaa

SEQ ID NO: 3266779 - RNA, 23 nt, Vaccinia virus
aauaagaacuauaaaaaaaauaa

SEQ ID NO: 3266780 - RNA, 11 nt, Vaccinia virus
uuaaauuauua

SEQ ID NO: 3266781 - RNA, 17 nt, Vaccinia virus
auuauuaaucagaauac

SEQ ID NO: 3266782 - RNA, 13 nt, Vaccinia virus
uacaagaguggaa

SEQ ID NO: 3266783 - RNA, 16 nt, Vaccinia virus
aagucaucgucuacaa

SEQ ID NO: 3266784 - RNA, 15 nt, Vaccinia virus
guucauaaauaaaaa

SEQ ID NO: 3266785 - RNA, 22 nt, Vaccinia virus
cugaagaagagguaagauaucu

SEQ ID NO: 3266786 - RNA, 14 nt, Vaccinia virus
cauucuaucucaaa

SEQ ID NO: 3266787 - RNA, 17 nt, Vaccinia virus
uccauuuuguucaucuc

SEQ ID NO: 3266788 - RNA, 18 nt, Vaccinia virus
uauacaaguguagaugau

SEQ ID NO: 3266789 - RNA, 22 nt, Vaccinia virus
auauaaugggucccuagucaua

SEQ ID NO: 3266790 - RNA, 13 nt, Vaccinia virus
accaucaaaagca

SEQ ID NO: 3266791 - RNA, 23 nt, Vaccinia virus
uaucucgcauccauauguuugga

SEQ ID NO: 3266792 - RNA, 14 nt, Vaccinia virus
uuaauauuacuguu

SEQ ID NO: 3266793 - RNA, 21 nt, Vaccinia virus
accauauauuuggcaugguuu

SEQ ID NO: 3266794 - RNA, 14 nt, Vaccinia virus
uaaacgaacuauau

SEQ ID NO: 3266795 - RNA, 16 nt, Vaccinia virus
cugauagaaagaauaa

SEQ ID NO: 3266796 - RNA, 14 nt, Vaccinia virus
auaguguauacaau

SEQ ID NO: 3266797 - RNA, 22 nt, Vaccinia virus
auuucggaaucgcaaaccacca

SEQ ID NO: 3266798 - RNA, 18 nt, Vaccinia virus
aaaacuaucaaugauaug

SEQ ID NO: 3266799 - RNA, 15 nt, Vaccinia virus
gacacucuauaucua

SEQ ID NO: 3266800 - RNA, 16 nt, Vaccinia virus
uguuguguacauguag

SEQ ID NO: 3266801 - RNA, 14 nt, Vaccinia virus
uacaaaaucaucug

SEQ ID NO: 3266802 - RNA, 16 nt, Vaccinia virus
uagauaaaguagaugu

SEQ ID NO: 3266803 - RNA, 21 nt, Vaccinia virus
agaaucuuaguugguccaaau

SEQ ID NO: 3266804 - RNA, 19 nt, Vaccinia virus
uuaaaucauuacuaauacu

SEQ ID NO: 3266805 - RNA, 12 nt, Vaccinia virus
ucauguaaccaa

SEQ ID NO: 3266806 - RNA, 22 nt, Vaccinia virus
acagaagauagcaaagagauga

SEQ ID NO: 3266807 - RNA, 17 nt, Vaccinia virus
guacuuugaugauuuuu

SEQ ID NO: 3266808 - RNA, 21 nt, Vaccinia virus
cggauaaugauagacaagaua

SEQ ID NO: 3266809 - RNA, 12 nt, Vaccinia virus
uuauguuucuuu

SEQ ID NO: 3266810 - RNA, 21 nt, Vaccinia virus
cugaaauccguagaaacaucu

SEQ ID NO: 3266811 - RNA, 15 nt, Vaccinia virus
uaguaugguuucaua

SEQ ID NO: 3266812 - RNA, 15 nt, Vaccinia virus
aaaucuugauuacaa

SEQ ID NO: 3266813 - RNA, 18 nt, Vaccinia virus
uggaaaagauaacuauug

SEQ ID NO: 3266814 - RNA, 18 nt, Vaccinia virus
agauuucugacaauuacu

SEQ ID NO: 3266815 - RNA, 20 nt, Vaccinia virus
acuuaugucacgaugaugga

SEQ ID NO: 3266816 - RNA, 23 nt, Vaccinia virus
acuagacuauuaauaagacugau

SEQ ID NO: 3266817 - RNA, 21 nt, Vaccinia virus
auuuugucuuuaaguauauac

SEQ ID NO: 3266818 - RNA, 22 nt, Vaccinia virus
aauuaguuuuucuuuacacaau

SEQ ID NO: 3266819 - RNA, 18 nt, Vaccinia virus
gaaauuugaaagaacuac

SEQ ID NO: 3266820 - RNA, 24 nt, Vaccinia virus
gcucuggcuauucgagaugaacau

SEQ ID NO: 3266821 - RNA, 18 nt, Vaccinia virus
auuucguuucuuaaauau

SEQ ID NO: 3266822 - RNA, 13 nt, Vaccinia virus
agucacuauuuuu

SEQ ID NO: 3266823 - RNA, 14 nt, Vaccinia virus
uaaucgauuuugca

SEQ ID NO: 3266824 - RNA, 15 nt, Vaccinia virus
auaucaugaaauaua

SEQ ID NO: 3266825 - RNA, 20 nt, Vaccinia virus
ugucucgcauaaacauuacu

SEQ ID NO: 3266826 - RNA, 13 nt, Vaccinia virus
aguauuuuucuaa

SEQ ID NO: 3266827 - RNA, 14 nt, Vaccinia virus
aauuccauaucuuu

SEQ ID NO: 3266828 - RNA, 22 nt, Vaccinia virus
agugggaugaaauccuauuuua

SEQ ID NO: 3266829 - RNA, 20 nt, Vaccinia virus
aacaauaucuuuaauacaga

SEQ ID NO: 3266830 - RNA, 15 nt, Vaccinia virus
aaugaagauccaaga

SEQ ID NO: 3266831 - RNA, 19 nt, Vaccinia virus
aggauggaauuaucaucaa

SEQ ID NO: 3266832 - RNA, 15 nt, Vaccinia virus
cacuguggaugugac

SEQ ID NO: 3266833 - RNA, 20 nt, Vaccinia virus
uccaucaugaucugguuuug

SEQ ID NO: 3266834 - RNA, 19 nt, Vaccinia virus
aauacuuauuaauggcucu

SEQ ID NO: 3266835 - RNA, 22 nt, Vaccinia virus
uacucuucaaaguuucugaaau

SEQ ID NO: 3266836 - RNA, 16 nt, Vaccinia virus
agaaauaauaagaaua

SEQ ID NO: 3266837 - RNA, 19 nt, Vaccinia virus
auuauucagauacgucuau

SEQ ID NO: 3266838 - RNA, 19 nt, Vaccinia virus
cauauuuauucuauggaug

SEQ ID NO: 3266839 - RNA, 22 nt, Vaccinia virus
gucuagagcaucaauguccugc

SEQ ID NO: 3266840 - RNA, 20 nt, Vaccinia virus
auuuggcuauuaaacaguau

SEQ ID NO: 3266841 - RNA, 17 nt, Vaccinia virus
aucaggauauaaagaaa

SEQ ID NO: 3266842 - RNA, 22 nt, Vaccinia virus
acgaucuuguuguuuauuuuca

SEQ ID NO: 3266843 - RNA, 13 nt, Vaccinia virus
aguauuuaacaag

SEQ ID NO: 3266844 - RNA, 15 nt, Vaccinia virus
auuucauauaauaga

SEQ ID NO: 3266845 - RNA, 18 nt, Vaccinia virus
gaauuaauaauaucucua

SEQ ID NO: 3266846 - RNA, 15 nt, Vaccinia virus
gaauguaucaagaau

SEQ ID NO: 3266847 - RNA, 17 nt, Vaccinia virus
accuguaguuuuaacug

SEQ ID NO: 3266848 - RNA, 17 nt, Vaccinia virus
ucaaauuuuuucuuuaa

SEQ ID NO: 3266849 - RNA, 15 nt, Vaccinia virus
acucucaaauuauua

SEQ ID NO: 3266850 - RNA, 17 nt, Vaccinia virus
auuucauucucugaaaa

SEQ ID NO: 3266851 - RNA, 16 nt, Vaccinia virus
uauguauuuaauauca

SEQ ID NO: 3266852 - RNA, 22 nt, Vaccinia virus
uucaacauuuuauggaaacuau

SEQ ID NO: 3266853 - RNA, 22 nt, Vaccinia virus
aguagaaaauacaacggauauc

SEQ ID NO: 3266854 - RNA, 19 nt, Vaccinia virus
cgauaacgugaaauauauu

SEQ ID NO: 3266855 - RNA, 21 nt, Vaccinia virus
acauguaaugauuuaaaaugu

SEQ ID NO: 3266856 - RNA, 16 nt, Vaccinia virus
gauaagguaaagugua

SEQ ID NO: 3266857 - RNA, 16 nt, Vaccinia virus
cuagauggaaauauug

SEQ ID NO: 3266858 - RNA, 16 nt, Vaccinia virus
uuaaugcaucauuaau

SEQ ID NO: 3266859 - RNA, 19 nt, Vaccinia virus
uuaauuuuagaaauacuua

SEQ ID NO: 3266860 - RNA, 22 nt, Vaccinia virus
uaaauccaguaauaucaugucu

SEQ ID NO: 3266861 - RNA, 15 nt, Vaccinia virus
aucguuaagaauugu

SEQ ID NO: 3266862 - RNA, 23 nt, Vaccinia virus
cauuguguguuagucuugcuauc

SEQ ID NO: 3266863 - RNA, 23 nt, Vaccinia virus
caucgauugugauuguauuuccu

SEQ ID NO: 3266864 - RNA, 16 nt, Vaccinia virus
auagcaauauguguaa

SEQ ID NO: 3266865 - RNA, 22 nt, Vaccinia virus
guucuuuccguacaacauacug

SEQ ID NO: 3266866 - RNA, 12 nt, Vaccinia virus
caaagaaauacg

SEQ ID NO: 3266867 - RNA, 16 nt, Vaccinia virus
uucuuaugaaacuugg

SEQ ID NO: 3266868 - RNA, 13 nt, Vaccinia virus
augaaacauuuaa

SEQ ID NO: 3266869 - RNA, 14 nt, Vaccinia virus
uaguauaauuauug

SEQ ID NO: 3266870 - RNA, 17 nt, Vaccinia virus
cauccaagucaauaucu

SEQ ID NO: 3266871 - RNA, 13 nt, Vaccinia virus
aaaaauucccauu

SEQ ID NO: 3266872 - RNA, 20 nt, Vaccinia virus
guagcaagauuuuuaaacaa

SEQ ID NO: 3266873 - RNA, 16 nt, Vaccinia virus
acuugauaauuaauaa

SEQ ID NO: 3266874 - RNA, 23 nt, Vaccinia virus
ucuaccacagcagaaucccauga

SEQ ID NO: 3266875 - RNA, 23 nt, Vaccinia virus
auaaucuaguaaaacuuucuagu

SEQ ID NO: 3266876 - RNA, 18 nt, Vaccinia virus
ucauacuuguuaguaguu

SEQ ID NO: 3266877 - RNA, 21 nt, Vaccinia virus
guucuaacgccgaucucugaa

SEQ ID NO: 3266878 - RNA, 15 nt, Vaccinia virus
uuauucucuacgagu

SEQ ID NO: 3266879 - RNA, 23 nt, Vaccinia virus
gauggugccaccguaguguauau

SEQ ID NO: 3266880 - RNA, 20 nt, Vaccinia virus
gauguauaauuuuuuuaguu

SEQ ID NO: 3266881 - RNA, 21 nt, Vaccinia virus
aucaccuauugccagguacau

SEQ ID NO: 3266882 - RNA, 20 nt, Vaccinia virus
caucuauuguuauauaacaa

SEQ ID NO: 3266883 - RNA, 23 nt, Vaccinia virus
gacucuucgucuucccaaaaugu

SEQ ID NO: 3266884 - RNA, 13 nt, Vaccinia virus
cuggaaaaguugu

SEQ ID NO: 3266885 - RNA, 16 nt, Vaccinia virus
cacgaaaaaugaugaa

SEQ ID NO: 3266886 - RNA, 20 nt, Vaccinia virus
uaucuuuaguaguguuuccc

SEQ ID NO: 3266887 - RNA, 19 nt, Vaccinia virus
uauccucguuuuguuuucu

SEQ ID NO: 3266888 - RNA, 14 nt, Vaccinia virus
gauuaauaauucau

SEQ ID NO: 3266889 - RNA, 13 nt, Vaccinia virus
aucggcucaaaga

SEQ ID NO: 3266890 - RNA, 21 nt, Vaccinia virus
uauaaacaugaauuuauuucu

SEQ ID NO: 3266891 - RNA, 22 nt, Vaccinia virus
aaccauugucuccuagcaauua

SEQ ID NO: 3266892 - RNA, 15 nt, Vaccinia virus
agcuaagucuauuau

SEQ ID NO: 3266893 - RNA, 12 nt, Vaccinia virus
uaacaaacaucu

SEQ ID NO: 3266894 - RNA, 21 nt, Vaccinia virus
gcaguuuuauuuuaucuuuua

SEQ ID NO: 3266895 - RNA, 22 nt, Vaccinia virus
cacaagccauuguugucugaaa

SEQ ID NO: 3266896 - RNA, 15 nt, Vaccinia virus
uuguaauuaaauuuu

SEQ ID NO: 3266897 - RNA, 17 nt, Vaccinia virus
ucuacaggcuucucauc

SEQ ID NO: 3266898 - RNA, 17 nt, Vaccinia virus
acaagauuccuuuucua

SEQ ID NO: 3266899 - RNA, 17 nt, Vaccinia virus
aauagcugaugauagaa

SEQ ID NO: 3266900 - RNA, 14 nt, Vaccinia virus
cacgaugaugauuu

SEQ ID NO: 3266901 - RNA, 21 nt, Vaccinia virus
cuauauaucgucucauagaga

SEQ ID NO: 3266902 - RNA, 14 nt, Vaccinia virus
agauugaaugccau

SEQ ID NO: 3266903 - RNA, 20 nt, Vaccinia virus
uagugguuauauucucugga

SEQ ID NO: 3266904 - RNA, 20 nt, Vaccinia virus
auacauguauuaaaauacuu

SEQ ID NO: 3266905 - RNA, 16 nt, Vaccinia virus
ucuacacauguaugua

SEQ ID NO: 3266906 - RNA, 19 nt, Vaccinia virus
auagaaauaaaaauuauua

SEQ ID NO: 3266907 - RNA, 21 nt, Vaccinia virus
ggacaucgacgccuuagaaau

SEQ ID NO: 3266908 - RNA, 16 nt, Vaccinia virus
ccaagugcuuaaauau

SEQ ID NO: 3266909 - RNA, 18 nt, Vaccinia virus
cuuggauuuuuuguacau

SEQ ID NO: 3266910 - RNA, 14 nt, Vaccinia virus
uugagaaaacauuu

SEQ ID NO: 3266911 - RNA, 22 nt, Vaccinia virus
agaacgaugucaaaauaugagu

SEQ ID NO: 3266912 - RNA, 15 nt, Vaccinia virus
uaguuaaugaaacau

SEQ ID NO: 3266913 - RNA, 21 nt, Vaccinia virus
cuaguuaagaacaugucuucu

SEQ ID NO: 3266914 - RNA, 16 nt, Vaccinia virus
uuuggcaauaaaguuu

SEQ ID NO: 3266915 - RNA, 23 nt, Vaccinia virus
augaauggaugguuuauguagac

SEQ ID NO: 3266916 - RNA, 17 nt, Vaccinia virus
cauuucucaaaugaaua

SEQ ID NO: 3266917 - RNA, 12 nt, Vaccinia virus
aauaaauagcuu

SEQ ID NO: 3266918 - RNA, 19 nt, Vaccinia virus
acacuuuuguaaaauauua

SEQ ID NO: 3266919 - RNA, 21 nt, Vaccinia virus
uucuuagcgaaugaugcagac

SEQ ID NO: 3266920 - RNA, 17 nt, Vaccinia virus
ucuuuagcuucugaaau

SEQ ID NO: 3266921 - RNA, 16 nt, Vaccinia virus
uguauaacaaauacag

SEQ ID NO: 3266922 - RNA, 23 nt, Vaccinia virus
agaagauguuagaaaaaaugaug

SEQ ID NO: 3266923 - RNA, 19 nt, Vaccinia virus
agauauuuccauuuaucua

SEQ ID NO: 3266924 - RNA, 16 nt, Vaccinia virus
uaauuacauccuugga

SEQ ID NO: 3266925 - RNA, 22 nt, Vaccinia virus
ccaaaaaguguuuggcaauaaa

SEQ ID NO: 3266926 - RNA, 18 nt, Vaccinia virus
acugauuaauuauuugcc

SEQ ID NO: 3266927 - RNA, 15 nt, Vaccinia virus
uaucguaucugucaa

SEQ ID NO: 3266928 - RNA, 20 nt, Vaccinia virus
uguaucauaauauuaaucau

SEQ ID NO: 3266929 - RNA, 15 nt, Vaccinia virus
aacagugaguuuauc

SEQ ID NO: 3266930 - RNA, 22 nt, Vaccinia virus
uaaaguauuugauaaaucucuu

SEQ ID NO: 3266931 - RNA, 19 nt, Vaccinia virus
caugccgugguguaacaau

SEQ ID NO: 3266932 - RNA, 20 nt, Vaccinia virus
acgaaaguauagcuaaugau

SEQ ID NO: 3266933 - RNA, 20 nt, Vaccinia virus
gauacacucucaauauacua

SEQ ID NO: 3266934 - RNA, 12 nt, Vaccinia virus
ugauaaaccauc

SEQ ID NO: 3266935 - RNA, 20 nt, Vaccinia virus
acacucauaaauaaaaauga

SEQ ID NO: 3266936 - RNA, 16 nt, Vaccinia virus
auaguagaauuaaugu

SEQ ID NO: 3266937 - RNA, 16 nt, Vaccinia virus
auagauaaugauauau

SEQ ID NO: 3266938 - RNA, 21 nt, Vaccinia virus
uuucaauauugaaaauacuaa

SEQ ID NO: 3266939 - RNA, 14 nt, Vaccinia virus
aucuacgaauguau

SEQ ID NO: 3266940 - RNA, 19 nt, Vaccinia virus
caaugacauggaaauaucu

SEQ ID NO: 3266941 - RNA, 20 nt, Vaccinia virus
uuaaugucaggaaauguaua

SEQ ID NO: 3266942 - RNA, 16 nt, Vaccinia virus
accauauuuucuggaa

SEQ ID NO: 3266943 - RNA, 12 nt, Vaccinia virus
cauuugaugcac

SEQ ID NO: 3266944 - RNA, 16 nt, Vaccinia virus
gaagaugcgcauucca

SEQ ID NO: 3266945 - RNA, 23 nt, Vaccinia virus
cuauaauguaguaaauauaaaau

SEQ ID NO: 3266946 - RNA, 18 nt, Vaccinia virus
ucaaggaagaagaugcua

SEQ ID NO: 3266947 - RNA, 13 nt, Vaccinia virus
ugacaaaauuaaa

SEQ ID NO: 3266948 - RNA, 23 nt, Vaccinia virus
ugauagauacgcauuuucuggag

SEQ ID NO: 3266949 - RNA, 20 nt, Vaccinia virus
cuuugguaaugaaauuauuc

SEQ ID NO: 3266950 - RNA, 15 nt, Vaccinia virus
gaccuguugcacaau

SEQ ID NO: 3266951 - RNA, 13 nt, Vaccinia virus
caucaucuggaau

SEQ ID NO: 3266952 - RNA, 14 nt, Vaccinia virus
aaaauaguucugua

SEQ ID NO: 3266953 - RNA, 23 nt, Vaccinia virus
ccagaucuauugacuauaacucc

SEQ ID NO: 3266954 - RNA, 23 nt, Vaccinia virus
acuuuaagcuaaaauauuuucua

SEQ ID NO: 3266955 - RNA, 15 nt, Vaccinia virus
acaauaucaauaaau

SEQ ID NO: 3266956 - RNA, 18 nt, Vaccinia virus
ucucagaaucaaauauag

SEQ ID NO: 3266957 - RNA, 16 nt, Vaccinia virus
aaucggagaauguuuc

SEQ ID NO: 3266958 - RNA, 21 nt, Vaccinia virus
uguuucaucuaucauagauuu

SEQ ID NO: 3266959 - RNA, 13 nt, Vaccinia virus
aaugaauacagug

SEQ ID NO: 3266960 - RNA, 21 nt, Vaccinia virus
ccuuuggugaauccaucucua

SEQ ID NO: 3266961 - RNA, 14 nt, Vaccinia virus
aacuccuggauaac

SEQ ID NO: 3266962 - RNA, 15 nt, Vaccinia virus
aucuauauauaccuu

SEQ ID NO: 3266963 - RNA, 18 nt, Vaccinia virus
agacguggagaucuagaa

SEQ ID NO: 3266964 - RNA, 13 nt, Vaccinia virus
aaaauugcauuug

SEQ ID NO: 3266965 - RNA, 13 nt, Vaccinia virus
uuaccgcauuaau

SEQ ID NO: 3266966 - RNA, 14 nt, Vaccinia virus
ucgucuaaaguuua

SEQ ID NO: 3266967 - RNA, 17 nt, Vaccinia virus
aguauaccaaacauagu

SEQ ID NO: 3266968 - RNA, 22 nt, Vaccinia virus
auuacaagacuacaaagaaugu

SEQ ID NO: 3266969 - RNA, 16 nt, Vaccinia virus
uuuauaccuuguaauu

SEQ ID NO: 3266970 - RNA, 14 nt, Vaccinia virus
aaucagaguuuuua

SEQ ID NO: 3266971 - RNA, 11 nt, Vaccinia virus
cuguaaaugau

SEQ ID NO: 3266972 - RNA, 15 nt, Vaccinia virus
uuccuggagauaucc

SEQ ID NO: 3266973 - RNA, 17 nt, Vaccinia virus
aguacauggaugauaua

SEQ ID NO: 3266974 - RNA, 21 nt, Vaccinia virus
auauuuggaaucagacacaga

SEQ ID NO: 3266975 - RNA, 19 nt, Vaccinia virus
auaaaauuuuaauuaaugu

SEQ ID NO: 3266976 - RNA, 19 nt, Vaccinia virus
caauuguuugauauauaau

SEQ ID NO: 3266977 - RNA, 18 nt, Vaccinia virus
auguuuugauuucaauuu

SEQ ID NO: 3266978 - RNA, 19 nt, Vaccinia virus
ucuaugaucugucuuuuaa

SEQ ID NO: 3266979 - RNA, 15 nt, Vaccinia virus
augaaacaugcauaa

SEQ ID NO: 3266980 - RNA, 18 nt, Vaccinia virus
acuauaauauaaucuaga

SEQ ID NO: 3266981 - RNA, 17 nt, Vaccinia virus
auaucaugaagagaugu

SEQ ID NO: 3266982 - RNA, 17 nt, Vaccinia virus
uugauaggaucuauaau

SEQ ID NO: 3266983 - RNA, 20 nt, Vaccinia virus
aauccauucucucaaucacu

SEQ ID NO: 3266984 - RNA, 17 nt, Vaccinia virus
aaaucuauauuguuuaa

SEQ ID NO: 3266985 - RNA, 15 nt, Vaccinia virus
aguaccuacacuauu

SEQ ID NO: 3266986 - RNA, 17 nt, Vaccinia virus
aucaauuucaaaaagag

SEQ ID NO: 3266987 - RNA, 19 nt, Vaccinia virus
agaaucaaauauagauuuu

SEQ ID NO: 3266988 - RNA, 23 nt, Vaccinia virus
acuucuagcgcugauuuaacuaa

SEQ ID NO: 3266989 - RNA, 20 nt, Vaccinia virus
aagauaucuacuagaaagau

SEQ ID NO: 3266990 - RNA, 13 nt, Vaccinia virus
uaaauuuauucuc

SEQ ID NO: 3266991 - RNA, 21 nt, Vaccinia virus
gaaccaguaccagaucuuaau

SEQ ID NO: 3266992 - RNA, 21 nt, Vaccinia virus
aucaugaauggauuuaucauc

SEQ ID NO: 3266993 - RNA, 16 nt, Vaccinia virus
aguugauaauaauaca

SEQ ID NO: 3266994 - RNA, 14 nt, Vaccinia virus
uauguuucaaucau

SEQ ID NO: 3266995 - RNA, 14 nt, Vaccinia virus
cgugauagcucccg

SEQ ID NO: 3266996 - RNA, 12 nt, Vaccinia virus
auuuuuaucaua

SEQ ID NO: 3266997 - RNA, 20 nt, Vaccinia virus
aacgaguucaaauaugaaau

SEQ ID NO: 3266998 - RNA, 18 nt, Vaccinia virus
agagaacauauaaaugua

SEQ ID NO: 3266999 - RNA, 16 nt, Vaccinia virus
guacauaaguuguaca

SEQ ID NO: 3267000 - RNA, 13 nt, Vaccinia virus
aucaacaauuuug

SEQ ID NO: 3267001 - RNA, 18 nt, Vaccinia virus
gauauagaguauaaugau

SEQ ID NO: 3267002 - RNA, 18 nt, Vaccinia virus
cuaaaucgcuuguuuaga

SEQ ID NO: 3267003 - RNA, 14 nt, Vaccinia virus
gcuugaaaauggac

SEQ ID NO: 3267004 - RNA, 16 nt, Vaccinia virus
ccacuuugguaaaauc

SEQ ID NO: 3267005 - RNA, 15 nt, Vaccinia virus
acauaaauaauucua

SEQ ID NO: 3267006 - RNA, 14 nt, Vaccinia virus
uauuagucaauggu

SEQ ID NO: 3267007 - RNA, 15 nt, Vaccinia virus
caauaucguagaauu

SEQ ID NO: 3267008 - RNA, 19 nt, Vaccinia virus
guuaaaaaauuaaguguua

SEQ ID NO: 3267009 - RNA, 18 nt, Vaccinia virus
aauaguauacgcagaaaa

SEQ ID NO: 3267010 - RNA, 13 nt, Vaccinia virus
acguuaaacauua

SEQ ID NO: 3267011 - RNA, 17 nt, Vaccinia virus
caagacggauaagaaau

SEQ ID NO: 3267012 - RNA, 17 nt, Vaccinia virus
aucaauuuaucauauau

SEQ ID NO: 3267013 - RNA, 16 nt, Vaccinia virus
ucaauaguuucauaau

SEQ ID NO: 3267014 - RNA, 15 nt, Vaccinia virus
uauacaagauugaaa

SEQ ID NO: 3267015 - RNA, 17 nt, Vaccinia virus
uaaugcuuaaacuauca

SEQ ID NO: 3267016 - RNA, 12 nt, Vaccinia virus
aaauuuagauua

SEQ ID NO: 3267017 - RNA, 12 nt, Vaccinia virus
auuauuagaaau

SEQ ID NO: 3267018 - RNA, 22 nt, Vaccinia virus
guauuuuuuauggcaaacuuua

SEQ ID NO: 3267019 - RNA, 15 nt, Vaccinia virus
ugcgugacagcacag

SEQ ID NO: 3267020 - RNA, 22 nt, Vaccinia virus
gaauaucugucuuauauuuaua

SEQ ID NO: 3267021 - RNA, 16 nt, Vaccinia virus
ugauacguauauacac

SEQ ID NO: 3267022 - RNA, 17 nt, Vaccinia virus
auccggauauaauauau

SEQ ID NO: 3267023 - RNA, 13 nt, Vaccinia virus
uuacuauguaguu

SEQ ID NO: 3267024 - RNA, 17 nt, Vaccinia virus
acgauauauaguaauga

SEQ ID NO: 3267025 - RNA, 15 nt, Vaccinia virus
auuaauagaaugaag

SEQ ID NO: 3267026 - RNA, 17 nt, Vaccinia virus
uaguuguggaaauacuu

SEQ ID NO: 3267027 - RNA, 15 nt, Vaccinia virus
caaacuuaacagcuc

SEQ ID NO: 3267028 - RNA, 20 nt, Vaccinia virus
ugagaguuuuauauguagca

SEQ ID NO: 3267029 - RNA, 13 nt, Vaccinia virus
agcacagaacaca

SEQ ID NO: 3267030 - RNA, 21 nt, Vaccinia virus
ccauauaccauuaauuguuua

SEQ ID NO: 3267031 - RNA, 21 nt, Vaccinia virus
aaaugugucguaguuagcaag

SEQ ID NO: 3267032 - RNA, 17 nt, Vaccinia virus
aaagaauaauccuauau

SEQ ID NO: 3267033 - RNA, 22 nt, Vaccinia virus
gauuacagucuuuaugauucau

SEQ ID NO: 3267034 - RNA, 16 nt, Vaccinia virus
caucagacaaugcuuu

SEQ ID NO: 3267035 - RNA, 17 nt, Vaccinia virus
uagauuuguaucuccuu

SEQ ID NO: 3267036 - RNA, 19 nt, Vaccinia virus
auguucugauuuuaucuuu

SEQ ID NO: 3267037 - RNA, 15 nt, Vaccinia virus
uaugaagaugauguu

SEQ ID NO: 3267038 - RNA, 15 nt, Vaccinia virus
acuacuaacauggau

SEQ ID NO: 3267039 - RNA, 15 nt, Vaccinia virus
ccuggaaaaauacuu

SEQ ID NO: 3267040 - RNA, 16 nt, Vaccinia virus
cagguauacuguucag

SEQ ID NO: 3267041 - RNA, 21 nt, Vaccinia virus
auaaacuccguguuuaugaug

SEQ ID NO: 3267042 - RNA, 19 nt, Vaccinia virus
cuuuccaaucaauaauuuu

SEQ ID NO: 3267043 - RNA, 17 nt, Vaccinia virus
auuuguauccuuaucua

SEQ ID NO: 3267044 - RNA, 13 nt, Vaccinia virus
agcaguuuauuau

SEQ ID NO: 3267045 - RNA, 19 nt, Vaccinia virus
acucuagagacuaugauug

SEQ ID NO: 3267046 - RNA, 22 nt, Vaccinia virus
cccaauagaauaguauucucag

SEQ ID NO: 3267047 - RNA, 22 nt, Vaccinia virus
uagacaauacuuuuacggaaaa

SEQ ID NO: 3267048 - RNA, 20 nt, Vaccinia virus
guaaugauaaaaucaaucgu

SEQ ID NO: 3267049 - RNA, 14 nt, Vaccinia virus
cuaguuuguuuaua

SEQ ID NO: 3267050 - RNA, 18 nt, Vaccinia virus
guuacaauuuguuaaaaa

SEQ ID NO: 3267051 - RNA, 16 nt, Vaccinia virus
aucuuuugaaaauaua

SEQ ID NO: 3267052 - RNA, 14 nt, Vaccinia virus
cauaacgcauaauu

SEQ ID NO: 3267053 - RNA, 17 nt, Vaccinia virus
uauuggugcauuaauaa

SEQ ID NO: 3267054 - RNA, 12 nt, Vaccinia virus
cauauuaaacau

SEQ ID NO: 3267055 - RNA, 21 nt, Vaccinia virus
aaaucaaacacaagaucuucu

SEQ ID NO: 3267056 - RNA, 18 nt, Vaccinia virus
aaauuaugaaaaaaagau

SEQ ID NO: 3267057 - RNA, 17 nt, Vaccinia virus
guaaccaaauacauauu

SEQ ID NO: 3267058 - RNA, 23 nt, Vaccinia virus
cauucgcggaacuacauaguaaa

SEQ ID NO: 3267059 - RNA, 12 nt, Vaccinia virus
aauucuuucuca

SEQ ID NO: 3267060 - RNA, 16 nt, Vaccinia virus
uuagaauauauuuucu

SEQ ID NO: 3267061 - RNA, 19 nt, Vaccinia virus
ugcuugcuagacaccuuuu

SEQ ID NO: 3267062 - RNA, 16 nt, Vaccinia virus
uguuucuuacauauuu

SEQ ID NO: 3267063 - RNA, 15 nt, Vaccinia virus
auagcaucaauaauu

SEQ ID NO: 3267064 - RNA, 12 nt, Vaccinia virus
cuauaacuucua

SEQ ID NO: 3267065 - RNA, 20 nt, Vaccinia virus
cuaguucaccuucuauagau

SEQ ID NO: 3267066 - RNA, 22 nt, Vaccinia virus
auuuuauaacguuaguuaauaa

SEQ ID NO: 3267067 - RNA, 21 nt, Vaccinia virus
guucuaucuucuaaaaaaucu

SEQ ID NO: 3267068 - RNA, 19 nt, Vaccinia virus
ucuuuguccauuauuucua

SEQ ID NO: 3267069 - RNA, 23 nt, Vaccinia virus
cugaaauacgauucuauauaucu

SEQ ID NO: 3267070 - RNA, 14 nt, Vaccinia virus
ugcauguuugcucu

SEQ ID NO: 3267071 - RNA, 15 nt, Vaccinia virus
aucuaaaaucauaau

SEQ ID NO: 3267072 - RNA, 20 nt, Vaccinia virus
uacagauguuacaaauguag

SEQ ID NO: 3267073 - RNA, 20 nt, Vaccinia virus
uauacagugaacacacaaua

SEQ ID NO: 3267074 - RNA, 20 nt, Vaccinia virus
cuguaucaaccggauuuaaa

SEQ ID NO: 3267075 - RNA, 16 nt, Vaccinia virus
auuaaacauuguucau

SEQ ID NO: 3267076 - RNA, 15 nt, Vaccinia virus
acugauuaacaaaug

SEQ ID NO: 3267077 - RNA, 21 nt, Vaccinia virus
agacuauaccuagagcuauuu

SEQ ID NO: 3267078 - RNA, 24 nt, Vaccinia virus
ucucauaauguaaagauauucuaa

SEQ ID NO: 3267079 - RNA, 13 nt, Vaccinia virus
aucacuaaaauaa

SEQ ID NO: 3267080 - RNA, 17 nt, Vaccinia virus
augaugaaauggauaau

SEQ ID NO: 3267081 - RNA, 16 nt, Vaccinia virus
acuacugaaaaaagug

SEQ ID NO: 3267082 - RNA, 17 nt, Vaccinia virus
cucugauccguauccau

SEQ ID NO: 3267083 - RNA, 17 nt, Vaccinia virus
auccuauacucugaaag

SEQ ID NO: 3267084 - RNA, 19 nt, Vaccinia virus
caugaucaagagugauuua

SEQ ID NO: 3267085 - RNA, 20 nt, Vaccinia virus
ucaauguguguaacuccaga

SEQ ID NO: 3267086 - RNA, 21 nt, Vaccinia virus
acgcguuuuaugaaugaugau

SEQ ID NO: 3267087 - RNA, 14 nt, Vaccinia virus
uuaugagaauagau

SEQ ID NO: 3267088 - RNA, 16 nt, Vaccinia virus
auaacguuagccacca

SEQ ID NO: 3267089 - RNA, 13 nt, Vaccinia virus
auucuauacuuaa

SEQ ID NO: 3267090 - RNA, 16 nt, Vaccinia virus
augauccuauucuaaa

SEQ ID NO: 3267091 - RNA, 16 nt, Vaccinia virus
uuauauagauguagug

SEQ ID NO: 3267092 - RNA, 19 nt, Vaccinia virus
cucagcgauagcucuucua

SEQ ID NO: 3267093 - RNA, 17 nt, Vaccinia virus
cauguuuaucuauuuug

SEQ ID NO: 3267094 - RNA, 19 nt, Vaccinia virus
aucuauauugcuacauaau

SEQ ID NO: 3267095 - RNA, 12 nt, Vaccinia virus
uagaauaugucu

SEQ ID NO: 3267096 - RNA, 15 nt, Vaccinia virus
ugagcaauucccaag

SEQ ID NO: 3267097 - RNA, 23 nt, Vaccinia virus
agcguauaucucuauuaaaugcg

SEQ ID NO: 3267098 - RNA, 22 nt, Vaccinia virus
agaacaacgaaauuauacuaga

SEQ ID NO: 3267099 - RNA, 15 nt, Vaccinia virus
ugaaaaaaauacuua

SEQ ID NO: 3267100 - RNA, 18 nt, Vaccinia virus
aucugcacuaauuaacag

SEQ ID NO: 3267101 - RNA, 16 nt, Vaccinia virus
auaaaccauuguauaa

SEQ ID NO: 3267102 - RNA, 13 nt, Vaccinia virus
uucauucguaaau

SEQ ID NO: 3267103 - RNA, 14 nt, Vaccinia virus
uuaacguauaaaug

SEQ ID NO: 3267104 - RNA, 15 nt, Vaccinia virus
augauuuagaaauga

SEQ ID NO: 3267105 - RNA, 13 nt, Vaccinia virus
acacauauacgaa

SEQ ID NO: 3267106 - RNA, 17 nt, Vaccinia virus
auugacgauucgucucu

SEQ ID NO: 3267107 - RNA, 18 nt, Vaccinia virus
acaauuacguaaugaaga

SEQ ID NO: 3267108 - RNA, 15 nt, Vaccinia virus
gaaaaucaucaucua

SEQ ID NO: 3267109 - RNA, 16 nt, Vaccinia virus
cgaauaccauggauug

SEQ ID NO: 3267110 - RNA, 14 nt, Vaccinia virus
ugaauuugauaaga

SEQ ID NO: 3267111 - RNA, 18 nt, Vaccinia virus
acagauguuacaaaugua

SEQ ID NO: 3267112 - RNA, 14 nt, Vaccinia virus
aacuccucuagaug

SEQ ID NO: 3267113 - RNA, 19 nt, Vaccinia virus
auuuaucgguuuuggugaa

SEQ ID NO: 3267114 - RNA, 19 nt, Vaccinia virus
uagaugccauaucauacau

SEQ ID NO: 3267115 - RNA, 21 nt, Vaccinia virus
auuaugaaaaaguaaaugaug

SEQ ID NO: 3267116 - RNA, 17 nt, Vaccinia virus
auagagguaauacuuuu

SEQ ID NO: 3267117 - RNA, 12 nt, Vaccinia virus
aaaaauacuuac

SEQ ID NO: 3267118 - RNA, 22 nt, Vaccinia virus
uuagaucccggauacuggauau

SEQ ID NO: 3267119 - RNA, 19 nt, Vaccinia virus
uagagugagucuagaauuc

SEQ ID NO: 3267120 - RNA, 24 nt, Vaccinia virus
uuaaaggauggugaaauuauugca

SEQ ID NO: 3267121 - RNA, 13 nt, Vaccinia virus
agacgcuuauuau

SEQ ID NO: 3267122 - RNA, 19 nt, Vaccinia virus
guauaacauucuuaaacaa

SEQ ID NO: 3267123 - RNA, 13 nt, Vaccinia virus
gauacaauacuua

SEQ ID NO: 3267124 - RNA, 17 nt, Vaccinia virus
uugauucgcuucuuuaa

SEQ ID NO: 3267125 - RNA, 14 nt, Vaccinia virus
uaucauuuacuaga

SEQ ID NO: 3267126 - RNA, 18 nt, Vaccinia virus
agcgcauaauaaauuaua

SEQ ID NO: 3267127 - RNA, 12 nt, Vaccinia virus
auuuaaauccua

SEQ ID NO: 3267128 - RNA, 19 nt, Vaccinia virus
guaucgacgguaaauggaa

SEQ ID NO: 3267129 - RNA, 16 nt, Vaccinia virus
agguuaaauagaaugc

SEQ ID NO: 3267130 - RNA, 14 nt, Vaccinia virus
aauguuaacaaaaa

SEQ ID NO: 3267131 - RNA, 23 nt, Vaccinia virus
auauagagagcuucaucaauaga

SEQ ID NO: 3267132 - RNA, 15 nt, Vaccinia virus
aaguaaacaauuuua

SEQ ID NO: 3267133 - RNA, 21 nt, Vaccinia virus
uaauuuacaaaaauuuaaaau

SEQ ID NO: 3267134 - RNA, 19 nt, Vaccinia virus
ucacaacaucuauaaaagu

SEQ ID NO: 3267135 - RNA, 13 nt, Vaccinia virus
guuaaaauuccua

SEQ ID NO: 3267136 - RNA, 22 nt, Vaccinia virus
agaccaagcuucguuguagaaa

SEQ ID NO: 3267137 - RNA, 15 nt, Vaccinia virus
ucaguaucuucuuua

SEQ ID NO: 3267138 - RNA, 19 nt, Vaccinia virus
gaagaaugccuacauauca

SEQ ID NO: 3267139 - RNA, 20 nt, Vaccinia virus
ucuaauugggacauuauguu

SEQ ID NO: 3267140 - RNA, 19 nt, Vaccinia virus
gaaaaaaaagcuauuauca

SEQ ID NO: 3267141 - RNA, 21 nt, Vaccinia virus
uacgaauaucguucucuaaau

SEQ ID NO: 3267142 - RNA, 15 nt, Vaccinia virus
acaagaucuguaaau

SEQ ID NO: 3267143 - RNA, 14 nt, Vaccinia virus
uauucauucaaugu

SEQ ID NO: 3267144 - RNA, 21 nt, Vaccinia virus
uaaauauauuuacaauuauug

SEQ ID NO: 3267145 - RNA, 22 nt, Vaccinia virus
uauuguauuaauuaugaaaaac

SEQ ID NO: 3267146 - RNA, 20 nt, Vaccinia virus
cuaauuugauauaaugaauu

SEQ ID NO: 3267147 - RNA, 14 nt, Vaccinia virus
agaggccaucugga

SEQ ID NO: 3267148 - RNA, 19 nt, Vaccinia virus
uuccgaaguaguagucuuu

SEQ ID NO: 3267149 - RNA, 20 nt, Vaccinia virus
uaguauaucuacacauguau

SEQ ID NO: 3267150 - RNA, 14 nt, Vaccinia virus
guuaugagggaaaa

SEQ ID NO: 3267151 - RNA, 14 nt, Vaccinia virus
uacaugucuaaugu

SEQ ID NO: 3267152 - RNA, 14 nt, Vaccinia virus
ccaacaauuguuua

SEQ ID NO: 3267153 - RNA, 13 nt, Vaccinia virus
augucuacauuau

SEQ ID NO: 3267154 - RNA, 20 nt, Vaccinia virus
aacagaugguagaacaaugu

SEQ ID NO: 3267155 - RNA, 16 nt, Vaccinia virus
aguauuugauaaaaca

SEQ ID NO: 3267156 - RNA, 20 nt, Vaccinia virus
gaauccaucucuauguuuca

SEQ ID NO: 3267157 - RNA, 14 nt, Vaccinia virus
gcgaauuacucugu

SEQ ID NO: 3267158 - RNA, 20 nt, Vaccinia virus
auuuauugcggauagcagua

SEQ ID NO: 3267159 - RNA, 18 nt, Vaccinia virus
auuagucacgacugaaau

SEQ ID NO: 3267160 - RNA, 15 nt, Vaccinia virus
auggagcaaacauua

SEQ ID NO: 3267161 - RNA, 23 nt, Vaccinia virus
auauagaugcagaaguaaugaag

SEQ ID NO: 3267162 - RNA, 14 nt, Vaccinia virus
gaucauucuuuuag

SEQ ID NO: 3267163 - RNA, 18 nt, Vaccinia virus
aacgauaacacaaaaugu

SEQ ID NO: 3267164 - RNA, 21 nt, Vaccinia virus
ugauauuagccuuuacagaua

SEQ ID NO: 3267165 - RNA, 17 nt, Vaccinia virus
aacacugguaacuauau

SEQ ID NO: 3267166 - RNA, 15 nt, Vaccinia virus
aaagaucaaggaaau

SEQ ID NO: 3267167 - RNA, 15 nt, Vaccinia virus
cagguuauccagaag

SEQ ID NO: 3267168 - RNA, 18 nt, Vaccinia virus
gcaauuuguuaauaagau

SEQ ID NO: 3267169 - RNA, 19 nt, Vaccinia virus
uaaacuguuuauuaaugau

SEQ ID NO: 3267170 - RNA, 20 nt, Vaccinia virus
uauauuaucaaaauuuggaa

SEQ ID NO: 3267171 - RNA, 12 nt, Vaccinia virus
aucaguaucuuc

SEQ ID NO: 3267172 - RNA, 14 nt, Vaccinia virus
cucuauauuacaaa

SEQ ID NO: 3267173 - RNA, 22 nt, Vaccinia virus
uuaauaagaaugacuccuaugu

SEQ ID NO: 3267174 - RNA, 23 nt, Vaccinia virus
uaugcuuuuauuuuuggaaugau

SEQ ID NO: 3267175 - RNA, 21 nt, Vaccinia virus
ggacagauacuacuauuuguc

SEQ ID NO: 3267176 - RNA, 19 nt, Vaccinia virus
auuugucuucuuucuuuua

SEQ ID NO: 3267177 - RNA, 13 nt, Vaccinia virus
cugcaauaaaaca

SEQ ID NO: 3267178 - RNA, 18 nt, Vaccinia virus
acaaguaggauuuuucca

SEQ ID NO: 3267179 - RNA, 14 nt, Vaccinia virus
auauuuuuuucuau

SEQ ID NO: 3267180 - RNA, 13 nt, Vaccinia virus
auuacuacguaaa

SEQ ID NO: 3267181 - RNA, 13 nt, Vaccinia virus
aguuauuaaugau

SEQ ID NO: 3267182 - RNA, 14 nt, Vaccinia virus
aaucauuaaaugau

SEQ ID NO: 3267183 - RNA, 21 nt, Vaccinia virus
ucuaccagccuacauuuugcu

SEQ ID NO: 3267184 - RNA, 21 nt, Vaccinia virus
gcauaguaacucauaauugcu

SEQ ID NO: 3267185 - RNA, 17 nt, Vaccinia virus
aauuuuaauuaauguaa

SEQ ID NO: 3267186 - RNA, 16 nt, Vaccinia virus
aaauuuuuuucauuga

SEQ ID NO: 3267187 - RNA, 16 nt, Vaccinia virus
aguaacuauguaaaug

SEQ ID NO: 3267188 - RNA, 21 nt, Vaccinia virus
uuuuuauuacauguuuucaua

SEQ ID NO: 3267189 - RNA, 20 nt, Vaccinia virus
aauaacuauguuuuaaaaau

SEQ ID NO: 3267190 - RNA, 22 nt, Vaccinia virus
acauuguuuauggaugccacug

SEQ ID NO: 3267191 - RNA, 24 nt, Vaccinia virus
agauuaucuaguuagaacuaucau

SEQ ID NO: 3267192 - RNA, 23 nt, Vaccinia virus
uaauguagaagaucauacagaca

SEQ ID NO: 3267193 - RNA, 17 nt, Vaccinia virus
ugugaagguuuagaugu

SEQ ID NO: 3267194 - RNA, 18 nt, Vaccinia virus
augauucgucuacauguu

SEQ ID NO: 3267195 - RNA, 16 nt, Vaccinia virus
aagucacuaacugaua

SEQ ID NO: 3267196 - RNA, 23 nt, Vaccinia virus
ggagaauacaaagcguacagaua

SEQ ID NO: 3267197 - RNA, 22 nt, Vaccinia virus
ccaucugucauauuuagauuuu

SEQ ID NO: 3267198 - RNA, 19 nt, Vaccinia virus
guuuuacguuauuaaucau

SEQ ID NO: 3267199 - RNA, 13 nt, Vaccinia virus
uucuauuauuaca

SEQ ID NO: 3267200 - RNA, 15 nt, Vaccinia virus
auagcgaugauuauc

SEQ ID NO: 3267201 - RNA, 21 nt, Vaccinia virus
agaauauaaccacuacaucau

SEQ ID NO: 3267202 - RNA, 23 nt, Vaccinia virus
aaauauauuuacaauuauuggaa

SEQ ID NO: 3267203 - RNA, 13 nt, Vaccinia virus
aaucuaaugauga

SEQ ID NO: 3267204 - RNA, 20 nt, Vaccinia virus
uacuuguuaguaguuagaua

SEQ ID NO: 3267205 - RNA, 18 nt, Vaccinia virus
uaaauuacacauuuccaa

SEQ ID NO: 3267206 - RNA, 22 nt, Vaccinia virus
ugucuuagaaggaguguuuucu

SEQ ID NO: 3267207 - RNA, 14 nt, Vaccinia virus
acagaccaaauaua

SEQ ID NO: 3267208 - RNA, 17 nt, Vaccinia virus
agauuucugacaauuac

SEQ ID NO: 3267209 - RNA, 16 nt, Vaccinia virus
accaucuaucaaacaa

SEQ ID NO: 3267210 - RNA, 15 nt, Vaccinia virus
cagaauagagccaaa

SEQ ID NO: 3267211 - RNA, 12 nt, Vaccinia virus
uguaagaaauaa

SEQ ID NO: 3267212 - RNA, 19 nt, Vaccinia virus
uauucgucccuacuauaaa

SEQ ID NO: 3267213 - RNA, 19 nt, Vaccinia virus
auaauauuuuaauagauua

SEQ ID NO: 3267214 - RNA, 22 nt, Vaccinia virus
ucuugauuaccuuacucaugau

SEQ ID NO: 3267215 - RNA, 13 nt, Vaccinia virus
ucgucuacuauuc

SEQ ID NO: 3267216 - RNA, 15 nt, Vaccinia virus
agaaacagaacuauu

SEQ ID NO: 3267217 - RNA, 14 nt, Vaccinia virus
augaaaaaaaacac

SEQ ID NO: 3267218 - RNA, 14 nt, Vaccinia virus
cuggauauuacaaa

SEQ ID NO: 3267219 - RNA, 21 nt, Vaccinia virus
ugauaugauuaucguuuucau

SEQ ID NO: 3267220 - RNA, 13 nt, Vaccinia virus
auaaaaauacuua

SEQ ID NO: 3267221 - RNA, 21 nt, Vaccinia virus
cagaaauauaugagauguagu

SEQ ID NO: 3267222 - RNA, 17 nt, Vaccinia virus
ucuagaauaaguuucau

SEQ ID NO: 3267223 - RNA, 17 nt, Vaccinia virus
aucuaauggauaaacug

SEQ ID NO: 3267224 - RNA, 16 nt, Vaccinia virus
agaucuuaagaaaauu

SEQ ID NO: 3267225 - RNA, 18 nt, Vaccinia virus
acuagucgcguuaauagu

SEQ ID NO: 3267226 - RNA, 18 nt, Vaccinia virus
aguuaaugcgucuaaaac

SEQ ID NO: 3267227 - RNA, 14 nt, Vaccinia virus
aaauaauaauggaa

SEQ ID NO: 3267228 - RNA, 23 nt, Vaccinia virus
uuggaggcgaugaucuuaauuuu

SEQ ID NO: 3267229 - RNA, 11 nt, Vaccinia virus
aaauuuucuaa

SEQ ID NO: 3267230 - RNA, 17 nt, Vaccinia virus
uccuuaucuucauagaa

SEQ ID NO: 3267231 - RNA, 18 nt, Vaccinia virus
aaaugucaugauuaguau

SEQ ID NO: 3267232 - RNA, 19 nt, Vaccinia virus
auuaaacguacauuuucca

SEQ ID NO: 3267233 - RNA, 16 nt, Vaccinia virus
auacacauuuaauaaa

SEQ ID NO: 3267234 - RNA, 22 nt, Vaccinia virus
aaaaucuuuguucuaaaaacug

SEQ ID NO: 3267235 - RNA, 15 nt, Vaccinia virus
uuuauaaacaaaaau

SEQ ID NO: 3267236 - RNA, 17 nt, Vaccinia virus
auuucacgaaaaaugau

SEQ ID NO: 3267237 - RNA, 19 nt, Vaccinia virus
agauauacgcuaucuauau

SEQ ID NO: 3267238 - RNA, 23 nt, Vaccinia virus
gcuucaaucgcgcguuagaaauu

SEQ ID NO: 3267239 - RNA, 16 nt, Vaccinia virus
ugguaucaagaaguau

SEQ ID NO: 3267240 - RNA, 22 nt, Vaccinia virus
caacuucaucaugaguuaaaua

SEQ ID NO: 3267241 - RNA, 23 nt, Vaccinia virus
uacaaaauguugauaauccuuga

SEQ ID NO: 3267242 - RNA, 22 nt, Vaccinia virus
aucacacaagccauuguugucu

SEQ ID NO: 3267243 - RNA, 17 nt, Vaccinia virus
ucuugauacuauccagu

SEQ ID NO: 3267244 - RNA, 12 nt, Vaccinia virus
cuuuaacuucug

SEQ ID NO: 3267245 - RNA, 13 nt, Vaccinia virus
uuauuuuuggaag

SEQ ID NO: 3267246 - RNA, 17 nt, Vaccinia virus
guacccacugaugagau

SEQ ID NO: 3267247 - RNA, 15 nt, Vaccinia virus
gaauuaauguccuga

SEQ ID NO: 3267248 - RNA, 14 nt, Vaccinia virus
auaaacaugucuau

SEQ ID NO: 3267249 - RNA, 15 nt, Vaccinia virus
auggucauagagaac

SEQ ID NO: 3267250 - RNA, 18 nt, Vaccinia virus
uagaggaauaucaucaaa

SEQ ID NO: 3267251 - RNA, 14 nt, Vaccinia virus
aucauagaugaaug

SEQ ID NO: 3267252 - RNA, 16 nt, Vaccinia virus
uaagaguaacagcugc

SEQ ID NO: 3267253 - RNA, 23 nt, Vaccinia virus
uucuagcucccggauugaaaaca

SEQ ID NO: 3267254 - RNA, 17 nt, Vaccinia virus
gaagaauuaauaaacaa

SEQ ID NO: 3267255 - RNA, 15 nt, Vaccinia virus
auaguuauaucacac

SEQ ID NO: 3267256 - RNA, 23 nt, Vaccinia virus
gaugcuauccaucagaauguuuc

SEQ ID NO: 3267257 - RNA, 18 nt, Vaccinia virus
acguucacuaauaaauug

SEQ ID NO: 3267258 - RNA, 19 nt, Vaccinia virus
acaucagauguagcgaaga

SEQ ID NO: 3267259 - RNA, 19 nt, Vaccinia virus
aaguuuggguaaauaacua

SEQ ID NO: 3267260 - RNA, 16 nt, Vaccinia virus
uucaagcgaauuacuc

SEQ ID NO: 3267261 - RNA, 18 nt, Vaccinia virus
aaugagagcaaaaauaua

SEQ ID NO: 3267262 - RNA, 17 nt, Vaccinia virus
augacgagcgucauauu

SEQ ID NO: 3267263 - RNA, 20 nt, Vaccinia virus
auauacgaagggauuaaaaa

SEQ ID NO: 3267264 - RNA, 20 nt, Vaccinia virus
cacauauggaauauaucuau

SEQ ID NO: 3267265 - RNA, 12 nt, Vaccinia virus
aauacuaucuau

SEQ ID NO: 3267266 - RNA, 20 nt, Vaccinia virus
gcggagauaauaucagaaag

SEQ ID NO: 3267267 - RNA, 22 nt, Vaccinia virus
uuugaacaaugcacgaccuaua

SEQ ID NO: 3267268 - RNA, 18 nt, Vaccinia virus
gauuguuuaagaagagaa

SEQ ID NO: 3267269 - RNA, 19 nt, Vaccinia virus
uagaaacuauacgaaauaa

SEQ ID NO: 3267270 - RNA, 21 nt, Vaccinia virus
agacaaguauccguuugauau

SEQ ID NO: 3267271 - RNA, 14 nt, Vaccinia virus
uucauagucauuaa

SEQ ID NO: 3267272 - RNA, 20 nt, Vaccinia virus
ucuuuaauccaaucuaagaa

SEQ ID NO: 3267273 - RNA, 15 nt, Vaccinia virus
acagauguauuggau

SEQ ID NO: 3267274 - RNA, 21 nt, Vaccinia virus
uuacaaacgacauacuguaug

SEQ ID NO: 3267275 - RNA, 14 nt, Vaccinia virus
aucaauaaauggau

SEQ ID NO: 3267276 - RNA, 22 nt, Vaccinia virus
ucuuccguuuauuauuauacau

SEQ ID NO: 3267277 - RNA, 18 nt, Vaccinia virus
uaugcaaccguaucaaaa

SEQ ID NO: 3267278 - RNA, 15 nt, Vaccinia virus
gacagaaaaaugcua

SEQ ID NO: 3267279 - RNA, 16 nt, Vaccinia virus
guguauacuauuuuua

SEQ ID NO: 3267280 - RNA, 23 nt, Vaccinia virus
acuaaucgauuuugcauacucua

SEQ ID NO: 3267281 - RNA, 12 nt, Vaccinia virus
caaauauauuua

SEQ ID NO: 3267282 - RNA, 14 nt, Vaccinia virus
cacuuguaguucuu

SEQ ID NO: 3267283 - RNA, 19 nt, Vaccinia virus
ucucuaaguuaacacaugu

SEQ ID NO: 3267284 - RNA, 16 nt, Vaccinia virus
aaauagguacucuguu

SEQ ID NO: 3267285 - RNA, 14 nt, Vaccinia virus
auuauagacacuau

SEQ ID NO: 3267286 - RNA, 15 nt, Vaccinia virus
aauacacauaaugaa

SEQ ID NO: 3267287 - RNA, 14 nt, Vaccinia virus
ccauacauacaucu

SEQ ID NO: 3267288 - RNA, 23 nt, Vaccinia virus
accaauaucgauuacuaugaaua

SEQ ID NO: 3267289 - RNA, 16 nt, Vaccinia virus
aucaacaucuuaaaaa

SEQ ID NO: 3267290 - RNA, 19 nt, Vaccinia virus
cuggcuauuucaaaauaaa

SEQ ID NO: 3267291 - RNA, 13 nt, Vaccinia virus
auguuacagaaua

SEQ ID NO: 3267292 - RNA, 20 nt, Vaccinia virus
acaaagcacucaauaaauua

SEQ ID NO: 3267293 - RNA, 23 nt, Vaccinia virus
gacauguucgugguguuaugaaa

SEQ ID NO: 3267294 - RNA, 13 nt, Vaccinia virus
aucuuaaauacca

SEQ ID NO: 3267295 - RNA, 11 nt, Vaccinia virus
uuucaaagaug

SEQ ID NO: 3267296 - RNA, 15 nt, Vaccinia virus
gccaaaaugauagau

SEQ ID NO: 3267297 - RNA, 14 nt, Vaccinia virus
auuaauacauuauu

SEQ ID NO: 3267298 - RNA, 21 nt, Vaccinia virus
uuaaagaugacaauauuauua

SEQ ID NO: 3267299 - RNA, 17 nt, Vaccinia virus
agguaacauaaaaacug

SEQ ID NO: 3267300 - RNA, 22 nt, Vaccinia virus
cagucugaacaucaaucuuuuu

SEQ ID NO: 3267301 - RNA, 14 nt, Vaccinia virus
auuaccauggauga

SEQ ID NO: 3267302 - RNA, 14 nt, Vaccinia virus
acugacuuaauagu

SEQ ID NO: 3267303 - RNA, 18 nt, Vaccinia virus
cauacauuuguaaaagua

SEQ ID NO: 3267304 - RNA, 18 nt, Vaccinia virus
uuagaugagaaauuauuc

SEQ ID NO: 3267305 - RNA, 17 nt, Vaccinia virus
aacaaguuggaugauau

SEQ ID NO: 3267306 - RNA, 14 nt, Vaccinia virus
uaaaccauuuuuca

SEQ ID NO: 3267307 - RNA, 21 nt, Vaccinia virus
uguuuaaugaauuacuaaaau

SEQ ID NO: 3267308 - RNA, 19 nt, Vaccinia virus
caauccuucagauaaucug

SEQ ID NO: 3267309 - RNA, 20 nt, Vaccinia virus
agauacuuuauuacuccauu

SEQ ID NO: 3267310 - RNA, 15 nt, Vaccinia virus
uaucauaauuaaauu

SEQ ID NO: 3267311 - RNA, 15 nt, Vaccinia virus
gugaguuuuccuuaa

SEQ ID NO: 3267312 - RNA, 19 nt, Vaccinia virus
uaucacgugcaaggcauuu

SEQ ID NO: 3267313 - RNA, 20 nt, Vaccinia virus
aacuccggauagagaaauau

SEQ ID NO: 3267314 - RNA, 18 nt, Vaccinia virus
gucgacagaagaauauga

SEQ ID NO: 3267315 - RNA, 12 nt, Vaccinia virus
auagaucaaaua

SEQ ID NO: 3267316 - RNA, 18 nt, Vaccinia virus
ccaagaaacagucagcug

SEQ ID NO: 3267317 - RNA, 24 nt, Vaccinia virus
aggguccauuuucuguaaauagaa

SEQ ID NO: 3267318 - RNA, 14 nt, Vaccinia virus
ucuccccaaacauu

SEQ ID NO: 3267319 - RNA, 17 nt, Vaccinia virus
guuggaaaaaugaugaa

SEQ ID NO: 3267320 - RNA, 11 nt, Vaccinia virus
uauuauacaug

SEQ ID NO: 3267321 - RNA, 22 nt, Vaccinia virus
uuaauccaucguacaugguugg

SEQ ID NO: 3267322 - RNA, 22 nt, Vaccinia virus
agaaaaugucucucauaauaaa

SEQ ID NO: 3267323 - RNA, 19 nt, Vaccinia virus
aauagcuaacgcuaguaau

SEQ ID NO: 3267324 - RNA, 18 nt, Vaccinia virus
auaauuuuuggacaaaug

SEQ ID NO: 3267325 - RNA, 13 nt, Vaccinia virus
acaauuacaaaug

SEQ ID NO: 3267326 - RNA, 15 nt, Vaccinia virus
ccaguacaucuauca

SEQ ID NO: 3267327 - RNA, 13 nt, Vaccinia virus
agaguccauguau

SEQ ID NO: 3267328 - RNA, 14 nt, Vaccinia virus
cuuaauuauaacga

SEQ ID NO: 3267329 - RNA, 17 nt, Vaccinia virus
gaacguaaauuaguuca

SEQ ID NO: 3267330 - RNA, 15 nt, Vaccinia virus
ugcaucuauaugucc

SEQ ID NO: 3267331 - RNA, 22 nt, Vaccinia virus
uccauauguuuggagcaaauau

SEQ ID NO: 3267332 - RNA, 18 nt, Vaccinia virus
aaauacaaaauaauagau

SEQ ID NO: 3267333 - RNA, 22 nt, Vaccinia virus
uauaacacuuauguauuaacuu

SEQ ID NO: 3267334 - RNA, 13 nt, Vaccinia virus
cuauuuuaauagg

SEQ ID NO: 3267335 - RNA, 22 nt, Vaccinia virus
ccuuuugauaaauuucuucuug

SEQ ID NO: 3267336 - RNA, 23 nt, Vaccinia virus
ucuauuuguucugacaauauuua

SEQ ID NO: 3267337 - RNA, 15 nt, Vaccinia virus
acaucuauuaaucau

SEQ ID NO: 3267338 - RNA, 17 nt, Vaccinia virus
uauuagagauaccaaag

SEQ ID NO: 3267339 - RNA, 18 nt, Vaccinia virus
uacucuauucgaaaacuc

SEQ ID NO: 3267340 - RNA, 22 nt, Vaccinia virus
gacuaagucuacaaauagagau

SEQ ID NO: 3267341 - RNA, 17 nt, Vaccinia virus
auccaaacccuugaucu

SEQ ID NO: 3267342 - RNA, 16 nt, Vaccinia virus
ucgagcuaauuucuaa

SEQ ID NO: 3267343 - RNA, 19 nt, Vaccinia virus
uaagcgcuauacaaaucau

SEQ ID NO: 3267344 - RNA, 23 nt, Vaccinia virus
ugucuuaaaguuuauuaauuaau

SEQ ID NO: 3267345 - RNA, 16 nt, Vaccinia virus
uauagaaacauauucu

SEQ ID NO: 3267346 - RNA, 15 nt, Vaccinia virus
uccuguacuauacca

SEQ ID NO: 3267347 - RNA, 15 nt, Vaccinia virus
ucugugguggaugau

SEQ ID NO: 3267348 - RNA, 18 nt, Vaccinia virus
aaggugucgauuaccauu

SEQ ID NO: 3267349 - RNA, 21 nt, Vaccinia virus
uagaacuuacugacaaaguua

SEQ ID NO: 3267350 - RNA, 22 nt, Vaccinia virus
aauuauaguaagccaauuccaa

SEQ ID NO: 3267351 - RNA, 17 nt, Vaccinia virus
auuaacgguuauaaaau

SEQ ID NO: 3267352 - RNA, 14 nt, Vaccinia virus
aagcugacaaaauu

SEQ ID NO: 3267353 - RNA, 17 nt, Vaccinia virus
auuauucuuaaaugccu

SEQ ID NO: 3267354 - RNA, 19 nt, Vaccinia virus
uauaugcccuauuaucaua

SEQ ID NO: 3267355 - RNA, 21 nt, Vaccinia virus
gauaaaaaccacuuaucgcau

SEQ ID NO: 3267356 - RNA, 22 nt, Vaccinia virus
uaauaucaaacgguaacacauc

SEQ ID NO: 3267357 - RNA, 22 nt, Vaccinia virus
uuauccguauuuccauaauaag

SEQ ID NO: 3267358 - RNA, 15 nt, Vaccinia virus
auacuuaaaaaauga

SEQ ID NO: 3267359 - RNA, 15 nt, Vaccinia virus
caauucaugcucuau

SEQ ID NO: 3267360 - RNA, 16 nt, Vaccinia virus
uauuuacaaaauucau

SEQ ID NO: 3267361 - RNA, 16 nt, Vaccinia virus
auaccuuguaauuaaa

SEQ ID NO: 3267362 - RNA, 20 nt, Vaccinia virus
agauaccaacauuaaaaugu

SEQ ID NO: 3267363 - RNA, 21 nt, Vaccinia virus
ugauuauucuauaaguauaga

SEQ ID NO: 3267364 - RNA, 17 nt, Vaccinia virus
auagagauauuauuacu

SEQ ID NO: 3267365 - RNA, 14 nt, Vaccinia virus
uagaaugaagaaug

SEQ ID NO: 3267366 - RNA, 16 nt, Vaccinia virus
agauaaaaaauuauau

SEQ ID NO: 3267367 - RNA, 12 nt, Vaccinia virus
cuguaaacauuu

SEQ ID NO: 3267368 - RNA, 17 nt, Vaccinia virus
gaaauguguaauaauau

SEQ ID NO: 3267369 - RNA, 15 nt, Vaccinia virus
uaaugauauaucuug

SEQ ID NO: 3267370 - RNA, 23 nt, Vaccinia virus
uuuuacgccucuccuuccguaaa

SEQ ID NO: 3267371 - RNA, 15 nt, Vaccinia virus
aguaauuacauagau

SEQ ID NO: 3267372 - RNA, 16 nt, Vaccinia virus
uagauaugugauuuac

SEQ ID NO: 3267373 - RNA, 21 nt, Vaccinia virus
acaacuuuuaaauacaaauau

SEQ ID NO: 3267374 - RNA, 19 nt, Vaccinia virus
gugacuuugauaauaacau

SEQ ID NO: 3267375 - RNA, 18 nt, Vaccinia virus
gauucucuacucuagaua

SEQ ID NO: 3267376 - RNA, 16 nt, Vaccinia virus
ucgacaucacaaccua

SEQ ID NO: 3267377 - RNA, 15 nt, Vaccinia virus
uguaucaguuucgua

SEQ ID NO: 3267378 - RNA, 14 nt, Vaccinia virus
cucucuaauggaug

SEQ ID NO: 3267379 - RNA, 21 nt, Vaccinia virus
auaguugaucagaaugaaugu

SEQ ID NO: 3267380 - RNA, 23 nt, Vaccinia virus
uucaucguuuagaauaaaaugau

SEQ ID NO: 3267381 - RNA, 13 nt, Vaccinia virus
aaacgaacuauau

SEQ ID NO: 3267382 - RNA, 14 nt, Vaccinia virus
gauaauauuauuau

SEQ ID NO: 3267383 - RNA, 13 nt, Vaccinia virus
aguauuaucaaag

SEQ ID NO: 3267384 - RNA, 16 nt, Vaccinia virus
aauucaucucuagaua

SEQ ID NO: 3267385 - RNA, 15 nt, Vaccinia virus
uugcucucugaaucu

SEQ ID NO: 3267386 - RNA, 17 nt, Vaccinia virus
acagaauaugagaauga

SEQ ID NO: 3267387 - RNA, 20 nt, Vaccinia virus
uguauuauucugaauaguga

SEQ ID NO: 3267388 - RNA, 14 nt, Vaccinia virus
aucuauauauguau

SEQ ID NO: 3267389 - RNA, 15 nt, Vaccinia virus
uccuaguacacaaua

SEQ ID NO: 3267390 - RNA, 13 nt, Vaccinia virus
acaaaauacauaa

SEQ ID NO: 3267391 - RNA, 15 nt, Vaccinia virus
uaaaaauucacacau

SEQ ID NO: 3267392 - RNA, 21 nt, Vaccinia virus
caauguagaaauuagaaagau

SEQ ID NO: 3267393 - RNA, 15 nt, Vaccinia virus
aaaaauguuaauuua

SEQ ID NO: 3267394 - RNA, 17 nt, Vaccinia virus
caaaucuauauaccaua

SEQ ID NO: 3267395 - RNA, 19 nt, Vaccinia virus
uacaaucucguuuaauauu

SEQ ID NO: 3267396 - RNA, 14 nt, Vaccinia virus
auacuuaaaaaaug

SEQ ID NO: 3267397 - RNA, 16 nt, Vaccinia virus
uauuuuauuucaaaau

SEQ ID NO: 3267398 - RNA, 13 nt, Vaccinia virus
agaaauacuauau

SEQ ID NO: 3267399 - RNA, 17 nt, Vaccinia virus
cuauuagaauuuacaaa

SEQ ID NO: 3267400 - RNA, 16 nt, Vaccinia virus
gaauauauaaaagacg

SEQ ID NO: 3267401 - RNA, 14 nt, Vaccinia virus
aguauuuuaauaca

SEQ ID NO: 3267402 - RNA, 23 nt, Vaccinia virus
uguauauuauaaagauauguacg

SEQ ID NO: 3267403 - RNA, 19 nt, Vaccinia virus
ugacaucgacgcauuauau

SEQ ID NO: 3267404 - RNA, 17 nt, Vaccinia virus
auaagucuauuugaaau

SEQ ID NO: 3267405 - RNA, 19 nt, Vaccinia virus
agauguuacaaauguagaa

SEQ ID NO: 3267406 - RNA, 18 nt, Vaccinia virus
uuuguacgucacaucuuc

SEQ ID NO: 3267407 - RNA, 14 nt, Vaccinia virus
acauuuuuuguaaa

SEQ ID NO: 3267408 - RNA, 20 nt, Vaccinia virus
acuuacauggacacauucuu

SEQ ID NO: 3267409 - RNA, 17 nt, Vaccinia virus
uauaugaaguaaaguau

SEQ ID NO: 3267410 - RNA, 22 nt, Vaccinia virus
agaaaagcaguuaccaaagaga

SEQ ID NO: 3267411 - RNA, 17 nt, Vaccinia virus
cauuuaucauauauaau

SEQ ID NO: 3267412 - RNA, 13 nt, Vaccinia virus
augacauuuuccu

SEQ ID NO: 3267413 - RNA, 14 nt, Vaccinia virus
agcuggucuaaaau

SEQ ID NO: 3267414 - RNA, 18 nt, Vaccinia virus
uuucuuguuaucagauau

SEQ ID NO: 3267415 - RNA, 18 nt, Vaccinia virus
cgcauuccaaucuuaaac

SEQ ID NO: 3267416 - RNA, 16 nt, Vaccinia virus
uuguucuaaagccagu

SEQ ID NO: 3267417 - RNA, 14 nt, Vaccinia virus
uucaccaauaaaaa

SEQ ID NO: 3267418 - RNA, 20 nt, Vaccinia virus
auauuacauaccauuaauaa

SEQ ID NO: 3267419 - RNA, 13 nt, Vaccinia virus
uacauuguauaaa

SEQ ID NO: 3267420 - RNA, 17 nt, Vaccinia virus
accucuaucaucuacau

SEQ ID NO: 3267421 - RNA, 21 nt, Vaccinia virus
uaaagauauucuaaaauggua

SEQ ID NO: 3267422 - RNA, 24 nt, Vaccinia virus
auuaacgaguuccauuuauaucau

SEQ ID NO: 3267423 - RNA, 22 nt, Vaccinia virus
gauuaauuguuauuuuauucau

SEQ ID NO: 3267424 - RNA, 19 nt, Vaccinia virus
aacaugaauuuauuucuaa

SEQ ID NO: 3267425 - RNA, 12 nt, Vaccinia virus
auucaucaauau

SEQ ID NO: 3267426 - RNA, 15 nt, Vaccinia virus
aauugucacuuuguu

SEQ ID NO: 3267427 - RNA, 20 nt, Vaccinia virus
cauaacaccacgaacauguc

SEQ ID NO: 3267428 - RNA, 16 nt, Vaccinia virus
auggagagauuuaacu

SEQ ID NO: 3267429 - RNA, 15 nt, Vaccinia virus
uauguagagguguau

SEQ ID NO: 3267430 - RNA, 18 nt, Vaccinia virus
augauccuauucuaaaug

SEQ ID NO: 3267431 - RNA, 15 nt, Vaccinia virus
cguacuuaacaucua

SEQ ID NO: 3267432 - RNA, 14 nt, Vaccinia virus
cauuaaauguauuu

SEQ ID NO: 3267433 - RNA, 14 nt, Vaccinia virus
caggaauagaugua

SEQ ID NO: 3267434 - RNA, 12 nt, Vaccinia virus
aguauacauguu

SEQ ID NO: 3267435 - RNA, 18 nt, Vaccinia virus
guagaucgucuaaaagaa

SEQ ID NO: 3267436 - RNA, 14 nt, Vaccinia virus
ugguaauuaaauau

SEQ ID NO: 3267437 - RNA, 14 nt, Vaccinia virus
aagauguuagaaaa

SEQ ID NO: 3267438 - RNA, 18 nt, Vaccinia virus
gcucuguaaagcauauuc

SEQ ID NO: 3267439 - RNA, 11 nt, Vaccinia virus
gguuagauauu

SEQ ID NO: 3267440 - RNA, 21 nt, Vaccinia virus
cuaugcauauuauuaaucauu

SEQ ID NO: 3267441 - RNA, 18 nt, Vaccinia virus
aagaagagaauuaaaaga

SEQ ID NO: 3267442 - RNA, 20 nt, Vaccinia virus
acuggucauagaaaaugauu

SEQ ID NO: 3267443 - RNA, 16 nt, Vaccinia virus
acagaugauauaucca

SEQ ID NO: 3267444 - RNA, 17 nt, Vaccinia virus
uauauuaucauagaccu

SEQ ID NO: 3267445 - RNA, 21 nt, Vaccinia virus
ucauaaaauauuuuuauucuc

SEQ ID NO: 3267446 - RNA, 17 nt, Vaccinia virus
agaguagauauuaaugu

SEQ ID NO: 3267447 - RNA, 20 nt, Vaccinia virus
ugucuacacauccuuuugua

SEQ ID NO: 3267448 - RNA, 14 nt, Vaccinia virus
gacuacucuaggua

SEQ ID NO: 3267449 - RNA, 11 nt, Vaccinia virus
auaauuuuacc

SEQ ID NO: 3267450 - RNA, 21 nt, Vaccinia virus
agcuggauaucaguagaugca

SEQ ID NO: 3267451 - RNA, 21 nt, Vaccinia virus
uauauuucauucgucaaggau

SEQ ID NO: 3267452 - RNA, 13 nt, Vaccinia virus
aaucugaccaucc

SEQ ID NO: 3267453 - RNA, 18 nt, Vaccinia virus
auaacauucuaggaaugu

SEQ ID NO: 3267454 - RNA, 21 nt, Vaccinia virus
guauucuauaccaauauuauu

SEQ ID NO: 3267455 - RNA, 22 nt, Vaccinia virus
caugaaggagauuuaguauuua

SEQ ID NO: 3267456 - RNA, 11 nt, Vaccinia virus
aaauaaauguc

SEQ ID NO: 3267457 - RNA, 19 nt, Vaccinia virus
aaacgaguacuuuaaagaa

SEQ ID NO: 3267458 - RNA, 17 nt, Vaccinia virus
auauacgccaugauugu

SEQ ID NO: 3267459 - RNA, 18 nt, Vaccinia virus
acucuuccacuauugcca

SEQ ID NO: 3267460 - RNA, 15 nt, Vaccinia virus
uuuggcuuugugcau

SEQ ID NO: 3267461 - RNA, 21 nt, Vaccinia virus
uuuaauuuuuucuacagauau

SEQ ID NO: 3267462 - RNA, 13 nt, Vaccinia virus
aaaauauuaucua

SEQ ID NO: 3267463 - RNA, 19 nt, Vaccinia virus
caauuauucuaauggaugu

SEQ ID NO: 3267464 - RNA, 15 nt, Vaccinia virus
uugcuggauucacaa

SEQ ID NO: 3267465 - RNA, 15 nt, Vaccinia virus
aaucauuaaaugauu

SEQ ID NO: 3267466 - RNA, 14 nt, Vaccinia virus
cugaauaaaacauc

SEQ ID NO: 3267467 - RNA, 17 nt, Vaccinia virus
aauauaaaaaaaugauu

SEQ ID NO: 3267468 - RNA, 22 nt, Vaccinia virus
guagcaaauaaaaucuauauga

SEQ ID NO: 3267469 - RNA, 20 nt, Vaccinia virus
aacuuggggagaaugauaca

SEQ ID NO: 3267470 - RNA, 16 nt, Vaccinia virus
auucauuuucaauuau

SEQ ID NO: 3267471 - RNA, 15 nt, Vaccinia virus
aguuuuauaaacucg

SEQ ID NO: 3267472 - RNA, 22 nt, Vaccinia virus
auagaaguuaaacugugaaugu

SEQ ID NO: 3267473 - RNA, 20 nt, Vaccinia virus
cuuaaauguaucuuuacuag

SEQ ID NO: 3267474 - RNA, 17 nt, Vaccinia virus
acucagauuauucuuaa

SEQ ID NO: 3267475 - RNA, 13 nt, Vaccinia virus
ggaguuagaaaac

SEQ ID NO: 3267476 - RNA, 19 nt, Vaccinia virus
uuaguauauuccuuauuca

SEQ ID NO: 3267477 - RNA, 19 nt, Vaccinia virus
uacuaaauucgauaucuuu

SEQ ID NO: 3267478 - RNA, 16 nt, Vaccinia virus
cauaccgcaaauggaa

SEQ ID NO: 3267479 - RNA, 19 nt, Vaccinia virus
aacguucaccaaugucucu

SEQ ID NO: 3267480 - RNA, 13 nt, Vaccinia virus
gauguguauacau

SEQ ID NO: 3267481 - RNA, 18 nt, Vaccinia virus
acaauuuacauguucauu

SEQ ID NO: 3267482 - RNA, 20 nt, Vaccinia virus
aacuauaugucuguagaaaa

SEQ ID NO: 3267483 - RNA, 14 nt, Vaccinia virus
auaauuauaagacu

SEQ ID NO: 3267484 - RNA, 21 nt, Vaccinia virus
acuuucgaauaaguuugcaga

SEQ ID NO: 3267485 - RNA, 17 nt, Vaccinia virus
auaacacaaaaugugaa

SEQ ID NO: 3267486 - RNA, 16 nt, Vaccinia virus
auaugaucaaaaagag

SEQ ID NO: 3267487 - RNA, 15 nt, Vaccinia virus
agcguaucuauaauu

SEQ ID NO: 3267488 - RNA, 14 nt, Vaccinia virus
gagaaauuauuccu

SEQ ID NO: 3267489 - RNA, 13 nt, Vaccinia virus
agcagcgauuuug

SEQ ID NO: 3267490 - RNA, 19 nt, Vaccinia virus
uaacuauauaccuauuaau

SEQ ID NO: 3267491 - RNA, 16 nt, Vaccinia virus
guuacgauuuuaucau

SEQ ID NO: 3267492 - RNA, 19 nt, Vaccinia virus
uuacuuugaccacauccuu

SEQ ID NO: 3267493 - RNA, 22 nt, Vaccinia virus
uuguacacuucuauaguaucua

SEQ ID NO: 3267494 - RNA, 12 nt, Vaccinia virus
aguauuaaugau

SEQ ID NO: 3267495 - RNA, 14 nt, Vaccinia virus
acaugcagaagaac

SEQ ID NO: 3267496 - RNA, 19 nt, Vaccinia virus
aggagauacuaucaaaaua

SEQ ID NO: 3267497 - RNA, 16 nt, Vaccinia virus
auggcguacaaaggaa

SEQ ID NO: 3267498 - RNA, 18 nt, Vaccinia virus
uaaacugcgccaaauugu

SEQ ID NO: 3267499 - RNA, 14 nt, Vaccinia virus
acuauagacauaau

SEQ ID NO: 3267500 - RNA, 20 nt, Vaccinia virus
uggaagcugaacacauuaaa

SEQ ID NO: 3267501 - RNA, 19 nt, Vaccinia virus
gaaucagugaauaaauuca

SEQ ID NO: 3267502 - RNA, 19 nt, Vaccinia virus
uauguguguagacaaucau

SEQ ID NO: 3267503 - RNA, 18 nt, Vaccinia virus
auuauuuaauuuaauaca

SEQ ID NO: 3267504 - RNA, 18 nt, Vaccinia virus
cuaauuugauauaaugaa

SEQ ID NO: 3267505 - RNA, 12 nt, Vaccinia virus
cagacuacuuau

SEQ ID NO: 3267506 - RNA, 14 nt, Vaccinia virus
uuuuaaacacucuu

SEQ ID NO: 3267507 - RNA, 21 nt, Vaccinia virus
uuacugcugcguuaaacauuc

SEQ ID NO: 3267508 - RNA, 18 nt, Vaccinia virus
uaauccacuauauauucu

SEQ ID NO: 3267509 - RNA, 16 nt, Vaccinia virus
uaaaugaauucucauu

SEQ ID NO: 3267510 - RNA, 14 nt, Vaccinia virus
aauaacaauguuuc

SEQ ID NO: 3267511 - RNA, 14 nt, Vaccinia virus
ucguauaaaguuau

SEQ ID NO: 3267512 - RNA, 17 nt, Vaccinia virus
uacaucuuccuucuuau

SEQ ID NO: 3267513 - RNA, 15 nt, Vaccinia virus
uaugacuaaagcuau

SEQ ID NO: 3267514 - RNA, 12 nt, Vaccinia virus
uaaauucaagau

SEQ ID NO: 3267515 - RNA, 18 nt, Vaccinia virus
gauguaauuaaauguuug

SEQ ID NO: 3267516 - RNA, 14 nt, Vaccinia virus
auguugacauguau

SEQ ID NO: 3267517 - RNA, 17 nt, Vaccinia virus
agugaaucgacuauaga

SEQ ID NO: 3267518 - RNA, 23 nt, Vaccinia virus
uuuauuggagacguaacaaugua

SEQ ID NO: 3267519 - RNA, 13 nt, Vaccinia virus
aacauuaguucca

SEQ ID NO: 3267520 - RNA, 23 nt, Vaccinia virus
uaaaauacuuuccgaauaagucu

SEQ ID NO: 3267521 - RNA, 13 nt, Vaccinia virus
cuugugcauuuuc

SEQ ID NO: 3267522 - RNA, 20 nt, Vaccinia virus
ugucuagcauucuagagcau

SEQ ID NO: 3267523 - RNA, 21 nt, Vaccinia virus
auacucccuugcaucauauac

SEQ ID NO: 3267524 - RNA, 19 nt, Vaccinia virus
auuuuuaaccaauacuauu

SEQ ID NO: 3267525 - RNA, 16 nt, Vaccinia virus
auucuaugucuauuau

SEQ ID NO: 3267526 - RNA, 13 nt, Vaccinia virus
auguauguuuaaa

SEQ ID NO: 3267527 - RNA, 15 nt, Vaccinia virus
cuacugcaucacuga

SEQ ID NO: 3267528 - RNA, 15 nt, Vaccinia virus
aaaaaguuuuaacau

SEQ ID NO: 3267529 - RNA, 19 nt, Vaccinia virus
ucauauaucugcucuuaaa

SEQ ID NO: 3267530 - RNA, 16 nt, Vaccinia virus
cguaaaccauuuuuca

SEQ ID NO: 3267531 - RNA, 22 nt, Vaccinia virus
aucgauaguguaguuauugaac

SEQ ID NO: 3267532 - RNA, 13 nt, Vaccinia virus
agauuuucaauua

SEQ ID NO: 3267533 - RNA, 14 nt, Vaccinia virus
auuaguaacagcuu

SEQ ID NO: 3267534 - RNA, 14 nt, Vaccinia virus
auguauacaaaugu

SEQ ID NO: 3267535 - RNA, 15 nt, Vaccinia virus
aauacguuggucuau

SEQ ID NO: 3267536 - RNA, 16 nt, Vaccinia virus
cugaaauaaucaugua

SEQ ID NO: 3267537 - RNA, 16 nt, Vaccinia virus
auuguagauuguugac

SEQ ID NO: 3267538 - RNA, 21 nt, Vaccinia virus
uagauuuccucguccuaugga

SEQ ID NO: 3267539 - RNA, 16 nt, Vaccinia virus
auuuuggaaaaaauug

SEQ ID NO: 3267540 - RNA, 21 nt, Vaccinia virus
gguagauuuguucuauagagc

SEQ ID NO: 3267541 - RNA, 14 nt, Vaccinia virus
aauaauuaaugccc

SEQ ID NO: 3267542 - RNA, 16 nt, Vaccinia virus
uggagcaaacauuaac

SEQ ID NO: 3267543 - RNA, 23 nt, Vaccinia virus
ugccacaaaugaaaaaaauacuu

SEQ ID NO: 3267544 - RNA, 22 nt, Vaccinia virus
gauuggauaagaaaacauaucu

SEQ ID NO: 3267545 - RNA, 18 nt, Vaccinia virus
gugcaaggaaucaucuga

SEQ ID NO: 3267546 - RNA, 18 nt, Vaccinia virus
augguuuacccuagaaua

SEQ ID NO: 3267547 - RNA, 16 nt, Vaccinia virus
gcuaauauuaguacua

SEQ ID NO: 3267548 - RNA, 14 nt, Vaccinia virus
acgaugaaaaccag

SEQ ID NO: 3267549 - RNA, 12 nt, Vaccinia virus
auugacaaaauu

SEQ ID NO: 3267550 - RNA, 21 nt, Vaccinia virus
auacgaaccgggaaagagaag

SEQ ID NO: 3267551 - RNA, 17 nt, Vaccinia virus
auacgcuccuuaucaaa

SEQ ID NO: 3267552 - RNA, 22 nt, Vaccinia virus
acgauuuccaugucuacauuau

SEQ ID NO: 3267553 - RNA, 15 nt, Vaccinia virus
uuaacggcuauucaa

SEQ ID NO: 3267554 - RNA, 20 nt, Vaccinia virus
auauuguacgguagaauuga

SEQ ID NO: 3267555 - RNA, 16 nt, Vaccinia virus
aauugauaauauaaau

SEQ ID NO: 3267556 - RNA, 12 nt, Vaccinia virus
cguuagucauau

SEQ ID NO: 3267557 - RNA, 16 nt, Vaccinia virus
ucuacaagaauuuugg

SEQ ID NO: 3267558 - RNA, 11 nt, Vaccinia virus
aaucuggaaaa

SEQ ID NO: 3267559 - RNA, 22 nt, Vaccinia virus
caauugguuaugauaucaugua

SEQ ID NO: 3267560 - RNA, 23 nt, Vaccinia virus
cauaaauaauaaauacaauaauu

SEQ ID NO: 3267561 - RNA, 16 nt, Vaccinia virus
auaaaaccaguauuug

SEQ ID NO: 3267562 - RNA, 14 nt, Vaccinia virus
acaauucauuucca

SEQ ID NO: 3267563 - RNA, 16 nt, Vaccinia virus
uaaaaagguagauguu

SEQ ID NO: 3267564 - RNA, 20 nt, Vaccinia virus
guaccuggaauguaaagccc

SEQ ID NO: 3267565 - RNA, 19 nt, Vaccinia virus
auaauugaguaaaugaaug

SEQ ID NO: 3267566 - RNA, 16 nt, Vaccinia virus
ggugacaugugugaua

SEQ ID NO: 3267567 - RNA, 15 nt, Vaccinia virus
acuacccaucacauu

SEQ ID NO: 3267568 - RNA, 14 nt, Vaccinia virus
augguaaaagaaau

SEQ ID NO: 3267569 - RNA, 20 nt, Vaccinia virus
auaucacaggagcaauguuu

SEQ ID NO: 3267570 - RNA, 17 nt, Vaccinia virus
ucugaucuuaacuccuc

SEQ ID NO: 3267571 - RNA, 19 nt, Vaccinia virus
uccacaguuuuuaauuucu

SEQ ID NO: 3267572 - RNA, 13 nt, Vaccinia virus
agauugcauggug

SEQ ID NO: 3267573 - RNA, 16 nt, Vaccinia virus
uagacaacaggaugaa

SEQ ID NO: 3267574 - RNA, 23 nt, Vaccinia virus
caauaaaguuuuuaguaugacau

SEQ ID NO: 3267575 - RNA, 13 nt, Vaccinia virus
aguucuucuagaa

SEQ ID NO: 3267576 - RNA, 23 nt, Vaccinia virus
ugugucaaagguuaaaccuuuau

SEQ ID NO: 3267577 - RNA, 17 nt, Vaccinia virus
auaucacauuguauaua

SEQ ID NO: 3267578 - RNA, 21 nt, Vaccinia virus
agauuuaaggaaccagaauga

SEQ ID NO: 3267579 - RNA, 23 nt, Vaccinia virus
ugucuuggaaucaauuacagauu

SEQ ID NO: 3267580 - RNA, 15 nt, Vaccinia virus
aacauauuuuucuau

SEQ ID NO: 3267581 - RNA, 20 nt, Vaccinia virus
auauuaucuuuuuagacacg

SEQ ID NO: 3267582 - RNA, 18 nt, Vaccinia virus
guuaaacaauagauggau

SEQ ID NO: 3267583 - RNA, 18 nt, Vaccinia virus
uguaugauaaaauucuua

SEQ ID NO: 3267584 - RNA, 15 nt, Vaccinia virus
uauauuagagaagau

SEQ ID NO: 3267585 - RNA, 22 nt, Vaccinia virus
uuaaaggauaaaauauuaucca

SEQ ID NO: 3267586 - RNA, 22 nt, Vaccinia virus
uuggagaaacugcaacuggaaa

SEQ ID NO: 3267587 - RNA, 14 nt, Vaccinia virus
aauacauguacaaa

SEQ ID NO: 3267588 - RNA, 17 nt, Vaccinia virus
aauagcgcugaaaauaa

SEQ ID NO: 3267589 - RNA, 23 nt, Vaccinia virus
ugacuguagauauuauauagaua

SEQ ID NO: 3267590 - RNA, 14 nt, Vaccinia virus
aauaaucagaaauu

SEQ ID NO: 3267591 - RNA, 13 nt, Vaccinia virus
auauaguaauaag

SEQ ID NO: 3267592 - RNA, 18 nt, Vaccinia virus
guaaauauucuaaauuaa

SEQ ID NO: 3267593 - RNA, 16 nt, Vaccinia virus
uaaucauuguccagau

SEQ ID NO: 3267594 - RNA, 14 nt, Vaccinia virus
auaaaauuuaagag

SEQ ID NO: 3267595 - RNA, 15 nt, Vaccinia virus
ucuauuuaauacuuu

SEQ ID NO: 3267596 - RNA, 22 nt, Vaccinia virus
aaaauauuuuuauucucuuucu

SEQ ID NO: 3267597 - RNA, 23 nt, Vaccinia virus
uuugauagcuaacucgguaucua

SEQ ID NO: 3267598 - RNA, 17 nt, Vaccinia virus
agcaaucagaaaugaug

SEQ ID NO: 3267599 - RNA, 21 nt, Vaccinia virus
aguacugcuuuuuucgaaaug

SEQ ID NO: 3267600 - RNA, 17 nt, Vaccinia virus
agcauccaguaugaaua

SEQ ID NO: 3267601 - RNA, 23 nt, Vaccinia virus
uaguacuccucccauaauacuuu

SEQ ID NO: 3267602 - RNA, 21 nt, Vaccinia virus
aauaucgauguuuaacuuuug

SEQ ID NO: 3267603 - RNA, 19 nt, Vaccinia virus
cagugguuucauguuuaua

SEQ ID NO: 3267604 - RNA, 14 nt, Vaccinia virus
ccaauuguuugaua

SEQ ID NO: 3267605 - RNA, 20 nt, Vaccinia virus
caauuagauccaaagaagau

SEQ ID NO: 3267606 - RNA, 20 nt, Vaccinia virus
agacuuuaagcuaaaauauu

SEQ ID NO: 3267607 - RNA, 21 nt, Vaccinia virus
auaauuugaccugauuacauu

SEQ ID NO: 3267608 - RNA, 16 nt, Vaccinia virus
caaaaugauagauauu

SEQ ID NO: 3267609 - RNA, 18 nt, Vaccinia virus
auaucaauaagcauuaug

SEQ ID NO: 3267610 - RNA, 19 nt, Vaccinia virus
ggaguaaguagucuauuaa

SEQ ID NO: 3267611 - RNA, 13 nt, Vaccinia virus
aucuaccuuauuu

SEQ ID NO: 3267612 - RNA, 20 nt, Vaccinia virus
uuuucuauaaauaaaagaca

SEQ ID NO: 3267613 - RNA, 14 nt, Vaccinia virus
uaauccuagaugau

SEQ ID NO: 3267614 - RNA, 17 nt, Vaccinia virus
aaugauugcauagugaa

SEQ ID NO: 3267615 - RNA, 21 nt, Vaccinia virus
uuaaguucuggaauauuauua

SEQ ID NO: 3267616 - RNA, 19 nt, Vaccinia virus
auaugauaauauuaaaaga

SEQ ID NO: 3267617 - RNA, 18 nt, Vaccinia virus
acccauggagauacuuua

SEQ ID NO: 3267618 - RNA, 16 nt, Vaccinia virus
gaugcugcaugaugaa

SEQ ID NO: 3267619 - RNA, 20 nt, Vaccinia virus
acgacacuggaaaaugcgau

SEQ ID NO: 3267620 - RNA, 16 nt, Vaccinia virus
gcggccaucauauuau

SEQ ID NO: 3267621 - RNA, 16 nt, Vaccinia virus
uucuucagaauaauag

SEQ ID NO: 3267622 - RNA, 16 nt, Vaccinia virus
acaaaauacuauauau

SEQ ID NO: 3267623 - RNA, 13 nt, Vaccinia virus
gauagcaaaacaa

SEQ ID NO: 3267624 - RNA, 16 nt, Vaccinia virus
uggaaucaucuucuga

SEQ ID NO: 3267625 - RNA, 15 nt, Vaccinia virus
uguaaagaacaguga

SEQ ID NO: 3267626 - RNA, 15 nt, Vaccinia virus
uagaaaacagagaua

SEQ ID NO: 3267627 - RNA, 19 nt, Vaccinia virus
aaaauaaucauacaaucua

SEQ ID NO: 3267628 - RNA, 23 nt, Vaccinia virus
aaccaaggacuuuguagaaauau

SEQ ID NO: 3267629 - RNA, 14 nt, Vaccinia virus
auuuuuuuauucau

SEQ ID NO: 3267630 - RNA, 13 nt, Vaccinia virus
uggaaagauauca

SEQ ID NO: 3267631 - RNA, 17 nt, Vaccinia virus
auguuuuaaaaaucaca

SEQ ID NO: 3267632 - RNA, 14 nt, Vaccinia virus
auaaaaauacuuau

SEQ ID NO: 3267633 - RNA, 19 nt, Vaccinia virus
guuaacuuugauuauccua

SEQ ID NO: 3267634 - RNA, 14 nt, Vaccinia virus
gauauugaagauga

SEQ ID NO: 3267635 - RNA, 19 nt, Vaccinia virus
augucuaaaaacagaaaua

SEQ ID NO: 3267636 - RNA, 21 nt, Vaccinia virus
acaucaaagaacguaaaauac

SEQ ID NO: 3267637 - RNA, 14 nt, Vaccinia virus
caaaaaauuacuuu

SEQ ID NO: 3267638 - RNA, 15 nt, Vaccinia virus
uaaauguuuaacguu

SEQ ID NO: 3267639 - RNA, 18 nt, Vaccinia virus
aaucuguauaucuuucca

SEQ ID NO: 3267640 - RNA, 22 nt, Vaccinia virus
uuauuaaaguuuacaguuugaa

SEQ ID NO: 3267641 - RNA, 14 nt, Vaccinia virus
uaauugcuuuucua

SEQ ID NO: 3267642 - RNA, 16 nt, Vaccinia virus
uagcauaguuuuucau

SEQ ID NO: 3267643 - RNA, 22 nt, Vaccinia virus
ugauaguauuccaauaucugag

SEQ ID NO: 3267644 - RNA, 12 nt, Vaccinia virus
uaugaaugacuc

SEQ ID NO: 3267645 - RNA, 16 nt, Vaccinia virus
aauagaaaaaacaugu

SEQ ID NO: 3267646 - RNA, 17 nt, Vaccinia virus
ucuauuuuuuaaauuuu

SEQ ID NO: 3267647 - RNA, 14 nt, Vaccinia virus
auuuagcaaaauuc

SEQ ID NO: 3267648 - RNA, 22 nt, Vaccinia virus
uauuugagaaauauguauacau

SEQ ID NO: 3267649 - RNA, 18 nt, Vaccinia virus
aguguaccaauaugugaa

SEQ ID NO: 3267650 - RNA, 12 nt, Vaccinia virus
aaucauugauau

SEQ ID NO: 3267651 - RNA, 13 nt, Vaccinia virus
auccucuaugaag

SEQ ID NO: 3267652 - RNA, 17 nt, Vaccinia virus
acacacgaugaaaaugu

SEQ ID NO: 3267653 - RNA, 14 nt, Vaccinia virus
cgaaccagaaagug

SEQ ID NO: 3267654 - RNA, 16 nt, Vaccinia virus
uccuagguuucucuau

SEQ ID NO: 3267655 - RNA, 14 nt, Vaccinia virus
augauuuaugaauu

SEQ ID NO: 3267656 - RNA, 13 nt, Vaccinia virus
cauuagauacaau

SEQ ID NO: 3267657 - RNA, 23 nt, Vaccinia virus
ucaaacgaauaaacaauuucaca

SEQ ID NO: 3267658 - RNA, 17 nt, Vaccinia virus
gcuguaaacaaguuugg

SEQ ID NO: 3267659 - RNA, 19 nt, Vaccinia virus
aaaaagcucuauauuacaa

SEQ ID NO: 3267660 - RNA, 14 nt, Vaccinia virus
guaaacauaucaua

SEQ ID NO: 3267661 - RNA, 20 nt, Vaccinia virus
aauaucucaauaguuucaua

SEQ ID NO: 3267662 - RNA, 23 nt, Vaccinia virus
aguucuugcuccuccuugauucu

SEQ ID NO: 3267663 - RNA, 12 nt, Vaccinia virus
agaaauaugauu

SEQ ID NO: 3267664 - RNA, 22 nt, Vaccinia virus
aacacuaaaaaauaaacacaua

SEQ ID NO: 3267665 - RNA, 18 nt, Vaccinia virus
uuaaacgauuuauaaaaa

SEQ ID NO: 3267666 - RNA, 17 nt, Vaccinia virus
uauaucaucuacauaau

SEQ ID NO: 3267667 - RNA, 22 nt, Vaccinia virus
uaguuauggcacucuuauuaua

SEQ ID NO: 3267668 - RNA, 19 nt, Vaccinia virus
auuuauucaucaucaaaag

SEQ ID NO: 3267669 - RNA, 19 nt, Vaccinia virus
cugcagcaaaggcaauaag

SEQ ID NO: 3267670 - RNA, 22 nt, Vaccinia virus
uccauucucucaaucacuacau

SEQ ID NO: 3267671 - RNA, 12 nt, Vaccinia virus
acguaacaaugu

SEQ ID NO: 3267672 - RNA, 14 nt, Vaccinia virus
auacaaaaaaaugc

SEQ ID NO: 3267673 - RNA, 15 nt, Vaccinia virus
gaaaaguaugauggu

SEQ ID NO: 3267674 - RNA, 15 nt, Vaccinia virus
auacaaaauaauaga

SEQ ID NO: 3267675 - RNA, 17 nt, Vaccinia virus
cuaaugcauguuauaga

SEQ ID NO: 3267676 - RNA, 13 nt, Vaccinia virus
auaauuaguuuuu

SEQ ID NO: 3267677 - RNA, 23 nt, Vaccinia virus
auccaauuguuugauauauaauu

SEQ ID NO: 3267678 - RNA, 23 nt, Vaccinia virus
gauauaauucguggauaaucauu

SEQ ID NO: 3267679 - RNA, 15 nt, Vaccinia virus
aaagaaguccauuua

SEQ ID NO: 3267680 - RNA, 17 nt, Vaccinia virus
uaacacauuucaacaau

SEQ ID NO: 3267681 - RNA, 19 nt, Vaccinia virus
aggcuuugauaucuaaaua

SEQ ID NO: 3267682 - RNA, 14 nt, Vaccinia virus
aaccuagaaaauau

SEQ ID NO: 3267683 - RNA, 22 nt, Vaccinia virus
auuaucaugacaaaauuaaaaa

SEQ ID NO: 3267684 - RNA, 22 nt, Vaccinia virus
aaaauuauuaaacaauacucua

SEQ ID NO: 3267685 - RNA, 21 nt, Vaccinia virus
uauuaaagauuguuuaagaag

SEQ ID NO: 3267686 - RNA, 22 nt, Vaccinia virus
ugggauaaaaauuauguuuuua

SEQ ID NO: 3267687 - RNA, 15 nt, Vaccinia virus
gcaguuuuguucauu

SEQ ID NO: 3267688 - RNA, 12 nt, Vaccinia virus
gauauuauuaca

SEQ ID NO: 3267689 - RNA, 12 nt, Vaccinia virus
gucuagaaauaa

SEQ ID NO: 3267690 - RNA, 23 nt, Vaccinia virus
uguuuaaauaacccgaguauuga

SEQ ID NO: 3267691 - RNA, 13 nt, Vaccinia virus
guuuagagaaugc

SEQ ID NO: 3267692 - RNA, 19 nt, Vaccinia virus
uuauuuucuucuacguaca

SEQ ID NO: 3267693 - RNA, 23 nt, Vaccinia virus
aucuaguuagaacuaucauagau

SEQ ID NO: 3267694 - RNA, 19 nt, Vaccinia virus
gugggggacuggcugauga

SEQ ID NO: 3267695 - RNA, 15 nt, Vaccinia virus
ugccacgguuccaag

SEQ ID NO: 3267696 - RNA, 21 nt, Vaccinia virus
augaacacacgaugaaaaugu

SEQ ID NO: 3267697 - RNA, 16 nt, Vaccinia virus
caaacucuauuuuaaa

SEQ ID NO: 3267698 - RNA, 22 nt, Vaccinia virus
caaugucuauaguucucaucuu

SEQ ID NO: 3267699 - RNA, 17 nt, Vaccinia virus
gcuacauaauccagcua

SEQ ID NO: 3267700 - RNA, 16 nt, Vaccinia virus
guaccauuugauuuuc

SEQ ID NO: 3267701 - RNA, 17 nt, Vaccinia virus
acuaauuguuuaaauaa

SEQ ID NO: 3267702 - RNA, 13 nt, Vaccinia virus
guuaauuuuauca

SEQ ID NO: 3267703 - RNA, 20 nt, Vaccinia virus
aguuuaagauuguacacuuu

SEQ ID NO: 3267704 - RNA, 15 nt, Vaccinia virus
acucugaaaagaaag

SEQ ID NO: 3267705 - RNA, 18 nt, Vaccinia virus
cuagaaaacgaaaacauc

SEQ ID NO: 3267706 - RNA, 15 nt, Vaccinia virus
gauauauuaaacaag

SEQ ID NO: 3267707 - RNA, 21 nt, Vaccinia virus
ugaaucaaauguaacuauuca

SEQ ID NO: 3267708 - RNA, 21 nt, Vaccinia virus
acaauguuugacugaauauau

SEQ ID NO: 3267709 - RNA, 18 nt, Vaccinia virus
acuaacgauaacgugaaa

SEQ ID NO: 3267710 - RNA, 16 nt, Vaccinia virus
cauauaguuaaucuau

SEQ ID NO: 3267711 - RNA, 18 nt, Vaccinia virus
acuauaaauggagaaugu

SEQ ID NO: 3267712 - RNA, 15 nt, Vaccinia virus
cuauguugacaugua

SEQ ID NO: 3267713 - RNA, 13 nt, Vaccinia virus
uccucccauaaua

SEQ ID NO: 3267714 - RNA, 19 nt, Vaccinia virus
gauuauaauccuuauacau

SEQ ID NO: 3267715 - RNA, 19 nt, Vaccinia virus
aauacgaugauauuaaaau

SEQ ID NO: 3267716 - RNA, 15 nt, Vaccinia virus
caauauauauacagu

SEQ ID NO: 3267717 - RNA, 20 nt, Vaccinia virus
uauagcugaggguguuagaa

SEQ ID NO: 3267718 - RNA, 20 nt, Vaccinia virus
aucaauaauauaucuuauau

SEQ ID NO: 3267719 - RNA, 16 nt, Vaccinia virus
caaaaguuaauuucua

SEQ ID NO: 3267720 - RNA, 20 nt, Vaccinia virus
uacaaaggauccgacccuaa

SEQ ID NO: 3267721 - RNA, 22 nt, Vaccinia virus
accuagagacaaugaaaaaguu

SEQ ID NO: 3267722 - RNA, 22 nt, Vaccinia virus
gaaaggagagaauguauucauu

SEQ ID NO: 3267723 - RNA, 22 nt, Vaccinia virus
aucuuuguucuaaaaacuguau

SEQ ID NO: 3267724 - RNA, 13 nt, Vaccinia virus
ucauagaacagac

SEQ ID NO: 3267725 - RNA, 22 nt, Vaccinia virus
cacuauacauuuugaaacuaug

SEQ ID NO: 3267726 - RNA, 22 nt, Vaccinia virus
aucuaauuaguuuuucuuuaca

SEQ ID NO: 3267727 - RNA, 14 nt, Vaccinia virus
cauauuacauaaua

SEQ ID NO: 3267728 - RNA, 19 nt, Vaccinia virus
cgaagaugcuauccaucag

SEQ ID NO: 3267729 - RNA, 16 nt, Vaccinia virus
cugucuggcaauaaau

SEQ ID NO: 3267730 - RNA, 16 nt, Vaccinia virus
uuccuuuaucauuaau

SEQ ID NO: 3267731 - RNA, 22 nt, Vaccinia virus
uauaaaccgcuauugaaacuga

SEQ ID NO: 3267732 - RNA, 17 nt, Vaccinia virus
uuacauaaaugaaaaga

SEQ ID NO: 3267733 - RNA, 21 nt, Vaccinia virus
uuccaaauuuuuuucauugau

SEQ ID NO: 3267734 - RNA, 19 nt, Vaccinia virus
uauuuucaguuuuauuaua

SEQ ID NO: 3267735 - RNA, 16 nt, Vaccinia virus
aucuuuucucaaagau

SEQ ID NO: 3267736 - RNA, 18 nt, Vaccinia virus
gcaaauugucuauaucua

SEQ ID NO: 3267737 - RNA, 13 nt, Vaccinia virus
auucuagcaucga

SEQ ID NO: 3267738 - RNA, 17 nt, Vaccinia virus
aggagccgaaaacauug

SEQ ID NO: 3267739 - RNA, 22 nt, Vaccinia virus
auuccaguaucugaaguacuau

SEQ ID NO: 3267740 - RNA, 20 nt, Vaccinia virus
aauaugugcuaaaaucacug

SEQ ID NO: 3267741 - RNA, 13 nt, Vaccinia virus
aacauuaggaaau

SEQ ID NO: 3267742 - RNA, 23 nt, Vaccinia virus
cugcuggaaaauaaaucacugac

SEQ ID NO: 3267743 - RNA, 15 nt, Vaccinia virus
acauaauauauacag

SEQ ID NO: 3267744 - RNA, 14 nt, Vaccinia virus
agucauaaaaggau

SEQ ID NO: 3267745 - RNA, 16 nt, Vaccinia virus
acaauggaauacuuca

SEQ ID NO: 3267746 - RNA, 22 nt, Vaccinia virus
ugaaaauggacguagaacaaga

SEQ ID NO: 3267747 - RNA, 15 nt, Vaccinia virus
uuacgaaucauuaaa

SEQ ID NO: 3267748 - RNA, 21 nt, Vaccinia virus
guuucauggaacaauaaaaga

SEQ ID NO: 3267749 - RNA, 17 nt, Vaccinia virus
auugaugcaaauagcag

SEQ ID NO: 3267750 - RNA, 23 nt, Vaccinia virus
gauuggucuuaaaagauauuaau

SEQ ID NO: 3267751 - RNA, 18 nt, Vaccinia virus
ugaucacauuuagauaaa

SEQ ID NO: 3267752 - RNA, 19 nt, Vaccinia virus
cgauaugccuccagaaguu

SEQ ID NO: 3267753 - RNA, 22 nt, Vaccinia virus
cuaaaacuacguucgaugaauu

SEQ ID NO: 3267754 - RNA, 20 nt, Vaccinia virus
auauaccgccuuucaaaauu

SEQ ID NO: 3267755 - RNA, 22 nt, Vaccinia virus
aucauaaaaguuguaaaguaaa

SEQ ID NO: 3267756 - RNA, 17 nt, Vaccinia virus
uccgauuguuguguaca

SEQ ID NO: 3267757 - RNA, 19 nt, Vaccinia virus
auugacuaucuuuugaaaa

SEQ ID NO: 3267758 - RNA, 13 nt, Vaccinia virus
uuuacauuauuua

SEQ ID NO: 3267759 - RNA, 14 nt, Vaccinia virus
uagauuaaugcuua

SEQ ID NO: 3267760 - RNA, 17 nt, Vaccinia virus
aucacuaucuuugaaaa

SEQ ID NO: 3267761 - RNA, 23 nt, Vaccinia virus
ugacuuuuugguccauuuuucca

SEQ ID NO: 3267762 - RNA, 20 nt, Vaccinia virus
uguuauacagauguauuaca

SEQ ID NO: 3267763 - RNA, 21 nt, Vaccinia virus
uauaaucguguauaacaucuu

SEQ ID NO: 3267764 - RNA, 20 nt, Vaccinia virus
auuugguaaaucauuaucua

SEQ ID NO: 3267765 - RNA, 21 nt, Vaccinia virus
gcgccuuauauagcacuuuua

SEQ ID NO: 3267766 - RNA, 16 nt, Vaccinia virus
ucuauuauuacagagu

SEQ ID NO: 3267767 - RNA, 22 nt, Vaccinia virus
uauugcguacacaaucaaucau

SEQ ID NO: 3267768 - RNA, 21 nt, Vaccinia virus
aggauaccguuaaauauaacu

SEQ ID NO: 3267769 - RNA, 13 nt, Vaccinia virus
aagaguauuguac

SEQ ID NO: 3267770 - RNA, 16 nt, Vaccinia virus
caauacaacguaaaau

SEQ ID NO: 3267771 - RNA, 15 nt, Vaccinia virus
cauaauauuaaacac

SEQ ID NO: 3267772 - RNA, 13 nt, Vaccinia virus
ucaugaacauaau

SEQ ID NO: 3267773 - RNA, 23 nt, Vaccinia virus
acuucuaaugagcaaguagaaaa

SEQ ID NO: 3267774 - RNA, 14 nt, Vaccinia virus
uaguaguguuuccc

SEQ ID NO: 3267775 - RNA, 18 nt, Vaccinia virus
uucguuuaucuuggaaca

SEQ ID NO: 3267776 - RNA, 22 nt, Vaccinia virus
uuuaucguggaaaauauggaca

SEQ ID NO: 3267777 - RNA, 20 nt, Vaccinia virus
gcgauaaacggaauaauaau

SEQ ID NO: 3267778 - RNA, 20 nt, Vaccinia virus
caccgcaugcaccauccgau

SEQ ID NO: 3267779 - RNA, 13 nt, Vaccinia virus
uuaccagauaucu

SEQ ID NO: 3267780 - RNA, 15 nt, Vaccinia virus
gcguucauuggaaaa

SEQ ID NO: 3267781 - RNA, 16 nt, Vaccinia virus
aaugucaggaaaugua

SEQ ID NO: 3267782 - RNA, 15 nt, Vaccinia virus
ccgucacauacacua

SEQ ID NO: 3267783 - RNA, 23 nt, Vaccinia virus
aucaugauuggguagcaaauauu

SEQ ID NO: 3267784 - RNA, 19 nt, Vaccinia virus
agaucuauuuuaaaguuaa

SEQ ID NO: 3267785 - RNA, 17 nt, Vaccinia virus
acgaucuaauacaaaau

SEQ ID NO: 3267786 - RNA, 23 nt, Vaccinia virus
uuuugaagacgaugauucgucua

SEQ ID NO: 3267787 - RNA, 20 nt, Vaccinia virus
cuggugauuggguagaagua

SEQ ID NO: 3267788 - RNA, 13 nt, Vaccinia virus
uucuuguuauaua

SEQ ID NO: 3267789 - RNA, 20 nt, Vaccinia virus
aauucuucaauaaaaugaga

SEQ ID NO: 3267790 - RNA, 18 nt, Vaccinia virus
uauuuuuuuauacuucua

SEQ ID NO: 3267791 - RNA, 15 nt, Vaccinia virus
auaucuaauuucugu

SEQ ID NO: 3267792 - RNA, 21 nt, Vaccinia virus
caaguaugaagaaaaauguug

SEQ ID NO: 3267793 - RNA, 18 nt, Vaccinia virus
acaaauggauguuaaugu

SEQ ID NO: 3267794 - RNA, 20 nt, Vaccinia virus
auuuguauagauaauuacga

SEQ ID NO: 3267795 - RNA, 22 nt, Vaccinia virus
aucacaacaucguuuuugauau

SEQ ID NO: 3267796 - RNA, 17 nt, Vaccinia virus
uccgagucagauccaga

SEQ ID NO: 3267797 - RNA, 17 nt, Vaccinia virus
guaacuguaaauuucuc

SEQ ID NO: 3267798 - RNA, 19 nt, Vaccinia virus
cuagaauuagaauuacaaa

SEQ ID NO: 3267799 - RNA, 16 nt, Vaccinia virus
acagcuggagauuauc

SEQ ID NO: 3267800 - RNA, 17 nt, Vaccinia virus
aacaagaucuuugauau

SEQ ID NO: 3267801 - RNA, 14 nt, Vaccinia virus
uguugaaaaugaaa

SEQ ID NO: 3267802 - RNA, 21 nt, Vaccinia virus
auuaucuuuuuagacacguau

SEQ ID NO: 3267803 - RNA, 18 nt, Vaccinia virus
uuguauccauacuguaug

SEQ ID NO: 3267804 - RNA, 21 nt, Vaccinia virus
uaagacuuuacuuuucuaaau

SEQ ID NO: 3267805 - RNA, 16 nt, Vaccinia virus
uuccaaaaacauauga

SEQ ID NO: 3267806 - RNA, 20 nt, Vaccinia virus
uacaagcucgguuuuaacuu

SEQ ID NO: 3267807 - RNA, 15 nt, Vaccinia virus
acaacgaauguguac

SEQ ID NO: 3267808 - RNA, 16 nt, Vaccinia virus
ccuuaccaugcaauaa

SEQ ID NO: 3267809 - RNA, 22 nt, Vaccinia virus
acauugauuaaauuuuaauaua

SEQ ID NO: 3267810 - RNA, 14 nt, Vaccinia virus
gaauuugauacugu

SEQ ID NO: 3267811 - RNA, 22 nt, Vaccinia virus
cuaauguauuaguuaaauauua

SEQ ID NO: 3267812 - RNA, 23 nt, Vaccinia virus
uacuaccugcuguuguuuauuca

SEQ ID NO: 3267813 - RNA, 18 nt, Vaccinia virus
ggaaauuuaugaagaugu

SEQ ID NO: 3267814 - RNA, 15 nt, Vaccinia virus
uuuuccaaaguuuua

SEQ ID NO: 3267815 - RNA, 15 nt, Vaccinia virus
gacgauaauaauuua

SEQ ID NO: 3267816 - RNA, 19 nt, Vaccinia virus
uguaucaaacaguuuggua

SEQ ID NO: 3267817 - RNA, 14 nt, Vaccinia virus
auacacaaaaagaa

SEQ ID NO: 3267818 - RNA, 13 nt, Vaccinia virus
aacaucaaacaug

SEQ ID NO: 3267819 - RNA, 19 nt, Vaccinia virus
cgauucuauauauacucuu

SEQ ID NO: 3267820 - RNA, 18 nt, Vaccinia virus
acuauauguuccaguaau

SEQ ID NO: 3267821 - RNA, 16 nt, Vaccinia virus
ccaucugguuuaauau

SEQ ID NO: 3267822 - RNA, 15 nt, Vaccinia virus
guaugcaauauauca

SEQ ID NO: 3267823 - RNA, 19 nt, Vaccinia virus
gaacauagaacuaguucuc

SEQ ID NO: 3267824 - RNA, 22 nt, Vaccinia virus
aguauuucuguguauuaauaga

SEQ ID NO: 3267825 - RNA, 15 nt, Vaccinia virus
acuuggggagaauga

SEQ ID NO: 3267826 - RNA, 23 nt, Vaccinia virus
ugacgaugaaaaugaugguacau

SEQ ID NO: 3267827 - RNA, 16 nt, Vaccinia virus
gcuacucguuuggaau

SEQ ID NO: 3267828 - RNA, 16 nt, Vaccinia virus
cuacaaaagaaucugu

SEQ ID NO: 3267829 - RNA, 20 nt, Vaccinia virus
uagauacauuggccguaaua

SEQ ID NO: 3267830 - RNA, 14 nt, Vaccinia virus
aaaacaaugaacua

SEQ ID NO: 3267831 - RNA, 16 nt, Vaccinia virus
uggaauuaguuagaua

SEQ ID NO: 3267832 - RNA, 14 nt, Vaccinia virus
ucaaucuuauucaa

SEQ ID NO: 3267833 - RNA, 22 nt, Vaccinia virus
augaucucgauauuucaaucau

SEQ ID NO: 3267834 - RNA, 15 nt, Vaccinia virus
agauagaaaugaauu

SEQ ID NO: 3267835 - RNA, 14 nt, Vaccinia virus
caauguuagaguau

SEQ ID NO: 3267836 - RNA, 19 nt, Vaccinia virus
aaauacguucuauugugua

SEQ ID NO: 3267837 - RNA, 16 nt, Vaccinia virus
aauuccauauauuugu

SEQ ID NO: 3267838 - RNA, 18 nt, Vaccinia virus
auaugccuccagaaguug

SEQ ID NO: 3267839 - RNA, 22 nt, Vaccinia virus
auuuagauuaaauccagaaguu

SEQ ID NO: 3267840 - RNA, 14 nt, Vaccinia virus
ucuguuugaagaaa

SEQ ID NO: 3267841 - RNA, 17 nt, Vaccinia virus
gugauuauuuuuuggua

SEQ ID NO: 3267842 - RNA, 14 nt, Vaccinia virus
uuguacagaaauca

SEQ ID NO: 3267843 - RNA, 12 nt, Vaccinia virus
guacauaauaga

SEQ ID NO: 3267844 - RNA, 15 nt, Vaccinia virus
auuaugaaacaauau

SEQ ID NO: 3267845 - RNA, 15 nt, Vaccinia virus
uuaagaaaauuauua

SEQ ID NO: 3267846 - RNA, 20 nt, Vaccinia virus
aauucacuguauaaaaagaa

SEQ ID NO: 3267847 - RNA, 19 nt, Vaccinia virus
cugaucuuaacuccucuau

SEQ ID NO: 3267848 - RNA, 22 nt, Vaccinia virus
augugcuaaaaucacugaacau

SEQ ID NO: 3267849 - RNA, 22 nt, Vaccinia virus
uggggaaauauggaagaaaguu

SEQ ID NO: 3267850 - RNA, 15 nt, Vaccinia virus
caugguggcauuuug

SEQ ID NO: 3267851 - RNA, 17 nt, Vaccinia virus
aucaacauuguuucaaa

SEQ ID NO: 3267852 - RNA, 16 nt, Vaccinia virus
ugaauucucauuuugc

SEQ ID NO: 3267853 - RNA, 15 nt, Vaccinia virus
gugucgauucaucaa

SEQ ID NO: 3267854 - RNA, 20 nt, Vaccinia virus
uuauguugccuaaacaagau

SEQ ID NO: 3267855 - RNA, 14 nt, Vaccinia virus
uucuuuuuauucuc

SEQ ID NO: 3267856 - RNA, 22 nt, Vaccinia virus
acuacaguaguaauuaaugaaa

SEQ ID NO: 3267857 - RNA, 15 nt, Vaccinia virus
uuggaugaaccauug

SEQ ID NO: 3267858 - RNA, 20 nt, Vaccinia virus
aaucaccgcaagaacacacg

SEQ ID NO: 3267859 - RNA, 16 nt, Vaccinia virus
aaucacuauagaaaau

SEQ ID NO: 3267860 - RNA, 16 nt, Vaccinia virus
aaagcaauuauuacaa

SEQ ID NO: 3267861 - RNA, 16 nt, Vaccinia virus
uuaaaugccuuauucu

SEQ ID NO: 3267862 - RNA, 18 nt, Vaccinia virus
acaucaugaaaugaugau

SEQ ID NO: 3267863 - RNA, 15 nt, Vaccinia virus
uacuacuauuauuga

SEQ ID NO: 3267864 - RNA, 15 nt, Vaccinia virus
auacggaauaaacau

SEQ ID NO: 3267865 - RNA, 18 nt, Vaccinia virus
auuuuaccucuucugaua

SEQ ID NO: 3267866 - RNA, 20 nt, Vaccinia virus
uaagcaaguacauggaugau

SEQ ID NO: 3267867 - RNA, 21 nt, Vaccinia virus
gacuuacgucugcuaaaauac

SEQ ID NO: 3267868 - RNA, 16 nt, Vaccinia virus
caaucucuauaucuau

SEQ ID NO: 3267869 - RNA, 14 nt, Vaccinia virus
uuauagaauuuaga

SEQ ID NO: 3267870 - RNA, 18 nt, Vaccinia virus
acacgggauaaauuauuu

SEQ ID NO: 3267871 - RNA, 21 nt, Vaccinia virus
uuauaaccuuuuccuuaucuu

SEQ ID NO: 3267872 - RNA, 21 nt, Vaccinia virus
ucuuauaauuguaacauccuu

SEQ ID NO: 3267873 - RNA, 22 nt, Vaccinia virus
aauuaucguuccugguauauag

SEQ ID NO: 3267874 - RNA, 16 nt, Vaccinia virus
uuaucaucuaaucauc

SEQ ID NO: 3267875 - RNA, 22 nt, Vaccinia virus
gaacguaguaguaaguauuuau

SEQ ID NO: 3267876 - RNA, 21 nt, Vaccinia virus
aagugacauuauaauuuuacc

SEQ ID NO: 3267877 - RNA, 18 nt, Vaccinia virus
cauggccgaugaauggau

SEQ ID NO: 3267878 - RNA, 22 nt, Vaccinia virus
gaaauguccguuauauaaucua

SEQ ID NO: 3267879 - RNA, 17 nt, Vaccinia virus
auaguucuuaacaucua

SEQ ID NO: 3267880 - RNA, 13 nt, Vaccinia virus
gucuuucacuaau

SEQ ID NO: 3267881 - RNA, 18 nt, Vaccinia virus
aauagauguuaguacagu

SEQ ID NO: 3267882 - RNA, 20 nt, Vaccinia virus
uaacaugcauuugaaaagau

SEQ ID NO: 3267883 - RNA, 23 nt, Vaccinia virus
cuagauaaaaaggaaucuauuaa

SEQ ID NO: 3267884 - RNA, 22 nt, Vaccinia virus
gcaugcgacuaugauaucaugu

SEQ ID NO: 3267885 - RNA, 19 nt, Vaccinia virus
auacauuauuacuaaacau

SEQ ID NO: 3267886 - RNA, 23 nt, Vaccinia virus
aaaaugcccaacaggaucauuug

SEQ ID NO: 3267887 - RNA, 19 nt, Vaccinia virus
ccccaggaucuccaacaaa

SEQ ID NO: 3267888 - RNA, 16 nt, Vaccinia virus
auuucuucauaugaug

SEQ ID NO: 3267889 - RNA, 22 nt, Vaccinia virus
auauauuuuucauaaauacacu

SEQ ID NO: 3267890 - RNA, 19 nt, Vaccinia virus
agcaauagugauagauuuu

SEQ ID NO: 3267891 - RNA, 17 nt, Vaccinia virus
agaaugcauccaaugag

SEQ ID NO: 3267892 - RNA, 16 nt, Vaccinia virus
aauuauguagaugaua

SEQ ID NO: 3267893 - RNA, 13 nt, Vaccinia virus
guaccaucuuauu

SEQ ID NO: 3267894 - RNA, 17 nt, Vaccinia virus
auacuuuuaggaaauca

SEQ ID NO: 3267895 - RNA, 16 nt, Vaccinia virus
aauggauaauuuaaga

SEQ ID NO: 3267896 - RNA, 20 nt, Vaccinia virus
aaguauuugaacauguagau

SEQ ID NO: 3267897 - RNA, 14 nt, Vaccinia virus
aucuauguagaauc

SEQ ID NO: 3267898 - RNA, 15 nt, Vaccinia virus
uucaauaaaugauuc

SEQ ID NO: 3267899 - RNA, 14 nt, Vaccinia virus
aaaauauaaugaua

SEQ ID NO: 3267900 - RNA, 22 nt, Vaccinia virus
aucgaugaauaauacauuuaaa

SEQ ID NO: 3267901 - RNA, 22 nt, Vaccinia virus
auagagaauccuccgaauaauu

SEQ ID NO: 3267902 - RNA, 22 nt, Vaccinia virus
cagauugcauggugauuugucu

SEQ ID NO: 3267903 - RNA, 17 nt, Vaccinia virus
aucgaaaucuuaaauac

SEQ ID NO: 3267904 - RNA, 18 nt, Vaccinia virus
agcuuaaacagaugagac

SEQ ID NO: 3267905 - RNA, 19 nt, Vaccinia virus
auuacuaaaucuguauauc

SEQ ID NO: 3267906 - RNA, 13 nt, Vaccinia virus
cguauauauuguu

SEQ ID NO: 3267907 - RNA, 21 nt, Vaccinia virus
aauucgaggaagauguaaaga

SEQ ID NO: 3267908 - RNA, 17 nt, Vaccinia virus
guuaauaaguaaaugaa

SEQ ID NO: 3267909 - RNA, 13 nt, Vaccinia virus
uaggauuaacaua

SEQ ID NO: 3267910 - RNA, 23 nt, Vaccinia virus
auuaaggagauagcuucaucuau

SEQ ID NO: 3267911 - RNA, 20 nt, Vaccinia virus
aaguagaucaucugaaaauc

SEQ ID NO: 3267912 - RNA, 11 nt, Vaccinia virus
auuucauguac

SEQ ID NO: 3267913 - RNA, 18 nt, Vaccinia virus
cccaagcagcauccccgu

SEQ ID NO: 3267914 - RNA, 15 nt, Vaccinia virus
gugcaaggaaucauc

SEQ ID NO: 3267915 - RNA, 16 nt, Vaccinia virus
aaaguuaaucauauag

SEQ ID NO: 3267916 - RNA, 15 nt, Vaccinia virus
gacaugcaaaaaugc

SEQ ID NO: 3267917 - RNA, 13 nt, Vaccinia virus
aucacaaugacuu

SEQ ID NO: 3267918 - RNA, 19 nt, Vaccinia virus
cgauuuguuuaauuuuuag

SEQ ID NO: 3267919 - RNA, 21 nt, Vaccinia virus
augaaaacuuuaaauacuuaa

SEQ ID NO: 3267920 - RNA, 18 nt, Vaccinia virus
uucuaaaaaaauauuaac

SEQ ID NO: 3267921 - RNA, 19 nt, Vaccinia virus
ugguauuagaaucaaggau

SEQ ID NO: 3267922 - RNA, 22 nt, Vaccinia virus
aauuguuuuuguacauaauaga

SEQ ID NO: 3267923 - RNA, 21 nt, Vaccinia virus
ccguguucguuugaaugccac

SEQ ID NO: 3267924 - RNA, 17 nt, Vaccinia virus
auucgaaauuagaaagu

SEQ ID NO: 3267925 - RNA, 18 nt, Vaccinia virus
aagucauaucuagaauga

SEQ ID NO: 3267926 - RNA, 14 nt, Vaccinia virus
auugaucauuuaac

SEQ ID NO: 3267927 - RNA, 18 nt, Vaccinia virus
acggagccccaggaucuc

SEQ ID NO: 3267928 - RNA, 14 nt, Vaccinia virus
aacacauuaaacaa

SEQ ID NO: 3267929 - RNA, 12 nt, Vaccinia virus
aaucaucacugu

SEQ ID NO: 3267930 - RNA, 17 nt, Vaccinia virus
ucucucagguacagauu

SEQ ID NO: 3267931 - RNA, 22 nt, Vaccinia virus
auuaguucccaauggaucaaug

SEQ ID NO: 3267932 - RNA, 18 nt, Vaccinia virus
ucuguauuucauuguaaa

SEQ ID NO: 3267933 - RNA, 14 nt, Vaccinia virus
cgugguuguuuauc

SEQ ID NO: 3267934 - RNA, 18 nt, Vaccinia virus
aguauaaaacauuaaaug

SEQ ID NO: 3267935 - RNA, 14 nt, Vaccinia virus
auuauuaugaugau

SEQ ID NO: 3267936 - RNA, 18 nt, Vaccinia virus
uaguauuuauacuacuaa

SEQ ID NO: 3267937 - RNA, 16 nt, Vaccinia virus
cuauggccaaauguuc

SEQ ID NO: 3267938 - RNA, 17 nt, Vaccinia virus
aauggauuaucggaaau

SEQ ID NO: 3267939 - RNA, 20 nt, Vaccinia virus
cuaaauaauggcuguuugua

SEQ ID NO: 3267940 - RNA, 17 nt, Vaccinia virus
aauauccucagucaucu

SEQ ID NO: 3267941 - RNA, 23 nt, Vaccinia virus
caaccauuaacggaugaaaauaa

SEQ ID NO: 3267942 - RNA, 22 nt, Vaccinia virus
auauugauaauauuuuaauaga

SEQ ID NO: 3267943 - RNA, 20 nt, Vaccinia virus
caauacauuuuucuauguua

SEQ ID NO: 3267944 - RNA, 21 nt, Vaccinia virus
uacuagccuacugccuauuaa

SEQ ID NO: 3267945 - RNA, 15 nt, Vaccinia virus
gcggcuauagaaaag

SEQ ID NO: 3267946 - RNA, 18 nt, Vaccinia virus
aggcggauguugugaaug

SEQ ID NO: 3267947 - RNA, 19 nt, Vaccinia virus
uuacucauuuuuuauaaaa

SEQ ID NO: 3267948 - RNA, 17 nt, Vaccinia virus
gauacuauuuauuucua

SEQ ID NO: 3267949 - RNA, 20 nt, Vaccinia virus
auauacgaagaacaaugucc

SEQ ID NO: 3267950 - RNA, 14 nt, Vaccinia virus
uaaaaauuauguuu

SEQ ID NO: 3267951 - RNA, 16 nt, Vaccinia virus
accaaauuaaugaaua

SEQ ID NO: 3267952 - RNA, 20 nt, Vaccinia virus
agucugugguggaugauguc

SEQ ID NO: 3267953 - RNA, 16 nt, Vaccinia virus
cuuaauagacaaacug

SEQ ID NO: 3267954 - RNA, 13 nt, Vaccinia virus
uggcaaauuauuu

SEQ ID NO: 3267955 - RNA, 11 nt, Vaccinia virus
ugauugaagaa

SEQ ID NO: 3267956 - RNA, 23 nt, Vaccinia virus
cguauaaaaaucgauaaacugcg

SEQ ID NO: 3267957 - RNA, 15 nt, Vaccinia virus
caauaaaaaaaauug

SEQ ID NO: 3267958 - RNA, 17 nt, Vaccinia virus
uaacuggaucuuuauuu

SEQ ID NO: 3267959 - RNA, 15 nt, Vaccinia virus
cacaauguaugaaca

SEQ ID NO: 3267960 - RNA, 20 nt, Vaccinia virus
uucuuacauauuuuuuucuu

SEQ ID NO: 3267961 - RNA, 20 nt, Vaccinia virus
gguuaauguuguauuucauu

SEQ ID NO: 3267962 - RNA, 21 nt, Vaccinia virus
auggucauguuuauuucuagu

SEQ ID NO: 3267963 - RNA, 15 nt, Vaccinia virus
caaugagauaaauau

SEQ ID NO: 3267964 - RNA, 20 nt, Vaccinia virus
uacuaguggauguacaugua

SEQ ID NO: 3267965 - RNA, 22 nt, Vaccinia virus
auaauuguuuaagacugucaau

SEQ ID NO: 3267966 - RNA, 14 nt, Vaccinia virus
augcaaaaaugcua

SEQ ID NO: 3267967 - RNA, 14 nt, Vaccinia virus
aaaguaaaaaagaa

SEQ ID NO: 3267968 - RNA, 14 nt, Vaccinia virus
auguaaaaauguua

SEQ ID NO: 3267969 - RNA, 15 nt, Vaccinia virus
cuuaaauauuucuac

SEQ ID NO: 3267970 - RNA, 20 nt, Vaccinia virus
auaauagguggaacguauau

SEQ ID NO: 3267971 - RNA, 14 nt, Vaccinia virus
aauuuauuaaauac

SEQ ID NO: 3267972 - RNA, 14 nt, Vaccinia virus
acagauaaauggaa

SEQ ID NO: 3267973 - RNA, 15 nt, Vaccinia virus
uacuuugacaaaugu

SEQ ID NO: 3267974 - RNA, 15 nt, Vaccinia virus
uaucaauuauaugug

SEQ ID NO: 3267975 - RNA, 23 nt, Vaccinia virus
uaacaucuggccuguucauaaau

SEQ ID NO: 3267976 - RNA, 15 nt, Vaccinia virus
auaccguuaaauaua

SEQ ID NO: 3267977 - RNA, 19 nt, Vaccinia virus
uuacagaauuuguauccuu

SEQ ID NO: 3267978 - RNA, 16 nt, Vaccinia virus
agauaaucaaaauugu

SEQ ID NO: 3267979 - RNA, 23 nt, Vaccinia virus
auggauuuuuuuaaaaaggaaau

SEQ ID NO: 3267980 - RNA, 13 nt, Vaccinia virus
cguauauuucuau

SEQ ID NO: 3267981 - RNA, 17 nt, Vaccinia virus
uuugagguaaucuucuu

SEQ ID NO: 3267982 - RNA, 18 nt, Vaccinia virus
cgucucagaauucuaaau

SEQ ID NO: 3267983 - RNA, 21 nt, Vaccinia virus
uauuauguuaacggaaaguau

SEQ ID NO: 3267984 - RNA, 18 nt, Vaccinia virus
auaaaaacauuaacaaga

SEQ ID NO: 3267985 - RNA, 17 nt, Vaccinia virus
gauuugguaguauuuau

SEQ ID NO: 3267986 - RNA, 17 nt, Vaccinia virus
uuuguacgucacaucuu

SEQ ID NO: 3267987 - RNA, 19 nt, Vaccinia virus
uacugauaacaaaauauua

SEQ ID NO: 3267988 - RNA, 12 nt, Vaccinia virus
uuguucucuuag

SEQ ID NO: 3267989 - RNA, 22 nt, Vaccinia virus
aacaaaugcgccaaaguuauau

SEQ ID NO: 3267990 - RNA, 23 nt, Vaccinia virus
auauagauggcuuguaugucaaa

SEQ ID NO: 3267991 - RNA, 13 nt, Vaccinia virus
acugauuagaaau

SEQ ID NO: 3267992 - RNA, 21 nt, Vaccinia virus
guuuucccauagaacaucagu

SEQ ID NO: 3267993 - RNA, 17 nt, Vaccinia virus
ccuuaaauguaucuuua

SEQ ID NO: 3267994 - RNA, 18 nt, Vaccinia virus
cucaauaaaaaaauuaau

SEQ ID NO: 3267995 - RNA, 13 nt, Vaccinia virus
gucccuaauaacu

SEQ ID NO: 3267996 - RNA, 18 nt, Vaccinia virus
uuagacggcaacauagaa

SEQ ID NO: 3267997 - RNA, 20 nt, Vaccinia virus
uaucauuauaacucuagaau

SEQ ID NO: 3267998 - RNA, 17 nt, Vaccinia virus
agaucaacagaaauauu

SEQ ID NO: 3267999 - RNA, 16 nt, Vaccinia virus
acaccagcuuuuauca

SEQ ID NO: 3268000 - RNA, 13 nt, Vaccinia virus
uggaaucaauaau

SEQ ID NO: 3268001 - RNA, 17 nt, Vaccinia virus
caugauuccguauucug

SEQ ID NO: 3268002 - RNA, 15 nt, Vaccinia virus
cuauuuuaucauuuu

SEQ ID NO: 3268003 - RNA, 16 nt, Vaccinia virus
uaucugguucuaaaag

SEQ ID NO: 3268004 - RNA, 13 nt, Vaccinia virus
acuguucaggaau

SEQ ID NO: 3268005 - RNA, 18 nt, Vaccinia virus
uuaauauugcacaaagaa

SEQ ID NO: 3268006 - RNA, 12 nt, Vaccinia virus
uucauuccuaua

SEQ ID NO: 3268007 - RNA, 22 nt, Vaccinia virus
caaacauacaucuauaaauuug

SEQ ID NO: 3268008 - RNA, 21 nt, Vaccinia virus
uauuauuagauaaauuuauca

SEQ ID NO: 3268009 - RNA, 13 nt, Vaccinia virus
aauaauuuaucau

SEQ ID NO: 3268010 - RNA, 12 nt, Vaccinia virus
cuauuguuuauu

SEQ ID NO: 3268011 - RNA, 22 nt, Vaccinia virus
ucaauucguucgaugaguauau

SEQ ID NO: 3268012 - RNA, 20 nt, Vaccinia virus
aaaaauuuaaagaauguaua

SEQ ID NO: 3268013 - RNA, 21 nt, Vaccinia virus
uaacuauuuuuuauuacuuua

SEQ ID NO: 3268014 - RNA, 21 nt, Vaccinia virus
acccaaguuugagauuucaua

SEQ ID NO: 3268015 - RNA, 16 nt, Vaccinia virus
caaaaagauauaaaau

SEQ ID NO: 3268016 - RNA, 22 nt, Vaccinia virus
uggaaaagaauuuaccagauau

SEQ ID NO: 3268017 - RNA, 22 nt, Vaccinia virus
auggagucccagaccagaaaug

SEQ ID NO: 3268018 - RNA, 18 nt, Vaccinia virus
auuacucuccuagguuuc

SEQ ID NO: 3268019 - RNA, 16 nt, Vaccinia virus
accagccuacauuuug

SEQ ID NO: 3268020 - RNA, 17 nt, Vaccinia virus
gcuauguuaucaugaaa

SEQ ID NO: 3268021 - RNA, 13 nt, Vaccinia virus
uguuuccauccau

SEQ ID NO: 3268022 - RNA, 14 nt, Vaccinia virus
auaguaaaauauua

SEQ ID NO: 3268023 - RNA, 17 nt, Vaccinia virus
agacuacgaaacugaua

SEQ ID NO: 3268024 - RNA, 18 nt, Vaccinia virus
gguaaauguuuuuaucau

SEQ ID NO: 3268025 - RNA, 13 nt, Vaccinia virus
uaacuaaauguca

SEQ ID NO: 3268026 - RNA, 16 nt, Vaccinia virus
uaagauaguauauucu

SEQ ID NO: 3268027 - RNA, 14 nt, Vaccinia virus
aaauuguuaaauua

SEQ ID NO: 3268028 - RNA, 19 nt, Vaccinia virus
guaucuuaguauugaaaug

SEQ ID NO: 3268029 - RNA, 22 nt, Vaccinia virus
gcauccuucuaagauuauuuua

SEQ ID NO: 3268030 - RNA, 22 nt, Vaccinia virus
uucugacgucguucuacauaaa

SEQ ID NO: 3268031 - RNA, 20 nt, Vaccinia virus
cgaggaugaacucacuucuc

SEQ ID NO: 3268032 - RNA, 20 nt, Vaccinia virus
aaauugguauaaauguugua

SEQ ID NO: 3268033 - RNA, 16 nt, Vaccinia virus
gaaauaggaauaauua

SEQ ID NO: 3268034 - RNA, 15 nt, Vaccinia virus
auauuaaaauagcua

SEQ ID NO: 3268035 - RNA, 12 nt, Vaccinia virus
cuaauucuuucu

SEQ ID NO: 3268036 - RNA, 12 nt, Vaccinia virus
gcgaauauuaaa

SEQ ID NO: 3268037 - RNA, 18 nt, Vaccinia virus
uugaucaucguaauuaau

SEQ ID NO: 3268038 - RNA, 14 nt, Vaccinia virus
ccaguauucucgga

SEQ ID NO: 3268039 - RNA, 16 nt, Vaccinia virus
uaaauuuuuaacgauu

SEQ ID NO: 3268040 - RNA, 17 nt, Vaccinia virus
guuuauguacuaugcca

SEQ ID NO: 3268041 - RNA, 23 nt, Vaccinia virus
auuaucguuccugguauauagau

SEQ ID NO: 3268042 - RNA, 14 nt, Vaccinia virus
aggucuaugucucu

SEQ ID NO: 3268043 - RNA, 15 nt, Vaccinia virus
caaaacuauuucaga

SEQ ID NO: 3268044 - RNA, 18 nt, Vaccinia virus
auaauaucucuaauagau

SEQ ID NO: 3268045 - RNA, 20 nt, Vaccinia virus
auacagcuggagauuaucau

SEQ ID NO: 3268046 - RNA, 16 nt, Vaccinia virus
aguuucuauacugucu

SEQ ID NO: 3268047 - RNA, 18 nt, Vaccinia virus
caaaaggacguagacaau

SEQ ID NO: 3268048 - RNA, 16 nt, Vaccinia virus
acucuauucuucaaga

SEQ ID NO: 3268049 - RNA, 15 nt, Vaccinia virus
caaauggauaauuua

SEQ ID NO: 3268050 - RNA, 17 nt, Vaccinia virus
auuagaauagucucuuu

SEQ ID NO: 3268051 - RNA, 15 nt, Vaccinia virus
acugauucagaaaug

SEQ ID NO: 3268052 - RNA, 14 nt, Vaccinia virus
acguuuacguguau

SEQ ID NO: 3268053 - RNA, 18 nt, Vaccinia virus
cagaugccagauuacaaa

SEQ ID NO: 3268054 - RNA, 14 nt, Vaccinia virus
guguccauuuuuua

SEQ ID NO: 3268055 - RNA, 17 nt, Vaccinia virus
accggagauauagcuuc

SEQ ID NO: 3268056 - RNA, 14 nt, Vaccinia virus
aaaugguguaacuc

SEQ ID NO: 3268057 - RNA, 15 nt, Vaccinia virus
aauccaaacaucacu

SEQ ID NO: 3268058 - RNA, 13 nt, Vaccinia virus
uauuaaauaucug

SEQ ID NO: 3268059 - RNA, 16 nt, Vaccinia virus
gucuuacacauucgcu

SEQ ID NO: 3268060 - RNA, 13 nt, Vaccinia virus
aucaaggauuaua

SEQ ID NO: 3268061 - RNA, 15 nt, Vaccinia virus
agauacgucuauaca

SEQ ID NO: 3268062 - RNA, 11 nt, Vaccinia virus
ucgauacuuuu

SEQ ID NO: 3268063 - RNA, 21 nt, Vaccinia virus
gaugacaauauuauuaugaag

SEQ ID NO: 3268064 - RNA, 23 nt, Vaccinia virus
guacccuggauacgaaauaaauu

SEQ ID NO: 3268065 - RNA, 14 nt, Vaccinia virus
acuaaucaauaauc

SEQ ID NO: 3268066 - RNA, 16 nt, Vaccinia virus
agauguguauaauucu

SEQ ID NO: 3268067 - RNA, 16 nt, Vaccinia virus
aaacagaugguagaac

SEQ ID NO: 3268068 - RNA, 14 nt, Vaccinia virus
acaauaaaaauagu

SEQ ID NO: 3268069 - RNA, 16 nt, Vaccinia virus
cuaccgaauaaaguug

SEQ ID NO: 3268070 - RNA, 14 nt, Vaccinia virus
aauaugauagaaau

SEQ ID NO: 3268071 - RNA, 21 nt, Vaccinia virus
gcaucuuauuagaauauuaac

SEQ ID NO: 3268072 - RNA, 13 nt, Vaccinia virus
ugggugauggaua

SEQ ID NO: 3268073 - RNA, 13 nt, Vaccinia virus
acuaccuuaauaa

SEQ ID NO: 3268074 - RNA, 14 nt, Vaccinia virus
uugucauuaucuac

SEQ ID NO: 3268075 - RNA, 16 nt, Vaccinia virus
ugacuggaguguauau

SEQ ID NO: 3268076 - RNA, 15 nt, Vaccinia virus
caucgauaguauaau

SEQ ID NO: 3268077 - RNA, 16 nt, Vaccinia virus
aguaugaauaaucuuc

SEQ ID NO: 3268078 - RNA, 18 nt, Vaccinia virus
auaucauugucuaauaga

SEQ ID NO: 3268079 - RNA, 16 nt, Vaccinia virus
agaugacgaugauaug

SEQ ID NO: 3268080 - RNA, 13 nt, Vaccinia virus
uaaagauauuucu

SEQ ID NO: 3268081 - RNA, 19 nt, Vaccinia virus
uaaauauagguuacuagau

SEQ ID NO: 3268082 - RNA, 16 nt, Vaccinia virus
agggauuuuauaugau

SEQ ID NO: 3268083 - RNA, 21 nt, Vaccinia virus
cauggaaaagauaaaguuuua

SEQ ID NO: 3268084 - RNA, 14 nt, Vaccinia virus
aauauuuuuccauu

SEQ ID NO: 3268085 - RNA, 13 nt, Vaccinia virus
ccuagcuuuguua

SEQ ID NO: 3268086 - RNA, 15 nt, Vaccinia virus
acugcgaucugaaua

SEQ ID NO: 3268087 - RNA, 14 nt, Vaccinia virus
auguaaucauauaa

SEQ ID NO: 3268088 - RNA, 22 nt, Vaccinia virus
gacgauauuagaugauaauuua

SEQ ID NO: 3268089 - RNA, 12 nt, Vaccinia virus
guauugauaaau

SEQ ID NO: 3268090 - RNA, 22 nt, Vaccinia virus
aaguacuguucaaacaugauga

SEQ ID NO: 3268091 - RNA, 19 nt, Vaccinia virus
uaugaacuuucaaggacuu

SEQ ID NO: 3268092 - RNA, 16 nt, Vaccinia virus
gcauuucuaauacaug

SEQ ID NO: 3268093 - RNA, 23 nt, Vaccinia virus
aaauuaacagauaaaaagacuuu

SEQ ID NO: 3268094 - RNA, 22 nt, Vaccinia virus
accggacgacauauuaaucuuu

SEQ ID NO: 3268095 - RNA, 15 nt, Vaccinia virus
uaacuuggaaaagau

SEQ ID NO: 3268096 - RNA, 18 nt, Vaccinia virus
aggaaauuaugagaauga

SEQ ID NO: 3268097 - RNA, 18 nt, Vaccinia virus
ugaaacuaagucuagaau

SEQ ID NO: 3268098 - RNA, 17 nt, Vaccinia virus
uaaaaauaguauuauca

SEQ ID NO: 3268099 - RNA, 12 nt, Vaccinia virus
gauauuaguaca

SEQ ID NO: 3268100 - RNA, 11 nt, Vaccinia virus
cguuagaugua

SEQ ID NO: 3268101 - RNA, 16 nt, Vaccinia virus
ugauagagguaaacuu

SEQ ID NO: 3268102 - RNA, 20 nt, Vaccinia virus
cggggaucguguucuacaua

SEQ ID NO: 3268103 - RNA, 22 nt, Vaccinia virus
cucaaagagaauuauauauuua

SEQ ID NO: 3268104 - RNA, 23 nt, Vaccinia virus
uagcuuuguuagacuagauacua

SEQ ID NO: 3268105 - RNA, 18 nt, Vaccinia virus
aggaucuagcaaaggaaa

SEQ ID NO: 3268106 - RNA, 22 nt, Vaccinia virus
auacacauuuucaaauaauaaa

SEQ ID NO: 3268107 - RNA, 19 nt, Vaccinia virus
aauaugaguuggaguugau

SEQ ID NO: 3268108 - RNA, 17 nt, Vaccinia virus
gauacuaguaugauggu

SEQ ID NO: 3268109 - RNA, 14 nt, Vaccinia virus
agauaucuucucaa

SEQ ID NO: 3268110 - RNA, 19 nt, Vaccinia virus
uauaacguuaugaaacgaa

SEQ ID NO: 3268111 - RNA, 17 nt, Vaccinia virus
ugacgcaguaacauaua

SEQ ID NO: 3268112 - RNA, 17 nt, Vaccinia virus
uaauccaucaacaaugu

SEQ ID NO: 3268113 - RNA, 22 nt, Vaccinia virus
agaucugauaauauuaaaaagu

SEQ ID NO: 3268114 - RNA, 14 nt, Vaccinia virus
ccuuguuauccauu

SEQ ID NO: 3268115 - RNA, 20 nt, Vaccinia virus
cucuauuauagcuucuggac

SEQ ID NO: 3268116 - RNA, 14 nt, Vaccinia virus
ucgacaguguauac

SEQ ID NO: 3268117 - RNA, 13 nt, Vaccinia virus
uaguagauacaua

SEQ ID NO: 3268118 - RNA, 18 nt, Vaccinia virus
ugacaucuaguauugaua

SEQ ID NO: 3268119 - RNA, 11 nt, Vaccinia virus
uauauauacag

SEQ ID NO: 3268120 - RNA, 19 nt, Vaccinia virus
uuucaaagcaauuguauua

SEQ ID NO: 3268121 - RNA, 22 nt, Vaccinia virus
accaacguuaguaaucauauaa

SEQ ID NO: 3268122 - RNA, 16 nt, Vaccinia virus
aucccuacauauuuua

SEQ ID NO: 3268123 - RNA, 15 nt, Vaccinia virus
aauacuuaguuucca

SEQ ID NO: 3268124 - RNA, 15 nt, Vaccinia virus
acgcaacaaaugauu

SEQ ID NO: 3268125 - RNA, 19 nt, Vaccinia virus
acugcgauuguauuauccg

SEQ ID NO: 3268126 - RNA, 15 nt, Vaccinia virus
uaauaucuaaauauu

SEQ ID NO: 3268127 - RNA, 12 nt, Vaccinia virus
acaauauuuccg

SEQ ID NO: 3268128 - RNA, 22 nt, Vaccinia virus
cauuuccaaaucuaacuucuag

SEQ ID NO: 3268129 - RNA, 17 nt, Vaccinia virus
auuugacgcuuuucucu

SEQ ID NO: 3268130 - RNA, 15 nt, Vaccinia virus
guauauucucuaguu

SEQ ID NO: 3268131 - RNA, 22 nt, Vaccinia virus
cagacucugauuugaacaaugc

SEQ ID NO: 3268132 - RNA, 18 nt, Vaccinia virus
gaacuucugaucauuaau

SEQ ID NO: 3268133 - RNA, 15 nt, Vaccinia virus
guuaucuauuucaaa

SEQ ID NO: 3268134 - RNA, 13 nt, Vaccinia virus
aguuaauagcuuc

SEQ ID NO: 3268135 - RNA, 12 nt, Vaccinia virus
aaauugucuaua

SEQ ID NO: 3268136 - RNA, 19 nt, Vaccinia virus
gaagcacgcugcuaauaaa

SEQ ID NO: 3268137 - RNA, 15 nt, Vaccinia virus
aggcacaaugaauga

SEQ ID NO: 3268138 - RNA, 20 nt, Vaccinia virus
aauuucuuagucauagacaa

SEQ ID NO: 3268139 - RNA, 17 nt, Vaccinia virus
auucuugguuaaacuca

SEQ ID NO: 3268140 - RNA, 11 nt, Vaccinia virus
cuuuauccaua

SEQ ID NO: 3268141 - RNA, 15 nt, Vaccinia virus
aucuagacucuauau

SEQ ID NO: 3268142 - RNA, 20 nt, Vaccinia virus
uacaaaauuugcaucuacau

SEQ ID NO: 3268143 - RNA, 15 nt, Vaccinia virus
aauuuauaucuaaga

SEQ ID NO: 3268144 - RNA, 19 nt, Vaccinia virus
agaaaucauccguuguuau

SEQ ID NO: 3268145 - RNA, 12 nt, Vaccinia virus
guguauuuccau

SEQ ID NO: 3268146 - RNA, 18 nt, Vaccinia virus
acuguucccgucaauaga

SEQ ID NO: 3268147 - RNA, 16 nt, Vaccinia virus
ucuacugauaaaacug

SEQ ID NO: 3268148 - RNA, 15 nt, Vaccinia virus
aucauacuuagaauu

SEQ ID NO: 3268149 - RNA, 20 nt, Vaccinia virus
cgauauuauccgaagacaga

SEQ ID NO: 3268150 - RNA, 19 nt, Vaccinia virus
agauuauggagcaaacauu

SEQ ID NO: 3268151 - RNA, 13 nt, Vaccinia virus
uaaaacaauaaau

SEQ ID NO: 3268152 - RNA, 16 nt, Vaccinia virus
aauauuucuauuucua

SEQ ID NO: 3268153 - RNA, 17 nt, Vaccinia virus
uauuuccagaugaugau

SEQ ID NO: 3268154 - RNA, 19 nt, Vaccinia virus
auguaucaaagauauagau

SEQ ID NO: 3268155 - RNA, 18 nt, Vaccinia virus
gaucuaauggaauccaau

SEQ ID NO: 3268156 - RNA, 23 nt, Vaccinia virus
aguauucuucuugucaucuuguu

SEQ ID NO: 3268157 - RNA, 17 nt, Vaccinia virus
gcguacuucagguuucu

SEQ ID NO: 3268158 - RNA, 17 nt, Vaccinia virus
ccaauuuggauauagca

SEQ ID NO: 3268159 - RNA, 15 nt, Vaccinia virus
ucaauaugagcaaug

SEQ ID NO: 3268160 - RNA, 19 nt, Vaccinia virus
uauucgucgucgacuauca

SEQ ID NO: 3268161 - RNA, 13 nt, Vaccinia virus
auagaagauagau

SEQ ID NO: 3268162 - RNA, 18 nt, Vaccinia virus
agucauguuaaaaaugac

SEQ ID NO: 3268163 - RNA, 13 nt, Vaccinia virus
uuauagauguaca

SEQ ID NO: 3268164 - RNA, 13 nt, Vaccinia virus
cuauauauguuuu

SEQ ID NO: 3268165 - RNA, 15 nt, Vaccinia virus
caaauaacaaaaucc

SEQ ID NO: 3268166 - RNA, 19 nt, Vaccinia virus
guaaaaugaaauaucuuaa

SEQ ID NO: 3268167 - RNA, 18 nt, Vaccinia virus
aaauaacaguaucauuua

SEQ ID NO: 3268168 - RNA, 22 nt, Vaccinia virus
ugguauaucuggaaagaaaucu

SEQ ID NO: 3268169 - RNA, 23 nt, Vaccinia virus
agauaucucuggauauaucacaa

SEQ ID NO: 3268170 - RNA, 17 nt, Vaccinia virus
auuguuuuuguacauaa

SEQ ID NO: 3268171 - RNA, 19 nt, Vaccinia virus
uaguuacuacgaucucauc

SEQ ID NO: 3268172 - RNA, 21 nt, Vaccinia virus
gugucaaacuguguagcuaga

SEQ ID NO: 3268173 - RNA, 22 nt, Vaccinia virus
cuauuguuacaaaaguuaauaa

SEQ ID NO: 3268174 - RNA, 17 nt, Vaccinia virus
aaucacuuuaacuuuua

SEQ ID NO: 3268175 - RNA, 22 nt, Vaccinia virus
uauaucgcauauuuauaucgug

SEQ ID NO: 3268176 - RNA, 15 nt, Vaccinia virus
auaaguguugucaaa

SEQ ID NO: 3268177 - RNA, 17 nt, Vaccinia virus
agcaucagcaucuggcu

SEQ ID NO: 3268178 - RNA, 20 nt, Vaccinia virus
ucugaauuauauuuauuauu

SEQ ID NO: 3268179 - RNA, 13 nt, Vaccinia virus
uuacucaugauua

SEQ ID NO: 3268180 - RNA, 17 nt, Vaccinia virus
agauauauuauaauucu

SEQ ID NO: 3268181 - RNA, 12 nt, Vaccinia virus
aauauuuaacuc

SEQ ID NO: 3268182 - RNA, 13 nt, Vaccinia virus
aacagaacagaua

SEQ ID NO: 3268183 - RNA, 14 nt, Vaccinia virus
caaaauacauaauu

SEQ ID NO: 3268184 - RNA, 13 nt, Vaccinia virus
acacucucaauau

SEQ ID NO: 3268185 - RNA, 14 nt, Vaccinia virus
uauugaguggaaag

SEQ ID NO: 3268186 - RNA, 20 nt, Vaccinia virus
cauuagauauuauggcauug

SEQ ID NO: 3268187 - RNA, 14 nt, Vaccinia virus
cuauuguuuggaau

SEQ ID NO: 3268188 - RNA, 12 nt, Vaccinia virus
gcucuacaaaau

SEQ ID NO: 3268189 - RNA, 13 nt, Vaccinia virus
cauauauuucauu

SEQ ID NO: 3268190 - RNA, 22 nt, Vaccinia virus
aauacuaauaggucuaaaaacc

SEQ ID NO: 3268191 - RNA, 15 nt, Vaccinia virus
uguauauuuuuucau

SEQ ID NO: 3268192 - RNA, 12 nt, Vaccinia virus
gaacaguuuauu

SEQ ID NO: 3268193 - RNA, 13 nt, Vaccinia virus
ucaaagcaucaaa

SEQ ID NO: 3268194 - RNA, 14 nt, Vaccinia virus
agcuauuuaaaugg

SEQ ID NO: 3268195 - RNA, 22 nt, Vaccinia virus
aaaguagaugguauuucugaaa

SEQ ID NO: 3268196 - RNA, 17 nt, Vaccinia virus
ucacauccuuuauuuua

SEQ ID NO: 3268197 - RNA, 12 nt, Vaccinia virus
gcauccauccaa

SEQ ID NO: 3268198 - RNA, 15 nt, Vaccinia virus
aucggcuuuaacaau

SEQ ID NO: 3268199 - RNA, 19 nt, Vaccinia virus
uagcuaauauaaaaauaua

SEQ ID NO: 3268200 - RNA, 16 nt, Vaccinia virus
augauauuagaacugc

SEQ ID NO: 3268201 - RNA, 19 nt, Vaccinia virus
uagagauaccaaagacuuu

SEQ ID NO: 3268202 - RNA, 15 nt, Vaccinia virus
uguacaauaugaaca

SEQ ID NO: 3268203 - RNA, 15 nt, Vaccinia virus
gucaauugauucuua

SEQ ID NO: 3268204 - RNA, 15 nt, Vaccinia virus
uaccucuacacuauu

SEQ ID NO: 3268205 - RNA, 21 nt, Vaccinia virus
ccauaauggcgcuaucuuuca

SEQ ID NO: 3268206 - RNA, 12 nt, Vaccinia virus
uagcuaauauua

SEQ ID NO: 3268207 - RNA, 12 nt, Vaccinia virus
ucggaauuauuu

SEQ ID NO: 3268208 - RNA, 12 nt, Vaccinia virus
auacauauacca

SEQ ID NO: 3268209 - RNA, 22 nt, Vaccinia virus
aaugucuauaguucucaucuuu

SEQ ID NO: 3268210 - RNA, 16 nt, Vaccinia virus
auggucucacaaaaaa

SEQ ID NO: 3268211 - RNA, 14 nt, Vaccinia virus
gauacauaaacgaa

SEQ ID NO: 3268212 - RNA, 19 nt, Vaccinia virus
auguagaagguucauaugu

SEQ ID NO: 3268213 - RNA, 17 nt, Vaccinia virus
uaccaaccuacacuauu

SEQ ID NO: 3268214 - RNA, 14 nt, Vaccinia virus
auucucuacagaug

SEQ ID NO: 3268215 - RNA, 17 nt, Vaccinia virus
aaacgucguauguagaa

SEQ ID NO: 3268216 - RNA, 13 nt, Vaccinia virus
uuggugaauccau

SEQ ID NO: 3268217 - RNA, 16 nt, Vaccinia virus
acaauuucuauuuccu

SEQ ID NO: 3268218 - RNA, 20 nt, Vaccinia virus
acauaugguuucuaaaucua

SEQ ID NO: 3268219 - RNA, 17 nt, Vaccinia virus
aggaaauggaagauauu

SEQ ID NO: 3268220 - RNA, 13 nt, Vaccinia virus
uuccuuccaauga

SEQ ID NO: 3268221 - RNA, 19 nt, Vaccinia virus
aaauucaguugcuggaauu

SEQ ID NO: 3268222 - RNA, 15 nt, Vaccinia virus
caauacuaauucaaa

SEQ ID NO: 3268223 - RNA, 13 nt, Vaccinia virus
agaacuaacacaa

SEQ ID NO: 3268224 - RNA, 15 nt, Vaccinia virus
aauuacacauuucca

SEQ ID NO: 3268225 - RNA, 18 nt, Vaccinia virus
ugauuuuuccuaaaucua

SEQ ID NO: 3268226 - RNA, 11 nt, Vaccinia virus
cucuuucugaa

SEQ ID NO: 3268227 - RNA, 18 nt, Vaccinia virus
uuacuaccaucauuauua

SEQ ID NO: 3268228 - RNA, 13 nt, Vaccinia virus
cuaccugcuguug

SEQ ID NO: 3268229 - RNA, 11 nt, Vaccinia virus
cuagauacauu

SEQ ID NO: 3268230 - RNA, 15 nt, Vaccinia virus
cagauacagauacag

SEQ ID NO: 3268231 - RNA, 17 nt, Vaccinia virus
agcuauguuuacugcug

SEQ ID NO: 3268232 - RNA, 22 nt, Vaccinia virus
aaugagauuauuaaguauuuau

SEQ ID NO: 3268233 - RNA, 14 nt, Vaccinia virus
uaccgcacuuauau

SEQ ID NO: 3268234 - RNA, 23 nt, Vaccinia virus
gucuugaacucgcugaaugaucu

SEQ ID NO: 3268235 - RNA, 21 nt, Vaccinia virus
acuugauacgcucauuaauaa

SEQ ID NO: 3268236 - RNA, 15 nt, Vaccinia virus
auucuggacauagcu

SEQ ID NO: 3268237 - RNA, 20 nt, Vaccinia virus
aaauauaguagaauuucauu

SEQ ID NO: 3268238 - RNA, 23 nt, Vaccinia virus
ugaaccaguuaauguauaucuuu

SEQ ID NO: 3268239 - RNA, 14 nt, Vaccinia virus
gaucauuaaucauc

SEQ ID NO: 3268240 - RNA, 13 nt, Vaccinia virus
uagaauggaugaa

SEQ ID NO: 3268241 - RNA, 19 nt, Vaccinia virus
uauucgacuugguguuuga

SEQ ID NO: 3268242 - RNA, 22 nt, Vaccinia virus
aauuuuguuuuuuuacuuucua

SEQ ID NO: 3268243 - RNA, 17 nt, Vaccinia virus
uuuguaaauaacuaucu

SEQ ID NO: 3268244 - RNA, 16 nt, Vaccinia virus
ugcaauaacaaagauu

SEQ ID NO: 3268245 - RNA, 17 nt, Vaccinia virus
gcauaaacuaacacaag

SEQ ID NO: 3268246 - RNA, 15 nt, Vaccinia virus
guuaguacaguguua

SEQ ID NO: 3268247 - RNA, 19 nt, Vaccinia virus
auauauguuuucaucauuu

SEQ ID NO: 3268248 - RNA, 15 nt, Vaccinia virus
acuuuuucucauaau

SEQ ID NO: 3268249 - RNA, 18 nt, Vaccinia virus
gugguauuggauagaauu

SEQ ID NO: 3268250 - RNA, 18 nt, Vaccinia virus
cggucgaugucaauaaua

SEQ ID NO: 3268251 - RNA, 18 nt, Vaccinia virus
aaacaaguuuucauauua

SEQ ID NO: 3268252 - RNA, 17 nt, Vaccinia virus
uaaaaaaaaaauacuua

SEQ ID NO: 3268253 - RNA, 14 nt, Vaccinia virus
uugccauuaguuuu

SEQ ID NO: 3268254 - RNA, 15 nt, Vaccinia virus
acaaugcuaauauau

SEQ ID NO: 3268255 - RNA, 14 nt, Vaccinia virus
aauauuuaguauua

SEQ ID NO: 3268256 - RNA, 12 nt, Vaccinia virus
aacuuuugcaua

SEQ ID NO: 3268257 - RNA, 20 nt, Vaccinia virus
uuaucaagauguguauguuu

SEQ ID NO: 3268258 - RNA, 15 nt, Vaccinia virus
ccauaauuuucucuc

SEQ ID NO: 3268259 - RNA, 18 nt, Vaccinia virus
auacagacgauaacuuga

SEQ ID NO: 3268260 - RNA, 14 nt, Vaccinia virus
ugguaucaacagau

SEQ ID NO: 3268261 - RNA, 15 nt, Vaccinia virus
agaaagaagaaauac

SEQ ID NO: 3268262 - RNA, 12 nt, Vaccinia virus
acuauuugucua

SEQ ID NO: 3268263 - RNA, 13 nt, Vaccinia virus
gaauauuucuauu

SEQ ID NO: 3268264 - RNA, 14 nt, Vaccinia virus
acaacauuaauaca

SEQ ID NO: 3268265 - RNA, 15 nt, Vaccinia virus
aucuuguucagaaau

SEQ ID NO: 3268266 - RNA, 13 nt, Vaccinia virus
aacuuuaaauacu

SEQ ID NO: 3268267 - RNA, 22 nt, Vaccinia virus
guacauuuuccagauuaacaga

SEQ ID NO: 3268268 - RNA, 21 nt, Vaccinia virus
ugcggauaugauccaagaggg

SEQ ID NO: 3268269 - RNA, 16 nt, Vaccinia virus
acauuuuugaaauacc

SEQ ID NO: 3268270 - RNA, 22 nt, Vaccinia virus
ucuuuacccauccaauacuacu

SEQ ID NO: 3268271 - RNA, 18 nt, Vaccinia virus
gaaauauaguaauaagau

SEQ ID NO: 3268272 - RNA, 19 nt, Vaccinia virus
accaugucguuaacuauaa

SEQ ID NO: 3268273 - RNA, 18 nt, Vaccinia virus
cauggacauaguaauaca

SEQ ID NO: 3268274 - RNA, 16 nt, Vaccinia virus
ugaagcaaaauaugcu

SEQ ID NO: 3268275 - RNA, 14 nt, Vaccinia virus
auacucuauuaaug

SEQ ID NO: 3268276 - RNA, 18 nt, Vaccinia virus
accucuccuauaugaaua

SEQ ID NO: 3268277 - RNA, 14 nt, Vaccinia virus
ucuuuauucucuac

SEQ ID NO: 3268278 - RNA, 17 nt, Vaccinia virus
cugucaauagacaucca

SEQ ID NO: 3268279 - RNA, 13 nt, Vaccinia virus
gugcacugguguc

SEQ ID NO: 3268280 - RNA, 20 nt, Vaccinia virus
uuagaaaugaguucauuaaa

SEQ ID NO: 3268281 - RNA, 14 nt, Vaccinia virus
gacgcuacacuauc

SEQ ID NO: 3268282 - RNA, 13 nt, Vaccinia virus
uacagauguuaca

SEQ ID NO: 3268283 - RNA, 16 nt, Vaccinia virus
uauacaauuguuugua

SEQ ID NO: 3268284 - RNA, 17 nt, Vaccinia virus
gaauucauuugauguau

SEQ ID NO: 3268285 - RNA, 21 nt, Vaccinia virus
aguaaauagauaguuuuucca

SEQ ID NO: 3268286 - RNA, 12 nt, Vaccinia virus
auagaaucugug

SEQ ID NO: 3268287 - RNA, 11 nt, Vaccinia virus
uugucuagaau

SEQ ID NO: 3268288 - RNA, 22 nt, Vaccinia virus
auagaaacauauucuaugaauu

SEQ ID NO: 3268289 - RNA, 19 nt, Vaccinia virus
cuucagcggauccuguauu

SEQ ID NO: 3268290 - RNA, 18 nt, Vaccinia virus
uauacauucuucuguuaa

SEQ ID NO: 3268291 - RNA, 17 nt, Vaccinia virus
cuacaacagauauucca

SEQ ID NO: 3268292 - RNA, 12 nt, Vaccinia virus
uaauaauuguau

SEQ ID NO: 3268293 - RNA, 14 nt, Vaccinia virus
auaucgauguuuaa

SEQ ID NO: 3268294 - RNA, 15 nt, Vaccinia virus
aacccagauaauaac

SEQ ID NO: 3268295 - RNA, 16 nt, Vaccinia virus
aaauagagagcuauau

SEQ ID NO: 3268296 - RNA, 14 nt, Vaccinia virus
cuggcauuaucuau

SEQ ID NO: 3268297 - RNA, 24 nt, Vaccinia virus
ucaauaauuguggcuauauauuca

SEQ ID NO: 3268298 - RNA, 19 nt, Vaccinia virus
auaucgagaucuuuuguau

SEQ ID NO: 3268299 - RNA, 13 nt, Vaccinia virus
acauuaaauguau

SEQ ID NO: 3268300 - RNA, 18 nt, Vaccinia virus
gaacaugugugaaaauau

SEQ ID NO: 3268301 - RNA, 12 nt, Vaccinia virus
ugauagcaagga

SEQ ID NO: 3268302 - RNA, 14 nt, Vaccinia virus
uuagccauuuaauu

SEQ ID NO: 3268303 - RNA, 23 nt, Vaccinia virus
acgucuagaguuuauaucaauaa

SEQ ID NO: 3268304 - RNA, 24 nt, Vaccinia virus
aacaucgauucccauaugauguuu

SEQ ID NO: 3268305 - RNA, 20 nt, Vaccinia virus
cauaucaucauuguguaaac

SEQ ID NO: 3268306 - RNA, 19 nt, Vaccinia virus
acacuaauauuaugaugaa

SEQ ID NO: 3268307 - RNA, 14 nt, Vaccinia virus
uauuauaaacucac

SEQ ID NO: 3268308 - RNA, 22 nt, Vaccinia virus
uaucaaucaaaacagaauauga

SEQ ID NO: 3268309 - RNA, 14 nt, Vaccinia virus
cucauuauuuccca

SEQ ID NO: 3268310 - RNA, 21 nt, Vaccinia virus
auuggcaaauuauuucuucug

SEQ ID NO: 3268311 - RNA, 23 nt, Vaccinia virus
guauucauuguuuagaauacaag

SEQ ID NO: 3268312 - RNA, 15 nt, Vaccinia virus
gaaacgauguaguua

SEQ ID NO: 3268313 - RNA, 14 nt, Vaccinia virus
uucuggaucucacc

SEQ ID NO: 3268314 - RNA, 22 nt, Vaccinia virus
aaaagcuauuaucaaauacugu

SEQ ID NO: 3268315 - RNA, 18 nt, Vaccinia virus
gaauaucauuaacgauau

SEQ ID NO: 3268316 - RNA, 17 nt, Vaccinia virus
aaggauacuaaacauug

SEQ ID NO: 3268317 - RNA, 18 nt, Vaccinia virus
uuccauucggauucacaa

SEQ ID NO: 3268318 - RNA, 22 nt, Vaccinia virus
aaugauugcauagugaauauau

SEQ ID NO: 3268319 - RNA, 15 nt, Vaccinia virus
acgcuauuaaucuuu

SEQ ID NO: 3268320 - RNA, 21 nt, Vaccinia virus
uuauauuaacacauacauuuu

SEQ ID NO: 3268321 - RNA, 22 nt, Vaccinia virus
aguuugcggauaaugauagaca

SEQ ID NO: 3268322 - RNA, 16 nt, Vaccinia virus
auguagaauccaucag

SEQ ID NO: 3268323 - RNA, 14 nt, Vaccinia virus
auuuuuaaaaauuu

SEQ ID NO: 3268324 - RNA, 14 nt, Vaccinia virus
acaauuuacauguu

SEQ ID NO: 3268325 - RNA, 15 nt, Vaccinia virus
gcugcagcauauaac

SEQ ID NO: 3268326 - RNA, 14 nt, Vaccinia virus
agauuuagaaaugu

SEQ ID NO: 3268327 - RNA, 14 nt, Vaccinia virus
cuccaauacuaauu

SEQ ID NO: 3268328 - RNA, 20 nt, Vaccinia virus
auuacgaauauauaaaagac

SEQ ID NO: 3268329 - RNA, 15 nt, Vaccinia virus
auguauaaaguguau

SEQ ID NO: 3268330 - RNA, 19 nt, Vaccinia virus
aauacugaugcauuuucca

SEQ ID NO: 3268331 - RNA, 14 nt, Vaccinia virus
uaucucuugucuga

SEQ ID NO: 3268332 - RNA, 13 nt, Vaccinia virus
ugauauuuggauc

SEQ ID NO: 3268333 - RNA, 16 nt, Vaccinia virus
ucuacaagaugucaga

SEQ ID NO: 3268334 - RNA, 20 nt, Vaccinia virus
uggaauccaauuguuugaua

SEQ ID NO: 3268335 - RNA, 14 nt, Vaccinia virus
uuccuucuuauucu

SEQ ID NO: 3268336 - RNA, 15 nt, Vaccinia virus
gacauaucagaugau

SEQ ID NO: 3268337 - RNA, 22 nt, Vaccinia virus
augguaacgauaacacaaaaug

SEQ ID NO: 3268338 - RNA, 13 nt, Vaccinia virus
cggaaaguauuuc

SEQ ID NO: 3268339 - RNA, 16 nt, Vaccinia virus
cagaggaugaaauaga

SEQ ID NO: 3268340 - RNA, 22 nt, Vaccinia virus
uuugaaaauguuacugaagaau

SEQ ID NO: 3268341 - RNA, 21 nt, Vaccinia virus
augacuucguaaaaaauaaua

SEQ ID NO: 3268342 - RNA, 12 nt, Vaccinia virus
ucaaaauuauuu

SEQ ID NO: 3268343 - RNA, 13 nt, Vaccinia virus
auacuaucaaaau

SEQ ID NO: 3268344 - RNA, 17 nt, Vaccinia virus
aagauacuguuuagaga

SEQ ID NO: 3268345 - RNA, 14 nt, Vaccinia virus
gauugauaacugaa

SEQ ID NO: 3268346 - RNA, 22 nt, Vaccinia virus
ugguaacgucaucaucaacaau

SEQ ID NO: 3268347 - RNA, 19 nt, Vaccinia virus
auauaccuagcaaacgauu

SEQ ID NO: 3268348 - RNA, 14 nt, Vaccinia virus
aagauauuccaaga

SEQ ID NO: 3268349 - RNA, 17 nt, Vaccinia virus
uuuaacuuugaaauugu

SEQ ID NO: 3268350 - RNA, 15 nt, Vaccinia virus
uccaauagugaaacu

SEQ ID NO: 3268351 - RNA, 17 nt, Vaccinia virus
ugauaucgagaacagau

SEQ ID NO: 3268352 - RNA, 16 nt, Vaccinia virus
cugcaaauguaguauu

SEQ ID NO: 3268353 - RNA, 21 nt, Vaccinia virus
cauucuccgauaucuaauuuc

SEQ ID NO: 3268354 - RNA, 16 nt, Vaccinia virus
agauuauucuuaaaug

SEQ ID NO: 3268355 - RNA, 17 nt, Vaccinia virus
gacugaccaguauugau

SEQ ID NO: 3268356 - RNA, 23 nt, Vaccinia virus
auauacuaagcaaguacauggau

SEQ ID NO: 3268357 - RNA, 19 nt, Vaccinia virus
aaauuaaaggagcauguau

SEQ ID NO: 3268358 - RNA, 14 nt, Vaccinia virus
augaaacauuuaau

SEQ ID NO: 3268359 - RNA, 11 nt, Vaccinia virus
gacuuguuaau

SEQ ID NO: 3268360 - RNA, 14 nt, Vaccinia virus
uaauuguuaaacau

SEQ ID NO: 3268361 - RNA, 18 nt, Vaccinia virus
cugguacaggaguucagu

SEQ ID NO: 3268362 - RNA, 20 nt, Vaccinia virus
auauucgaaauuagaaagua

SEQ ID NO: 3268363 - RNA, 21 nt, Vaccinia virus
uacgagaaauuaauuauugua

SEQ ID NO: 3268364 - RNA, 13 nt, Vaccinia virus
aauuuuaacagau

SEQ ID NO: 3268365 - RNA, 17 nt, Vaccinia virus
uaauauccugaacagca

SEQ ID NO: 3268366 - RNA, 14 nt, Vaccinia virus
uauauaguaaugaa

SEQ ID NO: 3268367 - RNA, 14 nt, Vaccinia virus
caauaauauacaau

SEQ ID NO: 3268368 - RNA, 19 nt, Vaccinia virus
gcguuuuaugaaugaugau

SEQ ID NO: 3268369 - RNA, 20 nt, Vaccinia virus
ugcuaucaucacucuaaaau

SEQ ID NO: 3268370 - RNA, 15 nt, Vaccinia virus
agauuucgucuaaua

SEQ ID NO: 3268371 - RNA, 15 nt, Vaccinia virus
gaauacgauaauuau

SEQ ID NO: 3268372 - RNA, 20 nt, Vaccinia virus
caauaaugccgguauuggca

SEQ ID NO: 3268373 - RNA, 21 nt, Vaccinia virus
aaugaggucgcaaaaaaacug

SEQ ID NO: 3268374 - RNA, 16 nt, Vaccinia virus
uaacaaauuaaagaua

SEQ ID NO: 3268375 - RNA, 23 nt, Vaccinia virus
uuuauauauugcuuacuagaugu

SEQ ID NO: 3268376 - RNA, 15 nt, Vaccinia virus
aaucgauaacaagau

SEQ ID NO: 3268377 - RNA, 16 nt, Vaccinia virus
uuuagaagugauucuu

SEQ ID NO: 3268378 - RNA, 15 nt, Vaccinia virus
augcaauaacaaaga

SEQ ID NO: 3268379 - RNA, 17 nt, Vaccinia virus
gcucaguaauggauauu

SEQ ID NO: 3268380 - RNA, 21 nt, Vaccinia virus
cgauguggaaauuaaucugua

SEQ ID NO: 3268381 - RNA, 16 nt, Vaccinia virus
auauuaucguuuguaa

SEQ ID NO: 3268382 - RNA, 14 nt, Vaccinia virus
acaucaaaugaugu

SEQ ID NO: 3268383 - RNA, 10 nt, Vaccinia virus
cuaaauuaac

SEQ ID NO: 3268384 - RNA, 21 nt, Vaccinia virus
ugggacuauuggaauguguua

SEQ ID NO: 3268385 - RNA, 20 nt, Vaccinia virus
cugaguaccuacacuauuau

SEQ ID NO: 3268386 - RNA, 15 nt, Vaccinia virus
auuaguaaaaaauuu

SEQ ID NO: 3268387 - RNA, 16 nt, Vaccinia virus
gauagguuauugacau

SEQ ID NO: 3268388 - RNA, 18 nt, Vaccinia virus
uaaacaauuucacaaaug

SEQ ID NO: 3268389 - RNA, 19 nt, Vaccinia virus
aacacaagucuaauaaugu

SEQ ID NO: 3268390 - RNA, 15 nt, Vaccinia virus
aucaugguaugcaug

SEQ ID NO: 3268391 - RNA, 16 nt, Vaccinia virus
gcaaaaauaauaugau

SEQ ID NO: 3268392 - RNA, 16 nt, Vaccinia virus
ucguuugaugaucaua

SEQ ID NO: 3268393 - RNA, 12 nt, Vaccinia virus
accuccuucaug

SEQ ID NO: 3268394 - RNA, 21 nt, Vaccinia virus
uaggaaauuucaugcaacgaa

SEQ ID NO: 3268395 - RNA, 18 nt, Vaccinia virus
uuugguguaaaucuaauu

SEQ ID NO: 3268396 - RNA, 16 nt, Vaccinia virus
uuaguauaauuauuga

SEQ ID NO: 3268397 - RNA, 23 nt, Vaccinia virus
agauuuauugacggcuacucuaa

SEQ ID NO: 3268398 - RNA, 16 nt, Vaccinia virus
gacauaccaucuauca

SEQ ID NO: 3268399 - RNA, 12 nt, Vaccinia virus
gucacacgcucc

SEQ ID NO: 3268400 - RNA, 17 nt, Vaccinia virus
gaagagacggugugaga

SEQ ID NO: 3268401 - RNA, 16 nt, Vaccinia virus
acuucguuuaucuugg

SEQ ID NO: 3268402 - RNA, 21 nt, Vaccinia virus
uaccauuaauuguuuacugua

SEQ ID NO: 3268403 - RNA, 13 nt, Vaccinia virus
aauaauaaaugua

SEQ ID NO: 3268404 - RNA, 18 nt, Vaccinia virus
auauuuuuuuaguaaugu

SEQ ID NO: 3268405 - RNA, 14 nt, Vaccinia virus
aauauauugauaau

SEQ ID NO: 3268406 - RNA, 15 nt, Vaccinia virus
acucauuaaaacuuc

SEQ ID NO: 3268407 - RNA, 13 nt, Vaccinia virus
aaaauaaaaaacc

SEQ ID NO: 3268408 - RNA, 15 nt, Vaccinia virus
aucucauauuaaaaa

SEQ ID NO: 3268409 - RNA, 14 nt, Vaccinia virus
cauauauuacguaa

SEQ ID NO: 3268410 - RNA, 21 nt, Vaccinia virus
agaauaugauccguaacauau

SEQ ID NO: 3268411 - RNA, 16 nt, Vaccinia virus
aaguaauuaauuuuuc

SEQ ID NO: 3268412 - RNA, 18 nt, Vaccinia virus
uaauacaugacaauaaag

SEQ ID NO: 3268413 - RNA, 18 nt, Vaccinia virus
aaaauaaagauaaaaacg

SEQ ID NO: 3268414 - RNA, 22 nt, Vaccinia virus
auuuuacccucaaucauguacu

SEQ ID NO: 3268415 - RNA, 22 nt, Vaccinia virus
uagaacugccauauguuggaga

SEQ ID NO: 3268416 - RNA, 19 nt, Vaccinia virus
uuauagacaaauuauucau

SEQ ID NO: 3268417 - RNA, 15 nt, Vaccinia virus
aggaaacuaauauug

SEQ ID NO: 3268418 - RNA, 14 nt, Vaccinia virus
ugugacuguuuucu

SEQ ID NO: 3268419 - RNA, 17 nt, Vaccinia virus
uuaaauauuguauuaau

SEQ ID NO: 3268420 - RNA, 17 nt, Vaccinia virus
auccagacaacaaucgu

SEQ ID NO: 3268421 - RNA, 19 nt, Vaccinia virus
agacggagucauaacuauu

SEQ ID NO: 3268422 - RNA, 16 nt, Vaccinia virus
caacucuaaucacuuu

SEQ ID NO: 3268423 - RNA, 15 nt, Vaccinia virus
cauccaagucaauau

SEQ ID NO: 3268424 - RNA, 13 nt, Vaccinia virus
caucgaauacuuc

SEQ ID NO: 3268425 - RNA, 15 nt, Vaccinia virus
acgccgucuuuaucu

SEQ ID NO: 3268426 - RNA, 20 nt, Vaccinia virus
aauugguaacucauucuaua

SEQ ID NO: 3268427 - RNA, 13 nt, Vaccinia virus
agaacguaaauua

SEQ ID NO: 3268428 - RNA, 17 nt, Vaccinia virus
uuuguuauuguaguaua

SEQ ID NO: 3268429 - RNA, 15 nt, Vaccinia virus
agaauuuuagacacu

SEQ ID NO: 3268430 - RNA, 22 nt, Vaccinia virus
cuagugaguacggauuaaacau

SEQ ID NO: 3268431 - RNA, 19 nt, Vaccinia virus
agcuuucacucauaugaca

SEQ ID NO: 3268432 - RNA, 22 nt, Vaccinia virus
uauauucucuaguuacuacgau

SEQ ID NO: 3268433 - RNA, 22 nt, Vaccinia virus
agacugagauacgcaaagaauc

SEQ ID NO: 3268434 - RNA, 12 nt, Vaccinia virus
ugcaaggcauuu

SEQ ID NO: 3268435 - RNA, 19 nt, Vaccinia virus
uauaaaacuugucuguaua

SEQ ID NO: 3268436 - RNA, 11 nt, Vaccinia virus
uuuaacuuuuc

SEQ ID NO: 3268437 - RNA, 15 nt, Vaccinia virus
uggcaauguuucaua

SEQ ID NO: 3268438 - RNA, 20 nt, Vaccinia virus
aggcguaucugauacaggcg

SEQ ID NO: 3268439 - RNA, 16 nt, Vaccinia virus
acuuucaucuaauaag

SEQ ID NO: 3268440 - RNA, 17 nt, Vaccinia virus
uaacgucgguauuauau

SEQ ID NO: 3268441 - RNA, 12 nt, Vaccinia virus
gcugucauguau

SEQ ID NO: 3268442 - RNA, 19 nt, Vaccinia virus
aaucauuuuuuuaaaacug

SEQ ID NO: 3268443 - RNA, 22 nt, Vaccinia virus
guauaucaacaucuaccuuauu

SEQ ID NO: 3268444 - RNA, 16 nt, Vaccinia virus
uauaaaguguaugucu

SEQ ID NO: 3268445 - RNA, 15 nt, Vaccinia virus
cuauguuuuuaauga

SEQ ID NO: 3268446 - RNA, 20 nt, Vaccinia virus
cuaucuuuagcuucugaaau

SEQ ID NO: 3268447 - RNA, 17 nt, Vaccinia virus
guguccuuuuucauccu

SEQ ID NO: 3268448 - RNA, 17 nt, Vaccinia virus
aaaucaaaacauuuuca

SEQ ID NO: 3268449 - RNA, 22 nt, Vaccinia virus
gagaucuacuggcgaaauggua

SEQ ID NO: 3268450 - RNA, 14 nt, Vaccinia virus
guuuagaugucgaa

SEQ ID NO: 3268451 - RNA, 22 nt, Vaccinia virus
ccauggacuaagauaucugaaa

SEQ ID NO: 3268452 - RNA, 16 nt, Vaccinia virus
acaucacgcucgauaa

SEQ ID NO: 3268453 - RNA, 21 nt, Vaccinia virus
caucuagccucgguaaucugu

SEQ ID NO: 3268454 - RNA, 15 nt, Vaccinia virus
gcuccucucucaggc

SEQ ID NO: 3268455 - RNA, 21 nt, Vaccinia virus
ccaguagguguaggaguacau

SEQ ID NO: 3268456 - RNA, 22 nt, Vaccinia virus
uaauauuggcagcguuguuuau

SEQ ID NO: 3268457 - RNA, 14 nt, Vaccinia virus
auauuuuuaauagc

SEQ ID NO: 3268458 - RNA, 15 nt, Vaccinia virus
auauuauauaaacau

SEQ ID NO: 3268459 - RNA, 20 nt, Vaccinia virus
uguuuccaugacauauuaca

SEQ ID NO: 3268460 - RNA, 18 nt, Vaccinia virus
gucaugauuaguauuuua

SEQ ID NO: 3268461 - RNA, 21 nt, Vaccinia virus
aucuaacaucuugauuaauaa

SEQ ID NO: 3268462 - RNA, 15 nt, Vaccinia virus
uaaauccgagaauau

SEQ ID NO: 3268463 - RNA, 18 nt, Vaccinia virus
agauagauaaucaaaauu

SEQ ID NO: 3268464 - RNA, 11 nt, Vaccinia virus
aaauaucucau

SEQ ID NO: 3268465 - RNA, 15 nt, Vaccinia virus
auuuuaucaagacau

SEQ ID NO: 3268466 - RNA, 15 nt, Vaccinia virus
aaaugauaacuagau

SEQ ID NO: 3268467 - RNA, 15 nt, Vaccinia virus
guaccugguaagaua

SEQ ID NO: 3268468 - RNA, 16 nt, Vaccinia virus
gaaauauauuguuaaa

SEQ ID NO: 3268469 - RNA, 21 nt, Vaccinia virus
acauucuuaaccauauaucca

SEQ ID NO: 3268470 - RNA, 21 nt, Vaccinia virus
acgugauggauauauuaaagu

SEQ ID NO: 3268471 - RNA, 14 nt, Vaccinia virus
guaauauucuaguu

SEQ ID NO: 3268472 - RNA, 15 nt, Vaccinia virus
gaacaauuacagaca

SEQ ID NO: 3268473 - RNA, 13 nt, Vaccinia virus
cuagccucaucuu

SEQ ID NO: 3268474 - RNA, 17 nt, Vaccinia virus
gacuguuauaaaaaugc

SEQ ID NO: 3268475 - RNA, 24 nt, Vaccinia virus
auaacagaguaccaucaacacauu

SEQ ID NO: 3268476 - RNA, 15 nt, Vaccinia virus
ucgauugauuuggaa

SEQ ID NO: 3268477 - RNA, 21 nt, Vaccinia virus
aacauaauuacgacgagcaua

SEQ ID NO: 3268478 - RNA, 19 nt, Vaccinia virus
aguagccagacaaaugguc

SEQ ID NO: 3268479 - RNA, 21 nt, Vaccinia virus
auggaaacaaaugaaacagga

SEQ ID NO: 3268480 - RNA, 17 nt, Vaccinia virus
auugucugaugaagaau

SEQ ID NO: 3268481 - RNA, 14 nt, Vaccinia virus
gucauagaugaaau

SEQ ID NO: 3268482 - RNA, 21 nt, Vaccinia virus
uaagauaucuacuagaaagau

SEQ ID NO: 3268483 - RNA, 14 nt, Vaccinia virus
aaauaaaacuauag

SEQ ID NO: 3268484 - RNA, 15 nt, Vaccinia virus
gauaaaaucaaacuu

SEQ ID NO: 3268485 - RNA, 18 nt, Vaccinia virus
cucaucggaucuguaaaa

SEQ ID NO: 3268486 - RNA, 17 nt, Vaccinia virus
augauuuacaaaugguu

SEQ ID NO: 3268487 - RNA, 19 nt, Vaccinia virus
aauaguaauuuuuuaucau

SEQ ID NO: 3268488 - RNA, 19 nt, Vaccinia virus
aaucuagccauuauaaagu

SEQ ID NO: 3268489 - RNA, 22 nt, Vaccinia virus
uggagaauguuccuaauguaua

SEQ ID NO: 3268490 - RNA, 17 nt, Vaccinia virus
auacauaugacaaacau

SEQ ID NO: 3268491 - RNA, 20 nt, Vaccinia virus
uguaacugcuacuugggaua

SEQ ID NO: 3268492 - RNA, 18 nt, Vaccinia virus
aaacacugauucagaaau

SEQ ID NO: 3268493 - RNA, 21 nt, Vaccinia virus
auucaauuacuacaaaaauua

SEQ ID NO: 3268494 - RNA, 23 nt, Vaccinia virus
auuagacuuuucguauguaaugu

SEQ ID NO: 3268495 - RNA, 22 nt, Vaccinia virus
uuaucgaaugauauauuuuuca

SEQ ID NO: 3268496 - RNA, 20 nt, Vaccinia virus
uauauccaccaauagaaguu

SEQ ID NO: 3268497 - RNA, 20 nt, Vaccinia virus
aacaucuuuguaaacagaua

SEQ ID NO: 3268498 - RNA, 23 nt, Vaccinia virus
gauauauauggucuuaugaaaga

SEQ ID NO: 3268499 - RNA, 16 nt, Vaccinia virus
ucuaccggaguuauau

SEQ ID NO: 3268500 - RNA, 14 nt, Vaccinia virus
guauucaauuacua

SEQ ID NO: 3268501 - RNA, 14 nt, Vaccinia virus
cuaguucugagaaa

SEQ ID NO: 3268502 - RNA, 19 nt, Vaccinia virus
auaugugguguuacaguca

SEQ ID NO: 3268503 - RNA, 20 nt, Vaccinia virus
uagaagaucgucgucaaagu

SEQ ID NO: 3268504 - RNA, 11 nt, Vaccinia virus
auauuaauaga

SEQ ID NO: 3268505 - RNA, 14 nt, Vaccinia virus
aaaguuaagaauua

SEQ ID NO: 3268506 - RNA, 13 nt, Vaccinia virus
auucagaaaucaa

SEQ ID NO: 3268507 - RNA, 15 nt, Vaccinia virus
uuucuuguuaaugau

SEQ ID NO: 3268508 - RNA, 19 nt, Vaccinia virus
cuauagaccaaacugcaaa

SEQ ID NO: 3268509 - RNA, 18 nt, Vaccinia virus
aaugaaauaacauaggau

SEQ ID NO: 3268510 - RNA, 20 nt, Vaccinia virus
aauaugacacgauuaccaau

SEQ ID NO: 3268511 - RNA, 12 nt, Vaccinia virus
ucuucuaucaaa

SEQ ID NO: 3268512 - RNA, 22 nt, Vaccinia virus
cgggaacaauauuaguauguua

SEQ ID NO: 3268513 - RNA, 14 nt, Vaccinia virus
gacuguuauaaaaa

SEQ ID NO: 3268514 - RNA, 22 nt, Vaccinia virus
gauuggauacacuaaaauuaaa

SEQ ID NO: 3268515 - RNA, 14 nt, Vaccinia virus
uuacuucuuccaug

SEQ ID NO: 3268516 - RNA, 23 nt, Vaccinia virus
ucgagauggguccguucucugaa

SEQ ID NO: 3268517 - RNA, 19 nt, Vaccinia virus
auuaaaugauuguauuaac

SEQ ID NO: 3268518 - RNA, 15 nt, Vaccinia virus
agaaguuguaaauga

SEQ ID NO: 3268519 - RNA, 18 nt, Vaccinia virus
agcuaaagacucuaaaug

SEQ ID NO: 3268520 - RNA, 16 nt, Vaccinia virus
aaaugcgucaaucaua

SEQ ID NO: 3268521 - RNA, 19 nt, Vaccinia virus
aacuuagacggcaaguugu

SEQ ID NO: 3268522 - RNA, 13 nt, Vaccinia virus
gccagaaucaugg

SEQ ID NO: 3268523 - RNA, 17 nt, Vaccinia virus
agguuucauauuuauca

SEQ ID NO: 3268524 - RNA, 13 nt, Vaccinia virus
aaacaugugguau

SEQ ID NO: 3268525 - RNA, 13 nt, Vaccinia virus
gaaguuuuaaaaa

SEQ ID NO: 3268526 - RNA, 20 nt, Vaccinia virus
caaauucuuggauauaugau

SEQ ID NO: 3268527 - RNA, 21 nt, Vaccinia virus
aguaacuauguaaaugauaac

SEQ ID NO: 3268528 - RNA, 14 nt, Vaccinia virus
gagagcauucacag

SEQ ID NO: 3268529 - RNA, 14 nt, Vaccinia virus
aggcauaaaaugua

SEQ ID NO: 3268530 - RNA, 18 nt, Vaccinia virus
acagagccaucuguaaaa

SEQ ID NO: 3268531 - RNA, 11 nt, Vaccinia virus
uucucauuaaa

SEQ ID NO: 3268532 - RNA, 15 nt, Vaccinia virus
ucguauacucugccc

SEQ ID NO: 3268533 - RNA, 14 nt, Vaccinia virus
ucuguaaaaguugu

SEQ ID NO: 3268534 - RNA, 17 nt, Vaccinia virus
gauaaucuauggggaga

SEQ ID NO: 3268535 - RNA, 18 nt, Vaccinia virus
aaaagaauguauauacau

SEQ ID NO: 3268536 - RNA, 18 nt, Vaccinia virus
agcaguagcgagaaagca

SEQ ID NO: 3268537 - RNA, 13 nt, Vaccinia virus
uuacuugugguaa

SEQ ID NO: 3268538 - RNA, 13 nt, Vaccinia virus
auguauccguaaa

SEQ ID NO: 3268539 - RNA, 17 nt, Vaccinia virus
acauacguauauuucua

SEQ ID NO: 3268540 - RNA, 17 nt, Vaccinia virus
uuaaaacuguuuaagaa

SEQ ID NO: 3268541 - RNA, 12 nt, Vaccinia virus
auguuacaaaug

SEQ ID NO: 3268542 - RNA, 14 nt, Vaccinia virus
uuuguaauugacau

SEQ ID NO: 3268543 - RNA, 22 nt, Vaccinia virus
aaugaagaaugccuacauauca

SEQ ID NO: 3268544 - RNA, 18 nt, Vaccinia virus
aauuuuuucuacagauau

SEQ ID NO: 3268545 - RNA, 16 nt, Vaccinia virus
auuaaaaauaaaauac

SEQ ID NO: 3268546 - RNA, 16 nt, Vaccinia virus
uuauccacuucacauu

SEQ ID NO: 3268547 - RNA, 17 nt, Vaccinia virus
aguauggagacauugau

SEQ ID NO: 3268548 - RNA, 15 nt, Vaccinia virus
cugauaauguagaag

SEQ ID NO: 3268549 - RNA, 18 nt, Vaccinia virus
cguaucuauaaucaucug

SEQ ID NO: 3268550 - RNA, 18 nt, Vaccinia virus
guacauuaauaaaugaaa

SEQ ID NO: 3268551 - RNA, 19 nt, Vaccinia virus
uauuagauaaauuuaucaa

SEQ ID NO: 3268552 - RNA, 17 nt, Vaccinia virus
aauguauggcuucaaga

SEQ ID NO: 3268553 - RNA, 13 nt, Vaccinia virus
ucgauaauuauuu

SEQ ID NO: 3268554 - RNA, 15 nt, Vaccinia virus
gaugucaaugaagag

SEQ ID NO: 3268555 - RNA, 20 nt, Vaccinia virus
cuauaagauuaucaaaaucu

SEQ ID NO: 3268556 - RNA, 22 nt, Vaccinia virus
aucuaucuuuagcuucugaaau

SEQ ID NO: 3268557 - RNA, 15 nt, Vaccinia virus
uguuauauauaaaag

SEQ ID NO: 3268558 - RNA, 17 nt, Vaccinia virus
auaucggucuuauucuu

SEQ ID NO: 3268559 - RNA, 20 nt, Vaccinia virus
gauaucgagaucuuuuguau

SEQ ID NO: 3268560 - RNA, 21 nt, Vaccinia virus
aauaacuggcacaacaauaac

SEQ ID NO: 3268561 - RNA, 22 nt, Vaccinia virus
agaauuuuuauaaauuuuucca

SEQ ID NO: 3268562 - RNA, 15 nt, Vaccinia virus
guaauauucuaaaac

SEQ ID NO: 3268563 - RNA, 14 nt, Vaccinia virus
auacuccuuuguau

SEQ ID NO: 3268564 - RNA, 20 nt, Vaccinia virus
ucuaggagcaccagaaguau

SEQ ID NO: 3268565 - RNA, 21 nt, Vaccinia virus
aacagauauuacaaccaaugu

SEQ ID NO: 3268566 - RNA, 20 nt, Vaccinia virus
uaauuguuauuuuauucaua

SEQ ID NO: 3268567 - RNA, 22 nt, Vaccinia virus
auuacuaugaauaucuucuaug

SEQ ID NO: 3268568 - RNA, 14 nt, Vaccinia virus
aauauuuucuauga

SEQ ID NO: 3268569 - RNA, 17 nt, Vaccinia virus
uuccaaccuacuacuag

SEQ ID NO: 3268570 - RNA, 17 nt, Vaccinia virus
cuaaaauuuugaucauc

SEQ ID NO: 3268571 - RNA, 21 nt, Vaccinia virus
aauaacuagcuuaaacagaug

SEQ ID NO: 3268572 - RNA, 12 nt, Vaccinia virus
uacguaaaaaag

SEQ ID NO: 3268573 - RNA, 19 nt, Vaccinia virus
agauugaaugccauuuacg

SEQ ID NO: 3268574 - RNA, 13 nt, Vaccinia virus
auacuaaacauug

SEQ ID NO: 3268575 - RNA, 19 nt, Vaccinia virus
caauauauacgaguauaau

SEQ ID NO: 3268576 - RNA, 18 nt, Vaccinia virus
ggucuguguuacauaucu

SEQ ID NO: 3268577 - RNA, 16 nt, Vaccinia virus
ugggguuacucuaaau

SEQ ID NO: 3268578 - RNA, 13 nt, Vaccinia virus
cuacaacuaguga

SEQ ID NO: 3268579 - RNA, 21 nt, Vaccinia virus
guacaaaaaaauaaaacuaga

SEQ ID NO: 3268580 - RNA, 23 nt, Vaccinia virus
cgaggauaauauuagauuuacug

SEQ ID NO: 3268581 - RNA, 15 nt, Vaccinia virus
aaggaagaaggacaa

SEQ ID NO: 3268582 - RNA, 20 nt, Vaccinia virus
uaucuagauaacaacgacuu

SEQ ID NO: 3268583 - RNA, 14 nt, Vaccinia virus
ugacauuuuggauu

SEQ ID NO: 3268584 - RNA, 16 nt, Vaccinia virus
gaugaugcaacucuau

SEQ ID NO: 3268585 - RNA, 22 nt, Vaccinia virus
accaauuaucuuuggagaaucg

SEQ ID NO: 3268586 - RNA, 14 nt, Vaccinia virus
auaacauuguuuau

SEQ ID NO: 3268587 - RNA, 14 nt, Vaccinia virus
auuucauuguaaau

SEQ ID NO: 3268588 - RNA, 18 nt, Vaccinia virus
acaguaucugauaaucua

SEQ ID NO: 3268589 - RNA, 17 nt, Vaccinia virus
auagauauuuucuuucu

SEQ ID NO: 3268590 - RNA, 14 nt, Vaccinia virus
acuacaguuugaaa

SEQ ID NO: 3268591 - RNA, 16 nt, Vaccinia virus
auugcaacguauauag

SEQ ID NO: 3268592 - RNA, 12 nt, Vaccinia virus
uuaccuauucac

SEQ ID NO: 3268593 - RNA, 12 nt, Vaccinia virus
agagcaugaagg

SEQ ID NO: 3268594 - RNA, 19 nt, Vaccinia virus
caauaaauuagaauauauu

SEQ ID NO: 3268595 - RNA, 14 nt, Vaccinia virus
auauaagguuguau

SEQ ID NO: 3268596 - RNA, 23 nt, Vaccinia virus
uucuucaguaguaauaacagugc

SEQ ID NO: 3268597 - RNA, 19 nt, Vaccinia virus
uagauucauucguuauaga

SEQ ID NO: 3268598 - RNA, 14 nt, Vaccinia virus
cuuaaauguuuucu

SEQ ID NO: 3268599 - RNA, 19 nt, Vaccinia virus
uggauguacggcuuuacau

SEQ ID NO: 3268600 - RNA, 23 nt, Vaccinia virus
uacauucucauuaauuaaccauu

SEQ ID NO: 3268601 - RNA, 21 nt, Vaccinia virus
uggaugucaucaauguagaaa

SEQ ID NO: 3268602 - RNA, 21 nt, Vaccinia virus
ugauagguaucgaugaaggac

SEQ ID NO: 3268603 - RNA, 22 nt, Vaccinia virus
ugcauuaguaagugccacaaaa

SEQ ID NO: 3268604 - RNA, 19 nt, Vaccinia virus
caaccaucucauaaaauag

SEQ ID NO: 3268605 - RNA, 14 nt, Vaccinia virus
aauaguaaugauuc

SEQ ID NO: 3268606 - RNA, 11 nt, Vaccinia virus
aaaaaaugaua

SEQ ID NO: 3268607 - RNA, 21 nt, Vaccinia virus
auucuaccuuuuuauuuucua

SEQ ID NO: 3268608 - RNA, 19 nt, Vaccinia virus
acaaaucaucuuaugguuu

SEQ ID NO: 3268609 - RNA, 13 nt, Vaccinia virus
ucuagcauuucua

SEQ ID NO: 3268610 - RNA, 22 nt, Vaccinia virus
acaucuguuugagaauuaagau

SEQ ID NO: 3268611 - RNA, 23 nt, Vaccinia virus
ugugaaugguaaagaaugcuguu

SEQ ID NO: 3268612 - RNA, 15 nt, Vaccinia virus
auaacaauuaacaau

SEQ ID NO: 3268613 - RNA, 15 nt, Vaccinia virus
aauaaauuuuuccaa

SEQ ID NO: 3268614 - RNA, 12 nt, Vaccinia virus
uuguacaaaugg

SEQ ID NO: 3268615 - RNA, 17 nt, Vaccinia virus
uuauauaaaaacauuuu

SEQ ID NO: 3268616 - RNA, 15 nt, Vaccinia virus
gucuuuaucucuuag

SEQ ID NO: 3268617 - RNA, 15 nt, Vaccinia virus
ugacauuuuccuugu

SEQ ID NO: 3268618 - RNA, 18 nt, Vaccinia virus
uacgcuccuuaucaaaau

SEQ ID NO: 3268619 - RNA, 18 nt, Vaccinia virus
agauguuagaaaaaauga

SEQ ID NO: 3268620 - RNA, 14 nt, Vaccinia virus
gaauguguauucuc

SEQ ID NO: 3268621 - RNA, 16 nt, Vaccinia virus
agauaguaaauagaua

SEQ ID NO: 3268622 - RNA, 16 nt, Vaccinia virus
aaucuaauauuaagaa

SEQ ID NO: 3268623 - RNA, 15 nt, Vaccinia virus
uaggaucaguuauug

SEQ ID NO: 3268624 - RNA, 17 nt, Vaccinia virus
guaauuaaaauaaaaag

SEQ ID NO: 3268625 - RNA, 18 nt, Vaccinia virus
uaagguagaaucucuauu

SEQ ID NO: 3268626 - RNA, 18 nt, Vaccinia virus
uaacuacugauaacaaaa

SEQ ID NO: 3268627 - RNA, 23 nt, Vaccinia virus
auuucguugaaccggaagaauug

SEQ ID NO: 3268628 - RNA, 21 nt, Vaccinia virus
acugucacuggaaagaugaua

SEQ ID NO: 3268629 - RNA, 14 nt, Vaccinia virus
uauaggaauagucu

SEQ ID NO: 3268630 - RNA, 22 nt, Vaccinia virus
ucucuguuuaaugaauuacuaa

SEQ ID NO: 3268631 - RNA, 17 nt, Vaccinia virus
agaaaauacaacggaua

SEQ ID NO: 3268632 - RNA, 21 nt, Vaccinia virus
caauauagagauuagaggagg

SEQ ID NO: 3268633 - RNA, 13 nt, Vaccinia virus
aauagauaaaacg

SEQ ID NO: 3268634 - RNA, 19 nt, Vaccinia virus
uguauaaaccuuuuucaga

SEQ ID NO: 3268635 - RNA, 14 nt, Vaccinia virus
uacuuuuucucaua

SEQ ID NO: 3268636 - RNA, 16 nt, Vaccinia virus
uacauaauucuucugu

SEQ ID NO: 3268637 - RNA, 16 nt, Vaccinia virus
uuacaacaacauauga

SEQ ID NO: 3268638 - RNA, 22 nt, Vaccinia virus
uuaguaaaaaauuuauuucuaa

SEQ ID NO: 3268639 - RNA, 19 nt, Vaccinia virus
acuauuauuuauaacugau

SEQ ID NO: 3268640 - RNA, 18 nt, Vaccinia virus
caagaucgauagacacug

SEQ ID NO: 3268641 - RNA, 18 nt, Vaccinia virus
aucaagaauauccagauu

SEQ ID NO: 3268642 - RNA, 19 nt, Vaccinia virus
caauaaaauuaucaugaca

SEQ ID NO: 3268643 - RNA, 23 nt, Vaccinia virus
ucuagaauaucccaauagguguu

SEQ ID NO: 3268644 - RNA, 17 nt, Vaccinia virus
guacaaauguuaaacau

SEQ ID NO: 3268645 - RNA, 22 nt, Vaccinia virus
auuaacaacgaccgauaauaaa

SEQ ID NO: 3268646 - RNA, 17 nt, Vaccinia virus
aguuauccgaucuaaaa

SEQ ID NO: 3268647 - RNA, 12 nt, Vaccinia virus
auauuucugaag

SEQ ID NO: 3268648 - RNA, 15 nt, Vaccinia virus
aguaauaaaucaacu

SEQ ID NO: 3268649 - RNA, 21 nt, Vaccinia virus
uuucuaccaaccaagaauaac

SEQ ID NO: 3268650 - RNA, 13 nt, Vaccinia virus
aaaaguucauaau

SEQ ID NO: 3268651 - RNA, 18 nt, Vaccinia virus
uaaaaguuaaugagagca

SEQ ID NO: 3268652 - RNA, 12 nt, Vaccinia virus
auaauuuuacca

SEQ ID NO: 3268653 - RNA, 23 nt, Vaccinia virus
cuaucucuuucucuuucucucuu

SEQ ID NO: 3268654 - RNA, 13 nt, Vaccinia virus
cuuaccccuugau

SEQ ID NO: 3268655 - RNA, 14 nt, Vaccinia virus
auaugcuacaagau

SEQ ID NO: 3268656 - RNA, 13 nt, Vaccinia virus
acaaaaucuaaac

SEQ ID NO: 3268657 - RNA, 22 nt, Vaccinia virus
guauucuucgauaguccuuauu

SEQ ID NO: 3268658 - RNA, 18 nt, Vaccinia virus
gaauuaauuauucauaau

SEQ ID NO: 3268659 - RNA, 15 nt, Vaccinia virus
uccacaucaucuagu

SEQ ID NO: 3268660 - RNA, 17 nt, Vaccinia virus
gauacaucuauauugcu

SEQ ID NO: 3268661 - RNA, 22 nt, Vaccinia virus
aaaaugguguauuggaccuggu

SEQ ID NO: 3268662 - RNA, 16 nt, Vaccinia virus
auacauuucucaaaug

SEQ ID NO: 3268663 - RNA, 13 nt, Vaccinia virus
aaugguucuuucc

SEQ ID NO: 3268664 - RNA, 17 nt, Vaccinia virus
aaguuaaaauaucaugg

SEQ ID NO: 3268665 - RNA, 13 nt, Vaccinia virus
uaaaauaauacau

SEQ ID NO: 3268666 - RNA, 16 nt, Vaccinia virus
acgcaccucaaaugua

SEQ ID NO: 3268667 - RNA, 14 nt, Vaccinia virus
uuaauuacauccuu

SEQ ID NO: 3268668 - RNA, 16 nt, Vaccinia virus
caucaaaauauguuuc

SEQ ID NO: 3268669 - RNA, 20 nt, Vaccinia virus
uauaagaauuuuuauacauu

SEQ ID NO: 3268670 - RNA, 22 nt, Vaccinia virus
aauguagaaauugaaaauaaua

SEQ ID NO: 3268671 - RNA, 15 nt, Vaccinia virus
uaaaaagauaaacuu

SEQ ID NO: 3268672 - RNA, 15 nt, Vaccinia virus
aaugcagaaaugauu

SEQ ID NO: 3268673 - RNA, 21 nt, Vaccinia virus
cgauaacauguuaauuuccga

SEQ ID NO: 3268674 - RNA, 18 nt, Vaccinia virus
caaagagaccaaugaauu

SEQ ID NO: 3268675 - RNA, 21 nt, Vaccinia virus
aaacaacaaugccauuuuaca

SEQ ID NO: 3268676 - RNA, 16 nt, Vaccinia virus
aguuuuaaaaauacuu

SEQ ID NO: 3268677 - RNA, 20 nt, Vaccinia virus
ucugacuggguuguaauguu

SEQ ID NO: 3268678 - RNA, 22 nt, Vaccinia virus
uaauccuauucuugaucucauc

SEQ ID NO: 3268679 - RNA, 22 nt, Vaccinia virus
ucugacacccaaaaacaaccga

SEQ ID NO: 3268680 - RNA, 15 nt, Vaccinia virus
agauuucaaagaugu

SEQ ID NO: 3268681 - RNA, 15 nt, Vaccinia virus
aaugaugaaaggaua

SEQ ID NO: 3268682 - RNA, 21 nt, Vaccinia virus
agacaaacuguaaguauguuu

SEQ ID NO: 3268683 - RNA, 14 nt, Vaccinia virus
cagccuuuaauagg

SEQ ID NO: 3268684 - RNA, 20 nt, Vaccinia virus
caaacaguuugguauuagaa

SEQ ID NO: 3268685 - RNA, 17 nt, Vaccinia virus
uaacauugaguaaaucc

SEQ ID NO: 3268686 - RNA, 13 nt, Vaccinia virus
uaguaucuaaaac

SEQ ID NO: 3268687 - RNA, 15 nt, Vaccinia virus
acugauaccaugaaa

SEQ ID NO: 3268688 - RNA, 15 nt, Vaccinia virus
acgguaacuaaaugu

SEQ ID NO: 3268689 - RNA, 17 nt, Vaccinia virus
ucaaguaaagauuucaa

SEQ ID NO: 3268690 - RNA, 22 nt, Vaccinia virus
auaaucaaaauugucuaugaug

SEQ ID NO: 3268691 - RNA, 19 nt, Vaccinia virus
agauacuaucaaaauaucu

SEQ ID NO: 3268692 - RNA, 15 nt, Vaccinia virus
cguaguguauaacaa

SEQ ID NO: 3268693 - RNA, 13 nt, Vaccinia virus
uaggcacacaauc

SEQ ID NO: 3268694 - RNA, 21 nt, Vaccinia virus
uaagaguguaguaucauagau

SEQ ID NO: 3268695 - RNA, 14 nt, Vaccinia virus
gcucaguaaaugua

SEQ ID NO: 3268696 - RNA, 19 nt, Vaccinia virus
gauuaaaucguguauucau

SEQ ID NO: 3268697 - RNA, 18 nt, Vaccinia virus
aaucaacucuaaucacuu

SEQ ID NO: 3268698 - RNA, 21 nt, Vaccinia virus
guuuaaaguaaacuucguaaa

SEQ ID NO: 3268699 - RNA, 19 nt, Vaccinia virus
gauauccaaaauuuuguau

SEQ ID NO: 3268700 - RNA, 17 nt, Vaccinia virus
uacuauaauaguacuag

SEQ ID NO: 3268701 - RNA, 14 nt, Vaccinia virus
ucuuccuucuuauu

SEQ ID NO: 3268702 - RNA, 21 nt, Vaccinia virus
aucuuaggcauggacauacua

SEQ ID NO: 3268703 - RNA, 20 nt, Vaccinia virus
gaggaaguauaaaaauuaaa

SEQ ID NO: 3268704 - RNA, 20 nt, Vaccinia virus
acagcaacacauucaauauu

SEQ ID NO: 3268705 - RNA, 16 nt, Vaccinia virus
gcucaaacaaaaugug

SEQ ID NO: 3268706 - RNA, 20 nt, Vaccinia virus
uugaaacuaaacuuauuuag

SEQ ID NO: 3268707 - RNA, 14 nt, Vaccinia virus
gguagagaaugaua

SEQ ID NO: 3268708 - RNA, 19 nt, Vaccinia virus
auucuaugaauuuauaaaa

SEQ ID NO: 3268709 - RNA, 21 nt, Vaccinia virus
uauacgaaauaaaauagacaa

SEQ ID NO: 3268710 - RNA, 21 nt, Vaccinia virus
guuauauuauuagauauccug

SEQ ID NO: 3268711 - RNA, 14 nt, Vaccinia virus
acuccguagagaaa

SEQ ID NO: 3268712 - RNA, 15 nt, Vaccinia virus
agcaaaggaaauugu

SEQ ID NO: 3268713 - RNA, 13 nt, Vaccinia virus
ucugagaauggau

SEQ ID NO: 3268714 - RNA, 22 nt, Vaccinia virus
auauuauuauuuuucuugguaa

SEQ ID NO: 3268715 - RNA, 18 nt, Vaccinia virus
augaucaugugagaauac

SEQ ID NO: 3268716 - RNA, 19 nt, Vaccinia virus
gugccaaaaugauauacag

SEQ ID NO: 3268717 - RNA, 17 nt, Vaccinia virus
guuacguuuacauguga

SEQ ID NO: 3268718 - RNA, 18 nt, Vaccinia virus
uauaaucugaugaacaau

SEQ ID NO: 3268719 - RNA, 16 nt, Vaccinia virus
uauauuguuaaacuuu

SEQ ID NO: 3268720 - RNA, 16 nt, Vaccinia virus
cuauaucaaugccuuu

SEQ ID NO: 3268721 - RNA, 17 nt, Vaccinia virus
ugaacgcuauuaaacau

SEQ ID NO: 3268722 - RNA, 16 nt, Vaccinia virus
cuuaauucaucuucua

SEQ ID NO: 3268723 - RNA, 21 nt, Vaccinia virus
acuacaaugaacuaagagaaa

SEQ ID NO: 3268724 - RNA, 17 nt, Vaccinia virus
uauuaaaggaacuaaag

SEQ ID NO: 3268725 - RNA, 21 nt, Vaccinia virus
aauccaucucuauguuucagu

SEQ ID NO: 3268726 - RNA, 18 nt, Vaccinia virus
uaaauuauauauggauuu

SEQ ID NO: 3268727 - RNA, 19 nt, Vaccinia virus
agaacucuugaagaugauu

SEQ ID NO: 3268728 - RNA, 16 nt, Vaccinia virus
ucauagcugagaauau

SEQ ID NO: 3268729 - RNA, 12 nt, Vaccinia virus
uuuaacacuaua

SEQ ID NO: 3268730 - RNA, 21 nt, Vaccinia virus
ucauaugugcuaaaaaguuuu

SEQ ID NO: 3268731 - RNA, 21 nt, Vaccinia virus
gauuaauaguuuuauuugaag

SEQ ID NO: 3268732 - RNA, 14 nt, Vaccinia virus
gaauuuucauggau

SEQ ID NO: 3268733 - RNA, 15 nt, Vaccinia virus
aucacaaaaaaaacu

SEQ ID NO: 3268734 - RNA, 17 nt, Vaccinia virus
uuaucauuuugauuaau

SEQ ID NO: 3268735 - RNA, 23 nt, Vaccinia virus
gcucuacaugcgguaaagauauu

SEQ ID NO: 3268736 - RNA, 16 nt, Vaccinia virus
uaggauuuuuccaaag

SEQ ID NO: 3268737 - RNA, 18 nt, Vaccinia virus
auuucggcgccuauuuua

SEQ ID NO: 3268738 - RNA, 16 nt, Vaccinia virus
ugauauaguaauauua

SEQ ID NO: 3268739 - RNA, 15 nt, Vaccinia virus
gaacauauaaaugua

SEQ ID NO: 3268740 - RNA, 20 nt, Vaccinia virus
aucuucucuccuuucaaacu

SEQ ID NO: 3268741 - RNA, 16 nt, Vaccinia virus
caaagauaaaaaccac

SEQ ID NO: 3268742 - RNA, 14 nt, Vaccinia virus
aaaguaauucauua

SEQ ID NO: 3268743 - RNA, 21 nt, Vaccinia virus
ugauacaacaauauaugugca

SEQ ID NO: 3268744 - RNA, 16 nt, Vaccinia virus
aaguaguauaaaagua

SEQ ID NO: 3268745 - RNA, 13 nt, Vaccinia virus
cuggauauguuuu

SEQ ID NO: 3268746 - RNA, 23 nt, Vaccinia virus
uauuugcacacauaauccauucu

SEQ ID NO: 3268747 - RNA, 11 nt, Vaccinia virus
gcgcaugauuu

SEQ ID NO: 3268748 - RNA, 14 nt, Vaccinia virus
acgauauuagaauu

SEQ ID NO: 3268749 - RNA, 22 nt, Vaccinia virus
agaugucguuagaaucauuuau

SEQ ID NO: 3268750 - RNA, 15 nt, Vaccinia virus
aguugaguuuauccu

SEQ ID NO: 3268751 - RNA, 21 nt, Vaccinia virus
auuaaacauuguucaugauau

SEQ ID NO: 3268752 - RNA, 17 nt, Vaccinia virus
uuuuagauuuuagcaua

SEQ ID NO: 3268753 - RNA, 23 nt, Vaccinia virus
auacuaguagcuucacaaagaug

SEQ ID NO: 3268754 - RNA, 14 nt, Vaccinia virus
uagagacaaugaaa

SEQ ID NO: 3268755 - RNA, 13 nt, Vaccinia virus
uaucuguuuccau

SEQ ID NO: 3268756 - RNA, 23 nt, Vaccinia virus
auaucuuguuuagaaaaaugcua

SEQ ID NO: 3268757 - RNA, 12 nt, Vaccinia virus
uuagcaauuuuc

SEQ ID NO: 3268758 - RNA, 17 nt, Vaccinia virus
agcuauugcauaauaca

SEQ ID NO: 3268759 - RNA, 23 nt, Vaccinia virus
ugugcucuuccagaguugggaua

SEQ ID NO: 3268760 - RNA, 15 nt, Vaccinia virus
auaucuauaugauug

SEQ ID NO: 3268761 - RNA, 14 nt, Vaccinia virus
aaaagauuauacaa

SEQ ID NO: 3268762 - RNA, 20 nt, Vaccinia virus
cacaagauuuccaaucuuug

SEQ ID NO: 3268763 - RNA, 20 nt, Vaccinia virus
uauugcaaaucacucaauau

SEQ ID NO: 3268764 - RNA, 18 nt, Vaccinia virus
uguauaacagagccaucu

SEQ ID NO: 3268765 - RNA, 15 nt, Vaccinia virus
aacaaaguuauucau

SEQ ID NO: 3268766 - RNA, 13 nt, Vaccinia virus
ucaauagguagua

SEQ ID NO: 3268767 - RNA, 13 nt, Vaccinia virus
acuuuguuaauaa

SEQ ID NO: 3268768 - RNA, 18 nt, Vaccinia virus
auauucuuuuuuuauaga

SEQ ID NO: 3268769 - RNA, 21 nt, Vaccinia virus
acuauauaaaccgcuauugaa

SEQ ID NO: 3268770 - RNA, 16 nt, Vaccinia virus
aauauuauuaugaaga

SEQ ID NO: 3268771 - RNA, 19 nt, Vaccinia virus
auucguugaugaauuauua

SEQ ID NO: 3268772 - RNA, 16 nt, Vaccinia virus
cgacucauuauuuccc

SEQ ID NO: 3268773 - RNA, 15 nt, Vaccinia virus
acuauuauuauugaa

SEQ ID NO: 3268774 - RNA, 13 nt, Vaccinia virus
augagauguuauu

SEQ ID NO: 3268775 - RNA, 19 nt, Vaccinia virus
agaaaaaugauuaucuucu

SEQ ID NO: 3268776 - RNA, 17 nt, Vaccinia virus
auaauagcaacauauga

SEQ ID NO: 3268777 - RNA, 21 nt, Vaccinia virus
aauuauaauauaaaaauacuu

SEQ ID NO: 3268778 - RNA, 14 nt, Vaccinia virus
uacuaaaggaugag

SEQ ID NO: 3268779 - RNA, 19 nt, Vaccinia virus
gcaaaucacucaauaucua

SEQ ID NO: 3268780 - RNA, 13 nt, Vaccinia virus
aaccgaaaguaaa

SEQ ID NO: 3268781 - RNA, 23 nt, Vaccinia virus
agagauccacugucacuggaaag

SEQ ID NO: 3268782 - RNA, 20 nt, Vaccinia virus
ugcucaaacaaaaugugaua

SEQ ID NO: 3268783 - RNA, 17 nt, Vaccinia virus
aagugucgauuguaaua

SEQ ID NO: 3268784 - RNA, 22 nt, Vaccinia virus
aaaaauuuuaagcgaugauaug

SEQ ID NO: 3268785 - RNA, 22 nt, Vaccinia virus
ugauagugaaugaaucagauag

SEQ ID NO: 3268786 - RNA, 14 nt, Vaccinia virus
auauaaucuagaca

SEQ ID NO: 3268787 - RNA, 22 nt, Vaccinia virus
aauaccgacgcgccugaauauc

SEQ ID NO: 3268788 - RNA, 14 nt, Vaccinia virus
cuguaaucuauagg

SEQ ID NO: 3268789 - RNA, 18 nt, Vaccinia virus
uucagcggauccuguauu

SEQ ID NO: 3268790 - RNA, 15 nt, Vaccinia virus
aagaaguuauagaca

SEQ ID NO: 3268791 - RNA, 16 nt, Vaccinia virus
aaaaagaaagaauaua

SEQ ID NO: 3268792 - RNA, 23 nt, Vaccinia virus
aucaagucuuuauacaaugacau

SEQ ID NO: 3268793 - RNA, 21 nt, Vaccinia virus
uccuucuaaaguaaguaugau

SEQ ID NO: 3268794 - RNA, 14 nt, Vaccinia virus
acuuaaguuguaaa

SEQ ID NO: 3268795 - RNA, 19 nt, Vaccinia virus
ugacuaguccaaagacuua

SEQ ID NO: 3268796 - RNA, 12 nt, Vaccinia virus
cuaaaaacugua

SEQ ID NO: 3268797 - RNA, 13 nt, Vaccinia virus
cgcgucuguuuua

SEQ ID NO: 3268798 - RNA, 18 nt, Vaccinia virus
cggguaccuucacaucuc

SEQ ID NO: 3268799 - RNA, 21 nt, Vaccinia virus
acacuauugaacgauuuaucu

SEQ ID NO: 3268800 - RNA, 20 nt, Vaccinia virus
ucauggaaacaaaugaaaca

SEQ ID NO: 3268801 - RNA, 14 nt, Vaccinia virus
ucaaaauauguuau

SEQ ID NO: 3268802 - RNA, 22 nt, Vaccinia virus
aaauugucugaugaagaauuau

SEQ ID NO: 3268803 - RNA, 17 nt, Vaccinia virus
auacaauggaugauaug

SEQ ID NO: 3268804 - RNA, 18 nt, Vaccinia virus
uaacguucuaacaucauu

SEQ ID NO: 3268805 - RNA, 16 nt, Vaccinia virus
caauaucguuaaagau

SEQ ID NO: 3268806 - RNA, 13 nt, Vaccinia virus
uauacaauuauca

SEQ ID NO: 3268807 - RNA, 21 nt, Vaccinia virus
aaucauaguuuuuacacauag

SEQ ID NO: 3268808 - RNA, 17 nt, Vaccinia virus
agauagacgaggaaaca

SEQ ID NO: 3268809 - RNA, 14 nt, Vaccinia virus
augguaaaggauaa

SEQ ID NO: 3268810 - RNA, 15 nt, Vaccinia virus
aagacaauaaagaua

SEQ ID NO: 3268811 - RNA, 13 nt, Vaccinia virus
aucuagccauuau

SEQ ID NO: 3268812 - RNA, 16 nt, Vaccinia virus
auagauucagaauuuc

SEQ ID NO: 3268813 - RNA, 23 nt, Vaccinia virus
ucaacgaugaaaacuuuaaauac

SEQ ID NO: 3268814 - RNA, 21 nt, Vaccinia virus
aauuuuauucuagaauugaua

SEQ ID NO: 3268815 - RNA, 22 nt, Vaccinia virus
acaaugaaccguaauauaucua

SEQ ID NO: 3268816 - RNA, 16 nt, Vaccinia virus
augcaccgaacaucca

SEQ ID NO: 3268817 - RNA, 16 nt, Vaccinia virus
cuacuaauguauacau

SEQ ID NO: 3268818 - RNA, 16 nt, Vaccinia virus
aaggaauuaauuauuc

SEQ ID NO: 3268819 - RNA, 23 nt, Vaccinia virus
aucuucacaaauuauaucauugu

SEQ ID NO: 3268820 - RNA, 11 nt, Vaccinia virus
uuaauaucuuu

SEQ ID NO: 3268821 - RNA, 20 nt, Vaccinia virus
acuccuagagaauuaauauc

SEQ ID NO: 3268822 - RNA, 21 nt, Vaccinia virus
uuuauaucauuuguuuuaauu

SEQ ID NO: 3268823 - RNA, 14 nt, Vaccinia virus
caugcucuauuuug

SEQ ID NO: 3268824 - RNA, 14 nt, Vaccinia virus
auuauauaauguau

SEQ ID NO: 3268825 - RNA, 16 nt, Vaccinia virus
agcaagagaaucauca

SEQ ID NO: 3268826 - RNA, 16 nt, Vaccinia virus
cgacuuuguuaaugac

SEQ ID NO: 3268827 - RNA, 14 nt, Vaccinia virus
auucaguaaauaga

SEQ ID NO: 3268828 - RNA, 22 nt, Vaccinia virus
aguagagauucggguacuguau

SEQ ID NO: 3268829 - RNA, 22 nt, Vaccinia virus
uauccucagacucugauuugaa

SEQ ID NO: 3268830 - RNA, 22 nt, Vaccinia virus
ugcucuacaugcgguaaagaua

SEQ ID NO: 3268831 - RNA, 15 nt, Vaccinia virus
uaauaacuugaaaga

SEQ ID NO: 3268832 - RNA, 18 nt, Vaccinia virus
cauuuggucuauacaaau

SEQ ID NO: 3268833 - RNA, 23 nt, Vaccinia virus
aucuagacaccagcgucuacaug

SEQ ID NO: 3268834 - RNA, 18 nt, Vaccinia virus
uaucaaaaucuugucugc

SEQ ID NO: 3268835 - RNA, 14 nt, Vaccinia virus
aucuaaaaacaaua

SEQ ID NO: 3268836 - RNA, 21 nt, Vaccinia virus
augauaugauuuuuaaucaag

SEQ ID NO: 3268837 - RNA, 19 nt, Vaccinia virus
cucaaaagaucaaggaaau

SEQ ID NO: 3268838 - RNA, 14 nt, Vaccinia virus
acaucgacucauaa

SEQ ID NO: 3268839 - RNA, 21 nt, Vaccinia virus
uauuuauaaacuuuauccaua

SEQ ID NO: 3268840 - RNA, 19 nt, Vaccinia virus
aacuucuaaucuuguaaua

SEQ ID NO: 3268841 - RNA, 16 nt, Vaccinia virus
auauauuaaaaaaugu

SEQ ID NO: 3268842 - RNA, 21 nt, Vaccinia virus
uauaauuuacagcuauagcau

SEQ ID NO: 3268843 - RNA, 18 nt, Vaccinia virus
uauaggaccacuagcaaa

SEQ ID NO: 3268844 - RNA, 15 nt, Vaccinia virus
acucuacuaguucca

SEQ ID NO: 3268845 - RNA, 23 nt, Vaccinia virus
ccugguaagauaucuuuauauuc

SEQ ID NO: 3268846 - RNA, 16 nt, Vaccinia virus
uuucuauauagcuauu

SEQ ID NO: 3268847 - RNA, 16 nt, Vaccinia virus
agaaauuaucaaaugu

SEQ ID NO: 3268848 - RNA, 19 nt, Vaccinia virus
cacagaacaguaaauguuc

SEQ ID NO: 3268849 - RNA, 14 nt, Vaccinia virus
auuguacuuuguaa

SEQ ID NO: 3268850 - RNA, 22 nt, Vaccinia virus
aguauuaucaacguaacuauau

SEQ ID NO: 3268851 - RNA, 13 nt, Vaccinia virus
uacuuucuaauau

SEQ ID NO: 3268852 - RNA, 11 nt, Vaccinia virus
gccaaauguac

SEQ ID NO: 3268853 - RNA, 13 nt, Vaccinia virus
ucgaauaaaguau

SEQ ID NO: 3268854 - RNA, 13 nt, Vaccinia virus
aguauaucaaaua

SEQ ID NO: 3268855 - RNA, 12 nt, Vaccinia virus
auauaaagaaau

SEQ ID NO: 3268856 - RNA, 16 nt, Vaccinia virus
cgacgacaauaguguu

SEQ ID NO: 3268857 - RNA, 19 nt, Vaccinia virus
auuucaguuuauguuugua

SEQ ID NO: 3268858 - RNA, 22 nt, Vaccinia virus
aaauaaaccguuuaauauugau

SEQ ID NO: 3268859 - RNA, 23 nt, Vaccinia virus
aagaacguaaaauacauaugaca

SEQ ID NO: 3268860 - RNA, 13 nt, Vaccinia virus
auucuaaaugaug

SEQ ID NO: 3268861 - RNA, 21 nt, Vaccinia virus
aauaguacgacuuuaaaucca

SEQ ID NO: 3268862 - RNA, 23 nt, Vaccinia virus
agauuagucagaccauucuuggu

SEQ ID NO: 3268863 - RNA, 15 nt, Vaccinia virus
cucauuuucucuuuc

SEQ ID NO: 3268864 - RNA, 16 nt, Vaccinia virus
cuauaaaaauggauuu

SEQ ID NO: 3268865 - RNA, 21 nt, Vaccinia virus
acggggauuucguagaaguug

SEQ ID NO: 3268866 - RNA, 15 nt, Vaccinia virus
uaguuuguuucugga

SEQ ID NO: 3268867 - RNA, 13 nt, Vaccinia virus
aguuauaugaaua

SEQ ID NO: 3268868 - RNA, 18 nt, Vaccinia virus
cauuaaaucuauuauauu

SEQ ID NO: 3268869 - RNA, 19 nt, Vaccinia virus
gcagacuagaaauaacagg

SEQ ID NO: 3268870 - RNA, 17 nt, Vaccinia virus
cuacgaaaacgaaaucu

SEQ ID NO: 3268871 - RNA, 14 nt, Vaccinia virus
ggauagagaaauau

SEQ ID NO: 3268872 - RNA, 18 nt, Vaccinia virus
ugugacuguuuucucauc

SEQ ID NO: 3268873 - RNA, 17 nt, Vaccinia virus
auaaugucugacuagau

SEQ ID NO: 3268874 - RNA, 13 nt, Vaccinia virus
auccucaaacauc

SEQ ID NO: 3268875 - RNA, 20 nt, Vaccinia virus
aucuuauccuuggacaagau

SEQ ID NO: 3268876 - RNA, 16 nt, Vaccinia virus
cuuucuccuguaaaga

SEQ ID NO: 3268877 - RNA, 14 nt, Vaccinia virus
aauaauuuaacaau

SEQ ID NO: 3268878 - RNA, 19 nt, Vaccinia virus
gaaaucauguuauaguguu

SEQ ID NO: 3268879 - RNA, 21 nt, Vaccinia virus
gacugccacguuagaggauga

SEQ ID NO: 3268880 - RNA, 22 nt, Vaccinia virus
uugcugucgaagaggcaaaaga

SEQ ID NO: 3268881 - RNA, 19 nt, Vaccinia virus
acuuuaacguauaaaugac

SEQ ID NO: 3268882 - RNA, 23 nt, Vaccinia virus
guacauggaugauauagauauga

SEQ ID NO: 3268883 - RNA, 13 nt, Vaccinia virus
caaucuuuaaugu

SEQ ID NO: 3268884 - RNA, 12 nt, Vaccinia virus
gacaauaaucuc

SEQ ID NO: 3268885 - RNA, 23 nt, Vaccinia virus
acauguaucgacgguaaauggaa

SEQ ID NO: 3268886 - RNA, 15 nt, Vaccinia virus
aauuuacauguucau

SEQ ID NO: 3268887 - RNA, 16 nt, Vaccinia virus
uuaacuuucaucuaau

SEQ ID NO: 3268888 - RNA, 12 nt, Vaccinia virus
uuaauaugagua

SEQ ID NO: 3268889 - RNA, 17 nt, Vaccinia virus
aggaucuacauccucga

SEQ ID NO: 3268890 - RNA, 17 nt, Vaccinia virus
aacaacugaaaaaaauu

SEQ ID NO: 3268891 - RNA, 12 nt, Vaccinia virus
ucgacauauuaa

SEQ ID NO: 3268892 - RNA, 23 nt, Vaccinia virus
ucuuucgcagcauaaguaguaug

SEQ ID NO: 3268893 - RNA, 21 nt, Vaccinia virus
aucuguuccucaucugucaua

SEQ ID NO: 3268894 - RNA, 13 nt, Vaccinia virus
uagaaaauggauu

SEQ ID NO: 3268895 - RNA, 19 nt, Vaccinia virus
ucugaauuauuucauauau

SEQ ID NO: 3268896 - RNA, 16 nt, Vaccinia virus
ccaguggcuaagauac

SEQ ID NO: 3268897 - RNA, 16 nt, Vaccinia virus
acauacuaucuuuaau

SEQ ID NO: 3268898 - RNA, 14 nt, Vaccinia virus
acguucuuuaauuu

SEQ ID NO: 3268899 - RNA, 14 nt, Vaccinia virus
gacuauaacagaua

SEQ ID NO: 3268900 - RNA, 17 nt, Vaccinia virus
cuuugcaaauuguauau

SEQ ID NO: 3268901 - RNA, 21 nt, Vaccinia virus
uagacaaugcuaauauauucu

SEQ ID NO: 3268902 - RNA, 19 nt, Vaccinia virus
aucaaagucacaaagcaag

SEQ ID NO: 3268903 - RNA, 21 nt, Vaccinia virus
agaaauaacaggcuaaaaugu

SEQ ID NO: 3268904 - RNA, 24 nt, Vaccinia virus
auucucucaacaucuucaauggau

SEQ ID NO: 3268905 - RNA, 17 nt, Vaccinia virus
aaugcgauacagacauu

SEQ ID NO: 3268906 - RNA, 16 nt, Vaccinia virus
ucgcuauuucuauaga

SEQ ID NO: 3268907 - RNA, 16 nt, Vaccinia virus
uucuggauauguuuuu

SEQ ID NO: 3268908 - RNA, 21 nt, Vaccinia virus
uuuuucgcgggauacaucauc

SEQ ID NO: 3268909 - RNA, 14 nt, Vaccinia virus
auccaaaaaaugaa

SEQ ID NO: 3268910 - RNA, 16 nt, Vaccinia virus
ucuuuaucucuuagua

SEQ ID NO: 3268911 - RNA, 20 nt, Vaccinia virus
uuauaucaauaccaaagaag

SEQ ID NO: 3268912 - RNA, 19 nt, Vaccinia virus
agauagcuuuagcuaauau

SEQ ID NO: 3268913 - RNA, 22 nt, Vaccinia virus
ccauauguuuggagcaaauauc

SEQ ID NO: 3268914 - RNA, 20 nt, Vaccinia virus
ucuacuaggcugacacuaug

SEQ ID NO: 3268915 - RNA, 22 nt, Vaccinia virus
aaagaguugguaaaauaugaaa

SEQ ID NO: 3268916 - RNA, 21 nt, Vaccinia virus
ccgauauauuugcacacauaa

SEQ ID NO: 3268917 - RNA, 15 nt, Vaccinia virus
auuauacaaaaauuu

SEQ ID NO: 3268918 - RNA, 22 nt, Vaccinia virus
aguuuucuuucaaaauagcuau

SEQ ID NO: 3268919 - RNA, 11 nt, Vaccinia virus
gacaaauguaa

SEQ ID NO: 3268920 - RNA, 13 nt, Vaccinia virus
aaacaauguuaug

SEQ ID NO: 3268921 - RNA, 12 nt, Vaccinia virus
agaaauacuucu

SEQ ID NO: 3268922 - RNA, 21 nt, Vaccinia virus
accuaccucucuuaaaauggu

SEQ ID NO: 3268923 - RNA, 18 nt, Vaccinia virus
uaauuugguauauacaua

SEQ ID NO: 3268924 - RNA, 20 nt, Vaccinia virus
gacuaucaacaauuuuguau

SEQ ID NO: 3268925 - RNA, 16 nt, Vaccinia virus
auuuaagguacuagau

SEQ ID NO: 3268926 - RNA, 13 nt, Vaccinia virus
cucauuaacaucu

SEQ ID NO: 3268927 - RNA, 18 nt, Vaccinia virus
acgauguaguuagauaga

SEQ ID NO: 3268928 - RNA, 16 nt, Vaccinia virus
aauaauaguagaauua

SEQ ID NO: 3268929 - RNA, 18 nt, Vaccinia virus
auauuccaagaucaaaag

SEQ ID NO: 3268930 - RNA, 22 nt, Vaccinia virus
uuagacuguuuguagaaugcug

SEQ ID NO: 3268931 - RNA, 19 nt, Vaccinia virus
caauauugaaaauacuaau

SEQ ID NO: 3268932 - RNA, 21 nt, Vaccinia virus
uccauauuuucugguaguguu

SEQ ID NO: 3268933 - RNA, 16 nt, Vaccinia virus
aacagucgaacaaucu

SEQ ID NO: 3268934 - RNA, 14 nt, Vaccinia virus
uggugcauaucuuu

SEQ ID NO: 3268935 - RNA, 15 nt, Vaccinia virus
guugaaauagaaaau

SEQ ID NO: 3268936 - RNA, 17 nt, Vaccinia virus
uaaucucuccagaguau

SEQ ID NO: 3268937 - RNA, 14 nt, Vaccinia virus
uaaaugauuuucug

SEQ ID NO: 3268938 - RNA, 15 nt, Vaccinia virus
auauuccauuaauga

SEQ ID NO: 3268939 - RNA, 23 nt, Vaccinia virus
auagagccaagacgaacaaaauc

SEQ ID NO: 3268940 - RNA, 19 nt, Vaccinia virus
uguauagacaauuauguaa

SEQ ID NO: 3268941 - RNA, 19 nt, Vaccinia virus
auaaguaguaauaaugauu

SEQ ID NO: 3268942 - RNA, 19 nt, Vaccinia virus
uaacuaaaaauguaaaaua

SEQ ID NO: 3268943 - RNA, 17 nt, Vaccinia virus
uaacaugugucauuuau

SEQ ID NO: 3268944 - RNA, 14 nt, Vaccinia virus
gacuacuuauucua

SEQ ID NO: 3268945 - RNA, 15 nt, Vaccinia virus
uaaacaauuucacaa

SEQ ID NO: 3268946 - RNA, 19 nt, Vaccinia virus
aggauauaaguagauguuc

SEQ ID NO: 3268947 - RNA, 15 nt, Vaccinia virus
gcucaguaaauguau

SEQ ID NO: 3268948 - RNA, 21 nt, Vaccinia virus
uuaauaguagucaguagacau

SEQ ID NO: 3268949 - RNA, 21 nt, Vaccinia virus
uuaaaugccuuccaaaguuua

SEQ ID NO: 3268950 - RNA, 20 nt, Vaccinia virus
uuccguuaauaauacuauuu

SEQ ID NO: 3268951 - RNA, 16 nt, Vaccinia virus
cguggaaucaauaauu

SEQ ID NO: 3268952 - RNA, 13 nt, Vaccinia virus
ugaacauucaucu

SEQ ID NO: 3268953 - RNA, 17 nt, Vaccinia virus
ucggauccuuuguacag

SEQ ID NO: 3268954 - RNA, 14 nt, Vaccinia virus
gagacuuaaacaac

SEQ ID NO: 3268955 - RNA, 15 nt, Vaccinia virus
caucucuauguuuca

SEQ ID NO: 3268956 - RNA, 21 nt, Vaccinia virus
auaacaaguuuccuguaaauu

SEQ ID NO: 3268957 - RNA, 17 nt, Vaccinia virus
caaugcucaguaaaugu

SEQ ID NO: 3268958 - RNA, 14 nt, Vaccinia virus
auaauuuacagcua

SEQ ID NO: 3268959 - RNA, 16 nt, Vaccinia virus
uagcagccaauacuuu

SEQ ID NO: 3268960 - RNA, 17 nt, Vaccinia virus
aguaauaucaugucuaa

SEQ ID NO: 3268961 - RNA, 14 nt, Vaccinia virus
auugaaaauuauuu

SEQ ID NO: 3268962 - RNA, 20 nt, Vaccinia virus
gauaaaaaggaaucuauuaa

SEQ ID NO: 3268963 - RNA, 20 nt, Vaccinia virus
acauuagccggacaaauaua

SEQ ID NO: 3268964 - RNA, 18 nt, Vaccinia virus
uuccacgaacuucuaauu

SEQ ID NO: 3268965 - RNA, 16 nt, Vaccinia virus
auugccaacucucaaa

SEQ ID NO: 3268966 - RNA, 15 nt, Vaccinia virus
auaauggcuguuugu

SEQ ID NO: 3268967 - RNA, 19 nt, Vaccinia virus
caacuucuccuuauugauu

SEQ ID NO: 3268968 - RNA, 23 nt, Vaccinia virus
accggcuguggaguuauaugaau

SEQ ID NO: 3268969 - RNA, 13 nt, Vaccinia virus
ucuaugcuauaaa

SEQ ID NO: 3268970 - RNA, 13 nt, Vaccinia virus
cacucugucauau

SEQ ID NO: 3268971 - RNA, 14 nt, Vaccinia virus
uaaugaaauuauuc

SEQ ID NO: 3268972 - RNA, 12 nt, Vaccinia virus
gauauuguuaaa

SEQ ID NO: 3268973 - RNA, 22 nt, Vaccinia virus
ugauaugauuuuuaaucaagau

SEQ ID NO: 3268974 - RNA, 18 nt, Vaccinia virus
auaguuacauacaaacug

SEQ ID NO: 3268975 - RNA, 21 nt, Vaccinia virus
auauuuauacccgcuaugaag

SEQ ID NO: 3268976 - RNA, 13 nt, Vaccinia virus
uagguauguacca

SEQ ID NO: 3268977 - RNA, 16 nt, Vaccinia virus
guauaaaaauuaaaca

SEQ ID NO: 3268978 - RNA, 16 nt, Vaccinia virus
acuaugccaaaugaau

SEQ ID NO: 3268979 - RNA, 14 nt, Vaccinia virus
cucuacaaauaucu

SEQ ID NO: 3268980 - RNA, 20 nt, Vaccinia virus
cuuccacuguccaaaaugau

SEQ ID NO: 3268981 - RNA, 21 nt, Vaccinia virus
aaaauaucacaggagcaaugu

SEQ ID NO: 3268982 - RNA, 13 nt, Vaccinia virus
guagauaaucauu

SEQ ID NO: 3268983 - RNA, 18 nt, Vaccinia virus
uaaaaaaccuccuucaug

SEQ ID NO: 3268984 - RNA, 15 nt, Vaccinia virus
aucugucaaguuacu

SEQ ID NO: 3268985 - RNA, 17 nt, Vaccinia virus
aauuauuauuacugaau

SEQ ID NO: 3268986 - RNA, 15 nt, Vaccinia virus
accgggaaagagaag

SEQ ID NO: 3268987 - RNA, 19 nt, Vaccinia virus
acauuguccaauccaggac

SEQ ID NO: 3268988 - RNA, 18 nt, Vaccinia virus
uaucaucgguucaacgau

SEQ ID NO: 3268989 - RNA, 14 nt, Vaccinia virus
uuauuuuuuuggaa

SEQ ID NO: 3268990 - RNA, 23 nt, Vaccinia virus
aaucugagauuuuacguaucuau

SEQ ID NO: 3268991 - RNA, 17 nt, Vaccinia virus
uaucaacguaacuauau

SEQ ID NO: 3268992 - RNA, 18 nt, Vaccinia virus
uaacucaaagacaucaua

SEQ ID NO: 3268993 - RNA, 22 nt, Vaccinia virus
gcgauagugagagugauaauau

SEQ ID NO: 3268994 - RNA, 15 nt, Vaccinia virus
aaagcauuaauacag

SEQ ID NO: 3268995 - RNA, 16 nt, Vaccinia virus
caccggaauacuauuc

SEQ ID NO: 3268996 - RNA, 15 nt, Vaccinia virus
uaaaggaugauacau

SEQ ID NO: 3268997 - RNA, 17 nt, Vaccinia virus
aggcacauaauaucuuu

SEQ ID NO: 3268998 - RNA, 16 nt, Vaccinia virus
agaacuuauuaaugaa

SEQ ID NO: 3268999 - RNA, 18 nt, Vaccinia virus
uuauugucgagcauauua

SEQ ID NO: 3269000 - RNA, 20 nt, Vaccinia virus
uguuauuguaguauaugaua

SEQ ID NO: 3269001 - RNA, 17 nt, Vaccinia virus
auuuggaaaagaaaauu

SEQ ID NO: 3269002 - RNA, 17 nt, Vaccinia virus
aauccuuuuuuauaaaa

SEQ ID NO: 3269003 - RNA, 16 nt, Vaccinia virus
gcaucuuaauccuucu

SEQ ID NO: 3269004 - RNA, 22 nt, Vaccinia virus
uuuacuguauauacuuagauau

SEQ ID NO: 3269005 - RNA, 21 nt, Vaccinia virus
uuggagaugaucauagauuca

SEQ ID NO: 3269006 - RNA, 15 nt, Vaccinia virus
uucuaaguucuaaug

SEQ ID NO: 3269007 - RNA, 15 nt, Vaccinia virus
ugaaaucgucacaau

SEQ ID NO: 3269008 - RNA, 15 nt, Vaccinia virus
aaauaauuagaacua

SEQ ID NO: 3269009 - RNA, 20 nt, Vaccinia virus
cuuuaauugucuugaugaag

SEQ ID NO: 3269010 - RNA, 13 nt, Vaccinia virus
auaugacaaacau

SEQ ID NO: 3269011 - RNA, 22 nt, Vaccinia virus
auaguucguguacuagucauaa

SEQ ID NO: 3269012 - RNA, 13 nt, Vaccinia virus
auuucuguaaauu

SEQ ID NO: 3269013 - RNA, 15 nt, Vaccinia virus
ucuauaccaauauua

SEQ ID NO: 3269014 - RNA, 15 nt, Vaccinia virus
aauuuuuaguuuaua

SEQ ID NO: 3269015 - RNA, 15 nt, Vaccinia virus
aguaucauuaaaucu

SEQ ID NO: 3269016 - RNA, 15 nt, Vaccinia virus
aauugaauugaugau

SEQ ID NO: 3269017 - RNA, 18 nt, Vaccinia virus
aguauacuaucgucauuu

SEQ ID NO: 3269018 - RNA, 22 nt, Vaccinia virus
agaacuuaugaccgugauaaaa

SEQ ID NO: 3269019 - RNA, 12 nt, Vaccinia virus
aucauaaaaaug

SEQ ID NO: 3269020 - RNA, 18 nt, Vaccinia virus
aauagauguauuugauau

SEQ ID NO: 3269021 - RNA, 18 nt, Vaccinia virus
cauagaccuguaguuuua

SEQ ID NO: 3269022 - RNA, 15 nt, Vaccinia virus
aauucgagaaagaua

SEQ ID NO: 3269023 - RNA, 18 nt, Vaccinia virus
uucacauugaaacuaugu

SEQ ID NO: 3269024 - RNA, 12 nt, Vaccinia virus
cguauacucuau

SEQ ID NO: 3269025 - RNA, 16 nt, Vaccinia virus
uuggaaccggcugugg

SEQ ID NO: 3269026 - RNA, 16 nt, Vaccinia virus
cuauaguuuguuuuca

SEQ ID NO: 3269027 - RNA, 17 nt, Vaccinia virus
uuguuaagacaaucgua

SEQ ID NO: 3269028 - RNA, 16 nt, Vaccinia virus
aacgucauaaaaaugu

SEQ ID NO: 3269029 - RNA, 18 nt, Vaccinia virus
uuaaaugggucuaguuuu

SEQ ID NO: 3269030 - RNA, 13 nt, Vaccinia virus
uucuuuuaucaua

SEQ ID NO: 3269031 - RNA, 20 nt, Vaccinia virus
ugggaaaaacgaaauuaucg

SEQ ID NO: 3269032 - RNA, 22 nt, Vaccinia virus
uaaauguuuuuaucaucuugga

SEQ ID NO: 3269033 - RNA, 16 nt, Vaccinia virus
aguaaguauuuauaca

SEQ ID NO: 3269034 - RNA, 17 nt, Vaccinia virus
uuucguaccaacucauu

SEQ ID NO: 3269035 - RNA, 22 nt, Vaccinia virus
auacuuagauauauuguagaua

SEQ ID NO: 3269036 - RNA, 16 nt, Vaccinia virus
acaaagcacucaauaa

SEQ ID NO: 3269037 - RNA, 14 nt, Vaccinia virus
auacuuuuaggaaa

SEQ ID NO: 3269038 - RNA, 17 nt, Vaccinia virus
aauauacugauuagaaa

SEQ ID NO: 3269039 - RNA, 14 nt, Vaccinia virus
gucauccuucacuc

SEQ ID NO: 3269040 - RNA, 21 nt, Vaccinia virus
uauaaauaguuuuuauguaua

SEQ ID NO: 3269041 - RNA, 23 nt, Vaccinia virus
ucagaacuuccaauaaaauuacu

SEQ ID NO: 3269042 - RNA, 20 nt, Vaccinia virus
uuuauuaucuauagccaauu

SEQ ID NO: 3269043 - RNA, 22 nt, Vaccinia virus
auccuuuuguuggaaaaaugau

SEQ ID NO: 3269044 - RNA, 18 nt, Vaccinia virus
auaggugcguuguauaca

SEQ ID NO: 3269045 - RNA, 13 nt, Vaccinia virus
accucaaaaauuu

SEQ ID NO: 3269046 - RNA, 20 nt, Vaccinia virus
agcauccguaugcuacuaga

SEQ ID NO: 3269047 - RNA, 21 nt, Vaccinia virus
acauaacuacguaucucaaua

SEQ ID NO: 3269048 - RNA, 22 nt, Vaccinia virus
gauuucauuaucgguguauuuu

SEQ ID NO: 3269049 - RNA, 14 nt, Vaccinia virus
uaauguaaaaucau

SEQ ID NO: 3269050 - RNA, 19 nt, Vaccinia virus
caucuggcuauuauguuua

SEQ ID NO: 3269051 - RNA, 18 nt, Vaccinia virus
agcaauuaugaaacaaua

SEQ ID NO: 3269052 - RNA, 20 nt, Vaccinia virus
ucuuccugguauauuucuau

SEQ ID NO: 3269053 - RNA, 16 nt, Vaccinia virus
uaaucauauaaaucau

SEQ ID NO: 3269054 - RNA, 14 nt, Vaccinia virus
aucaaacauuuaau

SEQ ID NO: 3269055 - RNA, 15 nt, Vaccinia virus
guuaagcauauccug

SEQ ID NO: 3269056 - RNA, 20 nt, Vaccinia virus
uauauuuuccaugaaaucaa

SEQ ID NO: 3269057 - RNA, 21 nt, Vaccinia virus
guagaacaacgauuuaaucau

SEQ ID NO: 3269058 - RNA, 24 nt, Vaccinia virus
auaguauacacgcuaaaauaacua

SEQ ID NO: 3269059 - RNA, 16 nt, Vaccinia virus
auaauaaccagaaagu

SEQ ID NO: 3269060 - RNA, 20 nt, Vaccinia virus
acauaguguuuuauauucca

SEQ ID NO: 3269061 - RNA, 17 nt, Vaccinia virus
caguguacguauauuua

SEQ ID NO: 3269062 - RNA, 15 nt, Vaccinia virus
aacuuugauuauccu

SEQ ID NO: 3269063 - RNA, 16 nt, Vaccinia virus
uugauaucacauauuu

SEQ ID NO: 3269064 - RNA, 12 nt, Vaccinia virus
uggagaaauacu

SEQ ID NO: 3269065 - RNA, 15 nt, Vaccinia virus
uuacuuuuucaaaga

SEQ ID NO: 3269066 - RNA, 23 nt, Vaccinia virus
aagauaggggaguaguugaaauc

SEQ ID NO: 3269067 - RNA, 17 nt, Vaccinia virus
uuagauccaacauuaau

SEQ ID NO: 3269068 - RNA, 15 nt, Vaccinia virus
cuagaggagaaguaa

SEQ ID NO: 3269069 - RNA, 19 nt, Vaccinia virus
aguuccgcauuaaaugaug

SEQ ID NO: 3269070 - RNA, 21 nt, Vaccinia virus
aaauuuuugguucuucucuaa

SEQ ID NO: 3269071 - RNA, 20 nt, Vaccinia virus
ucauugguugcgucaagaac

SEQ ID NO: 3269072 - RNA, 16 nt, Vaccinia virus
ucagauauaaaaaucu

SEQ ID NO: 3269073 - RNA, 20 nt, Vaccinia virus
ugauaaagauauuuauccuu

SEQ ID NO: 3269074 - RNA, 15 nt, Vaccinia virus
aaggacauuguaaau

SEQ ID NO: 3269075 - RNA, 21 nt, Vaccinia virus
aaaauuauguuuuuauaucua

SEQ ID NO: 3269076 - RNA, 20 nt, Vaccinia virus
agguaagauaucuacuagaa

SEQ ID NO: 3269077 - RNA, 18 nt, Vaccinia virus
aucgugcagguuaaauag

SEQ ID NO: 3269078 - RNA, 20 nt, Vaccinia virus
cuuugcguaucucagucugu

SEQ ID NO: 3269079 - RNA, 16 nt, Vaccinia virus
augauucuaacgacau

SEQ ID NO: 3269080 - RNA, 18 nt, Vaccinia virus
aagacugcugaauguauc

SEQ ID NO: 3269081 - RNA, 19 nt, Vaccinia virus
gaacauucuccgauaucua

SEQ ID NO: 3269082 - RNA, 22 nt, Vaccinia virus
aaguuuuucacccauaaauaau

SEQ ID NO: 3269083 - RNA, 15 nt, Vaccinia virus
cuaucuauauguuuu

SEQ ID NO: 3269084 - RNA, 15 nt, Vaccinia virus
aaugauuuuggaaaa

SEQ ID NO: 3269085 - RNA, 17 nt, Vaccinia virus
uuuacgguaucuaauau

SEQ ID NO: 3269086 - RNA, 21 nt, Vaccinia virus
gaguacauuucacagaaacac

SEQ ID NO: 3269087 - RNA, 15 nt, Vaccinia virus
agcuguucaaaauau

SEQ ID NO: 3269088 - RNA, 15 nt, Vaccinia virus
acacaauuaacaaua

SEQ ID NO: 3269089 - RNA, 17 nt, Vaccinia virus
uuucgauuucuggauau

SEQ ID NO: 3269090 - RNA, 18 nt, Vaccinia virus
gaauucuucaauaaaaug

SEQ ID NO: 3269091 - RNA, 14 nt, Vaccinia virus
cuuggaaauuauuu

SEQ ID NO: 3269092 - RNA, 23 nt, Vaccinia virus
uuuaauaugaaaaaaauaaacau

SEQ ID NO: 3269093 - RNA, 20 nt, Vaccinia virus
auacauuauuacuaaacauu

SEQ ID NO: 3269094 - RNA, 15 nt, Vaccinia virus
ucucuauguuucagu

SEQ ID NO: 3269095 - RNA, 15 nt, Vaccinia virus
ccaucauccaagaaa

SEQ ID NO: 3269096 - RNA, 18 nt, Vaccinia virus
gaauacgaugauauuaaa

SEQ ID NO: 3269097 - RNA, 21 nt, Vaccinia virus
aauguauccggccaauugaua

SEQ ID NO: 3269098 - RNA, 13 nt, Vaccinia virus
aaaaacugauauu

SEQ ID NO: 3269099 - RNA, 21 nt, Vaccinia virus
acuccucuauuuaauacuuua

SEQ ID NO: 3269100 - RNA, 17 nt, Vaccinia virus
acucugggucauauuau

SEQ ID NO: 3269101 - RNA, 13 nt, Vaccinia virus
ccaaccuuuguug

SEQ ID NO: 3269102 - RNA, 19 nt, Vaccinia virus
acaauguccaaaucuauau

SEQ ID NO: 3269103 - RNA, 14 nt, Vaccinia virus
gagaugucugaaac

SEQ ID NO: 3269104 - RNA, 14 nt, Vaccinia virus
auauucugaauaua

SEQ ID NO: 3269105 - RNA, 19 nt, Vaccinia virus
ccuaauacaucucuggaaa

SEQ ID NO: 3269106 - RNA, 18 nt, Vaccinia virus
cuaguggauguacaugua

SEQ ID NO: 3269107 - RNA, 14 nt, Vaccinia virus
uacuuuuuacuaau

SEQ ID NO: 3269108 - RNA, 13 nt, Vaccinia virus
cggauaguuuaag

SEQ ID NO: 3269109 - RNA, 19 nt, Vaccinia virus
uuuuccagaucuauugacu

SEQ ID NO: 3269110 - RNA, 19 nt, Vaccinia virus
uauuauaaacucucaacau

SEQ ID NO: 3269111 - RNA, 22 nt, Vaccinia virus
uuagauuuauuuuuauaaaguu

SEQ ID NO: 3269112 - RNA, 17 nt, Vaccinia virus
gauacugguuugauaaa

SEQ ID NO: 3269113 - RNA, 15 nt, Vaccinia virus
aaaauggauuacuua

SEQ ID NO: 3269114 - RNA, 13 nt, Vaccinia virus
acuguuuaauagc

SEQ ID NO: 3269115 - RNA, 16 nt, Vaccinia virus
aacucuugaagaugau

SEQ ID NO: 3269116 - RNA, 18 nt, Vaccinia virus
uucuaguucucuuuugua

SEQ ID NO: 3269117 - RNA, 18 nt, Vaccinia virus
guucuuucgauuuggaaa

SEQ ID NO: 3269118 - RNA, 15 nt, Vaccinia virus
aaauauaauaacgau

SEQ ID NO: 3269119 - RNA, 22 nt, Vaccinia virus
cuaaauuuuguugauuacucuu

SEQ ID NO: 3269120 - RNA, 14 nt, Vaccinia virus
auacugagaauuga

SEQ ID NO: 3269121 - RNA, 14 nt, Vaccinia virus
ucaaaauauguaga

SEQ ID NO: 3269122 - RNA, 23 nt, Vaccinia virus
ugauuucgacggagaugaagaau

SEQ ID NO: 3269123 - RNA, 23 nt, Vaccinia virus
agaauauaaauuauauauggauu

SEQ ID NO: 3269124 - RNA, 23 nt, Vaccinia virus
aaugcuucucuguuuaaugaauu

SEQ ID NO: 3269125 - RNA, 14 nt, Vaccinia virus
acaauuuuaacaga

SEQ ID NO: 3269126 - RNA, 12 nt, Vaccinia virus
aauuaugauaca

SEQ ID NO: 3269127 - RNA, 17 nt, Vaccinia virus
aauauauugaucauaau

SEQ ID NO: 3269128 - RNA, 21 nt, Vaccinia virus
cuauauagcuauucuucuuua

SEQ ID NO: 3269129 - RNA, 21 nt, Vaccinia virus
auucugaauagugaaaaccuu

SEQ ID NO: 3269130 - RNA, 14 nt, Vaccinia virus
aaauauauacuuca

SEQ ID NO: 3269131 - RNA, 20 nt, Vaccinia virus
aacucuauaguuuguuuuca

SEQ ID NO: 3269132 - RNA, 20 nt, Vaccinia virus
uugauuaccacgucuggaua

SEQ ID NO: 3269133 - RNA, 23 nt, Vaccinia virus
cugacauaaacauaucaaaagaa

SEQ ID NO: 3269134 - RNA, 18 nt, Vaccinia virus
caucuacuuuugucauau

SEQ ID NO: 3269135 - RNA, 19 nt, Vaccinia virus
cuaacagcaauaguauaau

SEQ ID NO: 3269136 - RNA, 14 nt, Vaccinia virus
uuuaacuuuucauu

SEQ ID NO: 3269137 - RNA, 20 nt, Vaccinia virus
uccagccguagaauaucuaa

SEQ ID NO: 3269138 - RNA, 19 nt, Vaccinia virus
cagcacggugguagauaua

SEQ ID NO: 3269139 - RNA, 20 nt, Vaccinia virus
agaaucccauagggcuaaau

SEQ ID NO: 3269140 - RNA, 20 nt, Vaccinia virus
uaucaagauguaaaauacuu

SEQ ID NO: 3269141 - RNA, 13 nt, Vaccinia virus
auuuuagacacua

SEQ ID NO: 3269142 - RNA, 21 nt, Vaccinia virus
auuuaagugauauaaaacuau

SEQ ID NO: 3269143 - RNA, 15 nt, Vaccinia virus
gaauuuuuauacauu

SEQ ID NO: 3269144 - RNA, 14 nt, Vaccinia virus
aucguaaaucuguu

SEQ ID NO: 3269145 - RNA, 17 nt, Vaccinia virus
aacauuuuauaaauaua

SEQ ID NO: 3269146 - RNA, 13 nt, Vaccinia virus
cagaaaagauauu

SEQ ID NO: 3269147 - RNA, 17 nt, Vaccinia virus
aaaaugguaaacuuuug

SEQ ID NO: 3269148 - RNA, 22 nt, Vaccinia virus
agauuugguaaaaugaaauauc

SEQ ID NO: 3269149 - RNA, 18 nt, Vaccinia virus
aacaucaacugaaaaagu

SEQ ID NO: 3269150 - RNA, 16 nt, Vaccinia virus
acguaaccaagaaguu

SEQ ID NO: 3269151 - RNA, 12 nt, Vaccinia virus
uauugacaaaua

SEQ ID NO: 3269152 - RNA, 23 nt, Vaccinia virus
uuaaauuuagagauaauauccug

SEQ ID NO: 3269153 - RNA, 20 nt, Vaccinia virus
aaaucauuacuaauacucaa

SEQ ID NO: 3269154 - RNA, 18 nt, Vaccinia virus
uguccaugcggauacuuu

SEQ ID NO: 3269155 - RNA, 14 nt, Vaccinia virus
accauuaaaaauug

SEQ ID NO: 3269156 - RNA, 19 nt, Vaccinia virus
auaauugagauugauguaa

SEQ ID NO: 3269157 - RNA, 20 nt, Vaccinia virus
caucccauauauuccaugaa

SEQ ID NO: 3269158 - RNA, 15 nt, Vaccinia virus
auguuauaaaaucua

SEQ ID NO: 3269159 - RNA, 17 nt, Vaccinia virus
gacaacaaaaaaugaau

SEQ ID NO: 3269160 - RNA, 13 nt, Vaccinia virus
auuauuaauaaag

SEQ ID NO: 3269161 - RNA, 22 nt, Vaccinia virus
ucaaugucuuaauaagaagugu

SEQ ID NO: 3269162 - RNA, 16 nt, Vaccinia virus
auuacuccauuaaaua

SEQ ID NO: 3269163 - RNA, 20 nt, Vaccinia virus
uauagauggcuuguauguca

SEQ ID NO: 3269164 - RNA, 14 nt, Vaccinia virus
acaugggaaaugau

SEQ ID NO: 3269165 - RNA, 17 nt, Vaccinia virus
acuuuguggaugaugau

SEQ ID NO: 3269166 - RNA, 13 nt, Vaccinia virus
auaggaacauuuc

SEQ ID NO: 3269167 - RNA, 10 nt, Vaccinia virus
aacauauucu

SEQ ID NO: 3269168 - RNA, 18 nt, Vaccinia virus
auauaucccuuaaaaauu

SEQ ID NO: 3269169 - RNA, 16 nt, Vaccinia virus
cuuuucuaaauucaua

SEQ ID NO: 3269170 - RNA, 21 nt, Vaccinia virus
auuaacagguucucaauauua

SEQ ID NO: 3269171 - RNA, 19 nt, Vaccinia virus
auauccguuaaguuuguau

SEQ ID NO: 3269172 - RNA, 17 nt, Vaccinia virus
aaaauauauaaugaaua

SEQ ID NO: 3269173 - RNA, 15 nt, Vaccinia virus
augagcaaguagaaa

SEQ ID NO: 3269174 - RNA, 17 nt, Vaccinia virus
gauaucgagaucuuuug

SEQ ID NO: 3269175 - RNA, 14 nt, Vaccinia virus
cuauguuguuuaug

SEQ ID NO: 3269176 - RNA, 16 nt, Vaccinia virus
auuauuccuaauuaag

SEQ ID NO: 3269177 - RNA, 16 nt, Vaccinia virus
auaaacuuaacccauu

SEQ ID NO: 3269178 - RNA, 12 nt, Vaccinia virus
auuccaaagauc

SEQ ID NO: 3269179 - RNA, 23 nt, Vaccinia virus
acuucacauuuuaaauaaauguc

SEQ ID NO: 3269180 - RNA, 16 nt, Vaccinia virus
uuucacccauaaauaa

SEQ ID NO: 3269181 - RNA, 23 nt, Vaccinia virus
guuauugcuuugguuuaauuauu

SEQ ID NO: 3269182 - RNA, 17 nt, Vaccinia virus
uaguuuuuuuguuuccu

SEQ ID NO: 3269183 - RNA, 22 nt, Vaccinia virus
auccuaaagguaaauguaaauu

SEQ ID NO: 3269184 - RNA, 21 nt, Vaccinia virus
auuaucaaagucacaaagcaa

SEQ ID NO: 3269185 - RNA, 18 nt, Vaccinia virus
uuugauaaauuucuucuu

SEQ ID NO: 3269186 - RNA, 18 nt, Vaccinia virus
auaguuaccgcaaagaaa

SEQ ID NO: 3269187 - RNA, 21 nt, Vaccinia virus
auagaaucggacgucugauau

SEQ ID NO: 3269188 - RNA, 19 nt, Vaccinia virus
aauaauuguuuugaauuuc

SEQ ID NO: 3269189 - RNA, 23 nt, Vaccinia virus
acaugguuaaaguacauguacaa

SEQ ID NO: 3269190 - RNA, 21 nt, Vaccinia virus
aauguacuucgaugagauuga

SEQ ID NO: 3269191 - RNA, 22 nt, Vaccinia virus
gucuaucgccuuagauacuuuu

SEQ ID NO: 3269192 - RNA, 15 nt, Vaccinia virus
uucuuggauaaaagc

SEQ ID NO: 3269193 - RNA, 14 nt, Vaccinia virus
auaaugaacauagu

SEQ ID NO: 3269194 - RNA, 17 nt, Vaccinia virus
gcgaauaaauagauaua

SEQ ID NO: 3269195 - RNA, 12 nt, Vaccinia virus
uugaaacuuuuu

SEQ ID NO: 3269196 - RNA, 21 nt, Vaccinia virus
aagauuguuuaagaagagaau

SEQ ID NO: 3269197 - RNA, 15 nt, Vaccinia virus
aauaucaacaagucc

SEQ ID NO: 3269198 - RNA, 14 nt, Vaccinia virus
cgagauacagaaaa

SEQ ID NO: 3269199 - RNA, 13 nt, Vaccinia virus
aaaagaauugcuu

SEQ ID NO: 3269200 - RNA, 15 nt, Vaccinia virus
uacaugcuacaugug

SEQ ID NO: 3269201 - RNA, 19 nt, Vaccinia virus
auucacagacucucaagau

SEQ ID NO: 3269202 - RNA, 23 nt, Vaccinia virus
auauguggaaaugucauagaaag

SEQ ID NO: 3269203 - RNA, 16 nt, Vaccinia virus
uauacaauuuguggaa

SEQ ID NO: 3269204 - RNA, 18 nt, Vaccinia virus
uacuuauuaguaaaacua

SEQ ID NO: 3269205 - RNA, 15 nt, Vaccinia virus
cuuaugaggaaugau

SEQ ID NO: 3269206 - RNA, 23 nt, Vaccinia virus
cauuguuauugaucaaacauuua

SEQ ID NO: 3269207 - RNA, 11 nt, Vaccinia virus
ugauagauauu

SEQ ID NO: 3269208 - RNA, 22 nt, Vaccinia virus
acggaguuuauuuuauaugucu

SEQ ID NO: 3269209 - RNA, 20 nt, Vaccinia virus
cuaccuuacccauaaacaau

SEQ ID NO: 3269210 - RNA, 13 nt, Vaccinia virus
uaaauauaaacac

SEQ ID NO: 3269211 - RNA, 17 nt, Vaccinia virus
aacgauuuacuguggcu

SEQ ID NO: 3269212 - RNA, 21 nt, Vaccinia virus
aacgaguacaaguagaacuua

SEQ ID NO: 3269213 - RNA, 21 nt, Vaccinia virus
aacaucauuauuuuugaagau

SEQ ID NO: 3269214 - RNA, 16 nt, Vaccinia virus
acaacauuccaaagau

SEQ ID NO: 3269215 - RNA, 21 nt, Vaccinia virus
aacucauuuaaauaucauaau

SEQ ID NO: 3269216 - RNA, 19 nt, Vaccinia virus
cguucaacauuuuauggaa

SEQ ID NO: 3269217 - RNA, 17 nt, Vaccinia virus
uaucaugaauuagauau

SEQ ID NO: 3269218 - RNA, 17 nt, Vaccinia virus
ugacuuaugaauacuaa

SEQ ID NO: 3269219 - RNA, 17 nt, Vaccinia virus
cucuauucgaaaacucu

SEQ ID NO: 3269220 - RNA, 12 nt, Vaccinia virus
cucuaaaugagu

SEQ ID NO: 3269221 - RNA, 19 nt, Vaccinia virus
gcaaucacuacaauaauua

SEQ ID NO: 3269222 - RNA, 15 nt, Vaccinia virus
cuaaaaauguuaauu

SEQ ID NO: 3269223 - RNA, 20 nt, Vaccinia virus
aaacugaaucuaacaaagag

SEQ ID NO: 3269224 - RNA, 15 nt, Vaccinia virus
caggcucuauuuuca

SEQ ID NO: 3269225 - RNA, 16 nt, Vaccinia virus
gaauauaaaauaacua

SEQ ID NO: 3269226 - RNA, 17 nt, Vaccinia virus
guucugaaagagaugag

SEQ ID NO: 3269227 - RNA, 13 nt, Vaccinia virus
agaggauugaugg

SEQ ID NO: 3269228 - RNA, 14 nt, Vaccinia virus
agcaacaugucucu

SEQ ID NO: 3269229 - RNA, 15 nt, Vaccinia virus
guguuuuaguuuauc

SEQ ID NO: 3269230 - RNA, 12 nt, Vaccinia virus
uacaacuaguga

SEQ ID NO: 3269231 - RNA, 13 nt, Vaccinia virus
auauuacaaaauc

SEQ ID NO: 3269232 - RNA, 22 nt, Vaccinia virus
aacaucguaucuucaaaaaggu

SEQ ID NO: 3269233 - RNA, 15 nt, Vaccinia virus
uuuccauuuuuaauu

SEQ ID NO: 3269234 - RNA, 17 nt, Vaccinia virus
gaaaaguauaauucuuu

SEQ ID NO: 3269235 - RNA, 18 nt, Vaccinia virus
cacuaacgcgcaugauuu

SEQ ID NO: 3269236 - RNA, 22 nt, Vaccinia virus
uuauuaaaguacguaaaucuag

SEQ ID NO: 3269237 - RNA, 13 nt, Vaccinia virus
guacuauaauauu

SEQ ID NO: 3269238 - RNA, 22 nt, Vaccinia virus
uuauuacauguuuucauauuca

SEQ ID NO: 3269239 - RNA, 11 nt, Vaccinia virus
cucuaaaugag

SEQ ID NO: 3269240 - RNA, 16 nt, Vaccinia virus
gucaaucuaauauuaa

SEQ ID NO: 3269241 - RNA, 22 nt, Vaccinia virus
acuauaaaaaaaauaauaauua

SEQ ID NO: 3269242 - RNA, 20 nt, Vaccinia virus
uucauaacgcauaauuauua

SEQ ID NO: 3269243 - RNA, 16 nt, Vaccinia virus
ggauaaccuagaaaau

SEQ ID NO: 3269244 - RNA, 23 nt, Vaccinia virus
cuaaaggaugaguacauuucaca

SEQ ID NO: 3269245 - RNA, 17 nt, Vaccinia virus
agcucucguauucaguu

SEQ ID NO: 3269246 - RNA, 14 nt, Vaccinia virus
agauaaauuuauca

SEQ ID NO: 3269247 - RNA, 16 nt, Vaccinia virus
uauguaaaacaaacuu

SEQ ID NO: 3269248 - RNA, 17 nt, Vaccinia virus
cugauggagucuccuuc

SEQ ID NO: 3269249 - RNA, 15 nt, Vaccinia virus
cucaauucaggaaca

SEQ ID NO: 3269250 - RNA, 22 nt, Vaccinia virus
uuauaauauaaaaauacuuaug

SEQ ID NO: 3269251 - RNA, 17 nt, Vaccinia virus
uaauaugauuagaaguu

SEQ ID NO: 3269252 - RNA, 17 nt, Vaccinia virus
cuacaaauagagauaaa

SEQ ID NO: 3269253 - RNA, 23 nt, Vaccinia virus
auuacaaaucuagagguagaacu

SEQ ID NO: 3269254 - RNA, 18 nt, Vaccinia virus
agugugaauaugaucuuc

SEQ ID NO: 3269255 - RNA, 14 nt, Vaccinia virus
ugugauauaaacaa

SEQ ID NO: 3269256 - RNA, 22 nt, Vaccinia virus
acucucuucuauaaaaauggau

SEQ ID NO: 3269257 - RNA, 21 nt, Vaccinia virus
cgguuaauguuguauuucauu

SEQ ID NO: 3269258 - RNA, 18 nt, Vaccinia virus
uccguuuauccacaauua

SEQ ID NO: 3269259 - RNA, 17 nt, Vaccinia virus
aaacucaauuauacucu

SEQ ID NO: 3269260 - RNA, 17 nt, Vaccinia virus
ugacaacucaaacaucu

SEQ ID NO: 3269261 - RNA, 21 nt, Vaccinia virus
aaaugauaacuagauagaaag

SEQ ID NO: 3269262 - RNA, 21 nt, Vaccinia virus
aaugaagauaucauugauuga

SEQ ID NO: 3269263 - RNA, 21 nt, Vaccinia virus
aauuauuaauuuuagugaaau

SEQ ID NO: 3269264 - RNA, 17 nt, Vaccinia virus
aauaggugaugaugcaa

SEQ ID NO: 3269265 - RNA, 15 nt, Vaccinia virus
cagaggauugauggu

SEQ ID NO: 3269266 - RNA, 18 nt, Vaccinia virus
aaguacauggaugauaua

SEQ ID NO: 3269267 - RNA, 14 nt, Vaccinia virus
uuuagaaaaacuuu

SEQ ID NO: 3269268 - RNA, 19 nt, Vaccinia virus
uuacacuauuugucuuaau

SEQ ID NO: 3269269 - RNA, 18 nt, Vaccinia virus
aaaacauggauuugguaa

SEQ ID NO: 3269270 - RNA, 14 nt, Vaccinia virus
auuaaucuuuacca

SEQ ID NO: 3269271 - RNA, 15 nt, Vaccinia virus
cuauaucuauguuuu

SEQ ID NO: 3269272 - RNA, 17 nt, Vaccinia virus
aucguuucuacaaaauc

SEQ ID NO: 3269273 - RNA, 16 nt, Vaccinia virus
uuagauuuccuagauu

SEQ ID NO: 3269274 - RNA, 15 nt, Vaccinia virus
guaaacacauaucca

SEQ ID NO: 3269275 - RNA, 15 nt, Vaccinia virus
ugagaguagauauca

SEQ ID NO: 3269276 - RNA, 15 nt, Vaccinia virus
uauaauaucuuugaa

SEQ ID NO: 3269277 - RNA, 18 nt, Vaccinia virus
aagacaucauauauagaa

SEQ ID NO: 3269278 - RNA, 13 nt, Vaccinia virus
caaugauaaugau

SEQ ID NO: 3269279 - RNA, 22 nt, Vaccinia virus
aaaucuugucugcuuaauacac

SEQ ID NO: 3269280 - RNA, 20 nt, Vaccinia virus
uggauuaagcaauagugaua

SEQ ID NO: 3269281 - RNA, 17 nt, Vaccinia virus
uaaaaagauaaacuuua

SEQ ID NO: 3269282 - RNA, 14 nt, Vaccinia virus
gaaggaucuguaca

SEQ ID NO: 3269283 - RNA, 12 nt, Vaccinia virus
gcacuauuucua

SEQ ID NO: 3269284 - RNA, 17 nt, Vaccinia virus
cucuagauauguauuua

SEQ ID NO: 3269285 - RNA, 17 nt, Vaccinia virus
agagaagucgucaagca

SEQ ID NO: 3269286 - RNA, 23 nt, Vaccinia virus
aguaucaagauguaaaauacuua

SEQ ID NO: 3269287 - RNA, 21 nt, Vaccinia virus
uggaaaaaggauggaaagaua

SEQ ID NO: 3269288 - RNA, 17 nt, Vaccinia virus
aauucuuuauaacugaa

SEQ ID NO: 3269289 - RNA, 22 nt, Vaccinia virus
accauccuuuaaaaaaaaugau

SEQ ID NO: 3269290 - RNA, 16 nt, Vaccinia virus
gcaauuauauaaugua

SEQ ID NO: 3269291 - RNA, 14 nt, Vaccinia virus
uacauaacaucuuu

SEQ ID NO: 3269292 - RNA, 13 nt, Vaccinia virus
gaaacauacgaua

SEQ ID NO: 3269293 - RNA, 19 nt, Vaccinia virus
aaguuuauucgcuaccaua

SEQ ID NO: 3269294 - RNA, 19 nt, Vaccinia virus
auugauccuagaacuagau

SEQ ID NO: 3269295 - RNA, 17 nt, Vaccinia virus
cuuauucggaaaguauu

SEQ ID NO: 3269296 - RNA, 17 nt, Vaccinia virus
caaacugcauucguguu

SEQ ID NO: 3269297 - RNA, 11 nt, Vaccinia virus
auauggaugag

SEQ ID NO: 3269298 - RNA, 18 nt, Vaccinia virus
gcaaagaaauuaauagaa

SEQ ID NO: 3269299 - RNA, 20 nt, Vaccinia virus
ucugaaccaguuaauguaua

SEQ ID NO: 3269300 - RNA, 19 nt, Vaccinia virus
gaacguaaauuaguucaua

SEQ ID NO: 3269301 - RNA, 15 nt, Vaccinia virus
auaucauacaugaua

SEQ ID NO: 3269302 - RNA, 17 nt, Vaccinia virus
aaucuuuuucaucuugu

SEQ ID NO: 3269303 - RNA, 14 nt, Vaccinia virus
cguacauugugugu

SEQ ID NO: 3269304 - RNA, 22 nt, Vaccinia virus
auagcuacaguaaaaauaacua

SEQ ID NO: 3269305 - RNA, 23 nt, Vaccinia virus
auucucucaucuaucaaaaguua

SEQ ID NO: 3269306 - RNA, 17 nt, Vaccinia virus
ugucuuaaaguuuauua

SEQ ID NO: 3269307 - RNA, 15 nt, Vaccinia virus
aacuaaaaaaaauga

SEQ ID NO: 3269308 - RNA, 14 nt, Vaccinia virus
aaugaaugaauaua

SEQ ID NO: 3269309 - RNA, 12 nt, Vaccinia virus
gacccauagaga

SEQ ID NO: 3269310 - RNA, 15 nt, Vaccinia virus
uacauuuucuuacaa

SEQ ID NO: 3269311 - RNA, 20 nt, Vaccinia virus
acagguuuaaacuaauacua

SEQ ID NO: 3269312 - RNA, 23 nt, Vaccinia virus
uuaacuauuuugucucuguuuuu

SEQ ID NO: 3269313 - RNA, 22 nt, Vaccinia virus
auuaguaaggcuuuagaaacuu

SEQ ID NO: 3269314 - RNA, 23 nt, Vaccinia virus
gcgauaucuccauuaauaaugau

SEQ ID NO: 3269315 - RNA, 17 nt, Vaccinia virus
auugcauggugauuugu

SEQ ID NO: 3269316 - RNA, 23 nt, Vaccinia virus
guaauugacaucuauauauccuu

SEQ ID NO: 3269317 - RNA, 21 nt, Vaccinia virus
cauguugaacauaaaacuaau

SEQ ID NO: 3269318 - RNA, 15 nt, Vaccinia virus
uacccgcaauuauua

SEQ ID NO: 3269319 - RNA, 14 nt, Vaccinia virus
auaucaucuacaua

SEQ ID NO: 3269320 - RNA, 17 nt, Vaccinia virus
uauguugaaucuaaacu

SEQ ID NO: 3269321 - RNA, 20 nt, Vaccinia virus
auuucauuacccaaguuuga

SEQ ID NO: 3269322 - RNA, 13 nt, Vaccinia virus
ucguauguagaaa

SEQ ID NO: 3269323 - RNA, 12 nt, Vaccinia virus
ucgacuguuacu

SEQ ID NO: 3269324 - RNA, 14 nt, Vaccinia virus
auauaccauuaaaa

SEQ ID NO: 3269325 - RNA, 20 nt, Vaccinia virus
uuuuacagaucuaguauaau

SEQ ID NO: 3269326 - RNA, 21 nt, Vaccinia virus
auagauguauuugauauacua

SEQ ID NO: 3269327 - RNA, 18 nt, Vaccinia virus
ucauauacaacucuuuaa

SEQ ID NO: 3269328 - RNA, 18 nt, Vaccinia virus
aagagaauugucaaaauu

SEQ ID NO: 3269329 - RNA, 14 nt, Vaccinia virus
ucaggaacauaaac

SEQ ID NO: 3269330 - RNA, 13 nt, Vaccinia virus
gacuauaaaauau

SEQ ID NO: 3269331 - RNA, 13 nt, Vaccinia virus
auaauuuaggaau

SEQ ID NO: 3269332 - RNA, 13 nt, Vaccinia virus
agagucaauguuu

SEQ ID NO: 3269333 - RNA, 19 nt, Vaccinia virus
uucuaugcuauaaaugaau

SEQ ID NO: 3269334 - RNA, 17 nt, Vaccinia virus
aaugcuugaaaauggac

SEQ ID NO: 3269335 - RNA, 16 nt, Vaccinia virus
gaaugaaauauauaca

SEQ ID NO: 3269336 - RNA, 23 nt, Vaccinia virus
uuauugggugguaaacuagauaa

SEQ ID NO: 3269337 - RNA, 17 nt, Vaccinia virus
acgagcuauuaaacugu

SEQ ID NO: 3269338 - RNA, 20 nt, Vaccinia virus
gaugucacaauuuguauuau

SEQ ID NO: 3269339 - RNA, 21 nt, Vaccinia virus
auccgaaacaaucucagauau

SEQ ID NO: 3269340 - RNA, 18 nt, Vaccinia virus
auucuucacagacugaag

SEQ ID NO: 3269341 - RNA, 13 nt, Vaccinia virus
uaauaaagacuuc

SEQ ID NO: 3269342 - RNA, 18 nt, Vaccinia virus
ucauuacagaaacuguaa

SEQ ID NO: 3269343 - RNA, 21 nt, Vaccinia virus
auccucagucaucuugucuag

SEQ ID NO: 3269344 - RNA, 22 nt, Vaccinia virus
uuaaaagaauuacuuagucugu

SEQ ID NO: 3269345 - RNA, 19 nt, Vaccinia virus
ucaucuuguucagaaauau

SEQ ID NO: 3269346 - RNA, 14 nt, Vaccinia virus
aauguuaaacauua

SEQ ID NO: 3269347 - RNA, 23 nt, Vaccinia virus
auuuuuuuaaaaaaaaaauacuu

SEQ ID NO: 3269348 - RNA, 22 nt, Vaccinia virus
uuaauaaauccggaacuguaaa

SEQ ID NO: 3269349 - RNA, 12 nt, Vaccinia virus
aacguggauaaa

SEQ ID NO: 3269350 - RNA, 11 nt, Vaccinia virus
aaaaaaugauc

SEQ ID NO: 3269351 - RNA, 21 nt, Vaccinia virus
acgucaaaauuggaaggauau

SEQ ID NO: 3269352 - RNA, 11 nt, Vaccinia virus
uuuucuguaaa

SEQ ID NO: 3269353 - RNA, 22 nt, Vaccinia virus
uguuaucaugaaauguuugaua

SEQ ID NO: 3269354 - RNA, 18 nt, Vaccinia virus
aaagaaacugucaucuau

SEQ ID NO: 3269355 - RNA, 16 nt, Vaccinia virus
uaacgcauaauuauua

SEQ ID NO: 3269356 - RNA, 18 nt, Vaccinia virus
uaagucucucuccauaac

SEQ ID NO: 3269357 - RNA, 20 nt, Vaccinia virus
cauauguuuuaauauuuaca

SEQ ID NO: 3269358 - RNA, 16 nt, Vaccinia virus
uugauaucuuuagaua

SEQ ID NO: 3269359 - RNA, 20 nt, Vaccinia virus
uacagaaacuguaaagaaca

SEQ ID NO: 3269360 - RNA, 14 nt, Vaccinia virus
aacuuuauuagaua

SEQ ID NO: 3269361 - RNA, 13 nt, Vaccinia virus
gaauaauguuucu

SEQ ID NO: 3269362 - RNA, 21 nt, Vaccinia virus
caucagacguuccggaaagag

SEQ ID NO: 3269363 - RNA, 15 nt, Vaccinia virus
auuuuaauauagcug

SEQ ID NO: 3269364 - RNA, 13 nt, Vaccinia virus
aucugaucuuguu

SEQ ID NO: 3269365 - RNA, 21 nt, Vaccinia virus
uaauauaaaagaauauguaua

SEQ ID NO: 3269366 - RNA, 14 nt, Vaccinia virus
auagagaacauaau

SEQ ID NO: 3269367 - RNA, 19 nt, Vaccinia virus
ccagucuuugguaucgaua

SEQ ID NO: 3269368 - RNA, 13 nt, Vaccinia virus
gaagaagaugcua

SEQ ID NO: 3269369 - RNA, 16 nt, Vaccinia virus
auuaaucuuuucugua

SEQ ID NO: 3269370 - RNA, 15 nt, Vaccinia virus
aacucauuauagaua

SEQ ID NO: 3269371 - RNA, 18 nt, Vaccinia virus
aguagaccguuaaugaaa

SEQ ID NO: 3269372 - RNA, 14 nt, Vaccinia virus
auacagaagauuua

SEQ ID NO: 3269373 - RNA, 22 nt, Vaccinia virus
aaauugcgacacuauucaugua

SEQ ID NO: 3269374 - RNA, 22 nt, Vaccinia virus
uaucgcuaaaauuuucaucaaa

SEQ ID NO: 3269375 - RNA, 19 nt, Vaccinia virus
uacguauuucguaccugua

SEQ ID NO: 3269376 - RNA, 13 nt, Vaccinia virus
cauagucuucaau

SEQ ID NO: 3269377 - RNA, 20 nt, Vaccinia virus
ucuaauagaucugauuagua

SEQ ID NO: 3269378 - RNA, 14 nt, Vaccinia virus
uaguuuuuacacau

SEQ ID NO: 3269379 - RNA, 12 nt, Vaccinia virus
aauacuuaaaaa

SEQ ID NO: 3269380 - RNA, 22 nt, Vaccinia virus
auauuaggcacagucaaacauu

SEQ ID NO: 3269381 - RNA, 14 nt, Vaccinia virus
uuaaagauggagua

SEQ ID NO: 3269382 - RNA, 19 nt, Vaccinia virus
gauucugauaacauaaaaa

SEQ ID NO: 3269383 - RNA, 16 nt, Vaccinia virus
uaccauuaaucacuga

SEQ ID NO: 3269384 - RNA, 17 nt, Vaccinia virus
caacaucuauaaaagua

SEQ ID NO: 3269385 - RNA, 19 nt, Vaccinia virus
auauccuuugcauucuauu

SEQ ID NO: 3269386 - RNA, 14 nt, Vaccinia virus
cauauuauacagua

SEQ ID NO: 3269387 - RNA, 21 nt, Vaccinia virus
gauaauucgcgcaccaacaau

SEQ ID NO: 3269388 - RNA, 19 nt, Vaccinia virus
auccuucuauguugacaug

SEQ ID NO: 3269389 - RNA, 18 nt, Vaccinia virus
cauguaauacauuuugaa

SEQ ID NO: 3269390 - RNA, 21 nt, Vaccinia virus
uucugauauggaaucuguauu

SEQ ID NO: 3269391 - RNA, 19 nt, Vaccinia virus
auuaaaccauguugugaaa

SEQ ID NO: 3269392 - RNA, 16 nt, Vaccinia virus
uagagauaaaacaagu

SEQ ID NO: 3269393 - RNA, 18 nt, Vaccinia virus
uguacccuguuuaacaug

SEQ ID NO: 3269394 - RNA, 17 nt, Vaccinia virus
uccagaugcgagagaau

SEQ ID NO: 3269395 - RNA, 14 nt, Vaccinia virus
ucuagauagaguau

SEQ ID NO: 3269396 - RNA, 14 nt, Vaccinia virus
agcuucugaaauaa

SEQ ID NO: 3269397 - RNA, 20 nt, Vaccinia virus
guacgggcgcuguaauuaau

SEQ ID NO: 3269398 - RNA, 23 nt, Vaccinia virus
uggaagacagccgucucuacaua

SEQ ID NO: 3269399 - RNA, 13 nt, Vaccinia virus
aacauuaauugau

SEQ ID NO: 3269400 - RNA, 13 nt, Vaccinia virus
ucaucauuucuaa

SEQ ID NO: 3269401 - RNA, 15 nt, Vaccinia virus
aucauacaaugaauu

SEQ ID NO: 3269402 - RNA, 15 nt, Vaccinia virus
uaugguauucuucua

SEQ ID NO: 3269403 - RNA, 15 nt, Vaccinia virus
auucacguuauauaa

SEQ ID NO: 3269404 - RNA, 15 nt, Vaccinia virus
guuuguaaaauaucu

SEQ ID NO: 3269405 - RNA, 14 nt, Vaccinia virus
uauuuauuuaaaau

SEQ ID NO: 3269406 - RNA, 15 nt, Vaccinia virus
aucaauaucucaauu

SEQ ID NO: 3269407 - RNA, 20 nt, Vaccinia virus
uauaauaacgauuuguuuaa

SEQ ID NO: 3269408 - RNA, 22 nt, Vaccinia virus
ucuugccauggacuaagauauc

SEQ ID NO: 3269409 - RNA, 16 nt, Vaccinia virus
uaucaucuauuagaga

SEQ ID NO: 3269410 - RNA, 19 nt, Vaccinia virus
uuagauuuuuuacacuguu

SEQ ID NO: 3269411 - RNA, 12 nt, Vaccinia virus
auauaugcauua

SEQ ID NO: 3269412 - RNA, 13 nt, Vaccinia virus
aaauagagcaauu

SEQ ID NO: 3269413 - RNA, 18 nt, Vaccinia virus
aacauacuauuguuuauu

SEQ ID NO: 3269414 - RNA, 23 nt, Vaccinia virus
aaucagacugggaggaucacugu

SEQ ID NO: 3269415 - RNA, 19 nt, Vaccinia virus
gugaguacggauuaaacau

SEQ ID NO: 3269416 - RNA, 14 nt, Vaccinia virus
aucaugacaaaauu

SEQ ID NO: 3269417 - RNA, 18 nt, Vaccinia virus
ucucacaaaaaaaguuuu

SEQ ID NO: 3269418 - RNA, 16 nt, Vaccinia virus
aaaauagcgcugaaaa

SEQ ID NO: 3269419 - RNA, 21 nt, Vaccinia virus
cgagagaaugaauaacccugg

SEQ ID NO: 3269420 - RNA, 23 nt, Vaccinia virus
guauccacaaauaguaaaugaga

SEQ ID NO: 3269421 - RNA, 21 nt, Vaccinia virus
gauaccgaucacguucuaguu

SEQ ID NO: 3269422 - RNA, 19 nt, Vaccinia virus
aauuccagauguuguaaaa

SEQ ID NO: 3269423 - RNA, 22 nt, Vaccinia virus
agguuuugcaacauguuaaaau

SEQ ID NO: 3269424 - RNA, 20 nt, Vaccinia virus
uaaaaucaaucguuaucuaa

SEQ ID NO: 3269425 - RNA, 17 nt, Vaccinia virus
acagaaauauaugagau

SEQ ID NO: 3269426 - RNA, 13 nt, Vaccinia virus
agaggaagaagau

SEQ ID NO: 3269427 - RNA, 14 nt, Vaccinia virus
aaucagaaaugaug

SEQ ID NO: 3269428 - RNA, 17 nt, Vaccinia virus
agauacaaauuuuaaga

SEQ ID NO: 3269429 - RNA, 15 nt, Vaccinia virus
aauaugauuagaagu

SEQ ID NO: 3269430 - RNA, 15 nt, Vaccinia virus
ucuaacgguuucuuc

SEQ ID NO: 3269431 - RNA, 21 nt, Vaccinia virus
acauauaaaucuaaaauugau

SEQ ID NO: 3269432 - RNA, 14 nt, Vaccinia virus
uaauagauuucuag

SEQ ID NO: 3269433 - RNA, 17 nt, Vaccinia virus
uaauucagauacuacag

SEQ ID NO: 3269434 - RNA, 22 nt, Vaccinia virus
augcaaccguaucaaaaaauua

SEQ ID NO: 3269435 - RNA, 13 nt, Vaccinia virus
caaaucuggaaaa

SEQ ID NO: 3269436 - RNA, 20 nt, Vaccinia virus
cagcaauuucuuuauucucu

SEQ ID NO: 3269437 - RNA, 15 nt, Vaccinia virus
aauuauguaaaacau

SEQ ID NO: 3269438 - RNA, 16 nt, Vaccinia virus
cucaacauaaauaauu

SEQ ID NO: 3269439 - RNA, 21 nt, Vaccinia virus
gaaaaguucaacaugauuauu

SEQ ID NO: 3269440 - RNA, 13 nt, Vaccinia virus
auguaaaauacuu

SEQ ID NO: 3269441 - RNA, 13 nt, Vaccinia virus
aacaaaaauugau

SEQ ID NO: 3269442 - RNA, 13 nt, Vaccinia virus
auaguacauuccc

SEQ ID NO: 3269443 - RNA, 16 nt, Vaccinia virus
uaucuauguuaucauc

SEQ ID NO: 3269444 - RNA, 17 nt, Vaccinia virus
acuauauuguacuuuac

SEQ ID NO: 3269445 - RNA, 15 nt, Vaccinia virus
guucaucacauaugc

SEQ ID NO: 3269446 - RNA, 14 nt, Vaccinia virus
uaaaauauguaguc

SEQ ID NO: 3269447 - RNA, 12 nt, Vaccinia virus
cauaaaaguugu

SEQ ID NO: 3269448 - RNA, 22 nt, Vaccinia virus
uaguuucugguuuucuauaaau

SEQ ID NO: 3269449 - RNA, 13 nt, Vaccinia virus
auuaauaguuuug

SEQ ID NO: 3269450 - RNA, 21 nt, Vaccinia virus
gauauauaguaaugaagagag

SEQ ID NO: 3269451 - RNA, 22 nt, Vaccinia virus
aaguuugaaacgagugaagaaa

SEQ ID NO: 3269452 - RNA, 17 nt, Vaccinia virus
cuuuaaaagaaacugac

SEQ ID NO: 3269453 - RNA, 13 nt, Vaccinia virus
aaauaauauauca

SEQ ID NO: 3269454 - RNA, 17 nt, Vaccinia virus
auugaauuuauaucuaa

SEQ ID NO: 3269455 - RNA, 12 nt, Vaccinia virus
uaauuaauguaa

SEQ ID NO: 3269456 - RNA, 16 nt, Vaccinia virus
gccauggacuaagaua

SEQ ID NO: 3269457 - RNA, 14 nt, Vaccinia virus
aucucaauaugaua

SEQ ID NO: 3269458 - RNA, 21 nt, Vaccinia virus
uagacauaaaaacuaauauua

SEQ ID NO: 3269459 - RNA, 21 nt, Vaccinia virus
cuauagacauaauacuaucug

SEQ ID NO: 3269460 - RNA, 16 nt, Vaccinia virus
gaaaaauuuguagauu

SEQ ID NO: 3269461 - RNA, 16 nt, Vaccinia virus
auuauucuaucaauuu

SEQ ID NO: 3269462 - RNA, 23 nt, Vaccinia virus
gccauuuaguuauugaaauuaau

SEQ ID NO: 3269463 - RNA, 17 nt, Vaccinia virus
uauccuaucauguauuu

SEQ ID NO: 3269464 - RNA, 17 nt, Vaccinia virus
uagaaaaaaugaugcug

SEQ ID NO: 3269465 - RNA, 23 nt, Vaccinia virus
gucuuauucuuaaaaucuauucc

SEQ ID NO: 3269466 - RNA, 20 nt, Vaccinia virus
uucuaaaaaaauauuaacga

SEQ ID NO: 3269467 - RNA, 14 nt, Vaccinia virus
acgcauaauuauua

SEQ ID NO: 3269468 - RNA, 17 nt, Vaccinia virus
augcacguaaacauuau

SEQ ID NO: 3269469 - RNA, 19 nt, Vaccinia virus
uagaaauuaucaaauguug

SEQ ID NO: 3269470 - RNA, 19 nt, Vaccinia virus
cucucuauuucuuaaugaa

SEQ ID NO: 3269471 - RNA, 16 nt, Vaccinia virus
aaaaugugauauagaa

SEQ ID NO: 3269472 - RNA, 15 nt, Vaccinia virus
auccauauuucuuaa

SEQ ID NO: 3269473 - RNA, 17 nt, Vaccinia virus
aaucccgucucagaaag

SEQ ID NO: 3269474 - RNA, 20 nt, Vaccinia virus
caguugaauggauucguccu

SEQ ID NO: 3269475 - RNA, 16 nt, Vaccinia virus
uuuaauagauauacac

SEQ ID NO: 3269476 - RNA, 13 nt, Vaccinia virus
uggaugaaccauu

SEQ ID NO: 3269477 - RNA, 14 nt, Vaccinia virus
ugaacuuuaucuag

SEQ ID NO: 3269478 - RNA, 13 nt, Vaccinia virus
ugaaaaaacauua

SEQ ID NO: 3269479 - RNA, 18 nt, Vaccinia virus
aacuccaagauaccagua

SEQ ID NO: 3269480 - RNA, 23 nt, Vaccinia virus
acaacaacgaaccaaaaugaauu

SEQ ID NO: 3269481 - RNA, 22 nt, Vaccinia virus
acaaacauuuuuguugguguaa

SEQ ID NO: 3269482 - RNA, 15 nt, Vaccinia virus
guuuagauucuuuuu

SEQ ID NO: 3269483 - RNA, 15 nt, Vaccinia virus
caggauucuaaugau

SEQ ID NO: 3269484 - RNA, 14 nt, Vaccinia virus
gagggaaaagucau

SEQ ID NO: 3269485 - RNA, 18 nt, Vaccinia virus
acuaccucagacugguag

SEQ ID NO: 3269486 - RNA, 16 nt, Vaccinia virus
uaacaguaacuuguau

SEQ ID NO: 3269487 - RNA, 21 nt, Vaccinia virus
guuacucaguugaacagauga

SEQ ID NO: 3269488 - RNA, 23 nt, Vaccinia virus
auggaauauaauaaucuauuuua

SEQ ID NO: 3269489 - RNA, 17 nt, Vaccinia virus
cuauuacugacuuuaau

SEQ ID NO: 3269490 - RNA, 19 nt, Vaccinia virus
augacuuauaaaaauacua

SEQ ID NO: 3269491 - RNA, 20 nt, Vaccinia virus
acuaucuaaauguaauuaau

SEQ ID NO: 3269492 - RNA, 14 nt, Vaccinia virus
aggaucuagcaaag

SEQ ID NO: 3269493 - RNA, 22 nt, Vaccinia virus
cuauuccuggugcuauuuugau

SEQ ID NO: 3269494 - RNA, 16 nt, Vaccinia virus
aguaaugguauguauu

SEQ ID NO: 3269495 - RNA, 18 nt, Vaccinia virus
aagcagacuagaaauaac

SEQ ID NO: 3269496 - RNA, 16 nt, Vaccinia virus
gaauaucuuuauucau

SEQ ID NO: 3269497 - RNA, 17 nt, Vaccinia virus
agauuaguaaauucaag

SEQ ID NO: 3269498 - RNA, 17 nt, Vaccinia virus
ggaaaaaauuguugauc

SEQ ID NO: 3269499 - RNA, 17 nt, Vaccinia virus
auauuagauauuuuaug

SEQ ID NO: 3269500 - RNA, 18 nt, Vaccinia virus
ucgucuccccaaacauug

SEQ ID NO: 3269501 - RNA, 20 nt, Vaccinia virus
auauuacaaacuauagaaau

SEQ ID NO: 3269502 - RNA, 17 nt, Vaccinia virus
ugauaguaauucucgga

SEQ ID NO: 3269503 - RNA, 15 nt, Vaccinia virus
acuggaucguuuaaa

SEQ ID NO: 3269504 - RNA, 18 nt, Vaccinia virus
aggaacuggauauuacaa

SEQ ID NO: 3269505 - RNA, 13 nt, Vaccinia virus
aaauauguagaaa

SEQ ID NO: 3269506 - RNA, 13 nt, Vaccinia virus
aaauauaacuauu

SEQ ID NO: 3269507 - RNA, 19 nt, Vaccinia virus
auuauugguucauuggaau

SEQ ID NO: 3269508 - RNA, 16 nt, Vaccinia virus
gagaauggaugauucu

SEQ ID NO: 3269509 - RNA, 17 nt, Vaccinia virus
gauaauagauuaaugau

SEQ ID NO: 3269510 - RNA, 18 nt, Vaccinia virus
uaauccaaugauacuuuu

SEQ ID NO: 3269511 - RNA, 16 nt, Vaccinia virus
ucuaucuuuuauuuua

SEQ ID NO: 3269512 - RNA, 16 nt, Vaccinia virus
acuuuaucagauuaaa

SEQ ID NO: 3269513 - RNA, 16 nt, Vaccinia virus
aaaacuuuaauaacaa

SEQ ID NO: 3269514 - RNA, 14 nt, Vaccinia virus
ugaauuguuucuuu

SEQ ID NO: 3269515 - RNA, 18 nt, Vaccinia virus
gcucuuuugaugauaaau

SEQ ID NO: 3269516 - RNA, 13 nt, Vaccinia virus
ugcuaauauacaa

SEQ ID NO: 3269517 - RNA, 14 nt, Vaccinia virus
uguuaguuuccuua

SEQ ID NO: 3269518 - RNA, 15 nt, Vaccinia virus
agaugcaaacauuau

SEQ ID NO: 3269519 - RNA, 17 nt, Vaccinia virus
cauaguaacucauaauu

SEQ ID NO: 3269520 - RNA, 21 nt, Vaccinia virus
cagaagugugaauaugaucuu

SEQ ID NO: 3269521 - RNA, 21 nt, Vaccinia virus
auuaauacaggaucuagcaaa

SEQ ID NO: 3269522 - RNA, 23 nt, Vaccinia virus
ugaauuuauuucagaaauuauuc

SEQ ID NO: 3269523 - RNA, 15 nt, Vaccinia virus
ucaauaaaugauuca

SEQ ID NO: 3269524 - RNA, 15 nt, Vaccinia virus
aacuauuuuuaacuu

SEQ ID NO: 3269525 - RNA, 18 nt, Vaccinia virus
uagaaaauggauuuauug

SEQ ID NO: 3269526 - RNA, 17 nt, Vaccinia virus
guacuucuguacaaaau

SEQ ID NO: 3269527 - RNA, 16 nt, Vaccinia virus
gcauuaguaacagcuu

SEQ ID NO: 3269528 - RNA, 19 nt, Vaccinia virus
aaggauaaaauauuaucca

SEQ ID NO: 3269529 - RNA, 15 nt, Vaccinia virus
cuaaacuuauuuaga

SEQ ID NO: 3269530 - RNA, 23 nt, Vaccinia virus
augugggacaucaauacgccaau

SEQ ID NO: 3269531 - RNA, 13 nt, Vaccinia virus
gugcuaccaaagg

SEQ ID NO: 3269532 - RNA, 16 nt, Vaccinia virus
gaauaaucguuauuau

SEQ ID NO: 3269533 - RNA, 13 nt, Vaccinia virus
ugccaaaaugaua

SEQ ID NO: 3269534 - RNA, 20 nt, Vaccinia virus
ugggugugguuaaacgaaag

SEQ ID NO: 3269535 - RNA, 15 nt, Vaccinia virus
aaacuguuuauucca

SEQ ID NO: 3269536 - RNA, 13 nt, Vaccinia virus
uacaaacugaaaa

SEQ ID NO: 3269537 - RNA, 14 nt, Vaccinia virus
ucuuccuacuaucu

SEQ ID NO: 3269538 - RNA, 22 nt, Vaccinia virus
auaccacuuaaugacaaaauca

SEQ ID NO: 3269539 - RNA, 13 nt, Vaccinia virus
accacaacauuuc

SEQ ID NO: 3269540 - RNA, 15 nt, Vaccinia virus
cgauuauuucugaau

SEQ ID NO: 3269541 - RNA, 11 nt, Vaccinia virus
guuaaauuaau

SEQ ID NO: 3269542 - RNA, 22 nt, Vaccinia virus
aaaaauuauccuaucauguauu

SEQ ID NO: 3269543 - RNA, 16 nt, Vaccinia virus
cuaaaaagaauguaua

SEQ ID NO: 3269544 - RNA, 16 nt, Vaccinia virus
cgaauauaaaugauuu

SEQ ID NO: 3269545 - RNA, 14 nt, Vaccinia virus
auaagacuuuacuu

SEQ ID NO: 3269546 - RNA, 21 nt, Vaccinia virus
ugaaauagcguucgucaacau

SEQ ID NO: 3269547 - RNA, 13 nt, Vaccinia virus
ugaucuagucuuu

SEQ ID NO: 3269548 - RNA, 17 nt, Vaccinia virus
uaaacauugauuaaauu

SEQ ID NO: 3269549 - RNA, 23 nt, Vaccinia virus
auacucuccgaguguaaauauua

SEQ ID NO: 3269550 - RNA, 20 nt, Vaccinia virus
uuauuacacgcuauuaauca

SEQ ID NO: 3269551 - RNA, 23 nt, Vaccinia virus
ugaagaaccaguaacauaugaua

SEQ ID NO: 3269552 - RNA, 20 nt, Vaccinia virus
aauauuaguggaagaaagau

SEQ ID NO: 3269553 - RNA, 18 nt, Vaccinia virus
gaauauugauuuacuaaa

SEQ ID NO: 3269554 - RNA, 14 nt, Vaccinia virus
gaacugaugccuau

SEQ ID NO: 3269555 - RNA, 15 nt, Vaccinia virus
uucaauaucuauacu

SEQ ID NO: 3269556 - RNA, 22 nt, Vaccinia virus
uucacuuuuuauaauuuuacca

SEQ ID NO: 3269557 - RNA, 19 nt, Vaccinia virus
aacuuccguuuaaaaaugg

SEQ ID NO: 3269558 - RNA, 15 nt, Vaccinia virus
uuauagaguguggua

SEQ ID NO: 3269559 - RNA, 14 nt, Vaccinia virus
gaauuuagaaauau

SEQ ID NO: 3269560 - RNA, 15 nt, Vaccinia virus
uucuaauucucagag

SEQ ID NO: 3269561 - RNA, 19 nt, Vaccinia virus
agauagagaugagaugucu

SEQ ID NO: 3269562 - RNA, 15 nt, Vaccinia virus
ccaagugcuuaaaua

SEQ ID NO: 3269563 - RNA, 16 nt, Vaccinia virus
uauuccuguuaucaua

SEQ ID NO: 3269564 - RNA, 15 nt, Vaccinia virus
guaaaaaauauguua

SEQ ID NO: 3269565 - RNA, 16 nt, Vaccinia virus
acauuaaaaauuucca

SEQ ID NO: 3269566 - RNA, 21 nt, Vaccinia virus
uuaacgucuaccgaaacaucg

SEQ ID NO: 3269567 - RNA, 17 nt, Vaccinia virus
uuagacgcuuauuauua

SEQ ID NO: 3269568 - RNA, 18 nt, Vaccinia virus
ccuuucuccuguaaagaa

SEQ ID NO: 3269569 - RNA, 17 nt, Vaccinia virus
gcauaaauuguaaaaaa

SEQ ID NO: 3269570 - RNA, 16 nt, Vaccinia virus
auaaauauaauaacaa

SEQ ID NO: 3269571 - RNA, 14 nt, Vaccinia virus
aaauaauucauuuu

SEQ ID NO: 3269572 - RNA, 19 nt, Vaccinia virus
aggagguauauaucaugau

SEQ ID NO: 3269573 - RNA, 17 nt, Vaccinia virus
uuagcagaauauauaag

SEQ ID NO: 3269574 - RNA, 22 nt, Vaccinia virus
acucauuauuucccaaaauuug

SEQ ID NO: 3269575 - RNA, 18 nt, Vaccinia virus
uaugacucaugaucuauu

SEQ ID NO: 3269576 - RNA, 14 nt, Vaccinia virus
uauucaucaucaaa

SEQ ID NO: 3269577 - RNA, 21 nt, Vaccinia virus
uaucauuucuacauuguuuau

SEQ ID NO: 3269578 - RNA, 20 nt, Vaccinia virus
uaacguccaucauuacagaa

SEQ ID NO: 3269579 - RNA, 22 nt, Vaccinia virus
auuugaaacuccuagagaauua

SEQ ID NO: 3269580 - RNA, 19 nt, Vaccinia virus
aguaaagauuucaaagaug

SEQ ID NO: 3269581 - RNA, 13 nt, Vaccinia virus
uguuuuuguacau

SEQ ID NO: 3269582 - RNA, 15 nt, Vaccinia virus
aauuaucaaauacuu

SEQ ID NO: 3269583 - RNA, 14 nt, Vaccinia virus
ugauauuucauaua

SEQ ID NO: 3269584 - RNA, 11 nt, Vaccinia virus
ugacuuucaaa

SEQ ID NO: 3269585 - RNA, 16 nt, Vaccinia virus
agauuucaaagauguu

SEQ ID NO: 3269586 - RNA, 14 nt, Vaccinia virus
aaaaauuauacugu

SEQ ID NO: 3269587 - RNA, 20 nt, Vaccinia virus
caucgucgucuacuauucua

SEQ ID NO: 3269588 - RNA, 17 nt, Vaccinia virus
gcauauauuagaaauac

SEQ ID NO: 3269589 - RNA, 22 nt, Vaccinia virus
ucuaugaaaggagagaauguau

SEQ ID NO: 3269590 - RNA, 24 nt, Vaccinia virus
aaaaugaaaauacuuuaguaauua

SEQ ID NO: 3269591 - RNA, 20 nt, Vaccinia virus
agauaccacgaguaucaauu

SEQ ID NO: 3269592 - RNA, 23 nt, Vaccinia virus
ucaaacaaaaaagcucaauaaga

SEQ ID NO: 3269593 - RNA, 16 nt, Vaccinia virus
aauguagacaaauaua

SEQ ID NO: 3269594 - RNA, 14 nt, Vaccinia virus
aauagaugaauaua

SEQ ID NO: 3269595 - RNA, 14 nt, Vaccinia virus
gcauuuccaaagaa

SEQ ID NO: 3269596 - RNA, 14 nt, Vaccinia virus
auagauaacauagu

SEQ ID NO: 3269597 - RNA, 14 nt, Vaccinia virus
auacugaaccaucg

SEQ ID NO: 3269598 - RNA, 19 nt, Vaccinia virus
cuugucaaaucuauauacc

SEQ ID NO: 3269599 - RNA, 21 nt, Vaccinia virus
aagaaguauacuaucgucauu

SEQ ID NO: 3269600 - RNA, 19 nt, Vaccinia virus
auuauauaauguauaaaug

SEQ ID NO: 3269601 - RNA, 22 nt, Vaccinia virus
uuaguucaucgcuuucuagaau

SEQ ID NO: 3269602 - RNA, 14 nt, Vaccinia virus
uaccacauacaaaa

SEQ ID NO: 3269603 - RNA, 17 nt, Vaccinia virus
aacauuuuauuucuaga

SEQ ID NO: 3269604 - RNA, 17 nt, Vaccinia virus
uaauagcuccauaaacu

SEQ ID NO: 3269605 - RNA, 12 nt, Vaccinia virus
uuaaaauacuaa

SEQ ID NO: 3269606 - RNA, 16 nt, Vaccinia virus
ugauagauuuucuacu

SEQ ID NO: 3269607 - RNA, 13 nt, Vaccinia virus
cggauacgacauc

SEQ ID NO: 3269608 - RNA, 13 nt, Vaccinia virus
uacaauaaauguu

SEQ ID NO: 3269609 - RNA, 12 nt, Vaccinia virus
gacgcauuuaau

SEQ ID NO: 3269610 - RNA, 14 nt, Vaccinia virus
auuaaaaaggaaaa

SEQ ID NO: 3269611 - RNA, 12 nt, Vaccinia virus
gcagcauuuccu

SEQ ID NO: 3269612 - RNA, 15 nt, Vaccinia virus
acauauuuauauaau

SEQ ID NO: 3269613 - RNA, 20 nt, Vaccinia virus
ucagacucugauuugaacaa

SEQ ID NO: 3269614 - RNA, 20 nt, Vaccinia virus
acucuguagacuuuaauaga

SEQ ID NO: 3269615 - RNA, 12 nt, Vaccinia virus
ucguuaaauuuu

SEQ ID NO: 3269616 - RNA, 14 nt, Vaccinia virus
uacuauacgcaaug

SEQ ID NO: 3269617 - RNA, 15 nt, Vaccinia virus
aguuuauacuauuaa

SEQ ID NO: 3269618 - RNA, 14 nt, Vaccinia virus
guaauauucaucau

SEQ ID NO: 3269619 - RNA, 16 nt, Vaccinia virus
ugauauguuuucagcu

SEQ ID NO: 3269620 - RNA, 17 nt, Vaccinia virus
acaaaaaagcucaauaa

SEQ ID NO: 3269621 - RNA, 13 nt, Vaccinia virus
agauauauuggag

SEQ ID NO: 3269622 - RNA, 14 nt, Vaccinia virus
uauuucaaagacua

SEQ ID NO: 3269623 - RNA, 16 nt, Vaccinia virus
aaguugaccaauucau

SEQ ID NO: 3269624 - RNA, 15 nt, Vaccinia virus
cacauacaaaacuag

SEQ ID NO: 3269625 - RNA, 18 nt, Vaccinia virus
aguauuguuuaguauuuu

SEQ ID NO: 3269626 - RNA, 12 nt, Vaccinia virus
cucguucaucua

SEQ ID NO: 3269627 - RNA, 15 nt, Vaccinia virus
ugaagaaaaauguug

SEQ ID NO: 3269628 - RNA, 21 nt, Vaccinia virus
auaaaugucacgccauaacua

SEQ ID NO: 3269629 - RNA, 22 nt, Vaccinia virus
ggagauuauagcaauaugugua

SEQ ID NO: 3269630 - RNA, 21 nt, Vaccinia virus
uagcaucuuauuagaauauua

SEQ ID NO: 3269631 - RNA, 14 nt, Vaccinia virus
caguaguaaugaag

SEQ ID NO: 3269632 - RNA, 18 nt, Vaccinia virus
auaauuuuuuuaguuuuu

SEQ ID NO: 3269633 - RNA, 15 nt, Vaccinia virus
auuauauauggauuu

SEQ ID NO: 3269634 - RNA, 18 nt, Vaccinia virus
cagauuuaacaauuucua

SEQ ID NO: 3269635 - RNA, 15 nt, Vaccinia virus
auaacaaguaugaca

SEQ ID NO: 3269636 - RNA, 21 nt, Vaccinia virus
aggaucuacguucauauguau

SEQ ID NO: 3269637 - RNA, 13 nt, Vaccinia virus
acagauacagaug

SEQ ID NO: 3269638 - RNA, 19 nt, Vaccinia virus
aauucaccuucacaaaaua

SEQ ID NO: 3269639 - RNA, 15 nt, Vaccinia virus
uucugguuuaaaaac

SEQ ID NO: 3269640 - RNA, 15 nt, Vaccinia virus
agauuuuaaaaaacu

SEQ ID NO: 3269641 - RNA, 13 nt, Vaccinia virus
auaaauggaaaug

SEQ ID NO: 3269642 - RNA, 23 nt, Vaccinia virus
ugauucuccagccgaaacauauu

SEQ ID NO: 3269643 - RNA, 19 nt, Vaccinia virus
gaauaauccuauaucacuu

SEQ ID NO: 3269644 - RNA, 15 nt, Vaccinia virus
aaucucuauuugcca

SEQ ID NO: 3269645 - RNA, 12 nt, Vaccinia virus
aguuucuagaua

SEQ ID NO: 3269646 - RNA, 11 nt, Vaccinia virus
acauguaacug

SEQ ID NO: 3269647 - RNA, 14 nt, Vaccinia virus
uaauacauuuugaa

SEQ ID NO: 3269648 - RNA, 14 nt, Vaccinia virus
aaaagacuauacau

SEQ ID NO: 3269649 - RNA, 15 nt, Vaccinia virus
auagagaacauaaug

SEQ ID NO: 3269650 - RNA, 20 nt, Vaccinia virus
acuauuuuaaauagcauaga

SEQ ID NO: 3269651 - RNA, 12 nt, Vaccinia virus
aguuuauaagaa

SEQ ID NO: 3269652 - RNA, 14 nt, Vaccinia virus
auuacacaaauauu

SEQ ID NO: 3269653 - RNA, 15 nt, Vaccinia virus
gcaaugcauaaucga

SEQ ID NO: 3269654 - RNA, 15 nt, Vaccinia virus
uugcgauauacauaa

SEQ ID NO: 3269655 - RNA, 19 nt, Vaccinia virus
uaacaguccgguucuuaau

SEQ ID NO: 3269656 - RNA, 16 nt, Vaccinia virus
guacacaacacaauga

SEQ ID NO: 3269657 - RNA, 14 nt, Vaccinia virus
acggagacaaaauu

SEQ ID NO: 3269658 - RNA, 20 nt, Vaccinia virus
gauuaaaucguguauucauc

SEQ ID NO: 3269659 - RNA, 16 nt, Vaccinia virus
ugcuauccaucagaau

SEQ ID NO: 3269660 - RNA, 18 nt, Vaccinia virus
uguccgaugaucaaugac

SEQ ID NO: 3269661 - RNA, 20 nt, Vaccinia virus
aucuucucuccuguuaauaa

SEQ ID NO: 3269662 - RNA, 15 nt, Vaccinia virus
cuuuaaaagaaacug

SEQ ID NO: 3269663 - RNA, 23 nt, Vaccinia virus
cuuuggauuuucaccaguaugua

SEQ ID NO: 3269664 - RNA, 12 nt, Vaccinia virus
ucaauagaauau

SEQ ID NO: 3269665 - RNA, 16 nt, Vaccinia virus
cauggaaaagaauuua

SEQ ID NO: 3269666 - RNA, 12 nt, Vaccinia virus
aauaagaauaaa

SEQ ID NO: 3269667 - RNA, 20 nt, Vaccinia virus
caaaaauauuuuuauucucu

SEQ ID NO: 3269668 - RNA, 17 nt, Vaccinia virus
auaaacuccguguuuau

SEQ ID NO: 3269669 - RNA, 12 nt, Vaccinia virus
auaauuuaagag

SEQ ID NO: 3269670 - RNA, 22 nt, Vaccinia virus
cuauacgaaauaaauauucaga

SEQ ID NO: 3269671 - RNA, 20 nt, Vaccinia virus
guuguacaaauggagauauu

SEQ ID NO: 3269672 - RNA, 19 nt, Vaccinia virus
agcuauaauaauaaaugua

SEQ ID NO: 3269673 - RNA, 22 nt, Vaccinia virus
uuccuguuccguuaacaucucu

SEQ ID NO: 3269674 - RNA, 20 nt, Vaccinia virus
uauucuaccauagcaaaucu

SEQ ID NO: 3269675 - RNA, 19 nt, Vaccinia virus
guaucgauaauuauuucua

SEQ ID NO: 3269676 - RNA, 15 nt, Vaccinia virus
aacucuuugacauau

SEQ ID NO: 3269677 - RNA, 18 nt, Vaccinia virus
uagugaucaguuuaugua

SEQ ID NO: 3269678 - RNA, 17 nt, Vaccinia virus
cuggaaguggauauaca

SEQ ID NO: 3269679 - RNA, 18 nt, Vaccinia virus
auaauauauuagauauuu

SEQ ID NO: 3269680 - RNA, 17 nt, Vaccinia virus
uauaccaauauuauucu

SEQ ID NO: 3269681 - RNA, 23 nt, Vaccinia virus
uacucuagguaacaaacaaacuc

SEQ ID NO: 3269682 - RNA, 15 nt, Vaccinia virus
ggauaugucuagaac

SEQ ID NO: 3269683 - RNA, 17 nt, Vaccinia virus
augugacguacaaaaaa

SEQ ID NO: 3269684 - RNA, 13 nt, Vaccinia virus
uccuuaaaguaac

SEQ ID NO: 3269685 - RNA, 15 nt, Vaccinia virus
uaagauuaucaaaau

SEQ ID NO: 3269686 - RNA, 22 nt, Vaccinia virus
gauaauuucuccagaacauuga

SEQ ID NO: 3269687 - RNA, 14 nt, Vaccinia virus
gaauuucuauguca

SEQ ID NO: 3269688 - RNA, 17 nt, Vaccinia virus
aaaaaugaaaauaaaua

SEQ ID NO: 3269689 - RNA, 16 nt, Vaccinia virus
aucuguuuccuauaau

SEQ ID NO: 3269690 - RNA, 19 nt, Vaccinia virus
auuacggaauuauuggcuu

SEQ ID NO: 3269691 - RNA, 23 nt, Vaccinia virus
ucuuaguuaauggagaaauacuu

SEQ ID NO: 3269692 - RNA, 15 nt, Vaccinia virus
aucaggaaaaaagau

SEQ ID NO: 3269693 - RNA, 15 nt, Vaccinia virus
guuaauuucuauuca

SEQ ID NO: 3269694 - RNA, 15 nt, Vaccinia virus
acuuuuguuacuaau

SEQ ID NO: 3269695 - RNA, 22 nt, Vaccinia virus
agauacuguguaaagaaauggu

SEQ ID NO: 3269696 - RNA, 19 nt, Vaccinia virus
uaacgauaacgucauuaau

SEQ ID NO: 3269697 - RNA, 20 nt, Vaccinia virus
cauuaauauaugcucuagau

SEQ ID NO: 3269698 - RNA, 12 nt, Vaccinia virus
aaacauggagac

SEQ ID NO: 3269699 - RNA, 12 nt, Vaccinia virus
acucaugaugaa

SEQ ID NO: 3269700 - RNA, 18 nt, Vaccinia virus
gaaaaaguuccauaugau

SEQ ID NO: 3269701 - RNA, 19 nt, Vaccinia virus
aguauaaacacgaauacua

SEQ ID NO: 3269702 - RNA, 22 nt, Vaccinia virus
augcuauccaucagaauguuuc

SEQ ID NO: 3269703 - RNA, 20 nt, Vaccinia virus
uaacauuuuuuguaaaugua

SEQ ID NO: 3269704 - RNA, 13 nt, Vaccinia virus
caacuguuguaaa

SEQ ID NO: 3269705 - RNA, 17 nt, Vaccinia virus
uguuuaucuauacuauu

SEQ ID NO: 3269706 - RNA, 15 nt, Vaccinia virus
gagcaaguagaaaac

SEQ ID NO: 3269707 - RNA, 17 nt, Vaccinia virus
aucaauuaaauaauuaa

SEQ ID NO: 3269708 - RNA, 15 nt, Vaccinia virus
acuuccguuuaaaaa

SEQ ID NO: 3269709 - RNA, 22 nt, Vaccinia virus
aaucauuguccagauugaacau

SEQ ID NO: 3269710 - RNA, 18 nt, Vaccinia virus
aaguucauaacagauaca

SEQ ID NO: 3269711 - RNA, 21 nt, Vaccinia virus
aaacuaggaaucgguaacagu

SEQ ID NO: 3269712 - RNA, 18 nt, Vaccinia virus
gacggcguuaauaguaau

SEQ ID NO: 3269713 - RNA, 21 nt, Vaccinia virus
auauuccggcguaugaauuga

SEQ ID NO: 3269714 - RNA, 13 nt, Vaccinia virus
agaagaauaugau

SEQ ID NO: 3269715 - RNA, 19 nt, Vaccinia virus
auaaugacuguagauauua

SEQ ID NO: 3269716 - RNA, 15 nt, Vaccinia virus
agguagcaaaaagau

SEQ ID NO: 3269717 - RNA, 16 nt, Vaccinia virus
uaugauggguggauau

SEQ ID NO: 3269718 - RNA, 19 nt, Vaccinia virus
aauuauuuuuucuuaguaa

SEQ ID NO: 3269719 - RNA, 19 nt, Vaccinia virus
ucuauaugugcgagaauau

SEQ ID NO: 3269720 - RNA, 22 nt, Vaccinia virus
uuuuaacuaguguagaaaacag

SEQ ID NO: 3269721 - RNA, 20 nt, Vaccinia virus
cguguucguuugaaugccac

SEQ ID NO: 3269722 - RNA, 19 nt, Vaccinia virus
caaaaaagcucaauaagau

SEQ ID NO: 3269723 - RNA, 14 nt, Vaccinia virus
uaauuuuacuagau

SEQ ID NO: 3269724 - RNA, 14 nt, Vaccinia virus
guuacuaaauuaau

SEQ ID NO: 3269725 - RNA, 15 nt, Vaccinia virus
caccguaguguauau

SEQ ID NO: 3269726 - RNA, 19 nt, Vaccinia virus
aaauauuaucgauauugaa

SEQ ID NO: 3269727 - RNA, 18 nt, Vaccinia virus
aucaacgaguucaaauau

SEQ ID NO: 3269728 - RNA, 11 nt, Vaccinia virus
uuucuagauac

SEQ ID NO: 3269729 - RNA, 13 nt, Vaccinia virus
cauuuguaauaau

SEQ ID NO: 3269730 - RNA, 20 nt, Vaccinia virus
uacaucuaaauuuuuacuau

SEQ ID NO: 3269731 - RNA, 15 nt, Vaccinia virus
agucugagaaaaugu

SEQ ID NO: 3269732 - RNA, 21 nt, Vaccinia virus
uaaaucuacucagauuauucu

SEQ ID NO: 3269733 - RNA, 12 nt, Vaccinia virus
cuuuuagaaaag

SEQ ID NO: 3269734 - RNA, 18 nt, Vaccinia virus
uccaugauacaacuuugc

SEQ ID NO: 3269735 - RNA, 21 nt, Vaccinia virus
uaauaucagaccguacauaca

SEQ ID NO: 3269736 - RNA, 16 nt, Vaccinia virus
cgauacuaauuacaaa

SEQ ID NO: 3269737 - RNA, 19 nt, Vaccinia virus
cguuaucguuuucuacaau

SEQ ID NO: 3269738 - RNA, 16 nt, Vaccinia virus
ccuauucuaaauggau

SEQ ID NO: 3269739 - RNA, 14 nt, Vaccinia virus
aacauguagauuua

SEQ ID NO: 3269740 - RNA, 17 nt, Vaccinia virus
cauauauuagaaauaca

SEQ ID NO: 3269741 - RNA, 21 nt, Vaccinia virus
aacucauauaacuucuagaug

SEQ ID NO: 3269742 - RNA, 16 nt, Vaccinia virus
aaauagguuuuguucu

SEQ ID NO: 3269743 - RNA, 17 nt, Vaccinia virus
acauaauucaucuauua

SEQ ID NO: 3269744 - RNA, 12 nt, Vaccinia virus
uaagauacugug

SEQ ID NO: 3269745 - RNA, 23 nt, Vaccinia virus
auaauggcuguuuguauaauaga

SEQ ID NO: 3269746 - RNA, 13 nt, Vaccinia virus
uagaggucuaagu

SEQ ID NO: 3269747 - RNA, 14 nt, Vaccinia virus
cuuuagaaaaacuu

SEQ ID NO: 3269748 - RNA, 21 nt, Vaccinia virus
aaugauauuucauugacagau

SEQ ID NO: 3269749 - RNA, 14 nt, Vaccinia virus
caaacugcugaagu

SEQ ID NO: 3269750 - RNA, 13 nt, Vaccinia virus
gaggagaaguaau

SEQ ID NO: 3269751 - RNA, 18 nt, Vaccinia virus
gagcuguuccaauaaauu

SEQ ID NO: 3269752 - RNA, 22 nt, Vaccinia virus
uaauauaaccaccgauaaaucu

SEQ ID NO: 3269753 - RNA, 21 nt, Vaccinia virus
ucgacauuuggaauguuauau

SEQ ID NO: 3269754 - RNA, 17 nt, Vaccinia virus
aaaucguauaaaguuau

SEQ ID NO: 3269755 - RNA, 15 nt, Vaccinia virus
aaauggauauuucca

SEQ ID NO: 3269756 - RNA, 21 nt, Vaccinia virus
ucgguaucuagaucucuagaa

SEQ ID NO: 3269757 - RNA, 12 nt, Vaccinia virus
ucaauacaaaaa

SEQ ID NO: 3269758 - RNA, 19 nt, Vaccinia virus
gcuugauaagauaaaaucu

SEQ ID NO: 3269759 - RNA, 16 nt, Vaccinia virus
cagauacaguuaauau

SEQ ID NO: 3269760 - RNA, 18 nt, Vaccinia virus
ugaugaauaauuuagaua

SEQ ID NO: 3269761 - RNA, 14 nt, Vaccinia virus
acggugaauacaau

SEQ ID NO: 3269762 - RNA, 19 nt, Vaccinia virus
agaauguuccagaguguuu

SEQ ID NO: 3269763 - RNA, 14 nt, Vaccinia virus
auacuaauaugaca

SEQ ID NO: 3269764 - RNA, 14 nt, Vaccinia virus
uauacauuacugaa

SEQ ID NO: 3269765 - RNA, 23 nt, Vaccinia virus
cauccuaagaugauaaaaaacuu

SEQ ID NO: 3269766 - RNA, 11 nt, Vaccinia virus
aacauucucca

SEQ ID NO: 3269767 - RNA, 23 nt, Vaccinia virus
cuaccauggcuccguuuaauuug

SEQ ID NO: 3269768 - RNA, 17 nt, Vaccinia virus
ccagaucaaaacaaaau

SEQ ID NO: 3269769 - RNA, 20 nt, Vaccinia virus
uccaauugaaugucaugaua

SEQ ID NO: 3269770 - RNA, 14 nt, Vaccinia virus
uuaucaucauuaaa

SEQ ID NO: 3269771 - RNA, 16 nt, Vaccinia virus
caaguaugacauugua

SEQ ID NO: 3269772 - RNA, 15 nt, Vaccinia virus
uuuauaaaaacuuuu

SEQ ID NO: 3269773 - RNA, 22 nt, Vaccinia virus
gcggacauuaaacgauuugaug

SEQ ID NO: 3269774 - RNA, 19 nt, Vaccinia virus
gauaguauucaagucaaag

SEQ ID NO: 3269775 - RNA, 14 nt, Vaccinia virus
uauaaggucagaaa

SEQ ID NO: 3269776 - RNA, 14 nt, Vaccinia virus
guaaauuaguucau

SEQ ID NO: 3269777 - RNA, 21 nt, Vaccinia virus
aucugauaagauaucuucuca

SEQ ID NO: 3269778 - RNA, 23 nt, Vaccinia virus
caaaaggacguagacaauacuuu

SEQ ID NO: 3269779 - RNA, 15 nt, Vaccinia virus
uaaaguaauaaucuu

SEQ ID NO: 3269780 - RNA, 13 nt, Vaccinia virus
uucuacaauaacu

SEQ ID NO: 3269781 - RNA, 15 nt, Vaccinia virus
agaauuaacuaguau

SEQ ID NO: 3269782 - RNA, 15 nt, Vaccinia virus
auacauccuucuaug

SEQ ID NO: 3269783 - RNA, 15 nt, Vaccinia virus
aucgucacaaugaua

SEQ ID NO: 3269784 - RNA, 22 nt, Vaccinia virus
acauauaccgccuuucaaaauu

SEQ ID NO: 3269785 - RNA, 15 nt, Vaccinia virus
cagucauuccaucau

SEQ ID NO: 3269786 - RNA, 13 nt, Vaccinia virus
cuuaacuuuuucu

SEQ ID NO: 3269787 - RNA, 16 nt, Vaccinia virus
uuuaaaaaguuaucuu

SEQ ID NO: 3269788 - RNA, 18 nt, Vaccinia virus
uaccauuagauaaucuag

SEQ ID NO: 3269789 - RNA, 18 nt, Vaccinia virus
acuacuuacauggacaca

SEQ ID NO: 3269790 - RNA, 23 nt, Vaccinia virus
aucgcccaucuauuacaaacaug

SEQ ID NO: 3269791 - RNA, 23 nt, Vaccinia virus
uagaggagacauuagaaucauug

SEQ ID NO: 3269792 - RNA, 18 nt, Vaccinia virus
auauauuaucauagaccu

SEQ ID NO: 3269793 - RNA, 15 nt, Vaccinia virus
uccuauuucacgaaa

SEQ ID NO: 3269794 - RNA, 17 nt, Vaccinia virus
guuuagcuauucguaac

SEQ ID NO: 3269795 - RNA, 19 nt, Vaccinia virus
uacuuugucggauuaucua

SEQ ID NO: 3269796 - RNA, 19 nt, Vaccinia virus
uuauuagucugucuguaga

SEQ ID NO: 3269797 - RNA, 21 nt, Vaccinia virus
gucuaaauccaacuauagaca

SEQ ID NO: 3269798 - RNA, 17 nt, Vaccinia virus
acaauguuuccauccau

SEQ ID NO: 3269799 - RNA, 14 nt, Vaccinia virus
aguauucaagucaa

SEQ ID NO: 3269800 - RNA, 15 nt, Vaccinia virus
agugcacguuuacau

SEQ ID NO: 3269801 - RNA, 15 nt, Vaccinia virus
caaauaggagauauu

SEQ ID NO: 3269802 - RNA, 15 nt, Vaccinia virus
cuguuaauaacucua

SEQ ID NO: 3269803 - RNA, 16 nt, Vaccinia virus
guucuuacacauauca

SEQ ID NO: 3269804 - RNA, 21 nt, Vaccinia virus
cauuaccuccacgauacauuu

SEQ ID NO: 3269805 - RNA, 21 nt, Vaccinia virus
caauuuuacccucaaucaugu

SEQ ID NO: 3269806 - RNA, 21 nt, Vaccinia virus
uagauuaaugcuuaaacuauc

SEQ ID NO: 3269807 - RNA, 19 nt, Vaccinia virus
agucaucuugucuagaaug

SEQ ID NO: 3269808 - RNA, 12 nt, Vaccinia virus
gccaaaguuaua

SEQ ID NO: 3269809 - RNA, 18 nt, Vaccinia virus
acagaauguagauaauca

SEQ ID NO: 3269810 - RNA, 13 nt, Vaccinia virus
auacuagucuuag

SEQ ID NO: 3269811 - RNA, 16 nt, Vaccinia virus
aaaauacuauagacca

SEQ ID NO: 3269812 - RNA, 18 nt, Vaccinia virus
auauuaccaguuguggaa

SEQ ID NO: 3269813 - RNA, 21 nt, Vaccinia virus
uagauacucuaccauuucugc

SEQ ID NO: 3269814 - RNA, 11 nt, Vaccinia virus
aaaacauaaua

SEQ ID NO: 3269815 - RNA, 17 nt, Vaccinia virus
uaagucccgaugaaaua

SEQ ID NO: 3269816 - RNA, 19 nt, Vaccinia virus
aauauaucaaacauggaga

SEQ ID NO: 3269817 - RNA, 17 nt, Vaccinia virus
uaacaaaaauuaugaaa

SEQ ID NO: 3269818 - RNA, 14 nt, Vaccinia virus
gagauuuagaaaac

SEQ ID NO: 3269819 - RNA, 18 nt, Vaccinia virus
uaaucauaaauuauuuca

SEQ ID NO: 3269820 - RNA, 14 nt, Vaccinia virus
auuaauuguaaaug

SEQ ID NO: 3269821 - RNA, 19 nt, Vaccinia virus
uguaaauuaggagaaacaa

SEQ ID NO: 3269822 - RNA, 17 nt, Vaccinia virus
aaauauguaauaaucau

SEQ ID NO: 3269823 - RNA, 19 nt, Vaccinia virus
aaguggacauauagaugca

SEQ ID NO: 3269824 - RNA, 15 nt, Vaccinia virus
aacauaaguauauaa

SEQ ID NO: 3269825 - RNA, 14 nt, Vaccinia virus
auaaaauaauacau

SEQ ID NO: 3269826 - RNA, 19 nt, Vaccinia virus
caauuggcacgaacaaaag

SEQ ID NO: 3269827 - RNA, 14 nt, Vaccinia virus
ucaaauuuuuucuu

SEQ ID NO: 3269828 - RNA, 18 nt, Vaccinia virus
uuauuucaaaauuauuua

SEQ ID NO: 3269829 - RNA, 21 nt, Vaccinia virus
auaugauuucagauacuauau

SEQ ID NO: 3269830 - RNA, 21 nt, Vaccinia virus
auauaguuauuaaugaugaaa

SEQ ID NO: 3269831 - RNA, 15 nt, Vaccinia virus
auuuacccauggaaa

SEQ ID NO: 3269832 - RNA, 16 nt, Vaccinia virus
ugacaucuuguagaac

SEQ ID NO: 3269833 - RNA, 17 nt, Vaccinia virus
auuuauuucuauaccuu

SEQ ID NO: 3269834 - RNA, 17 nt, Vaccinia virus
uuguuguccguuaucua

SEQ ID NO: 3269835 - RNA, 22 nt, Vaccinia virus
auuaucgagcgugauguuguaa

SEQ ID NO: 3269836 - RNA, 16 nt, Vaccinia virus
uaacaauugucuguaa

SEQ ID NO: 3269837 - RNA, 15 nt, Vaccinia virus
acaauguauaauaua

SEQ ID NO: 3269838 - RNA, 20 nt, Vaccinia virus
uauaaaggaauaaaauauga

SEQ ID NO: 3269839 - RNA, 17 nt, Vaccinia virus
ugauuggguagaaguag

SEQ ID NO: 3269840 - RNA, 14 nt, Vaccinia virus
ugaaagaacuacau

SEQ ID NO: 3269841 - RNA, 17 nt, Vaccinia virus
uagaaacuucaaagauu

SEQ ID NO: 3269842 - RNA, 13 nt, Vaccinia virus
aauggcaaaugua

SEQ ID NO: 3269843 - RNA, 14 nt, Vaccinia virus
aagauauauacacu

SEQ ID NO: 3269844 - RNA, 22 nt, Vaccinia virus
uaaaacuggagagacugauuac

SEQ ID NO: 3269845 - RNA, 15 nt, Vaccinia virus
gagaucuaaauacaa

SEQ ID NO: 3269846 - RNA, 21 nt, Vaccinia virus
augaccaguuugcaauaugca

SEQ ID NO: 3269847 - RNA, 18 nt, Vaccinia virus
aauuaguucguuggaaaa

SEQ ID NO: 3269848 - RNA, 18 nt, Vaccinia virus
uacuauuuguaauauuua

SEQ ID NO: 3269849 - RNA, 17 nt, Vaccinia virus
auccuauaacuucuaau

SEQ ID NO: 3269850 - RNA, 13 nt, Vaccinia virus
agauaaugauaua

SEQ ID NO: 3269851 - RNA, 13 nt, Vaccinia virus
cguaaacuauuac

SEQ ID NO: 3269852 - RNA, 21 nt, Vaccinia virus
cuccuagguuucucuauaaac

SEQ ID NO: 3269853 - RNA, 17 nt, Vaccinia virus
auauucaagcgaauuac

SEQ ID NO: 3269854 - RNA, 18 nt, Vaccinia virus
gcaaagauguuuaaugau

SEQ ID NO: 3269855 - RNA, 16 nt, Vaccinia virus
cguguucuuguguaau

SEQ ID NO: 3269856 - RNA, 23 nt, Vaccinia virus
uagauaaugguagcaauaugcua

SEQ ID NO: 3269857 - RNA, 20 nt, Vaccinia virus
cauuaaguaaaguaaacaau

SEQ ID NO: 3269858 - RNA, 13 nt, Vaccinia virus
gcgccaaauugug

SEQ ID NO: 3269859 - RNA, 14 nt, Vaccinia virus
ugaaccaaacauuc

SEQ ID NO: 3269860 - RNA, 16 nt, Vaccinia virus
acuuacugacaaaguu

SEQ ID NO: 3269861 - RNA, 16 nt, Vaccinia virus
uaauuagguuguuuau

SEQ ID NO: 3269862 - RNA, 20 nt, Vaccinia virus
gaaaacauuuuuaucauguu

SEQ ID NO: 3269863 - RNA, 21 nt, Vaccinia virus
auagaugugguaauaucugac

SEQ ID NO: 3269864 - RNA, 20 nt, Vaccinia virus
auccuuauaaagaaugaaug

SEQ ID NO: 3269865 - RNA, 13 nt, Vaccinia virus
gauucuaucuuua

SEQ ID NO: 3269866 - RNA, 18 nt, Vaccinia virus
uaaacguauucaugacau

SEQ ID NO: 3269867 - RNA, 19 nt, Vaccinia virus
aaaccauuuuucagaaagu

SEQ ID NO: 3269868 - RNA, 15 nt, Vaccinia virus
gaagaaaacaaacau

SEQ ID NO: 3269869 - RNA, 21 nt, Vaccinia virus
aggucuauuaggccucagaau

SEQ ID NO: 3269870 - RNA, 18 nt, Vaccinia virus
aauucauagccaauggau

SEQ ID NO: 3269871 - RNA, 22 nt, Vaccinia virus
aaagcggauauaccuagcaaac

SEQ ID NO: 3269872 - RNA, 15 nt, Vaccinia virus
aaaauagaaaaaaca

SEQ ID NO: 3269873 - RNA, 18 nt, Vaccinia virus
uccaugauagaaagaaaa

SEQ ID NO: 3269874 - RNA, 15 nt, Vaccinia virus
auaucuuguucuaug

SEQ ID NO: 3269875 - RNA, 15 nt, Vaccinia virus
ucauucuagaacuau

SEQ ID NO: 3269876 - RNA, 13 nt, Vaccinia virus
aaaacucaaaugu

SEQ ID NO: 3269877 - RNA, 13 nt, Vaccinia virus
auuaucugaaaug

SEQ ID NO: 3269878 - RNA, 15 nt, Vaccinia virus
uguguaaaauaucag

SEQ ID NO: 3269879 - RNA, 22 nt, Vaccinia virus
gcuacacccacuagaaaccacg

SEQ ID NO: 3269880 - RNA, 20 nt, Vaccinia virus
uuuaugaugccgguaaaugu

SEQ ID NO: 3269881 - RNA, 18 nt, Vaccinia virus
gaguaguacaagaaauau

SEQ ID NO: 3269882 - RNA, 21 nt, Vaccinia virus
uggaguguauauuuaucucuu

SEQ ID NO: 3269883 - RNA, 16 nt, Vaccinia virus
auagauuuuucauauu

SEQ ID NO: 3269884 - RNA, 23 nt, Vaccinia virus
agcaaagggugguaucauggcag

SEQ ID NO: 3269885 - RNA, 22 nt, Vaccinia virus
gaaaauaaugacgcguacgaua

SEQ ID NO: 3269886 - RNA, 22 nt, Vaccinia virus
agaauucaagucaggaacuauu

SEQ ID NO: 3269887 - RNA, 13 nt, Vaccinia virus
gucaaagaaauac

SEQ ID NO: 3269888 - RNA, 22 nt, Vaccinia virus
ucuaaagaacggagaauaucua

SEQ ID NO: 3269889 - RNA, 20 nt, Vaccinia virus
auuaauuguuauuuuauuca

SEQ ID NO: 3269890 - RNA, 16 nt, Vaccinia virus
aaauacuuuauauucu

SEQ ID NO: 3269891 - RNA, 13 nt, Vaccinia virus
aauaccaauuuuu

SEQ ID NO: 3269892 - RNA, 15 nt, Vaccinia virus
cuuuacuaagaaagu

SEQ ID NO: 3269893 - RNA, 21 nt, Vaccinia virus
aauaaauuauuuguugugacu

SEQ ID NO: 3269894 - RNA, 16 nt, Vaccinia virus
uuacuuagucuguaca

SEQ ID NO: 3269895 - RNA, 19 nt, Vaccinia virus
ucuacuagacuauuaauaa

SEQ ID NO: 3269896 - RNA, 14 nt, Vaccinia virus
auuugauguuguag

SEQ ID NO: 3269897 - RNA, 18 nt, Vaccinia virus
guaugaccguuaacuaca

SEQ ID NO: 3269898 - RNA, 17 nt, Vaccinia virus
ugcggguaucacuguua

SEQ ID NO: 3269899 - RNA, 13 nt, Vaccinia virus
gauaguaaugcau

SEQ ID NO: 3269900 - RNA, 15 nt, Vaccinia virus
uugaucagaaugaau

SEQ ID NO: 3269901 - RNA, 15 nt, Vaccinia virus
cuggaggaguaagaa

SEQ ID NO: 3269902 - RNA, 15 nt, Vaccinia virus
uugugauucuagaau

SEQ ID NO: 3269903 - RNA, 21 nt, Vaccinia virus
uucucaaaagaucaaggaaau

SEQ ID NO: 3269904 - RNA, 14 nt, Vaccinia virus
uaaauguaaauuca

SEQ ID NO: 3269905 - RNA, 12 nt, Vaccinia virus
ucguuguagaaa

SEQ ID NO: 3269906 - RNA, 19 nt, Vaccinia virus
uauuuucuucuacguacau

SEQ ID NO: 3269907 - RNA, 20 nt, Vaccinia virus
caaggaaacuaauaccucua

SEQ ID NO: 3269908 - RNA, 15 nt, Vaccinia virus
cuuugcaauauugua

SEQ ID NO: 3269909 - RNA, 17 nt, Vaccinia virus
gauaacuauaaauggag

SEQ ID NO: 3269910 - RNA, 21 nt, Vaccinia virus
uauuuccacauugcuuuaaaa

SEQ ID NO: 3269911 - RNA, 15 nt, Vaccinia virus
ucuauaguucucauc

SEQ ID NO: 3269912 - RNA, 18 nt, Vaccinia virus
cagaauuucuacauaauu

SEQ ID NO: 3269913 - RNA, 24 nt, Vaccinia virus
accauuauucgccuguaucagaua

SEQ ID NO: 3269914 - RNA, 14 nt, Vaccinia virus
uguccugcauguag

SEQ ID NO: 3269915 - RNA, 21 nt, Vaccinia virus
uuaaauccucuauuuauugac

SEQ ID NO: 3269916 - RNA, 19 nt, Vaccinia virus
uaucgauaauuauuucuac

SEQ ID NO: 3269917 - RNA, 16 nt, Vaccinia virus
caggagauagauaucc

SEQ ID NO: 3269918 - RNA, 12 nt, Vaccinia virus
guucucuaaaug

SEQ ID NO: 3269919 - RNA, 19 nt, Vaccinia virus
auaagaugucuaugaauau

SEQ ID NO: 3269920 - RNA, 20 nt, Vaccinia virus
aacacugaagcuaacgauga

SEQ ID NO: 3269921 - RNA, 18 nt, Vaccinia virus
gcuauuagagguaaugau

SEQ ID NO: 3269922 - RNA, 20 nt, Vaccinia virus
gcauauuaaaguaaaaucua

SEQ ID NO: 3269923 - RNA, 23 nt, Vaccinia virus
gaaacguaauauccucaauaacg

SEQ ID NO: 3269924 - RNA, 15 nt, Vaccinia virus
guauuggauaaagga

SEQ ID NO: 3269925 - RNA, 18 nt, Vaccinia virus
acuccccgaagauuuguu

SEQ ID NO: 3269926 - RNA, 21 nt, Vaccinia virus
guauuaauacaugucuuagau

SEQ ID NO: 3269927 - RNA, 14 nt, Vaccinia virus
auaacuuuuucaau

SEQ ID NO: 3269928 - RNA, 14 nt, Vaccinia virus
uaaacuuuaacaau

SEQ ID NO: 3269929 - RNA, 15 nt, Vaccinia virus
uuaaucguauguaua

SEQ ID NO: 3269930 - RNA, 16 nt, Vaccinia virus
uaucugcggaagagac

SEQ ID NO: 3269931 - RNA, 18 nt, Vaccinia virus
caacaagagcagauaucu

SEQ ID NO: 3269932 - RNA, 17 nt, Vaccinia virus
gacgauuccaacaaacg

SEQ ID NO: 3269933 - RNA, 22 nt, Vaccinia virus
aaauaucuuaaggagaaugaaa

SEQ ID NO: 3269934 - RNA, 17 nt, Vaccinia virus
uuagauaaaugcgguaa

SEQ ID NO: 3269935 - RNA, 20 nt, Vaccinia virus
auaggauucuuaauaugaua

SEQ ID NO: 3269936 - RNA, 17 nt, Vaccinia virus
auacuaauucaaauugu

SEQ ID NO: 3269937 - RNA, 13 nt, Vaccinia virus
aacacuauuagaa

SEQ ID NO: 3269938 - RNA, 22 nt, Vaccinia virus
aagaugcaaacauuauguagua

SEQ ID NO: 3269939 - RNA, 20 nt, Vaccinia virus
aucacauuguauauaguuua

SEQ ID NO: 3269940 - RNA, 18 nt, Vaccinia virus
uagaauuuauaaacauca

SEQ ID NO: 3269941 - RNA, 12 nt, Vaccinia virus
aacuaaaaaugu

SEQ ID NO: 3269942 - RNA, 12 nt, Vaccinia virus
uucuaaaauagu

SEQ ID NO: 3269943 - RNA, 22 nt, Vaccinia virus
gucauaaaaauguuuaaaucaa

SEQ ID NO: 3269944 - RNA, 14 nt, Vaccinia virus
uauacauucuucug

SEQ ID NO: 3269945 - RNA, 20 nt, Vaccinia virus
uuaaggaauacaauacauac

SEQ ID NO: 3269946 - RNA, 21 nt, Vaccinia virus
aacauuauaauaaucaauaau

SEQ ID NO: 3269947 - RNA, 12 nt, Vaccinia virus
uuauuguaacag

SEQ ID NO: 3269948 - RNA, 15 nt, Vaccinia virus
uacgucaucaaaaau

SEQ ID NO: 3269949 - RNA, 14 nt, Vaccinia virus
auaauaauaaaugu

SEQ ID NO: 3269950 - RNA, 11 nt, Vaccinia virus
uuaguauacac

SEQ ID NO: 3269951 - RNA, 17 nt, Vaccinia virus
auuaugaugauacauuu

SEQ ID NO: 3269952 - RNA, 22 nt, Vaccinia virus
auaaucuucgucuauuacacca

SEQ ID NO: 3269953 - RNA, 19 nt, Vaccinia virus
ucgacuauuuuaaauagca

SEQ ID NO: 3269954 - RNA, 15 nt, Vaccinia virus
auaauuuaacauuuu

SEQ ID NO: 3269955 - RNA, 18 nt, Vaccinia virus
gcauaaacuauacuauga

SEQ ID NO: 3269956 - RNA, 15 nt, Vaccinia virus
guacaaauauguaca

SEQ ID NO: 3269957 - RNA, 21 nt, Vaccinia virus
aaauguauuuuuuaugauaua

SEQ ID NO: 3269958 - RNA, 20 nt, Vaccinia virus
aucaacggauaaucugaagu

SEQ ID NO: 3269959 - RNA, 18 nt, Vaccinia virus
ugugauagucgauacguu

SEQ ID NO: 3269960 - RNA, 16 nt, Vaccinia virus
augauauguuaaauau

SEQ ID NO: 3269961 - RNA, 20 nt, Vaccinia virus
ccgaauuuguuuuguuuauu

SEQ ID NO: 3269962 - RNA, 19 nt, Vaccinia virus
aucaaacauuuaauuacau

SEQ ID NO: 3269963 - RNA, 14 nt, Vaccinia virus
aaauagggauguuu

SEQ ID NO: 3269964 - RNA, 12 nt, Vaccinia virus
agaggaaauauc

SEQ ID NO: 3269965 - RNA, 15 nt, Vaccinia virus
uuuauuccaaucauu

SEQ ID NO: 3269966 - RNA, 19 nt, Vaccinia virus
ggcaauaacuaaaaaugua

SEQ ID NO: 3269967 - RNA, 14 nt, Vaccinia virus
auguuaucaaaccu

SEQ ID NO: 3269968 - RNA, 18 nt, Vaccinia virus
uaagauguuugagaauau

SEQ ID NO: 3269969 - RNA, 17 nt, Vaccinia virus
cagaggauaacuauuua

SEQ ID NO: 3269970 - RNA, 17 nt, Vaccinia virus
aguaucgaaaaaugcug

SEQ ID NO: 3269971 - RNA, 20 nt, Vaccinia virus
uacaaauguagaagauauca

SEQ ID NO: 3269972 - RNA, 20 nt, Vaccinia virus
ccaauauaguaguuaaauua

SEQ ID NO: 3269973 - RNA, 20 nt, Vaccinia virus
acaauauuaucaucuugaau

SEQ ID NO: 3269974 - RNA, 17 nt, Vaccinia virus
cgaguuuaaaacuucua

SEQ ID NO: 3269975 - RNA, 13 nt, Vaccinia virus
auguauaaaccuu

SEQ ID NO: 3269976 - RNA, 22 nt, Vaccinia virus
auauccuuuagaguauuucuca

SEQ ID NO: 3269977 - RNA, 13 nt, Vaccinia virus
uacuauaauauua

SEQ ID NO: 3269978 - RNA, 14 nt, Vaccinia virus
ugaaaauaaagaua

SEQ ID NO: 3269979 - RNA, 23 nt, Vaccinia virus
uucacagauagaucauuuugaac

SEQ ID NO: 3269980 - RNA, 17 nt, Vaccinia virus
caccaucggaugauauu

SEQ ID NO: 3269981 - RNA, 15 nt, Vaccinia virus
gaauuuauuaauaca

SEQ ID NO: 3269982 - RNA, 15 nt, Vaccinia virus
cauuuacaacucuau

SEQ ID NO: 3269983 - RNA, 14 nt, Vaccinia virus
ugaggauaaugcua

SEQ ID NO: 3269984 - RNA, 22 nt, Vaccinia virus
uuaaacuguuuguauaauaucu

SEQ ID NO: 3269985 - RNA, 18 nt, Vaccinia virus
acugaaugcuuucuugga

SEQ ID NO: 3269986 - RNA, 15 nt, Vaccinia virus
auauuguagcauuac

SEQ ID NO: 3269987 - RNA, 21 nt, Vaccinia virus
acaaaaauugucacuuuguua

SEQ ID NO: 3269988 - RNA, 16 nt, Vaccinia virus
gcugaggguguuagaa

SEQ ID NO: 3269989 - RNA, 16 nt, Vaccinia virus
gucaguaguauacauc

SEQ ID NO: 3269990 - RNA, 13 nt, Vaccinia virus
acacauuaacauc

SEQ ID NO: 3269991 - RNA, 15 nt, Vaccinia virus
uauauaguuuggauu

SEQ ID NO: 3269992 - RNA, 15 nt, Vaccinia virus
aauugaguaaaugaa

SEQ ID NO: 3269993 - RNA, 20 nt, Vaccinia virus
ucuuaaggagaaugaaacag

SEQ ID NO: 3269994 - RNA, 15 nt, Vaccinia virus
uuucuggcuaagaag

SEQ ID NO: 3269995 - RNA, 16 nt, Vaccinia virus
auuuuuagugaaacau

SEQ ID NO: 3269996 - RNA, 20 nt, Vaccinia virus
auaagaggcauaaucaaugu

SEQ ID NO: 3269997 - RNA, 19 nt, Vaccinia virus
ucuggaaugacgaauccug

SEQ ID NO: 3269998 - RNA, 21 nt, Vaccinia virus
uuuuuauaaaaacuuuuagaa

SEQ ID NO: 3269999 - RNA, 16 nt, Vaccinia virus
agaucaaaacaaaauu

SEQ ID NO: 3270000 - RNA, 19 nt, Vaccinia virus
acauuuuuuauaaauagau

SEQ ID NO: 3270001 - RNA, 15 nt, Vaccinia virus
aacaauguuugucau

SEQ ID NO: 3270002 - RNA, 20 nt, Vaccinia virus
acuuuaucaucuuauauaga

SEQ ID NO: 3270003 - RNA, 21 nt, Vaccinia virus
uugauauaucaguuaaugcgu

SEQ ID NO: 3270004 - RNA, 20 nt, Vaccinia virus
auccuaaagaguauggugaa

SEQ ID NO: 3270005 - RNA, 21 nt, Vaccinia virus
cuguacaaauguuaaacauua

SEQ ID NO: 3270006 - RNA, 13 nt, Vaccinia virus
agaccagaaaugc

SEQ ID NO: 3270007 - RNA, 13 nt, Vaccinia virus
auaauauaaucua

SEQ ID NO: 3270008 - RNA, 14 nt, Vaccinia virus
uacacaacacaaug

SEQ ID NO: 3270009 - RNA, 16 nt, Vaccinia virus
caucggaucuguaaaa

SEQ ID NO: 3270010 - RNA, 22 nt, Vaccinia virus
guugagugaaagguggaagauc

SEQ ID NO: 3270011 - RNA, 19 nt, Vaccinia virus
cuaguaaaucaacugauag

SEQ ID NO: 3270012 - RNA, 18 nt, Vaccinia virus
aacaauauaaauccagua

SEQ ID NO: 3270013 - RNA, 17 nt, Vaccinia virus
caggauaaggaauugua

SEQ ID NO: 3270014 - RNA, 21 nt, Vaccinia virus
ggaucuaaaauccauauuuuc

SEQ ID NO: 3270015 - RNA, 21 nt, Vaccinia virus
auuuuaagaaaugguguaacu

SEQ ID NO: 3270016 - RNA, 14 nt, Vaccinia virus
uaaacaaaauacuc

SEQ ID NO: 3270017 - RNA, 16 nt, Vaccinia virus
cuaaugaccacaucuu

SEQ ID NO: 3270018 - RNA, 13 nt, Vaccinia virus
aggacuuaacaau

SEQ ID NO: 3270019 - RNA, 20 nt, Vaccinia virus
auaauaguacgacuuuaaau

SEQ ID NO: 3270020 - RNA, 16 nt, Vaccinia virus
ucaaauuguccuauau

SEQ ID NO: 3270021 - RNA, 15 nt, Vaccinia virus
gauauuucuggaaug

SEQ ID NO: 3270022 - RNA, 19 nt, Vaccinia virus
uauaauaaacuuuaaugau

SEQ ID NO: 3270023 - RNA, 18 nt, Vaccinia virus
uguuaaaaauaugugcuc

SEQ ID NO: 3270024 - RNA, 15 nt, Vaccinia virus
aggaugaaaaaggac

SEQ ID NO: 3270025 - RNA, 18 nt, Vaccinia virus
aaagcaguuaccaaagag

SEQ ID NO: 3270026 - RNA, 14 nt, Vaccinia virus
acuuuaacaaucuc

SEQ ID NO: 3270027 - RNA, 20 nt, Vaccinia virus
cagaaaugacuccaugaaaa

SEQ ID NO: 3270028 - RNA, 15 nt, Vaccinia virus
cuauauuuaucacag

SEQ ID NO: 3270029 - RNA, 20 nt, Vaccinia virus
auaucagccgcacuagcauc

SEQ ID NO: 3270030 - RNA, 12 nt, Vaccinia virus
uaaauaaauguc

SEQ ID NO: 3270031 - RNA, 20 nt, Vaccinia virus
guuuucagaagauaauuauc

SEQ ID NO: 3270032 - RNA, 16 nt, Vaccinia virus
uaaaauaaaaugagua

SEQ ID NO: 3270033 - RNA, 19 nt, Vaccinia virus
auucauaugacuaaaaugc

SEQ ID NO: 3270034 - RNA, 16 nt, Vaccinia virus
acuaacaauaacuaga

SEQ ID NO: 3270035 - RNA, 18 nt, Vaccinia virus
auccuuguucagauacua

SEQ ID NO: 3270036 - RNA, 17 nt, Vaccinia virus
cucuggauauaucacaa

SEQ ID NO: 3270037 - RNA, 19 nt, Vaccinia virus
agauaucgacgguauguau

SEQ ID NO: 3270038 - RNA, 18 nt, Vaccinia virus
aagaccugacuagcaaau

SEQ ID NO: 3270039 - RNA, 18 nt, Vaccinia virus
guaacagcuuggacaauc

SEQ ID NO: 3270040 - RNA, 16 nt, Vaccinia virus
auagggaaucauauau

SEQ ID NO: 3270041 - RNA, 18 nt, Vaccinia virus
auaguuugggaaaagaaa

SEQ ID NO: 3270042 - RNA, 22 nt, Vaccinia virus
agucuccuucgauggucucaca

SEQ ID NO: 3270043 - RNA, 12 nt, Vaccinia virus
uaaauagaauau

SEQ ID NO: 3270044 - RNA, 21 nt, Vaccinia virus
uaacggaugaaaauaagaaaa

SEQ ID NO: 3270045 - RNA, 22 nt, Vaccinia virus
aacuuauaauccuuuuuauuua

SEQ ID NO: 3270046 - RNA, 14 nt, Vaccinia virus
auaaauuauuucau

SEQ ID NO: 3270047 - RNA, 14 nt, Vaccinia virus
ugaaacuaagucac

SEQ ID NO: 3270048 - RNA, 17 nt, Vaccinia virus
auuauucauaaauaacu

SEQ ID NO: 3270049 - RNA, 14 nt, Vaccinia virus
agaggcauaaucaa

SEQ ID NO: 3270050 - RNA, 23 nt, Vaccinia virus
uaacauuguuaauugaaaaggga

SEQ ID NO: 3270051 - RNA, 21 nt, Vaccinia virus
aaucuuaaacauauagggaau

SEQ ID NO: 3270052 - RNA, 13 nt, Vaccinia virus
uaugaaauuuaag

SEQ ID NO: 3270053 - RNA, 23 nt, Vaccinia virus
cugaacacgauguuuauggaguu

SEQ ID NO: 3270054 - RNA, 17 nt, Vaccinia virus
aggacaccacuaucuga

SEQ ID NO: 3270055 - RNA, 13 nt, Vaccinia virus
cucagaaacagaa

SEQ ID NO: 3270056 - RNA, 19 nt, Vaccinia virus
auuaacaaaagugaauaua

SEQ ID NO: 3270057 - RNA, 13 nt, Vaccinia virus
guaaagauaucua

SEQ ID NO: 3270058 - RNA, 13 nt, Vaccinia virus
gaaaagauaacua

SEQ ID NO: 3270059 - RNA, 16 nt, Vaccinia virus
aguuagaaaguauuuu

SEQ ID NO: 3270060 - RNA, 14 nt, Vaccinia virus
caacaaauuuggaa

SEQ ID NO: 3270061 - RNA, 21 nt, Vaccinia virus
augucuaauggcgaacauguu

SEQ ID NO: 3270062 - RNA, 18 nt, Vaccinia virus
aaauuaucaaauacuuca

SEQ ID NO: 3270063 - RNA, 15 nt, Vaccinia virus
auaggaccauacauu

SEQ ID NO: 3270064 - RNA, 22 nt, Vaccinia virus
cauccuuggauagagauugaga

SEQ ID NO: 3270065 - RNA, 17 nt, Vaccinia virus
aucucuccgaccauucc

SEQ ID NO: 3270066 - RNA, 14 nt, Vaccinia virus
aauagauggauaaa

SEQ ID NO: 3270067 - RNA, 14 nt, Vaccinia virus
ucucccuacgacga

SEQ ID NO: 3270068 - RNA, 17 nt, Vaccinia virus
uaaucuuguaauauuca

SEQ ID NO: 3270069 - RNA, 17 nt, Vaccinia virus
uaucgagaucuuuugua

SEQ ID NO: 3270070 - RNA, 13 nt, Vaccinia virus
auguaaaauaaua

SEQ ID NO: 3270071 - RNA, 16 nt, Vaccinia virus
uauaaaaauuaauauu

SEQ ID NO: 3270072 - RNA, 22 nt, Vaccinia virus
cuaauauucccaaacauacauc

SEQ ID NO: 3270073 - RNA, 21 nt, Vaccinia virus
uaguucuucaguaguaauaac

SEQ ID NO: 3270074 - RNA, 15 nt, Vaccinia virus
aaccagaaguuuuau

SEQ ID NO: 3270075 - RNA, 19 nt, Vaccinia virus
cuaauuuguaaaccaucuu

SEQ ID NO: 3270076 - RNA, 22 nt, Vaccinia virus
gaugccaauaagcuuuagauau

SEQ ID NO: 3270077 - RNA, 20 nt, Vaccinia virus
uaucagaagugugaauauga

SEQ ID NO: 3270078 - RNA, 17 nt, Vaccinia virus
gcaucaguaucuucaga

SEQ ID NO: 3270079 - RNA, 16 nt, Vaccinia virus
augauacguacaauga

SEQ ID NO: 3270080 - RNA, 14 nt, Vaccinia virus
auacucagaauuau

SEQ ID NO: 3270081 - RNA, 19 nt, Vaccinia virus
agauuaucaaaaucuuguc

SEQ ID NO: 3270082 - RNA, 17 nt, Vaccinia virus
uaguuuuucuuuacaca

SEQ ID NO: 3270083 - RNA, 21 nt, Vaccinia virus
uuaugacaaaguuuacauucu

SEQ ID NO: 3270084 - RNA, 21 nt, Vaccinia virus
gaauacaaucuguauuucauu

SEQ ID NO: 3270085 - RNA, 17 nt, Vaccinia virus
uuuucaauuauguauca

SEQ ID NO: 3270086 - RNA, 20 nt, Vaccinia virus
aauacuacgauuaacgauga

SEQ ID NO: 3270087 - RNA, 21 nt, Vaccinia virus
uaguaaguagaaauuaucaaa

SEQ ID NO: 3270088 - RNA, 15 nt, Vaccinia virus
caaaauggcaauuau

SEQ ID NO: 3270089 - RNA, 18 nt, Vaccinia virus
cucuauucgaaaacucua

SEQ ID NO: 3270090 - RNA, 20 nt, Vaccinia virus
aauggaugaagcauauuacu

SEQ ID NO: 3270091 - RNA, 21 nt, Vaccinia virus
uagaauucucuucauaucauu

SEQ ID NO: 3270092 - RNA, 18 nt, Vaccinia virus
auaauuauauaaauaugu

SEQ ID NO: 3270093 - RNA, 22 nt, Vaccinia virus
ugucaucuucgucuauuucuau

SEQ ID NO: 3270094 - RNA, 13 nt, Vaccinia virus
aucuuuuguucua

SEQ ID NO: 3270095 - RNA, 11 nt, Vaccinia virus
cauucaugaaa

SEQ ID NO: 3270096 - RNA, 14 nt, Vaccinia virus
auaugcucauauau

SEQ ID NO: 3270097 - RNA, 20 nt, Vaccinia virus
uccuugugcuuaauguuucc

SEQ ID NO: 3270098 - RNA, 16 nt, Vaccinia virus
aacaaguguguagaua

SEQ ID NO: 3270099 - RNA, 20 nt, Vaccinia virus
acgauccaaacaauguuucu

SEQ ID NO: 3270100 - RNA, 19 nt, Vaccinia virus
aacucuuucgcuauuucua

SEQ ID NO: 3270101 - RNA, 20 nt, Vaccinia virus
agaacuaucauagaugagaa

SEQ ID NO: 3270102 - RNA, 13 nt, Vaccinia virus
uuugauucgaauu

SEQ ID NO: 3270103 - RNA, 21 nt, Vaccinia virus
agaaccgucauucauuuagaa

SEQ ID NO: 3270104 - RNA, 12 nt, Vaccinia virus
ucuagaaugaag

SEQ ID NO: 3270105 - RNA, 20 nt, Vaccinia virus
ccuaauucucucaucuauca

SEQ ID NO: 3270106 - RNA, 17 nt, Vaccinia virus
aaauggauuuauuggau

SEQ ID NO: 3270107 - RNA, 22 nt, Vaccinia virus
uauuagaauuggaauaccaaau

SEQ ID NO: 3270108 - RNA, 19 nt, Vaccinia virus
auaugacggacauuccauu

SEQ ID NO: 3270109 - RNA, 12 nt, Vaccinia virus
uauaauauccuc

SEQ ID NO: 3270110 - RNA, 14 nt, Vaccinia virus
uaugcucuagauac

SEQ ID NO: 3270111 - RNA, 21 nt, Vaccinia virus
auguaaccuacuagaaugaua

SEQ ID NO: 3270112 - RNA, 21 nt, Vaccinia virus
aauuacgguugauucaaaaau

SEQ ID NO: 3270113 - RNA, 23 nt, Vaccinia virus
uuuuuaaaaauugccacauccuu

SEQ ID NO: 3270114 - RNA, 22 nt, Vaccinia virus
aaauggaggaggagacaaugac

SEQ ID NO: 3270115 - RNA, 16 nt, Vaccinia virus
uggaagcguauguucc

SEQ ID NO: 3270116 - RNA, 18 nt, Vaccinia virus
guaguauaugaacaaacg

SEQ ID NO: 3270117 - RNA, 16 nt, Vaccinia virus
aauaaacuauuucuaa

SEQ ID NO: 3270118 - RNA, 18 nt, Vaccinia virus
uaaaugcgugacuauaaa

SEQ ID NO: 3270119 - RNA, 23 nt, Vaccinia virus
uagaagucugaucuuaacuccuc

SEQ ID NO: 3270120 - RNA, 17 nt, Vaccinia virus
cauugauaucuuuagau

SEQ ID NO: 3270121 - RNA, 13 nt, Vaccinia virus
guauuguauauac

SEQ ID NO: 3270122 - RNA, 20 nt, Vaccinia virus
cuuaaaagauauuaauggag

SEQ ID NO: 3270123 - RNA, 19 nt, Vaccinia virus
aauuuuuuguucuacacau

SEQ ID NO: 3270124 - RNA, 16 nt, Vaccinia virus
aauaccucuacacuau

SEQ ID NO: 3270125 - RNA, 19 nt, Vaccinia virus
auaccacaccauuuuuuaa

SEQ ID NO: 3270126 - RNA, 13 nt, Vaccinia virus
caauucaucucua

SEQ ID NO: 3270127 - RNA, 23 nt, Vaccinia virus
aaaaggaauuuaccagugauuau

SEQ ID NO: 3270128 - RNA, 17 nt, Vaccinia virus
uccauaauuuucucucg

SEQ ID NO: 3270129 - RNA, 16 nt, Vaccinia virus
agaaucauugcuguaa

SEQ ID NO: 3270130 - RNA, 22 nt, Vaccinia virus
caacaauguugccucauacauc

SEQ ID NO: 3270131 - RNA, 18 nt, Vaccinia virus
cuaauuauuccuauuuca

SEQ ID NO: 3270132 - RNA, 12 nt, Vaccinia virus
caaauuauucua

SEQ ID NO: 3270133 - RNA, 14 nt, Vaccinia virus
ugaugccaauaagc

SEQ ID NO: 3270134 - RNA, 23 nt, Vaccinia virus
auuuuuagacauuagauaugcca

SEQ ID NO: 3270135 - RNA, 14 nt, Vaccinia virus
augcucuuaaauaa

SEQ ID NO: 3270136 - RNA, 16 nt, Vaccinia virus
gaggaugaugaagaag

SEQ ID NO: 3270137 - RNA, 17 nt, Vaccinia virus
uacuuauguaugugcau

SEQ ID NO: 3270138 - RNA, 17 nt, Vaccinia virus
cgaugugucuacauaaa

SEQ ID NO: 3270139 - RNA, 20 nt, Vaccinia virus
acauaguugaauaaauccuc

SEQ ID NO: 3270140 - RNA, 20 nt, Vaccinia virus
auaauguuaccauacauuau

SEQ ID NO: 3270141 - RNA, 21 nt, Vaccinia virus
auaaaucacuuuuuauacuaa

SEQ ID NO: 3270142 - RNA, 18 nt, Vaccinia virus
uaggcacagucaaacauu

SEQ ID NO: 3270143 - RNA, 15 nt, Vaccinia virus
cugauauauugcaaa

SEQ ID NO: 3270144 - RNA, 18 nt, Vaccinia virus
ccauaauccuauucuuga

SEQ ID NO: 3270145 - RNA, 20 nt, Vaccinia virus
auuuaacuagauuauacaau

SEQ ID NO: 3270146 - RNA, 19 nt, Vaccinia virus
auaagcuuugaauguuaua

SEQ ID NO: 3270147 - RNA, 18 nt, Vaccinia virus
auaaaaaaacauuauucu

SEQ ID NO: 3270148 - RNA, 16 nt, Vaccinia virus
uauuugacgcaucuua

SEQ ID NO: 3270149 - RNA, 22 nt, Vaccinia virus
ugcaaaauaugcucuagauacu

SEQ ID NO: 3270150 - RNA, 23 nt, Vaccinia virus
uggcugaaaucagagcucaucua

SEQ ID NO: 3270151 - RNA, 12 nt, Vaccinia virus
agauaaggaagu

SEQ ID NO: 3270152 - RNA, 18 nt, Vaccinia virus
ucuuaacuuacaaaaugu

SEQ ID NO: 3270153 - RNA, 13 nt, Vaccinia virus
auuguuacaaaag

SEQ ID NO: 3270154 - RNA, 12 nt, Vaccinia virus
agaaguuauuau

SEQ ID NO: 3270155 - RNA, 18 nt, Vaccinia virus
aaauucuaggcucaguau

SEQ ID NO: 3270156 - RNA, 22 nt, Vaccinia virus
uuaaaaaaaaaauacuuauucu

SEQ ID NO: 3270157 - RNA, 14 nt, Vaccinia virus
auuaauuuuagaaa

SEQ ID NO: 3270158 - RNA, 19 nt, Vaccinia virus
aauaggaguaauagaacug

SEQ ID NO: 3270159 - RNA, 20 nt, Vaccinia virus
cagcacagggagccacagaa

SEQ ID NO: 3270160 - RNA, 20 nt, Vaccinia virus
aacuccaauaaaaagaugau

SEQ ID NO: 3270161 - RNA, 20 nt, Vaccinia virus
aaaugcaagcaucuuguuaa

SEQ ID NO: 3270162 - RNA, 14 nt, Vaccinia virus
uaaaaauauguaua

SEQ ID NO: 3270163 - RNA, 13 nt, Vaccinia virus
uguaauuaaauuu

SEQ ID NO: 3270164 - RNA, 21 nt, Vaccinia virus
ucggauuauccuccguaagac

SEQ ID NO: 3270165 - RNA, 18 nt, Vaccinia virus
uagugcucaaacaaaaug

SEQ ID NO: 3270166 - RNA, 12 nt, Vaccinia virus
aacaucaagaau

SEQ ID NO: 3270167 - RNA, 14 nt, Vaccinia virus
uuugagagggaaaa

SEQ ID NO: 3270168 - RNA, 14 nt, Vaccinia virus
uaaauguauccauu

SEQ ID NO: 3270169 - RNA, 21 nt, Vaccinia virus
uaucaucuuaugaggaaugau

SEQ ID NO: 3270170 - RNA, 15 nt, Vaccinia virus
ucauauuauagauuu

SEQ ID NO: 3270171 - RNA, 17 nt, Vaccinia virus
uccaucucgcccaucuc

SEQ ID NO: 3270172 - RNA, 19 nt, Vaccinia virus
aacagcuaucaaaauaugu

SEQ ID NO: 3270173 - RNA, 20 nt, Vaccinia virus
uaagauuaucaaaaucuugu

SEQ ID NO: 3270174 - RNA, 13 nt, Vaccinia virus
auuuauuaaauac

SEQ ID NO: 3270175 - RNA, 22 nt, Vaccinia virus
aguaaaacuuucuaguuaucau

SEQ ID NO: 3270176 - RNA, 12 nt, Vaccinia virus
uauuucuaaaau

SEQ ID NO: 3270177 - RNA, 19 nt, Vaccinia virus
aucaaucgguguguagaaa

SEQ ID NO: 3270178 - RNA, 20 nt, Vaccinia virus
gaugaauuaauuaauguuuu

SEQ ID NO: 3270179 - RNA, 17 nt, Vaccinia virus
uaucaaacaauccaaaa

SEQ ID NO: 3270180 - RNA, 15 nt, Vaccinia virus
auauccguuaauagg

SEQ ID NO: 3270181 - RNA, 18 nt, Vaccinia virus
uauuuggcuagucaagau

SEQ ID NO: 3270182 - RNA, 22 nt, Vaccinia virus
caaucuaucacugauuaauuau

SEQ ID NO: 3270183 - RNA, 22 nt, Vaccinia virus
uguagaacucaugaaucuaaaa

SEQ ID NO: 3270184 - RNA, 16 nt, Vaccinia virus
agaagucugaucuuaa

SEQ ID NO: 3270185 - RNA, 19 nt, Vaccinia virus
uuauguauauguuuguaaa

SEQ ID NO: 3270186 - RNA, 16 nt, Vaccinia virus
cuccguuacacuguua

SEQ ID NO: 3270187 - RNA, 23 nt, Vaccinia virus
auaauaucagaccguacauacau

SEQ ID NO: 3270188 - RNA, 17 nt, Vaccinia virus
auaauuucccaaauaca

SEQ ID NO: 3270189 - RNA, 17 nt, Vaccinia virus
accaaaaacucauauaa

SEQ ID NO: 3270190 - RNA, 22 nt, Vaccinia virus
aguacacuuaguccaggaccua

SEQ ID NO: 3270191 - RNA, 20 nt, Vaccinia virus
uaacgguuauaaaauuuaua

SEQ ID NO: 3270192 - RNA, 17 nt, Vaccinia virus
uaucuauauguuuugau

SEQ ID NO: 3270193 - RNA, 18 nt, Vaccinia virus
uagaagacaauaaagaua

SEQ ID NO: 3270194 - RNA, 21 nt, Vaccinia virus
aucucuauccaaggauguaau

SEQ ID NO: 3270195 - RNA, 18 nt, Vaccinia virus
uauauuaacucagaagau

SEQ ID NO: 3270196 - RNA, 16 nt, Vaccinia virus
cauuuaucacaaaaaa

SEQ ID NO: 3270197 - RNA, 14 nt, Vaccinia virus
guaaaugaugaaau

SEQ ID NO: 3270198 - RNA, 18 nt, Vaccinia virus
auagcuuccuucaaucua

SEQ ID NO: 3270199 - RNA, 15 nt, Vaccinia virus
auuaguaugguuuca

SEQ ID NO: 3270200 - RNA, 19 nt, Vaccinia virus
guuuaucgccuacaucauc

SEQ ID NO: 3270201 - RNA, 16 nt, Vaccinia virus
ccaacggaaaugguag

SEQ ID NO: 3270202 - RNA, 15 nt, Vaccinia virus
auacauuucucaaau

SEQ ID NO: 3270203 - RNA, 18 nt, Vaccinia virus
aauuuauuaauacaggau

SEQ ID NO: 3270204 - RNA, 14 nt, Vaccinia virus
uagauaucauuaau

SEQ ID NO: 3270205 - RNA, 16 nt, Vaccinia virus
uaacuagucuucucug

SEQ ID NO: 3270206 - RNA, 21 nt, Vaccinia virus
gauaacauguuaauuuccgac

SEQ ID NO: 3270207 - RNA, 13 nt, Vaccinia virus
guaaaucuuuuca

SEQ ID NO: 3270208 - RNA, 14 nt, Vaccinia virus
auauguuguuguaa

SEQ ID NO: 3270209 - RNA, 17 nt, Vaccinia virus
ggcaugcaugugccugc

SEQ ID NO: 3270210 - RNA, 19 nt, Vaccinia virus
aguucauauuuauuagaua

SEQ ID NO: 3270211 - RNA, 16 nt, Vaccinia virus
uaugcucaugaacauu

SEQ ID NO: 3270212 - RNA, 20 nt, Vaccinia virus
aagaagugucuauaaaugua

SEQ ID NO: 3270213 - RNA, 18 nt, Vaccinia virus
uguauacaccaacaguau

SEQ ID NO: 3270214 - RNA, 18 nt, Vaccinia virus
auagugaaacaaaauaua

SEQ ID NO: 3270215 - RNA, 20 nt, Vaccinia virus
uaacacuacucacaauagaa

SEQ ID NO: 3270216 - RNA, 22 nt, Vaccinia virus
ugauuaaguauuguuuuuucau

SEQ ID NO: 3270217 - RNA, 15 nt, Vaccinia virus
cuagucauauguuua

SEQ ID NO: 3270218 - RNA, 21 nt, Vaccinia virus
aaaaauugaauugaugauaua

SEQ ID NO: 3270219 - RNA, 21 nt, Vaccinia virus
auugguguuccgauuuuagua

SEQ ID NO: 3270220 - RNA, 21 nt, Vaccinia virus
uaacucucucauuuucuuuaa

SEQ ID NO: 3270221 - RNA, 22 nt, Vaccinia virus
ucaucauuguguaaacuaaaua

SEQ ID NO: 3270222 - RNA, 16 nt, Vaccinia virus
aaauaggguuguguau

SEQ ID NO: 3270223 - RNA, 22 nt, Vaccinia virus
auuuuguagaugccauaucaua

SEQ ID NO: 3270224 - RNA, 15 nt, Vaccinia virus
acuaacauuguuaau

SEQ ID NO: 3270225 - RNA, 18 nt, Vaccinia virus
ucacuacggacacaaagu

SEQ ID NO: 3270226 - RNA, 19 nt, Vaccinia virus
aaggaguagcagauuuccu

SEQ ID NO: 3270227 - RNA, 12 nt, Vaccinia virus
acuaaaagacau

SEQ ID NO: 3270228 - RNA, 16 nt, Vaccinia virus
agacauaaaaacuaau

SEQ ID NO: 3270229 - RNA, 22 nt, Vaccinia virus
aaauauuucuacuacuucauua

SEQ ID NO: 3270230 - RNA, 20 nt, Vaccinia virus
agaacccauuagguuaaaug

SEQ ID NO: 3270231 - RNA, 17 nt, Vaccinia virus
aauaacauaggauuaaa

SEQ ID NO: 3270232 - RNA, 18 nt, Vaccinia virus
augaguaaaaucaaacac

SEQ ID NO: 3270233 - RNA, 23 nt, Vaccinia virus
uaaacuccacccauuacauauau

SEQ ID NO: 3270234 - RNA, 21 nt, Vaccinia virus
agaauggaaaggaaacuaucu

SEQ ID NO: 3270235 - RNA, 19 nt, Vaccinia virus
guugacauguauauaucca

SEQ ID NO: 3270236 - RNA, 18 nt, Vaccinia virus
uuacagaucuaguauaau

SEQ ID NO: 3270237 - RNA, 18 nt, Vaccinia virus
ucuaucagaguccaugua

SEQ ID NO: 3270238 - RNA, 12 nt, Vaccinia virus
cacauagaauaa

SEQ ID NO: 3270239 - RNA, 16 nt, Vaccinia virus
gcacaaugaaugauau

SEQ ID NO: 3270240 - RNA, 16 nt, Vaccinia virus
aaucuauuuuggucau

SEQ ID NO: 3270241 - RNA, 17 nt, Vaccinia virus
agauaguuuuuuucauu

SEQ ID NO: 3270242 - RNA, 20 nt, Vaccinia virus
uagaaguuuuaaaaauacuu

SEQ ID NO: 3270243 - RNA, 15 nt, Vaccinia virus
uugauaauauuauua

SEQ ID NO: 3270244 - RNA, 17 nt, Vaccinia virus
guaucgaaaaacuuuaa

SEQ ID NO: 3270245 - RNA, 14 nt, Vaccinia virus
aauauucuaaauua

SEQ ID NO: 3270246 - RNA, 16 nt, Vaccinia virus
acuucaaucaaacaaa

SEQ ID NO: 3270247 - RNA, 22 nt, Vaccinia virus
aguauccaucgcuucuaucuug

SEQ ID NO: 3270248 - RNA, 16 nt, Vaccinia virus
uaaacaaucuaguuuu

SEQ ID NO: 3270249 - RNA, 19 nt, Vaccinia virus
ugaguuccauuacaaauau

SEQ ID NO: 3270250 - RNA, 18 nt, Vaccinia virus
aaaacuuccucauuaaga

SEQ ID NO: 3270251 - RNA, 21 nt, Vaccinia virus
aaacuauuacuaggagaauua

SEQ ID NO: 3270252 - RNA, 19 nt, Vaccinia virus
aaucucguuacauguuauu

SEQ ID NO: 3270253 - RNA, 14 nt, Vaccinia virus
auaacauugcuagu

SEQ ID NO: 3270254 - RNA, 23 nt, Vaccinia virus
gauauauuugcacacauaaucca

SEQ ID NO: 3270255 - RNA, 23 nt, Vaccinia virus
augaauuaacgagauauaugcga

SEQ ID NO: 3270256 - RNA, 14 nt, Vaccinia virus
gauguacgaaagaa

SEQ ID NO: 3270257 - RNA, 18 nt, Vaccinia virus
uagaaauaaaaauuauua

SEQ ID NO: 3270258 - RNA, 20 nt, Vaccinia virus
caauaugucuguacaaaugu

SEQ ID NO: 3270259 - RNA, 20 nt, Vaccinia virus
uauaauccuuauacaucuga

SEQ ID NO: 3270260 - RNA, 23 nt, Vaccinia virus
caauuugcuucagcggauccugu

SEQ ID NO: 3270261 - RNA, 15 nt, Vaccinia virus
cuguaaacaaguuug

SEQ ID NO: 3270262 - RNA, 18 nt, Vaccinia virus
ugucaucaguuauguacg

SEQ ID NO: 3270263 - RNA, 18 nt, Vaccinia virus
auaauuugguauauacau

SEQ ID NO: 3270264 - RNA, 21 nt, Vaccinia virus
caucuguuuccuauaaucguu

SEQ ID NO: 3270265 - RNA, 15 nt, Vaccinia virus
gaaucauaaagaaca

SEQ ID NO: 3270266 - RNA, 22 nt, Vaccinia virus
ugaugugagagagaaauacuuc

SEQ ID NO: 3270267 - RNA, 11 nt, Vaccinia virus
acuacauaucc

SEQ ID NO: 3270268 - RNA, 19 nt, Vaccinia virus
auuacuuuuucaaagaaaa

SEQ ID NO: 3270269 - RNA, 18 nt, Vaccinia virus
augauaguggaucucaau

SEQ ID NO: 3270270 - RNA, 13 nt, Vaccinia virus
ucauuaucugaaa

SEQ ID NO: 3270271 - RNA, 16 nt, Vaccinia virus
uaugaaguacgauguu

SEQ ID NO: 3270272 - RNA, 14 nt, Vaccinia virus
gaaucauacaauga

SEQ ID NO: 3270273 - RNA, 22 nt, Vaccinia virus
uuuaaacaagacggauauacag

SEQ ID NO: 3270274 - RNA, 15 nt, Vaccinia virus
uuuuccauccuuugu

SEQ ID NO: 3270275 - RNA, 14 nt, Vaccinia virus
acucuaauuuauug

SEQ ID NO: 3270276 - RNA, 22 nt, Vaccinia virus
acuuugauagcaaggaugaaaa

SEQ ID NO: 3270277 - RNA, 17 nt, Vaccinia virus
auucagcugaaaugaga

SEQ ID NO: 3270278 - RNA, 14 nt, Vaccinia virus
guaucuuuacuaga

SEQ ID NO: 3270279 - RNA, 14 nt, Vaccinia virus
aacgugaauguaug

SEQ ID NO: 3270280 - RNA, 23 nt, Vaccinia virus
caaauaucuuuacgaauuacuuu

SEQ ID NO: 3270281 - RNA, 13 nt, Vaccinia virus
acagaugauauau

SEQ ID NO: 3270282 - RNA, 16 nt, Vaccinia virus
agaauaaucagaaauu

SEQ ID NO: 3270283 - RNA, 23 nt, Vaccinia virus
ucaaugugaauguauucacuuaa

SEQ ID NO: 3270284 - RNA, 22 nt, Vaccinia virus
uaacacguuuuuuagaucucau

SEQ ID NO: 3270285 - RNA, 18 nt, Vaccinia virus
acgaauuaggagaacuua

SEQ ID NO: 3270286 - RNA, 11 nt, Vaccinia virus
agaaaaacaac

SEQ ID NO: 3270287 - RNA, 15 nt, Vaccinia virus
ucauccaguugaaug

SEQ ID NO: 3270288 - RNA, 21 nt, Vaccinia virus
ucuuugaaaaguucuaugaaa

SEQ ID NO: 3270289 - RNA, 13 nt, Vaccinia virus
acuuucagucugu

SEQ ID NO: 3270290 - RNA, 21 nt, Vaccinia virus
ucgcuuucugguaacaugaua

SEQ ID NO: 3270291 - RNA, 23 nt, Vaccinia virus
aaauaggucuucgucuacaguag

SEQ ID NO: 3270292 - RNA, 17 nt, Vaccinia virus
aguggaagucauuugac

SEQ ID NO: 3270293 - RNA, 20 nt, Vaccinia virus
uagucuuuuuggucaucucu

SEQ ID NO: 3270294 - RNA, 20 nt, Vaccinia virus
aguuaauggagaaauacuua

SEQ ID NO: 3270295 - RNA, 21 nt, Vaccinia virus
gcguuaacuaucaaacaaacu

SEQ ID NO: 3270296 - RNA, 17 nt, Vaccinia virus
uuaaccaacugauuaau

SEQ ID NO: 3270297 - RNA, 22 nt, Vaccinia virus
acgucuuucacuaauugacuau

SEQ ID NO: 3270298 - RNA, 18 nt, Vaccinia virus
auuuccugauuuaaauag

SEQ ID NO: 3270299 - RNA, 18 nt, Vaccinia virus
cgauucuggcuauuucaa

SEQ ID NO: 3270300 - RNA, 16 nt, Vaccinia virus
aucgucuguauuaaug

SEQ ID NO: 3270301 - RNA, 20 nt, Vaccinia virus
cggaauugccaacucucaaa

SEQ ID NO: 3270302 - RNA, 13 nt, Vaccinia virus
uaaaagucaacau

SEQ ID NO: 3270303 - RNA, 19 nt, Vaccinia virus
uuugccaagguuagaugua

SEQ ID NO: 3270304 - RNA, 17 nt, Vaccinia virus
uaguuacuuuaauaacc

SEQ ID NO: 3270305 - RNA, 12 nt, Vaccinia virus
gcaagaaaugga

SEQ ID NO: 3270306 - RNA, 12 nt, Vaccinia virus
ggaaaaaugaug

SEQ ID NO: 3270307 - RNA, 11 nt, Vaccinia virus
uccucaucugu

SEQ ID NO: 3270308 - RNA, 23 nt, Vaccinia virus
uacuacugaguauaaauaauuca

SEQ ID NO: 3270309 - RNA, 16 nt, Vaccinia virus
gcuaaaaaauuaguag

SEQ ID NO: 3270310 - RNA, 20 nt, Vaccinia virus
aaaagacggaggauuuccau

SEQ ID NO: 3270311 - RNA, 15 nt, Vaccinia virus
uucaagagaauauuc

SEQ ID NO: 3270312 - RNA, 20 nt, Vaccinia virus
ggccuguucauaaauaaaaa

SEQ ID NO: 3270313 - RNA, 13 nt, Vaccinia virus
gcaagaaauggau

SEQ ID NO: 3270314 - RNA, 15 nt, Vaccinia virus
acauuauuacauaga

SEQ ID NO: 3270315 - RNA, 23 nt, Vaccinia virus
gauaagcuauaauaauaaaugua

SEQ ID NO: 3270316 - RNA, 17 nt, Vaccinia virus
uaaacauuguucaugau

SEQ ID NO: 3270317 - RNA, 21 nt, Vaccinia virus
aaaagguauuacaagaauaua

SEQ ID NO: 3270318 - RNA, 23 nt, Vaccinia virus
uuaaugcacacaguauuaucuac

SEQ ID NO: 3270319 - RNA, 18 nt, Vaccinia virus
guuauccccuuuauguaa

SEQ ID NO: 3270320 - RNA, 16 nt, Vaccinia virus
uagacauagauauucu

SEQ ID NO: 3270321 - RNA, 16 nt, Vaccinia virus
accagcacaacaucua

SEQ ID NO: 3270322 - RNA, 20 nt, Vaccinia virus
gaacauauuuauauaauuau

SEQ ID NO: 3270323 - RNA, 21 nt, Vaccinia virus
guaugugugugugguauagau

SEQ ID NO: 3270324 - RNA, 14 nt, Vaccinia virus
augcauguuucaua

SEQ ID NO: 3270325 - RNA, 21 nt, Vaccinia virus
aucaauaccaaagaaggaaga

SEQ ID NO: 3270326 - RNA, 16 nt, Vaccinia virus
ugugcaucuacugaua

SEQ ID NO: 3270327 - RNA, 16 nt, Vaccinia virus
auuguugucugaaaua

SEQ ID NO: 3270328 - RNA, 16 nt, Vaccinia virus
uucauauccuacugua

SEQ ID NO: 3270329 - RNA, 14 nt, Vaccinia virus
auucacaaauauga

SEQ ID NO: 3270330 - RNA, 18 nt, Vaccinia virus
acaacacgggauaaauua

SEQ ID NO: 3270331 - RNA, 23 nt, Vaccinia virus
auuucuggauauguuuuuaauaa

SEQ ID NO: 3270332 - RNA, 22 nt, Vaccinia virus
cuauguauucagaauuaauaga

SEQ ID NO: 3270333 - RNA, 18 nt, Vaccinia virus
guuagaaucauuuaucau

SEQ ID NO: 3270334 - RNA, 17 nt, Vaccinia virus
ccaaugaugucaggaaa

SEQ ID NO: 3270335 - RNA, 16 nt, Vaccinia virus
caucagacgcaauaac

SEQ ID NO: 3270336 - RNA, 15 nt, Vaccinia virus
aauauacgucguucu

SEQ ID NO: 3270337 - RNA, 13 nt, Vaccinia virus
auacucucaucuu

SEQ ID NO: 3270338 - RNA, 16 nt, Vaccinia virus
uauaaucugaugaaca

SEQ ID NO: 3270339 - RNA, 23 nt, Vaccinia virus
caagcuucguuguagaaacacug

SEQ ID NO: 3270340 - RNA, 23 nt, Vaccinia virus
uacaaaugacacugauaaaguag

SEQ ID NO: 3270341 - RNA, 14 nt, Vaccinia virus
auuauuuauaccuc

SEQ ID NO: 3270342 - RNA, 23 nt, Vaccinia virus
uaaacauuguuuguauucuccag

SEQ ID NO: 3270343 - RNA, 13 nt, Vaccinia virus
acugauucuggac

SEQ ID NO: 3270344 - RNA, 15 nt, Vaccinia virus
auggcaagaaaugga

SEQ ID NO: 3270345 - RNA, 23 nt, Vaccinia virus
augucuuauuaaaaaacauauau

SEQ ID NO: 3270346 - RNA, 16 nt, Vaccinia virus
uacaaucuguauuuca

SEQ ID NO: 3270347 - RNA, 13 nt, Vaccinia virus
gaaucugugaaug

SEQ ID NO: 3270348 - RNA, 14 nt, Vaccinia virus
uacaccggaucuau

SEQ ID NO: 3270349 - RNA, 20 nt, Vaccinia virus
gaaaacgagccaguaaucuu

SEQ ID NO: 3270350 - RNA, 15 nt, Vaccinia virus
aacuuaucaaaacau

SEQ ID NO: 3270351 - RNA, 16 nt, Vaccinia virus
augaagaauggaugau

SEQ ID NO: 3270352 - RNA, 15 nt, Vaccinia virus
ucauauccuacugua

SEQ ID NO: 3270353 - RNA, 22 nt, Vaccinia virus
agaacuggaccguauaucucau

SEQ ID NO: 3270354 - RNA, 19 nt, Vaccinia virus
auuuugauuccaaaauuga

SEQ ID NO: 3270355 - RNA, 15 nt, Vaccinia virus
guaaaucacauaucu

SEQ ID NO: 3270356 - RNA, 21 nt, Vaccinia virus
uaccacaauaaaaaaaauuga

SEQ ID NO: 3270357 - RNA, 22 nt, Vaccinia virus
ugauggaugagauauacagcua

SEQ ID NO: 3270358 - RNA, 13 nt, Vaccinia virus
aaucuuugucaaa

SEQ ID NO: 3270359 - RNA, 20 nt, Vaccinia virus
acuaaauuaacaauaucaau

SEQ ID NO: 3270360 - RNA, 17 nt, Vaccinia virus
aauuuaugaagauguua

SEQ ID NO: 3270361 - RNA, 19 nt, Vaccinia virus
gcagcauuuccuacauaua

SEQ ID NO: 3270362 - RNA, 20 nt, Vaccinia virus
aaaucauuaaaugauuguau

SEQ ID NO: 3270363 - RNA, 22 nt, Vaccinia virus
ucaucacugucaucaguuaugu

SEQ ID NO: 3270364 - RNA, 22 nt, Vaccinia virus
auuuaccaucccauauauucca

SEQ ID NO: 3270365 - RNA, 17 nt, Vaccinia virus
aaugauggguuuucuau

SEQ ID NO: 3270366 - RNA, 24 nt, Vaccinia virus
gauaaaaguuccagaaaauguaga

SEQ ID NO: 3270367 - RNA, 14 nt, Vaccinia virus
uaauugucuuagaa

SEQ ID NO: 3270368 - RNA, 12 nt, Vaccinia virus
uauuuucuucua

SEQ ID NO: 3270369 - RNA, 18 nt, Vaccinia virus
uaugcgaguaugaugcaa

SEQ ID NO: 3270370 - RNA, 14 nt, Vaccinia virus
uguacuucuuccag

SEQ ID NO: 3270371 - RNA, 19 nt, Vaccinia virus
auaagaagaggacaaaguu

SEQ ID NO: 3270372 - RNA, 18 nt, Vaccinia virus
aggcaguccagaaauauu

SEQ ID NO: 3270373 - RNA, 15 nt, Vaccinia virus
ugaaaaugaaaauau

SEQ ID NO: 3270374 - RNA, 16 nt, Vaccinia virus
ggugagaacaugagac

SEQ ID NO: 3270375 - RNA, 12 nt, Vaccinia virus
aacagauacaua

SEQ ID NO: 3270376 - RNA, 22 nt, Vaccinia virus
auaaacguucacguaaauacaa

SEQ ID NO: 3270377 - RNA, 20 nt, Vaccinia virus
acugccgaguuuaaaacuuc

SEQ ID NO: 3270378 - RNA, 15 nt, Vaccinia virus
aguauucuuauguau

SEQ ID NO: 3270379 - RNA, 12 nt, Vaccinia virus
cuaucuuuagag

SEQ ID NO: 3270380 - RNA, 15 nt, Vaccinia virus
ugaugucuauguacg

SEQ ID NO: 3270381 - RNA, 18 nt, Vaccinia virus
auauuguagauaagaaug

SEQ ID NO: 3270382 - RNA, 19 nt, Vaccinia virus
acuuuuauuuuuagaaagu

SEQ ID NO: 3270383 - RNA, 16 nt, Vaccinia virus
guagaaucauauugcu

SEQ ID NO: 3270384 - RNA, 13 nt, Vaccinia virus
uguauaaaaagaa

SEQ ID NO: 3270385 - RNA, 14 nt, Vaccinia virus
aaaaguaggaauua

SEQ ID NO: 3270386 - RNA, 21 nt, Vaccinia virus
cuaaaucuguauaucuuucca

SEQ ID NO: 3270387 - RNA, 23 nt, Vaccinia virus
auagauagugcuaaacgaauuac

SEQ ID NO: 3270388 - RNA, 17 nt, Vaccinia virus
caauaaaacauuuccua

SEQ ID NO: 3270389 - RNA, 15 nt, Vaccinia virus
auaaacuauuuuacc

SEQ ID NO: 3270390 - RNA, 13 nt, Vaccinia virus
agauaaacuuuau

SEQ ID NO: 3270391 - RNA, 11 nt, Vaccinia virus
guuuucaucag

SEQ ID NO: 3270392 - RNA, 19 nt, Vaccinia virus
cucaaucacuacaucuuua

SEQ ID NO: 3270393 - RNA, 12 nt, Vaccinia virus
agaagauuaaac

SEQ ID NO: 3270394 - RNA, 18 nt, Vaccinia virus
aguagaaauuccguugga

SEQ ID NO: 3270395 - RNA, 21 nt, Vaccinia virus
accgucgaguuacuuaaaugc

SEQ ID NO: 3270396 - RNA, 13 nt, Vaccinia virus
cuguuauuuugaa

SEQ ID NO: 3270397 - RNA, 19 nt, Vaccinia virus
uauauaaucagaguuuuua

SEQ ID NO: 3270398 - RNA, 17 nt, Vaccinia virus
uguaauuuuuguuuccg

SEQ ID NO: 3270399 - RNA, 16 nt, Vaccinia virus
uuaguuuuuggauaga

SEQ ID NO: 3270400 - RNA, 16 nt, Vaccinia virus
uuaucgucuacgaaca

SEQ ID NO: 3270401 - RNA, 16 nt, Vaccinia virus
auuuuucuucauuuau

SEQ ID NO: 3270402 - RNA, 23 nt, Vaccinia virus
uccacgauaaaauccuccuauca

SEQ ID NO: 3270403 - RNA, 14 nt, Vaccinia virus
aaaauaauuuccaa

SEQ ID NO: 3270404 - RNA, 13 nt, Vaccinia virus
auacgauaucuuc

SEQ ID NO: 3270405 - RNA, 23 nt, Vaccinia virus
uucaaccaugagugugaaacuaa

SEQ ID NO: 3270406 - RNA, 18 nt, Vaccinia virus
cuccacaguuuuuaauuu

SEQ ID NO: 3270407 - RNA, 20 nt, Vaccinia virus
agugcacucucuaccacaau

SEQ ID NO: 3270408 - RNA, 14 nt, Vaccinia virus
aaagugcaaaugag

SEQ ID NO: 3270409 - RNA, 19 nt, Vaccinia virus
aaaucauccguuguuauau

SEQ ID NO: 3270410 - RNA, 16 nt, Vaccinia virus
augucauauaggaaac

SEQ ID NO: 3270411 - RNA, 16 nt, Vaccinia virus
uaguuaauaaaaucua

SEQ ID NO: 3270412 - RNA, 17 nt, Vaccinia virus
acugauuaacaaauggu

SEQ ID NO: 3270413 - RNA, 20 nt, Vaccinia virus
aucaauaagcauuaugauuu

SEQ ID NO: 3270414 - RNA, 15 nt, Vaccinia virus
caauaagcuuuagau

SEQ ID NO: 3270415 - RNA, 13 nt, Vaccinia virus
cgucuaucaucua

SEQ ID NO: 3270416 - RNA, 16 nt, Vaccinia virus
aagacauaaaacucau

SEQ ID NO: 3270417 - RNA, 14 nt, Vaccinia virus
uacgagaaaaucaa

SEQ ID NO: 3270418 - RNA, 17 nt, Vaccinia virus
cauuuucacaaauacua

SEQ ID NO: 3270419 - RNA, 23 nt, Vaccinia virus
uuaacaucuaaaaaauccuuaau

SEQ ID NO: 3270420 - RNA, 16 nt, Vaccinia virus
ucaccuuaucaaaguc

SEQ ID NO: 3270421 - RNA, 13 nt, Vaccinia virus
uagacaaaacuau

SEQ ID NO: 3270422 - RNA, 14 nt, Vaccinia virus
agauaugauagaca

SEQ ID NO: 3270423 - RNA, 18 nt, Vaccinia virus
ucuuuuaguuuaucaaaa

SEQ ID NO: 3270424 - RNA, 20 nt, Vaccinia virus
agaaugcucuuaaauaaugu

SEQ ID NO: 3270425 - RNA, 17 nt, Vaccinia virus
auuauuaguugauguga

SEQ ID NO: 3270426 - RNA, 19 nt, Vaccinia virus
uguuaagaaugauuacuaa

SEQ ID NO: 3270427 - RNA, 19 nt, Vaccinia virus
aagcuauuaucaaauacug

SEQ ID NO: 3270428 - RNA, 17 nt, Vaccinia virus
uauucuaucaccagauu

SEQ ID NO: 3270429 - RNA, 18 nt, Vaccinia virus
auccuuuucuucagaaua

SEQ ID NO: 3270430 - RNA, 16 nt, Vaccinia virus
agcugaaaaacuaugu

SEQ ID NO: 3270431 - RNA, 23 nt, Vaccinia virus
uugacgcacccgcgucuguuuuu

SEQ ID NO: 3270432 - RNA, 19 nt, Vaccinia virus
gucaauuacaaauaaagcg

SEQ ID NO: 3270433 - RNA, 15 nt, Vaccinia virus
uggacauacuaauau

SEQ ID NO: 3270434 - RNA, 20 nt, Vaccinia virus
aaauuuccauuuuuaauuua

SEQ ID NO: 3270435 - RNA, 14 nt, Vaccinia virus
cgcugauuuaacua

SEQ ID NO: 3270436 - RNA, 15 nt, Vaccinia virus
auucuucgguaacuu

SEQ ID NO: 3270437 - RNA, 16 nt, Vaccinia virus
auguuauauauaccuu

SEQ ID NO: 3270438 - RNA, 15 nt, Vaccinia virus
agugaauccaucuca

SEQ ID NO: 3270439 - RNA, 21 nt, Vaccinia virus
cuuuacaucaucgaacuucug

SEQ ID NO: 3270440 - RNA, 22 nt, Vaccinia virus
uauauccuacacccgaagagau

SEQ ID NO: 3270441 - RNA, 16 nt, Vaccinia virus
cucuguaauaguuucc

SEQ ID NO: 3270442 - RNA, 13 nt, Vaccinia virus
aggacuauuagaa

SEQ ID NO: 3270443 - RNA, 13 nt, Vaccinia virus
aucuaaauauuua

SEQ ID NO: 3270444 - RNA, 17 nt, Vaccinia virus
gaugucaaugaagagua

SEQ ID NO: 3270445 - RNA, 18 nt, Vaccinia virus
aucccuaucuauaauauc

SEQ ID NO: 3270446 - RNA, 22 nt, Vaccinia virus
agauucucauuugauaaaaauu

SEQ ID NO: 3270447 - RNA, 17 nt, Vaccinia virus
aauauuguuaucguaau

SEQ ID NO: 3270448 - RNA, 15 nt, Vaccinia virus
aauguccaagucuug

SEQ ID NO: 3270449 - RNA, 21 nt, Vaccinia virus
uugagcuaauuuuuguaaaua

SEQ ID NO: 3270450 - RNA, 18 nt, Vaccinia virus
cuggcaggcacaugcaug

SEQ ID NO: 3270451 - RNA, 21 nt, Vaccinia virus
aauuuacucgcauuucuaaua

SEQ ID NO: 3270452 - RNA, 15 nt, Vaccinia virus
caguuaauauauuua

SEQ ID NO: 3270453 - RNA, 20 nt, Vaccinia virus
aaacuaacauuguuaauuga

SEQ ID NO: 3270454 - RNA, 12 nt, Vaccinia virus
aaaauagcaaag

SEQ ID NO: 3270455 - RNA, 17 nt, Vaccinia virus
uauauaacuaucaauau

SEQ ID NO: 3270456 - RNA, 19 nt, Vaccinia virus
uaaaagacaaauauaugug

SEQ ID NO: 3270457 - RNA, 19 nt, Vaccinia virus
aggaauacaauacauaccu

SEQ ID NO: 3270458 - RNA, 20 nt, Vaccinia virus
uuguuaggaaucuauucaaa

SEQ ID NO: 3270459 - RNA, 23 nt, Vaccinia virus
gucacuaacugauaccaugaaau

SEQ ID NO: 3270460 - RNA, 18 nt, Vaccinia virus
agaaaguggauaaaacaa

SEQ ID NO: 3270461 - RNA, 13 nt, Vaccinia virus
aaucuuuaccaua

SEQ ID NO: 3270462 - RNA, 17 nt, Vaccinia virus
agacuguuuauacaaga

SEQ ID NO: 3270463 - RNA, 18 nt, Vaccinia virus
guagacauagauauucua

SEQ ID NO: 3270464 - RNA, 17 nt, Vaccinia virus
gauacccugauauuaau

SEQ ID NO: 3270465 - RNA, 19 nt, Vaccinia virus
accaaacuuucagaagaaa

SEQ ID NO: 3270466 - RNA, 17 nt, Vaccinia virus
guguaucgacaucuuua

SEQ ID NO: 3270467 - RNA, 18 nt, Vaccinia virus
uaauauauugaucauaau

SEQ ID NO: 3270468 - RNA, 19 nt, Vaccinia virus
gaauaguuuguuuuggaaa

SEQ ID NO: 3270469 - RNA, 14 nt, Vaccinia virus
acauauuucauuug

SEQ ID NO: 3270470 - RNA, 12 nt, Vaccinia virus
agcaaagaauga

SEQ ID NO: 3270471 - RNA, 17 nt, Vaccinia virus
uagagagguacguguaa

SEQ ID NO: 3270472 - RNA, 21 nt, Vaccinia virus
auuucauuauaauaguuuauc

SEQ ID NO: 3270473 - RNA, 16 nt, Vaccinia virus
aucgauagacuuucuc

SEQ ID NO: 3270474 - RNA, 20 nt, Vaccinia virus
uaaagaagaagaucauacag

SEQ ID NO: 3270475 - RNA, 19 nt, Vaccinia virus
aauauauguugauaauauc

SEQ ID NO: 3270476 - RNA, 14 nt, Vaccinia virus
uucuggauuauuuu

SEQ ID NO: 3270477 - RNA, 15 nt, Vaccinia virus
cgauauguuaucuac

SEQ ID NO: 3270478 - RNA, 20 nt, Vaccinia virus
auauaccuguuuuuauuuca

SEQ ID NO: 3270479 - RNA, 14 nt, Vaccinia virus
auauaguagaugcu

SEQ ID NO: 3270480 - RNA, 11 nt, Vaccinia virus
auguauauaca

SEQ ID NO: 3270481 - RNA, 22 nt, Vaccinia virus
gcauguagaaugugauaauuau

SEQ ID NO: 3270482 - RNA, 15 nt, Vaccinia virus
auuaaauuuagagau

SEQ ID NO: 3270483 - RNA, 12 nt, Vaccinia virus
uaucucagucug

SEQ ID NO: 3270484 - RNA, 21 nt, Vaccinia virus
auugauugccauaauaauuac

SEQ ID NO: 3270485 - RNA, 21 nt, Vaccinia virus
aaugaguaauuaauugucuua

SEQ ID NO: 3270486 - RNA, 12 nt, Vaccinia virus
acaucaaaugau

SEQ ID NO: 3270487 - RNA, 18 nt, Vaccinia virus
aucuauccgcgacaaauu

SEQ ID NO: 3270488 - RNA, 14 nt, Vaccinia virus
uaaaaaaauuauuu

SEQ ID NO: 3270489 - RNA, 22 nt, Vaccinia virus
uuguuuacacggugacuguauc

SEQ ID NO: 3270490 - RNA, 19 nt, Vaccinia virus
agaaauugguucuuuacca

SEQ ID NO: 3270491 - RNA, 15 nt, Vaccinia virus
cacuuaaugacaaaa

SEQ ID NO: 3270492 - RNA, 13 nt, Vaccinia virus
agucauuguuuua

SEQ ID NO: 3270493 - RNA, 18 nt, Vaccinia virus
aauauugccauaauuuuc

SEQ ID NO: 3270494 - RNA, 17 nt, Vaccinia virus
uguuuaccagcuccaug

SEQ ID NO: 3270495 - RNA, 18 nt, Vaccinia virus
ucgguauaaaaauuauug

SEQ ID NO: 3270496 - RNA, 18 nt, Vaccinia virus
acauagaguuaagagaga

SEQ ID NO: 3270497 - RNA, 14 nt, Vaccinia virus
uguaugaaaugcuu

SEQ ID NO: 3270498 - RNA, 12 nt, Vaccinia virus
agggaaaaugaa

SEQ ID NO: 3270499 - RNA, 17 nt, Vaccinia virus
gauaaauuaaugaucua

SEQ ID NO: 3270500 - RNA, 17 nt, Vaccinia virus
auaaugauagacaagau

SEQ ID NO: 3270501 - RNA, 14 nt, Vaccinia virus
uuaauacauuauua

SEQ ID NO: 3270502 - RNA, 14 nt, Vaccinia virus
uuaaagguauuucu

SEQ ID NO: 3270503 - RNA, 19 nt, Vaccinia virus
auaaccucuccuauaugaa

SEQ ID NO: 3270504 - RNA, 19 nt, Vaccinia virus
aauauauuuuuuuaguaau

SEQ ID NO: 3270505 - RNA, 22 nt, Vaccinia virus
uaguauaccaugaccuucuuca

SEQ ID NO: 3270506 - RNA, 15 nt, Vaccinia virus
aauguaaagucuaua

SEQ ID NO: 3270507 - RNA, 16 nt, Vaccinia virus
uuacuuguauaauaag

SEQ ID NO: 3270508 - RNA, 13 nt, Vaccinia virus
cgaauaacaaaaa

SEQ ID NO: 3270509 - RNA, 20 nt, Vaccinia virus
ugcaugauguacagauuucg

SEQ ID NO: 3270510 - RNA, 17 nt, Vaccinia virus
cagagccaucuguaaaa

SEQ ID NO: 3270511 - RNA, 23 nt, Vaccinia virus
cuuuuaaauacaaauauaucaau

SEQ ID NO: 3270512 - RNA, 14 nt, Vaccinia virus
gugaaaaauauuaa

SEQ ID NO: 3270513 - RNA, 20 nt, Vaccinia virus
aagacgaggagauuuagaaa

SEQ ID NO: 3270514 - RNA, 20 nt, Vaccinia virus
cauacuuagaauuuuaggac

SEQ ID NO: 3270515 - RNA, 12 nt, Vaccinia virus
uauuucuuacau

SEQ ID NO: 3270516 - RNA, 21 nt, Vaccinia virus
acagucgaacaaucuuaaugu

SEQ ID NO: 3270517 - RNA, 21 nt, Vaccinia virus
aagaaugcuucagaauuagaa

SEQ ID NO: 3270518 - RNA, 23 nt, Vaccinia virus
agaaaagguucuaucaacaauau

SEQ ID NO: 3270519 - RNA, 12 nt, Vaccinia virus
aucauaguuuuu

SEQ ID NO: 3270520 - RNA, 18 nt, Vaccinia virus
uuauacagaguauguaaa

SEQ ID NO: 3270521 - RNA, 17 nt, Vaccinia virus
aaugaugucaggaaaua

SEQ ID NO: 3270522 - RNA, 21 nt, Vaccinia virus
cauuuaucacaaaaaaaacuu

SEQ ID NO: 3270523 - RNA, 14 nt, Vaccinia virus
aaauauauaaugaa

SEQ ID NO: 3270524 - RNA, 22 nt, Vaccinia virus
aaugauagacuagaagaaagua

SEQ ID NO: 3270525 - RNA, 19 nt, Vaccinia virus
uguuucacauuuacauauu

SEQ ID NO: 3270526 - RNA, 23 nt, Vaccinia virus
agaaauggaagaguuaaugaaua

SEQ ID NO: 3270527 - RNA, 14 nt, Vaccinia virus
cuauuucuuaauga

SEQ ID NO: 3270528 - RNA, 13 nt, Vaccinia virus
guucuaacaucau

SEQ ID NO: 3270529 - RNA, 13 nt, Vaccinia virus
guaaaaucuauca

SEQ ID NO: 3270530 - RNA, 13 nt, Vaccinia virus
uucuagaccaaaa

SEQ ID NO: 3270531 - RNA, 22 nt, Vaccinia virus
gaauaugugcuaaaaucacuga

SEQ ID NO: 3270532 - RNA, 23 nt, Vaccinia virus
agaaauuauuuuuacuaauagaa

SEQ ID NO: 3270533 - RNA, 22 nt, Vaccinia virus
ggaaaacuuuaauaacaaagaa

SEQ ID NO: 3270534 - RNA, 21 nt, Vaccinia virus
acaacgaggacaugauaacuu

SEQ ID NO: 3270535 - RNA, 18 nt, Vaccinia virus
cugguauuuauauaugca

SEQ ID NO: 3270536 - RNA, 14 nt, Vaccinia virus
uauauuucuaugau

SEQ ID NO: 3270537 - RNA, 15 nt, Vaccinia virus
gaugcuauguuuaua

SEQ ID NO: 3270538 - RNA, 18 nt, Vaccinia virus
gccgaugaauggaucacc

SEQ ID NO: 3270539 - RNA, 15 nt, Vaccinia virus
uaguaaaaauaauua

SEQ ID NO: 3270540 - RNA, 14 nt, Vaccinia virus
gcaauucauuuucg

SEQ ID NO: 3270541 - RNA, 20 nt, Vaccinia virus
auguagugauagauaugaua

SEQ ID NO: 3270542 - RNA, 17 nt, Vaccinia virus
uuagucgucucaaagag

SEQ ID NO: 3270543 - RNA, 20 nt, Vaccinia virus
ucacgaaaaaugaugaaggc

SEQ ID NO: 3270544 - RNA, 18 nt, Vaccinia virus
ucuuucuccgccuauuaa

SEQ ID NO: 3270545 - RNA, 21 nt, Vaccinia virus
uaauacauccccauuccagua

SEQ ID NO: 3270546 - RNA, 14 nt, Vaccinia virus
cauucauaaaaacc

SEQ ID NO: 3270547 - RNA, 18 nt, Vaccinia virus
cggcuauagaaaaguaua

SEQ ID NO: 3270548 - RNA, 16 nt, Vaccinia virus
ucaaacacgauauuca

SEQ ID NO: 3270549 - RNA, 17 nt, Vaccinia virus
aauacuuaaaaauggau

SEQ ID NO: 3270550 - RNA, 15 nt, Vaccinia virus
acauaucuaacaaug

SEQ ID NO: 3270551 - RNA, 13 nt, Vaccinia virus
uauuaauaaugau

SEQ ID NO: 3270552 - RNA, 13 nt, Vaccinia virus
auuuaauauagau

SEQ ID NO: 3270553 - RNA, 15 nt, Vaccinia virus
ccacuaucugauuca

SEQ ID NO: 3270554 - RNA, 14 nt, Vaccinia virus
aaacuuuuuagaaa

SEQ ID NO: 3270555 - RNA, 14 nt, Vaccinia virus
cucuuucuuuugau

SEQ ID NO: 3270556 - RNA, 17 nt, Vaccinia virus
aacaaccgcuuagaaau

SEQ ID NO: 3270557 - RNA, 17 nt, Vaccinia virus
auuuacuaucuguaaug

SEQ ID NO: 3270558 - RNA, 18 nt, Vaccinia virus
gcaucaggauauaaagaa

SEQ ID NO: 3270559 - RNA, 17 nt, Vaccinia virus
uuuaaaaacgaaucaga

SEQ ID NO: 3270560 - RNA, 15 nt, Vaccinia virus
uauucacaaauauga

SEQ ID NO: 3270561 - RNA, 22 nt, Vaccinia virus
ucucuuuuguagaacuuaacuu

SEQ ID NO: 3270562 - RNA, 14 nt, Vaccinia virus
ucguuaaaaaguuu

SEQ ID NO: 3270563 - RNA, 13 nt, Vaccinia virus
uuuacccuagaau

SEQ ID NO: 3270564 - RNA, 17 nt, Vaccinia virus
aggaguaggaaugccac

SEQ ID NO: 3270565 - RNA, 18 nt, Vaccinia virus
guaauacauauaaauguc

SEQ ID NO: 3270566 - RNA, 17 nt, Vaccinia virus
aauaucaaacaauccaa

SEQ ID NO: 3270567 - RNA, 22 nt, Vaccinia virus
auguuaauaacaucagaaaaug

SEQ ID NO: 3270568 - RNA, 14 nt, Vaccinia virus
acgaugauauguuu

SEQ ID NO: 3270569 - RNA, 21 nt, Vaccinia virus
uuuccaaaucaguaacuaugu

SEQ ID NO: 3270570 - RNA, 22 nt, Vaccinia virus
auugauugaaaaugaaaauaua

SEQ ID NO: 3270571 - RNA, 12 nt, Vaccinia virus
auuucuauuuuu

SEQ ID NO: 3270572 - RNA, 22 nt, Vaccinia virus
gucauacuccaucaauuucaaa

SEQ ID NO: 3270573 - RNA, 16 nt, Vaccinia virus
auaacucuucgucaaa

SEQ ID NO: 3270574 - RNA, 19 nt, Vaccinia virus
cuaagagaaaucuuuagac

SEQ ID NO: 3270575 - RNA, 16 nt, Vaccinia virus
ugguaaaguaaaucau

SEQ ID NO: 3270576 - RNA, 16 nt, Vaccinia virus
auauuuaccaaagcaa

SEQ ID NO: 3270577 - RNA, 19 nt, Vaccinia virus
ucacuguauaaaaagaaug

SEQ ID NO: 3270578 - RNA, 15 nt, Vaccinia virus
cuuaaacagaugaga

SEQ ID NO: 3270579 - RNA, 15 nt, Vaccinia virus
accauauacguguuu

SEQ ID NO: 3270580 - RNA, 22 nt, Vaccinia virus
uaagaacaugucuucuauucua

SEQ ID NO: 3270581 - RNA, 21 nt, Vaccinia virus
aaaaauuauacuguaacacaa

SEQ ID NO: 3270582 - RNA, 16 nt, Vaccinia virus
auccuaggauccuuua

SEQ ID NO: 3270583 - RNA, 19 nt, Vaccinia virus
cucauguaaccuacuagaa

SEQ ID NO: 3270584 - RNA, 12 nt, Vaccinia virus
aguauuuucuau

SEQ ID NO: 3270585 - RNA, 18 nt, Vaccinia virus
cuucauuaaucuuuucug

SEQ ID NO: 3270586 - RNA, 19 nt, Vaccinia virus
cauuuuauaaauauauaau

SEQ ID NO: 3270587 - RNA, 22 nt, Vaccinia virus
uuuccaagugucaaauuccaaa

SEQ ID NO: 3270588 - RNA, 21 nt, Vaccinia virus
agaagagucauuaaaauaugc

SEQ ID NO: 3270589 - RNA, 20 nt, Vaccinia virus
ucuauuucaucguuuuguau

SEQ ID NO: 3270590 - RNA, 21 nt, Vaccinia virus
uucuauaccaauauuauucuu

SEQ ID NO: 3270591 - RNA, 16 nt, Vaccinia virus
ucuacacuauugaacg

SEQ ID NO: 3270592 - RNA, 22 nt, Vaccinia virus
auaggaucuccgaaucugaaaa

SEQ ID NO: 3270593 - RNA, 17 nt, Vaccinia virus
uacuuaacaucuaaaaa

SEQ ID NO: 3270594 - RNA, 14 nt, Vaccinia virus
aaaauauagcauag

SEQ ID NO: 3270595 - RNA, 21 nt, Vaccinia virus
ucacuaacugauaccaugaaa

SEQ ID NO: 3270596 - RNA, 20 nt, Vaccinia virus
ccaauucgguuauaaaugaa

SEQ ID NO: 3270597 - RNA, 18 nt, Vaccinia virus
uaucaaauagcucaauau

SEQ ID NO: 3270598 - RNA, 21 nt, Vaccinia virus
aaaaugcuccgcauaacucua

SEQ ID NO: 3270599 - RNA, 20 nt, Vaccinia virus
uaaacuauuuuaccagcauu

SEQ ID NO: 3270600 - RNA, 15 nt, Vaccinia virus
uuaauagauuaacau

SEQ ID NO: 3270601 - RNA, 17 nt, Vaccinia virus
cacacauuuaugauaug

SEQ ID NO: 3270602 - RNA, 20 nt, Vaccinia virus
auuaucuaaguccuguugau

SEQ ID NO: 3270603 - RNA, 16 nt, Vaccinia virus
augcacuaacgagaaa

SEQ ID NO: 3270604 - RNA, 12 nt, Vaccinia virus
aaagauguuaug

SEQ ID NO: 3270605 - RNA, 18 nt, Vaccinia virus
guuuaucgccuacaucau

SEQ ID NO: 3270606 - RNA, 20 nt, Vaccinia virus
uagauuuuuuaaaggaugau

SEQ ID NO: 3270607 - RNA, 17 nt, Vaccinia virus
ccuaugauguguuuaga

SEQ ID NO: 3270608 - RNA, 22 nt, Vaccinia virus
cauccuucucuucccucuucua

SEQ ID NO: 3270609 - RNA, 18 nt, Vaccinia virus
ucguacuauaccacauac

SEQ ID NO: 3270610 - RNA, 18 nt, Vaccinia virus
augcuagugcucaaacaa

SEQ ID NO: 3270611 - RNA, 17 nt, Vaccinia virus
ucucucaucuaucaaaa

SEQ ID NO: 3270612 - RNA, 22 nt, Vaccinia virus
gucaacaaguuggaugauauua

SEQ ID NO: 3270613 - RNA, 18 nt, Vaccinia virus
aagguguuaaaauuagaa

SEQ ID NO: 3270614 - RNA, 20 nt, Vaccinia virus
auguuaucaugaaauguuug

SEQ ID NO: 3270615 - RNA, 15 nt, Vaccinia virus
auauuauuaaucauu

SEQ ID NO: 3270616 - RNA, 14 nt, Vaccinia virus
cuagucuucucuga

SEQ ID NO: 3270617 - RNA, 18 nt, Vaccinia virus
ucaguguagauaguaaau

SEQ ID NO: 3270618 - RNA, 20 nt, Vaccinia virus
acauuaucaaaaagaacgau

SEQ ID NO: 3270619 - RNA, 16 nt, Vaccinia virus
ucauauuaaacauacu

SEQ ID NO: 3270620 - RNA, 16 nt, Vaccinia virus
auauaggugcaaaaaa

SEQ ID NO: 3270621 - RNA, 17 nt, Vaccinia virus
auguauccacaucaaag

SEQ ID NO: 3270622 - RNA, 14 nt, Vaccinia virus
gaaucauuuuugca

SEQ ID NO: 3270623 - RNA, 22 nt, Vaccinia virus
ucucuuuuucagaaauuaguuu

SEQ ID NO: 3270624 - RNA, 19 nt, Vaccinia virus
aaucacuacaauaauuaca

SEQ ID NO: 3270625 - RNA, 21 nt, Vaccinia virus
cuuaauauuguauuguuuaua

SEQ ID NO: 3270626 - RNA, 17 nt, Vaccinia virus
ucagcauuacuugauau

SEQ ID NO: 3270627 - RNA, 16 nt, Vaccinia virus
uacucuaguaaaguca

SEQ ID NO: 3270628 - RNA, 19 nt, Vaccinia virus
ucagauuauuaaguauaau

SEQ ID NO: 3270629 - RNA, 20 nt, Vaccinia virus
acuuuguaacuaguuuuaua

SEQ ID NO: 3270630 - RNA, 20 nt, Vaccinia virus
uauauguaagauguuuagaa

SEQ ID NO: 3270631 - RNA, 17 nt, Vaccinia virus
agaaugcuucagaauua

SEQ ID NO: 3270632 - RNA, 16 nt, Vaccinia virus
uauccucguucuaauu

SEQ ID NO: 3270633 - RNA, 21 nt, Vaccinia virus
augucgagauauauggacgau

SEQ ID NO: 3270634 - RNA, 22 nt, Vaccinia virus
aacugauuuuagcagaauauau

SEQ ID NO: 3270635 - RNA, 16 nt, Vaccinia virus
caugaaaugaugauau

SEQ ID NO: 3270636 - RNA, 14 nt, Vaccinia virus
uaacaauuaaugau

SEQ ID NO: 3270637 - RNA, 17 nt, Vaccinia virus
gcacauccaucaaagaa

SEQ ID NO: 3270638 - RNA, 13 nt, Vaccinia virus
uaugagaaugaau

SEQ ID NO: 3270639 - RNA, 22 nt, Vaccinia virus
caauaugaucacaaagaaagcu

SEQ ID NO: 3270640 - RNA, 18 nt, Vaccinia virus
uaacaugcgguucaaaau

SEQ ID NO: 3270641 - RNA, 21 nt, Vaccinia virus
cuaaaggagcaaauguuaaug

SEQ ID NO: 3270642 - RNA, 21 nt, Vaccinia virus
aucuacugauaaaacuggaag

SEQ ID NO: 3270643 - RNA, 14 nt, Vaccinia virus
aaauauguaauaau

SEQ ID NO: 3270644 - RNA, 21 nt, Vaccinia virus
ccuguuucuacuaacuuuuug

SEQ ID NO: 3270645 - RNA, 22 nt, Vaccinia virus
agccaaucaaaaagauuagaca

SEQ ID NO: 3270646 - RNA, 15 nt, Vaccinia virus
guaucuuauauacac

SEQ ID NO: 3270647 - RNA, 21 nt, Vaccinia virus
ugaaaucacuucaauaaauga

SEQ ID NO: 3270648 - RNA, 16 nt, Vaccinia virus
uaauucauaagaauuu

SEQ ID NO: 3270649 - RNA, 22 nt, Vaccinia virus
aggacugaguaccgauaucacu

SEQ ID NO: 3270650 - RNA, 14 nt, Vaccinia virus
auuauuuuaaaccu

SEQ ID NO: 3270651 - RNA, 17 nt, Vaccinia virus
cuugauacgcucauuaa

SEQ ID NO: 3270652 - RNA, 21 nt, Vaccinia virus
accaauagaaguuuucccaaa

SEQ ID NO: 3270653 - RNA, 14 nt, Vaccinia virus
ccacaauacgcaug

SEQ ID NO: 3270654 - RNA, 17 nt, Vaccinia virus
acauuauucuauuucga

SEQ ID NO: 3270655 - RNA, 20 nt, Vaccinia virus
uaaauauuuuaaaauuuaua

SEQ ID NO: 3270656 - RNA, 19 nt, Vaccinia virus
aaucuaguacgcgaaauaa

SEQ ID NO: 3270657 - RNA, 19 nt, Vaccinia virus
uccaccaucugccauaauc

SEQ ID NO: 3270658 - RNA, 22 nt, Vaccinia virus
uauuaucaaagucacaaagcaa

SEQ ID NO: 3270659 - RNA, 14 nt, Vaccinia virus
auauucuguucuau

SEQ ID NO: 3270660 - RNA, 19 nt, Vaccinia virus
gauucaucaagguauauaa

SEQ ID NO: 3270661 - RNA, 17 nt, Vaccinia virus
acgcuagauauacaguc

SEQ ID NO: 3270662 - RNA, 19 nt, Vaccinia virus
agaugugauggaaaaauga

SEQ ID NO: 3270663 - RNA, 19 nt, Vaccinia virus
uuaaauuucaguuuauguu

SEQ ID NO: 3270664 - RNA, 19 nt, Vaccinia virus
uguaugcaaccguaucaaa

SEQ ID NO: 3270665 - RNA, 21 nt, Vaccinia virus
uaacuuucuucugcaaacuua

SEQ ID NO: 3270666 - RNA, 17 nt, Vaccinia virus
accacgaauuaaaaaag

SEQ ID NO: 3270667 - RNA, 11 nt, Vaccinia virus
cgaagcaaacg

SEQ ID NO: 3270668 - RNA, 14 nt, Vaccinia virus
ucuagaacuaacaa

SEQ ID NO: 3270669 - RNA, 13 nt, Vaccinia virus
aucauuaaaugau

SEQ ID NO: 3270670 - RNA, 16 nt, Vaccinia virus
auagagcaaaauaauu

SEQ ID NO: 3270671 - RNA, 20 nt, Vaccinia virus
uguucauuaauaguauacac

SEQ ID NO: 3270672 - RNA, 21 nt, Vaccinia virus
gagacguaacaauguagcgca

SEQ ID NO: 3270673 - RNA, 16 nt, Vaccinia virus
aacguguauuaaauag

SEQ ID NO: 3270674 - RNA, 14 nt, Vaccinia virus
guaaaaaauaauau

SEQ ID NO: 3270675 - RNA, 19 nt, Vaccinia virus
augaauggaucaccguguu

SEQ ID NO: 3270676 - RNA, 17 nt, Vaccinia virus
agauaccaacauuaaaa

SEQ ID NO: 3270677 - RNA, 19 nt, Vaccinia virus
cuuaacaguuccacaaauu

SEQ ID NO: 3270678 - RNA, 15 nt, Vaccinia virus
gcauccguauaaaaa

SEQ ID NO: 3270679 - RNA, 14 nt, Vaccinia virus
guuuucucuauucu

SEQ ID NO: 3270680 - RNA, 15 nt, Vaccinia virus
ucuauauauacucuu

SEQ ID NO: 3270681 - RNA, 14 nt, Vaccinia virus
auuauacuagaguu

SEQ ID NO: 3270682 - RNA, 21 nt, Vaccinia virus
cugauuuuuuaugauuuugug

SEQ ID NO: 3270683 - RNA, 15 nt, Vaccinia virus
auugaucaaacauuu

SEQ ID NO: 3270684 - RNA, 22 nt, Vaccinia virus
agcuauagcauuguuauguauu

SEQ ID NO: 3270685 - RNA, 14 nt, Vaccinia virus
gauaaaguuaucau

SEQ ID NO: 3270686 - RNA, 13 nt, Vaccinia virus
cucauuacauagu

SEQ ID NO: 3270687 - RNA, 16 nt, Vaccinia virus
uuccagaugucauaau

SEQ ID NO: 3270688 - RNA, 18 nt, Vaccinia virus
agaaguuuucccaaaaaa

SEQ ID NO: 3270689 - RNA, 13 nt, Vaccinia virus
gucucuuaaagga

SEQ ID NO: 3270690 - RNA, 17 nt, Vaccinia virus
auucuuguucaauggau

SEQ ID NO: 3270691 - RNA, 21 nt, Vaccinia virus
uuguaacaucgguacggguau

SEQ ID NO: 3270692 - RNA, 21 nt, Vaccinia virus
acaaauauaugcaaaauaaua

SEQ ID NO: 3270693 - RNA, 23 nt, Vaccinia virus
uguuuuaaauaucaaccgcaaau

SEQ ID NO: 3270694 - RNA, 17 nt, Vaccinia virus
uauaacuucuaaucuug

SEQ ID NO: 3270695 - RNA, 21 nt, Vaccinia virus
uguccuugcguuucucugaua

SEQ ID NO: 3270696 - RNA, 11 nt, Vaccinia virus
uuacaaacauc

SEQ ID NO: 3270697 - RNA, 22 nt, Vaccinia virus
auauaaaauagaaaauaacaga

SEQ ID NO: 3270698 - RNA, 11 nt, Vaccinia virus
uguauuuccau

SEQ ID NO: 3270699 - RNA, 13 nt, Vaccinia virus
accgaaagacuau

SEQ ID NO: 3270700 - RNA, 14 nt, Vaccinia virus
guaaaaaaauuaga

SEQ ID NO: 3270701 - RNA, 17 nt, Vaccinia virus
ucgcauagcauaguuuu

SEQ ID NO: 3270702 - RNA, 19 nt, Vaccinia virus
aaaugaucggaucuaaaau

SEQ ID NO: 3270703 - RNA, 17 nt, Vaccinia virus
acuguacgauacauaau

SEQ ID NO: 3270704 - RNA, 19 nt, Vaccinia virus
cagaggaacgucauauauu

SEQ ID NO: 3270705 - RNA, 16 nt, Vaccinia virus
ggaucuaguauuauug

SEQ ID NO: 3270706 - RNA, 23 nt, Vaccinia virus
uauuaacacuaaaaaauaaacac

SEQ ID NO: 3270707 - RNA, 21 nt, Vaccinia virus
guaaaauguugaugauaucua

SEQ ID NO: 3270708 - RNA, 18 nt, Vaccinia virus
gcugauuauuuauuucuu

SEQ ID NO: 3270709 - RNA, 17 nt, Vaccinia virus
uuaaccuaacuaaaaga

SEQ ID NO: 3270710 - RNA, 21 nt, Vaccinia virus
uguucauuaacgauaucuugc

SEQ ID NO: 3270711 - RNA, 17 nt, Vaccinia virus
aucuauuauugaugcaa

SEQ ID NO: 3270712 - RNA, 14 nt, Vaccinia virus
gaagaagaaaacaa

SEQ ID NO: 3270713 - RNA, 14 nt, Vaccinia virus
auuaaaaccuaauu

SEQ ID NO: 3270714 - RNA, 19 nt, Vaccinia virus
uaacucgguaucuacuuua

SEQ ID NO: 3270715 - RNA, 17 nt, Vaccinia virus
gaaaaugcagaaaugau

SEQ ID NO: 3270716 - RNA, 14 nt, Vaccinia virus
gucaggaaauguau

SEQ ID NO: 3270717 - RNA, 17 nt, Vaccinia virus
uuuaauuggacagauau

SEQ ID NO: 3270718 - RNA, 12 nt, Vaccinia virus
auaccaaaauuc

SEQ ID NO: 3270719 - RNA, 14 nt, Vaccinia virus
aauguagaaauuga

SEQ ID NO: 3270720 - RNA, 12 nt, Vaccinia virus
uaacaucauuau

SEQ ID NO: 3270721 - RNA, 20 nt, Vaccinia virus
uaguuuuuuuguuuccuugu

SEQ ID NO: 3270722 - RNA, 16 nt, Vaccinia virus
caugacguaaauguaa

SEQ ID NO: 3270723 - RNA, 14 nt, Vaccinia virus
auacuuaaaaaugg

SEQ ID NO: 3270724 - RNA, 20 nt, Vaccinia virus
aucacaagaaguuagaaagu

SEQ ID NO: 3270725 - RNA, 16 nt, Vaccinia virus
auagaauuuauaacau

SEQ ID NO: 3270726 - RNA, 22 nt, Vaccinia virus
uacgcaaauaccgaucaacaaa

SEQ ID NO: 3270727 - RNA, 17 nt, Vaccinia virus
auaaugacgauaacauu

SEQ ID NO: 3270728 - RNA, 15 nt, Vaccinia virus
auaucuauaggaaag

SEQ ID NO: 3270729 - RNA, 13 nt, Vaccinia virus
auuuaaaaugaua

SEQ ID NO: 3270730 - RNA, 15 nt, Vaccinia virus
uuaccucuacaaaua

SEQ ID NO: 3270731 - RNA, 19 nt, Vaccinia virus
uuauaucguguucauuaac

SEQ ID NO: 3270732 - RNA, 23 nt, Vaccinia virus
agacgacgacaauaguguucuaa

SEQ ID NO: 3270733 - RNA, 18 nt, Vaccinia virus
ugaugcaaauagcagaua

SEQ ID NO: 3270734 - RNA, 14 nt, Vaccinia virus
uuuagauuuauuuu

SEQ ID NO: 3270735 - RNA, 12 nt, Vaccinia virus
agauaaaacaag

SEQ ID NO: 3270736 - RNA, 13 nt, Vaccinia virus
guaauuaaauguu

SEQ ID NO: 3270737 - RNA, 19 nt, Vaccinia virus
aauguuugacugaauauau

SEQ ID NO: 3270738 - RNA, 19 nt, Vaccinia virus
uuauugauugaaaaugaaa

SEQ ID NO: 3270739 - RNA, 15 nt, Vaccinia virus
aauugcgaauguuuu

SEQ ID NO: 3270740 - RNA, 19 nt, Vaccinia virus
uucacaugauguagugaua

SEQ ID NO: 3270741 - RNA, 19 nt, Vaccinia virus
uucccaaauaaucauucau

SEQ ID NO: 3270742 - RNA, 17 nt, Vaccinia virus
agaaauauacagcaaug

SEQ ID NO: 3270743 - RNA, 18 nt, Vaccinia virus
gccuccacuagaagagaa

SEQ ID NO: 3270744 - RNA, 22 nt, Vaccinia virus
uaacuccaggccguuuguuucc

SEQ ID NO: 3270745 - RNA, 16 nt, Vaccinia virus
auuucaacgucuaaug

SEQ ID NO: 3270746 - RNA, 17 nt, Vaccinia virus
cugaauauagaacauca

SEQ ID NO: 3270747 - RNA, 19 nt, Vaccinia virus
agaaguaacgccauauuac

SEQ ID NO: 3270748 - RNA, 22 nt, Vaccinia virus
agauaucauaaaugaaauagau

SEQ ID NO: 3270749 - RNA, 20 nt, Vaccinia virus
auguuccauuuauaagaaau

SEQ ID NO: 3270750 - RNA, 19 nt, Vaccinia virus
uuuagaauauauguaugua

SEQ ID NO: 3270751 - RNA, 17 nt, Vaccinia virus
guagaacguaaauuagu

SEQ ID NO: 3270752 - RNA, 20 nt, Vaccinia virus
cuuuguggaugaugauaaaa

SEQ ID NO: 3270753 - RNA, 21 nt, Vaccinia virus
auaucuuagugcaaaaguaua

SEQ ID NO: 3270754 - RNA, 23 nt, Vaccinia virus
accucuuauuggucagaaauauu

SEQ ID NO: 3270755 - RNA, 17 nt, Vaccinia virus
auaacauucuuaaacaa

SEQ ID NO: 3270756 - RNA, 21 nt, Vaccinia virus
aguugggauaguauuuuucua

SEQ ID NO: 3270757 - RNA, 17 nt, Vaccinia virus
aaugcggauuuagaaaa

SEQ ID NO: 3270758 - RNA, 13 nt, Vaccinia virus
uauuuauacuacu

SEQ ID NO: 3270759 - RNA, 14 nt, Vaccinia virus
caucaaaaaacaac

SEQ ID NO: 3270760 - RNA, 14 nt, Vaccinia virus
ugcgaucugaauaa

SEQ ID NO: 3270761 - RNA, 16 nt, Vaccinia virus
agauacguauuagaua

SEQ ID NO: 3270762 - RNA, 15 nt, Vaccinia virus
aguuaucaaguuugu

SEQ ID NO: 3270763 - RNA, 20 nt, Vaccinia virus
auauugaugugucuguuuau

SEQ ID NO: 3270764 - RNA, 17 nt, Vaccinia virus
uuaucgauucaucuaau

SEQ ID NO: 3270765 - RNA, 15 nt, Vaccinia virus
cucauuaaaacuucu

SEQ ID NO: 3270766 - RNA, 19 nt, Vaccinia virus
uguacgauggauucauccu

SEQ ID NO: 3270767 - RNA, 18 nt, Vaccinia virus
uauuaaaauuauuucuaa

SEQ ID NO: 3270768 - RNA, 23 nt, Vaccinia virus
ucccaauuaccaacuagaagucu

SEQ ID NO: 3270769 - RNA, 15 nt, Vaccinia virus
aauucuuaugauaua

SEQ ID NO: 3270770 - RNA, 17 nt, Vaccinia virus
gacacuauuauuauuga

SEQ ID NO: 3270771 - RNA, 13 nt, Vaccinia virus
aaauagauguuag

SEQ ID NO: 3270772 - RNA, 12 nt, Vaccinia virus
aaaauuagaaag

SEQ ID NO: 3270773 - RNA, 22 nt, Vaccinia virus
agaacucucuucauuacuauau

SEQ ID NO: 3270774 - RNA, 16 nt, Vaccinia virus
aacaaacuauacaaga

SEQ ID NO: 3270775 - RNA, 15 nt, Vaccinia virus
aauuaaugagauugu

SEQ ID NO: 3270776 - RNA, 17 nt, Vaccinia virus
cauggauuuuauauaga

SEQ ID NO: 3270777 - RNA, 16 nt, Vaccinia virus
aacaguucuaccacca

SEQ ID NO: 3270778 - RNA, 13 nt, Vaccinia virus
acaaaaaaguuau

SEQ ID NO: 3270779 - RNA, 18 nt, Vaccinia virus
agaucaaccaaaaaggag

SEQ ID NO: 3270780 - RNA, 19 nt, Vaccinia virus
uacuaauuacuaaaucugu

SEQ ID NO: 3270781 - RNA, 20 nt, Vaccinia virus
cauuuucccaaauaucuuua

SEQ ID NO: 3270782 - RNA, 22 nt, Vaccinia virus
ucuacaaauagagauaaaacaa

SEQ ID NO: 3270783 - RNA, 22 nt, Vaccinia virus
uugaucucaucauuccauaauu

SEQ ID NO: 3270784 - RNA, 22 nt, Vaccinia virus
gaauacacuccucagauuuaua

SEQ ID NO: 3270785 - RNA, 20 nt, Vaccinia virus
ugaaaugauucucucaacau

SEQ ID NO: 3270786 - RNA, 14 nt, Vaccinia virus
acauuuuccauuua

SEQ ID NO: 3270787 - RNA, 20 nt, Vaccinia virus
gaucucgagaaauaauaaga

SEQ ID NO: 3270788 - RNA, 17 nt, Vaccinia virus
acuaauucauuuucaau

SEQ ID NO: 3270789 - RNA, 19 nt, Vaccinia virus
uaaguaauaaaucaacuau

SEQ ID NO: 3270790 - RNA, 17 nt, Vaccinia virus
aaacuuccguuuaaaaa

SEQ ID NO: 3270791 - RNA, 14 nt, Vaccinia virus
aauguuaaaacuac

SEQ ID NO: 3270792 - RNA, 18 nt, Vaccinia virus
auuuuugcaucauuuacg

SEQ ID NO: 3270793 - RNA, 17 nt, Vaccinia virus
uagaugucgaagacuua

SEQ ID NO: 3270794 - RNA, 19 nt, Vaccinia virus
guauacaccaacaguauga

SEQ ID NO: 3270795 - RNA, 21 nt, Vaccinia virus
ucuuugauuaaugauuuagaa

SEQ ID NO: 3270796 - RNA, 18 nt, Vaccinia virus
gauaauuucguuaaaaca

SEQ ID NO: 3270797 - RNA, 14 nt, Vaccinia virus
aguauaauauuuaa

SEQ ID NO: 3270798 - RNA, 17 nt, Vaccinia virus
agaaaaaaaauugaauu

SEQ ID NO: 3270799 - RNA, 19 nt, Vaccinia virus
aaacauuguucaugauaua

SEQ ID NO: 3270800 - RNA, 20 nt, Vaccinia virus
uuguuuaaccacugcaugau

SEQ ID NO: 3270801 - RNA, 15 nt, Vaccinia virus
augacauuuauucau

SEQ ID NO: 3270802 - RNA, 16 nt, Vaccinia virus
cuauaaauagaucucu

SEQ ID NO: 3270803 - RNA, 21 nt, Vaccinia virus
uaguaucaauaacgcaaucau

SEQ ID NO: 3270804 - RNA, 19 nt, Vaccinia virus
cagucuugaaacagcaucu

SEQ ID NO: 3270805 - RNA, 19 nt, Vaccinia virus
uaaucauauaaauguuuaa

SEQ ID NO: 3270806 - RNA, 20 nt, Vaccinia virus
aaacuagagaaacuuaguac

SEQ ID NO: 3270807 - RNA, 15 nt, Vaccinia virus
acuucauuaaucuuu

SEQ ID NO: 3270808 - RNA, 21 nt, Vaccinia virus
uacucagauucaguuucucau

SEQ ID NO: 3270809 - RNA, 15 nt, Vaccinia virus
gaagugguuaaucuu

SEQ ID NO: 3270810 - RNA, 16 nt, Vaccinia virus
cuaugauuaaaucguu

SEQ ID NO: 3270811 - RNA, 22 nt, Vaccinia virus
gacacucuauaucuagaaauaa

SEQ ID NO: 3270812 - RNA, 21 nt, Vaccinia virus
gcauuaauacuguuuucuuag

SEQ ID NO: 3270813 - RNA, 23 nt, Vaccinia virus
uaaucaaaauugucuaugauguc

SEQ ID NO: 3270814 - RNA, 21 nt, Vaccinia virus
ugauagacaagauauauacac

SEQ ID NO: 3270815 - RNA, 21 nt, Vaccinia virus
aaucgauaaaaccaugaaaua

SEQ ID NO: 3270816 - RNA, 14 nt, Vaccinia virus
uauggaaaaacuug

SEQ ID NO: 3270817 - RNA, 13 nt, Vaccinia virus
ucguagauuuuaa

SEQ ID NO: 3270818 - RNA, 22 nt, Vaccinia virus
auaacagcuuagauuuaacguu

SEQ ID NO: 3270819 - RNA, 15 nt, Vaccinia virus
ccaauacauguuuua

SEQ ID NO: 3270820 - RNA, 21 nt, Vaccinia virus
uguuaugaaaccauacuaaua

SEQ ID NO: 3270821 - RNA, 18 nt, Vaccinia virus
agguauacacaaaaagaa

SEQ ID NO: 3270822 - RNA, 20 nt, Vaccinia virus
augcggaaccucgagaaugu

SEQ ID NO: 3270823 - RNA, 13 nt, Vaccinia virus
uucauaacaguga

SEQ ID NO: 3270824 - RNA, 18 nt, Vaccinia virus
ggaacgugauaguuucuc

SEQ ID NO: 3270825 - RNA, 17 nt, Vaccinia virus
ucgccgucgcuagauaa

SEQ ID NO: 3270826 - RNA, 13 nt, Vaccinia virus
gcucuaucuuuua

SEQ ID NO: 3270827 - RNA, 12 nt, Vaccinia virus
acucuaaaauau

SEQ ID NO: 3270828 - RNA, 14 nt, Vaccinia virus
gcaaugaauaucua

SEQ ID NO: 3270829 - RNA, 23 nt, Vaccinia virus
ucuaccaaagaaagaguuugauu

SEQ ID NO: 3270830 - RNA, 16 nt, Vaccinia virus
ugugaugauuguacac

SEQ ID NO: 3270831 - RNA, 14 nt, Vaccinia virus
auacucuaugaaug

SEQ ID NO: 3270832 - RNA, 15 nt, Vaccinia virus
uauaacauuaauauu

SEQ ID NO: 3270833 - RNA, 15 nt, Vaccinia virus
guuuucgauacuuuu

SEQ ID NO: 3270834 - RNA, 13 nt, Vaccinia virus
auaacaaagaaag

SEQ ID NO: 3270835 - RNA, 20 nt, Vaccinia virus
acaagauuuccaaucuuuga

SEQ ID NO: 3270836 - RNA, 20 nt, Vaccinia virus
agauccucucuuaaaugaau

SEQ ID NO: 3270837 - RNA, 20 nt, Vaccinia virus
ucgauuccguccaagaugau

SEQ ID NO: 3270838 - RNA, 15 nt, Vaccinia virus
acaauaacuacauau

SEQ ID NO: 3270839 - RNA, 17 nt, Vaccinia virus
agaucauuaaauguuuc

SEQ ID NO: 3270840 - RNA, 14 nt, Vaccinia virus
auauucaucagaua

SEQ ID NO: 3270841 - RNA, 22 nt, Vaccinia virus
gaaaaaaaauugaauugaugau

SEQ ID NO: 3270842 - RNA, 15 nt, Vaccinia virus
uaucgauguggagau

SEQ ID NO: 3270843 - RNA, 15 nt, Vaccinia virus
aaaauggacguagaa

SEQ ID NO: 3270844 - RNA, 15 nt, Vaccinia virus
uaguuuaucaaaaau

SEQ ID NO: 3270845 - RNA, 19 nt, Vaccinia virus
gacagacuacguagacugu

SEQ ID NO: 3270846 - RNA, 20 nt, Vaccinia virus
uauaugaauaugauuucaga

SEQ ID NO: 3270847 - RNA, 13 nt, Vaccinia virus
uuuauuucuaauu

SEQ ID NO: 3270848 - RNA, 13 nt, Vaccinia virus
caucuaucaucuc

SEQ ID NO: 3270849 - RNA, 12 nt, Vaccinia virus
cuauaucuucuu

SEQ ID NO: 3270850 - RNA, 15 nt, Vaccinia virus
accaucccacucuag

SEQ ID NO: 3270851 - RNA, 13 nt, Vaccinia virus
uagaucggaugau

SEQ ID NO: 3270852 - RNA, 18 nt, Vaccinia virus
ucuugcacgcguacauuu

SEQ ID NO: 3270853 - RNA, 19 nt, Vaccinia virus
aucuauaauucuagcuaau

SEQ ID NO: 3270854 - RNA, 17 nt, Vaccinia virus
aacucuugcuacaaaau

SEQ ID NO: 3270855 - RNA, 18 nt, Vaccinia virus
aucgucuaaaagaauugc

SEQ ID NO: 3270856 - RNA, 16 nt, Vaccinia virus
cuagagacaaugaaaa

SEQ ID NO: 3270857 - RNA, 13 nt, Vaccinia virus
uuaaaucauuacu

SEQ ID NO: 3270858 - RNA, 21 nt, Vaccinia virus
cuaguacuuguauguguuaua

SEQ ID NO: 3270859 - RNA, 13 nt, Vaccinia virus
guauauguuucua

SEQ ID NO: 3270860 - RNA, 16 nt, Vaccinia virus
acauaccguuagauaa

SEQ ID NO: 3270861 - RNA, 13 nt, Vaccinia virus
acguuaacagaga

SEQ ID NO: 3270862 - RNA, 21 nt, Vaccinia virus
aguauacacgcuaaaauaacu

SEQ ID NO: 3270863 - RNA, 16 nt, Vaccinia virus
uauaggcgguguauuu

SEQ ID NO: 3270864 - RNA, 15 nt, Vaccinia virus
aaucuucuuauaaga

SEQ ID NO: 3270865 - RNA, 21 nt, Vaccinia virus
ggcaauaauugcgaauguuuu

SEQ ID NO: 3270866 - RNA, 18 nt, Vaccinia virus
auuaacuaucuguaaaag

SEQ ID NO: 3270867 - RNA, 17 nt, Vaccinia virus
gcuaaggaguuuaagaa

SEQ ID NO: 3270868 - RNA, 23 nt, Vaccinia virus
agauagaucacacauuaugaacu

SEQ ID NO: 3270869 - RNA, 20 nt, Vaccinia virus
caucgaugauacauuucauc

SEQ ID NO: 3270870 - RNA, 21 nt, Vaccinia virus
aauauagguauauuuauucca

SEQ ID NO: 3270871 - RNA, 20 nt, Vaccinia virus
ugaacuauuucuugaaugag

SEQ ID NO: 3270872 - RNA, 19 nt, Vaccinia virus
agcauacgaauuacaauaa

SEQ ID NO: 3270873 - RNA, 18 nt, Vaccinia virus
acaaauuuauuuauuaac

SEQ ID NO: 3270874 - RNA, 18 nt, Vaccinia virus
uuaaauuuuuuuauuaau

SEQ ID NO: 3270875 - RNA, 21 nt, Vaccinia virus
gcacaaucguuccaugauggg

SEQ ID NO: 3270876 - RNA, 17 nt, Vaccinia virus
uucauccauuuacaacu

SEQ ID NO: 3270877 - RNA, 20 nt, Vaccinia virus
auagauggauaauggaagau

SEQ ID NO: 3270878 - RNA, 12 nt, Vaccinia virus
cuucauuucuaa

SEQ ID NO: 3270879 - RNA, 15 nt, Vaccinia virus
uaucuuuaacauaag

SEQ ID NO: 3270880 - RNA, 21 nt, Vaccinia virus
agacaaucaucuuggagcaac

SEQ ID NO: 3270881 - RNA, 14 nt, Vaccinia virus
ucguuuucuacaau

SEQ ID NO: 3270882 - RNA, 17 nt, Vaccinia virus
aaucucuguuauuuccu

SEQ ID NO: 3270883 - RNA, 22 nt, Vaccinia virus
auaaucauuacuaacuuuauca

SEQ ID NO: 3270884 - RNA, 23 nt, Vaccinia virus
ugauucuagucccgaagaauuuc

SEQ ID NO: 3270885 - RNA, 13 nt, Vaccinia virus
uggaaaugucaua

SEQ ID NO: 3270886 - RNA, 14 nt, Vaccinia virus
aggagauauugaaa

SEQ ID NO: 3270887 - RNA, 19 nt, Vaccinia virus
gagaguagauaucauuaau

SEQ ID NO: 3270888 - RNA, 16 nt, Vaccinia virus
uuuacagauauauuca

SEQ ID NO: 3270889 - RNA, 19 nt, Vaccinia virus
auauccuccuuuaaaauua

SEQ ID NO: 3270890 - RNA, 13 nt, Vaccinia virus
uauuaaaacugac

SEQ ID NO: 3270891 - RNA, 13 nt, Vaccinia virus
caugaaagaaaga

SEQ ID NO: 3270892 - RNA, 21 nt, Vaccinia virus
aauuugcugacugcauguacu

SEQ ID NO: 3270893 - RNA, 22 nt, Vaccinia virus
ugccguuuauaggucuagccac

SEQ ID NO: 3270894 - RNA, 18 nt, Vaccinia virus
uacacaucagcaucuuga

SEQ ID NO: 3270895 - RNA, 20 nt, Vaccinia virus
uccuagcaucagcaaaacag

SEQ ID NO: 3270896 - RNA, 14 nt, Vaccinia virus
cgccuuuauuucca

SEQ ID NO: 3270897 - RNA, 18 nt, Vaccinia virus
uuuaccgaacaggcauuu

SEQ ID NO: 3270898 - RNA, 16 nt, Vaccinia virus
ccgaggaaacgaaaga

SEQ ID NO: 3270899 - RNA, 22 nt, Vaccinia virus
aauugauucuuauucacuauau

SEQ ID NO: 3270900 - RNA, 21 nt, Vaccinia virus
uagagcccacguuuaaacauu

SEQ ID NO: 3270901 - RNA, 17 nt, Vaccinia virus
auucuucauucugcaua

SEQ ID NO: 3270902 - RNA, 12 nt, Vaccinia virus
aauacuaauuca

SEQ ID NO: 3270903 - RNA, 21 nt, Vaccinia virus
aucuagcgucgacaucuauau

SEQ ID NO: 3270904 - RNA, 14 nt, Vaccinia virus
guauuaugaugaau

SEQ ID NO: 3270905 - RNA, 16 nt, Vaccinia virus
aacuuuaucacaauau

SEQ ID NO: 3270906 - RNA, 17 nt, Vaccinia virus
ucuauguuuuuagauuu

SEQ ID NO: 3270907 - RNA, 14 nt, Vaccinia virus
aaauuauccuauca

SEQ ID NO: 3270908 - RNA, 14 nt, Vaccinia virus
ugaaccauuauucg

SEQ ID NO: 3270909 - RNA, 19 nt, Vaccinia virus
acguucggagacaauaaag

SEQ ID NO: 3270910 - RNA, 17 nt, Vaccinia virus
aaaguucauaaucucau

SEQ ID NO: 3270911 - RNA, 21 nt, Vaccinia virus
acaagaaucauccaaguggau

SEQ ID NO: 3270912 - RNA, 23 nt, Vaccinia virus
uuuuucguuuacaaaaucaaaua

SEQ ID NO: 3270913 - RNA, 20 nt, Vaccinia virus
cuuccagauaauguucucuu

SEQ ID NO: 3270914 - RNA, 15 nt, Vaccinia virus
gaucauguagaaaac

SEQ ID NO: 3270915 - RNA, 22 nt, Vaccinia virus
ucacaaguaugaagaaaaaugu

SEQ ID NO: 3270916 - RNA, 12 nt, Vaccinia virus
accacaauaauc

SEQ ID NO: 3270917 - RNA, 18 nt, Vaccinia virus
uguucuuaacuacauuca

SEQ ID NO: 3270918 - RNA, 20 nt, Vaccinia virus
auaaaagucuauuuguuuau

SEQ ID NO: 3270919 - RNA, 19 nt, Vaccinia virus
aauuaucacauauuaaaaa

SEQ ID NO: 3270920 - RNA, 22 nt, Vaccinia virus
uaacaucuuuguaaacagauau

SEQ ID NO: 3270921 - RNA, 17 nt, Vaccinia virus
ccauauaucuguaucau

SEQ ID NO: 3270922 - RNA, 17 nt, Vaccinia virus
cauugggaaacauuaca

SEQ ID NO: 3270923 - RNA, 13 nt, Vaccinia virus
ccaaauaucuuua

SEQ ID NO: 3270924 - RNA, 13 nt, Vaccinia virus
agcaagaaagaua

SEQ ID NO: 3270925 - RNA, 13 nt, Vaccinia virus
aucuaauauaauu

SEQ ID NO: 3270926 - RNA, 19 nt, Vaccinia virus
aaggaauaaaauaugaaau

SEQ ID NO: 3270927 - RNA, 18 nt, Vaccinia virus
auauuaauacacauaaug

SEQ ID NO: 3270928 - RNA, 19 nt, Vaccinia virus
uacucuagauaaaaucacu

SEQ ID NO: 3270929 - RNA, 16 nt, Vaccinia virus
agacuguuuguagaau

SEQ ID NO: 3270930 - RNA, 22 nt, Vaccinia virus
ucguaauuggaaaaauaguguu

SEQ ID NO: 3270931 - RNA, 13 nt, Vaccinia virus
auuaugagaauga

SEQ ID NO: 3270932 - RNA, 16 nt, Vaccinia virus
cuguauuccaauuagu

SEQ ID NO: 3270933 - RNA, 13 nt, Vaccinia virus
auuaguuaaauau

SEQ ID NO: 3270934 - RNA, 21 nt, Vaccinia virus
cugccauggauggaaacauug

SEQ ID NO: 3270935 - RNA, 22 nt, Vaccinia virus
cauugaugucguuauucugaaa

SEQ ID NO: 3270936 - RNA, 21 nt, Vaccinia virus
augauuuuccuucuaaaguaa

SEQ ID NO: 3270937 - RNA, 20 nt, Vaccinia virus
gauaaauucguaauaaucug

SEQ ID NO: 3270938 - RNA, 20 nt, Vaccinia virus
uaauagcguuaacuaucaaa

SEQ ID NO: 3270939 - RNA, 15 nt, Vaccinia virus
uacccaauaaaaugu

SEQ ID NO: 3270940 - RNA, 17 nt, Vaccinia virus
guauccuugauuauguu

SEQ ID NO: 3270941 - RNA, 17 nt, Vaccinia virus
ucguaagauaaaguuua

SEQ ID NO: 3270942 - RNA, 13 nt, Vaccinia virus
gaauaaguuuauu

SEQ ID NO: 3270943 - RNA, 13 nt, Vaccinia virus
agucgucaagcau

SEQ ID NO: 3270944 - RNA, 11 nt, Vaccinia virus
gggaaaugaua

SEQ ID NO: 3270945 - RNA, 17 nt, Vaccinia virus
auaguuguuauaaagga

SEQ ID NO: 3270946 - RNA, 17 nt, Vaccinia virus
uaucaauauuaacaguu

SEQ ID NO: 3270947 - RNA, 13 nt, Vaccinia virus
cgauacuagauuu

SEQ ID NO: 3270948 - RNA, 20 nt, Vaccinia virus
cuaaagacucuaaaugguug

SEQ ID NO: 3270949 - RNA, 19 nt, Vaccinia virus
cuauuauuugcgaggauga

SEQ ID NO: 3270950 - RNA, 13 nt, Vaccinia virus
cacuuauuucaug

SEQ ID NO: 3270951 - RNA, 16 nt, Vaccinia virus
caaaaugcaagcaucu

SEQ ID NO: 3270952 - RNA, 22 nt, Vaccinia virus
ucaugucugguaauucauauag

SEQ ID NO: 3270953 - RNA, 15 nt, Vaccinia virus
ucaauagauuauaca

SEQ ID NO: 3270954 - RNA, 21 nt, Vaccinia virus
uacaucaugccauuaagaaac

SEQ ID NO: 3270955 - RNA, 20 nt, Vaccinia virus
agacaaucauuuacuaagga

SEQ ID NO: 3270956 - RNA, 14 nt, Vaccinia virus
auauuuccauuuau

SEQ ID NO: 3270957 - RNA, 17 nt, Vaccinia virus
uuucacuuuaucucauu

SEQ ID NO: 3270958 - RNA, 14 nt, Vaccinia virus
uguacaccauagca

SEQ ID NO: 3270959 - RNA, 20 nt, Vaccinia virus
agacuuuauaauuucaucua

SEQ ID NO: 3270960 - RNA, 14 nt, Vaccinia virus
auuacuacugaaga

SEQ ID NO: 3270961 - RNA, 14 nt, Vaccinia virus
aaauuauucguuua

SEQ ID NO: 3270962 - RNA, 15 nt, Vaccinia virus
uucagaaaauaaucc

SEQ ID NO: 3270963 - RNA, 18 nt, Vaccinia virus
ucuauaauaucuuauucu

SEQ ID NO: 3270964 - RNA, 12 nt, Vaccinia virus
cauaaacauguc

SEQ ID NO: 3270965 - RNA, 16 nt, Vaccinia virus
aaaaucauugggauuu

SEQ ID NO: 3270966 - RNA, 17 nt, Vaccinia virus
ugucuguccgaauguau

SEQ ID NO: 3270967 - RNA, 14 nt, Vaccinia virus
ucguuaucucagaa

SEQ ID NO: 3270968 - RNA, 14 nt, Vaccinia virus
uaggaguaucuauu

SEQ ID NO: 3270969 - RNA, 19 nt, Vaccinia virus
auuagugaugaauugaaaa

SEQ ID NO: 3270970 - RNA, 14 nt, Vaccinia virus
ccaugauaaauuau

SEQ ID NO: 3270971 - RNA, 14 nt, Vaccinia virus
uauaaaguguaugu

SEQ ID NO: 3270972 - RNA, 18 nt, Vaccinia virus
cgaugauauguuaaauau

SEQ ID NO: 3270973 - RNA, 18 nt, Vaccinia virus
aaucaaugauagacuaga

SEQ ID NO: 3270974 - RNA, 14 nt, Vaccinia virus
agauauagauguua

SEQ ID NO: 3270975 - RNA, 15 nt, Vaccinia virus
aaacuuuauuaucca

SEQ ID NO: 3270976 - RNA, 20 nt, Vaccinia virus
aguaaguauuuauaaaacuc

SEQ ID NO: 3270977 - RNA, 23 nt, Vaccinia virus
ucaucgacuguacgauacauaau

SEQ ID NO: 3270978 - RNA, 13 nt, Vaccinia virus
ugucuaaaucucu

SEQ ID NO: 3270979 - RNA, 21 nt, Vaccinia virus
uugguauuacuauauaguaua

SEQ ID NO: 3270980 - RNA, 15 nt, Vaccinia virus
uagauuuauuugaua

SEQ ID NO: 3270981 - RNA, 21 nt, Vaccinia virus
uguuuauacaauccaugauau

SEQ ID NO: 3270982 - RNA, 14 nt, Vaccinia virus
caauauuaucaucu

SEQ ID NO: 3270983 - RNA, 14 nt, Vaccinia virus
uaguguuacaaaac

SEQ ID NO: 3270984 - RNA, 22 nt, Vaccinia virus
acagugcaaccucuauuggaua

SEQ ID NO: 3270985 - RNA, 15 nt, Vaccinia virus
uccguucucugaaua

SEQ ID NO: 3270986 - RNA, 12 nt, Vaccinia virus
ccuguguuuaua

SEQ ID NO: 3270987 - RNA, 20 nt, Vaccinia virus
auacaaauuuuaagaaaugg

SEQ ID NO: 3270988 - RNA, 20 nt, Vaccinia virus
acgaacauuuauaucauuug

SEQ ID NO: 3270989 - RNA, 15 nt, Vaccinia virus
gcauuucuaauacau

SEQ ID NO: 3270990 - RNA, 15 nt, Vaccinia virus
uaacgaggacuuauu

SEQ ID NO: 3270991 - RNA, 16 nt, Vaccinia virus
ucaauaaucaaccauc

SEQ ID NO: 3270992 - RNA, 13 nt, Vaccinia virus
uacuuacaucauu

SEQ ID NO: 3270993 - RNA, 16 nt, Vaccinia virus
auuagcgaacauauau

SEQ ID NO: 3270994 - RNA, 15 nt, Vaccinia virus
aucauauauagaaug

SEQ ID NO: 3270995 - RNA, 22 nt, Vaccinia virus
caacuacggcguccgcuuuagu

SEQ ID NO: 3270996 - RNA, 21 nt, Vaccinia virus
acaauacagaagauagcaaag

SEQ ID NO: 3270997 - RNA, 19 nt, Vaccinia virus
ugacauuuuggauucuguu

SEQ ID NO: 3270998 - RNA, 17 nt, Vaccinia virus
acuaaugacaauaauua

SEQ ID NO: 3270999 - RNA, 18 nt, Vaccinia virus
uacgguugauucaaaaau

SEQ ID NO: 3271000 - RNA, 12 nt, Vaccinia virus
acuauauccaug

SEQ ID NO: 3271001 - RNA, 21 nt, Vaccinia virus
uauaugugcgagaauauccuc

SEQ ID NO: 3271002 - RNA, 23 nt, Vaccinia virus
agaagaauucaagucaggaacua

SEQ ID NO: 3271003 - RNA, 13 nt, Vaccinia virus
gaacgccauaaua

SEQ ID NO: 3271004 - RNA, 19 nt, Vaccinia virus
uagauugguacgaaauaua

SEQ ID NO: 3271005 - RNA, 12 nt, Vaccinia virus
gacgauauuaac

SEQ ID NO: 3271006 - RNA, 20 nt, Vaccinia virus
aagaacacacgaacaucuuu

SEQ ID NO: 3271007 - RNA, 20 nt, Vaccinia virus
aaagauucuauaauaaugaa

SEQ ID NO: 3271008 - RNA, 16 nt, Vaccinia virus
gucaauugaguuuaua

SEQ ID NO: 3271009 - RNA, 13 nt, Vaccinia virus
cuuaucaauaaca

SEQ ID NO: 3271010 - RNA, 15 nt, Vaccinia virus
uaaucgaguacacca

SEQ ID NO: 3271011 - RNA, 17 nt, Vaccinia virus
acaauacggaauaucua

SEQ ID NO: 3271012 - RNA, 21 nt, Vaccinia virus
auacuaccaaccuacacuauu

SEQ ID NO: 3271013 - RNA, 22 nt, Vaccinia virus
aagauaugguaaaauuaaauag

SEQ ID NO: 3271014 - RNA, 16 nt, Vaccinia virus
cguuagaucuauuuua

SEQ ID NO: 3271015 - RNA, 23 nt, Vaccinia virus
ugagaauccgcuacauauuauug

SEQ ID NO: 3271016 - RNA, 23 nt, Vaccinia virus
ugacuguauccacgcuagagaua

SEQ ID NO: 3271017 - RNA, 17 nt, Vaccinia virus
uuucuauuucuuucaug

SEQ ID NO: 3271018 - RNA, 19 nt, Vaccinia virus
auuucaacagacuguuuau

SEQ ID NO: 3271019 - RNA, 23 nt, Vaccinia virus
aagcaugugucacuaugauaaac

SEQ ID NO: 3271020 - RNA, 15 nt, Vaccinia virus
aaucuauuagaauug

SEQ ID NO: 3271021 - RNA, 18 nt, Vaccinia virus
acuucuaacaaacaucuc

SEQ ID NO: 3271022 - RNA, 17 nt, Vaccinia virus
auuaucccauuguaaag

SEQ ID NO: 3271023 - RNA, 17 nt, Vaccinia virus
cucuuucgcuauuucua

SEQ ID NO: 3271024 - RNA, 18 nt, Vaccinia virus
acauccuucucuucccuc

SEQ ID NO: 3271025 - RNA, 17 nt, Vaccinia virus
uauauguggaaauguca

SEQ ID NO: 3271026 - RNA, 12 nt, Vaccinia virus
auaccaaacaua

SEQ ID NO: 3271027 - RNA, 23 nt, Vaccinia virus
uuaaacaauaucacgaaaguaga

SEQ ID NO: 3271028 - RNA, 16 nt, Vaccinia virus
aguuggccauuaucga

SEQ ID NO: 3271029 - RNA, 17 nt, Vaccinia virus
aucgauacauauaugca

SEQ ID NO: 3271030 - RNA, 18 nt, Vaccinia virus
uauauaccgauuucacaa

SEQ ID NO: 3271031 - RNA, 18 nt, Vaccinia virus
ugauaaacacguuagagu

SEQ ID NO: 3271032 - RNA, 13 nt, Vaccinia virus
acugauucagaaa

SEQ ID NO: 3271033 - RNA, 18 nt, Vaccinia virus
uguuuacaguaguaauga

SEQ ID NO: 3271034 - RNA, 15 nt, Vaccinia virus
agacgaacaaaauca

SEQ ID NO: 3271035 - RNA, 19 nt, Vaccinia virus
guauggaauauaauaaucu

SEQ ID NO: 3271036 - RNA, 17 nt, Vaccinia virus
gugaauaugaucuucau

SEQ ID NO: 3271037 - RNA, 19 nt, Vaccinia virus
gaucuaauacaaaaucauc

SEQ ID NO: 3271038 - RNA, 17 nt, Vaccinia virus
uagauagaaacuuauac

SEQ ID NO: 3271039 - RNA, 18 nt, Vaccinia virus
caacaaguuggaugauau

SEQ ID NO: 3271040 - RNA, 16 nt, Vaccinia virus
aacaauuuugucagua

SEQ ID NO: 3271041 - RNA, 15 nt, Vaccinia virus
aauguucugucuugu

SEQ ID NO: 3271042 - RNA, 22 nt, Vaccinia virus
uacaauuuguggaauuaauauu

SEQ ID NO: 3271043 - RNA, 20 nt, Vaccinia virus
uuaguaucuagcucuguaaa

SEQ ID NO: 3271044 - RNA, 16 nt, Vaccinia virus
uuaaacgaauaaaaga

SEQ ID NO: 3271045 - RNA, 21 nt, Vaccinia virus
uaugagucaauugguagaguu

SEQ ID NO: 3271046 - RNA, 22 nt, Vaccinia virus
auccuuuauuaaaucaugaaug

SEQ ID NO: 3271047 - RNA, 13 nt, Vaccinia virus
auuaauuauucau

SEQ ID NO: 3271048 - RNA, 12 nt, Vaccinia virus
aucuaaaaaacu

SEQ ID NO: 3271049 - RNA, 13 nt, Vaccinia virus
uacaauauuuccg

SEQ ID NO: 3271050 - RNA, 18 nt, Vaccinia virus
gaauagugccaucagaau

SEQ ID NO: 3271051 - RNA, 13 nt, Vaccinia virus
uuacuaauggagu

SEQ ID NO: 3271052 - RNA, 20 nt, Vaccinia virus
cuguuuaucuauacuauuaa

SEQ ID NO: 3271053 - RNA, 11 nt, Vaccinia virus
agcauguagac

SEQ ID NO: 3271054 - RNA, 17 nt, Vaccinia virus
ucucauuaauuaaccau

SEQ ID NO: 3271055 - RNA, 22 nt, Vaccinia virus
auaccaguauaccucaaaaauu

SEQ ID NO: 3271056 - RNA, 19 nt, Vaccinia virus
gauaauuuuuuuauuacau

SEQ ID NO: 3271057 - RNA, 19 nt, Vaccinia virus
ccgaaagaacugauugcag

SEQ ID NO: 3271058 - RNA, 20 nt, Vaccinia virus
aagaguggaaacucacauau

SEQ ID NO: 3271059 - RNA, 18 nt, Vaccinia virus
auaaaaugacaaauacuc

SEQ ID NO: 3271060 - RNA, 23 nt, Vaccinia virus
aacaggaaacgcuguauauggaa

SEQ ID NO: 3271061 - RNA, 18 nt, Vaccinia virus
uaacgccgaucucugaau

SEQ ID NO: 3271062 - RNA, 23 nt, Vaccinia virus
caguuuuuaauuucuuugguaau

SEQ ID NO: 3271063 - RNA, 23 nt, Vaccinia virus
gaaugagaugcauaaaacuuuau

SEQ ID NO: 3271064 - RNA, 17 nt, Vaccinia virus
agagcuucguauacucu

SEQ ID NO: 3271065 - RNA, 20 nt, Vaccinia virus
aauauauacuucaauugaua

SEQ ID NO: 3271066 - RNA, 17 nt, Vaccinia virus
ccaaucuaagaaauuua

SEQ ID NO: 3271067 - RNA, 16 nt, Vaccinia virus
uauucccaaacauaca

SEQ ID NO: 3271068 - RNA, 14 nt, Vaccinia virus
ucuagauguagaag

SEQ ID NO: 3271069 - RNA, 21 nt, Vaccinia virus
caaguuguagacuuuuucaaa

SEQ ID NO: 3271070 - RNA, 13 nt, Vaccinia virus
ccaaaucugguaa

SEQ ID NO: 3271071 - RNA, 21 nt, Vaccinia virus
aaauuauucauucuagaacua

SEQ ID NO: 3271072 - RNA, 18 nt, Vaccinia virus
auguugcaugaaauaaua

SEQ ID NO: 3271073 - RNA, 17 nt, Vaccinia virus
uucuuauucuuauucuu

SEQ ID NO: 3271074 - RNA, 16 nt, Vaccinia virus
auuauuuuuacagcga

SEQ ID NO: 3271075 - RNA, 21 nt, Vaccinia virus
cuucgauagauauucuucaga

SEQ ID NO: 3271076 - RNA, 13 nt, Vaccinia virus
augucauuuguau

SEQ ID NO: 3271077 - RNA, 18 nt, Vaccinia virus
auggaccaaauuaucauc

SEQ ID NO: 3271078 - RNA, 14 nt, Vaccinia virus
auuaucaaauguug

SEQ ID NO: 3271079 - RNA, 17 nt, Vaccinia virus
uauuauccuugacuuga

SEQ ID NO: 3271080 - RNA, 19 nt, Vaccinia virus
acuucuccguucuuaauaa

SEQ ID NO: 3271081 - RNA, 22 nt, Vaccinia virus
agauguauuagacaaaacuauu

SEQ ID NO: 3271082 - RNA, 14 nt, Vaccinia virus
aaaaagaaugagua

SEQ ID NO: 3271083 - RNA, 18 nt, Vaccinia virus
uguauuauccaauacaga

SEQ ID NO: 3271084 - RNA, 16 nt, Vaccinia virus
aagucugucaaaucau

SEQ ID NO: 3271085 - RNA, 15 nt, Vaccinia virus
auccaaaauuuugua

SEQ ID NO: 3271086 - RNA, 20 nt, Vaccinia virus
ugaacuccgccguaguuucc

SEQ ID NO: 3271087 - RNA, 19 nt, Vaccinia virus
auaaaaaguauagguguau

SEQ ID NO: 3271088 - RNA, 22 nt, Vaccinia virus
acuggugaguuaauauucaugu

SEQ ID NO: 3271089 - RNA, 22 nt, Vaccinia virus
auauccguguuaaaaaaaauua

SEQ ID NO: 3271090 - RNA, 23 nt, Vaccinia virus
auauaauccgcauauuccauaua

SEQ ID NO: 3271091 - RNA, 17 nt, Vaccinia virus
uaaacaucuugauacuu

SEQ ID NO: 3271092 - RNA, 14 nt, Vaccinia virus
ugcgaucaauaaau

SEQ ID NO: 3271093 - RNA, 20 nt, Vaccinia virus
aauauaugcaaaauaauauc

SEQ ID NO: 3271094 - RNA, 15 nt, Vaccinia virus
cagaguguuucaaag

SEQ ID NO: 3271095 - RNA, 18 nt, Vaccinia virus
guaaaccgauuaaacguc

SEQ ID NO: 3271096 - RNA, 17 nt, Vaccinia virus
gauauauugauaauaau

SEQ ID NO: 3271097 - RNA, 21 nt, Vaccinia virus
cagaaauugguauaaauguug

SEQ ID NO: 3271098 - RNA, 17 nt, Vaccinia virus
guuaaacugugaauguc

SEQ ID NO: 3271099 - RNA, 22 nt, Vaccinia virus
cguaauaugcggucuaauuguc

SEQ ID NO: 3271100 - RNA, 15 nt, Vaccinia virus
auaauagcaacauau

SEQ ID NO: 3271101 - RNA, 13 nt, Vaccinia virus
cuauuaaacuguu

SEQ ID NO: 3271102 - RNA, 22 nt, Vaccinia virus
auuauacaccuuauaauaggug

SEQ ID NO: 3271103 - RNA, 18 nt, Vaccinia virus
uaaacucagauaauagca

SEQ ID NO: 3271104 - RNA, 16 nt, Vaccinia virus
gaugccgguacuuaug

SEQ ID NO: 3271105 - RNA, 21 nt, Vaccinia virus
uaguuuucucuauucugaaau

SEQ ID NO: 3271106 - RNA, 17 nt, Vaccinia virus
uuuuucaucuuuacaua

SEQ ID NO: 3271107 - RNA, 17 nt, Vaccinia virus
auuuuaguaauauggaa

SEQ ID NO: 3271108 - RNA, 18 nt, Vaccinia virus
caugaugagauguuuaua

SEQ ID NO: 3271109 - RNA, 21 nt, Vaccinia virus
aauccauaaauaaaguauaug

SEQ ID NO: 3271110 - RNA, 19 nt, Vaccinia virus
auaucuagacuuucuguua

SEQ ID NO: 3271111 - RNA, 18 nt, Vaccinia virus
uaaucuacgauauuauua

SEQ ID NO: 3271112 - RNA, 12 nt, Vaccinia virus
guaucuauuuua

SEQ ID NO: 3271113 - RNA, 12 nt, Vaccinia virus
uaauuacauguu

SEQ ID NO: 3271114 - RNA, 15 nt, Vaccinia virus
auaacaguuauauau

SEQ ID NO: 3271115 - RNA, 19 nt, Vaccinia virus
gacagaucuucguuaaaaa

SEQ ID NO: 3271116 - RNA, 17 nt, Vaccinia virus
guguuaucuuagauaua

SEQ ID NO: 3271117 - RNA, 19 nt, Vaccinia virus
acagaacuuaacaauaaau

SEQ ID NO: 3271118 - RNA, 15 nt, Vaccinia virus
aacuacgucaagacu

SEQ ID NO: 3271119 - RNA, 17 nt, Vaccinia virus
gguguaggaguacauac

SEQ ID NO: 3271120 - RNA, 21 nt, Vaccinia virus
cgauaaaauccuccuaucaau

SEQ ID NO: 3271121 - RNA, 18 nt, Vaccinia virus
uuugagagaucauuucua

SEQ ID NO: 3271122 - RNA, 19 nt, Vaccinia virus
aauuauuagaauaagagug

SEQ ID NO: 3271123 - RNA, 21 nt, Vaccinia virus
auucuggcuauuucaaaauaa

SEQ ID NO: 3271124 - RNA, 18 nt, Vaccinia virus
uagaaugaagauaucauu

SEQ ID NO: 3271125 - RNA, 13 nt, Vaccinia virus
uuaacaauuauca

SEQ ID NO: 3271126 - RNA, 20 nt, Vaccinia virus
aacuaucgauaguaaugcau

SEQ ID NO: 3271127 - RNA, 22 nt, Vaccinia virus
agaaaucccaccuuauuauauu

SEQ ID NO: 3271128 - RNA, 16 nt, Vaccinia virus
ucguuuaauacuacau

SEQ ID NO: 3271129 - RNA, 18 nt, Vaccinia virus
caauaucaguaucuucuu

SEQ ID NO: 3271130 - RNA, 17 nt, Vaccinia virus
auuacuaggagaauuau

SEQ ID NO: 3271131 - RNA, 17 nt, Vaccinia virus
augaggcguuuaucaua

SEQ ID NO: 3271132 - RNA, 12 nt, Vaccinia virus
aauauuagaaaa

SEQ ID NO: 3271133 - RNA, 12 nt, Vaccinia virus
aauuuuagaaau

SEQ ID NO: 3271134 - RNA, 12 nt, Vaccinia virus
aaagaucauauu

SEQ ID NO: 3271135 - RNA, 17 nt, Vaccinia virus
cgacucuacuaguucca

SEQ ID NO: 3271136 - RNA, 20 nt, Vaccinia virus
agccuuaagaaaacuagaua

SEQ ID NO: 3271137 - RNA, 19 nt, Vaccinia virus
auuuuuggauuacaagaaa

SEQ ID NO: 3271138 - RNA, 16 nt, Vaccinia virus
cuaaaauauacaaaca

SEQ ID NO: 3271139 - RNA, 22 nt, Vaccinia virus
uaagaaauccaaauaaaaugga

SEQ ID NO: 3271140 - RNA, 23 nt, Vaccinia virus
aacaaggcgauuauaaaguggaa

SEQ ID NO: 3271141 - RNA, 21 nt, Vaccinia virus
caauccguaacggaaauuaca

SEQ ID NO: 3271142 - RNA, 15 nt, Vaccinia virus
gaugauacuucacuc

SEQ ID NO: 3271143 - RNA, 16 nt, Vaccinia virus
caagaauauauguuua

SEQ ID NO: 3271144 - RNA, 13 nt, Vaccinia virus
acacguguagaau

SEQ ID NO: 3271145 - RNA, 20 nt, Vaccinia virus
cuaaagccgguguaacauuc

SEQ ID NO: 3271146 - RNA, 12 nt, Vaccinia virus
ugagacauaucc

SEQ ID NO: 3271147 - RNA, 21 nt, Vaccinia virus
ugauucaucaacauuugcugu

SEQ ID NO: 3271148 - RNA, 17 nt, Vaccinia virus
uuaaaacagaugauuca

SEQ ID NO: 3271149 - RNA, 16 nt, Vaccinia virus
accgugaccaauaagu

SEQ ID NO: 3271150 - RNA, 22 nt, Vaccinia virus
caagaaagugaaaaguucacau

SEQ ID NO: 3271151 - RNA, 12 nt, Vaccinia virus
cacauuaaacaa

SEQ ID NO: 3271152 - RNA, 22 nt, Vaccinia virus
ccuuauagaggauguuaaacaa

SEQ ID NO: 3271153 - RNA, 17 nt, Vaccinia virus
aauaaacaauuucacaa

SEQ ID NO: 3271154 - RNA, 15 nt, Vaccinia virus
gccgauaaacaaauc

SEQ ID NO: 3271155 - RNA, 15 nt, Vaccinia virus
agauauacuacuucu

SEQ ID NO: 3271156 - RNA, 12 nt, Vaccinia virus
uauuccaaucau

SEQ ID NO: 3271157 - RNA, 16 nt, Vaccinia virus
aguauaccaacuauau

SEQ ID NO: 3271158 - RNA, 17 nt, Vaccinia virus
aguauagaucaaaagaa

SEQ ID NO: 3271159 - RNA, 21 nt, Vaccinia virus
uuguacgaauccaauuuuuca

SEQ ID NO: 3271160 - RNA, 21 nt, Vaccinia virus
aucuauaaaacgauuaaacaa

SEQ ID NO: 3271161 - RNA, 15 nt, Vaccinia virus
uagauauagaacaau

SEQ ID NO: 3271162 - RNA, 20 nt, Vaccinia virus
uauuaauacaugucuuagau

SEQ ID NO: 3271163 - RNA, 21 nt, Vaccinia virus
uauuaacgguaauacauuuau

SEQ ID NO: 3271164 - RNA, 21 nt, Vaccinia virus
ucauuaucgguguauuuucca

SEQ ID NO: 3271165 - RNA, 14 nt, Vaccinia virus
aacauggaaguuau

SEQ ID NO: 3271166 - RNA, 17 nt, Vaccinia virus
auucauucaaugucucu

SEQ ID NO: 3271167 - RNA, 23 nt, Vaccinia virus
agucauuugacuagauaaacuau

SEQ ID NO: 3271168 - RNA, 14 nt, Vaccinia virus
uaugcgcaauauca

SEQ ID NO: 3271169 - RNA, 13 nt, Vaccinia virus
uauauagauguca

SEQ ID NO: 3271170 - RNA, 16 nt, Vaccinia virus
aggggaugaaucauug

SEQ ID NO: 3271171 - RNA, 14 nt, Vaccinia virus
uuggcuacauuuaa

SEQ ID NO: 3271172 - RNA, 19 nt, Vaccinia virus
aguuuccgccauuuaucca

SEQ ID NO: 3271173 - RNA, 14 nt, Vaccinia virus
acaaucguuaauaa

SEQ ID NO: 3271174 - RNA, 19 nt, Vaccinia virus
uuauucuguucuauucaaa

SEQ ID NO: 3271175 - RNA, 16 nt, Vaccinia virus
caacugucuauacaag

SEQ ID NO: 3271176 - RNA, 16 nt, Vaccinia virus
aucauguguaaaaagu

SEQ ID NO: 3271177 - RNA, 21 nt, Vaccinia virus
ucauauacguucgucaccaga

SEQ ID NO: 3271178 - RNA, 14 nt, Vaccinia virus
uuguaacuaguuuu

SEQ ID NO: 3271179 - RNA, 20 nt, Vaccinia virus
auuaucaaaauuuggaaacu

SEQ ID NO: 3271180 - RNA, 22 nt, Vaccinia virus
aauauaucaaucaaaacagaau

SEQ ID NO: 3271181 - RNA, 21 nt, Vaccinia virus
ucuaauugucggaauuauuuu

SEQ ID NO: 3271182 - RNA, 23 nt, Vaccinia virus
cauauuuucugguaguguuucua

SEQ ID NO: 3271183 - RNA, 17 nt, Vaccinia virus
uacaauaauuacaagua

SEQ ID NO: 3271184 - RNA, 15 nt, Vaccinia virus
uagauuuuguugaga

SEQ ID NO: 3271185 - RNA, 21 nt, Vaccinia virus
uucuccaccaaacauauucuu

SEQ ID NO: 3271186 - RNA, 19 nt, Vaccinia virus
uaaaacauaaucaaggaua

SEQ ID NO: 3271187 - RNA, 22 nt, Vaccinia virus
aguagauacauggcuaucgcaa

SEQ ID NO: 3271188 - RNA, 20 nt, Vaccinia virus
ugguaauuaaauauaucaug

SEQ ID NO: 3271189 - RNA, 23 nt, Vaccinia virus
gaacaagagauauauuggagcac

SEQ ID NO: 3271190 - RNA, 15 nt, Vaccinia virus
auaacauuguuuaug

SEQ ID NO: 3271191 - RNA, 19 nt, Vaccinia virus
acacauucuuuagaacuuc

SEQ ID NO: 3271192 - RNA, 17 nt, Vaccinia virus
uaaaaguaucaaaucuu

SEQ ID NO: 3271193 - RNA, 22 nt, Vaccinia virus
aucugauaaauauacaauagau

SEQ ID NO: 3271194 - RNA, 17 nt, Vaccinia virus
cgaagaagagaaagaca

SEQ ID NO: 3271195 - RNA, 23 nt, Vaccinia virus
uauagaggaauaucaucaaacaa

SEQ ID NO: 3271196 - RNA, 22 nt, Vaccinia virus
cggacuuauauagcuuauucca

SEQ ID NO: 3271197 - RNA, 21 nt, Vaccinia virus
uacauuggcuacggcagauau

SEQ ID NO: 3271198 - RNA, 13 nt, Vaccinia virus
gaauauaaaucau

SEQ ID NO: 3271199 - RNA, 12 nt, Vaccinia virus
cgauauacuuau

SEQ ID NO: 3271200 - RNA, 16 nt, Vaccinia virus
guuccauaauaguuua

SEQ ID NO: 3271201 - RNA, 13 nt, Vaccinia virus
ugucuauaucuuc

SEQ ID NO: 3271202 - RNA, 12 nt, Vaccinia virus
acaaguuuucau

SEQ ID NO: 3271203 - RNA, 22 nt, Vaccinia virus
ucuaucaaaaguuaauuucuau

SEQ ID NO: 3271204 - RNA, 13 nt, Vaccinia virus
cuaguuguuuaug

SEQ ID NO: 3271205 - RNA, 17 nt, Vaccinia virus
ugauggguguacaauca

SEQ ID NO: 3271206 - RNA, 22 nt, Vaccinia virus
aaagaguauggugaaugacucu

SEQ ID NO: 3271207 - RNA, 20 nt, Vaccinia virus
auaucggacgcagaaauugg

SEQ ID NO: 3271208 - RNA, 18 nt, Vaccinia virus
aauauccacucugucaua

SEQ ID NO: 3271209 - RNA, 16 nt, Vaccinia virus
uguuugguauacuguu

SEQ ID NO: 3271210 - RNA, 23 nt, Vaccinia virus
auuauagacuugauccauuuccu

SEQ ID NO: 3271211 - RNA, 22 nt, Vaccinia virus
gaagaugauuuugcuagagaua

SEQ ID NO: 3271212 - RNA, 18 nt, Vaccinia virus
aauguagaaauuagaaag

SEQ ID NO: 3271213 - RNA, 20 nt, Vaccinia virus
acaguuaacgaaagcaaaga

SEQ ID NO: 3271214 - RNA, 18 nt, Vaccinia virus
ugaauauagaacaucauu

SEQ ID NO: 3271215 - RNA, 17 nt, Vaccinia virus
uugguacagucuaguau

SEQ ID NO: 3271216 - RNA, 14 nt, Vaccinia virus
agagagugcacuau

SEQ ID NO: 3271217 - RNA, 15 nt, Vaccinia virus
auuccgccauuuaag

SEQ ID NO: 3271218 - RNA, 15 nt, Vaccinia virus
uugacaaauuauucu

SEQ ID NO: 3271219 - RNA, 15 nt, Vaccinia virus
uagaucaaauacuug

SEQ ID NO: 3271220 - RNA, 19 nt, Vaccinia virus
cucauaauguaaagauauu

SEQ ID NO: 3271221 - RNA, 21 nt, Vaccinia virus
auaaaaacgagaaugacauaa

SEQ ID NO: 3271222 - RNA, 19 nt, Vaccinia virus
cuuuauuauuauugacuuc

SEQ ID NO: 3271223 - RNA, 19 nt, Vaccinia virus
augcauguuagauaacgga

SEQ ID NO: 3271224 - RNA, 18 nt, Vaccinia virus
ugaguuacgaagauauca

SEQ ID NO: 3271225 - RNA, 18 nt, Vaccinia virus
cacauacauuuuuaacag

SEQ ID NO: 3271226 - RNA, 18 nt, Vaccinia virus
ucuuauauagauuucgaa

SEQ ID NO: 3271227 - RNA, 15 nt, Vaccinia virus
aucuaaauuaaauau

SEQ ID NO: 3271228 - RNA, 24 nt, Vaccinia virus
uaagagauuuagaaaacauuauau

SEQ ID NO: 3271229 - RNA, 19 nt, Vaccinia virus
auuguugccguaaauccug

SEQ ID NO: 3271230 - RNA, 23 nt, Vaccinia virus
uauucucuauuuugguggaggau

SEQ ID NO: 3271231 - RNA, 20 nt, Vaccinia virus
ccuucacaucucgcaauaau

SEQ ID NO: 3271232 - RNA, 17 nt, Vaccinia virus
ucauacuagaauaaagc

SEQ ID NO: 3271233 - RNA, 16 nt, Vaccinia virus
caucuacuuuaucuau

SEQ ID NO: 3271234 - RNA, 14 nt, Vaccinia virus
aagacauaaaacuc

SEQ ID NO: 3271235 - RNA, 18 nt, Vaccinia virus
cuaucaugucuauucucc

SEQ ID NO: 3271236 - RNA, 17 nt, Vaccinia virus
uuauauacacauaauua

SEQ ID NO: 3271237 - RNA, 13 nt, Vaccinia virus
auacuuuaacauc

SEQ ID NO: 3271238 - RNA, 14 nt, Vaccinia virus
uggugaaauuauug

SEQ ID NO: 3271239 - RNA, 19 nt, Vaccinia virus
aauaauaaacggaagagau

SEQ ID NO: 3271240 - RNA, 23 nt, Vaccinia virus
gugaugccaauaagcuuuagaua

SEQ ID NO: 3271241 - RNA, 17 nt, Vaccinia virus
gacauuuucacaaauac

SEQ ID NO: 3271242 - RNA, 19 nt, Vaccinia virus
cucuagaauauuuaauuug

SEQ ID NO: 3271243 - RNA, 19 nt, Vaccinia virus
auacgaauguaucaaacag

SEQ ID NO: 3271244 - RNA, 15 nt, Vaccinia virus
agacuuugaaauaua

SEQ ID NO: 3271245 - RNA, 16 nt, Vaccinia virus
auguuaaauguagaca

SEQ ID NO: 3271246 - RNA, 21 nt, Vaccinia virus
auauaagacacagaaauacua

SEQ ID NO: 3271247 - RNA, 20 nt, Vaccinia virus
uuaaacgauuugaugaguua

SEQ ID NO: 3271248 - RNA, 19 nt, Vaccinia virus
acccaaagagaccaaugaa

SEQ ID NO: 3271249 - RNA, 20 nt, Vaccinia virus
caacaucacgcucgauaauc

SEQ ID NO: 3271250 - RNA, 19 nt, Vaccinia virus
aacaaguuuggauuaucgu

SEQ ID NO: 3271251 - RNA, 17 nt, Vaccinia virus
auguagugacgauguau

SEQ ID NO: 3271252 - RNA, 12 nt, Vaccinia virus
guaacauaaaaa

SEQ ID NO: 3271253 - RNA, 15 nt, Vaccinia virus
cacuuggauauugua

SEQ ID NO: 3271254 - RNA, 15 nt, Vaccinia virus
uucauuacacaucuu

SEQ ID NO: 3271255 - RNA, 18 nt, Vaccinia virus
uucucguauacucugccc

SEQ ID NO: 3271256 - RNA, 15 nt, Vaccinia virus
aucauuuaaacauuu

SEQ ID NO: 3271257 - RNA, 17 nt, Vaccinia virus
aggagucgccaaaugua

SEQ ID NO: 3271258 - RNA, 18 nt, Vaccinia virus
aacuagaaucagaaucua

SEQ ID NO: 3271259 - RNA, 16 nt, Vaccinia virus
uugaacuccucuagau

SEQ ID NO: 3271260 - RNA, 19 nt, Vaccinia virus
aguauugacaauacuguau

SEQ ID NO: 3271261 - RNA, 20 nt, Vaccinia virus
uaucguauuggauucugaaa

SEQ ID NO: 3271262 - RNA, 15 nt, Vaccinia virus
auucauccuuaaaug

SEQ ID NO: 3271263 - RNA, 17 nt, Vaccinia virus
cggaaaugguagaugua

SEQ ID NO: 3271264 - RNA, 21 nt, Vaccinia virus
aucacgaguuuguaaagcuau

SEQ ID NO: 3271265 - RNA, 23 nt, Vaccinia virus
aaucgucuauaauaaugaauauu

SEQ ID NO: 3271266 - RNA, 13 nt, Vaccinia virus
guggacauuuaac

SEQ ID NO: 3271267 - RNA, 13 nt, Vaccinia virus
caaguauaaugac

SEQ ID NO: 3271268 - RNA, 13 nt, Vaccinia virus
uugaaugucauga

SEQ ID NO: 3271269 - RNA, 18 nt, Vaccinia virus
aauagaugauagaauauc

SEQ ID NO: 3271270 - RNA, 20 nt, Vaccinia virus
uguaaauuuuaucaugugua

SEQ ID NO: 3271271 - RNA, 21 nt, Vaccinia virus
ugaagaugugacguacaaaaa

SEQ ID NO: 3271272 - RNA, 23 nt, Vaccinia virus
uuuucaguuccccuacguaucua

SEQ ID NO: 3271273 - RNA, 17 nt, Vaccinia virus
accaaagacuuugaaau

SEQ ID NO: 3271274 - RNA, 17 nt, Vaccinia virus
ugguuaacaauauggaa

SEQ ID NO: 3271275 - RNA, 17 nt, Vaccinia virus
agucuccagaaaucugu

SEQ ID NO: 3271276 - RNA, 17 nt, Vaccinia virus
gucaaacgaauaaacaa

SEQ ID NO: 3271277 - RNA, 17 nt, Vaccinia virus
acuauugacuuaauagg

SEQ ID NO: 3271278 - RNA, 20 nt, Vaccinia virus
gggauuguccggcauaucau

SEQ ID NO: 3271279 - RNA, 16 nt, Vaccinia virus
ugauaacuucaggaaa

SEQ ID NO: 3271280 - RNA, 13 nt, Vaccinia virus
uaacuauauucca

SEQ ID NO: 3271281 - RNA, 15 nt, Vaccinia virus
gaucucgagaaauaa

SEQ ID NO: 3271282 - RNA, 22 nt, Vaccinia virus
agucuaucgccuuagauacuuu

SEQ ID NO: 3271283 - RNA, 21 nt, Vaccinia virus
acaauguuugucauauguauu

SEQ ID NO: 3271284 - RNA, 19 nt, Vaccinia virus
agaauugacgaaacaaugu

SEQ ID NO: 3271285 - RNA, 20 nt, Vaccinia virus
uuauaguguuuaacaaagau

SEQ ID NO: 3271286 - RNA, 21 nt, Vaccinia virus
auuuuaccaacucuuuaauaa

SEQ ID NO: 3271287 - RNA, 12 nt, Vaccinia virus
uauauagauguc

SEQ ID NO: 3271288 - RNA, 22 nt, Vaccinia virus
ucuauagaaacauauucuauga

SEQ ID NO: 3271289 - RNA, 19 nt, Vaccinia virus
acuagcucgagaaugaaua

SEQ ID NO: 3271290 - RNA, 21 nt, Vaccinia virus
uagcgaagaagagaaagacag

SEQ ID NO: 3271291 - RNA, 15 nt, Vaccinia virus
cucuauaaaaaugaa

SEQ ID NO: 3271292 - RNA, 14 nt, Vaccinia virus
auauacuuuucuaa

SEQ ID NO: 3271293 - RNA, 15 nt, Vaccinia virus
ugaggaaugagagug

SEQ ID NO: 3271294 - RNA, 16 nt, Vaccinia virus
gcacauguauaauaua

SEQ ID NO: 3271295 - RNA, 22 nt, Vaccinia virus
aaucaguuacaaaacguuuaua

SEQ ID NO: 3271296 - RNA, 14 nt, Vaccinia virus
auacgauaaacauu

SEQ ID NO: 3271297 - RNA, 16 nt, Vaccinia virus
aaagagaauuauauau

SEQ ID NO: 3271298 - RNA, 23 nt, Vaccinia virus
gcuauagcauuguuauguauuuc

SEQ ID NO: 3271299 - RNA, 18 nt, Vaccinia virus
uaacagauaaaaagacuu

SEQ ID NO: 3271300 - RNA, 14 nt, Vaccinia virus
aaaaaugaugaauu

SEQ ID NO: 3271301 - RNA, 15 nt, Vaccinia virus
gacuccuuucuaaua

SEQ ID NO: 3271302 - RNA, 17 nt, Vaccinia virus
cgauaacauucuaaaga

SEQ ID NO: 3271303 - RNA, 18 nt, Vaccinia virus
auaaugacaauaaaauua

SEQ ID NO: 3271304 - RNA, 21 nt, Vaccinia virus
cugcggacgcggaugcucagu

SEQ ID NO: 3271305 - RNA, 15 nt, Vaccinia virus
auucaugaaaaugua

SEQ ID NO: 3271306 - RNA, 13 nt, Vaccinia virus
uuaauauuucuau

SEQ ID NO: 3271307 - RNA, 15 nt, Vaccinia virus
auauuuacaguuacu

SEQ ID NO: 3271308 - RNA, 14 nt, Vaccinia virus
uaacuauauucuua

SEQ ID NO: 3271309 - RNA, 11 nt, Vaccinia virus
gaagaaauuga

SEQ ID NO: 3271310 - RNA, 13 nt, Vaccinia virus
auaugaugaaugg

SEQ ID NO: 3271311 - RNA, 13 nt, Vaccinia virus
acagauggauaaa

SEQ ID NO: 3271312 - RNA, 16 nt, Vaccinia virus
uccaacaauagcuuua

SEQ ID NO: 3271313 - RNA, 21 nt, Vaccinia virus
uauguuuauuagcguacacau

SEQ ID NO: 3271314 - RNA, 15 nt, Vaccinia virus
aauccacauaugaua

SEQ ID NO: 3271315 - RNA, 21 nt, Vaccinia virus
gaaagauucuauaauaaugaa

SEQ ID NO: 3271316 - RNA, 19 nt, Vaccinia virus
agaucuaauuuuucauuga

SEQ ID NO: 3271317 - RNA, 16 nt, Vaccinia virus
agaaaaauauaaugua

SEQ ID NO: 3271318 - RNA, 23 nt, Vaccinia virus
uaagagagauuagaguuuguaca

SEQ ID NO: 3271319 - RNA, 18 nt, Vaccinia virus
acucgaacagauaguuua

SEQ ID NO: 3271320 - RNA, 12 nt, Vaccinia virus
agacagauuaug

SEQ ID NO: 3271321 - RNA, 22 nt, Vaccinia virus
cugucuugaguuccauuacaaa

SEQ ID NO: 3271322 - RNA, 20 nt, Vaccinia virus
cauccuguggguuucucaua

SEQ ID NO: 3271323 - RNA, 17 nt, Vaccinia virus
aacgugaguauuuuacu

SEQ ID NO: 3271324 - RNA, 19 nt, Vaccinia virus
cuaauacaucucuggaaau

SEQ ID NO: 3271325 - RNA, 22 nt, Vaccinia virus
aaaagauucgguuuuauacugu

SEQ ID NO: 3271326 - RNA, 21 nt, Vaccinia virus
cgaaauaguuaauaauucugu

SEQ ID NO: 3271327 - RNA, 18 nt, Vaccinia virus
gcuccuacaggaauaucu

SEQ ID NO: 3271328 - RNA, 17 nt, Vaccinia virus
ccuauaaacaugaauuu

SEQ ID NO: 3271329 - RNA, 22 nt, Vaccinia virus
gaccacacggagaacagaugac

SEQ ID NO: 3271330 - RNA, 13 nt, Vaccinia virus
ucagauauuugcg

SEQ ID NO: 3271331 - RNA, 23 nt, Vaccinia virus
caauauucuauuacugcagaggg

SEQ ID NO: 3271332 - RNA, 18 nt, Vaccinia virus
agcacauguauaauauaa

SEQ ID NO: 3271333 - RNA, 19 nt, Vaccinia virus
cucaaaugggaaacaaucu

SEQ ID NO: 3271334 - RNA, 19 nt, Vaccinia virus
aaucuauccgcgacaaauu

SEQ ID NO: 3271335 - RNA, 17 nt, Vaccinia virus
agcuugauaauuagaua

SEQ ID NO: 3271336 - RNA, 13 nt, Vaccinia virus
uagucaaggaugu

SEQ ID NO: 3271337 - RNA, 13 nt, Vaccinia virus
aaauaaaguauau

SEQ ID NO: 3271338 - RNA, 17 nt, Vaccinia virus
gcacuacgcaauaugau

SEQ ID NO: 3271339 - RNA, 20 nt, Vaccinia virus
cagauccucccguuaaaacc

SEQ ID NO: 3271340 - RNA, 16 nt, Vaccinia virus
uaauugaacaaaguau

SEQ ID NO: 3271341 - RNA, 16 nt, Vaccinia virus
auaauaggauaagacu

SEQ ID NO: 3271342 - RNA, 22 nt, Vaccinia virus
cuuauauaccgccucaaacucu

SEQ ID NO: 3271343 - RNA, 19 nt, Vaccinia virus
aaagcggggucgaucuugu

SEQ ID NO: 3271344 - RNA, 13 nt, Vaccinia virus
guuuaauauccuc

SEQ ID NO: 3271345 - RNA, 20 nt, Vaccinia virus
uauguauuccuuuacgugau

SEQ ID NO: 3271346 - RNA, 13 nt, Vaccinia virus
aguuaauuuauca

SEQ ID NO: 3271347 - RNA, 20 nt, Vaccinia virus
uucaaugucucuuuuucaga

SEQ ID NO: 3271348 - RNA, 17 nt, Vaccinia virus
uuauuacuaaacauuuu

SEQ ID NO: 3271349 - RNA, 23 nt, Vaccinia virus
guaguuuaucgguuuuaaaucaa

SEQ ID NO: 3271350 - RNA, 14 nt, Vaccinia virus
agaaguuuuauccu

SEQ ID NO: 3271351 - RNA, 21 nt, Vaccinia virus
caaugauauauuuuccaugaa

SEQ ID NO: 3271352 - RNA, 18 nt, Vaccinia virus
uguuuaagaagagaauua

SEQ ID NO: 3271353 - RNA, 22 nt, Vaccinia virus
auaauacucggccgacauaaug

SEQ ID NO: 3271354 - RNA, 16 nt, Vaccinia virus
cuuaccuucaacagua

SEQ ID NO: 3271355 - RNA, 18 nt, Vaccinia virus
uaaauuuacgaauuaaga

SEQ ID NO: 3271356 - RNA, 20 nt, Vaccinia virus
ucaggaauccaaagagcuau

SEQ ID NO: 3271357 - RNA, 19 nt, Vaccinia virus
cuuugugaugucuaguuuc

SEQ ID NO: 3271358 - RNA, 11 nt, Vaccinia virus
uuaauuauuca

SEQ ID NO: 3271359 - RNA, 15 nt, Vaccinia virus
gccucaguugucaac

SEQ ID NO: 3271360 - RNA, 18 nt, Vaccinia virus
agaaauaaacgaguaugu

SEQ ID NO: 3271361 - RNA, 15 nt, Vaccinia virus
uaauuuuauugagau

SEQ ID NO: 3271362 - RNA, 15 nt, Vaccinia virus
ugcuuacuagauguu

SEQ ID NO: 3271363 - RNA, 18 nt, Vaccinia virus
uaucucauucaaauccau

SEQ ID NO: 3271364 - RNA, 18 nt, Vaccinia virus
ugaucggauaguauucaa

SEQ ID NO: 3271365 - RNA, 16 nt, Vaccinia virus
auauuacuuauaauaa

SEQ ID NO: 3271366 - RNA, 20 nt, Vaccinia virus
ccuuuuccuuaucuucauag

SEQ ID NO: 3271367 - RNA, 22 nt, Vaccinia virus
uagguuguuuauugauauacua

SEQ ID NO: 3271368 - RNA, 18 nt, Vaccinia virus
agcugugguguaaucuua

SEQ ID NO: 3271369 - RNA, 19 nt, Vaccinia virus
gcauaauccuuguaaugau

SEQ ID NO: 3271370 - RNA, 19 nt, Vaccinia virus
auguauuuuaauaaaucau

SEQ ID NO: 3271371 - RNA, 17 nt, Vaccinia virus
auuguagaaucagcauc

SEQ ID NO: 3271372 - RNA, 12 nt, Vaccinia virus
uucauuaauuuu

SEQ ID NO: 3271373 - RNA, 13 nt, Vaccinia virus
cagcauguauguu

SEQ ID NO: 3271374 - RNA, 16 nt, Vaccinia virus
agaaucuaaugaugac

SEQ ID NO: 3271375 - RNA, 12 nt, Vaccinia virus
aacaauauuaag

SEQ ID NO: 3271376 - RNA, 13 nt, Vaccinia virus
cagaauguuacag

SEQ ID NO: 3271377 - RNA, 16 nt, Vaccinia virus
aauucuauuagaucau

SEQ ID NO: 3271378 - RNA, 21 nt, Vaccinia virus
ccaauauaguaguuaaauuau

SEQ ID NO: 3271379 - RNA, 11 nt, Vaccinia virus
cuuucucucuu

SEQ ID NO: 3271380 - RNA, 17 nt, Vaccinia virus
ccuagauacuguauaua

SEQ ID NO: 3271381 - RNA, 22 nt, Vaccinia virus
gaugucauauaggaaacuauaa

SEQ ID NO: 3271382 - RNA, 21 nt, Vaccinia virus
uuaacaauugucuguaaacca

SEQ ID NO: 3271383 - RNA, 16 nt, Vaccinia virus
auuguuuuaacuauaa

SEQ ID NO: 3271384 - RNA, 22 nt, Vaccinia virus
uuaucacaaugaaauauuuugg

SEQ ID NO: 3271385 - RNA, 19 nt, Vaccinia virus
aagacaugauaauauuaaa

SEQ ID NO: 3271386 - RNA, 16 nt, Vaccinia virus
aauuauuauuaaauau

SEQ ID NO: 3271387 - RNA, 14 nt, Vaccinia virus
uauuuaaaugacuu

SEQ ID NO: 3271388 - RNA, 18 nt, Vaccinia virus
gaauauagaaauaaugau

SEQ ID NO: 3271389 - RNA, 22 nt, Vaccinia virus
uaucggacacaagaucuguaaa

SEQ ID NO: 3271390 - RNA, 14 nt, Vaccinia virus
uuagugaaaucuuu

SEQ ID NO: 3271391 - RNA, 16 nt, Vaccinia virus
ugccaaguacauaaau

SEQ ID NO: 3271392 - RNA, 14 nt, Vaccinia virus
uucaucuuggauga

SEQ ID NO: 3271393 - RNA, 18 nt, Vaccinia virus
aauauccagaguguuuca

SEQ ID NO: 3271394 - RNA, 14 nt, Vaccinia virus
uguuuuuuaucaua

SEQ ID NO: 3271395 - RNA, 21 nt, Vaccinia virus
uaugucguccgguaguauaau

SEQ ID NO: 3271396 - RNA, 15 nt, Vaccinia virus
uuccguaucuguauu

SEQ ID NO: 3271397 - RNA, 18 nt, Vaccinia virus
aaugcuucagaauuagaa

SEQ ID NO: 3271398 - RNA, 23 nt, Vaccinia virus
cggauauucuaacgaaaacugua

SEQ ID NO: 3271399 - RNA, 14 nt, Vaccinia virus
guaauacaugcaaa

SEQ ID NO: 3271400 - RNA, 15 nt, Vaccinia virus
agaauaaguuucaua

SEQ ID NO: 3271401 - RNA, 15 nt, Vaccinia virus
gaauuacucaugcau

SEQ ID NO: 3271402 - RNA, 14 nt, Vaccinia virus
acuaaauuaacaau

SEQ ID NO: 3271403 - RNA, 14 nt, Vaccinia virus
gcuauuuugacaua

SEQ ID NO: 3271404 - RNA, 20 nt, Vaccinia virus
auacauccguagaaauauga

SEQ ID NO: 3271405 - RNA, 16 nt, Vaccinia virus
cauuuuauuguggaau

SEQ ID NO: 3271406 - RNA, 15 nt, Vaccinia virus
gucaaucuuauucaa

SEQ ID NO: 3271407 - RNA, 15 nt, Vaccinia virus
agaauucagauguug

SEQ ID NO: 3271408 - RNA, 15 nt, Vaccinia virus
auaucuauauuucca

SEQ ID NO: 3271409 - RNA, 23 nt, Vaccinia virus
gucauauagucgagcaagagaau

SEQ ID NO: 3271410 - RNA, 17 nt, Vaccinia virus
auucgaaaacucuaaga

SEQ ID NO: 3271411 - RNA, 12 nt, Vaccinia virus
auacauauuuua

SEQ ID NO: 3271412 - RNA, 22 nt, Vaccinia virus
uauucuuaauucuuuaacaaaa

SEQ ID NO: 3271413 - RNA, 23 nt, Vaccinia virus
uccauuagccuuuccacuucugc

SEQ ID NO: 3271414 - RNA, 17 nt, Vaccinia virus
cgacucauaagaaagag

SEQ ID NO: 3271415 - RNA, 22 nt, Vaccinia virus
acaaacuguucucuuaugaauc

SEQ ID NO: 3271416 - RNA, 16 nt, Vaccinia virus
aauggauaauuuccau

SEQ ID NO: 3271417 - RNA, 17 nt, Vaccinia virus
augcaucgguaaauaua

SEQ ID NO: 3271418 - RNA, 14 nt, Vaccinia virus
acuacaauauuuca

SEQ ID NO: 3271419 - RNA, 19 nt, Vaccinia virus
uagcaacaguaguucuugc

SEQ ID NO: 3271420 - RNA, 15 nt, Vaccinia virus
cuauggccaaauguu

SEQ ID NO: 3271421 - RNA, 20 nt, Vaccinia virus
acauuauuaaauuaugaagu

SEQ ID NO: 3271422 - RNA, 22 nt, Vaccinia virus
ucuaaaugaugauauaccuguu

SEQ ID NO: 3271423 - RNA, 20 nt, Vaccinia virus
cuuccuaggauagcuuuagu

SEQ ID NO: 3271424 - RNA, 23 nt, Vaccinia virus
auaacaagagauuuauuguguau

SEQ ID NO: 3271425 - RNA, 22 nt, Vaccinia virus
uagaaucucuauuugccaauau

SEQ ID NO: 3271426 - RNA, 19 nt, Vaccinia virus
auaucuggaaagaaaucua

SEQ ID NO: 3271427 - RNA, 16 nt, Vaccinia virus
gacgaguguaaacacu

SEQ ID NO: 3271428 - RNA, 21 nt, Vaccinia virus
aggaaauaccauaaauauauu

SEQ ID NO: 3271429 - RNA, 12 nt, Vaccinia virus
aauaaaaacaag

SEQ ID NO: 3271430 - RNA, 14 nt, Vaccinia virus
uacuaauagaugua

SEQ ID NO: 3271431 - RNA, 17 nt, Vaccinia virus
aucuuuucacuaaauaa

SEQ ID NO: 3271432 - RNA, 18 nt, Vaccinia virus
uacgauuuucuucuuuga

SEQ ID NO: 3271433 - RNA, 18 nt, Vaccinia virus
aguaagacuugacuagau

SEQ ID NO: 3271434 - RNA, 20 nt, Vaccinia virus
ucaugauugccggucauaaa

SEQ ID NO: 3271435 - RNA, 20 nt, Vaccinia virus
gagcaaucagaaaugaugcu

SEQ ID NO: 3271436 - RNA, 19 nt, Vaccinia virus
aauuauucguuuacugaau

SEQ ID NO: 3271437 - RNA, 13 nt, Vaccinia virus
aucagauuaaaau

SEQ ID NO: 3271438 - RNA, 18 nt, Vaccinia virus
cuuaaccauauauccaau

SEQ ID NO: 3271439 - RNA, 16 nt, Vaccinia virus
guuaguucucuuuuca

SEQ ID NO: 3271440 - RNA, 13 nt, Vaccinia virus
auuguaaaugaua

SEQ ID NO: 3271441 - RNA, 17 nt, Vaccinia virus
uaaauuuaucaauaaau

SEQ ID NO: 3271442 - RNA, 17 nt, Vaccinia virus
aaucauuuuugcaucau

SEQ ID NO: 3271443 - RNA, 20 nt, Vaccinia virus
uggaaagauaucagauaagu

SEQ ID NO: 3271444 - RNA, 19 nt, Vaccinia virus
gacagaagaauaugaugau

SEQ ID NO: 3271445 - RNA, 15 nt, Vaccinia virus
accuauuuacuggug

SEQ ID NO: 3271446 - RNA, 22 nt, Vaccinia virus
auauaaauccguuaaaauaauu

SEQ ID NO: 3271447 - RNA, 16 nt, Vaccinia virus
auuucugguuagauaa

SEQ ID NO: 3271448 - RNA, 20 nt, Vaccinia virus
ucauaucacauaguguuuua

SEQ ID NO: 3271449 - RNA, 19 nt, Vaccinia virus
ggaaaaaguguugaagaua

SEQ ID NO: 3271450 - RNA, 19 nt, Vaccinia virus
agaauauuccucuaacaga

SEQ ID NO: 3271451 - RNA, 17 nt, Vaccinia virus
uaaaguacguaaaucua

SEQ ID NO: 3271452 - RNA, 23 nt, Vaccinia virus
aaauuuuguugauuacucuuuuu

SEQ ID NO: 3271453 - RNA, 16 nt, Vaccinia virus
uuacccuugucauuau

SEQ ID NO: 3271454 - RNA, 13 nt, Vaccinia virus
gaugaguauauau

SEQ ID NO: 3271455 - RNA, 14 nt, Vaccinia virus
auauaucaaacaug

SEQ ID NO: 3271456 - RNA, 18 nt, Vaccinia virus
ucaaucaaggaacuaaau

SEQ ID NO: 3271457 - RNA, 17 nt, Vaccinia virus
uaucuuccgucaaggau

SEQ ID NO: 3271458 - RNA, 18 nt, Vaccinia virus
agaguguucgaaugccaa

SEQ ID NO: 3271459 - RNA, 18 nt, Vaccinia virus
agugauagagguaaacuu

SEQ ID NO: 3271460 - RNA, 21 nt, Vaccinia virus
gauauuuuaguuuuggcagau

SEQ ID NO: 3271461 - RNA, 13 nt, Vaccinia virus
auaucgaugugga

SEQ ID NO: 3271462 - RNA, 15 nt, Vaccinia virus
uauauccuuuuguau

SEQ ID NO: 3271463 - RNA, 19 nt, Vaccinia virus
auacuuuuacggaaaaaug

SEQ ID NO: 3271464 - RNA, 15 nt, Vaccinia virus
aauguuauuacuugu

SEQ ID NO: 3271465 - RNA, 15 nt, Vaccinia virus
auagcaauguaaugg

SEQ ID NO: 3271466 - RNA, 20 nt, Vaccinia virus
cuccuacaggaauaucuuua

SEQ ID NO: 3271467 - RNA, 21 nt, Vaccinia virus
aaacuuuaauaacaaagaaag

SEQ ID NO: 3271468 - RNA, 16 nt, Vaccinia virus
uaaauagagaagguau

SEQ ID NO: 3271469 - RNA, 20 nt, Vaccinia virus
augaucugucuuauaugaag

SEQ ID NO: 3271470 - RNA, 16 nt, Vaccinia virus
uauauagcacaaaugu

SEQ ID NO: 3271471 - RNA, 20 nt, Vaccinia virus
uaauaucccacauuaucauc

SEQ ID NO: 3271472 - RNA, 14 nt, Vaccinia virus
uguuaaauuucagu

SEQ ID NO: 3271473 - RNA, 16 nt, Vaccinia virus
uauuacguauuauaua

SEQ ID NO: 3271474 - RNA, 16 nt, Vaccinia virus
cgcuuaauaucuucug

SEQ ID NO: 3271475 - RNA, 15 nt, Vaccinia virus
cuguaaagaacagug

SEQ ID NO: 3271476 - RNA, 13 nt, Vaccinia virus
gaaucacaaacau

SEQ ID NO: 3271477 - RNA, 17 nt, Vaccinia virus
gaucaggaauccaaaga

SEQ ID NO: 3271478 - RNA, 18 nt, Vaccinia virus
acauuaauacuuuaauga

SEQ ID NO: 3271479 - RNA, 12 nt, Vaccinia virus
caacucucaaaa

SEQ ID NO: 3271480 - RNA, 14 nt, Vaccinia virus
ccaaguuauugcuu

SEQ ID NO: 3271481 - RNA, 23 nt, Vaccinia virus
cauuauuuaccgaacaggcauuu

SEQ ID NO: 3271482 - RNA, 21 nt, Vaccinia virus
aaggucaauuacggcgaaaua

SEQ ID NO: 3271483 - RNA, 22 nt, Vaccinia virus
gaggaggaauaucugaugaugu

SEQ ID NO: 3271484 - RNA, 16 nt, Vaccinia virus
uauuaaaacuaucaau

SEQ ID NO: 3271485 - RNA, 13 nt, Vaccinia virus
uccacauccauga

SEQ ID NO: 3271486 - RNA, 17 nt, Vaccinia virus
auaucaucauuguguaa

SEQ ID NO: 3271487 - RNA, 17 nt, Vaccinia virus
cuuugguuuaauuauuu

SEQ ID NO: 3271488 - RNA, 19 nt, Vaccinia virus
ucaaauggauuccauggaa

SEQ ID NO: 3271489 - RNA, 19 nt, Vaccinia virus
auaacagagccaucuguaa

SEQ ID NO: 3271490 - RNA, 16 nt, Vaccinia virus
gcaacugguaauuaaa

SEQ ID NO: 3271491 - RNA, 14 nt, Vaccinia virus
auaaagaaugaaug

SEQ ID NO: 3271492 - RNA, 15 nt, Vaccinia virus
gacgaacguauugcu

SEQ ID NO: 3271493 - RNA, 20 nt, Vaccinia virus
auuuuuacagcgacacuauu

SEQ ID NO: 3271494 - RNA, 17 nt, Vaccinia virus
uguuaaaauauaaacag

SEQ ID NO: 3271495 - RNA, 18 nt, Vaccinia virus
uauaaauauauaaugggu

SEQ ID NO: 3271496 - RNA, 19 nt, Vaccinia virus
aaaaugcauguacagaauc

SEQ ID NO: 3271497 - RNA, 13 nt, Vaccinia virus
ucaaacaguuugg

SEQ ID NO: 3271498 - RNA, 20 nt, Vaccinia virus
uaaucguguauaacaucuuu

SEQ ID NO: 3271499 - RNA, 13 nt, Vaccinia virus
ucauauuaaacau

SEQ ID NO: 3271500 - RNA, 14 nt, Vaccinia virus
gcauuguuaagaca

SEQ ID NO: 3271501 - RNA, 14 nt, Vaccinia virus
uacguuuacaugug

SEQ ID NO: 3271502 - RNA, 18 nt, Vaccinia virus
aaucaucaauccuucaga

SEQ ID NO: 3271503 - RNA, 22 nt, Vaccinia virus
auagauaguagcuauaauauau

SEQ ID NO: 3271504 - RNA, 16 nt, Vaccinia virus
uaucuuaucgaaugau

SEQ ID NO: 3271505 - RNA, 21 nt, Vaccinia virus
aucuuuacccauccaauacua

SEQ ID NO: 3271506 - RNA, 17 nt, Vaccinia virus
ugcuauaccuaauacua

SEQ ID NO: 3271507 - RNA, 14 nt, Vaccinia virus
uaagucacacuaag

SEQ ID NO: 3271508 - RNA, 14 nt, Vaccinia virus
agaggauaacuauu

SEQ ID NO: 3271509 - RNA, 13 nt, Vaccinia virus
auaaacuguuuau

SEQ ID NO: 3271510 - RNA, 14 nt, Vaccinia virus
auaucuucucaaaa

SEQ ID NO: 3271511 - RNA, 17 nt, Vaccinia virus
gaucaacggauaaucug

SEQ ID NO: 3271512 - RNA, 15 nt, Vaccinia virus
ccaugaaagaaagaa

SEQ ID NO: 3271513 - RNA, 15 nt, Vaccinia virus
auuuuucuucauuua

SEQ ID NO: 3271514 - RNA, 17 nt, Vaccinia virus
cguuaaauauaacuggu

SEQ ID NO: 3271515 - RNA, 17 nt, Vaccinia virus
aauaucuagcaaaaauu

SEQ ID NO: 3271516 - RNA, 21 nt, Vaccinia virus
uaaaaaguuuuccaucuaugu

SEQ ID NO: 3271517 - RNA, 13 nt, Vaccinia virus
uacguauccucga

SEQ ID NO: 3271518 - RNA, 13 nt, Vaccinia virus
uaauuaaugucca

SEQ ID NO: 3271519 - RNA, 15 nt, Vaccinia virus
aauccuguuucuacu

SEQ ID NO: 3271520 - RNA, 13 nt, Vaccinia virus
uuaauguuugcuc

SEQ ID NO: 3271521 - RNA, 18 nt, Vaccinia virus
ccacaauuagguauuuua

SEQ ID NO: 3271522 - RNA, 11 nt, Vaccinia virus
uucauuucuaa

SEQ ID NO: 3271523 - RNA, 16 nt, Vaccinia virus
accagucuaggaauaa

SEQ ID NO: 3271524 - RNA, 15 nt, Vaccinia virus
auuaaacguauucau

SEQ ID NO: 3271525 - RNA, 13 nt, Vaccinia virus
ucauaagaacuau

SEQ ID NO: 3271526 - RNA, 17 nt, Vaccinia virus
ucauauguuguuguaau

SEQ ID NO: 3271527 - RNA, 12 nt, Vaccinia virus
guaauaauugcu

SEQ ID NO: 3271528 - RNA, 14 nt, Vaccinia virus
auguagcuauauag

SEQ ID NO: 3271529 - RNA, 22 nt, Vaccinia virus
guaaccagaauuguaaaauuag

SEQ ID NO: 3271530 - RNA, 20 nt, Vaccinia virus
auucaauuacuacaaaaauu

SEQ ID NO: 3271531 - RNA, 23 nt, Vaccinia virus
auuauauagauacagaacaucaa

SEQ ID NO: 3271532 - RNA, 17 nt, Vaccinia virus
uauaccugccuagaaau

SEQ ID NO: 3271533 - RNA, 15 nt, Vaccinia virus
ucuuuaacaaauucu

SEQ ID NO: 3271534 - RNA, 21 nt, Vaccinia virus
uucaucauauucaucaucaau

SEQ ID NO: 3271535 - RNA, 20 nt, Vaccinia virus
uucuuggauccuaacaauga

SEQ ID NO: 3271536 - RNA, 16 nt, Vaccinia virus
uacguaucauaucuuc

SEQ ID NO: 3271537 - RNA, 13 nt, Vaccinia virus
aaauuuucauuca

SEQ ID NO: 3271538 - RNA, 22 nt, Vaccinia virus
agguacauggucuagauguaaa

SEQ ID NO: 3271539 - RNA, 21 nt, Vaccinia virus
aaaaucguguuuguguaguuu

SEQ ID NO: 3271540 - RNA, 17 nt, Vaccinia virus
cuuauuuuuaaaaauug

SEQ ID NO: 3271541 - RNA, 12 nt, Vaccinia virus
uaguagaugcua

SEQ ID NO: 3271542 - RNA, 22 nt, Vaccinia virus
gaauauauugugacuccagaua

SEQ ID NO: 3271543 - RNA, 15 nt, Vaccinia virus
auuuugguguaaauc

SEQ ID NO: 3271544 - RNA, 18 nt, Vaccinia virus
uguauauuuaucucuuca

SEQ ID NO: 3271545 - RNA, 18 nt, Vaccinia virus
uauguuuuaugaauagau

SEQ ID NO: 3271546 - RNA, 21 nt, Vaccinia virus
auuuggcauaaagagauagau

SEQ ID NO: 3271547 - RNA, 23 nt, Vaccinia virus
agaaauuuuugguucuucucuaa

SEQ ID NO: 3271548 - RNA, 17 nt, Vaccinia virus
uacaagaaauauuucca

SEQ ID NO: 3271549 - RNA, 22 nt, Vaccinia virus
acgggaaaggaauuaauuauuc

SEQ ID NO: 3271550 - RNA, 12 nt, Vaccinia virus
auauaguaauga

SEQ ID NO: 3271551 - RNA, 19 nt, Vaccinia virus
gauacuagaguaguauauu

SEQ ID NO: 3271552 - RNA, 22 nt, Vaccinia virus
uguuaccauaucguauaacuug

SEQ ID NO: 3271553 - RNA, 16 nt, Vaccinia virus
aaagauggucuaaaau

SEQ ID NO: 3271554 - RNA, 15 nt, Vaccinia virus
uuaacuguucaucgu

SEQ ID NO: 3271555 - RNA, 19 nt, Vaccinia virus
uauuuauccguaaaaaugu

SEQ ID NO: 3271556 - RNA, 21 nt, Vaccinia virus
auagaucggcaaagcuauugu

SEQ ID NO: 3271557 - RNA, 17 nt, Vaccinia virus
aguugauuguaaauaca

SEQ ID NO: 3271558 - RNA, 23 nt, Vaccinia virus
cuuaauccuucuagaauuagaau

SEQ ID NO: 3271559 - RNA, 21 nt, Vaccinia virus
auuuugcucuauaaacugaau

SEQ ID NO: 3271560 - RNA, 13 nt, Vaccinia virus
aguaaguaucuua

SEQ ID NO: 3271561 - RNA, 22 nt, Vaccinia virus
auuauaucguauuugugcuaua

SEQ ID NO: 3271562 - RNA, 17 nt, Vaccinia virus
uagccaucguuaauuau

SEQ ID NO: 3271563 - RNA, 17 nt, Vaccinia virus
uaccaauacucaagacu

SEQ ID NO: 3271564 - RNA, 20 nt, Vaccinia virus
aauaaauguuuugauuucaa

SEQ ID NO: 3271565 - RNA, 18 nt, Vaccinia virus
aacuauauucuuagaaau

SEQ ID NO: 3271566 - RNA, 13 nt, Vaccinia virus
agaugaaaaaugg

SEQ ID NO: 3271567 - RNA, 14 nt, Vaccinia virus
acaacuaaacagua

SEQ ID NO: 3271568 - RNA, 23 nt, Vaccinia virus
cugaaacaaagaauugugcauua

SEQ ID NO: 3271569 - RNA, 15 nt, Vaccinia virus
uguuuguucauugga

SEQ ID NO: 3271570 - RNA, 22 nt, Vaccinia virus
auuuucuuacaauuaacgagaa

SEQ ID NO: 3271571 - RNA, 13 nt, Vaccinia virus
uacuacaauuugu

SEQ ID NO: 3271572 - RNA, 19 nt, Vaccinia virus
auuaucaaaagacaugaua

SEQ ID NO: 3271573 - RNA, 14 nt, Vaccinia virus
uuccauauagauau

SEQ ID NO: 3271574 - RNA, 17 nt, Vaccinia virus
agaaauacuaaaaaaug

SEQ ID NO: 3271575 - RNA, 22 nt, Vaccinia virus
uguaugugcauucuuuaugaca

SEQ ID NO: 3271576 - RNA, 20 nt, Vaccinia virus
aagucccucauagaaugaua

SEQ ID NO: 3271577 - RNA, 17 nt, Vaccinia virus
uaguaacugacuuaaua

SEQ ID NO: 3271578 - RNA, 21 nt, Vaccinia virus
cgaguaaauaacuauagaagu

SEQ ID NO: 3271579 - RNA, 23 nt, Vaccinia virus
gaucuccucuauuuguacuaucu

SEQ ID NO: 3271580 - RNA, 12 nt, Vaccinia virus
cgaaaauauauu

SEQ ID NO: 3271581 - RNA, 19 nt, Vaccinia virus
acauuuuccauuuauaaca

SEQ ID NO: 3271582 - RNA, 22 nt, Vaccinia virus
ucuugauuaauaaaauuuauaa

SEQ ID NO: 3271583 - RNA, 22 nt, Vaccinia virus
aaucaccaaauuuuacaaaaaa

SEQ ID NO: 3271584 - RNA, 19 nt, Vaccinia virus
caaucggauacagacacuc

SEQ ID NO: 3271585 - RNA, 15 nt, Vaccinia virus
uaauagcaucucguu

SEQ ID NO: 3271586 - RNA, 22 nt, Vaccinia virus
aaugacaauaaaauuaucauga

SEQ ID NO: 3271587 - RNA, 20 nt, Vaccinia virus
uguucacaaaaauacauaaa

SEQ ID NO: 3271588 - RNA, 22 nt, Vaccinia virus
aaauaauccugaauauauugau

SEQ ID NO: 3271589 - RNA, 11 nt, Vaccinia virus
uagacauagau

SEQ ID NO: 3271590 - RNA, 16 nt, Vaccinia virus
auggaauuggagaaac

SEQ ID NO: 3271591 - RNA, 18 nt, Vaccinia virus
gucaaacuuaauaaagga

SEQ ID NO: 3271592 - RNA, 12 nt, Vaccinia virus
uccaauguuuaa

SEQ ID NO: 3271593 - RNA, 18 nt, Vaccinia virus
ucuaaacaguauguugua

SEQ ID NO: 3271594 - RNA, 12 nt, Vaccinia virus
uuuauaaauuuu

SEQ ID NO: 3271595 - RNA, 16 nt, Vaccinia virus
ccaccaucuccuccaa

SEQ ID NO: 3271596 - RNA, 16 nt, Vaccinia virus
accauacuucuacaga

SEQ ID NO: 3271597 - RNA, 20 nt, Vaccinia virus
auaucuuuacuaagaaaguu

SEQ ID NO: 3271598 - RNA, 20 nt, Vaccinia virus
aauaaucauaaauuauuuca

SEQ ID NO: 3271599 - RNA, 23 nt, Vaccinia virus
uacuuccaucaacauuguuucaa

SEQ ID NO: 3271600 - RNA, 17 nt, Vaccinia virus
aucuaugcuuacuguau

SEQ ID NO: 3271601 - RNA, 15 nt, Vaccinia virus
aaugucccuucaaga

SEQ ID NO: 3271602 - RNA, 23 nt, Vaccinia virus
uacuacaauacgguuuaccgaaa

SEQ ID NO: 3271603 - RNA, 21 nt, Vaccinia virus
ugaucucaauggaaugcaaaa

SEQ ID NO: 3271604 - RNA, 13 nt, Vaccinia virus
gacagaaaaaugc

SEQ ID NO: 3271605 - RNA, 18 nt, Vaccinia virus
aaucuuuugugaaaagau

SEQ ID NO: 3271606 - RNA, 17 nt, Vaccinia virus
uaaaucagaauguuaca

SEQ ID NO: 3271607 - RNA, 20 nt, Vaccinia virus
aggcaauguauauuuaucca

SEQ ID NO: 3271608 - RNA, 15 nt, Vaccinia virus
uaauaauaaacggaa

SEQ ID NO: 3271609 - RNA, 17 nt, Vaccinia virus
ugcuaauacgaauauua

SEQ ID NO: 3271610 - RNA, 18 nt, Vaccinia virus
agugacuuuguagcucuc

SEQ ID NO: 3271611 - RNA, 14 nt, Vaccinia virus
cgugaaauaaaguc

SEQ ID NO: 3271612 - RNA, 16 nt, Vaccinia virus
uacuuucaugauuuca

SEQ ID NO: 3271613 - RNA, 22 nt, Vaccinia virus
cauagcaugcgacuaugauauc

SEQ ID NO: 3271614 - RNA, 13 nt, Vaccinia virus
gaaauauauuaag

SEQ ID NO: 3271615 - RNA, 15 nt, Vaccinia virus
accauuaaagaauuc

SEQ ID NO: 3271616 - RNA, 14 nt, Vaccinia virus
cuucguuuaaauaa

SEQ ID NO: 3271617 - RNA, 21 nt, Vaccinia virus
agaauaugucucuuaacuauu

SEQ ID NO: 3271618 - RNA, 20 nt, Vaccinia virus
ucaagccggcuauauauucu

SEQ ID NO: 3271619 - RNA, 14 nt, Vaccinia virus
aaucugaaaaugaa

SEQ ID NO: 3271620 - RNA, 14 nt, Vaccinia virus
augcagaaaugauu

SEQ ID NO: 3271621 - RNA, 21 nt, Vaccinia virus
cuacauaguuaucuaucuuaa

SEQ ID NO: 3271622 - RNA, 21 nt, Vaccinia virus
aauucauccguccuucagaca

SEQ ID NO: 3271623 - RNA, 21 nt, Vaccinia virus
uccuauauauuugaaaaucgu

SEQ ID NO: 3271624 - RNA, 18 nt, Vaccinia virus
agaucuaaauacaaaauc

SEQ ID NO: 3271625 - RNA, 18 nt, Vaccinia virus
ucucaacaaguucucaau

SEQ ID NO: 3271626 - RNA, 19 nt, Vaccinia virus
aaucaagggaaaaucugaa

SEQ ID NO: 3271627 - RNA, 15 nt, Vaccinia virus
augccggagaguaaa

SEQ ID NO: 3271628 - RNA, 16 nt, Vaccinia virus
uaacagauacauaaac

SEQ ID NO: 3271629 - RNA, 15 nt, Vaccinia virus
uauuaucucaacaaa

SEQ ID NO: 3271630 - RNA, 20 nt, Vaccinia virus
aaaugaucauacucauuuau

SEQ ID NO: 3271631 - RNA, 13 nt, Vaccinia virus
uauauaucaugau

SEQ ID NO: 3271632 - RNA, 22 nt, Vaccinia virus
aucauaguuuuuacacauagau

SEQ ID NO: 3271633 - RNA, 18 nt, Vaccinia virus
auuucacgaaaaaugaug

SEQ ID NO: 3271634 - RNA, 11 nt, Vaccinia virus
agcauauuaaa

SEQ ID NO: 3271635 - RNA, 15 nt, Vaccinia virus
gaaagucagaaucua

SEQ ID NO: 3271636 - RNA, 12 nt, Vaccinia virus
ucguagaaagua

SEQ ID NO: 3271637 - RNA, 19 nt, Vaccinia virus
augaaaggagagaauguau

SEQ ID NO: 3271638 - RNA, 16 nt, Vaccinia virus
aaauucguuagcaaaa

SEQ ID NO: 3271639 - RNA, 20 nt, Vaccinia virus
gaccgaugaccauuuaaaaa

SEQ ID NO: 3271640 - RNA, 18 nt, Vaccinia virus
auacgaagaaaaaguaaa

SEQ ID NO: 3271641 - RNA, 22 nt, Vaccinia virus
aucaaggauacacucucaauau

SEQ ID NO: 3271642 - RNA, 21 nt, Vaccinia virus
acauccgccuuguauaugaug

SEQ ID NO: 3271643 - RNA, 13 nt, Vaccinia virus
aguguucuaaauu

SEQ ID NO: 3271644 - RNA, 14 nt, Vaccinia virus
gauauagauaugau

SEQ ID NO: 3271645 - RNA, 14 nt, Vaccinia virus
uauauauuaucaua

SEQ ID NO: 3271646 - RNA, 18 nt, Vaccinia virus
aaaggacaggaauauuua

SEQ ID NO: 3271647 - RNA, 23 nt, Vaccinia virus
gccacaaaugaaaaaaauacuua

SEQ ID NO: 3271648 - RNA, 13 nt, Vaccinia virus
guacuauguguua

SEQ ID NO: 3271649 - RNA, 22 nt, Vaccinia virus
gacgucuagaguuuauaucaau

SEQ ID NO: 3271650 - RNA, 16 nt, Vaccinia virus
aauccgguaaauggaa

SEQ ID NO: 3271651 - RNA, 14 nt, Vaccinia virus
guauccacaaauag

SEQ ID NO: 3271652 - RNA, 16 nt, Vaccinia virus
cucucuuaauuucaga

SEQ ID NO: 3271653 - RNA, 14 nt, Vaccinia virus
ucucagguacagau

SEQ ID NO: 3271654 - RNA, 14 nt, Vaccinia virus
cuaaaggaugagua

SEQ ID NO: 3271655 - RNA, 22 nt, Vaccinia virus
acucagauaauagcaauauuag

SEQ ID NO: 3271656 - RNA, 23 nt, Vaccinia virus
auucgugacagauccaugucuga

SEQ ID NO: 3271657 - RNA, 18 nt, Vaccinia virus
gugaaaauuacauacuua

SEQ ID NO: 3271658 - RNA, 13 nt, Vaccinia virus
uaauaaugauuca

SEQ ID NO: 3271659 - RNA, 16 nt, Vaccinia virus
aacuucuaaucuugua

SEQ ID NO: 3271660 - RNA, 15 nt, Vaccinia virus
aaaauaaaaugagua

SEQ ID NO: 3271661 - RNA, 19 nt, Vaccinia virus
acguuucuauuuucuauuu

SEQ ID NO: 3271662 - RNA, 21 nt, Vaccinia virus
gcugaaguaauuaauuuuucu

SEQ ID NO: 3271663 - RNA, 12 nt, Vaccinia virus
aucaauuucaaa

SEQ ID NO: 3271664 - RNA, 21 nt, Vaccinia virus
auacaucuauuaguaugguuu

SEQ ID NO: 3271665 - RNA, 13 nt, Vaccinia virus
gaaggaauucuuu

SEQ ID NO: 3271666 - RNA, 14 nt, Vaccinia virus
aaaaacuaauauua

SEQ ID NO: 3271667 - RNA, 18 nt, Vaccinia virus
uaugguucgcucaaaaau

SEQ ID NO: 3271668 - RNA, 23 nt, Vaccinia virus
aauaguucucccuuuuuaaaggu

SEQ ID NO: 3271669 - RNA, 16 nt, Vaccinia virus
gcuugugauuuuuucu

SEQ ID NO: 3271670 - RNA, 21 nt, Vaccinia virus
gaaaacgucauucaauaagau

SEQ ID NO: 3271671 - RNA, 23 nt, Vaccinia virus
acacuccguuuaauaaacugagu

SEQ ID NO: 3271672 - RNA, 19 nt, Vaccinia virus
uuacuaucaauauuauuca

SEQ ID NO: 3271673 - RNA, 18 nt, Vaccinia virus
aaucauccuaagaugaua

SEQ ID NO: 3271674 - RNA, 16 nt, Vaccinia virus
aaugaauuuuuaaaau

SEQ ID NO: 3271675 - RNA, 17 nt, Vaccinia virus
ucauauaccauuucuag

SEQ ID NO: 3271676 - RNA, 15 nt, Vaccinia virus
auaucagacagcaug

SEQ ID NO: 3271677 - RNA, 14 nt, Vaccinia virus
agcuauuaaacugu

SEQ ID NO: 3271678 - RNA, 19 nt, Vaccinia virus
uauaauaacaaguaugaca

SEQ ID NO: 3271679 - RNA, 16 nt, Vaccinia virus
cuaguaucauuucuac

SEQ ID NO: 3271680 - RNA, 13 nt, Vaccinia virus
uggguuccauaac

SEQ ID NO: 3271681 - RNA, 17 nt, Vaccinia virus
acaagagauagaggagg

SEQ ID NO: 3271682 - RNA, 18 nt, Vaccinia virus
guaccaucgugauucuua

SEQ ID NO: 3271683 - RNA, 17 nt, Vaccinia virus
ucagacuacuuauucua

SEQ ID NO: 3271684 - RNA, 19 nt, Vaccinia virus
gcccucuauuagcauaaac

SEQ ID NO: 3271685 - RNA, 17 nt, Vaccinia virus
auugaauaggaguuuga

SEQ ID NO: 3271686 - RNA, 19 nt, Vaccinia virus
uaaagaauguauaaaccuu

SEQ ID NO: 3271687 - RNA, 20 nt, Vaccinia virus
ccuuccacauccaugagauu

SEQ ID NO: 3271688 - RNA, 17 nt, Vaccinia virus
uauaauauauuagauau

SEQ ID NO: 3271689 - RNA, 14 nt, Vaccinia virus
aucaucgauuuuca

SEQ ID NO: 3271690 - RNA, 16 nt, Vaccinia virus
ucgucuuuguuagcau

SEQ ID NO: 3271691 - RNA, 20 nt, Vaccinia virus
cagauacgaugaugauguag

SEQ ID NO: 3271692 - RNA, 20 nt, Vaccinia virus
auuugaucgauuacauuuau

SEQ ID NO: 3271693 - RNA, 16 nt, Vaccinia virus
aucuucgguaucuuga

SEQ ID NO: 3271694 - RNA, 15 nt, Vaccinia virus
auauugguuguuaaa

SEQ ID NO: 3271695 - RNA, 19 nt, Vaccinia virus
gaauuuuuaaaaucauuau

SEQ ID NO: 3271696 - RNA, 22 nt, Vaccinia virus
uuuacgcaaaacauuauaauaa

SEQ ID NO: 3271697 - RNA, 18 nt, Vaccinia virus
uaaaauauaaugauauac

SEQ ID NO: 3271698 - RNA, 15 nt, Vaccinia virus
uuuaaaacagaugau

SEQ ID NO: 3271699 - RNA, 15 nt, Vaccinia virus
agucauguuaaaaau

SEQ ID NO: 3271700 - RNA, 17 nt, Vaccinia virus
cuucccucuaucauguu

SEQ ID NO: 3271701 - RNA, 13 nt, Vaccinia virus
uacaauucuguac

SEQ ID NO: 3271702 - RNA, 16 nt, Vaccinia virus
guauaauucuuuauaa

SEQ ID NO: 3271703 - RNA, 20 nt, Vaccinia virus
uguaacauugaguaaauccu

SEQ ID NO: 3271704 - RNA, 14 nt, Vaccinia virus
uaguuuucuaaaau

SEQ ID NO: 3271705 - RNA, 21 nt, Vaccinia virus
gaauugacgaaacaauguuuc

SEQ ID NO: 3271706 - RNA, 18 nt, Vaccinia virus
agagugagucuagaauuc

SEQ ID NO: 3271707 - RNA, 21 nt, Vaccinia virus
uuugucuuagaacaacauuuu

SEQ ID NO: 3271708 - RNA, 20 nt, Vaccinia virus
aggugaugcugguucuggag

SEQ ID NO: 3271709 - RNA, 16 nt, Vaccinia virus
uaucuauaauaucuua

SEQ ID NO: 3271710 - RNA, 24 nt, Vaccinia virus
acugguaauccacauaguuguaaa

SEQ ID NO: 3271711 - RNA, 15 nt, Vaccinia virus
ucaagucaaagaaau

SEQ ID NO: 3271712 - RNA, 13 nt, Vaccinia virus
cagaaaaaacaau

SEQ ID NO: 3271713 - RNA, 17 nt, Vaccinia virus
gagagaacuaacacaac

SEQ ID NO: 3271714 - RNA, 19 nt, Vaccinia virus
gagaagaagcuaauacccu

SEQ ID NO: 3271715 - RNA, 12 nt, Vaccinia virus
auaucaauuagu

SEQ ID NO: 3271716 - RNA, 14 nt, Vaccinia virus
ucuaacaucaucau

SEQ ID NO: 3271717 - RNA, 16 nt, Vaccinia virus
uaacucauuuuuugaa

SEQ ID NO: 3271718 - RNA, 21 nt, Vaccinia virus
auuugagagaucauuucuaua

SEQ ID NO: 3271719 - RNA, 15 nt, Vaccinia virus
accacgaaacaauau

SEQ ID NO: 3271720 - RNA, 14 nt, Vaccinia virus
aguaauuauaagaa

SEQ ID NO: 3271721 - RNA, 20 nt, Vaccinia virus
gaauaaguuuauuagacacg

SEQ ID NO: 3271722 - RNA, 17 nt, Vaccinia virus
gauuauguuuuaugaau

SEQ ID NO: 3271723 - RNA, 22 nt, Vaccinia virus
acauucgauggucuaucuauca

SEQ ID NO: 3271724 - RNA, 14 nt, Vaccinia virus
auuuauuaucuugu

SEQ ID NO: 3271725 - RNA, 16 nt, Vaccinia virus
acagaacaguaaaugu

SEQ ID NO: 3271726 - RNA, 19 nt, Vaccinia virus
uugaugacgucaaacaaug

SEQ ID NO: 3271727 - RNA, 19 nt, Vaccinia virus
agucaauauauuaagaagu

SEQ ID NO: 3271728 - RNA, 20 nt, Vaccinia virus
cauaauuaaauuaucgacau

SEQ ID NO: 3271729 - RNA, 15 nt, Vaccinia virus
aaauauacagcaaug

SEQ ID NO: 3271730 - RNA, 19 nt, Vaccinia virus
uggaugaugucauucacaa

SEQ ID NO: 3271731 - RNA, 20 nt, Vaccinia virus
caagcaaaaacaaaaaacuu

SEQ ID NO: 3271732 - RNA, 17 nt, Vaccinia virus
agauugaucauguagaa

SEQ ID NO: 3271733 - RNA, 18 nt, Vaccinia virus
guauaacauucuuaaaca

SEQ ID NO: 3271734 - RNA, 16 nt, Vaccinia virus
augauccauuuauagu

SEQ ID NO: 3271735 - RNA, 22 nt, Vaccinia virus
aucuucauccaguagacgacau

SEQ ID NO: 3271736 - RNA, 20 nt, Vaccinia virus
gucaauaaggcguuuaaaaa

SEQ ID NO: 3271737 - RNA, 14 nt, Vaccinia virus
gccauuacaagaua

SEQ ID NO: 3271738 - RNA, 15 nt, Vaccinia virus
uaaauuaauuuacca

SEQ ID NO: 3271739 - RNA, 23 nt, Vaccinia virus
uccaaucuaagaaauuuaaaauu

SEQ ID NO: 3271740 - RNA, 14 nt, Vaccinia virus
cauuaaucacugau

SEQ ID NO: 3271741 - RNA, 15 nt, Vaccinia virus
aauaaucguuauuau

SEQ ID NO: 3271742 - RNA, 16 nt, Vaccinia virus
agauuuuguauuaccu

SEQ ID NO: 3271743 - RNA, 17 nt, Vaccinia virus
aaucgcgcguuagaaau

SEQ ID NO: 3271744 - RNA, 16 nt, Vaccinia virus
guauaauauuuaaaca

SEQ ID NO: 3271745 - RNA, 18 nt, Vaccinia virus
aacagaguagauauuaau

SEQ ID NO: 3271746 - RNA, 16 nt, Vaccinia virus
auaaaaacuuauacau

SEQ ID NO: 3271747 - RNA, 15 nt, Vaccinia virus
aauagcucaauauaa

SEQ ID NO: 3271748 - RNA, 13 nt, Vaccinia virus
uaucuuguuacaa

SEQ ID NO: 3271749 - RNA, 17 nt, Vaccinia virus
gaaaugaugaaggaaag

SEQ ID NO: 3271750 - RNA, 15 nt, Vaccinia virus
uuuguugagaugcug

SEQ ID NO: 3271751 - RNA, 20 nt, Vaccinia virus
agauccuuguucuauuccca

SEQ ID NO: 3271752 - RNA, 22 nt, Vaccinia virus
ucuaauccuccuauuacauaua

SEQ ID NO: 3271753 - RNA, 17 nt, Vaccinia virus
aauauuagguaaagaua

SEQ ID NO: 3271754 - RNA, 17 nt, Vaccinia virus
agucauacguaaugaag

SEQ ID NO: 3271755 - RNA, 17 nt, Vaccinia virus
auagcauuaauacagua

SEQ ID NO: 3271756 - RNA, 22 nt, Vaccinia virus
acguacccaucaauauaaauaa

SEQ ID NO: 3271757 - RNA, 19 nt, Vaccinia virus
uaucucaaaaaauaauaag

SEQ ID NO: 3271758 - RNA, 21 nt, Vaccinia virus
aucuuaacuccucuauuaaug

SEQ ID NO: 3271759 - RNA, 13 nt, Vaccinia virus
uuuuaacaucuuu

SEQ ID NO: 3271760 - RNA, 15 nt, Vaccinia virus
uauaacaaauacaga

SEQ ID NO: 3271761 - RNA, 13 nt, Vaccinia virus
uauuuuacuaaau

SEQ ID NO: 3271762 - RNA, 14 nt, Vaccinia virus
auuaaaauacuuuc

SEQ ID NO: 3271763 - RNA, 18 nt, Vaccinia virus
uuccauccacaauuauug

SEQ ID NO: 3271764 - RNA, 19 nt, Vaccinia virus
cuacaaaauguugauaauc

SEQ ID NO: 3271765 - RNA, 15 nt, Vaccinia virus
auauaucaugaugau

SEQ ID NO: 3271766 - RNA, 13 nt, Vaccinia virus
cucuauagauaau

SEQ ID NO: 3271767 - RNA, 15 nt, Vaccinia virus
aucguacuauauaca

SEQ ID NO: 3271768 - RNA, 18 nt, Vaccinia virus
gacaaaguccuaguugua

SEQ ID NO: 3271769 - RNA, 23 nt, Vaccinia virus
aaaggcggucacgucgucaaaau

SEQ ID NO: 3271770 - RNA, 16 nt, Vaccinia virus
agauacuguuuagaga

SEQ ID NO: 3271771 - RNA, 21 nt, Vaccinia virus
auugucucgucaaugucuaua

SEQ ID NO: 3271772 - RNA, 17 nt, Vaccinia virus
auuaauuaucacauauu

SEQ ID NO: 3271773 - RNA, 14 nt, Vaccinia virus
cuauguaaaugaua

SEQ ID NO: 3271774 - RNA, 22 nt, Vaccinia virus
cucuauaguuuguuuucauuau

SEQ ID NO: 3271775 - RNA, 18 nt, Vaccinia virus
gauccaucaaaaaacaac

SEQ ID NO: 3271776 - RNA, 23 nt, Vaccinia virus
uggauaaaaugcaugacgugaua

SEQ ID NO: 3271777 - RNA, 16 nt, Vaccinia virus
gaugauacauuucauc

SEQ ID NO: 3271778 - RNA, 16 nt, Vaccinia virus
uuguacgguacguuau

SEQ ID NO: 3271779 - RNA, 17 nt, Vaccinia virus
uaaacacacauuauuca

SEQ ID NO: 3271780 - RNA, 22 nt, Vaccinia virus
uuauuacuaaacuacgugaaca

SEQ ID NO: 3271781 - RNA, 22 nt, Vaccinia virus
cuucgaugagauugaucaugua

SEQ ID NO: 3271782 - RNA, 18 nt, Vaccinia virus
uuagaucucauaugugcu

SEQ ID NO: 3271783 - RNA, 13 nt, Vaccinia virus
ggucuaucuauua

SEQ ID NO: 3271784 - RNA, 18 nt, Vaccinia virus
guucuaaauuuagauagu

SEQ ID NO: 3271785 - RNA, 12 nt, Vaccinia virus
uauuuacaauua

SEQ ID NO: 3271786 - RNA, 16 nt, Vaccinia virus
auaaacauaaguauau

SEQ ID NO: 3271787 - RNA, 15 nt, Vaccinia virus
uccaugaucaagaag

SEQ ID NO: 3271788 - RNA, 15 nt, Vaccinia virus
uaauggaucuucuag

SEQ ID NO: 3271789 - RNA, 14 nt, Vaccinia virus
caaagcaaccagaa

SEQ ID NO: 3271790 - RNA, 22 nt, Vaccinia virus
uaaacaaucuaguuuugagaac

SEQ ID NO: 3271791 - RNA, 13 nt, Vaccinia virus
ucaucuauaaaug

SEQ ID NO: 3271792 - RNA, 21 nt, Vaccinia virus
gaugauccuuugagaagacaa

SEQ ID NO: 3271793 - RNA, 17 nt, Vaccinia virus
auagcaaaaucuuuacu

SEQ ID NO: 3271794 - RNA, 13 nt, Vaccinia virus
uaacaacuuauac

SEQ ID NO: 3271795 - RNA, 13 nt, Vaccinia virus
uuauuagaucuuu

SEQ ID NO: 3271796 - RNA, 15 nt, Vaccinia virus
ccuuacucaugauua

SEQ ID NO: 3271797 - RNA, 14 nt, Vaccinia virus
cauguauauaucca

SEQ ID NO: 3271798 - RNA, 15 nt, Vaccinia virus
gaagaagaaaacaaa

SEQ ID NO: 3271799 - RNA, 19 nt, Vaccinia virus
cucugauagcaguuucaau

SEQ ID NO: 3271800 - RNA, 16 nt, Vaccinia virus
ugcauaaucagauucu

SEQ ID NO: 3271801 - RNA, 21 nt, Vaccinia virus
cuaugaauaccauuaaacaau

SEQ ID NO: 3271802 - RNA, 14 nt, Vaccinia virus
gcuauuaaucuuua

SEQ ID NO: 3271803 - RNA, 12 nt, Vaccinia virus
uaauacagacga

SEQ ID NO: 3271804 - RNA, 19 nt, Vaccinia virus
uaauguuuaauuuaucaaa

SEQ ID NO: 3271805 - RNA, 13 nt, Vaccinia virus
guauguuugugaa

SEQ ID NO: 3271806 - RNA, 16 nt, Vaccinia virus
uauaaucguuaaauuu

SEQ ID NO: 3271807 - RNA, 15 nt, Vaccinia virus
guuagauauagaaga

SEQ ID NO: 3271808 - RNA, 20 nt, Vaccinia virus
ucaaucauccuaaagaguau

SEQ ID NO: 3271809 - RNA, 15 nt, Vaccinia virus
uagcagucuaacauu

SEQ ID NO: 3271810 - RNA, 17 nt, Vaccinia virus
gaacguauaguuugaua

SEQ ID NO: 3271811 - RNA, 14 nt, Vaccinia virus
uaucugacauaaac

SEQ ID NO: 3271812 - RNA, 15 nt, Vaccinia virus
auaagaguguaguau

SEQ ID NO: 3271813 - RNA, 20 nt, Vaccinia virus
aauguagauaaucauuuaau

SEQ ID NO: 3271814 - RNA, 20 nt, Vaccinia virus
aagaaucaaaagaaugauuc

SEQ ID NO: 3271815 - RNA, 15 nt, Vaccinia virus
ugaagaggaaacaug

SEQ ID NO: 3271816 - RNA, 15 nt, Vaccinia virus
acuauauuauguuuu

SEQ ID NO: 3271817 - RNA, 14 nt, Vaccinia virus
auaaaauaacaaua

SEQ ID NO: 3271818 - RNA, 17 nt, Vaccinia virus
aacgaaguauuuauacu

SEQ ID NO: 3271819 - RNA, 14 nt, Vaccinia virus
ucccaaauaucuuu

SEQ ID NO: 3271820 - RNA, 20 nt, Vaccinia virus
ucguggauaaucauucuuaa

SEQ ID NO: 3271821 - RNA, 13 nt, Vaccinia virus
gaaugaagagaag

SEQ ID NO: 3271822 - RNA, 18 nt, Vaccinia virus
auaauuuuaccagaauac

SEQ ID NO: 3271823 - RNA, 17 nt, Vaccinia virus
auaucuucuuuuuucca

SEQ ID NO: 3271824 - RNA, 14 nt, Vaccinia virus
auaaauucuagcau

SEQ ID NO: 3271825 - RNA, 14 nt, Vaccinia virus
aauacaaaauguua

SEQ ID NO: 3271826 - RNA, 14 nt, Vaccinia virus
uacgcuauuaaaau

SEQ ID NO: 3271827 - RNA, 15 nt, Vaccinia virus
uucugauuuuaucuu

SEQ ID NO: 3271828 - RNA, 16 nt, Vaccinia virus
uccauaggauacuuug

SEQ ID NO: 3271829 - RNA, 14 nt, Vaccinia virus
uucuagucuagaaa

SEQ ID NO: 3271830 - RNA, 22 nt, Vaccinia virus
augauggguguacaaucaagau

SEQ ID NO: 3271831 - RNA, 24 nt, Vaccinia virus
uuagaucugauacaccuguaauca

SEQ ID NO: 3271832 - RNA, 19 nt, Vaccinia virus
acuaaugcaucuauuucau

SEQ ID NO: 3271833 - RNA, 17 nt, Vaccinia virus
agaagugugaauaugau

SEQ ID NO: 3271834 - RNA, 20 nt, Vaccinia virus
aucgauccucacuucgaaga

SEQ ID NO: 3271835 - RNA, 20 nt, Vaccinia virus
ccaagaaaauagaaauucgu

SEQ ID NO: 3271836 - RNA, 22 nt, Vaccinia virus
auagcuuuacucugaaaagaaa

SEQ ID NO: 3271837 - RNA, 13 nt, Vaccinia virus
auuuaaacaaaaa

SEQ ID NO: 3271838 - RNA, 16 nt, Vaccinia virus
cauaaacaauauaaau

SEQ ID NO: 3271839 - RNA, 15 nt, Vaccinia virus
cauuccaguauucuc

SEQ ID NO: 3271840 - RNA, 16 nt, Vaccinia virus
auuaaaucauuaaaug

SEQ ID NO: 3271841 - RNA, 14 nt, Vaccinia virus
uauccaacauaugg

SEQ ID NO: 3271842 - RNA, 14 nt, Vaccinia virus
auaaugaucauaua

SEQ ID NO: 3271843 - RNA, 14 nt, Vaccinia virus
auuucuaauguuuc

SEQ ID NO: 3271844 - RNA, 16 nt, Vaccinia virus
uauucugauucuucua

SEQ ID NO: 3271845 - RNA, 15 nt, Vaccinia virus
aucuuccuucuuauu

SEQ ID NO: 3271846 - RNA, 18 nt, Vaccinia virus
ucccacaguguugccauu

SEQ ID NO: 3271847 - RNA, 14 nt, Vaccinia virus
uaaagguaaaugua

SEQ ID NO: 3271848 - RNA, 19 nt, Vaccinia virus
auauuaaaaaaaaauacuu

SEQ ID NO: 3271849 - RNA, 12 nt, Vaccinia virus
aaacaacugaaa

SEQ ID NO: 3271850 - RNA, 22 nt, Vaccinia virus
cauccgauaacauguuaauuuc

SEQ ID NO: 3271851 - RNA, 16 nt, Vaccinia virus
auauuagacaauacua

SEQ ID NO: 3271852 - RNA, 18 nt, Vaccinia virus
aaagaggcugguaacaac

SEQ ID NO: 3271853 - RNA, 16 nt, Vaccinia virus
uugaucuuauuauaca

SEQ ID NO: 3271854 - RNA, 17 nt, Vaccinia virus
ccuuauaaagaaugaau

SEQ ID NO: 3271855 - RNA, 17 nt, Vaccinia virus
ucggauaauauguaaaa

SEQ ID NO: 3271856 - RNA, 21 nt, Vaccinia virus
uugucguaaauacaugucuaa

SEQ ID NO: 3271857 - RNA, 16 nt, Vaccinia virus
gaucuuaccaucuucu

SEQ ID NO: 3271858 - RNA, 22 nt, Vaccinia virus
gcaaaaauaauaugauuagaag

SEQ ID NO: 3271859 - RNA, 22 nt, Vaccinia virus
uacuucuccaaucauauagaua

SEQ ID NO: 3271860 - RNA, 23 nt, Vaccinia virus
aauacacuuagguuuuuggaaaa

SEQ ID NO: 3271861 - RNA, 22 nt, Vaccinia virus
cuucuacaucuuccuucuuauu

SEQ ID NO: 3271862 - RNA, 21 nt, Vaccinia virus
aaauuauuuaauaaaguauau

SEQ ID NO: 3271863 - RNA, 13 nt, Vaccinia virus
gaucaaauacuug

SEQ ID NO: 3271864 - RNA, 13 nt, Vaccinia virus
gaguguagaaaac

SEQ ID NO: 3271865 - RNA, 20 nt, Vaccinia virus
auuacuaugaaucauaaaga

SEQ ID NO: 3271866 - RNA, 14 nt, Vaccinia virus
uagaccuguagccg

SEQ ID NO: 3271867 - RNA, 13 nt, Vaccinia virus
aauugucuagaua

SEQ ID NO: 3271868 - RNA, 13 nt, Vaccinia virus
guguguagauauc

SEQ ID NO: 3271869 - RNA, 19 nt, Vaccinia virus
agaugauucgauaaauaga

SEQ ID NO: 3271870 - RNA, 14 nt, Vaccinia virus
uauuaaccaugaaa

SEQ ID NO: 3271871 - RNA, 21 nt, Vaccinia virus
uguauaacaaucguauaucuu

SEQ ID NO: 3271872 - RNA, 13 nt, Vaccinia virus
aucguaaugaaca

SEQ ID NO: 3271873 - RNA, 15 nt, Vaccinia virus
agcacaucaaaugau

SEQ ID NO: 3271874 - RNA, 15 nt, Vaccinia virus
gugucugaaucgaua

SEQ ID NO: 3271875 - RNA, 15 nt, Vaccinia virus
aauuaauuugauaau

SEQ ID NO: 3271876 - RNA, 11 nt, Vaccinia virus
caaagaaagag

SEQ ID NO: 3271877 - RNA, 20 nt, Vaccinia virus
caaaaauuuuuuauuucagc

SEQ ID NO: 3271878 - RNA, 21 nt, Vaccinia virus
aacauuuguguuuguaucuua

SEQ ID NO: 3271879 - RNA, 14 nt, Vaccinia virus
uggaauuaacuauc

SEQ ID NO: 3271880 - RNA, 19 nt, Vaccinia virus
aauauaucuauaauuugau

SEQ ID NO: 3271881 - RNA, 20 nt, Vaccinia virus
ccguuauauaaucuacaaaa

SEQ ID NO: 3271882 - RNA, 20 nt, Vaccinia virus
cagcuacugcugauaaugau

SEQ ID NO: 3271883 - RNA, 22 nt, Vaccinia virus
agaaaggugugcacucugaauu

SEQ ID NO: 3271884 - RNA, 14 nt, Vaccinia virus
augaugauguagaa

SEQ ID NO: 3271885 - RNA, 16 nt, Vaccinia virus
cauuaaaaugauuauu

SEQ ID NO: 3271886 - RNA, 18 nt, Vaccinia virus
caauguacgccguguggu

SEQ ID NO: 3271887 - RNA, 20 nt, Vaccinia virus
uauaagauuaucaaaaucuu

SEQ ID NO: 3271888 - RNA, 18 nt, Vaccinia virus
agucgaacaaucuuaaug

SEQ ID NO: 3271889 - RNA, 15 nt, Vaccinia virus
cauacacuacaguaa

SEQ ID NO: 3271890 - RNA, 21 nt, Vaccinia virus
auaacuagcuuaaacagauga

SEQ ID NO: 3271891 - RNA, 15 nt, Vaccinia virus
aggacguaacuauaa

SEQ ID NO: 3271892 - RNA, 16 nt, Vaccinia virus
cuuucaugauuucauu

SEQ ID NO: 3271893 - RNA, 13 nt, Vaccinia virus
guguuauaauauu

SEQ ID NO: 3271894 - RNA, 13 nt, Vaccinia virus
uugguguaaaucu

SEQ ID NO: 3271895 - RNA, 20 nt, Vaccinia virus
cuggaaaauaaaucacugac

SEQ ID NO: 3271896 - RNA, 23 nt, Vaccinia virus
agacgucaauaucugauuauuau

SEQ ID NO: 3271897 - RNA, 16 nt, Vaccinia virus
ucuccuuuuguagaca

SEQ ID NO: 3271898 - RNA, 12 nt, Vaccinia virus
uucuuucaaaau

SEQ ID NO: 3271899 - RNA, 16 nt, Vaccinia virus
caucuuaguauaacac

SEQ ID NO: 3271900 - RNA, 21 nt, Vaccinia virus
uuuuccucagacaucuaaaaa

SEQ ID NO: 3271901 - RNA, 21 nt, Vaccinia virus
uucuaagaaaucuauaauauc

SEQ ID NO: 3271902 - RNA, 22 nt, Vaccinia virus
aaagugaucacgaguuuguaaa

SEQ ID NO: 3271903 - RNA, 14 nt, Vaccinia virus
uauuggcuuucaua

SEQ ID NO: 3271904 - RNA, 13 nt, Vaccinia virus
ggcucauugauua

SEQ ID NO: 3271905 - RNA, 13 nt, Vaccinia virus
aaugaauauuaaa

SEQ ID NO: 3271906 - RNA, 12 nt, Vaccinia virus
aauacugaauuc

SEQ ID NO: 3271907 - RNA, 22 nt, Vaccinia virus
aauaguuacgcaauaucucaau

SEQ ID NO: 3271908 - RNA, 16 nt, Vaccinia virus
uaauaaaauguuacaa

SEQ ID NO: 3271909 - RNA, 13 nt, Vaccinia virus
acaugguuaaagu

SEQ ID NO: 3271910 - RNA, 21 nt, Vaccinia virus
aaauguuacugaagaauauau

SEQ ID NO: 3271911 - RNA, 19 nt, Vaccinia virus
aucugauaacuuuaaacau

SEQ ID NO: 3271912 - RNA, 23 nt, Vaccinia virus
uugccacauccuuuauuaaauca

SEQ ID NO: 3271913 - RNA, 15 nt, Vaccinia virus
uaacuuugauagcaa

SEQ ID NO: 3271914 - RNA, 14 nt, Vaccinia virus
aggauacuuuguaa

SEQ ID NO: 3271915 - RNA, 22 nt, Vaccinia virus
uuuacgagcuauuaaacuguuu

SEQ ID NO: 3271916 - RNA, 15 nt, Vaccinia virus
ccaccucucuggaag

SEQ ID NO: 3271917 - RNA, 23 nt, Vaccinia virus
cuucagaauacaaucuguauuuc

SEQ ID NO: 3271918 - RNA, 18 nt, Vaccinia virus
caaagguacuauuucuac

SEQ ID NO: 3271919 - RNA, 19 nt, Vaccinia virus
ucguuuccucuguacacau

SEQ ID NO: 3271920 - RNA, 13 nt, Vaccinia virus
ucuaaaauguaua

SEQ ID NO: 3271921 - RNA, 18 nt, Vaccinia virus
gauaaaacgauaaaagau

SEQ ID NO: 3271922 - RNA, 23 nt, Vaccinia virus
aacaagugauacguaagaauaua

SEQ ID NO: 3271923 - RNA, 12 nt, Vaccinia virus
uucuaauacuau

SEQ ID NO: 3271924 - RNA, 23 nt, Vaccinia virus
gcauagaguuugcggauaaugau

SEQ ID NO: 3271925 - RNA, 13 nt, Vaccinia virus
uccagauauauau

SEQ ID NO: 3271926 - RNA, 18 nt, Vaccinia virus
uugagguaaucuucuuug

SEQ ID NO: 3271927 - RNA, 13 nt, Vaccinia virus
ugcaauaaaucua

SEQ ID NO: 3271928 - RNA, 19 nt, Vaccinia virus
guauuauucauuuucuauu

SEQ ID NO: 3271929 - RNA, 19 nt, Vaccinia virus
aaucaauguacauacaucg

SEQ ID NO: 3271930 - RNA, 23 nt, Vaccinia virus
auagagagaaagaagaaauacua

SEQ ID NO: 3271931 - RNA, 18 nt, Vaccinia virus
auuggaauaccaaauauu

SEQ ID NO: 3271932 - RNA, 19 nt, Vaccinia virus
auuuuaacgacgacauauu

SEQ ID NO: 3271933 - RNA, 21 nt, Vaccinia virus
auaauucauuaauauguacau

SEQ ID NO: 3271934 - RNA, 16 nt, Vaccinia virus
uauuugauauacuaag

SEQ ID NO: 3271935 - RNA, 13 nt, Vaccinia virus
auaaaaucuauau

SEQ ID NO: 3271936 - RNA, 20 nt, Vaccinia virus
caguuccccuacguaucuau

SEQ ID NO: 3271937 - RNA, 12 nt, Vaccinia virus
auuaaucaaaug

SEQ ID NO: 3271938 - RNA, 16 nt, Vaccinia virus
uuauuagaauaagagu

SEQ ID NO: 3271939 - RNA, 16 nt, Vaccinia virus
ccaacucauuuaaaua

SEQ ID NO: 3271940 - RNA, 17 nt, Vaccinia virus
aaagaaaauaucuauau

SEQ ID NO: 3271941 - RNA, 15 nt, Vaccinia virus
cuaucuuguuuagau

SEQ ID NO: 3271942 - RNA, 16 nt, Vaccinia virus
aauuaaucaaauggua

SEQ ID NO: 3271943 - RNA, 16 nt, Vaccinia virus
gauacacguauaaaaa

SEQ ID NO: 3271944 - RNA, 19 nt, Vaccinia virus
cuaauucuauauuguuaua

SEQ ID NO: 3271945 - RNA, 12 nt, Vaccinia virus
uaucuaaagcuu

SEQ ID NO: 3271946 - RNA, 15 nt, Vaccinia virus
acauauucaguugau

SEQ ID NO: 3271947 - RNA, 16 nt, Vaccinia virus
caaaaaguaagauauu

SEQ ID NO: 3271948 - RNA, 20 nt, Vaccinia virus
cuuuauacuauaauaguacu

SEQ ID NO: 3271949 - RNA, 14 nt, Vaccinia virus
ucuauagucagaau

SEQ ID NO: 3271950 - RNA, 13 nt, Vaccinia virus
acaucuguuugag

SEQ ID NO: 3271951 - RNA, 21 nt, Vaccinia virus
augucggucggcauucuauuu

SEQ ID NO: 3271952 - RNA, 21 nt, Vaccinia virus
cuaaguagaccguuaaugaaa

SEQ ID NO: 3271953 - RNA, 14 nt, Vaccinia virus
uuuguauucauaga

SEQ ID NO: 3271954 - RNA, 20 nt, Vaccinia virus
aauagugucauuaggaguua

SEQ ID NO: 3271955 - RNA, 14 nt, Vaccinia virus
uugcauuauagaau

SEQ ID NO: 3271956 - RNA, 15 nt, Vaccinia virus
aauauauugaucaua

SEQ ID NO: 3271957 - RNA, 17 nt, Vaccinia virus
uguuauaagauuacuua

SEQ ID NO: 3271958 - RNA, 21 nt, Vaccinia virus
uugauaguuguuccuagauau

SEQ ID NO: 3271959 - RNA, 12 nt, Vaccinia virus
gcagaugaugau

SEQ ID NO: 3271960 - RNA, 21 nt, Vaccinia virus
auuauugaagaugaugugaau

SEQ ID NO: 3271961 - RNA, 19 nt, Vaccinia virus
uaguugauagaacaaaaua

SEQ ID NO: 3271962 - RNA, 20 nt, Vaccinia virus
cgaugauucgucuacauguu

SEQ ID NO: 3271963 - RNA, 16 nt, Vaccinia virus
ucuguuuuauuaaccg

SEQ ID NO: 3271964 - RNA, 19 nt, Vaccinia virus
ugaauugaugaguuguaca

SEQ ID NO: 3271965 - RNA, 16 nt, Vaccinia virus
aauggcauacauagaa

SEQ ID NO: 3271966 - RNA, 17 nt, Vaccinia virus
uacuugaaauucuccag

SEQ ID NO: 3271967 - RNA, 19 nt, Vaccinia virus
aucuucguuaaaaaguuuu

SEQ ID NO: 3271968 - RNA, 21 nt, Vaccinia virus
auccaaguuaaaggauauuau

SEQ ID NO: 3271969 - RNA, 16 nt, Vaccinia virus
uauuggaauuauaaua

SEQ ID NO: 3271970 - RNA, 22 nt, Vaccinia virus
auugcaugguaaggaaguagaa

SEQ ID NO: 3271971 - RNA, 16 nt, Vaccinia virus
aacguuuuaaaaaaag

SEQ ID NO: 3271972 - RNA, 19 nt, Vaccinia virus
ucuguuccccucuaucauc

SEQ ID NO: 3271973 - RNA, 22 nt, Vaccinia virus
aaguuuuuccaauuauauggua

SEQ ID NO: 3271974 - RNA, 21 nt, Vaccinia virus
uauuuaacggcuauucaagau

SEQ ID NO: 3271975 - RNA, 21 nt, Vaccinia virus
auauguuaaauauaaaaaaug

SEQ ID NO: 3271976 - RNA, 14 nt, Vaccinia virus
aaacaauacucuau

SEQ ID NO: 3271977 - RNA, 14 nt, Vaccinia virus
cucuuggaauuaau

SEQ ID NO: 3271978 - RNA, 20 nt, Vaccinia virus
uuaauacuacauauuuuuca

SEQ ID NO: 3271979 - RNA, 15 nt, Vaccinia virus
aucuguauaauaaga

SEQ ID NO: 3271980 - RNA, 22 nt, Vaccinia virus
gaucaaggacuuuuauauccca

SEQ ID NO: 3271981 - RNA, 21 nt, Vaccinia virus
acgucaucgcuucaucuauca

SEQ ID NO: 3271982 - RNA, 15 nt, Vaccinia virus
uaauuaaauguuuga

SEQ ID NO: 3271983 - RNA, 20 nt, Vaccinia virus
aaaguauuuuaauacaugua

SEQ ID NO: 3271984 - RNA, 13 nt, Vaccinia virus
cgaauaacaaaau

SEQ ID NO: 3271985 - RNA, 22 nt, Vaccinia virus
acuuuuuuacccacuauaaaau

SEQ ID NO: 3271986 - RNA, 17 nt, Vaccinia virus
caagaucuuugauauac

SEQ ID NO: 3271987 - RNA, 15 nt, Vaccinia virus
auuacucaugcauuu

SEQ ID NO: 3271988 - RNA, 15 nt, Vaccinia virus
uaucuaaaaaucuua

SEQ ID NO: 3271989 - RNA, 14 nt, Vaccinia virus
acauucuuaaacaa

SEQ ID NO: 3271990 - RNA, 14 nt, Vaccinia virus
augcaaaaaaaugu

SEQ ID NO: 3271991 - RNA, 15 nt, Vaccinia virus
uauaaauauccuuaa

SEQ ID NO: 3271992 - RNA, 22 nt, Vaccinia virus
ugauaucuacaucguuuggauu

SEQ ID NO: 3271993 - RNA, 15 nt, Vaccinia virus
acaaaucuauaacau

SEQ ID NO: 3271994 - RNA, 21 nt, Vaccinia virus
auauauuuuccaugaaaucaa

SEQ ID NO: 3271995 - RNA, 15 nt, Vaccinia virus
uuagagaacauacau

SEQ ID NO: 3271996 - RNA, 13 nt, Vaccinia virus
uuaaauaauuaau

SEQ ID NO: 3271997 - RNA, 15 nt, Vaccinia virus
uggcggcuagaaugg

SEQ ID NO: 3271998 - RNA, 19 nt, Vaccinia virus
uuucagcguggauuucuca

SEQ ID NO: 3271999 - RNA, 18 nt, Vaccinia virus
aauguauuaguaggaaau

SEQ ID NO: 3272000 - RNA, 18 nt, Vaccinia virus
aacucacauuucaaauau

SEQ ID NO: 3272001 - RNA, 19 nt, Vaccinia virus
aaacuucguaaaauauucu

SEQ ID NO: 3272002 - RNA, 15 nt, Vaccinia virus
ggacagucuauuuuc

SEQ ID NO: 3272003 - RNA, 18 nt, Vaccinia virus
auuacguggagaaaucau

SEQ ID NO: 3272004 - RNA, 21 nt, Vaccinia virus
ccuaguacggcggauuuacua

SEQ ID NO: 3272005 - RNA, 15 nt, Vaccinia virus
aucuuguuuagaaaa

SEQ ID NO: 3272006 - RNA, 14 nt, Vaccinia virus
uuauacaaugaacu

SEQ ID NO: 3272007 - RNA, 21 nt, Vaccinia virus
auacaccaucaauagauaaaa

SEQ ID NO: 3272008 - RNA, 12 nt, Vaccinia virus
aaggaacuagaa

SEQ ID NO: 3272009 - RNA, 22 nt, Vaccinia virus
ucuaugacuaaagcuauuacaa

SEQ ID NO: 3272010 - RNA, 17 nt, Vaccinia virus
gaacuagacgauaaugu

SEQ ID NO: 3272011 - RNA, 21 nt, Vaccinia virus
caaaaaacuuuacgauagacu

SEQ ID NO: 3272012 - RNA, 16 nt, Vaccinia virus
ugacgggauacagauu

SEQ ID NO: 3272013 - RNA, 21 nt, Vaccinia virus
acugcagcaaaggcaauaagu

SEQ ID NO: 3272014 - RNA, 14 nt, Vaccinia virus
auuauuuaauaaag

SEQ ID NO: 3272015 - RNA, 22 nt, Vaccinia virus
uuauugauacccgucuguuuaa

SEQ ID NO: 3272016 - RNA, 16 nt, Vaccinia virus
auaauauaucaaacau

SEQ ID NO: 3272017 - RNA, 15 nt, Vaccinia virus
aucauaauuaaauua

SEQ ID NO: 3272018 - RNA, 20 nt, Vaccinia virus
ccacacgaggacuauguuug

SEQ ID NO: 3272019 - RNA, 21 nt, Vaccinia virus
auaacgaguacauucugcaau

SEQ ID NO: 3272020 - RNA, 18 nt, Vaccinia virus
uugaugaaguucgaugau

SEQ ID NO: 3272021 - RNA, 18 nt, Vaccinia virus
cguuggaccauuaauagg

SEQ ID NO: 3272022 - RNA, 14 nt, Vaccinia virus
auucagcugaaaug

SEQ ID NO: 3272023 - RNA, 13 nt, Vaccinia virus
gaucguuaaugaa

SEQ ID NO: 3272024 - RNA, 21 nt, Vaccinia virus
aaucaugugauuaugaauauu

SEQ ID NO: 3272025 - RNA, 20 nt, Vaccinia virus
uuucauucgaagacgcuaua

SEQ ID NO: 3272026 - RNA, 15 nt, Vaccinia virus
auaacauguuaauuu

SEQ ID NO: 3272027 - RNA, 20 nt, Vaccinia virus
aaauuauuaaacaauacucu

SEQ ID NO: 3272028 - RNA, 16 nt, Vaccinia virus
gacuugauuuaaaacc

SEQ ID NO: 3272029 - RNA, 20 nt, Vaccinia virus
ucaucaccagcacaacaucu

SEQ ID NO: 3272030 - RNA, 18 nt, Vaccinia virus
aaauaacauuuauuauca

SEQ ID NO: 3272031 - RNA, 14 nt, Vaccinia virus
acaucgucuagauc

SEQ ID NO: 3272032 - RNA, 20 nt, Vaccinia virus
guacacaauaucauaaacaa

SEQ ID NO: 3272033 - RNA, 12 nt, Vaccinia virus
agaaaugauauc

SEQ ID NO: 3272034 - RNA, 17 nt, Vaccinia virus
uaaaagacaaaucuugu

SEQ ID NO: 3272035 - RNA, 21 nt, Vaccinia virus
aaacguauauagaugucaaug

SEQ ID NO: 3272036 - RNA, 17 nt, Vaccinia virus
aauggaucuaguauuau

SEQ ID NO: 3272037 - RNA, 17 nt, Vaccinia virus
ggucacacguguagaau

SEQ ID NO: 3272038 - RNA, 16 nt, Vaccinia virus
auaucuaauuucugua

SEQ ID NO: 3272039 - RNA, 15 nt, Vaccinia virus
guaaaacauaaagga

SEQ ID NO: 3272040 - RNA, 19 nt, Vaccinia virus
agagacuuuauaacagaua

SEQ ID NO: 3272041 - RNA, 19 nt, Vaccinia virus
uuacauugcucguaaaaga

SEQ ID NO: 3272042 - RNA, 17 nt, Vaccinia virus
cauugaucuauuauuua

SEQ ID NO: 3272043 - RNA, 23 nt, Vaccinia virus
cuauaaagucugucaaaucaucu

SEQ ID NO: 3272044 - RNA, 18 nt, Vaccinia virus
gaauaaacaaaauaaugu

SEQ ID NO: 3272045 - RNA, 20 nt, Vaccinia virus
agaauauacucaauagaauu

SEQ ID NO: 3272046 - RNA, 22 nt, Vaccinia virus
auuaugacgucagccauagcau

SEQ ID NO: 3272047 - RNA, 16 nt, Vaccinia virus
aagcuucguuguagaa

SEQ ID NO: 3272048 - RNA, 13 nt, Vaccinia virus
uauugauuuacua

SEQ ID NO: 3272049 - RNA, 18 nt, Vaccinia virus
guacuguaaaaacaaauu

SEQ ID NO: 3272050 - RNA, 21 nt, Vaccinia virus
cuacuaaaagaucaaccaaaa

SEQ ID NO: 3272051 - RNA, 16 nt, Vaccinia virus
caaauaaaauucugau

SEQ ID NO: 3272052 - RNA, 18 nt, Vaccinia virus
auauaccuauuaauacau

SEQ ID NO: 3272053 - RNA, 20 nt, Vaccinia virus
cacaauagcgcuuaaucuca

SEQ ID NO: 3272054 - RNA, 15 nt, Vaccinia virus
aagaaauuaauaaag

SEQ ID NO: 3272055 - RNA, 14 nt, Vaccinia virus
ccuaaagguaaaug

SEQ ID NO: 3272056 - RNA, 14 nt, Vaccinia virus
acgaaucaagugau

SEQ ID NO: 3272057 - RNA, 17 nt, Vaccinia virus
cauuuauuggagacgua

SEQ ID NO: 3272058 - RNA, 16 nt, Vaccinia virus
aaacaaaauuagaaag

SEQ ID NO: 3272059 - RNA, 14 nt, Vaccinia virus
gaaaauauauucua

SEQ ID NO: 3272060 - RNA, 15 nt, Vaccinia virus
aacucgguuaacaug

SEQ ID NO: 3272061 - RNA, 15 nt, Vaccinia virus
auaaauuuauucucu

SEQ ID NO: 3272062 - RNA, 18 nt, Vaccinia virus
ugauaauuauaccaagga

SEQ ID NO: 3272063 - RNA, 20 nt, Vaccinia virus
cuauaucuauguuuuuagau

SEQ ID NO: 3272064 - RNA, 14 nt, Vaccinia virus
ggaguuauaugaau

SEQ ID NO: 3272065 - RNA, 20 nt, Vaccinia virus
guaacuccagaacaucuucc

SEQ ID NO: 3272066 - RNA, 13 nt, Vaccinia virus
uuaucauuuucca

SEQ ID NO: 3272067 - RNA, 17 nt, Vaccinia virus
uguaucgaaaaacuuua

SEQ ID NO: 3272068 - RNA, 12 nt, Vaccinia virus
auuaucaguaau

SEQ ID NO: 3272069 - RNA, 13 nt, Vaccinia virus
agaucaaaacaaa

SEQ ID NO: 3272070 - RNA, 18 nt, Vaccinia virus
uaucuaauuucuguauau

SEQ ID NO: 3272071 - RNA, 20 nt, Vaccinia virus
cuggaauagaaucuauuuua

SEQ ID NO: 3272072 - RNA, 13 nt, Vaccinia virus
ugaaauagaagau

SEQ ID NO: 3272073 - RNA, 12 nt, Vaccinia virus
ucguaaauacuc

SEQ ID NO: 3272074 - RNA, 15 nt, Vaccinia virus
aggauugauggugaa

SEQ ID NO: 3272075 - RNA, 18 nt, Vaccinia virus
caaauuuaccacuagaac

SEQ ID NO: 3272076 - RNA, 13 nt, Vaccinia virus
uagaaucaaagga

SEQ ID NO: 3272077 - RNA, 19 nt, Vaccinia virus
guaucgcauuaauacuguu

SEQ ID NO: 3272078 - RNA, 19 nt, Vaccinia virus
cuaucuaugcgguagauag

SEQ ID NO: 3272079 - RNA, 20 nt, Vaccinia virus
aucuaucagaguccauguau

SEQ ID NO: 3272080 - RNA, 14 nt, Vaccinia virus
gagauuaaaugcaa

SEQ ID NO: 3272081 - RNA, 15 nt, Vaccinia virus
aguauucaagucaaa

SEQ ID NO: 3272082 - RNA, 22 nt, Vaccinia virus
cagauugaauaggaguuugaau

SEQ ID NO: 3272083 - RNA, 21 nt, Vaccinia virus
caucaucaaaagacuuaugau

SEQ ID NO: 3272084 - RNA, 15 nt, Vaccinia virus
aacucuaaucaaaau

SEQ ID NO: 3272085 - RNA, 23 nt, Vaccinia virus
augauucauuuuuuaaguauuug

SEQ ID NO: 3272086 - RNA, 15 nt, Vaccinia virus
aacuucguaaaauau

SEQ ID NO: 3272087 - RNA, 15 nt, Vaccinia virus
aauugaaugucauga

SEQ ID NO: 3272088 - RNA, 15 nt, Vaccinia virus
cacgagaacuauuaa

SEQ ID NO: 3272089 - RNA, 22 nt, Vaccinia virus
guccuauaugcaugauagauuu

SEQ ID NO: 3272090 - RNA, 20 nt, Vaccinia virus
uuccaauaucugagcuaucu

SEQ ID NO: 3272091 - RNA, 13 nt, Vaccinia virus
ugugaguaguguu

SEQ ID NO: 3272092 - RNA, 20 nt, Vaccinia virus
agguaaaguaggacauaaua

SEQ ID NO: 3272093 - RNA, 13 nt, Vaccinia virus
uugauaauaaucc

SEQ ID NO: 3272094 - RNA, 16 nt, Vaccinia virus
auaauacaaaugacua

SEQ ID NO: 3272095 - RNA, 13 nt, Vaccinia virus
uguuaauguauua

SEQ ID NO: 3272096 - RNA, 18 nt, Vaccinia virus
acggcaugauaaaaugaa

SEQ ID NO: 3272097 - RNA, 18 nt, Vaccinia virus
gccaaacucauucacuuu

SEQ ID NO: 3272098 - RNA, 16 nt, Vaccinia virus
aucaaucauauuacau

SEQ ID NO: 3272099 - RNA, 15 nt, Vaccinia virus
ucuauguauuuagua

SEQ ID NO: 3272100 - RNA, 16 nt, Vaccinia virus
guaacacaauaaagga

SEQ ID NO: 3272101 - RNA, 12 nt, Vaccinia virus
gcucuagauauu

SEQ ID NO: 3272102 - RNA, 21 nt, Vaccinia virus
auucaucuacgcgauaauaga

SEQ ID NO: 3272103 - RNA, 23 nt, Vaccinia virus
ucaauacaaaacauaaaaaacaa

SEQ ID NO: 3272104 - RNA, 23 nt, Vaccinia virus
aaagcuauuaucaaauacuguac

SEQ ID NO: 3272105 - RNA, 16 nt, Vaccinia virus
uguggaucugaagaag

SEQ ID NO: 3272106 - RNA, 17 nt, Vaccinia virus
uuaucgauauugaagau

SEQ ID NO: 3272107 - RNA, 17 nt, Vaccinia virus
aaauuguccuauauaau

SEQ ID NO: 3272108 - RNA, 13 nt, Vaccinia virus
uaauauagaagau

SEQ ID NO: 3272109 - RNA, 17 nt, Vaccinia virus
aacacuuuccugauuua

SEQ ID NO: 3272110 - RNA, 20 nt, Vaccinia virus
cuagacuaacuaucucuuuc

SEQ ID NO: 3272111 - RNA, 18 nt, Vaccinia virus
cuuugauguggauacauc

SEQ ID NO: 3272112 - RNA, 16 nt, Vaccinia virus
caacuuuauuagauaa

SEQ ID NO: 3272113 - RNA, 13 nt, Vaccinia virus
auauauuguuuca

SEQ ID NO: 3272114 - RNA, 19 nt, Vaccinia virus
uuugaauuaguuuauaauu

SEQ ID NO: 3272115 - RNA, 14 nt, Vaccinia virus
acccgcaauuauua

SEQ ID NO: 3272116 - RNA, 14 nt, Vaccinia virus
ccaucuaacaaaaa

SEQ ID NO: 3272117 - RNA, 13 nt, Vaccinia virus
agaauguuuacca

SEQ ID NO: 3272118 - RNA, 20 nt, Vaccinia virus
cuagauagaguauuaaauau

SEQ ID NO: 3272119 - RNA, 16 nt, Vaccinia virus
cuguucuccguguggu

SEQ ID NO: 3272120 - RNA, 21 nt, Vaccinia virus
guuuggagacuaauucuuucu

SEQ ID NO: 3272121 - RNA, 15 nt, Vaccinia virus
aauguucucaagaac

SEQ ID NO: 3272122 - RNA, 15 nt, Vaccinia virus
guaaaccguuuuuaa

SEQ ID NO: 3272123 - RNA, 18 nt, Vaccinia virus
ucaaucaaacaaaaaagc

SEQ ID NO: 3272124 - RNA, 23 nt, Vaccinia virus
uaucaauaacgcaaucaugauuu

SEQ ID NO: 3272125 - RNA, 12 nt, Vaccinia virus
aauacaauaauu

SEQ ID NO: 3272126 - RNA, 23 nt, Vaccinia virus
caacauacuguuuagaugauauu

SEQ ID NO: 3272127 - RNA, 17 nt, Vaccinia virus
aucuaggaauuacauaa

SEQ ID NO: 3272128 - RNA, 19 nt, Vaccinia virus
agcauugaaaauacguucu

SEQ ID NO: 3272129 - RNA, 21 nt, Vaccinia virus
aaaacuugucuguauauguaa

SEQ ID NO: 3272130 - RNA, 22 nt, Vaccinia virus
uagagauaaaacaaguuuucau

SEQ ID NO: 3272131 - RNA, 21 nt, Vaccinia virus
uaauaacuagcuuaaacagau

SEQ ID NO: 3272132 - RNA, 17 nt, Vaccinia virus
auaucggaauaaguaga

SEQ ID NO: 3272133 - RNA, 22 nt, Vaccinia virus
guacacauauggaauauaucua

SEQ ID NO: 3272134 - RNA, 21 nt, Vaccinia virus
uuacuuuagaaggaaaaucau

SEQ ID NO: 3272135 - RNA, 23 nt, Vaccinia virus
agguguuccggagaaucaguaaa

SEQ ID NO: 3272136 - RNA, 15 nt, Vaccinia virus
guuuguuuuggaaau

SEQ ID NO: 3272137 - RNA, 23 nt, Vaccinia virus
ucuacaucuuccuucuuauucuu

SEQ ID NO: 3272138 - RNA, 17 nt, Vaccinia virus
gaagaagaugacaaucu

SEQ ID NO: 3272139 - RNA, 22 nt, Vaccinia virus
augucauaaacuguaaaugauu

SEQ ID NO: 3272140 - RNA, 17 nt, Vaccinia virus
uauauaauaaauacuuu

SEQ ID NO: 3272141 - RNA, 21 nt, Vaccinia virus
agaacguaaaauacauaugac

SEQ ID NO: 3272142 - RNA, 13 nt, Vaccinia virus
agauaauauaccg

SEQ ID NO: 3272143 - RNA, 14 nt, Vaccinia virus
cuauauauuuugau

SEQ ID NO: 3272144 - RNA, 16 nt, Vaccinia virus
agauguuuaaugauac

SEQ ID NO: 3272145 - RNA, 17 nt, Vaccinia virus
agacauaugauaaaacg

SEQ ID NO: 3272146 - RNA, 15 nt, Vaccinia virus
aaugucucucauaau

SEQ ID NO: 3272147 - RNA, 18 nt, Vaccinia virus
ugagaaugagauucaaaa

SEQ ID NO: 3272148 - RNA, 11 nt, Vaccinia virus
guauauacaug

SEQ ID NO: 3272149 - RNA, 12 nt, Vaccinia virus
aggaaaaguauu

SEQ ID NO: 3272150 - RNA, 21 nt, Vaccinia virus
gucgcuauaauucauauuaau

SEQ ID NO: 3272151 - RNA, 13 nt, Vaccinia virus
ugugauaugaaca

SEQ ID NO: 3272152 - RNA, 21 nt, Vaccinia virus
aacucugauuauugucuaaua

SEQ ID NO: 3272153 - RNA, 14 nt, Vaccinia virus
uaggaguaauagaa

SEQ ID NO: 3272154 - RNA, 11 nt, Vaccinia virus
ucccagcauua

SEQ ID NO: 3272155 - RNA, 16 nt, Vaccinia virus
aaggcauuuggucuau

SEQ ID NO: 3272156 - RNA, 12 nt, Vaccinia virus
ucugaauuauuc

SEQ ID NO: 3272157 - RNA, 17 nt, Vaccinia virus
uucaauugauaagacac

SEQ ID NO: 3272158 - RNA, 18 nt, Vaccinia virus
uacaauauauucucauag

SEQ ID NO: 3272159 - RNA, 13 nt, Vaccinia virus
auucauauagaac

SEQ ID NO: 3272160 - RNA, 18 nt, Vaccinia virus
caguauaccucaaaaauu

SEQ ID NO: 3272161 - RNA, 16 nt, Vaccinia virus
aguugucuaguauuua

SEQ ID NO: 3272162 - RNA, 15 nt, Vaccinia virus
cuauaaaaauggauu

SEQ ID NO: 3272163 - RNA, 17 nt, Vaccinia virus
augaauuccucugaaaa

SEQ ID NO: 3272164 - RNA, 11 nt, Vaccinia virus
agaaaacauuu

SEQ ID NO: 3272165 - RNA, 16 nt, Vaccinia virus
cgaaauacaaaauguu

SEQ ID NO: 3272166 - RNA, 18 nt, Vaccinia virus
cuacagguugcagcauag

SEQ ID NO: 3272167 - RNA, 17 nt, Vaccinia virus
cauaaacauguccaaua

SEQ ID NO: 3272168 - RNA, 20 nt, Vaccinia virus
aauguauaacaaauacagaa

SEQ ID NO: 3272169 - RNA, 20 nt, Vaccinia virus
agugauacccgcaauuauua

SEQ ID NO: 3272170 - RNA, 21 nt, Vaccinia virus
agucaugcuuauugauaaaga

SEQ ID NO: 3272171 - RNA, 15 nt, Vaccinia virus
auuaauacacauaau

SEQ ID NO: 3272172 - RNA, 20 nt, Vaccinia virus
aaguuucaaacuguugacuu

SEQ ID NO: 3272173 - RNA, 14 nt, Vaccinia virus
ucauauuuagauuu

SEQ ID NO: 3272174 - RNA, 20 nt, Vaccinia virus
auauuaaaaauucacacauu

SEQ ID NO: 3272175 - RNA, 17 nt, Vaccinia virus
aucaaaauagcaaagua

SEQ ID NO: 3272176 - RNA, 17 nt, Vaccinia virus
aguuaaaauuuuaagau

SEQ ID NO: 3272177 - RNA, 15 nt, Vaccinia virus
uuuuugacuuacaua

SEQ ID NO: 3272178 - RNA, 19 nt, Vaccinia virus
uagacuguuuguagaaugc

SEQ ID NO: 3272179 - RNA, 16 nt, Vaccinia virus
agcacaucaaaugaug

SEQ ID NO: 3272180 - RNA, 21 nt, Vaccinia virus
acaaucaagaagauagcuucu

SEQ ID NO: 3272181 - RNA, 16 nt, Vaccinia virus
aucucuuaacaaaaau

SEQ ID NO: 3272182 - RNA, 18 nt, Vaccinia virus
uuuaaucccuuuuucaga

SEQ ID NO: 3272183 - RNA, 16 nt, Vaccinia virus
uauguuuuaaauauca

SEQ ID NO: 3272184 - RNA, 15 nt, Vaccinia virus
agcauagaggaugaa

SEQ ID NO: 3272185 - RNA, 23 nt, Vaccinia virus
acaauauuuaguuuauucauaau

SEQ ID NO: 3272186 - RNA, 24 nt, Vaccinia virus
aguguuuagcguggcuagaauagu

SEQ ID NO: 3272187 - RNA, 19 nt, Vaccinia virus
aaaauuguaacaacaaugu

SEQ ID NO: 3272188 - RNA, 13 nt, Vaccinia virus
aagaggauuuucu

SEQ ID NO: 3272189 - RNA, 16 nt, Vaccinia virus
gaagaauggaugauau

SEQ ID NO: 3272190 - RNA, 15 nt, Vaccinia virus
acauauuaaaaauuc

SEQ ID NO: 3272191 - RNA, 14 nt, Vaccinia virus
acaaaucuggaaaa

SEQ ID NO: 3272192 - RNA, 14 nt, Vaccinia virus
agacuccugguaau

SEQ ID NO: 3272193 - RNA, 18 nt, Vaccinia virus
auuucucucauaaauaca

SEQ ID NO: 3272194 - RNA, 18 nt, Vaccinia virus
aaucaugacguaaaugua

SEQ ID NO: 3272195 - RNA, 13 nt, Vaccinia virus
aaagaugauauau

SEQ ID NO: 3272196 - RNA, 13 nt, Vaccinia virus
caauaaacaaaau

SEQ ID NO: 3272197 - RNA, 19 nt, Vaccinia virus
ugcuagacaccuuuucaau

SEQ ID NO: 3272198 - RNA, 22 nt, Vaccinia virus
augccuauuaggacagauacua

SEQ ID NO: 3272199 - RNA, 21 nt, Vaccinia virus
uagaauguuaucgaugaugua

SEQ ID NO: 3272200 - RNA, 16 nt, Vaccinia virus
ggaguaucuauuuuaa

SEQ ID NO: 3272201 - RNA, 15 nt, Vaccinia virus
uauuacaaccaaugu

SEQ ID NO: 3272202 - RNA, 22 nt, Vaccinia virus
acuuuuuguuuauauuaaauau

SEQ ID NO: 3272203 - RNA, 20 nt, Vaccinia virus
ucuccgcaauacauuucuca

SEQ ID NO: 3272204 - RNA, 21 nt, Vaccinia virus
uugcucggcgucaacgcugga

SEQ ID NO: 3272205 - RNA, 11 nt, Vaccinia virus
gcauagauaua

SEQ ID NO: 3272206 - RNA, 12 nt, Vaccinia virus
uuucaucaagau

SEQ ID NO: 3272207 - RNA, 13 nt, Vaccinia virus
cacuagaugauuu

SEQ ID NO: 3272208 - RNA, 19 nt, Vaccinia virus
auggacgaauuaggagaac

SEQ ID NO: 3272209 - RNA, 23 nt, Vaccinia virus
cuacaagacaaagauuuaucaga

SEQ ID NO: 3272210 - RNA, 17 nt, Vaccinia virus
aucggauacagacacuc

SEQ ID NO: 3272211 - RNA, 15 nt, Vaccinia virus
aucuguaaacauuug

SEQ ID NO: 3272212 - RNA, 18 nt, Vaccinia virus
cguguaaggcguaucuag

SEQ ID NO: 3272213 - RNA, 18 nt, Vaccinia virus
auaaucuaaaauaguucu

SEQ ID NO: 3272214 - RNA, 23 nt, Vaccinia virus
auaaaaauguucuuuuuguguga

SEQ ID NO: 3272215 - RNA, 15 nt, Vaccinia virus
uagcuguucaagaau

SEQ ID NO: 3272216 - RNA, 15 nt, Vaccinia virus
auuauaaugaauauu

SEQ ID NO: 3272217 - RNA, 15 nt, Vaccinia virus
cauuuuuuuaaaacu

SEQ ID NO: 3272218 - RNA, 19 nt, Vaccinia virus
uaguauauugagaguguau

SEQ ID NO: 3272219 - RNA, 20 nt, Vaccinia virus
cauaauguaaagauauucua

SEQ ID NO: 3272220 - RNA, 20 nt, Vaccinia virus
agccacuauagaguuucuaa

SEQ ID NO: 3272221 - RNA, 23 nt, Vaccinia virus
gcagauuguugccguaaauccug

SEQ ID NO: 3272222 - RNA, 20 nt, Vaccinia virus
acuguggaugugacagacug

SEQ ID NO: 3272223 - RNA, 23 nt, Vaccinia virus
ucgacucauaagaaagagaauag

SEQ ID NO: 3272224 - RNA, 18 nt, Vaccinia virus
auuaucucccauaaucuu

SEQ ID NO: 3272225 - RNA, 17 nt, Vaccinia virus
aagauuccauuaucuaa

SEQ ID NO: 3272226 - RNA, 22 nt, Vaccinia virus
uuaucgguaacaucuuuguaaa

SEQ ID NO: 3272227 - RNA, 23 nt, Vaccinia virus
aguguagugagagagcaugaagg

SEQ ID NO: 3272228 - RNA, 13 nt, Vaccinia virus
aguaaauaauaaa

SEQ ID NO: 3272229 - RNA, 14 nt, Vaccinia virus
uacauuucucaaau

SEQ ID NO: 3272230 - RNA, 21 nt, Vaccinia virus
auaacuauugauguuacacca

SEQ ID NO: 3272231 - RNA, 14 nt, Vaccinia virus
acgcauccauccaa

SEQ ID NO: 3272232 - RNA, 14 nt, Vaccinia virus
cuuuaauguaugaa

SEQ ID NO: 3272233 - RNA, 15 nt, Vaccinia virus
ucauuuuauaauugu

SEQ ID NO: 3272234 - RNA, 14 nt, Vaccinia virus
cacauaagccauaa

SEQ ID NO: 3272235 - RNA, 21 nt, Vaccinia virus
gaaaaaauauuuuauuaguuu

SEQ ID NO: 3272236 - RNA, 22 nt, Vaccinia virus
acuguaucgauuucuacauaua

SEQ ID NO: 3272237 - RNA, 21 nt, Vaccinia virus
auuuccaaucuuugacaauuu

SEQ ID NO: 3272238 - RNA, 15 nt, Vaccinia virus
aaugauaaugauaca

SEQ ID NO: 3272239 - RNA, 23 nt, Vaccinia virus
gauauaucaaaauuagacuggag

SEQ ID NO: 3272240 - RNA, 21 nt, Vaccinia virus
uacaauccuucguuaucucug

SEQ ID NO: 3272241 - RNA, 20 nt, Vaccinia virus
auacccaaucucucucaaau

SEQ ID NO: 3272242 - RNA, 20 nt, Vaccinia virus
acauacucuuaaaauuggau

SEQ ID NO: 3272243 - RNA, 23 nt, Vaccinia virus
augaucaagaaggaaaucaaauc

SEQ ID NO: 3272244 - RNA, 14 nt, Vaccinia virus
gucaauauucuguu

SEQ ID NO: 3272245 - RNA, 23 nt, Vaccinia virus
caacuauaucgacauauuucauu

SEQ ID NO: 3272246 - RNA, 19 nt, Vaccinia virus
gcuaugauaaucagaucau

SEQ ID NO: 3272247 - RNA, 16 nt, Vaccinia virus
caaacauuauguagua

SEQ ID NO: 3272248 - RNA, 14 nt, Vaccinia virus
acacuaucuuuauu

SEQ ID NO: 3272249 - RNA, 14 nt, Vaccinia virus
cugccauggaugga

SEQ ID NO: 3272250 - RNA, 20 nt, Vaccinia virus
acguaguuaaugaaacauuu

SEQ ID NO: 3272251 - RNA, 21 nt, Vaccinia virus
acacgaaagaaucaaaagaau

SEQ ID NO: 3272252 - RNA, 17 nt, Vaccinia virus
acaaucguauaucuucu

SEQ ID NO: 3272253 - RNA, 14 nt, Vaccinia virus
agcaaaauaauuaa

SEQ ID NO: 3272254 - RNA, 11 nt, Vaccinia virus
ugcauucaaau

SEQ ID NO: 3272255 - RNA, 17 nt, Vaccinia virus
uagaaucguccauagca

SEQ ID NO: 3272256 - RNA, 20 nt, Vaccinia virus
agucuuuaaugaauuaacga

SEQ ID NO: 3272257 - RNA, 14 nt, Vaccinia virus
cacuauaugcaguu

SEQ ID NO: 3272258 - RNA, 22 nt, Vaccinia virus
uauacauagauauuaauuauca

SEQ ID NO: 3272259 - RNA, 19 nt, Vaccinia virus
agauacuacagaaacuaau

SEQ ID NO: 3272260 - RNA, 19 nt, Vaccinia virus
uaacaauaucaauaaauuu

SEQ ID NO: 3272261 - RNA, 22 nt, Vaccinia virus
acugauuaaugagaucuucuau

SEQ ID NO: 3272262 - RNA, 14 nt, Vaccinia virus
auccacaauuauug

SEQ ID NO: 3272263 - RNA, 22 nt, Vaccinia virus
ucugaaauccguagaaacaucu

SEQ ID NO: 3272264 - RNA, 18 nt, Vaccinia virus
acuucuuggaaugauacu

SEQ ID NO: 3272265 - RNA, 20 nt, Vaccinia virus
gcuuagcuaauccugauauu

SEQ ID NO: 3272266 - RNA, 20 nt, Vaccinia virus
auuaaaucauuaaaugauug

SEQ ID NO: 3272267 - RNA, 20 nt, Vaccinia virus
uggaccaccgacuguaacau

SEQ ID NO: 3272268 - RNA, 22 nt, Vaccinia virus
aauaguuuacagauauuuucca

SEQ ID NO: 3272269 - RNA, 17 nt, Vaccinia virus
uugugggcaacugucua

SEQ ID NO: 3272270 - RNA, 17 nt, Vaccinia virus
ucgauaacuguagucuu

SEQ ID NO: 3272271 - RNA, 16 nt, Vaccinia virus
auucacaauaaaauuc

SEQ ID NO: 3272272 - RNA, 22 nt, Vaccinia virus
ccaaccgaauggaguaaaauaa

SEQ ID NO: 3272273 - RNA, 17 nt, Vaccinia virus
aaaaugcugaagcaaua

SEQ ID NO: 3272274 - RNA, 15 nt, Vaccinia virus
cuaauauuuuuagau

SEQ ID NO: 3272275 - RNA, 13 nt, Vaccinia virus
guuaaauguuuua

SEQ ID NO: 3272276 - RNA, 14 nt, Vaccinia virus
ucuuucguacaucu

SEQ ID NO: 3272277 - RNA, 12 nt, Vaccinia virus
auauauuguuaa

SEQ ID NO: 3272278 - RNA, 18 nt, Vaccinia virus
uauaccuuguaauuaaau

SEQ ID NO: 3272279 - RNA, 17 nt, Vaccinia virus
uaaauagagagauauca

SEQ ID NO: 3272280 - RNA, 20 nt, Vaccinia virus
acacguagcaugugaauaua

SEQ ID NO: 3272281 - RNA, 19 nt, Vaccinia virus
acaacgagagauauuuuca

SEQ ID NO: 3272282 - RNA, 17 nt, Vaccinia virus
uuaaacauggcauuaau

SEQ ID NO: 3272283 - RNA, 19 nt, Vaccinia virus
auauuaaaaauucacacau

SEQ ID NO: 3272284 - RNA, 19 nt, Vaccinia virus
ugagauaaauaucaucaau

SEQ ID NO: 3272285 - RNA, 14 nt, Vaccinia virus
auuuauauaugcau

SEQ ID NO: 3272286 - RNA, 14 nt, Vaccinia virus
gugcuuaauguuuc

SEQ ID NO: 3272287 - RNA, 13 nt, Vaccinia virus
gaaauauauuguu

SEQ ID NO: 3272288 - RNA, 18 nt, Vaccinia virus
aggggauuggcauuuaac

SEQ ID NO: 3272289 - RNA, 12 nt, Vaccinia virus
gaacuaauacau

SEQ ID NO: 3272290 - RNA, 14 nt, Vaccinia virus
agcggauaaugaua

SEQ ID NO: 3272291 - RNA, 19 nt, Vaccinia virus
aacauuauucuauuucgaa

SEQ ID NO: 3272292 - RNA, 16 nt, Vaccinia virus
caagucuggaaaacug

SEQ ID NO: 3272293 - RNA, 21 nt, Vaccinia virus
caaagaaacaucaaguagaaa

SEQ ID NO: 3272294 - RNA, 14 nt, Vaccinia virus
guauucaacaugcu

SEQ ID NO: 3272295 - RNA, 20 nt, Vaccinia virus
agauuagacauaucagauga

SEQ ID NO: 3272296 - RNA, 15 nt, Vaccinia virus
ugcuuaauguuucca

SEQ ID NO: 3272297 - RNA, 16 nt, Vaccinia virus
uauuguuuauuaucua

SEQ ID NO: 3272298 - RNA, 18 nt, Vaccinia virus
uguuaauaaguaaaugaa

SEQ ID NO: 3272299 - RNA, 16 nt, Vaccinia virus
ucuauacguuucuauu

SEQ ID NO: 3272300 - RNA, 23 nt, Vaccinia virus
aauacucauuuucuuuuggaaaa

SEQ ID NO: 3272301 - RNA, 16 nt, Vaccinia virus
augaauauaguaauua

SEQ ID NO: 3272302 - RNA, 22 nt, Vaccinia virus
gccuuauucucuggagaaaaga

SEQ ID NO: 3272303 - RNA, 22 nt, Vaccinia virus
ucauuaaauguuucaucagaaa

SEQ ID NO: 3272304 - RNA, 22 nt, Vaccinia virus
ucagaaagcugggggauguucu

SEQ ID NO: 3272305 - RNA, 16 nt, Vaccinia virus
aagcucuaaauccaaa

SEQ ID NO: 3272306 - RNA, 14 nt, Vaccinia virus
agcguaaaaguaaa

SEQ ID NO: 3272307 - RNA, 16 nt, Vaccinia virus
ugcucggcaauaacua

SEQ ID NO: 3272308 - RNA, 16 nt, Vaccinia virus
auucuagauacaagau

SEQ ID NO: 3272309 - RNA, 14 nt, Vaccinia virus
agaaugaauguuua

SEQ ID NO: 3272310 - RNA, 12 nt, Vaccinia virus
cgcauuaaugag

SEQ ID NO: 3272311 - RNA, 18 nt, Vaccinia virus
aacgacguagauaguaau

SEQ ID NO: 3272312 - RNA, 23 nt, Vaccinia virus
ucugaucuuaacuccucuauuaa

SEQ ID NO: 3272313 - RNA, 15 nt, Vaccinia virus
aaagcaucauacgaa

SEQ ID NO: 3272314 - RNA, 23 nt, Vaccinia virus
gucaaauuccaaauuuuuuucau

SEQ ID NO: 3272315 - RNA, 16 nt, Vaccinia virus
uguauuaaaauacuuu

SEQ ID NO: 3272316 - RNA, 19 nt, Vaccinia virus
cugucaauugauucuuauu

SEQ ID NO: 3272317 - RNA, 15 nt, Vaccinia virus
ucauuguuacauaaa

SEQ ID NO: 3272318 - RNA, 15 nt, Vaccinia virus
aagauguuuagaaaa

SEQ ID NO: 3272319 - RNA, 16 nt, Vaccinia virus
caaucuagcauuucua

SEQ ID NO: 3272320 - RNA, 18 nt, Vaccinia virus
agaauauguauaucaauu

SEQ ID NO: 3272321 - RNA, 18 nt, Vaccinia virus
uuggcacgaacaaaagga

SEQ ID NO: 3272322 - RNA, 21 nt, Vaccinia virus
auggaauuaucaucaaaaaac

SEQ ID NO: 3272323 - RNA, 15 nt, Vaccinia virus
gaaccauuacaaaua

SEQ ID NO: 3272324 - RNA, 15 nt, Vaccinia virus
aauaagaauaaaaug

SEQ ID NO: 3272325 - RNA, 22 nt, Vaccinia virus
uaaauguuuugauuucaauuua

SEQ ID NO: 3272326 - RNA, 16 nt, Vaccinia virus
uaaacucagauaauag

SEQ ID NO: 3272327 - RNA, 12 nt, Vaccinia virus
uaaaaauuauug

SEQ ID NO: 3272328 - RNA, 13 nt, Vaccinia virus
uguucacauccuu

SEQ ID NO: 3272329 - RNA, 21 nt, Vaccinia virus
agugcuauggaacaaaacaau

SEQ ID NO: 3272330 - RNA, 18 nt, Vaccinia virus
aucgauucccauaugaug

SEQ ID NO: 3272331 - RNA, 22 nt, Vaccinia virus
agacgacucgagccuuuauuau

SEQ ID NO: 3272332 - RNA, 15 nt, Vaccinia virus
agcaaucagaaauga

SEQ ID NO: 3272333 - RNA, 14 nt, Vaccinia virus
ccaguuauaaaaca

SEQ ID NO: 3272334 - RNA, 18 nt, Vaccinia virus
aaaaguuccagaaaaugu

SEQ ID NO: 3272335 - RNA, 24 nt, Vaccinia virus
auaacauuuauuaucaugaugaca

SEQ ID NO: 3272336 - RNA, 20 nt, Vaccinia virus
agguacuauaauauuaaaaa

SEQ ID NO: 3272337 - RNA, 22 nt, Vaccinia virus
ucaucugggaauaaaauacuac

SEQ ID NO: 3272338 - RNA, 13 nt, Vaccinia virus
ucccauugaucau

SEQ ID NO: 3272339 - RNA, 12 nt, Vaccinia virus
gcauaauacaau

SEQ ID NO: 3272340 - RNA, 14 nt, Vaccinia virus
ccacuuuugcuuua

SEQ ID NO: 3272341 - RNA, 22 nt, Vaccinia virus
aucuuaccauguccucaaauaa

SEQ ID NO: 3272342 - RNA, 18 nt, Vaccinia virus
auguuagaaaaaaugaug

SEQ ID NO: 3272343 - RNA, 18 nt, Vaccinia virus
uucauguuuauaaaaaug

SEQ ID NO: 3272344 - RNA, 14 nt, Vaccinia virus
uucgcaucguauuu

SEQ ID NO: 3272345 - RNA, 22 nt, Vaccinia virus
uaauuugauaauaaaucaaaau

SEQ ID NO: 3272346 - RNA, 20 nt, Vaccinia virus
ucuucgaaaagaaacagaua

SEQ ID NO: 3272347 - RNA, 15 nt, Vaccinia virus
uuauuacuuuuggaa

SEQ ID NO: 3272348 - RNA, 18 nt, Vaccinia virus
agaacaaaaucuaacaga

SEQ ID NO: 3272349 - RNA, 21 nt, Vaccinia virus
gacauuguaaaagacaaauau

SEQ ID NO: 3272350 - RNA, 18 nt, Vaccinia virus
caaacugcaaauguagua

SEQ ID NO: 3272351 - RNA, 17 nt, Vaccinia virus
aauuauucguuuacuga

SEQ ID NO: 3272352 - RNA, 18 nt, Vaccinia virus
uaaguacaucaucuggaa

SEQ ID NO: 3272353 - RNA, 17 nt, Vaccinia virus
acaaauggucaaugaua

SEQ ID NO: 3272354 - RNA, 15 nt, Vaccinia virus
auuaugaaacuauau

SEQ ID NO: 3272355 - RNA, 16 nt, Vaccinia virus
uaaccuccugaaaaug

SEQ ID NO: 3272356 - RNA, 20 nt, Vaccinia virus
auaauauagagguguuuuau

SEQ ID NO: 3272357 - RNA, 20 nt, Vaccinia virus
auucagacacuucuuaacga

SEQ ID NO: 3272358 - RNA, 13 nt, Vaccinia virus
ugaauguuuucaa

SEQ ID NO: 3272359 - RNA, 18 nt, Vaccinia virus
ggaauaaauuauuaucca

SEQ ID NO: 3272360 - RNA, 21 nt, Vaccinia virus
uuucgauucuggcuauuucaa

SEQ ID NO: 3272361 - RNA, 21 nt, Vaccinia virus
uaaauaguuuuuuuguuuccu

SEQ ID NO: 3272362 - RNA, 21 nt, Vaccinia virus
aucauccaccuguuuuaacau

SEQ ID NO: 3272363 - RNA, 22 nt, Vaccinia virus
guaaauagaaucguauaauguc

SEQ ID NO: 3272364 - RNA, 19 nt, Vaccinia virus
aaguggugccgucaaacaa

SEQ ID NO: 3272365 - RNA, 18 nt, Vaccinia virus
cauggaacaauaaaagag

SEQ ID NO: 3272366 - RNA, 19 nt, Vaccinia virus
augacuaucuauauauacc

SEQ ID NO: 3272367 - RNA, 18 nt, Vaccinia virus
caaugcucaguaaaugua

SEQ ID NO: 3272368 - RNA, 20 nt, Vaccinia virus
aaaucaagucuagaauauau

SEQ ID NO: 3272369 - RNA, 23 nt, Vaccinia virus
gugcauaaauuaagauacaacaa

SEQ ID NO: 3272370 - RNA, 17 nt, Vaccinia virus
aaaauucuaagguagaa

SEQ ID NO: 3272371 - RNA, 13 nt, Vaccinia virus
auaaauguuguaa

SEQ ID NO: 3272372 - RNA, 13 nt, Vaccinia virus
auaauuguuguau

SEQ ID NO: 3272373 - RNA, 20 nt, Vaccinia virus
gaaagacagccauagccaaa

SEQ ID NO: 3272374 - RNA, 12 nt, Vaccinia virus
cugcugaaaaua

SEQ ID NO: 3272375 - RNA, 21 nt, Vaccinia virus
acugucuggcaauaaaugaua

SEQ ID NO: 3272376 - RNA, 12 nt, Vaccinia virus
uuuuauuuaauu

SEQ ID NO: 3272377 - RNA, 20 nt, Vaccinia virus
acuguugaaguacuuaauga

SEQ ID NO: 3272378 - RNA, 15 nt, Vaccinia virus
ucaacaaaacucaaa

SEQ ID NO: 3272379 - RNA, 21 nt, Vaccinia virus
guaugucccaauauuaaugca

SEQ ID NO: 3272380 - RNA, 24 nt, Vaccinia virus
ccacuaauucucauuaaaugguua

SEQ ID NO: 3272381 - RNA, 22 nt, Vaccinia virus
caaaaguaguucaacauaauau

SEQ ID NO: 3272382 - RNA, 17 nt, Vaccinia virus
auaacuaaauuaacaau

SEQ ID NO: 3272383 - RNA, 18 nt, Vaccinia virus
acaucuaccuuauuuccc

SEQ ID NO: 3272384 - RNA, 19 nt, Vaccinia virus
ucaaauggauaauuuaaga

SEQ ID NO: 3272385 - RNA, 18 nt, Vaccinia virus
gaacgaagaucuuuucuc

SEQ ID NO: 3272386 - RNA, 17 nt, Vaccinia virus
agauaauauuagacaua

SEQ ID NO: 3272387 - RNA, 17 nt, Vaccinia virus
aacauuuauuaucauga

SEQ ID NO: 3272388 - RNA, 20 nt, Vaccinia virus
ucugcaaacuuaacagcucu

SEQ ID NO: 3272389 - RNA, 15 nt, Vaccinia virus
caguauaccaaacau

SEQ ID NO: 3272390 - RNA, 22 nt, Vaccinia virus
uaaugcaggguguauauuauua

SEQ ID NO: 3272391 - RNA, 15 nt, Vaccinia virus
cuaggauuuaaacaa

SEQ ID NO: 3272392 - RNA, 21 nt, Vaccinia virus
uuauauggaacacgauuauua

SEQ ID NO: 3272393 - RNA, 21 nt, Vaccinia virus
auauuaggcacagucaaacau

SEQ ID NO: 3272394 - RNA, 15 nt, Vaccinia virus
gaacuauauaaugaa

SEQ ID NO: 3272395 - RNA, 21 nt, Vaccinia virus
uugaauuaaugguguuccauu

SEQ ID NO: 3272396 - RNA, 14 nt, Vaccinia virus
uauaaauagauguu

SEQ ID NO: 3272397 - RNA, 21 nt, Vaccinia virus
aauauuguuuugcugucucaa

SEQ ID NO: 3272398 - RNA, 17 nt, Vaccinia virus
uuaauacguucauuaaa

SEQ ID NO: 3272399 - RNA, 18 nt, Vaccinia virus
ugaacauaaaacuaauau

SEQ ID NO: 3272400 - RNA, 16 nt, Vaccinia virus
gauguguuuagaaaau

SEQ ID NO: 3272401 - RNA, 14 nt, Vaccinia virus
gaucucauauuaaa

SEQ ID NO: 3272402 - RNA, 15 nt, Vaccinia virus
uuauaaucaaagauu

SEQ ID NO: 3272403 - RNA, 23 nt, Vaccinia virus
ucuaauaaguagaguccucauga

SEQ ID NO: 3272404 - RNA, 18 nt, Vaccinia virus
uagccgcgguaacuuuua

SEQ ID NO: 3272405 - RNA, 22 nt, Vaccinia virus
aauaguucaacaucuacuuuug

SEQ ID NO: 3272406 - RNA, 20 nt, Vaccinia virus
uagaugaaauacucuucaaa

SEQ ID NO: 3272407 - RNA, 21 nt, Vaccinia virus
gaauauuagguaaagauauuu

SEQ ID NO: 3272408 - RNA, 14 nt, Vaccinia virus
agauacaucuauau

SEQ ID NO: 3272409 - RNA, 17 nt, Vaccinia virus
uuuuaucgauucuaaug

SEQ ID NO: 3272410 - RNA, 18 nt, Vaccinia virus
cuaaaccuucuuauucua

SEQ ID NO: 3272411 - RNA, 22 nt, Vaccinia virus
cauuguccagauugaacauaca

SEQ ID NO: 3272412 - RNA, 19 nt, Vaccinia virus
auaccuuuaacuucuggaa

SEQ ID NO: 3272413 - RNA, 16 nt, Vaccinia virus
acgucaucaaaaauag

SEQ ID NO: 3272414 - RNA, 15 nt, Vaccinia virus
gcugacuagcauauu

SEQ ID NO: 3272415 - RNA, 14 nt, Vaccinia virus
agauucuaauggau

SEQ ID NO: 3272416 - RNA, 18 nt, Vaccinia virus
uaauauacaauuaucauu

SEQ ID NO: 3272417 - RNA, 19 nt, Vaccinia virus
aucuagaugcggugaucag

SEQ ID NO: 3272418 - RNA, 14 nt, Vaccinia virus
uuaacgauaucuug

SEQ ID NO: 3272419 - RNA, 19 nt, Vaccinia virus
aacaaggcgauuauaaagu

SEQ ID NO: 3272420 - RNA, 14 nt, Vaccinia virus
uaagaaugugauaa

SEQ ID NO: 3272421 - RNA, 22 nt, Vaccinia virus
uauaaaaacauuuuauuucuag

SEQ ID NO: 3272422 - RNA, 15 nt, Vaccinia virus
gauaaaauuaaugag

SEQ ID NO: 3272423 - RNA, 14 nt, Vaccinia virus
uaacaaauuuccua

SEQ ID NO: 3272424 - RNA, 22 nt, Vaccinia virus
cauagauccaguagauccuaau

SEQ ID NO: 3272425 - RNA, 20 nt, Vaccinia virus
gucuaaguauagaucaaaag

SEQ ID NO: 3272426 - RNA, 20 nt, Vaccinia virus
cuucuauuuuaucauuuucc

SEQ ID NO: 3272427 - RNA, 13 nt, Vaccinia virus
guaauuacuuauc

SEQ ID NO: 3272428 - RNA, 22 nt, Vaccinia virus
uagaaauaagagacuuaaacaa

SEQ ID NO: 3272429 - RNA, 12 nt, Vaccinia virus
uacuaucaaaau

SEQ ID NO: 3272430 - RNA, 22 nt, Vaccinia virus
uuaauuuuuaguuuauacuauu

SEQ ID NO: 3272431 - RNA, 24 nt, Vaccinia virus
caauugguagaguuuuauaacgaa

SEQ ID NO: 3272432 - RNA, 17 nt, Vaccinia virus
aauguuguuaaaugauc

SEQ ID NO: 3272433 - RNA, 14 nt, Vaccinia virus
uauguugacaugua

SEQ ID NO: 3272434 - RNA, 18 nt, Vaccinia virus
uauuguauccauacauac

SEQ ID NO: 3272435 - RNA, 13 nt, Vaccinia virus
cauuguaaauuua

SEQ ID NO: 3272436 - RNA, 15 nt, Vaccinia virus
uuuggauuuggaaaa

SEQ ID NO: 3272437 - RNA, 18 nt, Vaccinia virus
cgaagagacgauagauuu

SEQ ID NO: 3272438 - RNA, 15 nt, Vaccinia virus
cuucaauaacuuaua

SEQ ID NO: 3272439 - RNA, 16 nt, Vaccinia virus
cuucucuauuguuuag

SEQ ID NO: 3272440 - RNA, 13 nt, Vaccinia virus
gaaaaaugaugaa

SEQ ID NO: 3272441 - RNA, 15 nt, Vaccinia virus
uucgauauucucauu

SEQ ID NO: 3272442 - RNA, 23 nt, Vaccinia virus
cagggaacggcuaaaaguauuuu

SEQ ID NO: 3272443 - RNA, 14 nt, Vaccinia virus
auaccauuucuagu

SEQ ID NO: 3272444 - RNA, 16 nt, Vaccinia virus
aauauuuuuuauaaaa

SEQ ID NO: 3272445 - RNA, 16 nt, Vaccinia virus
aguuauuaagcaauau

SEQ ID NO: 3272446 - RNA, 23 nt, Vaccinia virus
uaucuaauuugauauaaugaauu

SEQ ID NO: 3272447 - RNA, 21 nt, Vaccinia virus
uauguccauuaaaguuaaauu

SEQ ID NO: 3272448 - RNA, 17 nt, Vaccinia virus
acuauaauaguacuaga

SEQ ID NO: 3272449 - RNA, 17 nt, Vaccinia virus
ccaauauagucuguguu

SEQ ID NO: 3272450 - RNA, 19 nt, Vaccinia virus
uauggaagaagaaauaaag

SEQ ID NO: 3272451 - RNA, 12 nt, Vaccinia virus
acguuuuaucca

SEQ ID NO: 3272452 - RNA, 15 nt, Vaccinia virus
gaagagauguuauau

SEQ ID NO: 3272453 - RNA, 18 nt, Vaccinia virus
aagaugauaaaaacauuu

SEQ ID NO: 3272454 - RNA, 14 nt, Vaccinia virus
gaagacuccuggua

SEQ ID NO: 3272455 - RNA, 16 nt, Vaccinia virus
uaaaaccaacuaauau

SEQ ID NO: 3272456 - RNA, 12 nt, Vaccinia virus
uguuuuaacauc

SEQ ID NO: 3272457 - RNA, 16 nt, Vaccinia virus
gauaagauaaaaucua

SEQ ID NO: 3272458 - RNA, 18 nt, Vaccinia virus
ucugacaauauuuaguuu

SEQ ID NO: 3272459 - RNA, 17 nt, Vaccinia virus
auaaugaugaccuauau

SEQ ID NO: 3272460 - RNA, 17 nt, Vaccinia virus
aacuacucgaacagaua

SEQ ID NO: 3272461 - RNA, 13 nt, Vaccinia virus
cuucuauuucuaa

SEQ ID NO: 3272462 - RNA, 22 nt, Vaccinia virus
agagcuaccgaaggagauacua

SEQ ID NO: 3272463 - RNA, 20 nt, Vaccinia virus
auacagaagauuuaacuaga

SEQ ID NO: 3272464 - RNA, 17 nt, Vaccinia virus
gaacaauuuuaaaucau

SEQ ID NO: 3272465 - RNA, 14 nt, Vaccinia virus
uacaucuacuauau

SEQ ID NO: 3272466 - RNA, 18 nt, Vaccinia virus
auaauuauaucacaacau

SEQ ID NO: 3272467 - RNA, 22 nt, Vaccinia virus
uauuucuucgcuuuauauacca

SEQ ID NO: 3272468 - RNA, 22 nt, Vaccinia virus
ugagauacuaacacauuucaac

SEQ ID NO: 3272469 - RNA, 19 nt, Vaccinia virus
guaauucgcgugauaaaau

SEQ ID NO: 3272470 - RNA, 19 nt, Vaccinia virus
auaauccggauguugugua

SEQ ID NO: 3272471 - RNA, 23 nt, Vaccinia virus
aauaauacaauauuuuucguuua

SEQ ID NO: 3272472 - RNA, 12 nt, Vaccinia virus
uaaucuauuuua

SEQ ID NO: 3272473 - RNA, 14 nt, Vaccinia virus
auuauguuuaaaga

SEQ ID NO: 3272474 - RNA, 16 nt, Vaccinia virus
uacgucuauacagaua

SEQ ID NO: 3272475 - RNA, 18 nt, Vaccinia virus
uugauuuuaaaauuaaaa

SEQ ID NO: 3272476 - RNA, 14 nt, Vaccinia virus
aggauaucucaaaa

SEQ ID NO: 3272477 - RNA, 23 nt, Vaccinia virus
ucuaaauaauaucuauuguuugg

SEQ ID NO: 3272478 - RNA, 21 nt, Vaccinia virus
uauuucuuucaugacugauuu

SEQ ID NO: 3272479 - RNA, 22 nt, Vaccinia virus
caauacugcgacuuuguuaaug

SEQ ID NO: 3272480 - RNA, 14 nt, Vaccinia virus
accuguauguacaa

SEQ ID NO: 3272481 - RNA, 17 nt, Vaccinia virus
cauaguuuuucauaauu

SEQ ID NO: 3272482 - RNA, 23 nt, Vaccinia virus
aacuuuauccauaucucuagaua

SEQ ID NO: 3272483 - RNA, 13 nt, Vaccinia virus
ugaugaauuaaug

SEQ ID NO: 3272484 - RNA, 19 nt, Vaccinia virus
acuggucauagaaaaugau

SEQ ID NO: 3272485 - RNA, 23 nt, Vaccinia virus
uauagauaaagaguccuauauau

SEQ ID NO: 3272486 - RNA, 14 nt, Vaccinia virus
cgacuaucguguuu

SEQ ID NO: 3272487 - RNA, 20 nt, Vaccinia virus
uuuccauggcccauucuauu

SEQ ID NO: 3272488 - RNA, 21 nt, Vaccinia virus
cuucuaaugagcaaguagaaa

SEQ ID NO: 3272489 - RNA, 15 nt, Vaccinia virus
auuaggaaauguuuc

SEQ ID NO: 3272490 - RNA, 20 nt, Vaccinia virus
auuaaagacuuaagacuuaa

SEQ ID NO: 3272491 - RNA, 22 nt, Vaccinia virus
gccccaggaucuccaacaaauu

SEQ ID NO: 3272492 - RNA, 14 nt, Vaccinia virus
uuaucuauuaucca

SEQ ID NO: 3272493 - RNA, 14 nt, Vaccinia virus
acaauccaauaaua

SEQ ID NO: 3272494 - RNA, 12 nt, Vaccinia virus
uauuuuaucauu

SEQ ID NO: 3272495 - RNA, 12 nt, Vaccinia virus
uuaauuaucuaa

SEQ ID NO: 3272496 - RNA, 21 nt, Vaccinia virus
ucuaucgaauguagcucugau

SEQ ID NO: 3272497 - RNA, 16 nt, Vaccinia virus
cucuaaacaaggaaac

SEQ ID NO: 3272498 - RNA, 14 nt, Vaccinia virus
uauauuguuucaua

SEQ ID NO: 3272499 - RNA, 13 nt, Vaccinia virus
aucacaaacauua

SEQ ID NO: 3272500 - RNA, 21 nt, Vaccinia virus
gaucuauuagaaaauucucuu

SEQ ID NO: 3272501 - RNA, 19 nt, Vaccinia virus
uaccuauuaauacaucgua

SEQ ID NO: 3272502 - RNA, 22 nt, Vaccinia virus
aaacacgucgaagguuaacauc

SEQ ID NO: 3272503 - RNA, 13 nt, Vaccinia virus
aauauuauuuccc

SEQ ID NO: 3272504 - RNA, 22 nt, Vaccinia virus
ugaagcauucuuuccagaacua

SEQ ID NO: 3272505 - RNA, 22 nt, Vaccinia virus
aauuaugaaaaaguaaaugaug

SEQ ID NO: 3272506 - RNA, 21 nt, Vaccinia virus
ucuaaaaauguuaauuuugaa

SEQ ID NO: 3272507 - RNA, 18 nt, Vaccinia virus
agacgauuccaacaaacg

SEQ ID NO: 3272508 - RNA, 18 nt, Vaccinia virus
ugcacuuaaagucuacau

SEQ ID NO: 3272509 - RNA, 13 nt, Vaccinia virus
agacuaacacaca

SEQ ID NO: 3272510 - RNA, 19 nt, Vaccinia virus
aauaaucccgcaauucauu

SEQ ID NO: 3272511 - RNA, 13 nt, Vaccinia virus
agaagcaacuuau

SEQ ID NO: 3272512 - RNA, 20 nt, Vaccinia virus
caauaaauguuuaaacauca

SEQ ID NO: 3272513 - RNA, 17 nt, Vaccinia virus
acuauauauagaaacuu

SEQ ID NO: 3272514 - RNA, 15 nt, Vaccinia virus
auuagauacauagau

SEQ ID NO: 3272515 - RNA, 15 nt, Vaccinia virus
caaauguuaaacauu

SEQ ID NO: 3272516 - RNA, 17 nt, Vaccinia virus
ucgauacauuaacucuc

SEQ ID NO: 3272517 - RNA, 15 nt, Vaccinia virus
ugauaguuucucauu

SEQ ID NO: 3272518 - RNA, 17 nt, Vaccinia virus
caguaguaauuaaugaa

SEQ ID NO: 3272519 - RNA, 22 nt, Vaccinia virus
acucauaaaauacaagagaaug

SEQ ID NO: 3272520 - RNA, 12 nt, Vaccinia virus
uuauuuaacaug

SEQ ID NO: 3272521 - RNA, 17 nt, Vaccinia virus
ucaauacggccauccag

SEQ ID NO: 3272522 - RNA, 15 nt, Vaccinia virus
uugauggaaaaauuc

SEQ ID NO: 3272523 - RNA, 15 nt, Vaccinia virus
auaguuucuauuuuu

SEQ ID NO: 3272524 - RNA, 13 nt, Vaccinia virus
auauuucauauac

SEQ ID NO: 3272525 - RNA, 15 nt, Vaccinia virus
ccaugaucuauaaag

SEQ ID NO: 3272526 - RNA, 22 nt, Vaccinia virus
aagaauaauccuauaucacuuc

SEQ ID NO: 3272527 - RNA, 17 nt, Vaccinia virus
uaugauaguuuuaacau

SEQ ID NO: 3272528 - RNA, 16 nt, Vaccinia virus
uaaaauuuauaacauu

SEQ ID NO: 3272529 - RNA, 14 nt, Vaccinia virus
uuagaaaguauuuu

SEQ ID NO: 3272530 - RNA, 19 nt, Vaccinia virus
ucaguguggguacaaauau

SEQ ID NO: 3272531 - RNA, 17 nt, Vaccinia virus
cguaucuauaaucaucu

SEQ ID NO: 3272532 - RNA, 16 nt, Vaccinia virus
aguauuccaauaucug

SEQ ID NO: 3272533 - RNA, 20 nt, Vaccinia virus
cacauuggugcuauccauuu

SEQ ID NO: 3272534 - RNA, 22 nt, Vaccinia virus
augcuugauaagauaaaaucua

SEQ ID NO: 3272535 - RNA, 23 nt, Vaccinia virus
guaaauaguuuuacguuauuaau

SEQ ID NO: 3272536 - RNA, 19 nt, Vaccinia virus
guaugucgauauacuuauc

SEQ ID NO: 3272537 - RNA, 14 nt, Vaccinia virus
auuaacuaucugua

SEQ ID NO: 3272538 - RNA, 21 nt, Vaccinia virus
auacaauaauucagauaaugu

SEQ ID NO: 3272539 - RNA, 24 nt, Vaccinia virus
auuaugacgucagccauagcauca

SEQ ID NO: 3272540 - RNA, 18 nt, Vaccinia virus
ucaucagauaagauuuua

SEQ ID NO: 3272541 - RNA, 16 nt, Vaccinia virus
cgucuacaaaaaacuu

SEQ ID NO: 3272542 - RNA, 20 nt, Vaccinia virus
cgagagacuuuguagaaaca

SEQ ID NO: 3272543 - RNA, 17 nt, Vaccinia virus
cggagaagaauugguaa

SEQ ID NO: 3272544 - RNA, 23 nt, Vaccinia virus
uucuucauuuauggguaucaaaa

SEQ ID NO: 3272545 - RNA, 19 nt, Vaccinia virus
uagugacggacuuaacaug

SEQ ID NO: 3272546 - RNA, 13 nt, Vaccinia virus
agagaaugauaua

SEQ ID NO: 3272547 - RNA, 20 nt, Vaccinia virus
ccagggaaauuaaagaagaa

SEQ ID NO: 3272548 - RNA, 14 nt, Vaccinia virus
acauuguuaauuga

SEQ ID NO: 3272549 - RNA, 17 nt, Vaccinia virus
agaaaugagaaacuguu

SEQ ID NO: 3272550 - RNA, 16 nt, Vaccinia virus
guguauuaauagauuu

SEQ ID NO: 3272551 - RNA, 20 nt, Vaccinia virus
aggucuaccgcauacgaaau

SEQ ID NO: 3272552 - RNA, 23 nt, Vaccinia virus
cuaauucacaauacgauuuagau

SEQ ID NO: 3272553 - RNA, 21 nt, Vaccinia virus
auauaccgccucaaacucuau

SEQ ID NO: 3272554 - RNA, 21 nt, Vaccinia virus
aauucuauccaagauacuuau

SEQ ID NO: 3272555 - RNA, 13 nt, Vaccinia virus
aaacaaaaaaaag

SEQ ID NO: 3272556 - RNA, 18 nt, Vaccinia virus
aaacucucuauuucuuaa

SEQ ID NO: 3272557 - RNA, 21 nt, Vaccinia virus
gauucuaacgacaucucucgc

SEQ ID NO: 3272558 - RNA, 12 nt, Vaccinia virus
cuaaacuagugg

SEQ ID NO: 3272559 - RNA, 15 nt, Vaccinia virus
agaucuaaauacaaa

SEQ ID NO: 3272560 - RNA, 23 nt, Vaccinia virus
guguauauuuaucucuucauuau

SEQ ID NO: 3272561 - RNA, 13 nt, Vaccinia virus
auaaaaauauauu

SEQ ID NO: 3272562 - RNA, 22 nt, Vaccinia virus
auuucuuuuuucuggcauaacu

SEQ ID NO: 3272563 - RNA, 23 nt, Vaccinia virus
uauuuuuaauagcugcucuuugu

SEQ ID NO: 3272564 - RNA, 15 nt, Vaccinia virus
cggaacaucaauuau

SEQ ID NO: 3272565 - RNA, 17 nt, Vaccinia virus
agugaaacaaucaagaa

SEQ ID NO: 3272566 - RNA, 14 nt, Vaccinia virus
uuugacuuacauaa

SEQ ID NO: 3272567 - RNA, 19 nt, Vaccinia virus
uguagaagguucauauguu

SEQ ID NO: 3272568 - RNA, 13 nt, Vaccinia virus
ucaaagauaauag

SEQ ID NO: 3272569 - RNA, 18 nt, Vaccinia virus
gcaauuagauccaaagaa

SEQ ID NO: 3272570 - RNA, 14 nt, Vaccinia virus
ucuuaucaauaaca

SEQ ID NO: 3272571 - RNA, 17 nt, Vaccinia virus
uaaccaccucucuggaa

SEQ ID NO: 3272572 - RNA, 18 nt, Vaccinia virus
caucuauaggugaugcug

SEQ ID NO: 3272573 - RNA, 20 nt, Vaccinia virus
uauuuucuggaaguggauau

SEQ ID NO: 3272574 - RNA, 15 nt, Vaccinia virus
cauuaauacaguaag

SEQ ID NO: 3272575 - RNA, 16 nt, Vaccinia virus
cuuggaaaagauaacu

SEQ ID NO: 3272576 - RNA, 16 nt, Vaccinia virus
uauaagauuguagaau

SEQ ID NO: 3272577 - RNA, 13 nt, Vaccinia virus
aagaagagaauua

SEQ ID NO: 3272578 - RNA, 23 nt, Vaccinia virus
aggauuuaaacaaaaaaguuauc

SEQ ID NO: 3272579 - RNA, 23 nt, Vaccinia virus
agaguucuuacacauaucacugu

SEQ ID NO: 3272580 - RNA, 20 nt, Vaccinia virus
gauguugauuaggucuuuua

SEQ ID NO: 3272581 - RNA, 23 nt, Vaccinia virus
aucugacucauggauucauuaau

SEQ ID NO: 3272582 - RNA, 18 nt, Vaccinia virus
aauuuucuauacauagau

SEQ ID NO: 3272583 - RNA, 16 nt, Vaccinia virus
uuuaauacuuauucau

SEQ ID NO: 3272584 - RNA, 19 nt, Vaccinia virus
auuacaaacuauagaaauu

SEQ ID NO: 3272585 - RNA, 18 nt, Vaccinia virus
acuuuacuuuucuaaauu

SEQ ID NO: 3272586 - RNA, 20 nt, Vaccinia virus
auaaacuaggauuuaaacaa

SEQ ID NO: 3272587 - RNA, 22 nt, Vaccinia virus
cauagguggagucuuuaucaau

SEQ ID NO: 3272588 - RNA, 22 nt, Vaccinia virus
ggcggauguugugaaugacauc

SEQ ID NO: 3272589 - RNA, 22 nt, Vaccinia virus
uuuguaaauaacuaucuauaaa

SEQ ID NO: 3272590 - RNA, 18 nt, Vaccinia virus
auccgggugaaauuauuc

SEQ ID NO: 3272591 - RNA, 12 nt, Vaccinia virus
uuuguacauuuu

SEQ ID NO: 3272592 - RNA, 21 nt, Vaccinia virus
cuacaaaagcaauuauuacaa

SEQ ID NO: 3272593 - RNA, 15 nt, Vaccinia virus
auugagaagaagcua

SEQ ID NO: 3272594 - RNA, 20 nt, Vaccinia virus
uuugguacguugauuucuag

SEQ ID NO: 3272595 - RNA, 15 nt, Vaccinia virus
auauaaccauuuucu

SEQ ID NO: 3272596 - RNA, 22 nt, Vaccinia virus
aaugaccaguuugcaauaugca

SEQ ID NO: 3272597 - RNA, 12 nt, Vaccinia virus
agagauuuuacu

SEQ ID NO: 3272598 - RNA, 14 nt, Vaccinia virus
ugaugcaugcgaua

SEQ ID NO: 3272599 - RNA, 23 nt, Vaccinia virus
gaacuauaaaaacagauaaugau

SEQ ID NO: 3272600 - RNA, 13 nt, Vaccinia virus
agcauuaauacag

SEQ ID NO: 3272601 - RNA, 15 nt, Vaccinia virus
gaguucauuaaaaua

SEQ ID NO: 3272602 - RNA, 12 nt, Vaccinia virus
auagauuugcau

SEQ ID NO: 3272603 - RNA, 13 nt, Vaccinia virus
acauuuuuaaaga

SEQ ID NO: 3272604 - RNA, 14 nt, Vaccinia virus
auucuuaucaauaa

SEQ ID NO: 3272605 - RNA, 16 nt, Vaccinia virus
agcaguuuauuaucca

SEQ ID NO: 3272606 - RNA, 17 nt, Vaccinia virus
agaucaucaaaauaugu

SEQ ID NO: 3272607 - RNA, 21 nt, Vaccinia virus
aaaauaccaucaucauagcau

SEQ ID NO: 3272608 - RNA, 15 nt, Vaccinia virus
gaauauauguuuaua

SEQ ID NO: 3272609 - RNA, 15 nt, Vaccinia virus
aagcccaaaaccaaa

SEQ ID NO: 3272610 - RNA, 19 nt, Vaccinia virus
uguauucgucuuucugaau

SEQ ID NO: 3272611 - RNA, 19 nt, Vaccinia virus
uaucuacauauuuaccaaa

SEQ ID NO: 3272612 - RNA, 15 nt, Vaccinia virus
agaauggaugauauu

SEQ ID NO: 3272613 - RNA, 13 nt, Vaccinia virus
auuaucaaaauuu

SEQ ID NO: 3272614 - RNA, 20 nt, Vaccinia virus
cgaaucaagugauucagaaa

SEQ ID NO: 3272615 - RNA, 13 nt, Vaccinia virus
ccugaccauccau

SEQ ID NO: 3272616 - RNA, 23 nt, Vaccinia virus
aaauugcgacacuauucauguaa

SEQ ID NO: 3272617 - RNA, 14 nt, Vaccinia virus
uuaauaucaaacaa

SEQ ID NO: 3272618 - RNA, 19 nt, Vaccinia virus
auuacuaccuucagaaauu

SEQ ID NO: 3272619 - RNA, 16 nt, Vaccinia virus
cucauaugauuucagu

SEQ ID NO: 3272620 - RNA, 22 nt, Vaccinia virus
guaaacauugacggauaaaaca

SEQ ID NO: 3272621 - RNA, 18 nt, Vaccinia virus
uuaacaucuauuaaucau

SEQ ID NO: 3272622 - RNA, 13 nt, Vaccinia virus
uaauaagauaaau

SEQ ID NO: 3272623 - RNA, 18 nt, Vaccinia virus
agaaucaauacaaaaauu

SEQ ID NO: 3272624 - RNA, 12 nt, Vaccinia virus
ugacgaagagac

SEQ ID NO: 3272625 - RNA, 21 nt, Vaccinia virus
augaagggaucguuaaugaac

SEQ ID NO: 3272626 - RNA, 16 nt, Vaccinia virus
agggcuaaaugucuag

SEQ ID NO: 3272627 - RNA, 20 nt, Vaccinia virus
guauuugagaaauauguaua

SEQ ID NO: 3272628 - RNA, 11 nt, Vaccinia virus
cucuagaaaaa

SEQ ID NO: 3272629 - RNA, 15 nt, Vaccinia virus
caagucauaaaucau

SEQ ID NO: 3272630 - RNA, 22 nt, Vaccinia virus
uaugaauggauacuuguaugau

SEQ ID NO: 3272631 - RNA, 15 nt, Vaccinia virus
auacuaguuuucuaa

SEQ ID NO: 3272632 - RNA, 19 nt, Vaccinia virus
aaugaucucaauuagaaua

SEQ ID NO: 3272633 - RNA, 17 nt, Vaccinia virus
uauauaucauuuguaca

SEQ ID NO: 3272634 - RNA, 13 nt, Vaccinia virus
ucuaucaauaacu

SEQ ID NO: 3272635 - RNA, 19 nt, Vaccinia virus
uuauguguuauaagguacu

SEQ ID NO: 3272636 - RNA, 23 nt, Vaccinia virus
ucuucuugagaucccacaucauu

SEQ ID NO: 3272637 - RNA, 14 nt, Vaccinia virus
acaucaaaaaauua

SEQ ID NO: 3272638 - RNA, 19 nt, Vaccinia virus
aguaaguacaucaucugga

SEQ ID NO: 3272639 - RNA, 21 nt, Vaccinia virus
gcugagaauaucuuuauucau

SEQ ID NO: 3272640 - RNA, 21 nt, Vaccinia virus
auccuguugucuaaaucucuu

SEQ ID NO: 3272641 - RNA, 14 nt, Vaccinia virus
auuaauuaaccauu

SEQ ID NO: 3272642 - RNA, 22 nt, Vaccinia virus
uuccaggaucuagauaauuaau

SEQ ID NO: 3272643 - RNA, 16 nt, Vaccinia virus
aaauagauagaacuac

SEQ ID NO: 3272644 - RNA, 18 nt, Vaccinia virus
aauucagcgguaaagaua

SEQ ID NO: 3272645 - RNA, 17 nt, Vaccinia virus
aucaguuuuguauucca

SEQ ID NO: 3272646 - RNA, 19 nt, Vaccinia virus
accauuagauaaaguugau

SEQ ID NO: 3272647 - RNA, 17 nt, Vaccinia virus
uuaccggucauauuaau

SEQ ID NO: 3272648 - RNA, 16 nt, Vaccinia virus
uacgcauuuucaaaau

SEQ ID NO: 3272649 - RNA, 13 nt, Vaccinia virus
uacuucuguacaa

SEQ ID NO: 3272650 - RNA, 14 nt, Vaccinia virus
cauuauucuauuuc

SEQ ID NO: 3272651 - RNA, 19 nt, Vaccinia virus
ucuugagugcgaauguaau

SEQ ID NO: 3272652 - RNA, 13 nt, Vaccinia virus
ucguguucuacau

SEQ ID NO: 3272653 - RNA, 16 nt, Vaccinia virus
gacuaugggaauauau

SEQ ID NO: 3272654 - RNA, 14 nt, Vaccinia virus
uuagacuuguauuc

SEQ ID NO: 3272655 - RNA, 21 nt, Vaccinia virus
gcucuuuguccauuauuucua

SEQ ID NO: 3272656 - RNA, 14 nt, Vaccinia virus
gugguguaaucuua

SEQ ID NO: 3272657 - RNA, 23 nt, Vaccinia virus
uaugcuauaaaugaauucucauu

SEQ ID NO: 3272658 - RNA, 16 nt, Vaccinia virus
aauugaaucuuaguaa

SEQ ID NO: 3272659 - RNA, 17 nt, Vaccinia virus
gcgaaccgauuaaacau

SEQ ID NO: 3272660 - RNA, 21 nt, Vaccinia virus
aaucacugcgauuguauuauc

SEQ ID NO: 3272661 - RNA, 20 nt, Vaccinia virus
uagacuguuuguagaaugcu

SEQ ID NO: 3272662 - RNA, 22 nt, Vaccinia virus
cguuaauaggagcuagaagaac

SEQ ID NO: 3272663 - RNA, 17 nt, Vaccinia virus
gaugauuagauggagag

SEQ ID NO: 3272664 - RNA, 20 nt, Vaccinia virus
acuuaguauacaaaaaaaug

SEQ ID NO: 3272665 - RNA, 20 nt, Vaccinia virus
auuccacgaacuucuaauug

SEQ ID NO: 3272666 - RNA, 13 nt, Vaccinia virus
acgucauuucauc

SEQ ID NO: 3272667 - RNA, 17 nt, Vaccinia virus
uauuuuaauacauguau

SEQ ID NO: 3272668 - RNA, 16 nt, Vaccinia virus
cauccaugcagcauuu

SEQ ID NO: 3272669 - RNA, 20 nt, Vaccinia virus
cucguuaaacgccuuuagaa

SEQ ID NO: 3272670 - RNA, 19 nt, Vaccinia virus
uagauccucauaaguguau

SEQ ID NO: 3272671 - RNA, 23 nt, Vaccinia virus
aucaaggacuuuuauaucccaca

SEQ ID NO: 3272672 - RNA, 17 nt, Vaccinia virus
uggucaauuacaaauaa

SEQ ID NO: 3272673 - RNA, 14 nt, Vaccinia virus
aggacguaauacau

SEQ ID NO: 3272674 - RNA, 21 nt, Vaccinia virus
ucuuugaccaacgauuuagaa

SEQ ID NO: 3272675 - RNA, 13 nt, Vaccinia virus
ugcuacgcaaaua

SEQ ID NO: 3272676 - RNA, 15 nt, Vaccinia virus
caauaguugauuuuu

SEQ ID NO: 3272677 - RNA, 18 nt, Vaccinia virus
ggauuuggucauaauaga

SEQ ID NO: 3272678 - RNA, 17 nt, Vaccinia virus
uaguuaugauaaaugau

SEQ ID NO: 3272679 - RNA, 21 nt, Vaccinia virus
gacaauaguuucuauacuguc

SEQ ID NO: 3272680 - RNA, 13 nt, Vaccinia virus
agguauuuauuca

SEQ ID NO: 3272681 - RNA, 17 nt, Vaccinia virus
caauuauugggccagua

SEQ ID NO: 3272682 - RNA, 15 nt, Vaccinia virus
gaaauaaauaaugaa

SEQ ID NO: 3272683 - RNA, 18 nt, Vaccinia virus
uuuagaugaauuauuauu

SEQ ID NO: 3272684 - RNA, 17 nt, Vaccinia virus
cauuuauaucuuuagcu

SEQ ID NO: 3272685 - RNA, 14 nt, Vaccinia virus
uaaauuuaucuauu

SEQ ID NO: 3272686 - RNA, 22 nt, Vaccinia virus
aguacccacugaugagauguua

SEQ ID NO: 3272687 - RNA, 15 nt, Vaccinia virus
aacuaguauaaaauc

SEQ ID NO: 3272688 - RNA, 16 nt, Vaccinia virus
cguccgguaguauaau

SEQ ID NO: 3272689 - RNA, 18 nt, Vaccinia virus
aucaacuuuauuagauaa

SEQ ID NO: 3272690 - RNA, 18 nt, Vaccinia virus
agaacauauaaauguaga

SEQ ID NO: 3272691 - RNA, 15 nt, Vaccinia virus
uacaauauuuacauu

SEQ ID NO: 3272692 - RNA, 19 nt, Vaccinia virus
aacaggguuuguugauucg

SEQ ID NO: 3272693 - RNA, 14 nt, Vaccinia virus
uauaaauucucgag

SEQ ID NO: 3272694 - RNA, 14 nt, Vaccinia virus
aucaaguagaaauu

SEQ ID NO: 3272695 - RNA, 16 nt, Vaccinia virus
auauuagauuuuguau

SEQ ID NO: 3272696 - RNA, 16 nt, Vaccinia virus
aaggaauugaugaagu

SEQ ID NO: 3272697 - RNA, 13 nt, Vaccinia virus
auauaucuauugu

SEQ ID NO: 3272698 - RNA, 15 nt, Vaccinia virus
cguaucuaaaguauu

SEQ ID NO: 3272699 - RNA, 15 nt, Vaccinia virus
auacuggagaacuua

SEQ ID NO: 3272700 - RNA, 13 nt, Vaccinia virus
uccaauagauguc

SEQ ID NO: 3272701 - RNA, 22 nt, Vaccinia virus
cauuagccacguucacuguaaa

SEQ ID NO: 3272702 - RNA, 14 nt, Vaccinia virus
uuuauagaauuuag

SEQ ID NO: 3272703 - RNA, 20 nt, Vaccinia virus
auacacaucaaaauaauaaa

SEQ ID NO: 3272704 - RNA, 16 nt, Vaccinia virus
aucuauccauaugcau

SEQ ID NO: 3272705 - RNA, 23 nt, Vaccinia virus
uuacuuugaaacaggauuuccaa

SEQ ID NO: 3272706 - RNA, 22 nt, Vaccinia virus
gcaaaacugaaaauauauugau

SEQ ID NO: 3272707 - RNA, 16 nt, Vaccinia virus
uagcauuaauacagua

SEQ ID NO: 3272708 - RNA, 15 nt, Vaccinia virus
aaagauggcugaaau

SEQ ID NO: 3272709 - RNA, 18 nt, Vaccinia virus
aaguauuguuuugauaac

SEQ ID NO: 3272710 - RNA, 15 nt, Vaccinia virus
uaauccuaagaaaac

SEQ ID NO: 3272711 - RNA, 16 nt, Vaccinia virus
caaaaauauuaaaccu

SEQ ID NO: 3272712 - RNA, 21 nt, Vaccinia virus
cucuaaaugagucuacugcua

SEQ ID NO: 3272713 - RNA, 12 nt, Vaccinia virus
uuuccauaauaa

SEQ ID NO: 3272714 - RNA, 15 nt, Vaccinia virus
uugauauauuauuua

SEQ ID NO: 3272715 - RNA, 20 nt, Vaccinia virus
uugauccuagaacuagauau

SEQ ID NO: 3272716 - RNA, 13 nt, Vaccinia virus
gauaauaaaucaa

SEQ ID NO: 3272717 - RNA, 14 nt, Vaccinia virus
aauaacuagaucau

SEQ ID NO: 3272718 - RNA, 23 nt, Vaccinia virus
aauagacauaagaaauuugccaa

SEQ ID NO: 3272719 - RNA, 17 nt, Vaccinia virus
auucguuagcaaaauua

SEQ ID NO: 3272720 - RNA, 18 nt, Vaccinia virus
auuccaauguuuaacaag

SEQ ID NO: 3272721 - RNA, 23 nt, Vaccinia virus
agucagcuggucuaaaauuucca

SEQ ID NO: 3272722 - RNA, 21 nt, Vaccinia virus
uaucuuguuuagaaaaaugcu

SEQ ID NO: 3272723 - RNA, 15 nt, Vaccinia virus
guccguuauauaauc

SEQ ID NO: 3272724 - RNA, 21 nt, Vaccinia virus
uucuacaugcuccaauugaau

SEQ ID NO: 3272725 - RNA, 14 nt, Vaccinia virus
auuuacaauuauug

SEQ ID NO: 3272726 - RNA, 15 nt, Vaccinia virus
uuauaaaaauguucu

SEQ ID NO: 3272727 - RNA, 21 nt, Vaccinia virus
aauugaauugcgauuauaaga

SEQ ID NO: 3272728 - RNA, 15 nt, Vaccinia virus
cuuauuauauuuccc

SEQ ID NO: 3272729 - RNA, 20 nt, Vaccinia virus
uaacaucaucaaaagacuua

SEQ ID NO: 3272730 - RNA, 21 nt, Vaccinia virus
acuagugauagcauuaauaca

SEQ ID NO: 3272731 - RNA, 15 nt, Vaccinia virus
ugguuauuuacuaac

SEQ ID NO: 3272732 - RNA, 18 nt, Vaccinia virus
aagauaucuauacuuacu

SEQ ID NO: 3272733 - RNA, 23 nt, Vaccinia virus
augaaagauacaacaaauuaaac

SEQ ID NO: 3272734 - RNA, 18 nt, Vaccinia virus
acuacugccauuaauauc

SEQ ID NO: 3272735 - RNA, 20 nt, Vaccinia virus
acuacauucucauuaauuaa

SEQ ID NO: 3272736 - RNA, 15 nt, Vaccinia virus
aguuauaaguuugaa

SEQ ID NO: 3272737 - RNA, 21 nt, Vaccinia virus
auaaucguuuaccacuuaaau

SEQ ID NO: 3272738 - RNA, 14 nt, Vaccinia virus
agagauaacuauaa

SEQ ID NO: 3272739 - RNA, 19 nt, Vaccinia virus
uguuuacaguaguaaugaa

SEQ ID NO: 3272740 - RNA, 19 nt, Vaccinia virus
uaacgaguuccauuuauau

SEQ ID NO: 3272741 - RNA, 12 nt, Vaccinia virus
uuauaacuaaca

SEQ ID NO: 3272742 - RNA, 15 nt, Vaccinia virus
guaaccgaaucuucc

SEQ ID NO: 3272743 - RNA, 17 nt, Vaccinia virus
cuuauuacuuuuggaau

SEQ ID NO: 3272744 - RNA, 19 nt, Vaccinia virus
agcauaaacauaauaaaca

SEQ ID NO: 3272745 - RNA, 15 nt, Vaccinia virus
aaagacgaauacaua

SEQ ID NO: 3272746 - RNA, 19 nt, Vaccinia virus
guauaauuuuuauguuuua

SEQ ID NO: 3272747 - RNA, 18 nt, Vaccinia virus
agacuacguagacuguuu

SEQ ID NO: 3272748 - RNA, 15 nt, Vaccinia virus
aauaauaagaauaaa

SEQ ID NO: 3272749 - RNA, 19 nt, Vaccinia virus
aacgagauaucuuguuaca

SEQ ID NO: 3272750 - RNA, 20 nt, Vaccinia virus
aaaaacauuaacaagaauca

SEQ ID NO: 3272751 - RNA, 15 nt, Vaccinia virus
aucaucauuguguaa

SEQ ID NO: 3272752 - RNA, 15 nt, Vaccinia virus
uauuccaauguuuaa

SEQ ID NO: 3272753 - RNA, 15 nt, Vaccinia virus
ucuugguaauacuua

SEQ ID NO: 3272754 - RNA, 14 nt, Vaccinia virus
ccauugaaaacuau

SEQ ID NO: 3272755 - RNA, 14 nt, Vaccinia virus
aggagauuaaagga

SEQ ID NO: 3272756 - RNA, 22 nt, Vaccinia virus
ugauuuuguagaugccauauca

SEQ ID NO: 3272757 - RNA, 22 nt, Vaccinia virus
uauaacuaaacacguuaguguu

SEQ ID NO: 3272758 - RNA, 19 nt, Vaccinia virus
agcuauugcauaauacaag

SEQ ID NO: 3272759 - RNA, 18 nt, Vaccinia virus
uucagcauuacuugauau

SEQ ID NO: 3272760 - RNA, 14 nt, Vaccinia virus
acauuuaugauaug

SEQ ID NO: 3272761 - RNA, 17 nt, Vaccinia virus
aaauaggguuguguaua

SEQ ID NO: 3272762 - RNA, 24 nt, Vaccinia virus
uauaauuuaggaaugauuaucaaa

SEQ ID NO: 3272763 - RNA, 19 nt, Vaccinia virus
gaucugaugguaauccaau

SEQ ID NO: 3272764 - RNA, 16 nt, Vaccinia virus
auagaagauaucacau

SEQ ID NO: 3272765 - RNA, 19 nt, Vaccinia virus
aguagauuguuggcuacau

SEQ ID NO: 3272766 - RNA, 19 nt, Vaccinia virus
augauauaggggucuucau

SEQ ID NO: 3272767 - RNA, 21 nt, Vaccinia virus
agauaaagaguccuauauauu

SEQ ID NO: 3272768 - RNA, 13 nt, Vaccinia virus
uaggugaugaugc

SEQ ID NO: 3272769 - RNA, 15 nt, Vaccinia virus
agcuccugguauaug

SEQ ID NO: 3272770 - RNA, 15 nt, Vaccinia virus
uagcuuucauaguua

SEQ ID NO: 3272771 - RNA, 13 nt, Vaccinia virus
uguuuauuuucaa

SEQ ID NO: 3272772 - RNA, 20 nt, Vaccinia virus
gaauacaaucuguauuucau

SEQ ID NO: 3272773 - RNA, 18 nt, Vaccinia virus
uucuagucuuaaccaaaa

SEQ ID NO: 3272774 - RNA, 19 nt, Vaccinia virus
aguaagugcaacaucugga

SEQ ID NO: 3272775 - RNA, 18 nt, Vaccinia virus
cuuuugcggacauuuucu

SEQ ID NO: 3272776 - RNA, 14 nt, Vaccinia virus
uugaacauuauuga

SEQ ID NO: 3272777 - RNA, 13 nt, Vaccinia virus
aauauaaauggua

SEQ ID NO: 3272778 - RNA, 21 nt, Vaccinia virus
auggcaucuauuuuaaauaca

SEQ ID NO: 3272779 - RNA, 13 nt, Vaccinia virus
cuaacacauuuca

SEQ ID NO: 3272780 - RNA, 16 nt, Vaccinia virus
aaagacuaugcaaaga

SEQ ID NO: 3272781 - RNA, 21 nt, Vaccinia virus
augauugacgcauuuaauaga

SEQ ID NO: 3272782 - RNA, 22 nt, Vaccinia virus
aaauauugaacuaguaguacgu

SEQ ID NO: 3272783 - RNA, 16 nt, Vaccinia virus
agaauacgcauguuuu

SEQ ID NO: 3272784 - RNA, 19 nt, Vaccinia virus
uaaagcccucuauuagcau

SEQ ID NO: 3272785 - RNA, 19 nt, Vaccinia virus
uucucauugcuuauauuuu

SEQ ID NO: 3272786 - RNA, 21 nt, Vaccinia virus
agauaaauccaucuuccagaa

SEQ ID NO: 3272787 - RNA, 10 nt, Vaccinia virus
uugaaagaga

SEQ ID NO: 3272788 - RNA, 16 nt, Vaccinia virus
acucuacguaucucgu

SEQ ID NO: 3272789 - RNA, 17 nt, Vaccinia virus
guaaaaucaaacacaag

SEQ ID NO: 3272790 - RNA, 20 nt, Vaccinia virus
auauaucaucgacaaagaca

SEQ ID NO: 3272791 - RNA, 21 nt, Vaccinia virus
aucaucgaucauguuaaguaa

SEQ ID NO: 3272792 - RNA, 15 nt, Vaccinia virus
caagaggauggaauu

SEQ ID NO: 3272793 - RNA, 23 nt, Vaccinia virus
guuguuacauuaguaaucuuuuu

SEQ ID NO: 3272794 - RNA, 17 nt, Vaccinia virus
acgauuaccaauacuuu

SEQ ID NO: 3272795 - RNA, 22 nt, Vaccinia virus
guuuauaauuacaacauaauag

SEQ ID NO: 3272796 - RNA, 15 nt, Vaccinia virus
cuuugaagagauauu

SEQ ID NO: 3272797 - RNA, 19 nt, Vaccinia virus
uuguuaacgggcucguaaa

SEQ ID NO: 3272798 - RNA, 17 nt, Vaccinia virus
auccagucuuuaaugaa

SEQ ID NO: 3272799 - RNA, 14 nt, Vaccinia virus
uuuauacuucuaau

SEQ ID NO: 3272800 - RNA, 15 nt, Vaccinia virus
auauuucauauacua

SEQ ID NO: 3272801 - RNA, 16 nt, Vaccinia virus
uccuuugauuaucauc

SEQ ID NO: 3272802 - RNA, 23 nt, Vaccinia virus
guucuauguaucuaaaauaaugu

SEQ ID NO: 3272803 - RNA, 20 nt, Vaccinia virus
uuugauuugcuuugaaugau

SEQ ID NO: 3272804 - RNA, 17 nt, Vaccinia virus
uucaggaacauaaacaa

SEQ ID NO: 3272805 - RNA, 19 nt, Vaccinia virus
agcauaucacgaacuauau

SEQ ID NO: 3272806 - RNA, 17 nt, Vaccinia virus
uaagaccgaaauuauca

SEQ ID NO: 3272807 - RNA, 23 nt, Vaccinia virus
uguuugauuucucuaucgaugca

SEQ ID NO: 3272808 - RNA, 23 nt, Vaccinia virus
uccuuuaaaauauauucuaauau

SEQ ID NO: 3272809 - RNA, 16 nt, Vaccinia virus
cuauguuucaguuuaa

SEQ ID NO: 3272810 - RNA, 14 nt, Vaccinia virus
uuacgauagacuuu

SEQ ID NO: 3272811 - RNA, 13 nt, Vaccinia virus
acuuccauggaaa

SEQ ID NO: 3272812 - RNA, 23 nt, Vaccinia virus
cugaaugucgaaccuaucuagua

SEQ ID NO: 3272813 - RNA, 19 nt, Vaccinia virus
uuuuuaaagguaucuaaug

SEQ ID NO: 3272814 - RNA, 17 nt, Vaccinia virus
aaaauguugaugauauc

SEQ ID NO: 3272815 - RNA, 23 nt, Vaccinia virus
uucuagaaaacgaaaacauccua

SEQ ID NO: 3272816 - RNA, 15 nt, Vaccinia virus
aucaucaucugaaau

SEQ ID NO: 3272817 - RNA, 21 nt, Vaccinia virus
guagacgagccuagaaaucaa

SEQ ID NO: 3272818 - RNA, 17 nt, Vaccinia virus
cuagaaugaagauauca

SEQ ID NO: 3272819 - RNA, 17 nt, Vaccinia virus
auuaaauauagguauau

SEQ ID NO: 3272820 - RNA, 17 nt, Vaccinia virus
cguauucugaugauauu

SEQ ID NO: 3272821 - RNA, 20 nt, Vaccinia virus
gcgaacugaaggaaucaggu

SEQ ID NO: 3272822 - RNA, 15 nt, Vaccinia virus
uuaaucauguacaug

SEQ ID NO: 3272823 - RNA, 16 nt, Vaccinia virus
uuucguacauuuuuaa

SEQ ID NO: 3272824 - RNA, 20 nt, Vaccinia virus
gauacuccuuuguauguacc

SEQ ID NO: 3272825 - RNA, 18 nt, Vaccinia virus
aguauaacgugaauguau

SEQ ID NO: 3272826 - RNA, 17 nt, Vaccinia virus
guaugaggcaacauugu

SEQ ID NO: 3272827 - RNA, 20 nt, Vaccinia virus
auuuuaauaggaucuauaug

SEQ ID NO: 3272828 - RNA, 14 nt, Vaccinia virus
uucaaaguuucuga

SEQ ID NO: 3272829 - RNA, 21 nt, Vaccinia virus
gauaacuuuuucaauaucgua

SEQ ID NO: 3272830 - RNA, 13 nt, Vaccinia virus
aacaaucaagaag

SEQ ID NO: 3272831 - RNA, 15 nt, Vaccinia virus
uauaucccuuaaaaa

SEQ ID NO: 3272832 - RNA, 14 nt, Vaccinia virus
gauuauaugauaua

SEQ ID NO: 3272833 - RNA, 14 nt, Vaccinia virus
auaauaauauauau

SEQ ID NO: 3272834 - RNA, 14 nt, Vaccinia virus
augaaaaaaaacua

SEQ ID NO: 3272835 - RNA, 16 nt, Vaccinia virus
aacuauuucagaacau

SEQ ID NO: 3272836 - RNA, 13 nt, Vaccinia virus
auuuaauagagau

SEQ ID NO: 3272837 - RNA, 19 nt, Vaccinia virus
agaguugauuguaaauaca

SEQ ID NO: 3272838 - RNA, 12 nt, Vaccinia virus
agaaugcuguua

SEQ ID NO: 3272839 - RNA, 16 nt, Vaccinia virus
aauauuuuuuagagaa

SEQ ID NO: 3272840 - RNA, 13 nt, Vaccinia virus
gaccaauaauaaa

SEQ ID NO: 3272841 - RNA, 13 nt, Vaccinia virus
auacaauaucuuc

SEQ ID NO: 3272842 - RNA, 18 nt, Vaccinia virus
aauuuauuugauaaagga

SEQ ID NO: 3272843 - RNA, 16 nt, Vaccinia virus
auucuauuauauuaac

SEQ ID NO: 3272844 - RNA, 17 nt, Vaccinia virus
augucggaguuaauagc

SEQ ID NO: 3272845 - RNA, 13 nt, Vaccinia virus
auauauugucuaa

SEQ ID NO: 3272846 - RNA, 18 nt, Vaccinia virus
gauaaacacucauauuau

SEQ ID NO: 3272847 - RNA, 19 nt, Vaccinia virus
agauaaacuaggauuuaaa

SEQ ID NO: 3272848 - RNA, 18 nt, Vaccinia virus
aguucccgcauuaaauaa

SEQ ID NO: 3272849 - RNA, 19 nt, Vaccinia virus
uguuccaacucgugugcuc

SEQ ID NO: 3272850 - RNA, 16 nt, Vaccinia virus
cuguuaucuaaugaau

SEQ ID NO: 3272851 - RNA, 15 nt, Vaccinia virus
auaaauacauuuaca

SEQ ID NO: 3272852 - RNA, 13 nt, Vaccinia virus
uauggaaaacuaa

SEQ ID NO: 3272853 - RNA, 15 nt, Vaccinia virus
cuaugguacaaguug

SEQ ID NO: 3272854 - RNA, 23 nt, Vaccinia virus
uauuaauccuuucuucuugagau

SEQ ID NO: 3272855 - RNA, 12 nt, Vaccinia virus
uguuuaagaaaa

SEQ ID NO: 3272856 - RNA, 23 nt, Vaccinia virus
guauaacaugacauuuauucauc

SEQ ID NO: 3272857 - RNA, 19 nt, Vaccinia virus
uauugccauaauuuucaua

SEQ ID NO: 3272858 - RNA, 22 nt, Vaccinia virus
gcaucaacaauuacaaaugagu

SEQ ID NO: 3272859 - RNA, 16 nt, Vaccinia virus
ucguuguccuuuacau

SEQ ID NO: 3272860 - RNA, 16 nt, Vaccinia virus
aacgaaaaauuaucgu

SEQ ID NO: 3272861 - RNA, 12 nt, Vaccinia virus
gucaauacugua

SEQ ID NO: 3272862 - RNA, 13 nt, Vaccinia virus
agaaacauauucu

SEQ ID NO: 3272863 - RNA, 17 nt, Vaccinia virus
cugcguuaucaauaaau

SEQ ID NO: 3272864 - RNA, 17 nt, Vaccinia virus
uagccuuaagaaaacua

SEQ ID NO: 3272865 - RNA, 19 nt, Vaccinia virus
aaaacuuaacucaacuguu

SEQ ID NO: 3272866 - RNA, 16 nt, Vaccinia virus
augauacauuaaguaa

SEQ ID NO: 3272867 - RNA, 23 nt, Vaccinia virus
aauuaucgacauagguauagaau

SEQ ID NO: 3272868 - RNA, 19 nt, Vaccinia virus
ugaaauagcucguuucuau

SEQ ID NO: 3272869 - RNA, 21 nt, Vaccinia virus
aacauuuauuaucaugaugac

SEQ ID NO: 3272870 - RNA, 12 nt, Vaccinia virus
cguuuauggauc

SEQ ID NO: 3272871 - RNA, 16 nt, Vaccinia virus
cuuuuguauucauaga

SEQ ID NO: 3272872 - RNA, 21 nt, Vaccinia virus
aacgugaaugaucuauuaucu

SEQ ID NO: 3272873 - RNA, 13 nt, Vaccinia virus
uucacaaaauacg

SEQ ID NO: 3272874 - RNA, 18 nt, Vaccinia virus
gauauccuaucuauuauu

SEQ ID NO: 3272875 - RNA, 16 nt, Vaccinia virus
ccuuuacaguggauaa

SEQ ID NO: 3272876 - RNA, 23 nt, Vaccinia virus
auacauugaauauaaaauaacua

SEQ ID NO: 3272877 - RNA, 13 nt, Vaccinia virus
guccguacuuauu

SEQ ID NO: 3272878 - RNA, 14 nt, Vaccinia virus
auuguuuuucacag

SEQ ID NO: 3272879 - RNA, 17 nt, Vaccinia virus
agguggcuaccgacaau

SEQ ID NO: 3272880 - RNA, 21 nt, Vaccinia virus
cauguugauaaacuacuuaca

SEQ ID NO: 3272881 - RNA, 16 nt, Vaccinia virus
cacguuaaaucaucua

SEQ ID NO: 3272882 - RNA, 22 nt, Vaccinia virus
agaaauggaaaucguaauacca

SEQ ID NO: 3272883 - RNA, 12 nt, Vaccinia virus
uauaauaucuua

SEQ ID NO: 3272884 - RNA, 16 nt, Vaccinia virus
auaaccuuuuccuuau

SEQ ID NO: 3272885 - RNA, 21 nt, Vaccinia virus
uauggauuuuuuuaaaaagga

SEQ ID NO: 3272886 - RNA, 15 nt, Vaccinia virus
aauuauuauuacuga

SEQ ID NO: 3272887 - RNA, 13 nt, Vaccinia virus
gcguauuuaagag

SEQ ID NO: 3272888 - RNA, 22 nt, Vaccinia virus
aucuaacagaaacguuuagaga

SEQ ID NO: 3272889 - RNA, 17 nt, Vaccinia virus
ggaugaguuaauguaua

SEQ ID NO: 3272890 - RNA, 15 nt, Vaccinia virus
uaacuucugauuuua

SEQ ID NO: 3272891 - RNA, 22 nt, Vaccinia virus
augauuuugaaccguauuacuc

SEQ ID NO: 3272892 - RNA, 23 nt, Vaccinia virus
auacacguuagauuauucucaaa

SEQ ID NO: 3272893 - RNA, 21 nt, Vaccinia virus
uguauuggauccuuugacuau

SEQ ID NO: 3272894 - RNA, 20 nt, Vaccinia virus
aauacaugggaaaugauauc

SEQ ID NO: 3272895 - RNA, 21 nt, Vaccinia virus
aaggacauuggauauguggaa

SEQ ID NO: 3272896 - RNA, 12 nt, Vaccinia virus
agcgaauuauuu

SEQ ID NO: 3272897 - RNA, 15 nt, Vaccinia virus
uuaucucccauaauc

SEQ ID NO: 3272898 - RNA, 12 nt, Vaccinia virus
acuuuuaaauac

SEQ ID NO: 3272899 - RNA, 20 nt, Vaccinia virus
ucacguuauauaacuaucaa

SEQ ID NO: 3272900 - RNA, 17 nt, Vaccinia virus
agacaauugacaaaauu

SEQ ID NO: 3272901 - RNA, 22 nt, Vaccinia virus
uaauagguuugaucguugucau

SEQ ID NO: 3272902 - RNA, 15 nt, Vaccinia virus
gaauauaauaaucua

SEQ ID NO: 3272903 - RNA, 16 nt, Vaccinia virus
aaaucauuaaaaagau

SEQ ID NO: 3272904 - RNA, 21 nt, Vaccinia virus
aauacuaaaaaauguagaaau

SEQ ID NO: 3272905 - RNA, 17 nt, Vaccinia virus
acauguguuuuagaaua

SEQ ID NO: 3272906 - RNA, 13 nt, Vaccinia virus
guaaugaagagaa

SEQ ID NO: 3272907 - RNA, 16 nt, Vaccinia virus
aaaauauuuauuagaa

SEQ ID NO: 3272908 - RNA, 20 nt, Vaccinia virus
cacgaaauaaaaaacauaau

SEQ ID NO: 3272909 - RNA, 12 nt, Vaccinia virus
caguuauuggau

SEQ ID NO: 3272910 - RNA, 17 nt, Vaccinia virus
cauagauguauauauca

SEQ ID NO: 3272911 - RNA, 21 nt, Vaccinia virus
cuaaagagauuuagacaacag

SEQ ID NO: 3272912 - RNA, 13 nt, Vaccinia virus
auucgacacuauu

SEQ ID NO: 3272913 - RNA, 20 nt, Vaccinia virus
uucucaaauccauagucuuc

SEQ ID NO: 3272914 - RNA, 23 nt, Vaccinia virus
uuauacauguuccagaugucaua

SEQ ID NO: 3272915 - RNA, 20 nt, Vaccinia virus
uaaacuacgugaacauaugg

SEQ ID NO: 3272916 - RNA, 14 nt, Vaccinia virus
agccgaaaacauug

SEQ ID NO: 3272917 - RNA, 12 nt, Vaccinia virus
guuaauaacauc

SEQ ID NO: 3272918 - RNA, 16 nt, Vaccinia virus
agaaauaucuauaauu

SEQ ID NO: 3272919 - RNA, 19 nt, Vaccinia virus
uaauacagauggauuaaau

SEQ ID NO: 3272920 - RNA, 21 nt, Vaccinia virus
caaauguagugaauaucucua

SEQ ID NO: 3272921 - RNA, 18 nt, Vaccinia virus
acuuacuaaagucaauaa

SEQ ID NO: 3272922 - RNA, 20 nt, Vaccinia virus
agugguauauaauccaucaa

SEQ ID NO: 3272923 - RNA, 12 nt, Vaccinia virus
uuuauucucaaa

SEQ ID NO: 3272924 - RNA, 22 nt, Vaccinia virus
uagaucuuccaaucuaucuauu

SEQ ID NO: 3272925 - RNA, 20 nt, Vaccinia virus
gucuauccauuguuucacau

SEQ ID NO: 3272926 - RNA, 23 nt, Vaccinia virus
aauaacuucgugaauaauguuuc

SEQ ID NO: 3272927 - RNA, 14 nt, Vaccinia virus
agcaaaaaaugaua

SEQ ID NO: 3272928 - RNA, 22 nt, Vaccinia virus
uuauccuuuagaugaauuauua

SEQ ID NO: 3272929 - RNA, 16 nt, Vaccinia virus
aacaauuuuuuguucu

SEQ ID NO: 3272930 - RNA, 19 nt, Vaccinia virus
uucauuagauaacagugua

SEQ ID NO: 3272931 - RNA, 13 nt, Vaccinia virus
gauaauaaacaaa

SEQ ID NO: 3272932 - RNA, 20 nt, Vaccinia virus
auaguauacgcagaaaagau

SEQ ID NO: 3272933 - RNA, 20 nt, Vaccinia virus
uacagauacagauguuacaa

SEQ ID NO: 3272934 - RNA, 23 nt, Vaccinia virus
cuuaacgaaagaaguuguaucau

SEQ ID NO: 3272935 - RNA, 19 nt, Vaccinia virus
uaauaucauagcaucuauu

SEQ ID NO: 3272936 - RNA, 16 nt, Vaccinia virus
cgauaauuauaaggcu

SEQ ID NO: 3272937 - RNA, 13 nt, Vaccinia virus
aacucuaucaugg

SEQ ID NO: 3272938 - RNA, 13 nt, Vaccinia virus
gauucacaaauau

SEQ ID NO: 3272939 - RNA, 15 nt, Vaccinia virus
augagaucuguauag

SEQ ID NO: 3272940 - RNA, 23 nt, Vaccinia virus
gaauggaaaccuuuaaucuauau

SEQ ID NO: 3272941 - RNA, 13 nt, Vaccinia virus
auauaucaaacau

SEQ ID NO: 3272942 - RNA, 21 nt, Vaccinia virus
cuguuuaaacgaggacuauaa

SEQ ID NO: 3272943 - RNA, 13 nt, Vaccinia virus
ucugaaauaauca

SEQ ID NO: 3272944 - RNA, 17 nt, Vaccinia virus
uuguauagaaacuguau

SEQ ID NO: 3272945 - RNA, 16 nt, Vaccinia virus
gcagguacuauaauau

SEQ ID NO: 3272946 - RNA, 20 nt, Vaccinia virus
auaaacauuuguguuuguau

SEQ ID NO: 3272947 - RNA, 13 nt, Vaccinia virus
auaaugauagaca

SEQ ID NO: 3272948 - RNA, 22 nt, Vaccinia virus
accaauaugucuguacaaaugu

SEQ ID NO: 3272949 - RNA, 18 nt, Vaccinia virus
aucugguagcaaagaaau

SEQ ID NO: 3272950 - RNA, 17 nt, Vaccinia virus
ugauaacuucaggaaau

SEQ ID NO: 3272951 - RNA, 14 nt, Vaccinia virus
acaauaacuucacu

SEQ ID NO: 3272952 - RNA, 15 nt, Vaccinia virus
uacccaccuguaaua

SEQ ID NO: 3272953 - RNA, 13 nt, Vaccinia virus
cguuucuauuuuc

SEQ ID NO: 3272954 - RNA, 21 nt, Vaccinia virus
aaauugucugaugaagaauua

SEQ ID NO: 3272955 - RNA, 13 nt, Vaccinia virus
uucaauauugaaa

SEQ ID NO: 3272956 - RNA, 23 nt, Vaccinia virus
aaaccuuugacuaguuguagaau

SEQ ID NO: 3272957 - RNA, 18 nt, Vaccinia virus
aauugucuacuaacauua

SEQ ID NO: 3272958 - RNA, 15 nt, Vaccinia virus
uggauggaaacauug

SEQ ID NO: 3272959 - RNA, 22 nt, Vaccinia virus
uggaagacagcgugaauaaugu

SEQ ID NO: 3272960 - RNA, 21 nt, Vaccinia virus
cauaaucaucacugucaucag

SEQ ID NO: 3272961 - RNA, 16 nt, Vaccinia virus
ucauuugcguacccaa

SEQ ID NO: 3272962 - RNA, 18 nt, Vaccinia virus
uaguaaccguuuuccauu

SEQ ID NO: 3272963 - RNA, 13 nt, Vaccinia virus
agagagaaauacu

SEQ ID NO: 3272964 - RNA, 18 nt, Vaccinia virus
aggguaucuaauuuccug

SEQ ID NO: 3272965 - RNA, 22 nt, Vaccinia virus
aaacaauuucacaaauggaugu

SEQ ID NO: 3272966 - RNA, 14 nt, Vaccinia virus
auccagaguguuuc

SEQ ID NO: 3272967 - RNA, 13 nt, Vaccinia virus
agauaaguuuaag

SEQ ID NO: 3272968 - RNA, 15 nt, Vaccinia virus
aaauaauuauuagaa

SEQ ID NO: 3272969 - RNA, 22 nt, Vaccinia virus
auuuucggguuuaaauucuuua

SEQ ID NO: 3272970 - RNA, 13 nt, Vaccinia virus
uuauagaauguau

SEQ ID NO: 3272971 - RNA, 23 nt, Vaccinia virus
cuaaaauuccuaacgaugauaug

SEQ ID NO: 3272972 - RNA, 12 nt, Vaccinia virus
guaucuacuaga

SEQ ID NO: 3272973 - RNA, 12 nt, Vaccinia virus
auuaacugucuu

SEQ ID NO: 3272974 - RNA, 19 nt, Vaccinia virus
auaacacaaccaaauacuu

SEQ ID NO: 3272975 - RNA, 19 nt, Vaccinia virus
gauauauuuuugauaauau

SEQ ID NO: 3272976 - RNA, 15 nt, Vaccinia virus
cgaauccuguuucua

SEQ ID NO: 3272977 - RNA, 17 nt, Vaccinia virus
cgucuauauaguauuuu

SEQ ID NO: 3272978 - RNA, 16 nt, Vaccinia virus
ucguugacaucuugaa

SEQ ID NO: 3272979 - RNA, 20 nt, Vaccinia virus
aacuaaccaacuaacuauau

SEQ ID NO: 3272980 - RNA, 23 nt, Vaccinia virus
accuucuauagaucugagaaugg

SEQ ID NO: 3272981 - RNA, 21 nt, Vaccinia virus
aagacguuguacaauaugaac

SEQ ID NO: 3272982 - RNA, 22 nt, Vaccinia virus
ugucuggaccaucguuugucau

SEQ ID NO: 3272983 - RNA, 23 nt, Vaccinia virus
guaagaacucucuucauuacuau

SEQ ID NO: 3272984 - RNA, 13 nt, Vaccinia virus
gaaucguauauau

SEQ ID NO: 3272985 - RNA, 18 nt, Vaccinia virus
uauucauagauugacuuu

SEQ ID NO: 3272986 - RNA, 15 nt, Vaccinia virus
cauuaguaacagcuu

SEQ ID NO: 3272987 - RNA, 23 nt, Vaccinia virus
uuauaugucucgcauaaacauua

SEQ ID NO: 3272988 - RNA, 22 nt, Vaccinia virus
accaauaucgauuacuaugaau

SEQ ID NO: 3272989 - RNA, 19 nt, Vaccinia virus
augaacauaguaagaaauu

SEQ ID NO: 3272990 - RNA, 17 nt, Vaccinia virus
ccuggaguauggaauac

SEQ ID NO: 3272991 - RNA, 17 nt, Vaccinia virus
uuuuacaauuucaucca

SEQ ID NO: 3272992 - RNA, 13 nt, Vaccinia virus
aagaccaauaaua

SEQ ID NO: 3272993 - RNA, 19 nt, Vaccinia virus
agaaacuugcaaaaaagac

SEQ ID NO: 3272994 - RNA, 18 nt, Vaccinia virus
acaugucaucgaaauggu

SEQ ID NO: 3272995 - RNA, 14 nt, Vaccinia virus
cuauaguuaauuga

SEQ ID NO: 3272996 - RNA, 18 nt, Vaccinia virus
cuuugaaguuuuuaagag

SEQ ID NO: 3272997 - RNA, 18 nt, Vaccinia virus
uauaauuauauguagaag

SEQ ID NO: 3272998 - RNA, 17 nt, Vaccinia virus
ggguuaaauuugaacaa

SEQ ID NO: 3272999 - RNA, 23 nt, Vaccinia virus
gaaacauauucuaugaauuuaua

SEQ ID NO: 3273000 - RNA, 15 nt, Vaccinia virus
agagcuauucuugga

SEQ ID NO: 3273001 - RNA, 22 nt, Vaccinia virus
gcaaacuuacagaaacaaugau

SEQ ID NO: 3273002 - RNA, 15 nt, Vaccinia virus
uuccaacucugucuu

SEQ ID NO: 3273003 - RNA, 18 nt, Vaccinia virus
auguuuccgagaaauaua

SEQ ID NO: 3273004 - RNA, 13 nt, Vaccinia virus
augauuuauaaug

SEQ ID NO: 3273005 - RNA, 14 nt, Vaccinia virus
auguuacaaaugua

SEQ ID NO: 3273006 - RNA, 14 nt, Vaccinia virus
aaugacauggaaau

SEQ ID NO: 3273007 - RNA, 15 nt, Vaccinia virus
caagauaagcaaacg

SEQ ID NO: 3273008 - RNA, 16 nt, Vaccinia virus
cuaccaguuauucucg

SEQ ID NO: 3273009 - RNA, 19 nt, Vaccinia virus
caagugacaacaaaaaaug

SEQ ID NO: 3273010 - RNA, 19 nt, Vaccinia virus
guuuuauuuuaucuuuuac

SEQ ID NO: 3273011 - RNA, 21 nt, Vaccinia virus
uucuacuaugcacauuauucu

SEQ ID NO: 3273012 - RNA, 14 nt, Vaccinia virus
auccaaucauauau

SEQ ID NO: 3273013 - RNA, 21 nt, Vaccinia virus
auuacauuuuuuauaaauaga

SEQ ID NO: 3273014 - RNA, 22 nt, Vaccinia virus
uccgaaauuagaaauucccaag

SEQ ID NO: 3273015 - RNA, 23 nt, Vaccinia virus
uuaaaauaguuuauaacauuaau

SEQ ID NO: 3273016 - RNA, 17 nt, Vaccinia virus
cuuuagaaauuguauuc

SEQ ID NO: 3273017 - RNA, 15 nt, Vaccinia virus
guuucucaucuuuua

SEQ ID NO: 3273018 - RNA, 14 nt, Vaccinia virus
guguauauaagacc

SEQ ID NO: 3273019 - RNA, 22 nt, Vaccinia virus
cuuauugaguggaaaguucaaa

SEQ ID NO: 3273020 - RNA, 13 nt, Vaccinia virus
uauggaagaaagu

SEQ ID NO: 3273021 - RNA, 16 nt, Vaccinia virus
guauuugaaaauggaa

SEQ ID NO: 3273022 - RNA, 12 nt, Vaccinia virus
uucaacaucuuu

SEQ ID NO: 3273023 - RNA, 11 nt, Vaccinia virus
ccguguuuaug

SEQ ID NO: 3273024 - RNA, 22 nt, Vaccinia virus
caaagauucuuccuccaaacag

SEQ ID NO: 3273025 - RNA, 14 nt, Vaccinia virus
aagaucaaggaaau

SEQ ID NO: 3273026 - RNA, 23 nt, Vaccinia virus
auaaauaaugaucguaaugaaca

SEQ ID NO: 3273027 - RNA, 17 nt, Vaccinia virus
gaauauggggaaaauau

SEQ ID NO: 3273028 - RNA, 21 nt, Vaccinia virus
auguuuuuagauuuuagcaua

SEQ ID NO: 3273029 - RNA, 19 nt, Vaccinia virus
agguuuauauauucaauau

SEQ ID NO: 3273030 - RNA, 17 nt, Vaccinia virus
uaaguaugaugucuaug

SEQ ID NO: 3273031 - RNA, 20 nt, Vaccinia virus
aagugugguguuuggucgau

SEQ ID NO: 3273032 - RNA, 21 nt, Vaccinia virus
aucuaccauaguuacagaauu

SEQ ID NO: 3273033 - RNA, 15 nt, Vaccinia virus
aaggaucuguacacg

SEQ ID NO: 3273034 - RNA, 14 nt, Vaccinia virus
cgugaauguauguu

SEQ ID NO: 3273035 - RNA, 15 nt, Vaccinia virus
cuguuuauuaaugau

SEQ ID NO: 3273036 - RNA, 13 nt, Vaccinia virus
agugaaacuaucu

SEQ ID NO: 3273037 - RNA, 16 nt, Vaccinia virus
aaguaaguauguugaa

SEQ ID NO: 3273038 - RNA, 18 nt, Vaccinia virus
cuaaucucuuaacaaaaa

SEQ ID NO: 3273039 - RNA, 15 nt, Vaccinia virus
ucugucauauuuaga

SEQ ID NO: 3273040 - RNA, 16 nt, Vaccinia virus
cauaguuuguaucaau

SEQ ID NO: 3273041 - RNA, 24 nt, Vaccinia virus
auccaaauuuuuuuuacaaacauc

SEQ ID NO: 3273042 - RNA, 12 nt, Vaccinia virus
aauuauauuguc

SEQ ID NO: 3273043 - RNA, 21 nt, Vaccinia virus
uaauagcuccccuguuuucau

SEQ ID NO: 3273044 - RNA, 17 nt, Vaccinia virus
uuaagagaauaauagau

SEQ ID NO: 3273045 - RNA, 16 nt, Vaccinia virus
uaccucuucugauauc

SEQ ID NO: 3273046 - RNA, 12 nt, Vaccinia virus
ucuguuuucacc

SEQ ID NO: 3273047 - RNA, 14 nt, Vaccinia virus
ucucaaguuacauu

SEQ ID NO: 3273048 - RNA, 15 nt, Vaccinia virus
ucaaacucgauauau

SEQ ID NO: 3273049 - RNA, 17 nt, Vaccinia virus
uaacaaccucuuuaaua

SEQ ID NO: 3273050 - RNA, 12 nt, Vaccinia virus
uuauaguuuuua

SEQ ID NO: 3273051 - RNA, 23 nt, Vaccinia virus
gaacaccacuuacguuaauacua

SEQ ID NO: 3273052 - RNA, 20 nt, Vaccinia virus
cuucauucguaaaucuuuuc

SEQ ID NO: 3273053 - RNA, 17 nt, Vaccinia virus
auagaggaagacacauu

SEQ ID NO: 3273054 - RNA, 18 nt, Vaccinia virus
ugggacuauauaauuuug

SEQ ID NO: 3273055 - RNA, 20 nt, Vaccinia virus
gauguauuagcaucuuauua

SEQ ID NO: 3273056 - RNA, 14 nt, Vaccinia virus
aguacuuguaugug

SEQ ID NO: 3273057 - RNA, 17 nt, Vaccinia virus
uucuauacguuucuauu

SEQ ID NO: 3273058 - RNA, 20 nt, Vaccinia virus
uuuuauauguguuugaucua

SEQ ID NO: 3273059 - RNA, 18 nt, Vaccinia virus
agauaguuuuaguuucca

SEQ ID NO: 3273060 - RNA, 23 nt, Vaccinia virus
uaaugacaucuaugauuuuacug

SEQ ID NO: 3273061 - RNA, 14 nt, Vaccinia virus
uaauacacacaaag

SEQ ID NO: 3273062 - RNA, 15 nt, Vaccinia virus
caaagagaaaacaaa

SEQ ID NO: 3273063 - RNA, 16 nt, Vaccinia virus
auuuaauuacauccuu

SEQ ID NO: 3273064 - RNA, 17 nt, Vaccinia virus
auaaauuauaaaaaaag

SEQ ID NO: 3273065 - RNA, 18 nt, Vaccinia virus
ggacgauauauuguuuca

SEQ ID NO: 3273066 - RNA, 15 nt, Vaccinia virus
ccauaagcaaacuga

SEQ ID NO: 3273067 - RNA, 23 nt, Vaccinia virus
ugacuuaacuuguaauaauugcu

SEQ ID NO: 3273068 - RNA, 19 nt, Vaccinia virus
guuuaccacaauguauaau

SEQ ID NO: 3273069 - RNA, 15 nt, Vaccinia virus
uucaaaaauuuagaa

SEQ ID NO: 3273070 - RNA, 17 nt, Vaccinia virus
accaggguuuauuucau

SEQ ID NO: 3273071 - RNA, 12 nt, Vaccinia virus
agaugucauuau

SEQ ID NO: 3273072 - RNA, 19 nt, Vaccinia virus
gugcacuuuuuuauaaaga

SEQ ID NO: 3273073 - RNA, 14 nt, Vaccinia virus
caaugaaugauaug

SEQ ID NO: 3273074 - RNA, 15 nt, Vaccinia virus
auauagaucaaucau

SEQ ID NO: 3273075 - RNA, 13 nt, Vaccinia virus
uauaaaaauacuu

SEQ ID NO: 3273076 - RNA, 22 nt, Vaccinia virus
caagagugauuuaagaacaucc

SEQ ID NO: 3273077 - RNA, 13 nt, Vaccinia virus
augaacaaauccu

SEQ ID NO: 3273078 - RNA, 21 nt, Vaccinia virus
gauauaauucguggauaauca

SEQ ID NO: 3273079 - RNA, 22 nt, Vaccinia virus
caguuauguuuaacuuugaaau

SEQ ID NO: 3273080 - RNA, 22 nt, Vaccinia virus
acagaauguagauaaucauuua

SEQ ID NO: 3273081 - RNA, 21 nt, Vaccinia virus
aacugcauccuucuaagauua

SEQ ID NO: 3273082 - RNA, 15 nt, Vaccinia virus
uuccaguauuuucca

SEQ ID NO: 3273083 - RNA, 21 nt, Vaccinia virus
aauaugguauggguucugaua

SEQ ID NO: 3273084 - RNA, 14 nt, Vaccinia virus
auuacacauuucca

SEQ ID NO: 3273085 - RNA, 17 nt, Vaccinia virus
agagaagggaauuauug

SEQ ID NO: 3273086 - RNA, 16 nt, Vaccinia virus
uuuauggaauaguuuu

SEQ ID NO: 3273087 - RNA, 19 nt, Vaccinia virus
agucagaggaacauuaaac

SEQ ID NO: 3273088 - RNA, 14 nt, Vaccinia virus
auuguuuagaauac

SEQ ID NO: 3273089 - RNA, 20 nt, Vaccinia virus
guguagaugcuacuucaucu

SEQ ID NO: 3273090 - RNA, 15 nt, Vaccinia virus
aacuuaaaagaauua

SEQ ID NO: 3273091 - RNA, 14 nt, Vaccinia virus
ucauaaguguauau

SEQ ID NO: 3273092 - RNA, 14 nt, Vaccinia virus
gucauguuggaaca

SEQ ID NO: 3273093 - RNA, 18 nt, Vaccinia virus
cggcuaucgacuuaauau

SEQ ID NO: 3273094 - RNA, 18 nt, Vaccinia virus
aaagauaauacauuuucu

SEQ ID NO: 3273095 - RNA, 19 nt, Vaccinia virus
uauuuuuccauucuguuuu

SEQ ID NO: 3273096 - RNA, 19 nt, Vaccinia virus
uacauccgauuaucaagau

SEQ ID NO: 3273097 - RNA, 18 nt, Vaccinia virus
ucucuauuucuuaaugaa

SEQ ID NO: 3273098 - RNA, 14 nt, Vaccinia virus
auguaguucguaaa

SEQ ID NO: 3273099 - RNA, 21 nt, Vaccinia virus
gaaauauaugagauguaguua

SEQ ID NO: 3273100 - RNA, 17 nt, Vaccinia virus
gaucauuuugauauugu

SEQ ID NO: 3273101 - RNA, 18 nt, Vaccinia virus
auaguuauuacuuuucuc

SEQ ID NO: 3273102 - RNA, 18 nt, Vaccinia virus
cauaaaacuaauauuuua

SEQ ID NO: 3273103 - RNA, 20 nt, Vaccinia virus
acaaucucagauaugggaaa

SEQ ID NO: 3273104 - RNA, 22 nt, Vaccinia virus
aucucuaacgagugaucaaauc

SEQ ID NO: 3273105 - RNA, 22 nt, Vaccinia virus
cuguaauaaaggugguaguauu

SEQ ID NO: 3273106 - RNA, 13 nt, Vaccinia virus
guguuuaaucuuc

SEQ ID NO: 3273107 - RNA, 14 nt, Vaccinia virus
agccuagaaaucaa

SEQ ID NO: 3273108 - RNA, 15 nt, Vaccinia virus
aguucuuuuagaaaa

SEQ ID NO: 3273109 - RNA, 19 nt, Vaccinia virus
auuuguuuuacucuauaaa

SEQ ID NO: 3273110 - RNA, 18 nt, Vaccinia virus
aucaggauauaaagaaaa

SEQ ID NO: 3273111 - RNA, 17 nt, Vaccinia virus
cgaagaacuaauaaacu

SEQ ID NO: 3273112 - RNA, 21 nt, Vaccinia virus
cacaacaucguuuuugauauu

SEQ ID NO: 3273113 - RNA, 18 nt, Vaccinia virus
gaaaugccugauaaagau

SEQ ID NO: 3273114 - RNA, 21 nt, Vaccinia virus
uaacgcaccuauaaagacuuu

SEQ ID NO: 3273115 - RNA, 17 nt, Vaccinia virus
aacaucaaaaaauuaua

SEQ ID NO: 3273116 - RNA, 12 nt, Vaccinia virus
auaucuuaacuu

SEQ ID NO: 3273117 - RNA, 15 nt, Vaccinia virus
uccgguugaugauga

SEQ ID NO: 3273118 - RNA, 23 nt, Vaccinia virus
agcuccuaauggagauuuucuau

SEQ ID NO: 3273119 - RNA, 18 nt, Vaccinia virus
acauuuuuuauaaauaga

SEQ ID NO: 3273120 - RNA, 20 nt, Vaccinia virus
uuaacagaguagauauuaau

SEQ ID NO: 3273121 - RNA, 14 nt, Vaccinia virus
gccugaaguuuauu

SEQ ID NO: 3273122 - RNA, 13 nt, Vaccinia virus
uguaagauacuug

SEQ ID NO: 3273123 - RNA, 21 nt, Vaccinia virus
cuuucaggguaucacaaaaau

SEQ ID NO: 3273124 - RNA, 12 nt, Vaccinia virus
aagaauaaagua

SEQ ID NO: 3273125 - RNA, 17 nt, Vaccinia virus
gaaacauggggauugaa

SEQ ID NO: 3273126 - RNA, 14 nt, Vaccinia virus
uauucauaauaaga

SEQ ID NO: 3273127 - RNA, 22 nt, Vaccinia virus
acaaugcuaauauauucuuaca

SEQ ID NO: 3273128 - RNA, 13 nt, Vaccinia virus
acuaaacacauua

SEQ ID NO: 3273129 - RNA, 18 nt, Vaccinia virus
gauaacuagauagaaaga

SEQ ID NO: 3273130 - RNA, 21 nt, Vaccinia virus
agaauauacucaauagaauuu

SEQ ID NO: 3273131 - RNA, 22 nt, Vaccinia virus
acgauuacaucaccucuaacau

SEQ ID NO: 3273132 - RNA, 22 nt, Vaccinia virus
aauauagcaucgauccaugaga

SEQ ID NO: 3273133 - RNA, 14 nt, Vaccinia virus
uauaaguagauguu

SEQ ID NO: 3273134 - RNA, 18 nt, Vaccinia virus
aggauguaauuaaauguu

SEQ ID NO: 3273135 - RNA, 22 nt, Vaccinia virus
aagaagugucuauaaauguaga

SEQ ID NO: 3273136 - RNA, 20 nt, Vaccinia virus
auacaaugcucaguaaaugu

SEQ ID NO: 3273137 - RNA, 16 nt, Vaccinia virus
gcauucuuggaugaau

SEQ ID NO: 3273138 - RNA, 17 nt, Vaccinia virus
uuagaaaauucucuuac

SEQ ID NO: 3273139 - RNA, 13 nt, Vaccinia virus
agauauacgcuau

SEQ ID NO: 3273140 - RNA, 21 nt, Vaccinia virus
gcuacaggucuaccuuuacaa

SEQ ID NO: 3273141 - RNA, 23 nt, Vaccinia virus
aucaguuuuguauuccaaauuaa

SEQ ID NO: 3273142 - RNA, 23 nt, Vaccinia virus
gaauagccgauauagauauuaaa

SEQ ID NO: 3273143 - RNA, 15 nt, Vaccinia virus
ggaaucuguauucuc

SEQ ID NO: 3273144 - RNA, 23 nt, Vaccinia virus
acgugucaacggcaguauuggga

SEQ ID NO: 3273145 - RNA, 19 nt, Vaccinia virus
uugaaacuaggauacauaa

SEQ ID NO: 3273146 - RNA, 16 nt, Vaccinia virus
auaauguuaccguguu

SEQ ID NO: 3273147 - RNA, 15 nt, Vaccinia virus
augaauacuaaugcc

SEQ ID NO: 3273148 - RNA, 20 nt, Vaccinia virus
uaaacugcgccaaauugugg

SEQ ID NO: 3273149 - RNA, 22 nt, Vaccinia virus
augauaauuuacacaguaacca

SEQ ID NO: 3273150 - RNA, 17 nt, Vaccinia virus
aaguuuuaaaaauacuu

SEQ ID NO: 3273151 - RNA, 17 nt, Vaccinia virus
cauacgaugaaaauggu

SEQ ID NO: 3273152 - RNA, 12 nt, Vaccinia virus
uuuauuauucuu

SEQ ID NO: 3273153 - RNA, 17 nt, Vaccinia virus
auuaucgacuaugaauc

SEQ ID NO: 3273154 - RNA, 21 nt, Vaccinia virus
auauuccgguuugcaaaacaa

SEQ ID NO: 3273155 - RNA, 19 nt, Vaccinia virus
accaauuacugauaaugua

SEQ ID NO: 3273156 - RNA, 17 nt, Vaccinia virus
gagaaaccgaugauuau

SEQ ID NO: 3273157 - RNA, 13 nt, Vaccinia virus
uagauaaacuauc

SEQ ID NO: 3273158 - RNA, 19 nt, Vaccinia virus
gugaaaauuacauacuuaa

SEQ ID NO: 3273159 - RNA, 17 nt, Vaccinia virus
uggucgauuauagaaau

SEQ ID NO: 3273160 - RNA, 14 nt, Vaccinia virus
augaagaaagaaaa

SEQ ID NO: 3273161 - RNA, 19 nt, Vaccinia virus
uacauauuuuagaacagaa

SEQ ID NO: 3273162 - RNA, 23 nt, Vaccinia virus
caauaguaguguaguuaauguaa

SEQ ID NO: 3273163 - RNA, 16 nt, Vaccinia virus
caguuagcuacucuag

SEQ ID NO: 3273164 - RNA, 17 nt, Vaccinia virus
auucucaaacuccuaau

SEQ ID NO: 3273165 - RNA, 15 nt, Vaccinia virus
gucuaucaauaacug

SEQ ID NO: 3273166 - RNA, 12 nt, Vaccinia virus
uuugaaacugaa

SEQ ID NO: 3273167 - RNA, 19 nt, Vaccinia virus
cagagaggccaucuggaag

SEQ ID NO: 3273168 - RNA, 22 nt, Vaccinia virus
uaagaaaguaauucagacacuu

SEQ ID NO: 3273169 - RNA, 18 nt, Vaccinia virus
acuaugcgauuauuuuca

SEQ ID NO: 3273170 - RNA, 20 nt, Vaccinia virus
caugaauccauucuaaugau

SEQ ID NO: 3273171 - RNA, 20 nt, Vaccinia virus
accaucggaugauauuaaug

SEQ ID NO: 3273172 - RNA, 16 nt, Vaccinia virus
ccauuaaaaauuguua

SEQ ID NO: 3273173 - RNA, 14 nt, Vaccinia virus
uaggaauaugugcu

SEQ ID NO: 3273174 - RNA, 18 nt, Vaccinia virus
acgaagaauggaaauaua

SEQ ID NO: 3273175 - RNA, 13 nt, Vaccinia virus
auauucuaugaug

SEQ ID NO: 3273176 - RNA, 22 nt, Vaccinia virus
gauauauuguuucauaauugcu

SEQ ID NO: 3273177 - RNA, 19 nt, Vaccinia virus
gaauauuucgauaaugaac

SEQ ID NO: 3273178 - RNA, 21 nt, Vaccinia virus
uacgcuauuaaucuuuaaaau

SEQ ID NO: 3273179 - RNA, 17 nt, Vaccinia virus
aaaacucuaagaacuua

SEQ ID NO: 3273180 - RNA, 17 nt, Vaccinia virus
uuaugauagaaauuagc

SEQ ID NO: 3273181 - RNA, 18 nt, Vaccinia virus
uauaaauagauguuagua

SEQ ID NO: 3273182 - RNA, 20 nt, Vaccinia virus
uucuuggauauagaauccaa

SEQ ID NO: 3273183 - RNA, 24 nt, Vaccinia virus
guguuaaaugguucgauauaaagg

SEQ ID NO: 3273184 - RNA, 16 nt, Vaccinia virus
auguauagaacaacga

SEQ ID NO: 3273185 - RNA, 19 nt, Vaccinia virus
uucuagaacuaacaaacua

SEQ ID NO: 3273186 - RNA, 14 nt, Vaccinia virus
uauauccaauguau

SEQ ID NO: 3273187 - RNA, 19 nt, Vaccinia virus
auacacguauaaaaaauau

SEQ ID NO: 3273188 - RNA, 19 nt, Vaccinia virus
aaguuuggcagcuagcaga

SEQ ID NO: 3273189 - RNA, 15 nt, Vaccinia virus
guucaaaaauuuaga

SEQ ID NO: 3273190 - RNA, 17 nt, Vaccinia virus
aaaucuaacagauacaa

SEQ ID NO: 3273191 - RNA, 20 nt, Vaccinia virus
agaacaaaaucuaacagaua

SEQ ID NO: 3273192 - RNA, 15 nt, Vaccinia virus
agaucgaaaaaagag

SEQ ID NO: 3273193 - RNA, 23 nt, Vaccinia virus
uuuuacauggauuuaucauauca

SEQ ID NO: 3273194 - RNA, 16 nt, Vaccinia virus
uauguaagacuugugg

SEQ ID NO: 3273195 - RNA, 23 nt, Vaccinia virus
uauuaacgcguuuuaugaaugau

SEQ ID NO: 3273196 - RNA, 24 nt, Vaccinia virus
uauauaaaguuggaauuugacuau

SEQ ID NO: 3273197 - RNA, 20 nt, Vaccinia virus
ugacuaguuguagaauuuga

SEQ ID NO: 3273198 - RNA, 15 nt, Vaccinia virus
uauguguuuacagua

SEQ ID NO: 3273199 - RNA, 17 nt, Vaccinia virus
auacuaagcaaguacau

SEQ ID NO: 3273200 - RNA, 22 nt, Vaccinia virus
aaaugucguggacacaacuauu

SEQ ID NO: 3273201 - RNA, 22 nt, Vaccinia virus
uggaaauaucugugaauacuuu

SEQ ID NO: 3273202 - RNA, 14 nt, Vaccinia virus
uuugguucuucucu

SEQ ID NO: 3273203 - RNA, 16 nt, Vaccinia virus
aaaacugaaaauauau

SEQ ID NO: 3273204 - RNA, 22 nt, Vaccinia virus
aucuguggaaaauaauacucug

SEQ ID NO: 3273205 - RNA, 18 nt, Vaccinia virus
gaauauuucgauaaugaa

SEQ ID NO: 3273206 - RNA, 14 nt, Vaccinia virus
gaauagacuuucug

SEQ ID NO: 3273207 - RNA, 14 nt, Vaccinia virus
uaacaaaauuaaag

SEQ ID NO: 3273208 - RNA, 18 nt, Vaccinia virus
acucuuggaauuaauagu

SEQ ID NO: 3273209 - RNA, 19 nt, Vaccinia virus
aguaauuauaagaaauaua

SEQ ID NO: 3273210 - RNA, 19 nt, Vaccinia virus
ucaaacggcgcagacguau

SEQ ID NO: 3273211 - RNA, 18 nt, Vaccinia virus
ugaaacuuggaaacaucu

SEQ ID NO: 3273212 - RNA, 19 nt, Vaccinia virus
auaagaacgggucauuuau

SEQ ID NO: 3273213 - RNA, 15 nt, Vaccinia virus
acaauguauacaaau

SEQ ID NO: 3273214 - RNA, 20 nt, Vaccinia virus
aauauagcaucgauccauga

SEQ ID NO: 3273215 - RNA, 14 nt, Vaccinia virus
uggaacauaagaua

SEQ ID NO: 3273216 - RNA, 20 nt, Vaccinia virus
uuucagcguggauuucucau

SEQ ID NO: 3273217 - RNA, 16 nt, Vaccinia virus
auauugauguuaauaa

SEQ ID NO: 3273218 - RNA, 11 nt, Vaccinia virus
augaguauuuu

SEQ ID NO: 3273219 - RNA, 14 nt, Vaccinia virus
uuggcaaauuauuu

SEQ ID NO: 3273220 - RNA, 15 nt, Vaccinia virus
cuaauacuaaauaca

SEQ ID NO: 3273221 - RNA, 23 nt, Vaccinia virus
uaccuaucaaggaacaaauauug

SEQ ID NO: 3273222 - RNA, 13 nt, Vaccinia virus
uagauguggaugu

SEQ ID NO: 3273223 - RNA, 13 nt, Vaccinia virus
agaaagauuaaau

SEQ ID NO: 3273224 - RNA, 13 nt, Vaccinia virus
gcgauugauuuug

SEQ ID NO: 3273225 - RNA, 14 nt, Vaccinia virus
cugauuaacaaaug

SEQ ID NO: 3273226 - RNA, 12 nt, Vaccinia virus
ugaauauacuuu

SEQ ID NO: 3273227 - RNA, 12 nt, Vaccinia virus
acaguuuuacua

SEQ ID NO: 3273228 - RNA, 16 nt, Vaccinia virus
ucuguguuacauaucu

SEQ ID NO: 3273229 - RNA, 18 nt, Vaccinia virus
auaaauuaucaaauacuu

SEQ ID NO: 3273230 - RNA, 19 nt, Vaccinia virus
uggacauaaagauagauau

SEQ ID NO: 3273231 - RNA, 13 nt, Vaccinia virus
guuuggaauaacu

SEQ ID NO: 3273232 - RNA, 20 nt, Vaccinia virus
uuuuauauccaauguauuua

SEQ ID NO: 3273233 - RNA, 15 nt, Vaccinia virus
cuaaaaaaaaugacu

SEQ ID NO: 3273234 - RNA, 23 nt, Vaccinia virus
cucccggagauguuucauaauag

SEQ ID NO: 3273235 - RNA, 20 nt, Vaccinia virus
augugaacagauaaaaggua

SEQ ID NO: 3273236 - RNA, 14 nt, Vaccinia virus
agauuaaaaauggu

SEQ ID NO: 3273237 - RNA, 22 nt, Vaccinia virus
uguuauguauuucauuguucau

SEQ ID NO: 3273238 - RNA, 14 nt, Vaccinia virus
ucaaauguaguguu

SEQ ID NO: 3273239 - RNA, 15 nt, Vaccinia virus
uaaguucauaaucau

SEQ ID NO: 3273240 - RNA, 23 nt, Vaccinia virus
ugcaaaaaacgccaauacauguu

SEQ ID NO: 3273241 - RNA, 19 nt, Vaccinia virus
aagacgguaacuaaauguu

SEQ ID NO: 3273242 - RNA, 12 nt, Vaccinia virus
aacauaaugccg

SEQ ID NO: 3273243 - RNA, 12 nt, Vaccinia virus
acauucaucaau

SEQ ID NO: 3273244 - RNA, 15 nt, Vaccinia virus
guccgaauguauggc

SEQ ID NO: 3273245 - RNA, 15 nt, Vaccinia virus
caucauuccauaauu

SEQ ID NO: 3273246 - RNA, 23 nt, Vaccinia virus
aauuaaggagauagcuucaucua

SEQ ID NO: 3273247 - RNA, 23 nt, Vaccinia virus
uucccaaugguuucaucaauaga

SEQ ID NO: 3273248 - RNA, 16 nt, Vaccinia virus
acuuuuaauuaacaaa

SEQ ID NO: 3273249 - RNA, 19 nt, Vaccinia virus
auaucuauuuuuuugucau

SEQ ID NO: 3273250 - RNA, 17 nt, Vaccinia virus
uguucguccgucaugau

SEQ ID NO: 3273251 - RNA, 14 nt, Vaccinia virus
aauuguacuuugua

SEQ ID NO: 3273252 - RNA, 14 nt, Vaccinia virus
aaacauucauguac

SEQ ID NO: 3273253 - RNA, 21 nt, Vaccinia virus
cggaucuucuuaauucaucuu

SEQ ID NO: 3273254 - RNA, 15 nt, Vaccinia virus
acaaaagcaauuauu

SEQ ID NO: 3273255 - RNA, 23 nt, Vaccinia virus
aaugccuuacucgguguauauaa

SEQ ID NO: 3273256 - RNA, 22 nt, Vaccinia virus
cgggaagauuagucagaccauu

SEQ ID NO: 3273257 - RNA, 19 nt, Vaccinia virus
aacugaggaugauugauua

SEQ ID NO: 3273258 - RNA, 15 nt, Vaccinia virus
ugaaauauaguaaua

SEQ ID NO: 3273259 - RNA, 15 nt, Vaccinia virus
uaucauuuaaacauu

SEQ ID NO: 3273260 - RNA, 19 nt, Vaccinia virus
uaguuacgauuuuaucauc

SEQ ID NO: 3273261 - RNA, 17 nt, Vaccinia virus
augaaacgaacacuauu

SEQ ID NO: 3273262 - RNA, 19 nt, Vaccinia virus
auccguuaaaauaauuaau

SEQ ID NO: 3273263 - RNA, 17 nt, Vaccinia virus
aaaaggucauaacaagu

SEQ ID NO: 3273264 - RNA, 22 nt, Vaccinia virus
agaauauauagguaauacauau

SEQ ID NO: 3273265 - RNA, 14 nt, Vaccinia virus
agaaaucaacuuau

SEQ ID NO: 3273266 - RNA, 14 nt, Vaccinia virus
uuacguuacacuuu

SEQ ID NO: 3273267 - RNA, 23 nt, Vaccinia virus
gucgcagcaugguaguucguaga

SEQ ID NO: 3273268 - RNA, 13 nt, Vaccinia virus
aacgaauuaucgu

SEQ ID NO: 3273269 - RNA, 20 nt, Vaccinia virus
uaucuauuuuaacaaagcau

SEQ ID NO: 3273270 - RNA, 19 nt, Vaccinia virus
uauuaaaacuaucaaugau

SEQ ID NO: 3273271 - RNA, 18 nt, Vaccinia virus
ucuuuaaaauuucauaga

SEQ ID NO: 3273272 - RNA, 13 nt, Vaccinia virus
auaccauguguau

SEQ ID NO: 3273273 - RNA, 20 nt, Vaccinia virus
gacacauaugcgaucagaua

SEQ ID NO: 3273274 - RNA, 17 nt, Vaccinia virus
gaaccagauaguuuaua

SEQ ID NO: 3273275 - RNA, 20 nt, Vaccinia virus
aauuccauaucuuuuagaaa

SEQ ID NO: 3273276 - RNA, 10 nt, Vaccinia virus
ggauuacuua

SEQ ID NO: 3273277 - RNA, 20 nt, Vaccinia virus
cguuuaaaguaaacuucgua

SEQ ID NO: 3273278 - RNA, 16 nt, Vaccinia virus
gaaaauagcagcugau

SEQ ID NO: 3273279 - RNA, 17 nt, Vaccinia virus
cauuuuuuuuaaaaaaa

SEQ ID NO: 3273280 - RNA, 21 nt, Vaccinia virus
aacauuuuuauaaacaugaaa

SEQ ID NO: 3273281 - RNA, 21 nt, Vaccinia virus
gauucgcaaacuauucuaaua

SEQ ID NO: 3273282 - RNA, 24 nt, Vaccinia virus
uauuccaugaauaagugugaugau

SEQ ID NO: 3273283 - RNA, 15 nt, Vaccinia virus
ugauccuuuuccaga

SEQ ID NO: 3273284 - RNA, 13 nt, Vaccinia virus
aacacuuuucuau

SEQ ID NO: 3273285 - RNA, 21 nt, Vaccinia virus
aggaccuuccaacuguggaua

SEQ ID NO: 3273286 - RNA, 20 nt, Vaccinia virus
ugacgcauuuaauagagaua

SEQ ID NO: 3273287 - RNA, 20 nt, Vaccinia virus
auauauuaauacacauaaug

SEQ ID NO: 3273288 - RNA, 21 nt, Vaccinia virus
ucuuuaguuuccgccauuuau

SEQ ID NO: 3273289 - RNA, 23 nt, Vaccinia virus
gccaauugauaguagauaaugag

SEQ ID NO: 3273290 - RNA, 17 nt, Vaccinia virus
auaauccuuauacaucu

SEQ ID NO: 3273291 - RNA, 15 nt, Vaccinia virus
uaugaugcaaagaug

SEQ ID NO: 3273292 - RNA, 22 nt, Vaccinia virus
caauuaacgaucuuuauaauau

SEQ ID NO: 3273293 - RNA, 14 nt, Vaccinia virus
auauucccaaacau

SEQ ID NO: 3273294 - RNA, 13 nt, Vaccinia virus
ugaugaauuauua

SEQ ID NO: 3273295 - RNA, 19 nt, Vaccinia virus
aacucauuuauauauuaaa

SEQ ID NO: 3273296 - RNA, 20 nt, Vaccinia virus
aucacucuucgaaaagaaac

SEQ ID NO: 3273297 - RNA, 16 nt, Vaccinia virus
aacaugcuuuucuaua

SEQ ID NO: 3273298 - RNA, 16 nt, Vaccinia virus
gauggacccauagaga

SEQ ID NO: 3273299 - RNA, 14 nt, Vaccinia virus
acgauauauuguuu

SEQ ID NO: 3273300 - RNA, 16 nt, Vaccinia virus
gauauauaucuuuuca

SEQ ID NO: 3273301 - RNA, 18 nt, Vaccinia virus
auaucuugcaaaauagua

SEQ ID NO: 3273302 - RNA, 14 nt, Vaccinia virus
gucaauuauacguu

SEQ ID NO: 3273303 - RNA, 15 nt, Vaccinia virus
agcucaauauaaaug

SEQ ID NO: 3273304 - RNA, 16 nt, Vaccinia virus
aucugaaaauaaauaa

SEQ ID NO: 3273305 - RNA, 18 nt, Vaccinia virus
aauguuucuuacauauuu

SEQ ID NO: 3273306 - RNA, 16 nt, Vaccinia virus
auuguuaaacauacau

SEQ ID NO: 3273307 - RNA, 15 nt, Vaccinia virus
uggaauaaauuauua

SEQ ID NO: 3273308 - RNA, 22 nt, Vaccinia virus
acaacaauguugccucauacau

SEQ ID NO: 3273309 - RNA, 14 nt, Vaccinia virus
ccuaucauguauuu

SEQ ID NO: 3273310 - RNA, 20 nt, Vaccinia virus
auguuaaauauaaaaaauga

SEQ ID NO: 3273311 - RNA, 17 nt, Vaccinia virus
auuuuuaaacuguuugu

SEQ ID NO: 3273312 - RNA, 23 nt, Vaccinia virus
guaaacauugacggauaaaacaa

SEQ ID NO: 3273313 - RNA, 21 nt, Vaccinia virus
gccauauuccacagauaauau

SEQ ID NO: 3273314 - RNA, 14 nt, Vaccinia virus
uuauucauaauaag

SEQ ID NO: 3273315 - RNA, 22 nt, Vaccinia virus
uaaaauuccuaacgaugauaug

SEQ ID NO: 3273316 - RNA, 14 nt, Vaccinia virus
auaaacacauagaa

SEQ ID NO: 3273317 - RNA, 17 nt, Vaccinia virus
caaguaaagauuucaaa

SEQ ID NO: 3273318 - RNA, 24 nt, Vaccinia virus
cuagucuuugugggcaacugucua

SEQ ID NO: 3273319 - RNA, 14 nt, Vaccinia virus
caugaauuuuuugc

SEQ ID NO: 3273320 - RNA, 20 nt, Vaccinia virus
uaaucaaaauugucuaugau

SEQ ID NO: 3273321 - RNA, 19 nt, Vaccinia virus
aacucacauuucaaauaua

SEQ ID NO: 3273322 - RNA, 23 nt, Vaccinia virus
uggaaugcaaaaccccauaguga

SEQ ID NO: 3273323 - RNA, 15 nt, Vaccinia virus
augcgauuggauaag

SEQ ID NO: 3273324 - RNA, 19 nt, Vaccinia virus
auuacacgcuauuaaucau

SEQ ID NO: 3273325 - RNA, 18 nt, Vaccinia virus
uaaagauagaaaugaauu

SEQ ID NO: 3273326 - RNA, 18 nt, Vaccinia virus
aaacauuuuauuucuaga

SEQ ID NO: 3273327 - RNA, 13 nt, Vaccinia virus
cagauguuguaaa

SEQ ID NO: 3273328 - RNA, 21 nt, Vaccinia virus
uaccgauuuaucaucauacac

SEQ ID NO: 3273329 - RNA, 12 nt, Vaccinia virus
cacucucugcca

SEQ ID NO: 3273330 - RNA, 13 nt, Vaccinia virus
aguauaauguaaa

SEQ ID NO: 3273331 - RNA, 22 nt, Vaccinia virus
aauccuauaccgaguacuguaa

SEQ ID NO: 3273332 - RNA, 18 nt, Vaccinia virus
agagcuauuuugacauac

SEQ ID NO: 3273333 - RNA, 17 nt, Vaccinia virus
auaguuccauuaucuaa

SEQ ID NO: 3273334 - RNA, 15 nt, Vaccinia virus
uugaucauguagaaa

SEQ ID NO: 3273335 - RNA, 16 nt, Vaccinia virus
auuaucaaauggaugc

SEQ ID NO: 3273336 - RNA, 23 nt, Vaccinia virus
acgucuuuucaccacagcacugu

SEQ ID NO: 3273337 - RNA, 23 nt, Vaccinia virus
aaguaugaucaacgaugauacuc

SEQ ID NO: 3273338 - RNA, 18 nt, Vaccinia virus
ugccacugaucaugauug

SEQ ID NO: 3273339 - RNA, 16 nt, Vaccinia virus
cugaaauaauuagaac

SEQ ID NO: 3273340 - RNA, 21 nt, Vaccinia virus
uaauagcaacauaugaagaac

SEQ ID NO: 3273341 - RNA, 18 nt, Vaccinia virus
auaauguaaaaucaugau

SEQ ID NO: 3273342 - RNA, 20 nt, Vaccinia virus
ucuuuguugaacguuucaaa

SEQ ID NO: 3273343 - RNA, 11 nt, Vaccinia virus
agaaugauaug

SEQ ID NO: 3273344 - RNA, 14 nt, Vaccinia virus
uuuccuauauuauu

SEQ ID NO: 3273345 - RNA, 12 nt, Vaccinia virus
uauuaauuaaac

SEQ ID NO: 3273346 - RNA, 15 nt, Vaccinia virus
ucgucuuucugaaug

SEQ ID NO: 3273347 - RNA, 18 nt, Vaccinia virus
auuuaagcagagaauguu

SEQ ID NO: 3273348 - RNA, 14 nt, Vaccinia virus
ugaauauuaaacaa

SEQ ID NO: 3273349 - RNA, 13 nt, Vaccinia virus
accacuucucuau

SEQ ID NO: 3273350 - RNA, 19 nt, Vaccinia virus
aguucaucgcuuucuagaa

SEQ ID NO: 3273351 - RNA, 17 nt, Vaccinia virus
guaagacgauuaaccaa

SEQ ID NO: 3273352 - RNA, 17 nt, Vaccinia virus
gguauacuaguagguaa

SEQ ID NO: 3273353 - RNA, 19 nt, Vaccinia virus
gauccuagaacuagauaua

SEQ ID NO: 3273354 - RNA, 12 nt, Vaccinia virus
aacaaaauacuc

SEQ ID NO: 3273355 - RNA, 11 nt, Vaccinia virus
auuguauauag

SEQ ID NO: 3273356 - RNA, 22 nt, Vaccinia virus
auuaguacaccgcuauguuuaa

SEQ ID NO: 3273357 - RNA, 14 nt, Vaccinia virus
aucgaaugauauau

SEQ ID NO: 3273358 - RNA, 21 nt, Vaccinia virus
aaucuaucuuaucgaaugaua

SEQ ID NO: 3273359 - RNA, 17 nt, Vaccinia virus
uaguauaauuauaugua

SEQ ID NO: 3273360 - RNA, 11 nt, Vaccinia virus
aaacuuuaucc

SEQ ID NO: 3273361 - RNA, 19 nt, Vaccinia virus
acuaauauuuuauuucaaa

SEQ ID NO: 3273362 - RNA, 22 nt, Vaccinia virus
aauauuacuaauugauagaccu

SEQ ID NO: 3273363 - RNA, 16 nt, Vaccinia virus
aaggauauacaaagca

SEQ ID NO: 3273364 - RNA, 14 nt, Vaccinia virus
ggauaaugauagaa

SEQ ID NO: 3273365 - RNA, 20 nt, Vaccinia virus
auagguuuuuuaaaacagau

SEQ ID NO: 3273366 - RNA, 12 nt, Vaccinia virus
aaucguauauaa

SEQ ID NO: 3273367 - RNA, 17 nt, Vaccinia virus
ugaugccgguaaauguu

SEQ ID NO: 3273368 - RNA, 15 nt, Vaccinia virus
accuauuaauaauua

SEQ ID NO: 3273369 - RNA, 14 nt, Vaccinia virus
aauagauaucauga

SEQ ID NO: 3273370 - RNA, 14 nt, Vaccinia virus
uuagagaaaaacaa

SEQ ID NO: 3273371 - RNA, 20 nt, Vaccinia virus
acugguguauauaauuauuu

SEQ ID NO: 3273372 - RNA, 19 nt, Vaccinia virus
aguauccauuuuacauuau

SEQ ID NO: 3273373 - RNA, 18 nt, Vaccinia virus
gcaucagacgcaauaaca

SEQ ID NO: 3273374 - RNA, 20 nt, Vaccinia virus
uauuuguacacaucuaucaa

SEQ ID NO: 3273375 - RNA, 21 nt, Vaccinia virus
uagacugaaugcuuucuugga

SEQ ID NO: 3273376 - RNA, 14 nt, Vaccinia virus
accauuauuaauaa

SEQ ID NO: 3273377 - RNA, 17 nt, Vaccinia virus
ccaaggaucuucuauca

SEQ ID NO: 3273378 - RNA, 23 nt, Vaccinia virus
ugauaaagauaaaagaauucaga

SEQ ID NO: 3273379 - RNA, 17 nt, Vaccinia virus
acagaauauaaauuaua

SEQ ID NO: 3273380 - RNA, 15 nt, Vaccinia virus
gcuaguauagaaauu

SEQ ID NO: 3273381 - RNA, 14 nt, Vaccinia virus
uuuggcucuucuau

SEQ ID NO: 3273382 - RNA, 14 nt, Vaccinia virus
aaacgaaagacugu

SEQ ID NO: 3273383 - RNA, 13 nt, Vaccinia virus
uaacacauuuuca

SEQ ID NO: 3273384 - RNA, 24 nt, Vaccinia virus
auuuaacgaaucauccauaaauua

SEQ ID NO: 3273385 - RNA, 20 nt, Vaccinia virus
auauagauuuuuuaaaggau

SEQ ID NO: 3273386 - RNA, 15 nt, Vaccinia virus
uauccaugaugguca

SEQ ID NO: 3273387 - RNA, 20 nt, Vaccinia virus
cuauuucauacuauuuugug

SEQ ID NO: 3273388 - RNA, 13 nt, Vaccinia virus
auauuacaaaaua

SEQ ID NO: 3273389 - RNA, 22 nt, Vaccinia virus
ucacucucauaauguaaagaua

SEQ ID NO: 3273390 - RNA, 21 nt, Vaccinia virus
cgaauauuagguaaagauauu

SEQ ID NO: 3273391 - RNA, 16 nt, Vaccinia virus
auauacauuacugaau

SEQ ID NO: 3273392 - RNA, 18 nt, Vaccinia virus
aacacguuagaguuuaua

SEQ ID NO: 3273393 - RNA, 21 nt, Vaccinia virus
aaaagacgucacuauuaccaa

SEQ ID NO: 3273394 - RNA, 15 nt, Vaccinia virus
ucugaguauaguguu

SEQ ID NO: 3273395 - RNA, 15 nt, Vaccinia virus
augacacuagaugau

SEQ ID NO: 3273396 - RNA, 18 nt, Vaccinia virus
uagaaguuguaaaugaca

SEQ ID NO: 3273397 - RNA, 19 nt, Vaccinia virus
accauaucgccguaaugua

SEQ ID NO: 3273398 - RNA, 22 nt, Vaccinia virus
gacaguaguugcgggaacaaua

SEQ ID NO: 3273399 - RNA, 19 nt, Vaccinia virus
agucauaucuagaaugaag

SEQ ID NO: 3273400 - RNA, 14 nt, Vaccinia virus
auuauuauuaauaa

SEQ ID NO: 3273401 - RNA, 20 nt, Vaccinia virus
uccggugcccagucuaaaag

SEQ ID NO: 3273402 - RNA, 18 nt, Vaccinia virus
cucuauccgacuagaauu

SEQ ID NO: 3273403 - RNA, 21 nt, Vaccinia virus
aaugacaucuaugauuuuacu

SEQ ID NO: 3273404 - RNA, 20 nt, Vaccinia virus
cauuaauaucuuuauaagag

SEQ ID NO: 3273405 - RNA, 14 nt, Vaccinia virus
auuuuguucaucuc

SEQ ID NO: 3273406 - RNA, 14 nt, Vaccinia virus
guuuaauaaauguu

SEQ ID NO: 3273407 - RNA, 18 nt, Vaccinia virus
uaauaugacucaugaucu

SEQ ID NO: 3273408 - RNA, 17 nt, Vaccinia virus
ucuauauagauggagua

SEQ ID NO: 3273409 - RNA, 15 nt, Vaccinia virus
uagaaacauauucua

SEQ ID NO: 3273410 - RNA, 24 nt, Vaccinia virus
uaauaguuuccaccgaaagacuau

SEQ ID NO: 3273411 - RNA, 21 nt, Vaccinia virus
gagucuuuaucaauaaacaau

SEQ ID NO: 3273412 - RNA, 19 nt, Vaccinia virus
auaaucugguggauacucu

SEQ ID NO: 3273413 - RNA, 12 nt, Vaccinia virus
uuguaaaugaca

SEQ ID NO: 3273414 - RNA, 12 nt, Vaccinia virus
gaugucaugaac

SEQ ID NO: 3273415 - RNA, 15 nt, Vaccinia virus
aguuccagaaaaugu

SEQ ID NO: 3273416 - RNA, 21 nt, Vaccinia virus
uguaaccgcguuaauguuugc

SEQ ID NO: 3273417 - RNA, 18 nt, Vaccinia virus
guauggagacauucauug

SEQ ID NO: 3273418 - RNA, 21 nt, Vaccinia virus
ugaacaagagauauauuggag

SEQ ID NO: 3273419 - RNA, 12 nt, Vaccinia virus
caucuacauaau

SEQ ID NO: 3273420 - RNA, 16 nt, Vaccinia virus
auaauggugcuuguau

SEQ ID NO: 3273421 - RNA, 13 nt, Vaccinia virus
gaauuaauaauau

SEQ ID NO: 3273422 - RNA, 17 nt, Vaccinia virus
guaacuacguucaucau

SEQ ID NO: 3273423 - RNA, 14 nt, Vaccinia virus
auguauuugauaua

SEQ ID NO: 3273424 - RNA, 23 nt, Vaccinia virus
uaccaauaugucuguacaaaugu

SEQ ID NO: 3273425 - RNA, 24 nt, Vaccinia virus
cauaaucuaaaauaguucuguaau

SEQ ID NO: 3273426 - RNA, 14 nt, Vaccinia virus
auucaaauguuguu

SEQ ID NO: 3273427 - RNA, 16 nt, Vaccinia virus
cuguaaguauguuuaa

SEQ ID NO: 3273428 - RNA, 23 nt, Vaccinia virus
acgaauaucguucucuaaauguc

SEQ ID NO: 3273429 - RNA, 18 nt, Vaccinia virus
gaaccuucuacauauaau

SEQ ID NO: 3273430 - RNA, 22 nt, Vaccinia virus
auuuggucauaauagaauguau

SEQ ID NO: 3273431 - RNA, 19 nt, Vaccinia virus
ugguuucuuucauuucagu

SEQ ID NO: 3273432 - RNA, 21 nt, Vaccinia virus
ucuuuaaacgauauucuugaa

SEQ ID NO: 3273433 - RNA, 20 nt, Vaccinia virus
gaaacucuguuguauaucua

SEQ ID NO: 3273434 - RNA, 16 nt, Vaccinia virus
aucaacaauuuuguau

SEQ ID NO: 3273435 - RNA, 13 nt, Vaccinia virus
aucaaauacuuca

SEQ ID NO: 3273436 - RNA, 17 nt, Vaccinia virus
gagaagaugguuaaaaa

SEQ ID NO: 3273437 - RNA, 20 nt, Vaccinia virus
uauaaucuucgucuauuaca

SEQ ID NO: 3273438 - RNA, 14 nt, Vaccinia virus
caaauauacuaacg

SEQ ID NO: 3273439 - RNA, 23 nt, Vaccinia virus
acuaacauacggcaaauauuuug

SEQ ID NO: 3273440 - RNA, 17 nt, Vaccinia virus
auccauggcagagacga

SEQ ID NO: 3273441 - RNA, 15 nt, Vaccinia virus
acauugauugccaua

SEQ ID NO: 3273442 - RNA, 20 nt, Vaccinia virus
auacauuuccgaaugaaugu

SEQ ID NO: 3273443 - RNA, 13 nt, Vaccinia virus
aaauugaaaauaa

SEQ ID NO: 3273444 - RNA, 16 nt, Vaccinia virus
gaacaacgucaacaac

SEQ ID NO: 3273445 - RNA, 14 nt, Vaccinia virus
agacuacaauauau

SEQ ID NO: 3273446 - RNA, 19 nt, Vaccinia virus
uugaugucuacacauccuu

SEQ ID NO: 3273447 - RNA, 20 nt, Vaccinia virus
gccagagauaauuucuguaa

SEQ ID NO: 3273448 - RNA, 17 nt, Vaccinia virus
cgcuacaauaacucuau

SEQ ID NO: 3273449 - RNA, 20 nt, Vaccinia virus
gccgauagucucauagucua

SEQ ID NO: 3273450 - RNA, 16 nt, Vaccinia virus
cauguucgaaaaagug

SEQ ID NO: 3273451 - RNA, 15 nt, Vaccinia virus
gacgucaaacaaugu

SEQ ID NO: 3273452 - RNA, 12 nt, Vaccinia virus
uuaaauauuucu

SEQ ID NO: 3273453 - RNA, 16 nt, Vaccinia virus
ugggauaaaaauuaug

SEQ ID NO: 3273454 - RNA, 19 nt, Vaccinia virus
acauuagccggacaaauau

SEQ ID NO: 3273455 - RNA, 18 nt, Vaccinia virus
cugcgacggagcauuuuc

SEQ ID NO: 3273456 - RNA, 21 nt, Vaccinia virus
auuuaauacguucauuaaaaa

SEQ ID NO: 3273457 - RNA, 14 nt, Vaccinia virus
gaaaucuaguucug

SEQ ID NO: 3273458 - RNA, 22 nt, Vaccinia virus
auaagaaugacuccuauguuuc

SEQ ID NO: 3273459 - RNA, 21 nt, Vaccinia virus
ccuuuguuauuuauuuuauuc

SEQ ID NO: 3273460 - RNA, 22 nt, Vaccinia virus
aagacauuccuaugaugaugca

SEQ ID NO: 3273461 - RNA, 23 nt, Vaccinia virus
aaaugguugaauccagcauguau

SEQ ID NO: 3273462 - RNA, 22 nt, Vaccinia virus
cauguguagaugcuacuucauc

SEQ ID NO: 3273463 - RNA, 20 nt, Vaccinia virus
ggcuacacacgguagaaaaa

SEQ ID NO: 3273464 - RNA, 20 nt, Vaccinia virus
auacuucaucaguguagaua

SEQ ID NO: 3273465 - RNA, 20 nt, Vaccinia virus
uuuagaaauguuauauauaa

SEQ ID NO: 3273466 - RNA, 21 nt, Vaccinia virus
uucaaggaugccauagauucu

SEQ ID NO: 3273467 - RNA, 13 nt, Vaccinia virus
ccuuguauccauu

SEQ ID NO: 3273468 - RNA, 16 nt, Vaccinia virus
gaacacauuuacgaua

SEQ ID NO: 3273469 - RNA, 14 nt, Vaccinia virus
auugacgacuuugg

SEQ ID NO: 3273470 - RNA, 14 nt, Vaccinia virus
guacccaaguuauu

SEQ ID NO: 3273471 - RNA, 21 nt, Vaccinia virus
agaaacaccuagaauacucau

SEQ ID NO: 3273472 - RNA, 21 nt, Vaccinia virus
auuaguauucuucuugucauc

SEQ ID NO: 3273473 - RNA, 18 nt, Vaccinia virus
uaucauuaauaaagacuu

SEQ ID NO: 3273474 - RNA, 23 nt, Vaccinia virus
ugaugauuagauggagaguauau

SEQ ID NO: 3273475 - RNA, 16 nt, Vaccinia virus
auacauauuuucagua

SEQ ID NO: 3273476 - RNA, 14 nt, Vaccinia virus
caggcucuauuuuc

SEQ ID NO: 3273477 - RNA, 14 nt, Vaccinia virus
acuaaauccgagaa

SEQ ID NO: 3273478 - RNA, 18 nt, Vaccinia virus
ucacaauacgauuuagau

SEQ ID NO: 3273479 - RNA, 23 nt, Vaccinia virus
uuaaaauauauuaucacuucagu

SEQ ID NO: 3273480 - RNA, 14 nt, Vaccinia virus
auaaacauaauaaa

SEQ ID NO: 3273481 - RNA, 23 nt, Vaccinia virus
uuaauuguuaaacauacaucugu

SEQ ID NO: 3273482 - RNA, 20 nt, Vaccinia virus
acuauauaccuauuaauaca

SEQ ID NO: 3273483 - RNA, 22 nt, Vaccinia virus
augucugauuuuucuucauuua

SEQ ID NO: 3273484 - RNA, 23 nt, Vaccinia virus
auauucuuguuauguuaauacau

SEQ ID NO: 3273485 - RNA, 16 nt, Vaccinia virus
cucccauaauacuuua

SEQ ID NO: 3273486 - RNA, 13 nt, Vaccinia virus
aauaguagaauua

SEQ ID NO: 3273487 - RNA, 20 nt, Vaccinia virus
uauaaagaugguaaacucuu

SEQ ID NO: 3273488 - RNA, 14 nt, Vaccinia virus
aucagauauuugcg

SEQ ID NO: 3273489 - RNA, 14 nt, Vaccinia virus
augaguuagauuac

SEQ ID NO: 3273490 - RNA, 18 nt, Vaccinia virus
acaacaaugucucgaaau

SEQ ID NO: 3273491 - RNA, 18 nt, Vaccinia virus
aucugauaauuuagauaa

SEQ ID NO: 3273492 - RNA, 15 nt, Vaccinia virus
uguuuaauuuucaca

SEQ ID NO: 3273493 - RNA, 13 nt, Vaccinia virus
auauauacaguag

SEQ ID NO: 3273494 - RNA, 14 nt, Vaccinia virus
aagcaagaaagaua

SEQ ID NO: 3273495 - RNA, 14 nt, Vaccinia virus
uaauuacuaaaucu

SEQ ID NO: 3273496 - RNA, 20 nt, Vaccinia virus
aauggacuccaauacgaaau

SEQ ID NO: 3273497 - RNA, 17 nt, Vaccinia virus
agucgagauacagaaaa

SEQ ID NO: 3273498 - RNA, 18 nt, Vaccinia virus
uaguggacuugucaaauc

SEQ ID NO: 3273499 - RNA, 16 nt, Vaccinia virus
gaacucgauacuaucg

SEQ ID NO: 3273500 - RNA, 21 nt, Vaccinia virus
aguaugaguaagauaguguuu

SEQ ID NO: 3273501 - RNA, 19 nt, Vaccinia virus
gucucuuccgcagauaaau

SEQ ID NO: 3273502 - RNA, 22 nt, Vaccinia virus
uaugagggaaaagauucucauu

SEQ ID NO: 3273503 - RNA, 13 nt, Vaccinia virus
ggaugccacugcu

SEQ ID NO: 3273504 - RNA, 18 nt, Vaccinia virus
ucuagucgcaucucuuaa

SEQ ID NO: 3273505 - RNA, 13 nt, Vaccinia virus
auggaaaggaaac

SEQ ID NO: 3273506 - RNA, 18 nt, Vaccinia virus
aacucuuuagucgagaua

SEQ ID NO: 3273507 - RNA, 20 nt, Vaccinia virus
uguaauacauuuugaacucu

SEQ ID NO: 3273508 - RNA, 21 nt, Vaccinia virus
auaccuuaccgccuucauaag

SEQ ID NO: 3273509 - RNA, 19 nt, Vaccinia virus
auguauucagucagacaau

SEQ ID NO: 3273510 - RNA, 20 nt, Vaccinia virus
aauauauaagacacagaaau

SEQ ID NO: 3273511 - RNA, 14 nt, Vaccinia virus
guagcguauuucuc

SEQ ID NO: 3273512 - RNA, 22 nt, Vaccinia virus
uuaauagauauauuaauacuuu

SEQ ID NO: 3273513 - RNA, 18 nt, Vaccinia virus
ccugauuaguauuuucua

SEQ ID NO: 3273514 - RNA, 17 nt, Vaccinia virus
gcuaauuugauaaagau

SEQ ID NO: 3273515 - RNA, 19 nt, Vaccinia virus
aacgucgguauuauauuau

SEQ ID NO: 3273516 - RNA, 15 nt, Vaccinia virus
aaauuugucauuuau

SEQ ID NO: 3273517 - RNA, 20 nt, Vaccinia virus
caaugauaaugauacaguac

SEQ ID NO: 3273518 - RNA, 19 nt, Vaccinia virus
cuauuaaugacacuaguua

SEQ ID NO: 3273519 - RNA, 21 nt, Vaccinia virus
uauaugguauagggagaguau

SEQ ID NO: 3273520 - RNA, 17 nt, Vaccinia virus
uuacuaauaucauuagu

SEQ ID NO: 3273521 - RNA, 18 nt, Vaccinia virus
auuuuccaaauacaucca

SEQ ID NO: 3273522 - RNA, 13 nt, Vaccinia virus
gucuuaauagaca

SEQ ID NO: 3273523 - RNA, 15 nt, Vaccinia virus
acaaaacagaaauau

SEQ ID NO: 3273524 - RNA, 16 nt, Vaccinia virus
agcucgugguauuaua

SEQ ID NO: 3273525 - RNA, 16 nt, Vaccinia virus
ugugaugccaauaagc

SEQ ID NO: 3273526 - RNA, 17 nt, Vaccinia virus
aucuauucauaaaacau

SEQ ID NO: 3273527 - RNA, 22 nt, Vaccinia virus
acaaauguuaaacauuaauuga

SEQ ID NO: 3273528 - RNA, 16 nt, Vaccinia virus
aaacuguuuaagaaaa

SEQ ID NO: 3273529 - RNA, 19 nt, Vaccinia virus
auuuugugauauuaauaua

SEQ ID NO: 3273530 - RNA, 12 nt, Vaccinia virus
gauuuucuggga

SEQ ID NO: 3273531 - RNA, 21 nt, Vaccinia virus
uacuuaaagauagaaaugaau

SEQ ID NO: 3273532 - RNA, 21 nt, Vaccinia virus
acguccugcaggguauuguuu

SEQ ID NO: 3273533 - RNA, 12 nt, Vaccinia virus
ucuguacaaaau

SEQ ID NO: 3273534 - RNA, 23 nt, Vaccinia virus
gcugaauguaucuuccacaucaa

SEQ ID NO: 3273535 - RNA, 12 nt, Vaccinia virus
caaaauguuuga

SEQ ID NO: 3273536 - RNA, 20 nt, Vaccinia virus
ucaguguccaucauuucauu

SEQ ID NO: 3273537 - RNA, 16 nt, Vaccinia virus
ucgauaacucuauuca

SEQ ID NO: 3273538 - RNA, 12 nt, Vaccinia virus
cgccauggaugg

SEQ ID NO: 3273539 - RNA, 12 nt, Vaccinia virus
uuuccaaagaua

SEQ ID NO: 3273540 - RNA, 21 nt, Vaccinia virus
uauagauccuccaguaaauga

SEQ ID NO: 3273541 - RNA, 15 nt, Vaccinia virus
cucuuaauuauaacg

SEQ ID NO: 3273542 - RNA, 16 nt, Vaccinia virus
aauucaggaacuauaa

SEQ ID NO: 3273543 - RNA, 21 nt, Vaccinia virus
uguagugucaauuuuaaauga

SEQ ID NO: 3273544 - RNA, 22 nt, Vaccinia virus
ugacaaaauuaaaaaagauaaa

SEQ ID NO: 3273545 - RNA, 21 nt, Vaccinia virus
uaugaccgguuuaauguuaua

SEQ ID NO: 3273546 - RNA, 11 nt, Vaccinia virus
gucuuuucuaa

SEQ ID NO: 3273547 - RNA, 23 nt, Vaccinia virus
auuuuuuuaaaaaggaaauacuu

SEQ ID NO: 3273548 - RNA, 15 nt, Vaccinia virus
uaucuauguuaucau

SEQ ID NO: 3273549 - RNA, 15 nt, Vaccinia virus
uaauacacacaaagu

SEQ ID NO: 3273550 - RNA, 15 nt, Vaccinia virus
ucuacagauggagua

SEQ ID NO: 3273551 - RNA, 13 nt, Vaccinia virus
cuauauagauauu

SEQ ID NO: 3273552 - RNA, 13 nt, Vaccinia virus
acugcugugaaua

SEQ ID NO: 3273553 - RNA, 16 nt, Vaccinia virus
ugcuaauauucccaaa

SEQ ID NO: 3273554 - RNA, 13 nt, Vaccinia virus
aucaauguagaaa

SEQ ID NO: 3273555 - RNA, 15 nt, Vaccinia virus
uccauuaauguggaa

SEQ ID NO: 3273556 - RNA, 15 nt, Vaccinia virus
aagguguuaaaauua

SEQ ID NO: 3273557 - RNA, 13 nt, Vaccinia virus
acgcgucuguuuu

SEQ ID NO: 3273558 - RNA, 24 nt, Vaccinia virus
auggauuuggucauaauagaaugu

SEQ ID NO: 3273559 - RNA, 16 nt, Vaccinia virus
aaucucucucaaauau

SEQ ID NO: 3273560 - RNA, 15 nt, Vaccinia virus
cacuaacgugauuau

SEQ ID NO: 3273561 - RNA, 21 nt, Vaccinia virus
uuuuaacgcgucugaauguau

SEQ ID NO: 3273562 - RNA, 13 nt, Vaccinia virus
ugaauuguuucuu

SEQ ID NO: 3273563 - RNA, 15 nt, Vaccinia virus
ggauaaaaucuuuug

SEQ ID NO: 3273564 - RNA, 22 nt, Vaccinia virus
uucaaugaacucaucgagauau

SEQ ID NO: 3273565 - RNA, 18 nt, Vaccinia virus
auaauaagaugcaaacau

SEQ ID NO: 3273566 - RNA, 12 nt, Vaccinia virus
aaugaauguuua

SEQ ID NO: 3273567 - RNA, 18 nt, Vaccinia virus
uaguucguguacuaguca

SEQ ID NO: 3273568 - RNA, 14 nt, Vaccinia virus
auuuuuuacaauuu

SEQ ID NO: 3273569 - RNA, 13 nt, Vaccinia virus
gucuaucuauaug

SEQ ID NO: 3273570 - RNA, 15 nt, Vaccinia virus
cacaugauugacaaa

SEQ ID NO: 3273571 - RNA, 18 nt, Vaccinia virus
uaacuggcggauuauuca

SEQ ID NO: 3273572 - RNA, 18 nt, Vaccinia virus
cauuuuuuauaaaaacuu

SEQ ID NO: 3273573 - RNA, 16 nt, Vaccinia virus
agcacaagauuuccaa

SEQ ID NO: 3273574 - RNA, 18 nt, Vaccinia virus
ucauccuuaaauguuuuc

SEQ ID NO: 3273575 - RNA, 23 nt, Vaccinia virus
cuaucgaaaauugcuauuucaga

SEQ ID NO: 3273576 - RNA, 18 nt, Vaccinia virus
aguuaaguuuuuuaagaa

SEQ ID NO: 3273577 - RNA, 22 nt, Vaccinia virus
ucuaucuccaguauuuacauua

SEQ ID NO: 3273578 - RNA, 23 nt, Vaccinia virus
auccacuaugaucaauucuggau

SEQ ID NO: 3273579 - RNA, 14 nt, Vaccinia virus
ucaucuaugugauu

SEQ ID NO: 3273580 - RNA, 20 nt, Vaccinia virus
accacacggagaacagauga

SEQ ID NO: 3273581 - RNA, 16 nt, Vaccinia virus
auacuguguaaagaaa

SEQ ID NO: 3273582 - RNA, 16 nt, Vaccinia virus
aucgccuuuauuucca

SEQ ID NO: 3273583 - RNA, 22 nt, Vaccinia virus
auauuuguuauuuuuucuguaa

SEQ ID NO: 3273584 - RNA, 18 nt, Vaccinia virus
acuaacucucuaauggau

SEQ ID NO: 3273585 - RNA, 15 nt, Vaccinia virus
guaacgcguggaaaa

SEQ ID NO: 3273586 - RNA, 13 nt, Vaccinia virus
gcauaagaaaaac

SEQ ID NO: 3273587 - RNA, 21 nt, Vaccinia virus
uuaaugacacuaguuaagaac

SEQ ID NO: 3273588 - RNA, 13 nt, Vaccinia virus
aguacuuaaugaa

SEQ ID NO: 3273589 - RNA, 20 nt, Vaccinia virus
cuugacauuuucuucuuucu

SEQ ID NO: 3273590 - RNA, 22 nt, Vaccinia virus
aaugacuacguuguuaugagug

SEQ ID NO: 3273591 - RNA, 22 nt, Vaccinia virus
ucuucuuauaagauuguagaau

SEQ ID NO: 3273592 - RNA, 12 nt, Vaccinia virus
uaauuuacuacu

SEQ ID NO: 3273593 - RNA, 22 nt, Vaccinia virus
uaacaugacauuuauucaucau

SEQ ID NO: 3273594 - RNA, 21 nt, Vaccinia virus
caacaaaagguauuacaagaa

SEQ ID NO: 3273595 - RNA, 21 nt, Vaccinia virus
uaaaguuagaugugucauacu

SEQ ID NO: 3273596 - RNA, 16 nt, Vaccinia virus
ugacaucgccuacaaa

SEQ ID NO: 3273597 - RNA, 22 nt, Vaccinia virus
aauaugcuaguuaauaguaaau

SEQ ID NO: 3273598 - RNA, 19 nt, Vaccinia virus
acuaucgcaucaaaaggau

SEQ ID NO: 3273599 - RNA, 21 nt, Vaccinia virus
acaguuacuccaauuacaaca

SEQ ID NO: 3273600 - RNA, 17 nt, Vaccinia virus
auacugaagucugauau

SEQ ID NO: 3273601 - RNA, 20 nt, Vaccinia virus
agauucagaauuucuacaua

SEQ ID NO: 3273602 - RNA, 18 nt, Vaccinia virus
aucgauugauagugaaug

SEQ ID NO: 3273603 - RNA, 18 nt, Vaccinia virus
cauuuuaggauaugcuuu

SEQ ID NO: 3273604 - RNA, 13 nt, Vaccinia virus
uccuauuaugaaa

SEQ ID NO: 3273605 - RNA, 22 nt, Vaccinia virus
uuauacgaaaaaaaucauuaaa

SEQ ID NO: 3273606 - RNA, 17 nt, Vaccinia virus
cuaacaugcauuugaaa

SEQ ID NO: 3273607 - RNA, 15 nt, Vaccinia virus
ucuugauuacaaaac

SEQ ID NO: 3273608 - RNA, 23 nt, Vaccinia virus
aacuaccaauaugucuguacaaa

SEQ ID NO: 3273609 - RNA, 21 nt, Vaccinia virus
auuacucuccuagguuucucu

SEQ ID NO: 3273610 - RNA, 15 nt, Vaccinia virus
uguuauaaguuuuua

SEQ ID NO: 3273611 - RNA, 13 nt, Vaccinia virus
acauaaacaaauu

SEQ ID NO: 3273612 - RNA, 16 nt, Vaccinia virus
acucauccuaucugga

SEQ ID NO: 3273613 - RNA, 13 nt, Vaccinia virus
auauauagaaugg

SEQ ID NO: 3273614 - RNA, 18 nt, Vaccinia virus
cagucaagucaaugauau

SEQ ID NO: 3273615 - RNA, 13 nt, Vaccinia virus
gcuguuauauauu

SEQ ID NO: 3273616 - RNA, 17 nt, Vaccinia virus
aaggaauauacaaaguu

SEQ ID NO: 3273617 - RNA, 13 nt, Vaccinia virus
agaagauuuaacu

SEQ ID NO: 3273618 - RNA, 15 nt, Vaccinia virus
uaguauucguuuucu

SEQ ID NO: 3273619 - RNA, 18 nt, Vaccinia virus
auacaaauccauuaaugu

SEQ ID NO: 3273620 - RNA, 15 nt, Vaccinia virus
guguauaacaucuuu

SEQ ID NO: 3273621 - RNA, 15 nt, Vaccinia virus
auauacauuguauaa

SEQ ID NO: 3273622 - RNA, 17 nt, Vaccinia virus
uaggcacagucaaacau

SEQ ID NO: 3273623 - RNA, 21 nt, Vaccinia virus
uaguugauagaacaaaauaca

SEQ ID NO: 3273624 - RNA, 17 nt, Vaccinia virus
uaauuccuuuuuaaauu

SEQ ID NO: 3273625 - RNA, 19 nt, Vaccinia virus
aacgauuuaauuacagagu

SEQ ID NO: 3273626 - RNA, 15 nt, Vaccinia virus
uggaguaguacaaga

SEQ ID NO: 3273627 - RNA, 19 nt, Vaccinia virus
aucaauguguguaacucca

SEQ ID NO: 3273628 - RNA, 20 nt, Vaccinia virus
cuugauacagccaaguaucu

SEQ ID NO: 3273629 - RNA, 20 nt, Vaccinia virus
uuccuauaaucguuaaauuu

SEQ ID NO: 3273630 - RNA, 18 nt, Vaccinia virus
uaacaucagaaaauguaa

SEQ ID NO: 3273631 - RNA, 13 nt, Vaccinia virus
ucugacauucaga

SEQ ID NO: 3273632 - RNA, 16 nt, Vaccinia virus
uaucucauuugagaau

SEQ ID NO: 3273633 - RNA, 22 nt, Vaccinia virus
auguuaauugggguauuaauaa

SEQ ID NO: 3273634 - RNA, 23 nt, Vaccinia virus
uuuugacaaagauggucuaaaau

SEQ ID NO: 3273635 - RNA, 22 nt, Vaccinia virus
gaauauuuaauuuggucauuau

SEQ ID NO: 3273636 - RNA, 17 nt, Vaccinia virus
aagcuguucaaaauaua

SEQ ID NO: 3273637 - RNA, 22 nt, Vaccinia virus
aagcguuggcaccggaauacua

SEQ ID NO: 3273638 - RNA, 19 nt, Vaccinia virus
uuagacgacguauuauaca

SEQ ID NO: 3273639 - RNA, 14 nt, Vaccinia virus
cacugauucagaaa

SEQ ID NO: 3273640 - RNA, 13 nt, Vaccinia virus
cuaugauauuguu

SEQ ID NO: 3273641 - RNA, 16 nt, Vaccinia virus
caaauuuuucaugaau

SEQ ID NO: 3273642 - RNA, 23 nt, Vaccinia virus
auuuuuauauuauuuacacaauu

SEQ ID NO: 3273643 - RNA, 20 nt, Vaccinia virus
caaaauguuugacauuagua

SEQ ID NO: 3273644 - RNA, 20 nt, Vaccinia virus
cauguggaucugaagaagag

SEQ ID NO: 3273645 - RNA, 12 nt, Vaccinia virus
aauuugaauauc

SEQ ID NO: 3273646 - RNA, 16 nt, Vaccinia virus
agaauacaaucuguau

SEQ ID NO: 3273647 - RNA, 22 nt, Vaccinia virus
auuuucuugugaccaacucauc

SEQ ID NO: 3273648 - RNA, 14 nt, Vaccinia virus
ccaucaaaagcauu

SEQ ID NO: 3273649 - RNA, 18 nt, Vaccinia virus
agcuguacaccauagcac

SEQ ID NO: 3273650 - RNA, 14 nt, Vaccinia virus
auaaaagaauaugu

SEQ ID NO: 3273651 - RNA, 21 nt, Vaccinia virus
uggcuucuuccauaguuagaa

SEQ ID NO: 3273652 - RNA, 15 nt, Vaccinia virus
uuaaauaucugugaa

SEQ ID NO: 3273653 - RNA, 18 nt, Vaccinia virus
aucucuagauauguauuu

SEQ ID NO: 3273654 - RNA, 15 nt, Vaccinia virus
auccuaucuaagaug

SEQ ID NO: 3273655 - RNA, 12 nt, Vaccinia virus
aaauauucauua

SEQ ID NO: 3273656 - RNA, 17 nt, Vaccinia virus
cuagauuccaaucauug

SEQ ID NO: 3273657 - RNA, 14 nt, Vaccinia virus
acgugauuuuauca

SEQ ID NO: 3273658 - RNA, 21 nt, Vaccinia virus
uuaauagauauaucucuuaau

SEQ ID NO: 3273659 - RNA, 16 nt, Vaccinia virus
cagguaggcaguuuua

SEQ ID NO: 3273660 - RNA, 17 nt, Vaccinia virus
aaguuucguacaaauac

SEQ ID NO: 3273661 - RNA, 20 nt, Vaccinia virus
gccauugaaaacuauuucuu

SEQ ID NO: 3273662 - RNA, 23 nt, Vaccinia virus
aucuuauauacacauaauuauuc

SEQ ID NO: 3273663 - RNA, 20 nt, Vaccinia virus
auagcguacaauacauguac

SEQ ID NO: 3273664 - RNA, 14 nt, Vaccinia virus
ucucuaguuuuauu

SEQ ID NO: 3273665 - RNA, 20 nt, Vaccinia virus
aguuugccuucuuuaguaga

SEQ ID NO: 3273666 - RNA, 22 nt, Vaccinia virus
cuaguccaaagacuuacaggaa

SEQ ID NO: 3273667 - RNA, 18 nt, Vaccinia virus
uucugcauuacaaagaag

SEQ ID NO: 3273668 - RNA, 12 nt, Vaccinia virus
uguuaauaacug

SEQ ID NO: 3273669 - RNA, 14 nt, Vaccinia virus
uaauaauuaaccaa

SEQ ID NO: 3273670 - RNA, 14 nt, Vaccinia virus
auacauuuuucuau

SEQ ID NO: 3273671 - RNA, 17 nt, Vaccinia virus
ucuaaucacuuuaacuu

SEQ ID NO: 3273672 - RNA, 20 nt, Vaccinia virus
auuggagauccgauccauga

SEQ ID NO: 3273673 - RNA, 20 nt, Vaccinia virus
auaauaacaaguaugacauu

SEQ ID NO: 3273674 - RNA, 12 nt, Vaccinia virus
uuaccaacaaua

SEQ ID NO: 3273675 - RNA, 19 nt, Vaccinia virus
auaguuacagaauuuguau

SEQ ID NO: 3273676 - RNA, 15 nt, Vaccinia virus
acguagaaaacggau

SEQ ID NO: 3273677 - RNA, 16 nt, Vaccinia virus
cuguaaaggaaucauu

SEQ ID NO: 3273678 - RNA, 11 nt, Vaccinia virus
ugcgauacauu

SEQ ID NO: 3273679 - RNA, 15 nt, Vaccinia virus
gaauuagucaaucuu

SEQ ID NO: 3273680 - RNA, 15 nt, Vaccinia virus
acuucaaaaacgaua

SEQ ID NO: 3273681 - RNA, 17 nt, Vaccinia virus
agaggcauaaucaaugu

SEQ ID NO: 3273682 - RNA, 21 nt, Vaccinia virus
cgaaacauccaucgauacaua

SEQ ID NO: 3273683 - RNA, 15 nt, Vaccinia virus
aauuacccauggaga

SEQ ID NO: 3273684 - RNA, 15 nt, Vaccinia virus
gauaucuaaauaugc

SEQ ID NO: 3273685 - RNA, 18 nt, Vaccinia virus
gauucuaucuuccuucga

SEQ ID NO: 3273686 - RNA, 22 nt, Vaccinia virus
gacuauuggaauguguuaaaaa

SEQ ID NO: 3273687 - RNA, 15 nt, Vaccinia virus
cuguugaaguacuua

SEQ ID NO: 3273688 - RNA, 18 nt, Vaccinia virus
gaauccauagaacaaaau

SEQ ID NO: 3273689 - RNA, 13 nt, Vaccinia virus
cugaguaaaugug

SEQ ID NO: 3273690 - RNA, 15 nt, Vaccinia virus
auaauaaaucaaaau

SEQ ID NO: 3273691 - RNA, 15 nt, Vaccinia virus
aacauuauguaguaa

SEQ ID NO: 3273692 - RNA, 19 nt, Vaccinia virus
augacgcauauucuacucu

SEQ ID NO: 3273693 - RNA, 15 nt, Vaccinia virus
gaguuagauauuaau

SEQ ID NO: 3273694 - RNA, 17 nt, Vaccinia virus
aaacuacugauguuauc

SEQ ID NO: 3273695 - RNA, 14 nt, Vaccinia virus
agauucaacauuua

SEQ ID NO: 3273696 - RNA, 15 nt, Vaccinia virus
aggauagagcaauaa

SEQ ID NO: 3273697 - RNA, 16 nt, Vaccinia virus
aucauugcuguaaaca

SEQ ID NO: 3273698 - RNA, 20 nt, Vaccinia virus
ggauguuguucgauugauuu

SEQ ID NO: 3273699 - RNA, 22 nt, Vaccinia virus
auguauuuugaggaaauugaua

SEQ ID NO: 3273700 - RNA, 21 nt, Vaccinia virus
gaucuagcaaaggaaauugug

SEQ ID NO: 3273701 - RNA, 17 nt, Vaccinia virus
gcuaaguaauaaaucaa

SEQ ID NO: 3273702 - RNA, 19 nt, Vaccinia virus
aaacuuguaagaaguaaau

SEQ ID NO: 3273703 - RNA, 14 nt, Vaccinia virus
cuauauaguucaaa

SEQ ID NO: 3273704 - RNA, 12 nt, Vaccinia virus
agcauguagaag

SEQ ID NO: 3273705 - RNA, 22 nt, Vaccinia virus
gacuaauuccuaguuucaucau

SEQ ID NO: 3273706 - RNA, 17 nt, Vaccinia virus
ugagucuauaucccauu

SEQ ID NO: 3273707 - RNA, 19 nt, Vaccinia virus
ucaauaacuggcacaacaa

SEQ ID NO: 3273708 - RNA, 12 nt, Vaccinia virus
aguuuauaucaa

SEQ ID NO: 3273709 - RNA, 14 nt, Vaccinia virus
cauuauaaaaagug

SEQ ID NO: 3273710 - RNA, 18 nt, Vaccinia virus
gacuccggaaccaauuac

SEQ ID NO: 3273711 - RNA, 14 nt, Vaccinia virus
auuuguugaugaag

SEQ ID NO: 3273712 - RNA, 17 nt, Vaccinia virus
aguuuggagaaauggag

SEQ ID NO: 3273713 - RNA, 19 nt, Vaccinia virus
cugaauuauuauuacugaa

SEQ ID NO: 3273714 - RNA, 23 nt, Vaccinia virus
gacauuaugcuaccgucaugaau

SEQ ID NO: 3273715 - RNA, 15 nt, Vaccinia virus
uaccuggaauguaaa

SEQ ID NO: 3273716 - RNA, 14 nt, Vaccinia virus
gaacucauguagca

SEQ ID NO: 3273717 - RNA, 22 nt, Vaccinia virus
auacauagucgugaucaacauu

SEQ ID NO: 3273718 - RNA, 21 nt, Vaccinia virus
uauuuuuuucuauguuauaua

SEQ ID NO: 3273719 - RNA, 15 nt, Vaccinia virus
guacgguaccuuugu

SEQ ID NO: 3273720 - RNA, 22 nt, Vaccinia virus
auucuacuaggcugacacuaug

SEQ ID NO: 3273721 - RNA, 10 nt, Vaccinia virus
aauaugaacc

SEQ ID NO: 3273722 - RNA, 22 nt, Vaccinia virus
acuacuaggagggaaaaugaag

SEQ ID NO: 3273723 - RNA, 13 nt, Vaccinia virus
ucguucaaauuuu

SEQ ID NO: 3273724 - RNA, 14 nt, Vaccinia virus
uuauuuaacucuuu

SEQ ID NO: 3273725 - RNA, 22 nt, Vaccinia virus
aaauguuugauaaaaauaugua

SEQ ID NO: 3273726 - RNA, 15 nt, Vaccinia virus
uaauaacaguuauau

SEQ ID NO: 3273727 - RNA, 17 nt, Vaccinia virus
uaucuacacaaauagaa

SEQ ID NO: 3273728 - RNA, 21 nt, Vaccinia virus
acagucugcggacuuuaaaca

SEQ ID NO: 3273729 - RNA, 22 nt, Vaccinia virus
cuauaguacacggaauaaugau

SEQ ID NO: 3273730 - RNA, 17 nt, Vaccinia virus
auuaauaauuaauaauu

SEQ ID NO: 3273731 - RNA, 22 nt, Vaccinia virus
uugggcggaucuguaaacauuu

SEQ ID NO: 3273732 - RNA, 20 nt, Vaccinia virus
uaaauuauuuaauaaaguau

SEQ ID NO: 3273733 - RNA, 16 nt, Vaccinia virus
guaucauaauauuaau

SEQ ID NO: 3273734 - RNA, 16 nt, Vaccinia virus
uagcgguaaguauaaa

SEQ ID NO: 3273735 - RNA, 17 nt, Vaccinia virus
acaaacaaacucuaaua

SEQ ID NO: 3273736 - RNA, 18 nt, Vaccinia virus
uaucaaggaacaaauauu

SEQ ID NO: 3273737 - RNA, 23 nt, Vaccinia virus
uuauacgaauaucguucucuaaa

SEQ ID NO: 3273738 - RNA, 20 nt, Vaccinia virus
cguuauuugagagaucauuu

SEQ ID NO: 3273739 - RNA, 15 nt, Vaccinia virus
cgacauucagaaaga

SEQ ID NO: 3273740 - RNA, 13 nt, Vaccinia virus
uauauuuuaucua

SEQ ID NO: 3273741 - RNA, 14 nt, Vaccinia virus
ucauuggaaaauau

SEQ ID NO: 3273742 - RNA, 18 nt, Vaccinia virus
ucuauucugaaauaauua

SEQ ID NO: 3273743 - RNA, 12 nt, Vaccinia virus
aauauaaaacua

SEQ ID NO: 3273744 - RNA, 13 nt, Vaccinia virus
uagucucuguaau

SEQ ID NO: 3273745 - RNA, 23 nt, Vaccinia virus
ugguguccuaguacacaauauca

SEQ ID NO: 3273746 - RNA, 16 nt, Vaccinia virus
uaauuauaagaaauau

SEQ ID NO: 3273747 - RNA, 14 nt, Vaccinia virus
guaaaaauaauuau

SEQ ID NO: 3273748 - RNA, 14 nt, Vaccinia virus
cuacaauuuguauu

SEQ ID NO: 3273749 - RNA, 19 nt, Vaccinia virus
uuagacagugguuucaugu

SEQ ID NO: 3273750 - RNA, 14 nt, Vaccinia virus
aucaagaaacauuu

SEQ ID NO: 3273751 - RNA, 12 nt, Vaccinia virus
aaauaacauuua

SEQ ID NO: 3273752 - RNA, 18 nt, Vaccinia virus
gauaugaacagacauugu

SEQ ID NO: 3273753 - RNA, 16 nt, Vaccinia virus
uacugcugauaaugau

SEQ ID NO: 3273754 - RNA, 13 nt, Vaccinia virus
cuuugauuaauga

SEQ ID NO: 3273755 - RNA, 13 nt, Vaccinia virus
aauugauucuuga

SEQ ID NO: 3273756 - RNA, 23 nt, Vaccinia virus
cugauauggaaucuguauucucg

SEQ ID NO: 3273757 - RNA, 19 nt, Vaccinia virus
uacgccuuuaaauccucua

SEQ ID NO: 3273758 - RNA, 18 nt, Vaccinia virus
uuaauuuggucauuauua

SEQ ID NO: 3273759 - RNA, 16 nt, Vaccinia virus
ugcagaagcaauaaau

SEQ ID NO: 3273760 - RNA, 15 nt, Vaccinia virus
gaauccgaaauuaga

SEQ ID NO: 3273761 - RNA, 19 nt, Vaccinia virus
uucaaaauuguaacaacaa

SEQ ID NO: 3273762 - RNA, 20 nt, Vaccinia virus
auuuuuagaaaguauccauc

SEQ ID NO: 3273763 - RNA, 11 nt, Vaccinia virus
uaaauuagaag

SEQ ID NO: 3273764 - RNA, 22 nt, Vaccinia virus
ucaucuuuaguaaacauaucau

SEQ ID NO: 3273765 - RNA, 13 nt, Vaccinia virus
gucucuaucuuua

SEQ ID NO: 3273766 - RNA, 19 nt, Vaccinia virus
uaauucuauuaauuguuaa

SEQ ID NO: 3273767 - RNA, 13 nt, Vaccinia virus
auauaguuauuaa

SEQ ID NO: 3273768 - RNA, 14 nt, Vaccinia virus
ugcuaauuauuccu

SEQ ID NO: 3273769 - RNA, 18 nt, Vaccinia virus
aaugcaauaacaaagauu

SEQ ID NO: 3273770 - RNA, 19 nt, Vaccinia virus
uaauagacuauauaaaccg

SEQ ID NO: 3273771 - RNA, 16 nt, Vaccinia virus
uuaauccacuauauau

SEQ ID NO: 3273772 - RNA, 19 nt, Vaccinia virus
aaacuuccauggaaaaacg

SEQ ID NO: 3273773 - RNA, 22 nt, Vaccinia virus
aucacgucagcggcaucuaaau

SEQ ID NO: 3273774 - RNA, 16 nt, Vaccinia virus
gagaaaaacaacgaga

SEQ ID NO: 3273775 - RNA, 21 nt, Vaccinia virus
acauaugaaccuucuacauau

SEQ ID NO: 3273776 - RNA, 15 nt, Vaccinia virus
ucagauauaucuauu

SEQ ID NO: 3273777 - RNA, 15 nt, Vaccinia virus
acaaucucuauaucu

SEQ ID NO: 3273778 - RNA, 13 nt, Vaccinia virus
uucuauuauuauu

SEQ ID NO: 3273779 - RNA, 14 nt, Vaccinia virus
guuaaagaaauuaa

SEQ ID NO: 3273780 - RNA, 12 nt, Vaccinia virus
ucccauguuuca

SEQ ID NO: 3273781 - RNA, 21 nt, Vaccinia virus
ucgauaccguauuguucuaaa

SEQ ID NO: 3273782 - RNA, 18 nt, Vaccinia virus
aggccaaagaaaugagua

SEQ ID NO: 3273783 - RNA, 18 nt, Vaccinia virus
guugucuaguauuuaaca

SEQ ID NO: 3273784 - RNA, 12 nt, Vaccinia virus
cucccuuuagau

SEQ ID NO: 3273785 - RNA, 16 nt, Vaccinia virus
aacaacucguuauuac

SEQ ID NO: 3273786 - RNA, 20 nt, Vaccinia virus
gacgaccuuuggauuuucac

SEQ ID NO: 3273787 - RNA, 21 nt, Vaccinia virus
ucucauaauaaacuagaguau

SEQ ID NO: 3273788 - RNA, 21 nt, Vaccinia virus
aacuacaucgguaucuagauc

SEQ ID NO: 3273789 - RNA, 16 nt, Vaccinia virus
cuuauucuuaaaaucu

SEQ ID NO: 3273790 - RNA, 20 nt, Vaccinia virus
uuacauuuuuuauaaauaga

SEQ ID NO: 3273791 - RNA, 20 nt, Vaccinia virus
auaugaaccuucuacauaua

SEQ ID NO: 3273792 - RNA, 23 nt, Vaccinia virus
ugacgaucuuguuauaauuauaa

SEQ ID NO: 3273793 - RNA, 17 nt, Vaccinia virus
auaggagcuagaagaac

SEQ ID NO: 3273794 - RNA, 21 nt, Vaccinia virus
uauggaugccaacguaguauc

SEQ ID NO: 3273795 - RNA, 15 nt, Vaccinia virus
caaauccauuaaugu

SEQ ID NO: 3273796 - RNA, 13 nt, Vaccinia virus
aaaauauaaauua

SEQ ID NO: 3273797 - RNA, 13 nt, Vaccinia virus
aguaguucauuau

SEQ ID NO: 3273798 - RNA, 14 nt, Vaccinia virus
aaauaucgauguuu

SEQ ID NO: 3273799 - RNA, 19 nt, Vaccinia virus
guuauacgucauuucaucu

SEQ ID NO: 3273800 - RNA, 22 nt, Vaccinia virus
auguucucguuuccaaaaaaug

SEQ ID NO: 3273801 - RNA, 15 nt, Vaccinia virus
aguuauuuacuuuga

SEQ ID NO: 3273802 - RNA, 19 nt, Vaccinia virus
auaauaacgauuuguuuaa

SEQ ID NO: 3273803 - RNA, 13 nt, Vaccinia virus
ccaagacacauau

SEQ ID NO: 3273804 - RNA, 18 nt, Vaccinia virus
ugacuuaacuuguaauaa

SEQ ID NO: 3273805 - RNA, 21 nt, Vaccinia virus
gccaacucucaaaaugcugau

SEQ ID NO: 3273806 - RNA, 14 nt, Vaccinia virus
uuaauccaaauaug

SEQ ID NO: 3273807 - RNA, 21 nt, Vaccinia virus
aucuuucccggagauaagacu

SEQ ID NO: 3273808 - RNA, 20 nt, Vaccinia virus
augaugccgguaaauguuuu

SEQ ID NO: 3273809 - RNA, 16 nt, Vaccinia virus
auccaauacagaaugu

SEQ ID NO: 3273810 - RNA, 20 nt, Vaccinia virus
cucgauacauuaacucucuc

SEQ ID NO: 3273811 - RNA, 14 nt, Vaccinia virus
aauuucauauuaau

SEQ ID NO: 3273812 - RNA, 15 nt, Vaccinia virus
acguacauuuuccau

SEQ ID NO: 3273813 - RNA, 15 nt, Vaccinia virus
cuauuaaagauggag

SEQ ID NO: 3273814 - RNA, 22 nt, Vaccinia virus
aacacaaauaguaauacaugua

SEQ ID NO: 3273815 - RNA, 15 nt, Vaccinia virus
gcauauuagaaucua

SEQ ID NO: 3273816 - RNA, 18 nt, Vaccinia virus
acacugcgaucugaauaa

SEQ ID NO: 3273817 - RNA, 18 nt, Vaccinia virus
uauccagauggaguggaa

SEQ ID NO: 3273818 - RNA, 11 nt, Vaccinia virus
acauuaaacag

SEQ ID NO: 3273819 - RNA, 22 nt, Vaccinia virus
cauaaaauuaucgaggauaucu

SEQ ID NO: 3273820 - RNA, 15 nt, Vaccinia virus
uguguaaaaaguuuu

SEQ ID NO: 3273821 - RNA, 14 nt, Vaccinia virus
uggauugaagguua

SEQ ID NO: 3273822 - RNA, 15 nt, Vaccinia virus
guagauaucuuuacu

SEQ ID NO: 3273823 - RNA, 19 nt, Vaccinia virus
ggaaaaucugaagaagaua

SEQ ID NO: 3273824 - RNA, 21 nt, Vaccinia virus
auauuguacgauguaauacua

SEQ ID NO: 3273825 - RNA, 22 nt, Vaccinia virus
cuaauacaucucuggaaauaga

SEQ ID NO: 3273826 - RNA, 19 nt, Vaccinia virus
auccagaauguacacuauu

SEQ ID NO: 3273827 - RNA, 16 nt, Vaccinia virus
uaacuuacaaaaugua

SEQ ID NO: 3273828 - RNA, 23 nt, Vaccinia virus
gcaauuuuauugcuaauaaugac

SEQ ID NO: 3273829 - RNA, 18 nt, Vaccinia virus
gauccauuuauaguuaua

SEQ ID NO: 3273830 - RNA, 12 nt, Vaccinia virus
uaccauacauua

SEQ ID NO: 3273831 - RNA, 14 nt, Vaccinia virus
uagagagauucauu

SEQ ID NO: 3273832 - RNA, 22 nt, Vaccinia virus
caaacagcaaggguucgucaaa

SEQ ID NO: 3273833 - RNA, 15 nt, Vaccinia virus
auacuucuccaacau

SEQ ID NO: 3273834 - RNA, 20 nt, Vaccinia virus
augaaaauuauaaugaauau

SEQ ID NO: 3273835 - RNA, 14 nt, Vaccinia virus
accauauacguguu

SEQ ID NO: 3273836 - RNA, 18 nt, Vaccinia virus
aggauuggucuuaaaaga

SEQ ID NO: 3273837 - RNA, 17 nt, Vaccinia virus
uucacuuuaauagauau

SEQ ID NO: 3273838 - RNA, 18 nt, Vaccinia virus
uuuaacaaaguuauucau

SEQ ID NO: 3273839 - RNA, 19 nt, Vaccinia virus
uaaaccauguugugaaaga

SEQ ID NO: 3273840 - RNA, 23 nt, Vaccinia virus
auuggagaaguaggaaacaggaa

SEQ ID NO: 3273841 - RNA, 18 nt, Vaccinia virus
gaagcugguaaaguaaau

SEQ ID NO: 3273842 - RNA, 24 nt, Vaccinia virus
uauauaccacuuaaugacaaaauc

SEQ ID NO: 3273843 - RNA, 15 nt, Vaccinia virus
caacuuaaacaaaau

SEQ ID NO: 3273844 - RNA, 19 nt, Vaccinia virus
acuccuagagaauuaauau

SEQ ID NO: 3273845 - RNA, 15 nt, Vaccinia virus
cuuucgauuuggaaa

SEQ ID NO: 3273846 - RNA, 22 nt, Vaccinia virus
auguccaaaucuaguuguggaa

SEQ ID NO: 3273847 - RNA, 17 nt, Vaccinia virus
acagaaacuagaggaga

SEQ ID NO: 3273848 - RNA, 13 nt, Vaccinia virus
ugaagauacuguu

SEQ ID NO: 3273849 - RNA, 16 nt, Vaccinia virus
uuucccagcauuaacu

SEQ ID NO: 3273850 - RNA, 13 nt, Vaccinia virus
caaaguuguuaaa

SEQ ID NO: 3273851 - RNA, 16 nt, Vaccinia virus
uuauacuaauaugaca

SEQ ID NO: 3273852 - RNA, 18 nt, Vaccinia virus
uuauacaggucauuacau

SEQ ID NO: 3273853 - RNA, 19 nt, Vaccinia virus
auucauagauugacuuuga

SEQ ID NO: 3273854 - RNA, 17 nt, Vaccinia virus
uagguuguaauaucaua

SEQ ID NO: 3273855 - RNA, 22 nt, Vaccinia virus
agaaaugguaaauaaauacuuu

SEQ ID NO: 3273856 - RNA, 21 nt, Vaccinia virus
uccaucaucgucuuauuucaa

SEQ ID NO: 3273857 - RNA, 15 nt, Vaccinia virus
aagaacaauguccaa

SEQ ID NO: 3273858 - RNA, 13 nt, Vaccinia virus
ugcuccaugauuu

SEQ ID NO: 3273859 - RNA, 23 nt, Vaccinia virus
aucguucucuaaaugucacaauc

SEQ ID NO: 3273860 - RNA, 19 nt, Vaccinia virus
aagccaauuccaauuguug

SEQ ID NO: 3273861 - RNA, 17 nt, Vaccinia virus
cauuagauaacagugua

SEQ ID NO: 3273862 - RNA, 23 nt, Vaccinia virus
ucucaugagaauggaaaggaaac

SEQ ID NO: 3273863 - RNA, 16 nt, Vaccinia virus
uauacuucauaaaaga

SEQ ID NO: 3273864 - RNA, 12 nt, Vaccinia virus
aauuaucaaaau

SEQ ID NO: 3273865 - RNA, 21 nt, Vaccinia virus
accauuauucgccuguaucag

SEQ ID NO: 3273866 - RNA, 22 nt, Vaccinia virus
uguuuugaauuucuuagucaua

SEQ ID NO: 3273867 - RNA, 15 nt, Vaccinia virus
auuccaucuacuaag

SEQ ID NO: 3273868 - RNA, 11 nt, Vaccinia virus
agaaaacauua

SEQ ID NO: 3273869 - RNA, 22 nt, Vaccinia virus
aggaaaucccaccgccuuucug

SEQ ID NO: 3273870 - RNA, 21 nt, Vaccinia virus
ucaacaauguuugucauaugu

SEQ ID NO: 3273871 - RNA, 15 nt, Vaccinia virus
cuucuggacauaauu

SEQ ID NO: 3273872 - RNA, 23 nt, Vaccinia virus
uuauuucagucgcugauuaauca

SEQ ID NO: 3273873 - RNA, 11 nt, Vaccinia virus
cuuugcuuucg

SEQ ID NO: 3273874 - RNA, 19 nt, Vaccinia virus
cuaccagccuacauuuugc

SEQ ID NO: 3273875 - RNA, 12 nt, Vaccinia virus
uuauguacuaag

SEQ ID NO: 3273876 - RNA, 16 nt, Vaccinia virus
caugaaucuaaaagaa

SEQ ID NO: 3273877 - RNA, 20 nt, Vaccinia virus
ugauauuucauugacagaua

SEQ ID NO: 3273878 - RNA, 15 nt, Vaccinia virus
uauauucuuacagua

SEQ ID NO: 3273879 - RNA, 12 nt, Vaccinia virus
gaaaaaauagcu

SEQ ID NO: 3273880 - RNA, 17 nt, Vaccinia virus
aacgauaccaucuucug

SEQ ID NO: 3273881 - RNA, 23 nt, Vaccinia virus
uacgucucagaauucuaaaugau

SEQ ID NO: 3273882 - RNA, 21 nt, Vaccinia virus
aauauacagacucuaucgugu

SEQ ID NO: 3273883 - RNA, 17 nt, Vaccinia virus
auguuugggagaauuaa

SEQ ID NO: 3273884 - RNA, 19 nt, Vaccinia virus
aguauaugggcgauauucu

SEQ ID NO: 3273885 - RNA, 16 nt, Vaccinia virus
cucuucaacaucuuug

SEQ ID NO: 3273886 - RNA, 15 nt, Vaccinia virus
uauuuagauacagau

SEQ ID NO: 3273887 - RNA, 16 nt, Vaccinia virus
cuaucuucaucauauu

SEQ ID NO: 3273888 - RNA, 21 nt, Vaccinia virus
auaccaguauaccucaaaaau

SEQ ID NO: 3273889 - RNA, 14 nt, Vaccinia virus
acaacaaaauaaua

SEQ ID NO: 3273890 - RNA, 22 nt, Vaccinia virus
cugguagagaaugauauagaaa

SEQ ID NO: 3273891 - RNA, 13 nt, Vaccinia virus
uaauauuguugau

SEQ ID NO: 3273892 - RNA, 18 nt, Vaccinia virus
uggaaauaucugugaaua

SEQ ID NO: 3273893 - RNA, 22 nt, Vaccinia virus
augauuuuccuucuaaaguaag

SEQ ID NO: 3273894 - RNA, 19 nt, Vaccinia virus
uuaugccguuaucauuaau

SEQ ID NO: 3273895 - RNA, 22 nt, Vaccinia virus
gaagaaggacaacaucuacuuu

SEQ ID NO: 3273896 - RNA, 16 nt, Vaccinia virus
uuguagauuuaucaua

SEQ ID NO: 3273897 - RNA, 13 nt, Vaccinia virus
uauaugcaucaaa

SEQ ID NO: 3273898 - RNA, 22 nt, Vaccinia virus
uaauucuuaucaauaacauauu

SEQ ID NO: 3273899 - RNA, 15 nt, Vaccinia virus
uguuaauacaucacu

SEQ ID NO: 3273900 - RNA, 16 nt, Vaccinia virus
aucaauaacuggcaca

SEQ ID NO: 3273901 - RNA, 15 nt, Vaccinia virus
aauuaugauagaaau

SEQ ID NO: 3273902 - RNA, 21 nt, Vaccinia virus
aaaugaugacuugauagaaua

SEQ ID NO: 3273903 - RNA, 12 nt, Vaccinia virus
uuauucucuuaa

SEQ ID NO: 3273904 - RNA, 14 nt, Vaccinia virus
uauuuugcaucauu

SEQ ID NO: 3273905 - RNA, 13 nt, Vaccinia virus
accaugaaauaua

SEQ ID NO: 3273906 - RNA, 20 nt, Vaccinia virus
gauggaaaguguaaagacaa

SEQ ID NO: 3273907 - RNA, 17 nt, Vaccinia virus
ucuuaccaucuucuuug

SEQ ID NO: 3273908 - RNA, 15 nt, Vaccinia virus
gaaucauaguuuuua

SEQ ID NO: 3273909 - RNA, 14 nt, Vaccinia virus
ucuacucuagauaa

SEQ ID NO: 3273910 - RNA, 14 nt, Vaccinia virus
gaacgauaaacaaa

SEQ ID NO: 3273911 - RNA, 18 nt, Vaccinia virus
cuaauuaaucuaaaaucu

SEQ ID NO: 3273912 - RNA, 15 nt, Vaccinia virus
auccuccuauuacau

SEQ ID NO: 3273913 - RNA, 22 nt, Vaccinia virus
cagauuuuugaaugaaugaaua

SEQ ID NO: 3273914 - RNA, 15 nt, Vaccinia virus
gauacccuacucgau

SEQ ID NO: 3273915 - RNA, 22 nt, Vaccinia virus
uuuaucuuuaacgauaccuaua

SEQ ID NO: 3273916 - RNA, 17 nt, Vaccinia virus
gaauuaggagaacuuau

SEQ ID NO: 3273917 - RNA, 22 nt, Vaccinia virus
auccuuucguaaauuauaauaa

SEQ ID NO: 3273918 - RNA, 17 nt, Vaccinia virus
uuaaauaacucauuuau

SEQ ID NO: 3273919 - RNA, 21 nt, Vaccinia virus
uucagaauacaaucuguauuu

SEQ ID NO: 3273920 - RNA, 16 nt, Vaccinia virus
acaucucgcaauaauc

SEQ ID NO: 3273921 - RNA, 17 nt, Vaccinia virus
ugacuccuauguuuccc

SEQ ID NO: 3273922 - RNA, 21 nt, Vaccinia virus
auugucgcacuauagaugcaa

SEQ ID NO: 3273923 - RNA, 19 nt, Vaccinia virus
aaacuauaauuuugugaaa

SEQ ID NO: 3273924 - RNA, 18 nt, Vaccinia virus
uuuauaauuuuaccaucu

SEQ ID NO: 3273925 - RNA, 21 nt, Vaccinia virus
acauuguuacgucuccaauaa

SEQ ID NO: 3273926 - RNA, 20 nt, Vaccinia virus
ugaaaaguucuaugaaaaac

SEQ ID NO: 3273927 - RNA, 23 nt, Vaccinia virus
gaaguauaucugaguaugaugau

SEQ ID NO: 3273928 - RNA, 17 nt, Vaccinia virus
aauacguucauuaaaaa

SEQ ID NO: 3273929 - RNA, 21 nt, Vaccinia virus
ucagagauuauugucuuauau

SEQ ID NO: 3273930 - RNA, 16 nt, Vaccinia virus
auacauaaagaaaugu

SEQ ID NO: 3273931 - RNA, 20 nt, Vaccinia virus
gacgcuauggcacgaaauau

SEQ ID NO: 3273932 - RNA, 16 nt, Vaccinia virus
guaggguuaaucgaac

SEQ ID NO: 3273933 - RNA, 16 nt, Vaccinia virus
uuccguaucuguauuu

SEQ ID NO: 3273934 - RNA, 18 nt, Vaccinia virus
gaugccgguaaauguuuu

SEQ ID NO: 3273935 - RNA, 16 nt, Vaccinia virus
cacuucuauaguaucu

SEQ ID NO: 3273936 - RNA, 16 nt, Vaccinia virus
auggaguauaaucuuu

SEQ ID NO: 3273937 - RNA, 18 nt, Vaccinia virus
uaguauaugauaauauua

SEQ ID NO: 3273938 - RNA, 14 nt, Vaccinia virus
augacguaaaugua

SEQ ID NO: 3273939 - RNA, 21 nt, Vaccinia virus
agucaucuuauguuuuuaaga

SEQ ID NO: 3273940 - RNA, 13 nt, Vaccinia virus
cuuuaucaagcac

SEQ ID NO: 3273941 - RNA, 15 nt, Vaccinia virus
acuagauacaaaauu

SEQ ID NO: 3273942 - RNA, 12 nt, Vaccinia virus
gaaggacaacau

SEQ ID NO: 3273943 - RNA, 19 nt, Vaccinia virus
ugucguguuccuguuuccu

SEQ ID NO: 3273944 - RNA, 23 nt, Vaccinia virus
uauacgguaucgcgauuagugua

SEQ ID NO: 3273945 - RNA, 18 nt, Vaccinia virus
uguucaaggcaacagaug

SEQ ID NO: 3273946 - RNA, 18 nt, Vaccinia virus
auggauuaaaucguguau

SEQ ID NO: 3273947 - RNA, 13 nt, Vaccinia virus
uagagauggauau

SEQ ID NO: 3273948 - RNA, 22 nt, Vaccinia virus
cuucgauauuagauuuuguauu

SEQ ID NO: 3273949 - RNA, 18 nt, Vaccinia virus
agacggauaagaaauaua

SEQ ID NO: 3273950 - RNA, 23 nt, Vaccinia virus
aucaacggaacauauuuauauaa

SEQ ID NO: 3273951 - RNA, 16 nt, Vaccinia virus
cugcauagaaauaucu

SEQ ID NO: 3273952 - RNA, 21 nt, Vaccinia virus
agagauaauauagagguguuu

SEQ ID NO: 3273953 - RNA, 20 nt, Vaccinia virus
auguuugcaucgugcuuuaa

SEQ ID NO: 3273954 - RNA, 22 nt, Vaccinia virus
augucacaauuuguauuaucca

SEQ ID NO: 3273955 - RNA, 19 nt, Vaccinia virus
cauucuaauauauguauuu

SEQ ID NO: 3273956 - RNA, 16 nt, Vaccinia virus
aaauaucuauaugauu

SEQ ID NO: 3273957 - RNA, 21 nt, Vaccinia virus
auuaguuuccuuuuuauaaaa

SEQ ID NO: 3273958 - RNA, 16 nt, Vaccinia virus
ucaaagauuaauacau

SEQ ID NO: 3273959 - RNA, 15 nt, Vaccinia virus
guauguuuaaacacu

SEQ ID NO: 3273960 - RNA, 21 nt, Vaccinia virus
aauuuccccauugauagaaaa

SEQ ID NO: 3273961 - RNA, 20 nt, Vaccinia virus
cauauuaaacuaauucauuu

SEQ ID NO: 3273962 - RNA, 21 nt, Vaccinia virus
caucgauuuuuagauuucauu

SEQ ID NO: 3273963 - RNA, 20 nt, Vaccinia virus
aauacuuaccccuugaucgu

SEQ ID NO: 3273964 - RNA, 19 nt, Vaccinia virus
cgaacacuauuagaauuaa

SEQ ID NO: 3273965 - RNA, 21 nt, Vaccinia virus
agaauagaugcuauuuauccg

SEQ ID NO: 3273966 - RNA, 17 nt, Vaccinia virus
auuaacagguucucaau

SEQ ID NO: 3273967 - RNA, 17 nt, Vaccinia virus
acaaccgcuacauaauc

SEQ ID NO: 3273968 - RNA, 16 nt, Vaccinia virus
auauaugguuguugau

SEQ ID NO: 3273969 - RNA, 13 nt, Vaccinia virus
gaauauuauaauu

SEQ ID NO: 3273970 - RNA, 17 nt, Vaccinia virus
ucaaccacucgaaaaag

SEQ ID NO: 3273971 - RNA, 18 nt, Vaccinia virus
ggauaccaguuuggaaac

SEQ ID NO: 3273972 - RNA, 18 nt, Vaccinia virus
uagauuuuggugaaauua

SEQ ID NO: 3273973 - RNA, 14 nt, Vaccinia virus
acuacguuuaauaa

SEQ ID NO: 3273974 - RNA, 11 nt, Vaccinia virus
uuuuuuggaau

SEQ ID NO: 3273975 - RNA, 22 nt, Vaccinia virus
uagaauuuauagacgacucauu

SEQ ID NO: 3273976 - RNA, 19 nt, Vaccinia virus
caugaguacuuguacacau

SEQ ID NO: 3273977 - RNA, 15 nt, Vaccinia virus
cgguacaacauucca

SEQ ID NO: 3273978 - RNA, 14 nt, Vaccinia virus
aauacaaaugacua

SEQ ID NO: 3273979 - RNA, 19 nt, Vaccinia virus
auaugcuuuuauuuuugga

SEQ ID NO: 3273980 - RNA, 13 nt, Vaccinia virus
agaaacaaaaagu

SEQ ID NO: 3273981 - RNA, 16 nt, Vaccinia virus
uuuguucuuguagaua

SEQ ID NO: 3273982 - RNA, 17 nt, Vaccinia virus
aacuauuccaauguuua

SEQ ID NO: 3273983 - RNA, 12 nt, Vaccinia virus
uggaaauacuuc

SEQ ID NO: 3273984 - RNA, 16 nt, Vaccinia virus
aauggcugcuucuaua

SEQ ID NO: 3273985 - RNA, 22 nt, Vaccinia virus
aggauggguuccauaacuaaau

SEQ ID NO: 3273986 - RNA, 22 nt, Vaccinia virus
gcacaacaucuaacuauaugau

SEQ ID NO: 3273987 - RNA, 13 nt, Vaccinia virus
aggcuaucaaaug

SEQ ID NO: 3273988 - RNA, 12 nt, Vaccinia virus
uuaaauauuaau

SEQ ID NO: 3273989 - RNA, 18 nt, Vaccinia virus
ccaugauggucauguuua

SEQ ID NO: 3273990 - RNA, 21 nt, Vaccinia virus
guaccgauucuagauacaaga

SEQ ID NO: 3273991 - RNA, 22 nt, Vaccinia virus
acacguguccacauccuuuauu

SEQ ID NO: 3273992 - RNA, 19 nt, Vaccinia virus
ucuacagauauuuuaguuu

SEQ ID NO: 3273993 - RNA, 13 nt, Vaccinia virus
agauuguacuucu

SEQ ID NO: 3273994 - RNA, 20 nt, Vaccinia virus
uuaacuugacuaaauauuca

SEQ ID NO: 3273995 - RNA, 14 nt, Vaccinia virus
ccaagauaucuaua

SEQ ID NO: 3273996 - RNA, 18 nt, Vaccinia virus
caaagauggcugaaauca

SEQ ID NO: 3273997 - RNA, 13 nt, Vaccinia virus
uuugaacaucuug

SEQ ID NO: 3273998 - RNA, 20 nt, Vaccinia virus
uacauguaaugauuuaaaau

SEQ ID NO: 3273999 - RNA, 14 nt, Vaccinia virus
aguuaauaaaaucu

SEQ ID NO: 3274000 - RNA, 14 nt, Vaccinia virus
uaugacaaacauug

SEQ ID NO: 3274001 - RNA, 17 nt, Vaccinia virus
aaguaucaaaucuucua

SEQ ID NO: 3274002 - RNA, 19 nt, Vaccinia virus
agauuauuauggaaaucaa

SEQ ID NO: 3274003 - RNA, 19 nt, Vaccinia virus
cgaacaauaucuuauucca

SEQ ID NO: 3274004 - RNA, 20 nt, Vaccinia virus
uacucuuggucuaauacuga

SEQ ID NO: 3274005 - RNA, 15 nt, Vaccinia virus
uacuauauauaaaau

SEQ ID NO: 3274006 - RNA, 18 nt, Vaccinia virus
augcaucgugaaaagaaa

SEQ ID NO: 3274007 - RNA, 19 nt, Vaccinia virus
auccacaacccauuaaaaa

SEQ ID NO: 3274008 - RNA, 14 nt, Vaccinia virus
aacgccuuuagaaa

SEQ ID NO: 3274009 - RNA, 19 nt, Vaccinia virus
guuaauuaugcaaauuuga

SEQ ID NO: 3274010 - RNA, 16 nt, Vaccinia virus
uaauuuauaauauacu

SEQ ID NO: 3274011 - RNA, 14 nt, Vaccinia virus
auucugcaauauug

SEQ ID NO: 3274012 - RNA, 14 nt, Vaccinia virus
uugaaacuaugucu

SEQ ID NO: 3274013 - RNA, 16 nt, Vaccinia virus
uacacgugcuucggau

SEQ ID NO: 3274014 - RNA, 12 nt, Vaccinia virus
aaugauucucuc

SEQ ID NO: 3274015 - RNA, 15 nt, Vaccinia virus
gucuuaaaguuuauu

SEQ ID NO: 3274016 - RNA, 23 nt, Vaccinia virus
guaucaauaauagcaacauauga

SEQ ID NO: 3274017 - RNA, 21 nt, Vaccinia virus
caaauauucacaagaugaauu

SEQ ID NO: 3274018 - RNA, 20 nt, Vaccinia virus
aaauuauuccuaauuaagaa

SEQ ID NO: 3274019 - RNA, 14 nt, Vaccinia virus
uguuugagaauuaa

SEQ ID NO: 3274020 - RNA, 21 nt, Vaccinia virus
auaaucuugauuguacaccca

SEQ ID NO: 3274021 - RNA, 14 nt, Vaccinia virus
aucgugugucuaua

SEQ ID NO: 3274022 - RNA, 17 nt, Vaccinia virus
caucggguguauucuca

SEQ ID NO: 3274023 - RNA, 11 nt, Vaccinia virus
uuauuaacauc

SEQ ID NO: 3274024 - RNA, 19 nt, Vaccinia virus
ucaaaggaugaaagaaagc

SEQ ID NO: 3274025 - RNA, 13 nt, Vaccinia virus
uaucaacaucuga

SEQ ID NO: 3274026 - RNA, 14 nt, Vaccinia virus
auuuaguuaacaua

SEQ ID NO: 3274027 - RNA, 12 nt, Vaccinia virus
ucauugauuuuu

SEQ ID NO: 3274028 - RNA, 22 nt, Vaccinia virus
auuuauuuuuguacauuaauaa

SEQ ID NO: 3274029 - RNA, 15 nt, Vaccinia virus
uggaaagaaaucuac

SEQ ID NO: 3274030 - RNA, 15 nt, Vaccinia virus
gucauuuguauuuua

SEQ ID NO: 3274031 - RNA, 13 nt, Vaccinia virus
auggaaaggaaau

SEQ ID NO: 3274032 - RNA, 22 nt, Vaccinia virus
guguauuaccccucauaguauu

SEQ ID NO: 3274033 - RNA, 23 nt, Vaccinia virus
aagagauuccugacuuugcauuc

SEQ ID NO: 3274034 - RNA, 13 nt, Vaccinia virus
ugagauucuccau

SEQ ID NO: 3274035 - RNA, 15 nt, Vaccinia virus
ucuuauauacacagu

SEQ ID NO: 3274036 - RNA, 23 nt, Vaccinia virus
aacagcuaucaaaauauguagaa

SEQ ID NO: 3274037 - RNA, 16 nt, Vaccinia virus
ugaaagcgagaaauaa

SEQ ID NO: 3274038 - RNA, 13 nt, Vaccinia virus
auccuauaacuuc

SEQ ID NO: 3274039 - RNA, 19 nt, Vaccinia virus
aaaaauauuuuuauucucu

SEQ ID NO: 3274040 - RNA, 13 nt, Vaccinia virus
uuuuucaugauug

SEQ ID NO: 3274041 - RNA, 17 nt, Vaccinia virus
auacaagaacaacuaga

SEQ ID NO: 3274042 - RNA, 19 nt, Vaccinia virus
aauuaauauguaugauuca

SEQ ID NO: 3274043 - RNA, 17 nt, Vaccinia virus
acuaauacucaauccuu

SEQ ID NO: 3274044 - RNA, 18 nt, Vaccinia virus
auauuucuauuucuauuu

SEQ ID NO: 3274045 - RNA, 20 nt, Vaccinia virus
aauguuguagguuaaaauua

SEQ ID NO: 3274046 - RNA, 21 nt, Vaccinia virus
aucagaaucauacaaugaauu

SEQ ID NO: 3274047 - RNA, 13 nt, Vaccinia virus
uagcaaaauuaac

SEQ ID NO: 3274048 - RNA, 13 nt, Vaccinia virus
aaaauuaguagaa

SEQ ID NO: 3274049 - RNA, 20 nt, Vaccinia virus
uguacuacaaacaggcgaug

SEQ ID NO: 3274050 - RNA, 22 nt, Vaccinia virus
aggacuaucuccgaauuuguuu

SEQ ID NO: 3274051 - RNA, 18 nt, Vaccinia virus
aaacugaaaauauauuga

SEQ ID NO: 3274052 - RNA, 17 nt, Vaccinia virus
ucguacuuuauaucgug

SEQ ID NO: 3274053 - RNA, 14 nt, Vaccinia virus
cacuauuauaacaa

SEQ ID NO: 3274054 - RNA, 16 nt, Vaccinia virus
acuccggauagagaaa

SEQ ID NO: 3274055 - RNA, 21 nt, Vaccinia virus
ucgaucaaaagacuauacauu

SEQ ID NO: 3274056 - RNA, 18 nt, Vaccinia virus
gaugagcauaaacauaau

SEQ ID NO: 3274057 - RNA, 16 nt, Vaccinia virus
uaaauacauuaucaug

SEQ ID NO: 3274058 - RNA, 14 nt, Vaccinia virus
cuucuaucuuuagu

SEQ ID NO: 3274059 - RNA, 15 nt, Vaccinia virus
agucgacagaagaau

SEQ ID NO: 3274060 - RNA, 14 nt, Vaccinia virus
auaaacucagauaa

SEQ ID NO: 3274061 - RNA, 12 nt, Vaccinia virus
caauaugauauc

SEQ ID NO: 3274062 - RNA, 15 nt, Vaccinia virus
uauaaauaacauuua

SEQ ID NO: 3274063 - RNA, 23 nt, Vaccinia virus
uaacagccuguucaaauuuauau

SEQ ID NO: 3274064 - RNA, 19 nt, Vaccinia virus
uccgaaacgauaucaugaa

SEQ ID NO: 3274065 - RNA, 16 nt, Vaccinia virus
acauaucuaacaaugg

SEQ ID NO: 3274066 - RNA, 21 nt, Vaccinia virus
acuaucaguaaguuuuauaga

SEQ ID NO: 3274067 - RNA, 16 nt, Vaccinia virus
guguggguacaaauau

SEQ ID NO: 3274068 - RNA, 14 nt, Vaccinia virus
aauucuaaaugaug

SEQ ID NO: 3274069 - RNA, 15 nt, Vaccinia virus
aauccaaaaaaugaa

SEQ ID NO: 3274070 - RNA, 18 nt, Vaccinia virus
gauaaucugaaaaugaaa

SEQ ID NO: 3274071 - RNA, 22 nt, Vaccinia virus
uuaguauaucaaauacaucuau

SEQ ID NO: 3274072 - RNA, 18 nt, Vaccinia virus
gauaaguuagaucagugu

SEQ ID NO: 3274073 - RNA, 13 nt, Vaccinia virus
ucaucuacaaaaa

SEQ ID NO: 3274074 - RNA, 22 nt, Vaccinia virus
uauucuaucuccaguauuuaca

SEQ ID NO: 3274075 - RNA, 23 nt, Vaccinia virus
auacuucauaaaagaaaauucua

SEQ ID NO: 3274076 - RNA, 16 nt, Vaccinia virus
aaaugcgauacagaca

SEQ ID NO: 3274077 - RNA, 12 nt, Vaccinia virus
acuacuggaaua

SEQ ID NO: 3274078 - RNA, 18 nt, Vaccinia virus
uuauaaugaauauuauua

SEQ ID NO: 3274079 - RNA, 18 nt, Vaccinia virus
guaugccauuuacuuaau

SEQ ID NO: 3274080 - RNA, 14 nt, Vaccinia virus
auaaaucuaucuuu

SEQ ID NO: 3274081 - RNA, 16 nt, Vaccinia virus
ucucaauauuuggauc

SEQ ID NO: 3274082 - RNA, 23 nt, Vaccinia virus
augcgauaguagaguaaacauuu

SEQ ID NO: 3274083 - RNA, 17 nt, Vaccinia virus
auuguauaguuaauaag

SEQ ID NO: 3274084 - RNA, 22 nt, Vaccinia virus
cucucgaaagacguuguacaau

SEQ ID NO: 3274085 - RNA, 18 nt, Vaccinia virus
uuaacaauugucuguaaa

SEQ ID NO: 3274086 - RNA, 22 nt, Vaccinia virus
guauuucguaccuguauguaca

SEQ ID NO: 3274087 - RNA, 19 nt, Vaccinia virus
aacauauucuaugaauuua

SEQ ID NO: 3274088 - RNA, 23 nt, Vaccinia virus
gauauuaucaugaauuagauaua

SEQ ID NO: 3274089 - RNA, 21 nt, Vaccinia virus
auuaugaaaauuauaaugaau

SEQ ID NO: 3274090 - RNA, 20 nt, Vaccinia virus
agacaugguaucaacagaua

SEQ ID NO: 3274091 - RNA, 18 nt, Vaccinia virus
auauaaaaacucuaacau

SEQ ID NO: 3274092 - RNA, 13 nt, Vaccinia virus
auacuaaagaaac

SEQ ID NO: 3274093 - RNA, 20 nt, Vaccinia virus
acguaaauacaaaacagaga

SEQ ID NO: 3274094 - RNA, 21 nt, Vaccinia virus
aucaucguuaggauuugguaa

SEQ ID NO: 3274095 - RNA, 15 nt, Vaccinia virus
cacauaauuauucua

SEQ ID NO: 3274096 - RNA, 16 nt, Vaccinia virus
uuaacaucacuaauau

SEQ ID NO: 3274097 - RNA, 13 nt, Vaccinia virus
cgcauuaaaugau

SEQ ID NO: 3274098 - RNA, 17 nt, Vaccinia virus
auuuguaggaaaaagau

SEQ ID NO: 3274099 - RNA, 20 nt, Vaccinia virus
acaaugaugccaucauagau

SEQ ID NO: 3274100 - RNA, 21 nt, Vaccinia virus
auacagaguauguaaaaaugu

SEQ ID NO: 3274101 - RNA, 11 nt, Vaccinia virus
auacuaucaaa

SEQ ID NO: 3274102 - RNA, 15 nt, Vaccinia virus
gucgucuauauuaac

SEQ ID NO: 3274103 - RNA, 21 nt, Vaccinia virus
guucaacuggagauuauagca

SEQ ID NO: 3274104 - RNA, 19 nt, Vaccinia virus
uuuugaauuguuucuuuua

SEQ ID NO: 3274105 - RNA, 16 nt, Vaccinia virus
aaaaugcagaaaugau

SEQ ID NO: 3274106 - RNA, 14 nt, Vaccinia virus
uccaaucaugugua

SEQ ID NO: 3274107 - RNA, 15 nt, Vaccinia virus
uauuauugacuucgu

SEQ ID NO: 3274108 - RNA, 17 nt, Vaccinia virus
auauucaacauguuuaa

SEQ ID NO: 3274109 - RNA, 15 nt, Vaccinia virus
uauuauuaugaugau

SEQ ID NO: 3274110 - RNA, 21 nt, Vaccinia virus
uaacaugacauuuauucauca

SEQ ID NO: 3274111 - RNA, 13 nt, Vaccinia virus
auggaaaaaugac

SEQ ID NO: 3274112 - RNA, 20 nt, Vaccinia virus
uaucuugaguacgaugacuu

SEQ ID NO: 3274113 - RNA, 19 nt, Vaccinia virus
aauaaagaaaaugcagaaa

SEQ ID NO: 3274114 - RNA, 19 nt, Vaccinia virus
gucuaaaccuucuuauucu

SEQ ID NO: 3274115 - RNA, 15 nt, Vaccinia virus
agaauccgaaauauu

SEQ ID NO: 3274116 - RNA, 21 nt, Vaccinia virus
cagaauucuaaaugaugauau

SEQ ID NO: 3274117 - RNA, 19 nt, Vaccinia virus
cacaacacaaugacuuaua

SEQ ID NO: 3274118 - RNA, 22 nt, Vaccinia virus
uuguuugguuagcauuauuaaa

SEQ ID NO: 3274119 - RNA, 18 nt, Vaccinia virus
ucauauucaucaucaaua

SEQ ID NO: 3274120 - RNA, 14 nt, Vaccinia virus
acucuuauuauaga

SEQ ID NO: 3274121 - RNA, 23 nt, Vaccinia virus
auugaugcaaauagcagauagau

SEQ ID NO: 3274122 - RNA, 22 nt, Vaccinia virus
ugguaguucuuccguggaauca

SEQ ID NO: 3274123 - RNA, 23 nt, Vaccinia virus
aaggcggauguugugaaugacau

SEQ ID NO: 3274124 - RNA, 13 nt, Vaccinia virus
augcaucaaacag

SEQ ID NO: 3274125 - RNA, 14 nt, Vaccinia virus
cgacucgacauuug

SEQ ID NO: 3274126 - RNA, 18 nt, Vaccinia virus
ucauccguggauauuuga

SEQ ID NO: 3274127 - RNA, 15 nt, Vaccinia virus
cgguguaauauuaau

SEQ ID NO: 3274128 - RNA, 15 nt, Vaccinia virus
uauuuuguuauuaua

SEQ ID NO: 3274129 - RNA, 17 nt, Vaccinia virus
agauauggucaaaucaa

SEQ ID NO: 3274130 - RNA, 15 nt, Vaccinia virus
acuucucuaucaaug

SEQ ID NO: 3274131 - RNA, 17 nt, Vaccinia virus
acacucuauaucuagaa

SEQ ID NO: 3274132 - RNA, 14 nt, Vaccinia virus
uuauuccacauaag

SEQ ID NO: 3274133 - RNA, 19 nt, Vaccinia virus
acaaucuuaaugucuguau

SEQ ID NO: 3274134 - RNA, 15 nt, Vaccinia virus
uagaagucaaggaua

SEQ ID NO: 3274135 - RNA, 16 nt, Vaccinia virus
uaugaucuugauuuau

SEQ ID NO: 3274136 - RNA, 16 nt, Vaccinia virus
acuaacuuuaucacaa

SEQ ID NO: 3274137 - RNA, 16 nt, Vaccinia virus
aucuaaacaauaccuc

SEQ ID NO: 3274138 - RNA, 19 nt, Vaccinia virus
aucuaaacgcguuagauaa

SEQ ID NO: 3274139 - RNA, 14 nt, Vaccinia virus
aaauuaauauuucu

SEQ ID NO: 3274140 - RNA, 22 nt, Vaccinia virus
uaaugauguauguuuaaacacu

SEQ ID NO: 3274141 - RNA, 21 nt, Vaccinia virus
ccagaaacuaguucugagaaa

SEQ ID NO: 3274142 - RNA, 13 nt, Vaccinia virus
ucguacauccagg

SEQ ID NO: 3274143 - RNA, 16 nt, Vaccinia virus
aacaaucaacuaaugu

SEQ ID NO: 3274144 - RNA, 14 nt, Vaccinia virus
agaccaauaauaaa

SEQ ID NO: 3274145 - RNA, 22 nt, Vaccinia virus
caugaacacgaugauauagaau

SEQ ID NO: 3274146 - RNA, 22 nt, Vaccinia virus
caucuauuccaaauaaucagaa

SEQ ID NO: 3274147 - RNA, 14 nt, Vaccinia virus
guaauaacauugcu

SEQ ID NO: 3274148 - RNA, 23 nt, Vaccinia virus
aagaaguagcuaauguuguaaac

SEQ ID NO: 3274149 - RNA, 23 nt, Vaccinia virus
agugaauauaucauuaggauuua

SEQ ID NO: 3274150 - RNA, 22 nt, Vaccinia virus
gucacugucuggcaauaaauga

SEQ ID NO: 3274151 - RNA, 17 nt, Vaccinia virus
gauaauauuuguaaugg

SEQ ID NO: 3274152 - RNA, 17 nt, Vaccinia virus
agugaauuccaccauga

SEQ ID NO: 3274153 - RNA, 15 nt, Vaccinia virus
uggaaagaugcuguu

SEQ ID NO: 3274154 - RNA, 19 nt, Vaccinia virus
guuaaaggauauuaugcau

SEQ ID NO: 3274155 - RNA, 16 nt, Vaccinia virus
aaacaucauugcucca

SEQ ID NO: 3274156 - RNA, 19 nt, Vaccinia virus
guuagaugauuauaaagga

SEQ ID NO: 3274157 - RNA, 20 nt, Vaccinia virus
acacuuuguccguaaaacau

SEQ ID NO: 3274158 - RNA, 18 nt, Vaccinia virus
aucaacagaaguuaauaa

SEQ ID NO: 3274159 - RNA, 18 nt, Vaccinia virus
ucaaaacauauaaaucua

SEQ ID NO: 3274160 - RNA, 18 nt, Vaccinia virus
uaccuuucuacaugaaau

SEQ ID NO: 3274161 - RNA, 19 nt, Vaccinia virus
aguuuucucuauucugaaa

SEQ ID NO: 3274162 - RNA, 18 nt, Vaccinia virus
ugaauucucauuuugcau

SEQ ID NO: 3274163 - RNA, 20 nt, Vaccinia virus
auugucuagauaaaauacug

SEQ ID NO: 3274164 - RNA, 18 nt, Vaccinia virus
cgauuguauaguuaauaa

SEQ ID NO: 3274165 - RNA, 12 nt, Vaccinia virus
aaauaucucauc

SEQ ID NO: 3274166 - RNA, 14 nt, Vaccinia virus
cguguacaaaaaug

SEQ ID NO: 3274167 - RNA, 18 nt, Vaccinia virus
uuguauagaaacuguaua

SEQ ID NO: 3274168 - RNA, 18 nt, Vaccinia virus
agagcuuuauuaacuucu

SEQ ID NO: 3274169 - RNA, 14 nt, Vaccinia virus
cauggugauacuug

SEQ ID NO: 3274170 - RNA, 16 nt, Vaccinia virus
aaauacaccaaauaua

SEQ ID NO: 3274171 - RNA, 18 nt, Vaccinia virus
aucauuaucauuuuguaa

SEQ ID NO: 3274172 - RNA, 16 nt, Vaccinia virus
cauuaauuucugauau

SEQ ID NO: 3274173 - RNA, 21 nt, Vaccinia virus
augauucacaauuuacauguu

SEQ ID NO: 3274174 - RNA, 19 nt, Vaccinia virus
auuaacaaauuuuaaacaa

SEQ ID NO: 3274175 - RNA, 11 nt, Vaccinia virus
acgauaaaaga

SEQ ID NO: 3274176 - RNA, 13 nt, Vaccinia virus
ucgugaauacuug

SEQ ID NO: 3274177 - RNA, 21 nt, Vaccinia virus
uacaaucaaaccuauaacauu

SEQ ID NO: 3274178 - RNA, 14 nt, Vaccinia virus
acacugauucagaa

SEQ ID NO: 3274179 - RNA, 22 nt, Vaccinia virus
uagcgucgacaucuauauacua

SEQ ID NO: 3274180 - RNA, 22 nt, Vaccinia virus
aaaacaaauuuguacaugaaga

SEQ ID NO: 3274181 - RNA, 22 nt, Vaccinia virus
uggcggaguaaguguugagcuc

SEQ ID NO: 3274182 - RNA, 16 nt, Vaccinia virus
uucuaucguaguguau

SEQ ID NO: 3274183 - RNA, 20 nt, Vaccinia virus
auuuuaaaauuauuaaacaa

SEQ ID NO: 3274184 - RNA, 12 nt, Vaccinia virus
gugggaugaugu

SEQ ID NO: 3274185 - RNA, 14 nt, Vaccinia virus
acauguuaaaugua

SEQ ID NO: 3274186 - RNA, 20 nt, Vaccinia virus
aucgauuuuuagauuucauu

SEQ ID NO: 3274187 - RNA, 19 nt, Vaccinia virus
accacugucuaaauguaau

SEQ ID NO: 3274188 - RNA, 19 nt, Vaccinia virus
uauaccuuguaauuaaauu

SEQ ID NO: 3274189 - RNA, 10 nt, Vaccinia virus
uauauucucu

SEQ ID NO: 3274190 - RNA, 15 nt, Vaccinia virus
ucgaauacaaauuuu

SEQ ID NO: 3274191 - RNA, 19 nt, Vaccinia virus
auguuucuuuaaaagucaa

SEQ ID NO: 3274192 - RNA, 18 nt, Vaccinia virus
aguauuagucauaaacuu

SEQ ID NO: 3274193 - RNA, 23 nt, Vaccinia virus
caacugauuaaugagaucuucua

SEQ ID NO: 3274194 - RNA, 22 nt, Vaccinia virus
gaaugcggugccauucaugaaa

SEQ ID NO: 3274195 - RNA, 19 nt, Vaccinia virus
uauugacuuaauaggcauc

SEQ ID NO: 3274196 - RNA, 19 nt, Vaccinia virus
cugucugcagccauuuuua

SEQ ID NO: 3274197 - RNA, 19 nt, Vaccinia virus
auucuuaagacacauuucu

SEQ ID NO: 3274198 - RNA, 15 nt, Vaccinia virus
agaauucuaaaugau

SEQ ID NO: 3274199 - RNA, 12 nt, Vaccinia virus
ucuauucaagau

SEQ ID NO: 3274200 - RNA, 19 nt, Vaccinia virus
acgaagaccuaauccauca

SEQ ID NO: 3274201 - RNA, 21 nt, Vaccinia virus
auucaaauguuguuaaaugau

SEQ ID NO: 3274202 - RNA, 17 nt, Vaccinia virus
uacaugauauuaucaug

SEQ ID NO: 3274203 - RNA, 14 nt, Vaccinia virus
cagaaauacuauau

SEQ ID NO: 3274204 - RNA, 14 nt, Vaccinia virus
uaucucuaacaaaa

SEQ ID NO: 3274205 - RNA, 16 nt, Vaccinia virus
auaauaaugaaugcag

SEQ ID NO: 3274206 - RNA, 15 nt, Vaccinia virus
agauacagauguaaa

SEQ ID NO: 3274207 - RNA, 14 nt, Vaccinia virus
uauugucgagcaua

SEQ ID NO: 3274208 - RNA, 22 nt, Vaccinia virus
auuucaacaauaaugagaaugu

SEQ ID NO: 3274209 - RNA, 12 nt, Vaccinia virus
uaauacuaaaua

SEQ ID NO: 3274210 - RNA, 15 nt, Vaccinia virus
ucucuaaaggaugac

SEQ ID NO: 3274211 - RNA, 20 nt, Vaccinia virus
uacucaguugaacagaugau

SEQ ID NO: 3274212 - RNA, 20 nt, Vaccinia virus
augagauuauuaaguauuua

SEQ ID NO: 3274213 - RNA, 16 nt, Vaccinia virus
acaaacuauagaaauu

SEQ ID NO: 3274214 - RNA, 21 nt, Vaccinia virus
uaauuaauucuuuauugucau

SEQ ID NO: 3274215 - RNA, 16 nt, Vaccinia virus
aguauuuuuaccuaau

SEQ ID NO: 3274216 - RNA, 20 nt, Vaccinia virus
uugagcaaucagaaaugaug

SEQ ID NO: 3274217 - RNA, 22 nt, Vaccinia virus
agauacaguuaauaucuauaua

SEQ ID NO: 3274218 - RNA, 15 nt, Vaccinia virus
cuuugcauucugaaa

SEQ ID NO: 3274219 - RNA, 13 nt, Vaccinia virus
uauaguagaugcu

SEQ ID NO: 3274220 - RNA, 16 nt, Vaccinia virus
aucuuuaaucuuacua

SEQ ID NO: 3274221 - RNA, 22 nt, Vaccinia virus
caaaagacuaugggaauauauu

SEQ ID NO: 3274222 - RNA, 20 nt, Vaccinia virus
ucauuuacuaaggaguaaaa

SEQ ID NO: 3274223 - RNA, 15 nt, Vaccinia virus
aacuuuguucauuua

SEQ ID NO: 3274224 - RNA, 15 nt, Vaccinia virus
agguauuaaguuugg

SEQ ID NO: 3274225 - RNA, 19 nt, Vaccinia virus
auuucucguaaaaguagaa

SEQ ID NO: 3274226 - RNA, 16 nt, Vaccinia virus
auacauaccgaaagca

SEQ ID NO: 3274227 - RNA, 19 nt, Vaccinia virus
aauaaacuaaacaaaacug

SEQ ID NO: 3274228 - RNA, 19 nt, Vaccinia virus
aaguuugagauuucauaau

SEQ ID NO: 3274229 - RNA, 18 nt, Vaccinia virus
ugcaaagaacagaauaaa

SEQ ID NO: 3274230 - RNA, 15 nt, Vaccinia virus
uauugagauuucuga

SEQ ID NO: 3274231 - RNA, 18 nt, Vaccinia virus
uagauuuuuaguuacaga

SEQ ID NO: 3274232 - RNA, 11 nt, Vaccinia virus
cauuuaaacau

SEQ ID NO: 3274233 - RNA, 13 nt, Vaccinia virus
caaggaucuucua

SEQ ID NO: 3274234 - RNA, 18 nt, Vaccinia virus
cugacuagcaaauccagc

SEQ ID NO: 3274235 - RNA, 21 nt, Vaccinia virus
guugaucagaaugaauguuua

SEQ ID NO: 3274236 - RNA, 17 nt, Vaccinia virus
auagucgaauacaguau

SEQ ID NO: 3274237 - RNA, 21 nt, Vaccinia virus
agucaacaaugaaaauggaua

SEQ ID NO: 3274238 - RNA, 21 nt, Vaccinia virus
aauugguuuaugauguauaau

SEQ ID NO: 3274239 - RNA, 22 nt, Vaccinia virus
uuaguucaaucuacgaauguau

SEQ ID NO: 3274240 - RNA, 22 nt, Vaccinia virus
cuaauuuauugcaugguaagga

SEQ ID NO: 3274241 - RNA, 14 nt, Vaccinia virus
agugguuaaucuua

SEQ ID NO: 3274242 - RNA, 16 nt, Vaccinia virus
cugaaaaugaaauugu

SEQ ID NO: 3274243 - RNA, 22 nt, Vaccinia virus
agaaauauguauacaugauauu

SEQ ID NO: 3274244 - RNA, 10 nt, Vaccinia virus
aaaauacuua

SEQ ID NO: 3274245 - RNA, 12 nt, Vaccinia virus
aauuuauuucuu

SEQ ID NO: 3274246 - RNA, 20 nt, Vaccinia virus
gcaaacacuuuccugauuua

SEQ ID NO: 3274247 - RNA, 14 nt, Vaccinia virus
uaacaauuaauuag

SEQ ID NO: 3274248 - RNA, 19 nt, Vaccinia virus
uauucuaccauagcaaauc

SEQ ID NO: 3274249 - RNA, 15 nt, Vaccinia virus
uuaauccuagaugau

SEQ ID NO: 3274250 - RNA, 20 nt, Vaccinia virus
aauauauaaguauaauccca

SEQ ID NO: 3274251 - RNA, 19 nt, Vaccinia virus
cucuuugacauauuuugag

SEQ ID NO: 3274252 - RNA, 20 nt, Vaccinia virus
caauggaaugcaaaacccca

SEQ ID NO: 3274253 - RNA, 22 nt, Vaccinia virus
aaucuuggcauauugaucauuu

SEQ ID NO: 3274254 - RNA, 19 nt, Vaccinia virus
uucccuggaguaugagagu

SEQ ID NO: 3274255 - RNA, 20 nt, Vaccinia virus
aucuauauuuaucacagucu

SEQ ID NO: 3274256 - RNA, 15 nt, Vaccinia virus
auuagcauccuuaua

SEQ ID NO: 3274257 - RNA, 17 nt, Vaccinia virus
aauauuucgauaaugaa

SEQ ID NO: 3274258 - RNA, 17 nt, Vaccinia virus
gaaauauaugagaugua

SEQ ID NO: 3274259 - RNA, 15 nt, Vaccinia virus
auucaaugucucuuu

SEQ ID NO: 3274260 - RNA, 12 nt, Vaccinia virus
uuaaucuuuucu

SEQ ID NO: 3274261 - RNA, 20 nt, Vaccinia virus
aguaauggguuauuguggau

SEQ ID NO: 3274262 - RNA, 22 nt, Vaccinia virus
agaauccgcugauggaaacaca

SEQ ID NO: 3274263 - RNA, 14 nt, Vaccinia virus
cauagacuuuaucu

SEQ ID NO: 3274264 - RNA, 11 nt, Vaccinia virus
aauagaaucug

SEQ ID NO: 3274265 - RNA, 18 nt, Vaccinia virus
auuaauaaaggaugugga

SEQ ID NO: 3274266 - RNA, 16 nt, Vaccinia virus
caauagcacaauuguu

SEQ ID NO: 3274267 - RNA, 14 nt, Vaccinia virus
acuuguaauaauug

SEQ ID NO: 3274268 - RNA, 19 nt, Vaccinia virus
aguaacgcguggaaaaagc

SEQ ID NO: 3274269 - RNA, 19 nt, Vaccinia virus
gcaucuauauaaucuuuuu

SEQ ID NO: 3274270 - RNA, 16 nt, Vaccinia virus
aacuaucgauaguaau

SEQ ID NO: 3274271 - RNA, 13 nt, Vaccinia virus
auaaauggagaau

SEQ ID NO: 3274272 - RNA, 15 nt, Vaccinia virus
uaagcuguucaaaau

SEQ ID NO: 3274273 - RNA, 20 nt, Vaccinia virus
acauuuuggcaaauugauua

SEQ ID NO: 3274274 - RNA, 15 nt, Vaccinia virus
agauuguuuucagug

SEQ ID NO: 3274275 - RNA, 22 nt, Vaccinia virus
uuuauuuaaggacuuaacaauu

SEQ ID NO: 3274276 - RNA, 21 nt, Vaccinia virus
aauuuuaagauuuuaaaugua

SEQ ID NO: 3274277 - RNA, 18 nt, Vaccinia virus
uucuggugcuaauuauuc

SEQ ID NO: 3274278 - RNA, 11 nt, Vaccinia virus
aaaacagauga

SEQ ID NO: 3274279 - RNA, 15 nt, Vaccinia virus
accgucauucauuua

SEQ ID NO: 3274280 - RNA, 15 nt, Vaccinia virus
ucaaaguauccucua

SEQ ID NO: 3274281 - RNA, 14 nt, Vaccinia virus
aaucuuuugugaaa

SEQ ID NO: 3274282 - RNA, 11 nt, Vaccinia virus
auggucucaca

SEQ ID NO: 3274283 - RNA, 13 nt, Vaccinia virus
ugacaauacugua

SEQ ID NO: 3274284 - RNA, 13 nt, Vaccinia virus
cuaguuguagaau

SEQ ID NO: 3274285 - RNA, 13 nt, Vaccinia virus
augucauggaaac

SEQ ID NO: 3274286 - RNA, 20 nt, Vaccinia virus
gaaauaaaggcagaaaugca

SEQ ID NO: 3274287 - RNA, 13 nt, Vaccinia virus
auaaccuuuuccu

SEQ ID NO: 3274288 - RNA, 16 nt, Vaccinia virus
agugaaaaguucacau

SEQ ID NO: 3274289 - RNA, 19 nt, Vaccinia virus
gauauuaucgacuaugaau

SEQ ID NO: 3274290 - RNA, 16 nt, Vaccinia virus
ugaucucguguguaca

SEQ ID NO: 3274291 - RNA, 19 nt, Vaccinia virus
uucguaggcacacaaucua

SEQ ID NO: 3274292 - RNA, 18 nt, Vaccinia virus
ucagucuucgaagcaugu

SEQ ID NO: 3274293 - RNA, 21 nt, Vaccinia virus
uucaugauuacggaauuauug

SEQ ID NO: 3274294 - RNA, 20 nt, Vaccinia virus
uagaaaauucaucuaaacaa

SEQ ID NO: 3274295 - RNA, 22 nt, Vaccinia virus
agauauuaucauuagucauguu

SEQ ID NO: 3274296 - RNA, 16 nt, Vaccinia virus
guauuauccaauacag

SEQ ID NO: 3274297 - RNA, 23 nt, Vaccinia virus
auauaguguugcuaucucuugcg

SEQ ID NO: 3274298 - RNA, 17 nt, Vaccinia virus
aucuuuaauagaacucu

SEQ ID NO: 3274299 - RNA, 18 nt, Vaccinia virus
uuucugaauuauuucaua

SEQ ID NO: 3274300 - RNA, 22 nt, Vaccinia virus
cagaauccauauuucuuaaugu

SEQ ID NO: 3274301 - RNA, 10 nt, Vaccinia virus
guaauguuua

SEQ ID NO: 3274302 - RNA, 21 nt, Vaccinia virus
cguauucugaugauauuagaa

SEQ ID NO: 3274303 - RNA, 21 nt, Vaccinia virus
aauuaucaaauacuucaaaau

SEQ ID NO: 3274304 - RNA, 23 nt, Vaccinia virus
aauaauauuugagaguauuggua

SEQ ID NO: 3274305 - RNA, 22 nt, Vaccinia virus
uaaaaucaucauuauaauaggu

SEQ ID NO: 3274306 - RNA, 14 nt, Vaccinia virus
aacaucaaaaaauu

SEQ ID NO: 3274307 - RNA, 22 nt, Vaccinia virus
auguauuauuauagauuuucca

SEQ ID NO: 3274308 - RNA, 14 nt, Vaccinia virus
aucaaaagaaaucu

SEQ ID NO: 3274309 - RNA, 16 nt, Vaccinia virus
gauguauuguuuaguu

SEQ ID NO: 3274310 - RNA, 15 nt, Vaccinia virus
auuugguaaaaugaa

SEQ ID NO: 3274311 - RNA, 19 nt, Vaccinia virus
caaaaagagagucaauguu

SEQ ID NO: 3274312 - RNA, 14 nt, Vaccinia virus
uguaacaaaguuuc

SEQ ID NO: 3274313 - RNA, 16 nt, Vaccinia virus
uauguuucuaaauuuu

SEQ ID NO: 3274314 - RNA, 15 nt, Vaccinia virus
auuaucgcguucaga

SEQ ID NO: 3274315 - RNA, 15 nt, Vaccinia virus
uauuacguuagcauu

SEQ ID NO: 3274316 - RNA, 17 nt, Vaccinia virus
aaucauuccucauaaga

SEQ ID NO: 3274317 - RNA, 16 nt, Vaccinia virus
agaauuuuuauaaauu

SEQ ID NO: 3274318 - RNA, 21 nt, Vaccinia virus
aacaaauucuuuguugaacgu

SEQ ID NO: 3274319 - RNA, 13 nt, Vaccinia virus
uagaaaaacuuua

SEQ ID NO: 3274320 - RNA, 12 nt, Vaccinia virus
caauuacugaua

SEQ ID NO: 3274321 - RNA, 13 nt, Vaccinia virus
uauugaaacugag

SEQ ID NO: 3274322 - RNA, 20 nt, Vaccinia virus
aaaccgaugauuauauguuc

SEQ ID NO: 3274323 - RNA, 17 nt, Vaccinia virus
gauauucguugaugaau

SEQ ID NO: 3274324 - RNA, 17 nt, Vaccinia virus
gauauaucaaaauuaga

SEQ ID NO: 3274325 - RNA, 21 nt, Vaccinia virus
uagaucccggauacuggauau

SEQ ID NO: 3274326 - RNA, 24 nt, Vaccinia virus
uauacaauuguuuguauucauuca

SEQ ID NO: 3274327 - RNA, 17 nt, Vaccinia virus
auaaacauuguuuguau

SEQ ID NO: 3274328 - RNA, 21 nt, Vaccinia virus
gcaauauaucaucuuuucacu

SEQ ID NO: 3274329 - RNA, 12 nt, Vaccinia virus
ugaaaauuggag

SEQ ID NO: 3274330 - RNA, 22 nt, Vaccinia virus
auccacuaugaucaauucugga

SEQ ID NO: 3274331 - RNA, 15 nt, Vaccinia virus
acuucucuaaaugag

SEQ ID NO: 3274332 - RNA, 15 nt, Vaccinia virus
cuauaauauauucua

SEQ ID NO: 3274333 - RNA, 16 nt, Vaccinia virus
gagaaagaagaaauac

SEQ ID NO: 3274334 - RNA, 14 nt, Vaccinia virus
agauucccaaauaa

SEQ ID NO: 3274335 - RNA, 16 nt, Vaccinia virus
acauauauuauuacau

SEQ ID NO: 3274336 - RNA, 18 nt, Vaccinia virus
acucuuucgcuauuucua

SEQ ID NO: 3274337 - RNA, 17 nt, Vaccinia virus
auuaucgacauucaugg

SEQ ID NO: 3274338 - RNA, 14 nt, Vaccinia virus
uacuaaucaauaau

SEQ ID NO: 3274339 - RNA, 23 nt, Vaccinia virus
gauaguuuuuuucauuacuaucu

SEQ ID NO: 3274340 - RNA, 19 nt, Vaccinia virus
guucagaggaugaaauaga

SEQ ID NO: 3274341 - RNA, 22 nt, Vaccinia virus
auaaacauaaguauauaauaaa

SEQ ID NO: 3274342 - RNA, 20 nt, Vaccinia virus
uaucauugauugagaagaag

SEQ ID NO: 3274343 - RNA, 19 nt, Vaccinia virus
uaauuucccaaauacacau

SEQ ID NO: 3274344 - RNA, 20 nt, Vaccinia virus
acacaguaaccaaaaugaaa

SEQ ID NO: 3274345 - RNA, 23 nt, Vaccinia virus
ucauuuaacagauguaguaguau

SEQ ID NO: 3274346 - RNA, 18 nt, Vaccinia virus
agaaauuuagcaacgaua

SEQ ID NO: 3274347 - RNA, 15 nt, Vaccinia virus
uaacugguucaaaau

SEQ ID NO: 3274348 - RNA, 17 nt, Vaccinia virus
uaaugcaggguguauau

SEQ ID NO: 3274349 - RNA, 19 nt, Vaccinia virus
caauugucuuucucuuuua

SEQ ID NO: 3274350 - RNA, 17 nt, Vaccinia virus
uuuguaccuuuguacau

SEQ ID NO: 3274351 - RNA, 18 nt, Vaccinia virus
gaauauuauuaugaugau

SEQ ID NO: 3274352 - RNA, 19 nt, Vaccinia virus
acagaggaacgucauauau

SEQ ID NO: 3274353 - RNA, 19 nt, Vaccinia virus
uaaacucagauaauagcaa

SEQ ID NO: 3274354 - RNA, 21 nt, Vaccinia virus
gucuagaauaucacauacuga

SEQ ID NO: 3274355 - RNA, 15 nt, Vaccinia virus
gcuacaaaauauguu

SEQ ID NO: 3274356 - RNA, 16 nt, Vaccinia virus
uauugaagaugaugug

SEQ ID NO: 3274357 - RNA, 14 nt, Vaccinia virus
ucgaugauguagug

SEQ ID NO: 3274358 - RNA, 19 nt, Vaccinia virus
cagaaucauacaaugaauu

SEQ ID NO: 3274359 - RNA, 20 nt, Vaccinia virus
cauauuaucaccuauugcca

SEQ ID NO: 3274360 - RNA, 13 nt, Vaccinia virus
aauugccaaagau

SEQ ID NO: 3274361 - RNA, 20 nt, Vaccinia virus
aacaucuugauacuuuuucu

SEQ ID NO: 3274362 - RNA, 19 nt, Vaccinia virus
aaugcaggaauuugaauau

SEQ ID NO: 3274363 - RNA, 17 nt, Vaccinia virus
auguugacauguauaua

SEQ ID NO: 3274364 - RNA, 14 nt, Vaccinia virus
uagaucucuagaau

SEQ ID NO: 3274365 - RNA, 21 nt, Vaccinia virus
uauaaguuguuaaaaaaagga

SEQ ID NO: 3274366 - RNA, 19 nt, Vaccinia virus
agaauccaucaguuguuaa

SEQ ID NO: 3274367 - RNA, 23 nt, Vaccinia virus
cuuccugguugguauugcgcuac

SEQ ID NO: 3274368 - RNA, 22 nt, Vaccinia virus
uagaaaacagagauaguaaaua

SEQ ID NO: 3274369 - RNA, 21 nt, Vaccinia virus
ugaguuccuuguuuuugcuaa

SEQ ID NO: 3274370 - RNA, 20 nt, Vaccinia virus
uacauauucuccauaauggu

SEQ ID NO: 3274371 - RNA, 17 nt, Vaccinia virus
auguccauuaaaguuaa

SEQ ID NO: 3274372 - RNA, 17 nt, Vaccinia virus
uacccauggaaaaauag

SEQ ID NO: 3274373 - RNA, 20 nt, Vaccinia virus
ucuacaguaauguccaaauc

SEQ ID NO: 3274374 - RNA, 18 nt, Vaccinia virus
gaugucaaagauuguaca

SEQ ID NO: 3274375 - RNA, 12 nt, Vaccinia virus
gaaaauaauaaa

SEQ ID NO: 3274376 - RNA, 16 nt, Vaccinia virus
acaaccgcuacauaau

SEQ ID NO: 3274377 - RNA, 17 nt, Vaccinia virus
uaaaaaguuuuaacaug

SEQ ID NO: 3274378 - RNA, 16 nt, Vaccinia virus
aacuaucguuggaaaa

SEQ ID NO: 3274379 - RNA, 14 nt, Vaccinia virus
uggaaugauacugu

SEQ ID NO: 3274380 - RNA, 21 nt, Vaccinia virus
aauacuuugguaguauacaag

SEQ ID NO: 3274381 - RNA, 20 nt, Vaccinia virus
agaguaguaucauuaaaucu

SEQ ID NO: 3274382 - RNA, 17 nt, Vaccinia virus
gaacuagauauauuaau

SEQ ID NO: 3274383 - RNA, 18 nt, Vaccinia virus
aucaacaauuacaaauga

SEQ ID NO: 3274384 - RNA, 15 nt, Vaccinia virus
caugucuuagauguu

SEQ ID NO: 3274385 - RNA, 19 nt, Vaccinia virus
uuaaacgauggauuuucca

SEQ ID NO: 3274386 - RNA, 22 nt, Vaccinia virus
gaacacgauuauuauaaaauaa

SEQ ID NO: 3274387 - RNA, 15 nt, Vaccinia virus
caaaagacuauacau

SEQ ID NO: 3274388 - RNA, 12 nt, Vaccinia virus
uggugaaagagu

SEQ ID NO: 3274389 - RNA, 24 nt, Vaccinia virus
uacugauaaagaagaagaucauac

SEQ ID NO: 3274390 - RNA, 20 nt, Vaccinia virus
uauccaacuugacaaaucuu

SEQ ID NO: 3274391 - RNA, 15 nt, Vaccinia virus
uuuucguguuccaaa

SEQ ID NO: 3274392 - RNA, 21 nt, Vaccinia virus
uaauccagaauguacacuauu

SEQ ID NO: 3274393 - RNA, 21 nt, Vaccinia virus
cauuuaaaguacagauuuuag

SEQ ID NO: 3274394 - RNA, 18 nt, Vaccinia virus
aaauguccguuauauaau

SEQ ID NO: 3274395 - RNA, 19 nt, Vaccinia virus
uaucuuuccauuuaucaug

SEQ ID NO: 3274396 - RNA, 16 nt, Vaccinia virus
augauugauuucgaau

SEQ ID NO: 3274397 - RNA, 14 nt, Vaccinia virus
aucaaagaauaugu

SEQ ID NO: 3274398 - RNA, 19 nt, Vaccinia virus
ugaacaauaauuaauucuu

SEQ ID NO: 3274399 - RNA, 22 nt, Vaccinia virus
uucuaugaaaggagagaaugua

SEQ ID NO: 3274400 - RNA, 23 nt, Vaccinia virus
uaagaucuggguauuucuuuucu

SEQ ID NO: 3274401 - RNA, 19 nt, Vaccinia virus
uaucgccggucaucauaag

SEQ ID NO: 3274402 - RNA, 16 nt, Vaccinia virus
cacauauuuuaaugaa

SEQ ID NO: 3274403 - RNA, 23 nt, Vaccinia virus
ugaauaucugcaauauauauuca

SEQ ID NO: 3274404 - RNA, 21 nt, Vaccinia virus
cucucagguacagauuuugaa

SEQ ID NO: 3274405 - RNA, 15 nt, Vaccinia virus
uacuaguuccaacau

SEQ ID NO: 3274406 - RNA, 18 nt, Vaccinia virus
cugucuuucgauguucau

SEQ ID NO: 3274407 - RNA, 16 nt, Vaccinia virus
gcuauaauauauucua

SEQ ID NO: 3274408 - RNA, 17 nt, Vaccinia virus
uccuuggaauugauaga

SEQ ID NO: 3274409 - RNA, 20 nt, Vaccinia virus
uuuaaauauuauauaaacau

SEQ ID NO: 3274410 - RNA, 18 nt, Vaccinia virus
auuuuacgaauaaacgaa

SEQ ID NO: 3274411 - RNA, 20 nt, Vaccinia virus
caauuguuuuuguacauaau

SEQ ID NO: 3274412 - RNA, 20 nt, Vaccinia virus
uaaaacuaucucgacuuauu

SEQ ID NO: 3274413 - RNA, 15 nt, Vaccinia virus
ugacauucaaagauc

SEQ ID NO: 3274414 - RNA, 14 nt, Vaccinia virus
agaaucaauacaaa

SEQ ID NO: 3274415 - RNA, 13 nt, Vaccinia virus
auguauauguuug

SEQ ID NO: 3274416 - RNA, 19 nt, Vaccinia virus
auuaauuuuugugggaagc

SEQ ID NO: 3274417 - RNA, 15 nt, Vaccinia virus
cgguguauuguauuu

SEQ ID NO: 3274418 - RNA, 20 nt, Vaccinia virus
uaauuucuguaaauucauga

SEQ ID NO: 3274419 - RNA, 13 nt, Vaccinia virus
aaaauuauguaaa

SEQ ID NO: 3274420 - RNA, 22 nt, Vaccinia virus
ucauaaaaaaauauauuauuuu

SEQ ID NO: 3274421 - RNA, 18 nt, Vaccinia virus
aagccuuaugcauccaaa

SEQ ID NO: 3274422 - RNA, 18 nt, Vaccinia virus
uuguaaagaaauuauuuu

SEQ ID NO: 3274423 - RNA, 15 nt, Vaccinia virus
cuacaguaaugucca

SEQ ID NO: 3274424 - RNA, 17 nt, Vaccinia virus
acaaauauacuuuauca

SEQ ID NO: 3274425 - RNA, 19 nt, Vaccinia virus
cauaaaucaucuugauacu

SEQ ID NO: 3274426 - RNA, 21 nt, Vaccinia virus
aauaucauuaacgauauccaa

SEQ ID NO: 3274427 - RNA, 16 nt, Vaccinia virus
uuagcguacacauuuu

SEQ ID NO: 3274428 - RNA, 20 nt, Vaccinia virus
caaucauuuauugacaauaa

SEQ ID NO: 3274429 - RNA, 16 nt, Vaccinia virus
uuucucaaagauguua

SEQ ID NO: 3274430 - RNA, 15 nt, Vaccinia virus
aaauuuaaaaugaua

SEQ ID NO: 3274431 - RNA, 19 nt, Vaccinia virus
gaccaaauauauuauuaau

SEQ ID NO: 3274432 - RNA, 15 nt, Vaccinia virus
ucaagaguggagaau

SEQ ID NO: 3274433 - RNA, 20 nt, Vaccinia virus
guugagcuaauuuuuguaaa

SEQ ID NO: 3274434 - RNA, 23 nt, Vaccinia virus
uacgcauuuucaaaauacauguc

SEQ ID NO: 3274435 - RNA, 14 nt, Vaccinia virus
auauuauuaaauca

SEQ ID NO: 3274436 - RNA, 21 nt, Vaccinia virus
gauacacuagacauuuuuuaa

SEQ ID NO: 3274437 - RNA, 15 nt, Vaccinia virus
agagugauaauauau

SEQ ID NO: 3274438 - RNA, 14 nt, Vaccinia virus
ugcaaagucuaaau

SEQ ID NO: 3274439 - RNA, 14 nt, Vaccinia virus
augaguauauguau

SEQ ID NO: 3274440 - RNA, 17 nt, Vaccinia virus
uucuucaauaaaaugag

SEQ ID NO: 3274441 - RNA, 20 nt, Vaccinia virus
uuaacaccuccacaguuuuu

SEQ ID NO: 3274442 - RNA, 14 nt, Vaccinia virus
cuaauauauucuua

SEQ ID NO: 3274443 - RNA, 19 nt, Vaccinia virus
guguccguauaccaacaug

SEQ ID NO: 3274444 - RNA, 13 nt, Vaccinia virus
uuuaauaaacuga

SEQ ID NO: 3274445 - RNA, 23 nt, Vaccinia virus
aauagcgcuuaaucucaaaauau

SEQ ID NO: 3274446 - RNA, 20 nt, Vaccinia virus
uacaguguaugguacuagau

SEQ ID NO: 3274447 - RNA, 16 nt, Vaccinia virus
aauacaaaaguucaua

SEQ ID NO: 3274448 - RNA, 19 nt, Vaccinia virus
uguaaaugauuuuguagau

SEQ ID NO: 3274449 - RNA, 13 nt, Vaccinia virus
agauuaucaaaau

SEQ ID NO: 3274450 - RNA, 12 nt, Vaccinia virus
cauuuaauuaca

SEQ ID NO: 3274451 - RNA, 11 nt, Vaccinia virus
ccaaaaugaau

SEQ ID NO: 3274452 - RNA, 21 nt, Vaccinia virus
uauaucauccauguacuugcu

SEQ ID NO: 3274453 - RNA, 21 nt, Vaccinia virus
auaaucuucucuccuguuaau

SEQ ID NO: 3274454 - RNA, 23 nt, Vaccinia virus
gacguugccagaaaauccuguaa

SEQ ID NO: 3274455 - RNA, 20 nt, Vaccinia virus
auccaucuguauuaaagaua

SEQ ID NO: 3274456 - RNA, 15 nt, Vaccinia virus
caaacauacaucuau

SEQ ID NO: 3274457 - RNA, 14 nt, Vaccinia virus
guaucauuaaacau

SEQ ID NO: 3274458 - RNA, 22 nt, Vaccinia virus
gauaacuacaauauuucaucau

SEQ ID NO: 3274459 - RNA, 18 nt, Vaccinia virus
auaaacuaacauuguuaa

SEQ ID NO: 3274460 - RNA, 19 nt, Vaccinia virus
uuucuacccauaaguuauc

SEQ ID NO: 3274461 - RNA, 18 nt, Vaccinia virus
aaguuacuuaaaaugguu

SEQ ID NO: 3274462 - RNA, 16 nt, Vaccinia virus
uacuauuuauuucuau

SEQ ID NO: 3274463 - RNA, 14 nt, Vaccinia virus
aauugucuguaaac

SEQ ID NO: 3274464 - RNA, 23 nt, Vaccinia virus
cauaaaaaaauauauuauuuuua

SEQ ID NO: 3274465 - RNA, 12 nt, Vaccinia virus
uauuacuuuagu

SEQ ID NO: 3274466 - RNA, 13 nt, Vaccinia virus
uuauuaauucucu

SEQ ID NO: 3274467 - RNA, 17 nt, Vaccinia virus
cugccauuuuagagauu

SEQ ID NO: 3274468 - RNA, 22 nt, Vaccinia virus
auaaacauaauaaacaaaauua

SEQ ID NO: 3274469 - RNA, 20 nt, Vaccinia virus
gauucaacaaugucgagaua

SEQ ID NO: 3274470 - RNA, 20 nt, Vaccinia virus
uauugauaaagaucuaaaaa

SEQ ID NO: 3274471 - RNA, 13 nt, Vaccinia virus
gggaaaagucaaa

SEQ ID NO: 3274472 - RNA, 14 nt, Vaccinia virus
caaugaauuaacuu

SEQ ID NO: 3274473 - RNA, 19 nt, Vaccinia virus
acaaucauccggauauucu

SEQ ID NO: 3274474 - RNA, 12 nt, Vaccinia virus
gaccguguuucu

SEQ ID NO: 3274475 - RNA, 14 nt, Vaccinia virus
ggacaccacuaucu

SEQ ID NO: 3274476 - RNA, 17 nt, Vaccinia virus
aaguuaagaagauaccu

SEQ ID NO: 3274477 - RNA, 14 nt, Vaccinia virus
auauucuuucuugu

SEQ ID NO: 3274478 - RNA, 18 nt, Vaccinia virus
cguuaauaguacuacaau

SEQ ID NO: 3274479 - RNA, 23 nt, Vaccinia virus
aguauacuaccuguuauauuucu

SEQ ID NO: 3274480 - RNA, 23 nt, Vaccinia virus
uauacagugaacacacaauaagc

SEQ ID NO: 3274481 - RNA, 16 nt, Vaccinia virus
cuuaucguugaagacu

SEQ ID NO: 3274482 - RNA, 20 nt, Vaccinia virus
auaaaaauguuuuuguuuaa

SEQ ID NO: 3274483 - RNA, 20 nt, Vaccinia virus
uuggauaggcugucugcugg

SEQ ID NO: 3274484 - RNA, 13 nt, Vaccinia virus
aaaagauacguac

SEQ ID NO: 3274485 - RNA, 21 nt, Vaccinia virus
cauacaugaaaugaucucuau

SEQ ID NO: 3274486 - RNA, 17 nt, Vaccinia virus
cuagaucaagaaacauu

SEQ ID NO: 3274487 - RNA, 17 nt, Vaccinia virus
auuuaauacguucauua

SEQ ID NO: 3274488 - RNA, 16 nt, Vaccinia virus
aaaguuaguacagaag

SEQ ID NO: 3274489 - RNA, 15 nt, Vaccinia virus
caucgaagagcauuu

SEQ ID NO: 3274490 - RNA, 16 nt, Vaccinia virus
uaaacuguuuguauaa

SEQ ID NO: 3274491 - RNA, 19 nt, Vaccinia virus
cagaaauggugauuuugag

SEQ ID NO: 3274492 - RNA, 14 nt, Vaccinia virus
agaauaucucuaac

SEQ ID NO: 3274493 - RNA, 20 nt, Vaccinia virus
aucuucaucuaccaaagaaa

SEQ ID NO: 3274494 - RNA, 21 nt, Vaccinia virus
aguuuucagaagauaauuauc

SEQ ID NO: 3274495 - RNA, 17 nt, Vaccinia virus
aucgcuaaucaaaacua

SEQ ID NO: 3274496 - RNA, 23 nt, Vaccinia virus
uuuaauuuuguuauaguagauau

SEQ ID NO: 3274497 - RNA, 19 nt, Vaccinia virus
uggaauagaugaaggaaua

SEQ ID NO: 3274498 - RNA, 18 nt, Vaccinia virus
acucauaagaaagagaau

SEQ ID NO: 3274499 - RNA, 16 nt, Vaccinia virus
acuaucugauaagaua

SEQ ID NO: 3274500 - RNA, 18 nt, Vaccinia virus
aaccugauuauauagaua

SEQ ID NO: 3274501 - RNA, 14 nt, Vaccinia virus
uacuaaaauuccua

SEQ ID NO: 3274502 - RNA, 21 nt, Vaccinia virus
aucuauuaaacgaauaaaaga

SEQ ID NO: 3274503 - RNA, 17 nt, Vaccinia virus
aggagaaggaaaaugaa

SEQ ID NO: 3274504 - RNA, 20 nt, Vaccinia virus
aaugcgaggaaauguauaau

SEQ ID NO: 3274505 - RNA, 19 nt, Vaccinia virus
gucuaucgccuuagauacu

SEQ ID NO: 3274506 - RNA, 20 nt, Vaccinia virus
guuucugucaacaauguuug

SEQ ID NO: 3274507 - RNA, 22 nt, Vaccinia virus
caucgagguaaccaccucucug

SEQ ID NO: 3274508 - RNA, 22 nt, Vaccinia virus
aauggcaauaacuaaaaaugua

SEQ ID NO: 3274509 - RNA, 18 nt, Vaccinia virus
uaucuucauagaauacua

SEQ ID NO: 3274510 - RNA, 18 nt, Vaccinia virus
ucucuuaguaaguuuauu

SEQ ID NO: 3274511 - RNA, 13 nt, Vaccinia virus
acauuauaauaau

SEQ ID NO: 3274512 - RNA, 23 nt, Vaccinia virus
acacaaguugauaaaauguugau

SEQ ID NO: 3274513 - RNA, 19 nt, Vaccinia virus
aguuaugagucaauuggua

SEQ ID NO: 3274514 - RNA, 21 nt, Vaccinia virus
cuuagacaagcggguaaauga

SEQ ID NO: 3274515 - RNA, 14 nt, Vaccinia virus
auuacaaaccuguc

SEQ ID NO: 3274516 - RNA, 14 nt, Vaccinia virus
uuguacaaauuccu

SEQ ID NO: 3274517 - RNA, 23 nt, Vaccinia virus
cuuuuuuuagagaugaaaaauuu

SEQ ID NO: 3274518 - RNA, 21 nt, Vaccinia virus
aucuuuauaagagcuacuaac

SEQ ID NO: 3274519 - RNA, 12 nt, Vaccinia virus
cugucugcuggc

SEQ ID NO: 3274520 - RNA, 17 nt, Vaccinia virus
auccuucagaauacaau

SEQ ID NO: 3274521 - RNA, 17 nt, Vaccinia virus
auuacaacaacauauga

SEQ ID NO: 3274522 - RNA, 17 nt, Vaccinia virus
aguucauaaaaauaaua

SEQ ID NO: 3274523 - RNA, 19 nt, Vaccinia virus
cuuaaaauauaaugauaua

SEQ ID NO: 3274524 - RNA, 12 nt, Vaccinia virus
caaaaugauaua

SEQ ID NO: 3274525 - RNA, 12 nt, Vaccinia virus
acugucuaaaug

SEQ ID NO: 3274526 - RNA, 21 nt, Vaccinia virus
gaacacacgaugaaaauguac

SEQ ID NO: 3274527 - RNA, 21 nt, Vaccinia virus
uucaucagauuauuuaacaau

SEQ ID NO: 3274528 - RNA, 13 nt, Vaccinia virus
auaauuuaauaau

SEQ ID NO: 3274529 - RNA, 22 nt, Vaccinia virus
uaaacauaaauauccauuggaa

SEQ ID NO: 3274530 - RNA, 23 nt, Vaccinia virus
uacucuauagucagaauuuucau

SEQ ID NO: 3274531 - RNA, 13 nt, Vaccinia virus
uagcuguuuucau

SEQ ID NO: 3274532 - RNA, 22 nt, Vaccinia virus
cauauugaugugucuguuuaua

SEQ ID NO: 3274533 - RNA, 13 nt, Vaccinia virus
aaaaaaauaaaua

SEQ ID NO: 3274534 - RNA, 22 nt, Vaccinia virus
cuguaaaaacaaauuuguacau

SEQ ID NO: 3274535 - RNA, 17 nt, Vaccinia virus
uguaucauauucaacau

SEQ ID NO: 3274536 - RNA, 14 nt, Vaccinia virus
uuaccaacacaaag

SEQ ID NO: 3274537 - RNA, 13 nt, Vaccinia virus
cauacuauguuuu

SEQ ID NO: 3274538 - RNA, 15 nt, Vaccinia virus
aguaucaugaacucu

SEQ ID NO: 3274539 - RNA, 9 nt, Vaccinia virus
cauuucagu

SEQ ID NO: 3274540 - RNA, 17 nt, Vaccinia virus
uuauggagcaaacauua

SEQ ID NO: 3274541 - RNA, 23 nt, Vaccinia virus
cuagauauguauuuaauaucaaa

SEQ ID NO: 3274542 - RNA, 18 nt, Vaccinia virus
gacaccuaaaaagaaugu

SEQ ID NO: 3274543 - RNA, 22 nt, Vaccinia virus
cggaguaaguguugagcucccu

SEQ ID NO: 3274544 - RNA, 18 nt, Vaccinia virus
aauacguuagguauguac

SEQ ID NO: 3274545 - RNA, 14 nt, Vaccinia virus
uuucuagacaucuu

SEQ ID NO: 3274546 - RNA, 16 nt, Vaccinia virus
uuacacauaaacaucg

SEQ ID NO: 3274547 - RNA, 21 nt, Vaccinia virus
ugaaacgugucacaacuuauc

SEQ ID NO: 3274548 - RNA, 13 nt, Vaccinia virus
aaaauauauucua

SEQ ID NO: 3274549 - RNA, 14 nt, Vaccinia virus
caugaccuucuuca

SEQ ID NO: 3274550 - RNA, 21 nt, Vaccinia virus
aaaucagauaucgauguuaua

SEQ ID NO: 3274551 - RNA, 19 nt, Vaccinia virus
gguaauagauuuuucauau

SEQ ID NO: 3274552 - RNA, 20 nt, Vaccinia virus
ugaaucgauaacucuauuca

SEQ ID NO: 3274553 - RNA, 16 nt, Vaccinia virus
guauaucuauauuaac

SEQ ID NO: 3274554 - RNA, 14 nt, Vaccinia virus
auuuuaucaaacau

SEQ ID NO: 3274555 - RNA, 23 nt, Vaccinia virus
ugacaucauacuagauaaaucgu

SEQ ID NO: 3274556 - RNA, 22 nt, Vaccinia virus
auacgaauaucguucucuaaau

SEQ ID NO: 3274557 - RNA, 16 nt, Vaccinia virus
guuauaaacgggugua

SEQ ID NO: 3274558 - RNA, 19 nt, Vaccinia virus
auauuugagaguauuggua

SEQ ID NO: 3274559 - RNA, 22 nt, Vaccinia virus
cucagauucaguuucucaucuu

SEQ ID NO: 3274560 - RNA, 17 nt, Vaccinia virus
ugagauguuuauauguu

SEQ ID NO: 3274561 - RNA, 20 nt, Vaccinia virus
auuauaaugaauauuauuau

SEQ ID NO: 3274562 - RNA, 14 nt, Vaccinia virus
uauuuuuuaugaua

SEQ ID NO: 3274563 - RNA, 22 nt, Vaccinia virus
cauuggaguugauaauaauaca

SEQ ID NO: 3274564 - RNA, 23 nt, Vaccinia virus
agaaaacucguuauuaacuaugu

SEQ ID NO: 3274565 - RNA, 18 nt, Vaccinia virus
agaauccaucaaaaaugu

SEQ ID NO: 3274566 - RNA, 18 nt, Vaccinia virus
aucugauaauauuaaaaa

SEQ ID NO: 3274567 - RNA, 12 nt, Vaccinia virus
ccucaaauguag

SEQ ID NO: 3274568 - RNA, 12 nt, Vaccinia virus
auuuaaacgaag

SEQ ID NO: 3274569 - RNA, 18 nt, Vaccinia virus
aauaugagaaugaauaug

SEQ ID NO: 3274570 - RNA, 14 nt, Vaccinia virus
auaacaguaucuga

SEQ ID NO: 3274571 - RNA, 15 nt, Vaccinia virus
acgucaucaaaaaua

SEQ ID NO: 3274572 - RNA, 19 nt, Vaccinia virus
gaguauuaaccaugaaaga

SEQ ID NO: 3274573 - RNA, 17 nt, Vaccinia virus
gaugagguaaaaaauaa

SEQ ID NO: 3274574 - RNA, 19 nt, Vaccinia virus
gucaacggaccccaacauc

SEQ ID NO: 3274575 - RNA, 15 nt, Vaccinia virus
aguauggaauacaua

SEQ ID NO: 3274576 - RNA, 22 nt, Vaccinia virus
agcauccccuuucaauaguucu

SEQ ID NO: 3274577 - RNA, 20 nt, Vaccinia virus
ucgugcagaggauaguuguu

SEQ ID NO: 3274578 - RNA, 18 nt, Vaccinia virus
gucggaaaucuuaaccaa

SEQ ID NO: 3274579 - RNA, 17 nt, Vaccinia virus
cgaauaaagugaacaau

SEQ ID NO: 3274580 - RNA, 16 nt, Vaccinia virus
uagauuucgaaaauac

SEQ ID NO: 3274581 - RNA, 17 nt, Vaccinia virus
ucaugagauguguauac

SEQ ID NO: 3274582 - RNA, 17 nt, Vaccinia virus
cacacacgauuaauuuu

SEQ ID NO: 3274583 - RNA, 21 nt, Vaccinia virus
aaauccuguaauauuuuuagu

SEQ ID NO: 3274584 - RNA, 17 nt, Vaccinia virus
ugaugauuauggagaac

SEQ ID NO: 3274585 - RNA, 18 nt, Vaccinia virus
agaacagaccaaauauau

SEQ ID NO: 3274586 - RNA, 22 nt, Vaccinia virus
aaauaggaguuagaauaauaau

SEQ ID NO: 3274587 - RNA, 18 nt, Vaccinia virus
cgaugaucaaugacgaua

SEQ ID NO: 3274588 - RNA, 20 nt, Vaccinia virus
accucuuauuggucagaaau

SEQ ID NO: 3274589 - RNA, 15 nt, Vaccinia virus
gaaauguauaaacua

SEQ ID NO: 3274590 - RNA, 23 nt, Vaccinia virus
caaauccuucauucauuagauaa

SEQ ID NO: 3274591 - RNA, 22 nt, Vaccinia virus
acauauuuuagaacagaaauac

SEQ ID NO: 3274592 - RNA, 15 nt, Vaccinia virus
uagaaugaagaaugc

SEQ ID NO: 3274593 - RNA, 21 nt, Vaccinia virus
auuacacuacauuuuuaucau

SEQ ID NO: 3274594 - RNA, 14 nt, Vaccinia virus
cugugaauacuuua

SEQ ID NO: 3274595 - RNA, 13 nt, Vaccinia virus
cugaugaaacauu

SEQ ID NO: 3274596 - RNA, 23 nt, Vaccinia virus
acguaucaccaacggaaauggua

SEQ ID NO: 3274597 - RNA, 16 nt, Vaccinia virus
accauuaauaggaaaa

SEQ ID NO: 3274598 - RNA, 15 nt, Vaccinia virus
guacaucuugacauu

SEQ ID NO: 3274599 - RNA, 17 nt, Vaccinia virus
acaaacaacuaggaaau

SEQ ID NO: 3274600 - RNA, 21 nt, Vaccinia virus
aucagcauguagacaaaauga

SEQ ID NO: 3274601 - RNA, 13 nt, Vaccinia virus
uuauuucuaaaau

SEQ ID NO: 3274602 - RNA, 13 nt, Vaccinia virus
aaucauuuaucau

SEQ ID NO: 3274603 - RNA, 18 nt, Vaccinia virus
guaauuauaguauaaugu

SEQ ID NO: 3274604 - RNA, 19 nt, Vaccinia virus
aauuuguccacguucuuua

SEQ ID NO: 3274605 - RNA, 23 nt, Vaccinia virus
caaauuuuuucuuuaauauuuua

SEQ ID NO: 3274606 - RNA, 23 nt, Vaccinia virus
uguuugucugagggguucgucua

SEQ ID NO: 3274607 - RNA, 21 nt, Vaccinia virus
auuuuaucgauucuaaugaau

SEQ ID NO: 3274608 - RNA, 22 nt, Vaccinia virus
gacgaguuucggcacauauuaa

SEQ ID NO: 3274609 - RNA, 15 nt, Vaccinia virus
caacggagauacauu

SEQ ID NO: 3274610 - RNA, 14 nt, Vaccinia virus
aaacugugaauguc

SEQ ID NO: 3274611 - RNA, 14 nt, Vaccinia virus
cugauuuauguuuu

SEQ ID NO: 3274612 - RNA, 22 nt, Vaccinia virus
cuaaucuaaacgcguuagauaa

SEQ ID NO: 3274613 - RNA, 13 nt, Vaccinia virus
auuuguucuugua

SEQ ID NO: 3274614 - RNA, 15 nt, Vaccinia virus
cuaaacaagcuaucu

SEQ ID NO: 3274615 - RNA, 19 nt, Vaccinia virus
uacaguaguaauuaaugaa

SEQ ID NO: 3274616 - RNA, 15 nt, Vaccinia virus
uaaaggaugaguaca

SEQ ID NO: 3274617 - RNA, 18 nt, Vaccinia virus
cuagacgauauagugaaa

SEQ ID NO: 3274618 - RNA, 12 nt, Vaccinia virus
agcauacucuau

SEQ ID NO: 3274619 - RNA, 21 nt, Vaccinia virus
augauaauaggaauggauaau

SEQ ID NO: 3274620 - RNA, 19 nt, Vaccinia virus
cuaauaugaggaaaaugau

SEQ ID NO: 3274621 - RNA, 14 nt, Vaccinia virus
aagaaauuaauaga

SEQ ID NO: 3274622 - RNA, 12 nt, Vaccinia virus
ucaccaauaaaa

SEQ ID NO: 3274623 - RNA, 17 nt, Vaccinia virus
auacagaaggaaacuuc

SEQ ID NO: 3274624 - RNA, 13 nt, Vaccinia virus
uuuuguacauaau

SEQ ID NO: 3274625 - RNA, 22 nt, Vaccinia virus
acauaaauaauucuagaggaga

SEQ ID NO: 3274626 - RNA, 22 nt, Vaccinia virus
cugguaacuauauucuuagaaa

SEQ ID NO: 3274627 - RNA, 13 nt, Vaccinia virus
acuuuuuacuaau

SEQ ID NO: 3274628 - RNA, 22 nt, Vaccinia virus
agacuacuuauucuauuuuacu

SEQ ID NO: 3274629 - RNA, 15 nt, Vaccinia virus
uaaauuuauaauguu

SEQ ID NO: 3274630 - RNA, 21 nt, Vaccinia virus
aaauaacgucuucuauguauu

SEQ ID NO: 3274631 - RNA, 23 nt, Vaccinia virus
aacuuuaaauaauuuacaaaaau

SEQ ID NO: 3274632 - RNA, 14 nt, Vaccinia virus
uaaaacagauuucu

SEQ ID NO: 3274633 - RNA, 14 nt, Vaccinia virus
uuauuguuugggua

SEQ ID NO: 3274634 - RNA, 14 nt, Vaccinia virus
aauuuccaucucua

SEQ ID NO: 3274635 - RNA, 10 nt, Vaccinia virus
acaucuaucu

SEQ ID NO: 3274636 - RNA, 20 nt, Vaccinia virus
auaugucucgcauaaacauu

SEQ ID NO: 3274637 - RNA, 21 nt, Vaccinia virus
cauguguuucccaaacaaaau

SEQ ID NO: 3274638 - RNA, 23 nt, Vaccinia virus
cuagauuaauuuuugugggaagc

SEQ ID NO: 3274639 - RNA, 13 nt, Vaccinia virus
uaucuucuaaaaa

SEQ ID NO: 3274640 - RNA, 22 nt, Vaccinia virus
uggaguugauucauaacgaaaa

SEQ ID NO: 3274641 - RNA, 18 nt, Vaccinia virus
uaaaucagaauguuacag

SEQ ID NO: 3274642 - RNA, 15 nt, Vaccinia virus
uuauguaaaacauuu

SEQ ID NO: 3274643 - RNA, 16 nt, Vaccinia virus
aaucucuaaagucacu

SEQ ID NO: 3274644 - RNA, 17 nt, Vaccinia virus
uaguauuugagaaauau

SEQ ID NO: 3274645 - RNA, 16 nt, Vaccinia virus
aaaauuuaagagaaug

SEQ ID NO: 3274646 - RNA, 12 nt, Vaccinia virus
ucaaauaugaaa

SEQ ID NO: 3274647 - RNA, 19 nt, Vaccinia virus
guauaacacacaugucuua

SEQ ID NO: 3274648 - RNA, 16 nt, Vaccinia virus
auauuucuauuucuau

SEQ ID NO: 3274649 - RNA, 18 nt, Vaccinia virus
auauugcaccagaauuaa

SEQ ID NO: 3274650 - RNA, 19 nt, Vaccinia virus
uaauauucccagaaaagau

SEQ ID NO: 3274651 - RNA, 12 nt, Vaccinia virus
auguaaaacaaa

SEQ ID NO: 3274652 - RNA, 18 nt, Vaccinia virus
uuuuagaaauguuauaua

SEQ ID NO: 3274653 - RNA, 15 nt, Vaccinia virus
aggacgguauaugua

SEQ ID NO: 3274654 - RNA, 21 nt, Vaccinia virus
auuaaguucuggcaauguuuc

SEQ ID NO: 3274655 - RNA, 21 nt, Vaccinia virus
caucaaccuuccgacuaaaga

SEQ ID NO: 3274656 - RNA, 19 nt, Vaccinia virus
aguuucuguaaugauggac

SEQ ID NO: 3274657 - RNA, 17 nt, Vaccinia virus
uacauucuuuuugcugu

SEQ ID NO: 3274658 - RNA, 17 nt, Vaccinia virus
guuauaagauuacuuau

SEQ ID NO: 3274659 - RNA, 22 nt, Vaccinia virus
gugcuauuagaauuuacaaaac

SEQ ID NO: 3274660 - RNA, 15 nt, Vaccinia virus
gccuuuuuauacaug

SEQ ID NO: 3274661 - RNA, 13 nt, Vaccinia virus
gcauuaauacagu

SEQ ID NO: 3274662 - RNA, 16 nt, Vaccinia virus
ugauuaauaugugaca

SEQ ID NO: 3274663 - RNA, 16 nt, Vaccinia virus
acauauucuaugaauu

SEQ ID NO: 3274664 - RNA, 17 nt, Vaccinia virus
gucuacuggaugaagau

SEQ ID NO: 3274665 - RNA, 15 nt, Vaccinia virus
acaccucuacauaac

SEQ ID NO: 3274666 - RNA, 22 nt, Vaccinia virus
uauauagcuauucuucuuuaaa

SEQ ID NO: 3274667 - RNA, 19 nt, Vaccinia virus
aaagacagcgacaucaaga

SEQ ID NO: 3274668 - RNA, 21 nt, Vaccinia virus
agcacuacgcaauaugaucac

SEQ ID NO: 3274669 - RNA, 18 nt, Vaccinia virus
cuuuuguggaauuuccca

SEQ ID NO: 3274670 - RNA, 14 nt, Vaccinia virus
aaaauuuugaucau

SEQ ID NO: 3274671 - RNA, 14 nt, Vaccinia virus
ugaaauaaagucau

SEQ ID NO: 3274672 - RNA, 18 nt, Vaccinia virus
cuauaaaauaaaaugagu

SEQ ID NO: 3274673 - RNA, 15 nt, Vaccinia virus
aaagguauacgaaug

SEQ ID NO: 3274674 - RNA, 12 nt, Vaccinia virus
uauauuauuaca

SEQ ID NO: 3274675 - RNA, 20 nt, Vaccinia virus
uguugugucaguuuauaaua

SEQ ID NO: 3274676 - RNA, 14 nt, Vaccinia virus
aucauaccuccauc

SEQ ID NO: 3274677 - RNA, 15 nt, Vaccinia virus
aguucauuaucugaa

SEQ ID NO: 3274678 - RNA, 13 nt, Vaccinia virus
auacaucuaaauu

SEQ ID NO: 3274679 - RNA, 17 nt, Vaccinia virus
uguaauugugacaucau

SEQ ID NO: 3274680 - RNA, 20 nt, Vaccinia virus
uaaaacugaaccuacuuuau

SEQ ID NO: 3274681 - RNA, 19 nt, Vaccinia virus
agacaauaacuaacaauua

SEQ ID NO: 3274682 - RNA, 11 nt, Vaccinia virus
aacugucuaua

SEQ ID NO: 3274683 - RNA, 20 nt, Vaccinia virus
aguauaucaaauacaucuau

SEQ ID NO: 3274684 - RNA, 22 nt, Vaccinia virus
guagaacaacgauuuaaucaua

SEQ ID NO: 3274685 - RNA, 21 nt, Vaccinia virus
gauugauuuggaauucuuuuu

SEQ ID NO: 3274686 - RNA, 14 nt, Vaccinia virus
auugaagaugaugu

SEQ ID NO: 3274687 - RNA, 18 nt, Vaccinia virus
cauuacuucuuccauguc

SEQ ID NO: 3274688 - RNA, 13 nt, Vaccinia virus
augaauuagagaa

SEQ ID NO: 3274689 - RNA, 13 nt, Vaccinia virus
gaaagauguuauu

SEQ ID NO: 3274690 - RNA, 18 nt, Vaccinia virus
cgacaucaaaugguacaa

SEQ ID NO: 3274691 - RNA, 17 nt, Vaccinia virus
ucccaauuccaaagauc

SEQ ID NO: 3274692 - RNA, 23 nt, Vaccinia virus
auacaaaaucaucugauaauuua

SEQ ID NO: 3274693 - RNA, 16 nt, Vaccinia virus
gaaacggugaauacaa

SEQ ID NO: 3274694 - RNA, 16 nt, Vaccinia virus
uacaucgucuagaucu

SEQ ID NO: 3274695 - RNA, 17 nt, Vaccinia virus
agacuuuacuuuucuaa

SEQ ID NO: 3274696 - RNA, 21 nt, Vaccinia virus
ucagccgcuacagaaacauau

SEQ ID NO: 3274697 - RNA, 18 nt, Vaccinia virus
uauuauccgaagacagau

SEQ ID NO: 3274698 - RNA, 14 nt, Vaccinia virus
aucucaucagacau

SEQ ID NO: 3274699 - RNA, 16 nt, Vaccinia virus
gcgaaccgauuaaaca

SEQ ID NO: 3274700 - RNA, 19 nt, Vaccinia virus
uaaaaacaaauuuguacau

SEQ ID NO: 3274701 - RNA, 12 nt, Vaccinia virus
caauaagaaagu

SEQ ID NO: 3274702 - RNA, 16 nt, Vaccinia virus
uguaaaaucaugauuc

SEQ ID NO: 3274703 - RNA, 20 nt, Vaccinia virus
ugaagcauuggaagcaacua

SEQ ID NO: 3274704 - RNA, 15 nt, Vaccinia virus
guuauuauaaacucu

SEQ ID NO: 3274705 - RNA, 18 nt, Vaccinia virus
gcuucuaucuuguuuaga

SEQ ID NO: 3274706 - RNA, 17 nt, Vaccinia virus
guaauuguauuauuucc

SEQ ID NO: 3274707 - RNA, 23 nt, Vaccinia virus
aaugauuacuaacgcaacuauau

SEQ ID NO: 3274708 - RNA, 13 nt, Vaccinia virus
caccuuugccuua

SEQ ID NO: 3274709 - RNA, 15 nt, Vaccinia virus
auccuauucuaaaug

SEQ ID NO: 3274710 - RNA, 16 nt, Vaccinia virus
guauuuauaaacuuua

SEQ ID NO: 3274711 - RNA, 15 nt, Vaccinia virus
gauugggugaggaaa

SEQ ID NO: 3274712 - RNA, 15 nt, Vaccinia virus
uaguuuacuuuucua

SEQ ID NO: 3274713 - RNA, 15 nt, Vaccinia virus
uugacaucuauauau

SEQ ID NO: 3274714 - RNA, 20 nt, Vaccinia virus
cucauagaccuguaguuuua

SEQ ID NO: 3274715 - RNA, 13 nt, Vaccinia virus
acauugagaaugu

SEQ ID NO: 3274716 - RNA, 15 nt, Vaccinia virus
aagcuuuuagaauau

SEQ ID NO: 3274717 - RNA, 16 nt, Vaccinia virus
aauacuuaacagagga

SEQ ID NO: 3274718 - RNA, 24 nt, Vaccinia virus
aauaauuacuuuacaaacgaugua

SEQ ID NO: 3274719 - RNA, 20 nt, Vaccinia virus
auaacaucagaaaauguaaa

SEQ ID NO: 3274720 - RNA, 12 nt, Vaccinia virus
agagaauauacu

SEQ ID NO: 3274721 - RNA, 22 nt, Vaccinia virus
auuauaucauugucuaauagau

SEQ ID NO: 3274722 - RNA, 18 nt, Vaccinia virus
uuucauccgaucauugau

SEQ ID NO: 3274723 - RNA, 18 nt, Vaccinia virus
auaaauugguaaauccua

SEQ ID NO: 3274724 - RNA, 20 nt, Vaccinia virus
acguucuacuauagaauuaa

SEQ ID NO: 3274725 - RNA, 15 nt, Vaccinia virus
aucugucaauagaca

SEQ ID NO: 3274726 - RNA, 15 nt, Vaccinia virus
gaaauuuguaaucau

SEQ ID NO: 3274727 - RNA, 20 nt, Vaccinia virus
uaaacgauuuuccaaaucag

SEQ ID NO: 3274728 - RNA, 17 nt, Vaccinia virus
guuuaauaauaauucau

SEQ ID NO: 3274729 - RNA, 22 nt, Vaccinia virus
guauaauagaccacgauaauau

SEQ ID NO: 3274730 - RNA, 20 nt, Vaccinia virus
aggggaacccaucaaagaua

SEQ ID NO: 3274731 - RNA, 14 nt, Vaccinia virus
auauuguuaaauaa

SEQ ID NO: 3274732 - RNA, 21 nt, Vaccinia virus
auuuccaaagauacacacauu

SEQ ID NO: 3274733 - RNA, 18 nt, Vaccinia virus
ccgaugauguaagucuua

SEQ ID NO: 3274734 - RNA, 16 nt, Vaccinia virus
gcuaauaaauaaugau

SEQ ID NO: 3274735 - RNA, 13 nt, Vaccinia virus
uaaugauaaauuu

SEQ ID NO: 3274736 - RNA, 13 nt, Vaccinia virus
uuccauuauuaau

SEQ ID NO: 3274737 - RNA, 17 nt, Vaccinia virus
uuuagacgcuuauuauu

SEQ ID NO: 3274738 - RNA, 22 nt, Vaccinia virus
uuauugcuagccucaucuucua

SEQ ID NO: 3274739 - RNA, 14 nt, Vaccinia virus
acuggagagacuga

SEQ ID NO: 3274740 - RNA, 12 nt, Vaccinia virus
ugguauauacau

SEQ ID NO: 3274741 - RNA, 22 nt, Vaccinia virus
caaauaucauaacuuaguucuu

SEQ ID NO: 3274742 - RNA, 15 nt, Vaccinia virus
ugaagcauuggaagc

SEQ ID NO: 3274743 - RNA, 22 nt, Vaccinia virus
auuaacuacugauaacaaaaua

SEQ ID NO: 3274744 - RNA, 14 nt, Vaccinia virus
guaaacacauaucc

SEQ ID NO: 3274745 - RNA, 22 nt, Vaccinia virus
acuacauaguuaucuaucuuaa

SEQ ID NO: 3274746 - RNA, 17 nt, Vaccinia virus
ugugcaucuacugauau

SEQ ID NO: 3274747 - RNA, 18 nt, Vaccinia virus
ucucauaaaaaaaguuuu

SEQ ID NO: 3274748 - RNA, 21 nt, Vaccinia virus
aagaucauacagucacagaca

SEQ ID NO: 3274749 - RNA, 15 nt, Vaccinia virus
uccaaucuuaaacau

SEQ ID NO: 3274750 - RNA, 15 nt, Vaccinia virus
gauaacuuuaaacau

SEQ ID NO: 3274751 - RNA, 20 nt, Vaccinia virus
agagcauauuucauuuccaa

SEQ ID NO: 3274752 - RNA, 15 nt, Vaccinia virus
uccauaauuuucucu

SEQ ID NO: 3274753 - RNA, 21 nt, Vaccinia virus
ucugacauaagaugucuauga

SEQ ID NO: 3274754 - RNA, 19 nt, Vaccinia virus
gguuaacucuuucuuuuga

SEQ ID NO: 3274755 - RNA, 13 nt, Vaccinia virus
cacagaaauacua

SEQ ID NO: 3274756 - RNA, 19 nt, Vaccinia virus
aauaucaguaucuucuuua

SEQ ID NO: 3274757 - RNA, 16 nt, Vaccinia virus
uauaauucuccugaaa

SEQ ID NO: 3274758 - RNA, 17 nt, Vaccinia virus
acagaauaaacaaaaua

SEQ ID NO: 3274759 - RNA, 13 nt, Vaccinia virus
uagcgacauaaac

SEQ ID NO: 3274760 - RNA, 17 nt, Vaccinia virus
auauuaguauguuauau

SEQ ID NO: 3274761 - RNA, 21 nt, Vaccinia virus
ccacaccgccucuagauaucg

SEQ ID NO: 3274762 - RNA, 21 nt, Vaccinia virus
cugacuacuaacgaaauuaau

SEQ ID NO: 3274763 - RNA, 18 nt, Vaccinia virus
gauaaauaggaucaucua

SEQ ID NO: 3274764 - RNA, 22 nt, Vaccinia virus
guagauuuucaauuauguauca

SEQ ID NO: 3274765 - RNA, 21 nt, Vaccinia virus
auuaucaagauguguauguuu

SEQ ID NO: 3274766 - RNA, 19 nt, Vaccinia virus
aggauaaaauauuauccaa

SEQ ID NO: 3274767 - RNA, 17 nt, Vaccinia virus
cauaagucuaauagacu

SEQ ID NO: 3274768 - RNA, 18 nt, Vaccinia virus
gcacauagcgaugauuau

SEQ ID NO: 3274769 - RNA, 13 nt, Vaccinia virus
caaugauaacaau

SEQ ID NO: 3274770 - RNA, 11 nt, Vaccinia virus
aaguaaaugaa

SEQ ID NO: 3274771 - RNA, 18 nt, Vaccinia virus
auccucagucaucuuguc

SEQ ID NO: 3274772 - RNA, 14 nt, Vaccinia virus
uuuucgaaauggua

SEQ ID NO: 3274773 - RNA, 15 nt, Vaccinia virus
aucaaaagaaugauu

SEQ ID NO: 3274774 - RNA, 18 nt, Vaccinia virus
auuagugacggaaaaucg

SEQ ID NO: 3274775 - RNA, 18 nt, Vaccinia virus
augauuaaaauuaacaag

SEQ ID NO: 3274776 - RNA, 21 nt, Vaccinia virus
cuauauaaagguccuauucca

SEQ ID NO: 3274777 - RNA, 23 nt, Vaccinia virus
cauucacuauuccgucacuggcu

SEQ ID NO: 3274778 - RNA, 14 nt, Vaccinia virus
auuuaucuauuuua

SEQ ID NO: 3274779 - RNA, 14 nt, Vaccinia virus
ucuuauauuuauaa

SEQ ID NO: 3274780 - RNA, 12 nt, Vaccinia virus
caucuaugauuu

SEQ ID NO: 3274781 - RNA, 20 nt, Vaccinia virus
ugaauaucuacaaauuggag

SEQ ID NO: 3274782 - RNA, 16 nt, Vaccinia virus
ucagcugaaaaacuau

SEQ ID NO: 3274783 - RNA, 14 nt, Vaccinia virus
auguauauaucacu

SEQ ID NO: 3274784 - RNA, 18 nt, Vaccinia virus
gcaaaacauuauaauaau

SEQ ID NO: 3274785 - RNA, 16 nt, Vaccinia virus
uaaauauccacucugu

SEQ ID NO: 3274786 - RNA, 22 nt, Vaccinia virus
auuuaggaaugauuaucaaaug

SEQ ID NO: 3274787 - RNA, 12 nt, Vaccinia virus
uaaucuuuucug

SEQ ID NO: 3274788 - RNA, 18 nt, Vaccinia virus
auuuggagcuuuaauagu

SEQ ID NO: 3274789 - RNA, 16 nt, Vaccinia virus
auaauacauuuaaauu

SEQ ID NO: 3274790 - RNA, 12 nt, Vaccinia virus
aaacuuacagaa

SEQ ID NO: 3274791 - RNA, 20 nt, Vaccinia virus
uuuguaccaacaaacuguuc

SEQ ID NO: 3274792 - RNA, 16 nt, Vaccinia virus
cgcgauaaauucguaa

SEQ ID NO: 3274793 - RNA, 16 nt, Vaccinia virus
cauuuucuuacaauua

SEQ ID NO: 3274794 - RNA, 24 nt, Vaccinia virus
caaauuguuaaauuaauaauggau

SEQ ID NO: 3274795 - RNA, 20 nt, Vaccinia virus
ucauauaacuucuagaugua

SEQ ID NO: 3274796 - RNA, 17 nt, Vaccinia virus
guugacgcuguaaaaga

SEQ ID NO: 3274797 - RNA, 16 nt, Vaccinia virus
ugaggauuuaaaacuc

SEQ ID NO: 3274798 - RNA, 13 nt, Vaccinia virus
uugccaaguuauc

SEQ ID NO: 3274799 - RNA, 20 nt, Vaccinia virus
uuaguauaacgugaauguau

SEQ ID NO: 3274800 - RNA, 18 nt, Vaccinia virus
acugauucagaaauggau

SEQ ID NO: 3274801 - RNA, 13 nt, Vaccinia virus
uuaaauauguucu

SEQ ID NO: 3274802 - RNA, 11 nt, Vaccinia virus
aaaaacuauac

SEQ ID NO: 3274803 - RNA, 14 nt, Vaccinia virus
ggagaauguuuccc

SEQ ID NO: 3274804 - RNA, 16 nt, Vaccinia virus
ucacucgugaagaagc

SEQ ID NO: 3274805 - RNA, 20 nt, Vaccinia virus
ucaucuuuuaccaacacaaa

SEQ ID NO: 3274806 - RNA, 17 nt, Vaccinia virus
uuaacuccucuauuaau

SEQ ID NO: 3274807 - RNA, 20 nt, Vaccinia virus
aagacuuagugacggacuua

SEQ ID NO: 3274808 - RNA, 16 nt, Vaccinia virus
guucuugaucuuauua

SEQ ID NO: 3274809 - RNA, 15 nt, Vaccinia virus
aaugcauuaaauaau

SEQ ID NO: 3274810 - RNA, 17 nt, Vaccinia virus
aagcgaauuacucuguc

SEQ ID NO: 3274811 - RNA, 18 nt, Vaccinia virus
agaaauagauaaugaaca

SEQ ID NO: 3274812 - RNA, 18 nt, Vaccinia virus
cuuacuaucuuuuucuca

SEQ ID NO: 3274813 - RNA, 15 nt, Vaccinia virus
ggucuaucaauaacu

SEQ ID NO: 3274814 - RNA, 16 nt, Vaccinia virus
uaauaauagaaaccau

SEQ ID NO: 3274815 - RNA, 14 nt, Vaccinia virus
guuguauagaaauu

SEQ ID NO: 3274816 - RNA, 19 nt, Vaccinia virus
uucgucuucccaaaauguu

SEQ ID NO: 3274817 - RNA, 21 nt, Vaccinia virus
augucuaaaaacagaaauagc

SEQ ID NO: 3274818 - RNA, 16 nt, Vaccinia virus
cuauaccauuaucuau

SEQ ID NO: 3274819 - RNA, 22 nt, Vaccinia virus
gaaacugacggaugauucuagu

SEQ ID NO: 3274820 - RNA, 14 nt, Vaccinia virus
gcuaaaauuuucau

SEQ ID NO: 3274821 - RNA, 17 nt, Vaccinia virus
uuuuaccaacacaaagg

SEQ ID NO: 3274822 - RNA, 23 nt, Vaccinia virus
auuuccauccgauuguuguguac

SEQ ID NO: 3274823 - RNA, 22 nt, Vaccinia virus
ucuuugaaacacgauuuaaaau

SEQ ID NO: 3274824 - RNA, 20 nt, Vaccinia virus
gaaacccccucauuuuuuaa

SEQ ID NO: 3274825 - RNA, 17 nt, Vaccinia virus
aauaacaggcuaaaaug

SEQ ID NO: 3274826 - RNA, 18 nt, Vaccinia virus
aaucuagauuccaaucau

SEQ ID NO: 3274827 - RNA, 12 nt, Vaccinia virus
auuguaaaugau

SEQ ID NO: 3274828 - RNA, 14 nt, Vaccinia virus
agcaauaaauacag

SEQ ID NO: 3274829 - RNA, 14 nt, Vaccinia virus
aauuauuauccaau

SEQ ID NO: 3274830 - RNA, 23 nt, Vaccinia virus
gucucaugucguaauaaauauga

SEQ ID NO: 3274831 - RNA, 19 nt, Vaccinia virus
gaacaucuuccauauccua

SEQ ID NO: 3274832 - RNA, 23 nt, Vaccinia virus
uuaucagaagauggauggaugaa

SEQ ID NO: 3274833 - RNA, 20 nt, Vaccinia virus
auaucuuauucugguuuaaa

SEQ ID NO: 3274834 - RNA, 12 nt, Vaccinia virus
uaggaaugccac

SEQ ID NO: 3274835 - RNA, 18 nt, Vaccinia virus
ugccauaaauaaaugcuu

SEQ ID NO: 3274836 - RNA, 17 nt, Vaccinia virus
ucuauuuugucauuaac

SEQ ID NO: 3274837 - RNA, 12 nt, Vaccinia virus
ucucaaaauaug

SEQ ID NO: 3274838 - RNA, 23 nt, Vaccinia virus
gaacauuucugcauuacaaagaa

SEQ ID NO: 3274839 - RNA, 12 nt, Vaccinia virus
aaucauguacau

SEQ ID NO: 3274840 - RNA, 16 nt, Vaccinia virus
aaguugauacaacaua

SEQ ID NO: 3274841 - RNA, 21 nt, Vaccinia virus
uuaaaaauaagaaugaaauaa

SEQ ID NO: 3274842 - RNA, 17 nt, Vaccinia virus
gaaccaguaacauauga

SEQ ID NO: 3274843 - RNA, 17 nt, Vaccinia virus
auacaaguguagaugau

SEQ ID NO: 3274844 - RNA, 22 nt, Vaccinia virus
aaacaagugauacguaagaaua

SEQ ID NO: 3274845 - RNA, 14 nt, Vaccinia virus
aacuuugaaauugu

SEQ ID NO: 3274846 - RNA, 23 nt, Vaccinia virus
gcugguaauaguuuacagauauu

SEQ ID NO: 3274847 - RNA, 17 nt, Vaccinia virus
auaauuguacuuuguaa

SEQ ID NO: 3274848 - RNA, 18 nt, Vaccinia virus
uuauuaucccauuguaaa

SEQ ID NO: 3274849 - RNA, 19 nt, Vaccinia virus
ugguccaaacugccacuga

SEQ ID NO: 3274850 - RNA, 18 nt, Vaccinia virus
ggaugaagcauauuacuc

SEQ ID NO: 3274851 - RNA, 22 nt, Vaccinia virus
uccucagcgauagcucuucuau

SEQ ID NO: 3274852 - RNA, 18 nt, Vaccinia virus
cuauagaaauuauuuuua

SEQ ID NO: 3274853 - RNA, 22 nt, Vaccinia virus
ggauucauccuguugucuaaau

SEQ ID NO: 3274854 - RNA, 14 nt, Vaccinia virus
acuagaguauauaa

SEQ ID NO: 3274855 - RNA, 18 nt, Vaccinia virus
uccucauuacguuucauu

SEQ ID NO: 3274856 - RNA, 15 nt, Vaccinia virus
uuaaugcaccgaaca

SEQ ID NO: 3274857 - RNA, 20 nt, Vaccinia virus
ugcauccaugcagcauuucc

SEQ ID NO: 3274858 - RNA, 16 nt, Vaccinia virus
cuucauuaaucuuuuc

SEQ ID NO: 3274859 - RNA, 14 nt, Vaccinia virus
aguauuaaauauua

SEQ ID NO: 3274860 - RNA, 12 nt, Vaccinia virus
aauuaugaugau

SEQ ID NO: 3274861 - RNA, 21 nt, Vaccinia virus
agaggaugaaauagauagaau

SEQ ID NO: 3274862 - RNA, 15 nt, Vaccinia virus
caaagcaucgauuug

SEQ ID NO: 3274863 - RNA, 16 nt, Vaccinia virus
auuuacuaucuguaau

SEQ ID NO: 3274864 - RNA, 17 nt, Vaccinia virus
auuauguuuuaugaaua

SEQ ID NO: 3274865 - RNA, 17 nt, Vaccinia virus
uaacaauaucaauaaau

SEQ ID NO: 3274866 - RNA, 22 nt, Vaccinia virus
ucaauuacacuauuugucuuaa

SEQ ID NO: 3274867 - RNA, 13 nt, Vaccinia virus
aauuuacagaaau

SEQ ID NO: 3274868 - RNA, 20 nt, Vaccinia virus
aucaugaaaugaugauauau

SEQ ID NO: 3274869 - RNA, 18 nt, Vaccinia virus
agauaaugguagcaauau

SEQ ID NO: 3274870 - RNA, 14 nt, Vaccinia virus
cgauucaaaguacu

SEQ ID NO: 3274871 - RNA, 16 nt, Vaccinia virus
aaaauauauaguauua

SEQ ID NO: 3274872 - RNA, 22 nt, Vaccinia virus
aucaacguaacuauauuccaaa

SEQ ID NO: 3274873 - RNA, 15 nt, Vaccinia virus
cuugaauucuuuuau

SEQ ID NO: 3274874 - RNA, 19 nt, Vaccinia virus
ucguuuauaucacauugua

SEQ ID NO: 3274875 - RNA, 12 nt, Vaccinia virus
aauacagcaucu

SEQ ID NO: 3274876 - RNA, 18 nt, Vaccinia virus
aauaucaucuaaacagua

SEQ ID NO: 3274877 - RNA, 14 nt, Vaccinia virus
cuaaggauccagaa

SEQ ID NO: 3274878 - RNA, 18 nt, Vaccinia virus
ucugaaauuggaugagua

SEQ ID NO: 3274879 - RNA, 15 nt, Vaccinia virus
agaaaacuagauaca

SEQ ID NO: 3274880 - RNA, 22 nt, Vaccinia virus
gacgcauuuaauagagauauac

SEQ ID NO: 3274881 - RNA, 17 nt, Vaccinia virus
gacagcuauguuaucau

SEQ ID NO: 3274882 - RNA, 17 nt, Vaccinia virus
gauucuaguaucuuuug

SEQ ID NO: 3274883 - RNA, 23 nt, Vaccinia virus
aucaauucuucuacauuaaaaau

SEQ ID NO: 3274884 - RNA, 16 nt, Vaccinia virus
ugaauauccagaugga

SEQ ID NO: 3274885 - RNA, 22 nt, Vaccinia virus
ucgauucuggcuauuucaaaau

SEQ ID NO: 3274886 - RNA, 17 nt, Vaccinia virus
auaaucagaaaacuuau

SEQ ID NO: 3274887 - RNA, 21 nt, Vaccinia virus
agagaagucgucaagcauauu

SEQ ID NO: 3274888 - RNA, 15 nt, Vaccinia virus
gauuaauuagauaua

SEQ ID NO: 3274889 - RNA, 15 nt, Vaccinia virus
caaaaugauauacag

SEQ ID NO: 3274890 - RNA, 19 nt, Vaccinia virus
aacucgcuuaauaucuucu

SEQ ID NO: 3274891 - RNA, 19 nt, Vaccinia virus
aguagcuauaauauauucu

SEQ ID NO: 3274892 - RNA, 12 nt, Vaccinia virus
ugaagaugaugu

SEQ ID NO: 3274893 - RNA, 15 nt, Vaccinia virus
auaaagaaaaaucua

SEQ ID NO: 3274894 - RNA, 22 nt, Vaccinia virus
auuaacgaucuuuauaauauau

SEQ ID NO: 3274895 - RNA, 15 nt, Vaccinia virus
gaugauauauauauu

SEQ ID NO: 3274896 - RNA, 15 nt, Vaccinia virus
ccuuuaaauccucua

SEQ ID NO: 3274897 - RNA, 21 nt, Vaccinia virus
aacaguuugguauuagaauca

SEQ ID NO: 3274898 - RNA, 18 nt, Vaccinia virus
uaucuaugcuuacuguau

SEQ ID NO: 3274899 - RNA, 13 nt, Vaccinia virus
auauuagaauuua

SEQ ID NO: 3274900 - RNA, 22 nt, Vaccinia virus
aaauggaagauauuuccauuua

SEQ ID NO: 3274901 - RNA, 17 nt, Vaccinia virus
accucuaguuucagaau

SEQ ID NO: 3274902 - RNA, 20 nt, Vaccinia virus
acaucuacuuuaucuauuca

SEQ ID NO: 3274903 - RNA, 21 nt, Vaccinia virus
ucaauauacuauucuugugau

SEQ ID NO: 3274904 - RNA, 13 nt, Vaccinia virus
aucuauucaaaau

SEQ ID NO: 3274905 - RNA, 23 nt, Vaccinia virus
aaaucaaacggauugguaacauu

SEQ ID NO: 3274906 - RNA, 20 nt, Vaccinia virus
aauaucuuuaauacagaugg

SEQ ID NO: 3274907 - RNA, 21 nt, Vaccinia virus
gaauucuuuuucgacuuuuug

SEQ ID NO: 3274908 - RNA, 22 nt, Vaccinia virus
gacaacaaggcuuugauaucua

SEQ ID NO: 3274909 - RNA, 13 nt, Vaccinia virus
uugcuaaaaucug

SEQ ID NO: 3274910 - RNA, 23 nt, Vaccinia virus
acagcuaucaaaauauguagaaa

SEQ ID NO: 3274911 - RNA, 19 nt, Vaccinia virus
cuaaaauauuuuuauucuc

SEQ ID NO: 3274912 - RNA, 14 nt, Vaccinia virus
agcuuaaacuacua

SEQ ID NO: 3274913 - RNA, 20 nt, Vaccinia virus
cauaaucaucacugucauca

SEQ ID NO: 3274914 - RNA, 18 nt, Vaccinia virus
uaaaaacauuuuauuucu

SEQ ID NO: 3274915 - RNA, 21 nt, Vaccinia virus
uagcuaaagauuugucacaau

SEQ ID NO: 3274916 - RNA, 23 nt, Vaccinia virus
uucuuacaguacacaguauugac

SEQ ID NO: 3274917 - RNA, 16 nt, Vaccinia virus
agauaugccaaaauca

SEQ ID NO: 3274918 - RNA, 15 nt, Vaccinia virus
aggccaaagaaauga

SEQ ID NO: 3274919 - RNA, 19 nt, Vaccinia virus
ucuacauaaucuacgauau

SEQ ID NO: 3274920 - RNA, 23 nt, Vaccinia virus
uguuuccuauaaucguuaaauuu

SEQ ID NO: 3274921 - RNA, 21 nt, Vaccinia virus
cauaacaucuuucaucaucug

SEQ ID NO: 3274922 - RNA, 21 nt, Vaccinia virus
aaauaauagguuguaauauca

SEQ ID NO: 3274923 - RNA, 22 nt, Vaccinia virus
auuacuccagccguagaauauc

SEQ ID NO: 3274924 - RNA, 16 nt, Vaccinia virus
uuuucauaaauacacu

SEQ ID NO: 3274925 - RNA, 14 nt, Vaccinia virus
ucauccuugcuauc

SEQ ID NO: 3274926 - RNA, 23 nt, Vaccinia virus
uuggaccaccgacuguaacauug

SEQ ID NO: 3274927 - RNA, 22 nt, Vaccinia virus
cacgaacgaaaccuacugugac

SEQ ID NO: 3274928 - RNA, 18 nt, Vaccinia virus
uaugagaucgucguacau

SEQ ID NO: 3274929 - RNA, 15 nt, Vaccinia virus
uuaacagauguagua

SEQ ID NO: 3274930 - RNA, 21 nt, Vaccinia virus
ugaaugggaauuucuauguca

SEQ ID NO: 3274931 - RNA, 13 nt, Vaccinia virus
ggcaaaagaauac

SEQ ID NO: 3274932 - RNA, 17 nt, Vaccinia virus
uacuggaugaagaugug

SEQ ID NO: 3274933 - RNA, 13 nt, Vaccinia virus
cguucuacauaaa

SEQ ID NO: 3274934 - RNA, 19 nt, Vaccinia virus
ucgaugucgauagccauau

SEQ ID NO: 3274935 - RNA, 13 nt, Vaccinia virus
uauuuuuuucaua

SEQ ID NO: 3274936 - RNA, 21 nt, Vaccinia virus
aauaucuaggacaauaguuuc

SEQ ID NO: 3274937 - RNA, 21 nt, Vaccinia virus
acagaguuagaaauagauaau

SEQ ID NO: 3274938 - RNA, 21 nt, Vaccinia virus
aacgugauuauuauugucaua

SEQ ID NO: 3274939 - RNA, 19 nt, Vaccinia virus
acuugaaagagauaauaga

SEQ ID NO: 3274940 - RNA, 22 nt, Vaccinia virus
aguaaccccauauaauguagac

SEQ ID NO: 3274941 - RNA, 19 nt, Vaccinia virus
auaucuacugauaaaacug

SEQ ID NO: 3274942 - RNA, 15 nt, Vaccinia virus
caaccgaaaucaugg

SEQ ID NO: 3274943 - RNA, 13 nt, Vaccinia virus
aauauacaaguau

SEQ ID NO: 3274944 - RNA, 17 nt, Vaccinia virus
acuguuaucuaaugaau

SEQ ID NO: 3274945 - RNA, 16 nt, Vaccinia virus
auagcuagaggaaaug

SEQ ID NO: 3274946 - RNA, 17 nt, Vaccinia virus
uacaaauauguacauua

SEQ ID NO: 3274947 - RNA, 16 nt, Vaccinia virus
uauacacgcuaaaaua

SEQ ID NO: 3274948 - RNA, 17 nt, Vaccinia virus
auuaauaugcucaugaa

SEQ ID NO: 3274949 - RNA, 16 nt, Vaccinia virus
gauguuaaacaaauaa

SEQ ID NO: 3274950 - RNA, 16 nt, Vaccinia virus
uaauauaaaagaauau

SEQ ID NO: 3274951 - RNA, 15 nt, Vaccinia virus
uguaauuuuaacaua

SEQ ID NO: 3274952 - RNA, 18 nt, Vaccinia virus
acuccauccguaaaaaug

SEQ ID NO: 3274953 - RNA, 20 nt, Vaccinia virus
aucauaaaaguuguaaagua

SEQ ID NO: 3274954 - RNA, 14 nt, Vaccinia virus
guauuccuacuuuu

SEQ ID NO: 3274955 - RNA, 14 nt, Vaccinia virus
auucgauauuacga

SEQ ID NO: 3274956 - RNA, 15 nt, Vaccinia virus
ucugucagaaaauac

SEQ ID NO: 3274957 - RNA, 14 nt, Vaccinia virus
gauacucuauuaau

SEQ ID NO: 3274958 - RNA, 23 nt, Vaccinia virus
cuggaauuaguuagauauauaga

SEQ ID NO: 3274959 - RNA, 18 nt, Vaccinia virus
caauauauguaaucauug

SEQ ID NO: 3274960 - RNA, 22 nt, Vaccinia virus
auaaaugcgauacagacauuaa

SEQ ID NO: 3274961 - RNA, 14 nt, Vaccinia virus
auauaucugauagu

SEQ ID NO: 3274962 - RNA, 17 nt, Vaccinia virus
gaucuaguuacaacuau

SEQ ID NO: 3274963 - RNA, 22 nt, Vaccinia virus
uucacaagaugaauucaguaau

SEQ ID NO: 3274964 - RNA, 19 nt, Vaccinia virus
uaaaacugcauauuauaca

SEQ ID NO: 3274965 - RNA, 19 nt, Vaccinia virus
uauauaauccaucaacaau

SEQ ID NO: 3274966 - RNA, 19 nt, Vaccinia virus
uauuagcgaauauaucaaa

SEQ ID NO: 3274967 - RNA, 17 nt, Vaccinia virus
uugcguuucacaaacac

SEQ ID NO: 3274968 - RNA, 14 nt, Vaccinia virus
uuaucacaauauag

SEQ ID NO: 3274969 - RNA, 15 nt, Vaccinia virus
aaauauguacauuau

SEQ ID NO: 3274970 - RNA, 17 nt, Vaccinia virus
acaaaauucagauucua

SEQ ID NO: 3274971 - RNA, 15 nt, Vaccinia virus
auuaucgacauaggu

SEQ ID NO: 3274972 - RNA, 19 nt, Vaccinia virus
aucggccuucuuuuuuaca

SEQ ID NO: 3274973 - RNA, 22 nt, Vaccinia virus
auauauacucugagauaaaaca

SEQ ID NO: 3274974 - RNA, 14 nt, Vaccinia virus
augaucuggaucau

SEQ ID NO: 3274975 - RNA, 15 nt, Vaccinia virus
gacgcugucaguuau

SEQ ID NO: 3274976 - RNA, 18 nt, Vaccinia virus
uucaaaguuucugaaaua

SEQ ID NO: 3274977 - RNA, 17 nt, Vaccinia virus
uagucagaccauucuug

SEQ ID NO: 3274978 - RNA, 15 nt, Vaccinia virus
uggauuaucggaaau

SEQ ID NO: 3274979 - RNA, 21 nt, Vaccinia virus
uacguuagguauguaccacau

SEQ ID NO: 3274980 - RNA, 22 nt, Vaccinia virus
aauacgauccaagguuagagaa

SEQ ID NO: 3274981 - RNA, 19 nt, Vaccinia virus
cguagaaguuguaaaugac

SEQ ID NO: 3274982 - RNA, 16 nt, Vaccinia virus
auccgacuagaauuag

SEQ ID NO: 3274983 - RNA, 17 nt, Vaccinia virus
ccauuuuaacaguuucu

SEQ ID NO: 3274984 - RNA, 23 nt, Vaccinia virus
auaaccuucuaccgaacacuaac

SEQ ID NO: 3274985 - RNA, 21 nt, Vaccinia virus
ucuaaacauaagacuuauucu

SEQ ID NO: 3274986 - RNA, 12 nt, Vaccinia virus
aguuuaacuagu

SEQ ID NO: 3274987 - RNA, 19 nt, Vaccinia virus
caccauauagaucaaucau

SEQ ID NO: 3274988 - RNA, 17 nt, Vaccinia virus
cuucgauauuagauuuu

SEQ ID NO: 3274989 - RNA, 12 nt, Vaccinia virus
auuccauggaag

SEQ ID NO: 3274990 - RNA, 18 nt, Vaccinia virus
agaaagcgcguaauacua

SEQ ID NO: 3274991 - RNA, 13 nt, Vaccinia virus
cauaacguccaga

SEQ ID NO: 3274992 - RNA, 14 nt, Vaccinia virus
auaaaauaaaauga

SEQ ID NO: 3274993 - RNA, 22 nt, Vaccinia virus
auaugguuucuaaaucuaucaa

SEQ ID NO: 3274994 - RNA, 19 nt, Vaccinia virus
aaguucuggcaauguuuca

SEQ ID NO: 3274995 - RNA, 14 nt, Vaccinia virus
cgguuuuaacuuua

SEQ ID NO: 3274996 - RNA, 21 nt, Vaccinia virus
auuauuuuucaccauauagau

SEQ ID NO: 3274997 - RNA, 19 nt, Vaccinia virus
aucccauucuaauacuuua

SEQ ID NO: 3274998 - RNA, 18 nt, Vaccinia virus
agauaugauaaaacuauu

SEQ ID NO: 3274999 - RNA, 13 nt, Vaccinia virus
aagaaaacaaaca

SEQ ID NO: 3275000 - RNA, 19 nt, Vaccinia virus
ucauugauugagaagaagc

SEQ ID NO: 3275001 - RNA, 22 nt, Vaccinia virus
acauuagcagauuaguaugaag

SEQ ID NO: 3275002 - RNA, 17 nt, Vaccinia virus
ugcuguuccucuguaaa

SEQ ID NO: 3275003 - RNA, 21 nt, Vaccinia virus
acugauucuggacauagcuuu

SEQ ID NO: 3275004 - RNA, 22 nt, Vaccinia virus
uauggauuuggucauaauagaa

SEQ ID NO: 3275005 - RNA, 20 nt, Vaccinia virus
auguauaauaauaaacggaa

SEQ ID NO: 3275006 - RNA, 20 nt, Vaccinia virus
cuaaaauauuuuuauucuca

SEQ ID NO: 3275007 - RNA, 22 nt, Vaccinia virus
auauacguugauagauuagcug

SEQ ID NO: 3275008 - RNA, 16 nt, Vaccinia virus
uuuaauuuccuaguau

SEQ ID NO: 3275009 - RNA, 13 nt, Vaccinia virus
aucagagaacuuc

SEQ ID NO: 3275010 - RNA, 22 nt, Vaccinia virus
uuuaaugauacgauacuagauu

SEQ ID NO: 3275011 - RNA, 14 nt, Vaccinia virus
auuauauuuauuau

SEQ ID NO: 3275012 - RNA, 16 nt, Vaccinia virus
acucauuuaacagaug

SEQ ID NO: 3275013 - RNA, 16 nt, Vaccinia virus
acaauugucuguaaac

SEQ ID NO: 3275014 - RNA, 21 nt, Vaccinia virus
aguccauccgauuaugagaca

SEQ ID NO: 3275015 - RNA, 22 nt, Vaccinia virus
uaugaugaccggcgauaucaua

SEQ ID NO: 3275016 - RNA, 23 nt, Vaccinia virus
uccgacaucaaaugguacaaaaa

SEQ ID NO: 3275017 - RNA, 21 nt, Vaccinia virus
uuauauacgaaauauuauaca

SEQ ID NO: 3275018 - RNA, 14 nt, Vaccinia virus
acuaauguuaauug

SEQ ID NO: 3275019 - RNA, 18 nt, Vaccinia virus
auaacuucuagauguaga

SEQ ID NO: 3275020 - RNA, 18 nt, Vaccinia virus
ccaaaucuauauuguuua

SEQ ID NO: 3275021 - RNA, 16 nt, Vaccinia virus
uaaacaugaauuuauu

SEQ ID NO: 3275022 - RNA, 19 nt, Vaccinia virus
auuuuuauucagcauuacu

SEQ ID NO: 3275023 - RNA, 19 nt, Vaccinia virus
augcaucuauauaaucuuu

SEQ ID NO: 3275024 - RNA, 17 nt, Vaccinia virus
aauuucuuuauucucua

SEQ ID NO: 3275025 - RNA, 15 nt, Vaccinia virus
augaaauaaguauga

SEQ ID NO: 3275026 - RNA, 17 nt, Vaccinia virus
uaauacacacaaaguau

SEQ ID NO: 3275027 - RNA, 17 nt, Vaccinia virus
agauuuaucauauuucu

SEQ ID NO: 3275028 - RNA, 16 nt, Vaccinia virus
aacaccacgaacaugu

SEQ ID NO: 3275029 - RNA, 18 nt, Vaccinia virus
auugcacaauccaaacuu

SEQ ID NO: 3275030 - RNA, 15 nt, Vaccinia virus
gagauguuucauaau

SEQ ID NO: 3275031 - RNA, 17 nt, Vaccinia virus
aguagaaauuaucaaau

SEQ ID NO: 3275032 - RNA, 13 nt, Vaccinia virus
augauaucgagaa

SEQ ID NO: 3275033 - RNA, 23 nt, Vaccinia virus
aguagacauuaauagaaugaaga

SEQ ID NO: 3275034 - RNA, 23 nt, Vaccinia virus
auauagcaucgauccaugagaaa

SEQ ID NO: 3275035 - RNA, 19 nt, Vaccinia virus
gccuauaaaguaauaaucu

SEQ ID NO: 3275036 - RNA, 14 nt, Vaccinia virus
cauuuauagcauuu

SEQ ID NO: 3275037 - RNA, 22 nt, Vaccinia virus
agcauucuuuccagaacuauau

SEQ ID NO: 3275038 - RNA, 20 nt, Vaccinia virus
ugauuagaaaauauaaauua

SEQ ID NO: 3275039 - RNA, 17 nt, Vaccinia virus
auuccuccauaauugca

SEQ ID NO: 3275040 - RNA, 18 nt, Vaccinia virus
cauuauuuuuauauuuuc

SEQ ID NO: 3275041 - RNA, 21 nt, Vaccinia virus
aucaaaauagcaaaguaacga

SEQ ID NO: 3275042 - RNA, 20 nt, Vaccinia virus
uucagauauaaaaaucuguu

SEQ ID NO: 3275043 - RNA, 23 nt, Vaccinia virus
ggaaacaucucuucuaguuucac

SEQ ID NO: 3275044 - RNA, 19 nt, Vaccinia virus
aucuagauuccaaucauug

SEQ ID NO: 3275045 - RNA, 16 nt, Vaccinia virus
cuauaucuaacaucuu

SEQ ID NO: 3275046 - RNA, 17 nt, Vaccinia virus
uuaaucuuagaaaucaa

SEQ ID NO: 3275047 - RNA, 12 nt, Vaccinia virus
cugguaauuuaa

SEQ ID NO: 3275048 - RNA, 21 nt, Vaccinia virus
uggaaucaucuucugauucca

SEQ ID NO: 3275049 - RNA, 21 nt, Vaccinia virus
auauuaaaaaaugucacuauu

SEQ ID NO: 3275050 - RNA, 15 nt, Vaccinia virus
aauuucauccauuua

SEQ ID NO: 3275051 - RNA, 17 nt, Vaccinia virus
aucgcuuaauagacaaa

SEQ ID NO: 3275052 - RNA, 22 nt, Vaccinia virus
uuaaacgaauuaaaauuauuua

SEQ ID NO: 3275053 - RNA, 23 nt, Vaccinia virus
cgauaacauucuaggaauguugu

SEQ ID NO: 3275054 - RNA, 22 nt, Vaccinia virus
aaaauauggaauuguauuuucu

SEQ ID NO: 3275055 - RNA, 19 nt, Vaccinia virus
agacggauaagaaauauau

SEQ ID NO: 3275056 - RNA, 23 nt, Vaccinia virus
uaccaaacuuucagaagaaaugg

SEQ ID NO: 3275057 - RNA, 17 nt, Vaccinia virus
ucgcccaucucauacau

SEQ ID NO: 3275058 - RNA, 19 nt, Vaccinia virus
agggaaauuaaagaagaag

SEQ ID NO: 3275059 - RNA, 14 nt, Vaccinia virus
ucucuaucaaugau

SEQ ID NO: 3275060 - RNA, 16 nt, Vaccinia virus
guuccggaucuauaga

SEQ ID NO: 3275061 - RNA, 21 nt, Vaccinia virus
auaaucccauucuaauacuuu

SEQ ID NO: 3275062 - RNA, 20 nt, Vaccinia virus
gugauucucugaaaauguaa

SEQ ID NO: 3275063 - RNA, 15 nt, Vaccinia virus
uuaaucuauuagaau

SEQ ID NO: 3275064 - RNA, 14 nt, Vaccinia virus
cauuucuacaaaaa

SEQ ID NO: 3275065 - RNA, 19 nt, Vaccinia virus
gaauaaauuaucaacgaau

SEQ ID NO: 3275066 - RNA, 22 nt, Vaccinia virus
aguacuccucccauaauacuuu

SEQ ID NO: 3275067 - RNA, 16 nt, Vaccinia virus
ugaucuaacuaagaua

SEQ ID NO: 3275068 - RNA, 20 nt, Vaccinia virus
acgaugaugauuuaugaauu

SEQ ID NO: 3275069 - RNA, 12 nt, Vaccinia virus
gcaucuauuuua

SEQ ID NO: 3275070 - RNA, 11 nt, Vaccinia virus
cuuuguagaaa

SEQ ID NO: 3275071 - RNA, 21 nt, Vaccinia virus
agauuaaaauuaacaaaauua

SEQ ID NO: 3275072 - RNA, 23 nt, Vaccinia virus
cuaacauugauuuuaaaauuaaa

SEQ ID NO: 3275073 - RNA, 21 nt, Vaccinia virus
uacuguauguugcuacaugua

SEQ ID NO: 3275074 - RNA, 19 nt, Vaccinia virus
uguaacccacguaacauug

SEQ ID NO: 3275075 - RNA, 13 nt, Vaccinia virus
cucuaguuucaga

SEQ ID NO: 3275076 - RNA, 18 nt, Vaccinia virus
ccuacaggaauaucuuua

SEQ ID NO: 3275077 - RNA, 19 nt, Vaccinia virus
uauaaaaguaauaaaacaa

SEQ ID NO: 3275078 - RNA, 15 nt, Vaccinia virus
uugcauccggaugau

SEQ ID NO: 3275079 - RNA, 15 nt, Vaccinia virus
ucacaaauacuacaa

SEQ ID NO: 3275080 - RNA, 15 nt, Vaccinia virus
cgauuauuauaaaau

SEQ ID NO: 3275081 - RNA, 14 nt, Vaccinia virus
gaguuaucaagaga

SEQ ID NO: 3275082 - RNA, 17 nt, Vaccinia virus
uaaucguuauuaucauc

SEQ ID NO: 3275083 - RNA, 16 nt, Vaccinia virus
aaucauggacuuuaua

SEQ ID NO: 3275084 - RNA, 19 nt, Vaccinia virus
cuaaaaacuguaucgauuu

SEQ ID NO: 3275085 - RNA, 16 nt, Vaccinia virus
auccaccacagacuga

SEQ ID NO: 3275086 - RNA, 15 nt, Vaccinia virus
gcauuaaaugaugaa

SEQ ID NO: 3275087 - RNA, 18 nt, Vaccinia virus
ucauucaaauccauaaau

SEQ ID NO: 3275088 - RNA, 16 nt, Vaccinia virus
aaucuauuagaauugg

SEQ ID NO: 3275089 - RNA, 20 nt, Vaccinia virus
uauaaacauuuguguuugua

SEQ ID NO: 3275090 - RNA, 13 nt, Vaccinia virus
uucaacaaacuaa

SEQ ID NO: 3275091 - RNA, 21 nt, Vaccinia virus
agcuaugcgauuggauaagaa

SEQ ID NO: 3275092 - RNA, 18 nt, Vaccinia virus
aaugauaaugauacagua

SEQ ID NO: 3275093 - RNA, 15 nt, Vaccinia virus
aaucagaacuuccaa

SEQ ID NO: 3275094 - RNA, 17 nt, Vaccinia virus
auuuuuauaguuuuuac

SEQ ID NO: 3275095 - RNA, 17 nt, Vaccinia virus
auauuccaagaucaaaa

SEQ ID NO: 3275096 - RNA, 17 nt, Vaccinia virus
auuaauagauauaucuc

SEQ ID NO: 3275097 - RNA, 22 nt, Vaccinia virus
acuaucugauaagauaucuucu

SEQ ID NO: 3275098 - RNA, 12 nt, Vaccinia virus
uuaaaauuauuu

SEQ ID NO: 3275099 - RNA, 17 nt, Vaccinia virus
agacuacaauauauucu

SEQ ID NO: 3275100 - RNA, 18 nt, Vaccinia virus
gaaaaaguaaaugaugaa

SEQ ID NO: 3275101 - RNA, 14 nt, Vaccinia virus
aauaauguuauuau

SEQ ID NO: 3275102 - RNA, 16 nt, Vaccinia virus
augaaaccauacuaau

SEQ ID NO: 3275103 - RNA, 22 nt, Vaccinia virus
aaaacauauaaaucuaaaauug

SEQ ID NO: 3275104 - RNA, 21 nt, Vaccinia virus
cgaggagauuuagaaauguug

SEQ ID NO: 3275105 - RNA, 14 nt, Vaccinia virus
auauaguuaauagu

SEQ ID NO: 3275106 - RNA, 17 nt, Vaccinia virus
cauguuuuaaugcauuc

SEQ ID NO: 3275107 - RNA, 14 nt, Vaccinia virus
uagauaaacgugau

SEQ ID NO: 3275108 - RNA, 16 nt, Vaccinia virus
aguuuggauuaucgua

SEQ ID NO: 3275109 - RNA, 18 nt, Vaccinia virus
caucagaaaugacuccau

SEQ ID NO: 3275110 - RNA, 18 nt, Vaccinia virus
aaaagaacuaacguccau

SEQ ID NO: 3275111 - RNA, 12 nt, Vaccinia virus
aucaaucauauu

SEQ ID NO: 3275112 - RNA, 20 nt, Vaccinia virus
gcuauccaucagaauguuuc

SEQ ID NO: 3275113 - RNA, 21 nt, Vaccinia virus
agccaagacgaacaaaaucaa

SEQ ID NO: 3275114 - RNA, 19 nt, Vaccinia virus
ugauugauuauuucaaaga

SEQ ID NO: 3275115 - RNA, 17 nt, Vaccinia virus
auuauuaaauuaugaag

SEQ ID NO: 3275116 - RNA, 17 nt, Vaccinia virus
uaacagaaaaaacaaug

SEQ ID NO: 3275117 - RNA, 20 nt, Vaccinia virus
uaaaugauuucgaucugucu

SEQ ID NO: 3275118 - RNA, 16 nt, Vaccinia virus
caaagaauuaaugaua

SEQ ID NO: 3275119 - RNA, 14 nt, Vaccinia virus
aauucguuagcaaa

SEQ ID NO: 3275120 - RNA, 22 nt, Vaccinia virus
uagcagcugauacgucauuaac

SEQ ID NO: 3275121 - RNA, 17 nt, Vaccinia virus
cacagauagaucauuuu

SEQ ID NO: 3275122 - RNA, 18 nt, Vaccinia virus
ugcgcuacauuguuacgu

SEQ ID NO: 3275123 - RNA, 18 nt, Vaccinia virus
ucucuauugccaaauuuu

SEQ ID NO: 3275124 - RNA, 19 nt, Vaccinia virus
cuauuuuuuuauacuucua

SEQ ID NO: 3275125 - RNA, 22 nt, Vaccinia virus
cauauaguauucuuguauucua

SEQ ID NO: 3275126 - RNA, 22 nt, Vaccinia virus
aaucauuaaaaaaauuaacuga

SEQ ID NO: 3275127 - RNA, 23 nt, Vaccinia virus
guuaaaugguucgauauaaagga

SEQ ID NO: 3275128 - RNA, 20 nt, Vaccinia virus
uaaacuauacuaugaugucu

SEQ ID NO: 3275129 - RNA, 12 nt, Vaccinia virus
uauuaagcaaua

SEQ ID NO: 3275130 - RNA, 16 nt, Vaccinia virus
uuaaaaugauuauucc

SEQ ID NO: 3275131 - RNA, 14 nt, Vaccinia virus
acuugauaauuaau

SEQ ID NO: 3275132 - RNA, 17 nt, Vaccinia virus
auauacacauuuaauaa

SEQ ID NO: 3275133 - RNA, 15 nt, Vaccinia virus
auagaugaaauacuc

SEQ ID NO: 3275134 - RNA, 13 nt, Vaccinia virus
uucacucauauga

SEQ ID NO: 3275135 - RNA, 22 nt, Vaccinia virus
agcaauuagugccguauacuuu

SEQ ID NO: 3275136 - RNA, 23 nt, Vaccinia virus
gacggcuacucuaacucguacuc

SEQ ID NO: 3275137 - RNA, 14 nt, Vaccinia virus
gaaagauguuauuu

SEQ ID NO: 3275138 - RNA, 21 nt, Vaccinia virus
uaaacaaacuaauaaacauuc

SEQ ID NO: 3275139 - RNA, 19 nt, Vaccinia virus
auaauacggacuucauaau

SEQ ID NO: 3275140 - RNA, 21 nt, Vaccinia virus
ucaauaagaugcaucgugaaa

SEQ ID NO: 3275141 - RNA, 12 nt, Vaccinia virus
auccaaacauua

SEQ ID NO: 3275142 - RNA, 14 nt, Vaccinia virus
aaagugaaaaucua

SEQ ID NO: 3275143 - RNA, 14 nt, Vaccinia virus
ucguccuuaaccaa

SEQ ID NO: 3275144 - RNA, 14 nt, Vaccinia virus
aggaacauaaacaa

SEQ ID NO: 3275145 - RNA, 14 nt, Vaccinia virus
cgauucaacaaaac

SEQ ID NO: 3275146 - RNA, 19 nt, Vaccinia virus
ucuucucuaagagcuacgu

SEQ ID NO: 3275147 - RNA, 23 nt, Vaccinia virus
aguuaaaauaucaugguuaucca

SEQ ID NO: 3275148 - RNA, 12 nt, Vaccinia virus
uaacuaaauguc

SEQ ID NO: 3275149 - RNA, 12 nt, Vaccinia virus
gguaaauguuuu

SEQ ID NO: 3275150 - RNA, 15 nt, Vaccinia virus
aauuacacuauuugu

SEQ ID NO: 3275151 - RNA, 14 nt, Vaccinia virus
cuucuuuuuuccaa

SEQ ID NO: 3275152 - RNA, 18 nt, Vaccinia virus
aggaauaaaauaugaaau

SEQ ID NO: 3275153 - RNA, 16 nt, Vaccinia virus
aaguacuauugucuaa

SEQ ID NO: 3275154 - RNA, 15 nt, Vaccinia virus
ucacguaaauacaaa

SEQ ID NO: 3275155 - RNA, 17 nt, Vaccinia virus
aguuucuagauacuaga

SEQ ID NO: 3275156 - RNA, 15 nt, Vaccinia virus
acuagaguuguuaaa

SEQ ID NO: 3275157 - RNA, 20 nt, Vaccinia virus
ucugauuagaagccacuaua

SEQ ID NO: 3275158 - RNA, 17 nt, Vaccinia virus
uggucauaauagaaugu

SEQ ID NO: 3275159 - RNA, 18 nt, Vaccinia virus
uacaacagugauaugugu

SEQ ID NO: 3275160 - RNA, 14 nt, Vaccinia virus
agaacaauaucucg

SEQ ID NO: 3275161 - RNA, 16 nt, Vaccinia virus
auaucuacuagaaaga

SEQ ID NO: 3275162 - RNA, 12 nt, Vaccinia virus
aagcaaaugaug

SEQ ID NO: 3275163 - RNA, 19 nt, Vaccinia virus
auuuugcaauuucuucaua

SEQ ID NO: 3275164 - RNA, 19 nt, Vaccinia virus
uucacuauaucuaagaaac

SEQ ID NO: 3275165 - RNA, 16 nt, Vaccinia virus
uuucguugguagauau

SEQ ID NO: 3275166 - RNA, 23 nt, Vaccinia virus
uagaggaaguauaaaaauuaaac

SEQ ID NO: 3275167 - RNA, 17 nt, Vaccinia virus
uauuaacuaucuguaaa

SEQ ID NO: 3275168 - RNA, 19 nt, Vaccinia virus
cugggccauguagaauaaa

SEQ ID NO: 3275169 - RNA, 17 nt, Vaccinia virus
aagauaugcuacaagau

SEQ ID NO: 3275170 - RNA, 20 nt, Vaccinia virus
agauauuauuaaaucaugac

SEQ ID NO: 3275171 - RNA, 16 nt, Vaccinia virus
auacauuugaguuacu

SEQ ID NO: 3275172 - RNA, 18 nt, Vaccinia virus
uuaauaggcaucauuuau

SEQ ID NO: 3275173 - RNA, 15 nt, Vaccinia virus
uagugaaacaaaaua

SEQ ID NO: 3275174 - RNA, 21 nt, Vaccinia virus
aucaguacguucuucauuuau

SEQ ID NO: 3275175 - RNA, 21 nt, Vaccinia virus
cuguuguuuauucaacaugua

SEQ ID NO: 3275176 - RNA, 14 nt, Vaccinia virus
ugaauacauuauca

SEQ ID NO: 3275177 - RNA, 14 nt, Vaccinia virus
gaauugacaaauaa

SEQ ID NO: 3275178 - RNA, 24 nt, Vaccinia virus
uuuauaaagaaauacauaucgcac

SEQ ID NO: 3275179 - RNA, 13 nt, Vaccinia virus
uuguauuauucug

SEQ ID NO: 3275180 - RNA, 15 nt, Vaccinia virus
gauuauuuuuauuau

SEQ ID NO: 3275181 - RNA, 21 nt, Vaccinia virus
uguuuuuaagcuguucaaaau

SEQ ID NO: 3275182 - RNA, 20 nt, Vaccinia virus
uaaguuuauaaauuccacaa

SEQ ID NO: 3275183 - RNA, 20 nt, Vaccinia virus
uacuuagucuguacaaaagu

SEQ ID NO: 3275184 - RNA, 17 nt, Vaccinia virus
uauauuaaaaaauguca

SEQ ID NO: 3275185 - RNA, 19 nt, Vaccinia virus
caacagaacagauaguuua

SEQ ID NO: 3275186 - RNA, 21 nt, Vaccinia virus
guucacaaaaauacauaaaga

SEQ ID NO: 3275187 - RNA, 22 nt, Vaccinia virus
aaauauauuuacaauuauugga

SEQ ID NO: 3275188 - RNA, 17 nt, Vaccinia virus
aaguuauagacaaauua

SEQ ID NO: 3275189 - RNA, 19 nt, Vaccinia virus
acugccgaguuuaaaacuu

SEQ ID NO: 3275190 - RNA, 20 nt, Vaccinia virus
cuuaugauauucauucuuua

SEQ ID NO: 3275191 - RNA, 17 nt, Vaccinia virus
auuuuauuucaaaauua

SEQ ID NO: 3275192 - RNA, 17 nt, Vaccinia virus
aaaaauacuuaaaaugu

SEQ ID NO: 3275193 - RNA, 23 nt, Vaccinia virus
aacaaaaucuaacagauacaaau

SEQ ID NO: 3275194 - RNA, 20 nt, Vaccinia virus
aauacaaggcacuaugucca

SEQ ID NO: 3275195 - RNA, 17 nt, Vaccinia virus
aauuucugguuagauaa

SEQ ID NO: 3275196 - RNA, 16 nt, Vaccinia virus
uaaugaacgaauuaug

SEQ ID NO: 3275197 - RNA, 21 nt, Vaccinia virus
uuuaucuuucccccuagauac

SEQ ID NO: 3275198 - RNA, 19 nt, Vaccinia virus
auuugggccauuauaccuc

SEQ ID NO: 3275199 - RNA, 13 nt, Vaccinia virus
uuuuuaguaugac

SEQ ID NO: 3275200 - RNA, 22 nt, Vaccinia virus
gacuuuaucuaaauuucuagua

SEQ ID NO: 3275201 - RNA, 19 nt, Vaccinia virus
caaaauauguuucaaucau

SEQ ID NO: 3275202 - RNA, 18 nt, Vaccinia virus
agcaucauaaaaaugagu

SEQ ID NO: 3275203 - RNA, 17 nt, Vaccinia virus
uuaauauguaugauuca

SEQ ID NO: 3275204 - RNA, 23 nt, Vaccinia virus
auguuuacugcugcguuaaacau

SEQ ID NO: 3275205 - RNA, 19 nt, Vaccinia virus
augugagagagaaauacuu

SEQ ID NO: 3275206 - RNA, 22 nt, Vaccinia virus
cagauaaucugaaaaugaaauu

SEQ ID NO: 3275207 - RNA, 21 nt, Vaccinia virus
ugucuacaaccgcuacauaau

SEQ ID NO: 3275208 - RNA, 22 nt, Vaccinia virus
guaaacauuaugccguuaucau

SEQ ID NO: 3275209 - RNA, 18 nt, Vaccinia virus
ugguuccacaauucauuu

SEQ ID NO: 3275210 - RNA, 16 nt, Vaccinia virus
aaugcuuuagugaaau

SEQ ID NO: 3275211 - RNA, 17 nt, Vaccinia virus
augagaaacuuaaagua

SEQ ID NO: 3275212 - RNA, 20 nt, Vaccinia virus
gaaauguugggauauugcau

SEQ ID NO: 3275213 - RNA, 22 nt, Vaccinia virus
caugucugauauuuugauguau

SEQ ID NO: 3275214 - RNA, 18 nt, Vaccinia virus
aaguucuggcaauguuuc

SEQ ID NO: 3275215 - RNA, 18 nt, Vaccinia virus
cuagaucuauagaaucaa

SEQ ID NO: 3275216 - RNA, 16 nt, Vaccinia virus
uuuguaauugugacau

SEQ ID NO: 3275217 - RNA, 18 nt, Vaccinia virus
augaauggauacuuguau

SEQ ID NO: 3275218 - RNA, 15 nt, Vaccinia virus
cuguuucuacuaacu

SEQ ID NO: 3275219 - RNA, 21 nt, Vaccinia virus
aggcuucucaucucuuucaga

SEQ ID NO: 3275220 - RNA, 13 nt, Vaccinia virus
uugcgacacuauu

SEQ ID NO: 3275221 - RNA, 13 nt, Vaccinia virus
ugauucuacagua

SEQ ID NO: 3275222 - RNA, 17 nt, Vaccinia virus
aacuucgugaauaaugu

SEQ ID NO: 3275223 - RNA, 17 nt, Vaccinia virus
uuugauauuacuaaaca

SEQ ID NO: 3275224 - RNA, 21 nt, Vaccinia virus
aaacuaucuuuuuaggaaugu

SEQ ID NO: 3275225 - RNA, 21 nt, Vaccinia virus
uauucguuguauucauucuaa

SEQ ID NO: 3275226 - RNA, 17 nt, Vaccinia virus
auaugcaaagucuaaau

SEQ ID NO: 3275227 - RNA, 16 nt, Vaccinia virus
agauaaugcuaaugua

SEQ ID NO: 3275228 - RNA, 18 nt, Vaccinia virus
cuuucuagaauaaguuuc

SEQ ID NO: 3275229 - RNA, 19 nt, Vaccinia virus
agauguuuagaaaauggau

SEQ ID NO: 3275230 - RNA, 16 nt, Vaccinia virus
auaaaauguuaauaca

SEQ ID NO: 3275231 - RNA, 16 nt, Vaccinia virus
uauauaauaaauacuu

SEQ ID NO: 3275232 - RNA, 13 nt, Vaccinia virus
cugaaguuucaua

SEQ ID NO: 3275233 - RNA, 16 nt, Vaccinia virus
aauaauucauggaaau

SEQ ID NO: 3275234 - RNA, 18 nt, Vaccinia virus
uauacuccgguugaugau

SEQ ID NO: 3275235 - RNA, 14 nt, Vaccinia virus
aguacuuucgcaag

SEQ ID NO: 3275236 - RNA, 19 nt, Vaccinia virus
uuauacagaagauuuaacu

SEQ ID NO: 3275237 - RNA, 18 nt, Vaccinia virus
cauccucgacugaugugg

SEQ ID NO: 3275238 - RNA, 21 nt, Vaccinia virus
caaaaaaaugugcacaguuuc

SEQ ID NO: 3275239 - RNA, 18 nt, Vaccinia virus
ucagaaaacccaaacacu

SEQ ID NO: 3275240 - RNA, 17 nt, Vaccinia virus
aaauaucauuaauauau

SEQ ID NO: 3275241 - RNA, 16 nt, Vaccinia virus
aauuaaauaguuuauu

SEQ ID NO: 3275242 - RNA, 20 nt, Vaccinia virus
acuaucaaccgcauaauaca

SEQ ID NO: 3275243 - RNA, 20 nt, Vaccinia virus
gauacagauuaauuuccaca

SEQ ID NO: 3275244 - RNA, 14 nt, Vaccinia virus
aaauuaauuauugu

SEQ ID NO: 3275245 - RNA, 13 nt, Vaccinia virus
aacauaugauauu

SEQ ID NO: 3275246 - RNA, 18 nt, Vaccinia virus
gaugucguuauucugaaa

SEQ ID NO: 3275247 - RNA, 23 nt, Vaccinia virus
aucugagauucuauaaucgcuuu

SEQ ID NO: 3275248 - RNA, 24 nt, Vaccinia virus
uaauaccaauugcggacuuacuau

SEQ ID NO: 3275249 - RNA, 11 nt, Vaccinia virus
aaaccaaaucu

SEQ ID NO: 3275250 - RNA, 17 nt, Vaccinia virus
uauacgaauguaucaaa

SEQ ID NO: 3275251 - RNA, 15 nt, Vaccinia virus
uaauccuguguuuau

SEQ ID NO: 3275252 - RNA, 13 nt, Vaccinia virus
auguauacuguau

SEQ ID NO: 3275253 - RNA, 15 nt, Vaccinia virus
auuuacgcgcacaca

SEQ ID NO: 3275254 - RNA, 18 nt, Vaccinia virus
agaaucaguuacauguuu

SEQ ID NO: 3275255 - RNA, 20 nt, Vaccinia virus
aacauccauuuauagaauuu

SEQ ID NO: 3275256 - RNA, 13 nt, Vaccinia virus
auuauuuaaugag

SEQ ID NO: 3275257 - RNA, 22 nt, Vaccinia virus
guauuuuuguuagaguauauaa

SEQ ID NO: 3275258 - RNA, 22 nt, Vaccinia virus
aagagauaaaagcauuuuaacu

SEQ ID NO: 3275259 - RNA, 13 nt, Vaccinia virus
aacucaaucccaa

SEQ ID NO: 3275260 - RNA, 22 nt, Vaccinia virus
gccugaguaguuggaagaaucu

SEQ ID NO: 3275261 - RNA, 20 nt, Vaccinia virus
caugugaauauaauaauaca

SEQ ID NO: 3275262 - RNA, 17 nt, Vaccinia virus
cuagaauuagaauuaca

SEQ ID NO: 3275263 - RNA, 17 nt, Vaccinia virus
aaacuucucuaaaugag

SEQ ID NO: 3275264 - RNA, 22 nt, Vaccinia virus
gcaauaauggaaucuagaucua

SEQ ID NO: 3275265 - RNA, 19 nt, Vaccinia virus
gauugugcaucuacugaua

SEQ ID NO: 3275266 - RNA, 15 nt, Vaccinia virus
gaucgucacaaugau

SEQ ID NO: 3275267 - RNA, 15 nt, Vaccinia virus
auaacuuacuuucca

SEQ ID NO: 3275268 - RNA, 14 nt, Vaccinia virus
uuguaguuaaaaac

SEQ ID NO: 3275269 - RNA, 18 nt, Vaccinia virus
cauggugauuuauggaua

SEQ ID NO: 3275270 - RNA, 18 nt, Vaccinia virus
auuauucauuuucuauuu

SEQ ID NO: 3275271 - RNA, 13 nt, Vaccinia virus
auucauuuucuau

SEQ ID NO: 3275272 - RNA, 16 nt, Vaccinia virus
auaauccagaauguac

SEQ ID NO: 3275273 - RNA, 18 nt, Vaccinia virus
caaucauugauaucuuua

SEQ ID NO: 3275274 - RNA, 15 nt, Vaccinia virus
agauaccaaacagaa

SEQ ID NO: 3275275 - RNA, 21 nt, Vaccinia virus
agcacucguuauuaauacaag

SEQ ID NO: 3275276 - RNA, 15 nt, Vaccinia virus
guaauuaauuaugau

SEQ ID NO: 3275277 - RNA, 18 nt, Vaccinia virus
acguaaugaaguuaauga

SEQ ID NO: 3275278 - RNA, 21 nt, Vaccinia virus
uaagaggcauaaucaauguug

SEQ ID NO: 3275279 - RNA, 14 nt, Vaccinia virus
uuaacaucacuaau

SEQ ID NO: 3275280 - RNA, 13 nt, Vaccinia virus
aaaacuacuacaa

SEQ ID NO: 3275281 - RNA, 12 nt, Vaccinia virus
uaaaacauaaag

SEQ ID NO: 3275282 - RNA, 15 nt, Vaccinia virus
uaacauuuauuauca

SEQ ID NO: 3275283 - RNA, 18 nt, Vaccinia virus
uacuaauuacaaaccugu

SEQ ID NO: 3275284 - RNA, 17 nt, Vaccinia virus
acuuuuauaauuauaga

SEQ ID NO: 3275285 - RNA, 17 nt, Vaccinia virus
uuguucuacacauguau

SEQ ID NO: 3275286 - RNA, 17 nt, Vaccinia virus
uggcauaggaacauuuc

SEQ ID NO: 3275287 - RNA, 17 nt, Vaccinia virus
aucuuucuccaauacua

SEQ ID NO: 3275288 - RNA, 14 nt, Vaccinia virus
aauaguguucuaaa

SEQ ID NO: 3275289 - RNA, 15 nt, Vaccinia virus
agugacaaaaugcua

SEQ ID NO: 3275290 - RNA, 14 nt, Vaccinia virus
auacauuaaguaaa

SEQ ID NO: 3275291 - RNA, 17 nt, Vaccinia virus
aacuauauaauucuauu

SEQ ID NO: 3275292 - RNA, 13 nt, Vaccinia virus
uauugagauuucu

SEQ ID NO: 3275293 - RNA, 20 nt, Vaccinia virus
gacauuauguuguuaaaaua

SEQ ID NO: 3275294 - RNA, 20 nt, Vaccinia virus
aacuucuggaaguuccaaac

SEQ ID NO: 3275295 - RNA, 18 nt, Vaccinia virus
accacacgacaaugaaca

SEQ ID NO: 3275296 - RNA, 13 nt, Vaccinia virus
ugaaacuaucuuu

SEQ ID NO: 3275297 - RNA, 18 nt, Vaccinia virus
cucaccauuucgacaucu

SEQ ID NO: 3275298 - RNA, 20 nt, Vaccinia virus
auauaccacuuaaugacaaa

SEQ ID NO: 3275299 - RNA, 18 nt, Vaccinia virus
acuauuccguaucuaucu

SEQ ID NO: 3275300 - RNA, 20 nt, Vaccinia virus
uccagauacagugauuuugg

SEQ ID NO: 3275301 - RNA, 18 nt, Vaccinia virus
uaucauaaauaaauaaug

SEQ ID NO: 3275302 - RNA, 15 nt, Vaccinia virus
gauauuagaacugcu

SEQ ID NO: 3275303 - RNA, 23 nt, Vaccinia virus
uuaaucauauacaacucuuuaau

SEQ ID NO: 3275304 - RNA, 17 nt, Vaccinia virus
gauucaacaaaacucaa

SEQ ID NO: 3275305 - RNA, 16 nt, Vaccinia virus
uagauaccguaguaua

SEQ ID NO: 3275306 - RNA, 13 nt, Vaccinia virus
cuaaaguauuucu

SEQ ID NO: 3275307 - RNA, 13 nt, Vaccinia virus
guguauucaucgu

SEQ ID NO: 3275308 - RNA, 13 nt, Vaccinia virus
gccacaaaugaaa

SEQ ID NO: 3275309 - RNA, 14 nt, Vaccinia virus
auuucuuacauaaa

SEQ ID NO: 3275310 - RNA, 14 nt, Vaccinia virus
auauucuaugacug

SEQ ID NO: 3275311 - RNA, 16 nt, Vaccinia virus
acuuuaaacagaaaua

SEQ ID NO: 3275312 - RNA, 23 nt, Vaccinia virus
uuuacccgccuucgaauaaauaa

SEQ ID NO: 3275313 - RNA, 13 nt, Vaccinia virus
aauauuaaaacua

SEQ ID NO: 3275314 - RNA, 12 nt, Vaccinia virus
aaacuaguagaa

SEQ ID NO: 3275315 - RNA, 15 nt, Vaccinia virus
auccaucaaaaaaca

SEQ ID NO: 3275316 - RNA, 14 nt, Vaccinia virus
agauguaaaaaaug

SEQ ID NO: 3275317 - RNA, 18 nt, Vaccinia virus
acuccgguugaugaugau

SEQ ID NO: 3275318 - RNA, 14 nt, Vaccinia virus
ucguauacuagaaa

SEQ ID NO: 3275319 - RNA, 21 nt, Vaccinia virus
agucaauugguagaguuuuau

SEQ ID NO: 3275320 - RNA, 19 nt, Vaccinia virus
aauccaaauaaaauggaua

SEQ ID NO: 3275321 - RNA, 14 nt, Vaccinia virus
accagcuccaugac

SEQ ID NO: 3275322 - RNA, 23 nt, Vaccinia virus
ugauuaacagaaaaaacaauguu

SEQ ID NO: 3275323 - RNA, 17 nt, Vaccinia virus
auuuuggcguuaucauu

SEQ ID NO: 3275324 - RNA, 16 nt, Vaccinia virus
uacacguaccagcauu

SEQ ID NO: 3275325 - RNA, 22 nt, Vaccinia virus
ccaugcaaacuaucuaaaugua

SEQ ID NO: 3275326 - RNA, 20 nt, Vaccinia virus
gcuauaauccgauauaugau

SEQ ID NO: 3275327 - RNA, 16 nt, Vaccinia virus
guuuucauacauaugg

SEQ ID NO: 3275328 - RNA, 16 nt, Vaccinia virus
caaacauucuuucaaa

SEQ ID NO: 3275329 - RNA, 18 nt, Vaccinia virus
auguagauaaaaaagaua

SEQ ID NO: 3275330 - RNA, 21 nt, Vaccinia virus
aauuauuccuaauuaagaaaa

SEQ ID NO: 3275331 - RNA, 21 nt, Vaccinia virus
uaccuagaacgaugucaaaau

SEQ ID NO: 3275332 - RNA, 16 nt, Vaccinia virus
aaacugcugugaauac

SEQ ID NO: 3275333 - RNA, 16 nt, Vaccinia virus
uuuaucgcacagauau

SEQ ID NO: 3275334 - RNA, 17 nt, Vaccinia virus
gaauacgcauguuuuaa

SEQ ID NO: 3275335 - RNA, 16 nt, Vaccinia virus
ugacgacgaugauuga

SEQ ID NO: 3275336 - RNA, 20 nt, Vaccinia virus
auaacgauggcaagaaaugg

SEQ ID NO: 3275337 - RNA, 19 nt, Vaccinia virus
agcugugaguauuaaugau

SEQ ID NO: 3275338 - RNA, 16 nt, Vaccinia virus
uauuuuaauacaugua

SEQ ID NO: 3275339 - RNA, 19 nt, Vaccinia virus
aucugaucuguucauauac

SEQ ID NO: 3275340 - RNA, 14 nt, Vaccinia virus
aaugauacagaaaa

SEQ ID NO: 3275341 - RNA, 22 nt, Vaccinia virus
caacaaacgaguuuauuaguuu

SEQ ID NO: 3275342 - RNA, 13 nt, Vaccinia virus
uuuuauacuucua

SEQ ID NO: 3275343 - RNA, 22 nt, Vaccinia virus
aguaggguuauuaacacuaaaa

SEQ ID NO: 3275344 - RNA, 18 nt, Vaccinia virus
uuaauauauuuaaacuag

SEQ ID NO: 3275345 - RNA, 23 nt, Vaccinia virus
gaauuauaccgauagauaauggu

SEQ ID NO: 3275346 - RNA, 19 nt, Vaccinia virus
aaaacugguuaaaacagua

SEQ ID NO: 3275347 - RNA, 17 nt, Vaccinia virus
uagugcgccuaaaucaa

SEQ ID NO: 3275348 - RNA, 14 nt, Vaccinia virus
agcaucuaguugau

SEQ ID NO: 3275349 - RNA, 16 nt, Vaccinia virus
uguagguaguaguaca

SEQ ID NO: 3275350 - RNA, 19 nt, Vaccinia virus
guugaugugacuguuuucu

SEQ ID NO: 3275351 - RNA, 15 nt, Vaccinia virus
uaauggaguuguaaa

SEQ ID NO: 3275352 - RNA, 15 nt, Vaccinia virus
auaauacuaucugga

SEQ ID NO: 3275353 - RNA, 14 nt, Vaccinia virus
uagauuguuuucag

SEQ ID NO: 3275354 - RNA, 13 nt, Vaccinia virus
uuauauaauguau

SEQ ID NO: 3275355 - RNA, 18 nt, Vaccinia virus
caucugucauauuuagau

SEQ ID NO: 3275356 - RNA, 15 nt, Vaccinia virus
cugccgaauuuagag

SEQ ID NO: 3275357 - RNA, 16 nt, Vaccinia virus
uauauuugcaacaauu

SEQ ID NO: 3275358 - RNA, 15 nt, Vaccinia virus
agaugauacaaauaa

SEQ ID NO: 3275359 - RNA, 16 nt, Vaccinia virus
uuacagauauuuucca

SEQ ID NO: 3275360 - RNA, 14 nt, Vaccinia virus
aauuaagauauugu

SEQ ID NO: 3275361 - RNA, 17 nt, Vaccinia virus
gauuaauuuuuuuucau

SEQ ID NO: 3275362 - RNA, 17 nt, Vaccinia virus
guauguauuacgaagaa

SEQ ID NO: 3275363 - RNA, 18 nt, Vaccinia virus
uuagucauugcaauauag

SEQ ID NO: 3275364 - RNA, 19 nt, Vaccinia virus
auaaagaccgaauacauaa

SEQ ID NO: 3275365 - RNA, 22 nt, Vaccinia virus
aguguacgaagcgguuuuacga

SEQ ID NO: 3275366 - RNA, 19 nt, Vaccinia virus
uaacuugaugucaggaacu

SEQ ID NO: 3275367 - RNA, 16 nt, Vaccinia virus
aauuaauuaauguuuu

SEQ ID NO: 3275368 - RNA, 13 nt, Vaccinia virus
auuacaaaaacua

SEQ ID NO: 3275369 - RNA, 12 nt, Vaccinia virus
aagaauggauga

SEQ ID NO: 3275370 - RNA, 14 nt, Vaccinia virus
ucuuucauuucagu

SEQ ID NO: 3275371 - RNA, 17 nt, Vaccinia virus
uauaaaucauauuuaga

SEQ ID NO: 3275372 - RNA, 15 nt, Vaccinia virus
caaauaaaauggaua

SEQ ID NO: 3275373 - RNA, 19 nt, Vaccinia virus
aauucaucguuacggagau

SEQ ID NO: 3275374 - RNA, 21 nt, Vaccinia virus
aacguuucccaaugaaauggu

SEQ ID NO: 3275375 - RNA, 14 nt, Vaccinia virus
aagaaauauuucca

SEQ ID NO: 3275376 - RNA, 22 nt, Vaccinia virus
uauacaugauaccguuuagcau

SEQ ID NO: 3275377 - RNA, 15 nt, Vaccinia virus
uaaaucguauauguu

SEQ ID NO: 3275378 - RNA, 17 nt, Vaccinia virus
cuaucagaguccaugua

SEQ ID NO: 3275379 - RNA, 19 nt, Vaccinia virus
aauucuuggauauaugaua

SEQ ID NO: 3275380 - RNA, 18 nt, Vaccinia virus
acacuuuggauacaaaau

SEQ ID NO: 3275381 - RNA, 16 nt, Vaccinia virus
gcaaaauaguaaugau

SEQ ID NO: 3275382 - RNA, 20 nt, Vaccinia virus
ugaucaugugagaauacuaa

SEQ ID NO: 3275383 - RNA, 21 nt, Vaccinia virus
uauggguccaucuaugagaaa

SEQ ID NO: 3275384 - RNA, 16 nt, Vaccinia virus
cuagacuauauuauca

SEQ ID NO: 3275385 - RNA, 14 nt, Vaccinia virus
auuucacguucagc

SEQ ID NO: 3275386 - RNA, 20 nt, Vaccinia virus
cauuuaugagugauaaguaa

SEQ ID NO: 3275387 - RNA, 21 nt, Vaccinia virus
uucuacaucuuccuucuuauu

SEQ ID NO: 3275388 - RNA, 14 nt, Vaccinia virus
gaaauaaaucagac

SEQ ID NO: 3275389 - RNA, 18 nt, Vaccinia virus
auauauguucgcuauugu

SEQ ID NO: 3275390 - RNA, 23 nt, Vaccinia virus
aauacugaucuucuuuugucgua

SEQ ID NO: 3275391 - RNA, 16 nt, Vaccinia virus
agaaugcauacugucu

SEQ ID NO: 3275392 - RNA, 14 nt, Vaccinia virus
aucauccauguacu

SEQ ID NO: 3275393 - RNA, 20 nt, Vaccinia virus
auuauguuuuaugaauagau

SEQ ID NO: 3275394 - RNA, 21 nt, Vaccinia virus
aauuaaaaccaaguacuacaa

SEQ ID NO: 3275395 - RNA, 12 nt, Vaccinia virus
aucauuucacaa

SEQ ID NO: 3275396 - RNA, 20 nt, Vaccinia virus
augcguccauguugucuauu

SEQ ID NO: 3275397 - RNA, 15 nt, Vaccinia virus
acuuaguacuaauaa

SEQ ID NO: 3275398 - RNA, 21 nt, Vaccinia virus
uguccagcguguccccaggac

SEQ ID NO: 3275399 - RNA, 21 nt, Vaccinia virus
guguacguauauuuagauguu

SEQ ID NO: 3275400 - RNA, 22 nt, Vaccinia virus
uaaacgacuauaaaauuauuga

SEQ ID NO: 3275401 - RNA, 19 nt, Vaccinia virus
auuagacguagcuuaucau

SEQ ID NO: 3275402 - RNA, 18 nt, Vaccinia virus
auuuuccauuauuaauaa

SEQ ID NO: 3275403 - RNA, 23 nt, Vaccinia virus
uuacacacuuuguccguaaaaca

SEQ ID NO: 3275404 - RNA, 14 nt, Vaccinia virus
aagauaauuaucca

SEQ ID NO: 3275405 - RNA, 20 nt, Vaccinia virus
uuaagcaacaugucucuaaa

SEQ ID NO: 3275406 - RNA, 19 nt, Vaccinia virus
uuuaggaaugauuaucaaa

SEQ ID NO: 3275407 - RNA, 20 nt, Vaccinia virus
ucgcuaauguauagauuguu

SEQ ID NO: 3275408 - RNA, 23 nt, Vaccinia virus
uguccauuguaguauaaaaauua

SEQ ID NO: 3275409 - RNA, 17 nt, Vaccinia virus
uacucaaucaauagcaa

SEQ ID NO: 3275410 - RNA, 19 nt, Vaccinia virus
guacggcgagcuauuuaau

SEQ ID NO: 3275411 - RNA, 12 nt, Vaccinia virus
aaaaauggaugu

SEQ ID NO: 3275412 - RNA, 15 nt, Vaccinia virus
ugcucggcaauaacu

SEQ ID NO: 3275413 - RNA, 15 nt, Vaccinia virus
cauuguuauguauuu

SEQ ID NO: 3275414 - RNA, 12 nt, Vaccinia virus
aaguaaauacug

SEQ ID NO: 3275415 - RNA, 19 nt, Vaccinia virus
auauuacuaaacacacauu

SEQ ID NO: 3275416 - RNA, 21 nt, Vaccinia virus
agaagcauacgccaaauaucu

SEQ ID NO: 3275417 - RNA, 16 nt, Vaccinia virus
acauuguuuauggaug

SEQ ID NO: 3275418 - RNA, 20 nt, Vaccinia virus
accggaagaauuaauaaaca

SEQ ID NO: 3275419 - RNA, 17 nt, Vaccinia virus
aucaggaauccaaagag

SEQ ID NO: 3275420 - RNA, 19 nt, Vaccinia virus
aauaauaucuauauuucca

SEQ ID NO: 3275421 - RNA, 14 nt, Vaccinia virus
cugauuaucuugag

SEQ ID NO: 3275422 - RNA, 18 nt, Vaccinia virus
aaauagguuuuguucuau

SEQ ID NO: 3275423 - RNA, 22 nt, Vaccinia virus
ucaugaugaaguugagaaugau

SEQ ID NO: 3275424 - RNA, 21 nt, Vaccinia virus
uccaauacuaauucaaauugu

SEQ ID NO: 3275425 - RNA, 15 nt, Vaccinia virus
guaucuauaaucauc

SEQ ID NO: 3275426 - RNA, 23 nt, Vaccinia virus
uaaauccaaaauaacuaaacauu

SEQ ID NO: 3275427 - RNA, 17 nt, Vaccinia virus
auguuugacugaauaua

SEQ ID NO: 3275428 - RNA, 22 nt, Vaccinia virus
uguauccacuuuaauaauauca

SEQ ID NO: 3275429 - RNA, 22 nt, Vaccinia virus
acauuguuaauugaaaagggau

SEQ ID NO: 3275430 - RNA, 14 nt, Vaccinia virus
auauuuugcagcca

SEQ ID NO: 3275431 - RNA, 15 nt, Vaccinia virus
auauuuagaaauuga

SEQ ID NO: 3275432 - RNA, 19 nt, Vaccinia virus
aaucucuaucaucacauau

SEQ ID NO: 3275433 - RNA, 13 nt, Vaccinia virus
aucacaagaaguu

SEQ ID NO: 3275434 - RNA, 13 nt, Vaccinia virus
acuuguuuaauga

SEQ ID NO: 3275435 - RNA, 23 nt, Vaccinia virus
ucuucaaaguuucugaaauaaga

SEQ ID NO: 3275436 - RNA, 11 nt, Vaccinia virus
auaaaacauua

SEQ ID NO: 3275437 - RNA, 17 nt, Vaccinia virus
auaaagacaaacaaugg

SEQ ID NO: 3275438 - RNA, 17 nt, Vaccinia virus
guuaauuaucuaaauaa

SEQ ID NO: 3275439 - RNA, 15 nt, Vaccinia virus
ccauuaagugacauu

SEQ ID NO: 3275440 - RNA, 14 nt, Vaccinia virus
cuaaaaaauguaga

SEQ ID NO: 3275441 - RNA, 17 nt, Vaccinia virus
aucauguccauuuaacu

SEQ ID NO: 3275442 - RNA, 13 nt, Vaccinia virus
gaacacuacagua

SEQ ID NO: 3275443 - RNA, 19 nt, Vaccinia virus
cuuaucgaagugacacucu

SEQ ID NO: 3275444 - RNA, 13 nt, Vaccinia virus
aaaauauuuuacu

SEQ ID NO: 3275445 - RNA, 17 nt, Vaccinia virus
auaaauccgaugucuug

SEQ ID NO: 3275446 - RNA, 18 nt, Vaccinia virus
aauacaugggaaaugaua

SEQ ID NO: 3275447 - RNA, 15 nt, Vaccinia virus
acaugauauucaugu

SEQ ID NO: 3275448 - RNA, 14 nt, Vaccinia virus
auuuacaaaaauuu

SEQ ID NO: 3275449 - RNA, 15 nt, Vaccinia virus
auauagaucaaacaa

SEQ ID NO: 3275450 - RNA, 23 nt, Vaccinia virus
agugguaggucauacuccaucaa

SEQ ID NO: 3275451 - RNA, 15 nt, Vaccinia virus
ugcaucuacaucauc

SEQ ID NO: 3275452 - RNA, 22 nt, Vaccinia virus
auguagaauuuuuuaaaaaguu

SEQ ID NO: 3275453 - RNA, 16 nt, Vaccinia virus
agacgagauaguuuuc

SEQ ID NO: 3275454 - RNA, 11 nt, Vaccinia virus
auaauacuuug

SEQ ID NO: 3275455 - RNA, 14 nt, Vaccinia virus
ucgacgacauuaag

SEQ ID NO: 3275456 - RNA, 21 nt, Vaccinia virus
aauacgaaaacgauauuauua

SEQ ID NO: 3275457 - RNA, 18 nt, Vaccinia virus
caaaaguucauaaucuca

SEQ ID NO: 3275458 - RNA, 19 nt, Vaccinia virus
gcuguggaguuauaugaau

SEQ ID NO: 3275459 - RNA, 20 nt, Vaccinia virus
uuccauacguuuauauucuu

SEQ ID NO: 3275460 - RNA, 21 nt, Vaccinia virus
guauuuccauaauaagguuua

SEQ ID NO: 3275461 - RNA, 12 nt, Vaccinia virus
aguuuuuaagag

SEQ ID NO: 3275462 - RNA, 19 nt, Vaccinia virus
uguuuggcaauaaaguuuu

SEQ ID NO: 3275463 - RNA, 15 nt, Vaccinia virus
aaucuuggaaauuau

SEQ ID NO: 3275464 - RNA, 15 nt, Vaccinia virus
cauaauacucaauac

SEQ ID NO: 3275465 - RNA, 22 nt, Vaccinia virus
acacuucuauaguaucuauaua

SEQ ID NO: 3275466 - RNA, 20 nt, Vaccinia virus
agaaacuauagauaaugaua

SEQ ID NO: 3275467 - RNA, 23 nt, Vaccinia virus
caaaauugucuaugaugucaucu

SEQ ID NO: 3275468 - RNA, 22 nt, Vaccinia virus
uacaagaaauauuuccauccga

SEQ ID NO: 3275469 - RNA, 23 nt, Vaccinia virus
guugauguauugucguagaaaac

SEQ ID NO: 3275470 - RNA, 17 nt, Vaccinia virus
uauacaugauauuauca

SEQ ID NO: 3275471 - RNA, 19 nt, Vaccinia virus
aaacuuuacgauagacuuu

SEQ ID NO: 3275472 - RNA, 17 nt, Vaccinia virus
acuaaauacauuaucau

SEQ ID NO: 3275473 - RNA, 16 nt, Vaccinia virus
auugaugacacuagau

SEQ ID NO: 3275474 - RNA, 21 nt, Vaccinia virus
agaguaaacggcugaacuugu

SEQ ID NO: 3275475 - RNA, 20 nt, Vaccinia virus
acucucuacccuaaacuuua

SEQ ID NO: 3275476 - RNA, 13 nt, Vaccinia virus
auuuauuaucaug

SEQ ID NO: 3275477 - RNA, 19 nt, Vaccinia virus
auuccaaugaacaagauua

SEQ ID NO: 3275478 - RNA, 15 nt, Vaccinia virus
guguuuuucaaaaca

SEQ ID NO: 3275479 - RNA, 18 nt, Vaccinia virus
gauauauuuuucauaaau

SEQ ID NO: 3275480 - RNA, 18 nt, Vaccinia virus
gugcucaagcuaaacaag

SEQ ID NO: 3275481 - RNA, 13 nt, Vaccinia virus
aauggaaauacuu

SEQ ID NO: 3275482 - RNA, 20 nt, Vaccinia virus
caaagauauagaacacauaa

SEQ ID NO: 3275483 - RNA, 17 nt, Vaccinia virus
gacaugcaauaaaucua

SEQ ID NO: 3275484 - RNA, 22 nt, Vaccinia virus
uguacgauggauucauccuguu

SEQ ID NO: 3275485 - RNA, 15 nt, Vaccinia virus
ugaagaugaugugaa

SEQ ID NO: 3275486 - RNA, 16 nt, Vaccinia virus
guauuaaguuuggaga

SEQ ID NO: 3275487 - RNA, 16 nt, Vaccinia virus
auaaaguuuauacaag

SEQ ID NO: 3275488 - RNA, 21 nt, Vaccinia virus
gauaacucucuucuauaaaaa

SEQ ID NO: 3275489 - RNA, 23 nt, Vaccinia virus
guccguuauauaaucuacaaaac

SEQ ID NO: 3275490 - RNA, 16 nt, Vaccinia virus
uauauauccuuuugua

SEQ ID NO: 3275491 - RNA, 21 nt, Vaccinia virus
auauucugccguguuuaaaga

SEQ ID NO: 3275492 - RNA, 12 nt, Vaccinia virus
acucuucuuauu

SEQ ID NO: 3275493 - RNA, 19 nt, Vaccinia virus
gcuauggcuucuuaaauca

SEQ ID NO: 3275494 - RNA, 15 nt, Vaccinia virus
aauccaauugauuga

SEQ ID NO: 3275495 - RNA, 18 nt, Vaccinia virus
uaacuccagaacaucuuc

SEQ ID NO: 3275496 - RNA, 16 nt, Vaccinia virus
gauugagauucucuau

SEQ ID NO: 3275497 - RNA, 22 nt, Vaccinia virus
uaggcuuccaaaaauuuuucau

SEQ ID NO: 3275498 - RNA, 14 nt, Vaccinia virus
uaaaauaaucucuu

SEQ ID NO: 3275499 - RNA, 20 nt, Vaccinia virus
aauacauauuguuuagcaaa

SEQ ID NO: 3275500 - RNA, 22 nt, Vaccinia virus
guugauggaaaaauucuuuucg

SEQ ID NO: 3275501 - RNA, 14 nt, Vaccinia virus
auaacuaaaaaugu

SEQ ID NO: 3275502 - RNA, 17 nt, Vaccinia virus
auagauuuuccauccac

SEQ ID NO: 3275503 - RNA, 20 nt, Vaccinia virus
aggcacagucaaacauucaa

SEQ ID NO: 3275504 - RNA, 17 nt, Vaccinia virus
uacaauuaucauuuuga

SEQ ID NO: 3275505 - RNA, 18 nt, Vaccinia virus
cauaguggacaacauuaa

SEQ ID NO: 3275506 - RNA, 19 nt, Vaccinia virus
agguauguaccacauacug

SEQ ID NO: 3275507 - RNA, 13 nt, Vaccinia virus
uaguuuacagaua

SEQ ID NO: 3275508 - RNA, 18 nt, Vaccinia virus
gaaaagcuuaaaauagcu

SEQ ID NO: 3275509 - RNA, 12 nt, Vaccinia virus
aaauagauguua

SEQ ID NO: 3275510 - RNA, 16 nt, Vaccinia virus
cuguacaaauguuaaa

SEQ ID NO: 3275511 - RNA, 13 nt, Vaccinia virus
cgcaccaacaauu

SEQ ID NO: 3275512 - RNA, 22 nt, Vaccinia virus
agaggaccguugggaauuuuau

SEQ ID NO: 3275513 - RNA, 23 nt, Vaccinia virus
uaacgagugaucaaaucauugau

SEQ ID NO: 3275514 - RNA, 19 nt, Vaccinia virus
aaaaagccccaauuuacaa

SEQ ID NO: 3275515 - RNA, 22 nt, Vaccinia virus
uaccaauaugucuguacaaaug

SEQ ID NO: 3275516 - RNA, 15 nt, Vaccinia virus
auaacgugaaauaua

SEQ ID NO: 3275517 - RNA, 16 nt, Vaccinia virus
auuguaguauaugaua

SEQ ID NO: 3275518 - RNA, 20 nt, Vaccinia virus
uuaguacccacgucuuuuca

SEQ ID NO: 3275519 - RNA, 23 nt, Vaccinia virus
cagagauccacugucacuggaaa

SEQ ID NO: 3275520 - RNA, 22 nt, Vaccinia virus
acuguacaaggaauugaugaag

SEQ ID NO: 3275521 - RNA, 18 nt, Vaccinia virus
ugccuauuaggacagaua

SEQ ID NO: 3275522 - RNA, 12 nt, Vaccinia virus
uauaaauuaaag

SEQ ID NO: 3275523 - RNA, 18 nt, Vaccinia virus
aaauguucuuaacuacau

SEQ ID NO: 3275524 - RNA, 22 nt, Vaccinia virus
uauuccaaucauugauaucuuu

SEQ ID NO: 3275525 - RNA, 13 nt, Vaccinia virus
gcuaaaauaccua

SEQ ID NO: 3275526 - RNA, 17 nt, Vaccinia virus
gacacguuuauuucaua

SEQ ID NO: 3275527 - RNA, 15 nt, Vaccinia virus
cgguaccuuugucca

SEQ ID NO: 3275528 - RNA, 22 nt, Vaccinia virus
cuacaucaguuuuguauuccaa

SEQ ID NO: 3275529 - RNA, 12 nt, Vaccinia virus
auggaaauacuu

SEQ ID NO: 3275530 - RNA, 19 nt, Vaccinia virus
auauucuaacgauaauaga

SEQ ID NO: 3275531 - RNA, 11 nt, Vaccinia virus
uuauuaucuaa

SEQ ID NO: 3275532 - RNA, 11 nt, Vaccinia virus
uucaauguuua

SEQ ID NO: 3275533 - RNA, 21 nt, Vaccinia virus
uauaaaguccgcacuacuguu

SEQ ID NO: 3275534 - RNA, 20 nt, Vaccinia virus
acaacuuaaucugaugaaua

SEQ ID NO: 3275535 - RNA, 16 nt, Vaccinia virus
auuguuaauugaaaag

SEQ ID NO: 3275536 - RNA, 21 nt, Vaccinia virus
uauuaugaugaacuuuaucua

SEQ ID NO: 3275537 - RNA, 18 nt, Vaccinia virus
uuauuccaucaugucaac

SEQ ID NO: 3275538 - RNA, 19 nt, Vaccinia virus
ucguuaaacgccuuuagaa

SEQ ID NO: 3275539 - RNA, 15 nt, Vaccinia virus
uuucuuggcaaaaga

SEQ ID NO: 3275540 - RNA, 15 nt, Vaccinia virus
aaaauucgacaauga

SEQ ID NO: 3275541 - RNA, 14 nt, Vaccinia virus
gccgaacuaaaaaa

SEQ ID NO: 3275542 - RNA, 18 nt, Vaccinia virus
cuccauaguggacaacau

SEQ ID NO: 3275543 - RNA, 16 nt, Vaccinia virus
auacgaggaugaugaa

SEQ ID NO: 3275544 - RNA, 17 nt, Vaccinia virus
agaauuuagaaauauau

SEQ ID NO: 3275545 - RNA, 15 nt, Vaccinia virus
agucaagucaaugau

SEQ ID NO: 3275546 - RNA, 23 nt, Vaccinia virus
uuuacgguauagccucuagauaa

SEQ ID NO: 3275547 - RNA, 20 nt, Vaccinia virus
acuacaguaguaauuaauga

SEQ ID NO: 3275548 - RNA, 16 nt, Vaccinia virus
gauagaugauccagau

SEQ ID NO: 3275549 - RNA, 14 nt, Vaccinia virus
auuucguuucuuaa

SEQ ID NO: 3275550 - RNA, 13 nt, Vaccinia virus
cacauagaauaaa

SEQ ID NO: 3275551 - RNA, 20 nt, Vaccinia virus
cauagguagagauacuuuca

SEQ ID NO: 3275552 - RNA, 22 nt, Vaccinia virus
aucaucugcacuaauuaacagu

SEQ ID NO: 3275553 - RNA, 18 nt, Vaccinia virus
aaaucaaaauccauauca

SEQ ID NO: 3275554 - RNA, 14 nt, Vaccinia virus
auuacccauggaga

SEQ ID NO: 3275555 - RNA, 22 nt, Vaccinia virus
auauguauucgucuuucugaau

SEQ ID NO: 3275556 - RNA, 18 nt, Vaccinia virus
uucuccguucuuaauaag

SEQ ID NO: 3275557 - RNA, 18 nt, Vaccinia virus
acaauaucaguaucuucu

SEQ ID NO: 3275558 - RNA, 22 nt, Vaccinia virus
acauuaugccguuaucauuaau

SEQ ID NO: 3275559 - RNA, 16 nt, Vaccinia virus
aaugaaucccaaacau

SEQ ID NO: 3275560 - RNA, 17 nt, Vaccinia virus
cucucaucuacaaaaac

SEQ ID NO: 3275561 - RNA, 17 nt, Vaccinia virus
aaauaaacauaacauau

SEQ ID NO: 3275562 - RNA, 17 nt, Vaccinia virus
aaauauucauaacuaau

SEQ ID NO: 3275563 - RNA, 21 nt, Vaccinia virus
uagauuucauucagaggaugu

SEQ ID NO: 3275564 - RNA, 14 nt, Vaccinia virus
acuuuguuaauaau

SEQ ID NO: 3275565 - RNA, 12 nt, Vaccinia virus
auacucugaaag

SEQ ID NO: 3275566 - RNA, 17 nt, Vaccinia virus
uacguauuauauaugua

SEQ ID NO: 3275567 - RNA, 21 nt, Vaccinia virus
ugacuauugcguguagaguau

SEQ ID NO: 3275568 - RNA, 14 nt, Vaccinia virus
uuuauuaaauacuc

SEQ ID NO: 3275569 - RNA, 14 nt, Vaccinia virus
caucugcucaacaa

SEQ ID NO: 3275570 - RNA, 13 nt, Vaccinia virus
aauuuuaagaaau

SEQ ID NO: 3275571 - RNA, 16 nt, Vaccinia virus
aaauucccauucuaau

SEQ ID NO: 3275572 - RNA, 14 nt, Vaccinia virus
caagcgaauuauuu

SEQ ID NO: 3275573 - RNA, 15 nt, Vaccinia virus
auuuugucauuaacu

SEQ ID NO: 3275574 - RNA, 22 nt, Vaccinia virus
uucccauauccagacaacaauc

SEQ ID NO: 3275575 - RNA, 14 nt, Vaccinia virus
auaucauacaugau

SEQ ID NO: 3275576 - RNA, 14 nt, Vaccinia virus
aucuugauuaauaa

SEQ ID NO: 3275577 - RNA, 23 nt, Vaccinia virus
uuuuauaugucucgcauaaacau

SEQ ID NO: 3275578 - RNA, 15 nt, Vaccinia virus
aguuuaauaauacaa

SEQ ID NO: 3275579 - RNA, 15 nt, Vaccinia virus
aggaaauaaaucaua

SEQ ID NO: 3275580 - RNA, 22 nt, Vaccinia virus
agagacccugcgcuuucucuau

SEQ ID NO: 3275581 - RNA, 21 nt, Vaccinia virus
auuuuucuaccuuuucaauuu

SEQ ID NO: 3275582 - RNA, 13 nt, Vaccinia virus
aguccgcauuaug

SEQ ID NO: 3275583 - RNA, 21 nt, Vaccinia virus
uccuuccaagaagaagacuua

SEQ ID NO: 3275584 - RNA, 18 nt, Vaccinia virus
ugucuacuccaaugacug

SEQ ID NO: 3275585 - RNA, 19 nt, Vaccinia virus
augaucaggaaaguuuauu

SEQ ID NO: 3275586 - RNA, 20 nt, Vaccinia virus
ucaucauaguuacgauuuua

SEQ ID NO: 3275587 - RNA, 16 nt, Vaccinia virus
aaccacggaucguaau

SEQ ID NO: 3275588 - RNA, 22 nt, Vaccinia virus
aaguuuuauagagauagacgaa

SEQ ID NO: 3275589 - RNA, 23 nt, Vaccinia virus
guaauacuuuucuucauuacuuc

SEQ ID NO: 3275590 - RNA, 11 nt, Vaccinia virus
caaaaaaccau

SEQ ID NO: 3275591 - RNA, 14 nt, Vaccinia virus
agacgcccaaaaua

SEQ ID NO: 3275592 - RNA, 16 nt, Vaccinia virus
ucguucgaccuaaaau

SEQ ID NO: 3275593 - RNA, 15 nt, Vaccinia virus
ggaacauuaaaugua

SEQ ID NO: 3275594 - RNA, 14 nt, Vaccinia virus
acgaaauauuagaa

SEQ ID NO: 3275595 - RNA, 13 nt, Vaccinia virus
uccaauguauuua

SEQ ID NO: 3275596 - RNA, 12 nt, Vaccinia virus
auguuaaauaua

SEQ ID NO: 3275597 - RNA, 14 nt, Vaccinia virus
uauaaagacaaaca

SEQ ID NO: 3275598 - RNA, 14 nt, Vaccinia virus
uaauaaaaacauua

SEQ ID NO: 3275599 - RNA, 22 nt, Vaccinia virus
ucuuccggagaccccauaaaua

SEQ ID NO: 3275600 - RNA, 19 nt, Vaccinia virus
ugaugucaaagauuguaca

SEQ ID NO: 3275601 - RNA, 20 nt, Vaccinia virus
auagcaaggaugaaaaagga

SEQ ID NO: 3275602 - RNA, 21 nt, Vaccinia virus
auucauuaggauuaucaaauc

SEQ ID NO: 3275603 - RNA, 15 nt, Vaccinia virus
aaaauugauggauga

SEQ ID NO: 3275604 - RNA, 12 nt, Vaccinia virus
ucauuuagaaug

SEQ ID NO: 3275605 - RNA, 17 nt, Vaccinia virus
ugcauucguuuaaagau

SEQ ID NO: 3275606 - RNA, 21 nt, Vaccinia virus
aaucucgucaguauugacaau

SEQ ID NO: 3275607 - RNA, 19 nt, Vaccinia virus
agcuagaggaaaugaaaga

SEQ ID NO: 3275608 - RNA, 22 nt, Vaccinia virus
guuacacgcauccuuauaaaga

SEQ ID NO: 3275609 - RNA, 13 nt, Vaccinia virus
caauagaaucugu

SEQ ID NO: 3275610 - RNA, 20 nt, Vaccinia virus
auacucccacaaauacugac

SEQ ID NO: 3275611 - RNA, 20 nt, Vaccinia virus
uucuaauggaugauguucua

SEQ ID NO: 3275612 - RNA, 18 nt, Vaccinia virus
augauagaaaugaugaag

SEQ ID NO: 3275613 - RNA, 22 nt, Vaccinia virus
auacuucauuucuaaaauagua

SEQ ID NO: 3275614 - RNA, 16 nt, Vaccinia virus
auggcauugauaaugu

SEQ ID NO: 3275615 - RNA, 19 nt, Vaccinia virus
agauauguuuagagaaugc

SEQ ID NO: 3275616 - RNA, 14 nt, Vaccinia virus
uauuaaaauuauuu

SEQ ID NO: 3275617 - RNA, 13 nt, Vaccinia virus
cucucaucuuuua

SEQ ID NO: 3275618 - RNA, 15 nt, Vaccinia virus
auuauguaucaauau

SEQ ID NO: 3275619 - RNA, 14 nt, Vaccinia virus
gaaauaauauuaaa

SEQ ID NO: 3275620 - RNA, 18 nt, Vaccinia virus
augaaaaugguaucacac

SEQ ID NO: 3275621 - RNA, 14 nt, Vaccinia virus
aaacuaauucuguc

SEQ ID NO: 3275622 - RNA, 21 nt, Vaccinia virus
ugacgcguuuccuacauaaca

SEQ ID NO: 3275623 - RNA, 15 nt, Vaccinia virus
auaguauucuuguau

SEQ ID NO: 3275624 - RNA, 17 nt, Vaccinia virus
auauagaagauaaacau

SEQ ID NO: 3275625 - RNA, 15 nt, Vaccinia virus
aaacgcguacauaac

SEQ ID NO: 3275626 - RNA, 18 nt, Vaccinia virus
cuuauuccauuaucugaa

SEQ ID NO: 3275627 - RNA, 17 nt, Vaccinia virus
uaguuguuuaauuuauu

SEQ ID NO: 3275628 - RNA, 14 nt, Vaccinia virus
gucagaauucucuc

SEQ ID NO: 3275629 - RNA, 15 nt, Vaccinia virus
auacauugaucuaug

SEQ ID NO: 3275630 - RNA, 17 nt, Vaccinia virus
cucgcuuuguguaucau

SEQ ID NO: 3275631 - RNA, 19 nt, Vaccinia virus
aauuucgaagcuagcgaua

SEQ ID NO: 3275632 - RNA, 15 nt, Vaccinia virus
aucuugauuuauaga

SEQ ID NO: 3275633 - RNA, 16 nt, Vaccinia virus
aucugaagaaaguaau

SEQ ID NO: 3275634 - RNA, 19 nt, Vaccinia virus
uuuuucuucauuuaucaua

SEQ ID NO: 3275635 - RNA, 17 nt, Vaccinia virus
auaauggcuguuuguau

SEQ ID NO: 3275636 - RNA, 21 nt, Vaccinia virus
aaauucccaaguagauauccu

SEQ ID NO: 3275637 - RNA, 14 nt, Vaccinia virus
ugaguguagaugcu

SEQ ID NO: 3275638 - RNA, 19 nt, Vaccinia virus
aguuuuguucauuaauagu

SEQ ID NO: 3275639 - RNA, 14 nt, Vaccinia virus
uuuagaauuuccaa

SEQ ID NO: 3275640 - RNA, 20 nt, Vaccinia virus
gauuuuccaaaucaguaacu

SEQ ID NO: 3275641 - RNA, 13 nt, Vaccinia virus
aauaaaacuguau

SEQ ID NO: 3275642 - RNA, 14 nt, Vaccinia virus
ucauauucauacac

SEQ ID NO: 3275643 - RNA, 15 nt, Vaccinia virus
caaaagguagcuaau

SEQ ID NO: 3275644 - RNA, 14 nt, Vaccinia virus
auguuuuacucugg

SEQ ID NO: 3275645 - RNA, 13 nt, Vaccinia virus
uugauuauuuuga

SEQ ID NO: 3275646 - RNA, 17 nt, Vaccinia virus
auaauaucuuuaaucca

SEQ ID NO: 3275647 - RNA, 14 nt, Vaccinia virus
auauuauuaugaag

SEQ ID NO: 3275648 - RNA, 23 nt, Vaccinia virus
auaguaccuagaacgaugucaaa

SEQ ID NO: 3275649 - RNA, 14 nt, Vaccinia virus
uuaucgacaucuug

SEQ ID NO: 3275650 - RNA, 13 nt, Vaccinia virus
gauauucuucaga

SEQ ID NO: 3275651 - RNA, 14 nt, Vaccinia virus
uuaaacauuguuca

SEQ ID NO: 3275652 - RNA, 17 nt, Vaccinia virus
gcuaugaaggaaagaca

SEQ ID NO: 3275653 - RNA, 19 nt, Vaccinia virus
gaacuaacuauuacuauga

SEQ ID NO: 3275654 - RNA, 14 nt, Vaccinia virus
auacauuguugcau

SEQ ID NO: 3275655 - RNA, 23 nt, Vaccinia virus
ccaaaaaguguuuggcaauaaag

SEQ ID NO: 3275656 - RNA, 23 nt, Vaccinia virus
aaacuaugucaaaaauuguagaa

SEQ ID NO: 3275657 - RNA, 15 nt, Vaccinia virus
cuaucuaaauguaau

SEQ ID NO: 3275658 - RNA, 19 nt, Vaccinia virus
acccuucuacgucaucaaa

SEQ ID NO: 3275659 - RNA, 13 nt, Vaccinia virus
uggccgacgucag

SEQ ID NO: 3275660 - RNA, 19 nt, Vaccinia virus
aguauaucuacacauguau

SEQ ID NO: 3275661 - RNA, 20 nt, Vaccinia virus
ucaaucggauacagacacuc

SEQ ID NO: 3275662 - RNA, 19 nt, Vaccinia virus
auauuugugaaaaauauua

SEQ ID NO: 3275663 - RNA, 15 nt, Vaccinia virus
aauuguuugagauau

SEQ ID NO: 3275664 - RNA, 10 nt, Vaccinia virus
auuuaaacau

SEQ ID NO: 3275665 - RNA, 13 nt, Vaccinia virus
uuagacuagauac

SEQ ID NO: 3275666 - RNA, 20 nt, Vaccinia virus
cgauacaaaaugugucaaga

SEQ ID NO: 3275667 - RNA, 14 nt, Vaccinia virus
cugaaaauaaagau

SEQ ID NO: 3275668 - RNA, 18 nt, Vaccinia virus
uggagaucauuaaauguu

SEQ ID NO: 3275669 - RNA, 14 nt, Vaccinia virus
gaaaauaaauacaa

SEQ ID NO: 3275670 - RNA, 15 nt, Vaccinia virus
uccuauacucugaaa

SEQ ID NO: 3275671 - RNA, 20 nt, Vaccinia virus
uccauuuaaggcuuuaaaau

SEQ ID NO: 3275672 - RNA, 23 nt, Vaccinia virus
uuaaugagcguaaacaauaaucg

SEQ ID NO: 3275673 - RNA, 11 nt, Vaccinia virus
aagaaaugaua

SEQ ID NO: 3275674 - RNA, 23 nt, Vaccinia virus
aaaugaugcugguuauuauacau

SEQ ID NO: 3275675 - RNA, 15 nt, Vaccinia virus
augcaucauuaauuu

SEQ ID NO: 3275676 - RNA, 20 nt, Vaccinia virus
auguaauggagaguuaccuc

SEQ ID NO: 3275677 - RNA, 15 nt, Vaccinia virus
gauaauuauuucuac

SEQ ID NO: 3275678 - RNA, 21 nt, Vaccinia virus
ugucuaaacgaccaucuuuga

SEQ ID NO: 3275679 - RNA, 20 nt, Vaccinia virus
gcaucuagucuuaaauggag

SEQ ID NO: 3275680 - RNA, 18 nt, Vaccinia virus
uaugauauuccuggagau

SEQ ID NO: 3275681 - RNA, 20 nt, Vaccinia virus
caaggaacuaaauagauuua

SEQ ID NO: 3275682 - RNA, 22 nt, Vaccinia virus
caaauaaaucacuaaauaauau

SEQ ID NO: 3275683 - RNA, 17 nt, Vaccinia virus
gauccaaacaauguuuc

SEQ ID NO: 3275684 - RNA, 24 nt, Vaccinia virus
aguacauagcaucuucacaaauua

SEQ ID NO: 3275685 - RNA, 19 nt, Vaccinia virus
aaguucuucgacaaaucgu

SEQ ID NO: 3275686 - RNA, 19 nt, Vaccinia virus
aucacuaugaaacaaaugu

SEQ ID NO: 3275687 - RNA, 17 nt, Vaccinia virus
guagauaaucauuuaau

SEQ ID NO: 3275688 - RNA, 16 nt, Vaccinia virus
uucacguaaauacaaa

SEQ ID NO: 3275689 - RNA, 19 nt, Vaccinia virus
cauaaacugaucacuaauu

SEQ ID NO: 3275690 - RNA, 17 nt, Vaccinia virus
caucugauaauuuagau

SEQ ID NO: 3275691 - RNA, 18 nt, Vaccinia virus
aaaauauacguguacugu

SEQ ID NO: 3275692 - RNA, 17 nt, Vaccinia virus
auaaauuugucauuuau

SEQ ID NO: 3275693 - RNA, 13 nt, Vaccinia virus
auuuuaucaaacu

SEQ ID NO: 3275694 - RNA, 21 nt, Vaccinia virus
aauguuucgaugaaauagaua

SEQ ID NO: 3275695 - RNA, 13 nt, Vaccinia virus
uagacguauaagu

SEQ ID NO: 3275696 - RNA, 13 nt, Vaccinia virus
aauguaacuauag

SEQ ID NO: 3275697 - RNA, 21 nt, Vaccinia virus
cuaucgaugauagcacuguua

SEQ ID NO: 3275698 - RNA, 20 nt, Vaccinia virus
agaauuggaauaccaaauau

SEQ ID NO: 3275699 - RNA, 21 nt, Vaccinia virus
acgaugauauuaaaauuauuu

SEQ ID NO: 3275700 - RNA, 18 nt, Vaccinia virus
gauaaaauccuccuauca

SEQ ID NO: 3275701 - RNA, 16 nt, Vaccinia virus
caucgucucaucuguu

SEQ ID NO: 3275702 - RNA, 18 nt, Vaccinia virus
uuugugaaaacagauaac

SEQ ID NO: 3275703 - RNA, 17 nt, Vaccinia virus
uaguguugcuaucucuu

SEQ ID NO: 3275704 - RNA, 15 nt, Vaccinia virus
guaaagauauuucuc

SEQ ID NO: 3275705 - RNA, 21 nt, Vaccinia virus
aucaucuacuccaugucuauu

SEQ ID NO: 3275706 - RNA, 17 nt, Vaccinia virus
cauucaaccauucauaa

SEQ ID NO: 3275707 - RNA, 12 nt, Vaccinia virus
uacaaaugacua

SEQ ID NO: 3275708 - RNA, 15 nt, Vaccinia virus
acaagaucaugaaca

SEQ ID NO: 3275709 - RNA, 18 nt, Vaccinia virus
cagauugaacauacaguu

SEQ ID NO: 3275710 - RNA, 13 nt, Vaccinia virus
aaaauaauaucua

SEQ ID NO: 3275711 - RNA, 17 nt, Vaccinia virus
caacauccuuuaauggu

SEQ ID NO: 3275712 - RNA, 13 nt, Vaccinia virus
auaaauauacaau

SEQ ID NO: 3275713 - RNA, 15 nt, Vaccinia virus
uaauauugauacaua

SEQ ID NO: 3275714 - RNA, 21 nt, Vaccinia virus
agcuguuccaauaaauuauuu

SEQ ID NO: 3275715 - RNA, 15 nt, Vaccinia virus
agcuaaaaaugccac

SEQ ID NO: 3275716 - RNA, 13 nt, Vaccinia virus
aguuaaauauuaa

SEQ ID NO: 3275717 - RNA, 18 nt, Vaccinia virus
auauaacuaucaauauua

SEQ ID NO: 3275718 - RNA, 12 nt, Vaccinia virus
gcuguaaaucac

SEQ ID NO: 3275719 - RNA, 17 nt, Vaccinia virus
guaauuaguuucugguu

SEQ ID NO: 3275720 - RNA, 17 nt, Vaccinia virus
ccacgaugauaaauauc

SEQ ID NO: 3275721 - RNA, 16 nt, Vaccinia virus
uaguuaccgcaaagaa

SEQ ID NO: 3275722 - RNA, 20 nt, Vaccinia virus
uagucaucacauuaacuauu

SEQ ID NO: 3275723 - RNA, 19 nt, Vaccinia virus
uaauaaugauucaacaaug

SEQ ID NO: 3275724 - RNA, 17 nt, Vaccinia virus
cuauaguuuuauugcuu

SEQ ID NO: 3275725 - RNA, 21 nt, Vaccinia virus
uaaaaaccaucgucugaaucc

SEQ ID NO: 3275726 - RNA, 16 nt, Vaccinia virus
guuccugaccauccau

SEQ ID NO: 3275727 - RNA, 22 nt, Vaccinia virus
ugccauaauuuucauauauuga

SEQ ID NO: 3275728 - RNA, 14 nt, Vaccinia virus
auacgauucuauau

SEQ ID NO: 3275729 - RNA, 19 nt, Vaccinia virus
uaauuuguaaaccaucuua

SEQ ID NO: 3275730 - RNA, 14 nt, Vaccinia virus
ucccacauuauuuu

SEQ ID NO: 3275731 - RNA, 23 nt, Vaccinia virus
aaaucuaucuuuagcuucugaaa

SEQ ID NO: 3275732 - RNA, 15 nt, Vaccinia virus
cuccucauauggauc

SEQ ID NO: 3275733 - RNA, 23 nt, Vaccinia virus
gauucauucacuaucaaucgaua

SEQ ID NO: 3275734 - RNA, 14 nt, Vaccinia virus
auuuccaucaaaug

SEQ ID NO: 3275735 - RNA, 14 nt, Vaccinia virus
gucacgaugaugga

SEQ ID NO: 3275736 - RNA, 23 nt, Vaccinia virus
auaugacgacuucaaucaaacaa

SEQ ID NO: 3275737 - RNA, 19 nt, Vaccinia virus
acuguagauauuauauaga

SEQ ID NO: 3275738 - RNA, 20 nt, Vaccinia virus
aacuuacgauacaucuguuu

SEQ ID NO: 3275739 - RNA, 19 nt, Vaccinia virus
ucaucacuuagaacagauu

SEQ ID NO: 3275740 - RNA, 16 nt, Vaccinia virus
agacgacaacauguaa

SEQ ID NO: 3275741 - RNA, 14 nt, Vaccinia virus
auuuuaaaaaacug

SEQ ID NO: 3275742 - RNA, 15 nt, Vaccinia virus
auaguggacaacauu

SEQ ID NO: 3275743 - RNA, 22 nt, Vaccinia virus
caacaucuuaagcguagaaguu

SEQ ID NO: 3275744 - RNA, 18 nt, Vaccinia virus
cuaaauucaugucuaaug

SEQ ID NO: 3275745 - RNA, 20 nt, Vaccinia virus
acauaaacugaucacuaauu

SEQ ID NO: 3275746 - RNA, 20 nt, Vaccinia virus
aaaauguucuuaauagucua

SEQ ID NO: 3275747 - RNA, 20 nt, Vaccinia virus
aaacuuccucauuaagauug

SEQ ID NO: 3275748 - RNA, 14 nt, Vaccinia virus
auugguaaauccua

SEQ ID NO: 3275749 - RNA, 19 nt, Vaccinia virus
agugaaauguugucauuau

SEQ ID NO: 3275750 - RNA, 15 nt, Vaccinia virus
aucacauauuaaaaa

SEQ ID NO: 3275751 - RNA, 19 nt, Vaccinia virus
ucguauuggauucugaaau

SEQ ID NO: 3275752 - RNA, 19 nt, Vaccinia virus
ggugucuccauguacauac

SEQ ID NO: 3275753 - RNA, 13 nt, Vaccinia virus
uauuauguuuauc

SEQ ID NO: 3275754 - RNA, 20 nt, Vaccinia virus
uacaaucguucgaacucguc

SEQ ID NO: 3275755 - RNA, 18 nt, Vaccinia virus
aauacucuucaaaguuuc

SEQ ID NO: 3275756 - RNA, 13 nt, Vaccinia virus
auguaaaacauuu

SEQ ID NO: 3275757 - RNA, 20 nt, Vaccinia virus
aucaugauuggguagcaaau

SEQ ID NO: 3275758 - RNA, 21 nt, Vaccinia virus
auguauuucauuguucaucca

SEQ ID NO: 3275759 - RNA, 18 nt, Vaccinia virus
aucucuauaauaucuagu

SEQ ID NO: 3275760 - RNA, 12 nt, Vaccinia virus
gauuaacagagu

SEQ ID NO: 3275761 - RNA, 22 nt, Vaccinia virus
cucccggauauuuuuuacaauu

SEQ ID NO: 3275762 - RNA, 17 nt, Vaccinia virus
aggauacucuaugaaug

SEQ ID NO: 3275763 - RNA, 19 nt, Vaccinia virus
agaacuauaaaaacagaua

SEQ ID NO: 3275764 - RNA, 20 nt, Vaccinia virus
auucaagcaaaaacaaaaaa

SEQ ID NO: 3275765 - RNA, 18 nt, Vaccinia virus
gguucccaauuccaaaga

SEQ ID NO: 3275766 - RNA, 17 nt, Vaccinia virus
caugcauucaaauggau

SEQ ID NO: 3275767 - RNA, 13 nt, Vaccinia virus
ucgucucaucugu

SEQ ID NO: 3275768 - RNA, 20 nt, Vaccinia virus
acugcugaauguaucuucca

SEQ ID NO: 3275769 - RNA, 17 nt, Vaccinia virus
auaugaaaaacaugucu

SEQ ID NO: 3275770 - RNA, 16 nt, Vaccinia virus
acaaugaaaauggaua

SEQ ID NO: 3275771 - RNA, 23 nt, Vaccinia virus
ucauaaacaagcccgucaauaau

SEQ ID NO: 3275772 - RNA, 17 nt, Vaccinia virus
cuauauauucugcuaua

SEQ ID NO: 3275773 - RNA, 16 nt, Vaccinia virus
ucaaguaaagauuuca

SEQ ID NO: 3275774 - RNA, 24 nt, Vaccinia virus
aaauccaaauugcgacacuauuca

SEQ ID NO: 3275775 - RNA, 13 nt, Vaccinia virus
auaaagauauaca

SEQ ID NO: 3275776 - RNA, 19 nt, Vaccinia virus
ugaaccguaauauaucuag

SEQ ID NO: 3275777 - RNA, 13 nt, Vaccinia virus
guauugguaauau

SEQ ID NO: 3275778 - RNA, 18 nt, Vaccinia virus
uagaacgaugucaaaaua

SEQ ID NO: 3275779 - RNA, 23 nt, Vaccinia virus
gaagaauggaaaccuuuaaucua

SEQ ID NO: 3275780 - RNA, 16 nt, Vaccinia virus
auucgcuaaaaaauua

SEQ ID NO: 3275781 - RNA, 22 nt, Vaccinia virus
gauaauaauguuauuauaucua

SEQ ID NO: 3275782 - RNA, 14 nt, Vaccinia virus
auuugaucaguuua

SEQ ID NO: 3275783 - RNA, 18 nt, Vaccinia virus
auucuuuuauuaauguca

SEQ ID NO: 3275784 - RNA, 13 nt, Vaccinia virus
augacucugauuu

SEQ ID NO: 3275785 - RNA, 15 nt, Vaccinia virus
cuguuguacauacag

SEQ ID NO: 3275786 - RNA, 14 nt, Vaccinia virus
caaauguuaaacau

SEQ ID NO: 3275787 - RNA, 19 nt, Vaccinia virus
caaaaguaagcauuuccuu

SEQ ID NO: 3275788 - RNA, 20 nt, Vaccinia virus
aucuaugguauuaagaauuc

SEQ ID NO: 3275789 - RNA, 14 nt, Vaccinia virus
cgcccuuguauguu

SEQ ID NO: 3275790 - RNA, 13 nt, Vaccinia virus
uaggaaaaagaua

SEQ ID NO: 3275791 - RNA, 16 nt, Vaccinia virus
uaauugggugaagaau

SEQ ID NO: 3275792 - RNA, 14 nt, Vaccinia virus
ucuuucaggaaagc

SEQ ID NO: 3275793 - RNA, 18 nt, Vaccinia virus
aggaaauugauaaugagu

SEQ ID NO: 3275794 - RNA, 19 nt, Vaccinia virus
auggaaaaguucaacauga

SEQ ID NO: 3275795 - RNA, 21 nt, Vaccinia virus
ccacguaaaacuuaaaauuua

SEQ ID NO: 3275796 - RNA, 16 nt, Vaccinia virus
gaaauacaaaauguua

SEQ ID NO: 3275797 - RNA, 20 nt, Vaccinia virus
uaaacucgcuuaauaucuuc

SEQ ID NO: 3275798 - RNA, 11 nt, Vaccinia virus
gaaauuagaaa

SEQ ID NO: 3275799 - RNA, 21 nt, Vaccinia virus
aaauacauaugacaaacauug

SEQ ID NO: 3275800 - RNA, 18 nt, Vaccinia virus
uaucaauccaacaaaugc

SEQ ID NO: 3275801 - RNA, 18 nt, Vaccinia virus
uagaaaaaacauguggua

SEQ ID NO: 3275802 - RNA, 15 nt, Vaccinia virus
gaauuugauacuguc

SEQ ID NO: 3275803 - RNA, 12 nt, Vaccinia virus
uccuggugauau

SEQ ID NO: 3275804 - RNA, 23 nt, Vaccinia virus
cuaauaacacuuccaguaucaau

SEQ ID NO: 3275805 - RNA, 16 nt, Vaccinia virus
augcaaagucuaaaua

SEQ ID NO: 3275806 - RNA, 18 nt, Vaccinia virus
aucuuuaauaucuagauu

SEQ ID NO: 3275807 - RNA, 22 nt, Vaccinia virus
acgagaauggcguuugauauau

SEQ ID NO: 3275808 - RNA, 23 nt, Vaccinia virus
agugauauagaucccaaaucuuc

SEQ ID NO: 3275809 - RNA, 18 nt, Vaccinia virus
ucgacguuucucaaaguc

SEQ ID NO: 3275810 - RNA, 14 nt, Vaccinia virus
guauacucuauucg

SEQ ID NO: 3275811 - RNA, 20 nt, Vaccinia virus
acauaaguauauaauaaaua

SEQ ID NO: 3275812 - RNA, 19 nt, Vaccinia virus
guguguugacuauaacaga

SEQ ID NO: 3275813 - RNA, 17 nt, Vaccinia virus
auguaaucgaaauaaua

SEQ ID NO: 3275814 - RNA, 17 nt, Vaccinia virus
cauucugcaauauuguu

SEQ ID NO: 3275815 - RNA, 22 nt, Vaccinia virus
ucuucuugagaucccacaucau

SEQ ID NO: 3275816 - RNA, 17 nt, Vaccinia virus
gaaauuagaaaguaaug

SEQ ID NO: 3275817 - RNA, 15 nt, Vaccinia virus
aguggaguugaagau

SEQ ID NO: 3275818 - RNA, 17 nt, Vaccinia virus
gcuaguacucuuaagag

SEQ ID NO: 3275819 - RNA, 22 nt, Vaccinia virus
guaaugaacagacuauuuauca

SEQ ID NO: 3275820 - RNA, 17 nt, Vaccinia virus
uuauugauaauuguaaa

SEQ ID NO: 3275821 - RNA, 17 nt, Vaccinia virus
uuauuacugaauuauua

SEQ ID NO: 3275822 - RNA, 20 nt, Vaccinia virus
acuuuauugccuguaauaau

SEQ ID NO: 3275823 - RNA, 23 nt, Vaccinia virus
agagaucuacuggcgaaauggua

SEQ ID NO: 3275824 - RNA, 17 nt, Vaccinia virus
ugcaaggaaucaucuga

SEQ ID NO: 3275825 - RNA, 21 nt, Vaccinia virus
aguaagacaauaggaaaucua

SEQ ID NO: 3275826 - RNA, 22 nt, Vaccinia virus
aauauauuuggauuuguggugu

SEQ ID NO: 3275827 - RNA, 20 nt, Vaccinia virus
agagucacgaauaacgauau

SEQ ID NO: 3275828 - RNA, 14 nt, Vaccinia virus
aaauacaaauauau

SEQ ID NO: 3275829 - RNA, 20 nt, Vaccinia virus
aaccaacgucauaaaaaugu

SEQ ID NO: 3275830 - RNA, 12 nt, Vaccinia virus
guagauauugcu

SEQ ID NO: 3275831 - RNA, 21 nt, Vaccinia virus
uuaaugcuacagauauuauca

SEQ ID NO: 3275832 - RNA, 13 nt, Vaccinia virus
gacgauauuucug

SEQ ID NO: 3275833 - RNA, 17 nt, Vaccinia virus
augaaaaaaaacacuga

SEQ ID NO: 3275834 - RNA, 15 nt, Vaccinia virus
uuaacaucuauuaau

SEQ ID NO: 3275835 - RNA, 18 nt, Vaccinia virus
uaaaccgauaguguauaa

SEQ ID NO: 3275836 - RNA, 14 nt, Vaccinia virus
ccucucuuaacaaa

SEQ ID NO: 3275837 - RNA, 15 nt, Vaccinia virus
aaccuauaaugucca

SEQ ID NO: 3275838 - RNA, 18 nt, Vaccinia virus
aauaacuaaaaauguaaa

SEQ ID NO: 3275839 - RNA, 13 nt, Vaccinia virus
uccuaucucugac

SEQ ID NO: 3275840 - RNA, 15 nt, Vaccinia virus
aagaaaacaaacauc

SEQ ID NO: 3275841 - RNA, 20 nt, Vaccinia virus
uaugaucaauucuggauuau

SEQ ID NO: 3275842 - RNA, 20 nt, Vaccinia virus
cuuuuagaagugauucuuug

SEQ ID NO: 3275843 - RNA, 21 nt, Vaccinia virus
accaccucucuggaagacagc

SEQ ID NO: 3275844 - RNA, 18 nt, Vaccinia virus
uguauguacggucugaua

SEQ ID NO: 3275845 - RNA, 21 nt, Vaccinia virus
gagauuuguuuuguuaaacaa

SEQ ID NO: 3275846 - RNA, 20 nt, Vaccinia virus
agaucuaaagauaaucuucu

SEQ ID NO: 3275847 - RNA, 19 nt, Vaccinia virus
auauaggaccacuagcaaa

SEQ ID NO: 3275848 - RNA, 15 nt, Vaccinia virus
aacuaguguagaaaa

SEQ ID NO: 3275849 - RNA, 15 nt, Vaccinia virus
cuucaagagaugucu

SEQ ID NO: 3275850 - RNA, 11 nt, Vaccinia virus
cucacauuuca

SEQ ID NO: 3275851 - RNA, 14 nt, Vaccinia virus
gauguuuguucauu

SEQ ID NO: 3275852 - RNA, 19 nt, Vaccinia virus
auucugcggcuauagaaaa

SEQ ID NO: 3275853 - RNA, 18 nt, Vaccinia virus
uacagauguuacaaaugu

SEQ ID NO: 3275854 - RNA, 18 nt, Vaccinia virus
caaaaauuuuuuauuuca

SEQ ID NO: 3275855 - RNA, 21 nt, Vaccinia virus
auucgcuuagcgucuucuaua

SEQ ID NO: 3275856 - RNA, 22 nt, Vaccinia virus
uauaauacuuaaaaauggaugu

SEQ ID NO: 3275857 - RNA, 14 nt, Vaccinia virus
ucaucauuaucauu

SEQ ID NO: 3275858 - RNA, 15 nt, Vaccinia virus
uuaaaauauuauuua

SEQ ID NO: 3275859 - RNA, 13 nt, Vaccinia virus
auuauacaugugu

SEQ ID NO: 3275860 - RNA, 22 nt, Vaccinia virus
uauaagauauccauaucaucau

SEQ ID NO: 3275861 - RNA, 14 nt, Vaccinia virus
ucaaauacuucaaa

SEQ ID NO: 3275862 - RNA, 18 nt, Vaccinia virus
cguuagaguuuauacacu

SEQ ID NO: 3275863 - RNA, 19 nt, Vaccinia virus
auugacgaaacaauguuuc

SEQ ID NO: 3275864 - RNA, 21 nt, Vaccinia virus
uagugugacuuaacuuguaau

SEQ ID NO: 3275865 - RNA, 23 nt, Vaccinia virus
ccuauccaauaauccaucaucug

SEQ ID NO: 3275866 - RNA, 12 nt, Vaccinia virus
uaugacgucucu

SEQ ID NO: 3275867 - RNA, 19 nt, Vaccinia virus
ugcccccauucuuaauaau

SEQ ID NO: 3275868 - RNA, 18 nt, Vaccinia virus
ucagaacacacuuuucuc

SEQ ID NO: 3275869 - RNA, 23 nt, Vaccinia virus
ucugaaauaacguauuuaaacaa

SEQ ID NO: 3275870 - RNA, 17 nt, Vaccinia virus
ugaaguuaugacauuca

SEQ ID NO: 3275871 - RNA, 13 nt, Vaccinia virus
uaucuacacaugu

SEQ ID NO: 3275872 - RNA, 18 nt, Vaccinia virus
uagcaccauuaucuuugu

SEQ ID NO: 3275873 - RNA, 17 nt, Vaccinia virus
ucaaguuaugaaaauag

SEQ ID NO: 3275874 - RNA, 16 nt, Vaccinia virus
aucucucauaagaaag

SEQ ID NO: 3275875 - RNA, 18 nt, Vaccinia virus
agacaaugcuaauauauu

SEQ ID NO: 3275876 - RNA, 14 nt, Vaccinia virus
uauaaccuuaacuu

SEQ ID NO: 3275877 - RNA, 16 nt, Vaccinia virus
uuauuuauauuuggua

SEQ ID NO: 3275878 - RNA, 18 nt, Vaccinia virus
uacuguaaacacauaucc

SEQ ID NO: 3275879 - RNA, 19 nt, Vaccinia virus
uagagauacuuucagucug

SEQ ID NO: 3275880 - RNA, 17 nt, Vaccinia virus
uagagauucgaugguuu

SEQ ID NO: 3275881 - RNA, 21 nt, Vaccinia virus
uauacaagaguggaaacucac

SEQ ID NO: 3275882 - RNA, 16 nt, Vaccinia virus
aaauguauaaaaaacu

SEQ ID NO: 3275883 - RNA, 14 nt, Vaccinia virus
cauuuauacacaau

SEQ ID NO: 3275884 - RNA, 20 nt, Vaccinia virus
gagauuggguuaauaaauac

SEQ ID NO: 3275885 - RNA, 22 nt, Vaccinia virus
gcuauauuccuguuaucaucau

SEQ ID NO: 3275886 - RNA, 15 nt, Vaccinia virus
caucguauacuaaca

SEQ ID NO: 3275887 - RNA, 14 nt, Vaccinia virus
aagauaaaguuuau

SEQ ID NO: 3275888 - RNA, 19 nt, Vaccinia virus
ugcaacggcgaaacaaaau

SEQ ID NO: 3275889 - RNA, 16 nt, Vaccinia virus
acucugaaaagaaagu

SEQ ID NO: 3275890 - RNA, 18 nt, Vaccinia virus
cgugguuguuuaucacaa

SEQ ID NO: 3275891 - RNA, 21 nt, Vaccinia virus
aacgauuugaucgauuacauu

SEQ ID NO: 3275892 - RNA, 21 nt, Vaccinia virus
agguuacguauagucuauaug

SEQ ID NO: 3275893 - RNA, 15 nt, Vaccinia virus
gaucuccaacaaauu

SEQ ID NO: 3275894 - RNA, 17 nt, Vaccinia virus
ucguacaaggauuucaa

SEQ ID NO: 3275895 - RNA, 19 nt, Vaccinia virus
guaagauuccuaaauuagu

SEQ ID NO: 3275896 - RNA, 12 nt, Vaccinia virus
acacuaagaugc

SEQ ID NO: 3275897 - RNA, 17 nt, Vaccinia virus
uuauccauuuauacauu

SEQ ID NO: 3275898 - RNA, 19 nt, Vaccinia virus
gcguucaagauuaucuuua

SEQ ID NO: 3275899 - RNA, 23 nt, Vaccinia virus
gauauuuucuuucuaucauggau

SEQ ID NO: 3275900 - RNA, 18 nt, Vaccinia virus
auuuaacauuuuggcaaa

SEQ ID NO: 3275901 - RNA, 13 nt, Vaccinia virus
caccaaacauauu

SEQ ID NO: 3275902 - RNA, 21 nt, Vaccinia virus
ucuaacuggugaguuaauauu

SEQ ID NO: 3275903 - RNA, 14 nt, Vaccinia virus
gacguguuauuaca

SEQ ID NO: 3275904 - RNA, 16 nt, Vaccinia virus
auacaaauuuuaagaa

SEQ ID NO: 3275905 - RNA, 13 nt, Vaccinia virus
uacuaaaaaaugu

SEQ ID NO: 3275906 - RNA, 20 nt, Vaccinia virus
uguuauuacuacugaagaac

SEQ ID NO: 3275907 - RNA, 17 nt, Vaccinia virus
auauaauuauacuaucg

SEQ ID NO: 3275908 - RNA, 12 nt, Vaccinia virus
aaaguuugagau

SEQ ID NO: 3275909 - RNA, 16 nt, Vaccinia virus
ucuucuacuauugcaa

SEQ ID NO: 3275910 - RNA, 12 nt, Vaccinia virus
auucaaauccuu

SEQ ID NO: 3275911 - RNA, 22 nt, Vaccinia virus
augauuuuacugcaauauguau

SEQ ID NO: 3275912 - RNA, 23 nt, Vaccinia virus
caauuauaugguagauuguuaac

SEQ ID NO: 3275913 - RNA, 20 nt, Vaccinia virus
aguuucuugagugcgaaugu

SEQ ID NO: 3275914 - RNA, 20 nt, Vaccinia virus
cuguaaacuaaguagagauu

SEQ ID NO: 3275915 - RNA, 21 nt, Vaccinia virus
uggaagaugcuauaucaaaau

SEQ ID NO: 3275916 - RNA, 14 nt, Vaccinia virus
auauuguuacacca

SEQ ID NO: 3275917 - RNA, 17 nt, Vaccinia virus
uguauuuauaaccuuuu

SEQ ID NO: 3275918 - RNA, 16 nt, Vaccinia virus
auuuuuaguuacagaa

SEQ ID NO: 3275919 - RNA, 16 nt, Vaccinia virus
auacuaccuguuauau

SEQ ID NO: 3275920 - RNA, 19 nt, Vaccinia virus
augaucgucuuuuguggaa

SEQ ID NO: 3275921 - RNA, 13 nt, Vaccinia virus
gagauuaaugcua

SEQ ID NO: 3275922 - RNA, 17 nt, Vaccinia virus
uaaauuaguucauacac

SEQ ID NO: 3275923 - RNA, 17 nt, Vaccinia virus
aguucauuauaaauucu

SEQ ID NO: 3275924 - RNA, 19 nt, Vaccinia virus
guaagaagauuauauucua

SEQ ID NO: 3275925 - RNA, 15 nt, Vaccinia virus
auuagaugagaaauu

SEQ ID NO: 3275926 - RNA, 15 nt, Vaccinia virus
gacauaguaauacau

SEQ ID NO: 3275927 - RNA, 13 nt, Vaccinia virus
caagaaugauauc

SEQ ID NO: 3275928 - RNA, 14 nt, Vaccinia virus
ucacuagaaacuag

SEQ ID NO: 3275929 - RNA, 23 nt, Vaccinia virus
uucuccaugaauuaauacauauu

SEQ ID NO: 3275930 - RNA, 14 nt, Vaccinia virus
uuuuaaggggaaaa

SEQ ID NO: 3275931 - RNA, 16 nt, Vaccinia virus
uggauuaaacauacua

SEQ ID NO: 3275932 - RNA, 23 nt, Vaccinia virus
cuacuaguauagaucaaauacuu

SEQ ID NO: 3275933 - RNA, 19 nt, Vaccinia virus
cuuuaucucauuugagaau

SEQ ID NO: 3275934 - RNA, 19 nt, Vaccinia virus
uacauggucucagaaguag

SEQ ID NO: 3275935 - RNA, 14 nt, Vaccinia virus
acuacuucauuaau

SEQ ID NO: 3275936 - RNA, 13 nt, Vaccinia virus
uaauaagaauaaa

SEQ ID NO: 3275937 - RNA, 21 nt, Vaccinia virus
uaucucacccucuuggaucau

SEQ ID NO: 3275938 - RNA, 23 nt, Vaccinia virus
auagaacacccguagaaauacua

SEQ ID NO: 3275939 - RNA, 14 nt, Vaccinia virus
ucagcgugauuuuc

SEQ ID NO: 3275940 - RNA, 23 nt, Vaccinia virus
gaacagcuaucaaaauauguaga

SEQ ID NO: 3275941 - RNA, 22 nt, Vaccinia virus
auagagcccacguuuaaacauu

SEQ ID NO: 3275942 - RNA, 23 nt, Vaccinia virus
aucuuuaacgauaccuauaccua

SEQ ID NO: 3275943 - RNA, 19 nt, Vaccinia virus
uucuuaucaauaacauauu

SEQ ID NO: 3275944 - RNA, 14 nt, Vaccinia virus
aaaaagaugauaua

SEQ ID NO: 3275945 - RNA, 20 nt, Vaccinia virus
ucuauuagaguauugcauuu

SEQ ID NO: 3275946 - RNA, 19 nt, Vaccinia virus
ucagaacgcucgucaauau

SEQ ID NO: 3275947 - RNA, 19 nt, Vaccinia virus
aacagagccaucuguaaaa

SEQ ID NO: 3275948 - RNA, 15 nt, Vaccinia virus
guaauggauaaugac

SEQ ID NO: 3275949 - RNA, 12 nt, Vaccinia virus
aguuucagaauu

SEQ ID NO: 3275950 - RNA, 23 nt, Vaccinia virus
ugauucgaauuuaguuucuucga

SEQ ID NO: 3275951 - RNA, 18 nt, Vaccinia virus
acagauggauuaaaucgu

SEQ ID NO: 3275952 - RNA, 22 nt, Vaccinia virus
aaaacugguuuaacuaauaaua

SEQ ID NO: 3275953 - RNA, 13 nt, Vaccinia virus
caucuauuccaaa

SEQ ID NO: 3275954 - RNA, 15 nt, Vaccinia virus
gauaauuauuuccag

SEQ ID NO: 3275955 - RNA, 13 nt, Vaccinia virus
gcaguuucaauau

SEQ ID NO: 3275956 - RNA, 21 nt, Vaccinia virus
aauauuuaguuuauucauaau

SEQ ID NO: 3275957 - RNA, 11 nt, Vaccinia virus
ggauacaaaaa

SEQ ID NO: 3275958 - RNA, 17 nt, Vaccinia virus
uauccuauauacgaaaa

SEQ ID NO: 3275959 - RNA, 22 nt, Vaccinia virus
aaucuaauaacuugaaagagau

SEQ ID NO: 3275960 - RNA, 17 nt, Vaccinia virus
ugauuacauuuuugaua

SEQ ID NO: 3275961 - RNA, 16 nt, Vaccinia virus
aucacauaugcaaaga

SEQ ID NO: 3275962 - RNA, 13 nt, Vaccinia virus
uguuuuauaaaau

SEQ ID NO: 3275963 - RNA, 22 nt, Vaccinia virus
ugaguaguuggaagaaucucau

SEQ ID NO: 3275964 - RNA, 16 nt, Vaccinia virus
uguauaaucaacucua

SEQ ID NO: 3275965 - RNA, 16 nt, Vaccinia virus
agaaugaagauaucau

SEQ ID NO: 3275966 - RNA, 13 nt, Vaccinia virus
agacguuguacaa

SEQ ID NO: 3275967 - RNA, 18 nt, Vaccinia virus
uaaauauugauguuaaua

SEQ ID NO: 3275968 - RNA, 15 nt, Vaccinia virus
uauuauuuaaacgaa

SEQ ID NO: 3275969 - RNA, 17 nt, Vaccinia virus
cuguacaccauagcacu

SEQ ID NO: 3275970 - RNA, 15 nt, Vaccinia virus
gcaaagaaugaugac

SEQ ID NO: 3275971 - RNA, 23 nt, Vaccinia virus
agacaagcggguaaaugauuauu

SEQ ID NO: 3275972 - RNA, 19 nt, Vaccinia virus
auuguauacugucuaaacg

SEQ ID NO: 3275973 - RNA, 13 nt, Vaccinia virus
uaauauuuugcau

SEQ ID NO: 3275974 - RNA, 17 nt, Vaccinia virus
ucuacuuuaucuauuca

SEQ ID NO: 3275975 - RNA, 13 nt, Vaccinia virus
ugaauaaggaaua

SEQ ID NO: 3275976 - RNA, 17 nt, Vaccinia virus
ucauuaaguucacuaga

SEQ ID NO: 3275977 - RNA, 15 nt, Vaccinia virus
aauaugugcucugcg

SEQ ID NO: 3275978 - RNA, 22 nt, Vaccinia virus
caagaauauacaaguauuauuu

SEQ ID NO: 3275979 - RNA, 19 nt, Vaccinia virus
uaauaucuauauuuccagc

SEQ ID NO: 3275980 - RNA, 13 nt, Vaccinia virus
caacaaugauaua

SEQ ID NO: 3275981 - RNA, 17 nt, Vaccinia virus
aaguuaguuauuuuacg

SEQ ID NO: 3275982 - RNA, 22 nt, Vaccinia virus
aucuaaacagacgacaacaugu

SEQ ID NO: 3275983 - RNA, 23 nt, Vaccinia virus
aucaagauguguauguuugugaa

SEQ ID NO: 3275984 - RNA, 13 nt, Vaccinia virus
aauauucuguucu

SEQ ID NO: 3275985 - RNA, 9 nt, Vaccinia virus
uuagaaaaa

SEQ ID NO: 3275986 - RNA, 14 nt, Vaccinia virus
ugcagaauauuucu

SEQ ID NO: 3275987 - RNA, 22 nt, Vaccinia virus
ucuugaggguuguguuaaauug

SEQ ID NO: 3275988 - RNA, 18 nt, Vaccinia virus
uugauauauaauuuacag

SEQ ID NO: 3275989 - RNA, 12 nt, Vaccinia virus
cauaacauaauu

SEQ ID NO: 3275990 - RNA, 21 nt, Vaccinia virus
agacugacuucuaacaaacau

SEQ ID NO: 3275991 - RNA, 16 nt, Vaccinia virus
auaaucaauacggcca

SEQ ID NO: 3275992 - RNA, 17 nt, Vaccinia virus
uggaugauauagaucuu

SEQ ID NO: 3275993 - RNA, 16 nt, Vaccinia virus
uuaaauuauuauuaau

SEQ ID NO: 3275994 - RNA, 17 nt, Vaccinia virus
caagaacuacaaaaguu

SEQ ID NO: 3275995 - RNA, 14 nt, Vaccinia virus
uacagauacagaua

SEQ ID NO: 3275996 - RNA, 21 nt, Vaccinia virus
uaaguuacagcgacacgguau

SEQ ID NO: 3275997 - RNA, 19 nt, Vaccinia virus
auuguaaaagacaaauaua

SEQ ID NO: 3275998 - RNA, 19 nt, Vaccinia virus
ucgucugugaaacaucacg

SEQ ID NO: 3275999 - RNA, 14 nt, Vaccinia virus
cuuaacuauuuccg

SEQ ID NO: 3276000 - RNA, 13 nt, Vaccinia virus
cuuuauuaucuau

SEQ ID NO: 3276001 - RNA, 22 nt, Vaccinia virus
ccagauggaguggaagacacug

SEQ ID NO: 3276002 - RNA, 23 nt, Vaccinia virus
ucguuccaagucauaucuagaau

SEQ ID NO: 3276003 - RNA, 14 nt, Vaccinia virus
uauaauguagacau

SEQ ID NO: 3276004 - RNA, 15 nt, Vaccinia virus
guacaacauacuguu

SEQ ID NO: 3276005 - RNA, 17 nt, Vaccinia virus
gaggcuaaaacacauuu

SEQ ID NO: 3276006 - RNA, 15 nt, Vaccinia virus
ucacucaauaucuag

SEQ ID NO: 3276007 - RNA, 19 nt, Vaccinia virus
gaaucuaccuauagaaaag

SEQ ID NO: 3276008 - RNA, 16 nt, Vaccinia virus
agcauauuagaaucua

SEQ ID NO: 3276009 - RNA, 22 nt, Vaccinia virus
ugcaucaacaauuacaaaugag

SEQ ID NO: 3276010 - RNA, 17 nt, Vaccinia virus
augacuuaugaauacua

SEQ ID NO: 3276011 - RNA, 15 nt, Vaccinia virus
ccaucucuauguuuc

SEQ ID NO: 3276012 - RNA, 17 nt, Vaccinia virus
cagcggcuauuaauaau

SEQ ID NO: 3276013 - RNA, 23 nt, Vaccinia virus
uaccaucuucuuugauuaaugau

SEQ ID NO: 3276014 - RNA, 22 nt, Vaccinia virus
cuaauugaucaagaguaacuau

SEQ ID NO: 3276015 - RNA, 23 nt, Vaccinia virus
agauauuauacaaaauacuauau

SEQ ID NO: 3276016 - RNA, 14 nt, Vaccinia virus
aagucauaaaucau

SEQ ID NO: 3276017 - RNA, 15 nt, Vaccinia virus
uuauuucuucugaau

SEQ ID NO: 3276018 - RNA, 23 nt, Vaccinia virus
aucauuucuauaauuuaggaaug

SEQ ID NO: 3276019 - RNA, 20 nt, Vaccinia virus
gaggaguuauugauauuaac

SEQ ID NO: 3276020 - RNA, 20 nt, Vaccinia virus
uaauuucguuaaaacauuca

SEQ ID NO: 3276021 - RNA, 16 nt, Vaccinia virus
caaacaauuuuaacag

SEQ ID NO: 3276022 - RNA, 14 nt, Vaccinia virus
auuaucaaaagaca

SEQ ID NO: 3276023 - RNA, 17 nt, Vaccinia virus
aauuuuuucguguucca

SEQ ID NO: 3276024 - RNA, 17 nt, Vaccinia virus
uuuuuaaaaucaucauu

SEQ ID NO: 3276025 - RNA, 18 nt, Vaccinia virus
guuagaaagcagauuaga

SEQ ID NO: 3276026 - RNA, 19 nt, Vaccinia virus
gauuccacggaagaacuac

SEQ ID NO: 3276027 - RNA, 15 nt, Vaccinia virus
uuaacguauaaauga

SEQ ID NO: 3276028 - RNA, 22 nt, Vaccinia virus
gucucauggccguguaugaaau

SEQ ID NO: 3276029 - RNA, 22 nt, Vaccinia virus
uaagaauaauuuugaagcauug

SEQ ID NO: 3276030 - RNA, 17 nt, Vaccinia virus
uagaacuuuuaauuuug

SEQ ID NO: 3276031 - RNA, 23 nt, Vaccinia virus
uuagcaucagucuccacacuauu

SEQ ID NO: 3276032 - RNA, 18 nt, Vaccinia virus
cguaagauaaaguuuaua

SEQ ID NO: 3276033 - RNA, 16 nt, Vaccinia virus
aauacacguuaauaca

SEQ ID NO: 3276034 - RNA, 20 nt, Vaccinia virus
aguaucuuuuguucuagaug

SEQ ID NO: 3276035 - RNA, 15 nt, Vaccinia virus
aguuggaaguuuaau

SEQ ID NO: 3276036 - RNA, 15 nt, Vaccinia virus
cucguuuaaacagaa

SEQ ID NO: 3276037 - RNA, 21 nt, Vaccinia virus
ugaagaauuuauauaaaucau

SEQ ID NO: 3276038 - RNA, 12 nt, Vaccinia virus
gaauauauuaau

SEQ ID NO: 3276039 - RNA, 16 nt, Vaccinia virus
uauacuaaucaauaau

SEQ ID NO: 3276040 - RNA, 13 nt, Vaccinia virus
uaauaucauauag

SEQ ID NO: 3276041 - RNA, 16 nt, Vaccinia virus
cguucuuugaugugga

SEQ ID NO: 3276042 - RNA, 23 nt, Vaccinia virus
uggaaaacuuuaauaacaaagaa

SEQ ID NO: 3276043 - RNA, 19 nt, Vaccinia virus
gaugaaggugggacuauau

SEQ ID NO: 3276044 - RNA, 19 nt, Vaccinia virus
uaacaaaaauuaugaaaua

SEQ ID NO: 3276045 - RNA, 21 nt, Vaccinia virus
uauccgcacaugcagaagaac

SEQ ID NO: 3276046 - RNA, 14 nt, Vaccinia virus
auggaaaguguaaa

SEQ ID NO: 3276047 - RNA, 13 nt, Vaccinia virus
aauggauccacug

SEQ ID NO: 3276048 - RNA, 21 nt, Vaccinia virus
uugucugacugaauacauccu

SEQ ID NO: 3276049 - RNA, 12 nt, Vaccinia virus
agcaaaaauaua

SEQ ID NO: 3276050 - RNA, 17 nt, Vaccinia virus
aucacuguagugcuaug

SEQ ID NO: 3276051 - RNA, 15 nt, Vaccinia virus
agccaauacuuuaac

SEQ ID NO: 3276052 - RNA, 20 nt, Vaccinia virus
uauaauacggacuucauaau

SEQ ID NO: 3276053 - RNA, 22 nt, Vaccinia virus
auaaccacaucuggaaggcuua

SEQ ID NO: 3276054 - RNA, 20 nt, Vaccinia virus
cuuaagaaaauuauuacuag

SEQ ID NO: 3276055 - RNA, 15 nt, Vaccinia virus
aauuagaaagugaua

SEQ ID NO: 3276056 - RNA, 16 nt, Vaccinia virus
caauuuagcugcauua

SEQ ID NO: 3276057 - RNA, 17 nt, Vaccinia virus
guauucugaugauauua

SEQ ID NO: 3276058 - RNA, 15 nt, Vaccinia virus
auuucacuacuaucu

SEQ ID NO: 3276059 - RNA, 23 nt, Vaccinia virus
aucgaucaaaagacuauacauuu

SEQ ID NO: 3276060 - RNA, 12 nt, Vaccinia virus
uugauuuuggaa

SEQ ID NO: 3276061 - RNA, 17 nt, Vaccinia virus
uaucaauccaacaaaug

SEQ ID NO: 3276062 - RNA, 22 nt, Vaccinia virus
uuuauuaaugucaggaaaugua

SEQ ID NO: 3276063 - RNA, 15 nt, Vaccinia virus
cuagacaauauucca

SEQ ID NO: 3276064 - RNA, 17 nt, Vaccinia virus
auuauuaaacaauacuc

SEQ ID NO: 3276065 - RNA, 14 nt, Vaccinia virus
acuaucuaaaugua

SEQ ID NO: 3276066 - RNA, 22 nt, Vaccinia virus
auauuuggcuaaacuauauaau

SEQ ID NO: 3276067 - RNA, 23 nt, Vaccinia virus
acaucuaaaaaauccuuaaugau

SEQ ID NO: 3276068 - RNA, 16 nt, Vaccinia virus
aauuuguucaaaauaa

SEQ ID NO: 3276069 - RNA, 22 nt, Vaccinia virus
gacacugaacacguuaacgaua

SEQ ID NO: 3276070 - RNA, 15 nt, Vaccinia virus
aaugacuccaugaaa

SEQ ID NO: 3276071 - RNA, 11 nt, Vaccinia virus
gauuaguucuu

SEQ ID NO: 3276072 - RNA, 23 nt, Vaccinia virus
aagaagaaauacuaaaaaaugua

SEQ ID NO: 3276073 - RNA, 20 nt, Vaccinia virus
aucuaaagaugaugcuauuu

SEQ ID NO: 3276074 - RNA, 13 nt, Vaccinia virus
auagaaaaugauu

SEQ ID NO: 3276075 - RNA, 19 nt, Vaccinia virus
uaaagauacaaauaugucu

SEQ ID NO: 3276076 - RNA, 13 nt, Vaccinia virus
guaauaaucuguu

SEQ ID NO: 3276077 - RNA, 20 nt, Vaccinia virus
augucuaaugaugaacacaa

SEQ ID NO: 3276078 - RNA, 12 nt, Vaccinia virus
gaauauugauuu

SEQ ID NO: 3276079 - RNA, 16 nt, Vaccinia virus
acuauuauuuguuaua

SEQ ID NO: 3276080 - RNA, 16 nt, Vaccinia virus
auuauccguauuucca

SEQ ID NO: 3276081 - RNA, 20 nt, Vaccinia virus
ucuuaguauugaaaugugua

SEQ ID NO: 3276082 - RNA, 19 nt, Vaccinia virus
guagacuuacuaaagucaa

SEQ ID NO: 3276083 - RNA, 23 nt, Vaccinia virus
auacuauaccguugugucuacaa

SEQ ID NO: 3276084 - RNA, 21 nt, Vaccinia virus
auagaaaauaacagauauuac

SEQ ID NO: 3276085 - RNA, 19 nt, Vaccinia virus
uguaaaaagauaaacuuua

SEQ ID NO: 3276086 - RNA, 22 nt, Vaccinia virus
aaauugauagagaguucauuua

SEQ ID NO: 3276087 - RNA, 16 nt, Vaccinia virus
agaggaguuauuuacu

SEQ ID NO: 3276088 - RNA, 17 nt, Vaccinia virus
aguuucugguuuucuau

SEQ ID NO: 3276089 - RNA, 15 nt, Vaccinia virus
augauaaugauacag

SEQ ID NO: 3276090 - RNA, 14 nt, Vaccinia virus
gccaacuauacauc

SEQ ID NO: 3276091 - RNA, 18 nt, Vaccinia virus
uaucucuauuaaaugcgu

SEQ ID NO: 3276092 - RNA, 13 nt, Vaccinia virus
cauaauaucuuua

SEQ ID NO: 3276093 - RNA, 23 nt, Vaccinia virus
gaugccgccaucguugauuacaa

SEQ ID NO: 3276094 - RNA, 13 nt, Vaccinia virus
uauuguuaucgua

SEQ ID NO: 3276095 - RNA, 12 nt, Vaccinia virus
ugucuacauaaa

SEQ ID NO: 3276096 - RNA, 15 nt, Vaccinia virus
ugucuauuaucuguu

SEQ ID NO: 3276097 - RNA, 14 nt, Vaccinia virus
uagaaaauggauuu

SEQ ID NO: 3276098 - RNA, 15 nt, Vaccinia virus
auccguuaaguuugu

SEQ ID NO: 3276099 - RNA, 16 nt, Vaccinia virus
agauaguuuucucuau

SEQ ID NO: 3276100 - RNA, 18 nt, Vaccinia virus
agacagugguuucauguu

SEQ ID NO: 3276101 - RNA, 17 nt, Vaccinia virus
auagcaaccaguguuug

SEQ ID NO: 3276102 - RNA, 15 nt, Vaccinia virus
aauuauuuuguaaga

SEQ ID NO: 3276103 - RNA, 14 nt, Vaccinia virus
augagggaaaagau

SEQ ID NO: 3276104 - RNA, 21 nt, Vaccinia virus
auauaacguaaccagaauugu

SEQ ID NO: 3276105 - RNA, 14 nt, Vaccinia virus
auccaaaguauuuu

SEQ ID NO: 3276106 - RNA, 11 nt, Vaccinia virus
aucaugucuaa

SEQ ID NO: 3276107 - RNA, 20 nt, Vaccinia virus
cauucucuucucugcauuua

SEQ ID NO: 3276108 - RNA, 16 nt, Vaccinia virus
agaaacggaggagaac

SEQ ID NO: 3276109 - RNA, 23 nt, Vaccinia virus
auauauuuucacuuuaucucauu

SEQ ID NO: 3276110 - RNA, 17 nt, Vaccinia virus
agaugcuggaagacaag

SEQ ID NO: 3276111 - RNA, 22 nt, Vaccinia virus
gucaaagguauaugauaaacua

SEQ ID NO: 3276112 - RNA, 20 nt, Vaccinia virus
caguuuuaagaugucauaau

SEQ ID NO: 3276113 - RNA, 18 nt, Vaccinia virus
uuugguaauggcaaugua

SEQ ID NO: 3276114 - RNA, 16 nt, Vaccinia virus
uaacacaaaaugugaa

SEQ ID NO: 3276115 - RNA, 22 nt, Vaccinia virus
auaguuagcgucaacuuucaua

SEQ ID NO: 3276116 - RNA, 14 nt, Vaccinia virus
uaaaacauuuccua

SEQ ID NO: 3276117 - RNA, 14 nt, Vaccinia virus
auauuauguuuuau

SEQ ID NO: 3276118 - RNA, 13 nt, Vaccinia virus
acuaacuauugaa

SEQ ID NO: 3276119 - RNA, 18 nt, Vaccinia virus
auacuccuucaugaacau

SEQ ID NO: 3276120 - RNA, 15 nt, Vaccinia virus
auugaugucuacaca

SEQ ID NO: 3276121 - RNA, 23 nt, Vaccinia virus
uguaaacagauaugguguagcau

SEQ ID NO: 3276122 - RNA, 12 nt, Vaccinia virus
aaagauuguaca

SEQ ID NO: 3276123 - RNA, 15 nt, Vaccinia virus
uaaauccuuguuuga

SEQ ID NO: 3276124 - RNA, 13 nt, Vaccinia virus
ugaugauaauguu

SEQ ID NO: 3276125 - RNA, 19 nt, Vaccinia virus
ugguuaaaaccuuugcaaa

SEQ ID NO: 3276126 - RNA, 15 nt, Vaccinia virus
uauggaugccacugc

SEQ ID NO: 3276127 - RNA, 13 nt, Vaccinia virus
uaaguuggaugaa

SEQ ID NO: 3276128 - RNA, 15 nt, Vaccinia virus
uuaguuccaacaauu

SEQ ID NO: 3276129 - RNA, 13 nt, Vaccinia virus
uaaauucauauaa

SEQ ID NO: 3276130 - RNA, 17 nt, Vaccinia virus
aucagauaaguaugaag

SEQ ID NO: 3276131 - RNA, 17 nt, Vaccinia virus
uuuguuaaaaauuuaga

SEQ ID NO: 3276132 - RNA, 17 nt, Vaccinia virus
uauuuaguuuauucaua

SEQ ID NO: 3276133 - RNA, 18 nt, Vaccinia virus
cauguauacuugacaaaa

SEQ ID NO: 3276134 - RNA, 14 nt, Vaccinia virus
aaucaagaaugaua

SEQ ID NO: 3276135 - RNA, 22 nt, Vaccinia virus
uuaguaagugccacaaaacaga

SEQ ID NO: 3276136 - RNA, 21 nt, Vaccinia virus
ugacggagcccaauuuuggug

SEQ ID NO: 3276137 - RNA, 21 nt, Vaccinia virus
acuagacguuuauucucaaau

SEQ ID NO: 3276138 - RNA, 15 nt, Vaccinia virus
ucuagauaaaaucac

SEQ ID NO: 3276139 - RNA, 21 nt, Vaccinia virus
caguaauagcuccauaaacug

SEQ ID NO: 3276140 - RNA, 23 nt, Vaccinia virus
gauuccauggaagcucuagagua

SEQ ID NO: 3276141 - RNA, 20 nt, Vaccinia virus
augcuccaauugaaugucau

SEQ ID NO: 3276142 - RNA, 17 nt, Vaccinia virus
uauucaagcaaaaacaa

SEQ ID NO: 3276143 - RNA, 19 nt, Vaccinia virus
auuuauaaccuuuuccuua

SEQ ID NO: 3276144 - RNA, 18 nt, Vaccinia virus
uaaacggcuuuuaaacag

SEQ ID NO: 3276145 - RNA, 16 nt, Vaccinia virus
ugauauauaauuuaca

SEQ ID NO: 3276146 - RNA, 16 nt, Vaccinia virus
aagauuacuacacuug

SEQ ID NO: 3276147 - RNA, 16 nt, Vaccinia virus
caaugagaguuccuga

SEQ ID NO: 3276148 - RNA, 21 nt, Vaccinia virus
gaacaucuugauuauaauaua

SEQ ID NO: 3276149 - RNA, 15 nt, Vaccinia virus
aacaggaaagaagua

SEQ ID NO: 3276150 - RNA, 15 nt, Vaccinia virus
uacacucuauuucaa

SEQ ID NO: 3276151 - RNA, 22 nt, Vaccinia virus
cuaaaauuccuaacgaugauau

SEQ ID NO: 3276152 - RNA, 13 nt, Vaccinia virus
uauuaauggauuu

SEQ ID NO: 3276153 - RNA, 16 nt, Vaccinia virus
ucucaauaguuucaua

SEQ ID NO: 3276154 - RNA, 16 nt, Vaccinia virus
agcuaagcaacuaaga

SEQ ID NO: 3276155 - RNA, 20 nt, Vaccinia virus
acaauuugggacaaugaauu

SEQ ID NO: 3276156 - RNA, 16 nt, Vaccinia virus
agacguacuccagaua

SEQ ID NO: 3276157 - RNA, 15 nt, Vaccinia virus
uacaaauauucacaa

SEQ ID NO: 3276158 - RNA, 17 nt, Vaccinia virus
auaacgaaaauaucaca

SEQ ID NO: 3276159 - RNA, 17 nt, Vaccinia virus
uguuaaauuuucuaaug

SEQ ID NO: 3276160 - RNA, 17 nt, Vaccinia virus
agacugguagagaauga

SEQ ID NO: 3276161 - RNA, 23 nt, Vaccinia virus
cgaagaaaaaaauggaaauacuu

SEQ ID NO: 3276162 - RNA, 20 nt, Vaccinia virus
aaagucguuuauaucacauu

SEQ ID NO: 3276163 - RNA, 18 nt, Vaccinia virus
uaucaauagcaguuuauu

SEQ ID NO: 3276164 - RNA, 19 nt, Vaccinia virus
aucauauuauaaagaugau

SEQ ID NO: 3276165 - RNA, 18 nt, Vaccinia virus
cgcaauuauauaauguau

SEQ ID NO: 3276166 - RNA, 20 nt, Vaccinia virus
uauuuuacauggauuuauca

SEQ ID NO: 3276167 - RNA, 20 nt, Vaccinia virus
acugacuucuaacaaacauc

SEQ ID NO: 3276168 - RNA, 16 nt, Vaccinia virus
aucuuuuuaggaaugu

SEQ ID NO: 3276169 - RNA, 21 nt, Vaccinia virus
uuccauuuauaucauccaaua

SEQ ID NO: 3276170 - RNA, 19 nt, Vaccinia virus
agaucuaauaaauggagaa

SEQ ID NO: 3276171 - RNA, 21 nt, Vaccinia virus
acugucucauacacuacagua

SEQ ID NO: 3276172 - RNA, 17 nt, Vaccinia virus
agauaucuauacuuacu

SEQ ID NO: 3276173 - RNA, 22 nt, Vaccinia virus
gccccgcuucuauuuacucccg

SEQ ID NO: 3276174 - RNA, 14 nt, Vaccinia virus
acuccuuuaauagg

SEQ ID NO: 3276175 - RNA, 20 nt, Vaccinia virus
auggauuaucggaaauacuu

SEQ ID NO: 3276176 - RNA, 19 nt, Vaccinia virus
cgaaugccaauguuaauuu

SEQ ID NO: 3276177 - RNA, 13 nt, Vaccinia virus
cuacuauagaauu

SEQ ID NO: 3276178 - RNA, 15 nt, Vaccinia virus
agauauauuauaauu

SEQ ID NO: 3276179 - RNA, 22 nt, Vaccinia virus
uagaugauagagguaauacuuu

SEQ ID NO: 3276180 - RNA, 18 nt, Vaccinia virus
ccggaguaauugauuaua

SEQ ID NO: 3276181 - RNA, 14 nt, Vaccinia virus
uaagucuauuugaa

SEQ ID NO: 3276182 - RNA, 18 nt, Vaccinia virus
aaguuucguacaaauaca

SEQ ID NO: 3276183 - RNA, 13 nt, Vaccinia virus
uauuaaauuuaga

SEQ ID NO: 3276184 - RNA, 13 nt, Vaccinia virus
cgauuuaugugac

SEQ ID NO: 3276185 - RNA, 14 nt, Vaccinia virus
uacugucuuuugug

SEQ ID NO: 3276186 - RNA, 18 nt, Vaccinia virus
cuucagaauacaaucugu

SEQ ID NO: 3276187 - RNA, 18 nt, Vaccinia virus
cguagauaauauuucuag

SEQ ID NO: 3276188 - RNA, 13 nt, Vaccinia virus
uacaauacaugua

SEQ ID NO: 3276189 - RNA, 21 nt, Vaccinia virus
uggcguguggauuugguaaga

SEQ ID NO: 3276190 - RNA, 14 nt, Vaccinia virus
aaguaccuggaaug

SEQ ID NO: 3276191 - RNA, 12 nt, Vaccinia virus
acuacaauaauu

SEQ ID NO: 3276192 - RNA, 18 nt, Vaccinia virus
uaguauccauuuuacauu

SEQ ID NO: 3276193 - RNA, 16 nt, Vaccinia virus
auuucaucugugguau

SEQ ID NO: 3276194 - RNA, 14 nt, Vaccinia virus
cauuaauacaguaa

SEQ ID NO: 3276195 - RNA, 21 nt, Vaccinia virus
gaacacgauuauuauaaaaua

SEQ ID NO: 3276196 - RNA, 14 nt, Vaccinia virus
ucauaaauuacaca

SEQ ID NO: 3276197 - RNA, 12 nt, Vaccinia virus
uacugcaauaau

SEQ ID NO: 3276198 - RNA, 13 nt, Vaccinia virus
auuuuuuugaaau

SEQ ID NO: 3276199 - RNA, 18 nt, Vaccinia virus
caauuuuaacagauguau

SEQ ID NO: 3276200 - RNA, 15 nt, Vaccinia virus
uucuagcgcugauuu

SEQ ID NO: 3276201 - RNA, 21 nt, Vaccinia virus
cgaucuuguuguuuauuuuca

SEQ ID NO: 3276202 - RNA, 23 nt, Vaccinia virus
uaaaauaaucauacaaucuagua

SEQ ID NO: 3276203 - RNA, 17 nt, Vaccinia virus
uacauggacucauuaaa

SEQ ID NO: 3276204 - RNA, 23 nt, Vaccinia virus
aaauuaaaaaauaacuuaauuua

SEQ ID NO: 3276205 - RNA, 16 nt, Vaccinia virus
gcaagacuaacacaca

SEQ ID NO: 3276206 - RNA, 18 nt, Vaccinia virus
aacgauuagcuacagagu

SEQ ID NO: 3276207 - RNA, 14 nt, Vaccinia virus
aaacugguaaucca

SEQ ID NO: 3276208 - RNA, 17 nt, Vaccinia virus
cgauucaaauaaaucac

SEQ ID NO: 3276209 - RNA, 17 nt, Vaccinia virus
aucuuauuuuuaacaaa

SEQ ID NO: 3276210 - RNA, 19 nt, Vaccinia virus
aguauuuuuacaaaaaugu

SEQ ID NO: 3276211 - RNA, 15 nt, Vaccinia virus
auucuagaccaaaaa

SEQ ID NO: 3276212 - RNA, 15 nt, Vaccinia virus
agucuccacacuauu

SEQ ID NO: 3276213 - RNA, 20 nt, Vaccinia virus
uggauagagauugagauucu

SEQ ID NO: 3276214 - RNA, 21 nt, Vaccinia virus
caaaggagaugauuuaucuau

SEQ ID NO: 3276215 - RNA, 22 nt, Vaccinia virus
cugguaauccacauaguuguaa

SEQ ID NO: 3276216 - RNA, 21 nt, Vaccinia virus
aucauaucuauaggaaaggau

SEQ ID NO: 3276217 - RNA, 13 nt, Vaccinia virus
acaaaauaaugua

SEQ ID NO: 3276218 - RNA, 18 nt, Vaccinia virus
auuauuaucuuuagaaau

SEQ ID NO: 3276219 - RNA, 16 nt, Vaccinia virus
auuacauuuuaucaga

SEQ ID NO: 3276220 - RNA, 20 nt, Vaccinia virus
uauugcgcaucgauaucuuu

SEQ ID NO: 3276221 - RNA, 19 nt, Vaccinia virus
uaaguucauuaucugaaau

SEQ ID NO: 3276222 - RNA, 17 nt, Vaccinia virus
gcauucuucauucuauu

SEQ ID NO: 3276223 - RNA, 19 nt, Vaccinia virus
guuccggaucuauagaaga

SEQ ID NO: 3276224 - RNA, 19 nt, Vaccinia virus
auaacauucuuaaacaaua

SEQ ID NO: 3276225 - RNA, 14 nt, Vaccinia virus
cagaucaaaacaaa

SEQ ID NO: 3276226 - RNA, 12 nt, Vaccinia virus
uucauuaauuuc

SEQ ID NO: 3276227 - RNA, 14 nt, Vaccinia virus
auaaaguguucauc

SEQ ID NO: 3276228 - RNA, 19 nt, Vaccinia virus
auaaacugcgccaaauugu

SEQ ID NO: 3276229 - RNA, 20 nt, Vaccinia virus
aagauaccaguauaccucaa

SEQ ID NO: 3276230 - RNA, 18 nt, Vaccinia virus
aauggcuguuuguauaau

SEQ ID NO: 3276231 - RNA, 20 nt, Vaccinia virus
acaagcgagugcuucuucuu

SEQ ID NO: 3276232 - RNA, 23 nt, Vaccinia virus
uuuuacgacacgcauuugaugca

SEQ ID NO: 3276233 - RNA, 22 nt, Vaccinia virus
acuuuaauccuguguuuauaga

SEQ ID NO: 3276234 - RNA, 19 nt, Vaccinia virus
augccuuuccuggaauauc

SEQ ID NO: 3276235 - RNA, 20 nt, Vaccinia virus
acaggaccguauuagaaugu

SEQ ID NO: 3276236 - RNA, 21 nt, Vaccinia virus
ucuuccagcauccguuucuaa

SEQ ID NO: 3276237 - RNA, 17 nt, Vaccinia virus
ugguaaugaaauuauuc

SEQ ID NO: 3276238 - RNA, 19 nt, Vaccinia virus
guaucaaaaaauuacuuuu

SEQ ID NO: 3276239 - RNA, 15 nt, Vaccinia virus
augugagcaaagauu

SEQ ID NO: 3276240 - RNA, 14 nt, Vaccinia virus
gucgauaacaaauu

SEQ ID NO: 3276241 - RNA, 16 nt, Vaccinia virus
aaaaccguuaaaaugu

SEQ ID NO: 3276242 - RNA, 19 nt, Vaccinia virus
uauuaguugaugugacugu

SEQ ID NO: 3276243 - RNA, 20 nt, Vaccinia virus
aaguagaaauuaucaaaugu

SEQ ID NO: 3276244 - RNA, 16 nt, Vaccinia virus
auauuuguuaaugccu

SEQ ID NO: 3276245 - RNA, 15 nt, Vaccinia virus
gauauucuaugaauu

SEQ ID NO: 3276246 - RNA, 17 nt, Vaccinia virus
uuagcaaaauuauuaau

SEQ ID NO: 3276247 - RNA, 17 nt, Vaccinia virus
auagauacgcauuuucu

SEQ ID NO: 3276248 - RNA, 15 nt, Vaccinia virus
cuuagaaauaaacga

SEQ ID NO: 3276249 - RNA, 21 nt, Vaccinia virus
uauguauuguaccaaagauuu

SEQ ID NO: 3276250 - RNA, 22 nt, Vaccinia virus
aucggcauuuauguuucuuuaa

SEQ ID NO: 3276251 - RNA, 19 nt, Vaccinia virus
caaaggauccgacccuaau

SEQ ID NO: 3276252 - RNA, 19 nt, Vaccinia virus
aacauauauaauaaauaac

SEQ ID NO: 3276253 - RNA, 13 nt, Vaccinia virus
gaucguaaugaac

SEQ ID NO: 3276254 - RNA, 18 nt, Vaccinia virus
uagaauaagaacuauaaa

SEQ ID NO: 3276255 - RNA, 18 nt, Vaccinia virus
aucgcauacuaguauuua

SEQ ID NO: 3276256 - RNA, 14 nt, Vaccinia virus
uauauuuuuggauu

SEQ ID NO: 3276257 - RNA, 18 nt, Vaccinia virus
cucuauuucuuaaugaau

SEQ ID NO: 3276258 - RNA, 15 nt, Vaccinia virus
uaaaacgauaaaaga

SEQ ID NO: 3276259 - RNA, 18 nt, Vaccinia virus
acccagaucucuuuuucu

SEQ ID NO: 3276260 - RNA, 21 nt, Vaccinia virus
uguuguuuauucaacauguac

SEQ ID NO: 3276261 - RNA, 20 nt, Vaccinia virus
aauuuuuauuaaugauacaa

SEQ ID NO: 3276262 - RNA, 16 nt, Vaccinia virus
cugugaugccaauaag

SEQ ID NO: 3276263 - RNA, 17 nt, Vaccinia virus
uauuuccaucaugaucu

SEQ ID NO: 3276264 - RNA, 16 nt, Vaccinia virus
uccuuauacaauuugu

SEQ ID NO: 3276265 - RNA, 18 nt, Vaccinia virus
gaacagcuaucaaaauau

SEQ ID NO: 3276266 - RNA, 14 nt, Vaccinia virus
cauuaauuauaacg

SEQ ID NO: 3276267 - RNA, 12 nt, Vaccinia virus
cauuuaaacauu

SEQ ID NO: 3276268 - RNA, 23 nt, Vaccinia virus
aucagacucugguauuuauauau

SEQ ID NO: 3276269 - RNA, 14 nt, Vaccinia virus
ugucaaaaauugua

SEQ ID NO: 3276270 - RNA, 20 nt, Vaccinia virus
gcaauacauuuuucuauguu

SEQ ID NO: 3276271 - RNA, 14 nt, Vaccinia virus
ugcuguuuuuuacu

SEQ ID NO: 3276272 - RNA, 18 nt, Vaccinia virus
aauacucaauacuuucca

SEQ ID NO: 3276273 - RNA, 22 nt, Vaccinia virus
aauguuugauaaaaauauguau

SEQ ID NO: 3276274 - RNA, 22 nt, Vaccinia virus
acucuauaaaauacuaaugcau

SEQ ID NO: 3276275 - RNA, 20 nt, Vaccinia virus
uacaaugcucaguaaaugua

SEQ ID NO: 3276276 - RNA, 16 nt, Vaccinia virus
uacuggauucauacau

SEQ ID NO: 3276277 - RNA, 19 nt, Vaccinia virus
guuaaaaaaaauuauccua

SEQ ID NO: 3276278 - RNA, 20 nt, Vaccinia virus
cuguuggaaccggcugugga

SEQ ID NO: 3276279 - RNA, 22 nt, Vaccinia virus
uaaaugggugccgcagcaagca

SEQ ID NO: 3276280 - RNA, 15 nt, Vaccinia virus
caaaacugaaaauau

SEQ ID NO: 3276281 - RNA, 23 nt, Vaccinia virus
guaucgauacgcauuuucaaaau

SEQ ID NO: 3276282 - RNA, 22 nt, Vaccinia virus
auuaguguauacaccaacagua

SEQ ID NO: 3276283 - RNA, 16 nt, Vaccinia virus
ucuaugaauaugauuu

SEQ ID NO: 3276284 - RNA, 16 nt, Vaccinia virus
cagucuaguauccauu

SEQ ID NO: 3276285 - RNA, 22 nt, Vaccinia virus
uguuugaaaacagaaacaucau

SEQ ID NO: 3276286 - RNA, 18 nt, Vaccinia virus
gaauaauuggaacacaag

SEQ ID NO: 3276287 - RNA, 14 nt, Vaccinia virus
guauauaacauugu

SEQ ID NO: 3276288 - RNA, 21 nt, Vaccinia virus
gaaaacauuguguuuaaucuu

SEQ ID NO: 3276289 - RNA, 22 nt, Vaccinia virus
aucuaauaaguugcgaugaaau

SEQ ID NO: 3276290 - RNA, 16 nt, Vaccinia virus
uagauacaacgucauc

SEQ ID NO: 3276291 - RNA, 13 nt, Vaccinia virus
cguuguuaagaua

SEQ ID NO: 3276292 - RNA, 14 nt, Vaccinia virus
auaugauuacuaga

SEQ ID NO: 3276293 - RNA, 14 nt, Vaccinia virus
auaaaauuacuuaa

SEQ ID NO: 3276294 - RNA, 15 nt, Vaccinia virus
gauucuagaauauca

SEQ ID NO: 3276295 - RNA, 16 nt, Vaccinia virus
agaaucauaaagaaca

SEQ ID NO: 3276296 - RNA, 13 nt, Vaccinia virus
ucuucuacaucuu

SEQ ID NO: 3276297 - RNA, 14 nt, Vaccinia virus
cuccuguagauaug

SEQ ID NO: 3276298 - RNA, 22 nt, Vaccinia virus
uuauuccaauagaugucuuauu

SEQ ID NO: 3276299 - RNA, 16 nt, Vaccinia virus
uaaaacauuaaauguc

SEQ ID NO: 3276300 - RNA, 14 nt, Vaccinia virus
uaaaucuauuauau

SEQ ID NO: 3276301 - RNA, 20 nt, Vaccinia virus
gcaagauuuuuaaacaacaa

SEQ ID NO: 3276302 - RNA, 13 nt, Vaccinia virus
uuaaauguuuucu

SEQ ID NO: 3276303 - RNA, 14 nt, Vaccinia virus
gcaaauuauuucuu

SEQ ID NO: 3276304 - RNA, 15 nt, Vaccinia virus
uggaaaaauaguguu

SEQ ID NO: 3276305 - RNA, 19 nt, Vaccinia virus
acagaaauauaugagaugu

SEQ ID NO: 3276306 - RNA, 16 nt, Vaccinia virus
aguaaauaauaaaaca

SEQ ID NO: 3276307 - RNA, 17 nt, Vaccinia virus
uacucuauaaaauacua

SEQ ID NO: 3276308 - RNA, 21 nt, Vaccinia virus
auauugcaccagaauuaauaa

SEQ ID NO: 3276309 - RNA, 14 nt, Vaccinia virus
aucuguauuaccga

SEQ ID NO: 3276310 - RNA, 22 nt, Vaccinia virus
agauauuuccauuuaucuacug

SEQ ID NO: 3276311 - RNA, 20 nt, Vaccinia virus
auuaucuuuguuuugauauc

SEQ ID NO: 3276312 - RNA, 18 nt, Vaccinia virus
caauagaugauagaauau

SEQ ID NO: 3276313 - RNA, 15 nt, Vaccinia virus
cucaugucaaauugu

SEQ ID NO: 3276314 - RNA, 13 nt, Vaccinia virus
aguacggauuaaa

SEQ ID NO: 3276315 - RNA, 20 nt, Vaccinia virus
gauugaggaagcacauaugu

SEQ ID NO: 3276316 - RNA, 15 nt, Vaccinia virus
auuucgauaaugaac

SEQ ID NO: 3276317 - RNA, 15 nt, Vaccinia virus
uuauuucauccaauu

SEQ ID NO: 3276318 - RNA, 19 nt, Vaccinia virus
uaguagcuucacaaagaug

SEQ ID NO: 3276319 - RNA, 22 nt, Vaccinia virus
uacacguaccucucuaaugggg

SEQ ID NO: 3276320 - RNA, 16 nt, Vaccinia virus
uaguuuuacuaucaua

SEQ ID NO: 3276321 - RNA, 23 nt, Vaccinia virus
auuaucaggaacauuaucaauuu

SEQ ID NO: 3276322 - RNA, 20 nt, Vaccinia virus
caaugaacaagauuaaucuc

SEQ ID NO: 3276323 - RNA, 15 nt, Vaccinia virus
uuccaucuagacuau

SEQ ID NO: 3276324 - RNA, 20 nt, Vaccinia virus
cgcuacaauuauagaacgaa

SEQ ID NO: 3276325 - RNA, 14 nt, Vaccinia virus
auauccuuuuguau

SEQ ID NO: 3276326 - RNA, 23 nt, Vaccinia virus
auaaaucacuaaauaauauccca

SEQ ID NO: 3276327 - RNA, 15 nt, Vaccinia virus
aucucgaugaaaaua

SEQ ID NO: 3276328 - RNA, 16 nt, Vaccinia virus
cuucucuccuuucaaa

SEQ ID NO: 3276329 - RNA, 18 nt, Vaccinia virus
guauauauuguuucucuc

SEQ ID NO: 3276330 - RNA, 15 nt, Vaccinia virus
aacuuaaacaaaaua

SEQ ID NO: 3276331 - RNA, 13 nt, Vaccinia virus
cauuuuacauuau

SEQ ID NO: 3276332 - RNA, 19 nt, Vaccinia virus
auugaugaaguucgaugau

SEQ ID NO: 3276333 - RNA, 18 nt, Vaccinia virus
ucauucauggaguuagaa

SEQ ID NO: 3276334 - RNA, 20 nt, Vaccinia virus
ugauagaacugguaugaaca

SEQ ID NO: 3276335 - RNA, 18 nt, Vaccinia virus
gugcucaaacaaaaugug

SEQ ID NO: 3276336 - RNA, 19 nt, Vaccinia virus
acuuucagaagaaauggua

SEQ ID NO: 3276337 - RNA, 15 nt, Vaccinia virus
gauauuaauaaugau

SEQ ID NO: 3276338 - RNA, 12 nt, Vaccinia virus
uaccgaaaauaa

SEQ ID NO: 3276339 - RNA, 13 nt, Vaccinia virus
auauguauuuccu

SEQ ID NO: 3276340 - RNA, 17 nt, Vaccinia virus
gaagguuggguagaugg

SEQ ID NO: 3276341 - RNA, 15 nt, Vaccinia virus
uacucuuaagagagc

SEQ ID NO: 3276342 - RNA, 21 nt, Vaccinia virus
gaaaaucuuucuucuacuaua

SEQ ID NO: 3276343 - RNA, 16 nt, Vaccinia virus
auauuaaagucuuuac

SEQ ID NO: 3276344 - RNA, 13 nt, Vaccinia virus
gaacacgauguuu

SEQ ID NO: 3276345 - RNA, 12 nt, Vaccinia virus
cagcuguagaac

SEQ ID NO: 3276346 - RNA, 13 nt, Vaccinia virus
gaaucaguauaua

SEQ ID NO: 3276347 - RNA, 21 nt, Vaccinia virus
ugauauuggagcaaaauccua

SEQ ID NO: 3276348 - RNA, 17 nt, Vaccinia virus
auugcaugauagaaugg

SEQ ID NO: 3276349 - RNA, 21 nt, Vaccinia virus
gauaauaacagaguaccauca

SEQ ID NO: 3276350 - RNA, 15 nt, Vaccinia virus
uuuauaaaguuuagu

SEQ ID NO: 3276351 - RNA, 20 nt, Vaccinia virus
aagauuucaucuauaucauu

SEQ ID NO: 3276352 - RNA, 18 nt, Vaccinia virus
aaacugguuaaaacagua

SEQ ID NO: 3276353 - RNA, 16 nt, Vaccinia virus
guaaaaaugaaaugau

SEQ ID NO: 3276354 - RNA, 17 nt, Vaccinia virus
acauaucgguguuucca

SEQ ID NO: 3276355 - RNA, 22 nt, Vaccinia virus
agauauacgcuaucuauauccu

SEQ ID NO: 3276356 - RNA, 14 nt, Vaccinia virus
cuaaauaaguagua

SEQ ID NO: 3276357 - RNA, 20 nt, Vaccinia virus
uaaugacaauaaaauuauca

SEQ ID NO: 3276358 - RNA, 13 nt, Vaccinia virus
uugaaauguguaa

SEQ ID NO: 3276359 - RNA, 13 nt, Vaccinia virus
aguaaaugaugaa

SEQ ID NO: 3276360 - RNA, 23 nt, Vaccinia virus
ucuauauucccgauuuuguagua

SEQ ID NO: 3276361 - RNA, 14 nt, Vaccinia virus
uacgccaaggaaag

SEQ ID NO: 3276362 - RNA, 23 nt, Vaccinia virus
acuucaaaguuguuaaaaaauua

SEQ ID NO: 3276363 - RNA, 15 nt, Vaccinia virus
gagauaauagaaaau

SEQ ID NO: 3276364 - RNA, 21 nt, Vaccinia virus
auaaaauucuuaguuauauau

SEQ ID NO: 3276365 - RNA, 14 nt, Vaccinia virus
cauuuccuacauau

SEQ ID NO: 3276366 - RNA, 19 nt, Vaccinia virus
acuaauucucauuaaaugg

SEQ ID NO: 3276367 - RNA, 21 nt, Vaccinia virus
aauauggacacgcggcuguaa

SEQ ID NO: 3276368 - RNA, 16 nt, Vaccinia virus
aauuacauagaugaua

SEQ ID NO: 3276369 - RNA, 17 nt, Vaccinia virus
cgucaugauaaaaauuu

SEQ ID NO: 3276370 - RNA, 15 nt, Vaccinia virus
auaacuaaacuacua

SEQ ID NO: 3276371 - RNA, 22 nt, Vaccinia virus
caacaaaaagaugcuauguaua

SEQ ID NO: 3276372 - RNA, 22 nt, Vaccinia virus
aucuauauauguauuuuaauaa

SEQ ID NO: 3276373 - RNA, 18 nt, Vaccinia virus
gaaacuaucugauaagau

SEQ ID NO: 3276374 - RNA, 22 nt, Vaccinia virus
agaaaguaugauacaauacuua

SEQ ID NO: 3276375 - RNA, 22 nt, Vaccinia virus
aaaacuguccaaauagauguac

SEQ ID NO: 3276376 - RNA, 13 nt, Vaccinia virus
acaguuugaaaaa

SEQ ID NO: 3276377 - RNA, 17 nt, Vaccinia virus
auaaaauuaucaugaca

SEQ ID NO: 3276378 - RNA, 23 nt, Vaccinia virus
caagucuucaguucuaucuucua

SEQ ID NO: 3276379 - RNA, 18 nt, Vaccinia virus
aaauauaauuuauaauau

SEQ ID NO: 3276380 - RNA, 14 nt, Vaccinia virus
gcauuaauaacauc

SEQ ID NO: 3276381 - RNA, 17 nt, Vaccinia virus
auagagaguucauuuau

SEQ ID NO: 3276382 - RNA, 15 nt, Vaccinia virus
auaucacuguuguac

SEQ ID NO: 3276383 - RNA, 14 nt, Vaccinia virus
cuagucuuaaaugg

SEQ ID NO: 3276384 - RNA, 18 nt, Vaccinia virus
cuacugacgauaguaucu

SEQ ID NO: 3276385 - RNA, 14 nt, Vaccinia virus
cauuuaaaugaauc

SEQ ID NO: 3276386 - RNA, 15 nt, Vaccinia virus
augguacuuaugaca

SEQ ID NO: 3276387 - RNA, 15 nt, Vaccinia virus
agaucgauagacacu

SEQ ID NO: 3276388 - RNA, 17 nt, Vaccinia virus
aaaugcugaagcaauaa

SEQ ID NO: 3276389 - RNA, 14 nt, Vaccinia virus
auacuauuguuuau

SEQ ID NO: 3276390 - RNA, 18 nt, Vaccinia virus
gauacgcuauuaaaauau

SEQ ID NO: 3276391 - RNA, 15 nt, Vaccinia virus
gauaccuagaagauc

SEQ ID NO: 3276392 - RNA, 13 nt, Vaccinia virus
uacauuucaucau

SEQ ID NO: 3276393 - RNA, 16 nt, Vaccinia virus
uuucuccacuacauau

SEQ ID NO: 3276394 - RNA, 14 nt, Vaccinia virus
agaaauuuuucuac

SEQ ID NO: 3276395 - RNA, 15 nt, Vaccinia virus
agugccaucagaaua

SEQ ID NO: 3276396 - RNA, 20 nt, Vaccinia virus
acaaaaucaucugauaauuu

SEQ ID NO: 3276397 - RNA, 20 nt, Vaccinia virus
aaugaguauauguauuuucu

SEQ ID NO: 3276398 - RNA, 16 nt, Vaccinia virus
ggacagcuauauucuc

SEQ ID NO: 3276399 - RNA, 13 nt, Vaccinia virus
ugguauguaucua

SEQ ID NO: 3276400 - RNA, 21 nt, Vaccinia virus
uuauacauugaauauaaaaua

SEQ ID NO: 3276401 - RNA, 21 nt, Vaccinia virus
ggaaaaauuauaauguuuccu

SEQ ID NO: 3276402 - RNA, 23 nt, Vaccinia virus
uacuauuuuuuacauuacuacau

SEQ ID NO: 3276403 - RNA, 17 nt, Vaccinia virus
uguugaugauaucuaca

SEQ ID NO: 3276404 - RNA, 21 nt, Vaccinia virus
auaguggacaacauuaauaca

SEQ ID NO: 3276405 - RNA, 20 nt, Vaccinia virus
cauagcauaguuuuucauaa

SEQ ID NO: 3276406 - RNA, 15 nt, Vaccinia virus
agaacaguaaauguu

SEQ ID NO: 3276407 - RNA, 15 nt, Vaccinia virus
auauuccuugaauaa

SEQ ID NO: 3276408 - RNA, 21 nt, Vaccinia virus
auaaauaugcaaagucuaaau

SEQ ID NO: 3276409 - RNA, 17 nt, Vaccinia virus
uaaaaaaaauagaaaaa

SEQ ID NO: 3276410 - RNA, 15 nt, Vaccinia virus
uuggaacuaguauuu

SEQ ID NO: 3276411 - RNA, 18 nt, Vaccinia virus
acaagcccgucaauaauu

SEQ ID NO: 3276412 - RNA, 23 nt, Vaccinia virus
acuauagaccaaacugcaaaugu

SEQ ID NO: 3276413 - RNA, 13 nt, Vaccinia virus
uuaaaaucauuau

SEQ ID NO: 3276414 - RNA, 19 nt, Vaccinia virus
guaauaagauuucuauucc

SEQ ID NO: 3276415 - RNA, 16 nt, Vaccinia virus
uaaaaauaauauuguu

SEQ ID NO: 3276416 - RNA, 18 nt, Vaccinia virus
cuucuguacaaaaucguu

SEQ ID NO: 3276417 - RNA, 19 nt, Vaccinia virus
agaucugcguguaaaaagu

SEQ ID NO: 3276418 - RNA, 13 nt, Vaccinia virus
uuauuacuaaaca

SEQ ID NO: 3276419 - RNA, 18 nt, Vaccinia virus
gaauggcguuugauauau

SEQ ID NO: 3276420 - RNA, 15 nt, Vaccinia virus
auauuauacaaaaua

SEQ ID NO: 3276421 - RNA, 23 nt, Vaccinia virus
aucaaaucucuaucaucacauau

SEQ ID NO: 3276422 - RNA, 15 nt, Vaccinia virus
auauuuaguauuauu

SEQ ID NO: 3276423 - RNA, 21 nt, Vaccinia virus
ucuucugaauucgaggaagau

SEQ ID NO: 3276424 - RNA, 19 nt, Vaccinia virus
gaacacauuaaacaaaaau

SEQ ID NO: 3276425 - RNA, 17 nt, Vaccinia virus
uuaagauuguacacuuu

SEQ ID NO: 3276426 - RNA, 15 nt, Vaccinia virus
uaaucuuuguuggau

SEQ ID NO: 3276427 - RNA, 13 nt, Vaccinia virus
cugucuaaaugua

SEQ ID NO: 3276428 - RNA, 14 nt, Vaccinia virus
uauucaacauaucu

SEQ ID NO: 3276429 - RNA, 18 nt, Vaccinia virus
uaaauguccacuauacau

SEQ ID NO: 3276430 - RNA, 14 nt, Vaccinia virus
uaauucauaagaau

SEQ ID NO: 3276431 - RNA, 15 nt, Vaccinia virus
acauugaaacuaugu

SEQ ID NO: 3276432 - RNA, 18 nt, Vaccinia virus
uuucucaaccauagauau

SEQ ID NO: 3276433 - RNA, 13 nt, Vaccinia virus
uaccagagauuuu

SEQ ID NO: 3276434 - RNA, 20 nt, Vaccinia virus
gacacgauuaccaauacuuu

SEQ ID NO: 3276435 - RNA, 20 nt, Vaccinia virus
aagcauuuuggaaacauaaa

SEQ ID NO: 3276436 - RNA, 18 nt, Vaccinia virus
uguagucgacagaagaau

SEQ ID NO: 3276437 - RNA, 21 nt, Vaccinia virus
cuuacaauccguguuauuuua

SEQ ID NO: 3276438 - RNA, 16 nt, Vaccinia virus
uaaagaacgaauguug

SEQ ID NO: 3276439 - RNA, 15 nt, Vaccinia virus
auaauauauucuaug

SEQ ID NO: 3276440 - RNA, 14 nt, Vaccinia virus
acuagauaaacuau

SEQ ID NO: 3276441 - RNA, 20 nt, Vaccinia virus
auauuacaaccaauguuaug

SEQ ID NO: 3276442 - RNA, 20 nt, Vaccinia virus
aguucuucggcgguuuucau

SEQ ID NO: 3276443 - RNA, 15 nt, Vaccinia virus
gcguggauuguuaac

SEQ ID NO: 3276444 - RNA, 19 nt, Vaccinia virus
gacucaucaacgaugaaaa

SEQ ID NO: 3276445 - RNA, 17 nt, Vaccinia virus
caaagaauauaucuaau

SEQ ID NO: 3276446 - RNA, 15 nt, Vaccinia virus
gaaauagauaaugaa

SEQ ID NO: 3276447 - RNA, 22 nt, Vaccinia virus
caaauaucggcauuuauguuuc

SEQ ID NO: 3276448 - RNA, 12 nt, Vaccinia virus
uuaaugaagauc

SEQ ID NO: 3276449 - RNA, 20 nt, Vaccinia virus
gauuauaauccuuauacauc

SEQ ID NO: 3276450 - RNA, 16 nt, Vaccinia virus
aacacuuuccugauuu

SEQ ID NO: 3276451 - RNA, 12 nt, Vaccinia virus
uuuuauaaacaa

SEQ ID NO: 3276452 - RNA, 14 nt, Vaccinia virus
uaggauaauaauua

SEQ ID NO: 3276453 - RNA, 16 nt, Vaccinia virus
gaucagguaaaacaau

SEQ ID NO: 3276454 - RNA, 16 nt, Vaccinia virus
auacguacugucuaua

SEQ ID NO: 3276455 - RNA, 15 nt, Vaccinia virus
agauauauagaauua

SEQ ID NO: 3276456 - RNA, 20 nt, Vaccinia virus
ucaaauucucguucauguau

SEQ ID NO: 3276457 - RNA, 23 nt, Vaccinia virus
uaacgaacgaggugugaauguac

SEQ ID NO: 3276458 - RNA, 18 nt, Vaccinia virus
cauaauaugagauguuua

SEQ ID NO: 3276459 - RNA, 23 nt, Vaccinia virus
guuccguuggaugguaauaaacu

SEQ ID NO: 3276460 - RNA, 15 nt, Vaccinia virus
aaaugcuaaauaugc

SEQ ID NO: 3276461 - RNA, 21 nt, Vaccinia virus
gauaacuagaaucagaaucua

SEQ ID NO: 3276462 - RNA, 20 nt, Vaccinia virus
agauauaaaauagaaaauaa

SEQ ID NO: 3276463 - RNA, 23 nt, Vaccinia virus
cuacgaaacugauacaaucucuu

SEQ ID NO: 3276464 - RNA, 20 nt, Vaccinia virus
ucauggauaauauuuguaau

SEQ ID NO: 3276465 - RNA, 15 nt, Vaccinia virus
guaucgauaauuauu

SEQ ID NO: 3276466 - RNA, 18 nt, Vaccinia virus
aaucauccauaaauuaua

SEQ ID NO: 3276467 - RNA, 21 nt, Vaccinia virus
uucagaaaguaauucauuaau

SEQ ID NO: 3276468 - RNA, 20 nt, Vaccinia virus
cucuaugacuucaucaucug

SEQ ID NO: 3276469 - RNA, 21 nt, Vaccinia virus
agccugaguaguuggaagaau

SEQ ID NO: 3276470 - RNA, 18 nt, Vaccinia virus
cggugcuguaacauucug

SEQ ID NO: 3276471 - RNA, 22 nt, Vaccinia virus
aaguguguaaccgcguuaaugu

SEQ ID NO: 3276472 - RNA, 14 nt, Vaccinia virus
acaucucgcaauaa

SEQ ID NO: 3276473 - RNA, 17 nt, Vaccinia virus
gaacaauaaaagagaau

SEQ ID NO: 3276474 - RNA, 23 nt, Vaccinia virus
uaucaauaagcauuaugauuugu

SEQ ID NO: 3276475 - RNA, 14 nt, Vaccinia virus
guaccauuuuuaac

SEQ ID NO: 3276476 - RNA, 21 nt, Vaccinia virus
auguuagcgcuuccuaaauaa

SEQ ID NO: 3276477 - RNA, 15 nt, Vaccinia virus
cauagaauaaauauc

SEQ ID NO: 3276478 - RNA, 23 nt, Vaccinia virus
ucacauauaaaauuuuaauuaau

SEQ ID NO: 3276479 - RNA, 21 nt, Vaccinia virus
uuaucuuuuuagacacguaua

SEQ ID NO: 3276480 - RNA, 19 nt, Vaccinia virus
auuuuuaguuuauacuauu

SEQ ID NO: 3276481 - RNA, 13 nt, Vaccinia virus
aagaagaugaugg

SEQ ID NO: 3276482 - RNA, 16 nt, Vaccinia virus
auacauccuguucuau

SEQ ID NO: 3276483 - RNA, 13 nt, Vaccinia virus
uaaaaauaaaagu

SEQ ID NO: 3276484 - RNA, 16 nt, Vaccinia virus
ucaaaauagaaaauug

SEQ ID NO: 3276485 - RNA, 18 nt, Vaccinia virus
ucuaucauggcaauaaca

SEQ ID NO: 3276486 - RNA, 18 nt, Vaccinia virus
cuugaaaauuguuuuucu

SEQ ID NO: 3276487 - RNA, 15 nt, Vaccinia virus
auauaugacauaaua

SEQ ID NO: 3276488 - RNA, 21 nt, Vaccinia virus
uaauaacaugcgguucaaaau

SEQ ID NO: 3276489 - RNA, 21 nt, Vaccinia virus
uuaauaauuguuauuauuuca

SEQ ID NO: 3276490 - RNA, 19 nt, Vaccinia virus
auauuaaaaauaagaauga

SEQ ID NO: 3276491 - RNA, 17 nt, Vaccinia virus
acuccaauuaucuuuac

SEQ ID NO: 3276492 - RNA, 14 nt, Vaccinia virus
gauggaauuaucau

SEQ ID NO: 3276493 - RNA, 17 nt, Vaccinia virus
uuaaaaaaugaaaauaa

SEQ ID NO: 3276494 - RNA, 19 nt, Vaccinia virus
aguauucgccccaaaggau

SEQ ID NO: 3276495 - RNA, 18 nt, Vaccinia virus
ucuuuuucucaaauccau

SEQ ID NO: 3276496 - RNA, 18 nt, Vaccinia virus
aauuaauaaaaauacaau

SEQ ID NO: 3276497 - RNA, 14 nt, Vaccinia virus
uaacguaucgcauu

SEQ ID NO: 3276498 - RNA, 15 nt, Vaccinia virus
gaggaagacacauua

SEQ ID NO: 3276499 - RNA, 19 nt, Vaccinia virus
uagaagguucauauguugu

SEQ ID NO: 3276500 - RNA, 14 nt, Vaccinia virus
aacgguauaugaau

SEQ ID NO: 3276501 - RNA, 24 nt, Vaccinia virus
uacaauugguuaugauaucaugua

SEQ ID NO: 3276502 - RNA, 12 nt, Vaccinia virus
auacuaaagaaa

SEQ ID NO: 3276503 - RNA, 21 nt, Vaccinia virus
uaguuaagaacaugucuucua

SEQ ID NO: 3276504 - RNA, 15 nt, Vaccinia virus
caaaugauuaucaaa

SEQ ID NO: 3276505 - RNA, 22 nt, Vaccinia virus
cauacaugaaaugaucucuauu

SEQ ID NO: 3276506 - RNA, 18 nt, Vaccinia virus
acauccuucuauguugac

SEQ ID NO: 3276507 - RNA, 18 nt, Vaccinia virus
ucugggaauaaaauacua

SEQ ID NO: 3276508 - RNA, 17 nt, Vaccinia virus
uacuucagguuucuuag

SEQ ID NO: 3276509 - RNA, 13 nt, Vaccinia virus
auaggaucuauau

SEQ ID NO: 3276510 - RNA, 22 nt, Vaccinia virus
gaaccaauacaacguaaaauau

SEQ ID NO: 3276511 - RNA, 18 nt, Vaccinia virus
ugacgauauuucuggaau

SEQ ID NO: 3276512 - RNA, 19 nt, Vaccinia virus
acaucuaaagaaaaaugau

SEQ ID NO: 3276513 - RNA, 18 nt, Vaccinia virus
gaugucaaaggaugaaag

SEQ ID NO: 3276514 - RNA, 21 nt, Vaccinia virus
uugagaaagaccaguaguauu

SEQ ID NO: 3276515 - RNA, 14 nt, Vaccinia virus
aacuaucuguaaaa

SEQ ID NO: 3276516 - RNA, 17 nt, Vaccinia virus
cuucucuguuuaaugaa

SEQ ID NO: 3276517 - RNA, 21 nt, Vaccinia virus
uuuugucgauaaaaauuaaaa

SEQ ID NO: 3276518 - RNA, 14 nt, Vaccinia virus
acuuauuuaacucu

SEQ ID NO: 3276519 - RNA, 19 nt, Vaccinia virus
uugucucauggccguguau

SEQ ID NO: 3276520 - RNA, 18 nt, Vaccinia virus
ucuauuuuaucauuuucc

SEQ ID NO: 3276521 - RNA, 23 nt, Vaccinia virus
caucugguacaauaaauagcuuu

SEQ ID NO: 3276522 - RNA, 22 nt, Vaccinia virus
aauaucuauuaaacgaauaaaa

SEQ ID NO: 3276523 - RNA, 16 nt, Vaccinia virus
auuuauacuucuucua

SEQ ID NO: 3276524 - RNA, 15 nt, Vaccinia virus
gaucacacauuauga

SEQ ID NO: 3276525 - RNA, 14 nt, Vaccinia virus
agacauuaauagaa

SEQ ID NO: 3276526 - RNA, 20 nt, Vaccinia virus
ucgaucaaaagacuauacau

SEQ ID NO: 3276527 - RNA, 21 nt, Vaccinia virus
augaucaagagugauuuaaga

SEQ ID NO: 3276528 - RNA, 20 nt, Vaccinia virus
aaucauuccaucgauacauc

SEQ ID NO: 3276529 - RNA, 22 nt, Vaccinia virus
cauguguuuuagaauauauaua

SEQ ID NO: 3276530 - RNA, 23 nt, Vaccinia virus
uccauugauaaagaaguuauaga

SEQ ID NO: 3276531 - RNA, 19 nt, Vaccinia virus
auuaauguggaauauagau

SEQ ID NO: 3276532 - RNA, 15 nt, Vaccinia virus
uacaguucuuuucua

SEQ ID NO: 3276533 - RNA, 23 nt, Vaccinia virus
ccucggauaaauaggaucaucua

SEQ ID NO: 3276534 - RNA, 15 nt, Vaccinia virus
cgaugauggaguaau

SEQ ID NO: 3276535 - RNA, 15 nt, Vaccinia virus
caggaaggagauauu

SEQ ID NO: 3276536 - RNA, 15 nt, Vaccinia virus
auuuucuuucuaaua

SEQ ID NO: 3276537 - RNA, 15 nt, Vaccinia virus
aucucuuucuccuuu

SEQ ID NO: 3276538 - RNA, 14 nt, Vaccinia virus
aucagauaugaauu

SEQ ID NO: 3276539 - RNA, 14 nt, Vaccinia virus
uuaucuaaugaaug

SEQ ID NO: 3276540 - RNA, 13 nt, Vaccinia virus
gagauuuucuauu

SEQ ID NO: 3276541 - RNA, 15 nt, Vaccinia virus
aguguaguuaaugua

SEQ ID NO: 3276542 - RNA, 13 nt, Vaccinia virus
acaaugaacuaau

SEQ ID NO: 3276543 - RNA, 17 nt, Vaccinia virus
uaacaugagacauaaau

SEQ ID NO: 3276544 - RNA, 21 nt, Vaccinia virus
ugugucuacauaaauaugcaa

SEQ ID NO: 3276545 - RNA, 15 nt, Vaccinia virus
ugcagaaguaaugaa

SEQ ID NO: 3276546 - RNA, 15 nt, Vaccinia virus
cagagguuguauuua

SEQ ID NO: 3276547 - RNA, 14 nt, Vaccinia virus
ugccauaauaauua

SEQ ID NO: 3276548 - RNA, 23 nt, Vaccinia virus
gcguuccuugugcuuaauguuuc

SEQ ID NO: 3276549 - RNA, 16 nt, Vaccinia virus
caauaagcauuaugau

SEQ ID NO: 3276550 - RNA, 19 nt, Vaccinia virus
aauaacauaggauuaaaaa

SEQ ID NO: 3276551 - RNA, 13 nt, Vaccinia virus
caggaacuauuaa

SEQ ID NO: 3276552 - RNA, 21 nt, Vaccinia virus
aggguauauccaucacuaaaa

SEQ ID NO: 3276553 - RNA, 19 nt, Vaccinia virus
aguucuggcaauguuucau

SEQ ID NO: 3276554 - RNA, 17 nt, Vaccinia virus
ucuuauaauuguaacau

SEQ ID NO: 3276555 - RNA, 18 nt, Vaccinia virus
uaccuccacaucuaaaaa

SEQ ID NO: 3276556 - RNA, 18 nt, Vaccinia virus
agaaacgcaacaaaugau

SEQ ID NO: 3276557 - RNA, 16 nt, Vaccinia virus
caauauuaucaucuug

SEQ ID NO: 3276558 - RNA, 18 nt, Vaccinia virus
auauguagcaaacaugau

SEQ ID NO: 3276559 - RNA, 21 nt, Vaccinia virus
aguuaaaaaagaccaguucau

SEQ ID NO: 3276560 - RNA, 14 nt, Vaccinia virus
agauuguucucuua

SEQ ID NO: 3276561 - RNA, 12 nt, Vaccinia virus
gccugaauaucu

SEQ ID NO: 3276562 - RNA, 17 nt, Vaccinia virus
cauuuaaauaucauaau

SEQ ID NO: 3276563 - RNA, 15 nt, Vaccinia virus
gacauaauacuaucu

SEQ ID NO: 3276564 - RNA, 15 nt, Vaccinia virus
guuauuuaugucaua

SEQ ID NO: 3276565 - RNA, 12 nt, Vaccinia virus
gcuacaguaaaa

SEQ ID NO: 3276566 - RNA, 13 nt, Vaccinia virus
gcaucuuguuaac

SEQ ID NO: 3276567 - RNA, 21 nt, Vaccinia virus
gugacuuaacuuguaauaauu

SEQ ID NO: 3276568 - RNA, 21 nt, Vaccinia virus
accgaucaaagaauuaaugau

SEQ ID NO: 3276569 - RNA, 13 nt, Vaccinia virus
aauacuuaaaaug

SEQ ID NO: 3276570 - RNA, 18 nt, Vaccinia virus
aagagcgacguacaacug

SEQ ID NO: 3276571 - RNA, 14 nt, Vaccinia virus
cauauuuucaguaa

SEQ ID NO: 3276572 - RNA, 15 nt, Vaccinia virus
gcaucgauuugcuaa

SEQ ID NO: 3276573 - RNA, 15 nt, Vaccinia virus
gaauaucuacaaauu

SEQ ID NO: 3276574 - RNA, 20 nt, Vaccinia virus
caugacuugguauuuggaaa

SEQ ID NO: 3276575 - RNA, 16 nt, Vaccinia virus
uaacuauuuagcaaaa

SEQ ID NO: 3276576 - RNA, 20 nt, Vaccinia virus
caugaagagauguuauauaa

SEQ ID NO: 3276577 - RNA, 14 nt, Vaccinia virus
uuuaauacagaugg

SEQ ID NO: 3276578 - RNA, 18 nt, Vaccinia virus
acaugggaaaugaaaugu

SEQ ID NO: 3276579 - RNA, 13 nt, Vaccinia virus
aaaagauaauaca

SEQ ID NO: 3276580 - RNA, 14 nt, Vaccinia virus
agcaauucauguac

SEQ ID NO: 3276581 - RNA, 24 nt, Vaccinia virus
uaaauagaauucucuucauaucau

SEQ ID NO: 3276582 - RNA, 15 nt, Vaccinia virus
guuuccaaaaaaugu

SEQ ID NO: 3276583 - RNA, 11 nt, Vaccinia virus
auuaugauacu

SEQ ID NO: 3276584 - RNA, 17 nt, Vaccinia virus
guuuguuccugugacaa

SEQ ID NO: 3276585 - RNA, 19 nt, Vaccinia virus
uaaaacuuaugauuaguca

SEQ ID NO: 3276586 - RNA, 23 nt, Vaccinia virus
ggaugguccaaacugccacugau

SEQ ID NO: 3276587 - RNA, 15 nt, Vaccinia virus
agcaaaacaaaauua

SEQ ID NO: 3276588 - RNA, 19 nt, Vaccinia virus
auaaucaaaauugucuaug

SEQ ID NO: 3276589 - RNA, 19 nt, Vaccinia virus
acaugcuccaauugaaugu

SEQ ID NO: 3276590 - RNA, 14 nt, Vaccinia virus
uaaaaaagauaaag

SEQ ID NO: 3276591 - RNA, 14 nt, Vaccinia virus
uuaaacauacuggu

SEQ ID NO: 3276592 - RNA, 21 nt, Vaccinia virus
ucgauaauaacagaauguaga

SEQ ID NO: 3276593 - RNA, 16 nt, Vaccinia virus
uaacaaccucuuuaau

SEQ ID NO: 3276594 - RNA, 23 nt, Vaccinia virus
aucucagucuguggcguuugcuu

SEQ ID NO: 3276595 - RNA, 16 nt, Vaccinia virus
uagaaacaugaaacca

SEQ ID NO: 3276596 - RNA, 14 nt, Vaccinia virus
cggacuuuaaacag

SEQ ID NO: 3276597 - RNA, 18 nt, Vaccinia virus
gcuacugcugauaaugau

SEQ ID NO: 3276598 - RNA, 22 nt, Vaccinia virus
aacaauaugguaauuuagagaa

SEQ ID NO: 3276599 - RNA, 16 nt, Vaccinia virus
uauacucuauucuuca

SEQ ID NO: 3276600 - RNA, 20 nt, Vaccinia virus
caagagacguaaauauucua

SEQ ID NO: 3276601 - RNA, 17 nt, Vaccinia virus
uuuaguaggacuaguau

SEQ ID NO: 3276602 - RNA, 20 nt, Vaccinia virus
uguuucuaccggcauagugg

SEQ ID NO: 3276603 - RNA, 23 nt, Vaccinia virus
acgcagaaauugguauaaauguu

SEQ ID NO: 3276604 - RNA, 16 nt, Vaccinia virus
ucucacugaauacgag

SEQ ID NO: 3276605 - RNA, 19 nt, Vaccinia virus
accaugaaauugagaagau

SEQ ID NO: 3276606 - RNA, 19 nt, Vaccinia virus
auauuguacgguagaauug

SEQ ID NO: 3276607 - RNA, 13 nt, Vaccinia virus
aagaaaaaugauu

SEQ ID NO: 3276608 - RNA, 14 nt, Vaccinia virus
uuccagaguguuua

SEQ ID NO: 3276609 - RNA, 21 nt, Vaccinia virus
gagauaucccguuagaaauau

SEQ ID NO: 3276610 - RNA, 16 nt, Vaccinia virus
auguuaaauguuuuac

SEQ ID NO: 3276611 - RNA, 16 nt, Vaccinia virus
uuuaccggcaucauaa

SEQ ID NO: 3276612 - RNA, 17 nt, Vaccinia virus
auaaaauugaaguaaua

SEQ ID NO: 3276613 - RNA, 16 nt, Vaccinia virus
ugauugugucucgaau

SEQ ID NO: 3276614 - RNA, 19 nt, Vaccinia virus
gucugauauucgaaaaucu

SEQ ID NO: 3276615 - RNA, 17 nt, Vaccinia virus
guauauguaagauguuu

SEQ ID NO: 3276616 - RNA, 16 nt, Vaccinia virus
auaacgauaacgauau

SEQ ID NO: 3276617 - RNA, 17 nt, Vaccinia virus
auuaugcgauagcaaga

SEQ ID NO: 3276618 - RNA, 15 nt, Vaccinia virus
gauagcaaaauaaag

SEQ ID NO: 3276619 - RNA, 22 nt, Vaccinia virus
acaacaucacgcucgauaauca

SEQ ID NO: 3276620 - RNA, 17 nt, Vaccinia virus
cuaauuuacuaucugua

SEQ ID NO: 3276621 - RNA, 23 nt, Vaccinia virus
uaaucauauaggcauugauuuuu

SEQ ID NO: 3276622 - RNA, 18 nt, Vaccinia virus
gugcauacgcauucaucu

SEQ ID NO: 3276623 - RNA, 14 nt, Vaccinia virus
acggauacugucuu

SEQ ID NO: 3276624 - RNA, 15 nt, Vaccinia virus
uuuacuuuucuaaau

SEQ ID NO: 3276625 - RNA, 22 nt, Vaccinia virus
caauuuuuagcaccauuaucuu

SEQ ID NO: 3276626 - RNA, 22 nt, Vaccinia virus
ucuuuaaguauauacgauaaga

SEQ ID NO: 3276627 - RNA, 23 nt, Vaccinia virus
aucugucuuaauuaacugucuuu

SEQ ID NO: 3276628 - RNA, 18 nt, Vaccinia virus
agaaauaaaaauuauuau

SEQ ID NO: 3276629 - RNA, 17 nt, Vaccinia virus
gcaaacgcgauaaggau

SEQ ID NO: 3276630 - RNA, 13 nt, Vaccinia virus
gucuauaguucuc

SEQ ID NO: 3276631 - RNA, 20 nt, Vaccinia virus
caaaugaguucuguguagau

SEQ ID NO: 3276632 - RNA, 17 nt, Vaccinia virus
aauauacaauagaugca

SEQ ID NO: 3276633 - RNA, 20 nt, Vaccinia virus
cugauuuauguuuuaaauau

SEQ ID NO: 3276634 - RNA, 17 nt, Vaccinia virus
augguagcaauaugcua

SEQ ID NO: 3276635 - RNA, 19 nt, Vaccinia virus
caguuucaucgauaaagga

SEQ ID NO: 3276636 - RNA, 21 nt, Vaccinia virus
aaauuauuuaauuuaauacau

SEQ ID NO: 3276637 - RNA, 14 nt, Vaccinia virus
aaauagauuauuua

SEQ ID NO: 3276638 - RNA, 23 nt, Vaccinia virus
guguacauccgaaauacaaaaug

SEQ ID NO: 3276639 - RNA, 16 nt, Vaccinia virus
auaucuagcaaaaauu

SEQ ID NO: 3276640 - RNA, 15 nt, Vaccinia virus
cgaaaagaaacagau

SEQ ID NO: 3276641 - RNA, 14 nt, Vaccinia virus
agaaacuuaaagua

SEQ ID NO: 3276642 - RNA, 12 nt, Vaccinia virus
ugauccacaaaa

SEQ ID NO: 3276643 - RNA, 15 nt, Vaccinia virus
auauucauagauuga

SEQ ID NO: 3276644 - RNA, 12 nt, Vaccinia virus
uaaaaauuauua

SEQ ID NO: 3276645 - RNA, 15 nt, Vaccinia virus
caaugggucguugga

SEQ ID NO: 3276646 - RNA, 12 nt, Vaccinia virus
aauuucaaaaua

SEQ ID NO: 3276647 - RNA, 19 nt, Vaccinia virus
auaauucauaagaauuuac

SEQ ID NO: 3276648 - RNA, 18 nt, Vaccinia virus
cuggggauggucuauaca

SEQ ID NO: 3276649 - RNA, 15 nt, Vaccinia virus
aucacucuucgaaaa

SEQ ID NO: 3276650 - RNA, 16 nt, Vaccinia virus
uagaucaagaaacauu

SEQ ID NO: 3276651 - RNA, 20 nt, Vaccinia virus
ugaugaaagauaaacuaaau

SEQ ID NO: 3276652 - RNA, 20 nt, Vaccinia virus
cauggucuagauguaaaaaa

SEQ ID NO: 3276653 - RNA, 19 nt, Vaccinia virus
uauuacguggagaaaucau

SEQ ID NO: 3276654 - RNA, 20 nt, Vaccinia virus
caucaaaauaggagauaucu

SEQ ID NO: 3276655 - RNA, 17 nt, Vaccinia virus
aauucuuaucaauaaca

SEQ ID NO: 3276656 - RNA, 18 nt, Vaccinia virus
ugauuguaaauacagaua

SEQ ID NO: 3276657 - RNA, 21 nt, Vaccinia virus
gacguauaagucuauuugaaa

SEQ ID NO: 3276658 - RNA, 17 nt, Vaccinia virus
auaucugugaauacuuu

SEQ ID NO: 3276659 - RNA, 20 nt, Vaccinia virus
aaugauacaaaaacgaaaua

SEQ ID NO: 3276660 - RNA, 21 nt, Vaccinia virus
cuagauagaaagauguagcua

SEQ ID NO: 3276661 - RNA, 15 nt, Vaccinia virus
uacuaaagaaacugu

SEQ ID NO: 3276662 - RNA, 21 nt, Vaccinia virus
ucuagacgauuaguaauauau

SEQ ID NO: 3276663 - RNA, 21 nt, Vaccinia virus
uaacaacgacuuauaauuaau

SEQ ID NO: 3276664 - RNA, 18 nt, Vaccinia virus
ucuccauagagaaauuag

SEQ ID NO: 3276665 - RNA, 13 nt, Vaccinia virus
auguuuucacaau

SEQ ID NO: 3276666 - RNA, 16 nt, Vaccinia virus
acaaauaguaauacau

SEQ ID NO: 3276667 - RNA, 13 nt, Vaccinia virus
augacaaacauug

SEQ ID NO: 3276668 - RNA, 21 nt, Vaccinia virus
aacuauugaagccauugaaaa

SEQ ID NO: 3276669 - RNA, 18 nt, Vaccinia virus
caauggucucggauuggu

SEQ ID NO: 3276670 - RNA, 18 nt, Vaccinia virus
aauaaacuagagaaacuu

SEQ ID NO: 3276671 - RNA, 16 nt, Vaccinia virus
caauuacugauaaugu

SEQ ID NO: 3276672 - RNA, 16 nt, Vaccinia virus
uuguauccuuaucuau

SEQ ID NO: 3276673 - RNA, 23 nt, Vaccinia virus
caugaacaaucacaagaacagag

SEQ ID NO: 3276674 - RNA, 15 nt, Vaccinia virus
uacuuaucauuuacu

SEQ ID NO: 3276675 - RNA, 13 nt, Vaccinia virus
auauuauuaaaga

SEQ ID NO: 3276676 - RNA, 17 nt, Vaccinia virus
ugauauacagucuuaaa

SEQ ID NO: 3276677 - RNA, 16 nt, Vaccinia virus
uaugcgggaauuaaug

SEQ ID NO: 3276678 - RNA, 18 nt, Vaccinia virus
aauacuuaccuaaugccu

SEQ ID NO: 3276679 - RNA, 18 nt, Vaccinia virus
ugcuucaacgaggaagau

SEQ ID NO: 3276680 - RNA, 21 nt, Vaccinia virus
auaaaaguuguaaaguaaaua

SEQ ID NO: 3276681 - RNA, 23 nt, Vaccinia virus
gucacgauguaggaauauagauc

SEQ ID NO: 3276682 - RNA, 13 nt, Vaccinia virus
uacccaucaugua

SEQ ID NO: 3276683 - RNA, 21 nt, Vaccinia virus
uauuaaugauacaaaaacgaa

SEQ ID NO: 3276684 - RNA, 21 nt, Vaccinia virus
auagugucuccuauguuguaa

SEQ ID NO: 3276685 - RNA, 16 nt, Vaccinia virus
auucauaaaacauaau

SEQ ID NO: 3276686 - RNA, 14 nt, Vaccinia virus
aucacgucauauau

SEQ ID NO: 3276687 - RNA, 21 nt, Vaccinia virus
agccauucuucccauggaugu

SEQ ID NO: 3276688 - RNA, 15 nt, Vaccinia virus
aaaacaauaaauauu

SEQ ID NO: 3276689 - RNA, 21 nt, Vaccinia virus
auaucugaaacaaagaauugu

SEQ ID NO: 3276690 - RNA, 16 nt, Vaccinia virus
cauuaauggcaauaac

SEQ ID NO: 3276691 - RNA, 21 nt, Vaccinia virus
aaucuaguacgcgaaauaaua

SEQ ID NO: 3276692 - RNA, 17 nt, Vaccinia virus
ucaucuugucuagaaug

SEQ ID NO: 3276693 - RNA, 13 nt, Vaccinia virus
agcaacuaaucaa

SEQ ID NO: 3276694 - RNA, 15 nt, Vaccinia virus
auuucacgaaaaaug

SEQ ID NO: 3276695 - RNA, 13 nt, Vaccinia virus
guaauaaacuguu

SEQ ID NO: 3276696 - RNA, 23 nt, Vaccinia virus
ucuucucguaggcgaaugauucc

SEQ ID NO: 3276697 - RNA, 22 nt, Vaccinia virus
gagagaucauuucuauaauuua

SEQ ID NO: 3276698 - RNA, 18 nt, Vaccinia virus
cauuuuggaaacauaaaa

SEQ ID NO: 3276699 - RNA, 12 nt, Vaccinia virus
auagcuaucaag

SEQ ID NO: 3276700 - RNA, 15 nt, Vaccinia virus
cugcuagaacaucca

SEQ ID NO: 3276701 - RNA, 16 nt, Vaccinia virus
uacguugauuucuagc

SEQ ID NO: 3276702 - RNA, 21 nt, Vaccinia virus
uuuacuuuucuaaauucauaa

SEQ ID NO: 3276703 - RNA, 22 nt, Vaccinia virus
agauuugcauuucuauacuugu

SEQ ID NO: 3276704 - RNA, 14 nt, Vaccinia virus
auuauuacauagau

SEQ ID NO: 3276705 - RNA, 20 nt, Vaccinia virus
ucaucguauagcaauguaau

SEQ ID NO: 3276706 - RNA, 18 nt, Vaccinia virus
guuccguaucuguauuua

SEQ ID NO: 3276707 - RNA, 15 nt, Vaccinia virus
ccauagauucuuuga

SEQ ID NO: 3276708 - RNA, 18 nt, Vaccinia virus
uuaagcauauccugaaua

SEQ ID NO: 3276709 - RNA, 15 nt, Vaccinia virus
aucagguaaaacaau

SEQ ID NO: 3276710 - RNA, 14 nt, Vaccinia virus
guuauaauagagau

SEQ ID NO: 3276711 - RNA, 14 nt, Vaccinia virus
uaaaauuguagcau

SEQ ID NO: 3276712 - RNA, 13 nt, Vaccinia virus
uaauaguaggaac

SEQ ID NO: 3276713 - RNA, 17 nt, Vaccinia virus
cugauuuuuuaacuuca

SEQ ID NO: 3276714 - RNA, 14 nt, Vaccinia virus
uucuauuuaauuuu

SEQ ID NO: 3276715 - RNA, 15 nt, Vaccinia virus
acguuacucaaacac

SEQ ID NO: 3276716 - RNA, 15 nt, Vaccinia virus
auuuguuaaaaauuu

SEQ ID NO: 3276717 - RNA, 23 nt, Vaccinia virus
auauuaaucauccacguuuugau

SEQ ID NO: 3276718 - RNA, 12 nt, Vaccinia virus
acacuauugaac

SEQ ID NO: 3276719 - RNA, 18 nt, Vaccinia virus
auuaacagauaaaaagac

SEQ ID NO: 3276720 - RNA, 14 nt, Vaccinia virus
cugacauucagaaa

SEQ ID NO: 3276721 - RNA, 16 nt, Vaccinia virus
uaucauaaaugaaaua

SEQ ID NO: 3276722 - RNA, 16 nt, Vaccinia virus
aucccauauaauacag

SEQ ID NO: 3276723 - RNA, 21 nt, Vaccinia virus
auacgaaauaaauaaugaauu

SEQ ID NO: 3276724 - RNA, 14 nt, Vaccinia virus
acgcguauauguuu

SEQ ID NO: 3276725 - RNA, 15 nt, Vaccinia virus
ucauuacuacuguaa

SEQ ID NO: 3276726 - RNA, 18 nt, Vaccinia virus
acaugcgguucaaaauag

SEQ ID NO: 3276727 - RNA, 20 nt, Vaccinia virus
aauuuguagauuuuguuaua

SEQ ID NO: 3276728 - RNA, 13 nt, Vaccinia virus
gucucauagagaa

SEQ ID NO: 3276729 - RNA, 15 nt, Vaccinia virus
aauaauuauguagua

SEQ ID NO: 3276730 - RNA, 21 nt, Vaccinia virus
acagaguauguaaaaauguua

SEQ ID NO: 3276731 - RNA, 23 nt, Vaccinia virus
caguguaaagaacgaauguugua

SEQ ID NO: 3276732 - RNA, 14 nt, Vaccinia virus
uauccaaucuuauu

SEQ ID NO: 3276733 - RNA, 18 nt, Vaccinia virus
gcaacggauuuaauuuua

SEQ ID NO: 3276734 - RNA, 16 nt, Vaccinia virus
uucaacgcuuggcuga

SEQ ID NO: 3276735 - RNA, 19 nt, Vaccinia virus
gcauguuugcucucugaau

SEQ ID NO: 3276736 - RNA, 15 nt, Vaccinia virus
ucuaucauggauaau

SEQ ID NO: 3276737 - RNA, 15 nt, Vaccinia virus
aucuauaaugucuac

SEQ ID NO: 3276738 - RNA, 14 nt, Vaccinia virus
uuaucaaaaauaag

SEQ ID NO: 3276739 - RNA, 15 nt, Vaccinia virus
gaaucuaaugaugac

SEQ ID NO: 3276740 - RNA, 14 nt, Vaccinia virus
ccuuaauauaauag

SEQ ID NO: 3276741 - RNA, 16 nt, Vaccinia virus
guuuaacaaaguuauu

SEQ ID NO: 3276742 - RNA, 22 nt, Vaccinia virus
uaguggaguaauuuacaaauug

SEQ ID NO: 3276743 - RNA, 22 nt, Vaccinia virus
agcuucgcugguaguuuaauau

SEQ ID NO: 3276744 - RNA, 13 nt, Vaccinia virus
gauagacuuucuc

SEQ ID NO: 3276745 - RNA, 13 nt, Vaccinia virus
uuauaaauagaug

SEQ ID NO: 3276746 - RNA, 22 nt, Vaccinia virus
gcuauuaaucauccaaagucaa

SEQ ID NO: 3276747 - RNA, 15 nt, Vaccinia virus
aaauguaaauccaau

SEQ ID NO: 3276748 - RNA, 19 nt, Vaccinia virus
uguaugugugauauugaua

SEQ ID NO: 3276749 - RNA, 21 nt, Vaccinia virus
ucacuucucuucauuacuacu

SEQ ID NO: 3276750 - RNA, 18 nt, Vaccinia virus
auacaaaauguuugacau

SEQ ID NO: 3276751 - RNA, 17 nt, Vaccinia virus
cuaauucgacuaucgaa

SEQ ID NO: 3276752 - RNA, 16 nt, Vaccinia virus
auugauuuuggaaacg

SEQ ID NO: 3276753 - RNA, 21 nt, Vaccinia virus
acuucuccuuauugauugaaa

SEQ ID NO: 3276754 - RNA, 18 nt, Vaccinia virus
guaugucgcggaugaaac

SEQ ID NO: 3276755 - RNA, 13 nt, Vaccinia virus
agccaauacuuua

SEQ ID NO: 3276756 - RNA, 20 nt, Vaccinia virus
auuaacgcaccuauaaagac

SEQ ID NO: 3276757 - RNA, 22 nt, Vaccinia virus
aauaauuucuagaacaucaucu

SEQ ID NO: 3276758 - RNA, 22 nt, Vaccinia virus
aaaugcgauacagacauuaaga

SEQ ID NO: 3276759 - RNA, 15 nt, Vaccinia virus
cgcucuuuugaugau

SEQ ID NO: 3276760 - RNA, 14 nt, Vaccinia virus
uuaauuuuuaguuu

SEQ ID NO: 3276761 - RNA, 13 nt, Vaccinia virus
cauauucucauaa

SEQ ID NO: 3276762 - RNA, 14 nt, Vaccinia virus
uauuguuacagaug

SEQ ID NO: 3276763 - RNA, 18 nt, Vaccinia virus
uuaguaauauaucucaga

SEQ ID NO: 3276764 - RNA, 12 nt, Vaccinia virus
auaaaaaaauua

SEQ ID NO: 3276765 - RNA, 14 nt, Vaccinia virus
cauaucuauccaua

SEQ ID NO: 3276766 - RNA, 15 nt, Vaccinia virus
aaagaugauauaucu

SEQ ID NO: 3276767 - RNA, 11 nt, Vaccinia virus
aacauguacau

SEQ ID NO: 3276768 - RNA, 21 nt, Vaccinia virus
uguaaaggauaugauauguug

SEQ ID NO: 3276769 - RNA, 18 nt, Vaccinia virus
cauaauuauucuaucaau

SEQ ID NO: 3276770 - RNA, 12 nt, Vaccinia virus
auauuuuaauga

SEQ ID NO: 3276771 - RNA, 17 nt, Vaccinia virus
acuuguuuaacaaaguu

SEQ ID NO: 3276772 - RNA, 12 nt, Vaccinia virus
auuuuuaucaug

SEQ ID NO: 3276773 - RNA, 15 nt, Vaccinia virus
uaugauaucucuauu

SEQ ID NO: 3276774 - RNA, 16 nt, Vaccinia virus
uucucucaacaucuuc

SEQ ID NO: 3276775 - RNA, 17 nt, Vaccinia virus
auccaauauuauugaaa

SEQ ID NO: 3276776 - RNA, 19 nt, Vaccinia virus
aacuuuauccauaucucua

SEQ ID NO: 3276777 - RNA, 18 nt, Vaccinia virus
auguguuuuagaauauau

SEQ ID NO: 3276778 - RNA, 18 nt, Vaccinia virus
uaugauagaaauuagcaa

SEQ ID NO: 3276779 - RNA, 13 nt, Vaccinia virus
aggaauaucugau

SEQ ID NO: 3276780 - RNA, 21 nt, Vaccinia virus
agaguauaaaacauuaaaugu

SEQ ID NO: 3276781 - RNA, 14 nt, Vaccinia virus
uuuguuagaguaua

SEQ ID NO: 3276782 - RNA, 18 nt, Vaccinia virus
guuaucaugaaauguuug

SEQ ID NO: 3276783 - RNA, 13 nt, Vaccinia virus
auuuauaaaaaaa

SEQ ID NO: 3276784 - RNA, 14 nt, Vaccinia virus
aggauagcaaaaua

SEQ ID NO: 3276785 - RNA, 13 nt, Vaccinia virus
cuacaaaauguug

SEQ ID NO: 3276786 - RNA, 15 nt, Vaccinia virus
auuuguuaacuauau

SEQ ID NO: 3276787 - RNA, 23 nt, Vaccinia virus
cacugucucauacacuacaguaa

SEQ ID NO: 3276788 - RNA, 14 nt, Vaccinia virus
auagaagauguuag

SEQ ID NO: 3276789 - RNA, 17 nt, Vaccinia virus
aguaagugucauuuaac

SEQ ID NO: 3276790 - RNA, 15 nt, Vaccinia virus
uauuauuauacauga

SEQ ID NO: 3276791 - RNA, 13 nt, Vaccinia virus
acucuaaguuugu

SEQ ID NO: 3276792 - RNA, 13 nt, Vaccinia virus
cuucguacauaag

SEQ ID NO: 3276793 - RNA, 20 nt, Vaccinia virus
auuucaucuccguaaauaua

SEQ ID NO: 3276794 - RNA, 20 nt, Vaccinia virus
uugacuacauucucauuaau

SEQ ID NO: 3276795 - RNA, 19 nt, Vaccinia virus
aacuauacgaaauaaauau

SEQ ID NO: 3276796 - RNA, 13 nt, Vaccinia virus
ucuuauagaugug

SEQ ID NO: 3276797 - RNA, 12 nt, Vaccinia virus
uguucagaaaua

SEQ ID NO: 3276798 - RNA, 17 nt, Vaccinia virus
augcaucuuauugaaug

SEQ ID NO: 3276799 - RNA, 15 nt, Vaccinia virus
auguuggagauacua

SEQ ID NO: 3276800 - RNA, 18 nt, Vaccinia virus
auuuauaucuaaaaauua

SEQ ID NO: 3276801 - RNA, 18 nt, Vaccinia virus
uuuacuguggcuagauac

SEQ ID NO: 3276802 - RNA, 13 nt, Vaccinia virus
gaugaauuauuau

SEQ ID NO: 3276803 - RNA, 16 nt, Vaccinia virus
uaaaaauaaacaacau

SEQ ID NO: 3276804 - RNA, 12 nt, Vaccinia virus
uaaaauaucuua

SEQ ID NO: 3276805 - RNA, 22 nt, Vaccinia virus
aucacaaaaaaaacuucucuaa

SEQ ID NO: 3276806 - RNA, 20 nt, Vaccinia virus
uguagcucucccagauuucu

SEQ ID NO: 3276807 - RNA, 13 nt, Vaccinia virus
uuuauuuauucuc

SEQ ID NO: 3276808 - RNA, 17 nt, Vaccinia virus
cauauacuauuacuuau

SEQ ID NO: 3276809 - RNA, 22 nt, Vaccinia virus
aguacucucucauaaaguggau

SEQ ID NO: 3276810 - RNA, 23 nt, Vaccinia virus
gugcauccaugcagcauuuccua

SEQ ID NO: 3276811 - RNA, 22 nt, Vaccinia virus
aauagcaccuagacaaguugcu

SEQ ID NO: 3276812 - RNA, 19 nt, Vaccinia virus
agaccgucuacaaaaaacu

SEQ ID NO: 3276813 - RNA, 20 nt, Vaccinia virus
aucaucauuuaccagaauac

SEQ ID NO: 3276814 - RNA, 20 nt, Vaccinia virus
aaaccaaggacuuuguagaa

SEQ ID NO: 3276815 - RNA, 21 nt, Vaccinia virus
aacaauauuaaggagauucua

SEQ ID NO: 3276816 - RNA, 15 nt, Vaccinia virus
uaugauuuugaugau

SEQ ID NO: 3276817 - RNA, 19 nt, Vaccinia virus
cuuguauucaacaugcuuu

SEQ ID NO: 3276818 - RNA, 21 nt, Vaccinia virus
guuuaacgaggacuuauucag

SEQ ID NO: 3276819 - RNA, 14 nt, Vaccinia virus
cuguuguacauaca

SEQ ID NO: 3276820 - RNA, 18 nt, Vaccinia virus
uucacaaaacuagacuuu

SEQ ID NO: 3276821 - RNA, 18 nt, Vaccinia virus
uaccaucaacuacuguag

SEQ ID NO: 3276822 - RNA, 21 nt, Vaccinia virus
auuacaauuugcauguugcau

SEQ ID NO: 3276823 - RNA, 23 nt, Vaccinia virus
auuaccauagaagauguuagaaa

SEQ ID NO: 3276824 - RNA, 21 nt, Vaccinia virus
acaaucuacucacauaugcau

SEQ ID NO: 3276825 - RNA, 12 nt, Vaccinia virus
ucuauuuggauu

SEQ ID NO: 3276826 - RNA, 13 nt, Vaccinia virus
aaauagaacuuau

SEQ ID NO: 3276827 - RNA, 16 nt, Vaccinia virus
acugaucccuaauuuc

SEQ ID NO: 3276828 - RNA, 13 nt, Vaccinia virus
auaucucuagaua

SEQ ID NO: 3276829 - RNA, 18 nt, Vaccinia virus
aaauauaugcucauauau

SEQ ID NO: 3276830 - RNA, 17 nt, Vaccinia virus
gaucgauaaugagaaua

SEQ ID NO: 3276831 - RNA, 16 nt, Vaccinia virus
uuuaauucuagacuau

SEQ ID NO: 3276832 - RNA, 20 nt, Vaccinia virus
guaauaucaugucuaaugau

SEQ ID NO: 3276833 - RNA, 22 nt, Vaccinia virus
uauaucuguccaauuaaaugua

SEQ ID NO: 3276834 - RNA, 19 nt, Vaccinia virus
gaugcuauguauauauauu

SEQ ID NO: 3276835 - RNA, 17 nt, Vaccinia virus
cuuuagaugaauuauua

SEQ ID NO: 3276836 - RNA, 18 nt, Vaccinia virus
ugaccuggaaaaauacuu

SEQ ID NO: 3276837 - RNA, 19 nt, Vaccinia virus
agauauauauggucuuaug

SEQ ID NO: 3276838 - RNA, 16 nt, Vaccinia virus
ucuuauccauuuauaa

SEQ ID NO: 3276839 - RNA, 18 nt, Vaccinia virus
acgaauuuccucagagga

SEQ ID NO: 3276840 - RNA, 21 nt, Vaccinia virus
augagaauaaaacucuacuau

SEQ ID NO: 3276841 - RNA, 16 nt, Vaccinia virus
aacgcaacaaaugauu

SEQ ID NO: 3276842 - RNA, 21 nt, Vaccinia virus
ucauacauaugguacgauguu

SEQ ID NO: 3276843 - RNA, 15 nt, Vaccinia virus
auguuuguucagagg

SEQ ID NO: 3276844 - RNA, 14 nt, Vaccinia virus
uuuagucgagauau

SEQ ID NO: 3276845 - RNA, 22 nt, Vaccinia virus
uacgcaauaugaucacaaagaa

SEQ ID NO: 3276846 - RNA, 16 nt, Vaccinia virus
aggagcauacaguaag

SEQ ID NO: 3276847 - RNA, 18 nt, Vaccinia virus
cguauaacaguaaaagaa

SEQ ID NO: 3276848 - RNA, 17 nt, Vaccinia virus
auaguuaaaaaaauaca

SEQ ID NO: 3276849 - RNA, 14 nt, Vaccinia virus
gagucucaucuuua

SEQ ID NO: 3276850 - RNA, 23 nt, Vaccinia virus
aauaauucauggaaauuuaacag

SEQ ID NO: 3276851 - RNA, 13 nt, Vaccinia virus
uagaacuuaacuu

SEQ ID NO: 3276852 - RNA, 19 nt, Vaccinia virus
ucacaaaucacacaagcca

SEQ ID NO: 3276853 - RNA, 18 nt, Vaccinia virus
ccauuaucuauaucaucu

SEQ ID NO: 3276854 - RNA, 22 nt, Vaccinia virus
auugauaaagaucuaaaaauua

SEQ ID NO: 3276855 - RNA, 22 nt, Vaccinia virus
auauuuuuuaucuaaaaaacua

SEQ ID NO: 3276856 - RNA, 11 nt, Vaccinia virus
uuuaaaaucau

SEQ ID NO: 3276857 - RNA, 15 nt, Vaccinia virus
gauuacaagaaauau

SEQ ID NO: 3276858 - RNA, 15 nt, Vaccinia virus
gugcuuaauguuucc

SEQ ID NO: 3276859 - RNA, 17 nt, Vaccinia virus
gcauauucgaaauuaga

SEQ ID NO: 3276860 - RNA, 17 nt, Vaccinia virus
uugauaauuacgcguau

SEQ ID NO: 3276861 - RNA, 21 nt, Vaccinia virus
cuauuucaacgucuaauguau

SEQ ID NO: 3276862 - RNA, 15 nt, Vaccinia virus
accagaugucauuau

SEQ ID NO: 3276863 - RNA, 14 nt, Vaccinia virus
aaucauugauacau

SEQ ID NO: 3276864 - RNA, 18 nt, Vaccinia virus
auaaauauuuuuauucag

SEQ ID NO: 3276865 - RNA, 14 nt, Vaccinia virus
cauacuacuauuau

SEQ ID NO: 3276866 - RNA, 21 nt, Vaccinia virus
agugauaaguaauaacuaugu

SEQ ID NO: 3276867 - RNA, 20 nt, Vaccinia virus
acauucaaccacucucgaua

SEQ ID NO: 3276868 - RNA, 19 nt, Vaccinia virus
gaugacuuuaguaaaucau

SEQ ID NO: 3276869 - RNA, 19 nt, Vaccinia virus
cuauguugacauguauaua

SEQ ID NO: 3276870 - RNA, 23 nt, Vaccinia virus
gaauaucaucgacuguugccaau

SEQ ID NO: 3276871 - RNA, 16 nt, Vaccinia virus
aacaccuauaagauua

SEQ ID NO: 3276872 - RNA, 21 nt, Vaccinia virus
uauacauccguagaaauauga

SEQ ID NO: 3276873 - RNA, 19 nt, Vaccinia virus
gcagucauuccaucauuua

SEQ ID NO: 3276874 - RNA, 13 nt, Vaccinia virus
uauuaucuauaaa

SEQ ID NO: 3276875 - RNA, 16 nt, Vaccinia virus
uuguauauuuuauuuu

SEQ ID NO: 3276876 - RNA, 17 nt, Vaccinia virus
ggacuauuugacuuugu

SEQ ID NO: 3276877 - RNA, 17 nt, Vaccinia virus
uccaaauugcgacacua

SEQ ID NO: 3276878 - RNA, 15 nt, Vaccinia virus
auaauuauuuuguaa

SEQ ID NO: 3276879 - RNA, 15 nt, Vaccinia virus
aagauuuaaauccua

SEQ ID NO: 3276880 - RNA, 12 nt, Vaccinia virus
cuccuguuugau

SEQ ID NO: 3276881 - RNA, 14 nt, Vaccinia virus
uuccauccuuugua

SEQ ID NO: 3276882 - RNA, 14 nt, Vaccinia virus
uaucuaacaucuug

SEQ ID NO: 3276883 - RNA, 15 nt, Vaccinia virus
acacgcauuaacaug

SEQ ID NO: 3276884 - RNA, 20 nt, Vaccinia virus
aauauagaacaucauuucca

SEQ ID NO: 3276885 - RNA, 19 nt, Vaccinia virus
uagacuuaucgacaucuug

SEQ ID NO: 3276886 - RNA, 16 nt, Vaccinia virus
uaaaggaugaguacau

SEQ ID NO: 3276887 - RNA, 19 nt, Vaccinia virus
cuccacaguuuuuaauuuc

SEQ ID NO: 3276888 - RNA, 17 nt, Vaccinia virus
agauucgcauaaaggau

SEQ ID NO: 3276889 - RNA, 15 nt, Vaccinia virus
uguuuaaaucaaaau

SEQ ID NO: 3276890 - RNA, 14 nt, Vaccinia virus
gaaagagaagaugg

SEQ ID NO: 3276891 - RNA, 17 nt, Vaccinia virus
cuaucuccgaauuuguu

SEQ ID NO: 3276892 - RNA, 19 nt, Vaccinia virus
aucuauuugauaauuacgc

SEQ ID NO: 3276893 - RNA, 14 nt, Vaccinia virus
agguacuaggaaaa

SEQ ID NO: 3276894 - RNA, 22 nt, Vaccinia virus
acauauuauucaaaauaugauu

SEQ ID NO: 3276895 - RNA, 15 nt, Vaccinia virus
uucuauucuuauucu

SEQ ID NO: 3276896 - RNA, 17 nt, Vaccinia virus
uacuuaaagauagaaau

SEQ ID NO: 3276897 - RNA, 15 nt, Vaccinia virus
aucugucuuaauuaa

SEQ ID NO: 3276898 - RNA, 21 nt, Vaccinia virus
auagguaauacauauaaaugu

SEQ ID NO: 3276899 - RNA, 16 nt, Vaccinia virus
agaucuuugauauacu

SEQ ID NO: 3276900 - RNA, 22 nt, Vaccinia virus
cugguuugauaaacuguuuauu

SEQ ID NO: 3276901 - RNA, 15 nt, Vaccinia virus
cauuaucaaaaagaa

SEQ ID NO: 3276902 - RNA, 13 nt, Vaccinia virus
aaacacuguuguu

SEQ ID NO: 3276903 - RNA, 13 nt, Vaccinia virus
cuauuuguuuaua

SEQ ID NO: 3276904 - RNA, 16 nt, Vaccinia virus
aauaggaauggauaau

SEQ ID NO: 3276905 - RNA, 20 nt, Vaccinia virus
acuuuuucaucuuuacauau

SEQ ID NO: 3276906 - RNA, 16 nt, Vaccinia virus
uagcagauagauaaag

SEQ ID NO: 3276907 - RNA, 18 nt, Vaccinia virus
uauauaucagauacaguu

SEQ ID NO: 3276908 - RNA, 22 nt, Vaccinia virus
uaugugugauauugauaucuuu

SEQ ID NO: 3276909 - RNA, 15 nt, Vaccinia virus
aauucuauucuagua

SEQ ID NO: 3276910 - RNA, 23 nt, Vaccinia virus
agaaggaguugauuaagaauaua

SEQ ID NO: 3276911 - RNA, 14 nt, Vaccinia virus
aguaagcauuuccu

SEQ ID NO: 3276912 - RNA, 19 nt, Vaccinia virus
cagcuauguuaucaugaaa

SEQ ID NO: 3276913 - RNA, 23 nt, Vaccinia virus
aauuucuaaaggagcaaauguua

SEQ ID NO: 3276914 - RNA, 17 nt, Vaccinia virus
aggacagaaaaaugcua

SEQ ID NO: 3276915 - RNA, 19 nt, Vaccinia virus
gaguauucgccccaaagga

SEQ ID NO: 3276916 - RNA, 19 nt, Vaccinia virus
acuauguguuaaaaaauuc

SEQ ID NO: 3276917 - RNA, 17 nt, Vaccinia virus
auuaauguaacuauaga

SEQ ID NO: 3276918 - RNA, 22 nt, Vaccinia virus
aguaaacuugacuaaaucuuaa

SEQ ID NO: 3276919 - RNA, 13 nt, Vaccinia virus
ucguucucuaaau

SEQ ID NO: 3276920 - RNA, 21 nt, Vaccinia virus
aauacuaaugcaucuauuuca

SEQ ID NO: 3276921 - RNA, 14 nt, Vaccinia virus
ccauauuuuuugca

SEQ ID NO: 3276922 - RNA, 14 nt, Vaccinia virus
auagauagaacuac

SEQ ID NO: 3276923 - RNA, 17 nt, Vaccinia virus
uauuaauuguaaaugau

SEQ ID NO: 3276924 - RNA, 15 nt, Vaccinia virus
auaaguuucauagau

SEQ ID NO: 3276925 - RNA, 15 nt, Vaccinia virus
auaauuuucauauau

SEQ ID NO: 3276926 - RNA, 13 nt, Vaccinia virus
augauauggaugu

SEQ ID NO: 3276927 - RNA, 14 nt, Vaccinia virus
uuacugaauuauua

SEQ ID NO: 3276928 - RNA, 14 nt, Vaccinia virus
uacaucuguuuccu

SEQ ID NO: 3276929 - RNA, 14 nt, Vaccinia virus
gauucaucaacauu

SEQ ID NO: 3276930 - RNA, 15 nt, Vaccinia virus
uuucuacuagacuau

SEQ ID NO: 3276931 - RNA, 13 nt, Vaccinia virus
guuuaauacuuau

SEQ ID NO: 3276932 - RNA, 14 nt, Vaccinia virus
agaacuuaacaaua

SEQ ID NO: 3276933 - RNA, 18 nt, Vaccinia virus
aaguuuauagcagaauuc

SEQ ID NO: 3276934 - RNA, 19 nt, Vaccinia virus
cuuuggagucucaucuuua

SEQ ID NO: 3276935 - RNA, 19 nt, Vaccinia virus
aucuugugaacuagacaua

SEQ ID NO: 3276936 - RNA, 12 nt, Vaccinia virus
uucgcugcuaug

SEQ ID NO: 3276937 - RNA, 18 nt, Vaccinia virus
uuggcaguacucauuaau

SEQ ID NO: 3276938 - RNA, 15 nt, Vaccinia virus
guuuucauuauuauu

SEQ ID NO: 3276939 - RNA, 22 nt, Vaccinia virus
cuuuaauaggaguaauagaacu

SEQ ID NO: 3276940 - RNA, 12 nt, Vaccinia virus
cauucuauuuuu

SEQ ID NO: 3276941 - RNA, 16 nt, Vaccinia virus
aguccuauauauuuga

SEQ ID NO: 3276942 - RNA, 14 nt, Vaccinia virus
gcgaggaaauguau

SEQ ID NO: 3276943 - RNA, 19 nt, Vaccinia virus
ucguaauuauaguucuuaa

SEQ ID NO: 3276944 - RNA, 14 nt, Vaccinia virus
agaggauuuucuag

SEQ ID NO: 3276945 - RNA, 16 nt, Vaccinia virus
aaccagaucaaaacaa

SEQ ID NO: 3276946 - RNA, 19 nt, Vaccinia virus
aaugccuuccaaaguuuaa

SEQ ID NO: 3276947 - RNA, 13 nt, Vaccinia virus
cgacaagauaucg

SEQ ID NO: 3276948 - RNA, 14 nt, Vaccinia virus
gcaaauaaaaucua

SEQ ID NO: 3276949 - RNA, 19 nt, Vaccinia virus
ugccaaaucuauaagaaaa

SEQ ID NO: 3276950 - RNA, 22 nt, Vaccinia virus
uggaucuccaucgaugauacau

SEQ ID NO: 3276951 - RNA, 17 nt, Vaccinia virus
augcaucgaacgaccau

SEQ ID NO: 3276952 - RNA, 19 nt, Vaccinia virus
acaagacuacaaagaaugu

SEQ ID NO: 3276953 - RNA, 15 nt, Vaccinia virus
ugguaucaacagaua

SEQ ID NO: 3276954 - RNA, 21 nt, Vaccinia virus
acauaaacggcuuuuaaacag

SEQ ID NO: 3276955 - RNA, 15 nt, Vaccinia virus
acuguuuauuaauga

SEQ ID NO: 3276956 - RNA, 20 nt, Vaccinia virus
acaucucugaacuauauaau

SEQ ID NO: 3276957 - RNA, 19 nt, Vaccinia virus
ucuaacgccgaucucugaa

SEQ ID NO: 3276958 - RNA, 15 nt, Vaccinia virus
ugcaaauguaguauu

SEQ ID NO: 3276959 - RNA, 19 nt, Vaccinia virus
uagccgauaaacaaaucau

SEQ ID NO: 3276960 - RNA, 17 nt, Vaccinia virus
acauaugacaaacauug

SEQ ID NO: 3276961 - RNA, 20 nt, Vaccinia virus
auauuguaccagauuaauga

SEQ ID NO: 3276962 - RNA, 18 nt, Vaccinia virus
ucaacguagaaaaaauag

SEQ ID NO: 3276963 - RNA, 19 nt, Vaccinia virus
agcguuaacuaucaaacaa

SEQ ID NO: 3276964 - RNA, 16 nt, Vaccinia virus
aucauacauuuaauaa

SEQ ID NO: 3276965 - RNA, 18 nt, Vaccinia virus
uaauggauauucugaaua

SEQ ID NO: 3276966 - RNA, 23 nt, Vaccinia virus
ucauucgcggaacuacauaguaa

SEQ ID NO: 3276967 - RNA, 20 nt, Vaccinia virus
guuauugguauuucuuacau

SEQ ID NO: 3276968 - RNA, 20 nt, Vaccinia virus
cguccaacgaguaacauccg

SEQ ID NO: 3276969 - RNA, 15 nt, Vaccinia virus
agaauguauaaaccu

SEQ ID NO: 3276970 - RNA, 17 nt, Vaccinia virus
uaugaacgaaauagcua

SEQ ID NO: 3276971 - RNA, 21 nt, Vaccinia virus
cucauuacauaguugauaaaa

SEQ ID NO: 3276972 - RNA, 16 nt, Vaccinia virus
gaauauaucuauaauu

SEQ ID NO: 3276973 - RNA, 19 nt, Vaccinia virus
ucauguucgaaaaagugaa

SEQ ID NO: 3276974 - RNA, 20 nt, Vaccinia virus
caucucguuuagauuuucca

SEQ ID NO: 3276975 - RNA, 14 nt, Vaccinia virus
aagaauauagaaau

SEQ ID NO: 3276976 - RNA, 20 nt, Vaccinia virus
caauaucugauuauuaugau

SEQ ID NO: 3276977 - RNA, 12 nt, Vaccinia virus
aaagauguuauu

SEQ ID NO: 3276978 - RNA, 20 nt, Vaccinia virus
cgucacagaaucuaccacag

SEQ ID NO: 3276979 - RNA, 18 nt, Vaccinia virus
gaaauagaggaagacaca

SEQ ID NO: 3276980 - RNA, 18 nt, Vaccinia virus
auguaugauucaauguau

SEQ ID NO: 3276981 - RNA, 16 nt, Vaccinia virus
cugauguuuguuuucg

SEQ ID NO: 3276982 - RNA, 14 nt, Vaccinia virus
uaucuguuaccaua

SEQ ID NO: 3276983 - RNA, 19 nt, Vaccinia virus
auagauuucgaaaauacua

SEQ ID NO: 3276984 - RNA, 21 nt, Vaccinia virus
aaauugucuagauaaaauacu

SEQ ID NO: 3276985 - RNA, 17 nt, Vaccinia virus
ugacacauuuuacgaua

SEQ ID NO: 3276986 - RNA, 17 nt, Vaccinia virus
gugauggauuuaaacau

SEQ ID NO: 3276987 - RNA, 17 nt, Vaccinia virus
auaaaggagaaggaaaa

SEQ ID NO: 3276988 - RNA, 22 nt, Vaccinia virus
cacugucuggcaauaaaugaua

SEQ ID NO: 3276989 - RNA, 14 nt, Vaccinia virus
uaaauaucauuaau

SEQ ID NO: 3276990 - RNA, 15 nt, Vaccinia virus
aaauacuuccaucaa

SEQ ID NO: 3276991 - RNA, 15 nt, Vaccinia virus
ucaucaauagacaua

SEQ ID NO: 3276992 - RNA, 22 nt, Vaccinia virus
aagauaccaaacagaauccuaa

SEQ ID NO: 3276993 - RNA, 21 nt, Vaccinia virus
agauaaugauauauuaaacaa

SEQ ID NO: 3276994 - RNA, 17 nt, Vaccinia virus
ugaacauaguaagaaau

SEQ ID NO: 3276995 - RNA, 17 nt, Vaccinia virus
uaaacucacauuucaaa

SEQ ID NO: 3276996 - RNA, 21 nt, Vaccinia virus
uauuuugauaggaucuauaau

SEQ ID NO: 3276997 - RNA, 17 nt, Vaccinia virus
cucauaaaauaguucuc

SEQ ID NO: 3276998 - RNA, 15 nt, Vaccinia virus
uaaagccguaauuga

SEQ ID NO: 3276999 - RNA, 15 nt, Vaccinia virus
gacaacgaauacaaa

SEQ ID NO: 3277000 - RNA, 15 nt, Vaccinia virus
aauccauucuaauga

SEQ ID NO: 3277001 - RNA, 22 nt, Vaccinia virus
aagauccaaacgaggaggaaau

SEQ ID NO: 3277002 - RNA, 19 nt, Vaccinia virus
gauaauauuagacauauga

SEQ ID NO: 3277003 - RNA, 22 nt, Vaccinia virus
aguucacaacucgccucuaaug

SEQ ID NO: 3277004 - RNA, 17 nt, Vaccinia virus
gaccggcaaucaugaau

SEQ ID NO: 3277005 - RNA, 14 nt, Vaccinia virus
cuuccaacauaaua

SEQ ID NO: 3277006 - RNA, 14 nt, Vaccinia virus
auguuguuaccaua

SEQ ID NO: 3277007 - RNA, 12 nt, Vaccinia virus
aggaaauacuug

SEQ ID NO: 3277008 - RNA, 11 nt, Vaccinia virus
ucaacaaacua

SEQ ID NO: 3277009 - RNA, 16 nt, Vaccinia virus
gaagaugcuauaucaa

SEQ ID NO: 3277010 - RNA, 14 nt, Vaccinia virus
uagagaucuaaagc

SEQ ID NO: 3277011 - RNA, 13 nt, Vaccinia virus
acucucgauaaau

SEQ ID NO: 3277012 - RNA, 18 nt, Vaccinia virus
aaacgauguacugaagau

SEQ ID NO: 3277013 - RNA, 16 nt, Vaccinia virus
aguuaaggauaauaag

SEQ ID NO: 3277014 - RNA, 22 nt, Vaccinia virus
auugucuauaucuaaaaucaua

SEQ ID NO: 3277015 - RNA, 13 nt, Vaccinia virus
agauauuaaugag

SEQ ID NO: 3277016 - RNA, 17 nt, Vaccinia virus
aaucuaucuuauauaca

SEQ ID NO: 3277017 - RNA, 21 nt, Vaccinia virus
auaucuuugguguaaaguuaa

SEQ ID NO: 3277018 - RNA, 21 nt, Vaccinia virus
auuccaacaacaucaacugaa

SEQ ID NO: 3277019 - RNA, 15 nt, Vaccinia virus
auacuagaguacuua

SEQ ID NO: 3277020 - RNA, 16 nt, Vaccinia virus
cugaaaagaagugagu

SEQ ID NO: 3277021 - RNA, 17 nt, Vaccinia virus
cauacccuccuguauau

SEQ ID NO: 3277022 - RNA, 15 nt, Vaccinia virus
uacucagaggauuac

SEQ ID NO: 3277023 - RNA, 19 nt, Vaccinia virus
caucuaacuauaugauauc

SEQ ID NO: 3277024 - RNA, 19 nt, Vaccinia virus
auccacugcugaacagcua

SEQ ID NO: 3277025 - RNA, 15 nt, Vaccinia virus
acgaugaaaauggua

SEQ ID NO: 3277026 - RNA, 20 nt, Vaccinia virus
ucucuauccaaggauguaau

SEQ ID NO: 3277027 - RNA, 13 nt, Vaccinia virus
agaaaacagacuu

SEQ ID NO: 3277028 - RNA, 16 nt, Vaccinia virus
aacauuaaauguauuu

SEQ ID NO: 3277029 - RNA, 12 nt, Vaccinia virus
agauaaaugguc

SEQ ID NO: 3277030 - RNA, 20 nt, Vaccinia virus
acaggcgaugguaaaaagac

SEQ ID NO: 3277031 - RNA, 17 nt, Vaccinia virus
cuuuaaguauauacgau

SEQ ID NO: 3277032 - RNA, 15 nt, Vaccinia virus
uaggguuguguauaa

SEQ ID NO: 3277033 - RNA, 22 nt, Vaccinia virus
gaaaaugaaaagguacuagaua

SEQ ID NO: 3277034 - RNA, 18 nt, Vaccinia virus
uguaacgaugaaaaccag

SEQ ID NO: 3277035 - RNA, 23 nt, Vaccinia virus
uuaugaaacuuggaaacaucucu

SEQ ID NO: 3277036 - RNA, 16 nt, Vaccinia virus
acagcaguaguuuaac

SEQ ID NO: 3277037 - RNA, 16 nt, Vaccinia virus
auguagcaaacaugau

SEQ ID NO: 3277038 - RNA, 22 nt, Vaccinia virus
auucuuagaaauauaaaacuug

SEQ ID NO: 3277039 - RNA, 17 nt, Vaccinia virus
uuauuagcgcaaucagu

SEQ ID NO: 3277040 - RNA, 16 nt, Vaccinia virus
uaucuauaaacauaag

SEQ ID NO: 3277041 - RNA, 19 nt, Vaccinia virus
aaaacauauauaauaaaua

SEQ ID NO: 3277042 - RNA, 23 nt, Vaccinia virus
uagugucaauuuuaaaugaugau

SEQ ID NO: 3277043 - RNA, 17 nt, Vaccinia virus
auuauccuaucauguau

SEQ ID NO: 3277044 - RNA, 19 nt, Vaccinia virus
ucaucaucguuacaauaaa

SEQ ID NO: 3277045 - RNA, 23 nt, Vaccinia virus
acaaauauuuaacucaugaugaa

SEQ ID NO: 3277046 - RNA, 17 nt, Vaccinia virus
uccuauaacuucuaauc

SEQ ID NO: 3277047 - RNA, 21 nt, Vaccinia virus
aucaauaccuuuucuggcuaa

SEQ ID NO: 3277048 - RNA, 13 nt, Vaccinia virus
cuuuuuauucucg

SEQ ID NO: 3277049 - RNA, 15 nt, Vaccinia virus
uaaaggauguggaca

SEQ ID NO: 3277050 - RNA, 20 nt, Vaccinia virus
uucucaaaagaucaaggaaa

SEQ ID NO: 3277051 - RNA, 19 nt, Vaccinia virus
aaaaugcgauguugauuua

SEQ ID NO: 3277052 - RNA, 22 nt, Vaccinia virus
auggucucggauugguggauau

SEQ ID NO: 3277053 - RNA, 15 nt, Vaccinia virus
uauugucuucuacau

SEQ ID NO: 3277054 - RNA, 15 nt, Vaccinia virus
aucagauucuuauau

SEQ ID NO: 3277055 - RNA, 18 nt, Vaccinia virus
uugagacgggucaaacaa

SEQ ID NO: 3277056 - RNA, 21 nt, Vaccinia virus
uccccaaaaguaaaauaauca

SEQ ID NO: 3277057 - RNA, 20 nt, Vaccinia virus
acuaucaaucgauaacaaga

SEQ ID NO: 3277058 - RNA, 16 nt, Vaccinia virus
uugguggaauagauga

SEQ ID NO: 3277059 - RNA, 21 nt, Vaccinia virus
ucaggacgaauaauucuaaua

SEQ ID NO: 3277060 - RNA, 17 nt, Vaccinia virus
ucuauaaauaaaagaca

SEQ ID NO: 3277061 - RNA, 20 nt, Vaccinia virus
uuagaaaacucucuauuucu

SEQ ID NO: 3277062 - RNA, 13 nt, Vaccinia virus
guuacugauuuuu

SEQ ID NO: 3277063 - RNA, 14 nt, Vaccinia virus
aagaauuuggaaau

SEQ ID NO: 3277064 - RNA, 14 nt, Vaccinia virus
uguuucuuuuagaa

SEQ ID NO: 3277065 - RNA, 18 nt, Vaccinia virus
agaucugagaauggauga

SEQ ID NO: 3277066 - RNA, 13 nt, Vaccinia virus
acguuaauacaaa

SEQ ID NO: 3277067 - RNA, 17 nt, Vaccinia virus
cugauuauuuacuauaa

SEQ ID NO: 3277068 - RNA, 21 nt, Vaccinia virus
acucucuauuucuuaaugaau

SEQ ID NO: 3277069 - RNA, 18 nt, Vaccinia virus
aggagucuuauagaugua

SEQ ID NO: 3277070 - RNA, 22 nt, Vaccinia virus
aguuuaagaaucucaugucaaa

SEQ ID NO: 3277071 - RNA, 16 nt, Vaccinia virus
cauaacauaaaaacuc

SEQ ID NO: 3277072 - RNA, 22 nt, Vaccinia virus
aaucuacauccaauuuuagaaa

SEQ ID NO: 3277073 - RNA, 12 nt, Vaccinia virus
ugacuucaucau

SEQ ID NO: 3277074 - RNA, 17 nt, Vaccinia virus
ugacuuucaaaccaauu

SEQ ID NO: 3277075 - RNA, 18 nt, Vaccinia virus
gaauugguggaaaaagug

SEQ ID NO: 3277076 - RNA, 12 nt, Vaccinia virus
ccaguauucucg

SEQ ID NO: 3277077 - RNA, 19 nt, Vaccinia virus
cugaacuugaggucaagga

SEQ ID NO: 3277078 - RNA, 13 nt, Vaccinia virus
uaucgaacaaauu

SEQ ID NO: 3277079 - RNA, 23 nt, Vaccinia virus
guucguaaacgaacuauaucauc

SEQ ID NO: 3277080 - RNA, 16 nt, Vaccinia virus
uauaauaaucaauaau

SEQ ID NO: 3277081 - RNA, 24 nt, Vaccinia virus
cuagacgauuaguaauauaucuca

SEQ ID NO: 3277082 - RNA, 22 nt, Vaccinia virus
uggagauccauaugaggaguca

SEQ ID NO: 3277083 - RNA, 12 nt, Vaccinia virus
auuuuuaucauu

SEQ ID NO: 3277084 - RNA, 17 nt, Vaccinia virus
auacaauccaugauauu

SEQ ID NO: 3277085 - RNA, 21 nt, Vaccinia virus
cuccucauuacguuucauuuu

SEQ ID NO: 3277086 - RNA, 13 nt, Vaccinia virus
guaugucaugaau

SEQ ID NO: 3277087 - RNA, 16 nt, Vaccinia virus
uauaauuuuuaacagu

SEQ ID NO: 3277088 - RNA, 16 nt, Vaccinia virus
cuuugguguaaaguua

SEQ ID NO: 3277089 - RNA, 20 nt, Vaccinia virus
auuaugaaaaaguaaaugau

SEQ ID NO: 3277090 - RNA, 17 nt, Vaccinia virus
aucuagauaauuaauaa

SEQ ID NO: 3277091 - RNA, 15 nt, Vaccinia virus
auuacacauuuccaa

SEQ ID NO: 3277092 - RNA, 22 nt, Vaccinia virus
agcagauuagacgauaugacau

SEQ ID NO: 3277093 - RNA, 18 nt, Vaccinia virus
aauaacauuuauuaucau

SEQ ID NO: 3277094 - RNA, 14 nt, Vaccinia virus
aacucaucgagaua

SEQ ID NO: 3277095 - RNA, 11 nt, Vaccinia virus
aaaagaaagua

SEQ ID NO: 3277096 - RNA, 20 nt, Vaccinia virus
aagauuuuugagaugucuca

SEQ ID NO: 3277097 - RNA, 17 nt, Vaccinia virus
uuauagauuuguaucuc

SEQ ID NO: 3277098 - RNA, 20 nt, Vaccinia virus
uacuccucauuacguuucau

SEQ ID NO: 3277099 - RNA, 17 nt, Vaccinia virus
auauaucacuauaagaa

SEQ ID NO: 3277100 - RNA, 14 nt, Vaccinia virus
uauucuauuucgaa

SEQ ID NO: 3277101 - RNA, 16 nt, Vaccinia virus
auuaacgaguuaaaaa

SEQ ID NO: 3277102 - RNA, 17 nt, Vaccinia virus
ucccauucuaauacuuu

SEQ ID NO: 3277103 - RNA, 22 nt, Vaccinia virus
auauacucuaaucuuuaauaga

SEQ ID NO: 3277104 - RNA, 19 nt, Vaccinia virus
acauugaugagacaauaau

SEQ ID NO: 3277105 - RNA, 18 nt, Vaccinia virus
caguaaguacaucaucug

SEQ ID NO: 3277106 - RNA, 17 nt, Vaccinia virus
gacacuauucauguaau

SEQ ID NO: 3277107 - RNA, 13 nt, Vaccinia virus
ucauucauauucu

SEQ ID NO: 3277108 - RNA, 13 nt, Vaccinia virus
auuuucauucacu

SEQ ID NO: 3277109 - RNA, 19 nt, Vaccinia virus
gcgguucaaaauagaaaau

SEQ ID NO: 3277110 - RNA, 18 nt, Vaccinia virus
gaagaacgguagaaacua

SEQ ID NO: 3277111 - RNA, 19 nt, Vaccinia virus
cucgaugggacauuucaac

SEQ ID NO: 3277112 - RNA, 13 nt, Vaccinia virus
uuuaaagaaguag

SEQ ID NO: 3277113 - RNA, 24 nt, Vaccinia virus
cguacucccaauauguguacgaac

SEQ ID NO: 3277114 - RNA, 19 nt, Vaccinia virus
guaaauuuuaucaugugua

SEQ ID NO: 3277115 - RNA, 21 nt, Vaccinia virus
ucaucaauguagaaaaugccc

SEQ ID NO: 3277116 - RNA, 13 nt, Vaccinia virus
uaacauugagaau

SEQ ID NO: 3277117 - RNA, 17 nt, Vaccinia virus
ugaugacacuagaugau

SEQ ID NO: 3277118 - RNA, 19 nt, Vaccinia virus
acauuguuuguauucucca

SEQ ID NO: 3277119 - RNA, 23 nt, Vaccinia virus
auaauacauccuacuaugcaauu

SEQ ID NO: 3277120 - RNA, 20 nt, Vaccinia virus
uacuucacucaucgauucaa

SEQ ID NO: 3277121 - RNA, 14 nt, Vaccinia virus
uuauacauuaucuu

SEQ ID NO: 3277122 - RNA, 21 nt, Vaccinia virus
gaaauacuaaaaaauguagaa

SEQ ID NO: 3277123 - RNA, 12 nt, Vaccinia virus
aauauuaaauau

SEQ ID NO: 3277124 - RNA, 22 nt, Vaccinia virus
aauuauuccucucaucacuaau

SEQ ID NO: 3277125 - RNA, 16 nt, Vaccinia virus
guggaugguuaaaaag

SEQ ID NO: 3277126 - RNA, 18 nt, Vaccinia virus
ucaaacaugacauuuucc

SEQ ID NO: 3277127 - RNA, 23 nt, Vaccinia virus
agauauuagucaaggaugugauu

SEQ ID NO: 3277128 - RNA, 14 nt, Vaccinia virus
ccacuauaaaauaa

SEQ ID NO: 3277129 - RNA, 15 nt, Vaccinia virus
uuguaauaucuuaaa

SEQ ID NO: 3277130 - RNA, 16 nt, Vaccinia virus
aguagacgacauagaa

SEQ ID NO: 3277131 - RNA, 12 nt, Vaccinia virus
aauacaggauua

SEQ ID NO: 3277132 - RNA, 16 nt, Vaccinia virus
auucauccuguugucu

SEQ ID NO: 3277133 - RNA, 15 nt, Vaccinia virus
cagagaggccaucug

SEQ ID NO: 3277134 - RNA, 14 nt, Vaccinia virus
aauugcuuuucuaa

SEQ ID NO: 3277135 - RNA, 17 nt, Vaccinia virus
auuagacgauaugacau

SEQ ID NO: 3277136 - RNA, 16 nt, Vaccinia virus
agauguuauuccuguu

SEQ ID NO: 3277137 - RNA, 17 nt, Vaccinia virus
caaaauccuauauugua

SEQ ID NO: 3277138 - RNA, 20 nt, Vaccinia virus
aggauacauaaaauuuaaga

SEQ ID NO: 3277139 - RNA, 19 nt, Vaccinia virus
ugauaucauguuagauaua

SEQ ID NO: 3277140 - RNA, 14 nt, Vaccinia virus
acgauaaugucuuu

SEQ ID NO: 3277141 - RNA, 17 nt, Vaccinia virus
acaucuauauacuauau

SEQ ID NO: 3277142 - RNA, 12 nt, Vaccinia virus
aauaaaacauuu

SEQ ID NO: 3277143 - RNA, 23 nt, Vaccinia virus
cauuacuucuuccauguccaaua

SEQ ID NO: 3277144 - RNA, 16 nt, Vaccinia virus
cuuaguaaacagucca

SEQ ID NO: 3277145 - RNA, 13 nt, Vaccinia virus
guccuuaauaucu

SEQ ID NO: 3277146 - RNA, 18 nt, Vaccinia virus
ucaccaauaagauaauag

SEQ ID NO: 3277147 - RNA, 18 nt, Vaccinia virus
ucauagccgcucuuagag

SEQ ID NO: 3277148 - RNA, 14 nt, Vaccinia virus
uuaaauaucauaau

SEQ ID NO: 3277149 - RNA, 16 nt, Vaccinia virus
agaugauaaaaacauu

SEQ ID NO: 3277150 - RNA, 14 nt, Vaccinia virus
cuccccaaacauug

SEQ ID NO: 3277151 - RNA, 15 nt, Vaccinia virus
gaugagauguuuaua

SEQ ID NO: 3277152 - RNA, 17 nt, Vaccinia virus
aauuuauuguaacagua

SEQ ID NO: 3277153 - RNA, 19 nt, Vaccinia virus
ucucuccaguuuuaguauu

SEQ ID NO: 3277154 - RNA, 13 nt, Vaccinia virus
uuuauucuagaau

SEQ ID NO: 3277155 - RNA, 21 nt, Vaccinia virus
acauguuccagaugucauaau

SEQ ID NO: 3277156 - RNA, 13 nt, Vaccinia virus
cauuuuauuucua

SEQ ID NO: 3277157 - RNA, 16 nt, Vaccinia virus
ugaaauaguuaucaag

SEQ ID NO: 3277158 - RNA, 15 nt, Vaccinia virus
auugaguaaauccuu

SEQ ID NO: 3277159 - RNA, 20 nt, Vaccinia virus
aauaugcucaugaacauuag

SEQ ID NO: 3277160 - RNA, 14 nt, Vaccinia virus
caaauauacuuuau

SEQ ID NO: 3277161 - RNA, 17 nt, Vaccinia virus
cagucuaguauccauuu

SEQ ID NO: 3277162 - RNA, 11 nt, Vaccinia virus
aauagaaucua

SEQ ID NO: 3277163 - RNA, 17 nt, Vaccinia virus
aauauaucaaacaugga

SEQ ID NO: 3277164 - RNA, 14 nt, Vaccinia virus
aagcuugacuacau

SEQ ID NO: 3277165 - RNA, 18 nt, Vaccinia virus
ucaacauacuauguuuug

SEQ ID NO: 3277166 - RNA, 21 nt, Vaccinia virus
ucaauaauuguggcuauauau

SEQ ID NO: 3277167 - RNA, 23 nt, Vaccinia virus
aauaaccguuagacauaaaauug

SEQ ID NO: 3277168 - RNA, 23 nt, Vaccinia virus
uuaauauugauacauacauuaau

SEQ ID NO: 3277169 - RNA, 20 nt, Vaccinia virus
caauuaccaacuagaagucu

SEQ ID NO: 3277170 - RNA, 17 nt, Vaccinia virus
uuuaccucuucugauau

SEQ ID NO: 3277171 - RNA, 16 nt, Vaccinia virus
aacgcuacaacagaua

SEQ ID NO: 3277172 - RNA, 19 nt, Vaccinia virus
uauucggcauuucuaaaau

SEQ ID NO: 3277173 - RNA, 19 nt, Vaccinia virus
cuucgauauaaaaucauuu

SEQ ID NO: 3277174 - RNA, 14 nt, Vaccinia virus
aauuuagaaauaua

SEQ ID NO: 3277175 - RNA, 20 nt, Vaccinia virus
gucaucuuguucagaaauau

SEQ ID NO: 3277176 - RNA, 13 nt, Vaccinia virus
acuucucuaaaug

SEQ ID NO: 3277177 - RNA, 15 nt, Vaccinia virus
ucguuaacuauaaga

SEQ ID NO: 3277178 - RNA, 12 nt, Vaccinia virus
augcuauguuua

SEQ ID NO: 3277179 - RNA, 12 nt, Vaccinia virus
agaccaaaaauu

SEQ ID NO: 3277180 - RNA, 18 nt, Vaccinia virus
uaguaucuuuuuuacgua

SEQ ID NO: 3277181 - RNA, 19 nt, Vaccinia virus
auaucacaaccuuuguuaa

SEQ ID NO: 3277182 - RNA, 19 nt, Vaccinia virus
cuauucucguccauuuuag

SEQ ID NO: 3277183 - RNA, 14 nt, Vaccinia virus
aauacaaaauaaua

SEQ ID NO: 3277184 - RNA, 14 nt, Vaccinia virus
uacgauucaggaau

SEQ ID NO: 3277185 - RNA, 22 nt, Vaccinia virus
acaaaauccaaacauuacaaau

SEQ ID NO: 3277186 - RNA, 19 nt, Vaccinia virus
auaucuagcaaaaauucua

SEQ ID NO: 3277187 - RNA, 19 nt, Vaccinia virus
gauacaacgguuacuauca

SEQ ID NO: 3277188 - RNA, 16 nt, Vaccinia virus
uauuccaaauuauucu

SEQ ID NO: 3277189 - RNA, 22 nt, Vaccinia virus
auauauugcaaaucacucaaua

SEQ ID NO: 3277190 - RNA, 15 nt, Vaccinia virus
acucgcguuuagagg

SEQ ID NO: 3277191 - RNA, 20 nt, Vaccinia virus
gcgauauacauaaacugauc

SEQ ID NO: 3277192 - RNA, 15 nt, Vaccinia virus
acauuuccuacuacu

SEQ ID NO: 3277193 - RNA, 13 nt, Vaccinia virus
caaaaaauauauu

SEQ ID NO: 3277194 - RNA, 17 nt, Vaccinia virus
cucacauccuuuauuuu

SEQ ID NO: 3277195 - RNA, 14 nt, Vaccinia virus
uuaaacuguaucga

SEQ ID NO: 3277196 - RNA, 13 nt, Vaccinia virus
uuggcaauuaaaa

SEQ ID NO: 3277197 - RNA, 15 nt, Vaccinia virus
caauauaaauccagu

SEQ ID NO: 3277198 - RNA, 18 nt, Vaccinia virus
auauuaacaucuaaacau

SEQ ID NO: 3277199 - RNA, 16 nt, Vaccinia virus
aaagcccauauauguu

SEQ ID NO: 3277200 - RNA, 16 nt, Vaccinia virus
uuaucaaauggaugcu

SEQ ID NO: 3277201 - RNA, 17 nt, Vaccinia virus
agauaggacgguauaug

SEQ ID NO: 3277202 - RNA, 20 nt, Vaccinia virus
aaaauaaacacauagaaaua

SEQ ID NO: 3277203 - RNA, 15 nt, Vaccinia virus
uuuaacaauuucuau

SEQ ID NO: 3277204 - RNA, 13 nt, Vaccinia virus
auagcuaaaaaug

SEQ ID NO: 3277205 - RNA, 15 nt, Vaccinia virus
auuaaaaauuuccau

SEQ ID NO: 3277206 - RNA, 19 nt, Vaccinia virus
uauuacauaauauauacag

SEQ ID NO: 3277207 - RNA, 13 nt, Vaccinia virus
uaguuuuuuucau

SEQ ID NO: 3277208 - RNA, 18 nt, Vaccinia virus
ucgucuagcguugcuucu

SEQ ID NO: 3277209 - RNA, 18 nt, Vaccinia virus
guacucguguccauaauc

SEQ ID NO: 3277210 - RNA, 22 nt, Vaccinia virus
uuauucaucgucgucuacuauu

SEQ ID NO: 3277211 - RNA, 19 nt, Vaccinia virus
ccaauuuuucuuaacaaac

SEQ ID NO: 3277212 - RNA, 20 nt, Vaccinia virus
auuagaguuaggcaauguau

SEQ ID NO: 3277213 - RNA, 13 nt, Vaccinia virus
uauauucuaugau

SEQ ID NO: 3277214 - RNA, 14 nt, Vaccinia virus
uuguaaauuauuuu

SEQ ID NO: 3277215 - RNA, 20 nt, Vaccinia virus
uauaugguucgcucaaaaau

SEQ ID NO: 3277216 - RNA, 15 nt, Vaccinia virus
gaauccgugauuuug

SEQ ID NO: 3277217 - RNA, 14 nt, Vaccinia virus
acaagaucaugaac

SEQ ID NO: 3277218 - RNA, 23 nt, Vaccinia virus
uaauaaaggugguaguauuguca

SEQ ID NO: 3277219 - RNA, 19 nt, Vaccinia virus
gaauuauuauuaauuauau

SEQ ID NO: 3277220 - RNA, 13 nt, Vaccinia virus
acaaaagugaaua

SEQ ID NO: 3277221 - RNA, 14 nt, Vaccinia virus
guuaaaaauuuaga

SEQ ID NO: 3277222 - RNA, 21 nt, Vaccinia virus
uuucugguuuucuauaaauaa

SEQ ID NO: 3277223 - RNA, 16 nt, Vaccinia virus
uauacguacuuaacau

SEQ ID NO: 3277224 - RNA, 22 nt, Vaccinia virus
uguauccgucaaucuaauauua

SEQ ID NO: 3277225 - RNA, 17 nt, Vaccinia virus
uacuaugccaaaugaau

SEQ ID NO: 3277226 - RNA, 18 nt, Vaccinia virus
aauucgguuauaaaugaa

SEQ ID NO: 3277227 - RNA, 14 nt, Vaccinia virus
cauauuuauggauu

SEQ ID NO: 3277228 - RNA, 13 nt, Vaccinia virus
agaggaaacuaau

SEQ ID NO: 3277229 - RNA, 21 nt, Vaccinia virus
aauauauaagacacagaaaua

SEQ ID NO: 3277230 - RNA, 18 nt, Vaccinia virus
agcucaauauaaaugcgu

SEQ ID NO: 3277231 - RNA, 12 nt, Vaccinia virus
aauuuuucuuaa

SEQ ID NO: 3277232 - RNA, 16 nt, Vaccinia virus
uuaggauuaacauagu

SEQ ID NO: 3277233 - RNA, 19 nt, Vaccinia virus
uccauauuucuuaauguaa

SEQ ID NO: 3277234 - RNA, 14 nt, Vaccinia virus
uauaguuaacauuu

SEQ ID NO: 3277235 - RNA, 19 nt, Vaccinia virus
ucaccaaauuuuacaaaaa

SEQ ID NO: 3277236 - RNA, 14 nt, Vaccinia virus
caauagauagucua

SEQ ID NO: 3277237 - RNA, 18 nt, Vaccinia virus
ugauauagcauugcgcau

SEQ ID NO: 3277238 - RNA, 13 nt, Vaccinia virus
ucauaauaaauuu

SEQ ID NO: 3277239 - RNA, 22 nt, Vaccinia virus
uguacucaugaaacguuuggaa

SEQ ID NO: 3277240 - RNA, 22 nt, Vaccinia virus
ggaacaguucuaccaccaguaa

SEQ ID NO: 3277241 - RNA, 16 nt, Vaccinia virus
guuaaaacuacaaaaa

SEQ ID NO: 3277242 - RNA, 16 nt, Vaccinia virus
aucacacuuaaaauaa

SEQ ID NO: 3277243 - RNA, 12 nt, Vaccinia virus
ucucaauuucua

SEQ ID NO: 3277244 - RNA, 17 nt, Vaccinia virus
agauacauuguaugaug

SEQ ID NO: 3277245 - RNA, 18 nt, Vaccinia virus
agaugguagaacaaugug

SEQ ID NO: 3277246 - RNA, 22 nt, Vaccinia virus
uaauaaacauuccacauucaga

SEQ ID NO: 3277247 - RNA, 13 nt, Vaccinia virus
uugauucuaguau

SEQ ID NO: 3277248 - RNA, 15 nt, Vaccinia virus
aaaugguauauuuua

SEQ ID NO: 3277249 - RNA, 13 nt, Vaccinia virus
agaauucuagauc

SEQ ID NO: 3277250 - RNA, 17 nt, Vaccinia virus
uagaucggaugauuuac

SEQ ID NO: 3277251 - RNA, 16 nt, Vaccinia virus
ucgcgcuuuacauucu

SEQ ID NO: 3277252 - RNA, 19 nt, Vaccinia virus
aauaaacucagaacaauau

SEQ ID NO: 3277253 - RNA, 16 nt, Vaccinia virus
ccuauacuauguuaua

SEQ ID NO: 3277254 - RNA, 21 nt, Vaccinia virus
uuucauaauauuaucaaaaga

SEQ ID NO: 3277255 - RNA, 20 nt, Vaccinia virus
uaacgauaacacaaaaugug

SEQ ID NO: 3277256 - RNA, 17 nt, Vaccinia virus
cuaguagcgaaaacuau

SEQ ID NO: 3277257 - RNA, 22 nt, Vaccinia virus
gauauagacgaaauauuagaaa

SEQ ID NO: 3277258 - RNA, 18 nt, Vaccinia virus
uuuuacguaguaaucguc

SEQ ID NO: 3277259 - RNA, 15 nt, Vaccinia virus
gagaauuaauaucua

SEQ ID NO: 3277260 - RNA, 17 nt, Vaccinia virus
ugcaaagucuaaauauu

SEQ ID NO: 3277261 - RNA, 14 nt, Vaccinia virus
auuaaguguggugu

SEQ ID NO: 3277262 - RNA, 14 nt, Vaccinia virus
auccuaacaaugaa

SEQ ID NO: 3277263 - RNA, 21 nt, Vaccinia virus
aaauauauuaauccacuauau

SEQ ID NO: 3277264 - RNA, 19 nt, Vaccinia virus
auuguuauugaucaaacau

SEQ ID NO: 3277265 - RNA, 22 nt, Vaccinia virus
gaugaaggugggacuauaucua

SEQ ID NO: 3277266 - RNA, 12 nt, Vaccinia virus
ucgauauucuca

SEQ ID NO: 3277267 - RNA, 15 nt, Vaccinia virus
aucagauuauuuaac

SEQ ID NO: 3277268 - RNA, 20 nt, Vaccinia virus
uauccucacaacuuaaugaa

SEQ ID NO: 3277269 - RNA, 14 nt, Vaccinia virus
cguuugaaugccac

SEQ ID NO: 3277270 - RNA, 22 nt, Vaccinia virus
cagaauagagccaaaaugguaa

SEQ ID NO: 3277271 - RNA, 22 nt, Vaccinia virus
aguuagaugugucauacuuguu

SEQ ID NO: 3277272 - RNA, 22 nt, Vaccinia virus
guaucucuaccuaugauuaaau

SEQ ID NO: 3277273 - RNA, 18 nt, Vaccinia virus
guuuaacuagucuucucu

SEQ ID NO: 3277274 - RNA, 21 nt, Vaccinia virus
uauuuuuucuggcauuaucua

SEQ ID NO: 3277275 - RNA, 18 nt, Vaccinia virus
uaagaagauuauauucua

SEQ ID NO: 3277276 - RNA, 14 nt, Vaccinia virus
uaucuacacaugua

SEQ ID NO: 3277277 - RNA, 18 nt, Vaccinia virus
uucauauuuuaguuuuua

SEQ ID NO: 3277278 - RNA, 15 nt, Vaccinia virus
acgaggaaacaaugc

SEQ ID NO: 3277279 - RNA, 15 nt, Vaccinia virus
ucuguaaauagaauc

SEQ ID NO: 3277280 - RNA, 22 nt, Vaccinia virus
ccuagaaggucgccguauguua

SEQ ID NO: 3277281 - RNA, 13 nt, Vaccinia virus
gcauaucaugaaa

SEQ ID NO: 3277282 - RNA, 23 nt, Vaccinia virus
cuucuggaagguuuguauucuga

SEQ ID NO: 3277283 - RNA, 22 nt, Vaccinia virus
ucuauuguuuagacuguuugua

SEQ ID NO: 3277284 - RNA, 18 nt, Vaccinia virus
caagaacaacuagaacag

SEQ ID NO: 3277285 - RNA, 17 nt, Vaccinia virus
caauuuuaaaucaucuu

SEQ ID NO: 3277286 - RNA, 19 nt, Vaccinia virus
uuauaacacuuauguauua

SEQ ID NO: 3277287 - RNA, 15 nt, Vaccinia virus
uccagaugucauaau

SEQ ID NO: 3277288 - RNA, 13 nt, Vaccinia virus
cucuacucuagau

SEQ ID NO: 3277289 - RNA, 21 nt, Vaccinia virus
agauccacugucacuggaaag

SEQ ID NO: 3277290 - RNA, 19 nt, Vaccinia virus
cacuggugucagacugugc

SEQ ID NO: 3277291 - RNA, 20 nt, Vaccinia virus
uauucgucgucgacuaucaa

SEQ ID NO: 3277292 - RNA, 23 nt, Vaccinia virus
auuaaacguaguuaugauaaaug

SEQ ID NO: 3277293 - RNA, 14 nt, Vaccinia virus
ggaacaauaaaaga

SEQ ID NO: 3277294 - RNA, 22 nt, Vaccinia virus
aucggaacacuugguaguugaa

SEQ ID NO: 3277295 - RNA, 17 nt, Vaccinia virus
aaguuuggagaaaugga

SEQ ID NO: 3277296 - RNA, 15 nt, Vaccinia virus
uguacacauaguguu

SEQ ID NO: 3277297 - RNA, 18 nt, Vaccinia virus
aaucuauaucauguagaa

SEQ ID NO: 3277298 - RNA, 17 nt, Vaccinia virus
guuaagagaauaauaga

SEQ ID NO: 3277299 - RNA, 12 nt, Vaccinia virus
uaaagaaaauau

SEQ ID NO: 3277300 - RNA, 12 nt, Vaccinia virus
uuauuuagugua

SEQ ID NO: 3277301 - RNA, 19 nt, Vaccinia virus
aacggcguuucggaaaaug

SEQ ID NO: 3277302 - RNA, 19 nt, Vaccinia virus
caacgaaucccuacauauu

SEQ ID NO: 3277303 - RNA, 20 nt, Vaccinia virus
cauacauucggacagacaca

SEQ ID NO: 3277304 - RNA, 19 nt, Vaccinia virus
agcucucccagauuucuuu

SEQ ID NO: 3277305 - RNA, 15 nt, Vaccinia virus
aucucaacaaaauuc

SEQ ID NO: 3277306 - RNA, 20 nt, Vaccinia virus
cuugagacuugauagauauu

SEQ ID NO: 3277307 - RNA, 15 nt, Vaccinia virus
aacuguuguaaauua

SEQ ID NO: 3277308 - RNA, 14 nt, Vaccinia virus
gucgauauacuuau

SEQ ID NO: 3277309 - RNA, 24 nt, Vaccinia virus
aguauacgaagaaaaaguaaauac

SEQ ID NO: 3277310 - RNA, 16 nt, Vaccinia virus
ggaaacaauucauaau

SEQ ID NO: 3277311 - RNA, 19 nt, Vaccinia virus
agauacuuuauuacuccau

SEQ ID NO: 3277312 - RNA, 19 nt, Vaccinia virus
uuuagaaaaaugcuaauau

SEQ ID NO: 3277313 - RNA, 18 nt, Vaccinia virus
caaagaauuaaugauagu

SEQ ID NO: 3277314 - RNA, 13 nt, Vaccinia virus
aaaacauaaucaa

SEQ ID NO: 3277315 - RNA, 13 nt, Vaccinia virus
cuaguuuugagaa

SEQ ID NO: 3277316 - RNA, 17 nt, Vaccinia virus
gaauauacaaguauuau

SEQ ID NO: 3277317 - RNA, 17 nt, Vaccinia virus
cuguauguacaacagug

SEQ ID NO: 3277318 - RNA, 18 nt, Vaccinia virus
auacuacuucuccaacau

SEQ ID NO: 3277319 - RNA, 16 nt, Vaccinia virus
ucaucuaccaauucau

SEQ ID NO: 3277320 - RNA, 14 nt, Vaccinia virus
agcaagauacuuua

SEQ ID NO: 3277321 - RNA, 23 nt, Vaccinia virus
aauaguucccaacccagauaaua

SEQ ID NO: 3277322 - RNA, 23 nt, Vaccinia virus
cucccauggaaugacccaauaag

SEQ ID NO: 3277323 - RNA, 16 nt, Vaccinia virus
auuaguaacagucuua

SEQ ID NO: 3277324 - RNA, 13 nt, Vaccinia virus
ucaaaaauuuaga

SEQ ID NO: 3277325 - RNA, 12 nt, Vaccinia virus
ugaauaauguac

SEQ ID NO: 3277326 - RNA, 22 nt, Vaccinia virus
aaaacugguuaaaacaguaugu

SEQ ID NO: 3277327 - RNA, 12 nt, Vaccinia virus
guaaacauauca

SEQ ID NO: 3277328 - RNA, 21 nt, Vaccinia virus
uaucaauaacgcaaucaugau

SEQ ID NO: 3277329 - RNA, 17 nt, Vaccinia virus
caugaguacuuguacac

SEQ ID NO: 3277330 - RNA, 15 nt, Vaccinia virus
gacggauaaaacaaa

SEQ ID NO: 3277331 - RNA, 18 nt, Vaccinia virus
uauauccguucuuaacuu

SEQ ID NO: 3277332 - RNA, 16 nt, Vaccinia virus
aaauuaauuauuguau

SEQ ID NO: 3277333 - RNA, 23 nt, Vaccinia virus
ucauaucuagaaugaagauauca

SEQ ID NO: 3277334 - RNA, 22 nt, Vaccinia virus
aaucuaacauugauuuuaaaau

SEQ ID NO: 3277335 - RNA, 14 nt, Vaccinia virus
uaucuccaguauuu

SEQ ID NO: 3277336 - RNA, 17 nt, Vaccinia virus
acacuaaaauuaaacau

SEQ ID NO: 3277337 - RNA, 14 nt, Vaccinia virus
uaauaucuaacaaa

SEQ ID NO: 3277338 - RNA, 13 nt, Vaccinia virus
agucauaucuaga

SEQ ID NO: 3277339 - RNA, 19 nt, Vaccinia virus
ggacauacguauauuucua

SEQ ID NO: 3277340 - RNA, 14 nt, Vaccinia virus
acuaaauugaacac

SEQ ID NO: 3277341 - RNA, 12 nt, Vaccinia virus
acacaugaugaa

SEQ ID NO: 3277342 - RNA, 22 nt, Vaccinia virus
aucaaacaaaaaagcucaauaa

SEQ ID NO: 3277343 - RNA, 15 nt, Vaccinia virus
agagaugucugaaac

SEQ ID NO: 3277344 - RNA, 14 nt, Vaccinia virus
uauuauaaacucuc

SEQ ID NO: 3277345 - RNA, 11 nt, Vaccinia virus
acuuuaaacau

SEQ ID NO: 3277346 - RNA, 19 nt, Vaccinia virus
agguacuauaauauuaaaa

SEQ ID NO: 3277347 - RNA, 12 nt, Vaccinia virus
uauuaucaugau

SEQ ID NO: 3277348 - RNA, 15 nt, Vaccinia virus
cgcuagucaucacau

SEQ ID NO: 3277349 - RNA, 20 nt, Vaccinia virus
uaacaaagauauuaccaguu

SEQ ID NO: 3277350 - RNA, 15 nt, Vaccinia virus
aaucauauuuagaaa

SEQ ID NO: 3277351 - RNA, 14 nt, Vaccinia virus
aagaugaaaugauu

SEQ ID NO: 3277352 - RNA, 22 nt, Vaccinia virus
gcaagaacacacgaacaucuuu

SEQ ID NO: 3277353 - RNA, 22 nt, Vaccinia virus
gaugcgguuuaauaaauguuuu

SEQ ID NO: 3277354 - RNA, 20 nt, Vaccinia virus
uagagauuguuaaauuauua

SEQ ID NO: 3277355 - RNA, 22 nt, Vaccinia virus
auccucagacucugauuugaac

SEQ ID NO: 3277356 - RNA, 23 nt, Vaccinia virus
uuguuuagcuauucguaacaaaa

SEQ ID NO: 3277357 - RNA, 15 nt, Vaccinia virus
cauauauuuuuggau

SEQ ID NO: 3277358 - RNA, 14 nt, Vaccinia virus
auacauguuuguaa

SEQ ID NO: 3277359 - RNA, 22 nt, Vaccinia virus
ccaauuguuuuuguacauaaua

SEQ ID NO: 3277360 - RNA, 17 nt, Vaccinia virus
aaucuaccuauagaaaa

SEQ ID NO: 3277361 - RNA, 18 nt, Vaccinia virus
uaaguacccuuauauuca

SEQ ID NO: 3277362 - RNA, 21 nt, Vaccinia virus
agaaaucaacgaucuaauaca

SEQ ID NO: 3277363 - RNA, 15 nt, Vaccinia virus
cauaagauauccaua

SEQ ID NO: 3277364 - RNA, 15 nt, Vaccinia virus
auagcugagaauauc

SEQ ID NO: 3277365 - RNA, 20 nt, Vaccinia virus
aacaucgaagaugaaucaaa

SEQ ID NO: 3277366 - RNA, 20 nt, Vaccinia virus
aaguauaucgacauacuacu

SEQ ID NO: 3277367 - RNA, 15 nt, Vaccinia virus
gacacaucugccaua

SEQ ID NO: 3277368 - RNA, 21 nt, Vaccinia virus
auacuaaaggcaacaaagaaa

SEQ ID NO: 3277369 - RNA, 19 nt, Vaccinia virus
uuaaaaaggaaaauacuau

SEQ ID NO: 3277370 - RNA, 14 nt, Vaccinia virus
ugaugaguuguaca

SEQ ID NO: 3277371 - RNA, 19 nt, Vaccinia virus
cacuucgaagaguuaauau

SEQ ID NO: 3277372 - RNA, 22 nt, Vaccinia virus
gcccaauuuugguguaaaucua

SEQ ID NO: 3277373 - RNA, 22 nt, Vaccinia virus
aauauguucucgucuaagagau

SEQ ID NO: 3277374 - RNA, 11 nt, Vaccinia virus
guuaauguuug

SEQ ID NO: 3277375 - RNA, 13 nt, Vaccinia virus
uuaaaaauuauua

SEQ ID NO: 3277376 - RNA, 15 nt, Vaccinia virus
uaauacuaucuggau

SEQ ID NO: 3277377 - RNA, 23 nt, Vaccinia virus
ugagacgggucaaacaauuuuaa

SEQ ID NO: 3277378 - RNA, 17 nt, Vaccinia virus
uuugucaacuuuguaaa

SEQ ID NO: 3277379 - RNA, 15 nt, Vaccinia virus
ucauuauauaguguu

SEQ ID NO: 3277380 - RNA, 17 nt, Vaccinia virus
aucccuauauucaacau

SEQ ID NO: 3277381 - RNA, 20 nt, Vaccinia virus
ucaugguuauacaggcauua

SEQ ID NO: 3277382 - RNA, 21 nt, Vaccinia virus
caaucggauuaauaucucuau

SEQ ID NO: 3277383 - RNA, 21 nt, Vaccinia virus
uuuuaucuauauuguauucua

SEQ ID NO: 3277384 - RNA, 16 nt, Vaccinia virus
acacugguaacuauau

SEQ ID NO: 3277385 - RNA, 13 nt, Vaccinia virus
guaaaauaaucuc

SEQ ID NO: 3277386 - RNA, 16 nt, Vaccinia virus
auauacguguuuaaaa

SEQ ID NO: 3277387 - RNA, 11 nt, Vaccinia virus
uuauucuaaug

SEQ ID NO: 3277388 - RNA, 13 nt, Vaccinia virus
uccuuucuaaaau

SEQ ID NO: 3277389 - RNA, 13 nt, Vaccinia virus
aucuuaauaagca

SEQ ID NO: 3277390 - RNA, 15 nt, Vaccinia virus
ggugaauccaucucu

SEQ ID NO: 3277391 - RNA, 14 nt, Vaccinia virus
uaacacacaugucu

SEQ ID NO: 3277392 - RNA, 15 nt, Vaccinia virus
ucauugauugagaag

SEQ ID NO: 3277393 - RNA, 20 nt, Vaccinia virus
cauauuugaacuuaacuuca

SEQ ID NO: 3277394 - RNA, 21 nt, Vaccinia virus
agaacuguuuuagaagucaag

SEQ ID NO: 3277395 - RNA, 14 nt, Vaccinia virus
augcgauucaaaaa

SEQ ID NO: 3277396 - RNA, 23 nt, Vaccinia virus
aaguaucuacgauuuuuacaaaa

SEQ ID NO: 3277397 - RNA, 22 nt, Vaccinia virus
uuuguagucuuucaacauccuu

SEQ ID NO: 3277398 - RNA, 18 nt, Vaccinia virus
cuucauucguaaaucuuu

SEQ ID NO: 3277399 - RNA, 13 nt, Vaccinia virus
guagugguuauau

SEQ ID NO: 3277400 - RNA, 22 nt, Vaccinia virus
aagauuuuuagcguauuauccu

SEQ ID NO: 3277401 - RNA, 20 nt, Vaccinia virus
uuuaauccgaauuucaaaau

SEQ ID NO: 3277402 - RNA, 15 nt, Vaccinia virus
ucauguguagaugcu

SEQ ID NO: 3277403 - RNA, 12 nt, Vaccinia virus
auuuuuuaucua

SEQ ID NO: 3277404 - RNA, 13 nt, Vaccinia virus
uuagaucauuaac

SEQ ID NO: 3277405 - RNA, 13 nt, Vaccinia virus
auuuuacaaaaaa

SEQ ID NO: 3277406 - RNA, 21 nt, Vaccinia virus
uaaccuuuuccuuaucuucau

SEQ ID NO: 3277407 - RNA, 21 nt, Vaccinia virus
uuaugacgcaguaacauauau

SEQ ID NO: 3277408 - RNA, 13 nt, Vaccinia virus
aauuugauaaaga

SEQ ID NO: 3277409 - RNA, 17 nt, Vaccinia virus
ucagcauccacucauau

SEQ ID NO: 3277410 - RNA, 14 nt, Vaccinia virus
ggaagaguaggaag

SEQ ID NO: 3277411 - RNA, 18 nt, Vaccinia virus
cuuucuguauccagguag

SEQ ID NO: 3277412 - RNA, 22 nt, Vaccinia virus
ugaugaugcagaauuuuggaua

SEQ ID NO: 3277413 - RNA, 15 nt, Vaccinia virus
aauaauuaugaugau

SEQ ID NO: 3277414 - RNA, 22 nt, Vaccinia virus
guacaaugauaaugauacagua

SEQ ID NO: 3277415 - RNA, 18 nt, Vaccinia virus
acuucagaugauggugca

SEQ ID NO: 3277416 - RNA, 16 nt, Vaccinia virus
uugacuaaaucuuaau

SEQ ID NO: 3277417 - RNA, 14 nt, Vaccinia virus
uuuaguuuaucaaa

SEQ ID NO: 3277418 - RNA, 14 nt, Vaccinia virus
cauaaacacagaau

SEQ ID NO: 3277419 - RNA, 15 nt, Vaccinia virus
aaaaugcuaauauua

SEQ ID NO: 3277420 - RNA, 20 nt, Vaccinia virus
ucagguuaucaucauccauu

SEQ ID NO: 3277421 - RNA, 19 nt, Vaccinia virus
ucucguauccacaaauagu

SEQ ID NO: 3277422 - RNA, 23 nt, Vaccinia virus
uacguauaacuuucuucugcaaa

SEQ ID NO: 3277423 - RNA, 17 nt, Vaccinia virus
aaaauagcgcugaaaau

SEQ ID NO: 3277424 - RNA, 13 nt, Vaccinia virus
uaccauuauuaau

SEQ ID NO: 3277425 - RNA, 21 nt, Vaccinia virus
uacguucggagacaauaaagc

SEQ ID NO: 3277426 - RNA, 20 nt, Vaccinia virus
uaauaauuugguauauacau

SEQ ID NO: 3277427 - RNA, 18 nt, Vaccinia virus
acaaugcuaauauauucu

SEQ ID NO: 3277428 - RNA, 22 nt, Vaccinia virus
aacacuauuccaucuguggaaa

SEQ ID NO: 3277429 - RNA, 13 nt, Vaccinia virus
caauauaucaucu

SEQ ID NO: 3277430 - RNA, 18 nt, Vaccinia virus
uccggagacgucaucugu

SEQ ID NO: 3277431 - RNA, 16 nt, Vaccinia virus
agaauaagaucaagau

SEQ ID NO: 3277432 - RNA, 11 nt, Vaccinia virus
uuaaaacauuc

SEQ ID NO: 3277433 - RNA, 14 nt, Vaccinia virus
uucuauuucgaauu

SEQ ID NO: 3277434 - RNA, 23 nt, Vaccinia virus
aucguguuguguuggugaauauu

SEQ ID NO: 3277435 - RNA, 22 nt, Vaccinia virus
auggauucauccuguugucuaa

SEQ ID NO: 3277436 - RNA, 15 nt, Vaccinia virus
caauuucauaaugag

SEQ ID NO: 3277437 - RNA, 23 nt, Vaccinia virus
cuucagauaaucugaaaaugaaa

SEQ ID NO: 3277438 - RNA, 15 nt, Vaccinia virus
aucauccaaguggau

SEQ ID NO: 3277439 - RNA, 14 nt, Vaccinia virus
ucuuaaauuucaua

SEQ ID NO: 3277440 - RNA, 23 nt, Vaccinia virus
gacauccaugguggaauaaacua

SEQ ID NO: 3277441 - RNA, 20 nt, Vaccinia virus
guauucaguagccaauccua

SEQ ID NO: 3277442 - RNA, 18 nt, Vaccinia virus
caaaaagggauauauauu

SEQ ID NO: 3277443 - RNA, 15 nt, Vaccinia virus
auauguagcaaacau

SEQ ID NO: 3277444 - RNA, 23 nt, Vaccinia virus
auccaugguuuuaaguaaaugau

SEQ ID NO: 3277445 - RNA, 16 nt, Vaccinia virus
ucauguuuauuucuag

SEQ ID NO: 3277446 - RNA, 12 nt, Vaccinia virus
guuccauauuau

SEQ ID NO: 3277447 - RNA, 13 nt, Vaccinia virus
uuaucaaaucuag

SEQ ID NO: 3277448 - RNA, 13 nt, Vaccinia virus
guaaagacaauga

SEQ ID NO: 3277449 - RNA, 19 nt, Vaccinia virus
uaguuuccuuaacaaaucu

SEQ ID NO: 3277450 - RNA, 12 nt, Vaccinia virus
auuacuuuacaa

SEQ ID NO: 3277451 - RNA, 17 nt, Vaccinia virus
aauacggacuucauaau

SEQ ID NO: 3277452 - RNA, 14 nt, Vaccinia virus
uuuguauugcacau

SEQ ID NO: 3277453 - RNA, 16 nt, Vaccinia virus
agaauauaaauuauau

SEQ ID NO: 3277454 - RNA, 15 nt, Vaccinia virus
aucauaaggaacuaa

SEQ ID NO: 3277455 - RNA, 17 nt, Vaccinia virus
uagaauaaauauccuug

SEQ ID NO: 3277456 - RNA, 23 nt, Vaccinia virus
acauauagaugcagaaguaauga

SEQ ID NO: 3277457 - RNA, 21 nt, Vaccinia virus
caaauggauguuaauguauua

SEQ ID NO: 3277458 - RNA, 19 nt, Vaccinia virus
accucuggcacuuauuuca

SEQ ID NO: 3277459 - RNA, 21 nt, Vaccinia virus
acauuuuauaaauauauaaug

SEQ ID NO: 3277460 - RNA, 13 nt, Vaccinia virus
aaagaauuuggaa

SEQ ID NO: 3277461 - RNA, 16 nt, Vaccinia virus
auguguuuuagaauau

SEQ ID NO: 3277462 - RNA, 13 nt, Vaccinia virus
agaauuaaaagag

SEQ ID NO: 3277463 - RNA, 15 nt, Vaccinia virus
gaagacacauuauuu

SEQ ID NO: 3277464 - RNA, 22 nt, Vaccinia virus
augauguguuauuuuuuaacug

SEQ ID NO: 3277465 - RNA, 14 nt, Vaccinia virus
auauuuuaguuuug

SEQ ID NO: 3277466 - RNA, 14 nt, Vaccinia virus
guuucguaauaucu

SEQ ID NO: 3277467 - RNA, 22 nt, Vaccinia virus
acguagucgaacguuaguucca

SEQ ID NO: 3277468 - RNA, 14 nt, Vaccinia virus
ucucaauugucugu

SEQ ID NO: 3277469 - RNA, 18 nt, Vaccinia virus
uggaacaaaacaaugacg

SEQ ID NO: 3277470 - RNA, 14 nt, Vaccinia virus
uuuucaguuaucua

SEQ ID NO: 3277471 - RNA, 18 nt, Vaccinia virus
aucgauuuucaaauccau

SEQ ID NO: 3277472 - RNA, 15 nt, Vaccinia virus
aucuuugucaaauau

SEQ ID NO: 3277473 - RNA, 18 nt, Vaccinia virus
auaacauuuuuuguaaau

SEQ ID NO: 3277474 - RNA, 14 nt, Vaccinia virus
agagacaaugaaaa

SEQ ID NO: 3277475 - RNA, 15 nt, Vaccinia virus
gauguaguaguauau

SEQ ID NO: 3277476 - RNA, 14 nt, Vaccinia virus
gacucgucuacuau

SEQ ID NO: 3277477 - RNA, 20 nt, Vaccinia virus
aaugcaauuaaaaaucgaua

SEQ ID NO: 3277478 - RNA, 14 nt, Vaccinia virus
uaaggaguugaaau

SEQ ID NO: 3277479 - RNA, 17 nt, Vaccinia virus
aucacacuuaaaauaaa

SEQ ID NO: 3277480 - RNA, 17 nt, Vaccinia virus
uacauuguauaaaaagc

SEQ ID NO: 3277481 - RNA, 18 nt, Vaccinia virus
aguaaaugaaaaaaaacu

SEQ ID NO: 3277482 - RNA, 20 nt, Vaccinia virus
gacgauauauaguaaugaag

SEQ ID NO: 3277483 - RNA, 16 nt, Vaccinia virus
cucguauacucugccc

SEQ ID NO: 3277484 - RNA, 16 nt, Vaccinia virus
uauaauuauauguaga

SEQ ID NO: 3277485 - RNA, 17 nt, Vaccinia virus
uaguguaucgacaucuu

SEQ ID NO: 3277486 - RNA, 22 nt, Vaccinia virus
auuuguauuuuuuaaucuaucu

SEQ ID NO: 3277487 - RNA, 13 nt, Vaccinia virus
guguuuaauaacu

SEQ ID NO: 3277488 - RNA, 22 nt, Vaccinia virus
guuauuacuacugaagaacuac

SEQ ID NO: 3277489 - RNA, 14 nt, Vaccinia virus
uagauauuaaacaa

SEQ ID NO: 3277490 - RNA, 21 nt, Vaccinia virus
aucauauuccggcguaugaau

SEQ ID NO: 3277491 - RNA, 21 nt, Vaccinia virus
uguaaauguaacauauuuaga

SEQ ID NO: 3277492 - RNA, 15 nt, Vaccinia virus
augugagaaguuugc

SEQ ID NO: 3277493 - RNA, 23 nt, Vaccinia virus
auauuauugggugguaaacuaga

SEQ ID NO: 3277494 - RNA, 16 nt, Vaccinia virus
ugagacgauguaucca

SEQ ID NO: 3277495 - RNA, 16 nt, Vaccinia virus
aacuaucaauauuaac

SEQ ID NO: 3277496 - RNA, 15 nt, Vaccinia virus
auaauugcuuuucua

SEQ ID NO: 3277497 - RNA, 14 nt, Vaccinia virus
uuucaccaauaaga

SEQ ID NO: 3277498 - RNA, 20 nt, Vaccinia virus
cauaacguccagaauguuua

SEQ ID NO: 3277499 - RNA, 16 nt, Vaccinia virus
ucaucaaacaacugaa

SEQ ID NO: 3277500 - RNA, 21 nt, Vaccinia virus
uuaaccaauacuauucauaau

SEQ ID NO: 3277501 - RNA, 14 nt, Vaccinia virus
gagagauagaagaa

SEQ ID NO: 3277502 - RNA, 22 nt, Vaccinia virus
uaguacguauaacuuucuucug

SEQ ID NO: 3277503 - RNA, 22 nt, Vaccinia virus
uuauaaagaccgaauacauaac

SEQ ID NO: 3277504 - RNA, 15 nt, Vaccinia virus
augauaaaaacauuu

SEQ ID NO: 3277505 - RNA, 13 nt, Vaccinia virus
uauccauuauucu

SEQ ID NO: 3277506 - RNA, 17 nt, Vaccinia virus
uauaaacguauacugua

SEQ ID NO: 3277507 - RNA, 19 nt, Vaccinia virus
ucgacaucuggauuucaga

SEQ ID NO: 3277508 - RNA, 18 nt, Vaccinia virus
ucuauguugacauguaua

SEQ ID NO: 3277509 - RNA, 24 nt, Vaccinia virus
aaagauuaaaucauuaaaugauug

SEQ ID NO: 3277510 - RNA, 16 nt, Vaccinia virus
uacaacauuccaaaga

SEQ ID NO: 3277511 - RNA, 23 nt, Vaccinia virus
uuaaaaacaaacuuuuuauccuu

SEQ ID NO: 3277512 - RNA, 15 nt, Vaccinia virus
uauaauuuuuggaca

SEQ ID NO: 3277513 - RNA, 16 nt, Vaccinia virus
ugauauaucuaguguu

SEQ ID NO: 3277514 - RNA, 19 nt, Vaccinia virus
uuaagaggacuauuagaag

SEQ ID NO: 3277515 - RNA, 15 nt, Vaccinia virus
ugaagaaaguaauua

SEQ ID NO: 3277516 - RNA, 22 nt, Vaccinia virus
aguauuuauacuuuuaggaaau

SEQ ID NO: 3277517 - RNA, 23 nt, Vaccinia virus
auagucagaauuuucauggaugu

SEQ ID NO: 3277518 - RNA, 13 nt, Vaccinia virus
aauaaauaauaac

SEQ ID NO: 3277519 - RNA, 21 nt, Vaccinia virus
uaaacaauugggguuuccagg

SEQ ID NO: 3277520 - RNA, 14 nt, Vaccinia virus
guacucuuaagaga

SEQ ID NO: 3277521 - RNA, 16 nt, Vaccinia virus
agaagauaucauaaau

SEQ ID NO: 3277522 - RNA, 23 nt, Vaccinia virus
auuccaggaucuagauaauuaau

SEQ ID NO: 3277523 - RNA, 20 nt, Vaccinia virus
acacuguuaucuaaugaaug

SEQ ID NO: 3277524 - RNA, 17 nt, Vaccinia virus
uuaaugaacaaauccuu

SEQ ID NO: 3277525 - RNA, 21 nt, Vaccinia virus
ucaaauccauaaauaaaguau

SEQ ID NO: 3277526 - RNA, 22 nt, Vaccinia virus
aucuccacacagucaaauccgu

SEQ ID NO: 3277527 - RNA, 21 nt, Vaccinia virus
uaacauuuuuuguaaauguaa

SEQ ID NO: 3277528 - RNA, 17 nt, Vaccinia virus
uauuauaaaaaaguuuu

SEQ ID NO: 3277529 - RNA, 15 nt, Vaccinia virus
augcuucagaauuag

SEQ ID NO: 3277530 - RNA, 16 nt, Vaccinia virus
cuaagcgguaaauaau

SEQ ID NO: 3277531 - RNA, 13 nt, Vaccinia virus
cuucugauuuuaa

SEQ ID NO: 3277532 - RNA, 20 nt, Vaccinia virus
gauauuuucguguuuuaguu

SEQ ID NO: 3277533 - RNA, 12 nt, Vaccinia virus
aauaauguuauu

SEQ ID NO: 3277534 - RNA, 21 nt, Vaccinia virus
uggauuauaaauauugauguu

SEQ ID NO: 3277535 - RNA, 20 nt, Vaccinia virus
cuccaugauuaaauauuuua

SEQ ID NO: 3277536 - RNA, 16 nt, Vaccinia virus
gaaaaccgauaacgau

SEQ ID NO: 3277537 - RNA, 19 nt, Vaccinia virus
aaaauuuauaacauugucc

SEQ ID NO: 3277538 - RNA, 15 nt, Vaccinia virus
aagauuuauauaucu

SEQ ID NO: 3277539 - RNA, 20 nt, Vaccinia virus
aaaauuuaaagaauguauaa

SEQ ID NO: 3277540 - RNA, 20 nt, Vaccinia virus
gcucgcaucaaucuagcauu

SEQ ID NO: 3277541 - RNA, 22 nt, Vaccinia virus
auuacucauguaaccuacuaga

SEQ ID NO: 3277542 - RNA, 14 nt, Vaccinia virus
aaucaaacaaaaaa

SEQ ID NO: 3277543 - RNA, 21 nt, Vaccinia virus
uuaucucuauagauaaugacg

SEQ ID NO: 3277544 - RNA, 23 nt, Vaccinia virus
aaaucaguaacuauguucauuuu

SEQ ID NO: 3277545 - RNA, 22 nt, Vaccinia virus
agaauuagucaaucuuauucaa

SEQ ID NO: 3277546 - RNA, 20 nt, Vaccinia virus
cgaagaauuaaaucuaacga

SEQ ID NO: 3277547 - RNA, 16 nt, Vaccinia virus
augugauucucugaaa

SEQ ID NO: 3277548 - RNA, 15 nt, Vaccinia virus
acuugacaaaaauug

SEQ ID NO: 3277549 - RNA, 18 nt, Vaccinia virus
acucaggaagauauuuua

SEQ ID NO: 3277550 - RNA, 18 nt, Vaccinia virus
auucuaauauuaugaaug

SEQ ID NO: 3277551 - RNA, 17 nt, Vaccinia virus
acaaucagauauaucua

SEQ ID NO: 3277552 - RNA, 22 nt, Vaccinia virus
acuccaaugacugaauacauua

SEQ ID NO: 3277553 - RNA, 21 nt, Vaccinia virus
uaacaagaucgauagacacug

SEQ ID NO: 3277554 - RNA, 19 nt, Vaccinia virus
auaaaucuuuaucaagcac

SEQ ID NO: 3277555 - RNA, 18 nt, Vaccinia virus
caaaucuucuuauaagau

SEQ ID NO: 3277556 - RNA, 14 nt, Vaccinia virus
gauacauuuugcau

SEQ ID NO: 3277557 - RNA, 20 nt, Vaccinia virus
auugcaauugguaagaugac

SEQ ID NO: 3277558 - RNA, 17 nt, Vaccinia virus
ugaaucuaaacuagugg

SEQ ID NO: 3277559 - RNA, 23 nt, Vaccinia virus
aggacuauuguuacaaaaguuaa

SEQ ID NO: 3277560 - RNA, 17 nt, Vaccinia virus
aucaaacaggagacuau

SEQ ID NO: 3277561 - RNA, 16 nt, Vaccinia virus
uccauguccaauauga

SEQ ID NO: 3277562 - RNA, 23 nt, Vaccinia virus
uaguugauagaacaaaauacaua

SEQ ID NO: 3277563 - RNA, 19 nt, Vaccinia virus
uguaugcguugauauuaca

SEQ ID NO: 3277564 - RNA, 15 nt, Vaccinia virus
uucauucguaaaucu

SEQ ID NO: 3277565 - RNA, 17 nt, Vaccinia virus
acuagacugauuucucu

SEQ ID NO: 3277566 - RNA, 21 nt, Vaccinia virus
auaaugguucaggauauagau

SEQ ID NO: 3277567 - RNA, 15 nt, Vaccinia virus
cucaacgcgauaucu

SEQ ID NO: 3277568 - RNA, 19 nt, Vaccinia virus
acuuguuggugaaauggua

SEQ ID NO: 3277569 - RNA, 21 nt, Vaccinia virus
auguucuucgcagaugaugau

SEQ ID NO: 3277570 - RNA, 14 nt, Vaccinia virus
aguagaaaauauau

SEQ ID NO: 3277571 - RNA, 22 nt, Vaccinia virus
uauaaauaaaagacaaaucuug

SEQ ID NO: 3277572 - RNA, 20 nt, Vaccinia virus
aguaaacauaucauaauauu

SEQ ID NO: 3277573 - RNA, 21 nt, Vaccinia virus
uauacuugucaucauuucuaa

SEQ ID NO: 3277574 - RNA, 21 nt, Vaccinia virus
aaauccuuguuugauaaaugu

SEQ ID NO: 3277575 - RNA, 14 nt, Vaccinia virus
gcugaguauuucau

SEQ ID NO: 3277576 - RNA, 23 nt, Vaccinia virus
uguuagauauagaagauaaacau

SEQ ID NO: 3277577 - RNA, 15 nt, Vaccinia virus
gaaguuauagaaugu

SEQ ID NO: 3277578 - RNA, 15 nt, Vaccinia virus
auuggaacauaagau

SEQ ID NO: 3277579 - RNA, 13 nt, Vaccinia virus
aagaucaaccaaa

SEQ ID NO: 3277580 - RNA, 23 nt, Vaccinia virus
ucuaugauauuguugauaauaca

SEQ ID NO: 3277581 - RNA, 14 nt, Vaccinia virus
aucucuauuaaaug

SEQ ID NO: 3277582 - RNA, 20 nt, Vaccinia virus
auaugcaccuagagaauugc

SEQ ID NO: 3277583 - RNA, 15 nt, Vaccinia virus
gcguaguauuacuuc

SEQ ID NO: 3277584 - RNA, 17 nt, Vaccinia virus
auguagcaaacaugaua

SEQ ID NO: 3277585 - RNA, 24 nt, Vaccinia virus
aguuguuguccguuaucuaacaug

SEQ ID NO: 3277586 - RNA, 16 nt, Vaccinia virus
guuuuuuuacuuucua

SEQ ID NO: 3277587 - RNA, 19 nt, Vaccinia virus
uaaaauaguuuauaacauu

SEQ ID NO: 3277588 - RNA, 14 nt, Vaccinia virus
uauauuaauacuuu

SEQ ID NO: 3277589 - RNA, 12 nt, Vaccinia virus
gaaauaauacaa

SEQ ID NO: 3277590 - RNA, 12 nt, Vaccinia virus
gaauuaauacau

SEQ ID NO: 3277591 - RNA, 13 nt, Vaccinia virus
aaacuagauacaa

SEQ ID NO: 3277592 - RNA, 20 nt, Vaccinia virus
acuuucgguucuuuaaaaga

SEQ ID NO: 3277593 - RNA, 16 nt, Vaccinia virus
ucgauaccuagaagau

SEQ ID NO: 3277594 - RNA, 19 nt, Vaccinia virus
acagaaaagauauuuguua

SEQ ID NO: 3277595 - RNA, 15 nt, Vaccinia virus
auccauucuaaugau

SEQ ID NO: 3277596 - RNA, 15 nt, Vaccinia virus
agcaauaguauaauu

SEQ ID NO: 3277597 - RNA, 16 nt, Vaccinia virus
aaugccucagaauauc

SEQ ID NO: 3277598 - RNA, 17 nt, Vaccinia virus
ucgauguaaaauuuuug

SEQ ID NO: 3277599 - RNA, 20 nt, Vaccinia virus
aauuaauucuuuauugucau

SEQ ID NO: 3277600 - RNA, 19 nt, Vaccinia virus
ucugccugaaauccaaaua

SEQ ID NO: 3277601 - RNA, 16 nt, Vaccinia virus
uauaaagauugugcaa

SEQ ID NO: 3277602 - RNA, 22 nt, Vaccinia virus
uaauauagggcugacgucguau

SEQ ID NO: 3277603 - RNA, 17 nt, Vaccinia virus
gaaugaaauauauacau

SEQ ID NO: 3277604 - RNA, 20 nt, Vaccinia virus
gauauauggacgauaauaau

SEQ ID NO: 3277605 - RNA, 23 nt, Vaccinia virus
uuuacaucgacgagauuauuauu

SEQ ID NO: 3277606 - RNA, 16 nt, Vaccinia virus
uggauacuaauuguag

SEQ ID NO: 3277607 - RNA, 17 nt, Vaccinia virus
gaauauuaaacaauuau

SEQ ID NO: 3277608 - RNA, 24 nt, Vaccinia virus
uaacaucaucaaaagacuuaugau

SEQ ID NO: 3277609 - RNA, 15 nt, Vaccinia virus
uuauugauauguaua

SEQ ID NO: 3277610 - RNA, 17 nt, Vaccinia virus
auacgcugauaaauaua

SEQ ID NO: 3277611 - RNA, 16 nt, Vaccinia virus
cuuuugcuauuaccaa

SEQ ID NO: 3277612 - RNA, 13 nt, Vaccinia virus
cacuaauugacua

SEQ ID NO: 3277613 - RNA, 20 nt, Vaccinia virus
aagacgguaacuaaauguuc

SEQ ID NO: 3277614 - RNA, 18 nt, Vaccinia virus
uccauuagccuuuccacu

SEQ ID NO: 3277615 - RNA, 22 nt, Vaccinia virus
ugcucggcaguaaucaacaaua

SEQ ID NO: 3277616 - RNA, 21 nt, Vaccinia virus
uccaugcagcauuuccuacau

SEQ ID NO: 3277617 - RNA, 12 nt, Vaccinia virus
agauaauacaaa

SEQ ID NO: 3277618 - RNA, 19 nt, Vaccinia virus
uauuacaagaguacguuau

SEQ ID NO: 3277619 - RNA, 19 nt, Vaccinia virus
uaacucucuggaugcuaug

SEQ ID NO: 3277620 - RNA, 17 nt, Vaccinia virus
cuuauacaggucauuac

SEQ ID NO: 3277621 - RNA, 21 nt, Vaccinia virus
uaacgauaucuugcaaaauag

SEQ ID NO: 3277622 - RNA, 13 nt, Vaccinia virus
aauuuuuuaaaaa

SEQ ID NO: 3277623 - RNA, 14 nt, Vaccinia virus
acuucgcaauaauu

SEQ ID NO: 3277624 - RNA, 23 nt, Vaccinia virus
uuagugaaacauuccacaucguu

SEQ ID NO: 3277625 - RNA, 15 nt, Vaccinia virus
aucuaacguauucua

SEQ ID NO: 3277626 - RNA, 16 nt, Vaccinia virus
uugugaaugacaucau

SEQ ID NO: 3277627 - RNA, 18 nt, Vaccinia virus
uccuagauauguaaaaua

SEQ ID NO: 3277628 - RNA, 16 nt, Vaccinia virus
uagaagccaauaucug

SEQ ID NO: 3277629 - RNA, 20 nt, Vaccinia virus
uaaguucauuaucugaaaua

SEQ ID NO: 3277630 - RNA, 19 nt, Vaccinia virus
caauaaaaauaaacuagag

SEQ ID NO: 3277631 - RNA, 18 nt, Vaccinia virus
auuuauccguaaaaaugu

SEQ ID NO: 3277632 - RNA, 17 nt, Vaccinia virus
gacgcguucauuggaaa

SEQ ID NO: 3277633 - RNA, 14 nt, Vaccinia virus
agauacuguauaua

SEQ ID NO: 3277634 - RNA, 19 nt, Vaccinia virus
uuaaaacuugauaauuaau

SEQ ID NO: 3277635 - RNA, 23 nt, Vaccinia virus
aguauacgaguaaauaacuauag

SEQ ID NO: 3277636 - RNA, 19 nt, Vaccinia virus
uccuauauuuuuuuauucu

SEQ ID NO: 3277637 - RNA, 22 nt, Vaccinia virus
auaagguacuuuuucucauaau

SEQ ID NO: 3277638 - RNA, 16 nt, Vaccinia virus
acguggauauguguuu

SEQ ID NO: 3277639 - RNA, 22 nt, Vaccinia virus
aucacagcuaucuugaagccau

SEQ ID NO: 3277640 - RNA, 21 nt, Vaccinia virus
ccaagucauaucuagaaugaa

SEQ ID NO: 3277641 - RNA, 21 nt, Vaccinia virus
uuccaccguauccauaaacaa

SEQ ID NO: 3277642 - RNA, 21 nt, Vaccinia virus
auaucugaugagaucaauaga

SEQ ID NO: 3277643 - RNA, 23 nt, Vaccinia virus
uaacccauuauaaaacuuaugau

SEQ ID NO: 3277644 - RNA, 22 nt, Vaccinia virus
acaacaccuaugauaaaggaga

SEQ ID NO: 3277645 - RNA, 19 nt, Vaccinia virus
aaguauacauguuagagaa

SEQ ID NO: 3277646 - RNA, 16 nt, Vaccinia virus
uuuaaugacuacuaua

SEQ ID NO: 3277647 - RNA, 16 nt, Vaccinia virus
uauuauccaauacaga

SEQ ID NO: 3277648 - RNA, 22 nt, Vaccinia virus
auccaagaguuccgagauaauu

SEQ ID NO: 3277649 - RNA, 17 nt, Vaccinia virus
aauuguaaaaacauaca

SEQ ID NO: 3277650 - RNA, 13 nt, Vaccinia virus
aagauuguagaau

SEQ ID NO: 3277651 - RNA, 15 nt, Vaccinia virus
aguuuuauaacgaag

SEQ ID NO: 3277652 - RNA, 22 nt, Vaccinia virus
cauuaacgauaucuugcaaaau

SEQ ID NO: 3277653 - RNA, 16 nt, Vaccinia virus
aguauuucuuacucaa

SEQ ID NO: 3277654 - RNA, 21 nt, Vaccinia virus
uuccaauuccguagguaaacg

SEQ ID NO: 3277655 - RNA, 17 nt, Vaccinia virus
ggagguggauauuucug

SEQ ID NO: 3277656 - RNA, 15 nt, Vaccinia virus
uuuuuuacguaguaa

SEQ ID NO: 3277657 - RNA, 20 nt, Vaccinia virus
ucgcauaaacauuacuaaaa

SEQ ID NO: 3277658 - RNA, 19 nt, Vaccinia virus
caaaaaacgacgauuggaa

SEQ ID NO: 3277659 - RNA, 11 nt, Vaccinia virus
agaaaauggau

SEQ ID NO: 3277660 - RNA, 18 nt, Vaccinia virus
gaaauacuaaaaaaugua

SEQ ID NO: 3277661 - RNA, 17 nt, Vaccinia virus
uuauuagagauuucagc

SEQ ID NO: 3277662 - RNA, 20 nt, Vaccinia virus
acaucaaaaagcuguuguau

SEQ ID NO: 3277663 - RNA, 18 nt, Vaccinia virus
uguuacaaaaguuaauaa

SEQ ID NO: 3277664 - RNA, 19 nt, Vaccinia virus
ugguguauuaaauuccagu

SEQ ID NO: 3277665 - RNA, 12 nt, Vaccinia virus
cugaaaauuaaa

SEQ ID NO: 3277666 - RNA, 19 nt, Vaccinia virus
gcuauaauaauaaauguau

SEQ ID NO: 3277667 - RNA, 17 nt, Vaccinia virus
uauuacguggagaaauc

SEQ ID NO: 3277668 - RNA, 12 nt, Vaccinia virus
ugcuaauuauuu

SEQ ID NO: 3277669 - RNA, 18 nt, Vaccinia virus
aaugucgaauaacuguaa

SEQ ID NO: 3277670 - RNA, 16 nt, Vaccinia virus
ccaacucuuuaauaaa

SEQ ID NO: 3277671 - RNA, 22 nt, Vaccinia virus
guauucuauacccaucauguaa

SEQ ID NO: 3277672 - RNA, 19 nt, Vaccinia virus
auaauuuuugaugcuguug

SEQ ID NO: 3277673 - RNA, 13 nt, Vaccinia virus
auucuaugaugaa

SEQ ID NO: 3277674 - RNA, 15 nt, Vaccinia virus
uaaagauauaaauga

SEQ ID NO: 3277675 - RNA, 17 nt, Vaccinia virus
acugcaauaaaacauuu

SEQ ID NO: 3277676 - RNA, 13 nt, Vaccinia virus
gaacagaugauau

SEQ ID NO: 3277677 - RNA, 20 nt, Vaccinia virus
auucaagcgaauuacucugu

SEQ ID NO: 3277678 - RNA, 20 nt, Vaccinia virus
uacaauaaacuccguagaga

SEQ ID NO: 3277679 - RNA, 20 nt, Vaccinia virus
ggcggaguaaguguugagcu

SEQ ID NO: 3277680 - RNA, 12 nt, Vaccinia virus
uuauauauguaa

SEQ ID NO: 3277681 - RNA, 21 nt, Vaccinia virus
uaacagagaggccaucuggaa

SEQ ID NO: 3277682 - RNA, 23 nt, Vaccinia virus
uaaaauaucuagcaaaaauucua

SEQ ID NO: 3277683 - RNA, 18 nt, Vaccinia virus
uucuauauagcuauucuu

SEQ ID NO: 3277684 - RNA, 13 nt, Vaccinia virus
aggauaaaguaaa

SEQ ID NO: 3277685 - RNA, 18 nt, Vaccinia virus
uaaauuuuaaacauaaag

SEQ ID NO: 3277686 - RNA, 21 nt, Vaccinia virus
uaacuagcuuaaacagaugag

SEQ ID NO: 3277687 - RNA, 14 nt, Vaccinia virus
acaaacgugggaag

SEQ ID NO: 3277688 - RNA, 22 nt, Vaccinia virus
aucgcaucaaauaaaauuauug

SEQ ID NO: 3277689 - RNA, 17 nt, Vaccinia virus
uaaaaucacugaacauu

SEQ ID NO: 3277690 - RNA, 21 nt, Vaccinia virus
uugaagaauuuauauaaauca

SEQ ID NO: 3277691 - RNA, 15 nt, Vaccinia virus
auacuagaacuauag

SEQ ID NO: 3277692 - RNA, 22 nt, Vaccinia virus
ugggaucaugcauucaaaugga

SEQ ID NO: 3277693 - RNA, 17 nt, Vaccinia virus
guaucuagccauaucua

SEQ ID NO: 3277694 - RNA, 18 nt, Vaccinia virus
aauccuuaaguucauaau

SEQ ID NO: 3277695 - RNA, 15 nt, Vaccinia virus
uauggagcaaacauu

SEQ ID NO: 3277696 - RNA, 18 nt, Vaccinia virus
uagacgaggaaacaaugc

SEQ ID NO: 3277697 - RNA, 21 nt, Vaccinia virus
uaucuucgauauaaaaucauu

SEQ ID NO: 3277698 - RNA, 20 nt, Vaccinia virus
ugaauuucgagauuaaaugc

SEQ ID NO: 3277699 - RNA, 22 nt, Vaccinia virus
guacuaaauucgauaucuuuuu

SEQ ID NO: 3277700 - RNA, 23 nt, Vaccinia virus
cacugggguaaaguaaguauuua

SEQ ID NO: 3277701 - RNA, 17 nt, Vaccinia virus
uauucuuaaauuucaua

SEQ ID NO: 3277702 - RNA, 18 nt, Vaccinia virus
ugaauugcgauuauaaga

SEQ ID NO: 3277703 - RNA, 14 nt, Vaccinia virus
uuguugcucccaug

SEQ ID NO: 3277704 - RNA, 19 nt, Vaccinia virus
uucuaucaucauaaucagu

SEQ ID NO: 3277705 - RNA, 20 nt, Vaccinia virus
uacuaucuggaucuacacau

SEQ ID NO: 3277706 - RNA, 15 nt, Vaccinia virus
auggauauauuaaag

SEQ ID NO: 3277707 - RNA, 13 nt, Vaccinia virus
ugugauauugaua

SEQ ID NO: 3277708 - RNA, 20 nt, Vaccinia virus
uuguacauuaauaaaugaaa

SEQ ID NO: 3277709 - RNA, 17 nt, Vaccinia virus
ucguaaaaagauucuug

SEQ ID NO: 3277710 - RNA, 16 nt, Vaccinia virus
gacaaguauaaugaca

SEQ ID NO: 3277711 - RNA, 15 nt, Vaccinia virus
aucuuugauauacua

SEQ ID NO: 3277712 - RNA, 23 nt, Vaccinia virus
uaaacuguuuguauaauaucucu

SEQ ID NO: 3277713 - RNA, 20 nt, Vaccinia virus
aaaaauugaauugaugauau

SEQ ID NO: 3277714 - RNA, 23 nt, Vaccinia virus
accaauauuggaauuauaauaua

SEQ ID NO: 3277715 - RNA, 12 nt, Vaccinia virus
augucuguuuga

SEQ ID NO: 3277716 - RNA, 19 nt, Vaccinia virus
acuagcauccccuuucaau

SEQ ID NO: 3277717 - RNA, 12 nt, Vaccinia virus
ugacauggaaau

SEQ ID NO: 3277718 - RNA, 23 nt, Vaccinia virus
aucaucuguaggaaauggaagau

SEQ ID NO: 3277719 - RNA, 15 nt, Vaccinia virus
uaaaucaacgucauc

SEQ ID NO: 3277720 - RNA, 13 nt, Vaccinia virus
aauaggaauaauu

SEQ ID NO: 3277721 - RNA, 20 nt, Vaccinia virus
aacaaaugcgccaaaguuau

SEQ ID NO: 3277722 - RNA, 22 nt, Vaccinia virus
uucucucauaaauacagagaug

SEQ ID NO: 3277723 - RNA, 15 nt, Vaccinia virus
aaauguugucauuau

SEQ ID NO: 3277724 - RNA, 24 nt, Vaccinia virus
uaucugaguaugaugauuuacaaa

SEQ ID NO: 3277725 - RNA, 15 nt, Vaccinia virus
augucaaaaaaagau

SEQ ID NO: 3277726 - RNA, 18 nt, Vaccinia virus
uguagcucucccagauuu

SEQ ID NO: 3277727 - RNA, 21 nt, Vaccinia virus
agauaugaauuugauaagacu

SEQ ID NO: 3277728 - RNA, 14 nt, Vaccinia virus
uuaauaauacuauu

SEQ ID NO: 3277729 - RNA, 22 nt, Vaccinia virus
aucuauuucaucguuuuguaua

SEQ ID NO: 3277730 - RNA, 16 nt, Vaccinia virus
guuuggauuaauaauu

SEQ ID NO: 3277731 - RNA, 13 nt, Vaccinia virus
cgauuagauggac

SEQ ID NO: 3277732 - RNA, 23 nt, Vaccinia virus
aauuuguauguuugggagaauua

SEQ ID NO: 3277733 - RNA, 20 nt, Vaccinia virus
uuacuaguuuuccaguguuc

SEQ ID NO: 3277734 - RNA, 16 nt, Vaccinia virus
uaugaucauuuugaua

SEQ ID NO: 3277735 - RNA, 18 nt, Vaccinia virus
gauaaaacaaguuuucau

SEQ ID NO: 3277736 - RNA, 16 nt, Vaccinia virus
caauauauguaaucau

SEQ ID NO: 3277737 - RNA, 22 nt, Vaccinia virus
auaggugcguuguauacacaua

SEQ ID NO: 3277738 - RNA, 23 nt, Vaccinia virus
uggaugcuauguuuauagauguu

SEQ ID NO: 3277739 - RNA, 23 nt, Vaccinia virus
aauuuauagaugcuggaagacaa

SEQ ID NO: 3277740 - RNA, 12 nt, Vaccinia virus
aggaaugagagu

SEQ ID NO: 3277741 - RNA, 18 nt, Vaccinia virus
cuucaucuaccaaagaaa

SEQ ID NO: 3277742 - RNA, 14 nt, Vaccinia virus
auuagacauaugau

SEQ ID NO: 3277743 - RNA, 19 nt, Vaccinia virus
acgaaguauuuauacuuuu

SEQ ID NO: 3277744 - RNA, 21 nt, Vaccinia virus
uaugauccacaaaacguauau

SEQ ID NO: 3277745 - RNA, 21 nt, Vaccinia virus
auacaaaugacuacguuguua

SEQ ID NO: 3277746 - RNA, 21 nt, Vaccinia virus
uuguuacccaugaucuauaaa

SEQ ID NO: 3277747 - RNA, 16 nt, Vaccinia virus
auacaauuaucauuuu

SEQ ID NO: 3277748 - RNA, 18 nt, Vaccinia virus
gauguaaauauauuuaca

SEQ ID NO: 3277749 - RNA, 15 nt, Vaccinia virus
acccaguuaguuuua

SEQ ID NO: 3277750 - RNA, 17 nt, Vaccinia virus
uaaauguuuaaacauca

SEQ ID NO: 3277751 - RNA, 13 nt, Vaccinia virus
auagaucauaucu

SEQ ID NO: 3277752 - RNA, 19 nt, Vaccinia virus
acguuucugucaacaaugu

SEQ ID NO: 3277753 - RNA, 17 nt, Vaccinia virus
uuuuguuugggaaacac

SEQ ID NO: 3277754 - RNA, 21 nt, Vaccinia virus
cuucuuuaaacgauuuuccaa

SEQ ID NO: 3277755 - RNA, 20 nt, Vaccinia virus
uaaaauuauugauauguaua

SEQ ID NO: 3277756 - RNA, 16 nt, Vaccinia virus
uuuaguccuauuucaa

SEQ ID NO: 3277757 - RNA, 16 nt, Vaccinia virus
aauaguacauuuucca

SEQ ID NO: 3277758 - RNA, 15 nt, Vaccinia virus
acgcugauaaauaua

SEQ ID NO: 3277759 - RNA, 20 nt, Vaccinia virus
aacuaguagaagguacgacu

SEQ ID NO: 3277760 - RNA, 18 nt, Vaccinia virus
ucuagccauaucuaaagc

SEQ ID NO: 3277761 - RNA, 13 nt, Vaccinia virus
uaguuaaauauua

SEQ ID NO: 3277762 - RNA, 11 nt, Vaccinia virus
ccaaacaaaau

SEQ ID NO: 3277763 - RNA, 19 nt, Vaccinia virus
gcaauaacuaaaaauguaa

SEQ ID NO: 3277764 - RNA, 19 nt, Vaccinia virus
uauauagguaauacauaua

SEQ ID NO: 3277765 - RNA, 17 nt, Vaccinia virus
aaaacauauauaauaaa

SEQ ID NO: 3277766 - RNA, 19 nt, Vaccinia virus
aaucagauagacuguuguu

SEQ ID NO: 3277767 - RNA, 14 nt, Vaccinia virus
aauaauuuacaaaa

SEQ ID NO: 3277768 - RNA, 15 nt, Vaccinia virus
uuguccuauauauca

SEQ ID NO: 3277769 - RNA, 17 nt, Vaccinia virus
gauuuaucauauuucuc

SEQ ID NO: 3277770 - RNA, 14 nt, Vaccinia virus
uuuuacucuauaaa

SEQ ID NO: 3277771 - RNA, 15 nt, Vaccinia virus
agauacuuuaauaca

SEQ ID NO: 3277772 - RNA, 18 nt, Vaccinia virus
uagcaaaggaaauugugc

SEQ ID NO: 3277773 - RNA, 19 nt, Vaccinia virus
ucugcguguaaaaaguugu

SEQ ID NO: 3277774 - RNA, 18 nt, Vaccinia virus
auacaauggaauacuuca

SEQ ID NO: 3277775 - RNA, 23 nt, Vaccinia virus
gucuaugucucuuauuagagauu

SEQ ID NO: 3277776 - RNA, 15 nt, Vaccinia virus
cuauauuaacaucua

SEQ ID NO: 3277777 - RNA, 13 nt, Vaccinia virus
cguaccagcauuu

SEQ ID NO: 3277778 - RNA, 13 nt, Vaccinia virus
auauccaaaauuu

SEQ ID NO: 3277779 - RNA, 21 nt, Vaccinia virus
cucagucaauauauuaagaag

SEQ ID NO: 3277780 - RNA, 21 nt, Vaccinia virus
agaugagcauaaacauaauaa

SEQ ID NO: 3277781 - RNA, 20 nt, Vaccinia virus
acuagauacaaaauuugcau

SEQ ID NO: 3277782 - RNA, 18 nt, Vaccinia virus
uaguuucaucauccauga

SEQ ID NO: 3277783 - RNA, 17 nt, Vaccinia virus
ugccauaucauacauga

SEQ ID NO: 3277784 - RNA, 14 nt, Vaccinia virus
aaucaaagaauugg

SEQ ID NO: 3277785 - RNA, 22 nt, Vaccinia virus
auguuguaauauuucacaugau

SEQ ID NO: 3277786 - RNA, 14 nt, Vaccinia virus
uacggaaagaacca

SEQ ID NO: 3277787 - RNA, 23 nt, Vaccinia virus
uacauacagguacgaaauacgua

SEQ ID NO: 3277788 - RNA, 14 nt, Vaccinia virus
uaccacuagcaaaa

SEQ ID NO: 3277789 - RNA, 19 nt, Vaccinia virus
ggaacauuaaauguauuuu

SEQ ID NO: 3277790 - RNA, 14 nt, Vaccinia virus
cauacuauuguuua

SEQ ID NO: 3277791 - RNA, 19 nt, Vaccinia virus
ccuaacgaugauauguuuu

SEQ ID NO: 3277792 - RNA, 18 nt, Vaccinia virus
aauauaaaagaauaugua

SEQ ID NO: 3277793 - RNA, 22 nt, Vaccinia virus
acgaggaaacaaugcgcuacau

SEQ ID NO: 3277794 - RNA, 17 nt, Vaccinia virus
acgcugaaguaauuaau

SEQ ID NO: 3277795 - RNA, 18 nt, Vaccinia virus
uaaucagaaaacuuauaa

SEQ ID NO: 3277796 - RNA, 15 nt, Vaccinia virus
uaucaaacacauaua

SEQ ID NO: 3277797 - RNA, 12 nt, Vaccinia virus
acaaaaugugau

SEQ ID NO: 3277798 - RNA, 22 nt, Vaccinia virus
uacgauauuauuacacauaaac

SEQ ID NO: 3277799 - RNA, 19 nt, Vaccinia virus
ccugccauaaauaaaugcu

SEQ ID NO: 3277800 - RNA, 20 nt, Vaccinia virus
ugauuaguauaacuagauuu

SEQ ID NO: 3277801 - RNA, 22 nt, Vaccinia virus
agagcuacuaacguauaauucu

SEQ ID NO: 3277802 - RNA, 18 nt, Vaccinia virus
ucaaaaaaagauuauucg

SEQ ID NO: 3277803 - RNA, 23 nt, Vaccinia virus
uuaaacguaguuaugauaaauga

SEQ ID NO: 3277804 - RNA, 17 nt, Vaccinia virus
agcuaucaagucuuuau

SEQ ID NO: 3277805 - RNA, 14 nt, Vaccinia virus
acucuaaaucgcuu

SEQ ID NO: 3277806 - RNA, 13 nt, Vaccinia virus
uguagauaucuuu

SEQ ID NO: 3277807 - RNA, 17 nt, Vaccinia virus
aauagugccaucagaau

SEQ ID NO: 3277808 - RNA, 19 nt, Vaccinia virus
aucaacggagauauaaaug

SEQ ID NO: 3277809 - RNA, 18 nt, Vaccinia virus
aauauagaaauaaugaua

SEQ ID NO: 3277810 - RNA, 24 nt, Vaccinia virus
auaaaccucuggcacuuauuucau

SEQ ID NO: 3277811 - RNA, 17 nt, Vaccinia virus
gaaaaugcgauguugau

SEQ ID NO: 3277812 - RNA, 16 nt, Vaccinia virus
cacuauguuagcauuu

SEQ ID NO: 3277813 - RNA, 17 nt, Vaccinia virus
uaaaauaaaaauccauu

SEQ ID NO: 3277814 - RNA, 19 nt, Vaccinia virus
auuauaucacaacaucuau

SEQ ID NO: 3277815 - RNA, 17 nt, Vaccinia virus
auuaguugaugugacug

SEQ ID NO: 3277816 - RNA, 21 nt, Vaccinia virus
auaauguuauuacuuguggua

SEQ ID NO: 3277817 - RNA, 12 nt, Vaccinia virus
uuucuacauaau

SEQ ID NO: 3277818 - RNA, 15 nt, Vaccinia virus
cuuuaacguauaaau

SEQ ID NO: 3277819 - RNA, 17 nt, Vaccinia virus
caagaguaacuauugac

SEQ ID NO: 3277820 - RNA, 17 nt, Vaccinia virus
augcauuuuuauauaca

SEQ ID NO: 3277821 - RNA, 16 nt, Vaccinia virus
ucaucaacuagacguu

SEQ ID NO: 3277822 - RNA, 16 nt, Vaccinia virus
auuuacaccaauagug

SEQ ID NO: 3277823 - RNA, 23 nt, Vaccinia virus
augauucucucaacaucuucaau

SEQ ID NO: 3277824 - RNA, 19 nt, Vaccinia virus
auguauuuccuagcacauc

SEQ ID NO: 3277825 - RNA, 15 nt, Vaccinia virus
auuuuuuuucaucuc

SEQ ID NO: 3277826 - RNA, 13 nt, Vaccinia virus
aacauguuccauu

SEQ ID NO: 3277827 - RNA, 19 nt, Vaccinia virus
aaucauauaaaaaaugauu

SEQ ID NO: 3277828 - RNA, 19 nt, Vaccinia virus
uaauaaauugguaaauccu

SEQ ID NO: 3277829 - RNA, 16 nt, Vaccinia virus
uagaauuucauuuugu

SEQ ID NO: 3277830 - RNA, 19 nt, Vaccinia virus
uguaucauccaguuuucca

SEQ ID NO: 3277831 - RNA, 14 nt, Vaccinia virus
auauugcuacauaa

SEQ ID NO: 3277832 - RNA, 23 nt, Vaccinia virus
acaucggugagugauaugccuau

SEQ ID NO: 3277833 - RNA, 23 nt, Vaccinia virus
aauaugaguuggaguugauucau

SEQ ID NO: 3277834 - RNA, 22 nt, Vaccinia virus
aauaguauuugagaaauaugua

SEQ ID NO: 3277835 - RNA, 13 nt, Vaccinia virus
acuaaauacauua

SEQ ID NO: 3277836 - RNA, 22 nt, Vaccinia virus
caauuauacguuuuuauauaau

SEQ ID NO: 3277837 - RNA, 18 nt, Vaccinia virus
acuuuccaacuuaucauu

SEQ ID NO: 3277838 - RNA, 14 nt, Vaccinia virus
auauguuccaguaa

SEQ ID NO: 3277839 - RNA, 18 nt, Vaccinia virus
gucgauaaaaauuaaaaa

SEQ ID NO: 3277840 - RNA, 20 nt, Vaccinia virus
uaauacagcaucuaacuuga

SEQ ID NO: 3277841 - RNA, 11 nt, Vaccinia virus
uguuuaagaua

SEQ ID NO: 3277842 - RNA, 14 nt, Vaccinia virus
uuuacuggaauuag

SEQ ID NO: 3277843 - RNA, 16 nt, Vaccinia virus
ucauauaggaaacuau

SEQ ID NO: 3277844 - RNA, 13 nt, Vaccinia virus
agaaaucauauau

SEQ ID NO: 3277845 - RNA, 16 nt, Vaccinia virus
uacaucuguuuccuau

SEQ ID NO: 3277846 - RNA, 16 nt, Vaccinia virus
aaaaaguuuucccaua

SEQ ID NO: 3277847 - RNA, 21 nt, Vaccinia virus
cuaauguauagauuguuuuca

SEQ ID NO: 3277848 - RNA, 15 nt, Vaccinia virus
aacgacgcauuaucu

SEQ ID NO: 3277849 - RNA, 22 nt, Vaccinia virus
uauguaaaacaaacuuguaauu

SEQ ID NO: 3277850 - RNA, 18 nt, Vaccinia virus
uucaucgcuuucuagaau

SEQ ID NO: 3277851 - RNA, 20 nt, Vaccinia virus
uguaaucgguguccaccugg

SEQ ID NO: 3277852 - RNA, 16 nt, Vaccinia virus
uguuauuacuacugaa

SEQ ID NO: 3277853 - RNA, 17 nt, Vaccinia virus
uagaagauaucauaaau

SEQ ID NO: 3277854 - RNA, 16 nt, Vaccinia virus
acuaugucaaaaauug

SEQ ID NO: 3277855 - RNA, 17 nt, Vaccinia virus
caauuaguuuauuggua

SEQ ID NO: 3277856 - RNA, 19 nt, Vaccinia virus
uaguucucuuuuguagaac

SEQ ID NO: 3277857 - RNA, 18 nt, Vaccinia virus
ucaaaaauauucauuaau

SEQ ID NO: 3277858 - RNA, 19 nt, Vaccinia virus
auuuaccgaacaggcauuu

SEQ ID NO: 3277859 - RNA, 18 nt, Vaccinia virus
aguaugacuuacuuguau

SEQ ID NO: 3277860 - RNA, 20 nt, Vaccinia virus
auuaccggucauauuaauaa

SEQ ID NO: 3277861 - RNA, 16 nt, Vaccinia virus
ucauuucacaauucau

SEQ ID NO: 3277862 - RNA, 15 nt, Vaccinia virus
uuacuagauuaaaaa

SEQ ID NO: 3277863 - RNA, 16 nt, Vaccinia virus
gccagagauaauuucu

SEQ ID NO: 3277864 - RNA, 15 nt, Vaccinia virus
auuuuacuuuaauaa

SEQ ID NO: 3277865 - RNA, 16 nt, Vaccinia virus
gauaauuaauaauaua

SEQ ID NO: 3277866 - RNA, 15 nt, Vaccinia virus
aaaaucgauaaacug

SEQ ID NO: 3277867 - RNA, 14 nt, Vaccinia virus
uugaaccaaacauu

SEQ ID NO: 3277868 - RNA, 19 nt, Vaccinia virus
ugucuguaucauauucaac

SEQ ID NO: 3277869 - RNA, 21 nt, Vaccinia virus
aauccaaaguucauucucaga

SEQ ID NO: 3277870 - RNA, 21 nt, Vaccinia virus
agaucuacuggcgaaauggua

SEQ ID NO: 3277871 - RNA, 15 nt, Vaccinia virus
acaaugaaaauggau

SEQ ID NO: 3277872 - RNA, 16 nt, Vaccinia virus
acauauuuuaaugaac

SEQ ID NO: 3277873 - RNA, 15 nt, Vaccinia virus
aacauaaucaaggau

SEQ ID NO: 3277874 - RNA, 16 nt, Vaccinia virus
uacugcuauacagaug

SEQ ID NO: 3277875 - RNA, 22 nt, Vaccinia virus
gcaauaacaaagauucuuccuc

SEQ ID NO: 3277876 - RNA, 14 nt, Vaccinia virus
uaucuacuagauag

SEQ ID NO: 3277877 - RNA, 18 nt, Vaccinia virus
acguuguacguuaaagca

SEQ ID NO: 3277878 - RNA, 17 nt, Vaccinia virus
auuaauaucuauuaaac

SEQ ID NO: 3277879 - RNA, 14 nt, Vaccinia virus
uaucaauagcaguu

SEQ ID NO: 3277880 - RNA, 15 nt, Vaccinia virus
uuucgaauacuuauu

SEQ ID NO: 3277881 - RNA, 23 nt, Vaccinia virus
acguuucauuuuuugucuauaau

SEQ ID NO: 3277882 - RNA, 23 nt, Vaccinia virus
cuacaaugaacuaagagaaaucu

SEQ ID NO: 3277883 - RNA, 21 nt, Vaccinia virus
auaaucaccauacuagaguuu

SEQ ID NO: 3277884 - RNA, 18 nt, Vaccinia virus
gaacuggaccguauaucu

SEQ ID NO: 3277885 - RNA, 13 nt, Vaccinia virus
gaaacugauacaa

SEQ ID NO: 3277886 - RNA, 19 nt, Vaccinia virus
acaaugaaccguaauauau

SEQ ID NO: 3277887 - RNA, 15 nt, Vaccinia virus
agccggacaaauaua

SEQ ID NO: 3277888 - RNA, 22 nt, Vaccinia virus
aacagaauaaacaaaauaaugu

SEQ ID NO: 3277889 - RNA, 23 nt, Vaccinia virus
aauagaaugcucuuaaauaaugu

SEQ ID NO: 3277890 - RNA, 19 nt, Vaccinia virus
uuauguaguaaagaugcua

SEQ ID NO: 3277891 - RNA, 22 nt, Vaccinia virus
cagaaauugguauaaauguugu

SEQ ID NO: 3277892 - RNA, 20 nt, Vaccinia virus
gaaacuaugucaaaaauugu

SEQ ID NO: 3277893 - RNA, 17 nt, Vaccinia virus
ucuuucuaauacuauau

SEQ ID NO: 3277894 - RNA, 17 nt, Vaccinia virus
aaugccuuuacagugga

SEQ ID NO: 3277895 - RNA, 14 nt, Vaccinia virus
uucuauucuagaaa

SEQ ID NO: 3277896 - RNA, 14 nt, Vaccinia virus
uaucaaaacauaua

SEQ ID NO: 3277897 - RNA, 12 nt, Vaccinia virus
uguaguaguaua

SEQ ID NO: 3277898 - RNA, 17 nt, Vaccinia virus
gaguagggauucaucau

SEQ ID NO: 3277899 - RNA, 16 nt, Vaccinia virus
agcuaucaaaauaugu

SEQ ID NO: 3277900 - RNA, 17 nt, Vaccinia virus
acuaaaaauaaacauug

SEQ ID NO: 3277901 - RNA, 13 nt, Vaccinia virus
ucauauagauauu

SEQ ID NO: 3277902 - RNA, 16 nt, Vaccinia virus
ugauacaccuguaauc

SEQ ID NO: 3277903 - RNA, 21 nt, Vaccinia virus
aucucuuuuucucaaauccau

SEQ ID NO: 3277904 - RNA, 20 nt, Vaccinia virus
acuuauggacaacagaggau

SEQ ID NO: 3277905 - RNA, 21 nt, Vaccinia virus
ugaagauggauucauccuuaa

SEQ ID NO: 3277906 - RNA, 15 nt, Vaccinia virus
uaguaucuaaacauu

SEQ ID NO: 3277907 - RNA, 22 nt, Vaccinia virus
acuugaaauaaucggagaaugu

SEQ ID NO: 3277908 - RNA, 15 nt, Vaccinia virus
aaauuagaucaaaga

SEQ ID NO: 3277909 - RNA, 23 nt, Vaccinia virus
acuagaguaguauauugucacau

SEQ ID NO: 3277910 - RNA, 18 nt, Vaccinia virus
aauaaauagauauaaaau

SEQ ID NO: 3277911 - RNA, 19 nt, Vaccinia virus
auaaauucaaccaugaauu

SEQ ID NO: 3277912 - RNA, 17 nt, Vaccinia virus
auccaaucuaagaaauu

SEQ ID NO: 3277913 - RNA, 15 nt, Vaccinia virus
cauuacuacuguaaa

SEQ ID NO: 3277914 - RNA, 12 nt, Vaccinia virus
cuucagaauaau

SEQ ID NO: 3277915 - RNA, 22 nt, Vaccinia virus
gaacucuaaucaaaaucuuaau

SEQ ID NO: 3277916 - RNA, 23 nt, Vaccinia virus
auaaaaagacuuuuauaauucau

SEQ ID NO: 3277917 - RNA, 19 nt, Vaccinia virus
gaugucaaaggaugaaaga

SEQ ID NO: 3277918 - RNA, 18 nt, Vaccinia virus
caauuauacuagaacuau

SEQ ID NO: 3277919 - RNA, 16 nt, Vaccinia virus
gaaucggauaguuuaa

SEQ ID NO: 3277920 - RNA, 22 nt, Vaccinia virus
uuucauuccaggaucuagauaa

SEQ ID NO: 3277921 - RNA, 20 nt, Vaccinia virus
gaaagaaucaaaagaaugau

SEQ ID NO: 3277922 - RNA, 22 nt, Vaccinia virus
aacgauuuuccaaaucaguaac

SEQ ID NO: 3277923 - RNA, 18 nt, Vaccinia virus
caagagugcauugacuuu

SEQ ID NO: 3277924 - RNA, 13 nt, Vaccinia virus
guaguaacucuaa

SEQ ID NO: 3277925 - RNA, 21 nt, Vaccinia virus
aggauaucucaaaaaauaaua

SEQ ID NO: 3277926 - RNA, 22 nt, Vaccinia virus
accaguucauucaagauaagca

SEQ ID NO: 3277927 - RNA, 22 nt, Vaccinia virus
ucauucaaauccauaaauaaag

SEQ ID NO: 3277928 - RNA, 22 nt, Vaccinia virus
auacuagaguuguuaaaguuaa

SEQ ID NO: 3277929 - RNA, 18 nt, Vaccinia virus
uaaagaugacgaugaaaa

SEQ ID NO: 3277930 - RNA, 19 nt, Vaccinia virus
gaaauagcucguuucuauu

SEQ ID NO: 3277931 - RNA, 22 nt, Vaccinia virus
ucuuaauagacacaucugccau

SEQ ID NO: 3277932 - RNA, 21 nt, Vaccinia virus
agacuaggugcuauggauggg

SEQ ID NO: 3277933 - RNA, 18 nt, Vaccinia virus
uacuaaugacaauaauua

SEQ ID NO: 3277934 - RNA, 14 nt, Vaccinia virus
agaaauuaauagaa

SEQ ID NO: 3277935 - RNA, 21 nt, Vaccinia virus
ucagcaucugguacaauaaau

SEQ ID NO: 3277936 - RNA, 22 nt, Vaccinia virus
gaauagucucuguaaucacugc

SEQ ID NO: 3277937 - RNA, 12 nt, Vaccinia virus
gaaucuauuuua

SEQ ID NO: 3277938 - RNA, 16 nt, Vaccinia virus
aucggaugauauuaau

SEQ ID NO: 3277939 - RNA, 21 nt, Vaccinia virus
uuucagcguggauuucucaua

SEQ ID NO: 3277940 - RNA, 14 nt, Vaccinia virus
auaaaauggauaac

SEQ ID NO: 3277941 - RNA, 14 nt, Vaccinia virus
ucaauaauucuauu

SEQ ID NO: 3277942 - RNA, 18 nt, Vaccinia virus
auaauuguacuuuguaau

SEQ ID NO: 3277943 - RNA, 18 nt, Vaccinia virus
gccaaaaugauagauauu

SEQ ID NO: 3277944 - RNA, 14 nt, Vaccinia virus
auagaaauauauau

SEQ ID NO: 3277945 - RNA, 17 nt, Vaccinia virus
ugacuagacugauuucu

SEQ ID NO: 3277946 - RNA, 18 nt, Vaccinia virus
ucugauccguauccauga

SEQ ID NO: 3277947 - RNA, 13 nt, Vaccinia virus
agaucaaggaaau

SEQ ID NO: 3277948 - RNA, 20 nt, Vaccinia virus
ucgacuauuuuaaauagcau

SEQ ID NO: 3277949 - RNA, 20 nt, Vaccinia virus
uuuaucgaccaagacacaua

SEQ ID NO: 3277950 - RNA, 14 nt, Vaccinia virus
cggcacauauuaau

SEQ ID NO: 3277951 - RNA, 23 nt, Vaccinia virus
auuuuuauuaaugauacaaaaac

SEQ ID NO: 3277952 - RNA, 16 nt, Vaccinia virus
uaaauuccuuaauauu

SEQ ID NO: 3277953 - RNA, 15 nt, Vaccinia virus
caaucaaacaaaaaa

SEQ ID NO: 3277954 - RNA, 17 nt, Vaccinia virus
aauuucaauauugaaaa

SEQ ID NO: 3277955 - RNA, 21 nt, Vaccinia virus
uauauaggccgaaucuaugau

SEQ ID NO: 3277956 - RNA, 16 nt, Vaccinia virus
uaaaaacucauuacau

SEQ ID NO: 3277957 - RNA, 20 nt, Vaccinia virus
aacacuauacucauauuaau

SEQ ID NO: 3277958 - RNA, 17 nt, Vaccinia virus
acaauuuauucagagag

SEQ ID NO: 3277959 - RNA, 15 nt, Vaccinia virus
auaaguauuaucaaa

SEQ ID NO: 3277960 - RNA, 16 nt, Vaccinia virus
caauacggccauccag

SEQ ID NO: 3277961 - RNA, 15 nt, Vaccinia virus
acaaaaucaaauaau

SEQ ID NO: 3277962 - RNA, 18 nt, Vaccinia virus
agaaucuauuuuaaugag

SEQ ID NO: 3277963 - RNA, 16 nt, Vaccinia virus
uaacgaggaagaaauu

SEQ ID NO: 3277964 - RNA, 17 nt, Vaccinia virus
cauuaucuauaucaucu

SEQ ID NO: 3277965 - RNA, 20 nt, Vaccinia virus
aucaauaauuguuuugaauu

SEQ ID NO: 3277966 - RNA, 17 nt, Vaccinia virus
agucuacugcuagaaaa

SEQ ID NO: 3277967 - RNA, 18 nt, Vaccinia virus
ugugauauugauaucuuu

SEQ ID NO: 3277968 - RNA, 16 nt, Vaccinia virus
aaguaugaugucuaug

SEQ ID NO: 3277969 - RNA, 19 nt, Vaccinia virus
cuggaauuaguuagauaua

SEQ ID NO: 3277970 - RNA, 23 nt, Vaccinia virus
uuuggagaaaugagaaacuguuu

SEQ ID NO: 3277971 - RNA, 19 nt, Vaccinia virus
uauccauaucucuagauac

SEQ ID NO: 3277972 - RNA, 21 nt, Vaccinia virus
auaauucuacacggcaugguu

SEQ ID NO: 3277973 - RNA, 16 nt, Vaccinia virus
auuuggucauaauaga

SEQ ID NO: 3277974 - RNA, 22 nt, Vaccinia virus
gagcauacaguaagcauagaua

SEQ ID NO: 3277975 - RNA, 19 nt, Vaccinia virus
gaagauucccaaauaauca

SEQ ID NO: 3277976 - RNA, 16 nt, Vaccinia virus
uacagaaacaaugauu

SEQ ID NO: 3277977 - RNA, 15 nt, Vaccinia virus
uauauuaauacacau

SEQ ID NO: 3277978 - RNA, 13 nt, Vaccinia virus
uuucaucgaugau

SEQ ID NO: 3277979 - RNA, 18 nt, Vaccinia virus
guaauaacagugcuauca

SEQ ID NO: 3277980 - RNA, 15 nt, Vaccinia virus
uugaaccauguaugc

SEQ ID NO: 3277981 - RNA, 18 nt, Vaccinia virus
aaauaggaucaucuauca

SEQ ID NO: 3277982 - RNA, 17 nt, Vaccinia virus
guauuaucagauaucca

SEQ ID NO: 3277983 - RNA, 14 nt, Vaccinia virus
acuccuugacuauc

SEQ ID NO: 3277984 - RNA, 16 nt, Vaccinia virus
cuucgcuuuauauacc

SEQ ID NO: 3277985 - RNA, 21 nt, Vaccinia virus
aaaucauaauaugagauguuu

SEQ ID NO: 3277986 - RNA, 13 nt, Vaccinia virus
aggucgcaaaaaa

SEQ ID NO: 3277987 - RNA, 13 nt, Vaccinia virus
gcgaguguuacaa

SEQ ID NO: 3277988 - RNA, 14 nt, Vaccinia virus
aaugcaaauuacuu

SEQ ID NO: 3277989 - RNA, 12 nt, Vaccinia virus
acgcaaugguuu

SEQ ID NO: 3277990 - RNA, 15 nt, Vaccinia virus
uauuauauaaacauu

SEQ ID NO: 3277991 - RNA, 19 nt, Vaccinia virus
aguccuaguuguauacuga

SEQ ID NO: 3277992 - RNA, 14 nt, Vaccinia virus
aacggaugaaaaua

SEQ ID NO: 3277993 - RNA, 12 nt, Vaccinia virus
acacuaauuaaa

SEQ ID NO: 3277994 - RNA, 19 nt, Vaccinia virus
uagagaauuaauaucuauu

SEQ ID NO: 3277995 - RNA, 19 nt, Vaccinia virus
uggcaaacaauguauacaa

SEQ ID NO: 3277996 - RNA, 14 nt, Vaccinia virus
agaaucuguuauau

SEQ ID NO: 3277997 - RNA, 18 nt, Vaccinia virus
acauuuuggcaaauugau

SEQ ID NO: 3277998 - RNA, 17 nt, Vaccinia virus
cauagaaaguuaaaagu

SEQ ID NO: 3277999 - RNA, 17 nt, Vaccinia virus
auccucagucaucuugu

SEQ ID NO: 3278000 - RNA, 17 nt, Vaccinia virus
gcaaauacgauagucua

SEQ ID NO: 3278001 - RNA, 16 nt, Vaccinia virus
uaaucaaaaucuuaau

SEQ ID NO: 3278002 - RNA, 17 nt, Vaccinia virus
aauuuuaagaaauggug

SEQ ID NO: 3278003 - RNA, 22 nt, Vaccinia virus
uggaugaggaaugagagugaua

SEQ ID NO: 3278004 - RNA, 14 nt, Vaccinia virus
augauauuguugau

SEQ ID NO: 3278005 - RNA, 16 nt, Vaccinia virus
guccauuaucaguaau

SEQ ID NO: 3278006 - RNA, 22 nt, Vaccinia virus
aucguauuugugugauggauuu

SEQ ID NO: 3278007 - RNA, 13 nt, Vaccinia virus
uuaccauguauga

SEQ ID NO: 3278008 - RNA, 17 nt, Vaccinia virus
uaauucguauucuugga

SEQ ID NO: 3278009 - RNA, 19 nt, Vaccinia virus
caacauccuccagagaaga

SEQ ID NO: 3278010 - RNA, 20 nt, Vaccinia virus
cagcuaucgcuuacgcauuu

SEQ ID NO: 3278011 - RNA, 14 nt, Vaccinia virus
ugaggaaauugaua

SEQ ID NO: 3278012 - RNA, 20 nt, Vaccinia virus
auuuuauaccgaauaagaga

SEQ ID NO: 3278013 - RNA, 15 nt, Vaccinia virus
auuuaguuuaucuua

SEQ ID NO: 3278014 - RNA, 19 nt, Vaccinia virus
auaauacuggagaacuuau

SEQ ID NO: 3278015 - RNA, 23 nt, Vaccinia virus
auguauaauuugguaaugguuuc

SEQ ID NO: 3278016 - RNA, 15 nt, Vaccinia virus
aucauaucacauagu

SEQ ID NO: 3278017 - RNA, 13 nt, Vaccinia virus
aggaaaaaagaua

SEQ ID NO: 3278018 - RNA, 13 nt, Vaccinia virus
uaaugaacucauu

SEQ ID NO: 3278019 - RNA, 21 nt, Vaccinia virus
guuucuuagcuugugauuuuu

SEQ ID NO: 3278020 - RNA, 22 nt, Vaccinia virus
uuacuauguuguuuaugucuuu

SEQ ID NO: 3278021 - RNA, 15 nt, Vaccinia virus
aucuagucuuaaaug
